United States Patent 7,888,497 (BIOINFORMATICALLY DETECTABLE GROUP OF NOVEL REGULATORY OLIGONUCLEOTIDES AND USES THEREOF) - sequence listing, part 133

SEQ ID NO: 5638521 - DNA, 23 bp, Homo sapiens
tatactaccatagtgagccatga

SEQ ID NO: 5638522 - DNA, 17 bp, Homo sapiens
tatactaccctgggctc

SEQ ID NO: 5638523 - DNA, 20 bp, Homo sapiens
tatactatagtaccagtagg

SEQ ID NO: 5638524 - DNA, 13 bp, Homo sapiens
tatactatatgaa

SEQ ID NO: 5638525 - DNA, 16 bp, Homo sapiens
tatactatatgaaaag

SEQ ID NO: 5638526 - DNA, 14 bp, Homo sapiens
tatactatattaac

SEQ ID NO: 5638527 - DNA, 16 bp, Homo sapiens
tatactatatttatgg

SEQ ID NO: 5638528 - DNA, 13 bp, Homo sapiens
tatactatgaaat

SEQ ID NO: 5638529 - DNA, 23 bp, Homo sapiens
tatactatttattaaaaccattc

SEQ ID NO: 5638530 - DNA, 23 bp, Homo sapiens
tatactcagggattccttctaag

SEQ ID NO: 5638531 - DNA, 13 bp, Homo sapiens
tatactcatttgg

SEQ ID NO: 5638532 - DNA, 15 bp, Homo sapiens
tatactcatttggat

SEQ ID NO: 5638533 - DNA, 18 bp, Homo sapiens
tatactccagtgtacata

SEQ ID NO: 5638534 - DNA, 16 bp, Homo sapiens
tatactccatacataa

SEQ ID NO: 5638535 - DNA, 20 bp, Homo sapiens
tatactccttaaaaatgtat

SEQ ID NO: 5638536 - DNA, 14 bp, Homo sapiens
tatactctcccaga

SEQ ID NO: 5638537 - DNA, 17 bp, Homo sapiens
tatactctctgaaatat

SEQ ID NO: 5638538 - DNA, 14 bp, Homo sapiens
tatactctcttccc

SEQ ID NO: 5638539 - DNA, 23 bp, Homo sapiens
tatactcttgaattcctctcaaa

SEQ ID NO: 5638540 - DNA, 22 bp, Homo sapiens
tatactctttctgtatatactt

SEQ ID NO: 5638541 - DNA, 12 bp, Homo sapiens
tatactgaagga

SEQ ID NO: 5638542 - DNA, 23 bp, Homo sapiens
tatactgatcttcattaccaata

SEQ ID NO: 5638543 - DNA, 15 bp, Homo sapiens
tatactgatttaatt

SEQ ID NO: 5638544 - DNA, 12 bp, Homo sapiens
tatactgcatac

SEQ ID NO: 5638545 - DNA, 16 bp, Homo sapiens
tatactgcatactttt

SEQ ID NO: 5638546 - DNA, 22 bp, Homo sapiens
tatactgcatatcctggtgtct

SEQ ID NO: 5638547 - DNA, 16 bp, Homo sapiens
tatactgctatttaca

SEQ ID NO: 5638548 - DNA, 18 bp, Homo sapiens
tatactgctctataaata

SEQ ID NO: 5638549 - DNA, 16 bp, Homo sapiens
tatactggagaagtct

SEQ ID NO: 5638550 - DNA, 16 bp, Homo sapiens
tatactgggttcttgt

SEQ ID NO: 5638551 - DNA, 15 bp, Homo sapiens
tatactgggtttcaa

SEQ ID NO: 5638552 - DNA, 24 bp, Homo sapiens
tatactggttatagttgatatgta

SEQ ID NO: 5638553 - DNA, 20 bp, Homo sapiens
tatactgtaaaagttataat

SEQ ID NO: 5638554 - DNA, 12 bp, Homo sapiens
tatactgtaaag

SEQ ID NO: 5638555 - DNA, 14 bp, Homo sapiens
tatactgtaaagaa

SEQ ID NO: 5638556 - DNA, 15 bp, Homo sapiens
tatactgtaaagaaa

SEQ ID NO: 5638557 - DNA, 11 bp, Homo sapiens
tatactgtaat

SEQ ID NO: 5638558 - DNA, 15 bp, Homo sapiens
tatactgtaatttag

SEQ ID NO: 5638559 - DNA, 15 bp, Homo sapiens
tatactgtacaataa

SEQ ID NO: 5638560 - DNA, 13 bp, Homo sapiens
tatactgtacatg

SEQ ID NO: 5638561 - DNA, 13 bp, Homo sapiens
tatactgtagcaa

SEQ ID NO: 5638562 - DNA, 21 bp, Homo sapiens
tatactgtagcaatatatttg

SEQ ID NO: 5638563 - DNA, 13 bp, Homo sapiens
tatactgtaggtg

SEQ ID NO: 5638564 - DNA, 18 bp, Homo sapiens
tatactgtaggtgttatg

SEQ ID NO: 5638565 - DNA, 18 bp, Homo sapiens
tatactgtgtcatggtga

SEQ ID NO: 5638566 - DNA, 19 bp, Homo sapiens
tatactgtgtcatggtgat

SEQ ID NO: 5638567 - DNA, 17 bp, Homo sapiens
tatactgttatccatat

SEQ ID NO: 5638568 - DNA, 16 bp, Homo sapiens
tatactgtttgtaata

SEQ ID NO: 5638569 - DNA, 19 bp, Homo sapiens
tatactgtttgtaatatac

SEQ ID NO: 5638570 - DNA, 21 bp, Homo sapiens
tatacttaaaaaatcctgccc

SEQ ID NO: 5638571 - DNA, 22 bp, Homo sapiens
tatacttaaaaaatcctgccca

SEQ ID NO: 5638572 - DNA, 16 bp, Homo sapiens
tatacttaaaatgaca

SEQ ID NO: 5638573 - DNA, 15 bp, Homo sapiens
tatacttaaacagct

SEQ ID NO: 5638574 - DNA, 17 bp, Homo sapiens
tatacttaaacagcttt

SEQ ID NO: 5638575 - DNA, 18 bp, Homo sapiens
tatacttaaacagctttt

SEQ ID NO: 5638576 - DNA, 14 bp, Homo sapiens
tatacttaataaaa

SEQ ID NO: 5638577 - DNA, 16 bp, Homo sapiens
tatacttaataaaaca

SEQ ID NO: 5638578 - DNA, 18 bp, Homo sapiens
tatacttaataaaacatt

SEQ ID NO: 5638579 - DNA, 16 bp, Homo sapiens
tatacttaatctaaga

SEQ ID NO: 5638580 - DNA, 17 bp, Homo sapiens
tatacttatcacatttt

SEQ ID NO: 5638581 - DNA, 12 bp, Homo sapiens
tatacttcaaaa

SEQ ID NO: 5638582 - DNA, 13 bp, Homo sapiens
tatacttcaaatg

SEQ ID NO: 5638583 - DNA, 15 bp, Homo sapiens
tatacttcacactga

SEQ ID NO: 5638584 - DNA, 20 bp, Homo sapiens
tatacttcacactgaactca

SEQ ID NO: 5638585 - DNA, 21 bp, Homo sapiens
tatacttccttacttttaagg

SEQ ID NO: 5638586 - DNA, 13 bp, Homo sapiens
tatacttgaacaa

SEQ ID NO: 5638587 - DNA, 13 bp, Homo sapiens
tatacttgactct

SEQ ID NO: 5638588 - DNA, 20 bp, Homo sapiens
tatacttgactctaatatga

SEQ ID NO: 5638589 - DNA, 23 bp, Homo sapiens
tatacttgctttgtgttctttgt

SEQ ID NO: 5638590 - DNA, 19 bp, Homo sapiens
tatatcagaatctgtgtga

SEQ ID NO: 5638591 - DNA, 15 bp, Homo sapiens
tatatcagcctgagt

SEQ ID NO: 5638592 - DNA, 11 bp, Homo sapiens
tatatcagctc

SEQ ID NO: 5638593 - DNA, 17 bp, Homo sapiens
tatatcaggtgtataaa

SEQ ID NO: 5638594 - DNA, 23 bp, Homo sapiens
tatatcaggtgtataaatgtaca

SEQ ID NO: 5638595 - DNA, 16 bp, Homo sapiens
tatatcagtacctctc

SEQ ID NO: 5638596 - DNA, 14 bp, Homo sapiens
tatatcataaagta

SEQ ID NO: 5638597 - DNA, 14 bp, Homo sapiens
tatatcataactta

SEQ ID NO: 5638598 - DNA, 17 bp, Homo sapiens
tatatcatacagttttc

SEQ ID NO: 5638599 - DNA, 20 bp, Homo sapiens
tatatcatacagttttcatt

SEQ ID NO: 5638600 - DNA, 21 bp, Homo sapiens
tatatcatacattgttttcaa

SEQ ID NO: 5638601 - DNA, 14 bp, Homo sapiens
tatatcatatttct

SEQ ID NO: 5638602 - DNA, 19 bp, Homo sapiens
tatatcatatttctgtgga

SEQ ID NO: 5638603 - DNA, 17 bp, Homo sapiens
tatatcatgaagccttg

SEQ ID NO: 5638604 - DNA, 14 bp, Homo sapiens
tatatcatgcaaaa

SEQ ID NO: 5638605 - DNA, 19 bp, Homo sapiens
tatatcatgtaaagaaatg

SEQ ID NO: 5638606 - DNA, 15 bp, Homo sapiens
tatatcattctacag

SEQ ID NO: 5638607 - DNA, 22 bp, Homo sapiens
tatatcattggaacaactgata

SEQ ID NO: 5638608 - DNA, 17 bp, Homo sapiens
tatatccagttcctgct

SEQ ID NO: 5638609 - DNA, 22 bp, Homo sapiens
tatatccagttcctgctctctg

SEQ ID NO: 5638610 - DNA, 21 bp, Homo sapiens
tatatccatgatcacacagct

SEQ ID NO: 5638611 - DNA, 16 bp, Homo sapiens
tatatccatgtactgt

SEQ ID NO: 5638612 - DNA, 19 bp, Homo sapiens
tatatccctgataaatatt

SEQ ID NO: 5638613 - DNA, 15 bp, Homo sapiens
tatatcctgtgtacc

SEQ ID NO: 5638614 - DNA, 16 bp, Homo sapiens
tatatcctgtttgtat

SEQ ID NO: 5638615 - DNA, 21 bp, Homo sapiens
tatatccttgacaccttactt

SEQ ID NO: 5638616 - DNA, 16 bp, Homo sapiens
tatatcctttctaaca

SEQ ID NO: 5638617 - DNA, 21 bp, Homo sapiens
tatatccttttcttctatgta

SEQ ID NO: 5638618 - DNA, 16 bp, Homo sapiens
tatatcgttatcactg

SEQ ID NO: 5638619 - DNA, 18 bp, Homo sapiens
tatatctaaattgaataa

SEQ ID NO: 5638620 - DNA, 15 bp, Homo sapiens
tatatctaacttcga

SEQ ID NO: 5638621 - DNA, 13 bp, Homo sapiens
tatatctacacat

SEQ ID NO: 5638622 - DNA, 21 bp, Homo sapiens
tatatctaccccagactagat

SEQ ID NO: 5638623 - DNA, 22 bp, Homo sapiens
tatatctaggtttatgacagta

SEQ ID NO: 5638624 - DNA, 20 bp, Homo sapiens
tatatctataaacactgttt

SEQ ID NO: 5638625 - DNA, 13 bp, Homo sapiens
tatatctatatat

SEQ ID NO: 5638626 - DNA, 17 bp, Homo sapiens
tatatctatatgtactt

SEQ ID NO: 5638627 - DNA, 19 bp, Homo sapiens
tatatctatctatttgagg

SEQ ID NO: 5638628 - DNA, 15 bp, Homo sapiens
tatatctattattca

SEQ ID NO: 5638629 - DNA, 17 bp, Homo sapiens
tatatctcaaattgtaa

SEQ ID NO: 5638630 - DNA, 12 bp, Homo sapiens
tatatctgaaaa

SEQ ID NO: 5638631 - DNA, 16 bp, Homo sapiens
tatatctgaaaactgg

SEQ ID NO: 5638632 - DNA, 14 bp, Homo sapiens
tatatctgagcaag

SEQ ID NO: 5638633 - DNA, 16 bp, Homo sapiens
tatatctgagcaagga

SEQ ID NO: 5638634 - DNA, 18 bp, Homo sapiens
tatatctgaggaattctg

SEQ ID NO: 5638635 - DNA, 20 bp, Homo sapiens
tatatctgataaaattgtga

SEQ ID NO: 5638636 - DNA, 21 bp, Homo sapiens
tatatctgataaaattgtgat

SEQ ID NO: 5638637 - DNA, 17 bp, Homo sapiens
tatatctgctgtccaga

SEQ ID NO: 5638638 - DNA, 17 bp, Homo sapiens
tatatctgcttcagtgg

SEQ ID NO: 5638639 - DNA, 21 bp, Homo sapiens
tatatctggatttttacaaat

SEQ ID NO: 5638640 - DNA, 12 bp, Homo sapiens
tatatctgtaaa

SEQ ID NO: 5638641 - DNA, 14 bp, Homo sapiens
tatatctgtaaatt

SEQ ID NO: 5638642 - DNA, 23 bp, Homo sapiens
tatatctgtaacactattacagt

SEQ ID NO: 5638643 - DNA, 15 bp, Homo sapiens
tatatctgtaatata

SEQ ID NO: 5638644 - DNA, 15 bp, Homo sapiens
tatatctgtctttta

SEQ ID NO: 5638645 - DNA, 14 bp, Homo sapiens
tatatctgtggtct

SEQ ID NO: 5638646 - DNA, 21 bp, Homo sapiens
tatatcttggcaggtaggaat

SEQ ID NO: 5638647 - DNA, 14 bp, Homo sapiens
tatatcttgtagct

SEQ ID NO: 5638648 - DNA, 17 bp, Homo sapiens
tatatcttgtttacaat

SEQ ID NO: 5638649 - DNA, 18 bp, Homo sapiens
tatatctttaataagtaa

SEQ ID NO: 5638650 - DNA, 22 bp, Homo sapiens
tatatctttatgcaaaaacata

SEQ ID NO: 5638651 - DNA, 19 bp, Homo sapiens
tatatctttgtaaattatt

SEQ ID NO: 5638652 - DNA, 14 bp, Homo sapiens
tatatcttttggtt

SEQ ID NO: 5638653 - DNA, 20 bp, Homo sapiens
tatatcttttggttattcta

SEQ ID NO: 5638654 - DNA, 14 bp, Homo sapiens
tatatctttttcca

SEQ ID NO: 5638655 - DNA, 22 bp, Homo sapiens
tatatgaaaacaagttccaaat

SEQ ID NO: 5638656 - DNA, 14 bp, Homo sapiens
tatatgaaaacctg

SEQ ID NO: 5638657 - DNA, 14 bp, Homo sapiens
tatatgaaaactaa

SEQ ID NO: 5638658 - DNA, 20 bp, Homo sapiens
tatatgaaataagtaaatgt

SEQ ID NO: 5638659 - DNA, 18 bp, Homo sapiens
tatatgaaatgtttcact

SEQ ID NO: 5638660 - DNA, 19 bp, Homo sapiens
tatatgaacttaacatgct

SEQ ID NO: 5638661 - DNA, 16 bp, Homo sapiens
tatatgaagctcttga

SEQ ID NO: 5638662 - DNA, 19 bp, Homo sapiens
tatatgaatattacatgta

SEQ ID NO: 5638663 - DNA, 14 bp, Homo sapiens
tatatgaccagaag

SEQ ID NO: 5638664 - DNA, 19 bp, Homo sapiens
tatatgaccagaagccttg

SEQ ID NO: 5638665 - DNA, 14 bp, Homo sapiens
tatatgagaagaat

SEQ ID NO: 5638666 - DNA, 19 bp, Homo sapiens
tatatgaggacttgtgtct

SEQ ID NO: 5638667 - DNA, 15 bp, Homo sapiens
tatatgaggatgtat

SEQ ID NO: 5638668 - DNA, 17 bp, Homo sapiens
tatatgaggctacagaa

SEQ ID NO: 5638669 - DNA, 21 bp, Homo sapiens
tatatgatgaaattcttatgt

SEQ ID NO: 5638670 - DNA, 20 bp, Homo sapiens
tatatgatgtggacatatgt

SEQ ID NO: 5638671 - DNA, 14 bp, Homo sapiens
tatatgattaaatt

SEQ ID NO: 5638672 - DNA, 17 bp, Homo sapiens
tatatgattctctgtgg

SEQ ID NO: 5638673 - DNA, 20 bp, Homo sapiens
tatatgattgtataatgtga

SEQ ID NO: 5638674 - DNA, 22 bp, Homo sapiens
tatatgattgtataatgtgatt

SEQ ID NO: 5638675 - DNA, 16 bp, Homo sapiens
tatatgatttatagtt

SEQ ID NO: 5638676 - DNA, 21 bp, Homo sapiens
tatatgcacatgtaacccaaa

SEQ ID NO: 5638677 - DNA, 10 bp, Homo sapiens
tatatgcacc

SEQ ID NO: 5638678 - DNA, 22 bp, Homo sapiens
tatatgcagtctctttatttta

SEQ ID NO: 5638679 - DNA, 21 bp, Homo sapiens
tatatgcataaacaacagtac

SEQ ID NO: 5638680 - DNA, 15 bp, Homo sapiens
tatatgcatgcacag

SEQ ID NO: 5638681 - DNA, 17 bp, Homo sapiens
tatatgccaagctaatt

SEQ ID NO: 5638682 - DNA, 18 bp, Homo sapiens
tatatgccaagctaattt

SEQ ID NO: 5638683 - DNA, 19 bp, Homo sapiens
tatatgcccattcttttca

SEQ ID NO: 5638684 - DNA, 17 bp, Homo sapiens
tatatgccgtataaaag

SEQ ID NO: 5638685 - DNA, 18 bp, Homo sapiens
tatatgccttaagccaat

SEQ ID NO: 5638686 - DNA, 18 bp, Homo sapiens
tatatgcctttttcctag

SEQ ID NO: 5638687 - DNA, 16 bp, Homo sapiens
tatatgctatttctat

SEQ ID NO: 5638688 - DNA, 17 bp, Homo sapiens
tatatgctcaaccagaa

SEQ ID NO: 5638689 - DNA, 16 bp, Homo sapiens
tatatgctgtatttct

SEQ ID NO: 5638690 - DNA, 17 bp, Homo sapiens
tatatgcttactgatat

SEQ ID NO: 5638691 - DNA, 18 bp, Homo sapiens
tatatgcttcacatagca

SEQ ID NO: 5638692 - DNA, 14 bp, Homo sapiens
tatatgcttctgtt

SEQ ID NO: 5638693 - DNA, 18 bp, Homo sapiens
tatatgctttattaatgt

SEQ ID NO: 5638694 - DNA, 21 bp, Homo sapiens
tatatgcttttttgcaataag

SEQ ID NO: 5638695 - DNA, 17 bp, Homo sapiens
tatatggaacattttct

SEQ ID NO: 5638696 - DNA, 17 bp, Homo sapiens
tatatggaacgcatttt

SEQ ID NO: 5638697 - DNA, 16 bp, Homo sapiens
tatatggaagaaagta

SEQ ID NO: 5638698 - DNA, 21 bp, Homo sapiens
tatatggaagataattttatg

SEQ ID NO: 5638699 - DNA, 22 bp, Homo sapiens
tatatggaagataattttatgt

SEQ ID NO: 5638700 - DNA, 15 bp, Homo sapiens
tatatggaataagtg

SEQ ID NO: 5638701 - DNA, 20 bp, Homo sapiens
tatatggaataagtgtacat

SEQ ID NO: 5638702 - DNA, 22 bp, Homo sapiens
tatatggaataagtgtacatat

SEQ ID NO: 5638703 - DNA, 14 bp, Homo sapiens
tatatggacaaatg

SEQ ID NO: 5638704 - DNA, 12 bp, Homo sapiens
tatatggacttt

SEQ ID NO: 5638705 - DNA, 14 bp, Homo sapiens
tatatggatcagag

SEQ ID NO: 5638706 - DNA, 16 bp, Homo sapiens
tatatggatgattcag

SEQ ID NO: 5638707 - DNA, 14 bp, Homo sapiens
tatatggcaaatag

SEQ ID NO: 5638708 - DNA, 16 bp, Homo sapiens
tatatggcaaatagcc

SEQ ID NO: 5638709 - DNA, 19 bp, Homo sapiens
tatatggcagagttgtaaa

SEQ ID NO: 5638710 - DNA, 19 bp, Homo sapiens
tatatggcaggagctactg

SEQ ID NO: 5638711 - DNA, 20 bp, Homo sapiens
tatatggcatatttatattg

SEQ ID NO: 5638712 - DNA, 15 bp, Homo sapiens
tatatggcatttgca

SEQ ID NO: 5638713 - DNA, 21 bp, Homo sapiens
tatatggcgttttgtctgtgt

SEQ ID NO: 5638714 - DNA, 20 bp, Homo sapiens
tatatggggatggtagtttt

SEQ ID NO: 5638715 - DNA, 20 bp, Homo sapiens
tatatgggggaaaattattt

SEQ ID NO: 5638716 - DNA, 21 bp, Homo sapiens
tatatgggggaaaattatttt

SEQ ID NO: 5638717 - DNA, 20 bp, Homo sapiens
tatatgggtatatattcatc

SEQ ID NO: 5638718 - DNA, 22 bp, Homo sapiens
tatatgggtcttcactctgact

SEQ ID NO: 5638719 - DNA, 15 bp, Homo sapiens
tatatggtccactgg

SEQ ID NO: 5638720 - DNA, 18 bp, Homo sapiens
tatatggttctccaagaa

SEQ ID NO: 5638721 - DNA, 23 bp, Homo sapiens
tatatggttctccaagaaactga

SEQ ID NO: 5638722 - DNA, 12 bp, Homo sapiens
tatatgtaaatg

SEQ ID NO: 5638723 - DNA, 19 bp, Homo sapiens
tatatgtaacagtttaaaa

SEQ ID NO: 5638724 - DNA, 13 bp, Homo sapiens
tatatgtaatata

SEQ ID NO: 5638725 - DNA, 11 bp, Homo sapiens
tatatgtacag

SEQ ID NO: 5638726 - DNA, 14 bp, Homo sapiens
tatatgtacagtta

SEQ ID NO: 5638727 - DNA, 20 bp, Homo sapiens
tatatgtacagttatacata

SEQ ID NO: 5638728 - DNA, 19 bp, Homo sapiens
tatatgtaccctctgaaat

SEQ ID NO: 5638729 - DNA, 15 bp, Homo sapiens
tatatgtagagaaag

SEQ ID NO: 5638730 - DNA, 21 bp, Homo sapiens
tatatgtagccagacagttta

SEQ ID NO: 5638731 - DNA, 14 bp, Homo sapiens
tatatgtatacata

SEQ ID NO: 5638732 - DNA, 13 bp, Homo sapiens
tatatgtatatct

SEQ ID NO: 5638733 - DNA, 14 bp, Homo sapiens
tatatgtatatctg

SEQ ID NO: 5638734 - DNA, 14 bp, Homo sapiens
tatatgtatatgta

SEQ ID NO: 5638735 - DNA, 15 bp, Homo sapiens
tatatgtatattgtc

SEQ ID NO: 5638736 - DNA, 11 bp, Homo sapiens
tatatgtatgt

SEQ ID NO: 5638737 - DNA, 16 bp, Homo sapiens
tatatgtatgtaaaaa

SEQ ID NO: 5638738 - DNA, 16 bp, Homo sapiens
tatatgtatgtgttta

SEQ ID NO: 5638739 - DNA, 18 bp, Homo sapiens
tatatgtatgtgtttaga

SEQ ID NO: 5638740 - DNA, 14 bp, Homo sapiens
tatatgtattccct

SEQ ID NO: 5638741 - DNA, 15 bp, Homo sapiens
tatatgtattccctt

SEQ ID NO: 5638742 - DNA, 11 bp, Homo sapiens
tatatgtattt

SEQ ID NO: 5638743 - DNA, 16 bp, Homo sapiens
tatatgtatttaagat

SEQ ID NO: 5638744 - DNA, 23 bp, Homo sapiens
tatatgtatttaagatgtacatt

SEQ ID NO: 5638745 - DNA, 17 bp, Homo sapiens
tatatgtatttattgtc

SEQ ID NO: 5638746 - DNA, 15 bp, Homo sapiens
tatatgtcctattca

SEQ ID NO: 5638747 - DNA, 12 bp, Homo sapiens
tatatgtctgat

SEQ ID NO: 5638748 - DNA, 19 bp, Homo sapiens
tatatgtgaaaaaaatgag

SEQ ID NO: 5638749 - DNA, 13 bp, Homo sapiens
tatatgtgaaaca

SEQ ID NO: 5638750 - DNA, 22 bp, Homo sapiens
tatatgtgacactgcagcagaa

SEQ ID NO: 5638751 - DNA, 13 bp, Homo sapiens
tatatgtgagaaa

SEQ ID NO: 5638752 - DNA, 14 bp, Homo sapiens
tatatgtgcagtct

SEQ ID NO: 5638753 - DNA, 17 bp, Homo sapiens
tatatgtgccacatttt

SEQ ID NO: 5638754 - DNA, 20 bp, Homo sapiens
tatatgtggactaaatatct

SEQ ID NO: 5638755 - DNA, 22 bp, Homo sapiens
tatatgtggactaaatatctgt

SEQ ID NO: 5638756 - DNA, 14 bp, Homo sapiens
tatatgtgtataca

SEQ ID NO: 5638757 - DNA, 14 bp, Homo sapiens
tatatgtgtatata

SEQ ID NO: 5638758 - DNA, 18 bp, Homo sapiens
tatatgtgtatatataca

SEQ ID NO: 5638759 - DNA, 20 bp, Homo sapiens
tatatgtgtatatatacata

SEQ ID NO: 5638760 - DNA, 14 bp, Homo sapiens
tatatgtgtatgca

SEQ ID NO: 5638761 - DNA, 14 bp, Homo sapiens
tatatgtgtgccta

SEQ ID NO: 5638762 - DNA, 19 bp, Homo sapiens
tatatgtgtgtgtatgttt

SEQ ID NO: 5638763 - DNA, 22 bp, Homo sapiens
tatatgtgtgtgtatgtttgca

SEQ ID NO: 5638764 - DNA, 19 bp, Homo sapiens
tatatgtgtgtttaaataa

SEQ ID NO: 5638765 - DNA, 12 bp, Homo sapiens
tatatgttcata

SEQ ID NO: 5638766 - DNA, 20 bp, Homo sapiens
tatatgttgaatgttaacag

SEQ ID NO: 5638767 - DNA, 18 bp, Homo sapiens
tatatgttgaccattcca

SEQ ID NO: 5638768 - DNA, 14 bp, Homo sapiens
tatatgttggttta

SEQ ID NO: 5638769 - DNA, 14 bp, Homo sapiens
tatcacaaatctta

SEQ ID NO: 5638770 - DNA, 16 bp, Homo sapiens
tatcacaaatcttaac

SEQ ID NO: 5638771 - DNA, 14 bp, Homo sapiens
tatcacacaaagca

SEQ ID NO: 5638772 - DNA, 13 bp, Homo sapiens
tatcacacaatat

SEQ ID NO: 5638773 - DNA, 20 bp, Homo sapiens
tatcacacacattgctgtga

SEQ ID NO: 5638774 - DNA, 13 bp, Homo sapiens
tatcacacttctg

SEQ ID NO: 5638775 - DNA, 17 bp, Homo sapiens
tatcacacttgcaaatg

SEQ ID NO: 5638776 - DNA, 13 bp, Homo sapiens
tatcacactttgt

SEQ ID NO: 5638777 - DNA, 16 bp, Homo sapiens
tatcacaggccagatg

SEQ ID NO: 5638778 - DNA, 21 bp, Homo sapiens
tatcacagtattatctgtgtt

SEQ ID NO: 5638779 - DNA, 11 bp, Homo sapiens
tatcacagtgt

SEQ ID NO: 5638780 - DNA, 12 bp, Homo sapiens
tatcacagtgtt

SEQ ID NO: 5638781 - DNA, 20 bp, Homo sapiens
tatcacatacaatttgcact

SEQ ID NO: 5638782 - DNA, 21 bp, Homo sapiens
tatcacatcaagcatgcaata

SEQ ID NO: 5638783 - DNA, 12 bp, Homo sapiens
tatcacatgtat

SEQ ID NO: 5638784 - DNA, 18 bp, Homo sapiens
tatcacatgtatgttttg

SEQ ID NO: 5638785 - DNA, 12 bp, Homo sapiens
tatcacatgttt

SEQ ID NO: 5638786 - DNA, 20 bp, Homo sapiens
tatcacattaatctcaaaga

SEQ ID NO: 5638787 - DNA, 18 bp, Homo sapiens
tatcaccagagagggact

SEQ ID NO: 5638788 - DNA, 21 bp, Homo sapiens
tatcaccaggatttatacata

SEQ ID NO: 5638789 - DNA, 14 bp, Homo sapiens
tatcaccagtgcat

SEQ ID NO: 5638790 - DNA, 15 bp, Homo sapiens
tatcaccatgattta

SEQ ID NO: 5638791 - DNA, 16 bp, Homo sapiens
tatcaccatgatttaa

SEQ ID NO: 5638792 - DNA, 19 bp, Homo sapiens
tatcacccagaagaaaata

SEQ ID NO: 5638793 - DNA, 15 bp, Homo sapiens
tatcaccctcagctg

SEQ ID NO: 5638794 - DNA, 17 bp, Homo sapiens
tatcacccttccctgct

SEQ ID NO: 5638795 - DNA, 23 bp, Homo sapiens
tatcaccgtgggctccctgactg

SEQ ID NO: 5638796 - DNA, 18 bp, Homo sapiens
tatcacctaagcacttct

SEQ ID NO: 5638797 - DNA, 14 bp, Homo sapiens
tatcacctcccctc

SEQ ID NO: 5638798 - DNA, 18 bp, Homo sapiens
tatcacctcgagaagtaa

SEQ ID NO: 5638799 - DNA, 17 bp, Homo sapiens
tatcacctctcttcagc

SEQ ID NO: 5638800 - DNA, 21 bp, Homo sapiens
tatcacctgaattattaatga

SEQ ID NO: 5638801 - DNA, 12 bp, Homo sapiens
tatcacctggct

SEQ ID NO: 5638802 - DNA, 18 bp, Homo sapiens
tatcacctggcttgttta

SEQ ID NO: 5638803 - DNA, 20 bp, Homo sapiens
tatcacctgtcttgcctttt

SEQ ID NO: 5638804 - DNA, 23 bp, Homo sapiens
tatcacgtacaccatatgcaagt

SEQ ID NO: 5638805 - DNA, 21 bp, Homo sapiens
tatcacgttgaaccacgtgaa

SEQ ID NO: 5638806 - DNA, 20 bp, Homo sapiens
tatcactaaataaacacgat

SEQ ID NO: 5638807 - DNA, 20 bp, Homo sapiens
tatcactaataaagtctgtc

SEQ ID NO: 5638808 - DNA, 17 bp, Homo sapiens
tatcactaatttcttct

SEQ ID NO: 5638809 - DNA, 13 bp, Homo sapiens
tatcactcattaa

SEQ ID NO: 5638810 - DNA, 23 bp, Homo sapiens
tatcactctaaaaaacattttta

SEQ ID NO: 5638811 - DNA, 13 bp, Homo sapiens
tatcactgaagga

SEQ ID NO: 5638812 - DNA, 20 bp, Homo sapiens
tatcactgcagtcacctctt

SEQ ID NO: 5638813 - DNA, 13 bp, Homo sapiens
tatcactgcatta

SEQ ID NO: 5638814 - DNA, 19 bp, Homo sapiens
tatcactgccttcgtttat

SEQ ID NO: 5638815 - DNA, 21 bp, Homo sapiens
tatcactgccttcgtttatat

SEQ ID NO: 5638816 - DNA, 20 bp, Homo sapiens
tatcactgctttttccttag

SEQ ID NO: 5638817 - DNA, 14 bp, Homo sapiens
tatcactgtctttg

SEQ ID NO: 5638818 - DNA, 16 bp, Homo sapiens
tatcacttaaacttgc

SEQ ID NO: 5638819 - DNA, 15 bp, Homo sapiens
tatcacttacatttt

SEQ ID NO: 5638820 - DNA, 15 bp, Homo sapiens
tatcactttaagttt

SEQ ID NO: 5638821 - DNA, 18 bp, Homo sapiens
tatcactttgtattctct

SEQ ID NO: 5638822 - DNA, 14 bp, Homo sapiens
tatcactttttgaa

SEQ ID NO: 5638823 - DNA, 17 bp, Homo sapiens
tatcactttttgaacta

SEQ ID NO: 5638824 - DNA, 12 bp, Homo sapiens
tatcagaaaagt

SEQ ID NO: 5638825 - DNA, 20 bp, Homo sapiens
tatcagaaaagtagaattat

SEQ ID NO: 5638826 - DNA, 21 bp, Homo sapiens
tatcagaaaagtagaattata

SEQ ID NO: 5638827 - DNA, 22 bp, Homo sapiens
tatcagaaacagtattttcttc

SEQ ID NO: 5638828 - DNA, 17 bp, Homo sapiens
tatcagaaagatcaaat

SEQ ID NO: 5638829 - DNA, 14 bp, Homo sapiens
tatcagaaatacaa

SEQ ID NO: 5638830 - DNA, 14 bp, Homo sapiens
tatcagaaatgaaa

SEQ ID NO: 5638831 - DNA, 18 bp, Homo sapiens
tatcagaaatgaaacaga

SEQ ID NO: 5638832 - DNA, 20 bp, Homo sapiens
tatcagaactcctttctaag

SEQ ID NO: 5638833 - DNA, 13 bp, Homo sapiens
tatcagaatttgt

SEQ ID NO: 5638834 - DNA, 20 bp, Homo sapiens
tatcagaatttgtgttgaag

SEQ ID NO: 5638835 - DNA, 13 bp, Homo sapiens
tatcagacaagca

SEQ ID NO: 5638836 - DNA, 14 bp, Homo sapiens
tatcagacaagcac

SEQ ID NO: 5638837 - DNA, 15 bp, Homo sapiens
tatcagacaagcact

SEQ ID NO: 5638838 - DNA, 16 bp, Homo sapiens
tatcagacaagcacta

SEQ ID NO: 5638839 - DNA, 13 bp, Homo sapiens
tatcagacctctg

SEQ ID NO: 5638840 - DNA, 23 bp, Homo sapiens
tatcagacgtgctccctcccatc

SEQ ID NO: 5638841 - DNA, 21 bp, Homo sapiens
tatcagactcagttttttgta

SEQ ID NO: 5638842 - DNA, 13 bp, Homo sapiens
tatcagacttcac

SEQ ID NO: 5638843 - DNA, 22 bp, Homo sapiens
tatcagagctcttaatgttgct

SEQ ID NO: 5638844 - DNA, 17 bp, Homo sapiens
tatcagaggcctataat

SEQ ID NO: 5638845 - DNA, 18 bp, Homo sapiens
tatcagagtatccactgt

SEQ ID NO: 5638846 - DNA, 17 bp, Homo sapiens
tatcagatattttcata

SEQ ID NO: 5638847 - DNA, 18 bp, Homo sapiens
tatcagatattttcatat

SEQ ID NO: 5638848 - DNA, 15 bp, Homo sapiens
tatcagattgctttt

SEQ ID NO: 5638849 - DNA, 17 bp, Homo sapiens
tatcagattgcttttgt

SEQ ID NO: 5638850 - DNA, 16 bp, Homo sapiens
tatcagatttcattaa

SEQ ID NO: 5638851 - DNA, 14 bp, Homo sapiens
tatcagcaaaaaag

SEQ ID NO: 5638852 - DNA, 14 bp, Homo sapiens
tatcagcaaagaaa

SEQ ID NO: 5638853 - DNA, 21 bp, Homo sapiens
tatcagcaatgccccaaactt

SEQ ID NO: 5638854 - DNA, 14 bp, Homo sapiens
tatcagcactggat

SEQ ID NO: 5638855 - DNA, 15 bp, Homo sapiens
tatcagcagcaacaa

SEQ ID NO: 5638856 - DNA, 15 bp, Homo sapiens
tatcagcatgaagaa

SEQ ID NO: 5638857 - DNA, 11 bp, Homo sapiens
tatcagcctgt

SEQ ID NO: 5638858 - DNA, 13 bp, Homo sapiens
tatcagcctgtct

SEQ ID NO: 5638859 - DNA, 22 bp, Homo sapiens
tatcagcctgtctcttccatat

SEQ ID NO: 5638860 - DNA, 19 bp, Homo sapiens
tatcagcggccccttgact

SEQ ID NO: 5638861 - DNA, 21 bp, Homo sapiens
tatcagctctaaagcagagat

SEQ ID NO: 5638862 - DNA, 18 bp, Homo sapiens
tatcagctctatgtcaat

SEQ ID NO: 5638863 - DNA, 14 bp, Homo sapiens
tatcagctctctgc

SEQ ID NO: 5638864 - DNA, 16 bp, Homo sapiens
tatcagctctctgctg

SEQ ID NO: 5638865 - DNA, 18 bp, Homo sapiens
tatcagctctctgctggg

SEQ ID NO: 5638866 - DNA, 21 bp, Homo sapiens
tatcagctttgataattgtgt

SEQ ID NO: 5638867 - DNA, 20 bp, Homo sapiens
tatcaggacccagaggaagg

SEQ ID NO: 5638868 - DNA, 19 bp, Homo sapiens
tatcaggactgtgaccaaa

SEQ ID NO: 5638869 - DNA, 11 bp, Homo sapiens
tatcaggaggg

SEQ ID NO: 5638870 - DNA, 17 bp, Homo sapiens
tatcaggagtccactgc

SEQ ID NO: 5638871 - DNA, 19 bp, Homo sapiens
tatcaggagtccactgcct

SEQ ID NO: 5638872 - DNA, 14 bp, Homo sapiens
tatcaggcaagata

SEQ ID NO: 5638873 - DNA, 19 bp, Homo sapiens
tatcaggcacaggcaggaa

SEQ ID NO: 5638874 - DNA, 22 bp, Homo sapiens
tatcagggaaactaagattctt

SEQ ID NO: 5638875 - DNA, 15 bp, Homo sapiens
tatcagggaggaaga

SEQ ID NO: 5638876 - DNA, 17 bp, Homo sapiens
tatcagggcaagctcat

SEQ ID NO: 5638877 - DNA, 18 bp, Homo sapiens
tatcaggggaatttcagg

SEQ ID NO: 5638878 - DNA, 13 bp, Homo sapiens
tatcaggtaataa

SEQ ID NO: 5638879 - DNA, 23 bp, Homo sapiens
tatcaggtgcccatccctggaag

SEQ ID NO: 5638880 - DNA, 17 bp, Homo sapiens
tatcaggtgctgccatc

SEQ ID NO: 5638881 - DNA, 18 bp, Homo sapiens
tatcaggtgtataaatgt

SEQ ID NO: 5638882 - DNA, 21 bp, Homo sapiens
tatcaggtgtataaatgtaca

SEQ ID NO: 5638883 - DNA, 16 bp, Homo sapiens
tatcagtagaaagagt

SEQ ID NO: 5638884 - DNA, 17 bp, Homo sapiens
tatcagtagaaagagtg

SEQ ID NO: 5638885 - DNA, 20 bp, Homo sapiens
tatcagtagtgtacattacc

SEQ ID NO: 5638886 - DNA, 15 bp, Homo sapiens
tatcagtatggtgct

SEQ ID NO: 5638887 - DNA, 23 bp, Homo sapiens
tatcagtcatgacagatgaagaa

SEQ ID NO: 5638888 - DNA, 15 bp, Homo sapiens
tatcagtcatgagga

SEQ ID NO: 5638889 - DNA, 17 bp, Homo sapiens
tatcagtcgttttagtg

SEQ ID NO: 5638890 - DNA, 21 bp, Homo sapiens
tatcagtcgttttagtgtctg

SEQ ID NO: 5638891 - DNA, 15 bp, Homo sapiens
tatcagtgaagcagt

SEQ ID NO: 5638892 - DNA, 14 bp, Homo sapiens
tatcagtgaatata

SEQ ID NO: 5638893 - DNA, 22 bp, Homo sapiens
tatcagtgacagagttcactat

SEQ ID NO: 5638894 - DNA, 22 bp, Homo sapiens
tatcagtgacttctgaatcctt

SEQ ID NO: 5638895 - DNA, 23 bp, Homo sapiens
tatcagtgatggtctcacagagc

SEQ ID NO: 5638896 - DNA, 11 bp, Homo sapiens
tatcagtgctt

SEQ ID NO: 5638897 - DNA, 16 bp, Homo sapiens
tatcagtgcttaatgt

SEQ ID NO: 5638898 - DNA, 18 bp, Homo sapiens
tatcagtgctttgttgat

SEQ ID NO: 5638899 - DNA, 13 bp, Homo sapiens
tatcagtgtcctt

SEQ ID NO: 5638900 - DNA, 17 bp, Homo sapiens
tatcagtgtcctttcca

SEQ ID NO: 5638901 - DNA, 17 bp, Homo sapiens
tatcagtgttgtctcat

SEQ ID NO: 5638902 - DNA, 21 bp, Homo sapiens
tatcagtgttttaaattctga

SEQ ID NO: 5638903 - DNA, 20 bp, Homo sapiens
tatcagttaaaatcacattt

SEQ ID NO: 5638904 - DNA, 15 bp, Homo sapiens
tatcagttaacatta

SEQ ID NO: 5638905 - DNA, 15 bp, Homo sapiens
tatcagttactcagc

SEQ ID NO: 5638906 - DNA, 18 bp, Homo sapiens
tatcagttactcagccct

SEQ ID NO: 5638907 - DNA, 23 bp, Homo sapiens
tatcagttatcctttgtgagcct

SEQ ID NO: 5638908 - DNA, 20 bp, Homo sapiens
tatcagttatctgtttgtta

SEQ ID NO: 5638909 - DNA, 22 bp, Homo sapiens
tatcagtttgatcacactattt

SEQ ID NO: 5638910 - DNA, 18 bp, Homo sapiens
tatcagttttatagcttt

SEQ ID NO: 5638911 - DNA, 20 bp, Homo sapiens
tatcataaaggatatttcaa

SEQ ID NO: 5638912 - DNA, 21 bp, Homo sapiens
tatcataaaggatatttcaaa

SEQ ID NO: 5638913 - DNA, 13 bp, Homo sapiens
tatcataaagtat

SEQ ID NO: 5638914 - DNA, 15 bp, Homo sapiens
tatcataacatctgg

SEQ ID NO: 5638915 - DNA, 15 bp, Homo sapiens
tatcataatttcttt

SEQ ID NO: 5638916 - DNA, 18 bp, Homo sapiens
tatcataccctttattct

SEQ ID NO: 5638917 - DNA, 21 bp, Homo sapiens
tatcatacgttgatagtttac

SEQ ID NO: 5638918 - DNA, 15 bp, Homo sapiens
tatcatactgagact

SEQ ID NO: 5638919 - DNA, 14 bp, Homo sapiens
tatcatactgattt

SEQ ID NO: 5638920 - DNA, 20 bp, Homo sapiens
tatcatactgttttgaataa

SEQ ID NO: 5638921 - DNA, 15 bp, Homo sapiens
tatcataggtacaat

SEQ ID NO: 5638922 - DNA, 15 bp, Homo sapiens
tatcatataaacatt

SEQ ID NO: 5638923 - DNA, 17 bp, Homo sapiens
tatcatataaacatttt

SEQ ID NO: 5638924 - DNA, 20 bp, Homo sapiens
tatcatataaacattttatt

SEQ ID NO: 5638925 - DNA, 21 bp, Homo sapiens
tatcatatatatacatacatg

SEQ ID NO: 5638926 - DNA, 15 bp, Homo sapiens
tatcatatattaaaa

SEQ ID NO: 5638927 - DNA, 21 bp, Homo sapiens
tatcatatattaaaacaataa

SEQ ID NO: 5638928 - DNA, 15 bp, Homo sapiens
tatcatatatttaat

SEQ ID NO: 5638929 - DNA, 19 bp, Homo sapiens
tatcatatatttaatctta

SEQ ID NO: 5638930 - DNA, 21 bp, Homo sapiens
tatcatatgtatctaaatgaa

SEQ ID NO: 5638931 - DNA, 20 bp, Homo sapiens
tatcatattaacatattcta

SEQ ID NO: 5638932 - DNA, 14 bp, Homo sapiens
tatcatattattat

SEQ ID NO: 5638933 - DNA, 18 bp, Homo sapiens
tatcatattctaaaagta

SEQ ID NO: 5638934 - DNA, 20 bp, Homo sapiens
tatcatcacaaatggctaca

SEQ ID NO: 5638935 - DNA, 21 bp, Homo sapiens
tatcatcagcatacctttatt

SEQ ID NO: 5638936 - DNA, 16 bp, Homo sapiens
tatcatcagtattgaa

SEQ ID NO: 5638937 - DNA, 14 bp, Homo sapiens
tatcatccacacat

SEQ ID NO: 5638938 - DNA, 15 bp, Homo sapiens
tatcatccacacatg

SEQ ID NO: 5638939 - DNA, 15 bp, Homo sapiens
tatcatcccaacagc

SEQ ID NO: 5638940 - DNA, 19 bp, Homo sapiens
tatcatcccaacagccaag

SEQ ID NO: 5638941 - DNA, 12 bp, Homo sapiens
tatcatcggagt

SEQ ID NO: 5638942 - DNA, 12 bp, Homo sapiens
tatcatctaaat

SEQ ID NO: 5638943 - DNA, 23 bp, Homo sapiens
tatcatctccatcatatgcctga

SEQ ID NO: 5638944 - DNA, 15 bp, Homo sapiens
tatcatctcttaaat

SEQ ID NO: 5638945 - DNA, 19 bp, Homo sapiens
tatcatctggataggagcc

SEQ ID NO: 5638946 - DNA, 13 bp, Homo sapiens
tatcatctgtcat

SEQ ID NO: 5638947 - DNA, 20 bp, Homo sapiens
tatcatgaaacacttctcat

SEQ ID NO: 5638948 - DNA, 19 bp, Homo sapiens
tatctatatcatatttctg

SEQ ID NO: 5638949 - DNA, 16 bp, Homo sapiens
tatctatatgtacttg

SEQ ID NO: 5638950 - DNA, 16 bp, Homo sapiens
tatctatattctaaag

SEQ ID NO: 5638951 - DNA, 23 bp, Homo sapiens
tatctatattttacataaattta

SEQ ID NO: 5638952 - DNA, 18 bp, Homo sapiens
tatctatcctgaatctaa

SEQ ID NO: 5638953 - DNA, 14 bp, Homo sapiens
tatctatcggaaga

SEQ ID NO: 5638954 - DNA, 16 bp, Homo sapiens
tatctatcggaagaac

SEQ ID NO: 5638955 - DNA, 20 bp, Homo sapiens
tatctatcggaagaacatga

SEQ ID NO: 5638956 - DNA, 17 bp, Homo sapiens
tatctatctatttgagg

SEQ ID NO: 5638957 - DNA, 14 bp, Homo sapiens
tatctatgaaaacc

SEQ ID NO: 5638958 - DNA, 14 bp, Homo sapiens
tatctatggaaatg

SEQ ID NO: 5638959 - DNA, 17 bp, Homo sapiens
tatctatggaaatgtga

SEQ ID NO: 5638960 - DNA, 15 bp, Homo sapiens
tatctatgtcctgga

SEQ ID NO: 5638961 - DNA, 17 bp, Homo sapiens
tatctatgtggaaaaca

SEQ ID NO: 5638962 - DNA, 16 bp, Homo sapiens
tatctatgttttacca

SEQ ID NO: 5638963 - DNA, 20 bp, Homo sapiens
tatctattaaaattgccatt

SEQ ID NO: 5638964 - DNA, 19 bp, Homo sapiens
tatctattaaagtgacttt

SEQ ID NO: 5638965 - DNA, 12 bp, Homo sapiens
tatctattaata

SEQ ID NO: 5638966 - DNA, 17 bp, Homo sapiens
tatctattaatatatgt

SEQ ID NO: 5638967 - DNA, 13 bp, Homo sapiens
tatctattagata

SEQ ID NO: 5638968 - DNA, 18 bp, Homo sapiens
tatctattctgagaaaac

SEQ ID NO: 5638969 - DNA, 18 bp, Homo sapiens
tatctatttatctgtctg

SEQ ID NO: 5638970 - DNA, 19 bp, Homo sapiens
tatctatttatctgtctga

SEQ ID NO: 5638971 - DNA, 17 bp, Homo sapiens
tatctatttgaataaat

SEQ ID NO: 5638972 - DNA, 20 bp, Homo sapiens
tatctatttgtatatataca

SEQ ID NO: 5638973 - DNA, 14 bp, Homo sapiens
tatctcaaattgta

SEQ ID NO: 5638974 - DNA, 15 bp, Homo sapiens
tatctcaactctgtt

SEQ ID NO: 5638975 - DNA, 16 bp, Homo sapiens
tatctcaactctgttt

SEQ ID NO: 5638976 - DNA, 21 bp, Homo sapiens
tatctcaactctgtttatttg

SEQ ID NO: 5638977 - DNA, 18 bp, Homo sapiens
tatctcaagataggaaga

SEQ ID NO: 5638978 - DNA, 19 bp, Homo sapiens
tatctcaagtaaaacaaat

SEQ ID NO: 5638979 - DNA, 15 bp, Homo sapiens
tatctcaatctgcag

SEQ ID NO: 5638980 - DNA, 16 bp, Homo sapiens
tatctcaatgaaccat

SEQ ID NO: 5638981 - DNA, 16 bp, Homo sapiens
tatctcacagcacact

SEQ ID NO: 5638982 - DNA, 23 bp, Homo sapiens
tatctcacctaatggttgtacat

SEQ ID NO: 5638983 - DNA, 16 bp, Homo sapiens
tatctcactgttttat

SEQ ID NO: 5638984 - DNA, 19 bp, Homo sapiens
tatctcagaaagtgcctga

SEQ ID NO: 5638985 - DNA, 16 bp, Homo sapiens
tatctcagatatttgc

SEQ ID NO: 5638986 - DNA, 17 bp, Homo sapiens
tatctcagatatttgca

SEQ ID NO: 5638987 - DNA, 15 bp, Homo sapiens
tatctcagatgttaa

SEQ ID NO: 5638988 - DNA, 19 bp, Homo sapiens
tatctcagatgttaaaata

SEQ ID NO: 5638989 - DNA, 13 bp, Homo sapiens
tatctcagccata

SEQ ID NO: 5638990 - DNA, 19 bp, Homo sapiens
tatctcaggaagtccagcc

SEQ ID NO: 5638991 - DNA, 18 bp, Homo sapiens
tatctcagggagggaagg

SEQ ID NO: 5638992 - DNA, 21 bp, Homo sapiens
tatctcagtctaaggtctcat

SEQ ID NO: 5638993 - DNA, 17 bp, Homo sapiens
tatctcatactgtctgg

SEQ ID NO: 5638994 - DNA, 21 bp, Homo sapiens
tatctcatagggatgctgtga

SEQ ID NO: 5638995 - DNA, 16 bp, Homo sapiens
tatctcatctgtctcg

SEQ ID NO: 5638996 - DNA, 21 bp, Homo sapiens
tatctcatgccagtgccttat

SEQ ID NO: 5638997 - DNA, 13 bp, Homo sapiens
tatctcattgcaa

SEQ ID NO: 5638998 - DNA, 22 bp, Homo sapiens
tatctccagccaatttcaaaga

SEQ ID NO: 5638999 - DNA, 16 bp, Homo sapiens
tatctccatactttgg

SEQ ID NO: 5639000 - DNA, 18 bp, Homo sapiens
tatctccatactttggat

SEQ ID NO: 5639001 - DNA, 23 bp, Homo sapiens
tatctccatccttaactgtccag

SEQ ID NO: 5639002 - DNA, 17 bp, Homo sapiens
tatctccatggccctgt

SEQ ID NO: 5639003 - DNA, 13 bp, Homo sapiens
tatctccctgctt

SEQ ID NO: 5639004 - DNA, 18 bp, Homo sapiens
tatctccctgcttcatat

SEQ ID NO: 5639005 - DNA, 19 bp, Homo sapiens
tatctccctggagaagcac

SEQ ID NO: 5639006 - DNA, 12 bp, Homo sapiens
tatctccctggc

SEQ ID NO: 5639007 - DNA, 19 bp, Homo sapiens
tatctccggctcccagcct

SEQ ID NO: 5639008 - DNA, 20 bp, Homo sapiens
tatctccggctcccagcctc

SEQ ID NO: 5639009 - DNA, 11 bp, Homo sapiens
tatctcctgac

SEQ ID NO: 5639010 - DNA, 19 bp, Homo sapiens
tatctccttcccaccccta

SEQ ID NO: 5639011 - DNA, 20 bp, Homo sapiens
tatctccttcccacccctac

SEQ ID NO: 5639012 - DNA, 20 bp, Homo sapiens
tatctcctttgaagaaggca

SEQ ID NO: 5639013 - DNA, 23 bp, Homo sapiens
tatctcctttgaagaaggcaagg

SEQ ID NO: 5639014 - DNA, 19 bp, Homo sapiens
tatctcgaatttgaagaga

SEQ ID NO: 5639015 - DNA, 20 bp, Homo sapiens
tatctcgctagccatatatt

SEQ ID NO: 5639016 - DNA, 19 bp, Homo sapiens
tatctcggactttgcagga

SEQ ID NO: 5639017 - DNA, 22 bp, Homo sapiens
tatctcgtaatagcttctgtgt

SEQ ID NO: 5639018 - DNA, 12 bp, Homo sapiens
tatctctacttt

SEQ ID NO: 5639019 - DNA, 15 bp, Homo sapiens
tatctctactttcct

SEQ ID NO: 5639020 - DNA, 21 bp, Homo sapiens
tatctctagatgcaaatacat

SEQ ID NO: 5639021 - DNA, 17 bp, Homo sapiens
tatctctaggctgtttt

SEQ ID NO: 5639022 - DNA, 16 bp, Homo sapiens
tatctctagtccctgt

SEQ ID NO: 5639023 - DNA, 22 bp, Homo sapiens
tatctctagtccctgtgttctg

SEQ ID NO: 5639024 - DNA, 16 bp, Homo sapiens
tatctctatttaatat

SEQ ID NO: 5639025 - DNA, 14 bp, Homo sapiens
tatctctcccttct

SEQ ID NO: 5639026 - DNA, 18 bp, Homo sapiens
tatctctcccttctttac

SEQ ID NO: 5639027 - DNA, 12 bp, Homo sapiens
tatctctctgtg

SEQ ID NO: 5639028 - DNA, 16 bp, Homo sapiens
tatctctgaagcatgt

SEQ ID NO: 5639029 - DNA, 18 bp, Homo sapiens
tatctctgaagcatgttt

SEQ ID NO: 5639030 - DNA, 22 bp, Homo sapiens
tatctctgccaacatgaggaca

SEQ ID NO: 5639031 - DNA, 11 bp, Homo sapiens
tatctctgccg

SEQ ID NO: 5639032 - DNA, 16 bp, Homo sapiens
tatctctgccgtctct

SEQ ID NO: 5639033 - DNA, 20 bp, Homo sapiens
tatctctgtctaccatctcc

SEQ ID NO: 5639034 - DNA, 18 bp, Homo sapiens
tatctctgtgtgcacaaa

SEQ ID NO: 5639035 - DNA, 12 bp, Homo sapiens
tatctcttcagt

SEQ ID NO: 5639036 - DNA, 14 bp, Homo sapiens
tatctcttcctgtc

SEQ ID NO: 5639037 - DNA, 13 bp, Homo sapiens
tatctcttgccct

SEQ ID NO: 5639038 - DNA, 14 bp, Homo sapiens
tatctcttggaaaa

SEQ ID NO: 5639039 - DNA, 19 bp, Homo sapiens
tatctcttggaaaataaga

SEQ ID NO: 5639040 - DNA, 18 bp, Homo sapiens
tatctctttctctctttc

SEQ ID NO: 5639041 - DNA, 17 bp, Homo sapiens
tatctctttctttctct

SEQ ID NO: 5639042 - DNA, 18 bp, Homo sapiens
tatctctttgatctactt

SEQ ID NO: 5639043 - DNA, 22 bp, Homo sapiens
tatctctttgatctacttgcct

SEQ ID NO: 5639044 - DNA, 16 bp, Homo sapiens
tatctcttttatattt

SEQ ID NO: 5639045 - DNA, 23 bp, Homo sapiens
tatctcttttgaatccatgcttg

SEQ ID NO: 5639046 - DNA, 13 bp, Homo sapiens
tatctgaaagtca

SEQ ID NO: 5639047 - DNA, 14 bp, Homo sapiens
tatctgaacacata

SEQ ID NO: 5639048 - DNA, 21 bp, Homo sapiens
tatctgaacacatactagaaa

SEQ ID NO: 5639049 - DNA, 22 bp, Homo sapiens
tatctgaacacatactagaaag

SEQ ID NO: 5639050 - DNA, 14 bp, Homo sapiens
tatctgaaccaaga

SEQ ID NO: 5639051 - DNA, 14 bp, Homo sapiens
tatctgaagggaat

SEQ ID NO: 5639052 - DNA, 12 bp, Homo sapiens
tatctgaatgtt

SEQ ID NO: 5639053 - DNA, 20 bp, Homo sapiens
tatctgaatttttaaacaag

SEQ ID NO: 5639054 - DNA, 18 bp, Homo sapiens
tatctgacatctctgcaa

SEQ ID NO: 5639055 - DNA, 23 bp, Homo sapiens
tatctgacccactttgtaatttt

SEQ ID NO: 5639056 - DNA, 21 bp, Homo sapiens
tatctgagcgtttaaagtact

SEQ ID NO: 5639057 - DNA, 16 bp, Homo sapiens
tatctgaggaattctg

SEQ ID NO: 5639058 - DNA, 18 bp, Homo sapiens
tatctgaggaattctgta

SEQ ID NO: 5639059 - DNA, 23 bp, Homo sapiens
tatctgaggcactgataatatgt

SEQ ID NO: 5639060 - DNA, 17 bp, Homo sapiens
tatctgagttgccaaga

SEQ ID NO: 5639061 - DNA, 17 bp, Homo sapiens
tatctgagttgtgcctc

SEQ ID NO: 5639062 - DNA, 15 bp, Homo sapiens
tatctgataaaattg

SEQ ID NO: 5639063 - DNA, 21 bp, Homo sapiens
tatctgatcgggataacaaaa

SEQ ID NO: 5639064 - DNA, 16 bp, Homo sapiens
tatctgatcttcctca

SEQ ID NO: 5639065 - DNA, 16 bp, Homo sapiens
tatctgattcctttaa

SEQ ID NO: 5639066 - DNA, 22 bp, Homo sapiens
tatctgattttgtgcaaaagct

SEQ ID NO: 5639067 - DNA, 23 bp, Homo sapiens
tatctgcaatgtttttgtgtaga

SEQ ID NO: 5639068 - DNA, 12 bp, Homo sapiens
tatctgcactct

SEQ ID NO: 5639069 - DNA, 21 bp, Homo sapiens
tatctgcactctaaactgcaa

SEQ ID NO: 5639070 - DNA, 16 bp, Homo sapiens
tatctgcagaatgggc

SEQ ID NO: 5639071 - DNA, 13 bp, Homo sapiens
tatctgcatatgt

SEQ ID NO: 5639072 - DNA, 11 bp, Homo sapiens
tatctgcattt

SEQ ID NO: 5639073 - DNA, 19 bp, Homo sapiens
tatctgcatttaccactgt

SEQ ID NO: 5639074 - DNA, 21 bp, Homo sapiens
tatctgccaaattgagataat

SEQ ID NO: 5639075 - DNA, 18 bp, Homo sapiens
tatctgcccctcccccac

SEQ ID NO: 5639076 - DNA, 20 bp, Homo sapiens
tatctgcccctcccccactt

SEQ ID NO: 5639077 - DNA, 14 bp, Homo sapiens
tatctgcctgacag

SEQ ID NO: 5639078 - DNA, 18 bp, Homo sapiens
tatctgcctggcctggct

SEQ ID NO: 5639079 - DNA, 19 bp, Homo sapiens
tatctgcctggcctggctc

SEQ ID NO: 5639080 - DNA, 20 bp, Homo sapiens
tatctgctgcctctgaaaat

SEQ ID NO: 5639081 - DNA, 15 bp, Homo sapiens
tatctgctgtatgtc

SEQ ID NO: 5639082 - DNA, 17 bp, Homo sapiens
tatctgctgtccagaca

SEQ ID NO: 5639083 - DNA, 13 bp, Homo sapiens
tatctgctgttct

SEQ ID NO: 5639084 - DNA, 16 bp, Homo sapiens
tatctgctgttcttca

SEQ ID NO: 5639085 - DNA, 17 bp, Homo sapiens
tatctgctgttcttcag

SEQ ID NO: 5639086 - DNA, 12 bp, Homo sapiens
tatctggaattt

SEQ ID NO: 5639087 - DNA, 22 bp, Homo sapiens
tatctggccccaggtagaaact

SEQ ID NO: 5639088 - DNA, 23 bp, Homo sapiens
tatctggccctcgacactcacca

SEQ ID NO: 5639089 - DNA, 19 bp, Homo sapiens
tatctggcctaaaatcttg

SEQ ID NO: 5639090 - DNA, 17 bp, Homo sapiens
tatctggcttccctgga

SEQ ID NO: 5639091 - DNA, 18 bp, Homo sapiens
tatctgggaactgtgcct

SEQ ID NO: 5639092 - DNA, 21 bp, Homo sapiens
tatctgggagatgacctgcct

SEQ ID NO: 5639093 - DNA, 18 bp, Homo sapiens
tatctgggattattcttt

SEQ ID NO: 5639094 - DNA, 22 bp, Homo sapiens
tatctgggattattctttgaaa

SEQ ID NO: 5639095 - DNA, 16 bp, Homo sapiens
tatctgggcttaataa

SEQ ID NO: 5639096 - DNA, 18 bp, Homo sapiens
tatctgggcttcctggag

SEQ ID NO: 5639097 - DNA, 22 bp, Homo sapiens
tatctgggtaagaagaaagcaa

SEQ ID NO: 5639098 - DNA, 22 bp, Homo sapiens
tatctgggttttagaaattcta

SEQ ID NO: 5639099 - DNA, 22 bp, Homo sapiens
tatctggtatatgtcattattt

SEQ ID NO: 5639100 - DNA, 16 bp, Homo sapiens
tatctggtatctgcat

SEQ ID NO: 5639101 - DNA, 16 bp, Homo sapiens
tatctggttatatcat

SEQ ID NO: 5639102 - DNA, 21 bp, Homo sapiens
tatctgtaaatttaactgcat

SEQ ID NO: 5639103 - DNA, 17 bp, Homo sapiens
tatctgtaacactatta

SEQ ID NO: 5639104 - DNA, 23 bp, Homo sapiens
tatctgtaacccttgaatttcta

SEQ ID NO: 5639105 - DNA, 21 bp, Homo sapiens
tatctgtaatatataatcaaa

SEQ ID NO: 5639106 - DNA, 22 bp, Homo sapiens
tatctgtacatactttttcaag

SEQ ID NO: 5639107 - DNA, 24 bp, Homo sapiens
tatctgtacctgcccccactcagc

SEQ ID NO: 5639108 - DNA, 17 bp, Homo sapiens
tatctgtattggcagca

SEQ ID NO: 5639109 - DNA, 19 bp, Homo sapiens
tatctgtattggcagcaca

SEQ ID NO: 5639110 - DNA, 21 bp, Homo sapiens
tatctgtattggcagcacagc

SEQ ID NO: 5639111 - DNA, 13 bp, Homo sapiens
tatctgtatttat

SEQ ID NO: 5639112 - DNA, 15 bp, Homo sapiens
tatctgtcagctgca

SEQ ID NO: 5639113 - DNA, 20 bp, Homo sapiens
tatctgtcatttgagcaggg

SEQ ID NO: 5639114 - DNA, 17 bp, Homo sapiens
tatctgtcccctgctac

SEQ ID NO: 5639115 - DNA, 12 bp, Homo sapiens
tatctgtctact

SEQ ID NO: 5639116 - DNA, 21 bp, Homo sapiens
tatctgtctactttctcttgt

SEQ ID NO: 5639117 - DNA, 12 bp, Homo sapiens
tatctgtctgag

SEQ ID NO: 5639118 - DNA, 19 bp, Homo sapiens
tatctgtctgagccctgcc

SEQ ID NO: 5639119 - DNA, 14 bp, Homo sapiens
tatctgtctttatg

SEQ ID NO: 5639120 - DNA, 15 bp, Homo sapiens
tatctgtctttatga

SEQ ID NO: 5639121 - DNA, 17 bp, Homo sapiens
tatctgtgaaatatcat

SEQ ID NO: 5639122 - DNA, 20 bp, Homo sapiens
tatctgtgcttctaatatta

SEQ ID NO: 5639123 - DNA, 22 bp, Homo sapiens
tatctgtggagttcctgctccg

SEQ ID NO: 5639124 - DNA, 23 bp, Homo sapiens
tatctgtggattcagcttctgtt

SEQ ID NO: 5639125 - DNA, 16 bp, Homo sapiens
tatgatttcattatca

SEQ ID NO: 5639126 - DNA, 14 bp, Homo sapiens
tatgatttccttca

SEQ ID NO: 5639127 - DNA, 18 bp, Homo sapiens
tatgatttccttcaatgt

SEQ ID NO: 5639128 - DNA, 14 bp, Homo sapiens
tatgatttctgaat

SEQ ID NO: 5639129 - DNA, 14 bp, Homo sapiens
tatgatttgttcct

SEQ ID NO: 5639130 - DNA, 17 bp, Homo sapiens
tatgatttgttcctttc

SEQ ID NO: 5639131 - DNA, 16 bp, Homo sapiens
tatgatttgttttgaa

SEQ ID NO: 5639132 - DNA, 18 bp, Homo sapiens
tatgattttatttaaact

SEQ ID NO: 5639133 - DNA, 17 bp, Homo sapiens
tatgatttttacaataa

SEQ ID NO: 5639134 - DNA, 16 bp, Homo sapiens
tatgattttttaaaag

SEQ ID NO: 5639135 - DNA, 17 bp, Homo sapiens
tatgattttttaaaaga

SEQ ID NO: 5639136 - DNA, 18 bp, Homo sapiens
tatgattttttaaaagaa

SEQ ID NO: 5639137 - DNA, 16 bp, Homo sapiens
tatgattttttcatga

SEQ ID NO: 5639138 - DNA, 14 bp, Homo sapiens
tatgcaaaactttt

SEQ ID NO: 5639139 - DNA, 22 bp, Homo sapiens
tatgcaaaagcagctaaatgta

SEQ ID NO: 5639140 - DNA, 11 bp, Homo sapiens
tatgcaaaagg

SEQ ID NO: 5639141 - DNA, 22 bp, Homo sapiens
tatgcaaaagttctgacttgac

SEQ ID NO: 5639142 - DNA, 22 bp, Homo sapiens
tatgcaaaatagacatctttaa

SEQ ID NO: 5639143 - DNA, 18 bp, Homo sapiens
tatgcaaaatttagaaga

SEQ ID NO: 5639144 - DNA, 13 bp, Homo sapiens
tatgcaaagcact

SEQ ID NO: 5639145 - DNA, 14 bp, Homo sapiens
tatgcaaagcactg

SEQ ID NO: 5639146 - DNA, 15 bp, Homo sapiens
tatgcaaagcactga

SEQ ID NO: 5639147 - DNA, 13 bp, Homo sapiens
tatgcaaatacaa

SEQ ID NO: 5639148 - DNA, 14 bp, Homo sapiens
tatgcaaattccca

SEQ ID NO: 5639149 - DNA, 15 bp, Homo sapiens
tatgcaagcagcttt

SEQ ID NO: 5639150 - DNA, 17 bp, Homo sapiens
tatgcaagcagtttcaa

SEQ ID NO: 5639151 - DNA, 17 bp, Homo sapiens
tatgcaaggaaggaaag

SEQ ID NO: 5639152 - DNA, 16 bp, Homo sapiens
tatgcaaggggaaacc

SEQ ID NO: 5639153 - DNA, 23 bp, Homo sapiens
tatgcaagtcgccaggcaggagg

SEQ ID NO: 5639154 - DNA, 13 bp, Homo sapiens
tatgcaagtggga

SEQ ID NO: 5639155 - DNA, 21 bp, Homo sapiens
tatgcaataaaattatttgca

SEQ ID NO: 5639156 - DNA, 14 bp, Homo sapiens
tatgcaataaatat

SEQ ID NO: 5639157 - DNA, 16 bp, Homo sapiens
tatgcaataaatatta

SEQ ID NO: 5639158 - DNA, 18 bp, Homo sapiens
tatgcaataatccacccc

SEQ ID NO: 5639159 - DNA, 16 bp, Homo sapiens
tatgcaatatatgttc

SEQ ID NO: 5639160 - DNA, 20 bp, Homo sapiens
tatgcaatgtatagtgtcta

SEQ ID NO: 5639161 - DNA, 16 bp, Homo sapiens
tatgcaattcagtgtt

SEQ ID NO: 5639162 - DNA, 19 bp, Homo sapiens
tatgcaatttttaaactag

SEQ ID NO: 5639163 - DNA, 23 bp, Homo sapiens
tatgcacaccaaattgctgagat

SEQ ID NO: 5639164 - DNA, 22 bp, Homo sapiens
tatgcacacttttaattttgtc

SEQ ID NO: 5639165 - DNA, 15 bp, Homo sapiens
tatgcacagagccca

SEQ ID NO: 5639166 - DNA, 12 bp, Homo sapiens
tatgcacagcct

SEQ ID NO: 5639167 - DNA, 13 bp, Homo sapiens
tatgcacatatgg

SEQ ID NO: 5639168 - DNA, 19 bp, Homo sapiens
tatgcacatatggactctg

SEQ ID NO: 5639169 - DNA, 20 bp, Homo sapiens
tatgcacatatggactctgc

SEQ ID NO: 5639170 - DNA, 20 bp, Homo sapiens
tatgcaccaggtctcaaggt

SEQ ID NO: 5639171 - DNA, 18 bp, Homo sapiens
tatgcacctataaatact

SEQ ID NO: 5639172 - DNA, 17 bp, Homo sapiens
tatgcacgaccttggga

SEQ ID NO: 5639173 - DNA, 23 bp, Homo sapiens
tatgcacgttaacagcgtgtcaa

SEQ ID NO: 5639174 - DNA, 16 bp, Homo sapiens
tatgcactaaatatga

SEQ ID NO: 5639175 - DNA, 16 bp, Homo sapiens
tatgcactaagtctct

SEQ ID NO: 5639176 - DNA, 17 bp, Homo sapiens
tatgcactaatcaatac

SEQ ID NO: 5639177 - DNA, 22 bp, Homo sapiens
tatgcactgaagagctcttggc

SEQ ID NO: 5639178 - DNA, 13 bp, Homo sapiens
tatgcactggcca

SEQ ID NO: 5639179 - DNA, 23 bp, Homo sapiens
tatgcactgtggtttcagatgtg

SEQ ID NO: 5639180 - DNA, 22 bp, Homo sapiens
tatgcacttataattttcctaa

SEQ ID NO: 5639181 - DNA, 17 bp, Homo sapiens
tatgcactttccctaga

SEQ ID NO: 5639182 - DNA, 18 bp, Homo sapiens
tatgcacttttccccaat

SEQ ID NO: 5639183 - DNA, 22 bp, Homo sapiens
tatgcagaaatagacaaaaagt

SEQ ID NO: 5639184 - DNA, 18 bp, Homo sapiens
tatgcagaacacatttca

SEQ ID NO: 5639185 - DNA, 16 bp, Homo sapiens
tatgcagaatggcatt

SEQ ID NO: 5639186 - DNA, 18 bp, Homo sapiens
tatgcagacatctctgga

SEQ ID NO: 5639187 - DNA, 21 bp, Homo sapiens
tatgcagacatctctggagcc

SEQ ID NO: 5639188 - DNA, 12 bp, Homo sapiens
tatgcagagctt

SEQ ID NO: 5639189 - DNA, 18 bp, Homo sapiens
tatgcagaggtccacaac

SEQ ID NO: 5639190 - DNA, 18 bp, Homo sapiens
tatgcagatacttattaa

SEQ ID NO: 5639191 - DNA, 16 bp, Homo sapiens
tatgcagcaaatatat

SEQ ID NO: 5639192 - DNA, 13 bp, Homo sapiens
tatgcagccaacc

SEQ ID NO: 5639193 - DNA, 12 bp, Homo sapiens
tatgcagcctgc

SEQ ID NO: 5639194 - DNA, 15 bp, Homo sapiens
tatgcagcctgctct

SEQ ID NO: 5639195 - DNA, 20 bp, Homo sapiens
tatgcagcttggagacagga

SEQ ID NO: 5639196 - DNA, 21 bp, Homo sapiens
tatgcaggcagattaataaca

SEQ ID NO: 5639197 - DNA, 13 bp, Homo sapiens
tatgcagggaggc

SEQ ID NO: 5639198 - DNA, 18 bp, Homo sapiens
tatgcagtactaaaatta

SEQ ID NO: 5639199 - DNA, 19 bp, Homo sapiens
tatgcagtattgagcactg

SEQ ID NO: 5639200 - DNA, 23 bp, Homo sapiens
tatgcagtctctttattttacta

SEQ ID NO: 5639201 - DNA, 13 bp, Homo sapiens
tatgcagtgaact

SEQ ID NO: 5639202 - DNA, 18 bp, Homo sapiens
tatgcagtgaactatttt

SEQ ID NO: 5639203 - DNA, 23 bp, Homo sapiens
tatgcagttgataagaggaattt

SEQ ID NO: 5639204 - DNA, 17 bp, Homo sapiens
tatgcataaaaaaatga

SEQ ID NO: 5639205 - DNA, 13 bp, Homo sapiens
tatgcataaagcc

SEQ ID NO: 5639206 - DNA, 17 bp, Homo sapiens
tatgcatatatatgtat

SEQ ID NO: 5639207 - DNA, 23 bp, Homo sapiens
tatgcatcagataacaactgtga

SEQ ID NO: 5639208 - DNA, 17 bp, Homo sapiens
tatgcatcatttcagga

SEQ ID NO: 5639209 - DNA, 18 bp, Homo sapiens
tatgcatcatttcaggag

SEQ ID NO: 5639210 - DNA, 17 bp, Homo sapiens
tatgcatctttgagaat

SEQ ID NO: 5639211 - DNA, 13 bp, Homo sapiens
tatgcatgaagta

SEQ ID NO: 5639212 - DNA, 22 bp, Homo sapiens
tatgcatgaagtaatatgcaca

SEQ ID NO: 5639213 - DNA, 16 bp, Homo sapiens
tatgcatgagaactaa

SEQ ID NO: 5639214 - DNA, 17 bp, Homo sapiens
tatgcatgcagtcttgt

SEQ ID NO: 5639215 - DNA, 12 bp, Homo sapiens
tatgcatgccag

SEQ ID NO: 5639216 - DNA, 18 bp, Homo sapiens
tatgcatgcccttccttt

SEQ ID NO: 5639217 - DNA, 19 bp, Homo sapiens
tatgcatgctaaattatta

SEQ ID NO: 5639218 - DNA, 20 bp, Homo sapiens
tatgcatggaaacctgaaaa

SEQ ID NO: 5639219 - DNA, 20 bp, Homo sapiens
tatgcatggtgccccaggac

SEQ ID NO: 5639220 - DNA, 23 bp, Homo sapiens
tatgcatggtgccccaggaccag

SEQ ID NO: 5639221 - DNA, 22 bp, Homo sapiens
tatgcatggtgtagatgccctg

SEQ ID NO: 5639222 - DNA, 18 bp, Homo sapiens
tatgcatggtttcagcac

SEQ ID NO: 5639223 - DNA, 19 bp, Homo sapiens
tatgcatggtttcagcact

SEQ ID NO: 5639224 - DNA, 20 bp, Homo sapiens
tatgcatggtttcagcacta

SEQ ID NO: 5639225 - DNA, 15 bp, Homo sapiens
tatgcatgtagcata

SEQ ID NO: 5639226 - DNA, 14 bp, Homo sapiens
tatgcatgtgtgtg

SEQ ID NO: 5639227 - DNA, 22 bp, Homo sapiens
tatgcatgttgtctaagaaatt

SEQ ID NO: 5639228 - DNA, 12 bp, Homo sapiens
tatgcattcaca

SEQ ID NO: 5639229 - DNA, 12 bp, Homo sapiens
tatgcattcttt

SEQ ID NO: 5639230 - DNA, 21 bp, Homo sapiens
tatgcatttaaatacagtctt

SEQ ID NO: 5639231 - DNA, 12 bp, Homo sapiens
tatgcatttatg

SEQ ID NO: 5639232 - DNA, 14 bp, Homo sapiens
tatgcatttatgca

SEQ ID NO: 5639233 - DNA, 16 bp, Homo sapiens
tatgcatttatgcatg

SEQ ID NO: 5639234 - DNA, 13 bp, Homo sapiens
tatgcatttcatt

SEQ ID NO: 5639235 - DNA, 23 bp, Homo sapiens
tatgcatttcattcaaatcagtg

SEQ ID NO: 5639236 - DNA, 24 bp, Homo sapiens
tatgcatttgaaaattttgatgtt

SEQ ID NO: 5639237 - DNA, 15 bp, Homo sapiens
tatgcattttcttca

SEQ ID NO: 5639238 - DNA, 16 bp, Homo sapiens
tatgcattttcttcac

SEQ ID NO: 5639239 - DNA, 20 bp, Homo sapiens
tatgcattttcttcacagtg

SEQ ID NO: 5639240 - DNA, 19 bp, Homo sapiens
tatgccaaatgttaactgc

SEQ ID NO: 5639241 - DNA, 19 bp, Homo sapiens
tatgccaagtccctggaaa

SEQ ID NO: 5639242 - DNA, 23 bp, Homo sapiens
tatgccaccagcgaactctcaga

SEQ ID NO: 5639243 - DNA, 14 bp, Homo sapiens
tatgccacctgcag

SEQ ID NO: 5639244 - DNA, 15 bp, Homo sapiens
tatgccacctgcagc

SEQ ID NO: 5639245 - DNA, 16 bp, Homo sapiens
tatgccacctgcagcg

SEQ ID NO: 5639246 - DNA, 20 bp, Homo sapiens
tatgccacctgcagcgtctg

SEQ ID NO: 5639247 - DNA, 22 bp, Homo sapiens
tatgccactgcactccagcctg

SEQ ID NO: 5639248 - DNA, 14 bp, Homo sapiens
tatgccacttcctt

SEQ ID NO: 5639249 - DNA, 14 bp, Homo sapiens
tatgccagctcagt

SEQ ID NO: 5639250 - DNA, 23 bp, Homo sapiens
tatgccagcttggacatcagtgt

SEQ ID NO: 5639251 - DNA, 17 bp, Homo sapiens
tatgccaggctgtgcta

SEQ ID NO: 5639252 - DNA, 22 bp, Homo sapiens
tatgccagtgactgctgcgctg

SEQ ID NO: 5639253 - DNA, 14 bp, Homo sapiens
tatgccatgatgga

SEQ ID NO: 5639254 - DNA, 18 bp, Homo sapiens
tatgccatgatttttggt

SEQ ID NO: 5639255 - DNA, 18 bp, Homo sapiens
tatgccatgttaatattt

SEQ ID NO: 5639256 - DNA, 14 bp, Homo sapiens
tatgccattaaaaa

SEQ ID NO: 5639257 - DNA, 16 bp, Homo sapiens
tatgccattgcactcc

SEQ ID NO: 5639258 - DNA, 23 bp, Homo sapiens
tatgccatttcttctctctgttc

SEQ ID NO: 5639259 - DNA, 23 bp, Homo sapiens
tatgcccacatttagtctcttta

SEQ ID NO: 5639260 - DNA, 13 bp, Homo sapiens
tatgcccagctgt

SEQ ID NO: 5639261 - DNA, 17 bp, Homo sapiens
tatgcccagctgtgctg

SEQ ID NO: 5639262 - DNA, 18 bp, Homo sapiens
tatgcccagtttctgcct

SEQ ID NO: 5639263 - DNA, 20 bp, Homo sapiens
tatgccctcagatggagaca

SEQ ID NO: 5639264 - DNA, 13 bp, Homo sapiens
tatgccctgcaga

SEQ ID NO: 5639265 - DNA, 18 bp, Homo sapiens
tatgccctgcagagcaat

SEQ ID NO: 5639266 - DNA, 22 bp, Homo sapiens
tatgccctgcagagcaataaca

SEQ ID NO: 5639267 - DNA, 16 bp, Homo sapiens
tatgccggatgtgctt

SEQ ID NO: 5639268 - DNA, 23 bp, Homo sapiens
tatgccggatgtgcttttctcca

SEQ ID NO: 5639269 - DNA, 13 bp, Homo sapiens
tatgcctacagcc

SEQ ID NO: 5639270 - DNA, 15 bp, Homo sapiens
tatgcctatatttat

SEQ ID NO: 5639271 - DNA, 16 bp, Homo sapiens
tatgcctccatttcag

SEQ ID NO: 5639272 - DNA, 14 bp, Homo sapiens
tatgcctctccttt

SEQ ID NO: 5639273 - DNA, 15 bp, Homo sapiens
tatgcctctcctttg

SEQ ID NO: 5639274 - DNA, 17 bp, Homo sapiens
tatgcctctcctttgta

SEQ ID NO: 5639275 - DNA, 16 bp, Homo sapiens
tatgcctctgtattta

SEQ ID NO: 5639276 - DNA, 20 bp, Homo sapiens
tatgcctgagttataaatat

SEQ ID NO: 5639277 - DNA, 18 bp, Homo sapiens
tatgcctgattcatagta

SEQ ID NO: 5639278 - DNA, 18 bp, Homo sapiens
tatgcctgcactgggaag

SEQ ID NO: 5639279 - DNA, 22 bp, Homo sapiens
tatgcctgcgccatcttcacat

SEQ ID NO: 5639280 - DNA, 23 bp, Homo sapiens
tatgcctgcgccatcttcacatt

SEQ ID NO: 5639281 - DNA, 14 bp, Homo sapiens
tatgcctgctcttt

SEQ ID NO: 5639282 - DNA, 17 bp, Homo sapiens
tatgcctgttgcaggca

SEQ ID NO: 5639283 - DNA, 13 bp, Homo sapiens
tatgccttaattt

SEQ ID NO: 5639284 - DNA, 21 bp, Homo sapiens
tatgccttaatttagaaactg

SEQ ID NO: 5639285 - DNA, 23 bp, Homo sapiens
tatgccttaatttagaaactgaa

SEQ ID NO: 5639286 - DNA, 18 bp, Homo sapiens
tatgccttatgtaattat

SEQ ID NO: 5639287 - DNA, 23 bp, Homo sapiens
tatgccttatgtaattattttct

SEQ ID NO: 5639288 - DNA, 13 bp, Homo sapiens
tatgccttcaaat

SEQ ID NO: 5639289 - DNA, 14 bp, Homo sapiens
tatgccttcaaata

SEQ ID NO: 5639290 - DNA, 16 bp, Homo sapiens
tatgccttcactacaa

SEQ ID NO: 5639291 - DNA, 17 bp, Homo sapiens
tatgccttcctgtttaa

SEQ ID NO: 5639292 - DNA, 14 bp, Homo sapiens
tatgccttcttatt

SEQ ID NO: 5639293 - DNA, 18 bp, Homo sapiens
tatgccttggggaggaca

SEQ ID NO: 5639294 - DNA, 14 bp, Homo sapiens
tatgcctttagtca

SEQ ID NO: 5639295 - DNA, 15 bp, Homo sapiens
tatgcgcaaatacaa

SEQ ID NO: 5639296 - DNA, 21 bp, Homo sapiens
tatgcgccctggtatgtgcct

SEQ ID NO: 5639297 - DNA, 18 bp, Homo sapiens
tatgcggtgacggcgggg

SEQ ID NO: 5639298 - DNA, 21 bp, Homo sapiens
tatgcggttcttacagcacat

SEQ ID NO: 5639299 - DNA, 13 bp, Homo sapiens
tatgctaaatgtt

SEQ ID NO: 5639300 - DNA, 14 bp, Homo sapiens
tatgctaagaattt

SEQ ID NO: 5639301 - DNA, 15 bp, Homo sapiens
tatgctaattgaaca

SEQ ID NO: 5639302 - DNA, 18 bp, Homo sapiens
tatgctacacatatgtgc

SEQ ID NO: 5639303 - DNA, 23 bp, Homo sapiens
tatgtaggtaaaagtagaagcat

SEQ ID NO: 5639304 - DNA, 17 bp, Homo sapiens
tatgtaggtaagactgt

SEQ ID NO: 5639305 - DNA, 15 bp, Homo sapiens
tatgtagtcataata

SEQ ID NO: 5639306 - DNA, 18 bp, Homo sapiens
tatgtagtcataataaat

SEQ ID NO: 5639307 - DNA, 13 bp, Homo sapiens
tatgtagtggttt

SEQ ID NO: 5639308 - DNA, 17 bp, Homo sapiens
tatgtataaaatgtaac

SEQ ID NO: 5639309 - DNA, 12 bp, Homo sapiens
tatgtataaaca

SEQ ID NO: 5639310 - DNA, 13 bp, Homo sapiens
tatgtataaacat

SEQ ID NO: 5639311 - DNA, 17 bp, Homo sapiens
tatgtataaattaatac

SEQ ID NO: 5639312 - DNA, 16 bp, Homo sapiens
tatgtataatatatat

SEQ ID NO: 5639313 - DNA, 15 bp, Homo sapiens
tatgtataattcaaa

SEQ ID NO: 5639314 - DNA, 15 bp, Homo sapiens
tatgtataatttcac

SEQ ID NO: 5639315 - DNA, 9 bp, Homo sapiens
tatgtatac

SEQ ID NO: 5639316 - DNA, 12 bp, Homo sapiens
tatgtatacaca

SEQ ID NO: 5639317 - DNA, 15 bp, Homo sapiens
tatgtatacacacat

SEQ ID NO: 5639318 - DNA, 17 bp, Homo sapiens
tatgtatacacacatat

SEQ ID NO: 5639319 - DNA, 21 bp, Homo sapiens
tatgtatacacacatatacat

SEQ ID NO: 5639320 - DNA, 22 bp, Homo sapiens
tatgtatacacacatatacata

SEQ ID NO: 5639321 - DNA, 13 bp, Homo sapiens
tatgtatacatat

SEQ ID NO: 5639322 - DNA, 24 bp, Homo sapiens
tatgtatacatatagatagataat

SEQ ID NO: 5639323 - DNA, 13 bp, Homo sapiens
tatgtatacatgt

SEQ ID NO: 5639324 - DNA, 16 bp, Homo sapiens
tatgtatacgcacgca

SEQ ID NO: 5639325 - DNA, 23 bp, Homo sapiens
tatgtatacttatcttgctccat

SEQ ID NO: 5639326 - DNA, 14 bp, Homo sapiens
tatgtatagaaaat

SEQ ID NO: 5639327 - DNA, 15 bp, Homo sapiens
tatgtatagaaaata

SEQ ID NO: 5639328 - DNA, 19 bp, Homo sapiens
tatgtatatatatgtatgt

SEQ ID NO: 5639329 - DNA, 20 bp, Homo sapiens
tatgtatatatatgtatgta

SEQ ID NO: 5639330 - DNA, 15 bp, Homo sapiens
tatgtatatatattc

SEQ ID NO: 5639331 - DNA, 14 bp, Homo sapiens
tatgtatatcttct

SEQ ID NO: 5639332 - DNA, 16 bp, Homo sapiens
tatgtatatgtatatc

SEQ ID NO: 5639333 - DNA, 19 bp, Homo sapiens
tatgtatatgtatatctat

SEQ ID NO: 5639334 - DNA, 18 bp, Homo sapiens
tatgtatattaaaaaaga

SEQ ID NO: 5639335 - DNA, 17 bp, Homo sapiens
tatgtatattctatttt

SEQ ID NO: 5639336 - DNA, 16 bp, Homo sapiens
tatgtatattttaata

SEQ ID NO: 5639337 - DNA, 23 bp, Homo sapiens
tatgtatctaaatgaaaagagaa

SEQ ID NO: 5639338 - DNA, 15 bp, Homo sapiens
tatgtatcttagtta

SEQ ID NO: 5639339 - DNA, 22 bp, Homo sapiens
tatgtatctttataattgatga

SEQ ID NO: 5639340 - DNA, 18 bp, Homo sapiens
tatgtatggatatatttg

SEQ ID NO: 5639341 - DNA, 17 bp, Homo sapiens
tatgtatggtgcaatgt

SEQ ID NO: 5639342 - DNA, 19 bp, Homo sapiens
tatgtatgtgccaattttg

SEQ ID NO: 5639343 - DNA, 20 bp, Homo sapiens
tatgtatgtgccaattttgt

SEQ ID NO: 5639344 - DNA, 13 bp, Homo sapiens
tatgtatgtgttt

SEQ ID NO: 5639345 - DNA, 16 bp, Homo sapiens
tatgtatgtgtttaga

SEQ ID NO: 5639346 - DNA, 22 bp, Homo sapiens
tatgtatgtgtttagaattgaa

SEQ ID NO: 5639347 - DNA, 13 bp, Homo sapiens
tatgtatgttaat

SEQ ID NO: 5639348 - DNA, 14 bp, Homo sapiens
tatgtattaacact

SEQ ID NO: 5639349 - DNA, 22 bp, Homo sapiens
tatgtattaacactactcaaag

SEQ ID NO: 5639350 - DNA, 14 bp, Homo sapiens
tatgtattaacttg

SEQ ID NO: 5639351 - DNA, 19 bp, Homo sapiens
tatgtattaagccaaacat

SEQ ID NO: 5639352 - DNA, 18 bp, Homo sapiens
tatgtattaataaataga

SEQ ID NO: 5639353 - DNA, 16 bp, Homo sapiens
tatgtattaccagccc

SEQ ID NO: 5639354 - DNA, 18 bp, Homo sapiens
tatgtattaccagccccc

SEQ ID NO: 5639355 - DNA, 21 bp, Homo sapiens
tatgtattatttataattcct

SEQ ID NO: 5639356 - DNA, 20 bp, Homo sapiens
tatgtattcccttcctctga

SEQ ID NO: 5639357 - DNA, 22 bp, Homo sapiens
tatgtattcccttgtattttgt

SEQ ID NO: 5639358 - DNA, 15 bp, Homo sapiens
tatgtattctcttct

SEQ ID NO: 5639359 - DNA, 16 bp, Homo sapiens
tatgtattctgtaaaa

SEQ ID NO: 5639360 - DNA, 14 bp, Homo sapiens
tatgtattcttttc

SEQ ID NO: 5639361 - DNA, 14 bp, Homo sapiens
tatgtatttaaaaa

SEQ ID NO: 5639362 - DNA, 21 bp, Homo sapiens
tatgtatttaagatgtacatt

SEQ ID NO: 5639363 - DNA, 22 bp, Homo sapiens
tatgtatttataatttaaatga

SEQ ID NO: 5639364 - DNA, 15 bp, Homo sapiens
tatgtattttaaaat

SEQ ID NO: 5639365 - DNA, 16 bp, Homo sapiens
tatgtattttatgtat

SEQ ID NO: 5639366 - DNA, 19 bp, Homo sapiens
tatgtattttccaagtaaa

SEQ ID NO: 5639367 - DNA, 15 bp, Homo sapiens
tatgtattttcctaa

SEQ ID NO: 5639368 - DNA, 13 bp, Homo sapiens
tatgtcaaaaata

SEQ ID NO: 5639369 - DNA, 16 bp, Homo sapiens
tatgtcaaaaatattt

SEQ ID NO: 5639370 - DNA, 17 bp, Homo sapiens
tatgtcaaaaatatttt

SEQ ID NO: 5639371 - DNA, 11 bp, Homo sapiens
tatgtcaaatt

SEQ ID NO: 5639372 - DNA, 16 bp, Homo sapiens
tatgtcaatcttaaga

SEQ ID NO: 5639373 - DNA, 18 bp, Homo sapiens
tatgtcaattcattaata

SEQ ID NO: 5639374 - DNA, 11 bp, Homo sapiens
tatgtcactca

SEQ ID NO: 5639375 - DNA, 18 bp, Homo sapiens
tatgtcagacatgaaaac

SEQ ID NO: 5639376 - DNA, 13 bp, Homo sapiens
tatgtcagcagct

SEQ ID NO: 5639377 - DNA, 16 bp, Homo sapiens
tatgtcagcagctctg

SEQ ID NO: 5639378 - DNA, 15 bp, Homo sapiens
tatgtcagtccctgg

SEQ ID NO: 5639379 - DNA, 16 bp, Homo sapiens
tatgtcagtgatgact

SEQ ID NO: 5639380 - DNA, 12 bp, Homo sapiens
tatgtcagttat

SEQ ID NO: 5639381 - DNA, 13 bp, Homo sapiens
tatgtcatagaaa

SEQ ID NO: 5639382 - DNA, 18 bp, Homo sapiens
tatgtcatagtttaattg

SEQ ID NO: 5639383 - DNA, 15 bp, Homo sapiens
tatgtcatgcctcac

SEQ ID NO: 5639384 - DNA, 13 bp, Homo sapiens
tatgtcattaaag

SEQ ID NO: 5639385 - DNA, 16 bp, Homo sapiens
tatgtcattatttatt

SEQ ID NO: 5639386 - DNA, 17 bp, Homo sapiens
tatgtcattatttattg

SEQ ID NO: 5639387 - DNA, 22 bp, Homo sapiens
tatgtcattatttattgttaaa

SEQ ID NO: 5639388 - DNA, 12 bp, Homo sapiens
tatgtcatttca

SEQ ID NO: 5639389 - DNA, 15 bp, Homo sapiens
tatgtcatttcatgt

SEQ ID NO: 5639390 - DNA, 17 bp, Homo sapiens
tatgtcattttcagatc

SEQ ID NO: 5639391 - DNA, 19 bp, Homo sapiens
tatgtcatttttaatgtat

SEQ ID NO: 5639392 - DNA, 22 bp, Homo sapiens
tatgtccaccacttcaggggat

SEQ ID NO: 5639393 - DNA, 15 bp, Homo sapiens
tatgtccactgttct

SEQ ID NO: 5639394 - DNA, 20 bp, Homo sapiens
tatgtccagaagagtcaaag

SEQ ID NO: 5639395 - DNA, 21 bp, Homo sapiens
tatgtccagaagagtcaaagt

SEQ ID NO: 5639396 - DNA, 23 bp, Homo sapiens
tatgtccagaagagtcaaagtag

SEQ ID NO: 5639397 - DNA, 15 bp, Homo sapiens
tatgtccatatctaa

SEQ ID NO: 5639398 - DNA, 14 bp, Homo sapiens
tatgtccattcact

SEQ ID NO: 5639399 - DNA, 14 bp, Homo sapiens
tatgtcccagcccc

SEQ ID NO: 5639400 - DNA, 13 bp, Homo sapiens
tatgtcccatgac

SEQ ID NO: 5639401 - DNA, 22 bp, Homo sapiens
tatgtccccataagacaaacac

SEQ ID NO: 5639402 - DNA, 18 bp, Homo sapiens
tatgtccggctttaacta

SEQ ID NO: 5639403 - DNA, 16 bp, Homo sapiens
tatgtcgatgcacagt

SEQ ID NO: 5639404 - DNA, 22 bp, Homo sapiens
tatgtcgtagaattccttcgaa

SEQ ID NO: 5639405 - DNA, 20 bp, Homo sapiens
tatgtcgtcgagctcccccc

SEQ ID NO: 5639406 - DNA, 16 bp, Homo sapiens
tatgtctaaagagctt

SEQ ID NO: 5639407 - DNA, 16 bp, Homo sapiens
tatgtctagaaagtaa

SEQ ID NO: 5639408 - DNA, 18 bp, Homo sapiens
tatgtctagagcctcttg

SEQ ID NO: 5639409 - DNA, 16 bp, Homo sapiens
tatgtctagataaaag

SEQ ID NO: 5639410 - DNA, 18 bp, Homo sapiens
tatgtctagcacatgttg

SEQ ID NO: 5639411 - DNA, 14 bp, Homo sapiens
tatgtctatgtgta

SEQ ID NO: 5639412 - DNA, 18 bp, Homo sapiens
tatgtctatgtgtatata

SEQ ID NO: 5639413 - DNA, 14 bp, Homo sapiens
tatgtctcatgttt

SEQ ID NO: 5639414 - DNA, 22 bp, Homo sapiens
tatgtctctagcagtgagtact

SEQ ID NO: 5639415 - DNA, 13 bp, Homo sapiens
tatgtctctgcct

SEQ ID NO: 5639416 - DNA, 18 bp, Homo sapiens
tatgtctcttgagcatca

SEQ ID NO: 5639417 - DNA, 19 bp, Homo sapiens
tatgtctcttgagcatcaa

SEQ ID NO: 5639418 - DNA, 13 bp, Homo sapiens
tatgtctgcaggt

SEQ ID NO: 5639419 - DNA, 18 bp, Homo sapiens
tatgtctgctcctttccc

SEQ ID NO: 5639420 - DNA, 21 bp, Homo sapiens
tatgtctgcttctgtccagga

SEQ ID NO: 5639421 - DNA, 21 bp, Homo sapiens
tatgtctggttctcaattcca

SEQ ID NO: 5639422 - DNA, 22 bp, Homo sapiens
tatgtctggttctcaattccaa

SEQ ID NO: 5639423 - DNA, 17 bp, Homo sapiens
tatgtctgtctttgcaa

SEQ ID NO: 5639424 - DNA, 11 bp, Homo sapiens
tatgtctgtga

SEQ ID NO: 5639425 - DNA, 12 bp, Homo sapiens
tatgtctgtgat

SEQ ID NO: 5639426 - DNA, 13 bp, Homo sapiens
tatgtctgtgcca

SEQ ID NO: 5639427 - DNA, 14 bp, Homo sapiens
tatgtctgtgtatg

SEQ ID NO: 5639428 - DNA, 16 bp, Homo sapiens
tatgtctgtgtatgta

SEQ ID NO: 5639429 - DNA, 16 bp, Homo sapiens
tatgtctgtttaagaa

SEQ ID NO: 5639430 - DNA, 14 bp, Homo sapiens
tatgtcttataaga

SEQ ID NO: 5639431 - DNA, 22 bp, Homo sapiens
tatgtcttattttattatttct

SEQ ID NO: 5639432 - DNA, 16 bp, Homo sapiens
tatgtcttcaaaatat

SEQ ID NO: 5639433 - DNA, 15 bp, Homo sapiens
tatgtcttcttttgt

SEQ ID NO: 5639434 - DNA, 15 bp, Homo sapiens
tatgtcttgaaacat

SEQ ID NO: 5639435 - DNA, 22 bp, Homo sapiens
tatgtcttgcaaagcctttaaa

SEQ ID NO: 5639436 - DNA, 17 bp, Homo sapiens
tatgtcttggacactgt

SEQ ID NO: 5639437 - DNA, 21 bp, Homo sapiens
tatgtcttggacactgtacaa

SEQ ID NO: 5639438 - DNA, 17 bp, Homo sapiens
tatgtcttttatatttg

SEQ ID NO: 5639439 - DNA, 23 bp, Homo sapiens
tatgtcttttgatgaatagaagt

SEQ ID NO: 5639440 - DNA, 15 bp, Homo sapiens
tatgtgaaacaatgt

SEQ ID NO: 5639441 - DNA, 17 bp, Homo sapiens
tatgtgaaacatgtttc

SEQ ID NO: 5639442 - DNA, 17 bp, Homo sapiens
tatgtgaaactctatta

SEQ ID NO: 5639443 - DNA, 20 bp, Homo sapiens
tatgtgaaaggaacattttt

SEQ ID NO: 5639444 - DNA, 22 bp, Homo sapiens
tatgtgaaaggatatgaatctg

SEQ ID NO: 5639445 - DNA, 16 bp, Homo sapiens
tatgtgaaagtgtaaa

SEQ ID NO: 5639446 - DNA, 21 bp, Homo sapiens
tatgtgaaagtgtaaaataga

SEQ ID NO: 5639447 - DNA, 18 bp, Homo sapiens
tatgtgaaatgctttctg

SEQ ID NO: 5639448 - DNA, 22 bp, Homo sapiens
tatgtgaacaaatcaaattgct

SEQ ID NO: 5639449 - DNA, 16 bp, Homo sapiens
tatgtgaacattccta

SEQ ID NO: 5639450 - DNA, 14 bp, Homo sapiens
tatgtgaacattta

SEQ ID NO: 5639451 - DNA, 19 bp, Homo sapiens
tatgtgaaggtgtttcaaa

SEQ ID NO: 5639452 - DNA, 22 bp, Homo sapiens
tatgtgaatatttgtaaaaata

SEQ ID NO: 5639453 - DNA, 13 bp, Homo sapiens
tatgtgaatctgg

SEQ ID NO: 5639454 - DNA, 12 bp, Homo sapiens
tatgtgaatgat

SEQ ID NO: 5639455 - DNA, 14 bp, Homo sapiens
tatgtgaatttgag

SEQ ID NO: 5639456 - DNA, 22 bp, Homo sapiens
tatgtgacaacatttttgtaca

SEQ ID NO: 5639457 - DNA, 14 bp, Homo sapiens
tatgtgacattaac

SEQ ID NO: 5639458 - DNA, 19 bp, Homo sapiens
tatgtgacatttctcttcc

SEQ ID NO: 5639459 - DNA, 14 bp, Homo sapiens
tatgtgacatttta

SEQ ID NO: 5639460 - DNA, 15 bp, Homo sapiens
tatgtgacttttctg

SEQ ID NO: 5639461 - DNA, 20 bp, Homo sapiens
tatgtgagaaatcagaattg

SEQ ID NO: 5639462 - DNA, 12 bp, Homo sapiens
tatgtgagaaca

SEQ ID NO: 5639463 - DNA, 17 bp, Homo sapiens
tatgtgagcgagcaagc

SEQ ID NO: 5639464 - DNA, 20 bp, Homo sapiens
tatgtgagctaggagaaggg

SEQ ID NO: 5639465 - DNA, 23 bp, Homo sapiens
tatgtgagctaggagaagggctg

SEQ ID NO: 5639466 - DNA, 15 bp, Homo sapiens
tatgtgaggtaatta

SEQ ID NO: 5639467 - DNA, 19 bp, Homo sapiens
tatgtgagtagtcttatgt

SEQ ID NO: 5639468 - DNA, 19 bp, Homo sapiens
tatgtgagtgaaagtactt

SEQ ID NO: 5639469 - DNA, 13 bp, Homo sapiens
tatgtgagtgtgt

SEQ ID NO: 5639470 - DNA, 23 bp, Homo sapiens
tatgtgagtgtgtgtttgtgctg

SEQ ID NO: 5639471 - DNA, 17 bp, Homo sapiens
tatgtgagtttcagaaa

SEQ ID NO: 5639472 - DNA, 20 bp, Homo sapiens
tatgtgagtttcagaaattc

SEQ ID NO: 5639473 - DNA, 20 bp, Homo sapiens
tatgtgatatctgaacacat

SEQ ID NO: 5639474 - DNA, 13 bp, Homo sapiens
tatgtgatgaaac

SEQ ID NO: 5639475 - DNA, 13 bp, Homo sapiens
tatgtgatgccaa

SEQ ID NO: 5639476 - DNA, 16 bp, Homo sapiens
tatgtgattttaactc

SEQ ID NO: 5639477 - DNA, 15 bp, Homo sapiens
tatgtgattttcaaa

SEQ ID NO: 5639478 - DNA, 20 bp, Homo sapiens
tatgtgcaaggtgataggaa

SEQ ID NO: 5639479 - DNA, 15 bp, Homo sapiens
tatgtgcacatgtgt

SEQ ID NO: 5639480 - DNA, 21 bp, Homo sapiens
tatgtgcacatgtgtctgtgt

SEQ ID NO: 5639481 - DNA, 12 bp, Homo sapiens
tatgtgcactgt

SEQ ID NO: 5639482 - DNA, 17 bp, Homo sapiens
tatgtgcactgtcactt

SEQ ID NO: 5639483 - DNA, 14 bp, Homo sapiens
tattacttctgcta

SEQ ID NO: 5639484 - DNA, 13 bp, Homo sapiens
tattacttctgtt

SEQ ID NO: 5639485 - DNA, 17 bp, Homo sapiens
tattacttctgtttctc

SEQ ID NO: 5639486 - DNA, 12 bp, Homo sapiens
tattacttgaac

SEQ ID NO: 5639487 - DNA, 21 bp, Homo sapiens
tattacttgaactttccaaaa

SEQ ID NO: 5639488 - DNA, 14 bp, Homo sapiens
tattacttggcaaa

SEQ ID NO: 5639489 - DNA, 19 bp, Homo sapiens
tattacttgtaaatataaa

SEQ ID NO: 5639490 - DNA, 23 bp, Homo sapiens
tattacttgtaaatataaagacg

SEQ ID NO: 5639491 - DNA, 21 bp, Homo sapiens
tattacttgtttgtaagattt

SEQ ID NO: 5639492 - DNA, 15 bp, Homo sapiens
tattactttaaatta

SEQ ID NO: 5639493 - DNA, 21 bp, Homo sapiens
tattactttatgaacaatttt

SEQ ID NO: 5639494 - DNA, 17 bp, Homo sapiens
tattactttctgccgct

SEQ ID NO: 5639495 - DNA, 16 bp, Homo sapiens
tattactttgtctttt

SEQ ID NO: 5639496 - DNA, 20 bp, Homo sapiens
tattactttgtcttttcaat

SEQ ID NO: 5639497 - DNA, 17 bp, Homo sapiens
tattacttttctgcaat

SEQ ID NO: 5639498 - DNA, 14 bp, Homo sapiens
tattacttttgtaa

SEQ ID NO: 5639499 - DNA, 15 bp, Homo sapiens
tattacttttgtaaa

SEQ ID NO: 5639500 - DNA, 17 bp, Homo sapiens
tattacttttgtaaata

SEQ ID NO: 5639501 - DNA, 18 bp, Homo sapiens
tattacttttgtaaatat

SEQ ID NO: 5639502 - DNA, 18 bp, Homo sapiens
tattagaaaactttgtta

SEQ ID NO: 5639503 - DNA, 12 bp, Homo sapiens
tattagaaagcc

SEQ ID NO: 5639504 - DNA, 19 bp, Homo sapiens
tattagaaagtgctgaatt

SEQ ID NO: 5639505 - DNA, 23 bp, Homo sapiens
tattagaaattagaaaaaaatta

SEQ ID NO: 5639506 - DNA, 17 bp, Homo sapiens
tattagaatataaaaaa

SEQ ID NO: 5639507 - DNA, 23 bp, Homo sapiens
tattagaatcaaacattttgaaa

SEQ ID NO: 5639508 - DNA, 21 bp, Homo sapiens
tattagactctctagttttat

SEQ ID NO: 5639509 - DNA, 14 bp, Homo sapiens
tattagacttctaa

SEQ ID NO: 5639510 - DNA, 23 bp, Homo sapiens
tattagacttctgttttcaatct

SEQ ID NO: 5639511 - DNA, 16 bp, Homo sapiens
tattagactttagaaa

SEQ ID NO: 5639512 - DNA, 16 bp, Homo sapiens
tattagagcattgaat

SEQ ID NO: 5639513 - DNA, 19 bp, Homo sapiens
tattagagtatttcccttc

SEQ ID NO: 5639514 - DNA, 19 bp, Homo sapiens
tattagatacacttcttaa

SEQ ID NO: 5639515 - DNA, 23 bp, Homo sapiens
tattagatacacttcttaaatac

SEQ ID NO: 5639516 - DNA, 22 bp, Homo sapiens
tattagatcaaatagttgcata

SEQ ID NO: 5639517 - DNA, 14 bp, Homo sapiens
tattagatgaatta

SEQ ID NO: 5639518 - DNA, 15 bp, Homo sapiens
tattagatgcactta

SEQ ID NO: 5639519 - DNA, 15 bp, Homo sapiens
tattagatgtgattt

SEQ ID NO: 5639520 - DNA, 16 bp, Homo sapiens
tattagatgtgattta

SEQ ID NO: 5639521 - DNA, 23 bp, Homo sapiens
tattagatgtgatttaatagtgt

SEQ ID NO: 5639522 - DNA, 15 bp, Homo sapiens
tattagatgtggttt

SEQ ID NO: 5639523 - DNA, 21 bp, Homo sapiens
tattagatgttctctatcatt

SEQ ID NO: 5639524 - DNA, 18 bp, Homo sapiens
tattagatgttttacaaa

SEQ ID NO: 5639525 - DNA, 20 bp, Homo sapiens
tattagatgttttacaaatt

SEQ ID NO: 5639526 - DNA, 13 bp, Homo sapiens
tattagattgcca

SEQ ID NO: 5639527 - DNA, 21 bp, Homo sapiens
tattagattgctgaattaagg

SEQ ID NO: 5639528 - DNA, 18 bp, Homo sapiens
tattagcatggcatattt

SEQ ID NO: 5639529 - DNA, 15 bp, Homo sapiens
tattagccaaagagg

SEQ ID NO: 5639530 - DNA, 23 bp, Homo sapiens
tattagccaactgtttccctgct

SEQ ID NO: 5639531 - DNA, 13 bp, Homo sapiens
tattagccaggat

SEQ ID NO: 5639532 - DNA, 17 bp, Homo sapiens
tattagccaggatcatg

SEQ ID NO: 5639533 - DNA, 21 bp, Homo sapiens
tattagccaggtaatgtgaat

SEQ ID NO: 5639534 - DNA, 17 bp, Homo sapiens
tattagccctgcatttt

SEQ ID NO: 5639535 - DNA, 20 bp, Homo sapiens
tattagccctgcattttcat

SEQ ID NO: 5639536 - DNA, 22 bp, Homo sapiens
tattagcccttctccatggccc

SEQ ID NO: 5639537 - DNA, 18 bp, Homo sapiens
tattagcgacaacagatt

SEQ ID NO: 5639538 - DNA, 20 bp, Homo sapiens
tattagcgacaacagattgg

SEQ ID NO: 5639539 - DNA, 23 bp, Homo sapiens
tattagcgacaacagattggatt

SEQ ID NO: 5639540 - DNA, 16 bp, Homo sapiens
tattagctttactgtt

SEQ ID NO: 5639541 - DNA, 13 bp, Homo sapiens
tattagctttctc

SEQ ID NO: 5639542 - DNA, 16 bp, Homo sapiens
tattaggaaaagatat

SEQ ID NO: 5639543 - DNA, 20 bp, Homo sapiens
tattaggaaaagatattttt

SEQ ID NO: 5639544 - DNA, 21 bp, Homo sapiens
tattaggaaaataaacagaca

SEQ ID NO: 5639545 - DNA, 19 bp, Homo sapiens
tattaggaagtgtttatgt

SEQ ID NO: 5639546 - DNA, 13 bp, Homo sapiens
tattaggagtaat

SEQ ID NO: 5639547 - DNA, 23 bp, Homo sapiens
tattaggataatacataaatgat

SEQ ID NO: 5639548 - DNA, 16 bp, Homo sapiens
tattagggactgtggt

SEQ ID NO: 5639549 - DNA, 21 bp, Homo sapiens
tattaggtgaatatggaagta

SEQ ID NO: 5639550 - DNA, 17 bp, Homo sapiens
tattaggtgcaatttca

SEQ ID NO: 5639551 - DNA, 18 bp, Homo sapiens
tattagtaataaaacatt

SEQ ID NO: 5639552 - DNA, 14 bp, Homo sapiens
tattagtaccatag

SEQ ID NO: 5639553 - DNA, 17 bp, Homo sapiens
tattagtattgtgaata

SEQ ID NO: 5639554 - DNA, 13 bp, Homo sapiens
tattagtattgtt

SEQ ID NO: 5639555 - DNA, 19 bp, Homo sapiens
tattagtattgttgtcctt

SEQ ID NO: 5639556 - DNA, 17 bp, Homo sapiens
tattagtcagagtttca

SEQ ID NO: 5639557 - DNA, 16 bp, Homo sapiens
tattagtcataaaaca

SEQ ID NO: 5639558 - DNA, 17 bp, Homo sapiens
tattagtcataaaacac

SEQ ID NO: 5639559 - DNA, 21 bp, Homo sapiens
tattagtgacctcagctttga

SEQ ID NO: 5639560 - DNA, 18 bp, Homo sapiens
tattagtgatatttctct

SEQ ID NO: 5639561 - DNA, 19 bp, Homo sapiens
tattagtgatatttctcta

SEQ ID NO: 5639562 - DNA, 21 bp, Homo sapiens
tattagtgatatttctctagt

SEQ ID NO: 5639563 - DNA, 18 bp, Homo sapiens
tattagtgttatatgaac

SEQ ID NO: 5639564 - DNA, 17 bp, Homo sapiens
tattagttaaaacacat

SEQ ID NO: 5639565 - DNA, 19 bp, Homo sapiens
tattagttaatggattaaa

SEQ ID NO: 5639566 - DNA, 16 bp, Homo sapiens
tattagttacaaagtt

SEQ ID NO: 5639567 - DNA, 23 bp, Homo sapiens
tattagttccctgtctcttgaaa

SEQ ID NO: 5639568 - DNA, 15 bp, Homo sapiens
tattagttgccaata

SEQ ID NO: 5639569 - DNA, 17 bp, Homo sapiens
tattagttgccaatatg

SEQ ID NO: 5639570 - DNA, 22 bp, Homo sapiens
tattagtttaccacttgccttt

SEQ ID NO: 5639571 - DNA, 21 bp, Homo sapiens
tattagttttctttgtaaagg

SEQ ID NO: 5639572 - DNA, 14 bp, Homo sapiens
tattagttttgatt

SEQ ID NO: 5639573 - DNA, 19 bp, Homo sapiens
tattataaaaatgtcagaa

SEQ ID NO: 5639574 - DNA, 13 bp, Homo sapiens
tattataaacaag

SEQ ID NO: 5639575 - DNA, 19 bp, Homo sapiens
tattataaacaagaatgaa

SEQ ID NO: 5639576 - DNA, 23 bp, Homo sapiens
tattataaacaagaatgaaggtt

SEQ ID NO: 5639577 - DNA, 15 bp, Homo sapiens
tattataaactataa

SEQ ID NO: 5639578 - DNA, 14 bp, Homo sapiens
tattataaactgta

SEQ ID NO: 5639579 - DNA, 14 bp, Homo sapiens
tattataaataaat

SEQ ID NO: 5639580 - DNA, 15 bp, Homo sapiens
tattataaataaatg

SEQ ID NO: 5639581 - DNA, 19 bp, Homo sapiens
tattataaataaatgccaa

SEQ ID NO: 5639582 - DNA, 15 bp, Homo sapiens
tattataaatatata

SEQ ID NO: 5639583 - DNA, 20 bp, Homo sapiens
tattataaatatatataaag

SEQ ID NO: 5639584 - DNA, 19 bp, Homo sapiens
tattataaatccaaagtaa

SEQ ID NO: 5639585 - DNA, 12 bp, Homo sapiens
tattataaatgt

SEQ ID NO: 5639586 - DNA, 18 bp, Homo sapiens
tattataaattatgttta

SEQ ID NO: 5639587 - DNA, 13 bp, Homo sapiens
tattataaattct

SEQ ID NO: 5639588 - DNA, 19 bp, Homo sapiens
tattataacaagtgtgtct

SEQ ID NO: 5639589 - DNA, 16 bp, Homo sapiens
tattataacttaaaaa

SEQ ID NO: 5639590 - DNA, 17 bp, Homo sapiens
tattataagcattgaaa

SEQ ID NO: 5639591 - DNA, 14 bp, Homo sapiens
tattataagtgctt

SEQ ID NO: 5639592 - DNA, 18 bp, Homo sapiens
tattataagttgaccttt

SEQ ID NO: 5639593 - DNA, 21 bp, Homo sapiens
tattataataatgttctctgg

SEQ ID NO: 5639594 - DNA, 23 bp, Homo sapiens
tattataatataatatggaacct

SEQ ID NO: 5639595 - DNA, 15 bp, Homo sapiens
tattataatatagaa

SEQ ID NO: 5639596 - DNA, 15 bp, Homo sapiens
tattataatcaaagc

SEQ ID NO: 5639597 - DNA, 14 bp, Homo sapiens
tattataattgttg

SEQ ID NO: 5639598 - DNA, 18 bp, Homo sapiens
tattataattgttgatat

SEQ ID NO: 5639599 - DNA, 19 bp, Homo sapiens
tattataatttttttcaat

SEQ ID NO: 5639600 - DNA, 19 bp, Homo sapiens
tattatacaggaaagcaat

SEQ ID NO: 5639601 - DNA, 12 bp, Homo sapiens
tattataccttt

SEQ ID NO: 5639602 - DNA, 18 bp, Homo sapiens
tattatactaagaaaaga

SEQ ID NO: 5639603 - DNA, 19 bp, Homo sapiens
tattatactaagaaaagat

SEQ ID NO: 5639604 - DNA, 14 bp, Homo sapiens
tattatactgtatt

SEQ ID NO: 5639605 - DNA, 21 bp, Homo sapiens
tattatactgttatccatatt

SEQ ID NO: 5639606 - DNA, 13 bp, Homo sapiens
tattatagaaatt

SEQ ID NO: 5639607 - DNA, 15 bp, Homo sapiens
tattatagaaattct

SEQ ID NO: 5639608 - DNA, 20 bp, Homo sapiens
tattatagaaattctgaatt

SEQ ID NO: 5639609 - DNA, 15 bp, Homo sapiens
tattatagacaaaag

SEQ ID NO: 5639610 - DNA, 16 bp, Homo sapiens
tattatagagcagaaa

SEQ ID NO: 5639611 - DNA, 20 bp, Homo sapiens
tattatagagcagaaattct

SEQ ID NO: 5639612 - DNA, 21 bp, Homo sapiens
tattatagcaactttaagaag

SEQ ID NO: 5639613 - DNA, 22 bp, Homo sapiens
tattatagtactgctttactgt

SEQ ID NO: 5639614 - DNA, 15 bp, Homo sapiens
tattatagtctgtac

SEQ ID NO: 5639615 - DNA, 15 bp, Homo sapiens
tattatataaacttt

SEQ ID NO: 5639616 - DNA, 15 bp, Homo sapiens
tattatataaatata

SEQ ID NO: 5639617 - DNA, 13 bp, Homo sapiens
tattatatacata

SEQ ID NO: 5639618 - DNA, 15 bp, Homo sapiens
tattatatatacatt

SEQ ID NO: 5639619 - DNA, 12 bp, Homo sapiens
tattatatatag

SEQ ID NO: 5639620 - DNA, 12 bp, Homo sapiens
tattatatatat

SEQ ID NO: 5639621 - DNA, 17 bp, Homo sapiens
tattatatatatctata

SEQ ID NO: 5639622 - DNA, 19 bp, Homo sapiens
tattatatatgtatatctg

SEQ ID NO: 5639623 - DNA, 20 bp, Homo sapiens
tattatatatttacagaaga

SEQ ID NO: 5639624 - DNA, 15 bp, Homo sapiens
tattatatggcagga

SEQ ID NO: 5639625 - DNA, 21 bp, Homo sapiens
tattatatgtaccctctgaaa

SEQ ID NO: 5639626 - DNA, 17 bp, Homo sapiens
tattatattcattcttt

SEQ ID NO: 5639627 - DNA, 13 bp, Homo sapiens
tattatatttgga

SEQ ID NO: 5639628 - DNA, 16 bp, Homo sapiens
tattatcaaaattctg

SEQ ID NO: 5639629 - DNA, 22 bp, Homo sapiens
tattatcaaagggataaagaaa

SEQ ID NO: 5639630 - DNA, 13 bp, Homo sapiens
tattatcacatta

SEQ ID NO: 5639631 - DNA, 13 bp, Homo sapiens
tattatcactgtc

SEQ ID NO: 5639632 - DNA, 14 bp, Homo sapiens
tattatcactgtct

SEQ ID NO: 5639633 - DNA, 22 bp, Homo sapiens
tattatcagttaaaatcacatt

SEQ ID NO: 5639634 - DNA, 15 bp, Homo sapiens
tattatcataagaat

SEQ ID NO: 5639635 - DNA, 18 bp, Homo sapiens
tattatcatgcaaatgct

SEQ ID NO: 5639636 - DNA, 14 bp, Homo sapiens
tattatcatggtat

SEQ ID NO: 5639637 - DNA, 20 bp, Homo sapiens
tattatcattgctcccctga

SEQ ID NO: 5639638 - DNA, 23 bp, Homo sapiens
tattatcccagcttgctgagggg

SEQ ID NO: 5639639 - DNA, 21 bp, Homo sapiens
tattatccttcacaatttcaa

SEQ ID NO: 5639640 - DNA, 14 bp, Homo sapiens
tattatccttctac

SEQ ID NO: 5639641 - DNA, 17 bp, Homo sapiens
tattatctacctgttct

SEQ ID NO: 5639642 - DNA, 14 bp, Homo sapiens
tattatctgtaaaa

SEQ ID NO: 5639643 - DNA, 13 bp, Homo sapiens
tattatctgtcag

SEQ ID NO: 5639644 - DNA, 13 bp, Homo sapiens
tattatctgtgtt

SEQ ID NO: 5639645 - DNA, 20 bp, Homo sapiens
tattatcttaaacccacata

SEQ ID NO: 5639646 - DNA, 22 bp, Homo sapiens
tattatcttaaacccacataaa

SEQ ID NO: 5639647 - DNA, 23 bp, Homo sapiens
tattatcttaaacccacataaac

SEQ ID NO: 5639648 - DNA, 20 bp, Homo sapiens
tattatcttgttcaggaaaa

SEQ ID NO: 5639649 - DNA, 13 bp, Homo sapiens
tattatctttgta

SEQ ID NO: 5639650 - DNA, 19 bp, Homo sapiens
tattatcttttcatacatt

SEQ ID NO: 5639651 - DNA, 14 bp, Homo sapiens
tattatgaaaaaga

SEQ ID NO: 5639652 - DNA, 12 bp, Homo sapiens
tattatgaaact

SEQ ID NO: 5639653 - DNA, 16 bp, Homo sapiens
tattatgaaggaattt

SEQ ID NO: 5639654 - DNA, 12 bp, Homo sapiens
tattatgaataa

SEQ ID NO: 5639655 - DNA, 12 bp, Homo sapiens
tattatgagcca

SEQ ID NO: 5639656 - DNA, 19 bp, Homo sapiens
tattatgaggctattaaaa

SEQ ID NO: 5639657 - DNA, 19 bp, Homo sapiens
tattatgatgttagaagaa

SEQ ID NO: 5639658 - DNA, 18 bp, Homo sapiens
tattatgatgttttgcaa

SEQ ID NO: 5639659 - DNA, 19 bp, Homo sapiens
tattatgatgttttgcaaa

SEQ ID NO: 5639660 - DNA, 12 bp, Homo sapiens
tattatgcaaaa

SEQ ID NO: 5639661 - DNA, 13 bp, Homo sapiens
tattctattaact

SEQ ID NO: 5639662 - DNA, 20 bp, Homo sapiens
tattctattacattttcagt

SEQ ID NO: 5639663 - DNA, 11 bp, Homo sapiens
tattctattct

SEQ ID NO: 5639664 - DNA, 14 bp, Homo sapiens
tattctattctaat

SEQ ID NO: 5639665 - DNA, 14 bp, Homo sapiens
tattctattttcat

SEQ ID NO: 5639666 - DNA, 14 bp, Homo sapiens
tattctcaccagga

SEQ ID NO: 5639667 - DNA, 13 bp, Homo sapiens
tattctcactcca

SEQ ID NO: 5639668 - DNA, 18 bp, Homo sapiens
tattctcagagcatgtgt

SEQ ID NO: 5639669 - DNA, 15 bp, Homo sapiens
tattctcatgcctca

SEQ ID NO: 5639670 - DNA, 16 bp, Homo sapiens
tattctcatgcctcag

SEQ ID NO: 5639671 - DNA, 17 bp, Homo sapiens
tattctccactttttct

SEQ ID NO: 5639672 - DNA, 16 bp, Homo sapiens
tattctccagacatgg

SEQ ID NO: 5639673 - DNA, 20 bp, Homo sapiens
tattctcctcggactgtgtg

SEQ ID NO: 5639674 - DNA, 17 bp, Homo sapiens
tattctcctgccatggg

SEQ ID NO: 5639675 - DNA, 22 bp, Homo sapiens
tattctccttctgtcaaagtca

SEQ ID NO: 5639676 - DNA, 15 bp, Homo sapiens
tattctcgaatcacc

SEQ ID NO: 5639677 - DNA, 21 bp, Homo sapiens
tattctcggctcaggttttga

SEQ ID NO: 5639678 - DNA, 16 bp, Homo sapiens
tattctctaataaaat

SEQ ID NO: 5639679 - DNA, 22 bp, Homo sapiens
tattctctcacagtgtactcta

SEQ ID NO: 5639680 - DNA, 16 bp, Homo sapiens
tattctctcctcagac

SEQ ID NO: 5639681 - DNA, 17 bp, Homo sapiens
tattctctcctcagact

SEQ ID NO: 5639682 - DNA, 17 bp, Homo sapiens
tattctctcctgtacct

SEQ ID NO: 5639683 - DNA, 18 bp, Homo sapiens
tattctctcctgtacctc

SEQ ID NO: 5639684 - DNA, 13 bp, Homo sapiens
tattctctctatg

SEQ ID NO: 5639685 - DNA, 15 bp, Homo sapiens
tattctctctatgca

SEQ ID NO: 5639686 - DNA, 18 bp, Homo sapiens
tattctctgagctgtgca

SEQ ID NO: 5639687 - DNA, 13 bp, Homo sapiens
tattctctgtaca

SEQ ID NO: 5639688 - DNA, 21 bp, Homo sapiens
tattctcttaatttttcttaa

SEQ ID NO: 5639689 - DNA, 12 bp, Homo sapiens
tattctctttgg

SEQ ID NO: 5639690 - DNA, 14 bp, Homo sapiens
tattctcttttatc

SEQ ID NO: 5639691 - DNA, 18 bp, Homo sapiens
tattctcttttatctgtt

SEQ ID NO: 5639692 - DNA, 16 bp, Homo sapiens
tattctgaagcaacat

SEQ ID NO: 5639693 - DNA, 15 bp, Homo sapiens
tattctgagaaaaca

SEQ ID NO: 5639694 - DNA, 15 bp, Homo sapiens
tattctgagatgact

SEQ ID NO: 5639695 - DNA, 12 bp, Homo sapiens
tattctgagcct

SEQ ID NO: 5639696 - DNA, 15 bp, Homo sapiens
tattctgagccttga

SEQ ID NO: 5639697 - DNA, 18 bp, Homo sapiens
tattctgcttccacatgt

SEQ ID NO: 5639698 - DNA, 14 bp, Homo sapiens
tattctggaaaaaa

SEQ ID NO: 5639699 - DNA, 19 bp, Homo sapiens
tattctggaaaaaaaatat

SEQ ID NO: 5639700 - DNA, 18 bp, Homo sapiens
tattctggggtatggcgt

SEQ ID NO: 5639701 - DNA, 18 bp, Homo sapiens
tattctgtacattttttc

SEQ ID NO: 5639702 - DNA, 19 bp, Homo sapiens
tattctgtagattctgtgg

SEQ ID NO: 5639703 - DNA, 22 bp, Homo sapiens
tattctgtatccgtgaattgct

SEQ ID NO: 5639704 - DNA, 9 bp, Homo sapiens
tattctgtc

SEQ ID NO: 5639705 - DNA, 18 bp, Homo sapiens
tattctgtcagtgttaaa

SEQ ID NO: 5639706 - DNA, 18 bp, Homo sapiens
tattctgtcatttacaca

SEQ ID NO: 5639707 - DNA, 11 bp, Homo sapiens
tattctgtccc

SEQ ID NO: 5639708 - DNA, 12 bp, Homo sapiens
tattctgtggcc

SEQ ID NO: 5639709 - DNA, 15 bp, Homo sapiens
tattctgttaaaatc

SEQ ID NO: 5639710 - DNA, 12 bp, Homo sapiens
tattctgttgct

SEQ ID NO: 5639711 - DNA, 16 bp, Homo sapiens
tattctgttggccagt

SEQ ID NO: 5639712 - DNA, 11 bp, Homo sapiens
tattctgtttt

SEQ ID NO: 5639713 - DNA, 14 bp, Homo sapiens
tattctgttttgtt

SEQ ID NO: 5639714 - DNA, 13 bp, Homo sapiens
tattcttaaaatg

SEQ ID NO: 5639715 - DNA, 13 bp, Homo sapiens
tattcttaagtaa

SEQ ID NO: 5639716 - DNA, 20 bp, Homo sapiens
tattcttcatgaaatgtgtt

SEQ ID NO: 5639717 - DNA, 21 bp, Homo sapiens
tattcttcatgaaatgtgttt

SEQ ID NO: 5639718 - DNA, 14 bp, Homo sapiens
tattcttccaagtt

SEQ ID NO: 5639719 - DNA, 12 bp, Homo sapiens
tattcttccaga

SEQ ID NO: 5639720 - DNA, 14 bp, Homo sapiens
tattcttccagaat

SEQ ID NO: 5639721 - DNA, 17 bp, Homo sapiens
tattcttctagagttca

SEQ ID NO: 5639722 - DNA, 22 bp, Homo sapiens
tattcttctcttccttttatca

SEQ ID NO: 5639723 - DNA, 17 bp, Homo sapiens
tattcttcttgaaaata

SEQ ID NO: 5639724 - DNA, 11 bp, Homo sapiens
tattcttcttt

SEQ ID NO: 5639725 - DNA, 14 bp, Homo sapiens
tattcttgaaagaa

SEQ ID NO: 5639726 - DNA, 15 bp, Homo sapiens
tattcttgaaagaag

SEQ ID NO: 5639727 - DNA, 18 bp, Homo sapiens
tattcttgaaagaagaat

SEQ ID NO: 5639728 - DNA, 23 bp, Homo sapiens
tattcttgaaagaagaatgtgtt

SEQ ID NO: 5639729 - DNA, 13 bp, Homo sapiens
tattcttgaaagt

SEQ ID NO: 5639730 - DNA, 14 bp, Homo sapiens
tattcttgaaagta

SEQ ID NO: 5639731 - DNA, 19 bp, Homo sapiens
tattcttgatcagtagttt

SEQ ID NO: 5639732 - DNA, 22 bp, Homo sapiens
tattcttgatcagtagtttgca

SEQ ID NO: 5639733 - DNA, 19 bp, Homo sapiens
tattcttgatgaaaagctt

SEQ ID NO: 5639734 - DNA, 14 bp, Homo sapiens
tattcttgatgtaa

SEQ ID NO: 5639735 - DNA, 22 bp, Homo sapiens
tattcttgctttagaaaacatt

SEQ ID NO: 5639736 - DNA, 18 bp, Homo sapiens
tattcttgctttcacaaa

SEQ ID NO: 5639737 - DNA, 22 bp, Homo sapiens
tattcttggtactgttgctttg

SEQ ID NO: 5639738 - DNA, 19 bp, Homo sapiens
tattcttgtccacattcta

SEQ ID NO: 5639739 - DNA, 22 bp, Homo sapiens
tattcttgtggttaaaaacctg

SEQ ID NO: 5639740 - DNA, 13 bp, Homo sapiens
tattcttgttata

SEQ ID NO: 5639741 - DNA, 15 bp, Homo sapiens
tattcttgtttgaat

SEQ ID NO: 5639742 - DNA, 23 bp, Homo sapiens
tattcttgttttacatttggatt

SEQ ID NO: 5639743 - DNA, 13 bp, Homo sapiens
tattctttacaaa

SEQ ID NO: 5639744 - DNA, 14 bp, Homo sapiens
tattctttactatt

SEQ ID NO: 5639745 - DNA, 21 bp, Homo sapiens
tattctttcaattctgtaggt

SEQ ID NO: 5639746 - DNA, 13 bp, Homo sapiens
tattctttcacaa

SEQ ID NO: 5639747 - DNA, 16 bp, Homo sapiens
tattctttctcataaa

SEQ ID NO: 5639748 - DNA, 23 bp, Homo sapiens
tattctttgaccaaactgtgggt

SEQ ID NO: 5639749 - DNA, 20 bp, Homo sapiens
tattctttgatgttaacaca

SEQ ID NO: 5639750 - DNA, 24 bp, Homo sapiens
tattctttgatgttaacacatttt

SEQ ID NO: 5639751 - DNA, 21 bp, Homo sapiens
tattctttgtattaccaaagc

SEQ ID NO: 5639752 - DNA, 18 bp, Homo sapiens
tattctttgtgttgataa

SEQ ID NO: 5639753 - DNA, 13 bp, Homo sapiens
tattctttgttaa

SEQ ID NO: 5639754 - DNA, 18 bp, Homo sapiens
tattcttttatataacta

SEQ ID NO: 5639755 - DNA, 12 bp, Homo sapiens
tattcttttcca

SEQ ID NO: 5639756 - DNA, 18 bp, Homo sapiens
tattcttttctgcaaaat

SEQ ID NO: 5639757 - DNA, 12 bp, Homo sapiens
tattcttttgtt

SEQ ID NO: 5639758 - DNA, 20 bp, Homo sapiens
tattcttttgttattaaaaa

SEQ ID NO: 5639759 - DNA, 15 bp, Homo sapiens
tattcttttgtttcc

SEQ ID NO: 5639760 - DNA, 14 bp, Homo sapiens
tattgaaaaaaata

SEQ ID NO: 5639761 - DNA, 21 bp, Homo sapiens
tattgaaaaatacgttttgtg

SEQ ID NO: 5639762 - DNA, 17 bp, Homo sapiens
tattgaaaaattatcag

SEQ ID NO: 5639763 - DNA, 19 bp, Homo sapiens
tattgaaaacacttagtat

SEQ ID NO: 5639764 - DNA, 13 bp, Homo sapiens
tattgaaaacttc

SEQ ID NO: 5639765 - DNA, 15 bp, Homo sapiens
tattgaaaacttcaa

SEQ ID NO: 5639766 - DNA, 22 bp, Homo sapiens
tattgaaaacttcaaagctgaa

SEQ ID NO: 5639767 - DNA, 20 bp, Homo sapiens
tattgaaaagaaaaagaaga

SEQ ID NO: 5639768 - DNA, 14 bp, Homo sapiens
tattgaaaatgtca

SEQ ID NO: 5639769 - DNA, 20 bp, Homo sapiens
tattgaaaatgtcactgtta

SEQ ID NO: 5639770 - DNA, 14 bp, Homo sapiens
tattgaaaattgaa

SEQ ID NO: 5639771 - DNA, 14 bp, Homo sapiens
tattgaaagaatta

SEQ ID NO: 5639772 - DNA, 13 bp, Homo sapiens
tattgaaagccaa

SEQ ID NO: 5639773 - DNA, 20 bp, Homo sapiens
tattgaaaggggacacctgt

SEQ ID NO: 5639774 - DNA, 22 bp, Homo sapiens
tattgaaaggggacacctgtac

SEQ ID NO: 5639775 - DNA, 23 bp, Homo sapiens
tattgaaaggggacacctgtaca

SEQ ID NO: 5639776 - DNA, 13 bp, Homo sapiens
tattgaaatatta

SEQ ID NO: 5639777 - DNA, 22 bp, Homo sapiens
tattgaaatgatttcacagtgt

SEQ ID NO: 5639778 - DNA, 15 bp, Homo sapiens
tattgaaatgctgta

SEQ ID NO: 5639779 - DNA, 16 bp, Homo sapiens
tattgaaattactgaa

SEQ ID NO: 5639780 - DNA, 15 bp, Homo sapiens
tattgaactgagcca

SEQ ID NO: 5639781 - DNA, 19 bp, Homo sapiens
tattgaacttttgtactga

SEQ ID NO: 5639782 - DNA, 17 bp, Homo sapiens
tattgaagaaaagcact

SEQ ID NO: 5639783 - DNA, 18 bp, Homo sapiens
tattgaagaaaagcactt

SEQ ID NO: 5639784 - DNA, 13 bp, Homo sapiens
tattgaagaaaca

SEQ ID NO: 5639785 - DNA, 14 bp, Homo sapiens
tattgaagacaatt

SEQ ID NO: 5639786 - DNA, 21 bp, Homo sapiens
tattgaagacaatttgataca

SEQ ID NO: 5639787 - DNA, 14 bp, Homo sapiens
tattgaagaggata

SEQ ID NO: 5639788 - DNA, 19 bp, Homo sapiens
tattgaagaggatattctt

SEQ ID NO: 5639789 - DNA, 20 bp, Homo sapiens
tattgaagcagagtggcagt

SEQ ID NO: 5639790 - DNA, 16 bp, Homo sapiens
tattgaagcattttat

SEQ ID NO: 5639791 - DNA, 20 bp, Homo sapiens
tattgaaggaagccaaattt

SEQ ID NO: 5639792 - DNA, 21 bp, Homo sapiens
tattgaaggaagccaaattta

SEQ ID NO: 5639793 - DNA, 21 bp, Homo sapiens
tattgaaggaattagaaatga

SEQ ID NO: 5639794 - DNA, 19 bp, Homo sapiens
tattgaagttgtttatcaa

SEQ ID NO: 5639795 - DNA, 22 bp, Homo sapiens
tattgaatactgtctgtatctt

SEQ ID NO: 5639796 - DNA, 13 bp, Homo sapiens
tattgaatattgt

SEQ ID NO: 5639797 - DNA, 11 bp, Homo sapiens
tattgaatcta

SEQ ID NO: 5639798 - DNA, 16 bp, Homo sapiens
tattgaatctatttaa

SEQ ID NO: 5639799 - DNA, 17 bp, Homo sapiens
tattgaatctatttaag

SEQ ID NO: 5639800 - DNA, 18 bp, Homo sapiens
tattgaatgaaacaagca

SEQ ID NO: 5639801 - DNA, 14 bp, Homo sapiens
tattgaatgcctta

SEQ ID NO: 5639802 - DNA, 15 bp, Homo sapiens
tattgaatgccttat

SEQ ID NO: 5639803 - DNA, 13 bp, Homo sapiens
tattgaatgttat

SEQ ID NO: 5639804 - DNA, 14 bp, Homo sapiens
tattgaattagaaa

SEQ ID NO: 5639805 - DNA, 15 bp, Homo sapiens
tattgaattattttg

SEQ ID NO: 5639806 - DNA, 20 bp, Homo sapiens
tattgaattattttgttact

SEQ ID NO: 5639807 - DNA, 14 bp, Homo sapiens
tattgaatttgtgt

SEQ ID NO: 5639808 - DNA, 15 bp, Homo sapiens
tattgacaaactctc

SEQ ID NO: 5639809 - DNA, 13 bp, Homo sapiens
tattgacaataat

SEQ ID NO: 5639810 - DNA, 18 bp, Homo sapiens
tattgacacagaaaatgt

SEQ ID NO: 5639811 - DNA, 20 bp, Homo sapiens
tattgacacagaaaatgttg

SEQ ID NO: 5639812 - DNA, 18 bp, Homo sapiens
tattgacactgtccctct

SEQ ID NO: 5639813 - DNA, 19 bp, Homo sapiens
tattgacactgtccctctt

SEQ ID NO: 5639814 - DNA, 19 bp, Homo sapiens
tattgacaggtcttttcaa

SEQ ID NO: 5639815 - DNA, 21 bp, Homo sapiens
tattgacaggtcttttcaaat

SEQ ID NO: 5639816 - DNA, 14 bp, Homo sapiens
tattgacatttgta

SEQ ID NO: 5639817 - DNA, 15 bp, Homo sapiens
tattgaccaccagtt

SEQ ID NO: 5639818 - DNA, 22 bp, Homo sapiens
tattgaccatgtggttcacgta

SEQ ID NO: 5639819 - DNA, 18 bp, Homo sapiens
tattgacccaaatgtgta

SEQ ID NO: 5639820 - DNA, 15 bp, Homo sapiens
tattgactctgggtc

SEQ ID NO: 5639821 - DNA, 20 bp, Homo sapiens
tattgactctgggtccttcc

SEQ ID NO: 5639822 - DNA, 14 bp, Homo sapiens
tattgacttctctt

SEQ ID NO: 5639823 - DNA, 16 bp, Homo sapiens
tattgacttctcttga

SEQ ID NO: 5639824 - DNA, 23 bp, Homo sapiens
tattgactttatgttgtatgatt

SEQ ID NO: 5639825 - DNA, 15 bp, Homo sapiens
tattgactttcttaa

SEQ ID NO: 5639826 - DNA, 14 bp, Homo sapiens
tattgactttgtct

SEQ ID NO: 5639827 - DNA, 23 bp, Homo sapiens
tattgagaagatcggaacagctc

SEQ ID NO: 5639828 - DNA, 16 bp, Homo sapiens
tattgagaataattat

SEQ ID NO: 5639829 - DNA, 13 bp, Homo sapiens
tattgagaatcag

SEQ ID NO: 5639830 - DNA, 18 bp, Homo sapiens
tattgagaatcccttaaa

SEQ ID NO: 5639831 - DNA, 22 bp, Homo sapiens
tattgagaatcccttaaaatta

SEQ ID NO: 5639832 - DNA, 14 bp, Homo sapiens
tattgagacaaaaa

SEQ ID NO: 5639833 - DNA, 16 bp, Homo sapiens
tattgagagagatgtg

SEQ ID NO: 5639834 - DNA, 21 bp, Homo sapiens
tattgagcaagtatccttcat

SEQ ID NO: 5639835 - DNA, 17 bp, Homo sapiens
tattgagcagaattcat

SEQ ID NO: 5639836 - DNA, 21 bp, Homo sapiens
tattgagcccaaaaacaagca

SEQ ID NO: 5639837 - DNA, 23 bp, Homo sapiens
tattgagccttgcatgtacttga

SEQ ID NO: 5639838 - DNA, 18 bp, Homo sapiens
tattgaggccaagaatat

SEQ ID NO: 5639839 - DNA, 23 bp, Homo sapiens
tattgaggccaagaatattgcaa

SEQ ID NO: 5639840 - DNA, 15 bp, Homo sapiens
tattgaggctttgtg

SEQ ID NO: 5639841 - DNA, 23 bp, Homo sapiens
tatttcacatgagtcaaaacaaa

SEQ ID NO: 5639842 - DNA, 18 bp, Homo sapiens
tatttcacccatctctca

SEQ ID NO: 5639843 - DNA, 18 bp, Homo sapiens
tatttcactaaatgtaaa

SEQ ID NO: 5639844 - DNA, 23 bp, Homo sapiens
tatttcactgaatttcaaacatt

SEQ ID NO: 5639845 - DNA, 16 bp, Homo sapiens
tatttcacttgatgat

SEQ ID NO: 5639846 - DNA, 16 bp, Homo sapiens
tatttcagaagtttaa

SEQ ID NO: 5639847 - DNA, 18 bp, Homo sapiens
tatttcagaatattttgt

SEQ ID NO: 5639848 - DNA, 13 bp, Homo sapiens
tatttcagacatt

SEQ ID NO: 5639849 - DNA, 15 bp, Homo sapiens
tatttcagacatttt

SEQ ID NO: 5639850 - DNA, 19 bp, Homo sapiens
tatttcagacattttcact

SEQ ID NO: 5639851 - DNA, 18 bp, Homo sapiens
tatttcagatatcaaaat

SEQ ID NO: 5639852 - DNA, 17 bp, Homo sapiens
tatttcagattcctcag

SEQ ID NO: 5639853 - DNA, 12 bp, Homo sapiens
tatttcagattt

SEQ ID NO: 5639854 - DNA, 18 bp, Homo sapiens
tatttcagattttgataa

SEQ ID NO: 5639855 - DNA, 13 bp, Homo sapiens
tatttcagtgaat

SEQ ID NO: 5639856 - DNA, 12 bp, Homo sapiens
tatttcagtgac

SEQ ID NO: 5639857 - DNA, 21 bp, Homo sapiens
tatttcagtgataatgttcat

SEQ ID NO: 5639858 - DNA, 15 bp, Homo sapiens
tatttcagtgatttt

SEQ ID NO: 5639859 - DNA, 21 bp, Homo sapiens
tatttcagtgatttttagtaa

SEQ ID NO: 5639860 - DNA, 22 bp, Homo sapiens
tatttcagtggaatagatgtct

SEQ ID NO: 5639861 - DNA, 17 bp, Homo sapiens
tatttcagtgttacctg

SEQ ID NO: 5639862 - DNA, 18 bp, Homo sapiens
tatttcagtgttacctgt

SEQ ID NO: 5639863 - DNA, 20 bp, Homo sapiens
tatttcagtgttacctgtgt

SEQ ID NO: 5639864 - DNA, 22 bp, Homo sapiens
tatttcagttattgtccctggc

SEQ ID NO: 5639865 - DNA, 13 bp, Homo sapiens
tatttcataaatt

SEQ ID NO: 5639866 - DNA, 17 bp, Homo sapiens
tatttcatacaaaactg

SEQ ID NO: 5639867 - DNA, 20 bp, Homo sapiens
tatttcatcacaagaacaca

SEQ ID NO: 5639868 - DNA, 17 bp, Homo sapiens
tatttcatgattcacaa

SEQ ID NO: 5639869 - DNA, 12 bp, Homo sapiens
tatttcatgtgg

SEQ ID NO: 5639870 - DNA, 17 bp, Homo sapiens
tatttcatgtggctgta

SEQ ID NO: 5639871 - DNA, 21 bp, Homo sapiens
tatttcatgtttttgatcaaa

SEQ ID NO: 5639872 - DNA, 16 bp, Homo sapiens
tatttcattatctgta

SEQ ID NO: 5639873 - DNA, 14 bp, Homo sapiens
tatttcattcatat

SEQ ID NO: 5639874 - DNA, 18 bp, Homo sapiens
tatttcatttattttttg

SEQ ID NO: 5639875 - DNA, 18 bp, Homo sapiens
tatttcattttttgcatc

SEQ ID NO: 5639876 - DNA, 18 bp, Homo sapiens
tatttccaaacctggttc

SEQ ID NO: 5639877 - DNA, 15 bp, Homo sapiens
tatttccaaatattc

SEQ ID NO: 5639878 - DNA, 19 bp, Homo sapiens
tatttccaaatattctaaa

SEQ ID NO: 5639879 - DNA, 13 bp, Homo sapiens
tatttccaacaaa

SEQ ID NO: 5639880 - DNA, 14 bp, Homo sapiens
tatttccaatgtga

SEQ ID NO: 5639881 - DNA, 23 bp, Homo sapiens
tatttccaatgtgaaagattatt

SEQ ID NO: 5639882 - DNA, 13 bp, Homo sapiens
tatttccacaaat

SEQ ID NO: 5639883 - DNA, 16 bp, Homo sapiens
tatttccacataaagg

SEQ ID NO: 5639884 - DNA, 17 bp, Homo sapiens
tatttccactaaaaata

SEQ ID NO: 5639885 - DNA, 16 bp, Homo sapiens
tatttccactattttc

SEQ ID NO: 5639886 - DNA, 20 bp, Homo sapiens
tatttccactattttcaaag

SEQ ID NO: 5639887 - DNA, 17 bp, Homo sapiens
tatttccactgaacaaa

SEQ ID NO: 5639888 - DNA, 18 bp, Homo sapiens
tatttccactgaacaaaa

SEQ ID NO: 5639889 - DNA, 14 bp, Homo sapiens
tatttccatattaa

SEQ ID NO: 5639890 - DNA, 15 bp, Homo sapiens
tatttcccatgattt

SEQ ID NO: 5639891 - DNA, 16 bp, Homo sapiens
tatttcccatgatttc

SEQ ID NO: 5639892 - DNA, 21 bp, Homo sapiens
tatttccccaggggaaaatga

SEQ ID NO: 5639893 - DNA, 22 bp, Homo sapiens
tatttccccaggggaaaatgaa

SEQ ID NO: 5639894 - DNA, 15 bp, Homo sapiens
tatttcccccttcat

SEQ ID NO: 5639895 - DNA, 19 bp, Homo sapiens
tatttccctaaaatacatt

SEQ ID NO: 5639896 - DNA, 21 bp, Homo sapiens
tatttccctaaaatacattta

SEQ ID NO: 5639897 - DNA, 16 bp, Homo sapiens
tatttccctacattaa

SEQ ID NO: 5639898 - DNA, 20 bp, Homo sapiens
tatttccctcccctggggac

SEQ ID NO: 5639899 - DNA, 18 bp, Homo sapiens
tatttccctctcattttg

SEQ ID NO: 5639900 - DNA, 16 bp, Homo sapiens
tatttccctttagctg

SEQ ID NO: 5639901 - DNA, 15 bp, Homo sapiens
tatttcctaaggcat

SEQ ID NO: 5639902 - DNA, 19 bp, Homo sapiens
tatttcctataccatttcc

SEQ ID NO: 5639903 - DNA, 14 bp, Homo sapiens
tatttcctctgctg

SEQ ID NO: 5639904 - DNA, 14 bp, Homo sapiens
tatttcctcttgaa

SEQ ID NO: 5639905 - DNA, 15 bp, Homo sapiens
tatttcctgaaataa

SEQ ID NO: 5639906 - DNA, 18 bp, Homo sapiens
tatttcctgaaataaatg

SEQ ID NO: 5639907 - DNA, 21 bp, Homo sapiens
tatttcctgacttgagtgttc

SEQ ID NO: 5639908 - DNA, 11 bp, Homo sapiens
tatttcctgct

SEQ ID NO: 5639909 - DNA, 19 bp, Homo sapiens
tatttcctgtattgcttta

SEQ ID NO: 5639910 - DNA, 15 bp, Homo sapiens
tatttccttaaactg

SEQ ID NO: 5639911 - DNA, 19 bp, Homo sapiens
tatttccttaaactgtgtg

SEQ ID NO: 5639912 - DNA, 19 bp, Homo sapiens
tatttccttatgtgtgtag

SEQ ID NO: 5639913 - DNA, 23 bp, Homo sapiens
tatttccttccagcctttttagg

SEQ ID NO: 5639914 - DNA, 22 bp, Homo sapiens
tatttccttggattttcctgaa

SEQ ID NO: 5639915 - DNA, 22 bp, Homo sapiens
tatttcctttgcgcaaacttta

SEQ ID NO: 5639916 - DNA, 19 bp, Homo sapiens
tatttcctttttctagttt

SEQ ID NO: 5639917 - DNA, 17 bp, Homo sapiens
tatttcgaccctggggc

SEQ ID NO: 5639918 - DNA, 19 bp, Homo sapiens
tatttcgagtgttgtgtta

SEQ ID NO: 5639919 - DNA, 17 bp, Homo sapiens
tatttcggaaatacact

SEQ ID NO: 5639920 - DNA, 16 bp, Homo sapiens
tatttcgtttggtctt

SEQ ID NO: 5639921 - DNA, 12 bp, Homo sapiens
tatttctaaacc

SEQ ID NO: 5639922 - DNA, 22 bp, Homo sapiens
tatttctaaataaaaaaattaa

SEQ ID NO: 5639923 - DNA, 14 bp, Homo sapiens
tatttctaagctta

SEQ ID NO: 5639924 - DNA, 14 bp, Homo sapiens
tatttctaagtatt

SEQ ID NO: 5639925 - DNA, 15 bp, Homo sapiens
tatttctaagtattt

SEQ ID NO: 5639926 - DNA, 17 bp, Homo sapiens
tatttctaagtatttaa

SEQ ID NO: 5639927 - DNA, 19 bp, Homo sapiens
tatttctaatccttttcct

SEQ ID NO: 5639928 - DNA, 16 bp, Homo sapiens
tatttctacagagaaa

SEQ ID NO: 5639929 - DNA, 21 bp, Homo sapiens
tatttctaccattaaaatctt

SEQ ID NO: 5639930 - DNA, 17 bp, Homo sapiens
tatttctactatataca

SEQ ID NO: 5639931 - DNA, 16 bp, Homo sapiens
tatttctactgtcaaa

SEQ ID NO: 5639932 - DNA, 18 bp, Homo sapiens
tatttctactgtcaaatg

SEQ ID NO: 5639933 - DNA, 13 bp, Homo sapiens
tatttctagaagc

SEQ ID NO: 5639934 - DNA, 14 bp, Homo sapiens
tatttctagcagag

SEQ ID NO: 5639935 - DNA, 15 bp, Homo sapiens
tatttctagcagagt

SEQ ID NO: 5639936 - DNA, 13 bp, Homo sapiens
tatttctagccat

SEQ ID NO: 5639937 - DNA, 17 bp, Homo sapiens
tatttctagctttttaa

SEQ ID NO: 5639938 - DNA, 21 bp, Homo sapiens
tatttctagtccaaaattaca

SEQ ID NO: 5639939 - DNA, 19 bp, Homo sapiens
tatttctatatagacttgg

SEQ ID NO: 5639940 - DNA, 18 bp, Homo sapiens
tatttctatattttcatt

SEQ ID NO: 5639941 - DNA, 13 bp, Homo sapiens
tatttctatgaaa

SEQ ID NO: 5639942 - DNA, 19 bp, Homo sapiens
tatttctatgacaaattca

SEQ ID NO: 5639943 - DNA, 15 bp, Homo sapiens
tatttctatgtcatt

SEQ ID NO: 5639944 - DNA, 11 bp, Homo sapiens
tatttctattc

SEQ ID NO: 5639945 - DNA, 19 bp, Homo sapiens
tatttctcaacaaagcaca

SEQ ID NO: 5639946 - DNA, 19 bp, Homo sapiens
tatttctcagctgtgcctt

SEQ ID NO: 5639947 - DNA, 22 bp, Homo sapiens
tatttctcataggctatgccat

SEQ ID NO: 5639948 - DNA, 15 bp, Homo sapiens
tatttctcatctgca

SEQ ID NO: 5639949 - DNA, 14 bp, Homo sapiens
tatttctccagacc

SEQ ID NO: 5639950 - DNA, 15 bp, Homo sapiens
tatttctccagaccc

SEQ ID NO: 5639951 - DNA, 20 bp, Homo sapiens
tatttctccagacccagagg

SEQ ID NO: 5639952 - DNA, 17 bp, Homo sapiens
tatttctccatcccctc

SEQ ID NO: 5639953 - DNA, 18 bp, Homo sapiens
tatttctccatcccctcc

SEQ ID NO: 5639954 - DNA, 21 bp, Homo sapiens
tatttctccatcccctccctg

SEQ ID NO: 5639955 - DNA, 22 bp, Homo sapiens
tatttctcctttgcaatagcag

SEQ ID NO: 5639956 - DNA, 16 bp, Homo sapiens
tatttctctatgttta

SEQ ID NO: 5639957 - DNA, 13 bp, Homo sapiens
tatttctctgtga

SEQ ID NO: 5639958 - DNA, 17 bp, Homo sapiens
tatttctctgtgaatcc

SEQ ID NO: 5639959 - DNA, 18 bp, Homo sapiens
tatttctgaaaaagagaa

SEQ ID NO: 5639960 - DNA, 12 bp, Homo sapiens
tatttctgaaag

SEQ ID NO: 5639961 - DNA, 21 bp, Homo sapiens
tatttctgaaggtagcattct

SEQ ID NO: 5639962 - DNA, 22 bp, Homo sapiens
tatttctgaattcaaagcttgt

SEQ ID NO: 5639963 - DNA, 12 bp, Homo sapiens
tatttctgactc

SEQ ID NO: 5639964 - DNA, 17 bp, Homo sapiens
tatttctgatttcataa

SEQ ID NO: 5639965 - DNA, 14 bp, Homo sapiens
tatttctgcaaaca

SEQ ID NO: 5639966 - DNA, 19 bp, Homo sapiens
tatttctgcctataaattt

SEQ ID NO: 5639967 - DNA, 13 bp, Homo sapiens
tatttctgctgaa

SEQ ID NO: 5639968 - DNA, 16 bp, Homo sapiens
tatttctgctgaattt

SEQ ID NO: 5639969 - DNA, 15 bp, Homo sapiens
tatttctgctttctt

SEQ ID NO: 5639970 - DNA, 17 bp, Homo sapiens
tatttctgggtcttttg

SEQ ID NO: 5639971 - DNA, 18 bp, Homo sapiens
tatttctgggtcttttgc

SEQ ID NO: 5639972 - DNA, 22 bp, Homo sapiens
tatttctgggtcttttgctact

SEQ ID NO: 5639973 - DNA, 12 bp, Homo sapiens
tatttctgtaga

SEQ ID NO: 5639974 - DNA, 14 bp, Homo sapiens
tatttctgtatata

SEQ ID NO: 5639975 - DNA, 16 bp, Homo sapiens
tatttctgtatatttg

SEQ ID NO: 5639976 - DNA, 18 bp, Homo sapiens
tatttctgtatatttgtc

SEQ ID NO: 5639977 - DNA, 21 bp, Homo sapiens
tatttctgtatatttgtcatg

SEQ ID NO: 5639978 - DNA, 17 bp, Homo sapiens
tatttctgtatctgaca

SEQ ID NO: 5639979 - DNA, 15 bp, Homo sapiens
tatttctgtgaaaga

SEQ ID NO: 5639980 - DNA, 13 bp, Homo sapiens
tatttctgtggag

SEQ ID NO: 5639981 - DNA, 14 bp, Homo sapiens
tatttctgtgtcca

SEQ ID NO: 5639982 - DNA, 19 bp, Homo sapiens
tatttctgttccagtcaca

SEQ ID NO: 5639983 - DNA, 13 bp, Homo sapiens
tatttcttaaaca

SEQ ID NO: 5639984 - DNA, 18 bp, Homo sapiens
tatttcttaattattata

SEQ ID NO: 5639985 - DNA, 23 bp, Homo sapiens
tatttcttaattattataaaaat

SEQ ID NO: 5639986 - DNA, 14 bp, Homo sapiens
tatttcttaatttg

SEQ ID NO: 5639987 - DNA, 17 bp, Homo sapiens
tatttcttcaagtgagt

SEQ ID NO: 5639988 - DNA, 14 bp, Homo sapiens
tatttcttcacaaa

SEQ ID NO: 5639989 - DNA, 23 bp, Homo sapiens
tatttcttcccagaatctctgag

SEQ ID NO: 5639990 - DNA, 13 bp, Homo sapiens
tatttcttccctg

SEQ ID NO: 5639991 - DNA, 22 bp, Homo sapiens
tatttcttcctaccaagtcaaa

SEQ ID NO: 5639992 - DNA, 14 bp, Homo sapiens
tatttcttctctta

SEQ ID NO: 5639993 - DNA, 23 bp, Homo sapiens
tatttcttgaagaataaattcta

SEQ ID NO: 5639994 - DNA, 22 bp, Homo sapiens
tatttctttatatttatccact

SEQ ID NO: 5639995 - DNA, 15 bp, Homo sapiens
tatttctttcatcag

SEQ ID NO: 5639996 - DNA, 13 bp, Homo sapiens
tatttctttgtag

SEQ ID NO: 5639997 - DNA, 17 bp, Homo sapiens
tatttctttgtagaata

SEQ ID NO: 5639998 - DNA, 19 bp, Homo sapiens
tatttctttgtgataacaa

SEQ ID NO: 5639999 - DNA, 15 bp, Homo sapiens
tatttcttttatata

SEQ ID NO: 5640000 - DNA, 17 bp, Homo sapiens
tatttcttttgtgcaga

SEQ ID NO: 5640001 - DNA, 23 bp, Homo sapiens
tatttctttttaattattttaaa

SEQ ID NO: 5640002 - DNA, 19 bp, Homo sapiens
tatttcttttttttaataa

SEQ ID NO: 5640003 - DNA, 21 bp, Homo sapiens
tatttgaaaaaagttactgca

SEQ ID NO: 5640004 - DNA, 14 bp, Homo sapiens
tatttgaaaacaga

SEQ ID NO: 5640005 - DNA, 19 bp, Homo sapiens
tatttgaaaacagaaattg

SEQ ID NO: 5640006 - DNA, 22 bp, Homo sapiens
tatttgaaaacagaaattggta

SEQ ID NO: 5640007 - DNA, 19 bp, Homo sapiens
tatttgaaaacatataaag

SEQ ID NO: 5640008 - DNA, 19 bp, Homo sapiens
tatttgaaaattaccttta

SEQ ID NO: 5640009 - DNA, 18 bp, Homo sapiens
tatttgaaaattttactt

SEQ ID NO: 5640010 - DNA, 22 bp, Homo sapiens
tatttgaaacacacagtgacca

SEQ ID NO: 5640011 - DNA, 12 bp, Homo sapiens
tatttgaaactt

SEQ ID NO: 5640012 - DNA, 17 bp, Homo sapiens
tatttgaaatactaaaa

SEQ ID NO: 5640013 - DNA, 18 bp, Homo sapiens
tatttgaaatactaaaag

SEQ ID NO: 5640014 - DNA, 20 bp, Homo sapiens
tatttgaaatactaaaagca

SEQ ID NO: 5640015 - DNA, 21 bp, Homo sapiens
tatttgaaatactaaaagcaa

SEQ ID NO: 5640016 - DNA, 12 bp, Homo sapiens
tatttgaaatag

SEQ ID NO: 5640017 - DNA, 22 bp, Homo sapiens
tatttgaaatagtatacattgt

SEQ ID NO: 5640018 - DNA, 18 bp, Homo sapiens
tatttgaacaatgaagtt

SEQ ID NO: 5640019 - DNA, 20 bp, Homo sapiens
tattttctgtcagatgagaa

SEQ ID NO: 5640020 - DNA, 13 bp, Homo sapiens
tattttctgtgta

SEQ ID NO: 5640021 - DNA, 18 bp, Homo sapiens
tattttctgtgtaaaatg

SEQ ID NO: 5640022 - DNA, 19 bp, Homo sapiens
tattttctgtgtaaaatga

SEQ ID NO: 5640023 - DNA, 19 bp, Homo sapiens
tattttctgtgtgttcctg

SEQ ID NO: 5640024 - DNA, 21 bp, Homo sapiens
tattttctgtgtgttcctggc

SEQ ID NO: 5640025 - DNA, 22 bp, Homo sapiens
tattttctgttcagattaaaaa

SEQ ID NO: 5640026 - DNA, 19 bp, Homo sapiens
tattttctgtttttatgtt

SEQ ID NO: 5640027 - DNA, 21 bp, Homo sapiens
tattttcttacccaatttccc

SEQ ID NO: 5640028 - DNA, 15 bp, Homo sapiens
tattttcttctaagt

SEQ ID NO: 5640029 - DNA, 12 bp, Homo sapiens
tattttctttca

SEQ ID NO: 5640030 - DNA, 12 bp, Homo sapiens
tattttctttct

SEQ ID NO: 5640031 - DNA, 14 bp, Homo sapiens
tattttctttgaaa

SEQ ID NO: 5640032 - DNA, 18 bp, Homo sapiens
tattttctttgaaattca

SEQ ID NO: 5640033 - DNA, 15 bp, Homo sapiens
tattttctttttcct

SEQ ID NO: 5640034 - DNA, 20 bp, Homo sapiens
tattttgaaaacacttattt

SEQ ID NO: 5640035 - DNA, 17 bp, Homo sapiens
tattttgaaaagcttct

SEQ ID NO: 5640036 - DNA, 12 bp, Homo sapiens
tattttgaaata

SEQ ID NO: 5640037 - DNA, 14 bp, Homo sapiens
tattttgaaatgaa

SEQ ID NO: 5640038 - DNA, 17 bp, Homo sapiens
tattttgaagaatattt

SEQ ID NO: 5640039 - DNA, 20 bp, Homo sapiens
tattttgaagaatatttaag

SEQ ID NO: 5640040 - DNA, 23 bp, Homo sapiens
tattttgaagaatatttaagaaa

SEQ ID NO: 5640041 - DNA, 16 bp, Homo sapiens
tattttgaatcaataa

SEQ ID NO: 5640042 - DNA, 22 bp, Homo sapiens
tattttgaatcaataatatatt

SEQ ID NO: 5640043 - DNA, 14 bp, Homo sapiens
tattttgaatgtac

SEQ ID NO: 5640044 - DNA, 18 bp, Homo sapiens
tattttgactgtgattta

SEQ ID NO: 5640045 - DNA, 14 bp, Homo sapiens
tattttgacttgtt

SEQ ID NO: 5640046 - DNA, 21 bp, Homo sapiens
tattttgagaaactgctgcag

SEQ ID NO: 5640047 - DNA, 18 bp, Homo sapiens
tattttgaggtagaggaa

SEQ ID NO: 5640048 - DNA, 13 bp, Homo sapiens
tattttgataaaa

SEQ ID NO: 5640049 - DNA, 17 bp, Homo sapiens
tattttgataaattact

SEQ ID NO: 5640050 - DNA, 16 bp, Homo sapiens
tattttgattattgta

SEQ ID NO: 5640051 - DNA, 18 bp, Homo sapiens
tattttgattattgtatt

SEQ ID NO: 5640052 - DNA, 22 bp, Homo sapiens
tattttgcaaacactgtgatta

SEQ ID NO: 5640053 - DNA, 21 bp, Homo sapiens
tattttgcacgaattttaaaa

SEQ ID NO: 5640054 - DNA, 13 bp, Homo sapiens
tattttgccattt

SEQ ID NO: 5640055 - DNA, 15 bp, Homo sapiens
tattttgctccctct

SEQ ID NO: 5640056 - DNA, 22 bp, Homo sapiens
tattttgctccctctgttaggt

SEQ ID NO: 5640057 - DNA, 16 bp, Homo sapiens
tattttgctccttttc

SEQ ID NO: 5640058 - DNA, 14 bp, Homo sapiens
tattttgctcttgt

SEQ ID NO: 5640059 - DNA, 23 bp, Homo sapiens
tattttgctggagactatttaag

SEQ ID NO: 5640060 - DNA, 14 bp, Homo sapiens
tattttgctgttta

SEQ ID NO: 5640061 - DNA, 13 bp, Homo sapiens
tattttgctttgt

SEQ ID NO: 5640062 - DNA, 18 bp, Homo sapiens
tattttggaaagaagaaa

SEQ ID NO: 5640063 - DNA, 14 bp, Homo sapiens
tattttggaaagtt

SEQ ID NO: 5640064 - DNA, 19 bp, Homo sapiens
tattttggaaattgagtct

SEQ ID NO: 5640065 - DNA, 11 bp, Homo sapiens
tattttggaac

SEQ ID NO: 5640066 - DNA, 18 bp, Homo sapiens
tattttggaataagcatt

SEQ ID NO: 5640067 - DNA, 21 bp, Homo sapiens
tattttggaattggtgtatat

SEQ ID NO: 5640068 - DNA, 16 bp, Homo sapiens
tattttggaggtgctt

SEQ ID NO: 5640069 - DNA, 12 bp, Homo sapiens
tattttggatat

SEQ ID NO: 5640070 - DNA, 21 bp, Homo sapiens
tattttggcttcatttcaatc

SEQ ID NO: 5640071 - DNA, 22 bp, Homo sapiens
tattttgggaggccgaggagag

SEQ ID NO: 5640072 - DNA, 18 bp, Homo sapiens
tattttgggcctgttcct

SEQ ID NO: 5640073 - DNA, 19 bp, Homo sapiens
tattttgggcctgttcctt

SEQ ID NO: 5640074 - DNA, 19 bp, Homo sapiens
tattttgggttcaggcctg

SEQ ID NO: 5640075 - DNA, 21 bp, Homo sapiens
tattttggttcttagttctca

SEQ ID NO: 5640076 - DNA, 21 bp, Homo sapiens
tattttgtaaactcaaaatat

SEQ ID NO: 5640077 - DNA, 22 bp, Homo sapiens
tattttgtaaactgatgtttgt

SEQ ID NO: 5640078 - DNA, 16 bp, Homo sapiens
tattttgtaacttcca

SEQ ID NO: 5640079 - DNA, 13 bp, Homo sapiens
tattttgtaataa

SEQ ID NO: 5640080 - DNA, 16 bp, Homo sapiens
tattttgtaattattg

SEQ ID NO: 5640081 - DNA, 20 bp, Homo sapiens
tattttgtaatttttttgaa

SEQ ID NO: 5640082 - DNA, 15 bp, Homo sapiens
tattttgtactttgt

SEQ ID NO: 5640083 - DNA, 15 bp, Homo sapiens
tattttgtatatatc

SEQ ID NO: 5640084 - DNA, 13 bp, Homo sapiens
tattttgtatgca

SEQ ID NO: 5640085 - DNA, 20 bp, Homo sapiens
tattttgtatgcaagcagtt

SEQ ID NO: 5640086 - DNA, 22 bp, Homo sapiens
tattttgtatgcaagcagtttc

SEQ ID NO: 5640087 - DNA, 12 bp, Homo sapiens
tattttgtcact

SEQ ID NO: 5640088 - DNA, 18 bp, Homo sapiens
tattttgtcactgctgta

SEQ ID NO: 5640089 - DNA, 12 bp, Homo sapiens
tattttgtctaa

SEQ ID NO: 5640090 - DNA, 13 bp, Homo sapiens
tattttgtctaaa

SEQ ID NO: 5640091 - DNA, 17 bp, Homo sapiens
tattttgtcttattctt

SEQ ID NO: 5640092 - DNA, 20 bp, Homo sapiens
tattttgtcttattcttaag

SEQ ID NO: 5640093 - DNA, 17 bp, Homo sapiens
tattttgtgagtttgtt

SEQ ID NO: 5640094 - DNA, 19 bp, Homo sapiens
tattttgtgatgatgctgt

SEQ ID NO: 5640095 - DNA, 21 bp, Homo sapiens
tattttgtggaggcagtgtca

SEQ ID NO: 5640096 - DNA, 19 bp, Homo sapiens
tattttgtggttctatttt

SEQ ID NO: 5640097 - DNA, 15 bp, Homo sapiens
tattttgtgtacaag

SEQ ID NO: 5640098 - DNA, 17 bp, Homo sapiens
tattttgtgtacaagtt

SEQ ID NO: 5640099 - DNA, 15 bp, Homo sapiens
tattttgtgtccttt

SEQ ID NO: 5640100 - DNA, 21 bp, Homo sapiens
tattttgtgtgaccaactgtg

SEQ ID NO: 5640101 - DNA, 23 bp, Homo sapiens
tattttgtgtgaccaactgtgtt

SEQ ID NO: 5640102 - DNA, 19 bp, Homo sapiens
tattttgttaataataaga

SEQ ID NO: 5640103 - DNA, 17 bp, Homo sapiens
tattttgttacactaaa

SEQ ID NO: 5640104 - DNA, 15 bp, Homo sapiens
tattttgttcataca

SEQ ID NO: 5640105 - DNA, 19 bp, Homo sapiens
tattttgttgaccattttg

SEQ ID NO: 5640106 - DNA, 22 bp, Homo sapiens
tattttgttgtgattttgtaca

SEQ ID NO: 5640107 - DNA, 21 bp, Homo sapiens
tattttgttttgtgcagagat

SEQ ID NO: 5640108 - DNA, 24 bp, Homo sapiens
tattttgttttttttgactaaagc

SEQ ID NO: 5640109 - DNA, 19 bp, Homo sapiens
tatttttaaaaagaaatct

SEQ ID NO: 5640110 - DNA, 22 bp, Homo sapiens
tatttttaaaaagtaccacatt

SEQ ID NO: 5640111 - DNA, 17 bp, Homo sapiens
tatttttaaaagatctt

SEQ ID NO: 5640112 - DNA, 13 bp, Homo sapiens
tatttttaaaata

SEQ ID NO: 5640113 - DNA, 19 bp, Homo sapiens
tatttttaaaataatttat

SEQ ID NO: 5640114 - DNA, 15 bp, Homo sapiens
tatttttaaaatatt

SEQ ID NO: 5640115 - DNA, 13 bp, Homo sapiens
tatttttaaagaa

SEQ ID NO: 5640116 - DNA, 14 bp, Homo sapiens
tatttttaaatgga

SEQ ID NO: 5640117 - DNA, 13 bp, Homo sapiens
tatttttaaattt

SEQ ID NO: 5640118 - DNA, 12 bp, Homo sapiens
tatttttaacac

SEQ ID NO: 5640119 - DNA, 18 bp, Homo sapiens
tatttttaactctggatt

SEQ ID NO: 5640120 - DNA, 19 bp, Homo sapiens
tatttttaactctggattt

SEQ ID NO: 5640121 - DNA, 13 bp, Homo sapiens
tatttttaagaaa

SEQ ID NO: 5640122 - DNA, 18 bp, Homo sapiens
tatttttaatatgttgac

SEQ ID NO: 5640123 - DNA, 16 bp, Homo sapiens
tatttttaatggaaag

SEQ ID NO: 5640124 - DNA, 18 bp, Homo sapiens
tatttttaatggaaagtt

SEQ ID NO: 5640125 - DNA, 14 bp, Homo sapiens
tatttttaattaat

SEQ ID NO: 5640126 - DNA, 9 bp, Homo sapiens
tatttttac

SEQ ID NO: 5640127 - DNA, 14 bp, Homo sapiens
tatttttagaataa

SEQ ID NO: 5640128 - DNA, 13 bp, Homo sapiens
tatttttagagat

SEQ ID NO: 5640129 - DNA, 20 bp, Homo sapiens
tatttttagatggttacact

SEQ ID NO: 5640130 - DNA, 12 bp, Homo sapiens
tatttttataaa

SEQ ID NO: 5640131 - DNA, 22 bp, Homo sapiens
tatttttataaatataagcctt

SEQ ID NO: 5640132 - DNA, 16 bp, Homo sapiens
tatttttataatgact

SEQ ID NO: 5640133 - DNA, 17 bp, Homo sapiens
tatttttatacaaacct

SEQ ID NO: 5640134 - DNA, 23 bp, Homo sapiens
tatttttatacaagtaatttcct

SEQ ID NO: 5640135 - DNA, 18 bp, Homo sapiens
tatttttatataatatct

SEQ ID NO: 5640136 - DNA, 15 bp, Homo sapiens
tatttttatatagac

SEQ ID NO: 5640137 - DNA, 23 bp, Homo sapiens
tatttttatatagcttgaaacat

SEQ ID NO: 5640138 - DNA, 23 bp, Homo sapiens
tatttttatattaaagtaaatgg

SEQ ID NO: 5640139 - DNA, 17 bp, Homo sapiens
tatttttatatttcctt

SEQ ID NO: 5640140 - DNA, 21 bp, Homo sapiens
tatttttatcagttacacatg

SEQ ID NO: 5640141 - DNA, 12 bp, Homo sapiens
tatttttatcca

SEQ ID NO: 5640142 - DNA, 17 bp, Homo sapiens
tatttttatgtgcagcg

SEQ ID NO: 5640143 - DNA, 17 bp, Homo sapiens
tatttttattcaaacta

SEQ ID NO: 5640144 - DNA, 23 bp, Homo sapiens
tatttttattcaaactacctata

SEQ ID NO: 5640145 - DNA, 18 bp, Homo sapiens
tatttttatttatttttg

SEQ ID NO: 5640146 - DNA, 14 bp, Homo sapiens
tatttttatttcat

SEQ ID NO: 5640147 - DNA, 15 bp, Homo sapiens
tatttttatttcatt

SEQ ID NO: 5640148 - DNA, 22 bp, Homo sapiens
tatttttatttcattcacatta

SEQ ID NO: 5640149 - DNA, 19 bp, Homo sapiens
tatttttatttctgactct

SEQ ID NO: 5640150 - DNA, 17 bp, Homo sapiens
tatttttatttgtttgt

SEQ ID NO: 5640151 - DNA, 14 bp, Homo sapiens
tatttttatttttg

SEQ ID NO: 5640152 - DNA, 11 bp, Homo sapiens
tatttttcaac

SEQ ID NO: 5640153 - DNA, 15 bp, Homo sapiens
tatttttcaaggcat

SEQ ID NO: 5640154 - DNA, 16 bp, Homo sapiens
tatttttcaaggcatt

SEQ ID NO: 5640155 - DNA, 18 bp, Homo sapiens
tatttttcaataaagcat

SEQ ID NO: 5640156 - DNA, 15 bp, Homo sapiens
tatttttcacagttt

SEQ ID NO: 5640157 - DNA, 12 bp, Homo sapiens
tatttttcactc

SEQ ID NO: 5640158 - DNA, 16 bp, Homo sapiens
tatttttcagatataa

SEQ ID NO: 5640159 - DNA, 23 bp, Homo sapiens
tatttttcagatataaatactga

SEQ ID NO: 5640160 - DNA, 18 bp, Homo sapiens
tatttttcataaacaagt

SEQ ID NO: 5640161 - DNA, 19 bp, Homo sapiens
tatttttcatattgtgcca

SEQ ID NO: 5640162 - DNA, 12 bp, Homo sapiens
tatttttcatta

SEQ ID NO: 5640163 - DNA, 15 bp, Homo sapiens
tatttttccacattt

SEQ ID NO: 5640164 - DNA, 19 bp, Homo sapiens
tatttttccagctccgtgt

SEQ ID NO: 5640165 - DNA, 21 bp, Homo sapiens
tatttttccctgtttgcctat

SEQ ID NO: 5640166 - DNA, 22 bp, Homo sapiens
tatttttccctgtttgcctata

SEQ ID NO: 5640167 - DNA, 19 bp, Homo sapiens
tatttttctaaagaaatat

SEQ ID NO: 5640168 - DNA, 13 bp, Homo sapiens
tatttttctaact

SEQ ID NO: 5640169 - DNA, 16 bp, Homo sapiens
tatttttctaactaca

SEQ ID NO: 5640170 - DNA, 13 bp, Homo sapiens
tatttttctaagt

SEQ ID NO: 5640171 - DNA, 12 bp, Homo sapiens
tatttttctagt

SEQ ID NO: 5640172 - DNA, 14 bp, Homo sapiens
tatttttctagtca

SEQ ID NO: 5640173 - DNA, 15 bp, Homo sapiens
tatttttctctcctg

SEQ ID NO: 5640174 - DNA, 14 bp, Homo sapiens
tatttttctctctc

SEQ ID NO: 5640175 - DNA, 17 bp, Homo sapiens
tatttttctcttgtacc

SEQ ID NO: 5640176 - DNA, 19 bp, Homo sapiens
tatttttctcttgtaccat

SEQ ID NO: 5640177 - DNA, 20 bp, Homo sapiens
tatttttctgggcttttcct

SEQ ID NO: 5640178 - DNA, 14 bp, Homo sapiens
tatttttctgttac

SEQ ID NO: 5640179 - DNA, 15 bp, Homo sapiens
tatttttcttcagac

SEQ ID NO: 5640180 - DNA, 12 bp, Homo sapiens
tatttttcttga

SEQ ID NO: 5640181 - DNA, 20 bp, Homo sapiens
tatttttgaaagaattctat

SEQ ID NO: 5640182 - DNA, 18 bp, Homo sapiens
tatttttgaagtaaatta

SEQ ID NO: 5640183 - DNA, 22 bp, Homo sapiens
tatttttgaagtaaattaaaca

SEQ ID NO: 5640184 - DNA, 17 bp, Homo sapiens
tatttttgaagtctcct

SEQ ID NO: 5640185 - DNA, 13 bp, Homo sapiens
tatttttgaataa

SEQ ID NO: 5640186 - DNA, 18 bp, Homo sapiens
tatttttgactgtagcca

SEQ ID NO: 5640187 - DNA, 14 bp, Homo sapiens
tatttttgatgtat

SEQ ID NO: 5640188 - DNA, 19 bp, Homo sapiens
tatttttgcaaaataagtt

SEQ ID NO: 5640189 - DNA, 17 bp, Homo sapiens
tatttttgcatggcact

SEQ ID NO: 5640190 - DNA, 18 bp, Homo sapiens
tatttttgctgcttctga

SEQ ID NO: 5640191 - DNA, 16 bp, Homo sapiens
tatttttggaggttta

SEQ ID NO: 5640192 - DNA, 19 bp, Homo sapiens
tatttttggcagtctgaat

SEQ ID NO: 5640193 - DNA, 20 bp, Homo sapiens
tatttttggcagtctgaatt

SEQ ID NO: 5640194 - DNA, 17 bp, Homo sapiens
tatttttggcattcctc

SEQ ID NO: 5640195 - DNA, 19 bp, Homo sapiens
tatttttggggcatcctgg

SEQ ID NO: 5640196 - DNA, 21 bp, Homo sapiens
tatttttgggtttggccaggg

SEQ ID NO: 5640197 - DNA, 12 bp, Homo sapiens
tatttttgtaaa

SEQ ID NO: 5640198 - DNA, 18 bp, Homo sapiens
tcaaagaagtcggaatgt

SEQ ID NO: 5640199 - DNA, 15 bp, Homo sapiens
tcaaagaattacagt

SEQ ID NO: 5640200 - DNA, 15 bp, Homo sapiens
tcaaagacatttcat

SEQ ID NO: 5640201 - DNA, 12 bp, Homo sapiens
tcaaagacccca

SEQ ID NO: 5640202 - DNA, 14 bp, Homo sapiens
tcaaagaccccatg

SEQ ID NO: 5640203 - DNA, 17 bp, Homo sapiens
tcaaagaccttgtgtgt

SEQ ID NO: 5640204 - DNA, 19 bp, Homo sapiens
tcaaagaccttgtgtgtat

SEQ ID NO: 5640205 - DNA, 14 bp, Homo sapiens
tcaaagactcaaat

SEQ ID NO: 5640206 - DNA, 16 bp, Homo sapiens
tcaaagactcaaattt

SEQ ID NO: 5640207 - DNA, 17 bp, Homo sapiens
tcaaagactcaaatttt

SEQ ID NO: 5640208 - DNA, 22 bp, Homo sapiens
tcaaagactgtatttagatctc

SEQ ID NO: 5640209 - DNA, 20 bp, Homo sapiens
tcaaagacttcatttaacac

SEQ ID NO: 5640210 - DNA, 19 bp, Homo sapiens
tcaaagagaagatgcctgt

SEQ ID NO: 5640211 - DNA, 15 bp, Homo sapiens
tcaaagagaattgta

SEQ ID NO: 5640212 - DNA, 19 bp, Homo sapiens
tcaaagagatgaggaaata

SEQ ID NO: 5640213 - DNA, 21 bp, Homo sapiens
tcaaagagatgaggaaataag

SEQ ID NO: 5640214 - DNA, 15 bp, Homo sapiens
tcaaagagattcgaa

SEQ ID NO: 5640215 - DNA, 23 bp, Homo sapiens
tcaaagagcacttgagctgtctg

SEQ ID NO: 5640216 - DNA, 20 bp, Homo sapiens
tcaaagaggccagtactttg

SEQ ID NO: 5640217 - DNA, 21 bp, Homo sapiens
tcaaagaggctgaggctggca

SEQ ID NO: 5640218 - DNA, 21 bp, Homo sapiens
tcaaagagggggctctgccca

SEQ ID NO: 5640219 - DNA, 19 bp, Homo sapiens
tcaaagaggtgaacattaa

SEQ ID NO: 5640220 - DNA, 12 bp, Homo sapiens
tcaaagaggttt

SEQ ID NO: 5640221 - DNA, 20 bp, Homo sapiens
tcaaagataaatgaaataaa

SEQ ID NO: 5640222 - DNA, 22 bp, Homo sapiens
tcaaagataaatgaaataaacg

SEQ ID NO: 5640223 - DNA, 17 bp, Homo sapiens
tcaaagataacattgtt

SEQ ID NO: 5640224 - DNA, 15 bp, Homo sapiens
tcaaagatacaagaa

SEQ ID NO: 5640225 - DNA, 16 bp, Homo sapiens
tcaaagatacaagaaa

SEQ ID NO: 5640226 - DNA, 19 bp, Homo sapiens
tcaaagatacaagaaaaag

SEQ ID NO: 5640227 - DNA, 16 bp, Homo sapiens
tcaaagatctttcgtt

SEQ ID NO: 5640228 - DNA, 15 bp, Homo sapiens
tcaaagatgaaagct

SEQ ID NO: 5640229 - DNA, 15 bp, Homo sapiens
tcaaagatgataatt

SEQ ID NO: 5640230 - DNA, 15 bp, Homo sapiens
tcaaagatgatggaa

SEQ ID NO: 5640231 - DNA, 14 bp, Homo sapiens
tcaaagatgcattt

SEQ ID NO: 5640232 - DNA, 15 bp, Homo sapiens
tcaaagatgccccat

SEQ ID NO: 5640233 - DNA, 23 bp, Homo sapiens
tcaaagatgcgtttgcctcctgg

SEQ ID NO: 5640234 - DNA, 20 bp, Homo sapiens
tcaaagatggattaaactca

SEQ ID NO: 5640235 - DNA, 11 bp, Homo sapiens
tcaaagatgta

SEQ ID NO: 5640236 - DNA, 13 bp, Homo sapiens
tcaaagatgtact

SEQ ID NO: 5640237 - DNA, 17 bp, Homo sapiens
tcaaagattctgcattt

SEQ ID NO: 5640238 - DNA, 14 bp, Homo sapiens
tcaaagcaaccacc

SEQ ID NO: 5640239 - DNA, 16 bp, Homo sapiens
tcaaagcaaccacctg

SEQ ID NO: 5640240 - DNA, 19 bp, Homo sapiens
tcaaagcaagcattcagaa

SEQ ID NO: 5640241 - DNA, 13 bp, Homo sapiens
tcaaagcaagggc

SEQ ID NO: 5640242 - DNA, 14 bp, Homo sapiens
tcaaagcaatgcat

SEQ ID NO: 5640243 - DNA, 12 bp, Homo sapiens
tcaaagcaattg

SEQ ID NO: 5640244 - DNA, 19 bp, Homo sapiens
tcaaagcaattgaaatgca

SEQ ID NO: 5640245 - DNA, 15 bp, Homo sapiens
tcaaagcacatatgt

SEQ ID NO: 5640246 - DNA, 22 bp, Homo sapiens
tcaaagcaccaaaataagaaaa

SEQ ID NO: 5640247 - DNA, 20 bp, Homo sapiens
tcaaagcacctgaaccactg

SEQ ID NO: 5640248 - DNA, 21 bp, Homo sapiens
tcaaagcacctgaaccactgt

SEQ ID NO: 5640249 - DNA, 23 bp, Homo sapiens
tcaaagcaccttgaatggaaggt

SEQ ID NO: 5640250 - DNA, 19 bp, Homo sapiens
tcaaagcactgttgagaag

SEQ ID NO: 5640251 - DNA, 10 bp, Homo sapiens
tcaaagcaga

SEQ ID NO: 5640252 - DNA, 20 bp, Homo sapiens
tcaaagcagaagtctggctt

SEQ ID NO: 5640253 - DNA, 23 bp, Homo sapiens
tcaaagcagagtgggacttggag

SEQ ID NO: 5640254 - DNA, 22 bp, Homo sapiens
tcaaagcagcaggactgtggga

SEQ ID NO: 5640255 - DNA, 19 bp, Homo sapiens
tcaaagcaggggagtatgc

SEQ ID NO: 5640256 - DNA, 20 bp, Homo sapiens
tcaaagcatggacatttaga

SEQ ID NO: 5640257 - DNA, 22 bp, Homo sapiens
tcaaagcatggacatttagaag

SEQ ID NO: 5640258 - DNA, 21 bp, Homo sapiens
tcaaagcatgggattattaga

SEQ ID NO: 5640259 - DNA, 18 bp, Homo sapiens
tcaaagccaagtttatat

SEQ ID NO: 5640260 - DNA, 15 bp, Homo sapiens
tcaaagccacattat

SEQ ID NO: 5640261 - DNA, 17 bp, Homo sapiens
tcaaagccacattattt

SEQ ID NO: 5640262 - DNA, 18 bp, Homo sapiens
tcaaagccacattatttc

SEQ ID NO: 5640263 - DNA, 20 bp, Homo sapiens
tcaaagccacattatttcta

SEQ ID NO: 5640264 - DNA, 23 bp, Homo sapiens
tcaaagccagcgtcctcctctgt

SEQ ID NO: 5640265 - DNA, 15 bp, Homo sapiens
tcaaagccagggtct

SEQ ID NO: 5640266 - DNA, 22 bp, Homo sapiens
tcaaagccatatggacactgtg

SEQ ID NO: 5640267 - DNA, 12 bp, Homo sapiens
tcaaagcccaga

SEQ ID NO: 5640268 - DNA, 18 bp, Homo sapiens
tcaaagccccattaactg

SEQ ID NO: 5640269 - DNA, 21 bp, Homo sapiens
tcaaagccccattaactgctt

SEQ ID NO: 5640270 - DNA, 16 bp, Homo sapiens
tcaaagccctgcctct

SEQ ID NO: 5640271 - DNA, 17 bp, Homo sapiens
tcaaagccctgcctctg

SEQ ID NO: 5640272 - DNA, 19 bp, Homo sapiens
tcaaagccctgcctctgtg

SEQ ID NO: 5640273 - DNA, 20 bp, Homo sapiens
tcaaagccctgcctctgtgt

SEQ ID NO: 5640274 - DNA, 11 bp, Homo sapiens
tcaaagccttc

SEQ ID NO: 5640275 - DNA, 17 bp, Homo sapiens
tcaaagcgaacagtcca

SEQ ID NO: 5640276 - DNA, 19 bp, Homo sapiens
tcaaagcggatgctggcca

SEQ ID NO: 5640277 - DNA, 23 bp, Homo sapiens
tcaaagcggtttaaccacattaa

SEQ ID NO: 5640278 - DNA, 15 bp, Homo sapiens
tcaaagctaaaaaat

SEQ ID NO: 5640279 - DNA, 19 bp, Homo sapiens
tcaaagctaggaaaggcag

SEQ ID NO: 5640280 - DNA, 14 bp, Homo sapiens
tcaaagctgaaatg

SEQ ID NO: 5640281 - DNA, 11 bp, Homo sapiens
tcaaagctgcc

SEQ ID NO: 5640282 - DNA, 23 bp, Homo sapiens
tcaaagctgggaagaccctttca

SEQ ID NO: 5640283 - DNA, 17 bp, Homo sapiens
tcaaagcttcaaaaact

SEQ ID NO: 5640284 - DNA, 17 bp, Homo sapiens
tcaaagcttccattcca

SEQ ID NO: 5640285 - DNA, 22 bp, Homo sapiens
tcaaagcttggattaaatacat

SEQ ID NO: 5640286 - DNA, 14 bp, Homo sapiens
tcaaagcttgtgaa

SEQ ID NO: 5640287 - DNA, 18 bp, Homo sapiens
tcaaagctttcctgtttc

SEQ ID NO: 5640288 - DNA, 20 bp, Homo sapiens
tcaaagcttttgtaaaataa

SEQ ID NO: 5640289 - DNA, 16 bp, Homo sapiens
tcaaagctttttccag

SEQ ID NO: 5640290 - DNA, 15 bp, Homo sapiens
tcaaagctttttgaa

SEQ ID NO: 5640291 - DNA, 11 bp, Homo sapiens
tcaaaggaaaa

SEQ ID NO: 5640292 - DNA, 22 bp, Homo sapiens
tcaaaggaaaacacctttattt

SEQ ID NO: 5640293 - DNA, 12 bp, Homo sapiens
tcaaaggaagac

SEQ ID NO: 5640294 - DNA, 15 bp, Homo sapiens
tcaaaggaatataag

SEQ ID NO: 5640295 - DNA, 15 bp, Homo sapiens
tcaaaggacaaagtg

SEQ ID NO: 5640296 - DNA, 13 bp, Homo sapiens
tcaaaggagaaaa

SEQ ID NO: 5640297 - DNA, 15 bp, Homo sapiens
tcaaaggagaaaaaa

SEQ ID NO: 5640298 - DNA, 18 bp, Homo sapiens
tcaaaggagctttctcaa

SEQ ID NO: 5640299 - DNA, 13 bp, Homo sapiens
tcaaaggcagaaa

SEQ ID NO: 5640300 - DNA, 18 bp, Homo sapiens
tcaaaggcatctcccttc

SEQ ID NO: 5640301 - DNA, 19 bp, Homo sapiens
tcaaagggacggtcagttt

SEQ ID NO: 5640302 - DNA, 14 bp, Homo sapiens
tcaaagggactttt

SEQ ID NO: 5640303 - DNA, 16 bp, Homo sapiens
tcaaagggagagaaaa

SEQ ID NO: 5640304 - DNA, 18 bp, Homo sapiens
tcaaagggagagaaaagc

SEQ ID NO: 5640305 - DNA, 17 bp, Homo sapiens
tcaaagggataaagaaa

SEQ ID NO: 5640306 - DNA, 17 bp, Homo sapiens
tcaaagggtgaaaatta

SEQ ID NO: 5640307 - DNA, 15 bp, Homo sapiens
tcaaaggtacttgga

SEQ ID NO: 5640308 - DNA, 16 bp, Homo sapiens
tcaaaggtacttggat

SEQ ID NO: 5640309 - DNA, 19 bp, Homo sapiens
tcaaaggtagccatcatgg

SEQ ID NO: 5640310 - DNA, 22 bp, Homo sapiens
tcaaaggtcgggacagctgtgc

SEQ ID NO: 5640311 - DNA, 16 bp, Homo sapiens
tcaaaggttctaggtt

SEQ ID NO: 5640312 - DNA, 23 bp, Homo sapiens
tcaaaggttctaggtttcaaaga

SEQ ID NO: 5640313 - DNA, 14 bp, Homo sapiens
tcaaagtaaaaatt

SEQ ID NO: 5640314 - DNA, 21 bp, Homo sapiens
tcaaagtaaaggcctcctccc

SEQ ID NO: 5640315 - DNA, 19 bp, Homo sapiens
tcaaagtaatatatcaaat

SEQ ID NO: 5640316 - DNA, 20 bp, Homo sapiens
tcaaagtaatatatcaaatc

SEQ ID NO: 5640317 - DNA, 19 bp, Homo sapiens
tcaaagtaccacactgaaa

SEQ ID NO: 5640318 - DNA, 20 bp, Homo sapiens
tcaaagtagaaactactaat

SEQ ID NO: 5640319 - DNA, 18 bp, Homo sapiens
tcaaagtaggcaggacca

SEQ ID NO: 5640320 - DNA, 14 bp, Homo sapiens
tcaaagtagttagt

SEQ ID NO: 5640321 - DNA, 15 bp, Homo sapiens
tcaaagtagttagtt

SEQ ID NO: 5640322 - DNA, 16 bp, Homo sapiens
tcaaagtataatcttt

SEQ ID NO: 5640323 - DNA, 13 bp, Homo sapiens
tcaaagtatttgt

SEQ ID NO: 5640324 - DNA, 15 bp, Homo sapiens
tcaaagtcagaacaa

SEQ ID NO: 5640325 - DNA, 16 bp, Homo sapiens
tcaaagtcatgatgtt

SEQ ID NO: 5640326 - DNA, 13 bp, Homo sapiens
tcaaagtcattaa

SEQ ID NO: 5640327 - DNA, 18 bp, Homo sapiens
tcaaagtcattaaagaca

SEQ ID NO: 5640328 - DNA, 17 bp, Homo sapiens
tcaaagtctcatagctt

SEQ ID NO: 5640329 - DNA, 20 bp, Homo sapiens
tcaaagtgaaagacatttca

SEQ ID NO: 5640330 - DNA, 22 bp, Homo sapiens
tcaaagtgagaaaatgcctcaa

SEQ ID NO: 5640331 - DNA, 16 bp, Homo sapiens
tcaaagtgcctgggct

SEQ ID NO: 5640332 - DNA, 23 bp, Homo sapiens
tcaaagtgcctgggctcagcctg

SEQ ID NO: 5640333 - DNA, 11 bp, Homo sapiens
tcaaagtggaa

SEQ ID NO: 5640334 - DNA, 16 bp, Homo sapiens
tcaaagtggatgcaat

SEQ ID NO: 5640335 - DNA, 17 bp, Homo sapiens
tcaaagtggggtacagt

SEQ ID NO: 5640336 - DNA, 17 bp, Homo sapiens
tcaaagtggtaaatact

SEQ ID NO: 5640337 - DNA, 18 bp, Homo sapiens
tcaaagtggtacaggaag

SEQ ID NO: 5640338 - DNA, 20 bp, Homo sapiens
tcaaagtgtaaacaccatag

SEQ ID NO: 5640339 - DNA, 17 bp, Homo sapiens
tcaaagtgtaagcactt

SEQ ID NO: 5640340 - DNA, 13 bp, Homo sapiens
tcaaagtgtatat

SEQ ID NO: 5640341 - DNA, 19 bp, Homo sapiens
tcaaagtgtatatttattc

SEQ ID NO: 5640342 - DNA, 21 bp, Homo sapiens
tcaaagtgttgctgtggctcc

SEQ ID NO: 5640343 - DNA, 21 bp, Homo sapiens
tcaaagtgttgtgttcctggc

SEQ ID NO: 5640344 - DNA, 14 bp, Homo sapiens
tcaaagtgtttaat

SEQ ID NO: 5640345 - DNA, 14 bp, Homo sapiens
tcaaagttgaaaat

SEQ ID NO: 5640346 - DNA, 19 bp, Homo sapiens
tcaaagttgcctaaatcca

SEQ ID NO: 5640347 - DNA, 22 bp, Homo sapiens
tcaaagttgcctaaatccattt

SEQ ID NO: 5640348 - DNA, 23 bp, Homo sapiens
tcaaagttgtagttcttgtgcat

SEQ ID NO: 5640349 - DNA, 15 bp, Homo sapiens
tcaaagtttatatgc

SEQ ID NO: 5640350 - DNA, 17 bp, Homo sapiens
tcaaagtttatatgcct

SEQ ID NO: 5640351 - DNA, 11 bp, Homo sapiens
tcaaagtttta

SEQ ID NO: 5640352 - DNA, 22 bp, Homo sapiens
tcaaagttttgaaaagctatta

SEQ ID NO: 5640353 - DNA, 18 bp, Homo sapiens
tcaaagtttttacagtgt

SEQ ID NO: 5640354 - DNA, 19 bp, Homo sapiens
tcaaagtttttacagtgta

SEQ ID NO: 5640355 - DNA, 14 bp, Homo sapiens
tcaaataaaaataa

SEQ ID NO: 5640356 - DNA, 20 bp, Homo sapiens
tcaaataaaaattctagatt

SEQ ID NO: 5640357 - DNA, 15 bp, Homo sapiens
tcaaataaaatatca

SEQ ID NO: 5640358 - DNA, 13 bp, Homo sapiens
tcaaataaacctt

SEQ ID NO: 5640359 - DNA, 20 bp, Homo sapiens
tcaaataaaccttgtttctt

SEQ ID NO: 5640360 - DNA, 23 bp, Homo sapiens
tcaaataaagagagaacaggact

SEQ ID NO: 5640361 - DNA, 21 bp, Homo sapiens
tcaaataaatgtttcccccac

SEQ ID NO: 5640362 - DNA, 22 bp, Homo sapiens
tcaaataaatgtttcccccact

SEQ ID NO: 5640363 - DNA, 14 bp, Homo sapiens
tcaaataaatttct

SEQ ID NO: 5640364 - DNA, 21 bp, Homo sapiens
tcaaataaccctgaatcagag

SEQ ID NO: 5640365 - DNA, 12 bp, Homo sapiens
tcaaataactaa

SEQ ID NO: 5640366 - DNA, 19 bp, Homo sapiens
tcaaataactgcagaaaaa

SEQ ID NO: 5640367 - DNA, 20 bp, Homo sapiens
tcaaataagtatttataata

SEQ ID NO: 5640368 - DNA, 19 bp, Homo sapiens
tcaaataatacatctttat

SEQ ID NO: 5640369 - DNA, 19 bp, Homo sapiens
tcaaataataccttagaag

SEQ ID NO: 5640370 - DNA, 15 bp, Homo sapiens
tcaaataatattcat

SEQ ID NO: 5640371 - DNA, 18 bp, Homo sapiens
tcaaataatccattccaa

SEQ ID NO: 5640372 - DNA, 19 bp, Homo sapiens
tcaaataatgcttttctaa

SEQ ID NO: 5640373 - DNA, 14 bp, Homo sapiens
tcaaatacaaagta

SEQ ID NO: 5640374 - DNA, 19 bp, Homo sapiens
tcaaatacaaagtaaatac

SEQ ID NO: 5640375 - DNA, 20 bp, Homo sapiens
tcaaatacaaagtaaataca

SEQ ID NO: 5640376 - DNA, 17 bp, Homo sapiens
tcaactccaaggcaaat

SEQ ID NO: 5640377 - DNA, 20 bp, Homo sapiens
tcaactccaaggcaaatgtc

SEQ ID NO: 5640378 - DNA, 15 bp, Homo sapiens
tcaactccagctccc

SEQ ID NO: 5640379 - DNA, 12 bp, Homo sapiens
tcaactcctggc

SEQ ID NO: 5640380 - DNA, 13 bp, Homo sapiens
tcaactcctggct

SEQ ID NO: 5640381 - DNA, 14 bp, Homo sapiens
tcaactcctggctc

SEQ ID NO: 5640382 - DNA, 15 bp, Homo sapiens
tcaactcctggctcc

SEQ ID NO: 5640383 - DNA, 14 bp, Homo sapiens
tcaactctgagccc

SEQ ID NO: 5640384 - DNA, 17 bp, Homo sapiens
tcaactctgctgagggt

SEQ ID NO: 5640385 - DNA, 22 bp, Homo sapiens
tcaactctgctgagggtccaga

SEQ ID NO: 5640386 - DNA, 12 bp, Homo sapiens
tcaactctgtga

SEQ ID NO: 5640387 - DNA, 19 bp, Homo sapiens
tcaactctgtgtcccagca

SEQ ID NO: 5640388 - DNA, 19 bp, Homo sapiens
tcaactcttgagtttttca

SEQ ID NO: 5640389 - DNA, 19 bp, Homo sapiens
tcaactgagaagccaagcc

SEQ ID NO: 5640390 - DNA, 19 bp, Homo sapiens
tcaactgaggttcttggga

SEQ ID NO: 5640391 - DNA, 20 bp, Homo sapiens
tcaactgcatcaagatgtga

SEQ ID NO: 5640392 - DNA, 19 bp, Homo sapiens
tcaactgccaaaatgctct

SEQ ID NO: 5640393 - DNA, 20 bp, Homo sapiens
tcaactgccaaaatgctcta

SEQ ID NO: 5640394 - DNA, 15 bp, Homo sapiens
tcaactgcccagcaa

SEQ ID NO: 5640395 - DNA, 22 bp, Homo sapiens
tcaactgcccctgacttaactt

SEQ ID NO: 5640396 - DNA, 14 bp, Homo sapiens
tcaactgcctactc

SEQ ID NO: 5640397 - DNA, 18 bp, Homo sapiens
tcaactgcctactccaaa

SEQ ID NO: 5640398 - DNA, 20 bp, Homo sapiens
tcaactgcctactccaaaat

SEQ ID NO: 5640399 - DNA, 17 bp, Homo sapiens
tcaactgctgttttatg

SEQ ID NO: 5640400 - DNA, 12 bp, Homo sapiens
tcaactgctttg

SEQ ID NO: 5640401 - DNA, 19 bp, Homo sapiens
tcaactggacatcacagca

SEQ ID NO: 5640402 - DNA, 18 bp, Homo sapiens
tcaactggagcaagaagg

SEQ ID NO: 5640403 - DNA, 23 bp, Homo sapiens
tcaactggagcaagaaggaagga

SEQ ID NO: 5640404 - DNA, 21 bp, Homo sapiens
tcaactggagtctatgcttaa

SEQ ID NO: 5640405 - DNA, 22 bp, Homo sapiens
tcaactggggggaccaaatagc

SEQ ID NO: 5640406 - DNA, 18 bp, Homo sapiens
tcaactggggggcaattt

SEQ ID NO: 5640407 - DNA, 16 bp, Homo sapiens
tcaactgggtccagaa

SEQ ID NO: 5640408 - DNA, 17 bp, Homo sapiens
tcaactgggtccagaag

SEQ ID NO: 5640409 - DNA, 22 bp, Homo sapiens
tcaactgtataccgtgtgctcc

SEQ ID NO: 5640410 - DNA, 22 bp, Homo sapiens
tcaactgtattgggccttttgg

SEQ ID NO: 5640411 - DNA, 23 bp, Homo sapiens
tcaactgtcttcctcaaaataaa

SEQ ID NO: 5640412 - DNA, 15 bp, Homo sapiens
tcaacttaaagtgaa

SEQ ID NO: 5640413 - DNA, 15 bp, Homo sapiens
tcaacttaaatcact

SEQ ID NO: 5640414 - DNA, 12 bp, Homo sapiens
tcaacttaacat

SEQ ID NO: 5640415 - DNA, 20 bp, Homo sapiens
tcaacttagtcaataagaaa

SEQ ID NO: 5640416 - DNA, 16 bp, Homo sapiens
tcaacttattctttga

SEQ ID NO: 5640417 - DNA, 18 bp, Homo sapiens
tcaacttatttcataatt

SEQ ID NO: 5640418 - DNA, 19 bp, Homo sapiens
tcaacttatttcataattg

SEQ ID NO: 5640419 - DNA, 22 bp, Homo sapiens
tcaacttatttctgaaaaagag

SEQ ID NO: 5640420 - DNA, 14 bp, Homo sapiens
tcaacttcaggaaa

SEQ ID NO: 5640421 - DNA, 15 bp, Homo sapiens
tcaacttgaagcaag

SEQ ID NO: 5640422 - DNA, 13 bp, Homo sapiens
tcaacttgcaaaa

SEQ ID NO: 5640423 - DNA, 19 bp, Homo sapiens
tcaacttgcatccaactcc

SEQ ID NO: 5640424 - DNA, 14 bp, Homo sapiens
tcaacttggatcat

SEQ ID NO: 5640425 - DNA, 13 bp, Homo sapiens
tcaactttactgt

SEQ ID NO: 5640426 - DNA, 16 bp, Homo sapiens
tcaactttcatttgaa

SEQ ID NO: 5640427 - DNA, 20 bp, Homo sapiens
tcaactttcctcaaatcaaa

SEQ ID NO: 5640428 - DNA, 12 bp, Homo sapiens
tcaactttgaat

SEQ ID NO: 5640429 - DNA, 19 bp, Homo sapiens
tcaactttggttcctgtga

SEQ ID NO: 5640430 - DNA, 16 bp, Homo sapiens
tcaactttgtaaaaat

SEQ ID NO: 5640431 - DNA, 13 bp, Homo sapiens
tcaacttttctga

SEQ ID NO: 5640432 - DNA, 14 bp, Homo sapiens
tcaacttttgacaa

SEQ ID NO: 5640433 - DNA, 17 bp, Homo sapiens
tcaactttttattgcct

SEQ ID NO: 5640434 - DNA, 22 bp, Homo sapiens
tcaactttttattgccttctca

SEQ ID NO: 5640435 - DNA, 13 bp, Homo sapiens
tcaactttttcct

SEQ ID NO: 5640436 - DNA, 16 bp, Homo sapiens
tcaagaaaaaaaggga

SEQ ID NO: 5640437 - DNA, 21 bp, Homo sapiens
tcaagaaaaattattgtataa

SEQ ID NO: 5640438 - DNA, 16 bp, Homo sapiens
tcaagaaaacagcaag

SEQ ID NO: 5640439 - DNA, 15 bp, Homo sapiens
tcaagaaaacaggca

SEQ ID NO: 5640440 - DNA, 16 bp, Homo sapiens
tcaagaaaactggaaa

SEQ ID NO: 5640441 - DNA, 17 bp, Homo sapiens
tcaagaaaactggaaat

SEQ ID NO: 5640442 - DNA, 14 bp, Homo sapiens
tcaagaaaagaatt

SEQ ID NO: 5640443 - DNA, 14 bp, Homo sapiens
tcaagaaaatcttt

SEQ ID NO: 5640444 - DNA, 21 bp, Homo sapiens
tcaagaaaatctttgttgaag

SEQ ID NO: 5640445 - DNA, 17 bp, Homo sapiens
tcaagaaactgaggaat

SEQ ID NO: 5640446 - DNA, 22 bp, Homo sapiens
tcaagaaactgaggaattttct

SEQ ID NO: 5640447 - DNA, 23 bp, Homo sapiens
tcaagaaactgaggaattttctt

SEQ ID NO: 5640448 - DNA, 20 bp, Homo sapiens
tcaagaaagcagtatatatt

SEQ ID NO: 5640449 - DNA, 18 bp, Homo sapiens
tcaagaaagccagtctta

SEQ ID NO: 5640450 - DNA, 20 bp, Homo sapiens
tcaagaaagccagtcttaac

SEQ ID NO: 5640451 - DNA, 15 bp, Homo sapiens
tcaagaaataggtta

SEQ ID NO: 5640452 - DNA, 10 bp, Homo sapiens
tcaagaaatg

SEQ ID NO: 5640453 - DNA, 15 bp, Homo sapiens
tcaagaaatgagtct

SEQ ID NO: 5640454 - DNA, 15 bp, Homo sapiens
tcaagaaattctgct

SEQ ID NO: 5640455 - DNA, 15 bp, Homo sapiens
tcaagaaattttcaa

SEQ ID NO: 5640456 - DNA, 14 bp, Homo sapiens
tcaagaacaagcaa

SEQ ID NO: 5640457 - DNA, 23 bp, Homo sapiens
tcaagaacatgatgggcctgaac

SEQ ID NO: 5640458 - DNA, 15 bp, Homo sapiens
tcaagaacttgttta

SEQ ID NO: 5640459 - DNA, 14 bp, Homo sapiens
tcaagaagaaaaag

SEQ ID NO: 5640460 - DNA, 13 bp, Homo sapiens
tcaagaagaaagt

SEQ ID NO: 5640461 - DNA, 13 bp, Homo sapiens
tcaagaagacact

SEQ ID NO: 5640462 - DNA, 23 bp, Homo sapiens
tcaagaagacggattatctagag

SEQ ID NO: 5640463 - DNA, 17 bp, Homo sapiens
tcaagaagatagttgta

SEQ ID NO: 5640464 - DNA, 20 bp, Homo sapiens
tcaagaagtatttttttaat

SEQ ID NO: 5640465 - DNA, 14 bp, Homo sapiens
tcaagaagttcttt

SEQ ID NO: 5640466 - DNA, 17 bp, Homo sapiens
tcaagaatctagaagat

SEQ ID NO: 5640467 - DNA, 15 bp, Homo sapiens
tcaagaatgcaatat

SEQ ID NO: 5640468 - DNA, 20 bp, Homo sapiens
tcaagaattagaagtctttc

SEQ ID NO: 5640469 - DNA, 18 bp, Homo sapiens
tcaagacaagagctgtta

SEQ ID NO: 5640470 - DNA, 19 bp, Homo sapiens
tcaagacaagagctgttat

SEQ ID NO: 5640471 - DNA, 21 bp, Homo sapiens
tcaagacagatgagcaggagc

SEQ ID NO: 5640472 - DNA, 21 bp, Homo sapiens
tcaagacatagcatccaagtg

SEQ ID NO: 5640473 - DNA, 13 bp, Homo sapiens
tcaagacatttct

SEQ ID NO: 5640474 - DNA, 14 bp, Homo sapiens
tcaagacatttgct

SEQ ID NO: 5640475 - DNA, 13 bp, Homo sapiens
tcaagaccaaatg

SEQ ID NO: 5640476 - DNA, 21 bp, Homo sapiens
tcaagaccaaatggaaacaga

SEQ ID NO: 5640477 - DNA, 23 bp, Homo sapiens
tcaagaccaggctgcagcctcca

SEQ ID NO: 5640478 - DNA, 19 bp, Homo sapiens
tcaagaccagtctggccaa

SEQ ID NO: 5640479 - DNA, 11 bp, Homo sapiens
tcaagaccccc

SEQ ID NO: 5640480 - DNA, 22 bp, Homo sapiens
tcaagacccccatttgtcccag

SEQ ID NO: 5640481 - DNA, 17 bp, Homo sapiens
tcaagacgaggggcagg

SEQ ID NO: 5640482 - DNA, 17 bp, Homo sapiens
tcaagacggatccacag

SEQ ID NO: 5640483 - DNA, 19 bp, Homo sapiens
tcaagacggatccacagta

SEQ ID NO: 5640484 - DNA, 19 bp, Homo sapiens
tcaagactatctacaaaaa

SEQ ID NO: 5640485 - DNA, 17 bp, Homo sapiens
tcaagactatgttctcc

SEQ ID NO: 5640486 - DNA, 12 bp, Homo sapiens
tcaagactgaaa

SEQ ID NO: 5640487 - DNA, 16 bp, Homo sapiens
tcaagactgaattcca

SEQ ID NO: 5640488 - DNA, 14 bp, Homo sapiens
tcaagactgatcat

SEQ ID NO: 5640489 - DNA, 15 bp, Homo sapiens
tcaagactttagctt

SEQ ID NO: 5640490 - DNA, 20 bp, Homo sapiens
tcaagactttagcttttcct

SEQ ID NO: 5640491 - DNA, 21 bp, Homo sapiens
tcaagactttagcttttcctt

SEQ ID NO: 5640492 - DNA, 15 bp, Homo sapiens
tcaagagaatcaaca

SEQ ID NO: 5640493 - DNA, 14 bp, Homo sapiens
tcaagagacatggt

SEQ ID NO: 5640494 - DNA, 15 bp, Homo sapiens
tcaagagactgagtc

SEQ ID NO: 5640495 - DNA, 22 bp, Homo sapiens
tcaagagagaggctgagaaatg

SEQ ID NO: 5640496 - DNA, 16 bp, Homo sapiens
tcaagagatctttctt

SEQ ID NO: 5640497 - DNA, 17 bp, Homo sapiens
tcaagagattctgcctc

SEQ ID NO: 5640498 - DNA, 15 bp, Homo sapiens
tcaagagatttaatt

SEQ ID NO: 5640499 - DNA, 14 bp, Homo sapiens
tcaagagccaagac

SEQ ID NO: 5640500 - DNA, 15 bp, Homo sapiens
tcaagagcctcccct

SEQ ID NO: 5640501 - DNA, 19 bp, Homo sapiens
tcaagagccttaaaacatc

SEQ ID NO: 5640502 - DNA, 17 bp, Homo sapiens
tcaagagctgccctcct

SEQ ID NO: 5640503 - DNA, 22 bp, Homo sapiens
tcaagaggaatgaaaaaagctt

SEQ ID NO: 5640504 - DNA, 23 bp, Homo sapiens
tcaagaggacaatctagctctcc

SEQ ID NO: 5640505 - DNA, 17 bp, Homo sapiens
tcaagaggataaatttt

SEQ ID NO: 5640506 - DNA, 16 bp, Homo sapiens
tcaagaggcagagttc

SEQ ID NO: 5640507 - DNA, 19 bp, Homo sapiens
tcaagaggtttttctcccc

SEQ ID NO: 5640508 - DNA, 15 bp, Homo sapiens
tcaagagtccggatt

SEQ ID NO: 5640509 - DNA, 19 bp, Homo sapiens
tcaagagtccggatttcta

SEQ ID NO: 5640510 - DNA, 21 bp, Homo sapiens
tcaagagtccggatttctaac

SEQ ID NO: 5640511 - DNA, 18 bp, Homo sapiens
tcaagagtctctccagcc

SEQ ID NO: 5640512 - DNA, 19 bp, Homo sapiens
tcaagagtctctccagcct

SEQ ID NO: 5640513 - DNA, 21 bp, Homo sapiens
tcaagagtgaattccctcact

SEQ ID NO: 5640514 - DNA, 15 bp, Homo sapiens
tcaagagtgctgaga

SEQ ID NO: 5640515 - DNA, 12 bp, Homo sapiens
tcaagagtgggg

SEQ ID NO: 5640516 - DNA, 18 bp, Homo sapiens
tcaagagttcagtgctca

SEQ ID NO: 5640517 - DNA, 19 bp, Homo sapiens
tcaagagtttattattgta

SEQ ID NO: 5640518 - DNA, 22 bp, Homo sapiens
tcaagataatcctagagtctta

SEQ ID NO: 5640519 - DNA, 17 bp, Homo sapiens
tcaagatacatgttgta

SEQ ID NO: 5640520 - DNA, 20 bp, Homo sapiens
tcaagatacatgttgtattt

SEQ ID NO: 5640521 - DNA, 18 bp, Homo sapiens
tcaagatacatttcatct

SEQ ID NO: 5640522 - DNA, 22 bp, Homo sapiens
tcaagatactgctactgtaatt

SEQ ID NO: 5640523 - DNA, 19 bp, Homo sapiens
tcaagatatatgtgtatac

SEQ ID NO: 5640524 - DNA, 21 bp, Homo sapiens
tcaagatatatgtgtatacat

SEQ ID NO: 5640525 - DNA, 13 bp, Homo sapiens
tcaagatatggaa

SEQ ID NO: 5640526 - DNA, 18 bp, Homo sapiens
tcaagatattcaggtggc

SEQ ID NO: 5640527 - DNA, 16 bp, Homo sapiens
tcaagatcaatgaaat

SEQ ID NO: 5640528 - DNA, 22 bp, Homo sapiens
tcaagatccaaatgctgtgcaa

SEQ ID NO: 5640529 - DNA, 22 bp, Homo sapiens
tcaagatcctcttgccacatct

SEQ ID NO: 5640530 - DNA, 14 bp, Homo sapiens
tcaagatgagcctg

SEQ ID NO: 5640531 - DNA, 16 bp, Homo sapiens
tcaagatgagcctggg

SEQ ID NO: 5640532 - DNA, 20 bp, Homo sapiens
tcaagatgctacaatggaaa

SEQ ID NO: 5640533 - DNA, 22 bp, Homo sapiens
tcaagatgggtgattatgaaat

SEQ ID NO: 5640534 - DNA, 18 bp, Homo sapiens
tcaagatgttatattaaa

SEQ ID NO: 5640535 - DNA, 20 bp, Homo sapiens
tcaagatgttatattaaaga

SEQ ID NO: 5640536 - DNA, 23 bp, Homo sapiens
tcaagattaattaaaatttggga

SEQ ID NO: 5640537 - DNA, 14 bp, Homo sapiens
tcaagattcagcta

SEQ ID NO: 5640538 - DNA, 16 bp, Homo sapiens
tcaagattcccaggag

SEQ ID NO: 5640539 - DNA, 19 bp, Homo sapiens
tcaagattcccaggagttc

SEQ ID NO: 5640540 - DNA, 20 bp, Homo sapiens
tcaagattcccaggagttct

SEQ ID NO: 5640541 - DNA, 16 bp, Homo sapiens
tcaagattctaaagct

SEQ ID NO: 5640542 - DNA, 18 bp, Homo sapiens
tcaagattctaaagctca

SEQ ID NO: 5640543 - DNA, 16 bp, Homo sapiens
tcaagatttgaccaaa

SEQ ID NO: 5640544 - DNA, 18 bp, Homo sapiens
tcaagattttttttgtaa

SEQ ID NO: 5640545 - DNA, 19 bp, Homo sapiens
tcaagattttttttgtaac

SEQ ID NO: 5640546 - DNA, 20 bp, Homo sapiens
tcaagattttttttgtaact

SEQ ID NO: 5640547 - DNA, 22 bp, Homo sapiens
tcaagattttttttgtaacttc

SEQ ID NO: 5640548 - DNA, 22 bp, Homo sapiens
tcaagcaaaaaaggtaactaac

SEQ ID NO: 5640549 - DNA, 21 bp, Homo sapiens
tcaagcaaacagcttcacaaa

SEQ ID NO: 5640550 - DNA, 14 bp, Homo sapiens
tcaagcaaacatca

SEQ ID NO: 5640551 - DNA, 20 bp, Homo sapiens
tcaagcaaagtattgtgaaa

SEQ ID NO: 5640552 - DNA, 23 bp, Homo sapiens
tcaagcaaatatttatgacctca

SEQ ID NO: 5640553 - DNA, 20 bp, Homo sapiens
tcaatggcaccttcattctc

SEQ ID NO: 5640554 - DNA, 15 bp, Homo sapiens
tcaatggctttgtac

SEQ ID NO: 5640555 - DNA, 12 bp, Homo sapiens
tcaatggctttt

SEQ ID NO: 5640556 - DNA, 21 bp, Homo sapiens
tcaatgggagtgaacatttct

SEQ ID NO: 5640557 - DNA, 23 bp, Homo sapiens
tcaatgggattttctagtttcct

SEQ ID NO: 5640558 - DNA, 17 bp, Homo sapiens
tcaatgggcaatgacag

SEQ ID NO: 5640559 - DNA, 16 bp, Homo sapiens
tcaatgggtaaataaa

SEQ ID NO: 5640560 - DNA, 18 bp, Homo sapiens
tcaatgggtaaataaatg

SEQ ID NO: 5640561 - DNA, 22 bp, Homo sapiens
tcaatgggttttaattttcagt

SEQ ID NO: 5640562 - DNA, 12 bp, Homo sapiens
tcaatggtagat

SEQ ID NO: 5640563 - DNA, 22 bp, Homo sapiens
tcaatggtagattcgctgtccc

SEQ ID NO: 5640564 - DNA, 17 bp, Homo sapiens
tcaatggttcaagtctt

SEQ ID NO: 5640565 - DNA, 19 bp, Homo sapiens
tcaatggtttaacatataa

SEQ ID NO: 5640566 - DNA, 17 bp, Homo sapiens
tcaatgtacatagaccc

SEQ ID NO: 5640567 - DNA, 17 bp, Homo sapiens
tcaatgtacttgtttga

SEQ ID NO: 5640568 - DNA, 20 bp, Homo sapiens
tcaatgtcataaatgtcaca

SEQ ID NO: 5640569 - DNA, 21 bp, Homo sapiens
tcaatgtcataaatgtcacaa

SEQ ID NO: 5640570 - DNA, 19 bp, Homo sapiens
tcaatgtcttaggtcagga

SEQ ID NO: 5640571 - DNA, 12 bp, Homo sapiens
tcaatgtcttcc

SEQ ID NO: 5640572 - DNA, 11 bp, Homo sapiens
tcaatgtgaaa

SEQ ID NO: 5640573 - DNA, 15 bp, Homo sapiens
tcaatgtgattctaa

SEQ ID NO: 5640574 - DNA, 13 bp, Homo sapiens
tcaatgtgcagtg

SEQ ID NO: 5640575 - DNA, 19 bp, Homo sapiens
tcaatgtgctgttgattct

SEQ ID NO: 5640576 - DNA, 20 bp, Homo sapiens
tcaatgtgctgttgattctt

SEQ ID NO: 5640577 - DNA, 22 bp, Homo sapiens
tcaatgtggaaaaaatatttta

SEQ ID NO: 5640578 - DNA, 18 bp, Homo sapiens
tcaatgtggtgatgaaat

SEQ ID NO: 5640579 - DNA, 14 bp, Homo sapiens
tcaatgtgtataaa

SEQ ID NO: 5640580 - DNA, 18 bp, Homo sapiens
tcaatgtgtttaattttg

SEQ ID NO: 5640581 - DNA, 15 bp, Homo sapiens
tcaatgttaaatcta

SEQ ID NO: 5640582 - DNA, 18 bp, Homo sapiens
tcaatgttcattgtaatg

SEQ ID NO: 5640583 - DNA, 12 bp, Homo sapiens
tcaatgttccat

SEQ ID NO: 5640584 - DNA, 13 bp, Homo sapiens
tcaatgtttctgg

SEQ ID NO: 5640585 - DNA, 14 bp, Homo sapiens
tcaatgtttctgga

SEQ ID NO: 5640586 - DNA, 17 bp, Homo sapiens
tcaatgtttctggacat

SEQ ID NO: 5640587 - DNA, 20 bp, Homo sapiens
tcaatgtttctggacattct

SEQ ID NO: 5640588 - DNA, 23 bp, Homo sapiens
tcaatgtttgaggagcatgtttt

SEQ ID NO: 5640589 - DNA, 15 bp, Homo sapiens
tcaatgttttcagtt

SEQ ID NO: 5640590 - DNA, 14 bp, Homo sapiens
tcaatgttttcttt

SEQ ID NO: 5640591 - DNA, 18 bp, Homo sapiens
tcaatgtttttaaaaatc

SEQ ID NO: 5640592 - DNA, 23 bp, Homo sapiens
tcaattaaaatagtctctttaaa

SEQ ID NO: 5640593 - DNA, 15 bp, Homo sapiens
tcaattaaacggatt

SEQ ID NO: 5640594 - DNA, 17 bp, Homo sapiens
tcaattaaagaaataat

SEQ ID NO: 5640595 - DNA, 15 bp, Homo sapiens
tcaattaaagtctat

SEQ ID NO: 5640596 - DNA, 14 bp, Homo sapiens
tcaattaaatgtag

SEQ ID NO: 5640597 - DNA, 19 bp, Homo sapiens
tcaattaatggaaaactgt

SEQ ID NO: 5640598 - DNA, 13 bp, Homo sapiens
tcaattacaggaa

SEQ ID NO: 5640599 - DNA, 16 bp, Homo sapiens
tcaattactggtccaa

SEQ ID NO: 5640600 - DNA, 17 bp, Homo sapiens
tcaattagaaaaggaaa

SEQ ID NO: 5640601 - DNA, 18 bp, Homo sapiens
tcaattagaaaaggaaat

SEQ ID NO: 5640602 - DNA, 22 bp, Homo sapiens
tcaattagatttaaaataaaca

SEQ ID NO: 5640603 - DNA, 22 bp, Homo sapiens
tcaattaggggcaatagtagaa

SEQ ID NO: 5640604 - DNA, 17 bp, Homo sapiens
tcaattagtacagtagc

SEQ ID NO: 5640605 - DNA, 15 bp, Homo sapiens
tcaattatagtttct

SEQ ID NO: 5640606 - DNA, 21 bp, Homo sapiens
tcaattatattgttagtggac

SEQ ID NO: 5640607 - DNA, 15 bp, Homo sapiens
tcaattatctttatc

SEQ ID NO: 5640608 - DNA, 22 bp, Homo sapiens
tcaattattacatttatacatc

SEQ ID NO: 5640609 - DNA, 11 bp, Homo sapiens
tcaattatttc

SEQ ID NO: 5640610 - DNA, 15 bp, Homo sapiens
tcaattcaaaaatgt

SEQ ID NO: 5640611 - DNA, 17 bp, Homo sapiens
tcaattcaaaaatgtac

SEQ ID NO: 5640612 - DNA, 15 bp, Homo sapiens
tcaattcaaaagctc

SEQ ID NO: 5640613 - DNA, 18 bp, Homo sapiens
tcaattcaacacattact

SEQ ID NO: 5640614 - DNA, 13 bp, Homo sapiens
tcaattcaacact

SEQ ID NO: 5640615 - DNA, 15 bp, Homo sapiens
tcaattcaatttgga

SEQ ID NO: 5640616 - DNA, 18 bp, Homo sapiens
tcaattcagattgtcttg

SEQ ID NO: 5640617 - DNA, 13 bp, Homo sapiens
tcaattcagtgat

SEQ ID NO: 5640618 - DNA, 16 bp, Homo sapiens
tcaattcataaaaaca

SEQ ID NO: 5640619 - DNA, 15 bp, Homo sapiens
tcaattcatagaata

SEQ ID NO: 5640620 - DNA, 16 bp, Homo sapiens
tcaattcatatttatg

SEQ ID NO: 5640621 - DNA, 20 bp, Homo sapiens
tcaattcattaataaaatac

SEQ ID NO: 5640622 - DNA, 15 bp, Homo sapiens
tcaattccaacagtt

SEQ ID NO: 5640623 - DNA, 19 bp, Homo sapiens
tcaattccaacagtttaat

SEQ ID NO: 5640624 - DNA, 21 bp, Homo sapiens
tcaattccaccagggccagag

SEQ ID NO: 5640625 - DNA, 13 bp, Homo sapiens
tcaattccctctc

SEQ ID NO: 5640626 - DNA, 20 bp, Homo sapiens
tcaattccctctctcagcac

SEQ ID NO: 5640627 - DNA, 19 bp, Homo sapiens
tcaattccgtagccagctg

SEQ ID NO: 5640628 - DNA, 20 bp, Homo sapiens
tcaattctgatacagcctta

SEQ ID NO: 5640629 - DNA, 18 bp, Homo sapiens
tcaattctgtaattacat

SEQ ID NO: 5640630 - DNA, 20 bp, Homo sapiens
tcaattctgtaggttaaaaa

SEQ ID NO: 5640631 - DNA, 18 bp, Homo sapiens
tcaattctgtgtggtata

SEQ ID NO: 5640632 - DNA, 22 bp, Homo sapiens
tcaattcttcatgcgtgccctt

SEQ ID NO: 5640633 - DNA, 13 bp, Homo sapiens
tcaattcttgaga

SEQ ID NO: 5640634 - DNA, 16 bp, Homo sapiens
tcaattgagtaattct

SEQ ID NO: 5640635 - DNA, 22 bp, Homo sapiens
tcaattgagtaattctagacat

SEQ ID NO: 5640636 - DNA, 17 bp, Homo sapiens
tcaattgagttaaatca

SEQ ID NO: 5640637 - DNA, 22 bp, Homo sapiens
tcaattgagttaaatcagtaat

SEQ ID NO: 5640638 - DNA, 18 bp, Homo sapiens
tcaattgcatctcccaga

SEQ ID NO: 5640639 - DNA, 14 bp, Homo sapiens
tcaattgctttgta

SEQ ID NO: 5640640 - DNA, 16 bp, Homo sapiens
tcaattggcagtgact

SEQ ID NO: 5640641 - DNA, 18 bp, Homo sapiens
tcaattggcagtgacttt

SEQ ID NO: 5640642 - DNA, 18 bp, Homo sapiens
tcaattgtaaattgaatc

SEQ ID NO: 5640643 - DNA, 17 bp, Homo sapiens
tcaattgtgtctgtggt

SEQ ID NO: 5640644 - DNA, 16 bp, Homo sapiens
tcaattgtttaatgtt

SEQ ID NO: 5640645 - DNA, 19 bp, Homo sapiens
tcaattgtttatatggata

SEQ ID NO: 5640646 - DNA, 14 bp, Homo sapiens
tcaatttaaaccca

SEQ ID NO: 5640647 - DNA, 19 bp, Homo sapiens
tcaatttaaacccatttta

SEQ ID NO: 5640648 - DNA, 21 bp, Homo sapiens
tcaatttaaacccattttagt

SEQ ID NO: 5640649 - DNA, 16 bp, Homo sapiens
tcaatttaaatgttta

SEQ ID NO: 5640650 - DNA, 17 bp, Homo sapiens
tcaatttaaatgtttac

SEQ ID NO: 5640651 - DNA, 19 bp, Homo sapiens
tcaatttaagatacaaata

SEQ ID NO: 5640652 - DNA, 17 bp, Homo sapiens
tcaatttactttttaaa

SEQ ID NO: 5640653 - DNA, 23 bp, Homo sapiens
tcaatttactttttaaacagtgt

SEQ ID NO: 5640654 - DNA, 17 bp, Homo sapiens
tcaatttattgcacaaa

SEQ ID NO: 5640655 - DNA, 20 bp, Homo sapiens
tcaatttatttgaatgattt

SEQ ID NO: 5640656 - DNA, 20 bp, Homo sapiens
tcaatttcaaacttttgaaa

SEQ ID NO: 5640657 - DNA, 22 bp, Homo sapiens
tcaatttcaaacttttgaaaga

SEQ ID NO: 5640658 - DNA, 19 bp, Homo sapiens
tcaatttcaattttgtctg

SEQ ID NO: 5640659 - DNA, 13 bp, Homo sapiens
tcaatttcatgtt

SEQ ID NO: 5640660 - DNA, 15 bp, Homo sapiens
tcaatttcattatca

SEQ ID NO: 5640661 - DNA, 13 bp, Homo sapiens
tcaatttccaaga

SEQ ID NO: 5640662 - DNA, 16 bp, Homo sapiens
tcaatttcccacccat

SEQ ID NO: 5640663 - DNA, 21 bp, Homo sapiens
tcaatttcccacccatctcca

SEQ ID NO: 5640664 - DNA, 12 bp, Homo sapiens
tcaatttccctc

SEQ ID NO: 5640665 - DNA, 18 bp, Homo sapiens
tcaatttccctcaggttc

SEQ ID NO: 5640666 - DNA, 21 bp, Homo sapiens
tcaatttccctgactcctcta

SEQ ID NO: 5640667 - DNA, 20 bp, Homo sapiens
tcaatttcctcatctgggtc

SEQ ID NO: 5640668 - DNA, 18 bp, Homo sapiens
tcaatttctaatgtttac

SEQ ID NO: 5640669 - DNA, 15 bp, Homo sapiens
tcaatttctgtgttg

SEQ ID NO: 5640670 - DNA, 16 bp, Homo sapiens
tcaatttgaaatcacc

SEQ ID NO: 5640671 - DNA, 16 bp, Homo sapiens
tcaatttgatgtggtg

SEQ ID NO: 5640672 - DNA, 20 bp, Homo sapiens
tcaatttgccattggtttct

SEQ ID NO: 5640673 - DNA, 14 bp, Homo sapiens
tcaatttgctgaaa

SEQ ID NO: 5640674 - DNA, 23 bp, Homo sapiens
tcaatttggagcattaactaaat

SEQ ID NO: 5640675 - DNA, 17 bp, Homo sapiens
tcaatttggatatttgg

SEQ ID NO: 5640676 - DNA, 20 bp, Homo sapiens
tcaatttgggggacatgcta

SEQ ID NO: 5640677 - DNA, 13 bp, Homo sapiens
tcaatttgtatat

SEQ ID NO: 5640678 - DNA, 20 bp, Homo sapiens
tcaatttgtcattttgaagc

SEQ ID NO: 5640679 - DNA, 19 bp, Homo sapiens
tcaatttgttaacagagca

SEQ ID NO: 5640680 - DNA, 13 bp, Homo sapiens
tcaattttaaaca

SEQ ID NO: 5640681 - DNA, 15 bp, Homo sapiens
tcaattttaaacata

SEQ ID NO: 5640682 - DNA, 16 bp, Homo sapiens
tcaattttaaacatat

SEQ ID NO: 5640683 - DNA, 21 bp, Homo sapiens
tcaattttatccctcacctgt

SEQ ID NO: 5640684 - DNA, 22 bp, Homo sapiens
tcaattttatccctcacctgta

SEQ ID NO: 5640685 - DNA, 16 bp, Homo sapiens
tcaattttatgtattc

SEQ ID NO: 5640686 - DNA, 16 bp, Homo sapiens
tcaattttcactgtgt

SEQ ID NO: 5640687 - DNA, 18 bp, Homo sapiens
tcaattttcattaaactt

SEQ ID NO: 5640688 - DNA, 22 bp, Homo sapiens
tcaattttctttagcttttacc

SEQ ID NO: 5640689 - DNA, 14 bp, Homo sapiens
tcaattttgaaaac

SEQ ID NO: 5640690 - DNA, 17 bp, Homo sapiens
tcaattttggtttttct

SEQ ID NO: 5640691 - DNA, 17 bp, Homo sapiens
tcaattttgtatttaat

SEQ ID NO: 5640692 - DNA, 20 bp, Homo sapiens
tcaattttgtatttaatgat

SEQ ID NO: 5640693 - DNA, 14 bp, Homo sapiens
tcaatttttaggaa

SEQ ID NO: 5640694 - DNA, 14 bp, Homo sapiens
tcaatttttataca

SEQ ID NO: 5640695 - DNA, 22 bp, Homo sapiens
tcaatttttatacatatcagaa

SEQ ID NO: 5640696 - DNA, 20 bp, Homo sapiens
tcaatttttcccagtatttt

SEQ ID NO: 5640697 - DNA, 23 bp, Homo sapiens
tcaatttttcttatttcatttct

SEQ ID NO: 5640698 - DNA, 17 bp, Homo sapiens
tcaatttttgtctcaga

SEQ ID NO: 5640699 - DNA, 19 bp, Homo sapiens
tcaatttttgtctcagaag

SEQ ID NO: 5640700 - DNA, 14 bp, Homo sapiens
tcaattttttcaaa

SEQ ID NO: 5640701 - DNA, 18 bp, Homo sapiens
tcacaaaaaaagtaattg

SEQ ID NO: 5640702 - DNA, 14 bp, Homo sapiens
tcacaaaaaagaag

SEQ ID NO: 5640703 - DNA, 14 bp, Homo sapiens
tcacaaaaacaaaa

SEQ ID NO: 5640704 - DNA, 16 bp, Homo sapiens
tcacaaaaacaaaaaa

SEQ ID NO: 5640705 - DNA, 18 bp, Homo sapiens
tcacaaaaaggcaaatat

SEQ ID NO: 5640706 - DNA, 16 bp, Homo sapiens
tcacaaaaatttgaac

SEQ ID NO: 5640707 - DNA, 20 bp, Homo sapiens
tcacaaaaatttgaacactg

SEQ ID NO: 5640708 - DNA, 16 bp, Homo sapiens
tcacaaaacagccttt

SEQ ID NO: 5640709 - DNA, 17 bp, Homo sapiens
tcacaaaacctggcaca

SEQ ID NO: 5640710 - DNA, 21 bp, Homo sapiens
tcacaaaacctggcacaatgg

SEQ ID NO: 5640711 - DNA, 12 bp, Homo sapiens
tcacaaaagaaa

SEQ ID NO: 5640712 - DNA, 19 bp, Homo sapiens
tcacaaaagctgtgtctct

SEQ ID NO: 5640713 - DNA, 20 bp, Homo sapiens
tcacaaaagctgtgtctctg

SEQ ID NO: 5640714 - DNA, 21 bp, Homo sapiens
tcacaaaagctgtgtctctgt

SEQ ID NO: 5640715 - DNA, 23 bp, Homo sapiens
tcacaaaaggctggatgtgcttt

SEQ ID NO: 5640716 - DNA, 19 bp, Homo sapiens
tcacaaaaggttcttctgg

SEQ ID NO: 5640717 - DNA, 13 bp, Homo sapiens
tcacaaaatgcaa

SEQ ID NO: 5640718 - DNA, 13 bp, Homo sapiens
tcacaaaatgtct

SEQ ID NO: 5640719 - DNA, 17 bp, Homo sapiens
tcacaaaccagcctggg

SEQ ID NO: 5640720 - DNA, 16 bp, Homo sapiens
tcacaaactacctctg

SEQ ID NO: 5640721 - DNA, 19 bp, Homo sapiens
tcacaaactgatctaaaat

SEQ ID NO: 5640722 - DNA, 21 bp, Homo sapiens
tcacaaactgatctaaaatgt

SEQ ID NO: 5640723 - DNA, 12 bp, Homo sapiens
tcacaaactgtg

SEQ ID NO: 5640724 - DNA, 18 bp, Homo sapiens
tcacaaactgtgaaaata

SEQ ID NO: 5640725 - DNA, 20 bp, Homo sapiens
tcacaaactgtgaaaatagt

SEQ ID NO: 5640726 - DNA, 19 bp, Homo sapiens
tcacaaagagatgtccttg

SEQ ID NO: 5640727 - DNA, 14 bp, Homo sapiens
tcacaaagagctga

SEQ ID NO: 5640728 - DNA, 15 bp, Homo sapiens
tcacaaagcccaagg

SEQ ID NO: 5640729 - DNA, 18 bp, Homo sapiens
tcacaaagctaaatacat

SEQ ID NO: 5640730 - DNA, 19 bp, Homo sapiens
tcacaaagctaaatacatg

SEQ ID NO: 5640731 - DNA, 20 bp, Homo sapiens
tcacattggagtcactgcca

SEQ ID NO: 5640732 - DNA, 18 bp, Homo sapiens
tcacattgttcaactccc

SEQ ID NO: 5640733 - DNA, 13 bp, Homo sapiens
tcacattgtttct

SEQ ID NO: 5640734 - DNA, 11 bp, Homo sapiens
tcacatttaaa

SEQ ID NO: 5640735 - DNA, 13 bp, Homo sapiens
tcacatttaatat

SEQ ID NO: 5640736 - DNA, 19 bp, Homo sapiens
tcacatttagaaaagtgaa

SEQ ID NO: 5640737 - DNA, 15 bp, Homo sapiens
tcacatttgaattct

SEQ ID NO: 5640738 - DNA, 15 bp, Homo sapiens
tcacatttgatgtac

SEQ ID NO: 5640739 - DNA, 19 bp, Homo sapiens
tcacatttgatgtacatgt

SEQ ID NO: 5640740 - DNA, 20 bp, Homo sapiens
tcacatttggaatttaaaga

SEQ ID NO: 5640741 - DNA, 23 bp, Homo sapiens
tcacatttgtgaactcaaacgat

SEQ ID NO: 5640742 - DNA, 18 bp, Homo sapiens
tcacattttaagtgcttc

SEQ ID NO: 5640743 - DNA, 18 bp, Homo sapiens
tcacattttccttttcaa

SEQ ID NO: 5640744 - DNA, 13 bp, Homo sapiens
tcacattttctca

SEQ ID NO: 5640745 - DNA, 22 bp, Homo sapiens
tcacattttgttaagaagttga

SEQ ID NO: 5640746 - DNA, 19 bp, Homo sapiens
tcacatttttacttggtgt

SEQ ID NO: 5640747 - DNA, 20 bp, Homo sapiens
tcacatttttacttggtgta

SEQ ID NO: 5640748 - DNA, 20 bp, Homo sapiens
tcacatttttatacctgttt

SEQ ID NO: 5640749 - DNA, 17 bp, Homo sapiens
tcacattttttatgggc

SEQ ID NO: 5640750 - DNA, 14 bp, Homo sapiens
tcacatttttttct

SEQ ID NO: 5640751 - DNA, 17 bp, Homo sapiens
tcacatttttttctacc

SEQ ID NO: 5640752 - DNA, 16 bp, Homo sapiens
tcaccaaaagacactg

SEQ ID NO: 5640753 - DNA, 18 bp, Homo sapiens
tcaccaaacaacttggtt

SEQ ID NO: 5640754 - DNA, 22 bp, Homo sapiens
tcaccaaagatctgctcctcgc

SEQ ID NO: 5640755 - DNA, 18 bp, Homo sapiens
tcaccaaagtattaatgt

SEQ ID NO: 5640756 - DNA, 17 bp, Homo sapiens
tcaccaaatagtgtgaa

SEQ ID NO: 5640757 - DNA, 15 bp, Homo sapiens
tcaccaacacagttg

SEQ ID NO: 5640758 - DNA, 17 bp, Homo sapiens
tcaccaacgtctgtgcc

SEQ ID NO: 5640759 - DNA, 12 bp, Homo sapiens
tcaccaaggaaa

SEQ ID NO: 5640760 - DNA, 14 bp, Homo sapiens
tcaccaaggcagtg

SEQ ID NO: 5640761 - DNA, 20 bp, Homo sapiens
tcaccaaggcagtgcatgca

SEQ ID NO: 5640762 - DNA, 23 bp, Homo sapiens
tcaccaaggcagtgcatgcatgt

SEQ ID NO: 5640763 - DNA, 17 bp, Homo sapiens
tcaccaaggtggcttct

SEQ ID NO: 5640764 - DNA, 17 bp, Homo sapiens
tcaccaataacttcaga

SEQ ID NO: 5640765 - DNA, 22 bp, Homo sapiens
tcaccaataacttcagagaagt

SEQ ID NO: 5640766 - DNA, 15 bp, Homo sapiens
tcaccaatgagcctt

SEQ ID NO: 5640767 - DNA, 16 bp, Homo sapiens
tcaccaatgagcctta

SEQ ID NO: 5640768 - DNA, 23 bp, Homo sapiens
tcaccaatgtacccaccgggcca

SEQ ID NO: 5640769 - DNA, 15 bp, Homo sapiens
tcaccaatgttgtac

SEQ ID NO: 5640770 - DNA, 14 bp, Homo sapiens
tcaccaattaaaaa

SEQ ID NO: 5640771 - DNA, 18 bp, Homo sapiens
tcaccaattccacttcct

SEQ ID NO: 5640772 - DNA, 22 bp, Homo sapiens
tcaccacaaactgtaatacaat

SEQ ID NO: 5640773 - DNA, 19 bp, Homo sapiens
tcaccacaaccctgttgct

SEQ ID NO: 5640774 - DNA, 23 bp, Homo sapiens
tcaccacaaccctgttgctacat

SEQ ID NO: 5640775 - DNA, 21 bp, Homo sapiens
tcaccacaagccaccttttgt

SEQ ID NO: 5640776 - DNA, 17 bp, Homo sapiens
tcaccacaagctgagca

SEQ ID NO: 5640777 - DNA, 18 bp, Homo sapiens
tcaccacacccaggtctc

SEQ ID NO: 5640778 - DNA, 14 bp, Homo sapiens
tcaccacagacttt

SEQ ID NO: 5640779 - DNA, 16 bp, Homo sapiens
tcaccacagccttcta

SEQ ID NO: 5640780 - DNA, 20 bp, Homo sapiens
tcaccacatcttgtcttttc

SEQ ID NO: 5640781 - DNA, 21 bp, Homo sapiens
tcaccacatcttgtcttttcc

SEQ ID NO: 5640782 - DNA, 17 bp, Homo sapiens
tcaccacattctgtctc

SEQ ID NO: 5640783 - DNA, 19 bp, Homo sapiens
tcaccacattctgtctctg

SEQ ID NO: 5640784 - DNA, 22 bp, Homo sapiens
tcaccacattctgtctctgctt

SEQ ID NO: 5640785 - DNA, 19 bp, Homo sapiens
tcaccaccacacccctgcc

SEQ ID NO: 5640786 - DNA, 12 bp, Homo sapiens
tcaccaccaccc

SEQ ID NO: 5640787 - DNA, 18 bp, Homo sapiens
tcaccaccacccctacca

SEQ ID NO: 5640788 - DNA, 13 bp, Homo sapiens
tcaccacccagcc

SEQ ID NO: 5640789 - DNA, 14 bp, Homo sapiens
tcaccacccagccc

SEQ ID NO: 5640790 - DNA, 15 bp, Homo sapiens
tcaccacccagccct

SEQ ID NO: 5640791 - DNA, 17 bp, Homo sapiens
tcaccacccagcccttc

SEQ ID NO: 5640792 - DNA, 19 bp, Homo sapiens
tcaccacccagcccttcct

SEQ ID NO: 5640793 - DNA, 22 bp, Homo sapiens
tcaccaccccagtgaggacctc

SEQ ID NO: 5640794 - DNA, 12 bp, Homo sapiens
tcaccaccccca

SEQ ID NO: 5640795 - DNA, 17 bp, Homo sapiens
tcaccaccccctgtccc

SEQ ID NO: 5640796 - DNA, 15 bp, Homo sapiens
tcaccaccctcccct

SEQ ID NO: 5640797 - DNA, 11 bp, Homo sapiens
tcaccaccctg

SEQ ID NO: 5640798 - DNA, 13 bp, Homo sapiens
tcaccacctctcc

SEQ ID NO: 5640799 - DNA, 21 bp, Homo sapiens
tcaccacctctttctacagcc

SEQ ID NO: 5640800 - DNA, 15 bp, Homo sapiens
tcaccaccttcccag

SEQ ID NO: 5640801 - DNA, 21 bp, Homo sapiens
tcaccacgatgacgcctctgg

SEQ ID NO: 5640802 - DNA, 15 bp, Homo sapiens
tcaccacgcagagag

SEQ ID NO: 5640803 - DNA, 18 bp, Homo sapiens
tcaccacgtggggccatg

SEQ ID NO: 5640804 - DNA, 14 bp, Homo sapiens
tcaccactcctctc

SEQ ID NO: 5640805 - DNA, 13 bp, Homo sapiens
tcaccagaataaa

SEQ ID NO: 5640806 - DNA, 20 bp, Homo sapiens
tcaccagaattagtcctcac

SEQ ID NO: 5640807 - DNA, 23 bp, Homo sapiens
tcaccagaattagtcctcacagc

SEQ ID NO: 5640808 - DNA, 14 bp, Homo sapiens
tcaccagaatttct

SEQ ID NO: 5640809 - DNA, 16 bp, Homo sapiens
tcaccagactttggct

SEQ ID NO: 5640810 - DNA, 19 bp, Homo sapiens
tcaccagagactttagggg

SEQ ID NO: 5640811 - DNA, 17 bp, Homo sapiens
tcaccagagcttctctg

SEQ ID NO: 5640812 - DNA, 22 bp, Homo sapiens
tcaccagagcttctctgggctg

SEQ ID NO: 5640813 - DNA, 13 bp, Homo sapiens
tcaccagcaacat

SEQ ID NO: 5640814 - DNA, 21 bp, Homo sapiens
tcaccagcaactctgactctt

SEQ ID NO: 5640815 - DNA, 19 bp, Homo sapiens
tcaccagccccactgccag

SEQ ID NO: 5640816 - DNA, 22 bp, Homo sapiens
tcaccagccccactgccagcag

SEQ ID NO: 5640817 - DNA, 24 bp, Homo sapiens
tcaccagccccactgccagcagca

SEQ ID NO: 5640818 - DNA, 16 bp, Homo sapiens
tcaccagccccagtgc

SEQ ID NO: 5640819 - DNA, 20 bp, Homo sapiens
tcaccagccctgcagcccac

SEQ ID NO: 5640820 - DNA, 17 bp, Homo sapiens
tcaccagcctgactgca

SEQ ID NO: 5640821 - DNA, 11 bp, Homo sapiens
tcaccagcctt

SEQ ID NO: 5640822 - DNA, 17 bp, Homo sapiens
tcaccagcgttgggttt

SEQ ID NO: 5640823 - DNA, 14 bp, Homo sapiens
tcaccagctcagcc

SEQ ID NO: 5640824 - DNA, 21 bp, Homo sapiens
tcaccagctcagccccggcca

SEQ ID NO: 5640825 - DNA, 19 bp, Homo sapiens
tcaccagctgcaaagtgtt

SEQ ID NO: 5640826 - DNA, 15 bp, Homo sapiens
tcaccagctgcctct

SEQ ID NO: 5640827 - DNA, 13 bp, Homo sapiens
tcaccagctgctg

SEQ ID NO: 5640828 - DNA, 20 bp, Homo sapiens
tcaccagctgctgtgcccca

SEQ ID NO: 5640829 - DNA, 22 bp, Homo sapiens
tcaccaggaatgttaaagtcag

SEQ ID NO: 5640830 - DNA, 17 bp, Homo sapiens
tcaccaggacttggggt

SEQ ID NO: 5640831 - DNA, 16 bp, Homo sapiens
tcaccaggagattaca

SEQ ID NO: 5640832 - DNA, 16 bp, Homo sapiens
tcaccaggatgaaggc

SEQ ID NO: 5640833 - DNA, 19 bp, Homo sapiens
tcaccaggcagcctctggg

SEQ ID NO: 5640834 - DNA, 20 bp, Homo sapiens
tcaccaggcagcctctgggg

SEQ ID NO: 5640835 - DNA, 15 bp, Homo sapiens
tcaccaggcccacga

SEQ ID NO: 5640836 - DNA, 14 bp, Homo sapiens
tcaccaggcctggc

SEQ ID NO: 5640837 - DNA, 15 bp, Homo sapiens
tcaccaggcctggcc

SEQ ID NO: 5640838 - DNA, 17 bp, Homo sapiens
tcaccaggggaggagcc

SEQ ID NO: 5640839 - DNA, 24 bp, Homo sapiens
tcaccaggggaggagcctgtgcgt

SEQ ID NO: 5640840 - DNA, 18 bp, Homo sapiens
tcaccaggggcaggcaca

SEQ ID NO: 5640841 - DNA, 21 bp, Homo sapiens
tcaccagggtccgcaccagct

SEQ ID NO: 5640842 - DNA, 16 bp, Homo sapiens
tcaccaggtgcatctg

SEQ ID NO: 5640843 - DNA, 17 bp, Homo sapiens
tcaccaggtgcatctgc

SEQ ID NO: 5640844 - DNA, 22 bp, Homo sapiens
tcaccaggtgcatgcatgccct

SEQ ID NO: 5640845 - DNA, 21 bp, Homo sapiens
tcaccagtacattctcagttt

SEQ ID NO: 5640846 - DNA, 19 bp, Homo sapiens
tcaccagtctgtctactgt

SEQ ID NO: 5640847 - DNA, 23 bp, Homo sapiens
tcaccagtctgtctactgtggtg

SEQ ID NO: 5640848 - DNA, 15 bp, Homo sapiens
tcaccagtgccacgt

SEQ ID NO: 5640849 - DNA, 19 bp, Homo sapiens
tcaccagtgcgattctgga

SEQ ID NO: 5640850 - DNA, 21 bp, Homo sapiens
tcaccagtggccttggtcctt

SEQ ID NO: 5640851 - DNA, 16 bp, Homo sapiens
tcaccagtggcctttc

SEQ ID NO: 5640852 - DNA, 17 bp, Homo sapiens
tcaccagtgtcccctcc

SEQ ID NO: 5640853 - DNA, 20 bp, Homo sapiens
tcaccagtgtcccctccact

SEQ ID NO: 5640854 - DNA, 16 bp, Homo sapiens
tcaccagtgtttttct

SEQ ID NO: 5640855 - DNA, 20 bp, Homo sapiens
tcaccagttaaaagcatttt

SEQ ID NO: 5640856 - DNA, 19 bp, Homo sapiens
tcaccatagggctggggac

SEQ ID NO: 5640857 - DNA, 23 bp, Homo sapiens
tcaccatagttttgtttaatttg

SEQ ID NO: 5640858 - DNA, 15 bp, Homo sapiens
tcaccatatttgaat

SEQ ID NO: 5640859 - DNA, 21 bp, Homo sapiens
tcaccatatttgaattggcct

SEQ ID NO: 5640860 - DNA, 23 bp, Homo sapiens
tcaccatatttgaattggcctga

SEQ ID NO: 5640861 - DNA, 20 bp, Homo sapiens
tcaccatcaatcctgattcc

SEQ ID NO: 5640862 - DNA, 16 bp, Homo sapiens
tcaccatcatttctag

SEQ ID NO: 5640863 - DNA, 17 bp, Homo sapiens
tcaccatcatttctagt

SEQ ID NO: 5640864 - DNA, 20 bp, Homo sapiens
tcaccatccagagaccaaat

SEQ ID NO: 5640865 - DNA, 23 bp, Homo sapiens
tcaccatccagagaccaaataat

SEQ ID NO: 5640866 - DNA, 17 bp, Homo sapiens
tcaccatccagtgggcc

SEQ ID NO: 5640867 - DNA, 14 bp, Homo sapiens
tcaccatcctcaga

SEQ ID NO: 5640868 - DNA, 15 bp, Homo sapiens
tcaccatccttagac

SEQ ID NO: 5640869 - DNA, 17 bp, Homo sapiens
tcaccatctacctgctt

SEQ ID NO: 5640870 - DNA, 14 bp, Homo sapiens
tcaccatctcaggc

SEQ ID NO: 5640871 - DNA, 21 bp, Homo sapiens
tcaccatctcaggccacctgc

SEQ ID NO: 5640872 - DNA, 19 bp, Homo sapiens
tcaccatctttgaggtgag

SEQ ID NO: 5640873 - DNA, 20 bp, Homo sapiens
tcaccatctttgaggtgagg

SEQ ID NO: 5640874 - DNA, 13 bp, Homo sapiens
tcaccatctttgt

SEQ ID NO: 5640875 - DNA, 21 bp, Homo sapiens
tcaccatgatggccaggctga

SEQ ID NO: 5640876 - DNA, 16 bp, Homo sapiens
tcaccatgggaggtgg

SEQ ID NO: 5640877 - DNA, 21 bp, Homo sapiens
tcaccatgggaggtggggcct

SEQ ID NO: 5640878 - DNA, 20 bp, Homo sapiens
tcaccatgtaaaacaaaaaa

SEQ ID NO: 5640879 - DNA, 21 bp, Homo sapiens
tcaccatgtaaaacaaaaaac

SEQ ID NO: 5640880 - DNA, 18 bp, Homo sapiens
tcaccatgtaacaaccag

SEQ ID NO: 5640881 - DNA, 17 bp, Homo sapiens
tcaccatgtaagcactc

SEQ ID NO: 5640882 - DNA, 19 bp, Homo sapiens
tcaccatgtattttgtaaa

SEQ ID NO: 5640883 - DNA, 13 bp, Homo sapiens
tcaccatgttagc

SEQ ID NO: 5640884 - DNA, 21 bp, Homo sapiens
tcaccatgttagccaggctgg

SEQ ID NO: 5640885 - DNA, 17 bp, Homo sapiens
tcaccatgttagcctta

SEQ ID NO: 5640886 - DNA, 18 bp, Homo sapiens
tcaccatgttagccttag

SEQ ID NO: 5640887 - DNA, 21 bp, Homo sapiens
tcaccatgttggccaggctgg

SEQ ID NO: 5640888 - DNA, 23 bp, Homo sapiens
tcaccattataatgaatttagtg

SEQ ID NO: 5640889 - DNA, 21 bp, Homo sapiens
tcaccattcgtacataatact

SEQ ID NO: 5640890 - DNA, 21 bp, Homo sapiens
tcaccattctgcatttagctg

SEQ ID NO: 5640891 - DNA, 19 bp, Homo sapiens
tcaccatttccccagggca

SEQ ID NO: 5640892 - DNA, 17 bp, Homo sapiens
tcaccatttgattatgt

SEQ ID NO: 5640893 - DNA, 19 bp, Homo sapiens
tcacccaaacacttctgct

SEQ ID NO: 5640894 - DNA, 21 bp, Homo sapiens
tcacccaaacacttctgcttt

SEQ ID NO: 5640895 - DNA, 16 bp, Homo sapiens
tcacccaaagcctgtc

SEQ ID NO: 5640896 - DNA, 20 bp, Homo sapiens
tcacccaaagcctgtcccag

SEQ ID NO: 5640897 - DNA, 22 bp, Homo sapiens
tcacccaaagcctgtcccagga

SEQ ID NO: 5640898 - DNA, 16 bp, Homo sapiens
tcacccaatcccagtt

SEQ ID NO: 5640899 - DNA, 19 bp, Homo sapiens
tcacccaatcccagttctt

SEQ ID NO: 5640900 - DNA, 19 bp, Homo sapiens
tcacccacaaccctctgga

SEQ ID NO: 5640901 - DNA, 15 bp, Homo sapiens
tcacccacagaaaga

SEQ ID NO: 5640902 - DNA, 22 bp, Homo sapiens
tcacccacagggctaagagcta

SEQ ID NO: 5640903 - DNA, 13 bp, Homo sapiens
tcacccaccagct

SEQ ID NO: 5640904 - DNA, 23 bp, Homo sapiens
tcacccaccaggccagctcagga

SEQ ID NO: 5640905 - DNA, 18 bp, Homo sapiens
tcacccaccatggaccag

SEQ ID NO: 5640906 - DNA, 16 bp, Homo sapiens
tcacccaccccatgga

SEQ ID NO: 5640907 - DNA, 22 bp, Homo sapiens
tcacctgtttttaagctgtttc

SEQ ID NO: 5640908 - DNA, 23 bp, Homo sapiens
tcaccttaagaaagtgtctctgt

SEQ ID NO: 5640909 - DNA, 14 bp, Homo sapiens
tcaccttatgtatt

SEQ ID NO: 5640910 - DNA, 15 bp, Homo sapiens
tcaccttatgtatta

SEQ ID NO: 5640911 - DNA, 19 bp, Homo sapiens
tcaccttatgtattatttt

SEQ ID NO: 5640912 - DNA, 22 bp, Homo sapiens
tcaccttatgtattattttcta

SEQ ID NO: 5640913 - DNA, 15 bp, Homo sapiens
tcaccttccaacact

SEQ ID NO: 5640914 - DNA, 21 bp, Homo sapiens
tcaccttccaggacccctggg

SEQ ID NO: 5640915 - DNA, 11 bp, Homo sapiens
tcaccttccct

SEQ ID NO: 5640916 - DNA, 12 bp, Homo sapiens
tcaccttccctc

SEQ ID NO: 5640917 - DNA, 22 bp, Homo sapiens
tcaccttcctcagctcagctgg

SEQ ID NO: 5640918 - DNA, 14 bp, Homo sapiens
tcaccttcctgggc

SEQ ID NO: 5640919 - DNA, 15 bp, Homo sapiens
tcaccttcctgggca

SEQ ID NO: 5640920 - DNA, 21 bp, Homo sapiens
tcaccttcgtttactatgcct

SEQ ID NO: 5640921 - DNA, 20 bp, Homo sapiens
tcaccttctgttttagagtt

SEQ ID NO: 5640922 - DNA, 16 bp, Homo sapiens
tcaccttctttgtaat

SEQ ID NO: 5640923 - DNA, 18 bp, Homo sapiens
tcaccttgcaacacacag

SEQ ID NO: 5640924 - DNA, 19 bp, Homo sapiens
tcaccttgccgagagaggc

SEQ ID NO: 5640925 - DNA, 13 bp, Homo sapiens
tcaccttggaagg

SEQ ID NO: 5640926 - DNA, 18 bp, Homo sapiens
tcaccttggcaccagaca

SEQ ID NO: 5640927 - DNA, 19 bp, Homo sapiens
tcaccttggcaccagacac

SEQ ID NO: 5640928 - DNA, 16 bp, Homo sapiens
tcaccttgggctgggg

SEQ ID NO: 5640929 - DNA, 14 bp, Homo sapiens
tcaccttggggcct

SEQ ID NO: 5640930 - DNA, 21 bp, Homo sapiens
tcaccttgtaaccagtgcaga

SEQ ID NO: 5640931 - DNA, 13 bp, Homo sapiens
tcaccttgtattc

SEQ ID NO: 5640932 - DNA, 17 bp, Homo sapiens
tcaccttgtgtggcgca

SEQ ID NO: 5640933 - DNA, 20 bp, Homo sapiens
tcaccttgtgtgttccaagt

SEQ ID NO: 5640934 - DNA, 20 bp, Homo sapiens
tcacctttagaacaggagac

SEQ ID NO: 5640935 - DNA, 19 bp, Homo sapiens
tcacctttatatatgtact

SEQ ID NO: 5640936 - DNA, 14 bp, Homo sapiens
tcacctttcccacc

SEQ ID NO: 5640937 - DNA, 14 bp, Homo sapiens
tcacctttctgggc

SEQ ID NO: 5640938 - DNA, 20 bp, Homo sapiens
tcacctttctgggctttctc

SEQ ID NO: 5640939 - DNA, 22 bp, Homo sapiens
tcacctttctgggctttctcct

SEQ ID NO: 5640940 - DNA, 19 bp, Homo sapiens
tcacctttcttcttgtgtc

SEQ ID NO: 5640941 - DNA, 17 bp, Homo sapiens
tcacctttcttttgtaa

SEQ ID NO: 5640942 - DNA, 14 bp, Homo sapiens
tcacctttggtgca

SEQ ID NO: 5640943 - DNA, 14 bp, Homo sapiens
tcacctttgtaaga

SEQ ID NO: 5640944 - DNA, 12 bp, Homo sapiens
tcacctttgtag

SEQ ID NO: 5640945 - DNA, 12 bp, Homo sapiens
tcacctttgtcc

SEQ ID NO: 5640946 - DNA, 17 bp, Homo sapiens
tcacctttgtgtatttt

SEQ ID NO: 5640947 - DNA, 12 bp, Homo sapiens
tcaccttttaaa

SEQ ID NO: 5640948 - DNA, 17 bp, Homo sapiens
tcaccttttcaggaaaa

SEQ ID NO: 5640949 - DNA, 18 bp, Homo sapiens
tcaccttttctgtggctg

SEQ ID NO: 5640950 - DNA, 20 bp, Homo sapiens
tcacctttttgacttttcca

SEQ ID NO: 5640951 - DNA, 17 bp, Homo sapiens
tcacgaaactggaataa

SEQ ID NO: 5640952 - DNA, 19 bp, Homo sapiens
tcacgaatattatgcccag

SEQ ID NO: 5640953 - DNA, 20 bp, Homo sapiens
tcacgaatattatgcccagt

SEQ ID NO: 5640954 - DNA, 12 bp, Homo sapiens
tcacgacaatgt

SEQ ID NO: 5640955 - DNA, 18 bp, Homo sapiens
tcacgacacatttgcctt

SEQ ID NO: 5640956 - DNA, 18 bp, Homo sapiens
tcacgacaggaaaaaggt

SEQ ID NO: 5640957 - DNA, 19 bp, Homo sapiens
tcacgagcccattctcatg

SEQ ID NO: 5640958 - DNA, 23 bp, Homo sapiens
tcacgagcctttgtttttctcca

SEQ ID NO: 5640959 - DNA, 23 bp, Homo sapiens
tcacgagggtaggaccctcatga

SEQ ID NO: 5640960 - DNA, 16 bp, Homo sapiens
tcacgagtcatccaga

SEQ ID NO: 5640961 - DNA, 14 bp, Homo sapiens
tcacgattccagtg

SEQ ID NO: 5640962 - DNA, 15 bp, Homo sapiens
tcacgattccagtgc

SEQ ID NO: 5640963 - DNA, 13 bp, Homo sapiens
tcacgatttgcag

SEQ ID NO: 5640964 - DNA, 16 bp, Homo sapiens
tcacgcaacttgaaat

SEQ ID NO: 5640965 - DNA, 17 bp, Homo sapiens
tcacgcacctcccatcc

SEQ ID NO: 5640966 - DNA, 13 bp, Homo sapiens
tcacgccaccccc

SEQ ID NO: 5640967 - DNA, 17 bp, Homo sapiens
tcacgccacccccgccc

SEQ ID NO: 5640968 - DNA, 16 bp, Homo sapiens
tcacgccactgcactc

SEQ ID NO: 5640969 - DNA, 22 bp, Homo sapiens
tcacgccactgcactccagcct

SEQ ID NO: 5640970 - DNA, 18 bp, Homo sapiens
tcacgccagacttcccac

SEQ ID NO: 5640971 - DNA, 20 bp, Homo sapiens
tcacgccattctcctgcctc

SEQ ID NO: 5640972 - DNA, 20 bp, Homo sapiens
tcacgccattgtactccagc

SEQ ID NO: 5640973 - DNA, 21 bp, Homo sapiens
tcacgccattgtactccagcc

SEQ ID NO: 5640974 - DNA, 22 bp, Homo sapiens
tcacgccattgtactccagcct

SEQ ID NO: 5640975 - DNA, 16 bp, Homo sapiens
tcacgcccagcctcct

SEQ ID NO: 5640976 - DNA, 17 bp, Homo sapiens
tcacgccccgctgtgtc

SEQ ID NO: 5640977 - DNA, 20 bp, Homo sapiens
tcacgcctataatcccagca

SEQ ID NO: 5640978 - DNA, 15 bp, Homo sapiens
tcacgcctgaaactt

SEQ ID NO: 5640979 - DNA, 16 bp, Homo sapiens
tcacgcctgtaatccc

SEQ ID NO: 5640980 - DNA, 23 bp, Homo sapiens
tcacgcctgtaatcccagcactt

SEQ ID NO: 5640981 - DNA, 13 bp, Homo sapiens
tcacgcctgtgca

SEQ ID NO: 5640982 - DNA, 13 bp, Homo sapiens
tcacgctcaccca

SEQ ID NO: 5640983 - DNA, 22 bp, Homo sapiens
tcacgctcacccagtcacctcc

SEQ ID NO: 5640984 - DNA, 23 bp, Homo sapiens
tcacgctcccaacacaaggtggg

SEQ ID NO: 5640985 - DNA, 12 bp, Homo sapiens
tcacgctccccg

SEQ ID NO: 5640986 - DNA, 13 bp, Homo sapiens
tcacgctccctga

SEQ ID NO: 5640987 - DNA, 16 bp, Homo sapiens
tcacgctctggacatg

SEQ ID NO: 5640988 - DNA, 17 bp, Homo sapiens
tcacgctctggtgcagt

SEQ ID NO: 5640989 - DNA, 21 bp, Homo sapiens
tcacgctgacagcctcctagg

SEQ ID NO: 5640990 - DNA, 14 bp, Homo sapiens
tcacgctggcttcc

SEQ ID NO: 5640991 - DNA, 15 bp, Homo sapiens
tcacgctggcttcca

SEQ ID NO: 5640992 - DNA, 18 bp, Homo sapiens
tcacgctggggctctctg

SEQ ID NO: 5640993 - DNA, 23 bp, Homo sapiens
tcacgctggggctctctgagact

SEQ ID NO: 5640994 - DNA, 20 bp, Homo sapiens
tcacgcttgcctggtcaccc

SEQ ID NO: 5640995 - DNA, 12 bp, Homo sapiens
tcacgctttcat

SEQ ID NO: 5640996 - DNA, 16 bp, Homo sapiens
tcacgctttcatgacc

SEQ ID NO: 5640997 - DNA, 15 bp, Homo sapiens
tcacgctttcctgaa

SEQ ID NO: 5640998 - DNA, 17 bp, Homo sapiens
tcacgctttcctgaatc

SEQ ID NO: 5640999 - DNA, 16 bp, Homo sapiens
tcacggaagttttcaa

SEQ ID NO: 5641000 - DNA, 23 bp, Homo sapiens
tcacggaccactcgaggcctgca

SEQ ID NO: 5641001 - DNA, 15 bp, Homo sapiens
tcacggactctttgc

SEQ ID NO: 5641002 - DNA, 17 bp, Homo sapiens
tcacggactctttgctg

SEQ ID NO: 5641003 - DNA, 13 bp, Homo sapiens
tcacggcatgttt

SEQ ID NO: 5641004 - DNA, 20 bp, Homo sapiens
tcacggccacacagctgccg

SEQ ID NO: 5641005 - DNA, 14 bp, Homo sapiens
tcacggccaggcag

SEQ ID NO: 5641006 - DNA, 16 bp, Homo sapiens
tcacggcctggcatgc

SEQ ID NO: 5641007 - DNA, 14 bp, Homo sapiens
tcacggctgcgcac

SEQ ID NO: 5641008 - DNA, 18 bp, Homo sapiens
tcacggctgcgcactgtg

SEQ ID NO: 5641009 - DNA, 14 bp, Homo sapiens
tcacgggcccgctc

SEQ ID NO: 5641010 - DNA, 17 bp, Homo sapiens
tcacgggccctgcccca

SEQ ID NO: 5641011 - DNA, 18 bp, Homo sapiens
tcacgggcggtcctgcac

SEQ ID NO: 5641012 - DNA, 21 bp, Homo sapiens
tcacgggcggtcctgcacaga

SEQ ID NO: 5641013 - DNA, 21 bp, Homo sapiens
tcacggggttccctcctagct

SEQ ID NO: 5641014 - DNA, 22 bp, Homo sapiens
tcacggggttggctgttccaga

SEQ ID NO: 5641015 - DNA, 23 bp, Homo sapiens
tcacggggttggctgttccagac

SEQ ID NO: 5641016 - DNA, 17 bp, Homo sapiens
tcacggtgccaggtttt

SEQ ID NO: 5641017 - DNA, 18 bp, Homo sapiens
tcacgtaaagctagaaat

SEQ ID NO: 5641018 - DNA, 13 bp, Homo sapiens
tcacgtaaatatt

SEQ ID NO: 5641019 - DNA, 21 bp, Homo sapiens
tcacgtacaaaactctgtata

SEQ ID NO: 5641020 - DNA, 20 bp, Homo sapiens
tcacgtatttcacagagcac

SEQ ID NO: 5641021 - DNA, 14 bp, Homo sapiens
tcacgtcactgcca

SEQ ID NO: 5641022 - DNA, 17 bp, Homo sapiens
tcacgtcataggaagtt

SEQ ID NO: 5641023 - DNA, 21 bp, Homo sapiens
tcacgtctctgccgcctgcgt

SEQ ID NO: 5641024 - DNA, 13 bp, Homo sapiens
tcacgtctgacaa

SEQ ID NO: 5641025 - DNA, 20 bp, Homo sapiens
tcacgtctgacaaatgtgta

SEQ ID NO: 5641026 - DNA, 17 bp, Homo sapiens
tcacgtgaccagccccg

SEQ ID NO: 5641027 - DNA, 16 bp, Homo sapiens
tcacgtgaccctgtgc

SEQ ID NO: 5641028 - DNA, 17 bp, Homo sapiens
tcacgtgaccctgtgcc

SEQ ID NO: 5641029 - DNA, 16 bp, Homo sapiens
tcacgtgaggcccctg

SEQ ID NO: 5641030 - DNA, 14 bp, Homo sapiens
tcacgtgcaggaca

SEQ ID NO: 5641031 - DNA, 18 bp, Homo sapiens
tcacgtgcaggacagctc

SEQ ID NO: 5641032 - DNA, 23 bp, Homo sapiens
tcacgtgcgctgggcacttccct

SEQ ID NO: 5641033 - DNA, 20 bp, Homo sapiens
tcacgtggtcaaggcccggc

SEQ ID NO: 5641034 - DNA, 19 bp, Homo sapiens
tcacgtgtaaacaggatta

SEQ ID NO: 5641035 - DNA, 16 bp, Homo sapiens
tcacgtgtactggctc

SEQ ID NO: 5641036 - DNA, 18 bp, Homo sapiens
tcacgtgtactggctcct

SEQ ID NO: 5641037 - DNA, 16 bp, Homo sapiens
tcacgtgtgtgactca

SEQ ID NO: 5641038 - DNA, 17 bp, Homo sapiens
tcacgtgtgtgactcag

SEQ ID NO: 5641039 - DNA, 21 bp, Homo sapiens
tcacgtgtgtgtatgctgtgt

SEQ ID NO: 5641040 - DNA, 20 bp, Homo sapiens
tcacgttaccatttacatgt

SEQ ID NO: 5641041 - DNA, 14 bp, Homo sapiens
tcacgttggccctc

SEQ ID NO: 5641042 - DNA, 20 bp, Homo sapiens
tcacgttggggtgatttaat

SEQ ID NO: 5641043 - DNA, 22 bp, Homo sapiens
tcacgtttcatgtaatcctcaa

SEQ ID NO: 5641044 - DNA, 15 bp, Homo sapiens
tcacgtttcttcccc

SEQ ID NO: 5641045 - DNA, 18 bp, Homo sapiens
tcactaaaagcatgaatt

SEQ ID NO: 5641046 - DNA, 22 bp, Homo sapiens
tcactaaaagcatgaattggaa

SEQ ID NO: 5641047 - DNA, 19 bp, Homo sapiens
tcactaaaaggaagacagt

SEQ ID NO: 5641048 - DNA, 21 bp, Homo sapiens
tcactaaaagtctccaaaaca

SEQ ID NO: 5641049 - DNA, 13 bp, Homo sapiens
tcactaaaagtgt

SEQ ID NO: 5641050 - DNA, 19 bp, Homo sapiens
tcactaaaccgataatgca

SEQ ID NO: 5641051 - DNA, 13 bp, Homo sapiens
tcactaaactctg

SEQ ID NO: 5641052 - DNA, 21 bp, Homo sapiens
tcactaaagcatgaaatgtga

SEQ ID NO: 5641053 - DNA, 17 bp, Homo sapiens
tcactaaatcttttata

SEQ ID NO: 5641054 - DNA, 15 bp, Homo sapiens
tcactaaatgtaaaa

SEQ ID NO: 5641055 - DNA, 14 bp, Homo sapiens
tcactaacagggag

SEQ ID NO: 5641056 - DNA, 22 bp, Homo sapiens
tcactaacagggagaagtagct

SEQ ID NO: 5641057 - DNA, 16 bp, Homo sapiens
tcactaacattatatt

SEQ ID NO: 5641058 - DNA, 21 bp, Homo sapiens
tcactaacattatattgcaat

SEQ ID NO: 5641059 - DNA, 14 bp, Homo sapiens
tcactaagaaagaa

SEQ ID NO: 5641060 - DNA, 22 bp, Homo sapiens
tcactaagaacaaaagaagcag

SEQ ID NO: 5641061 - DNA, 16 bp, Homo sapiens
tcactaagaatataaa

SEQ ID NO: 5641062 - DNA, 20 bp, Homo sapiens
tcactaataaagtctgtctg

SEQ ID NO: 5641063 - DNA, 19 bp, Homo sapiens
tcactaatcatgagaaaaa

SEQ ID NO: 5641064 - DNA, 16 bp, Homo sapiens
tcactaatcttgaatg

SEQ ID NO: 5641065 - DNA, 14 bp, Homo sapiens
tcactaattcatta

SEQ ID NO: 5641066 - DNA, 15 bp, Homo sapiens
tcactaattcattaa

SEQ ID NO: 5641067 - DNA, 18 bp, Homo sapiens
tcactaattcattaatct

SEQ ID NO: 5641068 - DNA, 13 bp, Homo sapiens
tcactacaacctc

SEQ ID NO: 5641069 - DNA, 19 bp, Homo sapiens
tcactacatgggccagccc

SEQ ID NO: 5641070 - DNA, 23 bp, Homo sapiens
tcactaccctaatagactaaatg

SEQ ID NO: 5641071 - DNA, 23 bp, Homo sapiens
tcactacctttatagctcatcac

SEQ ID NO: 5641072 - DNA, 23 bp, Homo sapiens
tcactacctttatagctctcatc

SEQ ID NO: 5641073 - DNA, 14 bp, Homo sapiens
tcactactcagcat

SEQ ID NO: 5641074 - DNA, 12 bp, Homo sapiens
tcactactgcag

SEQ ID NO: 5641075 - DNA, 15 bp, Homo sapiens
tcactactgcattta

SEQ ID NO: 5641076 - DNA, 13 bp, Homo sapiens
tcactactggtct

SEQ ID NO: 5641077 - DNA, 14 bp, Homo sapiens
tcactactggtctg

SEQ ID NO: 5641078 - DNA, 11 bp, Homo sapiens
tcactactgta

SEQ ID NO: 5641079 - DNA, 19 bp, Homo sapiens
tcactagaatggataaaat

SEQ ID NO: 5641080 - DNA, 21 bp, Homo sapiens
tcactagagacaaatctttaa

SEQ ID NO: 5641081 - DNA, 14 bp, Homo sapiens
tcactagcagctgc

SEQ ID NO: 5641082 - DNA, 17 bp, Homo sapiens
tcactagcagctgcagt

SEQ ID NO: 5641083 - DNA, 22 bp, Homo sapiens
tcactagccatgctttatgtgg

SEQ ID NO: 5641084 - DNA, 23 bp, Homo sapiens
tcactagctccccaatccctgac

SEQ ID NO: 5641085 - DNA, 20 bp, Homo sapiens
tcagaaccttgtcccagcca

SEQ ID NO: 5641086 - DNA, 14 bp, Homo sapiens
tcagaactaaattt

SEQ ID NO: 5641087 - DNA, 20 bp, Homo sapiens
tcagaactaaatttttcata

SEQ ID NO: 5641088 - DNA, 22 bp, Homo sapiens
tcagaactaaatttttcataga

SEQ ID NO: 5641089 - DNA, 16 bp, Homo sapiens
tcagaactaactttgg

SEQ ID NO: 5641090 - DNA, 16 bp, Homo sapiens
tcagaactatgttttt

SEQ ID NO: 5641091 - DNA, 21 bp, Homo sapiens
tcagaactcaaatggggccag

SEQ ID NO: 5641092 - DNA, 16 bp, Homo sapiens
tcagaactcctttcta

SEQ ID NO: 5641093 - DNA, 15 bp, Homo sapiens
tcagaactctcagac

SEQ ID NO: 5641094 - DNA, 16 bp, Homo sapiens
tcagaactctcagact

SEQ ID NO: 5641095 - DNA, 14 bp, Homo sapiens
tcagaactcttcct

SEQ ID NO: 5641096 - DNA, 15 bp, Homo sapiens
tcagaactcttcctc

SEQ ID NO: 5641097 - DNA, 21 bp, Homo sapiens
tcagaactgaaataaaaaatt

SEQ ID NO: 5641098 - DNA, 19 bp, Homo sapiens
tcagaactgcccttgctgc

SEQ ID NO: 5641099 - DNA, 15 bp, Homo sapiens
tcagaactgtcccat

SEQ ID NO: 5641100 - DNA, 20 bp, Homo sapiens
tcagaactgtcggaggaaag

SEQ ID NO: 5641101 - DNA, 15 bp, Homo sapiens
tcagaactgtgccac

SEQ ID NO: 5641102 - DNA, 17 bp, Homo sapiens
tcagaacttcaggtgtg

SEQ ID NO: 5641103 - DNA, 18 bp, Homo sapiens
tcagaacttcatctgcca

SEQ ID NO: 5641104 - DNA, 16 bp, Homo sapiens
tcagaacttgctgctg

SEQ ID NO: 5641105 - DNA, 18 bp, Homo sapiens
tcagaacttgctgctgtc

SEQ ID NO: 5641106 - DNA, 21 bp, Homo sapiens
tcagaactttagtattaaatc

SEQ ID NO: 5641107 - DNA, 20 bp, Homo sapiens
tcagaagaaaaagaagctga

SEQ ID NO: 5641108 - DNA, 18 bp, Homo sapiens
tcagaagaaaggccaagg

SEQ ID NO: 5641109 - DNA, 23 bp, Homo sapiens
tcagaagaaaggccaaggtgctg

SEQ ID NO: 5641110 - DNA, 13 bp, Homo sapiens
tcagaagaaattt

SEQ ID NO: 5641111 - DNA, 18 bp, Homo sapiens
tcagaagaagtgggagca

SEQ ID NO: 5641112 - DNA, 21 bp, Homo sapiens
tcagaagaagtgggagcagct

SEQ ID NO: 5641113 - DNA, 22 bp, Homo sapiens
tcagaagaagtgggagcagctt

SEQ ID NO: 5641114 - DNA, 17 bp, Homo sapiens
tcagaagaatcttcctg

SEQ ID NO: 5641115 - DNA, 13 bp, Homo sapiens
tcagaagacacta

SEQ ID NO: 5641116 - DNA, 17 bp, Homo sapiens
tcagaagagttgtgcac

SEQ ID NO: 5641117 - DNA, 14 bp, Homo sapiens
tcagaagcaaacaa

SEQ ID NO: 5641118 - DNA, 14 bp, Homo sapiens
tcagaagcaagcca

SEQ ID NO: 5641119 - DNA, 16 bp, Homo sapiens
tcagaagcaaggaagt

SEQ ID NO: 5641120 - DNA, 20 bp, Homo sapiens
tcagaagcacagaatatttt

SEQ ID NO: 5641121 - DNA, 15 bp, Homo sapiens
tcagaagccagtctg

SEQ ID NO: 5641122 - DNA, 21 bp, Homo sapiens
tcagaagccccatttgcacag

SEQ ID NO: 5641123 - DNA, 22 bp, Homo sapiens
tcagaagcctattgtaaataca

SEQ ID NO: 5641124 - DNA, 22 bp, Homo sapiens
tcagaagcctccaagcctgcct

SEQ ID NO: 5641125 - DNA, 23 bp, Homo sapiens
tcagaagcctccaagcctgcctc

SEQ ID NO: 5641126 - DNA, 15 bp, Homo sapiens
tcagaagcctgaggc

SEQ ID NO: 5641127 - DNA, 23 bp, Homo sapiens
tcagaagcctgggggcctggctg

SEQ ID NO: 5641128 - DNA, 14 bp, Homo sapiens
tcagaagccttctt

SEQ ID NO: 5641129 - DNA, 16 bp, Homo sapiens
tcagaagccttcttgc

SEQ ID NO: 5641130 - DNA, 18 bp, Homo sapiens
tcagaagccttcttgctg

SEQ ID NO: 5641131 - DNA, 19 bp, Homo sapiens
tcagaagccttcttgctgc

SEQ ID NO: 5641132 - DNA, 20 bp, Homo sapiens
tcagaagccttcttgctgcc

SEQ ID NO: 5641133 - DNA, 15 bp, Homo sapiens
tcagaagctattttt

SEQ ID NO: 5641134 - DNA, 19 bp, Homo sapiens
tcagaagcttctgaaaaca

SEQ ID NO: 5641135 - DNA, 13 bp, Homo sapiens
tcagaaggacggc

SEQ ID NO: 5641136 - DNA, 12 bp, Homo sapiens
tcagaaggagaa

SEQ ID NO: 5641137 - DNA, 14 bp, Homo sapiens
tcagaaggagaagg

SEQ ID NO: 5641138 - DNA, 19 bp, Homo sapiens
tcagaaggagaaggaagga

SEQ ID NO: 5641139 - DNA, 22 bp, Homo sapiens
tcagaaggagaaggctggagaa

SEQ ID NO: 5641140 - DNA, 15 bp, Homo sapiens
tcagaaggagacaga

SEQ ID NO: 5641141 - DNA, 17 bp, Homo sapiens
tcagaaggatgcccaga

SEQ ID NO: 5641142 - DNA, 17 bp, Homo sapiens
tcagaaggcctcactca

SEQ ID NO: 5641143 - DNA, 17 bp, Homo sapiens
tcagaaggctggggcca

SEQ ID NO: 5641144 - DNA, 20 bp, Homo sapiens
tcagaaggctggggccagtg

SEQ ID NO: 5641145 - DNA, 14 bp, Homo sapiens
tcagaaggcttcat

SEQ ID NO: 5641146 - DNA, 17 bp, Homo sapiens
tcagaaggctttgggat

SEQ ID NO: 5641147 - DNA, 12 bp, Homo sapiens
tcagaagggagg

SEQ ID NO: 5641148 - DNA, 13 bp, Homo sapiens
tcagaagggctat

SEQ ID NO: 5641149 - DNA, 20 bp, Homo sapiens
tcagaaggggaggggagaca

SEQ ID NO: 5641150 - DNA, 22 bp, Homo sapiens
tcagaaggtaggggccgtgtcc

SEQ ID NO: 5641151 - DNA, 18 bp, Homo sapiens
tcagaaggttcacccagc

SEQ ID NO: 5641152 - DNA, 18 bp, Homo sapiens
tcagaagtaactcccact

SEQ ID NO: 5641153 - DNA, 19 bp, Homo sapiens
tcagaagtatggaattttc

SEQ ID NO: 5641154 - DNA, 15 bp, Homo sapiens
tcagaagtcatcttg

SEQ ID NO: 5641155 - DNA, 18 bp, Homo sapiens
tcagaagtctagttttat

SEQ ID NO: 5641156 - DNA, 15 bp, Homo sapiens
tcagaagtctttcag

SEQ ID NO: 5641157 - DNA, 17 bp, Homo sapiens
tcagaagtgaaaaagac

SEQ ID NO: 5641158 - DNA, 12 bp, Homo sapiens
tcagaagtgatt

SEQ ID NO: 5641159 - DNA, 14 bp, Homo sapiens
tcagaagttaacat

SEQ ID NO: 5641160 - DNA, 17 bp, Homo sapiens
tcagaagtttggcaata

SEQ ID NO: 5641161 - DNA, 15 bp, Homo sapiens
tcagaataaagaaca

SEQ ID NO: 5641162 - DNA, 16 bp, Homo sapiens
tcagaataaagaacat

SEQ ID NO: 5641163 - DNA, 12 bp, Homo sapiens
tcagaataaatg

SEQ ID NO: 5641164 - DNA, 12 bp, Homo sapiens
tcagaataaatt

SEQ ID NO: 5641165 - DNA, 23 bp, Homo sapiens
tcagaataaattgatcctttgat

SEQ ID NO: 5641166 - DNA, 22 bp, Homo sapiens
tcagaatagctgttttgtgtat

SEQ ID NO: 5641167 - DNA, 15 bp, Homo sapiens
tcagaataggaaaac

SEQ ID NO: 5641168 - DNA, 19 bp, Homo sapiens
tcagaatagtgatgtgttc

SEQ ID NO: 5641169 - DNA, 21 bp, Homo sapiens
tcagaatagttattctctaag

SEQ ID NO: 5641170 - DNA, 19 bp, Homo sapiens
tcagaatataacatgtaaa

SEQ ID NO: 5641171 - DNA, 18 bp, Homo sapiens
tcagaatatattcacttt

SEQ ID NO: 5641172 - DNA, 16 bp, Homo sapiens
tcagaatatgattcac

SEQ ID NO: 5641173 - DNA, 19 bp, Homo sapiens
tcagaatattctttttata

SEQ ID NO: 5641174 - DNA, 12 bp, Homo sapiens
tcagaatatttt

SEQ ID NO: 5641175 - DNA, 15 bp, Homo sapiens
tcagaatattttcaa

SEQ ID NO: 5641176 - DNA, 16 bp, Homo sapiens
tcagaatcaaaccttt

SEQ ID NO: 5641177 - DNA, 21 bp, Homo sapiens
tcagaatcaaacctttttata

SEQ ID NO: 5641178 - DNA, 21 bp, Homo sapiens
tcagaatcaaatctgagcctt

SEQ ID NO: 5641179 - DNA, 17 bp, Homo sapiens
tcagaatcacttctgag

SEQ ID NO: 5641180 - DNA, 17 bp, Homo sapiens
tcagaatcaggttgaca

SEQ ID NO: 5641181 - DNA, 15 bp, Homo sapiens
tcagaatcatgctgt

SEQ ID NO: 5641182 - DNA, 22 bp, Homo sapiens
tcagaatccaagtgaacactag

SEQ ID NO: 5641183 - DNA, 18 bp, Homo sapiens
tcagaatcccttaacagt

SEQ ID NO: 5641184 - DNA, 17 bp, Homo sapiens
tcagaatccttggctga

SEQ ID NO: 5641185 - DNA, 18 bp, Homo sapiens
tcagaatctcaaataact

SEQ ID NO: 5641186 - DNA, 19 bp, Homo sapiens
tcagaatctcaaataacta

SEQ ID NO: 5641187 - DNA, 17 bp, Homo sapiens
tcagaatctctcttctt

SEQ ID NO: 5641188 - DNA, 18 bp, Homo sapiens
tcagaatctgaatgtaat

SEQ ID NO: 5641189 - DNA, 13 bp, Homo sapiens
tcagaatctttaa

SEQ ID NO: 5641190 - DNA, 15 bp, Homo sapiens
tcagaatctttcctt

SEQ ID NO: 5641191 - DNA, 16 bp, Homo sapiens
tcagaatctttgttaa

SEQ ID NO: 5641192 - DNA, 17 bp, Homo sapiens
tcagaatcttttcaatg

SEQ ID NO: 5641193 - DNA, 19 bp, Homo sapiens
tcagaatgctattgaaaat

SEQ ID NO: 5641194 - DNA, 14 bp, Homo sapiens
tcagaatgctctac

SEQ ID NO: 5641195 - DNA, 17 bp, Homo sapiens
tcagaatgctctacttc

SEQ ID NO: 5641196 - DNA, 15 bp, Homo sapiens
tcagaatggaaagaa

SEQ ID NO: 5641197 - DNA, 20 bp, Homo sapiens
tcagaatggcagtcctggag

SEQ ID NO: 5641198 - DNA, 14 bp, Homo sapiens
tcagaatgggggct

SEQ ID NO: 5641199 - DNA, 18 bp, Homo sapiens
tcagaatgtgcaaagcag

SEQ ID NO: 5641200 - DNA, 21 bp, Homo sapiens
tcagaatgttgtgttggtatt

SEQ ID NO: 5641201 - DNA, 16 bp, Homo sapiens
tcagaattaaactttt

SEQ ID NO: 5641202 - DNA, 13 bp, Homo sapiens
tcagaattatgat

SEQ ID NO: 5641203 - DNA, 20 bp, Homo sapiens
tcagaattatttttaaaaag

SEQ ID NO: 5641204 - DNA, 21 bp, Homo sapiens
tcagaattcggtgtgctgcca

SEQ ID NO: 5641205 - DNA, 23 bp, Homo sapiens
tcagaattcggtgtgctgccaac

SEQ ID NO: 5641206 - DNA, 16 bp, Homo sapiens
tcagaattgaaacact

SEQ ID NO: 5641207 - DNA, 20 bp, Homo sapiens
tcagaattggcataatttgt

SEQ ID NO: 5641208 - DNA, 22 bp, Homo sapiens
tcagaattgtttttagaaattt

SEQ ID NO: 5641209 - DNA, 22 bp, Homo sapiens
tcagaatttgtgttgaaggaac

SEQ ID NO: 5641210 - DNA, 20 bp, Homo sapiens
tcagaattttatactttccc

SEQ ID NO: 5641211 - DNA, 23 bp, Homo sapiens
tcagaattttatactttccctac

SEQ ID NO: 5641212 - DNA, 19 bp, Homo sapiens
tcagaattttggaaaaatg

SEQ ID NO: 5641213 - DNA, 20 bp, Homo sapiens
tcagaattttggaaaaatgt

SEQ ID NO: 5641214 - DNA, 14 bp, Homo sapiens
tcagaattttgtat

SEQ ID NO: 5641215 - DNA, 18 bp, Homo sapiens
tcagaatttttaactgta

SEQ ID NO: 5641216 - DNA, 13 bp, Homo sapiens
tcagacaaaatgg

SEQ ID NO: 5641217 - DNA, 14 bp, Homo sapiens
tcagacaaaatgga

SEQ ID NO: 5641218 - DNA, 13 bp, Homo sapiens
tcagacaaattac

SEQ ID NO: 5641219 - DNA, 23 bp, Homo sapiens
tcagacaacattatgatctaata

SEQ ID NO: 5641220 - DNA, 14 bp, Homo sapiens
tcagacaagacaga

SEQ ID NO: 5641221 - DNA, 23 bp, Homo sapiens
tcagacaagacagaggggagcag

SEQ ID NO: 5641222 - DNA, 20 bp, Homo sapiens
tcagacaagcactattttat

SEQ ID NO: 5641223 - DNA, 22 bp, Homo sapiens
tcagacaagcactattttatat

SEQ ID NO: 5641224 - DNA, 20 bp, Homo sapiens
tcagacaagtgttttggaaa

SEQ ID NO: 5641225 - DNA, 20 bp, Homo sapiens
tcagacaataccactggtta

SEQ ID NO: 5641226 - DNA, 16 bp, Homo sapiens
tcagacaatccactct

SEQ ID NO: 5641227 - DNA, 23 bp, Homo sapiens
tcagacaatccactctcaggagg

SEQ ID NO: 5641228 - DNA, 22 bp, Homo sapiens
tcagacaattcagaagcatcac

SEQ ID NO: 5641229 - DNA, 15 bp, Homo sapiens
tcagacacagctctt

SEQ ID NO: 5641230 - DNA, 20 bp, Homo sapiens
tcagacacaggaaaaataaa

SEQ ID NO: 5641231 - DNA, 20 bp, Homo sapiens
tcagacacatgctatgttct

SEQ ID NO: 5641232 - DNA, 15 bp, Homo sapiens
tcagacaccctcaac

SEQ ID NO: 5641233 - DNA, 22 bp, Homo sapiens
tcagacaccctcaacctcttct

SEQ ID NO: 5641234 - DNA, 17 bp, Homo sapiens
tcagacaccctctcctt

SEQ ID NO: 5641235 - DNA, 22 bp, Homo sapiens
tcagacacctgttcacagaaaa

SEQ ID NO: 5641236 - DNA, 16 bp, Homo sapiens
tcagacacgattgaga

SEQ ID NO: 5641237 - DNA, 16 bp, Homo sapiens
tcagacactacatgat

SEQ ID NO: 5641238 - DNA, 15 bp, Homo sapiens
tcagacactctggct

SEQ ID NO: 5641239 - DNA, 17 bp, Homo sapiens
tcagacactctggctgg

SEQ ID NO: 5641240 - DNA, 14 bp, Homo sapiens
tcagacactttgga

SEQ ID NO: 5641241 - DNA, 21 bp, Homo sapiens
tcagacagaagggtaatgcgt

SEQ ID NO: 5641242 - DNA, 21 bp, Homo sapiens
tcagacagacttatacacccc

SEQ ID NO: 5641243 - DNA, 17 bp, Homo sapiens
tcagacagagaggactg

SEQ ID NO: 5641244 - DNA, 13 bp, Homo sapiens
tcagacagatgtc

SEQ ID NO: 5641245 - DNA, 19 bp, Homo sapiens
tcagacagatgtcagcttc

SEQ ID NO: 5641246 - DNA, 18 bp, Homo sapiens
tcagacagctgcctggga

SEQ ID NO: 5641247 - DNA, 14 bp, Homo sapiens
tcagacataaagcc

SEQ ID NO: 5641248 - DNA, 15 bp, Homo sapiens
tcagacataaagcca

SEQ ID NO: 5641249 - DNA, 16 bp, Homo sapiens
tcagacatccacataa

SEQ ID NO: 5641250 - DNA, 22 bp, Homo sapiens
tcagacatctgaggttttattt

SEQ ID NO: 5641251 - DNA, 22 bp, Homo sapiens
tcagacatgaaaactattttaa

SEQ ID NO: 5641252 - DNA, 19 bp, Homo sapiens
tcagacatgaaatgtacat

SEQ ID NO: 5641253 - DNA, 16 bp, Homo sapiens
tcagaccaaggaacaa

SEQ ID NO: 5641254 - DNA, 14 bp, Homo sapiens
tcagaccacggctc

SEQ ID NO: 5641255 - DNA, 18 bp, Homo sapiens
tcagaccagtactgggaa

SEQ ID NO: 5641256 - DNA, 13 bp, Homo sapiens
tcagacccagatg

SEQ ID NO: 5641257 - DNA, 17 bp, Homo sapiens
tcagacccaggagtcca

SEQ ID NO: 5641258 - DNA, 20 bp, Homo sapiens
tcagacccaggagtccagac

SEQ ID NO: 5641259 - DNA, 20 bp, Homo sapiens
tcagacccaggagtccagcc

SEQ ID NO: 5641260 - DNA, 23 bp, Homo sapiens
tcagacccaggggtccaggcccc

SEQ ID NO: 5641261 - DNA, 21 bp, Homo sapiens
tcagacccataaaccacctcc

SEQ ID NO: 5641262 - DNA, 17 bp, Homo sapiens
tcagatgatctctccac

SEQ ID NO: 5641263 - DNA, 12 bp, Homo sapiens
tcagatgatggc

SEQ ID NO: 5641264 - DNA, 20 bp, Homo sapiens
tcagatgatggccatttcta

SEQ ID NO: 5641265 - DNA, 21 bp, Homo sapiens
tcagatgatggccatttctaa

SEQ ID NO: 5641266 - DNA, 15 bp, Homo sapiens
tcagatgcaggttgg

SEQ ID NO: 5641267 - DNA, 18 bp, Homo sapiens
tcagatgcagttttcaaa

SEQ ID NO: 5641268 - DNA, 20 bp, Homo sapiens
tcagatgcagttttcaaatt

SEQ ID NO: 5641269 - DNA, 22 bp, Homo sapiens
tcagatgcccagagggcccagg

SEQ ID NO: 5641270 - DNA, 17 bp, Homo sapiens
tcagatgcgtgcccagc

SEQ ID NO: 5641271 - DNA, 12 bp, Homo sapiens
tcagatgctcaa

SEQ ID NO: 5641272 - DNA, 16 bp, Homo sapiens
tcagatgctgaattga

SEQ ID NO: 5641273 - DNA, 13 bp, Homo sapiens
tcagatgctggtc

SEQ ID NO: 5641274 - DNA, 23 bp, Homo sapiens
tcagatgctggtcatcctgggca

SEQ ID NO: 5641275 - DNA, 14 bp, Homo sapiens
tcagatgcttctgg

SEQ ID NO: 5641276 - DNA, 21 bp, Homo sapiens
tcagatggaaccgcaggaagc

SEQ ID NO: 5641277 - DNA, 13 bp, Homo sapiens
tcagatggaggtt

SEQ ID NO: 5641278 - DNA, 21 bp, Homo sapiens
tcagatggaggttctcagagc

SEQ ID NO: 5641279 - DNA, 15 bp, Homo sapiens
tcagatggatgtaga

SEQ ID NO: 5641280 - DNA, 16 bp, Homo sapiens
tcagatggcagctttt

SEQ ID NO: 5641281 - DNA, 17 bp, Homo sapiens
tcagatggctgaggcag

SEQ ID NO: 5641282 - DNA, 15 bp, Homo sapiens
tcagatgggaacagt

SEQ ID NO: 5641283 - DNA, 18 bp, Homo sapiens
tcagatgggaagacatga

SEQ ID NO: 5641284 - DNA, 22 bp, Homo sapiens
tcagatgggaggaaagagagca

SEQ ID NO: 5641285 - DNA, 13 bp, Homo sapiens
tcagatggggcct

SEQ ID NO: 5641286 - DNA, 17 bp, Homo sapiens
tcagatgggtctgatat

SEQ ID NO: 5641287 - DNA, 15 bp, Homo sapiens
tcagatggtgtcatt

SEQ ID NO: 5641288 - DNA, 22 bp, Homo sapiens
tcagatggtgtcatttagtaag

SEQ ID NO: 5641289 - DNA, 14 bp, Homo sapiens
tcagatgtcttctg

SEQ ID NO: 5641290 - DNA, 15 bp, Homo sapiens
tcagatgtgcaataa

SEQ ID NO: 5641291 - DNA, 16 bp, Homo sapiens
tcagatgtggagccag

SEQ ID NO: 5641292 - DNA, 18 bp, Homo sapiens
tcagatgtggagccaggc

SEQ ID NO: 5641293 - DNA, 20 bp, Homo sapiens
tcagatgtggagccaggcgt

SEQ ID NO: 5641294 - DNA, 17 bp, Homo sapiens
tcagatgttaaaataaa

SEQ ID NO: 5641295 - DNA, 16 bp, Homo sapiens
tcagatgtttcatcaa

SEQ ID NO: 5641296 - DNA, 17 bp, Homo sapiens
tcagatgtttcatcaat

SEQ ID NO: 5641297 - DNA, 13 bp, Homo sapiens
tcagatgtttcca

SEQ ID NO: 5641298 - DNA, 14 bp, Homo sapiens
tcagatgtttccaa

SEQ ID NO: 5641299 - DNA, 11 bp, Homo sapiens
tcagatgtttt

SEQ ID NO: 5641300 - DNA, 23 bp, Homo sapiens
tcagatgttttacgcaaggaagg

SEQ ID NO: 5641301 - DNA, 17 bp, Homo sapiens
tcagattaaattacagc

SEQ ID NO: 5641302 - DNA, 15 bp, Homo sapiens
tcagattagacacta

SEQ ID NO: 5641303 - DNA, 22 bp, Homo sapiens
tcagattagatgtgccaataac

SEQ ID NO: 5641304 - DNA, 14 bp, Homo sapiens
tcagattcccagag

SEQ ID NO: 5641305 - DNA, 14 bp, Homo sapiens
tcagattccccact

SEQ ID NO: 5641306 - DNA, 20 bp, Homo sapiens
tcagattccccactcagcct

SEQ ID NO: 5641307 - DNA, 21 bp, Homo sapiens
tcagattccccccatctccat

SEQ ID NO: 5641308 - DNA, 14 bp, Homo sapiens
tcagattcttgcat

SEQ ID NO: 5641309 - DNA, 19 bp, Homo sapiens
tcagattcttgctgtgacc

SEQ ID NO: 5641310 - DNA, 20 bp, Homo sapiens
tcagattgacagcatataga

SEQ ID NO: 5641311 - DNA, 22 bp, Homo sapiens
tcagattgacctataaaacaaa

SEQ ID NO: 5641312 - DNA, 18 bp, Homo sapiens
tcagattgactaaataaa

SEQ ID NO: 5641313 - DNA, 13 bp, Homo sapiens
tcagattgctgaa

SEQ ID NO: 5641314 - DNA, 15 bp, Homo sapiens
tcagattgctgaatc

SEQ ID NO: 5641315 - DNA, 20 bp, Homo sapiens
tcagattgcttaaaagcatt

SEQ ID NO: 5641316 - DNA, 24 bp, Homo sapiens
tcagattggggtgttagaagtgca

SEQ ID NO: 5641317 - DNA, 16 bp, Homo sapiens
tcagattgtcttgcaa

SEQ ID NO: 5641318 - DNA, 18 bp, Homo sapiens
tcagattgtcttgcaact

SEQ ID NO: 5641319 - DNA, 23 bp, Homo sapiens
tcagattgtggaatgttggataa

SEQ ID NO: 5641320 - DNA, 18 bp, Homo sapiens
tcagattgttaagggcat

SEQ ID NO: 5641321 - DNA, 21 bp, Homo sapiens
tcagatttaagccttacaaag

SEQ ID NO: 5641322 - DNA, 16 bp, Homo sapiens
tcagatttccacagag

SEQ ID NO: 5641323 - DNA, 15 bp, Homo sapiens
tcagatttctgagga

SEQ ID NO: 5641324 - DNA, 16 bp, Homo sapiens
tcagatttctgaggaa

SEQ ID NO: 5641325 - DNA, 19 bp, Homo sapiens
tcagatttctggttgttat

SEQ ID NO: 5641326 - DNA, 11 bp, Homo sapiens
tcagatttctt

SEQ ID NO: 5641327 - DNA, 18 bp, Homo sapiens
tcagatttcttaatgtct

SEQ ID NO: 5641328 - DNA, 20 bp, Homo sapiens
tcagatttgcacaaaaagat

SEQ ID NO: 5641329 - DNA, 22 bp, Homo sapiens
tcagatttgccttattggcagc

SEQ ID NO: 5641330 - DNA, 16 bp, Homo sapiens
tcagattttaaaaagg

SEQ ID NO: 5641331 - DNA, 21 bp, Homo sapiens
tcagattttaaaaagtcttca

SEQ ID NO: 5641332 - DNA, 22 bp, Homo sapiens
tcagattttactgtctatggat

SEQ ID NO: 5641333 - DNA, 15 bp, Homo sapiens
tcagattttcctgtg

SEQ ID NO: 5641334 - DNA, 14 bp, Homo sapiens
tcagattttctcct

SEQ ID NO: 5641335 - DNA, 21 bp, Homo sapiens
tcagattttgataactgttta

SEQ ID NO: 5641336 - DNA, 18 bp, Homo sapiens
tcagattttttaaaattt

SEQ ID NO: 5641337 - DNA, 14 bp, Homo sapiens
tcagattttttcct

SEQ ID NO: 5641338 - DNA, 20 bp, Homo sapiens
tcagcaaaaagcaaaatcat

SEQ ID NO: 5641339 - DNA, 14 bp, Homo sapiens
tcagcaaacacaat

SEQ ID NO: 5641340 - DNA, 17 bp, Homo sapiens
tcagcaaacacaataag

SEQ ID NO: 5641341 - DNA, 13 bp, Homo sapiens
tcagcaaaccatt

SEQ ID NO: 5641342 - DNA, 20 bp, Homo sapiens
tcagcaaagctacaggactg

SEQ ID NO: 5641343 - DNA, 19 bp, Homo sapiens
tcagcaaaggtcttgaata

SEQ ID NO: 5641344 - DNA, 18 bp, Homo sapiens
tcagcaaatgccttttca

SEQ ID NO: 5641345 - DNA, 22 bp, Homo sapiens
tcagcaaatgccttttcaaatg

SEQ ID NO: 5641346 - DNA, 21 bp, Homo sapiens
tcagcaaattaattggcagca

SEQ ID NO: 5641347 - DNA, 15 bp, Homo sapiens
tcagcaaattccaga

SEQ ID NO: 5641348 - DNA, 14 bp, Homo sapiens
tcagcaaattcttg

SEQ ID NO: 5641349 - DNA, 15 bp, Homo sapiens
tcagcaaattcttga

SEQ ID NO: 5641350 - DNA, 20 bp, Homo sapiens
tcagcaaattcttgaataaa

SEQ ID NO: 5641351 - DNA, 15 bp, Homo sapiens
tcagcaaatttaaga

SEQ ID NO: 5641352 - DNA, 21 bp, Homo sapiens
tcagcaaccctacagtatata

SEQ ID NO: 5641353 - DNA, 12 bp, Homo sapiens
tcagcaagactt

SEQ ID NO: 5641354 - DNA, 12 bp, Homo sapiens
tcagcaagagaa

SEQ ID NO: 5641355 - DNA, 20 bp, Homo sapiens
tcagcaagaggaggacagaa

SEQ ID NO: 5641356 - DNA, 12 bp, Homo sapiens
tcagcaaggcca

SEQ ID NO: 5641357 - DNA, 13 bp, Homo sapiens
tcagcaaggccac

SEQ ID NO: 5641358 - DNA, 14 bp, Homo sapiens
tcagcaaggccacc

SEQ ID NO: 5641359 - DNA, 17 bp, Homo sapiens
tcagcaaggccacctct

SEQ ID NO: 5641360 - DNA, 18 bp, Homo sapiens
tcagcaaggccacctctt

SEQ ID NO: 5641361 - DNA, 14 bp, Homo sapiens
tcagcaaggggctg

SEQ ID NO: 5641362 - DNA, 19 bp, Homo sapiens
tcagcaagtagagcagagt

SEQ ID NO: 5641363 - DNA, 13 bp, Homo sapiens
tcagcaagtgccc

SEQ ID NO: 5641364 - DNA, 19 bp, Homo sapiens
tcagcaagtgcccagtgga

SEQ ID NO: 5641365 - DNA, 12 bp, Homo sapiens
tcagcaagtgta

SEQ ID NO: 5641366 - DNA, 17 bp, Homo sapiens
tcagcaagtgtacagta

SEQ ID NO: 5641367 - DNA, 21 bp, Homo sapiens
tcagcaagttagaactagcca

SEQ ID NO: 5641368 - DNA, 18 bp, Homo sapiens
tcagcaatagggtgcagt

SEQ ID NO: 5641369 - DNA, 14 bp, Homo sapiens
tcagcaattaaaga

SEQ ID NO: 5641370 - DNA, 18 bp, Homo sapiens
tcagcaatttcagaacca

SEQ ID NO: 5641371 - DNA, 20 bp, Homo sapiens
tcagcacagataaaaagtgg

SEQ ID NO: 5641372 - DNA, 22 bp, Homo sapiens
tcagcacagataaaaagtggaa

SEQ ID NO: 5641373 - DNA, 14 bp, Homo sapiens
tcagcacaggaatt

SEQ ID NO: 5641374 - DNA, 17 bp, Homo sapiens
tcagcacatatgggaac

SEQ ID NO: 5641375 - DNA, 14 bp, Homo sapiens
tcagcacatctcaa

SEQ ID NO: 5641376 - DNA, 19 bp, Homo sapiens
tcagcaccaagagcagctg

SEQ ID NO: 5641377 - DNA, 13 bp, Homo sapiens
tcagcaccaccct

SEQ ID NO: 5641378 - DNA, 14 bp, Homo sapiens
tcagcaccacccta

SEQ ID NO: 5641379 - DNA, 18 bp, Homo sapiens
tcagcaccacgtgccaag

SEQ ID NO: 5641380 - DNA, 14 bp, Homo sapiens
tcagcaccatggag

SEQ ID NO: 5641381 - DNA, 20 bp, Homo sapiens
tcagcaccatggaggcaggc

SEQ ID NO: 5641382 - DNA, 18 bp, Homo sapiens
tcagcaccccactcctca

SEQ ID NO: 5641383 - DNA, 14 bp, Homo sapiens
tcagcacccccttc

SEQ ID NO: 5641384 - DNA, 17 bp, Homo sapiens
tcagcacccccttctct

SEQ ID NO: 5641385 - DNA, 23 bp, Homo sapiens
tcagcacccccttctctgcccat

SEQ ID NO: 5641386 - DNA, 17 bp, Homo sapiens
tcagcacccctgtctct

SEQ ID NO: 5641387 - DNA, 15 bp, Homo sapiens
tcagcaccccttcca

SEQ ID NO: 5641388 - DNA, 12 bp, Homo sapiens
tcagcaccctgg

SEQ ID NO: 5641389 - DNA, 17 bp, Homo sapiens
tcagcaccctgggtgcc

SEQ ID NO: 5641390 - DNA, 19 bp, Homo sapiens
tcagcaccctgggtgccat

SEQ ID NO: 5641391 - DNA, 21 bp, Homo sapiens
tcagcacctacagtgtacagt

SEQ ID NO: 5641392 - DNA, 22 bp, Homo sapiens
tcagcacctacagtgtacagtc

SEQ ID NO: 5641393 - DNA, 20 bp, Homo sapiens
tcagcaccttggcccaggag

SEQ ID NO: 5641394 - DNA, 22 bp, Homo sapiens
tcagcaccttggcccaggagct

SEQ ID NO: 5641395 - DNA, 21 bp, Homo sapiens
tcagcacgagacccatttcct

SEQ ID NO: 5641396 - DNA, 16 bp, Homo sapiens
tcagcacgatttctgt

SEQ ID NO: 5641397 - DNA, 17 bp, Homo sapiens
tcagcacgatttctgtt

SEQ ID NO: 5641398 - DNA, 18 bp, Homo sapiens
tcagcacgatttctgttt

SEQ ID NO: 5641399 - DNA, 16 bp, Homo sapiens
tcagcactcagaaaag

SEQ ID NO: 5641400 - DNA, 18 bp, Homo sapiens
tcagcactctgtaaaatg

SEQ ID NO: 5641401 - DNA, 15 bp, Homo sapiens
tcagcactgaaaata

SEQ ID NO: 5641402 - DNA, 19 bp, Homo sapiens
tcagcactgatggaaaata

SEQ ID NO: 5641403 - DNA, 17 bp, Homo sapiens
tcagcactgatttcaca

SEQ ID NO: 5641404 - DNA, 22 bp, Homo sapiens
tcagcactgcctgctcccatcc

SEQ ID NO: 5641405 - DNA, 14 bp, Homo sapiens
tcagcactggattg

SEQ ID NO: 5641406 - DNA, 21 bp, Homo sapiens
tcagcactggattgtagaact

SEQ ID NO: 5641407 - DNA, 18 bp, Homo sapiens
tcagcactgtttgaagat

SEQ ID NO: 5641408 - DNA, 16 bp, Homo sapiens
tcagcacttggccctt

SEQ ID NO: 5641409 - DNA, 15 bp, Homo sapiens
tcagcacttgtctca

SEQ ID NO: 5641410 - DNA, 18 bp, Homo sapiens
tcagcacttgtctcattt

SEQ ID NO: 5641411 - DNA, 21 bp, Homo sapiens
tcagcacttgtctcattttaa

SEQ ID NO: 5641412 - DNA, 22 bp, Homo sapiens
tcagcactttaaagaggctgtg

SEQ ID NO: 5641413 - DNA, 22 bp, Homo sapiens
tcagcactttgggaggccgagg

SEQ ID NO: 5641414 - DNA, 23 bp, Homo sapiens
tcagcactttgggaggctgaggc

SEQ ID NO: 5641415 - DNA, 17 bp, Homo sapiens
tcagcagaaacccccag

SEQ ID NO: 5641416 - DNA, 18 bp, Homo sapiens
tcagcagaaacccccagg

SEQ ID NO: 5641417 - DNA, 20 bp, Homo sapiens
tcagcagaaacccccaggag

SEQ ID NO: 5641418 - DNA, 21 bp, Homo sapiens
tcagcagaaacccccaggagg

SEQ ID NO: 5641419 - DNA, 17 bp, Homo sapiens
tcagcagaacctgcaca

SEQ ID NO: 5641420 - DNA, 18 bp, Homo sapiens
tcagcagaacctgtagga

SEQ ID NO: 5641421 - DNA, 14 bp, Homo sapiens
tcagcagacacaca

SEQ ID NO: 5641422 - DNA, 17 bp, Homo sapiens
tcagcagacacacatgg

SEQ ID NO: 5641423 - DNA, 13 bp, Homo sapiens
tcagcagacactc

SEQ ID NO: 5641424 - DNA, 15 bp, Homo sapiens
tcagcagacactcca

SEQ ID NO: 5641425 - DNA, 20 bp, Homo sapiens
tcagcagactttctctgtgt

SEQ ID NO: 5641426 - DNA, 15 bp, Homo sapiens
tcagcagagacgggg

SEQ ID NO: 5641427 - DNA, 18 bp, Homo sapiens
tcagcagagtgagggggt

SEQ ID NO: 5641428 - DNA, 12 bp, Homo sapiens
tcagcagagtgc

SEQ ID NO: 5641429 - DNA, 16 bp, Homo sapiens
tcagcagcaacaactg

SEQ ID NO: 5641430 - DNA, 23 bp, Homo sapiens
tcagcagcaacaactgtcagttc

SEQ ID NO: 5641431 - DNA, 19 bp, Homo sapiens
tcagcagcagagagccctg

SEQ ID NO: 5641432 - DNA, 15 bp, Homo sapiens
tcagcagccagctcc

SEQ ID NO: 5641433 - DNA, 12 bp, Homo sapiens
tcagcagccagt

SEQ ID NO: 5641434 - DNA, 14 bp, Homo sapiens
tcagcagccagtct

SEQ ID NO: 5641435 - DNA, 15 bp, Homo sapiens
tcagcagccagtctc

SEQ ID NO: 5641436 - DNA, 16 bp, Homo sapiens
tcagcagccagtctca

SEQ ID NO: 5641437 - DNA, 24 bp, Homo sapiens
tcagcagccagtctcagagaccag

SEQ ID NO: 5641438 - DNA, 12 bp, Homo sapiens
tcagcagccccc

SEQ ID NO: 5641439 - DNA, 17 bp, Homo sapiens
tcagcagccctcctcac

SEQ ID NO: 5641440 - DNA, 23 bp, Homo sapiens
tcagctggcggaacctggctgcg

SEQ ID NO: 5641441 - DNA, 22 bp, Homo sapiens
tcagctggctgagacactgaag

SEQ ID NO: 5641442 - DNA, 18 bp, Homo sapiens
tcagctgggagccagtgt

SEQ ID NO: 5641443 - DNA, 22 bp, Homo sapiens
tcagctgggagccagtgtgccc

SEQ ID NO: 5641444 - DNA, 22 bp, Homo sapiens
tcagctgggtcacatccatccc

SEQ ID NO: 5641445 - DNA, 19 bp, Homo sapiens
tcagctggtggatggtgac

SEQ ID NO: 5641446 - DNA, 17 bp, Homo sapiens
tcagctggtgtcagtcc

SEQ ID NO: 5641447 - DNA, 22 bp, Homo sapiens
tcagctggttactcagggttca

SEQ ID NO: 5641448 - DNA, 23 bp, Homo sapiens
tcagctgtaagaagagactggga

SEQ ID NO: 5641449 - DNA, 12 bp, Homo sapiens
tcagctgtactt

SEQ ID NO: 5641450 - DNA, 12 bp, Homo sapiens
tcagctgtcacc

SEQ ID NO: 5641451 - DNA, 21 bp, Homo sapiens
tcagctgtcacctgctcacag

SEQ ID NO: 5641452 - DNA, 13 bp, Homo sapiens
tcagctgtcctcc

SEQ ID NO: 5641453 - DNA, 14 bp, Homo sapiens
tcagctgtcctccc

SEQ ID NO: 5641454 - DNA, 18 bp, Homo sapiens
tcagctgtcctccctcca

SEQ ID NO: 5641455 - DNA, 19 bp, Homo sapiens
tcagctgtcctccctccac

SEQ ID NO: 5641456 - DNA, 15 bp, Homo sapiens
tcagctgtcctgcag

SEQ ID NO: 5641457 - DNA, 21 bp, Homo sapiens
tcagctgtcgggggccactgt

SEQ ID NO: 5641458 - DNA, 22 bp, Homo sapiens
tcagctgtcgggggccactgtg

SEQ ID NO: 5641459 - DNA, 23 bp, Homo sapiens
tcagctgtcgggggccactgtgt

SEQ ID NO: 5641460 - DNA, 15 bp, Homo sapiens
tcagctgtctgtcat

SEQ ID NO: 5641461 - DNA, 13 bp, Homo sapiens
tcagctgtctttt

SEQ ID NO: 5641462 - DNA, 19 bp, Homo sapiens
tcagctgtcttttggagga

SEQ ID NO: 5641463 - DNA, 21 bp, Homo sapiens
tcagctgtgaacatggactct

SEQ ID NO: 5641464 - DNA, 18 bp, Homo sapiens
tcagctgtggctggagga

SEQ ID NO: 5641465 - DNA, 21 bp, Homo sapiens
tcagctgtggggaacacagct

SEQ ID NO: 5641466 - DNA, 22 bp, Homo sapiens
tcagctgtggggaacatggctg

SEQ ID NO: 5641467 - DNA, 18 bp, Homo sapiens
tcagctgtggtcccaccc

SEQ ID NO: 5641468 - DNA, 15 bp, Homo sapiens
tcagctgttcagatt

SEQ ID NO: 5641469 - DNA, 19 bp, Homo sapiens
tcagctgttgcaggcagtg

SEQ ID NO: 5641470 - DNA, 16 bp, Homo sapiens
tcagctgtttgtcata

SEQ ID NO: 5641471 - DNA, 17 bp, Homo sapiens
tcagcttaaaataaaca

SEQ ID NO: 5641472 - DNA, 19 bp, Homo sapiens
tcagcttaaaattggtaat

SEQ ID NO: 5641473 - DNA, 20 bp, Homo sapiens
tcagcttaattctccttccc

SEQ ID NO: 5641474 - DNA, 21 bp, Homo sapiens
tcagcttaatttaagtttgta

SEQ ID NO: 5641475 - DNA, 18 bp, Homo sapiens
tcagcttaggggctgctg

SEQ ID NO: 5641476 - DNA, 13 bp, Homo sapiens
tcagcttataatg

SEQ ID NO: 5641477 - DNA, 19 bp, Homo sapiens
tcagcttatctcttttata

SEQ ID NO: 5641478 - DNA, 20 bp, Homo sapiens
tcagcttatctcttttatat

SEQ ID NO: 5641479 - DNA, 19 bp, Homo sapiens
tcagcttcaaataaagtaa

SEQ ID NO: 5641480 - DNA, 23 bp, Homo sapiens
tcagcttcagaatggcattgtac

SEQ ID NO: 5641481 - DNA, 17 bp, Homo sapiens
tcagcttcagactttta

SEQ ID NO: 5641482 - DNA, 14 bp, Homo sapiens
tcagcttcatttcc

SEQ ID NO: 5641483 - DNA, 18 bp, Homo sapiens
tcagcttcatttgtgtca

SEQ ID NO: 5641484 - DNA, 21 bp, Homo sapiens
tcagcttcatttgtgtcaatg

SEQ ID NO: 5641485 - DNA, 16 bp, Homo sapiens
tcagcttcccaacaat

SEQ ID NO: 5641486 - DNA, 21 bp, Homo sapiens
tcagcttcccaagtagctgag

SEQ ID NO: 5641487 - DNA, 18 bp, Homo sapiens
tcagcttccccagtagct

SEQ ID NO: 5641488 - DNA, 19 bp, Homo sapiens
tcagcttccccagtagctg

SEQ ID NO: 5641489 - DNA, 15 bp, Homo sapiens
tcagcttcctaccca

SEQ ID NO: 5641490 - DNA, 22 bp, Homo sapiens
tcagcttcctgctgctggggcc

SEQ ID NO: 5641491 - DNA, 23 bp, Homo sapiens
tcagcttctaattttgtgctctt

SEQ ID NO: 5641492 - DNA, 20 bp, Homo sapiens
tcagcttctatccttgactt

SEQ ID NO: 5641493 - DNA, 13 bp, Homo sapiens
tcagcttctccca

SEQ ID NO: 5641494 - DNA, 16 bp, Homo sapiens
tcagcttctgctgggc

SEQ ID NO: 5641495 - DNA, 17 bp, Homo sapiens
tcagcttctgctgggct

SEQ ID NO: 5641496 - DNA, 22 bp, Homo sapiens
tcagcttctgctgggctggggc

SEQ ID NO: 5641497 - DNA, 23 bp, Homo sapiens
tcagcttctgctgggctggggcc

SEQ ID NO: 5641498 - DNA, 12 bp, Homo sapiens
tcagcttctgtt

SEQ ID NO: 5641499 - DNA, 17 bp, Homo sapiens
tcagcttcttcctaggt

SEQ ID NO: 5641500 - DNA, 18 bp, Homo sapiens
tcagcttcttcctaggtc

SEQ ID NO: 5641501 - DNA, 14 bp, Homo sapiens
tcagcttgaacctg

SEQ ID NO: 5641502 - DNA, 15 bp, Homo sapiens
tcagcttggcactca

SEQ ID NO: 5641503 - DNA, 23 bp, Homo sapiens
tcagcttggcactcaggtgctga

SEQ ID NO: 5641504 - DNA, 21 bp, Homo sapiens
tcagcttgtaaatagctcagg

SEQ ID NO: 5641505 - DNA, 16 bp, Homo sapiens
tcagcttgtttctata

SEQ ID NO: 5641506 - DNA, 12 bp, Homo sapiens
tcagctttaaag

SEQ ID NO: 5641507 - DNA, 21 bp, Homo sapiens
tcagctttataataaactgtt

SEQ ID NO: 5641508 - DNA, 20 bp, Homo sapiens
tcagctttatttttctttaa

SEQ ID NO: 5641509 - DNA, 16 bp, Homo sapiens
tcagctttcagagcca

SEQ ID NO: 5641510 - DNA, 17 bp, Homo sapiens
tcagctttcagagccag

SEQ ID NO: 5641511 - DNA, 18 bp, Homo sapiens
tcagctttcagagccagt

SEQ ID NO: 5641512 - DNA, 16 bp, Homo sapiens
tcagctttccctgcca

SEQ ID NO: 5641513 - DNA, 14 bp, Homo sapiens
tcagctttccctgg

SEQ ID NO: 5641514 - DNA, 15 bp, Homo sapiens
tcagctttccctggc

SEQ ID NO: 5641515 - DNA, 20 bp, Homo sapiens
tcagctttccctggctcagg

SEQ ID NO: 5641516 - DNA, 21 bp, Homo sapiens
tcagctttctttaaagttctt

SEQ ID NO: 5641517 - DNA, 19 bp, Homo sapiens
tcagctttgcttcatgttc

SEQ ID NO: 5641518 - DNA, 19 bp, Homo sapiens
tcagctttggattgctggg

SEQ ID NO: 5641519 - DNA, 15 bp, Homo sapiens
tcagctttggctctg

SEQ ID NO: 5641520 - DNA, 23 bp, Homo sapiens
tcagctttttgatcctctactgt

SEQ ID NO: 5641521 - DNA, 14 bp, Homo sapiens
tcagctttttgtat

SEQ ID NO: 5641522 - DNA, 21 bp, Homo sapiens
tcagctttttgtattaacaaa

SEQ ID NO: 5641523 - DNA, 16 bp, Homo sapiens
tcagcttttttttcag

SEQ ID NO: 5641524 - DNA, 13 bp, Homo sapiens
tcaggaaaaatga

SEQ ID NO: 5641525 - DNA, 16 bp, Homo sapiens
tcaggaaaacagctag

SEQ ID NO: 5641526 - DNA, 18 bp, Homo sapiens
tcaggaaaagcctctgtg

SEQ ID NO: 5641527 - DNA, 17 bp, Homo sapiens
tcaggaaaaggcctggg

SEQ ID NO: 5641528 - DNA, 19 bp, Homo sapiens
tcaggaaaaggcctggggt

SEQ ID NO: 5641529 - DNA, 21 bp, Homo sapiens
tcaggaaaatgtattgattca

SEQ ID NO: 5641530 - DNA, 22 bp, Homo sapiens
tcaggaaaatgtattgattcaa

SEQ ID NO: 5641531 - DNA, 12 bp, Homo sapiens
tcaggaaagaat

SEQ ID NO: 5641532 - DNA, 14 bp, Homo sapiens
tcaggaaagacagg

SEQ ID NO: 5641533 - DNA, 15 bp, Homo sapiens
tcaggaaagacaggc

SEQ ID NO: 5641534 - DNA, 14 bp, Homo sapiens
tcaggaaagacgga

SEQ ID NO: 5641535 - DNA, 18 bp, Homo sapiens
tcaggaaagagagcacca

SEQ ID NO: 5641536 - DNA, 15 bp, Homo sapiens
tcaggaaaggaatca

SEQ ID NO: 5641537 - DNA, 22 bp, Homo sapiens
tcaggaaaggctgtagaaggaa

SEQ ID NO: 5641538 - DNA, 18 bp, Homo sapiens
tcaggaaatatatatgtg

SEQ ID NO: 5641539 - DNA, 19 bp, Homo sapiens
tcaggaaatatatatgtgt

SEQ ID NO: 5641540 - DNA, 20 bp, Homo sapiens
tcaggaaatcaaatatgcaa

SEQ ID NO: 5641541 - DNA, 22 bp, Homo sapiens
tcaggaaatcaaatatgcaaag

SEQ ID NO: 5641542 - DNA, 18 bp, Homo sapiens
tcaggaaatgaaaggtga

SEQ ID NO: 5641543 - DNA, 23 bp, Homo sapiens
tcaggaaatttttgcatgtttaa

SEQ ID NO: 5641544 - DNA, 13 bp, Homo sapiens
tcaggaacagaag

SEQ ID NO: 5641545 - DNA, 18 bp, Homo sapiens
tcaggaacagctatggga

SEQ ID NO: 5641546 - DNA, 18 bp, Homo sapiens
tcaggaaccagggcctcc

SEQ ID NO: 5641547 - DNA, 19 bp, Homo sapiens
tcaggaaccagggcctccc

SEQ ID NO: 5641548 - DNA, 22 bp, Homo sapiens
tcaggaacccaccctctccaca

SEQ ID NO: 5641549 - DNA, 16 bp, Homo sapiens
tcaggaaccctggaga

SEQ ID NO: 5641550 - DNA, 15 bp, Homo sapiens
tcaggaacctggacc

SEQ ID NO: 5641551 - DNA, 20 bp, Homo sapiens
tcaggaagaaaccccaagca

SEQ ID NO: 5641552 - DNA, 23 bp, Homo sapiens
tcaggaagaaaggagtctgcaca

SEQ ID NO: 5641553 - DNA, 15 bp, Homo sapiens
tcaggaagaaatcac

SEQ ID NO: 5641554 - DNA, 18 bp, Homo sapiens
tcaggaagaagagatgca

SEQ ID NO: 5641555 - DNA, 22 bp, Homo sapiens
tcaggaagactggacccccagc

SEQ ID NO: 5641556 - DNA, 16 bp, Homo sapiens
tcaggaagagaaggag

SEQ ID NO: 5641557 - DNA, 23 bp, Homo sapiens
tcaggaagagctatggcccagaa

SEQ ID NO: 5641558 - DNA, 23 bp, Homo sapiens
tcaggaagcaggtgtcctttccc

SEQ ID NO: 5641559 - DNA, 23 bp, Homo sapiens
tcaggaagcccggtggcgtggca

SEQ ID NO: 5641560 - DNA, 11 bp, Homo sapiens
tcaggaagctc

SEQ ID NO: 5641561 - DNA, 14 bp, Homo sapiens
tcaggaagctcagg

SEQ ID NO: 5641562 - DNA, 16 bp, Homo sapiens
tcaggaagctcagggc

SEQ ID NO: 5641563 - DNA, 17 bp, Homo sapiens
tcaggaagggagaggag

SEQ ID NO: 5641564 - DNA, 18 bp, Homo sapiens
tcaggaagggagaggagg

SEQ ID NO: 5641565 - DNA, 22 bp, Homo sapiens
tcaggaatatctgttcccagcc

SEQ ID NO: 5641566 - DNA, 23 bp, Homo sapiens
tcaggaatatgcatcccacagcc

SEQ ID NO: 5641567 - DNA, 22 bp, Homo sapiens
tcaggaatcatcaggaacgttt

SEQ ID NO: 5641568 - DNA, 12 bp, Homo sapiens
tcaggaatgggc

SEQ ID NO: 5641569 - DNA, 21 bp, Homo sapiens
tcaggaatgggccaagccagg

SEQ ID NO: 5641570 - DNA, 17 bp, Homo sapiens
tcaggaattccctggaa

SEQ ID NO: 5641571 - DNA, 20 bp, Homo sapiens
tcaggaattgcccattgttt

SEQ ID NO: 5641572 - DNA, 15 bp, Homo sapiens
tcaggaattgtcaaa

SEQ ID NO: 5641573 - DNA, 16 bp, Homo sapiens
tcaggaatttaagaat

SEQ ID NO: 5641574 - DNA, 18 bp, Homo sapiens
tcaggaatttaagaattt

SEQ ID NO: 5641575 - DNA, 16 bp, Homo sapiens
tcaggacacaggcctg

SEQ ID NO: 5641576 - DNA, 19 bp, Homo sapiens
tcaggacagctgcttctgt

SEQ ID NO: 5641577 - DNA, 16 bp, Homo sapiens
tcaggacatggggcat

SEQ ID NO: 5641578 - DNA, 23 bp, Homo sapiens
tcaggaccaaaaaacctcactgg

SEQ ID NO: 5641579 - DNA, 16 bp, Homo sapiens
tcaggaccaccctgcc

SEQ ID NO: 5641580 - DNA, 17 bp, Homo sapiens
tcaggaccaccctgcca

SEQ ID NO: 5641581 - DNA, 23 bp, Homo sapiens
tcaggaccactcagttaaggaag

SEQ ID NO: 5641582 - DNA, 15 bp, Homo sapiens
tcaggaccattttag

SEQ ID NO: 5641583 - DNA, 17 bp, Homo sapiens
tcaggacccaggccctc

SEQ ID NO: 5641584 - DNA, 22 bp, Homo sapiens
tcaggacccaggccctccatgg

SEQ ID NO: 5641585 - DNA, 15 bp, Homo sapiens
tcaggacccaggccg

SEQ ID NO: 5641586 - DNA, 18 bp, Homo sapiens
tcaggaccccactggaga

SEQ ID NO: 5641587 - DNA, 14 bp, Homo sapiens
tcaggaccccagag

SEQ ID NO: 5641588 - DNA, 18 bp, Homo sapiens
tcaggaccccatctgctg

SEQ ID NO: 5641589 - DNA, 23 bp, Homo sapiens
tcaggaccccatctgctgagctc

SEQ ID NO: 5641590 - DNA, 17 bp, Homo sapiens
tcaggaccctcgctggc

SEQ ID NO: 5641591 - DNA, 19 bp, Homo sapiens
tcaggaccctcgctggccc

SEQ ID NO: 5641592 - DNA, 20 bp, Homo sapiens
tcaggaccctcgctggcccc

SEQ ID NO: 5641593 - DNA, 23 bp, Homo sapiens
tcaggacctccggggagagcaga

SEQ ID NO: 5641594 - DNA, 16 bp, Homo sapiens
tcaggacggctcctca

SEQ ID NO: 5641595 - DNA, 21 bp, Homo sapiens
tcaggactcagaagcctctgg

SEQ ID NO: 5641596 - DNA, 17 bp, Homo sapiens
tcaggactctctccagg

SEQ ID NO: 5641597 - DNA, 21 bp, Homo sapiens
tcaggactctgcgggaggctg

SEQ ID NO: 5641598 - DNA, 22 bp, Homo sapiens
tcaggactctgcgggaggctgg

SEQ ID NO: 5641599 - DNA, 18 bp, Homo sapiens
tcaggactgtgaccaaag

SEQ ID NO: 5641600 - DNA, 20 bp, Homo sapiens
tcaggacttaacggctccag

SEQ ID NO: 5641601 - DNA, 17 bp, Homo sapiens
tcaggacttgaaagaaa

SEQ ID NO: 5641602 - DNA, 15 bp, Homo sapiens
tcaggacttggtctg

SEQ ID NO: 5641603 - DNA, 20 bp, Homo sapiens
tcaggagaatagcttttact

SEQ ID NO: 5641604 - DNA, 18 bp, Homo sapiens
tcaggagaattagatttc

SEQ ID NO: 5641605 - DNA, 24 bp, Homo sapiens
tcaggagagagtctaagataaaag

SEQ ID NO: 5641606 - DNA, 13 bp, Homo sapiens
tcaggagagcagc

SEQ ID NO: 5641607 - DNA, 17 bp, Homo sapiens
tcaggagagcatcacca

SEQ ID NO: 5641608 - DNA, 20 bp, Homo sapiens
tcaggagagccctctgctgc

SEQ ID NO: 5641609 - DNA, 22 bp, Homo sapiens
tcaggagagtagaacagataat

SEQ ID NO: 5641610 - DNA, 18 bp, Homo sapiens
tcaggagagtgcagatct

SEQ ID NO: 5641611 - DNA, 14 bp, Homo sapiens
tcaggagagtgtgc

SEQ ID NO: 5641612 - DNA, 20 bp, Homo sapiens
tcaggagagtgtgcaactgg

SEQ ID NO: 5641613 - DNA, 14 bp, Homo sapiens
tcaggagatgggga

SEQ ID NO: 5641614 - DNA, 22 bp, Homo sapiens
tcaggggcacctccggctgcct

SEQ ID NO: 5641615 - DNA, 23 bp, Homo sapiens
tcaggggcaggtggtggaggggc

SEQ ID NO: 5641616 - DNA, 15 bp, Homo sapiens
tcaggggccagagag

SEQ ID NO: 5641617 - DNA, 18 bp, Homo sapiens
tcaggggccctggagcag

SEQ ID NO: 5641618 - DNA, 15 bp, Homo sapiens
tcaggggcctctctc

SEQ ID NO: 5641619 - DNA, 15 bp, Homo sapiens
tcaggggctccatgc

SEQ ID NO: 5641620 - DNA, 17 bp, Homo sapiens
tcaggggctccatgctg

SEQ ID NO: 5641621 - DNA, 14 bp, Homo sapiens
tcaggggctcccta

SEQ ID NO: 5641622 - DNA, 14 bp, Homo sapiens
tcaggggctgcccg

SEQ ID NO: 5641623 - DNA, 16 bp, Homo sapiens
tcaggggctgcccgct

SEQ ID NO: 5641624 - DNA, 21 bp, Homo sapiens
tcaggggctgcccgctcccag

SEQ ID NO: 5641625 - DNA, 14 bp, Homo sapiens
tcaggggctgggca

SEQ ID NO: 5641626 - DNA, 16 bp, Homo sapiens
tcagggggaagaagca

SEQ ID NO: 5641627 - DNA, 22 bp, Homo sapiens
tcagggggaagaagcagagaga

SEQ ID NO: 5641628 - DNA, 17 bp, Homo sapiens
tcagggggagtctttgc

SEQ ID NO: 5641629 - DNA, 16 bp, Homo sapiens
tcagggggccagctgg

SEQ ID NO: 5641630 - DNA, 20 bp, Homo sapiens
tcagggggccagctggggag

SEQ ID NO: 5641631 - DNA, 13 bp, Homo sapiens
tcagggggccagg

SEQ ID NO: 5641632 - DNA, 20 bp, Homo sapiens
tcaggggggttgtgaggcct

SEQ ID NO: 5641633 - DNA, 19 bp, Homo sapiens
tcagggggtaggagagcac

SEQ ID NO: 5641634 - DNA, 20 bp, Homo sapiens
tcaggggtacattctagctg

SEQ ID NO: 5641635 - DNA, 22 bp, Homo sapiens
tcaggggtcaggtgtcaggccc

SEQ ID NO: 5641636 - DNA, 23 bp, Homo sapiens
tcaggggtcgtcaccacctctcc

SEQ ID NO: 5641637 - DNA, 20 bp, Homo sapiens
tcaggggtctgagctccagc

SEQ ID NO: 5641638 - DNA, 18 bp, Homo sapiens
tcaggggtgacacagact

SEQ ID NO: 5641639 - DNA, 19 bp, Homo sapiens
tcaggggtgacacagactc

SEQ ID NO: 5641640 - DNA, 20 bp, Homo sapiens
tcaggggtgacacagactca

SEQ ID NO: 5641641 - DNA, 16 bp, Homo sapiens
tcaggggtgactcaga

SEQ ID NO: 5641642 - DNA, 14 bp, Homo sapiens
tcaggggtgcacag

SEQ ID NO: 5641643 - DNA, 18 bp, Homo sapiens
tcaggggtgcattctggc

SEQ ID NO: 5641644 - DNA, 14 bp, Homo sapiens
tcaggggtgctggg

SEQ ID NO: 5641645 - DNA, 19 bp, Homo sapiens
tcaggggtgctggggcaga

SEQ ID NO: 5641646 - DNA, 17 bp, Homo sapiens
tcaggggtggagaagtg

SEQ ID NO: 5641647 - DNA, 18 bp, Homo sapiens
tcaggggttcgagaccag

SEQ ID NO: 5641648 - DNA, 15 bp, Homo sapiens
tcagggtaagctgct

SEQ ID NO: 5641649 - DNA, 16 bp, Homo sapiens
tcagggtagcagcaga

SEQ ID NO: 5641650 - DNA, 15 bp, Homo sapiens
tcagggtcatagcat

SEQ ID NO: 5641651 - DNA, 19 bp, Homo sapiens
tcagggtccctggtggcag

SEQ ID NO: 5641652 - DNA, 16 bp, Homo sapiens
tcagggtctccttcct

SEQ ID NO: 5641653 - DNA, 12 bp, Homo sapiens
tcagggtctctg

SEQ ID NO: 5641654 - DNA, 17 bp, Homo sapiens
tcagggtctctgctgcc

SEQ ID NO: 5641655 - DNA, 18 bp, Homo sapiens
tcagggtctctgctgccg

SEQ ID NO: 5641656 - DNA, 17 bp, Homo sapiens
tcagggtgaatcagatg

SEQ ID NO: 5641657 - DNA, 23 bp, Homo sapiens
tcagggtgagacgtgatgggcta

SEQ ID NO: 5641658 - DNA, 16 bp, Homo sapiens
tcagggtgatgccagg

SEQ ID NO: 5641659 - DNA, 20 bp, Homo sapiens
tcagggtgggccactctccc

SEQ ID NO: 5641660 - DNA, 17 bp, Homo sapiens
tcagggtgtgaggccac

SEQ ID NO: 5641661 - DNA, 19 bp, Homo sapiens
tcagggtgtgaggccacac

SEQ ID NO: 5641662 - DNA, 18 bp, Homo sapiens
tcagggtgtgggatctga

SEQ ID NO: 5641663 - DNA, 21 bp, Homo sapiens
tcagggttaagcctgtaatta

SEQ ID NO: 5641664 - DNA, 21 bp, Homo sapiens
tcagggttatacacagaaaag

SEQ ID NO: 5641665 - DNA, 16 bp, Homo sapiens
tcagggttatttgagg

SEQ ID NO: 5641666 - DNA, 19 bp, Homo sapiens
tcagggttggcccctgccc

SEQ ID NO: 5641667 - DNA, 17 bp, Homo sapiens
tcaggtaaaaacttcat

SEQ ID NO: 5641668 - DNA, 13 bp, Homo sapiens
tcaggtaaatctt

SEQ ID NO: 5641669 - DNA, 22 bp, Homo sapiens
tcaggtaacaggcagatacagg

SEQ ID NO: 5641670 - DNA, 15 bp, Homo sapiens
tcaggtaatacaaac

SEQ ID NO: 5641671 - DNA, 16 bp, Homo sapiens
tcaggtaatacaaact

SEQ ID NO: 5641672 - DNA, 19 bp, Homo sapiens
tcaggtacagagaaggaat

SEQ ID NO: 5641673 - DNA, 14 bp, Homo sapiens
tcaggtacggagaa

SEQ ID NO: 5641674 - DNA, 16 bp, Homo sapiens
tcaggtacggagaaga

SEQ ID NO: 5641675 - DNA, 14 bp, Homo sapiens
tcaggtactcctgc

SEQ ID NO: 5641676 - DNA, 16 bp, Homo sapiens
tcaggtactcctgcca

SEQ ID NO: 5641677 - DNA, 14 bp, Homo sapiens
tcaggtacttgtaa

SEQ ID NO: 5641678 - DNA, 16 bp, Homo sapiens
tcaggtagccaccacc

SEQ ID NO: 5641679 - DNA, 23 bp, Homo sapiens
tcaggtaggcccttgtcctgcca

SEQ ID NO: 5641680 - DNA, 19 bp, Homo sapiens
tcaggtagggagctaagga

SEQ ID NO: 5641681 - DNA, 14 bp, Homo sapiens
tcaggtagtactgg

SEQ ID NO: 5641682 - DNA, 19 bp, Homo sapiens
tcaggtagttgcaattgaa

SEQ ID NO: 5641683 - DNA, 15 bp, Homo sapiens
tcaggtattaagaaa

SEQ ID NO: 5641684 - DNA, 21 bp, Homo sapiens
tcaggtattgattgaaaaaag

SEQ ID NO: 5641685 - DNA, 16 bp, Homo sapiens
tcaggtcagagcccag

SEQ ID NO: 5641686 - DNA, 14 bp, Homo sapiens
tcaggtcagctggg

SEQ ID NO: 5641687 - DNA, 18 bp, Homo sapiens
tcaggtcagggtgaggat

SEQ ID NO: 5641688 - DNA, 17 bp, Homo sapiens
tcaggtcaggtggctgt

SEQ ID NO: 5641689 - DNA, 23 bp, Homo sapiens
tcaggtccaggccagtgggcctg

SEQ ID NO: 5641690 - DNA, 19 bp, Homo sapiens
tcaggtcccagttgctgtc

SEQ ID NO: 5641691 - DNA, 14 bp, Homo sapiens
tcaggtccccatgg

SEQ ID NO: 5641692 - DNA, 15 bp, Homo sapiens
tcaggtcccctggcc

SEQ ID NO: 5641693 - DNA, 17 bp, Homo sapiens
tcaggtccgtgggccgt

SEQ ID NO: 5641694 - DNA, 16 bp, Homo sapiens
tcaggtcctcagagaa

SEQ ID NO: 5641695 - DNA, 18 bp, Homo sapiens
tcaggtcctgctcagcag

SEQ ID NO: 5641696 - DNA, 21 bp, Homo sapiens
tcaggtctcccacgtgggaga

SEQ ID NO: 5641697 - DNA, 20 bp, Homo sapiens
tcaggtctctgtgggtggga

SEQ ID NO: 5641698 - DNA, 22 bp, Homo sapiens
tcaggtctgtaactgcccagcc

SEQ ID NO: 5641699 - DNA, 14 bp, Homo sapiens
tcaggtctgtatgt

SEQ ID NO: 5641700 - DNA, 17 bp, Homo sapiens
tcaggtctgtatgtcat

SEQ ID NO: 5641701 - DNA, 13 bp, Homo sapiens
tcaggtgaaaatg

SEQ ID NO: 5641702 - DNA, 18 bp, Homo sapiens
tcaggtgaaaatgttcat

SEQ ID NO: 5641703 - DNA, 16 bp, Homo sapiens
tcaggtgaaaggaaat

SEQ ID NO: 5641704 - DNA, 21 bp, Homo sapiens
tcaggtgaacacttagtgatc

SEQ ID NO: 5641705 - DNA, 21 bp, Homo sapiens
tcaggtgaataataaaatcaa

SEQ ID NO: 5641706 - DNA, 23 bp, Homo sapiens
tcaggtgaataataaaatcaaaa

SEQ ID NO: 5641707 - DNA, 17 bp, Homo sapiens
tcaggtgacatgtgaaa

SEQ ID NO: 5641708 - DNA, 22 bp, Homo sapiens
tcaggtgaccaaaatccccttc

SEQ ID NO: 5641709 - DNA, 16 bp, Homo sapiens
tcaggtgacctcctgc

SEQ ID NO: 5641710 - DNA, 18 bp, Homo sapiens
tcaggtgacctcctgcag

SEQ ID NO: 5641711 - DNA, 12 bp, Homo sapiens
tcaggtgacttt

SEQ ID NO: 5641712 - DNA, 21 bp, Homo sapiens
tcaggtgagaagcagaggaag

SEQ ID NO: 5641713 - DNA, 23 bp, Homo sapiens
tcaggtgattccaggatggtttg

SEQ ID NO: 5641714 - DNA, 19 bp, Homo sapiens
tcaggtgcacacatcacca

SEQ ID NO: 5641715 - DNA, 16 bp, Homo sapiens
tcaggtgcagaggaag

SEQ ID NO: 5641716 - DNA, 23 bp, Homo sapiens
tcaggtgcagtcccagtccttga

SEQ ID NO: 5641717 - DNA, 12 bp, Homo sapiens
tcaggtgccact

SEQ ID NO: 5641718 - DNA, 16 bp, Homo sapiens
tcaggtgccactgacc

SEQ ID NO: 5641719 - DNA, 18 bp, Homo sapiens
tcaggtgccttacatctt

SEQ ID NO: 5641720 - DNA, 14 bp, Homo sapiens
tcaggtgctgccat

SEQ ID NO: 5641721 - DNA, 15 bp, Homo sapiens
tcaggtgctggggcc

SEQ ID NO: 5641722 - DNA, 23 bp, Homo sapiens
tcaggtgctggggcctggttccc

SEQ ID NO: 5641723 - DNA, 13 bp, Homo sapiens
tcaggtggaacag

SEQ ID NO: 5641724 - DNA, 23 bp, Homo sapiens
tcaggtggaacaggaggaactgg

SEQ ID NO: 5641725 - DNA, 13 bp, Homo sapiens
tcaggtggaccct

SEQ ID NO: 5641726 - DNA, 16 bp, Homo sapiens
tcaggtggcatttgca

SEQ ID NO: 5641727 - DNA, 17 bp, Homo sapiens
tcaggtggcatttgcag

SEQ ID NO: 5641728 - DNA, 18 bp, Homo sapiens
tcaggtggcatttgcagg

SEQ ID NO: 5641729 - DNA, 11 bp, Homo sapiens
tcaggtggcca

SEQ ID NO: 5641730 - DNA, 13 bp, Homo sapiens
tcaggtggccaga

SEQ ID NO: 5641731 - DNA, 16 bp, Homo sapiens
tcaggtggccagaaga

SEQ ID NO: 5641732 - DNA, 19 bp, Homo sapiens
tcaggtggccagaagagct

SEQ ID NO: 5641733 - DNA, 14 bp, Homo sapiens
tcaggtggctgtgg

SEQ ID NO: 5641734 - DNA, 19 bp, Homo sapiens
tcaggtgggcggtgtgtct

SEQ ID NO: 5641735 - DNA, 22 bp, Homo sapiens
tcaggtggggagtccagggctc

SEQ ID NO: 5641736 - DNA, 19 bp, Homo sapiens
tcaggtggggcagcttgag

SEQ ID NO: 5641737 - DNA, 20 bp, Homo sapiens
tcaggtggtgtccttcttcc

SEQ ID NO: 5641738 - DNA, 13 bp, Homo sapiens
tcaggtgtataaa

SEQ ID NO: 5641739 - DNA, 23 bp, Homo sapiens
tcaggtgtatagggaattttcat

SEQ ID NO: 5641740 - DNA, 15 bp, Homo sapiens
tcaggtgtcaggccc

SEQ ID NO: 5641741 - DNA, 22 bp, Homo sapiens
tcaggtgtcatggactgttgcc

SEQ ID NO: 5641742 - DNA, 22 bp, Homo sapiens
tcaggtgtccctgcacttgcag

SEQ ID NO: 5641743 - DNA, 23 bp, Homo sapiens
tcaggtgtgataaaatgttgaac

SEQ ID NO: 5641744 - DNA, 22 bp, Homo sapiens
tcaggtgtgcctgttgctttct

SEQ ID NO: 5641745 - DNA, 19 bp, Homo sapiens
tcaggtgtggcggtgcgtg

SEQ ID NO: 5641746 - DNA, 22 bp, Homo sapiens
tcaggtgtggcggtgcgtgcct

SEQ ID NO: 5641747 - DNA, 22 bp, Homo sapiens
tcaggttactcgttcttcagca

SEQ ID NO: 5641748 - DNA, 15 bp, Homo sapiens
tcaggttatactcct

SEQ ID NO: 5641749 - DNA, 19 bp, Homo sapiens
tcaggttatcgaaataaca

SEQ ID NO: 5641750 - DNA, 20 bp, Homo sapiens
tcaggttatcgaaataacaa

SEQ ID NO: 5641751 - DNA, 23 bp, Homo sapiens
tcaggttatcgaaataacaatgt

SEQ ID NO: 5641752 - DNA, 17 bp, Homo sapiens
tcaggttccctgccaca

SEQ ID NO: 5641753 - DNA, 16 bp, Homo sapiens
tcaggttcctacagga

SEQ ID NO: 5641754 - DNA, 18 bp, Homo sapiens
tcaggttcctacaggaga

SEQ ID NO: 5641755 - DNA, 13 bp, Homo sapiens
tcaggttcctttt

SEQ ID NO: 5641756 - DNA, 19 bp, Homo sapiens
tcaggttctattttcttaa

SEQ ID NO: 5641757 - DNA, 18 bp, Homo sapiens
tcaggttcttagtgtcac

SEQ ID NO: 5641758 - DNA, 20 bp, Homo sapiens
tcaggttgctggttgctgtg

SEQ ID NO: 5641759 - DNA, 19 bp, Homo sapiens
tcaggttgtagtaaagaaa

SEQ ID NO: 5641760 - DNA, 19 bp, Homo sapiens
tcaggtttgtcatcagatg

SEQ ID NO: 5641761 - DNA, 14 bp, Homo sapiens
tcaggttttcaggt

SEQ ID NO: 5641762 - DNA, 20 bp, Homo sapiens
tcaggttttcttttaagaat

SEQ ID NO: 5641763 - DNA, 13 bp, Homo sapiens
tcaggttttgtaa

SEQ ID NO: 5641764 - DNA, 14 bp, Homo sapiens
tcaggttttgtaaa

SEQ ID NO: 5641765 - DNA, 20 bp, Homo sapiens
tcagtaaaagtcttctccca

SEQ ID NO: 5641766 - DNA, 18 bp, Homo sapiens
tcagtaaataactggaaa

SEQ ID NO: 5641767 - DNA, 15 bp, Homo sapiens
tcagtaacataactg

SEQ ID NO: 5641768 - DNA, 20 bp, Homo sapiens
tcagtaacataactgcttct

SEQ ID NO: 5641769 - DNA, 22 bp, Homo sapiens
tcagtaacataactgcttcttg

SEQ ID NO: 5641770 - DNA, 21 bp, Homo sapiens
tcagtaacccccttaaattta

SEQ ID NO: 5641771 - DNA, 21 bp, Homo sapiens
tcagtaacttacccttaggga

SEQ ID NO: 5641772 - DNA, 17 bp, Homo sapiens
tcagtaacttttaaaag

SEQ ID NO: 5641773 - DNA, 17 bp, Homo sapiens
tcagtaagaaaaagaag

SEQ ID NO: 5641774 - DNA, 13 bp, Homo sapiens
tcagtaagacgac

SEQ ID NO: 5641775 - DNA, 21 bp, Homo sapiens
tcagtaagacgacaaggaaag

SEQ ID NO: 5641776 - DNA, 22 bp, Homo sapiens
tcagtaagacgacaaggaaagg

SEQ ID NO: 5641777 - DNA, 16 bp, Homo sapiens
tcagtaagctgtgtgg

SEQ ID NO: 5641778 - DNA, 16 bp, Homo sapiens
tcagtaagtataacaa

SEQ ID NO: 5641779 - DNA, 14 bp, Homo sapiens
tcagtaagttatct

SEQ ID NO: 5641780 - DNA, 23 bp, Homo sapiens
tcagtaagttatctttgaatatg

SEQ ID NO: 5641781 - DNA, 16 bp, Homo sapiens
tcagtaatataatttg

SEQ ID NO: 5641782 - DNA, 14 bp, Homo sapiens
tcagtaatatttat

SEQ ID NO: 5641783 - DNA, 17 bp, Homo sapiens
tcagtaatcacttttca

SEQ ID NO: 5641784 - DNA, 12 bp, Homo sapiens
tcagtaatctgt

SEQ ID NO: 5641785 - DNA, 22 bp, Homo sapiens
tcagtaatgcagtttttaaaaa

SEQ ID NO: 5641786 - DNA, 18 bp, Homo sapiens
tcagtaatttagaaatca

SEQ ID NO: 5641787 - DNA, 19 bp, Homo sapiens
tcagtaatttagaaatcat

SEQ ID NO: 5641788 - DNA, 14 bp, Homo sapiens
tcagtaatttgagg

SEQ ID NO: 5641789 - DNA, 18 bp, Homo sapiens
tcagtaatttgaggacaa

SEQ ID NO: 5641790 - DNA, 15 bp, Homo sapiens
tcagtgtgttgactt

SEQ ID NO: 5641791 - DNA, 15 bp, Homo sapiens
tcagtgttaaattca

SEQ ID NO: 5641792 - DNA, 21 bp, Homo sapiens
tcagtgttaatactgagaaaa

SEQ ID NO: 5641793 - DNA, 22 bp, Homo sapiens
tcagtgttaatactgagaaaaa

SEQ ID NO: 5641794 - DNA, 23 bp, Homo sapiens
tcagtgttaatactgagaaaaag

SEQ ID NO: 5641795 - DNA, 15 bp, Homo sapiens
tcagtgttacctgtg

SEQ ID NO: 5641796 - DNA, 17 bp, Homo sapiens
tcagtgttacctgtgtg

SEQ ID NO: 5641797 - DNA, 18 bp, Homo sapiens
tcagtgttacctgtgtgc

SEQ ID NO: 5641798 - DNA, 23 bp, Homo sapiens
tcagtgttactgcctataatctt

SEQ ID NO: 5641799 - DNA, 20 bp, Homo sapiens
tcagtgttcagccaaacagt

SEQ ID NO: 5641800 - DNA, 12 bp, Homo sapiens
tcagtgttccca

SEQ ID NO: 5641801 - DNA, 11 bp, Homo sapiens
tcagtgttgac

SEQ ID NO: 5641802 - DNA, 17 bp, Homo sapiens
tcagtgttgacatagcc

SEQ ID NO: 5641803 - DNA, 15 bp, Homo sapiens
tcagtgttggtatat

SEQ ID NO: 5641804 - DNA, 11 bp, Homo sapiens
tcagtgtttaa

SEQ ID NO: 5641805 - DNA, 14 bp, Homo sapiens
tcagtgtttatgtg

SEQ ID NO: 5641806 - DNA, 15 bp, Homo sapiens
tcagtgtttggtgca

SEQ ID NO: 5641807 - DNA, 19 bp, Homo sapiens
tcagtgttttcattttaga

SEQ ID NO: 5641808 - DNA, 16 bp, Homo sapiens
tcagtgttttggactc

SEQ ID NO: 5641809 - DNA, 20 bp, Homo sapiens
tcagttaaaatcacatttta

SEQ ID NO: 5641810 - DNA, 16 bp, Homo sapiens
tcagttaacgtcaccc

SEQ ID NO: 5641811 - DNA, 20 bp, Homo sapiens
tcagttaactattgcattta

SEQ ID NO: 5641812 - DNA, 14 bp, Homo sapiens
tcagttaagaaaaa

SEQ ID NO: 5641813 - DNA, 15 bp, Homo sapiens
tcagttaagaaaaaa

SEQ ID NO: 5641814 - DNA, 18 bp, Homo sapiens
tcagttaagtttttccct

SEQ ID NO: 5641815 - DNA, 13 bp, Homo sapiens
tcagttacacagg

SEQ ID NO: 5641816 - DNA, 15 bp, Homo sapiens
tcagttacagaaagt

SEQ ID NO: 5641817 - DNA, 14 bp, Homo sapiens
tcagttacagtggc

SEQ ID NO: 5641818 - DNA, 18 bp, Homo sapiens
tcagttactcagccctgg

SEQ ID NO: 5641819 - DNA, 15 bp, Homo sapiens
tcagttacttacctg

SEQ ID NO: 5641820 - DNA, 16 bp, Homo sapiens
tcagttaggctagaga

SEQ ID NO: 5641821 - DNA, 21 bp, Homo sapiens
tcagttatacagttataaaat

SEQ ID NO: 5641822 - DNA, 17 bp, Homo sapiens
tcagttatattttgctg

SEQ ID NO: 5641823 - DNA, 17 bp, Homo sapiens
tcagttatgagtataat

SEQ ID NO: 5641824 - DNA, 13 bp, Homo sapiens
tcagttattaaat

SEQ ID NO: 5641825 - DNA, 20 bp, Homo sapiens
tcagttcaaagtcatgatgt

SEQ ID NO: 5641826 - DNA, 15 bp, Homo sapiens
tcagttcaaatgtta

SEQ ID NO: 5641827 - DNA, 22 bp, Homo sapiens
tcagttcaacctggtggcacca

SEQ ID NO: 5641828 - DNA, 18 bp, Homo sapiens
tcagttcaatcaaacttt

SEQ ID NO: 5641829 - DNA, 22 bp, Homo sapiens
tcagttcaatcaaactttcagc

SEQ ID NO: 5641830 - DNA, 14 bp, Homo sapiens
tcagttcagaaaaa

SEQ ID NO: 5641831 - DNA, 15 bp, Homo sapiens
tcagttcagaaaaaa

SEQ ID NO: 5641832 - DNA, 14 bp, Homo sapiens
tcagttcagcttta

SEQ ID NO: 5641833 - DNA, 16 bp, Homo sapiens
tcagttcatatgcaga

SEQ ID NO: 5641834 - DNA, 23 bp, Homo sapiens
tcagttcatcctgcatgggaaaa

SEQ ID NO: 5641835 - DNA, 23 bp, Homo sapiens
tcagttcattgacctcatcatta

SEQ ID NO: 5641836 - DNA, 14 bp, Homo sapiens
tcagttcatttcct

SEQ ID NO: 5641837 - DNA, 13 bp, Homo sapiens
tcagttccaaagt

SEQ ID NO: 5641838 - DNA, 12 bp, Homo sapiens
tcagttccaaga

SEQ ID NO: 5641839 - DNA, 15 bp, Homo sapiens
tcagttccagctttt

SEQ ID NO: 5641840 - DNA, 16 bp, Homo sapiens
tcagttccagcttttg

SEQ ID NO: 5641841 - DNA, 20 bp, Homo sapiens
tcagttccaggcctgatctt

SEQ ID NO: 5641842 - DNA, 14 bp, Homo sapiens
tcagttcccagaat

SEQ ID NO: 5641843 - DNA, 16 bp, Homo sapiens
tcagttcccagaatca

SEQ ID NO: 5641844 - DNA, 15 bp, Homo sapiens
tcagttcccagctcc

SEQ ID NO: 5641845 - DNA, 20 bp, Homo sapiens
tcagttcccccagtacctcc

SEQ ID NO: 5641846 - DNA, 22 bp, Homo sapiens
tcagttcccggagcacagccct

SEQ ID NO: 5641847 - DNA, 23 bp, Homo sapiens
tcagttcccggagcacagccctg

SEQ ID NO: 5641848 - DNA, 20 bp, Homo sapiens
tcagttccctcctgcccagg

SEQ ID NO: 5641849 - DNA, 22 bp, Homo sapiens
tcagttccctcctgcccaggac

SEQ ID NO: 5641850 - DNA, 16 bp, Homo sapiens
tcagttcccttggcct

SEQ ID NO: 5641851 - DNA, 18 bp, Homo sapiens
tcagttcccttggcctca

SEQ ID NO: 5641852 - DNA, 19 bp, Homo sapiens
tcagttcccttggcctcag

SEQ ID NO: 5641853 - DNA, 19 bp, Homo sapiens
tcagttccgtcagaaagtg

SEQ ID NO: 5641854 - DNA, 19 bp, Homo sapiens
tcagttcctctttgcatgg

SEQ ID NO: 5641855 - DNA, 19 bp, Homo sapiens
tcagttctacggatcatca

SEQ ID NO: 5641856 - DNA, 16 bp, Homo sapiens
tcagttctaggccttt

SEQ ID NO: 5641857 - DNA, 22 bp, Homo sapiens
tcagttctaggcctttcctctg

SEQ ID NO: 5641858 - DNA, 15 bp, Homo sapiens
tcagttctagttgat

SEQ ID NO: 5641859 - DNA, 19 bp, Homo sapiens
tcagttctcatcttgtaaa

SEQ ID NO: 5641860 - DNA, 22 bp, Homo sapiens
tcagttctctactccctcttgt

SEQ ID NO: 5641861 - DNA, 13 bp, Homo sapiens
tcagttctgcttg

SEQ ID NO: 5641862 - DNA, 15 bp, Homo sapiens
tcagttctgtgtaca

SEQ ID NO: 5641863 - DNA, 20 bp, Homo sapiens
tcagttctgtgtacatttta

SEQ ID NO: 5641864 - DNA, 21 bp, Homo sapiens
tcagttctgtgtggtgcattc

SEQ ID NO: 5641865 - DNA, 21 bp, Homo sapiens
tcagttcttggtgctctgtgt

SEQ ID NO: 5641866 - DNA, 16 bp, Homo sapiens
tcagttgagaaacagt

SEQ ID NO: 5641867 - DNA, 23 bp, Homo sapiens
tcagttgagcttcatataccagc

SEQ ID NO: 5641868 - DNA, 17 bp, Homo sapiens
tcagttgattttctgga

SEQ ID NO: 5641869 - DNA, 18 bp, Homo sapiens
tcagttgctcaaaaagaa

SEQ ID NO: 5641870 - DNA, 20 bp, Homo sapiens
tcagttgctctctgttcaag

SEQ ID NO: 5641871 - DNA, 14 bp, Homo sapiens
tcagttggacagta

SEQ ID NO: 5641872 - DNA, 22 bp, Homo sapiens
tcagttggagaaaatgaagaaa

SEQ ID NO: 5641873 - DNA, 14 bp, Homo sapiens
tcagttggcctctg

SEQ ID NO: 5641874 - DNA, 14 bp, Homo sapiens
tcagttggctgact

SEQ ID NO: 5641875 - DNA, 15 bp, Homo sapiens
tcagttgggtttcac

SEQ ID NO: 5641876 - DNA, 23 bp, Homo sapiens
tcagttgggtttcacgagtgttc

SEQ ID NO: 5641877 - DNA, 15 bp, Homo sapiens
tcagttggtaagctt

SEQ ID NO: 5641878 - DNA, 22 bp, Homo sapiens
tcagttgtggcctcattcagca

SEQ ID NO: 5641879 - DNA, 13 bp, Homo sapiens
tcagttgtgtttt

SEQ ID NO: 5641880 - DNA, 16 bp, Homo sapiens
tcagttgtgtttttta

SEQ ID NO: 5641881 - DNA, 17 bp, Homo sapiens
tcagttgttagtgtgtc

SEQ ID NO: 5641882 - DNA, 17 bp, Homo sapiens
tcagttgttatttattg

SEQ ID NO: 5641883 - DNA, 19 bp, Homo sapiens
tcagttgtttgtttttgct

SEQ ID NO: 5641884 - DNA, 19 bp, Homo sapiens
tcagtttaatccttctagt

SEQ ID NO: 5641885 - DNA, 13 bp, Homo sapiens
tcagtttaatgca

SEQ ID NO: 5641886 - DNA, 23 bp, Homo sapiens
tcagtttaatgcaagagaacatt

SEQ ID NO: 5641887 - DNA, 13 bp, Homo sapiens
tcagtttacatct

SEQ ID NO: 5641888 - DNA, 18 bp, Homo sapiens
tcagtttagaacctacaa

SEQ ID NO: 5641889 - DNA, 19 bp, Homo sapiens
tcagtttaggccttggctt

SEQ ID NO: 5641890 - DNA, 16 bp, Homo sapiens
tcagtttatctgttca

SEQ ID NO: 5641891 - DNA, 19 bp, Homo sapiens
tcagtttcaattcagtgct

SEQ ID NO: 5641892 - DNA, 19 bp, Homo sapiens
tcagtttcacagaaaataa

SEQ ID NO: 5641893 - DNA, 20 bp, Homo sapiens
tcagtttccaattatttgac

SEQ ID NO: 5641894 - DNA, 23 bp, Homo sapiens
tcagtttccccaacacacagcag

SEQ ID NO: 5641895 - DNA, 21 bp, Homo sapiens
tcagtttccgaatctctttcc

SEQ ID NO: 5641896 - DNA, 14 bp, Homo sapiens
tcagtttcctctcc

SEQ ID NO: 5641897 - DNA, 16 bp, Homo sapiens
tcagtttcctggtctg

SEQ ID NO: 5641898 - DNA, 14 bp, Homo sapiens
tcagtttctatcaa

SEQ ID NO: 5641899 - DNA, 18 bp, Homo sapiens
tcagtttctccatcagct

SEQ ID NO: 5641900 - DNA, 20 bp, Homo sapiens
tcagtttcttctccagactg

SEQ ID NO: 5641901 - DNA, 22 bp, Homo sapiens
tcagtttcttctgcgcctcagg

SEQ ID NO: 5641902 - DNA, 21 bp, Homo sapiens
tcagtttgaaaatattttgtt

SEQ ID NO: 5641903 - DNA, 22 bp, Homo sapiens
tcagtttgatacagtattgaaa

SEQ ID NO: 5641904 - DNA, 15 bp, Homo sapiens
tcagtttgcagagta

SEQ ID NO: 5641905 - DNA, 16 bp, Homo sapiens
tcagtttgcagagtag

SEQ ID NO: 5641906 - DNA, 17 bp, Homo sapiens
tcagtttggctgtaatt

SEQ ID NO: 5641907 - DNA, 20 bp, Homo sapiens
tcagtttgtgaagtgattga

SEQ ID NO: 5641908 - DNA, 15 bp, Homo sapiens
tcagttttaaaaatg

SEQ ID NO: 5641909 - DNA, 21 bp, Homo sapiens
tcagttttagtttcaaaatgt

SEQ ID NO: 5641910 - DNA, 22 bp, Homo sapiens
tcagttttagtttcaaaatgtt

SEQ ID NO: 5641911 - DNA, 16 bp, Homo sapiens
tcagttttatcatttt

SEQ ID NO: 5641912 - DNA, 14 bp, Homo sapiens
tcagttttatcttt

SEQ ID NO: 5641913 - DNA, 12 bp, Homo sapiens
tcagttttcaca

SEQ ID NO: 5641914 - DNA, 16 bp, Homo sapiens
tcagttttcacagagg

SEQ ID NO: 5641915 - DNA, 17 bp, Homo sapiens
tcagttttcacagaggc

SEQ ID NO: 5641916 - DNA, 16 bp, Homo sapiens
tcagttttcaggagtg

SEQ ID NO: 5641917 - DNA, 13 bp, Homo sapiens
tcagttttcattt

SEQ ID NO: 5641918 - DNA, 14 bp, Homo sapiens
tcagttttcccact

SEQ ID NO: 5641919 - DNA, 12 bp, Homo sapiens
tcagttttccta

SEQ ID NO: 5641920 - DNA, 20 bp, Homo sapiens
tcagttttcctagtctttgg

SEQ ID NO: 5641921 - DNA, 20 bp, Homo sapiens
tcagttttcctctcaataaa

SEQ ID NO: 5641922 - DNA, 13 bp, Homo sapiens
tcagttttccttc

SEQ ID NO: 5641923 - DNA, 19 bp, Homo sapiens
tcagttttccttctgttaa

SEQ ID NO: 5641924 - DNA, 12 bp, Homo sapiens
tcagttttggtg

SEQ ID NO: 5641925 - DNA, 15 bp, Homo sapiens
tcagttttgtacata

SEQ ID NO: 5641926 - DNA, 12 bp, Homo sapiens
tcagttttgtat

SEQ ID NO: 5641927 - DNA, 18 bp, Homo sapiens
tcagttttgtataactta

SEQ ID NO: 5641928 - DNA, 19 bp, Homo sapiens
tcagtttttattaatctac

SEQ ID NO: 5641929 - DNA, 13 bp, Homo sapiens
tcagtttttcact

SEQ ID NO: 5641930 - DNA, 14 bp, Homo sapiens
tcagtttttcattt

SEQ ID NO: 5641931 - DNA, 15 bp, Homo sapiens
tcagtttttcatttg

SEQ ID NO: 5641932 - DNA, 17 bp, Homo sapiens
tcagtttttcatttgtt

SEQ ID NO: 5641933 - DNA, 14 bp, Homo sapiens
tcagtttttcctcc

SEQ ID NO: 5641934 - DNA, 14 bp, Homo sapiens
tcagtttttgctga

SEQ ID NO: 5641935 - DNA, 17 bp, Homo sapiens
tcagtttttgtatcttg

SEQ ID NO: 5641936 - DNA, 15 bp, Homo sapiens
tcagtttttgttctt

SEQ ID NO: 5641937 - DNA, 23 bp, Homo sapiens
tcagttttttatctgggttctct

SEQ ID NO: 5641938 - DNA, 18 bp, Homo sapiens
tcagtttttttaaatgcc

SEQ ID NO: 5641939 - DNA, 18 bp, Homo sapiens
tcagtttttttttttcca

SEQ ID NO: 5641940 - DNA, 19 bp, Homo sapiens
tcagtttttttttttccag

SEQ ID NO: 5641941 - DNA, 20 bp, Homo sapiens
tcataaaaacaagtcatttt

SEQ ID NO: 5641942 - DNA, 20 bp, Homo sapiens
tcataaaaagcaaaacaaaa

SEQ ID NO: 5641943 - DNA, 22 bp, Homo sapiens
tcataaaaagcctgcaatttca

SEQ ID NO: 5641944 - DNA, 22 bp, Homo sapiens
tcataaaaataaaatctgtaaa

SEQ ID NO: 5641945 - DNA, 21 bp, Homo sapiens
tcataaaacggtgctttctgt

SEQ ID NO: 5641946 - DNA, 12 bp, Homo sapiens
tcataaaactgt

SEQ ID NO: 5641947 - DNA, 13 bp, Homo sapiens
tcataaaagagac

SEQ ID NO: 5641948 - DNA, 15 bp, Homo sapiens
tcataaaatgcatac

SEQ ID NO: 5641949 - DNA, 21 bp, Homo sapiens
tcataaaatgcatactgttga

SEQ ID NO: 5641950 - DNA, 17 bp, Homo sapiens
tcataaaatgctatttt

SEQ ID NO: 5641951 - DNA, 19 bp, Homo sapiens
tcataaaatgctattttaa

SEQ ID NO: 5641952 - DNA, 20 bp, Homo sapiens
tcataaaatgctattttaaa

SEQ ID NO: 5641953 - DNA, 19 bp, Homo sapiens
tcataaacagatgaataaa

SEQ ID NO: 5641954 - DNA, 13 bp, Homo sapiens
tcataaacagcat

SEQ ID NO: 5641955 - DNA, 16 bp, Homo sapiens
tcataaacagcattta

SEQ ID NO: 5641956 - DNA, 17 bp, Homo sapiens
tcataaacagcatttat

SEQ ID NO: 5641957 - DNA, 23 bp, Homo sapiens
tcataaacagcatttattacctt

SEQ ID NO: 5641958 - DNA, 19 bp, Homo sapiens
tcataaacattttacatgc

SEQ ID NO: 5641959 - DNA, 14 bp, Homo sapiens
tcataaacctgttt

SEQ ID NO: 5641960 - DNA, 15 bp, Homo sapiens
tcataaactgagcct

SEQ ID NO: 5641961 - DNA, 22 bp, Homo sapiens
tcataaactgagcctcttttca

SEQ ID NO: 5641962 - DNA, 14 bp, Homo sapiens
tcataaactgtgtg

SEQ ID NO: 5641963 - DNA, 12 bp, Homo sapiens
tcataaactttt

SEQ ID NO: 5641964 - DNA, 14 bp, Homo sapiens
tcataaagaaaaat

SEQ ID NO: 5641965 - DNA, 16 bp, Homo sapiens
tcataaagatgttaaa

SEQ ID NO: 5641966 - DNA, 18 bp, Homo sapiens
tcataaagatgttaaatg

SEQ ID NO: 5641967 - DNA, 24 bp, Homo sapiens
tcataaagcaggcagaactcatct

SEQ ID NO: 5641968 - DNA, 19 bp, Homo sapiens
tcatccctttctcccagtg

SEQ ID NO: 5641969 - DNA, 13 bp, Homo sapiens
tcatccctttggt

SEQ ID NO: 5641970 - DNA, 17 bp, Homo sapiens
tcatccgagcaaggtgg

SEQ ID NO: 5641971 - DNA, 14 bp, Homo sapiens
tcatccgcactgta

SEQ ID NO: 5641972 - DNA, 14 bp, Homo sapiens
tcatccgcctgtgg

SEQ ID NO: 5641973 - DNA, 18 bp, Homo sapiens
tcatccgcctgtgggcgc

SEQ ID NO: 5641974 - DNA, 14 bp, Homo sapiens
tcatccgttgtgac

SEQ ID NO: 5641975 - DNA, 22 bp, Homo sapiens
tcatccgttgtgactctaggct

SEQ ID NO: 5641976 - DNA, 16 bp, Homo sapiens
tcatccgtttcagctg

SEQ ID NO: 5641977 - DNA, 12 bp, Homo sapiens
tcatcctaacaa

SEQ ID NO: 5641978 - DNA, 18 bp, Homo sapiens
tcatcctattacttttca

SEQ ID NO: 5641979 - DNA, 20 bp, Homo sapiens
tcatcctattacttttcatc

SEQ ID NO: 5641980 - DNA, 11 bp, Homo sapiens
tcatcctcagc

SEQ ID NO: 5641981 - DNA, 13 bp, Homo sapiens
tcatcctcaggaa

SEQ ID NO: 5641982 - DNA, 18 bp, Homo sapiens
tcatcctcatacccaccc

SEQ ID NO: 5641983 - DNA, 17 bp, Homo sapiens
tcatcctccccaggacc

SEQ ID NO: 5641984 - DNA, 20 bp, Homo sapiens
tcatcctccctgaccctgct

SEQ ID NO: 5641985 - DNA, 19 bp, Homo sapiens
tcatcctcccttgccccag

SEQ ID NO: 5641986 - DNA, 20 bp, Homo sapiens
tcatcctcccttgccccagg

SEQ ID NO: 5641987 - DNA, 12 bp, Homo sapiens
tcatcctcctcc

SEQ ID NO: 5641988 - DNA, 13 bp, Homo sapiens
tcatcctcctccc

SEQ ID NO: 5641989 - DNA, 17 bp, Homo sapiens
tcatcctcctccccagc

SEQ ID NO: 5641990 - DNA, 15 bp, Homo sapiens
tcatcctcctcctca

SEQ ID NO: 5641991 - DNA, 16 bp, Homo sapiens
tcatcctcctcctcat

SEQ ID NO: 5641992 - DNA, 14 bp, Homo sapiens
tcatcctcctggac

SEQ ID NO: 5641993 - DNA, 22 bp, Homo sapiens
tcatcctccttataagcccagc

SEQ ID NO: 5641994 - DNA, 16 bp, Homo sapiens
tcatcctcctttcagt

SEQ ID NO: 5641995 - DNA, 22 bp, Homo sapiens
tcatcctctccacagctgcctc

SEQ ID NO: 5641996 - DNA, 16 bp, Homo sapiens
tcatcctgactctgcc

SEQ ID NO: 5641997 - DNA, 17 bp, Homo sapiens
tcatcctgactctgccc

SEQ ID NO: 5641998 - DNA, 19 bp, Homo sapiens
tcatcctgactctgccccc

SEQ ID NO: 5641999 - DNA, 13 bp, Homo sapiens
tcatcctgagccc

SEQ ID NO: 5642000 - DNA, 15 bp, Homo sapiens
tcatcctgattttta

SEQ ID NO: 5642001 - DNA, 17 bp, Homo sapiens
tcatcctgccctgcagc

SEQ ID NO: 5642002 - DNA, 15 bp, Homo sapiens
tcatcctgccttcat

SEQ ID NO: 5642003 - DNA, 20 bp, Homo sapiens
tcatcctgctcttttgtgat

SEQ ID NO: 5642004 - DNA, 15 bp, Homo sapiens
tcatcctgcttctct

SEQ ID NO: 5642005 - DNA, 16 bp, Homo sapiens
tcatcctggcctcctt

SEQ ID NO: 5642006 - DNA, 13 bp, Homo sapiens
tcatcctgggcat

SEQ ID NO: 5642007 - DNA, 15 bp, Homo sapiens
tcatcctgtgctcgg

SEQ ID NO: 5642008 - DNA, 12 bp, Homo sapiens
tcatcctgtgtc

SEQ ID NO: 5642009 - DNA, 17 bp, Homo sapiens
tcatcctgtgtggggag

SEQ ID NO: 5642010 - DNA, 22 bp, Homo sapiens
tcatcctgtgtggggaggcagc

SEQ ID NO: 5642011 - DNA, 15 bp, Homo sapiens
tcatcctgttttctc

SEQ ID NO: 5642012 - DNA, 18 bp, Homo sapiens
tcatccttagaaatcagt

SEQ ID NO: 5642013 - DNA, 18 bp, Homo sapiens
tcatccttagcaacagcc

SEQ ID NO: 5642014 - DNA, 22 bp, Homo sapiens
tcatccttatgagactcttaaa

SEQ ID NO: 5642015 - DNA, 15 bp, Homo sapiens
tcatccttccatcca

SEQ ID NO: 5642016 - DNA, 14 bp, Homo sapiens
tcatccttctttcc

SEQ ID NO: 5642017 - DNA, 18 bp, Homo sapiens
tcatccttgcccaggtga

SEQ ID NO: 5642018 - DNA, 20 bp, Homo sapiens
tcatccttggtctttgtatc

SEQ ID NO: 5642019 - DNA, 17 bp, Homo sapiens
tcatccttggtgctctt

SEQ ID NO: 5642020 - DNA, 21 bp, Homo sapiens
tcatccttggtgctcttgctt

SEQ ID NO: 5642021 - DNA, 13 bp, Homo sapiens
tcatccttgtctt

SEQ ID NO: 5642022 - DNA, 14 bp, Homo sapiens
tcatccttgtctta

SEQ ID NO: 5642023 - DNA, 24 bp, Homo sapiens
tcatcctttaagaaaaacatctgg

SEQ ID NO: 5642024 - DNA, 19 bp, Homo sapiens
tcatccttttctcctatct

SEQ ID NO: 5642025 - DNA, 21 bp, Homo sapiens
tcatcgaaaattcatttcaca

SEQ ID NO: 5642026 - DNA, 19 bp, Homo sapiens
tcatcgaacaaactgatgc

SEQ ID NO: 5642027 - DNA, 23 bp, Homo sapiens
tcatcgaagggattgtgtatctg

SEQ ID NO: 5642028 - DNA, 22 bp, Homo sapiens
tcatcgacttagcctgagtcat

SEQ ID NO: 5642029 - DNA, 14 bp, Homo sapiens
tcatcgccagaggt

SEQ ID NO: 5642030 - DNA, 15 bp, Homo sapiens
tcatcgccagaggtg

SEQ ID NO: 5642031 - DNA, 20 bp, Homo sapiens
tcatcgggattgtctttttt

SEQ ID NO: 5642032 - DNA, 18 bp, Homo sapiens
tcatcgggcccagggaca

SEQ ID NO: 5642033 - DNA, 13 bp, Homo sapiens
tcatcgtctttta

SEQ ID NO: 5642034 - DNA, 14 bp, Homo sapiens
tcatctaaatgaaa

SEQ ID NO: 5642035 - DNA, 17 bp, Homo sapiens
tcatctaataaatcagt

SEQ ID NO: 5642036 - DNA, 22 bp, Homo sapiens
tcatctaatgtattatgagcca

SEQ ID NO: 5642037 - DNA, 19 bp, Homo sapiens
tcatctacaagcatttgcc

SEQ ID NO: 5642038 - DNA, 13 bp, Homo sapiens
tcatctacacata

SEQ ID NO: 5642039 - DNA, 15 bp, Homo sapiens
tcatctacacatata

SEQ ID NO: 5642040 - DNA, 22 bp, Homo sapiens
tcatctacacatataaacacag

SEQ ID NO: 5642041 - DNA, 22 bp, Homo sapiens
tcatctaccattttctggttct

SEQ ID NO: 5642042 - DNA, 14 bp, Homo sapiens
tcatctacctagat

SEQ ID NO: 5642043 - DNA, 13 bp, Homo sapiens
tcatctaggattt

SEQ ID NO: 5642044 - DNA, 14 bp, Homo sapiens
tcatctaggatttt

SEQ ID NO: 5642045 - DNA, 18 bp, Homo sapiens
tcatctaggtaaattaca

SEQ ID NO: 5642046 - DNA, 20 bp, Homo sapiens
tcatctagttaagtcgctga

SEQ ID NO: 5642047 - DNA, 17 bp, Homo sapiens
tcatctataaaatgagg

SEQ ID NO: 5642048 - DNA, 22 bp, Homo sapiens
tcatctatagttgatatgtttt

SEQ ID NO: 5642049 - DNA, 20 bp, Homo sapiens
tcatctatgagggtgtttcc

SEQ ID NO: 5642050 - DNA, 21 bp, Homo sapiens
tcatctatgagggtgtttcct

SEQ ID NO: 5642051 - DNA, 18 bp, Homo sapiens
tcatctatgctctttcct

SEQ ID NO: 5642052 - DNA, 15 bp, Homo sapiens
tcatctattcaagca

SEQ ID NO: 5642053 - DNA, 21 bp, Homo sapiens
tcatctattcaagcacttaca

SEQ ID NO: 5642054 - DNA, 16 bp, Homo sapiens
tcatctatttggaacc

SEQ ID NO: 5642055 - DNA, 18 bp, Homo sapiens
tcatctattttgatgcag

SEQ ID NO: 5642056 - DNA, 23 bp, Homo sapiens
tcatctattttgatgcagcattt

SEQ ID NO: 5642057 - DNA, 16 bp, Homo sapiens
tcatctcaaacactgc

SEQ ID NO: 5642058 - DNA, 17 bp, Homo sapiens
tcatctcaaatccttga

SEQ ID NO: 5642059 - DNA, 20 bp, Homo sapiens
tcatctcagagtccactgtg

SEQ ID NO: 5642060 - DNA, 15 bp, Homo sapiens
tcatctcagcaatca

SEQ ID NO: 5642061 - DNA, 13 bp, Homo sapiens
tcatctcagcttt

SEQ ID NO: 5642062 - DNA, 16 bp, Homo sapiens
tcatctcagtcctcaa

SEQ ID NO: 5642063 - DNA, 20 bp, Homo sapiens
tcatctcattacccttttct

SEQ ID NO: 5642064 - DNA, 23 bp, Homo sapiens
tcatctcattacccttttctggg

SEQ ID NO: 5642065 - DNA, 16 bp, Homo sapiens
tcatctcatttaaggg

SEQ ID NO: 5642066 - DNA, 22 bp, Homo sapiens
tcatctcatttaagggaaaaat

SEQ ID NO: 5642067 - DNA, 20 bp, Homo sapiens
tcatctcatttaatcctccc

SEQ ID NO: 5642068 - DNA, 18 bp, Homo sapiens
tcatctccaaatcttgcc

SEQ ID NO: 5642069 - DNA, 23 bp, Homo sapiens
tcatctccagggagtcccctccc

SEQ ID NO: 5642070 - DNA, 22 bp, Homo sapiens
tcatctccagtatcctgctggt

SEQ ID NO: 5642071 - DNA, 16 bp, Homo sapiens
tcatctccatcagctg

SEQ ID NO: 5642072 - DNA, 17 bp, Homo sapiens
tcatctccatcagctgt

SEQ ID NO: 5642073 - DNA, 12 bp, Homo sapiens
tcatctcccacc

SEQ ID NO: 5642074 - DNA, 17 bp, Homo sapiens
tcatctcccctcctggc

SEQ ID NO: 5642075 - DNA, 13 bp, Homo sapiens
tcatctccctgcc

SEQ ID NO: 5642076 - DNA, 19 bp, Homo sapiens
tcatctccctgccatcccc

SEQ ID NO: 5642077 - DNA, 20 bp, Homo sapiens
tcatctccctgccatccccc

SEQ ID NO: 5642078 - DNA, 18 bp, Homo sapiens
tcatctcctgaccctccc

SEQ ID NO: 5642079 - DNA, 18 bp, Homo sapiens
tcatctcctgccttcctc

SEQ ID NO: 5642080 - DNA, 18 bp, Homo sapiens
tcatctcctttattgcag

SEQ ID NO: 5642081 - DNA, 21 bp, Homo sapiens
tcatctcggctgttcctgaga

SEQ ID NO: 5642082 - DNA, 13 bp, Homo sapiens
tcatctctactaa

SEQ ID NO: 5642083 - DNA, 21 bp, Homo sapiens
tcatctctagggaccagaacc

SEQ ID NO: 5642084 - DNA, 15 bp, Homo sapiens
tcatctctcaaactt

SEQ ID NO: 5642085 - DNA, 11 bp, Homo sapiens
tcatctctcct

SEQ ID NO: 5642086 - DNA, 16 bp, Homo sapiens
tcatctctctacctcc

SEQ ID NO: 5642087 - DNA, 19 bp, Homo sapiens
tcatctctctacctccacc

SEQ ID NO: 5642088 - DNA, 16 bp, Homo sapiens
tcatctctctgcccaa

SEQ ID NO: 5642089 - DNA, 14 bp, Homo sapiens
tcatctctctgggg

SEQ ID NO: 5642090 - DNA, 15 bp, Homo sapiens
tcatctctctggggc

SEQ ID NO: 5642091 - DNA, 14 bp, Homo sapiens
tcatctctgaaaat

SEQ ID NO: 5642092 - DNA, 13 bp, Homo sapiens
tcatctctgctga

SEQ ID NO: 5642093 - DNA, 20 bp, Homo sapiens
tcatctctggaaggggcagc

SEQ ID NO: 5642094 - DNA, 21 bp, Homo sapiens
tcatctcttaaattttgtttt

SEQ ID NO: 5642095 - DNA, 20 bp, Homo sapiens
tcatctcttagctcccctcc

SEQ ID NO: 5642096 - DNA, 13 bp, Homo sapiens
tcatctcttcctc

SEQ ID NO: 5642097 - DNA, 15 bp, Homo sapiens
tcatctctttagaga

SEQ ID NO: 5642098 - DNA, 15 bp, Homo sapiens
tcatctctttgtcct

SEQ ID NO: 5642099 - DNA, 17 bp, Homo sapiens
tcatctctttgtcctga

SEQ ID NO: 5642100 - DNA, 19 bp, Homo sapiens
tcatctctttgtcctgaat

SEQ ID NO: 5642101 - DNA, 14 bp, Homo sapiens
tcatctgaaaagca

SEQ ID NO: 5642102 - DNA, 17 bp, Homo sapiens
tcatctgaaaagcagtt

SEQ ID NO: 5642103 - DNA, 23 bp, Homo sapiens
tcatctgaaaagcagttcatgtc

SEQ ID NO: 5642104 - DNA, 14 bp, Homo sapiens
tcatctgaaatgtt

SEQ ID NO: 5642105 - DNA, 14 bp, Homo sapiens
tcatctgagaatga

SEQ ID NO: 5642106 - DNA, 19 bp, Homo sapiens
tcatctgagaatgaacaaa

SEQ ID NO: 5642107 - DNA, 23 bp, Homo sapiens
tcatctgagagaggctaaaatgt

SEQ ID NO: 5642108 - DNA, 11 bp, Homo sapiens
tcatctgagct

SEQ ID NO: 5642109 - DNA, 21 bp, Homo sapiens
tcatctgagcttttaccacta

SEQ ID NO: 5642110 - DNA, 13 bp, Homo sapiens
tcatctgcaaagg

SEQ ID NO: 5642111 - DNA, 14 bp, Homo sapiens
tcatctgcaaaggg

SEQ ID NO: 5642112 - DNA, 20 bp, Homo sapiens
tcatctgcacccttcttttc

SEQ ID NO: 5642113 - DNA, 18 bp, Homo sapiens
tcatctgccaaaatgtag

SEQ ID NO: 5642114 - DNA, 17 bp, Homo sapiens
tcatctgccagaaaact

SEQ ID NO: 5642115 - DNA, 21 bp, Homo sapiens
tcatctgcccaactgtgtagc

SEQ ID NO: 5642116 - DNA, 12 bp, Homo sapiens
tcatctgcctgc

SEQ ID NO: 5642117 - DNA, 13 bp, Homo sapiens
tcatctgcctgca

SEQ ID NO: 5642118 - DNA, 22 bp, Homo sapiens
tcatctgctcctagcccagcag

SEQ ID NO: 5642119 - DNA, 14 bp, Homo sapiens
tcatctgctctcct

SEQ ID NO: 5642120 - DNA, 15 bp, Homo sapiens
tcatctgctctcctt

SEQ ID NO: 5642121 - DNA, 18 bp, Homo sapiens
tcatctgctctccttcct

SEQ ID NO: 5642122 - DNA, 16 bp, Homo sapiens
tcatctgctgcacata

SEQ ID NO: 5642123 - DNA, 19 bp, Homo sapiens
tcatctgctggtccgtggg

SEQ ID NO: 5642124 - DNA, 18 bp, Homo sapiens
tcatctggaaccatcaga

SEQ ID NO: 5642125 - DNA, 12 bp, Homo sapiens
tcatctggaggc

SEQ ID NO: 5642126 - DNA, 20 bp, Homo sapiens
tcatctggagtccctcctcc

SEQ ID NO: 5642127 - DNA, 20 bp, Homo sapiens
tcatctggagttctcaaaga

SEQ ID NO: 5642128 - DNA, 18 bp, Homo sapiens
tcatctggattctacaaa

SEQ ID NO: 5642129 - DNA, 16 bp, Homo sapiens
tcatctgggaaagaca

SEQ ID NO: 5642130 - DNA, 23 bp, Homo sapiens
tcatctgggaacttgtcacagat

SEQ ID NO: 5642131 - DNA, 15 bp, Homo sapiens
tcatctgggacaaaa

SEQ ID NO: 5642132 - DNA, 12 bp, Homo sapiens
tcatctgggcca

SEQ ID NO: 5642133 - DNA, 21 bp, Homo sapiens
tcatctgggccaccagctcca

SEQ ID NO: 5642134 - DNA, 18 bp, Homo sapiens
tcatctgggctggcagag

SEQ ID NO: 5642135 - DNA, 16 bp, Homo sapiens
tcatctggggacctgg

SEQ ID NO: 5642136 - DNA, 21 bp, Homo sapiens
tcatctggggagcaggcagcc

SEQ ID NO: 5642137 - DNA, 20 bp, Homo sapiens
tcatctgggggagtggaata

SEQ ID NO: 5642138 - DNA, 14 bp, Homo sapiens
tcatctggggtggg

SEQ ID NO: 5642139 - DNA, 20 bp, Homo sapiens
tcatctggggttggcaacag

SEQ ID NO: 5642140 - DNA, 16 bp, Homo sapiens
tcatctgggtggtctg

SEQ ID NO: 5642141 - DNA, 20 bp, Homo sapiens
tcatctggtttttaaaagat

SEQ ID NO: 5642142 - DNA, 15 bp, Homo sapiens
tcatctgtaaaacca

SEQ ID NO: 5642143 - DNA, 14 bp, Homo sapiens
tcatctgtaaaata

SEQ ID NO: 5642144 - DNA, 13 bp, Homo sapiens
tcatctgtaactc

SEQ ID NO: 5642145 - DNA, 22 bp, Homo sapiens
tcatctgtaagagcttgctcca

SEQ ID NO: 5642146 - DNA, 16 bp, Homo sapiens
tcatctgtaagctgtt

SEQ ID NO: 5642147 - DNA, 22 bp, Homo sapiens
tcatgtatgttcagaagaaatt

SEQ ID NO: 5642148 - DNA, 16 bp, Homo sapiens
tcatgtatgtttctct

SEQ ID NO: 5642149 - DNA, 11 bp, Homo sapiens
tcatgtatttc

SEQ ID NO: 5642150 - DNA, 15 bp, Homo sapiens
tcatgtatttcttta

SEQ ID NO: 5642151 - DNA, 15 bp, Homo sapiens
tcatgtatttgagca

SEQ ID NO: 5642152 - DNA, 14 bp, Homo sapiens
tcatgtattttaca

SEQ ID NO: 5642153 - DNA, 23 bp, Homo sapiens
tcatgtcaaatatttagatgtaa

SEQ ID NO: 5642154 - DNA, 17 bp, Homo sapiens
tcatgtcaacttctggc

SEQ ID NO: 5642155 - DNA, 18 bp, Homo sapiens
tcatgtcaacttctggct

SEQ ID NO: 5642156 - DNA, 21 bp, Homo sapiens
tcatgtcaacttctggctcct

SEQ ID NO: 5642157 - DNA, 21 bp, Homo sapiens
tcatgtcagaggtttggagcc

SEQ ID NO: 5642158 - DNA, 16 bp, Homo sapiens
tcatgtcaggcctgtg

SEQ ID NO: 5642159 - DNA, 14 bp, Homo sapiens
tcatgtcattatga

SEQ ID NO: 5642160 - DNA, 15 bp, Homo sapiens
tcatgtcattatgac

SEQ ID NO: 5642161 - DNA, 16 bp, Homo sapiens
tcatgtcattatgaca

SEQ ID NO: 5642162 - DNA, 18 bp, Homo sapiens
tcatgtccagtgagcagt

SEQ ID NO: 5642163 - DNA, 16 bp, Homo sapiens
tcatgtccatcccttt

SEQ ID NO: 5642164 - DNA, 20 bp, Homo sapiens
tcatgtccatcccttttcct

SEQ ID NO: 5642165 - DNA, 20 bp, Homo sapiens
tcatgtccccaaacctgcaa

SEQ ID NO: 5642166 - DNA, 21 bp, Homo sapiens
tcatgtccccaaacctgcaag

SEQ ID NO: 5642167 - DNA, 13 bp, Homo sapiens
tcatgtccccttc

SEQ ID NO: 5642168 - DNA, 23 bp, Homo sapiens
tcatgtccctgtccccaggccca

SEQ ID NO: 5642169 - DNA, 22 bp, Homo sapiens
tcatgtcctctatacctgtgtc

SEQ ID NO: 5642170 - DNA, 13 bp, Homo sapiens
tcatgtcctgctg

SEQ ID NO: 5642171 - DNA, 12 bp, Homo sapiens
tcatgtcctgtc

SEQ ID NO: 5642172 - DNA, 14 bp, Homo sapiens
tcatgtcctgtcct

SEQ ID NO: 5642173 - DNA, 20 bp, Homo sapiens
tcatgtcctgtgtcagttta

SEQ ID NO: 5642174 - DNA, 19 bp, Homo sapiens
tcatgtctattccattccc

SEQ ID NO: 5642175 - DNA, 21 bp, Homo sapiens
tcatgtctattccattccctt

SEQ ID NO: 5642176 - DNA, 13 bp, Homo sapiens
tcatgtctattgt

SEQ ID NO: 5642177 - DNA, 12 bp, Homo sapiens
tcatgtctattt

SEQ ID NO: 5642178 - DNA, 23 bp, Homo sapiens
tcatgtctccccagttccacagc

SEQ ID NO: 5642179 - DNA, 21 bp, Homo sapiens
tcatgtctctacccactatgc

SEQ ID NO: 5642180 - DNA, 14 bp, Homo sapiens
tcatgtctgaaaca

SEQ ID NO: 5642181 - DNA, 19 bp, Homo sapiens
tcatgtctgaaacagagaa

SEQ ID NO: 5642182 - DNA, 20 bp, Homo sapiens
tcatgtctgtatactcctgt

SEQ ID NO: 5642183 - DNA, 18 bp, Homo sapiens
tcatgtctgtatccccag

SEQ ID NO: 5642184 - DNA, 21 bp, Homo sapiens
tcatgtctgtatccccagtgc

SEQ ID NO: 5642185 - DNA, 15 bp, Homo sapiens
tcatgtcttgtcata

SEQ ID NO: 5642186 - DNA, 18 bp, Homo sapiens
tcatgtctttccacttct

SEQ ID NO: 5642187 - DNA, 14 bp, Homo sapiens
tcatgtctttccta

SEQ ID NO: 5642188 - DNA, 13 bp, Homo sapiens
tcatgtcttttta

SEQ ID NO: 5642189 - DNA, 14 bp, Homo sapiens
tcatgtgactcttt

SEQ ID NO: 5642190 - DNA, 17 bp, Homo sapiens
tcatgtgactctttcca

SEQ ID NO: 5642191 - DNA, 15 bp, Homo sapiens
tcatgtgatcctttt

SEQ ID NO: 5642192 - DNA, 14 bp, Homo sapiens
tcatgtgatgtcat

SEQ ID NO: 5642193 - DNA, 20 bp, Homo sapiens
tcatgtgattcactgccttc

SEQ ID NO: 5642194 - DNA, 18 bp, Homo sapiens
tcatgtgcctctgtcctt

SEQ ID NO: 5642195 - DNA, 14 bp, Homo sapiens
tcatgtgcctggaa

SEQ ID NO: 5642196 - DNA, 22 bp, Homo sapiens
tcatgtgctctgttttgacata

SEQ ID NO: 5642197 - DNA, 21 bp, Homo sapiens
tcatgtgctggtaaatgttaa

SEQ ID NO: 5642198 - DNA, 16 bp, Homo sapiens
tcatgtgcttgtgcct

SEQ ID NO: 5642199 - DNA, 13 bp, Homo sapiens
tcatgtgctttgt

SEQ ID NO: 5642200 - DNA, 16 bp, Homo sapiens
tcatgtgctttgtagc

SEQ ID NO: 5642201 - DNA, 17 bp, Homo sapiens
tcatgtgctttgtagct

SEQ ID NO: 5642202 - DNA, 18 bp, Homo sapiens
tcatgtggaatataaaga

SEQ ID NO: 5642203 - DNA, 21 bp, Homo sapiens
tcatgtggaatggattataga

SEQ ID NO: 5642204 - DNA, 21 bp, Homo sapiens
tcatgtggcacttgggcattt

SEQ ID NO: 5642205 - DNA, 13 bp, Homo sapiens
tcatgtggctgga

SEQ ID NO: 5642206 - DNA, 17 bp, Homo sapiens
tcatgtgggtgagccag

SEQ ID NO: 5642207 - DNA, 20 bp, Homo sapiens
tcatgtgggtgagccagtgg

SEQ ID NO: 5642208 - DNA, 19 bp, Homo sapiens
tcatgtggtttctatgcaa

SEQ ID NO: 5642209 - DNA, 12 bp, Homo sapiens
tcatgtgtacag

SEQ ID NO: 5642210 - DNA, 17 bp, Homo sapiens
tcatgtgtacagaaaca

SEQ ID NO: 5642211 - DNA, 18 bp, Homo sapiens
tcatgtgtacctcatatc

SEQ ID NO: 5642212 - DNA, 14 bp, Homo sapiens
tcatgtgtagatat

SEQ ID NO: 5642213 - DNA, 12 bp, Homo sapiens
tcatgtgtagga

SEQ ID NO: 5642214 - DNA, 14 bp, Homo sapiens
tcatgtgtaggaag

SEQ ID NO: 5642215 - DNA, 18 bp, Homo sapiens
tcatgtgtcccagaagat

SEQ ID NO: 5642216 - DNA, 13 bp, Homo sapiens
tcatgtgtgaaca

SEQ ID NO: 5642217 - DNA, 14 bp, Homo sapiens
tcatgtgtgcatgt

SEQ ID NO: 5642218 - DNA, 15 bp, Homo sapiens
tcatgtgtgcatgtg

SEQ ID NO: 5642219 - DNA, 16 bp, Homo sapiens
tcatgtgtgcatgtga

SEQ ID NO: 5642220 - DNA, 14 bp, Homo sapiens
tcatgtgtgctctt

SEQ ID NO: 5642221 - DNA, 11 bp, Homo sapiens
tcatgtgtgta

SEQ ID NO: 5642222 - DNA, 22 bp, Homo sapiens
tcatgtgtgtattttttcatag

SEQ ID NO: 5642223 - DNA, 12 bp, Homo sapiens
tcatgtgtgtta

SEQ ID NO: 5642224 - DNA, 20 bp, Homo sapiens
tcatgtgtttaaattatttt

SEQ ID NO: 5642225 - DNA, 21 bp, Homo sapiens
tcatgttaacctctgctttta

SEQ ID NO: 5642226 - DNA, 22 bp, Homo sapiens
tcatgttacttgagaagtgctt

SEQ ID NO: 5642227 - DNA, 15 bp, Homo sapiens
tcatgttagagttac

SEQ ID NO: 5642228 - DNA, 19 bp, Homo sapiens
tcatgttagtaatacctct

SEQ ID NO: 5642229 - DNA, 15 bp, Homo sapiens
tcatgttagttacct

SEQ ID NO: 5642230 - DNA, 20 bp, Homo sapiens
tcatgttatatttaatgcat

SEQ ID NO: 5642231 - DNA, 15 bp, Homo sapiens
tcatgttatgatttg

SEQ ID NO: 5642232 - DNA, 14 bp, Homo sapiens
tcatgttatgcagt

SEQ ID NO: 5642233 - DNA, 16 bp, Homo sapiens
tcatgttatgcagtga

SEQ ID NO: 5642234 - DNA, 19 bp, Homo sapiens
tcatgttatgcctgttgca

SEQ ID NO: 5642235 - DNA, 12 bp, Homo sapiens
tcatgttatttt

SEQ ID NO: 5642236 - DNA, 14 bp, Homo sapiens
tcatgttattttat

SEQ ID NO: 5642237 - DNA, 13 bp, Homo sapiens
tcatgttcctcaa

SEQ ID NO: 5642238 - DNA, 24 bp, Homo sapiens
tcatgttccttttgaaattgtagt

SEQ ID NO: 5642239 - DNA, 20 bp, Homo sapiens
tcatgttctcttcccaggcc

SEQ ID NO: 5642240 - DNA, 21 bp, Homo sapiens
tcatgttctcttcccaggcct

SEQ ID NO: 5642241 - DNA, 22 bp, Homo sapiens
tcatgttctcttcccaggcctt

SEQ ID NO: 5642242 - DNA, 22 bp, Homo sapiens
tcatgttctgagctataacatt

SEQ ID NO: 5642243 - DNA, 13 bp, Homo sapiens
tcatgttctgtgt

SEQ ID NO: 5642244 - DNA, 14 bp, Homo sapiens
tcatgttctgtgtc

SEQ ID NO: 5642245 - DNA, 16 bp, Homo sapiens
tcatgttctgtgtcac

SEQ ID NO: 5642246 - DNA, 11 bp, Homo sapiens
tcatgttctta

SEQ ID NO: 5642247 - DNA, 17 bp, Homo sapiens
tcatgttcttaattctt

SEQ ID NO: 5642248 - DNA, 13 bp, Homo sapiens
tcatgttgaaaca

SEQ ID NO: 5642249 - DNA, 14 bp, Homo sapiens
tcatgttgaagctt

SEQ ID NO: 5642250 - DNA, 15 bp, Homo sapiens
tcatgttgaagtcaa

SEQ ID NO: 5642251 - DNA, 21 bp, Homo sapiens
tcatgttgatcatgtactttt

SEQ ID NO: 5642252 - DNA, 12 bp, Homo sapiens
tcatgttgatgt

SEQ ID NO: 5642253 - DNA, 22 bp, Homo sapiens
tcatgttgcacacccactcagc

SEQ ID NO: 5642254 - DNA, 13 bp, Homo sapiens
tcatgttggtcaa

SEQ ID NO: 5642255 - DNA, 19 bp, Homo sapiens
tcatgttggtttattttca

SEQ ID NO: 5642256 - DNA, 15 bp, Homo sapiens
tcatgtttaagaaat

SEQ ID NO: 5642257 - DNA, 14 bp, Homo sapiens
tcatgtttcagtga

SEQ ID NO: 5642258 - DNA, 12 bp, Homo sapiens
tcatgtttccct

SEQ ID NO: 5642259 - DNA, 14 bp, Homo sapiens
tcatgtttgcttca

SEQ ID NO: 5642260 - DNA, 13 bp, Homo sapiens
tcatgtttggaaa

SEQ ID NO: 5642261 - DNA, 11 bp, Homo sapiens
tcatgtttggt

SEQ ID NO: 5642262 - DNA, 21 bp, Homo sapiens
tcatgtttggtgcatagaact

SEQ ID NO: 5642263 - DNA, 22 bp, Homo sapiens
tcatgtttggtgcatagaactg

SEQ ID NO: 5642264 - DNA, 18 bp, Homo sapiens
tcatgttttaatgtagaa

SEQ ID NO: 5642265 - DNA, 18 bp, Homo sapiens
tcatgttttagcatttgt

SEQ ID NO: 5642266 - DNA, 20 bp, Homo sapiens
tcatgttttagcatttgtat

SEQ ID NO: 5642267 - DNA, 21 bp, Homo sapiens
tcatgttttagcatttgtata

SEQ ID NO: 5642268 - DNA, 21 bp, Homo sapiens
tcatgttttgatgagaaaaaa

SEQ ID NO: 5642269 - DNA, 14 bp, Homo sapiens
tcatgttttggtga

SEQ ID NO: 5642270 - DNA, 12 bp, Homo sapiens
tcatgtttttga

SEQ ID NO: 5642271 - DNA, 21 bp, Homo sapiens
tcatgtttttgaaacagaacc

SEQ ID NO: 5642272 - DNA, 15 bp, Homo sapiens
tcatgttttttcctt

SEQ ID NO: 5642273 - DNA, 20 bp, Homo sapiens
tcatgttttttctgcaatga

SEQ ID NO: 5642274 - DNA, 18 bp, Homo sapiens
tcattaaaaacatagaaa

SEQ ID NO: 5642275 - DNA, 22 bp, Homo sapiens
tcattaaaaattacctttaatt

SEQ ID NO: 5642276 - DNA, 15 bp, Homo sapiens
tcattaaaacaagag

SEQ ID NO: 5642277 - DNA, 20 bp, Homo sapiens
tcattaaaacaagagaccac

SEQ ID NO: 5642278 - DNA, 19 bp, Homo sapiens
tcattaaaatatatgttct

SEQ ID NO: 5642279 - DNA, 22 bp, Homo sapiens
tcattaaaatatatgttctgca

SEQ ID NO: 5642280 - DNA, 20 bp, Homo sapiens
tcattaaaatggaagtggat

SEQ ID NO: 5642281 - DNA, 13 bp, Homo sapiens
tcattaaacagaa

SEQ ID NO: 5642282 - DNA, 17 bp, Homo sapiens
tcattaaacatgaattt

SEQ ID NO: 5642283 - DNA, 20 bp, Homo sapiens
tcattaaacatgaatttaat

SEQ ID NO: 5642284 - DNA, 21 bp, Homo sapiens
tcattaaacatgaatttaatg

SEQ ID NO: 5642285 - DNA, 13 bp, Homo sapiens
tcattaaactcta

SEQ ID NO: 5642286 - DNA, 15 bp, Homo sapiens
tcattaaactgattc

SEQ ID NO: 5642287 - DNA, 19 bp, Homo sapiens
tcattaaactttttttgtc

SEQ ID NO: 5642288 - DNA, 15 bp, Homo sapiens
tcattaaagacagga

SEQ ID NO: 5642289 - DNA, 18 bp, Homo sapiens
tcattaaaggcttctctc

SEQ ID NO: 5642290 - DNA, 14 bp, Homo sapiens
tcattaaagttcta

SEQ ID NO: 5642291 - DNA, 13 bp, Homo sapiens
tcattaaataaat

SEQ ID NO: 5642292 - DNA, 15 bp, Homo sapiens
tcattaaatggggct

SEQ ID NO: 5642293 - DNA, 18 bp, Homo sapiens
tcattaaatggtgatttc

SEQ ID NO: 5642294 - DNA, 19 bp, Homo sapiens
tcattaaatggtgatttct

SEQ ID NO: 5642295 - DNA, 14 bp, Homo sapiens
tcattaaatgtttg

SEQ ID NO: 5642296 - DNA, 15 bp, Homo sapiens
tcattaaatgtttgt

SEQ ID NO: 5642297 - DNA, 18 bp, Homo sapiens
tcattaacccatctctga

SEQ ID NO: 5642298 - DNA, 13 bp, Homo sapiens
tcattaagaataa

SEQ ID NO: 5642299 - DNA, 13 bp, Homo sapiens
tcattaagaggca

SEQ ID NO: 5642300 - DNA, 22 bp, Homo sapiens
tcattaaggtcattactctcaa

SEQ ID NO: 5642301 - DNA, 15 bp, Homo sapiens
tcattaagtaatctt

SEQ ID NO: 5642302 - DNA, 21 bp, Homo sapiens
tcattaagttgtaaaatgtca

SEQ ID NO: 5642303 - DNA, 14 bp, Homo sapiens
tcattaatactgtg

SEQ ID NO: 5642304 - DNA, 12 bp, Homo sapiens
tcattaatctgt

SEQ ID NO: 5642305 - DNA, 20 bp, Homo sapiens
tcattaatgatgatcttcag

SEQ ID NO: 5642306 - DNA, 14 bp, Homo sapiens
tcattaatgtgttg

SEQ ID NO: 5642307 - DNA, 14 bp, Homo sapiens
tcattaattctata

SEQ ID NO: 5642308 - DNA, 16 bp, Homo sapiens
tcattaatttttaatt

SEQ ID NO: 5642309 - DNA, 14 bp, Homo sapiens
tcattacaaatggt

SEQ ID NO: 5642310 - DNA, 17 bp, Homo sapiens
tcattacaattttctgt

SEQ ID NO: 5642311 - DNA, 13 bp, Homo sapiens
tcattacactaaa

SEQ ID NO: 5642312 - DNA, 17 bp, Homo sapiens
tcattacagatttagtt

SEQ ID NO: 5642313 - DNA, 18 bp, Homo sapiens
tcattacagttctttcct

SEQ ID NO: 5642314 - DNA, 19 bp, Homo sapiens
tcattacagttctttcctc

SEQ ID NO: 5642315 - DNA, 17 bp, Homo sapiens
tcattaccactcgtaaa

SEQ ID NO: 5642316 - DNA, 16 bp, Homo sapiens
tcattacccttttctg

SEQ ID NO: 5642317 - DNA, 20 bp, Homo sapiens
tcattactacactggtgtgt

SEQ ID NO: 5642318 - DNA, 18 bp, Homo sapiens
tcattactgcctttggaa

SEQ ID NO: 5642319 - DNA, 16 bp, Homo sapiens
tcattactgcttcatt

SEQ ID NO: 5642320 - DNA, 22 bp, Homo sapiens
tcattactgcttcatttttgta

SEQ ID NO: 5642321 - DNA, 23 bp, Homo sapiens
tcattactgtgaggagtctgggt

SEQ ID NO: 5642322 - DNA, 19 bp, Homo sapiens
tcattactgtgttcaatta

SEQ ID NO: 5642323 - DNA, 19 bp, Homo sapiens
tcattacttctgagcccca

SEQ ID NO: 5642324 - DNA, 15 bp, Homo sapiens
tcattacttgaatgt

SEQ ID NO: 5642325 - DNA, 13 bp, Homo sapiens
tcattacttgatt

SEQ ID NO: 5642326 - DNA, 15 bp, Homo sapiens
tcattacttgattaa

SEQ ID NO: 5642327 - DNA, 19 bp, Homo sapiens
tcatttttaacagcatgct

SEQ ID NO: 5642328 - DNA, 23 bp, Homo sapiens
tcatttttaagactgtaatgtgt

SEQ ID NO: 5642329 - DNA, 18 bp, Homo sapiens
tcatttttaatcatgaaa

SEQ ID NO: 5642330 - DNA, 14 bp, Homo sapiens
tcatttttaatgta

SEQ ID NO: 5642331 - DNA, 20 bp, Homo sapiens
tcatttttacaatgtaatta

SEQ ID NO: 5642332 - DNA, 21 bp, Homo sapiens
tcatttttacaatgtaattat

SEQ ID NO: 5642333 - DNA, 15 bp, Homo sapiens
tcatttttacactat

SEQ ID NO: 5642334 - DNA, 19 bp, Homo sapiens
tcatttttagtagagacag

SEQ ID NO: 5642335 - DNA, 14 bp, Homo sapiens
tcatttttatagca

SEQ ID NO: 5642336 - DNA, 21 bp, Homo sapiens
tcatttttatagcaacaacaa

SEQ ID NO: 5642337 - DNA, 23 bp, Homo sapiens
tcatttttattaaacagtgaact

SEQ ID NO: 5642338 - DNA, 12 bp, Homo sapiens
tcatttttcaaa

SEQ ID NO: 5642339 - DNA, 14 bp, Homo sapiens
tcatttttcactgt

SEQ ID NO: 5642340 - DNA, 15 bp, Homo sapiens
tcatttttcattaga

SEQ ID NO: 5642341 - DNA, 16 bp, Homo sapiens
tcatttttccaggact

SEQ ID NO: 5642342 - DNA, 18 bp, Homo sapiens
tcatttttctctccctct

SEQ ID NO: 5642343 - DNA, 15 bp, Homo sapiens
tcatttttctgttag

SEQ ID NO: 5642344 - DNA, 21 bp, Homo sapiens
tcatttttgaaactgcatttg

SEQ ID NO: 5642345 - DNA, 14 bp, Homo sapiens
tcatttttgaatac

SEQ ID NO: 5642346 - DNA, 16 bp, Homo sapiens
tcatttttgagcaact

SEQ ID NO: 5642347 - DNA, 18 bp, Homo sapiens
tcatttttgtaataacat

SEQ ID NO: 5642348 - DNA, 21 bp, Homo sapiens
tcatttttgtacagtttgctg

SEQ ID NO: 5642349 - DNA, 22 bp, Homo sapiens
tcatttttgtacagtttgctgt

SEQ ID NO: 5642350 - DNA, 12 bp, Homo sapiens
tcatttttgtag

SEQ ID NO: 5642351 - DNA, 17 bp, Homo sapiens
tcatttttgtataaaaa

SEQ ID NO: 5642352 - DNA, 19 bp, Homo sapiens
tcatttttgtataaaaagg

SEQ ID NO: 5642353 - DNA, 22 bp, Homo sapiens
tcatttttgtgagcctctttgt

SEQ ID NO: 5642354 - DNA, 14 bp, Homo sapiens
tcatttttgtgcac

SEQ ID NO: 5642355 - DNA, 15 bp, Homo sapiens
tcatttttgtgcaca

SEQ ID NO: 5642356 - DNA, 23 bp, Homo sapiens
tcatttttgtttttggtttctta

SEQ ID NO: 5642357 - DNA, 20 bp, Homo sapiens
tcattttttaatgtgctctg

SEQ ID NO: 5642358 - DNA, 16 bp, Homo sapiens
tcattttttacttgaa

SEQ ID NO: 5642359 - DNA, 21 bp, Homo sapiens
tcattttttatatatatgcat

SEQ ID NO: 5642360 - DNA, 16 bp, Homo sapiens
tcattttttgtttctt

SEQ ID NO: 5642361 - DNA, 16 bp, Homo sapiens
tcatttttttccaggc

SEQ ID NO: 5642362 - DNA, 22 bp, Homo sapiens
tcatttttttctctctggagcc

SEQ ID NO: 5642363 - DNA, 17 bp, Homo sapiens
tcattttttttaattga

SEQ ID NO: 5642364 - DNA, 17 bp, Homo sapiens
tcatttttttttcaatc

SEQ ID NO: 5642365 - DNA, 18 bp, Homo sapiens
tccaaaaaaaaaaaaaat

SEQ ID NO: 5642366 - DNA, 22 bp, Homo sapiens
tccaaaaaaaaaaaaaatacaa

SEQ ID NO: 5642367 - DNA, 13 bp, Homo sapiens
tccaaaaaaagga

SEQ ID NO: 5642368 - DNA, 17 bp, Homo sapiens
tccaaaaaaaggaaaaa

SEQ ID NO: 5642369 - DNA, 21 bp, Homo sapiens
tccaaaaaaagggaaggattt

SEQ ID NO: 5642370 - DNA, 15 bp, Homo sapiens
tccaaaaagaacaat

SEQ ID NO: 5642371 - DNA, 22 bp, Homo sapiens
tccaaaaagatttattaattaa

SEQ ID NO: 5642372 - DNA, 19 bp, Homo sapiens
tccaaaaagctcctggggc

SEQ ID NO: 5642373 - DNA, 22 bp, Homo sapiens
tccaaaaagctctgaaaacaag

SEQ ID NO: 5642374 - DNA, 15 bp, Homo sapiens
tccaaaaatctgcct

SEQ ID NO: 5642375 - DNA, 18 bp, Homo sapiens
tccaaaaatctgcctggg

SEQ ID NO: 5642376 - DNA, 17 bp, Homo sapiens
tccaaaaatgtgtaaga

SEQ ID NO: 5642377 - DNA, 22 bp, Homo sapiens
tccaaaaattattataagcatt

SEQ ID NO: 5642378 - DNA, 18 bp, Homo sapiens
tccaaaacaaacatgcag

SEQ ID NO: 5642379 - DNA, 22 bp, Homo sapiens
tccaaaacatttctggacagta

SEQ ID NO: 5642380 - DNA, 20 bp, Homo sapiens
tccaaaaccgccagctctgt

SEQ ID NO: 5642381 - DNA, 22 bp, Homo sapiens
tccaaaaccgccagctctgttc

SEQ ID NO: 5642382 - DNA, 21 bp, Homo sapiens
tccaaaacctgcttccttcag

SEQ ID NO: 5642383 - DNA, 20 bp, Homo sapiens
tccaaaactgtattgaaaaa

SEQ ID NO: 5642384 - DNA, 22 bp, Homo sapiens
tccaaaacttagacccatgctg

SEQ ID NO: 5642385 - DNA, 15 bp, Homo sapiens
tccaaaacttctctt

SEQ ID NO: 5642386 - DNA, 23 bp, Homo sapiens
tccaaaacttctcttgaaaagtt

SEQ ID NO: 5642387 - DNA, 14 bp, Homo sapiens
tccaaaagaaaaac

SEQ ID NO: 5642388 - DNA, 14 bp, Homo sapiens
tccaaaagaagccc

SEQ ID NO: 5642389 - DNA, 13 bp, Homo sapiens
tccaaaagacaaa

SEQ ID NO: 5642390 - DNA, 22 bp, Homo sapiens
tccaaaagattgctgaaatttt

SEQ ID NO: 5642391 - DNA, 13 bp, Homo sapiens
tccaaaagcagga

SEQ ID NO: 5642392 - DNA, 16 bp, Homo sapiens
tccaaaagctttttat

SEQ ID NO: 5642393 - DNA, 16 bp, Homo sapiens
tccaaaagtaaagatg

SEQ ID NO: 5642394 - DNA, 16 bp, Homo sapiens
tccaaaagtactagca

SEQ ID NO: 5642395 - DNA, 14 bp, Homo sapiens
tccaaaagtgacca

SEQ ID NO: 5642396 - DNA, 17 bp, Homo sapiens
tccaaaagtgaccagca

SEQ ID NO: 5642397 - DNA, 20 bp, Homo sapiens
tccaaaagtgaccagcatac

SEQ ID NO: 5642398 - DNA, 20 bp, Homo sapiens
tccaaaataaaacctcagct

SEQ ID NO: 5642399 - DNA, 16 bp, Homo sapiens
tccaaaataaaacttt

SEQ ID NO: 5642400 - DNA, 18 bp, Homo sapiens
tccaaaataaaacttttt

SEQ ID NO: 5642401 - DNA, 12 bp, Homo sapiens
tccaaaataaat

SEQ ID NO: 5642402 - DNA, 13 bp, Homo sapiens
tccaaaataataa

SEQ ID NO: 5642403 - DNA, 20 bp, Homo sapiens
tccaaaataatctatattaa

SEQ ID NO: 5642404 - DNA, 22 bp, Homo sapiens
tccaaaataatctatattaaat

SEQ ID NO: 5642405 - DNA, 10 bp, Homo sapiens
tccaaaatgt

SEQ ID NO: 5642406 - DNA, 15 bp, Homo sapiens
tccaaaatgtgccta

SEQ ID NO: 5642407 - DNA, 19 bp, Homo sapiens
tccaaaatttttcaacccc

SEQ ID NO: 5642408 - DNA, 22 bp, Homo sapiens
tccaaacaaaagcacttacttt

SEQ ID NO: 5642409 - DNA, 19 bp, Homo sapiens
tccaaacaccggcagaaaa

SEQ ID NO: 5642410 - DNA, 14 bp, Homo sapiens
tccaaacaggctca

SEQ ID NO: 5642411 - DNA, 18 bp, Homo sapiens
tccaaacaggtgctggcc

SEQ ID NO: 5642412 - DNA, 19 bp, Homo sapiens
tccaaacaggtgctggccc

SEQ ID NO: 5642413 - DNA, 14 bp, Homo sapiens
tccaaacagtgtgt

SEQ ID NO: 5642414 - DNA, 19 bp, Homo sapiens
tccaaacagtgtgttggtg

SEQ ID NO: 5642415 - DNA, 19 bp, Homo sapiens
tccaaacatgtatttatgt

SEQ ID NO: 5642416 - DNA, 16 bp, Homo sapiens
tccaaaccaaataaaa

SEQ ID NO: 5642417 - DNA, 14 bp, Homo sapiens
tccaaaccaaattt

SEQ ID NO: 5642418 - DNA, 21 bp, Homo sapiens
tccaaaccagtttattctgtg

SEQ ID NO: 5642419 - DNA, 22 bp, Homo sapiens
tccaaaccagtttattctgtgg

SEQ ID NO: 5642420 - DNA, 16 bp, Homo sapiens
tccaaacccttcaact

SEQ ID NO: 5642421 - DNA, 13 bp, Homo sapiens
tccaaacctacct

SEQ ID NO: 5642422 - DNA, 24 bp, Homo sapiens
tccaaacctaccttatagagcaca

SEQ ID NO: 5642423 - DNA, 20 bp, Homo sapiens
tccaaacctccagcctccct

SEQ ID NO: 5642424 - DNA, 21 bp, Homo sapiens
tccaaacctccagcctccctg

SEQ ID NO: 5642425 - DNA, 21 bp, Homo sapiens
tccaaacctcctgttagctgt

SEQ ID NO: 5642426 - DNA, 14 bp, Homo sapiens
tccaaacctggttc

SEQ ID NO: 5642427 - DNA, 14 bp, Homo sapiens
tccaaaccttcaca

SEQ ID NO: 5642428 - DNA, 18 bp, Homo sapiens
tccaaaccttcacacaca

SEQ ID NO: 5642429 - DNA, 23 bp, Homo sapiens
tccaaaccttcacacacagactg

SEQ ID NO: 5642430 - DNA, 12 bp, Homo sapiens
tccaaactaatt

SEQ ID NO: 5642431 - DNA, 16 bp, Homo sapiens
tccaaactaattttta

SEQ ID NO: 5642432 - DNA, 14 bp, Homo sapiens
tccaaactcctgcc

SEQ ID NO: 5642433 - DNA, 15 bp, Homo sapiens
tccaaactcctgcct

SEQ ID NO: 5642434 - DNA, 16 bp, Homo sapiens
tccaaactcctgcctg

SEQ ID NO: 5642435 - DNA, 22 bp, Homo sapiens
tccaaactcgcttaggtagaaa

SEQ ID NO: 5642436 - DNA, 12 bp, Homo sapiens
tccaaactgctg

SEQ ID NO: 5642437 - DNA, 13 bp, Homo sapiens
tccaaactgctgt

SEQ ID NO: 5642438 - DNA, 17 bp, Homo sapiens
tccaaactgctgtctct

SEQ ID NO: 5642439 - DNA, 18 bp, Homo sapiens
tccaaactgctgtctctt

SEQ ID NO: 5642440 - DNA, 15 bp, Homo sapiens
tccaaacttctaaat

SEQ ID NO: 5642441 - DNA, 12 bp, Homo sapiens
tccaaagaaatg

SEQ ID NO: 5642442 - DNA, 21 bp, Homo sapiens
tccaaagaacttgatttgcat

SEQ ID NO: 5642443 - DNA, 12 bp, Homo sapiens
tccaaagaagat

SEQ ID NO: 5642444 - DNA, 14 bp, Homo sapiens
tccaaagaagatag

SEQ ID NO: 5642445 - DNA, 23 bp, Homo sapiens
tccaaagaatgttagagcacagt

SEQ ID NO: 5642446 - DNA, 13 bp, Homo sapiens
tccaaagactgta

SEQ ID NO: 5642447 - DNA, 15 bp, Homo sapiens
tccaaagactgtact

SEQ ID NO: 5642448 - DNA, 16 bp, Homo sapiens
tccaaagactgtactg

SEQ ID NO: 5642449 - DNA, 18 bp, Homo sapiens
tccaaagactgtactggc

SEQ ID NO: 5642450 - DNA, 12 bp, Homo sapiens
tccaaagagaaa

SEQ ID NO: 5642451 - DNA, 13 bp, Homo sapiens
tccaaagagaaac

SEQ ID NO: 5642452 - DNA, 22 bp, Homo sapiens
tccaaagagagttaaaagcagc

SEQ ID NO: 5642453 - DNA, 18 bp, Homo sapiens
tccaaagaggctgcccct

SEQ ID NO: 5642454 - DNA, 22 bp, Homo sapiens
tccaaagagtagaattgcattg

SEQ ID NO: 5642455 - DNA, 23 bp, Homo sapiens
tccaaagagtagaattgcattga

SEQ ID NO: 5642456 - DNA, 15 bp, Homo sapiens
tccaaagatctgaat

SEQ ID NO: 5642457 - DNA, 19 bp, Homo sapiens
tccaaagcaaaaccagaac

SEQ ID NO: 5642458 - DNA, 15 bp, Homo sapiens
tccaaagcagagagc

SEQ ID NO: 5642459 - DNA, 13 bp, Homo sapiens
tccaaagccagtg

SEQ ID NO: 5642460 - DNA, 15 bp, Homo sapiens
tccaaagccagtgaa

SEQ ID NO: 5642461 - DNA, 20 bp, Homo sapiens
tccaaagcctgcgttctcat

SEQ ID NO: 5642462 - DNA, 17 bp, Homo sapiens
tccaaagcctgggcaga

SEQ ID NO: 5642463 - DNA, 16 bp, Homo sapiens
tccaaagctgaagatc

SEQ ID NO: 5642464 - DNA, 15 bp, Homo sapiens
tccaaagcttcccct

SEQ ID NO: 5642465 - DNA, 16 bp, Homo sapiens
tccaaagcttcgtctt

SEQ ID NO: 5642466 - DNA, 15 bp, Homo sapiens
tccaaagctttcctg

SEQ ID NO: 5642467 - DNA, 17 bp, Homo sapiens
tccaaaggcagcgtgcc

SEQ ID NO: 5642468 - DNA, 21 bp, Homo sapiens
tccaaaggccatggagagctg

SEQ ID NO: 5642469 - DNA, 19 bp, Homo sapiens
tccaaaggctcctgagaca

SEQ ID NO: 5642470 - DNA, 18 bp, Homo sapiens
tccaaagggaatactcac

SEQ ID NO: 5642471 - DNA, 18 bp, Homo sapiens
tccaaaggggctgctggg

SEQ ID NO: 5642472 - DNA, 19 bp, Homo sapiens
tccaaaggggctgctgggg

SEQ ID NO: 5642473 - DNA, 16 bp, Homo sapiens
tccaaaggttgtacat

SEQ ID NO: 5642474 - DNA, 21 bp, Homo sapiens
tccaaaggttgtacatagtgg

SEQ ID NO: 5642475 - DNA, 19 bp, Homo sapiens
tccaaagtcagatctggtc

SEQ ID NO: 5642476 - DNA, 17 bp, Homo sapiens
tccaaagtcataattgc

SEQ ID NO: 5642477 - DNA, 18 bp, Homo sapiens
tccaaagtctctaattct

SEQ ID NO: 5642478 - DNA, 18 bp, Homo sapiens
tccaaagtggagctggga

SEQ ID NO: 5642479 - DNA, 16 bp, Homo sapiens
tccaaagttatttcat

SEQ ID NO: 5642480 - DNA, 22 bp, Homo sapiens
tccaaagttcttatctctagct

SEQ ID NO: 5642481 - DNA, 18 bp, Homo sapiens
tccaaataaaaataacat

SEQ ID NO: 5642482 - DNA, 16 bp, Homo sapiens
tccaaataaaaattag

SEQ ID NO: 5642483 - DNA, 21 bp, Homo sapiens
tccaaataaaacttgagccca

SEQ ID NO: 5642484 - DNA, 22 bp, Homo sapiens
tccaaataaacattttttaaga

SEQ ID NO: 5642485 - DNA, 14 bp, Homo sapiens
tccaaataataaag

SEQ ID NO: 5642486 - DNA, 16 bp, Homo sapiens
tccaaataataaagtc

SEQ ID NO: 5642487 - DNA, 12 bp, Homo sapiens
tccaaataatga

SEQ ID NO: 5642488 - DNA, 18 bp, Homo sapiens
tccaaatacccaaatgtc

SEQ ID NO: 5642489 - DNA, 17 bp, Homo sapiens
tccaaatactaatgaaa

SEQ ID NO: 5642490 - DNA, 14 bp, Homo sapiens
tccaaatattctaa

SEQ ID NO: 5642491 - DNA, 15 bp, Homo sapiens
tccaaatcctggaag

SEQ ID NO: 5642492 - DNA, 20 bp, Homo sapiens
tccaaatctcttgcttgtca

SEQ ID NO: 5642493 - DNA, 22 bp, Homo sapiens
tccaaatctcttgcttgtcatt

SEQ ID NO: 5642494 - DNA, 18 bp, Homo sapiens
tccaaatcttgaatttct

SEQ ID NO: 5642495 - DNA, 20 bp, Homo sapiens
tccaaatgaatgttgtctgt

SEQ ID NO: 5642496 - DNA, 16 bp, Homo sapiens
tccaaatgcattcatg

SEQ ID NO: 5642497 - DNA, 18 bp, Homo sapiens
tccaaatgcattcatgtt

SEQ ID NO: 5642498 - DNA, 16 bp, Homo sapiens
tccaaatgcccaagga

SEQ ID NO: 5642499 - DNA, 20 bp, Homo sapiens
tccaaatggcgtctggaagt

SEQ ID NO: 5642500 - DNA, 16 bp, Homo sapiens
tccaaatgtccctcca

SEQ ID NO: 5642501 - DNA, 17 bp, Homo sapiens
tccaaatgtcctccaga

SEQ ID NO: 5642502 - DNA, 20 bp, Homo sapiens
tccaaatgtcctccagaagc

SEQ ID NO: 5642503 - DNA, 17 bp, Homo sapiens
tccaaatgtctactgaa

SEQ ID NO: 5642504 - DNA, 13 bp, Homo sapiens
tccacatgtacat

SEQ ID NO: 5642505 - DNA, 14 bp, Homo sapiens
tccacatgtacata

SEQ ID NO: 5642506 - DNA, 19 bp, Homo sapiens
tccacattcatgtacaatg

SEQ ID NO: 5642507 - DNA, 15 bp, Homo sapiens
tccacattctacttc

SEQ ID NO: 5642508 - DNA, 19 bp, Homo sapiens
tccacattctacttcagct

SEQ ID NO: 5642509 - DNA, 14 bp, Homo sapiens
tccacattctgctg

SEQ ID NO: 5642510 - DNA, 15 bp, Homo sapiens
tccacattcttcagt

SEQ ID NO: 5642511 - DNA, 14 bp, Homo sapiens
tccacattgtttta

SEQ ID NO: 5642512 - DNA, 13 bp, Homo sapiens
tccacatttctaa

SEQ ID NO: 5642513 - DNA, 14 bp, Homo sapiens
tccacatttctaaa

SEQ ID NO: 5642514 - DNA, 16 bp, Homo sapiens
tccacatttctaaaat

SEQ ID NO: 5642515 - DNA, 21 bp, Homo sapiens
tccacatttgttttgccaatt

SEQ ID NO: 5642516 - DNA, 22 bp, Homo sapiens
tccacatttttgcacagattat

SEQ ID NO: 5642517 - DNA, 16 bp, Homo sapiens
tccaccaaactcctgc

SEQ ID NO: 5642518 - DNA, 22 bp, Homo sapiens
tccaccaatatcatgtgtagat

SEQ ID NO: 5642519 - DNA, 18 bp, Homo sapiens
tccaccacaagagctcct

SEQ ID NO: 5642520 - DNA, 21 bp, Homo sapiens
tccaccacaagagctccttga

SEQ ID NO: 5642521 - DNA, 15 bp, Homo sapiens
tccaccacatctgcc

SEQ ID NO: 5642522 - DNA, 21 bp, Homo sapiens
tccaccacatctgccagacct

SEQ ID NO: 5642523 - DNA, 22 bp, Homo sapiens
tccaccaccactggccaccagg

SEQ ID NO: 5642524 - DNA, 13 bp, Homo sapiens
tccaccacccaaa

SEQ ID NO: 5642525 - DNA, 24 bp, Homo sapiens
tccaccacccaacccaaaccatga

SEQ ID NO: 5642526 - DNA, 15 bp, Homo sapiens
tccaccaccccaccc

SEQ ID NO: 5642527 - DNA, 23 bp, Homo sapiens
tccaccaccccacccacctttgc

SEQ ID NO: 5642528 - DNA, 14 bp, Homo sapiens
tccaccacctccct

SEQ ID NO: 5642529 - DNA, 13 bp, Homo sapiens
tccaccactgtgc

SEQ ID NO: 5642530 - DNA, 13 bp, Homo sapiens
tccaccagaccca

SEQ ID NO: 5642531 - DNA, 13 bp, Homo sapiens
tccaccagagcag

SEQ ID NO: 5642532 - DNA, 15 bp, Homo sapiens
tccaccagagcaggg

SEQ ID NO: 5642533 - DNA, 13 bp, Homo sapiens
tccaccagcagca

SEQ ID NO: 5642534 - DNA, 14 bp, Homo sapiens
tccaccagcagcat

SEQ ID NO: 5642535 - DNA, 15 bp, Homo sapiens
tccaccagcagcatg

SEQ ID NO: 5642536 - DNA, 19 bp, Homo sapiens
tccaccagcatcacctgcc

SEQ ID NO: 5642537 - DNA, 16 bp, Homo sapiens
tccaccagccctactc

SEQ ID NO: 5642538 - DNA, 21 bp, Homo sapiens
tccaccaggaacctcttcaga

SEQ ID NO: 5642539 - DNA, 17 bp, Homo sapiens
tccaccaggccgtgcct

SEQ ID NO: 5642540 - DNA, 19 bp, Homo sapiens
tccaccaggccgtgccttg

SEQ ID NO: 5642541 - DNA, 15 bp, Homo sapiens
tccaccagggccaga

SEQ ID NO: 5642542 - DNA, 17 bp, Homo sapiens
tccaccagggccagagc

SEQ ID NO: 5642543 - DNA, 18 bp, Homo sapiens
tccaccagtcatttttca

SEQ ID NO: 5642544 - DNA, 17 bp, Homo sapiens
tccaccagtgtgtgggg

SEQ ID NO: 5642545 - DNA, 19 bp, Homo sapiens
tccaccagtttatacagaa

SEQ ID NO: 5642546 - DNA, 16 bp, Homo sapiens
tccaccataccttaga

SEQ ID NO: 5642547 - DNA, 17 bp, Homo sapiens
tccaccatcaaatgctg

SEQ ID NO: 5642548 - DNA, 16 bp, Homo sapiens
tccaccatccccagct

SEQ ID NO: 5642549 - DNA, 16 bp, Homo sapiens
tccaccatccccgcac

SEQ ID NO: 5642550 - DNA, 19 bp, Homo sapiens
tccaccatgctctctcacc

SEQ ID NO: 5642551 - DNA, 19 bp, Homo sapiens
tccacccaaaccccttccc

SEQ ID NO: 5642552 - DNA, 18 bp, Homo sapiens
tccacccacaaactccag

SEQ ID NO: 5642553 - DNA, 19 bp, Homo sapiens
tccacccacaaactccagg

SEQ ID NO: 5642554 - DNA, 12 bp, Homo sapiens
tccacccacagt

SEQ ID NO: 5642555 - DNA, 17 bp, Homo sapiens
tccacccaccagtcagg

SEQ ID NO: 5642556 - DNA, 13 bp, Homo sapiens
tccacccaccccc

SEQ ID NO: 5642557 - DNA, 18 bp, Homo sapiens
tccacccacctcagcctc

SEQ ID NO: 5642558 - DNA, 23 bp, Homo sapiens
tccacccacctcagcctcccaaa

SEQ ID NO: 5642559 - DNA, 13 bp, Homo sapiens
tccacccacgagc

SEQ ID NO: 5642560 - DNA, 17 bp, Homo sapiens
tccacccacgtggagac

SEQ ID NO: 5642561 - DNA, 12 bp, Homo sapiens
tccacccactgt

SEQ ID NO: 5642562 - DNA, 15 bp, Homo sapiens
tccacccagaccctc

SEQ ID NO: 5642563 - DNA, 17 bp, Homo sapiens
tccacccagaccctcct

SEQ ID NO: 5642564 - DNA, 18 bp, Homo sapiens
tccacccagaggtctccc

SEQ ID NO: 5642565 - DNA, 14 bp, Homo sapiens
tccacccagcaggc

SEQ ID NO: 5642566 - DNA, 20 bp, Homo sapiens
tccacccagcaggcagagtg

SEQ ID NO: 5642567 - DNA, 15 bp, Homo sapiens
tccacccagcccatt

SEQ ID NO: 5642568 - DNA, 17 bp, Homo sapiens
tccacccagcccattct

SEQ ID NO: 5642569 - DNA, 15 bp, Homo sapiens
tccacccaggagccc

SEQ ID NO: 5642570 - DNA, 17 bp, Homo sapiens
tccacccaggagccccg

SEQ ID NO: 5642571 - DNA, 16 bp, Homo sapiens
tccacccaggctgcac

SEQ ID NO: 5642572 - DNA, 19 bp, Homo sapiens
tccacccaggctgcactgc

SEQ ID NO: 5642573 - DNA, 12 bp, Homo sapiens
tccacccagtgc

SEQ ID NO: 5642574 - DNA, 21 bp, Homo sapiens
tccacccagtgctgccatgcc

SEQ ID NO: 5642575 - DNA, 20 bp, Homo sapiens
tccacccataatcctttctg

SEQ ID NO: 5642576 - DNA, 13 bp, Homo sapiens
tccacccattccc

SEQ ID NO: 5642577 - DNA, 24 bp, Homo sapiens
tccacccattcccccatgtggctg

SEQ ID NO: 5642578 - DNA, 22 bp, Homo sapiens
tccaccccagccccactgccct

SEQ ID NO: 5642579 - DNA, 13 bp, Homo sapiens
tccaccccaggac

SEQ ID NO: 5642580 - DNA, 15 bp, Homo sapiens
tccaccccagggtca

SEQ ID NO: 5642581 - DNA, 20 bp, Homo sapiens
tccaccccatccctccccag

SEQ ID NO: 5642582 - DNA, 22 bp, Homo sapiens
tccaccccatccctccccagtt

SEQ ID NO: 5642583 - DNA, 17 bp, Homo sapiens
tccacccccaccactct

SEQ ID NO: 5642584 - DNA, 23 bp, Homo sapiens
tccacccccattgtgaatgttgt

SEQ ID NO: 5642585 - DNA, 21 bp, Homo sapiens
tccaccccccacacacactat

SEQ ID NO: 5642586 - DNA, 17 bp, Homo sapiens
tccaccccccactcagt

SEQ ID NO: 5642587 - DNA, 23 bp, Homo sapiens
tccacccccgccacggccaccct

SEQ ID NO: 5642588 - DNA, 18 bp, Homo sapiens
tccacccccgcctccctc

SEQ ID NO: 5642589 - DNA, 23 bp, Homo sapiens
tccacccccgcctccctcccctg

SEQ ID NO: 5642590 - DNA, 12 bp, Homo sapiens
tccaccccctcc

SEQ ID NO: 5642591 - DNA, 18 bp, Homo sapiens
tccaccccctccagctcc

SEQ ID NO: 5642592 - DNA, 20 bp, Homo sapiens
tccaccccctccagctccag

SEQ ID NO: 5642593 - DNA, 18 bp, Homo sapiens
tccaccccctccctggcc

SEQ ID NO: 5642594 - DNA, 14 bp, Homo sapiens
tccaccccctgccc

SEQ ID NO: 5642595 - DNA, 12 bp, Homo sapiens
tccacccctaca

SEQ ID NO: 5642596 - DNA, 14 bp, Homo sapiens
tccacccctacaca

SEQ ID NO: 5642597 - DNA, 12 bp, Homo sapiens
tccacccctacc

SEQ ID NO: 5642598 - DNA, 19 bp, Homo sapiens
tccacccgccttcagcctc

SEQ ID NO: 5642599 - DNA, 17 bp, Homo sapiens
tccacccgctgcccctc

SEQ ID NO: 5642600 - DNA, 19 bp, Homo sapiens
tccacccgctgcccctccc

SEQ ID NO: 5642601 - DNA, 21 bp, Homo sapiens
tccacccgctgcccctccccg

SEQ ID NO: 5642602 - DNA, 16 bp, Homo sapiens
tccacccgtcctccct

SEQ ID NO: 5642603 - DNA, 18 bp, Homo sapiens
tccacccgtcctccctca

SEQ ID NO: 5642604 - DNA, 20 bp, Homo sapiens
tccacccgtcctccctcagc

SEQ ID NO: 5642605 - DNA, 16 bp, Homo sapiens
tccacccgtttccaag

SEQ ID NO: 5642606 - DNA, 22 bp, Homo sapiens
tccaccctcatttctgccagcg

SEQ ID NO: 5642607 - DNA, 16 bp, Homo sapiens
tccaccctcccagacc

SEQ ID NO: 5642608 - DNA, 15 bp, Homo sapiens
tccaccctcctctag

SEQ ID NO: 5642609 - DNA, 15 bp, Homo sapiens
tccaccctgagcctg

SEQ ID NO: 5642610 - DNA, 16 bp, Homo sapiens
tccaccctgagcctga

SEQ ID NO: 5642611 - DNA, 13 bp, Homo sapiens
tccaccctgagct

SEQ ID NO: 5642612 - DNA, 19 bp, Homo sapiens
tccaccctgagctcgggga

SEQ ID NO: 5642613 - DNA, 12 bp, Homo sapiens
tccaccctgcat

SEQ ID NO: 5642614 - DNA, 21 bp, Homo sapiens
tccaccctgcattttcctctt

SEQ ID NO: 5642615 - DNA, 14 bp, Homo sapiens
tccaccctgccctg

SEQ ID NO: 5642616 - DNA, 15 bp, Homo sapiens
tccaccctgccctgg

SEQ ID NO: 5642617 - DNA, 19 bp, Homo sapiens
tccaccctgccctggccta

SEQ ID NO: 5642618 - DNA, 13 bp, Homo sapiens
tccaccctgctct

SEQ ID NO: 5642619 - DNA, 14 bp, Homo sapiens
tccaccctgctctc

SEQ ID NO: 5642620 - DNA, 12 bp, Homo sapiens
tccaccctggaa

SEQ ID NO: 5642621 - DNA, 15 bp, Homo sapiens
tccaccctggctggg

SEQ ID NO: 5642622 - DNA, 17 bp, Homo sapiens
tccaccctgtcccccag

SEQ ID NO: 5642623 - DNA, 21 bp, Homo sapiens
tccaccctgtcccccagctct

SEQ ID NO: 5642624 - DNA, 12 bp, Homo sapiens
tccacccttcca

SEQ ID NO: 5642625 - DNA, 13 bp, Homo sapiens
tccacccttccat

SEQ ID NO: 5642626 - DNA, 17 bp, Homo sapiens
tccacccttccatcagc

SEQ ID NO: 5642627 - DNA, 13 bp, Homo sapiens
tccacccttggcc

SEQ ID NO: 5642628 - DNA, 16 bp, Homo sapiens
tccacccttggcctgt

SEQ ID NO: 5642629 - DNA, 20 bp, Homo sapiens
tccaccctttggagaccagg

SEQ ID NO: 5642630 - DNA, 18 bp, Homo sapiens
tccaccgaccaactgccc

SEQ ID NO: 5642631 - DNA, 16 bp, Homo sapiens
tccaccgcagaaggaa

SEQ ID NO: 5642632 - DNA, 17 bp, Homo sapiens
tccaccgcagaaggaag

SEQ ID NO: 5642633 - DNA, 18 bp, Homo sapiens
tccaccgcagaaggaagg

SEQ ID NO: 5642634 - DNA, 15 bp, Homo sapiens
tccaccgccacccca

SEQ ID NO: 5642635 - DNA, 13 bp, Homo sapiens
tccaccgctgcct

SEQ ID NO: 5642636 - DNA, 19 bp, Homo sapiens
tccaccgctgcctaagtgg

SEQ ID NO: 5642637 - DNA, 14 bp, Homo sapiens
tccaccggcactca

SEQ ID NO: 5642638 - DNA, 15 bp, Homo sapiens
tccaccggcccctgg

SEQ ID NO: 5642639 - DNA, 17 bp, Homo sapiens
tccaccggcccctggca

SEQ ID NO: 5642640 - DNA, 23 bp, Homo sapiens
tccaccgggcctgaaccacagcg

SEQ ID NO: 5642641 - DNA, 23 bp, Homo sapiens
tccaccgggcgcatgcctcccag

SEQ ID NO: 5642642 - DNA, 15 bp, Homo sapiens
tccaccgtcccctcc

SEQ ID NO: 5642643 - DNA, 21 bp, Homo sapiens
tccacctagtggctgtccagt

SEQ ID NO: 5642644 - DNA, 19 bp, Homo sapiens
tccacctatccaccacccc

SEQ ID NO: 5642645 - DNA, 18 bp, Homo sapiens
tccacctcaagaccccca

SEQ ID NO: 5642646 - DNA, 12 bp, Homo sapiens
tccacctcagcc

SEQ ID NO: 5642647 - DNA, 14 bp, Homo sapiens
tccacctccagcct

SEQ ID NO: 5642648 - DNA, 16 bp, Homo sapiens
tccacctcccaccctg

SEQ ID NO: 5642649 - DNA, 21 bp, Homo sapiens
tccacctcccccaaaccctgc

SEQ ID NO: 5642650 - DNA, 23 bp, Homo sapiens
tccacctccctgcaataaaatgg

SEQ ID NO: 5642651 - DNA, 19 bp, Homo sapiens
tccacctcctctcttggac

SEQ ID NO: 5642652 - DNA, 20 bp, Homo sapiens
tccacctcctctcttggact

SEQ ID NO: 5642653 - DNA, 23 bp, Homo sapiens
tccacctcctctcttggactccc

SEQ ID NO: 5642654 - DNA, 13 bp, Homo sapiens
tccacctccttct

SEQ ID NO: 5642655 - DNA, 12 bp, Homo sapiens
tccacctcggag

SEQ ID NO: 5642656 - DNA, 13 bp, Homo sapiens
tccacctcggagc

SEQ ID NO: 5642657 - DNA, 19 bp, Homo sapiens
tccacctcggagcatggtg

SEQ ID NO: 5642658 - DNA, 23 bp, Homo sapiens
tccacctctcacgggccctgccc

SEQ ID NO: 5642659 - DNA, 12 bp, Homo sapiens
tccacctctggt

SEQ ID NO: 5642660 - DNA, 22 bp, Homo sapiens
tccacctctggtggctcctcct

SEQ ID NO: 5642661 - DNA, 19 bp, Homo sapiens
tccacctctgtgcagggca

SEQ ID NO: 5642662 - DNA, 20 bp, Homo sapiens
tccacctctgtgcagggcac

SEQ ID NO: 5642663 - DNA, 13 bp, Homo sapiens
tccacctgcagcc

SEQ ID NO: 5642664 - DNA, 13 bp, Homo sapiens
tccacctgcctat

SEQ ID NO: 5642665 - DNA, 22 bp, Homo sapiens
tccacctgcctatccatcctgc

SEQ ID NO: 5642666 - DNA, 13 bp, Homo sapiens
tccacctgccttg

SEQ ID NO: 5642667 - DNA, 18 bp, Homo sapiens
tccacctgccttggcctc

SEQ ID NO: 5642668 - DNA, 21 bp, Homo sapiens
tccacctgccttggcctccca

SEQ ID NO: 5642669 - DNA, 14 bp, Homo sapiens
tccacctgctctgc

SEQ ID NO: 5642670 - DNA, 15 bp, Homo sapiens
tccacctgctctgct

SEQ ID NO: 5642671 - DNA, 19 bp, Homo sapiens
tccacctggaaactgctca

SEQ ID NO: 5642672 - DNA, 18 bp, Homo sapiens
tccacctggaaagccagg

SEQ ID NO: 5642673 - DNA, 13 bp, Homo sapiens
tccacctggaagc

SEQ ID NO: 5642674 - DNA, 12 bp, Homo sapiens
tccacctggaga

SEQ ID NO: 5642675 - DNA, 13 bp, Homo sapiens
tccacctggagag

SEQ ID NO: 5642676 - DNA, 23 bp, Homo sapiens
tccacctggccccttctccagca

SEQ ID NO: 5642677 - DNA, 14 bp, Homo sapiens
tccacctgggagat

SEQ ID NO: 5642678 - DNA, 17 bp, Homo sapiens
tccacctgggagatgct

SEQ ID NO: 5642679 - DNA, 20 bp, Homo sapiens
tccacctgggagatgctggg

SEQ ID NO: 5642680 - DNA, 21 bp, Homo sapiens
tccacctgggagatgctggga

SEQ ID NO: 5642681 - DNA, 20 bp, Homo sapiens
tccacctgtctcagcctccc

SEQ ID NO: 5642682 - DNA, 20 bp, Homo sapiens
tccacctgtcttggcctccc

SEQ ID NO: 5642683 - DNA, 19 bp, Homo sapiens
tcccactgcaacttgtgaa

SEQ ID NO: 5642684 - DNA, 20 bp, Homo sapiens
tcccactgcaccccctcctg

SEQ ID NO: 5642685 - DNA, 20 bp, Homo sapiens
tcccactgcactccagcctg

SEQ ID NO: 5642686 - DNA, 23 bp, Homo sapiens
tcccactgccaggattttgtatt

SEQ ID NO: 5642687 - DNA, 14 bp, Homo sapiens
tcccactgcctcag

SEQ ID NO: 5642688 - DNA, 20 bp, Homo sapiens
tcccactgcctcaggttcct

SEQ ID NO: 5642689 - DNA, 13 bp, Homo sapiens
tcccactggaaca

SEQ ID NO: 5642690 - DNA, 12 bp, Homo sapiens
tcccactggaag

SEQ ID NO: 5642691 - DNA, 13 bp, Homo sapiens
tcccactggaaga

SEQ ID NO: 5642692 - DNA, 13 bp, Homo sapiens
tcccactggctcc

SEQ ID NO: 5642693 - DNA, 15 bp, Homo sapiens
tcccactggctcctc

SEQ ID NO: 5642694 - DNA, 20 bp, Homo sapiens
tcccactggctcctccagca

SEQ ID NO: 5642695 - DNA, 13 bp, Homo sapiens
tcccactgtatga

SEQ ID NO: 5642696 - DNA, 18 bp, Homo sapiens
tcccactgtatgatttat

SEQ ID NO: 5642697 - DNA, 15 bp, Homo sapiens
tcccactgttctgaa

SEQ ID NO: 5642698 - DNA, 21 bp, Homo sapiens
tcccacttactttaatgcgaa

SEQ ID NO: 5642699 - DNA, 18 bp, Homo sapiens
tcccacttagcagggaca

SEQ ID NO: 5642700 - DNA, 19 bp, Homo sapiens
tcccacttatcaaatcatt

SEQ ID NO: 5642701 - DNA, 18 bp, Homo sapiens
tcccacttcactgtgagg

SEQ ID NO: 5642702 - DNA, 17 bp, Homo sapiens
tcccacttccacccccg

SEQ ID NO: 5642703 - DNA, 16 bp, Homo sapiens
tcccacttcccaccct

SEQ ID NO: 5642704 - DNA, 14 bp, Homo sapiens
tcccacttccccat

SEQ ID NO: 5642705 - DNA, 17 bp, Homo sapiens
tcccacttccctgacac

SEQ ID NO: 5642706 - DNA, 15 bp, Homo sapiens
tcccacttcctccta

SEQ ID NO: 5642707 - DNA, 19 bp, Homo sapiens
tcccacttcctcctacctg

SEQ ID NO: 5642708 - DNA, 14 bp, Homo sapiens
tcccacttcctttc

SEQ ID NO: 5642709 - DNA, 16 bp, Homo sapiens
tcccacttctcatctt

SEQ ID NO: 5642710 - DNA, 15 bp, Homo sapiens
tcccacttctgccag

SEQ ID NO: 5642711 - DNA, 16 bp, Homo sapiens
tcccacttctgccaga

SEQ ID NO: 5642712 - DNA, 22 bp, Homo sapiens
tcccacttcttggatttttaaa

SEQ ID NO: 5642713 - DNA, 21 bp, Homo sapiens
tcccacttgacctgagatgct

SEQ ID NO: 5642714 - DNA, 15 bp, Homo sapiens
tcccacttgcccctg

SEQ ID NO: 5642715 - DNA, 23 bp, Homo sapiens
tcccacttggcatcagctggcgt

SEQ ID NO: 5642716 - DNA, 22 bp, Homo sapiens
tcccactttcatctaccttttc

SEQ ID NO: 5642717 - DNA, 23 bp, Homo sapiens
tcccactttgctgttccttactt

SEQ ID NO: 5642718 - DNA, 15 bp, Homo sapiens
tcccactttgtctgt

SEQ ID NO: 5642719 - DNA, 17 bp, Homo sapiens
tcccactttgtctgtac

SEQ ID NO: 5642720 - DNA, 22 bp, Homo sapiens
tcccactttgtctgtacatact

SEQ ID NO: 5642721 - DNA, 14 bp, Homo sapiens
tcccactttttggt

SEQ ID NO: 5642722 - DNA, 12 bp, Homo sapiens
tcccagaaatta

SEQ ID NO: 5642723 - DNA, 12 bp, Homo sapiens
tcccagaacctc

SEQ ID NO: 5642724 - DNA, 22 bp, Homo sapiens
tcccagaacctcagcatttcct

SEQ ID NO: 5642725 - DNA, 23 bp, Homo sapiens
tcccagaactattctgggggccc

SEQ ID NO: 5642726 - DNA, 11 bp, Homo sapiens
tcccagaagag

SEQ ID NO: 5642727 - DNA, 18 bp, Homo sapiens
tcccagaagtccacagga

SEQ ID NO: 5642728 - DNA, 15 bp, Homo sapiens
tcccagaagtggcta

SEQ ID NO: 5642729 - DNA, 16 bp, Homo sapiens
tcccagaagtggctac

SEQ ID NO: 5642730 - DNA, 16 bp, Homo sapiens
tcccagaatcccagcc

SEQ ID NO: 5642731 - DNA, 18 bp, Homo sapiens
tcccagaatcccagccgg

SEQ ID NO: 5642732 - DNA, 16 bp, Homo sapiens
tcccagaatctctgag

SEQ ID NO: 5642733 - DNA, 19 bp, Homo sapiens
tcccagacaaggagagcgg

SEQ ID NO: 5642734 - DNA, 20 bp, Homo sapiens
tcccagacaaggagagcgga

SEQ ID NO: 5642735 - DNA, 15 bp, Homo sapiens
tcccagacagcagtg

SEQ ID NO: 5642736 - DNA, 18 bp, Homo sapiens
tcccagacagcagtgtga

SEQ ID NO: 5642737 - DNA, 13 bp, Homo sapiens
tcccagacagctg

SEQ ID NO: 5642738 - DNA, 16 bp, Homo sapiens
tcccagacagctggac

SEQ ID NO: 5642739 - DNA, 16 bp, Homo sapiens
tcccagacaggccctc

SEQ ID NO: 5642740 - DNA, 18 bp, Homo sapiens
tcccagacaggccctccc

SEQ ID NO: 5642741 - DNA, 23 bp, Homo sapiens
tcccagacaggccctccctgtct

SEQ ID NO: 5642742 - DNA, 21 bp, Homo sapiens
tcccagacagtggatatgacc

SEQ ID NO: 5642743 - DNA, 15 bp, Homo sapiens
tcccagacatgctgc

SEQ ID NO: 5642744 - DNA, 14 bp, Homo sapiens
tcccagaccaggaa

SEQ ID NO: 5642745 - DNA, 15 bp, Homo sapiens
tcccagacccagggc

SEQ ID NO: 5642746 - DNA, 16 bp, Homo sapiens
tcccagacccattcct

SEQ ID NO: 5642747 - DNA, 19 bp, Homo sapiens
tcccagaccccgcagcacg

SEQ ID NO: 5642748 - DNA, 22 bp, Homo sapiens
tcccagacgaggggcttcctct

SEQ ID NO: 5642749 - DNA, 20 bp, Homo sapiens
tcccagactagatttcaagc

SEQ ID NO: 5642750 - DNA, 14 bp, Homo sapiens
tcccagactctgcc

SEQ ID NO: 5642751 - DNA, 14 bp, Homo sapiens
tcccagacttgttt

SEQ ID NO: 5642752 - DNA, 15 bp, Homo sapiens
tcccagacttgtttc

SEQ ID NO: 5642753 - DNA, 16 bp, Homo sapiens
tcccagacttgtttcc

SEQ ID NO: 5642754 - DNA, 20 bp, Homo sapiens
tcccagacttgtttcctgtg

SEQ ID NO: 5642755 - DNA, 17 bp, Homo sapiens
tcccagactttctacac

SEQ ID NO: 5642756 - DNA, 17 bp, Homo sapiens
tcccagagacaggaaaa

SEQ ID NO: 5642757 - DNA, 18 bp, Homo sapiens
tcccagagacaggaaaat

SEQ ID NO: 5642758 - DNA, 21 bp, Homo sapiens
tcccagagcacaagaaggcca

SEQ ID NO: 5642759 - DNA, 19 bp, Homo sapiens
tcccagagcacctgctgtc

SEQ ID NO: 5642760 - DNA, 17 bp, Homo sapiens
tcccagagcaggaggcc

SEQ ID NO: 5642761 - DNA, 18 bp, Homo sapiens
tcccagagcaggaggccc

SEQ ID NO: 5642762 - DNA, 20 bp, Homo sapiens
tcccagagcttattggccac

SEQ ID NO: 5642763 - DNA, 22 bp, Homo sapiens
tcccagagcttattggccactg

SEQ ID NO: 5642764 - DNA, 23 bp, Homo sapiens
tcccagagcttattggccactgg

SEQ ID NO: 5642765 - DNA, 19 bp, Homo sapiens
tcccagagcttcccaggat

SEQ ID NO: 5642766 - DNA, 20 bp, Homo sapiens
tcccagaggagccaccagtt

SEQ ID NO: 5642767 - DNA, 23 bp, Homo sapiens
tcccagaggagccaccagttctc

SEQ ID NO: 5642768 - DNA, 22 bp, Homo sapiens
tcccagaggccaggaatctgcc

SEQ ID NO: 5642769 - DNA, 15 bp, Homo sapiens
tcccagaggctcctg

SEQ ID NO: 5642770 - DNA, 19 bp, Homo sapiens
tcccagaggctcctggagc

SEQ ID NO: 5642771 - DNA, 21 bp, Homo sapiens
tcccagaggctcctggagcca

SEQ ID NO: 5642772 - DNA, 14 bp, Homo sapiens
tcccagagggagca

SEQ ID NO: 5642773 - DNA, 15 bp, Homo sapiens
tcccagagggagcag

SEQ ID NO: 5642774 - DNA, 19 bp, Homo sapiens
tcccagaggggcctgccac

SEQ ID NO: 5642775 - DNA, 22 bp, Homo sapiens
tcccagaggggcctgccacctg

SEQ ID NO: 5642776 - DNA, 16 bp, Homo sapiens
tcccagaggtccagcc

SEQ ID NO: 5642777 - DNA, 19 bp, Homo sapiens
tcccagaggtccagcccat

SEQ ID NO: 5642778 - DNA, 22 bp, Homo sapiens
tcccagaggtggggaagagagc

SEQ ID NO: 5642779 - DNA, 23 bp, Homo sapiens
tcccagaggtggggaagagagcc

SEQ ID NO: 5642780 - DNA, 19 bp, Homo sapiens
tcccagaggttatctgcct

SEQ ID NO: 5642781 - DNA, 20 bp, Homo sapiens
tcccagaggttatctgcctg

SEQ ID NO: 5642782 - DNA, 15 bp, Homo sapiens
tcccagagtgctggg

SEQ ID NO: 5642783 - DNA, 21 bp, Homo sapiens
tcccagagtgctgggattaca

SEQ ID NO: 5642784 - DNA, 20 bp, Homo sapiens
tcccagataaggcaagccag

SEQ ID NO: 5642785 - DNA, 11 bp, Homo sapiens
tcccagatgcc

SEQ ID NO: 5642786 - DNA, 23 bp, Homo sapiens
tcccagatgccttctagattcac

SEQ ID NO: 5642787 - DNA, 15 bp, Homo sapiens
tcccagatgctgtca

SEQ ID NO: 5642788 - DNA, 15 bp, Homo sapiens
tcccagatgtgtgtt

SEQ ID NO: 5642789 - DNA, 20 bp, Homo sapiens
tcccagattactccttcctt

SEQ ID NO: 5642790 - DNA, 18 bp, Homo sapiens
tcccagattggctcacac

SEQ ID NO: 5642791 - DNA, 22 bp, Homo sapiens
tcccagattggctcacactgag

SEQ ID NO: 5642792 - DNA, 23 bp, Homo sapiens
tcccagattggctcacactgaga

SEQ ID NO: 5642793 - DNA, 23 bp, Homo sapiens
tcccagcaagacctcatctgtgg

SEQ ID NO: 5642794 - DNA, 18 bp, Homo sapiens
tcccagcaattattacaa

SEQ ID NO: 5642795 - DNA, 14 bp, Homo sapiens
tcccagcacaggca

SEQ ID NO: 5642796 - DNA, 22 bp, Homo sapiens
tcccagcacatcgccagccctg

SEQ ID NO: 5642797 - DNA, 16 bp, Homo sapiens
tcccagcacatttcct

SEQ ID NO: 5642798 - DNA, 20 bp, Homo sapiens
tcccagcacatttcctctct

SEQ ID NO: 5642799 - DNA, 20 bp, Homo sapiens
tcccagcacctattgaatta

SEQ ID NO: 5642800 - DNA, 15 bp, Homo sapiens
tcccagcacctgcca

SEQ ID NO: 5642801 - DNA, 19 bp, Homo sapiens
tcccagcactgcctcctgt

SEQ ID NO: 5642802 - DNA, 22 bp, Homo sapiens
tcccagcactgcctcctgtttt

SEQ ID NO: 5642803 - DNA, 19 bp, Homo sapiens
tcccagcactttgggaggc

SEQ ID NO: 5642804 - DNA, 23 bp, Homo sapiens
tcccagcactttgggaggcaggg

SEQ ID NO: 5642805 - DNA, 21 bp, Homo sapiens
tcccagcactttgggaggccg

SEQ ID NO: 5642806 - DNA, 24 bp, Homo sapiens
tcccagcactttgggaggccgagg

SEQ ID NO: 5642807 - DNA, 21 bp, Homo sapiens
tcccagcactttgggaggctg

SEQ ID NO: 5642808 - DNA, 22 bp, Homo sapiens
tcccagcactttgggagtccaa

SEQ ID NO: 5642809 - DNA, 19 bp, Homo sapiens
tcccagcagaagagggagg

SEQ ID NO: 5642810 - DNA, 13 bp, Homo sapiens
tcccagcagagcc

SEQ ID NO: 5642811 - DNA, 22 bp, Homo sapiens
tcccagcagagcccaccagcca

SEQ ID NO: 5642812 - DNA, 14 bp, Homo sapiens
tcccagcagccagc

SEQ ID NO: 5642813 - DNA, 16 bp, Homo sapiens
tcccagcagccagcca

SEQ ID NO: 5642814 - DNA, 14 bp, Homo sapiens
tcccagcagcccaa

SEQ ID NO: 5642815 - DNA, 18 bp, Homo sapiens
tcccagcagcccaagctt

SEQ ID NO: 5642816 - DNA, 18 bp, Homo sapiens
tcccagcagccctaagga

SEQ ID NO: 5642817 - DNA, 21 bp, Homo sapiens
tcccagcagccctaaggatct

SEQ ID NO: 5642818 - DNA, 18 bp, Homo sapiens
tcccagcagctgggccgg

SEQ ID NO: 5642819 - DNA, 21 bp, Homo sapiens
tcccagcaggaatttcttttt

SEQ ID NO: 5642820 - DNA, 17 bp, Homo sapiens
tcccagcagtggcttgc

SEQ ID NO: 5642821 - DNA, 17 bp, Homo sapiens
tcccagcatctgattga

SEQ ID NO: 5642822 - DNA, 19 bp, Homo sapiens
tcccagccaccaccactgt

SEQ ID NO: 5642823 - DNA, 21 bp, Homo sapiens
tcccagccaccaccactgtcc

SEQ ID NO: 5642824 - DNA, 14 bp, Homo sapiens
tcccagccaccccg

SEQ ID NO: 5642825 - DNA, 23 bp, Homo sapiens
tcccagccacccggatctccagg

SEQ ID NO: 5642826 - DNA, 18 bp, Homo sapiens
tcccagccacgttggtgg

SEQ ID NO: 5642827 - DNA, 21 bp, Homo sapiens
tcccagccacgttggtggtat

SEQ ID NO: 5642828 - DNA, 22 bp, Homo sapiens
tcccagccactcgggaggctga

SEQ ID NO: 5642829 - DNA, 13 bp, Homo sapiens
tcccagccaggcc

SEQ ID NO: 5642830 - DNA, 15 bp, Homo sapiens
tcccagcccaccctg

SEQ ID NO: 5642831 - DNA, 15 bp, Homo sapiens
tcccagccccaggcc

SEQ ID NO: 5642832 - DNA, 18 bp, Homo sapiens
tcccagccccaggcctgg

SEQ ID NO: 5642833 - DNA, 22 bp, Homo sapiens
tcccagccccaggcctggcctc

SEQ ID NO: 5642834 - DNA, 13 bp, Homo sapiens
tcccagcccccaa

SEQ ID NO: 5642835 - DNA, 14 bp, Homo sapiens
tcccagccccctga

SEQ ID NO: 5642836 - DNA, 21 bp, Homo sapiens
tcccagccccggcaagccaca

SEQ ID NO: 5642837 - DNA, 15 bp, Homo sapiens
tcccagcccctcctc

SEQ ID NO: 5642838 - DNA, 16 bp, Homo sapiens
tcccagcccctcctcc

SEQ ID NO: 5642839 - DNA, 18 bp, Homo sapiens
tcccagcccctcctccct

SEQ ID NO: 5642840 - DNA, 22 bp, Homo sapiens
tcccagcccctcctccctcaga

SEQ ID NO: 5642841 - DNA, 12 bp, Homo sapiens
tcccagcccctg

SEQ ID NO: 5642842 - DNA, 15 bp, Homo sapiens
tcccagcccctgcag

SEQ ID NO: 5642843 - DNA, 15 bp, Homo sapiens
tcccagcccctggta

SEQ ID NO: 5642844 - DNA, 22 bp, Homo sapiens
tcccagcccctggtactccccc

SEQ ID NO: 5642845 - DNA, 12 bp, Homo sapiens
tcccagccctca

SEQ ID NO: 5642846 - DNA, 13 bp, Homo sapiens
tcccagccctcag

SEQ ID NO: 5642847 - DNA, 15 bp, Homo sapiens
tcccagccctcagca

SEQ ID NO: 5642848 - DNA, 13 bp, Homo sapiens
tcccagccctcat

SEQ ID NO: 5642849 - DNA, 14 bp, Homo sapiens
tcccagccctgagg

SEQ ID NO: 5642850 - DNA, 19 bp, Homo sapiens
tcccagccctgccaggagg

SEQ ID NO: 5642851 - DNA, 21 bp, Homo sapiens
tcccagccctgccaggaggct

SEQ ID NO: 5642852 - DNA, 15 bp, Homo sapiens
tcccagccctggggg

SEQ ID NO: 5642853 - DNA, 16 bp, Homo sapiens
tcccagccctttccag

SEQ ID NO: 5642854 - DNA, 17 bp, Homo sapiens
tcccagcctcagaagcc

SEQ ID NO: 5642855 - DNA, 14 bp, Homo sapiens
tcccagcctctggg

SEQ ID NO: 5642856 - DNA, 15 bp, Homo sapiens
tcccagcctctgggg

SEQ ID NO: 5642857 - DNA, 16 bp, Homo sapiens
tcccagcctctggggc

SEQ ID NO: 5642858 - DNA, 10 bp, Homo sapiens
tcccagcctg

SEQ ID NO: 5642859 - DNA, 22 bp, Homo sapiens
tcccattattatttctgttctt

SEQ ID NO: 5642860 - DNA, 14 bp, Homo sapiens
tcccattcaagatt

SEQ ID NO: 5642861 - DNA, 16 bp, Homo sapiens
tcccattcaccctgtg

SEQ ID NO: 5642862 - DNA, 13 bp, Homo sapiens
tcccattccccca

SEQ ID NO: 5642863 - DNA, 23 bp, Homo sapiens
tcccattccttttcgtttagaat

SEQ ID NO: 5642864 - DNA, 13 bp, Homo sapiens
tcccattctagat

SEQ ID NO: 5642865 - DNA, 21 bp, Homo sapiens
tcccattctagatcctgcacc

SEQ ID NO: 5642866 - DNA, 22 bp, Homo sapiens
tcccattctagatcctgcaccc

SEQ ID NO: 5642867 - DNA, 13 bp, Homo sapiens
tcccattctatgt

SEQ ID NO: 5642868 - DNA, 15 bp, Homo sapiens
tcccattctatgtgt

SEQ ID NO: 5642869 - DNA, 15 bp, Homo sapiens
tcccattctgcacca

SEQ ID NO: 5642870 - DNA, 16 bp, Homo sapiens
tcccattctgcaccac

SEQ ID NO: 5642871 - DNA, 15 bp, Homo sapiens
tcccattcttggccc

SEQ ID NO: 5642872 - DNA, 14 bp, Homo sapiens
tcccattgcccagt

SEQ ID NO: 5642873 - DNA, 17 bp, Homo sapiens
tcccattgcccagtgag

SEQ ID NO: 5642874 - DNA, 18 bp, Homo sapiens
tcccattgcccagtgagc

SEQ ID NO: 5642875 - DNA, 13 bp, Homo sapiens
tcccattgccctg

SEQ ID NO: 5642876 - DNA, 15 bp, Homo sapiens
tcccattgccctggt

SEQ ID NO: 5642877 - DNA, 17 bp, Homo sapiens
tcccattggtctgcatg

SEQ ID NO: 5642878 - DNA, 17 bp, Homo sapiens
tcccattgtccctctgc

SEQ ID NO: 5642879 - DNA, 19 bp, Homo sapiens
tcccattgtccctctgccc

SEQ ID NO: 5642880 - DNA, 19 bp, Homo sapiens
tcccattgtcttctgacct

SEQ ID NO: 5642881 - DNA, 23 bp, Homo sapiens
tcccatttagaatggtgatttta

SEQ ID NO: 5642882 - DNA, 16 bp, Homo sapiens
tcccatttatcgcaga

SEQ ID NO: 5642883 - DNA, 13 bp, Homo sapiens
tcccatttcagct

SEQ ID NO: 5642884 - DNA, 12 bp, Homo sapiens
tcccatttcctg

SEQ ID NO: 5642885 - DNA, 13 bp, Homo sapiens
tcccatttcctga

SEQ ID NO: 5642886 - DNA, 14 bp, Homo sapiens
tcccatttcctgat

SEQ ID NO: 5642887 - DNA, 13 bp, Homo sapiens
tcccatttccttg

SEQ ID NO: 5642888 - DNA, 18 bp, Homo sapiens
tcccatttccttggaggc

SEQ ID NO: 5642889 - DNA, 21 bp, Homo sapiens
tcccatttccttggaggccac

SEQ ID NO: 5642890 - DNA, 18 bp, Homo sapiens
tcccatttccttgtctaa

SEQ ID NO: 5642891 - DNA, 17 bp, Homo sapiens
tcccatttcgtgtaata

SEQ ID NO: 5642892 - DNA, 15 bp, Homo sapiens
tcccatttctcactg

SEQ ID NO: 5642893 - DNA, 17 bp, Homo sapiens
tcccatttctgttgctg

SEQ ID NO: 5642894 - DNA, 20 bp, Homo sapiens
tcccatttctgttgctggag

SEQ ID NO: 5642895 - DNA, 11 bp, Homo sapiens
tcccatttctt

SEQ ID NO: 5642896 - DNA, 17 bp, Homo sapiens
tcccatttgtaatgtat

SEQ ID NO: 5642897 - DNA, 15 bp, Homo sapiens
tcccatttgtaattt

SEQ ID NO: 5642898 - DNA, 17 bp, Homo sapiens
tcccatttgttgctgct

SEQ ID NO: 5642899 - DNA, 20 bp, Homo sapiens
tcccatttgttgctgctgct

SEQ ID NO: 5642900 - DNA, 21 bp, Homo sapiens
tcccatttgttgctgctgctg

SEQ ID NO: 5642901 - DNA, 19 bp, Homo sapiens
tcccattttcagactgctt

SEQ ID NO: 5642902 - DNA, 23 bp, Homo sapiens
tcccattttcagactgctttaaa

SEQ ID NO: 5642903 - DNA, 15 bp, Homo sapiens
tcccattttcatcct

SEQ ID NO: 5642904 - DNA, 21 bp, Homo sapiens
tcccattttgcaaaatttcca

SEQ ID NO: 5642905 - DNA, 22 bp, Homo sapiens
tcccattttgcaaaatttccag

SEQ ID NO: 5642906 - DNA, 18 bp, Homo sapiens
tcccattttggaatttgc

SEQ ID NO: 5642907 - DNA, 15 bp, Homo sapiens
tcccatttttactta

SEQ ID NO: 5642908 - DNA, 18 bp, Homo sapiens
tccccaaaacactgtctg

SEQ ID NO: 5642909 - DNA, 14 bp, Homo sapiens
tccccaaaatgtga

SEQ ID NO: 5642910 - DNA, 21 bp, Homo sapiens
tccccaaacccatcagacagg

SEQ ID NO: 5642911 - DNA, 21 bp, Homo sapiens
tccccaaactgtgccctgcct

SEQ ID NO: 5642912 - DNA, 15 bp, Homo sapiens
tccccaaagccactg

SEQ ID NO: 5642913 - DNA, 19 bp, Homo sapiens
tccccaaagccactggaag

SEQ ID NO: 5642914 - DNA, 23 bp, Homo sapiens
tccccaaaggaaccgcccagtgc

SEQ ID NO: 5642915 - DNA, 18 bp, Homo sapiens
tccccaaaggacgcctgc

SEQ ID NO: 5642916 - DNA, 14 bp, Homo sapiens
tccccaaaggcatc

SEQ ID NO: 5642917 - DNA, 15 bp, Homo sapiens
tccccaaaggcatcc

SEQ ID NO: 5642918 - DNA, 20 bp, Homo sapiens
tccccaaaggccaacagcat

SEQ ID NO: 5642919 - DNA, 14 bp, Homo sapiens
tccccaaaggcttt

SEQ ID NO: 5642920 - DNA, 14 bp, Homo sapiens
tccccaaagggtgt

SEQ ID NO: 5642921 - DNA, 21 bp, Homo sapiens
tccccaaaggtcaaaaacaaa

SEQ ID NO: 5642922 - DNA, 17 bp, Homo sapiens
tccccaaagtaccacac

SEQ ID NO: 5642923 - DNA, 18 bp, Homo sapiens
tccccaaagtcttaaaat

SEQ ID NO: 5642924 - DNA, 19 bp, Homo sapiens
tccccaaatccgaacctcc

SEQ ID NO: 5642925 - DNA, 21 bp, Homo sapiens
tccccaaattgccctgttgcc

SEQ ID NO: 5642926 - DNA, 14 bp, Homo sapiens
tccccaacaatgtg

SEQ ID NO: 5642927 - DNA, 15 bp, Homo sapiens
tccccaacagcgccc

SEQ ID NO: 5642928 - DNA, 16 bp, Homo sapiens
tccccaacagcgccca

SEQ ID NO: 5642929 - DNA, 17 bp, Homo sapiens
tccccaacagcgcccaa

SEQ ID NO: 5642930 - DNA, 15 bp, Homo sapiens
tccccaacagtgtga

SEQ ID NO: 5642931 - DNA, 16 bp, Homo sapiens
tccccaacagtgtgaa

SEQ ID NO: 5642932 - DNA, 18 bp, Homo sapiens
tccccaacagtgtgaagt

SEQ ID NO: 5642933 - DNA, 19 bp, Homo sapiens
tccccaacagtgtgaagtt

SEQ ID NO: 5642934 - DNA, 20 bp, Homo sapiens
tccccaacagtgtgaagtta

SEQ ID NO: 5642935 - DNA, 17 bp, Homo sapiens
tccccaaccccagaccc

SEQ ID NO: 5642936 - DNA, 21 bp, Homo sapiens
tccccaacccctctccaggcc

SEQ ID NO: 5642937 - DNA, 22 bp, Homo sapiens
tccccaacccgtgcccctggga

SEQ ID NO: 5642938 - DNA, 18 bp, Homo sapiens
tccccaaccctgcccctg

SEQ ID NO: 5642939 - DNA, 19 bp, Homo sapiens
tccccaaccctgcccctgc

SEQ ID NO: 5642940 - DNA, 14 bp, Homo sapiens
tccccaacccttcc

SEQ ID NO: 5642941 - DNA, 16 bp, Homo sapiens
tccccaacccttccac

SEQ ID NO: 5642942 - DNA, 14 bp, Homo sapiens
tccccaacctgcaa

SEQ ID NO: 5642943 - DNA, 13 bp, Homo sapiens
tccccaactccat

SEQ ID NO: 5642944 - DNA, 21 bp, Homo sapiens
tccccaactccctctctgtgc

SEQ ID NO: 5642945 - DNA, 15 bp, Homo sapiens
tccccaactccttcc

SEQ ID NO: 5642946 - DNA, 18 bp, Homo sapiens
tccccaactgaccacctt

SEQ ID NO: 5642947 - DNA, 19 bp, Homo sapiens
tccccaactgaccaccttt

SEQ ID NO: 5642948 - DNA, 13 bp, Homo sapiens
tccccaactgctc

SEQ ID NO: 5642949 - DNA, 15 bp, Homo sapiens
tccccaactgctcca

SEQ ID NO: 5642950 - DNA, 19 bp, Homo sapiens
tccccaactgctccagcct

SEQ ID NO: 5642951 - DNA, 21 bp, Homo sapiens
tccccaactgctccagcctct

SEQ ID NO: 5642952 - DNA, 18 bp, Homo sapiens
tccccaacttccctagtc

SEQ ID NO: 5642953 - DNA, 18 bp, Homo sapiens
tccccaagaccccctggg

SEQ ID NO: 5642954 - DNA, 15 bp, Homo sapiens
tccccaagatctgcc

SEQ ID NO: 5642955 - DNA, 16 bp, Homo sapiens
tccccaagatctgcca

SEQ ID NO: 5642956 - DNA, 22 bp, Homo sapiens
tccccaagatctgccagacctg

SEQ ID NO: 5642957 - DNA, 16 bp, Homo sapiens
tccccaagcccaccag

SEQ ID NO: 5642958 - DNA, 18 bp, Homo sapiens
tccccaagcctggcaggg

SEQ ID NO: 5642959 - DNA, 22 bp, Homo sapiens
tccccaagcgcctggctgctgc

SEQ ID NO: 5642960 - DNA, 24 bp, Homo sapiens
tccccaagcgcctggctgctgctt

SEQ ID NO: 5642961 - DNA, 15 bp, Homo sapiens
tccccaaggatgacc

SEQ ID NO: 5642962 - DNA, 17 bp, Homo sapiens
tccccaaggcactgagc

SEQ ID NO: 5642963 - DNA, 19 bp, Homo sapiens
tccccaaggccccctgcct

SEQ ID NO: 5642964 - DNA, 20 bp, Homo sapiens
tccccaaggccccctgcctg

SEQ ID NO: 5642965 - DNA, 21 bp, Homo sapiens
tccccaaggccccctgcctgc

SEQ ID NO: 5642966 - DNA, 13 bp, Homo sapiens
tccccaaggctgc

SEQ ID NO: 5642967 - DNA, 13 bp, Homo sapiens
tccccaagggccc

SEQ ID NO: 5642968 - DNA, 17 bp, Homo sapiens
tccccaagggccctggc

SEQ ID NO: 5642969 - DNA, 18 bp, Homo sapiens
tccccaagtcagcagtcc

SEQ ID NO: 5642970 - DNA, 14 bp, Homo sapiens
tccccaataaagcc

SEQ ID NO: 5642971 - DNA, 16 bp, Homo sapiens
tccccaataaagcctt

SEQ ID NO: 5642972 - DNA, 21 bp, Homo sapiens
tccccaataattgcagaacta

SEQ ID NO: 5642973 - DNA, 20 bp, Homo sapiens
tccccaatccaacccatgca

SEQ ID NO: 5642974 - DNA, 16 bp, Homo sapiens
tccccaatccatgctt

SEQ ID NO: 5642975 - DNA, 17 bp, Homo sapiens
tccccaatccatgcttc

SEQ ID NO: 5642976 - DNA, 19 bp, Homo sapiens
tccccaatccatgcttcac

SEQ ID NO: 5642977 - DNA, 21 bp, Homo sapiens
tccccaatcccggtcatgctt

SEQ ID NO: 5642978 - DNA, 15 bp, Homo sapiens
tccccaatccctgac

SEQ ID NO: 5642979 - DNA, 16 bp, Homo sapiens
tccccaatgagacttg

SEQ ID NO: 5642980 - DNA, 19 bp, Homo sapiens
tccccaatgagacttgcct

SEQ ID NO: 5642981 - DNA, 16 bp, Homo sapiens
tccccaatttagtcta

SEQ ID NO: 5642982 - DNA, 15 bp, Homo sapiens
tccccacacacaggc

SEQ ID NO: 5642983 - DNA, 16 bp, Homo sapiens
tccccacacacaggcc

SEQ ID NO: 5642984 - DNA, 20 bp, Homo sapiens
tccccacacacaggccttct

SEQ ID NO: 5642985 - DNA, 23 bp, Homo sapiens
tccccacacacaggccttctgtg

SEQ ID NO: 5642986 - DNA, 17 bp, Homo sapiens
tccccacaccctggagt

SEQ ID NO: 5642987 - DNA, 20 bp, Homo sapiens
tccccacacgtgctcgcagc

SEQ ID NO: 5642988 - DNA, 17 bp, Homo sapiens
tccccacagaactgctt

SEQ ID NO: 5642989 - DNA, 19 bp, Homo sapiens
tccccacagaactgcttac

SEQ ID NO: 5642990 - DNA, 17 bp, Homo sapiens
tccccacagactgcccc

SEQ ID NO: 5642991 - DNA, 18 bp, Homo sapiens
tccccacagactgcccca

SEQ ID NO: 5642992 - DNA, 16 bp, Homo sapiens
tccccacagcctctgg

SEQ ID NO: 5642993 - DNA, 19 bp, Homo sapiens
tccccacagcctctggctc

SEQ ID NO: 5642994 - DNA, 22 bp, Homo sapiens
tccccacaggcacattaactgt

SEQ ID NO: 5642995 - DNA, 21 bp, Homo sapiens
tccccacagtcctcacagcct

SEQ ID NO: 5642996 - DNA, 17 bp, Homo sapiens
tccccacagtgccaccc

SEQ ID NO: 5642997 - DNA, 19 bp, Homo sapiens
tccccacatcgcacactgg

SEQ ID NO: 5642998 - DNA, 18 bp, Homo sapiens
tccccaccactgatatca

SEQ ID NO: 5642999 - DNA, 14 bp, Homo sapiens
tccccaccagagct

SEQ ID NO: 5643000 - DNA, 21 bp, Homo sapiens
tccccaccagagctgcctccc

SEQ ID NO: 5643001 - DNA, 16 bp, Homo sapiens
tccccaccagatgctg

SEQ ID NO: 5643002 - DNA, 16 bp, Homo sapiens
tccccaccagctcgtt

SEQ ID NO: 5643003 - DNA, 13 bp, Homo sapiens
tccccaccagctt

SEQ ID NO: 5643004 - DNA, 14 bp, Homo sapiens
tccccaccagtctc

SEQ ID NO: 5643005 - DNA, 22 bp, Homo sapiens
tccccaccagtctcacccacta

SEQ ID NO: 5643006 - DNA, 18 bp, Homo sapiens
tccccaccatctgctgtc

SEQ ID NO: 5643007 - DNA, 19 bp, Homo sapiens
tccccaccatctgctgtct

SEQ ID NO: 5643008 - DNA, 14 bp, Homo sapiens
tccccacccaagag

SEQ ID NO: 5643009 - DNA, 17 bp, Homo sapiens
tccccacccaagagagg

SEQ ID NO: 5643010 - DNA, 18 bp, Homo sapiens
tccccacccaagagagga

SEQ ID NO: 5643011 - DNA, 11 bp, Homo sapiens
tccccacccac

SEQ ID NO: 5643012 - DNA, 21 bp, Homo sapiens
tccccacccaccaaccctcag

SEQ ID NO: 5643013 - DNA, 15 bp, Homo sapiens
tccccacccaccacc

SEQ ID NO: 5643014 - DNA, 22 bp, Homo sapiens
tccccacccaccaccgctcccg

SEQ ID NO: 5643015 - DNA, 21 bp, Homo sapiens
tccccacccagacctgcctgt

SEQ ID NO: 5643016 - DNA, 22 bp, Homo sapiens
tccccacccatgcgccttcgtg

SEQ ID NO: 5643017 - DNA, 13 bp, Homo sapiens
tccccaccccact

SEQ ID NO: 5643018 - DNA, 15 bp, Homo sapiens
tccccaccccagtgg

SEQ ID NO: 5643019 - DNA, 19 bp, Homo sapiens
tccccaccccagtgggaac

SEQ ID NO: 5643020 - DNA, 22 bp, Homo sapiens
tccccaccccataagccctgag

SEQ ID NO: 5643021 - DNA, 22 bp, Homo sapiens
tccccacccccctctctttctc

SEQ ID NO: 5643022 - DNA, 23 bp, Homo sapiens
tccccacccccgctgggggtggg

SEQ ID NO: 5643023 - DNA, 23 bp, Homo sapiens
tccccaccccgggctctcctgcc

SEQ ID NO: 5643024 - DNA, 14 bp, Homo sapiens
tccccacccctacc

SEQ ID NO: 5643025 - DNA, 23 bp, Homo sapiens
tccccacccctacccctggctgt

SEQ ID NO: 5643026 - DNA, 14 bp, Homo sapiens
tccccacccctgcc

SEQ ID NO: 5643027 - DNA, 15 bp, Homo sapiens
tccccacccctgccc

SEQ ID NO: 5643028 - DNA, 16 bp, Homo sapiens
tccccacccctgcccc

SEQ ID NO: 5643029 - DNA, 18 bp, Homo sapiens
tccccacccctgccccca

SEQ ID NO: 5643030 - DNA, 19 bp, Homo sapiens
tccccaccctccactcagc

SEQ ID NO: 5643031 - DNA, 22 bp, Homo sapiens
tccccaccctcccctctcctga

SEQ ID NO: 5643032 - DNA, 17 bp, Homo sapiens
tccccaccctccccttc

SEQ ID NO: 5643033 - DNA, 18 bp, Homo sapiens
tccccaccctcctcttgg

SEQ ID NO: 5643034 - DNA, 16 bp, Homo sapiens
tccccaccctcctggc

SEQ ID NO: 5643035 - DNA, 23 bp, Homo sapiens
tccccaccctgaaagccctgagc

SEQ ID NO: 5643036 - DNA, 19 bp, Homo sapiens
tcccccatgttctgtccct

SEQ ID NO: 5643037 - DNA, 22 bp, Homo sapiens
tccccccaagggaggctgctgc

SEQ ID NO: 5643038 - DNA, 17 bp, Homo sapiens
tccccccaatccctcaa

SEQ ID NO: 5643039 - DNA, 16 bp, Homo sapiens
tccccccaccccccag

SEQ ID NO: 5643040 - DNA, 23 bp, Homo sapiens
tccccccactgcaggccccgctt

SEQ ID NO: 5643041 - DNA, 21 bp, Homo sapiens
tccccccagaccccgcccctg

SEQ ID NO: 5643042 - DNA, 18 bp, Homo sapiens
tccccccagcccctcctc

SEQ ID NO: 5643043 - DNA, 17 bp, Homo sapiens
tccccccagctccctgc

SEQ ID NO: 5643044 - DNA, 18 bp, Homo sapiens
tccccccagctccctgca

SEQ ID NO: 5643045 - DNA, 22 bp, Homo sapiens
tccccccatagagaccaggagg

SEQ ID NO: 5643046 - DNA, 14 bp, Homo sapiens
tccccccatcccag

SEQ ID NO: 5643047 - DNA, 14 bp, Homo sapiens
tccccccatctcca

SEQ ID NO: 5643048 - DNA, 16 bp, Homo sapiens
tccccccatctccatt

SEQ ID NO: 5643049 - DNA, 15 bp, Homo sapiens
tccccccatctctga

SEQ ID NO: 5643050 - DNA, 18 bp, Homo sapiens
tccccccatctctgagtg

SEQ ID NO: 5643051 - DNA, 12 bp, Homo sapiens
tccccccatctt

SEQ ID NO: 5643052 - DNA, 15 bp, Homo sapiens
tccccccatcttgct

SEQ ID NO: 5643053 - DNA, 14 bp, Homo sapiens
tccccccattttct

SEQ ID NO: 5643054 - DNA, 15 bp, Homo sapiens
tccccccattttctc

SEQ ID NO: 5643055 - DNA, 13 bp, Homo sapiens
tcccccccagcct

SEQ ID NO: 5643056 - DNA, 14 bp, Homo sapiens
tcccccccagcctg

SEQ ID NO: 5643057 - DNA, 16 bp, Homo sapiens
tcccccccagcctggc

SEQ ID NO: 5643058 - DNA, 13 bp, Homo sapiens
tccccccccaggc

SEQ ID NO: 5643059 - DNA, 18 bp, Homo sapiens
tccccccccaggccctcc

SEQ ID NO: 5643060 - DNA, 16 bp, Homo sapiens
tcccccccccctccaa

SEQ ID NO: 5643061 - DNA, 14 bp, Homo sapiens
tcccccccctttcc

SEQ ID NO: 5643062 - DNA, 15 bp, Homo sapiens
tccccccgcccaccc

SEQ ID NO: 5643063 - DNA, 12 bp, Homo sapiens
tcccccctcacc

SEQ ID NO: 5643064 - DNA, 14 bp, Homo sapiens
tcccccctcactcc

SEQ ID NO: 5643065 - DNA, 21 bp, Homo sapiens
tcccccctccattcccacccc

SEQ ID NO: 5643066 - DNA, 11 bp, Homo sapiens
tcccccctccc

SEQ ID NO: 5643067 - DNA, 13 bp, Homo sapiens
tcccccctcccac

SEQ ID NO: 5643068 - DNA, 22 bp, Homo sapiens
tcccccctcctctgaaacagct

SEQ ID NO: 5643069 - DNA, 12 bp, Homo sapiens
tcccccctctcc

SEQ ID NO: 5643070 - DNA, 22 bp, Homo sapiens
tcccccctctcctcccagctgc

SEQ ID NO: 5643071 - DNA, 13 bp, Homo sapiens
tcccccctgagtg

SEQ ID NO: 5643072 - DNA, 19 bp, Homo sapiens
tcccccctgtggtctgtgt

SEQ ID NO: 5643073 - DNA, 18 bp, Homo sapiens
tccccccttgaagcaata

SEQ ID NO: 5643074 - DNA, 18 bp, Homo sapiens
tcccccgaccaatcccca

SEQ ID NO: 5643075 - DNA, 21 bp, Homo sapiens
tcccccgaccaggttggggag

SEQ ID NO: 5643076 - DNA, 16 bp, Homo sapiens
tcccccgactgcctgt

SEQ ID NO: 5643077 - DNA, 16 bp, Homo sapiens
tcccccgagctcttgg

SEQ ID NO: 5643078 - DNA, 20 bp, Homo sapiens
tcccccgagctcttggcctt

SEQ ID NO: 5643079 - DNA, 17 bp, Homo sapiens
tcccccgattcagagac

SEQ ID NO: 5643080 - DNA, 18 bp, Homo sapiens
tcccccgattcagagact

SEQ ID NO: 5643081 - DNA, 21 bp, Homo sapiens
tcccccgcaatgtgcccccag

SEQ ID NO: 5643082 - DNA, 19 bp, Homo sapiens
tcccccgcagacagacaga

SEQ ID NO: 5643083 - DNA, 17 bp, Homo sapiens
tccccctaaacatggct

SEQ ID NO: 5643084 - DNA, 17 bp, Homo sapiens
tccccctaaaccaactg

SEQ ID NO: 5643085 - DNA, 15 bp, Homo sapiens
tccccctaattctta

SEQ ID NO: 5643086 - DNA, 13 bp, Homo sapiens
tccccctacccac

SEQ ID NO: 5643087 - DNA, 16 bp, Homo sapiens
tccccctacccaccga

SEQ ID NO: 5643088 - DNA, 14 bp, Homo sapiens
tccccctacccata

SEQ ID NO: 5643089 - DNA, 21 bp, Homo sapiens
tccccctacccatatccctcc

SEQ ID NO: 5643090 - DNA, 22 bp, Homo sapiens
tccccctaccgcatggcagctg

SEQ ID NO: 5643091 - DNA, 15 bp, Homo sapiens
tccccctagagactc

SEQ ID NO: 5643092 - DNA, 22 bp, Homo sapiens
tccccctcagatgatctctcca

SEQ ID NO: 5643093 - DNA, 16 bp, Homo sapiens
tccccctcagcaagcc

SEQ ID NO: 5643094 - DNA, 22 bp, Homo sapiens
tccccctcagctctccctcaca

SEQ ID NO: 5643095 - DNA, 16 bp, Homo sapiens
tccccctccacctgct

SEQ ID NO: 5643096 - DNA, 18 bp, Homo sapiens
tccccctcccagggccag

SEQ ID NO: 5643097 - DNA, 19 bp, Homo sapiens
tccccctcccagggccagg

SEQ ID NO: 5643098 - DNA, 14 bp, Homo sapiens
tccccctccccagg

SEQ ID NO: 5643099 - DNA, 21 bp, Homo sapiens
tccccctcccccagccactcc

SEQ ID NO: 5643100 - DNA, 13 bp, Homo sapiens
tccccctccctgc

SEQ ID NO: 5643101 - DNA, 14 bp, Homo sapiens
tccccctccctgcc

SEQ ID NO: 5643102 - DNA, 16 bp, Homo sapiens
tccccctccctgccca

SEQ ID NO: 5643103 - DNA, 17 bp, Homo sapiens
tccccctccctgcccaa

SEQ ID NO: 5643104 - DNA, 17 bp, Homo sapiens
tccccctcctagggggt

SEQ ID NO: 5643105 - DNA, 16 bp, Homo sapiens
tccccctcctctccct

SEQ ID NO: 5643106 - DNA, 12 bp, Homo sapiens
tccccctcctga

SEQ ID NO: 5643107 - DNA, 14 bp, Homo sapiens
tccccctcctgcac

SEQ ID NO: 5643108 - DNA, 17 bp, Homo sapiens
tccccctcctgctgtgc

SEQ ID NO: 5643109 - DNA, 19 bp, Homo sapiens
tccccctcctgctgtgctg

SEQ ID NO: 5643110 - DNA, 11 bp, Homo sapiens
tccccctcctt

SEQ ID NO: 5643111 - DNA, 18 bp, Homo sapiens
tccccctccttcccagct

SEQ ID NO: 5643112 - DNA, 21 bp, Homo sapiens
tccccctctcctctcccccag

SEQ ID NO: 5643113 - DNA, 12 bp, Homo sapiens
tccccctctgtc

SEQ ID NO: 5643114 - DNA, 23 bp, Homo sapiens
tccccctgcaaaaagaaaaaaag

SEQ ID NO: 5643115 - DNA, 11 bp, Homo sapiens
tccccctgcag

SEQ ID NO: 5643116 - DNA, 19 bp, Homo sapiens
tccccctgcagccatccca

SEQ ID NO: 5643117 - DNA, 18 bp, Homo sapiens
tccccctgcagccgtgca

SEQ ID NO: 5643118 - DNA, 14 bp, Homo sapiens
tccccctgccagca

SEQ ID NO: 5643119 - DNA, 13 bp, Homo sapiens
tccccctgcccca

SEQ ID NO: 5643120 - DNA, 22 bp, Homo sapiens
tccccctgccctcgtggccagc

SEQ ID NO: 5643121 - DNA, 16 bp, Homo sapiens
tccccctgccctgtgc

SEQ ID NO: 5643122 - DNA, 12 bp, Homo sapiens
tccccctgctcc

SEQ ID NO: 5643123 - DNA, 13 bp, Homo sapiens
tccccctgctgat

SEQ ID NO: 5643124 - DNA, 15 bp, Homo sapiens
tccccctgctgctca

SEQ ID NO: 5643125 - DNA, 23 bp, Homo sapiens
tccccctggaatcgaggctgtgt

SEQ ID NO: 5643126 - DNA, 18 bp, Homo sapiens
tccccctggacggggcgg

SEQ ID NO: 5643127 - DNA, 21 bp, Homo sapiens
tccccctggccaccacccccc

SEQ ID NO: 5643128 - DNA, 23 bp, Homo sapiens
tccccctgggctctgccccagct

SEQ ID NO: 5643129 - DNA, 15 bp, Homo sapiens
tccccctgtcccctc

SEQ ID NO: 5643130 - DNA, 19 bp, Homo sapiens
tccccctgtcccctcagct

SEQ ID NO: 5643131 - DNA, 13 bp, Homo sapiens
tccccctgtgcat

SEQ ID NO: 5643132 - DNA, 15 bp, Homo sapiens
tccccctgtgtggcc

SEQ ID NO: 5643133 - DNA, 18 bp, Homo sapiens
tccccctgtgtggccctg

SEQ ID NO: 5643134 - DNA, 15 bp, Homo sapiens
tcccccttcagctcc

SEQ ID NO: 5643135 - DNA, 16 bp, Homo sapiens
tcccccttcagctcct

SEQ ID NO: 5643136 - DNA, 17 bp, Homo sapiens
tcccccttcagctcctg

SEQ ID NO: 5643137 - DNA, 21 bp, Homo sapiens
tcccccttcatccatcctgag

SEQ ID NO: 5643138 - DNA, 22 bp, Homo sapiens
tcccccttcatccatcctgagc

SEQ ID NO: 5643139 - DNA, 10 bp, Homo sapiens
tcccccttcc

SEQ ID NO: 5643140 - DNA, 20 bp, Homo sapiens
tcccccttccaaataataaa

SEQ ID NO: 5643141 - DNA, 19 bp, Homo sapiens
tcccccttccgccttctcc

SEQ ID NO: 5643142 - DNA, 16 bp, Homo sapiens
tcccccttcctagtga

SEQ ID NO: 5643143 - DNA, 17 bp, Homo sapiens
tcccccttcctagtgaa

SEQ ID NO: 5643144 - DNA, 21 bp, Homo sapiens
tcccccttcctttggtgcctc

SEQ ID NO: 5643145 - DNA, 23 bp, Homo sapiens
tcccccttgccaccccaccctcc

SEQ ID NO: 5643146 - DNA, 20 bp, Homo sapiens
tccccctttctctgcctggc

SEQ ID NO: 5643147 - DNA, 22 bp, Homo sapiens
tccccctttctctgcctggcaa

SEQ ID NO: 5643148 - DNA, 15 bp, Homo sapiens
tccccctttcttcct

SEQ ID NO: 5643149 - DNA, 14 bp, Homo sapiens
tcccccttttttgt

SEQ ID NO: 5643150 - DNA, 13 bp, Homo sapiens
tccccgaaaaccc

SEQ ID NO: 5643151 - DNA, 19 bp, Homo sapiens
tccccgaaaacccccagca

SEQ ID NO: 5643152 - DNA, 24 bp, Homo sapiens
tccccgaaacaggctactctcctc

SEQ ID NO: 5643153 - DNA, 13 bp, Homo sapiens
tccccgacccccc

SEQ ID NO: 5643154 - DNA, 19 bp, Homo sapiens
tccccgacccccctacccc

SEQ ID NO: 5643155 - DNA, 18 bp, Homo sapiens
tccccgacgcccacccaa

SEQ ID NO: 5643156 - DNA, 17 bp, Homo sapiens
tccccgactggggcagg

SEQ ID NO: 5643157 - DNA, 19 bp, Homo sapiens
tccccgaggagctgggccc

SEQ ID NO: 5643158 - DNA, 23 bp, Homo sapiens
tccccgaggagctgggcccctgc

SEQ ID NO: 5643159 - DNA, 14 bp, Homo sapiens
tccccgaggctgcc

SEQ ID NO: 5643160 - DNA, 17 bp, Homo sapiens
tccccgaggctgcccca

SEQ ID NO: 5643161 - DNA, 20 bp, Homo sapiens
tccccgaggctgccccaggc

SEQ ID NO: 5643162 - DNA, 21 bp, Homo sapiens
tccccgaggctgccccaggcc

SEQ ID NO: 5643163 - DNA, 22 bp, Homo sapiens
tccccgaggctgccccaggccg

SEQ ID NO: 5643164 - DNA, 20 bp, Homo sapiens
tccccgagggatgatgccac

SEQ ID NO: 5643165 - DNA, 12 bp, Homo sapiens
tccccgagggct

SEQ ID NO: 5643166 - DNA, 17 bp, Homo sapiens
tccccgagtcctcaggt

SEQ ID NO: 5643167 - DNA, 22 bp, Homo sapiens
tccccgatccccgacagtggct

SEQ ID NO: 5643168 - DNA, 14 bp, Homo sapiens
tccccgcacccccc

SEQ ID NO: 5643169 - DNA, 21 bp, Homo sapiens
tccccgcaccccccaagctgt

SEQ ID NO: 5643170 - DNA, 23 bp, Homo sapiens
tccccgcagagctcccttcctga

SEQ ID NO: 5643171 - DNA, 18 bp, Homo sapiens
tccccgcagcccgcctgc

SEQ ID NO: 5643172 - DNA, 21 bp, Homo sapiens
tccccgcagccctctccaccc

SEQ ID NO: 5643173 - DNA, 23 bp, Homo sapiens
tccccgcagccctctccacccag

SEQ ID NO: 5643174 - DNA, 19 bp, Homo sapiens
tccccgcagtgtgcactaa

SEQ ID NO: 5643175 - DNA, 18 bp, Homo sapiens
tccccgccccctgaaaca

SEQ ID NO: 5643176 - DNA, 13 bp, Homo sapiens
tccccgcccctgt

SEQ ID NO: 5643177 - DNA, 21 bp, Homo sapiens
tccccgcccctgtggccctgg

SEQ ID NO: 5643178 - DNA, 16 bp, Homo sapiens
tccccgcccgccctcc

SEQ ID NO: 5643179 - DNA, 21 bp, Homo sapiens
tccccgcccgccctcctctgc

SEQ ID NO: 5643180 - DNA, 23 bp, Homo sapiens
tccccgcccgccctcctctgccc

SEQ ID NO: 5643181 - DNA, 21 bp, Homo sapiens
tccccgccgccggaatgaatg

SEQ ID NO: 5643182 - DNA, 18 bp, Homo sapiens
tccccgcctcctcccact

SEQ ID NO: 5643183 - DNA, 22 bp, Homo sapiens
tccccgcctcctcccactggga

SEQ ID NO: 5643184 - DNA, 19 bp, Homo sapiens
tccccgcctcctccctgcc

SEQ ID NO: 5643185 - DNA, 21 bp, Homo sapiens
tccccgcctcctccctgcctg

SEQ ID NO: 5643186 - DNA, 14 bp, Homo sapiens
tccccgcctgcagt

SEQ ID NO: 5643187 - DNA, 12 bp, Homo sapiens
tccccgcctggc

SEQ ID NO: 5643188 - DNA, 13 bp, Homo sapiens
tccccgcctggcc

SEQ ID NO: 5643189 - DNA, 14 bp, Homo sapiens
tccccgcctggcca

SEQ ID NO: 5643190 - DNA, 17 bp, Homo sapiens
tccccgcctggccaggg

SEQ ID NO: 5643191 - DNA, 19 bp, Homo sapiens
tccccgcctggccagggca

SEQ ID NO: 5643192 - DNA, 14 bp, Homo sapiens
tccccgcctgttcc

SEQ ID NO: 5643193 - DNA, 23 bp, Homo sapiens
tccccgccttagagcctcgtccc

SEQ ID NO: 5643194 - DNA, 24 bp, Homo sapiens
tccccgccttagagcctcgtccct

SEQ ID NO: 5643195 - DNA, 14 bp, Homo sapiens
tccccgccttccct

SEQ ID NO: 5643196 - DNA, 15 bp, Homo sapiens
tccccgcgggcagtg

SEQ ID NO: 5643197 - DNA, 15 bp, Homo sapiens
tccccgctaaggaag

SEQ ID NO: 5643198 - DNA, 20 bp, Homo sapiens
tccccgctcaggggcctgga

SEQ ID NO: 5643199 - DNA, 22 bp, Homo sapiens
tccccgctcaggggcctggagg

SEQ ID NO: 5643200 - DNA, 19 bp, Homo sapiens
tccccgctccgtctctgtc

SEQ ID NO: 5643201 - DNA, 13 bp, Homo sapiens
tccccgctctccc

SEQ ID NO: 5643202 - DNA, 14 bp, Homo sapiens
tccccgctctgccg

SEQ ID NO: 5643203 - DNA, 14 bp, Homo sapiens
tccccgctgcccaa

SEQ ID NO: 5643204 - DNA, 16 bp, Homo sapiens
tccccgctgcccaatc

SEQ ID NO: 5643205 - DNA, 17 bp, Homo sapiens
tccccgctgctgtgcaa

SEQ ID NO: 5643206 - DNA, 18 bp, Homo sapiens
tccccgcttctgcctgca

SEQ ID NO: 5643207 - DNA, 17 bp, Homo sapiens
tccccggaagtgcctta

SEQ ID NO: 5643208 - DNA, 20 bp, Homo sapiens
tccccggacaagcccaggac

SEQ ID NO: 5643209 - DNA, 22 bp, Homo sapiens
tccccggaccggacgcatgcag

SEQ ID NO: 5643210 - DNA, 16 bp, Homo sapiens
tccccggacgctggct

SEQ ID NO: 5643211 - DNA, 14 bp, Homo sapiens
tccccggagctggg

SEQ ID NO: 5643212 - DNA, 15 bp, Homo sapiens
tccccggagttcagt

SEQ ID NO: 5643213 - DNA, 17 bp, Homo sapiens
tccccggcaccctctgg

SEQ ID NO: 5643214 - DNA, 23 bp, Homo sapiens
tcccgcatcaaggtcagcatgag

SEQ ID NO: 5643215 - DNA, 12 bp, Homo sapiens
tcccgcatgctg

SEQ ID NO: 5643216 - DNA, 14 bp, Homo sapiens
tcccgccaccctca

SEQ ID NO: 5643217 - DNA, 19 bp, Homo sapiens
tcccgccaccctcaataaa

SEQ ID NO: 5643218 - DNA, 18 bp, Homo sapiens
tcccgccaccctgtctca

SEQ ID NO: 5643219 - DNA, 15 bp, Homo sapiens
tcccgccactcgcct

SEQ ID NO: 5643220 - DNA, 17 bp, Homo sapiens
tcccgccaggagcttct

SEQ ID NO: 5643221 - DNA, 19 bp, Homo sapiens
tcccgccaggaggtcctcc

SEQ ID NO: 5643222 - DNA, 21 bp, Homo sapiens
tcccgccaggaggtcctcctc

SEQ ID NO: 5643223 - DNA, 22 bp, Homo sapiens
tcccgccagggagtgtgatgca

SEQ ID NO: 5643224 - DNA, 20 bp, Homo sapiens
tcccgcccaaacctttcccc

SEQ ID NO: 5643225 - DNA, 16 bp, Homo sapiens
tcccgcccagcctcac

SEQ ID NO: 5643226 - DNA, 18 bp, Homo sapiens
tcccgccccagcctcctg

SEQ ID NO: 5643227 - DNA, 13 bp, Homo sapiens
tcccgccccaggg

SEQ ID NO: 5643228 - DNA, 19 bp, Homo sapiens
tcccgccccccacacttcc

SEQ ID NO: 5643229 - DNA, 22 bp, Homo sapiens
tcccgccccccacacttccctg

SEQ ID NO: 5643230 - DNA, 23 bp, Homo sapiens
tcccgccccccacacttccctgg

SEQ ID NO: 5643231 - DNA, 14 bp, Homo sapiens
tcccgccccgcccc

SEQ ID NO: 5643232 - DNA, 14 bp, Homo sapiens
tcccgccccgggct

SEQ ID NO: 5643233 - DNA, 15 bp, Homo sapiens
tcccgccccgggctg

SEQ ID NO: 5643234 - DNA, 22 bp, Homo sapiens
tcccgccctcacctgcagagaa

SEQ ID NO: 5643235 - DNA, 21 bp, Homo sapiens
tcccgccgccccccctatctc

SEQ ID NO: 5643236 - DNA, 16 bp, Homo sapiens
tcccgccgcccgaccc

SEQ ID NO: 5643237 - DNA, 18 bp, Homo sapiens
tcccgccgcctcgggccg

SEQ ID NO: 5643238 - DNA, 22 bp, Homo sapiens
tcccgccgcctcgggccgcctc

SEQ ID NO: 5643239 - DNA, 23 bp, Homo sapiens
tcccgccgcctcgggccgcctcc

SEQ ID NO: 5643240 - DNA, 18 bp, Homo sapiens
tcccgccggaggccagct

SEQ ID NO: 5643241 - DNA, 19 bp, Homo sapiens
tcccgccggaggccagcta

SEQ ID NO: 5643242 - DNA, 20 bp, Homo sapiens
tcccgccggaggccagctat

SEQ ID NO: 5643243 - DNA, 18 bp, Homo sapiens
tcccgcctcagcctcctg

SEQ ID NO: 5643244 - DNA, 17 bp, Homo sapiens
tcccgcctcagcctctc

SEQ ID NO: 5643245 - DNA, 17 bp, Homo sapiens
tcccgcctcagggccag

SEQ ID NO: 5643246 - DNA, 19 bp, Homo sapiens
tcccgcctcagggccaggc

SEQ ID NO: 5643247 - DNA, 21 bp, Homo sapiens
tcccgcctcttcttcttcaga

SEQ ID NO: 5643248 - DNA, 21 bp, Homo sapiens
tcccgccttcaggttcctcct

SEQ ID NO: 5643249 - DNA, 13 bp, Homo sapiens
tcccgccttccaa

SEQ ID NO: 5643250 - DNA, 18 bp, Homo sapiens
tcccgccttcctcctcca

SEQ ID NO: 5643251 - DNA, 23 bp, Homo sapiens
tcccgcgggttccgcaggcagac

SEQ ID NO: 5643252 - DNA, 14 bp, Homo sapiens
tcccgcggtgctga

SEQ ID NO: 5643253 - DNA, 18 bp, Homo sapiens
tcccgcggtgctgactga

SEQ ID NO: 5643254 - DNA, 14 bp, Homo sapiens
tcccgctcagccct

SEQ ID NO: 5643255 - DNA, 13 bp, Homo sapiens
tcccgctcccagg

SEQ ID NO: 5643256 - DNA, 13 bp, Homo sapiens
tcccgctcctgct

SEQ ID NO: 5643257 - DNA, 15 bp, Homo sapiens
tcccgctcctgctga

SEQ ID NO: 5643258 - DNA, 17 bp, Homo sapiens
tcccgctgagcccactc

SEQ ID NO: 5643259 - DNA, 13 bp, Homo sapiens
tcccgctgcacac

SEQ ID NO: 5643260 - DNA, 21 bp, Homo sapiens
tcccgctgcacacagacggcc

SEQ ID NO: 5643261 - DNA, 14 bp, Homo sapiens
tcccgctgcacatg

SEQ ID NO: 5643262 - DNA, 13 bp, Homo sapiens
tcccgctgcctcc

SEQ ID NO: 5643263 - DNA, 14 bp, Homo sapiens
tcccgctgcctcct

SEQ ID NO: 5643264 - DNA, 15 bp, Homo sapiens
tcccgctgcctcctg

SEQ ID NO: 5643265 - DNA, 17 bp, Homo sapiens
tcccgctgcctcctgct

SEQ ID NO: 5643266 - DNA, 14 bp, Homo sapiens
tcccgctgctgtgc

SEQ ID NO: 5643267 - DNA, 16 bp, Homo sapiens
tcccgcttagcctgcc

SEQ ID NO: 5643268 - DNA, 20 bp, Homo sapiens
tcccgcttagcctgcctcac

SEQ ID NO: 5643269 - DNA, 17 bp, Homo sapiens
tcccgcttagcgctctg

SEQ ID NO: 5643270 - DNA, 15 bp, Homo sapiens
tcccgcttagttctt

SEQ ID NO: 5643271 - DNA, 14 bp, Homo sapiens
tcccgcttcctggc

SEQ ID NO: 5643272 - DNA, 19 bp, Homo sapiens
tcccgcttcctggcctccc

SEQ ID NO: 5643273 - DNA, 23 bp, Homo sapiens
tcccgcttctgaagctgctgcag

SEQ ID NO: 5643274 - DNA, 14 bp, Homo sapiens
tcccgcttgctctc

SEQ ID NO: 5643275 - DNA, 21 bp, Homo sapiens
tcccgcttgctctcctggagc

SEQ ID NO: 5643276 - DNA, 18 bp, Homo sapiens
tcccggagcacagccctg

SEQ ID NO: 5643277 - DNA, 19 bp, Homo sapiens
tcccggagcacagccctgg

SEQ ID NO: 5643278 - DNA, 20 bp, Homo sapiens
tcccggagccatcaccctca

SEQ ID NO: 5643279 - DNA, 13 bp, Homo sapiens
tcccggagcccca

SEQ ID NO: 5643280 - DNA, 16 bp, Homo sapiens
tcccggagcctgtgca

SEQ ID NO: 5643281 - DNA, 18 bp, Homo sapiens
tcccggagcgcacctgct

SEQ ID NO: 5643282 - DNA, 18 bp, Homo sapiens
tcccggagctcaggccct

SEQ ID NO: 5643283 - DNA, 15 bp, Homo sapiens
tcccggaggaaatct

SEQ ID NO: 5643284 - DNA, 17 bp, Homo sapiens
tcccggaggccttccct

SEQ ID NO: 5643285 - DNA, 16 bp, Homo sapiens
tcccggagggccctga

SEQ ID NO: 5643286 - DNA, 12 bp, Homo sapiens
tcccggaggtgt

SEQ ID NO: 5643287 - DNA, 16 bp, Homo sapiens
tcccggataggctaat

SEQ ID NO: 5643288 - DNA, 20 bp, Homo sapiens
tcccggcaagcgcttctgct

SEQ ID NO: 5643289 - DNA, 20 bp, Homo sapiens
tcccggcagcgaggctgggc

SEQ ID NO: 5643290 - DNA, 13 bp, Homo sapiens
tcccggcatcctg

SEQ ID NO: 5643291 - DNA, 15 bp, Homo sapiens
tcccggcatcctgaa

SEQ ID NO: 5643292 - DNA, 23 bp, Homo sapiens
tcccggcatgggaaagccacctc

SEQ ID NO: 5643293 - DNA, 13 bp, Homo sapiens
tcccggccagctc

SEQ ID NO: 5643294 - DNA, 19 bp, Homo sapiens
tcccggccagctctggagt

SEQ ID NO: 5643295 - DNA, 18 bp, Homo sapiens
tcccggccaggcgggaga

SEQ ID NO: 5643296 - DNA, 17 bp, Homo sapiens
tcccggcccgcctgccc

SEQ ID NO: 5643297 - DNA, 21 bp, Homo sapiens
tcccggcccgcctgcccagac

SEQ ID NO: 5643298 - DNA, 14 bp, Homo sapiens
tcccggccctgcct

SEQ ID NO: 5643299 - DNA, 15 bp, Homo sapiens
tcccggccgcgccgc

SEQ ID NO: 5643300 - DNA, 18 bp, Homo sapiens
tcccggccgcgccgccgc

SEQ ID NO: 5643301 - DNA, 12 bp, Homo sapiens
tcccggctccag

SEQ ID NO: 5643302 - DNA, 15 bp, Homo sapiens
tcccggctccagagc

SEQ ID NO: 5643303 - DNA, 16 bp, Homo sapiens
tcccggctccagagca

SEQ ID NO: 5643304 - DNA, 16 bp, Homo sapiens
tcccggctcccctccc

SEQ ID NO: 5643305 - DNA, 20 bp, Homo sapiens
tcccggctgcccccatcacc

SEQ ID NO: 5643306 - DNA, 14 bp, Homo sapiens
tcccggctgccctt

SEQ ID NO: 5643307 - DNA, 13 bp, Homo sapiens
tcccggctgcctg

SEQ ID NO: 5643308 - DNA, 18 bp, Homo sapiens
tcccggctgcctgccgcc

SEQ ID NO: 5643309 - DNA, 23 bp, Homo sapiens
tcccgggaatgaccgctctccct

SEQ ID NO: 5643310 - DNA, 15 bp, Homo sapiens
tcccgggacgcagca

SEQ ID NO: 5643311 - DNA, 14 bp, Homo sapiens
tcccgggagctggg

SEQ ID NO: 5643312 - DNA, 15 bp, Homo sapiens
tcccgggagctgggc

SEQ ID NO: 5643313 - DNA, 16 bp, Homo sapiens
tcccgggagctgggcc

SEQ ID NO: 5643314 - DNA, 19 bp, Homo sapiens
tcccgggagctgggccctg

SEQ ID NO: 5643315 - DNA, 14 bp, Homo sapiens
tcccgggatgggtg

SEQ ID NO: 5643316 - DNA, 19 bp, Homo sapiens
tcccgggccacgccccagc

SEQ ID NO: 5643317 - DNA, 20 bp, Homo sapiens
tcccgggccacgccccagcc

SEQ ID NO: 5643318 - DNA, 15 bp, Homo sapiens
tcccgggccagggct

SEQ ID NO: 5643319 - DNA, 16 bp, Homo sapiens
tcccgggccctcagcc

SEQ ID NO: 5643320 - DNA, 14 bp, Homo sapiens
tcccgggccctccc

SEQ ID NO: 5643321 - DNA, 12 bp, Homo sapiens
tcccgggcctca

SEQ ID NO: 5643322 - DNA, 18 bp, Homo sapiens
tcccgggcctcagtgccc

SEQ ID NO: 5643323 - DNA, 14 bp, Homo sapiens
tcccggggcagggc

SEQ ID NO: 5643324 - DNA, 14 bp, Homo sapiens
tcccggggcctgga

SEQ ID NO: 5643325 - DNA, 20 bp, Homo sapiens
tcccggggcctggacaggcg

SEQ ID NO: 5643326 - DNA, 20 bp, Homo sapiens
tcccggggtgcccgtgtggc

SEQ ID NO: 5643327 - DNA, 19 bp, Homo sapiens
tcccgggtccttggccccc

SEQ ID NO: 5643328 - DNA, 22 bp, Homo sapiens
tcccggtcatgcttttgccact

SEQ ID NO: 5643329 - DNA, 14 bp, Homo sapiens
tcccggtcccgagt

SEQ ID NO: 5643330 - DNA, 20 bp, Homo sapiens
tcccggtgtatcctggccct

SEQ ID NO: 5643331 - DNA, 16 bp, Homo sapiens
tcccggttcaccttgc

SEQ ID NO: 5643332 - DNA, 20 bp, Homo sapiens
tcccggttcagacccctgcc

SEQ ID NO: 5643333 - DNA, 17 bp, Homo sapiens
tcccggtttcagaagct

SEQ ID NO: 5643334 - DNA, 21 bp, Homo sapiens
tcccgtaagaccaccttccct

SEQ ID NO: 5643335 - DNA, 19 bp, Homo sapiens
tcccgtaaggctgtacata

SEQ ID NO: 5643336 - DNA, 19 bp, Homo sapiens
tcccgtacaaacttggaca

SEQ ID NO: 5643337 - DNA, 15 bp, Homo sapiens
tcccgtactgtctgt

SEQ ID NO: 5643338 - DNA, 18 bp, Homo sapiens
tcccgtactgtctgtgtc

SEQ ID NO: 5643339 - DNA, 20 bp, Homo sapiens
tcccgtcagggcccaagtcc

SEQ ID NO: 5643340 - DNA, 18 bp, Homo sapiens
tcccgtcccatatcctgc

SEQ ID NO: 5643341 - DNA, 12 bp, Homo sapiens
tcccgtccctcc

SEQ ID NO: 5643342 - DNA, 22 bp, Homo sapiens
tcccgtccctccctttcctccg

SEQ ID NO: 5643343 - DNA, 14 bp, Homo sapiens
tcccgtccgtccgc

SEQ ID NO: 5643344 - DNA, 17 bp, Homo sapiens
tcccgtctactcattcc

SEQ ID NO: 5643345 - DNA, 15 bp, Homo sapiens
tcccgtctgattgtt

SEQ ID NO: 5643346 - DNA, 16 bp, Homo sapiens
tcccgtcttccagaga

SEQ ID NO: 5643347 - DNA, 16 bp, Homo sapiens
tcccgtcttcctcctc

SEQ ID NO: 5643348 - DNA, 19 bp, Homo sapiens
tcccgtgaaagaattattt

SEQ ID NO: 5643349 - DNA, 23 bp, Homo sapiens
tcccgtgaaagaattatttttgt

SEQ ID NO: 5643350 - DNA, 17 bp, Homo sapiens
tcccgtgccctgtttcc

SEQ ID NO: 5643351 - DNA, 22 bp, Homo sapiens
tcccgtggaacgtttttcctgt

SEQ ID NO: 5643352 - DNA, 20 bp, Homo sapiens
tcccgtggatgctctttcaa

SEQ ID NO: 5643353 - DNA, 13 bp, Homo sapiens
tcccgtggcccca

SEQ ID NO: 5643354 - DNA, 17 bp, Homo sapiens
tcccgtggccccagcct

SEQ ID NO: 5643355 - DNA, 23 bp, Homo sapiens
tcccgtggccccagcctggccca

SEQ ID NO: 5643356 - DNA, 20 bp, Homo sapiens
tcccgtgtcgtaacagcagg

SEQ ID NO: 5643357 - DNA, 16 bp, Homo sapiens
tcccgtgtgcctgagc

SEQ ID NO: 5643358 - DNA, 19 bp, Homo sapiens
tcccgttccccgctccaca

SEQ ID NO: 5643359 - DNA, 23 bp, Homo sapiens
tcccgtttagagttatttaggct

SEQ ID NO: 5643360 - DNA, 18 bp, Homo sapiens
tcccgtttccctccaggt

SEQ ID NO: 5643361 - DNA, 21 bp, Homo sapiens
tcccgttttacagataaggaa

SEQ ID NO: 5643362 - DNA, 20 bp, Homo sapiens
tccctaaaataaaaaccaga

SEQ ID NO: 5643363 - DNA, 19 bp, Homo sapiens
tccctaaaatacatttaaa

SEQ ID NO: 5643364 - DNA, 12 bp, Homo sapiens
tccctaaactgc

SEQ ID NO: 5643365 - DNA, 16 bp, Homo sapiens
tccctaaactgcagcc

SEQ ID NO: 5643366 - DNA, 16 bp, Homo sapiens
tccctaaactttggcc

SEQ ID NO: 5643367 - DNA, 14 bp, Homo sapiens
tccctaaagccctc

SEQ ID NO: 5643368 - DNA, 18 bp, Homo sapiens
tccctaaagccctcttca

SEQ ID NO: 5643369 - DNA, 13 bp, Homo sapiens
tccctaaagtgtt

SEQ ID NO: 5643370 - DNA, 15 bp, Homo sapiens
tccctaacaggctgt

SEQ ID NO: 5643371 - DNA, 20 bp, Homo sapiens
tccctaacatcatgcattca

SEQ ID NO: 5643372 - DNA, 17 bp, Homo sapiens
tccctaaccaaatgctg

SEQ ID NO: 5643373 - DNA, 14 bp, Homo sapiens
tccctaactctcgg

SEQ ID NO: 5643374 - DNA, 23 bp, Homo sapiens
tccctaactgttcccttatctgt

SEQ ID NO: 5643375 - DNA, 12 bp, Homo sapiens
tccctaacttct

SEQ ID NO: 5643376 - DNA, 15 bp, Homo sapiens
tccctaacttgtgaa

SEQ ID NO: 5643377 - DNA, 16 bp, Homo sapiens
tccctaagaattccca

SEQ ID NO: 5643378 - DNA, 19 bp, Homo sapiens
tccctaagaattcccagat

SEQ ID NO: 5643379 - DNA, 22 bp, Homo sapiens
tccctaagcatgtgtcccagga

SEQ ID NO: 5643380 - DNA, 20 bp, Homo sapiens
tccctaagccaagggcctct

SEQ ID NO: 5643381 - DNA, 13 bp, Homo sapiens
tccctaagccagc

SEQ ID NO: 5643382 - DNA, 16 bp, Homo sapiens
tccctaagccagcctg

SEQ ID NO: 5643383 - DNA, 16 bp, Homo sapiens
tccctaaggaatctga

SEQ ID NO: 5643384 - DNA, 18 bp, Homo sapiens
tccctaaggaatctgaaa

SEQ ID NO: 5643385 - DNA, 22 bp, Homo sapiens
tccctaaggcatgtgtgaaaca

SEQ ID NO: 5643386 - DNA, 21 bp, Homo sapiens
tccctaagtaagtttcttcct

SEQ ID NO: 5643387 - DNA, 21 bp, Homo sapiens
tccctaagtccaactactaaa

SEQ ID NO: 5643388 - DNA, 16 bp, Homo sapiens
tccctaatctatggtc

SEQ ID NO: 5643389 - DNA, 23 bp, Homo sapiens
tccctaatctatggtcgggagac

SEQ ID NO: 5643390 - DNA, 20 bp, Homo sapiens
tccctaatgctgcagatttg

SEQ ID NO: 5643391 - DNA, 15 bp, Homo sapiens
tccctaatgtgtttc

SEQ ID NO: 5643392 - DNA, 23 bp, Homo sapiens
tccctgccacactcagtccccca

SEQ ID NO: 5643393 - DNA, 12 bp, Homo sapiens
tccctgccacat

SEQ ID NO: 5643394 - DNA, 22 bp, Homo sapiens
tccctgccacatacaggtgctc

SEQ ID NO: 5643395 - DNA, 21 bp, Homo sapiens
tccctgccaccgtcacacagt

SEQ ID NO: 5643396 - DNA, 17 bp, Homo sapiens
tccctgccactgggctc

SEQ ID NO: 5643397 - DNA, 21 bp, Homo sapiens
tccctgccactgggctctgga

SEQ ID NO: 5643398 - DNA, 21 bp, Homo sapiens
tccctgccacttcaaccccca

SEQ ID NO: 5643399 - DNA, 14 bp, Homo sapiens
tccctgccagtgtt

SEQ ID NO: 5643400 - DNA, 16 bp, Homo sapiens
tccctgccatttttta

SEQ ID NO: 5643401 - DNA, 18 bp, Homo sapiens
tccctgcccaaaccctta

SEQ ID NO: 5643402 - DNA, 22 bp, Homo sapiens
tccctgcccaatcctccctgga

SEQ ID NO: 5643403 - DNA, 23 bp, Homo sapiens
tccctgcccaatcctccctggag

SEQ ID NO: 5643404 - DNA, 16 bp, Homo sapiens
tccctgcccaggccgg

SEQ ID NO: 5643405 - DNA, 16 bp, Homo sapiens
tccctgcccatttcat

SEQ ID NO: 5643406 - DNA, 13 bp, Homo sapiens
tccctgccccaaa

SEQ ID NO: 5643407 - DNA, 16 bp, Homo sapiens
tccctgccccccagcc

SEQ ID NO: 5643408 - DNA, 17 bp, Homo sapiens
tccctgccccctcccct

SEQ ID NO: 5643409 - DNA, 14 bp, Homo sapiens
tccctgccccgccc

SEQ ID NO: 5643410 - DNA, 15 bp, Homo sapiens
tccctgccccgcccc

SEQ ID NO: 5643411 - DNA, 19 bp, Homo sapiens
tccctgccccgccccccag

SEQ ID NO: 5643412 - DNA, 22 bp, Homo sapiens
tccctgccccgccccccagagc

SEQ ID NO: 5643413 - DNA, 14 bp, Homo sapiens
tccctgcccctccc

SEQ ID NO: 5643414 - DNA, 12 bp, Homo sapiens
tccctgcccctg

SEQ ID NO: 5643415 - DNA, 15 bp, Homo sapiens
tccctgcccctgtcc

SEQ ID NO: 5643416 - DNA, 21 bp, Homo sapiens
tccctgcccctgtgcctctgt

SEQ ID NO: 5643417 - DNA, 14 bp, Homo sapiens
tccctgccccttaa

SEQ ID NO: 5643418 - DNA, 23 bp, Homo sapiens
tccctgcccgaggtcgctgcagc

SEQ ID NO: 5643419 - DNA, 13 bp, Homo sapiens
tccctgccctccc

SEQ ID NO: 5643420 - DNA, 21 bp, Homo sapiens
tccctgccctcccctgctccc

SEQ ID NO: 5643421 - DNA, 19 bp, Homo sapiens
tccctgccctcgggtctcc

SEQ ID NO: 5643422 - DNA, 21 bp, Homo sapiens
tccctgccctgtcctccagct

SEQ ID NO: 5643423 - DNA, 11 bp, Homo sapiens
tccctgcctca

SEQ ID NO: 5643424 - DNA, 23 bp, Homo sapiens
tccctgcctcacctctgccattt

SEQ ID NO: 5643425 - DNA, 19 bp, Homo sapiens
tccctgcctcactcctccg

SEQ ID NO: 5643426 - DNA, 22 bp, Homo sapiens
tccctgcctcagtggctctggg

SEQ ID NO: 5643427 - DNA, 14 bp, Homo sapiens
tccctgcctccacc

SEQ ID NO: 5643428 - DNA, 13 bp, Homo sapiens
tccctgcctccag

SEQ ID NO: 5643429 - DNA, 13 bp, Homo sapiens
tccctgcctcctg

SEQ ID NO: 5643430 - DNA, 22 bp, Homo sapiens
tccctgcctcggttgattgtgc

SEQ ID NO: 5643431 - DNA, 15 bp, Homo sapiens
tccctgcctggcccc

SEQ ID NO: 5643432 - DNA, 20 bp, Homo sapiens
tccctgcctggccctcctct

SEQ ID NO: 5643433 - DNA, 23 bp, Homo sapiens
tccctgcctggtcctcacactca

SEQ ID NO: 5643434 - DNA, 19 bp, Homo sapiens
tccctgcctgtggcccctc

SEQ ID NO: 5643435 - DNA, 15 bp, Homo sapiens
tccctgcctgtttcc

SEQ ID NO: 5643436 - DNA, 17 bp, Homo sapiens
tccctgcctgtttcccg

SEQ ID NO: 5643437 - DNA, 11 bp, Homo sapiens
tccctgccttc

SEQ ID NO: 5643438 - DNA, 17 bp, Homo sapiens
tccctgcgcctgtgatg

SEQ ID NO: 5643439 - DNA, 15 bp, Homo sapiens
tccctgcgcgcagct

SEQ ID NO: 5643440 - DNA, 19 bp, Homo sapiens
tccctgcggaagccacagg

SEQ ID NO: 5643441 - DNA, 20 bp, Homo sapiens
tccctgcggaagccacaggg

SEQ ID NO: 5643442 - DNA, 23 bp, Homo sapiens
tccctgcggaagccacagggtga

SEQ ID NO: 5643443 - DNA, 22 bp, Homo sapiens
tccctgctaccaaggcccagct

SEQ ID NO: 5643444 - DNA, 23 bp, Homo sapiens
tccctgctaccaaggcccagcta

SEQ ID NO: 5643445 - DNA, 21 bp, Homo sapiens
tccctgctagcacagaggcct

SEQ ID NO: 5643446 - DNA, 23 bp, Homo sapiens
tccctgctagcacagaggcctga

SEQ ID NO: 5643447 - DNA, 15 bp, Homo sapiens
tccctgctcactgca

SEQ ID NO: 5643448 - DNA, 15 bp, Homo sapiens
tccctgctcagccca

SEQ ID NO: 5643449 - DNA, 17 bp, Homo sapiens
tccctgctcagcccatc

SEQ ID NO: 5643450 - DNA, 18 bp, Homo sapiens
tccctgctcagctggccg

SEQ ID NO: 5643451 - DNA, 22 bp, Homo sapiens
tccctgctcagtgcttgggctc

SEQ ID NO: 5643452 - DNA, 17 bp, Homo sapiens
tccctgctccacgtctg

SEQ ID NO: 5643453 - DNA, 11 bp, Homo sapiens
tccctgctccc

SEQ ID NO: 5643454 - DNA, 13 bp, Homo sapiens
tccctgctcccag

SEQ ID NO: 5643455 - DNA, 14 bp, Homo sapiens
tccctgctctctga

SEQ ID NO: 5643456 - DNA, 20 bp, Homo sapiens
tccctgctctggtcccctct

SEQ ID NO: 5643457 - DNA, 23 bp, Homo sapiens
tccctgctctggtcccctctctt

SEQ ID NO: 5643458 - DNA, 22 bp, Homo sapiens
tccctgctcttgcagttgctct

SEQ ID NO: 5643459 - DNA, 14 bp, Homo sapiens
tccctgctgaatgc

SEQ ID NO: 5643460 - DNA, 14 bp, Homo sapiens
tccctgctgccagc

SEQ ID NO: 5643461 - DNA, 18 bp, Homo sapiens
tccctgctgcgctgcttg

SEQ ID NO: 5643462 - DNA, 17 bp, Homo sapiens
tccctgctgctgccagg

SEQ ID NO: 5643463 - DNA, 14 bp, Homo sapiens
tccctgctggccaa

SEQ ID NO: 5643464 - DNA, 14 bp, Homo sapiens
tccctgctggggtc

SEQ ID NO: 5643465 - DNA, 16 bp, Homo sapiens
tccctgctgtgttccc

SEQ ID NO: 5643466 - DNA, 15 bp, Homo sapiens
tccctgcttatctga

SEQ ID NO: 5643467 - DNA, 20 bp, Homo sapiens
tccctgcttatctgaaactt

SEQ ID NO: 5643468 - DNA, 20 bp, Homo sapiens
tccctgcttcacgattctta

SEQ ID NO: 5643469 - DNA, 20 bp, Homo sapiens
tccctgcttgcacacttccc

SEQ ID NO: 5643470 - DNA, 23 bp, Homo sapiens
tccctgcttgcaggaggccaaac

SEQ ID NO: 5643471 - DNA, 15 bp, Homo sapiens
tccctgcttgcccgc

SEQ ID NO: 5643472 - DNA, 15 bp, Homo sapiens
tccctgctttgcatc

SEQ ID NO: 5643473 - DNA, 16 bp, Homo sapiens
tccctgctttgcatct

SEQ ID NO: 5643474 - DNA, 19 bp, Homo sapiens
tccctgctttggctgaggg

SEQ ID NO: 5643475 - DNA, 20 bp, Homo sapiens
tccctgctttggctgagggg

SEQ ID NO: 5643476 - DNA, 18 bp, Homo sapiens
tccctgcttttctcccag

SEQ ID NO: 5643477 - DNA, 19 bp, Homo sapiens
tccctgcttttctcccaga

SEQ ID NO: 5643478 - DNA, 20 bp, Homo sapiens
tccctggaactcctggcctt

SEQ ID NO: 5643479 - DNA, 11 bp, Homo sapiens
tccctggaagc

SEQ ID NO: 5643480 - DNA, 15 bp, Homo sapiens
tccctggaagctgga

SEQ ID NO: 5643481 - DNA, 19 bp, Homo sapiens
tccctggaagctggaagac

SEQ ID NO: 5643482 - DNA, 13 bp, Homo sapiens
tccctggaagctt

SEQ ID NO: 5643483 - DNA, 18 bp, Homo sapiens
tccctggaaggacatcca

SEQ ID NO: 5643484 - DNA, 13 bp, Homo sapiens
tccctggaaggtg

SEQ ID NO: 5643485 - DNA, 12 bp, Homo sapiens
tccctggacaca

SEQ ID NO: 5643486 - DNA, 13 bp, Homo sapiens
tccctggacacag

SEQ ID NO: 5643487 - DNA, 18 bp, Homo sapiens
tccctggacacagctctt

SEQ ID NO: 5643488 - DNA, 20 bp, Homo sapiens
tccctggacacagctcttca

SEQ ID NO: 5643489 - DNA, 11 bp, Homo sapiens
tccctggacag

SEQ ID NO: 5643490 - DNA, 15 bp, Homo sapiens
tccctggacaggcag

SEQ ID NO: 5643491 - DNA, 22 bp, Homo sapiens
tccctggacaggcagcctcctt

SEQ ID NO: 5643492 - DNA, 23 bp, Homo sapiens
tccctggacaggcagcctccttt

SEQ ID NO: 5643493 - DNA, 17 bp, Homo sapiens
tccctggaccagcctcc

SEQ ID NO: 5643494 - DNA, 16 bp, Homo sapiens
tccctggaccccattc

SEQ ID NO: 5643495 - DNA, 20 bp, Homo sapiens
tccctggacgcatgcagggc

SEQ ID NO: 5643496 - DNA, 20 bp, Homo sapiens
tccctggagaaaaaaattgc

SEQ ID NO: 5643497 - DNA, 13 bp, Homo sapiens
tccctggagaagg

SEQ ID NO: 5643498 - DNA, 21 bp, Homo sapiens
tccctggagaagggacatggg

SEQ ID NO: 5643499 - DNA, 11 bp, Homo sapiens
tccctggagac

SEQ ID NO: 5643500 - DNA, 16 bp, Homo sapiens
tccctggagcaggagc

SEQ ID NO: 5643501 - DNA, 22 bp, Homo sapiens
tccctggagccagactctggtc

SEQ ID NO: 5643502 - DNA, 14 bp, Homo sapiens
tccctggagctgag

SEQ ID NO: 5643503 - DNA, 19 bp, Homo sapiens
tccctggagctgtccttca

SEQ ID NO: 5643504 - DNA, 20 bp, Homo sapiens
tccctggagctgtccttcat

SEQ ID NO: 5643505 - DNA, 23 bp, Homo sapiens
tccctggaggagaagtattcctg

SEQ ID NO: 5643506 - DNA, 23 bp, Homo sapiens
tccctggaggcacgcaccactgc

SEQ ID NO: 5643507 - DNA, 21 bp, Homo sapiens
tccctggagggcaagccctgc

SEQ ID NO: 5643508 - DNA, 10 bp, Homo sapiens
tccctggagt

SEQ ID NO: 5643509 - DNA, 13 bp, Homo sapiens
tccctggagtcag

SEQ ID NO: 5643510 - DNA, 24 bp, Homo sapiens
tccctggagtcagggtgaactgca

SEQ ID NO: 5643511 - DNA, 21 bp, Homo sapiens
tccctggagtgtggctgagga

SEQ ID NO: 5643512 - DNA, 18 bp, Homo sapiens
tccctggatgacattaaa

SEQ ID NO: 5643513 - DNA, 21 bp, Homo sapiens
tccctggatgtgaagctcaca

SEQ ID NO: 5643514 - DNA, 15 bp, Homo sapiens
tccctggcagacaca

SEQ ID NO: 5643515 - DNA, 13 bp, Homo sapiens
tccctggcaggtg

SEQ ID NO: 5643516 - DNA, 22 bp, Homo sapiens
tccctggcatgaccatcctgtc

SEQ ID NO: 5643517 - DNA, 16 bp, Homo sapiens
tccctggcatgatgga

SEQ ID NO: 5643518 - DNA, 14 bp, Homo sapiens
tccctggccacctg

SEQ ID NO: 5643519 - DNA, 14 bp, Homo sapiens
tccctggccatctc

SEQ ID NO: 5643520 - DNA, 11 bp, Homo sapiens
tccctggccca

SEQ ID NO: 5643521 - DNA, 12 bp, Homo sapiens
tccctggcccca

SEQ ID NO: 5643522 - DNA, 13 bp, Homo sapiens
tccctggccccag

SEQ ID NO: 5643523 - DNA, 17 bp, Homo sapiens
tccctggccccagtgac

SEQ ID NO: 5643524 - DNA, 18 bp, Homo sapiens
tccctggccccctccctg

SEQ ID NO: 5643525 - DNA, 22 bp, Homo sapiens
tccctggccgcttctccccaga

SEQ ID NO: 5643526 - DNA, 18 bp, Homo sapiens
tccctggcctgttctgtt

SEQ ID NO: 5643527 - DNA, 11 bp, Homo sapiens
tccctggcctt

SEQ ID NO: 5643528 - DNA, 15 bp, Homo sapiens
tccctggccttgccc

SEQ ID NO: 5643529 - DNA, 15 bp, Homo sapiens
tccctggcctttcat

SEQ ID NO: 5643530 - DNA, 21 bp, Homo sapiens
tccctggcgcaggtgggctgg

SEQ ID NO: 5643531 - DNA, 15 bp, Homo sapiens
tccctggcggcccca

SEQ ID NO: 5643532 - DNA, 19 bp, Homo sapiens
tccctggcgtcctctccct

SEQ ID NO: 5643533 - DNA, 14 bp, Homo sapiens
tccctggctacttc

SEQ ID NO: 5643534 - DNA, 20 bp, Homo sapiens
tccctggctacttcccttcc

SEQ ID NO: 5643535 - DNA, 12 bp, Homo sapiens
tccctggctcag

SEQ ID NO: 5643536 - DNA, 17 bp, Homo sapiens
tccctggctcagggatc

SEQ ID NO: 5643537 - DNA, 12 bp, Homo sapiens
tccctggctccc

SEQ ID NO: 5643538 - DNA, 13 bp, Homo sapiens
tccctggctcctc

SEQ ID NO: 5643539 - DNA, 15 bp, Homo sapiens
tccctggctcctccg

SEQ ID NO: 5643540 - DNA, 18 bp, Homo sapiens
tccctggctcctccgtct

SEQ ID NO: 5643541 - DNA, 19 bp, Homo sapiens
tccctggctctcagaaggt

SEQ ID NO: 5643542 - DNA, 12 bp, Homo sapiens
tccctggctgca

SEQ ID NO: 5643543 - DNA, 17 bp, Homo sapiens
tccctggctgcagcctc

SEQ ID NO: 5643544 - DNA, 20 bp, Homo sapiens
tccctggctgccctggccct

SEQ ID NO: 5643545 - DNA, 21 bp, Homo sapiens
tccctggctgccctggccctg

SEQ ID NO: 5643546 - DNA, 19 bp, Homo sapiens
tccctggctgcctctggga

SEQ ID NO: 5643547 - DNA, 23 bp, Homo sapiens
tccctggctgtgagcagcctcca

SEQ ID NO: 5643548 - DNA, 15 bp, Homo sapiens
tccctggcttcctta

SEQ ID NO: 5643549 - DNA, 12 bp, Homo sapiens
tccctggcttct

SEQ ID NO: 5643550 - DNA, 14 bp, Homo sapiens
tccctggcttctgt

SEQ ID NO: 5643551 - DNA, 20 bp, Homo sapiens
tccctggcttgagtgatcct

SEQ ID NO: 5643552 - DNA, 18 bp, Homo sapiens
tccctggcttgtaactcc

SEQ ID NO: 5643553 - DNA, 21 bp, Homo sapiens
tccctgggaaaggggttgtca

SEQ ID NO: 5643554 - DNA, 23 bp, Homo sapiens
tccctgggaagcctgtgccagca

SEQ ID NO: 5643555 - DNA, 22 bp, Homo sapiens
tccctgggacacagacccagga

SEQ ID NO: 5643556 - DNA, 17 bp, Homo sapiens
tccctgggagcaagttg

SEQ ID NO: 5643557 - DNA, 19 bp, Homo sapiens
tccctgggagcaagttgca

SEQ ID NO: 5643558 - DNA, 19 bp, Homo sapiens
tccctgggaggaaatttga

SEQ ID NO: 5643559 - DNA, 15 bp, Homo sapiens
tccctgggagggagg

SEQ ID NO: 5643560 - DNA, 21 bp, Homo sapiens
tccctgggagtgttcccgtgc

SEQ ID NO: 5643561 - DNA, 22 bp, Homo sapiens
tccctgggatggacgctgccgg

SEQ ID NO: 5643562 - DNA, 20 bp, Homo sapiens
tccctgggcaccctgcaggc

SEQ ID NO: 5643563 - DNA, 22 bp, Homo sapiens
tccctgggcaccctgcaggcag

SEQ ID NO: 5643564 - DNA, 17 bp, Homo sapiens
tccctgggcattgcttt

SEQ ID NO: 5643565 - DNA, 20 bp, Homo sapiens
tccctgggccacctcctacc

SEQ ID NO: 5643566 - DNA, 21 bp, Homo sapiens
tccctgggccacctcctaccc

SEQ ID NO: 5643567 - DNA, 22 bp, Homo sapiens
tccctgggccacctcctacccc

SEQ ID NO: 5643568 - DNA, 11 bp, Homo sapiens
tccctgggcct

SEQ ID NO: 5643569 - DNA, 15 bp, Homo sapiens
tcccttttcctgtca

SEQ ID NO: 5643570 - DNA, 12 bp, Homo sapiens
tcccttttcctt

SEQ ID NO: 5643571 - DNA, 15 bp, Homo sapiens
tcccttttcctttct

SEQ ID NO: 5643572 - DNA, 20 bp, Homo sapiens
tcccttttctgttctagttt

SEQ ID NO: 5643573 - DNA, 21 bp, Homo sapiens
tcccttttctgtttaggaaga

SEQ ID NO: 5643574 - DNA, 17 bp, Homo sapiens
tcccttttctttaagtt

SEQ ID NO: 5643575 - DNA, 15 bp, Homo sapiens
tcccttttctttcct

SEQ ID NO: 5643576 - DNA, 17 bp, Homo sapiens
tcccttttctttccttt

SEQ ID NO: 5643577 - DNA, 14 bp, Homo sapiens
tcccttttctttga

SEQ ID NO: 5643578 - DNA, 16 bp, Homo sapiens
tccctttttaaaaaat

SEQ ID NO: 5643579 - DNA, 18 bp, Homo sapiens
tccctttttctccacact

SEQ ID NO: 5643580 - DNA, 22 bp, Homo sapiens
tccctttttctccacactccac

SEQ ID NO: 5643581 - DNA, 16 bp, Homo sapiens
tccctttttttaagta

SEQ ID NO: 5643582 - DNA, 16 bp, Homo sapiens
tcccttttttttctgg

SEQ ID NO: 5643583 - DNA, 18 bp, Homo sapiens
tccgaaagtctgaatctc

SEQ ID NO: 5643584 - DNA, 20 bp, Homo sapiens
tccgaaatgctgtctttctt

SEQ ID NO: 5643585 - DNA, 15 bp, Homo sapiens
tccgaacagttgggg

SEQ ID NO: 5643586 - DNA, 17 bp, Homo sapiens
tccgaacctcctctgtg

SEQ ID NO: 5643587 - DNA, 18 bp, Homo sapiens
tccgaacctcctctgtga

SEQ ID NO: 5643588 - DNA, 22 bp, Homo sapiens
tccgaacctcctctgtgaagca

SEQ ID NO: 5643589 - DNA, 21 bp, Homo sapiens
tccgaactgttcaagtgtccc

SEQ ID NO: 5643590 - DNA, 13 bp, Homo sapiens
tccgaagaaaaga

SEQ ID NO: 5643591 - DNA, 16 bp, Homo sapiens
tccgaagaaaagaatt

SEQ ID NO: 5643592 - DNA, 20 bp, Homo sapiens
tccgaaggtgtctctggtct

SEQ ID NO: 5643593 - DNA, 22 bp, Homo sapiens
tccgaaggtgtctctggtcttc

SEQ ID NO: 5643594 - DNA, 22 bp, Homo sapiens
tccgacaaccgatgctccagcc

SEQ ID NO: 5643595 - DNA, 17 bp, Homo sapiens
tccgacacatttaccaa

SEQ ID NO: 5643596 - DNA, 20 bp, Homo sapiens
tccgacacatttaccaaatt

SEQ ID NO: 5643597 - DNA, 14 bp, Homo sapiens
tccgacaccactgg

SEQ ID NO: 5643598 - DNA, 15 bp, Homo sapiens
tccgacaccactggg

SEQ ID NO: 5643599 - DNA, 17 bp, Homo sapiens
tccgacatcccagacca

SEQ ID NO: 5643600 - DNA, 15 bp, Homo sapiens
tccgaccctcatggc

SEQ ID NO: 5643601 - DNA, 17 bp, Homo sapiens
tccgaccctctgggaac

SEQ ID NO: 5643602 - DNA, 17 bp, Homo sapiens
tccgacctacgttcctg

SEQ ID NO: 5643603 - DNA, 15 bp, Homo sapiens
tccgactctaagctg

SEQ ID NO: 5643604 - DNA, 19 bp, Homo sapiens
tccgactctttctgagtgc

SEQ ID NO: 5643605 - DNA, 23 bp, Homo sapiens
tccgactgcccctgctgtgctgc

SEQ ID NO: 5643606 - DNA, 14 bp, Homo sapiens
tccgacttcccctg

SEQ ID NO: 5643607 - DNA, 16 bp, Homo sapiens
tccgacttcccctggg

SEQ ID NO: 5643608 - DNA, 12 bp, Homo sapiens
tccgagaactaa

SEQ ID NO: 5643609 - DNA, 14 bp, Homo sapiens
tccgagaagctctc

SEQ ID NO: 5643610 - DNA, 20 bp, Homo sapiens
tccgagacaccacaaggcag

SEQ ID NO: 5643611 - DNA, 14 bp, Homo sapiens
tccgagacagccgg

SEQ ID NO: 5643612 - DNA, 17 bp, Homo sapiens
tccgagagagcacccct

SEQ ID NO: 5643613 - DNA, 17 bp, Homo sapiens
tccgagaggcagccaga

SEQ ID NO: 5643614 - DNA, 13 bp, Homo sapiens
tccgagagggaga

SEQ ID NO: 5643615 - DNA, 14 bp, Homo sapiens
tccgagatccccag

SEQ ID NO: 5643616 - DNA, 21 bp, Homo sapiens
tccgagcattccagtaacttt

SEQ ID NO: 5643617 - DNA, 13 bp, Homo sapiens
tccgagcccctgt

SEQ ID NO: 5643618 - DNA, 24 bp, Homo sapiens
tccgagccggggagtttctttcct

SEQ ID NO: 5643619 - DNA, 14 bp, Homo sapiens
tccgagctctggtg

SEQ ID NO: 5643620 - DNA, 15 bp, Homo sapiens
tccgagctctgtcct

SEQ ID NO: 5643621 - DNA, 18 bp, Homo sapiens
tccgagctgaggactctg

SEQ ID NO: 5643622 - DNA, 17 bp, Homo sapiens
tccgagctgctttgtgg

SEQ ID NO: 5643623 - DNA, 21 bp, Homo sapiens
tccgaggacccaggaaaggca

SEQ ID NO: 5643624 - DNA, 15 bp, Homo sapiens
tccgaggactggact

SEQ ID NO: 5643625 - DNA, 16 bp, Homo sapiens
tccgaggactggactg

SEQ ID NO: 5643626 - DNA, 14 bp, Homo sapiens
tccgaggcctacct

SEQ ID NO: 5643627 - DNA, 20 bp, Homo sapiens
tccgaggcctacctgctccc

SEQ ID NO: 5643628 - DNA, 22 bp, Homo sapiens
tccgaggcctggctctggagcc

SEQ ID NO: 5643629 - DNA, 19 bp, Homo sapiens
tccgaggctccccgcctcc

SEQ ID NO: 5643630 - DNA, 16 bp, Homo sapiens
tccgagggcggccagg

SEQ ID NO: 5643631 - DNA, 21 bp, Homo sapiens
tccgagggcggccagggacag

SEQ ID NO: 5643632 - DNA, 23 bp, Homo sapiens
tccgagtgtgatttgaattctgt

SEQ ID NO: 5643633 - DNA, 19 bp, Homo sapiens
tccgagtgtgtttcatcct

SEQ ID NO: 5643634 - DNA, 18 bp, Homo sapiens
tccgatcaacatttatga

SEQ ID NO: 5643635 - DNA, 16 bp, Homo sapiens
tccgatgcccgcccgg

SEQ ID NO: 5643636 - DNA, 16 bp, Homo sapiens
tccgatgctgaggcca

SEQ ID NO: 5643637 - DNA, 16 bp, Homo sapiens
tccgattaatttatgg

SEQ ID NO: 5643638 - DNA, 19 bp, Homo sapiens
tccgattaatttatggttt

SEQ ID NO: 5643639 - DNA, 17 bp, Homo sapiens
tccgcaacccatgccct

SEQ ID NO: 5643640 - DNA, 23 bp, Homo sapiens
tccgcaatgtggagcagcagcca

SEQ ID NO: 5643641 - DNA, 21 bp, Homo sapiens
tccgcacagaaaatacgagaa

SEQ ID NO: 5643642 - DNA, 21 bp, Homo sapiens
tccgcaccagctgctctgccc

SEQ ID NO: 5643643 - DNA, 19 bp, Homo sapiens
tccgcaccctccctagctc

SEQ ID NO: 5643644 - DNA, 12 bp, Homo sapiens
tccgcaccctgc

SEQ ID NO: 5643645 - DNA, 18 bp, Homo sapiens
tccgcaccctgtcctgca

SEQ ID NO: 5643646 - DNA, 20 bp, Homo sapiens
tccgcaccctgtcctgcaca

SEQ ID NO: 5643647 - DNA, 16 bp, Homo sapiens
tccgcacgcggccgct

SEQ ID NO: 5643648 - DNA, 18 bp, Homo sapiens
tccgcacgcggccgctct

SEQ ID NO: 5643649 - DNA, 19 bp, Homo sapiens
tccgcacgcggccgctctc

SEQ ID NO: 5643650 - DNA, 13 bp, Homo sapiens
tccgcacttggaa

SEQ ID NO: 5643651 - DNA, 15 bp, Homo sapiens
tccgcactttccact

SEQ ID NO: 5643652 - DNA, 22 bp, Homo sapiens
tccgcactttccacttcttcct

SEQ ID NO: 5643653 - DNA, 13 bp, Homo sapiens
tccgcagcccagg

SEQ ID NO: 5643654 - DNA, 20 bp, Homo sapiens
tccgcagcccctttccccac

SEQ ID NO: 5643655 - DNA, 12 bp, Homo sapiens
tccgcaggactt

SEQ ID NO: 5643656 - DNA, 19 bp, Homo sapiens
tccgcaggctatttgttca

SEQ ID NO: 5643657 - DNA, 18 bp, Homo sapiens
tccgcagtgtggccaggc

SEQ ID NO: 5643658 - DNA, 16 bp, Homo sapiens
tccgcagttgtagcag

SEQ ID NO: 5643659 - DNA, 16 bp, Homo sapiens
tccgcataagaaaaag

SEQ ID NO: 5643660 - DNA, 21 bp, Homo sapiens
tccgcatccagccgtgctgag

SEQ ID NO: 5643661 - DNA, 12 bp, Homo sapiens
tccgcatgtgtc

SEQ ID NO: 5643662 - DNA, 14 bp, Homo sapiens
tccgcatgtgtctg

SEQ ID NO: 5643663 - DNA, 16 bp, Homo sapiens
tccgcatgtgtctgta

SEQ ID NO: 5643664 - DNA, 17 bp, Homo sapiens
tccgcatgtgtctgtat

SEQ ID NO: 5643665 - DNA, 18 bp, Homo sapiens
tccgcatgtgtctgtatt

SEQ ID NO: 5643666 - DNA, 16 bp, Homo sapiens
tccgccacgaggagct

SEQ ID NO: 5643667 - DNA, 14 bp, Homo sapiens
tccgccactcagcc

SEQ ID NO: 5643668 - DNA, 15 bp, Homo sapiens
tccgccactcagcca

SEQ ID NO: 5643669 - DNA, 14 bp, Homo sapiens
tccgccactccagt

SEQ ID NO: 5643670 - DNA, 15 bp, Homo sapiens
tccgccactggggct

SEQ ID NO: 5643671 - DNA, 19 bp, Homo sapiens
tccgccagaccccgtggct

SEQ ID NO: 5643672 - DNA, 15 bp, Homo sapiens
tccgccagccacagg

SEQ ID NO: 5643673 - DNA, 17 bp, Homo sapiens
tccgccagccacaggac

SEQ ID NO: 5643674 - DNA, 12 bp, Homo sapiens
tccgccagcctc

SEQ ID NO: 5643675 - DNA, 17 bp, Homo sapiens
tccgccagcctcctctg

SEQ ID NO: 5643676 - DNA, 18 bp, Homo sapiens
tccgccagcctcctctgg

SEQ ID NO: 5643677 - DNA, 13 bp, Homo sapiens
tccgccagggccc

SEQ ID NO: 5643678 - DNA, 19 bp, Homo sapiens
tccgccagggcccacaccc

SEQ ID NO: 5643679 - DNA, 17 bp, Homo sapiens
tccgccatccagggtct

SEQ ID NO: 5643680 - DNA, 22 bp, Homo sapiens
tccgccatccagggtctggcag

SEQ ID NO: 5643681 - DNA, 20 bp, Homo sapiens
tccgccatggtgtcccggta

SEQ ID NO: 5643682 - DNA, 21 bp, Homo sapiens
tccgcccacaggaagcctgca

SEQ ID NO: 5643683 - DNA, 19 bp, Homo sapiens
tccgcccacctcagcctcc

SEQ ID NO: 5643684 - DNA, 17 bp, Homo sapiens
tccgccccagacacacc

SEQ ID NO: 5643685 - DNA, 11 bp, Homo sapiens
tccgcccccag

SEQ ID NO: 5643686 - DNA, 13 bp, Homo sapiens
tccgcccccagcc

SEQ ID NO: 5643687 - DNA, 14 bp, Homo sapiens
tccgcccccaggta

SEQ ID NO: 5643688 - DNA, 19 bp, Homo sapiens
tccgccccccggcctggcc

SEQ ID NO: 5643689 - DNA, 15 bp, Homo sapiens
tccgccccgtccccc

SEQ ID NO: 5643690 - DNA, 15 bp, Homo sapiens
tccgccccttccctt

SEQ ID NO: 5643691 - DNA, 12 bp, Homo sapiens
tccgcccgccca

SEQ ID NO: 5643692 - DNA, 14 bp, Homo sapiens
tccgcccgcccacc

SEQ ID NO: 5643693 - DNA, 16 bp, Homo sapiens
tccgcccgcccacccc

SEQ ID NO: 5643694 - DNA, 21 bp, Homo sapiens
tccgcccgccgccctggacag

SEQ ID NO: 5643695 - DNA, 19 bp, Homo sapiens
tccgcccgcctctgcctcc

SEQ ID NO: 5643696 - DNA, 21 bp, Homo sapiens
tccgccctccgctggctccga

SEQ ID NO: 5643697 - DNA, 12 bp, Homo sapiens
tccgccctgctc

SEQ ID NO: 5643698 - DNA, 20 bp, Homo sapiens
tccgccctgctcctccctgg

SEQ ID NO: 5643699 - DNA, 22 bp, Homo sapiens
tccgccctgctcctccctggct

SEQ ID NO: 5643700 - DNA, 18 bp, Homo sapiens
tccgcctacctcagcctc

SEQ ID NO: 5643701 - DNA, 17 bp, Homo sapiens
tccgcctactgtccctc

SEQ ID NO: 5643702 - DNA, 12 bp, Homo sapiens
tccgcctccaca

SEQ ID NO: 5643703 - DNA, 20 bp, Homo sapiens
tccgcctccacactgaccaa

SEQ ID NO: 5643704 - DNA, 16 bp, Homo sapiens
tccgcctcccatcccg

SEQ ID NO: 5643705 - DNA, 16 bp, Homo sapiens
tccgcctctgagccag

SEQ ID NO: 5643706 - DNA, 17 bp, Homo sapiens
tccgcctctgctggcac

SEQ ID NO: 5643707 - DNA, 13 bp, Homo sapiens
tccgcctgcctct

SEQ ID NO: 5643708 - DNA, 16 bp, Homo sapiens
tccgcctgcctctgcc

SEQ ID NO: 5643709 - DNA, 15 bp, Homo sapiens
tccgcctgcgcctcc

SEQ ID NO: 5643710 - DNA, 21 bp, Homo sapiens
tccgcctgctgggaagagctc

SEQ ID NO: 5643711 - DNA, 18 bp, Homo sapiens
tccgcctggcacccactc

SEQ ID NO: 5643712 - DNA, 13 bp, Homo sapiens
tccgcctgtgggc

SEQ ID NO: 5643713 - DNA, 18 bp, Homo sapiens
tccgccttgctgagactt

SEQ ID NO: 5643714 - DNA, 13 bp, Homo sapiens
tccgccttttgta

SEQ ID NO: 5643715 - DNA, 19 bp, Homo sapiens
tccgcgaaaatagtttgtt

SEQ ID NO: 5643716 - DNA, 13 bp, Homo sapiens
tccgcgagcctgc

SEQ ID NO: 5643717 - DNA, 15 bp, Homo sapiens
tccgcgcccagcgct

SEQ ID NO: 5643718 - DNA, 19 bp, Homo sapiens
tccgcgcccagcgctcgcc

SEQ ID NO: 5643719 - DNA, 20 bp, Homo sapiens
tccgcgccctccgacctctc

SEQ ID NO: 5643720 - DNA, 18 bp, Homo sapiens
tccgcgccgatgccaccg

SEQ ID NO: 5643721 - DNA, 20 bp, Homo sapiens
tccgcgcggagacctcctga

SEQ ID NO: 5643722 - DNA, 23 bp, Homo sapiens
tccgcgcggagacctcctgacaa

SEQ ID NO: 5643723 - DNA, 19 bp, Homo sapiens
tccgcggagcccttggccc

SEQ ID NO: 5643724 - DNA, 13 bp, Homo sapiens
tccgcggcctgca

SEQ ID NO: 5643725 - DNA, 15 bp, Homo sapiens
tccgcggcctgcacc

SEQ ID NO: 5643726 - DNA, 14 bp, Homo sapiens
tccgcggctggagc

SEQ ID NO: 5643727 - DNA, 17 bp, Homo sapiens
tccgcgggagacccctt

SEQ ID NO: 5643728 - DNA, 19 bp, Homo sapiens
tccgcgggctgactgggcc

SEQ ID NO: 5643729 - DNA, 12 bp, Homo sapiens
tccgcggggacc

SEQ ID NO: 5643730 - DNA, 16 bp, Homo sapiens
tccgcggggaccctgc

SEQ ID NO: 5643731 - DNA, 16 bp, Homo sapiens
tccgcgggtgggactc

SEQ ID NO: 5643732 - DNA, 17 bp, Homo sapiens
tccgcgtggttctgcca

SEQ ID NO: 5643733 - DNA, 19 bp, Homo sapiens
tccgctaagacctccccac

SEQ ID NO: 5643734 - DNA, 20 bp, Homo sapiens
tccgctaagacctccccacc

SEQ ID NO: 5643735 - DNA, 17 bp, Homo sapiens
tccgctaatctcttcta

SEQ ID NO: 5643736 - DNA, 12 bp, Homo sapiens
tccgctcagcca

SEQ ID NO: 5643737 - DNA, 12 bp, Homo sapiens
tccgctcccacc

SEQ ID NO: 5643738 - DNA, 17 bp, Homo sapiens
tccgctcccctttccca

SEQ ID NO: 5643739 - DNA, 12 bp, Homo sapiens
tccgctctcttc

SEQ ID NO: 5643740 - DNA, 18 bp, Homo sapiens
tccgctctcttcctgccc

SEQ ID NO: 5643741 - DNA, 20 bp, Homo sapiens
tccgctctgaggcaaccccc

SEQ ID NO: 5643742 - DNA, 22 bp, Homo sapiens
tccgctgccaccacgtctgcca

SEQ ID NO: 5643743 - DNA, 14 bp, Homo sapiens
tccgctgccgtgcc

SEQ ID NO: 5643744 - DNA, 12 bp, Homo sapiens
tccgctgcctgg

SEQ ID NO: 5643745 - DNA, 20 bp, Homo sapiens
tccgctgcgggcccagctga

SEQ ID NO: 5643746 - DNA, 12 bp, Homo sapiens
tccgctggaggt

SEQ ID NO: 5643747 - DNA, 16 bp, Homo sapiens
tccgctggctttggga

SEQ ID NO: 5643748 - DNA, 14 bp, Homo sapiens
tccgctgtcaccca

SEQ ID NO: 5643749 - DNA, 21 bp, Homo sapiens
tcctacatccagctcctctag

SEQ ID NO: 5643750 - DNA, 20 bp, Homo sapiens
tcctacatcttcttcccagt

SEQ ID NO: 5643751 - DNA, 20 bp, Homo sapiens
tcctacattaattatctagt

SEQ ID NO: 5643752 - DNA, 15 bp, Homo sapiens
tcctaccaatgcatg

SEQ ID NO: 5643753 - DNA, 21 bp, Homo sapiens
tcctaccacccggtccccact

SEQ ID NO: 5643754 - DNA, 16 bp, Homo sapiens
tcctaccactggacag

SEQ ID NO: 5643755 - DNA, 24 bp, Homo sapiens
tcctaccagttgccctagcccaga

SEQ ID NO: 5643756 - DNA, 22 bp, Homo sapiens
tcctacccagcgtggcccaggc

SEQ ID NO: 5643757 - DNA, 14 bp, Homo sapiens
tcctacccatcccc

SEQ ID NO: 5643758 - DNA, 16 bp, Homo sapiens
tcctaccccaattcct

SEQ ID NO: 5643759 - DNA, 18 bp, Homo sapiens
tcctaccccaattccttg

SEQ ID NO: 5643760 - DNA, 14 bp, Homo sapiens
tcctaccccatctc

SEQ ID NO: 5643761 - DNA, 19 bp, Homo sapiens
tcctaccccatctccaaga

SEQ ID NO: 5643762 - DNA, 13 bp, Homo sapiens
tcctaccccctgt

SEQ ID NO: 5643763 - DNA, 17 bp, Homo sapiens
tcctaccccctgtgcct

SEQ ID NO: 5643764 - DNA, 15 bp, Homo sapiens
tcctacccctcccag

SEQ ID NO: 5643765 - DNA, 16 bp, Homo sapiens
tcctacccctcccagc

SEQ ID NO: 5643766 - DNA, 18 bp, Homo sapiens
tcctacccctcccagctg

SEQ ID NO: 5643767 - DNA, 12 bp, Homo sapiens
tcctacccctct

SEQ ID NO: 5643768 - DNA, 19 bp, Homo sapiens
tcctacccctcttccagct

SEQ ID NO: 5643769 - DNA, 20 bp, Homo sapiens
tcctacccctcttccagctt

SEQ ID NO: 5643770 - DNA, 15 bp, Homo sapiens
tcctacccctgtcct

SEQ ID NO: 5643771 - DNA, 16 bp, Homo sapiens
tcctaccccttcctgt

SEQ ID NO: 5643772 - DNA, 18 bp, Homo sapiens
tcctaccccttcctgtcc

SEQ ID NO: 5643773 - DNA, 19 bp, Homo sapiens
tcctaccccttcctgtcct

SEQ ID NO: 5643774 - DNA, 21 bp, Homo sapiens
tcctaccctcccaccagaacg

SEQ ID NO: 5643775 - DNA, 15 bp, Homo sapiens
tcctaccctgcgccc

SEQ ID NO: 5643776 - DNA, 14 bp, Homo sapiens
tcctacccttttct

SEQ ID NO: 5643777 - DNA, 14 bp, Homo sapiens
tcctaccgtactcc

SEQ ID NO: 5643778 - DNA, 18 bp, Homo sapiens
tcctaccgtactccctgc

SEQ ID NO: 5643779 - DNA, 15 bp, Homo sapiens
tcctacctcaaaatt

SEQ ID NO: 5643780 - DNA, 12 bp, Homo sapiens
tcctacctcagc

SEQ ID NO: 5643781 - DNA, 17 bp, Homo sapiens
tcctacctcagcctaga

SEQ ID NO: 5643782 - DNA, 20 bp, Homo sapiens
tcctacctcagcctcctggg

SEQ ID NO: 5643783 - DNA, 15 bp, Homo sapiens
tcctacctctgtgcc

SEQ ID NO: 5643784 - DNA, 19 bp, Homo sapiens
tcctacctgaaggcagggc

SEQ ID NO: 5643785 - DNA, 16 bp, Homo sapiens
tcctacctgccctgga

SEQ ID NO: 5643786 - DNA, 18 bp, Homo sapiens
tcctacctgccctggaac

SEQ ID NO: 5643787 - DNA, 15 bp, Homo sapiens
tcctacctgctgctg

SEQ ID NO: 5643788 - DNA, 10 bp, Homo sapiens
tcctacctgg

SEQ ID NO: 5643789 - DNA, 23 bp, Homo sapiens
tcctacctgggggcagaactcct

SEQ ID NO: 5643790 - DNA, 14 bp, Homo sapiens
tcctacctgtctgc

SEQ ID NO: 5643791 - DNA, 16 bp, Homo sapiens
tcctacctgtctgctg

SEQ ID NO: 5643792 - DNA, 17 bp, Homo sapiens
tcctaccttttgtctct

SEQ ID NO: 5643793 - DNA, 22 bp, Homo sapiens
tcctactccagccccttcaatt

SEQ ID NO: 5643794 - DNA, 18 bp, Homo sapiens
tcctactccctcttccaa

SEQ ID NO: 5643795 - DNA, 15 bp, Homo sapiens
tcctactccgttcct

SEQ ID NO: 5643796 - DNA, 16 bp, Homo sapiens
tcctactccgttcctg

SEQ ID NO: 5643797 - DNA, 17 bp, Homo sapiens
tcctactcctcatagca

SEQ ID NO: 5643798 - DNA, 14 bp, Homo sapiens
tcctactcctgact

SEQ ID NO: 5643799 - DNA, 19 bp, Homo sapiens
tcctactcggctctgcagt

SEQ ID NO: 5643800 - DNA, 19 bp, Homo sapiens
tcctactctgggaagaatg

SEQ ID NO: 5643801 - DNA, 20 bp, Homo sapiens
tcctactctgggaagaatgt

SEQ ID NO: 5643802 - DNA, 13 bp, Homo sapiens
tcctactctgtgt

SEQ ID NO: 5643803 - DNA, 18 bp, Homo sapiens
tcctactcttctctctgc

SEQ ID NO: 5643804 - DNA, 17 bp, Homo sapiens
tcctactgcgcgttttc

SEQ ID NO: 5643805 - DNA, 17 bp, Homo sapiens
tcctactggtctctcta

SEQ ID NO: 5643806 - DNA, 13 bp, Homo sapiens
tcctactgtcctg

SEQ ID NO: 5643807 - DNA, 15 bp, Homo sapiens
tcctactgtcctgga

SEQ ID NO: 5643808 - DNA, 16 bp, Homo sapiens
tcctacttaaacaaaa

SEQ ID NO: 5643809 - DNA, 18 bp, Homo sapiens
tcctacttgcagtacatc

SEQ ID NO: 5643810 - DNA, 20 bp, Homo sapiens
tcctactttagccactggtt

SEQ ID NO: 5643811 - DNA, 16 bp, Homo sapiens
tcctacttttaaagaa

SEQ ID NO: 5643812 - DNA, 17 bp, Homo sapiens
tcctagaaaacccttcc

SEQ ID NO: 5643813 - DNA, 22 bp, Homo sapiens
tcctagaaattccccaccctga

SEQ ID NO: 5643814 - DNA, 19 bp, Homo sapiens
tcctagaaccaagcttcag

SEQ ID NO: 5643815 - DNA, 21 bp, Homo sapiens
tcctagaagaaccaaatacct

SEQ ID NO: 5643816 - DNA, 23 bp, Homo sapiens
tcctagaagaaccaaatacctca

SEQ ID NO: 5643817 - DNA, 20 bp, Homo sapiens
tcctagaagagtcaggaagg

SEQ ID NO: 5643818 - DNA, 17 bp, Homo sapiens
tcctagaagtcttaatt

SEQ ID NO: 5643819 - DNA, 22 bp, Homo sapiens
tcctagaagtcttaattgtgtt

SEQ ID NO: 5643820 - DNA, 21 bp, Homo sapiens
tcctagaagtggtttgtagac

SEQ ID NO: 5643821 - DNA, 19 bp, Homo sapiens
tcctagaagttactgaatg

SEQ ID NO: 5643822 - DNA, 18 bp, Homo sapiens
tcctagaatgtttcattt

SEQ ID NO: 5643823 - DNA, 14 bp, Homo sapiens
tcctagactgctcc

SEQ ID NO: 5643824 - DNA, 17 bp, Homo sapiens
tcctagactgctcctgg

SEQ ID NO: 5643825 - DNA, 21 bp, Homo sapiens
tcctagactgctcctgggcat

SEQ ID NO: 5643826 - DNA, 18 bp, Homo sapiens
tcctagacttgaaagttt

SEQ ID NO: 5643827 - DNA, 22 bp, Homo sapiens
tcctagagaaaacttgaattca

SEQ ID NO: 5643828 - DNA, 17 bp, Homo sapiens
tcctagagaacgcagcc

SEQ ID NO: 5643829 - DNA, 19 bp, Homo sapiens
tcctagagaacgcagccct

SEQ ID NO: 5643830 - DNA, 18 bp, Homo sapiens
tcctagagaggagaaagg

SEQ ID NO: 5643831 - DNA, 21 bp, Homo sapiens
tcctagagaggctggcaagga

SEQ ID NO: 5643832 - DNA, 22 bp, Homo sapiens
tcctagagcatctgtcccactg

SEQ ID NO: 5643833 - DNA, 13 bp, Homo sapiens
tcctagagctcct

SEQ ID NO: 5643834 - DNA, 16 bp, Homo sapiens
tcctagagctcctgtc

SEQ ID NO: 5643835 - DNA, 21 bp, Homo sapiens
tcctagagctcctgtccctac

SEQ ID NO: 5643836 - DNA, 14 bp, Homo sapiens
tcctagaggacctg

SEQ ID NO: 5643837 - DNA, 17 bp, Homo sapiens
tcctagaggagacagcc

SEQ ID NO: 5643838 - DNA, 15 bp, Homo sapiens
tcctagaggtgggca

SEQ ID NO: 5643839 - DNA, 19 bp, Homo sapiens
tcctagaggtgggcagctg

SEQ ID NO: 5643840 - DNA, 21 bp, Homo sapiens
tcctagaggtgggcagctggg

SEQ ID NO: 5643841 - DNA, 14 bp, Homo sapiens
tcctagatcctaag

SEQ ID NO: 5643842 - DNA, 19 bp, Homo sapiens
tcctagatctgcaggctgc

SEQ ID NO: 5643843 - DNA, 15 bp, Homo sapiens
tcctagcaaatttct

SEQ ID NO: 5643844 - DNA, 22 bp, Homo sapiens
tcctagcaagtaagaatggcca

SEQ ID NO: 5643845 - DNA, 20 bp, Homo sapiens
tcctagcacaaggagtgccc

SEQ ID NO: 5643846 - DNA, 17 bp, Homo sapiens
tcctagcacacactttt

SEQ ID NO: 5643847 - DNA, 12 bp, Homo sapiens
tcctagcacaga

SEQ ID NO: 5643848 - DNA, 20 bp, Homo sapiens
tcctagcacagatggccagc

SEQ ID NO: 5643849 - DNA, 21 bp, Homo sapiens
tcctagcacagatggccagcc

SEQ ID NO: 5643850 - DNA, 17 bp, Homo sapiens
tcctagcacatgcttca

SEQ ID NO: 5643851 - DNA, 19 bp, Homo sapiens
tcctagcacatgcttcaat

SEQ ID NO: 5643852 - DNA, 18 bp, Homo sapiens
tcctagcaccctggagag

SEQ ID NO: 5643853 - DNA, 20 bp, Homo sapiens
tcctagcacttgtctcagga

SEQ ID NO: 5643854 - DNA, 20 bp, Homo sapiens
tcctagcactttgggaggcc

SEQ ID NO: 5643855 - DNA, 15 bp, Homo sapiens
tcctagcagagagac

SEQ ID NO: 5643856 - DNA, 16 bp, Homo sapiens
tcctagcaggatctgc

SEQ ID NO: 5643857 - DNA, 20 bp, Homo sapiens
tcctagccacccaccacact

SEQ ID NO: 5643858 - DNA, 17 bp, Homo sapiens
tcctagccactcaggag

SEQ ID NO: 5643859 - DNA, 19 bp, Homo sapiens
tcctagcccagtgcttctc

SEQ ID NO: 5643860 - DNA, 13 bp, Homo sapiens
tcctagccctcct

SEQ ID NO: 5643861 - DNA, 12 bp, Homo sapiens
tcctagcccttc

SEQ ID NO: 5643862 - DNA, 15 bp, Homo sapiens
tcctagcccttccct

SEQ ID NO: 5643863 - DNA, 17 bp, Homo sapiens
tcctagcccttccctga

SEQ ID NO: 5643864 - DNA, 19 bp, Homo sapiens
tcctagcccttccctgagt

SEQ ID NO: 5643865 - DNA, 17 bp, Homo sapiens
tcctagcctgctctgcc

SEQ ID NO: 5643866 - DNA, 18 bp, Homo sapiens
tcctagcctgctctgcca

SEQ ID NO: 5643867 - DNA, 21 bp, Homo sapiens
tcctagcctgtgcctctggga

SEQ ID NO: 5643868 - DNA, 15 bp, Homo sapiens
tcctagcctgtttct

SEQ ID NO: 5643869 - DNA, 20 bp, Homo sapiens
tcctagccttatcctctgat

SEQ ID NO: 5643870 - DNA, 15 bp, Homo sapiens
tcctagcctttgggc

SEQ ID NO: 5643871 - DNA, 19 bp, Homo sapiens
tcctagctacttggcaggc

SEQ ID NO: 5643872 - DNA, 15 bp, Homo sapiens
tcctagctctcccag

SEQ ID NO: 5643873 - DNA, 18 bp, Homo sapiens
tcctagctctcccagtga

SEQ ID NO: 5643874 - DNA, 14 bp, Homo sapiens
tcctagctgacgcc

SEQ ID NO: 5643875 - DNA, 16 bp, Homo sapiens
tcctagctgcacaggg

SEQ ID NO: 5643876 - DNA, 15 bp, Homo sapiens
tcctagctgtccttt

SEQ ID NO: 5643877 - DNA, 19 bp, Homo sapiens
tcctagcttatctccctgc

SEQ ID NO: 5643878 - DNA, 22 bp, Homo sapiens
tcctagcttgggaggcttcccc

SEQ ID NO: 5643879 - DNA, 18 bp, Homo sapiens
tcctaggaaaaaaggaat

SEQ ID NO: 5643880 - DNA, 11 bp, Homo sapiens
tcctaggactt

SEQ ID NO: 5643881 - DNA, 13 bp, Homo sapiens
tcctaggagaagc

SEQ ID NO: 5643882 - DNA, 17 bp, Homo sapiens
tcctaggaggaaaattc

SEQ ID NO: 5643883 - DNA, 18 bp, Homo sapiens
tcctaggagtatcctcat

SEQ ID NO: 5643884 - DNA, 17 bp, Homo sapiens
tcctaggcatctgctgt

SEQ ID NO: 5643885 - DNA, 19 bp, Homo sapiens
tcctaggcattctggacct

SEQ ID NO: 5643886 - DNA, 23 bp, Homo sapiens
tcctaggcattctggacctctgg

SEQ ID NO: 5643887 - DNA, 14 bp, Homo sapiens
tcctaggcatttgc

SEQ ID NO: 5643888 - DNA, 21 bp, Homo sapiens
tcctaggcgctcagaggccgc

SEQ ID NO: 5643889 - DNA, 22 bp, Homo sapiens
tcctaggctccaccccatccag

SEQ ID NO: 5643890 - DNA, 22 bp, Homo sapiens
tcctaggctccctgaggtacct

SEQ ID NO: 5643891 - DNA, 18 bp, Homo sapiens
tcctaggctcctgggagg

SEQ ID NO: 5643892 - DNA, 21 bp, Homo sapiens
tcctaggctcctgggaggccc

SEQ ID NO: 5643893 - DNA, 16 bp, Homo sapiens
tcctaggctggaagcc

SEQ ID NO: 5643894 - DNA, 21 bp, Homo sapiens
tcctagggatctgaaatccat

SEQ ID NO: 5643895 - DNA, 19 bp, Homo sapiens
tcctaggggaacagaccag

SEQ ID NO: 5643896 - DNA, 20 bp, Homo sapiens
tcctaggggaacagaccagt

SEQ ID NO: 5643897 - DNA, 16 bp, Homo sapiens
tcctaggggaaggggg

SEQ ID NO: 5643898 - DNA, 17 bp, Homo sapiens
tcctaggggcttggtcc

SEQ ID NO: 5643899 - DNA, 17 bp, Homo sapiens
tcctagggtcttgtgtt

SEQ ID NO: 5643900 - DNA, 14 bp, Homo sapiens
tcctaggtccaagc

SEQ ID NO: 5643901 - DNA, 15 bp, Homo sapiens
tcctaggtccaagcc

SEQ ID NO: 5643902 - DNA, 16 bp, Homo sapiens
tcctaggtcctctgag

SEQ ID NO: 5643903 - DNA, 23 bp, Homo sapiens
tcctagtaagaacgtactttctg

SEQ ID NO: 5643904 - DNA, 13 bp, Homo sapiens
tcctagtaagaag

SEQ ID NO: 5643905 - DNA, 19 bp, Homo sapiens
tcctagtaagtcaggacag

SEQ ID NO: 5643906 - DNA, 20 bp, Homo sapiens
tcctagtatacccactgcat

SEQ ID NO: 5643907 - DNA, 13 bp, Homo sapiens
tcctagtatatta

SEQ ID NO: 5643908 - DNA, 23 bp, Homo sapiens
tcctagtatattagtttgattta

SEQ ID NO: 5643909 - DNA, 18 bp, Homo sapiens
tcctagtctccctcacag

SEQ ID NO: 5643910 - DNA, 16 bp, Homo sapiens
tcctagtcttcacaac

SEQ ID NO: 5643911 - DNA, 16 bp, Homo sapiens
tcctagtctttccagt

SEQ ID NO: 5643912 - DNA, 16 bp, Homo sapiens
tcctagtgaaccacag

SEQ ID NO: 5643913 - DNA, 22 bp, Homo sapiens
tcctagtgagtgtgctgacttt

SEQ ID NO: 5643914 - DNA, 18 bp, Homo sapiens
tcctagtggatgactgtt

SEQ ID NO: 5643915 - DNA, 14 bp, Homo sapiens
tcctagtggtgtca

SEQ ID NO: 5643916 - DNA, 22 bp, Homo sapiens
tcctagtggtgtcatttttgaa

SEQ ID NO: 5643917 - DNA, 18 bp, Homo sapiens
tcctagtgtctttaaata

SEQ ID NO: 5643918 - DNA, 21 bp, Homo sapiens
tcctagttaatcatcattttt

SEQ ID NO: 5643919 - DNA, 19 bp, Homo sapiens
tcctagttcatcccttctc

SEQ ID NO: 5643920 - DNA, 21 bp, Homo sapiens
tcctagttccaccatcaagcc

SEQ ID NO: 5643921 - DNA, 22 bp, Homo sapiens
tcctagttccaccatcaagcca

SEQ ID NO: 5643922 - DNA, 19 bp, Homo sapiens
tcctagttctagaaaaaca

SEQ ID NO: 5643923 - DNA, 22 bp, Homo sapiens
tcctagttctagaaaaacaggc

SEQ ID NO: 5643924 - DNA, 23 bp, Homo sapiens
tcctagttcttaagcatttgcgt

SEQ ID NO: 5643925 - DNA, 21 bp, Homo sapiens
tcctcctcacccacctctggg

SEQ ID NO: 5643926 - DNA, 18 bp, Homo sapiens
tcctcctcacccttcccg

SEQ ID NO: 5643927 - DNA, 20 bp, Homo sapiens
tcctcctcacccttcccggc

SEQ ID NO: 5643928 - DNA, 22 bp, Homo sapiens
tcctcctcagcccccaggccag

SEQ ID NO: 5643929 - DNA, 18 bp, Homo sapiens
tcctcctcatcctccctg

SEQ ID NO: 5643930 - DNA, 12 bp, Homo sapiens
tcctcctcatga

SEQ ID NO: 5643931 - DNA, 21 bp, Homo sapiens
tcctcctccaaaggcccccta

SEQ ID NO: 5643932 - DNA, 18 bp, Homo sapiens
tcctcctccaccaccgcc

SEQ ID NO: 5643933 - DNA, 14 bp, Homo sapiens
tcctcctccagggt

SEQ ID NO: 5643934 - DNA, 18 bp, Homo sapiens
tcctcctccatcacctga

SEQ ID NO: 5643935 - DNA, 20 bp, Homo sapiens
tcctcctccatctttctaca

SEQ ID NO: 5643936 - DNA, 14 bp, Homo sapiens
tcctcctcccaact

SEQ ID NO: 5643937 - DNA, 13 bp, Homo sapiens
tcctcctcccaag

SEQ ID NO: 5643938 - DNA, 15 bp, Homo sapiens
tcctcctcccctcct

SEQ ID NO: 5643939 - DNA, 14 bp, Homo sapiens
tcctcctccctgca

SEQ ID NO: 5643940 - DNA, 14 bp, Homo sapiens
tcctcctcctcctg

SEQ ID NO: 5643941 - DNA, 15 bp, Homo sapiens
tcctcctcctcctgt

SEQ ID NO: 5643942 - DNA, 14 bp, Homo sapiens
tcctcctcctgggc

SEQ ID NO: 5643943 - DNA, 16 bp, Homo sapiens
tcctcctcctgttcct

SEQ ID NO: 5643944 - DNA, 14 bp, Homo sapiens
tcctcctcgctcct

SEQ ID NO: 5643945 - DNA, 17 bp, Homo sapiens
tcctcctcgctcctcct

SEQ ID NO: 5643946 - DNA, 23 bp, Homo sapiens
tcctcctcggaaccgctcaccta

SEQ ID NO: 5643947 - DNA, 14 bp, Homo sapiens
tcctcctcggaaga

SEQ ID NO: 5643948 - DNA, 13 bp, Homo sapiens
tcctcctctcctg

SEQ ID NO: 5643949 - DNA, 16 bp, Homo sapiens
tcctcctctctctact

SEQ ID NO: 5643950 - DNA, 15 bp, Homo sapiens
tcctcctctgtgaaa

SEQ ID NO: 5643951 - DNA, 18 bp, Homo sapiens
tcctcctcttcaccaggt

SEQ ID NO: 5643952 - DNA, 12 bp, Homo sapiens
tcctcctctttc

SEQ ID NO: 5643953 - DNA, 13 bp, Homo sapiens
tcctcctctttct

SEQ ID NO: 5643954 - DNA, 19 bp, Homo sapiens
tcctcctctttctctcccc

SEQ ID NO: 5643955 - DNA, 14 bp, Homo sapiens
tcctcctgaagcct

SEQ ID NO: 5643956 - DNA, 22 bp, Homo sapiens
tcctcctgaagcctctgccctg

SEQ ID NO: 5643957 - DNA, 21 bp, Homo sapiens
tcctcctgacaccccacttag

SEQ ID NO: 5643958 - DNA, 21 bp, Homo sapiens
tcctcctgacagcgacagaaa

SEQ ID NO: 5643959 - DNA, 19 bp, Homo sapiens
tcctcctgagtagctggga

SEQ ID NO: 5643960 - DNA, 20 bp, Homo sapiens
tcctcctgagtagctgggat

SEQ ID NO: 5643961 - DNA, 12 bp, Homo sapiens
tcctcctgcaga

SEQ ID NO: 5643962 - DNA, 20 bp, Homo sapiens
tcctcctgcagacacctgga

SEQ ID NO: 5643963 - DNA, 22 bp, Homo sapiens
tcctcctgcagacacctggact

SEQ ID NO: 5643964 - DNA, 21 bp, Homo sapiens
tcctcctgcatgtcggggccc

SEQ ID NO: 5643965 - DNA, 12 bp, Homo sapiens
tcctcctgccag

SEQ ID NO: 5643966 - DNA, 14 bp, Homo sapiens
tcctcctgccagct

SEQ ID NO: 5643967 - DNA, 17 bp, Homo sapiens
tcctcctgccagctctg

SEQ ID NO: 5643968 - DNA, 16 bp, Homo sapiens
tcctcctgcccacctg

SEQ ID NO: 5643969 - DNA, 19 bp, Homo sapiens
tcctcctgcccagctcctc

SEQ ID NO: 5643970 - DNA, 22 bp, Homo sapiens
tcctcctgcccagctcctcaca

SEQ ID NO: 5643971 - DNA, 13 bp, Homo sapiens
tcctcctgcctca

SEQ ID NO: 5643972 - DNA, 17 bp, Homo sapiens
tcctcctgcctcagcct

SEQ ID NO: 5643973 - DNA, 21 bp, Homo sapiens
tcctcctgcctcagccttcca

SEQ ID NO: 5643974 - DNA, 13 bp, Homo sapiens
tcctcctgccttt

SEQ ID NO: 5643975 - DNA, 18 bp, Homo sapiens
tcctcctgcctttctcaa

SEQ ID NO: 5643976 - DNA, 13 bp, Homo sapiens
tcctcctgctcct

SEQ ID NO: 5643977 - DNA, 13 bp, Homo sapiens
tcctcctgctctg

SEQ ID NO: 5643978 - DNA, 14 bp, Homo sapiens
tcctcctgctctgc

SEQ ID NO: 5643979 - DNA, 15 bp, Homo sapiens
tcctcctgctctgct

SEQ ID NO: 5643980 - DNA, 18 bp, Homo sapiens
tcctcctgctctgcttcc

SEQ ID NO: 5643981 - DNA, 11 bp, Homo sapiens
tcctcctgctg

SEQ ID NO: 5643982 - DNA, 15 bp, Homo sapiens
tcctcctgctgccag

SEQ ID NO: 5643983 - DNA, 16 bp, Homo sapiens
tcctcctgctgctcac

SEQ ID NO: 5643984 - DNA, 17 bp, Homo sapiens
tcctcctgctgctcact

SEQ ID NO: 5643985 - DNA, 23 bp, Homo sapiens
tcctcctgctgtagtcctttctg

SEQ ID NO: 5643986 - DNA, 20 bp, Homo sapiens
tcctcctggacccagcaggg

SEQ ID NO: 5643987 - DNA, 12 bp, Homo sapiens
tcctcctggcac

SEQ ID NO: 5643988 - DNA, 13 bp, Homo sapiens
tcctcctggcacc

SEQ ID NO: 5643989 - DNA, 18 bp, Homo sapiens
tcctcctggcacctgagt

SEQ ID NO: 5643990 - DNA, 13 bp, Homo sapiens
tcctcctggcctg

SEQ ID NO: 5643991 - DNA, 13 bp, Homo sapiens
tcctcctgggagc

SEQ ID NO: 5643992 - DNA, 13 bp, Homo sapiens
tcctcctgggggc

SEQ ID NO: 5643993 - DNA, 16 bp, Homo sapiens
tcctcctgtgtcactg

SEQ ID NO: 5643994 - DNA, 12 bp, Homo sapiens
tcctcctgtgtg

SEQ ID NO: 5643995 - DNA, 12 bp, Homo sapiens
tcctcctgttca

SEQ ID NO: 5643996 - DNA, 16 bp, Homo sapiens
tcctcctgttcatctg

SEQ ID NO: 5643997 - DNA, 21 bp, Homo sapiens
tcctcctgttcctgccttctc

SEQ ID NO: 5643998 - DNA, 20 bp, Homo sapiens
tcctccttccccccatctct

SEQ ID NO: 5643999 - DNA, 15 bp, Homo sapiens
tcctccttcccctcc

SEQ ID NO: 5644000 - DNA, 18 bp, Homo sapiens
tcctccttcccctgtggt

SEQ ID NO: 5644001 - DNA, 20 bp, Homo sapiens
tcctccttccggggaaggat

SEQ ID NO: 5644002 - DNA, 16 bp, Homo sapiens
tcctccttgggcaggg

SEQ ID NO: 5644003 - DNA, 16 bp, Homo sapiens
tcctccttggtgcctg

SEQ ID NO: 5644004 - DNA, 19 bp, Homo sapiens
tcctccttgtcttggcagc

SEQ ID NO: 5644005 - DNA, 13 bp, Homo sapiens
tcctcctttctct

SEQ ID NO: 5644006 - DNA, 16 bp, Homo sapiens
tcctcctttctctgta

SEQ ID NO: 5644007 - DNA, 18 bp, Homo sapiens
tcctcctttctctgtata

SEQ ID NO: 5644008 - DNA, 16 bp, Homo sapiens
tcctcctttctgaggg

SEQ ID NO: 5644009 - DNA, 20 bp, Homo sapiens
tcctcctttgcctaggaggc

SEQ ID NO: 5644010 - DNA, 19 bp, Homo sapiens
tcctccttttcacagttct

SEQ ID NO: 5644011 - DNA, 17 bp, Homo sapiens
tcctcgaacccactccg

SEQ ID NO: 5644012 - DNA, 18 bp, Homo sapiens
tcctcgaagtcccggctt

SEQ ID NO: 5644013 - DNA, 23 bp, Homo sapiens
tcctcgagatcccaacactgcca

SEQ ID NO: 5644014 - DNA, 12 bp, Homo sapiens
tcctcgagccct

SEQ ID NO: 5644015 - DNA, 14 bp, Homo sapiens
tcctcgagccctcc

SEQ ID NO: 5644016 - DNA, 15 bp, Homo sapiens
tcctcgagccctccc

SEQ ID NO: 5644017 - DNA, 16 bp, Homo sapiens
tcctcgagccctcccc

SEQ ID NO: 5644018 - DNA, 14 bp, Homo sapiens
tcctcgcaagctgg

SEQ ID NO: 5644019 - DNA, 15 bp, Homo sapiens
tcctcgcaagctggg

SEQ ID NO: 5644020 - DNA, 16 bp, Homo sapiens
tcctcgcaagctgggt

SEQ ID NO: 5644021 - DNA, 19 bp, Homo sapiens
tcctcgcactgcccaggga

SEQ ID NO: 5644022 - DNA, 16 bp, Homo sapiens
tcctcgcagagaggcc

SEQ ID NO: 5644023 - DNA, 14 bp, Homo sapiens
tcctcgcagcctct

SEQ ID NO: 5644024 - DNA, 13 bp, Homo sapiens
tcctcgccctggg

SEQ ID NO: 5644025 - DNA, 18 bp, Homo sapiens
tcctcgcctaggcctgtg

SEQ ID NO: 5644026 - DNA, 13 bp, Homo sapiens
tcctcgcctgaca

SEQ ID NO: 5644027 - DNA, 12 bp, Homo sapiens
tcctcgctcctc

SEQ ID NO: 5644028 - DNA, 17 bp, Homo sapiens
tcctcgctcctccttcc

SEQ ID NO: 5644029 - DNA, 18 bp, Homo sapiens
tcctcgctcctccttccc

SEQ ID NO: 5644030 - DNA, 16 bp, Homo sapiens
tcctcgctgtgccacc

SEQ ID NO: 5644031 - DNA, 20 bp, Homo sapiens
tcctcggacacccagggtct

SEQ ID NO: 5644032 - DNA, 18 bp, Homo sapiens
tcctcggagagcagcagc

SEQ ID NO: 5644033 - DNA, 13 bp, Homo sapiens
tcctcggagctgg

SEQ ID NO: 5644034 - DNA, 14 bp, Homo sapiens
tcctcggagctggt

SEQ ID NO: 5644035 - DNA, 18 bp, Homo sapiens
tcctcggagctggttcct

SEQ ID NO: 5644036 - DNA, 19 bp, Homo sapiens
tcctcggatcaccgagagt

SEQ ID NO: 5644037 - DNA, 13 bp, Homo sapiens
tcctcggcagctc

SEQ ID NO: 5644038 - DNA, 15 bp, Homo sapiens
tcctcggcagctccg

SEQ ID NO: 5644039 - DNA, 15 bp, Homo sapiens
tcctcggccagagct

SEQ ID NO: 5644040 - DNA, 18 bp, Homo sapiens
tcctcggccagagctccc

SEQ ID NO: 5644041 - DNA, 21 bp, Homo sapiens
tcctcggccagagctcccagg

SEQ ID NO: 5644042 - DNA, 14 bp, Homo sapiens
tcctcggcccatct

SEQ ID NO: 5644043 - DNA, 23 bp, Homo sapiens
tcctcggcccatctgtccatcct

SEQ ID NO: 5644044 - DNA, 14 bp, Homo sapiens
tcctcggccccctc

SEQ ID NO: 5644045 - DNA, 18 bp, Homo sapiens
tcctcggccctgtagccc

SEQ ID NO: 5644046 - DNA, 14 bp, Homo sapiens
tcctcggcctggct

SEQ ID NO: 5644047 - DNA, 20 bp, Homo sapiens
tcctcgggatgaaaagccat

SEQ ID NO: 5644048 - DNA, 18 bp, Homo sapiens
tcctcgggatgccgttct

SEQ ID NO: 5644049 - DNA, 22 bp, Homo sapiens
tcctcgggatgccgttctgttc

SEQ ID NO: 5644050 - DNA, 17 bp, Homo sapiens
tcctcgggccctgtggt

SEQ ID NO: 5644051 - DNA, 16 bp, Homo sapiens
tcctcgggccgaggcc

SEQ ID NO: 5644052 - DNA, 19 bp, Homo sapiens
tcctcgggccgaggcccag

SEQ ID NO: 5644053 - DNA, 16 bp, Homo sapiens
tcctcggggctccagg

SEQ ID NO: 5644054 - DNA, 18 bp, Homo sapiens
tcctcggggctccaggct

SEQ ID NO: 5644055 - DNA, 22 bp, Homo sapiens
tcctcggtaaaccgaggaccca

SEQ ID NO: 5644056 - DNA, 14 bp, Homo sapiens
tcctcggtctccct

SEQ ID NO: 5644057 - DNA, 15 bp, Homo sapiens
tcctcggtctccctt

SEQ ID NO: 5644058 - DNA, 14 bp, Homo sapiens
tcctcggtggcatt

SEQ ID NO: 5644059 - DNA, 20 bp, Homo sapiens
tcctcggtggcatttgctga

SEQ ID NO: 5644060 - DNA, 17 bp, Homo sapiens
tcctcggtggctctggg

SEQ ID NO: 5644061 - DNA, 19 bp, Homo sapiens
tcctcggtggctctggggt

SEQ ID NO: 5644062 - DNA, 18 bp, Homo sapiens
tcctcggtgggccagagc

SEQ ID NO: 5644063 - DNA, 17 bp, Homo sapiens
tcctcgtccggcctgca

SEQ ID NO: 5644064 - DNA, 21 bp, Homo sapiens
tcctcgtccggcctgcagccc

SEQ ID NO: 5644065 - DNA, 23 bp, Homo sapiens
tcctcgtgggtcccagagacctc

SEQ ID NO: 5644066 - DNA, 23 bp, Homo sapiens
tcctcgttcaaaacattccaaga

SEQ ID NO: 5644067 - DNA, 15 bp, Homo sapiens
tcctcgttcctttct

SEQ ID NO: 5644068 - DNA, 15 bp, Homo sapiens
tcctcgttctccctg

SEQ ID NO: 5644069 - DNA, 15 bp, Homo sapiens
tcctcgtttgtgttc

SEQ ID NO: 5644070 - DNA, 16 bp, Homo sapiens
tcctcgtttgtgttct

SEQ ID NO: 5644071 - DNA, 21 bp, Homo sapiens
tcctctaacaggggctggtgg

SEQ ID NO: 5644072 - DNA, 15 bp, Homo sapiens
tcctctaacatttgc

SEQ ID NO: 5644073 - DNA, 19 bp, Homo sapiens
tcctctaactcactgccta

SEQ ID NO: 5644074 - DNA, 20 bp, Homo sapiens
tcctctaactcactgcctag

SEQ ID NO: 5644075 - DNA, 16 bp, Homo sapiens
tcctctaacttggctc

SEQ ID NO: 5644076 - DNA, 21 bp, Homo sapiens
tcctctaagatcttgcctctt

SEQ ID NO: 5644077 - DNA, 21 bp, Homo sapiens
tcctctaagccactcttccaa

SEQ ID NO: 5644078 - DNA, 22 bp, Homo sapiens
tcctctaattaaaatgtgcagt

SEQ ID NO: 5644079 - DNA, 17 bp, Homo sapiens
tcctctacctctctcct

SEQ ID NO: 5644080 - DNA, 14 bp, Homo sapiens
tcctctactcttac

SEQ ID NO: 5644081 - DNA, 22 bp, Homo sapiens
tcctctagaaataggttaaact

SEQ ID NO: 5644082 - DNA, 14 bp, Homo sapiens
tcctctagaagcca

SEQ ID NO: 5644083 - DNA, 17 bp, Homo sapiens
tcctctagaagccaagg

SEQ ID NO: 5644084 - DNA, 16 bp, Homo sapiens
tcctctagaaggctga

SEQ ID NO: 5644085 - DNA, 19 bp, Homo sapiens
tcctctagctacactattg

SEQ ID NO: 5644086 - DNA, 15 bp, Homo sapiens
tcctctagctaccat

SEQ ID NO: 5644087 - DNA, 15 bp, Homo sapiens
tcctctagctgtggg

SEQ ID NO: 5644088 - DNA, 14 bp, Homo sapiens
tcctctagcttttc

SEQ ID NO: 5644089 - DNA, 21 bp, Homo sapiens
tcctctaggaggtctctaaga

SEQ ID NO: 5644090 - DNA, 18 bp, Homo sapiens
tcctctaggcaagcagga

SEQ ID NO: 5644091 - DNA, 21 bp, Homo sapiens
tcctctagtaagatgcactga

SEQ ID NO: 5644092 - DNA, 15 bp, Homo sapiens
tcctctataattagt

SEQ ID NO: 5644093 - DNA, 20 bp, Homo sapiens
tcctctattaattactgtgt

SEQ ID NO: 5644094 - DNA, 14 bp, Homo sapiens
tcctctatttcttt

SEQ ID NO: 5644095 - DNA, 18 bp, Homo sapiens
tcctctattttgtgatga

SEQ ID NO: 5644096 - DNA, 20 bp, Homo sapiens
tcctctcaaattcagctctg

SEQ ID NO: 5644097 - DNA, 21 bp, Homo sapiens
tcctctcaaccacctttcaga

SEQ ID NO: 5644098 - DNA, 19 bp, Homo sapiens
tcctctcaactgcctcagc

SEQ ID NO: 5644099 - DNA, 13 bp, Homo sapiens
tcctctcaataaa

SEQ ID NO: 5644100 - DNA, 19 bp, Homo sapiens
tcctctcaccccactcctg

SEQ ID NO: 5644101 - DNA, 15 bp, Homo sapiens
tcctctcactcccca

SEQ ID NO: 5644102 - DNA, 13 bp, Homo sapiens
tcctctcactcct

SEQ ID NO: 5644103 - DNA, 18 bp, Homo sapiens
tcctctcactcctgcctc

SEQ ID NO: 5644104 - DNA, 18 bp, Homo sapiens
tcctctcagagcctcagc

SEQ ID NO: 5644105 - DNA, 16 bp, Homo sapiens
tcctgcctggccaggc

SEQ ID NO: 5644106 - DNA, 20 bp, Homo sapiens
tcctgcctgggtgggacagc

SEQ ID NO: 5644107 - DNA, 23 bp, Homo sapiens
tcctgcctgggtgggacagcctc

SEQ ID NO: 5644108 - DNA, 16 bp, Homo sapiens
tcctgcctggtcctcc

SEQ ID NO: 5644109 - DNA, 14 bp, Homo sapiens
tcctgcctggtctc

SEQ ID NO: 5644110 - DNA, 17 bp, Homo sapiens
tcctgcctggtctcctg

SEQ ID NO: 5644111 - DNA, 18 bp, Homo sapiens
tcctgcctggtctcctgc

SEQ ID NO: 5644112 - DNA, 21 bp, Homo sapiens
tcctgcctggtctcctgcccc

SEQ ID NO: 5644113 - DNA, 18 bp, Homo sapiens
tcctgcctgtctgaagcc

SEQ ID NO: 5644114 - DNA, 17 bp, Homo sapiens
tcctgcctgtctgcccc

SEQ ID NO: 5644115 - DNA, 19 bp, Homo sapiens
tcctgcctgtctgccccag

SEQ ID NO: 5644116 - DNA, 12 bp, Homo sapiens
tcctgcctgtgg

SEQ ID NO: 5644117 - DNA, 23 bp, Homo sapiens
tcctgccttcctcctgggccctc

SEQ ID NO: 5644118 - DNA, 15 bp, Homo sapiens
tcctgccttctcttc

SEQ ID NO: 5644119 - DNA, 21 bp, Homo sapiens
tcctgccttctcttctatcct

SEQ ID NO: 5644120 - DNA, 13 bp, Homo sapiens
tcctgccttctgt

SEQ ID NO: 5644121 - DNA, 17 bp, Homo sapiens
tcctgccttctgtcctg

SEQ ID NO: 5644122 - DNA, 22 bp, Homo sapiens
tcctgccttcttctttttgctg

SEQ ID NO: 5644123 - DNA, 11 bp, Homo sapiens
tcctgccttga

SEQ ID NO: 5644124 - DNA, 16 bp, Homo sapiens
tcctgccttgaaaaag

SEQ ID NO: 5644125 - DNA, 22 bp, Homo sapiens
tcctgccttgatgaagcccgtg

SEQ ID NO: 5644126 - DNA, 21 bp, Homo sapiens
tcctgccttgatgaagcctgt

SEQ ID NO: 5644127 - DNA, 14 bp, Homo sapiens
tcctgcctttaagc

SEQ ID NO: 5644128 - DNA, 23 bp, Homo sapiens
tcctgcctttaagccaaagaaac

SEQ ID NO: 5644129 - DNA, 17 bp, Homo sapiens
tcctgcctttcttccat

SEQ ID NO: 5644130 - DNA, 18 bp, Homo sapiens
tcctgcgccccgcccaca

SEQ ID NO: 5644131 - DNA, 19 bp, Homo sapiens
tcctgcgccccgcccacac

SEQ ID NO: 5644132 - DNA, 20 bp, Homo sapiens
tcctgcgcctgcgcctcctc

SEQ ID NO: 5644133 - DNA, 22 bp, Homo sapiens
tcctgcgcctgcgcctcctcct

SEQ ID NO: 5644134 - DNA, 15 bp, Homo sapiens
tcctgcgctctgcca

SEQ ID NO: 5644135 - DNA, 19 bp, Homo sapiens
tcctgcggagtgaagaggg

SEQ ID NO: 5644136 - DNA, 23 bp, Homo sapiens
tcctgcggagtgaagaggggcag

SEQ ID NO: 5644137 - DNA, 21 bp, Homo sapiens
tcctgcggctcagccttgcac

SEQ ID NO: 5644138 - DNA, 20 bp, Homo sapiens
tcctgcgggcttttccccgg

SEQ ID NO: 5644139 - DNA, 13 bp, Homo sapiens
tcctgcgggtggg

SEQ ID NO: 5644140 - DNA, 14 bp, Homo sapiens
tcctgcgtcctcct

SEQ ID NO: 5644141 - DNA, 18 bp, Homo sapiens
tcctgcgtcctcctcacc

SEQ ID NO: 5644142 - DNA, 16 bp, Homo sapiens
tcctgcgttcagcccc

SEQ ID NO: 5644143 - DNA, 23 bp, Homo sapiens
tcctgcgttcagcccctgatctc

SEQ ID NO: 5644144 - DNA, 17 bp, Homo sapiens
tcctgctaaaacaatga

SEQ ID NO: 5644145 - DNA, 20 bp, Homo sapiens
tcctgctaacggtgctcagg

SEQ ID NO: 5644146 - DNA, 20 bp, Homo sapiens
tcctgctacaacttcagcag

SEQ ID NO: 5644147 - DNA, 21 bp, Homo sapiens
tcctgctacaacttcagcagt

SEQ ID NO: 5644148 - DNA, 14 bp, Homo sapiens
tcctgctacaggag

SEQ ID NO: 5644149 - DNA, 15 bp, Homo sapiens
tcctgctacaggagg

SEQ ID NO: 5644150 - DNA, 16 bp, Homo sapiens
tcctgctacaggaggg

SEQ ID NO: 5644151 - DNA, 21 bp, Homo sapiens
tcctgctacctcccttgcctt

SEQ ID NO: 5644152 - DNA, 23 bp, Homo sapiens
tcctgctacctcccttgcctttc

SEQ ID NO: 5644153 - DNA, 18 bp, Homo sapiens
tcctgctacctttgtctc

SEQ ID NO: 5644154 - DNA, 22 bp, Homo sapiens
tcctgctacttccccagctctc

SEQ ID NO: 5644155 - DNA, 19 bp, Homo sapiens
tcctgctagcacctcccca

SEQ ID NO: 5644156 - DNA, 19 bp, Homo sapiens
tcctgctatgacagctggc

SEQ ID NO: 5644157 - DNA, 20 bp, Homo sapiens
tcctgctatgacagctggct

SEQ ID NO: 5644158 - DNA, 22 bp, Homo sapiens
tcctgctatgacagctggctag

SEQ ID NO: 5644159 - DNA, 19 bp, Homo sapiens
tcctgctatttcccaagct

SEQ ID NO: 5644160 - DNA, 22 bp, Homo sapiens
tcctgctcaactctacccctgc

SEQ ID NO: 5644161 - DNA, 16 bp, Homo sapiens
tcctgctcaccacctg

SEQ ID NO: 5644162 - DNA, 19 bp, Homo sapiens
tcctgctcaccacctgcct

SEQ ID NO: 5644163 - DNA, 15 bp, Homo sapiens
tcctgctcacctgtg

SEQ ID NO: 5644164 - DNA, 17 bp, Homo sapiens
tcctgctcagatgctgg

SEQ ID NO: 5644165 - DNA, 14 bp, Homo sapiens
tcctgctccacagt

SEQ ID NO: 5644166 - DNA, 18 bp, Homo sapiens
tcctgctccacagtgttg

SEQ ID NO: 5644167 - DNA, 16 bp, Homo sapiens
tcctgctccagcagca

SEQ ID NO: 5644168 - DNA, 17 bp, Homo sapiens
tcctgctccagcagcac

SEQ ID NO: 5644169 - DNA, 18 bp, Homo sapiens
tcctgctccagcagcaca

SEQ ID NO: 5644170 - DNA, 20 bp, Homo sapiens
tcctgctccagcagcacacc

SEQ ID NO: 5644171 - DNA, 16 bp, Homo sapiens
tcctgctccatgactg

SEQ ID NO: 5644172 - DNA, 21 bp, Homo sapiens
tcctgctccatgactggctgt

SEQ ID NO: 5644173 - DNA, 23 bp, Homo sapiens
tcctgctccatgactggctgtct

SEQ ID NO: 5644174 - DNA, 14 bp, Homo sapiens
tcctgctccgctgc

SEQ ID NO: 5644175 - DNA, 15 bp, Homo sapiens
tcctgctccgctgcc

SEQ ID NO: 5644176 - DNA, 22 bp, Homo sapiens
tcctgctcctcacccctgtagg

SEQ ID NO: 5644177 - DNA, 16 bp, Homo sapiens
tcctgctcctcaggaa

SEQ ID NO: 5644178 - DNA, 13 bp, Homo sapiens
tcctgctcctttt

SEQ ID NO: 5644179 - DNA, 20 bp, Homo sapiens
tcctgctccttttcctcttt

SEQ ID NO: 5644180 - DNA, 14 bp, Homo sapiens
tcctgctcgccctg

SEQ ID NO: 5644181 - DNA, 15 bp, Homo sapiens
tcctgctcgccctgt

SEQ ID NO: 5644182 - DNA, 17 bp, Homo sapiens
tcctgctcgccctgtgc

SEQ ID NO: 5644183 - DNA, 15 bp, Homo sapiens
tcctgctctctaccc

SEQ ID NO: 5644184 - DNA, 19 bp, Homo sapiens
tcctgctctctacccagcc

SEQ ID NO: 5644185 - DNA, 21 bp, Homo sapiens
tcctgctctctacccagccca

SEQ ID NO: 5644186 - DNA, 18 bp, Homo sapiens
tcctgctctctgctcatg

SEQ ID NO: 5644187 - DNA, 15 bp, Homo sapiens
tcctgctctcttcag

SEQ ID NO: 5644188 - DNA, 16 bp, Homo sapiens
tcctgctctcttcagg

SEQ ID NO: 5644189 - DNA, 17 bp, Homo sapiens
tcctgctctcttcagga

SEQ ID NO: 5644190 - DNA, 21 bp, Homo sapiens
tcctgctctcttcaggaggcc

SEQ ID NO: 5644191 - DNA, 22 bp, Homo sapiens
tcctgctctgcacggtctgcgg

SEQ ID NO: 5644192 - DNA, 14 bp, Homo sapiens
tcctgctcttttgt

SEQ ID NO: 5644193 - DNA, 18 bp, Homo sapiens
tcctgctgaaacacctcc

SEQ ID NO: 5644194 - DNA, 23 bp, Homo sapiens
tcctgctgaaacacctcccaggg

SEQ ID NO: 5644195 - DNA, 23 bp, Homo sapiens
tcctgctgacctcactgtcctgt

SEQ ID NO: 5644196 - DNA, 17 bp, Homo sapiens
tcctgctgagctgcccc

SEQ ID NO: 5644197 - DNA, 18 bp, Homo sapiens
tcctgctgagctgcccct

SEQ ID NO: 5644198 - DNA, 23 bp, Homo sapiens
tcctgctgagctgcccctgctgc

SEQ ID NO: 5644199 - DNA, 13 bp, Homo sapiens
tcctgctgcacag

SEQ ID NO: 5644200 - DNA, 21 bp, Homo sapiens
tcctgctgcaccaacccagcc

SEQ ID NO: 5644201 - DNA, 22 bp, Homo sapiens
tcctgctgcaccaacccagccg

SEQ ID NO: 5644202 - DNA, 15 bp, Homo sapiens
tcctgctgcaccctg

SEQ ID NO: 5644203 - DNA, 16 bp, Homo sapiens
tcctgctgcagagggg

SEQ ID NO: 5644204 - DNA, 13 bp, Homo sapiens
tcctgctgcatga

SEQ ID NO: 5644205 - DNA, 16 bp, Homo sapiens
tcctgctgccagagaa

SEQ ID NO: 5644206 - DNA, 20 bp, Homo sapiens
tcctgctgccctcccacagc

SEQ ID NO: 5644207 - DNA, 11 bp, Homo sapiens
tcctgctgcct

SEQ ID NO: 5644208 - DNA, 16 bp, Homo sapiens
tcctgctgcctaataa

SEQ ID NO: 5644209 - DNA, 14 bp, Homo sapiens
tcctgctgcctgca

SEQ ID NO: 5644210 - DNA, 14 bp, Homo sapiens
tcctgctgcctgga

SEQ ID NO: 5644211 - DNA, 18 bp, Homo sapiens
tcctgctgccttttctgg

SEQ ID NO: 5644212 - DNA, 13 bp, Homo sapiens
tcctgctgcgtga

SEQ ID NO: 5644213 - DNA, 13 bp, Homo sapiens
tcctgctgctcac

SEQ ID NO: 5644214 - DNA, 18 bp, Homo sapiens
tcctgctgctcactcccg

SEQ ID NO: 5644215 - DNA, 14 bp, Homo sapiens
tcctgctgctccct

SEQ ID NO: 5644216 - DNA, 16 bp, Homo sapiens
tcctgctgctcgggaa

SEQ ID NO: 5644217 - DNA, 15 bp, Homo sapiens
tcctgctgctggggc

SEQ ID NO: 5644218 - DNA, 19 bp, Homo sapiens
tcctgctgctggggccagc

SEQ ID NO: 5644219 - DNA, 12 bp, Homo sapiens
tcctgctgctgt

SEQ ID NO: 5644220 - DNA, 23 bp, Homo sapiens
tcctgctgctgtaactgctgagc

SEQ ID NO: 5644221 - DNA, 15 bp, Homo sapiens
tcctgctgctgtctg

SEQ ID NO: 5644222 - DNA, 19 bp, Homo sapiens
tcctgctgctgtctgggtg

SEQ ID NO: 5644223 - DNA, 14 bp, Homo sapiens
tcctgctgctgtgt

SEQ ID NO: 5644224 - DNA, 13 bp, Homo sapiens
tcctgctgctttg

SEQ ID NO: 5644225 - DNA, 22 bp, Homo sapiens
tcctgctggacagagactcagc

SEQ ID NO: 5644226 - DNA, 16 bp, Homo sapiens
tcctgctggatgcgtg

SEQ ID NO: 5644227 - DNA, 12 bp, Homo sapiens
tcctgctggcct

SEQ ID NO: 5644228 - DNA, 17 bp, Homo sapiens
tcctgctggcctgctct

SEQ ID NO: 5644229 - DNA, 13 bp, Homo sapiens
tcctgctggctga

SEQ ID NO: 5644230 - DNA, 19 bp, Homo sapiens
tcctgctggctgaggcttg

SEQ ID NO: 5644231 - DNA, 15 bp, Homo sapiens
tcctgctgggactga

SEQ ID NO: 5644232 - DNA, 19 bp, Homo sapiens
tcctgctgggactgagaag

SEQ ID NO: 5644233 - DNA, 13 bp, Homo sapiens
tcctgctgggcag

SEQ ID NO: 5644234 - DNA, 14 bp, Homo sapiens
tcctgctgggcgtg

SEQ ID NO: 5644235 - DNA, 19 bp, Homo sapiens
tcctgctgggcgtgtgtga

SEQ ID NO: 5644236 - DNA, 14 bp, Homo sapiens
tcctgctggggctg

SEQ ID NO: 5644237 - DNA, 11 bp, Homo sapiens
tcctgctggta

SEQ ID NO: 5644238 - DNA, 14 bp, Homo sapiens
tcctgctggtacct

SEQ ID NO: 5644239 - DNA, 22 bp, Homo sapiens
tcctgctgtaaatttggcttct

SEQ ID NO: 5644240 - DNA, 13 bp, Homo sapiens
tcctgctgtccct

SEQ ID NO: 5644241 - DNA, 23 bp, Homo sapiens
tcctgctgtccctgtcaggacac

SEQ ID NO: 5644242 - DNA, 19 bp, Homo sapiens
tcctgctgtcctggtggct

SEQ ID NO: 5644243 - DNA, 14 bp, Homo sapiens
tcctgctgtcttct

SEQ ID NO: 5644244 - DNA, 11 bp, Homo sapiens
tcctgctgtgc

SEQ ID NO: 5644245 - DNA, 13 bp, Homo sapiens
tcctgctgtggcc

SEQ ID NO: 5644246 - DNA, 21 bp, Homo sapiens
tcctgctgtggcctcacttcc

SEQ ID NO: 5644247 - DNA, 10 bp, Homo sapiens
tcctgcttcc

SEQ ID NO: 5644248 - DNA, 13 bp, Homo sapiens
tcctgcttcccct

SEQ ID NO: 5644249 - DNA, 17 bp, Homo sapiens
tcctgcttcccctccct

SEQ ID NO: 5644250 - DNA, 22 bp, Homo sapiens
tcctgcttcccctccctaccct

SEQ ID NO: 5644251 - DNA, 13 bp, Homo sapiens
tcctgcttcctca

SEQ ID NO: 5644252 - DNA, 19 bp, Homo sapiens
tcctgcttcctgaaagctg

SEQ ID NO: 5644253 - DNA, 20 bp, Homo sapiens
tcctgcttcctgaaagctgt

SEQ ID NO: 5644254 - DNA, 18 bp, Homo sapiens
tcctgcttctcctgatcc

SEQ ID NO: 5644255 - DNA, 18 bp, Homo sapiens
tcctgcttctctcagcca

SEQ ID NO: 5644256 - DNA, 20 bp, Homo sapiens
tcctgcttcttcttccaaat

SEQ ID NO: 5644257 - DNA, 16 bp, Homo sapiens
tcctgcttgccaaggc

SEQ ID NO: 5644258 - DNA, 17 bp, Homo sapiens
tcctgcttgccaaggca

SEQ ID NO: 5644259 - DNA, 19 bp, Homo sapiens
tcctgcttgtactaagcca

SEQ ID NO: 5644260 - DNA, 21 bp, Homo sapiens
tcctgctttacaggatcatgt

SEQ ID NO: 5644261 - DNA, 12 bp, Homo sapiens
tcctgctttcca

SEQ ID NO: 5644262 - DNA, 12 bp, Homo sapiens
tcctgctttctc

SEQ ID NO: 5644263 - DNA, 13 bp, Homo sapiens
tcctgctttctcc

SEQ ID NO: 5644264 - DNA, 15 bp, Homo sapiens
tcctgctttctcttt

SEQ ID NO: 5644265 - DNA, 15 bp, Homo sapiens
tcctgctttggcagt

SEQ ID NO: 5644266 - DNA, 13 bp, Homo sapiens
tcctgcttttagg

SEQ ID NO: 5644267 - DNA, 13 bp, Homo sapiens
tcctgcttttctg

SEQ ID NO: 5644268 - DNA, 22 bp, Homo sapiens
tcctgcttttctgtcctgggca

SEQ ID NO: 5644269 - DNA, 20 bp, Homo sapiens
tcctgcttttggggctcttg

SEQ ID NO: 5644270 - DNA, 16 bp, Homo sapiens
tcctggaaaagaagaa

SEQ ID NO: 5644271 - DNA, 20 bp, Homo sapiens
tcctggaaaagaagaaactt

SEQ ID NO: 5644272 - DNA, 14 bp, Homo sapiens
tcctggaaacagca

SEQ ID NO: 5644273 - DNA, 14 bp, Homo sapiens
tcctggaaccaatc

SEQ ID NO: 5644274 - DNA, 21 bp, Homo sapiens
tcctggaaccaggcttgcctg

SEQ ID NO: 5644275 - DNA, 21 bp, Homo sapiens
tcctggaacctggaccccagc

SEQ ID NO: 5644276 - DNA, 15 bp, Homo sapiens
tcctggaacctggca

SEQ ID NO: 5644277 - DNA, 22 bp, Homo sapiens
tcctggaacctggcaggccctg

SEQ ID NO: 5644278 - DNA, 17 bp, Homo sapiens
tcctggaaccttgctgt

SEQ ID NO: 5644279 - DNA, 18 bp, Homo sapiens
tcctggaaccttgctgtc

SEQ ID NO: 5644280 - DNA, 22 bp, Homo sapiens
tcctggaaccttgctgtcctga

SEQ ID NO: 5644281 - DNA, 18 bp, Homo sapiens
tcctggaacttgctctca

SEQ ID NO: 5644282 - DNA, 20 bp, Homo sapiens
tcctggaagcaggtgctaca

SEQ ID NO: 5644283 - DNA, 22 bp, Homo sapiens
tcctgtaggaaggtactgtatg

SEQ ID NO: 5644284 - DNA, 19 bp, Homo sapiens
tcctgtaggagttctattt

SEQ ID NO: 5644285 - DNA, 21 bp, Homo sapiens
tcctgtagtggcaaaaaagaa

SEQ ID NO: 5644286 - DNA, 14 bp, Homo sapiens
tcctgtataagcac

SEQ ID NO: 5644287 - DNA, 14 bp, Homo sapiens
tcctgtatattatg

SEQ ID NO: 5644288 - DNA, 14 bp, Homo sapiens
tcctgtatgtctgt

SEQ ID NO: 5644289 - DNA, 15 bp, Homo sapiens
tcctgtatgtctgtc

SEQ ID NO: 5644290 - DNA, 16 bp, Homo sapiens
tcctgtatgtctgtca

SEQ ID NO: 5644291 - DNA, 11 bp, Homo sapiens
tcctgtatgtt

SEQ ID NO: 5644292 - DNA, 18 bp, Homo sapiens
tcctgtatgttgtacaat

SEQ ID NO: 5644293 - DNA, 22 bp, Homo sapiens
tcctgtatgttgtacaatcaaa

SEQ ID NO: 5644294 - DNA, 20 bp, Homo sapiens
tcctgtattcagacagatga

SEQ ID NO: 5644295 - DNA, 22 bp, Homo sapiens
tcctgtatttgttcccaagagc

SEQ ID NO: 5644296 - DNA, 12 bp, Homo sapiens
tcctgtcaatgt

SEQ ID NO: 5644297 - DNA, 13 bp, Homo sapiens
tcctgtcaccctg

SEQ ID NO: 5644298 - DNA, 20 bp, Homo sapiens
tcctgtcactcactgaggcc

SEQ ID NO: 5644299 - DNA, 17 bp, Homo sapiens
tcctgtcagtgaggact

SEQ ID NO: 5644300 - DNA, 12 bp, Homo sapiens
tcctgtcagtgc

SEQ ID NO: 5644301 - DNA, 13 bp, Homo sapiens
tcctgtcagtgtt

SEQ ID NO: 5644302 - DNA, 15 bp, Homo sapiens
tcctgtcagtgtttt

SEQ ID NO: 5644303 - DNA, 16 bp, Homo sapiens
tcctgtcatcccctac

SEQ ID NO: 5644304 - DNA, 14 bp, Homo sapiens
tcctgtcattcctc

SEQ ID NO: 5644305 - DNA, 18 bp, Homo sapiens
tcctgtccaacctaaccc

SEQ ID NO: 5644306 - DNA, 17 bp, Homo sapiens
tcctgtccacacccagc

SEQ ID NO: 5644307 - DNA, 22 bp, Homo sapiens
tcctgtccacacccagctcagc

SEQ ID NO: 5644308 - DNA, 19 bp, Homo sapiens
tcctgtccactctcggggc

SEQ ID NO: 5644309 - DNA, 21 bp, Homo sapiens
tcctgtccactctcggggccc

SEQ ID NO: 5644310 - DNA, 14 bp, Homo sapiens
tcctgtccagagag

SEQ ID NO: 5644311 - DNA, 14 bp, Homo sapiens
tcctgtccagctcc

SEQ ID NO: 5644312 - DNA, 13 bp, Homo sapiens
tcctgtcccagag

SEQ ID NO: 5644313 - DNA, 13 bp, Homo sapiens
tcctgtccccggc

SEQ ID NO: 5644314 - DNA, 19 bp, Homo sapiens
tcctgtcccctccttccag

SEQ ID NO: 5644315 - DNA, 16 bp, Homo sapiens
tcctgtcccctgctac

SEQ ID NO: 5644316 - DNA, 17 bp, Homo sapiens
tcctgtcccctgctaca

SEQ ID NO: 5644317 - DNA, 16 bp, Homo sapiens
tcctgtccctacccac

SEQ ID NO: 5644318 - DNA, 12 bp, Homo sapiens
tcctgtccctga

SEQ ID NO: 5644319 - DNA, 14 bp, Homo sapiens
tcctgtccctgagg

SEQ ID NO: 5644320 - DNA, 16 bp, Homo sapiens
tcctgtccctgaggtt

SEQ ID NO: 5644321 - DNA, 13 bp, Homo sapiens
tcctgtccctgta

SEQ ID NO: 5644322 - DNA, 18 bp, Homo sapiens
tcctgtcccttctcttaa

SEQ ID NO: 5644323 - DNA, 17 bp, Homo sapiens
tcctgtcccttgacctt

SEQ ID NO: 5644324 - DNA, 13 bp, Homo sapiens
tcctgtccgccct

SEQ ID NO: 5644325 - DNA, 15 bp, Homo sapiens
tcctgtccgccctct

SEQ ID NO: 5644326 - DNA, 19 bp, Homo sapiens
tcctgtccgccctcttccc

SEQ ID NO: 5644327 - DNA, 17 bp, Homo sapiens
tcctgtcctccctcacc

SEQ ID NO: 5644328 - DNA, 18 bp, Homo sapiens
tcctgtcctctttcagct

SEQ ID NO: 5644329 - DNA, 11 bp, Homo sapiens
tcctgtcctgc

SEQ ID NO: 5644330 - DNA, 13 bp, Homo sapiens
tcctgtcctgcct

SEQ ID NO: 5644331 - DNA, 16 bp, Homo sapiens
tcctgtcctgcctcct

SEQ ID NO: 5644332 - DNA, 16 bp, Homo sapiens
tcctgtcctgctcacg

SEQ ID NO: 5644333 - DNA, 19 bp, Homo sapiens
tcctgtcctggctcccagg

SEQ ID NO: 5644334 - DNA, 13 bp, Homo sapiens
tcctgtcctggtc

SEQ ID NO: 5644335 - DNA, 15 bp, Homo sapiens
tcctgtcctggtcct

SEQ ID NO: 5644336 - DNA, 15 bp, Homo sapiens
tcctgtccttcacct

SEQ ID NO: 5644337 - DNA, 19 bp, Homo sapiens
tcctgtcctttcttgcaga

SEQ ID NO: 5644338 - DNA, 23 bp, Homo sapiens
tcctgtcgaaggggaggcacact

SEQ ID NO: 5644339 - DNA, 17 bp, Homo sapiens
tcctgtcgattagactg

SEQ ID NO: 5644340 - DNA, 22 bp, Homo sapiens
tcctgtcgattagactggacag

SEQ ID NO: 5644341 - DNA, 22 bp, Homo sapiens
tcctgtcggagccctgtctcct

SEQ ID NO: 5644342 - DNA, 15 bp, Homo sapiens
tcctgtctaactgct

SEQ ID NO: 5644343 - DNA, 20 bp, Homo sapiens
tcctgtctcaatagctccaa

SEQ ID NO: 5644344 - DNA, 13 bp, Homo sapiens
tcctgtctcactc

SEQ ID NO: 5644345 - DNA, 14 bp, Homo sapiens
tcctgtctcagcct

SEQ ID NO: 5644346 - DNA, 11 bp, Homo sapiens
tcctgtctccc

SEQ ID NO: 5644347 - DNA, 13 bp, Homo sapiens
tcctgtctcccag

SEQ ID NO: 5644348 - DNA, 18 bp, Homo sapiens
tcctgtctcccctctgct

SEQ ID NO: 5644349 - DNA, 14 bp, Homo sapiens
tcctgtctccgcct

SEQ ID NO: 5644350 - DNA, 17 bp, Homo sapiens
tcctgtctcctctgtca

SEQ ID NO: 5644351 - DNA, 20 bp, Homo sapiens
tcctgtctcctctgtcagtt

SEQ ID NO: 5644352 - DNA, 18 bp, Homo sapiens
tcctgtctctaaaaagaa

SEQ ID NO: 5644353 - DNA, 17 bp, Homo sapiens
tcctgtctctgcacaga

SEQ ID NO: 5644354 - DNA, 13 bp, Homo sapiens
tcctgtctctgcc

SEQ ID NO: 5644355 - DNA, 15 bp, Homo sapiens
tcctgtctcttggga

SEQ ID NO: 5644356 - DNA, 14 bp, Homo sapiens
tcctgtctgccagc

SEQ ID NO: 5644357 - DNA, 22 bp, Homo sapiens
tcctgtctgccagccagcagcc

SEQ ID NO: 5644358 - DNA, 16 bp, Homo sapiens
tcctgtctgctgggct

SEQ ID NO: 5644359 - DNA, 18 bp, Homo sapiens
tcctgtctgctgggctac

SEQ ID NO: 5644360 - DNA, 13 bp, Homo sapiens
tcctgtctggccc

SEQ ID NO: 5644361 - DNA, 14 bp, Homo sapiens
tcctgtctggccca

SEQ ID NO: 5644362 - DNA, 20 bp, Homo sapiens
tcctgtctgtatataactta

SEQ ID NO: 5644363 - DNA, 17 bp, Homo sapiens
tcctgtctgtccttctg

SEQ ID NO: 5644364 - DNA, 20 bp, Homo sapiens
tcctgtcttatggtccagaa

SEQ ID NO: 5644365 - DNA, 12 bp, Homo sapiens
tcctgtcttccc

SEQ ID NO: 5644366 - DNA, 15 bp, Homo sapiens
tcctgtcttctgctt

SEQ ID NO: 5644367 - DNA, 17 bp, Homo sapiens
tcctgtcttctgctttg

SEQ ID NO: 5644368 - DNA, 19 bp, Homo sapiens
tcctgtcttctgctttgtt

SEQ ID NO: 5644369 - DNA, 14 bp, Homo sapiens
tcctgtcttctttc

SEQ ID NO: 5644370 - DNA, 14 bp, Homo sapiens
tcctgtcttggcct

SEQ ID NO: 5644371 - DNA, 21 bp, Homo sapiens
tcctgtctttaaagcctgcct

SEQ ID NO: 5644372 - DNA, 15 bp, Homo sapiens
tcctgtctttctgag

SEQ ID NO: 5644373 - DNA, 22 bp, Homo sapiens
tcctgtctttctgagcacactt

SEQ ID NO: 5644374 - DNA, 13 bp, Homo sapiens
tcctgtctttgat

SEQ ID NO: 5644375 - DNA, 16 bp, Homo sapiens
tcctgtgaatgccact

SEQ ID NO: 5644376 - DNA, 12 bp, Homo sapiens
tcctgtgaatgg

SEQ ID NO: 5644377 - DNA, 14 bp, Homo sapiens
tcctgtgacatgta

SEQ ID NO: 5644378 - DNA, 15 bp, Homo sapiens
tcctgtgactgtttt

SEQ ID NO: 5644379 - DNA, 15 bp, Homo sapiens
tcctgtgagatgtgt

SEQ ID NO: 5644380 - DNA, 17 bp, Homo sapiens
tcctgtgagatgtgtat

SEQ ID NO: 5644381 - DNA, 10 bp, Homo sapiens
tcctgtgagg

SEQ ID NO: 5644382 - DNA, 19 bp, Homo sapiens
tcctgtgaggtttcccaat

SEQ ID NO: 5644383 - DNA, 18 bp, Homo sapiens
tcctgtgatcctttgatg

SEQ ID NO: 5644384 - DNA, 17 bp, Homo sapiens
tcctgtgatcttatttt

SEQ ID NO: 5644385 - DNA, 11 bp, Homo sapiens
tcctgtgcaga

SEQ ID NO: 5644386 - DNA, 14 bp, Homo sapiens
tcctgtgcagatgc

SEQ ID NO: 5644387 - DNA, 20 bp, Homo sapiens
tcctgtgcatgggtgaaggg

SEQ ID NO: 5644388 - DNA, 23 bp, Homo sapiens
tcctgtgcattggtggcatcaca

SEQ ID NO: 5644389 - DNA, 17 bp, Homo sapiens
tcctgtgccaggtacta

SEQ ID NO: 5644390 - DNA, 19 bp, Homo sapiens
tcctgtgccatgttattca

SEQ ID NO: 5644391 - DNA, 10 bp, Homo sapiens
tcctgtgccc

SEQ ID NO: 5644392 - DNA, 17 bp, Homo sapiens
tcctgtgcccatcatct

SEQ ID NO: 5644393 - DNA, 23 bp, Homo sapiens
tcctgtgcccatcatctctgcct

SEQ ID NO: 5644394 - DNA, 24 bp, Homo sapiens
tcctgtgccctagatgcacgtggg

SEQ ID NO: 5644395 - DNA, 16 bp, Homo sapiens
tcctgtgccctcaccc

SEQ ID NO: 5644396 - DNA, 18 bp, Homo sapiens
tcctgtgccctcacccca

SEQ ID NO: 5644397 - DNA, 19 bp, Homo sapiens
tcctgtgcctccatcagct

SEQ ID NO: 5644398 - DNA, 15 bp, Homo sapiens
tcctgtgcctggccc

SEQ ID NO: 5644399 - DNA, 15 bp, Homo sapiens
tcctgtgcctttcct

SEQ ID NO: 5644400 - DNA, 16 bp, Homo sapiens
tcctgtgcctttccta

SEQ ID NO: 5644401 - DNA, 18 bp, Homo sapiens
tcctgtgctatttgtaca

SEQ ID NO: 5644402 - DNA, 23 bp, Homo sapiens
tcctgtgctatttgtacaaataa

SEQ ID NO: 5644403 - DNA, 13 bp, Homo sapiens
tcctgtgctctgg

SEQ ID NO: 5644404 - DNA, 14 bp, Homo sapiens
tcctgtgctggggg

SEQ ID NO: 5644405 - DNA, 20 bp, Homo sapiens
tcctgtgctttctgcatgct

SEQ ID NO: 5644406 - DNA, 17 bp, Homo sapiens
tcctgtggaaatatgca

SEQ ID NO: 5644407 - DNA, 18 bp, Homo sapiens
tcctgtggaaatatgcaa

SEQ ID NO: 5644408 - DNA, 22 bp, Homo sapiens
tcctgtggaaggcagagaaatc

SEQ ID NO: 5644409 - DNA, 16 bp, Homo sapiens
tcctgtggagacactg

SEQ ID NO: 5644410 - DNA, 17 bp, Homo sapiens
tcctgtggatgcaaata

SEQ ID NO: 5644411 - DNA, 14 bp, Homo sapiens
tcctgtggcagctg

SEQ ID NO: 5644412 - DNA, 20 bp, Homo sapiens
tcctgtggcaggcagcgcca

SEQ ID NO: 5644413 - DNA, 21 bp, Homo sapiens
tcctgtggcaggcagcgccaa

SEQ ID NO: 5644414 - DNA, 12 bp, Homo sapiens
tcctgtggcccc

SEQ ID NO: 5644415 - DNA, 13 bp, Homo sapiens
tcctgtggcctca

SEQ ID NO: 5644416 - DNA, 14 bp, Homo sapiens
tcctgtggctccct

SEQ ID NO: 5644417 - DNA, 21 bp, Homo sapiens
tcctgtggctccctctctcct

SEQ ID NO: 5644418 - DNA, 19 bp, Homo sapiens
tcctgtggctttgttttct

SEQ ID NO: 5644419 - DNA, 16 bp, Homo sapiens
tcctgtgggagcctcg

SEQ ID NO: 5644420 - DNA, 15 bp, Homo sapiens
tcctgtgggtggggc

SEQ ID NO: 5644421 - DNA, 13 bp, Homo sapiens
tcctgtgggtgtg

SEQ ID NO: 5644422 - DNA, 23 bp, Homo sapiens
tcctgtgggtgttctttcctgcc

SEQ ID NO: 5644423 - DNA, 21 bp, Homo sapiens
tcctgtggtagtcctcccaag

SEQ ID NO: 5644424 - DNA, 15 bp, Homo sapiens
tcctgtgtaacatct

SEQ ID NO: 5644425 - DNA, 18 bp, Homo sapiens
tcctgtgtaatcatttct

SEQ ID NO: 5644426 - DNA, 22 bp, Homo sapiens
tcctgtgtacctcactgtccaa

SEQ ID NO: 5644427 - DNA, 15 bp, Homo sapiens
tcctgtgtactgtgt

SEQ ID NO: 5644428 - DNA, 17 bp, Homo sapiens
tcctgtgtactgtgtca

SEQ ID NO: 5644429 - DNA, 13 bp, Homo sapiens
tcctgtgtagcat

SEQ ID NO: 5644430 - DNA, 21 bp, Homo sapiens
tcctgtgtccacatctaacaa

SEQ ID NO: 5644431 - DNA, 22 bp, Homo sapiens
tcctgtgtctggtccacacacc

SEQ ID NO: 5644432 - DNA, 20 bp, Homo sapiens
tcctgtgtgaccctgggcag

SEQ ID NO: 5644433 - DNA, 18 bp, Homo sapiens
tcctgtgtggagagggaa

SEQ ID NO: 5644434 - DNA, 22 bp, Homo sapiens
tcctgtgtggagagggaatgtg

SEQ ID NO: 5644435 - DNA, 23 bp, Homo sapiens
tcctgtgtggggaggcagctcca

SEQ ID NO: 5644436 - DNA, 18 bp, Homo sapiens
tcctgtgtggtttagtgt

SEQ ID NO: 5644437 - DNA, 10 bp, Homo sapiens
tcctgtgtgt

SEQ ID NO: 5644438 - DNA, 12 bp, Homo sapiens
tcctgtgtgtta

SEQ ID NO: 5644439 - DNA, 20 bp, Homo sapiens
tcctgtgtgttaagctctgc

SEQ ID NO: 5644440 - DNA, 17 bp, Homo sapiens
tcctgtgttcaatattt

SEQ ID NO: 5644441 - DNA, 17 bp, Homo sapiens
tcctgtgtttcattact

SEQ ID NO: 5644442 - DNA, 12 bp, Homo sapiens
tcctgtgtttct

SEQ ID NO: 5644443 - DNA, 19 bp, Homo sapiens
tcctgtgtttctagggaaa

SEQ ID NO: 5644444 - DNA, 18 bp, Homo sapiens
tcctgtgtttgctcccat

SEQ ID NO: 5644445 - DNA, 20 bp, Homo sapiens
tcctgtgtttgtcctgggtt

SEQ ID NO: 5644446 - DNA, 15 bp, Homo sapiens
tcctgttacctgtct

SEQ ID NO: 5644447 - DNA, 23 bp, Homo sapiens
tcctgttagctcctcactgtggt

SEQ ID NO: 5644448 - DNA, 23 bp, Homo sapiens
tcctgttagctgttatttctatt

SEQ ID NO: 5644449 - DNA, 20 bp, Homo sapiens
tcctgttagtagcagaaata

SEQ ID NO: 5644450 - DNA, 22 bp, Homo sapiens
tcctgttcaaatttttttttaa

SEQ ID NO: 5644451 - DNA, 23 bp, Homo sapiens
tcctgttcatggggtttttgccc

SEQ ID NO: 5644452 - DNA, 23 bp, Homo sapiens
tcctgttccctcctggtcctgga

SEQ ID NO: 5644453 - DNA, 20 bp, Homo sapiens
tcctgttccttgctagccct

SEQ ID NO: 5644454 - DNA, 23 bp, Homo sapiens
tcctgttccttgctagccctggg

SEQ ID NO: 5644455 - DNA, 15 bp, Homo sapiens
tcctgttctcagagc

SEQ ID NO: 5644456 - DNA, 17 bp, Homo sapiens
tcctgttctcagcatcc

SEQ ID NO: 5644457 - DNA, 16 bp, Homo sapiens
tcctgttctctttgcc

SEQ ID NO: 5644458 - DNA, 15 bp, Homo sapiens
tcctgttctgcccac

SEQ ID NO: 5644459 - DNA, 13 bp, Homo sapiens
tcctgttcttcct

SEQ ID NO: 5644460 - DNA, 19 bp, Homo sapiens
tcctgttcttccttcctag

SEQ ID NO: 5644461 - DNA, 20 bp, Homo sapiens
tcctgttcttccttcctaga

SEQ ID NO: 5644462 - DNA, 13 bp, Homo sapiens
tcctgttgaagac

SEQ ID NO: 5644463 - DNA, 15 bp, Homo sapiens
tccttgggctgggac

SEQ ID NO: 5644464 - DNA, 19 bp, Homo sapiens
tccttggggaaacttggga

SEQ ID NO: 5644465 - DNA, 14 bp, Homo sapiens
tccttggggcaggc

SEQ ID NO: 5644466 - DNA, 16 bp, Homo sapiens
tccttggggcaggcag

SEQ ID NO: 5644467 - DNA, 18 bp, Homo sapiens
tccttggggcagggcctg

SEQ ID NO: 5644468 - DNA, 19 bp, Homo sapiens
tccttggggcagggcctgg

SEQ ID NO: 5644469 - DNA, 22 bp, Homo sapiens
tccttggggcagggcctgggcc

SEQ ID NO: 5644470 - DNA, 18 bp, Homo sapiens
tccttgggggctcccagg

SEQ ID NO: 5644471 - DNA, 15 bp, Homo sapiens
tccttggggggccaa

SEQ ID NO: 5644472 - DNA, 23 bp, Homo sapiens
tccttggggttaagtctcctgtc

SEQ ID NO: 5644473 - DNA, 22 bp, Homo sapiens
tccttgggtcattgacctctca

SEQ ID NO: 5644474 - DNA, 14 bp, Homo sapiens
tccttgggtcctgc

SEQ ID NO: 5644475 - DNA, 19 bp, Homo sapiens
tccttggtcctagtaagaa

SEQ ID NO: 5644476 - DNA, 15 bp, Homo sapiens
tccttggtctgctgg

SEQ ID NO: 5644477 - DNA, 16 bp, Homo sapiens
tccttggtctttgtat

SEQ ID NO: 5644478 - DNA, 23 bp, Homo sapiens
tccttggtctttgtatcttccat

SEQ ID NO: 5644479 - DNA, 22 bp, Homo sapiens
tccttggtgctaaagattgtta

SEQ ID NO: 5644480 - DNA, 18 bp, Homo sapiens
tccttggtgctgtgtgcc

SEQ ID NO: 5644481 - DNA, 19 bp, Homo sapiens
tccttggtgctgtgtgccc

SEQ ID NO: 5644482 - DNA, 21 bp, Homo sapiens
tccttggtgctgtgtgcccca

SEQ ID NO: 5644483 - DNA, 21 bp, Homo sapiens
tccttggtggccgggggtggg

SEQ ID NO: 5644484 - DNA, 18 bp, Homo sapiens
tccttggtgtcgggcatg

SEQ ID NO: 5644485 - DNA, 19 bp, Homo sapiens
tccttggttccctcttccc

SEQ ID NO: 5644486 - DNA, 15 bp, Homo sapiens
tccttggttttgcct

SEQ ID NO: 5644487 - DNA, 17 bp, Homo sapiens
tccttggttttgcctct

SEQ ID NO: 5644488 - DNA, 21 bp, Homo sapiens
tccttggttttgcctctttaa

SEQ ID NO: 5644489 - DNA, 14 bp, Homo sapiens
tccttgtactctta

SEQ ID NO: 5644490 - DNA, 17 bp, Homo sapiens
tccttgtacttgaataa

SEQ ID NO: 5644491 - DNA, 23 bp, Homo sapiens
tccttgtacttgaataataacca

SEQ ID NO: 5644492 - DNA, 15 bp, Homo sapiens
tccttgtatgttctt

SEQ ID NO: 5644493 - DNA, 14 bp, Homo sapiens
tccttgtcaccagc

SEQ ID NO: 5644494 - DNA, 15 bp, Homo sapiens
tccttgtcaccagca

SEQ ID NO: 5644495 - DNA, 16 bp, Homo sapiens
tccttgtccccacact

SEQ ID NO: 5644496 - DNA, 20 bp, Homo sapiens
tccttgtccccacactccta

SEQ ID NO: 5644497 - DNA, 13 bp, Homo sapiens
tccttgtccccgc

SEQ ID NO: 5644498 - DNA, 21 bp, Homo sapiens
tccttgtcgtagagccctcca

SEQ ID NO: 5644499 - DNA, 19 bp, Homo sapiens
tccttgtctagtttcccac

SEQ ID NO: 5644500 - DNA, 14 bp, Homo sapiens
tccttgtctctcat

SEQ ID NO: 5644501 - DNA, 16 bp, Homo sapiens
tccttgtcttggcagc

SEQ ID NO: 5644502 - DNA, 19 bp, Homo sapiens
tccttgtcttttgagctat

SEQ ID NO: 5644503 - DNA, 19 bp, Homo sapiens
tccttgtgatgtgcacgta

SEQ ID NO: 5644504 - DNA, 20 bp, Homo sapiens
tccttgtgatgtgcacgtaa

SEQ ID NO: 5644505 - DNA, 18 bp, Homo sapiens
tccttgtgcaattgtctt

SEQ ID NO: 5644506 - DNA, 15 bp, Homo sapiens
tccttgtgccagaga

SEQ ID NO: 5644507 - DNA, 16 bp, Homo sapiens
tccttgtgctcctgcc

SEQ ID NO: 5644508 - DNA, 20 bp, Homo sapiens
tccttgtgctcctgccagct

SEQ ID NO: 5644509 - DNA, 15 bp, Homo sapiens
tccttgtgctgccag

SEQ ID NO: 5644510 - DNA, 16 bp, Homo sapiens
tccttgtgctgccagt

SEQ ID NO: 5644511 - DNA, 19 bp, Homo sapiens
tccttgtggaatgctgcct

SEQ ID NO: 5644512 - DNA, 14 bp, Homo sapiens
tccttgtggcctat

SEQ ID NO: 5644513 - DNA, 18 bp, Homo sapiens
tccttgtggcctgggcct

SEQ ID NO: 5644514 - DNA, 18 bp, Homo sapiens
tccttgtgggcctgggct

SEQ ID NO: 5644515 - DNA, 22 bp, Homo sapiens
tccttgtggttagcaagactgc

SEQ ID NO: 5644516 - DNA, 22 bp, Homo sapiens
tccttgtggttgaaaaccacag

SEQ ID NO: 5644517 - DNA, 21 bp, Homo sapiens
tccttgtgttttgtcctgcct

SEQ ID NO: 5644518 - DNA, 22 bp, Homo sapiens
tccttgtgttttgtcctgcctc

SEQ ID NO: 5644519 - DNA, 14 bp, Homo sapiens
tccttgttcctaga

SEQ ID NO: 5644520 - DNA, 18 bp, Homo sapiens
tccttgttgtttgctttg

SEQ ID NO: 5644521 - DNA, 23 bp, Homo sapiens
tccttgtttatcagatacatcac

SEQ ID NO: 5644522 - DNA, 23 bp, Homo sapiens
tccttgtttgcctttaggcagga

SEQ ID NO: 5644523 - DNA, 23 bp, Homo sapiens
tccttgttttaagattgtaattc

SEQ ID NO: 5644524 - DNA, 13 bp, Homo sapiens
tccttgttttcag

SEQ ID NO: 5644525 - DNA, 21 bp, Homo sapiens
tcctttaaaaaaatttaagtg

SEQ ID NO: 5644526 - DNA, 15 bp, Homo sapiens
tcctttaaaaaagaa

SEQ ID NO: 5644527 - DNA, 13 bp, Homo sapiens
tcctttaaaaata

SEQ ID NO: 5644528 - DNA, 16 bp, Homo sapiens
tcctttaaagatgaac

SEQ ID NO: 5644529 - DNA, 17 bp, Homo sapiens
tcctttaaatccttcca

SEQ ID NO: 5644530 - DNA, 21 bp, Homo sapiens
tcctttaaatggtaagagttt

SEQ ID NO: 5644531 - DNA, 17 bp, Homo sapiens
tcctttaaattctccaa

SEQ ID NO: 5644532 - DNA, 18 bp, Homo sapiens
tcctttaaatttcagctt

SEQ ID NO: 5644533 - DNA, 20 bp, Homo sapiens
tcctttaacataggttttta

SEQ ID NO: 5644534 - DNA, 15 bp, Homo sapiens
tcctttaatatgaaa

SEQ ID NO: 5644535 - DNA, 21 bp, Homo sapiens
tcctttaattaagactgaaaa

SEQ ID NO: 5644536 - DNA, 21 bp, Homo sapiens
tcctttaattttttactattt

SEQ ID NO: 5644537 - DNA, 12 bp, Homo sapiens
tcctttacaaaa

SEQ ID NO: 5644538 - DNA, 22 bp, Homo sapiens
tcctttacaaccatactttata

SEQ ID NO: 5644539 - DNA, 19 bp, Homo sapiens
tcctttacactcaggcttt

SEQ ID NO: 5644540 - DNA, 19 bp, Homo sapiens
tcctttacattcaactttt

SEQ ID NO: 5644541 - DNA, 17 bp, Homo sapiens
tcctttaccctcatctg

SEQ ID NO: 5644542 - DNA, 14 bp, Homo sapiens
tcctttaccctctt

SEQ ID NO: 5644543 - DNA, 23 bp, Homo sapiens
tcctttaccgaggacagcctgcc

SEQ ID NO: 5644544 - DNA, 13 bp, Homo sapiens
tcctttacctacc

SEQ ID NO: 5644545 - DNA, 23 bp, Homo sapiens
tcctttaccttttctataagttg

SEQ ID NO: 5644546 - DNA, 14 bp, Homo sapiens
tcctttacgtgttt

SEQ ID NO: 5644547 - DNA, 14 bp, Homo sapiens
tcctttactcctgg

SEQ ID NO: 5644548 - DNA, 16 bp, Homo sapiens
tcctttactgaatgta

SEQ ID NO: 5644549 - DNA, 17 bp, Homo sapiens
tcctttactgaatgtaa

SEQ ID NO: 5644550 - DNA, 18 bp, Homo sapiens
tcctttactgaatgtaag

SEQ ID NO: 5644551 - DNA, 18 bp, Homo sapiens
tcctttactttcccttgc

SEQ ID NO: 5644552 - DNA, 13 bp, Homo sapiens
tcctttagaaaca

SEQ ID NO: 5644553 - DNA, 22 bp, Homo sapiens
tcctttagcgcccagttgggtg

SEQ ID NO: 5644554 - DNA, 23 bp, Homo sapiens
tcctttagcgcccagttgggtgg

SEQ ID NO: 5644555 - DNA, 23 bp, Homo sapiens
tcctttaggagggagttatctaa

SEQ ID NO: 5644556 - DNA, 16 bp, Homo sapiens
tcctttaggcagcctg

SEQ ID NO: 5644557 - DNA, 17 bp, Homo sapiens
tcctttaggcagcctgc

SEQ ID NO: 5644558 - DNA, 19 bp, Homo sapiens
tcctttagggttctgcctc

SEQ ID NO: 5644559 - DNA, 20 bp, Homo sapiens
tcctttagggttctgcctct

SEQ ID NO: 5644560 - DNA, 17 bp, Homo sapiens
tcctttaggtttgaaag

SEQ ID NO: 5644561 - DNA, 17 bp, Homo sapiens
tcctttataaggttgtc

SEQ ID NO: 5644562 - DNA, 22 bp, Homo sapiens
tcctttataagttgctttcctc

SEQ ID NO: 5644563 - DNA, 13 bp, Homo sapiens
tcctttataattc

SEQ ID NO: 5644564 - DNA, 16 bp, Homo sapiens
tcctttatatttagtg

SEQ ID NO: 5644565 - DNA, 18 bp, Homo sapiens
tcctttatattttttgtc

SEQ ID NO: 5644566 - DNA, 14 bp, Homo sapiens
tcctttatgtgaat

SEQ ID NO: 5644567 - DNA, 17 bp, Homo sapiens
tcctttatgtgaatttt

SEQ ID NO: 5644568 - DNA, 20 bp, Homo sapiens
tcctttatgtgaatttttaa

SEQ ID NO: 5644569 - DNA, 15 bp, Homo sapiens
tcctttatgtgatgt

SEQ ID NO: 5644570 - DNA, 12 bp, Homo sapiens
tcctttatttag

SEQ ID NO: 5644571 - DNA, 18 bp, Homo sapiens
tcctttattttattgaaa

SEQ ID NO: 5644572 - DNA, 21 bp, Homo sapiens
tcctttattttattgaaatgt

SEQ ID NO: 5644573 - DNA, 18 bp, Homo sapiens
tcctttcaaggtaactgt

SEQ ID NO: 5644574 - DNA, 19 bp, Homo sapiens
tcctttcaatggtttgcaa

SEQ ID NO: 5644575 - DNA, 19 bp, Homo sapiens
tcctttcaattccaccagg

SEQ ID NO: 5644576 - DNA, 20 bp, Homo sapiens
tcctttcacaaccttctgtg

SEQ ID NO: 5644577 - DNA, 15 bp, Homo sapiens
tcctttcaccacatg

SEQ ID NO: 5644578 - DNA, 17 bp, Homo sapiens
tcctttcaccccagggc

SEQ ID NO: 5644579 - DNA, 24 bp, Homo sapiens
tcctttcaggagggtccccagctg

SEQ ID NO: 5644580 - DNA, 18 bp, Homo sapiens
tcctttcaggccaaggct

SEQ ID NO: 5644581 - DNA, 18 bp, Homo sapiens
tcctttcatccccacctt

SEQ ID NO: 5644582 - DNA, 13 bp, Homo sapiens
tcctttccacctt

SEQ ID NO: 5644583 - DNA, 22 bp, Homo sapiens
tcctttccagtggcctggctcc

SEQ ID NO: 5644584 - DNA, 13 bp, Homo sapiens
tcctttccatcag

SEQ ID NO: 5644585 - DNA, 16 bp, Homo sapiens
tcctttccatcagctt

SEQ ID NO: 5644586 - DNA, 22 bp, Homo sapiens
tcctttccatcagctttataat

SEQ ID NO: 5644587 - DNA, 14 bp, Homo sapiens
tcctttccatctgt

SEQ ID NO: 5644588 - DNA, 16 bp, Homo sapiens
tcctttcccaagcctt

SEQ ID NO: 5644589 - DNA, 17 bp, Homo sapiens
tcctttcccctctctgc

SEQ ID NO: 5644590 - DNA, 18 bp, Homo sapiens
tcctttcccctttctctt

SEQ ID NO: 5644591 - DNA, 17 bp, Homo sapiens
tcctttccctctcccag

SEQ ID NO: 5644592 - DNA, 15 bp, Homo sapiens
tcctttcccttcctc

SEQ ID NO: 5644593 - DNA, 14 bp, Homo sapiens
tcctttcccttttc

SEQ ID NO: 5644594 - DNA, 19 bp, Homo sapiens
tcctttcctactgtcctgg

SEQ ID NO: 5644595 - DNA, 18 bp, Homo sapiens
tcctttcctatctttaca

SEQ ID NO: 5644596 - DNA, 18 bp, Homo sapiens
tcctttcctcagacctgg

SEQ ID NO: 5644597 - DNA, 11 bp, Homo sapiens
tcctttcctct

SEQ ID NO: 5644598 - DNA, 15 bp, Homo sapiens
tcctttcctctcctc

SEQ ID NO: 5644599 - DNA, 12 bp, Homo sapiens
tcctttcctctg

SEQ ID NO: 5644600 - DNA, 16 bp, Homo sapiens
tcctttcctgcatctt

SEQ ID NO: 5644601 - DNA, 22 bp, Homo sapiens
tcctttccttcccaggcccttt

SEQ ID NO: 5644602 - DNA, 16 bp, Homo sapiens
tcctttcctttttctt

SEQ ID NO: 5644603 - DNA, 14 bp, Homo sapiens
tcctttctaaacaa

SEQ ID NO: 5644604 - DNA, 22 bp, Homo sapiens
tcctttctaacaaaaaaatata

SEQ ID NO: 5644605 - DNA, 11 bp, Homo sapiens
tcctttctatc

SEQ ID NO: 5644606 - DNA, 23 bp, Homo sapiens
tcctttctcagccgcttctgact

SEQ ID NO: 5644607 - DNA, 19 bp, Homo sapiens
tcctttctcatttctttct

SEQ ID NO: 5644608 - DNA, 15 bp, Homo sapiens
tcctttctccaggac

SEQ ID NO: 5644609 - DNA, 17 bp, Homo sapiens
tcctttctccaggccct

SEQ ID NO: 5644610 - DNA, 16 bp, Homo sapiens
tcctttctccagtgta

SEQ ID NO: 5644611 - DNA, 15 bp, Homo sapiens
tcctttctcctgtga

SEQ ID NO: 5644612 - DNA, 16 bp, Homo sapiens
tcctttctcctgtgaa

SEQ ID NO: 5644613 - DNA, 15 bp, Homo sapiens
tcctttctctgggct

SEQ ID NO: 5644614 - DNA, 13 bp, Homo sapiens
tcctttctctgta

SEQ ID NO: 5644615 - DNA, 14 bp, Homo sapiens
tcctttctctgtat

SEQ ID NO: 5644616 - DNA, 23 bp, Homo sapiens
tcctttctctttctctcttccct

SEQ ID NO: 5644617 - DNA, 13 bp, Homo sapiens
tcctttctgactg

SEQ ID NO: 5644618 - DNA, 14 bp, Homo sapiens
tcctttctgcccag

SEQ ID NO: 5644619 - DNA, 15 bp, Homo sapiens
tcctttctgcccagc

SEQ ID NO: 5644620 - DNA, 13 bp, Homo sapiens
tcctttctgcccc

SEQ ID NO: 5644621 - DNA, 14 bp, Homo sapiens
tcctttctgccccc

SEQ ID NO: 5644622 - DNA, 15 bp, Homo sapiens
tcctttctgccttgg

SEQ ID NO: 5644623 - DNA, 12 bp, Homo sapiens
tcctttctggaa

SEQ ID NO: 5644624 - DNA, 13 bp, Homo sapiens
tcctttctggctt

SEQ ID NO: 5644625 - DNA, 22 bp, Homo sapiens
tcctttctgggtaacaagccct

SEQ ID NO: 5644626 - DNA, 19 bp, Homo sapiens
tcctttctgtaggtttctc

SEQ ID NO: 5644627 - DNA, 14 bp, Homo sapiens
tcctttctgtgaag

SEQ ID NO: 5644628 - DNA, 17 bp, Homo sapiens
tcctttctgtggtgagg

SEQ ID NO: 5644629 - DNA, 14 bp, Homo sapiens
tcctttcttccttc

SEQ ID NO: 5644630 - DNA, 16 bp, Homo sapiens
tcctttcttccttcct

SEQ ID NO: 5644631 - DNA, 19 bp, Homo sapiens
tcctttcttctagtatttt

SEQ ID NO: 5644632 - DNA, 12 bp, Homo sapiens
tcctttcttgat

SEQ ID NO: 5644633 - DNA, 22 bp, Homo sapiens
tcctttcttgcactattccaca

SEQ ID NO: 5644634 - DNA, 15 bp, Homo sapiens
tcctttcttgtcttt

SEQ ID NO: 5644635 - DNA, 14 bp, Homo sapiens
tcctttctttgctg

SEQ ID NO: 5644636 - DNA, 13 bp, Homo sapiens
tcctttcttttcc

SEQ ID NO: 5644637 - DNA, 14 bp, Homo sapiens
tcctttctttttct

SEQ ID NO: 5644638 - DNA, 12 bp, Homo sapiens
tcctttgaagaa

SEQ ID NO: 5644639 - DNA, 14 bp, Homo sapiens
tcctttgaagaagg

SEQ ID NO: 5644640 - DNA, 13 bp, Homo sapiens
tcctttgaagaat

SEQ ID NO: 5644641 - DNA, 21 bp, Homo sapiens
tcgcacagggcatgcctggcc

SEQ ID NO: 5644642 - DNA, 22 bp, Homo sapiens
tcgcacagggcatgcctggcct

SEQ ID NO: 5644643 - DNA, 23 bp, Homo sapiens
tcgcacagggcatgcctggcctg

SEQ ID NO: 5644644 - DNA, 12 bp, Homo sapiens
tcgcacagttta

SEQ ID NO: 5644645 - DNA, 20 bp, Homo sapiens
tcgcaccactgcactccagc

SEQ ID NO: 5644646 - DNA, 22 bp, Homo sapiens
tcgcaccactgcactccagcct

SEQ ID NO: 5644647 - DNA, 15 bp, Homo sapiens
tcgcacccccctgtt

SEQ ID NO: 5644648 - DNA, 17 bp, Homo sapiens
tcgcacccccctgttct

SEQ ID NO: 5644649 - DNA, 22 bp, Homo sapiens
tcgcaccggagtgtctggaatt

SEQ ID NO: 5644650 - DNA, 17 bp, Homo sapiens
tcgcaccgtgctgggct

SEQ ID NO: 5644651 - DNA, 13 bp, Homo sapiens
tcgcacctgcctc

SEQ ID NO: 5644652 - DNA, 18 bp, Homo sapiens
tcgcaccttgctgtgtga

SEQ ID NO: 5644653 - DNA, 17 bp, Homo sapiens
tcgcacttgcagaggag

SEQ ID NO: 5644654 - DNA, 21 bp, Homo sapiens
tcgcagaccagagctgtctga

SEQ ID NO: 5644655 - DNA, 18 bp, Homo sapiens
tcgcagacctaagccctg

SEQ ID NO: 5644656 - DNA, 12 bp, Homo sapiens
tcgcagagaggc

SEQ ID NO: 5644657 - DNA, 11 bp, Homo sapiens
tcgcagaggca

SEQ ID NO: 5644658 - DNA, 12 bp, Homo sapiens
tcgcagaggcaa

SEQ ID NO: 5644659 - DNA, 10 bp, Homo sapiens
tcgcagccac

SEQ ID NO: 5644660 - DNA, 13 bp, Homo sapiens
tcgcagccaccct

SEQ ID NO: 5644661 - DNA, 16 bp, Homo sapiens
tcgcagccaccctgag

SEQ ID NO: 5644662 - DNA, 19 bp, Homo sapiens
tcgcagccaccctgaggag

SEQ ID NO: 5644663 - DNA, 14 bp, Homo sapiens
tcgcagcctgagtc

SEQ ID NO: 5644664 - DNA, 12 bp, Homo sapiens
tcgcagcctggc

SEQ ID NO: 5644665 - DNA, 16 bp, Homo sapiens
tcgcagctaccctcag

SEQ ID NO: 5644666 - DNA, 17 bp, Homo sapiens
tcgcagctaccctcagc

SEQ ID NO: 5644667 - DNA, 14 bp, Homo sapiens
tcgcagctgtgggt

SEQ ID NO: 5644668 - DNA, 23 bp, Homo sapiens
tcgcaggattcttcctccctccc

SEQ ID NO: 5644669 - DNA, 15 bp, Homo sapiens
tcgcaggcctccctg

SEQ ID NO: 5644670 - DNA, 18 bp, Homo sapiens
tcgcaggggcgctggctg

SEQ ID NO: 5644671 - DNA, 21 bp, Homo sapiens
tcgcaggggcgctggctgcac

SEQ ID NO: 5644672 - DNA, 20 bp, Homo sapiens
tcgcagtgcccagtgatggc

SEQ ID NO: 5644673 - DNA, 13 bp, Homo sapiens
tcgcatcattgca

SEQ ID NO: 5644674 - DNA, 20 bp, Homo sapiens
tcgcatccaccgccacccca

SEQ ID NO: 5644675 - DNA, 19 bp, Homo sapiens
tcgcatcccggctgaccct

SEQ ID NO: 5644676 - DNA, 19 bp, Homo sapiens
tcgcatccgtcctgggcgt

SEQ ID NO: 5644677 - DNA, 16 bp, Homo sapiens
tcgcattaagcacaca

SEQ ID NO: 5644678 - DNA, 17 bp, Homo sapiens
tcgcattaagcacacac

SEQ ID NO: 5644679 - DNA, 19 bp, Homo sapiens
tcgcattgctgtccttggg

SEQ ID NO: 5644680 - DNA, 14 bp, Homo sapiens
tcgcatttcatcaa

SEQ ID NO: 5644681 - DNA, 14 bp, Homo sapiens
tcgcatttcctaag

SEQ ID NO: 5644682 - DNA, 15 bp, Homo sapiens
tcgccaaactgtctc

SEQ ID NO: 5644683 - DNA, 16 bp, Homo sapiens
tcgccaaactgtctct

SEQ ID NO: 5644684 - DNA, 21 bp, Homo sapiens
tcgccaaactgtctctgcctc

SEQ ID NO: 5644685 - DNA, 15 bp, Homo sapiens
tcgccaacatggtga

SEQ ID NO: 5644686 - DNA, 13 bp, Homo sapiens
tcgccaagccatc

SEQ ID NO: 5644687 - DNA, 15 bp, Homo sapiens
tcgccaaggcctagg

SEQ ID NO: 5644688 - DNA, 10 bp, Homo sapiens
tcgccacacc

SEQ ID NO: 5644689 - DNA, 21 bp, Homo sapiens
tcgccacctggcattccttct

SEQ ID NO: 5644690 - DNA, 18 bp, Homo sapiens
tcgccacctttcaccctc

SEQ ID NO: 5644691 - DNA, 17 bp, Homo sapiens
tcgccacgctcagtgcc

SEQ ID NO: 5644692 - DNA, 18 bp, Homo sapiens
tcgccacgctcagtgccc

SEQ ID NO: 5644693 - DNA, 19 bp, Homo sapiens
tcgccacgctcagtgcccg

SEQ ID NO: 5644694 - DNA, 20 bp, Homo sapiens
tcgccacgctcagtgcccgt

SEQ ID NO: 5644695 - DNA, 20 bp, Homo sapiens
tcgccagaagactcctaggc

SEQ ID NO: 5644696 - DNA, 22 bp, Homo sapiens
tcgccagaagactcctaggccc

SEQ ID NO: 5644697 - DNA, 19 bp, Homo sapiens
tcgccagctgatgactcaa

SEQ ID NO: 5644698 - DNA, 14 bp, Homo sapiens
tcgccagcttggct

SEQ ID NO: 5644699 - DNA, 15 bp, Homo sapiens
tcgccagcttggctc

SEQ ID NO: 5644700 - DNA, 21 bp, Homo sapiens
tcgccaggactggtgaatata

SEQ ID NO: 5644701 - DNA, 18 bp, Homo sapiens
tcgccagtcactgctgca

SEQ ID NO: 5644702 - DNA, 22 bp, Homo sapiens
tcgccagtcactgctgcaaggt

SEQ ID NO: 5644703 - DNA, 13 bp, Homo sapiens
tcgccataggcca

SEQ ID NO: 5644704 - DNA, 15 bp, Homo sapiens
tcgccataggccaag

SEQ ID NO: 5644705 - DNA, 17 bp, Homo sapiens
tcgccataggccaaggt

SEQ ID NO: 5644706 - DNA, 15 bp, Homo sapiens
tcgccatctcctggg

SEQ ID NO: 5644707 - DNA, 14 bp, Homo sapiens
tcgccatcttcttc

SEQ ID NO: 5644708 - DNA, 13 bp, Homo sapiens
tcgccatgccggg

SEQ ID NO: 5644709 - DNA, 14 bp, Homo sapiens
tcgccatgccgggg

SEQ ID NO: 5644710 - DNA, 15 bp, Homo sapiens
tcgccatgtgctgtg

SEQ ID NO: 5644711 - DNA, 17 bp, Homo sapiens
tcgccatgtgctgtgca

SEQ ID NO: 5644712 - DNA, 18 bp, Homo sapiens
tcgccatgtgctgtgcac

SEQ ID NO: 5644713 - DNA, 20 bp, Homo sapiens
tcgccatttggccaggctgg

SEQ ID NO: 5644714 - DNA, 17 bp, Homo sapiens
tcgcccacaagccttac

SEQ ID NO: 5644715 - DNA, 22 bp, Homo sapiens
tcgcccacaagccttactcacc

SEQ ID NO: 5644716 - DNA, 15 bp, Homo sapiens
tcgcccacccagctg

SEQ ID NO: 5644717 - DNA, 23 bp, Homo sapiens
tcgcccacctaaagggaagccct

SEQ ID NO: 5644718 - DNA, 13 bp, Homo sapiens
tcgcccaggaagg

SEQ ID NO: 5644719 - DNA, 22 bp, Homo sapiens
tcgcccaggcctgggatgcagt

SEQ ID NO: 5644720 - DNA, 12 bp, Homo sapiens
tcgcccaggctg

SEQ ID NO: 5644721 - DNA, 17 bp, Homo sapiens
tcgcccaggctggactg

SEQ ID NO: 5644722 - DNA, 14 bp, Homo sapiens
tcgcccagtcccag

SEQ ID NO: 5644723 - DNA, 19 bp, Homo sapiens
tcgcccagtcccagcagcc

SEQ ID NO: 5644724 - DNA, 23 bp, Homo sapiens
tcgcccagtcccagcagccagcc

SEQ ID NO: 5644725 - DNA, 19 bp, Homo sapiens
tcgcccagtctggaatgca

SEQ ID NO: 5644726 - DNA, 23 bp, Homo sapiens
tcgcccagtctggaatgcagtgg

SEQ ID NO: 5644727 - DNA, 16 bp, Homo sapiens
tcgcccagtgccctgg

SEQ ID NO: 5644728 - DNA, 19 bp, Homo sapiens
tcgcccagtgccctggggc

SEQ ID NO: 5644729 - DNA, 20 bp, Homo sapiens
tcgcccatcagtgccagccc

SEQ ID NO: 5644730 - DNA, 13 bp, Homo sapiens
tcgccccacctcc

SEQ ID NO: 5644731 - DNA, 17 bp, Homo sapiens
tcgccccacctccacct

SEQ ID NO: 5644732 - DNA, 22 bp, Homo sapiens
tcgccccagatcaccagcccgg

SEQ ID NO: 5644733 - DNA, 14 bp, Homo sapiens
tcgccccagcaggt

SEQ ID NO: 5644734 - DNA, 12 bp, Homo sapiens
tcgccccagcct

SEQ ID NO: 5644735 - DNA, 15 bp, Homo sapiens
tcgccccattttctt

SEQ ID NO: 5644736 - DNA, 14 bp, Homo sapiens
tcgcccccactttt

SEQ ID NO: 5644737 - DNA, 23 bp, Homo sapiens
tcgcccccaggaacgctctcctc

SEQ ID NO: 5644738 - DNA, 23 bp, Homo sapiens
tcgccccccgcccggcctcctag

SEQ ID NO: 5644739 - DNA, 18 bp, Homo sapiens
tcgcccccgggccctttc

SEQ ID NO: 5644740 - DNA, 15 bp, Homo sapiens
tcgccccctgcctgc

SEQ ID NO: 5644741 - DNA, 13 bp, Homo sapiens
tcgcccctcagag

SEQ ID NO: 5644742 - DNA, 15 bp, Homo sapiens
tcgcccctcagagca

SEQ ID NO: 5644743 - DNA, 16 bp, Homo sapiens
tcgcccctcccctcag

SEQ ID NO: 5644744 - DNA, 21 bp, Homo sapiens
tcgcccctcccctcagcctgc

SEQ ID NO: 5644745 - DNA, 22 bp, Homo sapiens
tcgcccctcccctcagcctgcc

SEQ ID NO: 5644746 - DNA, 23 bp, Homo sapiens
tcgccccttccctctctccctgc

SEQ ID NO: 5644747 - DNA, 13 bp, Homo sapiens
tcgcccgcccact

SEQ ID NO: 5644748 - DNA, 15 bp, Homo sapiens
tcgcccgcccactgt

SEQ ID NO: 5644749 - DNA, 12 bp, Homo sapiens
tcgccctaccct

SEQ ID NO: 5644750 - DNA, 13 bp, Homo sapiens
tcgccctcccagg

SEQ ID NO: 5644751 - DNA, 17 bp, Homo sapiens
tcgccctcccaggctct

SEQ ID NO: 5644752 - DNA, 12 bp, Homo sapiens
tcgccctccttt

SEQ ID NO: 5644753 - DNA, 17 bp, Homo sapiens
tcgccctctctcaccag

SEQ ID NO: 5644754 - DNA, 19 bp, Homo sapiens
tcgccctctctcaccagcc

SEQ ID NO: 5644755 - DNA, 23 bp, Homo sapiens
tcgccctctctcaccagccttga

SEQ ID NO: 5644756 - DNA, 13 bp, Homo sapiens
tcgccctctgaaa

SEQ ID NO: 5644757 - DNA, 12 bp, Homo sapiens
tcgccctctgtg

SEQ ID NO: 5644758 - DNA, 17 bp, Homo sapiens
tcgccctctgtgcctaa

SEQ ID NO: 5644759 - DNA, 20 bp, Homo sapiens
tcgccctctgtgcctaataa

SEQ ID NO: 5644760 - DNA, 13 bp, Homo sapiens
tcgccctggcagg

SEQ ID NO: 5644761 - DNA, 14 bp, Homo sapiens
tcgccctggccagg

SEQ ID NO: 5644762 - DNA, 12 bp, Homo sapiens
tcgccctgtccc

SEQ ID NO: 5644763 - DNA, 13 bp, Homo sapiens
tcgccctgtgagg

SEQ ID NO: 5644764 - DNA, 15 bp, Homo sapiens
tcgccctgtgccctc

SEQ ID NO: 5644765 - DNA, 19 bp, Homo sapiens
tcgccctgtgccctctcac

SEQ ID NO: 5644766 - DNA, 15 bp, Homo sapiens
tcgccctgttcttga

SEQ ID NO: 5644767 - DNA, 21 bp, Homo sapiens
tcgccctgttcttgaggtctc

SEQ ID NO: 5644768 - DNA, 20 bp, Homo sapiens
tcgcccttacttcttgccct

SEQ ID NO: 5644769 - DNA, 23 bp, Homo sapiens
tcgcccttacttcttgccctggg

SEQ ID NO: 5644770 - DNA, 16 bp, Homo sapiens
tcgccgtccctcccag

SEQ ID NO: 5644771 - DNA, 14 bp, Homo sapiens
tcgccgtccctctg

SEQ ID NO: 5644772 - DNA, 19 bp, Homo sapiens
tcgccgtccctctgccttg

SEQ ID NO: 5644773 - DNA, 15 bp, Homo sapiens
tcgccgtctgtgaat

SEQ ID NO: 5644774 - DNA, 14 bp, Homo sapiens
tcgccgtggctgcg

SEQ ID NO: 5644775 - DNA, 20 bp, Homo sapiens
tcgcctaccaatctctgctc

SEQ ID NO: 5644776 - DNA, 14 bp, Homo sapiens
tcgcctaggcctgt

SEQ ID NO: 5644777 - DNA, 16 bp, Homo sapiens
tcgcctaggcctgtga

SEQ ID NO: 5644778 - DNA, 15 bp, Homo sapiens
tcgcctcctccagct

SEQ ID NO: 5644779 - DNA, 20 bp, Homo sapiens
tcgcctcctccagctcctgc

SEQ ID NO: 5644780 - DNA, 17 bp, Homo sapiens
tcgcctcggatcagctg

SEQ ID NO: 5644781 - DNA, 16 bp, Homo sapiens
tcgcctctcactctgg

SEQ ID NO: 5644782 - DNA, 22 bp, Homo sapiens
tcgcctgacaaccactggtctg

SEQ ID NO: 5644783 - DNA, 20 bp, Homo sapiens
tcgcctgcccccagcactcc

SEQ ID NO: 5644784 - DNA, 13 bp, Homo sapiens
tcgcctgccctcc

SEQ ID NO: 5644785 - DNA, 15 bp, Homo sapiens
tcgcctggaaacaga

SEQ ID NO: 5644786 - DNA, 17 bp, Homo sapiens
tcgcctggaaacagagg

SEQ ID NO: 5644787 - DNA, 15 bp, Homo sapiens
tcgcctggcctgagg

SEQ ID NO: 5644788 - DNA, 17 bp, Homo sapiens
tcgcctgggacgcccct

SEQ ID NO: 5644789 - DNA, 15 bp, Homo sapiens
tcgcctgggcccagg

SEQ ID NO: 5644790 - DNA, 16 bp, Homo sapiens
tcgcctgggcccaggc

SEQ ID NO: 5644791 - DNA, 12 bp, Homo sapiens
tcgcctgtaatc

SEQ ID NO: 5644792 - DNA, 18 bp, Homo sapiens
tcgcctgtaatgccagcg

SEQ ID NO: 5644793 - DNA, 18 bp, Homo sapiens
tcgcctgtggagctcagc

SEQ ID NO: 5644794 - DNA, 19 bp, Homo sapiens
tcgcctgtggagctcagcc

SEQ ID NO: 5644795 - DNA, 12 bp, Homo sapiens
tcgcctgtggga

SEQ ID NO: 5644796 - DNA, 13 bp, Homo sapiens
tcgccttaaactc

SEQ ID NO: 5644797 - DNA, 14 bp, Homo sapiens
tcgccttaaactct

SEQ ID NO: 5644798 - DNA, 14 bp, Homo sapiens
tcgccttagcatgt

SEQ ID NO: 5644799 - DNA, 21 bp, Homo sapiens
tcgccttagcatgtttgctga

SEQ ID NO: 5644800 - DNA, 14 bp, Homo sapiens
tcgccttccctcct

SEQ ID NO: 5644801 - DNA, 15 bp, Homo sapiens
tcgccttccctcctg

SEQ ID NO: 5644802 - DNA, 12 bp, Homo sapiens
tcgccttctggc

SEQ ID NO: 5644803 - DNA, 15 bp, Homo sapiens
tcgccttctggctgc

SEQ ID NO: 5644804 - DNA, 20 bp, Homo sapiens
tcgccttcttagagttttat

SEQ ID NO: 5644805 - DNA, 20 bp, Homo sapiens
tcgcctttcagcaggcagcc

SEQ ID NO: 5644806 - DNA, 13 bp, Homo sapiens
tcgcctttcctct

SEQ ID NO: 5644807 - DNA, 21 bp, Homo sapiens
tcgcctttcctctctatattt

SEQ ID NO: 5644808 - DNA, 16 bp, Homo sapiens
tcgcgacaatgcaaac

SEQ ID NO: 5644809 - DNA, 19 bp, Homo sapiens
tcgcgacaatgcaaaccat

SEQ ID NO: 5644810 - DNA, 18 bp, Homo sapiens
tcgcgacatcttctcaac

SEQ ID NO: 5644811 - DNA, 18 bp, Homo sapiens
tcgcgagcacatgttcat

SEQ ID NO: 5644812 - DNA, 22 bp, Homo sapiens
tcgcgccagcgacctctctgcc

SEQ ID NO: 5644813 - DNA, 15 bp, Homo sapiens
tcgcgcccaaaagat

SEQ ID NO: 5644814 - DNA, 18 bp, Homo sapiens
tcgcgcgtctcccatcct

SEQ ID NO: 5644815 - DNA, 14 bp, Homo sapiens
tcgcgctcagtaaa

SEQ ID NO: 5644816 - DNA, 15 bp, Homo sapiens
tcgcggcgcagcccc

SEQ ID NO: 5644817 - DNA, 17 bp, Homo sapiens
tcgcggcgcagcccctg

SEQ ID NO: 5644818 - DNA, 16 bp, Homo sapiens
tcgcggcggagctggc

SEQ ID NO: 5644819 - DNA, 18 bp, Homo sapiens
tcgcggcggagctggccc

SEQ ID NO: 5644820 - DNA, 14 bp, Homo sapiens
tcgcggctgggagc

SEQ ID NO: 5644821 - DNA, 16 bp, Homo sapiens
tcggggtaaaaagtgg

SEQ ID NO: 5644822 - DNA, 19 bp, Homo sapiens
tcggggtaaaaagtggctg

SEQ ID NO: 5644823 - DNA, 15 bp, Homo sapiens
tcggggtccaccagt

SEQ ID NO: 5644824 - DNA, 18 bp, Homo sapiens
tcggggtccaccagtgtg

SEQ ID NO: 5644825 - DNA, 15 bp, Homo sapiens
tcggggtgcacagga

SEQ ID NO: 5644826 - DNA, 22 bp, Homo sapiens
tcggggtgcacaggagggggtc

SEQ ID NO: 5644827 - DNA, 14 bp, Homo sapiens
tcggggtggcccac

SEQ ID NO: 5644828 - DNA, 15 bp, Homo sapiens
tcggggtggtgcagg

SEQ ID NO: 5644829 - DNA, 16 bp, Homo sapiens
tcggggtggtgcaggc

SEQ ID NO: 5644830 - DNA, 17 bp, Homo sapiens
tcggggtggtgcaggct

SEQ ID NO: 5644831 - DNA, 20 bp, Homo sapiens
tcggggttggggtgggaggg

SEQ ID NO: 5644832 - DNA, 13 bp, Homo sapiens
tcgggtccagaga

SEQ ID NO: 5644833 - DNA, 15 bp, Homo sapiens
tcgggtccagagacc

SEQ ID NO: 5644834 - DNA, 23 bp, Homo sapiens
tcgggtccatagagatgagccca

SEQ ID NO: 5644835 - DNA, 20 bp, Homo sapiens
tcgggtccgattaatttatg

SEQ ID NO: 5644836 - DNA, 17 bp, Homo sapiens
tcgggttaagaaatacc

SEQ ID NO: 5644837 - DNA, 22 bp, Homo sapiens
tcgggttttattgtttaaaatc

SEQ ID NO: 5644838 - DNA, 21 bp, Homo sapiens
tcggtacccggggcccagggc

SEQ ID NO: 5644839 - DNA, 22 bp, Homo sapiens
tcggtacccggggcccagggca

SEQ ID NO: 5644840 - DNA, 16 bp, Homo sapiens
tcggtatctggcttcc

SEQ ID NO: 5644841 - DNA, 21 bp, Homo sapiens
tcggtatctggcttccctgga

SEQ ID NO: 5644842 - DNA, 16 bp, Homo sapiens
tcggtattttaactga

SEQ ID NO: 5644843 - DNA, 12 bp, Homo sapiens
tcggtcagcagg

SEQ ID NO: 5644844 - DNA, 18 bp, Homo sapiens
tcggtcataaagaatgta

SEQ ID NO: 5644845 - DNA, 16 bp, Homo sapiens
tcggtcctggtgccct

SEQ ID NO: 5644846 - DNA, 20 bp, Homo sapiens
tcggtcgccccgtgtttgcg

SEQ ID NO: 5644847 - DNA, 15 bp, Homo sapiens
tcggtctagaaccac

SEQ ID NO: 5644848 - DNA, 22 bp, Homo sapiens
tcggtcttgcaaagcgacagat

SEQ ID NO: 5644849 - DNA, 23 bp, Homo sapiens
tcggtcttgcaaagcgacagatt

SEQ ID NO: 5644850 - DNA, 13 bp, Homo sapiens
tcggtcttttgta

SEQ ID NO: 5644851 - DNA, 16 bp, Homo sapiens
tcggtgcagagtgcag

SEQ ID NO: 5644852 - DNA, 15 bp, Homo sapiens
tcggtgcagcggtgg

SEQ ID NO: 5644853 - DNA, 15 bp, Homo sapiens
tcggtgctatgtgtt

SEQ ID NO: 5644854 - DNA, 17 bp, Homo sapiens
tcggtgctatgtgtttg

SEQ ID NO: 5644855 - DNA, 15 bp, Homo sapiens
tcggtggccatgctt

SEQ ID NO: 5644856 - DNA, 13 bp, Homo sapiens
tcggtggctctgg

SEQ ID NO: 5644857 - DNA, 14 bp, Homo sapiens
tcggtggctctggg

SEQ ID NO: 5644858 - DNA, 17 bp, Homo sapiens
tcggtggctctggggta

SEQ ID NO: 5644859 - DNA, 13 bp, Homo sapiens
tcggtggctgcct

SEQ ID NO: 5644860 - DNA, 21 bp, Homo sapiens
tcggtgggacagccccagggc

SEQ ID NO: 5644861 - DNA, 16 bp, Homo sapiens
tcggtgggccagagct

SEQ ID NO: 5644862 - DNA, 14 bp, Homo sapiens
tcggtgtaaaacca

SEQ ID NO: 5644863 - DNA, 16 bp, Homo sapiens
tcggtgtccccaccat

SEQ ID NO: 5644864 - DNA, 19 bp, Homo sapiens
tcggtgtccccaccatctg

SEQ ID NO: 5644865 - DNA, 20 bp, Homo sapiens
tcggtgtccccaccatctgc

SEQ ID NO: 5644866 - DNA, 24 bp, Homo sapiens
tcggtgttcttcttctcttctctg

SEQ ID NO: 5644867 - DNA, 21 bp, Homo sapiens
tcggtgtttggaggctgctgc

SEQ ID NO: 5644868 - DNA, 23 bp, Homo sapiens
tcggtgttttgcaaacatttctt

SEQ ID NO: 5644869 - DNA, 14 bp, Homo sapiens
tcggttgcagggct

SEQ ID NO: 5644870 - DNA, 20 bp, Homo sapiens
tcgtaaaaaaatagaaaaaa

SEQ ID NO: 5644871 - DNA, 20 bp, Homo sapiens
tcgtaaccagccagatcctc

SEQ ID NO: 5644872 - DNA, 13 bp, Homo sapiens
tcgtaagttctgt

SEQ ID NO: 5644873 - DNA, 15 bp, Homo sapiens
tcgtaatagctcaga

SEQ ID NO: 5644874 - DNA, 13 bp, Homo sapiens
tcgtaatgactta

SEQ ID NO: 5644875 - DNA, 15 bp, Homo sapiens
tcgtacagaaagctg

SEQ ID NO: 5644876 - DNA, 16 bp, Homo sapiens
tcgtacagaaagctgc

SEQ ID NO: 5644877 - DNA, 14 bp, Homo sapiens
tcgtacataatact

SEQ ID NO: 5644878 - DNA, 15 bp, Homo sapiens
tcgtaccagccagga

SEQ ID NO: 5644879 - DNA, 19 bp, Homo sapiens
tcgtacctgtccctccagg

SEQ ID NO: 5644880 - DNA, 21 bp, Homo sapiens
tcgtacctgtccctccaggcc

SEQ ID NO: 5644881 - DNA, 13 bp, Homo sapiens
tcgtaccttccca

SEQ ID NO: 5644882 - DNA, 15 bp, Homo sapiens
tcgtagaacctgcgc

SEQ ID NO: 5644883 - DNA, 16 bp, Homo sapiens
tcgtagaacctgcgca

SEQ ID NO: 5644884 - DNA, 23 bp, Homo sapiens
tcgtagagccctccacattttct

SEQ ID NO: 5644885 - DNA, 16 bp, Homo sapiens
tcgtagatgctgccta

SEQ ID NO: 5644886 - DNA, 12 bp, Homo sapiens
tcgtagctttcc

SEQ ID NO: 5644887 - DNA, 19 bp, Homo sapiens
tcgtaggggatgtggagtg

SEQ ID NO: 5644888 - DNA, 19 bp, Homo sapiens
tcgtaggtattagtgctag

SEQ ID NO: 5644889 - DNA, 23 bp, Homo sapiens
tcgtataaggaaatccagcccca

SEQ ID NO: 5644890 - DNA, 19 bp, Homo sapiens
tcgtataccgtgccacttt

SEQ ID NO: 5644891 - DNA, 19 bp, Homo sapiens
tcgtatagaaaaagcacag

SEQ ID NO: 5644892 - DNA, 22 bp, Homo sapiens
tcgtatagaagtcttcatgaaa

SEQ ID NO: 5644893 - DNA, 21 bp, Homo sapiens
tcgtatagctgtattgaatca

SEQ ID NO: 5644894 - DNA, 16 bp, Homo sapiens
tcgtatatttctcata

SEQ ID NO: 5644895 - DNA, 13 bp, Homo sapiens
tcgtatgaaaatg

SEQ ID NO: 5644896 - DNA, 17 bp, Homo sapiens
tcgtatgatcagtactg

SEQ ID NO: 5644897 - DNA, 17 bp, Homo sapiens
tcgtattaaaaaacaat

SEQ ID NO: 5644898 - DNA, 18 bp, Homo sapiens
tcgtattctaattcttca

SEQ ID NO: 5644899 - DNA, 15 bp, Homo sapiens
tcgtcaggctgccag

SEQ ID NO: 5644900 - DNA, 16 bp, Homo sapiens
tcgtcaggctgccaga

SEQ ID NO: 5644901 - DNA, 19 bp, Homo sapiens
tcgtcaggctgccagagaa

SEQ ID NO: 5644902 - DNA, 23 bp, Homo sapiens
tcgtcagtctctcaaagacccca

SEQ ID NO: 5644903 - DNA, 15 bp, Homo sapiens
tcgtcatcttccctg

SEQ ID NO: 5644904 - DNA, 17 bp, Homo sapiens
tcgtcatcttccctgcc

SEQ ID NO: 5644905 - DNA, 19 bp, Homo sapiens
tcgtcatgttggccaggct

SEQ ID NO: 5644906 - DNA, 21 bp, Homo sapiens
tcgtcatgttggccaggctgg

SEQ ID NO: 5644907 - DNA, 17 bp, Homo sapiens
tcgtcatttgcaagctg

SEQ ID NO: 5644908 - DNA, 22 bp, Homo sapiens
tcgtccaaggcagttctgtgtc

SEQ ID NO: 5644909 - DNA, 15 bp, Homo sapiens
tcgtccacagcttcc

SEQ ID NO: 5644910 - DNA, 22 bp, Homo sapiens
tcgtccacaggggcaggcctgg

SEQ ID NO: 5644911 - DNA, 23 bp, Homo sapiens
tcgtccacaggggcaggcctggg

SEQ ID NO: 5644912 - DNA, 20 bp, Homo sapiens
tcgtccaccccccacacaca

SEQ ID NO: 5644913 - DNA, 19 bp, Homo sapiens
tcgtccacggtcttctgca

SEQ ID NO: 5644914 - DNA, 14 bp, Homo sapiens
tcgtccagccctcc

SEQ ID NO: 5644915 - DNA, 15 bp, Homo sapiens
tcgtccagccctcct

SEQ ID NO: 5644916 - DNA, 12 bp, Homo sapiens
tcgtccagggag

SEQ ID NO: 5644917 - DNA, 19 bp, Homo sapiens
tcgtccatttaaacccggc

SEQ ID NO: 5644918 - DNA, 15 bp, Homo sapiens
tcgtcccaggctgcc

SEQ ID NO: 5644919 - DNA, 14 bp, Homo sapiens
tcgtcccatccagc

SEQ ID NO: 5644920 - DNA, 17 bp, Homo sapiens
tcgtcccatccagctac

SEQ ID NO: 5644921 - DNA, 11 bp, Homo sapiens
tcgtccccaga

SEQ ID NO: 5644922 - DNA, 17 bp, Homo sapiens
tcgtccccagaccagta

SEQ ID NO: 5644923 - DNA, 11 bp, Homo sapiens
tcgtccccctc

SEQ ID NO: 5644924 - DNA, 21 bp, Homo sapiens
tcgtccccctccctgcccaaa

SEQ ID NO: 5644925 - DNA, 20 bp, Homo sapiens
tcgtccctcctccccggagc

SEQ ID NO: 5644926 - DNA, 15 bp, Homo sapiens
tcgtccgctcagcca

SEQ ID NO: 5644927 - DNA, 14 bp, Homo sapiens
tcgtccggcctgca

SEQ ID NO: 5644928 - DNA, 18 bp, Homo sapiens
tcgtccggcctgcagccc

SEQ ID NO: 5644929 - DNA, 16 bp, Homo sapiens
tcgtccgtctgtctcg

SEQ ID NO: 5644930 - DNA, 16 bp, Homo sapiens
tcgtcctccccctgcc

SEQ ID NO: 5644931 - DNA, 17 bp, Homo sapiens
tcgtcctccccctgcca

SEQ ID NO: 5644932 - DNA, 18 bp, Homo sapiens
tcgtcctccccctgccag

SEQ ID NO: 5644933 - DNA, 23 bp, Homo sapiens
tcgtcctccccctgccagtgcct

SEQ ID NO: 5644934 - DNA, 19 bp, Homo sapiens
tcgtcctcgtttgtgttct

SEQ ID NO: 5644935 - DNA, 18 bp, Homo sapiens
tcgtcctgatccctccac

SEQ ID NO: 5644936 - DNA, 20 bp, Homo sapiens
tcgtcgaaaggtgcagctgc

SEQ ID NO: 5644937 - DNA, 16 bp, Homo sapiens
tcgtcgcacagtctct

SEQ ID NO: 5644938 - DNA, 19 bp, Homo sapiens
tcgtcggggggacagctcc

SEQ ID NO: 5644939 - DNA, 14 bp, Homo sapiens
tcgtctaaacataa

SEQ ID NO: 5644940 - DNA, 15 bp, Homo sapiens
tcgtctcatcctcct

SEQ ID NO: 5644941 - DNA, 16 bp, Homo sapiens
tcgtctcatcctcctt

SEQ ID NO: 5644942 - DNA, 16 bp, Homo sapiens
tcgtctccctggccac

SEQ ID NO: 5644943 - DNA, 23 bp, Homo sapiens
tcgtctctcccaccccctcccca

SEQ ID NO: 5644944 - DNA, 23 bp, Homo sapiens
tcgtctcttttaccctggcccct

SEQ ID NO: 5644945 - DNA, 10 bp, Homo sapiens
tcgtctgtga

SEQ ID NO: 5644946 - DNA, 11 bp, Homo sapiens
tcgtctgtgaa

SEQ ID NO: 5644947 - DNA, 13 bp, Homo sapiens
tcgtctgtgaatg

SEQ ID NO: 5644948 - DNA, 18 bp, Homo sapiens
tcgtctgtgaatgctaag

SEQ ID NO: 5644949 - DNA, 16 bp, Homo sapiens
tcgtcttaactcacca

SEQ ID NO: 5644950 - DNA, 12 bp, Homo sapiens
tcgtcttcactc

SEQ ID NO: 5644951 - DNA, 15 bp, Homo sapiens
tcgtcttcagctgca

SEQ ID NO: 5644952 - DNA, 17 bp, Homo sapiens
tcgtcttcagctgcatt

SEQ ID NO: 5644953 - DNA, 19 bp, Homo sapiens
tcgtcttgaacgagcagcc

SEQ ID NO: 5644954 - DNA, 19 bp, Homo sapiens
tcgtcttggtttggttcat

SEQ ID NO: 5644955 - DNA, 13 bp, Homo sapiens
tcgtctttacttc

SEQ ID NO: 5644956 - DNA, 18 bp, Homo sapiens
tcgtctttcccatgggga

SEQ ID NO: 5644957 - DNA, 22 bp, Homo sapiens
tcgtctttccctttaccactgt

SEQ ID NO: 5644958 - DNA, 10 bp, Homo sapiens
tcgtctttgc

SEQ ID NO: 5644959 - DNA, 19 bp, Homo sapiens
tcgtcttttagttccaaca

SEQ ID NO: 5644960 - DNA, 15 bp, Homo sapiens
tcgtctttttccaaa

SEQ ID NO: 5644961 - DNA, 23 bp, Homo sapiens
tcgtgaaaaccaaccctgtgggc

SEQ ID NO: 5644962 - DNA, 18 bp, Homo sapiens
tcgtgaaaccctgtctct

SEQ ID NO: 5644963 - DNA, 22 bp, Homo sapiens
tcgtgaaagtgcatttttgtaa

SEQ ID NO: 5644964 - DNA, 16 bp, Homo sapiens
tcgtgaacataactga

SEQ ID NO: 5644965 - DNA, 22 bp, Homo sapiens
tcgtgaagaggggaagtctctt

SEQ ID NO: 5644966 - DNA, 21 bp, Homo sapiens
tcgtgaataagttgattctgt

SEQ ID NO: 5644967 - DNA, 13 bp, Homo sapiens
tcgtgacaacact

SEQ ID NO: 5644968 - DNA, 21 bp, Homo sapiens
tcgtgaccaactagacattct

SEQ ID NO: 5644969 - DNA, 23 bp, Homo sapiens
tcgtgacccacccgccttggcct

SEQ ID NO: 5644970 - DNA, 18 bp, Homo sapiens
tcgtgacccttcagggcc

SEQ ID NO: 5644971 - DNA, 17 bp, Homo sapiens
tcgtgacctgctaggcc

SEQ ID NO: 5644972 - DNA, 18 bp, Homo sapiens
tcgtgacgctgaataaat

SEQ ID NO: 5644973 - DNA, 22 bp, Homo sapiens
tcgtgagctcttgtgaggaaag

SEQ ID NO: 5644974 - DNA, 20 bp, Homo sapiens
tcgtgagctggggactcagg

SEQ ID NO: 5644975 - DNA, 15 bp, Homo sapiens
tcgtgataaactttg

SEQ ID NO: 5644976 - DNA, 22 bp, Homo sapiens
tcgtgatatccacaaatgctat

SEQ ID NO: 5644977 - DNA, 19 bp, Homo sapiens
tcgtgatccacccacctcg

SEQ ID NO: 5644978 - DNA, 22 bp, Homo sapiens
tcgtgatctacccacctcggcc

SEQ ID NO: 5644979 - DNA, 16 bp, Homo sapiens
tcgtgatcttattgct

SEQ ID NO: 5644980 - DNA, 21 bp, Homo sapiens
tcgtgatgctatgatgttagt

SEQ ID NO: 5644981 - DNA, 23 bp, Homo sapiens
tcgtgatgggcccgcctcggcct

SEQ ID NO: 5644982 - DNA, 16 bp, Homo sapiens
tcgtgatttgcctgcc

SEQ ID NO: 5644983 - DNA, 17 bp, Homo sapiens
tcgtgatttgcctgcct

SEQ ID NO: 5644984 - DNA, 18 bp, Homo sapiens
tcgtgatttgcctgcctg

SEQ ID NO: 5644985 - DNA, 19 bp, Homo sapiens
tcgtgatttgcctgcctgg

SEQ ID NO: 5644986 - DNA, 20 bp, Homo sapiens
tcgtgattttcaagcagcat

SEQ ID NO: 5644987 - DNA, 12 bp, Homo sapiens
tcgtgcagagct

SEQ ID NO: 5644988 - DNA, 18 bp, Homo sapiens
tcgtgcatttgaggggcc

SEQ ID NO: 5644989 - DNA, 14 bp, Homo sapiens
tcgtgcatttgtga

SEQ ID NO: 5644990 - DNA, 17 bp, Homo sapiens
tcgtgcatttgtgagcc

SEQ ID NO: 5644991 - DNA, 14 bp, Homo sapiens
tcgtgccagcagcc

SEQ ID NO: 5644992 - DNA, 23 bp, Homo sapiens
tcgtgccagtcgcgctgcctgtg

SEQ ID NO: 5644993 - DNA, 20 bp, Homo sapiens
tcgtgccattacactccagc

SEQ ID NO: 5644994 - DNA, 21 bp, Homo sapiens
tcgtgccattacactccagcc

SEQ ID NO: 5644995 - DNA, 20 bp, Homo sapiens
tcgtgcccccccttccccct

SEQ ID NO: 5644996 - DNA, 19 bp, Homo sapiens
tcgtgccgtggagcttgga

SEQ ID NO: 5644997 - DNA, 17 bp, Homo sapiens
tcgtgcctataaatagt

SEQ ID NO: 5644998 - DNA, 18 bp, Homo sapiens
tctaagaataatggactc

SEQ ID NO: 5644999 - DNA, 12 bp, Homo sapiens
tctaagaattca

SEQ ID NO: 5645000 - DNA, 21 bp, Homo sapiens
tctaagaccacgaaaaaaggc

SEQ ID NO: 5645001 - DNA, 21 bp, Homo sapiens
tctaagactactaaggccttt

SEQ ID NO: 5645002 - DNA, 23 bp, Homo sapiens
tctaagactatatatataaatgt

SEQ ID NO: 5645003 - DNA, 14 bp, Homo sapiens
tctaagagcaattc

SEQ ID NO: 5645004 - DNA, 22 bp, Homo sapiens
tctaagatacactgcactttgt

SEQ ID NO: 5645005 - DNA, 23 bp, Homo sapiens
tctaagatgaatccaaatgtgaa

SEQ ID NO: 5645006 - DNA, 22 bp, Homo sapiens
tctaagatgattcaaagtagtt

SEQ ID NO: 5645007 - DNA, 20 bp, Homo sapiens
tctaagatgtgatattctaa

SEQ ID NO: 5645008 - DNA, 16 bp, Homo sapiens
tctaagatgttatatt

SEQ ID NO: 5645009 - DNA, 21 bp, Homo sapiens
tctaagatgttatatttttct

SEQ ID NO: 5645010 - DNA, 12 bp, Homo sapiens
tctaagatgttc

SEQ ID NO: 5645011 - DNA, 18 bp, Homo sapiens
tctaagattaatagcatt

SEQ ID NO: 5645012 - DNA, 12 bp, Homo sapiens
tctaagattcta

SEQ ID NO: 5645013 - DNA, 14 bp, Homo sapiens
tctaagattctaaa

SEQ ID NO: 5645014 - DNA, 15 bp, Homo sapiens
tctaagattctaaag

SEQ ID NO: 5645015 - DNA, 18 bp, Homo sapiens
tctaagattctaaaggtc

SEQ ID NO: 5645016 - DNA, 14 bp, Homo sapiens
tctaagattctaat

SEQ ID NO: 5645017 - DNA, 15 bp, Homo sapiens
tctaagattctaatg

SEQ ID NO: 5645018 - DNA, 16 bp, Homo sapiens
tctaagattctaatga

SEQ ID NO: 5645019 - DNA, 20 bp, Homo sapiens
tctaagattctaatgatgat

SEQ ID NO: 5645020 - DNA, 13 bp, Homo sapiens
tctaagattctag

SEQ ID NO: 5645021 - DNA, 14 bp, Homo sapiens
tctaagcaaccaca

SEQ ID NO: 5645022 - DNA, 23 bp, Homo sapiens
tctaagcaagatgttttgtataa

SEQ ID NO: 5645023 - DNA, 16 bp, Homo sapiens
tctaagcacattccaa

SEQ ID NO: 5645024 - DNA, 20 bp, Homo sapiens
tctaagcagctggtcttttc

SEQ ID NO: 5645025 - DNA, 18 bp, Homo sapiens
tctaagcagcttattgtt

SEQ ID NO: 5645026 - DNA, 14 bp, Homo sapiens
tctaagcaggaagg

SEQ ID NO: 5645027 - DNA, 14 bp, Homo sapiens
tctaagcagttatg

SEQ ID NO: 5645028 - DNA, 21 bp, Homo sapiens
tctaagcagttttgtaaatgt

SEQ ID NO: 5645029 - DNA, 17 bp, Homo sapiens
tctaagcataaaagatg

SEQ ID NO: 5645030 - DNA, 21 bp, Homo sapiens
tctaagcatcttgtcaagaaa

SEQ ID NO: 5645031 - DNA, 16 bp, Homo sapiens
tctaagccagttttca

SEQ ID NO: 5645032 - DNA, 17 bp, Homo sapiens
tctaagccagttttcat

SEQ ID NO: 5645033 - DNA, 18 bp, Homo sapiens
tctaagcccaggatctct

SEQ ID NO: 5645034 - DNA, 14 bp, Homo sapiens
tctaagcctgaagg

SEQ ID NO: 5645035 - DNA, 18 bp, Homo sapiens
tctaagctcagtgctctc

SEQ ID NO: 5645036 - DNA, 15 bp, Homo sapiens
tctaagctgcagctt

SEQ ID NO: 5645037 - DNA, 17 bp, Homo sapiens
tctaagctgtgtgcagg

SEQ ID NO: 5645038 - DNA, 17 bp, Homo sapiens
tctaagctgtttgccaa

SEQ ID NO: 5645039 - DNA, 14 bp, Homo sapiens
tctaagcttatttc

SEQ ID NO: 5645040 - DNA, 23 bp, Homo sapiens
tctaaggacctgaaattccaaag

SEQ ID NO: 5645041 - DNA, 17 bp, Homo sapiens
tctaaggactttttctt

SEQ ID NO: 5645042 - DNA, 23 bp, Homo sapiens
tctaaggagcgctagtgccttgc

SEQ ID NO: 5645043 - DNA, 22 bp, Homo sapiens
tctaaggagttttgttgtattt

SEQ ID NO: 5645044 - DNA, 19 bp, Homo sapiens
tctaaggataatgaaataa

SEQ ID NO: 5645045 - DNA, 19 bp, Homo sapiens
tctaaggatgtcacagggc

SEQ ID NO: 5645046 - DNA, 20 bp, Homo sapiens
tctaaggatgtcacagggcc

SEQ ID NO: 5645047 - DNA, 15 bp, Homo sapiens
tctaaggcaggatgt

SEQ ID NO: 5645048 - DNA, 19 bp, Homo sapiens
tctaaggccaaggcctcag

SEQ ID NO: 5645049 - DNA, 19 bp, Homo sapiens
tctaaggcctaggattcta

SEQ ID NO: 5645050 - DNA, 14 bp, Homo sapiens
tctaaggctctgag

SEQ ID NO: 5645051 - DNA, 16 bp, Homo sapiens
tctaagggaaaaagtt

SEQ ID NO: 5645052 - DNA, 22 bp, Homo sapiens
tctaagggaggcacttcctccc

SEQ ID NO: 5645053 - DNA, 17 bp, Homo sapiens
tctaagggatccagaga

SEQ ID NO: 5645054 - DNA, 21 bp, Homo sapiens
tctaagggatccagagacctg

SEQ ID NO: 5645055 - DNA, 22 bp, Homo sapiens
tctaagggatccagagacctgc

SEQ ID NO: 5645056 - DNA, 17 bp, Homo sapiens
tctaaggtactgtgggg

SEQ ID NO: 5645057 - DNA, 23 bp, Homo sapiens
tctaaggtccggtgttctaagat

SEQ ID NO: 5645058 - DNA, 14 bp, Homo sapiens
tctaaggttctcat

SEQ ID NO: 5645059 - DNA, 14 bp, Homo sapiens
tctaagtaaaacca

SEQ ID NO: 5645060 - DNA, 15 bp, Homo sapiens
tctaagtaaaaccac

SEQ ID NO: 5645061 - DNA, 16 bp, Homo sapiens
tctaagtaagaacact

SEQ ID NO: 5645062 - DNA, 20 bp, Homo sapiens
tctaagtacctttcctacat

SEQ ID NO: 5645063 - DNA, 22 bp, Homo sapiens
tctaagtatattatatggcagg

SEQ ID NO: 5645064 - DNA, 12 bp, Homo sapiens
tctaagtattta

SEQ ID NO: 5645065 - DNA, 16 bp, Homo sapiens
tctaagtatttgaaac

SEQ ID NO: 5645066 - DNA, 23 bp, Homo sapiens
tctaagtcaaacacttgtgactt

SEQ ID NO: 5645067 - DNA, 16 bp, Homo sapiens
tctaagtcatgtatgt

SEQ ID NO: 5645068 - DNA, 18 bp, Homo sapiens
tctaagtcatgtatgttt

SEQ ID NO: 5645069 - DNA, 19 bp, Homo sapiens
tctaagtcatgtatgtttc

SEQ ID NO: 5645070 - DNA, 20 bp, Homo sapiens
tctaagtcatgtatgtttct

SEQ ID NO: 5645071 - DNA, 17 bp, Homo sapiens
tctaagtcgtgcacttt

SEQ ID NO: 5645072 - DNA, 23 bp, Homo sapiens
tctaagtcgttgagggaatgaca

SEQ ID NO: 5645073 - DNA, 18 bp, Homo sapiens
tctaagtgagatgtttgg

SEQ ID NO: 5645074 - DNA, 13 bp, Homo sapiens
tctaagtgctgct

SEQ ID NO: 5645075 - DNA, 14 bp, Homo sapiens
tctaagtgctgctg

SEQ ID NO: 5645076 - DNA, 19 bp, Homo sapiens
tctaagtggcctgcagggg

SEQ ID NO: 5645077 - DNA, 14 bp, Homo sapiens
tctaagtgtaaaaa

SEQ ID NO: 5645078 - DNA, 19 bp, Homo sapiens
tctaagtgtaacctcagta

SEQ ID NO: 5645079 - DNA, 21 bp, Homo sapiens
tctaagtgttcgtctttagtt

SEQ ID NO: 5645080 - DNA, 18 bp, Homo sapiens
tctaagtgtttcataaat

SEQ ID NO: 5645081 - DNA, 16 bp, Homo sapiens
tctaagttaaatcatt

SEQ ID NO: 5645082 - DNA, 21 bp, Homo sapiens
tctaagttaatttaaagttgt

SEQ ID NO: 5645083 - DNA, 17 bp, Homo sapiens
tctaagttagactcttc

SEQ ID NO: 5645084 - DNA, 14 bp, Homo sapiens
tctaagttataaga

SEQ ID NO: 5645085 - DNA, 17 bp, Homo sapiens
tctaagttataagactc

SEQ ID NO: 5645086 - DNA, 19 bp, Homo sapiens
tctaagttattttgtacat

SEQ ID NO: 5645087 - DNA, 18 bp, Homo sapiens
tctaagttcatgtttgta

SEQ ID NO: 5645088 - DNA, 13 bp, Homo sapiens
tctaagttctatt

SEQ ID NO: 5645089 - DNA, 19 bp, Homo sapiens
tctaagttgagtatattat

SEQ ID NO: 5645090 - DNA, 22 bp, Homo sapiens
tctaagttgcatctttaatcct

SEQ ID NO: 5645091 - DNA, 13 bp, Homo sapiens
tctaagtttctaa

SEQ ID NO: 5645092 - DNA, 14 bp, Homo sapiens
tctaagtttctaag

SEQ ID NO: 5645093 - DNA, 15 bp, Homo sapiens
tctaagtttctaaga

SEQ ID NO: 5645094 - DNA, 23 bp, Homo sapiens
tctaagtttctaagattctaaag

SEQ ID NO: 5645095 - DNA, 24 bp, Homo sapiens
tctaagtttggttagccttagttt

SEQ ID NO: 5645096 - DNA, 17 bp, Homo sapiens
tctaataaaatggctat

SEQ ID NO: 5645097 - DNA, 16 bp, Homo sapiens
tctaataaagtagtta

SEQ ID NO: 5645098 - DNA, 21 bp, Homo sapiens
tctaataaatcagtgaactgt

SEQ ID NO: 5645099 - DNA, 18 bp, Homo sapiens
tctaataagctagttgaa

SEQ ID NO: 5645100 - DNA, 11 bp, Homo sapiens
tctaataataa

SEQ ID NO: 5645101 - DNA, 15 bp, Homo sapiens
tctaataatttctaa

SEQ ID NO: 5645102 - DNA, 16 bp, Homo sapiens
tctaataatttctaat

SEQ ID NO: 5645103 - DNA, 18 bp, Homo sapiens
tctaataatttctaatgt

SEQ ID NO: 5645104 - DNA, 16 bp, Homo sapiens
tctaatacaagcatat

SEQ ID NO: 5645105 - DNA, 17 bp, Homo sapiens
tctaatactttgtttat

SEQ ID NO: 5645106 - DNA, 15 bp, Homo sapiens
tctaatagaaaagtc

SEQ ID NO: 5645107 - DNA, 17 bp, Homo sapiens
tctaatagaagtccatg

SEQ ID NO: 5645108 - DNA, 16 bp, Homo sapiens
tctaatagagaacttt

SEQ ID NO: 5645109 - DNA, 14 bp, Homo sapiens
tctaatagagagat

SEQ ID NO: 5645110 - DNA, 20 bp, Homo sapiens
tctaatagcgaggctctaac

SEQ ID NO: 5645111 - DNA, 22 bp, Homo sapiens
tctaatagcgaggctctaacca

SEQ ID NO: 5645112 - DNA, 17 bp, Homo sapiens
tctaatagtataaaccc

SEQ ID NO: 5645113 - DNA, 13 bp, Homo sapiens
tctaatagtgctt

SEQ ID NO: 5645114 - DNA, 16 bp, Homo sapiens
tctaatatatccacac

SEQ ID NO: 5645115 - DNA, 20 bp, Homo sapiens
tctaatatccccaaattagg

SEQ ID NO: 5645116 - DNA, 21 bp, Homo sapiens
tctaatatgcctaatctgtaa

SEQ ID NO: 5645117 - DNA, 14 bp, Homo sapiens
tctaatatggccac

SEQ ID NO: 5645118 - DNA, 22 bp, Homo sapiens
tctaatattagttggctttcat

SEQ ID NO: 5645119 - DNA, 18 bp, Homo sapiens
tctaatattcacatgttc

SEQ ID NO: 5645120 - DNA, 19 bp, Homo sapiens
tctaatattcacatgttct

SEQ ID NO: 5645121 - DNA, 20 bp, Homo sapiens
tctaatattcacatgttcta

SEQ ID NO: 5645122 - DNA, 15 bp, Homo sapiens
tctaatattgcttct

SEQ ID NO: 5645123 - DNA, 15 bp, Homo sapiens
tctaatcaggttgtt

SEQ ID NO: 5645124 - DNA, 15 bp, Homo sapiens
tctaatcagtgatta

SEQ ID NO: 5645125 - DNA, 16 bp, Homo sapiens
tctaatcagtgattat

SEQ ID NO: 5645126 - DNA, 15 bp, Homo sapiens
tctaatccttttcct

SEQ ID NO: 5645127 - DNA, 16 bp, Homo sapiens
tctaatctcttattct

SEQ ID NO: 5645128 - DNA, 12 bp, Homo sapiens
tctaatctgaac

SEQ ID NO: 5645129 - DNA, 14 bp, Homo sapiens
tctaatctgagctg

SEQ ID NO: 5645130 - DNA, 17 bp, Homo sapiens
tctaatcttgttaaatt

SEQ ID NO: 5645131 - DNA, 13 bp, Homo sapiens
tctaatgaagaga

SEQ ID NO: 5645132 - DNA, 17 bp, Homo sapiens
tctaatgacagataaat

SEQ ID NO: 5645133 - DNA, 18 bp, Homo sapiens
tctaatgacattcaataa

SEQ ID NO: 5645134 - DNA, 22 bp, Homo sapiens
tctaatgaggagagaaaatata

SEQ ID NO: 5645135 - DNA, 24 bp, Homo sapiens
tctaatgaggagagaaaatatatg

SEQ ID NO: 5645136 - DNA, 18 bp, Homo sapiens
tctaatgatcaaaacatg

SEQ ID NO: 5645137 - DNA, 16 bp, Homo sapiens
tctaatgatggcccat

SEQ ID NO: 5645138 - DNA, 23 bp, Homo sapiens
tctaatgatggcccattctactt

SEQ ID NO: 5645139 - DNA, 12 bp, Homo sapiens
tctaatgcatat

SEQ ID NO: 5645140 - DNA, 20 bp, Homo sapiens
tctaatgcatatttataaga

SEQ ID NO: 5645141 - DNA, 22 bp, Homo sapiens
tctaatgcattaacttttgtaa

SEQ ID NO: 5645142 - DNA, 14 bp, Homo sapiens
tctaatgcttgttt

SEQ ID NO: 5645143 - DNA, 21 bp, Homo sapiens
tctaatggccttccataataa

SEQ ID NO: 5645144 - DNA, 21 bp, Homo sapiens
tctaatggggaaatgtagcta

SEQ ID NO: 5645145 - DNA, 12 bp, Homo sapiens
tctaatggtaac

SEQ ID NO: 5645146 - DNA, 14 bp, Homo sapiens
tctaatggtaactt

SEQ ID NO: 5645147 - DNA, 17 bp, Homo sapiens
tctaatggtaacttttg

SEQ ID NO: 5645148 - DNA, 21 bp, Homo sapiens
tctaatggtaacttttgtagt

SEQ ID NO: 5645149 - DNA, 19 bp, Homo sapiens
tctaatgtctcttcctctg

SEQ ID NO: 5645150 - DNA, 21 bp, Homo sapiens
tctaatgtctcttcctctgtt

SEQ ID NO: 5645151 - DNA, 17 bp, Homo sapiens
tctaatgtcttcatttc

SEQ ID NO: 5645152 - DNA, 17 bp, Homo sapiens
tctaatgtgaaaatcat

SEQ ID NO: 5645153 - DNA, 11 bp, Homo sapiens
tctaatgtggt

SEQ ID NO: 5645154 - DNA, 19 bp, Homo sapiens
tctaatgtggttatttctc

SEQ ID NO: 5645155 - DNA, 18 bp, Homo sapiens
tctaatgttattttcctt

SEQ ID NO: 5645156 - DNA, 19 bp, Homo sapiens
tctaatgttattttccttc

SEQ ID NO: 5645157 - DNA, 21 bp, Homo sapiens
tctaatgttattttccttctg

SEQ ID NO: 5645158 - DNA, 14 bp, Homo sapiens
tctaatgttgtatc

SEQ ID NO: 5645159 - DNA, 18 bp, Homo sapiens
tctaatgtttaagcagaa

SEQ ID NO: 5645160 - DNA, 11 bp, Homo sapiens
tctaatgtttg

SEQ ID NO: 5645161 - DNA, 15 bp, Homo sapiens
tctaatgtttgcata

SEQ ID NO: 5645162 - DNA, 18 bp, Homo sapiens
tctaatgtttgcatataa

SEQ ID NO: 5645163 - DNA, 13 bp, Homo sapiens
tctaatgtttgtg

SEQ ID NO: 5645164 - DNA, 14 bp, Homo sapiens
tctaatgtttgtga

SEQ ID NO: 5645165 - DNA, 14 bp, Homo sapiens
tctaattaaaattg

SEQ ID NO: 5645166 - DNA, 15 bp, Homo sapiens
tctaattaaaattgt

SEQ ID NO: 5645167 - DNA, 16 bp, Homo sapiens
tctaattaaaattgtg

SEQ ID NO: 5645168 - DNA, 15 bp, Homo sapiens
tctaattaaagatgg

SEQ ID NO: 5645169 - DNA, 18 bp, Homo sapiens
tctaattaaccttactaa

SEQ ID NO: 5645170 - DNA, 12 bp, Homo sapiens
tctaattagaga

SEQ ID NO: 5645171 - DNA, 18 bp, Homo sapiens
tctaattatgtagctctt

SEQ ID NO: 5645172 - DNA, 21 bp, Homo sapiens
tctaattatgtagctctttgt

SEQ ID NO: 5645173 - DNA, 19 bp, Homo sapiens
tctaattattccaatatga

SEQ ID NO: 5645174 - DNA, 22 bp, Homo sapiens
tctaattatttccacttgccct

SEQ ID NO: 5645175 - DNA, 16 bp, Homo sapiens
tctaattcatttactc

SEQ ID NO: 5645176 - DNA, 22 bp, Homo sapiens
tctagactgcaagaactgtttt

SEQ ID NO: 5645177 - DNA, 14 bp, Homo sapiens
tctagacttcccca

SEQ ID NO: 5645178 - DNA, 15 bp, Homo sapiens
tctagacttccccat

SEQ ID NO: 5645179 - DNA, 15 bp, Homo sapiens
tctagactttctgtt

SEQ ID NO: 5645180 - DNA, 13 bp, Homo sapiens
tctagagaagagg

SEQ ID NO: 5645181 - DNA, 21 bp, Homo sapiens
tctagagaagtggactggagg

SEQ ID NO: 5645182 - DNA, 12 bp, Homo sapiens
tctagagacaca

SEQ ID NO: 5645183 - DNA, 13 bp, Homo sapiens
tctagagacacat

SEQ ID NO: 5645184 - DNA, 14 bp, Homo sapiens
tctagagacacatt

SEQ ID NO: 5645185 - DNA, 22 bp, Homo sapiens
tctagagagatgagaagccagg

SEQ ID NO: 5645186 - DNA, 14 bp, Homo sapiens
tctagagagggaat

SEQ ID NO: 5645187 - DNA, 13 bp, Homo sapiens
tctagagagggag

SEQ ID NO: 5645188 - DNA, 23 bp, Homo sapiens
tctagagagggaggcaagccctg

SEQ ID NO: 5645189 - DNA, 12 bp, Homo sapiens
tctagagcctct

SEQ ID NO: 5645190 - DNA, 19 bp, Homo sapiens
tctagagcctgctggatct

SEQ ID NO: 5645191 - DNA, 13 bp, Homo sapiens
tctagagccttca

SEQ ID NO: 5645192 - DNA, 18 bp, Homo sapiens
tctagagccttcagcctt

SEQ ID NO: 5645193 - DNA, 18 bp, Homo sapiens
tctagagctatgcacacc

SEQ ID NO: 5645194 - DNA, 22 bp, Homo sapiens
tctagagctatgcacaccaaat

SEQ ID NO: 5645195 - DNA, 21 bp, Homo sapiens
tctagagctggaggctgtggg

SEQ ID NO: 5645196 - DNA, 23 bp, Homo sapiens
tctagaggagggggcaggctgag

SEQ ID NO: 5645197 - DNA, 13 bp, Homo sapiens
tctagaggcctca

SEQ ID NO: 5645198 - DNA, 14 bp, Homo sapiens
tctagaggcctcag

SEQ ID NO: 5645199 - DNA, 16 bp, Homo sapiens
tctagaggcctcagtt

SEQ ID NO: 5645200 - DNA, 20 bp, Homo sapiens
tctagaggctcatggccctg

SEQ ID NO: 5645201 - DNA, 24 bp, Homo sapiens
tctagaggctcatggccctgtagt

SEQ ID NO: 5645202 - DNA, 16 bp, Homo sapiens
tctagaggctggcaag

SEQ ID NO: 5645203 - DNA, 21 bp, Homo sapiens
tctagaggcttccttcatttc

SEQ ID NO: 5645204 - DNA, 17 bp, Homo sapiens
tctagagggagaagact

SEQ ID NO: 5645205 - DNA, 15 bp, Homo sapiens
tctagagtcatgtga

SEQ ID NO: 5645206 - DNA, 22 bp, Homo sapiens
tctagagttatcttctttatta

SEQ ID NO: 5645207 - DNA, 17 bp, Homo sapiens
tctagagtttagtcctt

SEQ ID NO: 5645208 - DNA, 23 bp, Homo sapiens
tctagataaccttgtttattagc

SEQ ID NO: 5645209 - DNA, 16 bp, Homo sapiens
tctagatacaataaat

SEQ ID NO: 5645210 - DNA, 18 bp, Homo sapiens
tctagatacctaaaacat

SEQ ID NO: 5645211 - DNA, 22 bp, Homo sapiens
tctagatacctaaaacataaga

SEQ ID NO: 5645212 - DNA, 13 bp, Homo sapiens
tctagatcaatta

SEQ ID NO: 5645213 - DNA, 20 bp, Homo sapiens
tctagatcaattaattctta

SEQ ID NO: 5645214 - DNA, 21 bp, Homo sapiens
tctagatcaattaattcttaa

SEQ ID NO: 5645215 - DNA, 15 bp, Homo sapiens
tctagatcactgtgc

SEQ ID NO: 5645216 - DNA, 20 bp, Homo sapiens
tctagatcagatgctccaag

SEQ ID NO: 5645217 - DNA, 15 bp, Homo sapiens
tctagatcctgcacc

SEQ ID NO: 5645218 - DNA, 14 bp, Homo sapiens
tctagatctcagcc

SEQ ID NO: 5645219 - DNA, 20 bp, Homo sapiens
tctagatgaagttttacatt

SEQ ID NO: 5645220 - DNA, 23 bp, Homo sapiens
tctagatgaagttttacattgtt

SEQ ID NO: 5645221 - DNA, 21 bp, Homo sapiens
tctagatgattttttgaaagt

SEQ ID NO: 5645222 - DNA, 22 bp, Homo sapiens
tctagatgattttttgaaagtt

SEQ ID NO: 5645223 - DNA, 22 bp, Homo sapiens
tctagatggatattagatgccc

SEQ ID NO: 5645224 - DNA, 18 bp, Homo sapiens
tctagatggcaacattgg

SEQ ID NO: 5645225 - DNA, 18 bp, Homo sapiens
tctagatggctcctctca

SEQ ID NO: 5645226 - DNA, 20 bp, Homo sapiens
tctagatggctcctctcagt

SEQ ID NO: 5645227 - DNA, 16 bp, Homo sapiens
tctagatgtaaatttt

SEQ ID NO: 5645228 - DNA, 22 bp, Homo sapiens
tctagatgtttattcttctaga

SEQ ID NO: 5645229 - DNA, 23 bp, Homo sapiens
tctagattaccccctcattgttt

SEQ ID NO: 5645230 - DNA, 22 bp, Homo sapiens
tctagattcaaaggttctaggt

SEQ ID NO: 5645231 - DNA, 20 bp, Homo sapiens
tctagattcataaatacaaa

SEQ ID NO: 5645232 - DNA, 19 bp, Homo sapiens
tctagattccattggtcca

SEQ ID NO: 5645233 - DNA, 11 bp, Homo sapiens
tctagattctc

SEQ ID NO: 5645234 - DNA, 21 bp, Homo sapiens
tctagattctctggctgtaag

SEQ ID NO: 5645235 - DNA, 13 bp, Homo sapiens
tctagattttgaa

SEQ ID NO: 5645236 - DNA, 18 bp, Homo sapiens
tctagattttgaaaaatt

SEQ ID NO: 5645237 - DNA, 16 bp, Homo sapiens
tctagcaaacagatgt

SEQ ID NO: 5645238 - DNA, 15 bp, Homo sapiens
tctagcaaatatgct

SEQ ID NO: 5645239 - DNA, 20 bp, Homo sapiens
tctagcaaatatgctgttat

SEQ ID NO: 5645240 - DNA, 22 bp, Homo sapiens
tctagcaaatatgctgttatgt

SEQ ID NO: 5645241 - DNA, 21 bp, Homo sapiens
tctagcaactgttggataata

SEQ ID NO: 5645242 - DNA, 19 bp, Homo sapiens
tctagcaagaagattctaa

SEQ ID NO: 5645243 - DNA, 23 bp, Homo sapiens
tctagcaatcacaacactggctg

SEQ ID NO: 5645244 - DNA, 18 bp, Homo sapiens
tctagcaattttctttgt

SEQ ID NO: 5645245 - DNA, 17 bp, Homo sapiens
tctagcactcattttct

SEQ ID NO: 5645246 - DNA, 15 bp, Homo sapiens
tctagcactggcctg

SEQ ID NO: 5645247 - DNA, 14 bp, Homo sapiens
tctagcacttcctt

SEQ ID NO: 5645248 - DNA, 18 bp, Homo sapiens
tctagcacttccttgcca

SEQ ID NO: 5645249 - DNA, 13 bp, Homo sapiens
tctagcagctggc

SEQ ID NO: 5645250 - DNA, 14 bp, Homo sapiens
tctagcagctggcc

SEQ ID NO: 5645251 - DNA, 12 bp, Homo sapiens
tctagcaggcag

SEQ ID NO: 5645252 - DNA, 13 bp, Homo sapiens
tctagcaggcagg

SEQ ID NO: 5645253 - DNA, 23 bp, Homo sapiens
tctagcagtaaaagataaatttg

SEQ ID NO: 5645254 - DNA, 23 bp, Homo sapiens
tctagcagtaaatacttgcagtt

SEQ ID NO: 5645255 - DNA, 13 bp, Homo sapiens
tctagcatataga

SEQ ID NO: 5645256 - DNA, 22 bp, Homo sapiens
tctagcatatagactatataat

SEQ ID NO: 5645257 - DNA, 17 bp, Homo sapiens
tctagcatggcatattt

SEQ ID NO: 5645258 - DNA, 16 bp, Homo sapiens
tctagcatttatttct

SEQ ID NO: 5645259 - DNA, 18 bp, Homo sapiens
tctagcatttatttctct

SEQ ID NO: 5645260 - DNA, 16 bp, Homo sapiens
tctagccactccctcc

SEQ ID NO: 5645261 - DNA, 17 bp, Homo sapiens
tctagccactccctccc

SEQ ID NO: 5645262 - DNA, 20 bp, Homo sapiens
tctagccactccctcccaga

SEQ ID NO: 5645263 - DNA, 13 bp, Homo sapiens
tctagccagagga

SEQ ID NO: 5645264 - DNA, 21 bp, Homo sapiens
tctagccagcccctcttcccc

SEQ ID NO: 5645265 - DNA, 14 bp, Homo sapiens
tctagccaggcctc

SEQ ID NO: 5645266 - DNA, 16 bp, Homo sapiens
tctagccaggcctccc

SEQ ID NO: 5645267 - DNA, 20 bp, Homo sapiens
tctagccaggcctcccgcat

SEQ ID NO: 5645268 - DNA, 13 bp, Homo sapiens
tctagccatggct

SEQ ID NO: 5645269 - DNA, 16 bp, Homo sapiens
tctagcccctctggat

SEQ ID NO: 5645270 - DNA, 22 bp, Homo sapiens
tctagcccctctggattccctt

SEQ ID NO: 5645271 - DNA, 21 bp, Homo sapiens
tctagccctctccctcagtcc

SEQ ID NO: 5645272 - DNA, 16 bp, Homo sapiens
tctagccgatggaaaa

SEQ ID NO: 5645273 - DNA, 20 bp, Homo sapiens
tctagccgctgccctgggtc

SEQ ID NO: 5645274 - DNA, 21 bp, Homo sapiens
tctagccgctgccctgggtcc

SEQ ID NO: 5645275 - DNA, 20 bp, Homo sapiens
tctagcctatttacctgcag

SEQ ID NO: 5645276 - DNA, 12 bp, Homo sapiens
tctagcctctgg

SEQ ID NO: 5645277 - DNA, 14 bp, Homo sapiens
tctagcctgcactt

SEQ ID NO: 5645278 - DNA, 21 bp, Homo sapiens
tctagcctggcaacagagcga

SEQ ID NO: 5645279 - DNA, 12 bp, Homo sapiens
tctagcctgggc

SEQ ID NO: 5645280 - DNA, 20 bp, Homo sapiens
tctagcctgggccagagaag

SEQ ID NO: 5645281 - DNA, 20 bp, Homo sapiens
tctagcctggggcttgaatt

SEQ ID NO: 5645282 - DNA, 21 bp, Homo sapiens
tctagcctggggcttgaattt

SEQ ID NO: 5645283 - DNA, 22 bp, Homo sapiens
tctagcctggggcttgaatttg

SEQ ID NO: 5645284 - DNA, 22 bp, Homo sapiens
tctagcgaacgtatttctccag

SEQ ID NO: 5645285 - DNA, 23 bp, Homo sapiens
tctagcgcagttttttttttctt

SEQ ID NO: 5645286 - DNA, 17 bp, Homo sapiens
tctagctaaataaatgg

SEQ ID NO: 5645287 - DNA, 23 bp, Homo sapiens
tctagctagaaatatgattttat

SEQ ID NO: 5645288 - DNA, 22 bp, Homo sapiens
tctagctataacaactctattt

SEQ ID NO: 5645289 - DNA, 13 bp, Homo sapiens
tctagctccgggg

SEQ ID NO: 5645290 - DNA, 14 bp, Homo sapiens
tctagctctcacag

SEQ ID NO: 5645291 - DNA, 16 bp, Homo sapiens
tctagctctcacagac

SEQ ID NO: 5645292 - DNA, 17 bp, Homo sapiens
tctagctctcacagaca

SEQ ID NO: 5645293 - DNA, 15 bp, Homo sapiens
tctagctgagcttta

SEQ ID NO: 5645294 - DNA, 22 bp, Homo sapiens
tctagctgagctttaaatcatt

SEQ ID NO: 5645295 - DNA, 20 bp, Homo sapiens
tctagctgcagatgcctctg

SEQ ID NO: 5645296 - DNA, 18 bp, Homo sapiens
tctagctggagccccgca

SEQ ID NO: 5645297 - DNA, 13 bp, Homo sapiens
tctagctggcagg

SEQ ID NO: 5645298 - DNA, 14 bp, Homo sapiens
tctagctggcagga

SEQ ID NO: 5645299 - DNA, 17 bp, Homo sapiens
tctagctggcaggacac

SEQ ID NO: 5645300 - DNA, 18 bp, Homo sapiens
tctagctgtatgatttgt

SEQ ID NO: 5645301 - DNA, 13 bp, Homo sapiens
tctagctgtctgt

SEQ ID NO: 5645302 - DNA, 18 bp, Homo sapiens
tctagctgttgagctgtt

SEQ ID NO: 5645303 - DNA, 21 bp, Homo sapiens
tctagcttaagtgtaaatgaa

SEQ ID NO: 5645304 - DNA, 15 bp, Homo sapiens
tctagctttgtcata

SEQ ID NO: 5645305 - DNA, 17 bp, Homo sapiens
tctagcttttctatttt

SEQ ID NO: 5645306 - DNA, 22 bp, Homo sapiens
tctagctttttaattaagcaaa

SEQ ID NO: 5645307 - DNA, 15 bp, Homo sapiens
tctaggaaatatact

SEQ ID NO: 5645308 - DNA, 14 bp, Homo sapiens
tctaggaaatctag

SEQ ID NO: 5645309 - DNA, 19 bp, Homo sapiens
tctaggaaattcttgaaaa

SEQ ID NO: 5645310 - DNA, 15 bp, Homo sapiens
tctaggaagacattt

SEQ ID NO: 5645311 - DNA, 12 bp, Homo sapiens
tctaggaagact

SEQ ID NO: 5645312 - DNA, 19 bp, Homo sapiens
tctaggaagactttggaaa

SEQ ID NO: 5645313 - DNA, 15 bp, Homo sapiens
tctaggaaggtgtga

SEQ ID NO: 5645314 - DNA, 15 bp, Homo sapiens
tctaggaatggagga

SEQ ID NO: 5645315 - DNA, 22 bp, Homo sapiens
tctaggaatggaggagccaggc

SEQ ID NO: 5645316 - DNA, 13 bp, Homo sapiens
tctaggacacagt

SEQ ID NO: 5645317 - DNA, 21 bp, Homo sapiens
tctaggacacagttcctggga

SEQ ID NO: 5645318 - DNA, 17 bp, Homo sapiens
tctaggactctgcactg

SEQ ID NO: 5645319 - DNA, 16 bp, Homo sapiens
tctaggactgaattat

SEQ ID NO: 5645320 - DNA, 14 bp, Homo sapiens
tctaggactgcagt

SEQ ID NO: 5645321 - DNA, 20 bp, Homo sapiens
tctaggactgcagtgtggag

SEQ ID NO: 5645322 - DNA, 16 bp, Homo sapiens
tctaggagacagagcc

SEQ ID NO: 5645323 - DNA, 17 bp, Homo sapiens
tctaggagacagagcca

SEQ ID NO: 5645324 - DNA, 19 bp, Homo sapiens
tctaggagacagagccaag

SEQ ID NO: 5645325 - DNA, 13 bp, Homo sapiens
tctaggagaggag

SEQ ID NO: 5645326 - DNA, 20 bp, Homo sapiens
tctaggagctgggaggaaaa

SEQ ID NO: 5645327 - DNA, 19 bp, Homo sapiens
tctaggaggatgctgtgcc

SEQ ID NO: 5645328 - DNA, 20 bp, Homo sapiens
tctaggaggatgctgtgcct

SEQ ID NO: 5645329 - DNA, 21 bp, Homo sapiens
tctaggaggctcctcctcgca

SEQ ID NO: 5645330 - DNA, 19 bp, Homo sapiens
tctaggagggagacactgg

SEQ ID NO: 5645331 - DNA, 20 bp, Homo sapiens
tctaggatagttgatgcatg

SEQ ID NO: 5645332 - DNA, 22 bp, Homo sapiens
tctaggatagttgatgcatgtt

SEQ ID NO: 5645333 - DNA, 18 bp, Homo sapiens
tctaggcaaaattgtgaa

SEQ ID NO: 5645334 - DNA, 16 bp, Homo sapiens
tctaggcaagcaggac

SEQ ID NO: 5645335 - DNA, 23 bp, Homo sapiens
tctaggcaagcaggacctggcat

SEQ ID NO: 5645336 - DNA, 16 bp, Homo sapiens
tctaggcacaaggttg

SEQ ID NO: 5645337 - DNA, 18 bp, Homo sapiens
tctaggcagaagaagctg

SEQ ID NO: 5645338 - DNA, 21 bp, Homo sapiens
tctaggcagttcaaagcagga

SEQ ID NO: 5645339 - DNA, 18 bp, Homo sapiens
tctaggcatctcctctcc

SEQ ID NO: 5645340 - DNA, 14 bp, Homo sapiens
tctaggcatttcat

SEQ ID NO: 5645341 - DNA, 21 bp, Homo sapiens
tctaggcatttcattatgctt

SEQ ID NO: 5645342 - DNA, 23 bp, Homo sapiens
tctaggccccccagaaagctgcc

SEQ ID NO: 5645343 - DNA, 12 bp, Homo sapiens
tctaggccctgt

SEQ ID NO: 5645344 - DNA, 20 bp, Homo sapiens
tctaggccctgtgagcacaa

SEQ ID NO: 5645345 - DNA, 22 bp, Homo sapiens
tctaggccctgtgagcacaaag

SEQ ID NO: 5645346 - DNA, 13 bp, Homo sapiens
tctaggcctgaac

SEQ ID NO: 5645347 - DNA, 18 bp, Homo sapiens
tctaggcctttcctctgc

SEQ ID NO: 5645348 - DNA, 21 bp, Homo sapiens
tctaggcgaggcgaagctgag

SEQ ID NO: 5645349 - DNA, 17 bp, Homo sapiens
tctaggctctgccttcg

SEQ ID NO: 5645350 - DNA, 13 bp, Homo sapiens
tctaggctgcccc

SEQ ID NO: 5645351 - DNA, 12 bp, Homo sapiens
tctaggctgggg

SEQ ID NO: 5645352 - DNA, 18 bp, Homo sapiens
tctcaaacttgtggcctc

SEQ ID NO: 5645353 - DNA, 19 bp, Homo sapiens
tctcaaacttgtggcctca

SEQ ID NO: 5645354 - DNA, 17 bp, Homo sapiens
tctcaaagaaatattaa

SEQ ID NO: 5645355 - DNA, 17 bp, Homo sapiens
tctcaaagaaatttcca

SEQ ID NO: 5645356 - DNA, 17 bp, Homo sapiens
tctcaaagagattcgaa

SEQ ID NO: 5645357 - DNA, 16 bp, Homo sapiens
tctcaaagagggggct

SEQ ID NO: 5645358 - DNA, 19 bp, Homo sapiens
tctcaaagagggggctctg

SEQ ID NO: 5645359 - DNA, 22 bp, Homo sapiens
tctcaaagagggggctctgccc

SEQ ID NO: 5645360 - DNA, 22 bp, Homo sapiens
tctcaaagatgcgtttgcctcc

SEQ ID NO: 5645361 - DNA, 14 bp, Homo sapiens
tctcaaagcagaag

SEQ ID NO: 5645362 - DNA, 13 bp, Homo sapiens
tctcaaagcatca

SEQ ID NO: 5645363 - DNA, 21 bp, Homo sapiens
tctcaaagcatcaaataatac

SEQ ID NO: 5645364 - DNA, 14 bp, Homo sapiens
tctcaaaggagaaa

SEQ ID NO: 5645365 - DNA, 14 bp, Homo sapiens
tctcaaaggagctt

SEQ ID NO: 5645366 - DNA, 16 bp, Homo sapiens
tctcaaagtaaggctg

SEQ ID NO: 5645367 - DNA, 18 bp, Homo sapiens
tctcaaagtataatcttt

SEQ ID NO: 5645368 - DNA, 19 bp, Homo sapiens
tctcaaagtataatctttc

SEQ ID NO: 5645369 - DNA, 18 bp, Homo sapiens
tctcaaagttaaaagtaa

SEQ ID NO: 5645370 - DNA, 22 bp, Homo sapiens
tctcaaagtttcctaatcagaa

SEQ ID NO: 5645371 - DNA, 12 bp, Homo sapiens
tctcaaagtttt

SEQ ID NO: 5645372 - DNA, 16 bp, Homo sapiens
tctcaaagttttgaaa

SEQ ID NO: 5645373 - DNA, 23 bp, Homo sapiens
tctcaaagttttgaaaagctatt

SEQ ID NO: 5645374 - DNA, 19 bp, Homo sapiens
tctcaaagtttttacagtg

SEQ ID NO: 5645375 - DNA, 20 bp, Homo sapiens
tctcaaatccactgacagat

SEQ ID NO: 5645376 - DNA, 23 bp, Homo sapiens
tctcaaatccctctccaactgcc

SEQ ID NO: 5645377 - DNA, 17 bp, Homo sapiens
tctcaaatctgctttca

SEQ ID NO: 5645378 - DNA, 21 bp, Homo sapiens
tctcaaatctgctttcatcca

SEQ ID NO: 5645379 - DNA, 19 bp, Homo sapiens
tctcaaatgctaaatgcaa

SEQ ID NO: 5645380 - DNA, 13 bp, Homo sapiens
tctcaaatgtgac

SEQ ID NO: 5645381 - DNA, 15 bp, Homo sapiens
tctcaaatgttttct

SEQ ID NO: 5645382 - DNA, 18 bp, Homo sapiens
tctcaaatgttttctgca

SEQ ID NO: 5645383 - DNA, 15 bp, Homo sapiens
tctcaaattcagctc

SEQ ID NO: 5645384 - DNA, 16 bp, Homo sapiens
tctcaaattcagctct

SEQ ID NO: 5645385 - DNA, 13 bp, Homo sapiens
tctcaaatttcta

SEQ ID NO: 5645386 - DNA, 14 bp, Homo sapiens
tctcaaatttctaa

SEQ ID NO: 5645387 - DNA, 16 bp, Homo sapiens
tctcaaatttctaaat

SEQ ID NO: 5645388 - DNA, 21 bp, Homo sapiens
tctcaaatttggattgctaat

SEQ ID NO: 5645389 - DNA, 22 bp, Homo sapiens
tctcaacaaggcaaaaacaaag

SEQ ID NO: 5645390 - DNA, 23 bp, Homo sapiens
tctcaacacacagtatagataaa

SEQ ID NO: 5645391 - DNA, 21 bp, Homo sapiens
tctcaacaccatgattccttt

SEQ ID NO: 5645392 - DNA, 18 bp, Homo sapiens
tctcaacatggaaaaatc

SEQ ID NO: 5645393 - DNA, 14 bp, Homo sapiens
tctcaaccttggcc

SEQ ID NO: 5645394 - DNA, 16 bp, Homo sapiens
tctcaaccttggcctt

SEQ ID NO: 5645395 - DNA, 17 bp, Homo sapiens
tctcaaccttggccttc

SEQ ID NO: 5645396 - DNA, 18 bp, Homo sapiens
tctcaaccttggccttct

SEQ ID NO: 5645397 - DNA, 17 bp, Homo sapiens
tctcaacgcagtaattc

SEQ ID NO: 5645398 - DNA, 15 bp, Homo sapiens
tctcaactccaaact

SEQ ID NO: 5645399 - DNA, 16 bp, Homo sapiens
tctcaagacctgagta

SEQ ID NO: 5645400 - DNA, 12 bp, Homo sapiens
tctcaagactga

SEQ ID NO: 5645401 - DNA, 13 bp, Homo sapiens
tctcaagacttct

SEQ ID NO: 5645402 - DNA, 23 bp, Homo sapiens
tctcaagaggcagagttctgtga

SEQ ID NO: 5645403 - DNA, 17 bp, Homo sapiens
tctcaagagtgctgaga

SEQ ID NO: 5645404 - DNA, 17 bp, Homo sapiens
tctcaagatattcaggt

SEQ ID NO: 5645405 - DNA, 22 bp, Homo sapiens
tctcaagattatattataataa

SEQ ID NO: 5645406 - DNA, 19 bp, Homo sapiens
tctcaagcactaaaaagtg

SEQ ID NO: 5645407 - DNA, 21 bp, Homo sapiens
tctcaagcactaaaaagtggc

SEQ ID NO: 5645408 - DNA, 15 bp, Homo sapiens
tctcaagccagcccc

SEQ ID NO: 5645409 - DNA, 20 bp, Homo sapiens
tctcaagccgcatcccagac

SEQ ID NO: 5645410 - DNA, 21 bp, Homo sapiens
tctcaagccgcatcccagact

SEQ ID NO: 5645411 - DNA, 20 bp, Homo sapiens
tctcaagcgctatccacaga

SEQ ID NO: 5645412 - DNA, 15 bp, Homo sapiens
tctcaagctaagtaa

SEQ ID NO: 5645413 - DNA, 20 bp, Homo sapiens
tctcaagctaagtaaaaata

SEQ ID NO: 5645414 - DNA, 23 bp, Homo sapiens
tctcaagctagtgtttctagcta

SEQ ID NO: 5645415 - DNA, 14 bp, Homo sapiens
tctcaaggacacat

SEQ ID NO: 5645416 - DNA, 21 bp, Homo sapiens
tctcaaggagaggcaaagaaa

SEQ ID NO: 5645417 - DNA, 14 bp, Homo sapiens
tctcaagggtggca

SEQ ID NO: 5645418 - DNA, 20 bp, Homo sapiens
tctcaagggtggcaggtcac

SEQ ID NO: 5645419 - DNA, 22 bp, Homo sapiens
tctcaagtaacatgacttcctt

SEQ ID NO: 5645420 - DNA, 14 bp, Homo sapiens
tctcaagtaatata

SEQ ID NO: 5645421 - DNA, 14 bp, Homo sapiens
tctcaagtgaaaga

SEQ ID NO: 5645422 - DNA, 20 bp, Homo sapiens
tctcaagtgttttggagaaa

SEQ ID NO: 5645423 - DNA, 12 bp, Homo sapiens
tctcaagttcta

SEQ ID NO: 5645424 - DNA, 14 bp, Homo sapiens
tctcaagttctaag

SEQ ID NO: 5645425 - DNA, 16 bp, Homo sapiens
tctcaagttctaagat

SEQ ID NO: 5645426 - DNA, 21 bp, Homo sapiens
tctcaagttctaagattctaa

SEQ ID NO: 5645427 - DNA, 22 bp, Homo sapiens
tctcaagttctaagattctaat

SEQ ID NO: 5645428 - DNA, 21 bp, Homo sapiens
tctcaatacttgaatatggaa

SEQ ID NO: 5645429 - DNA, 21 bp, Homo sapiens
tctcaatagctccaagctgtt

SEQ ID NO: 5645430 - DNA, 21 bp, Homo sapiens
tctcaatagttcttaaaatta

SEQ ID NO: 5645431 - DNA, 18 bp, Homo sapiens
tctcaatattcaataaag

SEQ ID NO: 5645432 - DNA, 16 bp, Homo sapiens
tctcaatatttattat

SEQ ID NO: 5645433 - DNA, 16 bp, Homo sapiens
tctcaatcagtgcagt

SEQ ID NO: 5645434 - DNA, 14 bp, Homo sapiens
tctcaatcattgtc

SEQ ID NO: 5645435 - DNA, 16 bp, Homo sapiens
tctcaatccctttgca

SEQ ID NO: 5645436 - DNA, 23 bp, Homo sapiens
tctcaatcctaatttctcctccc

SEQ ID NO: 5645437 - DNA, 19 bp, Homo sapiens
tctcaatcctgcagtgggg

SEQ ID NO: 5645438 - DNA, 14 bp, Homo sapiens
tctcaatctgcagc

SEQ ID NO: 5645439 - DNA, 15 bp, Homo sapiens
tctcaatctgcagcc

SEQ ID NO: 5645440 - DNA, 15 bp, Homo sapiens
tctcaatgcttttct

SEQ ID NO: 5645441 - DNA, 19 bp, Homo sapiens
tctcaatggtattgtaact

SEQ ID NO: 5645442 - DNA, 21 bp, Homo sapiens
tctcaatggtgctataataaa

SEQ ID NO: 5645443 - DNA, 15 bp, Homo sapiens
tctcaattccaacag

SEQ ID NO: 5645444 - DNA, 20 bp, Homo sapiens
tctcaattgaaagcttttaa

SEQ ID NO: 5645445 - DNA, 23 bp, Homo sapiens
tctcaattgaaagcttttaaaat

SEQ ID NO: 5645446 - DNA, 22 bp, Homo sapiens
tctcaatttatttggggggaaa

SEQ ID NO: 5645447 - DNA, 17 bp, Homo sapiens
tctcaatttgaaacaca

SEQ ID NO: 5645448 - DNA, 12 bp, Homo sapiens
tctcaattttgt

SEQ ID NO: 5645449 - DNA, 22 bp, Homo sapiens
tctcaatttttggttgaataaa

SEQ ID NO: 5645450 - DNA, 15 bp, Homo sapiens
tctcacaaataagta

SEQ ID NO: 5645451 - DNA, 12 bp, Homo sapiens
tctcacacacac

SEQ ID NO: 5645452 - DNA, 16 bp, Homo sapiens
tctcacacagctgggg

SEQ ID NO: 5645453 - DNA, 24 bp, Homo sapiens
tctcacacatcacattcccatggt

SEQ ID NO: 5645454 - DNA, 21 bp, Homo sapiens
tctcacacatgagcatcaggc

SEQ ID NO: 5645455 - DNA, 11 bp, Homo sapiens
tctcacactcc

SEQ ID NO: 5645456 - DNA, 16 bp, Homo sapiens
tctcacactcctcctg

SEQ ID NO: 5645457 - DNA, 14 bp, Homo sapiens
tctcacactggcgt

SEQ ID NO: 5645458 - DNA, 19 bp, Homo sapiens
tctcacactggtctgctgt

SEQ ID NO: 5645459 - DNA, 20 bp, Homo sapiens
tctcacactggttctcaatg

SEQ ID NO: 5645460 - DNA, 22 bp, Homo sapiens
tctcacactggttctcaatgaa

SEQ ID NO: 5645461 - DNA, 23 bp, Homo sapiens
tctcacactggttctcaatgaaa

SEQ ID NO: 5645462 - DNA, 13 bp, Homo sapiens
tctcacagacagg

SEQ ID NO: 5645463 - DNA, 19 bp, Homo sapiens
tctcacagacaggacccct

SEQ ID NO: 5645464 - DNA, 16 bp, Homo sapiens
tctcacagagaagctc

SEQ ID NO: 5645465 - DNA, 18 bp, Homo sapiens
tctcacagagaagctcct

SEQ ID NO: 5645466 - DNA, 20 bp, Homo sapiens
tctcacagagaagctcctgc

SEQ ID NO: 5645467 - DNA, 20 bp, Homo sapiens
tctcacagcacatgctggcc

SEQ ID NO: 5645468 - DNA, 18 bp, Homo sapiens
tctcacagctatgcaaaa

SEQ ID NO: 5645469 - DNA, 14 bp, Homo sapiens
tctcacaggcagct

SEQ ID NO: 5645470 - DNA, 18 bp, Homo sapiens
tctcacaggcagctctga

SEQ ID NO: 5645471 - DNA, 18 bp, Homo sapiens
tctcacaggctgagaact

SEQ ID NO: 5645472 - DNA, 19 bp, Homo sapiens
tctcacaggctgagaactc

SEQ ID NO: 5645473 - DNA, 19 bp, Homo sapiens
tctcacagtgggagccagg

SEQ ID NO: 5645474 - DNA, 21 bp, Homo sapiens
tctcacagtgggagccagggc

SEQ ID NO: 5645475 - DNA, 12 bp, Homo sapiens
tctcacagtgtg

SEQ ID NO: 5645476 - DNA, 20 bp, Homo sapiens
tctcacatgattccagccat

SEQ ID NO: 5645477 - DNA, 20 bp, Homo sapiens
tctcacatgctgtttttcct

SEQ ID NO: 5645478 - DNA, 20 bp, Homo sapiens
tctcacatggaatgagggtt

SEQ ID NO: 5645479 - DNA, 23 bp, Homo sapiens
tctcacatttttatacctgttta

SEQ ID NO: 5645480 - DNA, 21 bp, Homo sapiens
tctcaccacataccatgtgga

SEQ ID NO: 5645481 - DNA, 17 bp, Homo sapiens
tctcaccacgggaaagc

SEQ ID NO: 5645482 - DNA, 12 bp, Homo sapiens
tctcaccaggaa

SEQ ID NO: 5645483 - DNA, 19 bp, Homo sapiens
tctcaccaggcagcctctg

SEQ ID NO: 5645484 - DNA, 22 bp, Homo sapiens
tctcaccaggcagcctctgggg

SEQ ID NO: 5645485 - DNA, 20 bp, Homo sapiens
tctcaccatttccccagggc

SEQ ID NO: 5645486 - DNA, 15 bp, Homo sapiens
tctcaccatttggat

SEQ ID NO: 5645487 - DNA, 16 bp, Homo sapiens
tctcaccatttggatc

SEQ ID NO: 5645488 - DNA, 11 bp, Homo sapiens
tctcacccacc

SEQ ID NO: 5645489 - DNA, 18 bp, Homo sapiens
tctcacccaccagctcca

SEQ ID NO: 5645490 - DNA, 15 bp, Homo sapiens
tctcacccagcctgg

SEQ ID NO: 5645491 - DNA, 14 bp, Homo sapiens
tctcaccccactcc

SEQ ID NO: 5645492 - DNA, 17 bp, Homo sapiens
tctcaccccatcccaca

SEQ ID NO: 5645493 - DNA, 21 bp, Homo sapiens
tctcaccccatcccacaccct

SEQ ID NO: 5645494 - DNA, 21 bp, Homo sapiens
tctcacccccaccctagcctc

SEQ ID NO: 5645495 - DNA, 18 bp, Homo sapiens
tctcaccctggaggcacc

SEQ ID NO: 5645496 - DNA, 19 bp, Homo sapiens
tctcaccctggaggcacct

SEQ ID NO: 5645497 - DNA, 15 bp, Homo sapiens
tctcaccctgtgaaa

SEQ ID NO: 5645498 - DNA, 18 bp, Homo sapiens
tctcaccggctctcacct

SEQ ID NO: 5645499 - DNA, 18 bp, Homo sapiens
tctcacctaaaccctctg

SEQ ID NO: 5645500 - DNA, 19 bp, Homo sapiens
tctcacctaaaccctctgt

SEQ ID NO: 5645501 - DNA, 22 bp, Homo sapiens
tctcacctaaaccctctgtgaa

SEQ ID NO: 5645502 - DNA, 21 bp, Homo sapiens
tctcacctaatggttgtacat

SEQ ID NO: 5645503 - DNA, 18 bp, Homo sapiens
tctcacctagaccttgcc

SEQ ID NO: 5645504 - DNA, 20 bp, Homo sapiens
tctcacctccgaactgttca

SEQ ID NO: 5645505 - DNA, 18 bp, Homo sapiens
tctcacctcctgctgggc

SEQ ID NO: 5645506 - DNA, 13 bp, Homo sapiens
tctcacctctagg

SEQ ID NO: 5645507 - DNA, 24 bp, Homo sapiens
tctcacctggacttaagcatctgg

SEQ ID NO: 5645508 - DNA, 22 bp, Homo sapiens
tctcacctggaggcaagaggga

SEQ ID NO: 5645509 - DNA, 12 bp, Homo sapiens
tctcacctggcc

SEQ ID NO: 5645510 - DNA, 19 bp, Homo sapiens
tctcacctggccctgcttc

SEQ ID NO: 5645511 - DNA, 21 bp, Homo sapiens
tctcacctggccctgcttcct

SEQ ID NO: 5645512 - DNA, 15 bp, Homo sapiens
tctcacctgtactct

SEQ ID NO: 5645513 - DNA, 23 bp, Homo sapiens
tctcaccttgagcccacccccac

SEQ ID NO: 5645514 - DNA, 15 bp, Homo sapiens
tctcacgattccagt

SEQ ID NO: 5645515 - DNA, 20 bp, Homo sapiens
tctcacgctttgtttactct

SEQ ID NO: 5645516 - DNA, 20 bp, Homo sapiens
tctcacggccacacagctgc

SEQ ID NO: 5645517 - DNA, 21 bp, Homo sapiens
tctcacggccacacagctgcc

SEQ ID NO: 5645518 - DNA, 14 bp, Homo sapiens
tctcacgggccctg

SEQ ID NO: 5645519 - DNA, 17 bp, Homo sapiens
tctcacgggccctgccc

SEQ ID NO: 5645520 - DNA, 23 bp, Homo sapiens
tctcacgggccctgccccagccc

SEQ ID NO: 5645521 - DNA, 15 bp, Homo sapiens
tctcactagtgccaa

SEQ ID NO: 5645522 - DNA, 19 bp, Homo sapiens
tctcactagtgtcaggccc

SEQ ID NO: 5645523 - DNA, 20 bp, Homo sapiens
tctcactagtgtcaggcccc

SEQ ID NO: 5645524 - DNA, 15 bp, Homo sapiens
tctcactatgctgct

SEQ ID NO: 5645525 - DNA, 19 bp, Homo sapiens
tctcactatgttgcccagg

SEQ ID NO: 5645526 - DNA, 14 bp, Homo sapiens
tctcactcacattt

SEQ ID NO: 5645527 - DNA, 24 bp, Homo sapiens
tctcactcaccactaccagccagc

SEQ ID NO: 5645528 - DNA, 23 bp, Homo sapiens
tctccagcccatgctggctgggg

SEQ ID NO: 5645529 - DNA, 14 bp, Homo sapiens
tctccagcccctgg

SEQ ID NO: 5645530 - DNA, 21 bp, Homo sapiens
tctccagcctcacagatgctg

SEQ ID NO: 5645531 - DNA, 14 bp, Homo sapiens
tctccagcctggac

SEQ ID NO: 5645532 - DNA, 21 bp, Homo sapiens
tctccagcctggacccccagc

SEQ ID NO: 5645533 - DNA, 22 bp, Homo sapiens
tctccagcctggacccccagct

SEQ ID NO: 5645534 - DNA, 22 bp, Homo sapiens
tctccagccttctctctctggt

SEQ ID NO: 5645535 - DNA, 21 bp, Homo sapiens
tctccagcgtcagctgctccc

SEQ ID NO: 5645536 - DNA, 16 bp, Homo sapiens
tctccagctcagaacc

SEQ ID NO: 5645537 - DNA, 22 bp, Homo sapiens
tctccagctcagaacccagggc

SEQ ID NO: 5645538 - DNA, 12 bp, Homo sapiens
tctccagctgac

SEQ ID NO: 5645539 - DNA, 12 bp, Homo sapiens
tctccagctgcc

SEQ ID NO: 5645540 - DNA, 17 bp, Homo sapiens
tctccagctgcctgggc

SEQ ID NO: 5645541 - DNA, 14 bp, Homo sapiens
tctccagcttcagc

SEQ ID NO: 5645542 - DNA, 20 bp, Homo sapiens
tctccagcttcagctcaact

SEQ ID NO: 5645543 - DNA, 13 bp, Homo sapiens
tctccagcttccc

SEQ ID NO: 5645544 - DNA, 21 bp, Homo sapiens
tctccagctttccctccccag

SEQ ID NO: 5645545 - DNA, 17 bp, Homo sapiens
tctccaggcaccgcctg

SEQ ID NO: 5645546 - DNA, 21 bp, Homo sapiens
tctccaggcacgggaaacttg

SEQ ID NO: 5645547 - DNA, 13 bp, Homo sapiens
tctccaggcattt

SEQ ID NO: 5645548 - DNA, 22 bp, Homo sapiens
tctccaggcccagcctggcccc

SEQ ID NO: 5645549 - DNA, 11 bp, Homo sapiens
tctccaggcct

SEQ ID NO: 5645550 - DNA, 13 bp, Homo sapiens
tctccaggcctgt

SEQ ID NO: 5645551 - DNA, 15 bp, Homo sapiens
tctccaggcctgtca

SEQ ID NO: 5645552 - DNA, 23 bp, Homo sapiens
tctccaggcctgtcaagagggag

SEQ ID NO: 5645553 - DNA, 15 bp, Homo sapiens
tctccaggcgccggc

SEQ ID NO: 5645554 - DNA, 16 bp, Homo sapiens
tctccaggctgtatcc

SEQ ID NO: 5645555 - DNA, 13 bp, Homo sapiens
tctccaggcttca

SEQ ID NO: 5645556 - DNA, 12 bp, Homo sapiens
tctccagggacc

SEQ ID NO: 5645557 - DNA, 21 bp, Homo sapiens
tctccagggacccttgcctgc

SEQ ID NO: 5645558 - DNA, 20 bp, Homo sapiens
tctccagggagcaagacaga

SEQ ID NO: 5645559 - DNA, 19 bp, Homo sapiens
tctccagggccccccaact

SEQ ID NO: 5645560 - DNA, 15 bp, Homo sapiens
tctccagggctccaa

SEQ ID NO: 5645561 - DNA, 12 bp, Homo sapiens
tctccaggggcc

SEQ ID NO: 5645562 - DNA, 23 bp, Homo sapiens
tctccaggggctgcttcctcctg

SEQ ID NO: 5645563 - DNA, 19 bp, Homo sapiens
tctccaggggtttacagtg

SEQ ID NO: 5645564 - DNA, 21 bp, Homo sapiens
tctccagggtcagaaacagga

SEQ ID NO: 5645565 - DNA, 16 bp, Homo sapiens
tctccaggtaactttg

SEQ ID NO: 5645566 - DNA, 17 bp, Homo sapiens
tctccaggtcagcctgg

SEQ ID NO: 5645567 - DNA, 19 bp, Homo sapiens
tctccaggtctcacgggca

SEQ ID NO: 5645568 - DNA, 13 bp, Homo sapiens
tctccaggtgctc

SEQ ID NO: 5645569 - DNA, 15 bp, Homo sapiens
tctccaggtgctcat

SEQ ID NO: 5645570 - DNA, 16 bp, Homo sapiens
tctccagtatgaaatt

SEQ ID NO: 5645571 - DNA, 19 bp, Homo sapiens
tctccagtcatctgtaaga

SEQ ID NO: 5645572 - DNA, 12 bp, Homo sapiens
tctccagtccct

SEQ ID NO: 5645573 - DNA, 13 bp, Homo sapiens
tctccagtgaaat

SEQ ID NO: 5645574 - DNA, 15 bp, Homo sapiens
tctccagtgcacctg

SEQ ID NO: 5645575 - DNA, 20 bp, Homo sapiens
tctccagttgggactcagga

SEQ ID NO: 5645576 - DNA, 21 bp, Homo sapiens
tctccagttgggactcaggat

SEQ ID NO: 5645577 - DNA, 23 bp, Homo sapiens
tctccagttgggactcaggatat

SEQ ID NO: 5645578 - DNA, 19 bp, Homo sapiens
tctccagtttcagaagcag

SEQ ID NO: 5645579 - DNA, 23 bp, Homo sapiens
tctccagtttcagaagcaggcag

SEQ ID NO: 5645580 - DNA, 15 bp, Homo sapiens
tctccagttttcagt

SEQ ID NO: 5645581 - DNA, 20 bp, Homo sapiens
tctccataaccccacccttg

SEQ ID NO: 5645582 - DNA, 23 bp, Homo sapiens
tctccataaccccacccttgccc

SEQ ID NO: 5645583 - DNA, 18 bp, Homo sapiens
tctccataaggcagtggc

SEQ ID NO: 5645584 - DNA, 17 bp, Homo sapiens
tctccataatgccactg

SEQ ID NO: 5645585 - DNA, 23 bp, Homo sapiens
tctccatacccacaatctgagca

SEQ ID NO: 5645586 - DNA, 15 bp, Homo sapiens
tctccatactttgga

SEQ ID NO: 5645587 - DNA, 15 bp, Homo sapiens
tctccatatctcctt

SEQ ID NO: 5645588 - DNA, 16 bp, Homo sapiens
tctccatatctccttc

SEQ ID NO: 5645589 - DNA, 22 bp, Homo sapiens
tctccatcagatgtgttcctcc

SEQ ID NO: 5645590 - DNA, 13 bp, Homo sapiens
tctccatcagctg

SEQ ID NO: 5645591 - DNA, 13 bp, Homo sapiens
tctccatccacat

SEQ ID NO: 5645592 - DNA, 14 bp, Homo sapiens
tctccatccccatg

SEQ ID NO: 5645593 - DNA, 13 bp, Homo sapiens
tctccatcccctc

SEQ ID NO: 5645594 - DNA, 16 bp, Homo sapiens
tctccatcccctccct

SEQ ID NO: 5645595 - DNA, 22 bp, Homo sapiens
tctccatccctctcctctgccc

SEQ ID NO: 5645596 - DNA, 19 bp, Homo sapiens
tctccatcctttctgcctc

SEQ ID NO: 5645597 - DNA, 16 bp, Homo sapiens
tctccatctcccaagg

SEQ ID NO: 5645598 - DNA, 23 bp, Homo sapiens
tctccatctcccaaggctgccag

SEQ ID NO: 5645599 - DNA, 14 bp, Homo sapiens
tctccatctccgct

SEQ ID NO: 5645600 - DNA, 12 bp, Homo sapiens
tctccatctcta

SEQ ID NO: 5645601 - DNA, 16 bp, Homo sapiens
tctccatctttataga

SEQ ID NO: 5645602 - DNA, 15 bp, Homo sapiens
tctccatgaagagct

SEQ ID NO: 5645603 - DNA, 17 bp, Homo sapiens
tctccatgaagagcttg

SEQ ID NO: 5645604 - DNA, 22 bp, Homo sapiens
tctccatgaggtactggtccct

SEQ ID NO: 5645605 - DNA, 16 bp, Homo sapiens
tctccatgcaagtgct

SEQ ID NO: 5645606 - DNA, 17 bp, Homo sapiens
tctccatgcacagtgga

SEQ ID NO: 5645607 - DNA, 16 bp, Homo sapiens
tctccatgctttgctc

SEQ ID NO: 5645608 - DNA, 20 bp, Homo sapiens
tctccatggagcctacctct

SEQ ID NO: 5645609 - DNA, 18 bp, Homo sapiens
tctccatggccctgcaaa

SEQ ID NO: 5645610 - DNA, 17 bp, Homo sapiens
tctccatggccctgcca

SEQ ID NO: 5645611 - DNA, 20 bp, Homo sapiens
tctccatggccctgtcccag

SEQ ID NO: 5645612 - DNA, 19 bp, Homo sapiens
tctccatggggaggcctca

SEQ ID NO: 5645613 - DNA, 22 bp, Homo sapiens
tctccatgtagaataaatgaag

SEQ ID NO: 5645614 - DNA, 13 bp, Homo sapiens
tctccatgtgtac

SEQ ID NO: 5645615 - DNA, 19 bp, Homo sapiens
tctccatgttggcctgtca

SEQ ID NO: 5645616 - DNA, 15 bp, Homo sapiens
tctccattccctagc

SEQ ID NO: 5645617 - DNA, 16 bp, Homo sapiens
tctccattccctagca

SEQ ID NO: 5645618 - DNA, 18 bp, Homo sapiens
tctccattctagatgctt

SEQ ID NO: 5645619 - DNA, 22 bp, Homo sapiens
tctccattctgaaaatagcagg

SEQ ID NO: 5645620 - DNA, 18 bp, Homo sapiens
tctccattctgctccttc

SEQ ID NO: 5645621 - DNA, 21 bp, Homo sapiens
tctccattgtgtgatccagcc

SEQ ID NO: 5645622 - DNA, 22 bp, Homo sapiens
tctccattgtgtgatccagccc

SEQ ID NO: 5645623 - DNA, 24 bp, Homo sapiens
tctccattgtgtgatccagccctg

SEQ ID NO: 5645624 - DNA, 16 bp, Homo sapiens
tctccatttaagacac

SEQ ID NO: 5645625 - DNA, 16 bp, Homo sapiens
tctccatttcacacag

SEQ ID NO: 5645626 - DNA, 17 bp, Homo sapiens
tctccattttagcccag

SEQ ID NO: 5645627 - DNA, 19 bp, Homo sapiens
tctccattttggtgtcttt

SEQ ID NO: 5645628 - DNA, 23 bp, Homo sapiens
tctcccaaataaactccttaacc

SEQ ID NO: 5645629 - DNA, 22 bp, Homo sapiens
tctcccaaatgtctattttctt

SEQ ID NO: 5645630 - DNA, 19 bp, Homo sapiens
tctcccaactataaaacta

SEQ ID NO: 5645631 - DNA, 20 bp, Homo sapiens
tctcccaactataaaactag

SEQ ID NO: 5645632 - DNA, 19 bp, Homo sapiens
tctcccaactcagcctgtt

SEQ ID NO: 5645633 - DNA, 22 bp, Homo sapiens
tctcccaactcagcctgttcct

SEQ ID NO: 5645634 - DNA, 22 bp, Homo sapiens
tctcccaactcttgcacagtca

SEQ ID NO: 5645635 - DNA, 20 bp, Homo sapiens
tctcccaagctgattttatt

SEQ ID NO: 5645636 - DNA, 17 bp, Homo sapiens
tctcccaaggagggcac

SEQ ID NO: 5645637 - DNA, 16 bp, Homo sapiens
tctcccaaggctgcca

SEQ ID NO: 5645638 - DNA, 17 bp, Homo sapiens
tctcccaaggctgccag

SEQ ID NO: 5645639 - DNA, 14 bp, Homo sapiens
tctcccacccaagg

SEQ ID NO: 5645640 - DNA, 15 bp, Homo sapiens
tctcccacccaagga

SEQ ID NO: 5645641 - DNA, 14 bp, Homo sapiens
tctcccaccccgcc

SEQ ID NO: 5645642 - DNA, 16 bp, Homo sapiens
tctcccaccccttggc

SEQ ID NO: 5645643 - DNA, 18 bp, Homo sapiens
tctcccaccccttggccc

SEQ ID NO: 5645644 - DNA, 19 bp, Homo sapiens
tctcccaccccttggcccc

SEQ ID NO: 5645645 - DNA, 22 bp, Homo sapiens
tctcccaccccttggcccctca

SEQ ID NO: 5645646 - DNA, 16 bp, Homo sapiens
tctcccacccggccac

SEQ ID NO: 5645647 - DNA, 23 bp, Homo sapiens
tctcccacccggccacagctgct

SEQ ID NO: 5645648 - DNA, 22 bp, Homo sapiens
tctcccaccctaagggcagccc

SEQ ID NO: 5645649 - DNA, 23 bp, Homo sapiens
tctcccaccctaagggcagccct

SEQ ID NO: 5645650 - DNA, 13 bp, Homo sapiens
tctcccaccctct

SEQ ID NO: 5645651 - DNA, 14 bp, Homo sapiens
tctcccaccctctt

SEQ ID NO: 5645652 - DNA, 15 bp, Homo sapiens
tctcccaccctcttc

SEQ ID NO: 5645653 - DNA, 20 bp, Homo sapiens
tctcccaccctcttcctact

SEQ ID NO: 5645654 - DNA, 12 bp, Homo sapiens
tctcccacctcc

SEQ ID NO: 5645655 - DNA, 16 bp, Homo sapiens
tctcccacgtgggaga

SEQ ID NO: 5645656 - DNA, 19 bp, Homo sapiens
tctcccactagacaagtcc

SEQ ID NO: 5645657 - DNA, 15 bp, Homo sapiens
tctcccactttctgt

SEQ ID NO: 5645658 - DNA, 12 bp, Homo sapiens
tctcccagaact

SEQ ID NO: 5645659 - DNA, 17 bp, Homo sapiens
tctcccagaatcccagc

SEQ ID NO: 5645660 - DNA, 17 bp, Homo sapiens
tctcccagacttgtttc

SEQ ID NO: 5645661 - DNA, 19 bp, Homo sapiens
tctcccagacttgtttcct

SEQ ID NO: 5645662 - DNA, 20 bp, Homo sapiens
tctcccagacttgtttcctg

SEQ ID NO: 5645663 - DNA, 13 bp, Homo sapiens
tctcccagaggct

SEQ ID NO: 5645664 - DNA, 17 bp, Homo sapiens
tctcccagaggctcctg

SEQ ID NO: 5645665 - DNA, 18 bp, Homo sapiens
tctcccagaggctcctgg

SEQ ID NO: 5645666 - DNA, 10 bp, Homo sapiens
tctcccagat

SEQ ID NO: 5645667 - DNA, 23 bp, Homo sapiens
tctcccagatcctggaaacagca

SEQ ID NO: 5645668 - DNA, 19 bp, Homo sapiens
tctcccagcactgcctcct

SEQ ID NO: 5645669 - DNA, 22 bp, Homo sapiens
tctcccagctctagcctctgga

SEQ ID NO: 5645670 - DNA, 13 bp, Homo sapiens
tctcccaggaagc

SEQ ID NO: 5645671 - DNA, 12 bp, Homo sapiens
tctcccaggaca

SEQ ID NO: 5645672 - DNA, 14 bp, Homo sapiens
tctcccaggccagg

SEQ ID NO: 5645673 - DNA, 12 bp, Homo sapiens
tctcccaggccc

SEQ ID NO: 5645674 - DNA, 21 bp, Homo sapiens
tctcccaggccccaggggaga

SEQ ID NO: 5645675 - DNA, 17 bp, Homo sapiens
tctcccaggccccatga

SEQ ID NO: 5645676 - DNA, 23 bp, Homo sapiens
tctcccaggccccatgacctcca

SEQ ID NO: 5645677 - DNA, 16 bp, Homo sapiens
tctcccaggccccctg

SEQ ID NO: 5645678 - DNA, 17 bp, Homo sapiens
tctcccaggcctctgcc

SEQ ID NO: 5645679 - DNA, 16 bp, Homo sapiens
tctcccaggctggagt

SEQ ID NO: 5645680 - DNA, 19 bp, Homo sapiens
tctcccaggctggagtgca

SEQ ID NO: 5645681 - DNA, 12 bp, Homo sapiens
tctcccagggat

SEQ ID NO: 5645682 - DNA, 22 bp, Homo sapiens
tctcccagggctactcactcaa

SEQ ID NO: 5645683 - DNA, 18 bp, Homo sapiens
tctcccagggctctctgg

SEQ ID NO: 5645684 - DNA, 20 bp, Homo sapiens
tctcccagggctctctggac

SEQ ID NO: 5645685 - DNA, 12 bp, Homo sapiens
tctcccaggggc

SEQ ID NO: 5645686 - DNA, 18 bp, Homo sapiens
tctcccaggggctggctt

SEQ ID NO: 5645687 - DNA, 23 bp, Homo sapiens
tctcccaggggctggcttcagga

SEQ ID NO: 5645688 - DNA, 19 bp, Homo sapiens
tctcccaggtaccagctgc

SEQ ID NO: 5645689 - DNA, 13 bp, Homo sapiens
tctcccaggtgaa

SEQ ID NO: 5645690 - DNA, 19 bp, Homo sapiens
tctcccagtctacccagag

SEQ ID NO: 5645691 - DNA, 20 bp, Homo sapiens
tctcccagtgaactcctgcc

SEQ ID NO: 5645692 - DNA, 11 bp, Homo sapiens
tctcccagttg

SEQ ID NO: 5645693 - DNA, 15 bp, Homo sapiens
tctcccatccccctg

SEQ ID NO: 5645694 - DNA, 22 bp, Homo sapiens
tctcccatccccctgccctcgt

SEQ ID NO: 5645695 - DNA, 23 bp, Homo sapiens
tctcccatcccctccctccttca

SEQ ID NO: 5645696 - DNA, 21 bp, Homo sapiens
tctcccatcctgatcccagac

SEQ ID NO: 5645697 - DNA, 18 bp, Homo sapiens
tctcccatctcttccttg

SEQ ID NO: 5645698 - DNA, 20 bp, Homo sapiens
tctcccatggagccccagcc

SEQ ID NO: 5645699 - DNA, 22 bp, Homo sapiens
tctcccatggagccccagcccc

SEQ ID NO: 5645700 - DNA, 18 bp, Homo sapiens
tctcccatgggggctcca

SEQ ID NO: 5645701 - DNA, 22 bp, Homo sapiens
tctcccatgggggctccagaca

SEQ ID NO: 5645702 - DNA, 21 bp, Homo sapiens
tctcccatgtgtgatgctgac

SEQ ID NO: 5645703 - DNA, 14 bp, Homo sapiens
tctcccatttcagg

SEQ ID NO: 5645704 - DNA, 22 bp, Homo sapiens
tctcccatttcaggaatttaaa

SEQ ID NO: 5645705 - DNA, 14 bp, Homo sapiens
tctcctttgctctt

SEQ ID NO: 5645706 - DNA, 17 bp, Homo sapiens
tctcctttggcatgttt

SEQ ID NO: 5645707 - DNA, 21 bp, Homo sapiens
tctccttttatctggtgcctc

SEQ ID NO: 5645708 - DNA, 16 bp, Homo sapiens
tctccttttccttacc

SEQ ID NO: 5645709 - DNA, 17 bp, Homo sapiens
tctccttttccttacca

SEQ ID NO: 5645710 - DNA, 12 bp, Homo sapiens
tctccttttctt

SEQ ID NO: 5645711 - DNA, 14 bp, Homo sapiens
tctccttttctttt

SEQ ID NO: 5645712 - DNA, 17 bp, Homo sapiens
tctccttttcttttgtt

SEQ ID NO: 5645713 - DNA, 20 bp, Homo sapiens
tctccttttcttttgttact

SEQ ID NO: 5645714 - DNA, 21 bp, Homo sapiens
tctccttttcttttgttactg

SEQ ID NO: 5645715 - DNA, 23 bp, Homo sapiens
tctccttttcttttgttactgtt

SEQ ID NO: 5645716 - DNA, 14 bp, Homo sapiens
tctccttttgaact

SEQ ID NO: 5645717 - DNA, 19 bp, Homo sapiens
tctccttttgaacttgtca

SEQ ID NO: 5645718 - DNA, 15 bp, Homo sapiens
tctccttttgaggct

SEQ ID NO: 5645719 - DNA, 23 bp, Homo sapiens
tctcgaacatggaactcattcct

SEQ ID NO: 5645720 - DNA, 14 bp, Homo sapiens
tctcgaactcctga

SEQ ID NO: 5645721 - DNA, 21 bp, Homo sapiens
tctcgaagtcttccatcagca

SEQ ID NO: 5645722 - DNA, 20 bp, Homo sapiens
tctcgaatactttgaatgtt

SEQ ID NO: 5645723 - DNA, 23 bp, Homo sapiens
tctcgaatttgaagagattgctg

SEQ ID NO: 5645724 - DNA, 14 bp, Homo sapiens
tctcgaccctgtcc

SEQ ID NO: 5645725 - DNA, 20 bp, Homo sapiens
tctcgaccctgtcccctagg

SEQ ID NO: 5645726 - DNA, 18 bp, Homo sapiens
tctcgaccggccctgcat

SEQ ID NO: 5645727 - DNA, 13 bp, Homo sapiens
tctcgaccttctg

SEQ ID NO: 5645728 - DNA, 12 bp, Homo sapiens
tctcgactgctt

SEQ ID NO: 5645729 - DNA, 14 bp, Homo sapiens
tctcgacttcagga

SEQ ID NO: 5645730 - DNA, 16 bp, Homo sapiens
tctcgacttcaggagc

SEQ ID NO: 5645731 - DNA, 19 bp, Homo sapiens
tctcgagacttctctgtga

SEQ ID NO: 5645732 - DNA, 18 bp, Homo sapiens
tctcgagcccagatggaa

SEQ ID NO: 5645733 - DNA, 15 bp, Homo sapiens
tctcgagccccctgg

SEQ ID NO: 5645734 - DNA, 14 bp, Homo sapiens
tctcgagcgccctg

SEQ ID NO: 5645735 - DNA, 17 bp, Homo sapiens
tctcgagcgccctgcag

SEQ ID NO: 5645736 - DNA, 18 bp, Homo sapiens
tctcgagcgccctgcaga

SEQ ID NO: 5645737 - DNA, 19 bp, Homo sapiens
tctcgagcgccctgcagac

SEQ ID NO: 5645738 - DNA, 13 bp, Homo sapiens
tctcgagcttggg

SEQ ID NO: 5645739 - DNA, 14 bp, Homo sapiens
tctcgatctcctga

SEQ ID NO: 5645740 - DNA, 22 bp, Homo sapiens
tctcgatgccataatcagaaca

SEQ ID NO: 5645741 - DNA, 14 bp, Homo sapiens
tctcgatgctgctg

SEQ ID NO: 5645742 - DNA, 14 bp, Homo sapiens
tctcgattttatct

SEQ ID NO: 5645743 - DNA, 18 bp, Homo sapiens
tctcgcaactgaaggaag

SEQ ID NO: 5645744 - DNA, 15 bp, Homo sapiens
tctcgcacaatgcat

SEQ ID NO: 5645745 - DNA, 14 bp, Homo sapiens
tctcgcacacctct

SEQ ID NO: 5645746 - DNA, 20 bp, Homo sapiens
tctcgccaggctggagtgta

SEQ ID NO: 5645747 - DNA, 21 bp, Homo sapiens
tctcgccctggccagggcctc

SEQ ID NO: 5645748 - DNA, 18 bp, Homo sapiens
tctcgcctaggatttcag

SEQ ID NO: 5645749 - DNA, 21 bp, Homo sapiens
tctcgcctcattactgtgagg

SEQ ID NO: 5645750 - DNA, 16 bp, Homo sapiens
tctcgcctggaaacag

SEQ ID NO: 5645751 - DNA, 16 bp, Homo sapiens
tctcgcgccctccccc

SEQ ID NO: 5645752 - DNA, 17 bp, Homo sapiens
tctcgcgccctccccca

SEQ ID NO: 5645753 - DNA, 16 bp, Homo sapiens
tctcgcgcgactgaga

SEQ ID NO: 5645754 - DNA, 13 bp, Homo sapiens
tctcgctaaagag

SEQ ID NO: 5645755 - DNA, 20 bp, Homo sapiens
tctcgctattgtcaccaggg

SEQ ID NO: 5645756 - DNA, 12 bp, Homo sapiens
tctcgctctctc

SEQ ID NO: 5645757 - DNA, 14 bp, Homo sapiens
tctcgctctctctc

SEQ ID NO: 5645758 - DNA, 21 bp, Homo sapiens
tctcgctctgtcgcccaggct

SEQ ID NO: 5645759 - DNA, 18 bp, Homo sapiens
tctcgctgatgctgggct

SEQ ID NO: 5645760 - DNA, 21 bp, Homo sapiens
tctcgctgcatcacccaggct

SEQ ID NO: 5645761 - DNA, 20 bp, Homo sapiens
tctcgctgcgtcctcatttc

SEQ ID NO: 5645762 - DNA, 17 bp, Homo sapiens
tctcgctgtcactggct

SEQ ID NO: 5645763 - DNA, 17 bp, Homo sapiens
tctcggaaggctggctg

SEQ ID NO: 5645764 - DNA, 15 bp, Homo sapiens
tctcggagctggccc

SEQ ID NO: 5645765 - DNA, 18 bp, Homo sapiens
tctcggagctggcccagg

SEQ ID NO: 5645766 - DNA, 15 bp, Homo sapiens
tctcggaggccaggc

SEQ ID NO: 5645767 - DNA, 18 bp, Homo sapiens
tctcggaggccaggccct

SEQ ID NO: 5645768 - DNA, 18 bp, Homo sapiens
tctcggatgacaccctgg

SEQ ID NO: 5645769 - DNA, 22 bp, Homo sapiens
tctcggatgacaccctggcctg

SEQ ID NO: 5645770 - DNA, 20 bp, Homo sapiens
tctcggatgaccaaaccagc

SEQ ID NO: 5645771 - DNA, 21 bp, Homo sapiens
tctcggcaactaagcagtccc

SEQ ID NO: 5645772 - DNA, 12 bp, Homo sapiens
tctcggctcagg

SEQ ID NO: 5645773 - DNA, 14 bp, Homo sapiens
tctcggctcaggct

SEQ ID NO: 5645774 - DNA, 20 bp, Homo sapiens
tctcggctcaggctctgctg

SEQ ID NO: 5645775 - DNA, 14 bp, Homo sapiens
tctcggctcagtgc

SEQ ID NO: 5645776 - DNA, 15 bp, Homo sapiens
tctcggctgccaggg

SEQ ID NO: 5645777 - DNA, 21 bp, Homo sapiens
tctcggctggaagaacatcaa

SEQ ID NO: 5645778 - DNA, 16 bp, Homo sapiens
tctcggggcctgtgcc

SEQ ID NO: 5645779 - DNA, 20 bp, Homo sapiens
tctcgggggtccggaagggt

SEQ ID NO: 5645780 - DNA, 21 bp, Homo sapiens
tctcgggtccgattaatttat

SEQ ID NO: 5645781 - DNA, 19 bp, Homo sapiens
tctcgggtgggggagccag

SEQ ID NO: 5645782 - DNA, 12 bp, Homo sapiens
tctcggtgacct

SEQ ID NO: 5645783 - DNA, 14 bp, Homo sapiens
tctcggtgacctcc

SEQ ID NO: 5645784 - DNA, 16 bp, Homo sapiens
tctcggtgctccatct

SEQ ID NO: 5645785 - DNA, 14 bp, Homo sapiens
tctcggtggtacca

SEQ ID NO: 5645786 - DNA, 16 bp, Homo sapiens
tctcggttctgcgcca

SEQ ID NO: 5645787 - DNA, 22 bp, Homo sapiens
tctcgtagaacctgcgcacccc

SEQ ID NO: 5645788 - DNA, 14 bp, Homo sapiens
tctcgtatagaagt

SEQ ID NO: 5645789 - DNA, 17 bp, Homo sapiens
tctcgtcaggctgccag

SEQ ID NO: 5645790 - DNA, 18 bp, Homo sapiens
tctcgtcaggctgccaga

SEQ ID NO: 5645791 - DNA, 19 bp, Homo sapiens
tctcgtcctcgtttgtgtt

SEQ ID NO: 5645792 - DNA, 21 bp, Homo sapiens
tctcgtcctcgtttgtgttct

SEQ ID NO: 5645793 - DNA, 18 bp, Homo sapiens
tctcgtcttccgtctccc

SEQ ID NO: 5645794 - DNA, 19 bp, Homo sapiens
tctcgtggtagaagccagt

SEQ ID NO: 5645795 - DNA, 15 bp, Homo sapiens
tctcgtggtatgtat

SEQ ID NO: 5645796 - DNA, 23 bp, Homo sapiens
tctcgtgtacagctcccttccct

SEQ ID NO: 5645797 - DNA, 15 bp, Homo sapiens
tctcgtgtttgctta

SEQ ID NO: 5645798 - DNA, 15 bp, Homo sapiens
tctcgttctccttcc

SEQ ID NO: 5645799 - DNA, 22 bp, Homo sapiens
tctcgttgccctaattcatctt

SEQ ID NO: 5645800 - DNA, 14 bp, Homo sapiens
tctcgttgcctctg

SEQ ID NO: 5645801 - DNA, 13 bp, Homo sapiens
tctcgttggtagt

SEQ ID NO: 5645802 - DNA, 21 bp, Homo sapiens
tctcgtttagtgccaatgttg

SEQ ID NO: 5645803 - DNA, 14 bp, Homo sapiens
tctcgtttctgccc

SEQ ID NO: 5645804 - DNA, 17 bp, Homo sapiens
tctcgtttgtgattctt

SEQ ID NO: 5645805 - DNA, 20 bp, Homo sapiens
tctcgttttgggtactttct

SEQ ID NO: 5645806 - DNA, 12 bp, Homo sapiens
tctcgtttttct

SEQ ID NO: 5645807 - DNA, 21 bp, Homo sapiens
tctctaaaaagaagccacaga

SEQ ID NO: 5645808 - DNA, 16 bp, Homo sapiens
tctctaaaaataaaat

SEQ ID NO: 5645809 - DNA, 20 bp, Homo sapiens
tctctaaaatgctgttctca

SEQ ID NO: 5645810 - DNA, 14 bp, Homo sapiens
tctctaaacccaaa

SEQ ID NO: 5645811 - DNA, 21 bp, Homo sapiens
tctctaaactggcatctgctc

SEQ ID NO: 5645812 - DNA, 12 bp, Homo sapiens
tctctaaactgt

SEQ ID NO: 5645813 - DNA, 23 bp, Homo sapiens
tctctaaagcactaccgattctt

SEQ ID NO: 5645814 - DNA, 20 bp, Homo sapiens
tctctaaatcttccttgtga

SEQ ID NO: 5645815 - DNA, 23 bp, Homo sapiens
tctctaaatgaggggcctcaggt

SEQ ID NO: 5645816 - DNA, 16 bp, Homo sapiens
tctctaaccattcaaa

SEQ ID NO: 5645817 - DNA, 18 bp, Homo sapiens
tctctaaccattcaaatg

SEQ ID NO: 5645818 - DNA, 16 bp, Homo sapiens
tctctaaccctatcct

SEQ ID NO: 5645819 - DNA, 20 bp, Homo sapiens
tctctaactcagaaacatca

SEQ ID NO: 5645820 - DNA, 13 bp, Homo sapiens
tctctaacttatt

SEQ ID NO: 5645821 - DNA, 19 bp, Homo sapiens
tctctaacttcaccatatt

SEQ ID NO: 5645822 - DNA, 14 bp, Homo sapiens
tctctaagaaaaga

SEQ ID NO: 5645823 - DNA, 16 bp, Homo sapiens
tctctaagaaaagaga

SEQ ID NO: 5645824 - DNA, 19 bp, Homo sapiens
tctctaagatgaatccaaa

SEQ ID NO: 5645825 - DNA, 19 bp, Homo sapiens
tctctaagcctggcttaga

SEQ ID NO: 5645826 - DNA, 19 bp, Homo sapiens
tctctaaggagcagcggga

SEQ ID NO: 5645827 - DNA, 22 bp, Homo sapiens
tctctaagttatgactgtgaaa

SEQ ID NO: 5645828 - DNA, 22 bp, Homo sapiens
tctctaagtttagaagcgctca

SEQ ID NO: 5645829 - DNA, 12 bp, Homo sapiens
tctctaataata

SEQ ID NO: 5645830 - DNA, 15 bp, Homo sapiens
tctctaataataaat

SEQ ID NO: 5645831 - DNA, 17 bp, Homo sapiens
tctctaataataaatag

SEQ ID NO: 5645832 - DNA, 22 bp, Homo sapiens
tctctaataataaatagttctt

SEQ ID NO: 5645833 - DNA, 14 bp, Homo sapiens
tctctaatagaagt

SEQ ID NO: 5645834 - DNA, 18 bp, Homo sapiens
tctctaatatgtaaaatt

SEQ ID NO: 5645835 - DNA, 18 bp, Homo sapiens
tctctaatctgtgctgtt

SEQ ID NO: 5645836 - DNA, 14 bp, Homo sapiens
tctctaattagaaa

SEQ ID NO: 5645837 - DNA, 15 bp, Homo sapiens
tctctaattgattca

SEQ ID NO: 5645838 - DNA, 23 bp, Homo sapiens
tctctaatttaacttattgctag

SEQ ID NO: 5645839 - DNA, 15 bp, Homo sapiens
tctctaattttggat

SEQ ID NO: 5645840 - DNA, 19 bp, Homo sapiens
tctctaattttggataata

SEQ ID NO: 5645841 - DNA, 17 bp, Homo sapiens
tctctacaaaaaataaa

SEQ ID NO: 5645842 - DNA, 19 bp, Homo sapiens
tctctacagatgtcccatt

SEQ ID NO: 5645843 - DNA, 19 bp, Homo sapiens
tctctacagcaccttaaaa

SEQ ID NO: 5645844 - DNA, 15 bp, Homo sapiens
tctctacatgcataa

SEQ ID NO: 5645845 - DNA, 15 bp, Homo sapiens
tctctacatgctctt

SEQ ID NO: 5645846 - DNA, 20 bp, Homo sapiens
tctctacattaatgtcctct

SEQ ID NO: 5645847 - DNA, 20 bp, Homo sapiens
tctctaccactgctgatatt

SEQ ID NO: 5645848 - DNA, 18 bp, Homo sapiens
tctctacccagcccatct

SEQ ID NO: 5645849 - DNA, 20 bp, Homo sapiens
tctctacccagcccatcttg

SEQ ID NO: 5645850 - DNA, 20 bp, Homo sapiens
tctctacccatcttaaaaac

SEQ ID NO: 5645851 - DNA, 23 bp, Homo sapiens
tctctacccatcttaaaaacaac

SEQ ID NO: 5645852 - DNA, 22 bp, Homo sapiens
tctctacccctttctgttcgaa

SEQ ID NO: 5645853 - DNA, 15 bp, Homo sapiens
tctctactaaaaaat

SEQ ID NO: 5645854 - DNA, 15 bp, Homo sapiens
tctctactaaaaata

SEQ ID NO: 5645855 - DNA, 17 bp, Homo sapiens
tctctactaaaaatgca

SEQ ID NO: 5645856 - DNA, 19 bp, Homo sapiens
tctctactaccacaaggaa

SEQ ID NO: 5645857 - DNA, 20 bp, Homo sapiens
tctctactaccacaaggaaa

SEQ ID NO: 5645858 - DNA, 18 bp, Homo sapiens
tctctactcatgccagat

SEQ ID NO: 5645859 - DNA, 16 bp, Homo sapiens
tctctactccatggtt

SEQ ID NO: 5645860 - DNA, 18 bp, Homo sapiens
tctctactccatggttct

SEQ ID NO: 5645861 - DNA, 20 bp, Homo sapiens
tctctactccatggttctca

SEQ ID NO: 5645862 - DNA, 21 bp, Homo sapiens
tctctactccatggttctcaa

SEQ ID NO: 5645863 - DNA, 23 bp, Homo sapiens
tctctactccatggttctcaatt

SEQ ID NO: 5645864 - DNA, 20 bp, Homo sapiens
tctctactcctacctcagcc

SEQ ID NO: 5645865 - DNA, 21 bp, Homo sapiens
tctctactcctacctcagcct

SEQ ID NO: 5645866 - DNA, 23 bp, Homo sapiens
tctctactgctggactgtggagg

SEQ ID NO: 5645867 - DNA, 22 bp, Homo sapiens
tctctacttccccttcttgcca

SEQ ID NO: 5645868 - DNA, 21 bp, Homo sapiens
tctctactttaaattttttaa

SEQ ID NO: 5645869 - DNA, 18 bp, Homo sapiens
tctctagaagctgtctgc

SEQ ID NO: 5645870 - DNA, 19 bp, Homo sapiens
tctctagaatccagcaggt

SEQ ID NO: 5645871 - DNA, 17 bp, Homo sapiens
tctctagaattttaagt

SEQ ID NO: 5645872 - DNA, 13 bp, Homo sapiens
tctctagcagtga

SEQ ID NO: 5645873 - DNA, 14 bp, Homo sapiens
tctctagctcccca

SEQ ID NO: 5645874 - DNA, 23 bp, Homo sapiens
tctctagctccccaattctgcct

SEQ ID NO: 5645875 - DNA, 15 bp, Homo sapiens
tctctagctttgtca

SEQ ID NO: 5645876 - DNA, 13 bp, Homo sapiens
tctctaggaagtc

SEQ ID NO: 5645877 - DNA, 13 bp, Homo sapiens
tctctaggcctga

SEQ ID NO: 5645878 - DNA, 14 bp, Homo sapiens
tctctaggctgggg

SEQ ID NO: 5645879 - DNA, 20 bp, Homo sapiens
tctctagggaaggccacctg

SEQ ID NO: 5645880 - DNA, 15 bp, Homo sapiens
tctctagtagttaaa

SEQ ID NO: 5645881 - DNA, 17 bp, Homo sapiens
tctctagtagttagaaa

SEQ ID NO: 5645882 - DNA, 17 bp, Homo sapiens
tctctttcttcctttct

SEQ ID NO: 5645883 - DNA, 20 bp, Homo sapiens
tctctttctttctctttctg

SEQ ID NO: 5645884 - DNA, 17 bp, Homo sapiens
tctctttcttttgtgca

SEQ ID NO: 5645885 - DNA, 18 bp, Homo sapiens
tctctttcttttgtgcat

SEQ ID NO: 5645886 - DNA, 19 bp, Homo sapiens
tctctttgaaaattcttgt

SEQ ID NO: 5645887 - DNA, 12 bp, Homo sapiens
tctctttgaaac

SEQ ID NO: 5645888 - DNA, 14 bp, Homo sapiens
tctctttgaaacat

SEQ ID NO: 5645889 - DNA, 18 bp, Homo sapiens
tctctttgataacaaaaa

SEQ ID NO: 5645890 - DNA, 18 bp, Homo sapiens
tctctttgattatttgca

SEQ ID NO: 5645891 - DNA, 18 bp, Homo sapiens
tctctttggaaatagcat

SEQ ID NO: 5645892 - DNA, 23 bp, Homo sapiens
tctctttggggagagctggcagt

SEQ ID NO: 5645893 - DNA, 24 bp, Homo sapiens
tctctttggggagagctggcagtg

SEQ ID NO: 5645894 - DNA, 15 bp, Homo sapiens
tctctttgtcctgaa

SEQ ID NO: 5645895 - DNA, 13 bp, Homo sapiens
tctctttgtctgc

SEQ ID NO: 5645896 - DNA, 20 bp, Homo sapiens
tctctttgtggggcttggcg

SEQ ID NO: 5645897 - DNA, 21 bp, Homo sapiens
tctctttgtggggcttggcgt

SEQ ID NO: 5645898 - DNA, 14 bp, Homo sapiens
tctctttgttcaat

SEQ ID NO: 5645899 - DNA, 14 bp, Homo sapiens
tctctttgtttctg

SEQ ID NO: 5645900 - DNA, 19 bp, Homo sapiens
tctctttgtttctgtttct

SEQ ID NO: 5645901 - DNA, 20 bp, Homo sapiens
tctctttgtttctgtttctt

SEQ ID NO: 5645902 - DNA, 23 bp, Homo sapiens
tctctttgtttctgtttcttgct

SEQ ID NO: 5645903 - DNA, 19 bp, Homo sapiens
tctcttttatctgtttaaa

SEQ ID NO: 5645904 - DNA, 18 bp, Homo sapiens
tctcttttatgttcagct

SEQ ID NO: 5645905 - DNA, 11 bp, Homo sapiens
tctcttttcat

SEQ ID NO: 5645906 - DNA, 13 bp, Homo sapiens
tctcttttccccg

SEQ ID NO: 5645907 - DNA, 14 bp, Homo sapiens
tctcttttccccgc

SEQ ID NO: 5645908 - DNA, 19 bp, Homo sapiens
tctcttttccctcctttcc

SEQ ID NO: 5645909 - DNA, 20 bp, Homo sapiens
tctcttttccctcctttcct

SEQ ID NO: 5645910 - DNA, 15 bp, Homo sapiens
tctcttttcctcctc

SEQ ID NO: 5645911 - DNA, 17 bp, Homo sapiens
tctcttttcctcgcaga

SEQ ID NO: 5645912 - DNA, 16 bp, Homo sapiens
tctcttttcctctctg

SEQ ID NO: 5645913 - DNA, 17 bp, Homo sapiens
tctcttttcctctctgt

SEQ ID NO: 5645914 - DNA, 18 bp, Homo sapiens
tctcttttcctctctgtc

SEQ ID NO: 5645915 - DNA, 20 bp, Homo sapiens
tctcttttcctctctgtctg

SEQ ID NO: 5645916 - DNA, 22 bp, Homo sapiens
tctcttttctacacactcagcc

SEQ ID NO: 5645917 - DNA, 13 bp, Homo sapiens
tctcttttctcta

SEQ ID NO: 5645918 - DNA, 17 bp, Homo sapiens
tctcttttctcttttta

SEQ ID NO: 5645919 - DNA, 20 bp, Homo sapiens
tctcttttgaatccatgctt

SEQ ID NO: 5645920 - DNA, 22 bp, Homo sapiens
tctcttttgaatccatgcttgg

SEQ ID NO: 5645921 - DNA, 18 bp, Homo sapiens
tctcttttgctttctgtt

SEQ ID NO: 5645922 - DNA, 23 bp, Homo sapiens
tctctttttatttaaatgtgaat

SEQ ID NO: 5645923 - DNA, 13 bp, Homo sapiens
tctctttttcagt

SEQ ID NO: 5645924 - DNA, 14 bp, Homo sapiens
tctctttttgactc

SEQ ID NO: 5645925 - DNA, 19 bp, Homo sapiens
tctctttttggaggtgctt

SEQ ID NO: 5645926 - DNA, 17 bp, Homo sapiens
tctcttttttacaaagg

SEQ ID NO: 5645927 - DNA, 15 bp, Homo sapiens
tctgaaaaagacata

SEQ ID NO: 5645928 - DNA, 16 bp, Homo sapiens
tctgaaaaagacataa

SEQ ID NO: 5645929 - DNA, 23 bp, Homo sapiens
tctgaaaaagacataaaacagaa

SEQ ID NO: 5645930 - DNA, 13 bp, Homo sapiens
tctgaaaacaaga

SEQ ID NO: 5645931 - DNA, 11 bp, Homo sapiens
tctgaaaacac

SEQ ID NO: 5645932 - DNA, 22 bp, Homo sapiens
tctgaaaacacttgatgatgtg

SEQ ID NO: 5645933 - DNA, 22 bp, Homo sapiens
tctgaaaaccccatttgctttc

SEQ ID NO: 5645934 - DNA, 20 bp, Homo sapiens
tctgaaaacctaccagccag

SEQ ID NO: 5645935 - DNA, 17 bp, Homo sapiens
tctgaaaacggccctct

SEQ ID NO: 5645936 - DNA, 12 bp, Homo sapiens
tctgaaaactgg

SEQ ID NO: 5645937 - DNA, 14 bp, Homo sapiens
tctgaaaactggaa

SEQ ID NO: 5645938 - DNA, 15 bp, Homo sapiens
tctgaaaagaaataa

SEQ ID NO: 5645939 - DNA, 21 bp, Homo sapiens
tctgaaaagcaattgccctgt

SEQ ID NO: 5645940 - DNA, 15 bp, Homo sapiens
tctgaaaagggcatc

SEQ ID NO: 5645941 - DNA, 20 bp, Homo sapiens
tctgaaaagtgaagacagaa

SEQ ID NO: 5645942 - DNA, 18 bp, Homo sapiens
tctgaaaatagcaggaca

SEQ ID NO: 5645943 - DNA, 13 bp, Homo sapiens
tctgaaaatataa

SEQ ID NO: 5645944 - DNA, 17 bp, Homo sapiens
tctgaaaatattctact

SEQ ID NO: 5645945 - DNA, 20 bp, Homo sapiens
tctgaaaatatttttttcta

SEQ ID NO: 5645946 - DNA, 14 bp, Homo sapiens
tctgaaaatgtatg

SEQ ID NO: 5645947 - DNA, 22 bp, Homo sapiens
tctgaaaatgttgttatgctat

SEQ ID NO: 5645948 - DNA, 19 bp, Homo sapiens
tctgaaaattaacactgct

SEQ ID NO: 5645949 - DNA, 13 bp, Homo sapiens
tctgaaaattctg

SEQ ID NO: 5645950 - DNA, 14 bp, Homo sapiens
tctgaaaattgatg

SEQ ID NO: 5645951 - DNA, 24 bp, Homo sapiens
tctgaaaatttatataactgttgt

SEQ ID NO: 5645952 - DNA, 17 bp, Homo sapiens
tctgaaacacagtcatg

SEQ ID NO: 5645953 - DNA, 10 bp, Homo sapiens
tctgaaacag

SEQ ID NO: 5645954 - DNA, 22 bp, Homo sapiens
tctgaaacagaaagttggaaag

SEQ ID NO: 5645955 - DNA, 15 bp, Homo sapiens
tctgaaacagagaac

SEQ ID NO: 5645956 - DNA, 22 bp, Homo sapiens
tctgaaacagctgccttagctt

SEQ ID NO: 5645957 - DNA, 17 bp, Homo sapiens
tctgaaacatggcctgt

SEQ ID NO: 5645958 - DNA, 20 bp, Homo sapiens
tctgaaacatttcataattt

SEQ ID NO: 5645959 - DNA, 16 bp, Homo sapiens
tctgaaaccacagttt

SEQ ID NO: 5645960 - DNA, 15 bp, Homo sapiens
tctgaaactcccttg

SEQ ID NO: 5645961 - DNA, 18 bp, Homo sapiens
tctgaaactcccttgtgt

SEQ ID NO: 5645962 - DNA, 20 bp, Homo sapiens
tctgaaactcccttgtgttc

SEQ ID NO: 5645963 - DNA, 21 bp, Homo sapiens
tctgaaactcccttgtgttcc

SEQ ID NO: 5645964 - DNA, 13 bp, Homo sapiens
tctgaaactggct

SEQ ID NO: 5645965 - DNA, 17 bp, Homo sapiens
tctgaaagacagaatgt

SEQ ID NO: 5645966 - DNA, 12 bp, Homo sapiens
tctgaaagagaa

SEQ ID NO: 5645967 - DNA, 12 bp, Homo sapiens
tctgaaagcaca

SEQ ID NO: 5645968 - DNA, 13 bp, Homo sapiens
tctgaaagcacag

SEQ ID NO: 5645969 - DNA, 23 bp, Homo sapiens
tctgaaagcacaggagacactgt

SEQ ID NO: 5645970 - DNA, 16 bp, Homo sapiens
tctgaaagctgcttct

SEQ ID NO: 5645971 - DNA, 22 bp, Homo sapiens
tctgaaaggaaatacacttctt

SEQ ID NO: 5645972 - DNA, 16 bp, Homo sapiens
tctgaaaggagacatt

SEQ ID NO: 5645973 - DNA, 21 bp, Homo sapiens
tctgaaaggagacattgctct

SEQ ID NO: 5645974 - DNA, 23 bp, Homo sapiens
tctgaaaggagacattgctctat

SEQ ID NO: 5645975 - DNA, 21 bp, Homo sapiens
tctgaaaggctatcctgctga

SEQ ID NO: 5645976 - DNA, 13 bp, Homo sapiens
tctgaaagtgttg

SEQ ID NO: 5645977 - DNA, 19 bp, Homo sapiens
tctgaaagttttgatactt

SEQ ID NO: 5645978 - DNA, 16 bp, Homo sapiens
tctgaaataaaaatta

SEQ ID NO: 5645979 - DNA, 18 bp, Homo sapiens
tctgaaataggaaacaag

SEQ ID NO: 5645980 - DNA, 21 bp, Homo sapiens
tctgaaatataggtttaattt

SEQ ID NO: 5645981 - DNA, 16 bp, Homo sapiens
tctgaaatatcccggg

SEQ ID NO: 5645982 - DNA, 16 bp, Homo sapiens
tctgaaatcaactctc

SEQ ID NO: 5645983 - DNA, 19 bp, Homo sapiens
tctgaaatcaactctcttc

SEQ ID NO: 5645984 - DNA, 15 bp, Homo sapiens
tctgaaatcccaaca

SEQ ID NO: 5645985 - DNA, 12 bp, Homo sapiens
tctgaaatctga

SEQ ID NO: 5645986 - DNA, 14 bp, Homo sapiens
tctgaaatgaaaca

SEQ ID NO: 5645987 - DNA, 21 bp, Homo sapiens
tctgaaatgtgataagttctt

SEQ ID NO: 5645988 - DNA, 13 bp, Homo sapiens
tctgaaattaaag

SEQ ID NO: 5645989 - DNA, 17 bp, Homo sapiens
tctgaaattaaagaaat

SEQ ID NO: 5645990 - DNA, 22 bp, Homo sapiens
tctgaaattaaagtatgcaaaa

SEQ ID NO: 5645991 - DNA, 20 bp, Homo sapiens
tctgaaattcacagaagcct

SEQ ID NO: 5645992 - DNA, 12 bp, Homo sapiens
tctgaaattcta

SEQ ID NO: 5645993 - DNA, 20 bp, Homo sapiens
tctgaaattggtgggaagca

SEQ ID NO: 5645994 - DNA, 23 bp, Homo sapiens
tctgaaattggtgggaagcaagc

SEQ ID NO: 5645995 - DNA, 17 bp, Homo sapiens
tctgaaatttcctggga

SEQ ID NO: 5645996 - DNA, 16 bp, Homo sapiens
tctgaaattttctaga

SEQ ID NO: 5645997 - DNA, 15 bp, Homo sapiens
tctgaacaaaagctt

SEQ ID NO: 5645998 - DNA, 16 bp, Homo sapiens
tctgaacaaagtgcta

SEQ ID NO: 5645999 - DNA, 19 bp, Homo sapiens
tctgaacacacacgccagc

SEQ ID NO: 5646000 - DNA, 12 bp, Homo sapiens
tctgaacacatt

SEQ ID NO: 5646001 - DNA, 12 bp, Homo sapiens
tctgaacacttt

SEQ ID NO: 5646002 - DNA, 15 bp, Homo sapiens
tctgaacagctggtg

SEQ ID NO: 5646003 - DNA, 21 bp, Homo sapiens
tctgaaccaatagaaagcaaa

SEQ ID NO: 5646004 - DNA, 16 bp, Homo sapiens
tctgaaccactttgcc

SEQ ID NO: 5646005 - DNA, 17 bp, Homo sapiens
tctgaaccactttgcct

SEQ ID NO: 5646006 - DNA, 16 bp, Homo sapiens
tctgaacccaggcagc

SEQ ID NO: 5646007 - DNA, 21 bp, Homo sapiens
tctgaacccaggcagctggca

SEQ ID NO: 5646008 - DNA, 23 bp, Homo sapiens
tctgaacccaggcagctggcagg

SEQ ID NO: 5646009 - DNA, 21 bp, Homo sapiens
tctgaacccttgtgcttggtg

SEQ ID NO: 5646010 - DNA, 14 bp, Homo sapiens
tctgaactcaaact

SEQ ID NO: 5646011 - DNA, 21 bp, Homo sapiens
tctgaactcaaactgaggaat

SEQ ID NO: 5646012 - DNA, 21 bp, Homo sapiens
tctgaactcacagactgctgt

SEQ ID NO: 5646013 - DNA, 17 bp, Homo sapiens
tctgaactccatacagc

SEQ ID NO: 5646014 - DNA, 14 bp, Homo sapiens
tctgaactccattt

SEQ ID NO: 5646015 - DNA, 22 bp, Homo sapiens
tctgaactgaccttgaatcttt

SEQ ID NO: 5646016 - DNA, 16 bp, Homo sapiens
tctgaactgcaacact

SEQ ID NO: 5646017 - DNA, 20 bp, Homo sapiens
tctgaactgctgctggtcac

SEQ ID NO: 5646018 - DNA, 13 bp, Homo sapiens
tctgaactgcttg

SEQ ID NO: 5646019 - DNA, 23 bp, Homo sapiens
tctgaactggactagtgaaaaat

SEQ ID NO: 5646020 - DNA, 18 bp, Homo sapiens
tctgaactggtagaaaaa

SEQ ID NO: 5646021 - DNA, 15 bp, Homo sapiens
tctgaactgttacaa

SEQ ID NO: 5646022 - DNA, 18 bp, Homo sapiens
tctgaactgttacaactt

SEQ ID NO: 5646023 - DNA, 22 bp, Homo sapiens
tctgaacttgagtataagataa

SEQ ID NO: 5646024 - DNA, 12 bp, Homo sapiens
tctgaacttgcc

SEQ ID NO: 5646025 - DNA, 15 bp, Homo sapiens
tctgaactttggaag

SEQ ID NO: 5646026 - DNA, 16 bp, Homo sapiens
tctgaactttgggaag

SEQ ID NO: 5646027 - DNA, 13 bp, Homo sapiens
tctgaactttgtt

SEQ ID NO: 5646028 - DNA, 19 bp, Homo sapiens
tctgaactttgtttccaga

SEQ ID NO: 5646029 - DNA, 20 bp, Homo sapiens
tctgaactttgtttccagaa

SEQ ID NO: 5646030 - DNA, 18 bp, Homo sapiens
tctgaagaaagttattct

SEQ ID NO: 5646031 - DNA, 18 bp, Homo sapiens
tctgaagaagggaattag

SEQ ID NO: 5646032 - DNA, 19 bp, Homo sapiens
tctgaagaagttaattctt

SEQ ID NO: 5646033 - DNA, 13 bp, Homo sapiens
tctgaagaagttt

SEQ ID NO: 5646034 - DNA, 23 bp, Homo sapiens
tctgaagagaccactcaatccat

SEQ ID NO: 5646035 - DNA, 24 bp, Homo sapiens
tctgaagagcctgaagctggcctg

SEQ ID NO: 5646036 - DNA, 12 bp, Homo sapiens
tctgaagagctg

SEQ ID NO: 5646037 - DNA, 17 bp, Homo sapiens
tctgaagaggcttctcc

SEQ ID NO: 5646038 - DNA, 18 bp, Homo sapiens
tctgaagatatatttcac

SEQ ID NO: 5646039 - DNA, 17 bp, Homo sapiens
tctgaagatcaatttct

SEQ ID NO: 5646040 - DNA, 13 bp, Homo sapiens
tctgaagatcaga

SEQ ID NO: 5646041 - DNA, 23 bp, Homo sapiens
tctgaagatcagaacattcagct

SEQ ID NO: 5646042 - DNA, 14 bp, Homo sapiens
tctgaagatggaag

SEQ ID NO: 5646043 - DNA, 14 bp, Homo sapiens
tctgaagattgttt

SEQ ID NO: 5646044 - DNA, 16 bp, Homo sapiens
tctgaagcagagaccg

SEQ ID NO: 5646045 - DNA, 19 bp, Homo sapiens
tctgaagccacctctctgc

SEQ ID NO: 5646046 - DNA, 21 bp, Homo sapiens
tctgaagccacctctctgcct

SEQ ID NO: 5646047 - DNA, 23 bp, Homo sapiens
tctgaagccatagcctccacgga

SEQ ID NO: 5646048 - DNA, 20 bp, Homo sapiens
tctgaagcccaaagcctgag

SEQ ID NO: 5646049 - DNA, 18 bp, Homo sapiens
tctgaagccctcccaggt

SEQ ID NO: 5646050 - DNA, 13 bp, Homo sapiens
tctgaagcctcac

SEQ ID NO: 5646051 - DNA, 19 bp, Homo sapiens
tctgaagccttttcctgag

SEQ ID NO: 5646052 - DNA, 19 bp, Homo sapiens
tctgaagcgactctcctgt

SEQ ID NO: 5646053 - DNA, 16 bp, Homo sapiens
tctgaagctagaaaca

SEQ ID NO: 5646054 - DNA, 17 bp, Homo sapiens
tctgaagctagaaacaa

SEQ ID NO: 5646055 - DNA, 21 bp, Homo sapiens
tctgaagctcaactctcttat

SEQ ID NO: 5646056 - DNA, 20 bp, Homo sapiens
tctgaagcttatgtttctta

SEQ ID NO: 5646057 - DNA, 14 bp, Homo sapiens
tctgaaggaagaga

SEQ ID NO: 5646058 - DNA, 16 bp, Homo sapiens
tctgaaggaagagaag

SEQ ID NO: 5646059 - DNA, 14 bp, Homo sapiens
tctgatttatacca

SEQ ID NO: 5646060 - DNA, 16 bp, Homo sapiens
tctgatttcacatatt

SEQ ID NO: 5646061 - DNA, 18 bp, Homo sapiens
tctgatttcactcagggt

SEQ ID NO: 5646062 - DNA, 13 bp, Homo sapiens
tctgatttcagga

SEQ ID NO: 5646063 - DNA, 18 bp, Homo sapiens
tctgatttcagtttttca

SEQ ID NO: 5646064 - DNA, 21 bp, Homo sapiens
tctgatttcagtttttcattt

SEQ ID NO: 5646065 - DNA, 19 bp, Homo sapiens
tctgatttcataattcaga

SEQ ID NO: 5646066 - DNA, 12 bp, Homo sapiens
tctgatttctga

SEQ ID NO: 5646067 - DNA, 21 bp, Homo sapiens
tctgatttctgcccttgttcc

SEQ ID NO: 5646068 - DNA, 11 bp, Homo sapiens
tctgatttgca

SEQ ID NO: 5646069 - DNA, 12 bp, Homo sapiens
tctgatttgcag

SEQ ID NO: 5646070 - DNA, 17 bp, Homo sapiens
tctgatttgcatattca

SEQ ID NO: 5646071 - DNA, 22 bp, Homo sapiens
tctgatttgtaacccactgaga

SEQ ID NO: 5646072 - DNA, 12 bp, Homo sapiens
tctgatttgtcc

SEQ ID NO: 5646073 - DNA, 14 bp, Homo sapiens
tctgattttaagtt

SEQ ID NO: 5646074 - DNA, 15 bp, Homo sapiens
tctgattttaatgaa

SEQ ID NO: 5646075 - DNA, 19 bp, Homo sapiens
tctgattttaatgaaatca

SEQ ID NO: 5646076 - DNA, 22 bp, Homo sapiens
tctgattttatgtaaaattttg

SEQ ID NO: 5646077 - DNA, 13 bp, Homo sapiens
tctgattttctca

SEQ ID NO: 5646078 - DNA, 15 bp, Homo sapiens
tctgattttctccac

SEQ ID NO: 5646079 - DNA, 22 bp, Homo sapiens
tctgattttgatattttcacag

SEQ ID NO: 5646080 - DNA, 15 bp, Homo sapiens
tctgattttgcttct

SEQ ID NO: 5646081 - DNA, 17 bp, Homo sapiens
tctgatttttaaagtac

SEQ ID NO: 5646082 - DNA, 20 bp, Homo sapiens
tctgatttttaaagtacttt

SEQ ID NO: 5646083 - DNA, 13 bp, Homo sapiens
tctgatttttaat

SEQ ID NO: 5646084 - DNA, 14 bp, Homo sapiens
tctgatttttctct

SEQ ID NO: 5646085 - DNA, 17 bp, Homo sapiens
tctgatttttttgttgt

SEQ ID NO: 5646086 - DNA, 19 bp, Homo sapiens
tctgatttttttgttgttg

SEQ ID NO: 5646087 - DNA, 20 bp, Homo sapiens
tctgattttttttgtagctg

SEQ ID NO: 5646088 - DNA, 14 bp, Homo sapiens
tctgcaaaaatatt

SEQ ID NO: 5646089 - DNA, 19 bp, Homo sapiens
tctgcaaaaatatttataa

SEQ ID NO: 5646090 - DNA, 24 bp, Homo sapiens
tctgcaaacaccaacatgttggga

SEQ ID NO: 5646091 - DNA, 15 bp, Homo sapiens
tctgcaaactgcctt

SEQ ID NO: 5646092 - DNA, 18 bp, Homo sapiens
tctgcaaagaatgagaag

SEQ ID NO: 5646093 - DNA, 20 bp, Homo sapiens
tctgcaaaggagggcctcag

SEQ ID NO: 5646094 - DNA, 14 bp, Homo sapiens
tctgcaaaggcctg

SEQ ID NO: 5646095 - DNA, 18 bp, Homo sapiens
tctgcaaagtggcaggga

SEQ ID NO: 5646096 - DNA, 14 bp, Homo sapiens
tctgcaacaagcat

SEQ ID NO: 5646097 - DNA, 14 bp, Homo sapiens
tctgcaacactttg

SEQ ID NO: 5646098 - DNA, 16 bp, Homo sapiens
tctgcaacagcctgtt

SEQ ID NO: 5646099 - DNA, 17 bp, Homo sapiens
tctgcaactagccaagg

SEQ ID NO: 5646100 - DNA, 22 bp, Homo sapiens
tctgcaactcatgaacaaaatg

SEQ ID NO: 5646101 - DNA, 13 bp, Homo sapiens
tctgcaactgaat

SEQ ID NO: 5646102 - DNA, 16 bp, Homo sapiens
tctgcaactgcaagaa

SEQ ID NO: 5646103 - DNA, 14 bp, Homo sapiens
tctgcaactgctca

SEQ ID NO: 5646104 - DNA, 21 bp, Homo sapiens
tctgcaagaattaaaactgag

SEQ ID NO: 5646105 - DNA, 21 bp, Homo sapiens
tctgcaagattctgaaacatt

SEQ ID NO: 5646106 - DNA, 16 bp, Homo sapiens
tctgcaagattctgtg

SEQ ID NO: 5646107 - DNA, 23 bp, Homo sapiens
tctgcaagattctgtgggcagct

SEQ ID NO: 5646108 - DNA, 17 bp, Homo sapiens
tctgcaagcctcatgcc

SEQ ID NO: 5646109 - DNA, 14 bp, Homo sapiens
tctgcaaggatttt

SEQ ID NO: 5646110 - DNA, 16 bp, Homo sapiens
tctgcaagggcccaga

SEQ ID NO: 5646111 - DNA, 17 bp, Homo sapiens
tctgcaagggcccagag

SEQ ID NO: 5646112 - DNA, 13 bp, Homo sapiens
tctgcaagtcaga

SEQ ID NO: 5646113 - DNA, 14 bp, Homo sapiens
tctgcaagtcagag

SEQ ID NO: 5646114 - DNA, 18 bp, Homo sapiens
tctgcaagtgctcaggga

SEQ ID NO: 5646115 - DNA, 20 bp, Homo sapiens
tctgcaagtgctcagggaaa

SEQ ID NO: 5646116 - DNA, 21 bp, Homo sapiens
tctgcaagtgctcagggaaat

SEQ ID NO: 5646117 - DNA, 15 bp, Homo sapiens
tctgcaatgcttctg

SEQ ID NO: 5646118 - DNA, 20 bp, Homo sapiens
tctgcaatgcttctgtagct

SEQ ID NO: 5646119 - DNA, 16 bp, Homo sapiens
tctgcaatgggcactg

SEQ ID NO: 5646120 - DNA, 18 bp, Homo sapiens
tctgcaatgtttttgtgt

SEQ ID NO: 5646121 - DNA, 19 bp, Homo sapiens
tctgcaattcaaaagttcc

SEQ ID NO: 5646122 - DNA, 21 bp, Homo sapiens
tctgcaattcaaaagttccaa

SEQ ID NO: 5646123 - DNA, 16 bp, Homo sapiens
tctgcaattcccctct

SEQ ID NO: 5646124 - DNA, 16 bp, Homo sapiens
tctgcacacaaatatt

SEQ ID NO: 5646125 - DNA, 19 bp, Homo sapiens
tctgcacacacctccgaga

SEQ ID NO: 5646126 - DNA, 14 bp, Homo sapiens
tctgcacacagcac

SEQ ID NO: 5646127 - DNA, 22 bp, Homo sapiens
tctgcacaccctccagagacaa

SEQ ID NO: 5646128 - DNA, 21 bp, Homo sapiens
tctgcacagaaacttgaactc

SEQ ID NO: 5646129 - DNA, 16 bp, Homo sapiens
tctgcacagctcctcc

SEQ ID NO: 5646130 - DNA, 17 bp, Homo sapiens
tctgcacagctcctccc

SEQ ID NO: 5646131 - DNA, 12 bp, Homo sapiens
tctgcacagctt

SEQ ID NO: 5646132 - DNA, 13 bp, Homo sapiens
tctgcacagcttt

SEQ ID NO: 5646133 - DNA, 19 bp, Homo sapiens
tctgcacagcttttccaaa

SEQ ID NO: 5646134 - DNA, 14 bp, Homo sapiens
tctgcacagggtcc

SEQ ID NO: 5646135 - DNA, 20 bp, Homo sapiens
tctgcacaggtctctgttta

SEQ ID NO: 5646136 - DNA, 18 bp, Homo sapiens
tctgcacagtcagaagga

SEQ ID NO: 5646137 - DNA, 12 bp, Homo sapiens
tctgcacatgtc

SEQ ID NO: 5646138 - DNA, 18 bp, Homo sapiens
tctgcaccacacctggca

SEQ ID NO: 5646139 - DNA, 20 bp, Homo sapiens
tctgcaccaccatgcccagc

SEQ ID NO: 5646140 - DNA, 16 bp, Homo sapiens
tctgcacccacgtgca

SEQ ID NO: 5646141 - DNA, 22 bp, Homo sapiens
tctgcacccagccccaaggggt

SEQ ID NO: 5646142 - DNA, 12 bp, Homo sapiens
tctgcacccagt

SEQ ID NO: 5646143 - DNA, 21 bp, Homo sapiens
tctgcacccagtgaacacatt

SEQ ID NO: 5646144 - DNA, 18 bp, Homo sapiens
tctgcacccgcctcgacc

SEQ ID NO: 5646145 - DNA, 16 bp, Homo sapiens
tctgcaccctccaccc

SEQ ID NO: 5646146 - DNA, 18 bp, Homo sapiens
tctgcaccctccaccctg

SEQ ID NO: 5646147 - DNA, 15 bp, Homo sapiens
tctgcacccttcttt

SEQ ID NO: 5646148 - DNA, 16 bp, Homo sapiens
tctgcacccttctttt

SEQ ID NO: 5646149 - DNA, 21 bp, Homo sapiens
tctgcaccgacgcctgccccc

SEQ ID NO: 5646150 - DNA, 22 bp, Homo sapiens
tctgcacctatgtagctctgca

SEQ ID NO: 5646151 - DNA, 14 bp, Homo sapiens
tctgcaccttatct

SEQ ID NO: 5646152 - DNA, 15 bp, Homo sapiens
tctgcaccttctgac

SEQ ID NO: 5646153 - DNA, 15 bp, Homo sapiens
tctgcaccttgccag

SEQ ID NO: 5646154 - DNA, 18 bp, Homo sapiens
tctgcaccttgccaggga

SEQ ID NO: 5646155 - DNA, 21 bp, Homo sapiens
tctgcacgctcaatgcccagt

SEQ ID NO: 5646156 - DNA, 18 bp, Homo sapiens
tctgcacgtgcacacacc

SEQ ID NO: 5646157 - DNA, 21 bp, Homo sapiens
tctgcacgtgcacacacctgc

SEQ ID NO: 5646158 - DNA, 12 bp, Homo sapiens
tctgcactactc

SEQ ID NO: 5646159 - DNA, 14 bp, Homo sapiens
tctgcactactcct

SEQ ID NO: 5646160 - DNA, 18 bp, Homo sapiens
tctgcactactcctctgc

SEQ ID NO: 5646161 - DNA, 20 bp, Homo sapiens
tctgcactactcctctgcag

SEQ ID NO: 5646162 - DNA, 20 bp, Homo sapiens
tctgcactactgacatgtgg

SEQ ID NO: 5646163 - DNA, 21 bp, Homo sapiens
tctgcactactgacatgtggg

SEQ ID NO: 5646164 - DNA, 15 bp, Homo sapiens
tctgcactcagaaaa

SEQ ID NO: 5646165 - DNA, 16 bp, Homo sapiens
tctgcactccagatat

SEQ ID NO: 5646166 - DNA, 22 bp, Homo sapiens
tctgcactccagatatgtgcca

SEQ ID NO: 5646167 - DNA, 13 bp, Homo sapiens
tctgcactccatg

SEQ ID NO: 5646168 - DNA, 17 bp, Homo sapiens
tctgcactccatggcca

SEQ ID NO: 5646169 - DNA, 13 bp, Homo sapiens
tctgcactcccct

SEQ ID NO: 5646170 - DNA, 22 bp, Homo sapiens
tctgcactcccctgctgggtgt

SEQ ID NO: 5646171 - DNA, 14 bp, Homo sapiens
tctgcactcctgga

SEQ ID NO: 5646172 - DNA, 18 bp, Homo sapiens
tctgcactcctgtctctt

SEQ ID NO: 5646173 - DNA, 20 bp, Homo sapiens
tctgcactctccaccctggc

SEQ ID NO: 5646174 - DNA, 15 bp, Homo sapiens
tctgcactgagcaga

SEQ ID NO: 5646175 - DNA, 14 bp, Homo sapiens
tctgcactgaggat

SEQ ID NO: 5646176 - DNA, 20 bp, Homo sapiens
tctgcactgaggatttcttt

SEQ ID NO: 5646177 - DNA, 22 bp, Homo sapiens
tctgcactggggcgtttcctac

SEQ ID NO: 5646178 - DNA, 16 bp, Homo sapiens
tctgcacttctgttcc

SEQ ID NO: 5646179 - DNA, 23 bp, Homo sapiens
tctgcacttgcggttccggcatg

SEQ ID NO: 5646180 - DNA, 22 bp, Homo sapiens
tctgcagaacatcgatatgtat

SEQ ID NO: 5646181 - DNA, 18 bp, Homo sapiens
tctgcagaagccaaggga

SEQ ID NO: 5646182 - DNA, 22 bp, Homo sapiens
tctgcagaaggaaaaatgtgta

SEQ ID NO: 5646183 - DNA, 22 bp, Homo sapiens
tctgcagacaagtcttgctgtg

SEQ ID NO: 5646184 - DNA, 19 bp, Homo sapiens
tctgcagacacgccttccc

SEQ ID NO: 5646185 - DNA, 17 bp, Homo sapiens
tctgcagactcgttctc

SEQ ID NO: 5646186 - DNA, 15 bp, Homo sapiens
tctgcagactgctag

SEQ ID NO: 5646187 - DNA, 16 bp, Homo sapiens
tctgcagactggcagt

SEQ ID NO: 5646188 - DNA, 18 bp, Homo sapiens
tctgcagacttcccagct

SEQ ID NO: 5646189 - DNA, 12 bp, Homo sapiens
tctgcagagcag

SEQ ID NO: 5646190 - DNA, 12 bp, Homo sapiens
tctgcagaggca

SEQ ID NO: 5646191 - DNA, 16 bp, Homo sapiens
tctgcagaggcagcag

SEQ ID NO: 5646192 - DNA, 21 bp, Homo sapiens
tctgcagaggcagcaggagcc

SEQ ID NO: 5646193 - DNA, 15 bp, Homo sapiens
tctgcagagtatttg

SEQ ID NO: 5646194 - DNA, 19 bp, Homo sapiens
tctgcagatagtgcctctg

SEQ ID NO: 5646195 - DNA, 21 bp, Homo sapiens
tctgcagatagtgcctctgca

SEQ ID NO: 5646196 - DNA, 14 bp, Homo sapiens
tctgcagcaactcc

SEQ ID NO: 5646197 - DNA, 19 bp, Homo sapiens
tctgcagcaactcccacga

SEQ ID NO: 5646198 - DNA, 18 bp, Homo sapiens
tctgcagcaataaagcag

SEQ ID NO: 5646199 - DNA, 22 bp, Homo sapiens
tctgcagcacattgccctgagg

SEQ ID NO: 5646200 - DNA, 21 bp, Homo sapiens
tctgcagcactttaaccctct

SEQ ID NO: 5646201 - DNA, 18 bp, Homo sapiens
tctgcagcattgaagtat

SEQ ID NO: 5646202 - DNA, 20 bp, Homo sapiens
tctgcagcccacagaggaca

SEQ ID NO: 5646203 - DNA, 12 bp, Homo sapiens
tctgcagcccag

SEQ ID NO: 5646204 - DNA, 15 bp, Homo sapiens
tctgcagcccaggga

SEQ ID NO: 5646205 - DNA, 20 bp, Homo sapiens
tctgcagcccgatgtccctg

SEQ ID NO: 5646206 - DNA, 22 bp, Homo sapiens
tctgcagcccgatgtccctgtc

SEQ ID NO: 5646207 - DNA, 16 bp, Homo sapiens
tctgcagccggaggag

SEQ ID NO: 5646208 - DNA, 14 bp, Homo sapiens
tctgcagcctgagc

SEQ ID NO: 5646209 - DNA, 14 bp, Homo sapiens
tctgcagcctgctg

SEQ ID NO: 5646210 - DNA, 16 bp, Homo sapiens
tctgcagcctgctggg

SEQ ID NO: 5646211 - DNA, 17 bp, Homo sapiens
tctgcagcctgctgggg

SEQ ID NO: 5646212 - DNA, 13 bp, Homo sapiens
tctgcagcggcag

SEQ ID NO: 5646213 - DNA, 19 bp, Homo sapiens
tctgcagcggcagagcaat

SEQ ID NO: 5646214 - DNA, 20 bp, Homo sapiens
tctgcagctattcacacaca

SEQ ID NO: 5646215 - DNA, 14 bp, Homo sapiens
tctgcagctgacct

SEQ ID NO: 5646216 - DNA, 18 bp, Homo sapiens
tctgcagctgcttttgca

SEQ ID NO: 5646217 - DNA, 19 bp, Homo sapiens
tctgcagctgcttttgcat

SEQ ID NO: 5646218 - DNA, 11 bp, Homo sapiens
tctgcagctgt

SEQ ID NO: 5646219 - DNA, 13 bp, Homo sapiens
tctgcagctgttt

SEQ ID NO: 5646220 - DNA, 17 bp, Homo sapiens
tctgcagctttggctgc

SEQ ID NO: 5646221 - DNA, 11 bp, Homo sapiens
tctgcaggaaa

SEQ ID NO: 5646222 - DNA, 19 bp, Homo sapiens
tctgcaggaaataggccca

SEQ ID NO: 5646223 - DNA, 21 bp, Homo sapiens
tctgcaggaatcccggctcca

SEQ ID NO: 5646224 - DNA, 15 bp, Homo sapiens
tctgcaggacacaga

SEQ ID NO: 5646225 - DNA, 14 bp, Homo sapiens
tctgcaggacagag

SEQ ID NO: 5646226 - DNA, 22 bp, Homo sapiens
tctgcaggattgattatgcaga

SEQ ID NO: 5646227 - DNA, 13 bp, Homo sapiens
tctgcaggcagcc

SEQ ID NO: 5646228 - DNA, 15 bp, Homo sapiens
tctgcaggcagcctt

SEQ ID NO: 5646229 - DNA, 14 bp, Homo sapiens
tctgcaggcagggc

SEQ ID NO: 5646230 - DNA, 14 bp, Homo sapiens
tctgcaggcttaat

SEQ ID NO: 5646231 - DNA, 15 bp, Homo sapiens
tctgcagggcagcct

SEQ ID NO: 5646232 - DNA, 17 bp, Homo sapiens
tctgcaggggcctggag

SEQ ID NO: 5646233 - DNA, 19 bp, Homo sapiens
tctgcagggggtgtgtctg

SEQ ID NO: 5646234 - DNA, 16 bp, Homo sapiens
tctgcaggggtctggg

SEQ ID NO: 5646235 - DNA, 17 bp, Homo sapiens
tctgcaggggtctggga

SEQ ID NO: 5646236 - DNA, 20 bp, Homo sapiens
tctgcagggtgacgcctgag

SEQ ID NO: 5646237 - DNA, 21 bp, Homo sapiens
tctgcagggtgacgcctgaga

SEQ ID NO: 5646238 - DNA, 23 bp, Homo sapiens
tctgctgggaacctagcacacct

SEQ ID NO: 5646239 - DNA, 15 bp, Homo sapiens
tctgctgggagttct

SEQ ID NO: 5646240 - DNA, 21 bp, Homo sapiens
tctgctgggagttctagaacc

SEQ ID NO: 5646241 - DNA, 21 bp, Homo sapiens
tctgctgggatgtgtgctttc

SEQ ID NO: 5646242 - DNA, 22 bp, Homo sapiens
tctgctgggctggcggccatcc

SEQ ID NO: 5646243 - DNA, 14 bp, Homo sapiens
tctgctgggctggg

SEQ ID NO: 5646244 - DNA, 22 bp, Homo sapiens
tctgctgggctggggcctgatg

SEQ ID NO: 5646245 - DNA, 15 bp, Homo sapiens
tctgctgggtttcca

SEQ ID NO: 5646246 - DNA, 13 bp, Homo sapiens
tctgctggtcact

SEQ ID NO: 5646247 - DNA, 13 bp, Homo sapiens
tctgctggtgaat

SEQ ID NO: 5646248 - DNA, 17 bp, Homo sapiens
tctgctggttcctgact

SEQ ID NO: 5646249 - DNA, 21 bp, Homo sapiens
tctgctggttcctgactggca

SEQ ID NO: 5646250 - DNA, 22 bp, Homo sapiens
tctgctggttcctgactggcaa

SEQ ID NO: 5646251 - DNA, 13 bp, Homo sapiens
tctgctgtagaaa

SEQ ID NO: 5646252 - DNA, 17 bp, Homo sapiens
tctgctgtcctgtttct

SEQ ID NO: 5646253 - DNA, 16 bp, Homo sapiens
tctgctgtccttgcct

SEQ ID NO: 5646254 - DNA, 13 bp, Homo sapiens
tctgctgtctccc

SEQ ID NO: 5646255 - DNA, 16 bp, Homo sapiens
tctgctgtctccctga

SEQ ID NO: 5646256 - DNA, 21 bp, Homo sapiens
tctgctgtggtctataaaata

SEQ ID NO: 5646257 - DNA, 22 bp, Homo sapiens
tctgctgtggtctataaaataa

SEQ ID NO: 5646258 - DNA, 11 bp, Homo sapiens
tctgctgtgtg

SEQ ID NO: 5646259 - DNA, 14 bp, Homo sapiens
tctgctgttccagt

SEQ ID NO: 5646260 - DNA, 21 bp, Homo sapiens
tctgctgttctctagaaagaa

SEQ ID NO: 5646261 - DNA, 14 bp, Homo sapiens
tctgctgttcttca

SEQ ID NO: 5646262 - DNA, 13 bp, Homo sapiens
tctgctgttgcca

SEQ ID NO: 5646263 - DNA, 19 bp, Homo sapiens
tctgctgttgccatagccc

SEQ ID NO: 5646264 - DNA, 16 bp, Homo sapiens
tctgcttaaaaactca

SEQ ID NO: 5646265 - DNA, 20 bp, Homo sapiens
tctgcttacaattccctgct

SEQ ID NO: 5646266 - DNA, 15 bp, Homo sapiens
tctgcttaccaaaac

SEQ ID NO: 5646267 - DNA, 13 bp, Homo sapiens
tctgcttaccctt

SEQ ID NO: 5646268 - DNA, 17 bp, Homo sapiens
tctgcttacccttcacc

SEQ ID NO: 5646269 - DNA, 20 bp, Homo sapiens
tctgcttaccgttcaagagg

SEQ ID NO: 5646270 - DNA, 21 bp, Homo sapiens
tctgcttaggtgccaggcatg

SEQ ID NO: 5646271 - DNA, 19 bp, Homo sapiens
tctgcttatttcatctgtt

SEQ ID NO: 5646272 - DNA, 23 bp, Homo sapiens
tctgcttatttcatctgttctat

SEQ ID NO: 5646273 - DNA, 19 bp, Homo sapiens
tctgcttcaataaatcttt

SEQ ID NO: 5646274 - DNA, 12 bp, Homo sapiens
tctgcttcccag

SEQ ID NO: 5646275 - DNA, 14 bp, Homo sapiens
tctgcttccctggg

SEQ ID NO: 5646276 - DNA, 19 bp, Homo sapiens
tctgcttccgtattttaat

SEQ ID NO: 5646277 - DNA, 12 bp, Homo sapiens
tctgcttccgtt

SEQ ID NO: 5646278 - DNA, 16 bp, Homo sapiens
tctgcttccgttcctc

SEQ ID NO: 5646279 - DNA, 17 bp, Homo sapiens
tctgcttcctcagggcc

SEQ ID NO: 5646280 - DNA, 19 bp, Homo sapiens
tctgcttcctcagggccca

SEQ ID NO: 5646281 - DNA, 21 bp, Homo sapiens
tctgcttccttacacatagat

SEQ ID NO: 5646282 - DNA, 13 bp, Homo sapiens
tctgcttctagta

SEQ ID NO: 5646283 - DNA, 13 bp, Homo sapiens
tctgcttctcatc

SEQ ID NO: 5646284 - DNA, 15 bp, Homo sapiens
tctgcttctccctgg

SEQ ID NO: 5646285 - DNA, 17 bp, Homo sapiens
tctgcttctccctggct

SEQ ID NO: 5646286 - DNA, 21 bp, Homo sapiens
tctgcttctcggggtccagtg

SEQ ID NO: 5646287 - DNA, 23 bp, Homo sapiens
tctgcttctcggggtccagtgca

SEQ ID NO: 5646288 - DNA, 14 bp, Homo sapiens
tctgcttctctcac

SEQ ID NO: 5646289 - DNA, 22 bp, Homo sapiens
tctgcttctctgacttctgcct

SEQ ID NO: 5646290 - DNA, 15 bp, Homo sapiens
tctgcttctctttca

SEQ ID NO: 5646291 - DNA, 12 bp, Homo sapiens
tctgcttgagtc

SEQ ID NO: 5646292 - DNA, 18 bp, Homo sapiens
tctgcttgatatcccaag

SEQ ID NO: 5646293 - DNA, 19 bp, Homo sapiens
tctgcttgcatctgcacat

SEQ ID NO: 5646294 - DNA, 14 bp, Homo sapiens
tctgcttgccagcc

SEQ ID NO: 5646295 - DNA, 17 bp, Homo sapiens
tctgcttgccagccagg

SEQ ID NO: 5646296 - DNA, 20 bp, Homo sapiens
tctgcttgccgaaactggaa

SEQ ID NO: 5646297 - DNA, 20 bp, Homo sapiens
tctgcttgccgactggctgt

SEQ ID NO: 5646298 - DNA, 15 bp, Homo sapiens
tctgcttgcctagcc

SEQ ID NO: 5646299 - DNA, 14 bp, Homo sapiens
tctgcttgctccca

SEQ ID NO: 5646300 - DNA, 21 bp, Homo sapiens
tctgcttggcttcccctccac

SEQ ID NO: 5646301 - DNA, 16 bp, Homo sapiens
tctgcttgtattccaa

SEQ ID NO: 5646302 - DNA, 18 bp, Homo sapiens
tctgcttgtattttccat

SEQ ID NO: 5646303 - DNA, 19 bp, Homo sapiens
tctgcttgtattttccata

SEQ ID NO: 5646304 - DNA, 18 bp, Homo sapiens
tctgctttaaagggcctg

SEQ ID NO: 5646305 - DNA, 22 bp, Homo sapiens
tctgctttaaagggcctgcctg

SEQ ID NO: 5646306 - DNA, 16 bp, Homo sapiens
tctgctttagacttga

SEQ ID NO: 5646307 - DNA, 18 bp, Homo sapiens
tctgctttagacttgaaa

SEQ ID NO: 5646308 - DNA, 18 bp, Homo sapiens
tctgctttatcttttcat

SEQ ID NO: 5646309 - DNA, 15 bp, Homo sapiens
tctgctttatgttgc

SEQ ID NO: 5646310 - DNA, 18 bp, Homo sapiens
tctgctttattgcctctg

SEQ ID NO: 5646311 - DNA, 22 bp, Homo sapiens
tctgctttcacttaagtgtctg

SEQ ID NO: 5646312 - DNA, 13 bp, Homo sapiens
tctgctttccaca

SEQ ID NO: 5646313 - DNA, 13 bp, Homo sapiens
tctgctttcctct

SEQ ID NO: 5646314 - DNA, 17 bp, Homo sapiens
tctgctttctgatacat

SEQ ID NO: 5646315 - DNA, 15 bp, Homo sapiens
tctgctttctgttca

SEQ ID NO: 5646316 - DNA, 16 bp, Homo sapiens
tctgctttctgttcat

SEQ ID NO: 5646317 - DNA, 17 bp, Homo sapiens
tctgctttctgttcatc

SEQ ID NO: 5646318 - DNA, 19 bp, Homo sapiens
tctgctttctttgattctc

SEQ ID NO: 5646319 - DNA, 22 bp, Homo sapiens
tctgctttctttgattctcctt

SEQ ID NO: 5646320 - DNA, 22 bp, Homo sapiens
tctgctttggggcttatcagaa

SEQ ID NO: 5646321 - DNA, 22 bp, Homo sapiens
tctgctttggggtttatcagaa

SEQ ID NO: 5646322 - DNA, 18 bp, Homo sapiens
tctgctttgttaatgaaa

SEQ ID NO: 5646323 - DNA, 22 bp, Homo sapiens
tctgctttgttgtgtgcctcta

SEQ ID NO: 5646324 - DNA, 13 bp, Homo sapiens
tctgcttttatct

SEQ ID NO: 5646325 - DNA, 22 bp, Homo sapiens
tctgcttttccattctgggtgt

SEQ ID NO: 5646326 - DNA, 14 bp, Homo sapiens
tctgcttttcctct

SEQ ID NO: 5646327 - DNA, 15 bp, Homo sapiens
tctgcttttcctgtc

SEQ ID NO: 5646328 - DNA, 17 bp, Homo sapiens
tctgcttttcctgtctg

SEQ ID NO: 5646329 - DNA, 21 bp, Homo sapiens
tctgcttttgcacaccttttc

SEQ ID NO: 5646330 - DNA, 13 bp, Homo sapiens
tctgcttttgcat

SEQ ID NO: 5646331 - DNA, 14 bp, Homo sapiens
tctgcttttgcatc

SEQ ID NO: 5646332 - DNA, 23 bp, Homo sapiens
tctgctttttaaagaatgctctt

SEQ ID NO: 5646333 - DNA, 21 bp, Homo sapiens
tctgcttttttggctgctctt

SEQ ID NO: 5646334 - DNA, 19 bp, Homo sapiens
tctggaaaaaaaaaaatat

SEQ ID NO: 5646335 - DNA, 23 bp, Homo sapiens
tctggaaaaaaacaaaaacagaa

SEQ ID NO: 5646336 - DNA, 17 bp, Homo sapiens
tctggaaaacctgaggc

SEQ ID NO: 5646337 - DNA, 15 bp, Homo sapiens
tctggaaaactcagg

SEQ ID NO: 5646338 - DNA, 20 bp, Homo sapiens
tctggaaacctctacatatt

SEQ ID NO: 5646339 - DNA, 14 bp, Homo sapiens
tctggaaagcaaag

SEQ ID NO: 5646340 - DNA, 9 bp, Homo sapiens
tctggaaat

SEQ ID NO: 5646341 - DNA, 14 bp, Homo sapiens
tctggaaataaaga

SEQ ID NO: 5646342 - DNA, 12 bp, Homo sapiens
tctggaaatctg

SEQ ID NO: 5646343 - DNA, 13 bp, Homo sapiens
tctggaaatctgt

SEQ ID NO: 5646344 - DNA, 15 bp, Homo sapiens
tctggaaatgttctt

SEQ ID NO: 5646345 - DNA, 17 bp, Homo sapiens
tctggaaattcttccct

SEQ ID NO: 5646346 - DNA, 20 bp, Homo sapiens
tctggaaattcttccctggg

SEQ ID NO: 5646347 - DNA, 19 bp, Homo sapiens
tctggaaatttagagttct

SEQ ID NO: 5646348 - DNA, 23 bp, Homo sapiens
tctggaacatggactttcttgca

SEQ ID NO: 5646349 - DNA, 19 bp, Homo sapiens
tctggaaccatcctctgtt

SEQ ID NO: 5646350 - DNA, 13 bp, Homo sapiens
tctggaacccaga

SEQ ID NO: 5646351 - DNA, 16 bp, Homo sapiens
tctggaacccagactc

SEQ ID NO: 5646352 - DNA, 22 bp, Homo sapiens
tctggaacccagactcagacat

SEQ ID NO: 5646353 - DNA, 23 bp, Homo sapiens
tctggaacccagactcagacatt

SEQ ID NO: 5646354 - DNA, 18 bp, Homo sapiens
tctggaaccccccaggcc

SEQ ID NO: 5646355 - DNA, 20 bp, Homo sapiens
tctggaaccccccaggccct

SEQ ID NO: 5646356 - DNA, 15 bp, Homo sapiens
tctggaacctcagcc

SEQ ID NO: 5646357 - DNA, 17 bp, Homo sapiens
tctggaacctcagcctg

SEQ ID NO: 5646358 - DNA, 20 bp, Homo sapiens
tctggaacctcagcctggcc

SEQ ID NO: 5646359 - DNA, 21 bp, Homo sapiens
tctggaacctcagcctggcca

SEQ ID NO: 5646360 - DNA, 23 bp, Homo sapiens
tctggaacctcagcctggccaga

SEQ ID NO: 5646361 - DNA, 14 bp, Homo sapiens
tctggaacctgact

SEQ ID NO: 5646362 - DNA, 18 bp, Homo sapiens
tctggaactgctgctgac

SEQ ID NO: 5646363 - DNA, 19 bp, Homo sapiens
tctggaactgctgctgacc

SEQ ID NO: 5646364 - DNA, 21 bp, Homo sapiens
tctggaagaaagccctgtgct

SEQ ID NO: 5646365 - DNA, 22 bp, Homo sapiens
tctggaagaaagccctgtgctt

SEQ ID NO: 5646366 - DNA, 16 bp, Homo sapiens
tctggaagaagcagcg

SEQ ID NO: 5646367 - DNA, 20 bp, Homo sapiens
tctggaagaggccttcccat

SEQ ID NO: 5646368 - DNA, 14 bp, Homo sapiens
tctggaagagggag

SEQ ID NO: 5646369 - DNA, 22 bp, Homo sapiens
tctggaagagggaggggccctg

SEQ ID NO: 5646370 - DNA, 15 bp, Homo sapiens
tctggaagatgggga

SEQ ID NO: 5646371 - DNA, 13 bp, Homo sapiens
tctggaaggaatg

SEQ ID NO: 5646372 - DNA, 14 bp, Homo sapiens
tctggaaggctggc

SEQ ID NO: 5646373 - DNA, 18 bp, Homo sapiens
tctggaaggctggctgag

SEQ ID NO: 5646374 - DNA, 21 bp, Homo sapiens
tctggaagggcactatatttt

SEQ ID NO: 5646375 - DNA, 13 bp, Homo sapiens
tctggaagggcca

SEQ ID NO: 5646376 - DNA, 19 bp, Homo sapiens
tctggaagtattttcctcc

SEQ ID NO: 5646377 - DNA, 20 bp, Homo sapiens
tctggaagtccccgggagcc

SEQ ID NO: 5646378 - DNA, 19 bp, Homo sapiens
tctggaagtgactttggct

SEQ ID NO: 5646379 - DNA, 16 bp, Homo sapiens
tctggaagtttctggt

SEQ ID NO: 5646380 - DNA, 20 bp, Homo sapiens
tctggaagttttctagcaac

SEQ ID NO: 5646381 - DNA, 18 bp, Homo sapiens
tctggaataaagttgcag

SEQ ID NO: 5646382 - DNA, 14 bp, Homo sapiens
tctggaatactgaa

SEQ ID NO: 5646383 - DNA, 20 bp, Homo sapiens
tctggaatattgtgattctg

SEQ ID NO: 5646384 - DNA, 13 bp, Homo sapiens
tctggaatcttcc

SEQ ID NO: 5646385 - DNA, 14 bp, Homo sapiens
tctggaatgagcct

SEQ ID NO: 5646386 - DNA, 21 bp, Homo sapiens
tctggaatgccagtttgacct

SEQ ID NO: 5646387 - DNA, 16 bp, Homo sapiens
tctggaatgtaatcaa

SEQ ID NO: 5646388 - DNA, 18 bp, Homo sapiens
tctggaatgtttttccct

SEQ ID NO: 5646389 - DNA, 23 bp, Homo sapiens
tctggaatgtttttccctcccca

SEQ ID NO: 5646390 - DNA, 19 bp, Homo sapiens
tctggaattgatgtttaca

SEQ ID NO: 5646391 - DNA, 16 bp, Homo sapiens
tctggaattgttgaat

SEQ ID NO: 5646392 - DNA, 17 bp, Homo sapiens
tctggaattgttgaatg

SEQ ID NO: 5646393 - DNA, 14 bp, Homo sapiens
tctggaatttgaaa

SEQ ID NO: 5646394 - DNA, 16 bp, Homo sapiens
tctggacaagaagagt

SEQ ID NO: 5646395 - DNA, 21 bp, Homo sapiens
tctggacaagccaacttgtaa

SEQ ID NO: 5646396 - DNA, 23 bp, Homo sapiens
tctggacaagccaacttgtaaat

SEQ ID NO: 5646397 - DNA, 16 bp, Homo sapiens
tctggacacttcttta

SEQ ID NO: 5646398 - DNA, 18 bp, Homo sapiens
tctggacagatggacgca

SEQ ID NO: 5646399 - DNA, 17 bp, Homo sapiens
tctggacagccagtgac

SEQ ID NO: 5646400 - DNA, 14 bp, Homo sapiens
tctggacaggctct

SEQ ID NO: 5646401 - DNA, 20 bp, Homo sapiens
tctggacaggctctgcttct

SEQ ID NO: 5646402 - DNA, 15 bp, Homo sapiens
tctggacagtacctg

SEQ ID NO: 5646403 - DNA, 20 bp, Homo sapiens
tctggacatgaattaaagta

SEQ ID NO: 5646404 - DNA, 22 bp, Homo sapiens
tctggaccaaccctgtttcctg

SEQ ID NO: 5646405 - DNA, 17 bp, Homo sapiens
tctggaccaaggagcat

SEQ ID NO: 5646406 - DNA, 18 bp, Homo sapiens
tctggaccaaggagcatc

SEQ ID NO: 5646407 - DNA, 20 bp, Homo sapiens
tctggaccaaggtgaagcaa

SEQ ID NO: 5646408 - DNA, 17 bp, Homo sapiens
tctggaccatgctgaga

SEQ ID NO: 5646409 - DNA, 17 bp, Homo sapiens
tctggaccccaggccat

SEQ ID NO: 5646410 - DNA, 14 bp, Homo sapiens
tctggaccccatct

SEQ ID NO: 5646411 - DNA, 19 bp, Homo sapiens
tctggaccccatctgtgaa

SEQ ID NO: 5646412 - DNA, 23 bp, Homo sapiens
tctggaccccatctgtgaataag

SEQ ID NO: 5646413 - DNA, 21 bp, Homo sapiens
tctggaccccgtttcattttt

SEQ ID NO: 5646414 - DNA, 13 bp, Homo sapiens
tctggacctcagg

SEQ ID NO: 5646415 - DNA, 17 bp, Homo sapiens
tctggtcagagccacag

SEQ ID NO: 5646416 - DNA, 18 bp, Homo sapiens
tctggtcagagccacagg

SEQ ID NO: 5646417 - DNA, 13 bp, Homo sapiens
tctggtcaggcaa

SEQ ID NO: 5646418 - DNA, 21 bp, Homo sapiens
tctggtcaggcccactgcaga

SEQ ID NO: 5646419 - DNA, 22 bp, Homo sapiens
tctggtccacacaccacagaag

SEQ ID NO: 5646420 - DNA, 18 bp, Homo sapiens
tctggtccatatttacat

SEQ ID NO: 5646421 - DNA, 16 bp, Homo sapiens
tctggtcccctctctt

SEQ ID NO: 5646422 - DNA, 21 bp, Homo sapiens
tctggtcctaccaatggattc

SEQ ID NO: 5646423 - DNA, 13 bp, Homo sapiens
tctggtcctaccc

SEQ ID NO: 5646424 - DNA, 12 bp, Homo sapiens
tctggtcctcgg

SEQ ID NO: 5646425 - DNA, 11 bp, Homo sapiens
tctggtccttc

SEQ ID NO: 5646426 - DNA, 22 bp, Homo sapiens
tctggtctaaattgtgttacta

SEQ ID NO: 5646427 - DNA, 21 bp, Homo sapiens
tctggtctaatttattaatct

SEQ ID NO: 5646428 - DNA, 21 bp, Homo sapiens
tctggtctcgtgttcgctggc

SEQ ID NO: 5646429 - DNA, 17 bp, Homo sapiens
tctggtctctaggctgg

SEQ ID NO: 5646430 - DNA, 19 bp, Homo sapiens
tctggtctctaggctgggg

SEQ ID NO: 5646431 - DNA, 16 bp, Homo sapiens
tctggtgactttcctc

SEQ ID NO: 5646432 - DNA, 23 bp, Homo sapiens
tctggtgagatacccagagagaa

SEQ ID NO: 5646433 - DNA, 12 bp, Homo sapiens
tctggtgcacgc

SEQ ID NO: 5646434 - DNA, 15 bp, Homo sapiens
tctggtgcagaatat

SEQ ID NO: 5646435 - DNA, 20 bp, Homo sapiens
tctggtgccaatcctgtagg

SEQ ID NO: 5646436 - DNA, 23 bp, Homo sapiens
tctggtgccagatcctcttctca

SEQ ID NO: 5646437 - DNA, 23 bp, Homo sapiens
tctggtgccctggtggcctgccc

SEQ ID NO: 5646438 - DNA, 12 bp, Homo sapiens
tctggtgcctcc

SEQ ID NO: 5646439 - DNA, 13 bp, Homo sapiens
tctggtgcctcca

SEQ ID NO: 5646440 - DNA, 12 bp, Homo sapiens
tctggtgccttt

SEQ ID NO: 5646441 - DNA, 19 bp, Homo sapiens
tctggtgcgtgtggccctg

SEQ ID NO: 5646442 - DNA, 22 bp, Homo sapiens
tctggtgcgtgtggccctgtgg

SEQ ID NO: 5646443 - DNA, 16 bp, Homo sapiens
tctggtgctactccat

SEQ ID NO: 5646444 - DNA, 19 bp, Homo sapiens
tctggtgctactccatgca

SEQ ID NO: 5646445 - DNA, 12 bp, Homo sapiens
tctggtgctgag

SEQ ID NO: 5646446 - DNA, 12 bp, Homo sapiens
tctggtgcttta

SEQ ID NO: 5646447 - DNA, 18 bp, Homo sapiens
tctggtggccactgagct

SEQ ID NO: 5646448 - DNA, 21 bp, Homo sapiens
tctggtggccgatcggggcac

SEQ ID NO: 5646449 - DNA, 13 bp, Homo sapiens
tctggtggctcct

SEQ ID NO: 5646450 - DNA, 15 bp, Homo sapiens
tctggtggctcctcc

SEQ ID NO: 5646451 - DNA, 17 bp, Homo sapiens
tctggtggctcctccta

SEQ ID NO: 5646452 - DNA, 17 bp, Homo sapiens
tctggtggctgggctgc

SEQ ID NO: 5646453 - DNA, 18 bp, Homo sapiens
tctggtggggctgtcctg

SEQ ID NO: 5646454 - DNA, 16 bp, Homo sapiens
tctggtggtctgttgg

SEQ ID NO: 5646455 - DNA, 15 bp, Homo sapiens
tctggtggtcttcct

SEQ ID NO: 5646456 - DNA, 14 bp, Homo sapiens
tctggtggtgctgg

SEQ ID NO: 5646457 - DNA, 16 bp, Homo sapiens
tctggtggtttgattg

SEQ ID NO: 5646458 - DNA, 15 bp, Homo sapiens
tctggtgtaaaagta

SEQ ID NO: 5646459 - DNA, 18 bp, Homo sapiens
tctggtgtagctcctctg

SEQ ID NO: 5646460 - DNA, 17 bp, Homo sapiens
tctggtgtgtggtgagg

SEQ ID NO: 5646461 - DNA, 17 bp, Homo sapiens
tctggtgttacacatac

SEQ ID NO: 5646462 - DNA, 13 bp, Homo sapiens
tctggtgtttaca

SEQ ID NO: 5646463 - DNA, 20 bp, Homo sapiens
tctggtgtttggtttcttca

SEQ ID NO: 5646464 - DNA, 15 bp, Homo sapiens
tctggtgtttgtcat

SEQ ID NO: 5646465 - DNA, 16 bp, Homo sapiens
tctggtgtttgtcatg

SEQ ID NO: 5646466 - DNA, 13 bp, Homo sapiens
tctggttaaaaaa

SEQ ID NO: 5646467 - DNA, 14 bp, Homo sapiens
tctggttaatttat

SEQ ID NO: 5646468 - DNA, 22 bp, Homo sapiens
tctggttagctcagccccagcc

SEQ ID NO: 5646469 - DNA, 16 bp, Homo sapiens
tctggttaggtgtgtc

SEQ ID NO: 5646470 - DNA, 16 bp, Homo sapiens
tctggttagttaaaag

SEQ ID NO: 5646471 - DNA, 14 bp, Homo sapiens
tctggttatatcat

SEQ ID NO: 5646472 - DNA, 16 bp, Homo sapiens
tctggttatatcattc

SEQ ID NO: 5646473 - DNA, 15 bp, Homo sapiens
tctggttatcctgta

SEQ ID NO: 5646474 - DNA, 20 bp, Homo sapiens
tctggttatttttctcttgt

SEQ ID NO: 5646475 - DNA, 14 bp, Homo sapiens
tctggttcatgcag

SEQ ID NO: 5646476 - DNA, 12 bp, Homo sapiens
tctggttccaaa

SEQ ID NO: 5646477 - DNA, 14 bp, Homo sapiens
tctggttccactca

SEQ ID NO: 5646478 - DNA, 23 bp, Homo sapiens
tctggttccactcagcttggttc

SEQ ID NO: 5646479 - DNA, 12 bp, Homo sapiens
tctggttccagg

SEQ ID NO: 5646480 - DNA, 15 bp, Homo sapiens
tctggttccctgctg

SEQ ID NO: 5646481 - DNA, 16 bp, Homo sapiens
tctggttccctgctgc

SEQ ID NO: 5646482 - DNA, 13 bp, Homo sapiens
tctggttcctccc

SEQ ID NO: 5646483 - DNA, 14 bp, Homo sapiens
tctggttctcaatt

SEQ ID NO: 5646484 - DNA, 19 bp, Homo sapiens
tctggttctcaattccaac

SEQ ID NO: 5646485 - DNA, 21 bp, Homo sapiens
tctggttgaagctttgcttat

SEQ ID NO: 5646486 - DNA, 16 bp, Homo sapiens
tctggttgatttgtaa

SEQ ID NO: 5646487 - DNA, 12 bp, Homo sapiens
tctggttgcctc

SEQ ID NO: 5646488 - DNA, 14 bp, Homo sapiens
tctggttgcctccc

SEQ ID NO: 5646489 - DNA, 17 bp, Homo sapiens
tctggttgtatttctat

SEQ ID NO: 5646490 - DNA, 20 bp, Homo sapiens
tctggttgtatttctatatt

SEQ ID NO: 5646491 - DNA, 16 bp, Homo sapiens
tctggttgtctagtca

SEQ ID NO: 5646492 - DNA, 15 bp, Homo sapiens
tctggttgtttctgt

SEQ ID NO: 5646493 - DNA, 17 bp, Homo sapiens
tctggttgtttctgttc

SEQ ID NO: 5646494 - DNA, 15 bp, Homo sapiens
tctggtttcaccgag

SEQ ID NO: 5646495 - DNA, 14 bp, Homo sapiens
tctggtttctcatt

SEQ ID NO: 5646496 - DNA, 16 bp, Homo sapiens
tctggtttctcattct

SEQ ID NO: 5646497 - DNA, 17 bp, Homo sapiens
tctggtttctgtgtgtc

SEQ ID NO: 5646498 - DNA, 22 bp, Homo sapiens
tctggtttgactccgctggagg

SEQ ID NO: 5646499 - DNA, 15 bp, Homo sapiens
tctggttttaacaat

SEQ ID NO: 5646500 - DNA, 23 bp, Homo sapiens
tctggttttcttgccaccctctg

SEQ ID NO: 5646501 - DNA, 15 bp, Homo sapiens
tctggttttgctatt

SEQ ID NO: 5646502 - DNA, 23 bp, Homo sapiens
tctgtaaaaaagaaaaacaagtt

SEQ ID NO: 5646503 - DNA, 19 bp, Homo sapiens
tctgtaaaaaatggagctc

SEQ ID NO: 5646504 - DNA, 20 bp, Homo sapiens
tctgtaaaaaatggagctca

SEQ ID NO: 5646505 - DNA, 14 bp, Homo sapiens
tctgtaaaaaatgt

SEQ ID NO: 5646506 - DNA, 19 bp, Homo sapiens
tctgtaaaaacactgaaaa

SEQ ID NO: 5646507 - DNA, 18 bp, Homo sapiens
tctgtaaaaagcaggtga

SEQ ID NO: 5646508 - DNA, 14 bp, Homo sapiens
tctgtaaaactaag

SEQ ID NO: 5646509 - DNA, 13 bp, Homo sapiens
tctgtaaaataca

SEQ ID NO: 5646510 - DNA, 22 bp, Homo sapiens
tctgtaaaatagtctcattgcc

SEQ ID NO: 5646511 - DNA, 17 bp, Homo sapiens
tctgtaaaatctttctt

SEQ ID NO: 5646512 - DNA, 13 bp, Homo sapiens
tctgtaaactttt

SEQ ID NO: 5646513 - DNA, 15 bp, Homo sapiens
tctgtaaagaaaacc

SEQ ID NO: 5646514 - DNA, 13 bp, Homo sapiens
tctgtaaagccag

SEQ ID NO: 5646515 - DNA, 13 bp, Homo sapiens
tctgtaaataacc

SEQ ID NO: 5646516 - DNA, 21 bp, Homo sapiens
tctgtaaataccattgacaca

SEQ ID NO: 5646517 - DNA, 23 bp, Homo sapiens
tctgtaaatatcccagagaacaa

SEQ ID NO: 5646518 - DNA, 13 bp, Homo sapiens
tctgtaaatttaa

SEQ ID NO: 5646519 - DNA, 21 bp, Homo sapiens
tctgtaacatcgcacagttta

SEQ ID NO: 5646520 - DNA, 23 bp, Homo sapiens
tctgtaacatcgcacagtttacc

SEQ ID NO: 5646521 - DNA, 16 bp, Homo sapiens
tctgtaaccacctctc

SEQ ID NO: 5646522 - DNA, 20 bp, Homo sapiens
tctgtaaccacctctctgtc

SEQ ID NO: 5646523 - DNA, 13 bp, Homo sapiens
tctgtaacccttg

SEQ ID NO: 5646524 - DNA, 17 bp, Homo sapiens
tctgtaactattgggtg

SEQ ID NO: 5646525 - DNA, 21 bp, Homo sapiens
tctgtaactgcccagcccctt

SEQ ID NO: 5646526 - DNA, 18 bp, Homo sapiens
tctgtaacttacacctgg

SEQ ID NO: 5646527 - DNA, 14 bp, Homo sapiens
tctgtaagaaactg

SEQ ID NO: 5646528 - DNA, 15 bp, Homo sapiens
tctgtaagaaactgc

SEQ ID NO: 5646529 - DNA, 21 bp, Homo sapiens
tctgtaagattttattttcaa

SEQ ID NO: 5646530 - DNA, 14 bp, Homo sapiens
tctgtaaggaactg

SEQ ID NO: 5646531 - DNA, 16 bp, Homo sapiens
tctgtaaggaactgga

SEQ ID NO: 5646532 - DNA, 20 bp, Homo sapiens
tctgtaagtaattgccacag

SEQ ID NO: 5646533 - DNA, 14 bp, Homo sapiens
tctgtaataaaact

SEQ ID NO: 5646534 - DNA, 17 bp, Homo sapiens
tctgtaataaaactgtt

SEQ ID NO: 5646535 - DNA, 15 bp, Homo sapiens
tctgtaataatagac

SEQ ID NO: 5646536 - DNA, 17 bp, Homo sapiens
tctgtaatagttcagta

SEQ ID NO: 5646537 - DNA, 23 bp, Homo sapiens
tctgtaatatattgccagtatat

SEQ ID NO: 5646538 - DNA, 13 bp, Homo sapiens
tctgtaatattta

SEQ ID NO: 5646539 - DNA, 19 bp, Homo sapiens
tctgtaatcaatatcccaa

SEQ ID NO: 5646540 - DNA, 21 bp, Homo sapiens
tctgtaatcacactctcttct

SEQ ID NO: 5646541 - DNA, 15 bp, Homo sapiens
tctgtaatcctagct

SEQ ID NO: 5646542 - DNA, 15 bp, Homo sapiens
tctgtaatctcgttt

SEQ ID NO: 5646543 - DNA, 19 bp, Homo sapiens
tctgtaatgatactgatta

SEQ ID NO: 5646544 - DNA, 21 bp, Homo sapiens
tctgtaatgtaaataaactat

SEQ ID NO: 5646545 - DNA, 18 bp, Homo sapiens
tctgtaattacaactaaa

SEQ ID NO: 5646546 - DNA, 18 bp, Homo sapiens
tctgtaattatatctaaa

SEQ ID NO: 5646547 - DNA, 18 bp, Homo sapiens
tctgtaattctattgtgc

SEQ ID NO: 5646548 - DNA, 18 bp, Homo sapiens
tctgtaattcttctcctt

SEQ ID NO: 5646549 - DNA, 14 bp, Homo sapiens
tctgtaattgcaaa

SEQ ID NO: 5646550 - DNA, 23 bp, Homo sapiens
tctgtaattggcttttgaatcaa

SEQ ID NO: 5646551 - DNA, 22 bp, Homo sapiens
tctgtacaaaatggtcctattt

SEQ ID NO: 5646552 - DNA, 21 bp, Homo sapiens
tctgtacagaatgctatttca

SEQ ID NO: 5646553 - DNA, 15 bp, Homo sapiens
tctgtacagagccca

SEQ ID NO: 5646554 - DNA, 23 bp, Homo sapiens
tctgtacagcaagatgtttcttg

SEQ ID NO: 5646555 - DNA, 16 bp, Homo sapiens
tctgtacatactggcc

SEQ ID NO: 5646556 - DNA, 20 bp, Homo sapiens
tctgtacatactggcctctg

SEQ ID NO: 5646557 - DNA, 21 bp, Homo sapiens
tctgtacatactggcctctgt

SEQ ID NO: 5646558 - DNA, 22 bp, Homo sapiens
tctgtacatactggcctctgtg

SEQ ID NO: 5646559 - DNA, 21 bp, Homo sapiens
tctgtacatactttttcaaga

SEQ ID NO: 5646560 - DNA, 14 bp, Homo sapiens
tctgtacatagcct

SEQ ID NO: 5646561 - DNA, 18 bp, Homo sapiens
tctgtacatagcctatat

SEQ ID NO: 5646562 - DNA, 12 bp, Homo sapiens
tctgtacatatt

SEQ ID NO: 5646563 - DNA, 17 bp, Homo sapiens
tctgtacatgttcttgt

SEQ ID NO: 5646564 - DNA, 21 bp, Homo sapiens
tctgtacattttgttgtaaaa

SEQ ID NO: 5646565 - DNA, 22 bp, Homo sapiens
tctgtacattttgttgtaaaaa

SEQ ID NO: 5646566 - DNA, 16 bp, Homo sapiens
tctgtaccatttattt

SEQ ID NO: 5646567 - DNA, 22 bp, Homo sapiens
tctgtaccgcccggcagcccct

SEQ ID NO: 5646568 - DNA, 12 bp, Homo sapiens
tctgtacctcaa

SEQ ID NO: 5646569 - DNA, 18 bp, Homo sapiens
tctgtaccttgcagccat

SEQ ID NO: 5646570 - DNA, 15 bp, Homo sapiens
tctgtacgggccagt

SEQ ID NO: 5646571 - DNA, 17 bp, Homo sapiens
tctgtactaaacatttc

SEQ ID NO: 5646572 - DNA, 22 bp, Homo sapiens
tctgtactccttggatttgcat

SEQ ID NO: 5646573 - DNA, 16 bp, Homo sapiens
tctgtactgaaagcaa

SEQ ID NO: 5646574 - DNA, 16 bp, Homo sapiens
tctgtactgattcaat

SEQ ID NO: 5646575 - DNA, 12 bp, Homo sapiens
tctgtacttcat

SEQ ID NO: 5646576 - DNA, 17 bp, Homo sapiens
tctgtactttttggcat

SEQ ID NO: 5646577 - DNA, 21 bp, Homo sapiens
tctgtacttttttcaaatatt

SEQ ID NO: 5646578 - DNA, 22 bp, Homo sapiens
tctgtacttttttcaaatattg

SEQ ID NO: 5646579 - DNA, 23 bp, Homo sapiens
tctgtacttttttcaaatattga

SEQ ID NO: 5646580 - DNA, 22 bp, Homo sapiens
tctgtagaaaagaaaacattta

SEQ ID NO: 5646581 - DNA, 21 bp, Homo sapiens
tctgtagaaatggttgtatta

SEQ ID NO: 5646582 - DNA, 13 bp, Homo sapiens
tctgtagaatctt

SEQ ID NO: 5646583 - DNA, 19 bp, Homo sapiens
tctgtagaatgctgtagaa

SEQ ID NO: 5646584 - DNA, 14 bp, Homo sapiens
tctgtagagccaat

SEQ ID NO: 5646585 - DNA, 20 bp, Homo sapiens
tctgtagaggagcctggagt

SEQ ID NO: 5646586 - DNA, 21 bp, Homo sapiens
tctgtagatgttgtcttggct

SEQ ID NO: 5646587 - DNA, 16 bp, Homo sapiens
tctgtagattctgtgg

SEQ ID NO: 5646588 - DNA, 20 bp, Homo sapiens
tctgtagcaaatttgtttaa

SEQ ID NO: 5646589 - DNA, 16 bp, Homo sapiens
tctgtagccaacttaa

SEQ ID NO: 5646590 - DNA, 13 bp, Homo sapiens
tctgtagccacct

SEQ ID NO: 5646591 - DNA, 16 bp, Homo sapiens
tctgtagcccaggcca

SEQ ID NO: 5646592 - DNA, 14 bp, Homo sapiens
tctgtagcctggtc

SEQ ID NO: 5646593 - DNA, 15 bp, Homo sapiens
tctgtagcctggtct

SEQ ID NO: 5646594 - DNA, 12 bp, Homo sapiens
tctgtgtggctc

SEQ ID NO: 5646595 - DNA, 13 bp, Homo sapiens
tctgtgtggctcc

SEQ ID NO: 5646596 - DNA, 14 bp, Homo sapiens
tctgtgtggctcct

SEQ ID NO: 5646597 - DNA, 20 bp, Homo sapiens
tctgtgtggtgcattcctga

SEQ ID NO: 5646598 - DNA, 19 bp, Homo sapiens
tctgtgtgtacatgtacat

SEQ ID NO: 5646599 - DNA, 13 bp, Homo sapiens
tctgtgtgtgaat

SEQ ID NO: 5646600 - DNA, 19 bp, Homo sapiens
tctgtgtgtgaattccttt

SEQ ID NO: 5646601 - DNA, 17 bp, Homo sapiens
tctgtgtgtgcctgtgt

SEQ ID NO: 5646602 - DNA, 18 bp, Homo sapiens
tctgtgtgtgcctgtgtg

SEQ ID NO: 5646603 - DNA, 13 bp, Homo sapiens
tctgtgtgtgtgt

SEQ ID NO: 5646604 - DNA, 15 bp, Homo sapiens
tctgtgtgtgtgtat

SEQ ID NO: 5646605 - DNA, 21 bp, Homo sapiens
tctgtgtgtgtgtatgtgggg

SEQ ID NO: 5646606 - DNA, 14 bp, Homo sapiens
tctgtgtgtgttct

SEQ ID NO: 5646607 - DNA, 13 bp, Homo sapiens
tctgtgtgttcct

SEQ ID NO: 5646608 - DNA, 14 bp, Homo sapiens
tctgtgtgttcctg

SEQ ID NO: 5646609 - DNA, 15 bp, Homo sapiens
tctgtgtgttcctgg

SEQ ID NO: 5646610 - DNA, 16 bp, Homo sapiens
tctgtgtgttcctggc

SEQ ID NO: 5646611 - DNA, 15 bp, Homo sapiens
tctgtgtgtttatgt

SEQ ID NO: 5646612 - DNA, 16 bp, Homo sapiens
tctgtgtgtttatgtg

SEQ ID NO: 5646613 - DNA, 19 bp, Homo sapiens
tctgtgtgtttatgtgtgt

SEQ ID NO: 5646614 - DNA, 23 bp, Homo sapiens
tctgtgttacaatcgttctgtgt

SEQ ID NO: 5646615 - DNA, 12 bp, Homo sapiens
tctgtgttcatt

SEQ ID NO: 5646616 - DNA, 13 bp, Homo sapiens
tctgtgttcattt

SEQ ID NO: 5646617 - DNA, 21 bp, Homo sapiens
tctgtgttgcattattcattt

SEQ ID NO: 5646618 - DNA, 14 bp, Homo sapiens
tctgtgttgccaag

SEQ ID NO: 5646619 - DNA, 13 bp, Homo sapiens
tctgtgttgctgt

SEQ ID NO: 5646620 - DNA, 17 bp, Homo sapiens
tctgtgttgctgtttag

SEQ ID NO: 5646621 - DNA, 18 bp, Homo sapiens
tctgtgttgctgtttaga

SEQ ID NO: 5646622 - DNA, 12 bp, Homo sapiens
tctgtgttgctt

SEQ ID NO: 5646623 - DNA, 21 bp, Homo sapiens
tctgtgttggcccaagctctt

SEQ ID NO: 5646624 - DNA, 22 bp, Homo sapiens
tctgtgtttaatttcttcaaaa

SEQ ID NO: 5646625 - DNA, 13 bp, Homo sapiens
tctgtgtttataa

SEQ ID NO: 5646626 - DNA, 23 bp, Homo sapiens
tctgtgtttatggccaatctatt

SEQ ID NO: 5646627 - DNA, 16 bp, Homo sapiens
tctgtgtttttgaaat

SEQ ID NO: 5646628 - DNA, 16 bp, Homo sapiens
tctgttaaaatcagga

SEQ ID NO: 5646629 - DNA, 14 bp, Homo sapiens
tctgttaaaatgca

SEQ ID NO: 5646630 - DNA, 14 bp, Homo sapiens
tctgttaaagatca

SEQ ID NO: 5646631 - DNA, 13 bp, Homo sapiens
tctgttaactgaa

SEQ ID NO: 5646632 - DNA, 20 bp, Homo sapiens
tctgttaactgaataccact

SEQ ID NO: 5646633 - DNA, 15 bp, Homo sapiens
tctgttaagaaagga

SEQ ID NO: 5646634 - DNA, 22 bp, Homo sapiens
tctgttaagatatgcacagtct

SEQ ID NO: 5646635 - DNA, 23 bp, Homo sapiens
tctgttaaggttgaactttgcca

SEQ ID NO: 5646636 - DNA, 13 bp, Homo sapiens
tctgttaatgctt

SEQ ID NO: 5646637 - DNA, 16 bp, Homo sapiens
tctgttaatgcttgct

SEQ ID NO: 5646638 - DNA, 13 bp, Homo sapiens
tctgttaatgtgg

SEQ ID NO: 5646639 - DNA, 12 bp, Homo sapiens
tctgttacaaaa

SEQ ID NO: 5646640 - DNA, 19 bp, Homo sapiens
tctgttacaaaatgtaact

SEQ ID NO: 5646641 - DNA, 15 bp, Homo sapiens
tctgttacacactaa

SEQ ID NO: 5646642 - DNA, 16 bp, Homo sapiens
tctgttacattctaag

SEQ ID NO: 5646643 - DNA, 14 bp, Homo sapiens
tctgttactccaaa

SEQ ID NO: 5646644 - DNA, 15 bp, Homo sapiens
tctgttactccaaaa

SEQ ID NO: 5646645 - DNA, 16 bp, Homo sapiens
tctgttactccaaaaa

SEQ ID NO: 5646646 - DNA, 13 bp, Homo sapiens
tctgttactgaaa

SEQ ID NO: 5646647 - DNA, 19 bp, Homo sapiens
tctgttactttgctatgtg

SEQ ID NO: 5646648 - DNA, 20 bp, Homo sapiens
tctgttagcagagtctgtct

SEQ ID NO: 5646649 - DNA, 21 bp, Homo sapiens
tctgttagcattattgccaaa

SEQ ID NO: 5646650 - DNA, 15 bp, Homo sapiens
tctgttagctgctca

SEQ ID NO: 5646651 - DNA, 16 bp, Homo sapiens
tctgttaggtccattt

SEQ ID NO: 5646652 - DNA, 20 bp, Homo sapiens
tctgttataccccatatatt

SEQ ID NO: 5646653 - DNA, 23 bp, Homo sapiens
tctgttataggtcctttagaaac

SEQ ID NO: 5646654 - DNA, 12 bp, Homo sapiens
tctgttatatga

SEQ ID NO: 5646655 - DNA, 20 bp, Homo sapiens
tctgttatcgaacacattca

SEQ ID NO: 5646656 - DNA, 21 bp, Homo sapiens
tctgttatgggcttttgggga

SEQ ID NO: 5646657 - DNA, 14 bp, Homo sapiens
tctgttatgtactg

SEQ ID NO: 5646658 - DNA, 18 bp, Homo sapiens
tctgttatgtactgtact

SEQ ID NO: 5646659 - DNA, 12 bp, Homo sapiens
tctgttatttat

SEQ ID NO: 5646660 - DNA, 23 bp, Homo sapiens
tctgttatttattattaatttat

SEQ ID NO: 5646661 - DNA, 17 bp, Homo sapiens
tctgttcaacctcagta

SEQ ID NO: 5646662 - DNA, 19 bp, Homo sapiens
tctgttcacaaactacctc

SEQ ID NO: 5646663 - DNA, 22 bp, Homo sapiens
tctgttcacttttcctccctca

SEQ ID NO: 5646664 - DNA, 13 bp, Homo sapiens
tctgttcagtgat

SEQ ID NO: 5646665 - DNA, 12 bp, Homo sapiens
tctgttcagtgt

SEQ ID NO: 5646666 - DNA, 16 bp, Homo sapiens
tctgttcagtgtaaat

SEQ ID NO: 5646667 - DNA, 17 bp, Homo sapiens
tctgttcagtgtaaata

SEQ ID NO: 5646668 - DNA, 22 bp, Homo sapiens
tctgttcatcaccagtctgtaa

SEQ ID NO: 5646669 - DNA, 12 bp, Homo sapiens
tctgttcatctc

SEQ ID NO: 5646670 - DNA, 13 bp, Homo sapiens
tctgttccaaatg

SEQ ID NO: 5646671 - DNA, 23 bp, Homo sapiens
tctgttccaaattcagtttcata

SEQ ID NO: 5646672 - DNA, 13 bp, Homo sapiens
tctgttccaacct

SEQ ID NO: 5646673 - DNA, 12 bp, Homo sapiens
tctgttccaagt

SEQ ID NO: 5646674 - DNA, 17 bp, Homo sapiens
tctgttccatagttaaa

SEQ ID NO: 5646675 - DNA, 19 bp, Homo sapiens
tctgttccatgcaactgga

SEQ ID NO: 5646676 - DNA, 13 bp, Homo sapiens
tctgttcccaagg

SEQ ID NO: 5646677 - DNA, 22 bp, Homo sapiens
tctgttcccaaggaagctcctt

SEQ ID NO: 5646678 - DNA, 22 bp, Homo sapiens
tctgttcccctgtcctgtgaat

SEQ ID NO: 5646679 - DNA, 23 bp, Homo sapiens
tctgttccctgctgggtgggaat

SEQ ID NO: 5646680 - DNA, 14 bp, Homo sapiens
tctgttccctgggc

SEQ ID NO: 5646681 - DNA, 13 bp, Homo sapiens
tctgttcctggct

SEQ ID NO: 5646682 - DNA, 20 bp, Homo sapiens
tctgttcctttctctgggct

SEQ ID NO: 5646683 - DNA, 18 bp, Homo sapiens
tctgttctaaaactccaa

SEQ ID NO: 5646684 - DNA, 22 bp, Homo sapiens
tctgttctacttgatatttcct

SEQ ID NO: 5646685 - DNA, 10 bp, Homo sapiens
tctgttctat

SEQ ID NO: 5646686 - DNA, 12 bp, Homo sapiens
tctgttctcaaa

SEQ ID NO: 5646687 - DNA, 21 bp, Homo sapiens
tctgttctcaaatgctaaatg

SEQ ID NO: 5646688 - DNA, 11 bp, Homo sapiens
tctgttctcac

SEQ ID NO: 5646689 - DNA, 12 bp, Homo sapiens
tctgttctcaca

SEQ ID NO: 5646690 - DNA, 11 bp, Homo sapiens
tctgttctctc

SEQ ID NO: 5646691 - DNA, 23 bp, Homo sapiens
tctgttctgatattaatttatca

SEQ ID NO: 5646692 - DNA, 18 bp, Homo sapiens
tctgttctgcacacagca

SEQ ID NO: 5646693 - DNA, 12 bp, Homo sapiens
tctgttctgctc

SEQ ID NO: 5646694 - DNA, 15 bp, Homo sapiens
tctgttctgctccca

SEQ ID NO: 5646695 - DNA, 16 bp, Homo sapiens
tctgttctgctcccag

SEQ ID NO: 5646696 - DNA, 22 bp, Homo sapiens
tctgttctgctcccagatgcct

SEQ ID NO: 5646697 - DNA, 14 bp, Homo sapiens
tctgttctgctggg

SEQ ID NO: 5646698 - DNA, 19 bp, Homo sapiens
tctgttctggtggccccag

SEQ ID NO: 5646699 - DNA, 15 bp, Homo sapiens
tctgttctgtggaaa

SEQ ID NO: 5646700 - DNA, 19 bp, Homo sapiens
tctgttctgtggaaagtgt

SEQ ID NO: 5646701 - DNA, 23 bp, Homo sapiens
tctgttctgtggaaagtgtaaag

SEQ ID NO: 5646702 - DNA, 23 bp, Homo sapiens
tctgttctgttgatcccacttca

SEQ ID NO: 5646703 - DNA, 17 bp, Homo sapiens
tctgttcttacaaatgt

SEQ ID NO: 5646704 - DNA, 14 bp, Homo sapiens
tctgttcttcattt

SEQ ID NO: 5646705 - DNA, 15 bp, Homo sapiens
tctgttcttcctcag

SEQ ID NO: 5646706 - DNA, 18 bp, Homo sapiens
tctgttcttcctcagcca

SEQ ID NO: 5646707 - DNA, 13 bp, Homo sapiens
tctgttcttgaag

SEQ ID NO: 5646708 - DNA, 13 bp, Homo sapiens
tctgttctttacc

SEQ ID NO: 5646709 - DNA, 20 bp, Homo sapiens
tctgttctttcatactacat

SEQ ID NO: 5646710 - DNA, 13 bp, Homo sapiens
tctgttctttcca

SEQ ID NO: 5646711 - DNA, 21 bp, Homo sapiens
tctgttgaaacttacactgtt

SEQ ID NO: 5646712 - DNA, 18 bp, Homo sapiens
tctgttgaagtgcatgtt

SEQ ID NO: 5646713 - DNA, 16 bp, Homo sapiens
tctgttgaccaggctg

SEQ ID NO: 5646714 - DNA, 23 bp, Homo sapiens
tctgttgagtgcaacaagagcaa

SEQ ID NO: 5646715 - DNA, 18 bp, Homo sapiens
tctgttgatcccacttca

SEQ ID NO: 5646716 - DNA, 23 bp, Homo sapiens
tctgttgatgttaactgagctac

SEQ ID NO: 5646717 - DNA, 19 bp, Homo sapiens
tctgttgccagtcagcaac

SEQ ID NO: 5646718 - DNA, 15 bp, Homo sapiens
tctgttgcccaggct

SEQ ID NO: 5646719 - DNA, 16 bp, Homo sapiens
tctgttgcccaggctg

SEQ ID NO: 5646720 - DNA, 15 bp, Homo sapiens
tctgttgcctcctct

SEQ ID NO: 5646721 - DNA, 23 bp, Homo sapiens
tctgttgcctcctctctccctgc

SEQ ID NO: 5646722 - DNA, 17 bp, Homo sapiens
tctgttgccttatttct

SEQ ID NO: 5646723 - DNA, 20 bp, Homo sapiens
tctgttgccttatttctcat

SEQ ID NO: 5646724 - DNA, 15 bp, Homo sapiens
tctgttgctgctcca

SEQ ID NO: 5646725 - DNA, 12 bp, Homo sapiens
tctgttggataa

SEQ ID NO: 5646726 - DNA, 16 bp, Homo sapiens
tctgttggattccatg

SEQ ID NO: 5646727 - DNA, 18 bp, Homo sapiens
tctgttggcaaatttgtg

SEQ ID NO: 5646728 - DNA, 19 bp, Homo sapiens
tctgttggccagtgtgaca

SEQ ID NO: 5646729 - DNA, 21 bp, Homo sapiens
tctgttggcctaagtgcctct

SEQ ID NO: 5646730 - DNA, 17 bp, Homo sapiens
tctgttggtccactgtg

SEQ ID NO: 5646731 - DNA, 21 bp, Homo sapiens
tctgttggtccactgtgttta

SEQ ID NO: 5646732 - DNA, 16 bp, Homo sapiens
tctgttggtctgcctt

SEQ ID NO: 5646733 - DNA, 23 bp, Homo sapiens
tctgttggtctgccttctgctga

SEQ ID NO: 5646734 - DNA, 21 bp, Homo sapiens
tctgttggtgccacgctttga

SEQ ID NO: 5646735 - DNA, 14 bp, Homo sapiens
tctgttggttagta

SEQ ID NO: 5646736 - DNA, 14 bp, Homo sapiens
tctgttgtaaataa

SEQ ID NO: 5646737 - DNA, 11 bp, Homo sapiens
tctgttgtaac

SEQ ID NO: 5646738 - DNA, 13 bp, Homo sapiens
tctgttgtaactt

SEQ ID NO: 5646739 - DNA, 14 bp, Homo sapiens
tctgttgtcattgc

SEQ ID NO: 5646740 - DNA, 17 bp, Homo sapiens
tctgttgtcctcccctt

SEQ ID NO: 5646741 - DNA, 21 bp, Homo sapiens
tctgttgtcctccccttgggc

SEQ ID NO: 5646742 - DNA, 16 bp, Homo sapiens
tctgttgtctagagct

SEQ ID NO: 5646743 - DNA, 22 bp, Homo sapiens
tctgttgtggaaagtagctgct

SEQ ID NO: 5646744 - DNA, 21 bp, Homo sapiens
tctgttgttcagtcctctgca

SEQ ID NO: 5646745 - DNA, 20 bp, Homo sapiens
tctgttgtttggttcaggga

SEQ ID NO: 5646746 - DNA, 13 bp, Homo sapiens
tctgttgttttgt

SEQ ID NO: 5646747 - DNA, 17 bp, Homo sapiens
tctgttgttttgtgtat

SEQ ID NO: 5646748 - DNA, 18 bp, Homo sapiens
tctgtttaaaatttgtgc

SEQ ID NO: 5646749 - DNA, 17 bp, Homo sapiens
tctgtttaaagtagatt

SEQ ID NO: 5646750 - DNA, 13 bp, Homo sapiens
tctgtttaaagtg

SEQ ID NO: 5646751 - DNA, 17 bp, Homo sapiens
tctgtttaatactcatc

SEQ ID NO: 5646752 - DNA, 18 bp, Homo sapiens
tctgtttacatccagagt

SEQ ID NO: 5646753 - DNA, 16 bp, Homo sapiens
tctgtttaccctccct

SEQ ID NO: 5646754 - DNA, 23 bp, Homo sapiens
tctgtttagcgaacttgtatact

SEQ ID NO: 5646755 - DNA, 14 bp, Homo sapiens
tctgtttaggaaga

SEQ ID NO: 5646756 - DNA, 21 bp, Homo sapiens
tctgtttataatgaagaacac

SEQ ID NO: 5646757 - DNA, 16 bp, Homo sapiens
tctgtttattatgaca

SEQ ID NO: 5646758 - DNA, 15 bp, Homo sapiens
tctgtttcaaactga

SEQ ID NO: 5646759 - DNA, 12 bp, Homo sapiens
tctgtttcaagg

SEQ ID NO: 5646760 - DNA, 20 bp, Homo sapiens
tctgtttcagagcataaaac

SEQ ID NO: 5646761 - DNA, 22 bp, Homo sapiens
tctgtttcaggtttccattctg

SEQ ID NO: 5646762 - DNA, 13 bp, Homo sapiens
tctgtttcccaag

SEQ ID NO: 5646763 - DNA, 20 bp, Homo sapiens
tctgtttcccctcagaacac

SEQ ID NO: 5646764 - DNA, 20 bp, Homo sapiens
tctgtttcctgacattgtct

SEQ ID NO: 5646765 - DNA, 21 bp, Homo sapiens
tctgtttcctggcctcagagc

SEQ ID NO: 5646766 - DNA, 22 bp, Homo sapiens
tctgtttcctggcctcagagct

SEQ ID NO: 5646767 - DNA, 13 bp, Homo sapiens
tctgtttcctgtg

SEQ ID NO: 5646768 - DNA, 17 bp, Homo sapiens
tctgtttcctgtgtctc

SEQ ID NO: 5646769 - DNA, 17 bp, Homo sapiens
tctgtttcctgttctct

SEQ ID NO: 5646770 - DNA, 12 bp, Homo sapiens
tctgtttctagt

SEQ ID NO: 5646771 - DNA, 22 bp, Homo sapiens
tctgtttctattctctcctcag

SEQ ID NO: 5646772 - DNA, 17 bp, Homo sapiens
tctgtttctctgctgtc

SEQ ID NO: 5646773 - DNA, 16 bp, Homo sapiens
tctgtttctctttcct

SEQ ID NO: 5646774 - DNA, 21 bp, Homo sapiens
tcttcaccccggcaggccctg

SEQ ID NO: 5646775 - DNA, 16 bp, Homo sapiens
tcttcacccgctgcag

SEQ ID NO: 5646776 - DNA, 12 bp, Homo sapiens
tcttcacctcag

SEQ ID NO: 5646777 - DNA, 21 bp, Homo sapiens
tcttcacctctattcttggga

SEQ ID NO: 5646778 - DNA, 15 bp, Homo sapiens
tcttcacctcttcca

SEQ ID NO: 5646779 - DNA, 23 bp, Homo sapiens
tcttcacctgattcaactaaaaa

SEQ ID NO: 5646780 - DNA, 16 bp, Homo sapiens
tcttcacctgttatgt

SEQ ID NO: 5646781 - DNA, 21 bp, Homo sapiens
tcttcacctttgtaagacatt

SEQ ID NO: 5646782 - DNA, 23 bp, Homo sapiens
tcttcacgacaatgttgagaagt

SEQ ID NO: 5646783 - DNA, 22 bp, Homo sapiens
tcttcacgcagagattttcatc

SEQ ID NO: 5646784 - DNA, 19 bp, Homo sapiens
tcttcactattcagaactt

SEQ ID NO: 5646785 - DNA, 17 bp, Homo sapiens
tcttcactcagccacac

SEQ ID NO: 5646786 - DNA, 14 bp, Homo sapiens
tcttcactccccct

SEQ ID NO: 5646787 - DNA, 14 bp, Homo sapiens
tcttcactcttagg

SEQ ID NO: 5646788 - DNA, 18 bp, Homo sapiens
tcttcactcttcacttga

SEQ ID NO: 5646789 - DNA, 19 bp, Homo sapiens
tcttcactcttcacttgag

SEQ ID NO: 5646790 - DNA, 22 bp, Homo sapiens
tcttcactgcagatttctcacc

SEQ ID NO: 5646791 - DNA, 14 bp, Homo sapiens
tcttcactgcccag

SEQ ID NO: 5646792 - DNA, 13 bp, Homo sapiens
tcttcactggctt

SEQ ID NO: 5646793 - DNA, 13 bp, Homo sapiens
tcttcactgtata

SEQ ID NO: 5646794 - DNA, 16 bp, Homo sapiens
tcttcactgtggccac

SEQ ID NO: 5646795 - DNA, 15 bp, Homo sapiens
tcttcacttcctcca

SEQ ID NO: 5646796 - DNA, 23 bp, Homo sapiens
tcttcacttcctccagaagcctc

SEQ ID NO: 5646797 - DNA, 11 bp, Homo sapiens
tcttcactttc

SEQ ID NO: 5646798 - DNA, 15 bp, Homo sapiens
tcttcacttttgcaa

SEQ ID NO: 5646799 - DNA, 16 bp, Homo sapiens
tcttcacttttgcaag

SEQ ID NO: 5646800 - DNA, 20 bp, Homo sapiens
tcttcagaacacacagactt

SEQ ID NO: 5646801 - DNA, 21 bp, Homo sapiens
tcttcagaacacacagacttt

SEQ ID NO: 5646802 - DNA, 17 bp, Homo sapiens
tcttcagaactgccctt

SEQ ID NO: 5646803 - DNA, 19 bp, Homo sapiens
tcttcagaactgcccttgc

SEQ ID NO: 5646804 - DNA, 18 bp, Homo sapiens
tcttcagaagacactgca

SEQ ID NO: 5646805 - DNA, 13 bp, Homo sapiens
tcttcagacccag

SEQ ID NO: 5646806 - DNA, 20 bp, Homo sapiens
tcttcagacggagctgcgct

SEQ ID NO: 5646807 - DNA, 23 bp, Homo sapiens
tcttcagactctcagcccagaag

SEQ ID NO: 5646808 - DNA, 16 bp, Homo sapiens
tcttcagactgaggcc

SEQ ID NO: 5646809 - DNA, 18 bp, Homo sapiens
tcttcagactgaggcctt

SEQ ID NO: 5646810 - DNA, 14 bp, Homo sapiens
tcttcagagaaatc

SEQ ID NO: 5646811 - DNA, 12 bp, Homo sapiens
tcttcagagact

SEQ ID NO: 5646812 - DNA, 17 bp, Homo sapiens
tcttcagagactcctgc

SEQ ID NO: 5646813 - DNA, 14 bp, Homo sapiens
tcttcagaggccct

SEQ ID NO: 5646814 - DNA, 19 bp, Homo sapiens
tcttcagaggctcatctaa

SEQ ID NO: 5646815 - DNA, 14 bp, Homo sapiens
tcttcagatctcta

SEQ ID NO: 5646816 - DNA, 20 bp, Homo sapiens
tcttcagcagcgtgcaatag

SEQ ID NO: 5646817 - DNA, 16 bp, Homo sapiens
tcttcagccacctctc

SEQ ID NO: 5646818 - DNA, 17 bp, Homo sapiens
tcttcagcccaggcttt

SEQ ID NO: 5646819 - DNA, 16 bp, Homo sapiens
tcttcagccccttctc

SEQ ID NO: 5646820 - DNA, 19 bp, Homo sapiens
tcttcagccccttctcccc

SEQ ID NO: 5646821 - DNA, 12 bp, Homo sapiens
tcttcagctccc

SEQ ID NO: 5646822 - DNA, 14 bp, Homo sapiens
tcttcagctcccat

SEQ ID NO: 5646823 - DNA, 21 bp, Homo sapiens
tcttcagctgattgtttattt

SEQ ID NO: 5646824 - DNA, 17 bp, Homo sapiens
tcttcagctgctgacaa

SEQ ID NO: 5646825 - DNA, 23 bp, Homo sapiens
tcttcagctgtttcgcatccacc

SEQ ID NO: 5646826 - DNA, 15 bp, Homo sapiens
tcttcaggaaaataa

SEQ ID NO: 5646827 - DNA, 19 bp, Homo sapiens
tcttcaggagatgatgtga

SEQ ID NO: 5646828 - DNA, 15 bp, Homo sapiens
tcttcaggcctccct

SEQ ID NO: 5646829 - DNA, 12 bp, Homo sapiens
tcttcaggcctg

SEQ ID NO: 5646830 - DNA, 14 bp, Homo sapiens
tcttcaggcctgct

SEQ ID NO: 5646831 - DNA, 13 bp, Homo sapiens
tcttcagggcctg

SEQ ID NO: 5646832 - DNA, 22 bp, Homo sapiens
tcttcagggcctggttgaagaa

SEQ ID NO: 5646833 - DNA, 15 bp, Homo sapiens
tcttcagggggccag

SEQ ID NO: 5646834 - DNA, 22 bp, Homo sapiens
tcttcaggggtcacctcctcca

SEQ ID NO: 5646835 - DNA, 18 bp, Homo sapiens
tcttcaggtaacactaca

SEQ ID NO: 5646836 - DNA, 20 bp, Homo sapiens
tcttcaggtgaacacttagt

SEQ ID NO: 5646837 - DNA, 16 bp, Homo sapiens
tcttcagtcagaaaac

SEQ ID NO: 5646838 - DNA, 21 bp, Homo sapiens
tcttcagtcctttgtctttct

SEQ ID NO: 5646839 - DNA, 19 bp, Homo sapiens
tcttcagtctcacagagaa

SEQ ID NO: 5646840 - DNA, 20 bp, Homo sapiens
tcttcagtctcacagagaag

SEQ ID NO: 5646841 - DNA, 16 bp, Homo sapiens
tcttcagtgactcctg

SEQ ID NO: 5646842 - DNA, 17 bp, Homo sapiens
tcttcagtgactcctgc

SEQ ID NO: 5646843 - DNA, 23 bp, Homo sapiens
tcttcagtggaacacaaatgaaa

SEQ ID NO: 5646844 - DNA, 19 bp, Homo sapiens
tcttcagtgggagaaaaca

SEQ ID NO: 5646845 - DNA, 17 bp, Homo sapiens
tcttcagtgtaatgtga

SEQ ID NO: 5646846 - DNA, 14 bp, Homo sapiens
tcttcagtgtctct

SEQ ID NO: 5646847 - DNA, 15 bp, Homo sapiens
tcttcagtgtctctg

SEQ ID NO: 5646848 - DNA, 20 bp, Homo sapiens
tcttcagttaagcctttgga

SEQ ID NO: 5646849 - DNA, 15 bp, Homo sapiens
tcttcagttaattct

SEQ ID NO: 5646850 - DNA, 16 bp, Homo sapiens
tcttcagttaattctt

SEQ ID NO: 5646851 - DNA, 21 bp, Homo sapiens
tcttcagttctctactccctc

SEQ ID NO: 5646852 - DNA, 18 bp, Homo sapiens
tcttcagttggtgtgttt

SEQ ID NO: 5646853 - DNA, 15 bp, Homo sapiens
tcttcagttgtctct

SEQ ID NO: 5646854 - DNA, 17 bp, Homo sapiens
tcttcagttgtctctga

SEQ ID NO: 5646855 - DNA, 14 bp, Homo sapiens
tcttcagtttaatg

SEQ ID NO: 5646856 - DNA, 15 bp, Homo sapiens
tcttcagtttctgaa

SEQ ID NO: 5646857 - DNA, 12 bp, Homo sapiens
tcttcagtttta

SEQ ID NO: 5646858 - DNA, 15 bp, Homo sapiens
tcttcagtttttcac

SEQ ID NO: 5646859 - DNA, 18 bp, Homo sapiens
tcttcagtttttcacttc

SEQ ID NO: 5646860 - DNA, 20 bp, Homo sapiens
tcttcataacaattttagga

SEQ ID NO: 5646861 - DNA, 18 bp, Homo sapiens
tcttcatacctacatgta

SEQ ID NO: 5646862 - DNA, 13 bp, Homo sapiens
tcttcatactttt

SEQ ID NO: 5646863 - DNA, 14 bp, Homo sapiens
tcttcatataaact

SEQ ID NO: 5646864 - DNA, 16 bp, Homo sapiens
tcttcatataataaat

SEQ ID NO: 5646865 - DNA, 23 bp, Homo sapiens
tcttcatatcatcacaacattat

SEQ ID NO: 5646866 - DNA, 21 bp, Homo sapiens
tcttcatattctaaaaccatt

SEQ ID NO: 5646867 - DNA, 19 bp, Homo sapiens
tcttcatcacttcttccac

SEQ ID NO: 5646868 - DNA, 22 bp, Homo sapiens
tcttcatcacttcttccactgt

SEQ ID NO: 5646869 - DNA, 18 bp, Homo sapiens
tcttcatccaacttccaa

SEQ ID NO: 5646870 - DNA, 18 bp, Homo sapiens
tcttcatccatagacaca

SEQ ID NO: 5646871 - DNA, 20 bp, Homo sapiens
tcttcatccatagacacagt

SEQ ID NO: 5646872 - DNA, 15 bp, Homo sapiens
tcttcatcccactcc

SEQ ID NO: 5646873 - DNA, 18 bp, Homo sapiens
tcttcatccggcagcctg

SEQ ID NO: 5646874 - DNA, 19 bp, Homo sapiens
tcttcatccggcagcctgg

SEQ ID NO: 5646875 - DNA, 20 bp, Homo sapiens
tcttcatccggcagcctgga

SEQ ID NO: 5646876 - DNA, 15 bp, Homo sapiens
tcttcatccttagca

SEQ ID NO: 5646877 - DNA, 19 bp, Homo sapiens
tcttcatctgactatgaca

SEQ ID NO: 5646878 - DNA, 13 bp, Homo sapiens
tcttcatcttcac

SEQ ID NO: 5646879 - DNA, 14 bp, Homo sapiens
tcttcatgaaatgt

SEQ ID NO: 5646880 - DNA, 19 bp, Homo sapiens
tcttcatgcgtgccctttt

SEQ ID NO: 5646881 - DNA, 18 bp, Homo sapiens
tcttcatggaattcacaa

SEQ ID NO: 5646882 - DNA, 23 bp, Homo sapiens
tcttcatgtaaattgactgtact

SEQ ID NO: 5646883 - DNA, 23 bp, Homo sapiens
tcttcatgtctattccattccct

SEQ ID NO: 5646884 - DNA, 16 bp, Homo sapiens
tcttcatgtgcaaagt

SEQ ID NO: 5646885 - DNA, 18 bp, Homo sapiens
tcttcatgtgcaaagtga

SEQ ID NO: 5646886 - DNA, 17 bp, Homo sapiens
tcttcatgttcagtcac

SEQ ID NO: 5646887 - DNA, 23 bp, Homo sapiens
tcttcatgttgatgtgtccgtga

SEQ ID NO: 5646888 - DNA, 16 bp, Homo sapiens
tcttcatgtttcagga

SEQ ID NO: 5646889 - DNA, 17 bp, Homo sapiens
tcttcattcaaactgca

SEQ ID NO: 5646890 - DNA, 15 bp, Homo sapiens
tcttcattccattga

SEQ ID NO: 5646891 - DNA, 17 bp, Homo sapiens
tcttcattccattgact

SEQ ID NO: 5646892 - DNA, 16 bp, Homo sapiens
tcttcattcccactgc

SEQ ID NO: 5646893 - DNA, 20 bp, Homo sapiens
tcttcattctttactgcact

SEQ ID NO: 5646894 - DNA, 16 bp, Homo sapiens
tcttcattgcactgca

SEQ ID NO: 5646895 - DNA, 22 bp, Homo sapiens
tcttcatttcattgtatgatgt

SEQ ID NO: 5646896 - DNA, 13 bp, Homo sapiens
tcttcatttctct

SEQ ID NO: 5646897 - DNA, 16 bp, Homo sapiens
tcttcatttggaggaa

SEQ ID NO: 5646898 - DNA, 19 bp, Homo sapiens
tcttcattttgagtctcag

SEQ ID NO: 5646899 - DNA, 15 bp, Homo sapiens
tcttcattttggttt

SEQ ID NO: 5646900 - DNA, 22 bp, Homo sapiens
tcttcattttggtttatttttg

SEQ ID NO: 5646901 - DNA, 18 bp, Homo sapiens
tcttcattttttaatgtg

SEQ ID NO: 5646902 - DNA, 14 bp, Homo sapiens
tcttccaaagcaca

SEQ ID NO: 5646903 - DNA, 13 bp, Homo sapiens
tcttccaaagctc

SEQ ID NO: 5646904 - DNA, 16 bp, Homo sapiens
tcttccaaaggcagcg

SEQ ID NO: 5646905 - DNA, 20 bp, Homo sapiens
tcttccaaagtaaaattgct

SEQ ID NO: 5646906 - DNA, 21 bp, Homo sapiens
tcttccaaatgcagttcattg

SEQ ID NO: 5646907 - DNA, 21 bp, Homo sapiens
tcttccaacacatttcacttt

SEQ ID NO: 5646908 - DNA, 22 bp, Homo sapiens
tcttccaaccatttatcttgaa

SEQ ID NO: 5646909 - DNA, 18 bp, Homo sapiens
tcttccaaccccagctgg

SEQ ID NO: 5646910 - DNA, 22 bp, Homo sapiens
tcttccaaggtagctctaagtt

SEQ ID NO: 5646911 - DNA, 17 bp, Homo sapiens
tcttccaagttcattca

SEQ ID NO: 5646912 - DNA, 20 bp, Homo sapiens
tcttccaagttcattcatac

SEQ ID NO: 5646913 - DNA, 13 bp, Homo sapiens
tcttccaattatt

SEQ ID NO: 5646914 - DNA, 13 bp, Homo sapiens
tcttccacacatg

SEQ ID NO: 5646915 - DNA, 19 bp, Homo sapiens
tcttccacagcaaatgaga

SEQ ID NO: 5646916 - DNA, 15 bp, Homo sapiens
tcttccaccagagca

SEQ ID NO: 5646917 - DNA, 18 bp, Homo sapiens
tcttccacccacaaactc

SEQ ID NO: 5646918 - DNA, 21 bp, Homo sapiens
tcttccacctcagcctcccag

SEQ ID NO: 5646919 - DNA, 13 bp, Homo sapiens
tcttccacctgga

SEQ ID NO: 5646920 - DNA, 14 bp, Homo sapiens
tcttccactgcaaa

SEQ ID NO: 5646921 - DNA, 15 bp, Homo sapiens
tcttccactgtgtgt

SEQ ID NO: 5646922 - DNA, 22 bp, Homo sapiens
tcttccactgtgtgttgacact

SEQ ID NO: 5646923 - DNA, 18 bp, Homo sapiens
tcttccactttttccaga

SEQ ID NO: 5646924 - DNA, 21 bp, Homo sapiens
tcttccagaaagcaaggactg

SEQ ID NO: 5646925 - DNA, 21 bp, Homo sapiens
tcttccagaacctaggaggat

SEQ ID NO: 5646926 - DNA, 11 bp, Homo sapiens
tcttccagaag

SEQ ID NO: 5646927 - DNA, 13 bp, Homo sapiens
tcttccagaatgc

SEQ ID NO: 5646928 - DNA, 20 bp, Homo sapiens
tcttccagagcctaagaaaa

SEQ ID NO: 5646929 - DNA, 16 bp, Homo sapiens
tcttccagatgtgatg

SEQ ID NO: 5646930 - DNA, 11 bp, Homo sapiens
tcttccagcca

SEQ ID NO: 5646931 - DNA, 13 bp, Homo sapiens
tcttccagcccag

SEQ ID NO: 5646932 - DNA, 13 bp, Homo sapiens
tcttccagcttct

SEQ ID NO: 5646933 - DNA, 17 bp, Homo sapiens
tcttccagcttcttttg

SEQ ID NO: 5646934 - DNA, 12 bp, Homo sapiens
tcttccaggaag

SEQ ID NO: 5646935 - DNA, 13 bp, Homo sapiens
tcttccaggaagc

SEQ ID NO: 5646936 - DNA, 16 bp, Homo sapiens
tcttccaggaagcaca

SEQ ID NO: 5646937 - DNA, 16 bp, Homo sapiens
tcttccaggcccagtc

SEQ ID NO: 5646938 - DNA, 18 bp, Homo sapiens
tcttccagggcagcggct

SEQ ID NO: 5646939 - DNA, 14 bp, Homo sapiens
tcttccagggggaa

SEQ ID NO: 5646940 - DNA, 21 bp, Homo sapiens
tcttccaggtccaaacccttc

SEQ ID NO: 5646941 - DNA, 21 bp, Homo sapiens
tcttccaggtgcctggccctt

SEQ ID NO: 5646942 - DNA, 19 bp, Homo sapiens
tcttccaggtggggtgagg

SEQ ID NO: 5646943 - DNA, 21 bp, Homo sapiens
tcttccagtgaacattcccag

SEQ ID NO: 5646944 - DNA, 24 bp, Homo sapiens
tcttccagtgaggcatctctctgg

SEQ ID NO: 5646945 - DNA, 16 bp, Homo sapiens
tcttccagtgcaacaa

SEQ ID NO: 5646946 - DNA, 17 bp, Homo sapiens
tcttccagtttctgtaa

SEQ ID NO: 5646947 - DNA, 22 bp, Homo sapiens
tcttccagtttctgtaaggtct

SEQ ID NO: 5646948 - DNA, 22 bp, Homo sapiens
tcttccagtttgctttgccctt

SEQ ID NO: 5646949 - DNA, 12 bp, Homo sapiens
tcttccataatg

SEQ ID NO: 5646950 - DNA, 16 bp, Homo sapiens
tcttccataatgtata

SEQ ID NO: 5646951 - DNA, 23 bp, Homo sapiens
tcttccatatccgggtgctcaat

SEQ ID NO: 5646952 - DNA, 14 bp, Homo sapiens
tcttgactttctga

SEQ ID NO: 5646953 - DNA, 17 bp, Homo sapiens
tcttgactttttaaaaa

SEQ ID NO: 5646954 - DNA, 18 bp, Homo sapiens
tcttgactttttaaaaaa

SEQ ID NO: 5646955 - DNA, 20 bp, Homo sapiens
tcttgagaatttggatacac

SEQ ID NO: 5646956 - DNA, 15 bp, Homo sapiens
tcttgagagaaaaga

SEQ ID NO: 5646957 - DNA, 16 bp, Homo sapiens
tcttgagagaaaagaa

SEQ ID NO: 5646958 - DNA, 21 bp, Homo sapiens
tcttgagagaaacgtgaaacg

SEQ ID NO: 5646959 - DNA, 14 bp, Homo sapiens
tcttgagagcccca

SEQ ID NO: 5646960 - DNA, 18 bp, Homo sapiens
tcttgagagcgctggcct

SEQ ID NO: 5646961 - DNA, 19 bp, Homo sapiens
tcttgagagcgctggcctc

SEQ ID NO: 5646962 - DNA, 16 bp, Homo sapiens
tcttgagagtgttcct

SEQ ID NO: 5646963 - DNA, 20 bp, Homo sapiens
tcttgagagtgttcctgaga

SEQ ID NO: 5646964 - DNA, 19 bp, Homo sapiens
tcttgagataaggttttaa

SEQ ID NO: 5646965 - DNA, 14 bp, Homo sapiens
tcttgagatctgct

SEQ ID NO: 5646966 - DNA, 19 bp, Homo sapiens
tcttgagattttgtatatt

SEQ ID NO: 5646967 - DNA, 14 bp, Homo sapiens
tcttgagcaatgtt

SEQ ID NO: 5646968 - DNA, 20 bp, Homo sapiens
tcttgagcatcaatcttgtt

SEQ ID NO: 5646969 - DNA, 13 bp, Homo sapiens
tcttgagccagta

SEQ ID NO: 5646970 - DNA, 16 bp, Homo sapiens
tcttgagccttgaact

SEQ ID NO: 5646971 - DNA, 17 bp, Homo sapiens
tcttgagccttgaactt

SEQ ID NO: 5646972 - DNA, 20 bp, Homo sapiens
tcttgagccttgaactttga

SEQ ID NO: 5646973 - DNA, 13 bp, Homo sapiens
tcttgagctggcc

SEQ ID NO: 5646974 - DNA, 20 bp, Homo sapiens
tcttgaggaagcccaggctc

SEQ ID NO: 5646975 - DNA, 22 bp, Homo sapiens
tcttgaggagagagacagagag

SEQ ID NO: 5646976 - DNA, 16 bp, Homo sapiens
tcttgaggcagggtct

SEQ ID NO: 5646977 - DNA, 15 bp, Homo sapiens
tcttgaggggaagct

SEQ ID NO: 5646978 - DNA, 20 bp, Homo sapiens
tcttgaggggaagctgccac

SEQ ID NO: 5646979 - DNA, 17 bp, Homo sapiens
tcttgaggggaccagga

SEQ ID NO: 5646980 - DNA, 19 bp, Homo sapiens
tcttgaggggaccaggagt

SEQ ID NO: 5646981 - DNA, 20 bp, Homo sapiens
tcttgagggtcattttcctt

SEQ ID NO: 5646982 - DNA, 22 bp, Homo sapiens
tcttgaggtggtagtaaaacac

SEQ ID NO: 5646983 - DNA, 19 bp, Homo sapiens
tcttgagtataagaaatgc

SEQ ID NO: 5646984 - DNA, 21 bp, Homo sapiens
tcttgagtataagaaatgcat

SEQ ID NO: 5646985 - DNA, 21 bp, Homo sapiens
tcttgagtcaaaaaacatgag

SEQ ID NO: 5646986 - DNA, 19 bp, Homo sapiens
tcttgagtcatggatttct

SEQ ID NO: 5646987 - DNA, 18 bp, Homo sapiens
tcttgagtgggccccctc

SEQ ID NO: 5646988 - DNA, 21 bp, Homo sapiens
tcttgagtgggccccctctct

SEQ ID NO: 5646989 - DNA, 17 bp, Homo sapiens
tcttgagttcctctgca

SEQ ID NO: 5646990 - DNA, 19 bp, Homo sapiens
tcttgagttcctctgcagt

SEQ ID NO: 5646991 - DNA, 19 bp, Homo sapiens
tcttgagtttcatttttca

SEQ ID NO: 5646992 - DNA, 13 bp, Homo sapiens
tcttgagtttgtc

SEQ ID NO: 5646993 - DNA, 14 bp, Homo sapiens
tcttgagtttgtcg

SEQ ID NO: 5646994 - DNA, 20 bp, Homo sapiens
tcttgagtttgtcgctcatg

SEQ ID NO: 5646995 - DNA, 22 bp, Homo sapiens
tcttgagtttgtcgctcatgtg

SEQ ID NO: 5646996 - DNA, 18 bp, Homo sapiens
tcttgagttttgataaag

SEQ ID NO: 5646997 - DNA, 21 bp, Homo sapiens
tcttgagttttgttttaaaat

SEQ ID NO: 5646998 - DNA, 18 bp, Homo sapiens
tcttgagtttttcaggta

SEQ ID NO: 5646999 - DNA, 13 bp, Homo sapiens
tcttgatacattc

SEQ ID NO: 5647000 - DNA, 19 bp, Homo sapiens
tcttgatatctttcctccc

SEQ ID NO: 5647001 - DNA, 17 bp, Homo sapiens
tcttgatcaacatcttt

SEQ ID NO: 5647002 - DNA, 18 bp, Homo sapiens
tcttgatcaacatctttt

SEQ ID NO: 5647003 - DNA, 21 bp, Homo sapiens
tcttgatcagacattcagaga

SEQ ID NO: 5647004 - DNA, 17 bp, Homo sapiens
tcttgatcagtagtttg

SEQ ID NO: 5647005 - DNA, 15 bp, Homo sapiens
tcttgatcagtgtgc

SEQ ID NO: 5647006 - DNA, 18 bp, Homo sapiens
tcttgatcagttaagaaa

SEQ ID NO: 5647007 - DNA, 23 bp, Homo sapiens
tcttgatcagttaagaaatttca

SEQ ID NO: 5647008 - DNA, 14 bp, Homo sapiens
tcttgatcctccaa

SEQ ID NO: 5647009 - DNA, 20 bp, Homo sapiens
tcttgatcctccaatgtcta

SEQ ID NO: 5647010 - DNA, 13 bp, Homo sapiens
tcttgatctcctg

SEQ ID NO: 5647011 - DNA, 17 bp, Homo sapiens
tcttgatctcctgagct

SEQ ID NO: 5647012 - DNA, 13 bp, Homo sapiens
tcttgatctctaa

SEQ ID NO: 5647013 - DNA, 15 bp, Homo sapiens
tcttgatctctaatg

SEQ ID NO: 5647014 - DNA, 14 bp, Homo sapiens
tcttgatctgctca

SEQ ID NO: 5647015 - DNA, 19 bp, Homo sapiens
tcttgatctgctcagccct

SEQ ID NO: 5647016 - DNA, 15 bp, Homo sapiens
tcttgatctgttctg

SEQ ID NO: 5647017 - DNA, 13 bp, Homo sapiens
tcttgatcttaaa

SEQ ID NO: 5647018 - DNA, 13 bp, Homo sapiens
tcttgatctttga

SEQ ID NO: 5647019 - DNA, 18 bp, Homo sapiens
tcttgatctttgagccca

SEQ ID NO: 5647020 - DNA, 16 bp, Homo sapiens
tcttgatgaaaagctt

SEQ ID NO: 5647021 - DNA, 19 bp, Homo sapiens
tcttgatgaaacaaaaata

SEQ ID NO: 5647022 - DNA, 12 bp, Homo sapiens
tcttgatgacca

SEQ ID NO: 5647023 - DNA, 20 bp, Homo sapiens
tcttgatgccaccttcagat

SEQ ID NO: 5647024 - DNA, 14 bp, Homo sapiens
tcttgatgcctggc

SEQ ID NO: 5647025 - DNA, 13 bp, Homo sapiens
tcttgatgtcatg

SEQ ID NO: 5647026 - DNA, 13 bp, Homo sapiens
tcttgatgtgaag

SEQ ID NO: 5647027 - DNA, 16 bp, Homo sapiens
tcttgatgttgcttag

SEQ ID NO: 5647028 - DNA, 21 bp, Homo sapiens
tcttgatgttttttctgtaat

SEQ ID NO: 5647029 - DNA, 14 bp, Homo sapiens
tcttgattaatgta

SEQ ID NO: 5647030 - DNA, 16 bp, Homo sapiens
tcttgattaatgtact

SEQ ID NO: 5647031 - DNA, 14 bp, Homo sapiens
tcttgattataaat

SEQ ID NO: 5647032 - DNA, 19 bp, Homo sapiens
tcttgattataaatgtttg

SEQ ID NO: 5647033 - DNA, 15 bp, Homo sapiens
tcttgattcagtcac

SEQ ID NO: 5647034 - DNA, 14 bp, Homo sapiens
tcttgattcctggc

SEQ ID NO: 5647035 - DNA, 16 bp, Homo sapiens
tcttgattctctccct

SEQ ID NO: 5647036 - DNA, 13 bp, Homo sapiens
tcttgattgattt

SEQ ID NO: 5647037 - DNA, 16 bp, Homo sapiens
tcttgattgattttta

SEQ ID NO: 5647038 - DNA, 18 bp, Homo sapiens
tcttgatttatttgcttc

SEQ ID NO: 5647039 - DNA, 19 bp, Homo sapiens
tcttgatttgttttagaat

SEQ ID NO: 5647040 - DNA, 17 bp, Homo sapiens
tcttgattttcaagctt

SEQ ID NO: 5647041 - DNA, 20 bp, Homo sapiens
tcttgcaaagcgacagattc

SEQ ID NO: 5647042 - DNA, 17 bp, Homo sapiens
tcttgcaacttcagttt

SEQ ID NO: 5647043 - DNA, 16 bp, Homo sapiens
tcttgcaagcatgctt

SEQ ID NO: 5647044 - DNA, 17 bp, Homo sapiens
tcttgcaagcatgcttg

SEQ ID NO: 5647045 - DNA, 22 bp, Homo sapiens
tcttgcaagggaagagccttta

SEQ ID NO: 5647046 - DNA, 16 bp, Homo sapiens
tcttgcaatggcagcc

SEQ ID NO: 5647047 - DNA, 18 bp, Homo sapiens
tcttgcaatggcagcctt

SEQ ID NO: 5647048 - DNA, 22 bp, Homo sapiens
tcttgcaatggcagccttggca

SEQ ID NO: 5647049 - DNA, 15 bp, Homo sapiens
tcttgcaatttgaag

SEQ ID NO: 5647050 - DNA, 16 bp, Homo sapiens
tcttgcaatttgaagg

SEQ ID NO: 5647051 - DNA, 23 bp, Homo sapiens
tcttgcacacactttcatgcagt

SEQ ID NO: 5647052 - DNA, 15 bp, Homo sapiens
tcttgcacccgcctc

SEQ ID NO: 5647053 - DNA, 20 bp, Homo sapiens
tcttgcacccgcctctcccg

SEQ ID NO: 5647054 - DNA, 15 bp, Homo sapiens
tcttgcactccttcc

SEQ ID NO: 5647055 - DNA, 17 bp, Homo sapiens
tcttgcactccttccct

SEQ ID NO: 5647056 - DNA, 19 bp, Homo sapiens
tcttgcactgaatatataa

SEQ ID NO: 5647057 - DNA, 23 bp, Homo sapiens
tcttgcaggaaggactatgaaaa

SEQ ID NO: 5647058 - DNA, 13 bp, Homo sapiens
tcttgcaggtctc

SEQ ID NO: 5647059 - DNA, 14 bp, Homo sapiens
tcttgcaggtctca

SEQ ID NO: 5647060 - DNA, 20 bp, Homo sapiens
tcttgcaggtctcaaccctt

SEQ ID NO: 5647061 - DNA, 14 bp, Homo sapiens
tcttgcagtgatta

SEQ ID NO: 5647062 - DNA, 22 bp, Homo sapiens
tcttgcataagcctcaggcctg

SEQ ID NO: 5647063 - DNA, 22 bp, Homo sapiens
tcttgcataggctcttaagcag

SEQ ID NO: 5647064 - DNA, 17 bp, Homo sapiens
tcttgcatattttgtaa

SEQ ID NO: 5647065 - DNA, 21 bp, Homo sapiens
tcttgcatccttcctataact

SEQ ID NO: 5647066 - DNA, 14 bp, Homo sapiens
tcttgcatctaatg

SEQ ID NO: 5647067 - DNA, 20 bp, Homo sapiens
tcttgcatctacctgctcct

SEQ ID NO: 5647068 - DNA, 16 bp, Homo sapiens
tcttgcatctgggcca

SEQ ID NO: 5647069 - DNA, 19 bp, Homo sapiens
tcttgcatggcattaattg

SEQ ID NO: 5647070 - DNA, 21 bp, Homo sapiens
tcttgcatggcattaattgtt

SEQ ID NO: 5647071 - DNA, 19 bp, Homo sapiens
tcttgcatggtttggagct

SEQ ID NO: 5647072 - DNA, 17 bp, Homo sapiens
tcttgcattcaaaatct

SEQ ID NO: 5647073 - DNA, 15 bp, Homo sapiens
tcttgcattcatttt

SEQ ID NO: 5647074 - DNA, 16 bp, Homo sapiens
tcttgcattgaattta

SEQ ID NO: 5647075 - DNA, 17 bp, Homo sapiens
tcttgcattgacattat

SEQ ID NO: 5647076 - DNA, 11 bp, Homo sapiens
tcttgcatttt

SEQ ID NO: 5647077 - DNA, 20 bp, Homo sapiens
tcttgcatttttttccttta

SEQ ID NO: 5647078 - DNA, 19 bp, Homo sapiens
tcttgccaaatataaataa

SEQ ID NO: 5647079 - DNA, 22 bp, Homo sapiens
tcttgccaacctgtaataaata

SEQ ID NO: 5647080 - DNA, 10 bp, Homo sapiens
tcttgccaca

SEQ ID NO: 5647081 - DNA, 14 bp, Homo sapiens
tcttgccacacagt

SEQ ID NO: 5647082 - DNA, 21 bp, Homo sapiens
tcttgccacatttctgatcag

SEQ ID NO: 5647083 - DNA, 13 bp, Homo sapiens
tcttgccaccctc

SEQ ID NO: 5647084 - DNA, 16 bp, Homo sapiens
tcttgccaccctctgg

SEQ ID NO: 5647085 - DNA, 19 bp, Homo sapiens
tcttgccagccagaagcct

SEQ ID NO: 5647086 - DNA, 12 bp, Homo sapiens
tcttgccagcct

SEQ ID NO: 5647087 - DNA, 20 bp, Homo sapiens
tcttgccagcctcaggcttg

SEQ ID NO: 5647088 - DNA, 18 bp, Homo sapiens
tcttgccagcctccttgc

SEQ ID NO: 5647089 - DNA, 18 bp, Homo sapiens
tcttgccatcctgatgga

SEQ ID NO: 5647090 - DNA, 20 bp, Homo sapiens
tcttgccattattaacccat

SEQ ID NO: 5647091 - DNA, 11 bp, Homo sapiens
tcttgcccact

SEQ ID NO: 5647092 - DNA, 14 bp, Homo sapiens
tcttgcccagcagc

SEQ ID NO: 5647093 - DNA, 20 bp, Homo sapiens
tcttgcccagcagctcaaga

SEQ ID NO: 5647094 - DNA, 15 bp, Homo sapiens
tcttgcccatcctga

SEQ ID NO: 5647095 - DNA, 15 bp, Homo sapiens
tcttgccccaaatca

SEQ ID NO: 5647096 - DNA, 19 bp, Homo sapiens
tcttgccccaaatcacaaa

SEQ ID NO: 5647097 - DNA, 20 bp, Homo sapiens
tcttgccccaacccccagca

SEQ ID NO: 5647098 - DNA, 21 bp, Homo sapiens
tcttgccccaacccccagcac

SEQ ID NO: 5647099 - DNA, 20 bp, Homo sapiens
tcttgccccactccctggcc

SEQ ID NO: 5647100 - DNA, 13 bp, Homo sapiens
tcttgccccagtt

SEQ ID NO: 5647101 - DNA, 13 bp, Homo sapiens
tcttgccccttgt

SEQ ID NO: 5647102 - DNA, 22 bp, Homo sapiens
tcttgccccttgtcctgaagcc

SEQ ID NO: 5647103 - DNA, 21 bp, Homo sapiens
tcttgcccgcacccctccctg

SEQ ID NO: 5647104 - DNA, 22 bp, Homo sapiens
tcttgcccgcacccctccctgc

SEQ ID NO: 5647105 - DNA, 19 bp, Homo sapiens
tcttgcccgtcggccctgc

SEQ ID NO: 5647106 - DNA, 20 bp, Homo sapiens
tcttgcccgtcggccctgcg

SEQ ID NO: 5647107 - DNA, 11 bp, Homo sapiens
tcttgccctga

SEQ ID NO: 5647108 - DNA, 15 bp, Homo sapiens
tcttgccctgagctt

SEQ ID NO: 5647109 - DNA, 15 bp, Homo sapiens
tcttgcccttccctg

SEQ ID NO: 5647110 - DNA, 18 bp, Homo sapiens
tcttgcccttcctactcc

SEQ ID NO: 5647111 - DNA, 19 bp, Homo sapiens
tcttgccgaggagccaggc

SEQ ID NO: 5647112 - DNA, 20 bp, Homo sapiens
tcttgccgtcactattcatc

SEQ ID NO: 5647113 - DNA, 20 bp, Homo sapiens
tcttgcctaagtattccttt

SEQ ID NO: 5647114 - DNA, 19 bp, Homo sapiens
tcttgcctatattttcctg

SEQ ID NO: 5647115 - DNA, 20 bp, Homo sapiens
tcttgcctatattttcctga

SEQ ID NO: 5647116 - DNA, 16 bp, Homo sapiens
tcttgcctcaacctcc

SEQ ID NO: 5647117 - DNA, 22 bp, Homo sapiens
tcttgcctcattttgcttccca

SEQ ID NO: 5647118 - DNA, 22 bp, Homo sapiens
tcttgcctctgtccccttctct

SEQ ID NO: 5647119 - DNA, 21 bp, Homo sapiens
tcttgcctgaactcctgccat

SEQ ID NO: 5647120 - DNA, 16 bp, Homo sapiens
tcttgcctgccactgt

SEQ ID NO: 5647121 - DNA, 19 bp, Homo sapiens
tcttgcctgccactgtgtg

SEQ ID NO: 5647122 - DNA, 20 bp, Homo sapiens
tcttgcctgccactgtgtga

SEQ ID NO: 5647123 - DNA, 18 bp, Homo sapiens
tcttgcctgccagggccc

SEQ ID NO: 5647124 - DNA, 23 bp, Homo sapiens
tcttgccttaaccagtctctcaa

SEQ ID NO: 5647125 - DNA, 12 bp, Homo sapiens
tcttgccttcag

SEQ ID NO: 5647126 - DNA, 19 bp, Homo sapiens
tcttgcctttccacctgct

SEQ ID NO: 5647127 - DNA, 23 bp, Homo sapiens
tcttgcctttccacctgctttct

SEQ ID NO: 5647128 - DNA, 15 bp, Homo sapiens
tcttgccttttgtta

SEQ ID NO: 5647129 - DNA, 20 bp, Homo sapiens
tctttcaagtgaatctaaaa

SEQ ID NO: 5647130 - DNA, 19 bp, Homo sapiens
tctttcaataaactaaaga

SEQ ID NO: 5647131 - DNA, 21 bp, Homo sapiens
tctttcaatccacagtattgt

SEQ ID NO: 5647132 - DNA, 14 bp, Homo sapiens
tctttcacaaggta

SEQ ID NO: 5647133 - DNA, 15 bp, Homo sapiens
tctttcacaaggtat

SEQ ID NO: 5647134 - DNA, 16 bp, Homo sapiens
tctttcacaagtacta

SEQ ID NO: 5647135 - DNA, 14 bp, Homo sapiens
tctttcacacaatg

SEQ ID NO: 5647136 - DNA, 17 bp, Homo sapiens
tctttcacaggtagcct

SEQ ID NO: 5647137 - DNA, 22 bp, Homo sapiens
tctttcacattgtttgctgcta

SEQ ID NO: 5647138 - DNA, 19 bp, Homo sapiens
tctttcacccacagaaaga

SEQ ID NO: 5647139 - DNA, 20 bp, Homo sapiens
tctttcacccacagaaagag

SEQ ID NO: 5647140 - DNA, 15 bp, Homo sapiens
tctttcacccatcct

SEQ ID NO: 5647141 - DNA, 23 bp, Homo sapiens
tctttcacccatcctaggaacca

SEQ ID NO: 5647142 - DNA, 23 bp, Homo sapiens
tctttcacccttttctgtttgct

SEQ ID NO: 5647143 - DNA, 15 bp, Homo sapiens
tctttcacctgggtg

SEQ ID NO: 5647144 - DNA, 19 bp, Homo sapiens
tctttcacttgatgtttgt

SEQ ID NO: 5647145 - DNA, 20 bp, Homo sapiens
tctttcagaaaacagaaaaa

SEQ ID NO: 5647146 - DNA, 21 bp, Homo sapiens
tctttcagacttgccatgtga

SEQ ID NO: 5647147 - DNA, 18 bp, Homo sapiens
tctttcagatgtttattt

SEQ ID NO: 5647148 - DNA, 21 bp, Homo sapiens
tctttcagcaagataaacatt

SEQ ID NO: 5647149 - DNA, 12 bp, Homo sapiens
tctttcagcatt

SEQ ID NO: 5647150 - DNA, 17 bp, Homo sapiens
tctttcagctatcagta

SEQ ID NO: 5647151 - DNA, 18 bp, Homo sapiens
tctttcagctatcagtag

SEQ ID NO: 5647152 - DNA, 20 bp, Homo sapiens
tctttcagctgaattatatt

SEQ ID NO: 5647153 - DNA, 14 bp, Homo sapiens
tctttcaggaaatt

SEQ ID NO: 5647154 - DNA, 15 bp, Homo sapiens
tctttcagtattaaa

SEQ ID NO: 5647155 - DNA, 14 bp, Homo sapiens
tctttcatacatta

SEQ ID NO: 5647156 - DNA, 15 bp, Homo sapiens
tctttcatacattat

SEQ ID NO: 5647157 - DNA, 14 bp, Homo sapiens
tctttcatactaca

SEQ ID NO: 5647158 - DNA, 14 bp, Homo sapiens
tctttcatagttct

SEQ ID NO: 5647159 - DNA, 13 bp, Homo sapiens
tctttcatatggt

SEQ ID NO: 5647160 - DNA, 14 bp, Homo sapiens
tctttcatgagttt

SEQ ID NO: 5647161 - DNA, 15 bp, Homo sapiens
tctttcatgccattt

SEQ ID NO: 5647162 - DNA, 12 bp, Homo sapiens
tctttcatggaa

SEQ ID NO: 5647163 - DNA, 23 bp, Homo sapiens
tctttcattctaatccttgctat

SEQ ID NO: 5647164 - DNA, 16 bp, Homo sapiens
tctttcatttcttcta

SEQ ID NO: 5647165 - DNA, 21 bp, Homo sapiens
tctttcatttgctttggaagt

SEQ ID NO: 5647166 - DNA, 18 bp, Homo sapiens
tctttccaaaacatttct

SEQ ID NO: 5647167 - DNA, 13 bp, Homo sapiens
tctttccaaagta

SEQ ID NO: 5647168 - DNA, 23 bp, Homo sapiens
tctttccaaagtacactgtttca

SEQ ID NO: 5647169 - DNA, 17 bp, Homo sapiens
tctttccaaataaaatg

SEQ ID NO: 5647170 - DNA, 19 bp, Homo sapiens
tctttccaaattatttctt

SEQ ID NO: 5647171 - DNA, 21 bp, Homo sapiens
tctttccaaattgatgggtgg

SEQ ID NO: 5647172 - DNA, 22 bp, Homo sapiens
tctttccaaattgatgggtggg

SEQ ID NO: 5647173 - DNA, 19 bp, Homo sapiens
tctttccacggagccactc

SEQ ID NO: 5647174 - DNA, 23 bp, Homo sapiens
tctttccacggagccactcctct

SEQ ID NO: 5647175 - DNA, 15 bp, Homo sapiens
tctttccactctgga

SEQ ID NO: 5647176 - DNA, 16 bp, Homo sapiens
tctttccactctggat

SEQ ID NO: 5647177 - DNA, 16 bp, Homo sapiens
tctttccacttctctg

SEQ ID NO: 5647178 - DNA, 15 bp, Homo sapiens
tctttccacttgccc

SEQ ID NO: 5647179 - DNA, 10 bp, Homo sapiens
tctttccaga

SEQ ID NO: 5647180 - DNA, 16 bp, Homo sapiens
tctttccataataaaa

SEQ ID NO: 5647181 - DNA, 17 bp, Homo sapiens
tctttccatttgcattt

SEQ ID NO: 5647182 - DNA, 12 bp, Homo sapiens
tctttcccagcc

SEQ ID NO: 5647183 - DNA, 13 bp, Homo sapiens
tctttcccaggac

SEQ ID NO: 5647184 - DNA, 18 bp, Homo sapiens
tctttcccatggggaggg

SEQ ID NO: 5647185 - DNA, 18 bp, Homo sapiens
tctttccccaaaaattga

SEQ ID NO: 5647186 - DNA, 20 bp, Homo sapiens
tctttccccaaggacccagc

SEQ ID NO: 5647187 - DNA, 21 bp, Homo sapiens
tctttccccaaggacccagcc

SEQ ID NO: 5647188 - DNA, 22 bp, Homo sapiens
tctttccccaaggacccagccc

SEQ ID NO: 5647189 - DNA, 14 bp, Homo sapiens
tctttccccacctc

SEQ ID NO: 5647190 - DNA, 18 bp, Homo sapiens
tctttccccacctcttcc

SEQ ID NO: 5647191 - DNA, 16 bp, Homo sapiens
tctttccccactgaag

SEQ ID NO: 5647192 - DNA, 14 bp, Homo sapiens
tctttccccagagg

SEQ ID NO: 5647193 - DNA, 16 bp, Homo sapiens
tctttcccctcagagc

SEQ ID NO: 5647194 - DNA, 16 bp, Homo sapiens
tctttcccctcctttg

SEQ ID NO: 5647195 - DNA, 14 bp, Homo sapiens
tctttccctccttg

SEQ ID NO: 5647196 - DNA, 16 bp, Homo sapiens
tctttccctccttggt

SEQ ID NO: 5647197 - DNA, 13 bp, Homo sapiens
tctttccctggac

SEQ ID NO: 5647198 - DNA, 18 bp, Homo sapiens
tctttcccttagtgactc

SEQ ID NO: 5647199 - DNA, 17 bp, Homo sapiens
tctttcccttcctccat

SEQ ID NO: 5647200 - DNA, 13 bp, Homo sapiens
tctttcccttctt

SEQ ID NO: 5647201 - DNA, 16 bp, Homo sapiens
tctttcccttttctgt

SEQ ID NO: 5647202 - DNA, 21 bp, Homo sapiens
tctttccgacacatttaccaa

SEQ ID NO: 5647203 - DNA, 17 bp, Homo sapiens
tctttccgactgcccag

SEQ ID NO: 5647204 - DNA, 15 bp, Homo sapiens
tctttccggccaagg

SEQ ID NO: 5647205 - DNA, 17 bp, Homo sapiens
tctttccgtctccctaa

SEQ ID NO: 5647206 - DNA, 22 bp, Homo sapiens
tctttccgtttttttttctttt

SEQ ID NO: 5647207 - DNA, 17 bp, Homo sapiens
tctttcctaaggctgca

SEQ ID NO: 5647208 - DNA, 19 bp, Homo sapiens
tctttcctaccttggtcct

SEQ ID NO: 5647209 - DNA, 22 bp, Homo sapiens
tctttcctaccttggtcctgcc

SEQ ID NO: 5647210 - DNA, 19 bp, Homo sapiens
tctttcctagatggcagtc

SEQ ID NO: 5647211 - DNA, 14 bp, Homo sapiens
tctttcctcaagta

SEQ ID NO: 5647212 - DNA, 16 bp, Homo sapiens
tctttcctccaaactc

SEQ ID NO: 5647213 - DNA, 15 bp, Homo sapiens
tctttcctccccctg

SEQ ID NO: 5647214 - DNA, 15 bp, Homo sapiens
tctttcctcccttct

SEQ ID NO: 5647215 - DNA, 22 bp, Homo sapiens
tctttcctcctcatgaaagcag

SEQ ID NO: 5647216 - DNA, 14 bp, Homo sapiens
tctttcctccttcc

SEQ ID NO: 5647217 - DNA, 15 bp, Homo sapiens
tctttcctccttcca

SEQ ID NO: 5647218 - DNA, 21 bp, Homo sapiens
tctttcctctccaattgtaaa

SEQ ID NO: 5647219 - DNA, 11 bp, Homo sapiens
tctttcctctt

SEQ ID NO: 5647220 - DNA, 17 bp, Homo sapiens
tctttcctctttctgct

SEQ ID NO: 5647221 - DNA, 16 bp, Homo sapiens
tctttcctgaaccatg

SEQ ID NO: 5647222 - DNA, 12 bp, Homo sapiens
tctttcctgccc

SEQ ID NO: 5647223 - DNA, 17 bp, Homo sapiens
tctttcctgccctgtcc

SEQ ID NO: 5647224 - DNA, 14 bp, Homo sapiens
tctttcctgccttc

SEQ ID NO: 5647225 - DNA, 16 bp, Homo sapiens
tctttcctgccttctt

SEQ ID NO: 5647226 - DNA, 18 bp, Homo sapiens
tctttcctgttgttgtta

SEQ ID NO: 5647227 - DNA, 16 bp, Homo sapiens
tctttccttaataaat

SEQ ID NO: 5647228 - DNA, 16 bp, Homo sapiens
tctttccttctttcat

SEQ ID NO: 5647229 - DNA, 10 bp, Homo sapiens
tctttccttg

SEQ ID NO: 5647230 - DNA, 13 bp, Homo sapiens
tctttccttgctc

SEQ ID NO: 5647231 - DNA, 13 bp, Homo sapiens
tctttccttgtct

SEQ ID NO: 5647232 - DNA, 15 bp, Homo sapiens
tctttccttgtctct

SEQ ID NO: 5647233 - DNA, 17 bp, Homo sapiens
tctttccttgtctctca

SEQ ID NO: 5647234 - DNA, 18 bp, Homo sapiens
tctttccttgtctctcat

SEQ ID NO: 5647235 - DNA, 13 bp, Homo sapiens
tctttcctttaaa

SEQ ID NO: 5647236 - DNA, 16 bp, Homo sapiens
tctttcctttaaaaat

SEQ ID NO: 5647237 - DNA, 17 bp, Homo sapiens
tctttcgcacagcagtt

SEQ ID NO: 5647238 - DNA, 16 bp, Homo sapiens
tctttcggaattttta

SEQ ID NO: 5647239 - DNA, 21 bp, Homo sapiens
tctttcggaatttttaaaata

SEQ ID NO: 5647240 - DNA, 22 bp, Homo sapiens
tctttctaagagacctgaactg

SEQ ID NO: 5647241 - DNA, 11 bp, Homo sapiens
tctttctaata

SEQ ID NO: 5647242 - DNA, 15 bp, Homo sapiens
tctttctaatacaag

SEQ ID NO: 5647243 - DNA, 16 bp, Homo sapiens
tctttctacagcctaa

SEQ ID NO: 5647244 - DNA, 16 bp, Homo sapiens
tctttctacatagtta

SEQ ID NO: 5647245 - DNA, 22 bp, Homo sapiens
tctttctacatgactgggcctc

SEQ ID NO: 5647246 - DNA, 20 bp, Homo sapiens
tctttctagcagcagatctg

SEQ ID NO: 5647247 - DNA, 14 bp, Homo sapiens
tctttctagcctgg

SEQ ID NO: 5647248 - DNA, 21 bp, Homo sapiens
tctttctagcctggggcttga

SEQ ID NO: 5647249 - DNA, 15 bp, Homo sapiens
tctttctagtggtct

SEQ ID NO: 5647250 - DNA, 13 bp, Homo sapiens
tctttctagtttg

SEQ ID NO: 5647251 - DNA, 17 bp, Homo sapiens
tctttctatataaaatg

SEQ ID NO: 5647252 - DNA, 15 bp, Homo sapiens
tctttctatgcccgt

SEQ ID NO: 5647253 - DNA, 17 bp, Homo sapiens
tctttctattttcacaa

SEQ ID NO: 5647254 - DNA, 17 bp, Homo sapiens
tctttctcactaaatct

SEQ ID NO: 5647255 - DNA, 17 bp, Homo sapiens
tctttctcctcaggaca

SEQ ID NO: 5647256 - DNA, 12 bp, Homo sapiens
tctttctcctgg

SEQ ID NO: 5647257 - DNA, 19 bp, Homo sapiens
tctttctcctggtgactca

SEQ ID NO: 5647258 - DNA, 18 bp, Homo sapiens
tctttctccttagtcttc

SEQ ID NO: 5647259 - DNA, 21 bp, Homo sapiens
tctttctccttgaatatcttt

SEQ ID NO: 5647260 - DNA, 12 bp, Homo sapiens
tctttctcggtg

SEQ ID NO: 5647261 - DNA, 14 bp, Homo sapiens
tctttctctcagcc

SEQ ID NO: 5647262 - DNA, 21 bp, Homo sapiens
tctttctctcagccttacatt

SEQ ID NO: 5647263 - DNA, 12 bp, Homo sapiens
tctttctctccc

SEQ ID NO: 5647264 - DNA, 14 bp, Homo sapiens
tctttctctcccca

SEQ ID NO: 5647265 - DNA, 17 bp, Homo sapiens
tctttctctcccctcct

SEQ ID NO: 5647266 - DNA, 13 bp, Homo sapiens
tctttctctctgc

SEQ ID NO: 5647267 - DNA, 16 bp, Homo sapiens
tctttctctctggcct

SEQ ID NO: 5647268 - DNA, 17 bp, Homo sapiens
tctttctctctgtgtgg

SEQ ID NO: 5647269 - DNA, 17 bp, Homo sapiens
tctttctctctttccat

SEQ ID NO: 5647270 - DNA, 10 bp, Homo sapiens
tctttctctg

SEQ ID NO: 5647271 - DNA, 19 bp, Homo sapiens
tctttctctgacactgtgt

SEQ ID NO: 5647272 - DNA, 11 bp, Homo sapiens
tctttctctgc

SEQ ID NO: 5647273 - DNA, 15 bp, Homo sapiens
tctttctctgccagt

SEQ ID NO: 5647274 - DNA, 13 bp, Homo sapiens
tctttctcttccc

SEQ ID NO: 5647275 - DNA, 15 bp, Homo sapiens
tctttctcttcccat

SEQ ID NO: 5647276 - DNA, 16 bp, Homo sapiens
tctttctcttccctga

SEQ ID NO: 5647277 - DNA, 17 bp, Homo sapiens
tctttctctttccctgg

SEQ ID NO: 5647278 - DNA, 12 bp, Homo sapiens
tctttctctttt

SEQ ID NO: 5647279 - DNA, 14 bp, Homo sapiens
tctttctgaaggaa

SEQ ID NO: 5647280 - DNA, 18 bp, Homo sapiens
tctttctgagtgccttct

SEQ ID NO: 5647281 - DNA, 16 bp, Homo sapiens
tctttctgatgtcaaa

SEQ ID NO: 5647282 - DNA, 21 bp, Homo sapiens
tctttctgattccgcaccctg

SEQ ID NO: 5647283 - DNA, 15 bp, Homo sapiens
tctttctgcagaaaa

SEQ ID NO: 5647284 - DNA, 17 bp, Homo sapiens
tctttctgcagaaaatt

SEQ ID NO: 5647285 - DNA, 12 bp, Homo sapiens
tctttctgctct

SEQ ID NO: 5647286 - DNA, 15 bp, Homo sapiens
tctttctgctggctg

SEQ ID NO: 5647287 - DNA, 14 bp, Homo sapiens
tctttctggactgg

SEQ ID NO: 5647288 - DNA, 18 bp, Homo sapiens
tctttctggcctgccttc

SEQ ID NO: 5647289 - DNA, 23 bp, Homo sapiens
tctttctggcctgccttcgttaa

SEQ ID NO: 5647290 - DNA, 18 bp, Homo sapiens
tctttctggctatgcatt

SEQ ID NO: 5647291 - DNA, 20 bp, Homo sapiens
tctttctggctatgcatttg

SEQ ID NO: 5647292 - DNA, 23 bp, Homo sapiens
tctttctggggggatatttccta

SEQ ID NO: 5647293 - DNA, 14 bp, Homo sapiens
tctttctgtaaaca

SEQ ID NO: 5647294 - DNA, 19 bp, Homo sapiens
tctttctgtctcccttctc

SEQ ID NO: 5647295 - DNA, 20 bp, Homo sapiens
tctttctgtctcccttctct

SEQ ID NO: 5647296 - DNA, 19 bp, Homo sapiens
tctttctgtgcttggattt

SEQ ID NO: 5647297 - DNA, 19 bp, Homo sapiens
tctttcttagaaatttatt

SEQ ID NO: 5647298 - DNA, 16 bp, Homo sapiens
tctttcttagattaaa

SEQ ID NO: 5647299 - DNA, 17 bp, Homo sapiens
tctttcttattttgtaa

SEQ ID NO: 5647300 - DNA, 22 bp, Homo sapiens
tctttcttattttgtaataaac

SEQ ID NO: 5647301 - DNA, 23 bp, Homo sapiens
tctttcttattttgtaataaact

SEQ ID NO: 5647302 - DNA, 16 bp, Homo sapiens
tctttcttcaattaat

SEQ ID NO: 5647303 - DNA, 22 bp, Homo sapiens
tctttcttccactaccctccct

SEQ ID NO: 5647304 - DNA, 22 bp, Homo sapiens
tctttcttccattccttcatgt

SEQ ID NO: 5647305 - DNA, 19 bp, Homo sapiens
tctttcttcccgtgtgtat

SEQ ID NO: 5647306 - DNA, 15 bp, Homo sapiens
tctttcttccctcgt

SEQ ID NO: 5647307 - DNA, 18 bp, Homo sapiens
tctttcttcctccagtct

SEQ ID NO: 5647308 - DNA, 23 bp, Homo sapiens
tctttcttcctccagtctgttct

SEQ ID NO: 5647309 - DNA, 13 bp, Homo sapiens
tgaaaaaactttc

SEQ ID NO: 5647310 - DNA, 15 bp, Homo sapiens
tgaaaaaactttctc

SEQ ID NO: 5647311 - DNA, 17 bp, Homo sapiens
tgaaaaaactttctctt

SEQ ID NO: 5647312 - DNA, 21 bp, Homo sapiens
tgaaaaaagcaagattgaaat

SEQ ID NO: 5647313 - DNA, 17 bp, Homo sapiens
tgaaaaaagcagttctt

SEQ ID NO: 5647314 - DNA, 12 bp, Homo sapiens
tgaaaaaagctc

SEQ ID NO: 5647315 - DNA, 13 bp, Homo sapiens
tgaaaaaatacta

SEQ ID NO: 5647316 - DNA, 22 bp, Homo sapiens
tgaaaaaatagagcctgaggga

SEQ ID NO: 5647317 - DNA, 12 bp, Homo sapiens
tgaaaaaatgat

SEQ ID NO: 5647318 - DNA, 15 bp, Homo sapiens
tgaaaaaatgttcaa

SEQ ID NO: 5647319 - DNA, 21 bp, Homo sapiens
tgaaaaaatttactttaaact

SEQ ID NO: 5647320 - DNA, 13 bp, Homo sapiens
tgaaaaacagcag

SEQ ID NO: 5647321 - DNA, 21 bp, Homo sapiens
tgaaaaacatcccaaacttta

SEQ ID NO: 5647322 - DNA, 12 bp, Homo sapiens
tgaaaaacatga

SEQ ID NO: 5647323 - DNA, 22 bp, Homo sapiens
tgaaaaactatgtcagtatttt

SEQ ID NO: 5647324 - DNA, 18 bp, Homo sapiens
tgaaaaactcttctactt

SEQ ID NO: 5647325 - DNA, 16 bp, Homo sapiens
tgaaaaactgctgtaa

SEQ ID NO: 5647326 - DNA, 19 bp, Homo sapiens
tgaaaaactgctgtaaaca

SEQ ID NO: 5647327 - DNA, 21 bp, Homo sapiens
tgaaaaacttacctactgggg

SEQ ID NO: 5647328 - DNA, 14 bp, Homo sapiens
tgaaaaagaaaaaa

SEQ ID NO: 5647329 - DNA, 13 bp, Homo sapiens
tgaaaaagaagaa

SEQ ID NO: 5647330 - DNA, 11 bp, Homo sapiens
tgaaaaagaat

SEQ ID NO: 5647331 - DNA, 19 bp, Homo sapiens
tgaaaaagaatgaaaacaa

SEQ ID NO: 5647332 - DNA, 17 bp, Homo sapiens
tgaaaaagacataaaac

SEQ ID NO: 5647333 - DNA, 22 bp, Homo sapiens
tgaaaaagacctttggagcaaa

SEQ ID NO: 5647334 - DNA, 14 bp, Homo sapiens
tgaaaaagatattt

SEQ ID NO: 5647335 - DNA, 22 bp, Homo sapiens
tgaaaaagcaacgggaaatgtg

SEQ ID NO: 5647336 - DNA, 13 bp, Homo sapiens
tgaaaaagcatgt

SEQ ID NO: 5647337 - DNA, 17 bp, Homo sapiens
tgaaaaagcatgtacag

SEQ ID NO: 5647338 - DNA, 20 bp, Homo sapiens
tgaaaaagcatgtacagtgt

SEQ ID NO: 5647339 - DNA, 13 bp, Homo sapiens
tgaaaaagcgaaa

SEQ ID NO: 5647340 - DNA, 22 bp, Homo sapiens
tgaaaaagctgcttcttattaa

SEQ ID NO: 5647341 - DNA, 20 bp, Homo sapiens
tgaaaaagctggtctttgag

SEQ ID NO: 5647342 - DNA, 14 bp, Homo sapiens
tgaaaaaggaaaaa

SEQ ID NO: 5647343 - DNA, 16 bp, Homo sapiens
tgaaaaaggaaatatt

SEQ ID NO: 5647344 - DNA, 11 bp, Homo sapiens
tgaaaaaggat

SEQ ID NO: 5647345 - DNA, 16 bp, Homo sapiens
tgaaaaagtaaagtgt

SEQ ID NO: 5647346 - DNA, 17 bp, Homo sapiens
tgaaaaagtaggctgcc

SEQ ID NO: 5647347 - DNA, 21 bp, Homo sapiens
tgaaaaagtgtacatgaagaa

SEQ ID NO: 5647348 - DNA, 15 bp, Homo sapiens
tgaaaaagtgttttt

SEQ ID NO: 5647349 - DNA, 20 bp, Homo sapiens
tgaaaaagtgtttttacata

SEQ ID NO: 5647350 - DNA, 19 bp, Homo sapiens
tgaaaaagttaatgcttaa

SEQ ID NO: 5647351 - DNA, 17 bp, Homo sapiens
tgaaaaataaaaaccat

SEQ ID NO: 5647352 - DNA, 14 bp, Homo sapiens
tgaaaaatacttta

SEQ ID NO: 5647353 - DNA, 17 bp, Homo sapiens
tgaaaaatataaaatta

SEQ ID NO: 5647354 - DNA, 20 bp, Homo sapiens
tgaaaaatataaaattatga

SEQ ID NO: 5647355 - DNA, 22 bp, Homo sapiens
tgaaaaatataaaattatgaga

SEQ ID NO: 5647356 - DNA, 13 bp, Homo sapiens
tgaaaaatatctt

SEQ ID NO: 5647357 - DNA, 15 bp, Homo sapiens
tgaaaaatatgtgct

SEQ ID NO: 5647358 - DNA, 16 bp, Homo sapiens
tgaaaaatatgtgctt

SEQ ID NO: 5647359 - DNA, 11 bp, Homo sapiens
tgaaaaatatt

SEQ ID NO: 5647360 - DNA, 14 bp, Homo sapiens
tgaaaaatattgct

SEQ ID NO: 5647361 - DNA, 20 bp, Homo sapiens
tgaaaaatattgctaaaagt

SEQ ID NO: 5647362 - DNA, 18 bp, Homo sapiens
tgaaaaatcagatgaatt

SEQ ID NO: 5647363 - DNA, 19 bp, Homo sapiens
tgaaaaatcagatgaattg

SEQ ID NO: 5647364 - DNA, 20 bp, Homo sapiens
tgaaaaatctagtatttgta

SEQ ID NO: 5647365 - DNA, 19 bp, Homo sapiens
tgaaaaatctcattatttc

SEQ ID NO: 5647366 - DNA, 21 bp, Homo sapiens
tgaaaaatctcattatttctg

SEQ ID NO: 5647367 - DNA, 16 bp, Homo sapiens
tgaaaaatctgaattt

SEQ ID NO: 5647368 - DNA, 15 bp, Homo sapiens
tgaaaaatcttaagt

SEQ ID NO: 5647369 - DNA, 13 bp, Homo sapiens
tgaaaaatgaaag

SEQ ID NO: 5647370 - DNA, 14 bp, Homo sapiens
tgaaaaatgaaaga

SEQ ID NO: 5647371 - DNA, 12 bp, Homo sapiens
tgaaaaatgaca

SEQ ID NO: 5647372 - DNA, 14 bp, Homo sapiens
tgaaaaatgacaat

SEQ ID NO: 5647373 - DNA, 16 bp, Homo sapiens
tgaaaaatgacaattg

SEQ ID NO: 5647374 - DNA, 22 bp, Homo sapiens
tgaaaaatgacaattgtgaaca

SEQ ID NO: 5647375 - DNA, 19 bp, Homo sapiens
tgaaaaatgagattgaatg

SEQ ID NO: 5647376 - DNA, 12 bp, Homo sapiens
tgaaaaatgagc

SEQ ID NO: 5647377 - DNA, 13 bp, Homo sapiens
tgaaaaatgagct

SEQ ID NO: 5647378 - DNA, 22 bp, Homo sapiens
tgaaaaatgcctgctgctgcca

SEQ ID NO: 5647379 - DNA, 15 bp, Homo sapiens
tgaaaaatgtaaata

SEQ ID NO: 5647380 - DNA, 12 bp, Homo sapiens
tgaaaaatgtca

SEQ ID NO: 5647381 - DNA, 16 bp, Homo sapiens
tgaaaaatgtgcaaaa

SEQ ID NO: 5647382 - DNA, 20 bp, Homo sapiens
tgaaaaatgtttttattttt

SEQ ID NO: 5647383 - DNA, 14 bp, Homo sapiens
tgaaaaattaactt

SEQ ID NO: 5647384 - DNA, 16 bp, Homo sapiens
tgaaaaattatcagtt

SEQ ID NO: 5647385 - DNA, 12 bp, Homo sapiens
tgaaaaattcct

SEQ ID NO: 5647386 - DNA, 18 bp, Homo sapiens
tgaaaaatttaagcattg

SEQ ID NO: 5647387 - DNA, 19 bp, Homo sapiens
tgaaaaatttaagcattgt

SEQ ID NO: 5647388 - DNA, 12 bp, Homo sapiens
tgaaaacaaaaa

SEQ ID NO: 5647389 - DNA, 22 bp, Homo sapiens
tgaaaacaaaattccattacag

SEQ ID NO: 5647390 - DNA, 15 bp, Homo sapiens
tgaaaacaaacaaat

SEQ ID NO: 5647391 - DNA, 13 bp, Homo sapiens
tgaaaacaaagac

SEQ ID NO: 5647392 - DNA, 15 bp, Homo sapiens
tgaaaacaaagacat

SEQ ID NO: 5647393 - DNA, 13 bp, Homo sapiens
tgaaaacaaatct

SEQ ID NO: 5647394 - DNA, 19 bp, Homo sapiens
tgaaaacaagaaagaaatg

SEQ ID NO: 5647395 - DNA, 15 bp, Homo sapiens
tgaaaacaagtgctg

SEQ ID NO: 5647396 - DNA, 20 bp, Homo sapiens
tgaaaacaatactaaataaa

SEQ ID NO: 5647397 - DNA, 14 bp, Homo sapiens
tgaaaacaattcag

SEQ ID NO: 5647398 - DNA, 15 bp, Homo sapiens
tgaaaacaattcagt

SEQ ID NO: 5647399 - DNA, 18 bp, Homo sapiens
tgaaaacaattcagtggt

SEQ ID NO: 5647400 - DNA, 14 bp, Homo sapiens
tgaaaacacatttg

SEQ ID NO: 5647401 - DNA, 19 bp, Homo sapiens
tgaaaacacatttttctta

SEQ ID NO: 5647402 - DNA, 20 bp, Homo sapiens
tgaaaacacatttttcttag

SEQ ID NO: 5647403 - DNA, 18 bp, Homo sapiens
tgaaaacaccaagagtac

SEQ ID NO: 5647404 - DNA, 19 bp, Homo sapiens
tgaaaacaccagctgtata

SEQ ID NO: 5647405 - DNA, 16 bp, Homo sapiens
tgaaaacactgtgcac

SEQ ID NO: 5647406 - DNA, 20 bp, Homo sapiens
tgaaaacactgttctctgcc

SEQ ID NO: 5647407 - DNA, 23 bp, Homo sapiens
tgaaaacactgttctctgccctc

SEQ ID NO: 5647408 - DNA, 18 bp, Homo sapiens
tgaaaacacttgatgatg

SEQ ID NO: 5647409 - DNA, 22 bp, Homo sapiens
tgaaaacagaaattggtacctt

SEQ ID NO: 5647410 - DNA, 18 bp, Homo sapiens
tgaaaacagaatcagtgt

SEQ ID NO: 5647411 - DNA, 21 bp, Homo sapiens
tgaaaacagaatcagtgttaa

SEQ ID NO: 5647412 - DNA, 13 bp, Homo sapiens
tgaaaacagatat

SEQ ID NO: 5647413 - DNA, 23 bp, Homo sapiens
tgaaaacagatgaccataatttt

SEQ ID NO: 5647414 - DNA, 18 bp, Homo sapiens
tgaaaacagatgcccccg

SEQ ID NO: 5647415 - DNA, 14 bp, Homo sapiens
tgaaaacataaaaa

SEQ ID NO: 5647416 - DNA, 13 bp, Homo sapiens
tgaaaacatctgg

SEQ ID NO: 5647417 - DNA, 22 bp, Homo sapiens
tgaaaacatgtactacagctat

SEQ ID NO: 5647418 - DNA, 20 bp, Homo sapiens
tgaaaacattgatgaatgag

SEQ ID NO: 5647419 - DNA, 17 bp, Homo sapiens
tgaaaaccaaaatgaca

SEQ ID NO: 5647420 - DNA, 21 bp, Homo sapiens
tgaaaaccaaaatgacatctt

SEQ ID NO: 5647421 - DNA, 17 bp, Homo sapiens
tgaaaaccaaccctgtg

SEQ ID NO: 5647422 - DNA, 17 bp, Homo sapiens
tgaaaaccagtcttctc

SEQ ID NO: 5647423 - DNA, 22 bp, Homo sapiens
tgaaaaccagtggcttccatca

SEQ ID NO: 5647424 - DNA, 18 bp, Homo sapiens
tgaaaaccatctggcctg

SEQ ID NO: 5647425 - DNA, 21 bp, Homo sapiens
tgaaaaccatctggcctggcc

SEQ ID NO: 5647426 - DNA, 16 bp, Homo sapiens
tgaaaacccagactgt

SEQ ID NO: 5647427 - DNA, 16 bp, Homo sapiens
tgaaaacccagagagg

SEQ ID NO: 5647428 - DNA, 23 bp, Homo sapiens
tgaaaacccagagaggaatcaga

SEQ ID NO: 5647429 - DNA, 14 bp, Homo sapiens
tgaaaacccctggc

SEQ ID NO: 5647430 - DNA, 20 bp, Homo sapiens
tgaaaaccctcgatgttcat

SEQ ID NO: 5647431 - DNA, 18 bp, Homo sapiens
tgaaaacctaaaagacag

SEQ ID NO: 5647432 - DNA, 15 bp, Homo sapiens
tgaaaacctacatat

SEQ ID NO: 5647433 - DNA, 16 bp, Homo sapiens
tgaaaacctacatatt

SEQ ID NO: 5647434 - DNA, 17 bp, Homo sapiens
tgaaaacctctttcgga

SEQ ID NO: 5647435 - DNA, 13 bp, Homo sapiens
tgaaaacctgcat

SEQ ID NO: 5647436 - DNA, 16 bp, Homo sapiens
tgaaaacctgtcactt

SEQ ID NO: 5647437 - DNA, 16 bp, Homo sapiens
tgaaaacgtttcaaag

SEQ ID NO: 5647438 - DNA, 17 bp, Homo sapiens
tgaaaactaaggatttt

SEQ ID NO: 5647439 - DNA, 16 bp, Homo sapiens
tgaaaactaagttctc

SEQ ID NO: 5647440 - DNA, 22 bp, Homo sapiens
tgaaaactaatgtactgtacat

SEQ ID NO: 5647441 - DNA, 16 bp, Homo sapiens
tgaaaactacatttta

SEQ ID NO: 5647442 - DNA, 22 bp, Homo sapiens
tgaaaactagcattacattatt

SEQ ID NO: 5647443 - DNA, 22 bp, Homo sapiens
tgaaaactcatgatcaagatat

SEQ ID NO: 5647444 - DNA, 18 bp, Homo sapiens
tgaaaactgacatcagat

SEQ ID NO: 5647445 - DNA, 13 bp, Homo sapiens
tgaaaactggaat

SEQ ID NO: 5647446 - DNA, 21 bp, Homo sapiens
tgaaaactggaataagaagca

SEQ ID NO: 5647447 - DNA, 14 bp, Homo sapiens
tgaaaactgtaaat

SEQ ID NO: 5647448 - DNA, 23 bp, Homo sapiens
tgaaaactgtttatggtattttc

SEQ ID NO: 5647449 - DNA, 13 bp, Homo sapiens
tgaaaacttcaaa

SEQ ID NO: 5647450 - DNA, 13 bp, Homo sapiens
tgaaaacttctca

SEQ ID NO: 5647451 - DNA, 15 bp, Homo sapiens
tgaaaacttctcatt

SEQ ID NO: 5647452 - DNA, 19 bp, Homo sapiens
tgaaaactttatgctaagt

SEQ ID NO: 5647453 - DNA, 13 bp, Homo sapiens
tgaaaactttgta

SEQ ID NO: 5647454 - DNA, 16 bp, Homo sapiens
tgaaaactttgtagta

SEQ ID NO: 5647455 - DNA, 13 bp, Homo sapiens
tgaaaacttttgt

SEQ ID NO: 5647456 - DNA, 15 bp, Homo sapiens
tgaaaacttttgtaa

SEQ ID NO: 5647457 - DNA, 11 bp, Homo sapiens
tgaaaagaaaa

SEQ ID NO: 5647458 - DNA, 17 bp, Homo sapiens
tgaaaagaaaaagaaga

SEQ ID NO: 5647459 - DNA, 22 bp, Homo sapiens
tgaaaagaaaaatgagcctggc

SEQ ID NO: 5647460 - DNA, 19 bp, Homo sapiens
tgaaaagaaaatgtgccat

SEQ ID NO: 5647461 - DNA, 18 bp, Homo sapiens
tgaaaagaaagtgtttta

SEQ ID NO: 5647462 - DNA, 15 bp, Homo sapiens
tgaaaagaaatgcta

SEQ ID NO: 5647463 - DNA, 18 bp, Homo sapiens
tgaaaagaactagtttct

SEQ ID NO: 5647464 - DNA, 15 bp, Homo sapiens
tgaaaagaaggaaag

SEQ ID NO: 5647465 - DNA, 22 bp, Homo sapiens
tgaaaagaaggaatataccttt

SEQ ID NO: 5647466 - DNA, 15 bp, Homo sapiens
tgaaaagaagtagtg

SEQ ID NO: 5647467 - DNA, 18 bp, Homo sapiens
tgaaaagaataaaaattg

SEQ ID NO: 5647468 - DNA, 16 bp, Homo sapiens
tgaaaagacaagaaaa

SEQ ID NO: 5647469 - DNA, 19 bp, Homo sapiens
tgaaaagacaagaaaatca

SEQ ID NO: 5647470 - DNA, 17 bp, Homo sapiens
tgaaaagacatcaagca

SEQ ID NO: 5647471 - DNA, 18 bp, Homo sapiens
tgaaaagaccaagacttt

SEQ ID NO: 5647472 - DNA, 15 bp, Homo sapiens
tgaaaagactccaaa

SEQ ID NO: 5647473 - DNA, 22 bp, Homo sapiens
tgaaaagactccaaagaaatgt

SEQ ID NO: 5647474 - DNA, 15 bp, Homo sapiens
tgaaaagagaaactt

SEQ ID NO: 5647475 - DNA, 18 bp, Homo sapiens
tgaaaagagaaacttaaa

SEQ ID NO: 5647476 - DNA, 16 bp, Homo sapiens
tgaaaagagaatgatg

SEQ ID NO: 5647477 - DNA, 16 bp, Homo sapiens
tgaaaagagacaggca

SEQ ID NO: 5647478 - DNA, 22 bp, Homo sapiens
tgaaaagaggtgtgcaagagag

SEQ ID NO: 5647479 - DNA, 22 bp, Homo sapiens
tgaaaagagtatgtagtggctt

SEQ ID NO: 5647480 - DNA, 16 bp, Homo sapiens
tgaaaagatgttgtgt

SEQ ID NO: 5647481 - DNA, 15 bp, Homo sapiens
tgaaaagattctgaa

SEQ ID NO: 5647482 - DNA, 17 bp, Homo sapiens
tgaaaagattttattta

SEQ ID NO: 5647483 - DNA, 23 bp, Homo sapiens
tgaaaagcacaaggggccaaggt

SEQ ID NO: 5647484 - DNA, 22 bp, Homo sapiens
tgaaaagcaggttgataaatca

SEQ ID NO: 5647485 - DNA, 18 bp, Homo sapiens
tgaaaagccatatctagt

SEQ ID NO: 5647486 - DNA, 16 bp, Homo sapiens
tgaaaagccatgttta

SEQ ID NO: 5647487 - DNA, 17 bp, Homo sapiens
tgaaaagccatgtttaa

SEQ ID NO: 5647488 - DNA, 17 bp, Homo sapiens
tgaaatattgctgtata

SEQ ID NO: 5647489 - DNA, 15 bp, Homo sapiens
tgaaatattgtaaat

SEQ ID NO: 5647490 - DNA, 17 bp, Homo sapiens
tgaaatatttgcttatt

SEQ ID NO: 5647491 - DNA, 19 bp, Homo sapiens
tgaaatatttgcttattta

SEQ ID NO: 5647492 - DNA, 20 bp, Homo sapiens
tgaaatattttgaatacaca

SEQ ID NO: 5647493 - DNA, 15 bp, Homo sapiens
tgaaatcaaatgtat

SEQ ID NO: 5647494 - DNA, 12 bp, Homo sapiens
tgaaatcaagag

SEQ ID NO: 5647495 - DNA, 22 bp, Homo sapiens
tgaaatcaatgcaagagtgatt

SEQ ID NO: 5647496 - DNA, 20 bp, Homo sapiens
tgaaatcaccttttctaaaa

SEQ ID NO: 5647497 - DNA, 18 bp, Homo sapiens
tgaaatcagcatgacaaa

SEQ ID NO: 5647498 - DNA, 17 bp, Homo sapiens
tgaaatcagtaaacact

SEQ ID NO: 5647499 - DNA, 22 bp, Homo sapiens
tgaaatcagtatcagaatactt

SEQ ID NO: 5647500 - DNA, 21 bp, Homo sapiens
tgaaatcagtggtgttacatt

SEQ ID NO: 5647501 - DNA, 17 bp, Homo sapiens
tgaaatcatatttggaa

SEQ ID NO: 5647502 - DNA, 13 bp, Homo sapiens
tgaaatcatcaaa

SEQ ID NO: 5647503 - DNA, 23 bp, Homo sapiens
tgaaatcatctttgttggctcag

SEQ ID NO: 5647504 - DNA, 21 bp, Homo sapiens
tgaaatccacacatctttaga

SEQ ID NO: 5647505 - DNA, 16 bp, Homo sapiens
tgaaatccataaacta

SEQ ID NO: 5647506 - DNA, 23 bp, Homo sapiens
tgaaatccatatatatgaaatgt

SEQ ID NO: 5647507 - DNA, 18 bp, Homo sapiens
tgaaatcccaacaaaaaa

SEQ ID NO: 5647508 - DNA, 18 bp, Homo sapiens
tgaaatcccatctctaca

SEQ ID NO: 5647509 - DNA, 19 bp, Homo sapiens
tgaaatcccatctctacaa

SEQ ID NO: 5647510 - DNA, 20 bp, Homo sapiens
tgaaatcccatctctacaaa

SEQ ID NO: 5647511 - DNA, 15 bp, Homo sapiens
tgaaatccctgcctc

SEQ ID NO: 5647512 - DNA, 20 bp, Homo sapiens
tgaaatcctcaattcatcaa

SEQ ID NO: 5647513 - DNA, 23 bp, Homo sapiens
tgaaatcctcagccgagaaattg

SEQ ID NO: 5647514 - DNA, 14 bp, Homo sapiens
tgaaatcctgcttc

SEQ ID NO: 5647515 - DNA, 17 bp, Homo sapiens
tgaaatccttgactgga

SEQ ID NO: 5647516 - DNA, 18 bp, Homo sapiens
tgaaatccttgactggac

SEQ ID NO: 5647517 - DNA, 17 bp, Homo sapiens
tgaaatctaggaaaatt

SEQ ID NO: 5647518 - DNA, 18 bp, Homo sapiens
tgaaatctaggaaaatta

SEQ ID NO: 5647519 - DNA, 19 bp, Homo sapiens
tgaaatctaggaaaattat

SEQ ID NO: 5647520 - DNA, 16 bp, Homo sapiens
tgaaatctcagaattc

SEQ ID NO: 5647521 - DNA, 21 bp, Homo sapiens
tgaaatctcagaatttatctc

SEQ ID NO: 5647522 - DNA, 14 bp, Homo sapiens
tgaaatctgtcttt

SEQ ID NO: 5647523 - DNA, 16 bp, Homo sapiens
tgaaatctgtgcaata

SEQ ID NO: 5647524 - DNA, 17 bp, Homo sapiens
tgaaatctgtgcaataa

SEQ ID NO: 5647525 - DNA, 19 bp, Homo sapiens
tgaaatctgtgcaataaaa

SEQ ID NO: 5647526 - DNA, 19 bp, Homo sapiens
tgaaatcttacagctgggt

SEQ ID NO: 5647527 - DNA, 14 bp, Homo sapiens
tgaaatcttcccag

SEQ ID NO: 5647528 - DNA, 18 bp, Homo sapiens
tgaaatcttcccatgcat

SEQ ID NO: 5647529 - DNA, 14 bp, Homo sapiens
tgaaatcttgtttg

SEQ ID NO: 5647530 - DNA, 16 bp, Homo sapiens
tgaaatctttcaagtt

SEQ ID NO: 5647531 - DNA, 14 bp, Homo sapiens
tgaaatgaaaacat

SEQ ID NO: 5647532 - DNA, 17 bp, Homo sapiens
tgaaatgaaaattttaa

SEQ ID NO: 5647533 - DNA, 15 bp, Homo sapiens
tgaaatgaaagggaa

SEQ ID NO: 5647534 - DNA, 15 bp, Homo sapiens
tgaaatgaaatttaa

SEQ ID NO: 5647535 - DNA, 16 bp, Homo sapiens
tgaaatgaaatttaaa

SEQ ID NO: 5647536 - DNA, 14 bp, Homo sapiens
tgaaatgaacacaa

SEQ ID NO: 5647537 - DNA, 17 bp, Homo sapiens
tgaaatgaacacaaatt

SEQ ID NO: 5647538 - DNA, 22 bp, Homo sapiens
tgaaatgaactttgtcagtgtt

SEQ ID NO: 5647539 - DNA, 13 bp, Homo sapiens
tgaaatgaagcaa

SEQ ID NO: 5647540 - DNA, 16 bp, Homo sapiens
tgaaatgaatatttaa

SEQ ID NO: 5647541 - DNA, 21 bp, Homo sapiens
tgaaatgaatgattctacagc

SEQ ID NO: 5647542 - DNA, 15 bp, Homo sapiens
tgaaatgacatttca

SEQ ID NO: 5647543 - DNA, 17 bp, Homo sapiens
tgaaatgacatttcact

SEQ ID NO: 5647544 - DNA, 19 bp, Homo sapiens
tgaaatgacctcaagatgt

SEQ ID NO: 5647545 - DNA, 17 bp, Homo sapiens
tgaaatgagcacctcca

SEQ ID NO: 5647546 - DNA, 19 bp, Homo sapiens
tgaaatgaggtcagagcct

SEQ ID NO: 5647547 - DNA, 18 bp, Homo sapiens
tgaaatgaggtctgttta

SEQ ID NO: 5647548 - DNA, 23 bp, Homo sapiens
tgaaatgaggtctgtttaaagtg

SEQ ID NO: 5647549 - DNA, 21 bp, Homo sapiens
tgaaatgagtaaaaactagaa

SEQ ID NO: 5647550 - DNA, 15 bp, Homo sapiens
tgaaatgataaagac

SEQ ID NO: 5647551 - DNA, 17 bp, Homo sapiens
tgaaatgatagatttga

SEQ ID NO: 5647552 - DNA, 13 bp, Homo sapiens
tgaaatgattcat

SEQ ID NO: 5647553 - DNA, 13 bp, Homo sapiens
tgaaatgcactgt

SEQ ID NO: 5647554 - DNA, 13 bp, Homo sapiens
tgaaatgccaaag

SEQ ID NO: 5647555 - DNA, 14 bp, Homo sapiens
tgaaatgccaagac

SEQ ID NO: 5647556 - DNA, 15 bp, Homo sapiens
tgaaatgccaagact

SEQ ID NO: 5647557 - DNA, 22 bp, Homo sapiens
tgaaatgccaagtgcctgctta

SEQ ID NO: 5647558 - DNA, 23 bp, Homo sapiens
tgaaatgccaagtgcctgcttag

SEQ ID NO: 5647559 - DNA, 20 bp, Homo sapiens
tgaaatgccctcctaaatgt

SEQ ID NO: 5647560 - DNA, 22 bp, Homo sapiens
tgaaatgccctcctaaatgtca

SEQ ID NO: 5647561 - DNA, 23 bp, Homo sapiens
tgaaatgccttactttgtatgat

SEQ ID NO: 5647562 - DNA, 17 bp, Homo sapiens
tgaaatgctatgtcatt

SEQ ID NO: 5647563 - DNA, 17 bp, Homo sapiens
tgaaatgctgaaaattg

SEQ ID NO: 5647564 - DNA, 13 bp, Homo sapiens
tgaaatgctgcat

SEQ ID NO: 5647565 - DNA, 17 bp, Homo sapiens
tgaaatgctgcatttta

SEQ ID NO: 5647566 - DNA, 16 bp, Homo sapiens
tgaaatgctggcattt

SEQ ID NO: 5647567 - DNA, 20 bp, Homo sapiens
tgaaatgctgtatttttaca

SEQ ID NO: 5647568 - DNA, 20 bp, Homo sapiens
tgaaatgctttagcatacta

SEQ ID NO: 5647569 - DNA, 18 bp, Homo sapiens
tgaaatggactgactgta

SEQ ID NO: 5647570 - DNA, 14 bp, Homo sapiens
tgaaatggcattta

SEQ ID NO: 5647571 - DNA, 16 bp, Homo sapiens
tgaaatggctggggcc

SEQ ID NO: 5647572 - DNA, 16 bp, Homo sapiens
tgaaatgggaacaata

SEQ ID NO: 5647573 - DNA, 19 bp, Homo sapiens
tgaaatgggagatggtcag

SEQ ID NO: 5647574 - DNA, 16 bp, Homo sapiens
tgaaatgggctttaac

SEQ ID NO: 5647575 - DNA, 19 bp, Homo sapiens
tgaaatgtaaggctgtgta

SEQ ID NO: 5647576 - DNA, 16 bp, Homo sapiens
tgaaatgtacgtcatt

SEQ ID NO: 5647577 - DNA, 22 bp, Homo sapiens
tgaaatgtacgtcatttgtgca

SEQ ID NO: 5647578 - DNA, 14 bp, Homo sapiens
tgaaatgtataatt

SEQ ID NO: 5647579 - DNA, 13 bp, Homo sapiens
tgaaatgtcaacc

SEQ ID NO: 5647580 - DNA, 13 bp, Homo sapiens
tgaaatgtcagtt

SEQ ID NO: 5647581 - DNA, 20 bp, Homo sapiens
tgaaatgtcagttctgatat

SEQ ID NO: 5647582 - DNA, 21 bp, Homo sapiens
tgaaatgtcccctcaaactca

SEQ ID NO: 5647583 - DNA, 21 bp, Homo sapiens
tgaaatgtgaacgtccttcct

SEQ ID NO: 5647584 - DNA, 12 bp, Homo sapiens
tgaaatgtgaat

SEQ ID NO: 5647585 - DNA, 20 bp, Homo sapiens
tgaaatgtgaatttttattg

SEQ ID NO: 5647586 - DNA, 12 bp, Homo sapiens
tgaaatgtgtgt

SEQ ID NO: 5647587 - DNA, 13 bp, Homo sapiens
tgaaatgtgtttc

SEQ ID NO: 5647588 - DNA, 15 bp, Homo sapiens
tgaaatgtgtttctg

SEQ ID NO: 5647589 - DNA, 20 bp, Homo sapiens
tgaaatgtgttttgtctttt

SEQ ID NO: 5647590 - DNA, 15 bp, Homo sapiens
tgaaatgttaacaat

SEQ ID NO: 5647591 - DNA, 18 bp, Homo sapiens
tgaaatgtttaataaagc

SEQ ID NO: 5647592 - DNA, 20 bp, Homo sapiens
tgaaatgtttggattctctt

SEQ ID NO: 5647593 - DNA, 18 bp, Homo sapiens
tgaaatgtttttgattta

SEQ ID NO: 5647594 - DNA, 14 bp, Homo sapiens
tgaaattaaagaaa

SEQ ID NO: 5647595 - DNA, 15 bp, Homo sapiens
tgaaattaaagaaat

SEQ ID NO: 5647596 - DNA, 19 bp, Homo sapiens
tgaaattaaagctgccttt

SEQ ID NO: 5647597 - DNA, 17 bp, Homo sapiens
tgaaattaaagtatgca

SEQ ID NO: 5647598 - DNA, 15 bp, Homo sapiens
tgaaattaacaagaa

SEQ ID NO: 5647599 - DNA, 19 bp, Homo sapiens
tgaaattaacaagaactca

SEQ ID NO: 5647600 - DNA, 13 bp, Homo sapiens
tgaaattaacaca

SEQ ID NO: 5647601 - DNA, 21 bp, Homo sapiens
tgaaattaacacaaaggaagt

SEQ ID NO: 5647602 - DNA, 21 bp, Homo sapiens
tgaaattaagaaggcaaaaat

SEQ ID NO: 5647603 - DNA, 23 bp, Homo sapiens
tgaaattaataaaacttatctga

SEQ ID NO: 5647604 - DNA, 16 bp, Homo sapiens
tgaaattaatttgtga

SEQ ID NO: 5647605 - DNA, 19 bp, Homo sapiens
tgaaattacgggtacctga

SEQ ID NO: 5647606 - DNA, 20 bp, Homo sapiens
tgaaattactacaaaatttg

SEQ ID NO: 5647607 - DNA, 17 bp, Homo sapiens
tgaaattactgtgtaaa

SEQ ID NO: 5647608 - DNA, 14 bp, Homo sapiens
tgaaattactttaa

SEQ ID NO: 5647609 - DNA, 18 bp, Homo sapiens
tgaaattactttaacatt

SEQ ID NO: 5647610 - DNA, 19 bp, Homo sapiens
tgaaattactttaacattt

SEQ ID NO: 5647611 - DNA, 12 bp, Homo sapiens
tgaaattagtat

SEQ ID NO: 5647612 - DNA, 18 bp, Homo sapiens
tgaaattagtattttgag

SEQ ID NO: 5647613 - DNA, 19 bp, Homo sapiens
tgaaattagtgttttcatt

SEQ ID NO: 5647614 - DNA, 21 bp, Homo sapiens
tgaaattagtgttttcattct

SEQ ID NO: 5647615 - DNA, 22 bp, Homo sapiens
tgaaattagtgttttcattctg

SEQ ID NO: 5647616 - DNA, 21 bp, Homo sapiens
tgaaattataactattacagt

SEQ ID NO: 5647617 - DNA, 13 bp, Homo sapiens
tgaaattatagtt

SEQ ID NO: 5647618 - DNA, 23 bp, Homo sapiens
tgaaattatatatatacacatat

SEQ ID NO: 5647619 - DNA, 15 bp, Homo sapiens
tgaaattatgtaaat

SEQ ID NO: 5647620 - DNA, 14 bp, Homo sapiens
tgaaattatgtcaa

SEQ ID NO: 5647621 - DNA, 19 bp, Homo sapiens
tgaaattatgtcaaatgga

SEQ ID NO: 5647622 - DNA, 12 bp, Homo sapiens
tgaaattattca

SEQ ID NO: 5647623 - DNA, 15 bp, Homo sapiens
tgaaattattttctc

SEQ ID NO: 5647624 - DNA, 19 bp, Homo sapiens
tgaaattattttctccaaa

SEQ ID NO: 5647625 - DNA, 19 bp, Homo sapiens
tgaaattcaaaatgctcta

SEQ ID NO: 5647626 - DNA, 12 bp, Homo sapiens
tgaaattcaatt

SEQ ID NO: 5647627 - DNA, 21 bp, Homo sapiens
tgaaattcacagaagcctagg

SEQ ID NO: 5647628 - DNA, 21 bp, Homo sapiens
tgaaattcagagcaagttcct

SEQ ID NO: 5647629 - DNA, 14 bp, Homo sapiens
tgaaattccaaagt

SEQ ID NO: 5647630 - DNA, 14 bp, Homo sapiens
tgaaattccagcaa

SEQ ID NO: 5647631 - DNA, 22 bp, Homo sapiens
tgaaattcccccacttgggagc

SEQ ID NO: 5647632 - DNA, 16 bp, Homo sapiens
tgaaattctattgaaa

SEQ ID NO: 5647633 - DNA, 23 bp, Homo sapiens
tgaaattctattgaaaacagtgt

SEQ ID NO: 5647634 - DNA, 13 bp, Homo sapiens
tgaaattctattt

SEQ ID NO: 5647635 - DNA, 15 bp, Homo sapiens
tgaaattctcagagt

SEQ ID NO: 5647636 - DNA, 20 bp, Homo sapiens
tgaaattctggatcaggagg

SEQ ID NO: 5647637 - DNA, 13 bp, Homo sapiens
tgaaattcttcct

SEQ ID NO: 5647638 - DNA, 15 bp, Homo sapiens
tgaaattgaacctgg

SEQ ID NO: 5647639 - DNA, 22 bp, Homo sapiens
tgaaattgaagaggtgaaatgg

SEQ ID NO: 5647640 - DNA, 23 bp, Homo sapiens
tgaaattgacaagctaggaaaga

SEQ ID NO: 5647641 - DNA, 13 bp, Homo sapiens
tgaaattgagaag

SEQ ID NO: 5647642 - DNA, 13 bp, Homo sapiens
tgaaattgcctga

SEQ ID NO: 5647643 - DNA, 16 bp, Homo sapiens
tgaaattgtaattata

SEQ ID NO: 5647644 - DNA, 21 bp, Homo sapiens
tgaaattgtaattatatctga

SEQ ID NO: 5647645 - DNA, 17 bp, Homo sapiens
tgaaattgtagtgcaaa

SEQ ID NO: 5647646 - DNA, 18 bp, Homo sapiens
tgaaattgtgaactcatt

SEQ ID NO: 5647647 - DNA, 22 bp, Homo sapiens
tgaaattgtgaactcattgctc

SEQ ID NO: 5647648 - DNA, 12 bp, Homo sapiens
tgaaattgtgta

SEQ ID NO: 5647649 - DNA, 13 bp, Homo sapiens
tgaaattgtgtag

SEQ ID NO: 5647650 - DNA, 18 bp, Homo sapiens
tgaaattgtttaagtgtt

SEQ ID NO: 5647651 - DNA, 21 bp, Homo sapiens
tgaaattgttttaccagctcc

SEQ ID NO: 5647652 - DNA, 15 bp, Homo sapiens
tgaaatttaaaaata

SEQ ID NO: 5647653 - DNA, 20 bp, Homo sapiens
tgaaatttaaaaataaagct

SEQ ID NO: 5647654 - DNA, 24 bp, Homo sapiens
tgaaatttaaaaataaagctactg

SEQ ID NO: 5647655 - DNA, 20 bp, Homo sapiens
tgaaatttaaaaatctttca

SEQ ID NO: 5647656 - DNA, 14 bp, Homo sapiens
tgaaatttaaacat

SEQ ID NO: 5647657 - DNA, 18 bp, Homo sapiens
tgaaatttaaacattaaa

SEQ ID NO: 5647658 - DNA, 22 bp, Homo sapiens
tgaaatttaaacattaaaaatg

SEQ ID NO: 5647659 - DNA, 15 bp, Homo sapiens
tgaaatttaaataat

SEQ ID NO: 5647660 - DNA, 23 bp, Homo sapiens
tgaaatttaactgcctaaaatgt

SEQ ID NO: 5647661 - DNA, 15 bp, Homo sapiens
tgaaatttaattaca

SEQ ID NO: 5647662 - DNA, 23 bp, Homo sapiens
tgaaatttacctttttttagtta

SEQ ID NO: 5647663 - DNA, 21 bp, Homo sapiens
tgaaatttagtacactatgtt

SEQ ID NO: 5647664 - DNA, 16 bp, Homo sapiens
tgaaatttatacacca

SEQ ID NO: 5647665 - DNA, 19 bp, Homo sapiens
tgaagatttgaggacttgt

SEQ ID NO: 5647666 - DNA, 13 bp, Homo sapiens
tgaagattttctt

SEQ ID NO: 5647667 - DNA, 14 bp, Homo sapiens
tgaagcaaacacat

SEQ ID NO: 5647668 - DNA, 13 bp, Homo sapiens
tgaagcaaagaag

SEQ ID NO: 5647669 - DNA, 16 bp, Homo sapiens
tgaagcaaataccaaa

SEQ ID NO: 5647670 - DNA, 18 bp, Homo sapiens
tgaagcaaatcagaaact

SEQ ID NO: 5647671 - DNA, 11 bp, Homo sapiens
tgaagcaaatg

SEQ ID NO: 5647672 - DNA, 23 bp, Homo sapiens
tgaagcaaatgtcatgctgcctt

SEQ ID NO: 5647673 - DNA, 11 bp, Homo sapiens
tgaagcaactg

SEQ ID NO: 5647674 - DNA, 18 bp, Homo sapiens
tgaagcaagctgtgttac

SEQ ID NO: 5647675 - DNA, 14 bp, Homo sapiens
tgaagcaaggaaga

SEQ ID NO: 5647676 - DNA, 11 bp, Homo sapiens
tgaagcaataa

SEQ ID NO: 5647677 - DNA, 17 bp, Homo sapiens
tgaagcaataactccaa

SEQ ID NO: 5647678 - DNA, 14 bp, Homo sapiens
tgaagcaatttata

SEQ ID NO: 5647679 - DNA, 18 bp, Homo sapiens
tgaagcaatttatatctt

SEQ ID NO: 5647680 - DNA, 17 bp, Homo sapiens
tgaagcacagacccctt

SEQ ID NO: 5647681 - DNA, 19 bp, Homo sapiens
tgaagcacatacggcagac

SEQ ID NO: 5647682 - DNA, 17 bp, Homo sapiens
tgaagcacgtgagagac

SEQ ID NO: 5647683 - DNA, 21 bp, Homo sapiens
tgaagcacttaagtcttcctt

SEQ ID NO: 5647684 - DNA, 22 bp, Homo sapiens
tgaagcacttaagtcttcctta

SEQ ID NO: 5647685 - DNA, 12 bp, Homo sapiens
tgaagcagaaat

SEQ ID NO: 5647686 - DNA, 13 bp, Homo sapiens
tgaagcagaacct

SEQ ID NO: 5647687 - DNA, 19 bp, Homo sapiens
tgaagcagaagccccaaag

SEQ ID NO: 5647688 - DNA, 11 bp, Homo sapiens
tgaagcagagg

SEQ ID NO: 5647689 - DNA, 16 bp, Homo sapiens
tgaagcagaggaagga

SEQ ID NO: 5647690 - DNA, 21 bp, Homo sapiens
tgaagcagaggcctttattgt

SEQ ID NO: 5647691 - DNA, 16 bp, Homo sapiens
tgaagcagagtggcag

SEQ ID NO: 5647692 - DNA, 17 bp, Homo sapiens
tgaagcagagtggcagt

SEQ ID NO: 5647693 - DNA, 19 bp, Homo sapiens
tgaagcagatgcaaagagg

SEQ ID NO: 5647694 - DNA, 19 bp, Homo sapiens
tgaagcagatttatttttg

SEQ ID NO: 5647695 - DNA, 13 bp, Homo sapiens
tgaagcagcactg

SEQ ID NO: 5647696 - DNA, 15 bp, Homo sapiens
tgaagcagcactgtg

SEQ ID NO: 5647697 - DNA, 18 bp, Homo sapiens
tgaagcagcagccaccag

SEQ ID NO: 5647698 - DNA, 15 bp, Homo sapiens
tgaagcagcctctcc

SEQ ID NO: 5647699 - DNA, 20 bp, Homo sapiens
tgaagcagcctctccccagg

SEQ ID NO: 5647700 - DNA, 11 bp, Homo sapiens
tgaagcagctc

SEQ ID NO: 5647701 - DNA, 15 bp, Homo sapiens
tgaagcagctctgcc

SEQ ID NO: 5647702 - DNA, 19 bp, Homo sapiens
tgaagcagctttaaacaaa

SEQ ID NO: 5647703 - DNA, 12 bp, Homo sapiens
tgaagcaggagg

SEQ ID NO: 5647704 - DNA, 15 bp, Homo sapiens
tgaagcaggaggccc

SEQ ID NO: 5647705 - DNA, 14 bp, Homo sapiens
tgaagcagtatttt

SEQ ID NO: 5647706 - DNA, 16 bp, Homo sapiens
tgaagcagtcttgctc

SEQ ID NO: 5647707 - DNA, 17 bp, Homo sapiens
tgaagcagtcttgctct

SEQ ID NO: 5647708 - DNA, 19 bp, Homo sapiens
tgaagcagtgcctcgaggc

SEQ ID NO: 5647709 - DNA, 17 bp, Homo sapiens
tgaagcagttcagaagg

SEQ ID NO: 5647710 - DNA, 16 bp, Homo sapiens
tgaagcataaacatca

SEQ ID NO: 5647711 - DNA, 15 bp, Homo sapiens
tgaagcataaagtta

SEQ ID NO: 5647712 - DNA, 14 bp, Homo sapiens
tgaagcataatttg

SEQ ID NO: 5647713 - DNA, 19 bp, Homo sapiens
tgaagcataatttgtttaa

SEQ ID NO: 5647714 - DNA, 17 bp, Homo sapiens
tgaagcatagataatat

SEQ ID NO: 5647715 - DNA, 19 bp, Homo sapiens
tgaagcatagctacaattt

SEQ ID NO: 5647716 - DNA, 14 bp, Homo sapiens
tgaagcatgaacgt

SEQ ID NO: 5647717 - DNA, 18 bp, Homo sapiens
tgaagcatgctctgtaag

SEQ ID NO: 5647718 - DNA, 16 bp, Homo sapiens
tgaagcatgtttcatg

SEQ ID NO: 5647719 - DNA, 18 bp, Homo sapiens
tgaagcattctccccagt

SEQ ID NO: 5647720 - DNA, 23 bp, Homo sapiens
tgaagcatttcaaagccctgcct

SEQ ID NO: 5647721 - DNA, 16 bp, Homo sapiens
tgaagcattttctcag

SEQ ID NO: 5647722 - DNA, 16 bp, Homo sapiens
tgaagccaaatgaaac

SEQ ID NO: 5647723 - DNA, 15 bp, Homo sapiens
tgaagccaactgaca

SEQ ID NO: 5647724 - DNA, 16 bp, Homo sapiens
tgaagccaactgacaa

SEQ ID NO: 5647725 - DNA, 14 bp, Homo sapiens
tgaagccaagtggg

SEQ ID NO: 5647726 - DNA, 22 bp, Homo sapiens
tgaagccaagtggggtgctggg

SEQ ID NO: 5647727 - DNA, 14 bp, Homo sapiens
tgaagccacacagc

SEQ ID NO: 5647728 - DNA, 16 bp, Homo sapiens
tgaagccacacagccc

SEQ ID NO: 5647729 - DNA, 19 bp, Homo sapiens
tgaagccacacagcccaga

SEQ ID NO: 5647730 - DNA, 22 bp, Homo sapiens
tgaagccacacagcccagaagg

SEQ ID NO: 5647731 - DNA, 22 bp, Homo sapiens
tgaagccacagcccaggcctcc

SEQ ID NO: 5647732 - DNA, 21 bp, Homo sapiens
tgaagccacctctctgcctgt

SEQ ID NO: 5647733 - DNA, 20 bp, Homo sapiens
tgaagccactgaagctggga

SEQ ID NO: 5647734 - DNA, 14 bp, Homo sapiens
tgaagccagccttc

SEQ ID NO: 5647735 - DNA, 16 bp, Homo sapiens
tgaagccagctccctg

SEQ ID NO: 5647736 - DNA, 18 bp, Homo sapiens
tgaagccagctccctgaa

SEQ ID NO: 5647737 - DNA, 16 bp, Homo sapiens
tgaagccagtatttct

SEQ ID NO: 5647738 - DNA, 21 bp, Homo sapiens
tgaagccatgagttccagaaa

SEQ ID NO: 5647739 - DNA, 17 bp, Homo sapiens
tgaagccatgtagccac

SEQ ID NO: 5647740 - DNA, 19 bp, Homo sapiens
tgaagccatgtagccaccc

SEQ ID NO: 5647741 - DNA, 21 bp, Homo sapiens
tgaagccatgtagccacccaa

SEQ ID NO: 5647742 - DNA, 15 bp, Homo sapiens
tgaagcccaataaac

SEQ ID NO: 5647743 - DNA, 17 bp, Homo sapiens
tgaagcccgtgtcctgc

SEQ ID NO: 5647744 - DNA, 18 bp, Homo sapiens
tgaagcccgtgtcctgcc

SEQ ID NO: 5647745 - DNA, 16 bp, Homo sapiens
tgaagccgactctggc

SEQ ID NO: 5647746 - DNA, 18 bp, Homo sapiens
tgaagccgactctggccc

SEQ ID NO: 5647747 - DNA, 20 bp, Homo sapiens
tgaagccgactctggccctg

SEQ ID NO: 5647748 - DNA, 17 bp, Homo sapiens
tgaagccgccaggaccg

SEQ ID NO: 5647749 - DNA, 19 bp, Homo sapiens
tgaagccggacagctgccc

SEQ ID NO: 5647750 - DNA, 15 bp, Homo sapiens
tgaagcctaaatttg

SEQ ID NO: 5647751 - DNA, 21 bp, Homo sapiens
tgaagcctccacaccagctgc

SEQ ID NO: 5647752 - DNA, 16 bp, Homo sapiens
tgaagcctctaacaaa

SEQ ID NO: 5647753 - DNA, 13 bp, Homo sapiens
tgaagcctctgcc

SEQ ID NO: 5647754 - DNA, 22 bp, Homo sapiens
tgaagcctctgccctgcctccc

SEQ ID NO: 5647755 - DNA, 13 bp, Homo sapiens
tgaagcctctggg

SEQ ID NO: 5647756 - DNA, 13 bp, Homo sapiens
tgaagcctgccct

SEQ ID NO: 5647757 - DNA, 23 bp, Homo sapiens
tgaagcctgcgttggtccagagc

SEQ ID NO: 5647758 - DNA, 18 bp, Homo sapiens
tgaagcctgctccttccc

SEQ ID NO: 5647759 - DNA, 12 bp, Homo sapiens
tgaagcctggac

SEQ ID NO: 5647760 - DNA, 21 bp, Homo sapiens
tgaagcctggacgcagccaca

SEQ ID NO: 5647761 - DNA, 20 bp, Homo sapiens
tgaagcctggattccagcag

SEQ ID NO: 5647762 - DNA, 12 bp, Homo sapiens
tgaagcctgtgc

SEQ ID NO: 5647763 - DNA, 19 bp, Homo sapiens
tgaagcctgtgccacctgc

SEQ ID NO: 5647764 - DNA, 14 bp, Homo sapiens
tgaagcctgtgcct

SEQ ID NO: 5647765 - DNA, 14 bp, Homo sapiens
tgaagccttcttct

SEQ ID NO: 5647766 - DNA, 16 bp, Homo sapiens
tgaagccttcttctgc

SEQ ID NO: 5647767 - DNA, 18 bp, Homo sapiens
tgaagccttcttctgcca

SEQ ID NO: 5647768 - DNA, 18 bp, Homo sapiens
tgaagcctttcttttgga

SEQ ID NO: 5647769 - DNA, 11 bp, Homo sapiens
tgaagcctttg

SEQ ID NO: 5647770 - DNA, 13 bp, Homo sapiens
tgaagccttttga

SEQ ID NO: 5647771 - DNA, 16 bp, Homo sapiens
tgaagccttttgaaag

SEQ ID NO: 5647772 - DNA, 14 bp, Homo sapiens
tgaagccttttgtt

SEQ ID NO: 5647773 - DNA, 21 bp, Homo sapiens
tgaagcgaaacacagagaagc

SEQ ID NO: 5647774 - DNA, 17 bp, Homo sapiens
tgaagcggtcagactgg

SEQ ID NO: 5647775 - DNA, 14 bp, Homo sapiens
tgaagctaaaacac

SEQ ID NO: 5647776 - DNA, 15 bp, Homo sapiens
tgaagctaaaacact

SEQ ID NO: 5647777 - DNA, 15 bp, Homo sapiens
tgaagctaagattta

SEQ ID NO: 5647778 - DNA, 22 bp, Homo sapiens
tgaagctaatgaactctttcaa

SEQ ID NO: 5647779 - DNA, 16 bp, Homo sapiens
tgaagctaatgaccaa

SEQ ID NO: 5647780 - DNA, 16 bp, Homo sapiens
tgaagctagaaacaat

SEQ ID NO: 5647781 - DNA, 20 bp, Homo sapiens
tgaagctatcgtaaaattaa

SEQ ID NO: 5647782 - DNA, 15 bp, Homo sapiens
tgaagctattgatgt

SEQ ID NO: 5647783 - DNA, 19 bp, Homo sapiens
tgaagctatttatctgtag

SEQ ID NO: 5647784 - DNA, 18 bp, Homo sapiens
tgaagctcacctgttgct

SEQ ID NO: 5647785 - DNA, 19 bp, Homo sapiens
tgaagctcacctgttgctt

SEQ ID NO: 5647786 - DNA, 20 bp, Homo sapiens
tgaagctcgcatccagacag

SEQ ID NO: 5647787 - DNA, 22 bp, Homo sapiens
tgaagctctggtgacaccagcc

SEQ ID NO: 5647788 - DNA, 20 bp, Homo sapiens
tgaagctgaaccccctccag

SEQ ID NO: 5647789 - DNA, 18 bp, Homo sapiens
tgaagctgacaatttatg

SEQ ID NO: 5647790 - DNA, 13 bp, Homo sapiens
tgaagctgacagc

SEQ ID NO: 5647791 - DNA, 13 bp, Homo sapiens
tgaagctgaggct

SEQ ID NO: 5647792 - DNA, 16 bp, Homo sapiens
tgaagctgcctgcttt

SEQ ID NO: 5647793 - DNA, 19 bp, Homo sapiens
tgaagctgctggagcccgc

SEQ ID NO: 5647794 - DNA, 12 bp, Homo sapiens
tgaagctgctgt

SEQ ID NO: 5647795 - DNA, 16 bp, Homo sapiens
tgaagctggagcagcg

SEQ ID NO: 5647796 - DNA, 19 bp, Homo sapiens
tgaagctggagcagcggat

SEQ ID NO: 5647797 - DNA, 13 bp, Homo sapiens
tgaagctggccct

SEQ ID NO: 5647798 - DNA, 17 bp, Homo sapiens
tgaagctggccctcagc

SEQ ID NO: 5647799 - DNA, 18 bp, Homo sapiens
tgaagctggcctggacca

SEQ ID NO: 5647800 - DNA, 18 bp, Homo sapiens
tgaagctgggctgtctct

SEQ ID NO: 5647801 - DNA, 23 bp, Homo sapiens
tgaagctggggacagctttcctg

SEQ ID NO: 5647802 - DNA, 13 bp, Homo sapiens
tgaagctgtaccc

SEQ ID NO: 5647803 - DNA, 15 bp, Homo sapiens
tgaagctgttgtgtg

SEQ ID NO: 5647804 - DNA, 17 bp, Homo sapiens
tgaagcttattaatgct

SEQ ID NO: 5647805 - DNA, 18 bp, Homo sapiens
tgaagcttattaatgcta

SEQ ID NO: 5647806 - DNA, 13 bp, Homo sapiens
tgaagcttcatgc

SEQ ID NO: 5647807 - DNA, 12 bp, Homo sapiens
tgaagcttcctt

SEQ ID NO: 5647808 - DNA, 15 bp, Homo sapiens
tgaagcttgactccc

SEQ ID NO: 5647809 - DNA, 18 bp, Homo sapiens
tgaagcttgactcccaag

SEQ ID NO: 5647810 - DNA, 18 bp, Homo sapiens
tgaagcttggttgactga

SEQ ID NO: 5647811 - DNA, 15 bp, Homo sapiens
tgaagcttgtatctg

SEQ ID NO: 5647812 - DNA, 14 bp, Homo sapiens
tgaagcttgtgtat

SEQ ID NO: 5647813 - DNA, 23 bp, Homo sapiens
tgaagcttgtgtatccattatca

SEQ ID NO: 5647814 - DNA, 13 bp, Homo sapiens
tgaagctttacca

SEQ ID NO: 5647815 - DNA, 19 bp, Homo sapiens
tgaagctttggttctctga

SEQ ID NO: 5647816 - DNA, 21 bp, Homo sapiens
tgaagcttttatgtgaaacat

SEQ ID NO: 5647817 - DNA, 14 bp, Homo sapiens
tgaaggaaaaattc

SEQ ID NO: 5647818 - DNA, 15 bp, Homo sapiens
tgaaggaaaattaaa

SEQ ID NO: 5647819 - DNA, 12 bp, Homo sapiens
tgaaggaaacag

SEQ ID NO: 5647820 - DNA, 13 bp, Homo sapiens
tgaaggaaagatt

SEQ ID NO: 5647821 - DNA, 16 bp, Homo sapiens
tgaaggaaagatttgt

SEQ ID NO: 5647822 - DNA, 13 bp, Homo sapiens
tgaaggaaaggaa

SEQ ID NO: 5647823 - DNA, 23 bp, Homo sapiens
tgaaggaacagttaccctgcttt

SEQ ID NO: 5647824 - DNA, 20 bp, Homo sapiens
tgaaggaacttgtctcttca

SEQ ID NO: 5647825 - DNA, 14 bp, Homo sapiens
tgaaggaagagaag

SEQ ID NO: 5647826 - DNA, 14 bp, Homo sapiens
tgaaggaaggctga

SEQ ID NO: 5647827 - DNA, 21 bp, Homo sapiens
tgaaggaagttggtctttgtc

SEQ ID NO: 5647828 - DNA, 20 bp, Homo sapiens
tgaaggaataaattgctcct

SEQ ID NO: 5647829 - DNA, 17 bp, Homo sapiens
tgaaggaatagccagag

SEQ ID NO: 5647830 - DNA, 14 bp, Homo sapiens
tgaaggaatatatg

SEQ ID NO: 5647831 - DNA, 20 bp, Homo sapiens
tgaaggaatatatggcagag

SEQ ID NO: 5647832 - DNA, 21 bp, Homo sapiens
tgaaggaatcattccagtgct

SEQ ID NO: 5647833 - DNA, 20 bp, Homo sapiens
tgaaggacacttcctgccta

SEQ ID NO: 5647834 - DNA, 17 bp, Homo sapiens
tgaaggacctccccctg

SEQ ID NO: 5647835 - DNA, 23 bp, Homo sapiens
tgaaggacctgaaataaggtata

SEQ ID NO: 5647836 - DNA, 19 bp, Homo sapiens
tgaaggacctgagctggcc

SEQ ID NO: 5647837 - DNA, 12 bp, Homo sapiens
tgaaggactgtg

SEQ ID NO: 5647838 - DNA, 13 bp, Homo sapiens
tgaaggagaaagg

SEQ ID NO: 5647839 - DNA, 14 bp, Homo sapiens
tgaaggagaaagga

SEQ ID NO: 5647840 - DNA, 13 bp, Homo sapiens
tgaaggagaatgg

SEQ ID NO: 5647841 - DNA, 14 bp, Homo sapiens
tgaaggagaatggc

SEQ ID NO: 5647842 - DNA, 20 bp, Homo sapiens
tgaaggagagcccttcattt

SEQ ID NO: 5647843 - DNA, 13 bp, Homo sapiens
tgaaggagaggag

SEQ ID NO: 5647844 - DNA, 19 bp, Homo sapiens
tgaaggagaggaggaatta

SEQ ID NO: 5647845 - DNA, 23 bp, Homo sapiens
tgaatgtggataaaactgtgtaa

SEQ ID NO: 5647846 - DNA, 15 bp, Homo sapiens
tgaatgtggcagttt

SEQ ID NO: 5647847 - DNA, 20 bp, Homo sapiens
tgaatgtggctgaagttgaa

SEQ ID NO: 5647848 - DNA, 16 bp, Homo sapiens
tgaatgtggtctcagg

SEQ ID NO: 5647849 - DNA, 14 bp, Homo sapiens
tgaatgtgtcacta

SEQ ID NO: 5647850 - DNA, 14 bp, Homo sapiens
tgaatgtgtgagaa

SEQ ID NO: 5647851 - DNA, 15 bp, Homo sapiens
tgaatgtgtgagaaa

SEQ ID NO: 5647852 - DNA, 17 bp, Homo sapiens
tgaatgtgtgagaaaaa

SEQ ID NO: 5647853 - DNA, 16 bp, Homo sapiens
tgaatgtgtgatgtga

SEQ ID NO: 5647854 - DNA, 14 bp, Homo sapiens
tgaatgtgtgtggt

SEQ ID NO: 5647855 - DNA, 16 bp, Homo sapiens
tgaatgtgtttcacag

SEQ ID NO: 5647856 - DNA, 11 bp, Homo sapiens
tgaatgttaaa

SEQ ID NO: 5647857 - DNA, 13 bp, Homo sapiens
tgaatgttaaata

SEQ ID NO: 5647858 - DNA, 16 bp, Homo sapiens
tgaatgttaaataaat

SEQ ID NO: 5647859 - DNA, 15 bp, Homo sapiens
tgaatgttaacatgc

SEQ ID NO: 5647860 - DNA, 18 bp, Homo sapiens
tgaatgttagatgcttag

SEQ ID NO: 5647861 - DNA, 16 bp, Homo sapiens
tgaatgttatatcatc

SEQ ID NO: 5647862 - DNA, 22 bp, Homo sapiens
tgaatgttccaccattgctgga

SEQ ID NO: 5647863 - DNA, 22 bp, Homo sapiens
tgaatgttcccaagtaggcatt

SEQ ID NO: 5647864 - DNA, 23 bp, Homo sapiens
tgaatgttcccaagtaggcattc

SEQ ID NO: 5647865 - DNA, 12 bp, Homo sapiens
tgaatgttctga

SEQ ID NO: 5647866 - DNA, 17 bp, Homo sapiens
tgaatgttctgacatta

SEQ ID NO: 5647867 - DNA, 18 bp, Homo sapiens
tgaatgttctgacattaa

SEQ ID NO: 5647868 - DNA, 20 bp, Homo sapiens
tgaatgttctgacattaaca

SEQ ID NO: 5647869 - DNA, 21 bp, Homo sapiens
tgaatgttgtctgtttgttct

SEQ ID NO: 5647870 - DNA, 20 bp, Homo sapiens
tgaatgtttagtgtgctgct

SEQ ID NO: 5647871 - DNA, 22 bp, Homo sapiens
tgaatgtttagtgtgctgctgt

SEQ ID NO: 5647872 - DNA, 19 bp, Homo sapiens
tgaatgtttattccttgat

SEQ ID NO: 5647873 - DNA, 21 bp, Homo sapiens
tgaatgtttgaactgccaaga

SEQ ID NO: 5647874 - DNA, 18 bp, Homo sapiens
tgaatgtttgtgtctgtg

SEQ ID NO: 5647875 - DNA, 14 bp, Homo sapiens
tgaatgttttattt

SEQ ID NO: 5647876 - DNA, 21 bp, Homo sapiens
tgaatgttttgtgtgtaagga

SEQ ID NO: 5647877 - DNA, 17 bp, Homo sapiens
tgaatgtttttctaaag

SEQ ID NO: 5647878 - DNA, 18 bp, Homo sapiens
tgaatgtttttctaaagg

SEQ ID NO: 5647879 - DNA, 12 bp, Homo sapiens
tgaattaaagtc

SEQ ID NO: 5647880 - DNA, 17 bp, Homo sapiens
tgaattaaataaaccct

SEQ ID NO: 5647881 - DNA, 11 bp, Homo sapiens
tgaattaaatt

SEQ ID NO: 5647882 - DNA, 20 bp, Homo sapiens
tgaattaacacagtgtttca

SEQ ID NO: 5647883 - DNA, 22 bp, Homo sapiens
tgaattaaccagctgatttttc

SEQ ID NO: 5647884 - DNA, 11 bp, Homo sapiens
tgaattaagaa

SEQ ID NO: 5647885 - DNA, 19 bp, Homo sapiens
tgaattaagaaagattaaa

SEQ ID NO: 5647886 - DNA, 14 bp, Homo sapiens
tgaattaagttttt

SEQ ID NO: 5647887 - DNA, 16 bp, Homo sapiens
tgaattaatatcccta

SEQ ID NO: 5647888 - DNA, 19 bp, Homo sapiens
tgaattaatatccctacat

SEQ ID NO: 5647889 - DNA, 21 bp, Homo sapiens
tgaattaatctagaaaatgaa

SEQ ID NO: 5647890 - DNA, 14 bp, Homo sapiens
tgaattaattcaga

SEQ ID NO: 5647891 - DNA, 18 bp, Homo sapiens
tgaattacagagatataa

SEQ ID NO: 5647892 - DNA, 16 bp, Homo sapiens
tgaattacagggaaga

SEQ ID NO: 5647893 - DNA, 21 bp, Homo sapiens
tgaattacagggaagaaatca

SEQ ID NO: 5647894 - DNA, 17 bp, Homo sapiens
tgaattacctggatgtt

SEQ ID NO: 5647895 - DNA, 16 bp, Homo sapiens
tgaattactaacttct

SEQ ID NO: 5647896 - DNA, 20 bp, Homo sapiens
tgaattactaacttctaaaa

SEQ ID NO: 5647897 - DNA, 21 bp, Homo sapiens
tgaattactaacttctaaaac

SEQ ID NO: 5647898 - DNA, 14 bp, Homo sapiens
tgaattagaaaatt

SEQ ID NO: 5647899 - DNA, 23 bp, Homo sapiens
tgaattagaaacataaataaaat

SEQ ID NO: 5647900 - DNA, 15 bp, Homo sapiens
tgaattagttttaaa

SEQ ID NO: 5647901 - DNA, 19 bp, Homo sapiens
tgaattataactagacatc

SEQ ID NO: 5647902 - DNA, 18 bp, Homo sapiens
tgaattatactttgttgt

SEQ ID NO: 5647903 - DNA, 20 bp, Homo sapiens
tgaattatattcaatgcatt

SEQ ID NO: 5647904 - DNA, 15 bp, Homo sapiens
tgaattatcagcaaa

SEQ ID NO: 5647905 - DNA, 21 bp, Homo sapiens
tgaattatccacatgaaaata

SEQ ID NO: 5647906 - DNA, 15 bp, Homo sapiens
tgaattatgaaactt

SEQ ID NO: 5647907 - DNA, 14 bp, Homo sapiens
tgaattatgataaa

SEQ ID NO: 5647908 - DNA, 17 bp, Homo sapiens
tgaattattaatgaatg

SEQ ID NO: 5647909 - DNA, 19 bp, Homo sapiens
tgaattattacactgtaag

SEQ ID NO: 5647910 - DNA, 16 bp, Homo sapiens
tgaattattacagtgt

SEQ ID NO: 5647911 - DNA, 15 bp, Homo sapiens
tgaattattgacact

SEQ ID NO: 5647912 - DNA, 19 bp, Homo sapiens
tgaattattttgttactgt

SEQ ID NO: 5647913 - DNA, 14 bp, Homo sapiens
tgaattcaaagctt

SEQ ID NO: 5647914 - DNA, 19 bp, Homo sapiens
tgaattcaaagcttgtgaa

SEQ ID NO: 5647915 - DNA, 17 bp, Homo sapiens
tgaattcaaatattctt

SEQ ID NO: 5647916 - DNA, 17 bp, Homo sapiens
tgaattcaagaaaggaa

SEQ ID NO: 5647917 - DNA, 19 bp, Homo sapiens
tgaattcaccacagacttt

SEQ ID NO: 5647918 - DNA, 14 bp, Homo sapiens
tgaattcacctgtg

SEQ ID NO: 5647919 - DNA, 11 bp, Homo sapiens
tgaattcactc

SEQ ID NO: 5647920 - DNA, 21 bp, Homo sapiens
tgaattcactccagtcaacag

SEQ ID NO: 5647921 - DNA, 23 bp, Homo sapiens
tgaattcactccagtcaacagat

SEQ ID NO: 5647922 - DNA, 22 bp, Homo sapiens
tgaattcacttaagtttttcca

SEQ ID NO: 5647923 - DNA, 13 bp, Homo sapiens
tgaattcataaaa

SEQ ID NO: 5647924 - DNA, 15 bp, Homo sapiens
tgaattcataaaaat

SEQ ID NO: 5647925 - DNA, 16 bp, Homo sapiens
tgaattcatactctgt

SEQ ID NO: 5647926 - DNA, 15 bp, Homo sapiens
tgaattcattgtctc

SEQ ID NO: 5647927 - DNA, 21 bp, Homo sapiens
tgaattcattgtctcagtgaa

SEQ ID NO: 5647928 - DNA, 20 bp, Homo sapiens
tgaattccactccttccaga

SEQ ID NO: 5647929 - DNA, 16 bp, Homo sapiens
tgaattcctaaaatta

SEQ ID NO: 5647930 - DNA, 23 bp, Homo sapiens
tgaattcctaaaattatggaaac

SEQ ID NO: 5647931 - DNA, 15 bp, Homo sapiens
tgaattcctcctcta

SEQ ID NO: 5647932 - DNA, 15 bp, Homo sapiens
tgaattcctctcaaa

SEQ ID NO: 5647933 - DNA, 16 bp, Homo sapiens
tgaattcgagacaggc

SEQ ID NO: 5647934 - DNA, 22 bp, Homo sapiens
tgaattcgatgcgtattctgtg

SEQ ID NO: 5647935 - DNA, 23 bp, Homo sapiens
tgaattcggaactgtcctttcct

SEQ ID NO: 5647936 - DNA, 19 bp, Homo sapiens
tgaattcgtttctgacata

SEQ ID NO: 5647937 - DNA, 12 bp, Homo sapiens
tgaattctgcct

SEQ ID NO: 5647938 - DNA, 20 bp, Homo sapiens
tgaattctgctctaaataaa

SEQ ID NO: 5647939 - DNA, 20 bp, Homo sapiens
tgaattctggtcacattcca

SEQ ID NO: 5647940 - DNA, 14 bp, Homo sapiens
tgaattctgtgaag

SEQ ID NO: 5647941 - DNA, 18 bp, Homo sapiens
tgaattctgttgtaattt

SEQ ID NO: 5647942 - DNA, 21 bp, Homo sapiens
tgaattcttcaacagggaaaa

SEQ ID NO: 5647943 - DNA, 17 bp, Homo sapiens
tgaattcttcctctcct

SEQ ID NO: 5647944 - DNA, 19 bp, Homo sapiens
tgaattcttcctctccttc

SEQ ID NO: 5647945 - DNA, 22 bp, Homo sapiens
tgaattcttcctctccttccca

SEQ ID NO: 5647946 - DNA, 23 bp, Homo sapiens
tgaattcttcctctccttcccac

SEQ ID NO: 5647947 - DNA, 16 bp, Homo sapiens
tgaattctttaaatat

SEQ ID NO: 5647948 - DNA, 14 bp, Homo sapiens
tgaattctttagat

SEQ ID NO: 5647949 - DNA, 14 bp, Homo sapiens
tgaattcttttcct

SEQ ID NO: 5647950 - DNA, 15 bp, Homo sapiens
tgaattcttttgcca

SEQ ID NO: 5647951 - DNA, 18 bp, Homo sapiens
tgaattgaaagagaattt

SEQ ID NO: 5647952 - DNA, 21 bp, Homo sapiens
tgaattgaagtcatcataaaa

SEQ ID NO: 5647953 - DNA, 12 bp, Homo sapiens
tgaattgaagtt

SEQ ID NO: 5647954 - DNA, 17 bp, Homo sapiens
tgaattgaagtttcaag

SEQ ID NO: 5647955 - DNA, 16 bp, Homo sapiens
tgaattgaatgctcta

SEQ ID NO: 5647956 - DNA, 20 bp, Homo sapiens
tgaattgagaaaagagtgag

SEQ ID NO: 5647957 - DNA, 17 bp, Homo sapiens
tgaattgagcctaaaaa

SEQ ID NO: 5647958 - DNA, 18 bp, Homo sapiens
tgaattgataaaagagtt

SEQ ID NO: 5647959 - DNA, 20 bp, Homo sapiens
tgaattgcctgccatggctg

SEQ ID NO: 5647960 - DNA, 19 bp, Homo sapiens
tgaattgcctgttcataaa

SEQ ID NO: 5647961 - DNA, 21 bp, Homo sapiens
tgaattgcctgttcataaaac

SEQ ID NO: 5647962 - DNA, 16 bp, Homo sapiens
tgaattgcctttgata

SEQ ID NO: 5647963 - DNA, 16 bp, Homo sapiens
tgaattgcgttggtct

SEQ ID NO: 5647964 - DNA, 17 bp, Homo sapiens
tgaattgctaattctga

SEQ ID NO: 5647965 - DNA, 16 bp, Homo sapiens
tgaattggaaagactt

SEQ ID NO: 5647966 - DNA, 21 bp, Homo sapiens
tgaattggaactgcaatgaaa

SEQ ID NO: 5647967 - DNA, 12 bp, Homo sapiens
tgaattggaagg

SEQ ID NO: 5647968 - DNA, 16 bp, Homo sapiens
tgaattggaagggaaa

SEQ ID NO: 5647969 - DNA, 14 bp, Homo sapiens
tgaattggaatgca

SEQ ID NO: 5647970 - DNA, 13 bp, Homo sapiens
tgaattggacccc

SEQ ID NO: 5647971 - DNA, 21 bp, Homo sapiens
tgaattggcaaaattacagtt

SEQ ID NO: 5647972 - DNA, 15 bp, Homo sapiens
tgaattggcctgaac

SEQ ID NO: 5647973 - DNA, 23 bp, Homo sapiens
tgaattggctaaaagacatgcat

SEQ ID NO: 5647974 - DNA, 16 bp, Homo sapiens
tgaattggcttccaga

SEQ ID NO: 5647975 - DNA, 15 bp, Homo sapiens
tgaattggcttcctt

SEQ ID NO: 5647976 - DNA, 20 bp, Homo sapiens
tgaattggtgaataaaacct

SEQ ID NO: 5647977 - DNA, 19 bp, Homo sapiens
tgaattgtaactgttcttg

SEQ ID NO: 5647978 - DNA, 18 bp, Homo sapiens
tgaattgtacctatttct

SEQ ID NO: 5647979 - DNA, 19 bp, Homo sapiens
tgaattgtacctatttctg

SEQ ID NO: 5647980 - DNA, 23 bp, Homo sapiens
tgaattgtacctatttctgatga

SEQ ID NO: 5647981 - DNA, 16 bp, Homo sapiens
tgaattgtatcaattt

SEQ ID NO: 5647982 - DNA, 22 bp, Homo sapiens
tgaattgtctagggtgttctgt

SEQ ID NO: 5647983 - DNA, 12 bp, Homo sapiens
tgaattgtcttt

SEQ ID NO: 5647984 - DNA, 19 bp, Homo sapiens
tgaattgtcttttagacaa

SEQ ID NO: 5647985 - DNA, 17 bp, Homo sapiens
tgaattgtgaccaagtt

SEQ ID NO: 5647986 - DNA, 22 bp, Homo sapiens
tgaattgtgtattgatgcaata

SEQ ID NO: 5647987 - DNA, 16 bp, Homo sapiens
tgaattgtttataatg

SEQ ID NO: 5647988 - DNA, 15 bp, Homo sapiens
tgaattgtttgatat

SEQ ID NO: 5647989 - DNA, 19 bp, Homo sapiens
tgaattgtttttattgttt

SEQ ID NO: 5647990 - DNA, 12 bp, Homo sapiens
tgaatttaaata

SEQ ID NO: 5647991 - DNA, 13 bp, Homo sapiens
tgaatttaaataa

SEQ ID NO: 5647992 - DNA, 17 bp, Homo sapiens
tgaatttaaataaagtt

SEQ ID NO: 5647993 - DNA, 15 bp, Homo sapiens
tgaatttaaatataa

SEQ ID NO: 5647994 - DNA, 16 bp, Homo sapiens
tgaatttaaatataat

SEQ ID NO: 5647995 - DNA, 19 bp, Homo sapiens
tgaatttaaatataattct

SEQ ID NO: 5647996 - DNA, 14 bp, Homo sapiens
tgaatttaacaatg

SEQ ID NO: 5647997 - DNA, 18 bp, Homo sapiens
tgaatttaaggcaaaaaa

SEQ ID NO: 5647998 - DNA, 20 bp, Homo sapiens
tgaatttaccatcaaacaaa

SEQ ID NO: 5647999 - DNA, 15 bp, Homo sapiens
tgaatttagtgagca

SEQ ID NO: 5648000 - DNA, 17 bp, Homo sapiens
tgaatttagtgagcata

SEQ ID NO: 5648001 - DNA, 17 bp, Homo sapiens
tgaatttatataaagta

SEQ ID NO: 5648002 - DNA, 18 bp, Homo sapiens
tgaatttatatttagtaa

SEQ ID NO: 5648003 - DNA, 14 bp, Homo sapiens
tgaatttatctgaa

SEQ ID NO: 5648004 - DNA, 20 bp, Homo sapiens
tgaatttattgcacattgtt

SEQ ID NO: 5648005 - DNA, 14 bp, Homo sapiens
tgaatttattgccg

SEQ ID NO: 5648006 - DNA, 17 bp, Homo sapiens
tgaatttattggctttt

SEQ ID NO: 5648007 - DNA, 23 bp, Homo sapiens
tgaatttctaccagatgtgcttt

SEQ ID NO: 5648008 - DNA, 20 bp, Homo sapiens
tgaatttctagacagtattg

SEQ ID NO: 5648009 - DNA, 21 bp, Homo sapiens
tgaatttctatggcatattga

SEQ ID NO: 5648010 - DNA, 14 bp, Homo sapiens
tgaatttctctaca

SEQ ID NO: 5648011 - DNA, 22 bp, Homo sapiens
tgaatttctggtttgcctgaat

SEQ ID NO: 5648012 - DNA, 23 bp, Homo sapiens
tgaatttcttcactgttgaaaat

SEQ ID NO: 5648013 - DNA, 20 bp, Homo sapiens
tgaatttcttctaattattt

SEQ ID NO: 5648014 - DNA, 21 bp, Homo sapiens
tgaatttcttcttttcctgca

SEQ ID NO: 5648015 - DNA, 23 bp, Homo sapiens
tgaatttcttgatttttcagggt

SEQ ID NO: 5648016 - DNA, 17 bp, Homo sapiens
tgaatttctttgattta

SEQ ID NO: 5648017 - DNA, 18 bp, Homo sapiens
tgaatttctttgatttaa

SEQ ID NO: 5648018 - DNA, 23 bp, Homo sapiens
tgaatttcttttgccgttattaa

SEQ ID NO: 5648019 - DNA, 14 bp, Homo sapiens
tgaatttgataaaa

SEQ ID NO: 5648020 - DNA, 12 bp, Homo sapiens
tgaatttgcaaa

SEQ ID NO: 5648021 - DNA, 14 bp, Homo sapiens
tgaatttgcaaagt

SEQ ID NO: 5648022 - DNA, 16 bp, Homo sapiens
tgacattttacattaa

SEQ ID NO: 5648023 - DNA, 12 bp, Homo sapiens
tgacattttact

SEQ ID NO: 5648024 - DNA, 20 bp, Homo sapiens
tgacattttagaatgtcaat

SEQ ID NO: 5648025 - DNA, 22 bp, Homo sapiens
tgacattttagaatgtcaataa

SEQ ID NO: 5648026 - DNA, 12 bp, Homo sapiens
tgacattttatt

SEQ ID NO: 5648027 - DNA, 16 bp, Homo sapiens
tgaccaaaaccagagg

SEQ ID NO: 5648028 - DNA, 17 bp, Homo sapiens
tgaccaaaaccagaggg

SEQ ID NO: 5648029 - DNA, 22 bp, Homo sapiens
tgaccaaaagtgagatgggaag

SEQ ID NO: 5648030 - DNA, 15 bp, Homo sapiens
tgaccaaaagttaca

SEQ ID NO: 5648031 - DNA, 15 bp, Homo sapiens
tgaccaaaatgtgtt

SEQ ID NO: 5648032 - DNA, 19 bp, Homo sapiens
tgaccaaaatgtgtttcat

SEQ ID NO: 5648033 - DNA, 16 bp, Homo sapiens
tgaccaaaccagcctt

SEQ ID NO: 5648034 - DNA, 17 bp, Homo sapiens
tgaccaaaccagccttc

SEQ ID NO: 5648035 - DNA, 22 bp, Homo sapiens
tgaccaaaccagccttcggagc

SEQ ID NO: 5648036 - DNA, 16 bp, Homo sapiens
tgaccaaagactgcag

SEQ ID NO: 5648037 - DNA, 13 bp, Homo sapiens
tgaccaaagcatt

SEQ ID NO: 5648038 - DNA, 16 bp, Homo sapiens
tgaccaaagtcctttt

SEQ ID NO: 5648039 - DNA, 18 bp, Homo sapiens
tgaccaacagaaaccttt

SEQ ID NO: 5648040 - DNA, 17 bp, Homo sapiens
tgaccaacagttccttc

SEQ ID NO: 5648041 - DNA, 18 bp, Homo sapiens
tgaccaacatggagaaac

SEQ ID NO: 5648042 - DNA, 22 bp, Homo sapiens
tgaccaaccgaacatgaccaaa

SEQ ID NO: 5648043 - DNA, 15 bp, Homo sapiens
tgaccaactagacat

SEQ ID NO: 5648044 - DNA, 16 bp, Homo sapiens
tgaccaactagacatt

SEQ ID NO: 5648045 - DNA, 13 bp, Homo sapiens
tgaccaactgtgt

SEQ ID NO: 5648046 - DNA, 15 bp, Homo sapiens
tgaccaactgtgttg

SEQ ID NO: 5648047 - DNA, 15 bp, Homo sapiens
tgaccaagaactgca

SEQ ID NO: 5648048 - DNA, 18 bp, Homo sapiens
tgaccaagaactgcatgg

SEQ ID NO: 5648049 - DNA, 15 bp, Homo sapiens
tgaccaagatactta

SEQ ID NO: 5648050 - DNA, 15 bp, Homo sapiens
tgaccaagcaggaag

SEQ ID NO: 5648051 - DNA, 16 bp, Homo sapiens
tgaccaagcaggaagc

SEQ ID NO: 5648052 - DNA, 18 bp, Homo sapiens
tgaccaagcaggaagctc

SEQ ID NO: 5648053 - DNA, 21 bp, Homo sapiens
tgaccaagcaggaagctcaga

SEQ ID NO: 5648054 - DNA, 17 bp, Homo sapiens
tgaccaaggtgaagatg

SEQ ID NO: 5648055 - DNA, 18 bp, Homo sapiens
tgaccaagtataaacttt

SEQ ID NO: 5648056 - DNA, 13 bp, Homo sapiens
tgaccaataaaaa

SEQ ID NO: 5648057 - DNA, 23 bp, Homo sapiens
tgaccaatattatactaagaaaa

SEQ ID NO: 5648058 - DNA, 17 bp, Homo sapiens
tgaccaatattgtacag

SEQ ID NO: 5648059 - DNA, 21 bp, Homo sapiens
tgaccaatattgtacagtttt

SEQ ID NO: 5648060 - DNA, 19 bp, Homo sapiens
tgaccaatcgggagtagca

SEQ ID NO: 5648061 - DNA, 20 bp, Homo sapiens
tgaccaatcgggagtagcaa

SEQ ID NO: 5648062 - DNA, 14 bp, Homo sapiens
tgaccaatctctgt

SEQ ID NO: 5648063 - DNA, 19 bp, Homo sapiens
tgaccaatgggatgaggtc

SEQ ID NO: 5648064 - DNA, 19 bp, Homo sapiens
tgaccaattgccctgccag

SEQ ID NO: 5648065 - DNA, 18 bp, Homo sapiens
tgaccaattgtgctgcca

SEQ ID NO: 5648066 - DNA, 22 bp, Homo sapiens
tgaccaatttgcaccagtttta

SEQ ID NO: 5648067 - DNA, 16 bp, Homo sapiens
tgaccaattttaactt

SEQ ID NO: 5648068 - DNA, 20 bp, Homo sapiens
tgaccacaccaaccaggcct

SEQ ID NO: 5648069 - DNA, 20 bp, Homo sapiens
tgaccacacccgaagtcctg

SEQ ID NO: 5648070 - DNA, 23 bp, Homo sapiens
tgaccacacgctgtctcttgaga

SEQ ID NO: 5648071 - DNA, 12 bp, Homo sapiens
tgaccacactcc

SEQ ID NO: 5648072 - DNA, 20 bp, Homo sapiens
tgaccacactccagctggga

SEQ ID NO: 5648073 - DNA, 18 bp, Homo sapiens
tgaccacacttcctgtcc

SEQ ID NO: 5648074 - DNA, 21 bp, Homo sapiens
tgaccacagcccgctctctgg

SEQ ID NO: 5648075 - DNA, 13 bp, Homo sapiens
tgaccacaggcag

SEQ ID NO: 5648076 - DNA, 20 bp, Homo sapiens
tgaccacataagaaggcaat

SEQ ID NO: 5648077 - DNA, 23 bp, Homo sapiens
tgaccaccaaattgttatttgca

SEQ ID NO: 5648078 - DNA, 16 bp, Homo sapiens
tgaccaccccctgttc

SEQ ID NO: 5648079 - DNA, 21 bp, Homo sapiens
tgaccaccccctgttccctgt

SEQ ID NO: 5648080 - DNA, 14 bp, Homo sapiens
tgaccacccctctc

SEQ ID NO: 5648081 - DNA, 21 bp, Homo sapiens
tgaccacccctctcgcctcat

SEQ ID NO: 5648082 - DNA, 16 bp, Homo sapiens
tgaccaccctcccctc

SEQ ID NO: 5648083 - DNA, 15 bp, Homo sapiens
tgaccaccctgcctg

SEQ ID NO: 5648084 - DNA, 14 bp, Homo sapiens
tgaccacgcacctc

SEQ ID NO: 5648085 - DNA, 22 bp, Homo sapiens
tgaccacgctttctagctgttg

SEQ ID NO: 5648086 - DNA, 23 bp, Homo sapiens
tgaccacggacgtttccatcagg

SEQ ID NO: 5648087 - DNA, 16 bp, Homo sapiens
tgaccacggctgttcc

SEQ ID NO: 5648088 - DNA, 21 bp, Homo sapiens
tgaccacgtgaaatttgcctc

SEQ ID NO: 5648089 - DNA, 22 bp, Homo sapiens
tgaccacgtgaaatttgcctct

SEQ ID NO: 5648090 - DNA, 23 bp, Homo sapiens
tgaccacgtgaaatttgcctctg

SEQ ID NO: 5648091 - DNA, 18 bp, Homo sapiens
tgaccactcagagacatg

SEQ ID NO: 5648092 - DNA, 15 bp, Homo sapiens
tgaccactctgtctt

SEQ ID NO: 5648093 - DNA, 16 bp, Homo sapiens
tgaccactctgtcttg

SEQ ID NO: 5648094 - DNA, 23 bp, Homo sapiens
tgaccactcttctttaagccata

SEQ ID NO: 5648095 - DNA, 16 bp, Homo sapiens
tgaccactcttggcta

SEQ ID NO: 5648096 - DNA, 18 bp, Homo sapiens
tgaccactgcagaagaca

SEQ ID NO: 5648097 - DNA, 20 bp, Homo sapiens
tgaccactgcagaagacagt

SEQ ID NO: 5648098 - DNA, 17 bp, Homo sapiens
tgaccacttattctgta

SEQ ID NO: 5648099 - DNA, 18 bp, Homo sapiens
tgaccacttattctgtat

SEQ ID NO: 5648100 - DNA, 17 bp, Homo sapiens
tgaccacttgaggcctg

SEQ ID NO: 5648101 - DNA, 23 bp, Homo sapiens
tgaccactttttagaaagataat

SEQ ID NO: 5648102 - DNA, 18 bp, Homo sapiens
tgaccagaaacagggaca

SEQ ID NO: 5648103 - DNA, 23 bp, Homo sapiens
tgaccagaaagcttcatccacag

SEQ ID NO: 5648104 - DNA, 19 bp, Homo sapiens
tgaccagaagacaaaggcc

SEQ ID NO: 5648105 - DNA, 20 bp, Homo sapiens
tgaccagaagacaaaggccc

SEQ ID NO: 5648106 - DNA, 22 bp, Homo sapiens
tgaccagaagacaaaggcccaa

SEQ ID NO: 5648107 - DNA, 15 bp, Homo sapiens
tgaccagaagccttg

SEQ ID NO: 5648108 - DNA, 15 bp, Homo sapiens
tgaccagaccaaggc

SEQ ID NO: 5648109 - DNA, 22 bp, Homo sapiens
tgaccagaccaaggcagggccc

SEQ ID NO: 5648110 - DNA, 15 bp, Homo sapiens
tgaccagactgtggg

SEQ ID NO: 5648111 - DNA, 16 bp, Homo sapiens
tgaccagactgtgggt

SEQ ID NO: 5648112 - DNA, 15 bp, Homo sapiens
tgaccagagcaaaaa

SEQ ID NO: 5648113 - DNA, 17 bp, Homo sapiens
tgaccagataaatagaa

SEQ ID NO: 5648114 - DNA, 15 bp, Homo sapiens
tgaccagatctttct

SEQ ID NO: 5648115 - DNA, 22 bp, Homo sapiens
tgaccagatctttctcttccct

SEQ ID NO: 5648116 - DNA, 20 bp, Homo sapiens
tgaccagcaccatctctcct

SEQ ID NO: 5648117 - DNA, 16 bp, Homo sapiens
tgaccagcactgaccc

SEQ ID NO: 5648118 - DNA, 21 bp, Homo sapiens
tgaccagcagatcccagctca

SEQ ID NO: 5648119 - DNA, 17 bp, Homo sapiens
tgaccagcaggagggaa

SEQ ID NO: 5648120 - DNA, 23 bp, Homo sapiens
tgaccagcataccagttcttgca

SEQ ID NO: 5648121 - DNA, 17 bp, Homo sapiens
tgaccagccgtgagcat

SEQ ID NO: 5648122 - DNA, 20 bp, Homo sapiens
tgaccagcctgtcacccagc

SEQ ID NO: 5648123 - DNA, 21 bp, Homo sapiens
tgaccagcggaaacaggtgtg

SEQ ID NO: 5648124 - DNA, 16 bp, Homo sapiens
tgaccagcggctgctc

SEQ ID NO: 5648125 - DNA, 18 bp, Homo sapiens
tgaccagcggctgctcaa

SEQ ID NO: 5648126 - DNA, 21 bp, Homo sapiens
tgaccagcggctgctcaagcc

SEQ ID NO: 5648127 - DNA, 16 bp, Homo sapiens
tgaccagctccccctc

SEQ ID NO: 5648128 - DNA, 13 bp, Homo sapiens
tgaccagctctct

SEQ ID NO: 5648129 - DNA, 17 bp, Homo sapiens
tgaccagctctcttcct

SEQ ID NO: 5648130 - DNA, 19 bp, Homo sapiens
tgaccaggatggagcaagc

SEQ ID NO: 5648131 - DNA, 20 bp, Homo sapiens
tgaccaggatggagcaagct

SEQ ID NO: 5648132 - DNA, 13 bp, Homo sapiens
tgaccaggccacc

SEQ ID NO: 5648133 - DNA, 16 bp, Homo sapiens
tgaccaggccaccatc

SEQ ID NO: 5648134 - DNA, 16 bp, Homo sapiens
tgaccaggcccaagga

SEQ ID NO: 5648135 - DNA, 12 bp, Homo sapiens
tgaccaggcctg

SEQ ID NO: 5648136 - DNA, 13 bp, Homo sapiens
tgaccaggcctgg

SEQ ID NO: 5648137 - DNA, 20 bp, Homo sapiens
tgaccaggcctgggccagag

SEQ ID NO: 5648138 - DNA, 19 bp, Homo sapiens
tgaccaggctggagtgaag

SEQ ID NO: 5648139 - DNA, 20 bp, Homo sapiens
tgaccaggcttttgtagatg

SEQ ID NO: 5648140 - DNA, 13 bp, Homo sapiens
tgaccagggaagt

SEQ ID NO: 5648141 - DNA, 15 bp, Homo sapiens
tgaccagggcaaggc

SEQ ID NO: 5648142 - DNA, 19 bp, Homo sapiens
tgaccaggggccctacctg

SEQ ID NO: 5648143 - DNA, 17 bp, Homo sapiens
tgaccagtgcctgtgag

SEQ ID NO: 5648144 - DNA, 18 bp, Homo sapiens
tgaccagtgcctgtgagc

SEQ ID NO: 5648145 - DNA, 16 bp, Homo sapiens
tgaccagttctggcca

SEQ ID NO: 5648146 - DNA, 20 bp, Homo sapiens
tgaccagttgcacttggcct

SEQ ID NO: 5648147 - DNA, 17 bp, Homo sapiens
tgaccagttgcagtcac

SEQ ID NO: 5648148 - DNA, 20 bp, Homo sapiens
tgaccagtttaacctgatgc

SEQ ID NO: 5648149 - DNA, 19 bp, Homo sapiens
tgaccagtttaagccgcag

SEQ ID NO: 5648150 - DNA, 13 bp, Homo sapiens
tgaccagtttctt

SEQ ID NO: 5648151 - DNA, 15 bp, Homo sapiens
tgaccagtttcttaa

SEQ ID NO: 5648152 - DNA, 16 bp, Homo sapiens
tgaccataaattaatt

SEQ ID NO: 5648153 - DNA, 20 bp, Homo sapiens
tgaccataacagtgccagct

SEQ ID NO: 5648154 - DNA, 15 bp, Homo sapiens
tgaccataatttttt

SEQ ID NO: 5648155 - DNA, 19 bp, Homo sapiens
tgaccataattttttttaa

SEQ ID NO: 5648156 - DNA, 20 bp, Homo sapiens
tgaccatacaatttcatcct

SEQ ID NO: 5648157 - DNA, 20 bp, Homo sapiens
tgaccatactaataaatata

SEQ ID NO: 5648158 - DNA, 23 bp, Homo sapiens
tgaccatactaataaatataatt

SEQ ID NO: 5648159 - DNA, 16 bp, Homo sapiens
tgaccatactgaggga

SEQ ID NO: 5648160 - DNA, 15 bp, Homo sapiens
tgaccatctgctttt

SEQ ID NO: 5648161 - DNA, 13 bp, Homo sapiens
tgaccatctgtga

SEQ ID NO: 5648162 - DNA, 14 bp, Homo sapiens
tgaccatctgtgac

SEQ ID NO: 5648163 - DNA, 23 bp, Homo sapiens
tgaccatctgtgactataaagct

SEQ ID NO: 5648164 - DNA, 16 bp, Homo sapiens
tgaccatgaaagactt

SEQ ID NO: 5648165 - DNA, 23 bp, Homo sapiens
tgaccatgcactatatttgtata

SEQ ID NO: 5648166 - DNA, 19 bp, Homo sapiens
tgaccatgcattttaccat

SEQ ID NO: 5648167 - DNA, 18 bp, Homo sapiens
tgaccatggttttggctc

SEQ ID NO: 5648168 - DNA, 15 bp, Homo sapiens
tgaccatgtctatga

SEQ ID NO: 5648169 - DNA, 12 bp, Homo sapiens
tgaccatgtgat

SEQ ID NO: 5648170 - DNA, 14 bp, Homo sapiens
tgaccatgtggttc

SEQ ID NO: 5648171 - DNA, 18 bp, Homo sapiens
tgaccatgttatattgct

SEQ ID NO: 5648172 - DNA, 14 bp, Homo sapiens
tgaccatgttcatt

SEQ ID NO: 5648173 - DNA, 14 bp, Homo sapiens
tgaccattaataaa

SEQ ID NO: 5648174 - DNA, 16 bp, Homo sapiens
tgaccattattcacag

SEQ ID NO: 5648175 - DNA, 13 bp, Homo sapiens
tgaccattctcca

SEQ ID NO: 5648176 - DNA, 17 bp, Homo sapiens
tgaccattctccacctg

SEQ ID NO: 5648177 - DNA, 23 bp, Homo sapiens
tgaccattctccacctgccaggg

SEQ ID NO: 5648178 - DNA, 13 bp, Homo sapiens
tgaccattctgcc

SEQ ID NO: 5648179 - DNA, 15 bp, Homo sapiens
tgaccattgaaaaag

SEQ ID NO: 5648180 - DNA, 18 bp, Homo sapiens
tgaccattgaaaaaggaa

SEQ ID NO: 5648181 - DNA, 19 bp, Homo sapiens
tgaccattgaaaaaggaaa

SEQ ID NO: 5648182 - DNA, 20 bp, Homo sapiens
tgaccattgaaaaaggaaaa

SEQ ID NO: 5648183 - DNA, 19 bp, Homo sapiens
tgaccattgagtccctgct

SEQ ID NO: 5648184 - DNA, 23 bp, Homo sapiens
tgaccattggctgcgctaacccc

SEQ ID NO: 5648185 - DNA, 14 bp, Homo sapiens
tgaccatttataat

SEQ ID NO: 5648186 - DNA, 23 bp, Homo sapiens
tgaccatttataatgttagtaga

SEQ ID NO: 5648187 - DNA, 16 bp, Homo sapiens
tgacccaaagaccaat

SEQ ID NO: 5648188 - DNA, 19 bp, Homo sapiens
tgacccaaagcaaaacatc

SEQ ID NO: 5648189 - DNA, 21 bp, Homo sapiens
tgacccaaatctcttccacaa

SEQ ID NO: 5648190 - DNA, 15 bp, Homo sapiens
tgacccaactgatcc

SEQ ID NO: 5648191 - DNA, 20 bp, Homo sapiens
tgacccaactgatcctgctc

SEQ ID NO: 5648192 - DNA, 16 bp, Homo sapiens
tgacccaactgggggc

SEQ ID NO: 5648193 - DNA, 22 bp, Homo sapiens
tgacccaagaactcctgaaatc

SEQ ID NO: 5648194 - DNA, 17 bp, Homo sapiens
tgacccaatgctcctgg

SEQ ID NO: 5648195 - DNA, 14 bp, Homo sapiens
tgacccaattaagt

SEQ ID NO: 5648196 - DNA, 19 bp, Homo sapiens
tgacccacaaagtttcaga

SEQ ID NO: 5648197 - DNA, 13 bp, Homo sapiens
tgacccacactgc

SEQ ID NO: 5648198 - DNA, 14 bp, Homo sapiens
tgacccacactgcc

SEQ ID NO: 5648199 - DNA, 19 bp, Homo sapiens
tgactccaccttctcacct

SEQ ID NO: 5648200 - DNA, 21 bp, Homo sapiens
tgactccacgatcctgccacc

SEQ ID NO: 5648201 - DNA, 16 bp, Homo sapiens
tgactccactcaaaga

SEQ ID NO: 5648202 - DNA, 17 bp, Homo sapiens
tgactccagaatttccc

SEQ ID NO: 5648203 - DNA, 18 bp, Homo sapiens
tgactccagagtctgagc

SEQ ID NO: 5648204 - DNA, 19 bp, Homo sapiens
tgactccagagtctgagcc

SEQ ID NO: 5648205 - DNA, 21 bp, Homo sapiens
tgactccagagtctgagcccc

SEQ ID NO: 5648206 - DNA, 14 bp, Homo sapiens
tgactccaggagag

SEQ ID NO: 5648207 - DNA, 18 bp, Homo sapiens
tgactccaggagaggagc

SEQ ID NO: 5648208 - DNA, 18 bp, Homo sapiens
tgactccagtataatctc

SEQ ID NO: 5648209 - DNA, 17 bp, Homo sapiens
tgactccagtgagctgg

SEQ ID NO: 5648210 - DNA, 21 bp, Homo sapiens
tgactccatagaccttttcat

SEQ ID NO: 5648211 - DNA, 13 bp, Homo sapiens
tgactcccatgca

SEQ ID NO: 5648212 - DNA, 22 bp, Homo sapiens
tgactcccatgcaagtagctgg

SEQ ID NO: 5648213 - DNA, 23 bp, Homo sapiens
tgactcccattttggtgtgcatc

SEQ ID NO: 5648214 - DNA, 16 bp, Homo sapiens
tgactccccagcccag

SEQ ID NO: 5648215 - DNA, 17 bp, Homo sapiens
tgactccccagcccagc

SEQ ID NO: 5648216 - DNA, 18 bp, Homo sapiens
tgactccccagcccagca

SEQ ID NO: 5648217 - DNA, 20 bp, Homo sapiens
tgactccccagcccagcacc

SEQ ID NO: 5648218 - DNA, 18 bp, Homo sapiens
tgactcccccagtcccct

SEQ ID NO: 5648219 - DNA, 19 bp, Homo sapiens
tgactccctccccacccaa

SEQ ID NO: 5648220 - DNA, 21 bp, Homo sapiens
tgactccctgggagccgcctg

SEQ ID NO: 5648221 - DNA, 23 bp, Homo sapiens
tgactccctgtgggggtggccat

SEQ ID NO: 5648222 - DNA, 16 bp, Homo sapiens
tgactccgtcaagctg

SEQ ID NO: 5648223 - DNA, 20 bp, Homo sapiens
tgactcctacctgccctgga

SEQ ID NO: 5648224 - DNA, 17 bp, Homo sapiens
tgactcctctaagccac

SEQ ID NO: 5648225 - DNA, 15 bp, Homo sapiens
tgactcctggactcc

SEQ ID NO: 5648226 - DNA, 14 bp, Homo sapiens
tgactcctggtcct

SEQ ID NO: 5648227 - DNA, 20 bp, Homo sapiens
tgactccttatctctttcca

SEQ ID NO: 5648228 - DNA, 15 bp, Homo sapiens
tgactccttctgcca

SEQ ID NO: 5648229 - DNA, 14 bp, Homo sapiens
tgactccttttgga

SEQ ID NO: 5648230 - DNA, 23 bp, Homo sapiens
tgactcgaaactgacagtattaa

SEQ ID NO: 5648231 - DNA, 22 bp, Homo sapiens
tgactcgacaaaggccacaggc

SEQ ID NO: 5648232 - DNA, 21 bp, Homo sapiens
tgactcgagggttgggttcat

SEQ ID NO: 5648233 - DNA, 22 bp, Homo sapiens
tgactcgatttaaactccagca

SEQ ID NO: 5648234 - DNA, 14 bp, Homo sapiens
tgactcgccataaa

SEQ ID NO: 5648235 - DNA, 22 bp, Homo sapiens
tgactcgccataaatcagccgc

SEQ ID NO: 5648236 - DNA, 20 bp, Homo sapiens
tgactcgggagctgcacaca

SEQ ID NO: 5648237 - DNA, 15 bp, Homo sapiens
tgactcgggctcctg

SEQ ID NO: 5648238 - DNA, 18 bp, Homo sapiens
tgactcgggctcctgtgc

SEQ ID NO: 5648239 - DNA, 16 bp, Homo sapiens
tgactcgggggtgggg

SEQ ID NO: 5648240 - DNA, 17 bp, Homo sapiens
tgactcgggggtgggga

SEQ ID NO: 5648241 - DNA, 14 bp, Homo sapiens
tgactcggtgtaaa

SEQ ID NO: 5648242 - DNA, 19 bp, Homo sapiens
tgactcggtgtaaaaccat

SEQ ID NO: 5648243 - DNA, 21 bp, Homo sapiens
tgactcggtgtaaaaccatgt

SEQ ID NO: 5648244 - DNA, 16 bp, Homo sapiens
tgactcgtctgactgt

SEQ ID NO: 5648245 - DNA, 15 bp, Homo sapiens
tgactcgttacctgc

SEQ ID NO: 5648246 - DNA, 16 bp, Homo sapiens
tgactcgttacctgcc

SEQ ID NO: 5648247 - DNA, 15 bp, Homo sapiens
tgactcgttttattt

SEQ ID NO: 5648248 - DNA, 15 bp, Homo sapiens
tgactctaaaatatg

SEQ ID NO: 5648249 - DNA, 14 bp, Homo sapiens
tgactctaaatgca

SEQ ID NO: 5648250 - DNA, 12 bp, Homo sapiens
tgactctaaatt

SEQ ID NO: 5648251 - DNA, 19 bp, Homo sapiens
tgactctagtactgtgaat

SEQ ID NO: 5648252 - DNA, 16 bp, Homo sapiens
tgactctataagcaaa

SEQ ID NO: 5648253 - DNA, 21 bp, Homo sapiens
tgactctataagcaaattgct

SEQ ID NO: 5648254 - DNA, 11 bp, Homo sapiens
tgactctccac

SEQ ID NO: 5648255 - DNA, 14 bp, Homo sapiens
tgactctccaggga

SEQ ID NO: 5648256 - DNA, 12 bp, Homo sapiens
tgactctctcca

SEQ ID NO: 5648257 - DNA, 15 bp, Homo sapiens
tgactctctgtgacc

SEQ ID NO: 5648258 - DNA, 18 bp, Homo sapiens
tgactctgagtccactgc

SEQ ID NO: 5648259 - DNA, 20 bp, Homo sapiens
tgactctgagtccactgctc

SEQ ID NO: 5648260 - DNA, 15 bp, Homo sapiens
tgactctgccccctg

SEQ ID NO: 5648261 - DNA, 21 bp, Homo sapiens
tgactctgcctaaccatgggc

SEQ ID NO: 5648262 - DNA, 21 bp, Homo sapiens
tgactctggaaccatcctctg

SEQ ID NO: 5648263 - DNA, 18 bp, Homo sapiens
tgactctggaccatgctg

SEQ ID NO: 5648264 - DNA, 21 bp, Homo sapiens
tgactctggaccatgctgaga

SEQ ID NO: 5648265 - DNA, 14 bp, Homo sapiens
tgactctgggcagg

SEQ ID NO: 5648266 - DNA, 11 bp, Homo sapiens
tgactctgggg

SEQ ID NO: 5648267 - DNA, 13 bp, Homo sapiens
tgactctgggtcc

SEQ ID NO: 5648268 - DNA, 17 bp, Homo sapiens
tgactctgggtccttcc

SEQ ID NO: 5648269 - DNA, 21 bp, Homo sapiens
tgactctgggttcgttgggga

SEQ ID NO: 5648270 - DNA, 12 bp, Homo sapiens
tgactcttaaga

SEQ ID NO: 5648271 - DNA, 15 bp, Homo sapiens
tgactcttaagaaga

SEQ ID NO: 5648272 - DNA, 14 bp, Homo sapiens
tgactcttatttat

SEQ ID NO: 5648273 - DNA, 19 bp, Homo sapiens
tgactcttatttatagaat

SEQ ID NO: 5648274 - DNA, 18 bp, Homo sapiens
tgactcttccattcagtt

SEQ ID NO: 5648275 - DNA, 15 bp, Homo sapiens
tgactcttccgtgca

SEQ ID NO: 5648276 - DNA, 14 bp, Homo sapiens
tgactcttcttatc

SEQ ID NO: 5648277 - DNA, 23 bp, Homo sapiens
tgactcttcttatcacacttgca

SEQ ID NO: 5648278 - DNA, 22 bp, Homo sapiens
tgactcttgaataaaaataact

SEQ ID NO: 5648279 - DNA, 15 bp, Homo sapiens
tgactcttggagcct

SEQ ID NO: 5648280 - DNA, 23 bp, Homo sapiens
tgactcttggagcctctttttcc

SEQ ID NO: 5648281 - DNA, 21 bp, Homo sapiens
tgactctttattgtctgtaaa

SEQ ID NO: 5648282 - DNA, 14 bp, Homo sapiens
tgactctttcaaag

SEQ ID NO: 5648283 - DNA, 19 bp, Homo sapiens
tgactctttccaaccggct

SEQ ID NO: 5648284 - DNA, 22 bp, Homo sapiens
tgactctttttagggccaggca

SEQ ID NO: 5648285 - DNA, 21 bp, Homo sapiens
tgactgaaaaaaaaaaagaag

SEQ ID NO: 5648286 - DNA, 13 bp, Homo sapiens
tgactgaaattac

SEQ ID NO: 5648287 - DNA, 22 bp, Homo sapiens
tgactgaaattactttaacatt

SEQ ID NO: 5648288 - DNA, 21 bp, Homo sapiens
tgactgaacgatccttcaaag

SEQ ID NO: 5648289 - DNA, 23 bp, Homo sapiens
tgactgaactagagcttgcagtg

SEQ ID NO: 5648290 - DNA, 17 bp, Homo sapiens
tgactgaactgcacgtt

SEQ ID NO: 5648291 - DNA, 14 bp, Homo sapiens
tgactgaactggga

SEQ ID NO: 5648292 - DNA, 17 bp, Homo sapiens
tgactgaagccgtgcct

SEQ ID NO: 5648293 - DNA, 19 bp, Homo sapiens
tgactgaagcgaacatctt

SEQ ID NO: 5648294 - DNA, 20 bp, Homo sapiens
tgactgaagcgaacatcttc

SEQ ID NO: 5648295 - DNA, 23 bp, Homo sapiens
tgactgaagcgaacatcttcata

SEQ ID NO: 5648296 - DNA, 18 bp, Homo sapiens
tgactgaaggggcacacc

SEQ ID NO: 5648297 - DNA, 14 bp, Homo sapiens
tgactgaatttctt

SEQ ID NO: 5648298 - DNA, 16 bp, Homo sapiens
tgactgacaaagacat

SEQ ID NO: 5648299 - DNA, 14 bp, Homo sapiens
tgactgacacaggc

SEQ ID NO: 5648300 - DNA, 22 bp, Homo sapiens
tgactgacacaggccagcccca

SEQ ID NO: 5648301 - DNA, 16 bp, Homo sapiens
tgactgagatttgtaa

SEQ ID NO: 5648302 - DNA, 17 bp, Homo sapiens
tgactgagatttgtaaa

SEQ ID NO: 5648303 - DNA, 22 bp, Homo sapiens
tgactgagcaagaccctgtctc

SEQ ID NO: 5648304 - DNA, 15 bp, Homo sapiens
tgactgagcagactg

SEQ ID NO: 5648305 - DNA, 21 bp, Homo sapiens
tgactgagcgtagcatacagg

SEQ ID NO: 5648306 - DNA, 15 bp, Homo sapiens
tgactgagcttccct

SEQ ID NO: 5648307 - DNA, 14 bp, Homo sapiens
tgactgaggcctgc

SEQ ID NO: 5648308 - DNA, 15 bp, Homo sapiens
tgactgaggcctgct

SEQ ID NO: 5648309 - DNA, 22 bp, Homo sapiens
tgactgaggcctgcttccccct

SEQ ID NO: 5648310 - DNA, 23 bp, Homo sapiens
tgactgatagcttacactgagga

SEQ ID NO: 5648311 - DNA, 15 bp, Homo sapiens
tgactgatgattttc

SEQ ID NO: 5648312 - DNA, 17 bp, Homo sapiens
tgactgatgttcatgat

SEQ ID NO: 5648313 - DNA, 13 bp, Homo sapiens
tgactgatgttgt

SEQ ID NO: 5648314 - DNA, 13 bp, Homo sapiens
tgactgattcttc

SEQ ID NO: 5648315 - DNA, 14 bp, Homo sapiens
tgactgattcttca

SEQ ID NO: 5648316 - DNA, 19 bp, Homo sapiens
tgactgcaacttctgtccc

SEQ ID NO: 5648317 - DNA, 18 bp, Homo sapiens
tgactgcacgtggcttct

SEQ ID NO: 5648318 - DNA, 22 bp, Homo sapiens
tgactgcacgtggcttctgatg

SEQ ID NO: 5648319 - DNA, 17 bp, Homo sapiens
tgactgcatcatatatt

SEQ ID NO: 5648320 - DNA, 21 bp, Homo sapiens
tgactgcattttactgtacag

SEQ ID NO: 5648321 - DNA, 14 bp, Homo sapiens
tgactgccaagact

SEQ ID NO: 5648322 - DNA, 14 bp, Homo sapiens
tgactgccaagcca

SEQ ID NO: 5648323 - DNA, 16 bp, Homo sapiens
tgactgccaagccaga

SEQ ID NO: 5648324 - DNA, 20 bp, Homo sapiens
tgactgccaagccagattct

SEQ ID NO: 5648325 - DNA, 24 bp, Homo sapiens
tgactgccaggaccccaggtcagg

SEQ ID NO: 5648326 - DNA, 18 bp, Homo sapiens
tgactgcccattcaccaa

SEQ ID NO: 5648327 - DNA, 16 bp, Homo sapiens
tgactgccccaactcc

SEQ ID NO: 5648328 - DNA, 19 bp, Homo sapiens
tgactgccccaactcctgg

SEQ ID NO: 5648329 - DNA, 22 bp, Homo sapiens
tgactgccccttctatgctgct

SEQ ID NO: 5648330 - DNA, 19 bp, Homo sapiens
tgactgccctcttactgtt

SEQ ID NO: 5648331 - DNA, 23 bp, Homo sapiens
tgactgcctatgccaagtccctg

SEQ ID NO: 5648332 - DNA, 14 bp, Homo sapiens
tgactgccttgcct

SEQ ID NO: 5648333 - DNA, 13 bp, Homo sapiens
tgactgcgcagag

SEQ ID NO: 5648334 - DNA, 16 bp, Homo sapiens
tgactgctcagaactt

SEQ ID NO: 5648335 - DNA, 21 bp, Homo sapiens
tgactgctccccagccctggc

SEQ ID NO: 5648336 - DNA, 22 bp, Homo sapiens
tgactgctccccagccctggct

SEQ ID NO: 5648337 - DNA, 15 bp, Homo sapiens
tgactgctgattctc

SEQ ID NO: 5648338 - DNA, 15 bp, Homo sapiens
tgactgctgcctccc

SEQ ID NO: 5648339 - DNA, 15 bp, Homo sapiens
tgactgctgcgctgt

SEQ ID NO: 5648340 - DNA, 13 bp, Homo sapiens
tgactggaaacaa

SEQ ID NO: 5648341 - DNA, 14 bp, Homo sapiens
tgactggaattttt

SEQ ID NO: 5648342 - DNA, 19 bp, Homo sapiens
tgactggaatttttattat

SEQ ID NO: 5648343 - DNA, 23 bp, Homo sapiens
tgactggaatttttattatgcat

SEQ ID NO: 5648344 - DNA, 12 bp, Homo sapiens
tgactggacagc

SEQ ID NO: 5648345 - DNA, 21 bp, Homo sapiens
tgactggacagcggttgtaaa

SEQ ID NO: 5648346 - DNA, 15 bp, Homo sapiens
tgactggagcccgag

SEQ ID NO: 5648347 - DNA, 23 bp, Homo sapiens
tgactggaggaggcctgtcccaa

SEQ ID NO: 5648348 - DNA, 13 bp, Homo sapiens
tgactggagtaaa

SEQ ID NO: 5648349 - DNA, 21 bp, Homo sapiens
tgactggatcttctatcattc

SEQ ID NO: 5648350 - DNA, 19 bp, Homo sapiens
tgactggcaagaggcctca

SEQ ID NO: 5648351 - DNA, 21 bp, Homo sapiens
tgactggcattttatagacac

SEQ ID NO: 5648352 - DNA, 18 bp, Homo sapiens
tgactggccaaaaatatc

SEQ ID NO: 5648353 - DNA, 19 bp, Homo sapiens
tgactggccacacaggatc

SEQ ID NO: 5648354 - DNA, 14 bp, Homo sapiens
tgactggccagttg

SEQ ID NO: 5648355 - DNA, 22 bp, Homo sapiens
tgactggccagttgcccagagc

SEQ ID NO: 5648356 - DNA, 11 bp, Homo sapiens
tgactggcctg

SEQ ID NO: 5648357 - DNA, 14 bp, Homo sapiens
tgactggctcctga

SEQ ID NO: 5648358 - DNA, 16 bp, Homo sapiens
tgactggctgtctgcc

SEQ ID NO: 5648359 - DNA, 12 bp, Homo sapiens
tgactgggaaag

SEQ ID NO: 5648360 - DNA, 23 bp, Homo sapiens
tgactgggcaacactgcaggaca

SEQ ID NO: 5648361 - DNA, 21 bp, Homo sapiens
tgactgggccctgcctctgtt

SEQ ID NO: 5648362 - DNA, 14 bp, Homo sapiens
tgactgggccctgt

SEQ ID NO: 5648363 - DNA, 15 bp, Homo sapiens
tgactgggccctgtc

SEQ ID NO: 5648364 - DNA, 19 bp, Homo sapiens
tgactgggccctgtccagg

SEQ ID NO: 5648365 - DNA, 12 bp, Homo sapiens
tgactgggctgg

SEQ ID NO: 5648366 - DNA, 15 bp, Homo sapiens
tgactgggctgggtt

SEQ ID NO: 5648367 - DNA, 17 bp, Homo sapiens
tgactgggctgggtttg

SEQ ID NO: 5648368 - DNA, 20 bp, Homo sapiens
tgactgggctgggtttgctg

SEQ ID NO: 5648369 - DNA, 22 bp, Homo sapiens
tgactgggctgggtttgctgtc

SEQ ID NO: 5648370 - DNA, 17 bp, Homo sapiens
tgactggggagggctgc

SEQ ID NO: 5648371 - DNA, 11 bp, Homo sapiens
tgactggggct

SEQ ID NO: 5648372 - DNA, 19 bp, Homo sapiens
tgactggggctggggtgag

SEQ ID NO: 5648373 - DNA, 12 bp, Homo sapiens
tgactgggggcc

SEQ ID NO: 5648374 - DNA, 17 bp, Homo sapiens
tgactgggggcctctgc

SEQ ID NO: 5648375 - DNA, 19 bp, Homo sapiens
tgactgggggcctctgcct

SEQ ID NO: 5648376 - DNA, 15 bp, Homo sapiens
tgagacggcagagac

SEQ ID NO: 5648377 - DNA, 16 bp, Homo sapiens
tgagactaaatgagag

SEQ ID NO: 5648378 - DNA, 19 bp, Homo sapiens
tgagactaaattcaatcac

SEQ ID NO: 5648379 - DNA, 21 bp, Homo sapiens
tgagactaatcttattcattt

SEQ ID NO: 5648380 - DNA, 19 bp, Homo sapiens
tgagactacaagtgtgtgc

SEQ ID NO: 5648381 - DNA, 20 bp, Homo sapiens
tgagactagattctcacctg

SEQ ID NO: 5648382 - DNA, 20 bp, Homo sapiens
tgagactataaagcagtaga

SEQ ID NO: 5648383 - DNA, 18 bp, Homo sapiens
tgagactatgcgttttta

SEQ ID NO: 5648384 - DNA, 18 bp, Homo sapiens
tgagactattatgaaatc

SEQ ID NO: 5648385 - DNA, 20 bp, Homo sapiens
tgagactcagacaggaaagg

SEQ ID NO: 5648386 - DNA, 18 bp, Homo sapiens
tgagactcagtgcagatg

SEQ ID NO: 5648387 - DNA, 14 bp, Homo sapiens
tgagactccatctc

SEQ ID NO: 5648388 - DNA, 15 bp, Homo sapiens
tgagactcctcagca

SEQ ID NO: 5648389 - DNA, 16 bp, Homo sapiens
tgagactcctcagcac

SEQ ID NO: 5648390 - DNA, 18 bp, Homo sapiens
tgagactcctcagcaccc

SEQ ID NO: 5648391 - DNA, 20 bp, Homo sapiens
tgagactcgcgacaatgcaa

SEQ ID NO: 5648392 - DNA, 22 bp, Homo sapiens
tgagactcgcgacaatgcaaac

SEQ ID NO: 5648393 - DNA, 17 bp, Homo sapiens
tgagactcggccgcagc

SEQ ID NO: 5648394 - DNA, 15 bp, Homo sapiens
tgagactcgtctcaa

SEQ ID NO: 5648395 - DNA, 23 bp, Homo sapiens
tgagactctcttaggagcagagc

SEQ ID NO: 5648396 - DNA, 12 bp, Homo sapiens
tgagactcttaa

SEQ ID NO: 5648397 - DNA, 18 bp, Homo sapiens
tgagactctttagagcag

SEQ ID NO: 5648398 - DNA, 21 bp, Homo sapiens
tgagactgaaagaaactaaga

SEQ ID NO: 5648399 - DNA, 15 bp, Homo sapiens
tgagactgagagggc

SEQ ID NO: 5648400 - DNA, 21 bp, Homo sapiens
tgagactgatccctggccact

SEQ ID NO: 5648401 - DNA, 17 bp, Homo sapiens
tgagactgcaggtgggc

SEQ ID NO: 5648402 - DNA, 14 bp, Homo sapiens
tgagactgccccac

SEQ ID NO: 5648403 - DNA, 17 bp, Homo sapiens
tgagactgccctgccca

SEQ ID NO: 5648404 - DNA, 20 bp, Homo sapiens
tgagactgccctgcccaggt

SEQ ID NO: 5648405 - DNA, 23 bp, Homo sapiens
tgagactgcgccacggcactcca

SEQ ID NO: 5648406 - DNA, 19 bp, Homo sapiens
tgagactggaaaaggtgga

SEQ ID NO: 5648407 - DNA, 13 bp, Homo sapiens
tgagactggcact

SEQ ID NO: 5648408 - DNA, 13 bp, Homo sapiens
tgagactggcaga

SEQ ID NO: 5648409 - DNA, 17 bp, Homo sapiens
tgagactgggaacttga

SEQ ID NO: 5648410 - DNA, 22 bp, Homo sapiens
tgagactggggccactacattt

SEQ ID NO: 5648411 - DNA, 18 bp, Homo sapiens
tgagactgggtctcgctt

SEQ ID NO: 5648412 - DNA, 16 bp, Homo sapiens
tgagactgtacataat

SEQ ID NO: 5648413 - DNA, 16 bp, Homo sapiens
tgagactgtcaggaag

SEQ ID NO: 5648414 - DNA, 14 bp, Homo sapiens
tgagactgtcctgt

SEQ ID NO: 5648415 - DNA, 13 bp, Homo sapiens
tgagactgtgctg

SEQ ID NO: 5648416 - DNA, 16 bp, Homo sapiens
tgagacttaattttgt

SEQ ID NO: 5648417 - DNA, 21 bp, Homo sapiens
tgagacttacgccctgttccc

SEQ ID NO: 5648418 - DNA, 19 bp, Homo sapiens
tgagacttgccttcctaag

SEQ ID NO: 5648419 - DNA, 14 bp, Homo sapiens
tgagacttgctctc

SEQ ID NO: 5648420 - DNA, 22 bp, Homo sapiens
tgagacttgttcttggttcctg

SEQ ID NO: 5648421 - DNA, 13 bp, Homo sapiens
tgagactttaaaa

SEQ ID NO: 5648422 - DNA, 15 bp, Homo sapiens
tgagactttcccctc

SEQ ID NO: 5648423 - DNA, 20 bp, Homo sapiens
tgagactttccgactgcttt

SEQ ID NO: 5648424 - DNA, 14 bp, Homo sapiens
tgagactttctgct

SEQ ID NO: 5648425 - DNA, 22 bp, Homo sapiens
tgagactttcttctagtgcttt

SEQ ID NO: 5648426 - DNA, 14 bp, Homo sapiens
tgagactttctttc

SEQ ID NO: 5648427 - DNA, 14 bp, Homo sapiens
tgagactttttggt

SEQ ID NO: 5648428 - DNA, 15 bp, Homo sapiens
tgagactttttggtg

SEQ ID NO: 5648429 - DNA, 13 bp, Homo sapiens
tgagagaaaagaa

SEQ ID NO: 5648430 - DNA, 19 bp, Homo sapiens
tgagagaaaagaaaaatat

SEQ ID NO: 5648431 - DNA, 17 bp, Homo sapiens
tgagagaaagagagaag

SEQ ID NO: 5648432 - DNA, 21 bp, Homo sapiens
tgagagaaagagagaagccag

SEQ ID NO: 5648433 - DNA, 16 bp, Homo sapiens
tgagagaagccacgct

SEQ ID NO: 5648434 - DNA, 17 bp, Homo sapiens
tgagagaagccacgctg

SEQ ID NO: 5648435 - DNA, 21 bp, Homo sapiens
tgagagaagccacgctgtcct

SEQ ID NO: 5648436 - DNA, 16 bp, Homo sapiens
tgagagaaggtgaaat

SEQ ID NO: 5648437 - DNA, 20 bp, Homo sapiens
tgagagaataatttctgttg

SEQ ID NO: 5648438 - DNA, 14 bp, Homo sapiens
tgagagaatggaaa

SEQ ID NO: 5648439 - DNA, 23 bp, Homo sapiens
tgagagaatggaaaacagactca

SEQ ID NO: 5648440 - DNA, 20 bp, Homo sapiens
tgagagaatgggtttactct

SEQ ID NO: 5648441 - DNA, 20 bp, Homo sapiens
tgagagacacactgaagaag

SEQ ID NO: 5648442 - DNA, 20 bp, Homo sapiens
tgagagacccaaggaggaaa

SEQ ID NO: 5648443 - DNA, 15 bp, Homo sapiens
tgagagacctgctca

SEQ ID NO: 5648444 - DNA, 18 bp, Homo sapiens
tgagagacctgctcaggc

SEQ ID NO: 5648445 - DNA, 15 bp, Homo sapiens
tgagagacctgtgtg

SEQ ID NO: 5648446 - DNA, 18 bp, Homo sapiens
tgagagacgccactccct

SEQ ID NO: 5648447 - DNA, 21 bp, Homo sapiens
tgagagacggtgtcttgttct

SEQ ID NO: 5648448 - DNA, 14 bp, Homo sapiens
tgagagactgccat

SEQ ID NO: 5648449 - DNA, 19 bp, Homo sapiens
tgagagagaaatgctgttc

SEQ ID NO: 5648450 - DNA, 23 bp, Homo sapiens
tgagagagaagtcggccaggtag

SEQ ID NO: 5648451 - DNA, 22 bp, Homo sapiens
tgagagagaatagagctgccac

SEQ ID NO: 5648452 - DNA, 18 bp, Homo sapiens
tgagagagaatgaggaag

SEQ ID NO: 5648453 - DNA, 12 bp, Homo sapiens
tgagagagactg

SEQ ID NO: 5648454 - DNA, 17 bp, Homo sapiens
tgagagagactgatggg

SEQ ID NO: 5648455 - DNA, 18 bp, Homo sapiens
tgagagagagactgtgtg

SEQ ID NO: 5648456 - DNA, 22 bp, Homo sapiens
tgagagagatgggagctcctct

SEQ ID NO: 5648457 - DNA, 14 bp, Homo sapiens
tgagagagatgtgt

SEQ ID NO: 5648458 - DNA, 16 bp, Homo sapiens
tgagagagcagccagg

SEQ ID NO: 5648459 - DNA, 17 bp, Homo sapiens
tgagagagcagccagga

SEQ ID NO: 5648460 - DNA, 23 bp, Homo sapiens
tgagagaggacctccatgccccc

SEQ ID NO: 5648461 - DNA, 18 bp, Homo sapiens
tgagagaggctaaaatgt

SEQ ID NO: 5648462 - DNA, 23 bp, Homo sapiens
tgagagagtgctgagaaggacac

SEQ ID NO: 5648463 - DNA, 11 bp, Homo sapiens
tgagagagtgt

SEQ ID NO: 5648464 - DNA, 20 bp, Homo sapiens
tgagagagttgctcctcagg

SEQ ID NO: 5648465 - DNA, 18 bp, Homo sapiens
tgagagatggggcggggg

SEQ ID NO: 5648466 - DNA, 14 bp, Homo sapiens
tgagagattctgtg

SEQ ID NO: 5648467 - DNA, 22 bp, Homo sapiens
tgagagcaaagggaaggactga

SEQ ID NO: 5648468 - DNA, 21 bp, Homo sapiens
tgagagcaaatgcaaaaataa

SEQ ID NO: 5648469 - DNA, 22 bp, Homo sapiens
tgagagcagagcccccatggcc

SEQ ID NO: 5648470 - DNA, 14 bp, Homo sapiens
tgagagcagggctg

SEQ ID NO: 5648471 - DNA, 15 bp, Homo sapiens
tgagagcataattta

SEQ ID NO: 5648472 - DNA, 21 bp, Homo sapiens
tgagagcatcaggcctagagg

SEQ ID NO: 5648473 - DNA, 21 bp, Homo sapiens
tgagagccagatgcctcccca

SEQ ID NO: 5648474 - DNA, 15 bp, Homo sapiens
tgagagcccagaggt

SEQ ID NO: 5648475 - DNA, 19 bp, Homo sapiens
tgagagcccagaggtaaca

SEQ ID NO: 5648476 - DNA, 20 bp, Homo sapiens
tgagagcccagtcattgtac

SEQ ID NO: 5648477 - DNA, 23 bp, Homo sapiens
tgagagcccattcccaccattct

SEQ ID NO: 5648478 - DNA, 15 bp, Homo sapiens
tgagagccccagctg

SEQ ID NO: 5648479 - DNA, 19 bp, Homo sapiens
tgagagccggccgtggaag

SEQ ID NO: 5648480 - DNA, 10 bp, Homo sapiens
tgagagcctc

SEQ ID NO: 5648481 - DNA, 19 bp, Homo sapiens
tgagagcctccaggttcct

SEQ ID NO: 5648482 - DNA, 20 bp, Homo sapiens
tgagagcctccaggttcctc

SEQ ID NO: 5648483 - DNA, 14 bp, Homo sapiens
tgagagcctttgcc

SEQ ID NO: 5648484 - DNA, 17 bp, Homo sapiens
tgagagctcagcctgcc

SEQ ID NO: 5648485 - DNA, 21 bp, Homo sapiens
tgagagctcagcctgcctggg

SEQ ID NO: 5648486 - DNA, 16 bp, Homo sapiens
tgagagctgcctcctg

SEQ ID NO: 5648487 - DNA, 14 bp, Homo sapiens
tgagagctgctcct

SEQ ID NO: 5648488 - DNA, 18 bp, Homo sapiens
tgagagctgctcctttgg

SEQ ID NO: 5648489 - DNA, 15 bp, Homo sapiens
tgagagctgctgagg

SEQ ID NO: 5648490 - DNA, 14 bp, Homo sapiens
tgagagctggccca

SEQ ID NO: 5648491 - DNA, 12 bp, Homo sapiens
tgagagctgggc

SEQ ID NO: 5648492 - DNA, 22 bp, Homo sapiens
tgagagctttattgctgcattt

SEQ ID NO: 5648493 - DNA, 17 bp, Homo sapiens
tgagagctttctgcctt

SEQ ID NO: 5648494 - DNA, 19 bp, Homo sapiens
tgagagctttctgccttag

SEQ ID NO: 5648495 - DNA, 22 bp, Homo sapiens
tgagagctttctgccttagcct

SEQ ID NO: 5648496 - DNA, 15 bp, Homo sapiens
tgagagctttgctta

SEQ ID NO: 5648497 - DNA, 23 bp, Homo sapiens
tgagagctttgcttataaactgg

SEQ ID NO: 5648498 - DNA, 10 bp, Homo sapiens
tgagaggaaa

SEQ ID NO: 5648499 - DNA, 11 bp, Homo sapiens
tgagaggaaat

SEQ ID NO: 5648500 - DNA, 12 bp, Homo sapiens
tgagaggaaatc

SEQ ID NO: 5648501 - DNA, 20 bp, Homo sapiens
tgagaggaagatgaagagaa

SEQ ID NO: 5648502 - DNA, 23 bp, Homo sapiens
tgagaggagaaatgcaataactc

SEQ ID NO: 5648503 - DNA, 16 bp, Homo sapiens
tgagaggaggcagcag

SEQ ID NO: 5648504 - DNA, 20 bp, Homo sapiens
tgagaggaggggtaaatata

SEQ ID NO: 5648505 - DNA, 22 bp, Homo sapiens
tgagaggaggggtaaatatatg

SEQ ID NO: 5648506 - DNA, 20 bp, Homo sapiens
tgagaggcaatgattgttaa

SEQ ID NO: 5648507 - DNA, 18 bp, Homo sapiens
tgagaggcagacttccct

SEQ ID NO: 5648508 - DNA, 16 bp, Homo sapiens
tgagaggcagaggcag

SEQ ID NO: 5648509 - DNA, 20 bp, Homo sapiens
tgagaggcaggaatgggggt

SEQ ID NO: 5648510 - DNA, 16 bp, Homo sapiens
tgagaggcaggcatag

SEQ ID NO: 5648511 - DNA, 16 bp, Homo sapiens
tgagaggcccccaccc

SEQ ID NO: 5648512 - DNA, 14 bp, Homo sapiens
tgagaggccctgga

SEQ ID NO: 5648513 - DNA, 15 bp, Homo sapiens
tgagaggcctggagc

SEQ ID NO: 5648514 - DNA, 16 bp, Homo sapiens
tgagaggcctggagcc

SEQ ID NO: 5648515 - DNA, 11 bp, Homo sapiens
tgagaggctga

SEQ ID NO: 5648516 - DNA, 14 bp, Homo sapiens
tgagaggctgcctc

SEQ ID NO: 5648517 - DNA, 11 bp, Homo sapiens
tgagagggcaa

SEQ ID NO: 5648518 - DNA, 22 bp, Homo sapiens
tgagagggcaatctttgccttt

SEQ ID NO: 5648519 - DNA, 19 bp, Homo sapiens
tgagagggccctgcctgct

SEQ ID NO: 5648520 - DNA, 14 bp, Homo sapiens
tgagagggccgggc

SEQ ID NO: 5648521 - DNA, 17 bp, Homo sapiens
tgagagggccgggcaga

SEQ ID NO: 5648522 - DNA, 16 bp, Homo sapiens
tgagagggctgtggct

SEQ ID NO: 5648523 - DNA, 16 bp, Homo sapiens
tgagaggggaagcggc

SEQ ID NO: 5648524 - DNA, 11 bp, Homo sapiens
tgagaggggag

SEQ ID NO: 5648525 - DNA, 14 bp, Homo sapiens
tgagaggggagagc

SEQ ID NO: 5648526 - DNA, 21 bp, Homo sapiens
tgagaggggagagctgaacag

SEQ ID NO: 5648527 - DNA, 13 bp, Homo sapiens
tgagaggggaggg

SEQ ID NO: 5648528 - DNA, 17 bp, Homo sapiens
tgagaggggagggaggg

SEQ ID NO: 5648529 - DNA, 21 bp, Homo sapiens
tgagagggggatgcccctggc

SEQ ID NO: 5648530 - DNA, 23 bp, Homo sapiens
tgagagggggatgcccctggccc

SEQ ID NO: 5648531 - DNA, 14 bp, Homo sapiens
tgagaggggtgaga

SEQ ID NO: 5648532 - DNA, 21 bp, Homo sapiens
tgagagggtgtgggtgccctg

SEQ ID NO: 5648533 - DNA, 15 bp, Homo sapiens
tgagaggtgctgcag

SEQ ID NO: 5648534 - DNA, 21 bp, Homo sapiens
tgagaggtggcttttgcggcc

SEQ ID NO: 5648535 - DNA, 21 bp, Homo sapiens
tgagaggtgggggatgctgag

SEQ ID NO: 5648536 - DNA, 19 bp, Homo sapiens
tgagaggtgtaggttgaaa

SEQ ID NO: 5648537 - DNA, 16 bp, Homo sapiens
tgagaggttagaatga

SEQ ID NO: 5648538 - DNA, 17 bp, Homo sapiens
tgagaggttagaatgat

SEQ ID NO: 5648539 - DNA, 18 bp, Homo sapiens
tgagagtaacttaagtta

SEQ ID NO: 5648540 - DNA, 21 bp, Homo sapiens
tgagagtactcacttttcact

SEQ ID NO: 5648541 - DNA, 16 bp, Homo sapiens
tgagagtactgtccca

SEQ ID NO: 5648542 - DNA, 17 bp, Homo sapiens
tgagagtagggccctga

SEQ ID NO: 5648543 - DNA, 21 bp, Homo sapiens
tgagagtcagctctctgccct

SEQ ID NO: 5648544 - DNA, 22 bp, Homo sapiens
tgagagtcagctctctgccctg

SEQ ID NO: 5648545 - DNA, 13 bp, Homo sapiens
tgagagtcatctc

SEQ ID NO: 5648546 - DNA, 20 bp, Homo sapiens
tgagagtcattcaggtgacc

SEQ ID NO: 5648547 - DNA, 20 bp, Homo sapiens
tgagagtccaacagacacaa

SEQ ID NO: 5648548 - DNA, 20 bp, Homo sapiens
tgagagtctggtctgcgcct

SEQ ID NO: 5648549 - DNA, 16 bp, Homo sapiens
tgagagtgaacaaatt

SEQ ID NO: 5648550 - DNA, 15 bp, Homo sapiens
tgagagtgcactgct

SEQ ID NO: 5648551 - DNA, 14 bp, Homo sapiens
tgagagtgtgacca

SEQ ID NO: 5648552 - DNA, 22 bp, Homo sapiens
tgagagttccggggagaaaccc

SEQ ID NO: 5648553 - DNA, 21 bp, Homo sapiens
tgagcgccccgcccccacccc

SEQ ID NO: 5648554 - DNA, 22 bp, Homo sapiens
tgagcgccccgcccccacccct

SEQ ID NO: 5648555 - DNA, 18 bp, Homo sapiens
tgagcgcctccatccaag

SEQ ID NO: 5648556 - DNA, 20 bp, Homo sapiens
tgagcgcctccatccaaggc

SEQ ID NO: 5648557 - DNA, 18 bp, Homo sapiens
tgagcgcctgtgcacaca

SEQ ID NO: 5648558 - DNA, 17 bp, Homo sapiens
tgagcgctactcttgga

SEQ ID NO: 5648559 - DNA, 14 bp, Homo sapiens
tgagcgctcctgcc

SEQ ID NO: 5648560 - DNA, 17 bp, Homo sapiens
tgagcgctgtgagatgg

SEQ ID NO: 5648561 - DNA, 21 bp, Homo sapiens
tgagcgctgtggactgtcctg

SEQ ID NO: 5648562 - DNA, 18 bp, Homo sapiens
tgagcgcttctgcagcct

SEQ ID NO: 5648563 - DNA, 23 bp, Homo sapiens
tgagcggacagaatgatgccaaa

SEQ ID NO: 5648564 - DNA, 18 bp, Homo sapiens
tgagcggccgcctgtcct

SEQ ID NO: 5648565 - DNA, 19 bp, Homo sapiens
tgagcggccgcctgtcctt

SEQ ID NO: 5648566 - DNA, 21 bp, Homo sapiens
tgagcggccgcctgtccttgg

SEQ ID NO: 5648567 - DNA, 12 bp, Homo sapiens
tgagcgggaggc

SEQ ID NO: 5648568 - DNA, 14 bp, Homo sapiens
tgagcgggaggcag

SEQ ID NO: 5648569 - DNA, 20 bp, Homo sapiens
tgagcggtgctgtcctcagg

SEQ ID NO: 5648570 - DNA, 20 bp, Homo sapiens
tgagcgtcaaagaaaatgcc

SEQ ID NO: 5648571 - DNA, 21 bp, Homo sapiens
tgagcgtcaaagaaaatgcct

SEQ ID NO: 5648572 - DNA, 15 bp, Homo sapiens
tgagcgtccaggtga

SEQ ID NO: 5648573 - DNA, 13 bp, Homo sapiens
tgagcgtgattct

SEQ ID NO: 5648574 - DNA, 17 bp, Homo sapiens
tgagcgtgcgcactgca

SEQ ID NO: 5648575 - DNA, 20 bp, Homo sapiens
tgagcgtgcgcactgcatgg

SEQ ID NO: 5648576 - DNA, 21 bp, Homo sapiens
tgagcgtggaagggggaggag

SEQ ID NO: 5648577 - DNA, 14 bp, Homo sapiens
tgagcgtggccttg

SEQ ID NO: 5648578 - DNA, 17 bp, Homo sapiens
tgagcgtggccttggga

SEQ ID NO: 5648579 - DNA, 19 bp, Homo sapiens
tgagcgtggccttgggagg

SEQ ID NO: 5648580 - DNA, 23 bp, Homo sapiens
tgagcgtgtagcgtcctgaggaa

SEQ ID NO: 5648581 - DNA, 16 bp, Homo sapiens
tgagcgtttaaagtac

SEQ ID NO: 5648582 - DNA, 19 bp, Homo sapiens
tgagcgtttaaagtactga

SEQ ID NO: 5648583 - DNA, 14 bp, Homo sapiens
tgagctaaataagt

SEQ ID NO: 5648584 - DNA, 14 bp, Homo sapiens
tgagctacaaatgc

SEQ ID NO: 5648585 - DNA, 19 bp, Homo sapiens
tgagctaccaggaagaggg

SEQ ID NO: 5648586 - DNA, 18 bp, Homo sapiens
tgagctaccgtggatctc

SEQ ID NO: 5648587 - DNA, 21 bp, Homo sapiens
tgagctaccgtggatctcctt

SEQ ID NO: 5648588 - DNA, 21 bp, Homo sapiens
tgagctactgccgtcagtgct

SEQ ID NO: 5648589 - DNA, 18 bp, Homo sapiens
tgagctactggattctta

SEQ ID NO: 5648590 - DNA, 16 bp, Homo sapiens
tgagctagaaccctct

SEQ ID NO: 5648591 - DNA, 22 bp, Homo sapiens
tgagctagaagctggaggacta

SEQ ID NO: 5648592 - DNA, 18 bp, Homo sapiens
tgagctagaccaaggtca

SEQ ID NO: 5648593 - DNA, 18 bp, Homo sapiens
tgagctaggagaagggct

SEQ ID NO: 5648594 - DNA, 20 bp, Homo sapiens
tgagctaggagaagggctga

SEQ ID NO: 5648595 - DNA, 14 bp, Homo sapiens
tgagctagtgtctt

SEQ ID NO: 5648596 - DNA, 20 bp, Homo sapiens
tgagctagttaaggcaaatc

SEQ ID NO: 5648597 - DNA, 20 bp, Homo sapiens
tgagctatagtgaagaatag

SEQ ID NO: 5648598 - DNA, 14 bp, Homo sapiens
tgagctatgagccc

SEQ ID NO: 5648599 - DNA, 22 bp, Homo sapiens
tgagctatgataagattgaaat

SEQ ID NO: 5648600 - DNA, 14 bp, Homo sapiens
tgagctatgatatg

SEQ ID NO: 5648601 - DNA, 17 bp, Homo sapiens
tgagctatgatatgtgc

SEQ ID NO: 5648602 - DNA, 14 bp, Homo sapiens
tgagctatgtatta

SEQ ID NO: 5648603 - DNA, 15 bp, Homo sapiens
tgagctatgtattaa

SEQ ID NO: 5648604 - DNA, 15 bp, Homo sapiens
tgagctattaaaact

SEQ ID NO: 5648605 - DNA, 18 bp, Homo sapiens
tgagctattaaaactcag

SEQ ID NO: 5648606 - DNA, 19 bp, Homo sapiens
tgagctatttccattccag

SEQ ID NO: 5648607 - DNA, 16 bp, Homo sapiens
tgagctatttccttcc

SEQ ID NO: 5648608 - DNA, 19 bp, Homo sapiens
tgagctatttccttccagc

SEQ ID NO: 5648609 - DNA, 17 bp, Homo sapiens
tgagctattttcctctg

SEQ ID NO: 5648610 - DNA, 18 bp, Homo sapiens
tgagctattttcctctgg

SEQ ID NO: 5648611 - DNA, 21 bp, Homo sapiens
tgagctcaaatctctgttact

SEQ ID NO: 5648612 - DNA, 22 bp, Homo sapiens
tgagctcaatctctgcaggatg

SEQ ID NO: 5648613 - DNA, 17 bp, Homo sapiens
tgagctcacaaccacca

SEQ ID NO: 5648614 - DNA, 19 bp, Homo sapiens
tgagctcacaaggcagcaa

SEQ ID NO: 5648615 - DNA, 17 bp, Homo sapiens
tgagctcagacccccac

SEQ ID NO: 5648616 - DNA, 14 bp, Homo sapiens
tgagctcagcgtgg

SEQ ID NO: 5648617 - DNA, 17 bp, Homo sapiens
tgagctcagctcactgg

SEQ ID NO: 5648618 - DNA, 20 bp, Homo sapiens
tgagctcaggctgagcccag

SEQ ID NO: 5648619 - DNA, 21 bp, Homo sapiens
tgagctcaggctgagcccagc

SEQ ID NO: 5648620 - DNA, 22 bp, Homo sapiens
tgagctcaggctgagcccagcc

SEQ ID NO: 5648621 - DNA, 11 bp, Homo sapiens
tgagctcaggt

SEQ ID NO: 5648622 - DNA, 15 bp, Homo sapiens
tgagctcatgagggc

SEQ ID NO: 5648623 - DNA, 14 bp, Homo sapiens
tgagctccaccctc

SEQ ID NO: 5648624 - DNA, 14 bp, Homo sapiens
tgagctccacctct

SEQ ID NO: 5648625 - DNA, 15 bp, Homo sapiens
tgagctccacctctg

SEQ ID NO: 5648626 - DNA, 23 bp, Homo sapiens
tgagctccacctctggtggctcc

SEQ ID NO: 5648627 - DNA, 13 bp, Homo sapiens
tgagctccagacc

SEQ ID NO: 5648628 - DNA, 14 bp, Homo sapiens
tgagctccagaccc

SEQ ID NO: 5648629 - DNA, 20 bp, Homo sapiens
tgagctccagacccccagca

SEQ ID NO: 5648630 - DNA, 21 bp, Homo sapiens
tgagctccagccaccccgcag

SEQ ID NO: 5648631 - DNA, 15 bp, Homo sapiens
tgagctcccacaagc

SEQ ID NO: 5648632 - DNA, 15 bp, Homo sapiens
tgagctcccacctcc

SEQ ID NO: 5648633 - DNA, 19 bp, Homo sapiens
tgagctcccacttctgcca

SEQ ID NO: 5648634 - DNA, 23 bp, Homo sapiens
tgagctcccaggtgcagccagag

SEQ ID NO: 5648635 - DNA, 15 bp, Homo sapiens
tgagctccccaaaaa

SEQ ID NO: 5648636 - DNA, 19 bp, Homo sapiens
tgagctccccaatccaacc

SEQ ID NO: 5648637 - DNA, 15 bp, Homo sapiens
tgagctccccaccac

SEQ ID NO: 5648638 - DNA, 22 bp, Homo sapiens
tgagctccccaccaccccagct

SEQ ID NO: 5648639 - DNA, 16 bp, Homo sapiens
tgagctccccagatct

SEQ ID NO: 5648640 - DNA, 20 bp, Homo sapiens
tgagctccccagatctccca

SEQ ID NO: 5648641 - DNA, 17 bp, Homo sapiens
tgagctcccccttccca

SEQ ID NO: 5648642 - DNA, 16 bp, Homo sapiens
tgagctcccctggagc

SEQ ID NO: 5648643 - DNA, 20 bp, Homo sapiens
tgagctcccctggagccagc

SEQ ID NO: 5648644 - DNA, 22 bp, Homo sapiens
tgagctcccctggagccagcag

SEQ ID NO: 5648645 - DNA, 16 bp, Homo sapiens
tgagctccctcgctgt

SEQ ID NO: 5648646 - DNA, 15 bp, Homo sapiens
tgagctcctctgggc

SEQ ID NO: 5648647 - DNA, 19 bp, Homo sapiens
tgagctcctgatcagaggc

SEQ ID NO: 5648648 - DNA, 12 bp, Homo sapiens
tgagctcctggg

SEQ ID NO: 5648649 - DNA, 16 bp, Homo sapiens
tgagctccttgattgc

SEQ ID NO: 5648650 - DNA, 15 bp, Homo sapiens
tgagctcggggacag

SEQ ID NO: 5648651 - DNA, 17 bp, Homo sapiens
tgagctcggggggctct

SEQ ID NO: 5648652 - DNA, 21 bp, Homo sapiens
tgagctcggggggctctgcct

SEQ ID NO: 5648653 - DNA, 19 bp, Homo sapiens
tgagctcggggtccaccag

SEQ ID NO: 5648654 - DNA, 19 bp, Homo sapiens
tgagctctatttccccacc

SEQ ID NO: 5648655 - DNA, 22 bp, Homo sapiens
tgagctctcaggccgagagcct

SEQ ID NO: 5648656 - DNA, 16 bp, Homo sapiens
tgagctctccaggcca

SEQ ID NO: 5648657 - DNA, 18 bp, Homo sapiens
tgagctctccaggccagg

SEQ ID NO: 5648658 - DNA, 20 bp, Homo sapiens
tgagctctcggaactgcatg

SEQ ID NO: 5648659 - DNA, 12 bp, Homo sapiens
tgagctctgaaa

SEQ ID NO: 5648660 - DNA, 17 bp, Homo sapiens
tgagctctgaaatcttc

SEQ ID NO: 5648661 - DNA, 23 bp, Homo sapiens
tgagctctgacccttgggcctgg

SEQ ID NO: 5648662 - DNA, 12 bp, Homo sapiens
tgagctctgaga

SEQ ID NO: 5648663 - DNA, 19 bp, Homo sapiens
tgagctctgagaggccctg

SEQ ID NO: 5648664 - DNA, 22 bp, Homo sapiens
tgagctctgcatttgtctattc

SEQ ID NO: 5648665 - DNA, 13 bp, Homo sapiens
tgagctctgcctc

SEQ ID NO: 5648666 - DNA, 15 bp, Homo sapiens
tgagctctgcctcaa

SEQ ID NO: 5648667 - DNA, 22 bp, Homo sapiens
tgagctctggttatttttctct

SEQ ID NO: 5648668 - DNA, 14 bp, Homo sapiens
tgagctctgtaact

SEQ ID NO: 5648669 - DNA, 14 bp, Homo sapiens
tgagctcttccctt

SEQ ID NO: 5648670 - DNA, 20 bp, Homo sapiens
tgagctcttcccttattcct

SEQ ID NO: 5648671 - DNA, 21 bp, Homo sapiens
tgagctcttcctatccctctc

SEQ ID NO: 5648672 - DNA, 20 bp, Homo sapiens
tgagctcttgctatctctca

SEQ ID NO: 5648673 - DNA, 13 bp, Homo sapiens
tgagctcttgtga

SEQ ID NO: 5648674 - DNA, 22 bp, Homo sapiens
tgagctcttgtgaggaaagtca

SEQ ID NO: 5648675 - DNA, 23 bp, Homo sapiens
tgagctcttgtgaggaaagtcat

SEQ ID NO: 5648676 - DNA, 23 bp, Homo sapiens
tgagctcttgttccgtgccaggc

SEQ ID NO: 5648677 - DNA, 15 bp, Homo sapiens
tgagctctttgcact

SEQ ID NO: 5648678 - DNA, 16 bp, Homo sapiens
tgagctgaagacaaac

SEQ ID NO: 5648679 - DNA, 15 bp, Homo sapiens
tgagctgaccagccg

SEQ ID NO: 5648680 - DNA, 16 bp, Homo sapiens
tgagctgagcagggag

SEQ ID NO: 5648681 - DNA, 15 bp, Homo sapiens
tgagctgatataaat

SEQ ID NO: 5648682 - DNA, 12 bp, Homo sapiens
tgagctgatgtg

SEQ ID NO: 5648683 - DNA, 14 bp, Homo sapiens
tgagctgcagaaac

SEQ ID NO: 5648684 - DNA, 15 bp, Homo sapiens
tgagctgcagaaacg

SEQ ID NO: 5648685 - DNA, 17 bp, Homo sapiens
tgagctgcagaaacgaa

SEQ ID NO: 5648686 - DNA, 14 bp, Homo sapiens
tgagctgcagcctg

SEQ ID NO: 5648687 - DNA, 15 bp, Homo sapiens
tgagctgcagcctgg

SEQ ID NO: 5648688 - DNA, 18 bp, Homo sapiens
tgagctgcagcctggctg

SEQ ID NO: 5648689 - DNA, 15 bp, Homo sapiens
tgagctgccatccag

SEQ ID NO: 5648690 - DNA, 17 bp, Homo sapiens
tgagctgcccacagcag

SEQ ID NO: 5648691 - DNA, 15 bp, Homo sapiens
tgagctgcctccagc

SEQ ID NO: 5648692 - DNA, 21 bp, Homo sapiens
tgagctgcctccagcctggtg

SEQ ID NO: 5648693 - DNA, 14 bp, Homo sapiens
tgagctgcctgctc

SEQ ID NO: 5648694 - DNA, 20 bp, Homo sapiens
tgagctgcctgctctgcagc

SEQ ID NO: 5648695 - DNA, 15 bp, Homo sapiens
tgagctgccttccct

SEQ ID NO: 5648696 - DNA, 13 bp, Homo sapiens
tgagctgcttcac

SEQ ID NO: 5648697 - DNA, 19 bp, Homo sapiens
tgagctgcttcactaggga

SEQ ID NO: 5648698 - DNA, 18 bp, Homo sapiens
tgagctgctttttttgaa

SEQ ID NO: 5648699 - DNA, 17 bp, Homo sapiens
tgagctggaaggggcca

SEQ ID NO: 5648700 - DNA, 11 bp, Homo sapiens
tgagctggagc

SEQ ID NO: 5648701 - DNA, 19 bp, Homo sapiens
tgagctggatagacttggg

SEQ ID NO: 5648702 - DNA, 20 bp, Homo sapiens
tgagctggatagacttggga

SEQ ID NO: 5648703 - DNA, 18 bp, Homo sapiens
tgagctggcaaccagcca

SEQ ID NO: 5648704 - DNA, 22 bp, Homo sapiens
tgagctggcattggtctgctga

SEQ ID NO: 5648705 - DNA, 16 bp, Homo sapiens
tgagctggccaggccc

SEQ ID NO: 5648706 - DNA, 17 bp, Homo sapiens
tgagctggccaggccct

SEQ ID NO: 5648707 - DNA, 19 bp, Homo sapiens
tgagctggcctcacctggg

SEQ ID NO: 5648708 - DNA, 12 bp, Homo sapiens
tgagctgggccc

SEQ ID NO: 5648709 - DNA, 18 bp, Homo sapiens
tgagctgggcccagcccc

SEQ ID NO: 5648710 - DNA, 16 bp, Homo sapiens
tgagctgggccctggg

SEQ ID NO: 5648711 - DNA, 18 bp, Homo sapiens
tgagctgggccggagggt

SEQ ID NO: 5648712 - DNA, 10 bp, Homo sapiens
tgagctgggg

SEQ ID NO: 5648713 - DNA, 17 bp, Homo sapiens
tgagctggggaggtggg

SEQ ID NO: 5648714 - DNA, 21 bp, Homo sapiens
tgagctggggccgtctgtgtg

SEQ ID NO: 5648715 - DNA, 14 bp, Homo sapiens
tgagctggggcctg

SEQ ID NO: 5648716 - DNA, 23 bp, Homo sapiens
tgagctggggcctggagaggggc

SEQ ID NO: 5648717 - DNA, 17 bp, Homo sapiens
tgagctgggtactgact

SEQ ID NO: 5648718 - DNA, 16 bp, Homo sapiens
tgagctggtcccctct

SEQ ID NO: 5648719 - DNA, 19 bp, Homo sapiens
tgagctggtgcctgctttg

SEQ ID NO: 5648720 - DNA, 15 bp, Homo sapiens
tgagctggtttgact

SEQ ID NO: 5648721 - DNA, 17 bp, Homo sapiens
tgagctggttttctctg

SEQ ID NO: 5648722 - DNA, 14 bp, Homo sapiens
tgagctgtatatat

SEQ ID NO: 5648723 - DNA, 23 bp, Homo sapiens
tgagctgtatatatatatgtgtg

SEQ ID NO: 5648724 - DNA, 16 bp, Homo sapiens
tgagctgtcatcaaca

SEQ ID NO: 5648725 - DNA, 15 bp, Homo sapiens
tgagctgtcccaagt

SEQ ID NO: 5648726 - DNA, 15 bp, Homo sapiens
tgagctgtcccctgg

SEQ ID NO: 5648727 - DNA, 17 bp, Homo sapiens
tgagctgtcgctgcctc

SEQ ID NO: 5648728 - DNA, 20 bp, Homo sapiens
tgagctgtcgctgcctccat

SEQ ID NO: 5648729 - DNA, 20 bp, Homo sapiens
tgagctgtgacattgctggt

SEQ ID NO: 5648730 - DNA, 18 bp, Homo sapiens
tgagtgcaagagcctgag

SEQ ID NO: 5648731 - DNA, 19 bp, Homo sapiens
tgagtgcaagagcctgaga

SEQ ID NO: 5648732 - DNA, 17 bp, Homo sapiens
tgagtgcaagcaaagca

SEQ ID NO: 5648733 - DNA, 15 bp, Homo sapiens
tgagtgcacctgcct

SEQ ID NO: 5648734 - DNA, 15 bp, Homo sapiens
tgagtgcactgactg

SEQ ID NO: 5648735 - DNA, 13 bp, Homo sapiens
tgagtgcagaccc

SEQ ID NO: 5648736 - DNA, 14 bp, Homo sapiens
tgagtgcagaggct

SEQ ID NO: 5648737 - DNA, 14 bp, Homo sapiens
tgagtgcagttggt

SEQ ID NO: 5648738 - DNA, 18 bp, Homo sapiens
tgagtgcctgcagcatct

SEQ ID NO: 5648739 - DNA, 13 bp, Homo sapiens
tgagtgccttaca

SEQ ID NO: 5648740 - DNA, 21 bp, Homo sapiens
tgagtgccttctgtggggact

SEQ ID NO: 5648741 - DNA, 17 bp, Homo sapiens
tgagtgccttttgcaga

SEQ ID NO: 5648742 - DNA, 15 bp, Homo sapiens
tgagtgcgaccacca

SEQ ID NO: 5648743 - DNA, 14 bp, Homo sapiens
tgagtgcgcctcac

SEQ ID NO: 5648744 - DNA, 16 bp, Homo sapiens
tgagtgcgcctcacca

SEQ ID NO: 5648745 - DNA, 22 bp, Homo sapiens
tgagtgctaagagcctctggaa

SEQ ID NO: 5648746 - DNA, 19 bp, Homo sapiens
tgagtgctctgatccctct

SEQ ID NO: 5648747 - DNA, 17 bp, Homo sapiens
tgagtgctgattcaaac

SEQ ID NO: 5648748 - DNA, 12 bp, Homo sapiens
tgagtgctgggc

SEQ ID NO: 5648749 - DNA, 14 bp, Homo sapiens
tgagtggaatgcag

SEQ ID NO: 5648750 - DNA, 19 bp, Homo sapiens
tgagtggaatgcagggaag

SEQ ID NO: 5648751 - DNA, 21 bp, Homo sapiens
tgagtggacagcagctggact

SEQ ID NO: 5648752 - DNA, 22 bp, Homo sapiens
tgagtggacagcagctggactg

SEQ ID NO: 5648753 - DNA, 19 bp, Homo sapiens
tgagtggacgtcagaagaa

SEQ ID NO: 5648754 - DNA, 14 bp, Homo sapiens
tgagtggagttact

SEQ ID NO: 5648755 - DNA, 15 bp, Homo sapiens
tgagtggagtttcca

SEQ ID NO: 5648756 - DNA, 14 bp, Homo sapiens
tgagtggataatca

SEQ ID NO: 5648757 - DNA, 15 bp, Homo sapiens
tgagtggataatcag

SEQ ID NO: 5648758 - DNA, 18 bp, Homo sapiens
tgagtggatgatgtttcg

SEQ ID NO: 5648759 - DNA, 23 bp, Homo sapiens
tgagtggatggaggagaaataaa

SEQ ID NO: 5648760 - DNA, 18 bp, Homo sapiens
tgagtggatggatggaca

SEQ ID NO: 5648761 - DNA, 14 bp, Homo sapiens
tgagtggcagcagc

SEQ ID NO: 5648762 - DNA, 16 bp, Homo sapiens
tgagtggcagcagccc

SEQ ID NO: 5648763 - DNA, 15 bp, Homo sapiens
tgagtggcatggcca

SEQ ID NO: 5648764 - DNA, 19 bp, Homo sapiens
tgagtggccagcgccaggg

SEQ ID NO: 5648765 - DNA, 15 bp, Homo sapiens
tgagtggccagggaa

SEQ ID NO: 5648766 - DNA, 15 bp, Homo sapiens
tgagtggccccacct

SEQ ID NO: 5648767 - DNA, 16 bp, Homo sapiens
tgagtggcgcaaggcc

SEQ ID NO: 5648768 - DNA, 22 bp, Homo sapiens
tgagtggcttcactcctgctgt

SEQ ID NO: 5648769 - DNA, 12 bp, Homo sapiens
tgagtgggaagc

SEQ ID NO: 5648770 - DNA, 14 bp, Homo sapiens
tgagtgggaagccc

SEQ ID NO: 5648771 - DNA, 12 bp, Homo sapiens
tgagtgggagaa

SEQ ID NO: 5648772 - DNA, 21 bp, Homo sapiens
tgagtgggagagtacctgtgt

SEQ ID NO: 5648773 - DNA, 12 bp, Homo sapiens
tgagtgggcccc

SEQ ID NO: 5648774 - DNA, 13 bp, Homo sapiens
tgagtgggccctg

SEQ ID NO: 5648775 - DNA, 14 bp, Homo sapiens
tgagtgggccctgc

SEQ ID NO: 5648776 - DNA, 15 bp, Homo sapiens
tgagtgggctgggcc

SEQ ID NO: 5648777 - DNA, 23 bp, Homo sapiens
tgagtggggagacacctcagagc

SEQ ID NO: 5648778 - DNA, 16 bp, Homo sapiens
tgagtggggcttcctg

SEQ ID NO: 5648779 - DNA, 19 bp, Homo sapiens
tgagtggggcttcctgggc

SEQ ID NO: 5648780 - DNA, 21 bp, Homo sapiens
tgagtgggggatcacagcctc

SEQ ID NO: 5648781 - DNA, 15 bp, Homo sapiens
tgagtggtcactggt

SEQ ID NO: 5648782 - DNA, 18 bp, Homo sapiens
tgagtggtccacattctg

SEQ ID NO: 5648783 - DNA, 22 bp, Homo sapiens
tgagtggtccacattctgctgc

SEQ ID NO: 5648784 - DNA, 21 bp, Homo sapiens
tgagtggtgttggcagtgttt

SEQ ID NO: 5648785 - DNA, 20 bp, Homo sapiens
tgagtggttttctttttcct

SEQ ID NO: 5648786 - DNA, 22 bp, Homo sapiens
tgagtgtaaataattttaaata

SEQ ID NO: 5648787 - DNA, 14 bp, Homo sapiens
tgagtgtaagtgtg

SEQ ID NO: 5648788 - DNA, 16 bp, Homo sapiens
tgagtgtactgtgcct

SEQ ID NO: 5648789 - DNA, 18 bp, Homo sapiens
tgagtgtactgtgcctgg

SEQ ID NO: 5648790 - DNA, 16 bp, Homo sapiens
tgagtgtatatatatt

SEQ ID NO: 5648791 - DNA, 18 bp, Homo sapiens
tgagtgtatgagtagcca

SEQ ID NO: 5648792 - DNA, 15 bp, Homo sapiens
tgagtgtatgtgtgt

SEQ ID NO: 5648793 - DNA, 20 bp, Homo sapiens
tgagtgtcaaacgtgccccc

SEQ ID NO: 5648794 - DNA, 17 bp, Homo sapiens
tgagtgtccttgctcta

SEQ ID NO: 5648795 - DNA, 14 bp, Homo sapiens
tgagtgtctctgcc

SEQ ID NO: 5648796 - DNA, 16 bp, Homo sapiens
tgagtgtctctgcctg

SEQ ID NO: 5648797 - DNA, 18 bp, Homo sapiens
tgagtgtctctgcctgga

SEQ ID NO: 5648798 - DNA, 14 bp, Homo sapiens
tgagtgtctgcgcc

SEQ ID NO: 5648799 - DNA, 21 bp, Homo sapiens
tgagtgtgacgggggttgggg

SEQ ID NO: 5648800 - DNA, 14 bp, Homo sapiens
tgagtgtgactttt

SEQ ID NO: 5648801 - DNA, 15 bp, Homo sapiens
tgagtgtgagagatg

SEQ ID NO: 5648802 - DNA, 14 bp, Homo sapiens
tgagtgtgagggca

SEQ ID NO: 5648803 - DNA, 21 bp, Homo sapiens
tgagtgtgatccagtttttca

SEQ ID NO: 5648804 - DNA, 23 bp, Homo sapiens
tgagtgtgctgctgtaagaaatc

SEQ ID NO: 5648805 - DNA, 12 bp, Homo sapiens
tgagtgtggaag

SEQ ID NO: 5648806 - DNA, 19 bp, Homo sapiens
tgagtgtggcgggaagggt

SEQ ID NO: 5648807 - DNA, 15 bp, Homo sapiens
tgagtgtgtatgtca

SEQ ID NO: 5648808 - DNA, 17 bp, Homo sapiens
tgagtgtgtccaagtgt

SEQ ID NO: 5648809 - DNA, 15 bp, Homo sapiens
tgagtgtgtgtgtgc

SEQ ID NO: 5648810 - DNA, 16 bp, Homo sapiens
tgagtgttatgtgaat

SEQ ID NO: 5648811 - DNA, 17 bp, Homo sapiens
tgagtgttcctttttaa

SEQ ID NO: 5648812 - DNA, 14 bp, Homo sapiens
tgagtgttctcctc

SEQ ID NO: 5648813 - DNA, 12 bp, Homo sapiens
tgagtgttctgg

SEQ ID NO: 5648814 - DNA, 15 bp, Homo sapiens
tgagtgtttctatga

SEQ ID NO: 5648815 - DNA, 14 bp, Homo sapiens
tgagtgtttggggg

SEQ ID NO: 5648816 - DNA, 15 bp, Homo sapiens
tgagttaactgtgaa

SEQ ID NO: 5648817 - DNA, 19 bp, Homo sapiens
tgagttaatgtgctgagca

SEQ ID NO: 5648818 - DNA, 16 bp, Homo sapiens
tgagttaatttgataa

SEQ ID NO: 5648819 - DNA, 22 bp, Homo sapiens
tgagttaatttgataaagatct

SEQ ID NO: 5648820 - DNA, 23 bp, Homo sapiens
tgagttacaggggattttattaa

SEQ ID NO: 5648821 - DNA, 18 bp, Homo sapiens
tgagttacattaaaataa

SEQ ID NO: 5648822 - DNA, 19 bp, Homo sapiens
tgagttacattaaaataaa

SEQ ID NO: 5648823 - DNA, 17 bp, Homo sapiens
tgagttactgtgcattg

SEQ ID NO: 5648824 - DNA, 19 bp, Homo sapiens
tgagttacttagaatgcca

SEQ ID NO: 5648825 - DNA, 15 bp, Homo sapiens
tgagttacttcctat

SEQ ID NO: 5648826 - DNA, 21 bp, Homo sapiens
tgagttacttgtctgaggcct

SEQ ID NO: 5648827 - DNA, 12 bp, Homo sapiens
tgagttaggaac

SEQ ID NO: 5648828 - DNA, 17 bp, Homo sapiens
tgagttaggaatgagaa

SEQ ID NO: 5648829 - DNA, 18 bp, Homo sapiens
tgagttaggaatgagaag

SEQ ID NO: 5648830 - DNA, 16 bp, Homo sapiens
tgagttataaatattt

SEQ ID NO: 5648831 - DNA, 16 bp, Homo sapiens
tgagttatcatgaatt

SEQ ID NO: 5648832 - DNA, 16 bp, Homo sapiens
tgagttatctaagaat

SEQ ID NO: 5648833 - DNA, 23 bp, Homo sapiens
tgagttatctgattttttttgta

SEQ ID NO: 5648834 - DNA, 16 bp, Homo sapiens
tgagttatgttaaaat

SEQ ID NO: 5648835 - DNA, 17 bp, Homo sapiens
tgagttattccacaaac

SEQ ID NO: 5648836 - DNA, 15 bp, Homo sapiens
tgagttcaactacat

SEQ ID NO: 5648837 - DNA, 16 bp, Homo sapiens
tgagttcacatgtgcc

SEQ ID NO: 5648838 - DNA, 19 bp, Homo sapiens
tgagttcacatgtgccctg

SEQ ID NO: 5648839 - DNA, 17 bp, Homo sapiens
tgagttcaccatctctt

SEQ ID NO: 5648840 - DNA, 18 bp, Homo sapiens
tgagttcataaatttatg

SEQ ID NO: 5648841 - DNA, 17 bp, Homo sapiens
tgagttccagttgaagt

SEQ ID NO: 5648842 - DNA, 13 bp, Homo sapiens
tgagttcccaaag

SEQ ID NO: 5648843 - DNA, 19 bp, Homo sapiens
tgagttcccaaagggaggg

SEQ ID NO: 5648844 - DNA, 21 bp, Homo sapiens
tgagttcccgggagctgggcc

SEQ ID NO: 5648845 - DNA, 23 bp, Homo sapiens
tgagttcctgtgggtgtgtctct

SEQ ID NO: 5648846 - DNA, 20 bp, Homo sapiens
tgagttccttataagaatta

SEQ ID NO: 5648847 - DNA, 15 bp, Homo sapiens
tgagttctacataag

SEQ ID NO: 5648848 - DNA, 20 bp, Homo sapiens
tgagttctatcagttatcct

SEQ ID NO: 5648849 - DNA, 12 bp, Homo sapiens
tgagttctcact

SEQ ID NO: 5648850 - DNA, 22 bp, Homo sapiens
tgagttctcactatgtttctca

SEQ ID NO: 5648851 - DNA, 14 bp, Homo sapiens
tgagttctgacact

SEQ ID NO: 5648852 - DNA, 12 bp, Homo sapiens
tgagttcttgtt

SEQ ID NO: 5648853 - DNA, 16 bp, Homo sapiens
tgagttgaaatgttct

SEQ ID NO: 5648854 - DNA, 23 bp, Homo sapiens
tgagttgatagcacagaccctgc

SEQ ID NO: 5648855 - DNA, 20 bp, Homo sapiens
tgagttgatgggggccagga

SEQ ID NO: 5648856 - DNA, 19 bp, Homo sapiens
tgagttgattcagctctgc

SEQ ID NO: 5648857 - DNA, 16 bp, Homo sapiens
tgagttgatttataaa

SEQ ID NO: 5648858 - DNA, 14 bp, Homo sapiens
tgagttgcaccctt

SEQ ID NO: 5648859 - DNA, 12 bp, Homo sapiens
tgagttgcagtt

SEQ ID NO: 5648860 - DNA, 13 bp, Homo sapiens
tgagttgcagttt

SEQ ID NO: 5648861 - DNA, 13 bp, Homo sapiens
tgagttgcatttg

SEQ ID NO: 5648862 - DNA, 15 bp, Homo sapiens
tgagttgcatttgta

SEQ ID NO: 5648863 - DNA, 16 bp, Homo sapiens
tgagttgctggaaaat

SEQ ID NO: 5648864 - DNA, 10 bp, Homo sapiens
tgagttgctt

SEQ ID NO: 5648865 - DNA, 21 bp, Homo sapiens
tgagttggaagcggtttgcat

SEQ ID NO: 5648866 - DNA, 19 bp, Homo sapiens
tgagttggacttcagtctt

SEQ ID NO: 5648867 - DNA, 18 bp, Homo sapiens
tgagttgggcaaaaccca

SEQ ID NO: 5648868 - DNA, 13 bp, Homo sapiens
tgagttgggggta

SEQ ID NO: 5648869 - DNA, 21 bp, Homo sapiens
tgagttggggtctggcagcct

SEQ ID NO: 5648870 - DNA, 15 bp, Homo sapiens
tgagttgtaaagaaa

SEQ ID NO: 5648871 - DNA, 19 bp, Homo sapiens
tgagttgtaaagaaaactt

SEQ ID NO: 5648872 - DNA, 14 bp, Homo sapiens
tgagttgtttaaag

SEQ ID NO: 5648873 - DNA, 23 bp, Homo sapiens
tgagttgttttcagactcagact

SEQ ID NO: 5648874 - DNA, 22 bp, Homo sapiens
tgagtttaagtctctgactctt

SEQ ID NO: 5648875 - DNA, 18 bp, Homo sapiens
tgagtttaatcttttcag

SEQ ID NO: 5648876 - DNA, 23 bp, Homo sapiens
tgagtttaccttgtatactgtag

SEQ ID NO: 5648877 - DNA, 20 bp, Homo sapiens
tgagtttagtttttcacttt

SEQ ID NO: 5648878 - DNA, 22 bp, Homo sapiens
tgagtttatgggaatgcctttt

SEQ ID NO: 5648879 - DNA, 22 bp, Homo sapiens
tgagtttcactgtactgcatgt

SEQ ID NO: 5648880 - DNA, 16 bp, Homo sapiens
tgagtttcagaaattc

SEQ ID NO: 5648881 - DNA, 21 bp, Homo sapiens
tgagtttcagaaattctcaaa

SEQ ID NO: 5648882 - DNA, 18 bp, Homo sapiens
tgagtttcagaataaaat

SEQ ID NO: 5648883 - DNA, 14 bp, Homo sapiens
tgagtttcagctgg

SEQ ID NO: 5648884 - DNA, 22 bp, Homo sapiens
tgagtttcagctggaaacttct

SEQ ID NO: 5648885 - DNA, 13 bp, Homo sapiens
tgagtttcatgtt

SEQ ID NO: 5648886 - DNA, 18 bp, Homo sapiens
tgagtttcattctcctgc

SEQ ID NO: 5648887 - DNA, 19 bp, Homo sapiens
tgagtttcctcaggctgct

SEQ ID NO: 5648888 - DNA, 19 bp, Homo sapiens
tgagtttctctcacattac

SEQ ID NO: 5648889 - DNA, 14 bp, Homo sapiens
tgagtttcttttat

SEQ ID NO: 5648890 - DNA, 14 bp, Homo sapiens
tgagtttgccctgg

SEQ ID NO: 5648891 - DNA, 22 bp, Homo sapiens
tgagtttggatgtctgtagcat

SEQ ID NO: 5648892 - DNA, 18 bp, Homo sapiens
tgagtttggtctggactg

SEQ ID NO: 5648893 - DNA, 14 bp, Homo sapiens
tgagtttgtaaata

SEQ ID NO: 5648894 - DNA, 21 bp, Homo sapiens
tgagtttgtaggtaaaatgta

SEQ ID NO: 5648895 - DNA, 15 bp, Homo sapiens
tgagtttgtattatt

SEQ ID NO: 5648896 - DNA, 20 bp, Homo sapiens
tgagtttgtcgctcatgtgt

SEQ ID NO: 5648897 - DNA, 13 bp, Homo sapiens
tgagtttgtttct

SEQ ID NO: 5648898 - DNA, 23 bp, Homo sapiens
tgagttttctctttgtggggctt

SEQ ID NO: 5648899 - DNA, 15 bp, Homo sapiens
tgagttttgatgctg

SEQ ID NO: 5648900 - DNA, 17 bp, Homo sapiens
tgagttttgatgctgta

SEQ ID NO: 5648901 - DNA, 19 bp, Homo sapiens
tgagttttgatgctgtatt

SEQ ID NO: 5648902 - DNA, 22 bp, Homo sapiens
tgagttttgggaagttaaaggg

SEQ ID NO: 5648903 - DNA, 18 bp, Homo sapiens
tgagttttgtgtttgttg

SEQ ID NO: 5648904 - DNA, 21 bp, Homo sapiens
tgagttttgtgtttgttgtag

SEQ ID NO: 5648905 - DNA, 15 bp, Homo sapiens
tgagtttttaaatgc

SEQ ID NO: 5648906 - DNA, 19 bp, Homo sapiens
tgagtttttatggggctga

SEQ ID NO: 5648907 - DNA, 15 bp, Homo sapiens
tgagtttttcattat

SEQ ID NO: 5648908 - DNA, 15 bp, Homo sapiens
tgagtttttcctccc

SEQ ID NO: 5648909 - DNA, 12 bp, Homo sapiens
tgatgaaaataa

SEQ ID NO: 5648910 - DNA, 13 bp, Homo sapiens
tgatgaaaataaa

SEQ ID NO: 5648911 - DNA, 17 bp, Homo sapiens
tgatgaaaataaagaat

SEQ ID NO: 5648912 - DNA, 16 bp, Homo sapiens
tgatgaaaataataaa

SEQ ID NO: 5648913 - DNA, 14 bp, Homo sapiens
tgatgaaaatattt

SEQ ID NO: 5648914 - DNA, 19 bp, Homo sapiens
tgatgaaaccttgaagttc

SEQ ID NO: 5648915 - DNA, 16 bp, Homo sapiens
tgatgaaactttgaaa

SEQ ID NO: 5648916 - DNA, 13 bp, Homo sapiens
tgatgaaagctga

SEQ ID NO: 5648917 - DNA, 15 bp, Homo sapiens
tgatgaaagctgatt

SEQ ID NO: 5648918 - DNA, 19 bp, Homo sapiens
tgatgaaagctgattactg

SEQ ID NO: 5648919 - DNA, 12 bp, Homo sapiens
tgatgaaatctg

SEQ ID NO: 5648920 - DNA, 18 bp, Homo sapiens
tgatgaaatctgctagaa

SEQ ID NO: 5648921 - DNA, 13 bp, Homo sapiens
tgatgaaattctt

SEQ ID NO: 5648922 - DNA, 20 bp, Homo sapiens
tgatgaacatattcatgaaa

SEQ ID NO: 5648923 - DNA, 18 bp, Homo sapiens
tgatgaactcttaatcaa

SEQ ID NO: 5648924 - DNA, 13 bp, Homo sapiens
tgatgaactttct

SEQ ID NO: 5648925 - DNA, 14 bp, Homo sapiens
tgatgaactttctc

SEQ ID NO: 5648926 - DNA, 18 bp, Homo sapiens
tgatgaagaaaagtgggc

SEQ ID NO: 5648927 - DNA, 12 bp, Homo sapiens
tgatgaagaagg

SEQ ID NO: 5648928 - DNA, 19 bp, Homo sapiens
tgatgaagaagggggtggg

SEQ ID NO: 5648929 - DNA, 14 bp, Homo sapiens
tgatgaagagagag

SEQ ID NO: 5648930 - DNA, 15 bp, Homo sapiens
tgatgaagcaaggaa

SEQ ID NO: 5648931 - DNA, 16 bp, Homo sapiens
tgatgaagcccgtgtc

SEQ ID NO: 5648932 - DNA, 20 bp, Homo sapiens
tgatgaagcccgtgtcctgc

SEQ ID NO: 5648933 - DNA, 13 bp, Homo sapiens
tgatgaagcctgt

SEQ ID NO: 5648934 - DNA, 15 bp, Homo sapiens
tgatgaagcctgtgc

SEQ ID NO: 5648935 - DNA, 18 bp, Homo sapiens
tgatgaagctgaggctgc

SEQ ID NO: 5648936 - DNA, 23 bp, Homo sapiens
tgatgaagctgaggctgctgcca

SEQ ID NO: 5648937 - DNA, 17 bp, Homo sapiens
tgatgaagggaggaggt

SEQ ID NO: 5648938 - DNA, 15 bp, Homo sapiens
tgatgaagtatactt

SEQ ID NO: 5648939 - DNA, 19 bp, Homo sapiens
tgatgaagttgtacaacac

SEQ ID NO: 5648940 - DNA, 15 bp, Homo sapiens
tgatgaataaaatgt

SEQ ID NO: 5648941 - DNA, 13 bp, Homo sapiens
tgatgaataaaca

SEQ ID NO: 5648942 - DNA, 16 bp, Homo sapiens
tgatgaatcaatgaaa

SEQ ID NO: 5648943 - DNA, 20 bp, Homo sapiens
tgatgaatcaatgaaaaatg

SEQ ID NO: 5648944 - DNA, 22 bp, Homo sapiens
tgatgaatcaatgaaaaatgta

SEQ ID NO: 5648945 - DNA, 18 bp, Homo sapiens
tgatgaatctacatttgt

SEQ ID NO: 5648946 - DNA, 15 bp, Homo sapiens
tgatgaatgaggaac

SEQ ID NO: 5648947 - DNA, 20 bp, Homo sapiens
tgatgacaaaaaatgtttta

SEQ ID NO: 5648948 - DNA, 19 bp, Homo sapiens
tgatgacaactggaatagt

SEQ ID NO: 5648949 - DNA, 15 bp, Homo sapiens
tgatgacattccctg

SEQ ID NO: 5648950 - DNA, 14 bp, Homo sapiens
tgatgaccaaagtc

SEQ ID NO: 5648951 - DNA, 17 bp, Homo sapiens
tgatgacccactaaaga

SEQ ID NO: 5648952 - DNA, 15 bp, Homo sapiens
tgatgacccttttca

SEQ ID NO: 5648953 - DNA, 16 bp, Homo sapiens
tgatgacccttttcat

SEQ ID NO: 5648954 - DNA, 22 bp, Homo sapiens
tgatgacgaatcctgctctaaa

SEQ ID NO: 5648955 - DNA, 16 bp, Homo sapiens
tgatgacgcctgtctg

SEQ ID NO: 5648956 - DNA, 17 bp, Homo sapiens
tgatgacgggatgctct

SEQ ID NO: 5648957 - DNA, 15 bp, Homo sapiens
tgatgactcaagatt

SEQ ID NO: 5648958 - DNA, 16 bp, Homo sapiens
tgatgactcaaggcca

SEQ ID NO: 5648959 - DNA, 21 bp, Homo sapiens
tgatgactcaaggccaataat

SEQ ID NO: 5648960 - DNA, 19 bp, Homo sapiens
tgatgactcgaaactgaca

SEQ ID NO: 5648961 - DNA, 18 bp, Homo sapiens
tgatgactcttcttatca

SEQ ID NO: 5648962 - DNA, 20 bp, Homo sapiens
tgatgactgccttgcctcct

SEQ ID NO: 5648963 - DNA, 13 bp, Homo sapiens
tgatgactgtttt

SEQ ID NO: 5648964 - DNA, 17 bp, Homo sapiens
tgatgacttgagccctg

SEQ ID NO: 5648965 - DNA, 17 bp, Homo sapiens
tgatgagacaacacaca

SEQ ID NO: 5648966 - DNA, 18 bp, Homo sapiens
tgatgagacaacacacac

SEQ ID NO: 5648967 - DNA, 19 bp, Homo sapiens
tgatgagacaacacacaca

SEQ ID NO: 5648968 - DNA, 18 bp, Homo sapiens
tgatgagacagtgaagta

SEQ ID NO: 5648969 - DNA, 12 bp, Homo sapiens
tgatgagacctg

SEQ ID NO: 5648970 - DNA, 16 bp, Homo sapiens
tgatgagagataacct

SEQ ID NO: 5648971 - DNA, 16 bp, Homo sapiens
tgatgagaggaaatca

SEQ ID NO: 5648972 - DNA, 21 bp, Homo sapiens
tgatgagatattaaattctca

SEQ ID NO: 5648973 - DNA, 19 bp, Homo sapiens
tgatgagcactcctgattt

SEQ ID NO: 5648974 - DNA, 18 bp, Homo sapiens
tgatgagcatttagcaca

SEQ ID NO: 5648975 - DNA, 20 bp, Homo sapiens
tgatgagcatttagcacaat

SEQ ID NO: 5648976 - DNA, 16 bp, Homo sapiens
tgatgagctcctcttc

SEQ ID NO: 5648977 - DNA, 18 bp, Homo sapiens
tgatgaggacccagagct

SEQ ID NO: 5648978 - DNA, 19 bp, Homo sapiens
tgatgaggacccagagctg

SEQ ID NO: 5648979 - DNA, 15 bp, Homo sapiens
tgatgaggccctcca

SEQ ID NO: 5648980 - DNA, 21 bp, Homo sapiens
tgatgaggccgcggcctcccc

SEQ ID NO: 5648981 - DNA, 17 bp, Homo sapiens
tgatgaggcctcttgga

SEQ ID NO: 5648982 - DNA, 18 bp, Homo sapiens
tgatgaggcctcttggac

SEQ ID NO: 5648983 - DNA, 16 bp, Homo sapiens
tgatgaggctggtgac

SEQ ID NO: 5648984 - DNA, 15 bp, Homo sapiens
tgatgagggcagcag

SEQ ID NO: 5648985 - DNA, 17 bp, Homo sapiens
tgatgagggcagcagcc

SEQ ID NO: 5648986 - DNA, 22 bp, Homo sapiens
tgatgagggcagcagccagccc

SEQ ID NO: 5648987 - DNA, 14 bp, Homo sapiens
tgatgaggggaggg

SEQ ID NO: 5648988 - DNA, 15 bp, Homo sapiens
tgatgaggggagggg

SEQ ID NO: 5648989 - DNA, 20 bp, Homo sapiens
tgatgagggggaattcctgg

SEQ ID NO: 5648990 - DNA, 18 bp, Homo sapiens
tgatgagtaacttaacca

SEQ ID NO: 5648991 - DNA, 17 bp, Homo sapiens
tgatgagtcttgatcta

SEQ ID NO: 5648992 - DNA, 21 bp, Homo sapiens
tgatgagtgattgacacacag

SEQ ID NO: 5648993 - DNA, 19 bp, Homo sapiens
tgatgagtgtaacaagaaa

SEQ ID NO: 5648994 - DNA, 22 bp, Homo sapiens
tgatgagtgtaacaagaaagga

SEQ ID NO: 5648995 - DNA, 18 bp, Homo sapiens
tgatgagttaactgtgaa

SEQ ID NO: 5648996 - DNA, 19 bp, Homo sapiens
tgatgagttaactgtgaaa

SEQ ID NO: 5648997 - DNA, 20 bp, Homo sapiens
tgatgagttaactgtgaaat

SEQ ID NO: 5648998 - DNA, 15 bp, Homo sapiens
tgatgatacaagatt

SEQ ID NO: 5648999 - DNA, 22 bp, Homo sapiens
tgatgatagacttcgaaaacag

SEQ ID NO: 5649000 - DNA, 23 bp, Homo sapiens
tgatgatagacttcgaaaacaga

SEQ ID NO: 5649001 - DNA, 23 bp, Homo sapiens
tgatgatagcagacattgttaca

SEQ ID NO: 5649002 - DNA, 21 bp, Homo sapiens
tgatgatcaaggagtgaagta

SEQ ID NO: 5649003 - DNA, 15 bp, Homo sapiens
tgatgatccagaaca

SEQ ID NO: 5649004 - DNA, 13 bp, Homo sapiens
tgatgatccatta

SEQ ID NO: 5649005 - DNA, 14 bp, Homo sapiens
tgatgatcctaggc

SEQ ID NO: 5649006 - DNA, 19 bp, Homo sapiens
tgatgatctttgcagacag

SEQ ID NO: 5649007 - DNA, 14 bp, Homo sapiens
tgatgatgaaaatt

SEQ ID NO: 5649008 - DNA, 15 bp, Homo sapiens
tgatgatgatgaaaa

SEQ ID NO: 5649009 - DNA, 16 bp, Homo sapiens
tgatgatgatgaaaac

SEQ ID NO: 5649010 - DNA, 13 bp, Homo sapiens
tgatgatgatgat

SEQ ID NO: 5649011 - DNA, 14 bp, Homo sapiens
tgatgatggaaggg

SEQ ID NO: 5649012 - DNA, 22 bp, Homo sapiens
tgatgatggtgttggtgaaaat

SEQ ID NO: 5649013 - DNA, 13 bp, Homo sapiens
tgatgatgtaatt

SEQ ID NO: 5649014 - DNA, 20 bp, Homo sapiens
tgatgatgtcggtcttgcaa

SEQ ID NO: 5649015 - DNA, 21 bp, Homo sapiens
tgatgatgtctacagaaaatg

SEQ ID NO: 5649016 - DNA, 17 bp, Homo sapiens
tgatgatgttttgatat

SEQ ID NO: 5649017 - DNA, 17 bp, Homo sapiens
tgatgattaaacacctg

SEQ ID NO: 5649018 - DNA, 18 bp, Homo sapiens
tgatgattaaacacctga

SEQ ID NO: 5649019 - DNA, 20 bp, Homo sapiens
tgatgattaaacacctgaca

SEQ ID NO: 5649020 - DNA, 16 bp, Homo sapiens
tgatgattaatacaat

SEQ ID NO: 5649021 - DNA, 22 bp, Homo sapiens
tgatgattgaactggaataata

SEQ ID NO: 5649022 - DNA, 16 bp, Homo sapiens
tgatgatttcagaaac

SEQ ID NO: 5649023 - DNA, 15 bp, Homo sapiens
tgatgatttggggga

SEQ ID NO: 5649024 - DNA, 16 bp, Homo sapiens
tgatgattttcatttc

SEQ ID NO: 5649025 - DNA, 15 bp, Homo sapiens
tgatgattttccttt

SEQ ID NO: 5649026 - DNA, 16 bp, Homo sapiens
tgatgattttcctttt

SEQ ID NO: 5649027 - DNA, 18 bp, Homo sapiens
tgatgattttcctttttc

SEQ ID NO: 5649028 - DNA, 18 bp, Homo sapiens
tgatgattttgcaaaatg

SEQ ID NO: 5649029 - DNA, 19 bp, Homo sapiens
tgatgcaaccaaaagggaa

SEQ ID NO: 5649030 - DNA, 13 bp, Homo sapiens
tgatgcaaggatt

SEQ ID NO: 5649031 - DNA, 21 bp, Homo sapiens
tgatgcaaggattacagaaac

SEQ ID NO: 5649032 - DNA, 14 bp, Homo sapiens
tgatgcaagtcact

SEQ ID NO: 5649033 - DNA, 11 bp, Homo sapiens
tgatgcaatat

SEQ ID NO: 5649034 - DNA, 17 bp, Homo sapiens
tgatgcacagagaagct

SEQ ID NO: 5649035 - DNA, 17 bp, Homo sapiens
tgatgcacatttcatgt

SEQ ID NO: 5649036 - DNA, 14 bp, Homo sapiens
tgatgcacttattt

SEQ ID NO: 5649037 - DNA, 14 bp, Homo sapiens
tgatgcagacacag

SEQ ID NO: 5649038 - DNA, 13 bp, Homo sapiens
tgatgcagcattt

SEQ ID NO: 5649039 - DNA, 14 bp, Homo sapiens
tgatgcagcatttg

SEQ ID NO: 5649040 - DNA, 23 bp, Homo sapiens
tgatgcagcatttgataatgata

SEQ ID NO: 5649041 - DNA, 21 bp, Homo sapiens
tgatgcagcttatacgaaata

SEQ ID NO: 5649042 - DNA, 19 bp, Homo sapiens
tgatgcaggatttgttctc

SEQ ID NO: 5649043 - DNA, 13 bp, Homo sapiens
tgatgcagtgccc

SEQ ID NO: 5649044 - DNA, 22 bp, Homo sapiens
tgatgcagtgtgtctttataaa

SEQ ID NO: 5649045 - DNA, 21 bp, Homo sapiens
tgatgcagttagtatagcttt

SEQ ID NO: 5649046 - DNA, 14 bp, Homo sapiens
tgatgcatacagtt

SEQ ID NO: 5649047 - DNA, 20 bp, Homo sapiens
tgatgcatacagttttctag

SEQ ID NO: 5649048 - DNA, 22 bp, Homo sapiens
tgatgcatcagaaagggagggc

SEQ ID NO: 5649049 - DNA, 23 bp, Homo sapiens
tgatgcatgcactgttccccctg

SEQ ID NO: 5649050 - DNA, 13 bp, Homo sapiens
tgatgcatgcttt

SEQ ID NO: 5649051 - DNA, 20 bp, Homo sapiens
tgatgcatggagtgtttgac

SEQ ID NO: 5649052 - DNA, 13 bp, Homo sapiens
tgatgcatgtctt

SEQ ID NO: 5649053 - DNA, 21 bp, Homo sapiens
tgatgcatgtggtttggttcc

SEQ ID NO: 5649054 - DNA, 17 bp, Homo sapiens
tgatgcattaaaagaaa

SEQ ID NO: 5649055 - DNA, 17 bp, Homo sapiens
tgatgcatttccacact

SEQ ID NO: 5649056 - DNA, 14 bp, Homo sapiens
tgatgcattttata

SEQ ID NO: 5649057 - DNA, 20 bp, Homo sapiens
tgatgccaaaatgactttat

SEQ ID NO: 5649058 - DNA, 21 bp, Homo sapiens
tgatgccaaagatgtttgaaa

SEQ ID NO: 5649059 - DNA, 12 bp, Homo sapiens
tgatgccaaagc

SEQ ID NO: 5649060 - DNA, 14 bp, Homo sapiens
tgatgccaaagctg

SEQ ID NO: 5649061 - DNA, 19 bp, Homo sapiens
tgatgccaaagctgctttc

SEQ ID NO: 5649062 - DNA, 19 bp, Homo sapiens
tgatgccaagttgtttgag

SEQ ID NO: 5649063 - DNA, 21 bp, Homo sapiens
tgatgccaagttgtttgagaa

SEQ ID NO: 5649064 - DNA, 18 bp, Homo sapiens
tgatgccacacagagtgg

SEQ ID NO: 5649065 - DNA, 15 bp, Homo sapiens
tgatgccacaccaag

SEQ ID NO: 5649066 - DNA, 20 bp, Homo sapiens
tgatgccacaccaagctgtg

SEQ ID NO: 5649067 - DNA, 13 bp, Homo sapiens
tgatgccagaggg

SEQ ID NO: 5649068 - DNA, 15 bp, Homo sapiens
tgatgccagagggcc

SEQ ID NO: 5649069 - DNA, 18 bp, Homo sapiens
tgatgccagagggccagc

SEQ ID NO: 5649070 - DNA, 19 bp, Homo sapiens
tgatgccagagggccagca

SEQ ID NO: 5649071 - DNA, 20 bp, Homo sapiens
tgatgccagagggccagcag

SEQ ID NO: 5649072 - DNA, 21 bp, Homo sapiens
tgatgccagagggccagcagg

SEQ ID NO: 5649073 - DNA, 22 bp, Homo sapiens
tgatgccagagggccagcaggc

SEQ ID NO: 5649074 - DNA, 16 bp, Homo sapiens
tgatgcccagctcagt

SEQ ID NO: 5649075 - DNA, 24 bp, Homo sapiens
tgatgccctataacccctgcctgg

SEQ ID NO: 5649076 - DNA, 18 bp, Homo sapiens
tgatgccctcccctcagc

SEQ ID NO: 5649077 - DNA, 19 bp, Homo sapiens
tgatgccctcccctcagcg

SEQ ID NO: 5649078 - DNA, 12 bp, Homo sapiens
tgatgccctctt

SEQ ID NO: 5649079 - DNA, 18 bp, Homo sapiens
tgatgccctgctccaggg

SEQ ID NO: 5649080 - DNA, 20 bp, Homo sapiens
tgatgccctgctccagggag

SEQ ID NO: 5649081 - DNA, 17 bp, Homo sapiens
tgatgccgctcttctgt

SEQ ID NO: 5649082 - DNA, 23 bp, Homo sapiens
tgatgccgctcttctgtcatccc

SEQ ID NO: 5649083 - DNA, 14 bp, Homo sapiens
tgatgccgtgcggg

SEQ ID NO: 5649084 - DNA, 18 bp, Homo sapiens
tgatgcctaattatgaat

SEQ ID NO: 5649085 - DNA, 14 bp, Homo sapiens
tgatgcctccttgg

SEQ ID NO: 5649086 - DNA, 12 bp, Homo sapiens
tgatgccttccg

SEQ ID NO: 5649087 - DNA, 16 bp, Homo sapiens
tgatttactggaatta

SEQ ID NO: 5649088 - DNA, 16 bp, Homo sapiens
tgatttagagatgata

SEQ ID NO: 5649089 - DNA, 12 bp, Homo sapiens
tgatttagatga

SEQ ID NO: 5649090 - DNA, 16 bp, Homo sapiens
tgatttagcaagcaac

SEQ ID NO: 5649091 - DNA, 20 bp, Homo sapiens
tgatttagccatgtgaaact

SEQ ID NO: 5649092 - DNA, 22 bp, Homo sapiens
tgatttaggagaagccaggaat

SEQ ID NO: 5649093 - DNA, 21 bp, Homo sapiens
tgatttaggtagccttgtgtt

SEQ ID NO: 5649094 - DNA, 22 bp, Homo sapiens
tgatttaggtagccttgtgttc

SEQ ID NO: 5649095 - DNA, 22 bp, Homo sapiens
tgatttagtaatagtccaatat

SEQ ID NO: 5649096 - DNA, 15 bp, Homo sapiens
tgatttataaacaga

SEQ ID NO: 5649097 - DNA, 23 bp, Homo sapiens
tgatttataaacagacaatatgt

SEQ ID NO: 5649098 - DNA, 18 bp, Homo sapiens
tgatttatatatggcata

SEQ ID NO: 5649099 - DNA, 18 bp, Homo sapiens
tgatttatcacacaaagc

SEQ ID NO: 5649100 - DNA, 20 bp, Homo sapiens
tgatttatcctcacataaaa

SEQ ID NO: 5649101 - DNA, 13 bp, Homo sapiens
tgatttatgcatt

SEQ ID NO: 5649102 - DNA, 14 bp, Homo sapiens
tgatttatgcattt

SEQ ID NO: 5649103 - DNA, 12 bp, Homo sapiens
tgatttattaac

SEQ ID NO: 5649104 - DNA, 18 bp, Homo sapiens
tgatttattctggtgtct

SEQ ID NO: 5649105 - DNA, 16 bp, Homo sapiens
tgatttattgaaattt

SEQ ID NO: 5649106 - DNA, 18 bp, Homo sapiens
tgatttatttctactata

SEQ ID NO: 5649107 - DNA, 20 bp, Homo sapiens
tgatttatttctactatata

SEQ ID NO: 5649108 - DNA, 19 bp, Homo sapiens
tgatttatttggagtggag

SEQ ID NO: 5649109 - DNA, 21 bp, Homo sapiens
tgatttcaaagttttgttgta

SEQ ID NO: 5649110 - DNA, 19 bp, Homo sapiens
tgatttcaatacactcaag

SEQ ID NO: 5649111 - DNA, 17 bp, Homo sapiens
tgatttcaatgattgtt

SEQ ID NO: 5649112 - DNA, 16 bp, Homo sapiens
tgatttcacaaatatt

SEQ ID NO: 5649113 - DNA, 23 bp, Homo sapiens
tgatttcacaaatattaaaaagt

SEQ ID NO: 5649114 - DNA, 16 bp, Homo sapiens
tgatttcactttggga

SEQ ID NO: 5649115 - DNA, 18 bp, Homo sapiens
tgatttcagaagagactg

SEQ ID NO: 5649116 - DNA, 21 bp, Homo sapiens
tgatttcagcacctacagtgt

SEQ ID NO: 5649117 - DNA, 11 bp, Homo sapiens
tgatttcagga

SEQ ID NO: 5649118 - DNA, 23 bp, Homo sapiens
tgatttcagggaaatggagggtg

SEQ ID NO: 5649119 - DNA, 22 bp, Homo sapiens
tgatttcagtagcacaagttat

SEQ ID NO: 5649120 - DNA, 15 bp, Homo sapiens
tgatttcagttctag

SEQ ID NO: 5649121 - DNA, 18 bp, Homo sapiens
tgatttcagttctaggaa

SEQ ID NO: 5649122 - DNA, 19 bp, Homo sapiens
tgatttcagttctaggaaa

SEQ ID NO: 5649123 - DNA, 18 bp, Homo sapiens
tgatttcagtttttcatt

SEQ ID NO: 5649124 - DNA, 21 bp, Homo sapiens
tgatttcagtttttcatttgt

SEQ ID NO: 5649125 - DNA, 13 bp, Homo sapiens
tgatttcataatt

SEQ ID NO: 5649126 - DNA, 16 bp, Homo sapiens
tgatttcatcttctgg

SEQ ID NO: 5649127 - DNA, 22 bp, Homo sapiens
tgatttcatgattagacaatgt

SEQ ID NO: 5649128 - DNA, 13 bp, Homo sapiens
tgatttcatgtac

SEQ ID NO: 5649129 - DNA, 15 bp, Homo sapiens
tgatttcatgtactg

SEQ ID NO: 5649130 - DNA, 12 bp, Homo sapiens
tgatttccaggc

SEQ ID NO: 5649131 - DNA, 20 bp, Homo sapiens
tgatttccaggcccctgagg

SEQ ID NO: 5649132 - DNA, 20 bp, Homo sapiens
tgatttccagtgagtgtaaa

SEQ ID NO: 5649133 - DNA, 16 bp, Homo sapiens
tgatttccatttctga

SEQ ID NO: 5649134 - DNA, 17 bp, Homo sapiens
tgatttccatttctgat

SEQ ID NO: 5649135 - DNA, 17 bp, Homo sapiens
tgatttcccaaatgaaa

SEQ ID NO: 5649136 - DNA, 21 bp, Homo sapiens
tgatttcccaaatgaaatact

SEQ ID NO: 5649137 - DNA, 20 bp, Homo sapiens
tgatttcccactgcactcca

SEQ ID NO: 5649138 - DNA, 17 bp, Homo sapiens
tgatttcccgtggcccc

SEQ ID NO: 5649139 - DNA, 19 bp, Homo sapiens
tgatttcccgtggccccag

SEQ ID NO: 5649140 - DNA, 20 bp, Homo sapiens
tgatttcccgtggccccagc

SEQ ID NO: 5649141 - DNA, 22 bp, Homo sapiens
tgatttcccgtggccccagcct

SEQ ID NO: 5649142 - DNA, 23 bp, Homo sapiens
tgatttcccgtggccccagcctg

SEQ ID NO: 5649143 - DNA, 21 bp, Homo sapiens
tgatttccctccagagaaagc

SEQ ID NO: 5649144 - DNA, 22 bp, Homo sapiens
tgatttccctccagagaaagca

SEQ ID NO: 5649145 - DNA, 18 bp, Homo sapiens
tgatttccgttaaaatac

SEQ ID NO: 5649146 - DNA, 16 bp, Homo sapiens
tgatttcctaaacata

SEQ ID NO: 5649147 - DNA, 14 bp, Homo sapiens
tgatttcctctaaa

SEQ ID NO: 5649148 - DNA, 15 bp, Homo sapiens
tgatttcctctaaag

SEQ ID NO: 5649149 - DNA, 16 bp, Homo sapiens
tgatttcctctgaatt

SEQ ID NO: 5649150 - DNA, 12 bp, Homo sapiens
tgatttccttcc

SEQ ID NO: 5649151 - DNA, 15 bp, Homo sapiens
tgatttccttgaatg

SEQ ID NO: 5649152 - DNA, 15 bp, Homo sapiens
tgatttcgatgtaca

SEQ ID NO: 5649153 - DNA, 14 bp, Homo sapiens
tgatttctaagtgt

SEQ ID NO: 5649154 - DNA, 21 bp, Homo sapiens
tgatttctacgttatgaaaac

SEQ ID NO: 5649155 - DNA, 18 bp, Homo sapiens
tgatttctagaatggttt

SEQ ID NO: 5649156 - DNA, 21 bp, Homo sapiens
tgatttctatggctttcaaag

SEQ ID NO: 5649157 - DNA, 13 bp, Homo sapiens
tgatttctattca

SEQ ID NO: 5649158 - DNA, 21 bp, Homo sapiens
tgatttctattccctaacttg

SEQ ID NO: 5649159 - DNA, 23 bp, Homo sapiens
tgatttctcaccctctgtccttc

SEQ ID NO: 5649160 - DNA, 13 bp, Homo sapiens
tgatttctctgaa

SEQ ID NO: 5649161 - DNA, 16 bp, Homo sapiens
tgatttcttctccctc

SEQ ID NO: 5649162 - DNA, 19 bp, Homo sapiens
tgatttcttctgttttctg

SEQ ID NO: 5649163 - DNA, 22 bp, Homo sapiens
tgatttcttgctaagctccagc

SEQ ID NO: 5649164 - DNA, 19 bp, Homo sapiens
tgatttctttccttcccaa

SEQ ID NO: 5649165 - DNA, 19 bp, Homo sapiens
tgatttgaaaaaaagcatg

SEQ ID NO: 5649166 - DNA, 17 bp, Homo sapiens
tgatttgaagaacatgt

SEQ ID NO: 5649167 - DNA, 18 bp, Homo sapiens
tgatttgacccactcaca

SEQ ID NO: 5649168 - DNA, 14 bp, Homo sapiens
tgatttgagttgat

SEQ ID NO: 5649169 - DNA, 16 bp, Homo sapiens
tgatttgatatacaga

SEQ ID NO: 5649170 - DNA, 19 bp, Homo sapiens
tgatttgatatacagacct

SEQ ID NO: 5649171 - DNA, 15 bp, Homo sapiens
tgatttgatatagat

SEQ ID NO: 5649172 - DNA, 15 bp, Homo sapiens
tgatttgatgtgact

SEQ ID NO: 5649173 - DNA, 17 bp, Homo sapiens
tgatttgatgtgacttt

SEQ ID NO: 5649174 - DNA, 17 bp, Homo sapiens
tgatttgcaactttaga

SEQ ID NO: 5649175 - DNA, 18 bp, Homo sapiens
tgatttgcaggattttta

SEQ ID NO: 5649176 - DNA, 15 bp, Homo sapiens
tgatttgcatattca

SEQ ID NO: 5649177 - DNA, 14 bp, Homo sapiens
tgatttgcatggat

SEQ ID NO: 5649178 - DNA, 17 bp, Homo sapiens
tgatttgcatggatttt

SEQ ID NO: 5649179 - DNA, 14 bp, Homo sapiens
tgatttgccactga

SEQ ID NO: 5649180 - DNA, 21 bp, Homo sapiens
tgatttgccactgatattcag

SEQ ID NO: 5649181 - DNA, 13 bp, Homo sapiens
tgatttgcctgta

SEQ ID NO: 5649182 - DNA, 17 bp, Homo sapiens
tgatttgcctgtaattt

SEQ ID NO: 5649183 - DNA, 17 bp, Homo sapiens
tgatttgctctctaaac

SEQ ID NO: 5649184 - DNA, 19 bp, Homo sapiens
tgatttggaagagaggcac

SEQ ID NO: 5649185 - DNA, 14 bp, Homo sapiens
tgatttggccaggc

SEQ ID NO: 5649186 - DNA, 21 bp, Homo sapiens
tgatttgggctgaatgtatgt

SEQ ID NO: 5649187 - DNA, 13 bp, Homo sapiens
tgatttgggggag

SEQ ID NO: 5649188 - DNA, 18 bp, Homo sapiens
tgatttgggggaggcttt

SEQ ID NO: 5649189 - DNA, 13 bp, Homo sapiens
tgatttggggtga

SEQ ID NO: 5649190 - DNA, 21 bp, Homo sapiens
tgatttgggtttttttgttgt

SEQ ID NO: 5649191 - DNA, 22 bp, Homo sapiens
tgatttggtcagattgggataa

SEQ ID NO: 5649192 - DNA, 19 bp, Homo sapiens
tgatttggtgaccaactgt

SEQ ID NO: 5649193 - DNA, 20 bp, Homo sapiens
tgatttggttgcactttaga

SEQ ID NO: 5649194 - DNA, 15 bp, Homo sapiens
tgatttgtaaaacag

SEQ ID NO: 5649195 - DNA, 23 bp, Homo sapiens
tgatttgtaccattccttcaaat

SEQ ID NO: 5649196 - DNA, 18 bp, Homo sapiens
tgatttgtactgaaaaat

SEQ ID NO: 5649197 - DNA, 20 bp, Homo sapiens
tgatttgtcccagcctgggg

SEQ ID NO: 5649198 - DNA, 11 bp, Homo sapiens
tgatttgtcct

SEQ ID NO: 5649199 - DNA, 20 bp, Homo sapiens
tgatttgtgaaacagttgct

SEQ ID NO: 5649200 - DNA, 15 bp, Homo sapiens
tgatttgttcctttc

SEQ ID NO: 5649201 - DNA, 16 bp, Homo sapiens
tgatttgttttagaat

SEQ ID NO: 5649202 - DNA, 19 bp, Homo sapiens
tgatttgttttcctcttaa

SEQ ID NO: 5649203 - DNA, 14 bp, Homo sapiens
tgatttgttttgaa

SEQ ID NO: 5649204 - DNA, 19 bp, Homo sapiens
tgattttaaaaatacattt

SEQ ID NO: 5649205 - DNA, 13 bp, Homo sapiens
tgattttaaaatg

SEQ ID NO: 5649206 - DNA, 22 bp, Homo sapiens
tgattttaaaatgtacatgtat

SEQ ID NO: 5649207 - DNA, 17 bp, Homo sapiens
tgattttaaatgtgtga

SEQ ID NO: 5649208 - DNA, 16 bp, Homo sapiens
tgattttaacaataac

SEQ ID NO: 5649209 - DNA, 12 bp, Homo sapiens
tgattttaagag

SEQ ID NO: 5649210 - DNA, 11 bp, Homo sapiens
tgattttaagt

SEQ ID NO: 5649211 - DNA, 14 bp, Homo sapiens
tgattttaatacat

SEQ ID NO: 5649212 - DNA, 23 bp, Homo sapiens
tgattttaatgaaatcaaatgta

SEQ ID NO: 5649213 - DNA, 16 bp, Homo sapiens
tgattttacaaattaa

SEQ ID NO: 5649214 - DNA, 23 bp, Homo sapiens
tgattttacaaattaatatttgt

SEQ ID NO: 5649215 - DNA, 13 bp, Homo sapiens
tgattttacagag

SEQ ID NO: 5649216 - DNA, 19 bp, Homo sapiens
tgattttagatttctttga

SEQ ID NO: 5649217 - DNA, 18 bp, Homo sapiens
tgattttagctgcagaac

SEQ ID NO: 5649218 - DNA, 22 bp, Homo sapiens
tgattttaggagctaaggctct

SEQ ID NO: 5649219 - DNA, 14 bp, Homo sapiens
tgattttataattg

SEQ ID NO: 5649220 - DNA, 13 bp, Homo sapiens
tgattttatacat

SEQ ID NO: 5649221 - DNA, 15 bp, Homo sapiens
tgattttatctgtga

SEQ ID NO: 5649222 - DNA, 15 bp, Homo sapiens
tgattttattacaga

SEQ ID NO: 5649223 - DNA, 15 bp, Homo sapiens
tgattttattcttga

SEQ ID NO: 5649224 - DNA, 20 bp, Homo sapiens
tgattttatttaaactattc

SEQ ID NO: 5649225 - DNA, 11 bp, Homo sapiens
tgattttcaaa

SEQ ID NO: 5649226 - DNA, 13 bp, Homo sapiens
tgattttcaaaaa

SEQ ID NO: 5649227 - DNA, 18 bp, Homo sapiens
tgattttcaaaaaaatgt

SEQ ID NO: 5649228 - DNA, 17 bp, Homo sapiens
tgattttcaaacctcaa

SEQ ID NO: 5649229 - DNA, 20 bp, Homo sapiens
tgattttcaaagctttttcc

SEQ ID NO: 5649230 - DNA, 19 bp, Homo sapiens
tgattttcaaatatgtaaa

SEQ ID NO: 5649231 - DNA, 19 bp, Homo sapiens
tgattttcaagcagcatct

SEQ ID NO: 5649232 - DNA, 16 bp, Homo sapiens
tgattttcacagcttt

SEQ ID NO: 5649233 - DNA, 18 bp, Homo sapiens
tgattttcacctgttata

SEQ ID NO: 5649234 - DNA, 16 bp, Homo sapiens
tgattttcagacaggg

SEQ ID NO: 5649235 - DNA, 19 bp, Homo sapiens
tgattttccatctaaaaat

SEQ ID NO: 5649236 - DNA, 20 bp, Homo sapiens
tgattttccccctaattctt

SEQ ID NO: 5649237 - DNA, 12 bp, Homo sapiens
tgattttctcac

SEQ ID NO: 5649238 - DNA, 23 bp, Homo sapiens
tgattttgaaaaagtaggctgcc

SEQ ID NO: 5649239 - DNA, 16 bp, Homo sapiens
tgattttgaaaagtat

SEQ ID NO: 5649240 - DNA, 16 bp, Homo sapiens
tgattttgaccttgta

SEQ ID NO: 5649241 - DNA, 13 bp, Homo sapiens
tgattttgaggtt

SEQ ID NO: 5649242 - DNA, 20 bp, Homo sapiens
tgattttgcaaaatgagttg

SEQ ID NO: 5649243 - DNA, 13 bp, Homo sapiens
tgattttgcaaat

SEQ ID NO: 5649244 - DNA, 18 bp, Homo sapiens
tgattttgccccctgagg

SEQ ID NO: 5649245 - DNA, 16 bp, Homo sapiens
tgattttgccctcctg

SEQ ID NO: 5649246 - DNA, 17 bp, Homo sapiens
tgattttgccctcctgc

SEQ ID NO: 5649247 - DNA, 14 bp, Homo sapiens
tgattttgctgtag

SEQ ID NO: 5649248 - DNA, 16 bp, Homo sapiens
tgattttgctgtagaa

SEQ ID NO: 5649249 - DNA, 17 bp, Homo sapiens
tgattttggaaagatgt

SEQ ID NO: 5649250 - DNA, 20 bp, Homo sapiens
tgattttggaaagatgttaa

SEQ ID NO: 5649251 - DNA, 13 bp, Homo sapiens
tgattttggcatg

SEQ ID NO: 5649252 - DNA, 20 bp, Homo sapiens
tgattttgtaattcttatga

SEQ ID NO: 5649253 - DNA, 12 bp, Homo sapiens
tgattttgtaca

SEQ ID NO: 5649254 - DNA, 15 bp, Homo sapiens
tgattttgtacagaa

SEQ ID NO: 5649255 - DNA, 16 bp, Homo sapiens
tgatttttaaagtact

SEQ ID NO: 5649256 - DNA, 21 bp, Homo sapiens
tgatttttaaagtttaaatac

SEQ ID NO: 5649257 - DNA, 23 bp, Homo sapiens
tgatttttaaagtttaaatacca

SEQ ID NO: 5649258 - DNA, 16 bp, Homo sapiens
tgatttttaacctcaa

SEQ ID NO: 5649259 - DNA, 21 bp, Homo sapiens
tgatttttaccgtttcttccc

SEQ ID NO: 5649260 - DNA, 13 bp, Homo sapiens
tgatttttatcta

SEQ ID NO: 5649261 - DNA, 18 bp, Homo sapiens
tgatttttatgccacctg

SEQ ID NO: 5649262 - DNA, 13 bp, Homo sapiens
tgatttttccttt

SEQ ID NO: 5649263 - DNA, 12 bp, Homo sapiens
tgatttttcggc

SEQ ID NO: 5649264 - DNA, 13 bp, Homo sapiens
tgatttttctctt

SEQ ID NO: 5649265 - DNA, 24 bp, Homo sapiens
tgcacagcccctaagtcaacttag

SEQ ID NO: 5649266 - DNA, 12 bp, Homo sapiens
tgcacagcctct

SEQ ID NO: 5649267 - DNA, 23 bp, Homo sapiens
tgcacagcgcgggcggaggcggc

SEQ ID NO: 5649268 - DNA, 12 bp, Homo sapiens
tgcacagctgct

SEQ ID NO: 5649269 - DNA, 13 bp, Homo sapiens
tgcacagctgctt

SEQ ID NO: 5649270 - DNA, 16 bp, Homo sapiens
tgcacagctgcttgtc

SEQ ID NO: 5649271 - DNA, 14 bp, Homo sapiens
tgcacagctggaga

SEQ ID NO: 5649272 - DNA, 16 bp, Homo sapiens
tgcacagctggagaaa

SEQ ID NO: 5649273 - DNA, 17 bp, Homo sapiens
tgcacagctggagaaat

SEQ ID NO: 5649274 - DNA, 13 bp, Homo sapiens
tgcacagctgtcc

SEQ ID NO: 5649275 - DNA, 20 bp, Homo sapiens
tgcacagctgtttgaaatgt

SEQ ID NO: 5649276 - DNA, 15 bp, Homo sapiens
tgcacagcttttcca

SEQ ID NO: 5649277 - DNA, 18 bp, Homo sapiens
tgcacaggaaagagtcac

SEQ ID NO: 5649278 - DNA, 20 bp, Homo sapiens
tgcacaggcacacagggccc

SEQ ID NO: 5649279 - DNA, 21 bp, Homo sapiens
tgcacaggcagatgtttgcct

SEQ ID NO: 5649280 - DNA, 13 bp, Homo sapiens
tgcacaggcagca

SEQ ID NO: 5649281 - DNA, 14 bp, Homo sapiens
tgcacaggccctgg

SEQ ID NO: 5649282 - DNA, 15 bp, Homo sapiens
tgcacaggccctggg

SEQ ID NO: 5649283 - DNA, 17 bp, Homo sapiens
tgcacaggccctgggga

SEQ ID NO: 5649284 - DNA, 18 bp, Homo sapiens
tgcacaggcctctgcctg

SEQ ID NO: 5649285 - DNA, 21 bp, Homo sapiens
tgcacaggcctctgcctgctg

SEQ ID NO: 5649286 - DNA, 16 bp, Homo sapiens
tgcacagggagacgta

SEQ ID NO: 5649287 - DNA, 16 bp, Homo sapiens
tgcacagggcaattga

SEQ ID NO: 5649288 - DNA, 18 bp, Homo sapiens
tgcacagggcagctgggc

SEQ ID NO: 5649289 - DNA, 15 bp, Homo sapiens
tgcacagggctgcaa

SEQ ID NO: 5649290 - DNA, 19 bp, Homo sapiens
tgcacagggtccccgagtg

SEQ ID NO: 5649291 - DNA, 15 bp, Homo sapiens
tgcacaggtctctgt

SEQ ID NO: 5649292 - DNA, 22 bp, Homo sapiens
tgcacaggtgccgccagctgcc

SEQ ID NO: 5649293 - DNA, 19 bp, Homo sapiens
tgcacaggtggctgtttct

SEQ ID NO: 5649294 - DNA, 22 bp, Homo sapiens
tgcacaggtttgttttttcaag

SEQ ID NO: 5649295 - DNA, 16 bp, Homo sapiens
tgcacaggttttcagc

SEQ ID NO: 5649296 - DNA, 14 bp, Homo sapiens
tgcacagtaaaaat

SEQ ID NO: 5649297 - DNA, 16 bp, Homo sapiens
tgcacagtaatatgaa

SEQ ID NO: 5649298 - DNA, 21 bp, Homo sapiens
tgcacagtaatatgaaagcca

SEQ ID NO: 5649299 - DNA, 15 bp, Homo sapiens
tgcacagtacaataa

SEQ ID NO: 5649300 - DNA, 17 bp, Homo sapiens
tgcacagtagtgttggg

SEQ ID NO: 5649301 - DNA, 19 bp, Homo sapiens
tgcacagtagtgttgggtg

SEQ ID NO: 5649302 - DNA, 22 bp, Homo sapiens
tgcacagtagtgttgggtggag

SEQ ID NO: 5649303 - DNA, 19 bp, Homo sapiens
tgcacagtatctgctgttc

SEQ ID NO: 5649304 - DNA, 18 bp, Homo sapiens
tgcacagtatttgtaatt

SEQ ID NO: 5649305 - DNA, 20 bp, Homo sapiens
tgcacagtatttgtaattaa

SEQ ID NO: 5649306 - DNA, 18 bp, Homo sapiens
tgcacagtcagaaggacg

SEQ ID NO: 5649307 - DNA, 18 bp, Homo sapiens
tgcacagtccacagctga

SEQ ID NO: 5649308 - DNA, 20 bp, Homo sapiens
tgcacagtccctcctgttgc

SEQ ID NO: 5649309 - DNA, 21 bp, Homo sapiens
tgcacagtgacttctgagatc

SEQ ID NO: 5649310 - DNA, 19 bp, Homo sapiens
tgcacagtgatttttttct

SEQ ID NO: 5649311 - DNA, 15 bp, Homo sapiens
tgcacagtgcatctc

SEQ ID NO: 5649312 - DNA, 18 bp, Homo sapiens
tgcacagtgcatctcagc

SEQ ID NO: 5649313 - DNA, 20 bp, Homo sapiens
tgcacagtgcatctcagccc

SEQ ID NO: 5649314 - DNA, 16 bp, Homo sapiens
tgcacagtgcctgatg

SEQ ID NO: 5649315 - DNA, 15 bp, Homo sapiens
tgcacagtggcttct

SEQ ID NO: 5649316 - DNA, 18 bp, Homo sapiens
tgcacagtttagaacaga

SEQ ID NO: 5649317 - DNA, 20 bp, Homo sapiens
tgcacatacgggctttaata

SEQ ID NO: 5649318 - DNA, 14 bp, Homo sapiens
tgcacatatacatc

SEQ ID NO: 5649319 - DNA, 18 bp, Homo sapiens
tgcacatatggactctgc

SEQ ID NO: 5649320 - DNA, 19 bp, Homo sapiens
tgcacatatgggtgctggc

SEQ ID NO: 5649321 - DNA, 22 bp, Homo sapiens
tgcacatcatattctattgttt

SEQ ID NO: 5649322 - DNA, 15 bp, Homo sapiens
tgcacatcattcatt

SEQ ID NO: 5649323 - DNA, 17 bp, Homo sapiens
tgcacatcattcattca

SEQ ID NO: 5649324 - DNA, 22 bp, Homo sapiens
tgcacatcattcattcactgta

SEQ ID NO: 5649325 - DNA, 13 bp, Homo sapiens
tgcacatccattc

SEQ ID NO: 5649326 - DNA, 18 bp, Homo sapiens
tgcacatccattcccaag

SEQ ID NO: 5649327 - DNA, 22 bp, Homo sapiens
tgcacatccgcgtgtgcctgtg

SEQ ID NO: 5649328 - DNA, 17 bp, Homo sapiens
tgcacatcctcattcac

SEQ ID NO: 5649329 - DNA, 19 bp, Homo sapiens
tgcacatctacatgccatg

SEQ ID NO: 5649330 - DNA, 15 bp, Homo sapiens
tgcacatctgtgtct

SEQ ID NO: 5649331 - DNA, 19 bp, Homo sapiens
tgcacatctgtgtcttgtt

SEQ ID NO: 5649332 - DNA, 17 bp, Homo sapiens
tgcacatctgttttgta

SEQ ID NO: 5649333 - DNA, 13 bp, Homo sapiens
tgcacatgaacat

SEQ ID NO: 5649334 - DNA, 14 bp, Homo sapiens
tgcacatgaactgt

SEQ ID NO: 5649335 - DNA, 14 bp, Homo sapiens
tgcacatgaactta

SEQ ID NO: 5649336 - DNA, 17 bp, Homo sapiens
tgcacatgaacttagat

SEQ ID NO: 5649337 - DNA, 14 bp, Homo sapiens
tgcacatgaagaaa

SEQ ID NO: 5649338 - DNA, 15 bp, Homo sapiens
tgcacatgaagaaat

SEQ ID NO: 5649339 - DNA, 21 bp, Homo sapiens
tgcacatgaagaaatactgca

SEQ ID NO: 5649340 - DNA, 17 bp, Homo sapiens
tgcacatgagtggaaat

SEQ ID NO: 5649341 - DNA, 18 bp, Homo sapiens
tgcacatgattgtataag

SEQ ID NO: 5649342 - DNA, 19 bp, Homo sapiens
tgcacatgatttcacaaat

SEQ ID NO: 5649343 - DNA, 20 bp, Homo sapiens
tgcacatgatttcacaaata

SEQ ID NO: 5649344 - DNA, 21 bp, Homo sapiens
tgcacatgatttcacaaatat

SEQ ID NO: 5649345 - DNA, 19 bp, Homo sapiens
tgcacatgcgcactctcat

SEQ ID NO: 5649346 - DNA, 17 bp, Homo sapiens
tgcacatggattcagtt

SEQ ID NO: 5649347 - DNA, 13 bp, Homo sapiens
tgcacatggcctg

SEQ ID NO: 5649348 - DNA, 15 bp, Homo sapiens
tgcacatggcctgag

SEQ ID NO: 5649349 - DNA, 12 bp, Homo sapiens
tgcacatgtctt

SEQ ID NO: 5649350 - DNA, 22 bp, Homo sapiens
tgcacatgtcttgtacatgtgt

SEQ ID NO: 5649351 - DNA, 19 bp, Homo sapiens
tgcacatgtgccacacagt

SEQ ID NO: 5649352 - DNA, 19 bp, Homo sapiens
tgcacatgtgtgcgtgtgc

SEQ ID NO: 5649353 - DNA, 20 bp, Homo sapiens
tgcacatgttggaggagaga

SEQ ID NO: 5649354 - DNA, 22 bp, Homo sapiens
tgcacatgttggaggagagagc

SEQ ID NO: 5649355 - DNA, 13 bp, Homo sapiens
tgcacatgtttcc

SEQ ID NO: 5649356 - DNA, 23 bp, Homo sapiens
tgcacattaggaacagagtatat

SEQ ID NO: 5649357 - DNA, 16 bp, Homo sapiens
tgcacattcatcctca

SEQ ID NO: 5649358 - DNA, 21 bp, Homo sapiens
tgcacattcatcctcacatgt

SEQ ID NO: 5649359 - DNA, 18 bp, Homo sapiens
tgcacattcctggccccg

SEQ ID NO: 5649360 - DNA, 19 bp, Homo sapiens
tgcacattgcctgttctgc

SEQ ID NO: 5649361 - DNA, 11 bp, Homo sapiens
tgcacattgtt

SEQ ID NO: 5649362 - DNA, 22 bp, Homo sapiens
tgcacatttatatatatatgta

SEQ ID NO: 5649363 - DNA, 13 bp, Homo sapiens
tgcacatttctgg

SEQ ID NO: 5649364 - DNA, 15 bp, Homo sapiens
tgcacatttctggat

SEQ ID NO: 5649365 - DNA, 21 bp, Homo sapiens
tgcacatttctggattgtggt

SEQ ID NO: 5649366 - DNA, 21 bp, Homo sapiens
tgcacatttgtgcataaattt

SEQ ID NO: 5649367 - DNA, 16 bp, Homo sapiens
tgcacattttgtacat

SEQ ID NO: 5649368 - DNA, 16 bp, Homo sapiens
tgcaccaaagagaatg

SEQ ID NO: 5649369 - DNA, 20 bp, Homo sapiens
tgcaccaaagatgtcctgac

SEQ ID NO: 5649370 - DNA, 18 bp, Homo sapiens
tgcaccaacccactgccc

SEQ ID NO: 5649371 - DNA, 23 bp, Homo sapiens
tgcaccaacccagccgctgcccg

SEQ ID NO: 5649372 - DNA, 15 bp, Homo sapiens
tgcaccaagaaagct

SEQ ID NO: 5649373 - DNA, 18 bp, Homo sapiens
tgcaccaatcttgtttat

SEQ ID NO: 5649374 - DNA, 23 bp, Homo sapiens
tgcaccaatcttgtttatagcaa

SEQ ID NO: 5649375 - DNA, 15 bp, Homo sapiens
tgcaccacacctggc

SEQ ID NO: 5649376 - DNA, 14 bp, Homo sapiens
tgcaccaccaagcc

SEQ ID NO: 5649377 - DNA, 15 bp, Homo sapiens
tgcaccaccaagcca

SEQ ID NO: 5649378 - DNA, 16 bp, Homo sapiens
tgcaccaccaagccaa

SEQ ID NO: 5649379 - DNA, 19 bp, Homo sapiens
tgcaccaccaagccaaggg

SEQ ID NO: 5649380 - DNA, 14 bp, Homo sapiens
tgcaccaccatgcc

SEQ ID NO: 5649381 - DNA, 19 bp, Homo sapiens
tgcaccactgcactccagc

SEQ ID NO: 5649382 - DNA, 21 bp, Homo sapiens
tgcaccactgcactccagcct

SEQ ID NO: 5649383 - DNA, 23 bp, Homo sapiens
tgcaccagagcaacctctcactc

SEQ ID NO: 5649384 - DNA, 18 bp, Homo sapiens
tgcaccagcccttccctg

SEQ ID NO: 5649385 - DNA, 12 bp, Homo sapiens
tgcaccaggaga

SEQ ID NO: 5649386 - DNA, 13 bp, Homo sapiens
tgcaccatactca

SEQ ID NO: 5649387 - DNA, 17 bp, Homo sapiens
tgcaccatactcatgca

SEQ ID NO: 5649388 - DNA, 22 bp, Homo sapiens
tgcaccatactccttgcttcct

SEQ ID NO: 5649389 - DNA, 17 bp, Homo sapiens
tgcaccatcacacatgc

SEQ ID NO: 5649390 - DNA, 15 bp, Homo sapiens
tgcaccatccctttt

SEQ ID NO: 5649391 - DNA, 21 bp, Homo sapiens
tgcaccatccctttttgaagt

SEQ ID NO: 5649392 - DNA, 23 bp, Homo sapiens
tgcaccatccctttttgaagtgt

SEQ ID NO: 5649393 - DNA, 14 bp, Homo sapiens
tgcaccatctgctt

SEQ ID NO: 5649394 - DNA, 15 bp, Homo sapiens
tgcaccatctgcttg

SEQ ID NO: 5649395 - DNA, 19 bp, Homo sapiens
tgcaccatgctgctgggga

SEQ ID NO: 5649396 - DNA, 15 bp, Homo sapiens
tgcaccatgtgaagt

SEQ ID NO: 5649397 - DNA, 19 bp, Homo sapiens
tgcaccatttaaaaacagg

SEQ ID NO: 5649398 - DNA, 14 bp, Homo sapiens
tgcaccattttcaa

SEQ ID NO: 5649399 - DNA, 16 bp, Homo sapiens
tgcacccaactactga

SEQ ID NO: 5649400 - DNA, 16 bp, Homo sapiens
tgcacccacccctgcc

SEQ ID NO: 5649401 - DNA, 13 bp, Homo sapiens
tgcacccacctgt

SEQ ID NO: 5649402 - DNA, 20 bp, Homo sapiens
tgcacccacctgttttctga

SEQ ID NO: 5649403 - DNA, 21 bp, Homo sapiens
tgcacccacctgttttctgaa

SEQ ID NO: 5649404 - DNA, 22 bp, Homo sapiens
tgcacccacctgttttctgaaa

SEQ ID NO: 5649405 - DNA, 14 bp, Homo sapiens
tgcacccacgtgca

SEQ ID NO: 5649406 - DNA, 18 bp, Homo sapiens
tgcacccactcaccaggg

SEQ ID NO: 5649407 - DNA, 23 bp, Homo sapiens
tgcacccagaaattccttcccac

SEQ ID NO: 5649408 - DNA, 15 bp, Homo sapiens
tgcacccagaagaag

SEQ ID NO: 5649409 - DNA, 21 bp, Homo sapiens
tgcacccagccccaaggggtg

SEQ ID NO: 5649410 - DNA, 17 bp, Homo sapiens
tgcacccagccctggtc

SEQ ID NO: 5649411 - DNA, 12 bp, Homo sapiens
tgcacccagctc

SEQ ID NO: 5649412 - DNA, 15 bp, Homo sapiens
tgcacccatcagcac

SEQ ID NO: 5649413 - DNA, 20 bp, Homo sapiens
tgcacccatcagcactctgt

SEQ ID NO: 5649414 - DNA, 20 bp, Homo sapiens
tgcaccccaaagctttcctg

SEQ ID NO: 5649415 - DNA, 22 bp, Homo sapiens
tgcaccccaaagctttcctgcc

SEQ ID NO: 5649416 - DNA, 18 bp, Homo sapiens
tgcaccccagcattccag

SEQ ID NO: 5649417 - DNA, 16 bp, Homo sapiens
tgcaccccatgctgtt

SEQ ID NO: 5649418 - DNA, 22 bp, Homo sapiens
tgcaccccatgtgggtgaccag

SEQ ID NO: 5649419 - DNA, 15 bp, Homo sapiens
tgcacccccctgggc

SEQ ID NO: 5649420 - DNA, 18 bp, Homo sapiens
tgcacccccctgtgcctg

SEQ ID NO: 5649421 - DNA, 21 bp, Homo sapiens
tgcacccccctgtgcctgctg

SEQ ID NO: 5649422 - DNA, 22 bp, Homo sapiens
tgcacccccctgtgcctgctgg

SEQ ID NO: 5649423 - DNA, 14 bp, Homo sapiens
tgcaccccctcctg

SEQ ID NO: 5649424 - DNA, 16 bp, Homo sapiens
tgcaccccctcctgct

SEQ ID NO: 5649425 - DNA, 17 bp, Homo sapiens
tgcaccccctcctgctg

SEQ ID NO: 5649426 - DNA, 18 bp, Homo sapiens
tgcacccctgagccagca

SEQ ID NO: 5649427 - DNA, 23 bp, Homo sapiens
tgcacccctgagttgggcagcca

SEQ ID NO: 5649428 - DNA, 13 bp, Homo sapiens
tgcacccctgccc

SEQ ID NO: 5649429 - DNA, 16 bp, Homo sapiens
tgcacccctgggccag

SEQ ID NO: 5649430 - DNA, 13 bp, Homo sapiens
tgcaccccttcct

SEQ ID NO: 5649431 - DNA, 14 bp, Homo sapiens
tgcaccccttcctc

SEQ ID NO: 5649432 - DNA, 15 bp, Homo sapiens
tgcaccccttcctgg

SEQ ID NO: 5649433 - DNA, 18 bp, Homo sapiens
tgcaccccttcctgggca

SEQ ID NO: 5649434 - DNA, 15 bp, Homo sapiens
tgcaccccttctctc

SEQ ID NO: 5649435 - DNA, 14 bp, Homo sapiens
tgcacccctttcct

SEQ ID NO: 5649436 - DNA, 16 bp, Homo sapiens
tgcacccgcatgtaca

SEQ ID NO: 5649437 - DNA, 14 bp, Homo sapiens
tgcacccggcctgg

SEQ ID NO: 5649438 - DNA, 15 bp, Homo sapiens
tgcacccggcctgga

SEQ ID NO: 5649439 - DNA, 23 bp, Homo sapiens
tgcacccggcctggatgccagct

SEQ ID NO: 5649440 - DNA, 14 bp, Homo sapiens
tgcacccgtgccac

SEQ ID NO: 5649441 - DNA, 15 bp, Homo sapiens
tgcacccgtgccacg

SEQ ID NO: 5649442 - DNA, 15 bp, Homo sapiens
tgcaccctccaccct

SEQ ID NO: 5649443 - DNA, 12 bp, Homo sapiens
tgcagcaggcag

SEQ ID NO: 5649444 - DNA, 19 bp, Homo sapiens
tgcagcaggcagaggagag

SEQ ID NO: 5649445 - DNA, 14 bp, Homo sapiens
tgcagcagggaagg

SEQ ID NO: 5649446 - DNA, 19 bp, Homo sapiens
tgcagcagggatgccctgg

SEQ ID NO: 5649447 - DNA, 15 bp, Homo sapiens
tgcagcagggctggg

SEQ ID NO: 5649448 - DNA, 17 bp, Homo sapiens
tgcagcagggctgggcc

SEQ ID NO: 5649449 - DNA, 19 bp, Homo sapiens
tgcagcagggctgggcctg

SEQ ID NO: 5649450 - DNA, 20 bp, Homo sapiens
tgcagcaggtgctgggctgg

SEQ ID NO: 5649451 - DNA, 23 bp, Homo sapiens
tgcagcaggtgctgggctggact

SEQ ID NO: 5649452 - DNA, 13 bp, Homo sapiens
tgcagcagtcgcc

SEQ ID NO: 5649453 - DNA, 22 bp, Homo sapiens
tgcagcagtgagtctcttcaga

SEQ ID NO: 5649454 - DNA, 22 bp, Homo sapiens
tgcagcagttcacctatttcaa

SEQ ID NO: 5649455 - DNA, 14 bp, Homo sapiens
tgcagcatacaaaa

SEQ ID NO: 5649456 - DNA, 19 bp, Homo sapiens
tgcagcataccaattaccc

SEQ ID NO: 5649457 - DNA, 15 bp, Homo sapiens
tgcagcatatgagga

SEQ ID NO: 5649458 - DNA, 17 bp, Homo sapiens
tgcagcatatgaggatg

SEQ ID NO: 5649459 - DNA, 13 bp, Homo sapiens
tgcagcatgacct

SEQ ID NO: 5649460 - DNA, 15 bp, Homo sapiens
tgcagcatgagactt

SEQ ID NO: 5649461 - DNA, 19 bp, Homo sapiens
tgcagcatgagactttctg

SEQ ID NO: 5649462 - DNA, 21 bp, Homo sapiens
tgcagcatgagactttctgct

SEQ ID NO: 5649463 - DNA, 18 bp, Homo sapiens
tgcagcatggtccctgcc

SEQ ID NO: 5649464 - DNA, 19 bp, Homo sapiens
tgcagcatggtccctgcct

SEQ ID NO: 5649465 - DNA, 21 bp, Homo sapiens
tgcagcatgttgctgaggagt

SEQ ID NO: 5649466 - DNA, 15 bp, Homo sapiens
tgcagcatttactat

SEQ ID NO: 5649467 - DNA, 21 bp, Homo sapiens
tgcagcatttactatgcacaa

SEQ ID NO: 5649468 - DNA, 22 bp, Homo sapiens
tgcagcatttactatgcacaac

SEQ ID NO: 5649469 - DNA, 14 bp, Homo sapiens
tgcagcatttcact

SEQ ID NO: 5649470 - DNA, 13 bp, Homo sapiens
tgcagccaaacag

SEQ ID NO: 5649471 - DNA, 18 bp, Homo sapiens
tgcagccaaacagagcct

SEQ ID NO: 5649472 - DNA, 21 bp, Homo sapiens
tgcagccaaacagagccttca

SEQ ID NO: 5649473 - DNA, 21 bp, Homo sapiens
tgcagccaaaggggagccaga

SEQ ID NO: 5649474 - DNA, 19 bp, Homo sapiens
tgcagccaaccccatcctc

SEQ ID NO: 5649475 - DNA, 21 bp, Homo sapiens
tgcagccaagtagcctctcct

SEQ ID NO: 5649476 - DNA, 15 bp, Homo sapiens
tgcagccacatggga

SEQ ID NO: 5649477 - DNA, 16 bp, Homo sapiens
tgcagccaccacatcc

SEQ ID NO: 5649478 - DNA, 17 bp, Homo sapiens
tgcagccagaaaggaac

SEQ ID NO: 5649479 - DNA, 14 bp, Homo sapiens
tgcagccagaccta

SEQ ID NO: 5649480 - DNA, 11 bp, Homo sapiens
tgcagccagag

SEQ ID NO: 5649481 - DNA, 15 bp, Homo sapiens
tgcagccagcccagc

SEQ ID NO: 5649482 - DNA, 22 bp, Homo sapiens
tgcagccagcccagcccagctg

SEQ ID NO: 5649483 - DNA, 23 bp, Homo sapiens
tgcagccagcccagcccagctgg

SEQ ID NO: 5649484 - DNA, 14 bp, Homo sapiens
tgcagccaggagaa

SEQ ID NO: 5649485 - DNA, 23 bp, Homo sapiens
tgcagccaggaggagaggaaagg

SEQ ID NO: 5649486 - DNA, 12 bp, Homo sapiens
tgcagccaggcc

SEQ ID NO: 5649487 - DNA, 15 bp, Homo sapiens
tgcagccaggcctcg

SEQ ID NO: 5649488 - DNA, 14 bp, Homo sapiens
tgcagccagggctg

SEQ ID NO: 5649489 - DNA, 18 bp, Homo sapiens
tgcagccagggctggggt

SEQ ID NO: 5649490 - DNA, 14 bp, Homo sapiens
tgcagccatcccgc

SEQ ID NO: 5649491 - DNA, 21 bp, Homo sapiens
tgcagccatcccgcttagcct

SEQ ID NO: 5649492 - DNA, 22 bp, Homo sapiens
tgcagcccaaaacccagggcaa

SEQ ID NO: 5649493 - DNA, 22 bp, Homo sapiens
tgcagcccaaaggctgcagcat

SEQ ID NO: 5649494 - DNA, 23 bp, Homo sapiens
tgcagcccaaggacagttcagag

SEQ ID NO: 5649495 - DNA, 20 bp, Homo sapiens
tgcagcccacagaggacagt

SEQ ID NO: 5649496 - DNA, 12 bp, Homo sapiens
tgcagcccacca

SEQ ID NO: 5649497 - DNA, 14 bp, Homo sapiens
tgcagcccaccagg

SEQ ID NO: 5649498 - DNA, 16 bp, Homo sapiens
tgcagcccaccaggag

SEQ ID NO: 5649499 - DNA, 20 bp, Homo sapiens
tgcagcccagcctagtcagg

SEQ ID NO: 5649500 - DNA, 14 bp, Homo sapiens
tgcagcccaggcca

SEQ ID NO: 5649501 - DNA, 19 bp, Homo sapiens
tgcagcccatgcccacctg

SEQ ID NO: 5649502 - DNA, 15 bp, Homo sapiens
tgcagcccatttctc

SEQ ID NO: 5649503 - DNA, 13 bp, Homo sapiens
tgcagccccaggc

SEQ ID NO: 5649504 - DNA, 17 bp, Homo sapiens
tgcagccccaggcctcc

SEQ ID NO: 5649505 - DNA, 17 bp, Homo sapiens
tgcagccccagggcctg

SEQ ID NO: 5649506 - DNA, 19 bp, Homo sapiens
tgcagccccctcctgaccc

SEQ ID NO: 5649507 - DNA, 19 bp, Homo sapiens
tgcagcccctctcacaggc

SEQ ID NO: 5649508 - DNA, 15 bp, Homo sapiens
tgcagcccctgggcc

SEQ ID NO: 5649509 - DNA, 19 bp, Homo sapiens
tgcagcccctgggcccttg

SEQ ID NO: 5649510 - DNA, 19 bp, Homo sapiens
tgcagcccgatgtccctgt

SEQ ID NO: 5649511 - DNA, 22 bp, Homo sapiens
tgcagcccggcgccaccatcct

SEQ ID NO: 5649512 - DNA, 17 bp, Homo sapiens
tgcagcccgtgtccagg

SEQ ID NO: 5649513 - DNA, 18 bp, Homo sapiens
tgcagcccgtgtccagga

SEQ ID NO: 5649514 - DNA, 21 bp, Homo sapiens
tgcagcccgtgtggccccttc

SEQ ID NO: 5649515 - DNA, 23 bp, Homo sapiens
tgcagcccgtgtggccccttcac

SEQ ID NO: 5649516 - DNA, 19 bp, Homo sapiens
tgcagccctgagaaagccc

SEQ ID NO: 5649517 - DNA, 22 bp, Homo sapiens
tgcagccctgctgctgcctgcc

SEQ ID NO: 5649518 - DNA, 14 bp, Homo sapiens
tgcagcccttcctc

SEQ ID NO: 5649519 - DNA, 18 bp, Homo sapiens
tgcagcccttcctcctga

SEQ ID NO: 5649520 - DNA, 12 bp, Homo sapiens
tgcagcccttgg

SEQ ID NO: 5649521 - DNA, 13 bp, Homo sapiens
tgcagcccttggg

SEQ ID NO: 5649522 - DNA, 16 bp, Homo sapiens
tgcagccgccttcctt

SEQ ID NO: 5649523 - DNA, 18 bp, Homo sapiens
tgcagccggaggaggaga

SEQ ID NO: 5649524 - DNA, 21 bp, Homo sapiens
tgcagccggggagctgagggg

SEQ ID NO: 5649525 - DNA, 19 bp, Homo sapiens
tgcagcctcaacctcctgg

SEQ ID NO: 5649526 - DNA, 23 bp, Homo sapiens
tgcagcctcaacctcctgggcta

SEQ ID NO: 5649527 - DNA, 15 bp, Homo sapiens
tgcagcctcacagtc

SEQ ID NO: 5649528 - DNA, 16 bp, Homo sapiens
tgcagcctcacagtcc

SEQ ID NO: 5649529 - DNA, 14 bp, Homo sapiens
tgcagcctcagaga

SEQ ID NO: 5649530 - DNA, 21 bp, Homo sapiens
tgcagcctcaggactgggagc

SEQ ID NO: 5649531 - DNA, 23 bp, Homo sapiens
tgcagcctcatactcctgggctc

SEQ ID NO: 5649532 - DNA, 18 bp, Homo sapiens
tgcagcctccacttccct

SEQ ID NO: 5649533 - DNA, 19 bp, Homo sapiens
tgcagcctccacttccctc

SEQ ID NO: 5649534 - DNA, 20 bp, Homo sapiens
tgcagcctccacttccctcg

SEQ ID NO: 5649535 - DNA, 15 bp, Homo sapiens
tgcagcctcccccac

SEQ ID NO: 5649536 - DNA, 17 bp, Homo sapiens
tgcagcctccgcctccc

SEQ ID NO: 5649537 - DNA, 23 bp, Homo sapiens
tgcagcctccgcttccctggttc

SEQ ID NO: 5649538 - DNA, 16 bp, Homo sapiens
tgcagcctcctcctga

SEQ ID NO: 5649539 - DNA, 17 bp, Homo sapiens
tgcagcctcctcctgac

SEQ ID NO: 5649540 - DNA, 21 bp, Homo sapiens
tgcagcctcgaactcctgggc

SEQ ID NO: 5649541 - DNA, 22 bp, Homo sapiens
tgcagcctcgaactcctgggct

SEQ ID NO: 5649542 - DNA, 23 bp, Homo sapiens
tgcagcctcgaactcctgggctc

SEQ ID NO: 5649543 - DNA, 21 bp, Homo sapiens
tgcagcctcgacctccctggc

SEQ ID NO: 5649544 - DNA, 18 bp, Homo sapiens
tgcagcctctctggctgg

SEQ ID NO: 5649545 - DNA, 12 bp, Homo sapiens
tgcagcctgaga

SEQ ID NO: 5649546 - DNA, 13 bp, Homo sapiens
tgcagcctgagct

SEQ ID NO: 5649547 - DNA, 18 bp, Homo sapiens
tgcagcctgcaggacctc

SEQ ID NO: 5649548 - DNA, 18 bp, Homo sapiens
tgcagcctgcatcccttc

SEQ ID NO: 5649549 - DNA, 13 bp, Homo sapiens
tgcagcctgctgg

SEQ ID NO: 5649550 - DNA, 15 bp, Homo sapiens
tgcagcctgctgggg

SEQ ID NO: 5649551 - DNA, 14 bp, Homo sapiens
tgcagcctggctgg

SEQ ID NO: 5649552 - DNA, 23 bp, Homo sapiens
tgcagcctgggctccctcttgtg

SEQ ID NO: 5649553 - DNA, 15 bp, Homo sapiens
tgcagcctgggtctg

SEQ ID NO: 5649554 - DNA, 22 bp, Homo sapiens
tgcagcctgggtctggatggga

SEQ ID NO: 5649555 - DNA, 13 bp, Homo sapiens
tgcagcctggtca

SEQ ID NO: 5649556 - DNA, 20 bp, Homo sapiens
tgcagcctgtcctgggctgg

SEQ ID NO: 5649557 - DNA, 13 bp, Homo sapiens
tgcagcctgtggc

SEQ ID NO: 5649558 - DNA, 21 bp, Homo sapiens
tgcagccttaaacagtgtcca

SEQ ID NO: 5649559 - DNA, 13 bp, Homo sapiens
tgcagccttcccc

SEQ ID NO: 5649560 - DNA, 19 bp, Homo sapiens
tgcagccttcccctccctg

SEQ ID NO: 5649561 - DNA, 13 bp, Homo sapiens
tgcagccttctcc

SEQ ID NO: 5649562 - DNA, 12 bp, Homo sapiens
tgcagccttgcg

SEQ ID NO: 5649563 - DNA, 14 bp, Homo sapiens
tgcagccttgcgct

SEQ ID NO: 5649564 - DNA, 21 bp, Homo sapiens
tgcagccttgcgctgtcccag

SEQ ID NO: 5649565 - DNA, 23 bp, Homo sapiens
tgcagccttgcgctgtcccaggc

SEQ ID NO: 5649566 - DNA, 22 bp, Homo sapiens
tgcagcctttcacaggactctg

SEQ ID NO: 5649567 - DNA, 21 bp, Homo sapiens
tgcagccttttctggtccctc

SEQ ID NO: 5649568 - DNA, 23 bp, Homo sapiens
tgcagccttttctggtccctctt

SEQ ID NO: 5649569 - DNA, 19 bp, Homo sapiens
tgcagcgcagctggactct

SEQ ID NO: 5649570 - DNA, 22 bp, Homo sapiens
tgcagcgcagctggactctgca

SEQ ID NO: 5649571 - DNA, 17 bp, Homo sapiens
tgcagcgcccctctgca

SEQ ID NO: 5649572 - DNA, 16 bp, Homo sapiens
tgcagcgcctcccttg

SEQ ID NO: 5649573 - DNA, 21 bp, Homo sapiens
tgcagcgctgggccccaaggc

SEQ ID NO: 5649574 - DNA, 22 bp, Homo sapiens
tgcagcgggcaaagagctcccg

SEQ ID NO: 5649575 - DNA, 17 bp, Homo sapiens
tgcagcgggccaggcag

SEQ ID NO: 5649576 - DNA, 18 bp, Homo sapiens
tgcagcgggccaggcagg

SEQ ID NO: 5649577 - DNA, 19 bp, Homo sapiens
tgcagcgggccaggcaggc

SEQ ID NO: 5649578 - DNA, 21 bp, Homo sapiens
tgcagcggtggaaggagcctg

SEQ ID NO: 5649579 - DNA, 23 bp, Homo sapiens
tgcagcgtctttttaacctcaga

SEQ ID NO: 5649580 - DNA, 22 bp, Homo sapiens
tgcagctagtcctagtgaacct

SEQ ID NO: 5649581 - DNA, 17 bp, Homo sapiens
tgcagctatggacaatt

SEQ ID NO: 5649582 - DNA, 17 bp, Homo sapiens
tgcagctcaactttctg

SEQ ID NO: 5649583 - DNA, 21 bp, Homo sapiens
tgcagctcaaggaaaggcctg

SEQ ID NO: 5649584 - DNA, 21 bp, Homo sapiens
tgcagctcaagggctggcact

SEQ ID NO: 5649585 - DNA, 18 bp, Homo sapiens
tgcagctccctggcttct

SEQ ID NO: 5649586 - DNA, 14 bp, Homo sapiens
tgcagctcttcctg

SEQ ID NO: 5649587 - DNA, 21 bp, Homo sapiens
tgcagctgaaattgaaaagtt

SEQ ID NO: 5649588 - DNA, 21 bp, Homo sapiens
tgcagctgacctctgttgtcc

SEQ ID NO: 5649589 - DNA, 20 bp, Homo sapiens
tgcagctgacttttctgacc

SEQ ID NO: 5649590 - DNA, 19 bp, Homo sapiens
tgcagctgagagaaaataa

SEQ ID NO: 5649591 - DNA, 18 bp, Homo sapiens
tgcagctgatccatagga

SEQ ID NO: 5649592 - DNA, 15 bp, Homo sapiens
tgcagctgattttaa

SEQ ID NO: 5649593 - DNA, 19 bp, Homo sapiens
tgcagctgattttaacaat

SEQ ID NO: 5649594 - DNA, 20 bp, Homo sapiens
tgcagctgattttaacaata

SEQ ID NO: 5649595 - DNA, 16 bp, Homo sapiens
tgcagctgcctggggc

SEQ ID NO: 5649596 - DNA, 13 bp, Homo sapiens
tgcagctgctccc

SEQ ID NO: 5649597 - DNA, 16 bp, Homo sapiens
tgcagctgctccccag

SEQ ID NO: 5649598 - DNA, 19 bp, Homo sapiens
tgcagctggaaaagggtct

SEQ ID NO: 5649599 - DNA, 21 bp, Homo sapiens
tgcagctggaatgtgccacag

SEQ ID NO: 5649600 - DNA, 15 bp, Homo sapiens
tgcagctggacagag

SEQ ID NO: 5649601 - DNA, 15 bp, Homo sapiens
tgcagctggcccact

SEQ ID NO: 5649602 - DNA, 21 bp, Homo sapiens
tgcagctggcccactgctggc

SEQ ID NO: 5649603 - DNA, 16 bp, Homo sapiens
tgcagctgggatttga

SEQ ID NO: 5649604 - DNA, 12 bp, Homo sapiens
tgcagctgggcc

SEQ ID NO: 5649605 - DNA, 19 bp, Homo sapiens
tgcagctgggccccatgct

SEQ ID NO: 5649606 - DNA, 20 bp, Homo sapiens
tgcagctgggccccatgctc

SEQ ID NO: 5649607 - DNA, 17 bp, Homo sapiens
tgcagctgggcttggcc

SEQ ID NO: 5649608 - DNA, 16 bp, Homo sapiens
tgcagctgggtggggc

SEQ ID NO: 5649609 - DNA, 22 bp, Homo sapiens
tgcagctggtctgtttccaggt

SEQ ID NO: 5649610 - DNA, 14 bp, Homo sapiens
tgcagctgtgagaa

SEQ ID NO: 5649611 - DNA, 20 bp, Homo sapiens
tgcagctgtgagtgcgtgtg

SEQ ID NO: 5649612 - DNA, 15 bp, Homo sapiens
tgcagctgttgagaa

SEQ ID NO: 5649613 - DNA, 13 bp, Homo sapiens
tgcagctgtttca

SEQ ID NO: 5649614 - DNA, 20 bp, Homo sapiens
tgcagctgttttcaaagccc

SEQ ID NO: 5649615 - DNA, 22 bp, Homo sapiens
tgcagcttcacccaccaggcca

SEQ ID NO: 5649616 - DNA, 18 bp, Homo sapiens
tgcagcttcaggtgagcc

SEQ ID NO: 5649617 - DNA, 22 bp, Homo sapiens
tgcagcttcaggtgagccaagg

SEQ ID NO: 5649618 - DNA, 15 bp, Homo sapiens
tgcagcttcatcaat

SEQ ID NO: 5649619 - DNA, 21 bp, Homo sapiens
tgcatcagaaatgtctggaga

SEQ ID NO: 5649620 - DNA, 20 bp, Homo sapiens
tgcatcagcctctggccaga

SEQ ID NO: 5649621 - DNA, 13 bp, Homo sapiens
tgcatcagctgct

SEQ ID NO: 5649622 - DNA, 14 bp, Homo sapiens
tgcatcagtattaa

SEQ ID NO: 5649623 - DNA, 19 bp, Homo sapiens
tgcatcatcatagaaaaac

SEQ ID NO: 5649624 - DNA, 16 bp, Homo sapiens
tgcatcatccttgcag

SEQ ID NO: 5649625 - DNA, 17 bp, Homo sapiens
tgcatcatctgtttgta

SEQ ID NO: 5649626 - DNA, 20 bp, Homo sapiens
tgcatcatctgtttgtaatc

SEQ ID NO: 5649627 - DNA, 19 bp, Homo sapiens
tgcatcattctttctgcta

SEQ ID NO: 5649628 - DNA, 13 bp, Homo sapiens
tgcatccaactcc

SEQ ID NO: 5649629 - DNA, 20 bp, Homo sapiens
tgcatccagagattcatttt

SEQ ID NO: 5649630 - DNA, 15 bp, Homo sapiens
tgcatccaggcctga

SEQ ID NO: 5649631 - DNA, 16 bp, Homo sapiens
tgcatccattcctcag

SEQ ID NO: 5649632 - DNA, 18 bp, Homo sapiens
tgcatccattcctcaggg

SEQ ID NO: 5649633 - DNA, 18 bp, Homo sapiens
tgcatccattctcctgag

SEQ ID NO: 5649634 - DNA, 22 bp, Homo sapiens
tgcatcccaaaccacgcctctt

SEQ ID NO: 5649635 - DNA, 15 bp, Homo sapiens
tgcatcccacagcca

SEQ ID NO: 5649636 - DNA, 20 bp, Homo sapiens
tgcatcccagcacctgcctc

SEQ ID NO: 5649637 - DNA, 13 bp, Homo sapiens
tgcatccccttcc

SEQ ID NO: 5649638 - DNA, 14 bp, Homo sapiens
tgcatccccttcca

SEQ ID NO: 5649639 - DNA, 15 bp, Homo sapiens
tgcatccccttccag

SEQ ID NO: 5649640 - DNA, 22 bp, Homo sapiens
tgcatccccttccagctccctc

SEQ ID NO: 5649641 - DNA, 22 bp, Homo sapiens
tgcatcccgatacctcagccct

SEQ ID NO: 5649642 - DNA, 14 bp, Homo sapiens
tgcatccctccacc

SEQ ID NO: 5649643 - DNA, 13 bp, Homo sapiens
tgcatccctgaga

SEQ ID NO: 5649644 - DNA, 16 bp, Homo sapiens
tgcatccctgtgtcca

SEQ ID NO: 5649645 - DNA, 22 bp, Homo sapiens
tgcatccggagaattgcctcta

SEQ ID NO: 5649646 - DNA, 20 bp, Homo sapiens
tgcatccgtagttccctgaa

SEQ ID NO: 5649647 - DNA, 14 bp, Homo sapiens
tgcatcctccaaga

SEQ ID NO: 5649648 - DNA, 16 bp, Homo sapiens
tgcatcctcccctctc

SEQ ID NO: 5649649 - DNA, 15 bp, Homo sapiens
tgcatcctccgcctc

SEQ ID NO: 5649650 - DNA, 19 bp, Homo sapiens
tgcatcctcctcagccccc

SEQ ID NO: 5649651 - DNA, 20 bp, Homo sapiens
tgcatcctcctcagccccca

SEQ ID NO: 5649652 - DNA, 15 bp, Homo sapiens
tgcatcctcctccca

SEQ ID NO: 5649653 - DNA, 19 bp, Homo sapiens
tgcatcctctggagccagc

SEQ ID NO: 5649654 - DNA, 12 bp, Homo sapiens
tgcatcctgagg

SEQ ID NO: 5649655 - DNA, 13 bp, Homo sapiens
tgcatcctgaggc

SEQ ID NO: 5649656 - DNA, 16 bp, Homo sapiens
tgcatcctgaggccag

SEQ ID NO: 5649657 - DNA, 17 bp, Homo sapiens
tgcatcctgaggccagt

SEQ ID NO: 5649658 - DNA, 23 bp, Homo sapiens
tgcatcctgaggccagtggcccc

SEQ ID NO: 5649659 - DNA, 10 bp, Homo sapiens
tgcatcctgg

SEQ ID NO: 5649660 - DNA, 18 bp, Homo sapiens
tgcatccttcctataact

SEQ ID NO: 5649661 - DNA, 14 bp, Homo sapiens
tgcatcgaaatgta

SEQ ID NO: 5649662 - DNA, 18 bp, Homo sapiens
tgcatcgaaatgtattca

SEQ ID NO: 5649663 - DNA, 17 bp, Homo sapiens
tgcatcgctgttctggg

SEQ ID NO: 5649664 - DNA, 17 bp, Homo sapiens
tgcatcgggaaagaaga

SEQ ID NO: 5649665 - DNA, 19 bp, Homo sapiens
tgcatcgggaaagaagaaa

SEQ ID NO: 5649666 - DNA, 15 bp, Homo sapiens
tgcatcgtttcatct

SEQ ID NO: 5649667 - DNA, 22 bp, Homo sapiens
tgcatcgttttctttgctgtgc

SEQ ID NO: 5649668 - DNA, 23 bp, Homo sapiens
tgcatcgttttctttgctgtgcc

SEQ ID NO: 5649669 - DNA, 14 bp, Homo sapiens
tgcatctactccca

SEQ ID NO: 5649670 - DNA, 18 bp, Homo sapiens
tgcatctagaaagctttg

SEQ ID NO: 5649671 - DNA, 18 bp, Homo sapiens
tgcatctagattatggag

SEQ ID NO: 5649672 - DNA, 20 bp, Homo sapiens
tgcatctagctggagccccg

SEQ ID NO: 5649673 - DNA, 23 bp, Homo sapiens
tgcatctcagatgcctcagtagg

SEQ ID NO: 5649674 - DNA, 13 bp, Homo sapiens
tgcatctcagccc

SEQ ID NO: 5649675 - DNA, 14 bp, Homo sapiens
tgcatctcagccca

SEQ ID NO: 5649676 - DNA, 15 bp, Homo sapiens
tgcatctcagcccac

SEQ ID NO: 5649677 - DNA, 12 bp, Homo sapiens
tgcatctcctcc

SEQ ID NO: 5649678 - DNA, 13 bp, Homo sapiens
tgcatctctgtga

SEQ ID NO: 5649679 - DNA, 16 bp, Homo sapiens
tgcatctgaccccggg

SEQ ID NO: 5649680 - DNA, 12 bp, Homo sapiens
tgcatctgactc

SEQ ID NO: 5649681 - DNA, 14 bp, Homo sapiens
tgcatctgcacata

SEQ ID NO: 5649682 - DNA, 18 bp, Homo sapiens
tgcatctgcacataggca

SEQ ID NO: 5649683 - DNA, 17 bp, Homo sapiens
tgcatctgcacccaggg

SEQ ID NO: 5649684 - DNA, 21 bp, Homo sapiens
tgcatctggagagaacaggtt

SEQ ID NO: 5649685 - DNA, 12 bp, Homo sapiens
tgcatctggcct

SEQ ID NO: 5649686 - DNA, 14 bp, Homo sapiens
tgcatctggcctat

SEQ ID NO: 5649687 - DNA, 19 bp, Homo sapiens
tgcatctgggtagctgtaa

SEQ ID NO: 5649688 - DNA, 20 bp, Homo sapiens
tgcatctgggtagctgtaag

SEQ ID NO: 5649689 - DNA, 20 bp, Homo sapiens
tgcatctgtataagtaagaa

SEQ ID NO: 5649690 - DNA, 13 bp, Homo sapiens
tgcatctgtctgc

SEQ ID NO: 5649691 - DNA, 16 bp, Homo sapiens
tgcatctgtctgtcct

SEQ ID NO: 5649692 - DNA, 14 bp, Homo sapiens
tgcatctgtgtgtg

SEQ ID NO: 5649693 - DNA, 22 bp, Homo sapiens
tgcatcttacagaagagtaaac

SEQ ID NO: 5649694 - DNA, 14 bp, Homo sapiens
tgcatcttactgaa

SEQ ID NO: 5649695 - DNA, 15 bp, Homo sapiens
tgcatcttagtttac

SEQ ID NO: 5649696 - DNA, 21 bp, Homo sapiens
tgcatcttatagcactttgaa

SEQ ID NO: 5649697 - DNA, 11 bp, Homo sapiens
tgcatcttcag

SEQ ID NO: 5649698 - DNA, 17 bp, Homo sapiens
tgcatcttcttgcatct

SEQ ID NO: 5649699 - DNA, 23 bp, Homo sapiens
tgcatcttgctctgtggccttgg

SEQ ID NO: 5649700 - DNA, 21 bp, Homo sapiens
tgcatctttcatagttctgtt

SEQ ID NO: 5649701 - DNA, 22 bp, Homo sapiens
tgcatctttcatagttctgtta

SEQ ID NO: 5649702 - DNA, 13 bp, Homo sapiens
tgcatctttccct

SEQ ID NO: 5649703 - DNA, 16 bp, Homo sapiens
tgcatctttgatgtgt

SEQ ID NO: 5649704 - DNA, 16 bp, Homo sapiens
tgcatctttgttactt

SEQ ID NO: 5649705 - DNA, 18 bp, Homo sapiens
tgcatctttttttcattt

SEQ ID NO: 5649706 - DNA, 16 bp, Homo sapiens
tgcatgaaaagtgcat

SEQ ID NO: 5649707 - DNA, 14 bp, Homo sapiens
tgcatgaaactagg

SEQ ID NO: 5649708 - DNA, 17 bp, Homo sapiens
tgcatgaaagcacaagg

SEQ ID NO: 5649709 - DNA, 14 bp, Homo sapiens
tgcatgaaagcatt

SEQ ID NO: 5649710 - DNA, 19 bp, Homo sapiens
tgcatgaataaaattattc

SEQ ID NO: 5649711 - DNA, 21 bp, Homo sapiens
tgcatgacaaaccttatggaa

SEQ ID NO: 5649712 - DNA, 15 bp, Homo sapiens
tgcatgacttgtagc

SEQ ID NO: 5649713 - DNA, 16 bp, Homo sapiens
tgcatgagaactaaat

SEQ ID NO: 5649714 - DNA, 21 bp, Homo sapiens
tgcatgagaatgtcatttgct

SEQ ID NO: 5649715 - DNA, 22 bp, Homo sapiens
tgcatgagaatgtcatttgcta

SEQ ID NO: 5649716 - DNA, 20 bp, Homo sapiens
tgcatgagctccctcgctgt

SEQ ID NO: 5649717 - DNA, 20 bp, Homo sapiens
tgcatgagctggcaaccagc

SEQ ID NO: 5649718 - DNA, 18 bp, Homo sapiens
tgcatgatattgtatgta

SEQ ID NO: 5649719 - DNA, 21 bp, Homo sapiens
tgcatgatattgtatgtacct

SEQ ID NO: 5649720 - DNA, 22 bp, Homo sapiens
tgcatgatgactcttcttatca

SEQ ID NO: 5649721 - DNA, 18 bp, Homo sapiens
tgcatgatgccctcccct

SEQ ID NO: 5649722 - DNA, 14 bp, Homo sapiens
tgcatgatgtttgc

SEQ ID NO: 5649723 - DNA, 18 bp, Homo sapiens
tgcatgattcttctcttg

SEQ ID NO: 5649724 - DNA, 15 bp, Homo sapiens
tgcatgattgcagaa

SEQ ID NO: 5649725 - DNA, 16 bp, Homo sapiens
tgcatgattgcagaat

SEQ ID NO: 5649726 - DNA, 12 bp, Homo sapiens
tgcatgatttta

SEQ ID NO: 5649727 - DNA, 18 bp, Homo sapiens
tgcatgattttgtaaccc

SEQ ID NO: 5649728 - DNA, 17 bp, Homo sapiens
tgcatgcaaaaatgaat

SEQ ID NO: 5649729 - DNA, 22 bp, Homo sapiens
tgcatgcaaatgagctctgaaa

SEQ ID NO: 5649730 - DNA, 14 bp, Homo sapiens
tgcatgcaactaat

SEQ ID NO: 5649731 - DNA, 12 bp, Homo sapiens
tgcatgcactgt

SEQ ID NO: 5649732 - DNA, 22 bp, Homo sapiens
tgcatgcactgttccccctgtg

SEQ ID NO: 5649733 - DNA, 21 bp, Homo sapiens
tgcatgcaggtctccatgaag

SEQ ID NO: 5649734 - DNA, 17 bp, Homo sapiens
tgcatgcataatgaacc

SEQ ID NO: 5649735 - DNA, 18 bp, Homo sapiens
tgcatgcatgcaaatgag

SEQ ID NO: 5649736 - DNA, 17 bp, Homo sapiens
tgcatgcatgccctctc

SEQ ID NO: 5649737 - DNA, 11 bp, Homo sapiens
tgcatgcatgt

SEQ ID NO: 5649738 - DNA, 17 bp, Homo sapiens
tgcatgcattgagctgc

SEQ ID NO: 5649739 - DNA, 11 bp, Homo sapiens
tgcatgccagg

SEQ ID NO: 5649740 - DNA, 12 bp, Homo sapiens
tgcatgccaggc

SEQ ID NO: 5649741 - DNA, 17 bp, Homo sapiens
tgcatgccaggctgggc

SEQ ID NO: 5649742 - DNA, 21 bp, Homo sapiens
tgcatgccatctccaccctga

SEQ ID NO: 5649743 - DNA, 14 bp, Homo sapiens
tgcatgcccagaga

SEQ ID NO: 5649744 - DNA, 18 bp, Homo sapiens
tgcatgcccagagaccca

SEQ ID NO: 5649745 - DNA, 17 bp, Homo sapiens
tgcatgcccctgagtgt

SEQ ID NO: 5649746 - DNA, 17 bp, Homo sapiens
tgcatgcctggcccctc

SEQ ID NO: 5649747 - DNA, 15 bp, Homo sapiens
tgcatgcctgtaatc

SEQ ID NO: 5649748 - DNA, 15 bp, Homo sapiens
tgcatgctagcatgg

SEQ ID NO: 5649749 - DNA, 18 bp, Homo sapiens
tgcatgctagtgttgtat

SEQ ID NO: 5649750 - DNA, 15 bp, Homo sapiens
tgcatgctcaaatga

SEQ ID NO: 5649751 - DNA, 17 bp, Homo sapiens
tgcatgctcaaatgaaa

SEQ ID NO: 5649752 - DNA, 15 bp, Homo sapiens
tgcatgctcctctgc

SEQ ID NO: 5649753 - DNA, 19 bp, Homo sapiens
tgcatgctctctgcagcca

SEQ ID NO: 5649754 - DNA, 13 bp, Homo sapiens
tgcatgctgcttt

SEQ ID NO: 5649755 - DNA, 15 bp, Homo sapiens
tgcatgctgctttaa

SEQ ID NO: 5649756 - DNA, 13 bp, Homo sapiens
tgcatgctgtccc

SEQ ID NO: 5649757 - DNA, 19 bp, Homo sapiens
tgcatgctgtcccttacgt

SEQ ID NO: 5649758 - DNA, 21 bp, Homo sapiens
tgcatgctgtcccttacgtga

SEQ ID NO: 5649759 - DNA, 14 bp, Homo sapiens
tgcatgctttccat

SEQ ID NO: 5649760 - DNA, 15 bp, Homo sapiens
tgcatgctttccata

SEQ ID NO: 5649761 - DNA, 13 bp, Homo sapiens
tgcatgctttgga

SEQ ID NO: 5649762 - DNA, 15 bp, Homo sapiens
tgcatggaaatcagc

SEQ ID NO: 5649763 - DNA, 22 bp, Homo sapiens
tgcatggaaatcagccaagttt

SEQ ID NO: 5649764 - DNA, 23 bp, Homo sapiens
tgcatggaaattcccttcatctg

SEQ ID NO: 5649765 - DNA, 19 bp, Homo sapiens
tgcatggaagtaattaagg

SEQ ID NO: 5649766 - DNA, 17 bp, Homo sapiens
tgcatggacctaacatt

SEQ ID NO: 5649767 - DNA, 18 bp, Homo sapiens
tgcatggacctaacattc

SEQ ID NO: 5649768 - DNA, 21 bp, Homo sapiens
tgcatggacctaacattcgat

SEQ ID NO: 5649769 - DNA, 14 bp, Homo sapiens
tgcatggagcctgg

SEQ ID NO: 5649770 - DNA, 22 bp, Homo sapiens
tgcatggaggactctcctcttc

SEQ ID NO: 5649771 - DNA, 15 bp, Homo sapiens
tgcatggagtgtttg

SEQ ID NO: 5649772 - DNA, 14 bp, Homo sapiens
tgcatggatttctt

SEQ ID NO: 5649773 - DNA, 20 bp, Homo sapiens
tgcatggatttctttgaaaa

SEQ ID NO: 5649774 - DNA, 21 bp, Homo sapiens
tgcatggcacataccaaagct

SEQ ID NO: 5649775 - DNA, 17 bp, Homo sapiens
tgcatggcactgactga

SEQ ID NO: 5649776 - DNA, 20 bp, Homo sapiens
tgcatggcacttgcatctgt

SEQ ID NO: 5649777 - DNA, 15 bp, Homo sapiens
tgcatggcagggcct

SEQ ID NO: 5649778 - DNA, 21 bp, Homo sapiens
tgcatggcagggcctcatctc

SEQ ID NO: 5649779 - DNA, 19 bp, Homo sapiens
tgcatggcagggggctgct

SEQ ID NO: 5649780 - DNA, 11 bp, Homo sapiens
tgcatggcatc

SEQ ID NO: 5649781 - DNA, 23 bp, Homo sapiens
tgcatggcatttgttccacagga

SEQ ID NO: 5649782 - DNA, 20 bp, Homo sapiens
tgcatggccacagccacctc

SEQ ID NO: 5649783 - DNA, 17 bp, Homo sapiens
tgcatggcctcccagcc

SEQ ID NO: 5649784 - DNA, 23 bp, Homo sapiens
tgcatggcctctaagagtgcccg

SEQ ID NO: 5649785 - DNA, 16 bp, Homo sapiens
tgcatggctccagaaa

SEQ ID NO: 5649786 - DNA, 18 bp, Homo sapiens
tgcatggctccagaaatg

SEQ ID NO: 5649787 - DNA, 18 bp, Homo sapiens
tgcatggctcctgtctgg

SEQ ID NO: 5649788 - DNA, 21 bp, Homo sapiens
tgcatggctcctgtctggctc

SEQ ID NO: 5649789 - DNA, 15 bp, Homo sapiens
tgcatggggaggcag

SEQ ID NO: 5649790 - DNA, 17 bp, Homo sapiens
tgcatggggaggcagca

SEQ ID NO: 5649791 - DNA, 17 bp, Homo sapiens
tgcatggggcgggtcct

SEQ ID NO: 5649792 - DNA, 19 bp, Homo sapiens
tgcatggtaatttatagtt

SEQ ID NO: 5649793 - DNA, 17 bp, Homo sapiens
tgcatggtcaagcctct

SEQ ID NO: 5649794 - DNA, 17 bp, Homo sapiens
tgcatggtgccccagga

SEQ ID NO: 5649795 - DNA, 12 bp, Homo sapiens
tgcatggtgtga

SEQ ID NO: 5649796 - DNA, 16 bp, Homo sapiens
tgcatggtgtgaacta

SEQ ID NO: 5649797 - DNA, 18 bp, Homo sapiens
tgcatggtttcagcacta

SEQ ID NO: 5649798 - DNA, 12 bp, Homo sapiens
tgccacatttct

SEQ ID NO: 5649799 - DNA, 12 bp, Homo sapiens
tgccacattttc

SEQ ID NO: 5649800 - DNA, 19 bp, Homo sapiens
tgccacattttgctttata

SEQ ID NO: 5649801 - DNA, 19 bp, Homo sapiens
tgccaccaaaggagacata

SEQ ID NO: 5649802 - DNA, 21 bp, Homo sapiens
tgccaccaaaggagacatatc

SEQ ID NO: 5649803 - DNA, 19 bp, Homo sapiens
tgccaccaactggccctct

SEQ ID NO: 5649804 - DNA, 16 bp, Homo sapiens
tgccaccaacttacaa

SEQ ID NO: 5649805 - DNA, 19 bp, Homo sapiens
tgccaccaacttacaaaaa

SEQ ID NO: 5649806 - DNA, 14 bp, Homo sapiens
tgccaccaagctca

SEQ ID NO: 5649807 - DNA, 21 bp, Homo sapiens
tgccaccaagctcacacctgt

SEQ ID NO: 5649808 - DNA, 15 bp, Homo sapiens
tgccaccaataaaaa

SEQ ID NO: 5649809 - DNA, 17 bp, Homo sapiens
tgccaccaataaaaatc

SEQ ID NO: 5649810 - DNA, 17 bp, Homo sapiens
tgccaccacccacccca

SEQ ID NO: 5649811 - DNA, 15 bp, Homo sapiens
tgccaccacccctcc

SEQ ID NO: 5649812 - DNA, 17 bp, Homo sapiens
tgccaccaccctgcccc

SEQ ID NO: 5649813 - DNA, 15 bp, Homo sapiens
tgccaccacctctgt

SEQ ID NO: 5649814 - DNA, 18 bp, Homo sapiens
tgccaccacctctgtggc

SEQ ID NO: 5649815 - DNA, 19 bp, Homo sapiens
tgccaccacctctgtggca

SEQ ID NO: 5649816 - DNA, 15 bp, Homo sapiens
tgccaccacgcccgg

SEQ ID NO: 5649817 - DNA, 17 bp, Homo sapiens
tgccaccacgctggcca

SEQ ID NO: 5649818 - DNA, 18 bp, Homo sapiens
tgccaccacgctggccaa

SEQ ID NO: 5649819 - DNA, 15 bp, Homo sapiens
tgccaccacgtctgc

SEQ ID NO: 5649820 - DNA, 17 bp, Homo sapiens
tgccaccacgtctgcca

SEQ ID NO: 5649821 - DNA, 19 bp, Homo sapiens
tgccaccacgtctgccagg

SEQ ID NO: 5649822 - DNA, 13 bp, Homo sapiens
tgccaccagagac

SEQ ID NO: 5649823 - DNA, 18 bp, Homo sapiens
tgccaccagagaccgtcc

SEQ ID NO: 5649824 - DNA, 14 bp, Homo sapiens
tgccaccagcaatg

SEQ ID NO: 5649825 - DNA, 13 bp, Homo sapiens
tgccaccagcccc

SEQ ID NO: 5649826 - DNA, 19 bp, Homo sapiens
tgccaccagcccctcccca

SEQ ID NO: 5649827 - DNA, 14 bp, Homo sapiens
tgccaccagcgccc

SEQ ID NO: 5649828 - DNA, 14 bp, Homo sapiens
tgccaccaggagaa

SEQ ID NO: 5649829 - DNA, 22 bp, Homo sapiens
tgccaccagggagcttcctggc

SEQ ID NO: 5649830 - DNA, 14 bp, Homo sapiens
tgccaccatacctc

SEQ ID NO: 5649831 - DNA, 18 bp, Homo sapiens
tgccaccatccaataaaa

SEQ ID NO: 5649832 - DNA, 21 bp, Homo sapiens
tgccaccatgtattcatccag

SEQ ID NO: 5649833 - DNA, 21 bp, Homo sapiens
tgccacccacctccctgcctc

SEQ ID NO: 5649834 - DNA, 22 bp, Homo sapiens
tgccacccacctccctgcctcc

SEQ ID NO: 5649835 - DNA, 15 bp, Homo sapiens
tgccacccactcagg

SEQ ID NO: 5649836 - DNA, 22 bp, Homo sapiens
tgccacccagccccagccaggg

SEQ ID NO: 5649837 - DNA, 21 bp, Homo sapiens
tgccacccaggtgatgttagt

SEQ ID NO: 5649838 - DNA, 16 bp, Homo sapiens
tgccaccccaccctcc

SEQ ID NO: 5649839 - DNA, 21 bp, Homo sapiens
tgccaccccaccctccctgga

SEQ ID NO: 5649840 - DNA, 17 bp, Homo sapiens
tgccaccccatgtgcct

SEQ ID NO: 5649841 - DNA, 22 bp, Homo sapiens
tgccacccccagccctggcccc

SEQ ID NO: 5649842 - DNA, 20 bp, Homo sapiens
tgccacccccaggtcttcct

SEQ ID NO: 5649843 - DNA, 18 bp, Homo sapiens
tgccacccccgctggagg

SEQ ID NO: 5649844 - DNA, 21 bp, Homo sapiens
tgccacccccttccctgggag

SEQ ID NO: 5649845 - DNA, 13 bp, Homo sapiens
tgccacccctaaa

SEQ ID NO: 5649846 - DNA, 21 bp, Homo sapiens
tgccacccctcttctgctcct

SEQ ID NO: 5649847 - DNA, 16 bp, Homo sapiens
tgccaccccttcctca

SEQ ID NO: 5649848 - DNA, 22 bp, Homo sapiens
tgccaccccttcctcagcctgg

SEQ ID NO: 5649849 - DNA, 22 bp, Homo sapiens
tgccacccgtaggcagcctctc

SEQ ID NO: 5649850 - DNA, 19 bp, Homo sapiens
tgccaccctcctccctcca

SEQ ID NO: 5649851 - DNA, 14 bp, Homo sapiens
tgccaccctcctgc

SEQ ID NO: 5649852 - DNA, 17 bp, Homo sapiens
tgccaccctcctgcgca

SEQ ID NO: 5649853 - DNA, 14 bp, Homo sapiens
tgccaccctctcca

SEQ ID NO: 5649854 - DNA, 17 bp, Homo sapiens
tgccaccctctccatgc

SEQ ID NO: 5649855 - DNA, 17 bp, Homo sapiens
tgccaccctctgcaggg

SEQ ID NO: 5649856 - DNA, 18 bp, Homo sapiens
tgccaccctctgcagggc

SEQ ID NO: 5649857 - DNA, 15 bp, Homo sapiens
tgccaccctctggga

SEQ ID NO: 5649858 - DNA, 18 bp, Homo sapiens
tgccaccctgggctctgt

SEQ ID NO: 5649859 - DNA, 20 bp, Homo sapiens
tgccaccctggggagaaagt

SEQ ID NO: 5649860 - DNA, 15 bp, Homo sapiens
tgccaccgactgccc

SEQ ID NO: 5649861 - DNA, 18 bp, Homo sapiens
tgccaccgactgcccagc

SEQ ID NO: 5649862 - DNA, 22 bp, Homo sapiens
tgccaccgactgcccagccact

SEQ ID NO: 5649863 - DNA, 23 bp, Homo sapiens
tgccaccgactgcccagccactc

SEQ ID NO: 5649864 - DNA, 22 bp, Homo sapiens
tgccaccggcctgtgggtctct

SEQ ID NO: 5649865 - DNA, 21 bp, Homo sapiens
tgccaccggggaacccagccc

SEQ ID NO: 5649866 - DNA, 19 bp, Homo sapiens
tgccaccgtgggggaactg

SEQ ID NO: 5649867 - DNA, 21 bp, Homo sapiens
tgccaccgtgggggaactgac

SEQ ID NO: 5649868 - DNA, 17 bp, Homo sapiens
tgccacctatgcctgtg

SEQ ID NO: 5649869 - DNA, 17 bp, Homo sapiens
tgccacctcccctatcc

SEQ ID NO: 5649870 - DNA, 22 bp, Homo sapiens
tgccacctccccttgccagctg

SEQ ID NO: 5649871 - DNA, 14 bp, Homo sapiens
tgccacctcctgcc

SEQ ID NO: 5649872 - DNA, 10 bp, Homo sapiens
tgccacctgc

SEQ ID NO: 5649873 - DNA, 13 bp, Homo sapiens
tgccacctgcaag

SEQ ID NO: 5649874 - DNA, 14 bp, Homo sapiens
tgccacctgcagcg

SEQ ID NO: 5649875 - DNA, 14 bp, Homo sapiens
tgccacctggaccc

SEQ ID NO: 5649876 - DNA, 15 bp, Homo sapiens
tgccacctggacccc

SEQ ID NO: 5649877 - DNA, 16 bp, Homo sapiens
tgccacctggggcagt

SEQ ID NO: 5649878 - DNA, 17 bp, Homo sapiens
tgccacctggggcagtc

SEQ ID NO: 5649879 - DNA, 11 bp, Homo sapiens
tgccacctgtc

SEQ ID NO: 5649880 - DNA, 12 bp, Homo sapiens
tgccacctgtct

SEQ ID NO: 5649881 - DNA, 14 bp, Homo sapiens
tgccacctgtctgt

SEQ ID NO: 5649882 - DNA, 15 bp, Homo sapiens
tgccacctgtctgtc

SEQ ID NO: 5649883 - DNA, 17 bp, Homo sapiens
tgccaccttgtggccgc

SEQ ID NO: 5649884 - DNA, 16 bp, Homo sapiens
tgccacgcaggccacc

SEQ ID NO: 5649885 - DNA, 19 bp, Homo sapiens
tgccacgccccgtgtctgg

SEQ ID NO: 5649886 - DNA, 16 bp, Homo sapiens
tgccacgcctggaagg

SEQ ID NO: 5649887 - DNA, 16 bp, Homo sapiens
tgccacgcgctctgca

SEQ ID NO: 5649888 - DNA, 23 bp, Homo sapiens
tgccacgcgctctgcatgctcct

SEQ ID NO: 5649889 - DNA, 14 bp, Homo sapiens
tgccacgctttgct

SEQ ID NO: 5649890 - DNA, 19 bp, Homo sapiens
tgccacgctttgctgctac

SEQ ID NO: 5649891 - DNA, 18 bp, Homo sapiens
tgccacggcagccaccct

SEQ ID NO: 5649892 - DNA, 22 bp, Homo sapiens
tgccacggcagccaccctgcca

SEQ ID NO: 5649893 - DNA, 13 bp, Homo sapiens
tgccacggccatg

SEQ ID NO: 5649894 - DNA, 17 bp, Homo sapiens
tgccacggccatgaggg

SEQ ID NO: 5649895 - DNA, 20 bp, Homo sapiens
tgccacggccatgagggctg

SEQ ID NO: 5649896 - DNA, 15 bp, Homo sapiens
tgccacgtcccgctg

SEQ ID NO: 5649897 - DNA, 17 bp, Homo sapiens
tgccacgtgccttagga

SEQ ID NO: 5649898 - DNA, 15 bp, Homo sapiens
tgccacgtggccgct

SEQ ID NO: 5649899 - DNA, 21 bp, Homo sapiens
tgccacgtggccgctgcccac

SEQ ID NO: 5649900 - DNA, 17 bp, Homo sapiens
tgccacgtggtcactgt

SEQ ID NO: 5649901 - DNA, 18 bp, Homo sapiens
tgccacgtggtcactgtg

SEQ ID NO: 5649902 - DNA, 21 bp, Homo sapiens
tgccacgtggtcactgtgcac

SEQ ID NO: 5649903 - DNA, 20 bp, Homo sapiens
tgccacgttccacagttgcc

SEQ ID NO: 5649904 - DNA, 15 bp, Homo sapiens
tgccactaaaatcca

SEQ ID NO: 5649905 - DNA, 19 bp, Homo sapiens
tgccactaaactacattgt

SEQ ID NO: 5649906 - DNA, 19 bp, Homo sapiens
tgccactaaccttccaaaa

SEQ ID NO: 5649907 - DNA, 23 bp, Homo sapiens
tgccactaagagattgcacagtc

SEQ ID NO: 5649908 - DNA, 11 bp, Homo sapiens
tgccactaagt

SEQ ID NO: 5649909 - DNA, 18 bp, Homo sapiens
tgccactaggccctggtc

SEQ ID NO: 5649910 - DNA, 23 bp, Homo sapiens
tgccactaggctgggtgcccaca

SEQ ID NO: 5649911 - DNA, 11 bp, Homo sapiens
tgccactcaca

SEQ ID NO: 5649912 - DNA, 19 bp, Homo sapiens
tgccactcacccttcctgg

SEQ ID NO: 5649913 - DNA, 19 bp, Homo sapiens
tgccactcactaggccccc

SEQ ID NO: 5649914 - DNA, 20 bp, Homo sapiens
tgccactcactaggccccca

SEQ ID NO: 5649915 - DNA, 22 bp, Homo sapiens
tgccactcagggtctgggatga

SEQ ID NO: 5649916 - DNA, 22 bp, Homo sapiens
tgccactccagtcctgccacca

SEQ ID NO: 5649917 - DNA, 11 bp, Homo sapiens
tgccactccct

SEQ ID NO: 5649918 - DNA, 12 bp, Homo sapiens
tgccactcccta

SEQ ID NO: 5649919 - DNA, 15 bp, Homo sapiens
tgccactccctgagc

SEQ ID NO: 5649920 - DNA, 18 bp, Homo sapiens
tgccactcctcaactgat

SEQ ID NO: 5649921 - DNA, 17 bp, Homo sapiens
tgccactcctccctccg

SEQ ID NO: 5649922 - DNA, 23 bp, Homo sapiens
tgccactcctgacccagccctga

SEQ ID NO: 5649923 - DNA, 13 bp, Homo sapiens
tgccactccttgt

SEQ ID NO: 5649924 - DNA, 16 bp, Homo sapiens
tgccactctcctgagg

SEQ ID NO: 5649925 - DNA, 21 bp, Homo sapiens
tgccactctcctgaggagcag

SEQ ID NO: 5649926 - DNA, 12 bp, Homo sapiens
tgccactctgct

SEQ ID NO: 5649927 - DNA, 15 bp, Homo sapiens
tgccactctgctgcc

SEQ ID NO: 5649928 - DNA, 16 bp, Homo sapiens
tgccactctgctgcct

SEQ ID NO: 5649929 - DNA, 17 bp, Homo sapiens
tgccactctgctgcctg

SEQ ID NO: 5649930 - DNA, 18 bp, Homo sapiens
tgccactctgctgcctgt

SEQ ID NO: 5649931 - DNA, 12 bp, Homo sapiens
tgccactgacct

SEQ ID NO: 5649932 - DNA, 14 bp, Homo sapiens
tgccactgacctca

SEQ ID NO: 5649933 - DNA, 19 bp, Homo sapiens
tgccactgactgcagggac

SEQ ID NO: 5649934 - DNA, 17 bp, Homo sapiens
tgccactgacttgctgt

SEQ ID NO: 5649935 - DNA, 13 bp, Homo sapiens
tgccactgaggag

SEQ ID NO: 5649936 - DNA, 19 bp, Homo sapiens
tgccactgatattcagaat

SEQ ID NO: 5649937 - DNA, 12 bp, Homo sapiens
tgccactgcaaa

SEQ ID NO: 5649938 - DNA, 14 bp, Homo sapiens
tgccactgcactcc

SEQ ID NO: 5649939 - DNA, 22 bp, Homo sapiens
tgccactgcactccagcctggg

SEQ ID NO: 5649940 - DNA, 14 bp, Homo sapiens
tgccactgccaggc

SEQ ID NO: 5649941 - DNA, 17 bp, Homo sapiens
tgccactgccaggcacc

SEQ ID NO: 5649942 - DNA, 20 bp, Homo sapiens
tgccactgccaggcacctgg

SEQ ID NO: 5649943 - DNA, 21 bp, Homo sapiens
tgccactgccaggcacctggc

SEQ ID NO: 5649944 - DNA, 23 bp, Homo sapiens
tgccactgccaggcacctggcct

SEQ ID NO: 5649945 - DNA, 12 bp, Homo sapiens
tgccactgccat

SEQ ID NO: 5649946 - DNA, 20 bp, Homo sapiens
tgccactgccataacttgtt

SEQ ID NO: 5649947 - DNA, 17 bp, Homo sapiens
tgccactgcctcttcct

SEQ ID NO: 5649948 - DNA, 18 bp, Homo sapiens
tgccactgcctcttcctc

SEQ ID NO: 5649949 - DNA, 14 bp, Homo sapiens
tgccactgcctgca

SEQ ID NO: 5649950 - DNA, 18 bp, Homo sapiens
tgccactgcctgcacctt

SEQ ID NO: 5649951 - DNA, 21 bp, Homo sapiens
tgccactgccttcgcttcttg

SEQ ID NO: 5649952 - DNA, 22 bp, Homo sapiens
tgccactgccttcgcttcttgc

SEQ ID NO: 5649953 - DNA, 17 bp, Homo sapiens
tgccactgctgtatttt

SEQ ID NO: 5649954 - DNA, 21 bp, Homo sapiens
tgccactgctgtatttttatt

SEQ ID NO: 5649955 - DNA, 13 bp, Homo sapiens
tgccactggagtg

SEQ ID NO: 5649956 - DNA, 21 bp, Homo sapiens
tgccactgggacagctggctg

SEQ ID NO: 5649957 - DNA, 23 bp, Homo sapiens
tgccactgggacggctcctgctt

SEQ ID NO: 5649958 - DNA, 16 bp, Homo sapiens
tgccactgggctctgg

SEQ ID NO: 5649959 - DNA, 19 bp, Homo sapiens
tgccactggggaaaactcc

SEQ ID NO: 5649960 - DNA, 17 bp, Homo sapiens
tgccacttaaaaagact

SEQ ID NO: 5649961 - DNA, 17 bp, Homo sapiens
tgccacttaatgtatgt

SEQ ID NO: 5649962 - DNA, 18 bp, Homo sapiens
tgccacttaatgtatgtt

SEQ ID NO: 5649963 - DNA, 20 bp, Homo sapiens
tgccacttcaacccccagct

SEQ ID NO: 5649964 - DNA, 12 bp, Homo sapiens
tgccacttccca

SEQ ID NO: 5649965 - DNA, 16 bp, Homo sapiens
tgccacttcccaggta

SEQ ID NO: 5649966 - DNA, 16 bp, Homo sapiens
tgccacttctaagaaa

SEQ ID NO: 5649967 - DNA, 23 bp, Homo sapiens
tgccacttctaagaaaagcctaa

SEQ ID NO: 5649968 - DNA, 19 bp, Homo sapiens
tgccacttctgcgggctcc

SEQ ID NO: 5649969 - DNA, 22 bp, Homo sapiens
tgccacttctgcgggctccctc

SEQ ID NO: 5649970 - DNA, 19 bp, Homo sapiens
tgccacttgaacaaaatct

SEQ ID NO: 5649971 - DNA, 16 bp, Homo sapiens
tgccacttgacattcc

SEQ ID NO: 5649972 - DNA, 19 bp, Homo sapiens
tgccacttgcactgtgctt

SEQ ID NO: 5649973 - DNA, 16 bp, Homo sapiens
tgccacttggccacca

SEQ ID NO: 5649974 - DNA, 17 bp, Homo sapiens
tgccacttggccaccag

SEQ ID NO: 5649975 - DNA, 13 bp, Homo sapiens
tgccactttccaa

SEQ ID NO: 5649976 - DNA, 19 bp, Homo sapiens
tgcccagccctaaacatca

SEQ ID NO: 5649977 - DNA, 13 bp, Homo sapiens
tgcccagccctcc

SEQ ID NO: 5649978 - DNA, 20 bp, Homo sapiens
tgcccagccctcccagctgg

SEQ ID NO: 5649979 - DNA, 15 bp, Homo sapiens
tgcccagccctctgt

SEQ ID NO: 5649980 - DNA, 15 bp, Homo sapiens
tgcccagccctggcc

SEQ ID NO: 5649981 - DNA, 16 bp, Homo sapiens
tgcccagcctccaact

SEQ ID NO: 5649982 - DNA, 18 bp, Homo sapiens
tgcccagcctccaactcc

SEQ ID NO: 5649983 - DNA, 17 bp, Homo sapiens
tgcccagcctctttccc

SEQ ID NO: 5649984 - DNA, 18 bp, Homo sapiens
tgcccagcctctttccct

SEQ ID NO: 5649985 - DNA, 23 bp, Homo sapiens
tgcccagcctctttcccttccag

SEQ ID NO: 5649986 - DNA, 11 bp, Homo sapiens
tgcccagcctg

SEQ ID NO: 5649987 - DNA, 14 bp, Homo sapiens
tgcccagcctgccc

SEQ ID NO: 5649988 - DNA, 15 bp, Homo sapiens
tgcccagcctgctca

SEQ ID NO: 5649989 - DNA, 15 bp, Homo sapiens
tgcccagcctgctct

SEQ ID NO: 5649990 - DNA, 13 bp, Homo sapiens
tgcccagcctgga

SEQ ID NO: 5649991 - DNA, 17 bp, Homo sapiens
tgcccagcctggatgcc

SEQ ID NO: 5649992 - DNA, 14 bp, Homo sapiens
tgcccagcctgggg

SEQ ID NO: 5649993 - DNA, 20 bp, Homo sapiens
tgcccagcggacagtggcag

SEQ ID NO: 5649994 - DNA, 23 bp, Homo sapiens
tgcccagctaatttttgtatttt

SEQ ID NO: 5649995 - DNA, 12 bp, Homo sapiens
tgcccagctcag

SEQ ID NO: 5649996 - DNA, 15 bp, Homo sapiens
tgcccagctcagtgc

SEQ ID NO: 5649997 - DNA, 14 bp, Homo sapiens
tgcccagctcctca

SEQ ID NO: 5649998 - DNA, 11 bp, Homo sapiens
tgcccagctct

SEQ ID NO: 5649999 - DNA, 13 bp, Homo sapiens
tgcccagctctga

SEQ ID NO: 5650000 - DNA, 18 bp, Homo sapiens
tgcccagctctgaccctg

SEQ ID NO: 5650001 - DNA, 18 bp, Homo sapiens
tgcccagcttcgtcagct

SEQ ID NO: 5650002 - DNA, 15 bp, Homo sapiens
tgcccagcttggagt

SEQ ID NO: 5650003 - DNA, 16 bp, Homo sapiens
tgcccagcttggagtg

SEQ ID NO: 5650004 - DNA, 16 bp, Homo sapiens
tgcccagcttgggccc

SEQ ID NO: 5650005 - DNA, 23 bp, Homo sapiens
tgcccagcttgggcccagctggg

SEQ ID NO: 5650006 - DNA, 23 bp, Homo sapiens
tgcccaggaagtaattttcttct

SEQ ID NO: 5650007 - DNA, 21 bp, Homo sapiens
tgcccaggacggggccggcca

SEQ ID NO: 5650008 - DNA, 20 bp, Homo sapiens
tgcccaggacggtctgtgcc

SEQ ID NO: 5650009 - DNA, 21 bp, Homo sapiens
tgcccaggacgtcctatctcc

SEQ ID NO: 5650010 - DNA, 11 bp, Homo sapiens
tgcccaggaga

SEQ ID NO: 5650011 - DNA, 12 bp, Homo sapiens
tgcccaggagaa

SEQ ID NO: 5650012 - DNA, 20 bp, Homo sapiens
tgcccaggagagccagccct

SEQ ID NO: 5650013 - DNA, 15 bp, Homo sapiens
tgcccaggagcagct

SEQ ID NO: 5650014 - DNA, 14 bp, Homo sapiens
tgcccaggatttga

SEQ ID NO: 5650015 - DNA, 23 bp, Homo sapiens
tgcccaggcaaagtgcacctcaa

SEQ ID NO: 5650016 - DNA, 12 bp, Homo sapiens
tgcccaggcact

SEQ ID NO: 5650017 - DNA, 21 bp, Homo sapiens
tgcccaggcagtctttgctca

SEQ ID NO: 5650018 - DNA, 23 bp, Homo sapiens
tgcccaggcatgaaattcttcct

SEQ ID NO: 5650019 - DNA, 16 bp, Homo sapiens
tgcccaggccacagag

SEQ ID NO: 5650020 - DNA, 19 bp, Homo sapiens
tgcccaggccacagagaac

SEQ ID NO: 5650021 - DNA, 15 bp, Homo sapiens
tgcccaggccacagc

SEQ ID NO: 5650022 - DNA, 20 bp, Homo sapiens
tgcccaggccacagccgcct

SEQ ID NO: 5650023 - DNA, 14 bp, Homo sapiens
tgcccaggcccaga

SEQ ID NO: 5650024 - DNA, 15 bp, Homo sapiens
tgcccaggcccagac

SEQ ID NO: 5650025 - DNA, 15 bp, Homo sapiens
tgcccaggcccctgc

SEQ ID NO: 5650026 - DNA, 17 bp, Homo sapiens
tgcccaggcccctgcca

SEQ ID NO: 5650027 - DNA, 22 bp, Homo sapiens
tgcccaggcccctgccaccctg

SEQ ID NO: 5650028 - DNA, 12 bp, Homo sapiens
tgcccaggccct

SEQ ID NO: 5650029 - DNA, 17 bp, Homo sapiens
tgcccaggcccttggct

SEQ ID NO: 5650030 - DNA, 21 bp, Homo sapiens
tgcccaggcccttggctgcag

SEQ ID NO: 5650031 - DNA, 15 bp, Homo sapiens
tgcccaggccggcca

SEQ ID NO: 5650032 - DNA, 20 bp, Homo sapiens
tgcccaggcctatctggaag

SEQ ID NO: 5650033 - DNA, 13 bp, Homo sapiens
tgcccaggcctct

SEQ ID NO: 5650034 - DNA, 10 bp, Homo sapiens
tgcccaggct

SEQ ID NO: 5650035 - DNA, 14 bp, Homo sapiens
tgcccaggctggag

SEQ ID NO: 5650036 - DNA, 18 bp, Homo sapiens
tgcccaggctggagtgca

SEQ ID NO: 5650037 - DNA, 20 bp, Homo sapiens
tgcccaggctggagtgcagt

SEQ ID NO: 5650038 - DNA, 19 bp, Homo sapiens
tgcccaggctggcgtgcag

SEQ ID NO: 5650039 - DNA, 13 bp, Homo sapiens
tgcccaggctggt

SEQ ID NO: 5650040 - DNA, 16 bp, Homo sapiens
tgcccaggctggtctt

SEQ ID NO: 5650041 - DNA, 15 bp, Homo sapiens
tgcccaggcttctca

SEQ ID NO: 5650042 - DNA, 18 bp, Homo sapiens
tgcccagggagtccttgc

SEQ ID NO: 5650043 - DNA, 22 bp, Homo sapiens
tgcccagggccactctgcctct

SEQ ID NO: 5650044 - DNA, 17 bp, Homo sapiens
tgcccagggctcagcct

SEQ ID NO: 5650045 - DNA, 18 bp, Homo sapiens
tgcccagggctcagcctg

SEQ ID NO: 5650046 - DNA, 23 bp, Homo sapiens
tgcccagggctcagcctggtggg

SEQ ID NO: 5650047 - DNA, 17 bp, Homo sapiens
tgcccaggggagccctc

SEQ ID NO: 5650048 - DNA, 21 bp, Homo sapiens
tgcccaggggagcgtgttcct

SEQ ID NO: 5650049 - DNA, 20 bp, Homo sapiens
tgcccaggggtgccccctcc

SEQ ID NO: 5650050 - DNA, 17 bp, Homo sapiens
tgcccagggtcagtgta

SEQ ID NO: 5650051 - DNA, 17 bp, Homo sapiens
tgcccagggtcctgtgc

SEQ ID NO: 5650052 - DNA, 19 bp, Homo sapiens
tgcccagggtggctgccag

SEQ ID NO: 5650053 - DNA, 20 bp, Homo sapiens
tgcccaggtaccacccttca

SEQ ID NO: 5650054 - DNA, 16 bp, Homo sapiens
tgcccaggtggcctcc

SEQ ID NO: 5650055 - DNA, 19 bp, Homo sapiens
tgcccaggtggctgtggaa

SEQ ID NO: 5650056 - DNA, 20 bp, Homo sapiens
tgcccaggttggtctcgaac

SEQ ID NO: 5650057 - DNA, 21 bp, Homo sapiens
tgcccagtaaaatttcaggat

SEQ ID NO: 5650058 - DNA, 22 bp, Homo sapiens
tgcccagtaaaatttcaggatt

SEQ ID NO: 5650059 - DNA, 19 bp, Homo sapiens
tgcccagtacatttaaatt

SEQ ID NO: 5650060 - DNA, 18 bp, Homo sapiens
tgcccagtcccccaaccc

SEQ ID NO: 5650061 - DNA, 22 bp, Homo sapiens
tgcccagtcccccaaccccagc

SEQ ID NO: 5650062 - DNA, 23 bp, Homo sapiens
tgcccagtcccccaaccccagcc

SEQ ID NO: 5650063 - DNA, 11 bp, Homo sapiens
tgcccagtcct

SEQ ID NO: 5650064 - DNA, 17 bp, Homo sapiens
tgcccagtcgaccccaa

SEQ ID NO: 5650065 - DNA, 21 bp, Homo sapiens
tgcccagtcgatatctcactt

SEQ ID NO: 5650066 - DNA, 22 bp, Homo sapiens
tgcccagtctggaagaagagga

SEQ ID NO: 5650067 - DNA, 23 bp, Homo sapiens
tgcccagtctggaagaagaggag

SEQ ID NO: 5650068 - DNA, 15 bp, Homo sapiens
tgcccagtcttgagt

SEQ ID NO: 5650069 - DNA, 12 bp, Homo sapiens
tgcccagtgagc

SEQ ID NO: 5650070 - DNA, 22 bp, Homo sapiens
tgcccagtgagccctgctcttc

SEQ ID NO: 5650071 - DNA, 18 bp, Homo sapiens
tgcccagtgatggcatta

SEQ ID NO: 5650072 - DNA, 18 bp, Homo sapiens
tgcccagtgcaaaccact

SEQ ID NO: 5650073 - DNA, 21 bp, Homo sapiens
tgcccagtggagcctgccgcc

SEQ ID NO: 5650074 - DNA, 22 bp, Homo sapiens
tgcccagtggtttccctttgct

SEQ ID NO: 5650075 - DNA, 19 bp, Homo sapiens
tgcccagtgttgtttgtaa

SEQ ID NO: 5650076 - DNA, 14 bp, Homo sapiens
tgcccagttaatct

SEQ ID NO: 5650077 - DNA, 16 bp, Homo sapiens
tgcccagttagcccgg

SEQ ID NO: 5650078 - DNA, 23 bp, Homo sapiens
tgcccagttagcccggccaagga

SEQ ID NO: 5650079 - DNA, 13 bp, Homo sapiens
tgcccagttcact

SEQ ID NO: 5650080 - DNA, 17 bp, Homo sapiens
tgcccagtttcagggct

SEQ ID NO: 5650081 - DNA, 17 bp, Homo sapiens
tgcccagtttctgcctc

SEQ ID NO: 5650082 - DNA, 17 bp, Homo sapiens
tgcccatactgagcctg

SEQ ID NO: 5650083 - DNA, 17 bp, Homo sapiens
tgcccatcatctctgcc

SEQ ID NO: 5650084 - DNA, 21 bp, Homo sapiens
tgcccatcatctctgcctttg

SEQ ID NO: 5650085 - DNA, 22 bp, Homo sapiens
tgcccatcatctctgcctttga

SEQ ID NO: 5650086 - DNA, 21 bp, Homo sapiens
tgcccatcatgtggccccacc

SEQ ID NO: 5650087 - DNA, 14 bp, Homo sapiens
tgcccatcccaccc

SEQ ID NO: 5650088 - DNA, 19 bp, Homo sapiens
tgcccatcccagtccctcg

SEQ ID NO: 5650089 - DNA, 12 bp, Homo sapiens
tgcccatcctcc

SEQ ID NO: 5650090 - DNA, 15 bp, Homo sapiens
tgcccatcctgactg

SEQ ID NO: 5650091 - DNA, 14 bp, Homo sapiens
tgcccatgaagagg

SEQ ID NO: 5650092 - DNA, 14 bp, Homo sapiens
tgcccatgagcaag

SEQ ID NO: 5650093 - DNA, 22 bp, Homo sapiens
tgcccatgatggtcacttaaaa

SEQ ID NO: 5650094 - DNA, 16 bp, Homo sapiens
tgcccatgcctccagc

SEQ ID NO: 5650095 - DNA, 19 bp, Homo sapiens
tgcccatgggatatgtggt

SEQ ID NO: 5650096 - DNA, 15 bp, Homo sapiens
tgcccatgggcactg

SEQ ID NO: 5650097 - DNA, 22 bp, Homo sapiens
tgcccatgtgtcccctcactct

SEQ ID NO: 5650098 - DNA, 16 bp, Homo sapiens
tgcccattccccagcc

SEQ ID NO: 5650099 - DNA, 15 bp, Homo sapiens
tgcccattcctcacc

SEQ ID NO: 5650100 - DNA, 19 bp, Homo sapiens
tgcccattcctgcctggtc

SEQ ID NO: 5650101 - DNA, 20 bp, Homo sapiens
tgcccatttcacacaactgt

SEQ ID NO: 5650102 - DNA, 21 bp, Homo sapiens
tgcccatttcgaagatataca

SEQ ID NO: 5650103 - DNA, 23 bp, Homo sapiens
tgcccatttcgaagatatacaaa

SEQ ID NO: 5650104 - DNA, 17 bp, Homo sapiens
tgcccatttttgctaat

SEQ ID NO: 5650105 - DNA, 20 bp, Homo sapiens
tgccccaaataacttcagtc

SEQ ID NO: 5650106 - DNA, 15 bp, Homo sapiens
tgccccaaatcacaa

SEQ ID NO: 5650107 - DNA, 11 bp, Homo sapiens
tgccccaaccc

SEQ ID NO: 5650108 - DNA, 18 bp, Homo sapiens
tgccccaacccccaccga

SEQ ID NO: 5650109 - DNA, 16 bp, Homo sapiens
tgccccaacccccagc

SEQ ID NO: 5650110 - DNA, 17 bp, Homo sapiens
tgccccaacccccagca

SEQ ID NO: 5650111 - DNA, 13 bp, Homo sapiens
tgccccaactcct

SEQ ID NO: 5650112 - DNA, 17 bp, Homo sapiens
tgccccaagaggctagc

SEQ ID NO: 5650113 - DNA, 18 bp, Homo sapiens
tgccccaagcagccagcc

SEQ ID NO: 5650114 - DNA, 12 bp, Homo sapiens
tgccccaaggac

SEQ ID NO: 5650115 - DNA, 13 bp, Homo sapiens
tgccccaaggagg

SEQ ID NO: 5650116 - DNA, 18 bp, Homo sapiens
tgccccaaggaggtggct

SEQ ID NO: 5650117 - DNA, 22 bp, Homo sapiens
tgccccaaggccccagggacag

SEQ ID NO: 5650118 - DNA, 17 bp, Homo sapiens
tgccccaagggcccaga

SEQ ID NO: 5650119 - DNA, 18 bp, Homo sapiens
tgccccaagggcccagac

SEQ ID NO: 5650120 - DNA, 14 bp, Homo sapiens
tgccccaagtggtg

SEQ ID NO: 5650121 - DNA, 18 bp, Homo sapiens
tgccccaagtggtgagca

SEQ ID NO: 5650122 - DNA, 22 bp, Homo sapiens
tgccccaatcgggtccagagac

SEQ ID NO: 5650123 - DNA, 19 bp, Homo sapiens
tgccccacaaggcccagcc

SEQ ID NO: 5650124 - DNA, 23 bp, Homo sapiens
tgccccacaaggcccagccctgg

SEQ ID NO: 5650125 - DNA, 17 bp, Homo sapiens
tgccccacacctcctct

SEQ ID NO: 5650126 - DNA, 20 bp, Homo sapiens
tgccccacacctcctctcac

SEQ ID NO: 5650127 - DNA, 11 bp, Homo sapiens
tgccccacagc

SEQ ID NO: 5650128 - DNA, 21 bp, Homo sapiens
tgccccacaggccacacgctg

SEQ ID NO: 5650129 - DNA, 23 bp, Homo sapiens
tgccccacaggccacacgctgcc

SEQ ID NO: 5650130 - DNA, 19 bp, Homo sapiens
tgccccacagttgtgttca

SEQ ID NO: 5650131 - DNA, 22 bp, Homo sapiens
tgccccacatgcatgtctgcct

SEQ ID NO: 5650132 - DNA, 18 bp, Homo sapiens
tgccccacatgtggccat

SEQ ID NO: 5650133 - DNA, 13 bp, Homo sapiens
tgccccaccactc

SEQ ID NO: 5650134 - DNA, 20 bp, Homo sapiens
tgccccacccaactccacag

SEQ ID NO: 5650135 - DNA, 21 bp, Homo sapiens
tgccccacccaactccacagg

SEQ ID NO: 5650136 - DNA, 15 bp, Homo sapiens
tgccccacccaagcc

SEQ ID NO: 5650137 - DNA, 16 bp, Homo sapiens
tgccccacccaagccc

SEQ ID NO: 5650138 - DNA, 18 bp, Homo sapiens
tgccccacccaagcccaa

SEQ ID NO: 5650139 - DNA, 15 bp, Homo sapiens
tgccccacccacccc

SEQ ID NO: 5650140 - DNA, 23 bp, Homo sapiens
tgccccacccacccctcctgggc

SEQ ID NO: 5650141 - DNA, 19 bp, Homo sapiens
tgccccaccccatccagcc

SEQ ID NO: 5650142 - DNA, 22 bp, Homo sapiens
tgccccaccccatccagccaga

SEQ ID NO: 5650143 - DNA, 13 bp, Homo sapiens
tgccccacccctc

SEQ ID NO: 5650144 - DNA, 20 bp, Homo sapiens
tgccccacccctccccatta

SEQ ID NO: 5650145 - DNA, 12 bp, Homo sapiens
tgccccacctcc

SEQ ID NO: 5650146 - DNA, 15 bp, Homo sapiens
tgccccacctcccca

SEQ ID NO: 5650147 - DNA, 15 bp, Homo sapiens
tgccccacctccccc

SEQ ID NO: 5650148 - DNA, 20 bp, Homo sapiens
tgccccacctcccccttccc

SEQ ID NO: 5650149 - DNA, 20 bp, Homo sapiens
tgccccacctcccgccctca

SEQ ID NO: 5650150 - DNA, 23 bp, Homo sapiens
tgccccacctgccgcatgctccc

SEQ ID NO: 5650151 - DNA, 17 bp, Homo sapiens
tgccccacctgcctggt

SEQ ID NO: 5650152 - DNA, 20 bp, Homo sapiens
tgccccacctgttgtcctga

SEQ ID NO: 5650153 - DNA, 12 bp, Homo sapiens
tgccgataacct

SEQ ID NO: 5650154 - DNA, 20 bp, Homo sapiens
tgccgatgttgaactttttt

SEQ ID NO: 5650155 - DNA, 22 bp, Homo sapiens
tgccgatttcataccttatgct

SEQ ID NO: 5650156 - DNA, 13 bp, Homo sapiens
tgccgatttctgt

SEQ ID NO: 5650157 - DNA, 19 bp, Homo sapiens
tgccgattttgtaaatgtt

SEQ ID NO: 5650158 - DNA, 22 bp, Homo sapiens
tgccgcaaggccctgtcccagc

SEQ ID NO: 5650159 - DNA, 20 bp, Homo sapiens
tgccgcaagtctgcagcccg

SEQ ID NO: 5650160 - DNA, 15 bp, Homo sapiens
tgccgcaataaatgc

SEQ ID NO: 5650161 - DNA, 20 bp, Homo sapiens
tgccgcactagcctccctct

SEQ ID NO: 5650162 - DNA, 13 bp, Homo sapiens
tgccgcagacggg

SEQ ID NO: 5650163 - DNA, 17 bp, Homo sapiens
tgccgcagcggtgggaa

SEQ ID NO: 5650164 - DNA, 18 bp, Homo sapiens
tgccgcagggagggctgt

SEQ ID NO: 5650165 - DNA, 23 bp, Homo sapiens
tgccgcagtggggtcaagctgag

SEQ ID NO: 5650166 - DNA, 16 bp, Homo sapiens
tgccgcatctcacagc

SEQ ID NO: 5650167 - DNA, 15 bp, Homo sapiens
tgccgcatctgcctg

SEQ ID NO: 5650168 - DNA, 20 bp, Homo sapiens
tgccgcatctgcctggagcc

SEQ ID NO: 5650169 - DNA, 14 bp, Homo sapiens
tgccgcatgctccc

SEQ ID NO: 5650170 - DNA, 17 bp, Homo sapiens
tgccgcatgctccctcc

SEQ ID NO: 5650171 - DNA, 13 bp, Homo sapiens
tgccgccaccacg

SEQ ID NO: 5650172 - DNA, 17 bp, Homo sapiens
tgccgccagctgccgca

SEQ ID NO: 5650173 - DNA, 20 bp, Homo sapiens
tgccgccagctgccgcacca

SEQ ID NO: 5650174 - DNA, 23 bp, Homo sapiens
tgccgccagctgccgcaccagcc

SEQ ID NO: 5650175 - DNA, 14 bp, Homo sapiens
tgccgccccaccca

SEQ ID NO: 5650176 - DNA, 17 bp, Homo sapiens
tgccgcccccgcctggg

SEQ ID NO: 5650177 - DNA, 20 bp, Homo sapiens
tgccgcccccgcctgggcac

SEQ ID NO: 5650178 - DNA, 23 bp, Homo sapiens
tgccgcccgaggtggctgcctgg

SEQ ID NO: 5650179 - DNA, 21 bp, Homo sapiens
tgccgccctgtgggagccgca

SEQ ID NO: 5650180 - DNA, 14 bp, Homo sapiens
tgccgcccttcctg

SEQ ID NO: 5650181 - DNA, 15 bp, Homo sapiens
tgccgccgcagctgg

SEQ ID NO: 5650182 - DNA, 17 bp, Homo sapiens
tgccgccgcctcgccca

SEQ ID NO: 5650183 - DNA, 20 bp, Homo sapiens
tgccgccgcctcgcccaccg

SEQ ID NO: 5650184 - DNA, 21 bp, Homo sapiens
tgccgccgcctcgcccaccgc

SEQ ID NO: 5650185 - DNA, 17 bp, Homo sapiens
tgccgccgtgtttcctc

SEQ ID NO: 5650186 - DNA, 20 bp, Homo sapiens
tgccgcctcagcttctcaaa

SEQ ID NO: 5650187 - DNA, 18 bp, Homo sapiens
tgccgcctcccagcctgg

SEQ ID NO: 5650188 - DNA, 13 bp, Homo sapiens
tgccgcctgtcaa

SEQ ID NO: 5650189 - DNA, 14 bp, Homo sapiens
tgccgcctgtgccc

SEQ ID NO: 5650190 - DNA, 18 bp, Homo sapiens
tgccgccttccccatcac

SEQ ID NO: 5650191 - DNA, 21 bp, Homo sapiens
tgccgcgtcccacgtctcctc

SEQ ID NO: 5650192 - DNA, 22 bp, Homo sapiens
tgccgcgtcccacgtctcctcc

SEQ ID NO: 5650193 - DNA, 17 bp, Homo sapiens
tgccgcgtccctgcccc

SEQ ID NO: 5650194 - DNA, 16 bp, Homo sapiens
tgccgcgtcgccctcc

SEQ ID NO: 5650195 - DNA, 16 bp, Homo sapiens
tgccgctacctccctc

SEQ ID NO: 5650196 - DNA, 15 bp, Homo sapiens
tgccgctccccttgg

SEQ ID NO: 5650197 - DNA, 14 bp, Homo sapiens
tgccgctcctgctt

SEQ ID NO: 5650198 - DNA, 16 bp, Homo sapiens
tgccgctcctgcttcc

SEQ ID NO: 5650199 - DNA, 21 bp, Homo sapiens
tgccgctcctgcttcccctcc

SEQ ID NO: 5650200 - DNA, 21 bp, Homo sapiens
tgccgctctaaattggctcca

SEQ ID NO: 5650201 - DNA, 14 bp, Homo sapiens
tgccgctctctctg

SEQ ID NO: 5650202 - DNA, 12 bp, Homo sapiens
tgccgctcttct

SEQ ID NO: 5650203 - DNA, 16 bp, Homo sapiens
tgccgctgcacctgcc

SEQ ID NO: 5650204 - DNA, 15 bp, Homo sapiens
tgccgctgccatgct

SEQ ID NO: 5650205 - DNA, 18 bp, Homo sapiens
tgccgctgcccccaccct

SEQ ID NO: 5650206 - DNA, 20 bp, Homo sapiens
tgccgctgcccccaccctgc

SEQ ID NO: 5650207 - DNA, 22 bp, Homo sapiens
tgccgctgcccccaccctgctt

SEQ ID NO: 5650208 - DNA, 21 bp, Homo sapiens
tgccgctgcttgagtggacag

SEQ ID NO: 5650209 - DNA, 22 bp, Homo sapiens
tgccgctgggagagccaaggcc

SEQ ID NO: 5650210 - DNA, 13 bp, Homo sapiens
tgccgctgtcaag

SEQ ID NO: 5650211 - DNA, 15 bp, Homo sapiens
tgccgctgtctctga

SEQ ID NO: 5650212 - DNA, 22 bp, Homo sapiens
tgccgcttaaacatttccctgc

SEQ ID NO: 5650213 - DNA, 12 bp, Homo sapiens
tgccgcttctgg

SEQ ID NO: 5650214 - DNA, 15 bp, Homo sapiens
tgccgctttctctga

SEQ ID NO: 5650215 - DNA, 18 bp, Homo sapiens
tgccgctttgtctgtcca

SEQ ID NO: 5650216 - DNA, 19 bp, Homo sapiens
tgccgcttttgtgcctctc

SEQ ID NO: 5650217 - DNA, 15 bp, Homo sapiens
tgccggagaggaaga

SEQ ID NO: 5650218 - DNA, 22 bp, Homo sapiens
tgccggagccccaagactctgc

SEQ ID NO: 5650219 - DNA, 14 bp, Homo sapiens
tgccggaggagcat

SEQ ID NO: 5650220 - DNA, 13 bp, Homo sapiens
tgccggaggcctt

SEQ ID NO: 5650221 - DNA, 22 bp, Homo sapiens
tgccggaggccttggggtgggg

SEQ ID NO: 5650222 - DNA, 16 bp, Homo sapiens
tgccggagggagccct

SEQ ID NO: 5650223 - DNA, 17 bp, Homo sapiens
tgccggagggagccctg

SEQ ID NO: 5650224 - DNA, 16 bp, Homo sapiens
tgccggatacaaactg

SEQ ID NO: 5650225 - DNA, 18 bp, Homo sapiens
tgccggcacagctgggat

SEQ ID NO: 5650226 - DNA, 19 bp, Homo sapiens
tgccggcacagctgggata

SEQ ID NO: 5650227 - DNA, 16 bp, Homo sapiens
tgccggcaggatgcag

SEQ ID NO: 5650228 - DNA, 19 bp, Homo sapiens
tgccggcatctcccctagc

SEQ ID NO: 5650229 - DNA, 21 bp, Homo sapiens
tgccggcatctcccctagctc

SEQ ID NO: 5650230 - DNA, 15 bp, Homo sapiens
tgccggccctggggc

SEQ ID NO: 5650231 - DNA, 19 bp, Homo sapiens
tgccggcggcagccccact

SEQ ID NO: 5650232 - DNA, 20 bp, Homo sapiens
tgccggcggcagccccactt

SEQ ID NO: 5650233 - DNA, 14 bp, Homo sapiens
tgccggctctgggc

SEQ ID NO: 5650234 - DNA, 20 bp, Homo sapiens
tgccggctctgggcctgagg

SEQ ID NO: 5650235 - DNA, 16 bp, Homo sapiens
tgccggctctgggctg

SEQ ID NO: 5650236 - DNA, 17 bp, Homo sapiens
tgccggctctgggctgg

SEQ ID NO: 5650237 - DNA, 20 bp, Homo sapiens
tgccggctctgggctggctg

SEQ ID NO: 5650238 - DNA, 20 bp, Homo sapiens
tgccggctctttccttgctc

SEQ ID NO: 5650239 - DNA, 22 bp, Homo sapiens
tgccggctgcaccctgtatgga

SEQ ID NO: 5650240 - DNA, 17 bp, Homo sapiens
tgccggctgtggagcaa

SEQ ID NO: 5650241 - DNA, 21 bp, Homo sapiens
tgccgggagactgccagtgga

SEQ ID NO: 5650242 - DNA, 15 bp, Homo sapiens
tgccgggcgccagga

SEQ ID NO: 5650243 - DNA, 18 bp, Homo sapiens
tgccgggcgccaggacag

SEQ ID NO: 5650244 - DNA, 21 bp, Homo sapiens
tgccgggcgccaggacagcag

SEQ ID NO: 5650245 - DNA, 17 bp, Homo sapiens
tgccggggaggggcaga

SEQ ID NO: 5650246 - DNA, 18 bp, Homo sapiens
tgccgggggagccaccag

SEQ ID NO: 5650247 - DNA, 18 bp, Homo sapiens
tgccgggtgcagcatctg

SEQ ID NO: 5650248 - DNA, 21 bp, Homo sapiens
tgccgggtggggggagggcac

SEQ ID NO: 5650249 - DNA, 23 bp, Homo sapiens
tgccgggtggggggagggcaccc

SEQ ID NO: 5650250 - DNA, 15 bp, Homo sapiens
tgccggtaccagcct

SEQ ID NO: 5650251 - DNA, 13 bp, Homo sapiens
tgccggtcatttg

SEQ ID NO: 5650252 - DNA, 19 bp, Homo sapiens
tgccggtgcacaggcctct

SEQ ID NO: 5650253 - DNA, 16 bp, Homo sapiens
tgccggtgggaccctg

SEQ ID NO: 5650254 - DNA, 15 bp, Homo sapiens
tgccggtggggccag

SEQ ID NO: 5650255 - DNA, 16 bp, Homo sapiens
tgccggtggggccagc

SEQ ID NO: 5650256 - DNA, 17 bp, Homo sapiens
tgccggttaaattccat

SEQ ID NO: 5650257 - DNA, 19 bp, Homo sapiens
tgccgtagcttcagccagg

SEQ ID NO: 5650258 - DNA, 23 bp, Homo sapiens
tgccgtagggagtacctgctgcc

SEQ ID NO: 5650259 - DNA, 13 bp, Homo sapiens
tgccgtcaccacc

SEQ ID NO: 5650260 - DNA, 14 bp, Homo sapiens
tgccgtcaccacca

SEQ ID NO: 5650261 - DNA, 15 bp, Homo sapiens
tgccgtcaccaccac

SEQ ID NO: 5650262 - DNA, 18 bp, Homo sapiens
tgccgtcaccaccacccc

SEQ ID NO: 5650263 - DNA, 15 bp, Homo sapiens
tgccgtctacctgag

SEQ ID NO: 5650264 - DNA, 16 bp, Homo sapiens
tgccgtctacctgagg

SEQ ID NO: 5650265 - DNA, 18 bp, Homo sapiens
tgccgtctcatcttctct

SEQ ID NO: 5650266 - DNA, 12 bp, Homo sapiens
tgccgtctctgg

SEQ ID NO: 5650267 - DNA, 16 bp, Homo sapiens
tgccgtcttctgccct

SEQ ID NO: 5650268 - DNA, 17 bp, Homo sapiens
tgccgtctttggttcct

SEQ ID NO: 5650269 - DNA, 19 bp, Homo sapiens
tgccgtctttggttcctca

SEQ ID NO: 5650270 - DNA, 15 bp, Homo sapiens
tgccgtgagcatgca

SEQ ID NO: 5650271 - DNA, 19 bp, Homo sapiens
tgccgtgcacggggccagc

SEQ ID NO: 5650272 - DNA, 15 bp, Homo sapiens
tgccgtggcttgggg

SEQ ID NO: 5650273 - DNA, 16 bp, Homo sapiens
tgccgttactctccaa

SEQ ID NO: 5650274 - DNA, 22 bp, Homo sapiens
tgccgttacttttcatatttgc

SEQ ID NO: 5650275 - DNA, 22 bp, Homo sapiens
tgcctaaaaattcccttcctgt

SEQ ID NO: 5650276 - DNA, 20 bp, Homo sapiens
tgcctaaaacaatctaaaac

SEQ ID NO: 5650277 - DNA, 20 bp, Homo sapiens
tgcctaaaacccagttgctg

SEQ ID NO: 5650278 - DNA, 14 bp, Homo sapiens
tgcctaaaatataa

SEQ ID NO: 5650279 - DNA, 14 bp, Homo sapiens
tgcctaaaatatga

SEQ ID NO: 5650280 - DNA, 14 bp, Homo sapiens
tgcctaaaatgaat

SEQ ID NO: 5650281 - DNA, 16 bp, Homo sapiens
tgcctaaaattgtatg

SEQ ID NO: 5650282 - DNA, 21 bp, Homo sapiens
tgcctaaaattttagatgtag

SEQ ID NO: 5650283 - DNA, 16 bp, Homo sapiens
tgcctaaagcccattg

SEQ ID NO: 5650284 - DNA, 15 bp, Homo sapiens
tgcctaaagtgctgc

SEQ ID NO: 5650285 - DNA, 16 bp, Homo sapiens
tgcctaaagtgctgca

SEQ ID NO: 5650286 - DNA, 17 bp, Homo sapiens
tgcctaaagtgctgcag

SEQ ID NO: 5650287 - DNA, 17 bp, Homo sapiens
tgcctaaatccaaagaa

SEQ ID NO: 5650288 - DNA, 18 bp, Homo sapiens
tgcctaaatccaaagaaa

SEQ ID NO: 5650289 - DNA, 15 bp, Homo sapiens
tgcctaaatcccaag

SEQ ID NO: 5650290 - DNA, 21 bp, Homo sapiens
tgcctaaatttaatgctgcct

SEQ ID NO: 5650291 - DNA, 16 bp, Homo sapiens
tgcctaaccaggccca

SEQ ID NO: 5650292 - DNA, 18 bp, Homo sapiens
tgcctaaccaggcccagc

SEQ ID NO: 5650293 - DNA, 14 bp, Homo sapiens
tgcctaacctggga

SEQ ID NO: 5650294 - DNA, 13 bp, Homo sapiens
tgcctaagaagtt

SEQ ID NO: 5650295 - DNA, 13 bp, Homo sapiens
tgcctaagccctc

SEQ ID NO: 5650296 - DNA, 13 bp, Homo sapiens
tgcctaaggactt

SEQ ID NO: 5650297 - DNA, 15 bp, Homo sapiens
tgcctaaggacttct

SEQ ID NO: 5650298 - DNA, 16 bp, Homo sapiens
tgcctaaggacttctt

SEQ ID NO: 5650299 - DNA, 21 bp, Homo sapiens
tgcctaaggacttctttaatt

SEQ ID NO: 5650300 - DNA, 15 bp, Homo sapiens
tgcctaagtattaaa

SEQ ID NO: 5650301 - DNA, 17 bp, Homo sapiens
tgcctaagtattaaaac

SEQ ID NO: 5650302 - DNA, 19 bp, Homo sapiens
tgcctaagtattaaaacat

SEQ ID NO: 5650303 - DNA, 22 bp, Homo sapiens
tgcctaagtccagtgtttcttt

SEQ ID NO: 5650304 - DNA, 12 bp, Homo sapiens
tgcctaataaag

SEQ ID NO: 5650305 - DNA, 15 bp, Homo sapiens
tgcctaataaagaga

SEQ ID NO: 5650306 - DNA, 17 bp, Homo sapiens
tgcctaatatgatgact

SEQ ID NO: 5650307 - DNA, 16 bp, Homo sapiens
tgcctaatggagaaga

SEQ ID NO: 5650308 - DNA, 14 bp, Homo sapiens
tgcctaattggaaa

SEQ ID NO: 5650309 - DNA, 16 bp, Homo sapiens
tgcctaattggaaagt

SEQ ID NO: 5650310 - DNA, 15 bp, Homo sapiens
tgcctaattttctat

SEQ ID NO: 5650311 - DNA, 20 bp, Homo sapiens
tgcctacaaaacctcaaacc

SEQ ID NO: 5650312 - DNA, 15 bp, Homo sapiens
tgcctacaaagctct

SEQ ID NO: 5650313 - DNA, 14 bp, Homo sapiens
tgcctacaataaaa

SEQ ID NO: 5650314 - DNA, 19 bp, Homo sapiens
tgcctacaataaaaagaaa

SEQ ID NO: 5650315 - DNA, 17 bp, Homo sapiens
tgcctacagaacttcag

SEQ ID NO: 5650316 - DNA, 15 bp, Homo sapiens
tgcctacagataatt

SEQ ID NO: 5650317 - DNA, 15 bp, Homo sapiens
tgcctacatcccggg

SEQ ID NO: 5650318 - DNA, 21 bp, Homo sapiens
tgcctacatcccgggcctcag

SEQ ID NO: 5650319 - DNA, 15 bp, Homo sapiens
tgcctacattatcta

SEQ ID NO: 5650320 - DNA, 19 bp, Homo sapiens
tgcctacattccctggcct

SEQ ID NO: 5650321 - DNA, 23 bp, Homo sapiens
tgcctaccaatatttaatctttt

SEQ ID NO: 5650322 - DNA, 14 bp, Homo sapiens
tgcctaccatttca

SEQ ID NO: 5650323 - DNA, 20 bp, Homo sapiens
tgcctacctagctgcatcta

SEQ ID NO: 5650324 - DNA, 14 bp, Homo sapiens
tgcctacgccagga

SEQ ID NO: 5650325 - DNA, 21 bp, Homo sapiens
tgcctacgtgacaacacaaat

SEQ ID NO: 5650326 - DNA, 23 bp, Homo sapiens
tgcctacgttctctttaaaagct

SEQ ID NO: 5650327 - DNA, 21 bp, Homo sapiens
tgcctactgcccctgccctga

SEQ ID NO: 5650328 - DNA, 23 bp, Homo sapiens
tgcctactgcccctgccctgagg

SEQ ID NO: 5650329 - DNA, 17 bp, Homo sapiens
tgcctacttttctttat

SEQ ID NO: 5650330 - DNA, 18 bp, Homo sapiens
tgcctagaaacaacactg

SEQ ID NO: 5650331 - DNA, 19 bp, Homo sapiens
tgcctgctctccttgccct

SEQ ID NO: 5650332 - DNA, 20 bp, Homo sapiens
tgcctgctctccttgccctg

SEQ ID NO: 5650333 - DNA, 23 bp, Homo sapiens
tgcctgctctgcagcccacagag

SEQ ID NO: 5650334 - DNA, 12 bp, Homo sapiens
tgcctgctcttt

SEQ ID NO: 5650335 - DNA, 15 bp, Homo sapiens
tgcctgctgagatga

SEQ ID NO: 5650336 - DNA, 14 bp, Homo sapiens
tgcctgctgctgcc

SEQ ID NO: 5650337 - DNA, 23 bp, Homo sapiens
tgcctgctgggctccccccagtg

SEQ ID NO: 5650338 - DNA, 14 bp, Homo sapiens
tgcctgctggggat

SEQ ID NO: 5650339 - DNA, 21 bp, Homo sapiens
tgcctgctgggtgccaggtgc

SEQ ID NO: 5650340 - DNA, 16 bp, Homo sapiens
tgcctgctgtatccct

SEQ ID NO: 5650341 - DNA, 21 bp, Homo sapiens
tgcctgctgtgttaagaggac

SEQ ID NO: 5650342 - DNA, 21 bp, Homo sapiens
tgcctgcttcagcctcccaca

SEQ ID NO: 5650343 - DNA, 14 bp, Homo sapiens
tgcctgcttcctgg

SEQ ID NO: 5650344 - DNA, 20 bp, Homo sapiens
tgcctgctttctccaagaca

SEQ ID NO: 5650345 - DNA, 13 bp, Homo sapiens
tgcctgctttgaa

SEQ ID NO: 5650346 - DNA, 21 bp, Homo sapiens
tgcctgcttttcactgctgca

SEQ ID NO: 5650347 - DNA, 22 bp, Homo sapiens
tgcctgcttttcactgctgcaa

SEQ ID NO: 5650348 - DNA, 13 bp, Homo sapiens
tgcctgcttttga

SEQ ID NO: 5650349 - DNA, 21 bp, Homo sapiens
tgcctgctttttatggcctgt

SEQ ID NO: 5650350 - DNA, 22 bp, Homo sapiens
tgcctgctttttatggcctgtg

SEQ ID NO: 5650351 - DNA, 21 bp, Homo sapiens
tgcctgctttttggaaagtca

SEQ ID NO: 5650352 - DNA, 19 bp, Homo sapiens
tgcctggaacaccagcagc

SEQ ID NO: 5650353 - DNA, 19 bp, Homo sapiens
tgcctggaagagcagccct

SEQ ID NO: 5650354 - DNA, 23 bp, Homo sapiens
tgcctggaagagccgagcacctg

SEQ ID NO: 5650355 - DNA, 15 bp, Homo sapiens
tgcctggacaaaccc

SEQ ID NO: 5650356 - DNA, 21 bp, Homo sapiens
tgcctggacatttgccttgct

SEQ ID NO: 5650357 - DNA, 11 bp, Homo sapiens
tgcctggactg

SEQ ID NO: 5650358 - DNA, 13 bp, Homo sapiens
tgcctggactgac

SEQ ID NO: 5650359 - DNA, 14 bp, Homo sapiens
tgcctggagaaagg

SEQ ID NO: 5650360 - DNA, 15 bp, Homo sapiens
tgcctggagaaagga

SEQ ID NO: 5650361 - DNA, 19 bp, Homo sapiens
tgcctggagaaaggatggc

SEQ ID NO: 5650362 - DNA, 20 bp, Homo sapiens
tgcctggagacaaggtgcta

SEQ ID NO: 5650363 - DNA, 23 bp, Homo sapiens
tgcctggagacaaggtgctaaca

SEQ ID NO: 5650364 - DNA, 15 bp, Homo sapiens
tgcctggagacagat

SEQ ID NO: 5650365 - DNA, 22 bp, Homo sapiens
tgcctggagacgtggaacctct

SEQ ID NO: 5650366 - DNA, 20 bp, Homo sapiens
tgcctggagacttagggcac

SEQ ID NO: 5650367 - DNA, 22 bp, Homo sapiens
tgcctggagagggtctcgctgt

SEQ ID NO: 5650368 - DNA, 17 bp, Homo sapiens
tgcctggagcctgggca

SEQ ID NO: 5650369 - DNA, 21 bp, Homo sapiens
tgcctggagcctgggcagcac

SEQ ID NO: 5650370 - DNA, 11 bp, Homo sapiens
tgcctggagct

SEQ ID NO: 5650371 - DNA, 18 bp, Homo sapiens
tgcctggagctcctggga

SEQ ID NO: 5650372 - DNA, 15 bp, Homo sapiens
tgcctggaggacctg

SEQ ID NO: 5650373 - DNA, 18 bp, Homo sapiens
tgcctggaggacctgagc

SEQ ID NO: 5650374 - DNA, 19 bp, Homo sapiens
tgcctggaggacctgagcc

SEQ ID NO: 5650375 - DNA, 18 bp, Homo sapiens
tgcctggaggctcctcta

SEQ ID NO: 5650376 - DNA, 17 bp, Homo sapiens
tgcctggagtcagtagc

SEQ ID NO: 5650377 - DNA, 21 bp, Homo sapiens
tgcctggagtcagtagccaga

SEQ ID NO: 5650378 - DNA, 22 bp, Homo sapiens
tgcctggagtcagtagccagag

SEQ ID NO: 5650379 - DNA, 19 bp, Homo sapiens
tgcctggagtcccgtccct

SEQ ID NO: 5650380 - DNA, 14 bp, Homo sapiens
tgcctggagtgctg

SEQ ID NO: 5650381 - DNA, 15 bp, Homo sapiens
tgcctggagtgctgt

SEQ ID NO: 5650382 - DNA, 16 bp, Homo sapiens
tgcctggagtgctgtg

SEQ ID NO: 5650383 - DNA, 22 bp, Homo sapiens
tgcctggagtgtcggatcctgt

SEQ ID NO: 5650384 - DNA, 22 bp, Homo sapiens
tgcctggagttgactgactgag

SEQ ID NO: 5650385 - DNA, 15 bp, Homo sapiens
tgcctggatattttt

SEQ ID NO: 5650386 - DNA, 22 bp, Homo sapiens
tgcctggatgagaaacagctca

SEQ ID NO: 5650387 - DNA, 20 bp, Homo sapiens
tgcctggatgaggcacttct

SEQ ID NO: 5650388 - DNA, 22 bp, Homo sapiens
tgcctggatgggggtgcaggca

SEQ ID NO: 5650389 - DNA, 21 bp, Homo sapiens
tgcctggattgggagccattt

SEQ ID NO: 5650390 - DNA, 17 bp, Homo sapiens
tgcctggcacagaccag

SEQ ID NO: 5650391 - DNA, 20 bp, Homo sapiens
tgcctggcacttactggtcc

SEQ ID NO: 5650392 - DNA, 23 bp, Homo sapiens
tgcctggcaggctgtctggccag

SEQ ID NO: 5650393 - DNA, 13 bp, Homo sapiens
tgcctggccagat

SEQ ID NO: 5650394 - DNA, 14 bp, Homo sapiens
tgcctggccagatt

SEQ ID NO: 5650395 - DNA, 16 bp, Homo sapiens
tgcctggccaggcaga

SEQ ID NO: 5650396 - DNA, 20 bp, Homo sapiens
tgcctggccaggcagatctg

SEQ ID NO: 5650397 - DNA, 18 bp, Homo sapiens
tgcctggccatgctgtcc

SEQ ID NO: 5650398 - DNA, 17 bp, Homo sapiens
tgcctggcccagggagg

SEQ ID NO: 5650399 - DNA, 11 bp, Homo sapiens
tgcctggcccc

SEQ ID NO: 5650400 - DNA, 16 bp, Homo sapiens
tgcctggccccagcct

SEQ ID NO: 5650401 - DNA, 21 bp, Homo sapiens
tgcctggccccagcctgggcc

SEQ ID NO: 5650402 - DNA, 18 bp, Homo sapiens
tgcctggcccccctccag

SEQ ID NO: 5650403 - DNA, 16 bp, Homo sapiens
tgcctggccctcccca

SEQ ID NO: 5650404 - DNA, 18 bp, Homo sapiens
tgcctggccctccccaca

SEQ ID NO: 5650405 - DNA, 12 bp, Homo sapiens
tgcctggccctt

SEQ ID NO: 5650406 - DNA, 13 bp, Homo sapiens
tgcctggccggcc

SEQ ID NO: 5650407 - DNA, 17 bp, Homo sapiens
tgcctggccggccagcc

SEQ ID NO: 5650408 - DNA, 18 bp, Homo sapiens
tgcctggccggccagcca

SEQ ID NO: 5650409 - DNA, 15 bp, Homo sapiens
tgcctggcctctgcc

SEQ ID NO: 5650410 - DNA, 12 bp, Homo sapiens
tgcctggcctgg

SEQ ID NO: 5650411 - DNA, 14 bp, Homo sapiens
tgcctggcctggca

SEQ ID NO: 5650412 - DNA, 16 bp, Homo sapiens
tgcctggcctggcaca

SEQ ID NO: 5650413 - DNA, 17 bp, Homo sapiens
tgcctggcctggcacac

SEQ ID NO: 5650414 - DNA, 14 bp, Homo sapiens
tgcctggcctggct

SEQ ID NO: 5650415 - DNA, 15 bp, Homo sapiens
tgcctggcctggctc

SEQ ID NO: 5650416 - DNA, 16 bp, Homo sapiens
tgcctggcctggctcc

SEQ ID NO: 5650417 - DNA, 15 bp, Homo sapiens
tgcctggcgggcagc

SEQ ID NO: 5650418 - DNA, 19 bp, Homo sapiens
tgcctggcgggcagcccct

SEQ ID NO: 5650419 - DNA, 21 bp, Homo sapiens
tgcctggcgggcagcccctgc

SEQ ID NO: 5650420 - DNA, 15 bp, Homo sapiens
tgcctggctaacttt

SEQ ID NO: 5650421 - DNA, 15 bp, Homo sapiens
tgcctggctcagagc

SEQ ID NO: 5650422 - DNA, 11 bp, Homo sapiens
tgcctggctgg

SEQ ID NO: 5650423 - DNA, 13 bp, Homo sapiens
tgcctggctgggc

SEQ ID NO: 5650424 - DNA, 14 bp, Homo sapiens
tgcctggctgggct

SEQ ID NO: 5650425 - DNA, 23 bp, Homo sapiens
tgcctggctgggctttggggctg

SEQ ID NO: 5650426 - DNA, 11 bp, Homo sapiens
tgcctggctgt

SEQ ID NO: 5650427 - DNA, 17 bp, Homo sapiens
tgcctggctgtggaggc

SEQ ID NO: 5650428 - DNA, 18 bp, Homo sapiens
tgcctggctgtggaggcc

SEQ ID NO: 5650429 - DNA, 22 bp, Homo sapiens
tgcctggcttcgcaaaatgttt

SEQ ID NO: 5650430 - DNA, 14 bp, Homo sapiens
tgcctgggaagccc

SEQ ID NO: 5650431 - DNA, 20 bp, Homo sapiens
tgcctgggaagcccacccag

SEQ ID NO: 5650432 - DNA, 22 bp, Homo sapiens
tgcctgggaatcctgctgccag

SEQ ID NO: 5650433 - DNA, 14 bp, Homo sapiens
tgcctgggaatgta

SEQ ID NO: 5650434 - DNA, 15 bp, Homo sapiens
tgcctgggaatgtat

SEQ ID NO: 5650435 - DNA, 12 bp, Homo sapiens
tgcctgggacag

SEQ ID NO: 5650436 - DNA, 22 bp, Homo sapiens
tgcctgggagagcccttgtggc

SEQ ID NO: 5650437 - DNA, 20 bp, Homo sapiens
tgcctgggagccagggtgag

SEQ ID NO: 5650438 - DNA, 23 bp, Homo sapiens
tgcctgggatcagtggggcccca

SEQ ID NO: 5650439 - DNA, 19 bp, Homo sapiens
tgcctgggatgcccttccc

SEQ ID NO: 5650440 - DNA, 13 bp, Homo sapiens
tgcctgggattct

SEQ ID NO: 5650441 - DNA, 23 bp, Homo sapiens
tgcctgggcaatggccaggggcc

SEQ ID NO: 5650442 - DNA, 18 bp, Homo sapiens
tgcctgggcagaaggaag

SEQ ID NO: 5650443 - DNA, 17 bp, Homo sapiens
tgcctgggcccaggccc

SEQ ID NO: 5650444 - DNA, 18 bp, Homo sapiens
tgcctgggcccctcccct

SEQ ID NO: 5650445 - DNA, 22 bp, Homo sapiens
tgcctgggcccctcccctcaga

SEQ ID NO: 5650446 - DNA, 17 bp, Homo sapiens
tgcctgggccctgggct

SEQ ID NO: 5650447 - DNA, 22 bp, Homo sapiens
tgcctgggccgtggcacagctg

SEQ ID NO: 5650448 - DNA, 14 bp, Homo sapiens
tgcctgggcctccc

SEQ ID NO: 5650449 - DNA, 13 bp, Homo sapiens
tgcctgggcctga

SEQ ID NO: 5650450 - DNA, 14 bp, Homo sapiens
tgcctgggcctgtg

SEQ ID NO: 5650451 - DNA, 19 bp, Homo sapiens
tgcctgggctcagcctggt

SEQ ID NO: 5650452 - DNA, 18 bp, Homo sapiens
tgcctgggctctggaaga

SEQ ID NO: 5650453 - DNA, 21 bp, Homo sapiens
tgcctgggctgggcagccttg

SEQ ID NO: 5650454 - DNA, 22 bp, Homo sapiens
tgcctgggctgggcagccttgg

SEQ ID NO: 5650455 - DNA, 16 bp, Homo sapiens
tgcctgggcttatgcc

SEQ ID NO: 5650456 - DNA, 23 bp, Homo sapiens
tgcctggggattgggagggacag

SEQ ID NO: 5650457 - DNA, 14 bp, Homo sapiens
tgcctggggccaca

SEQ ID NO: 5650458 - DNA, 13 bp, Homo sapiens
tgcctggggctgg

SEQ ID NO: 5650459 - DNA, 14 bp, Homo sapiens
tgcctgggggagtt

SEQ ID NO: 5650460 - DNA, 21 bp, Homo sapiens
tgcctgggggagttttcctct

SEQ ID NO: 5650461 - DNA, 22 bp, Homo sapiens
tgcctggggtggaggctaagcc

SEQ ID NO: 5650462 - DNA, 18 bp, Homo sapiens
tgcctgggtctccacatc

SEQ ID NO: 5650463 - DNA, 19 bp, Homo sapiens
tgcctgggtggatgggcca

SEQ ID NO: 5650464 - DNA, 16 bp, Homo sapiens
tgcctgggtggccatc

SEQ ID NO: 5650465 - DNA, 20 bp, Homo sapiens
tgcctgggtggccatcctac

SEQ ID NO: 5650466 - DNA, 23 bp, Homo sapiens
tgcctgggtggccatcctaccca

SEQ ID NO: 5650467 - DNA, 21 bp, Homo sapiens
tgcctgggtgggacagcctct

SEQ ID NO: 5650468 - DNA, 16 bp, Homo sapiens
tgcctgggtggggctg

SEQ ID NO: 5650469 - DNA, 21 bp, Homo sapiens
tgcctgggtggggctgctcct

SEQ ID NO: 5650470 - DNA, 14 bp, Homo sapiens
tgcctgggttttct

SEQ ID NO: 5650471 - DNA, 21 bp, Homo sapiens
tgcctgggttttctaactgta

SEQ ID NO: 5650472 - DNA, 23 bp, Homo sapiens
tgcctgggttttctaactgtaaa

SEQ ID NO: 5650473 - DNA, 20 bp, Homo sapiens
tgcctggtaagtggcttttt

SEQ ID NO: 5650474 - DNA, 15 bp, Homo sapiens
tgcctggtacagtat

SEQ ID NO: 5650475 - DNA, 23 bp, Homo sapiens
tgcctggtatatccaaaagcttt

SEQ ID NO: 5650476 - DNA, 13 bp, Homo sapiens
tgcctggtatttt

SEQ ID NO: 5650477 - DNA, 16 bp, Homo sapiens
tgcctggtattttcaa

SEQ ID NO: 5650478 - DNA, 19 bp, Homo sapiens
tgcctggtattttcaacca

SEQ ID NO: 5650479 - DNA, 16 bp, Homo sapiens
tgcctggtcacagggc

SEQ ID NO: 5650480 - DNA, 22 bp, Homo sapiens
tgcctggtcacagggcatgccc

SEQ ID NO: 5650481 - DNA, 14 bp, Homo sapiens
tgcctggtcccaag

SEQ ID NO: 5650482 - DNA, 17 bp, Homo sapiens
tgcctggtctgtctgga

SEQ ID NO: 5650483 - DNA, 19 bp, Homo sapiens
tgcctggtctgtctggatc

SEQ ID NO: 5650484 - DNA, 17 bp, Homo sapiens
tgcctggtgaatggcct

SEQ ID NO: 5650485 - DNA, 19 bp, Homo sapiens
tgcctggtgcactgtgtct

SEQ ID NO: 5650486 - DNA, 15 bp, Homo sapiens
tgcctggtgcattgc

SEQ ID NO: 5650487 - DNA, 19 bp, Homo sapiens
tgcctggtgcgctgtgctc

SEQ ID NO: 5650488 - DNA, 24 bp, Homo sapiens
tgcctggtgcgctgtgctccagca

SEQ ID NO: 5650489 - DNA, 19 bp, Homo sapiens
tgcctggtggcagctgcgg

SEQ ID NO: 5650490 - DNA, 21 bp, Homo sapiens
tgcctggtggtcagatgcagg

SEQ ID NO: 5650491 - DNA, 18 bp, Homo sapiens
tgcctggttaatattaat

SEQ ID NO: 5650492 - DNA, 21 bp, Homo sapiens
tgcctggttccctccccaagg

SEQ ID NO: 5650493 - DNA, 22 bp, Homo sapiens
tgcctggttctaggctgctgca

SEQ ID NO: 5650494 - DNA, 17 bp, Homo sapiens
tgcctggttttatttat

SEQ ID NO: 5650495 - DNA, 13 bp, Homo sapiens
tgcctgtaaacat

SEQ ID NO: 5650496 - DNA, 11 bp, Homo sapiens
tgcctgtaatc

SEQ ID NO: 5650497 - DNA, 19 bp, Homo sapiens
tgcctgtaatcccaacact

SEQ ID NO: 5650498 - DNA, 17 bp, Homo sapiens
tgcctgtaatcccaact

SEQ ID NO: 5650499 - DNA, 16 bp, Homo sapiens
tgcctgtaatcccagc

SEQ ID NO: 5650500 - DNA, 13 bp, Homo sapiens
tgcctgtaatcct

SEQ ID NO: 5650501 - DNA, 19 bp, Homo sapiens
tgcctgtaatctttttctc

SEQ ID NO: 5650502 - DNA, 18 bp, Homo sapiens
tgcctgtaattcagtgta

SEQ ID NO: 5650503 - DNA, 20 bp, Homo sapiens
tgcctgtaattccagccact

SEQ ID NO: 5650504 - DNA, 12 bp, Homo sapiens
tgcctgtacaag

SEQ ID NO: 5650505 - DNA, 16 bp, Homo sapiens
tgcctgtacaagctga

SEQ ID NO: 5650506 - DNA, 21 bp, Homo sapiens
tgcctgtactactctagggag

SEQ ID NO: 5650507 - DNA, 14 bp, Homo sapiens
tgctaggtctcgga

SEQ ID NO: 5650508 - DNA, 15 bp, Homo sapiens
tgctaggtctgacca

SEQ ID NO: 5650509 - DNA, 16 bp, Homo sapiens
tgctaggtctgaccaa

SEQ ID NO: 5650510 - DNA, 15 bp, Homo sapiens
tgctaggtgggccag

SEQ ID NO: 5650511 - DNA, 20 bp, Homo sapiens
tgctaggtgggccagcccct

SEQ ID NO: 5650512 - DNA, 16 bp, Homo sapiens
tgctaggttaattcca

SEQ ID NO: 5650513 - DNA, 13 bp, Homo sapiens
tgctaggttctac

SEQ ID NO: 5650514 - DNA, 14 bp, Homo sapiens
tgctagtacctgta

SEQ ID NO: 5650515 - DNA, 23 bp, Homo sapiens
tgctagtactggggagaaataat

SEQ ID NO: 5650516 - DNA, 19 bp, Homo sapiens
tgctagtatcttgggtgta

SEQ ID NO: 5650517 - DNA, 18 bp, Homo sapiens
tgctagtatttgaattaa

SEQ ID NO: 5650518 - DNA, 17 bp, Homo sapiens
tgctagtcactggcagc

SEQ ID NO: 5650519 - DNA, 22 bp, Homo sapiens
tgctagtctagtttcctttttg

SEQ ID NO: 5650520 - DNA, 22 bp, Homo sapiens
tgctagtctcagataggtgctt

SEQ ID NO: 5650521 - DNA, 22 bp, Homo sapiens
tgctagtctgccctatggattt

SEQ ID NO: 5650522 - DNA, 16 bp, Homo sapiens
tgctagtcttaagaac

SEQ ID NO: 5650523 - DNA, 21 bp, Homo sapiens
tgctagtgaaatggctggggc

SEQ ID NO: 5650524 - DNA, 19 bp, Homo sapiens
tgctagtgagccttcccat

SEQ ID NO: 5650525 - DNA, 23 bp, Homo sapiens
tgctagtgctgtaatattgtaaa

SEQ ID NO: 5650526 - DNA, 16 bp, Homo sapiens
tgctagtggtgggcag

SEQ ID NO: 5650527 - DNA, 20 bp, Homo sapiens
tgctagtgtggtctgtaata

SEQ ID NO: 5650528 - DNA, 15 bp, Homo sapiens
tgctagttctgctgc

SEQ ID NO: 5650529 - DNA, 16 bp, Homo sapiens
tgctagttctgctgcc

SEQ ID NO: 5650530 - DNA, 16 bp, Homo sapiens
tgctagttggagtgct

SEQ ID NO: 5650531 - DNA, 20 bp, Homo sapiens
tgctataaatgccagagcca

SEQ ID NO: 5650532 - DNA, 22 bp, Homo sapiens
tgctataaatgccagagccaac

SEQ ID NO: 5650533 - DNA, 18 bp, Homo sapiens
tgctataaattttttgaa

SEQ ID NO: 5650534 - DNA, 22 bp, Homo sapiens
tgctataagaaaagtgaaagta

SEQ ID NO: 5650535 - DNA, 13 bp, Homo sapiens
tgctataatctgt

SEQ ID NO: 5650536 - DNA, 17 bp, Homo sapiens
tgctataatctgttttt

SEQ ID NO: 5650537 - DNA, 21 bp, Homo sapiens
tgctataatctgtttttacgt

SEQ ID NO: 5650538 - DNA, 23 bp, Homo sapiens
tgctataattctatactgttgat

SEQ ID NO: 5650539 - DNA, 14 bp, Homo sapiens
tgctatacacacac

SEQ ID NO: 5650540 - DNA, 13 bp, Homo sapiens
tgctatacatgtt

SEQ ID NO: 5650541 - DNA, 16 bp, Homo sapiens
tgctatactgtgtcat

SEQ ID NO: 5650542 - DNA, 16 bp, Homo sapiens
tgctatacttatcaca

SEQ ID NO: 5650543 - DNA, 20 bp, Homo sapiens
tgctatacttatcacatttt

SEQ ID NO: 5650544 - DNA, 18 bp, Homo sapiens
tgctatagagcctacctg

SEQ ID NO: 5650545 - DNA, 23 bp, Homo sapiens
tgctataggctggagaagctcac

SEQ ID NO: 5650546 - DNA, 13 bp, Homo sapiens
tgctatagtgaca

SEQ ID NO: 5650547 - DNA, 23 bp, Homo sapiens
tgctatagtgtataccacctgta

SEQ ID NO: 5650548 - DNA, 21 bp, Homo sapiens
tgctatatataaaacggtgct

SEQ ID NO: 5650549 - DNA, 15 bp, Homo sapiens
tgctatatatataaa

SEQ ID NO: 5650550 - DNA, 19 bp, Homo sapiens
tgctatatccagttcctgc

SEQ ID NO: 5650551 - DNA, 20 bp, Homo sapiens
tgctatatccagttcctgct

SEQ ID NO: 5650552 - DNA, 23 bp, Homo sapiens
tgctatatccagttcctgctctc

SEQ ID NO: 5650553 - DNA, 16 bp, Homo sapiens
tgctatattaggcctg

SEQ ID NO: 5650554 - DNA, 23 bp, Homo sapiens
tgctatatttgtgatataggaat

SEQ ID NO: 5650555 - DNA, 22 bp, Homo sapiens
tgctatattttcatgacttttc

SEQ ID NO: 5650556 - DNA, 18 bp, Homo sapiens
tgctatatttttaaagaa

SEQ ID NO: 5650557 - DNA, 21 bp, Homo sapiens
tgctatatttttaaagaagga

SEQ ID NO: 5650558 - DNA, 21 bp, Homo sapiens
tgctatcaaaataaattgaaa

SEQ ID NO: 5650559 - DNA, 19 bp, Homo sapiens
tgctatcaacaataaaatt

SEQ ID NO: 5650560 - DNA, 12 bp, Homo sapiens
tgctatcaatga

SEQ ID NO: 5650561 - DNA, 13 bp, Homo sapiens
tgctatcacatgt

SEQ ID NO: 5650562 - DNA, 17 bp, Homo sapiens
tgctatcacatgtgaaa

SEQ ID NO: 5650563 - DNA, 18 bp, Homo sapiens
tgctatcagaaacagtat

SEQ ID NO: 5650564 - DNA, 13 bp, Homo sapiens
tgctatcagtctc

SEQ ID NO: 5650565 - DNA, 21 bp, Homo sapiens
tgctatcatatattataagat

SEQ ID NO: 5650566 - DNA, 16 bp, Homo sapiens
tgctatccaatgatat

SEQ ID NO: 5650567 - DNA, 19 bp, Homo sapiens
tgctatccagctattttta

SEQ ID NO: 5650568 - DNA, 22 bp, Homo sapiens
tgctatccatttctcatgtttt

SEQ ID NO: 5650569 - DNA, 20 bp, Homo sapiens
tgctatccccatctccctgc

SEQ ID NO: 5650570 - DNA, 17 bp, Homo sapiens
tgctatcgccctccttt

SEQ ID NO: 5650571 - DNA, 21 bp, Homo sapiens
tgctatcgccctcctttccct

SEQ ID NO: 5650572 - DNA, 23 bp, Homo sapiens
tgctatcgccctcctttccctta

SEQ ID NO: 5650573 - DNA, 13 bp, Homo sapiens
tgctatctccccc

SEQ ID NO: 5650574 - DNA, 17 bp, Homo sapiens
tgctatctcgctagcca

SEQ ID NO: 5650575 - DNA, 16 bp, Homo sapiens
tgctatctctgtgtgc

SEQ ID NO: 5650576 - DNA, 20 bp, Homo sapiens
tgctatctctgtgtgcacaa

SEQ ID NO: 5650577 - DNA, 19 bp, Homo sapiens
tgctatcttttttagtgtt

SEQ ID NO: 5650578 - DNA, 12 bp, Homo sapiens
tgctatgaaaat

SEQ ID NO: 5650579 - DNA, 17 bp, Homo sapiens
tgctatgaaaatgagca

SEQ ID NO: 5650580 - DNA, 20 bp, Homo sapiens
tgctatgaaaatgagcatca

SEQ ID NO: 5650581 - DNA, 13 bp, Homo sapiens
tgctatgaaacaa

SEQ ID NO: 5650582 - DNA, 15 bp, Homo sapiens
tgctatgcatattta

SEQ ID NO: 5650583 - DNA, 14 bp, Homo sapiens
tgctatgcatgtct

SEQ ID NO: 5650584 - DNA, 21 bp, Homo sapiens
tgctatgccatttcttctctc

SEQ ID NO: 5650585 - DNA, 15 bp, Homo sapiens
tgctatggaaataca

SEQ ID NO: 5650586 - DNA, 12 bp, Homo sapiens
tgctatggggag

SEQ ID NO: 5650587 - DNA, 19 bp, Homo sapiens
tgctatggggagaaaagac

SEQ ID NO: 5650588 - DNA, 17 bp, Homo sapiens
tgctatggttttctcca

SEQ ID NO: 5650589 - DNA, 16 bp, Homo sapiens
tgctatgtatttgcaa

SEQ ID NO: 5650590 - DNA, 18 bp, Homo sapiens
tgctatgtcccaagagcc

SEQ ID NO: 5650591 - DNA, 14 bp, Homo sapiens
tgctatgtctgtga

SEQ ID NO: 5650592 - DNA, 17 bp, Homo sapiens
tgctatgtctgtgatgt

SEQ ID NO: 5650593 - DNA, 21 bp, Homo sapiens
tgctatgtgtttggtttataa

SEQ ID NO: 5650594 - DNA, 16 bp, Homo sapiens
tgctatgttactattt

SEQ ID NO: 5650595 - DNA, 19 bp, Homo sapiens
tgctatgttactattttct

SEQ ID NO: 5650596 - DNA, 14 bp, Homo sapiens
tgctatgttctgtc

SEQ ID NO: 5650597 - DNA, 16 bp, Homo sapiens
tgctatgttctgtctt

SEQ ID NO: 5650598 - DNA, 19 bp, Homo sapiens
tgctatgttctgtcttccc

SEQ ID NO: 5650599 - DNA, 20 bp, Homo sapiens
tgctatgttgcccaagctgg

SEQ ID NO: 5650600 - DNA, 13 bp, Homo sapiens
tgctattaaagtg

SEQ ID NO: 5650601 - DNA, 17 bp, Homo sapiens
tgctattaaattaatat

SEQ ID NO: 5650602 - DNA, 15 bp, Homo sapiens
tgctattaagaaggc

SEQ ID NO: 5650603 - DNA, 12 bp, Homo sapiens
tgctattaatat

SEQ ID NO: 5650604 - DNA, 21 bp, Homo sapiens
tgctattatactgttatccat

SEQ ID NO: 5650605 - DNA, 17 bp, Homo sapiens
tgctattatgtaacatc

SEQ ID NO: 5650606 - DNA, 16 bp, Homo sapiens
tgctattctagagctt

SEQ ID NO: 5650607 - DNA, 19 bp, Homo sapiens
tgctattctagagctttta

SEQ ID NO: 5650608 - DNA, 15 bp, Homo sapiens
tgctattctgagtga

SEQ ID NO: 5650609 - DNA, 12 bp, Homo sapiens
tgctattctgtc

SEQ ID NO: 5650610 - DNA, 20 bp, Homo sapiens
tgctattctgtccctaggtg

SEQ ID NO: 5650611 - DNA, 13 bp, Homo sapiens
tgctattctgtgt

SEQ ID NO: 5650612 - DNA, 21 bp, Homo sapiens
tgctattctgtgttgaacaca

SEQ ID NO: 5650613 - DNA, 13 bp, Homo sapiens
tgctattgaaatt

SEQ ID NO: 5650614 - DNA, 14 bp, Homo sapiens
tgctattgaaatta

SEQ ID NO: 5650615 - DNA, 17 bp, Homo sapiens
tgctattgacaataaaa

SEQ ID NO: 5650616 - DNA, 18 bp, Homo sapiens
tgctattgcagaatgaag

SEQ ID NO: 5650617 - DNA, 15 bp, Homo sapiens
tgctattgctgtctg

SEQ ID NO: 5650618 - DNA, 16 bp, Homo sapiens
tgctattgctgtctgg

SEQ ID NO: 5650619 - DNA, 16 bp, Homo sapiens
tgctattgtaaatatg

SEQ ID NO: 5650620 - DNA, 18 bp, Homo sapiens
tgctattgtagagccaga

SEQ ID NO: 5650621 - DNA, 13 bp, Homo sapiens
tgctattgtttat

SEQ ID NO: 5650622 - DNA, 22 bp, Homo sapiens
tgctattgtttataggaaataa

SEQ ID NO: 5650623 - DNA, 16 bp, Homo sapiens
tgctatttaattcttt

SEQ ID NO: 5650624 - DNA, 12 bp, Homo sapiens
tgctatttatgc

SEQ ID NO: 5650625 - DNA, 17 bp, Homo sapiens
tgctatttcaataacag

SEQ ID NO: 5650626 - DNA, 20 bp, Homo sapiens
tgctatttcacttgagcaag

SEQ ID NO: 5650627 - DNA, 17 bp, Homo sapiens
tgctatttcaggccctc

SEQ ID NO: 5650628 - DNA, 13 bp, Homo sapiens
tgctatttccacc

SEQ ID NO: 5650629 - DNA, 13 bp, Homo sapiens
tgctatttctata

SEQ ID NO: 5650630 - DNA, 13 bp, Homo sapiens
tgctatttctatt

SEQ ID NO: 5650631 - DNA, 19 bp, Homo sapiens
tgctatttctattccttat

SEQ ID NO: 5650632 - DNA, 15 bp, Homo sapiens
tgctatttctggcct

SEQ ID NO: 5650633 - DNA, 14 bp, Homo sapiens
tgctatttgaagaa

SEQ ID NO: 5650634 - DNA, 15 bp, Homo sapiens
tgctatttgaagaaa

SEQ ID NO: 5650635 - DNA, 16 bp, Homo sapiens
tgctatttgaagaaaa

SEQ ID NO: 5650636 - DNA, 17 bp, Homo sapiens
tgctatttgagcatgca

SEQ ID NO: 5650637 - DNA, 15 bp, Homo sapiens
tgctatttgctttag

SEQ ID NO: 5650638 - DNA, 21 bp, Homo sapiens
tgctatttgctttagagacag

SEQ ID NO: 5650639 - DNA, 10 bp, Homo sapiens
tgctatttgt

SEQ ID NO: 5650640 - DNA, 13 bp, Homo sapiens
tgctatttgtaca

SEQ ID NO: 5650641 - DNA, 16 bp, Homo sapiens
tgctatttgtacaaat

SEQ ID NO: 5650642 - DNA, 19 bp, Homo sapiens
tgctatttgtacaaataaa

SEQ ID NO: 5650643 - DNA, 20 bp, Homo sapiens
tgctatttgtacaaataaac

SEQ ID NO: 5650644 - DNA, 20 bp, Homo sapiens
tgctatttgtgtaactgaaa

SEQ ID NO: 5650645 - DNA, 22 bp, Homo sapiens
tgctatttgttgtttttaacaa

SEQ ID NO: 5650646 - DNA, 18 bp, Homo sapiens
tgctattttaaaaaatat

SEQ ID NO: 5650647 - DNA, 18 bp, Homo sapiens
tgctattttaaaattcat

SEQ ID NO: 5650648 - DNA, 23 bp, Homo sapiens
tgctatttttaatttcctgtgag

SEQ ID NO: 5650649 - DNA, 19 bp, Homo sapiens
tgctatttttcatcctaaa

SEQ ID NO: 5650650 - DNA, 12 bp, Homo sapiens
tgctatttttgt

SEQ ID NO: 5650651 - DNA, 13 bp, Homo sapiens
tgctatttttgta

SEQ ID NO: 5650652 - DNA, 21 bp, Homo sapiens
tgctattttttatcattgaaa

SEQ ID NO: 5650653 - DNA, 22 bp, Homo sapiens
tgctattttttatcattgaaac

SEQ ID NO: 5650654 - DNA, 23 bp, Homo sapiens
tgctattttttcccttctcttct

SEQ ID NO: 5650655 - DNA, 12 bp, Homo sapiens
tgctcaaaaaag

SEQ ID NO: 5650656 - DNA, 15 bp, Homo sapiens
tgctcaaaaatctgt

SEQ ID NO: 5650657 - DNA, 16 bp, Homo sapiens
tgctcaaaatctgtga

SEQ ID NO: 5650658 - DNA, 19 bp, Homo sapiens
tgctcaaaattgcttctaa

SEQ ID NO: 5650659 - DNA, 18 bp, Homo sapiens
tgctcaaaatttgaagaa

SEQ ID NO: 5650660 - DNA, 19 bp, Homo sapiens
tgctcaaaatttgaagaat

SEQ ID NO: 5650661 - DNA, 23 bp, Homo sapiens
tgctcaaaattttaaaaatacca

SEQ ID NO: 5650662 - DNA, 14 bp, Homo sapiens
tgctcaaagaaatc

SEQ ID NO: 5650663 - DNA, 17 bp, Homo sapiens
tgctcaaagatgtactg

SEQ ID NO: 5650664 - DNA, 21 bp, Homo sapiens
tgctcaaagatgtactgagag

SEQ ID NO: 5650665 - DNA, 21 bp, Homo sapiens
tgctcaaatctattcagacaa

SEQ ID NO: 5650666 - DNA, 19 bp, Homo sapiens
tgctcaaattactaatgat

SEQ ID NO: 5650667 - DNA, 19 bp, Homo sapiens
tgctcaacagacaattaga

SEQ ID NO: 5650668 - DNA, 14 bp, Homo sapiens
tgctcaacccccct

SEQ ID NO: 5650669 - DNA, 16 bp, Homo sapiens
tgctcaacccccctcc

SEQ ID NO: 5650670 - DNA, 22 bp, Homo sapiens
tgctcaacctacagtggaggga

SEQ ID NO: 5650671 - DNA, 23 bp, Homo sapiens
tgctcaacctctctccttctggc

SEQ ID NO: 5650672 - DNA, 17 bp, Homo sapiens
tgctcaacttgcaaaat

SEQ ID NO: 5650673 - DNA, 14 bp, Homo sapiens
tgctcaagaaacaa

SEQ ID NO: 5650674 - DNA, 15 bp, Homo sapiens
tgctcaagaatgtag

SEQ ID NO: 5650675 - DNA, 23 bp, Homo sapiens
tgctcaagcagcaaaatccttac

SEQ ID NO: 5650676 - DNA, 19 bp, Homo sapiens
tgctcaaggaccaagagca

SEQ ID NO: 5650677 - DNA, 21 bp, Homo sapiens
tgctcaaggttactgggagtg

SEQ ID NO: 5650678 - DNA, 17 bp, Homo sapiens
tgctcaagttcaccagc

SEQ ID NO: 5650679 - DNA, 12 bp, Homo sapiens
tgctcaataaac

SEQ ID NO: 5650680 - DNA, 18 bp, Homo sapiens
tgctcaataaacacttgt

SEQ ID NO: 5650681 - DNA, 19 bp, Homo sapiens
tgctcaataaacacttgta

SEQ ID NO: 5650682 - DNA, 20 bp, Homo sapiens
tgctcaataaacttgtgcct

SEQ ID NO: 5650683 - DNA, 21 bp, Homo sapiens
tgctcaataaacttgtgcctc

SEQ ID NO: 5650684 - DNA, 18 bp, Homo sapiens
tgctctgatgcatcagaa

SEQ ID NO: 5650685 - DNA, 17 bp, Homo sapiens
tgctctgcagcccacag

SEQ ID NO: 5650686 - DNA, 23 bp, Homo sapiens
tgctctgcaggcagccttgccca

SEQ ID NO: 5650687 - DNA, 19 bp, Homo sapiens
tgctctgcaggctggggag

SEQ ID NO: 5650688 - DNA, 23 bp, Homo sapiens
tgctctgcaggctggggaggtgc

SEQ ID NO: 5650689 - DNA, 18 bp, Homo sapiens
tgctctgcatgttacata

SEQ ID NO: 5650690 - DNA, 12 bp, Homo sapiens
tgctctgccact

SEQ ID NO: 5650691 - DNA, 14 bp, Homo sapiens
tgctctgccactgg

SEQ ID NO: 5650692 - DNA, 11 bp, Homo sapiens
tgctctgccat

SEQ ID NO: 5650693 - DNA, 14 bp, Homo sapiens
tgctctgccatctt

SEQ ID NO: 5650694 - DNA, 14 bp, Homo sapiens
tgctctgcccactg

SEQ ID NO: 5650695 - DNA, 13 bp, Homo sapiens
tgctctgcccaga

SEQ ID NO: 5650696 - DNA, 14 bp, Homo sapiens
tgctctgcccatgc

SEQ ID NO: 5650697 - DNA, 17 bp, Homo sapiens
tgctctgccccaagccc

SEQ ID NO: 5650698 - DNA, 22 bp, Homo sapiens
tgctctgcccccaactcccgga

SEQ ID NO: 5650699 - DNA, 14 bp, Homo sapiens
tgctctgccccttg

SEQ ID NO: 5650700 - DNA, 20 bp, Homo sapiens
tgctctgccccttgggcatc

SEQ ID NO: 5650701 - DNA, 12 bp, Homo sapiens
tgctctgccctt

SEQ ID NO: 5650702 - DNA, 13 bp, Homo sapiens
tgctctgcctcag

SEQ ID NO: 5650703 - DNA, 17 bp, Homo sapiens
tgctctgcctcagacgt

SEQ ID NO: 5650704 - DNA, 20 bp, Homo sapiens
tgctctgcctctaactccct

SEQ ID NO: 5650705 - DNA, 12 bp, Homo sapiens
tgctctgcctgg

SEQ ID NO: 5650706 - DNA, 14 bp, Homo sapiens
tgctctgcctggag

SEQ ID NO: 5650707 - DNA, 16 bp, Homo sapiens
tgctctgctctaccat

SEQ ID NO: 5650708 - DNA, 16 bp, Homo sapiens
tgctctgcttgacaac

SEQ ID NO: 5650709 - DNA, 20 bp, Homo sapiens
tgctctgcttttcctgtctg

SEQ ID NO: 5650710 - DNA, 20 bp, Homo sapiens
tgctctggaaaacctgaggc

SEQ ID NO: 5650711 - DNA, 23 bp, Homo sapiens
tgctctggaaaatgtgacccaga

SEQ ID NO: 5650712 - DNA, 19 bp, Homo sapiens
tgctctggaagcctgctga

SEQ ID NO: 5650713 - DNA, 15 bp, Homo sapiens
tgctctggacacttg

SEQ ID NO: 5650714 - DNA, 17 bp, Homo sapiens
tgctctggacaggcatg

SEQ ID NO: 5650715 - DNA, 13 bp, Homo sapiens
tgctctggagcag

SEQ ID NO: 5650716 - DNA, 17 bp, Homo sapiens
tgctctggagcagccaa

SEQ ID NO: 5650717 - DNA, 22 bp, Homo sapiens
tgctctggaggaagttctccag

SEQ ID NO: 5650718 - DNA, 18 bp, Homo sapiens
tgctctggcggcttcctg

SEQ ID NO: 5650719 - DNA, 21 bp, Homo sapiens
tgctctggcggcttcctgtcc

SEQ ID NO: 5650720 - DNA, 23 bp, Homo sapiens
tgctctggcggcttcctgtccac

SEQ ID NO: 5650721 - DNA, 19 bp, Homo sapiens
tgctctggctggagaggaa

SEQ ID NO: 5650722 - DNA, 11 bp, Homo sapiens
tgctctggctt

SEQ ID NO: 5650723 - DNA, 20 bp, Homo sapiens
tgctctggcttgccccagga

SEQ ID NO: 5650724 - DNA, 17 bp, Homo sapiens
tgctctgggaaggggct

SEQ ID NO: 5650725 - DNA, 16 bp, Homo sapiens
tgctctgggagactta

SEQ ID NO: 5650726 - DNA, 14 bp, Homo sapiens
tgctctggggattt

SEQ ID NO: 5650727 - DNA, 21 bp, Homo sapiens
tgctctggggatttctgggat

SEQ ID NO: 5650728 - DNA, 15 bp, Homo sapiens
tgctctggtctgacc

SEQ ID NO: 5650729 - DNA, 23 bp, Homo sapiens
tgctctggttgtttctgttccaa

SEQ ID NO: 5650730 - DNA, 12 bp, Homo sapiens
tgctctgtactg

SEQ ID NO: 5650731 - DNA, 14 bp, Homo sapiens
tgctctgtccagct

SEQ ID NO: 5650732 - DNA, 17 bp, Homo sapiens
tgctctgtccagctttc

SEQ ID NO: 5650733 - DNA, 13 bp, Homo sapiens
tgctctgtctccc

SEQ ID NO: 5650734 - DNA, 18 bp, Homo sapiens
tgctctgtctcccaggct

SEQ ID NO: 5650735 - DNA, 22 bp, Homo sapiens
tgctctgtgaactatcccctgc

SEQ ID NO: 5650736 - DNA, 16 bp, Homo sapiens
tgctctgtgagcccca

SEQ ID NO: 5650737 - DNA, 19 bp, Homo sapiens
tgctctgtgcccaccctcc

SEQ ID NO: 5650738 - DNA, 18 bp, Homo sapiens
tgctctgtgcctgggatc

SEQ ID NO: 5650739 - DNA, 18 bp, Homo sapiens
tgctctgtggccttggcc

SEQ ID NO: 5650740 - DNA, 21 bp, Homo sapiens
tgctctgtggccttggccctg

SEQ ID NO: 5650741 - DNA, 18 bp, Homo sapiens
tgctctgtgttcccagag

SEQ ID NO: 5650742 - DNA, 19 bp, Homo sapiens
tgctctgtgttcccagagg

SEQ ID NO: 5650743 - DNA, 20 bp, Homo sapiens
tgctctgtgttcccagaggc

SEQ ID NO: 5650744 - DNA, 20 bp, Homo sapiens
tgctctgttcctgtccagca

SEQ ID NO: 5650745 - DNA, 14 bp, Homo sapiens
tgctcttaaaatat

SEQ ID NO: 5650746 - DNA, 23 bp, Homo sapiens
tgctcttaagaaactatgaagat

SEQ ID NO: 5650747 - DNA, 15 bp, Homo sapiens
tgctcttaagcctaa

SEQ ID NO: 5650748 - DNA, 15 bp, Homo sapiens
tgctcttaagtacca

SEQ ID NO: 5650749 - DNA, 18 bp, Homo sapiens
tgctcttaagtaccagaa

SEQ ID NO: 5650750 - DNA, 18 bp, Homo sapiens
tgctcttacccacactac

SEQ ID NO: 5650751 - DNA, 21 bp, Homo sapiens
tgctcttacttcccccaccct

SEQ ID NO: 5650752 - DNA, 20 bp, Homo sapiens
tgctcttagattgggccatg

SEQ ID NO: 5650753 - DNA, 17 bp, Homo sapiens
tgctcttagtcccaagc

SEQ ID NO: 5650754 - DNA, 16 bp, Homo sapiens
tgctcttatccccagc

SEQ ID NO: 5650755 - DNA, 17 bp, Homo sapiens
tgctcttatccccagct

SEQ ID NO: 5650756 - DNA, 13 bp, Homo sapiens
tgctcttcagtgg

SEQ ID NO: 5650757 - DNA, 11 bp, Homo sapiens
tgctcttccca

SEQ ID NO: 5650758 - DNA, 13 bp, Homo sapiens
tgctcttcccact

SEQ ID NO: 5650759 - DNA, 15 bp, Homo sapiens
tgctcttcccactcc

SEQ ID NO: 5650760 - DNA, 17 bp, Homo sapiens
tgctcttcccactccag

SEQ ID NO: 5650761 - DNA, 18 bp, Homo sapiens
tgctcttcccactccagc

SEQ ID NO: 5650762 - DNA, 19 bp, Homo sapiens
tgctcttcccactccagct

SEQ ID NO: 5650763 - DNA, 13 bp, Homo sapiens
tgctcttcctctg

SEQ ID NO: 5650764 - DNA, 14 bp, Homo sapiens
tgctcttcctctgg

SEQ ID NO: 5650765 - DNA, 19 bp, Homo sapiens
tgctcttctcattttttcc

SEQ ID NO: 5650766 - DNA, 22 bp, Homo sapiens
tgctcttctcattttttcctga

SEQ ID NO: 5650767 - DNA, 13 bp, Homo sapiens
tgctcttctcctt

SEQ ID NO: 5650768 - DNA, 14 bp, Homo sapiens
tgctcttctctccc

SEQ ID NO: 5650769 - DNA, 16 bp, Homo sapiens
tgctcttctctcccca

SEQ ID NO: 5650770 - DNA, 17 bp, Homo sapiens
tgctcttctctccccag

SEQ ID NO: 5650771 - DNA, 21 bp, Homo sapiens
tgctcttctctccccagcccc

SEQ ID NO: 5650772 - DNA, 22 bp, Homo sapiens
tgctcttctctccccagccccc

SEQ ID NO: 5650773 - DNA, 22 bp, Homo sapiens
tgctcttctcttacgctctctg

SEQ ID NO: 5650774 - DNA, 13 bp, Homo sapiens
tgctcttctgtgg

SEQ ID NO: 5650775 - DNA, 14 bp, Homo sapiens
tgctcttctttaga

SEQ ID NO: 5650776 - DNA, 17 bp, Homo sapiens
tgctcttctttctgaga

SEQ ID NO: 5650777 - DNA, 20 bp, Homo sapiens
tgctcttgaaatattcagaa

SEQ ID NO: 5650778 - DNA, 18 bp, Homo sapiens
tgctcttgaacctgtgct

SEQ ID NO: 5650779 - DNA, 19 bp, Homo sapiens
tgctcttgaacctgtgctc

SEQ ID NO: 5650780 - DNA, 20 bp, Homo sapiens
tgctcttgaccttgtagaga

SEQ ID NO: 5650781 - DNA, 13 bp, Homo sapiens
tgctcttgcatct

SEQ ID NO: 5650782 - DNA, 18 bp, Homo sapiens
tgctcttggaaagctgat

SEQ ID NO: 5650783 - DNA, 16 bp, Homo sapiens
tgctcttggctgaccc

SEQ ID NO: 5650784 - DNA, 18 bp, Homo sapiens
tgctcttggctgacccct

SEQ ID NO: 5650785 - DNA, 19 bp, Homo sapiens
tgctcttggctggacccag

SEQ ID NO: 5650786 - DNA, 17 bp, Homo sapiens
tgctcttgggcaatatt

SEQ ID NO: 5650787 - DNA, 19 bp, Homo sapiens
tgctcttgggcaatattct

SEQ ID NO: 5650788 - DNA, 24 bp, Homo sapiens
tgctcttgggcaatattctctgta

SEQ ID NO: 5650789 - DNA, 18 bp, Homo sapiens
tgctcttgggcctgggga

SEQ ID NO: 5650790 - DNA, 12 bp, Homo sapiens
tgctcttgggga

SEQ ID NO: 5650791 - DNA, 13 bp, Homo sapiens
tgctcttggggaa

SEQ ID NO: 5650792 - DNA, 14 bp, Homo sapiens
tgctcttgtagccc

SEQ ID NO: 5650793 - DNA, 21 bp, Homo sapiens
tgctcttgtcccacgtgtctt

SEQ ID NO: 5650794 - DNA, 17 bp, Homo sapiens
tgctcttgttctgttcc

SEQ ID NO: 5650795 - DNA, 18 bp, Homo sapiens
tgctcttgttctgttcct

SEQ ID NO: 5650796 - DNA, 17 bp, Homo sapiens
tgctcttgtttcactcc

SEQ ID NO: 5650797 - DNA, 24 bp, Homo sapiens
tgctcttgtttcactccaccatca

SEQ ID NO: 5650798 - DNA, 18 bp, Homo sapiens
tgctcttgtttttattaa

SEQ ID NO: 5650799 - DNA, 23 bp, Homo sapiens
tgctcttgtttttattaatttat

SEQ ID NO: 5650800 - DNA, 11 bp, Homo sapiens
tgctctttaaa

SEQ ID NO: 5650801 - DNA, 14 bp, Homo sapiens
tgctctttaaataa

SEQ ID NO: 5650802 - DNA, 16 bp, Homo sapiens
tgctctttattgcaga

SEQ ID NO: 5650803 - DNA, 16 bp, Homo sapiens
tgctctttcaatgcag

SEQ ID NO: 5650804 - DNA, 15 bp, Homo sapiens
tgctctttcaccctg

SEQ ID NO: 5650805 - DNA, 23 bp, Homo sapiens
tgctctttcaccctgccaccctc

SEQ ID NO: 5650806 - DNA, 18 bp, Homo sapiens
tgctctttcatagtataa

SEQ ID NO: 5650807 - DNA, 20 bp, Homo sapiens
tgctctttcatagtataact

SEQ ID NO: 5650808 - DNA, 14 bp, Homo sapiens
tgctctttccactt

SEQ ID NO: 5650809 - DNA, 23 bp, Homo sapiens
tgctctttccacttgccctgtgt

SEQ ID NO: 5650810 - DNA, 16 bp, Homo sapiens
tgctctttcccaccca

SEQ ID NO: 5650811 - DNA, 14 bp, Homo sapiens
tgctctttcccttt

SEQ ID NO: 5650812 - DNA, 15 bp, Homo sapiens
tgctctttccctttt

SEQ ID NO: 5650813 - DNA, 17 bp, Homo sapiens
tgctctttcccttttct

SEQ ID NO: 5650814 - DNA, 21 bp, Homo sapiens
tgctctttcccttttctgttt

SEQ ID NO: 5650815 - DNA, 23 bp, Homo sapiens
tgctctttcccttttctgtttag

SEQ ID NO: 5650816 - DNA, 16 bp, Homo sapiens
tgctctttcctgccct

SEQ ID NO: 5650817 - DNA, 15 bp, Homo sapiens
tgctctttctctgag

SEQ ID NO: 5650818 - DNA, 23 bp, Homo sapiens
tgctctttctctgagaaccaaaa

SEQ ID NO: 5650819 - DNA, 22 bp, Homo sapiens
tgctctttcttggattggacag

SEQ ID NO: 5650820 - DNA, 18 bp, Homo sapiens
tgctctttgacaactaaa

SEQ ID NO: 5650821 - DNA, 20 bp, Homo sapiens
tgctctttgacaactaaaat

SEQ ID NO: 5650822 - DNA, 22 bp, Homo sapiens
tgctctttgtagctaacagtga

SEQ ID NO: 5650823 - DNA, 16 bp, Homo sapiens
tgctctttgtggcagt

SEQ ID NO: 5650824 - DNA, 18 bp, Homo sapiens
tgctctttgttttgtgtc

SEQ ID NO: 5650825 - DNA, 15 bp, Homo sapiens
tgctcttttaaaata

SEQ ID NO: 5650826 - DNA, 16 bp, Homo sapiens
tgctcttttaagcagt

SEQ ID NO: 5650827 - DNA, 13 bp, Homo sapiens
tgctcttttacta

SEQ ID NO: 5650828 - DNA, 14 bp, Homo sapiens
tgctcttttcccag

SEQ ID NO: 5650829 - DNA, 14 bp, Homo sapiens
tgctcttttcctgg

SEQ ID NO: 5650830 - DNA, 15 bp, Homo sapiens
tgctcttttctcctc

SEQ ID NO: 5650831 - DNA, 21 bp, Homo sapiens
tgctcttttctcctcactgta

SEQ ID NO: 5650832 - DNA, 23 bp, Homo sapiens
tgctcttttctcctcactgtatc

SEQ ID NO: 5650833 - DNA, 14 bp, Homo sapiens
tgctcttttgtgat

SEQ ID NO: 5650834 - DNA, 22 bp, Homo sapiens
tgctcttttttactcattgaaa

SEQ ID NO: 5650835 - DNA, 14 bp, Homo sapiens
tgctcttttttctc

SEQ ID NO: 5650836 - DNA, 16 bp, Homo sapiens
tgctctttttttaaaa

SEQ ID NO: 5650837 - DNA, 16 bp, Homo sapiens
tgctgaaaatgtcctt

SEQ ID NO: 5650838 - DNA, 21 bp, Homo sapiens
tgctgaaaatgtccttgtgat

SEQ ID NO: 5650839 - DNA, 13 bp, Homo sapiens
tgctgaaactgcc

SEQ ID NO: 5650840 - DNA, 13 bp, Homo sapiens
tgctgaaagactc

SEQ ID NO: 5650841 - DNA, 22 bp, Homo sapiens
tgctgaaagagaaaagaggggt

SEQ ID NO: 5650842 - DNA, 15 bp, Homo sapiens
tgctgaaagccaagg

SEQ ID NO: 5650843 - DNA, 20 bp, Homo sapiens
tgctgaaagcccaagtaggg

SEQ ID NO: 5650844 - DNA, 15 bp, Homo sapiens
tgctgaaataaacta

SEQ ID NO: 5650845 - DNA, 17 bp, Homo sapiens
tgctgaaatttggaaag

SEQ ID NO: 5650846 - DNA, 15 bp, Homo sapiens
tgctgaacaaaaaat

SEQ ID NO: 5650847 - DNA, 20 bp, Homo sapiens
tgctgaacaaaaaataaaaa

SEQ ID NO: 5650848 - DNA, 13 bp, Homo sapiens
tgctgaacacaca

SEQ ID NO: 5650849 - DNA, 15 bp, Homo sapiens
tgctgaacacacaca

SEQ ID NO: 5650850 - DNA, 15 bp, Homo sapiens
tgctgaacacagtgt

SEQ ID NO: 5650851 - DNA, 20 bp, Homo sapiens
tgctgaacacagtgtctgtt

SEQ ID NO: 5650852 - DNA, 14 bp, Homo sapiens
tgctgaacagtgga

SEQ ID NO: 5650853 - DNA, 19 bp, Homo sapiens
tgctgaacattgcatataa

SEQ ID NO: 5650854 - DNA, 18 bp, Homo sapiens
tgctgaacattgttctga

SEQ ID NO: 5650855 - DNA, 20 bp, Homo sapiens
tgctgaacgcagaagaaagg

SEQ ID NO: 5650856 - DNA, 19 bp, Homo sapiens
tgctgaactcagcacattc

SEQ ID NO: 5650857 - DNA, 20 bp, Homo sapiens
tgctgaactcagcacattcg

SEQ ID NO: 5650858 - DNA, 20 bp, Homo sapiens
tgctgaactcttaggcacat

SEQ ID NO: 5650859 - DNA, 17 bp, Homo sapiens
tgctgaactgtgcatca

SEQ ID NO: 5650860 - DNA, 17 bp, Homo sapiens
tgctgaagacatgtttc

SEQ ID NO: 5650861 - DNA, 14 bp, Homo sapiens
tgctgaagatgcct

SEQ ID NO: 5650862 - DNA, 20 bp, Homo sapiens
tgctggccagcaccctctcc

SEQ ID NO: 5650863 - DNA, 18 bp, Homo sapiens
tgctggccagcctggggc

SEQ ID NO: 5650864 - DNA, 22 bp, Homo sapiens
tgctggccatgaatctctgcct

SEQ ID NO: 5650865 - DNA, 17 bp, Homo sapiens
tgctggcccagggccca

SEQ ID NO: 5650866 - DNA, 18 bp, Homo sapiens
tgctggcccagggcccag

SEQ ID NO: 5650867 - DNA, 19 bp, Homo sapiens
tgctggcccagggcccaga

SEQ ID NO: 5650868 - DNA, 21 bp, Homo sapiens
tgctggcccagggcccagagc

SEQ ID NO: 5650869 - DNA, 23 bp, Homo sapiens
tgctggcccagggcccagagccc

SEQ ID NO: 5650870 - DNA, 13 bp, Homo sapiens
tgctggccccagc

SEQ ID NO: 5650871 - DNA, 16 bp, Homo sapiens
tgctggccccagccct

SEQ ID NO: 5650872 - DNA, 11 bp, Homo sapiens
tgctggccccc

SEQ ID NO: 5650873 - DNA, 15 bp, Homo sapiens
tgctggcccctcacc

SEQ ID NO: 5650874 - DNA, 14 bp, Homo sapiens
tgctggccctgcct

SEQ ID NO: 5650875 - DNA, 19 bp, Homo sapiens
tgctggccctgcgctgcct

SEQ ID NO: 5650876 - DNA, 15 bp, Homo sapiens
tgctggccgcctcac

SEQ ID NO: 5650877 - DNA, 18 bp, Homo sapiens
tgctggccgggcacagct

SEQ ID NO: 5650878 - DNA, 16 bp, Homo sapiens
tgctggcctcaggctg

SEQ ID NO: 5650879 - DNA, 16 bp, Homo sapiens
tgctggcctctgcgag

SEQ ID NO: 5650880 - DNA, 20 bp, Homo sapiens
tgctggcctcttggcacctg

SEQ ID NO: 5650881 - DNA, 22 bp, Homo sapiens
tgctggcctcttggcacctgcc

SEQ ID NO: 5650882 - DNA, 20 bp, Homo sapiens
tgctggcctgcgcctgcacc

SEQ ID NO: 5650883 - DNA, 12 bp, Homo sapiens
tgctggcctgct

SEQ ID NO: 5650884 - DNA, 14 bp, Homo sapiens
tgctggcctgctct

SEQ ID NO: 5650885 - DNA, 12 bp, Homo sapiens
tgctggcctgga

SEQ ID NO: 5650886 - DNA, 14 bp, Homo sapiens
tgctggcctggatc

SEQ ID NO: 5650887 - DNA, 13 bp, Homo sapiens
tgctggcctggcc

SEQ ID NO: 5650888 - DNA, 20 bp, Homo sapiens
tgctggcctggcccttgagt

SEQ ID NO: 5650889 - DNA, 20 bp, Homo sapiens
tgctggcctgtggcaggcct

SEQ ID NO: 5650890 - DNA, 17 bp, Homo sapiens
tgctggcgacactcagg

SEQ ID NO: 5650891 - DNA, 19 bp, Homo sapiens
tgctggcgacactcagggc

SEQ ID NO: 5650892 - DNA, 23 bp, Homo sapiens
tgctggcgagtgaatgccagtgt

SEQ ID NO: 5650893 - DNA, 14 bp, Homo sapiens
tgctggcgcctctg

SEQ ID NO: 5650894 - DNA, 14 bp, Homo sapiens
tgctggctctgaga

SEQ ID NO: 5650895 - DNA, 15 bp, Homo sapiens
tgctggctctgagaa

SEQ ID NO: 5650896 - DNA, 13 bp, Homo sapiens
tgctggctctgct

SEQ ID NO: 5650897 - DNA, 23 bp, Homo sapiens
tgctggctgaagaggaccagagg

SEQ ID NO: 5650898 - DNA, 23 bp, Homo sapiens
tgctggctgatgggtggacctgt

SEQ ID NO: 5650899 - DNA, 13 bp, Homo sapiens
tgctggctgccca

SEQ ID NO: 5650900 - DNA, 14 bp, Homo sapiens
tgctggctgcccag

SEQ ID NO: 5650901 - DNA, 13 bp, Homo sapiens
tgctggctgcctt

SEQ ID NO: 5650902 - DNA, 15 bp, Homo sapiens
tgctggctgccttag

SEQ ID NO: 5650903 - DNA, 13 bp, Homo sapiens
tgctggctgctgg

SEQ ID NO: 5650904 - DNA, 16 bp, Homo sapiens
tgctggctgctggccc

SEQ ID NO: 5650905 - DNA, 10 bp, Homo sapiens
tgctggctgg

SEQ ID NO: 5650906 - DNA, 11 bp, Homo sapiens
tgctggctggg

SEQ ID NO: 5650907 - DNA, 14 bp, Homo sapiens
tgctggctggggcc

SEQ ID NO: 5650908 - DNA, 14 bp, Homo sapiens
tgctggctgtgaaa

SEQ ID NO: 5650909 - DNA, 20 bp, Homo sapiens
tgctggctttcttttctcta

SEQ ID NO: 5650910 - DNA, 14 bp, Homo sapiens
tgctggctttttgt

SEQ ID NO: 5650911 - DNA, 16 bp, Homo sapiens
tgctgggaacacagcc

SEQ ID NO: 5650912 - DNA, 18 bp, Homo sapiens
tgctgggaacacagccag

SEQ ID NO: 5650913 - DNA, 21 bp, Homo sapiens
tgctgggaaccccgcagcccg

SEQ ID NO: 5650914 - DNA, 23 bp, Homo sapiens
tgctgggaaccccgcagcccgtg

SEQ ID NO: 5650915 - DNA, 14 bp, Homo sapiens
tgctgggaagtggc

SEQ ID NO: 5650916 - DNA, 13 bp, Homo sapiens
tgctgggacagct

SEQ ID NO: 5650917 - DNA, 15 bp, Homo sapiens
tgctgggaccagagc

SEQ ID NO: 5650918 - DNA, 16 bp, Homo sapiens
tgctgggaccagagcc

SEQ ID NO: 5650919 - DNA, 19 bp, Homo sapiens
tgctgggaccagagccaga

SEQ ID NO: 5650920 - DNA, 16 bp, Homo sapiens
tgctgggacccacctc

SEQ ID NO: 5650921 - DNA, 21 bp, Homo sapiens
tgctgggacccacctccccct

SEQ ID NO: 5650922 - DNA, 21 bp, Homo sapiens
tgctgggacgatcgcccaggc

SEQ ID NO: 5650923 - DNA, 20 bp, Homo sapiens
tgctgggactgagccagtcc

SEQ ID NO: 5650924 - DNA, 17 bp, Homo sapiens
tgctgggactggccagg

SEQ ID NO: 5650925 - DNA, 22 bp, Homo sapiens
tgctgggacttgaacaaagaca

SEQ ID NO: 5650926 - DNA, 22 bp, Homo sapiens
tgctgggagatgctctctgagg

SEQ ID NO: 5650927 - DNA, 14 bp, Homo sapiens
tgctgggagcagaa

SEQ ID NO: 5650928 - DNA, 15 bp, Homo sapiens
tgctgggagctccac

SEQ ID NO: 5650929 - DNA, 17 bp, Homo sapiens
tgctgggagctccactc

SEQ ID NO: 5650930 - DNA, 22 bp, Homo sapiens
tgctgggagctccactctgctt

SEQ ID NO: 5650931 - DNA, 14 bp, Homo sapiens
tgctgggagctgaa

SEQ ID NO: 5650932 - DNA, 13 bp, Homo sapiens
tgctgggagggct

SEQ ID NO: 5650933 - DNA, 20 bp, Homo sapiens
tgctgggaggtcccagggcc

SEQ ID NO: 5650934 - DNA, 13 bp, Homo sapiens
tgctgggatagcc

SEQ ID NO: 5650935 - DNA, 20 bp, Homo sapiens
tgctgggatggtgggcttca

SEQ ID NO: 5650936 - DNA, 23 bp, Homo sapiens
tgctgggattaaggcgtgagcca

SEQ ID NO: 5650937 - DNA, 21 bp, Homo sapiens
tgctgggattacaagcgtgag

SEQ ID NO: 5650938 - DNA, 11 bp, Homo sapiens
tgctgggcagc

SEQ ID NO: 5650939 - DNA, 12 bp, Homo sapiens
tgctgggcagcc

SEQ ID NO: 5650940 - DNA, 14 bp, Homo sapiens
tgctgggcagcccg

SEQ ID NO: 5650941 - DNA, 13 bp, Homo sapiens
tgctgggccaggg

SEQ ID NO: 5650942 - DNA, 18 bp, Homo sapiens
tgctgggccagggaaaca

SEQ ID NO: 5650943 - DNA, 15 bp, Homo sapiens
tgctgggccagtggc

SEQ ID NO: 5650944 - DNA, 16 bp, Homo sapiens
tgctgggccagtggca

SEQ ID NO: 5650945 - DNA, 17 bp, Homo sapiens
tgctgggccagtggcac

SEQ ID NO: 5650946 - DNA, 18 bp, Homo sapiens
tgctgggccagtggcact

SEQ ID NO: 5650947 - DNA, 19 bp, Homo sapiens
tgctgggccagtggcactc

SEQ ID NO: 5650948 - DNA, 13 bp, Homo sapiens
tgctgggcccagc

SEQ ID NO: 5650949 - DNA, 23 bp, Homo sapiens
tgctgggcccagccggggtgggg

SEQ ID NO: 5650950 - DNA, 18 bp, Homo sapiens
tgctgggcccccagcctg

SEQ ID NO: 5650951 - DNA, 19 bp, Homo sapiens
tgctgggcccccagcctgg

SEQ ID NO: 5650952 - DNA, 14 bp, Homo sapiens
tgctgggcctgggg

SEQ ID NO: 5650953 - DNA, 14 bp, Homo sapiens
tgctgggcggctgt

SEQ ID NO: 5650954 - DNA, 16 bp, Homo sapiens
tgctgggcggctgtgc

SEQ ID NO: 5650955 - DNA, 18 bp, Homo sapiens
tgctgggcgtctgttctt

SEQ ID NO: 5650956 - DNA, 19 bp, Homo sapiens
tgctgggcgtctgttcttt

SEQ ID NO: 5650957 - DNA, 21 bp, Homo sapiens
tgctgggctacaaaccaggag

SEQ ID NO: 5650958 - DNA, 22 bp, Homo sapiens
tgctgggctacaaaccaggagc

SEQ ID NO: 5650959 - DNA, 17 bp, Homo sapiens
tgctgggctctccacct

SEQ ID NO: 5650960 - DNA, 18 bp, Homo sapiens
tgctgggctctccacctc

SEQ ID NO: 5650961 - DNA, 13 bp, Homo sapiens
tgctgggctctgc

SEQ ID NO: 5650962 - DNA, 19 bp, Homo sapiens
tgctgggctgacggtgcag

SEQ ID NO: 5650963 - DNA, 15 bp, Homo sapiens
tgctgggctggactg

SEQ ID NO: 5650964 - DNA, 21 bp, Homo sapiens
tgctgggctggcggccatccc

SEQ ID NO: 5650965 - DNA, 12 bp, Homo sapiens
tgctgggctggg

SEQ ID NO: 5650966 - DNA, 13 bp, Homo sapiens
tgctgggctgggc

SEQ ID NO: 5650967 - DNA, 14 bp, Homo sapiens
tgctgggctgggcc

SEQ ID NO: 5650968 - DNA, 14 bp, Homo sapiens
tgctgggctgggtg

SEQ ID NO: 5650969 - DNA, 17 bp, Homo sapiens
tgctggggaagaacagc

SEQ ID NO: 5650970 - DNA, 17 bp, Homo sapiens
tgctggggaagacagtg

SEQ ID NO: 5650971 - DNA, 23 bp, Homo sapiens
tgctggggcagggcccagggagg

SEQ ID NO: 5650972 - DNA, 14 bp, Homo sapiens
tgctggggcagggg

SEQ ID NO: 5650973 - DNA, 18 bp, Homo sapiens
tgctggggcatgtgtgcc

SEQ ID NO: 5650974 - DNA, 14 bp, Homo sapiens
tgctggggccaggc

SEQ ID NO: 5650975 - DNA, 23 bp, Homo sapiens
tgctggggccgccacggcctggc

SEQ ID NO: 5650976 - DNA, 20 bp, Homo sapiens
tgctggggctcacggggcct

SEQ ID NO: 5650977 - DNA, 15 bp, Homo sapiens
tgctgggggaatgag

SEQ ID NO: 5650978 - DNA, 20 bp, Homo sapiens
tgctgggggcaactggccat

SEQ ID NO: 5650979 - DNA, 22 bp, Homo sapiens
tgctgggggctccccttgccct

SEQ ID NO: 5650980 - DNA, 20 bp, Homo sapiens
tgctggggtctcaggtccag

SEQ ID NO: 5650981 - DNA, 12 bp, Homo sapiens
tgctgggtccca

SEQ ID NO: 5650982 - DNA, 20 bp, Homo sapiens
tgctgggtctgaggcccctg

SEQ ID NO: 5650983 - DNA, 22 bp, Homo sapiens
tgctgggtctgaggcccctgcc

SEQ ID NO: 5650984 - DNA, 23 bp, Homo sapiens
tgctgggtctgaggcccctgcct

SEQ ID NO: 5650985 - DNA, 21 bp, Homo sapiens
tgctgggtggcaggggggctg

SEQ ID NO: 5650986 - DNA, 14 bp, Homo sapiens
tgctgggtggccca

SEQ ID NO: 5650987 - DNA, 22 bp, Homo sapiens
tgctgggtggcccatcccccct

SEQ ID NO: 5650988 - DNA, 20 bp, Homo sapiens
tgctgggttcccactcccgg

SEQ ID NO: 5650989 - DNA, 21 bp, Homo sapiens
tgctgggttcccactcccggc

SEQ ID NO: 5650990 - DNA, 16 bp, Homo sapiens
tgctgggttctggggc

SEQ ID NO: 5650991 - DNA, 18 bp, Homo sapiens
tgctgggttggtgcacag

SEQ ID NO: 5650992 - DNA, 15 bp, Homo sapiens
tgctgggtttccaca

SEQ ID NO: 5650993 - DNA, 19 bp, Homo sapiens
tgctgggtttccacacagc

SEQ ID NO: 5650994 - DNA, 16 bp, Homo sapiens
tgctggtaacagtggc

SEQ ID NO: 5650995 - DNA, 18 bp, Homo sapiens
tgctggtagagaccccca

SEQ ID NO: 5650996 - DNA, 16 bp, Homo sapiens
tgctggtagctgaggg

SEQ ID NO: 5650997 - DNA, 17 bp, Homo sapiens
tgctggtagctgagggg

SEQ ID NO: 5650998 - DNA, 23 bp, Homo sapiens
tgctggtagctgaggggacgggc

SEQ ID NO: 5650999 - DNA, 14 bp, Homo sapiens
tgctggtatttcta

SEQ ID NO: 5651000 - DNA, 16 bp, Homo sapiens
tgctggtcactgccat

SEQ ID NO: 5651001 - DNA, 20 bp, Homo sapiens
tgctggtcagagagacctca

SEQ ID NO: 5651002 - DNA, 16 bp, Homo sapiens
tgctggtccgtgggac

SEQ ID NO: 5651003 - DNA, 22 bp, Homo sapiens
tgctggtcctaggtcctctgag

SEQ ID NO: 5651004 - DNA, 15 bp, Homo sapiens
tgctggtcctgcaca

SEQ ID NO: 5651005 - DNA, 20 bp, Homo sapiens
tgctggtcctgcacatgagt

SEQ ID NO: 5651006 - DNA, 20 bp, Homo sapiens
tgctggtctcatttgggggc

SEQ ID NO: 5651007 - DNA, 16 bp, Homo sapiens
tgctggtctctggctc

SEQ ID NO: 5651008 - DNA, 22 bp, Homo sapiens
tgctggtgaaagccctgctctt

SEQ ID NO: 5651009 - DNA, 18 bp, Homo sapiens
tgctggtgaacactgtga

SEQ ID NO: 5651010 - DNA, 19 bp, Homo sapiens
tgctggtgaacactgtgac

SEQ ID NO: 5651011 - DNA, 13 bp, Homo sapiens
tgctggtgcccac

SEQ ID NO: 5651012 - DNA, 13 bp, Homo sapiens
tgctggtggagga

SEQ ID NO: 5651013 - DNA, 23 bp, Homo sapiens
tgctggtggaggaagggctgggc

SEQ ID NO: 5651014 - DNA, 16 bp, Homo sapiens
tgctggtggctcttca

SEQ ID NO: 5651015 - DNA, 13 bp, Homo sapiens
tgctggtggctgg

SEQ ID NO: 5651016 - DNA, 15 bp, Homo sapiens
tgctggtggctggtg

SEQ ID NO: 5651017 - DNA, 22 bp, Homo sapiens
tgctggtgggcttgtcatagcc

SEQ ID NO: 5651018 - DNA, 18 bp, Homo sapiens
tgctggtgggtctgagct

SEQ ID NO: 5651019 - DNA, 19 bp, Homo sapiens
tgctggtgggtctgagctg

SEQ ID NO: 5651020 - DNA, 20 bp, Homo sapiens
tgctggtggtttttcagctc

SEQ ID NO: 5651021 - DNA, 22 bp, Homo sapiens
tgctggtgtatgtgtgaagtga

SEQ ID NO: 5651022 - DNA, 18 bp, Homo sapiens
tgctggtgtcattgctgt

SEQ ID NO: 5651023 - DNA, 22 bp, Homo sapiens
tgctggttccatgcctgctctc

SEQ ID NO: 5651024 - DNA, 20 bp, Homo sapiens
tgctggttcctgactggcaa

SEQ ID NO: 5651025 - DNA, 15 bp, Homo sapiens
tgctggttgctgtgt

SEQ ID NO: 5651026 - DNA, 13 bp, Homo sapiens
tgctggtttattt

SEQ ID NO: 5651027 - DNA, 15 bp, Homo sapiens
tgctggtttgggtaa

SEQ ID NO: 5651028 - DNA, 13 bp, Homo sapiens
tgctggttttagt

SEQ ID NO: 5651029 - DNA, 22 bp, Homo sapiens
tgctggttttcctaaatgcagt

SEQ ID NO: 5651030 - DNA, 18 bp, Homo sapiens
tgctggttttggtttcca

SEQ ID NO: 5651031 - DNA, 16 bp, Homo sapiens
tgctggtttttagatt

SEQ ID NO: 5651032 - DNA, 17 bp, Homo sapiens
tgctgtaaaatttgtgt

SEQ ID NO: 5651033 - DNA, 20 bp, Homo sapiens
tgctgtaaagcaaaatattt

SEQ ID NO: 5651034 - DNA, 16 bp, Homo sapiens
tgctgtaaataaaaat

SEQ ID NO: 5651035 - DNA, 15 bp, Homo sapiens
tgctgtaaatacagg

SEQ ID NO: 5651036 - DNA, 19 bp, Homo sapiens
tgctgtaaatatttcataa

SEQ ID NO: 5651037 - DNA, 22 bp, Homo sapiens
tgctgtaactaaaggaatctga

SEQ ID NO: 5651038 - DNA, 17 bp, Homo sapiens
tgctgtaactgctgagc

SEQ ID NO: 5651039 - DNA, 20 bp, Homo sapiens
tgctgtaactgctgagccac

SEQ ID NO: 5651040 - DNA, 17 bp, Homo sapiens
tgcttgtaggtatgtct

SEQ ID NO: 5651041 - DNA, 19 bp, Homo sapiens
tgcttgtaggtatgtctgt

SEQ ID NO: 5651042 - DNA, 23 bp, Homo sapiens
tgcttgtaggtatgtctgtgcca

SEQ ID NO: 5651043 - DNA, 14 bp, Homo sapiens
tgcttgtatagctt

SEQ ID NO: 5651044 - DNA, 12 bp, Homo sapiens
tgcttgtatgat

SEQ ID NO: 5651045 - DNA, 18 bp, Homo sapiens
tgcttgtattgtaaatgt

SEQ ID NO: 5651046 - DNA, 23 bp, Homo sapiens
tgcttgtcatccacacaacacca

SEQ ID NO: 5651047 - DNA, 21 bp, Homo sapiens
tgcttgtcatctgcatgtcta

SEQ ID NO: 5651048 - DNA, 17 bp, Homo sapiens
tgcttgtccctgcccag

SEQ ID NO: 5651049 - DNA, 15 bp, Homo sapiens
tgcttgtcctgctca

SEQ ID NO: 5651050 - DNA, 16 bp, Homo sapiens
tgcttgtcctgctcag

SEQ ID NO: 5651051 - DNA, 22 bp, Homo sapiens
tgcttgtcctgctctcttcagg

SEQ ID NO: 5651052 - DNA, 23 bp, Homo sapiens
tgcttgtcctgctctcttcagga

SEQ ID NO: 5651053 - DNA, 15 bp, Homo sapiens
tgcttgtcttctggt

SEQ ID NO: 5651054 - DNA, 20 bp, Homo sapiens
tgcttgtcttctggtacttt

SEQ ID NO: 5651055 - DNA, 13 bp, Homo sapiens
tgcttgtgacctt

SEQ ID NO: 5651056 - DNA, 18 bp, Homo sapiens
tgcttgtgaccttgactt

SEQ ID NO: 5651057 - DNA, 21 bp, Homo sapiens
tgcttgtgatttttgaacaat

SEQ ID NO: 5651058 - DNA, 20 bp, Homo sapiens
tgcttgtgcctcccttccca

SEQ ID NO: 5651059 - DNA, 20 bp, Homo sapiens
tgcttgtgctcatgtgtgtg

SEQ ID NO: 5651060 - DNA, 13 bp, Homo sapiens
tgcttgtgtgtat

SEQ ID NO: 5651061 - DNA, 18 bp, Homo sapiens
tgcttgtgttgggcccca

SEQ ID NO: 5651062 - DNA, 14 bp, Homo sapiens
tgcttgttgacaga

SEQ ID NO: 5651063 - DNA, 16 bp, Homo sapiens
tgcttgttgcatttcc

SEQ ID NO: 5651064 - DNA, 15 bp, Homo sapiens
tgcttgttgggattc

SEQ ID NO: 5651065 - DNA, 12 bp, Homo sapiens
tgcttgttgtca

SEQ ID NO: 5651066 - DNA, 17 bp, Homo sapiens
tgcttgttgtcaagtat

SEQ ID NO: 5651067 - DNA, 22 bp, Homo sapiens
tgcttgttgtcaagtataaagt

SEQ ID NO: 5651068 - DNA, 14 bp, Homo sapiens
tgcttgtttacagc

SEQ ID NO: 5651069 - DNA, 18 bp, Homo sapiens
tgcttgtttatgatattt

SEQ ID NO: 5651070 - DNA, 15 bp, Homo sapiens
tgcttgtttcttggt

SEQ ID NO: 5651071 - DNA, 15 bp, Homo sapiens
tgctttaaaaaattc

SEQ ID NO: 5651072 - DNA, 21 bp, Homo sapiens
tgctttaaaaaattctcttaa

SEQ ID NO: 5651073 - DNA, 13 bp, Homo sapiens
tgctttaaaaact

SEQ ID NO: 5651074 - DNA, 16 bp, Homo sapiens
tgctttaaaaactatt

SEQ ID NO: 5651075 - DNA, 15 bp, Homo sapiens
tgctttaaaacaaag

SEQ ID NO: 5651076 - DNA, 17 bp, Homo sapiens
tgctttaaagagtcctc

SEQ ID NO: 5651077 - DNA, 23 bp, Homo sapiens
tgctttaaagagtcctccttccc

SEQ ID NO: 5651078 - DNA, 13 bp, Homo sapiens
tgctttaaagata

SEQ ID NO: 5651079 - DNA, 21 bp, Homo sapiens
tgctttaaagggcctgcctgg

SEQ ID NO: 5651080 - DNA, 16 bp, Homo sapiens
tgctttaagaaactgt

SEQ ID NO: 5651081 - DNA, 22 bp, Homo sapiens
tgctttaagacagaattcactg

SEQ ID NO: 5651082 - DNA, 21 bp, Homo sapiens
tgctttaatataaatgcaaat

SEQ ID NO: 5651083 - DNA, 21 bp, Homo sapiens
tgctttaatatagctatcatt

SEQ ID NO: 5651084 - DNA, 20 bp, Homo sapiens
tgctttaatgagaatagaaa

SEQ ID NO: 5651085 - DNA, 20 bp, Homo sapiens
tgctttaatgagtgcacctg

SEQ ID NO: 5651086 - DNA, 23 bp, Homo sapiens
tgctttaattaattaagtatctg

SEQ ID NO: 5651087 - DNA, 15 bp, Homo sapiens
tgctttaattgtgaa

SEQ ID NO: 5651088 - DNA, 19 bp, Homo sapiens
tgctttaattgttaagata

SEQ ID NO: 5651089 - DNA, 17 bp, Homo sapiens
tgctttaattttagcaa

SEQ ID NO: 5651090 - DNA, 22 bp, Homo sapiens
tgctttacaggatcatgtaaat

SEQ ID NO: 5651091 - DNA, 20 bp, Homo sapiens
tgctttacatgctgtgctct

SEQ ID NO: 5651092 - DNA, 19 bp, Homo sapiens
tgctttaccaaacagcaaa

SEQ ID NO: 5651093 - DNA, 20 bp, Homo sapiens
tgctttacctttattaatga

SEQ ID NO: 5651094 - DNA, 21 bp, Homo sapiens
tgctttacctttattaatgaa

SEQ ID NO: 5651095 - DNA, 18 bp, Homo sapiens
tgctttaccttttcaggg

SEQ ID NO: 5651096 - DNA, 21 bp, Homo sapiens
tgctttaccttttcagggctg

SEQ ID NO: 5651097 - DNA, 22 bp, Homo sapiens
tgctttacttaaagttgatttt

SEQ ID NO: 5651098 - DNA, 16 bp, Homo sapiens
tgctttagaaaacatt

SEQ ID NO: 5651099 - DNA, 15 bp, Homo sapiens
tgctttagacttgaa

SEQ ID NO: 5651100 - DNA, 19 bp, Homo sapiens
tgctttagacttgaaaaga

SEQ ID NO: 5651101 - DNA, 21 bp, Homo sapiens
tgctttagacttgaaaagaga

SEQ ID NO: 5651102 - DNA, 23 bp, Homo sapiens
tgctttagcgattgattgatgta

SEQ ID NO: 5651103 - DNA, 13 bp, Homo sapiens
tgctttagcttga

SEQ ID NO: 5651104 - DNA, 23 bp, Homo sapiens
tgctttagtacatggagctcagg

SEQ ID NO: 5651105 - DNA, 18 bp, Homo sapiens
tgctttagtatgctggct

SEQ ID NO: 5651106 - DNA, 17 bp, Homo sapiens
tgctttataaaaaaaag

SEQ ID NO: 5651107 - DNA, 14 bp, Homo sapiens
tgctttataaataa

SEQ ID NO: 5651108 - DNA, 19 bp, Homo sapiens
tgctttatcagaagcaagg

SEQ ID NO: 5651109 - DNA, 17 bp, Homo sapiens
tgctttatccacattgt

SEQ ID NO: 5651110 - DNA, 14 bp, Homo sapiens
tgctttatccagca

SEQ ID NO: 5651111 - DNA, 20 bp, Homo sapiens
tgctttatcctcctgtcagc

SEQ ID NO: 5651112 - DNA, 15 bp, Homo sapiens
tgctttatgctgaaa

SEQ ID NO: 5651113 - DNA, 15 bp, Homo sapiens
tgctttattaatgtt

SEQ ID NO: 5651114 - DNA, 21 bp, Homo sapiens
tgctttattaatgttttcaaa

SEQ ID NO: 5651115 - DNA, 23 bp, Homo sapiens
tgctttattaatgttttcaaaag

SEQ ID NO: 5651116 - DNA, 14 bp, Homo sapiens
tgctttattccaga

SEQ ID NO: 5651117 - DNA, 18 bp, Homo sapiens
tgctttattgaattagaa

SEQ ID NO: 5651118 - DNA, 14 bp, Homo sapiens
tgctttatttatgg

SEQ ID NO: 5651119 - DNA, 15 bp, Homo sapiens
tgctttcaacttaaa

SEQ ID NO: 5651120 - DNA, 20 bp, Homo sapiens
tgctttcaacttaaatcact

SEQ ID NO: 5651121 - DNA, 23 bp, Homo sapiens
tgctttcaccagaatttctaaga

SEQ ID NO: 5651122 - DNA, 12 bp, Homo sapiens
tgctttcactct

SEQ ID NO: 5651123 - DNA, 17 bp, Homo sapiens
tgctttcactctttaga

SEQ ID NO: 5651124 - DNA, 20 bp, Homo sapiens
tgctttcagatactggattg

SEQ ID NO: 5651125 - DNA, 20 bp, Homo sapiens
tgctttcagattaaaattgt

SEQ ID NO: 5651126 - DNA, 13 bp, Homo sapiens
tgctttcagtgcc

SEQ ID NO: 5651127 - DNA, 12 bp, Homo sapiens
tgctttcatcca

SEQ ID NO: 5651128 - DNA, 13 bp, Homo sapiens
tgctttcatccag

SEQ ID NO: 5651129 - DNA, 19 bp, Homo sapiens
tgctttcatcttggtcaca

SEQ ID NO: 5651130 - DNA, 14 bp, Homo sapiens
tgctttcattatgt

SEQ ID NO: 5651131 - DNA, 20 bp, Homo sapiens
tgctttccaaaccttatctc

SEQ ID NO: 5651132 - DNA, 18 bp, Homo sapiens
tgctttccagcctgggca

SEQ ID NO: 5651133 - DNA, 18 bp, Homo sapiens
tgctttccattcgtgaaa

SEQ ID NO: 5651134 - DNA, 23 bp, Homo sapiens
tgctttcccaccagcatgtcact

SEQ ID NO: 5651135 - DNA, 21 bp, Homo sapiens
tgctttcccatatcttgcctt

SEQ ID NO: 5651136 - DNA, 20 bp, Homo sapiens
tgctttccccgggggaggaa

SEQ ID NO: 5651137 - DNA, 13 bp, Homo sapiens
tgctttcccctgt

SEQ ID NO: 5651138 - DNA, 15 bp, Homo sapiens
tgctttccctcccca

SEQ ID NO: 5651139 - DNA, 15 bp, Homo sapiens
tgctttccctgagga

SEQ ID NO: 5651140 - DNA, 19 bp, Homo sapiens
tgctttccctgaggaatga

SEQ ID NO: 5651141 - DNA, 21 bp, Homo sapiens
tgctttccgcgtggttctgcc

SEQ ID NO: 5651142 - DNA, 15 bp, Homo sapiens
tgctttcctatctag

SEQ ID NO: 5651143 - DNA, 22 bp, Homo sapiens
tgctttcctcttactttcagtt

SEQ ID NO: 5651144 - DNA, 15 bp, Homo sapiens
tgctttcctgcagca

SEQ ID NO: 5651145 - DNA, 17 bp, Homo sapiens
tgctttcctgcatctct

SEQ ID NO: 5651146 - DNA, 16 bp, Homo sapiens
tgctttcctgggcctt

SEQ ID NO: 5651147 - DNA, 12 bp, Homo sapiens
tgctttccttcg

SEQ ID NO: 5651148 - DNA, 12 bp, Homo sapiens
tgctttcctttc

SEQ ID NO: 5651149 - DNA, 19 bp, Homo sapiens
tgctttcgtgtaaattatg

SEQ ID NO: 5651150 - DNA, 18 bp, Homo sapiens
tgctttctactcattttt

SEQ ID NO: 5651151 - DNA, 15 bp, Homo sapiens
tgctttctatctaat

SEQ ID NO: 5651152 - DNA, 21 bp, Homo sapiens
tgctttctattatcatggtat

SEQ ID NO: 5651153 - DNA, 15 bp, Homo sapiens
tgctttctcaaaatt

SEQ ID NO: 5651154 - DNA, 12 bp, Homo sapiens
tgctttctcatg

SEQ ID NO: 5651155 - DNA, 22 bp, Homo sapiens
tgctttctccatttatttaaaa

SEQ ID NO: 5651156 - DNA, 15 bp, Homo sapiens
tgctttctcctttaa

SEQ ID NO: 5651157 - DNA, 17 bp, Homo sapiens
tgctttctctctcatgc

SEQ ID NO: 5651158 - DNA, 20 bp, Homo sapiens
tgctttctgaactcgcttct

SEQ ID NO: 5651159 - DNA, 14 bp, Homo sapiens
tgctttctgatcaa

SEQ ID NO: 5651160 - DNA, 19 bp, Homo sapiens
tgctttctgatgttgcctt

SEQ ID NO: 5651161 - DNA, 19 bp, Homo sapiens
tgctttctgctcagcttct

SEQ ID NO: 5651162 - DNA, 13 bp, Homo sapiens
tgctttctgtgaa

SEQ ID NO: 5651163 - DNA, 20 bp, Homo sapiens
tgctttctgtgaaagcctta

SEQ ID NO: 5651164 - DNA, 12 bp, Homo sapiens
tgctttctgtgg

SEQ ID NO: 5651165 - DNA, 15 bp, Homo sapiens
tgctttctgttcatc

SEQ ID NO: 5651166 - DNA, 17 bp, Homo sapiens
tgctttctgttcatctc

SEQ ID NO: 5651167 - DNA, 19 bp, Homo sapiens
tgctttctgttcatctctt

SEQ ID NO: 5651168 - DNA, 16 bp, Homo sapiens
tgctttctgttccaaa

SEQ ID NO: 5651169 - DNA, 17 bp, Homo sapiens
tgctttctgttccaaat

SEQ ID NO: 5651170 - DNA, 16 bp, Homo sapiens
tgctttctgtttctta

SEQ ID NO: 5651171 - DNA, 11 bp, Homo sapiens
tgctttcttac

SEQ ID NO: 5651172 - DNA, 16 bp, Homo sapiens
tgctttcttacctact

SEQ ID NO: 5651173 - DNA, 12 bp, Homo sapiens
tgctttcttcat

SEQ ID NO: 5651174 - DNA, 19 bp, Homo sapiens
tgctttcttctctgcctcc

SEQ ID NO: 5651175 - DNA, 21 bp, Homo sapiens
tgctttcttctctgcctcctc

SEQ ID NO: 5651176 - DNA, 15 bp, Homo sapiens
tgctttcttctttcc

SEQ ID NO: 5651177 - DNA, 17 bp, Homo sapiens
tgctttcttctttccag

SEQ ID NO: 5651178 - DNA, 17 bp, Homo sapiens
tgctttcttgccacaca

SEQ ID NO: 5651179 - DNA, 22 bp, Homo sapiens
tgctttctttcgtttgtttgtt

SEQ ID NO: 5651180 - DNA, 17 bp, Homo sapiens
tgctttctttgacctct

SEQ ID NO: 5651181 - DNA, 16 bp, Homo sapiens
tgctttctttgagttt

SEQ ID NO: 5651182 - DNA, 20 bp, Homo sapiens
tgctttctttggcctacatt

SEQ ID NO: 5651183 - DNA, 20 bp, Homo sapiens
tgctttcttttttaaaatca

SEQ ID NO: 5651184 - DNA, 18 bp, Homo sapiens
tgctttgaaaaagcctct

SEQ ID NO: 5651185 - DNA, 14 bp, Homo sapiens
tgctttgaaaaatc

SEQ ID NO: 5651186 - DNA, 21 bp, Homo sapiens
tgctttgaaaatatttgtcca

SEQ ID NO: 5651187 - DNA, 22 bp, Homo sapiens
tgctttgaaaatatttgtccaa

SEQ ID NO: 5651188 - DNA, 22 bp, Homo sapiens
tgctttgaaagccccagaaatc

SEQ ID NO: 5651189 - DNA, 15 bp, Homo sapiens
tgctttgaagcagtt

SEQ ID NO: 5651190 - DNA, 19 bp, Homo sapiens
tgctttgaagcagttgtgt

SEQ ID NO: 5651191 - DNA, 16 bp, Homo sapiens
tgctttgaagtagctc

SEQ ID NO: 5651192 - DNA, 13 bp, Homo sapiens
tgctttgaatgca

SEQ ID NO: 5651193 - DNA, 16 bp, Homo sapiens
tgctttgaatgcatgt

SEQ ID NO: 5651194 - DNA, 22 bp, Homo sapiens
tgctttgactcacctgttactt

SEQ ID NO: 5651195 - DNA, 15 bp, Homo sapiens
tgctttgagaagaat

SEQ ID NO: 5651196 - DNA, 19 bp, Homo sapiens
tgctttgagaccagaagaa

SEQ ID NO: 5651197 - DNA, 20 bp, Homo sapiens
tgctttgagaccagaagaaa

SEQ ID NO: 5651198 - DNA, 17 bp, Homo sapiens
tgctttgagacctttcc

SEQ ID NO: 5651199 - DNA, 23 bp, Homo sapiens
tgctttgagactcctcagcaccc

SEQ ID NO: 5651200 - DNA, 22 bp, Homo sapiens
tgctttgaggctcaccagaatt

SEQ ID NO: 5651201 - DNA, 15 bp, Homo sapiens
tgctttgataaaata

SEQ ID NO: 5651202 - DNA, 19 bp, Homo sapiens
tgctttgatttttgaagtt

SEQ ID NO: 5651203 - DNA, 14 bp, Homo sapiens
tgctttgcaaagac

SEQ ID NO: 5651204 - DNA, 16 bp, Homo sapiens
tgctttgcatctttgt

SEQ ID NO: 5651205 - DNA, 18 bp, Homo sapiens
tgctttgcattactgtcc

SEQ ID NO: 5651206 - DNA, 16 bp, Homo sapiens
tgctttgcattttctg

SEQ ID NO: 5651207 - DNA, 17 bp, Homo sapiens
tgctttgcattttctga

SEQ ID NO: 5651208 - DNA, 13 bp, Homo sapiens
tgctttgccaaaa

SEQ ID NO: 5651209 - DNA, 20 bp, Homo sapiens
tgctttgccaaaataccaga

SEQ ID NO: 5651210 - DNA, 17 bp, Homo sapiens
tgctttgccaagttgct

SEQ ID NO: 5651211 - DNA, 21 bp, Homo sapiens
tgctttgccaagttgctgtca

SEQ ID NO: 5651212 - DNA, 23 bp, Homo sapiens
tgctttgccaagttgctgtcact

SEQ ID NO: 5651213 - DNA, 14 bp, Homo sapiens
tgctttgccagagc

SEQ ID NO: 5651214 - DNA, 17 bp, Homo sapiens
tgctttgccagagcagg

SEQ ID NO: 5651215 - DNA, 13 bp, Homo sapiens
tgctttgcccagc

SEQ ID NO: 5651216 - DNA, 14 bp, Homo sapiens
tgctttgcccagca

SEQ ID NO: 5651217 - DNA, 21 bp, Homo sapiens
tggaagcatgtttattctgtt

SEQ ID NO: 5651218 - DNA, 16 bp, Homo sapiens
tggaagccagctttcc

SEQ ID NO: 5651219 - DNA, 12 bp, Homo sapiens
tggaagccaggt

SEQ ID NO: 5651220 - DNA, 18 bp, Homo sapiens
tggaagccaggtacagga

SEQ ID NO: 5651221 - DNA, 20 bp, Homo sapiens
tggaagccaggtacaggaga

SEQ ID NO: 5651222 - DNA, 22 bp, Homo sapiens
tggaagccaggtacaggagagg

SEQ ID NO: 5651223 - DNA, 22 bp, Homo sapiens
tggaagccccaacgggaaagga

SEQ ID NO: 5651224 - DNA, 16 bp, Homo sapiens
tggaagccctccttcc

SEQ ID NO: 5651225 - DNA, 17 bp, Homo sapiens
tggaagccctgtctgtt

SEQ ID NO: 5651226 - DNA, 13 bp, Homo sapiens
tggaagcctcaga

SEQ ID NO: 5651227 - DNA, 20 bp, Homo sapiens
tggaagcctgaactgaggcc

SEQ ID NO: 5651228 - DNA, 16 bp, Homo sapiens
tggaagcctgctgatt

SEQ ID NO: 5651229 - DNA, 19 bp, Homo sapiens
tggaagcctgctgatttct

SEQ ID NO: 5651230 - DNA, 16 bp, Homo sapiens
tggaagccttccccca

SEQ ID NO: 5651231 - DNA, 22 bp, Homo sapiens
tggaagccttcccccagcaagg

SEQ ID NO: 5651232 - DNA, 17 bp, Homo sapiens
tggaagctaatttgcat

SEQ ID NO: 5651233 - DNA, 16 bp, Homo sapiens
tggaagctaccagagc

SEQ ID NO: 5651234 - DNA, 14 bp, Homo sapiens
tggaagctagctcc

SEQ ID NO: 5651235 - DNA, 20 bp, Homo sapiens
tggaagctagctcccctcct

SEQ ID NO: 5651236 - DNA, 13 bp, Homo sapiens
tggaagctccgct

SEQ ID NO: 5651237 - DNA, 14 bp, Homo sapiens
tggaagctcttctt

SEQ ID NO: 5651238 - DNA, 14 bp, Homo sapiens
tggaagctgagcag

SEQ ID NO: 5651239 - DNA, 15 bp, Homo sapiens
tggaagctgagcagg

SEQ ID NO: 5651240 - DNA, 16 bp, Homo sapiens
tggaagctgagcaggc

SEQ ID NO: 5651241 - DNA, 19 bp, Homo sapiens
tggaagctgagcaggcccg

SEQ ID NO: 5651242 - DNA, 21 bp, Homo sapiens
tggaagctgattcccagagca

SEQ ID NO: 5651243 - DNA, 18 bp, Homo sapiens
tggaagctgccctgccca

SEQ ID NO: 5651244 - DNA, 18 bp, Homo sapiens
tggaagctgctgaggccc

SEQ ID NO: 5651245 - DNA, 14 bp, Homo sapiens
tggaagctggcagg

SEQ ID NO: 5651246 - DNA, 23 bp, Homo sapiens
tggaagctgtcaggctgggacag

SEQ ID NO: 5651247 - DNA, 15 bp, Homo sapiens
tggaagcttactctc

SEQ ID NO: 5651248 - DNA, 20 bp, Homo sapiens
tggaagcttctggtgacctt

SEQ ID NO: 5651249 - DNA, 14 bp, Homo sapiens
tggaagcttgttga

SEQ ID NO: 5651250 - DNA, 16 bp, Homo sapiens
tggaagcttgttgaaa

SEQ ID NO: 5651251 - DNA, 22 bp, Homo sapiens
tggaagcttgttgaaaacccag

SEQ ID NO: 5651252 - DNA, 20 bp, Homo sapiens
tggaagctttggttatgaaa

SEQ ID NO: 5651253 - DNA, 19 bp, Homo sapiens
tggaaggacctgctcccac

SEQ ID NO: 5651254 - DNA, 20 bp, Homo sapiens
tggaaggactgtggctgcag

SEQ ID NO: 5651255 - DNA, 22 bp, Homo sapiens
tggaaggagaggggaggtcact

SEQ ID NO: 5651256 - DNA, 19 bp, Homo sapiens
tggaaggagccagccagga

SEQ ID NO: 5651257 - DNA, 14 bp, Homo sapiens
tggaaggagcctgc

SEQ ID NO: 5651258 - DNA, 15 bp, Homo sapiens
tggaaggagggatgc

SEQ ID NO: 5651259 - DNA, 20 bp, Homo sapiens
tggaaggcaagattgtgtcc

SEQ ID NO: 5651260 - DNA, 14 bp, Homo sapiens
tggaaggcacccgc

SEQ ID NO: 5651261 - DNA, 16 bp, Homo sapiens
tggaaggcacccgccc

SEQ ID NO: 5651262 - DNA, 23 bp, Homo sapiens
tggaaggcagacagcaggcagcg

SEQ ID NO: 5651263 - DNA, 16 bp, Homo sapiens
tggaaggcagagaaat

SEQ ID NO: 5651264 - DNA, 17 bp, Homo sapiens
tggaaggcagagaaatc

SEQ ID NO: 5651265 - DNA, 14 bp, Homo sapiens
tggaaggcagggca

SEQ ID NO: 5651266 - DNA, 14 bp, Homo sapiens
tggaaggcatggcg

SEQ ID NO: 5651267 - DNA, 21 bp, Homo sapiens
tggaaggcccagcaccaccct

SEQ ID NO: 5651268 - DNA, 14 bp, Homo sapiens
tggaaggctggctg

SEQ ID NO: 5651269 - DNA, 22 bp, Homo sapiens
tggaaggctttattcttccaag

SEQ ID NO: 5651270 - DNA, 14 bp, Homo sapiens
tggaaggctttgcc

SEQ ID NO: 5651271 - DNA, 17 bp, Homo sapiens
tggaagggaagaaaagg

SEQ ID NO: 5651272 - DNA, 16 bp, Homo sapiens
tggaagggaccccaga

SEQ ID NO: 5651273 - DNA, 17 bp, Homo sapiens
tggaagggaccccagat

SEQ ID NO: 5651274 - DNA, 17 bp, Homo sapiens
tggaagggactcccagg

SEQ ID NO: 5651275 - DNA, 15 bp, Homo sapiens
tggaagggcaggagc

SEQ ID NO: 5651276 - DNA, 16 bp, Homo sapiens
tggaagggccaaggtc

SEQ ID NO: 5651277 - DNA, 19 bp, Homo sapiens
tggaagggccaatggagaa

SEQ ID NO: 5651278 - DNA, 22 bp, Homo sapiens
tggaagggccggcttctgcctg

SEQ ID NO: 5651279 - DNA, 20 bp, Homo sapiens
tggaagggcgctgagggcag

SEQ ID NO: 5651280 - DNA, 18 bp, Homo sapiens
tggaagggcgttctaggt

SEQ ID NO: 5651281 - DNA, 19 bp, Homo sapiens
tggaagggcgttctaggta

SEQ ID NO: 5651282 - DNA, 14 bp, Homo sapiens
tggaagggctgggt

SEQ ID NO: 5651283 - DNA, 23 bp, Homo sapiens
tggaaggggacacgtgacagccg

SEQ ID NO: 5651284 - DNA, 12 bp, Homo sapiens
tggaaggggcag

SEQ ID NO: 5651285 - DNA, 14 bp, Homo sapiens
tggaaggggcagca

SEQ ID NO: 5651286 - DNA, 15 bp, Homo sapiens
tggaaggggcagccc

SEQ ID NO: 5651287 - DNA, 17 bp, Homo sapiens
tggaaggggcagccctg

SEQ ID NO: 5651288 - DNA, 19 bp, Homo sapiens
tggaaggggcagccctgag

SEQ ID NO: 5651289 - DNA, 16 bp, Homo sapiens
tggaagggggagacag

SEQ ID NO: 5651290 - DNA, 18 bp, Homo sapiens
tggaagggggagacagga

SEQ ID NO: 5651291 - DNA, 21 bp, Homo sapiens
tggaagggggagacaggaagt

SEQ ID NO: 5651292 - DNA, 21 bp, Homo sapiens
tggaagggggaggagtcaggg

SEQ ID NO: 5651293 - DNA, 19 bp, Homo sapiens
tggaagggtctctctccag

SEQ ID NO: 5651294 - DNA, 16 bp, Homo sapiens
tggaaggtagagccca

SEQ ID NO: 5651295 - DNA, 21 bp, Homo sapiens
tggaaggtagagcccactgct

SEQ ID NO: 5651296 - DNA, 13 bp, Homo sapiens
tggaaggtattta

SEQ ID NO: 5651297 - DNA, 17 bp, Homo sapiens
tggaaggtatttaatag

SEQ ID NO: 5651298 - DNA, 21 bp, Homo sapiens
tggaaggtatttttttaaatt

SEQ ID NO: 5651299 - DNA, 22 bp, Homo sapiens
tggaaggtccgagtctttttag

SEQ ID NO: 5651300 - DNA, 23 bp, Homo sapiens
tggaaggtgaggcgttctcctgc

SEQ ID NO: 5651301 - DNA, 16 bp, Homo sapiens
tggaaggtgccagaag

SEQ ID NO: 5651302 - DNA, 13 bp, Homo sapiens
tggaaggtgggga

SEQ ID NO: 5651303 - DNA, 16 bp, Homo sapiens
tggaaggttcaggggc

SEQ ID NO: 5651304 - DNA, 18 bp, Homo sapiens
tggaaggttttaacattg

SEQ ID NO: 5651305 - DNA, 22 bp, Homo sapiens
tggaagtaaaggcattccacag

SEQ ID NO: 5651306 - DNA, 20 bp, Homo sapiens
tggaagtaattaaggtacat

SEQ ID NO: 5651307 - DNA, 22 bp, Homo sapiens
tggaagtaattaaggtacatca

SEQ ID NO: 5651308 - DNA, 20 bp, Homo sapiens
tggaagtactataatttacc

SEQ ID NO: 5651309 - DNA, 16 bp, Homo sapiens
tggaagtacttggccc

SEQ ID NO: 5651310 - DNA, 14 bp, Homo sapiens
tggaagtagtggag

SEQ ID NO: 5651311 - DNA, 17 bp, Homo sapiens
tggaagtagttctatga

SEQ ID NO: 5651312 - DNA, 13 bp, Homo sapiens
tggaagtatacct

SEQ ID NO: 5651313 - DNA, 21 bp, Homo sapiens
tggaagtcaaataaatgtttc

SEQ ID NO: 5651314 - DNA, 16 bp, Homo sapiens
tggaagtcacctttct

SEQ ID NO: 5651315 - DNA, 14 bp, Homo sapiens
tggaagtccctcag

SEQ ID NO: 5651316 - DNA, 15 bp, Homo sapiens
tggaagtccctcaga

SEQ ID NO: 5651317 - DNA, 14 bp, Homo sapiens
tggaagtctacctg

SEQ ID NO: 5651318 - DNA, 12 bp, Homo sapiens
tggaagtctcaa

SEQ ID NO: 5651319 - DNA, 13 bp, Homo sapiens
tggaagtctgcgc

SEQ ID NO: 5651320 - DNA, 14 bp, Homo sapiens
tggaagtctgcgcc

SEQ ID NO: 5651321 - DNA, 21 bp, Homo sapiens
tggaagtgagggtcagagagg

SEQ ID NO: 5651322 - DNA, 14 bp, Homo sapiens
tggaagtgctaatt

SEQ ID NO: 5651323 - DNA, 14 bp, Homo sapiens
tggaagtgggccag

SEQ ID NO: 5651324 - DNA, 18 bp, Homo sapiens
tggaagtgggccagtcct

SEQ ID NO: 5651325 - DNA, 21 bp, Homo sapiens
tggaagtgggccagtcctggt

SEQ ID NO: 5651326 - DNA, 16 bp, Homo sapiens
tggaagtgtatttatt

SEQ ID NO: 5651327 - DNA, 17 bp, Homo sapiens
tggaagtgtctgccagc

SEQ ID NO: 5651328 - DNA, 15 bp, Homo sapiens
tggaagtgtgacttc

SEQ ID NO: 5651329 - DNA, 17 bp, Homo sapiens
tggaagtgtgacttctt

SEQ ID NO: 5651330 - DNA, 23 bp, Homo sapiens
tggaagtgtgggtctgtgtgtgt

SEQ ID NO: 5651331 - DNA, 20 bp, Homo sapiens
tggaagtgtgtggaaggcag

SEQ ID NO: 5651332 - DNA, 13 bp, Homo sapiens
tggaagtgttcag

SEQ ID NO: 5651333 - DNA, 15 bp, Homo sapiens
tggaagtgttcctgt

SEQ ID NO: 5651334 - DNA, 18 bp, Homo sapiens
tggaagtgttcctgtctc

SEQ ID NO: 5651335 - DNA, 22 bp, Homo sapiens
tggaagtgtttcaaaaaattat

SEQ ID NO: 5651336 - DNA, 18 bp, Homo sapiens
tggaagttaaagtgaggc

SEQ ID NO: 5651337 - DNA, 13 bp, Homo sapiens
tggaagttattta

SEQ ID NO: 5651338 - DNA, 23 bp, Homo sapiens
tggaagttcatacctaagtactg

SEQ ID NO: 5651339 - DNA, 14 bp, Homo sapiens
tggaagttcttcaa

SEQ ID NO: 5651340 - DNA, 16 bp, Homo sapiens
tggaagttcttcaaga

SEQ ID NO: 5651341 - DNA, 18 bp, Homo sapiens
tggaagttgcatggcatc

SEQ ID NO: 5651342 - DNA, 23 bp, Homo sapiens
tggaagttgttgctatacatgtt

SEQ ID NO: 5651343 - DNA, 14 bp, Homo sapiens
tggaagttttgcta

SEQ ID NO: 5651344 - DNA, 13 bp, Homo sapiens
tggaataaaatac

SEQ ID NO: 5651345 - DNA, 21 bp, Homo sapiens
tggaataaacagtgagcatat

SEQ ID NO: 5651346 - DNA, 20 bp, Homo sapiens
tggaataaacatctgtgtct

SEQ ID NO: 5651347 - DNA, 13 bp, Homo sapiens
tggaataaacatt

SEQ ID NO: 5651348 - DNA, 14 bp, Homo sapiens
tggaataaacatta

SEQ ID NO: 5651349 - DNA, 17 bp, Homo sapiens
tggaataaacattaatt

SEQ ID NO: 5651350 - DNA, 20 bp, Homo sapiens
tggaataaacattaattttg

SEQ ID NO: 5651351 - DNA, 15 bp, Homo sapiens
tggaataaaggctga

SEQ ID NO: 5651352 - DNA, 19 bp, Homo sapiens
tggaataacatgtaattaa

SEQ ID NO: 5651353 - DNA, 14 bp, Homo sapiens
tggaataactatct

SEQ ID NO: 5651354 - DNA, 23 bp, Homo sapiens
tggaataagccttcgaaaagaaa

SEQ ID NO: 5651355 - DNA, 19 bp, Homo sapiens
tggaataaggagctggggc

SEQ ID NO: 5651356 - DNA, 18 bp, Homo sapiens
tggaataaggcatggctc

SEQ ID NO: 5651357 - DNA, 12 bp, Homo sapiens
tggaataagtgt

SEQ ID NO: 5651358 - DNA, 21 bp, Homo sapiens
tggaataatacatactaatga

SEQ ID NO: 5651359 - DNA, 22 bp, Homo sapiens
tggaataatcctaaacatatga

SEQ ID NO: 5651360 - DNA, 16 bp, Homo sapiens
tggaataatttgtaaa

SEQ ID NO: 5651361 - DNA, 19 bp, Homo sapiens
tggaatacacatgcaggac

SEQ ID NO: 5651362 - DNA, 15 bp, Homo sapiens
tggaatacagtcatt

SEQ ID NO: 5651363 - DNA, 15 bp, Homo sapiens
tggaatacagtgtta

SEQ ID NO: 5651364 - DNA, 14 bp, Homo sapiens
tggaatacatgaaa

SEQ ID NO: 5651365 - DNA, 20 bp, Homo sapiens
tggaatactaaaaatcatga

SEQ ID NO: 5651366 - DNA, 14 bp, Homo sapiens
tggaatactgaaaa

SEQ ID NO: 5651367 - DNA, 12 bp, Homo sapiens
tggaatactttt

SEQ ID NO: 5651368 - DNA, 23 bp, Homo sapiens
tggaatagaaaagatgagaggca

SEQ ID NO: 5651369 - DNA, 17 bp, Homo sapiens
tggaataggaataagct

SEQ ID NO: 5651370 - DNA, 16 bp, Homo sapiens
tggaatagtaaactaa

SEQ ID NO: 5651371 - DNA, 23 bp, Homo sapiens
tggaatagtatcctccaggtttt

SEQ ID NO: 5651372 - DNA, 20 bp, Homo sapiens
tggaatagttactttacaac

SEQ ID NO: 5651373 - DNA, 13 bp, Homo sapiens
tggaatataaaac

SEQ ID NO: 5651374 - DNA, 15 bp, Homo sapiens
tggaatataaatagc

SEQ ID NO: 5651375 - DNA, 18 bp, Homo sapiens
tggaatataaggaaagca

SEQ ID NO: 5651376 - DNA, 14 bp, Homo sapiens
tggaatataattgt

SEQ ID NO: 5651377 - DNA, 23 bp, Homo sapiens
tggaatatattctttgaaatata

SEQ ID NO: 5651378 - DNA, 13 bp, Homo sapiens
tggaatatcaatg

SEQ ID NO: 5651379 - DNA, 15 bp, Homo sapiens
tggaatatcaatgcc

SEQ ID NO: 5651380 - DNA, 16 bp, Homo sapiens
tggaatatctgagaat

SEQ ID NO: 5651381 - DNA, 16 bp, Homo sapiens
tggaatatggccaagg

SEQ ID NO: 5651382 - DNA, 13 bp, Homo sapiens
tggaatattaaaa

SEQ ID NO: 5651383 - DNA, 13 bp, Homo sapiens
tggaatattcatt

SEQ ID NO: 5651384 - DNA, 20 bp, Homo sapiens
tggaatattgtccattgtcc

SEQ ID NO: 5651385 - DNA, 24 bp, Homo sapiens
tggaatatttataggccagggcat

SEQ ID NO: 5651386 - DNA, 13 bp, Homo sapiens
tggaatatttgaa

SEQ ID NO: 5651387 - DNA, 18 bp, Homo sapiens
tggaatattttatcctgt

SEQ ID NO: 5651388 - DNA, 16 bp, Homo sapiens
tggaatcaaggaatcc

SEQ ID NO: 5651389 - DNA, 20 bp, Homo sapiens
tggaatcacctggagggctt

SEQ ID NO: 5651390 - DNA, 22 bp, Homo sapiens
tggaatcactgtttagaacaca

SEQ ID NO: 5651391 - DNA, 17 bp, Homo sapiens
tggaatcagcttttaat

SEQ ID NO: 5651392 - DNA, 23 bp, Homo sapiens
tggaatcagcttttaataaaatt

SEQ ID NO: 5651393 - DNA, 21 bp, Homo sapiens
tggaatcaggaatattttcca

SEQ ID NO: 5651394 - DNA, 22 bp, Homo sapiens
tggaatcaggaatattttccaa

SEQ ID NO: 5651395 - DNA, 17 bp, Homo sapiens
tggagcccagggtgctg

SEQ ID NO: 5651396 - DNA, 19 bp, Homo sapiens
tggagcccagttggaaaat

SEQ ID NO: 5651397 - DNA, 20 bp, Homo sapiens
tggagcccagttggaaaatt

SEQ ID NO: 5651398 - DNA, 21 bp, Homo sapiens
tggagcccataggccaccccc

SEQ ID NO: 5651399 - DNA, 14 bp, Homo sapiens
tggagccccacctt

SEQ ID NO: 5651400 - DNA, 19 bp, Homo sapiens
tggagccccaccttgtctg

SEQ ID NO: 5651401 - DNA, 21 bp, Homo sapiens
tggagccccaccttgtctgct

SEQ ID NO: 5651402 - DNA, 12 bp, Homo sapiens
tggagccccagc

SEQ ID NO: 5651403 - DNA, 15 bp, Homo sapiens
tggagccccagcccc

SEQ ID NO: 5651404 - DNA, 16 bp, Homo sapiens
tggagccccagccccc

SEQ ID NO: 5651405 - DNA, 22 bp, Homo sapiens
tggagcccccagatagagctgg

SEQ ID NO: 5651406 - DNA, 16 bp, Homo sapiens
tggagcccccagcaga

SEQ ID NO: 5651407 - DNA, 18 bp, Homo sapiens
tggagccccctggcggca

SEQ ID NO: 5651408 - DNA, 19 bp, Homo sapiens
tggagccccctggcggcag

SEQ ID NO: 5651409 - DNA, 15 bp, Homo sapiens
tggagcccctatcct

SEQ ID NO: 5651410 - DNA, 23 bp, Homo sapiens
tggagcccctgggtgggtggtgg

SEQ ID NO: 5651411 - DNA, 14 bp, Homo sapiens
tggagcccctgtgt

SEQ ID NO: 5651412 - DNA, 15 bp, Homo sapiens
tggagcccctgtgtc

SEQ ID NO: 5651413 - DNA, 23 bp, Homo sapiens
tggagccccttcgggagcagggc

SEQ ID NO: 5651414 - DNA, 17 bp, Homo sapiens
tggagcccgcaccccca

SEQ ID NO: 5651415 - DNA, 18 bp, Homo sapiens
tggagcccgcacccccac

SEQ ID NO: 5651416 - DNA, 19 bp, Homo sapiens
tggagcccgcacccccacc

SEQ ID NO: 5651417 - DNA, 22 bp, Homo sapiens
tggagcccgcacccccaccctt

SEQ ID NO: 5651418 - DNA, 18 bp, Homo sapiens
tggagcccgcactgtccc

SEQ ID NO: 5651419 - DNA, 22 bp, Homo sapiens
tggagcccgcctgcgcccccca

SEQ ID NO: 5651420 - DNA, 17 bp, Homo sapiens
tggagcccgcttcaagc

SEQ ID NO: 5651421 - DNA, 22 bp, Homo sapiens
tggagcccgtgcagtacaggca

SEQ ID NO: 5651422 - DNA, 20 bp, Homo sapiens
tggagccctactcacacatt

SEQ ID NO: 5651423 - DNA, 16 bp, Homo sapiens
tggagccctggagacc

SEQ ID NO: 5651424 - DNA, 22 bp, Homo sapiens
tggagccgcttccccagctcag

SEQ ID NO: 5651425 - DNA, 20 bp, Homo sapiens
tggagccggactttcggagt

SEQ ID NO: 5651426 - DNA, 17 bp, Homo sapiens
tggagccgtggccgagg

SEQ ID NO: 5651427 - DNA, 15 bp, Homo sapiens
tggagcctaaagaga

SEQ ID NO: 5651428 - DNA, 17 bp, Homo sapiens
tggagcctacattcctt

SEQ ID NO: 5651429 - DNA, 22 bp, Homo sapiens
tggagcctagagtgagggcctg

SEQ ID NO: 5651430 - DNA, 16 bp, Homo sapiens
tggagcctcagcagca

SEQ ID NO: 5651431 - DNA, 19 bp, Homo sapiens
tggagcctctttttccttc

SEQ ID NO: 5651432 - DNA, 20 bp, Homo sapiens
tggagcctctttttccttct

SEQ ID NO: 5651433 - DNA, 24 bp, Homo sapiens
tggagcctctttttccttcttcag

SEQ ID NO: 5651434 - DNA, 17 bp, Homo sapiens
tggagcctgacagccag

SEQ ID NO: 5651435 - DNA, 12 bp, Homo sapiens
tggagcctggaa

SEQ ID NO: 5651436 - DNA, 12 bp, Homo sapiens
tggagcctgggc

SEQ ID NO: 5651437 - DNA, 16 bp, Homo sapiens
tggagcctgggcagca

SEQ ID NO: 5651438 - DNA, 12 bp, Homo sapiens
tggagcctgtgt

SEQ ID NO: 5651439 - DNA, 17 bp, Homo sapiens
tggagcctgtgtaacag

SEQ ID NO: 5651440 - DNA, 17 bp, Homo sapiens
tggagccttccaccggc

SEQ ID NO: 5651441 - DNA, 19 bp, Homo sapiens
tggagccttccaccggcac

SEQ ID NO: 5651442 - DNA, 21 bp, Homo sapiens
tggagccttccaccggcactc

SEQ ID NO: 5651443 - DNA, 22 bp, Homo sapiens
tggagccttccaccggcactca

SEQ ID NO: 5651444 - DNA, 21 bp, Homo sapiens
tggagcgaagccttctgcagc

SEQ ID NO: 5651445 - DNA, 20 bp, Homo sapiens
tggagcgagagggaggcagg

SEQ ID NO: 5651446 - DNA, 23 bp, Homo sapiens
tggagcgagcatcccccaaagtt

SEQ ID NO: 5651447 - DNA, 16 bp, Homo sapiens
tggagcgcacctgccc

SEQ ID NO: 5651448 - DNA, 22 bp, Homo sapiens
tggagcgcacctgccccctggt

SEQ ID NO: 5651449 - DNA, 23 bp, Homo sapiens
tggagcggaatttacctgatttc

SEQ ID NO: 5651450 - DNA, 19 bp, Homo sapiens
tggagcggagaggaagcca

SEQ ID NO: 5651451 - DNA, 18 bp, Homo sapiens
tggagcggagcttgcctg

SEQ ID NO: 5651452 - DNA, 21 bp, Homo sapiens
tggagcggagcttgcctgcct

SEQ ID NO: 5651453 - DNA, 17 bp, Homo sapiens
tggagcggctctcctga

SEQ ID NO: 5651454 - DNA, 14 bp, Homo sapiens
tggagcggctgctc

SEQ ID NO: 5651455 - DNA, 22 bp, Homo sapiens
tggagcggctgctcgcccagga

SEQ ID NO: 5651456 - DNA, 18 bp, Homo sapiens
tggagcgtccttgtcccc

SEQ ID NO: 5651457 - DNA, 15 bp, Homo sapiens
tggagcgtggactgg

SEQ ID NO: 5651458 - DNA, 23 bp, Homo sapiens
tggagcgtttgctgtgccaggag

SEQ ID NO: 5651459 - DNA, 20 bp, Homo sapiens
tggagcgtttttgctggctt

SEQ ID NO: 5651460 - DNA, 16 bp, Homo sapiens
tggagctaaggccagc

SEQ ID NO: 5651461 - DNA, 16 bp, Homo sapiens
tggagctactgatgaa

SEQ ID NO: 5651462 - DNA, 15 bp, Homo sapiens
tggagctattttaaa

SEQ ID NO: 5651463 - DNA, 19 bp, Homo sapiens
tggagctcaagccgtggcc

SEQ ID NO: 5651464 - DNA, 13 bp, Homo sapiens
tggagctcagccc

SEQ ID NO: 5651465 - DNA, 16 bp, Homo sapiens
tggagctcaggtttct

SEQ ID NO: 5651466 - DNA, 14 bp, Homo sapiens
tggagctcatgtca

SEQ ID NO: 5651467 - DNA, 14 bp, Homo sapiens
tggagctccagcct

SEQ ID NO: 5651468 - DNA, 16 bp, Homo sapiens
tggagctcctgctggg

SEQ ID NO: 5651469 - DNA, 17 bp, Homo sapiens
tggagctcctgggaagg

SEQ ID NO: 5651470 - DNA, 21 bp, Homo sapiens
tggagctcttggaagagctct

SEQ ID NO: 5651471 - DNA, 12 bp, Homo sapiens
tggagctcttgt

SEQ ID NO: 5651472 - DNA, 13 bp, Homo sapiens
tggagctgaagac

SEQ ID NO: 5651473 - DNA, 15 bp, Homo sapiens
tggagctgaagacct

SEQ ID NO: 5651474 - DNA, 17 bp, Homo sapiens
tggagctgaatttgata

SEQ ID NO: 5651475 - DNA, 15 bp, Homo sapiens
tggagctgagaagag

SEQ ID NO: 5651476 - DNA, 18 bp, Homo sapiens
tggagctgagatgagccc

SEQ ID NO: 5651477 - DNA, 13 bp, Homo sapiens
tggagctgagcct

SEQ ID NO: 5651478 - DNA, 14 bp, Homo sapiens
tggagctgccacag

SEQ ID NO: 5651479 - DNA, 13 bp, Homo sapiens
tggagctgcttcc

SEQ ID NO: 5651480 - DNA, 15 bp, Homo sapiens
tggagctgcttccag

SEQ ID NO: 5651481 - DNA, 15 bp, Homo sapiens
tggagctggcgtctg

SEQ ID NO: 5651482 - DNA, 18 bp, Homo sapiens
tggagctgggagacaaag

SEQ ID NO: 5651483 - DNA, 14 bp, Homo sapiens
tggagctgggaggt

SEQ ID NO: 5651484 - DNA, 19 bp, Homo sapiens
tggagctggtctgccaggg

SEQ ID NO: 5651485 - DNA, 12 bp, Homo sapiens
tggagctgtcat

SEQ ID NO: 5651486 - DNA, 13 bp, Homo sapiens
tggagctgtcatc

SEQ ID NO: 5651487 - DNA, 21 bp, Homo sapiens
tggagctgtcatcactcaaca

SEQ ID NO: 5651488 - DNA, 18 bp, Homo sapiens
tggagctgtctgtctcta

SEQ ID NO: 5651489 - DNA, 21 bp, Homo sapiens
tggagctgtgccgaggcttgg

SEQ ID NO: 5651490 - DNA, 22 bp, Homo sapiens
tggagcttaagccactgcctct

SEQ ID NO: 5651491 - DNA, 15 bp, Homo sapiens
tggagcttggagccc

SEQ ID NO: 5651492 - DNA, 16 bp, Homo sapiens
tggagcttttaaaaat

SEQ ID NO: 5651493 - DNA, 14 bp, Homo sapiens
tggagcttttttcc

SEQ ID NO: 5651494 - DNA, 20 bp, Homo sapiens
tggagcttttttgcatagca

SEQ ID NO: 5651495 - DNA, 11 bp, Homo sapiens
tggaggaaaaa

SEQ ID NO: 5651496 - DNA, 20 bp, Homo sapiens
tggaggaaaatccatggata

SEQ ID NO: 5651497 - DNA, 19 bp, Homo sapiens
tggaggaacacttgatgga

SEQ ID NO: 5651498 - DNA, 19 bp, Homo sapiens
tggaggaacattgggaagg

SEQ ID NO: 5651499 - DNA, 15 bp, Homo sapiens
tggaggaagaactga

SEQ ID NO: 5651500 - DNA, 13 bp, Homo sapiens
tggaggaagagcc

SEQ ID NO: 5651501 - DNA, 14 bp, Homo sapiens
tggaggaagagcca

SEQ ID NO: 5651502 - DNA, 19 bp, Homo sapiens
tggaggaagagccacctgc

SEQ ID NO: 5651503 - DNA, 19 bp, Homo sapiens
tggaggaagatagcgcata

SEQ ID NO: 5651504 - DNA, 23 bp, Homo sapiens
tggaggaagctgttttgagccag

SEQ ID NO: 5651505 - DNA, 20 bp, Homo sapiens
tggaggaaggaaacccagct

SEQ ID NO: 5651506 - DNA, 23 bp, Homo sapiens
tggaggaaggaaacccagctctg

SEQ ID NO: 5651507 - DNA, 18 bp, Homo sapiens
tggaggaaggattgtaaa

SEQ ID NO: 5651508 - DNA, 15 bp, Homo sapiens
tggaggaaggctctg

SEQ ID NO: 5651509 - DNA, 20 bp, Homo sapiens
tggaggaaggctctgtcact

SEQ ID NO: 5651510 - DNA, 20 bp, Homo sapiens
tggaggaagtatgagtgctg

SEQ ID NO: 5651511 - DNA, 17 bp, Homo sapiens
tggaggaatacatttta

SEQ ID NO: 5651512 - DNA, 16 bp, Homo sapiens
tggaggaattcagctc

SEQ ID NO: 5651513 - DNA, 23 bp, Homo sapiens
tggaggacactaagaggaggcag

SEQ ID NO: 5651514 - DNA, 13 bp, Homo sapiens
tggaggacagacg

SEQ ID NO: 5651515 - DNA, 21 bp, Homo sapiens
tggaggacagagggagacagg

SEQ ID NO: 5651516 - DNA, 15 bp, Homo sapiens
tggaggaccagattg

SEQ ID NO: 5651517 - DNA, 23 bp, Homo sapiens
tggaggaccagattgctctgccc

SEQ ID NO: 5651518 - DNA, 18 bp, Homo sapiens
tggaggaccccgagggct

SEQ ID NO: 5651519 - DNA, 23 bp, Homo sapiens
tggaggaccccgagggctgagga

SEQ ID NO: 5651520 - DNA, 18 bp, Homo sapiens
tggaggaccgaggctaca

SEQ ID NO: 5651521 - DNA, 19 bp, Homo sapiens
tggaggaccgaggctacag

SEQ ID NO: 5651522 - DNA, 18 bp, Homo sapiens
tggaggacctgagcctgc

SEQ ID NO: 5651523 - DNA, 20 bp, Homo sapiens
tggaggacctgagcctgccg

SEQ ID NO: 5651524 - DNA, 20 bp, Homo sapiens
tggaggacctttaggtcaaa

SEQ ID NO: 5651525 - DNA, 17 bp, Homo sapiens
tggaggacgtggactgg

SEQ ID NO: 5651526 - DNA, 19 bp, Homo sapiens
tggaggactagaacctgga

SEQ ID NO: 5651527 - DNA, 21 bp, Homo sapiens
tggaggactagaacctggagg

SEQ ID NO: 5651528 - DNA, 21 bp, Homo sapiens
tggaggactctagaagctcag

SEQ ID NO: 5651529 - DNA, 15 bp, Homo sapiens
tggaggactctcctc

SEQ ID NO: 5651530 - DNA, 17 bp, Homo sapiens
tggaggactgtgacaga

SEQ ID NO: 5651531 - DNA, 15 bp, Homo sapiens
tggaggagaaggagg

SEQ ID NO: 5651532 - DNA, 19 bp, Homo sapiens
tggaggagacaggaagcct

SEQ ID NO: 5651533 - DNA, 15 bp, Homo sapiens
tggaggagactgggc

SEQ ID NO: 5651534 - DNA, 14 bp, Homo sapiens
tggaggagagagac

SEQ ID NO: 5651535 - DNA, 13 bp, Homo sapiens
tggaggagagagc

SEQ ID NO: 5651536 - DNA, 14 bp, Homo sapiens
tggaggagagagcc

SEQ ID NO: 5651537 - DNA, 15 bp, Homo sapiens
tggaggagagcctgg

SEQ ID NO: 5651538 - DNA, 12 bp, Homo sapiens
tggaggagagga

SEQ ID NO: 5651539 - DNA, 14 bp, Homo sapiens
tggaggagaggaga

SEQ ID NO: 5651540 - DNA, 22 bp, Homo sapiens
tggaggagaggggtggaggctg

SEQ ID NO: 5651541 - DNA, 18 bp, Homo sapiens
tggaggagcaaaggctga

SEQ ID NO: 5651542 - DNA, 13 bp, Homo sapiens
tggaggagcagtg

SEQ ID NO: 5651543 - DNA, 14 bp, Homo sapiens
tggaggagccaggc

SEQ ID NO: 5651544 - DNA, 16 bp, Homo sapiens
tggaggagccaggccc

SEQ ID NO: 5651545 - DNA, 17 bp, Homo sapiens
tggaggagccaggcccc

SEQ ID NO: 5651546 - DNA, 13 bp, Homo sapiens
tggaggagcccag

SEQ ID NO: 5651547 - DNA, 14 bp, Homo sapiens
tggaggagctggcc

SEQ ID NO: 5651548 - DNA, 15 bp, Homo sapiens
tggaggagctggcct

SEQ ID NO: 5651549 - DNA, 16 bp, Homo sapiens
tggaggaggagcaggg

SEQ ID NO: 5651550 - DNA, 14 bp, Homo sapiens
tggaggaggaggag

SEQ ID NO: 5651551 - DNA, 20 bp, Homo sapiens
tggaggaggaggaggagcct

SEQ ID NO: 5651552 - DNA, 23 bp, Homo sapiens
tggaggaggaggaggagccttgc

SEQ ID NO: 5651553 - DNA, 15 bp, Homo sapiens
tggaggaggaggcaa

SEQ ID NO: 5651554 - DNA, 15 bp, Homo sapiens
tggaggaggatgcca

SEQ ID NO: 5651555 - DNA, 18 bp, Homo sapiens
tggaggaggcctgggggc

SEQ ID NO: 5651556 - DNA, 19 bp, Homo sapiens
tggaggaggcctgtcccaa

SEQ ID NO: 5651557 - DNA, 21 bp, Homo sapiens
tggaggagggagagccctgtc

SEQ ID NO: 5651558 - DNA, 20 bp, Homo sapiens
tggaggagggtttgggcaga

SEQ ID NO: 5651559 - DNA, 18 bp, Homo sapiens
tggaggaggtggcttcat

SEQ ID NO: 5651560 - DNA, 21 bp, Homo sapiens
tggaggatgaatagatgtgat

SEQ ID NO: 5651561 - DNA, 15 bp, Homo sapiens
tggaggatggacgag

SEQ ID NO: 5651562 - DNA, 19 bp, Homo sapiens
tggaggatggacgagtgag

SEQ ID NO: 5651563 - DNA, 20 bp, Homo sapiens
tggaggatggacgagtgagc

SEQ ID NO: 5651564 - DNA, 17 bp, Homo sapiens
tggaggatgtgggcagc

SEQ ID NO: 5651565 - DNA, 23 bp, Homo sapiens
tggaggatgttagacttgctccc

SEQ ID NO: 5651566 - DNA, 16 bp, Homo sapiens
tggaggattctttccc

SEQ ID NO: 5651567 - DNA, 19 bp, Homo sapiens
tggaggattctttccccag

SEQ ID NO: 5651568 - DNA, 21 bp, Homo sapiens
tggaggattctttccccagag

SEQ ID NO: 5651569 - DNA, 22 bp, Homo sapiens
tggaggattctttccccagagg

SEQ ID NO: 5651570 - DNA, 15 bp, Homo sapiens
tggaggatttggtca

SEQ ID NO: 5651571 - DNA, 18 bp, Homo sapiens
tggaggcaaaggcctgga

SEQ ID NO: 5651572 - DNA, 12 bp, Homo sapiens
tggatggcctct

SEQ ID NO: 5651573 - DNA, 15 bp, Homo sapiens
tggatggcctctggg

SEQ ID NO: 5651574 - DNA, 13 bp, Homo sapiens
tggatggcttcta

SEQ ID NO: 5651575 - DNA, 17 bp, Homo sapiens
tggatgggaatttgtca

SEQ ID NO: 5651576 - DNA, 18 bp, Homo sapiens
tggatgggaggagagcca

SEQ ID NO: 5651577 - DNA, 23 bp, Homo sapiens
tggatgggaggagagccactggg

SEQ ID NO: 5651578 - DNA, 17 bp, Homo sapiens
tggatgggagtgagaca

SEQ ID NO: 5651579 - DNA, 17 bp, Homo sapiens
tggatgggagtgggcac

SEQ ID NO: 5651580 - DNA, 18 bp, Homo sapiens
tggatgggcaaagcttgt

SEQ ID NO: 5651581 - DNA, 19 bp, Homo sapiens
tggatgggcattgggctga

SEQ ID NO: 5651582 - DNA, 14 bp, Homo sapiens
tggatgggccctgc

SEQ ID NO: 5651583 - DNA, 20 bp, Homo sapiens
tggatgggccctgcaagaca

SEQ ID NO: 5651584 - DNA, 19 bp, Homo sapiens
tggatggggcagagcttct

SEQ ID NO: 5651585 - DNA, 22 bp, Homo sapiens
tggatggggcagagcttctcct

SEQ ID NO: 5651586 - DNA, 21 bp, Homo sapiens
tggatggggcccaggggcttt

SEQ ID NO: 5651587 - DNA, 17 bp, Homo sapiens
tggatggggcggcctgc

SEQ ID NO: 5651588 - DNA, 18 bp, Homo sapiens
tggatgggggaactcaga

SEQ ID NO: 5651589 - DNA, 21 bp, Homo sapiens
tggatgggggaactcagatcc

SEQ ID NO: 5651590 - DNA, 23 bp, Homo sapiens
tggatgggggaactcagatccag

SEQ ID NO: 5651591 - DNA, 18 bp, Homo sapiens
tggatgggggtgcaggca

SEQ ID NO: 5651592 - DNA, 18 bp, Homo sapiens
tggatggtccagtgtcat

SEQ ID NO: 5651593 - DNA, 17 bp, Homo sapiens
tggatggtctccacctg

SEQ ID NO: 5651594 - DNA, 21 bp, Homo sapiens
tggatggtctccacctgtgct

SEQ ID NO: 5651595 - DNA, 21 bp, Homo sapiens
tggatggtctttgggcaggga

SEQ ID NO: 5651596 - DNA, 17 bp, Homo sapiens
tggatggtgacttttga

SEQ ID NO: 5651597 - DNA, 19 bp, Homo sapiens
tggatgtaattagctctgg

SEQ ID NO: 5651598 - DNA, 14 bp, Homo sapiens
tggatgtatttgta

SEQ ID NO: 5651599 - DNA, 15 bp, Homo sapiens
tggatgtatttgtag

SEQ ID NO: 5651600 - DNA, 23 bp, Homo sapiens
tggatgtcctcaaagaagtggtt

SEQ ID NO: 5651601 - DNA, 15 bp, Homo sapiens
tggatgtctgaactt

SEQ ID NO: 5651602 - DNA, 17 bp, Homo sapiens
tggatgtctgccaattt

SEQ ID NO: 5651603 - DNA, 14 bp, Homo sapiens
tggatgtctgtagc

SEQ ID NO: 5651604 - DNA, 16 bp, Homo sapiens
tggatgtctgtgagta

SEQ ID NO: 5651605 - DNA, 24 bp, Homo sapiens
tggatgtgaagctcacactgatgg

SEQ ID NO: 5651606 - DNA, 21 bp, Homo sapiens
tggatgtggacttttttgtac

SEQ ID NO: 5651607 - DNA, 15 bp, Homo sapiens
tggatgtgttcattc

SEQ ID NO: 5651608 - DNA, 21 bp, Homo sapiens
tggatgttagcctgcaaacaa

SEQ ID NO: 5651609 - DNA, 18 bp, Homo sapiens
tggatgttatgaacagct

SEQ ID NO: 5651610 - DNA, 20 bp, Homo sapiens
tggatgttatgaacagctgt

SEQ ID NO: 5651611 - DNA, 12 bp, Homo sapiens
tggatgttcaga

SEQ ID NO: 5651612 - DNA, 18 bp, Homo sapiens
tggatgttcagaattttg

SEQ ID NO: 5651613 - DNA, 22 bp, Homo sapiens
tggatgtttacaggaacccagc

SEQ ID NO: 5651614 - DNA, 21 bp, Homo sapiens
tggatgtttttagttctgact

SEQ ID NO: 5651615 - DNA, 21 bp, Homo sapiens
tggattaaaaatagagcaaga

SEQ ID NO: 5651616 - DNA, 15 bp, Homo sapiens
tggattaaaacaatt

SEQ ID NO: 5651617 - DNA, 15 bp, Homo sapiens
tggattaaacttatg

SEQ ID NO: 5651618 - DNA, 17 bp, Homo sapiens
tggattaaacttatgaa

SEQ ID NO: 5651619 - DNA, 20 bp, Homo sapiens
tggattaaacttatgaatgt

SEQ ID NO: 5651620 - DNA, 19 bp, Homo sapiens
tggattaatgttttgtaca

SEQ ID NO: 5651621 - DNA, 14 bp, Homo sapiens
tggattagaaattt

SEQ ID NO: 5651622 - DNA, 19 bp, Homo sapiens
tggattagaaatttaacat

SEQ ID NO: 5651623 - DNA, 23 bp, Homo sapiens
tggattagacaggttaaatatat

SEQ ID NO: 5651624 - DNA, 13 bp, Homo sapiens
tggattaggtctc

SEQ ID NO: 5651625 - DNA, 21 bp, Homo sapiens
tggattatgttatacaaggca

SEQ ID NO: 5651626 - DNA, 16 bp, Homo sapiens
tggattattcatttaa

SEQ ID NO: 5651627 - DNA, 17 bp, Homo sapiens
tggattattcatttaaa

SEQ ID NO: 5651628 - DNA, 15 bp, Homo sapiens
tggattatttaataa

SEQ ID NO: 5651629 - DNA, 18 bp, Homo sapiens
tggattatttaataacat

SEQ ID NO: 5651630 - DNA, 23 bp, Homo sapiens
tggattatttaataacattacct

SEQ ID NO: 5651631 - DNA, 17 bp, Homo sapiens
tggattcaattcctgtc

SEQ ID NO: 5651632 - DNA, 20 bp, Homo sapiens
tggattcaattcctgtcctt

SEQ ID NO: 5651633 - DNA, 20 bp, Homo sapiens
tggattcacccccctctgct

SEQ ID NO: 5651634 - DNA, 23 bp, Homo sapiens
tggattcagccttctttttctgg

SEQ ID NO: 5651635 - DNA, 21 bp, Homo sapiens
tggattcatggagtagcctgg

SEQ ID NO: 5651636 - DNA, 15 bp, Homo sapiens
tggattcatttcctg

SEQ ID NO: 5651637 - DNA, 19 bp, Homo sapiens
tggattcatttcctgccct

SEQ ID NO: 5651638 - DNA, 12 bp, Homo sapiens
tggattccaaac

SEQ ID NO: 5651639 - DNA, 20 bp, Homo sapiens
tggattccaaccttcctttt

SEQ ID NO: 5651640 - DNA, 13 bp, Homo sapiens
tggattccatgct

SEQ ID NO: 5651641 - DNA, 18 bp, Homo sapiens
tggattccccatctcagg

SEQ ID NO: 5651642 - DNA, 19 bp, Homo sapiens
tggattccccatctcaggc

SEQ ID NO: 5651643 - DNA, 20 bp, Homo sapiens
tggattcccccccctttcct

SEQ ID NO: 5651644 - DNA, 15 bp, Homo sapiens
tggattcccttttga

SEQ ID NO: 5651645 - DNA, 19 bp, Homo sapiens
tggattcccttttgactct

SEQ ID NO: 5651646 - DNA, 18 bp, Homo sapiens
tggattccgagtggtgac

SEQ ID NO: 5651647 - DNA, 13 bp, Homo sapiens
tggattcctaagc

SEQ ID NO: 5651648 - DNA, 22 bp, Homo sapiens
tggattcctaagcagtgcttgt

SEQ ID NO: 5651649 - DNA, 13 bp, Homo sapiens
tggattcctcccc

SEQ ID NO: 5651650 - DNA, 14 bp, Homo sapiens
tggattcctcccca

SEQ ID NO: 5651651 - DNA, 17 bp, Homo sapiens
tggattcctccccaccc

SEQ ID NO: 5651652 - DNA, 15 bp, Homo sapiens
tggattctatatttc

SEQ ID NO: 5651653 - DNA, 18 bp, Homo sapiens
tggattctatatttcata

SEQ ID NO: 5651654 - DNA, 14 bp, Homo sapiens
tggattctcagata

SEQ ID NO: 5651655 - DNA, 16 bp, Homo sapiens
tggattctcagatatt

SEQ ID NO: 5651656 - DNA, 15 bp, Homo sapiens
tggattctctaagat

SEQ ID NO: 5651657 - DNA, 23 bp, Homo sapiens
tggattctgggaggcaagaaaag

SEQ ID NO: 5651658 - DNA, 17 bp, Homo sapiens
tggattctttaaatata

SEQ ID NO: 5651659 - DNA, 18 bp, Homo sapiens
tggattcttttcatcaaa

SEQ ID NO: 5651660 - DNA, 21 bp, Homo sapiens
tggattgacagtaacttggtt

SEQ ID NO: 5651661 - DNA, 13 bp, Homo sapiens
tggattgagggta

SEQ ID NO: 5651662 - DNA, 17 bp, Homo sapiens
tggattgcagactgttc

SEQ ID NO: 5651663 - DNA, 14 bp, Homo sapiens
tggattgccacagc

SEQ ID NO: 5651664 - DNA, 19 bp, Homo sapiens
tggattgcgcctaatgtgt

SEQ ID NO: 5651665 - DNA, 19 bp, Homo sapiens
tggattgcgcctttgtatt

SEQ ID NO: 5651666 - DNA, 22 bp, Homo sapiens
tggattgcgcctttgtattata

SEQ ID NO: 5651667 - DNA, 14 bp, Homo sapiens
tggattgctggggc

SEQ ID NO: 5651668 - DNA, 22 bp, Homo sapiens
tggattgctggggccaggcccc

SEQ ID NO: 5651669 - DNA, 20 bp, Homo sapiens
tggattggacaaaatgactt

SEQ ID NO: 5651670 - DNA, 23 bp, Homo sapiens
tggattggacaggagatcagcag

SEQ ID NO: 5651671 - DNA, 20 bp, Homo sapiens
tggattggattatttaataa

SEQ ID NO: 5651672 - DNA, 21 bp, Homo sapiens
tggattggattatttaataac

SEQ ID NO: 5651673 - DNA, 13 bp, Homo sapiens
tggattggcaggt

SEQ ID NO: 5651674 - DNA, 17 bp, Homo sapiens
tggattgggggggccaa

SEQ ID NO: 5651675 - DNA, 18 bp, Homo sapiens
tggattgggttatgaata

SEQ ID NO: 5651676 - DNA, 16 bp, Homo sapiens
tggattgtagaacttg

SEQ ID NO: 5651677 - DNA, 13 bp, Homo sapiens
tggattgtattta

SEQ ID NO: 5651678 - DNA, 20 bp, Homo sapiens
tggattgtatttaagacata

SEQ ID NO: 5651679 - DNA, 13 bp, Homo sapiens
tggattgtgcttt

SEQ ID NO: 5651680 - DNA, 21 bp, Homo sapiens
tggattgtggatgtggacttt

SEQ ID NO: 5651681 - DNA, 21 bp, Homo sapiens
tggattgtggttccatgcagc

SEQ ID NO: 5651682 - DNA, 21 bp, Homo sapiens
tggattgttctagtactgtat

SEQ ID NO: 5651683 - DNA, 22 bp, Homo sapiens
tggattgttctagtactgtatt

SEQ ID NO: 5651684 - DNA, 15 bp, Homo sapiens
tggattgtttttccc

SEQ ID NO: 5651685 - DNA, 20 bp, Homo sapiens
tggatttaaaagcctgctca

SEQ ID NO: 5651686 - DNA, 17 bp, Homo sapiens
tggatttaacagaaatg

SEQ ID NO: 5651687 - DNA, 20 bp, Homo sapiens
tggatttaacagaaatgtac

SEQ ID NO: 5651688 - DNA, 13 bp, Homo sapiens
tggatttaacagc

SEQ ID NO: 5651689 - DNA, 19 bp, Homo sapiens
tggatttactgagagaagg

SEQ ID NO: 5651690 - DNA, 15 bp, Homo sapiens
tggatttagcttgtt

SEQ ID NO: 5651691 - DNA, 16 bp, Homo sapiens
tggatttagtttcagt

SEQ ID NO: 5651692 - DNA, 21 bp, Homo sapiens
tggatttatagtatgtgactt

SEQ ID NO: 5651693 - DNA, 20 bp, Homo sapiens
tggatttattttttgtaact

SEQ ID NO: 5651694 - DNA, 13 bp, Homo sapiens
tggatttcagaag

SEQ ID NO: 5651695 - DNA, 21 bp, Homo sapiens
tggatttcctaatactgtcat

SEQ ID NO: 5651696 - DNA, 15 bp, Homo sapiens
tggatttcctttata

SEQ ID NO: 5651697 - DNA, 23 bp, Homo sapiens
tggatttcctttgacctctcact

SEQ ID NO: 5651698 - DNA, 14 bp, Homo sapiens
tggatttctgtgaa

SEQ ID NO: 5651699 - DNA, 16 bp, Homo sapiens
tggatttcttagagat

SEQ ID NO: 5651700 - DNA, 19 bp, Homo sapiens
tggatttgaagtttgccaa

SEQ ID NO: 5651701 - DNA, 17 bp, Homo sapiens
tggatttgacacactca

SEQ ID NO: 5651702 - DNA, 13 bp, Homo sapiens
tggatttgacatt

SEQ ID NO: 5651703 - DNA, 13 bp, Homo sapiens
tggatttgcagaa

SEQ ID NO: 5651704 - DNA, 17 bp, Homo sapiens
tggatttgcatttttgt

SEQ ID NO: 5651705 - DNA, 16 bp, Homo sapiens
tggatttggagagaaa

SEQ ID NO: 5651706 - DNA, 21 bp, Homo sapiens
tggatttggagagaaatattt

SEQ ID NO: 5651707 - DNA, 19 bp, Homo sapiens
tggatttgggagctctgct

SEQ ID NO: 5651708 - DNA, 14 bp, Homo sapiens
tggattttaaaaaa

SEQ ID NO: 5651709 - DNA, 16 bp, Homo sapiens
tggattttaaacaaaa

SEQ ID NO: 5651710 - DNA, 22 bp, Homo sapiens
tggattttaaacaaaatttatg

SEQ ID NO: 5651711 - DNA, 23 bp, Homo sapiens
tggattttaaacaaaatttatgt

SEQ ID NO: 5651712 - DNA, 15 bp, Homo sapiens
tggattttctactgt

SEQ ID NO: 5651713 - DNA, 19 bp, Homo sapiens
tggattttctattgttact

SEQ ID NO: 5651714 - DNA, 20 bp, Homo sapiens
tggattttctcataggaagt

SEQ ID NO: 5651715 - DNA, 14 bp, Homo sapiens
tggattttgtggct

SEQ ID NO: 5651716 - DNA, 16 bp, Homo sapiens
tggatttttaaattat

SEQ ID NO: 5651717 - DNA, 15 bp, Homo sapiens
tggatttttctttaa

SEQ ID NO: 5651718 - DNA, 19 bp, Homo sapiens
tggattttttatgtacaac

SEQ ID NO: 5651719 - DNA, 23 bp, Homo sapiens
tggattttttatgtacaaccctg

SEQ ID NO: 5651720 - DNA, 17 bp, Homo sapiens
tggattttttattatta

SEQ ID NO: 5651721 - DNA, 20 bp, Homo sapiens
tggattttttttttcaggtt

SEQ ID NO: 5651722 - DNA, 16 bp, Homo sapiens
tggcaaaaaagaacag

SEQ ID NO: 5651723 - DNA, 21 bp, Homo sapiens
tggcaaaaagagtcagacatt

SEQ ID NO: 5651724 - DNA, 22 bp, Homo sapiens
tggcaaaaaggagccttttgct

SEQ ID NO: 5651725 - DNA, 22 bp, Homo sapiens
tggcaaaaatgcaacaaatgaa

SEQ ID NO: 5651726 - DNA, 20 bp, Homo sapiens
tggcaaaacactatgtatag

SEQ ID NO: 5651727 - DNA, 14 bp, Homo sapiens
tggcaaaactcagg

SEQ ID NO: 5651728 - DNA, 16 bp, Homo sapiens
tggcaaaagccttgtg

SEQ ID NO: 5651729 - DNA, 19 bp, Homo sapiens
tggcaaaagccttgtgtat

SEQ ID NO: 5651730 - DNA, 14 bp, Homo sapiens
tggcaaaattgcca

SEQ ID NO: 5651731 - DNA, 13 bp, Homo sapiens
tggcaaacaaaac

SEQ ID NO: 5651732 - DNA, 13 bp, Homo sapiens
tggcaaacattta

SEQ ID NO: 5651733 - DNA, 16 bp, Homo sapiens
tggcaaaccctcccag

SEQ ID NO: 5651734 - DNA, 21 bp, Homo sapiens
tggcaaacgagactttctcct

SEQ ID NO: 5651735 - DNA, 19 bp, Homo sapiens
tggcaaacgtttctcaaat

SEQ ID NO: 5651736 - DNA, 15 bp, Homo sapiens
tggcaaacttttctt

SEQ ID NO: 5651737 - DNA, 17 bp, Homo sapiens
tggcaaagacagaagcc

SEQ ID NO: 5651738 - DNA, 15 bp, Homo sapiens
tggcaaagagaggtc

SEQ ID NO: 5651739 - DNA, 16 bp, Homo sapiens
tggcaaagagaggtcc

SEQ ID NO: 5651740 - DNA, 15 bp, Homo sapiens
tggcaaagcagaaaa

SEQ ID NO: 5651741 - DNA, 16 bp, Homo sapiens
tggcaaagcttttaga

SEQ ID NO: 5651742 - DNA, 22 bp, Homo sapiens
tggcaaagggagcagaactgaa

SEQ ID NO: 5651743 - DNA, 17 bp, Homo sapiens
tggcaaagtttaaatgt

SEQ ID NO: 5651744 - DNA, 13 bp, Homo sapiens
tggcaaataatac

SEQ ID NO: 5651745 - DNA, 12 bp, Homo sapiens
tggcaaatataa

SEQ ID NO: 5651746 - DNA, 20 bp, Homo sapiens
tggcaaatattttgtcactg

SEQ ID NO: 5651747 - DNA, 22 bp, Homo sapiens
tggcaaatattttgtcactgct

SEQ ID NO: 5651748 - DNA, 15 bp, Homo sapiens
tggcatgcaaaagaa

SEQ ID NO: 5651749 - DNA, 22 bp, Homo sapiens
tggcatgcaaaagaaagcaaat

SEQ ID NO: 5651750 - DNA, 14 bp, Homo sapiens
tggcatgcatcttt

SEQ ID NO: 5651751 - DNA, 16 bp, Homo sapiens
tggcatgctgtctcta

SEQ ID NO: 5651752 - DNA, 19 bp, Homo sapiens
tggcatggaaggggcttct

SEQ ID NO: 5651753 - DNA, 12 bp, Homo sapiens
tggcatggcaga

SEQ ID NO: 5651754 - DNA, 14 bp, Homo sapiens
tggcatggccacca

SEQ ID NO: 5651755 - DNA, 16 bp, Homo sapiens
tggcatggctccagtc

SEQ ID NO: 5651756 - DNA, 17 bp, Homo sapiens
tggcatggctccagtct

SEQ ID NO: 5651757 - DNA, 12 bp, Homo sapiens
tggcatgggaat

SEQ ID NO: 5651758 - DNA, 22 bp, Homo sapiens
tggcatgggaatgaatgtcagt

SEQ ID NO: 5651759 - DNA, 15 bp, Homo sapiens
tggcatgggacagac

SEQ ID NO: 5651760 - DNA, 17 bp, Homo sapiens
tggcatgggggcctcag

SEQ ID NO: 5651761 - DNA, 20 bp, Homo sapiens
tggcatgggggcctcagggc

SEQ ID NO: 5651762 - DNA, 17 bp, Homo sapiens
tggcatggtcctgtgcc

SEQ ID NO: 5651763 - DNA, 20 bp, Homo sapiens
tggcatggtcctgtgccccg

SEQ ID NO: 5651764 - DNA, 21 bp, Homo sapiens
tggcatggtcctgtgccccga

SEQ ID NO: 5651765 - DNA, 13 bp, Homo sapiens
tggcatggtggct

SEQ ID NO: 5651766 - DNA, 20 bp, Homo sapiens
tggcatggtggctcccgcct

SEQ ID NO: 5651767 - DNA, 17 bp, Homo sapiens
tggcatgtaaatgtaaa

SEQ ID NO: 5651768 - DNA, 14 bp, Homo sapiens
tggcatgtcagagc

SEQ ID NO: 5651769 - DNA, 19 bp, Homo sapiens
tggcatgtccacgtgtgtg

SEQ ID NO: 5651770 - DNA, 20 bp, Homo sapiens
tggcatgtgctgtgaccatt

SEQ ID NO: 5651771 - DNA, 14 bp, Homo sapiens
tggcatgtggcctg

SEQ ID NO: 5651772 - DNA, 19 bp, Homo sapiens
tggcatgtgggttgtgata

SEQ ID NO: 5651773 - DNA, 12 bp, Homo sapiens
tggcatgtgttt

SEQ ID NO: 5651774 - DNA, 17 bp, Homo sapiens
tggcatgtttaattgtg

SEQ ID NO: 5651775 - DNA, 18 bp, Homo sapiens
tggcatgtttcactcctg

SEQ ID NO: 5651776 - DNA, 13 bp, Homo sapiens
tggcatgttttct

SEQ ID NO: 5651777 - DNA, 20 bp, Homo sapiens
tggcatgttttgtcattgtt

SEQ ID NO: 5651778 - DNA, 21 bp, Homo sapiens
tggcatgttttgtcattgttt

SEQ ID NO: 5651779 - DNA, 21 bp, Homo sapiens
tggcattaaaccacatcatgg

SEQ ID NO: 5651780 - DNA, 22 bp, Homo sapiens
tggcattaaaccacatcatgga

SEQ ID NO: 5651781 - DNA, 23 bp, Homo sapiens
tggcattaaaccacatcatggac

SEQ ID NO: 5651782 - DNA, 18 bp, Homo sapiens
tggcattaacaataaagc

SEQ ID NO: 5651783 - DNA, 13 bp, Homo sapiens
tggcattatgtcc

SEQ ID NO: 5651784 - DNA, 22 bp, Homo sapiens
tggcattattaggtcttaaagt

SEQ ID NO: 5651785 - DNA, 23 bp, Homo sapiens
tggcattcaaccacgcaggaagc

SEQ ID NO: 5651786 - DNA, 13 bp, Homo sapiens
tggcattcctcta

SEQ ID NO: 5651787 - DNA, 15 bp, Homo sapiens
tggcattcctctaat

SEQ ID NO: 5651788 - DNA, 15 bp, Homo sapiens
tggcattcctttctt

SEQ ID NO: 5651789 - DNA, 18 bp, Homo sapiens
tggcattcctttctttaa

SEQ ID NO: 5651790 - DNA, 18 bp, Homo sapiens
tggcattctacacctgga

SEQ ID NO: 5651791 - DNA, 19 bp, Homo sapiens
tggcattctctctgctcag

SEQ ID NO: 5651792 - DNA, 20 bp, Homo sapiens
tggcattctctctgctcagt

SEQ ID NO: 5651793 - DNA, 17 bp, Homo sapiens
tggcattcttgtacagt

SEQ ID NO: 5651794 - DNA, 22 bp, Homo sapiens
tggcattctttgcaatactgct

SEQ ID NO: 5651795 - DNA, 14 bp, Homo sapiens
tggcattgatctta

SEQ ID NO: 5651796 - DNA, 13 bp, Homo sapiens
tggcattggcagc

SEQ ID NO: 5651797 - DNA, 23 bp, Homo sapiens
tggcattggccagaccacagcag

SEQ ID NO: 5651798 - DNA, 17 bp, Homo sapiens
tggcattggtctgctga

SEQ ID NO: 5651799 - DNA, 17 bp, Homo sapiens
tggcattgtttccaccc

SEQ ID NO: 5651800 - DNA, 20 bp, Homo sapiens
tggcatttagtaccttcaaa

SEQ ID NO: 5651801 - DNA, 13 bp, Homo sapiens
tggcatttccaaa

SEQ ID NO: 5651802 - DNA, 16 bp, Homo sapiens
tggcatttctatactt

SEQ ID NO: 5651803 - DNA, 17 bp, Homo sapiens
tggcatttctatacttt

SEQ ID NO: 5651804 - DNA, 20 bp, Homo sapiens
tggcatttgctgatttctag

SEQ ID NO: 5651805 - DNA, 18 bp, Homo sapiens
tggcatttggtctcaggc

SEQ ID NO: 5651806 - DNA, 17 bp, Homo sapiens
tggcatttgttatcctc

SEQ ID NO: 5651807 - DNA, 17 bp, Homo sapiens
tggcattttcctcgcct

SEQ ID NO: 5651808 - DNA, 18 bp, Homo sapiens
tggcattttctgttccag

SEQ ID NO: 5651809 - DNA, 18 bp, Homo sapiens
tggcattttggctcagag

SEQ ID NO: 5651810 - DNA, 19 bp, Homo sapiens
tggcattttggctcagagt

SEQ ID NO: 5651811 - DNA, 21 bp, Homo sapiens
tggcattttggctcagagtcc

SEQ ID NO: 5651812 - DNA, 17 bp, Homo sapiens
tggcatttttgcttcct

SEQ ID NO: 5651813 - DNA, 14 bp, Homo sapiens
tggccaaaacttaa

SEQ ID NO: 5651814 - DNA, 16 bp, Homo sapiens
tggccaaacatcagac

SEQ ID NO: 5651815 - DNA, 20 bp, Homo sapiens
tggccaaagagcctttccaa

SEQ ID NO: 5651816 - DNA, 22 bp, Homo sapiens
tggccaaaggaccgttttgtat

SEQ ID NO: 5651817 - DNA, 15 bp, Homo sapiens
tggccaaagtgtaca

SEQ ID NO: 5651818 - DNA, 16 bp, Homo sapiens
tggccaaataggaggg

SEQ ID NO: 5651819 - DNA, 21 bp, Homo sapiens
tggccaaataggagggagact

SEQ ID NO: 5651820 - DNA, 15 bp, Homo sapiens
tggccaacagggtag

SEQ ID NO: 5651821 - DNA, 23 bp, Homo sapiens
tggccaacagggtagatttctct

SEQ ID NO: 5651822 - DNA, 22 bp, Homo sapiens
tggccaacatcatatacctctt

SEQ ID NO: 5651823 - DNA, 16 bp, Homo sapiens
tggccaacatggtgaa

SEQ ID NO: 5651824 - DNA, 17 bp, Homo sapiens
tggccaaccaggaccca

SEQ ID NO: 5651825 - DNA, 18 bp, Homo sapiens
tggccaaccaggacccag

SEQ ID NO: 5651826 - DNA, 20 bp, Homo sapiens
tggccaaccaggacccaggg

SEQ ID NO: 5651827 - DNA, 21 bp, Homo sapiens
tggccaaccaggacccagggt

SEQ ID NO: 5651828 - DNA, 19 bp, Homo sapiens
tggccaacgtggacctgcc

SEQ ID NO: 5651829 - DNA, 14 bp, Homo sapiens
tggccaactgcaaa

SEQ ID NO: 5651830 - DNA, 23 bp, Homo sapiens
tggccaactgcaaaaaaagcctc

SEQ ID NO: 5651831 - DNA, 15 bp, Homo sapiens
tggccaagagaaggg

SEQ ID NO: 5651832 - DNA, 14 bp, Homo sapiens
tggccaagcctgcc

SEQ ID NO: 5651833 - DNA, 15 bp, Homo sapiens
tggccaagcctgccc

SEQ ID NO: 5651834 - DNA, 16 bp, Homo sapiens
tggccaagcctgctgt

SEQ ID NO: 5651835 - DNA, 13 bp, Homo sapiens
tggccaagctgag

SEQ ID NO: 5651836 - DNA, 21 bp, Homo sapiens
tggccaagctgaggtgcccag

SEQ ID NO: 5651837 - DNA, 22 bp, Homo sapiens
tggccaaggagaggagttcttt

SEQ ID NO: 5651838 - DNA, 16 bp, Homo sapiens
tggccaaggagctgct

SEQ ID NO: 5651839 - DNA, 14 bp, Homo sapiens
tggccaagggccag

SEQ ID NO: 5651840 - DNA, 19 bp, Homo sapiens
tggccaaggggccagctgc

SEQ ID NO: 5651841 - DNA, 22 bp, Homo sapiens
tggccaaggggccagctgcccc

SEQ ID NO: 5651842 - DNA, 16 bp, Homo sapiens
tggccaagggggtgga

SEQ ID NO: 5651843 - DNA, 18 bp, Homo sapiens
tggccaagtgtacatttg

SEQ ID NO: 5651844 - DNA, 17 bp, Homo sapiens
tggccaattaaggcatc

SEQ ID NO: 5651845 - DNA, 14 bp, Homo sapiens
tggccaatttttgt

SEQ ID NO: 5651846 - DNA, 14 bp, Homo sapiens
tggccacaaattct

SEQ ID NO: 5651847 - DNA, 17 bp, Homo sapiens
tggccacaactgctgtg

SEQ ID NO: 5651848 - DNA, 20 bp, Homo sapiens
tggccacaactgctgtggcc

SEQ ID NO: 5651849 - DNA, 19 bp, Homo sapiens
tggccacaaggacgctggc

SEQ ID NO: 5651850 - DNA, 20 bp, Homo sapiens
tggccacaagttctttccca

SEQ ID NO: 5651851 - DNA, 23 bp, Homo sapiens
tggccacaagttctttcccagcc

SEQ ID NO: 5651852 - DNA, 22 bp, Homo sapiens
tggccacaatcctccccaccag

SEQ ID NO: 5651853 - DNA, 15 bp, Homo sapiens
tggccacacagcagc

SEQ ID NO: 5651854 - DNA, 18 bp, Homo sapiens
tggccacacaggcagggc

SEQ ID NO: 5651855 - DNA, 21 bp, Homo sapiens
tggccacacaggcagggcctg

SEQ ID NO: 5651856 - DNA, 23 bp, Homo sapiens
tggccacacaggcagggcctggc

SEQ ID NO: 5651857 - DNA, 12 bp, Homo sapiens
tggccacactgg

SEQ ID NO: 5651858 - DNA, 20 bp, Homo sapiens
tggccacactggaatccagt

SEQ ID NO: 5651859 - DNA, 15 bp, Homo sapiens
tggccacactggggc

SEQ ID NO: 5651860 - DNA, 19 bp, Homo sapiens
tggccacactggggctgac

SEQ ID NO: 5651861 - DNA, 12 bp, Homo sapiens
tggccacactgt

SEQ ID NO: 5651862 - DNA, 19 bp, Homo sapiens
tggccacactgtgacacac

SEQ ID NO: 5651863 - DNA, 14 bp, Homo sapiens
tggccacagcaccc

SEQ ID NO: 5651864 - DNA, 13 bp, Homo sapiens
tggccacagccac

SEQ ID NO: 5651865 - DNA, 16 bp, Homo sapiens
tggccacagccagggg

SEQ ID NO: 5651866 - DNA, 14 bp, Homo sapiens
tggccacagccccc

SEQ ID NO: 5651867 - DNA, 16 bp, Homo sapiens
tggccacagccccctt

SEQ ID NO: 5651868 - DNA, 14 bp, Homo sapiens
tggccacagccttc

SEQ ID NO: 5651869 - DNA, 13 bp, Homo sapiens
tggccacagcgcc

SEQ ID NO: 5651870 - DNA, 16 bp, Homo sapiens
tggccacagcgtgctg

SEQ ID NO: 5651871 - DNA, 20 bp, Homo sapiens
tggccacagtgtcactggtc

SEQ ID NO: 5651872 - DNA, 14 bp, Homo sapiens
tggccacatcagcc

SEQ ID NO: 5651873 - DNA, 21 bp, Homo sapiens
tggccacattttcagccaaag

SEQ ID NO: 5651874 - DNA, 23 bp, Homo sapiens
tggccaccacccaacctgtcctt

SEQ ID NO: 5651875 - DNA, 23 bp, Homo sapiens
tggccaccaccccccactctgtg

SEQ ID NO: 5651876 - DNA, 14 bp, Homo sapiens
tggccaccaggctg

SEQ ID NO: 5651877 - DNA, 11 bp, Homo sapiens
tggccaccagt

SEQ ID NO: 5651878 - DNA, 18 bp, Homo sapiens
tggccaccccagagtggg

SEQ ID NO: 5651879 - DNA, 19 bp, Homo sapiens
tggccaccccatctggctg

SEQ ID NO: 5651880 - DNA, 19 bp, Homo sapiens
tggccaccccttgctctct

SEQ ID NO: 5651881 - DNA, 20 bp, Homo sapiens
tggccaccccttgctctctg

SEQ ID NO: 5651882 - DNA, 22 bp, Homo sapiens
tggccacccgttctgctggcct

SEQ ID NO: 5651883 - DNA, 17 bp, Homo sapiens
tggccaccgggggtggc

SEQ ID NO: 5651884 - DNA, 15 bp, Homo sapiens
tggccacctctctcc

SEQ ID NO: 5651885 - DNA, 20 bp, Homo sapiens
tggccacctgaggtgggccc

SEQ ID NO: 5651886 - DNA, 21 bp, Homo sapiens
tggccacctgaggtgggccca

SEQ ID NO: 5651887 - DNA, 12 bp, Homo sapiens
tggccacctgcc

SEQ ID NO: 5651888 - DNA, 23 bp, Homo sapiens
tggccacctgccaggcctccctc

SEQ ID NO: 5651889 - DNA, 14 bp, Homo sapiens
tggccaccttgctt

SEQ ID NO: 5651890 - DNA, 16 bp, Homo sapiens
tggccaccttgcttga

SEQ ID NO: 5651891 - DNA, 18 bp, Homo sapiens
tggccaccttgcttgagg

SEQ ID NO: 5651892 - DNA, 17 bp, Homo sapiens
tggccaccttttcagcg

SEQ ID NO: 5651893 - DNA, 16 bp, Homo sapiens
tggccacgcagccagg

SEQ ID NO: 5651894 - DNA, 17 bp, Homo sapiens
tggccacgcagccagga

SEQ ID NO: 5651895 - DNA, 20 bp, Homo sapiens
tggccacgcagccaggacac

SEQ ID NO: 5651896 - DNA, 18 bp, Homo sapiens
tggccacggcctgggagg

SEQ ID NO: 5651897 - DNA, 22 bp, Homo sapiens
tggccacggcctgggagggtgg

SEQ ID NO: 5651898 - DNA, 18 bp, Homo sapiens
tggccacgggggcagtgt

SEQ ID NO: 5651899 - DNA, 19 bp, Homo sapiens
tggccacgggggcagtgtg

SEQ ID NO: 5651900 - DNA, 17 bp, Homo sapiens
tggccacgttcagggag

SEQ ID NO: 5651901 - DNA, 22 bp, Homo sapiens
tggccacgttcagggaggggcc

SEQ ID NO: 5651902 - DNA, 18 bp, Homo sapiens
tggccactaaagcttcag

SEQ ID NO: 5651903 - DNA, 20 bp, Homo sapiens
tggccactatcacatatgct

SEQ ID NO: 5651904 - DNA, 13 bp, Homo sapiens
tggccactcagct

SEQ ID NO: 5651905 - DNA, 17 bp, Homo sapiens
tggccactccagacccc

SEQ ID NO: 5651906 - DNA, 22 bp, Homo sapiens
tggccactccagacccctggct

SEQ ID NO: 5651907 - DNA, 14 bp, Homo sapiens
tggccactccgaga

SEQ ID NO: 5651908 - DNA, 18 bp, Homo sapiens
tggccactccgagaggtg

SEQ ID NO: 5651909 - DNA, 20 bp, Homo sapiens
tggccactccgagaggtggg

SEQ ID NO: 5651910 - DNA, 14 bp, Homo sapiens
tggccactcctggg

SEQ ID NO: 5651911 - DNA, 18 bp, Homo sapiens
tggccactctgctctgca

SEQ ID NO: 5651912 - DNA, 14 bp, Homo sapiens
tggccactgagctg

SEQ ID NO: 5651913 - DNA, 19 bp, Homo sapiens
tggccactgagctggctga

SEQ ID NO: 5651914 - DNA, 19 bp, Homo sapiens
tggccactgctccctaagc

SEQ ID NO: 5651915 - DNA, 20 bp, Homo sapiens
tggccactgctccctaagcc

SEQ ID NO: 5651916 - DNA, 14 bp, Homo sapiens
tggccactgctgga

SEQ ID NO: 5651917 - DNA, 17 bp, Homo sapiens
tggccactgctggaggc

SEQ ID NO: 5651918 - DNA, 19 bp, Homo sapiens
tggccactggatcctgctg

SEQ ID NO: 5651919 - DNA, 18 bp, Homo sapiens
tggccactggcacttgcc

SEQ ID NO: 5651920 - DNA, 13 bp, Homo sapiens
tggccactggccc

SEQ ID NO: 5651921 - DNA, 21 bp, Homo sapiens
tggccactggggtgccttcac

SEQ ID NO: 5651922 - DNA, 15 bp, Homo sapiens
tggccactgtatttg

SEQ ID NO: 5651923 - DNA, 15 bp, Homo sapiens
tggccactgtcaagg

SEQ ID NO: 5651924 - DNA, 21 bp, Homo sapiens
tggccacttcattccagcagc

SEQ ID NO: 5651925 - DNA, 18 bp, Homo sapiens
tggcctagaccagcagac

SEQ ID NO: 5651926 - DNA, 22 bp, Homo sapiens
tggcctagacttgtgtgttcta

SEQ ID NO: 5651927 - DNA, 20 bp, Homo sapiens
tggcctagcccaccctgctg

SEQ ID NO: 5651928 - DNA, 22 bp, Homo sapiens
tggcctagcccaccctgctgcc

SEQ ID NO: 5651929 - DNA, 21 bp, Homo sapiens
tggcctaggagatatctgagg

SEQ ID NO: 5651930 - DNA, 17 bp, Homo sapiens
tggcctaggatcttcac

SEQ ID NO: 5651931 - DNA, 16 bp, Homo sapiens
tggcctatctcctagg

SEQ ID NO: 5651932 - DNA, 17 bp, Homo sapiens
tggcctatctcctaggg

SEQ ID NO: 5651933 - DNA, 11 bp, Homo sapiens
tggcctatgaa

SEQ ID NO: 5651934 - DNA, 15 bp, Homo sapiens
tggcctatgaccctg

SEQ ID NO: 5651935 - DNA, 22 bp, Homo sapiens
tggcctatgaccctgtgcctgt

SEQ ID NO: 5651936 - DNA, 17 bp, Homo sapiens
tggcctatgcacatatg

SEQ ID NO: 5651937 - DNA, 20 bp, Homo sapiens
tggcctatgcacatatggac

SEQ ID NO: 5651938 - DNA, 20 bp, Homo sapiens
tggcctatgtgcgaagcaag

SEQ ID NO: 5651939 - DNA, 20 bp, Homo sapiens
tggcctattatattaaaata

SEQ ID NO: 5651940 - DNA, 14 bp, Homo sapiens
tggcctatttaagc

SEQ ID NO: 5651941 - DNA, 19 bp, Homo sapiens
tggcctcaaaacagaagca

SEQ ID NO: 5651942 - DNA, 15 bp, Homo sapiens
tggcctcaaccctcc

SEQ ID NO: 5651943 - DNA, 17 bp, Homo sapiens
tggcctcaaccctccct

SEQ ID NO: 5651944 - DNA, 18 bp, Homo sapiens
tggcctcaaccctccctc

SEQ ID NO: 5651945 - DNA, 20 bp, Homo sapiens
tggcctcaaccctccctcag

SEQ ID NO: 5651946 - DNA, 23 bp, Homo sapiens
tggcctcaaccctccctcagccc

SEQ ID NO: 5651947 - DNA, 19 bp, Homo sapiens
tggcctcaagagcacacag

SEQ ID NO: 5651948 - DNA, 20 bp, Homo sapiens
tggcctcaagcgatcctcct

SEQ ID NO: 5651949 - DNA, 23 bp, Homo sapiens
tggcctcaagtgattctcctgcc

SEQ ID NO: 5651950 - DNA, 22 bp, Homo sapiens
tggcctcacccacccctgcaca

SEQ ID NO: 5651951 - DNA, 22 bp, Homo sapiens
tggcctcacctgggttccccac

SEQ ID NO: 5651952 - DNA, 15 bp, Homo sapiens
tggcctcactggctg

SEQ ID NO: 5651953 - DNA, 19 bp, Homo sapiens
tggcctcactggctggggc

SEQ ID NO: 5651954 - DNA, 18 bp, Homo sapiens
tggcctcacttccctggg

SEQ ID NO: 5651955 - DNA, 19 bp, Homo sapiens
tggcctcacttccctggga

SEQ ID NO: 5651956 - DNA, 21 bp, Homo sapiens
tggcctcacttccctgggaac

SEQ ID NO: 5651957 - DNA, 23 bp, Homo sapiens
tggcctcacttgattcatctctg

SEQ ID NO: 5651958 - DNA, 17 bp, Homo sapiens
tggcctcagaattcaca

SEQ ID NO: 5651959 - DNA, 13 bp, Homo sapiens
tggcctcagacca

SEQ ID NO: 5651960 - DNA, 16 bp, Homo sapiens
tggcctcagaccaact

SEQ ID NO: 5651961 - DNA, 17 bp, Homo sapiens
tggcctcagactgcacc

SEQ ID NO: 5651962 - DNA, 24 bp, Homo sapiens
tggcctcagactgcacccaggagg

SEQ ID NO: 5651963 - DNA, 14 bp, Homo sapiens
tggcctcagagctt

SEQ ID NO: 5651964 - DNA, 17 bp, Homo sapiens
tggcctcagagcttcct

SEQ ID NO: 5651965 - DNA, 15 bp, Homo sapiens
tggcctcagcagaag

SEQ ID NO: 5651966 - DNA, 12 bp, Homo sapiens
tggcctcagcat

SEQ ID NO: 5651967 - DNA, 16 bp, Homo sapiens
tggcctcagccagctg

SEQ ID NO: 5651968 - DNA, 19 bp, Homo sapiens
tggcctcagccagctgccc

SEQ ID NO: 5651969 - DNA, 22 bp, Homo sapiens
tggcctcagccctgctccctgc

SEQ ID NO: 5651970 - DNA, 19 bp, Homo sapiens
tggcctcagctcccacaag

SEQ ID NO: 5651971 - DNA, 22 bp, Homo sapiens
tggcctcagctgaatgcctcct

SEQ ID NO: 5651972 - DNA, 14 bp, Homo sapiens
tggcctcagctgcc

SEQ ID NO: 5651973 - DNA, 16 bp, Homo sapiens
tggcctcagctgcctc

SEQ ID NO: 5651974 - DNA, 16 bp, Homo sapiens
tggcctcagctggctg

SEQ ID NO: 5651975 - DNA, 17 bp, Homo sapiens
tggcctcagctggctgt

SEQ ID NO: 5651976 - DNA, 14 bp, Homo sapiens
tggcctcaggaggc

SEQ ID NO: 5651977 - DNA, 18 bp, Homo sapiens
tggcctcagggccaggaa

SEQ ID NO: 5651978 - DNA, 19 bp, Homo sapiens
tggcctcagggccaggaag

SEQ ID NO: 5651979 - DNA, 15 bp, Homo sapiens
tggcctcagggctct

SEQ ID NO: 5651980 - DNA, 20 bp, Homo sapiens
tggcctcagttcccagctcc

SEQ ID NO: 5651981 - DNA, 20 bp, Homo sapiens
tggcctcatctcagaccctg

SEQ ID NO: 5651982 - DNA, 16 bp, Homo sapiens
tggcctcatctctgcc

SEQ ID NO: 5651983 - DNA, 19 bp, Homo sapiens
tggcctcatctctgcctga

SEQ ID NO: 5651984 - DNA, 18 bp, Homo sapiens
tggcctcatgtggctgga

SEQ ID NO: 5651985 - DNA, 19 bp, Homo sapiens
tggcctcatgtggctggaa

SEQ ID NO: 5651986 - DNA, 20 bp, Homo sapiens
tggcctccaaaatattaaca

SEQ ID NO: 5651987 - DNA, 19 bp, Homo sapiens
tggcctccacacttgctct

SEQ ID NO: 5651988 - DNA, 18 bp, Homo sapiens
tggcctccagctgttctt

SEQ ID NO: 5651989 - DNA, 21 bp, Homo sapiens
tggcctccaggcccgtctgtc

SEQ ID NO: 5651990 - DNA, 23 bp, Homo sapiens
tggcctccaggcccgtctgtcca

SEQ ID NO: 5651991 - DNA, 13 bp, Homo sapiens
tggcctccagggc

SEQ ID NO: 5651992 - DNA, 20 bp, Homo sapiens
tggcctccagggcgcagggg

SEQ ID NO: 5651993 - DNA, 12 bp, Homo sapiens
tggcctccagtc

SEQ ID NO: 5651994 - DNA, 14 bp, Homo sapiens
tggcctccatttct

SEQ ID NO: 5651995 - DNA, 18 bp, Homo sapiens
tggcctccatttctgtct

SEQ ID NO: 5651996 - DNA, 21 bp, Homo sapiens
tggcctcccaaagtgctggga

SEQ ID NO: 5651997 - DNA, 14 bp, Homo sapiens
tggcctcccaactc

SEQ ID NO: 5651998 - DNA, 19 bp, Homo sapiens
tggcctcccaactcacccc

SEQ ID NO: 5651999 - DNA, 21 bp, Homo sapiens
tggcctcccacccgatgctgc

SEQ ID NO: 5652000 - DNA, 16 bp, Homo sapiens
tggcctcccagccacc

SEQ ID NO: 5652001 - DNA, 18 bp, Homo sapiens
tggcctcccagccacccg

SEQ ID NO: 5652002 - DNA, 23 bp, Homo sapiens
tggcctccccatgggcacagtgg

SEQ ID NO: 5652003 - DNA, 22 bp, Homo sapiens
tggcctcccccaacacctgctg

SEQ ID NO: 5652004 - DNA, 15 bp, Homo sapiens
tggcctcccccactt

SEQ ID NO: 5652005 - DNA, 19 bp, Homo sapiens
tggcctcccctgccaccag

SEQ ID NO: 5652006 - DNA, 20 bp, Homo sapiens
tggcctcccctgccaccagg

SEQ ID NO: 5652007 - DNA, 16 bp, Homo sapiens
tggcctccctccgtcc

SEQ ID NO: 5652008 - DNA, 12 bp, Homo sapiens
tggcctccctgc

SEQ ID NO: 5652009 - DNA, 13 bp, Homo sapiens
tggcctccctgct

SEQ ID NO: 5652010 - DNA, 14 bp, Homo sapiens
tggcctccctggct

SEQ ID NO: 5652011 - DNA, 15 bp, Homo sapiens
tggcctcccttctcc

SEQ ID NO: 5652012 - DNA, 16 bp, Homo sapiens
tggcctcccttctcct

SEQ ID NO: 5652013 - DNA, 19 bp, Homo sapiens
tggcctccgatgcctggcc

SEQ ID NO: 5652014 - DNA, 16 bp, Homo sapiens
tggcctccgcctgggt

SEQ ID NO: 5652015 - DNA, 20 bp, Homo sapiens
tggcctccggcgtcagcctc

SEQ ID NO: 5652016 - DNA, 20 bp, Homo sapiens
tggcctcctaaggctcccca

SEQ ID NO: 5652017 - DNA, 13 bp, Homo sapiens
tggcctcctggcc

SEQ ID NO: 5652018 - DNA, 14 bp, Homo sapiens
tggcctcctggccc

SEQ ID NO: 5652019 - DNA, 19 bp, Homo sapiens
tggcctcctgggggcccat

SEQ ID NO: 5652020 - DNA, 17 bp, Homo sapiens
tggcctcgcctggcctg

SEQ ID NO: 5652021 - DNA, 17 bp, Homo sapiens
tggcctcgcctgggccc

SEQ ID NO: 5652022 - DNA, 21 bp, Homo sapiens
tggcctcgcctgggcccaggc

SEQ ID NO: 5652023 - DNA, 22 bp, Homo sapiens
tggcctcgcctgggcccaggct

SEQ ID NO: 5652024 - DNA, 16 bp, Homo sapiens
tggcctcggggcaggg

SEQ ID NO: 5652025 - DNA, 21 bp, Homo sapiens
tggcctcgtgaggggcaagct

SEQ ID NO: 5652026 - DNA, 15 bp, Homo sapiens
tggcctctctccact

SEQ ID NO: 5652027 - DNA, 13 bp, Homo sapiens
tggcctctctctc

SEQ ID NO: 5652028 - DNA, 17 bp, Homo sapiens
tggcctctgcactcccc

SEQ ID NO: 5652029 - DNA, 21 bp, Homo sapiens
tggcctctgcccctcttccct

SEQ ID NO: 5652030 - DNA, 21 bp, Homo sapiens
tggcctctgctgatcctccca

SEQ ID NO: 5652031 - DNA, 14 bp, Homo sapiens
tggcctctgctggt

SEQ ID NO: 5652032 - DNA, 18 bp, Homo sapiens
tggcctctgctggtctct

SEQ ID NO: 5652033 - DNA, 23 bp, Homo sapiens
tggcctctgctggtctctggctc

SEQ ID NO: 5652034 - DNA, 14 bp, Homo sapiens
tggcctctgctttc

SEQ ID NO: 5652035 - DNA, 16 bp, Homo sapiens
tggcctctggcctggg

SEQ ID NO: 5652036 - DNA, 17 bp, Homo sapiens
tggcctctggcctggga

SEQ ID NO: 5652037 - DNA, 17 bp, Homo sapiens
tggcctctgtaccgccc

SEQ ID NO: 5652038 - DNA, 20 bp, Homo sapiens
tggcctctgtgattacatag

SEQ ID NO: 5652039 - DNA, 17 bp, Homo sapiens
tggcctcttgagcagtg

SEQ ID NO: 5652040 - DNA, 22 bp, Homo sapiens
tggcctcttgagcagtggctgg

SEQ ID NO: 5652041 - DNA, 15 bp, Homo sapiens
tggcctcttggcacc

SEQ ID NO: 5652042 - DNA, 20 bp, Homo sapiens
tggcctcttggcacctgcct

SEQ ID NO: 5652043 - DNA, 13 bp, Homo sapiens
tggcctcttggct

SEQ ID NO: 5652044 - DNA, 18 bp, Homo sapiens
tggcctcttgtagtcttg

SEQ ID NO: 5652045 - DNA, 19 bp, Homo sapiens
tggcctcttgtcccttggc

SEQ ID NO: 5652046 - DNA, 19 bp, Homo sapiens
tggcctgaaccacaggaga

SEQ ID NO: 5652047 - DNA, 16 bp, Homo sapiens
tggcctgaactgagga

SEQ ID NO: 5652048 - DNA, 18 bp, Homo sapiens
tggcctgaactgaggaga

SEQ ID NO: 5652049 - DNA, 17 bp, Homo sapiens
tggcctgacacaatggt

SEQ ID NO: 5652050 - DNA, 16 bp, Homo sapiens
tggcctgactcccatg

SEQ ID NO: 5652051 - DNA, 17 bp, Homo sapiens
tggcctgactcccccag

SEQ ID NO: 5652052 - DNA, 21 bp, Homo sapiens
tggcctgactggttgtcagaa

SEQ ID NO: 5652053 - DNA, 15 bp, Homo sapiens
tggcctgagaagagt

SEQ ID NO: 5652054 - DNA, 20 bp, Homo sapiens
tggcctgagaattgagggga

SEQ ID NO: 5652055 - DNA, 15 bp, Homo sapiens
tggcctgagagggga

SEQ ID NO: 5652056 - DNA, 23 bp, Homo sapiens
tggcctgagcgcagcgcctccac

SEQ ID NO: 5652057 - DNA, 18 bp, Homo sapiens
tggcctgagctgggatga

SEQ ID NO: 5652058 - DNA, 12 bp, Homo sapiens
tggcctgaggag

SEQ ID NO: 5652059 - DNA, 15 bp, Homo sapiens
tggcctgaggagcag

SEQ ID NO: 5652060 - DNA, 19 bp, Homo sapiens
tggcctgcaaactgggaac

SEQ ID NO: 5652061 - DNA, 20 bp, Homo sapiens
tggcctgcaaactgggaacc

SEQ ID NO: 5652062 - DNA, 23 bp, Homo sapiens
tggcctgcaaactgggaacccct

SEQ ID NO: 5652063 - DNA, 14 bp, Homo sapiens
tggcctgcaggggc

SEQ ID NO: 5652064 - DNA, 20 bp, Homo sapiens
tggcctgcataggctccttc

SEQ ID NO: 5652065 - DNA, 20 bp, Homo sapiens
tggcctgccaccctcctgcg

SEQ ID NO: 5652066 - DNA, 17 bp, Homo sapiens
tggcctgccagtctgcc

SEQ ID NO: 5652067 - DNA, 15 bp, Homo sapiens
tggcctgccatgcca

SEQ ID NO: 5652068 - DNA, 16 bp, Homo sapiens
tggcctgcccagcctc

SEQ ID NO: 5652069 - DNA, 14 bp, Homo sapiens
tggcctgcccgtgc

SEQ ID NO: 5652070 - DNA, 22 bp, Homo sapiens
tggcctgcccgtgccctggtga

SEQ ID NO: 5652071 - DNA, 17 bp, Homo sapiens
tggcctgcgcctgcacc

SEQ ID NO: 5652072 - DNA, 13 bp, Homo sapiens
tggcctgcgggga

SEQ ID NO: 5652073 - DNA, 22 bp, Homo sapiens
tggcctgctgcgccccaggccc

SEQ ID NO: 5652074 - DNA, 15 bp, Homo sapiens
tggcctgctggatgt

SEQ ID NO: 5652075 - DNA, 12 bp, Homo sapiens
tggcctgctggg

SEQ ID NO: 5652076 - DNA, 22 bp, Homo sapiens
tggcctgctgggaaccccgcag

SEQ ID NO: 5652077 - DNA, 20 bp, Homo sapiens
tggcctggaatttgggcaga

SEQ ID NO: 5652078 - DNA, 21 bp, Homo sapiens
tggcctggaatttgggcagat

SEQ ID NO: 5652079 - DNA, 15 bp, Homo sapiens
tggcctggacagtat

SEQ ID NO: 5652080 - DNA, 22 bp, Homo sapiens
tggcctggactgactgcagccc

SEQ ID NO: 5652081 - DNA, 12 bp, Homo sapiens
tggcctggagca

SEQ ID NO: 5652082 - DNA, 23 bp, Homo sapiens
tggcctggagcacaaagaccctg

SEQ ID NO: 5652083 - DNA, 13 bp, Homo sapiens
tggcctggagcag

SEQ ID NO: 5652084 - DNA, 14 bp, Homo sapiens
tggcctggagcagg

SEQ ID NO: 5652085 - DNA, 15 bp, Homo sapiens
tggcctggagcaggc

SEQ ID NO: 5652086 - DNA, 17 bp, Homo sapiens
tggcctggagcaggccc

SEQ ID NO: 5652087 - DNA, 14 bp, Homo sapiens
tggcctggaggctc

SEQ ID NO: 5652088 - DNA, 18 bp, Homo sapiens
tggcctggaggtggggtt

SEQ ID NO: 5652089 - DNA, 19 bp, Homo sapiens
tggcctggatccatcctgc

SEQ ID NO: 5652090 - DNA, 20 bp, Homo sapiens
tggcctggatccatcctgct

SEQ ID NO: 5652091 - DNA, 16 bp, Homo sapiens
tggcctggcaaaataa

SEQ ID NO: 5652092 - DNA, 18 bp, Homo sapiens
tggcctggcatctgtgtg

SEQ ID NO: 5652093 - DNA, 17 bp, Homo sapiens
tggcctggccaggagct

SEQ ID NO: 5652094 - DNA, 21 bp, Homo sapiens
tggcctggccaggagctcttc

SEQ ID NO: 5652095 - DNA, 13 bp, Homo sapiens
tggcctggccatc

SEQ ID NO: 5652096 - DNA, 16 bp, Homo sapiens
tggcctggccctcctg

SEQ ID NO: 5652097 - DNA, 17 bp, Homo sapiens
tggcctggccctcctgg

SEQ ID NO: 5652098 - DNA, 15 bp, Homo sapiens
tggcctggccctgcc

SEQ ID NO: 5652099 - DNA, 20 bp, Homo sapiens
tggcctggccctgccctgag

SEQ ID NO: 5652100 - DNA, 16 bp, Homo sapiens
tggcctggccggcaac

SEQ ID NO: 5652101 - DNA, 16 bp, Homo sapiens
tggctgattcagcatt

SEQ ID NO: 5652102 - DNA, 19 bp, Homo sapiens
tggctgattggaaaataat

SEQ ID NO: 5652103 - DNA, 23 bp, Homo sapiens
tggctgattggaaaataataaaa

SEQ ID NO: 5652104 - DNA, 21 bp, Homo sapiens
tggctgatttactaacagtaa

SEQ ID NO: 5652105 - DNA, 14 bp, Homo sapiens
tggctgatttcaaa

SEQ ID NO: 5652106 - DNA, 22 bp, Homo sapiens
tggctgcaaataaggacagcag

SEQ ID NO: 5652107 - DNA, 23 bp, Homo sapiens
tggctgcaaataaggacagcagc

SEQ ID NO: 5652108 - DNA, 18 bp, Homo sapiens
tggctgcaagcccacctc

SEQ ID NO: 5652109 - DNA, 16 bp, Homo sapiens
tggctgcaagcgcact

SEQ ID NO: 5652110 - DNA, 21 bp, Homo sapiens
tggctgcacagaagggctctt

SEQ ID NO: 5652111 - DNA, 15 bp, Homo sapiens
tggctgcacagccca

SEQ ID NO: 5652112 - DNA, 21 bp, Homo sapiens
tggctgcacagcccaaccagg

SEQ ID NO: 5652113 - DNA, 13 bp, Homo sapiens
tggctgcacaggc

SEQ ID NO: 5652114 - DNA, 15 bp, Homo sapiens
tggctgcacaggctg

SEQ ID NO: 5652115 - DNA, 23 bp, Homo sapiens
tggctgcacgtaggttccccaga

SEQ ID NO: 5652116 - DNA, 15 bp, Homo sapiens
tggctgcagagacct

SEQ ID NO: 5652117 - DNA, 21 bp, Homo sapiens
tggctgcagcagcggtggcct

SEQ ID NO: 5652118 - DNA, 13 bp, Homo sapiens
tggctgcagcctc

SEQ ID NO: 5652119 - DNA, 15 bp, Homo sapiens
tggctgcagcctcag

SEQ ID NO: 5652120 - DNA, 23 bp, Homo sapiens
tggctgcagcctcaggactggga

SEQ ID NO: 5652121 - DNA, 20 bp, Homo sapiens
tggctgcagcggcaggaccg

SEQ ID NO: 5652122 - DNA, 12 bp, Homo sapiens
tggctgcagctg

SEQ ID NO: 5652123 - DNA, 18 bp, Homo sapiens
tggctgcagctgggcagc

SEQ ID NO: 5652124 - DNA, 20 bp, Homo sapiens
tggctgcaggaagaaacttt

SEQ ID NO: 5652125 - DNA, 14 bp, Homo sapiens
tggctgcagggagt

SEQ ID NO: 5652126 - DNA, 15 bp, Homo sapiens
tggctgcagggagtc

SEQ ID NO: 5652127 - DNA, 11 bp, Homo sapiens
tggctgcaggt

SEQ ID NO: 5652128 - DNA, 15 bp, Homo sapiens
tggctgcaggtggga

SEQ ID NO: 5652129 - DNA, 20 bp, Homo sapiens
tggctgcatcccccccacct

SEQ ID NO: 5652130 - DNA, 14 bp, Homo sapiens
tggctgccagctat

SEQ ID NO: 5652131 - DNA, 19 bp, Homo sapiens
tggctgccagcttgtgagc

SEQ ID NO: 5652132 - DNA, 11 bp, Homo sapiens
tggctgccagg

SEQ ID NO: 5652133 - DNA, 13 bp, Homo sapiens
tggctgccaggcg

SEQ ID NO: 5652134 - DNA, 22 bp, Homo sapiens
tggctgccaggcgttggtgcca

SEQ ID NO: 5652135 - DNA, 13 bp, Homo sapiens
tggctgccagggg

SEQ ID NO: 5652136 - DNA, 18 bp, Homo sapiens
tggctgccccattccagc

SEQ ID NO: 5652137 - DNA, 18 bp, Homo sapiens
tggctgccccggcctcct

SEQ ID NO: 5652138 - DNA, 20 bp, Homo sapiens
tggctgcccctcaccttggg

SEQ ID NO: 5652139 - DNA, 21 bp, Homo sapiens
tggctgccccttgctggacct

SEQ ID NO: 5652140 - DNA, 11 bp, Homo sapiens
tggctgccctc

SEQ ID NO: 5652141 - DNA, 14 bp, Homo sapiens
tggctgccctggcc

SEQ ID NO: 5652142 - DNA, 15 bp, Homo sapiens
tggctgccctggccc

SEQ ID NO: 5652143 - DNA, 17 bp, Homo sapiens
tggctgccctggccctg

SEQ ID NO: 5652144 - DNA, 16 bp, Homo sapiens
tggctgcctccactcc

SEQ ID NO: 5652145 - DNA, 21 bp, Homo sapiens
tggctgcctggcccagggagg

SEQ ID NO: 5652146 - DNA, 17 bp, Homo sapiens
tggctgccttctttcca

SEQ ID NO: 5652147 - DNA, 16 bp, Homo sapiens
tggctgcgctaacccc

SEQ ID NO: 5652148 - DNA, 16 bp, Homo sapiens
tggctgcggcaccctt

SEQ ID NO: 5652149 - DNA, 22 bp, Homo sapiens
tggctgcggggcgggcacacct

SEQ ID NO: 5652150 - DNA, 17 bp, Homo sapiens
tggctgctagattttaa

SEQ ID NO: 5652151 - DNA, 14 bp, Homo sapiens
tggctgctaggcca

SEQ ID NO: 5652152 - DNA, 15 bp, Homo sapiens
tggctgctaggccag

SEQ ID NO: 5652153 - DNA, 12 bp, Homo sapiens
tggctgctccct

SEQ ID NO: 5652154 - DNA, 14 bp, Homo sapiens
tggctgctccctgc

SEQ ID NO: 5652155 - DNA, 15 bp, Homo sapiens
tggctgctctcatgc

SEQ ID NO: 5652156 - DNA, 16 bp, Homo sapiens
tggctgctctccatct

SEQ ID NO: 5652157 - DNA, 11 bp, Homo sapiens
tggctgctctg

SEQ ID NO: 5652158 - DNA, 14 bp, Homo sapiens
tggctgctctggga

SEQ ID NO: 5652159 - DNA, 15 bp, Homo sapiens
tggctgctctgggaa

SEQ ID NO: 5652160 - DNA, 11 bp, Homo sapiens
tggctgctgaa

SEQ ID NO: 5652161 - DNA, 12 bp, Homo sapiens
tggctgctgaag

SEQ ID NO: 5652162 - DNA, 21 bp, Homo sapiens
tggctgctgaagctgcctgct

SEQ ID NO: 5652163 - DNA, 22 bp, Homo sapiens
tggctgctgaagctgcctgctt

SEQ ID NO: 5652164 - DNA, 13 bp, Homo sapiens
tggctgctgaagg

SEQ ID NO: 5652165 - DNA, 14 bp, Homo sapiens
tggctgctgaaggc

SEQ ID NO: 5652166 - DNA, 14 bp, Homo sapiens
tggctgctgactga

SEQ ID NO: 5652167 - DNA, 21 bp, Homo sapiens
tggctgctgccatgtctcaga

SEQ ID NO: 5652168 - DNA, 12 bp, Homo sapiens
tggctgctgccc

SEQ ID NO: 5652169 - DNA, 16 bp, Homo sapiens
tggctgctgcctgctc

SEQ ID NO: 5652170 - DNA, 11 bp, Homo sapiens
tggctgctgcg

SEQ ID NO: 5652171 - DNA, 14 bp, Homo sapiens
tggctgctgcggct

SEQ ID NO: 5652172 - DNA, 19 bp, Homo sapiens
tggctgctgcggctgtggg

SEQ ID NO: 5652173 - DNA, 12 bp, Homo sapiens
tggctgctgctc

SEQ ID NO: 5652174 - DNA, 14 bp, Homo sapiens
tggctgctgctcac

SEQ ID NO: 5652175 - DNA, 14 bp, Homo sapiens
tggctgctggaggg

SEQ ID NO: 5652176 - DNA, 23 bp, Homo sapiens
tggctgctggcccacagctctgc

SEQ ID NO: 5652177 - DNA, 13 bp, Homo sapiens
tggctgctgggct

SEQ ID NO: 5652178 - DNA, 11 bp, Homo sapiens
tggctgcttca

SEQ ID NO: 5652179 - DNA, 15 bp, Homo sapiens
tggctgcttcaagga

SEQ ID NO: 5652180 - DNA, 12 bp, Homo sapiens
tggctgcttctc

SEQ ID NO: 5652181 - DNA, 15 bp, Homo sapiens
tggctgcttctctct

SEQ ID NO: 5652182 - DNA, 16 bp, Homo sapiens
tggctgcttgcagcca

SEQ ID NO: 5652183 - DNA, 20 bp, Homo sapiens
tggctgcttgcagccaggag

SEQ ID NO: 5652184 - DNA, 15 bp, Homo sapiens
tggctgcttggcctt

SEQ ID NO: 5652185 - DNA, 17 bp, Homo sapiens
tggctgctttgcctcta

SEQ ID NO: 5652186 - DNA, 18 bp, Homo sapiens
tggctggaaagcagagcc

SEQ ID NO: 5652187 - DNA, 23 bp, Homo sapiens
tggctggaaagcagagcctcctg

SEQ ID NO: 5652188 - DNA, 16 bp, Homo sapiens
tggctggaagggagga

SEQ ID NO: 5652189 - DNA, 16 bp, Homo sapiens
tggctggaattaaaac

SEQ ID NO: 5652190 - DNA, 19 bp, Homo sapiens
tggctggaattaaaacaaa

SEQ ID NO: 5652191 - DNA, 18 bp, Homo sapiens
tggctggaatttctgctg

SEQ ID NO: 5652192 - DNA, 21 bp, Homo sapiens
tggctggacccagccaggccc

SEQ ID NO: 5652193 - DNA, 22 bp, Homo sapiens
tggctggacccagccaggccca

SEQ ID NO: 5652194 - DNA, 23 bp, Homo sapiens
tggctggagacgggtgggcggct

SEQ ID NO: 5652195 - DNA, 18 bp, Homo sapiens
tggctggagatggctgct

SEQ ID NO: 5652196 - DNA, 23 bp, Homo sapiens
tggctggagatggctgctgctca

SEQ ID NO: 5652197 - DNA, 13 bp, Homo sapiens
tggctggagcccc

SEQ ID NO: 5652198 - DNA, 20 bp, Homo sapiens
tggctggagcggagatgagg

SEQ ID NO: 5652199 - DNA, 18 bp, Homo sapiens
tggctggagtctcagagc

SEQ ID NO: 5652200 - DNA, 22 bp, Homo sapiens
tggctggatgaaattttctaga

SEQ ID NO: 5652201 - DNA, 18 bp, Homo sapiens
tggctggatgtgcatctg

SEQ ID NO: 5652202 - DNA, 20 bp, Homo sapiens
tggctggatgtgcatctggc

SEQ ID NO: 5652203 - DNA, 23 bp, Homo sapiens
tggctggatgtgcatctggccta

SEQ ID NO: 5652204 - DNA, 21 bp, Homo sapiens
tggctggcaggcagttctaga

SEQ ID NO: 5652205 - DNA, 23 bp, Homo sapiens
tggctggcaggtgttgggacctg

SEQ ID NO: 5652206 - DNA, 15 bp, Homo sapiens
tggctggccactgca

SEQ ID NO: 5652207 - DNA, 15 bp, Homo sapiens
tggctggccaggaca

SEQ ID NO: 5652208 - DNA, 21 bp, Homo sapiens
tggctggccttccacttggct

SEQ ID NO: 5652209 - DNA, 23 bp, Homo sapiens
tggctggccttgtggtccaaata

SEQ ID NO: 5652210 - DNA, 21 bp, Homo sapiens
tggctggctcctaggggaaga

SEQ ID NO: 5652211 - DNA, 11 bp, Homo sapiens
tggctggctct

SEQ ID NO: 5652212 - DNA, 14 bp, Homo sapiens
tggctggctgaggg

SEQ ID NO: 5652213 - DNA, 23 bp, Homo sapiens
tggctggcttgtttgatttcaac

SEQ ID NO: 5652214 - DNA, 22 bp, Homo sapiens
tggctgggaacatgacccagcc

SEQ ID NO: 5652215 - DNA, 20 bp, Homo sapiens
tggctgggaagactatggtg

SEQ ID NO: 5652216 - DNA, 11 bp, Homo sapiens
tggctgggacc

SEQ ID NO: 5652217 - DNA, 23 bp, Homo sapiens
tggctgggacgtggctcagccag

SEQ ID NO: 5652218 - DNA, 12 bp, Homo sapiens
tggctgggaggg

SEQ ID NO: 5652219 - DNA, 19 bp, Homo sapiens
tggctgggagggggccctt

SEQ ID NO: 5652220 - DNA, 10 bp, Homo sapiens
tggctgggca

SEQ ID NO: 5652221 - DNA, 20 bp, Homo sapiens
tggctgggcaaaagaatgtt

SEQ ID NO: 5652222 - DNA, 20 bp, Homo sapiens
tggctgggcagagctgcatc

SEQ ID NO: 5652223 - DNA, 13 bp, Homo sapiens
tggctgggcccag

SEQ ID NO: 5652224 - DNA, 15 bp, Homo sapiens
tggctgggcccagca

SEQ ID NO: 5652225 - DNA, 12 bp, Homo sapiens
tggctgggcccc

SEQ ID NO: 5652226 - DNA, 14 bp, Homo sapiens
tggctgggcccctg

SEQ ID NO: 5652227 - DNA, 22 bp, Homo sapiens
tggctgggcccctggggacaga

SEQ ID NO: 5652228 - DNA, 15 bp, Homo sapiens
tggctgggctacaat

SEQ ID NO: 5652229 - DNA, 18 bp, Homo sapiens
tggctgggctctggtggg

SEQ ID NO: 5652230 - DNA, 13 bp, Homo sapiens
tggctgggctgct

SEQ ID NO: 5652231 - DNA, 20 bp, Homo sapiens
tggctgggctggctgaagaa

SEQ ID NO: 5652232 - DNA, 17 bp, Homo sapiens
tggctggggaggaccag

SEQ ID NO: 5652233 - DNA, 12 bp, Homo sapiens
tggctggggatg

SEQ ID NO: 5652234 - DNA, 17 bp, Homo sapiens
tggctggggccgctggg

SEQ ID NO: 5652235 - DNA, 21 bp, Homo sapiens
tggctggggcctatcagtgtg

SEQ ID NO: 5652236 - DNA, 15 bp, Homo sapiens
tggctggggctggca

SEQ ID NO: 5652237 - DNA, 17 bp, Homo sapiens
tggctgggggactgctt

SEQ ID NO: 5652238 - DNA, 16 bp, Homo sapiens
tggctgggggagggac

SEQ ID NO: 5652239 - DNA, 14 bp, Homo sapiens
tggctgggggcagg

SEQ ID NO: 5652240 - DNA, 16 bp, Homo sapiens
tggctgggggcaggag

SEQ ID NO: 5652241 - DNA, 17 bp, Homo sapiens
tggctgggggcaggagg

SEQ ID NO: 5652242 - DNA, 12 bp, Homo sapiens
tggctgggggcc

SEQ ID NO: 5652243 - DNA, 17 bp, Homo sapiens
tggctgggggcctcagt

SEQ ID NO: 5652244 - DNA, 16 bp, Homo sapiens
tggctggggtggcctg

SEQ ID NO: 5652245 - DNA, 21 bp, Homo sapiens
tggctggggtggcctgtgtgg

SEQ ID NO: 5652246 - DNA, 19 bp, Homo sapiens
tggctgggtcagggccaga

SEQ ID NO: 5652247 - DNA, 23 bp, Homo sapiens
tggctgggtcagggccagactgg

SEQ ID NO: 5652248 - DNA, 18 bp, Homo sapiens
tggctgggtccttgggcc

SEQ ID NO: 5652249 - DNA, 15 bp, Homo sapiens
tggctgggtgccctc

SEQ ID NO: 5652250 - DNA, 19 bp, Homo sapiens
tggctgggtgccctctcag

SEQ ID NO: 5652251 - DNA, 11 bp, Homo sapiens
tggctgggtgg

SEQ ID NO: 5652252 - DNA, 16 bp, Homo sapiens
tggctgggtggtcagc

SEQ ID NO: 5652253 - DNA, 17 bp, Homo sapiens
tggctgggtttgggcag

SEQ ID NO: 5652254 - DNA, 22 bp, Homo sapiens
tggctggtaacagttcatgttt

SEQ ID NO: 5652255 - DNA, 23 bp, Homo sapiens
tggctggtagaaaaaggggcctg

SEQ ID NO: 5652256 - DNA, 18 bp, Homo sapiens
tggctggtagcagcaggc

SEQ ID NO: 5652257 - DNA, 22 bp, Homo sapiens
tggctggtcaacttgagcatgt

SEQ ID NO: 5652258 - DNA, 16 bp, Homo sapiens
tggctggtcctcccat

SEQ ID NO: 5652259 - DNA, 16 bp, Homo sapiens
tggctggtctggagtc

SEQ ID NO: 5652260 - DNA, 23 bp, Homo sapiens
tggctggtctggagtcccacccg

SEQ ID NO: 5652261 - DNA, 23 bp, Homo sapiens
tggctggtcttcactttcctcag

SEQ ID NO: 5652262 - DNA, 17 bp, Homo sapiens
tggctggtgagaccccg

SEQ ID NO: 5652263 - DNA, 13 bp, Homo sapiens
tggctggtgccca

SEQ ID NO: 5652264 - DNA, 15 bp, Homo sapiens
tggctggtgcccatg

SEQ ID NO: 5652265 - DNA, 14 bp, Homo sapiens
tggctggtgggccc

SEQ ID NO: 5652266 - DNA, 14 bp, Homo sapiens
tggctggtgtatgc

SEQ ID NO: 5652267 - DNA, 12 bp, Homo sapiens
tggctggtgtcc

SEQ ID NO: 5652268 - DNA, 11 bp, Homo sapiens
tggctggtgtg

SEQ ID NO: 5652269 - DNA, 17 bp, Homo sapiens
tggctggtgtggtacag

SEQ ID NO: 5652270 - DNA, 21 bp, Homo sapiens
tggctggtgtggtacagagaa

SEQ ID NO: 5652271 - DNA, 22 bp, Homo sapiens
tggctggtgtggtacagagaag

SEQ ID NO: 5652272 - DNA, 12 bp, Homo sapiens
tggctggtgtta

SEQ ID NO: 5652273 - DNA, 16 bp, Homo sapiens
tggctggtgttaacag

SEQ ID NO: 5652274 - DNA, 18 bp, Homo sapiens
tggctggtgttaacagaa

SEQ ID NO: 5652275 - DNA, 20 bp, Homo sapiens
tggctggtgttaacagaagg

SEQ ID NO: 5652276 - DNA, 14 bp, Homo sapiens
tggctggtttctga

SEQ ID NO: 5652277 - DNA, 15 bp, Homo sapiens
tggctggtttctgag

SEQ ID NO: 5652278 - DNA, 11 bp, Homo sapiens
tggctgtaaaa

SEQ ID NO: 5652279 - DNA, 12 bp, Homo sapiens
tggctgtaaact

SEQ ID NO: 5652280 - DNA, 20 bp, Homo sapiens
tggctgtaaggctctagatc

SEQ ID NO: 5652281 - DNA, 16 bp, Homo sapiens
tgggaagacgttttct

SEQ ID NO: 5652282 - DNA, 21 bp, Homo sapiens
tgggaagactcaggagtctgc

SEQ ID NO: 5652283 - DNA, 22 bp, Homo sapiens
tgggaagactcctagctgtcct

SEQ ID NO: 5652284 - DNA, 12 bp, Homo sapiens
tgggaagagctg

SEQ ID NO: 5652285 - DNA, 12 bp, Homo sapiens
tgggaagaggac

SEQ ID NO: 5652286 - DNA, 16 bp, Homo sapiens
tgggaagaggacttcg

SEQ ID NO: 5652287 - DNA, 19 bp, Homo sapiens
tgggaagagggggctggcc

SEQ ID NO: 5652288 - DNA, 17 bp, Homo sapiens
tgggaagatggtttgaa

SEQ ID NO: 5652289 - DNA, 13 bp, Homo sapiens
tgggaagcaggac

SEQ ID NO: 5652290 - DNA, 15 bp, Homo sapiens
tgggaagcagggaat

SEQ ID NO: 5652291 - DNA, 12 bp, Homo sapiens
tgggaagcccgg

SEQ ID NO: 5652292 - DNA, 16 bp, Homo sapiens
tgggaagcctgtgcca

SEQ ID NO: 5652293 - DNA, 15 bp, Homo sapiens
tgggaagctgaggca

SEQ ID NO: 5652294 - DNA, 24 bp, Homo sapiens
tgggaagctgtactcagagcagag

SEQ ID NO: 5652295 - DNA, 14 bp, Homo sapiens
tgggaagcttgagc

SEQ ID NO: 5652296 - DNA, 18 bp, Homo sapiens
tgggaagcttgagcctcc

SEQ ID NO: 5652297 - DNA, 19 bp, Homo sapiens
tgggaagcttgagcctccc

SEQ ID NO: 5652298 - DNA, 13 bp, Homo sapiens
tgggaagcttgct

SEQ ID NO: 5652299 - DNA, 11 bp, Homo sapiens
tgggaaggaaa

SEQ ID NO: 5652300 - DNA, 14 bp, Homo sapiens
tgggaaggaaacaa

SEQ ID NO: 5652301 - DNA, 19 bp, Homo sapiens
tgggaaggaaacaaatgtg

SEQ ID NO: 5652302 - DNA, 17 bp, Homo sapiens
tgggaaggacacagcag

SEQ ID NO: 5652303 - DNA, 12 bp, Homo sapiens
tgggaaggactt

SEQ ID NO: 5652304 - DNA, 13 bp, Homo sapiens
tgggaaggacttg

SEQ ID NO: 5652305 - DNA, 22 bp, Homo sapiens
tgggaaggacttggcgcgccct

SEQ ID NO: 5652306 - DNA, 23 bp, Homo sapiens
tgggaaggagggagctgctcaga

SEQ ID NO: 5652307 - DNA, 15 bp, Homo sapiens
tgggaaggaggggag

SEQ ID NO: 5652308 - DNA, 17 bp, Homo sapiens
tgggaaggaggggagcc

SEQ ID NO: 5652309 - DNA, 20 bp, Homo sapiens
tgggaaggcacctgctccca

SEQ ID NO: 5652310 - DNA, 16 bp, Homo sapiens
tgggaaggccagcctt

SEQ ID NO: 5652311 - DNA, 15 bp, Homo sapiens
tgggaaggccagctg

SEQ ID NO: 5652312 - DNA, 16 bp, Homo sapiens
tgggaaggccggcagc

SEQ ID NO: 5652313 - DNA, 14 bp, Homo sapiens
tgggaaggctaagt

SEQ ID NO: 5652314 - DNA, 17 bp, Homo sapiens
tgggaaggcttgggatt

SEQ ID NO: 5652315 - DNA, 14 bp, Homo sapiens
tgggaagggagagg

SEQ ID NO: 5652316 - DNA, 18 bp, Homo sapiens
tgggaagggagagggcct

SEQ ID NO: 5652317 - DNA, 19 bp, Homo sapiens
tgggaagggagagttcttt

SEQ ID NO: 5652318 - DNA, 18 bp, Homo sapiens
tgggaagggataatttat

SEQ ID NO: 5652319 - DNA, 22 bp, Homo sapiens
tgggaaggggaacacagaccag

SEQ ID NO: 5652320 - DNA, 13 bp, Homo sapiens
tgggaagggggca

SEQ ID NO: 5652321 - DNA, 18 bp, Homo sapiens
tgggaaggggtcctgcag

SEQ ID NO: 5652322 - DNA, 19 bp, Homo sapiens
tgggaaggggtcctgcagg

SEQ ID NO: 5652323 - DNA, 20 bp, Homo sapiens
tgggaaggggtcctgcaggg

SEQ ID NO: 5652324 - DNA, 22 bp, Homo sapiens
tgggaaggttagaaaggcagcc

SEQ ID NO: 5652325 - DNA, 12 bp, Homo sapiens
tgggaaggttcc

SEQ ID NO: 5652326 - DNA, 21 bp, Homo sapiens
tgggaaggtttttaagggccg

SEQ ID NO: 5652327 - DNA, 13 bp, Homo sapiens
tgggaagtcctgg

SEQ ID NO: 5652328 - DNA, 18 bp, Homo sapiens
tgggaagtctcagcctgg

SEQ ID NO: 5652329 - DNA, 20 bp, Homo sapiens
tgggaagtgacttagcagat

SEQ ID NO: 5652330 - DNA, 15 bp, Homo sapiens
tgggaagttaaaggg

SEQ ID NO: 5652331 - DNA, 15 bp, Homo sapiens
tgggaagttaccttt

SEQ ID NO: 5652332 - DNA, 22 bp, Homo sapiens
tgggaagtttgctgtgctttgg

SEQ ID NO: 5652333 - DNA, 15 bp, Homo sapiens
tgggaataaaagtat

SEQ ID NO: 5652334 - DNA, 16 bp, Homo sapiens
tgggaataaaatttct

SEQ ID NO: 5652335 - DNA, 13 bp, Homo sapiens
tgggaataaatat

SEQ ID NO: 5652336 - DNA, 14 bp, Homo sapiens
tgggaataaatatg

SEQ ID NO: 5652337 - DNA, 15 bp, Homo sapiens
tgggaataattgctt

SEQ ID NO: 5652338 - DNA, 13 bp, Homo sapiens
tgggaatatttga

SEQ ID NO: 5652339 - DNA, 16 bp, Homo sapiens
tgggaatatttgaatc

SEQ ID NO: 5652340 - DNA, 14 bp, Homo sapiens
tgggaatcaagatt

SEQ ID NO: 5652341 - DNA, 19 bp, Homo sapiens
tgggaatcatgtccatccc

SEQ ID NO: 5652342 - DNA, 13 bp, Homo sapiens
tgggaatcattcc

SEQ ID NO: 5652343 - DNA, 22 bp, Homo sapiens
tgggaatcctgctgccagagaa

SEQ ID NO: 5652344 - DNA, 13 bp, Homo sapiens
tgggaatctccca

SEQ ID NO: 5652345 - DNA, 12 bp, Homo sapiens
tgggaatgaagc

SEQ ID NO: 5652346 - DNA, 19 bp, Homo sapiens
tgggaatgaagcttgtgta

SEQ ID NO: 5652347 - DNA, 21 bp, Homo sapiens
tgggaatgaagcttgtgtatc

SEQ ID NO: 5652348 - DNA, 21 bp, Homo sapiens
tgggaatgaatgtcagtgtga

SEQ ID NO: 5652349 - DNA, 19 bp, Homo sapiens
tgggaatggaggggcagag

SEQ ID NO: 5652350 - DNA, 23 bp, Homo sapiens
tgggaatggaggggcagagccag

SEQ ID NO: 5652351 - DNA, 12 bp, Homo sapiens
tgggaatgggag

SEQ ID NO: 5652352 - DNA, 15 bp, Homo sapiens
tgggaatgggagagg

SEQ ID NO: 5652353 - DNA, 22 bp, Homo sapiens
tgggaatgtattattctgcagc

SEQ ID NO: 5652354 - DNA, 16 bp, Homo sapiens
tgggaatgtttgtctc

SEQ ID NO: 5652355 - DNA, 20 bp, Homo sapiens
tgggaattctttacaataaa

SEQ ID NO: 5652356 - DNA, 17 bp, Homo sapiens
tgggaattgtgtgatgt

SEQ ID NO: 5652357 - DNA, 16 bp, Homo sapiens
tgggaatttggcttca

SEQ ID NO: 5652358 - DNA, 15 bp, Homo sapiens
tgggaatttgtcagc

SEQ ID NO: 5652359 - DNA, 19 bp, Homo sapiens
tgggaatttgtcagcgttc

SEQ ID NO: 5652360 - DNA, 13 bp, Homo sapiens
tgggaattttaac

SEQ ID NO: 5652361 - DNA, 18 bp, Homo sapiens
tgggacaagcaggccgcc

SEQ ID NO: 5652362 - DNA, 20 bp, Homo sapiens
tgggacacaaaactccgccc

SEQ ID NO: 5652363 - DNA, 12 bp, Homo sapiens
tgggacacacat

SEQ ID NO: 5652364 - DNA, 18 bp, Homo sapiens
tgggacacagacccagga

SEQ ID NO: 5652365 - DNA, 20 bp, Homo sapiens
tgggacacagaccggccgca

SEQ ID NO: 5652366 - DNA, 14 bp, Homo sapiens
tgggacaccaggga

SEQ ID NO: 5652367 - DNA, 12 bp, Homo sapiens
tgggacaccctg

SEQ ID NO: 5652368 - DNA, 21 bp, Homo sapiens
tgggacacctcagaaaactta

SEQ ID NO: 5652369 - DNA, 17 bp, Homo sapiens
tgggacacctgggagaa

SEQ ID NO: 5652370 - DNA, 13 bp, Homo sapiens
tgggacagacagc

SEQ ID NO: 5652371 - DNA, 15 bp, Homo sapiens
tgggacagacagcag

SEQ ID NO: 5652372 - DNA, 17 bp, Homo sapiens
tgggacagacagcagct

SEQ ID NO: 5652373 - DNA, 14 bp, Homo sapiens
tgggacagccactg

SEQ ID NO: 5652374 - DNA, 21 bp, Homo sapiens
tgggacagccagagctgggtg

SEQ ID NO: 5652375 - DNA, 18 bp, Homo sapiens
tgggacagccattttcca

SEQ ID NO: 5652376 - DNA, 11 bp, Homo sapiens
tgggacagccc

SEQ ID NO: 5652377 - DNA, 14 bp, Homo sapiens
tgggacagccccag

SEQ ID NO: 5652378 - DNA, 17 bp, Homo sapiens
tgggacagccccagggc

SEQ ID NO: 5652379 - DNA, 14 bp, Homo sapiens
tgggacagctaggc

SEQ ID NO: 5652380 - DNA, 13 bp, Homo sapiens
tgggacagctggc

SEQ ID NO: 5652381 - DNA, 14 bp, Homo sapiens
tgggacagctggct

SEQ ID NO: 5652382 - DNA, 19 bp, Homo sapiens
tgggacagctggctgggcc

SEQ ID NO: 5652383 - DNA, 16 bp, Homo sapiens
tgggacaggaaagaga

SEQ ID NO: 5652384 - DNA, 13 bp, Homo sapiens
tgggacaggctct

SEQ ID NO: 5652385 - DNA, 19 bp, Homo sapiens
tgggacagggagcagcccc

SEQ ID NO: 5652386 - DNA, 18 bp, Homo sapiens
tgggacagggagggccgg

SEQ ID NO: 5652387 - DNA, 13 bp, Homo sapiens
tgggacagggctt

SEQ ID NO: 5652388 - DNA, 20 bp, Homo sapiens
tgggacagtcacctcatgga

SEQ ID NO: 5652389 - DNA, 21 bp, Homo sapiens
tgggacagtcacctcatggaa

SEQ ID NO: 5652390 - DNA, 22 bp, Homo sapiens
tgggacagtttatcatgaagcc

SEQ ID NO: 5652391 - DNA, 17 bp, Homo sapiens
tgggacatggaaaagaa

SEQ ID NO: 5652392 - DNA, 20 bp, Homo sapiens
tgggacatttgctcatggaa

SEQ ID NO: 5652393 - DNA, 22 bp, Homo sapiens
tgggacatttttgtctgtccta

SEQ ID NO: 5652394 - DNA, 16 bp, Homo sapiens
tgggaccaaaggggga

SEQ ID NO: 5652395 - DNA, 17 bp, Homo sapiens
tgggaccaaagggggag

SEQ ID NO: 5652396 - DNA, 22 bp, Homo sapiens
tgggaccaacctgacctaacct

SEQ ID NO: 5652397 - DNA, 21 bp, Homo sapiens
tgggaccacaggcatgcacca

SEQ ID NO: 5652398 - DNA, 20 bp, Homo sapiens
tgggaccacaggtgcccgcc

SEQ ID NO: 5652399 - DNA, 19 bp, Homo sapiens
tgggaccacgtgagatcat

SEQ ID NO: 5652400 - DNA, 12 bp, Homo sapiens
tgggaccagagc

SEQ ID NO: 5652401 - DNA, 13 bp, Homo sapiens
tgggaccagagcc

SEQ ID NO: 5652402 - DNA, 14 bp, Homo sapiens
tgggaccagagcca

SEQ ID NO: 5652403 - DNA, 22 bp, Homo sapiens
tgggaccaggcacccccagaat

SEQ ID NO: 5652404 - DNA, 15 bp, Homo sapiens
tgggaccaggccaat

SEQ ID NO: 5652405 - DNA, 16 bp, Homo sapiens
tgggaccaggccaatc

SEQ ID NO: 5652406 - DNA, 15 bp, Homo sapiens
tgggaccaggctcca

SEQ ID NO: 5652407 - DNA, 14 bp, Homo sapiens
tgggaccagggcat

SEQ ID NO: 5652408 - DNA, 22 bp, Homo sapiens
tgggacccaaaacacaggaagt

SEQ ID NO: 5652409 - DNA, 13 bp, Homo sapiens
tgggacccacaga

SEQ ID NO: 5652410 - DNA, 14 bp, Homo sapiens
tgggacccacagaa

SEQ ID NO: 5652411 - DNA, 22 bp, Homo sapiens
tgggacccacgaaactgccctg

SEQ ID NO: 5652412 - DNA, 22 bp, Homo sapiens
tgggacccagctactctgtcca

SEQ ID NO: 5652413 - DNA, 20 bp, Homo sapiens
tgggacccaggctcccagcc

SEQ ID NO: 5652414 - DNA, 20 bp, Homo sapiens
tgggacccagtggcagggca

SEQ ID NO: 5652415 - DNA, 21 bp, Homo sapiens
tgggacccagtggcagggcac

SEQ ID NO: 5652416 - DNA, 22 bp, Homo sapiens
tgggacccagtggcagggcaca

SEQ ID NO: 5652417 - DNA, 20 bp, Homo sapiens
tgggacccatagatcttctg

SEQ ID NO: 5652418 - DNA, 16 bp, Homo sapiens
tgggaccccagagaaa

SEQ ID NO: 5652419 - DNA, 12 bp, Homo sapiens
tgggaccccctc

SEQ ID NO: 5652420 - DNA, 16 bp, Homo sapiens
tgggaccccctcgcca

SEQ ID NO: 5652421 - DNA, 17 bp, Homo sapiens
tgggaccccctcgccag

SEQ ID NO: 5652422 - DNA, 14 bp, Homo sapiens
tgggaccccgagct

SEQ ID NO: 5652423 - DNA, 22 bp, Homo sapiens
tgggacccctcccaacctcaat

SEQ ID NO: 5652424 - DNA, 14 bp, Homo sapiens
tgggaccctcagca

SEQ ID NO: 5652425 - DNA, 21 bp, Homo sapiens
tgggaccctcggggcaggaag

SEQ ID NO: 5652426 - DNA, 18 bp, Homo sapiens
tgggaccctttccttcct

SEQ ID NO: 5652427 - DNA, 19 bp, Homo sapiens
tgggaccgccagatggggc

SEQ ID NO: 5652428 - DNA, 23 bp, Homo sapiens
tgggaccgccagatggggcctct

SEQ ID NO: 5652429 - DNA, 17 bp, Homo sapiens
tgggaccgcctggccct

SEQ ID NO: 5652430 - DNA, 16 bp, Homo sapiens
tgggaccgtgccccac

SEQ ID NO: 5652431 - DNA, 16 bp, Homo sapiens
tgggacctagggaggc

SEQ ID NO: 5652432 - DNA, 19 bp, Homo sapiens
tgggacctaggggcgccgc

SEQ ID NO: 5652433 - DNA, 20 bp, Homo sapiens
tgggacctagggggacgggg

SEQ ID NO: 5652434 - DNA, 19 bp, Homo sapiens
tgggacctccccagcccag

SEQ ID NO: 5652435 - DNA, 15 bp, Homo sapiens
tgggacctcctccct

SEQ ID NO: 5652436 - DNA, 16 bp, Homo sapiens
tgggacctcctccctc

SEQ ID NO: 5652437 - DNA, 18 bp, Homo sapiens
tgggacctgccaggcagg

SEQ ID NO: 5652438 - DNA, 14 bp, Homo sapiens
tgggacctgctgct

SEQ ID NO: 5652439 - DNA, 14 bp, Homo sapiens
tgggacctggcccc

SEQ ID NO: 5652440 - DNA, 14 bp, Homo sapiens
tgggacctgtggct

SEQ ID NO: 5652441 - DNA, 15 bp, Homo sapiens
tgggacctttagtgg

SEQ ID NO: 5652442 - DNA, 12 bp, Homo sapiens
tgggacgcccct

SEQ ID NO: 5652443 - DNA, 20 bp, Homo sapiens
tgggacggaagtggcctgag

SEQ ID NO: 5652444 - DNA, 14 bp, Homo sapiens
tgggacggctcctg

SEQ ID NO: 5652445 - DNA, 16 bp, Homo sapiens
tgggacggctcctgct

SEQ ID NO: 5652446 - DNA, 23 bp, Homo sapiens
tgggacgggatggttctggctgt

SEQ ID NO: 5652447 - DNA, 16 bp, Homo sapiens
tgggacgtggtcaggg

SEQ ID NO: 5652448 - DNA, 19 bp, Homo sapiens
tgggacgtgtacagcacag

SEQ ID NO: 5652449 - DNA, 22 bp, Homo sapiens
tgggactaaagccaggaacagg

SEQ ID NO: 5652450 - DNA, 21 bp, Homo sapiens
tgggactacaggcacaggcca

SEQ ID NO: 5652451 - DNA, 18 bp, Homo sapiens
tgggactacaggcaccca

SEQ ID NO: 5652452 - DNA, 18 bp, Homo sapiens
tgggactagagctttctt

SEQ ID NO: 5652453 - DNA, 18 bp, Homo sapiens
tgggactcaatgcactga

SEQ ID NO: 5652454 - DNA, 23 bp, Homo sapiens
tgggactcagccttcagacagag

SEQ ID NO: 5652455 - DNA, 18 bp, Homo sapiens
tgggactcaggtctgtaa

SEQ ID NO: 5652456 - DNA, 18 bp, Homo sapiens
tgggactcagttcttggc

SEQ ID NO: 5652457 - DNA, 21 bp, Homo sapiens
tgggactcatccttgcccagg

SEQ ID NO: 5652458 - DNA, 18 bp, Homo sapiens
tgggactccaggccagct

SEQ ID NO: 5652459 - DNA, 14 bp, Homo sapiens
tgggactccaggtc

SEQ ID NO: 5652460 - DNA, 12 bp, Homo sapiens
tgggcaggcggt

SEQ ID NO: 5652461 - DNA, 22 bp, Homo sapiens
tgggcaggcggtccccatcccc

SEQ ID NO: 5652462 - DNA, 13 bp, Homo sapiens
tgggcagggaggg

SEQ ID NO: 5652463 - DNA, 15 bp, Homo sapiens
tgggcagggaggggc

SEQ ID NO: 5652464 - DNA, 21 bp, Homo sapiens
tgggcagggaggggctggggc

SEQ ID NO: 5652465 - DNA, 10 bp, Homo sapiens
tgggcagggc

SEQ ID NO: 5652466 - DNA, 12 bp, Homo sapiens
tgggcagggccg

SEQ ID NO: 5652467 - DNA, 21 bp, Homo sapiens
tgggcagggccgcagggcgct

SEQ ID NO: 5652468 - DNA, 23 bp, Homo sapiens
tgggcagggcctggcggaggtgg

SEQ ID NO: 5652469 - DNA, 12 bp, Homo sapiens
tgggcagggctg

SEQ ID NO: 5652470 - DNA, 20 bp, Homo sapiens
tgggcaggggttccagcttc

SEQ ID NO: 5652471 - DNA, 23 bp, Homo sapiens
tgggcaggggttccagcttccct

SEQ ID NO: 5652472 - DNA, 19 bp, Homo sapiens
tgggcagggtctctgctcc

SEQ ID NO: 5652473 - DNA, 16 bp, Homo sapiens
tgggcaggtcctgggg

SEQ ID NO: 5652474 - DNA, 21 bp, Homo sapiens
tgggcaggtctcctctgggag

SEQ ID NO: 5652475 - DNA, 20 bp, Homo sapiens
tgggcaggtggcctctgctg

SEQ ID NO: 5652476 - DNA, 17 bp, Homo sapiens
tgggcaggtgggagctg

SEQ ID NO: 5652477 - DNA, 21 bp, Homo sapiens
tgggcaggtggtggcactgag

SEQ ID NO: 5652478 - DNA, 15 bp, Homo sapiens
tgggcaggttcctgg

SEQ ID NO: 5652479 - DNA, 17 bp, Homo sapiens
tgggcaggttcctgggg

SEQ ID NO: 5652480 - DNA, 20 bp, Homo sapiens
tgggcaggttcctggggccg

SEQ ID NO: 5652481 - DNA, 18 bp, Homo sapiens
tgggcagtcaccacccag

SEQ ID NO: 5652482 - DNA, 14 bp, Homo sapiens
tgggcagtctttct

SEQ ID NO: 5652483 - DNA, 19 bp, Homo sapiens
tgggcagtctttcttgaaa

SEQ ID NO: 5652484 - DNA, 21 bp, Homo sapiens
tgggcagtctttcttgaaatt

SEQ ID NO: 5652485 - DNA, 16 bp, Homo sapiens
tgggcagtgccccagg

SEQ ID NO: 5652486 - DNA, 18 bp, Homo sapiens
tgggcagtgccccaggga

SEQ ID NO: 5652487 - DNA, 22 bp, Homo sapiens
tgggcagtgcctcctgggacca

SEQ ID NO: 5652488 - DNA, 13 bp, Homo sapiens
tgggcagtggaga

SEQ ID NO: 5652489 - DNA, 22 bp, Homo sapiens
tgggcagtgtggcctcttggct

SEQ ID NO: 5652490 - DNA, 15 bp, Homo sapiens
tgggcagttacatgc

SEQ ID NO: 5652491 - DNA, 15 bp, Homo sapiens
tgggcagttctccca

SEQ ID NO: 5652492 - DNA, 16 bp, Homo sapiens
tgggcagttctcccag

SEQ ID NO: 5652493 - DNA, 20 bp, Homo sapiens
tgggcagttctcccagggag

SEQ ID NO: 5652494 - DNA, 21 bp, Homo sapiens
tgggcagttctcccagggagt

SEQ ID NO: 5652495 - DNA, 16 bp, Homo sapiens
tgggcatactaataaa

SEQ ID NO: 5652496 - DNA, 18 bp, Homo sapiens
tgggcatcagaaaacagg

SEQ ID NO: 5652497 - DNA, 21 bp, Homo sapiens
tgggcatcagggcctttctcc

SEQ ID NO: 5652498 - DNA, 16 bp, Homo sapiens
tgggcatcattttaac

SEQ ID NO: 5652499 - DNA, 18 bp, Homo sapiens
tgggcatccacccagtgc

SEQ ID NO: 5652500 - DNA, 20 bp, Homo sapiens
tgggcatccacccagtgctg

SEQ ID NO: 5652501 - DNA, 17 bp, Homo sapiens
tgggcatccccagcccc

SEQ ID NO: 5652502 - DNA, 22 bp, Homo sapiens
tgggcatccccagccccctggc

SEQ ID NO: 5652503 - DNA, 22 bp, Homo sapiens
tgggcatctcgtgccagggcag

SEQ ID NO: 5652504 - DNA, 17 bp, Homo sapiens
tgggcatctggccctgc

SEQ ID NO: 5652505 - DNA, 19 bp, Homo sapiens
tgggcatctggccctgctg

SEQ ID NO: 5652506 - DNA, 21 bp, Homo sapiens
tgggcatctggccctgctgcc

SEQ ID NO: 5652507 - DNA, 16 bp, Homo sapiens
tgggcatctgttctgg

SEQ ID NO: 5652508 - DNA, 16 bp, Homo sapiens
tgggcatcttctggct

SEQ ID NO: 5652509 - DNA, 13 bp, Homo sapiens
tgggcatcttttg

SEQ ID NO: 5652510 - DNA, 18 bp, Homo sapiens
tgggcatcttttgtatta

SEQ ID NO: 5652511 - DNA, 22 bp, Homo sapiens
tgggcatgaggggttcctcccc

SEQ ID NO: 5652512 - DNA, 15 bp, Homo sapiens
tgggcatgccaccct

SEQ ID NO: 5652513 - DNA, 16 bp, Homo sapiens
tgggcatgccaccctc

SEQ ID NO: 5652514 - DNA, 13 bp, Homo sapiens
tgggcatggccgc

SEQ ID NO: 5652515 - DNA, 15 bp, Homo sapiens
tgggcatggggtggg

SEQ ID NO: 5652516 - DNA, 20 bp, Homo sapiens
tgggcatggtaccagccctg

SEQ ID NO: 5652517 - DNA, 16 bp, Homo sapiens
tgggcatggtggggca

SEQ ID NO: 5652518 - DNA, 20 bp, Homo sapiens
tgggcatggtgttctcctgc

SEQ ID NO: 5652519 - DNA, 21 bp, Homo sapiens
tgggcatgtccccagtgtgga

SEQ ID NO: 5652520 - DNA, 17 bp, Homo sapiens
tgggcattagcaaggca

SEQ ID NO: 5652521 - DNA, 20 bp, Homo sapiens
tgggcattagcaaggcagag

SEQ ID NO: 5652522 - DNA, 19 bp, Homo sapiens
tgggcattgacaaatctgt

SEQ ID NO: 5652523 - DNA, 17 bp, Homo sapiens
tgggcattgcagccttg

SEQ ID NO: 5652524 - DNA, 15 bp, Homo sapiens
tgggcattgccatgt

SEQ ID NO: 5652525 - DNA, 11 bp, Homo sapiens
tgggcattgct

SEQ ID NO: 5652526 - DNA, 18 bp, Homo sapiens
tgggcattgctggactga

SEQ ID NO: 5652527 - DNA, 15 bp, Homo sapiens
tgggcattgctttcc

SEQ ID NO: 5652528 - DNA, 14 bp, Homo sapiens
tgggcatttatatt

SEQ ID NO: 5652529 - DNA, 19 bp, Homo sapiens
tgggcatttctaaaatgtt

SEQ ID NO: 5652530 - DNA, 16 bp, Homo sapiens
tgggcatttggtgaga

SEQ ID NO: 5652531 - DNA, 17 bp, Homo sapiens
tgggcatttggtgagag

SEQ ID NO: 5652532 - DNA, 17 bp, Homo sapiens
tgggcattttgacaaca

SEQ ID NO: 5652533 - DNA, 17 bp, Homo sapiens
tgggccaaaagggcagc

SEQ ID NO: 5652534 - DNA, 19 bp, Homo sapiens
tgggccaaaagggcagcca

SEQ ID NO: 5652535 - DNA, 16 bp, Homo sapiens
tgggccaactcacctg

SEQ ID NO: 5652536 - DNA, 12 bp, Homo sapiens
tgggccaagcca

SEQ ID NO: 5652537 - DNA, 13 bp, Homo sapiens
tgggccaagccag

SEQ ID NO: 5652538 - DNA, 23 bp, Homo sapiens
tgggccaagccagggttccagac

SEQ ID NO: 5652539 - DNA, 18 bp, Homo sapiens
tgggccaaggtgtttcca

SEQ ID NO: 5652540 - DNA, 19 bp, Homo sapiens
tgggccaatttactggcca

SEQ ID NO: 5652541 - DNA, 18 bp, Homo sapiens
tgggccacacccaggaag

SEQ ID NO: 5652542 - DNA, 19 bp, Homo sapiens
tgggccacacccaggaagg

SEQ ID NO: 5652543 - DNA, 20 bp, Homo sapiens
tgggccacacccaggaaggg

SEQ ID NO: 5652544 - DNA, 22 bp, Homo sapiens
tgggccacaggggacagggctg

SEQ ID NO: 5652545 - DNA, 18 bp, Homo sapiens
tgggccacccaccagggc

SEQ ID NO: 5652546 - DNA, 13 bp, Homo sapiens
tgggccacccttc

SEQ ID NO: 5652547 - DNA, 22 bp, Homo sapiens
tgggccacccttcacgctggct

SEQ ID NO: 5652548 - DNA, 18 bp, Homo sapiens
tgggccaccgcccagctc

SEQ ID NO: 5652549 - DNA, 21 bp, Homo sapiens
tgggccaccgcccagctcatg

SEQ ID NO: 5652550 - DNA, 18 bp, Homo sapiens
tgggccaccgtgcctggc

SEQ ID NO: 5652551 - DNA, 20 bp, Homo sapiens
tgggccaccgtgcctggctg

SEQ ID NO: 5652552 - DNA, 17 bp, Homo sapiens
tgggccacctcctaccc

SEQ ID NO: 5652553 - DNA, 23 bp, Homo sapiens
tgggccacctcctaccccttcct

SEQ ID NO: 5652554 - DNA, 20 bp, Homo sapiens
tgggccacgccggccacacc

SEQ ID NO: 5652555 - DNA, 17 bp, Homo sapiens
tgggccacggctgagcc

SEQ ID NO: 5652556 - DNA, 18 bp, Homo sapiens
tgggccacggctgagcct

SEQ ID NO: 5652557 - DNA, 16 bp, Homo sapiens
tgggccactcctcttc

SEQ ID NO: 5652558 - DNA, 20 bp, Homo sapiens
tgggccactctcccctccct

SEQ ID NO: 5652559 - DNA, 12 bp, Homo sapiens
tgggccactgcc

SEQ ID NO: 5652560 - DNA, 18 bp, Homo sapiens
tgggccactgccagcagc

SEQ ID NO: 5652561 - DNA, 13 bp, Homo sapiens
tgggccactgccc

SEQ ID NO: 5652562 - DNA, 19 bp, Homo sapiens
tgggccactggcatctctg

SEQ ID NO: 5652563 - DNA, 14 bp, Homo sapiens
tgggccactgggga

SEQ ID NO: 5652564 - DNA, 23 bp, Homo sapiens
tgggccactggggactttattta

SEQ ID NO: 5652565 - DNA, 22 bp, Homo sapiens
tgggccacttctgggtggggca

SEQ ID NO: 5652566 - DNA, 20 bp, Homo sapiens
tgggccagaagtaccagact

SEQ ID NO: 5652567 - DNA, 21 bp, Homo sapiens
tgggccagaagtaccagacta

SEQ ID NO: 5652568 - DNA, 17 bp, Homo sapiens
tgggccagaatttcaaa

SEQ ID NO: 5652569 - DNA, 13 bp, Homo sapiens
tgggccagagaag

SEQ ID NO: 5652570 - DNA, 12 bp, Homo sapiens
tgggccagagct

SEQ ID NO: 5652571 - DNA, 13 bp, Homo sapiens
tgggccagcagag

SEQ ID NO: 5652572 - DNA, 13 bp, Homo sapiens
tgggccagcccct

SEQ ID NO: 5652573 - DNA, 22 bp, Homo sapiens
tgggccagcccctcccaccaca

SEQ ID NO: 5652574 - DNA, 18 bp, Homo sapiens
tgggccagccctgcagcc

SEQ ID NO: 5652575 - DNA, 14 bp, Homo sapiens
tgggccagcccttg

SEQ ID NO: 5652576 - DNA, 15 bp, Homo sapiens
tgggccagcccttgc

SEQ ID NO: 5652577 - DNA, 13 bp, Homo sapiens
tgggccagcctag

SEQ ID NO: 5652578 - DNA, 14 bp, Homo sapiens
tgggccagcctcag

SEQ ID NO: 5652579 - DNA, 17 bp, Homo sapiens
tgggccagcctcagctc

SEQ ID NO: 5652580 - DNA, 20 bp, Homo sapiens
tgggccagcctcagctcagc

SEQ ID NO: 5652581 - DNA, 22 bp, Homo sapiens
tgggccagcctcagctcagcct

SEQ ID NO: 5652582 - DNA, 17 bp, Homo sapiens
tgggccagcggggctgc

SEQ ID NO: 5652583 - DNA, 13 bp, Homo sapiens
tgggccaggagcc

SEQ ID NO: 5652584 - DNA, 16 bp, Homo sapiens
tgggccaggagctcag

SEQ ID NO: 5652585 - DNA, 23 bp, Homo sapiens
tgggccaggaggtagtttctcat

SEQ ID NO: 5652586 - DNA, 15 bp, Homo sapiens
tgggccaggcaggcg

SEQ ID NO: 5652587 - DNA, 13 bp, Homo sapiens
tgggccagggctg

SEQ ID NO: 5652588 - DNA, 22 bp, Homo sapiens
tgggccagggctgccctgagaa

SEQ ID NO: 5652589 - DNA, 14 bp, Homo sapiens
tgggccagggtctc

SEQ ID NO: 5652590 - DNA, 20 bp, Homo sapiens
tgggccaggttggaaaagaa

SEQ ID NO: 5652591 - DNA, 22 bp, Homo sapiens
tgggccagtcaacggggggctc

SEQ ID NO: 5652592 - DNA, 17 bp, Homo sapiens
tgggccagtcctggttg

SEQ ID NO: 5652593 - DNA, 23 bp, Homo sapiens
tgggccataatgttgcttctcag

SEQ ID NO: 5652594 - DNA, 18 bp, Homo sapiens
tgggccataattatgaaa

SEQ ID NO: 5652595 - DNA, 18 bp, Homo sapiens
tgggccatagctcctgct

SEQ ID NO: 5652596 - DNA, 17 bp, Homo sapiens
tgggccatattccgcac

SEQ ID NO: 5652597 - DNA, 15 bp, Homo sapiens
tgggccatctggggt

SEQ ID NO: 5652598 - DNA, 18 bp, Homo sapiens
tgggccatgcgaggggcc

SEQ ID NO: 5652599 - DNA, 16 bp, Homo sapiens
tgggccatgggtcctc

SEQ ID NO: 5652600 - DNA, 20 bp, Homo sapiens
tgggccatgggtcctcggcc

SEQ ID NO: 5652601 - DNA, 21 bp, Homo sapiens
tgggccatgggtcctcggccc

SEQ ID NO: 5652602 - DNA, 17 bp, Homo sapiens
tgggccatgtccaaaga

SEQ ID NO: 5652603 - DNA, 20 bp, Homo sapiens
tgggccattctccacagcaa

SEQ ID NO: 5652604 - DNA, 18 bp, Homo sapiens
tgggcccaaccctgtctg

SEQ ID NO: 5652605 - DNA, 17 bp, Homo sapiens
tgggcccaagaactgca

SEQ ID NO: 5652606 - DNA, 18 bp, Homo sapiens
tgggcccaagaactgcag

SEQ ID NO: 5652607 - DNA, 15 bp, Homo sapiens
tgggcccacacctcc

SEQ ID NO: 5652608 - DNA, 14 bp, Homo sapiens
tgggcccacatccg

SEQ ID NO: 5652609 - DNA, 18 bp, Homo sapiens
tgggcccagaactgcccc

SEQ ID NO: 5652610 - DNA, 21 bp, Homo sapiens
tgggcccagaccactgtctcc

SEQ ID NO: 5652611 - DNA, 12 bp, Homo sapiens
tgggcccagagg

SEQ ID NO: 5652612 - DNA, 13 bp, Homo sapiens
tgggcccagagga

SEQ ID NO: 5652613 - DNA, 17 bp, Homo sapiens
tgggcccagaggagagg

SEQ ID NO: 5652614 - DNA, 13 bp, Homo sapiens
tgggcccagatct

SEQ ID NO: 5652615 - DNA, 12 bp, Homo sapiens
tgggcccagccg

SEQ ID NO: 5652616 - DNA, 20 bp, Homo sapiens
tgggcccagccggggtgggg

SEQ ID NO: 5652617 - DNA, 22 bp, Homo sapiens
tgggcccagccggggtggggtg

SEQ ID NO: 5652618 - DNA, 19 bp, Homo sapiens
tgggcccagctgggctctg

SEQ ID NO: 5652619 - DNA, 22 bp, Homo sapiens
tgggcccagctgggctctgcca

SEQ ID NO: 5652620 - DNA, 10 bp, Homo sapiens
tgggcccagg

SEQ ID NO: 5652621 - DNA, 15 bp, Homo sapiens
tgggcccaggaccag

SEQ ID NO: 5652622 - DNA, 18 bp, Homo sapiens
tgggcccaggaccagctg

SEQ ID NO: 5652623 - DNA, 23 bp, Homo sapiens
tgggcccaggaccagctggggcg

SEQ ID NO: 5652624 - DNA, 20 bp, Homo sapiens
tgggcccaggcagcacctgg

SEQ ID NO: 5652625 - DNA, 14 bp, Homo sapiens
tgggcccaggcagg

SEQ ID NO: 5652626 - DNA, 15 bp, Homo sapiens
tgggcccaggcaggt

SEQ ID NO: 5652627 - DNA, 16 bp, Homo sapiens
tgggcccaggcccagc

SEQ ID NO: 5652628 - DNA, 17 bp, Homo sapiens
tgggcccaggcccagcc

SEQ ID NO: 5652629 - DNA, 18 bp, Homo sapiens
tgggcccaggcccagcct

SEQ ID NO: 5652630 - DNA, 22 bp, Homo sapiens
tgggcccaggcccagcctcttg

SEQ ID NO: 5652631 - DNA, 15 bp, Homo sapiens
tgggcccaggcctca

SEQ ID NO: 5652632 - DNA, 15 bp, Homo sapiens
tgggcccaggctctg

SEQ ID NO: 5652633 - DNA, 19 bp, Homo sapiens
tgggcccaggctctgggaa

SEQ ID NO: 5652634 - DNA, 19 bp, Homo sapiens
tgggcccagggacaccagc

SEQ ID NO: 5652635 - DNA, 14 bp, Homo sapiens
tgggcccagtagcc

SEQ ID NO: 5652636 - DNA, 21 bp, Homo sapiens
tgggcccataatagttagccc

SEQ ID NO: 5652637 - DNA, 22 bp, Homo sapiens
tggggcagtgcttggcccagga

SEQ ID NO: 5652638 - DNA, 22 bp, Homo sapiens
tggggcatgacctcagtcaggc

SEQ ID NO: 5652639 - DNA, 21 bp, Homo sapiens
tggggcatggttttacagtga

SEQ ID NO: 5652640 - DNA, 18 bp, Homo sapiens
tggggcatgtgtgcctgt

SEQ ID NO: 5652641 - DNA, 16 bp, Homo sapiens
tggggcatttgtaaaa

SEQ ID NO: 5652642 - DNA, 14 bp, Homo sapiens
tggggccacacaga

SEQ ID NO: 5652643 - DNA, 17 bp, Homo sapiens
tggggccacacagaaac

SEQ ID NO: 5652644 - DNA, 12 bp, Homo sapiens
tggggccacagc

SEQ ID NO: 5652645 - DNA, 18 bp, Homo sapiens
tggggccaccctggcccg

SEQ ID NO: 5652646 - DNA, 23 bp, Homo sapiens
tggggccactacctcctttccta

SEQ ID NO: 5652647 - DNA, 18 bp, Homo sapiens
tggggccagactggctgc

SEQ ID NO: 5652648 - DNA, 20 bp, Homo sapiens
tggggccagactggctgcac

SEQ ID NO: 5652649 - DNA, 18 bp, Homo sapiens
tggggccagaggctggga

SEQ ID NO: 5652650 - DNA, 14 bp, Homo sapiens
tggggccagatcca

SEQ ID NO: 5652651 - DNA, 20 bp, Homo sapiens
tggggccagatccagcctgg

SEQ ID NO: 5652652 - DNA, 14 bp, Homo sapiens
tggggccagcatac

SEQ ID NO: 5652653 - DNA, 23 bp, Homo sapiens
tggggccagcccctccccgcctc

SEQ ID NO: 5652654 - DNA, 12 bp, Homo sapiens
tggggccaggcc

SEQ ID NO: 5652655 - DNA, 15 bp, Homo sapiens
tggggccaggccagg

SEQ ID NO: 5652656 - DNA, 13 bp, Homo sapiens
tggggccaggccc

SEQ ID NO: 5652657 - DNA, 17 bp, Homo sapiens
tggggccaggctgggtc

SEQ ID NO: 5652658 - DNA, 15 bp, Homo sapiens
tggggccagggcaga

SEQ ID NO: 5652659 - DNA, 12 bp, Homo sapiens
tggggccagggg

SEQ ID NO: 5652660 - DNA, 13 bp, Homo sapiens
tggggccagtgta

SEQ ID NO: 5652661 - DNA, 21 bp, Homo sapiens
tggggccagtgtaaggcatag

SEQ ID NO: 5652662 - DNA, 22 bp, Homo sapiens
tggggccagtgtaaggcatagg

SEQ ID NO: 5652663 - DNA, 22 bp, Homo sapiens
tggggccataaacggttcctgg

SEQ ID NO: 5652664 - DNA, 19 bp, Homo sapiens
tggggccatgcctcctcag

SEQ ID NO: 5652665 - DNA, 21 bp, Homo sapiens
tggggccatgcctcctcagga

SEQ ID NO: 5652666 - DNA, 20 bp, Homo sapiens
tggggccatgggtgcatgga

SEQ ID NO: 5652667 - DNA, 18 bp, Homo sapiens
tggggccatggtggaggg

SEQ ID NO: 5652668 - DNA, 17 bp, Homo sapiens
tggggcccaagttgcag

SEQ ID NO: 5652669 - DNA, 22 bp, Homo sapiens
tggggcccaagttgcagtgagc

SEQ ID NO: 5652670 - DNA, 23 bp, Homo sapiens
tggggcccaagttgcagtgagca

SEQ ID NO: 5652671 - DNA, 20 bp, Homo sapiens
tggggcccaggaagcccaca

SEQ ID NO: 5652672 - DNA, 16 bp, Homo sapiens
tggggcccagtccttg

SEQ ID NO: 5652673 - DNA, 21 bp, Homo sapiens
tggggcccatggaggagacag

SEQ ID NO: 5652674 - DNA, 16 bp, Homo sapiens
tggggcccatggcccc

SEQ ID NO: 5652675 - DNA, 20 bp, Homo sapiens
tggggcccatggccccagct

SEQ ID NO: 5652676 - DNA, 22 bp, Homo sapiens
tggggccccaaagcccagcccg

SEQ ID NO: 5652677 - DNA, 19 bp, Homo sapiens
tggggccccatcagctgcc

SEQ ID NO: 5652678 - DNA, 20 bp, Homo sapiens
tggggccccatcagctgcca

SEQ ID NO: 5652679 - DNA, 14 bp, Homo sapiens
tggggcccccagca

SEQ ID NO: 5652680 - DNA, 19 bp, Homo sapiens
tggggccccggctcccacc

SEQ ID NO: 5652681 - DNA, 17 bp, Homo sapiens
tggggcccctcccctcc

SEQ ID NO: 5652682 - DNA, 16 bp, Homo sapiens
tggggcccctggccca

SEQ ID NO: 5652683 - DNA, 14 bp, Homo sapiens
tggggcccgcctgc

SEQ ID NO: 5652684 - DNA, 21 bp, Homo sapiens
tggggccctctatgctggctt

SEQ ID NO: 5652685 - DNA, 22 bp, Homo sapiens
tggggccctctatgctggcttt

SEQ ID NO: 5652686 - DNA, 16 bp, Homo sapiens
tggggccctcttgcca

SEQ ID NO: 5652687 - DNA, 23 bp, Homo sapiens
tggggccctcttgccagcctcct

SEQ ID NO: 5652688 - DNA, 14 bp, Homo sapiens
tggggccctgcccc

SEQ ID NO: 5652689 - DNA, 15 bp, Homo sapiens
tggggccctgcccct

SEQ ID NO: 5652690 - DNA, 19 bp, Homo sapiens
tggggccctgcccctagga

SEQ ID NO: 5652691 - DNA, 14 bp, Homo sapiens
tggggccctgcctc

SEQ ID NO: 5652692 - DNA, 15 bp, Homo sapiens
tggggccctgggcct

SEQ ID NO: 5652693 - DNA, 17 bp, Homo sapiens
tggggccctgggcctca

SEQ ID NO: 5652694 - DNA, 19 bp, Homo sapiens
tggggcccttggccccaga

SEQ ID NO: 5652695 - DNA, 22 bp, Homo sapiens
tggggcccttggccccagagga

SEQ ID NO: 5652696 - DNA, 17 bp, Homo sapiens
tggggcccttgggccac

SEQ ID NO: 5652697 - DNA, 13 bp, Homo sapiens
tggggccgcctgc

SEQ ID NO: 5652698 - DNA, 17 bp, Homo sapiens
tggggccgcctgccctg

SEQ ID NO: 5652699 - DNA, 19 bp, Homo sapiens
tggggccgcctgccctgcc

SEQ ID NO: 5652700 - DNA, 22 bp, Homo sapiens
tggggccgcctgccctgccttg

SEQ ID NO: 5652701 - DNA, 19 bp, Homo sapiens
tggggccggtagaggctcc

SEQ ID NO: 5652702 - DNA, 21 bp, Homo sapiens
tggggccggttttcctcagct

SEQ ID NO: 5652703 - DNA, 17 bp, Homo sapiens
tggggcctaataaaact

SEQ ID NO: 5652704 - DNA, 16 bp, Homo sapiens
tggggcctagactctg

SEQ ID NO: 5652705 - DNA, 13 bp, Homo sapiens
tggggcctcaccc

SEQ ID NO: 5652706 - DNA, 15 bp, Homo sapiens
tggggcctcacccag

SEQ ID NO: 5652707 - DNA, 14 bp, Homo sapiens
tggggcctcagacc

SEQ ID NO: 5652708 - DNA, 16 bp, Homo sapiens
tggggcctcagcctgg

SEQ ID NO: 5652709 - DNA, 14 bp, Homo sapiens
tggggcctcaggct

SEQ ID NO: 5652710 - DNA, 21 bp, Homo sapiens
tggggcctcaggctccgggca

SEQ ID NO: 5652711 - DNA, 18 bp, Homo sapiens
tggggcctccagaagctg

SEQ ID NO: 5652712 - DNA, 19 bp, Homo sapiens
tggggcctccagaagctgc

SEQ ID NO: 5652713 - DNA, 18 bp, Homo sapiens
tggggcctccctccttgg

SEQ ID NO: 5652714 - DNA, 19 bp, Homo sapiens
tggggcctccttgtccagg

SEQ ID NO: 5652715 - DNA, 22 bp, Homo sapiens
tggggcctccttgtccaggtct

SEQ ID NO: 5652716 - DNA, 12 bp, Homo sapiens
tggggcctctgt

SEQ ID NO: 5652717 - DNA, 17 bp, Homo sapiens
tggggcctgaggtcatc

SEQ ID NO: 5652718 - DNA, 19 bp, Homo sapiens
tggggcctgatggggaggg

SEQ ID NO: 5652719 - DNA, 17 bp, Homo sapiens
tggggcctggacctgcc

SEQ ID NO: 5652720 - DNA, 17 bp, Homo sapiens
tggggcctggactggac

SEQ ID NO: 5652721 - DNA, 14 bp, Homo sapiens
tggggcctggagag

SEQ ID NO: 5652722 - DNA, 14 bp, Homo sapiens
tggggcctggccca

SEQ ID NO: 5652723 - DNA, 14 bp, Homo sapiens
tggggcctggccta

SEQ ID NO: 5652724 - DNA, 22 bp, Homo sapiens
tggggcctggcctatttaagcc

SEQ ID NO: 5652725 - DNA, 14 bp, Homo sapiens
tggggcctggcgtg

SEQ ID NO: 5652726 - DNA, 16 bp, Homo sapiens
tggggcctggcttgct

SEQ ID NO: 5652727 - DNA, 20 bp, Homo sapiens
tggggcctggcttgctccag

SEQ ID NO: 5652728 - DNA, 13 bp, Homo sapiens
tggggcctgggac

SEQ ID NO: 5652729 - DNA, 14 bp, Homo sapiens
tggggcctgggctg

SEQ ID NO: 5652730 - DNA, 20 bp, Homo sapiens
tggggcctggggagcccact

SEQ ID NO: 5652731 - DNA, 18 bp, Homo sapiens
tggggcctgtactgcctg

SEQ ID NO: 5652732 - DNA, 22 bp, Homo sapiens
tggggcctgtggaatgagtgtg

SEQ ID NO: 5652733 - DNA, 16 bp, Homo sapiens
tggggccttccccctt

SEQ ID NO: 5652734 - DNA, 23 bp, Homo sapiens
tggggccttcgggaccctggggc

SEQ ID NO: 5652735 - DNA, 22 bp, Homo sapiens
tggggccttgatgactgccttg

SEQ ID NO: 5652736 - DNA, 14 bp, Homo sapiens
tggggccttggcct

SEQ ID NO: 5652737 - DNA, 14 bp, Homo sapiens
tggggcctttgcca

SEQ ID NO: 5652738 - DNA, 20 bp, Homo sapiens
tggggcctttgccagcagag

SEQ ID NO: 5652739 - DNA, 21 bp, Homo sapiens
tggggcctttgccagcagagc

SEQ ID NO: 5652740 - DNA, 23 bp, Homo sapiens
tggggcctttgccagcagagcca

SEQ ID NO: 5652741 - DNA, 24 bp, Homo sapiens
tggggcctttgccagcagagccag

SEQ ID NO: 5652742 - DNA, 14 bp, Homo sapiens
tggggcgaggcaga

SEQ ID NO: 5652743 - DNA, 13 bp, Homo sapiens
tggggcgcccacc

SEQ ID NO: 5652744 - DNA, 16 bp, Homo sapiens
tggggcgcccacccgg

SEQ ID NO: 5652745 - DNA, 22 bp, Homo sapiens
tggggcgcccacccggcccggc

SEQ ID NO: 5652746 - DNA, 19 bp, Homo sapiens
tggggcgctcccactcaga

SEQ ID NO: 5652747 - DNA, 15 bp, Homo sapiens
tggggcgctggacac

SEQ ID NO: 5652748 - DNA, 22 bp, Homo sapiens
tggggcgctggacacctacagc

SEQ ID NO: 5652749 - DNA, 20 bp, Homo sapiens
tggggcggagccccggctct

SEQ ID NO: 5652750 - DNA, 20 bp, Homo sapiens
tggggcggcccacgccagct

SEQ ID NO: 5652751 - DNA, 22 bp, Homo sapiens
tggggcggcccacgccagctgg

SEQ ID NO: 5652752 - DNA, 23 bp, Homo sapiens
tggggcggcccacgccagctggc

SEQ ID NO: 5652753 - DNA, 22 bp, Homo sapiens
tggggcggcctgcagaccctgc

SEQ ID NO: 5652754 - DNA, 14 bp, Homo sapiens
tggggcggggccca

SEQ ID NO: 5652755 - DNA, 16 bp, Homo sapiens
tggggcggggcccagg

SEQ ID NO: 5652756 - DNA, 14 bp, Homo sapiens
tggggcggggcttc

SEQ ID NO: 5652757 - DNA, 18 bp, Homo sapiens
tggggcgggggtgtgtct

SEQ ID NO: 5652758 - DNA, 14 bp, Homo sapiens
tggggcgtggggag

SEQ ID NO: 5652759 - DNA, 22 bp, Homo sapiens
tggggcgtttcctactgcgcct

SEQ ID NO: 5652760 - DNA, 20 bp, Homo sapiens
tggggctaaagactgatctc

SEQ ID NO: 5652761 - DNA, 16 bp, Homo sapiens
tggggctactgtttca

SEQ ID NO: 5652762 - DNA, 21 bp, Homo sapiens
tggggctactgtttcagtcct

SEQ ID NO: 5652763 - DNA, 18 bp, Homo sapiens
tggggctagactgggctg

SEQ ID NO: 5652764 - DNA, 22 bp, Homo sapiens
tggggctagactgggctggctg

SEQ ID NO: 5652765 - DNA, 23 bp, Homo sapiens
tggggctagactgggctggctgc

SEQ ID NO: 5652766 - DNA, 17 bp, Homo sapiens
tggggctaggggctggg

SEQ ID NO: 5652767 - DNA, 17 bp, Homo sapiens
tggggctcagagccggg

SEQ ID NO: 5652768 - DNA, 19 bp, Homo sapiens
tggggctcagccctgagct

SEQ ID NO: 5652769 - DNA, 16 bp, Homo sapiens
tggggctcccagctcc

SEQ ID NO: 5652770 - DNA, 14 bp, Homo sapiens
tggggctcccgccc

SEQ ID NO: 5652771 - DNA, 18 bp, Homo sapiens
tggggctcccggcatcct

SEQ ID NO: 5652772 - DNA, 19 bp, Homo sapiens
tggggctcccggcatcctg

SEQ ID NO: 5652773 - DNA, 21 bp, Homo sapiens
tggggctcccggcatcctgaa

SEQ ID NO: 5652774 - DNA, 17 bp, Homo sapiens
tggggctccggagggga

SEQ ID NO: 5652775 - DNA, 15 bp, Homo sapiens
tggggctcctacctg

SEQ ID NO: 5652776 - DNA, 16 bp, Homo sapiens
tggggctcctacctgg

SEQ ID NO: 5652777 - DNA, 23 bp, Homo sapiens
tggggctcctccagggtggcagc

SEQ ID NO: 5652778 - DNA, 13 bp, Homo sapiens
tggggctcctgga

SEQ ID NO: 5652779 - DNA, 14 bp, Homo sapiens
tggggctcctggga

SEQ ID NO: 5652780 - DNA, 18 bp, Homo sapiens
tggggctcctgggaggga

SEQ ID NO: 5652781 - DNA, 21 bp, Homo sapiens
tggggctcctttctccagcca

SEQ ID NO: 5652782 - DNA, 23 bp, Homo sapiens
tggggctcctttctccagccagc

SEQ ID NO: 5652783 - DNA, 20 bp, Homo sapiens
tggggctcgccccacccagg

SEQ ID NO: 5652784 - DNA, 20 bp, Homo sapiens
tggggctcgtggccttcccc

SEQ ID NO: 5652785 - DNA, 21 bp, Homo sapiens
tggggctcgtggccttcccct

SEQ ID NO: 5652786 - DNA, 17 bp, Homo sapiens
tggggctctaacgcctg

SEQ ID NO: 5652787 - DNA, 19 bp, Homo sapiens
tggggctctaacgcctgag

SEQ ID NO: 5652788 - DNA, 22 bp, Homo sapiens
tggggctctaacgcctgagccc

SEQ ID NO: 5652789 - DNA, 24 bp, Homo sapiens
tggggctctaacgcctgagcccag

SEQ ID NO: 5652790 - DNA, 23 bp, Homo sapiens
tggggctctagggttgctggagc

SEQ ID NO: 5652791 - DNA, 13 bp, Homo sapiens
tggggctctcagt

SEQ ID NO: 5652792 - DNA, 22 bp, Homo sapiens
tggggctctctgagtcctggcc

SEQ ID NO: 5652793 - DNA, 11 bp, Homo sapiens
tggggctgaac

SEQ ID NO: 5652794 - DNA, 19 bp, Homo sapiens
tggggctgaacatgcctgc

SEQ ID NO: 5652795 - DNA, 17 bp, Homo sapiens
tggggctgacacccagg

SEQ ID NO: 5652796 - DNA, 18 bp, Homo sapiens
tggggctgaccttcctcg

SEQ ID NO: 5652797 - DNA, 23 bp, Homo sapiens
tggggctgagagagtataaataa

SEQ ID NO: 5652798 - DNA, 13 bp, Homo sapiens
tggggctgagcct

SEQ ID NO: 5652799 - DNA, 14 bp, Homo sapiens
tggggctgagcctg

SEQ ID NO: 5652800 - DNA, 22 bp, Homo sapiens
tggggctgatctcagggaagcc

SEQ ID NO: 5652801 - DNA, 20 bp, Homo sapiens
tggggctgatgaagaagggg

SEQ ID NO: 5652802 - DNA, 14 bp, Homo sapiens
tggggctgattgta

SEQ ID NO: 5652803 - DNA, 22 bp, Homo sapiens
tggggctgcaccggctggcctg

SEQ ID NO: 5652804 - DNA, 23 bp, Homo sapiens
tggggctgcaccggctggcctgg

SEQ ID NO: 5652805 - DNA, 13 bp, Homo sapiens
tggggctgcaggc

SEQ ID NO: 5652806 - DNA, 15 bp, Homo sapiens
tggggctgccagcct

SEQ ID NO: 5652807 - DNA, 20 bp, Homo sapiens
tggggctgccatagggtctg

SEQ ID NO: 5652808 - DNA, 21 bp, Homo sapiens
tggggctgccatagggtctgc

SEQ ID NO: 5652809 - DNA, 22 bp, Homo sapiens
tggggctgccatagggtctgca

SEQ ID NO: 5652810 - DNA, 13 bp, Homo sapiens
tggggctgccgga

SEQ ID NO: 5652811 - DNA, 20 bp, Homo sapiens
tggggctgccggatctgggc

SEQ ID NO: 5652812 - DNA, 14 bp, Homo sapiens
tggtacctgtgctt

SEQ ID NO: 5652813 - DNA, 16 bp, Homo sapiens
tggtacctgtgctttc

SEQ ID NO: 5652814 - DNA, 14 bp, Homo sapiens
tggtaccttcagcc

SEQ ID NO: 5652815 - DNA, 20 bp, Homo sapiens
tggtaccttcccccagcttt

SEQ ID NO: 5652816 - DNA, 13 bp, Homo sapiens
tggtaccttgcac

SEQ ID NO: 5652817 - DNA, 14 bp, Homo sapiens
tggtaccttgcaca

SEQ ID NO: 5652818 - DNA, 14 bp, Homo sapiens
tggtacgtgggtac

SEQ ID NO: 5652819 - DNA, 23 bp, Homo sapiens
tggtactaagaggctatttaaaa

SEQ ID NO: 5652820 - DNA, 20 bp, Homo sapiens
tggtactactagatgtcttt

SEQ ID NO: 5652821 - DNA, 19 bp, Homo sapiens
tggtactagtgtggtgtgt

SEQ ID NO: 5652822 - DNA, 13 bp, Homo sapiens
tggtactcccaaa

SEQ ID NO: 5652823 - DNA, 17 bp, Homo sapiens
tggtactccctctcagg

SEQ ID NO: 5652824 - DNA, 13 bp, Homo sapiens
tggtactctgtgt

SEQ ID NO: 5652825 - DNA, 17 bp, Homo sapiens
tggtactgactttgctt

SEQ ID NO: 5652826 - DNA, 14 bp, Homo sapiens
tggtactgctgagg

SEQ ID NO: 5652827 - DNA, 22 bp, Homo sapiens
tggtactgctgaggtcccgggc

SEQ ID NO: 5652828 - DNA, 17 bp, Homo sapiens
tggtactgctgtcttcc

SEQ ID NO: 5652829 - DNA, 19 bp, Homo sapiens
tggtactgtacagctggct

SEQ ID NO: 5652830 - DNA, 24 bp, Homo sapiens
tggtacttagagtttctgtttgat

SEQ ID NO: 5652831 - DNA, 13 bp, Homo sapiens
tggtacttcctct

SEQ ID NO: 5652832 - DNA, 15 bp, Homo sapiens
tggtacttcctctgt

SEQ ID NO: 5652833 - DNA, 17 bp, Homo sapiens
tggtacttcctctgtga

SEQ ID NO: 5652834 - DNA, 16 bp, Homo sapiens
tggtacttcctttctc

SEQ ID NO: 5652835 - DNA, 13 bp, Homo sapiens
tggtacttggcac

SEQ ID NO: 5652836 - DNA, 21 bp, Homo sapiens
tggtacttggcaccaataaag

SEQ ID NO: 5652837 - DNA, 16 bp, Homo sapiens
tggtactttattcttg

SEQ ID NO: 5652838 - DNA, 22 bp, Homo sapiens
tggtacttttatgatgtatatt

SEQ ID NO: 5652839 - DNA, 18 bp, Homo sapiens
tggtagaaactttggaag

SEQ ID NO: 5652840 - DNA, 23 bp, Homo sapiens
tggtagaagctgaagagcacggt

SEQ ID NO: 5652841 - DNA, 23 bp, Homo sapiens
tggtagaagtgagagctttgctt

SEQ ID NO: 5652842 - DNA, 17 bp, Homo sapiens
tggtagaccactgccat

SEQ ID NO: 5652843 - DNA, 23 bp, Homo sapiens
tggtagaccactgccatatgatt

SEQ ID NO: 5652844 - DNA, 23 bp, Homo sapiens
tggtagacgagctgtctgctgcc

SEQ ID NO: 5652845 - DNA, 14 bp, Homo sapiens
tggtagagaaggag

SEQ ID NO: 5652846 - DNA, 19 bp, Homo sapiens
tggtagagacccccaggcc

SEQ ID NO: 5652847 - DNA, 12 bp, Homo sapiens
tggtagagacta

SEQ ID NO: 5652848 - DNA, 13 bp, Homo sapiens
tggtagagaggtt

SEQ ID NO: 5652849 - DNA, 13 bp, Homo sapiens
tggtagagattca

SEQ ID NO: 5652850 - DNA, 14 bp, Homo sapiens
tggtagaggcctgg

SEQ ID NO: 5652851 - DNA, 18 bp, Homo sapiens
tggtagagttcctttctg

SEQ ID NO: 5652852 - DNA, 14 bp, Homo sapiens
tggtagatgacaaa

SEQ ID NO: 5652853 - DNA, 15 bp, Homo sapiens
tggtagatgacaaat

SEQ ID NO: 5652854 - DNA, 16 bp, Homo sapiens
tggtagatgacaaata

SEQ ID NO: 5652855 - DNA, 17 bp, Homo sapiens
tggtagatgacaaatat

SEQ ID NO: 5652856 - DNA, 16 bp, Homo sapiens
tggtagatgcttgatt

SEQ ID NO: 5652857 - DNA, 18 bp, Homo sapiens
tggtagattaaatataga

SEQ ID NO: 5652858 - DNA, 19 bp, Homo sapiens
tggtagattaaatatagat

SEQ ID NO: 5652859 - DNA, 18 bp, Homo sapiens
tggtagattcgctgtccc

SEQ ID NO: 5652860 - DNA, 22 bp, Homo sapiens
tggtagcacatgtctgtcctca

SEQ ID NO: 5652861 - DNA, 13 bp, Homo sapiens
tggtagcacttta

SEQ ID NO: 5652862 - DNA, 17 bp, Homo sapiens
tggtagcagcaggctca

SEQ ID NO: 5652863 - DNA, 15 bp, Homo sapiens
tggtagcataaataa

SEQ ID NO: 5652864 - DNA, 22 bp, Homo sapiens
tggtagcataaataaaactgaa

SEQ ID NO: 5652865 - DNA, 23 bp, Homo sapiens
tggtagcataaataaaactgaat

SEQ ID NO: 5652866 - DNA, 18 bp, Homo sapiens
tggtagcatattcatggt

SEQ ID NO: 5652867 - DNA, 23 bp, Homo sapiens
tggtagcctcgatgtcctcctct

SEQ ID NO: 5652868 - DNA, 18 bp, Homo sapiens
tggtagctagtgatttac

SEQ ID NO: 5652869 - DNA, 13 bp, Homo sapiens
tggtagctctgag

SEQ ID NO: 5652870 - DNA, 16 bp, Homo sapiens
tggtagctgaaaaaac

SEQ ID NO: 5652871 - DNA, 21 bp, Homo sapiens
tggtagctgaggggacgggca

SEQ ID NO: 5652872 - DNA, 16 bp, Homo sapiens
tggtagcttttacttt

SEQ ID NO: 5652873 - DNA, 16 bp, Homo sapiens
tggtaggaaagcaccg

SEQ ID NO: 5652874 - DNA, 13 bp, Homo sapiens
tggtaggaactgc

SEQ ID NO: 5652875 - DNA, 16 bp, Homo sapiens
tggtaggaccaagcat

SEQ ID NO: 5652876 - DNA, 18 bp, Homo sapiens
tggtaggactgtagaaaa

SEQ ID NO: 5652877 - DNA, 22 bp, Homo sapiens
tggtaggatcagccctcatttt

SEQ ID NO: 5652878 - DNA, 13 bp, Homo sapiens
tggtaggattgct

SEQ ID NO: 5652879 - DNA, 14 bp, Homo sapiens
tggtaggctacttt

SEQ ID NO: 5652880 - DNA, 20 bp, Homo sapiens
tggtaggcttatcaaaatct

SEQ ID NO: 5652881 - DNA, 21 bp, Homo sapiens
tggtaggggagggcaggcttg

SEQ ID NO: 5652882 - DNA, 16 bp, Homo sapiens
tggtaggggcagggag

SEQ ID NO: 5652883 - DNA, 22 bp, Homo sapiens
tggtagggtataatgtgtctgt

SEQ ID NO: 5652884 - DNA, 13 bp, Homo sapiens
tggtagggtggga

SEQ ID NO: 5652885 - DNA, 18 bp, Homo sapiens
tggtaggtagcacagtgg

SEQ ID NO: 5652886 - DNA, 21 bp, Homo sapiens
tggtaggtagtgattaactgt

SEQ ID NO: 5652887 - DNA, 13 bp, Homo sapiens
tggtaggtgtggt

SEQ ID NO: 5652888 - DNA, 14 bp, Homo sapiens
tggtaggttctgtc

SEQ ID NO: 5652889 - DNA, 14 bp, Homo sapiens
tggtaggttgggac

SEQ ID NO: 5652890 - DNA, 18 bp, Homo sapiens
tggtaggttgggacacca

SEQ ID NO: 5652891 - DNA, 15 bp, Homo sapiens
tggtagtaaaacaca

SEQ ID NO: 5652892 - DNA, 22 bp, Homo sapiens
tggtagtactcctgcaaaattt

SEQ ID NO: 5652893 - DNA, 21 bp, Homo sapiens
tggtagtatctcgtaatagct

SEQ ID NO: 5652894 - DNA, 22 bp, Homo sapiens
tggtagtatctcgtaatagctt

SEQ ID NO: 5652895 - DNA, 24 bp, Homo sapiens
tggtagtcctcccaagctgtgctg

SEQ ID NO: 5652896 - DNA, 17 bp, Homo sapiens
tggtagtcggagccccc

SEQ ID NO: 5652897 - DNA, 12 bp, Homo sapiens
tggtagtgcccc

SEQ ID NO: 5652898 - DNA, 20 bp, Homo sapiens
tggtagttagtagcatgttg

SEQ ID NO: 5652899 - DNA, 19 bp, Homo sapiens
tggtagttcattgtaaatg

SEQ ID NO: 5652900 - DNA, 21 bp, Homo sapiens
tggtagttctgtgcctccccc

SEQ ID NO: 5652901 - DNA, 14 bp, Homo sapiens
tggtagtttaaaac

SEQ ID NO: 5652902 - DNA, 15 bp, Homo sapiens
tggtagttttcccta

SEQ ID NO: 5652903 - DNA, 15 bp, Homo sapiens
tggtagttttttcat

SEQ ID NO: 5652904 - DNA, 17 bp, Homo sapiens
tggtagttttttcatct

SEQ ID NO: 5652905 - DNA, 18 bp, Homo sapiens
tggtagttttttcatctt

SEQ ID NO: 5652906 - DNA, 11 bp, Homo sapiens
tggtataaaag

SEQ ID NO: 5652907 - DNA, 19 bp, Homo sapiens
tggtataaaaggttgccaa

SEQ ID NO: 5652908 - DNA, 17 bp, Homo sapiens
tggtataaacaggagac

SEQ ID NO: 5652909 - DNA, 19 bp, Homo sapiens
tggtataaggtacatattt

SEQ ID NO: 5652910 - DNA, 15 bp, Homo sapiens
tggtataatgtttaa

SEQ ID NO: 5652911 - DNA, 18 bp, Homo sapiens
tggtataatgtttaaatc

SEQ ID NO: 5652912 - DNA, 19 bp, Homo sapiens
tggtataatgtttaaatca

SEQ ID NO: 5652913 - DNA, 20 bp, Homo sapiens
tggtataatgtttaaatcat

SEQ ID NO: 5652914 - DNA, 13 bp, Homo sapiens
tggtataattatg

SEQ ID NO: 5652915 - DNA, 13 bp, Homo sapiens
tggtataattgtg

SEQ ID NO: 5652916 - DNA, 21 bp, Homo sapiens
tggtatacatgtgtacatata

SEQ ID NO: 5652917 - DNA, 13 bp, Homo sapiens
tggtatagaaatg

SEQ ID NO: 5652918 - DNA, 22 bp, Homo sapiens
tggtatagaaatgctggttttt

SEQ ID NO: 5652919 - DNA, 17 bp, Homo sapiens
tggtatagccatgattt

SEQ ID NO: 5652920 - DNA, 16 bp, Homo sapiens
tggtatatccaaaagc

SEQ ID NO: 5652921 - DNA, 22 bp, Homo sapiens
tggtatatccttttctgtgttt

SEQ ID NO: 5652922 - DNA, 21 bp, Homo sapiens
tggtatattattgcttcatgt

SEQ ID NO: 5652923 - DNA, 16 bp, Homo sapiens
tggtatattgtgtaaa

SEQ ID NO: 5652924 - DNA, 17 bp, Homo sapiens
tggtatatttgaaataa

SEQ ID NO: 5652925 - DNA, 18 bp, Homo sapiens
tggtatatttgaaataaa

SEQ ID NO: 5652926 - DNA, 16 bp, Homo sapiens
tggtatatttgtagat

SEQ ID NO: 5652927 - DNA, 17 bp, Homo sapiens
tggtatatttgtgtatg

SEQ ID NO: 5652928 - DNA, 14 bp, Homo sapiens
tggtatcaaaatta

SEQ ID NO: 5652929 - DNA, 16 bp, Homo sapiens
tggtatcaaaattaca

SEQ ID NO: 5652930 - DNA, 16 bp, Homo sapiens
tggtatcatatattaa

SEQ ID NO: 5652931 - DNA, 20 bp, Homo sapiens
tggtatcatattaacatatt

SEQ ID NO: 5652932 - DNA, 22 bp, Homo sapiens
tggtatcattacaattttctgt

SEQ ID NO: 5652933 - DNA, 15 bp, Homo sapiens
tggtatccacagtta

SEQ ID NO: 5652934 - DNA, 20 bp, Homo sapiens
tggtatcctactgagcattt

SEQ ID NO: 5652935 - DNA, 22 bp, Homo sapiens
tggtatcctgtgacatgtaaca

SEQ ID NO: 5652936 - DNA, 21 bp, Homo sapiens
tggtatcgttcgcttgtttta

SEQ ID NO: 5652937 - DNA, 22 bp, Homo sapiens
tggtatctagacccatcttctt

SEQ ID NO: 5652938 - DNA, 14 bp, Homo sapiens
tggtatctgttctt

SEQ ID NO: 5652939 - DNA, 20 bp, Homo sapiens
tggtatctttaattgtatct

SEQ ID NO: 5652940 - DNA, 14 bp, Homo sapiens
tggtatctttagat

SEQ ID NO: 5652941 - DNA, 14 bp, Homo sapiens
tggtatgaaacaaa

SEQ ID NO: 5652942 - DNA, 14 bp, Homo sapiens
tggtatgagctgag

SEQ ID NO: 5652943 - DNA, 16 bp, Homo sapiens
tggtatgagctgaggg

SEQ ID NO: 5652944 - DNA, 17 bp, Homo sapiens
tggtatgagggggtggt

SEQ ID NO: 5652945 - DNA, 18 bp, Homo sapiens
tggtatgatcacggctca

SEQ ID NO: 5652946 - DNA, 18 bp, Homo sapiens
tggtatgcattctttata

SEQ ID NO: 5652947 - DNA, 21 bp, Homo sapiens
tggtatgctggccagcaccct

SEQ ID NO: 5652948 - DNA, 19 bp, Homo sapiens
tggtatggaactctctcca

SEQ ID NO: 5652949 - DNA, 18 bp, Homo sapiens
tggtatggccaaaagtca

SEQ ID NO: 5652950 - DNA, 19 bp, Homo sapiens
tggtatgggtttctcccag

SEQ ID NO: 5652951 - DNA, 18 bp, Homo sapiens
tggtatggtgctaatatt

SEQ ID NO: 5652952 - DNA, 18 bp, Homo sapiens
tggtatgtaatttatgca

SEQ ID NO: 5652953 - DNA, 15 bp, Homo sapiens
tggtatgtagagctt

SEQ ID NO: 5652954 - DNA, 15 bp, Homo sapiens
tggtatgtgccaggc

SEQ ID NO: 5652955 - DNA, 19 bp, Homo sapiens
tggtatgttgggataagga

SEQ ID NO: 5652956 - DNA, 12 bp, Homo sapiens
tggtattaaaga

SEQ ID NO: 5652957 - DNA, 15 bp, Homo sapiens
tggtattaaatgcca

SEQ ID NO: 5652958 - DNA, 24 bp, Homo sapiens
tggtattaactttatacacttgga

SEQ ID NO: 5652959 - DNA, 20 bp, Homo sapiens
tggtattagttaaaacacat

SEQ ID NO: 5652960 - DNA, 17 bp, Homo sapiens
tggtattctggtaggga

SEQ ID NO: 5652961 - DNA, 20 bp, Homo sapiens
tggtattgaatctaaaacca

SEQ ID NO: 5652962 - DNA, 20 bp, Homo sapiens
tggtattggccgatgagctg

SEQ ID NO: 5652963 - DNA, 23 bp, Homo sapiens
tggtattggctagaggttcaaag

SEQ ID NO: 5652964 - DNA, 13 bp, Homo sapiens
tggtattgtaaaa

SEQ ID NO: 5652965 - DNA, 16 bp, Homo sapiens
tggtattgtaaaacat

SEQ ID NO: 5652966 - DNA, 21 bp, Homo sapiens
tggtattgtaaaacattcaca

SEQ ID NO: 5652967 - DNA, 17 bp, Homo sapiens
tggtattgtattgtaaa

SEQ ID NO: 5652968 - DNA, 22 bp, Homo sapiens
tggtattgtatttattcaataa

SEQ ID NO: 5652969 - DNA, 20 bp, Homo sapiens
tggtattgtcttaaataaat

SEQ ID NO: 5652970 - DNA, 14 bp, Homo sapiens
tggtatttactgca

SEQ ID NO: 5652971 - DNA, 22 bp, Homo sapiens
tggtatttactgcaatgtctgt

SEQ ID NO: 5652972 - DNA, 22 bp, Homo sapiens
tggtatttatctattgtaagat

SEQ ID NO: 5652973 - DNA, 15 bp, Homo sapiens
tggtatttcccctgt

SEQ ID NO: 5652974 - DNA, 19 bp, Homo sapiens
tggtatttgagacattcca

SEQ ID NO: 5652975 - DNA, 20 bp, Homo sapiens
tggtatttgcaccaacatag

SEQ ID NO: 5652976 - DNA, 14 bp, Homo sapiens
tggtatttgtttaa

SEQ ID NO: 5652977 - DNA, 20 bp, Homo sapiens
tggtatttgtttgtagcttt

SEQ ID NO: 5652978 - DNA, 17 bp, Homo sapiens
tggtattttaacatagc

SEQ ID NO: 5652979 - DNA, 18 bp, Homo sapiens
tggtattttaacatagca

SEQ ID NO: 5652980 - DNA, 18 bp, Homo sapiens
tggtattttaagagaaaa

SEQ ID NO: 5652981 - DNA, 14 bp, Homo sapiens
tggtattttatttt

SEQ ID NO: 5652982 - DNA, 15 bp, Homo sapiens
tggtattttcaacca

SEQ ID NO: 5652983 - DNA, 18 bp, Homo sapiens
tggtattttcagagaaca

SEQ ID NO: 5652984 - DNA, 22 bp, Homo sapiens
tggtattttggcattttggctc

SEQ ID NO: 5652985 - DNA, 23 bp, Homo sapiens
tggtattttggcattttggctca

SEQ ID NO: 5652986 - DNA, 17 bp, Homo sapiens
tggtcaaaccgcactca

SEQ ID NO: 5652987 - DNA, 20 bp, Homo sapiens
tggtcaaaccgcactcaccc

SEQ ID NO: 5652988 - DNA, 14 bp, Homo sapiens
tggtcaacacttaa

SEQ ID NO: 5652989 - DNA, 20 bp, Homo sapiens
tggtgtggtacagagaagcc

SEQ ID NO: 5652990 - DNA, 21 bp, Homo sapiens
tggtgtggtacagagaagcca

SEQ ID NO: 5652991 - DNA, 22 bp, Homo sapiens
tggtgtgtcccattggtgttgt

SEQ ID NO: 5652992 - DNA, 19 bp, Homo sapiens
tggtgtgtccccctctgtc

SEQ ID NO: 5652993 - DNA, 17 bp, Homo sapiens
tggtgtgtccctggaca

SEQ ID NO: 5652994 - DNA, 21 bp, Homo sapiens
tggtgtgtccctggacacagc

SEQ ID NO: 5652995 - DNA, 15 bp, Homo sapiens
tggtgtgtgtctctg

SEQ ID NO: 5652996 - DNA, 14 bp, Homo sapiens
tggtgtgttggaca

SEQ ID NO: 5652997 - DNA, 16 bp, Homo sapiens
tggtgtgttggacaga

SEQ ID NO: 5652998 - DNA, 14 bp, Homo sapiens
tggtgttaaaacac

SEQ ID NO: 5652999 - DNA, 14 bp, Homo sapiens
tggtgttaaagctg

SEQ ID NO: 5653000 - DNA, 16 bp, Homo sapiens
tggtgttaaagctgta

SEQ ID NO: 5653001 - DNA, 20 bp, Homo sapiens
tggtgttaacagaagggagg

SEQ ID NO: 5653002 - DNA, 14 bp, Homo sapiens
tggtgttacacata

SEQ ID NO: 5653003 - DNA, 15 bp, Homo sapiens
tggtgttacattaaa

SEQ ID NO: 5653004 - DNA, 17 bp, Homo sapiens
tggtgttactgcagttg

SEQ ID NO: 5653005 - DNA, 20 bp, Homo sapiens
tggtgttagggggatgagca

SEQ ID NO: 5653006 - DNA, 21 bp, Homo sapiens
tggtgttcaaaaaacttgtaa

SEQ ID NO: 5653007 - DNA, 13 bp, Homo sapiens
tggtgttccattg

SEQ ID NO: 5653008 - DNA, 16 bp, Homo sapiens
tggtgttcctgaagca

SEQ ID NO: 5653009 - DNA, 13 bp, Homo sapiens
tggtgttcctgga

SEQ ID NO: 5653010 - DNA, 18 bp, Homo sapiens
tggtgttcgtttccatca

SEQ ID NO: 5653011 - DNA, 22 bp, Homo sapiens
tggtgttctcctgctgctccct

SEQ ID NO: 5653012 - DNA, 16 bp, Homo sapiens
tggtgttctggcctct

SEQ ID NO: 5653013 - DNA, 17 bp, Homo sapiens
tggtgttcttcccaaag

SEQ ID NO: 5653014 - DNA, 20 bp, Homo sapiens
tggtgttcttgctaactttg

SEQ ID NO: 5653015 - DNA, 17 bp, Homo sapiens
tggtgttgcagaaggtt

SEQ ID NO: 5653016 - DNA, 22 bp, Homo sapiens
tggtgttgcagccgcagagaaa

SEQ ID NO: 5653017 - DNA, 22 bp, Homo sapiens
tggtgttgccagttgtcctcct

SEQ ID NO: 5653018 - DNA, 16 bp, Homo sapiens
tggtgttggaggggca

SEQ ID NO: 5653019 - DNA, 11 bp, Homo sapiens
tggtgttggct

SEQ ID NO: 5653020 - DNA, 21 bp, Homo sapiens
tggtgttgggaaggggtcctg

SEQ ID NO: 5653021 - DNA, 21 bp, Homo sapiens
tggtgttggggaaaccttcat

SEQ ID NO: 5653022 - DNA, 23 bp, Homo sapiens
tggtgtttatgtgaacattccta

SEQ ID NO: 5653023 - DNA, 16 bp, Homo sapiens
tggtgtttcccttcct

SEQ ID NO: 5653024 - DNA, 13 bp, Homo sapiens
tggtgtttgactg

SEQ ID NO: 5653025 - DNA, 16 bp, Homo sapiens
tggtgtttgactgtaa

SEQ ID NO: 5653026 - DNA, 22 bp, Homo sapiens
tggtgtttgggccacgatttta

SEQ ID NO: 5653027 - DNA, 14 bp, Homo sapiens
tggtgtttgtcatg

SEQ ID NO: 5653028 - DNA, 15 bp, Homo sapiens
tggtgtttgtcatgg

SEQ ID NO: 5653029 - DNA, 19 bp, Homo sapiens
tggtgtttgtcatggtgaa

SEQ ID NO: 5653030 - DNA, 23 bp, Homo sapiens
tggtgttttcattcccccttcct

SEQ ID NO: 5653031 - DNA, 23 bp, Homo sapiens
tggtgttttgcacttctgtaaac

SEQ ID NO: 5653032 - DNA, 20 bp, Homo sapiens
tggtgtttttctctctggac

SEQ ID NO: 5653033 - DNA, 23 bp, Homo sapiens
tggtgtttttcttgtaaatgtgt

SEQ ID NO: 5653034 - DNA, 22 bp, Homo sapiens
tggtgtttttttctatgggtgt

SEQ ID NO: 5653035 - DNA, 15 bp, Homo sapiens
tggtgttttttttcc

SEQ ID NO: 5653036 - DNA, 17 bp, Homo sapiens
tggttaaaaaggccaaa

SEQ ID NO: 5653037 - DNA, 17 bp, Homo sapiens
tggttaaaataaagcct

SEQ ID NO: 5653038 - DNA, 15 bp, Homo sapiens
tggttaaaatgtgat

SEQ ID NO: 5653039 - DNA, 18 bp, Homo sapiens
tggttaaaatgtgatttt

SEQ ID NO: 5653040 - DNA, 17 bp, Homo sapiens
tggttaaaggtctccca

SEQ ID NO: 5653041 - DNA, 19 bp, Homo sapiens
tggttaaataaggcagggt

SEQ ID NO: 5653042 - DNA, 16 bp, Homo sapiens
tggttaaattttacat

SEQ ID NO: 5653043 - DNA, 21 bp, Homo sapiens
tggttaacagagctaagaaat

SEQ ID NO: 5653044 - DNA, 20 bp, Homo sapiens
tggttaagaatgtatatcag

SEQ ID NO: 5653045 - DNA, 21 bp, Homo sapiens
tggttaagaatgtatatcagg

SEQ ID NO: 5653046 - DNA, 13 bp, Homo sapiens
tggttaagagtcc

SEQ ID NO: 5653047 - DNA, 16 bp, Homo sapiens
tggttaagagtccaag

SEQ ID NO: 5653048 - DNA, 14 bp, Homo sapiens
tggttaagggactt

SEQ ID NO: 5653049 - DNA, 17 bp, Homo sapiens
tggttaagggctcccta

SEQ ID NO: 5653050 - DNA, 22 bp, Homo sapiens
tggttaagttttcttgtttctg

SEQ ID NO: 5653051 - DNA, 15 bp, Homo sapiens
tggttaataaaactg

SEQ ID NO: 5653052 - DNA, 17 bp, Homo sapiens
tggttaataaaactgca

SEQ ID NO: 5653053 - DNA, 23 bp, Homo sapiens
tggttaatcacttaacctgcttt

SEQ ID NO: 5653054 - DNA, 12 bp, Homo sapiens
tggttaatctct

SEQ ID NO: 5653055 - DNA, 17 bp, Homo sapiens
tggttaatctttcctga

SEQ ID NO: 5653056 - DNA, 18 bp, Homo sapiens
tggttaatgaaaaatctg

SEQ ID NO: 5653057 - DNA, 20 bp, Homo sapiens
tggttaatgaaaaatctgaa

SEQ ID NO: 5653058 - DNA, 16 bp, Homo sapiens
tggttaatgtagtatg

SEQ ID NO: 5653059 - DNA, 22 bp, Homo sapiens
tggttaatttttcctgcatgtt

SEQ ID NO: 5653060 - DNA, 13 bp, Homo sapiens
tggttacactgtt

SEQ ID NO: 5653061 - DNA, 14 bp, Homo sapiens
tggttacactgtta

SEQ ID NO: 5653062 - DNA, 17 bp, Homo sapiens
tggttacagtgcagaca

SEQ ID NO: 5653063 - DNA, 12 bp, Homo sapiens
tggttacatgaa

SEQ ID NO: 5653064 - DNA, 16 bp, Homo sapiens
tggttaccatgggtgt

SEQ ID NO: 5653065 - DNA, 19 bp, Homo sapiens
tggttaccgagtatctgta

SEQ ID NO: 5653066 - DNA, 21 bp, Homo sapiens
tggttaccgagtatctgtaac

SEQ ID NO: 5653067 - DNA, 22 bp, Homo sapiens
tggttaccgagtatctgtaacc

SEQ ID NO: 5653068 - DNA, 21 bp, Homo sapiens
tggttacctgacctaaattag

SEQ ID NO: 5653069 - DNA, 17 bp, Homo sapiens
tggttacctggagaagt

SEQ ID NO: 5653070 - DNA, 19 bp, Homo sapiens
tggttacctggagaagtag

SEQ ID NO: 5653071 - DNA, 16 bp, Homo sapiens
tggttacctgttccat

SEQ ID NO: 5653072 - DNA, 14 bp, Homo sapiens
tggttactcagggt

SEQ ID NO: 5653073 - DNA, 14 bp, Homo sapiens
tggttactcatttt

SEQ ID NO: 5653074 - DNA, 13 bp, Homo sapiens
tggttactggtga

SEQ ID NO: 5653075 - DNA, 14 bp, Homo sapiens
tggttacttcttct

SEQ ID NO: 5653076 - DNA, 21 bp, Homo sapiens
tggttacttcttctcttagat

SEQ ID NO: 5653077 - DNA, 13 bp, Homo sapiens
tggttactttcaa

SEQ ID NO: 5653078 - DNA, 14 bp, Homo sapiens
tggttactttcaaa

SEQ ID NO: 5653079 - DNA, 12 bp, Homo sapiens
tggttactttgt

SEQ ID NO: 5653080 - DNA, 13 bp, Homo sapiens
tggttagaaatgc

SEQ ID NO: 5653081 - DNA, 16 bp, Homo sapiens
tggttagaaccagcag

SEQ ID NO: 5653082 - DNA, 17 bp, Homo sapiens
tggttagaaccagcaga

SEQ ID NO: 5653083 - DNA, 23 bp, Homo sapiens
tggttagaaccagcagaagccag

SEQ ID NO: 5653084 - DNA, 16 bp, Homo sapiens
tggttagaatcttgtt

SEQ ID NO: 5653085 - DNA, 17 bp, Homo sapiens
tggttagaatcttgttt

SEQ ID NO: 5653086 - DNA, 15 bp, Homo sapiens
tggttagaggaaggc

SEQ ID NO: 5653087 - DNA, 14 bp, Homo sapiens
tggttagattcatt

SEQ ID NO: 5653088 - DNA, 13 bp, Homo sapiens
tggttagctcagc

SEQ ID NO: 5653089 - DNA, 20 bp, Homo sapiens
tggttaggcattgtgggaag

SEQ ID NO: 5653090 - DNA, 12 bp, Homo sapiens
tggttatacatg

SEQ ID NO: 5653091 - DNA, 19 bp, Homo sapiens
tggttatagtgcaatatat

SEQ ID NO: 5653092 - DNA, 21 bp, Homo sapiens
tggttatagttgatatgtaac

SEQ ID NO: 5653093 - DNA, 21 bp, Homo sapiens
tggttatcctgtgctacagag

SEQ ID NO: 5653094 - DNA, 13 bp, Homo sapiens
tggttatcttgtt

SEQ ID NO: 5653095 - DNA, 18 bp, Homo sapiens
tggttatgaaagaatata

SEQ ID NO: 5653096 - DNA, 19 bp, Homo sapiens
tggttatgaaagaatatat

SEQ ID NO: 5653097 - DNA, 20 bp, Homo sapiens
tggttatgaaagaatatatt

SEQ ID NO: 5653098 - DNA, 12 bp, Homo sapiens
tggttatgaact

SEQ ID NO: 5653099 - DNA, 14 bp, Homo sapiens
tggttatggagagg

SEQ ID NO: 5653100 - DNA, 14 bp, Homo sapiens
tggttatggagtct

SEQ ID NO: 5653101 - DNA, 20 bp, Homo sapiens
tggttatggggagagggcat

SEQ ID NO: 5653102 - DNA, 13 bp, Homo sapiens
tggttatgtccca

SEQ ID NO: 5653103 - DNA, 16 bp, Homo sapiens
tggttatgtcccatga

SEQ ID NO: 5653104 - DNA, 19 bp, Homo sapiens
tggttatgtttttctgtgt

SEQ ID NO: 5653105 - DNA, 17 bp, Homo sapiens
tggttattctgccataa

SEQ ID NO: 5653106 - DNA, 19 bp, Homo sapiens
tggttattggactccaggc

SEQ ID NO: 5653107 - DNA, 21 bp, Homo sapiens
tggttattggactccaggcct

SEQ ID NO: 5653108 - DNA, 22 bp, Homo sapiens
tggttatttagggaactgcttg

SEQ ID NO: 5653109 - DNA, 13 bp, Homo sapiens
tggttatttctct

SEQ ID NO: 5653110 - DNA, 19 bp, Homo sapiens
tggttatttttatacagta

SEQ ID NO: 5653111 - DNA, 13 bp, Homo sapiens
tggttatttttct

SEQ ID NO: 5653112 - DNA, 24 bp, Homo sapiens
tggttatttttctcttgtaccata

SEQ ID NO: 5653113 - DNA, 15 bp, Homo sapiens
tggttcacactgacc

SEQ ID NO: 5653114 - DNA, 15 bp, Homo sapiens
tggttcacctgtgac

SEQ ID NO: 5653115 - DNA, 15 bp, Homo sapiens
tggttcactgcactg

SEQ ID NO: 5653116 - DNA, 18 bp, Homo sapiens
tggttcagacacagctct

SEQ ID NO: 5653117 - DNA, 14 bp, Homo sapiens
tggttcagagactg

SEQ ID NO: 5653118 - DNA, 19 bp, Homo sapiens
tggttcagagactggcagc

SEQ ID NO: 5653119 - DNA, 21 bp, Homo sapiens
tggttcagagactggcagcca

SEQ ID NO: 5653120 - DNA, 20 bp, Homo sapiens
tggttcagctactttccatt

SEQ ID NO: 5653121 - DNA, 18 bp, Homo sapiens
tggttcaggcataaatta

SEQ ID NO: 5653122 - DNA, 15 bp, Homo sapiens
tggttcagtctagaa

SEQ ID NO: 5653123 - DNA, 16 bp, Homo sapiens
tggttcagtctagaag

SEQ ID NO: 5653124 - DNA, 15 bp, Homo sapiens
tggttcataaatgaa

SEQ ID NO: 5653125 - DNA, 19 bp, Homo sapiens
tggttcatgcagacaaagc

SEQ ID NO: 5653126 - DNA, 14 bp, Homo sapiens
tggttcattccaca

SEQ ID NO: 5653127 - DNA, 19 bp, Homo sapiens
tggttcattttttttccct

SEQ ID NO: 5653128 - DNA, 20 bp, Homo sapiens
tggttccaagaaagatccac

SEQ ID NO: 5653129 - DNA, 13 bp, Homo sapiens
tggttccaagccc

SEQ ID NO: 5653130 - DNA, 15 bp, Homo sapiens
tggttccaatgaaat

SEQ ID NO: 5653131 - DNA, 19 bp, Homo sapiens
tggttccagatacttcagc

SEQ ID NO: 5653132 - DNA, 21 bp, Homo sapiens
tggttccagggtccctctgtg

SEQ ID NO: 5653133 - DNA, 17 bp, Homo sapiens
tggttccatgcctgagg

SEQ ID NO: 5653134 - DNA, 18 bp, Homo sapiens
tggttccatgcctgctct

SEQ ID NO: 5653135 - DNA, 23 bp, Homo sapiens
tggttccattgtttggagacatt

SEQ ID NO: 5653136 - DNA, 15 bp, Homo sapiens
tggttcccaataaaa

SEQ ID NO: 5653137 - DNA, 16 bp, Homo sapiens
tggttcccaataaaag

SEQ ID NO: 5653138 - DNA, 20 bp, Homo sapiens
tggttcccaataaaagtgac

SEQ ID NO: 5653139 - DNA, 21 bp, Homo sapiens
tggttcccaataaaagtgact

SEQ ID NO: 5653140 - DNA, 14 bp, Homo sapiens
tggttcccaatatc

SEQ ID NO: 5653141 - DNA, 19 bp, Homo sapiens
tggttcccaatatcatgtg

SEQ ID NO: 5653142 - DNA, 22 bp, Homo sapiens
tggttcccaatatcatgtgatt

SEQ ID NO: 5653143 - DNA, 20 bp, Homo sapiens
tggttcccccaggaccctga

SEQ ID NO: 5653144 - DNA, 23 bp, Homo sapiens
tggttcccctgttcactctactt

SEQ ID NO: 5653145 - DNA, 15 bp, Homo sapiens
tggttccctgctgcg

SEQ ID NO: 5653146 - DNA, 19 bp, Homo sapiens
tggttccctgctgcgctgc

SEQ ID NO: 5653147 - DNA, 16 bp, Homo sapiens
tggttcccttgatgaa

SEQ ID NO: 5653148 - DNA, 17 bp, Homo sapiens
tggttcccttgatgaag

SEQ ID NO: 5653149 - DNA, 20 bp, Homo sapiens
tggttcccttgatgaagaag

SEQ ID NO: 5653150 - DNA, 23 bp, Homo sapiens
tggttccctttgctccaccccac

SEQ ID NO: 5653151 - DNA, 21 bp, Homo sapiens
tggttccgcccactcattcct

SEQ ID NO: 5653152 - DNA, 15 bp, Homo sapiens
tggttcctcacatat

SEQ ID NO: 5653153 - DNA, 16 bp, Homo sapiens
tggttcctcatggctg

SEQ ID NO: 5653154 - DNA, 23 bp, Homo sapiens
tggttcctcccctcctcctggac

SEQ ID NO: 5653155 - DNA, 16 bp, Homo sapiens
tggttcctctctccca

SEQ ID NO: 5653156 - DNA, 13 bp, Homo sapiens
tggttcctctgct

SEQ ID NO: 5653157 - DNA, 13 bp, Homo sapiens
tggttcctgctgt

SEQ ID NO: 5653158 - DNA, 16 bp, Homo sapiens
tggttcctgctgtcct

SEQ ID NO: 5653159 - DNA, 21 bp, Homo sapiens
tggttccttaagtggctgtga

SEQ ID NO: 5653160 - DNA, 13 bp, Homo sapiens
tggttccttgggg

SEQ ID NO: 5653161 - DNA, 16 bp, Homo sapiens
tggttcgtgctgtgct

SEQ ID NO: 5653162 - DNA, 14 bp, Homo sapiens
tggttctaaaggta

SEQ ID NO: 5653163 - DNA, 14 bp, Homo sapiens
tggttctaaatatt

SEQ ID NO: 5653164 - DNA, 19 bp, Homo sapiens
tggttctaaatattgcttc

SEQ ID NO: 5653165 - DNA, 17 bp, Homo sapiens
tggttctaaggacctga

SEQ ID NO: 5653166 - DNA, 15 bp, Homo sapiens
tggttctaatagaac

SEQ ID NO: 5653167 - DNA, 22 bp, Homo sapiens
tgtaaattgactgtactaggcc

SEQ ID NO: 5653168 - DNA, 16 bp, Homo sapiens
tgtaaattgcacagag

SEQ ID NO: 5653169 - DNA, 23 bp, Homo sapiens
tgtaaattgcacagagcacactt

SEQ ID NO: 5653170 - DNA, 17 bp, Homo sapiens
tgtaaattgttgtttca

SEQ ID NO: 5653171 - DNA, 20 bp, Homo sapiens
tgtaaatttaactgcatata

SEQ ID NO: 5653172 - DNA, 15 bp, Homo sapiens
tgtaaatttatgtga

SEQ ID NO: 5653173 - DNA, 17 bp, Homo sapiens
tgtaaatttatgtgatg

SEQ ID NO: 5653174 - DNA, 16 bp, Homo sapiens
tgtaaatttggattta

SEQ ID NO: 5653175 - DNA, 18 bp, Homo sapiens
tgtaaatttggcttctgt

SEQ ID NO: 5653176 - DNA, 21 bp, Homo sapiens
tgtaaatttggcttctgttgt

SEQ ID NO: 5653177 - DNA, 14 bp, Homo sapiens
tgtaaatttgtact

SEQ ID NO: 5653178 - DNA, 18 bp, Homo sapiens
tgtaaatttgtactattt

SEQ ID NO: 5653179 - DNA, 13 bp, Homo sapiens
tgtaaattttgga

SEQ ID NO: 5653180 - DNA, 12 bp, Homo sapiens
tgtaacaaagtt

SEQ ID NO: 5653181 - DNA, 18 bp, Homo sapiens
tgtaacaaagtttgctga

SEQ ID NO: 5653182 - DNA, 12 bp, Homo sapiens
tgtaacaacaat

SEQ ID NO: 5653183 - DNA, 14 bp, Homo sapiens
tgtaacaagaaaat

SEQ ID NO: 5653184 - DNA, 13 bp, Homo sapiens
tgtaacaagaaag

SEQ ID NO: 5653185 - DNA, 21 bp, Homo sapiens
tgtaacaagggttttaatgta

SEQ ID NO: 5653186 - DNA, 22 bp, Homo sapiens
tgtaacaagttccattatgaaa

SEQ ID NO: 5653187 - DNA, 19 bp, Homo sapiens
tgtaacaattgtgtagcct

SEQ ID NO: 5653188 - DNA, 21 bp, Homo sapiens
tgtaacacaagccacagaagc

SEQ ID NO: 5653189 - DNA, 21 bp, Homo sapiens
tgtaacacagctgagagactt

SEQ ID NO: 5653190 - DNA, 16 bp, Homo sapiens
tgtaacacaggataaa

SEQ ID NO: 5653191 - DNA, 16 bp, Homo sapiens
tgtaacactcctctgc

SEQ ID NO: 5653192 - DNA, 19 bp, Homo sapiens
tgtaacactgtgtacacct

SEQ ID NO: 5653193 - DNA, 21 bp, Homo sapiens
tgtaacactgtgtacacctca

SEQ ID NO: 5653194 - DNA, 22 bp, Homo sapiens
tgtaacagaaagggcaacaata

SEQ ID NO: 5653195 - DNA, 13 bp, Homo sapiens
tgtaacagacatt

SEQ ID NO: 5653196 - DNA, 18 bp, Homo sapiens
tgtaacagccaggagtgt

SEQ ID NO: 5653197 - DNA, 13 bp, Homo sapiens
tgtaacagctcct

SEQ ID NO: 5653198 - DNA, 14 bp, Homo sapiens
tgtaacagctcctt

SEQ ID NO: 5653199 - DNA, 20 bp, Homo sapiens
tgtaacaggatacaggtgac

SEQ ID NO: 5653200 - DNA, 20 bp, Homo sapiens
tgtaacaggtctcctcttaa

SEQ ID NO: 5653201 - DNA, 21 bp, Homo sapiens
tgtaacagtcaaatatcattt

SEQ ID NO: 5653202 - DNA, 17 bp, Homo sapiens
tgtaacagttggtgatt

SEQ ID NO: 5653203 - DNA, 19 bp, Homo sapiens
tgtaacagttggtgatttt

SEQ ID NO: 5653204 - DNA, 13 bp, Homo sapiens
tgtaacagtttaa

SEQ ID NO: 5653205 - DNA, 14 bp, Homo sapiens
tgtaacatagagta

SEQ ID NO: 5653206 - DNA, 15 bp, Homo sapiens
tgtaacatagattta

SEQ ID NO: 5653207 - DNA, 15 bp, Homo sapiens
tgtaacatatctgta

SEQ ID NO: 5653208 - DNA, 22 bp, Homo sapiens
tgtaacatcactatccatgcac

SEQ ID NO: 5653209 - DNA, 14 bp, Homo sapiens
tgtaacatcataat

SEQ ID NO: 5653210 - DNA, 15 bp, Homo sapiens
tgtaacatcataatt

SEQ ID NO: 5653211 - DNA, 16 bp, Homo sapiens
tgtaacatccaagcca

SEQ ID NO: 5653212 - DNA, 17 bp, Homo sapiens
tgtaacatccaagccag

SEQ ID NO: 5653213 - DNA, 18 bp, Homo sapiens
tgtaacatccaagccaga

SEQ ID NO: 5653214 - DNA, 20 bp, Homo sapiens
tgtaacatccaataggaatg

SEQ ID NO: 5653215 - DNA, 15 bp, Homo sapiens
tgtaacatccagaag

SEQ ID NO: 5653216 - DNA, 15 bp, Homo sapiens
tgtaacatgatgtta

SEQ ID NO: 5653217 - DNA, 18 bp, Homo sapiens
tgtaacatgatgttaact

SEQ ID NO: 5653218 - DNA, 16 bp, Homo sapiens
tgtaacatgatttccc

SEQ ID NO: 5653219 - DNA, 16 bp, Homo sapiens
tgtaacatgtctaaag

SEQ ID NO: 5653220 - DNA, 17 bp, Homo sapiens
tgtaacattctatttca

SEQ ID NO: 5653221 - DNA, 15 bp, Homo sapiens
tgtaacattggtgaa

SEQ ID NO: 5653222 - DNA, 16 bp, Homo sapiens
tgtaacatttacgaat

SEQ ID NO: 5653223 - DNA, 17 bp, Homo sapiens
tgtaaccacaactttca

SEQ ID NO: 5653224 - DNA, 18 bp, Homo sapiens
tgtaaccacctctctgtc

SEQ ID NO: 5653225 - DNA, 14 bp, Homo sapiens
tgtaaccagattaa

SEQ ID NO: 5653226 - DNA, 23 bp, Homo sapiens
tgtaaccatatgattgaaaagaa

SEQ ID NO: 5653227 - DNA, 23 bp, Homo sapiens
tgtaacccttgaatttctagaca

SEQ ID NO: 5653228 - DNA, 20 bp, Homo sapiens
tgtaaccgtaacccaccccc

SEQ ID NO: 5653229 - DNA, 12 bp, Homo sapiens
tgtaacctcagc

SEQ ID NO: 5653230 - DNA, 14 bp, Homo sapiens
tgtaacctcagctc

SEQ ID NO: 5653231 - DNA, 13 bp, Homo sapiens
tgtaacctgagat

SEQ ID NO: 5653232 - DNA, 19 bp, Homo sapiens
tgtaacctgagatggccct

SEQ ID NO: 5653233 - DNA, 15 bp, Homo sapiens
tgtaacctgtttgtc

SEQ ID NO: 5653234 - DNA, 14 bp, Homo sapiens
tgtaacgattgaca

SEQ ID NO: 5653235 - DNA, 18 bp, Homo sapiens
tgtaacggttaactgtaa

SEQ ID NO: 5653236 - DNA, 22 bp, Homo sapiens
tgtaacgtgtgctgtgtttgct

SEQ ID NO: 5653237 - DNA, 17 bp, Homo sapiens
tgtaacgttgctgtggg

SEQ ID NO: 5653238 - DNA, 20 bp, Homo sapiens
tgtaactaaagtatttaaag

SEQ ID NO: 5653239 - DNA, 15 bp, Homo sapiens
tgtaactaagttatt

SEQ ID NO: 5653240 - DNA, 14 bp, Homo sapiens
tgtaactacactaa

SEQ ID NO: 5653241 - DNA, 17 bp, Homo sapiens
tgtaactactttataac

SEQ ID NO: 5653242 - DNA, 21 bp, Homo sapiens
tgtaactaggctcagagatgt

SEQ ID NO: 5653243 - DNA, 23 bp, Homo sapiens
tgtaactatagactggaaaaaat

SEQ ID NO: 5653244 - DNA, 16 bp, Homo sapiens
tgtaactattaacctt

SEQ ID NO: 5653245 - DNA, 14 bp, Homo sapiens
tgtaactattgaat

SEQ ID NO: 5653246 - DNA, 22 bp, Homo sapiens
tgtaactcacatgccttctaaa

SEQ ID NO: 5653247 - DNA, 14 bp, Homo sapiens
tgtaactcaccgtg

SEQ ID NO: 5653248 - DNA, 14 bp, Homo sapiens
tgtaactctccagc

SEQ ID NO: 5653249 - DNA, 11 bp, Homo sapiens
tgtaactcttt

SEQ ID NO: 5653250 - DNA, 21 bp, Homo sapiens
tgtaactgaggactgtttgca

SEQ ID NO: 5653251 - DNA, 13 bp, Homo sapiens
tgtaactgcccaa

SEQ ID NO: 5653252 - DNA, 18 bp, Homo sapiens
tgtaactgcccaaagcag

SEQ ID NO: 5653253 - DNA, 22 bp, Homo sapiens
tgtaactgcccttttaaatggc

SEQ ID NO: 5653254 - DNA, 16 bp, Homo sapiens
tgtaactgcctagaaa

SEQ ID NO: 5653255 - DNA, 13 bp, Homo sapiens
tgtaactgctcag

SEQ ID NO: 5653256 - DNA, 16 bp, Homo sapiens
tgtaactgctcagagc

SEQ ID NO: 5653257 - DNA, 17 bp, Homo sapiens
tgtaactgctgagccac

SEQ ID NO: 5653258 - DNA, 19 bp, Homo sapiens
tgtaactggctgctccctg

SEQ ID NO: 5653259 - DNA, 12 bp, Homo sapiens
tgtaactgttac

SEQ ID NO: 5653260 - DNA, 15 bp, Homo sapiens
tgtaactgttacagt

SEQ ID NO: 5653261 - DNA, 16 bp, Homo sapiens
tgtaactgttacagta

SEQ ID NO: 5653262 - DNA, 18 bp, Homo sapiens
tgtaactgttacagtaat

SEQ ID NO: 5653263 - DNA, 15 bp, Homo sapiens
tgtaactgttctttg

SEQ ID NO: 5653264 - DNA, 17 bp, Homo sapiens
tgtaactgttctttgca

SEQ ID NO: 5653265 - DNA, 21 bp, Homo sapiens
tgtaactgttctttgcagtga

SEQ ID NO: 5653266 - DNA, 23 bp, Homo sapiens
tgtaactgttctttgcagtgaag

SEQ ID NO: 5653267 - DNA, 19 bp, Homo sapiens
tgtaacttaaatatttgaa

SEQ ID NO: 5653268 - DNA, 20 bp, Homo sapiens
tgtaacttaaatatttgaaa

SEQ ID NO: 5653269 - DNA, 16 bp, Homo sapiens
tgtaacttagctttat

SEQ ID NO: 5653270 - DNA, 20 bp, Homo sapiens
tgtaacttatattgaagaca

SEQ ID NO: 5653271 - DNA, 23 bp, Homo sapiens
tgtaacttatattgaagacaatt

SEQ ID NO: 5653272 - DNA, 16 bp, Homo sapiens
tgtaacttatgtagat

SEQ ID NO: 5653273 - DNA, 23 bp, Homo sapiens
tgtaacttatgtagatatttggc

SEQ ID NO: 5653274 - DNA, 19 bp, Homo sapiens
tgtaacttccatgtgaggg

SEQ ID NO: 5653275 - DNA, 13 bp, Homo sapiens
tgtaacttcctgt

SEQ ID NO: 5653276 - DNA, 20 bp, Homo sapiens
tgtaacttgcttaaatttct

SEQ ID NO: 5653277 - DNA, 18 bp, Homo sapiens
tgtaactttaaacatcta

SEQ ID NO: 5653278 - DNA, 21 bp, Homo sapiens
tgtaactttattggtcttgcc

SEQ ID NO: 5653279 - DNA, 22 bp, Homo sapiens
tgtaactttattggtcttgccc

SEQ ID NO: 5653280 - DNA, 18 bp, Homo sapiens
tgtaactttcataccact

SEQ ID NO: 5653281 - DNA, 18 bp, Homo sapiens
tgtaactttctctatgaa

SEQ ID NO: 5653282 - DNA, 17 bp, Homo sapiens
tgtaactttctgaaata

SEQ ID NO: 5653283 - DNA, 21 bp, Homo sapiens
tgtaactttggttaaaatctc

SEQ ID NO: 5653284 - DNA, 17 bp, Homo sapiens
tgtaacttttaatccct

SEQ ID NO: 5653285 - DNA, 15 bp, Homo sapiens
tgtaacttttgtaag

SEQ ID NO: 5653286 - DNA, 19 bp, Homo sapiens
tgtaactttttacattaca

SEQ ID NO: 5653287 - DNA, 19 bp, Homo sapiens
tgtaacttttttattttaa

SEQ ID NO: 5653288 - DNA, 17 bp, Homo sapiens
tgtaactttttttcagt

SEQ ID NO: 5653289 - DNA, 19 bp, Homo sapiens
tgtaacttttttttagaga

SEQ ID NO: 5653290 - DNA, 13 bp, Homo sapiens
tgtaagaaaacaa

SEQ ID NO: 5653291 - DNA, 19 bp, Homo sapiens
tgtaagaaaacaaaatcta

SEQ ID NO: 5653292 - DNA, 13 bp, Homo sapiens
tgtaagaaaacca

SEQ ID NO: 5653293 - DNA, 17 bp, Homo sapiens
tgtaagaaacacactga

SEQ ID NO: 5653294 - DNA, 22 bp, Homo sapiens
tgtaagaaacacactgaggcag

SEQ ID NO: 5653295 - DNA, 12 bp, Homo sapiens
tgtaagaaatac

SEQ ID NO: 5653296 - DNA, 12 bp, Homo sapiens
tgtaagaactgt

SEQ ID NO: 5653297 - DNA, 21 bp, Homo sapiens
tgtaagaactgtacattgtga

SEQ ID NO: 5653298 - DNA, 14 bp, Homo sapiens
tgtaagaagaaact

SEQ ID NO: 5653299 - DNA, 15 bp, Homo sapiens
tgtaagaagaaactg

SEQ ID NO: 5653300 - DNA, 17 bp, Homo sapiens
tgtaagaagagactggg

SEQ ID NO: 5653301 - DNA, 19 bp, Homo sapiens
tgtaagaagagactgggaa

SEQ ID NO: 5653302 - DNA, 21 bp, Homo sapiens
tgtaagaagagactgggaaga

SEQ ID NO: 5653303 - DNA, 14 bp, Homo sapiens
tgtaagaagcccga

SEQ ID NO: 5653304 - DNA, 22 bp, Homo sapiens
tgtaagaagctaaaatgaaaaa

SEQ ID NO: 5653305 - DNA, 15 bp, Homo sapiens
tgtaagaatcattgt

SEQ ID NO: 5653306 - DNA, 20 bp, Homo sapiens
tgtaagacaaaggttttcct

SEQ ID NO: 5653307 - DNA, 19 bp, Homo sapiens
tgtaagacaatccatgtaa

SEQ ID NO: 5653308 - DNA, 11 bp, Homo sapiens
tgtaagacatt

SEQ ID NO: 5653309 - DNA, 15 bp, Homo sapiens
tgtaagacatttgta

SEQ ID NO: 5653310 - DNA, 16 bp, Homo sapiens
tgtaagacatttgtat

SEQ ID NO: 5653311 - DNA, 18 bp, Homo sapiens
tgtaagacatttgtatat

SEQ ID NO: 5653312 - DNA, 20 bp, Homo sapiens
tgtaagacatttgtatattg

SEQ ID NO: 5653313 - DNA, 18 bp, Homo sapiens
tgtaagacgtatgtaaca

SEQ ID NO: 5653314 - DNA, 15 bp, Homo sapiens
tgtaagacttcagat

SEQ ID NO: 5653315 - DNA, 20 bp, Homo sapiens
tgtaagacttcagatttcaa

SEQ ID NO: 5653316 - DNA, 21 bp, Homo sapiens
tgtaagacttcagatttcaaa

SEQ ID NO: 5653317 - DNA, 13 bp, Homo sapiens
tgtaagagaattc

SEQ ID NO: 5653318 - DNA, 19 bp, Homo sapiens
tgtaagagcaccttcctca

SEQ ID NO: 5653319 - DNA, 22 bp, Homo sapiens
tgtaagagcaccttcctcactt

SEQ ID NO: 5653320 - DNA, 19 bp, Homo sapiens
tgtaagagcttgctccaga

SEQ ID NO: 5653321 - DNA, 21 bp, Homo sapiens
tgtaagagctttacaaaaaga

SEQ ID NO: 5653322 - DNA, 14 bp, Homo sapiens
tgtaagaggatgtg

SEQ ID NO: 5653323 - DNA, 15 bp, Homo sapiens
tgtaagaggatgtgg

SEQ ID NO: 5653324 - DNA, 20 bp, Homo sapiens
tgtaagaggtactaaaaaca

SEQ ID NO: 5653325 - DNA, 20 bp, Homo sapiens
tgtaagagtgtagaagcatt

SEQ ID NO: 5653326 - DNA, 15 bp, Homo sapiens
tgtaagagtgtttat

SEQ ID NO: 5653327 - DNA, 16 bp, Homo sapiens
tgtaagatccaccccc

SEQ ID NO: 5653328 - DNA, 17 bp, Homo sapiens
tgtaagatccaccccct

SEQ ID NO: 5653329 - DNA, 14 bp, Homo sapiens
tgtaagatgctggg

SEQ ID NO: 5653330 - DNA, 14 bp, Homo sapiens
tgtaagatgtctgt

SEQ ID NO: 5653331 - DNA, 15 bp, Homo sapiens
tgtaagcaacttgct

SEQ ID NO: 5653332 - DNA, 15 bp, Homo sapiens
tgtaagcaattctaa

SEQ ID NO: 5653333 - DNA, 17 bp, Homo sapiens
tgtaagcactctggatg

SEQ ID NO: 5653334 - DNA, 22 bp, Homo sapiens
tgtaagcatactttgtaaatag

SEQ ID NO: 5653335 - DNA, 20 bp, Homo sapiens
tgtaagccaaagaaatgaac

SEQ ID NO: 5653336 - DNA, 13 bp, Homo sapiens
tgtaagccagagt

SEQ ID NO: 5653337 - DNA, 16 bp, Homo sapiens
tgtaagccagagtcaa

SEQ ID NO: 5653338 - DNA, 18 bp, Homo sapiens
tgtaagccatcagaagtt

SEQ ID NO: 5653339 - DNA, 13 bp, Homo sapiens
tgtaagccctctt

SEQ ID NO: 5653340 - DNA, 16 bp, Homo sapiens
tgtaagctataacata

SEQ ID NO: 5653341 - DNA, 14 bp, Homo sapiens
tgtaagctcaagct

SEQ ID NO: 5653342 - DNA, 22 bp, Homo sapiens
tgtaagctctactgaggtgcta

SEQ ID NO: 5653343 - DNA, 17 bp, Homo sapiens
tgtaagctgactggccc

SEQ ID NO: 5653344 - DNA, 23 bp, Homo sapiens
tgtaagctgtttggttttaaaat

SEQ ID NO: 5653345 - DNA, 22 bp, Homo sapiens
tgtacccagccaccttcctgac

SEQ ID NO: 5653346 - DNA, 12 bp, Homo sapiens
tgtacccagctc

SEQ ID NO: 5653347 - DNA, 21 bp, Homo sapiens
tgtacccagtattctaggtag

SEQ ID NO: 5653348 - DNA, 19 bp, Homo sapiens
tgtacccattgcagaccct

SEQ ID NO: 5653349 - DNA, 13 bp, Homo sapiens
tgtaccccatccc

SEQ ID NO: 5653350 - DNA, 14 bp, Homo sapiens
tgtaccccatccct

SEQ ID NO: 5653351 - DNA, 15 bp, Homo sapiens
tgtaccccatccctt

SEQ ID NO: 5653352 - DNA, 17 bp, Homo sapiens
tgtaccccatcccttcc

SEQ ID NO: 5653353 - DNA, 14 bp, Homo sapiens
tgtacccccgccca

SEQ ID NO: 5653354 - DNA, 16 bp, Homo sapiens
tgtacccgagcacata

SEQ ID NO: 5653355 - DNA, 14 bp, Homo sapiens
tgtaccctctccag

SEQ ID NO: 5653356 - DNA, 16 bp, Homo sapiens
tgtacccttccacctc

SEQ ID NO: 5653357 - DNA, 20 bp, Homo sapiens
tgtacccttccacctcctag

SEQ ID NO: 5653358 - DNA, 16 bp, Homo sapiens
tgtacccttcctacag

SEQ ID NO: 5653359 - DNA, 15 bp, Homo sapiens
tgtaccctttaagat

SEQ ID NO: 5653360 - DNA, 20 bp, Homo sapiens
tgtaccgcccggcagcccct

SEQ ID NO: 5653361 - DNA, 19 bp, Homo sapiens
tgtaccgcgtctaccctgg

SEQ ID NO: 5653362 - DNA, 17 bp, Homo sapiens
tgtaccggccactgcaa

SEQ ID NO: 5653363 - DNA, 18 bp, Homo sapiens
tgtaccggccactgcaac

SEQ ID NO: 5653364 - DNA, 15 bp, Homo sapiens
tgtacctaaagcaat

SEQ ID NO: 5653365 - DNA, 18 bp, Homo sapiens
tgtacctaatccaaatat

SEQ ID NO: 5653366 - DNA, 24 bp, Homo sapiens
tgtacctatagaaatagaacactg

SEQ ID NO: 5653367 - DNA, 17 bp, Homo sapiens
tgtacctatgtgacaga

SEQ ID NO: 5653368 - DNA, 14 bp, Homo sapiens
tgtacctatttctg

SEQ ID NO: 5653369 - DNA, 15 bp, Homo sapiens
tgtacctcaaatgaa

SEQ ID NO: 5653370 - DNA, 16 bp, Homo sapiens
tgtacctcaaatgaat

SEQ ID NO: 5653371 - DNA, 22 bp, Homo sapiens
tgtacctcagtggatcttcaga

SEQ ID NO: 5653372 - DNA, 17 bp, Homo sapiens
tgtacctcccctgcctt

SEQ ID NO: 5653373 - DNA, 18 bp, Homo sapiens
tgtacctcccctgccttg

SEQ ID NO: 5653374 - DNA, 19 bp, Homo sapiens
tgtacctcgggtgggaggg

SEQ ID NO: 5653375 - DNA, 20 bp, Homo sapiens
tgtacctctggctgactaaa

SEQ ID NO: 5653376 - DNA, 14 bp, Homo sapiens
tgtacctcttttag

SEQ ID NO: 5653377 - DNA, 21 bp, Homo sapiens
tgtacctgagcatatgtacac

SEQ ID NO: 5653378 - DNA, 18 bp, Homo sapiens
tgtacctggtgacccctt

SEQ ID NO: 5653379 - DNA, 23 bp, Homo sapiens
tgtacctgtaggaaacagaaaag

SEQ ID NO: 5653380 - DNA, 18 bp, Homo sapiens
tgtacctgtggctgtgtg

SEQ ID NO: 5653381 - DNA, 15 bp, Homo sapiens
tgtacctgttcctcc

SEQ ID NO: 5653382 - DNA, 15 bp, Homo sapiens
tgtaccttatttaaa

SEQ ID NO: 5653383 - DNA, 21 bp, Homo sapiens
tgtaccttatttaaaagattt

SEQ ID NO: 5653384 - DNA, 21 bp, Homo sapiens
tgtaccttccttaagccagga

SEQ ID NO: 5653385 - DNA, 15 bp, Homo sapiens
tgtaccttgaccatc

SEQ ID NO: 5653386 - DNA, 20 bp, Homo sapiens
tgtacctttgtgtaaagaag

SEQ ID NO: 5653387 - DNA, 22 bp, Homo sapiens
tgtaccttttgcgatttcacag

SEQ ID NO: 5653388 - DNA, 22 bp, Homo sapiens
tgtacgacgtcagatgtttaaa

SEQ ID NO: 5653389 - DNA, 23 bp, Homo sapiens
tgtacgacgtcagatgtttaaaa

SEQ ID NO: 5653390 - DNA, 19 bp, Homo sapiens
tgtacgctgcgtgccatga

SEQ ID NO: 5653391 - DNA, 15 bp, Homo sapiens
tgtacgctgctgcag

SEQ ID NO: 5653392 - DNA, 18 bp, Homo sapiens
tgtacggattttcagtta

SEQ ID NO: 5653393 - DNA, 21 bp, Homo sapiens
tgtacggattttcagttactt

SEQ ID NO: 5653394 - DNA, 14 bp, Homo sapiens
tgtacgtaatgtat

SEQ ID NO: 5653395 - DNA, 14 bp, Homo sapiens
tgtacgtactgcat

SEQ ID NO: 5653396 - DNA, 18 bp, Homo sapiens
tgtacgtagccacaggag

SEQ ID NO: 5653397 - DNA, 18 bp, Homo sapiens
tgtacgtatgaatgatat

SEQ ID NO: 5653398 - DNA, 17 bp, Homo sapiens
tgtacgtctgacaggca

SEQ ID NO: 5653399 - DNA, 14 bp, Homo sapiens
tgtacgtgggagag

SEQ ID NO: 5653400 - DNA, 16 bp, Homo sapiens
tgtacgtgggagaggc

SEQ ID NO: 5653401 - DNA, 20 bp, Homo sapiens
tgtacgtgggagaggcagaa

SEQ ID NO: 5653402 - DNA, 15 bp, Homo sapiens
tgtacgttatatatt

SEQ ID NO: 5653403 - DNA, 17 bp, Homo sapiens
tgtacgttatatattgt

SEQ ID NO: 5653404 - DNA, 17 bp, Homo sapiens
tgtacgtttaaagtgta

SEQ ID NO: 5653405 - DNA, 19 bp, Homo sapiens
tgtacgtttgtatgtgtgt

SEQ ID NO: 5653406 - DNA, 14 bp, Homo sapiens
tgtactaaacagta

SEQ ID NO: 5653407 - DNA, 20 bp, Homo sapiens
tgtactaaagccaaacatat

SEQ ID NO: 5653408 - DNA, 22 bp, Homo sapiens
tgtactaagaatgtccttattc

SEQ ID NO: 5653409 - DNA, 15 bp, Homo sapiens
tgtactaagccagga

SEQ ID NO: 5653410 - DNA, 16 bp, Homo sapiens
tgtactaatctgagat

SEQ ID NO: 5653411 - DNA, 20 bp, Homo sapiens
tgtactacacttctgaaact

SEQ ID NO: 5653412 - DNA, 18 bp, Homo sapiens
tgtactacagctatattt

SEQ ID NO: 5653413 - DNA, 22 bp, Homo sapiens
tgtactacagctatatttgatt

SEQ ID NO: 5653414 - DNA, 16 bp, Homo sapiens
tgtactacatttgcat

SEQ ID NO: 5653415 - DNA, 17 bp, Homo sapiens
tgtactacatttgcatg

SEQ ID NO: 5653416 - DNA, 22 bp, Homo sapiens
tgtactacatttgcatgccttt

SEQ ID NO: 5653417 - DNA, 17 bp, Homo sapiens
tgtactaccctcagtct

SEQ ID NO: 5653418 - DNA, 21 bp, Homo sapiens
tgtactactcctaattattgt

SEQ ID NO: 5653419 - DNA, 23 bp, Homo sapiens
tgtactactcctaattattgtaa

SEQ ID NO: 5653420 - DNA, 22 bp, Homo sapiens
tgtactactctagggagtatgc

SEQ ID NO: 5653421 - DNA, 18 bp, Homo sapiens
tgtactaggatactgctg

SEQ ID NO: 5653422 - DNA, 18 bp, Homo sapiens
tgtactagtactgtgtac

SEQ ID NO: 5653423 - DNA, 15 bp, Homo sapiens
tgtactagtctgtgt

SEQ ID NO: 5653424 - DNA, 19 bp, Homo sapiens
tgtactagtctgtgtggga

SEQ ID NO: 5653425 - DNA, 13 bp, Homo sapiens
tgtactagtttta

SEQ ID NO: 5653426 - DNA, 20 bp, Homo sapiens
tgtactataacatagaattg

SEQ ID NO: 5653427 - DNA, 14 bp, Homo sapiens
tgtactatgtctga

SEQ ID NO: 5653428 - DNA, 15 bp, Homo sapiens
tgtactatgtctgaa

SEQ ID NO: 5653429 - DNA, 15 bp, Homo sapiens
tgtactattgtttaa

SEQ ID NO: 5653430 - DNA, 19 bp, Homo sapiens
tgtactcaaagcccagaat

SEQ ID NO: 5653431 - DNA, 20 bp, Homo sapiens
tgtactcaaagcccagaatc

SEQ ID NO: 5653432 - DNA, 14 bp, Homo sapiens
tgtactcagagcag

SEQ ID NO: 5653433 - DNA, 18 bp, Homo sapiens
tgtactcaggaggctgag

SEQ ID NO: 5653434 - DNA, 12 bp, Homo sapiens
tgtactcagggc

SEQ ID NO: 5653435 - DNA, 21 bp, Homo sapiens
tgtactcagtggacagtgctg

SEQ ID NO: 5653436 - DNA, 12 bp, Homo sapiens
tgtactccagcc

SEQ ID NO: 5653437 - DNA, 20 bp, Homo sapiens
tgtactccagcctgggcaac

SEQ ID NO: 5653438 - DNA, 19 bp, Homo sapiens
tgtactccagcctgggcga

SEQ ID NO: 5653439 - DNA, 19 bp, Homo sapiens
tgtactccagcctgggtga

SEQ ID NO: 5653440 - DNA, 14 bp, Homo sapiens
tgtactcccagcac

SEQ ID NO: 5653441 - DNA, 15 bp, Homo sapiens
tgtactctaacttaa

SEQ ID NO: 5653442 - DNA, 17 bp, Homo sapiens
tgtactctacaaaatat

SEQ ID NO: 5653443 - DNA, 14 bp, Homo sapiens
tgtactctaggact

SEQ ID NO: 5653444 - DNA, 18 bp, Homo sapiens
tgtactctaggacttcaa

SEQ ID NO: 5653445 - DNA, 19 bp, Homo sapiens
tgtactctggggtgctgcc

SEQ ID NO: 5653446 - DNA, 13 bp, Homo sapiens
tgtactcttagga

SEQ ID NO: 5653447 - DNA, 15 bp, Homo sapiens
tgtactcttaggata

SEQ ID NO: 5653448 - DNA, 14 bp, Homo sapiens
tgtactctttggct

SEQ ID NO: 5653449 - DNA, 14 bp, Homo sapiens
tgtactgaaagcaa

SEQ ID NO: 5653450 - DNA, 14 bp, Homo sapiens
tgtactgaagaaca

SEQ ID NO: 5653451 - DNA, 15 bp, Homo sapiens
tgtactgaagaacag

SEQ ID NO: 5653452 - DNA, 23 bp, Homo sapiens
tgtactgagaggaggggtaaata

SEQ ID NO: 5653453 - DNA, 23 bp, Homo sapiens
tgtactgatactattcaatgcaa

SEQ ID NO: 5653454 - DNA, 17 bp, Homo sapiens
tgtactgattcaatttg

SEQ ID NO: 5653455 - DNA, 12 bp, Homo sapiens
tgtactggagag

SEQ ID NO: 5653456 - DNA, 19 bp, Homo sapiens
tgtactggagagcaacaca

SEQ ID NO: 5653457 - DNA, 21 bp, Homo sapiens
tgtactggccagtgtcatttt

SEQ ID NO: 5653458 - DNA, 20 bp, Homo sapiens
tgtactgtaaacagttctgc

SEQ ID NO: 5653459 - DNA, 16 bp, Homo sapiens
tgtactgtaaagaatt

SEQ ID NO: 5653460 - DNA, 18 bp, Homo sapiens
tgtactgtaaagagacct

SEQ ID NO: 5653461 - DNA, 15 bp, Homo sapiens
tgtactgtaattttg

SEQ ID NO: 5653462 - DNA, 16 bp, Homo sapiens
tgtactgtactgaaga

SEQ ID NO: 5653463 - DNA, 22 bp, Homo sapiens
tgtactgtataacattaagaaa

SEQ ID NO: 5653464 - DNA, 21 bp, Homo sapiens
tgtactgtatagacagtttgt

SEQ ID NO: 5653465 - DNA, 19 bp, Homo sapiens
tgtactgtatggaaacact

SEQ ID NO: 5653466 - DNA, 24 bp, Homo sapiens
tgtactgtatggaaacactgattt

SEQ ID NO: 5653467 - DNA, 13 bp, Homo sapiens
tgtactgtgcctg

SEQ ID NO: 5653468 - DNA, 14 bp, Homo sapiens
tgtactgtgcctgg

SEQ ID NO: 5653469 - DNA, 24 bp, Homo sapiens
tgtactgtgtttgatttgtctcat

SEQ ID NO: 5653470 - DNA, 19 bp, Homo sapiens
tgtactgttctgtgtcttt

SEQ ID NO: 5653471 - DNA, 13 bp, Homo sapiens
tgtactgttttta

SEQ ID NO: 5653472 - DNA, 13 bp, Homo sapiens
tgtacttaaatga

SEQ ID NO: 5653473 - DNA, 21 bp, Homo sapiens
tgtacttaaatgagttactta

SEQ ID NO: 5653474 - DNA, 15 bp, Homo sapiens
tgtacttaaatggta

SEQ ID NO: 5653475 - DNA, 23 bp, Homo sapiens
tgtacttacactgaaatccaaaa

SEQ ID NO: 5653476 - DNA, 15 bp, Homo sapiens
tgtacttacatgggt

SEQ ID NO: 5653477 - DNA, 16 bp, Homo sapiens
tgtacttattttccaa

SEQ ID NO: 5653478 - DNA, 17 bp, Homo sapiens
tgtacttattttccaat

SEQ ID NO: 5653479 - DNA, 21 bp, Homo sapiens
tgtacttattttccaataaaa

SEQ ID NO: 5653480 - DNA, 14 bp, Homo sapiens
tgtacttcaagtta

SEQ ID NO: 5653481 - DNA, 13 bp, Homo sapiens
tgtacttcactgt

SEQ ID NO: 5653482 - DNA, 14 bp, Homo sapiens
tgtacttcactgtc

SEQ ID NO: 5653483 - DNA, 16 bp, Homo sapiens
tgtacttcagttctca

SEQ ID NO: 5653484 - DNA, 17 bp, Homo sapiens
tgtacttcagttctcat

SEQ ID NO: 5653485 - DNA, 12 bp, Homo sapiens
tgtacttcctgt

SEQ ID NO: 5653486 - DNA, 21 bp, Homo sapiens
tgtacttctctgtgtgcacac

SEQ ID NO: 5653487 - DNA, 17 bp, Homo sapiens
tgtacttctgtgttcat

SEQ ID NO: 5653488 - DNA, 20 bp, Homo sapiens
tgtacttctgtgttcatttt

SEQ ID NO: 5653489 - DNA, 22 bp, Homo sapiens
tgtacttcttcatccatagaca

SEQ ID NO: 5653490 - DNA, 19 bp, Homo sapiens
tgtacttctttatttttta

SEQ ID NO: 5653491 - DNA, 15 bp, Homo sapiens
tgtacttgatactga

SEQ ID NO: 5653492 - DNA, 17 bp, Homo sapiens
tgtacttgatactgaat

SEQ ID NO: 5653493 - DNA, 21 bp, Homo sapiens
tgtacttgatactgaatgcat

SEQ ID NO: 5653494 - DNA, 18 bp, Homo sapiens
tgtacttgatttgatgtg

SEQ ID NO: 5653495 - DNA, 20 bp, Homo sapiens
tgtacttgatttttcaaaga

SEQ ID NO: 5653496 - DNA, 22 bp, Homo sapiens
tgtacttgatttttcaaagact

SEQ ID NO: 5653497 - DNA, 15 bp, Homo sapiens
tgtacttgctccttt

SEQ ID NO: 5653498 - DNA, 17 bp, Homo sapiens
tgtacttggtccaactg

SEQ ID NO: 5653499 - DNA, 18 bp, Homo sapiens
tgtacttgtcctcagctt

SEQ ID NO: 5653500 - DNA, 22 bp, Homo sapiens
tgtacttgtgtttgcttaaaca

SEQ ID NO: 5653501 - DNA, 18 bp, Homo sapiens
tgtacttgtttgaatatt

SEQ ID NO: 5653502 - DNA, 20 bp, Homo sapiens
tgtactttatcatgaatgct

SEQ ID NO: 5653503 - DNA, 21 bp, Homo sapiens
tgtactttatttttgtataaa

SEQ ID NO: 5653504 - DNA, 19 bp, Homo sapiens
tgtactttctgttaaaatg

SEQ ID NO: 5653505 - DNA, 13 bp, Homo sapiens
tgtactttgaaaa

SEQ ID NO: 5653506 - DNA, 20 bp, Homo sapiens
tgtactttgattcacatgtt

SEQ ID NO: 5653507 - DNA, 15 bp, Homo sapiens
tgtactttgccattt

SEQ ID NO: 5653508 - DNA, 21 bp, Homo sapiens
tgtactttgccatttttctat

SEQ ID NO: 5653509 - DNA, 23 bp, Homo sapiens
tgtactttgccatttttctataa

SEQ ID NO: 5653510 - DNA, 15 bp, Homo sapiens
tgtactttgcttgct

SEQ ID NO: 5653511 - DNA, 18 bp, Homo sapiens
tgtactttgcttgctcat

SEQ ID NO: 5653512 - DNA, 17 bp, Homo sapiens
tgtactttgtttttcca

SEQ ID NO: 5653513 - DNA, 13 bp, Homo sapiens
tgtacttttcatt

SEQ ID NO: 5653514 - DNA, 22 bp, Homo sapiens
tgtacttttcattctcttttaa

SEQ ID NO: 5653515 - DNA, 17 bp, Homo sapiens
tgtacttttccatttat

SEQ ID NO: 5653516 - DNA, 15 bp, Homo sapiens
tgtacttttcctttg

SEQ ID NO: 5653517 - DNA, 19 bp, Homo sapiens
tgtactttttattgcatgg

SEQ ID NO: 5653518 - DNA, 15 bp, Homo sapiens
tgtactttttggcat

SEQ ID NO: 5653519 - DNA, 13 bp, Homo sapiens
tgtacttttttca

SEQ ID NO: 5653520 - DNA, 14 bp, Homo sapiens
tgtacttttttcaa

SEQ ID NO: 5653521 - DNA, 22 bp, Homo sapiens
tgtacttttttcaaatattgaa

SEQ ID NO: 5653522 - DNA, 17 bp, Homo sapiens
tgtatatagtataaagt

SEQ ID NO: 5653523 - DNA, 14 bp, Homo sapiens
tgtatatagttttt

SEQ ID NO: 5653524 - DNA, 14 bp, Homo sapiens
tgtatatatacata

SEQ ID NO: 5653525 - DNA, 17 bp, Homo sapiens
tgtatatatatatgtgt

SEQ ID NO: 5653526 - DNA, 18 bp, Homo sapiens
tgtatatatatatgtgtg

SEQ ID NO: 5653527 - DNA, 13 bp, Homo sapiens
tgtatatatatgt

SEQ ID NO: 5653528 - DNA, 14 bp, Homo sapiens
tgtatatatatgtg

SEQ ID NO: 5653529 - DNA, 20 bp, Homo sapiens
tgtatatatattctcagctg

SEQ ID NO: 5653530 - DNA, 20 bp, Homo sapiens
tgtatatatggatcagagga

SEQ ID NO: 5653531 - DNA, 15 bp, Homo sapiens
tgtatatatgtattt

SEQ ID NO: 5653532 - DNA, 19 bp, Homo sapiens
tgtatatatgtatttctat

SEQ ID NO: 5653533 - DNA, 19 bp, Homo sapiens
tgtatatatgtcaaattgt

SEQ ID NO: 5653534 - DNA, 14 bp, Homo sapiens
tgtatatatgtgtg

SEQ ID NO: 5653535 - DNA, 21 bp, Homo sapiens
tgtatatatgtgtgccctgga

SEQ ID NO: 5653536 - DNA, 20 bp, Homo sapiens
tgtatatatgtgtgtttaaa

SEQ ID NO: 5653537 - DNA, 23 bp, Homo sapiens
tgtatatatttattattttcata

SEQ ID NO: 5653538 - DNA, 20 bp, Homo sapiens
tgtatatattttgtgtgaaa

SEQ ID NO: 5653539 - DNA, 16 bp, Homo sapiens
tgtatatcactaaaag

SEQ ID NO: 5653540 - DNA, 18 bp, Homo sapiens
tgtatatcagaaaaggga

SEQ ID NO: 5653541 - DNA, 19 bp, Homo sapiens
tgtatatcagctctaaagc

SEQ ID NO: 5653542 - DNA, 23 bp, Homo sapiens
tgtatatcagctctaaagcagag

SEQ ID NO: 5653543 - DNA, 20 bp, Homo sapiens
tgtatatcctatataggaaa

SEQ ID NO: 5653544 - DNA, 17 bp, Homo sapiens
tgtatatccttccaaaa

SEQ ID NO: 5653545 - DNA, 15 bp, Homo sapiens
tgtatatctgtgtaa

SEQ ID NO: 5653546 - DNA, 15 bp, Homo sapiens
tgtatatgaaaacaa

SEQ ID NO: 5653547 - DNA, 23 bp, Homo sapiens
tgtatatgaaaacaagttccaaa

SEQ ID NO: 5653548 - DNA, 13 bp, Homo sapiens
tgtatatgactgc

SEQ ID NO: 5653549 - DNA, 23 bp, Homo sapiens
tgtatatgatctaatacaaagat

SEQ ID NO: 5653550 - DNA, 20 bp, Homo sapiens
tgtatatggtatatatacat

SEQ ID NO: 5653551 - DNA, 19 bp, Homo sapiens
tgtatatgtataaattaat

SEQ ID NO: 5653552 - DNA, 21 bp, Homo sapiens
tgtatatgtattcccttgtat

SEQ ID NO: 5653553 - DNA, 19 bp, Homo sapiens
tgtatatgtcaaaaatatt

SEQ ID NO: 5653554 - DNA, 12 bp, Homo sapiens
tgtatatgtgct

SEQ ID NO: 5653555 - DNA, 14 bp, Homo sapiens
tgtatatgtgcttg

SEQ ID NO: 5653556 - DNA, 20 bp, Homo sapiens
tgtatatgtgcttgtgctca

SEQ ID NO: 5653557 - DNA, 18 bp, Homo sapiens
tgtatattaaaatagcat

SEQ ID NO: 5653558 - DNA, 19 bp, Homo sapiens
tgtatattaaggtgtggct

SEQ ID NO: 5653559 - DNA, 19 bp, Homo sapiens
tgtatattacaatgatcac

SEQ ID NO: 5653560 - DNA, 19 bp, Homo sapiens
tgtatattatataactctt

SEQ ID NO: 5653561 - DNA, 19 bp, Homo sapiens
tgtatattatcttctggtg

SEQ ID NO: 5653562 - DNA, 21 bp, Homo sapiens
tgtatattatggaagatttta

SEQ ID NO: 5653563 - DNA, 23 bp, Homo sapiens
tgtatattatggtgtaatgcaca

SEQ ID NO: 5653564 - DNA, 16 bp, Homo sapiens
tgtatattattgctat

SEQ ID NO: 5653565 - DNA, 15 bp, Homo sapiens
tgtatattatttcta

SEQ ID NO: 5653566 - DNA, 15 bp, Homo sapiens
tgtatattatttggc

SEQ ID NO: 5653567 - DNA, 14 bp, Homo sapiens
tgtatattcacttt

SEQ ID NO: 5653568 - DNA, 21 bp, Homo sapiens
tgtatattccaccattcacat

SEQ ID NO: 5653569 - DNA, 14 bp, Homo sapiens
tgtatattcctttt

SEQ ID NO: 5653570 - DNA, 22 bp, Homo sapiens
tgtatattctcttgtctggctg

SEQ ID NO: 5653571 - DNA, 21 bp, Homo sapiens
tgtatattgatgtaactgtgt

SEQ ID NO: 5653572 - DNA, 15 bp, Homo sapiens
tgtatattgattata

SEQ ID NO: 5653573 - DNA, 19 bp, Homo sapiens
tgtatattgggctcagaga

SEQ ID NO: 5653574 - DNA, 14 bp, Homo sapiens
tgtatattggtttt

SEQ ID NO: 5653575 - DNA, 16 bp, Homo sapiens
tgtatatttaacttct

SEQ ID NO: 5653576 - DNA, 13 bp, Homo sapiens
tgtatatttacat

SEQ ID NO: 5653577 - DNA, 14 bp, Homo sapiens
tgtatatttattca

SEQ ID NO: 5653578 - DNA, 22 bp, Homo sapiens
tgtatatttgatttattaactt

SEQ ID NO: 5653579 - DNA, 22 bp, Homo sapiens
tgtatatttgcaaaccctttgt

SEQ ID NO: 5653580 - DNA, 13 bp, Homo sapiens
tgtatatttgcat

SEQ ID NO: 5653581 - DNA, 13 bp, Homo sapiens
tgtatatttgctg

SEQ ID NO: 5653582 - DNA, 22 bp, Homo sapiens
tgtatatttgtaaagctattta

SEQ ID NO: 5653583 - DNA, 18 bp, Homo sapiens
tgtatatttgtaatatat

SEQ ID NO: 5653584 - DNA, 14 bp, Homo sapiens
tgtatatttgtaca

SEQ ID NO: 5653585 - DNA, 16 bp, Homo sapiens
tgtatatttgtacaaa

SEQ ID NO: 5653586 - DNA, 15 bp, Homo sapiens
tgtatatttgtatga

SEQ ID NO: 5653587 - DNA, 17 bp, Homo sapiens
tgtatattttatataaa

SEQ ID NO: 5653588 - DNA, 17 bp, Homo sapiens
tgtatattttgttacct

SEQ ID NO: 5653589 - DNA, 18 bp, Homo sapiens
tgtatatttttaaagaat

SEQ ID NO: 5653590 - DNA, 13 bp, Homo sapiens
tgtatcaaaatgc

SEQ ID NO: 5653591 - DNA, 23 bp, Homo sapiens
tgtatcaaaatgctcttatttca

SEQ ID NO: 5653592 - DNA, 16 bp, Homo sapiens
tgtatcaaactcgtct

SEQ ID NO: 5653593 - DNA, 23 bp, Homo sapiens
tgtatcaaactcgtctgatgttt

SEQ ID NO: 5653594 - DNA, 16 bp, Homo sapiens
tgtatcaaactgcttt

SEQ ID NO: 5653595 - DNA, 21 bp, Homo sapiens
tgtatcaaatacatttaaaac

SEQ ID NO: 5653596 - DNA, 12 bp, Homo sapiens
tgtatcaaatgt

SEQ ID NO: 5653597 - DNA, 15 bp, Homo sapiens
tgtatcaagcccctg

SEQ ID NO: 5653598 - DNA, 16 bp, Homo sapiens
tgtatcaagcccctgt

SEQ ID NO: 5653599 - DNA, 22 bp, Homo sapiens
tgtatcaataaaattctgtaat

SEQ ID NO: 5653600 - DNA, 17 bp, Homo sapiens
tgtatcaatgagtaaca

SEQ ID NO: 5653601 - DNA, 15 bp, Homo sapiens
tgtatcaatttctaa

SEQ ID NO: 5653602 - DNA, 18 bp, Homo sapiens
tgtatcacaccagttact

SEQ ID NO: 5653603 - DNA, 18 bp, Homo sapiens
tgtatcaccctcagctgg

SEQ ID NO: 5653604 - DNA, 22 bp, Homo sapiens
tgtatcactcactgccaaaaat

SEQ ID NO: 5653605 - DNA, 15 bp, Homo sapiens
tgtatcagaatcttg

SEQ ID NO: 5653606 - DNA, 18 bp, Homo sapiens
tgtatcagaggcctataa

SEQ ID NO: 5653607 - DNA, 17 bp, Homo sapiens
tgtatcaggtcagggac

SEQ ID NO: 5653608 - DNA, 18 bp, Homo sapiens
tgtatcaggtcagggact

SEQ ID NO: 5653609 - DNA, 20 bp, Homo sapiens
tgtatcagtcagtgctggag

SEQ ID NO: 5653610 - DNA, 15 bp, Homo sapiens
tgtatcagtgtcctt

SEQ ID NO: 5653611 - DNA, 16 bp, Homo sapiens
tgtatcagtgtccttt

SEQ ID NO: 5653612 - DNA, 18 bp, Homo sapiens
tgtatcagtgtcctttcc

SEQ ID NO: 5653613 - DNA, 13 bp, Homo sapiens
tgtatcataatta

SEQ ID NO: 5653614 - DNA, 22 bp, Homo sapiens
tgtatcatgtgctagattggag

SEQ ID NO: 5653615 - DNA, 15 bp, Homo sapiens
tgtatcattaatgta

SEQ ID NO: 5653616 - DNA, 19 bp, Homo sapiens
tgtatcatttcatgctttg

SEQ ID NO: 5653617 - DNA, 22 bp, Homo sapiens
tgtatccaaggaaacattttat

SEQ ID NO: 5653618 - DNA, 21 bp, Homo sapiens
tgtatccaagttatttgatct

SEQ ID NO: 5653619 - DNA, 20 bp, Homo sapiens
tgtatccacacaaattcagt

SEQ ID NO: 5653620 - DNA, 14 bp, Homo sapiens
tgtatccagaggaa

SEQ ID NO: 5653621 - DNA, 17 bp, Homo sapiens
tgtatccagtacattta

SEQ ID NO: 5653622 - DNA, 16 bp, Homo sapiens
tgtatccatgggggca

SEQ ID NO: 5653623 - DNA, 19 bp, Homo sapiens
tgtatccatgggggcaggg

SEQ ID NO: 5653624 - DNA, 14 bp, Homo sapiens
tgtatccattatca

SEQ ID NO: 5653625 - DNA, 20 bp, Homo sapiens
tgtatccattatcatgtgta

SEQ ID NO: 5653626 - DNA, 19 bp, Homo sapiens
tgtatcccatgagcctcag

SEQ ID NO: 5653627 - DNA, 16 bp, Homo sapiens
tgtatcccctgcaggc

SEQ ID NO: 5653628 - DNA, 17 bp, Homo sapiens
tgtatccgactctaagc

SEQ ID NO: 5653629 - DNA, 20 bp, Homo sapiens
tgtatccgactctaagctgt

SEQ ID NO: 5653630 - DNA, 24 bp, Homo sapiens
tgtatccgactctaagctgtgtgc

SEQ ID NO: 5653631 - DNA, 17 bp, Homo sapiens
tgtatccgtgaattgct

SEQ ID NO: 5653632 - DNA, 19 bp, Homo sapiens
tgtatcctccattgtatct

SEQ ID NO: 5653633 - DNA, 19 bp, Homo sapiens
tgtatcctccctggcagac

SEQ ID NO: 5653634 - DNA, 19 bp, Homo sapiens
tgtatcctggaacaatatt

SEQ ID NO: 5653635 - DNA, 19 bp, Homo sapiens
tgtatcctttcacacattt

SEQ ID NO: 5653636 - DNA, 19 bp, Homo sapiens
tgtatcgatgttttattat

SEQ ID NO: 5653637 - DNA, 17 bp, Homo sapiens
tgtatcggagacagtga

SEQ ID NO: 5653638 - DNA, 15 bp, Homo sapiens
tgtatcggatgcttt

SEQ ID NO: 5653639 - DNA, 16 bp, Homo sapiens
tgtatcgtatagctgt

SEQ ID NO: 5653640 - DNA, 17 bp, Homo sapiens
tgtatcgtatagctgta

SEQ ID NO: 5653641 - DNA, 18 bp, Homo sapiens
tgtatcgtatagctgtat

SEQ ID NO: 5653642 - DNA, 13 bp, Homo sapiens
tgtatctaaaaaa

SEQ ID NO: 5653643 - DNA, 23 bp, Homo sapiens
tgtatctaaaaaataactgtgca

SEQ ID NO: 5653644 - DNA, 19 bp, Homo sapiens
tgtatctaagaataataaa

SEQ ID NO: 5653645 - DNA, 20 bp, Homo sapiens
tgtatctaagaataataaaa

SEQ ID NO: 5653646 - DNA, 21 bp, Homo sapiens
tgtatctaagaataataaaat

SEQ ID NO: 5653647 - DNA, 19 bp, Homo sapiens
tgtatctaatttcattcaa

SEQ ID NO: 5653648 - DNA, 21 bp, Homo sapiens
tgtatctacagtaatgaaatg

SEQ ID NO: 5653649 - DNA, 19 bp, Homo sapiens
tgtatctagtgcagctgat

SEQ ID NO: 5653650 - DNA, 21 bp, Homo sapiens
tgtatctagtgcagctgattt

SEQ ID NO: 5653651 - DNA, 18 bp, Homo sapiens
tgtatctatttgtacaat

SEQ ID NO: 5653652 - DNA, 21 bp, Homo sapiens
tgtatctcatttaatttgtta

SEQ ID NO: 5653653 - DNA, 13 bp, Homo sapiens
tgtatctcctcct

SEQ ID NO: 5653654 - DNA, 20 bp, Homo sapiens
tgtatctcgaagtcttccat

SEQ ID NO: 5653655 - DNA, 15 bp, Homo sapiens
tgtatctctaatgaa

SEQ ID NO: 5653656 - DNA, 23 bp, Homo sapiens
tgtatctctgaagcatgtttcat

SEQ ID NO: 5653657 - DNA, 14 bp, Homo sapiens
tgtatctcttaaag

SEQ ID NO: 5653658 - DNA, 16 bp, Homo sapiens
tgtatctctttcacat

SEQ ID NO: 5653659 - DNA, 15 bp, Homo sapiens
tgtatctgaaagtca

SEQ ID NO: 5653660 - DNA, 17 bp, Homo sapiens
tgtatctgaattcctgt

SEQ ID NO: 5653661 - DNA, 16 bp, Homo sapiens
tgtatctgagttgcca

SEQ ID NO: 5653662 - DNA, 14 bp, Homo sapiens
tgtatctgctggat

SEQ ID NO: 5653663 - DNA, 13 bp, Homo sapiens
tgtatctgtctac

SEQ ID NO: 5653664 - DNA, 15 bp, Homo sapiens
tgtatctgtctactt

SEQ ID NO: 5653665 - DNA, 14 bp, Homo sapiens
tgtatctgtctttc

SEQ ID NO: 5653666 - DNA, 19 bp, Homo sapiens
tgtatctgtgcttctaata

SEQ ID NO: 5653667 - DNA, 12 bp, Homo sapiens
tgtatctgtgta

SEQ ID NO: 5653668 - DNA, 13 bp, Homo sapiens
tgtatctgtgtag

SEQ ID NO: 5653669 - DNA, 12 bp, Homo sapiens
tgtatctgttta

SEQ ID NO: 5653670 - DNA, 16 bp, Homo sapiens
tgtatcttaaaggaca

SEQ ID NO: 5653671 - DNA, 21 bp, Homo sapiens
tgtatcttaaaggacataaaa

SEQ ID NO: 5653672 - DNA, 18 bp, Homo sapiens
tgtatcttatttatatat

SEQ ID NO: 5653673 - DNA, 16 bp, Homo sapiens
tgtatcttcctttctt

SEQ ID NO: 5653674 - DNA, 14 bp, Homo sapiens
tgtatcttgattaa

SEQ ID NO: 5653675 - DNA, 18 bp, Homo sapiens
tgtatcttgattaatgta

SEQ ID NO: 5653676 - DNA, 21 bp, Homo sapiens
tgtatcttgattaatgtactt

SEQ ID NO: 5653677 - DNA, 22 bp, Homo sapiens
tgtatcttgattaatgtacttt

SEQ ID NO: 5653678 - DNA, 22 bp, Homo sapiens
tgtatcttgggggacagggctg

SEQ ID NO: 5653679 - DNA, 17 bp, Homo sapiens
tgtatctttataattga

SEQ ID NO: 5653680 - DNA, 12 bp, Homo sapiens
tgtatctttatg

SEQ ID NO: 5653681 - DNA, 19 bp, Homo sapiens
tgtatctttctttctctaa

SEQ ID NO: 5653682 - DNA, 19 bp, Homo sapiens
tgtatctttgtaagagcaa

SEQ ID NO: 5653683 - DNA, 19 bp, Homo sapiens
tgtatcttttttaaactgt

SEQ ID NO: 5653684 - DNA, 13 bp, Homo sapiens
tgtatgaaaacat

SEQ ID NO: 5653685 - DNA, 22 bp, Homo sapiens
tgtatgaaagatggctgtgcct

SEQ ID NO: 5653686 - DNA, 18 bp, Homo sapiens
tgtatgaaatatatgtga

SEQ ID NO: 5653687 - DNA, 15 bp, Homo sapiens
tgtatgaaattggtt

SEQ ID NO: 5653688 - DNA, 14 bp, Homo sapiens
tgtatgaaggcttt

SEQ ID NO: 5653689 - DNA, 18 bp, Homo sapiens
tgtatgaataatgaaaat

SEQ ID NO: 5653690 - DNA, 19 bp, Homo sapiens
tgtatgaatacagcagcaa

SEQ ID NO: 5653691 - DNA, 20 bp, Homo sapiens
tgtatgaattttgtaagtat

SEQ ID NO: 5653692 - DNA, 16 bp, Homo sapiens
tgtatgactaaagaga

SEQ ID NO: 5653693 - DNA, 15 bp, Homo sapiens
tgtatgacttctgct

SEQ ID NO: 5653694 - DNA, 22 bp, Homo sapiens
tgtatgagacaggaaaaaccaa

SEQ ID NO: 5653695 - DNA, 19 bp, Homo sapiens
tgtatgagactgtgtttct

SEQ ID NO: 5653696 - DNA, 23 bp, Homo sapiens
tgtatgagagggccctgcctgct

SEQ ID NO: 5653697 - DNA, 18 bp, Homo sapiens
tgtatgagatggttaaaa

SEQ ID NO: 5653698 - DNA, 19 bp, Homo sapiens
tgtatgagatggttaaaaa

SEQ ID NO: 5653699 - DNA, 19 bp, Homo sapiens
tgtcagccatcgtcctggg

SEQ ID NO: 5653700 - DNA, 23 bp, Homo sapiens
tgtcagccatcgtcctgggactc

SEQ ID NO: 5653701 - DNA, 16 bp, Homo sapiens
tgtcagccattcctgt

SEQ ID NO: 5653702 - DNA, 18 bp, Homo sapiens
tgtcagcccaagcagagt

SEQ ID NO: 5653703 - DNA, 19 bp, Homo sapiens
tgtcagcccatgtcaatca

SEQ ID NO: 5653704 - DNA, 14 bp, Homo sapiens
tgtcagcccctctt

SEQ ID NO: 5653705 - DNA, 17 bp, Homo sapiens
tgtcagcccctcttccc

SEQ ID NO: 5653706 - DNA, 22 bp, Homo sapiens
tgtcagcccctcttcccttcct

SEQ ID NO: 5653707 - DNA, 21 bp, Homo sapiens
tgtcagccgagccgggcctgg

SEQ ID NO: 5653708 - DNA, 15 bp, Homo sapiens
tgtcagcctgtgctg

SEQ ID NO: 5653709 - DNA, 14 bp, Homo sapiens
tgtcagcctttgtt

SEQ ID NO: 5653710 - DNA, 23 bp, Homo sapiens
tgtcagcgcaggtttagtttact

SEQ ID NO: 5653711 - DNA, 22 bp, Homo sapiens
tgtcagcgctctggtgctgcag

SEQ ID NO: 5653712 - DNA, 23 bp, Homo sapiens
tgtcagcgttctaccaggcaaat

SEQ ID NO: 5653713 - DNA, 21 bp, Homo sapiens
tgtcagctcccctcggagaag

SEQ ID NO: 5653714 - DNA, 17 bp, Homo sapiens
tgtcagctctcatctga

SEQ ID NO: 5653715 - DNA, 21 bp, Homo sapiens
tgtcagctgagcttgagctcc

SEQ ID NO: 5653716 - DNA, 22 bp, Homo sapiens
tgtcagctgcaaggtactctgg

SEQ ID NO: 5653717 - DNA, 16 bp, Homo sapiens
tgtcagctgctgttga

SEQ ID NO: 5653718 - DNA, 20 bp, Homo sapiens
tgtcagctgctgttgaactt

SEQ ID NO: 5653719 - DNA, 22 bp, Homo sapiens
tgtcagctgctgttgaactttt

SEQ ID NO: 5653720 - DNA, 14 bp, Homo sapiens
tgtcagcttcccaa

SEQ ID NO: 5653721 - DNA, 15 bp, Homo sapiens
tgtcagcttcccaac

SEQ ID NO: 5653722 - DNA, 16 bp, Homo sapiens
tgtcagcttcccagcc

SEQ ID NO: 5653723 - DNA, 20 bp, Homo sapiens
tgtcagcttggctgtaggac

SEQ ID NO: 5653724 - DNA, 18 bp, Homo sapiens
tgtcagcttttgcttcat

SEQ ID NO: 5653725 - DNA, 19 bp, Homo sapiens
tgtcaggaaaacacccagg

SEQ ID NO: 5653726 - DNA, 18 bp, Homo sapiens
tgtcaggaacagaaggat

SEQ ID NO: 5653727 - DNA, 17 bp, Homo sapiens
tgtcaggaagaaatcac

SEQ ID NO: 5653728 - DNA, 21 bp, Homo sapiens
tgtcaggaagtaaaataaata

SEQ ID NO: 5653729 - DNA, 14 bp, Homo sapiens
tgtcaggacccagg

SEQ ID NO: 5653730 - DNA, 17 bp, Homo sapiens
tgtcaggagagccctct

SEQ ID NO: 5653731 - DNA, 14 bp, Homo sapiens
tgtcaggagatgga

SEQ ID NO: 5653732 - DNA, 19 bp, Homo sapiens
tgtcaggagatggaagagt

SEQ ID NO: 5653733 - DNA, 23 bp, Homo sapiens
tgtcaggattgcgagagatgtgt

SEQ ID NO: 5653734 - DNA, 18 bp, Homo sapiens
tgtcaggcagtagcagct

SEQ ID NO: 5653735 - DNA, 21 bp, Homo sapiens
tgtcaggcattgaatgacaag

SEQ ID NO: 5653736 - DNA, 16 bp, Homo sapiens
tgtcaggccagcctgt

SEQ ID NO: 5653737 - DNA, 17 bp, Homo sapiens
tgtcaggccagcctgtc

SEQ ID NO: 5653738 - DNA, 20 bp, Homo sapiens
tgtcaggccagcctgtccct

SEQ ID NO: 5653739 - DNA, 20 bp, Homo sapiens
tgtcaggcccgtcggagctg

SEQ ID NO: 5653740 - DNA, 16 bp, Homo sapiens
tgtcaggccctctgcc

SEQ ID NO: 5653741 - DNA, 18 bp, Homo sapiens
tgtcaggccctctgcctg

SEQ ID NO: 5653742 - DNA, 14 bp, Homo sapiens
tgtcaggcctgtgt

SEQ ID NO: 5653743 - DNA, 14 bp, Homo sapiens
tgtcaggccttcag

SEQ ID NO: 5653744 - DNA, 15 bp, Homo sapiens
tgtcaggctctgaat

SEQ ID NO: 5653745 - DNA, 15 bp, Homo sapiens
tgtcaggctgctggc

SEQ ID NO: 5653746 - DNA, 17 bp, Homo sapiens
tgtcaggctgctggcgc

SEQ ID NO: 5653747 - DNA, 20 bp, Homo sapiens
tgtcaggctgctggcgcctc

SEQ ID NO: 5653748 - DNA, 24 bp, Homo sapiens
tgtcaggctgctggcgcctctgca

SEQ ID NO: 5653749 - DNA, 18 bp, Homo sapiens
tgtcagggagggccaggg

SEQ ID NO: 5653750 - DNA, 21 bp, Homo sapiens
tgtcagggagggccagggagg

SEQ ID NO: 5653751 - DNA, 22 bp, Homo sapiens
tgtcagggagggccagggaggc

SEQ ID NO: 5653752 - DNA, 23 bp, Homo sapiens
tgtcagggagggccagggaggca

SEQ ID NO: 5653753 - DNA, 15 bp, Homo sapiens
tgtcagggccaggtg

SEQ ID NO: 5653754 - DNA, 22 bp, Homo sapiens
tgtcaggggcggggagggtgac

SEQ ID NO: 5653755 - DNA, 14 bp, Homo sapiens
tgtcaggggcttgg

SEQ ID NO: 5653756 - DNA, 20 bp, Homo sapiens
tgtcaggggtttgcttacag

SEQ ID NO: 5653757 - DNA, 14 bp, Homo sapiens
tgtcagggtctcct

SEQ ID NO: 5653758 - DNA, 20 bp, Homo sapiens
tgtcagggtctccttccttc

SEQ ID NO: 5653759 - DNA, 15 bp, Homo sapiens
tgtcagggttggaaa

SEQ ID NO: 5653760 - DNA, 16 bp, Homo sapiens
tgtcagggttggaaag

SEQ ID NO: 5653761 - DNA, 18 bp, Homo sapiens
tgtcaggtcccagcgagc

SEQ ID NO: 5653762 - DNA, 20 bp, Homo sapiens
tgtcaggtggttaccaggca

SEQ ID NO: 5653763 - DNA, 22 bp, Homo sapiens
tgtcaggtggttaccaggcact

SEQ ID NO: 5653764 - DNA, 15 bp, Homo sapiens
tgtcagtaatttata

SEQ ID NO: 5653765 - DNA, 20 bp, Homo sapiens
tgtcagtaccttcaaactag

SEQ ID NO: 5653766 - DNA, 20 bp, Homo sapiens
tgtcagtactaaggtgactt

SEQ ID NO: 5653767 - DNA, 17 bp, Homo sapiens
tgtcagtactattcagg

SEQ ID NO: 5653768 - DNA, 17 bp, Homo sapiens
tgtcagtagtgccagaa

SEQ ID NO: 5653769 - DNA, 15 bp, Homo sapiens
tgtcagtatccaggc

SEQ ID NO: 5653770 - DNA, 20 bp, Homo sapiens
tgtcagtatgtggaagtgtg

SEQ ID NO: 5653771 - DNA, 14 bp, Homo sapiens
tgtcagtatttcaa

SEQ ID NO: 5653772 - DNA, 15 bp, Homo sapiens
tgtcagtatttcaac

SEQ ID NO: 5653773 - DNA, 21 bp, Homo sapiens
tgtcagtatttcaactgctgt

SEQ ID NO: 5653774 - DNA, 22 bp, Homo sapiens
tgtcagtatttcaactgctgta

SEQ ID NO: 5653775 - DNA, 23 bp, Homo sapiens
tgtcagtatttcagtgtagttaa

SEQ ID NO: 5653776 - DNA, 16 bp, Homo sapiens
tgtcagtatttttgcc

SEQ ID NO: 5653777 - DNA, 14 bp, Homo sapiens
tgtcagtcacagcc

SEQ ID NO: 5653778 - DNA, 15 bp, Homo sapiens
tgtcagtcacagcca

SEQ ID NO: 5653779 - DNA, 17 bp, Homo sapiens
tgtcagtcacagccacc

SEQ ID NO: 5653780 - DNA, 18 bp, Homo sapiens
tgtcagtcacagccaccc

SEQ ID NO: 5653781 - DNA, 15 bp, Homo sapiens
tgtcagtcccactgc

SEQ ID NO: 5653782 - DNA, 22 bp, Homo sapiens
tgtcagtcccactgcacccccc

SEQ ID NO: 5653783 - DNA, 17 bp, Homo sapiens
tgtcagtctgagtcatc

SEQ ID NO: 5653784 - DNA, 13 bp, Homo sapiens
tgtcagtctgctt

SEQ ID NO: 5653785 - DNA, 23 bp, Homo sapiens
tgtcagtctgtccacgtggagag

SEQ ID NO: 5653786 - DNA, 22 bp, Homo sapiens
tgtcagtgctataaatgccaga

SEQ ID NO: 5653787 - DNA, 15 bp, Homo sapiens
tgtcagtggaagaag

SEQ ID NO: 5653788 - DNA, 14 bp, Homo sapiens
tgtcagtggggacc

SEQ ID NO: 5653789 - DNA, 17 bp, Homo sapiens
tgtcagtggtttctact

SEQ ID NO: 5653790 - DNA, 16 bp, Homo sapiens
tgtcagtgtagacaca

SEQ ID NO: 5653791 - DNA, 17 bp, Homo sapiens
tgtcagtgtagacacag

SEQ ID NO: 5653792 - DNA, 17 bp, Homo sapiens
tgtcagtgtcaccttgg

SEQ ID NO: 5653793 - DNA, 16 bp, Homo sapiens
tgtcagtgtgactgat

SEQ ID NO: 5653794 - DNA, 22 bp, Homo sapiens
tgtcagtgttaaagattttgtt

SEQ ID NO: 5653795 - DNA, 11 bp, Homo sapiens
tgtcagtgttt

SEQ ID NO: 5653796 - DNA, 14 bp, Homo sapiens
tgtcagtgtttggt

SEQ ID NO: 5653797 - DNA, 17 bp, Homo sapiens
tgtcagtgtttgtattt

SEQ ID NO: 5653798 - DNA, 18 bp, Homo sapiens
tgtcagtgtttttgaaac

SEQ ID NO: 5653799 - DNA, 17 bp, Homo sapiens
tgtcagttcaactttca

SEQ ID NO: 5653800 - DNA, 19 bp, Homo sapiens
tgtcagttctgatatggaa

SEQ ID NO: 5653801 - DNA, 22 bp, Homo sapiens
tgtcagttggccctttaatatt

SEQ ID NO: 5653802 - DNA, 16 bp, Homo sapiens
tgtcagtttatgtttt

SEQ ID NO: 5653803 - DNA, 19 bp, Homo sapiens
tgtcagtttgtgaagtgat

SEQ ID NO: 5653804 - DNA, 16 bp, Homo sapiens
tgtcagttttgtacat

SEQ ID NO: 5653805 - DNA, 14 bp, Homo sapiens
tgtcagtttttcct

SEQ ID NO: 5653806 - DNA, 15 bp, Homo sapiens
tgtcagtttttcctc

SEQ ID NO: 5653807 - DNA, 23 bp, Homo sapiens
tgtcataaaatgcatactgttga

SEQ ID NO: 5653808 - DNA, 15 bp, Homo sapiens
tgtcataaaatgcta

SEQ ID NO: 5653809 - DNA, 20 bp, Homo sapiens
tgtcataaaatgctatttta

SEQ ID NO: 5653810 - DNA, 15 bp, Homo sapiens
tgtcataaactttct

SEQ ID NO: 5653811 - DNA, 21 bp, Homo sapiens
tgtcataaagattataatatg

SEQ ID NO: 5653812 - DNA, 22 bp, Homo sapiens
tgtcataaagattataatatgt

SEQ ID NO: 5653813 - DNA, 15 bp, Homo sapiens
tgtcataaagttgac

SEQ ID NO: 5653814 - DNA, 13 bp, Homo sapiens
tgtcataaattac

SEQ ID NO: 5653815 - DNA, 18 bp, Homo sapiens
tgtcataaattactgttt

SEQ ID NO: 5653816 - DNA, 18 bp, Homo sapiens
tgtcataactagagcacg

SEQ ID NO: 5653817 - DNA, 15 bp, Homo sapiens
tgtcataagaatgaa

SEQ ID NO: 5653818 - DNA, 16 bp, Homo sapiens
tgtcataaggttttta

SEQ ID NO: 5653819 - DNA, 16 bp, Homo sapiens
tgtcataagtaaacct

SEQ ID NO: 5653820 - DNA, 15 bp, Homo sapiens
tgtcatacaaattta

SEQ ID NO: 5653821 - DNA, 12 bp, Homo sapiens
tgtcatacagag

SEQ ID NO: 5653822 - DNA, 13 bp, Homo sapiens
tgtcatacagaga

SEQ ID NO: 5653823 - DNA, 14 bp, Homo sapiens
tgtcatacagagaa

SEQ ID NO: 5653824 - DNA, 19 bp, Homo sapiens
tgtcataccagaaagctct

SEQ ID NO: 5653825 - DNA, 21 bp, Homo sapiens
tgtcataccagaaagctctac

SEQ ID NO: 5653826 - DNA, 20 bp, Homo sapiens
tgtcatactctgtgtaatct

SEQ ID NO: 5653827 - DNA, 14 bp, Homo sapiens
tgtcatactgtgca

SEQ ID NO: 5653828 - DNA, 17 bp, Homo sapiens
tgtcatagaaagtgcca

SEQ ID NO: 5653829 - DNA, 13 bp, Homo sapiens
tgtcatagaaata

SEQ ID NO: 5653830 - DNA, 19 bp, Homo sapiens
tgtcatagactcctttgct

SEQ ID NO: 5653831 - DNA, 21 bp, Homo sapiens
tgtcatagaggctatcctgga

SEQ ID NO: 5653832 - DNA, 20 bp, Homo sapiens
tgtcatagggattgtccctg

SEQ ID NO: 5653833 - DNA, 21 bp, Homo sapiens
tgtcataggttttaaatctgc

SEQ ID NO: 5653834 - DNA, 16 bp, Homo sapiens
tgtcatagtcttgaaa

SEQ ID NO: 5653835 - DNA, 21 bp, Homo sapiens
tgtcatagtcttgaaatgaaa

SEQ ID NO: 5653836 - DNA, 20 bp, Homo sapiens
tgtcatagttatgtgatttt

SEQ ID NO: 5653837 - DNA, 13 bp, Homo sapiens
tgtcatagtttaa

SEQ ID NO: 5653838 - DNA, 21 bp, Homo sapiens
tgtcatataaactcatttatc

SEQ ID NO: 5653839 - DNA, 16 bp, Homo sapiens
tgtcatatactgccat

SEQ ID NO: 5653840 - DNA, 17 bp, Homo sapiens
tgtcatatactgccatg

SEQ ID NO: 5653841 - DNA, 18 bp, Homo sapiens
tgtcatatagctggttat

SEQ ID NO: 5653842 - DNA, 18 bp, Homo sapiens
tgtcatatatcaaatcat

SEQ ID NO: 5653843 - DNA, 19 bp, Homo sapiens
tgtcatatattactagcat

SEQ ID NO: 5653844 - DNA, 15 bp, Homo sapiens
tgtcatatattcatg

SEQ ID NO: 5653845 - DNA, 19 bp, Homo sapiens
tgtcatatattcatgtaat

SEQ ID NO: 5653846 - DNA, 21 bp, Homo sapiens
tgtcatatattcatgtaataa

SEQ ID NO: 5653847 - DNA, 13 bp, Homo sapiens
tgtcatatcagca

SEQ ID NO: 5653848 - DNA, 18 bp, Homo sapiens
tgtcatatcatttcactg

SEQ ID NO: 5653849 - DNA, 15 bp, Homo sapiens
tgtcatatgactgat

SEQ ID NO: 5653850 - DNA, 17 bp, Homo sapiens
tgtcatcaacattcttg

SEQ ID NO: 5653851 - DNA, 20 bp, Homo sapiens
tgtcatcaacattcttgtgt

SEQ ID NO: 5653852 - DNA, 14 bp, Homo sapiens
tgtcatcaatccag

SEQ ID NO: 5653853 - DNA, 17 bp, Homo sapiens
tgtcatcaatgttcagt

SEQ ID NO: 5653854 - DNA, 14 bp, Homo sapiens
tgtcatcactccct

SEQ ID NO: 5653855 - DNA, 18 bp, Homo sapiens
tgtcatcactccctggat

SEQ ID NO: 5653856 - DNA, 20 bp, Homo sapiens
tgtcatcactccctggatgt

SEQ ID NO: 5653857 - DNA, 16 bp, Homo sapiens
tgtcatcagaagataa

SEQ ID NO: 5653858 - DNA, 19 bp, Homo sapiens
tgtcatcagaagataactt

SEQ ID NO: 5653859 - DNA, 19 bp, Homo sapiens
tgtcatcagagctcctctg

SEQ ID NO: 5653860 - DNA, 15 bp, Homo sapiens
tgtcatcagccacca

SEQ ID NO: 5653861 - DNA, 18 bp, Homo sapiens
tgtcatcatcatggccag

SEQ ID NO: 5653862 - DNA, 21 bp, Homo sapiens
tgtcatcatcatggccagctg

SEQ ID NO: 5653863 - DNA, 23 bp, Homo sapiens
tgtcatccacacaacaccaggac

SEQ ID NO: 5653864 - DNA, 22 bp, Homo sapiens
tgtcatccacctgtcttggcct

SEQ ID NO: 5653865 - DNA, 14 bp, Homo sapiens
tgtcatccagaaaa

SEQ ID NO: 5653866 - DNA, 16 bp, Homo sapiens
tgtcatcccgctcctg

SEQ ID NO: 5653867 - DNA, 19 bp, Homo sapiens
tgtcatccctgatgaatgt

SEQ ID NO: 5653868 - DNA, 20 bp, Homo sapiens
tgtcatcctcaaagaaagtg

SEQ ID NO: 5653869 - DNA, 22 bp, Homo sapiens
tgtcatcctcaaagaaagtgta

SEQ ID NO: 5653870 - DNA, 15 bp, Homo sapiens
tgtcatcctcccttg

SEQ ID NO: 5653871 - DNA, 23 bp, Homo sapiens
tgtcatccttggtctttgtatct

SEQ ID NO: 5653872 - DNA, 20 bp, Homo sapiens
tgtcatcgttccccacccct

SEQ ID NO: 5653873 - DNA, 13 bp, Homo sapiens
tgtcatctcagct

SEQ ID NO: 5653874 - DNA, 14 bp, Homo sapiens
tgtcatctctctgg

SEQ ID NO: 5653875 - DNA, 21 bp, Homo sapiens
tgtgagcctatgatattcccc

SEQ ID NO: 5653876 - DNA, 18 bp, Homo sapiens
tgtgagccttgctgccaa

SEQ ID NO: 5653877 - DNA, 15 bp, Homo sapiens
tgtgagcgagcaagc

SEQ ID NO: 5653878 - DNA, 17 bp, Homo sapiens
tgtgagcgccttggtat

SEQ ID NO: 5653879 - DNA, 16 bp, Homo sapiens
tgtgagcgtggccttg

SEQ ID NO: 5653880 - DNA, 19 bp, Homo sapiens
tgtgagcgtggccttggga

SEQ ID NO: 5653881 - DNA, 23 bp, Homo sapiens
tgtgagctcccaggtgcagccag

SEQ ID NO: 5653882 - DNA, 15 bp, Homo sapiens
tgtgagctcttccct

SEQ ID NO: 5653883 - DNA, 15 bp, Homo sapiens
tgtgagctcttccta

SEQ ID NO: 5653884 - DNA, 17 bp, Homo sapiens
tgtgagctgtaaaaatg

SEQ ID NO: 5653885 - DNA, 14 bp, Homo sapiens
tgtgagcttacatt

SEQ ID NO: 5653886 - DNA, 20 bp, Homo sapiens
tgtgagctttttgttccctc

SEQ ID NO: 5653887 - DNA, 21 bp, Homo sapiens
tgtgagctttttgttccctca

SEQ ID NO: 5653888 - DNA, 12 bp, Homo sapiens
tgtgaggaagag

SEQ ID NO: 5653889 - DNA, 12 bp, Homo sapiens
tgtgaggaagcc

SEQ ID NO: 5653890 - DNA, 12 bp, Homo sapiens
tgtgaggactgg

SEQ ID NO: 5653891 - DNA, 20 bp, Homo sapiens
tgtgaggactgggggcacct

SEQ ID NO: 5653892 - DNA, 21 bp, Homo sapiens
tgtgaggagagggtggcatca

SEQ ID NO: 5653893 - DNA, 20 bp, Homo sapiens
tgtgaggagctgctggcttg

SEQ ID NO: 5653894 - DNA, 16 bp, Homo sapiens
tgtgaggatagagact

SEQ ID NO: 5653895 - DNA, 17 bp, Homo sapiens
tgtgaggatagagactt

SEQ ID NO: 5653896 - DNA, 12 bp, Homo sapiens
tgtgaggcaggg

SEQ ID NO: 5653897 - DNA, 21 bp, Homo sapiens
tgtgaggcattcggggaagct

SEQ ID NO: 5653898 - DNA, 13 bp, Homo sapiens
tgtgaggccaggg

SEQ ID NO: 5653899 - DNA, 16 bp, Homo sapiens
tgtgaggccagggcag

SEQ ID NO: 5653900 - DNA, 22 bp, Homo sapiens
tgtgaggcccctggacaagcag

SEQ ID NO: 5653901 - DNA, 22 bp, Homo sapiens
tgtgaggcccgaggcagaaggg

SEQ ID NO: 5653902 - DNA, 23 bp, Homo sapiens
tgtgaggctccctccctccctgc

SEQ ID NO: 5653903 - DNA, 20 bp, Homo sapiens
tgtgaggctgggccagcctc

SEQ ID NO: 5653904 - DNA, 17 bp, Homo sapiens
tgtgaggcttctaataa

SEQ ID NO: 5653905 - DNA, 14 bp, Homo sapiens
tgtgagggaaagag

SEQ ID NO: 5653906 - DNA, 22 bp, Homo sapiens
tgtgagggaggggaaaagcatt

SEQ ID NO: 5653907 - DNA, 15 bp, Homo sapiens
tgtgagggagtgcag

SEQ ID NO: 5653908 - DNA, 16 bp, Homo sapiens
tgtgagggcaaaccag

SEQ ID NO: 5653909 - DNA, 15 bp, Homo sapiens
tgtgagggcagcact

SEQ ID NO: 5653910 - DNA, 16 bp, Homo sapiens
tgtgagggcagcactg

SEQ ID NO: 5653911 - DNA, 16 bp, Homo sapiens
tgtgaggggcccctgg

SEQ ID NO: 5653912 - DNA, 18 bp, Homo sapiens
tgtgaggggcccctggcc

SEQ ID NO: 5653913 - DNA, 18 bp, Homo sapiens
tgtgaggggctctctcat

SEQ ID NO: 5653914 - DNA, 16 bp, Homo sapiens
tgtgaggtgaatgtct

SEQ ID NO: 5653915 - DNA, 17 bp, Homo sapiens
tgtgaggtttcacctcc

SEQ ID NO: 5653916 - DNA, 16 bp, Homo sapiens
tgtgaggtttcccaat

SEQ ID NO: 5653917 - DNA, 22 bp, Homo sapiens
tgtgagtaaatcagatgttgaa

SEQ ID NO: 5653918 - DNA, 18 bp, Homo sapiens
tgtgagtactacagtcct

SEQ ID NO: 5653919 - DNA, 23 bp, Homo sapiens
tgtgagtactacagtcctcccat

SEQ ID NO: 5653920 - DNA, 20 bp, Homo sapiens
tgtgagtagcctatgaatga

SEQ ID NO: 5653921 - DNA, 14 bp, Homo sapiens
tgtgagtaggctgg

SEQ ID NO: 5653922 - DNA, 23 bp, Homo sapiens
tgtgagtataaaataaagcaaat

SEQ ID NO: 5653923 - DNA, 16 bp, Homo sapiens
tgtgagtatcagaatt

SEQ ID NO: 5653924 - DNA, 13 bp, Homo sapiens
tgtgagtatttct

SEQ ID NO: 5653925 - DNA, 15 bp, Homo sapiens
tgtgagtatttctgt

SEQ ID NO: 5653926 - DNA, 17 bp, Homo sapiens
tgtgagtatttctgttc

SEQ ID NO: 5653927 - DNA, 19 bp, Homo sapiens
tgtgagtatttctgttcct

SEQ ID NO: 5653928 - DNA, 20 bp, Homo sapiens
tgtgagtatttctgttcctt

SEQ ID NO: 5653929 - DNA, 16 bp, Homo sapiens
tgtgagtcaatacata

SEQ ID NO: 5653930 - DNA, 17 bp, Homo sapiens
tgtgagtcaccaagccc

SEQ ID NO: 5653931 - DNA, 17 bp, Homo sapiens
tgtgagtcagaatgtga

SEQ ID NO: 5653932 - DNA, 14 bp, Homo sapiens
tgtgagtccctgtg

SEQ ID NO: 5653933 - DNA, 21 bp, Homo sapiens
tgtgagtctccccttgcagcc

SEQ ID NO: 5653934 - DNA, 21 bp, Homo sapiens
tgtgagtctttggttctaagg

SEQ ID NO: 5653935 - DNA, 19 bp, Homo sapiens
tgtgagtgaaagttgccat

SEQ ID NO: 5653936 - DNA, 20 bp, Homo sapiens
tgtgagtgaaagttgccatt

SEQ ID NO: 5653937 - DNA, 21 bp, Homo sapiens
tgtgagtgaaagttgccatta

SEQ ID NO: 5653938 - DNA, 21 bp, Homo sapiens
tgtgagtgactcggtgtaaaa

SEQ ID NO: 5653939 - DNA, 17 bp, Homo sapiens
tgtgagtgccttttgca

SEQ ID NO: 5653940 - DNA, 21 bp, Homo sapiens
tgtgagtgccttttgcagaag

SEQ ID NO: 5653941 - DNA, 22 bp, Homo sapiens
tgtgagtggagttgaggtgtca

SEQ ID NO: 5653942 - DNA, 19 bp, Homo sapiens
tgtgagtggataatcagga

SEQ ID NO: 5653943 - DNA, 20 bp, Homo sapiens
tgtgagtggcagccatgcct

SEQ ID NO: 5653944 - DNA, 13 bp, Homo sapiens
tgtgagtgtatgt

SEQ ID NO: 5653945 - DNA, 14 bp, Homo sapiens
tgtgagtgtatgta

SEQ ID NO: 5653946 - DNA, 16 bp, Homo sapiens
tgtgagtgtatgtata

SEQ ID NO: 5653947 - DNA, 14 bp, Homo sapiens
tgtgagtgtgacag

SEQ ID NO: 5653948 - DNA, 20 bp, Homo sapiens
tgtgagtgtgtccaagtgtg

SEQ ID NO: 5653949 - DNA, 17 bp, Homo sapiens
tgtgagtgtttttatct

SEQ ID NO: 5653950 - DNA, 14 bp, Homo sapiens
tgtgagtttcagaa

SEQ ID NO: 5653951 - DNA, 21 bp, Homo sapiens
tgtgagtttggtctggactga

SEQ ID NO: 5653952 - DNA, 17 bp, Homo sapiens
tgtgataactctgcaaa

SEQ ID NO: 5653953 - DNA, 21 bp, Homo sapiens
tgtgataactctgcaaaggcc

SEQ ID NO: 5653954 - DNA, 13 bp, Homo sapiens
tgtgataaggaaa

SEQ ID NO: 5653955 - DNA, 22 bp, Homo sapiens
tgtgataaggcctactatacat

SEQ ID NO: 5653956 - DNA, 18 bp, Homo sapiens
tgtgataattgtaaaggt

SEQ ID NO: 5653957 - DNA, 22 bp, Homo sapiens
tgtgatacactgaatggaaata

SEQ ID NO: 5653958 - DNA, 14 bp, Homo sapiens
tgtgatacagtttt

SEQ ID NO: 5653959 - DNA, 20 bp, Homo sapiens
tgtgatacagttttgagtaa

SEQ ID NO: 5653960 - DNA, 16 bp, Homo sapiens
tgtgatactattacca

SEQ ID NO: 5653961 - DNA, 16 bp, Homo sapiens
tgtgatagagcctttg

SEQ ID NO: 5653962 - DNA, 13 bp, Homo sapiens
tgtgatataaagg

SEQ ID NO: 5653963 - DNA, 13 bp, Homo sapiens
tgtgatataagtg

SEQ ID NO: 5653964 - DNA, 16 bp, Homo sapiens
tgtgatatatgtatta

SEQ ID NO: 5653965 - DNA, 17 bp, Homo sapiens
tgtgatatatgtattaa

SEQ ID NO: 5653966 - DNA, 15 bp, Homo sapiens
tgtgatatggagccc

SEQ ID NO: 5653967 - DNA, 13 bp, Homo sapiens
tgtgatattctgt

SEQ ID NO: 5653968 - DNA, 13 bp, Homo sapiens
tgtgatatttcag

SEQ ID NO: 5653969 - DNA, 20 bp, Homo sapiens
tgtgatatttcagaaataca

SEQ ID NO: 5653970 - DNA, 16 bp, Homo sapiens
tgtgatatttgacaga

SEQ ID NO: 5653971 - DNA, 17 bp, Homo sapiens
tgtgatcagcattgtga

SEQ ID NO: 5653972 - DNA, 19 bp, Homo sapiens
tgtgatcagcattgtgact

SEQ ID NO: 5653973 - DNA, 14 bp, Homo sapiens
tgtgatcaggcccc

SEQ ID NO: 5653974 - DNA, 15 bp, Homo sapiens
tgtgatcaggcccca

SEQ ID NO: 5653975 - DNA, 21 bp, Homo sapiens
tgtgatcaggccccacccctg

SEQ ID NO: 5653976 - DNA, 14 bp, Homo sapiens
tgtgatcagtgatt

SEQ ID NO: 5653977 - DNA, 20 bp, Homo sapiens
tgtgatcagtgattttcaaa

SEQ ID NO: 5653978 - DNA, 13 bp, Homo sapiens
tgtgatccagccc

SEQ ID NO: 5653979 - DNA, 13 bp, Homo sapiens
tgtgatcgtctga

SEQ ID NO: 5653980 - DNA, 23 bp, Homo sapiens
tgtgatctattactctgacataa

SEQ ID NO: 5653981 - DNA, 15 bp, Homo sapiens
tgtgatctcattgtt

SEQ ID NO: 5653982 - DNA, 14 bp, Homo sapiens
tgtgatctctgctg

SEQ ID NO: 5653983 - DNA, 22 bp, Homo sapiens
tgtgatctgggcattttcctcc

SEQ ID NO: 5653984 - DNA, 18 bp, Homo sapiens
tgtgatctgggtctctaa

SEQ ID NO: 5653985 - DNA, 13 bp, Homo sapiens
tgtgatctgtctt

SEQ ID NO: 5653986 - DNA, 19 bp, Homo sapiens
tgtgatctgtgtacaattt

SEQ ID NO: 5653987 - DNA, 22 bp, Homo sapiens
tgtgatcttatttttctaaacg

SEQ ID NO: 5653988 - DNA, 16 bp, Homo sapiens
tgtgatcttttaaagt

SEQ ID NO: 5653989 - DNA, 12 bp, Homo sapiens
tgtgatgaaaag

SEQ ID NO: 5653990 - DNA, 18 bp, Homo sapiens
tgtgatgaaactttgaaa

SEQ ID NO: 5653991 - DNA, 20 bp, Homo sapiens
tgtgatgaacatattcatga

SEQ ID NO: 5653992 - DNA, 19 bp, Homo sapiens
tgtgatgaagctgaggctg

SEQ ID NO: 5653993 - DNA, 20 bp, Homo sapiens
tgtgatgaatcaatgaaaaa

SEQ ID NO: 5653994 - DNA, 21 bp, Homo sapiens
tgtgatgaatctacatttgtt

SEQ ID NO: 5653995 - DNA, 13 bp, Homo sapiens
tgtgatgagctga

SEQ ID NO: 5653996 - DNA, 16 bp, Homo sapiens
tgtgatgaggcagagg

SEQ ID NO: 5653997 - DNA, 17 bp, Homo sapiens
tgtgatgcaggaagacc

SEQ ID NO: 5653998 - DNA, 19 bp, Homo sapiens
tgtgatgccaaagatgttt

SEQ ID NO: 5653999 - DNA, 16 bp, Homo sapiens
tgtgatgccctgccct

SEQ ID NO: 5654000 - DNA, 17 bp, Homo sapiens
tgtgatgcgccttgctg

SEQ ID NO: 5654001 - DNA, 14 bp, Homo sapiens
tgtgatgctcccaa

SEQ ID NO: 5654002 - DNA, 13 bp, Homo sapiens
tgtgatgctgaca

SEQ ID NO: 5654003 - DNA, 15 bp, Homo sapiens
tgtgatgctgacacc

SEQ ID NO: 5654004 - DNA, 18 bp, Homo sapiens
tgtgatggacactccagg

SEQ ID NO: 5654005 - DNA, 13 bp, Homo sapiens
tgtgatggagggg

SEQ ID NO: 5654006 - DNA, 16 bp, Homo sapiens
tgtgatggatggcaca

SEQ ID NO: 5654007 - DNA, 19 bp, Homo sapiens
tgtgatggggtcatcaaat

SEQ ID NO: 5654008 - DNA, 23 bp, Homo sapiens
tgtgatggggtgggcagggctgg

SEQ ID NO: 5654009 - DNA, 13 bp, Homo sapiens
tgtgatggtctct

SEQ ID NO: 5654010 - DNA, 16 bp, Homo sapiens
tgtgatgtaaggcact

SEQ ID NO: 5654011 - DNA, 12 bp, Homo sapiens
tgtgatgtatgt

SEQ ID NO: 5654012 - DNA, 13 bp, Homo sapiens
tgtgatgtatgtt

SEQ ID NO: 5654013 - DNA, 16 bp, Homo sapiens
tgtgatgtatgttggt

SEQ ID NO: 5654014 - DNA, 20 bp, Homo sapiens
tgtgatgtatgttggttttt

SEQ ID NO: 5654015 - DNA, 23 bp, Homo sapiens
tgtgatgtcatacagagaagtca

SEQ ID NO: 5654016 - DNA, 20 bp, Homo sapiens
tgtgatgtcatgaaactgta

SEQ ID NO: 5654017 - DNA, 17 bp, Homo sapiens
tgtgatgtgacatttgt

SEQ ID NO: 5654018 - DNA, 18 bp, Homo sapiens
tgtgatgtgacatttgtc

SEQ ID NO: 5654019 - DNA, 11 bp, Homo sapiens
tgtgatgtgtc

SEQ ID NO: 5654020 - DNA, 13 bp, Homo sapiens
tgtgatgttctaa

SEQ ID NO: 5654021 - DNA, 17 bp, Homo sapiens
tgtgatgttctaaggct

SEQ ID NO: 5654022 - DNA, 20 bp, Homo sapiens
tgtgatgttgggaagctatt

SEQ ID NO: 5654023 - DNA, 22 bp, Homo sapiens
tgtgatgtttggattgatatcg

SEQ ID NO: 5654024 - DNA, 18 bp, Homo sapiens
tgtgatgttttatcctta

SEQ ID NO: 5654025 - DNA, 22 bp, Homo sapiens
tgtgattaacatctacaatcag

SEQ ID NO: 5654026 - DNA, 19 bp, Homo sapiens
tgtgattaatgttttcatt

SEQ ID NO: 5654027 - DNA, 17 bp, Homo sapiens
tgtgattaattattgaa

SEQ ID NO: 5654028 - DNA, 19 bp, Homo sapiens
tgtgattacatagatcagc

SEQ ID NO: 5654029 - DNA, 19 bp, Homo sapiens
tgtgattactctttgcttt

SEQ ID NO: 5654030 - DNA, 13 bp, Homo sapiens
tgtgattactgca

SEQ ID NO: 5654031 - DNA, 15 bp, Homo sapiens
tgtgattactgcaat

SEQ ID NO: 5654032 - DNA, 16 bp, Homo sapiens
tgtgattagacagaac

SEQ ID NO: 5654033 - DNA, 14 bp, Homo sapiens
tgtgattatggaca

SEQ ID NO: 5654034 - DNA, 15 bp, Homo sapiens
tgtgattatttcact

SEQ ID NO: 5654035 - DNA, 18 bp, Homo sapiens
tgtgattatttcacttta

SEQ ID NO: 5654036 - DNA, 14 bp, Homo sapiens
tgtgattcaatctg

SEQ ID NO: 5654037 - DNA, 22 bp, Homo sapiens
tgtgattcaatctgtaaactgt

SEQ ID NO: 5654038 - DNA, 14 bp, Homo sapiens
tgtgattcaatgcc

SEQ ID NO: 5654039 - DNA, 16 bp, Homo sapiens
tgtgattcctgcattt

SEQ ID NO: 5654040 - DNA, 19 bp, Homo sapiens
tgtgattcctttgaagagg

SEQ ID NO: 5654041 - DNA, 21 bp, Homo sapiens
tgtgattcctttgaagaggaa

SEQ ID NO: 5654042 - DNA, 16 bp, Homo sapiens
tgtgattctaatgtct

SEQ ID NO: 5654043 - DNA, 19 bp, Homo sapiens
tgtgattcttccagatgtg

SEQ ID NO: 5654044 - DNA, 14 bp, Homo sapiens
tgtgattgacagaa

SEQ ID NO: 5654045 - DNA, 16 bp, Homo sapiens
tgtgattgcacagaat

SEQ ID NO: 5654046 - DNA, 21 bp, Homo sapiens
tgtgattgcctcaataaagct

SEQ ID NO: 5654047 - DNA, 23 bp, Homo sapiens
tgtgattggcagcttcaaaacag

SEQ ID NO: 5654048 - DNA, 15 bp, Homo sapiens
tgtgattggcctgta

SEQ ID NO: 5654049 - DNA, 12 bp, Homo sapiens
tgtgattggctg

SEQ ID NO: 5654050 - DNA, 13 bp, Homo sapiens
tgtgattggctgc

SEQ ID NO: 5654051 - DNA, 22 bp, Homo sapiens
tgtgattggcttaaatccagtt

SEQ ID NO: 5654052 - DNA, 17 bp, Homo sapiens
tgtgattgggaataaat

SEQ ID NO: 5654053 - DNA, 14 bp, Homo sapiens
tgtggagccaggcg

SEQ ID NO: 5654054 - DNA, 15 bp, Homo sapiens
tgtggagccaggcgt

SEQ ID NO: 5654055 - DNA, 18 bp, Homo sapiens
tgtggagcccgcaccccc

SEQ ID NO: 5654056 - DNA, 19 bp, Homo sapiens
tgtggagccgaggcctacc

SEQ ID NO: 5654057 - DNA, 20 bp, Homo sapiens
tgtggagccgaggcctaccc

SEQ ID NO: 5654058 - DNA, 22 bp, Homo sapiens
tgtggagcgtccttgtccccgc

SEQ ID NO: 5654059 - DNA, 19 bp, Homo sapiens
tgtggagctactgatgaaa

SEQ ID NO: 5654060 - DNA, 16 bp, Homo sapiens
tgtggagctcagcccc

SEQ ID NO: 5654061 - DNA, 15 bp, Homo sapiens
tgtggagctgcttcc

SEQ ID NO: 5654062 - DNA, 18 bp, Homo sapiens
tgtggagctgcttccagt

SEQ ID NO: 5654063 - DNA, 15 bp, Homo sapiens
tgtggaggaagagcc

SEQ ID NO: 5654064 - DNA, 12 bp, Homo sapiens
tgtggaggaagg

SEQ ID NO: 5654065 - DNA, 17 bp, Homo sapiens
tgtggaggaaggattgt

SEQ ID NO: 5654066 - DNA, 14 bp, Homo sapiens
tgtggaggacagac

SEQ ID NO: 5654067 - DNA, 19 bp, Homo sapiens
tgtggaggagggagagccc

SEQ ID NO: 5654068 - DNA, 22 bp, Homo sapiens
tgtggaggagggagagccctgt

SEQ ID NO: 5654069 - DNA, 23 bp, Homo sapiens
tgtggaggagggagagccctgtc

SEQ ID NO: 5654070 - DNA, 14 bp, Homo sapiens
tgtggaggaggtga

SEQ ID NO: 5654071 - DNA, 18 bp, Homo sapiens
tgtggaggcagtgtcatt

SEQ ID NO: 5654072 - DNA, 12 bp, Homo sapiens
tgtggaggcctg

SEQ ID NO: 5654073 - DNA, 15 bp, Homo sapiens
tgtggaggctcctgt

SEQ ID NO: 5654074 - DNA, 21 bp, Homo sapiens
tgtggagggagtgagccagca

SEQ ID NO: 5654075 - DNA, 13 bp, Homo sapiens
tgtggagggcaca

SEQ ID NO: 5654076 - DNA, 23 bp, Homo sapiens
tgtggagggctgcagagcctgca

SEQ ID NO: 5654077 - DNA, 12 bp, Homo sapiens
tgtggaggggag

SEQ ID NO: 5654078 - DNA, 18 bp, Homo sapiens
tgtggagggtggcgccct

SEQ ID NO: 5654079 - DNA, 17 bp, Homo sapiens
tgtggagggttgccatg

SEQ ID NO: 5654080 - DNA, 17 bp, Homo sapiens
tgtggaggtggaaaatg

SEQ ID NO: 5654081 - DNA, 17 bp, Homo sapiens
tgtggagtatttttata

SEQ ID NO: 5654082 - DNA, 17 bp, Homo sapiens
tgtggagtcatttctga

SEQ ID NO: 5654083 - DNA, 18 bp, Homo sapiens
tgtggagtcatttctgat

SEQ ID NO: 5654084 - DNA, 15 bp, Homo sapiens
tgtggagtccagctc

SEQ ID NO: 5654085 - DNA, 19 bp, Homo sapiens
tgtggagtggacattcaaa

SEQ ID NO: 5654086 - DNA, 16 bp, Homo sapiens
tgtggagtggaggggt

SEQ ID NO: 5654087 - DNA, 19 bp, Homo sapiens
tgtggagtggaggggtcag

SEQ ID NO: 5654088 - DNA, 12 bp, Homo sapiens
tgtggagtgggg

SEQ ID NO: 5654089 - DNA, 16 bp, Homo sapiens
tgtggagtggggcagt

SEQ ID NO: 5654090 - DNA, 15 bp, Homo sapiens
tgtggagtgtgctga

SEQ ID NO: 5654091 - DNA, 20 bp, Homo sapiens
tgtggagttcaccttggaag

SEQ ID NO: 5654092 - DNA, 22 bp, Homo sapiens
tgtggagttcaccttggaaggg

SEQ ID NO: 5654093 - DNA, 17 bp, Homo sapiens
tgtggagttcatcttga

SEQ ID NO: 5654094 - DNA, 18 bp, Homo sapiens
tgtggagttcctgctccg

SEQ ID NO: 5654095 - DNA, 16 bp, Homo sapiens
tgtggagttttcatga

SEQ ID NO: 5654096 - DNA, 21 bp, Homo sapiens
tgtggataaaactgtgtaaac

SEQ ID NO: 5654097 - DNA, 13 bp, Homo sapiens
tgtggataagaaa

SEQ ID NO: 5654098 - DNA, 15 bp, Homo sapiens
tgtggataagggaga

SEQ ID NO: 5654099 - DNA, 18 bp, Homo sapiens
tgtggatacagtgcccac

SEQ ID NO: 5654100 - DNA, 22 bp, Homo sapiens
tgtggatagagcagcctgctgc

SEQ ID NO: 5654101 - DNA, 20 bp, Homo sapiens
tgtggatcaaccatcgcttt

SEQ ID NO: 5654102 - DNA, 14 bp, Homo sapiens
tgtggatccaatgt

SEQ ID NO: 5654103 - DNA, 15 bp, Homo sapiens
tgtggatccaatgtt

SEQ ID NO: 5654104 - DNA, 17 bp, Homo sapiens
tgtggatccctttagaa

SEQ ID NO: 5654105 - DNA, 23 bp, Homo sapiens
tgtggatcttgccacatttctga

SEQ ID NO: 5654106 - DNA, 15 bp, Homo sapiens
tgtggatgacacaat

SEQ ID NO: 5654107 - DNA, 19 bp, Homo sapiens
tgtggatgatcaatccttt

SEQ ID NO: 5654108 - DNA, 16 bp, Homo sapiens
tgtggatgctccaggg

SEQ ID NO: 5654109 - DNA, 13 bp, Homo sapiens
tgtggatgctctt

SEQ ID NO: 5654110 - DNA, 23 bp, Homo sapiens
tgtggatggaggtgatgaaaacc

SEQ ID NO: 5654111 - DNA, 22 bp, Homo sapiens
tgtggatgtaattagctctggg

SEQ ID NO: 5654112 - DNA, 17 bp, Homo sapiens
tgtggatgtgtaaatgg

SEQ ID NO: 5654113 - DNA, 23 bp, Homo sapiens
tgtggatgtgtaaatggagcttg

SEQ ID NO: 5654114 - DNA, 13 bp, Homo sapiens
tgtggatgtgttc

SEQ ID NO: 5654115 - DNA, 16 bp, Homo sapiens
tgtggattaaaccttt

SEQ ID NO: 5654116 - DNA, 18 bp, Homo sapiens
tgtggattataaaaaatg

SEQ ID NO: 5654117 - DNA, 18 bp, Homo sapiens
tgtggatttcctatttta

SEQ ID NO: 5654118 - DNA, 15 bp, Homo sapiens
tgtggcaaaaagagt

SEQ ID NO: 5654119 - DNA, 23 bp, Homo sapiens
tgtggcaaaaagagtcagacatt

SEQ ID NO: 5654120 - DNA, 23 bp, Homo sapiens
tgtggcaaaatgttacagaatct

SEQ ID NO: 5654121 - DNA, 14 bp, Homo sapiens
tgtggcaaacattt

SEQ ID NO: 5654122 - DNA, 20 bp, Homo sapiens
tgtggcaaaccccaaagaga

SEQ ID NO: 5654123 - DNA, 15 bp, Homo sapiens
tgtggcaaactgaag

SEQ ID NO: 5654124 - DNA, 24 bp, Homo sapiens
tgtggcaagcaagagctcttgtga

SEQ ID NO: 5654125 - DNA, 18 bp, Homo sapiens
tgtggcaagcccctgccc

SEQ ID NO: 5654126 - DNA, 22 bp, Homo sapiens
tgtggcaataaaggagaagaga

SEQ ID NO: 5654127 - DNA, 23 bp, Homo sapiens
tgtggcaataaaggagaagagat

SEQ ID NO: 5654128 - DNA, 22 bp, Homo sapiens
tgtggcacagacttctggaagg

SEQ ID NO: 5654129 - DNA, 18 bp, Homo sapiens
tgtggcacagatgcccac

SEQ ID NO: 5654130 - DNA, 13 bp, Homo sapiens
tgtggcactgcca

SEQ ID NO: 5654131 - DNA, 19 bp, Homo sapiens
tgtggcactgccaccagca

SEQ ID NO: 5654132 - DNA, 18 bp, Homo sapiens
tgtggcacttgcctgggt

SEQ ID NO: 5654133 - DNA, 19 bp, Homo sapiens
tgtggcacttgcctgggtc

SEQ ID NO: 5654134 - DNA, 15 bp, Homo sapiens
tgtggcagaaaagag

SEQ ID NO: 5654135 - DNA, 18 bp, Homo sapiens
tgtggcagaccgggggcc

SEQ ID NO: 5654136 - DNA, 22 bp, Homo sapiens
tgtggcagaccgggggccagac

SEQ ID NO: 5654137 - DNA, 21 bp, Homo sapiens
tgtggcagagttacagttctg

SEQ ID NO: 5654138 - DNA, 15 bp, Homo sapiens
tgtggcagcaggagg

SEQ ID NO: 5654139 - DNA, 16 bp, Homo sapiens
tgtggcagcaggaggg

SEQ ID NO: 5654140 - DNA, 21 bp, Homo sapiens
tgtggcagccgtcccaggcca

SEQ ID NO: 5654141 - DNA, 20 bp, Homo sapiens
tgtggcagcctgattcgggg

SEQ ID NO: 5654142 - DNA, 14 bp, Homo sapiens
tgtggcaggcagcg

SEQ ID NO: 5654143 - DNA, 18 bp, Homo sapiens
tgtggcaggcctaggacc

SEQ ID NO: 5654144 - DNA, 13 bp, Homo sapiens
tgtggcagggcgt

SEQ ID NO: 5654145 - DNA, 13 bp, Homo sapiens
tgtggcaggggca

SEQ ID NO: 5654146 - DNA, 21 bp, Homo sapiens
tgtggcaggggcagtggcctg

SEQ ID NO: 5654147 - DNA, 13 bp, Homo sapiens
tgtggcagggggc

SEQ ID NO: 5654148 - DNA, 20 bp, Homo sapiens
tgtggcaggggttagagcag

SEQ ID NO: 5654149 - DNA, 23 bp, Homo sapiens
tgtggcaggggttagagcaggac

SEQ ID NO: 5654150 - DNA, 18 bp, Homo sapiens
tgtggcagtaaagagaaa

SEQ ID NO: 5654151 - DNA, 19 bp, Homo sapiens
tgtggcagtcccttataat

SEQ ID NO: 5654152 - DNA, 15 bp, Homo sapiens
tgtggcagtggccag

SEQ ID NO: 5654153 - DNA, 12 bp, Homo sapiens
tgtggcagtggt

SEQ ID NO: 5654154 - DNA, 15 bp, Homo sapiens
tgtggcagtggtttt

SEQ ID NO: 5654155 - DNA, 23 bp, Homo sapiens
tgtggcagtttggcaaactctcc

SEQ ID NO: 5654156 - DNA, 23 bp, Homo sapiens
tgtggcataaattgcatcactgt

SEQ ID NO: 5654157 - DNA, 22 bp, Homo sapiens
tgtggcatagacatggatgcga

SEQ ID NO: 5654158 - DNA, 16 bp, Homo sapiens
tgtggcatccagagtc

SEQ ID NO: 5654159 - DNA, 19 bp, Homo sapiens
tgtggcattctctctgctc

SEQ ID NO: 5654160 - DNA, 16 bp, Homo sapiens
tgtggccaaccaggac

SEQ ID NO: 5654161 - DNA, 23 bp, Homo sapiens
tgtggccaaccaggacccagggt

SEQ ID NO: 5654162 - DNA, 17 bp, Homo sapiens
tgtggccaaggagctgc

SEQ ID NO: 5654163 - DNA, 18 bp, Homo sapiens
tgtggccaaggagctgct

SEQ ID NO: 5654164 - DNA, 17 bp, Homo sapiens
tgtggccaaggctgaga

SEQ ID NO: 5654165 - DNA, 15 bp, Homo sapiens
tgtggccacagcccc

SEQ ID NO: 5654166 - DNA, 16 bp, Homo sapiens
tgtggccacagccccc

SEQ ID NO: 5654167 - DNA, 16 bp, Homo sapiens
tgtggccacttctgtc

SEQ ID NO: 5654168 - DNA, 15 bp, Homo sapiens
tgtggccagagctgg

SEQ ID NO: 5654169 - DNA, 11 bp, Homo sapiens
tgtggccagcc

SEQ ID NO: 5654170 - DNA, 14 bp, Homo sapiens
tgtggccagcctgg

SEQ ID NO: 5654171 - DNA, 21 bp, Homo sapiens
tgtggccagctgcatctgtct

SEQ ID NO: 5654172 - DNA, 11 bp, Homo sapiens
tgtggccagga

SEQ ID NO: 5654173 - DNA, 12 bp, Homo sapiens
tgtggccaggag

SEQ ID NO: 5654174 - DNA, 13 bp, Homo sapiens
tgtggccaggagc

SEQ ID NO: 5654175 - DNA, 15 bp, Homo sapiens
tgtggccaggagccc

SEQ ID NO: 5654176 - DNA, 16 bp, Homo sapiens
tgtggccaggagccct

SEQ ID NO: 5654177 - DNA, 20 bp, Homo sapiens
tgtggccaggagccctggcc

SEQ ID NO: 5654178 - DNA, 14 bp, Homo sapiens
tgtggccaggcctt

SEQ ID NO: 5654179 - DNA, 21 bp, Homo sapiens
tgtggccaggggtgctcctgt

SEQ ID NO: 5654180 - DNA, 23 bp, Homo sapiens
tgtggccatgaccctgcctctcc

SEQ ID NO: 5654181 - DNA, 14 bp, Homo sapiens
tgtggccatggcct

SEQ ID NO: 5654182 - DNA, 15 bp, Homo sapiens
tgtggcccagataag

SEQ ID NO: 5654183 - DNA, 21 bp, Homo sapiens
tgtggcccagataaggcttta

SEQ ID NO: 5654184 - DNA, 21 bp, Homo sapiens
tgtggcccagcacgagcctgg

SEQ ID NO: 5654185 - DNA, 22 bp, Homo sapiens
tgtggcccagtcgtccgctcag

SEQ ID NO: 5654186 - DNA, 16 bp, Homo sapiens
tgtggcccagttctga

SEQ ID NO: 5654187 - DNA, 12 bp, Homo sapiens
tgtggccccacc

SEQ ID NO: 5654188 - DNA, 13 bp, Homo sapiens
tgtggccccaccc

SEQ ID NO: 5654189 - DNA, 17 bp, Homo sapiens
tgtggccccaccctggg

SEQ ID NO: 5654190 - DNA, 23 bp, Homo sapiens
tgtggccccaccctgggccctgg

SEQ ID NO: 5654191 - DNA, 17 bp, Homo sapiens
tgtggccccaggtgcca

SEQ ID NO: 5654192 - DNA, 21 bp, Homo sapiens
tgtggccccaggtgccaccaa

SEQ ID NO: 5654193 - DNA, 13 bp, Homo sapiens
tgtggccccctgt

SEQ ID NO: 5654194 - DNA, 20 bp, Homo sapiens
tgtggccccgaggctgggac

SEQ ID NO: 5654195 - DNA, 21 bp, Homo sapiens
tgtggccccgaggctgggaca

SEQ ID NO: 5654196 - DNA, 22 bp, Homo sapiens
tgtggccccgcccgagcccctg

SEQ ID NO: 5654197 - DNA, 23 bp, Homo sapiens
tgtggccccgcccgagcccctgc

SEQ ID NO: 5654198 - DNA, 15 bp, Homo sapiens
tgtggcccctccttc

SEQ ID NO: 5654199 - DNA, 12 bp, Homo sapiens
tgtggccccttc

SEQ ID NO: 5654200 - DNA, 12 bp, Homo sapiens
tgtggccctgcc

SEQ ID NO: 5654201 - DNA, 22 bp, Homo sapiens
tgtggccctgccatcttcccag

SEQ ID NO: 5654202 - DNA, 13 bp, Homo sapiens
tgtggccctgccc

SEQ ID NO: 5654203 - DNA, 15 bp, Homo sapiens
tgtggccctggccac

SEQ ID NO: 5654204 - DNA, 22 bp, Homo sapiens
tgtggccctggccactaaagct

SEQ ID NO: 5654205 - DNA, 17 bp, Homo sapiens
tgtggccctggcctgct

SEQ ID NO: 5654206 - DNA, 15 bp, Homo sapiens
tgtggccctgtggga

SEQ ID NO: 5654207 - DNA, 20 bp, Homo sapiens
tgtggcccttctgtccacca

SEQ ID NO: 5654208 - DNA, 15 bp, Homo sapiens
tgtggccgaggactt

SEQ ID NO: 5654209 - DNA, 21 bp, Homo sapiens
tgtggccggtgccagctgccc

SEQ ID NO: 5654210 - DNA, 19 bp, Homo sapiens
tgtggcctaagaggctgcc

SEQ ID NO: 5654211 - DNA, 23 bp, Homo sapiens
tgtggcctaagaggctgccctcc

SEQ ID NO: 5654212 - DNA, 22 bp, Homo sapiens
tgtggcctatgaaactggttta

SEQ ID NO: 5654213 - DNA, 24 bp, Homo sapiens
tgtggcctcacttccctgggaact

SEQ ID NO: 5654214 - DNA, 13 bp, Homo sapiens
tgtggcctcagaa

SEQ ID NO: 5654215 - DNA, 22 bp, Homo sapiens
tgtggcctcattcagcagaatg

SEQ ID NO: 5654216 - DNA, 15 bp, Homo sapiens
tgtggcctccatgtg

SEQ ID NO: 5654217 - DNA, 14 bp, Homo sapiens
tgtggcctctcagt

SEQ ID NO: 5654218 - DNA, 16 bp, Homo sapiens
tgtggcctcttctgag

SEQ ID NO: 5654219 - DNA, 18 bp, Homo sapiens
tgtggcctcttctgagct

SEQ ID NO: 5654220 - DNA, 17 bp, Homo sapiens
tgtggcctgcacagtga

SEQ ID NO: 5654221 - DNA, 16 bp, Homo sapiens
tgtggcctgcaggagg

SEQ ID NO: 5654222 - DNA, 14 bp, Homo sapiens
tgtggcctgccagt

SEQ ID NO: 5654223 - DNA, 14 bp, Homo sapiens
tgtggcctgcccag

SEQ ID NO: 5654224 - DNA, 15 bp, Homo sapiens
tgtggcctgcccagc

SEQ ID NO: 5654225 - DNA, 17 bp, Homo sapiens
tgtggcctgcccagcct

SEQ ID NO: 5654226 - DNA, 14 bp, Homo sapiens
tgtggcctgctcat

SEQ ID NO: 5654227 - DNA, 12 bp, Homo sapiens
tgtggcctggat

SEQ ID NO: 5654228 - DNA, 11 bp, Homo sapiens
tgtggcctggg

SEQ ID NO: 5654229 - DNA, 15 bp, Homo sapiens
tgtggcctgggcctc

SEQ ID NO: 5654230 - DNA, 13 bp, Homo sapiens
tgtggcctggggc

SEQ ID NO: 5654231 - DNA, 14 bp, Homo sapiens
tgtgtccttccctg

SEQ ID NO: 5654232 - DNA, 19 bp, Homo sapiens
tgtgtccttgcacctgcat

SEQ ID NO: 5654233 - DNA, 18 bp, Homo sapiens
tgtgtccttggggcacag

SEQ ID NO: 5654234 - DNA, 10 bp, Homo sapiens
tgtgtccttt

SEQ ID NO: 5654235 - DNA, 15 bp, Homo sapiens
tgtgtcctttctgaa

SEQ ID NO: 5654236 - DNA, 18 bp, Homo sapiens
tgtgtcctttggtactat

SEQ ID NO: 5654237 - DNA, 21 bp, Homo sapiens
tgtgtcggggggcgagggagg

SEQ ID NO: 5654238 - DNA, 22 bp, Homo sapiens
tgtgtcggggggcgagggaggg

SEQ ID NO: 5654239 - DNA, 12 bp, Homo sapiens
tgtgtctaaact

SEQ ID NO: 5654240 - DNA, 13 bp, Homo sapiens
tgtgtctaaactg

SEQ ID NO: 5654241 - DNA, 17 bp, Homo sapiens
tgtgtctaagattctag

SEQ ID NO: 5654242 - DNA, 21 bp, Homo sapiens
tgtgtctacagagaacctgga

SEQ ID NO: 5654243 - DNA, 16 bp, Homo sapiens
tgtgtctagcaaagcc

SEQ ID NO: 5654244 - DNA, 13 bp, Homo sapiens
tgtgtctattttg

SEQ ID NO: 5654245 - DNA, 23 bp, Homo sapiens
tgtgtctccagctgattttaact

SEQ ID NO: 5654246 - DNA, 13 bp, Homo sapiens
tgtgtctcccaga

SEQ ID NO: 5654247 - DNA, 17 bp, Homo sapiens
tgtgtctcccagaacta

SEQ ID NO: 5654248 - DNA, 18 bp, Homo sapiens
tgtgtctcccagaactat

SEQ ID NO: 5654249 - DNA, 16 bp, Homo sapiens
tgtgtctcccaggtgc

SEQ ID NO: 5654250 - DNA, 20 bp, Homo sapiens
tgtgtctcgtgtcagtaatt

SEQ ID NO: 5654251 - DNA, 13 bp, Homo sapiens
tgtgtctctatgt

SEQ ID NO: 5654252 - DNA, 22 bp, Homo sapiens
tgtgtctctatgtgaatatgga

SEQ ID NO: 5654253 - DNA, 17 bp, Homo sapiens
tgtgtctctcgatgcca

SEQ ID NO: 5654254 - DNA, 13 bp, Homo sapiens
tgtgtctcttggt

SEQ ID NO: 5654255 - DNA, 20 bp, Homo sapiens
tgtgtctgaaaatatctctt

SEQ ID NO: 5654256 - DNA, 19 bp, Homo sapiens
tgtgtctgaatcatgtctg

SEQ ID NO: 5654257 - DNA, 20 bp, Homo sapiens
tgtgtctgaatcatgtctgt

SEQ ID NO: 5654258 - DNA, 19 bp, Homo sapiens
tgtgtctgactcaggcgcc

SEQ ID NO: 5654259 - DNA, 13 bp, Homo sapiens
tgtgtctgagccc

SEQ ID NO: 5654260 - DNA, 12 bp, Homo sapiens
tgtgtctgagtg

SEQ ID NO: 5654261 - DNA, 12 bp, Homo sapiens
tgtgtctgccaa

SEQ ID NO: 5654262 - DNA, 19 bp, Homo sapiens
tgtgtctgcgtctgtgttg

SEQ ID NO: 5654263 - DNA, 13 bp, Homo sapiens
tgtgtctgctctc

SEQ ID NO: 5654264 - DNA, 13 bp, Homo sapiens
tgtgtctggaaga

SEQ ID NO: 5654265 - DNA, 17 bp, Homo sapiens
tgtgtctgggagagcct

SEQ ID NO: 5654266 - DNA, 23 bp, Homo sapiens
tgtgtctggtccaggagaagtat

SEQ ID NO: 5654267 - DNA, 19 bp, Homo sapiens
tgtgtctggtgcagaatat

SEQ ID NO: 5654268 - DNA, 21 bp, Homo sapiens
tgtgtctgtaggtgtctctgg

SEQ ID NO: 5654269 - DNA, 12 bp, Homo sapiens
tgtgtctgtatt

SEQ ID NO: 5654270 - DNA, 15 bp, Homo sapiens
tgtgtctgtcacagg

SEQ ID NO: 5654271 - DNA, 18 bp, Homo sapiens
tgtgtctgtcatttctct

SEQ ID NO: 5654272 - DNA, 12 bp, Homo sapiens
tgtgtctgtctt

SEQ ID NO: 5654273 - DNA, 21 bp, Homo sapiens
tgtgtctgtgccctccaaaga

SEQ ID NO: 5654274 - DNA, 12 bp, Homo sapiens
tgtgtctgtgcg

SEQ ID NO: 5654275 - DNA, 16 bp, Homo sapiens
tgtgtctgtggaccct

SEQ ID NO: 5654276 - DNA, 14 bp, Homo sapiens
tgtgtctgtggtcc

SEQ ID NO: 5654277 - DNA, 15 bp, Homo sapiens
tgtgtctgtggttgc

SEQ ID NO: 5654278 - DNA, 15 bp, Homo sapiens
tgtgtctgtgtggta

SEQ ID NO: 5654279 - DNA, 16 bp, Homo sapiens
tgtgtctgtgtttaat

SEQ ID NO: 5654280 - DNA, 23 bp, Homo sapiens
tgtgtctgtgtttaatattacca

SEQ ID NO: 5654281 - DNA, 14 bp, Homo sapiens
tgtgtcttaattat

SEQ ID NO: 5654282 - DNA, 13 bp, Homo sapiens
tgtgtcttctatt

SEQ ID NO: 5654283 - DNA, 19 bp, Homo sapiens
tgtgtcttggagtgcattt

SEQ ID NO: 5654284 - DNA, 16 bp, Homo sapiens
tgtgtcttgtgttttt

SEQ ID NO: 5654285 - DNA, 18 bp, Homo sapiens
tgtgtctttataaagctg

SEQ ID NO: 5654286 - DNA, 18 bp, Homo sapiens
tgtgtctttcacagctcc

SEQ ID NO: 5654287 - DNA, 12 bp, Homo sapiens
tgtgtctttcta

SEQ ID NO: 5654288 - DNA, 13 bp, Homo sapiens
tgtgtctttctct

SEQ ID NO: 5654289 - DNA, 15 bp, Homo sapiens
tgtgtcttttataaa

SEQ ID NO: 5654290 - DNA, 22 bp, Homo sapiens
tgtgtgaaaaaagaaaatggct

SEQ ID NO: 5654291 - DNA, 14 bp, Homo sapiens
tgtgtgaaacaatg

SEQ ID NO: 5654292 - DNA, 18 bp, Homo sapiens
tgtgtgaaacctacagca

SEQ ID NO: 5654293 - DNA, 20 bp, Homo sapiens
tgtgtgaaataccagtgtgg

SEQ ID NO: 5654294 - DNA, 19 bp, Homo sapiens
tgtgtgaaatctttcaagt

SEQ ID NO: 5654295 - DNA, 13 bp, Homo sapiens
tgtgtgaacgtgt

SEQ ID NO: 5654296 - DNA, 15 bp, Homo sapiens
tgtgtgaagaaagcc

SEQ ID NO: 5654297 - DNA, 13 bp, Homo sapiens
tgtgtgaaggcag

SEQ ID NO: 5654298 - DNA, 18 bp, Homo sapiens
tgtgtgaaggtaactaag

SEQ ID NO: 5654299 - DNA, 21 bp, Homo sapiens
tgtgtgaaggtcttgcctgaa

SEQ ID NO: 5654300 - DNA, 17 bp, Homo sapiens
tgtgtgaatgaacactc

SEQ ID NO: 5654301 - DNA, 22 bp, Homo sapiens
tgtgtgacaccaccactgtgtc

SEQ ID NO: 5654302 - DNA, 19 bp, Homo sapiens
tgtgtgacccctcctgggg

SEQ ID NO: 5654303 - DNA, 20 bp, Homo sapiens
tgtgtgagataacttccttc

SEQ ID NO: 5654304 - DNA, 16 bp, Homo sapiens
tgtgtgagcatcctgc

SEQ ID NO: 5654305 - DNA, 18 bp, Homo sapiens
tgtgtgagcatcctgcaa

SEQ ID NO: 5654306 - DNA, 14 bp, Homo sapiens
tgtgtgagcatctc

SEQ ID NO: 5654307 - DNA, 19 bp, Homo sapiens
tgtgtgagcatctctgtgt

SEQ ID NO: 5654308 - DNA, 13 bp, Homo sapiens
tgtgtgagcgtgg

SEQ ID NO: 5654309 - DNA, 15 bp, Homo sapiens
tgtgtgagtgtatgt

SEQ ID NO: 5654310 - DNA, 16 bp, Homo sapiens
tgtgtgagtgtatgta

SEQ ID NO: 5654311 - DNA, 13 bp, Homo sapiens
tgtgtgagtgtga

SEQ ID NO: 5654312 - DNA, 13 bp, Homo sapiens
tgtgtgagttgag

SEQ ID NO: 5654313 - DNA, 14 bp, Homo sapiens
tgtgtgagttgagt

SEQ ID NO: 5654314 - DNA, 18 bp, Homo sapiens
tgtgtgagtttgctggtt

SEQ ID NO: 5654315 - DNA, 20 bp, Homo sapiens
tgtgtgatatttcagaaata

SEQ ID NO: 5654316 - DNA, 13 bp, Homo sapiens
tgtgtgatcagga

SEQ ID NO: 5654317 - DNA, 16 bp, Homo sapiens
tgtgtgatccagccct

SEQ ID NO: 5654318 - DNA, 15 bp, Homo sapiens
tgtgtgatggaggga

SEQ ID NO: 5654319 - DNA, 14 bp, Homo sapiens
tgtgtgattgaagg

SEQ ID NO: 5654320 - DNA, 16 bp, Homo sapiens
tgtgtgattgaatctg

SEQ ID NO: 5654321 - DNA, 19 bp, Homo sapiens
tgtgtgatttcctaaacat

SEQ ID NO: 5654322 - DNA, 21 bp, Homo sapiens
tgtgtgatttcctaaacataa

SEQ ID NO: 5654323 - DNA, 17 bp, Homo sapiens
tgtgtgcaaaagcagtg

SEQ ID NO: 5654324 - DNA, 14 bp, Homo sapiens
tgtgtgcacaccca

SEQ ID NO: 5654325 - DNA, 19 bp, Homo sapiens
tgtgtgcacgtacacacac

SEQ ID NO: 5654326 - DNA, 19 bp, Homo sapiens
tgtgtgcactttttttcta

SEQ ID NO: 5654327 - DNA, 21 bp, Homo sapiens
tgtgtgcaggagcctccctgc

SEQ ID NO: 5654328 - DNA, 13 bp, Homo sapiens
tgtgtgcagtgaa

SEQ ID NO: 5654329 - DNA, 17 bp, Homo sapiens
tgtgtgcatcaggcttt

SEQ ID NO: 5654330 - DNA, 16 bp, Homo sapiens
tgtgtgcatgtatgtg

SEQ ID NO: 5654331 - DNA, 14 bp, Homo sapiens
tgtgtgcatgtgag

SEQ ID NO: 5654332 - DNA, 14 bp, Homo sapiens
tgtgtgcatgtgtg

SEQ ID NO: 5654333 - DNA, 24 bp, Homo sapiens
tgtgtgcatgtgtgtgtctgtctt

SEQ ID NO: 5654334 - DNA, 15 bp, Homo sapiens
tgtgtgcattggggt

SEQ ID NO: 5654335 - DNA, 18 bp, Homo sapiens
tgtgtgccaagccctggc

SEQ ID NO: 5654336 - DNA, 23 bp, Homo sapiens
tgtgtgccatagagtttaacaca

SEQ ID NO: 5654337 - DNA, 13 bp, Homo sapiens
tgtgtgcccagct

SEQ ID NO: 5654338 - DNA, 14 bp, Homo sapiens
tgtgtgccctctgg

SEQ ID NO: 5654339 - DNA, 13 bp, Homo sapiens
tgtgtgccctgga

SEQ ID NO: 5654340 - DNA, 20 bp, Homo sapiens
tgtgtgccgagcccttgccc

SEQ ID NO: 5654341 - DNA, 16 bp, Homo sapiens
tgtgtgcctctagctg

SEQ ID NO: 5654342 - DNA, 13 bp, Homo sapiens
tgtgtgcctgtgg

SEQ ID NO: 5654343 - DNA, 15 bp, Homo sapiens
tgtgtgcctgtggca

SEQ ID NO: 5654344 - DNA, 17 bp, Homo sapiens
tgtgtgcctgtggcaga

SEQ ID NO: 5654345 - DNA, 17 bp, Homo sapiens
tgtgtgcgcctgagtga

SEQ ID NO: 5654346 - DNA, 18 bp, Homo sapiens
tgtgtgcgctgcctggcc

SEQ ID NO: 5654347 - DNA, 19 bp, Homo sapiens
tgtgtgcggagtcattttg

SEQ ID NO: 5654348 - DNA, 18 bp, Homo sapiens
tgtgtgcgtgtatatgtg

SEQ ID NO: 5654349 - DNA, 16 bp, Homo sapiens
tgtgtgctactaacag

SEQ ID NO: 5654350 - DNA, 19 bp, Homo sapiens
tgtgtgctactaacagatt

SEQ ID NO: 5654351 - DNA, 22 bp, Homo sapiens
tgtgtgctgtggttcctggggt

SEQ ID NO: 5654352 - DNA, 15 bp, Homo sapiens
tgtgtgcttatgtat

SEQ ID NO: 5654353 - DNA, 15 bp, Homo sapiens
tgtgtgcttcacaca

SEQ ID NO: 5654354 - DNA, 15 bp, Homo sapiens
tgtgtgcttctgctc

SEQ ID NO: 5654355 - DNA, 18 bp, Homo sapiens
tgtgtgcttgaatgtgag

SEQ ID NO: 5654356 - DNA, 17 bp, Homo sapiens
tgtgtgctttaggcgtg

SEQ ID NO: 5654357 - DNA, 13 bp, Homo sapiens
tgtgtgctttccc

SEQ ID NO: 5654358 - DNA, 12 bp, Homo sapiens
tgtgtggaaatg

SEQ ID NO: 5654359 - DNA, 12 bp, Homo sapiens
tgtgtggaattt

SEQ ID NO: 5654360 - DNA, 19 bp, Homo sapiens
tgtgtggacagcccgggag

SEQ ID NO: 5654361 - DNA, 14 bp, Homo sapiens
tgtgtggacaggac

SEQ ID NO: 5654362 - DNA, 16 bp, Homo sapiens
tgtgtggactgtgatg

SEQ ID NO: 5654363 - DNA, 16 bp, Homo sapiens
tgtgtggactgtggca

SEQ ID NO: 5654364 - DNA, 15 bp, Homo sapiens
tgtgtggatatttat

SEQ ID NO: 5654365 - DNA, 23 bp, Homo sapiens
tgtgtggattgcctctgaaaagt

SEQ ID NO: 5654366 - DNA, 21 bp, Homo sapiens
tgtgtggcaaattaaacaata

SEQ ID NO: 5654367 - DNA, 12 bp, Homo sapiens
tgtgtggcaggg

SEQ ID NO: 5654368 - DNA, 15 bp, Homo sapiens
tgtgtggcagggggc

SEQ ID NO: 5654369 - DNA, 22 bp, Homo sapiens
tgtgtggccaaccaggacccag

SEQ ID NO: 5654370 - DNA, 17 bp, Homo sapiens
tgtgtggccacttctgt

SEQ ID NO: 5654371 - DNA, 13 bp, Homo sapiens
tgtgtggcccagc

SEQ ID NO: 5654372 - DNA, 14 bp, Homo sapiens
tgtgtggcccagca

SEQ ID NO: 5654373 - DNA, 22 bp, Homo sapiens
tgtgtggcccagcacgagcctg

SEQ ID NO: 5654374 - DNA, 22 bp, Homo sapiens
tgtgtggcctaatccacctggt

SEQ ID NO: 5654375 - DNA, 11 bp, Homo sapiens
tgtgtggcctc

SEQ ID NO: 5654376 - DNA, 13 bp, Homo sapiens
tgtgtggcctggt

SEQ ID NO: 5654377 - DNA, 22 bp, Homo sapiens
tgtgtggcctggtgggtcaggg

SEQ ID NO: 5654378 - DNA, 20 bp, Homo sapiens
tgtgtggctcattcttttca

SEQ ID NO: 5654379 - DNA, 12 bp, Homo sapiens
tgtgtggctcct

SEQ ID NO: 5654380 - DNA, 14 bp, Homo sapiens
tgtgtggcttggag

SEQ ID NO: 5654381 - DNA, 16 bp, Homo sapiens
tgtgtgggactgtaca

SEQ ID NO: 5654382 - DNA, 23 bp, Homo sapiens
tgtgtgggctcctttaggcaggt

SEQ ID NO: 5654383 - DNA, 13 bp, Homo sapiens
tgtgtggggaggc

SEQ ID NO: 5654384 - DNA, 18 bp, Homo sapiens
tgtgtggggcccaagcat

SEQ ID NO: 5654385 - DNA, 17 bp, Homo sapiens
tgtgtggggttctcagt

SEQ ID NO: 5654386 - DNA, 20 bp, Homo sapiens
tgtgtgggtaaatgctttta

SEQ ID NO: 5654387 - DNA, 19 bp, Homo sapiens
tgtgtgggtctggggaggg

SEQ ID NO: 5654388 - DNA, 15 bp, Homo sapiens
tgtgtgggtgctgat

SEQ ID NO: 5654389 - DNA, 19 bp, Homo sapiens
tgtgtgggtgctgataatt

SEQ ID NO: 5654390 - DNA, 14 bp, Homo sapiens
tgtgtggtactttg

SEQ ID NO: 5654391 - DNA, 16 bp, Homo sapiens
tgtgtggtactttgca

SEQ ID NO: 5654392 - DNA, 21 bp, Homo sapiens
tgtgtggtactttgcagctgc

SEQ ID NO: 5654393 - DNA, 14 bp, Homo sapiens
tgtgtggtcagcgg

SEQ ID NO: 5654394 - DNA, 23 bp, Homo sapiens
tgtgtggtcagcggtatgtgcgt

SEQ ID NO: 5654395 - DNA, 14 bp, Homo sapiens
tgtgtggtgcattc

SEQ ID NO: 5654396 - DNA, 20 bp, Homo sapiens
tgtgtggtgggttctttgga

SEQ ID NO: 5654397 - DNA, 14 bp, Homo sapiens
tgtgtggttggaaa

SEQ ID NO: 5654398 - DNA, 12 bp, Homo sapiens
tgtgtgtacatg

SEQ ID NO: 5654399 - DNA, 18 bp, Homo sapiens
tgtgtgtaccacaccctg

SEQ ID NO: 5654400 - DNA, 24 bp, Homo sapiens
tgtgtgtaccacaccctgcctgct

SEQ ID NO: 5654401 - DNA, 16 bp, Homo sapiens
tgtgtgtagccaggaa

SEQ ID NO: 5654402 - DNA, 14 bp, Homo sapiens
tgtgtgtatacatg

SEQ ID NO: 5654403 - DNA, 15 bp, Homo sapiens
tgtgtgtatatatgt

SEQ ID NO: 5654404 - DNA, 17 bp, Homo sapiens
tgtgtgtatatgtattt

SEQ ID NO: 5654405 - DNA, 21 bp, Homo sapiens
tgtgtgtatcaccctcagctg

SEQ ID NO: 5654406 - DNA, 16 bp, Homo sapiens
tgtgtgtatgctgctt

SEQ ID NO: 5654407 - DNA, 16 bp, Homo sapiens
tgtgtgtatgtatgtg

SEQ ID NO: 5654408 - DNA, 14 bp, Homo sapiens
tgtgtgtatgtcta

SEQ ID NO: 5654409 - DNA, 15 bp, Homo sapiens
tgtgtgtatgtgtgt

SEQ ID NO: 5654410 - DNA, 19 bp, Homo sapiens
tgtgtgtatgtttgcacac

SEQ ID NO: 5654411 - DNA, 12 bp, Homo sapiens
tgtgtgtatttg

SEQ ID NO: 5654412 - DNA, 12 bp, Homo sapiens
tgttcacacaca

SEQ ID NO: 5654413 - DNA, 18 bp, Homo sapiens
tgttcacacacacacaat

SEQ ID NO: 5654414 - DNA, 16 bp, Homo sapiens
tgttcacaccagagaa

SEQ ID NO: 5654415 - DNA, 21 bp, Homo sapiens
tgttcacaccattctcctgcc

SEQ ID NO: 5654416 - DNA, 13 bp, Homo sapiens
tgttcacactcct

SEQ ID NO: 5654417 - DNA, 14 bp, Homo sapiens
tgttcacactccta

SEQ ID NO: 5654418 - DNA, 15 bp, Homo sapiens
tgttcacactctcac

SEQ ID NO: 5654419 - DNA, 19 bp, Homo sapiens
tgttcacactctcacatgt

SEQ ID NO: 5654420 - DNA, 17 bp, Homo sapiens
tgttcacactgcagaga

SEQ ID NO: 5654421 - DNA, 17 bp, Homo sapiens
tgttcacagaaaaagca

SEQ ID NO: 5654422 - DNA, 17 bp, Homo sapiens
tgttcacagcttttctt

SEQ ID NO: 5654423 - DNA, 18 bp, Homo sapiens
tgttcacagcttttcttg

SEQ ID NO: 5654424 - DNA, 20 bp, Homo sapiens
tgttcacagtctctggaaaa

SEQ ID NO: 5654425 - DNA, 21 bp, Homo sapiens
tgttcacatatgattctctta

SEQ ID NO: 5654426 - DNA, 17 bp, Homo sapiens
tgttcaccaaaaccaaa

SEQ ID NO: 5654427 - DNA, 16 bp, Homo sapiens
tgttcaccatcggcag

SEQ ID NO: 5654428 - DNA, 16 bp, Homo sapiens
tgttcaccttatgtat

SEQ ID NO: 5654429 - DNA, 21 bp, Homo sapiens
tgttcaccttcaaaatgttct

SEQ ID NO: 5654430 - DNA, 15 bp, Homo sapiens
tgttcaccttctgtg

SEQ ID NO: 5654431 - DNA, 15 bp, Homo sapiens
tgttcacgtgactcc

SEQ ID NO: 5654432 - DNA, 18 bp, Homo sapiens
tgttcactcactctaaag

SEQ ID NO: 5654433 - DNA, 15 bp, Homo sapiens
tgttcactcagcact

SEQ ID NO: 5654434 - DNA, 17 bp, Homo sapiens
tgttcactgaagacgcc

SEQ ID NO: 5654435 - DNA, 18 bp, Homo sapiens
tgttcactgaaggtgatt

SEQ ID NO: 5654436 - DNA, 18 bp, Homo sapiens
tgttcactgaataaataa

SEQ ID NO: 5654437 - DNA, 16 bp, Homo sapiens
tgttcactgcagcatg

SEQ ID NO: 5654438 - DNA, 18 bp, Homo sapiens
tgttcactgctccttgct

SEQ ID NO: 5654439 - DNA, 22 bp, Homo sapiens
tgttcacttcgaaattctgagt

SEQ ID NO: 5654440 - DNA, 22 bp, Homo sapiens
tgttcactttaaagcaattgca

SEQ ID NO: 5654441 - DNA, 15 bp, Homo sapiens
tgttcagaaaagcac

SEQ ID NO: 5654442 - DNA, 22 bp, Homo sapiens
tgttcagaaagcaataactttg

SEQ ID NO: 5654443 - DNA, 24 bp, Homo sapiens
tgttcagaacttcatctgccactg

SEQ ID NO: 5654444 - DNA, 18 bp, Homo sapiens
tgttcagaattttggaaa

SEQ ID NO: 5654445 - DNA, 19 bp, Homo sapiens
tgttcagaattttggaaaa

SEQ ID NO: 5654446 - DNA, 21 bp, Homo sapiens
tgttcagagtggctcactggc

SEQ ID NO: 5654447 - DNA, 22 bp, Homo sapiens
tgttcagatctcatagatgacc

SEQ ID NO: 5654448 - DNA, 17 bp, Homo sapiens
tgttcagattgctttga

SEQ ID NO: 5654449 - DNA, 13 bp, Homo sapiens
tgttcagcactgt

SEQ ID NO: 5654450 - DNA, 14 bp, Homo sapiens
tgttcagcactgtc

SEQ ID NO: 5654451 - DNA, 14 bp, Homo sapiens
tgttcagcagaacc

SEQ ID NO: 5654452 - DNA, 16 bp, Homo sapiens
tgttcagcagaacctg

SEQ ID NO: 5654453 - DNA, 18 bp, Homo sapiens
tgttcagcagaacctgca

SEQ ID NO: 5654454 - DNA, 22 bp, Homo sapiens
tgttcagcagaacctgcacaca

SEQ ID NO: 5654455 - DNA, 12 bp, Homo sapiens
tgttcagcatag

SEQ ID NO: 5654456 - DNA, 14 bp, Homo sapiens
tgttcagcattctt

SEQ ID NO: 5654457 - DNA, 18 bp, Homo sapiens
tgttcagcggagctgact

SEQ ID NO: 5654458 - DNA, 16 bp, Homo sapiens
tgttcagctccagctc

SEQ ID NO: 5654459 - DNA, 21 bp, Homo sapiens
tgttcagctccagctcaccag

SEQ ID NO: 5654460 - DNA, 21 bp, Homo sapiens
tgttcagctctttccaaatta

SEQ ID NO: 5654461 - DNA, 17 bp, Homo sapiens
tgttcagcttttattcc

SEQ ID NO: 5654462 - DNA, 21 bp, Homo sapiens
tgttcaggaaaaggttgaata

SEQ ID NO: 5654463 - DNA, 23 bp, Homo sapiens
tgttcaggagtccaaaccttcta

SEQ ID NO: 5654464 - DNA, 18 bp, Homo sapiens
tgttcaggcattccaggt

SEQ ID NO: 5654465 - DNA, 18 bp, Homo sapiens
tgttcagtgagatatcat

SEQ ID NO: 5654466 - DNA, 13 bp, Homo sapiens
tgttcagtgtaat

SEQ ID NO: 5654467 - DNA, 22 bp, Homo sapiens
tgttcagtgtaatttctttgcc

SEQ ID NO: 5654468 - DNA, 12 bp, Homo sapiens
tgttcagtgtta

SEQ ID NO: 5654469 - DNA, 15 bp, Homo sapiens
tgttcagtgttgaca

SEQ ID NO: 5654470 - DNA, 16 bp, Homo sapiens
tgttcagtgttgacat

SEQ ID NO: 5654471 - DNA, 17 bp, Homo sapiens
tgttcagtgttgacata

SEQ ID NO: 5654472 - DNA, 20 bp, Homo sapiens
tgttcagtgttgacatagcc

SEQ ID NO: 5654473 - DNA, 23 bp, Homo sapiens
tgttcagtgttgacatagccttt

SEQ ID NO: 5654474 - DNA, 18 bp, Homo sapiens
tgttcagttgcacttcta

SEQ ID NO: 5654475 - DNA, 20 bp, Homo sapiens
tgttcataaaacggtgcttt

SEQ ID NO: 5654476 - DNA, 17 bp, Homo sapiens
tgttcataaataaagtt

SEQ ID NO: 5654477 - DNA, 12 bp, Homo sapiens
tgttcatacagt

SEQ ID NO: 5654478 - DNA, 14 bp, Homo sapiens
tgttcatacatatt

SEQ ID NO: 5654479 - DNA, 23 bp, Homo sapiens
tgttcatacggggtggctgaaag

SEQ ID NO: 5654480 - DNA, 13 bp, Homo sapiens
tgttcatactttg

SEQ ID NO: 5654481 - DNA, 22 bp, Homo sapiens
tgttcatactttggctgtgatg

SEQ ID NO: 5654482 - DNA, 16 bp, Homo sapiens
tgttcatatgtacttg

SEQ ID NO: 5654483 - DNA, 22 bp, Homo sapiens
tgttcatatgtacttgtttgct

SEQ ID NO: 5654484 - DNA, 18 bp, Homo sapiens
tgttcatattaagaatga

SEQ ID NO: 5654485 - DNA, 15 bp, Homo sapiens
tgttcatcatccaga

SEQ ID NO: 5654486 - DNA, 16 bp, Homo sapiens
tgttcatcatccagat

SEQ ID NO: 5654487 - DNA, 11 bp, Homo sapiens
tgttcatccca

SEQ ID NO: 5654488 - DNA, 16 bp, Homo sapiens
tgttcatctctttgtc

SEQ ID NO: 5654489 - DNA, 19 bp, Homo sapiens
tgttcatctctttgtcctg

SEQ ID NO: 5654490 - DNA, 21 bp, Homo sapiens
tgttcatctctttgtcctgaa

SEQ ID NO: 5654491 - DNA, 14 bp, Homo sapiens
tgttcatctgtaac

SEQ ID NO: 5654492 - DNA, 17 bp, Homo sapiens
tgttcatcttgtacaaa

SEQ ID NO: 5654493 - DNA, 13 bp, Homo sapiens
tgttcatgaaaga

SEQ ID NO: 5654494 - DNA, 19 bp, Homo sapiens
tgttcatgatagaaagaat

SEQ ID NO: 5654495 - DNA, 16 bp, Homo sapiens
tgttcatgctgaatcc

SEQ ID NO: 5654496 - DNA, 19 bp, Homo sapiens
tgttcatgttaccaaagca

SEQ ID NO: 5654497 - DNA, 12 bp, Homo sapiens
tgttcatgtttg

SEQ ID NO: 5654498 - DNA, 17 bp, Homo sapiens
tgttcatgttttgctaa

SEQ ID NO: 5654499 - DNA, 21 bp, Homo sapiens
tgttcattaaacgtcattcag

SEQ ID NO: 5654500 - DNA, 17 bp, Homo sapiens
tgttcattaaattttct

SEQ ID NO: 5654501 - DNA, 15 bp, Homo sapiens
tgttcattgcacaat

SEQ ID NO: 5654502 - DNA, 18 bp, Homo sapiens
tgttcattgcacaatata

SEQ ID NO: 5654503 - DNA, 20 bp, Homo sapiens
tgttcattgcacaatatatt

SEQ ID NO: 5654504 - DNA, 20 bp, Homo sapiens
tgttcattgtaatgttactg

SEQ ID NO: 5654505 - DNA, 19 bp, Homo sapiens
tgttcatttagataatttg

SEQ ID NO: 5654506 - DNA, 11 bp, Homo sapiens
tgttcatttcc

SEQ ID NO: 5654507 - DNA, 13 bp, Homo sapiens
tgttcatttctgt

SEQ ID NO: 5654508 - DNA, 22 bp, Homo sapiens
tgttcatttggtgttcctggaa

SEQ ID NO: 5654509 - DNA, 23 bp, Homo sapiens
tgttcatttggtgttcctggaag

SEQ ID NO: 5654510 - DNA, 18 bp, Homo sapiens
tgttcatttgttattctt

SEQ ID NO: 5654511 - DNA, 19 bp, Homo sapiens
tgttcatttgttattctta

SEQ ID NO: 5654512 - DNA, 20 bp, Homo sapiens
tgttcatttgttattcttaa

SEQ ID NO: 5654513 - DNA, 15 bp, Homo sapiens
tgttcattttgaaaa

SEQ ID NO: 5654514 - DNA, 20 bp, Homo sapiens
tgttcattttgagctgaaat

SEQ ID NO: 5654515 - DNA, 15 bp, Homo sapiens
tgttcattttgagta

SEQ ID NO: 5654516 - DNA, 22 bp, Homo sapiens
tgttcattttgtcacaagctgt

SEQ ID NO: 5654517 - DNA, 22 bp, Homo sapiens
tgttcatttttaaagcctggct

SEQ ID NO: 5654518 - DNA, 15 bp, Homo sapiens
tgttcatttttcaaa

SEQ ID NO: 5654519 - DNA, 18 bp, Homo sapiens
tgttcatttttctctccc

SEQ ID NO: 5654520 - DNA, 17 bp, Homo sapiens
tgttccaaaccctcctg

SEQ ID NO: 5654521 - DNA, 18 bp, Homo sapiens
tgttccaaaccctcctgg

SEQ ID NO: 5654522 - DNA, 19 bp, Homo sapiens
tgttccaaaccctcctggg

SEQ ID NO: 5654523 - DNA, 10 bp, Homo sapiens
tgttccaaat

SEQ ID NO: 5654524 - DNA, 14 bp, Homo sapiens
tgttccaaatgtgt

SEQ ID NO: 5654525 - DNA, 18 bp, Homo sapiens
tgttccaaattcagtttc

SEQ ID NO: 5654526 - DNA, 19 bp, Homo sapiens
tgttccaaattcagtttca

SEQ ID NO: 5654527 - DNA, 22 bp, Homo sapiens
tgttccaaattcagtttcataa

SEQ ID NO: 5654528 - DNA, 12 bp, Homo sapiens
tgttccaaattt

SEQ ID NO: 5654529 - DNA, 19 bp, Homo sapiens
tgttccaaatttgctttac

SEQ ID NO: 5654530 - DNA, 19 bp, Homo sapiens
tgttccaacagttaaactt

SEQ ID NO: 5654531 - DNA, 13 bp, Homo sapiens
tgttccaacctcc

SEQ ID NO: 5654532 - DNA, 17 bp, Homo sapiens
tgttccaacctcctgct

SEQ ID NO: 5654533 - DNA, 14 bp, Homo sapiens
tgttccaactgccc

SEQ ID NO: 5654534 - DNA, 11 bp, Homo sapiens
tgttccaagac

SEQ ID NO: 5654535 - DNA, 14 bp, Homo sapiens
tgttccaagacatt

SEQ ID NO: 5654536 - DNA, 16 bp, Homo sapiens
tgttccaaggccaggg

SEQ ID NO: 5654537 - DNA, 19 bp, Homo sapiens
tgttccaagtctctgtgta

SEQ ID NO: 5654538 - DNA, 21 bp, Homo sapiens
tgttccaagtgtgtgtgcaat

SEQ ID NO: 5654539 - DNA, 15 bp, Homo sapiens
tgttccaataaacag

SEQ ID NO: 5654540 - DNA, 21 bp, Homo sapiens
tgttccacacccaatgctgct

SEQ ID NO: 5654541 - DNA, 14 bp, Homo sapiens
tgttccacagtgac

SEQ ID NO: 5654542 - DNA, 17 bp, Homo sapiens
tgttccacttggaaatg

SEQ ID NO: 5654543 - DNA, 17 bp, Homo sapiens
tgttccacttgtttgca

SEQ ID NO: 5654544 - DNA, 19 bp, Homo sapiens
tgttccacttgtttgcact

SEQ ID NO: 5654545 - DNA, 20 bp, Homo sapiens
tgttccacttgtttgcactg

SEQ ID NO: 5654546 - DNA, 11 bp, Homo sapiens
tgttccagact

SEQ ID NO: 5654547 - DNA, 23 bp, Homo sapiens
tgttccagactcaggttccagaa

SEQ ID NO: 5654548 - DNA, 19 bp, Homo sapiens
tgttccaggtttcttccac

SEQ ID NO: 5654549 - DNA, 10 bp, Homo sapiens
tgttccagtt

SEQ ID NO: 5654550 - DNA, 22 bp, Homo sapiens
tgttccataggaaggctgtgat

SEQ ID NO: 5654551 - DNA, 18 bp, Homo sapiens
tgttccatgacttcagag

SEQ ID NO: 5654552 - DNA, 16 bp, Homo sapiens
tgttccatgcctggcc

SEQ ID NO: 5654553 - DNA, 18 bp, Homo sapiens
tgttccatgcctggccct

SEQ ID NO: 5654554 - DNA, 20 bp, Homo sapiens
tgttccatgcctggcccttg

SEQ ID NO: 5654555 - DNA, 22 bp, Homo sapiens
tgttccatgcctggcccttgcc

SEQ ID NO: 5654556 - DNA, 22 bp, Homo sapiens
tgttccattgcctcttttcaca

SEQ ID NO: 5654557 - DNA, 15 bp, Homo sapiens
tgttcccaaattgac

SEQ ID NO: 5654558 - DNA, 23 bp, Homo sapiens
tgttcccaagagcatcatgcctc

SEQ ID NO: 5654559 - DNA, 21 bp, Homo sapiens
tgttcccacaatggctgggag

SEQ ID NO: 5654560 - DNA, 13 bp, Homo sapiens
tgttcccacacac

SEQ ID NO: 5654561 - DNA, 12 bp, Homo sapiens
tgttcccagaaa

SEQ ID NO: 5654562 - DNA, 15 bp, Homo sapiens
tgttcccagcagtgg

SEQ ID NO: 5654563 - DNA, 13 bp, Homo sapiens
tgttcccagcccc

SEQ ID NO: 5654564 - DNA, 14 bp, Homo sapiens
tgttcccagcccct

SEQ ID NO: 5654565 - DNA, 22 bp, Homo sapiens
tgttcccagcccctcctccctc

SEQ ID NO: 5654566 - DNA, 13 bp, Homo sapiens
tgttcccagctca

SEQ ID NO: 5654567 - DNA, 19 bp, Homo sapiens
tgttcccatcctcttcttt

SEQ ID NO: 5654568 - DNA, 20 bp, Homo sapiens
tgttcccatgtagccccctg

SEQ ID NO: 5654569 - DNA, 16 bp, Homo sapiens
tgttcccattggatgc

SEQ ID NO: 5654570 - DNA, 20 bp, Homo sapiens
tgttcccattggatgcattt

SEQ ID NO: 5654571 - DNA, 17 bp, Homo sapiens
tgttccccaaataattg

SEQ ID NO: 5654572 - DNA, 15 bp, Homo sapiens
tgttccccactggag

SEQ ID NO: 5654573 - DNA, 13 bp, Homo sapiens
tgttccccagaga

SEQ ID NO: 5654574 - DNA, 14 bp, Homo sapiens
tgttcccccagggg

SEQ ID NO: 5654575 - DNA, 15 bp, Homo sapiens
tgttccccccataga

SEQ ID NO: 5654576 - DNA, 16 bp, Homo sapiens
tgttcccccgccgctt

SEQ ID NO: 5654577 - DNA, 17 bp, Homo sapiens
tgttccccctgccgcag

SEQ ID NO: 5654578 - DNA, 21 bp, Homo sapiens
tgttcccctcactggatgaaa

SEQ ID NO: 5654579 - DNA, 17 bp, Homo sapiens
tgttcccctcctccact

SEQ ID NO: 5654580 - DNA, 15 bp, Homo sapiens
tgttcccctcttccc

SEQ ID NO: 5654581 - DNA, 23 bp, Homo sapiens
tgttcccctcttgtctcccctgt

SEQ ID NO: 5654582 - DNA, 14 bp, Homo sapiens
tgttccccttccac

SEQ ID NO: 5654583 - DNA, 13 bp, Homo sapiens
tgttccctacccc

SEQ ID NO: 5654584 - DNA, 15 bp, Homo sapiens
tgttccctagagaga

SEQ ID NO: 5654585 - DNA, 16 bp, Homo sapiens
tgttccctatccaatc

SEQ ID NO: 5654586 - DNA, 20 bp, Homo sapiens
tgttccctcattctgcatta

SEQ ID NO: 5654587 - DNA, 14 bp, Homo sapiens
tgttccctccaggc

SEQ ID NO: 5654588 - DNA, 18 bp, Homo sapiens
tgttccctctccctgttg

SEQ ID NO: 5654589 - DNA, 19 bp, Homo sapiens
tgttccctctgctcctgga

SEQ ID NO: 5654590 - DNA, 17 bp, Homo sapiens
tgttgacccttttttga

SEQ ID NO: 5654591 - DNA, 16 bp, Homo sapiens
tgttgacgaagtctct

SEQ ID NO: 5654592 - DNA, 16 bp, Homo sapiens
tgttgacgcacctgtg

SEQ ID NO: 5654593 - DNA, 13 bp, Homo sapiens
tgttgactgctgc

SEQ ID NO: 5654594 - DNA, 17 bp, Homo sapiens
tgttgactggactgctt

SEQ ID NO: 5654595 - DNA, 13 bp, Homo sapiens
tgttgactgtgat

SEQ ID NO: 5654596 - DNA, 20 bp, Homo sapiens
tgttgacttattttctctgt

SEQ ID NO: 5654597 - DNA, 14 bp, Homo sapiens
tgttgagaaaacga

SEQ ID NO: 5654598 - DNA, 13 bp, Homo sapiens
tgttgagaagaat

SEQ ID NO: 5654599 - DNA, 13 bp, Homo sapiens
tgttgagaggttc

SEQ ID NO: 5654600 - DNA, 15 bp, Homo sapiens
tgttgagagtgtgac

SEQ ID NO: 5654601 - DNA, 18 bp, Homo sapiens
tgttgagatggtaacaga

SEQ ID NO: 5654602 - DNA, 14 bp, Homo sapiens
tgttgagatgtgct

SEQ ID NO: 5654603 - DNA, 19 bp, Homo sapiens
tgttgagatgtgctttgct

SEQ ID NO: 5654604 - DNA, 23 bp, Homo sapiens
tgttgagcaagcagtagcatttg

SEQ ID NO: 5654605 - DNA, 16 bp, Homo sapiens
tgttgagcatcacaga

SEQ ID NO: 5654606 - DNA, 17 bp, Homo sapiens
tgttgagcatcacagaa

SEQ ID NO: 5654607 - DNA, 23 bp, Homo sapiens
tgttgagccccagtgctggaagg

SEQ ID NO: 5654608 - DNA, 16 bp, Homo sapiens
tgttgagccttttccc

SEQ ID NO: 5654609 - DNA, 13 bp, Homo sapiens
tgttgagctgtca

SEQ ID NO: 5654610 - DNA, 13 bp, Homo sapiens
tgttgagctgttt

SEQ ID NO: 5654611 - DNA, 12 bp, Homo sapiens
tgttgaggaggg

SEQ ID NO: 5654612 - DNA, 15 bp, Homo sapiens
tgttgaggcgagcag

SEQ ID NO: 5654613 - DNA, 16 bp, Homo sapiens
tgttgaggtgaccact

SEQ ID NO: 5654614 - DNA, 17 bp, Homo sapiens
tgttgagtacattgaag

SEQ ID NO: 5654615 - DNA, 18 bp, Homo sapiens
tgttgagtatttgctgtt

SEQ ID NO: 5654616 - DNA, 19 bp, Homo sapiens
tgttgagtgcactgactgt

SEQ ID NO: 5654617 - DNA, 21 bp, Homo sapiens
tgttgataaaccaaaaacatt

SEQ ID NO: 5654618 - DNA, 20 bp, Homo sapiens
tgttgataaggaacatttat

SEQ ID NO: 5654619 - DNA, 18 bp, Homo sapiens
tgttgataatttcaggga

SEQ ID NO: 5654620 - DNA, 13 bp, Homo sapiens
tgttgatacaaac

SEQ ID NO: 5654621 - DNA, 19 bp, Homo sapiens
tgttgatacgtgtgtgaag

SEQ ID NO: 5654622 - DNA, 19 bp, Homo sapiens
tgttgatactgttgcacgt

SEQ ID NO: 5654623 - DNA, 21 bp, Homo sapiens
tgttgatagtgatgtatttta

SEQ ID NO: 5654624 - DNA, 17 bp, Homo sapiens
tgttgatattgtttgct

SEQ ID NO: 5654625 - DNA, 18 bp, Homo sapiens
tgttgatcagatcttaca

SEQ ID NO: 5654626 - DNA, 17 bp, Homo sapiens
tgttgatcatgtacttt

SEQ ID NO: 5654627 - DNA, 16 bp, Homo sapiens
tgttgatccatccagc

SEQ ID NO: 5654628 - DNA, 20 bp, Homo sapiens
tgttgatcccacttcactgt

SEQ ID NO: 5654629 - DNA, 13 bp, Homo sapiens
tgttgatctgcat

SEQ ID NO: 5654630 - DNA, 23 bp, Homo sapiens
tgttgatctgcatatttctgtat

SEQ ID NO: 5654631 - DNA, 14 bp, Homo sapiens
tgttgatcttacaa

SEQ ID NO: 5654632 - DNA, 15 bp, Homo sapiens
tgttgatctttcact

SEQ ID NO: 5654633 - DNA, 17 bp, Homo sapiens
tgttgatctttcactat

SEQ ID NO: 5654634 - DNA, 19 bp, Homo sapiens
tgttgatgactcgaaactg

SEQ ID NO: 5654635 - DNA, 12 bp, Homo sapiens
tgttgatgagga

SEQ ID NO: 5654636 - DNA, 21 bp, Homo sapiens
tgttgatgcaatccttacaaa

SEQ ID NO: 5654637 - DNA, 22 bp, Homo sapiens
tgttgatgcaatccttacaaat

SEQ ID NO: 5654638 - DNA, 16 bp, Homo sapiens
tgttgatgctttcgtc

SEQ ID NO: 5654639 - DNA, 21 bp, Homo sapiens
tgttgatgggatgattgaaga

SEQ ID NO: 5654640 - DNA, 22 bp, Homo sapiens
tgttgatgggcacttgagaact

SEQ ID NO: 5654641 - DNA, 19 bp, Homo sapiens
tgttgatgggccttcagat

SEQ ID NO: 5654642 - DNA, 13 bp, Homo sapiens
tgttgatgtatct

SEQ ID NO: 5654643 - DNA, 17 bp, Homo sapiens
tgttgatgtatctgagt

SEQ ID NO: 5654644 - DNA, 19 bp, Homo sapiens
tgttgatgtatctgagttg

SEQ ID NO: 5654645 - DNA, 21 bp, Homo sapiens
tgttgatgtatctgagttgcc

SEQ ID NO: 5654646 - DNA, 22 bp, Homo sapiens
tgttgatgtatctgagttgcca

SEQ ID NO: 5654647 - DNA, 16 bp, Homo sapiens
tgttgattaatttgag

SEQ ID NO: 5654648 - DNA, 16 bp, Homo sapiens
tgttgatttctagtta

SEQ ID NO: 5654649 - DNA, 17 bp, Homo sapiens
tgttgatttgagaaatt

SEQ ID NO: 5654650 - DNA, 14 bp, Homo sapiens
tgttgattttctgt

SEQ ID NO: 5654651 - DNA, 15 bp, Homo sapiens
tgttgattttctgtt

SEQ ID NO: 5654652 - DNA, 18 bp, Homo sapiens
tgttgatttttactgtgt

SEQ ID NO: 5654653 - DNA, 20 bp, Homo sapiens
tgttgatttttactgtgttt

SEQ ID NO: 5654654 - DNA, 11 bp, Homo sapiens
tgttgcaaagc

SEQ ID NO: 5654655 - DNA, 18 bp, Homo sapiens
tgttgcaaattccacccc

SEQ ID NO: 5654656 - DNA, 22 bp, Homo sapiens
tgttgcaaattccacccctcct

SEQ ID NO: 5654657 - DNA, 15 bp, Homo sapiens
tgttgcaagatgtga

SEQ ID NO: 5654658 - DNA, 19 bp, Homo sapiens
tgttgcaagatgtgaatta

SEQ ID NO: 5654659 - DNA, 23 bp, Homo sapiens
tgttgcaagatgtgaattattga

SEQ ID NO: 5654660 - DNA, 16 bp, Homo sapiens
tgttgcaagcccctct

SEQ ID NO: 5654661 - DNA, 17 bp, Homo sapiens
tgttgcaagtactgctg

SEQ ID NO: 5654662 - DNA, 17 bp, Homo sapiens
tgttgcaagtgcaataa

SEQ ID NO: 5654663 - DNA, 20 bp, Homo sapiens
tgttgcacacccactcagct

SEQ ID NO: 5654664 - DNA, 20 bp, Homo sapiens
tgttgcacagtccctcctgt

SEQ ID NO: 5654665 - DNA, 19 bp, Homo sapiens
tgttgcaccatctgcttgg

SEQ ID NO: 5654666 - DNA, 23 bp, Homo sapiens
tgttgcaccatggacttttctca

SEQ ID NO: 5654667 - DNA, 15 bp, Homo sapiens
tgttgcacccagccc

SEQ ID NO: 5654668 - DNA, 23 bp, Homo sapiens
tgttgcactgaagtttgataaat

SEQ ID NO: 5654669 - DNA, 13 bp, Homo sapiens
tgttgcactgccc

SEQ ID NO: 5654670 - DNA, 15 bp, Homo sapiens
tgttgcactgtttgc

SEQ ID NO: 5654671 - DNA, 22 bp, Homo sapiens
tgttgcacttttgaatgtccaa

SEQ ID NO: 5654672 - DNA, 18 bp, Homo sapiens
tgttgcagactggtgtta

SEQ ID NO: 5654673 - DNA, 17 bp, Homo sapiens
tgttgcagagatttcct

SEQ ID NO: 5654674 - DNA, 18 bp, Homo sapiens
tgttgcagatgggtgata

SEQ ID NO: 5654675 - DNA, 16 bp, Homo sapiens
tgttgcagctgtcacc

SEQ ID NO: 5654676 - DNA, 19 bp, Homo sapiens
tgttgcaggaaaccctttt

SEQ ID NO: 5654677 - DNA, 17 bp, Homo sapiens
tgttgcaggcaaatgta

SEQ ID NO: 5654678 - DNA, 17 bp, Homo sapiens
tgttgcaggttcatgga

SEQ ID NO: 5654679 - DNA, 14 bp, Homo sapiens
tgttgcagtggcct

SEQ ID NO: 5654680 - DNA, 14 bp, Homo sapiens
tgttgcatagaatt

SEQ ID NO: 5654681 - DNA, 15 bp, Homo sapiens
tgttgcatatagtta

SEQ ID NO: 5654682 - DNA, 21 bp, Homo sapiens
tgttgcattaattgtgctgtt

SEQ ID NO: 5654683 - DNA, 18 bp, Homo sapiens
tgttgcattattcattta

SEQ ID NO: 5654684 - DNA, 14 bp, Homo sapiens
tgttgccaaagctg

SEQ ID NO: 5654685 - DNA, 19 bp, Homo sapiens
tgttgccaaagctggcttt

SEQ ID NO: 5654686 - DNA, 18 bp, Homo sapiens
tgttgccaaagctggtct

SEQ ID NO: 5654687 - DNA, 19 bp, Homo sapiens
tgttgccaactaagccctc

SEQ ID NO: 5654688 - DNA, 20 bp, Homo sapiens
tgttgccaactaagccctcg

SEQ ID NO: 5654689 - DNA, 20 bp, Homo sapiens
tgttgccaagctccaagccc

SEQ ID NO: 5654690 - DNA, 14 bp, Homo sapiens
tgttgccaagctgg

SEQ ID NO: 5654691 - DNA, 17 bp, Homo sapiens
tgttgccacctgttaaa

SEQ ID NO: 5654692 - DNA, 21 bp, Homo sapiens
tgttgccacctgttaaaatgt

SEQ ID NO: 5654693 - DNA, 23 bp, Homo sapiens
tgttgccaggagatggaatatca

SEQ ID NO: 5654694 - DNA, 12 bp, Homo sapiens
tgttgccaggtt

SEQ ID NO: 5654695 - DNA, 18 bp, Homo sapiens
tgttgccaggttgcagct

SEQ ID NO: 5654696 - DNA, 19 bp, Homo sapiens
tgttgccaggttgcagctg

SEQ ID NO: 5654697 - DNA, 20 bp, Homo sapiens
tgttgccaggttgcagctgc

SEQ ID NO: 5654698 - DNA, 16 bp, Homo sapiens
tgttgccagtgctaag

SEQ ID NO: 5654699 - DNA, 19 bp, Homo sapiens
tgttgccagttgtcctcct

SEQ ID NO: 5654700 - DNA, 16 bp, Homo sapiens
tgttgccatgaggcct

SEQ ID NO: 5654701 - DNA, 15 bp, Homo sapiens
tgttgccatgtgttt

SEQ ID NO: 5654702 - DNA, 15 bp, Homo sapiens
tgttgccatttctct

SEQ ID NO: 5654703 - DNA, 18 bp, Homo sapiens
tgttgccatttctctgct

SEQ ID NO: 5654704 - DNA, 20 bp, Homo sapiens
tgttgccatttctctgctta

SEQ ID NO: 5654705 - DNA, 23 bp, Homo sapiens
tgttgcccaactactatctcaga

SEQ ID NO: 5654706 - DNA, 22 bp, Homo sapiens
tgttgcccacagctgtatgatt

SEQ ID NO: 5654707 - DNA, 11 bp, Homo sapiens
tgttgcccaga

SEQ ID NO: 5654708 - DNA, 12 bp, Homo sapiens
tgttgcccaggc

SEQ ID NO: 5654709 - DNA, 17 bp, Homo sapiens
tgttgcccaggcaggtc

SEQ ID NO: 5654710 - DNA, 13 bp, Homo sapiens
tgttgcccaggct

SEQ ID NO: 5654711 - DNA, 15 bp, Homo sapiens
tgttgcccaggctgg

SEQ ID NO: 5654712 - DNA, 16 bp, Homo sapiens
tgttgcccaggctgga

SEQ ID NO: 5654713 - DNA, 18 bp, Homo sapiens
tgttgcccaggctggagt

SEQ ID NO: 5654714 - DNA, 23 bp, Homo sapiens
tgttgcccaggctggcgtgcagt

SEQ ID NO: 5654715 - DNA, 21 bp, Homo sapiens
tgttgcccctttctcttttcc

SEQ ID NO: 5654716 - DNA, 21 bp, Homo sapiens
tgttgccctgtttcctgctgc

SEQ ID NO: 5654717 - DNA, 12 bp, Homo sapiens
tgttgcccttct

SEQ ID NO: 5654718 - DNA, 15 bp, Homo sapiens
tgttgccctttctgt

SEQ ID NO: 5654719 - DNA, 21 bp, Homo sapiens
tgttgccctttctgtaccatt

SEQ ID NO: 5654720 - DNA, 12 bp, Homo sapiens
tgttgcctaagt

SEQ ID NO: 5654721 - DNA, 23 bp, Homo sapiens
tgttgcctacctagctgcatcta

SEQ ID NO: 5654722 - DNA, 14 bp, Homo sapiens
tgttgcctcctccc

SEQ ID NO: 5654723 - DNA, 16 bp, Homo sapiens
tgttgcctcctcccat

SEQ ID NO: 5654724 - DNA, 19 bp, Homo sapiens
tgttgcctcctcccatcca

SEQ ID NO: 5654725 - DNA, 21 bp, Homo sapiens
tgttgcctcctctctccctgc

SEQ ID NO: 5654726 - DNA, 15 bp, Homo sapiens
tgttgcctcttgcaa

SEQ ID NO: 5654727 - DNA, 22 bp, Homo sapiens
tgttgcctgctgagctgtgccc

SEQ ID NO: 5654728 - DNA, 18 bp, Homo sapiens
tgttgccttatttctcat

SEQ ID NO: 5654729 - DNA, 16 bp, Homo sapiens
tgttgccttcatcttc

SEQ ID NO: 5654730 - DNA, 22 bp, Homo sapiens
tgttgccttgaaccacttccct

SEQ ID NO: 5654731 - DNA, 13 bp, Homo sapiens
tgttgccttttca

SEQ ID NO: 5654732 - DNA, 18 bp, Homo sapiens
tgttgcgcacatccctgc

SEQ ID NO: 5654733 - DNA, 21 bp, Homo sapiens
tgttgcgtgacactctccttg

SEQ ID NO: 5654734 - DNA, 14 bp, Homo sapiens
tgttgctagggaga

SEQ ID NO: 5654735 - DNA, 21 bp, Homo sapiens
tgttgctagggagagggaaga

SEQ ID NO: 5654736 - DNA, 16 bp, Homo sapiens
tgttgctataataaag

SEQ ID NO: 5654737 - DNA, 16 bp, Homo sapiens
tgttgctatacatgtt

SEQ ID NO: 5654738 - DNA, 14 bp, Homo sapiens
tgttgctatagtga

SEQ ID NO: 5654739 - DNA, 17 bp, Homo sapiens
tgttgctatcctgcagg

SEQ ID NO: 5654740 - DNA, 21 bp, Homo sapiens
tgttgctatcctgcaggaaat

SEQ ID NO: 5654741 - DNA, 19 bp, Homo sapiens
tgttgctcaaaaaatgagc

SEQ ID NO: 5654742 - DNA, 21 bp, Homo sapiens
tgttgctcaaatctattcaga

SEQ ID NO: 5654743 - DNA, 23 bp, Homo sapiens
tgttgctcaaatctattcagaca

SEQ ID NO: 5654744 - DNA, 19 bp, Homo sapiens
tgttgctcagtgtgtaatg

SEQ ID NO: 5654745 - DNA, 14 bp, Homo sapiens
tgttgctccctgtg

SEQ ID NO: 5654746 - DNA, 17 bp, Homo sapiens
tgttgctcgaagactgt

SEQ ID NO: 5654747 - DNA, 14 bp, Homo sapiens
tgttgctcttggaa

SEQ ID NO: 5654748 - DNA, 12 bp, Homo sapiens
tgttgctctttc

SEQ ID NO: 5654749 - DNA, 13 bp, Homo sapiens
tgttgctgaatag

SEQ ID NO: 5654750 - DNA, 23 bp, Homo sapiens
tgttgctgaataggcgatcacaa

SEQ ID NO: 5654751 - DNA, 13 bp, Homo sapiens
tgttgctgcctca

SEQ ID NO: 5654752 - DNA, 18 bp, Homo sapiens
tgttgctgctactgtctt

SEQ ID NO: 5654753 - DNA, 16 bp, Homo sapiens
tgttgctggatcagga

SEQ ID NO: 5654754 - DNA, 17 bp, Homo sapiens
tgttgctgtctggcttt

SEQ ID NO: 5654755 - DNA, 14 bp, Homo sapiens
tgttgcttaattgt

SEQ ID NO: 5654756 - DNA, 18 bp, Homo sapiens
tgttgcttagatgagggt

SEQ ID NO: 5654757 - DNA, 14 bp, Homo sapiens
tgttgcttatgttg

SEQ ID NO: 5654758 - DNA, 16 bp, Homo sapiens
tgttgcttcaaactga

SEQ ID NO: 5654759 - DNA, 15 bp, Homo sapiens
tgttgcttcttgtga

SEQ ID NO: 5654760 - DNA, 14 bp, Homo sapiens
tgttgcttggacta

SEQ ID NO: 5654761 - DNA, 19 bp, Homo sapiens
tgttgctttaatatgagct

SEQ ID NO: 5654762 - DNA, 14 bp, Homo sapiens
tgttgctttacagt

SEQ ID NO: 5654763 - DNA, 16 bp, Homo sapiens
tgttgctttacagtta

SEQ ID NO: 5654764 - DNA, 16 bp, Homo sapiens
tgttgctttgttgcac

SEQ ID NO: 5654765 - DNA, 17 bp, Homo sapiens
tgttgcttttcaaatgt

SEQ ID NO: 5654766 - DNA, 20 bp, Homo sapiens
tgttgcttttgaaaagttga

SEQ ID NO: 5654767 - DNA, 13 bp, Homo sapiens
tgttggaaaagaa

SEQ ID NO: 5654768 - DNA, 17 bp, Homo sapiens
tgtttgggatgaccagg

SEQ ID NO: 5654769 - DNA, 16 bp, Homo sapiens
tgtttgggcagaaggg

SEQ ID NO: 5654770 - DNA, 22 bp, Homo sapiens
tgtttgggcagaagggagaagg

SEQ ID NO: 5654771 - DNA, 19 bp, Homo sapiens
tgtttggggaagttcaagt

SEQ ID NO: 5654772 - DNA, 20 bp, Homo sapiens
tgtttggggaagttcaagtg

SEQ ID NO: 5654773 - DNA, 16 bp, Homo sapiens
tgtttgggggaaaaaa

SEQ ID NO: 5654774 - DNA, 23 bp, Homo sapiens
tgtttgggggaaaaaaaagaaaa

SEQ ID NO: 5654775 - DNA, 18 bp, Homo sapiens
tgtttgggggacgtttct

SEQ ID NO: 5654776 - DNA, 24 bp, Homo sapiens
tgtttgggggacgtttctcatttg

SEQ ID NO: 5654777 - DNA, 15 bp, Homo sapiens
tgtttgggtatcctg

SEQ ID NO: 5654778 - DNA, 18 bp, Homo sapiens
tgtttgggtatcctgccc

SEQ ID NO: 5654779 - DNA, 22 bp, Homo sapiens
tgtttgggtggtttgtgagcct

SEQ ID NO: 5654780 - DNA, 16 bp, Homo sapiens
tgtttggtcgagtctt

SEQ ID NO: 5654781 - DNA, 18 bp, Homo sapiens
tgtttggtgctcatttaa

SEQ ID NO: 5654782 - DNA, 15 bp, Homo sapiens
tgtttggtttacatt

SEQ ID NO: 5654783 - DNA, 13 bp, Homo sapiens
tgtttggtttcag

SEQ ID NO: 5654784 - DNA, 10 bp, Homo sapiens
tgtttgtaaa

SEQ ID NO: 5654785 - DNA, 14 bp, Homo sapiens
tgtttgtaaaacca

SEQ ID NO: 5654786 - DNA, 18 bp, Homo sapiens
tgtttgtaaaagagctgt

SEQ ID NO: 5654787 - DNA, 15 bp, Homo sapiens
tgtttgtaaataaga

SEQ ID NO: 5654788 - DNA, 21 bp, Homo sapiens
tgtttgtaaataagagatttg

SEQ ID NO: 5654789 - DNA, 14 bp, Homo sapiens
tgtttgtaaatgcc

SEQ ID NO: 5654790 - DNA, 16 bp, Homo sapiens
tgtttgtaacaagaaa

SEQ ID NO: 5654791 - DNA, 22 bp, Homo sapiens
tgtttgtaactttttacattac

SEQ ID NO: 5654792 - DNA, 15 bp, Homo sapiens
tgtttgtaagattta

SEQ ID NO: 5654793 - DNA, 19 bp, Homo sapiens
tgtttgtactttttaatgt

SEQ ID NO: 5654794 - DNA, 19 bp, Homo sapiens
tgtttgtagctttcctgga

SEQ ID NO: 5654795 - DNA, 22 bp, Homo sapiens
tgtttgtagctttcctggaagt

SEQ ID NO: 5654796 - DNA, 16 bp, Homo sapiens
tgtttgtagtgaaata

SEQ ID NO: 5654797 - DNA, 21 bp, Homo sapiens
tgtttgtataccatgatgcat

SEQ ID NO: 5654798 - DNA, 16 bp, Homo sapiens
tgtttgtatatttgca

SEQ ID NO: 5654799 - DNA, 17 bp, Homo sapiens
tgtttgtatatttgcaa

SEQ ID NO: 5654800 - DNA, 15 bp, Homo sapiens
tgtttgtatgaaatt

SEQ ID NO: 5654801 - DNA, 14 bp, Homo sapiens
tgtttgtatgtctg

SEQ ID NO: 5654802 - DNA, 11 bp, Homo sapiens
tgtttgtattc

SEQ ID NO: 5654803 - DNA, 20 bp, Homo sapiens
tgtttgtatttttttccaag

SEQ ID NO: 5654804 - DNA, 21 bp, Homo sapiens
tgtttgtatttttttccaagt

SEQ ID NO: 5654805 - DNA, 16 bp, Homo sapiens
tgtttgtcagcatctg

SEQ ID NO: 5654806 - DNA, 19 bp, Homo sapiens
tgtttgtcagcatctgacc

SEQ ID NO: 5654807 - DNA, 21 bp, Homo sapiens
tgtttgtcagcatctgaccat

SEQ ID NO: 5654808 - DNA, 23 bp, Homo sapiens
tgtttgtcagcatctgaccatct

SEQ ID NO: 5654809 - DNA, 17 bp, Homo sapiens
tgtttgtcattagcctg

SEQ ID NO: 5654810 - DNA, 17 bp, Homo sapiens
tgtttgtccagttcagg

SEQ ID NO: 5654811 - DNA, 23 bp, Homo sapiens
tgtttgtccttgcacctgagcct

SEQ ID NO: 5654812 - DNA, 22 bp, Homo sapiens
tgtttgtctcacttttcatctg

SEQ ID NO: 5654813 - DNA, 16 bp, Homo sapiens
tgtttgtctctccttt

SEQ ID NO: 5654814 - DNA, 17 bp, Homo sapiens
tgtttgtctctcctttt

SEQ ID NO: 5654815 - DNA, 14 bp, Homo sapiens
tgtttgtctgatgt

SEQ ID NO: 5654816 - DNA, 14 bp, Homo sapiens
tgtttgtgagaagc

SEQ ID NO: 5654817 - DNA, 16 bp, Homo sapiens
tgtttgtgagaagctt

SEQ ID NO: 5654818 - DNA, 13 bp, Homo sapiens
tgtttgtgcttct

SEQ ID NO: 5654819 - DNA, 18 bp, Homo sapiens
tgtttgtggaatggattt

SEQ ID NO: 5654820 - DNA, 12 bp, Homo sapiens
tgtttgtggcct

SEQ ID NO: 5654821 - DNA, 22 bp, Homo sapiens
tgtttgtgggtatttcttggca

SEQ ID NO: 5654822 - DNA, 17 bp, Homo sapiens
tgtttgtgtaataagat

SEQ ID NO: 5654823 - DNA, 14 bp, Homo sapiens
tgtttgtgtattta

SEQ ID NO: 5654824 - DNA, 14 bp, Homo sapiens
tgtttgtgtgagag

SEQ ID NO: 5654825 - DNA, 16 bp, Homo sapiens
tgtttgtgtgcatgaa

SEQ ID NO: 5654826 - DNA, 20 bp, Homo sapiens
tgtttgtgtgcatgaaagag

SEQ ID NO: 5654827 - DNA, 17 bp, Homo sapiens
tgtttgtgtttatgaaa

SEQ ID NO: 5654828 - DNA, 14 bp, Homo sapiens
tgtttgttactgca

SEQ ID NO: 5654829 - DNA, 19 bp, Homo sapiens
tgtttgttatttacactgg

SEQ ID NO: 5654830 - DNA, 15 bp, Homo sapiens
tgtttgttcacactc

SEQ ID NO: 5654831 - DNA, 18 bp, Homo sapiens
tgtttgttcccattggat

SEQ ID NO: 5654832 - DNA, 14 bp, Homo sapiens
tgtttgttctgttt

SEQ ID NO: 5654833 - DNA, 14 bp, Homo sapiens
tgtttgttcttgtt

SEQ ID NO: 5654834 - DNA, 16 bp, Homo sapiens
tgtttgttgtcagctg

SEQ ID NO: 5654835 - DNA, 17 bp, Homo sapiens
tgtttgttgtcagctga

SEQ ID NO: 5654836 - DNA, 14 bp, Homo sapiens
tgtttgtttcagtg

SEQ ID NO: 5654837 - DNA, 13 bp, Homo sapiens
tgtttgtttgtct

SEQ ID NO: 5654838 - DNA, 14 bp, Homo sapiens
tgtttgttttcaaa

SEQ ID NO: 5654839 - DNA, 15 bp, Homo sapiens
tgtttgttttggatt

SEQ ID NO: 5654840 - DNA, 15 bp, Homo sapiens
tgttttaaaaaaact

SEQ ID NO: 5654841 - DNA, 19 bp, Homo sapiens
tgttttaaaaaaactgaag

SEQ ID NO: 5654842 - DNA, 12 bp, Homo sapiens
tgttttaaaaag

SEQ ID NO: 5654843 - DNA, 18 bp, Homo sapiens
tgttttaaaaaggaactg

SEQ ID NO: 5654844 - DNA, 22 bp, Homo sapiens
tgttttaaaacgtgtaaatgaa

SEQ ID NO: 5654845 - DNA, 20 bp, Homo sapiens
tgttttaaaagtttgtcctt

SEQ ID NO: 5654846 - DNA, 17 bp, Homo sapiens
tgttttaaaataaggat

SEQ ID NO: 5654847 - DNA, 13 bp, Homo sapiens
tgttttaaaatta

SEQ ID NO: 5654848 - DNA, 20 bp, Homo sapiens
tgttttaaacatagaaagtt

SEQ ID NO: 5654849 - DNA, 21 bp, Homo sapiens
tgttttaaactctcctagtca

SEQ ID NO: 5654850 - DNA, 19 bp, Homo sapiens
tgttttaaagaatatgact

SEQ ID NO: 5654851 - DNA, 22 bp, Homo sapiens
tgttttaaagaatatgactttt

SEQ ID NO: 5654852 - DNA, 21 bp, Homo sapiens
tgttttaaagtcagatttgta

SEQ ID NO: 5654853 - DNA, 12 bp, Homo sapiens
tgttttaaattc

SEQ ID NO: 5654854 - DNA, 22 bp, Homo sapiens
tgttttaaattctgagacatgt

SEQ ID NO: 5654855 - DNA, 18 bp, Homo sapiens
tgttttaaatttaaaaca

SEQ ID NO: 5654856 - DNA, 15 bp, Homo sapiens
tgttttaacaaaaaa

SEQ ID NO: 5654857 - DNA, 15 bp, Homo sapiens
tgttttaacaccaac

SEQ ID NO: 5654858 - DNA, 13 bp, Homo sapiens
tgttttaacttat

SEQ ID NO: 5654859 - DNA, 18 bp, Homo sapiens
tgttttaacttatttata

SEQ ID NO: 5654860 - DNA, 21 bp, Homo sapiens
tgttttaacttatttatatga

SEQ ID NO: 5654861 - DNA, 23 bp, Homo sapiens
tgttttaacttatttatatgaag

SEQ ID NO: 5654862 - DNA, 15 bp, Homo sapiens
tgttttaagaaatgt

SEQ ID NO: 5654863 - DNA, 16 bp, Homo sapiens
tgttttaagaaatgta

SEQ ID NO: 5654864 - DNA, 17 bp, Homo sapiens
tgttttaagaggcaggg

SEQ ID NO: 5654865 - DNA, 22 bp, Homo sapiens
tgttttaagaggcagggtctca

SEQ ID NO: 5654866 - DNA, 13 bp, Homo sapiens
tgttttaagcaaa

SEQ ID NO: 5654867 - DNA, 17 bp, Homo sapiens
tgttttaagcagctcta

SEQ ID NO: 5654868 - DNA, 19 bp, Homo sapiens
tgttttaaggatgcttgta

SEQ ID NO: 5654869 - DNA, 16 bp, Homo sapiens
tgttttaataacttat

SEQ ID NO: 5654870 - DNA, 23 bp, Homo sapiens
tgttttaatatcaactctcactc

SEQ ID NO: 5654871 - DNA, 15 bp, Homo sapiens
tgttttaatctactt

SEQ ID NO: 5654872 - DNA, 14 bp, Homo sapiens
tgttttaatgtaga

SEQ ID NO: 5654873 - DNA, 14 bp, Homo sapiens
tgttttaattccat

SEQ ID NO: 5654874 - DNA, 18 bp, Homo sapiens
tgttttaattgtagttct

SEQ ID NO: 5654875 - DNA, 14 bp, Homo sapiens
tgttttaattttag

SEQ ID NO: 5654876 - DNA, 22 bp, Homo sapiens
tgttttacaaagaaacaaaata

SEQ ID NO: 5654877 - DNA, 23 bp, Homo sapiens
tgttttacaaatttttcctgcaa

SEQ ID NO: 5654878 - DNA, 20 bp, Homo sapiens
tgttttacaagttggagtca

SEQ ID NO: 5654879 - DNA, 21 bp, Homo sapiens
tgttttacaatagttctgtgg

SEQ ID NO: 5654880 - DNA, 18 bp, Homo sapiens
tgttttacagtatatctt

SEQ ID NO: 5654881 - DNA, 14 bp, Homo sapiens
tgttttaccagctc

SEQ ID NO: 5654882 - DNA, 16 bp, Homo sapiens
tgttttactgtcagat

SEQ ID NO: 5654883 - DNA, 19 bp, Homo sapiens
tgttttactgtcagattaa

SEQ ID NO: 5654884 - DNA, 13 bp, Homo sapiens
tgttttagaaatt

SEQ ID NO: 5654885 - DNA, 20 bp, Homo sapiens
tgttttagaagattctatgt

SEQ ID NO: 5654886 - DNA, 22 bp, Homo sapiens
tgttttagaagattctatgtta

SEQ ID NO: 5654887 - DNA, 24 bp, Homo sapiens
tgttttagaatgatgcacatttca

SEQ ID NO: 5654888 - DNA, 17 bp, Homo sapiens
tgttttagagataaata

SEQ ID NO: 5654889 - DNA, 19 bp, Homo sapiens
tgttttagagttaacaatg

SEQ ID NO: 5654890 - DNA, 21 bp, Homo sapiens
tgttttagatccaaatgtaaa

SEQ ID NO: 5654891 - DNA, 22 bp, Homo sapiens
tgttttagatgttactacctta

SEQ ID NO: 5654892 - DNA, 13 bp, Homo sapiens
tgttttagcattt

SEQ ID NO: 5654893 - DNA, 17 bp, Homo sapiens
tgttttagcatttgtat

SEQ ID NO: 5654894 - DNA, 17 bp, Homo sapiens
tgttttagtgtaaaatt

SEQ ID NO: 5654895 - DNA, 16 bp, Homo sapiens
tgttttagttaaattt

SEQ ID NO: 5654896 - DNA, 14 bp, Homo sapiens
tgttttagttcttg

SEQ ID NO: 5654897 - DNA, 21 bp, Homo sapiens
tgttttagtttctgaactctg

SEQ ID NO: 5654898 - DNA, 19 bp, Homo sapiens
tgttttataaaattttgct

SEQ ID NO: 5654899 - DNA, 13 bp, Homo sapiens
tgttttataattt

SEQ ID NO: 5654900 - DNA, 14 bp, Homo sapiens
tgttttatagtatt

SEQ ID NO: 5654901 - DNA, 22 bp, Homo sapiens
tgttttatagtattaagtgaaa

SEQ ID NO: 5654902 - DNA, 21 bp, Homo sapiens
tgttttatatagcaagacatt

SEQ ID NO: 5654903 - DNA, 14 bp, Homo sapiens
tgttttatatatta

SEQ ID NO: 5654904 - DNA, 19 bp, Homo sapiens
tgttttatatattatgtga

SEQ ID NO: 5654905 - DNA, 15 bp, Homo sapiens
tgttttatatcaaat

SEQ ID NO: 5654906 - DNA, 21 bp, Homo sapiens
tgttttatccttacaatgtga

SEQ ID NO: 5654907 - DNA, 23 bp, Homo sapiens
tgttttatctagtcacataaatg

SEQ ID NO: 5654908 - DNA, 19 bp, Homo sapiens
tgttttattactgtttcta

SEQ ID NO: 5654909 - DNA, 23 bp, Homo sapiens
tgttttattatttctattaaata

SEQ ID NO: 5654910 - DNA, 22 bp, Homo sapiens
tgttttattcacttgtgtttgt

SEQ ID NO: 5654911 - DNA, 15 bp, Homo sapiens
tgttttattcctgta

SEQ ID NO: 5654912 - DNA, 21 bp, Homo sapiens
tgttttattgagttctgaagg

SEQ ID NO: 5654913 - DNA, 13 bp, Homo sapiens
tgttttatttaaa

SEQ ID NO: 5654914 - DNA, 14 bp, Homo sapiens
tgttttatttaaat

SEQ ID NO: 5654915 - DNA, 17 bp, Homo sapiens
tgttttatttaaatgct

SEQ ID NO: 5654916 - DNA, 15 bp, Homo sapiens
tgttttatttatcaa

SEQ ID NO: 5654917 - DNA, 17 bp, Homo sapiens
tgttttatttatcaaaa

SEQ ID NO: 5654918 - DNA, 14 bp, Homo sapiens
tgttttatttccta

SEQ ID NO: 5654919 - DNA, 22 bp, Homo sapiens
tgttttattttcaaatctggtc

SEQ ID NO: 5654920 - DNA, 12 bp, Homo sapiens
tgttttcaaaat

SEQ ID NO: 5654921 - DNA, 22 bp, Homo sapiens
tgttttcaaaccagtatacaag

SEQ ID NO: 5654922 - DNA, 12 bp, Homo sapiens
tgttttcaaatg

SEQ ID NO: 5654923 - DNA, 14 bp, Homo sapiens
tgttttcaaatgtt

SEQ ID NO: 5654924 - DNA, 14 bp, Homo sapiens
tgttttcaagatgg

SEQ ID NO: 5654925 - DNA, 12 bp, Homo sapiens
tgttttcaagga

SEQ ID NO: 5654926 - DNA, 19 bp, Homo sapiens
tgttttcaagtgtaaatga

SEQ ID NO: 5654927 - DNA, 15 bp, Homo sapiens
tgttttcaagttgca

SEQ ID NO: 5654928 - DNA, 11 bp, Homo sapiens
tgttttcaata

SEQ ID NO: 5654929 - DNA, 22 bp, Homo sapiens
tgttttcaataacaaagcacat

SEQ ID NO: 5654930 - DNA, 21 bp, Homo sapiens
tgttttcaatgaattaagaaa

SEQ ID NO: 5654931 - DNA, 12 bp, Homo sapiens
tgttttcacact

SEQ ID NO: 5654932 - DNA, 14 bp, Homo sapiens
tgttttcacttgta

SEQ ID NO: 5654933 - DNA, 17 bp, Homo sapiens
tgttttcacttgtattg

SEQ ID NO: 5654934 - DNA, 21 bp, Homo sapiens
tgttttcacttgtattgactt

SEQ ID NO: 5654935 - DNA, 15 bp, Homo sapiens
tgttttcagactcag

SEQ ID NO: 5654936 - DNA, 13 bp, Homo sapiens
tgttttcatcatt

SEQ ID NO: 5654937 - DNA, 18 bp, Homo sapiens
tgttttcatcatttcagc

SEQ ID NO: 5654938 - DNA, 16 bp, Homo sapiens
tgttttcattaaagag

SEQ ID NO: 5654939 - DNA, 22 bp, Homo sapiens
tgttttcattaaattagctatt

SEQ ID NO: 5654940 - DNA, 18 bp, Homo sapiens
tgttttcattatgttcat

SEQ ID NO: 5654941 - DNA, 19 bp, Homo sapiens
tgttttcattatgttcatg

SEQ ID NO: 5654942 - DNA, 18 bp, Homo sapiens
tgttttccacataaattt

SEQ ID NO: 5654943 - DNA, 14 bp, Homo sapiens
tgttttccagcctt

SEQ ID NO: 5654944 - DNA, 17 bp, Homo sapiens
tgttttccagctcctca

SEQ ID NO: 5654945 - DNA, 20 bp, Homo sapiens
tgttttccatttgggcacat

SEQ ID NO: 5654946 - DNA, 16 bp, Homo sapiens
ttaaagtttaaagttg

SEQ ID NO: 5654947 - DNA, 18 bp, Homo sapiens
ttaaagtttaaagttgca

SEQ ID NO: 5654948 - DNA, 19 bp, Homo sapiens
ttaaagtttaaataccagt

SEQ ID NO: 5654949 - DNA, 19 bp, Homo sapiens
ttaaagtttaagtgtgcag

SEQ ID NO: 5654950 - DNA, 16 bp, Homo sapiens
ttaaagtttcaaaaat

SEQ ID NO: 5654951 - DNA, 19 bp, Homo sapiens
ttaaagtttcaaaaatctg

SEQ ID NO: 5654952 - DNA, 19 bp, Homo sapiens
ttaaagttttcaaattatt

SEQ ID NO: 5654953 - DNA, 15 bp, Homo sapiens
ttaaataaaaataat

SEQ ID NO: 5654954 - DNA, 13 bp, Homo sapiens
ttaaataaaacta

SEQ ID NO: 5654955 - DNA, 17 bp, Homo sapiens
ttaaataaaactttcca

SEQ ID NO: 5654956 - DNA, 21 bp, Homo sapiens
ttaaataaaactttccaaata

SEQ ID NO: 5654957 - DNA, 13 bp, Homo sapiens
ttaaataaaagaa

SEQ ID NO: 5654958 - DNA, 19 bp, Homo sapiens
ttaaataaaagcacaagta

SEQ ID NO: 5654959 - DNA, 13 bp, Homo sapiens
ttaaataaaagct

SEQ ID NO: 5654960 - DNA, 20 bp, Homo sapiens
ttaaataaaatttttatgta

SEQ ID NO: 5654961 - DNA, 13 bp, Homo sapiens
ttaaataaacaca

SEQ ID NO: 5654962 - DNA, 12 bp, Homo sapiens
ttaaataaactt

SEQ ID NO: 5654963 - DNA, 19 bp, Homo sapiens
ttaaataaagtatcatgca

SEQ ID NO: 5654964 - DNA, 16 bp, Homo sapiens
ttaaataaagtttgga

SEQ ID NO: 5654965 - DNA, 17 bp, Homo sapiens
ttaaataaatagaaaga

SEQ ID NO: 5654966 - DNA, 15 bp, Homo sapiens
ttaaataaatatttt

SEQ ID NO: 5654967 - DNA, 20 bp, Homo sapiens
ttaaataaatcaagaatcat

SEQ ID NO: 5654968 - DNA, 13 bp, Homo sapiens
ttaaataaatcat

SEQ ID NO: 5654969 - DNA, 15 bp, Homo sapiens
ttaaataaatcataa

SEQ ID NO: 5654970 - DNA, 21 bp, Homo sapiens
ttaaataaatccaaaaaaaat

SEQ ID NO: 5654971 - DNA, 15 bp, Homo sapiens
ttaaataaatgaata

SEQ ID NO: 5654972 - DNA, 12 bp, Homo sapiens
ttaaataaatgt

SEQ ID NO: 5654973 - DNA, 20 bp, Homo sapiens
ttaaataaatgtcattaaaa

SEQ ID NO: 5654974 - DNA, 16 bp, Homo sapiens
ttaaataaattcaaac

SEQ ID NO: 5654975 - DNA, 13 bp, Homo sapiens
ttaaataaattgt

SEQ ID NO: 5654976 - DNA, 16 bp, Homo sapiens
ttaaataaatttgact

SEQ ID NO: 5654977 - DNA, 15 bp, Homo sapiens
ttaaataacctctgg

SEQ ID NO: 5654978 - DNA, 16 bp, Homo sapiens
ttaaataaccttcatc

SEQ ID NO: 5654979 - DNA, 16 bp, Homo sapiens
ttaaataagattctaa

SEQ ID NO: 5654980 - DNA, 19 bp, Homo sapiens
ttaaataagcaaataaaca

SEQ ID NO: 5654981 - DNA, 16 bp, Homo sapiens
ttaaataataaagatc

SEQ ID NO: 5654982 - DNA, 17 bp, Homo sapiens
ttaaataataaagtatg

SEQ ID NO: 5654983 - DNA, 15 bp, Homo sapiens
ttaaataatatggct

SEQ ID NO: 5654984 - DNA, 15 bp, Homo sapiens
ttaaataatgtattt

SEQ ID NO: 5654985 - DNA, 16 bp, Homo sapiens
ttaaataatgtattta

SEQ ID NO: 5654986 - DNA, 21 bp, Homo sapiens
ttaaataatgtatttactttt

SEQ ID NO: 5654987 - DNA, 21 bp, Homo sapiens
ttaaataatgtgaaactggat

SEQ ID NO: 5654988 - DNA, 23 bp, Homo sapiens
ttaaataattgcatcagttcatt

SEQ ID NO: 5654989 - DNA, 13 bp, Homo sapiens
ttaaataatttaa

SEQ ID NO: 5654990 - DNA, 12 bp, Homo sapiens
ttaaataatttc

SEQ ID NO: 5654991 - DNA, 14 bp, Homo sapiens
ttaaataattttac

SEQ ID NO: 5654992 - DNA, 16 bp, Homo sapiens
ttaaatacaaaacttc

SEQ ID NO: 5654993 - DNA, 19 bp, Homo sapiens
ttaaatacactgaattgaa

SEQ ID NO: 5654994 - DNA, 10 bp, Homo sapiens
ttaaatacag

SEQ ID NO: 5654995 - DNA, 16 bp, Homo sapiens
ttaaatacagataatt

SEQ ID NO: 5654996 - DNA, 18 bp, Homo sapiens
ttaaatacagataattca

SEQ ID NO: 5654997 - DNA, 15 bp, Homo sapiens
ttaaatacaggaaac

SEQ ID NO: 5654998 - DNA, 13 bp, Homo sapiens
ttaaatacagtct

SEQ ID NO: 5654999 - DNA, 16 bp, Homo sapiens
ttaaatacatatggat

SEQ ID NO: 5655000 - DNA, 13 bp, Homo sapiens
ttaaataccagta

SEQ ID NO: 5655001 - DNA, 19 bp, Homo sapiens
ttaaatacccatcttcatt

SEQ ID NO: 5655002 - DNA, 22 bp, Homo sapiens
ttaaatacctctggcttagaaa

SEQ ID NO: 5655003 - DNA, 19 bp, Homo sapiens
ttaaatacgcactacatgt

SEQ ID NO: 5655004 - DNA, 16 bp, Homo sapiens
ttaaatactgtgcaga

SEQ ID NO: 5655005 - DNA, 19 bp, Homo sapiens
ttaaatactgtgcagaata

SEQ ID NO: 5655006 - DNA, 13 bp, Homo sapiens
ttaaatacttcat

SEQ ID NO: 5655007 - DNA, 19 bp, Homo sapiens
ttaaatagagtatatgcac

SEQ ID NO: 5655008 - DNA, 23 bp, Homo sapiens
ttaaatagataaccaattttcag

SEQ ID NO: 5655009 - DNA, 14 bp, Homo sapiens
ttaaatagatgaca

SEQ ID NO: 5655010 - DNA, 16 bp, Homo sapiens
ttaaatagatgacatt

SEQ ID NO: 5655011 - DNA, 20 bp, Homo sapiens
ttaaatagcatctgctcttc

SEQ ID NO: 5655012 - DNA, 23 bp, Homo sapiens
ttaaatagcatctgctcttctct

SEQ ID NO: 5655013 - DNA, 14 bp, Homo sapiens
ttaaatagctttga

SEQ ID NO: 5655014 - DNA, 20 bp, Homo sapiens
ttaaatagggaaaaaacatg

SEQ ID NO: 5655015 - DNA, 18 bp, Homo sapiens
ttaaatagtaaaaataaa

SEQ ID NO: 5655016 - DNA, 17 bp, Homo sapiens
ttaaatataaaatacat

SEQ ID NO: 5655017 - DNA, 12 bp, Homo sapiens
ttaaatataaag

SEQ ID NO: 5655018 - DNA, 13 bp, Homo sapiens
ttaaatataaata

SEQ ID NO: 5655019 - DNA, 13 bp, Homo sapiens
ttaaatataattc

SEQ ID NO: 5655020 - DNA, 16 bp, Homo sapiens
ttaaatataattctgt

SEQ ID NO: 5655021 - DNA, 16 bp, Homo sapiens
ttaaatatacaacttt

SEQ ID NO: 5655022 - DNA, 13 bp, Homo sapiens
ttaaatatagaat

SEQ ID NO: 5655023 - DNA, 18 bp, Homo sapiens
ttaaatatagattagaaa

SEQ ID NO: 5655024 - DNA, 16 bp, Homo sapiens
ttaaatatataaacaa

SEQ ID NO: 5655025 - DNA, 21 bp, Homo sapiens
ttaaatatatattattctcat

SEQ ID NO: 5655026 - DNA, 23 bp, Homo sapiens
ttaaatatatattattctcattt

SEQ ID NO: 5655027 - DNA, 16 bp, Homo sapiens
ttaaatatatattttg

SEQ ID NO: 5655028 - DNA, 19 bp, Homo sapiens
ttaaatatatgtatgtaaa

SEQ ID NO: 5655029 - DNA, 20 bp, Homo sapiens
ttaaatatatgtatgtaaaa

SEQ ID NO: 5655030 - DNA, 22 bp, Homo sapiens
ttaaatatattttcaaagtaca

SEQ ID NO: 5655031 - DNA, 14 bp, Homo sapiens
ttaaatatcattct

SEQ ID NO: 5655032 - DNA, 16 bp, Homo sapiens
ttaaatatccaggtgt

SEQ ID NO: 5655033 - DNA, 19 bp, Homo sapiens
ttaaatatccatttatctt

SEQ ID NO: 5655034 - DNA, 17 bp, Homo sapiens
ttaaatatctgaacatt

SEQ ID NO: 5655035 - DNA, 21 bp, Homo sapiens
ttaaatatcttttatgtttga

SEQ ID NO: 5655036 - DNA, 17 bp, Homo sapiens
ttaaatatgaacaaaga

SEQ ID NO: 5655037 - DNA, 18 bp, Homo sapiens
ttaaatatgaattctgtt

SEQ ID NO: 5655038 - DNA, 16 bp, Homo sapiens
ttaaatattataatgt

SEQ ID NO: 5655039 - DNA, 17 bp, Homo sapiens
ttaaatattatgctgct

SEQ ID NO: 5655040 - DNA, 21 bp, Homo sapiens
ttaaatattatgctgctttaa

SEQ ID NO: 5655041 - DNA, 23 bp, Homo sapiens
ttaaatattatgctgctttaaca

SEQ ID NO: 5655042 - DNA, 16 bp, Homo sapiens
ttaaatattgtatttg

SEQ ID NO: 5655043 - DNA, 14 bp, Homo sapiens
ttaaatatttacat

SEQ ID NO: 5655044 - DNA, 15 bp, Homo sapiens
ttaaatatttcaaga

SEQ ID NO: 5655045 - DNA, 16 bp, Homo sapiens
ttaaatatttcttaag

SEQ ID NO: 5655046 - DNA, 16 bp, Homo sapiens
ttaaatatttgaaaat

SEQ ID NO: 5655047 - DNA, 12 bp, Homo sapiens
ttaaatatttgt

SEQ ID NO: 5655048 - DNA, 14 bp, Homo sapiens
ttaaatatttgtga

SEQ ID NO: 5655049 - DNA, 14 bp, Homo sapiens
ttaaatattttcca

SEQ ID NO: 5655050 - DNA, 22 bp, Homo sapiens
ttaaatattttctattttaaga

SEQ ID NO: 5655051 - DNA, 20 bp, Homo sapiens
ttaaatattttgacttgttg

SEQ ID NO: 5655052 - DNA, 19 bp, Homo sapiens
ttaaatattttgctaactg

SEQ ID NO: 5655053 - DNA, 23 bp, Homo sapiens
ttaaatattttttaaaaccataa

SEQ ID NO: 5655054 - DNA, 12 bp, Homo sapiens
ttaaatcaaaaa

SEQ ID NO: 5655055 - DNA, 16 bp, Homo sapiens
ttaaatcaaaaacttt

SEQ ID NO: 5655056 - DNA, 14 bp, Homo sapiens
ttaaatcaaaagct

SEQ ID NO: 5655057 - DNA, 23 bp, Homo sapiens
ttaaatcaaaagctgcttgacta

SEQ ID NO: 5655058 - DNA, 14 bp, Homo sapiens
ttaaatcaaagata

SEQ ID NO: 5655059 - DNA, 11 bp, Homo sapiens
ttaaatcactg

SEQ ID NO: 5655060 - DNA, 20 bp, Homo sapiens
ttaaatcagttttgtgtaca

SEQ ID NO: 5655061 - DNA, 15 bp, Homo sapiens
ttaaatcatgtatgt

SEQ ID NO: 5655062 - DNA, 16 bp, Homo sapiens
ttaaatcatgtatgtt

SEQ ID NO: 5655063 - DNA, 21 bp, Homo sapiens
ttaaatcatgtatgttatgat

SEQ ID NO: 5655064 - DNA, 18 bp, Homo sapiens
ttaaatcattttaggaaa

SEQ ID NO: 5655065 - DNA, 19 bp, Homo sapiens
ttaaatcattttcattaaa

SEQ ID NO: 5655066 - DNA, 16 bp, Homo sapiens
ttaaatcctaccaaag

SEQ ID NO: 5655067 - DNA, 12 bp, Homo sapiens
ttaaatcctgtt

SEQ ID NO: 5655068 - DNA, 18 bp, Homo sapiens
ttaaatcgtttaatgttt

SEQ ID NO: 5655069 - DNA, 19 bp, Homo sapiens
ttaaatcgtttaatgttta

SEQ ID NO: 5655070 - DNA, 20 bp, Homo sapiens
ttaaatctaaacaaaaaata

SEQ ID NO: 5655071 - DNA, 18 bp, Homo sapiens
ttaaatctcaaatttatt

SEQ ID NO: 5655072 - DNA, 16 bp, Homo sapiens
ttaaatctcattgctt

SEQ ID NO: 5655073 - DNA, 13 bp, Homo sapiens
ttaaatctgaatt

SEQ ID NO: 5655074 - DNA, 20 bp, Homo sapiens
ttaaatctgacagtctcaaa

SEQ ID NO: 5655075 - DNA, 14 bp, Homo sapiens
ttaaatctgcttta

SEQ ID NO: 5655076 - DNA, 18 bp, Homo sapiens
ttaaatctgtttttctaa

SEQ ID NO: 5655077 - DNA, 14 bp, Homo sapiens
ttaaatcttaatgt

SEQ ID NO: 5655078 - DNA, 15 bp, Homo sapiens
ttaaatcttaatgtt

SEQ ID NO: 5655079 - DNA, 19 bp, Homo sapiens
ttaaatcttgaccaacaga

SEQ ID NO: 5655080 - DNA, 15 bp, Homo sapiens
ttaaatctttcttca

SEQ ID NO: 5655081 - DNA, 17 bp, Homo sapiens
ttaaatctttgttaaaa

SEQ ID NO: 5655082 - DNA, 15 bp, Homo sapiens
ttaaatgaaaaaaga

SEQ ID NO: 5655083 - DNA, 12 bp, Homo sapiens
ttaaatgaaaga

SEQ ID NO: 5655084 - DNA, 16 bp, Homo sapiens
ttaaatgaaagaaaat

SEQ ID NO: 5655085 - DNA, 23 bp, Homo sapiens
ttaaatgaaattgtaaaacctgt

SEQ ID NO: 5655086 - DNA, 14 bp, Homo sapiens
ttaaatgaacaaga

SEQ ID NO: 5655087 - DNA, 18 bp, Homo sapiens
ttaaatgaacaagagaag

SEQ ID NO: 5655088 - DNA, 20 bp, Homo sapiens
ttaaatgaacaagagaagca

SEQ ID NO: 5655089 - DNA, 22 bp, Homo sapiens
ttaaatgaacacagctctttaa

SEQ ID NO: 5655090 - DNA, 20 bp, Homo sapiens
ttaaatgaagatacagtgga

SEQ ID NO: 5655091 - DNA, 13 bp, Homo sapiens
ttaaatgacagta

SEQ ID NO: 5655092 - DNA, 17 bp, Homo sapiens
ttaaatgacttttctta

SEQ ID NO: 5655093 - DNA, 22 bp, Homo sapiens
ttaaatgagaaaggatttcctt

SEQ ID NO: 5655094 - DNA, 20 bp, Homo sapiens
ttaaatgagcttaatgtctt

SEQ ID NO: 5655095 - DNA, 15 bp, Homo sapiens
ttaaatgagttactt

SEQ ID NO: 5655096 - DNA, 12 bp, Homo sapiens
ttaaatgattcc

SEQ ID NO: 5655097 - DNA, 16 bp, Homo sapiens
ttaaatgattccaaat

SEQ ID NO: 5655098 - DNA, 22 bp, Homo sapiens
ttaaatgcaaccagaattgtcc

SEQ ID NO: 5655099 - DNA, 22 bp, Homo sapiens
ttaaatgcacagttctatttgc

SEQ ID NO: 5655100 - DNA, 15 bp, Homo sapiens
ttaaatgcatgtctt

SEQ ID NO: 5655101 - DNA, 17 bp, Homo sapiens
ttaaatgcatgtcttaa

SEQ ID NO: 5655102 - DNA, 22 bp, Homo sapiens
ttaaatgcatgtcttaaatgct

SEQ ID NO: 5655103 - DNA, 18 bp, Homo sapiens
ttaaatgccaaaatgtac

SEQ ID NO: 5655104 - DNA, 13 bp, Homo sapiens
ttaaatgcccagc

SEQ ID NO: 5655105 - DNA, 14 bp, Homo sapiens
ttaaatgccttgta

SEQ ID NO: 5655106 - DNA, 16 bp, Homo sapiens
ttaaatgccttgtata

SEQ ID NO: 5655107 - DNA, 13 bp, Homo sapiens
ttaaatgctgtat

SEQ ID NO: 5655108 - DNA, 15 bp, Homo sapiens
ttaaatgctgtgtac

SEQ ID NO: 5655109 - DNA, 18 bp, Homo sapiens
ttaaatgcttattttaaa

SEQ ID NO: 5655110 - DNA, 12 bp, Homo sapiens
ttaaatgctttg

SEQ ID NO: 5655111 - DNA, 20 bp, Homo sapiens
ttaaatggaaaaaatgatgt

SEQ ID NO: 5655112 - DNA, 22 bp, Homo sapiens
ttaaatggaataattagcttgt

SEQ ID NO: 5655113 - DNA, 15 bp, Homo sapiens
ttaaatggcacctgt

SEQ ID NO: 5655114 - DNA, 16 bp, Homo sapiens
ttaaatggcagtattt

SEQ ID NO: 5655115 - DNA, 21 bp, Homo sapiens
ttaaatgggaatatttataaa

SEQ ID NO: 5655116 - DNA, 22 bp, Homo sapiens
ttaaatggtaataagcactgta

SEQ ID NO: 5655117 - DNA, 14 bp, Homo sapiens
ttaaatgtaaaatt

SEQ ID NO: 5655118 - DNA, 18 bp, Homo sapiens
ttaaatgtaaagacaaaa

SEQ ID NO: 5655119 - DNA, 15 bp, Homo sapiens
ttaaatgtaatataa

SEQ ID NO: 5655120 - DNA, 19 bp, Homo sapiens
ttaaatgtacagacatatt

SEQ ID NO: 5655121 - DNA, 21 bp, Homo sapiens
ttaaatgtacagacatattta

SEQ ID NO: 5655122 - DNA, 21 bp, Homo sapiens
ttaaatgtagcttcagtcatt

SEQ ID NO: 5655123 - DNA, 19 bp, Homo sapiens
ttaaatgtatactatagta

SEQ ID NO: 5655124 - DNA, 20 bp, Homo sapiens
ttaaatgtcaaatgtgaatt

SEQ ID NO: 5655125 - DNA, 20 bp, Homo sapiens
ttaagcatttgtatattaaa

SEQ ID NO: 5655126 - DNA, 22 bp, Homo sapiens
ttaagcattttactgtctgtaa

SEQ ID NO: 5655127 - DNA, 20 bp, Homo sapiens
ttaagccaaagaaacaagct

SEQ ID NO: 5655128 - DNA, 23 bp, Homo sapiens
ttaagccaaagaaacaagctgtg

SEQ ID NO: 5655129 - DNA, 17 bp, Homo sapiens
ttaagccaataaataat

SEQ ID NO: 5655130 - DNA, 16 bp, Homo sapiens
ttaagccactgcctct

SEQ ID NO: 5655131 - DNA, 20 bp, Homo sapiens
ttaagccactgcctctccct

SEQ ID NO: 5655132 - DNA, 19 bp, Homo sapiens
ttaagcccacagtatattt

SEQ ID NO: 5655133 - DNA, 20 bp, Homo sapiens
ttaagcccagtgcactgaaa

SEQ ID NO: 5655134 - DNA, 21 bp, Homo sapiens
ttaagccccaacatgttcaga

SEQ ID NO: 5655135 - DNA, 15 bp, Homo sapiens
ttaagcctaaagatt

SEQ ID NO: 5655136 - DNA, 16 bp, Homo sapiens
ttaagcctaaagattt

SEQ ID NO: 5655137 - DNA, 19 bp, Homo sapiens
ttaagcctcaaatttgaac

SEQ ID NO: 5655138 - DNA, 21 bp, Homo sapiens
ttaagcctgtaattatgtaac

SEQ ID NO: 5655139 - DNA, 16 bp, Homo sapiens
ttaagccttcatttgc

SEQ ID NO: 5655140 - DNA, 17 bp, Homo sapiens
ttaagcctttgaagtgc

SEQ ID NO: 5655141 - DNA, 16 bp, Homo sapiens
ttaagctaaaatgtta

SEQ ID NO: 5655142 - DNA, 23 bp, Homo sapiens
ttaagctaatggtcctgttatgt

SEQ ID NO: 5655143 - DNA, 15 bp, Homo sapiens
ttaagctccagcttt

SEQ ID NO: 5655144 - DNA, 18 bp, Homo sapiens
ttaagctccatgtgcata

SEQ ID NO: 5655145 - DNA, 15 bp, Homo sapiens
ttaagctccttcagt

SEQ ID NO: 5655146 - DNA, 15 bp, Homo sapiens
ttaagctctgagctg

SEQ ID NO: 5655147 - DNA, 21 bp, Homo sapiens
ttaagctgttcctgttcagta

SEQ ID NO: 5655148 - DNA, 23 bp, Homo sapiens
ttaagcttaaaaaagaaagattt

SEQ ID NO: 5655149 - DNA, 15 bp, Homo sapiens
ttaagcttgaagatt

SEQ ID NO: 5655150 - DNA, 16 bp, Homo sapiens
ttaagctttaaatgac

SEQ ID NO: 5655151 - DNA, 20 bp, Homo sapiens
ttaagctttaaatgacagta

SEQ ID NO: 5655152 - DNA, 23 bp, Homo sapiens
ttaagctttaaatgacagtaata

SEQ ID NO: 5655153 - DNA, 18 bp, Homo sapiens
ttaagctttattgtgatt

SEQ ID NO: 5655154 - DNA, 15 bp, Homo sapiens
ttaagcttttatttc

SEQ ID NO: 5655155 - DNA, 13 bp, Homo sapiens
ttaagctttttgg

SEQ ID NO: 5655156 - DNA, 16 bp, Homo sapiens
ttaagctttttggaat

SEQ ID NO: 5655157 - DNA, 16 bp, Homo sapiens
ttaaggaaaaaaaacg

SEQ ID NO: 5655158 - DNA, 23 bp, Homo sapiens
ttaaggaaaactacctgtattta

SEQ ID NO: 5655159 - DNA, 15 bp, Homo sapiens
ttaaggaaaagagaa

SEQ ID NO: 5655160 - DNA, 20 bp, Homo sapiens
ttaaggaaaagtaagggaat

SEQ ID NO: 5655161 - DNA, 14 bp, Homo sapiens
ttaaggaaactctt

SEQ ID NO: 5655162 - DNA, 20 bp, Homo sapiens
ttaaggaaactcttatctca

SEQ ID NO: 5655163 - DNA, 21 bp, Homo sapiens
ttaaggaaactttttaattgt

SEQ ID NO: 5655164 - DNA, 22 bp, Homo sapiens
ttaaggacaaagtgccaaagaa

SEQ ID NO: 5655165 - DNA, 20 bp, Homo sapiens
ttaaggacccttttaagcat

SEQ ID NO: 5655166 - DNA, 16 bp, Homo sapiens
ttaaggactacagaat

SEQ ID NO: 5655167 - DNA, 16 bp, Homo sapiens
ttaaggactgactgag

SEQ ID NO: 5655168 - DNA, 18 bp, Homo sapiens
ttaaggactgactgaggc

SEQ ID NO: 5655169 - DNA, 13 bp, Homo sapiens
ttaaggagaaata

SEQ ID NO: 5655170 - DNA, 14 bp, Homo sapiens
ttaaggagaaatag

SEQ ID NO: 5655171 - DNA, 17 bp, Homo sapiens
ttaaggagaatcatgtt

SEQ ID NO: 5655172 - DNA, 14 bp, Homo sapiens
ttaaggagaggaga

SEQ ID NO: 5655173 - DNA, 23 bp, Homo sapiens
ttaaggagatagacgggttgaaa

SEQ ID NO: 5655174 - DNA, 16 bp, Homo sapiens
ttaaggagatggcctc

SEQ ID NO: 5655175 - DNA, 19 bp, Homo sapiens
ttaaggagatgtaagagct

SEQ ID NO: 5655176 - DNA, 14 bp, Homo sapiens
ttaaggagcctaat

SEQ ID NO: 5655177 - DNA, 17 bp, Homo sapiens
ttaaggagggagaaagg

SEQ ID NO: 5655178 - DNA, 20 bp, Homo sapiens
ttaaggaggtagctcccagc

SEQ ID NO: 5655179 - DNA, 14 bp, Homo sapiens
ttaaggataaatca

SEQ ID NO: 5655180 - DNA, 22 bp, Homo sapiens
ttaaggataaatcataaagtca

SEQ ID NO: 5655181 - DNA, 21 bp, Homo sapiens
ttaaggatcaccccagccccc

SEQ ID NO: 5655182 - DNA, 18 bp, Homo sapiens
ttaaggatgcttgtacat

SEQ ID NO: 5655183 - DNA, 20 bp, Homo sapiens
ttaaggatgcttgtacataa

SEQ ID NO: 5655184 - DNA, 19 bp, Homo sapiens
ttaaggatggatggcaccc

SEQ ID NO: 5655185 - DNA, 20 bp, Homo sapiens
ttaaggatggatggcaccct

SEQ ID NO: 5655186 - DNA, 18 bp, Homo sapiens
ttaaggatggggttatga

SEQ ID NO: 5655187 - DNA, 23 bp, Homo sapiens
ttaaggatggggttatgaaccct

SEQ ID NO: 5655188 - DNA, 11 bp, Homo sapiens
ttaaggattct

SEQ ID NO: 5655189 - DNA, 18 bp, Homo sapiens
ttaaggattttatgcttt

SEQ ID NO: 5655190 - DNA, 14 bp, Homo sapiens
ttaaggcaaaaaag

SEQ ID NO: 5655191 - DNA, 19 bp, Homo sapiens
ttaaggcaaatcaggtaaa

SEQ ID NO: 5655192 - DNA, 20 bp, Homo sapiens
ttaaggcaactgaacaaaaa

SEQ ID NO: 5655193 - DNA, 15 bp, Homo sapiens
ttaaggcaataaaac

SEQ ID NO: 5655194 - DNA, 14 bp, Homo sapiens
ttaaggcagtgact

SEQ ID NO: 5655195 - DNA, 18 bp, Homo sapiens
ttaaggcatatactttgt

SEQ ID NO: 5655196 - DNA, 13 bp, Homo sapiens
ttaaggcatttgt

SEQ ID NO: 5655197 - DNA, 18 bp, Homo sapiens
ttaaggccctcattctca

SEQ ID NO: 5655198 - DNA, 23 bp, Homo sapiens
ttaaggctgaggaaaggccagct

SEQ ID NO: 5655199 - DNA, 20 bp, Homo sapiens
ttaaggctgtgtgaattttt

SEQ ID NO: 5655200 - DNA, 13 bp, Homo sapiens
ttaagggaaaaat

SEQ ID NO: 5655201 - DNA, 15 bp, Homo sapiens
ttaagggaaagaaaa

SEQ ID NO: 5655202 - DNA, 14 bp, Homo sapiens
ttaagggaatatgc

SEQ ID NO: 5655203 - DNA, 15 bp, Homo sapiens
ttaagggacatttct

SEQ ID NO: 5655204 - DNA, 22 bp, Homo sapiens
ttaagggccacctacaatacat

SEQ ID NO: 5655205 - DNA, 22 bp, Homo sapiens
ttaagggccggggatggatctt

SEQ ID NO: 5655206 - DNA, 14 bp, Homo sapiens
ttaagggcctgctg

SEQ ID NO: 5655207 - DNA, 15 bp, Homo sapiens
ttaagggggaaaact

SEQ ID NO: 5655208 - DNA, 23 bp, Homo sapiens
ttaaggggggcagggagtgatga

SEQ ID NO: 5655209 - DNA, 19 bp, Homo sapiens
ttaagggggtgtaatgaaa

SEQ ID NO: 5655210 - DNA, 18 bp, Homo sapiens
ttaaggggtatcatgtat

SEQ ID NO: 5655211 - DNA, 13 bp, Homo sapiens
ttaagggtatgat

SEQ ID NO: 5655212 - DNA, 18 bp, Homo sapiens
ttaaggtaactactgcta

SEQ ID NO: 5655213 - DNA, 23 bp, Homo sapiens
ttaaggtacactgtttccatgtt

SEQ ID NO: 5655214 - DNA, 20 bp, Homo sapiens
ttaaggtatatttagttgca

SEQ ID NO: 5655215 - DNA, 22 bp, Homo sapiens
ttaaggtcaaactaattctcac

SEQ ID NO: 5655216 - DNA, 19 bp, Homo sapiens
ttaaggtccctgctcggcc

SEQ ID NO: 5655217 - DNA, 15 bp, Homo sapiens
ttaaggtcctgcttg

SEQ ID NO: 5655218 - DNA, 21 bp, Homo sapiens
ttaaggtctaactgtggaata

SEQ ID NO: 5655219 - DNA, 16 bp, Homo sapiens
ttaaggtctctctttg

SEQ ID NO: 5655220 - DNA, 17 bp, Homo sapiens
ttaaggtctctctttgg

SEQ ID NO: 5655221 - DNA, 13 bp, Homo sapiens
ttaaggtctgttt

SEQ ID NO: 5655222 - DNA, 13 bp, Homo sapiens
ttaaggtggaaag

SEQ ID NO: 5655223 - DNA, 20 bp, Homo sapiens
ttaaggtggaaagtgttcat

SEQ ID NO: 5655224 - DNA, 21 bp, Homo sapiens
ttaaggtggaaagtgttcatt

SEQ ID NO: 5655225 - DNA, 23 bp, Homo sapiens
ttaaggtgtgcagtgtttttcct

SEQ ID NO: 5655226 - DNA, 14 bp, Homo sapiens
ttaaggtgtttgaa

SEQ ID NO: 5655227 - DNA, 14 bp, Homo sapiens
ttaaggttactcag

SEQ ID NO: 5655228 - DNA, 15 bp, Homo sapiens
ttaaggttatttatt

SEQ ID NO: 5655229 - DNA, 15 bp, Homo sapiens
ttaaggttgaacttt

SEQ ID NO: 5655230 - DNA, 19 bp, Homo sapiens
ttaaggtttgccctgcctg

SEQ ID NO: 5655231 - DNA, 21 bp, Homo sapiens
ttaaggtttgccctgcctgca

SEQ ID NO: 5655232 - DNA, 15 bp, Homo sapiens
ttaagtaaaagtcta

SEQ ID NO: 5655233 - DNA, 11 bp, Homo sapiens
ttaagtaactt

SEQ ID NO: 5655234 - DNA, 23 bp, Homo sapiens
ttaagtaagacttttattaataa

SEQ ID NO: 5655235 - DNA, 21 bp, Homo sapiens
ttaagtaagtaagtttcattc

SEQ ID NO: 5655236 - DNA, 12 bp, Homo sapiens
ttaagtaagttt

SEQ ID NO: 5655237 - DNA, 18 bp, Homo sapiens
ttaagtaatgatactgtg

SEQ ID NO: 5655238 - DNA, 23 bp, Homo sapiens
ttaagtaattgccagcttttata

SEQ ID NO: 5655239 - DNA, 21 bp, Homo sapiens
ttaagtaccaatgggaagcag

SEQ ID NO: 5655240 - DNA, 16 bp, Homo sapiens
ttaagtaccagaagcc

SEQ ID NO: 5655241 - DNA, 15 bp, Homo sapiens
ttaagtacccgaggc

SEQ ID NO: 5655242 - DNA, 21 bp, Homo sapiens
ttaagtagaaaaattgtttcc

SEQ ID NO: 5655243 - DNA, 23 bp, Homo sapiens
ttaagtagaaaaattgtttccaa

SEQ ID NO: 5655244 - DNA, 21 bp, Homo sapiens
ttaagtatacaacaggagaga

SEQ ID NO: 5655245 - DNA, 15 bp, Homo sapiens
ttaagtatatagtat

SEQ ID NO: 5655246 - DNA, 19 bp, Homo sapiens
ttaagtatatagtatattt

SEQ ID NO: 5655247 - DNA, 17 bp, Homo sapiens
ttaagtatatttgtaaa

SEQ ID NO: 5655248 - DNA, 21 bp, Homo sapiens
ttaagtatatttgtaaaagct

SEQ ID NO: 5655249 - DNA, 17 bp, Homo sapiens
ttaagtatctgacatct

SEQ ID NO: 5655250 - DNA, 19 bp, Homo sapiens
ttaagtatcttgtgcttct

SEQ ID NO: 5655251 - DNA, 19 bp, Homo sapiens
ttaagtatcttttttcaaa

SEQ ID NO: 5655252 - DNA, 17 bp, Homo sapiens
ttaagtatgagttatca

SEQ ID NO: 5655253 - DNA, 13 bp, Homo sapiens
ttaagtatggaat

SEQ ID NO: 5655254 - DNA, 20 bp, Homo sapiens
ttaagtatggaatattcatt

SEQ ID NO: 5655255 - DNA, 14 bp, Homo sapiens
ttaagtatgtgtaa

SEQ ID NO: 5655256 - DNA, 13 bp, Homo sapiens
ttaagtattgcat

SEQ ID NO: 5655257 - DNA, 16 bp, Homo sapiens
ttaagtatttatatat

SEQ ID NO: 5655258 - DNA, 17 bp, Homo sapiens
ttaagtatttatatatt

SEQ ID NO: 5655259 - DNA, 21 bp, Homo sapiens
ttaagtcattttgtaatattt

SEQ ID NO: 5655260 - DNA, 19 bp, Homo sapiens
ttaagtcccagtatacctc

SEQ ID NO: 5655261 - DNA, 17 bp, Homo sapiens
ttaagtcccattcagtg

SEQ ID NO: 5655262 - DNA, 20 bp, Homo sapiens
ttaagtccctgtcacctctt

SEQ ID NO: 5655263 - DNA, 20 bp, Homo sapiens
ttaagtcctacttttaaaga

SEQ ID NO: 5655264 - DNA, 17 bp, Homo sapiens
ttaagtcctctcttctc

SEQ ID NO: 5655265 - DNA, 19 bp, Homo sapiens
ttaagtctaaatatttcct

SEQ ID NO: 5655266 - DNA, 17 bp, Homo sapiens
ttaagtctatctggtat

SEQ ID NO: 5655267 - DNA, 20 bp, Homo sapiens
ttaagtctgttttatgactt

SEQ ID NO: 5655268 - DNA, 18 bp, Homo sapiens
ttaagtcttactgttttg

SEQ ID NO: 5655269 - DNA, 17 bp, Homo sapiens
ttaagtctttttgaagt

SEQ ID NO: 5655270 - DNA, 20 bp, Homo sapiens
ttaagtgacacagacatttt

SEQ ID NO: 5655271 - DNA, 16 bp, Homo sapiens
ttaagtgactgagaag

SEQ ID NO: 5655272 - DNA, 18 bp, Homo sapiens
ttaagtgatttaaaaaaa

SEQ ID NO: 5655273 - DNA, 23 bp, Homo sapiens
ttaagtgcaacatttctgtatac

SEQ ID NO: 5655274 - DNA, 22 bp, Homo sapiens
ttaagtgcatgcattgagctgc

SEQ ID NO: 5655275 - DNA, 20 bp, Homo sapiens
ttaagtgccattactactgt

SEQ ID NO: 5655276 - DNA, 22 bp, Homo sapiens
ttaagtgccattactactgtac

SEQ ID NO: 5655277 - DNA, 18 bp, Homo sapiens
ttaagtgcgtgtgtagag

SEQ ID NO: 5655278 - DNA, 21 bp, Homo sapiens
ttaagtgcgtgtgtagagtta

SEQ ID NO: 5655279 - DNA, 17 bp, Homo sapiens
ttaagtgcttacatttt

SEQ ID NO: 5655280 - DNA, 18 bp, Homo sapiens
ttaagtggactctctgac

SEQ ID NO: 5655281 - DNA, 18 bp, Homo sapiens
ttaagtggactgtatttc

SEQ ID NO: 5655282 - DNA, 15 bp, Homo sapiens
ttaagtgggctcctg

SEQ ID NO: 5655283 - DNA, 18 bp, Homo sapiens
ttaagtgggctcctgaca

SEQ ID NO: 5655284 - DNA, 20 bp, Homo sapiens
ttaagtggtcccaatgctca

SEQ ID NO: 5655285 - DNA, 15 bp, Homo sapiens
ttaagtgtaaatgaa

SEQ ID NO: 5655286 - DNA, 17 bp, Homo sapiens
ttaagtgtaaatgaagt

SEQ ID NO: 5655287 - DNA, 23 bp, Homo sapiens
ttaagtgtcagactatccatttt

SEQ ID NO: 5655288 - DNA, 15 bp, Homo sapiens
ttaagtgtcatttct

SEQ ID NO: 5655289 - DNA, 19 bp, Homo sapiens
ttaagtgtgtataaaacat

SEQ ID NO: 5655290 - DNA, 15 bp, Homo sapiens
ttaagtgtgtgtata

SEQ ID NO: 5655291 - DNA, 15 bp, Homo sapiens
ttaagtgttcatttt

SEQ ID NO: 5655292 - DNA, 15 bp, Homo sapiens
ttaagtgttctgtgg

SEQ ID NO: 5655293 - DNA, 20 bp, Homo sapiens
ttaagtgttggaaaaaattt

SEQ ID NO: 5655294 - DNA, 14 bp, Homo sapiens
ttaagtgtttctca

SEQ ID NO: 5655295 - DNA, 15 bp, Homo sapiens
ttaagttaatgaaat

SEQ ID NO: 5655296 - DNA, 16 bp, Homo sapiens
ttaagttaatgaaata

SEQ ID NO: 5655297 - DNA, 20 bp, Homo sapiens
ttaagttacaattacatctc

SEQ ID NO: 5655298 - DNA, 22 bp, Homo sapiens
ttaagttatagtgaatactgct

SEQ ID NO: 5655299 - DNA, 14 bp, Homo sapiens
ttaagttatgtgtg

SEQ ID NO: 5655300 - DNA, 20 bp, Homo sapiens
ttaagttattttacctgttt

SEQ ID NO: 5655301 - DNA, 18 bp, Homo sapiens
ttaatttccttctgttaa

SEQ ID NO: 5655302 - DNA, 13 bp, Homo sapiens
ttaatttctgcca

SEQ ID NO: 5655303 - DNA, 20 bp, Homo sapiens
ttaatttctgccatttcatg

SEQ ID NO: 5655304 - DNA, 15 bp, Homo sapiens
ttaatttcttcaaaa

SEQ ID NO: 5655305 - DNA, 18 bp, Homo sapiens
ttaatttcttcaaaatgt

SEQ ID NO: 5655306 - DNA, 21 bp, Homo sapiens
ttaatttcttcaaaatgtata

SEQ ID NO: 5655307 - DNA, 22 bp, Homo sapiens
ttaatttcttgcaatttgaagg

SEQ ID NO: 5655308 - DNA, 15 bp, Homo sapiens
ttaatttgaaatctg

SEQ ID NO: 5655309 - DNA, 13 bp, Homo sapiens
ttaatttgaccat

SEQ ID NO: 5655310 - DNA, 13 bp, Homo sapiens
ttaatttgactgt

SEQ ID NO: 5655311 - DNA, 21 bp, Homo sapiens
ttaatttgagatcgtccactg

SEQ ID NO: 5655312 - DNA, 22 bp, Homo sapiens
ttaatttgagatcgtccactgt

SEQ ID NO: 5655313 - DNA, 14 bp, Homo sapiens
ttaatttgattaac

SEQ ID NO: 5655314 - DNA, 19 bp, Homo sapiens
ttaatttgattaacaaata

SEQ ID NO: 5655315 - DNA, 13 bp, Homo sapiens
ttaatttgccaaa

SEQ ID NO: 5655316 - DNA, 14 bp, Homo sapiens
ttaatttggaaact

SEQ ID NO: 5655317 - DNA, 20 bp, Homo sapiens
ttaatttggaaactaataaa

SEQ ID NO: 5655318 - DNA, 21 bp, Homo sapiens
ttaatttggaccattttcctg

SEQ ID NO: 5655319 - DNA, 22 bp, Homo sapiens
ttaatttggataataaaaattg

SEQ ID NO: 5655320 - DNA, 20 bp, Homo sapiens
ttaatttggtagatgacaaa

SEQ ID NO: 5655321 - DNA, 16 bp, Homo sapiens
ttaatttggttttcac

SEQ ID NO: 5655322 - DNA, 21 bp, Homo sapiens
ttaatttgtaaacttctgaag

SEQ ID NO: 5655323 - DNA, 15 bp, Homo sapiens
ttaatttgtattgaa

SEQ ID NO: 5655324 - DNA, 12 bp, Homo sapiens
ttaatttgttgt

SEQ ID NO: 5655325 - DNA, 14 bp, Homo sapiens
ttaatttgttgtag

SEQ ID NO: 5655326 - DNA, 12 bp, Homo sapiens
ttaattttaaag

SEQ ID NO: 5655327 - DNA, 17 bp, Homo sapiens
ttaattttaaagagtgt

SEQ ID NO: 5655328 - DNA, 13 bp, Homo sapiens
ttaattttaagaa

SEQ ID NO: 5655329 - DNA, 11 bp, Homo sapiens
ttaattttacc

SEQ ID NO: 5655330 - DNA, 17 bp, Homo sapiens
ttaattttagaaagaaa

SEQ ID NO: 5655331 - DNA, 23 bp, Homo sapiens
ttaattttattttttataaaata

SEQ ID NO: 5655332 - DNA, 16 bp, Homo sapiens
ttaattttcacaaaat

SEQ ID NO: 5655333 - DNA, 13 bp, Homo sapiens
ttaattttcagta

SEQ ID NO: 5655334 - DNA, 16 bp, Homo sapiens
ttaattttcagttcta

SEQ ID NO: 5655335 - DNA, 19 bp, Homo sapiens
ttaattttcagttctattt

SEQ ID NO: 5655336 - DNA, 21 bp, Homo sapiens
ttaattttcctctaattaaaa

SEQ ID NO: 5655337 - DNA, 16 bp, Homo sapiens
ttaattttctatgtgt

SEQ ID NO: 5655338 - DNA, 20 bp, Homo sapiens
ttaattttctctttaggaga

SEQ ID NO: 5655339 - DNA, 19 bp, Homo sapiens
ttaattttctttatggaaa

SEQ ID NO: 5655340 - DNA, 19 bp, Homo sapiens
ttaattttgaagtgctgtt

SEQ ID NO: 5655341 - DNA, 17 bp, Homo sapiens
ttaattttgatatacat

SEQ ID NO: 5655342 - DNA, 21 bp, Homo sapiens
ttaattttgatatacattgtg

SEQ ID NO: 5655343 - DNA, 13 bp, Homo sapiens
ttaattttggaat

SEQ ID NO: 5655344 - DNA, 14 bp, Homo sapiens
ttaattttggaatt

SEQ ID NO: 5655345 - DNA, 15 bp, Homo sapiens
ttaattttggaattt

SEQ ID NO: 5655346 - DNA, 17 bp, Homo sapiens
ttaattttggttgtatt

SEQ ID NO: 5655347 - DNA, 20 bp, Homo sapiens
ttaattttggttgtattctt

SEQ ID NO: 5655348 - DNA, 23 bp, Homo sapiens
ttaattttgtaaaggtgaaaaaa

SEQ ID NO: 5655349 - DNA, 14 bp, Homo sapiens
ttaattttgtattt

SEQ ID NO: 5655350 - DNA, 18 bp, Homo sapiens
ttaattttgtgcattctt

SEQ ID NO: 5655351 - DNA, 22 bp, Homo sapiens
ttaattttgtgcattctttggt

SEQ ID NO: 5655352 - DNA, 23 bp, Homo sapiens
ttaattttgttaagaatttcaat

SEQ ID NO: 5655353 - DNA, 16 bp, Homo sapiens
ttaatttttaaatgca

SEQ ID NO: 5655354 - DNA, 14 bp, Homo sapiens
ttaatttttaagag

SEQ ID NO: 5655355 - DNA, 16 bp, Homo sapiens
ttaatttttataaata

SEQ ID NO: 5655356 - DNA, 19 bp, Homo sapiens
ttaatttttataaatatgt

SEQ ID NO: 5655357 - DNA, 13 bp, Homo sapiens
ttaatttttccaa

SEQ ID NO: 5655358 - DNA, 15 bp, Homo sapiens
ttaatttttccaact

SEQ ID NO: 5655359 - DNA, 12 bp, Homo sapiens
ttaatttttcct

SEQ ID NO: 5655360 - DNA, 18 bp, Homo sapiens
ttaatttttcttagtgtt

SEQ ID NO: 5655361 - DNA, 12 bp, Homo sapiens
ttaatttttgat

SEQ ID NO: 5655362 - DNA, 13 bp, Homo sapiens
ttaatttttgata

SEQ ID NO: 5655363 - DNA, 18 bp, Homo sapiens
ttaattttttctctttgt

SEQ ID NO: 5655364 - DNA, 20 bp, Homo sapiens
ttaattttttggtacaaaaa

SEQ ID NO: 5655365 - DNA, 20 bp, Homo sapiens
ttaatttttttaaatttcag

SEQ ID NO: 5655366 - DNA, 17 bp, Homo sapiens
ttaatttttttaaccaa

SEQ ID NO: 5655367 - DNA, 17 bp, Homo sapiens
ttaattttttttaatgt

SEQ ID NO: 5655368 - DNA, 18 bp, Homo sapiens
ttacaaaaagaaatgtca

SEQ ID NO: 5655369 - DNA, 19 bp, Homo sapiens
ttacaaaaagaaatgtcaa

SEQ ID NO: 5655370 - DNA, 15 bp, Homo sapiens
ttacaaaaagacact

SEQ ID NO: 5655371 - DNA, 21 bp, Homo sapiens
ttacaaaacctatttttcctt

SEQ ID NO: 5655372 - DNA, 17 bp, Homo sapiens
ttacaaaactacatgag

SEQ ID NO: 5655373 - DNA, 21 bp, Homo sapiens
ttacaaaactgctttgtgcat

SEQ ID NO: 5655374 - DNA, 13 bp, Homo sapiens
ttacaaaagatgt

SEQ ID NO: 5655375 - DNA, 14 bp, Homo sapiens
ttacaaaagatgta

SEQ ID NO: 5655376 - DNA, 14 bp, Homo sapiens
ttacaaaatgccaa

SEQ ID NO: 5655377 - DNA, 13 bp, Homo sapiens
ttacaaaatgtaa

SEQ ID NO: 5655378 - DNA, 19 bp, Homo sapiens
ttacaaaatgtaactgtta

SEQ ID NO: 5655379 - DNA, 16 bp, Homo sapiens
ttacaaaatttattct

SEQ ID NO: 5655380 - DNA, 22 bp, Homo sapiens
ttacaaacaagatacgtatatt

SEQ ID NO: 5655381 - DNA, 21 bp, Homo sapiens
ttacaaacaagtggatgtttt

SEQ ID NO: 5655382 - DNA, 22 bp, Homo sapiens
ttacaaacaagtggatgttttt

SEQ ID NO: 5655383 - DNA, 21 bp, Homo sapiens
ttacaaacaataagaacaagt

SEQ ID NO: 5655384 - DNA, 12 bp, Homo sapiens
ttacaaacatgt

SEQ ID NO: 5655385 - DNA, 16 bp, Homo sapiens
ttacaaacctttgttt

SEQ ID NO: 5655386 - DNA, 18 bp, Homo sapiens
ttacaaacctttgtttca

SEQ ID NO: 5655387 - DNA, 16 bp, Homo sapiens
ttacaaagaaaataat

SEQ ID NO: 5655388 - DNA, 21 bp, Homo sapiens
ttacaaagaaacaaaatataa

SEQ ID NO: 5655389 - DNA, 18 bp, Homo sapiens
ttacaaagcccttttata

SEQ ID NO: 5655390 - DNA, 13 bp, Homo sapiens
ttacaaagtgtgt

SEQ ID NO: 5655391 - DNA, 18 bp, Homo sapiens
ttacaaagtgtgtattaa

SEQ ID NO: 5655392 - DNA, 22 bp, Homo sapiens
ttacaaagtgtgtattaaaaaa

SEQ ID NO: 5655393 - DNA, 20 bp, Homo sapiens
ttacaaagttcactgtttat

SEQ ID NO: 5655394 - DNA, 19 bp, Homo sapiens
ttacaaataaacagttgtt

SEQ ID NO: 5655395 - DNA, 21 bp, Homo sapiens
ttacaaatgaagtatttcatg

SEQ ID NO: 5655396 - DNA, 14 bp, Homo sapiens
ttacaaatgattgc

SEQ ID NO: 5655397 - DNA, 20 bp, Homo sapiens
ttacaaatgattgcttttaa

SEQ ID NO: 5655398 - DNA, 17 bp, Homo sapiens
ttacaaatgcaaatttc

SEQ ID NO: 5655399 - DNA, 21 bp, Homo sapiens
ttacaaatgcaaatttctata

SEQ ID NO: 5655400 - DNA, 11 bp, Homo sapiens
ttacaaatgtt

SEQ ID NO: 5655401 - DNA, 18 bp, Homo sapiens
ttacaaatgttaaaatgt

SEQ ID NO: 5655402 - DNA, 19 bp, Homo sapiens
ttacaaatgttaaaatgtg

SEQ ID NO: 5655403 - DNA, 13 bp, Homo sapiens
ttacaaattaata

SEQ ID NO: 5655404 - DNA, 16 bp, Homo sapiens
ttacaaattaatattt

SEQ ID NO: 5655405 - DNA, 17 bp, Homo sapiens
ttacaaattaatatttg

SEQ ID NO: 5655406 - DNA, 23 bp, Homo sapiens
ttacaaattataatgtattcata

SEQ ID NO: 5655407 - DNA, 15 bp, Homo sapiens
ttacaaattcctttc

SEQ ID NO: 5655408 - DNA, 15 bp, Homo sapiens
ttacaaatttaattt

SEQ ID NO: 5655409 - DNA, 16 bp, Homo sapiens
ttacaaatttttactc

SEQ ID NO: 5655410 - DNA, 18 bp, Homo sapiens
ttacaaatttttcctgca

SEQ ID NO: 5655411 - DNA, 20 bp, Homo sapiens
ttacaacaactattttttaa

SEQ ID NO: 5655412 - DNA, 12 bp, Homo sapiens
ttacaacaagca

SEQ ID NO: 5655413 - DNA, 19 bp, Homo sapiens
ttacaacaagcaaactgaa

SEQ ID NO: 5655414 - DNA, 23 bp, Homo sapiens
ttacaacaagcaaactgaaatta

SEQ ID NO: 5655415 - DNA, 14 bp, Homo sapiens
ttacaacactttaa

SEQ ID NO: 5655416 - DNA, 17 bp, Homo sapiens
ttacaacagatttgtga

SEQ ID NO: 5655417 - DNA, 19 bp, Homo sapiens
ttacaacagatttgtgaac

SEQ ID NO: 5655418 - DNA, 18 bp, Homo sapiens
ttacaacagtaacacatc

SEQ ID NO: 5655419 - DNA, 19 bp, Homo sapiens
ttacaacagtaacacatct

SEQ ID NO: 5655420 - DNA, 13 bp, Homo sapiens
ttacaacattaat

SEQ ID NO: 5655421 - DNA, 18 bp, Homo sapiens
ttacaaccattgtatttt

SEQ ID NO: 5655422 - DNA, 13 bp, Homo sapiens
ttacaacctagaa

SEQ ID NO: 5655423 - DNA, 16 bp, Homo sapiens
ttacaacctagaagta

SEQ ID NO: 5655424 - DNA, 19 bp, Homo sapiens
ttacaacggagtcaaaaat

SEQ ID NO: 5655425 - DNA, 20 bp, Homo sapiens
ttacaactaaataacacaga

SEQ ID NO: 5655426 - DNA, 17 bp, Homo sapiens
ttacaactcccccaccg

SEQ ID NO: 5655427 - DNA, 19 bp, Homo sapiens
ttacaactgaccaagtttc

SEQ ID NO: 5655428 - DNA, 23 bp, Homo sapiens
ttacaactgcctcgaaacacaga

SEQ ID NO: 5655429 - DNA, 17 bp, Homo sapiens
ttacaactttctaagag

SEQ ID NO: 5655430 - DNA, 17 bp, Homo sapiens
ttacaagaaaaaatgaa

SEQ ID NO: 5655431 - DNA, 17 bp, Homo sapiens
ttacaagaaataaatct

SEQ ID NO: 5655432 - DNA, 16 bp, Homo sapiens
ttacaagaagaactca

SEQ ID NO: 5655433 - DNA, 13 bp, Homo sapiens
ttacaagaagttt

SEQ ID NO: 5655434 - DNA, 16 bp, Homo sapiens
ttacaagaattgtcca

SEQ ID NO: 5655435 - DNA, 18 bp, Homo sapiens
ttacaagataaaaaacga

SEQ ID NO: 5655436 - DNA, 15 bp, Homo sapiens
ttacaagatattatt

SEQ ID NO: 5655437 - DNA, 13 bp, Homo sapiens
ttacaagatccat

SEQ ID NO: 5655438 - DNA, 21 bp, Homo sapiens
ttacaagatccatttgccttt

SEQ ID NO: 5655439 - DNA, 16 bp, Homo sapiens
ttacaagcattagatt

SEQ ID NO: 5655440 - DNA, 19 bp, Homo sapiens
ttacaagcccccccttcca

SEQ ID NO: 5655441 - DNA, 20 bp, Homo sapiens
ttacaagcccccccttccac

SEQ ID NO: 5655442 - DNA, 20 bp, Homo sapiens
ttacaagcgtgagccactgc

SEQ ID NO: 5655443 - DNA, 18 bp, Homo sapiens
ttacaaggcaatggaaac

SEQ ID NO: 5655444 - DNA, 20 bp, Homo sapiens
ttacaaggcaggcctttcct

SEQ ID NO: 5655445 - DNA, 23 bp, Homo sapiens
ttacaaggcaggcctttcctaca

SEQ ID NO: 5655446 - DNA, 16 bp, Homo sapiens
ttacaagggaagattt

SEQ ID NO: 5655447 - DNA, 21 bp, Homo sapiens
ttacaaggtgttgttaaaaca

SEQ ID NO: 5655448 - DNA, 17 bp, Homo sapiens
ttacaagtaacaaaaat

SEQ ID NO: 5655449 - DNA, 20 bp, Homo sapiens
ttacaagtaacaaaaataaa

SEQ ID NO: 5655450 - DNA, 15 bp, Homo sapiens
ttacaagtaatgaat

SEQ ID NO: 5655451 - DNA, 18 bp, Homo sapiens
ttacaagtaatgaatttt

SEQ ID NO: 5655452 - DNA, 22 bp, Homo sapiens
ttacaagtattcagttccaata

SEQ ID NO: 5655453 - DNA, 14 bp, Homo sapiens
ttacaagtggctcc

SEQ ID NO: 5655454 - DNA, 18 bp, Homo sapiens
ttacaagtggtgaccaaa

SEQ ID NO: 5655455 - DNA, 23 bp, Homo sapiens
ttacaagtggtgaccaaaatttt

SEQ ID NO: 5655456 - DNA, 12 bp, Homo sapiens
ttacaagtgttc

SEQ ID NO: 5655457 - DNA, 23 bp, Homo sapiens
ttacaagtgttcttaggtttact

SEQ ID NO: 5655458 - DNA, 17 bp, Homo sapiens
ttacaagtttatatata

SEQ ID NO: 5655459 - DNA, 19 bp, Homo sapiens
ttacaagtttcagtaatag

SEQ ID NO: 5655460 - DNA, 15 bp, Homo sapiens
ttacaagtttctagc

SEQ ID NO: 5655461 - DNA, 16 bp, Homo sapiens
ttacaagtttctagct

SEQ ID NO: 5655462 - DNA, 14 bp, Homo sapiens
ttacaagtttgcta

SEQ ID NO: 5655463 - DNA, 20 bp, Homo sapiens
ttacaataaaactaaatgtg

SEQ ID NO: 5655464 - DNA, 21 bp, Homo sapiens
ttacaataaaactttgctgcc

SEQ ID NO: 5655465 - DNA, 23 bp, Homo sapiens
ttacaataaaatcttgaaaatgc

SEQ ID NO: 5655466 - DNA, 20 bp, Homo sapiens
ttacaataaaccctccttgg

SEQ ID NO: 5655467 - DNA, 13 bp, Homo sapiens
ttacaataaatat

SEQ ID NO: 5655468 - DNA, 21 bp, Homo sapiens
ttacaatacaaaggttccatt

SEQ ID NO: 5655469 - DNA, 21 bp, Homo sapiens
ttacaataccgttaagataca

SEQ ID NO: 5655470 - DNA, 12 bp, Homo sapiens
ttacaatagaat

SEQ ID NO: 5655471 - DNA, 15 bp, Homo sapiens
ttacaatagttctgt

SEQ ID NO: 5655472 - DNA, 13 bp, Homo sapiens
ttacaatatttgt

SEQ ID NO: 5655473 - DNA, 12 bp, Homo sapiens
ttacaatcaaag

SEQ ID NO: 5655474 - DNA, 17 bp, Homo sapiens
ttacaatcatgcctaca

SEQ ID NO: 5655475 - DNA, 22 bp, Homo sapiens
ttacaatcattgctgaaaatgg

SEQ ID NO: 5655476 - DNA, 23 bp, Homo sapiens
ttacaatcccacctttcctcaaa

SEQ ID NO: 5655477 - DNA, 14 bp, Homo sapiens
ttacaatgatttgt

SEQ ID NO: 5655478 - DNA, 15 bp, Homo sapiens
ttacaatgatttgta

SEQ ID NO: 5655479 - DNA, 17 bp, Homo sapiens
ttacctttttgtatgtg

SEQ ID NO: 5655480 - DNA, 20 bp, Homo sapiens
ttaccttttttatacataaa

SEQ ID NO: 5655481 - DNA, 19 bp, Homo sapiens
ttaccttttttttttcttg

SEQ ID NO: 5655482 - DNA, 19 bp, Homo sapiens
ttacgaagttcaagatcaa

SEQ ID NO: 5655483 - DNA, 16 bp, Homo sapiens
ttacgaatattttcag

SEQ ID NO: 5655484 - DNA, 16 bp, Homo sapiens
ttacgagttttccctc

SEQ ID NO: 5655485 - DNA, 22 bp, Homo sapiens
ttacgatcaggcacaggtcagg

SEQ ID NO: 5655486 - DNA, 20 bp, Homo sapiens
ttacgatctgtttccaaatc

SEQ ID NO: 5655487 - DNA, 21 bp, Homo sapiens
ttacgcaggtatttagaagca

SEQ ID NO: 5655488 - DNA, 22 bp, Homo sapiens
ttacgcaggtatttagaagcag

SEQ ID NO: 5655489 - DNA, 13 bp, Homo sapiens
ttacgcctgtaaa

SEQ ID NO: 5655490 - DNA, 20 bp, Homo sapiens
ttacgctatccagttgcagg

SEQ ID NO: 5655491 - DNA, 14 bp, Homo sapiens
ttacgctgtctgta

SEQ ID NO: 5655492 - DNA, 17 bp, Homo sapiens
ttacgctgtctgtaatg

SEQ ID NO: 5655493 - DNA, 13 bp, Homo sapiens
ttacgctttgatt

SEQ ID NO: 5655494 - DNA, 16 bp, Homo sapiens
ttacgctttgattcat

SEQ ID NO: 5655495 - DNA, 16 bp, Homo sapiens
ttacggaactcaaata

SEQ ID NO: 5655496 - DNA, 13 bp, Homo sapiens
ttacggaattcca

SEQ ID NO: 5655497 - DNA, 14 bp, Homo sapiens
ttacggaattccaa

SEQ ID NO: 5655498 - DNA, 16 bp, Homo sapiens
ttacggaattccaata

SEQ ID NO: 5655499 - DNA, 16 bp, Homo sapiens
ttacggaggaacagat

SEQ ID NO: 5655500 - DNA, 20 bp, Homo sapiens
ttacggtccatgcctttaat

SEQ ID NO: 5655501 - DNA, 13 bp, Homo sapiens
ttacgtaaaacat

SEQ ID NO: 5655502 - DNA, 12 bp, Homo sapiens
ttacgtactgta

SEQ ID NO: 5655503 - DNA, 16 bp, Homo sapiens
ttacgtactgtaactg

SEQ ID NO: 5655504 - DNA, 18 bp, Homo sapiens
ttacgtactgtaactgct

SEQ ID NO: 5655505 - DNA, 14 bp, Homo sapiens
ttacgtagtaaaag

SEQ ID NO: 5655506 - DNA, 13 bp, Homo sapiens
ttacgtgagtcct

SEQ ID NO: 5655507 - DNA, 23 bp, Homo sapiens
ttacgtgcaaacaacctgaatct

SEQ ID NO: 5655508 - DNA, 22 bp, Homo sapiens
ttacgtgcatttaaactctgcc

SEQ ID NO: 5655509 - DNA, 16 bp, Homo sapiens
ttacgtgtatgtttct

SEQ ID NO: 5655510 - DNA, 19 bp, Homo sapiens
ttacgtgtatgtttcttct

SEQ ID NO: 5655511 - DNA, 17 bp, Homo sapiens
ttacgtttgaagtctga

SEQ ID NO: 5655512 - DNA, 17 bp, Homo sapiens
ttactaaaaaaaagatg

SEQ ID NO: 5655513 - DNA, 20 bp, Homo sapiens
ttactaaaagttttgagaaa

SEQ ID NO: 5655514 - DNA, 17 bp, Homo sapiens
ttactaaaatatatata

SEQ ID NO: 5655515 - DNA, 18 bp, Homo sapiens
ttactaaaatggactgtg

SEQ ID NO: 5655516 - DNA, 15 bp, Homo sapiens
ttactaaaatttaca

SEQ ID NO: 5655517 - DNA, 22 bp, Homo sapiens
ttactaaacatatgatttcact

SEQ ID NO: 5655518 - DNA, 11 bp, Homo sapiens
ttactaaagaa

SEQ ID NO: 5655519 - DNA, 15 bp, Homo sapiens
ttactaaagaaagat

SEQ ID NO: 5655520 - DNA, 24 bp, Homo sapiens
ttactaaatatataaagtatatgt

SEQ ID NO: 5655521 - DNA, 12 bp, Homo sapiens
ttactaaatatg

SEQ ID NO: 5655522 - DNA, 17 bp, Homo sapiens
ttactaaatatgggaat

SEQ ID NO: 5655523 - DNA, 23 bp, Homo sapiens
ttactaaatatgggaatgtctaa

SEQ ID NO: 5655524 - DNA, 14 bp, Homo sapiens
ttactaaatctact

SEQ ID NO: 5655525 - DNA, 23 bp, Homo sapiens
ttactaaatctactcttaaatat

SEQ ID NO: 5655526 - DNA, 20 bp, Homo sapiens
ttactaaatggtgttacatt

SEQ ID NO: 5655527 - DNA, 22 bp, Homo sapiens
ttactaaattacgtatgcaagt

SEQ ID NO: 5655528 - DNA, 19 bp, Homo sapiens
ttactaaattgtatacatt

SEQ ID NO: 5655529 - DNA, 20 bp, Homo sapiens
ttactaacagtaactgccat

SEQ ID NO: 5655530 - DNA, 15 bp, Homo sapiens
ttactaactaaactc

SEQ ID NO: 5655531 - DNA, 18 bp, Homo sapiens
ttactaactaaataccat

SEQ ID NO: 5655532 - DNA, 15 bp, Homo sapiens
ttactaactgtggac

SEQ ID NO: 5655533 - DNA, 19 bp, Homo sapiens
ttactaacttctaaaactg

SEQ ID NO: 5655534 - DNA, 20 bp, Homo sapiens
ttactaacttctaaaactgt

SEQ ID NO: 5655535 - DNA, 19 bp, Homo sapiens
ttactaagatgaaattgcc

SEQ ID NO: 5655536 - DNA, 18 bp, Homo sapiens
ttactaagccacaagaaa

SEQ ID NO: 5655537 - DNA, 23 bp, Homo sapiens
ttactaagtaatctcacagcatt

SEQ ID NO: 5655538 - DNA, 18 bp, Homo sapiens
ttactaagttttcaaatt

SEQ ID NO: 5655539 - DNA, 16 bp, Homo sapiens
ttactaataacttttt

SEQ ID NO: 5655540 - DNA, 14 bp, Homo sapiens
ttactaataggtct

SEQ ID NO: 5655541 - DNA, 15 bp, Homo sapiens
ttactaatatatctg

SEQ ID NO: 5655542 - DNA, 16 bp, Homo sapiens
ttactaatatatctgt

SEQ ID NO: 5655543 - DNA, 12 bp, Homo sapiens
ttactaatgatt

SEQ ID NO: 5655544 - DNA, 16 bp, Homo sapiens
ttactaatgtaaaatg

SEQ ID NO: 5655545 - DNA, 18 bp, Homo sapiens
ttactaattattcctctt

SEQ ID NO: 5655546 - DNA, 19 bp, Homo sapiens
ttactaattctatttctct

SEQ ID NO: 5655547 - DNA, 15 bp, Homo sapiens
ttactaatttgtata

SEQ ID NO: 5655548 - DNA, 20 bp, Homo sapiens
ttactacaaaatttgaaatt

SEQ ID NO: 5655549 - DNA, 17 bp, Homo sapiens
ttactacaaatggatga

SEQ ID NO: 5655550 - DNA, 13 bp, Homo sapiens
ttactacatgcac

SEQ ID NO: 5655551 - DNA, 16 bp, Homo sapiens
ttactaccctcaccct

SEQ ID NO: 5655552 - DNA, 21 bp, Homo sapiens
ttactaccttattttccccga

SEQ ID NO: 5655553 - DNA, 16 bp, Homo sapiens
ttactactattctgtt

SEQ ID NO: 5655554 - DNA, 17 bp, Homo sapiens
ttactactattctgtta

SEQ ID NO: 5655555 - DNA, 19 bp, Homo sapiens
ttactactgattttaaaat

SEQ ID NO: 5655556 - DNA, 22 bp, Homo sapiens
ttactactgattttaaaatgaa

SEQ ID NO: 5655557 - DNA, 12 bp, Homo sapiens
ttactactgtac

SEQ ID NO: 5655558 - DNA, 13 bp, Homo sapiens
ttactactgtgga

SEQ ID NO: 5655559 - DNA, 16 bp, Homo sapiens
ttactacttaatgctt

SEQ ID NO: 5655560 - DNA, 14 bp, Homo sapiens
ttactagaaatata

SEQ ID NO: 5655561 - DNA, 16 bp, Homo sapiens
ttactagaaatgggaa

SEQ ID NO: 5655562 - DNA, 22 bp, Homo sapiens
ttactagaaatgggaatcatgg

SEQ ID NO: 5655563 - DNA, 16 bp, Homo sapiens
ttactagggatccctc

SEQ ID NO: 5655564 - DNA, 21 bp, Homo sapiens
ttactaggtgcccagaatgag

SEQ ID NO: 5655565 - DNA, 21 bp, Homo sapiens
ttactagtactagtactatga

SEQ ID NO: 5655566 - DNA, 19 bp, Homo sapiens
ttactagtagccaaaagga

SEQ ID NO: 5655567 - DNA, 21 bp, Homo sapiens
ttactagtgtttaagtcattt

SEQ ID NO: 5655568 - DNA, 22 bp, Homo sapiens
ttactagtgtttaagtcatttt

SEQ ID NO: 5655569 - DNA, 23 bp, Homo sapiens
ttactataagaactttgagctac

SEQ ID NO: 5655570 - DNA, 16 bp, Homo sapiens
ttactataatggttgg

SEQ ID NO: 5655571 - DNA, 22 bp, Homo sapiens
ttactatagcaaagtagtactt

SEQ ID NO: 5655572 - DNA, 18 bp, Homo sapiens
ttactatagtctcttgtt

SEQ ID NO: 5655573 - DNA, 21 bp, Homo sapiens
ttactatatagaatttcctgt

SEQ ID NO: 5655574 - DNA, 19 bp, Homo sapiens
ttactatcatgtcaaacgt

SEQ ID NO: 5655575 - DNA, 21 bp, Homo sapiens
ttactatcttttcatctcatt

SEQ ID NO: 5655576 - DNA, 20 bp, Homo sapiens
ttactatgccacagattgtt

SEQ ID NO: 5655577 - DNA, 13 bp, Homo sapiens
ttactatgcctgt

SEQ ID NO: 5655578 - DNA, 22 bp, Homo sapiens
ttactatgcctgttgatctatg

SEQ ID NO: 5655579 - DNA, 20 bp, Homo sapiens
ttactattaacatgatgtac

SEQ ID NO: 5655580 - DNA, 16 bp, Homo sapiens
ttactattaactctgc

SEQ ID NO: 5655581 - DNA, 17 bp, Homo sapiens
ttactattaactctgca

SEQ ID NO: 5655582 - DNA, 18 bp, Homo sapiens
ttactattaagggaaagg

SEQ ID NO: 5655583 - DNA, 21 bp, Homo sapiens
ttactattaggaaaataaaca

SEQ ID NO: 5655584 - DNA, 15 bp, Homo sapiens
ttactattcttggtt

SEQ ID NO: 5655585 - DNA, 14 bp, Homo sapiens
ttactatttaaaga

SEQ ID NO: 5655586 - DNA, 21 bp, Homo sapiens
ttactatttgccaatgtatat

SEQ ID NO: 5655587 - DNA, 21 bp, Homo sapiens
ttactattttctacaattaat

SEQ ID NO: 5655588 - DNA, 18 bp, Homo sapiens
ttactcaaaatgcaggac

SEQ ID NO: 5655589 - DNA, 15 bp, Homo sapiens
ttactcacagcactt

SEQ ID NO: 5655590 - DNA, 21 bp, Homo sapiens
ttactcaccaccttagagcaa

SEQ ID NO: 5655591 - DNA, 20 bp, Homo sapiens
ttactcaccatatttgaatt

SEQ ID NO: 5655592 - DNA, 14 bp, Homo sapiens
ttactcacctctct

SEQ ID NO: 5655593 - DNA, 17 bp, Homo sapiens
ttactcagaatagctgt

SEQ ID NO: 5655594 - DNA, 14 bp, Homo sapiens
ttactcagagctgc

SEQ ID NO: 5655595 - DNA, 20 bp, Homo sapiens
ttactcagagctgcgggctg

SEQ ID NO: 5655596 - DNA, 22 bp, Homo sapiens
ttactcagccctgggccccacc

SEQ ID NO: 5655597 - DNA, 13 bp, Homo sapiens
ttactcagggctc

SEQ ID NO: 5655598 - DNA, 16 bp, Homo sapiens
ttactcagtaatttgt

SEQ ID NO: 5655599 - DNA, 14 bp, Homo sapiens
ttactcagtgaaat

SEQ ID NO: 5655600 - DNA, 17 bp, Homo sapiens
ttactcagtgaaatcat

SEQ ID NO: 5655601 - DNA, 22 bp, Homo sapiens
ttactcagtgaaatcatattaa

SEQ ID NO: 5655602 - DNA, 17 bp, Homo sapiens
ttactcagtgactgttg

SEQ ID NO: 5655603 - DNA, 18 bp, Homo sapiens
ttactcatagcacttccc

SEQ ID NO: 5655604 - DNA, 21 bp, Homo sapiens
ttactcattaattcaatgaaa

SEQ ID NO: 5655605 - DNA, 22 bp, Homo sapiens
ttactcattaattcaatgaaat

SEQ ID NO: 5655606 - DNA, 15 bp, Homo sapiens
ttactcattgaaatg

SEQ ID NO: 5655607 - DNA, 18 bp, Homo sapiens
ttactcattgaaatgtca

SEQ ID NO: 5655608 - DNA, 21 bp, Homo sapiens
ttactcatttttttaatttat

SEQ ID NO: 5655609 - DNA, 19 bp, Homo sapiens
ttactccaaaaagacaagt

SEQ ID NO: 5655610 - DNA, 18 bp, Homo sapiens
ttactccaaggtttataa

SEQ ID NO: 5655611 - DNA, 22 bp, Homo sapiens
ttactccaaggtttataaagca

SEQ ID NO: 5655612 - DNA, 24 bp, Homo sapiens
ttactccaaggtttataaagcaga

SEQ ID NO: 5655613 - DNA, 21 bp, Homo sapiens
ttactccacagcggaggagac

SEQ ID NO: 5655614 - DNA, 22 bp, Homo sapiens
ttactccaggttattgcaataa

SEQ ID NO: 5655615 - DNA, 16 bp, Homo sapiens
ttactccataaacaga

SEQ ID NO: 5655616 - DNA, 23 bp, Homo sapiens
ttactccatatatatatatgtgt

SEQ ID NO: 5655617 - DNA, 18 bp, Homo sapiens
ttactccattactgtgat

SEQ ID NO: 5655618 - DNA, 23 bp, Homo sapiens
ttactcccccaccactcaggcca

SEQ ID NO: 5655619 - DNA, 19 bp, Homo sapiens
ttactccctgttttagttt

SEQ ID NO: 5655620 - DNA, 19 bp, Homo sapiens
ttactcccttcctggcctc

SEQ ID NO: 5655621 - DNA, 17 bp, Homo sapiens
ttactcccttctgtagt

SEQ ID NO: 5655622 - DNA, 20 bp, Homo sapiens
ttactcccttctgtagtttt

SEQ ID NO: 5655623 - DNA, 21 bp, Homo sapiens
ttactcccttctgtagttttt

SEQ ID NO: 5655624 - DNA, 12 bp, Homo sapiens
ttactcctggct

SEQ ID NO: 5655625 - DNA, 21 bp, Homo sapiens
ttactccttaggtgcccagaa

SEQ ID NO: 5655626 - DNA, 13 bp, Homo sapiens
ttactccttcctt

SEQ ID NO: 5655627 - DNA, 20 bp, Homo sapiens
ttactcgatcaaaaccttcc

SEQ ID NO: 5655628 - DNA, 22 bp, Homo sapiens
ttactcgatcaaaaccttcctt

SEQ ID NO: 5655629 - DNA, 20 bp, Homo sapiens
ttactctaaatagaaatata

SEQ ID NO: 5655630 - DNA, 21 bp, Homo sapiens
ttactctaagatcttagattc

SEQ ID NO: 5655631 - DNA, 19 bp, Homo sapiens
ttactctcaaaatctttgt

SEQ ID NO: 5655632 - DNA, 14 bp, Homo sapiens
ttactctcaatgca

SEQ ID NO: 5655633 - DNA, 22 bp, Homo sapiens
ttactctcacccataaacagta

SEQ ID NO: 5655634 - DNA, 16 bp, Homo sapiens
ttactctccaacctgg

SEQ ID NO: 5655635 - DNA, 23 bp, Homo sapiens
ttactctcttgcaccaaattatc

SEQ ID NO: 5655636 - DNA, 20 bp, Homo sapiens
ttactctgagcccaggccgt

SEQ ID NO: 5655637 - DNA, 13 bp, Homo sapiens
ttactctgagctc

SEQ ID NO: 5655638 - DNA, 18 bp, Homo sapiens
ttactctgctctatgcca

SEQ ID NO: 5655639 - DNA, 20 bp, Homo sapiens
ttactctgtctcccaggctg

SEQ ID NO: 5655640 - DNA, 16 bp, Homo sapiens
ttactctgtgtttaaa

SEQ ID NO: 5655641 - DNA, 21 bp, Homo sapiens
ttactcttaaatcatttggtt

SEQ ID NO: 5655642 - DNA, 16 bp, Homo sapiens
ttactcttatgatcaa

SEQ ID NO: 5655643 - DNA, 21 bp, Homo sapiens
ttactcttcttcattagcttt

SEQ ID NO: 5655644 - DNA, 16 bp, Homo sapiens
ttactcttgtaagatt

SEQ ID NO: 5655645 - DNA, 23 bp, Homo sapiens
ttactcttgtaagattttgaaaa

SEQ ID NO: 5655646 - DNA, 13 bp, Homo sapiens
ttactctttgcaa

SEQ ID NO: 5655647 - DNA, 16 bp, Homo sapiens
ttactctttgctttgt

SEQ ID NO: 5655648 - DNA, 12 bp, Homo sapiens
ttactgaaagac

SEQ ID NO: 5655649 - DNA, 18 bp, Homo sapiens
ttactgaaagacaggagt

SEQ ID NO: 5655650 - DNA, 13 bp, Homo sapiens
ttactgaaatgag

SEQ ID NO: 5655651 - DNA, 17 bp, Homo sapiens
ttactgaaatgcgctct

SEQ ID NO: 5655652 - DNA, 21 bp, Homo sapiens
ttactgaagaaatctttccag

SEQ ID NO: 5655653 - DNA, 12 bp, Homo sapiens
ttactgaagtta

SEQ ID NO: 5655654 - DNA, 20 bp, Homo sapiens
ttactgaataatatcaaata

SEQ ID NO: 5655655 - DNA, 16 bp, Homo sapiens
ttagcatccaggctgg

SEQ ID NO: 5655656 - DNA, 17 bp, Homo sapiens
ttagcatcctaagaaat

SEQ ID NO: 5655657 - DNA, 22 bp, Homo sapiens
ttagcatgacaagccccaggca

SEQ ID NO: 5655658 - DNA, 13 bp, Homo sapiens
ttagcatgcaagc

SEQ ID NO: 5655659 - DNA, 15 bp, Homo sapiens
ttagcatgcaagctt

SEQ ID NO: 5655660 - DNA, 16 bp, Homo sapiens
ttagcatgcaagcttg

SEQ ID NO: 5655661 - DNA, 22 bp, Homo sapiens
ttagcatgcaagcttggtcaaa

SEQ ID NO: 5655662 - DNA, 11 bp, Homo sapiens
ttagcatggta

SEQ ID NO: 5655663 - DNA, 15 bp, Homo sapiens
ttagcatgtgttgca

SEQ ID NO: 5655664 - DNA, 22 bp, Homo sapiens
ttagcatgtgttgcagctgtca

SEQ ID NO: 5655665 - DNA, 20 bp, Homo sapiens
ttagcatgttcctccttttc

SEQ ID NO: 5655666 - DNA, 15 bp, Homo sapiens
ttagcattattgcca

SEQ ID NO: 5655667 - DNA, 18 bp, Homo sapiens
ttagcattattgccaaat

SEQ ID NO: 5655668 - DNA, 18 bp, Homo sapiens
ttagcattttaattctct

SEQ ID NO: 5655669 - DNA, 20 bp, Homo sapiens
ttagcattttctgcatctcc

SEQ ID NO: 5655670 - DNA, 18 bp, Homo sapiens
ttagcatttttatgcaga

SEQ ID NO: 5655671 - DNA, 20 bp, Homo sapiens
ttagcatttttatgcagaca

SEQ ID NO: 5655672 - DNA, 21 bp, Homo sapiens
ttagcatttttatgcagacag

SEQ ID NO: 5655673 - DNA, 21 bp, Homo sapiens
ttagccaactgtttccctgct

SEQ ID NO: 5655674 - DNA, 23 bp, Homo sapiens
ttagccaactgtttccctgctga

SEQ ID NO: 5655675 - DNA, 19 bp, Homo sapiens
ttagccaagccctaagcct

SEQ ID NO: 5655676 - DNA, 20 bp, Homo sapiens
ttagccactggtttctcaga

SEQ ID NO: 5655677 - DNA, 18 bp, Homo sapiens
ttagccagcgtttattgt

SEQ ID NO: 5655678 - DNA, 19 bp, Homo sapiens
ttagccagcgtttattgta

SEQ ID NO: 5655679 - DNA, 15 bp, Homo sapiens
ttagccaggatcatg

SEQ ID NO: 5655680 - DNA, 17 bp, Homo sapiens
ttagccaggatcatggt

SEQ ID NO: 5655681 - DNA, 13 bp, Homo sapiens
ttagccaggcgtg

SEQ ID NO: 5655682 - DNA, 16 bp, Homo sapiens
ttagccagtgaaacac

SEQ ID NO: 5655683 - DNA, 17 bp, Homo sapiens
ttagccatgtgaaactc

SEQ ID NO: 5655684 - DNA, 13 bp, Homo sapiens
ttagcccaagagg

SEQ ID NO: 5655685 - DNA, 17 bp, Homo sapiens
ttagcccaagaggtctg

SEQ ID NO: 5655686 - DNA, 19 bp, Homo sapiens
ttagcccaagaggtctgag

SEQ ID NO: 5655687 - DNA, 22 bp, Homo sapiens
ttagcccaagaggtctgagccc

SEQ ID NO: 5655688 - DNA, 18 bp, Homo sapiens
ttagccccagaaaatgaa

SEQ ID NO: 5655689 - DNA, 21 bp, Homo sapiens
ttagccccagaaaatgaaatc

SEQ ID NO: 5655690 - DNA, 12 bp, Homo sapiens
ttagcccccacc

SEQ ID NO: 5655691 - DNA, 14 bp, Homo sapiens
ttagcccctctctt

SEQ ID NO: 5655692 - DNA, 16 bp, Homo sapiens
ttagcccctgaaagcc

SEQ ID NO: 5655693 - DNA, 17 bp, Homo sapiens
ttagccgcccatgcact

SEQ ID NO: 5655694 - DNA, 14 bp, Homo sapiens
ttagccggagatcc

SEQ ID NO: 5655695 - DNA, 14 bp, Homo sapiens
ttagccgggcccca

SEQ ID NO: 5655696 - DNA, 20 bp, Homo sapiens
ttagcctcaatttctgaaca

SEQ ID NO: 5655697 - DNA, 13 bp, Homo sapiens
ttagcctctccca

SEQ ID NO: 5655698 - DNA, 14 bp, Homo sapiens
ttagcctctggatc

SEQ ID NO: 5655699 - DNA, 22 bp, Homo sapiens
ttagcctcttggaaatcaggta

SEQ ID NO: 5655700 - DNA, 15 bp, Homo sapiens
ttagcctgcctcacc

SEQ ID NO: 5655701 - DNA, 16 bp, Homo sapiens
ttagcctgcctcaccc

SEQ ID NO: 5655702 - DNA, 17 bp, Homo sapiens
ttagcctgcctcaccca

SEQ ID NO: 5655703 - DNA, 18 bp, Homo sapiens
ttagcctggacctctgac

SEQ ID NO: 5655704 - DNA, 23 bp, Homo sapiens
ttagcctggagcacctttccttc

SEQ ID NO: 5655705 - DNA, 14 bp, Homo sapiens
ttagcctgtcctgt

SEQ ID NO: 5655706 - DNA, 20 bp, Homo sapiens
ttagcctgtggcagtaaaga

SEQ ID NO: 5655707 - DNA, 14 bp, Homo sapiens
ttagccttagacga

SEQ ID NO: 5655708 - DNA, 14 bp, Homo sapiens
ttagccttgctcag

SEQ ID NO: 5655709 - DNA, 21 bp, Homo sapiens
ttagccttttttccccagact

SEQ ID NO: 5655710 - DNA, 18 bp, Homo sapiens
ttagcgaacttgtatact

SEQ ID NO: 5655711 - DNA, 15 bp, Homo sapiens
ttagcgacaacagat

SEQ ID NO: 5655712 - DNA, 16 bp, Homo sapiens
ttagcgacaacagatt

SEQ ID NO: 5655713 - DNA, 16 bp, Homo sapiens
ttagcgctctggacag

SEQ ID NO: 5655714 - DNA, 14 bp, Homo sapiens
ttagcggagacgga

SEQ ID NO: 5655715 - DNA, 14 bp, Homo sapiens
ttagcggctcctcg

SEQ ID NO: 5655716 - DNA, 15 bp, Homo sapiens
ttagcggctcctcgc

SEQ ID NO: 5655717 - DNA, 20 bp, Homo sapiens
ttagcggctcctcgccccca

SEQ ID NO: 5655718 - DNA, 21 bp, Homo sapiens
ttagcggctcctcgcccccac

SEQ ID NO: 5655719 - DNA, 23 bp, Homo sapiens
ttagcggctcctcgcccccacca

SEQ ID NO: 5655720 - DNA, 19 bp, Homo sapiens
ttagcgggactcagtgagc

SEQ ID NO: 5655721 - DNA, 16 bp, Homo sapiens
ttagcggtttgcaaac

SEQ ID NO: 5655722 - DNA, 21 bp, Homo sapiens
ttagcgtagctaagtgaaaag

SEQ ID NO: 5655723 - DNA, 23 bp, Homo sapiens
ttagcgttctggactctgcccca

SEQ ID NO: 5655724 - DNA, 15 bp, Homo sapiens
ttagcgttctgtttc

SEQ ID NO: 5655725 - DNA, 17 bp, Homo sapiens
ttagctaaaccaagaag

SEQ ID NO: 5655726 - DNA, 21 bp, Homo sapiens
ttagctaaacggattccaaag

SEQ ID NO: 5655727 - DNA, 12 bp, Homo sapiens
ttagctaaagga

SEQ ID NO: 5655728 - DNA, 18 bp, Homo sapiens
ttagctaaatgcaattta

SEQ ID NO: 5655729 - DNA, 15 bp, Homo sapiens
ttagctaataaaaag

SEQ ID NO: 5655730 - DNA, 18 bp, Homo sapiens
ttagctacgtttactcac

SEQ ID NO: 5655731 - DNA, 18 bp, Homo sapiens
ttagctactgtatgcaaa

SEQ ID NO: 5655732 - DNA, 21 bp, Homo sapiens
ttagctactttggcattgctg

SEQ ID NO: 5655733 - DNA, 14 bp, Homo sapiens
ttagctagaatcca

SEQ ID NO: 5655734 - DNA, 15 bp, Homo sapiens
ttagctagaatccac

SEQ ID NO: 5655735 - DNA, 19 bp, Homo sapiens
ttagctagactaggagacc

SEQ ID NO: 5655736 - DNA, 18 bp, Homo sapiens
ttagctaggatttgaaca

SEQ ID NO: 5655737 - DNA, 13 bp, Homo sapiens
ttagctatttaat

SEQ ID NO: 5655738 - DNA, 23 bp, Homo sapiens
ttagctcacaagccgtgttttat

SEQ ID NO: 5655739 - DNA, 12 bp, Homo sapiens
ttagctcagccc

SEQ ID NO: 5655740 - DNA, 19 bp, Homo sapiens
ttagctcagccccagccca

SEQ ID NO: 5655741 - DNA, 11 bp, Homo sapiens
ttagctcaggt

SEQ ID NO: 5655742 - DNA, 17 bp, Homo sapiens
ttagctcaggtgcctta

SEQ ID NO: 5655743 - DNA, 24 bp, Homo sapiens
ttagctccataaagtacaaatgaa

SEQ ID NO: 5655744 - DNA, 20 bp, Homo sapiens
ttagctcccagctagggggc

SEQ ID NO: 5655745 - DNA, 13 bp, Homo sapiens
ttagctcccctcc

SEQ ID NO: 5655746 - DNA, 16 bp, Homo sapiens
ttagctccctcccgca

SEQ ID NO: 5655747 - DNA, 22 bp, Homo sapiens
ttagctccctgtggggcaggag

SEQ ID NO: 5655748 - DNA, 15 bp, Homo sapiens
ttagctctattgata

SEQ ID NO: 5655749 - DNA, 20 bp, Homo sapiens
ttagctctgccctggaacct

SEQ ID NO: 5655750 - DNA, 18 bp, Homo sapiens
ttagctctggacgtgaaa

SEQ ID NO: 5655751 - DNA, 19 bp, Homo sapiens
ttagctctggacgtgaaat

SEQ ID NO: 5655752 - DNA, 19 bp, Homo sapiens
ttagctctgtactcctaat

SEQ ID NO: 5655753 - DNA, 12 bp, Homo sapiens
ttagctcttaat

SEQ ID NO: 5655754 - DNA, 22 bp, Homo sapiens
ttagctcttaattgttcatttt

SEQ ID NO: 5655755 - DNA, 12 bp, Homo sapiens
ttagctgaaggg

SEQ ID NO: 5655756 - DNA, 12 bp, Homo sapiens
ttagctgacaaa

SEQ ID NO: 5655757 - DNA, 19 bp, Homo sapiens
ttagctgacagtcagctgt

SEQ ID NO: 5655758 - DNA, 15 bp, Homo sapiens
ttagctgcactgttt

SEQ ID NO: 5655759 - DNA, 15 bp, Homo sapiens
ttagctgccaagccc

SEQ ID NO: 5655760 - DNA, 11 bp, Homo sapiens
ttagctgccat

SEQ ID NO: 5655761 - DNA, 15 bp, Homo sapiens
ttagctgctcactta

SEQ ID NO: 5655762 - DNA, 12 bp, Homo sapiens
ttagctgcttct

SEQ ID NO: 5655763 - DNA, 11 bp, Homo sapiens
ttagctggcca

SEQ ID NO: 5655764 - DNA, 19 bp, Homo sapiens
ttagctggtgtcagcccct

SEQ ID NO: 5655765 - DNA, 21 bp, Homo sapiens
ttagctggtgtcttcatttta

SEQ ID NO: 5655766 - DNA, 14 bp, Homo sapiens
ttagctgtaaactg

SEQ ID NO: 5655767 - DNA, 18 bp, Homo sapiens
ttagctgtactataagta

SEQ ID NO: 5655768 - DNA, 19 bp, Homo sapiens
ttagctgtgaatggctgtg

SEQ ID NO: 5655769 - DNA, 21 bp, Homo sapiens
ttagctgtgaatggctgtgcc

SEQ ID NO: 5655770 - DNA, 10 bp, Homo sapiens
ttagctgtgc

SEQ ID NO: 5655771 - DNA, 15 bp, Homo sapiens
ttagctgttaactcc

SEQ ID NO: 5655772 - DNA, 19 bp, Homo sapiens
ttagctgttatttctattt

SEQ ID NO: 5655773 - DNA, 21 bp, Homo sapiens
ttagctgttatttctattttt

SEQ ID NO: 5655774 - DNA, 21 bp, Homo sapiens
ttagcttagacctcagcctgt

SEQ ID NO: 5655775 - DNA, 13 bp, Homo sapiens
ttagcttatcttt

SEQ ID NO: 5655776 - DNA, 18 bp, Homo sapiens
ttagcttattgatcccac

SEQ ID NO: 5655777 - DNA, 12 bp, Homo sapiens
ttagcttcagga

SEQ ID NO: 5655778 - DNA, 13 bp, Homo sapiens
ttagcttcaggaa

SEQ ID NO: 5655779 - DNA, 15 bp, Homo sapiens
ttagcttcagttgtt

SEQ ID NO: 5655780 - DNA, 20 bp, Homo sapiens
ttagcttcagttgttcttta

SEQ ID NO: 5655781 - DNA, 15 bp, Homo sapiens
ttagcttcctgcagg

SEQ ID NO: 5655782 - DNA, 16 bp, Homo sapiens
ttagcttcctgcagga

SEQ ID NO: 5655783 - DNA, 20 bp, Homo sapiens
ttagcttggggccagggaag

SEQ ID NO: 5655784 - DNA, 20 bp, Homo sapiens
ttagcttgttcacactttgc

SEQ ID NO: 5655785 - DNA, 13 bp, Homo sapiens
ttagctttaactt

SEQ ID NO: 5655786 - DNA, 16 bp, Homo sapiens
ttagctttactgtttg

SEQ ID NO: 5655787 - DNA, 20 bp, Homo sapiens
ttagctttattatggcttgt

SEQ ID NO: 5655788 - DNA, 16 bp, Homo sapiens
ttagctttccctgtgc

SEQ ID NO: 5655789 - DNA, 15 bp, Homo sapiens
ttagctttgctctgc

SEQ ID NO: 5655790 - DNA, 16 bp, Homo sapiens
ttagctttgtcactgt

SEQ ID NO: 5655791 - DNA, 12 bp, Homo sapiens
ttagctttgtgt

SEQ ID NO: 5655792 - DNA, 19 bp, Homo sapiens
ttagcttttaccaacccaa

SEQ ID NO: 5655793 - DNA, 20 bp, Homo sapiens
ttagcttttaccaacccaaa

SEQ ID NO: 5655794 - DNA, 17 bp, Homo sapiens
ttagcttttagcctggc

SEQ ID NO: 5655795 - DNA, 18 bp, Homo sapiens
ttagcttttagcctggct

SEQ ID NO: 5655796 - DNA, 14 bp, Homo sapiens
ttagcttttctgca

SEQ ID NO: 5655797 - DNA, 19 bp, Homo sapiens
ttagcttttgatgtctcca

SEQ ID NO: 5655798 - DNA, 13 bp, Homo sapiens
ttaggaaaatgag

SEQ ID NO: 5655799 - DNA, 12 bp, Homo sapiens
ttaggaaacacc

SEQ ID NO: 5655800 - DNA, 14 bp, Homo sapiens
ttaggaaacctggc

SEQ ID NO: 5655801 - DNA, 17 bp, Homo sapiens
ttaggaaacttgtagaa

SEQ ID NO: 5655802 - DNA, 18 bp, Homo sapiens
ttaggaaaggatgatcaa

SEQ ID NO: 5655803 - DNA, 17 bp, Homo sapiens
ttaggaaataaaacctt

SEQ ID NO: 5655804 - DNA, 18 bp, Homo sapiens
ttaggaaataaaaccttt

SEQ ID NO: 5655805 - DNA, 22 bp, Homo sapiens
ttaggaaatttatacaaagaaa

SEQ ID NO: 5655806 - DNA, 16 bp, Homo sapiens
ttaggaacagcagtgt

SEQ ID NO: 5655807 - DNA, 20 bp, Homo sapiens
ttaggaacagcagtgttctc

SEQ ID NO: 5655808 - DNA, 22 bp, Homo sapiens
ttaggaacagcagtgttctcac

SEQ ID NO: 5655809 - DNA, 19 bp, Homo sapiens
ttaggaactgagtatgtgt

SEQ ID NO: 5655810 - DNA, 17 bp, Homo sapiens
ttaggaacttcagagat

SEQ ID NO: 5655811 - DNA, 11 bp, Homo sapiens
ttaggaagagc

SEQ ID NO: 5655812 - DNA, 12 bp, Homo sapiens
ttaggaagatat

SEQ ID NO: 5655813 - DNA, 18 bp, Homo sapiens
ttaggaagtatggcaaaa

SEQ ID NO: 5655814 - DNA, 19 bp, Homo sapiens
ttaggaagtgtaacagctg

SEQ ID NO: 5655815 - DNA, 20 bp, Homo sapiens
ttaggaagtgtaacagctga

SEQ ID NO: 5655816 - DNA, 21 bp, Homo sapiens
ttaggaagtgtaacagctgag

SEQ ID NO: 5655817 - DNA, 15 bp, Homo sapiens
ttaggaagttacctg

SEQ ID NO: 5655818 - DNA, 17 bp, Homo sapiens
ttaggaagttttctgta

SEQ ID NO: 5655819 - DNA, 17 bp, Homo sapiens
ttaggaataacactgca

SEQ ID NO: 5655820 - DNA, 14 bp, Homo sapiens
ttaggaataataaa

SEQ ID NO: 5655821 - DNA, 14 bp, Homo sapiens
ttaggaatgctcaa

SEQ ID NO: 5655822 - DNA, 20 bp, Homo sapiens
ttaggaatgctcaatgtgct

SEQ ID NO: 5655823 - DNA, 17 bp, Homo sapiens
ttaggaattgtttatac

SEQ ID NO: 5655824 - DNA, 20 bp, Homo sapiens
ttaggacaaggctgtgccag

SEQ ID NO: 5655825 - DNA, 22 bp, Homo sapiens
ttaggacaaggctgtgccaggc

SEQ ID NO: 5655826 - DNA, 18 bp, Homo sapiens
ttaggacaattactgtac

SEQ ID NO: 5655827 - DNA, 19 bp, Homo sapiens
ttaggactcttcttccata

SEQ ID NO: 5655828 - DNA, 20 bp, Homo sapiens
ttaggagaagtcttctattt

SEQ ID NO: 5655829 - DNA, 23 bp, Homo sapiens
ttaggagaagtcttctatttatt

SEQ ID NO: 5655830 - DNA, 21 bp, Homo sapiens
ttaggagatttaccacttttt

SEQ ID NO: 5655831 - DNA, 18 bp, Homo sapiens
ttaggaggacaaaaggaa

SEQ ID NO: 5655832 - DNA, 19 bp, Homo sapiens
ttaggaggacaaaaggaat

SEQ ID NO: 5655833 - DNA, 18 bp, Homo sapiens
ttaggaggctcaacaata

SEQ ID NO: 5655834 - DNA, 21 bp, Homo sapiens
ttatacaggggaatattttat

SEQ ID NO: 5655835 - DNA, 14 bp, Homo sapiens
ttatacaggtcata

SEQ ID NO: 5655836 - DNA, 12 bp, Homo sapiens
ttatacagtaca

SEQ ID NO: 5655837 - DNA, 21 bp, Homo sapiens
ttatacagttataaaattaaa

SEQ ID NO: 5655838 - DNA, 17 bp, Homo sapiens
ttatacataaacagttt

SEQ ID NO: 5655839 - DNA, 18 bp, Homo sapiens
ttatacataataaagtgt

SEQ ID NO: 5655840 - DNA, 21 bp, Homo sapiens
ttatacatagtcacaaaaatg

SEQ ID NO: 5655841 - DNA, 23 bp, Homo sapiens
ttatacatcaatttaaaaagcaa

SEQ ID NO: 5655842 - DNA, 18 bp, Homo sapiens
ttatacatcacttcctgt

SEQ ID NO: 5655843 - DNA, 15 bp, Homo sapiens
ttatacatctgtatt

SEQ ID NO: 5655844 - DNA, 15 bp, Homo sapiens
ttatacatcttcatt

SEQ ID NO: 5655845 - DNA, 20 bp, Homo sapiens
ttatacatgacactgaaatg

SEQ ID NO: 5655846 - DNA, 22 bp, Homo sapiens
ttatacatgacactgaaatgcc

SEQ ID NO: 5655847 - DNA, 23 bp, Homo sapiens
ttatacatgacactgaaatgcct

SEQ ID NO: 5655848 - DNA, 20 bp, Homo sapiens
ttatacatgtgatacatttt

SEQ ID NO: 5655849 - DNA, 23 bp, Homo sapiens
ttatacattagtaaatgtctttg

SEQ ID NO: 5655850 - DNA, 16 bp, Homo sapiens
ttatacatttggttat

SEQ ID NO: 5655851 - DNA, 16 bp, Homo sapiens
ttataccaaagggaaa

SEQ ID NO: 5655852 - DNA, 18 bp, Homo sapiens
ttataccaagagtatgag

SEQ ID NO: 5655853 - DNA, 18 bp, Homo sapiens
ttataccagatgaacatt

SEQ ID NO: 5655854 - DNA, 21 bp, Homo sapiens
ttataccagcttaatagctgt

SEQ ID NO: 5655855 - DNA, 23 bp, Homo sapiens
ttatacccagaaagttattgata

SEQ ID NO: 5655856 - DNA, 16 bp, Homo sapiens
ttataccccatatatt

SEQ ID NO: 5655857 - DNA, 16 bp, Homo sapiens
ttataccccatttgat

SEQ ID NO: 5655858 - DNA, 17 bp, Homo sapiens
ttatacccccaggaaac

SEQ ID NO: 5655859 - DNA, 21 bp, Homo sapiens
ttatacccttgacttaacttt

SEQ ID NO: 5655860 - DNA, 15 bp, Homo sapiens
ttataccgcagagta

SEQ ID NO: 5655861 - DNA, 15 bp, Homo sapiens
ttatacctgtacaca

SEQ ID NO: 5655862 - DNA, 16 bp, Homo sapiens
ttatacctgtacacac

SEQ ID NO: 5655863 - DNA, 17 bp, Homo sapiens
ttatacgaaataattgt

SEQ ID NO: 5655864 - DNA, 14 bp, Homo sapiens
ttatacgcttttct

SEQ ID NO: 5655865 - DNA, 20 bp, Homo sapiens
ttatacggaaaaaattgtat

SEQ ID NO: 5655866 - DNA, 15 bp, Homo sapiens
ttatacgtgtagcta

SEQ ID NO: 5655867 - DNA, 21 bp, Homo sapiens
ttatacgtgtagctatatcta

SEQ ID NO: 5655868 - DNA, 11 bp, Homo sapiens
ttatactaact

SEQ ID NO: 5655869 - DNA, 18 bp, Homo sapiens
ttatactaccaagtgacc

SEQ ID NO: 5655870 - DNA, 22 bp, Homo sapiens
ttatactatattaacttttatt

SEQ ID NO: 5655871 - DNA, 15 bp, Homo sapiens
ttatactatatttgt

SEQ ID NO: 5655872 - DNA, 16 bp, Homo sapiens
ttatactcaaaattca

SEQ ID NO: 5655873 - DNA, 18 bp, Homo sapiens
ttatactcagaactgtcc

SEQ ID NO: 5655874 - DNA, 18 bp, Homo sapiens
ttatactccagtgtacat

SEQ ID NO: 5655875 - DNA, 17 bp, Homo sapiens
ttatactccatacataa

SEQ ID NO: 5655876 - DNA, 14 bp, Homo sapiens
ttatactctcttcc

SEQ ID NO: 5655877 - DNA, 13 bp, Homo sapiens
ttatactgaaaaa

SEQ ID NO: 5655878 - DNA, 17 bp, Homo sapiens
ttatactgaatataaaa

SEQ ID NO: 5655879 - DNA, 18 bp, Homo sapiens
ttatactgagcttttgag

SEQ ID NO: 5655880 - DNA, 16 bp, Homo sapiens
ttatactgctatattt

SEQ ID NO: 5655881 - DNA, 21 bp, Homo sapiens
ttatactgctctataaatagt

SEQ ID NO: 5655882 - DNA, 13 bp, Homo sapiens
ttatactgtacat

SEQ ID NO: 5655883 - DNA, 14 bp, Homo sapiens
ttatactgtacatg

SEQ ID NO: 5655884 - DNA, 17 bp, Homo sapiens
ttatactgtagcaatat

SEQ ID NO: 5655885 - DNA, 15 bp, Homo sapiens
ttatactgtgaagtt

SEQ ID NO: 5655886 - DNA, 14 bp, Homo sapiens
ttatacttaaacag

SEQ ID NO: 5655887 - DNA, 11 bp, Homo sapiens
ttatacttact

SEQ ID NO: 5655888 - DNA, 14 bp, Homo sapiens
ttatactttatatc

SEQ ID NO: 5655889 - DNA, 23 bp, Homo sapiens
ttatactttatatctgtaatgat

SEQ ID NO: 5655890 - DNA, 13 bp, Homo sapiens
ttatactttattg

SEQ ID NO: 5655891 - DNA, 14 bp, Homo sapiens
ttatactttattga

SEQ ID NO: 5655892 - DNA, 20 bp, Homo sapiens
ttatactttgctgttgaaga

SEQ ID NO: 5655893 - DNA, 18 bp, Homo sapiens
ttatagaaaacctgactt

SEQ ID NO: 5655894 - DNA, 15 bp, Homo sapiens
ttatagaaaaggaac

SEQ ID NO: 5655895 - DNA, 11 bp, Homo sapiens
ttatagaaaat

SEQ ID NO: 5655896 - DNA, 15 bp, Homo sapiens
ttatagaaaatgcat

SEQ ID NO: 5655897 - DNA, 12 bp, Homo sapiens
ttatagaaaatt

SEQ ID NO: 5655898 - DNA, 18 bp, Homo sapiens
ttatagaacttcatggat

SEQ ID NO: 5655899 - DNA, 13 bp, Homo sapiens
ttatagaagaaat

SEQ ID NO: 5655900 - DNA, 22 bp, Homo sapiens
ttatagaagaatgcatgctttc

SEQ ID NO: 5655901 - DNA, 18 bp, Homo sapiens
ttatagaaggaatttgta

SEQ ID NO: 5655902 - DNA, 19 bp, Homo sapiens
ttatagaataaaagctata

SEQ ID NO: 5655903 - DNA, 22 bp, Homo sapiens
ttatagaataaaagctataaag

SEQ ID NO: 5655904 - DNA, 15 bp, Homo sapiens
ttatagaatatttat

SEQ ID NO: 5655905 - DNA, 23 bp, Homo sapiens
ttatagaatatttattacctctg

SEQ ID NO: 5655906 - DNA, 19 bp, Homo sapiens
ttatagacaaaagaataag

SEQ ID NO: 5655907 - DNA, 21 bp, Homo sapiens
ttatagacaaaagaataagac

SEQ ID NO: 5655908 - DNA, 22 bp, Homo sapiens
ttatagacaaaagaataagaca

SEQ ID NO: 5655909 - DNA, 21 bp, Homo sapiens
ttatagacgtttggactgatt

SEQ ID NO: 5655910 - DNA, 17 bp, Homo sapiens
ttatagagcagaaattc

SEQ ID NO: 5655911 - DNA, 18 bp, Homo sapiens
ttatagagcctcaatttt

SEQ ID NO: 5655912 - DNA, 19 bp, Homo sapiens
ttatagaggtaaaatttgc

SEQ ID NO: 5655913 - DNA, 13 bp, Homo sapiens
ttatagagttatt

SEQ ID NO: 5655914 - DNA, 19 bp, Homo sapiens
ttatagagttcatagaaat

SEQ ID NO: 5655915 - DNA, 15 bp, Homo sapiens
ttatagatcatttct

SEQ ID NO: 5655916 - DNA, 16 bp, Homo sapiens
ttatagatcatttcta

SEQ ID NO: 5655917 - DNA, 15 bp, Homo sapiens
ttatagatgtctagg

SEQ ID NO: 5655918 - DNA, 12 bp, Homo sapiens
ttatagattcta

SEQ ID NO: 5655919 - DNA, 16 bp, Homo sapiens
ttatagattctaaaga

SEQ ID NO: 5655920 - DNA, 19 bp, Homo sapiens
ttatagattctaaagattc

SEQ ID NO: 5655921 - DNA, 18 bp, Homo sapiens
ttatagatttagctattt

SEQ ID NO: 5655922 - DNA, 23 bp, Homo sapiens
ttatagcaaaaatgttttccaat

SEQ ID NO: 5655923 - DNA, 20 bp, Homo sapiens
ttatagcaacaacaattggt

SEQ ID NO: 5655924 - DNA, 18 bp, Homo sapiens
ttatagcaagatattgat

SEQ ID NO: 5655925 - DNA, 21 bp, Homo sapiens
ttatagcaagatattgatcaa

SEQ ID NO: 5655926 - DNA, 17 bp, Homo sapiens
ttatagcaatgtaacat

SEQ ID NO: 5655927 - DNA, 18 bp, Homo sapiens
ttatagcaatgtgatttt

SEQ ID NO: 5655928 - DNA, 24 bp, Homo sapiens
ttatagcacgaagctatgagaata

SEQ ID NO: 5655929 - DNA, 17 bp, Homo sapiens
ttatagcccggtgcagc

SEQ ID NO: 5655930 - DNA, 15 bp, Homo sapiens
ttatagccctgtgaa

SEQ ID NO: 5655931 - DNA, 16 bp, Homo sapiens
ttatagccctgtgaag

SEQ ID NO: 5655932 - DNA, 16 bp, Homo sapiens
ttatagccgaaatgat

SEQ ID NO: 5655933 - DNA, 19 bp, Homo sapiens
ttatagcctctgtctggca

SEQ ID NO: 5655934 - DNA, 18 bp, Homo sapiens
ttatagctcccaaaagaa

SEQ ID NO: 5655935 - DNA, 12 bp, Homo sapiens
ttatagctctaa

SEQ ID NO: 5655936 - DNA, 21 bp, Homo sapiens
ttatagctctaataagtttgt

SEQ ID NO: 5655937 - DNA, 15 bp, Homo sapiens
ttatagctctaatgt

SEQ ID NO: 5655938 - DNA, 18 bp, Homo sapiens
ttatagctctaatgtttg

SEQ ID NO: 5655939 - DNA, 20 bp, Homo sapiens
ttatagctctaatgtttgca

SEQ ID NO: 5655940 - DNA, 14 bp, Homo sapiens
ttatagcttactga

SEQ ID NO: 5655941 - DNA, 17 bp, Homo sapiens
ttataggaaaaaaactg

SEQ ID NO: 5655942 - DNA, 21 bp, Homo sapiens
ttataggaaataaatctaaat

SEQ ID NO: 5655943 - DNA, 22 bp, Homo sapiens
ttataggagaaagcaaaataca

SEQ ID NO: 5655944 - DNA, 18 bp, Homo sapiens
ttataggatttatttaaa

SEQ ID NO: 5655945 - DNA, 19 bp, Homo sapiens
ttataggcagatctttaaa

SEQ ID NO: 5655946 - DNA, 23 bp, Homo sapiens
ttataggccagggcatgtgtatg

SEQ ID NO: 5655947 - DNA, 23 bp, Homo sapiens
ttataggcctgtcccttgcctct

SEQ ID NO: 5655948 - DNA, 15 bp, Homo sapiens
ttataggtaacgtga

SEQ ID NO: 5655949 - DNA, 23 bp, Homo sapiens
ttataggtaacgtgattgattca

SEQ ID NO: 5655950 - DNA, 17 bp, Homo sapiens
ttataggtcactcctgg

SEQ ID NO: 5655951 - DNA, 21 bp, Homo sapiens
ttataggttatcaaaactgtt

SEQ ID NO: 5655952 - DNA, 15 bp, Homo sapiens
ttatagtaactataa

SEQ ID NO: 5655953 - DNA, 13 bp, Homo sapiens
ttatagtacatga

SEQ ID NO: 5655954 - DNA, 18 bp, Homo sapiens
ttatagtactgacagata

SEQ ID NO: 5655955 - DNA, 15 bp, Homo sapiens
ttatagtactgcttt

SEQ ID NO: 5655956 - DNA, 18 bp, Homo sapiens
ttatagtagaacaaggca

SEQ ID NO: 5655957 - DNA, 19 bp, Homo sapiens
ttatagtattaagtgaaat

SEQ ID NO: 5655958 - DNA, 20 bp, Homo sapiens
ttatagtattaagtgaaatt

SEQ ID NO: 5655959 - DNA, 14 bp, Homo sapiens
ttatagtgaagtgt

SEQ ID NO: 5655960 - DNA, 21 bp, Homo sapiens
ttatagtgaatactgctacag

SEQ ID NO: 5655961 - DNA, 20 bp, Homo sapiens
ttatagtgagttgcatgttt

SEQ ID NO: 5655962 - DNA, 15 bp, Homo sapiens
ttatagtgcaatata

SEQ ID NO: 5655963 - DNA, 22 bp, Homo sapiens
ttatagtgcaatatattttgta

SEQ ID NO: 5655964 - DNA, 13 bp, Homo sapiens
ttatagtggaaaa

SEQ ID NO: 5655965 - DNA, 19 bp, Homo sapiens
ttatagtgtttaactggca

SEQ ID NO: 5655966 - DNA, 17 bp, Homo sapiens
ttatagttaatctataa

SEQ ID NO: 5655967 - DNA, 13 bp, Homo sapiens
ttatagttactgt

SEQ ID NO: 5655968 - DNA, 21 bp, Homo sapiens
ttatagttaggcttccatgat

SEQ ID NO: 5655969 - DNA, 15 bp, Homo sapiens
ttatagttgtaacta

SEQ ID NO: 5655970 - DNA, 18 bp, Homo sapiens
ttatagttgtattttgta

SEQ ID NO: 5655971 - DNA, 20 bp, Homo sapiens
ttatagttgtgggtgggaga

SEQ ID NO: 5655972 - DNA, 11 bp, Homo sapiens
ttatagtttag

SEQ ID NO: 5655973 - DNA, 17 bp, Homo sapiens
ttatagtttatacagtt

SEQ ID NO: 5655974 - DNA, 12 bp, Homo sapiens
ttatagtttctg

SEQ ID NO: 5655975 - DNA, 13 bp, Homo sapiens
ttatagtttctga

SEQ ID NO: 5655976 - DNA, 16 bp, Homo sapiens
ttatagtttgggcttc

SEQ ID NO: 5655977 - DNA, 12 bp, Homo sapiens
ttatagtttgta

SEQ ID NO: 5655978 - DNA, 22 bp, Homo sapiens
ttatataaaaaaattgtaaatg

SEQ ID NO: 5655979 - DNA, 22 bp, Homo sapiens
ttatataaagaaaatcaatgaa

SEQ ID NO: 5655980 - DNA, 17 bp, Homo sapiens
ttatataaagagaaaat

SEQ ID NO: 5655981 - DNA, 19 bp, Homo sapiens
ttatataaaggcaaggaaa

SEQ ID NO: 5655982 - DNA, 18 bp, Homo sapiens
ttatataaatgtaaaaat

SEQ ID NO: 5655983 - DNA, 12 bp, Homo sapiens
ttatataacaaa

SEQ ID NO: 5655984 - DNA, 14 bp, Homo sapiens
ttatataacaaaaa

SEQ ID NO: 5655985 - DNA, 18 bp, Homo sapiens
ttatataacaaaaaaggt

SEQ ID NO: 5655986 - DNA, 13 bp, Homo sapiens
ttatataactaca

SEQ ID NO: 5655987 - DNA, 14 bp, Homo sapiens
ttatataagcaaaa

SEQ ID NO: 5655988 - DNA, 14 bp, Homo sapiens
ttatataagtattc

SEQ ID NO: 5655989 - DNA, 15 bp, Homo sapiens
ttatataatatgaat

SEQ ID NO: 5655990 - DNA, 16 bp, Homo sapiens
ttatataatcattatt

SEQ ID NO: 5655991 - DNA, 20 bp, Homo sapiens
ttatatacaataatggaaaa

SEQ ID NO: 5655992 - DNA, 23 bp, Homo sapiens
ttatatacagaggaaatctgtaa

SEQ ID NO: 5655993 - DNA, 21 bp, Homo sapiens
ttatatacctggcttttactt

SEQ ID NO: 5655994 - DNA, 16 bp, Homo sapiens
ttatatacttagctat

SEQ ID NO: 5655995 - DNA, 18 bp, Homo sapiens
ttatatacttgttgttta

SEQ ID NO: 5655996 - DNA, 22 bp, Homo sapiens
ttatatacttgttgtttaatgt

SEQ ID NO: 5655997 - DNA, 23 bp, Homo sapiens
ttatatagcaaagatatatattc

SEQ ID NO: 5655998 - DNA, 13 bp, Homo sapiens
ttatatataaata

SEQ ID NO: 5655999 - DNA, 23 bp, Homo sapiens
ttatatataaatatattattact

SEQ ID NO: 5656000 - DNA, 18 bp, Homo sapiens
ttatatataaggtaatgt

SEQ ID NO: 5656001 - DNA, 14 bp, Homo sapiens
ttatatataataaa

SEQ ID NO: 5656002 - DNA, 17 bp, Homo sapiens
ttatatataataaatac

SEQ ID NO: 5656003 - DNA, 19 bp, Homo sapiens
ttatatatagaaaagagga

SEQ ID NO: 5656004 - DNA, 12 bp, Homo sapiens
ttatatatataa

SEQ ID NO: 5656005 - DNA, 14 bp, Homo sapiens
ttatatatatatat

SEQ ID NO: 5656006 - DNA, 19 bp, Homo sapiens
ttatatatatatatatttc

SEQ ID NO: 5656007 - DNA, 14 bp, Homo sapiens
ttatatatatatgt

SEQ ID NO: 5656008 - DNA, 13 bp, Homo sapiens
ttatatatatcta

SEQ ID NO: 5656009 - DNA, 20 bp, Homo sapiens
ttatatatattttgtttctt

SEQ ID NO: 5656010 - DNA, 22 bp, Homo sapiens
ttatatatatttttttctgaaa

SEQ ID NO: 5656011 - DNA, 18 bp, Homo sapiens
ttatatatccctgataaa

SEQ ID NO: 5656012 - DNA, 12 bp, Homo sapiens
ttatctgtgaat

SEQ ID NO: 5656013 - DNA, 16 bp, Homo sapiens
ttatctgtgaccacac

SEQ ID NO: 5656014 - DNA, 18 bp, Homo sapiens
ttatctgtgcgtgaaaca

SEQ ID NO: 5656015 - DNA, 16 bp, Homo sapiens
ttatctgtgttaaaat

SEQ ID NO: 5656016 - DNA, 16 bp, Homo sapiens
ttatctgttaaccaaa

SEQ ID NO: 5656017 - DNA, 11 bp, Homo sapiens
ttatctgttct

SEQ ID NO: 5656018 - DNA, 16 bp, Homo sapiens
ttatctgtttgttact

SEQ ID NO: 5656019 - DNA, 17 bp, Homo sapiens
ttatcttaaacccacat

SEQ ID NO: 5656020 - DNA, 15 bp, Homo sapiens
ttatcttaaactgtt

SEQ ID NO: 5656021 - DNA, 15 bp, Homo sapiens
ttatcttaaatatga

SEQ ID NO: 5656022 - DNA, 17 bp, Homo sapiens
ttatcttaaatatgaat

SEQ ID NO: 5656023 - DNA, 16 bp, Homo sapiens
ttatcttacaaagtgt

SEQ ID NO: 5656024 - DNA, 21 bp, Homo sapiens
ttatcttacgtttaagcttaa

SEQ ID NO: 5656025 - DNA, 13 bp, Homo sapiens
ttatcttactttt

SEQ ID NO: 5656026 - DNA, 15 bp, Homo sapiens
ttatcttacttttgg

SEQ ID NO: 5656027 - DNA, 21 bp, Homo sapiens
ttatcttatactgtacaataa

SEQ ID NO: 5656028 - DNA, 22 bp, Homo sapiens
ttatcttatactgtacaataaa

SEQ ID NO: 5656029 - DNA, 13 bp, Homo sapiens
ttatcttatcatt

SEQ ID NO: 5656030 - DNA, 14 bp, Homo sapiens
ttatcttatcattt

SEQ ID NO: 5656031 - DNA, 14 bp, Homo sapiens
ttatcttatctagc

SEQ ID NO: 5656032 - DNA, 21 bp, Homo sapiens
ttatcttatgaaaaccaaatt

SEQ ID NO: 5656033 - DNA, 14 bp, Homo sapiens
ttatcttatttaat

SEQ ID NO: 5656034 - DNA, 19 bp, Homo sapiens
ttatcttctcaagttctaa

SEQ ID NO: 5656035 - DNA, 22 bp, Homo sapiens
ttatcttctggtgcatgttctt

SEQ ID NO: 5656036 - DNA, 13 bp, Homo sapiens
ttatcttctgttt

SEQ ID NO: 5656037 - DNA, 17 bp, Homo sapiens
ttatcttctgtttttct

SEQ ID NO: 5656038 - DNA, 12 bp, Homo sapiens
ttatcttcttaa

SEQ ID NO: 5656039 - DNA, 11 bp, Homo sapiens
ttatcttgaaa

SEQ ID NO: 5656040 - DNA, 20 bp, Homo sapiens
ttatcttgaagtcagccaca

SEQ ID NO: 5656041 - DNA, 14 bp, Homo sapiens
ttatcttgaataat

SEQ ID NO: 5656042 - DNA, 14 bp, Homo sapiens
ttatcttgatacat

SEQ ID NO: 5656043 - DNA, 14 bp, Homo sapiens
ttatcttggatgag

SEQ ID NO: 5656044 - DNA, 16 bp, Homo sapiens
ttatcttgtctctggg

SEQ ID NO: 5656045 - DNA, 22 bp, Homo sapiens
ttatcttgtgtatggatatgtg

SEQ ID NO: 5656046 - DNA, 20 bp, Homo sapiens
ttatcttgttattattgtta

SEQ ID NO: 5656047 - DNA, 13 bp, Homo sapiens
ttatctttaccaa

SEQ ID NO: 5656048 - DNA, 23 bp, Homo sapiens
ttatctttaccaaaaaccatgtt

SEQ ID NO: 5656049 - DNA, 14 bp, Homo sapiens
ttatctttctttcc

SEQ ID NO: 5656050 - DNA, 15 bp, Homo sapiens
ttatctttctttcca

SEQ ID NO: 5656051 - DNA, 20 bp, Homo sapiens
ttatctttgtattcttcatg

SEQ ID NO: 5656052 - DNA, 23 bp, Homo sapiens
ttatctttgtattcttcatgaaa

SEQ ID NO: 5656053 - DNA, 16 bp, Homo sapiens
ttatcttttaattaca

SEQ ID NO: 5656054 - DNA, 13 bp, Homo sapiens
ttatcttttactt

SEQ ID NO: 5656055 - DNA, 22 bp, Homo sapiens
ttatcttttagctagaatccac

SEQ ID NO: 5656056 - DNA, 12 bp, Homo sapiens
ttatcttttgag

SEQ ID NO: 5656057 - DNA, 18 bp, Homo sapiens
ttatctttttaaaaactc

SEQ ID NO: 5656058 - DNA, 15 bp, Homo sapiens
ttatctttttacctt

SEQ ID NO: 5656059 - DNA, 19 bp, Homo sapiens
ttatgaaaaaaaaagaaat

SEQ ID NO: 5656060 - DNA, 21 bp, Homo sapiens
ttatgaaaaaatgttcaaatt

SEQ ID NO: 5656061 - DNA, 12 bp, Homo sapiens
ttatgaaaatta

SEQ ID NO: 5656062 - DNA, 14 bp, Homo sapiens
ttatgaaaattaag

SEQ ID NO: 5656063 - DNA, 16 bp, Homo sapiens
ttatgaaaattatact

SEQ ID NO: 5656064 - DNA, 17 bp, Homo sapiens
ttatgaaacagccattt

SEQ ID NO: 5656065 - DNA, 13 bp, Homo sapiens
ttatgaaacatgt

SEQ ID NO: 5656066 - DNA, 20 bp, Homo sapiens
ttatgaaataaagaaattgc

SEQ ID NO: 5656067 - DNA, 14 bp, Homo sapiens
ttatgaaatatggt

SEQ ID NO: 5656068 - DNA, 14 bp, Homo sapiens
ttatgaaatgccag

SEQ ID NO: 5656069 - DNA, 13 bp, Homo sapiens
ttatgaaatttca

SEQ ID NO: 5656070 - DNA, 11 bp, Homo sapiens
ttatgaacagc

SEQ ID NO: 5656071 - DNA, 17 bp, Homo sapiens
ttatgaacagctgtgtc

SEQ ID NO: 5656072 - DNA, 20 bp, Homo sapiens
ttatgaacccttcctgagct

SEQ ID NO: 5656073 - DNA, 16 bp, Homo sapiens
ttatgaactgcatcaa

SEQ ID NO: 5656074 - DNA, 23 bp, Homo sapiens
ttatgaactgcatgtataaatga

SEQ ID NO: 5656075 - DNA, 13 bp, Homo sapiens
ttatgaagcagat

SEQ ID NO: 5656076 - DNA, 15 bp, Homo sapiens
ttatgaagctcatat

SEQ ID NO: 5656077 - DNA, 23 bp, Homo sapiens
ttatgaagggccttgagcatctg

SEQ ID NO: 5656078 - DNA, 11 bp, Homo sapiens
ttatgaagttt

SEQ ID NO: 5656079 - DNA, 13 bp, Homo sapiens
ttatgaagttttt

SEQ ID NO: 5656080 - DNA, 15 bp, Homo sapiens
ttatgaataagcact

SEQ ID NO: 5656081 - DNA, 19 bp, Homo sapiens
ttatgaataagcacttgaa

SEQ ID NO: 5656082 - DNA, 14 bp, Homo sapiens
ttatgaatagacat

SEQ ID NO: 5656083 - DNA, 22 bp, Homo sapiens
ttatgaatagacataaattgta

SEQ ID NO: 5656084 - DNA, 16 bp, Homo sapiens
ttatgaatatcattga

SEQ ID NO: 5656085 - DNA, 14 bp, Homo sapiens
ttatgaatattaaa

SEQ ID NO: 5656086 - DNA, 16 bp, Homo sapiens
ttatgaatattaaagg

SEQ ID NO: 5656087 - DNA, 19 bp, Homo sapiens
ttatgaatatttacgtttt

SEQ ID NO: 5656088 - DNA, 19 bp, Homo sapiens
ttatgaatatttataacag

SEQ ID NO: 5656089 - DNA, 22 bp, Homo sapiens
ttatgaatccaacgtgtaacca

SEQ ID NO: 5656090 - DNA, 18 bp, Homo sapiens
ttatgaatcgcagacgca

SEQ ID NO: 5656091 - DNA, 19 bp, Homo sapiens
ttatgaatgtgcatttctt

SEQ ID NO: 5656092 - DNA, 14 bp, Homo sapiens
ttatgaattacatt

SEQ ID NO: 5656093 - DNA, 23 bp, Homo sapiens
ttatgaatttttgtaagaaaccg

SEQ ID NO: 5656094 - DNA, 21 bp, Homo sapiens
ttatgacaaatgaaagagaaa

SEQ ID NO: 5656095 - DNA, 22 bp, Homo sapiens
ttatgacaagctgtatcactgc

SEQ ID NO: 5656096 - DNA, 23 bp, Homo sapiens
ttatgacacaatgacacatttgt

SEQ ID NO: 5656097 - DNA, 16 bp, Homo sapiens
ttatgacagtaattgt

SEQ ID NO: 5656098 - DNA, 24 bp, Homo sapiens
ttatgacagtaattgtgtttacat

SEQ ID NO: 5656099 - DNA, 14 bp, Homo sapiens
ttatgacagttata

SEQ ID NO: 5656100 - DNA, 21 bp, Homo sapiens
ttatgacatcacttgtacaaa

SEQ ID NO: 5656101 - DNA, 16 bp, Homo sapiens
ttatgacatttcttaa

SEQ ID NO: 5656102 - DNA, 16 bp, Homo sapiens
ttatgacgtgcacaaa

SEQ ID NO: 5656103 - DNA, 15 bp, Homo sapiens
ttatgactaaaaata

SEQ ID NO: 5656104 - DNA, 18 bp, Homo sapiens
ttatgactaatccttaat

SEQ ID NO: 5656105 - DNA, 20 bp, Homo sapiens
ttatgactgtaaacatagat

SEQ ID NO: 5656106 - DNA, 15 bp, Homo sapiens
ttatgactgtgaaat

SEQ ID NO: 5656107 - DNA, 11 bp, Homo sapiens
ttatgagaaaa

SEQ ID NO: 5656108 - DNA, 21 bp, Homo sapiens
ttatgagaaactggcaaagca

SEQ ID NO: 5656109 - DNA, 23 bp, Homo sapiens
ttatgagaaactggcaaagcaga

SEQ ID NO: 5656110 - DNA, 13 bp, Homo sapiens
ttatgagaaactt

SEQ ID NO: 5656111 - DNA, 22 bp, Homo sapiens
ttatgagaaacttaaatgttat

SEQ ID NO: 5656112 - DNA, 15 bp, Homo sapiens
ttatgagaaagcctt

SEQ ID NO: 5656113 - DNA, 18 bp, Homo sapiens
ttatgagaaatgtaatgc

SEQ ID NO: 5656114 - DNA, 15 bp, Homo sapiens
ttatgagaaattagt

SEQ ID NO: 5656115 - DNA, 23 bp, Homo sapiens
ttatgagaaattagtcacttaaa

SEQ ID NO: 5656116 - DNA, 15 bp, Homo sapiens
ttatgagaacatggt

SEQ ID NO: 5656117 - DNA, 16 bp, Homo sapiens
ttatgagaactggttc

SEQ ID NO: 5656118 - DNA, 19 bp, Homo sapiens
ttatgagatcactgaactt

SEQ ID NO: 5656119 - DNA, 20 bp, Homo sapiens
ttatgagatcactgaacttt

SEQ ID NO: 5656120 - DNA, 23 bp, Homo sapiens
ttatgagatgatgaaaataataa

SEQ ID NO: 5656121 - DNA, 19 bp, Homo sapiens
ttatgagatggatcacata

SEQ ID NO: 5656122 - DNA, 14 bp, Homo sapiens
ttatgagatttact

SEQ ID NO: 5656123 - DNA, 13 bp, Homo sapiens
ttatgagccaggc

SEQ ID NO: 5656124 - DNA, 16 bp, Homo sapiens
ttatgagcgtcactgc

SEQ ID NO: 5656125 - DNA, 18 bp, Homo sapiens
ttatgagctcatgtagca

SEQ ID NO: 5656126 - DNA, 18 bp, Homo sapiens
ttatgagctccatgttgc

SEQ ID NO: 5656127 - DNA, 14 bp, Homo sapiens
ttatgaggaaactt

SEQ ID NO: 5656128 - DNA, 13 bp, Homo sapiens
ttatgagggccac

SEQ ID NO: 5656129 - DNA, 21 bp, Homo sapiens
ttatgagtataatgaacactc

SEQ ID NO: 5656130 - DNA, 18 bp, Homo sapiens
ttatgagtgttaataaaa

SEQ ID NO: 5656131 - DNA, 13 bp, Homo sapiens
ttatgagttcttg

SEQ ID NO: 5656132 - DNA, 20 bp, Homo sapiens
ttatgagttcttgtttttta

SEQ ID NO: 5656133 - DNA, 16 bp, Homo sapiens
ttatgataaaaggaag

SEQ ID NO: 5656134 - DNA, 19 bp, Homo sapiens
ttatgataaaggcttagga

SEQ ID NO: 5656135 - DNA, 17 bp, Homo sapiens
ttatgataatagattct

SEQ ID NO: 5656136 - DNA, 20 bp, Homo sapiens
ttatgatacttgaaaattaa

SEQ ID NO: 5656137 - DNA, 18 bp, Homo sapiens
ttatgatagtgcaaggaa

SEQ ID NO: 5656138 - DNA, 18 bp, Homo sapiens
ttatgatagtggtatgac

SEQ ID NO: 5656139 - DNA, 11 bp, Homo sapiens
ttatgatatca

SEQ ID NO: 5656140 - DNA, 19 bp, Homo sapiens
ttatgatattgtttaaaat

SEQ ID NO: 5656141 - DNA, 20 bp, Homo sapiens
ttatgatctaataaacttta

SEQ ID NO: 5656142 - DNA, 14 bp, Homo sapiens
ttatgatctatttg

SEQ ID NO: 5656143 - DNA, 13 bp, Homo sapiens
ttatgatctggcc

SEQ ID NO: 5656144 - DNA, 15 bp, Homo sapiens
ttatgatgacgtaca

SEQ ID NO: 5656145 - DNA, 23 bp, Homo sapiens
ttatgatgacgtacaagtagttc

SEQ ID NO: 5656146 - DNA, 15 bp, Homo sapiens
ttatgatgatacagt

SEQ ID NO: 5656147 - DNA, 18 bp, Homo sapiens
ttatgatgatacagtgtt

SEQ ID NO: 5656148 - DNA, 20 bp, Homo sapiens
ttatgatgatacagtgttaa

SEQ ID NO: 5656149 - DNA, 17 bp, Homo sapiens
ttatgatgcatacagtt

SEQ ID NO: 5656150 - DNA, 21 bp, Homo sapiens
ttatgatgcatacagttttct

SEQ ID NO: 5656151 - DNA, 19 bp, Homo sapiens
ttatgatggagcaactgaa

SEQ ID NO: 5656152 - DNA, 20 bp, Homo sapiens
ttatgatggagcaactgaaa

SEQ ID NO: 5656153 - DNA, 18 bp, Homo sapiens
ttatgatgggctccccag

SEQ ID NO: 5656154 - DNA, 19 bp, Homo sapiens
ttatgatgggctccccagg

SEQ ID NO: 5656155 - DNA, 20 bp, Homo sapiens
ttatgatggttttaaacttt

SEQ ID NO: 5656156 - DNA, 20 bp, Homo sapiens
ttatgatgtgggtcaaggaa

SEQ ID NO: 5656157 - DNA, 21 bp, Homo sapiens
ttatgatgtgggtcaaggaat

SEQ ID NO: 5656158 - DNA, 11 bp, Homo sapiens
ttatgatgtta

SEQ ID NO: 5656159 - DNA, 16 bp, Homo sapiens
ttatgatgttttgcaa

SEQ ID NO: 5656160 - DNA, 14 bp, Homo sapiens
ttatgattagcttt

SEQ ID NO: 5656161 - DNA, 15 bp, Homo sapiens
ttatgatttaataaa

SEQ ID NO: 5656162 - DNA, 17 bp, Homo sapiens
ttatgatttaataaaat

SEQ ID NO: 5656163 - DNA, 16 bp, Homo sapiens
ttatgatttcatgatt

SEQ ID NO: 5656164 - DNA, 22 bp, Homo sapiens
ttatgatttcatgattagacaa

SEQ ID NO: 5656165 - DNA, 16 bp, Homo sapiens
ttatgatttccttcaa

SEQ ID NO: 5656166 - DNA, 21 bp, Homo sapiens
ttatgatttctccagaaattt

SEQ ID NO: 5656167 - DNA, 15 bp, Homo sapiens
ttatgatttgtaaca

SEQ ID NO: 5656168 - DNA, 15 bp, Homo sapiens
ttatgattttattac

SEQ ID NO: 5656169 - DNA, 14 bp, Homo sapiens
ttatgattttcata

SEQ ID NO: 5656170 - DNA, 18 bp, Homo sapiens
ttatgattttcataactt

SEQ ID NO: 5656171 - DNA, 13 bp, Homo sapiens
ttatgcaaaagca

SEQ ID NO: 5656172 - DNA, 15 bp, Homo sapiens
ttatgcaaaatggaa

SEQ ID NO: 5656173 - DNA, 17 bp, Homo sapiens
ttatgcaaaatttagaa

SEQ ID NO: 5656174 - DNA, 22 bp, Homo sapiens
ttatgcaaaatttagaagaaaa

SEQ ID NO: 5656175 - DNA, 14 bp, Homo sapiens
ttatgcaaatacaa

SEQ ID NO: 5656176 - DNA, 17 bp, Homo sapiens
ttatgcaaattcccaga

SEQ ID NO: 5656177 - DNA, 19 bp, Homo sapiens
ttatgcaacgtttaacatt

SEQ ID NO: 5656178 - DNA, 18 bp, Homo sapiens
ttatgcaaggaaggaaag

SEQ ID NO: 5656179 - DNA, 20 bp, Homo sapiens
ttatgcaagggactgtgtgt

SEQ ID NO: 5656180 - DNA, 17 bp, Homo sapiens
ttatgcaattcagtgtt

SEQ ID NO: 5656181 - DNA, 22 bp, Homo sapiens
ttatgcacagcctagttatcaa

SEQ ID NO: 5656182 - DNA, 13 bp, Homo sapiens
ttatgcactgcct

SEQ ID NO: 5656183 - DNA, 16 bp, Homo sapiens
ttatgcactgcctgcc

SEQ ID NO: 5656184 - DNA, 18 bp, Homo sapiens
ttatgcacttttagaaat

SEQ ID NO: 5656185 - DNA, 20 bp, Homo sapiens
ttatgcacttttagaaatgc

SEQ ID NO: 5656186 - DNA, 19 bp, Homo sapiens
ttatgcagaaggtattttt

SEQ ID NO: 5656187 - DNA, 20 bp, Homo sapiens
ttatgcagagacagctgttt

SEQ ID NO: 5656188 - DNA, 20 bp, Homo sapiens
ttatgcaggcagattaataa

SEQ ID NO: 5656189 - DNA, 21 bp, Homo sapiens
ttatgcaggcagattaataac

SEQ ID NO: 5656190 - DNA, 20 bp, Homo sapiens
ttatgcagtgaactattttt

SEQ ID NO: 5656191 - DNA, 19 bp, Homo sapiens
ttattggtgagttaggaac

SEQ ID NO: 5656192 - DNA, 20 bp, Homo sapiens
ttattggtggctgttcctga

SEQ ID NO: 5656193 - DNA, 18 bp, Homo sapiens
ttattggttttgcagaag

SEQ ID NO: 5656194 - DNA, 17 bp, Homo sapiens
ttattgtaaagtcctat

SEQ ID NO: 5656195 - DNA, 12 bp, Homo sapiens
ttattgtaaatt

SEQ ID NO: 5656196 - DNA, 22 bp, Homo sapiens
ttattgtaagcatctcaatctt

SEQ ID NO: 5656197 - DNA, 19 bp, Homo sapiens
ttattgtaagttgtacaaa

SEQ ID NO: 5656198 - DNA, 22 bp, Homo sapiens
ttattgtaagttgtacaaatgt

SEQ ID NO: 5656199 - DNA, 12 bp, Homo sapiens
ttattgtacctc

SEQ ID NO: 5656200 - DNA, 14 bp, Homo sapiens
ttattgtacctctc

SEQ ID NO: 5656201 - DNA, 17 bp, Homo sapiens
ttattgtacctctctta

SEQ ID NO: 5656202 - DNA, 21 bp, Homo sapiens
ttattgtacgtttaaagtgta

SEQ ID NO: 5656203 - DNA, 16 bp, Homo sapiens
ttattgtataaaaagt

SEQ ID NO: 5656204 - DNA, 14 bp, Homo sapiens
ttattgtataaact

SEQ ID NO: 5656205 - DNA, 14 bp, Homo sapiens
ttattgtatattga

SEQ ID NO: 5656206 - DNA, 14 bp, Homo sapiens
ttattgtatttatg

SEQ ID NO: 5656207 - DNA, 18 bp, Homo sapiens
ttattgtcagacacttat

SEQ ID NO: 5656208 - DNA, 23 bp, Homo sapiens
ttattgtcattactgcctttgga

SEQ ID NO: 5656209 - DNA, 21 bp, Homo sapiens
ttattgtctgtctacatttct

SEQ ID NO: 5656210 - DNA, 22 bp, Homo sapiens
ttattgtctgtctacatttctg

SEQ ID NO: 5656211 - DNA, 12 bp, Homo sapiens
ttattgtcttta

SEQ ID NO: 5656212 - DNA, 23 bp, Homo sapiens
ttattgtgctgggtcccagcctg

SEQ ID NO: 5656213 - DNA, 20 bp, Homo sapiens
ttattgtggtaggcctttta

SEQ ID NO: 5656214 - DNA, 18 bp, Homo sapiens
ttattgtgtgcgctgcct

SEQ ID NO: 5656215 - DNA, 19 bp, Homo sapiens
ttattgtgtgcgctgcctg

SEQ ID NO: 5656216 - DNA, 23 bp, Homo sapiens
ttattgtgttgccttagcacttc

SEQ ID NO: 5656217 - DNA, 15 bp, Homo sapiens
ttattgtgtttgtca

SEQ ID NO: 5656218 - DNA, 18 bp, Homo sapiens
ttattgtgtttgtcatta

SEQ ID NO: 5656219 - DNA, 22 bp, Homo sapiens
ttattgtgtttgtcattagcct

SEQ ID NO: 5656220 - DNA, 15 bp, Homo sapiens
ttattgttaaattac

SEQ ID NO: 5656221 - DNA, 16 bp, Homo sapiens
ttattgttccaagaca

SEQ ID NO: 5656222 - DNA, 19 bp, Homo sapiens
ttattgttccaagacattg

SEQ ID NO: 5656223 - DNA, 22 bp, Homo sapiens
ttattgttccaagacattgtca

SEQ ID NO: 5656224 - DNA, 14 bp, Homo sapiens
ttattgttctttca

SEQ ID NO: 5656225 - DNA, 14 bp, Homo sapiens
ttattgttgccttt

SEQ ID NO: 5656226 - DNA, 22 bp, Homo sapiens
ttattgtttaaagcaactgtct

SEQ ID NO: 5656227 - DNA, 13 bp, Homo sapiens
ttattgtttgaaa

SEQ ID NO: 5656228 - DNA, 13 bp, Homo sapiens
ttatttaaaaaag

SEQ ID NO: 5656229 - DNA, 15 bp, Homo sapiens
ttatttaaaactctg

SEQ ID NO: 5656230 - DNA, 18 bp, Homo sapiens
ttatttaaaactctggtg

SEQ ID NO: 5656231 - DNA, 14 bp, Homo sapiens
ttatttaaaagatt

SEQ ID NO: 5656232 - DNA, 17 bp, Homo sapiens
ttatttaaaagattcat

SEQ ID NO: 5656233 - DNA, 15 bp, Homo sapiens
ttatttaaaatagca

SEQ ID NO: 5656234 - DNA, 16 bp, Homo sapiens
ttatttaaaatagcaa

SEQ ID NO: 5656235 - DNA, 21 bp, Homo sapiens
ttatttaaaatagcaaaagaa

SEQ ID NO: 5656236 - DNA, 14 bp, Homo sapiens
ttatttaaactatt

SEQ ID NO: 5656237 - DNA, 15 bp, Homo sapiens
ttatttaaatgcttt

SEQ ID NO: 5656238 - DNA, 18 bp, Homo sapiens
ttatttaaatgtacttat

SEQ ID NO: 5656239 - DNA, 16 bp, Homo sapiens
ttatttaacaaaaaat

SEQ ID NO: 5656240 - DNA, 20 bp, Homo sapiens
ttatttaacaaaaaatgtaa

SEQ ID NO: 5656241 - DNA, 13 bp, Homo sapiens
ttatttaacagct

SEQ ID NO: 5656242 - DNA, 23 bp, Homo sapiens
ttatttaacagctgaattatcta

SEQ ID NO: 5656243 - DNA, 12 bp, Homo sapiens
ttatttaactct

SEQ ID NO: 5656244 - DNA, 17 bp, Homo sapiens
ttatttaaggatggatg

SEQ ID NO: 5656245 - DNA, 16 bp, Homo sapiens
ttatttaagttgtgat

SEQ ID NO: 5656246 - DNA, 12 bp, Homo sapiens
ttatttaataac

SEQ ID NO: 5656247 - DNA, 13 bp, Homo sapiens
ttatttaataaca

SEQ ID NO: 5656248 - DNA, 14 bp, Homo sapiens
ttatttaataacaa

SEQ ID NO: 5656249 - DNA, 13 bp, Homo sapiens
ttatttaataaga

SEQ ID NO: 5656250 - DNA, 18 bp, Homo sapiens
ttatttaatagctgtgat

SEQ ID NO: 5656251 - DNA, 13 bp, Homo sapiens
ttatttaatatgc

SEQ ID NO: 5656252 - DNA, 18 bp, Homo sapiens
ttatttaatatgcatctt

SEQ ID NO: 5656253 - DNA, 18 bp, Homo sapiens
ttatttaatgaaagactg

SEQ ID NO: 5656254 - DNA, 15 bp, Homo sapiens
ttatttaatgtgagt

SEQ ID NO: 5656255 - DNA, 14 bp, Homo sapiens
ttatttaatgtttg

SEQ ID NO: 5656256 - DNA, 14 bp, Homo sapiens
ttatttaattaaaa

SEQ ID NO: 5656257 - DNA, 15 bp, Homo sapiens
ttatttaatttcata

SEQ ID NO: 5656258 - DNA, 18 bp, Homo sapiens
ttatttaatttcataaat

SEQ ID NO: 5656259 - DNA, 19 bp, Homo sapiens
ttatttaatttcataaatt

SEQ ID NO: 5656260 - DNA, 15 bp, Homo sapiens
ttatttacagctgtg

SEQ ID NO: 5656261 - DNA, 18 bp, Homo sapiens
ttatttacagctgtgctc

SEQ ID NO: 5656262 - DNA, 24 bp, Homo sapiens
ttatttacatcactttgtgaatta

SEQ ID NO: 5656263 - DNA, 14 bp, Homo sapiens
ttatttagaaactg

SEQ ID NO: 5656264 - DNA, 15 bp, Homo sapiens
ttatttagaaactgg

SEQ ID NO: 5656265 - DNA, 17 bp, Homo sapiens
ttatttagaaactggtt

SEQ ID NO: 5656266 - DNA, 15 bp, Homo sapiens
ttatttagacaagag

SEQ ID NO: 5656267 - DNA, 13 bp, Homo sapiens
ttatttataaaat

SEQ ID NO: 5656268 - DNA, 20 bp, Homo sapiens
ttatttatatgaagcaagct

SEQ ID NO: 5656269 - DNA, 13 bp, Homo sapiens
ttatttatatgta

SEQ ID NO: 5656270 - DNA, 14 bp, Homo sapiens
ttatttatatgtac

SEQ ID NO: 5656271 - DNA, 15 bp, Homo sapiens
ttatttatatgtact

SEQ ID NO: 5656272 - DNA, 15 bp, Homo sapiens
ttatttatatttatt

SEQ ID NO: 5656273 - DNA, 15 bp, Homo sapiens
ttatttatctgagca

SEQ ID NO: 5656274 - DNA, 13 bp, Homo sapiens
ttatttatgatgt

SEQ ID NO: 5656275 - DNA, 22 bp, Homo sapiens
ttatttatgcgtaatttaatgg

SEQ ID NO: 5656276 - DNA, 14 bp, Homo sapiens
ttatttatggtttc

SEQ ID NO: 5656277 - DNA, 14 bp, Homo sapiens
ttatttatgtattg

SEQ ID NO: 5656278 - DNA, 15 bp, Homo sapiens
ttatttatgtattgt

SEQ ID NO: 5656279 - DNA, 21 bp, Homo sapiens
ttatttatgtattgtgcaatg

SEQ ID NO: 5656280 - DNA, 14 bp, Homo sapiens
ttatttattactgt

SEQ ID NO: 5656281 - DNA, 17 bp, Homo sapiens
ttatttattactgtccc

SEQ ID NO: 5656282 - DNA, 15 bp, Homo sapiens
ttatttattattaat

SEQ ID NO: 5656283 - DNA, 12 bp, Homo sapiens
ttatttattctg

SEQ ID NO: 5656284 - DNA, 14 bp, Homo sapiens
ttatttattggcaa

SEQ ID NO: 5656285 - DNA, 15 bp, Homo sapiens
ttatttattgttaaa

SEQ ID NO: 5656286 - DNA, 14 bp, Homo sapiens
ttatttatttattg

SEQ ID NO: 5656287 - DNA, 12 bp, Homo sapiens
ttatttatttct

SEQ ID NO: 5656288 - DNA, 15 bp, Homo sapiens
ttatttattttagca

SEQ ID NO: 5656289 - DNA, 23 bp, Homo sapiens
ttatttcaaaatatacattcaaa

SEQ ID NO: 5656290 - DNA, 22 bp, Homo sapiens
ttatttcaaccgcttgccatat

SEQ ID NO: 5656291 - DNA, 16 bp, Homo sapiens
ttatttcaataaatct

SEQ ID NO: 5656292 - DNA, 12 bp, Homo sapiens
ttatttcaatgt

SEQ ID NO: 5656293 - DNA, 16 bp, Homo sapiens
ttatttcaatgtaatt

SEQ ID NO: 5656294 - DNA, 13 bp, Homo sapiens
ttatttcaattgt

SEQ ID NO: 5656295 - DNA, 23 bp, Homo sapiens
ttatttcacacgctgttctaatg

SEQ ID NO: 5656296 - DNA, 16 bp, Homo sapiens
ttatttcaccagcagc

SEQ ID NO: 5656297 - DNA, 20 bp, Homo sapiens
ttatttcactatcttcttca

SEQ ID NO: 5656298 - DNA, 21 bp, Homo sapiens
ttatttcactttagatgctga

SEQ ID NO: 5656299 - DNA, 11 bp, Homo sapiens
ttatttcagaa

SEQ ID NO: 5656300 - DNA, 23 bp, Homo sapiens
ttatttcagattttgataactgt

SEQ ID NO: 5656301 - DNA, 15 bp, Homo sapiens
ttatttcataccatt

SEQ ID NO: 5656302 - DNA, 20 bp, Homo sapiens
ttatttcatatactataatt

SEQ ID NO: 5656303 - DNA, 14 bp, Homo sapiens
ttatttcatccagt

SEQ ID NO: 5656304 - DNA, 12 bp, Homo sapiens
ttatttcatgac

SEQ ID NO: 5656305 - DNA, 16 bp, Homo sapiens
ttatttcatgtcttta

SEQ ID NO: 5656306 - DNA, 13 bp, Homo sapiens
ttatttcattcat

SEQ ID NO: 5656307 - DNA, 16 bp, Homo sapiens
ttatttcattcatatc

SEQ ID NO: 5656308 - DNA, 15 bp, Homo sapiens
ttatttccaaaataa

SEQ ID NO: 5656309 - DNA, 17 bp, Homo sapiens
ttatttccaaataaaat

SEQ ID NO: 5656310 - DNA, 17 bp, Homo sapiens
ttatttccacataaagg

SEQ ID NO: 5656311 - DNA, 19 bp, Homo sapiens
ttatttccactaaaaatat

SEQ ID NO: 5656312 - DNA, 19 bp, Homo sapiens
ttatttccaggtaatatgt

SEQ ID NO: 5656313 - DNA, 13 bp, Homo sapiens
ttatttccatatt

SEQ ID NO: 5656314 - DNA, 16 bp, Homo sapiens
ttatttccatattaaa

SEQ ID NO: 5656315 - DNA, 19 bp, Homo sapiens
ttatttcctagttctgtag

SEQ ID NO: 5656316 - DNA, 11 bp, Homo sapiens
ttatttcctat

SEQ ID NO: 5656317 - DNA, 21 bp, Homo sapiens
ttatttcctatagctacatgt

SEQ ID NO: 5656318 - DNA, 20 bp, Homo sapiens
ttatttcctatgatgtatac

SEQ ID NO: 5656319 - DNA, 22 bp, Homo sapiens
ttatttcctatgatgtatactg

SEQ ID NO: 5656320 - DNA, 15 bp, Homo sapiens
ttatttcctgattac

SEQ ID NO: 5656321 - DNA, 13 bp, Homo sapiens
ttatttcctgcta

SEQ ID NO: 5656322 - DNA, 14 bp, Homo sapiens
ttatttctaaaata

SEQ ID NO: 5656323 - DNA, 18 bp, Homo sapiens
ttatttctagctttttaa

SEQ ID NO: 5656324 - DNA, 18 bp, Homo sapiens
ttatttctagtccaaaat

SEQ ID NO: 5656325 - DNA, 16 bp, Homo sapiens
ttatttctcagctgtg

SEQ ID NO: 5656326 - DNA, 16 bp, Homo sapiens
ttatttctccatcccc

SEQ ID NO: 5656327 - DNA, 19 bp, Homo sapiens
ttatttctcgggtgcattt

SEQ ID NO: 5656328 - DNA, 14 bp, Homo sapiens
ttatttctctctcc

SEQ ID NO: 5656329 - DNA, 14 bp, Homo sapiens
ttatttctctgatt

SEQ ID NO: 5656330 - DNA, 16 bp, Homo sapiens
ttatttctgaaaaaga

SEQ ID NO: 5656331 - DNA, 18 bp, Homo sapiens
ttatttctgagcaaagca

SEQ ID NO: 5656332 - DNA, 13 bp, Homo sapiens
ttatttctgatgt

SEQ ID NO: 5656333 - DNA, 15 bp, Homo sapiens
ttatttctgatgttt

SEQ ID NO: 5656334 - DNA, 15 bp, Homo sapiens
ttatttctgatttca

SEQ ID NO: 5656335 - DNA, 11 bp, Homo sapiens
ttatttctgca

SEQ ID NO: 5656336 - DNA, 15 bp, Homo sapiens
ttatttctgcttcct

SEQ ID NO: 5656337 - DNA, 12 bp, Homo sapiens
ttatttctgtaa

SEQ ID NO: 5656338 - DNA, 19 bp, Homo sapiens
ttatttctgtatatagatg

SEQ ID NO: 5656339 - DNA, 15 bp, Homo sapiens
ttatttctgtatctg

SEQ ID NO: 5656340 - DNA, 11 bp, Homo sapiens
ttatttctgtt

SEQ ID NO: 5656341 - DNA, 14 bp, Homo sapiens
ttatttcttccctg

SEQ ID NO: 5656342 - DNA, 14 bp, Homo sapiens
ttatttcttcgtga

SEQ ID NO: 5656343 - DNA, 14 bp, Homo sapiens
ttatttctttatta

SEQ ID NO: 5656344 - DNA, 20 bp, Homo sapiens
ttatttgaaaacactgctgt

SEQ ID NO: 5656345 - DNA, 20 bp, Homo sapiens
ttatttgaatgaacactatg

SEQ ID NO: 5656346 - DNA, 12 bp, Homo sapiens
ttatttgagaag

SEQ ID NO: 5656347 - DNA, 19 bp, Homo sapiens
ttatttgaggtcagtgttt

SEQ ID NO: 5656348 - DNA, 20 bp, Homo sapiens
ttatttgattatttaagact

SEQ ID NO: 5656349 - DNA, 11 bp, Homo sapiens
ttatttgcata

SEQ ID NO: 5656350 - DNA, 14 bp, Homo sapiens
ttatttgcatgtta

SEQ ID NO: 5656351 - DNA, 21 bp, Homo sapiens
ttatttgcatgttatgtttaa

SEQ ID NO: 5656352 - DNA, 20 bp, Homo sapiens
ttatttgccctaagaacttt

SEQ ID NO: 5656353 - DNA, 17 bp, Homo sapiens
ttatttgccttctgaaa

SEQ ID NO: 5656354 - DNA, 16 bp, Homo sapiens
ttatttgctaagcata

SEQ ID NO: 5656355 - DNA, 18 bp, Homo sapiens
ttatttgctcataagtaa

SEQ ID NO: 5656356 - DNA, 15 bp, Homo sapiens
ttatttgctgttaac

SEQ ID NO: 5656357 - DNA, 21 bp, Homo sapiens
ttatttggaaatattctatga

SEQ ID NO: 5656358 - DNA, 18 bp, Homo sapiens
ttatttggaaattttagt

SEQ ID NO: 5656359 - DNA, 23 bp, Homo sapiens
ttatttggagtggaggcattgtt

SEQ ID NO: 5656360 - DNA, 19 bp, Homo sapiens
ttatttggggttgcatcag

SEQ ID NO: 5656361 - DNA, 20 bp, Homo sapiens
ttatttgtaaaccattgtaa

SEQ ID NO: 5656362 - DNA, 18 bp, Homo sapiens
ttatttgtaatagatgtt

SEQ ID NO: 5656363 - DNA, 16 bp, Homo sapiens
ttatttgtaattttaa

SEQ ID NO: 5656364 - DNA, 15 bp, Homo sapiens
ttatttgtacagttc

SEQ ID NO: 5656365 - DNA, 12 bp, Homo sapiens
ttatttgtatta

SEQ ID NO: 5656366 - DNA, 13 bp, Homo sapiens
ttatttgtattac

SEQ ID NO: 5656367 - DNA, 12 bp, Homo sapiens
ttatttgtcaaa

SEQ ID NO: 5656368 - DNA, 15 bp, Homo sapiens
ttatttgtctgtaaa

SEQ ID NO: 5656369 - DNA, 23 bp, Homo sapiens
ttatttgtctgtaaaaaatggag

SEQ ID NO: 5656370 - DNA, 14 bp, Homo sapiens
ttatttgtgaaact

SEQ ID NO: 5656371 - DNA, 23 bp, Homo sapiens
ttatttgtgcattttattgactg

SEQ ID NO: 5656372 - DNA, 12 bp, Homo sapiens
ttcaatatgcaa

SEQ ID NO: 5656373 - DNA, 19 bp, Homo sapiens
ttcaatattatgaattcac

SEQ ID NO: 5656374 - DNA, 16 bp, Homo sapiens
ttcaatattgaatttt

SEQ ID NO: 5656375 - DNA, 14 bp, Homo sapiens
ttcaatattgacat

SEQ ID NO: 5656376 - DNA, 21 bp, Homo sapiens
ttcaatattgacatttgtagt

SEQ ID NO: 5656377 - DNA, 14 bp, Homo sapiens
ttcaatcaaagcta

SEQ ID NO: 5656378 - DNA, 15 bp, Homo sapiens
ttcaatcaaagctac

SEQ ID NO: 5656379 - DNA, 20 bp, Homo sapiens
ttcaatcactagtcaagaaa

SEQ ID NO: 5656380 - DNA, 19 bp, Homo sapiens
ttcaatcactgtaacctga

SEQ ID NO: 5656381 - DNA, 23 bp, Homo sapiens
ttcaatcagagctccagtttgca

SEQ ID NO: 5656382 - DNA, 19 bp, Homo sapiens
ttcaatcattttgggaaat

SEQ ID NO: 5656383 - DNA, 21 bp, Homo sapiens
ttcaatccagagagcttaaat

SEQ ID NO: 5656384 - DNA, 22 bp, Homo sapiens
ttcaatccagagagcttaaatt

SEQ ID NO: 5656385 - DNA, 17 bp, Homo sapiens
ttcaatcctacttttcg

SEQ ID NO: 5656386 - DNA, 22 bp, Homo sapiens
ttcaatcctgtcaatgtttgct

SEQ ID NO: 5656387 - DNA, 22 bp, Homo sapiens
ttcaatccttgaaggtatatct

SEQ ID NO: 5656388 - DNA, 22 bp, Homo sapiens
ttcaatctcgtatagaagtctt

SEQ ID NO: 5656389 - DNA, 20 bp, Homo sapiens
ttcaatctcgtttagtgcca

SEQ ID NO: 5656390 - DNA, 12 bp, Homo sapiens
ttcaatctctgt

SEQ ID NO: 5656391 - DNA, 19 bp, Homo sapiens
ttcaatctggattcatatt

SEQ ID NO: 5656392 - DNA, 15 bp, Homo sapiens
ttcaatctgtaaact

SEQ ID NO: 5656393 - DNA, 17 bp, Homo sapiens
ttcaatctgtaaactgt

SEQ ID NO: 5656394 - DNA, 18 bp, Homo sapiens
ttcaatctgtaaactgtg

SEQ ID NO: 5656395 - DNA, 16 bp, Homo sapiens
ttcaatctttgctgta

SEQ ID NO: 5656396 - DNA, 13 bp, Homo sapiens
ttcaatcttttaa

SEQ ID NO: 5656397 - DNA, 17 bp, Homo sapiens
ttcaatgacttctaatt

SEQ ID NO: 5656398 - DNA, 16 bp, Homo sapiens
ttcaatgatagtaaga

SEQ ID NO: 5656399 - DNA, 15 bp, Homo sapiens
ttcaatgatctaggt

SEQ ID NO: 5656400 - DNA, 23 bp, Homo sapiens
ttcaatgatctaggtttaactca

SEQ ID NO: 5656401 - DNA, 16 bp, Homo sapiens
ttcaatgcaatgaaaa

SEQ ID NO: 5656402 - DNA, 23 bp, Homo sapiens
ttcaatgcaatgaaaacaaaatt

SEQ ID NO: 5656403 - DNA, 21 bp, Homo sapiens
ttcaatgcaatgcatctgaaa

SEQ ID NO: 5656404 - DNA, 18 bp, Homo sapiens
ttcaatgcatacaataaa

SEQ ID NO: 5656405 - DNA, 21 bp, Homo sapiens
ttcaatgcatacaataaaaga

SEQ ID NO: 5656406 - DNA, 22 bp, Homo sapiens
ttcaatgccaatgagtctgtaa

SEQ ID NO: 5656407 - DNA, 21 bp, Homo sapiens
ttcaatgcgttttgttgtaga

SEQ ID NO: 5656408 - DNA, 16 bp, Homo sapiens
ttcaatgcttctatca

SEQ ID NO: 5656409 - DNA, 23 bp, Homo sapiens
ttcaatgcttctatcagactcag

SEQ ID NO: 5656410 - DNA, 23 bp, Homo sapiens
ttcaatgggagtgaacatttcta

SEQ ID NO: 5656411 - DNA, 22 bp, Homo sapiens
ttcaatgggtaaataaatgctg

SEQ ID NO: 5656412 - DNA, 23 bp, Homo sapiens
ttcaatgggtaaataaatgctgc

SEQ ID NO: 5656413 - DNA, 22 bp, Homo sapiens
ttcaatggtagattcgctgtcc

SEQ ID NO: 5656414 - DNA, 18 bp, Homo sapiens
ttcaatggttgggacaat

SEQ ID NO: 5656415 - DNA, 15 bp, Homo sapiens
ttcaatgtaattaaa

SEQ ID NO: 5656416 - DNA, 19 bp, Homo sapiens
ttcaatgtcagcctttgtt

SEQ ID NO: 5656417 - DNA, 23 bp, Homo sapiens
ttcaatgtccacctgtgagaaag

SEQ ID NO: 5656418 - DNA, 11 bp, Homo sapiens
ttcaatgtgaa

SEQ ID NO: 5656419 - DNA, 21 bp, Homo sapiens
ttcaatgtgaaacacatgcca

SEQ ID NO: 5656420 - DNA, 21 bp, Homo sapiens
ttcaatgtgattctaatgtct

SEQ ID NO: 5656421 - DNA, 15 bp, Homo sapiens
ttcaatgtgattctt

SEQ ID NO: 5656422 - DNA, 18 bp, Homo sapiens
ttcaatgtgttggaaact

SEQ ID NO: 5656423 - DNA, 18 bp, Homo sapiens
ttcaatgtgtttaatttt

SEQ ID NO: 5656424 - DNA, 17 bp, Homo sapiens
ttcaatgttaaatctac

SEQ ID NO: 5656425 - DNA, 13 bp, Homo sapiens
ttcaatgttccat

SEQ ID NO: 5656426 - DNA, 12 bp, Homo sapiens
ttcaattaaaac

SEQ ID NO: 5656427 - DNA, 15 bp, Homo sapiens
ttcaattaaagaaat

SEQ ID NO: 5656428 - DNA, 21 bp, Homo sapiens
ttcaattacaaagcagttact

SEQ ID NO: 5656429 - DNA, 15 bp, Homo sapiens
ttcaattatattgtt

SEQ ID NO: 5656430 - DNA, 15 bp, Homo sapiens
ttcaattatgtttga

SEQ ID NO: 5656431 - DNA, 19 bp, Homo sapiens
ttcaattcaaaaatgtaca

SEQ ID NO: 5656432 - DNA, 17 bp, Homo sapiens
ttcaattcatagaataa

SEQ ID NO: 5656433 - DNA, 18 bp, Homo sapiens
ttcaattcatagaataac

SEQ ID NO: 5656434 - DNA, 17 bp, Homo sapiens
ttcaattccaccagggc

SEQ ID NO: 5656435 - DNA, 18 bp, Homo sapiens
ttcaattccaccagggcc

SEQ ID NO: 5656436 - DNA, 20 bp, Homo sapiens
ttcaattccaccagggccag

SEQ ID NO: 5656437 - DNA, 12 bp, Homo sapiens
ttcaattcctct

SEQ ID NO: 5656438 - DNA, 16 bp, Homo sapiens
ttcaattcctggccct

SEQ ID NO: 5656439 - DNA, 12 bp, Homo sapiens
ttcaattgtaaa

SEQ ID NO: 5656440 - DNA, 13 bp, Homo sapiens
ttcaattgtattt

SEQ ID NO: 5656441 - DNA, 12 bp, Homo sapiens
ttcaattgtgaa

SEQ ID NO: 5656442 - DNA, 14 bp, Homo sapiens
ttcaattgtttata

SEQ ID NO: 5656443 - DNA, 15 bp, Homo sapiens
ttcaattgtttatat

SEQ ID NO: 5656444 - DNA, 15 bp, Homo sapiens
ttcaatttatacctc

SEQ ID NO: 5656445 - DNA, 14 bp, Homo sapiens
ttcaatttcaaact

SEQ ID NO: 5656446 - DNA, 17 bp, Homo sapiens
ttcaatttccaagagct

SEQ ID NO: 5656447 - DNA, 19 bp, Homo sapiens
ttcaatttccaagagctga

SEQ ID NO: 5656448 - DNA, 16 bp, Homo sapiens
ttcaatttgatgtggt

SEQ ID NO: 5656449 - DNA, 22 bp, Homo sapiens
ttcaatttggagcattaactaa

SEQ ID NO: 5656450 - DNA, 19 bp, Homo sapiens
ttcaatttgtcatgttact

SEQ ID NO: 5656451 - DNA, 18 bp, Homo sapiens
ttcaatttgttaacagag

SEQ ID NO: 5656452 - DNA, 12 bp, Homo sapiens
ttcaatttgttc

SEQ ID NO: 5656453 - DNA, 17 bp, Homo sapiens
ttcaattttaaacatat

SEQ ID NO: 5656454 - DNA, 14 bp, Homo sapiens
ttcaattttaaaga

SEQ ID NO: 5656455 - DNA, 14 bp, Homo sapiens
ttcacaaaatgcaa

SEQ ID NO: 5656456 - DNA, 19 bp, Homo sapiens
ttcacaaaatgtctcagtt

SEQ ID NO: 5656457 - DNA, 22 bp, Homo sapiens
ttcacaaaatgtctcagttttc

SEQ ID NO: 5656458 - DNA, 15 bp, Homo sapiens
ttcacaaacattagt

SEQ ID NO: 5656459 - DNA, 19 bp, Homo sapiens
ttcacaaactacctctgga

SEQ ID NO: 5656460 - DNA, 15 bp, Homo sapiens
ttcacaaagcccaag

SEQ ID NO: 5656461 - DNA, 18 bp, Homo sapiens
ttcacaaagtaatttgga

SEQ ID NO: 5656462 - DNA, 11 bp, Homo sapiens
ttcacaaatat

SEQ ID NO: 5656463 - DNA, 14 bp, Homo sapiens
ttcacaaatatagt

SEQ ID NO: 5656464 - DNA, 12 bp, Homo sapiens
ttcacaaatatt

SEQ ID NO: 5656465 - DNA, 19 bp, Homo sapiens
ttcacaaatattaaaaagt

SEQ ID NO: 5656466 - DNA, 20 bp, Homo sapiens
ttcacaaatattaaaaagtc

SEQ ID NO: 5656467 - DNA, 15 bp, Homo sapiens
ttcacaacagatttc

SEQ ID NO: 5656468 - DNA, 17 bp, Homo sapiens
ttcacaacagatttcta

SEQ ID NO: 5656469 - DNA, 22 bp, Homo sapiens
ttcacaacagcctgacaacatt

SEQ ID NO: 5656470 - DNA, 15 bp, Homo sapiens
ttcacaacaggcatt

SEQ ID NO: 5656471 - DNA, 16 bp, Homo sapiens
ttcacaacctcaccaa

SEQ ID NO: 5656472 - DNA, 12 bp, Homo sapiens
ttcacaactagg

SEQ ID NO: 5656473 - DNA, 15 bp, Homo sapiens
ttcacaactttgctt

SEQ ID NO: 5656474 - DNA, 23 bp, Homo sapiens
ttcacaagacccaaaaggcagaa

SEQ ID NO: 5656475 - DNA, 16 bp, Homo sapiens
ttcacaagctaacttc

SEQ ID NO: 5656476 - DNA, 13 bp, Homo sapiens
ttcacaagctgcc

SEQ ID NO: 5656477 - DNA, 14 bp, Homo sapiens
ttcacaagctgcct

SEQ ID NO: 5656478 - DNA, 18 bp, Homo sapiens
ttcacaagctgcctccct

SEQ ID NO: 5656479 - DNA, 16 bp, Homo sapiens
ttcacaaggtataata

SEQ ID NO: 5656480 - DNA, 15 bp, Homo sapiens
ttcacaataaaagct

SEQ ID NO: 5656481 - DNA, 20 bp, Homo sapiens
ttcacaatgaaatgctctcc

SEQ ID NO: 5656482 - DNA, 17 bp, Homo sapiens
ttcacaatggaaacttt

SEQ ID NO: 5656483 - DNA, 22 bp, Homo sapiens
ttcacaatggtgctcatttcat

SEQ ID NO: 5656484 - DNA, 18 bp, Homo sapiens
ttcacaatgtgaaactga

SEQ ID NO: 5656485 - DNA, 19 bp, Homo sapiens
ttcacaatgtgaaactgaa

SEQ ID NO: 5656486 - DNA, 20 bp, Homo sapiens
ttcacaatgtgaaactgaag

SEQ ID NO: 5656487 - DNA, 18 bp, Homo sapiens
ttcacacaaagtgaaatt

SEQ ID NO: 5656488 - DNA, 14 bp, Homo sapiens
ttcacacacacaca

SEQ ID NO: 5656489 - DNA, 14 bp, Homo sapiens
ttcacacacagcct

SEQ ID NO: 5656490 - DNA, 16 bp, Homo sapiens
ttcacacacagcctgg

SEQ ID NO: 5656491 - DNA, 20 bp, Homo sapiens
ttcacacacagcctggcctc

SEQ ID NO: 5656492 - DNA, 21 bp, Homo sapiens
ttcacacacagcctggcctcc

SEQ ID NO: 5656493 - DNA, 13 bp, Homo sapiens
ttcacacacccct

SEQ ID NO: 5656494 - DNA, 22 bp, Homo sapiens
ttcacacatctgggtgccctga

SEQ ID NO: 5656495 - DNA, 12 bp, Homo sapiens
ttcacacatgcc

SEQ ID NO: 5656496 - DNA, 16 bp, Homo sapiens
ttcacaccccacctgc

SEQ ID NO: 5656497 - DNA, 13 bp, Homo sapiens
ttcacaccccagg

SEQ ID NO: 5656498 - DNA, 23 bp, Homo sapiens
ttcacacccctcagcgctccctg

SEQ ID NO: 5656499 - DNA, 11 bp, Homo sapiens
ttcacaccctg

SEQ ID NO: 5656500 - DNA, 12 bp, Homo sapiens
ttcacaccctgc

SEQ ID NO: 5656501 - DNA, 15 bp, Homo sapiens
ttcacaccctgcaag

SEQ ID NO: 5656502 - DNA, 17 bp, Homo sapiens
ttcacacctcacgctct

SEQ ID NO: 5656503 - DNA, 19 bp, Homo sapiens
ttcacacctgactctgaaa

SEQ ID NO: 5656504 - DNA, 20 bp, Homo sapiens
ttcacactatcaacactgca

SEQ ID NO: 5656505 - DNA, 22 bp, Homo sapiens
ttcacactctcacatgtttaga

SEQ ID NO: 5656506 - DNA, 21 bp, Homo sapiens
ttcacactgcaagagccttgg

SEQ ID NO: 5656507 - DNA, 18 bp, Homo sapiens
ttcacactggtaaatgtt

SEQ ID NO: 5656508 - DNA, 17 bp, Homo sapiens
ttcacactgtcttcccg

SEQ ID NO: 5656509 - DNA, 18 bp, Homo sapiens
ttcacagaaaaagcatga

SEQ ID NO: 5656510 - DNA, 12 bp, Homo sapiens
ttcacagaaaac

SEQ ID NO: 5656511 - DNA, 19 bp, Homo sapiens
ttcacagaaaacattgact

SEQ ID NO: 5656512 - DNA, 13 bp, Homo sapiens
ttcacagaaaata

SEQ ID NO: 5656513 - DNA, 22 bp, Homo sapiens
ttcacagaccaagtccaagccc

SEQ ID NO: 5656514 - DNA, 17 bp, Homo sapiens
ttcacagagactgtttg

SEQ ID NO: 5656515 - DNA, 16 bp, Homo sapiens
ttcacagagcacgcct

SEQ ID NO: 5656516 - DNA, 13 bp, Homo sapiens
ttcacagagtaca

SEQ ID NO: 5656517 - DNA, 15 bp, Homo sapiens
ttcacagagtacaaa

SEQ ID NO: 5656518 - DNA, 12 bp, Homo sapiens
ttcacagagtgt

SEQ ID NO: 5656519 - DNA, 16 bp, Homo sapiens
ttcacagatgctgtgt

SEQ ID NO: 5656520 - DNA, 16 bp, Homo sapiens
ttcacagcaacatttt

SEQ ID NO: 5656521 - DNA, 22 bp, Homo sapiens
ttcacagcaacattttcttgaa

SEQ ID NO: 5656522 - DNA, 15 bp, Homo sapiens
ttcacagcacgggca

SEQ ID NO: 5656523 - DNA, 19 bp, Homo sapiens
ttcacagcacttacaattt

SEQ ID NO: 5656524 - DNA, 12 bp, Homo sapiens
ttcacagcccag

SEQ ID NO: 5656525 - DNA, 14 bp, Homo sapiens
ttcacagcctccgc

SEQ ID NO: 5656526 - DNA, 23 bp, Homo sapiens
ttcacagctctgtgttgccatgt

SEQ ID NO: 5656527 - DNA, 14 bp, Homo sapiens
ttcacagcttcttt

SEQ ID NO: 5656528 - DNA, 18 bp, Homo sapiens
ttcacagctttgaggaac

SEQ ID NO: 5656529 - DNA, 15 bp, Homo sapiens
ttcacagcttttctt

SEQ ID NO: 5656530 - DNA, 14 bp, Homo sapiens
ttcacaggcagcca

SEQ ID NO: 5656531 - DNA, 19 bp, Homo sapiens
ttcacaggcagccagtgcc

SEQ ID NO: 5656532 - DNA, 16 bp, Homo sapiens
ttcacaggcagtgcat

SEQ ID NO: 5656533 - DNA, 18 bp, Homo sapiens
ttcacaggcagtgcatgt

SEQ ID NO: 5656534 - DNA, 15 bp, Homo sapiens
ttcacaggtcaataa

SEQ ID NO: 5656535 - DNA, 23 bp, Homo sapiens
ttcacaggtggacaaatgttgtc

SEQ ID NO: 5656536 - DNA, 18 bp, Homo sapiens
ttcacaggttttatgtgt

SEQ ID NO: 5656537 - DNA, 18 bp, Homo sapiens
ttcacagtagagccagct

SEQ ID NO: 5656538 - DNA, 13 bp, Homo sapiens
ttcacagtcccag

SEQ ID NO: 5656539 - DNA, 16 bp, Homo sapiens
ttcacagtctggtgct

SEQ ID NO: 5656540 - DNA, 17 bp, Homo sapiens
ttcacagtctggtgctt

SEQ ID NO: 5656541 - DNA, 18 bp, Homo sapiens
ttcacagtgaagtgcctt

SEQ ID NO: 5656542 - DNA, 20 bp, Homo sapiens
ttcacagtgcccaagagtgg

SEQ ID NO: 5656543 - DNA, 15 bp, Homo sapiens
ttcacagtgctcttt

SEQ ID NO: 5656544 - DNA, 14 bp, Homo sapiens
ttcacagtgtctgt

SEQ ID NO: 5656545 - DNA, 18 bp, Homo sapiens
ttcacagttcctctttgt

SEQ ID NO: 5656546 - DNA, 13 bp, Homo sapiens
ttcacagttctct

SEQ ID NO: 5656547 - DNA, 20 bp, Homo sapiens
ttcacagttctgtaatgtag

SEQ ID NO: 5656548 - DNA, 23 bp, Homo sapiens
ttcacagttggctggatgaaatt

SEQ ID NO: 5656549 - DNA, 14 bp, Homo sapiens
ttcacagtttgaaa

SEQ ID NO: 5656550 - DNA, 17 bp, Homo sapiens
ttcacagtttgaaataa

SEQ ID NO: 5656551 - DNA, 16 bp, Homo sapiens
ttcagctggcagagtt

SEQ ID NO: 5656552 - DNA, 21 bp, Homo sapiens
ttcagctggttgaggtttcaa

SEQ ID NO: 5656553 - DNA, 21 bp, Homo sapiens
ttcagctgtatgaaagggacg

SEQ ID NO: 5656554 - DNA, 23 bp, Homo sapiens
ttcagctgtgctttttgcaaaag

SEQ ID NO: 5656555 - DNA, 16 bp, Homo sapiens
ttcagcttaaaataaa

SEQ ID NO: 5656556 - DNA, 23 bp, Homo sapiens
ttcagcttcctgctgctagcaat

SEQ ID NO: 5656557 - DNA, 15 bp, Homo sapiens
ttcagcttctgctgg

SEQ ID NO: 5656558 - DNA, 17 bp, Homo sapiens
ttcagcttctgctgggc

SEQ ID NO: 5656559 - DNA, 18 bp, Homo sapiens
ttcagcttctgctgggct

SEQ ID NO: 5656560 - DNA, 22 bp, Homo sapiens
ttcagcttgaacctgcttcctg

SEQ ID NO: 5656561 - DNA, 19 bp, Homo sapiens
ttcagcttgtttctatact

SEQ ID NO: 5656562 - DNA, 12 bp, Homo sapiens
ttcagctttatt

SEQ ID NO: 5656563 - DNA, 21 bp, Homo sapiens
ttcagctttatttttctttaa

SEQ ID NO: 5656564 - DNA, 14 bp, Homo sapiens
ttcagctttgtgta

SEQ ID NO: 5656565 - DNA, 18 bp, Homo sapiens
ttcaggaaaagcctctgt

SEQ ID NO: 5656566 - DNA, 16 bp, Homo sapiens
ttcaggaaaaggcctg

SEQ ID NO: 5656567 - DNA, 18 bp, Homo sapiens
ttcaggaaaaggcctggg

SEQ ID NO: 5656568 - DNA, 15 bp, Homo sapiens
ttcaggaaaataaat

SEQ ID NO: 5656569 - DNA, 17 bp, Homo sapiens
ttcaggaacctggacca

SEQ ID NO: 5656570 - DNA, 22 bp, Homo sapiens
ttcaggaacctggaccaaagct

SEQ ID NO: 5656571 - DNA, 23 bp, Homo sapiens
ttcaggaacctggaccaaagctg

SEQ ID NO: 5656572 - DNA, 16 bp, Homo sapiens
ttcaggaagataaaaa

SEQ ID NO: 5656573 - DNA, 13 bp, Homo sapiens
ttcaggaagctca

SEQ ID NO: 5656574 - DNA, 17 bp, Homo sapiens
ttcaggaagctcagggc

SEQ ID NO: 5656575 - DNA, 20 bp, Homo sapiens
ttcaggaagctcagggcctg

SEQ ID NO: 5656576 - DNA, 22 bp, Homo sapiens
ttcaggaagggatgcaggctcc

SEQ ID NO: 5656577 - DNA, 15 bp, Homo sapiens
ttcaggaatttaatt

SEQ ID NO: 5656578 - DNA, 14 bp, Homo sapiens
ttcaggacacatct

SEQ ID NO: 5656579 - DNA, 18 bp, Homo sapiens
ttcaggacactcactaca

SEQ ID NO: 5656580 - DNA, 20 bp, Homo sapiens
ttcaggaccccatctgctga

SEQ ID NO: 5656581 - DNA, 14 bp, Homo sapiens
ttcaggacccttct

SEQ ID NO: 5656582 - DNA, 15 bp, Homo sapiens
ttcaggactctctcc

SEQ ID NO: 5656583 - DNA, 19 bp, Homo sapiens
ttcaggactctctccagga

SEQ ID NO: 5656584 - DNA, 20 bp, Homo sapiens
ttcaggactctctccaggag

SEQ ID NO: 5656585 - DNA, 10 bp, Homo sapiens
ttcaggactt

SEQ ID NO: 5656586 - DNA, 21 bp, Homo sapiens
ttcaggacttaacggctccag

SEQ ID NO: 5656587 - DNA, 23 bp, Homo sapiens
ttcaggagactttacaaaccttt

SEQ ID NO: 5656588 - DNA, 20 bp, Homo sapiens
ttcaggagagtaaaaattca

SEQ ID NO: 5656589 - DNA, 17 bp, Homo sapiens
ttcaggagatgatgtga

SEQ ID NO: 5656590 - DNA, 14 bp, Homo sapiens
ttcaggagcctggc

SEQ ID NO: 5656591 - DNA, 20 bp, Homo sapiens
ttcaggagcctggccaggca

SEQ ID NO: 5656592 - DNA, 12 bp, Homo sapiens
ttcaggagctga

SEQ ID NO: 5656593 - DNA, 15 bp, Homo sapiens
ttcaggagctgaagc

SEQ ID NO: 5656594 - DNA, 14 bp, Homo sapiens
ttcaggaggctgga

SEQ ID NO: 5656595 - DNA, 17 bp, Homo sapiens
ttcaggagggtccccag

SEQ ID NO: 5656596 - DNA, 22 bp, Homo sapiens
ttcaggagggtccccagctggt

SEQ ID NO: 5656597 - DNA, 17 bp, Homo sapiens
ttcaggagtcccaagga

SEQ ID NO: 5656598 - DNA, 19 bp, Homo sapiens
ttcaggatacgctgctctc

SEQ ID NO: 5656599 - DNA, 22 bp, Homo sapiens
ttcaggatactgtagtttcctc

SEQ ID NO: 5656600 - DNA, 20 bp, Homo sapiens
ttcaggatattggttcttcc

SEQ ID NO: 5656601 - DNA, 12 bp, Homo sapiens
ttcaggatctat

SEQ ID NO: 5656602 - DNA, 23 bp, Homo sapiens
ttcaggatctatttttggaggtt

SEQ ID NO: 5656603 - DNA, 17 bp, Homo sapiens
ttcaggattaactaaag

SEQ ID NO: 5656604 - DNA, 21 bp, Homo sapiens
ttcaggattaactaaagaaga

SEQ ID NO: 5656605 - DNA, 23 bp, Homo sapiens
ttcaggatttggtttttctcttt

SEQ ID NO: 5656606 - DNA, 16 bp, Homo sapiens
ttcaggcaaggcagct

SEQ ID NO: 5656607 - DNA, 14 bp, Homo sapiens
ttcaggcaccagca

SEQ ID NO: 5656608 - DNA, 22 bp, Homo sapiens
ttcaggcagcagtgtctgtacc

SEQ ID NO: 5656609 - DNA, 14 bp, Homo sapiens
ttcaggcagctgaa

SEQ ID NO: 5656610 - DNA, 18 bp, Homo sapiens
ttcaggcagctgaaattc

SEQ ID NO: 5656611 - DNA, 15 bp, Homo sapiens
ttcaggcattccagg

SEQ ID NO: 5656612 - DNA, 18 bp, Homo sapiens
ttcaggccctcagctgtc

SEQ ID NO: 5656613 - DNA, 11 bp, Homo sapiens
ttcaggcctct

SEQ ID NO: 5656614 - DNA, 15 bp, Homo sapiens
ttcaggcctctgagg

SEQ ID NO: 5656615 - DNA, 20 bp, Homo sapiens
ttcaggcgattctcctgcct

SEQ ID NO: 5656616 - DNA, 17 bp, Homo sapiens
ttcaggctacctttttc

SEQ ID NO: 5656617 - DNA, 17 bp, Homo sapiens
ttcaggctactgttctt

SEQ ID NO: 5656618 - DNA, 18 bp, Homo sapiens
ttcaggctcaaccttcca

SEQ ID NO: 5656619 - DNA, 22 bp, Homo sapiens
ttcaggctccccagatcatgtt

SEQ ID NO: 5656620 - DNA, 19 bp, Homo sapiens
ttcaggctcgccaaggcct

SEQ ID NO: 5656621 - DNA, 14 bp, Homo sapiens
ttcaggctctgaga

SEQ ID NO: 5656622 - DNA, 14 bp, Homo sapiens
ttcaggctctgccc

SEQ ID NO: 5656623 - DNA, 19 bp, Homo sapiens
ttcaggcttcctgcaattt

SEQ ID NO: 5656624 - DNA, 18 bp, Homo sapiens
ttcaggcttgcattaaaa

SEQ ID NO: 5656625 - DNA, 22 bp, Homo sapiens
ttcaggcttgcattaaaagact

SEQ ID NO: 5656626 - DNA, 22 bp, Homo sapiens
ttcaggctttaggcatatgctt

SEQ ID NO: 5656627 - DNA, 15 bp, Homo sapiens
ttcaggcttttatga

SEQ ID NO: 5656628 - DNA, 21 bp, Homo sapiens
ttcagggaaatggagggtggg

SEQ ID NO: 5656629 - DNA, 19 bp, Homo sapiens
ttcagggaagataagttgg

SEQ ID NO: 5656630 - DNA, 23 bp, Homo sapiens
ttcagggaaggaggagcctgtcc

SEQ ID NO: 5656631 - DNA, 17 bp, Homo sapiens
ttcagggaccgtccagg

SEQ ID NO: 5656632 - DNA, 12 bp, Homo sapiens
ttcagggacctc

SEQ ID NO: 5656633 - DNA, 20 bp, Homo sapiens
ttcagggacctcaggggcac

SEQ ID NO: 5656634 - DNA, 13 bp, Homo sapiens
ttcagggagagct

SEQ ID NO: 5656635 - DNA, 21 bp, Homo sapiens
ttcagggagggctgttcaagt

SEQ ID NO: 5656636 - DNA, 21 bp, Homo sapiens
ttcagggagggttagcctgca

SEQ ID NO: 5656637 - DNA, 14 bp, Homo sapiens
ttcagggattccct

SEQ ID NO: 5656638 - DNA, 23 bp, Homo sapiens
ttcagggcagattttagttttat

SEQ ID NO: 5656639 - DNA, 15 bp, Homo sapiens
ttcagggccagtcct

SEQ ID NO: 5656640 - DNA, 20 bp, Homo sapiens
ttcagggctggctcctgatc

SEQ ID NO: 5656641 - DNA, 14 bp, Homo sapiens
ttcaggggaagggc

SEQ ID NO: 5656642 - DNA, 19 bp, Homo sapiens
ttcaggggactcagccctg

SEQ ID NO: 5656643 - DNA, 21 bp, Homo sapiens
ttcaggggactgttctcacct

SEQ ID NO: 5656644 - DNA, 23 bp, Homo sapiens
ttcaggggctgcccgctcccagt

SEQ ID NO: 5656645 - DNA, 15 bp, Homo sapiens
ttcaggggctggggg

SEQ ID NO: 5656646 - DNA, 20 bp, Homo sapiens
ttcaggggctgggggtgctg

SEQ ID NO: 5656647 - DNA, 18 bp, Homo sapiens
ttcaggggctttgggccc

SEQ ID NO: 5656648 - DNA, 19 bp, Homo sapiens
ttcaggggctttgggccca

SEQ ID NO: 5656649 - DNA, 13 bp, Homo sapiens
ttcagggggccag

SEQ ID NO: 5656650 - DNA, 21 bp, Homo sapiens
ttcaggggggttgtgaggcct

SEQ ID NO: 5656651 - DNA, 17 bp, Homo sapiens
ttcagggtgagtgaatg

SEQ ID NO: 5656652 - DNA, 23 bp, Homo sapiens
ttcagggtgcagcccaatctgcc

SEQ ID NO: 5656653 - DNA, 17 bp, Homo sapiens
ttcaggtacagaaaaca

SEQ ID NO: 5656654 - DNA, 14 bp, Homo sapiens
ttcaggtagaggtg

SEQ ID NO: 5656655 - DNA, 22 bp, Homo sapiens
ttcaggtaggcccttgtcctgc

SEQ ID NO: 5656656 - DNA, 15 bp, Homo sapiens
ttcaggtccaggcca

SEQ ID NO: 5656657 - DNA, 20 bp, Homo sapiens
ttcaggtcccacgtctggcc

SEQ ID NO: 5656658 - DNA, 22 bp, Homo sapiens
ttcaggtcccagttgctgtcac

SEQ ID NO: 5656659 - DNA, 16 bp, Homo sapiens
ttcaggtcccctggcc

SEQ ID NO: 5656660 - DNA, 24 bp, Homo sapiens
ttcaggtcccctggcccttccttc

SEQ ID NO: 5656661 - DNA, 14 bp, Homo sapiens
ttcaggtctgtatg

SEQ ID NO: 5656662 - DNA, 20 bp, Homo sapiens
ttcaggtctgtatgtcatgg

SEQ ID NO: 5656663 - DNA, 16 bp, Homo sapiens
ttcaggtgacatgtga

SEQ ID NO: 5656664 - DNA, 18 bp, Homo sapiens
ttcaggtgacatgtgaaa

SEQ ID NO: 5656665 - DNA, 19 bp, Homo sapiens
ttcaggtgataactcacca

SEQ ID NO: 5656666 - DNA, 17 bp, Homo sapiens
ttcaggtgcagaggaag

SEQ ID NO: 5656667 - DNA, 17 bp, Homo sapiens
ttcaggtggccagaaga

SEQ ID NO: 5656668 - DNA, 22 bp, Homo sapiens
ttcaggtgtcatggactgttgc

SEQ ID NO: 5656669 - DNA, 13 bp, Homo sapiens
ttcaggtgtgaga

SEQ ID NO: 5656670 - DNA, 20 bp, Homo sapiens
ttcaggtgtttagttgcaga

SEQ ID NO: 5656671 - DNA, 20 bp, Homo sapiens
ttcaggttatcgaaataaca

SEQ ID NO: 5656672 - DNA, 15 bp, Homo sapiens
ttcaggttgtgcatt

SEQ ID NO: 5656673 - DNA, 21 bp, Homo sapiens
ttcaggttgttttgttttata

SEQ ID NO: 5656674 - DNA, 20 bp, Homo sapiens
ttcaggtttcttaaaaacag

SEQ ID NO: 5656675 - DNA, 13 bp, Homo sapiens
ttcaggttttcag

SEQ ID NO: 5656676 - DNA, 13 bp, Homo sapiens
ttcaggtttttcc

SEQ ID NO: 5656677 - DNA, 15 bp, Homo sapiens
ttcagtaaaaaacaa

SEQ ID NO: 5656678 - DNA, 13 bp, Homo sapiens
ttcagtaaacaac

SEQ ID NO: 5656679 - DNA, 16 bp, Homo sapiens
ttcagtaaacaccatg

SEQ ID NO: 5656680 - DNA, 19 bp, Homo sapiens
ttcagtaaacataaagcca

SEQ ID NO: 5656681 - DNA, 15 bp, Homo sapiens
ttcagtaactgtcag

SEQ ID NO: 5656682 - DNA, 20 bp, Homo sapiens
ttcagtaagttatctttgaa

SEQ ID NO: 5656683 - DNA, 16 bp, Homo sapiens
ttcagtaataaaacat

SEQ ID NO: 5656684 - DNA, 14 bp, Homo sapiens
ttcagtaatagctg

SEQ ID NO: 5656685 - DNA, 17 bp, Homo sapiens
ttcagtaatgtcttcag

SEQ ID NO: 5656686 - DNA, 21 bp, Homo sapiens
ttcagtacacttggtgtactg

SEQ ID NO: 5656687 - DNA, 15 bp, Homo sapiens
ttcagtaccaaagaa

SEQ ID NO: 5656688 - DNA, 22 bp, Homo sapiens
ttcagtaccctatggagtacat

SEQ ID NO: 5656689 - DNA, 16 bp, Homo sapiens
ttcagtacctggagga

SEQ ID NO: 5656690 - DNA, 21 bp, Homo sapiens
ttcagtacttttttaaatatt

SEQ ID NO: 5656691 - DNA, 15 bp, Homo sapiens
ttcagtagaattacc

SEQ ID NO: 5656692 - DNA, 16 bp, Homo sapiens
ttcagtagaattttag

SEQ ID NO: 5656693 - DNA, 15 bp, Homo sapiens
ttcagtagatttcct

SEQ ID NO: 5656694 - DNA, 23 bp, Homo sapiens
ttcagtagcaggacctgccaaga

SEQ ID NO: 5656695 - DNA, 15 bp, Homo sapiens
ttcagtagctccttg

SEQ ID NO: 5656696 - DNA, 16 bp, Homo sapiens
ttcagtagcttatctc

SEQ ID NO: 5656697 - DNA, 21 bp, Homo sapiens
ttcagtaggaacaagctggct

SEQ ID NO: 5656698 - DNA, 14 bp, Homo sapiens
ttcagtaggaactg

SEQ ID NO: 5656699 - DNA, 17 bp, Homo sapiens
ttcagtaggctttatgc

SEQ ID NO: 5656700 - DNA, 19 bp, Homo sapiens
ttcagtataaattatctta

SEQ ID NO: 5656701 - DNA, 16 bp, Homo sapiens
ttcagtatcaaggctg

SEQ ID NO: 5656702 - DNA, 22 bp, Homo sapiens
ttcagtatcaaggctgcctgga

SEQ ID NO: 5656703 - DNA, 16 bp, Homo sapiens
ttcagtatcatctcca

SEQ ID NO: 5656704 - DNA, 15 bp, Homo sapiens
ttcagtatcttagag

SEQ ID NO: 5656705 - DNA, 21 bp, Homo sapiens
ttcagtatgtgtcaactgaga

SEQ ID NO: 5656706 - DNA, 17 bp, Homo sapiens
ttcagtatgttgtcaaa

SEQ ID NO: 5656707 - DNA, 20 bp, Homo sapiens
ttcagtattaaactctcctt

SEQ ID NO: 5656708 - DNA, 20 bp, Homo sapiens
ttcagtattatgtagttgtt

SEQ ID NO: 5656709 - DNA, 15 bp, Homo sapiens
ttcagtattttccag

SEQ ID NO: 5656710 - DNA, 18 bp, Homo sapiens
ttcagtattttggagaaa

SEQ ID NO: 5656711 - DNA, 21 bp, Homo sapiens
ttcagtattttggagaaatta

SEQ ID NO: 5656712 - DNA, 15 bp, Homo sapiens
ttcagtcaattctga

SEQ ID NO: 5656713 - DNA, 17 bp, Homo sapiens
ttcagtcacatggcatg

SEQ ID NO: 5656714 - DNA, 22 bp, Homo sapiens
ttcagtcatagcaagcttttgc

SEQ ID NO: 5656715 - DNA, 21 bp, Homo sapiens
ttcagtcatataaaagctatg

SEQ ID NO: 5656716 - DNA, 15 bp, Homo sapiens
ttcagtcccctctct

SEQ ID NO: 5656717 - DNA, 17 bp, Homo sapiens
ttcagtcccctctctct

SEQ ID NO: 5656718 - DNA, 22 bp, Homo sapiens
ttcagtccctgagcagtctact

SEQ ID NO: 5656719 - DNA, 14 bp, Homo sapiens
ttcagtcctctgca

SEQ ID NO: 5656720 - DNA, 23 bp, Homo sapiens
ttcagtcctggtctgctcaggaa

SEQ ID NO: 5656721 - DNA, 15 bp, Homo sapiens
ttcagtcctttgtct

SEQ ID NO: 5656722 - DNA, 19 bp, Homo sapiens
ttcagtcctttgtctttct

SEQ ID NO: 5656723 - DNA, 19 bp, Homo sapiens
ttcagtctcacagagaagc

SEQ ID NO: 5656724 - DNA, 22 bp, Homo sapiens
ttcagtctcacagagaagctcc

SEQ ID NO: 5656725 - DNA, 17 bp, Homo sapiens
ttcagtctcagctgctg

SEQ ID NO: 5656726 - DNA, 18 bp, Homo sapiens
ttcagtctctataccaat

SEQ ID NO: 5656727 - DNA, 19 bp, Homo sapiens
ttccaaagttttgaagtca

SEQ ID NO: 5656728 - DNA, 22 bp, Homo sapiens
ttccaaataaaacttgagccca

SEQ ID NO: 5656729 - DNA, 15 bp, Homo sapiens
ttccaaataaaatga

SEQ ID NO: 5656730 - DNA, 20 bp, Homo sapiens
ttccaaataaaatgttccct

SEQ ID NO: 5656731 - DNA, 20 bp, Homo sapiens
ttccaaataatatgtttcct

SEQ ID NO: 5656732 - DNA, 15 bp, Homo sapiens
ttccaaatactaatg

SEQ ID NO: 5656733 - DNA, 23 bp, Homo sapiens
ttccaaatattctaaaaaagata

SEQ ID NO: 5656734 - DNA, 13 bp, Homo sapiens
ttccaaatccaaa

SEQ ID NO: 5656735 - DNA, 17 bp, Homo sapiens
ttccaaatgcccaagga

SEQ ID NO: 5656736 - DNA, 17 bp, Homo sapiens
ttccaaatgctttcagt

SEQ ID NO: 5656737 - DNA, 21 bp, Homo sapiens
ttccaaatgtaataaacttta

SEQ ID NO: 5656738 - DNA, 15 bp, Homo sapiens
ttccaaatgtccctc

SEQ ID NO: 5656739 - DNA, 19 bp, Homo sapiens
ttccaaatgtggcctccat

SEQ ID NO: 5656740 - DNA, 19 bp, Homo sapiens
ttccaaatgtgtcagaata

SEQ ID NO: 5656741 - DNA, 13 bp, Homo sapiens
ttccaaattcatg

SEQ ID NO: 5656742 - DNA, 20 bp, Homo sapiens
ttccaaatttttttcttagg

SEQ ID NO: 5656743 - DNA, 14 bp, Homo sapiens
ttccaacaaagggt

SEQ ID NO: 5656744 - DNA, 15 bp, Homo sapiens
ttccaacaaagggtt

SEQ ID NO: 5656745 - DNA, 22 bp, Homo sapiens
ttccaacaaagggttttaatgt

SEQ ID NO: 5656746 - DNA, 18 bp, Homo sapiens
ttccaacacatttcactt

SEQ ID NO: 5656747 - DNA, 21 bp, Homo sapiens
ttccaacaccacagacacaca

SEQ ID NO: 5656748 - DNA, 13 bp, Homo sapiens
ttccaacagacag

SEQ ID NO: 5656749 - DNA, 22 bp, Homo sapiens
ttccaacaggcgtgggatcaga

SEQ ID NO: 5656750 - DNA, 19 bp, Homo sapiens
ttccaacaggggctggagg

SEQ ID NO: 5656751 - DNA, 15 bp, Homo sapiens
ttccaacatacaatt

SEQ ID NO: 5656752 - DNA, 17 bp, Homo sapiens
ttccaaccatttatctt

SEQ ID NO: 5656753 - DNA, 18 bp, Homo sapiens
ttccaaccatttatcttg

SEQ ID NO: 5656754 - DNA, 20 bp, Homo sapiens
ttccaaccatttatcttgaa

SEQ ID NO: 5656755 - DNA, 21 bp, Homo sapiens
ttccaaccatttatcttgaag

SEQ ID NO: 5656756 - DNA, 15 bp, Homo sapiens
ttccaacccagccac

SEQ ID NO: 5656757 - DNA, 12 bp, Homo sapiens
ttccaaccccag

SEQ ID NO: 5656758 - DNA, 20 bp, Homo sapiens
ttccaaccccagctggcctc

SEQ ID NO: 5656759 - DNA, 14 bp, Homo sapiens
ttccaacctcctgc

SEQ ID NO: 5656760 - DNA, 15 bp, Homo sapiens
ttccaacctcctgct

SEQ ID NO: 5656761 - DNA, 22 bp, Homo sapiens
ttccaacgtttggaagatcctg

SEQ ID NO: 5656762 - DNA, 16 bp, Homo sapiens
ttccaactcctgatgc

SEQ ID NO: 5656763 - DNA, 15 bp, Homo sapiens
ttccaacttgaagga

SEQ ID NO: 5656764 - DNA, 16 bp, Homo sapiens
ttccaagacatgtctg

SEQ ID NO: 5656765 - DNA, 12 bp, Homo sapiens
ttccaagacatt

SEQ ID NO: 5656766 - DNA, 14 bp, Homo sapiens
ttccaagacattgt

SEQ ID NO: 5656767 - DNA, 17 bp, Homo sapiens
ttccaagacattgtcaa

SEQ ID NO: 5656768 - DNA, 20 bp, Homo sapiens
ttccaagacattgtcaataa

SEQ ID NO: 5656769 - DNA, 17 bp, Homo sapiens
ttccaagactctagagt

SEQ ID NO: 5656770 - DNA, 22 bp, Homo sapiens
ttccaagactctagagtccaag

SEQ ID NO: 5656771 - DNA, 20 bp, Homo sapiens
ttccaagactgaagactgca

SEQ ID NO: 5656772 - DNA, 20 bp, Homo sapiens
ttccaagacttattttcaca

SEQ ID NO: 5656773 - DNA, 13 bp, Homo sapiens
ttccaagagcctg

SEQ ID NO: 5656774 - DNA, 14 bp, Homo sapiens
ttccaagagcctga

SEQ ID NO: 5656775 - DNA, 14 bp, Homo sapiens
ttccaagaggctgt

SEQ ID NO: 5656776 - DNA, 17 bp, Homo sapiens
ttccaagagtctaaaga

SEQ ID NO: 5656777 - DNA, 19 bp, Homo sapiens
ttccaagcccttccctctg

SEQ ID NO: 5656778 - DNA, 19 bp, Homo sapiens
ttccaagcctgggccactg

SEQ ID NO: 5656779 - DNA, 14 bp, Homo sapiens
ttccaagctgcggg

SEQ ID NO: 5656780 - DNA, 16 bp, Homo sapiens
ttccaaggaaaattga

SEQ ID NO: 5656781 - DNA, 18 bp, Homo sapiens
ttccaagggcccagaggg

SEQ ID NO: 5656782 - DNA, 18 bp, Homo sapiens
ttccaaggtcactcttgg

SEQ ID NO: 5656783 - DNA, 13 bp, Homo sapiens
ttccaagtaatat

SEQ ID NO: 5656784 - DNA, 15 bp, Homo sapiens
ttccaagtagctggg

SEQ ID NO: 5656785 - DNA, 15 bp, Homo sapiens
ttccaagtcttcctg

SEQ ID NO: 5656786 - DNA, 13 bp, Homo sapiens
ttccaagtgtata

SEQ ID NO: 5656787 - DNA, 16 bp, Homo sapiens
ttccaagtgtataatg

SEQ ID NO: 5656788 - DNA, 18 bp, Homo sapiens
ttccaagtgtataatgtt

SEQ ID NO: 5656789 - DNA, 14 bp, Homo sapiens
ttccaagtgtattt

SEQ ID NO: 5656790 - DNA, 20 bp, Homo sapiens
ttccaagtgtgcatattgta

SEQ ID NO: 5656791 - DNA, 18 bp, Homo sapiens
ttccaagtgtgtgtgcaa

SEQ ID NO: 5656792 - DNA, 22 bp, Homo sapiens
ttccaagttccccatccctgtc

SEQ ID NO: 5656793 - DNA, 19 bp, Homo sapiens
ttccaagttcctgcactcc

SEQ ID NO: 5656794 - DNA, 22 bp, Homo sapiens
ttccaagttcctgcactccaga

SEQ ID NO: 5656795 - DNA, 17 bp, Homo sapiens
ttccaagttgaagggaa

SEQ ID NO: 5656796 - DNA, 11 bp, Homo sapiens
ttccaataaaa

SEQ ID NO: 5656797 - DNA, 13 bp, Homo sapiens
ttccaataaaatt

SEQ ID NO: 5656798 - DNA, 13 bp, Homo sapiens
ttccaataaacag

SEQ ID NO: 5656799 - DNA, 23 bp, Homo sapiens
ttccaataaagcagagtttgaca

SEQ ID NO: 5656800 - DNA, 17 bp, Homo sapiens
ttccaatacttcattaa

SEQ ID NO: 5656801 - DNA, 15 bp, Homo sapiens
ttccaatagaaagaa

SEQ ID NO: 5656802 - DNA, 16 bp, Homo sapiens
ttccaatatgatgact

SEQ ID NO: 5656803 - DNA, 17 bp, Homo sapiens
ttccaatatttataatt

SEQ ID NO: 5656804 - DNA, 20 bp, Homo sapiens
ttccaatatttataattaaa

SEQ ID NO: 5656805 - DNA, 21 bp, Homo sapiens
ttccaatatttataattaaag

SEQ ID NO: 5656806 - DNA, 16 bp, Homo sapiens
ttccaatattttaata

SEQ ID NO: 5656807 - DNA, 15 bp, Homo sapiens
ttccaatcaacagca

SEQ ID NO: 5656808 - DNA, 13 bp, Homo sapiens
ttccaatcactgt

SEQ ID NO: 5656809 - DNA, 14 bp, Homo sapiens
ttccaatcttgctt

SEQ ID NO: 5656810 - DNA, 15 bp, Homo sapiens
ttccaatgaaaaaat

SEQ ID NO: 5656811 - DNA, 17 bp, Homo sapiens
ttccaatgatgcttact

SEQ ID NO: 5656812 - DNA, 18 bp, Homo sapiens
ttccaatgccaattcatc

SEQ ID NO: 5656813 - DNA, 17 bp, Homo sapiens
ttccaatgtctggagac

SEQ ID NO: 5656814 - DNA, 23 bp, Homo sapiens
ttccaattatttataataaatca

SEQ ID NO: 5656815 - DNA, 18 bp, Homo sapiens
ttccaattctaaatccga

SEQ ID NO: 5656816 - DNA, 21 bp, Homo sapiens
ttccaattctatcttttgttt

SEQ ID NO: 5656817 - DNA, 17 bp, Homo sapiens
ttccaatttagttgttg

SEQ ID NO: 5656818 - DNA, 19 bp, Homo sapiens
ttccaatttcaaaatgtct

SEQ ID NO: 5656819 - DNA, 13 bp, Homo sapiens
ttccaatttggaa

SEQ ID NO: 5656820 - DNA, 18 bp, Homo sapiens
ttccacaaaatctgtcca

SEQ ID NO: 5656821 - DNA, 19 bp, Homo sapiens
ttccacaaacaccatcttc

SEQ ID NO: 5656822 - DNA, 14 bp, Homo sapiens
ttccacaaagaaaa

SEQ ID NO: 5656823 - DNA, 13 bp, Homo sapiens
ttccacaaatatg

SEQ ID NO: 5656824 - DNA, 13 bp, Homo sapiens
ttccacaacagtc

SEQ ID NO: 5656825 - DNA, 21 bp, Homo sapiens
ttccacaagagcccaggcctc

SEQ ID NO: 5656826 - DNA, 21 bp, Homo sapiens
ttccacaagattcccagagac

SEQ ID NO: 5656827 - DNA, 18 bp, Homo sapiens
ttccacaattttgtctct

SEQ ID NO: 5656828 - DNA, 13 bp, Homo sapiens
ttccacacaaaat

SEQ ID NO: 5656829 - DNA, 17 bp, Homo sapiens
ttccacacaaaatgtca

SEQ ID NO: 5656830 - DNA, 16 bp, Homo sapiens
ttccacacagcctgtc

SEQ ID NO: 5656831 - DNA, 12 bp, Homo sapiens
ttccacacaggc

SEQ ID NO: 5656832 - DNA, 17 bp, Homo sapiens
ttccacacaggcccatg

SEQ ID NO: 5656833 - DNA, 22 bp, Homo sapiens
ttccacacatttccctatttta

SEQ ID NO: 5656834 - DNA, 18 bp, Homo sapiens
ttccacaccaagcagcaa

SEQ ID NO: 5656835 - DNA, 22 bp, Homo sapiens
ttccacacccccaccccttgct

SEQ ID NO: 5656836 - DNA, 20 bp, Homo sapiens
ttccacagagtaagacattg

SEQ ID NO: 5656837 - DNA, 18 bp, Homo sapiens
ttccacagattgtttcta

SEQ ID NO: 5656838 - DNA, 22 bp, Homo sapiens
ttccacagcacaaacacacctc

SEQ ID NO: 5656839 - DNA, 16 bp, Homo sapiens
ttccacagcagcagaa

SEQ ID NO: 5656840 - DNA, 23 bp, Homo sapiens
ttccacaggagggagagaactta

SEQ ID NO: 5656841 - DNA, 15 bp, Homo sapiens
ttccacaggatcatc

SEQ ID NO: 5656842 - DNA, 17 bp, Homo sapiens
ttccacaggtctcagaa

SEQ ID NO: 5656843 - DNA, 19 bp, Homo sapiens
ttccacagtggcgggccca

SEQ ID NO: 5656844 - DNA, 23 bp, Homo sapiens
ttccacagtggcgggcccactca

SEQ ID NO: 5656845 - DNA, 16 bp, Homo sapiens
ttccacagttgccacc

SEQ ID NO: 5656846 - DNA, 13 bp, Homo sapiens
ttccacataaatt

SEQ ID NO: 5656847 - DNA, 15 bp, Homo sapiens
ttccacatccccacc

SEQ ID NO: 5656848 - DNA, 20 bp, Homo sapiens
ttccacatgtgccagttgcc

SEQ ID NO: 5656849 - DNA, 11 bp, Homo sapiens
ttccacatttt

SEQ ID NO: 5656850 - DNA, 22 bp, Homo sapiens
ttccaccaaatacaattcaaat

SEQ ID NO: 5656851 - DNA, 21 bp, Homo sapiens
ttccaccaactttttccaagt

SEQ ID NO: 5656852 - DNA, 16 bp, Homo sapiens
ttccaccacagccagc

SEQ ID NO: 5656853 - DNA, 21 bp, Homo sapiens
ttccaccacagccagcacctg

SEQ ID NO: 5656854 - DNA, 18 bp, Homo sapiens
ttccaccacaggaatgta

SEQ ID NO: 5656855 - DNA, 14 bp, Homo sapiens
ttccaccagagcag

SEQ ID NO: 5656856 - DNA, 15 bp, Homo sapiens
ttccaccagagcagg

SEQ ID NO: 5656857 - DNA, 23 bp, Homo sapiens
ttccaccagagcaggggctgctg

SEQ ID NO: 5656858 - DNA, 23 bp, Homo sapiens
ttccacccacaaactccaggctg

SEQ ID NO: 5656859 - DNA, 18 bp, Homo sapiens
ttccacccagaccctcct

SEQ ID NO: 5656860 - DNA, 12 bp, Homo sapiens
ttccacccaggg

SEQ ID NO: 5656861 - DNA, 22 bp, Homo sapiens
ttccaccccaaaggggcctctc

SEQ ID NO: 5656862 - DNA, 15 bp, Homo sapiens
ttccaccccaagaga

SEQ ID NO: 5656863 - DNA, 20 bp, Homo sapiens
ttccaccccaagagaactcg

SEQ ID NO: 5656864 - DNA, 15 bp, Homo sapiens
ttccaccccctccct

SEQ ID NO: 5656865 - DNA, 15 bp, Homo sapiens
ttccacccctccttc

SEQ ID NO: 5656866 - DNA, 15 bp, Homo sapiens
ttccacccctctcct

SEQ ID NO: 5656867 - DNA, 18 bp, Homo sapiens
ttccaccctctctccacc

SEQ ID NO: 5656868 - DNA, 17 bp, Homo sapiens
ttccaccctgccctggc

SEQ ID NO: 5656869 - DNA, 19 bp, Homo sapiens
ttccaccctgccctggcct

SEQ ID NO: 5656870 - DNA, 20 bp, Homo sapiens
ttccaccctgtctaggcaca

SEQ ID NO: 5656871 - DNA, 23 bp, Homo sapiens
ttccaccgctggagctcctacat

SEQ ID NO: 5656872 - DNA, 15 bp, Homo sapiens
ttccaccggcactca

SEQ ID NO: 5656873 - DNA, 15 bp, Homo sapiens
ttccacctcacctct

SEQ ID NO: 5656874 - DNA, 19 bp, Homo sapiens
ttccacctcacctctttgt

SEQ ID NO: 5656875 - DNA, 22 bp, Homo sapiens
ttccacctcatggattgccaca

SEQ ID NO: 5656876 - DNA, 14 bp, Homo sapiens
ttccacctccacca

SEQ ID NO: 5656877 - DNA, 17 bp, Homo sapiens
ttccacctccagcctct

SEQ ID NO: 5656878 - DNA, 20 bp, Homo sapiens
ttccacctccagcctctggt

SEQ ID NO: 5656879 - DNA, 15 bp, Homo sapiens
ttccacctccctccc

SEQ ID NO: 5656880 - DNA, 13 bp, Homo sapiens
ttccacctgctct

SEQ ID NO: 5656881 - DNA, 16 bp, Homo sapiens
ttccacctgctctgct

SEQ ID NO: 5656882 - DNA, 14 bp, Homo sapiens
ttccacctgctttc

SEQ ID NO: 5656883 - DNA, 15 bp, Homo sapiens
ttccacctgctttct

SEQ ID NO: 5656884 - DNA, 19 bp, Homo sapiens
ttccacctgtgccctcacc

SEQ ID NO: 5656885 - DNA, 23 bp, Homo sapiens
ttccaccttaccctactggctgt

SEQ ID NO: 5656886 - DNA, 15 bp, Homo sapiens
ttccaccttcccatg

SEQ ID NO: 5656887 - DNA, 22 bp, Homo sapiens
ttccacctttatgttttaatat

SEQ ID NO: 5656888 - DNA, 21 bp, Homo sapiens
ttccacctttctgaatggaaa

SEQ ID NO: 5656889 - DNA, 19 bp, Homo sapiens
ttccacgatgaaaaacttc

SEQ ID NO: 5656890 - DNA, 16 bp, Homo sapiens
ttccacgcagcaccct

SEQ ID NO: 5656891 - DNA, 15 bp, Homo sapiens
ttccacggagccact

SEQ ID NO: 5656892 - DNA, 21 bp, Homo sapiens
ttccacggagccactcctctg

SEQ ID NO: 5656893 - DNA, 22 bp, Homo sapiens
ttccacggagccactcctctga

SEQ ID NO: 5656894 - DNA, 24 bp, Homo sapiens
ttccacggagccactcctctgact

SEQ ID NO: 5656895 - DNA, 16 bp, Homo sapiens
ttccacggcatcgcat

SEQ ID NO: 5656896 - DNA, 19 bp, Homo sapiens
ttccacgtactgcagcctc

SEQ ID NO: 5656897 - DNA, 19 bp, Homo sapiens
ttccacgtccccctggggc

SEQ ID NO: 5656898 - DNA, 14 bp, Homo sapiens
ttccacgtgtatgc

SEQ ID NO: 5656899 - DNA, 18 bp, Homo sapiens
ttccactaaaaatattgt

SEQ ID NO: 5656900 - DNA, 17 bp, Homo sapiens
ttccactaatccattat

SEQ ID NO: 5656901 - DNA, 17 bp, Homo sapiens
ttccactacacctggct

SEQ ID NO: 5656902 - DNA, 18 bp, Homo sapiens
ttccactacacctggctg

SEQ ID NO: 5656903 - DNA, 22 bp, Homo sapiens
ttccactacacctggctgaggt

SEQ ID NO: 5656904 - DNA, 13 bp, Homo sapiens
ttcccatctcctt

SEQ ID NO: 5656905 - DNA, 21 bp, Homo sapiens
ttcccatctcctttctctggt

SEQ ID NO: 5656906 - DNA, 14 bp, Homo sapiens
ttcccatctggctt

SEQ ID NO: 5656907 - DNA, 20 bp, Homo sapiens
ttcccatctggctttttctg

SEQ ID NO: 5656908 - DNA, 19 bp, Homo sapiens
ttcccatgacccaggctgg

SEQ ID NO: 5656909 - DNA, 15 bp, Homo sapiens
ttcccatgactgcac

SEQ ID NO: 5656910 - DNA, 22 bp, Homo sapiens
ttcccatgactgcacccagctc

SEQ ID NO: 5656911 - DNA, 13 bp, Homo sapiens
ttcccatgatttc

SEQ ID NO: 5656912 - DNA, 20 bp, Homo sapiens
ttcccatgatttcatgtact

SEQ ID NO: 5656913 - DNA, 21 bp, Homo sapiens
ttcccatgcaacaccctcttc

SEQ ID NO: 5656914 - DNA, 16 bp, Homo sapiens
ttcccatgcaggctaa

SEQ ID NO: 5656915 - DNA, 16 bp, Homo sapiens
ttcccatggagttgcc

SEQ ID NO: 5656916 - DNA, 14 bp, Homo sapiens
ttcccatggccatt

SEQ ID NO: 5656917 - DNA, 17 bp, Homo sapiens
ttcccatggtgtatgtg

SEQ ID NO: 5656918 - DNA, 17 bp, Homo sapiens
ttcccatgtcccaccct

SEQ ID NO: 5656919 - DNA, 15 bp, Homo sapiens
ttcccatgtggaaca

SEQ ID NO: 5656920 - DNA, 13 bp, Homo sapiens
ttcccatgttaaa

SEQ ID NO: 5656921 - DNA, 18 bp, Homo sapiens
ttcccatgttgactgtct

SEQ ID NO: 5656922 - DNA, 13 bp, Homo sapiens
ttcccattaaaaa

SEQ ID NO: 5656923 - DNA, 19 bp, Homo sapiens
ttcccattattatttctgt

SEQ ID NO: 5656924 - DNA, 20 bp, Homo sapiens
ttcccattctgccccagagt

SEQ ID NO: 5656925 - DNA, 14 bp, Homo sapiens
ttcccattcttgca

SEQ ID NO: 5656926 - DNA, 18 bp, Homo sapiens
ttcccattgaaaatgtaa

SEQ ID NO: 5656927 - DNA, 23 bp, Homo sapiens
ttcccattgcatcacctctgtaa

SEQ ID NO: 5656928 - DNA, 14 bp, Homo sapiens
ttcccattggcttt

SEQ ID NO: 5656929 - DNA, 14 bp, Homo sapiens
ttcccatttagaat

SEQ ID NO: 5656930 - DNA, 14 bp, Homo sapiens
ttcccatttcagct

SEQ ID NO: 5656931 - DNA, 15 bp, Homo sapiens
ttcccatttgtaatg

SEQ ID NO: 5656932 - DNA, 17 bp, Homo sapiens
ttcccatttgtgccaga

SEQ ID NO: 5656933 - DNA, 18 bp, Homo sapiens
ttcccatttgttgctgct

SEQ ID NO: 5656934 - DNA, 14 bp, Homo sapiens
ttcccattttgcaa

SEQ ID NO: 5656935 - DNA, 19 bp, Homo sapiens
ttcccattttgcaaaattt

SEQ ID NO: 5656936 - DNA, 16 bp, Homo sapiens
ttccccaaaccataaa

SEQ ID NO: 5656937 - DNA, 21 bp, Homo sapiens
ttccccaaaggccaacagcat

SEQ ID NO: 5656938 - DNA, 15 bp, Homo sapiens
ttccccaaagtctta

SEQ ID NO: 5656939 - DNA, 15 bp, Homo sapiens
ttccccaacagtgtg

SEQ ID NO: 5656940 - DNA, 18 bp, Homo sapiens
ttccccaaccacttcatt

SEQ ID NO: 5656941 - DNA, 16 bp, Homo sapiens
ttccccaacgaaaagc

SEQ ID NO: 5656942 - DNA, 16 bp, Homo sapiens
ttccccaacttcccta

SEQ ID NO: 5656943 - DNA, 14 bp, Homo sapiens
ttccccaagacatt

SEQ ID NO: 5656944 - DNA, 20 bp, Homo sapiens
ttccccaagcctggcagggg

SEQ ID NO: 5656945 - DNA, 19 bp, Homo sapiens
ttccccaaggcactgagcg

SEQ ID NO: 5656946 - DNA, 15 bp, Homo sapiens
ttccccaagggccaa

SEQ ID NO: 5656947 - DNA, 17 bp, Homo sapiens
ttccccaagggccaaac

SEQ ID NO: 5656948 - DNA, 17 bp, Homo sapiens
ttccccaataaagcctt

SEQ ID NO: 5656949 - DNA, 15 bp, Homo sapiens
ttccccacaggtgaa

SEQ ID NO: 5656950 - DNA, 17 bp, Homo sapiens
ttccccacattctatag

SEQ ID NO: 5656951 - DNA, 15 bp, Homo sapiens
ttccccaccagatgc

SEQ ID NO: 5656952 - DNA, 19 bp, Homo sapiens
ttccccacccaccaaccct

SEQ ID NO: 5656953 - DNA, 23 bp, Homo sapiens
ttccccacccaccaaccctcagg

SEQ ID NO: 5656954 - DNA, 12 bp, Homo sapiens
ttccccacccag

SEQ ID NO: 5656955 - DNA, 21 bp, Homo sapiens
ttccccaccccataagccctg

SEQ ID NO: 5656956 - DNA, 21 bp, Homo sapiens
ttccccaccctccccttccca

SEQ ID NO: 5656957 - DNA, 19 bp, Homo sapiens
ttccccaccgcagtcacca

SEQ ID NO: 5656958 - DNA, 18 bp, Homo sapiens
ttccccactaataaagtg

SEQ ID NO: 5656959 - DNA, 15 bp, Homo sapiens
ttccccactcccccg

SEQ ID NO: 5656960 - DNA, 16 bp, Homo sapiens
ttccccactcccgtga

SEQ ID NO: 5656961 - DNA, 14 bp, Homo sapiens
ttccccactgcctg

SEQ ID NO: 5656962 - DNA, 18 bp, Homo sapiens
ttccccactgcctgccca

SEQ ID NO: 5656963 - DNA, 22 bp, Homo sapiens
ttccccacttgagaattaccct

SEQ ID NO: 5656964 - DNA, 18 bp, Homo sapiens
ttccccagacgcctggct

SEQ ID NO: 5656965 - DNA, 22 bp, Homo sapiens
ttccccagactcagctccagaa

SEQ ID NO: 5656966 - DNA, 14 bp, Homo sapiens
ttccccagacttgc

SEQ ID NO: 5656967 - DNA, 16 bp, Homo sapiens
ttccccagacttgcac

SEQ ID NO: 5656968 - DNA, 17 bp, Homo sapiens
ttccccagacttgcact

SEQ ID NO: 5656969 - DNA, 17 bp, Homo sapiens
ttccccagagtgggatc

SEQ ID NO: 5656970 - DNA, 16 bp, Homo sapiens
ttccccagcaactctg

SEQ ID NO: 5656971 - DNA, 13 bp, Homo sapiens
ttccccagccaca

SEQ ID NO: 5656972 - DNA, 14 bp, Homo sapiens
ttccccagccacag

SEQ ID NO: 5656973 - DNA, 12 bp, Homo sapiens
ttccccagccca

SEQ ID NO: 5656974 - DNA, 15 bp, Homo sapiens
ttccccagcccaggg

SEQ ID NO: 5656975 - DNA, 14 bp, Homo sapiens
ttccccagccccac

SEQ ID NO: 5656976 - DNA, 14 bp, Homo sapiens
ttccccagccctta

SEQ ID NO: 5656977 - DNA, 14 bp, Homo sapiens
ttccccagctcaga

SEQ ID NO: 5656978 - DNA, 14 bp, Homo sapiens
ttccccagctctca

SEQ ID NO: 5656979 - DNA, 19 bp, Homo sapiens
ttccccagctttgctgcct

SEQ ID NO: 5656980 - DNA, 21 bp, Homo sapiens
ttccccaggagctctctgctg

SEQ ID NO: 5656981 - DNA, 22 bp, Homo sapiens
ttccccaggagctctctgctga

SEQ ID NO: 5656982 - DNA, 12 bp, Homo sapiens
ttccccaggagg

SEQ ID NO: 5656983 - DNA, 21 bp, Homo sapiens
ttccccaggaggccagccttg

SEQ ID NO: 5656984 - DNA, 11 bp, Homo sapiens
ttccccaggat

SEQ ID NO: 5656985 - DNA, 20 bp, Homo sapiens
ttccccagggttctgtattg

SEQ ID NO: 5656986 - DNA, 19 bp, Homo sapiens
ttccccagtgactccaggg

SEQ ID NO: 5656987 - DNA, 20 bp, Homo sapiens
ttccccagtgactccagggt

SEQ ID NO: 5656988 - DNA, 16 bp, Homo sapiens
ttccccatactctgtc

SEQ ID NO: 5656989 - DNA, 12 bp, Homo sapiens
ttccccatcccg

SEQ ID NO: 5656990 - DNA, 19 bp, Homo sapiens
ttccccatccctgtcattt

SEQ ID NO: 5656991 - DNA, 20 bp, Homo sapiens
ttccccatcgttgcccccat

SEQ ID NO: 5656992 - DNA, 17 bp, Homo sapiens
ttccccatctcactctt

SEQ ID NO: 5656993 - DNA, 19 bp, Homo sapiens
ttccccatctcaggccaga

SEQ ID NO: 5656994 - DNA, 15 bp, Homo sapiens
ttccccatctctgtc

SEQ ID NO: 5656995 - DNA, 19 bp, Homo sapiens
ttccccatggccctgagcg

SEQ ID NO: 5656996 - DNA, 11 bp, Homo sapiens
ttccccatggg

SEQ ID NO: 5656997 - DNA, 12 bp, Homo sapiens
ttccccatggga

SEQ ID NO: 5656998 - DNA, 23 bp, Homo sapiens
ttccccatgggaagacgaggccc

SEQ ID NO: 5656999 - DNA, 23 bp, Homo sapiens
ttccccatggttttaatctgtat

SEQ ID NO: 5657000 - DNA, 22 bp, Homo sapiens
ttccccattatatcacacttat

SEQ ID NO: 5657001 - DNA, 16 bp, Homo sapiens
ttccccattgccttct

SEQ ID NO: 5657002 - DNA, 14 bp, Homo sapiens
ttcccccaaagtgg

SEQ ID NO: 5657003 - DNA, 22 bp, Homo sapiens
ttcccccaaatcttcctctgga

SEQ ID NO: 5657004 - DNA, 17 bp, Homo sapiens
ttcccccaaggctgatg

SEQ ID NO: 5657005 - DNA, 12 bp, Homo sapiens
ttcccccaccac

SEQ ID NO: 5657006 - DNA, 18 bp, Homo sapiens
ttcccccacccctccacg

SEQ ID NO: 5657007 - DNA, 18 bp, Homo sapiens
ttcccccaccggtccagc

SEQ ID NO: 5657008 - DNA, 17 bp, Homo sapiens
ttcccccactactgcag

SEQ ID NO: 5657009 - DNA, 11 bp, Homo sapiens
ttcccccactc

SEQ ID NO: 5657010 - DNA, 17 bp, Homo sapiens
ttcccccacttcccctc

SEQ ID NO: 5657011 - DNA, 17 bp, Homo sapiens
ttcccccacttttctct

SEQ ID NO: 5657012 - DNA, 13 bp, Homo sapiens
ttcccccagccca

SEQ ID NO: 5657013 - DNA, 15 bp, Homo sapiens
ttcccccagcccaat

SEQ ID NO: 5657014 - DNA, 16 bp, Homo sapiens
ttcccccagcccaata

SEQ ID NO: 5657015 - DNA, 14 bp, Homo sapiens
ttcccccagccctg

SEQ ID NO: 5657016 - DNA, 15 bp, Homo sapiens
ttcccccagccctgt

SEQ ID NO: 5657017 - DNA, 20 bp, Homo sapiens
ttcccccagccctgtggaag

SEQ ID NO: 5657018 - DNA, 21 bp, Homo sapiens
ttcccccaggggtgagccccg

SEQ ID NO: 5657019 - DNA, 22 bp, Homo sapiens
ttcccccaggggtgagccccgc

SEQ ID NO: 5657020 - DNA, 15 bp, Homo sapiens
ttcccccatagccac

SEQ ID NO: 5657021 - DNA, 20 bp, Homo sapiens
ttcccccatcccctttcctc

SEQ ID NO: 5657022 - DNA, 23 bp, Homo sapiens
ttcccccatcccctttcctcccc

SEQ ID NO: 5657023 - DNA, 18 bp, Homo sapiens
ttcccccatccctaccac

SEQ ID NO: 5657024 - DNA, 17 bp, Homo sapiens
ttcccccatgtggctga

SEQ ID NO: 5657025 - DNA, 18 bp, Homo sapiens
ttcccccatgtggctgaa

SEQ ID NO: 5657026 - DNA, 21 bp, Homo sapiens
ttccccccaacccggaaacag

SEQ ID NO: 5657027 - DNA, 20 bp, Homo sapiens
ttccccccaccccccagcac

SEQ ID NO: 5657028 - DNA, 12 bp, Homo sapiens
ttccccccactc

SEQ ID NO: 5657029 - DNA, 15 bp, Homo sapiens
ttccccccatctctg

SEQ ID NO: 5657030 - DNA, 19 bp, Homo sapiens
ttcccccccctttcctaaa

SEQ ID NO: 5657031 - DNA, 14 bp, Homo sapiens
ttcccccctaagct

SEQ ID NO: 5657032 - DNA, 18 bp, Homo sapiens
ttcccccctctcctccca

SEQ ID NO: 5657033 - DNA, 22 bp, Homo sapiens
ttcccccctctcctcccagctg

SEQ ID NO: 5657034 - DNA, 23 bp, Homo sapiens
ttcccccctctcctcccagctgc

SEQ ID NO: 5657035 - DNA, 20 bp, Homo sapiens
ttcccccgctggcagccacc

SEQ ID NO: 5657036 - DNA, 13 bp, Homo sapiens
ttccccctcctca

SEQ ID NO: 5657037 - DNA, 14 bp, Homo sapiens
ttccccctctccca

SEQ ID NO: 5657038 - DNA, 18 bp, Homo sapiens
ttccccctctcccagttg

SEQ ID NO: 5657039 - DNA, 21 bp, Homo sapiens
ttccccctcttcttctgaaga

SEQ ID NO: 5657040 - DNA, 16 bp, Homo sapiens
ttccccctgcaaaaag

SEQ ID NO: 5657041 - DNA, 16 bp, Homo sapiens
ttccccctgctgatca

SEQ ID NO: 5657042 - DNA, 20 bp, Homo sapiens
ttccccctggccaccacccc

SEQ ID NO: 5657043 - DNA, 12 bp, Homo sapiens
ttcccccttaaa

SEQ ID NO: 5657044 - DNA, 17 bp, Homo sapiens
ttcccccttcacaaagc

SEQ ID NO: 5657045 - DNA, 19 bp, Homo sapiens
ttcccccttcatccatcct

SEQ ID NO: 5657046 - DNA, 17 bp, Homo sapiens
ttcccccttcccatttc

SEQ ID NO: 5657047 - DNA, 13 bp, Homo sapiens
ttcccccttcccc

SEQ ID NO: 5657048 - DNA, 15 bp, Homo sapiens
ttcccccttcccctg

SEQ ID NO: 5657049 - DNA, 16 bp, Homo sapiens
ttcccccttcccctgc

SEQ ID NO: 5657050 - DNA, 23 bp, Homo sapiens
ttcccccttgaggattgtggaaa

SEQ ID NO: 5657051 - DNA, 23 bp, Homo sapiens
ttcccccttgatcgacttcttgg

SEQ ID NO: 5657052 - DNA, 19 bp, Homo sapiens
ttcccccttttctgcattt

SEQ ID NO: 5657053 - DNA, 15 bp, Homo sapiens
ttccccgacactgcc

SEQ ID NO: 5657054 - DNA, 22 bp, Homo sapiens
ttccccgcgaagtccgaggcct

SEQ ID NO: 5657055 - DNA, 14 bp, Homo sapiens
ttccccgtcccctg

SEQ ID NO: 5657056 - DNA, 15 bp, Homo sapiens
ttccccgtcccctgc

SEQ ID NO: 5657057 - DNA, 18 bp, Homo sapiens
ttccccgtcccctgcagc

SEQ ID NO: 5657058 - DNA, 21 bp, Homo sapiens
ttccccgtcccctgcagcctg

SEQ ID NO: 5657059 - DNA, 21 bp, Homo sapiens
ttcccctaccccctcctctct

SEQ ID NO: 5657060 - DNA, 11 bp, Homo sapiens
ttcccctagac

SEQ ID NO: 5657061 - DNA, 16 bp, Homo sapiens
ttcccctagacctccc

SEQ ID NO: 5657062 - DNA, 18 bp, Homo sapiens
ttcccctagcttactgat

SEQ ID NO: 5657063 - DNA, 15 bp, Homo sapiens
ttcccctatcattta

SEQ ID NO: 5657064 - DNA, 12 bp, Homo sapiens
ttcccctcattg

SEQ ID NO: 5657065 - DNA, 18 bp, Homo sapiens
ttcccctcattgcattta

SEQ ID NO: 5657066 - DNA, 15 bp, Homo sapiens
ttcccctcccacctc

SEQ ID NO: 5657067 - DNA, 17 bp, Homo sapiens
ttcccctcccagccctg

SEQ ID NO: 5657068 - DNA, 20 bp, Homo sapiens
ttcccctcccagccctgagg

SEQ ID NO: 5657069 - DNA, 13 bp, Homo sapiens
ttcccctcccctc

SEQ ID NO: 5657070 - DNA, 17 bp, Homo sapiens
ttcccctcccctccttg

SEQ ID NO: 5657071 - DNA, 19 bp, Homo sapiens
ttcccctcccgcttcctcc

SEQ ID NO: 5657072 - DNA, 16 bp, Homo sapiens
ttcccctccctaccct

SEQ ID NO: 5657073 - DNA, 23 bp, Homo sapiens
ttcccctccctcgttttcaaaga

SEQ ID NO: 5657074 - DNA, 17 bp, Homo sapiens
ttcccctccctggctcc

SEQ ID NO: 5657075 - DNA, 17 bp, Homo sapiens
ttcccctccttctccct

SEQ ID NO: 5657076 - DNA, 18 bp, Homo sapiens
ttcccctccttctccctt

SEQ ID NO: 5657077 - DNA, 20 bp, Homo sapiens
ttcccctctcatacataaaa

SEQ ID NO: 5657078 - DNA, 21 bp, Homo sapiens
ttcccctctcccttccctcct

SEQ ID NO: 5657079 - DNA, 14 bp, Homo sapiens
ttcccctctctgcc

SEQ ID NO: 5657080 - DNA, 16 bp, Homo sapiens
ttcccctctctgcccc

SEQ ID NO: 5657081 - DNA, 17 bp, Homo sapiens
ttcccctctctgcccct

SEQ ID NO: 5657082 - DNA, 14 bp, Homo sapiens
ttcccctctgctgc

SEQ ID NO: 5657083 - DNA, 15 bp, Homo sapiens
ttcctccccctgcaa

SEQ ID NO: 5657084 - DNA, 11 bp, Homo sapiens
ttcctcccctc

SEQ ID NO: 5657085 - DNA, 14 bp, Homo sapiens
ttcctcccctcaac

SEQ ID NO: 5657086 - DNA, 12 bp, Homo sapiens
ttcctcccctct

SEQ ID NO: 5657087 - DNA, 16 bp, Homo sapiens
ttcctccctcatgagc

SEQ ID NO: 5657088 - DNA, 12 bp, Homo sapiens
ttcctccctccc

SEQ ID NO: 5657089 - DNA, 22 bp, Homo sapiens
ttcctccctcccacactcgcca

SEQ ID NO: 5657090 - DNA, 19 bp, Homo sapiens
ttcctccctccctgcaggg

SEQ ID NO: 5657091 - DNA, 19 bp, Homo sapiens
ttcctccctgggggcccca

SEQ ID NO: 5657092 - DNA, 22 bp, Homo sapiens
ttcctccctggtttgcagctgt

SEQ ID NO: 5657093 - DNA, 23 bp, Homo sapiens
ttcctccctgtctctgcatctga

SEQ ID NO: 5657094 - DNA, 15 bp, Homo sapiens
ttcctcccttctgat

SEQ ID NO: 5657095 - DNA, 20 bp, Homo sapiens
ttcctccgctcccctttccc

SEQ ID NO: 5657096 - DNA, 18 bp, Homo sapiens
ttcctccgtctgcaatgt

SEQ ID NO: 5657097 - DNA, 22 bp, Homo sapiens
ttcctcctacttacaacccagg

SEQ ID NO: 5657098 - DNA, 13 bp, Homo sapiens
ttcctcctcagcc

SEQ ID NO: 5657099 - DNA, 10 bp, Homo sapiens
ttcctcctcc

SEQ ID NO: 5657100 - DNA, 21 bp, Homo sapiens
ttcctcctccacagtgctgct

SEQ ID NO: 5657101 - DNA, 18 bp, Homo sapiens
ttcctcctccaccaccgc

SEQ ID NO: 5657102 - DNA, 19 bp, Homo sapiens
ttcctcctccaccaccgcc

SEQ ID NO: 5657103 - DNA, 19 bp, Homo sapiens
ttcctcctccacccacccc

SEQ ID NO: 5657104 - DNA, 18 bp, Homo sapiens
ttcctcctcccaaggcat

SEQ ID NO: 5657105 - DNA, 19 bp, Homo sapiens
ttcctcctcccaaggcatt

SEQ ID NO: 5657106 - DNA, 18 bp, Homo sapiens
ttcctcctcccagtgcct

SEQ ID NO: 5657107 - DNA, 16 bp, Homo sapiens
ttcctcctccccactt

SEQ ID NO: 5657108 - DNA, 17 bp, Homo sapiens
ttcctcctccctcctgc

SEQ ID NO: 5657109 - DNA, 19 bp, Homo sapiens
ttcctcctcctcctcctgt

SEQ ID NO: 5657110 - DNA, 15 bp, Homo sapiens
ttcctcctctcctgg

SEQ ID NO: 5657111 - DNA, 20 bp, Homo sapiens
ttcctcctctgacttgggga

SEQ ID NO: 5657112 - DNA, 15 bp, Homo sapiens
ttcctcctctgccta

SEQ ID NO: 5657113 - DNA, 16 bp, Homo sapiens
ttcctcctgaagcctc

SEQ ID NO: 5657114 - DNA, 23 bp, Homo sapiens
ttcctcctgaagcctctgccctg

SEQ ID NO: 5657115 - DNA, 13 bp, Homo sapiens
ttcctcctgctca

SEQ ID NO: 5657116 - DNA, 13 bp, Homo sapiens
ttcctcctggaaa

SEQ ID NO: 5657117 - DNA, 11 bp, Homo sapiens
ttcctcctggg

SEQ ID NO: 5657118 - DNA, 14 bp, Homo sapiens
ttcctcctgggccc

SEQ ID NO: 5657119 - DNA, 21 bp, Homo sapiens
ttcctcctgggccctctctgc

SEQ ID NO: 5657120 - DNA, 23 bp, Homo sapiens
ttcctcctgggccctctctgctc

SEQ ID NO: 5657121 - DNA, 11 bp, Homo sapiens
ttcctccttcc

SEQ ID NO: 5657122 - DNA, 11 bp, Homo sapiens
ttcctcctttc

SEQ ID NO: 5657123 - DNA, 13 bp, Homo sapiens
ttcctcctttctc

SEQ ID NO: 5657124 - DNA, 14 bp, Homo sapiens
ttcctcctttctct

SEQ ID NO: 5657125 - DNA, 15 bp, Homo sapiens
ttcctcctttctctg

SEQ ID NO: 5657126 - DNA, 16 bp, Homo sapiens
ttcctcctttctctgt

SEQ ID NO: 5657127 - DNA, 19 bp, Homo sapiens
ttcctcctttctctgtata

SEQ ID NO: 5657128 - DNA, 18 bp, Homo sapiens
ttcctcgcagagaggcca

SEQ ID NO: 5657129 - DNA, 14 bp, Homo sapiens
ttcctcgccctggg

SEQ ID NO: 5657130 - DNA, 19 bp, Homo sapiens
ttcctcgcctaggcctgtg

SEQ ID NO: 5657131 - DNA, 15 bp, Homo sapiens
ttcctcgcctctccc

SEQ ID NO: 5657132 - DNA, 17 bp, Homo sapiens
ttcctcgcctctcccac

SEQ ID NO: 5657133 - DNA, 17 bp, Homo sapiens
ttcctcgctctgggatg

SEQ ID NO: 5657134 - DNA, 22 bp, Homo sapiens
ttcctcgctctgggatgcaggc

SEQ ID NO: 5657135 - DNA, 21 bp, Homo sapiens
ttcctcgggatgaaaagccat

SEQ ID NO: 5657136 - DNA, 23 bp, Homo sapiens
ttcctcgggatgaaaagccatat

SEQ ID NO: 5657137 - DNA, 17 bp, Homo sapiens
ttcctcggtggctctgg

SEQ ID NO: 5657138 - DNA, 18 bp, Homo sapiens
ttcctcggtgggccagag

SEQ ID NO: 5657139 - DNA, 19 bp, Homo sapiens
ttcctcggtgggccagagc

SEQ ID NO: 5657140 - DNA, 18 bp, Homo sapiens
ttcctcgttgggccgctc

SEQ ID NO: 5657141 - DNA, 16 bp, Homo sapiens
ttcctctaacattttt

SEQ ID NO: 5657142 - DNA, 21 bp, Homo sapiens
ttcctctaactcactgcctag

SEQ ID NO: 5657143 - DNA, 15 bp, Homo sapiens
ttcctctagaagcca

SEQ ID NO: 5657144 - DNA, 21 bp, Homo sapiens
ttcctctatactttgttctgt

SEQ ID NO: 5657145 - DNA, 20 bp, Homo sapiens
ttcctctcaaattcagctct

SEQ ID NO: 5657146 - DNA, 21 bp, Homo sapiens
ttcctctcaaattcagctctg

SEQ ID NO: 5657147 - DNA, 18 bp, Homo sapiens
ttcctctcaagctagcca

SEQ ID NO: 5657148 - DNA, 16 bp, Homo sapiens
ttcctctcaccccact

SEQ ID NO: 5657149 - DNA, 14 bp, Homo sapiens
ttcctctcactcct

SEQ ID NO: 5657150 - DNA, 14 bp, Homo sapiens
ttcctctcatttcc

SEQ ID NO: 5657151 - DNA, 21 bp, Homo sapiens
ttcctctcatttccagcttct

SEQ ID NO: 5657152 - DNA, 18 bp, Homo sapiens
ttcctctccaattgtaaa

SEQ ID NO: 5657153 - DNA, 15 bp, Homo sapiens
ttcctctccacagga

SEQ ID NO: 5657154 - DNA, 16 bp, Homo sapiens
ttcctctccacaggag

SEQ ID NO: 5657155 - DNA, 19 bp, Homo sapiens
ttcctctccacaggagcct

SEQ ID NO: 5657156 - DNA, 12 bp, Homo sapiens
ttcctctccact

SEQ ID NO: 5657157 - DNA, 14 bp, Homo sapiens
ttcctctccactgc

SEQ ID NO: 5657158 - DNA, 15 bp, Homo sapiens
ttcctctccactgcc

SEQ ID NO: 5657159 - DNA, 16 bp, Homo sapiens
ttcctctccactgcct

SEQ ID NO: 5657160 - DNA, 18 bp, Homo sapiens
ttcctctccactgccttc

SEQ ID NO: 5657161 - DNA, 14 bp, Homo sapiens
ttcctctccacttc

SEQ ID NO: 5657162 - DNA, 14 bp, Homo sapiens
ttcctctccaggcc

SEQ ID NO: 5657163 - DNA, 14 bp, Homo sapiens
ttcctctcccttcc

SEQ ID NO: 5657164 - DNA, 13 bp, Homo sapiens
ttcctctcctctc

SEQ ID NO: 5657165 - DNA, 17 bp, Homo sapiens
ttcctctctacccccca

SEQ ID NO: 5657166 - DNA, 19 bp, Homo sapiens
ttcctctctaccccccacc

SEQ ID NO: 5657167 - DNA, 22 bp, Homo sapiens
ttcctctctcggagccctcaga

SEQ ID NO: 5657168 - DNA, 22 bp, Homo sapiens
ttcctctctctctctctctctg

SEQ ID NO: 5657169 - DNA, 22 bp, Homo sapiens
ttcctctctgtctgtctctccc

SEQ ID NO: 5657170 - DNA, 17 bp, Homo sapiens
ttcctctgaattataat

SEQ ID NO: 5657171 - DNA, 13 bp, Homo sapiens
ttcctctgagccc

SEQ ID NO: 5657172 - DNA, 15 bp, Homo sapiens
ttcctctgagcccag

SEQ ID NO: 5657173 - DNA, 18 bp, Homo sapiens
ttcctctgagcccagctg

SEQ ID NO: 5657174 - DNA, 22 bp, Homo sapiens
ttcctctgagcccagctgcctg

SEQ ID NO: 5657175 - DNA, 14 bp, Homo sapiens
ttcctctgagctgt

SEQ ID NO: 5657176 - DNA, 13 bp, Homo sapiens
ttcctctgaggct

SEQ ID NO: 5657177 - DNA, 21 bp, Homo sapiens
ttcctctgaggctgaaattca

SEQ ID NO: 5657178 - DNA, 21 bp, Homo sapiens
ttcctctgaggctggatccta

SEQ ID NO: 5657179 - DNA, 19 bp, Homo sapiens
ttcctctgcaaaaagattt

SEQ ID NO: 5657180 - DNA, 16 bp, Homo sapiens
ttcctctgcaagtgct

SEQ ID NO: 5657181 - DNA, 19 bp, Homo sapiens
ttcctctgcacgctcaatg

SEQ ID NO: 5657182 - DNA, 21 bp, Homo sapiens
ttcctctgcacgctcaatgcc

SEQ ID NO: 5657183 - DNA, 17 bp, Homo sapiens
ttcctctgcagctgacc

SEQ ID NO: 5657184 - DNA, 19 bp, Homo sapiens
ttcctctgcagctgacctc

SEQ ID NO: 5657185 - DNA, 14 bp, Homo sapiens
ttcctctgcagttt

SEQ ID NO: 5657186 - DNA, 20 bp, Homo sapiens
ttcctctgcccttcctgcag

SEQ ID NO: 5657187 - DNA, 17 bp, Homo sapiens
ttcctctgctaaattga

SEQ ID NO: 5657188 - DNA, 19 bp, Homo sapiens
ttcctctgctaaattgatg

SEQ ID NO: 5657189 - DNA, 12 bp, Homo sapiens
ttcctctgctgc

SEQ ID NO: 5657190 - DNA, 11 bp, Homo sapiens
ttcctctggat

SEQ ID NO: 5657191 - DNA, 12 bp, Homo sapiens
ttcctctgggaa

SEQ ID NO: 5657192 - DNA, 21 bp, Homo sapiens
ttcctctgtacagcaagatgt

SEQ ID NO: 5657193 - DNA, 13 bp, Homo sapiens
ttcctctgtcctc

SEQ ID NO: 5657194 - DNA, 12 bp, Homo sapiens
ttcctctgtgcc

SEQ ID NO: 5657195 - DNA, 14 bp, Homo sapiens
ttcctctgtgccac

SEQ ID NO: 5657196 - DNA, 22 bp, Homo sapiens
ttcctctgttcaaagctgcctg

SEQ ID NO: 5657197 - DNA, 16 bp, Homo sapiens
ttcctctgttcttttc

SEQ ID NO: 5657198 - DNA, 19 bp, Homo sapiens
ttcctcttagaagaatatt

SEQ ID NO: 5657199 - DNA, 13 bp, Homo sapiens
ttcctcttcccca

SEQ ID NO: 5657200 - DNA, 16 bp, Homo sapiens
ttcctcttccccttgc

SEQ ID NO: 5657201 - DNA, 16 bp, Homo sapiens
ttcctcttcctgccct

SEQ ID NO: 5657202 - DNA, 13 bp, Homo sapiens
ttcctcttccttc

SEQ ID NO: 5657203 - DNA, 16 bp, Homo sapiens
ttcctcttccttctct

SEQ ID NO: 5657204 - DNA, 20 bp, Homo sapiens
ttcctcttctattttgtaaa

SEQ ID NO: 5657205 - DNA, 23 bp, Homo sapiens
ttcctcttgaacgttatgttcag

SEQ ID NO: 5657206 - DNA, 23 bp, Homo sapiens
ttcctcttgagggtcattttcct

SEQ ID NO: 5657207 - DNA, 20 bp, Homo sapiens
ttcctcttggtgtcaaattt

SEQ ID NO: 5657208 - DNA, 23 bp, Homo sapiens
ttcctcttggtgtcaaattttta

SEQ ID NO: 5657209 - DNA, 21 bp, Homo sapiens
ttcctcttgtcctggcccttc

SEQ ID NO: 5657210 - DNA, 15 bp, Homo sapiens
ttcctcttgtctgat

SEQ ID NO: 5657211 - DNA, 14 bp, Homo sapiens
ttcctctttctgct

SEQ ID NO: 5657212 - DNA, 15 bp, Homo sapiens
ttcctctttgcatga

SEQ ID NO: 5657213 - DNA, 12 bp, Homo sapiens
ttcctctttgtt

SEQ ID NO: 5657214 - DNA, 19 bp, Homo sapiens
ttcctcttttcctgctccc

SEQ ID NO: 5657215 - DNA, 13 bp, Homo sapiens
ttcctcttttgct

SEQ ID NO: 5657216 - DNA, 23 bp, Homo sapiens
ttcctgaaagctgttggatttca

SEQ ID NO: 5657217 - DNA, 22 bp, Homo sapiens
ttcctgaaagttggggcccagt

SEQ ID NO: 5657218 - DNA, 12 bp, Homo sapiens
ttcctgaaataa

SEQ ID NO: 5657219 - DNA, 13 bp, Homo sapiens
ttcctgaaataaa

SEQ ID NO: 5657220 - DNA, 18 bp, Homo sapiens
ttcctgaaataaacactg

SEQ ID NO: 5657221 - DNA, 18 bp, Homo sapiens
ttcctgaaataaatgttt

SEQ ID NO: 5657222 - DNA, 12 bp, Homo sapiens
ttcctgaaatgt

SEQ ID NO: 5657223 - DNA, 12 bp, Homo sapiens
ttcctgaacagg

SEQ ID NO: 5657224 - DNA, 15 bp, Homo sapiens
ttcctgaacaggata

SEQ ID NO: 5657225 - DNA, 14 bp, Homo sapiens
ttcctgaaccatgt

SEQ ID NO: 5657226 - DNA, 14 bp, Homo sapiens
ttcctgaaccgatg

SEQ ID NO: 5657227 - DNA, 17 bp, Homo sapiens
ttcctgaacctggaaat

SEQ ID NO: 5657228 - DNA, 15 bp, Homo sapiens
ttcctgaactcccag

SEQ ID NO: 5657229 - DNA, 15 bp, Homo sapiens
ttcctgaagccagat

SEQ ID NO: 5657230 - DNA, 14 bp, Homo sapiens
ttcctgaatattaa

SEQ ID NO: 5657231 - DNA, 16 bp, Homo sapiens
ttcctgaatattaatc

SEQ ID NO: 5657232 - DNA, 20 bp, Homo sapiens
ttcctgaattctatttgctg

SEQ ID NO: 5657233 - DNA, 23 bp, Homo sapiens
ttcctgacactcaataaacagtc

SEQ ID NO: 5657234 - DNA, 13 bp, Homo sapiens
ttcctgacccagg

SEQ ID NO: 5657235 - DNA, 14 bp, Homo sapiens
ttcctgacccaggc

SEQ ID NO: 5657236 - DNA, 16 bp, Homo sapiens
ttcctgacccaggccg

SEQ ID NO: 5657237 - DNA, 13 bp, Homo sapiens
ttcctgaccctca

SEQ ID NO: 5657238 - DNA, 15 bp, Homo sapiens
ttcctgaccctcact

SEQ ID NO: 5657239 - DNA, 17 bp, Homo sapiens
ttcctgaccctcacttt

SEQ ID NO: 5657240 - DNA, 23 bp, Homo sapiens
ttcctgacgaaactggccccgga

SEQ ID NO: 5657241 - DNA, 13 bp, Homo sapiens
ttcctgactggga

SEQ ID NO: 5657242 - DNA, 14 bp, Homo sapiens
ttcctgactgggaa

SEQ ID NO: 5657243 - DNA, 17 bp, Homo sapiens
ttcctgactgttctctt

SEQ ID NO: 5657244 - DNA, 16 bp, Homo sapiens
ttcctgacttgagtgt

SEQ ID NO: 5657245 - DNA, 23 bp, Homo sapiens
ttcctgacttgagtgttcctttt

SEQ ID NO: 5657246 - DNA, 21 bp, Homo sapiens
ttcctgagaaacgtccatctc

SEQ ID NO: 5657247 - DNA, 14 bp, Homo sapiens
ttcctgagacagaa

SEQ ID NO: 5657248 - DNA, 15 bp, Homo sapiens
ttcctgagattctgg

SEQ ID NO: 5657249 - DNA, 16 bp, Homo sapiens
ttcctgagatttcctc

SEQ ID NO: 5657250 - DNA, 18 bp, Homo sapiens
ttcctgagatttcctcct

SEQ ID NO: 5657251 - DNA, 15 bp, Homo sapiens
ttcctgagcagtccc

SEQ ID NO: 5657252 - DNA, 17 bp, Homo sapiens
ttcctgagcagtccctg

SEQ ID NO: 5657253 - DNA, 18 bp, Homo sapiens
ttcctgagctggcctgtc

SEQ ID NO: 5657254 - DNA, 22 bp, Homo sapiens
ttcctgagctgtcgctgcctcc

SEQ ID NO: 5657255 - DNA, 23 bp, Homo sapiens
ttcctgagctgtcgctgcctcca

SEQ ID NO: 5657256 - DNA, 20 bp, Homo sapiens
ttcctgaggctgggctccct

SEQ ID NO: 5657257 - DNA, 13 bp, Homo sapiens
ttcctgagggcta

SEQ ID NO: 5657258 - DNA, 19 bp, Homo sapiens
ttcctgaggtcatctgtaa

SEQ ID NO: 5657259 - DNA, 20 bp, Homo sapiens
ttcctgaggtggatttactg

SEQ ID NO: 5657260 - DNA, 23 bp, Homo sapiens
ttcctgagtgtgggcttctgaaa

SEQ ID NO: 5657261 - DNA, 17 bp, Homo sapiens
ttcctgataataaagga

SEQ ID NO: 5657262 - DNA, 22 bp, Homo sapiens
ttcgctattcccaggcagggag

SEQ ID NO: 5657263 - DNA, 13 bp, Homo sapiens
ttcgctgccagga

SEQ ID NO: 5657264 - DNA, 17 bp, Homo sapiens
ttcgctgccaggacacc

SEQ ID NO: 5657265 - DNA, 17 bp, Homo sapiens
ttcgctggctcctaccc

SEQ ID NO: 5657266 - DNA, 15 bp, Homo sapiens
ttcgctgtcccccaa

SEQ ID NO: 5657267 - DNA, 15 bp, Homo sapiens
ttcgctgtcccctca

SEQ ID NO: 5657268 - DNA, 14 bp, Homo sapiens
ttcgcttgagaaaa

SEQ ID NO: 5657269 - DNA, 16 bp, Homo sapiens
ttcgcttgcttctgca

SEQ ID NO: 5657270 - DNA, 18 bp, Homo sapiens
ttcgcttgcttctgcagc

SEQ ID NO: 5657271 - DNA, 11 bp, Homo sapiens
ttcggaaacac

SEQ ID NO: 5657272 - DNA, 12 bp, Homo sapiens
ttcggaaacctt

SEQ ID NO: 5657273 - DNA, 18 bp, Homo sapiens
ttcggaaaccttggtgta

SEQ ID NO: 5657274 - DNA, 23 bp, Homo sapiens
ttcggaaagaagaaggtgggagg

SEQ ID NO: 5657275 - DNA, 15 bp, Homo sapiens
ttcggaacactaaaa

SEQ ID NO: 5657276 - DNA, 18 bp, Homo sapiens
ttcggaagggggaagtct

SEQ ID NO: 5657277 - DNA, 19 bp, Homo sapiens
ttcggacagtttatttgtt

SEQ ID NO: 5657278 - DNA, 23 bp, Homo sapiens
ttcggaccgaaggtgacagccgt

SEQ ID NO: 5657279 - DNA, 17 bp, Homo sapiens
ttcggagcgttctctgt

SEQ ID NO: 5657280 - DNA, 15 bp, Homo sapiens
ttcggagtgaatgtg

SEQ ID NO: 5657281 - DNA, 17 bp, Homo sapiens
ttcggatttggggtgga

SEQ ID NO: 5657282 - DNA, 11 bp, Homo sapiens
ttcggcagcct

SEQ ID NO: 5657283 - DNA, 16 bp, Homo sapiens
ttcggcagtggctggg

SEQ ID NO: 5657284 - DNA, 21 bp, Homo sapiens
ttcggcattggttccctttgc

SEQ ID NO: 5657285 - DNA, 17 bp, Homo sapiens
ttcggccgagctggttt

SEQ ID NO: 5657286 - DNA, 19 bp, Homo sapiens
ttcggcctccatcctgagg

SEQ ID NO: 5657287 - DNA, 13 bp, Homo sapiens
ttcggcctgtgtc

SEQ ID NO: 5657288 - DNA, 21 bp, Homo sapiens
ttcggccttggtgaacacaca

SEQ ID NO: 5657289 - DNA, 18 bp, Homo sapiens
ttcggctctgggtgggca

SEQ ID NO: 5657290 - DNA, 14 bp, Homo sapiens
ttcgggaagagagg

SEQ ID NO: 5657291 - DNA, 20 bp, Homo sapiens
ttcgggaggtcgaggcagga

SEQ ID NO: 5657292 - DNA, 16 bp, Homo sapiens
ttcgggattccctggt

SEQ ID NO: 5657293 - DNA, 15 bp, Homo sapiens
ttcgggccacagggc

SEQ ID NO: 5657294 - DNA, 16 bp, Homo sapiens
ttcggggcaagtgaga

SEQ ID NO: 5657295 - DNA, 17 bp, Homo sapiens
ttcggggcgatgctccc

SEQ ID NO: 5657296 - DNA, 13 bp, Homo sapiens
ttcggggctggga

SEQ ID NO: 5657297 - DNA, 17 bp, Homo sapiens
ttcggggctgggaagtc

SEQ ID NO: 5657298 - DNA, 16 bp, Homo sapiens
ttcgggtgctggaagt

SEQ ID NO: 5657299 - DNA, 17 bp, Homo sapiens
ttcggtctgaattttag

SEQ ID NO: 5657300 - DNA, 14 bp, Homo sapiens
ttcggtcttttgta

SEQ ID NO: 5657301 - DNA, 18 bp, Homo sapiens
ttcggtgagctacaaatg

SEQ ID NO: 5657302 - DNA, 12 bp, Homo sapiens
ttcggtgcttcc

SEQ ID NO: 5657303 - DNA, 16 bp, Homo sapiens
ttcggtggccttgagt

SEQ ID NO: 5657304 - DNA, 16 bp, Homo sapiens
ttcggtttctgagcat

SEQ ID NO: 5657305 - DNA, 21 bp, Homo sapiens
ttcgtaacttcatattaatat

SEQ ID NO: 5657306 - DNA, 17 bp, Homo sapiens
ttcgtaagaacatgtta

SEQ ID NO: 5657307 - DNA, 15 bp, Homo sapiens
ttcgtaagacaaaaa

SEQ ID NO: 5657308 - DNA, 14 bp, Homo sapiens
ttcgtaagttctgt

SEQ ID NO: 5657309 - DNA, 16 bp, Homo sapiens
ttcgtaagttctgtgc

SEQ ID NO: 5657310 - DNA, 19 bp, Homo sapiens
ttcgtacataataagtttc

SEQ ID NO: 5657311 - DNA, 19 bp, Homo sapiens
ttcgtaccgcttccttaga

SEQ ID NO: 5657312 - DNA, 15 bp, Homo sapiens
ttcgtagatattgga

SEQ ID NO: 5657313 - DNA, 19 bp, Homo sapiens
ttcgtagctttcccaaata

SEQ ID NO: 5657314 - DNA, 22 bp, Homo sapiens
ttcgtataatcttgtagacact

SEQ ID NO: 5657315 - DNA, 15 bp, Homo sapiens
ttcgtatgaaaatga

SEQ ID NO: 5657316 - DNA, 18 bp, Homo sapiens
ttcgtatgatcagtactg

SEQ ID NO: 5657317 - DNA, 16 bp, Homo sapiens
ttcgtattacaagaga

SEQ ID NO: 5657318 - DNA, 20 bp, Homo sapiens
ttcgtcatgttggccaggct

SEQ ID NO: 5657319 - DNA, 16 bp, Homo sapiens
ttcgtctccatctctg

SEQ ID NO: 5657320 - DNA, 18 bp, Homo sapiens
ttcgtctgcgattttatc

SEQ ID NO: 5657321 - DNA, 20 bp, Homo sapiens
ttcgtctgcgattttatctg

SEQ ID NO: 5657322 - DNA, 14 bp, Homo sapiens
ttcgtcttccctgc

SEQ ID NO: 5657323 - DNA, 16 bp, Homo sapiens
ttcgtcttctaatttc

SEQ ID NO: 5657324 - DNA, 20 bp, Homo sapiens
ttcgtgaacatagagtttgg

SEQ ID NO: 5657325 - DNA, 17 bp, Homo sapiens
ttcgtgaagtatactgt

SEQ ID NO: 5657326 - DNA, 21 bp, Homo sapiens
ttcgtgaagtatactgtattt

SEQ ID NO: 5657327 - DNA, 23 bp, Homo sapiens
ttcgtgagccccatcttcaccca

SEQ ID NO: 5657328 - DNA, 18 bp, Homo sapiens
ttcgtgagctggggactc

SEQ ID NO: 5657329 - DNA, 23 bp, Homo sapiens
ttcgtgatgacatatcacatgtc

SEQ ID NO: 5657330 - DNA, 15 bp, Homo sapiens
ttcgtgcactctgct

SEQ ID NO: 5657331 - DNA, 19 bp, Homo sapiens
ttcgtgcctgggttcccca

SEQ ID NO: 5657332 - DNA, 14 bp, Homo sapiens
ttcgtgctggagga

SEQ ID NO: 5657333 - DNA, 15 bp, Homo sapiens
ttcgtgctggaggaa

SEQ ID NO: 5657334 - DNA, 15 bp, Homo sapiens
ttcgtgggcctgctg

SEQ ID NO: 5657335 - DNA, 18 bp, Homo sapiens
ttcgtgggcctgctgctc

SEQ ID NO: 5657336 - DNA, 13 bp, Homo sapiens
ttcgtggggaggt

SEQ ID NO: 5657337 - DNA, 22 bp, Homo sapiens
ttcgtggtgatcaattaaatgt

SEQ ID NO: 5657338 - DNA, 15 bp, Homo sapiens
ttcgtgtactgcaaa

SEQ ID NO: 5657339 - DNA, 15 bp, Homo sapiens
ttcgtgtgccgctgc

SEQ ID NO: 5657340 - DNA, 14 bp, Homo sapiens
ttcgtgtggctcct

SEQ ID NO: 5657341 - DNA, 16 bp, Homo sapiens
ttcgtgtgtgcgcccc

SEQ ID NO: 5657342 - DNA, 18 bp, Homo sapiens
ttcgtgtgtgcgcccctc

SEQ ID NO: 5657343 - DNA, 15 bp, Homo sapiens
ttcgtgtttgattcc

SEQ ID NO: 5657344 - DNA, 14 bp, Homo sapiens
ttcgttaagcagta

SEQ ID NO: 5657345 - DNA, 23 bp, Homo sapiens
ttcgttaattaatgtcatgttgc

SEQ ID NO: 5657346 - DNA, 14 bp, Homo sapiens
ttcgttctctgcca

SEQ ID NO: 5657347 - DNA, 20 bp, Homo sapiens
ttcgttcttgttctgttttg

SEQ ID NO: 5657348 - DNA, 14 bp, Homo sapiens
ttcgttctttttaa

SEQ ID NO: 5657349 - DNA, 18 bp, Homo sapiens
ttcgttggttgtttctct

SEQ ID NO: 5657350 - DNA, 20 bp, Homo sapiens
ttcgttggttgtttctctga

SEQ ID NO: 5657351 - DNA, 14 bp, Homo sapiens
ttcgttgtccaatt

SEQ ID NO: 5657352 - DNA, 16 bp, Homo sapiens
ttcgtttaatgaatgc

SEQ ID NO: 5657353 - DNA, 19 bp, Homo sapiens
ttcgtttagaatcagaata

SEQ ID NO: 5657354 - DNA, 23 bp, Homo sapiens
ttcgtttatatttttttaactgt

SEQ ID NO: 5657355 - DNA, 16 bp, Homo sapiens
ttcgtttccatcatgt

SEQ ID NO: 5657356 - DNA, 15 bp, Homo sapiens
ttcgtttgcctccag

SEQ ID NO: 5657357 - DNA, 15 bp, Homo sapiens
ttcgtttggtcttag

SEQ ID NO: 5657358 - DNA, 17 bp, Homo sapiens
ttctaaaaaaaaaaact

SEQ ID NO: 5657359 - DNA, 19 bp, Homo sapiens
ttctaaaaaaaaaaactgt

SEQ ID NO: 5657360 - DNA, 14 bp, Homo sapiens
ttctaaaaacttct

SEQ ID NO: 5657361 - DNA, 14 bp, Homo sapiens
ttctaaaaagatgt

SEQ ID NO: 5657362 - DNA, 15 bp, Homo sapiens
ttctaaaaagtcaat

SEQ ID NO: 5657363 - DNA, 20 bp, Homo sapiens
ttctaaaaagtcagatgttt

SEQ ID NO: 5657364 - DNA, 16 bp, Homo sapiens
ttctaaaacaataaag

SEQ ID NO: 5657365 - DNA, 15 bp, Homo sapiens
ttctaaaacattctt

SEQ ID NO: 5657366 - DNA, 18 bp, Homo sapiens
ttctaaaactactgcctt

SEQ ID NO: 5657367 - DNA, 13 bp, Homo sapiens
ttctaaaactgta

SEQ ID NO: 5657368 - DNA, 20 bp, Homo sapiens
ttctaaaactgtactttgat

SEQ ID NO: 5657369 - DNA, 19 bp, Homo sapiens
ttctaaaacttgtatgttt

SEQ ID NO: 5657370 - DNA, 14 bp, Homo sapiens
ttctaaaagccatt

SEQ ID NO: 5657371 - DNA, 17 bp, Homo sapiens
ttctaaaatagcaataa

SEQ ID NO: 5657372 - DNA, 18 bp, Homo sapiens
ttctaaaatagcaataac

SEQ ID NO: 5657373 - DNA, 16 bp, Homo sapiens
ttctaaaatataacac

SEQ ID NO: 5657374 - DNA, 19 bp, Homo sapiens
ttctaaaatataatcaacc

SEQ ID NO: 5657375 - DNA, 22 bp, Homo sapiens
ttctaaaatcttatagttctag

SEQ ID NO: 5657376 - DNA, 13 bp, Homo sapiens
ttctaaaatgaaa

SEQ ID NO: 5657377 - DNA, 23 bp, Homo sapiens
ttctaaaatgtgatgttctaagg

SEQ ID NO: 5657378 - DNA, 20 bp, Homo sapiens
ttctaaaatgttaaaacata

SEQ ID NO: 5657379 - DNA, 23 bp, Homo sapiens
ttctaaacaagaaccatttgcaa

SEQ ID NO: 5657380 - DNA, 22 bp, Homo sapiens
ttctaaacaagaatcagtctat

SEQ ID NO: 5657381 - DNA, 11 bp, Homo sapiens
ttctaaacaga

SEQ ID NO: 5657382 - DNA, 23 bp, Homo sapiens
ttctaaacagaaattattttcta

SEQ ID NO: 5657383 - DNA, 14 bp, Homo sapiens
ttctaaacattttt

SEQ ID NO: 5657384 - DNA, 23 bp, Homo sapiens
ttctaaaccaaaaattatgtgtt

SEQ ID NO: 5657385 - DNA, 18 bp, Homo sapiens
ttctaaaccacaaaagtt

SEQ ID NO: 5657386 - DNA, 19 bp, Homo sapiens
ttctaaacctgtgcctccc

SEQ ID NO: 5657387 - DNA, 21 bp, Homo sapiens
ttctaaacctgtgcctccctc

SEQ ID NO: 5657388 - DNA, 19 bp, Homo sapiens
ttctaaactaggctccttc

SEQ ID NO: 5657389 - DNA, 20 bp, Homo sapiens
ttctaaactaggctccttca

SEQ ID NO: 5657390 - DNA, 13 bp, Homo sapiens
ttctaaactgttt

SEQ ID NO: 5657391 - DNA, 11 bp, Homo sapiens
ttctaaactta

SEQ ID NO: 5657392 - DNA, 14 bp, Homo sapiens
ttctaaagattcta

SEQ ID NO: 5657393 - DNA, 13 bp, Homo sapiens
ttctaaagctcaa

SEQ ID NO: 5657394 - DNA, 17 bp, Homo sapiens
ttctaaagctctgacat

SEQ ID NO: 5657395 - DNA, 17 bp, Homo sapiens
ttctaaagctgccagcc

SEQ ID NO: 5657396 - DNA, 16 bp, Homo sapiens
ttctaaaggagtttat

SEQ ID NO: 5657397 - DNA, 19 bp, Homo sapiens
ttctaaaggagtttatgtt

SEQ ID NO: 5657398 - DNA, 20 bp, Homo sapiens
ttctaaaggcctcttccttg

SEQ ID NO: 5657399 - DNA, 17 bp, Homo sapiens
ttctaaaggctaccttt

SEQ ID NO: 5657400 - DNA, 23 bp, Homo sapiens
ttctaaaggtaccaaacaaggaa

SEQ ID NO: 5657401 - DNA, 21 bp, Homo sapiens
ttctaaaggtagatcatcttg

SEQ ID NO: 5657402 - DNA, 15 bp, Homo sapiens
ttctaaagtaaaaac

SEQ ID NO: 5657403 - DNA, 13 bp, Homo sapiens
ttctaaagtactg

SEQ ID NO: 5657404 - DNA, 12 bp, Homo sapiens
ttctaaagtgtt

SEQ ID NO: 5657405 - DNA, 13 bp, Homo sapiens
ttctaaagtgttg

SEQ ID NO: 5657406 - DNA, 12 bp, Homo sapiens
ttctaaagttct

SEQ ID NO: 5657407 - DNA, 20 bp, Homo sapiens
ttctaaagttctaagattct

SEQ ID NO: 5657408 - DNA, 21 bp, Homo sapiens
ttctaaataaaagttttacaa

SEQ ID NO: 5657409 - DNA, 22 bp, Homo sapiens
ttctaaatatcccttggacatt

SEQ ID NO: 5657410 - DNA, 14 bp, Homo sapiens
ttctaaatcagaaa

SEQ ID NO: 5657411 - DNA, 18 bp, Homo sapiens
ttctaaatcataatcatc

SEQ ID NO: 5657412 - DNA, 19 bp, Homo sapiens
ttctaaatctccaaaataa

SEQ ID NO: 5657413 - DNA, 14 bp, Homo sapiens
ttctaaatgcaata

SEQ ID NO: 5657414 - DNA, 19 bp, Homo sapiens
ttctaaatgcaataagatt

SEQ ID NO: 5657415 - DNA, 13 bp, Homo sapiens
ttctaaatgcata

SEQ ID NO: 5657416 - DNA, 20 bp, Homo sapiens
ttctaaatgcatatcctgag

SEQ ID NO: 5657417 - DNA, 17 bp, Homo sapiens
ttctaaatgtacaaatt

SEQ ID NO: 5657418 - DNA, 22 bp, Homo sapiens
ttctaaatgttattacttgtaa

SEQ ID NO: 5657419 - DNA, 12 bp, Homo sapiens
ttctaaatgttt

SEQ ID NO: 5657420 - DNA, 12 bp, Homo sapiens
ttctaaattaaa

SEQ ID NO: 5657421 - DNA, 15 bp, Homo sapiens
ttctaaattacaaag

SEQ ID NO: 5657422 - DNA, 17 bp, Homo sapiens
ttctaaattacaaaggt

SEQ ID NO: 5657423 - DNA, 19 bp, Homo sapiens
ttctaacaaaaaaatatat

SEQ ID NO: 5657424 - DNA, 13 bp, Homo sapiens
ttctaacagtcct

SEQ ID NO: 5657425 - DNA, 13 bp, Homo sapiens
ttctaacataagt

SEQ ID NO: 5657426 - DNA, 18 bp, Homo sapiens
ttctaacataagtaagac

SEQ ID NO: 5657427 - DNA, 16 bp, Homo sapiens
ttctaacatatgtatt

SEQ ID NO: 5657428 - DNA, 17 bp, Homo sapiens
ttctaacatatgtatta

SEQ ID NO: 5657429 - DNA, 17 bp, Homo sapiens
ttctaacatattgccat

SEQ ID NO: 5657430 - DNA, 16 bp, Homo sapiens
ttctaacattaaatca

SEQ ID NO: 5657431 - DNA, 12 bp, Homo sapiens
ttctaacatttg

SEQ ID NO: 5657432 - DNA, 23 bp, Homo sapiens
ttctaaccaaagagtctctggct

SEQ ID NO: 5657433 - DNA, 22 bp, Homo sapiens
ttctaacctactaagtctgtgt

SEQ ID NO: 5657434 - DNA, 13 bp, Homo sapiens
ttctaacctcagc

SEQ ID NO: 5657435 - DNA, 14 bp, Homo sapiens
ttctaacctggagg

SEQ ID NO: 5657436 - DNA, 17 bp, Homo sapiens
ttctaaccttcacgatt

SEQ ID NO: 5657437 - DNA, 18 bp, Homo sapiens
ttctaaccttgaatgctg

SEQ ID NO: 5657438 - DNA, 15 bp, Homo sapiens
ttctaacctttacat

SEQ ID NO: 5657439 - DNA, 21 bp, Homo sapiens
ttctaacgcaaaaatagctct

SEQ ID NO: 5657440 - DNA, 14 bp, Homo sapiens
ttctaactaaacta

SEQ ID NO: 5657441 - DNA, 19 bp, Homo sapiens
ttctcagtttctgcctggg

SEQ ID NO: 5657442 - DNA, 21 bp, Homo sapiens
ttctcagtttctgcctgggca

SEQ ID NO: 5657443 - DNA, 15 bp, Homo sapiens
ttctcagtttgtata

SEQ ID NO: 5657444 - DNA, 14 bp, Homo sapiens
ttctcagttttcat

SEQ ID NO: 5657445 - DNA, 18 bp, Homo sapiens
ttctcataaatcttttta

SEQ ID NO: 5657446 - DNA, 14 bp, Homo sapiens
ttctcatagcatta

SEQ ID NO: 5657447 - DNA, 18 bp, Homo sapiens
ttctcatagcattaacta

SEQ ID NO: 5657448 - DNA, 20 bp, Homo sapiens
ttctcataggaaaagtacat

SEQ ID NO: 5657449 - DNA, 22 bp, Homo sapiens
ttctcataggaaaagtacattt

SEQ ID NO: 5657450 - DNA, 24 bp, Homo sapiens
ttctcataggaaaagtacatttaa

SEQ ID NO: 5657451 - DNA, 18 bp, Homo sapiens
ttctcatatccataaaat

SEQ ID NO: 5657452 - DNA, 22 bp, Homo sapiens
ttctcatatccataaaattgga

SEQ ID NO: 5657453 - DNA, 16 bp, Homo sapiens
ttctcatcacacacat

SEQ ID NO: 5657454 - DNA, 15 bp, Homo sapiens
ttctcatcactcccc

SEQ ID NO: 5657455 - DNA, 16 bp, Homo sapiens
ttctcatcactcccct

SEQ ID NO: 5657456 - DNA, 12 bp, Homo sapiens
ttctcatcagta

SEQ ID NO: 5657457 - DNA, 15 bp, Homo sapiens
ttctcatccaaaagt

SEQ ID NO: 5657458 - DNA, 17 bp, Homo sapiens
ttctcatctgcaccctt

SEQ ID NO: 5657459 - DNA, 20 bp, Homo sapiens
ttctcatctgtaaaaccagg

SEQ ID NO: 5657460 - DNA, 12 bp, Homo sapiens
ttctcatcttgt

SEQ ID NO: 5657461 - DNA, 15 bp, Homo sapiens
ttctcatctttcttg

SEQ ID NO: 5657462 - DNA, 17 bp, Homo sapiens
ttctcatcttttatcta

SEQ ID NO: 5657463 - DNA, 14 bp, Homo sapiens
ttctcatgatccaa

SEQ ID NO: 5657464 - DNA, 17 bp, Homo sapiens
ttctcatgatttacaga

SEQ ID NO: 5657465 - DNA, 17 bp, Homo sapiens
ttctcatgcactgcaaa

SEQ ID NO: 5657466 - DNA, 11 bp, Homo sapiens
ttctcatgcct

SEQ ID NO: 5657467 - DNA, 12 bp, Homo sapiens
ttctcatgcctc

SEQ ID NO: 5657468 - DNA, 13 bp, Homo sapiens
ttctcatgcctca

SEQ ID NO: 5657469 - DNA, 15 bp, Homo sapiens
ttctcatgctatttc

SEQ ID NO: 5657470 - DNA, 15 bp, Homo sapiens
ttctcatggggtggg

SEQ ID NO: 5657471 - DNA, 15 bp, Homo sapiens
ttctcatgtaagaat

SEQ ID NO: 5657472 - DNA, 16 bp, Homo sapiens
ttctcatgtgctttgt

SEQ ID NO: 5657473 - DNA, 19 bp, Homo sapiens
ttctcatgttccttttgaa

SEQ ID NO: 5657474 - DNA, 23 bp, Homo sapiens
ttctcattaaagttgtttcccac

SEQ ID NO: 5657475 - DNA, 15 bp, Homo sapiens
ttctcattacttgtt

SEQ ID NO: 5657476 - DNA, 15 bp, Homo sapiens
ttctcattatgaaga

SEQ ID NO: 5657477 - DNA, 18 bp, Homo sapiens
ttctcattatgaagatgt

SEQ ID NO: 5657478 - DNA, 21 bp, Homo sapiens
ttctcattatgaagatgtttt

SEQ ID NO: 5657479 - DNA, 17 bp, Homo sapiens
ttctcattatttcatca

SEQ ID NO: 5657480 - DNA, 20 bp, Homo sapiens
ttctcattccaacagtgagt

SEQ ID NO: 5657481 - DNA, 19 bp, Homo sapiens
ttctcattctgtgccattt

SEQ ID NO: 5657482 - DNA, 16 bp, Homo sapiens
ttctcattcttctaaa

SEQ ID NO: 5657483 - DNA, 18 bp, Homo sapiens
ttctcattgaccgtgctg

SEQ ID NO: 5657484 - DNA, 20 bp, Homo sapiens
ttctcattgacttttataaa

SEQ ID NO: 5657485 - DNA, 18 bp, Homo sapiens
ttctcattggaaatttag

SEQ ID NO: 5657486 - DNA, 13 bp, Homo sapiens
ttctcatttagtg

SEQ ID NO: 5657487 - DNA, 16 bp, Homo sapiens
ttctcatttatgttat

SEQ ID NO: 5657488 - DNA, 19 bp, Homo sapiens
ttctcatttatgttattta

SEQ ID NO: 5657489 - DNA, 15 bp, Homo sapiens
ttctcatttcacccc

SEQ ID NO: 5657490 - DNA, 11 bp, Homo sapiens
ttctcatttct

SEQ ID NO: 5657491 - DNA, 15 bp, Homo sapiens
ttctcatttctcagg

SEQ ID NO: 5657492 - DNA, 15 bp, Homo sapiens
ttctcatttctttct

SEQ ID NO: 5657493 - DNA, 17 bp, Homo sapiens
ttctcatttgaaatgtt

SEQ ID NO: 5657494 - DNA, 23 bp, Homo sapiens
ttctcatttggtctgccagaata

SEQ ID NO: 5657495 - DNA, 13 bp, Homo sapiens
ttctcattttctt

SEQ ID NO: 5657496 - DNA, 16 bp, Homo sapiens
ttctcattttcttttc

SEQ ID NO: 5657497 - DNA, 17 bp, Homo sapiens
ttctcattttttcctga

SEQ ID NO: 5657498 - DNA, 19 bp, Homo sapiens
ttctcattttttcctgaga

SEQ ID NO: 5657499 - DNA, 21 bp, Homo sapiens
ttctccaaaaatctgcctggg

SEQ ID NO: 5657500 - DNA, 14 bp, Homo sapiens
ttctccaaagcttg

SEQ ID NO: 5657501 - DNA, 22 bp, Homo sapiens
ttctccaaaggcactgaccctc

SEQ ID NO: 5657502 - DNA, 17 bp, Homo sapiens
ttctccaaaggctctgt

SEQ ID NO: 5657503 - DNA, 18 bp, Homo sapiens
ttctccaacaagttgcct

SEQ ID NO: 5657504 - DNA, 16 bp, Homo sapiens
ttctccaagagctaca

SEQ ID NO: 5657505 - DNA, 15 bp, Homo sapiens
ttctccaagtctagc

SEQ ID NO: 5657506 - DNA, 21 bp, Homo sapiens
ttctccaattctgaaatactt

SEQ ID NO: 5657507 - DNA, 14 bp, Homo sapiens
ttctccacctcccc

SEQ ID NO: 5657508 - DNA, 16 bp, Homo sapiens
ttctccacctgccagg

SEQ ID NO: 5657509 - DNA, 17 bp, Homo sapiens
ttctccactcagttgca

SEQ ID NO: 5657510 - DNA, 12 bp, Homo sapiens
ttctccactgga

SEQ ID NO: 5657511 - DNA, 15 bp, Homo sapiens
ttctccactttttct

SEQ ID NO: 5657512 - DNA, 18 bp, Homo sapiens
ttctccagaatgtaagaa

SEQ ID NO: 5657513 - DNA, 19 bp, Homo sapiens
ttctccagcaagcagtgcc

SEQ ID NO: 5657514 - DNA, 19 bp, Homo sapiens
ttctccagcccacacccct

SEQ ID NO: 5657515 - DNA, 22 bp, Homo sapiens
ttctccagcccatgctggctgg

SEQ ID NO: 5657516 - DNA, 22 bp, Homo sapiens
ttctccagcctggacccccagc

SEQ ID NO: 5657517 - DNA, 19 bp, Homo sapiens
ttctccagctcagaaccca

SEQ ID NO: 5657518 - DNA, 20 bp, Homo sapiens
ttctccagctcagaacccag

SEQ ID NO: 5657519 - DNA, 15 bp, Homo sapiens
ttctccagctgggct

SEQ ID NO: 5657520 - DNA, 18 bp, Homo sapiens
ttctccaggattccaaag

SEQ ID NO: 5657521 - DNA, 20 bp, Homo sapiens
ttctccaggattttaatttc

SEQ ID NO: 5657522 - DNA, 19 bp, Homo sapiens
ttctccaggtttgctgtgt

SEQ ID NO: 5657523 - DNA, 13 bp, Homo sapiens
ttctccatcccca

SEQ ID NO: 5657524 - DNA, 21 bp, Homo sapiens
ttctccatcccctccctgcct

SEQ ID NO: 5657525 - DNA, 15 bp, Homo sapiens
ttctccatcctacca

SEQ ID NO: 5657526 - DNA, 21 bp, Homo sapiens
ttctccatcctttctgcctct

SEQ ID NO: 5657527 - DNA, 16 bp, Homo sapiens
ttctccatggagccta

SEQ ID NO: 5657528 - DNA, 19 bp, Homo sapiens
ttctccatggagcctacct

SEQ ID NO: 5657529 - DNA, 22 bp, Homo sapiens
ttctccatggagcctacctctg

SEQ ID NO: 5657530 - DNA, 18 bp, Homo sapiens
ttctccattaaacttcta

SEQ ID NO: 5657531 - DNA, 20 bp, Homo sapiens
ttctccattaaacttctact

SEQ ID NO: 5657532 - DNA, 24 bp, Homo sapiens
ttctccattaaacttctactgagc

SEQ ID NO: 5657533 - DNA, 14 bp, Homo sapiens
ttctccattgtaaa

SEQ ID NO: 5657534 - DNA, 18 bp, Homo sapiens
ttctccatttaagacaca

SEQ ID NO: 5657535 - DNA, 16 bp, Homo sapiens
ttctcccaactcagcc

SEQ ID NO: 5657536 - DNA, 17 bp, Homo sapiens
ttctcccaccccttggc

SEQ ID NO: 5657537 - DNA, 19 bp, Homo sapiens
ttctcccacctccttcctc

SEQ ID NO: 5657538 - DNA, 17 bp, Homo sapiens
ttctcccagaatcccag

SEQ ID NO: 5657539 - DNA, 12 bp, Homo sapiens
ttctcccaggaa

SEQ ID NO: 5657540 - DNA, 13 bp, Homo sapiens
ttctcccaggaag

SEQ ID NO: 5657541 - DNA, 13 bp, Homo sapiens
ttctcccaggcct

SEQ ID NO: 5657542 - DNA, 20 bp, Homo sapiens
ttctcccaggcctctgcccc

SEQ ID NO: 5657543 - DNA, 13 bp, Homo sapiens
ttctcccagggag

SEQ ID NO: 5657544 - DNA, 20 bp, Homo sapiens
ttctcccaggtaccagctgc

SEQ ID NO: 5657545 - DNA, 22 bp, Homo sapiens
ttctcccagtatgttttaacaa

SEQ ID NO: 5657546 - DNA, 18 bp, Homo sapiens
ttctcccagtctctgtcg

SEQ ID NO: 5657547 - DNA, 15 bp, Homo sapiens
ttctcccatgatttg

SEQ ID NO: 5657548 - DNA, 14 bp, Homo sapiens
ttctcccatttcct

SEQ ID NO: 5657549 - DNA, 18 bp, Homo sapiens
ttctcccatttcctgatc

SEQ ID NO: 5657550 - DNA, 13 bp, Homo sapiens
ttctccccacagc

SEQ ID NO: 5657551 - DNA, 16 bp, Homo sapiens
ttctccccacccaccc

SEQ ID NO: 5657552 - DNA, 12 bp, Homo sapiens
ttctccccagct

SEQ ID NO: 5657553 - DNA, 21 bp, Homo sapiens
ttctcccccatgttctgtccc

SEQ ID NO: 5657554 - DNA, 20 bp, Homo sapiens
ttctccccccaacacaatct

SEQ ID NO: 5657555 - DNA, 17 bp, Homo sapiens
ttctccccccatcccag

SEQ ID NO: 5657556 - DNA, 19 bp, Homo sapiens
ttctccccccatcccaggg

SEQ ID NO: 5657557 - DNA, 17 bp, Homo sapiens
ttctccccctgggctct

SEQ ID NO: 5657558 - DNA, 18 bp, Homo sapiens
ttctccccctgggctctg

SEQ ID NO: 5657559 - DNA, 20 bp, Homo sapiens
ttctccccgaggctgcccca

SEQ ID NO: 5657560 - DNA, 22 bp, Homo sapiens
ttctccccgaggctgccccagg

SEQ ID NO: 5657561 - DNA, 14 bp, Homo sapiens
ttctcccctccaga

SEQ ID NO: 5657562 - DNA, 16 bp, Homo sapiens
ttctcccctccagacc

SEQ ID NO: 5657563 - DNA, 19 bp, Homo sapiens
ttctcccctccagacccct

SEQ ID NO: 5657564 - DNA, 20 bp, Homo sapiens
ttctcccctctcccagggat

SEQ ID NO: 5657565 - DNA, 19 bp, Homo sapiens
ttctcccctcttctgagct

SEQ ID NO: 5657566 - DNA, 19 bp, Homo sapiens
ttctcccctgcactgtaaa

SEQ ID NO: 5657567 - DNA, 16 bp, Homo sapiens
ttctcccctgcccttc

SEQ ID NO: 5657568 - DNA, 19 bp, Homo sapiens
ttctcccctgggtcctcca

SEQ ID NO: 5657569 - DNA, 13 bp, Homo sapiens
ttctccccttcca

SEQ ID NO: 5657570 - DNA, 20 bp, Homo sapiens
ttctccccttcctggacaca

SEQ ID NO: 5657571 - DNA, 13 bp, Homo sapiens
ttctcccggccct

SEQ ID NO: 5657572 - DNA, 11 bp, Homo sapiens
ttctccctagc

SEQ ID NO: 5657573 - DNA, 20 bp, Homo sapiens
ttctccctcatttcaggagc

SEQ ID NO: 5657574 - DNA, 10 bp, Homo sapiens
ttctccctct

SEQ ID NO: 5657575 - DNA, 13 bp, Homo sapiens
ttctccctgcagc

SEQ ID NO: 5657576 - DNA, 15 bp, Homo sapiens
ttctccctggacccc

SEQ ID NO: 5657577 - DNA, 12 bp, Homo sapiens
ttctccctgggg

SEQ ID NO: 5657578 - DNA, 17 bp, Homo sapiens
ttctccctgtcccctca

SEQ ID NO: 5657579 - DNA, 21 bp, Homo sapiens
ttctcccttcggtggaagagc

SEQ ID NO: 5657580 - DNA, 15 bp, Homo sapiens
ttctcccttctgctc

SEQ ID NO: 5657581 - DNA, 12 bp, Homo sapiens
ttctcccttctt

SEQ ID NO: 5657582 - DNA, 16 bp, Homo sapiens
ttctcccttgccctcc

SEQ ID NO: 5657583 - DNA, 17 bp, Homo sapiens
ttctcccttgccctccc

SEQ ID NO: 5657584 - DNA, 14 bp, Homo sapiens
ttctccctttctct

SEQ ID NO: 5657585 - DNA, 24 bp, Homo sapiens
ttctccctttctctctcctctctg

SEQ ID NO: 5657586 - DNA, 14 bp, Homo sapiens
ttctccgccagcct

SEQ ID NO: 5657587 - DNA, 21 bp, Homo sapiens
ttctccgggtgtggcctcagc

SEQ ID NO: 5657588 - DNA, 19 bp, Homo sapiens
ttctccgtcctcgatggga

SEQ ID NO: 5657589 - DNA, 22 bp, Homo sapiens
ttctccgttagctcctgtggcc

SEQ ID NO: 5657590 - DNA, 14 bp, Homo sapiens
ttctcctaaagctt

SEQ ID NO: 5657591 - DNA, 17 bp, Homo sapiens
ttctcctaatgctctga

SEQ ID NO: 5657592 - DNA, 15 bp, Homo sapiens
ttctcctatgtgtaa

SEQ ID NO: 5657593 - DNA, 20 bp, Homo sapiens
ttctcctcaggacaaggcct

SEQ ID NO: 5657594 - DNA, 15 bp, Homo sapiens
ttctcctcagtggct

SEQ ID NO: 5657595 - DNA, 17 bp, Homo sapiens
ttctcctccaaatgctg

SEQ ID NO: 5657596 - DNA, 18 bp, Homo sapiens
ttctcctccaaatgctgt

SEQ ID NO: 5657597 - DNA, 22 bp, Homo sapiens
ttctcctccattcatgtttaat

SEQ ID NO: 5657598 - DNA, 13 bp, Homo sapiens
ttctcctccccac

SEQ ID NO: 5657599 - DNA, 17 bp, Homo sapiens
ttctcctccccacctgt

SEQ ID NO: 5657600 - DNA, 20 bp, Homo sapiens
ttctcctccccacctgtagc

SEQ ID NO: 5657601 - DNA, 21 bp, Homo sapiens
ttctcctccccacctgtagct

SEQ ID NO: 5657602 - DNA, 22 bp, Homo sapiens
ttctcctccccacctgtagctg

SEQ ID NO: 5657603 - DNA, 23 bp, Homo sapiens
ttctcctccgcctgtgtccatct

SEQ ID NO: 5657604 - DNA, 16 bp, Homo sapiens
ttctcctcctcctccc

SEQ ID NO: 5657605 - DNA, 21 bp, Homo sapiens
ttctcctcgtccatcagggat

SEQ ID NO: 5657606 - DNA, 21 bp, Homo sapiens
ttctcctcgttggttcatgtg

SEQ ID NO: 5657607 - DNA, 15 bp, Homo sapiens
ttctcctctggcttc

SEQ ID NO: 5657608 - DNA, 13 bp, Homo sapiens
ttctcctcttgta

SEQ ID NO: 5657609 - DNA, 14 bp, Homo sapiens
ttctcctcttgtaa

SEQ ID NO: 5657610 - DNA, 19 bp, Homo sapiens
ttctcctcttgtaaataaa

SEQ ID NO: 5657611 - DNA, 17 bp, Homo sapiens
ttctcctctttctcagt

SEQ ID NO: 5657612 - DNA, 21 bp, Homo sapiens
ttctcctgatgttttgccgtg

SEQ ID NO: 5657613 - DNA, 20 bp, Homo sapiens
ttctcctgcaaatttagttt

SEQ ID NO: 5657614 - DNA, 14 bp, Homo sapiens
ttctcctgcctcac

SEQ ID NO: 5657615 - DNA, 17 bp, Homo sapiens
ttctcctgcctcagcct

SEQ ID NO: 5657616 - DNA, 22 bp, Homo sapiens
ttctcctgcctcagcctcctga

SEQ ID NO: 5657617 - DNA, 20 bp, Homo sapiens
ttctcctgctgctccctcag

SEQ ID NO: 5657618 - DNA, 21 bp, Homo sapiens
ttctcctgctgctccctcaga

SEQ ID NO: 5657619 - DNA, 16 bp, Homo sapiens
ttctgcagttctcatg

SEQ ID NO: 5657620 - DNA, 19 bp, Homo sapiens
ttctgcatagcgaaataaa

SEQ ID NO: 5657621 - DNA, 23 bp, Homo sapiens
ttctgcatcagctgctgaaacaa

SEQ ID NO: 5657622 - DNA, 20 bp, Homo sapiens
ttctgcatcatctgtagata

SEQ ID NO: 5657623 - DNA, 15 bp, Homo sapiens
ttctgcatgagctga

SEQ ID NO: 5657624 - DNA, 18 bp, Homo sapiens
ttctgcatgagctgatca

SEQ ID NO: 5657625 - DNA, 12 bp, Homo sapiens
ttctgcattact

SEQ ID NO: 5657626 - DNA, 18 bp, Homo sapiens
ttctgcattcctgtaact

SEQ ID NO: 5657627 - DNA, 14 bp, Homo sapiens
ttctgcattgagaa

SEQ ID NO: 5657628 - DNA, 22 bp, Homo sapiens
ttctgcattgctagataaaagc

SEQ ID NO: 5657629 - DNA, 15 bp, Homo sapiens
ttctgcatttagctg

SEQ ID NO: 5657630 - DNA, 21 bp, Homo sapiens
ttctgcatttagctgtattca

SEQ ID NO: 5657631 - DNA, 17 bp, Homo sapiens
ttctgcattttgctatt

SEQ ID NO: 5657632 - DNA, 15 bp, Homo sapiens
ttctgccacataaaa

SEQ ID NO: 5657633 - DNA, 19 bp, Homo sapiens
ttctgccactgaggagaca

SEQ ID NO: 5657634 - DNA, 21 bp, Homo sapiens
ttctgccacttgcactgtgct

SEQ ID NO: 5657635 - DNA, 10 bp, Homo sapiens
ttctgccagc

SEQ ID NO: 5657636 - DNA, 13 bp, Homo sapiens
ttctgccaggaga

SEQ ID NO: 5657637 - DNA, 23 bp, Homo sapiens
ttctgccatcatttttgatgact

SEQ ID NO: 5657638 - DNA, 21 bp, Homo sapiens
ttctgccatctagccagcccc

SEQ ID NO: 5657639 - DNA, 16 bp, Homo sapiens
ttctgcccaaattatg

SEQ ID NO: 5657640 - DNA, 19 bp, Homo sapiens
ttctgcccaattggaggaa

SEQ ID NO: 5657641 - DNA, 22 bp, Homo sapiens
ttctgcccacaccgcagggaca

SEQ ID NO: 5657642 - DNA, 20 bp, Homo sapiens
ttctgcccaccccgcctctg

SEQ ID NO: 5657643 - DNA, 20 bp, Homo sapiens
ttctgcccatcctgtctgtt

SEQ ID NO: 5657644 - DNA, 15 bp, Homo sapiens
ttctgcccccagccc

SEQ ID NO: 5657645 - DNA, 19 bp, Homo sapiens
ttctgcccccgttccagct

SEQ ID NO: 5657646 - DNA, 13 bp, Homo sapiens
ttctgccctgagc

SEQ ID NO: 5657647 - DNA, 18 bp, Homo sapiens
ttctgccctgggttcttc

SEQ ID NO: 5657648 - DNA, 18 bp, Homo sapiens
ttctgcccttcctccagg

SEQ ID NO: 5657649 - DNA, 22 bp, Homo sapiens
ttctgccgccccctcctgaacc

SEQ ID NO: 5657650 - DNA, 14 bp, Homo sapiens
ttctgcctaataaa

SEQ ID NO: 5657651 - DNA, 15 bp, Homo sapiens
ttctgcctagagtgt

SEQ ID NO: 5657652 - DNA, 16 bp, Homo sapiens
ttctgcctagagtgta

SEQ ID NO: 5657653 - DNA, 23 bp, Homo sapiens
ttctgcctataaatttactctgt

SEQ ID NO: 5657654 - DNA, 17 bp, Homo sapiens
ttctgcctcagcctcct

SEQ ID NO: 5657655 - DNA, 12 bp, Homo sapiens
ttctgcctcctg

SEQ ID NO: 5657656 - DNA, 17 bp, Homo sapiens
ttctgcctcctttagta

SEQ ID NO: 5657657 - DNA, 13 bp, Homo sapiens
ttctgcctctcaa

SEQ ID NO: 5657658 - DNA, 12 bp, Homo sapiens
ttctgcctctcc

SEQ ID NO: 5657659 - DNA, 17 bp, Homo sapiens
ttctgcctctctaggac

SEQ ID NO: 5657660 - DNA, 15 bp, Homo sapiens
ttctgcctctgatgt

SEQ ID NO: 5657661 - DNA, 16 bp, Homo sapiens
ttctgcctctgatgta

SEQ ID NO: 5657662 - DNA, 15 bp, Homo sapiens
ttctgcctgagattc

SEQ ID NO: 5657663 - DNA, 21 bp, Homo sapiens
ttctgcctgaggggcagcctg

SEQ ID NO: 5657664 - DNA, 23 bp, Homo sapiens
ttctgcctgaggggcagcctgcc

SEQ ID NO: 5657665 - DNA, 15 bp, Homo sapiens
ttctgcctgcccagg

SEQ ID NO: 5657666 - DNA, 21 bp, Homo sapiens
ttctgcctgcccaggcccctg

SEQ ID NO: 5657667 - DNA, 21 bp, Homo sapiens
ttctgcctgcctcctccctcc

SEQ ID NO: 5657668 - DNA, 17 bp, Homo sapiens
ttctgcctgctccatcg

SEQ ID NO: 5657669 - DNA, 22 bp, Homo sapiens
ttctgcctgtcctagtctcctt

SEQ ID NO: 5657670 - DNA, 15 bp, Homo sapiens
ttctgcctgttataa

SEQ ID NO: 5657671 - DNA, 20 bp, Homo sapiens
ttctgcctgttataactctg

SEQ ID NO: 5657672 - DNA, 14 bp, Homo sapiens
ttctgccttctcat

SEQ ID NO: 5657673 - DNA, 16 bp, Homo sapiens
ttctgccttctcatga

SEQ ID NO: 5657674 - DNA, 20 bp, Homo sapiens
ttctgccttggttctggcca

SEQ ID NO: 5657675 - DNA, 20 bp, Homo sapiens
ttctgcctttagcctggacc

SEQ ID NO: 5657676 - DNA, 18 bp, Homo sapiens
ttctgcctttcccccctc

SEQ ID NO: 5657677 - DNA, 21 bp, Homo sapiens
ttctgcctttcccccctcaca

SEQ ID NO: 5657678 - DNA, 15 bp, Homo sapiens
ttctgcctttgatgt

SEQ ID NO: 5657679 - DNA, 16 bp, Homo sapiens
ttctgccttttcactg

SEQ ID NO: 5657680 - DNA, 15 bp, Homo sapiens
ttctgccttttttat

SEQ ID NO: 5657681 - DNA, 22 bp, Homo sapiens
ttctgcgccacttcctttgtgt

SEQ ID NO: 5657682 - DNA, 14 bp, Homo sapiens
ttctgcgcctcagg

SEQ ID NO: 5657683 - DNA, 14 bp, Homo sapiens
ttctgcgcttcagt

SEQ ID NO: 5657684 - DNA, 18 bp, Homo sapiens
ttctgcgggctccctcct

SEQ ID NO: 5657685 - DNA, 21 bp, Homo sapiens
ttctgcgggctccctcctctg

SEQ ID NO: 5657686 - DNA, 19 bp, Homo sapiens
ttctgcggggcctgaggca

SEQ ID NO: 5657687 - DNA, 19 bp, Homo sapiens
ttctgcgtccaccaggcct

SEQ ID NO: 5657688 - DNA, 21 bp, Homo sapiens
ttctgcgtgatggctatgcct

SEQ ID NO: 5657689 - DNA, 18 bp, Homo sapiens
ttctgcgtgctttattta

SEQ ID NO: 5657690 - DNA, 15 bp, Homo sapiens
ttctgcgtgtgtata

SEQ ID NO: 5657691 - DNA, 16 bp, Homo sapiens
ttctgctaatttatga

SEQ ID NO: 5657692 - DNA, 15 bp, Homo sapiens
ttctgctacctcact

SEQ ID NO: 5657693 - DNA, 16 bp, Homo sapiens
ttctgctacctggttt

SEQ ID NO: 5657694 - DNA, 18 bp, Homo sapiens
ttctgctacctggttttc

SEQ ID NO: 5657695 - DNA, 15 bp, Homo sapiens
ttctgctacttcact

SEQ ID NO: 5657696 - DNA, 20 bp, Homo sapiens
ttctgctaggtagaggcatt

SEQ ID NO: 5657697 - DNA, 24 bp, Homo sapiens
ttctgctaggtagaggcatttgtc

SEQ ID NO: 5657698 - DNA, 19 bp, Homo sapiens
ttctgctcacatatctgtc

SEQ ID NO: 5657699 - DNA, 22 bp, Homo sapiens
ttctgctcagaggccttgctgt

SEQ ID NO: 5657700 - DNA, 15 bp, Homo sapiens
ttctgctcattctaa

SEQ ID NO: 5657701 - DNA, 16 bp, Homo sapiens
ttctgctccacccttg

SEQ ID NO: 5657702 - DNA, 13 bp, Homo sapiens
ttctgctccagcc

SEQ ID NO: 5657703 - DNA, 15 bp, Homo sapiens
ttctgctcccacccc

SEQ ID NO: 5657704 - DNA, 17 bp, Homo sapiens
ttctgctcctctccagg

SEQ ID NO: 5657705 - DNA, 18 bp, Homo sapiens
ttctgctcctctccaggc

SEQ ID NO: 5657706 - DNA, 14 bp, Homo sapiens
ttctgctcctgctt

SEQ ID NO: 5657707 - DNA, 20 bp, Homo sapiens
ttctgctcctgcttttctgt

SEQ ID NO: 5657708 - DNA, 22 bp, Homo sapiens
ttctgctctaagaagctgcaat

SEQ ID NO: 5657709 - DNA, 18 bp, Homo sapiens
ttctgctctatactgtgg

SEQ ID NO: 5657710 - DNA, 12 bp, Homo sapiens
ttctgctctgcc

SEQ ID NO: 5657711 - DNA, 13 bp, Homo sapiens
ttctgctctgcca

SEQ ID NO: 5657712 - DNA, 21 bp, Homo sapiens
ttctgctctggttgtttctgt

SEQ ID NO: 5657713 - DNA, 23 bp, Homo sapiens
ttctgctctggttgtttctgttc

SEQ ID NO: 5657714 - DNA, 14 bp, Homo sapiens
ttctgctctttaca

SEQ ID NO: 5657715 - DNA, 16 bp, Homo sapiens
ttctgctcttttcctg

SEQ ID NO: 5657716 - DNA, 14 bp, Homo sapiens
ttctgctgaatttt

SEQ ID NO: 5657717 - DNA, 18 bp, Homo sapiens
ttctgctgaattttcaca

SEQ ID NO: 5657718 - DNA, 14 bp, Homo sapiens
ttctgctgaccaaa

SEQ ID NO: 5657719 - DNA, 15 bp, Homo sapiens
ttctgctgcccaggc

SEQ ID NO: 5657720 - DNA, 17 bp, Homo sapiens
ttctgctgcccaggcca

SEQ ID NO: 5657721 - DNA, 14 bp, Homo sapiens
ttctgctgcccctg

SEQ ID NO: 5657722 - DNA, 13 bp, Homo sapiens
ttctgctgccctc

SEQ ID NO: 5657723 - DNA, 14 bp, Homo sapiens
ttctgctgcctgtt

SEQ ID NO: 5657724 - DNA, 21 bp, Homo sapiens
ttctgctggataaaatgaggt

SEQ ID NO: 5657725 - DNA, 18 bp, Homo sapiens
ttctgctggcctctgcga

SEQ ID NO: 5657726 - DNA, 14 bp, Homo sapiens
ttctgctggcctgg

SEQ ID NO: 5657727 - DNA, 15 bp, Homo sapiens
ttctgctggcctgga

SEQ ID NO: 5657728 - DNA, 18 bp, Homo sapiens
ttctgctggcctggatct

SEQ ID NO: 5657729 - DNA, 20 bp, Homo sapiens
ttctgctgggagttctagaa

SEQ ID NO: 5657730 - DNA, 15 bp, Homo sapiens
ttctgctgggctggg

SEQ ID NO: 5657731 - DNA, 20 bp, Homo sapiens
ttctgctgggctggggcctg

SEQ ID NO: 5657732 - DNA, 14 bp, Homo sapiens
ttctgctgtctccc

SEQ ID NO: 5657733 - DNA, 17 bp, Homo sapiens
ttctgctgtctgggact

SEQ ID NO: 5657734 - DNA, 15 bp, Homo sapiens
ttctgcttcagcctc

SEQ ID NO: 5657735 - DNA, 16 bp, Homo sapiens
ttctgcttcagcctcc

SEQ ID NO: 5657736 - DNA, 11 bp, Homo sapiens
ttctgcttcta

SEQ ID NO: 5657737 - DNA, 13 bp, Homo sapiens
ttctgcttgagaa

SEQ ID NO: 5657738 - DNA, 15 bp, Homo sapiens
ttctgcttgtcatcc

SEQ ID NO: 5657739 - DNA, 14 bp, Homo sapiens
ttctgcttgtccca

SEQ ID NO: 5657740 - DNA, 18 bp, Homo sapiens
ttctgcttgtgacattaa

SEQ ID NO: 5657741 - DNA, 15 bp, Homo sapiens
ttctgctttaaaaat

SEQ ID NO: 5657742 - DNA, 19 bp, Homo sapiens
ttctgctttaaattaaaat

SEQ ID NO: 5657743 - DNA, 20 bp, Homo sapiens
ttctgctttaaattaaaatt

SEQ ID NO: 5657744 - DNA, 17 bp, Homo sapiens
ttctgctttatcttttc

SEQ ID NO: 5657745 - DNA, 19 bp, Homo sapiens
ttctgctttctttgattct

SEQ ID NO: 5657746 - DNA, 18 bp, Homo sapiens
ttctgcttttaagttttt

SEQ ID NO: 5657747 - DNA, 18 bp, Homo sapiens
ttctgcttttctgccctg

SEQ ID NO: 5657748 - DNA, 20 bp, Homo sapiens
ttctggaaaaaaaatatata

SEQ ID NO: 5657749 - DNA, 22 bp, Homo sapiens
ttctggaaaaaaaatatatata

SEQ ID NO: 5657750 - DNA, 17 bp, Homo sapiens
ttctggaaaaacaggat

SEQ ID NO: 5657751 - DNA, 18 bp, Homo sapiens
ttctggaaaagaggagtt

SEQ ID NO: 5657752 - DNA, 14 bp, Homo sapiens
ttctggaaaggaaa

SEQ ID NO: 5657753 - DNA, 10 bp, Homo sapiens
ttctggaaat

SEQ ID NO: 5657754 - DNA, 17 bp, Homo sapiens
ttctggaaatccagata

SEQ ID NO: 5657755 - DNA, 16 bp, Homo sapiens
ttctggaaatgttctt

SEQ ID NO: 5657756 - DNA, 17 bp, Homo sapiens
ttctggaaatgttcttt

SEQ ID NO: 5657757 - DNA, 20 bp, Homo sapiens
ttctggaaattcttccctgg

SEQ ID NO: 5657758 - DNA, 15 bp, Homo sapiens
ttctggaaattttgt

SEQ ID NO: 5657759 - DNA, 12 bp, Homo sapiens
ttctggaagaaa

SEQ ID NO: 5657760 - DNA, 15 bp, Homo sapiens
ttctggaagaaaggc

SEQ ID NO: 5657761 - DNA, 18 bp, Homo sapiens
ttctggaaggctggctga

SEQ ID NO: 5657762 - DNA, 19 bp, Homo sapiens
ttctggaaggctggctgag

SEQ ID NO: 5657763 - DNA, 17 bp, Homo sapiens
ttctggaatacatgaaa

SEQ ID NO: 5657764 - DNA, 22 bp, Homo sapiens
ttctggaatcattgtccagagc

SEQ ID NO: 5657765 - DNA, 13 bp, Homo sapiens
ttctggaatgctt

SEQ ID NO: 5657766 - DNA, 19 bp, Homo sapiens
ttctggaatttgttcaagt

SEQ ID NO: 5657767 - DNA, 21 bp, Homo sapiens
ttctggaatttgttcaagttt

SEQ ID NO: 5657768 - DNA, 22 bp, Homo sapiens
ttctggaatttgttcaagtttt

SEQ ID NO: 5657769 - DNA, 22 bp, Homo sapiens
ttctggaccagatcctactctt

SEQ ID NO: 5657770 - DNA, 17 bp, Homo sapiens
ttctggacctctgggtt

SEQ ID NO: 5657771 - DNA, 18 bp, Homo sapiens
ttctggacctctgggttg

SEQ ID NO: 5657772 - DNA, 18 bp, Homo sapiens
ttctggacctgggcatga

SEQ ID NO: 5657773 - DNA, 15 bp, Homo sapiens
ttctggactaaaact

SEQ ID NO: 5657774 - DNA, 17 bp, Homo sapiens
ttctggactcccactct

SEQ ID NO: 5657775 - DNA, 22 bp, Homo sapiens
ttctggactcccactctttgaa

SEQ ID NO: 5657776 - DNA, 16 bp, Homo sapiens
ttctggactctgcccc

SEQ ID NO: 5657777 - DNA, 23 bp, Homo sapiens
ttctggagatggaagcttgttga

SEQ ID NO: 5657778 - DNA, 23 bp, Homo sapiens
ttctggagcaagagagagctcgc

SEQ ID NO: 5657779 - DNA, 15 bp, Homo sapiens
ttctggagctgctgt

SEQ ID NO: 5657780 - DNA, 19 bp, Homo sapiens
ttctggaggaaagggagga

SEQ ID NO: 5657781 - DNA, 15 bp, Homo sapiens
ttctggaggaagaag

SEQ ID NO: 5657782 - DNA, 16 bp, Homo sapiens
ttctggaggtggggag

SEQ ID NO: 5657783 - DNA, 19 bp, Homo sapiens
ttctggagtgattctagag

SEQ ID NO: 5657784 - DNA, 23 bp, Homo sapiens
ttctggataaaccaccctctggg

SEQ ID NO: 5657785 - DNA, 13 bp, Homo sapiens
ttctggataaagc

SEQ ID NO: 5657786 - DNA, 23 bp, Homo sapiens
ttctggatccatggggggagaag

SEQ ID NO: 5657787 - DNA, 21 bp, Homo sapiens
ttctggatctgaccctcccag

SEQ ID NO: 5657788 - DNA, 18 bp, Homo sapiens
ttctggatggtgtgcctt

SEQ ID NO: 5657789 - DNA, 20 bp, Homo sapiens
ttctggatggtgtgccttcc

SEQ ID NO: 5657790 - DNA, 17 bp, Homo sapiens
ttctggattataaaaat

SEQ ID NO: 5657791 - DNA, 19 bp, Homo sapiens
ttctggattataaaaatga

SEQ ID NO: 5657792 - DNA, 20 bp, Homo sapiens
ttctggattataaaaatgaa

SEQ ID NO: 5657793 - DNA, 15 bp, Homo sapiens
ttctggattcttggc

SEQ ID NO: 5657794 - DNA, 23 bp, Homo sapiens
ttctggatttttttttctttata

SEQ ID NO: 5657795 - DNA, 15 bp, Homo sapiens
ttctggcagaggagg

SEQ ID NO: 5657796 - DNA, 10 bp, Homo sapiens
ttctggcagg

SEQ ID NO: 5657797 - DNA, 19 bp, Homo sapiens
ttcttatttaatgaaagac

SEQ ID NO: 5657798 - DNA, 18 bp, Homo sapiens
ttcttatttatgtaacaa

SEQ ID NO: 5657799 - DNA, 13 bp, Homo sapiens
ttcttatttcatt

SEQ ID NO: 5657800 - DNA, 17 bp, Homo sapiens
ttcttatttcatttatt

SEQ ID NO: 5657801 - DNA, 14 bp, Homo sapiens
ttcttatttgaaag

SEQ ID NO: 5657802 - DNA, 15 bp, Homo sapiens
ttcttatttgcaata

SEQ ID NO: 5657803 - DNA, 17 bp, Homo sapiens
ttcttatttgcaataaa

SEQ ID NO: 5657804 - DNA, 18 bp, Homo sapiens
ttcttatttgcaataaaa

SEQ ID NO: 5657805 - DNA, 22 bp, Homo sapiens
ttcttatttttcctaacaaaag

SEQ ID NO: 5657806 - DNA, 19 bp, Homo sapiens
ttcttatttttttctattt

SEQ ID NO: 5657807 - DNA, 21 bp, Homo sapiens
ttcttcaaaaggtaaatacaa

SEQ ID NO: 5657808 - DNA, 21 bp, Homo sapiens
ttcttcaaaatgtatatattt

SEQ ID NO: 5657809 - DNA, 23 bp, Homo sapiens
ttcttcaaaatgtatatatttag

SEQ ID NO: 5657810 - DNA, 14 bp, Homo sapiens
ttcttcaaagtgga

SEQ ID NO: 5657811 - DNA, 18 bp, Homo sapiens
ttcttcaaatacaaagta

SEQ ID NO: 5657812 - DNA, 19 bp, Homo sapiens
ttcttcaaatccttccaaa

SEQ ID NO: 5657813 - DNA, 17 bp, Homo sapiens
ttcttcaaatctcagca

SEQ ID NO: 5657814 - DNA, 19 bp, Homo sapiens
ttcttcaaatctcagcaaa

SEQ ID NO: 5657815 - DNA, 21 bp, Homo sapiens
ttcttcaacgttggtatgata

SEQ ID NO: 5657816 - DNA, 14 bp, Homo sapiens
ttcttcaactccct

SEQ ID NO: 5657817 - DNA, 17 bp, Homo sapiens
ttcttcaagatcccatt

SEQ ID NO: 5657818 - DNA, 19 bp, Homo sapiens
ttcttcaagggaagaaaca

SEQ ID NO: 5657819 - DNA, 17 bp, Homo sapiens
ttcttcaattaatggaa

SEQ ID NO: 5657820 - DNA, 18 bp, Homo sapiens
ttcttcaattaatggaaa

SEQ ID NO: 5657821 - DNA, 17 bp, Homo sapiens
ttcttcacatgtaactt

SEQ ID NO: 5657822 - DNA, 21 bp, Homo sapiens
ttcttcacccagctaatctgt

SEQ ID NO: 5657823 - DNA, 22 bp, Homo sapiens
ttcttcacctaagtctctgtga

SEQ ID NO: 5657824 - DNA, 13 bp, Homo sapiens
ttcttcacctcta

SEQ ID NO: 5657825 - DNA, 15 bp, Homo sapiens
ttcttcacctcttcc

SEQ ID NO: 5657826 - DNA, 18 bp, Homo sapiens
ttcttcactcaaattttg

SEQ ID NO: 5657827 - DNA, 16 bp, Homo sapiens
ttcttcactctggctt

SEQ ID NO: 5657828 - DNA, 18 bp, Homo sapiens
ttcttcactctggcttca

SEQ ID NO: 5657829 - DNA, 17 bp, Homo sapiens
ttcttcacttcaagctg

SEQ ID NO: 5657830 - DNA, 14 bp, Homo sapiens
ttcttcagaagaca

SEQ ID NO: 5657831 - DNA, 12 bp, Homo sapiens
ttcttcagaatt

SEQ ID NO: 5657832 - DNA, 18 bp, Homo sapiens
ttcttcagaattatccat

SEQ ID NO: 5657833 - DNA, 22 bp, Homo sapiens
ttcttcagaattatccattacg

SEQ ID NO: 5657834 - DNA, 18 bp, Homo sapiens
ttcttcagatatactgga

SEQ ID NO: 5657835 - DNA, 12 bp, Homo sapiens
ttcttcagattg

SEQ ID NO: 5657836 - DNA, 10 bp, Homo sapiens
ttcttcagca

SEQ ID NO: 5657837 - DNA, 14 bp, Homo sapiens
ttcttcagccacct

SEQ ID NO: 5657838 - DNA, 19 bp, Homo sapiens
ttcttcagcgtaaaatggt

SEQ ID NO: 5657839 - DNA, 20 bp, Homo sapiens
ttcttcaggagatgatgtga

SEQ ID NO: 5657840 - DNA, 24 bp, Homo sapiens
ttcttcaggctgcctaagacatgt

SEQ ID NO: 5657841 - DNA, 18 bp, Homo sapiens
ttcttcagtcctttgtct

SEQ ID NO: 5657842 - DNA, 22 bp, Homo sapiens
ttcttcagtcctttgtctttct

SEQ ID NO: 5657843 - DNA, 19 bp, Homo sapiens
ttcttcagtctggactata

SEQ ID NO: 5657844 - DNA, 18 bp, Homo sapiens
ttcttcagtgtctctgtt

SEQ ID NO: 5657845 - DNA, 18 bp, Homo sapiens
ttcttcataacaatttta

SEQ ID NO: 5657846 - DNA, 14 bp, Homo sapiens
ttcttcatataata

SEQ ID NO: 5657847 - DNA, 21 bp, Homo sapiens
ttcttcatccggcagcctgga

SEQ ID NO: 5657848 - DNA, 16 bp, Homo sapiens
ttcttcatcttgacat

SEQ ID NO: 5657849 - DNA, 15 bp, Homo sapiens
ttcttcatgcaatga

SEQ ID NO: 5657850 - DNA, 18 bp, Homo sapiens
ttcttcatgcaatgacat

SEQ ID NO: 5657851 - DNA, 16 bp, Homo sapiens
ttcttcatgtcatcaa

SEQ ID NO: 5657852 - DNA, 21 bp, Homo sapiens
ttcttcattcaatacaagtgt

SEQ ID NO: 5657853 - DNA, 22 bp, Homo sapiens
ttcttcattctatcaagcccag

SEQ ID NO: 5657854 - DNA, 14 bp, Homo sapiens
ttcttcatttacaa

SEQ ID NO: 5657855 - DNA, 11 bp, Homo sapiens
ttcttcatttc

SEQ ID NO: 5657856 - DNA, 15 bp, Homo sapiens
ttcttcatttctctg

SEQ ID NO: 5657857 - DNA, 16 bp, Homo sapiens
ttcttcatttctctgc

SEQ ID NO: 5657858 - DNA, 17 bp, Homo sapiens
ttcttccaaaaagattt

SEQ ID NO: 5657859 - DNA, 17 bp, Homo sapiens
ttcttccaaacttttgc

SEQ ID NO: 5657860 - DNA, 17 bp, Homo sapiens
ttcttccaaatgcagtt

SEQ ID NO: 5657861 - DNA, 14 bp, Homo sapiens
ttcttccaattatt

SEQ ID NO: 5657862 - DNA, 22 bp, Homo sapiens
ttcttccacctcagcctcccag

SEQ ID NO: 5657863 - DNA, 18 bp, Homo sapiens
ttcttccacgtaattcaa

SEQ ID NO: 5657864 - DNA, 20 bp, Homo sapiens
ttcttccactttttccagaa

SEQ ID NO: 5657865 - DNA, 15 bp, Homo sapiens
ttcttccagaatgct

SEQ ID NO: 5657866 - DNA, 11 bp, Homo sapiens
ttcttccagga

SEQ ID NO: 5657867 - DNA, 19 bp, Homo sapiens
ttcttccaggtgcccagct

SEQ ID NO: 5657868 - DNA, 19 bp, Homo sapiens
ttcttccagtgatgttgaa

SEQ ID NO: 5657869 - DNA, 20 bp, Homo sapiens
ttcttccagtgatgttgaaa

SEQ ID NO: 5657870 - DNA, 18 bp, Homo sapiens
ttcttccatcatcactgt

SEQ ID NO: 5657871 - DNA, 21 bp, Homo sapiens
ttcttccatcatcactgtaaa

SEQ ID NO: 5657872 - DNA, 16 bp, Homo sapiens
ttcttccatcccagga

SEQ ID NO: 5657873 - DNA, 13 bp, Homo sapiens
ttcttccatctga

SEQ ID NO: 5657874 - DNA, 21 bp, Homo sapiens
ttcttccattcccatttcctg

SEQ ID NO: 5657875 - DNA, 22 bp, Homo sapiens
ttcttcccaaatcaaaataaaa

SEQ ID NO: 5657876 - DNA, 19 bp, Homo sapiens
ttcttcccaacttgccttt

SEQ ID NO: 5657877 - DNA, 20 bp, Homo sapiens
ttcttcccaatagcaaggct

SEQ ID NO: 5657878 - DNA, 20 bp, Homo sapiens
ttcttcccacttcttggatt

SEQ ID NO: 5657879 - DNA, 18 bp, Homo sapiens
ttcttcccagaatctctg

SEQ ID NO: 5657880 - DNA, 20 bp, Homo sapiens
ttcttcccagaatctctgag

SEQ ID NO: 5657881 - DNA, 23 bp, Homo sapiens
ttcttccccaaggcactgagcgc

SEQ ID NO: 5657882 - DNA, 12 bp, Homo sapiens
ttcttccccacc

SEQ ID NO: 5657883 - DNA, 23 bp, Homo sapiens
ttcttccccagggttctgtattg

SEQ ID NO: 5657884 - DNA, 21 bp, Homo sapiens
ttcttcccccagggtcccctg

SEQ ID NO: 5657885 - DNA, 17 bp, Homo sapiens
ttcttcccgccccacct

SEQ ID NO: 5657886 - DNA, 14 bp, Homo sapiens
ttcttcccgctccc

SEQ ID NO: 5657887 - DNA, 21 bp, Homo sapiens
ttcttcccgtgtgtatttcta

SEQ ID NO: 5657888 - DNA, 20 bp, Homo sapiens
ttcttccctatacttcacac

SEQ ID NO: 5657889 - DNA, 17 bp, Homo sapiens
ttcttcccttatccctg

SEQ ID NO: 5657890 - DNA, 21 bp, Homo sapiens
ttcttcccttctcttcactag

SEQ ID NO: 5657891 - DNA, 22 bp, Homo sapiens
ttcttcccttttaaacacattt

SEQ ID NO: 5657892 - DNA, 22 bp, Homo sapiens
ttcttccgcaccctccctagct

SEQ ID NO: 5657893 - DNA, 15 bp, Homo sapiens
ttcttccgggggaag

SEQ ID NO: 5657894 - DNA, 18 bp, Homo sapiens
ttcttccgggggaagggg

SEQ ID NO: 5657895 - DNA, 16 bp, Homo sapiens
ttcttccgtcacatat

SEQ ID NO: 5657896 - DNA, 21 bp, Homo sapiens
ttcttcctatttgccatgggc

SEQ ID NO: 5657897 - DNA, 18 bp, Homo sapiens
ttcttcctcaagtcttga

SEQ ID NO: 5657898 - DNA, 13 bp, Homo sapiens
ttcttcctcagcc

SEQ ID NO: 5657899 - DNA, 21 bp, Homo sapiens
ttcttcctccagtctgttctc

SEQ ID NO: 5657900 - DNA, 13 bp, Homo sapiens
ttcttcctccctc

SEQ ID NO: 5657901 - DNA, 21 bp, Homo sapiens
ttcttcctcctccatcacctg

SEQ ID NO: 5657902 - DNA, 14 bp, Homo sapiens
ttcttcctctcctt

SEQ ID NO: 5657903 - DNA, 11 bp, Homo sapiens
ttcttcctctg

SEQ ID NO: 5657904 - DNA, 13 bp, Homo sapiens
ttcttcctgccag

SEQ ID NO: 5657905 - DNA, 12 bp, Homo sapiens
ttcttcctgctg

SEQ ID NO: 5657906 - DNA, 14 bp, Homo sapiens
ttcttcctgtgaag

SEQ ID NO: 5657907 - DNA, 9 bp, Homo sapiens
ttcttcctt

SEQ ID NO: 5657908 - DNA, 20 bp, Homo sapiens
ttcttccttccctcctttta

SEQ ID NO: 5657909 - DNA, 13 bp, Homo sapiens
ttcttccttcctt

SEQ ID NO: 5657910 - DNA, 13 bp, Homo sapiens
ttcttcctttccc

SEQ ID NO: 5657911 - DNA, 19 bp, Homo sapiens
ttcttcctttccctggagc

SEQ ID NO: 5657912 - DNA, 13 bp, Homo sapiens
ttcttcctttcta

SEQ ID NO: 5657913 - DNA, 13 bp, Homo sapiens
ttcttcctttctc

SEQ ID NO: 5657914 - DNA, 20 bp, Homo sapiens
ttcttccttttgtatcctcc

SEQ ID NO: 5657915 - DNA, 17 bp, Homo sapiens
ttcttcgaaaatctaga

SEQ ID NO: 5657916 - DNA, 19 bp, Homo sapiens
ttcttcgactgttgttatc

SEQ ID NO: 5657917 - DNA, 15 bp, Homo sapiens
ttcttcgggaagaga

SEQ ID NO: 5657918 - DNA, 17 bp, Homo sapiens
ttcttcgggaagagagg

SEQ ID NO: 5657919 - DNA, 20 bp, Homo sapiens
ttcttcggggaactcctgga

SEQ ID NO: 5657920 - DNA, 19 bp, Homo sapiens
ttcttcgtccttttggttt

SEQ ID NO: 5657921 - DNA, 20 bp, Homo sapiens
ttcttctaaaactactgcct

SEQ ID NO: 5657922 - DNA, 16 bp, Homo sapiens
ttcttctaagaagaca

SEQ ID NO: 5657923 - DNA, 19 bp, Homo sapiens
ttcttctaagaagacattt

SEQ ID NO: 5657924 - DNA, 20 bp, Homo sapiens
ttcttctaagaagacatttt

SEQ ID NO: 5657925 - DNA, 17 bp, Homo sapiens
ttcttctacaaccagag

SEQ ID NO: 5657926 - DNA, 19 bp, Homo sapiens
ttcttctacaaccagagcc

SEQ ID NO: 5657927 - DNA, 22 bp, Homo sapiens
ttcttctacaactcatacactc

SEQ ID NO: 5657928 - DNA, 11 bp, Homo sapiens
ttcttctagag

SEQ ID NO: 5657929 - DNA, 20 bp, Homo sapiens
ttcttctaggggtagctggt

SEQ ID NO: 5657930 - DNA, 18 bp, Homo sapiens
ttcttctatatccaaaat

SEQ ID NO: 5657931 - DNA, 20 bp, Homo sapiens
ttcttctattaatcaagaga

SEQ ID NO: 5657932 - DNA, 18 bp, Homo sapiens
ttcttctattgcctctga

SEQ ID NO: 5657933 - DNA, 18 bp, Homo sapiens
ttcttctcaaggacacat

SEQ ID NO: 5657934 - DNA, 11 bp, Homo sapiens
ttcttctcatt

SEQ ID NO: 5657935 - DNA, 17 bp, Homo sapiens
ttcttctcccccatcct

SEQ ID NO: 5657936 - DNA, 11 bp, Homo sapiens
ttcttctccct

SEQ ID NO: 5657937 - DNA, 14 bp, Homo sapiens
ttcttctccctcag

SEQ ID NO: 5657938 - DNA, 22 bp, Homo sapiens
ttcttctcctgtgatgtcccag

SEQ ID NO: 5657939 - DNA, 15 bp, Homo sapiens
ttcttctctctgttc

SEQ ID NO: 5657940 - DNA, 20 bp, Homo sapiens
ttcttctctctgttcccttc

SEQ ID NO: 5657941 - DNA, 13 bp, Homo sapiens
ttcttctctgtga

SEQ ID NO: 5657942 - DNA, 16 bp, Homo sapiens
ttcttctcttatcctc

SEQ ID NO: 5657943 - DNA, 15 bp, Homo sapiens
ttcttctcttctctg

SEQ ID NO: 5657944 - DNA, 14 bp, Homo sapiens
ttcttctcttgtga

SEQ ID NO: 5657945 - DNA, 14 bp, Homo sapiens
ttcttctctttagt

SEQ ID NO: 5657946 - DNA, 20 bp, Homo sapiens
ttcttctgaactcaaactga

SEQ ID NO: 5657947 - DNA, 21 bp, Homo sapiens
ttcttctgaagtgctgctcca

SEQ ID NO: 5657948 - DNA, 21 bp, Homo sapiens
ttcttctgattctagtgtgtg

SEQ ID NO: 5657949 - DNA, 12 bp, Homo sapiens
ttcttctgcccc

SEQ ID NO: 5657950 - DNA, 11 bp, Homo sapiens
ttcttctgggc

SEQ ID NO: 5657951 - DNA, 13 bp, Homo sapiens
ttcttctgtaata

SEQ ID NO: 5657952 - DNA, 14 bp, Homo sapiens
ttcttctgtaatat

SEQ ID NO: 5657953 - DNA, 20 bp, Homo sapiens
ttcttctgtcctgagaagca

SEQ ID NO: 5657954 - DNA, 20 bp, Homo sapiens
ttcttctgtgtttataaaat

SEQ ID NO: 5657955 - DNA, 16 bp, Homo sapiens
ttcttctgttctgcag

SEQ ID NO: 5657956 - DNA, 19 bp, Homo sapiens
ttcttcttaaaagtttcta

SEQ ID NO: 5657957 - DNA, 13 bp, Homo sapiens
ttcttcttcagaa

SEQ ID NO: 5657958 - DNA, 13 bp, Homo sapiens
ttcttcttcctgg

SEQ ID NO: 5657959 - DNA, 16 bp, Homo sapiens
ttcttcttttacttga

SEQ ID NO: 5657960 - DNA, 14 bp, Homo sapiens
ttcttcttttcctt

SEQ ID NO: 5657961 - DNA, 21 bp, Homo sapiens
ttcttctttttgcttcaaaaa

SEQ ID NO: 5657962 - DNA, 14 bp, Homo sapiens
ttcttgaaaaagat

SEQ ID NO: 5657963 - DNA, 15 bp, Homo sapiens
ttcttgaaaagcctt

SEQ ID NO: 5657964 - DNA, 20 bp, Homo sapiens
ttcttgaaagccaagtgttt

SEQ ID NO: 5657965 - DNA, 13 bp, Homo sapiens
ttcttgaaagctg

SEQ ID NO: 5657966 - DNA, 14 bp, Homo sapiens
ttcttgaaattgaa

SEQ ID NO: 5657967 - DNA, 16 bp, Homo sapiens
ttcttgaacttgaaaa

SEQ ID NO: 5657968 - DNA, 22 bp, Homo sapiens
ttcttgaagctgggctgtctct

SEQ ID NO: 5657969 - DNA, 14 bp, Homo sapiens
ttcttgaagtgaaa

SEQ ID NO: 5657970 - DNA, 14 bp, Homo sapiens
ttcttgaataaaag

SEQ ID NO: 5657971 - DNA, 15 bp, Homo sapiens
ttcttgaatatctgc

SEQ ID NO: 5657972 - DNA, 12 bp, Homo sapiens
ttcttgaattgt

SEQ ID NO: 5657973 - DNA, 13 bp, Homo sapiens
ttcttgaattgtt

SEQ ID NO: 5657974 - DNA, 15 bp, Homo sapiens
ttcttgaattgttat

SEQ ID NO: 5657975 - DNA, 20 bp, Homo sapiens
ttcttgaatttttttctgca

SEQ ID NO: 5657976 - DNA, 23 bp, Homo sapiens
ttgaaagtggggtgttgaagacc

SEQ ID NO: 5657977 - DNA, 15 bp, Homo sapiens
ttgaaagttctggaa

SEQ ID NO: 5657978 - DNA, 18 bp, Homo sapiens
ttgaaagttgtacatgat

SEQ ID NO: 5657979 - DNA, 19 bp, Homo sapiens
ttgaaagttgtacatgata

SEQ ID NO: 5657980 - DNA, 23 bp, Homo sapiens
ttgaaagttttccagtattgaaa

SEQ ID NO: 5657981 - DNA, 22 bp, Homo sapiens
ttgaaataacagccttaaatcc

SEQ ID NO: 5657982 - DNA, 16 bp, Homo sapiens
ttgaaataactggaac

SEQ ID NO: 5657983 - DNA, 21 bp, Homo sapiens
ttgaaataactggaacaaatt

SEQ ID NO: 5657984 - DNA, 20 bp, Homo sapiens
ttgaaataaggagggacatg

SEQ ID NO: 5657985 - DNA, 14 bp, Homo sapiens
ttgaaatacctcat

SEQ ID NO: 5657986 - DNA, 12 bp, Homo sapiens
ttgaaatacctt

SEQ ID NO: 5657987 - DNA, 17 bp, Homo sapiens
ttgaaatactaaaagca

SEQ ID NO: 5657988 - DNA, 19 bp, Homo sapiens
ttgaaatactaaaagcaaa

SEQ ID NO: 5657989 - DNA, 23 bp, Homo sapiens
ttgaaatagctttactgtttctc

SEQ ID NO: 5657990 - DNA, 14 bp, Homo sapiens
ttgaaatagtgtct

SEQ ID NO: 5657991 - DNA, 17 bp, Homo sapiens
ttgaaatagtgtctgat

SEQ ID NO: 5657992 - DNA, 22 bp, Homo sapiens
ttgaaatagtttccaagaaatt

SEQ ID NO: 5657993 - DNA, 17 bp, Homo sapiens
ttgaaatatagttgaaa

SEQ ID NO: 5657994 - DNA, 23 bp, Homo sapiens
ttgaaatatagttgaaagtaaaa

SEQ ID NO: 5657995 - DNA, 23 bp, Homo sapiens
ttgaaatatatggtctaatgttt

SEQ ID NO: 5657996 - DNA, 14 bp, Homo sapiens
ttgaaatatgcata

SEQ ID NO: 5657997 - DNA, 21 bp, Homo sapiens
ttgaaatatgcatactaattt

SEQ ID NO: 5657998 - DNA, 16 bp, Homo sapiens
ttgaaatatgcatgta

SEQ ID NO: 5657999 - DNA, 15 bp, Homo sapiens
ttgaaatattaaaat

SEQ ID NO: 5658000 - DNA, 19 bp, Homo sapiens
ttgaaatattgacttttta

SEQ ID NO: 5658001 - DNA, 17 bp, Homo sapiens
ttgaaatcaccttttct

SEQ ID NO: 5658002 - DNA, 23 bp, Homo sapiens
ttgaaatcagtaaacactgtgta

SEQ ID NO: 5658003 - DNA, 15 bp, Homo sapiens
ttgaaatctgtatct

SEQ ID NO: 5658004 - DNA, 16 bp, Homo sapiens
ttgaaatgaaagggaa

SEQ ID NO: 5658005 - DNA, 13 bp, Homo sapiens
ttgaaatgaaatt

SEQ ID NO: 5658006 - DNA, 14 bp, Homo sapiens
ttgaaatgaacttt

SEQ ID NO: 5658007 - DNA, 18 bp, Homo sapiens
ttgaaatgaggtctgttt

SEQ ID NO: 5658008 - DNA, 13 bp, Homo sapiens
ttgaaatgagtaa

SEQ ID NO: 5658009 - DNA, 18 bp, Homo sapiens
ttgaaatgattcatcttt

SEQ ID NO: 5658010 - DNA, 22 bp, Homo sapiens
ttgaaatgattcatctttcaga

SEQ ID NO: 5658011 - DNA, 14 bp, Homo sapiens
ttgaaatgatttca

SEQ ID NO: 5658012 - DNA, 11 bp, Homo sapiens
ttgaaatgctg

SEQ ID NO: 5658013 - DNA, 23 bp, Homo sapiens
ttgaaatgctgtatttttacagc

SEQ ID NO: 5658014 - DNA, 21 bp, Homo sapiens
ttgaaatggaaagtcatgcaa

SEQ ID NO: 5658015 - DNA, 15 bp, Homo sapiens
ttgaaatggaaatta

SEQ ID NO: 5658016 - DNA, 15 bp, Homo sapiens
ttgaaatggcattta

SEQ ID NO: 5658017 - DNA, 17 bp, Homo sapiens
ttgaaatgggaacaata

SEQ ID NO: 5658018 - DNA, 16 bp, Homo sapiens
ttgaaatgggcattta

SEQ ID NO: 5658019 - DNA, 11 bp, Homo sapiens
ttgaaatgtaa

SEQ ID NO: 5658020 - DNA, 17 bp, Homo sapiens
ttgaaatgtaaggctgt

SEQ ID NO: 5658021 - DNA, 22 bp, Homo sapiens
ttgaaatgtgaacgtccttcct

SEQ ID NO: 5658022 - DNA, 18 bp, Homo sapiens
ttgaaattaacctctcac

SEQ ID NO: 5658023 - DNA, 13 bp, Homo sapiens
ttgaaattactgt

SEQ ID NO: 5658024 - DNA, 17 bp, Homo sapiens
ttgaaattactgtgtaa

SEQ ID NO: 5658025 - DNA, 14 bp, Homo sapiens
ttgaaattatatct

SEQ ID NO: 5658026 - DNA, 16 bp, Homo sapiens
ttgaaattatatctgt

SEQ ID NO: 5658027 - DNA, 21 bp, Homo sapiens
ttgaaattatgtatgtttaca

SEQ ID NO: 5658028 - DNA, 21 bp, Homo sapiens
ttgaaattctatttataatac

SEQ ID NO: 5658029 - DNA, 13 bp, Homo sapiens
ttgaaattctgaa

SEQ ID NO: 5658030 - DNA, 18 bp, Homo sapiens
ttgaaattgattaactta

SEQ ID NO: 5658031 - DNA, 15 bp, Homo sapiens
ttgaaattgtaatta

SEQ ID NO: 5658032 - DNA, 17 bp, Homo sapiens
ttgaaattgtaattata

SEQ ID NO: 5658033 - DNA, 15 bp, Homo sapiens
ttgaaattgtacata

SEQ ID NO: 5658034 - DNA, 16 bp, Homo sapiens
ttgaaattgtagtgca

SEQ ID NO: 5658035 - DNA, 19 bp, Homo sapiens
ttgaaattgtgaactcatt

SEQ ID NO: 5658036 - DNA, 19 bp, Homo sapiens
ttgaaattgtttaagtgtt

SEQ ID NO: 5658037 - DNA, 14 bp, Homo sapiens
ttgaaatttatgac

SEQ ID NO: 5658038 - DNA, 13 bp, Homo sapiens
ttgaaatttccta

SEQ ID NO: 5658039 - DNA, 20 bp, Homo sapiens
ttgaaattttccattacatg

SEQ ID NO: 5658040 - DNA, 21 bp, Homo sapiens
ttgaaattttccattacatga

SEQ ID NO: 5658041 - DNA, 20 bp, Homo sapiens
ttgaaattttgcaaatataa

SEQ ID NO: 5658042 - DNA, 15 bp, Homo sapiens
ttgaaatttttaaat

SEQ ID NO: 5658043 - DNA, 20 bp, Homo sapiens
ttgaaatttttaaatcattt

SEQ ID NO: 5658044 - DNA, 12 bp, Homo sapiens
ttgaacaaaata

SEQ ID NO: 5658045 - DNA, 14 bp, Homo sapiens
ttgaacaaaataaa

SEQ ID NO: 5658046 - DNA, 16 bp, Homo sapiens
ttgaacaaattttctg

SEQ ID NO: 5658047 - DNA, 15 bp, Homo sapiens
ttgaacacaaactgt

SEQ ID NO: 5658048 - DNA, 22 bp, Homo sapiens
ttgaacacaattgatacttcag

SEQ ID NO: 5658049 - DNA, 13 bp, Homo sapiens
ttgaacacaggca

SEQ ID NO: 5658050 - DNA, 14 bp, Homo sapiens
ttgaacacaggcaa

SEQ ID NO: 5658051 - DNA, 18 bp, Homo sapiens
ttgaacactcatgctgaa

SEQ ID NO: 5658052 - DNA, 20 bp, Homo sapiens
ttgaacactcatgctgaaag

SEQ ID NO: 5658053 - DNA, 20 bp, Homo sapiens
ttgaacactggctaaagata

SEQ ID NO: 5658054 - DNA, 13 bp, Homo sapiens
ttgaacactgggg

SEQ ID NO: 5658055 - DNA, 21 bp, Homo sapiens
ttgaacagagctagaggccat

SEQ ID NO: 5658056 - DNA, 19 bp, Homo sapiens
ttgaacatgtgccttttct

SEQ ID NO: 5658057 - DNA, 22 bp, Homo sapiens
ttgaacattaatccacatgttt

SEQ ID NO: 5658058 - DNA, 15 bp, Homo sapiens
ttgaaccaacatctt

SEQ ID NO: 5658059 - DNA, 12 bp, Homo sapiens
ttgaaccaataa

SEQ ID NO: 5658060 - DNA, 19 bp, Homo sapiens
ttgaaccattatactttat

SEQ ID NO: 5658061 - DNA, 14 bp, Homo sapiens
ttgaaccccctccc

SEQ ID NO: 5658062 - DNA, 15 bp, Homo sapiens
ttgaacccctgtgtc

SEQ ID NO: 5658063 - DNA, 19 bp, Homo sapiens
ttgaacctatttctctttc

SEQ ID NO: 5658064 - DNA, 16 bp, Homo sapiens
ttgaacctccaaatgg

SEQ ID NO: 5658065 - DNA, 17 bp, Homo sapiens
ttgaacctccaaatgga

SEQ ID NO: 5658066 - DNA, 18 bp, Homo sapiens
ttgaacctgatgaaaata

SEQ ID NO: 5658067 - DNA, 20 bp, Homo sapiens
ttgaacctggatccagcact

SEQ ID NO: 5658068 - DNA, 17 bp, Homo sapiens
ttgaacctgtgaggaag

SEQ ID NO: 5658069 - DNA, 18 bp, Homo sapiens
ttgaacctgtgaggaaga

SEQ ID NO: 5658070 - DNA, 21 bp, Homo sapiens
ttgaacctgtgagtaaatatt

SEQ ID NO: 5658071 - DNA, 20 bp, Homo sapiens
ttgaaccttaaaaggtactg

SEQ ID NO: 5658072 - DNA, 19 bp, Homo sapiens
ttgaacctttgtgccctat

SEQ ID NO: 5658073 - DNA, 18 bp, Homo sapiens
ttgaacctttttttttga

SEQ ID NO: 5658074 - DNA, 23 bp, Homo sapiens
ttgaacctttttttttgaaacag

SEQ ID NO: 5658075 - DNA, 19 bp, Homo sapiens
ttgaacgagcagcccaggg

SEQ ID NO: 5658076 - DNA, 22 bp, Homo sapiens
ttgaacgcccccccccacccct

SEQ ID NO: 5658077 - DNA, 22 bp, Homo sapiens
ttgaacgcttaagtcatcatta

SEQ ID NO: 5658078 - DNA, 17 bp, Homo sapiens
ttgaacgtgccagcagc

SEQ ID NO: 5658079 - DNA, 20 bp, Homo sapiens
ttgaacgtgcttctttgtaa

SEQ ID NO: 5658080 - DNA, 17 bp, Homo sapiens
ttgaacgttatgttcag

SEQ ID NO: 5658081 - DNA, 16 bp, Homo sapiens
ttgaacgttttctaat

SEQ ID NO: 5658082 - DNA, 18 bp, Homo sapiens
ttgaactaatatatgaaa

SEQ ID NO: 5658083 - DNA, 13 bp, Homo sapiens
ttgaactatattt

SEQ ID NO: 5658084 - DNA, 18 bp, Homo sapiens
ttgaactcacgagccttg

SEQ ID NO: 5658085 - DNA, 14 bp, Homo sapiens
ttgaactcctgacc

SEQ ID NO: 5658086 - DNA, 15 bp, Homo sapiens
ttgaactcctggcct

SEQ ID NO: 5658087 - DNA, 15 bp, Homo sapiens
ttgaactctgagaga

SEQ ID NO: 5658088 - DNA, 20 bp, Homo sapiens
ttgaactcttctcattactt

SEQ ID NO: 5658089 - DNA, 16 bp, Homo sapiens
ttgaactcttggcctc

SEQ ID NO: 5658090 - DNA, 15 bp, Homo sapiens
ttgaactgagcttgg

SEQ ID NO: 5658091 - DNA, 16 bp, Homo sapiens
ttgaactgagcttgga

SEQ ID NO: 5658092 - DNA, 14 bp, Homo sapiens
ttgaactgaggccc

SEQ ID NO: 5658093 - DNA, 20 bp, Homo sapiens
ttgaactgatagttactgtt

SEQ ID NO: 5658094 - DNA, 19 bp, Homo sapiens
ttgaactgtttaacacttt

SEQ ID NO: 5658095 - DNA, 18 bp, Homo sapiens
ttgaacttaaataaatgt

SEQ ID NO: 5658096 - DNA, 16 bp, Homo sapiens
ttgaacttgctctttt

SEQ ID NO: 5658097 - DNA, 13 bp, Homo sapiens
ttgaactttgacc

SEQ ID NO: 5658098 - DNA, 17 bp, Homo sapiens
ttgaactttgacctctg

SEQ ID NO: 5658099 - DNA, 16 bp, Homo sapiens
ttgaactttgccaaaa

SEQ ID NO: 5658100 - DNA, 14 bp, Homo sapiens
ttgaacttttgtac

SEQ ID NO: 5658101 - DNA, 19 bp, Homo sapiens
ttgaacttttgtactgaat

SEQ ID NO: 5658102 - DNA, 23 bp, Homo sapiens
ttgaacttttgtactgaattttt

SEQ ID NO: 5658103 - DNA, 20 bp, Homo sapiens
ttgaagaaaggaacctggga

SEQ ID NO: 5658104 - DNA, 22 bp, Homo sapiens
ttgaagaaattataaagataaa

SEQ ID NO: 5658105 - DNA, 18 bp, Homo sapiens
ttgaagaacaaaaggctt

SEQ ID NO: 5658106 - DNA, 17 bp, Homo sapiens
ttgaagaactgcacttt

SEQ ID NO: 5658107 - DNA, 20 bp, Homo sapiens
ttgaagaactgcaggccctg

SEQ ID NO: 5658108 - DNA, 19 bp, Homo sapiens
ttgaagaagaaccagccca

SEQ ID NO: 5658109 - DNA, 22 bp, Homo sapiens
ttgaagaagagaaaatttgaaa

SEQ ID NO: 5658110 - DNA, 20 bp, Homo sapiens
ttgaagaagagtttgcaaat

SEQ ID NO: 5658111 - DNA, 18 bp, Homo sapiens
ttgaagaaggaaagaacc

SEQ ID NO: 5658112 - DNA, 17 bp, Homo sapiens
ttgaagaaggaatcttt

SEQ ID NO: 5658113 - DNA, 17 bp, Homo sapiens
ttgaagaataaattcta

SEQ ID NO: 5658114 - DNA, 18 bp, Homo sapiens
ttgaagaatattgttaaa

SEQ ID NO: 5658115 - DNA, 17 bp, Homo sapiens
ttgaagaatatttaaga

SEQ ID NO: 5658116 - DNA, 21 bp, Homo sapiens
ttgaagaatgttaagacttga

SEQ ID NO: 5658117 - DNA, 23 bp, Homo sapiens
ttgaagaattgtagttcttagtc

SEQ ID NO: 5658118 - DNA, 12 bp, Homo sapiens
ttgaagacaatt

SEQ ID NO: 5658119 - DNA, 22 bp, Homo sapiens
ttgaagacaatttgatacataa

SEQ ID NO: 5658120 - DNA, 23 bp, Homo sapiens
ttgaagacaatttgatacataat

SEQ ID NO: 5658121 - DNA, 20 bp, Homo sapiens
ttgaagacacagcctccccc

SEQ ID NO: 5658122 - DNA, 13 bp, Homo sapiens
ttgaagacactga

SEQ ID NO: 5658123 - DNA, 20 bp, Homo sapiens
ttgaagacccgctacaaaac

SEQ ID NO: 5658124 - DNA, 22 bp, Homo sapiens
ttgaagacttcctctctacccc

SEQ ID NO: 5658125 - DNA, 22 bp, Homo sapiens
ttgaagagaaaaaagtcaccat

SEQ ID NO: 5658126 - DNA, 14 bp, Homo sapiens
ttgaagagacagag

SEQ ID NO: 5658127 - DNA, 20 bp, Homo sapiens
ttgaagagatttcaacatat

SEQ ID NO: 5658128 - DNA, 22 bp, Homo sapiens
ttgaagaggaaaatgaataata

SEQ ID NO: 5658129 - DNA, 21 bp, Homo sapiens
ttgaagaggttttaaagcttc

SEQ ID NO: 5658130 - DNA, 13 bp, Homo sapiens
ttgaagatacaca

SEQ ID NO: 5658131 - DNA, 19 bp, Homo sapiens
ttgaagatacacaagaggg

SEQ ID NO: 5658132 - DNA, 18 bp, Homo sapiens
ttgaagatagtaactgta

SEQ ID NO: 5658133 - DNA, 22 bp, Homo sapiens
ttgaagatatcttgaaatgaaa

SEQ ID NO: 5658134 - DNA, 21 bp, Homo sapiens
ttgaagatgtagcttccaaat

SEQ ID NO: 5658135 - DNA, 22 bp, Homo sapiens
ttgaagattaggagaaacacat

SEQ ID NO: 5658136 - DNA, 23 bp, Homo sapiens
ttgaagattctatgttaatattt

SEQ ID NO: 5658137 - DNA, 14 bp, Homo sapiens
ttgaagcaaatgtg

SEQ ID NO: 5658138 - DNA, 17 bp, Homo sapiens
ttgaagcaactacaact

SEQ ID NO: 5658139 - DNA, 13 bp, Homo sapiens
ttgaagcacaagt

SEQ ID NO: 5658140 - DNA, 14 bp, Homo sapiens
ttgaagcacgtaca

SEQ ID NO: 5658141 - DNA, 18 bp, Homo sapiens
ttgaagcacgtacatttt

SEQ ID NO: 5658142 - DNA, 23 bp, Homo sapiens
ttgaagcacttaagtcttcctta

SEQ ID NO: 5658143 - DNA, 18 bp, Homo sapiens
ttgaagcagtcttgctct

SEQ ID NO: 5658144 - DNA, 11 bp, Homo sapiens
ttgaagcatag

SEQ ID NO: 5658145 - DNA, 19 bp, Homo sapiens
ttgaagcatagctacaatt

SEQ ID NO: 5658146 - DNA, 12 bp, Homo sapiens
ttgaagcatgaa

SEQ ID NO: 5658147 - DNA, 23 bp, Homo sapiens
ttgaagcatttcaaagccctgcc

SEQ ID NO: 5658148 - DNA, 13 bp, Homo sapiens
ttgaagcatttta

SEQ ID NO: 5658149 - DNA, 14 bp, Homo sapiens
ttgaagcattttat

SEQ ID NO: 5658150 - DNA, 15 bp, Homo sapiens
ttgaagcattttata

SEQ ID NO: 5658151 - DNA, 22 bp, Homo sapiens
ttgaagcattttataaatcgct

SEQ ID NO: 5658152 - DNA, 23 bp, Homo sapiens
ttgaagccaagtcagctttgcct

SEQ ID NO: 5658153 - DNA, 16 bp, Homo sapiens
ttgaggttctcttttg

SEQ ID NO: 5658154 - DNA, 18 bp, Homo sapiens
ttgaggttgttcaaagtt

SEQ ID NO: 5658155 - DNA, 15 bp, Homo sapiens
ttgaggttttggtaa

SEQ ID NO: 5658156 - DNA, 17 bp, Homo sapiens
ttgaggttttggtaatt

SEQ ID NO: 5658157 - DNA, 18 bp, Homo sapiens
ttgaggttttgtaaaact

SEQ ID NO: 5658158 - DNA, 20 bp, Homo sapiens
ttgaggttttgtaaaactgt

SEQ ID NO: 5658159 - DNA, 16 bp, Homo sapiens
ttgagtaaaaagacat

SEQ ID NO: 5658160 - DNA, 13 bp, Homo sapiens
ttgagtaaaaagg

SEQ ID NO: 5658161 - DNA, 21 bp, Homo sapiens
ttgagtaatattacatttcat

SEQ ID NO: 5658162 - DNA, 21 bp, Homo sapiens
ttgagtaatggtgtagaacac

SEQ ID NO: 5658163 - DNA, 19 bp, Homo sapiens
ttgagtacagtgaggaggg

SEQ ID NO: 5658164 - DNA, 19 bp, Homo sapiens
ttgagtacctactgtgtgc

SEQ ID NO: 5658165 - DNA, 21 bp, Homo sapiens
ttgagtagatattactttatc

SEQ ID NO: 5658166 - DNA, 18 bp, Homo sapiens
ttgagtagatctgcttct

SEQ ID NO: 5658167 - DNA, 14 bp, Homo sapiens
ttgagtaggccctg

SEQ ID NO: 5658168 - DNA, 23 bp, Homo sapiens
ttgagtaggtaccttgtagcagt

SEQ ID NO: 5658169 - DNA, 19 bp, Homo sapiens
ttgagtataagaaatgcat

SEQ ID NO: 5658170 - DNA, 14 bp, Homo sapiens
ttgagtatcacttt

SEQ ID NO: 5658171 - DNA, 13 bp, Homo sapiens
ttgagtatttgct

SEQ ID NO: 5658172 - DNA, 14 bp, Homo sapiens
ttgagtatttgctg

SEQ ID NO: 5658173 - DNA, 15 bp, Homo sapiens
ttgagtatttgctgt

SEQ ID NO: 5658174 - DNA, 19 bp, Homo sapiens
ttgagtatttgctgtttgt

SEQ ID NO: 5658175 - DNA, 17 bp, Homo sapiens
ttgagtcaaaagcctgg

SEQ ID NO: 5658176 - DNA, 22 bp, Homo sapiens
ttgagtcattatccttgctatg

SEQ ID NO: 5658177 - DNA, 13 bp, Homo sapiens
ttgagtcattgac

SEQ ID NO: 5658178 - DNA, 13 bp, Homo sapiens
ttgagtcatttta

SEQ ID NO: 5658179 - DNA, 16 bp, Homo sapiens
ttgagtccacgcccac

SEQ ID NO: 5658180 - DNA, 18 bp, Homo sapiens
ttgagtccagctttcctt

SEQ ID NO: 5658181 - DNA, 20 bp, Homo sapiens
ttgagtccagctttccttct

SEQ ID NO: 5658182 - DNA, 17 bp, Homo sapiens
ttgagtccattgcaaaa

SEQ ID NO: 5658183 - DNA, 18 bp, Homo sapiens
ttgagtccattgcaaaag

SEQ ID NO: 5658184 - DNA, 19 bp, Homo sapiens
ttgagtcctaggacttaaa

SEQ ID NO: 5658185 - DNA, 13 bp, Homo sapiens
ttgagtctcaagg

SEQ ID NO: 5658186 - DNA, 16 bp, Homo sapiens
ttgagtctctgaattt

SEQ ID NO: 5658187 - DNA, 21 bp, Homo sapiens
ttgagtctgtccagataagtt

SEQ ID NO: 5658188 - DNA, 13 bp, Homo sapiens
ttgagtcttggtt

SEQ ID NO: 5658189 - DNA, 14 bp, Homo sapiens
ttgagtgacagctt

SEQ ID NO: 5658190 - DNA, 12 bp, Homo sapiens
ttgagtgagaag

SEQ ID NO: 5658191 - DNA, 14 bp, Homo sapiens
ttgagtgagaagag

SEQ ID NO: 5658192 - DNA, 11 bp, Homo sapiens
ttgagtgcctt

SEQ ID NO: 5658193 - DNA, 13 bp, Homo sapiens
ttgagtggacagc

SEQ ID NO: 5658194 - DNA, 19 bp, Homo sapiens
ttgagtggatgatgtttcg

SEQ ID NO: 5658195 - DNA, 15 bp, Homo sapiens
ttgagtgggccccct

SEQ ID NO: 5658196 - DNA, 15 bp, Homo sapiens
ttgagtgggccctgc

SEQ ID NO: 5658197 - DNA, 23 bp, Homo sapiens
ttgagtgggccctgcccggggag

SEQ ID NO: 5658198 - DNA, 23 bp, Homo sapiens
ttgagtggggttatctctgtgtt

SEQ ID NO: 5658199 - DNA, 17 bp, Homo sapiens
ttgagtgtacagatttt

SEQ ID NO: 5658200 - DNA, 16 bp, Homo sapiens
ttgagtgtatatatat

SEQ ID NO: 5658201 - DNA, 14 bp, Homo sapiens
ttgagtgtcaagct

SEQ ID NO: 5658202 - DNA, 16 bp, Homo sapiens
ttgagtgtcaggctct

SEQ ID NO: 5658203 - DNA, 15 bp, Homo sapiens
ttgagtgtcttctaa

SEQ ID NO: 5658204 - DNA, 21 bp, Homo sapiens
ttgagtgtgcaagcaaagaac

SEQ ID NO: 5658205 - DNA, 14 bp, Homo sapiens
ttgagtgtgtggtc

SEQ ID NO: 5658206 - DNA, 21 bp, Homo sapiens
ttgagtgttcctttttaaatg

SEQ ID NO: 5658207 - DNA, 23 bp, Homo sapiens
ttgagtgttcctttttaaatgtg

SEQ ID NO: 5658208 - DNA, 11 bp, Homo sapiens
ttgagtgttct

SEQ ID NO: 5658209 - DNA, 17 bp, Homo sapiens
ttgagtgttttaagata

SEQ ID NO: 5658210 - DNA, 18 bp, Homo sapiens
ttgagttaacaggacagt

SEQ ID NO: 5658211 - DNA, 19 bp, Homo sapiens
ttgagttaactttttgtag

SEQ ID NO: 5658212 - DNA, 20 bp, Homo sapiens
ttgagttaagtctatctggt

SEQ ID NO: 5658213 - DNA, 16 bp, Homo sapiens
ttgagttacaatttgg

SEQ ID NO: 5658214 - DNA, 15 bp, Homo sapiens
ttgagttatcaggga

SEQ ID NO: 5658215 - DNA, 17 bp, Homo sapiens
ttgagttatcagggaac

SEQ ID NO: 5658216 - DNA, 14 bp, Homo sapiens
ttgagttcctctgc

SEQ ID NO: 5658217 - DNA, 18 bp, Homo sapiens
ttgagttctgtagagcct

SEQ ID NO: 5658218 - DNA, 20 bp, Homo sapiens
ttgagttgattcagctctgc

SEQ ID NO: 5658219 - DNA, 20 bp, Homo sapiens
ttgagttggttacttcatat

SEQ ID NO: 5658220 - DNA, 16 bp, Homo sapiens
ttgagtttattctgat

SEQ ID NO: 5658221 - DNA, 17 bp, Homo sapiens
ttgagtttattctgatt

SEQ ID NO: 5658222 - DNA, 15 bp, Homo sapiens
ttgagtttcagaata

SEQ ID NO: 5658223 - DNA, 14 bp, Homo sapiens
ttgagtttcttcta

SEQ ID NO: 5658224 - DNA, 23 bp, Homo sapiens
ttgagtttgctgtatacaaacag

SEQ ID NO: 5658225 - DNA, 20 bp, Homo sapiens
ttgagtttgtaggtaaaatg

SEQ ID NO: 5658226 - DNA, 12 bp, Homo sapiens
ttgagttttcat

SEQ ID NO: 5658227 - DNA, 18 bp, Homo sapiens
ttgagttttgactgcttg

SEQ ID NO: 5658228 - DNA, 12 bp, Homo sapiens
ttgagttttgtt

SEQ ID NO: 5658229 - DNA, 14 bp, Homo sapiens
ttgagtttttcctc

SEQ ID NO: 5658230 - DNA, 14 bp, Homo sapiens
ttgataaaagagtt

SEQ ID NO: 5658231 - DNA, 14 bp, Homo sapiens
ttgataaaatgtaa

SEQ ID NO: 5658232 - DNA, 13 bp, Homo sapiens
ttgataaaatgtt

SEQ ID NO: 5658233 - DNA, 22 bp, Homo sapiens
ttgataaacataattatttcta

SEQ ID NO: 5658234 - DNA, 18 bp, Homo sapiens
ttgataaaccaaaaacat

SEQ ID NO: 5658235 - DNA, 19 bp, Homo sapiens
ttgataaaccaaaaacatt

SEQ ID NO: 5658236 - DNA, 20 bp, Homo sapiens
ttgataaaccaaaaacattt

SEQ ID NO: 5658237 - DNA, 14 bp, Homo sapiens
ttgataaagatttt

SEQ ID NO: 5658238 - DNA, 17 bp, Homo sapiens
ttgataaagatttttta

SEQ ID NO: 5658239 - DNA, 12 bp, Homo sapiens
ttgataaagtaa

SEQ ID NO: 5658240 - DNA, 12 bp, Homo sapiens
ttgataaagttt

SEQ ID NO: 5658241 - DNA, 12 bp, Homo sapiens
ttgataaatgga

SEQ ID NO: 5658242 - DNA, 18 bp, Homo sapiens
ttgataaattccactgga

SEQ ID NO: 5658243 - DNA, 14 bp, Homo sapiens
ttgataaattttaa

SEQ ID NO: 5658244 - DNA, 18 bp, Homo sapiens
ttgataacaaaaaataaa

SEQ ID NO: 5658245 - DNA, 18 bp, Homo sapiens
ttgataacaatgttttaa

SEQ ID NO: 5658246 - DNA, 21 bp, Homo sapiens
ttgataacaccaagagtagca

SEQ ID NO: 5658247 - DNA, 15 bp, Homo sapiens
ttgataacagcactg

SEQ ID NO: 5658248 - DNA, 14 bp, Homo sapiens
ttgataactttgct

SEQ ID NO: 5658249 - DNA, 13 bp, Homo sapiens
ttgataagaggaa

SEQ ID NO: 5658250 - DNA, 22 bp, Homo sapiens
ttgataagctattgtctgtaat

SEQ ID NO: 5658251 - DNA, 22 bp, Homo sapiens
ttgataaggaacatttatccag

SEQ ID NO: 5658252 - DNA, 17 bp, Homo sapiens
ttgataagtaatgaaag

SEQ ID NO: 5658253 - DNA, 18 bp, Homo sapiens
ttgataagtaatgaaagt

SEQ ID NO: 5658254 - DNA, 17 bp, Homo sapiens
ttgataagttcatacat

SEQ ID NO: 5658255 - DNA, 19 bp, Homo sapiens
ttgataataaattgaaatt

SEQ ID NO: 5658256 - DNA, 16 bp, Homo sapiens
ttgataatacttgacc

SEQ ID NO: 5658257 - DNA, 21 bp, Homo sapiens
ttgataatagtaatggttcta

SEQ ID NO: 5658258 - DNA, 17 bp, Homo sapiens
ttgataatatatattaa

SEQ ID NO: 5658259 - DNA, 16 bp, Homo sapiens
ttgataatattagtga

SEQ ID NO: 5658260 - DNA, 22 bp, Homo sapiens
ttgataatattagtgattctga

SEQ ID NO: 5658261 - DNA, 13 bp, Homo sapiens
ttgataatcttca

SEQ ID NO: 5658262 - DNA, 14 bp, Homo sapiens
ttgataatgttaaa

SEQ ID NO: 5658263 - DNA, 19 bp, Homo sapiens
ttgataatgttaaatttgt

SEQ ID NO: 5658264 - DNA, 20 bp, Homo sapiens
ttgataatgttaaatttgta

SEQ ID NO: 5658265 - DNA, 21 bp, Homo sapiens
ttgataatgttaaatttgtaa

SEQ ID NO: 5658266 - DNA, 19 bp, Homo sapiens
ttgataattcgagcaaaca

SEQ ID NO: 5658267 - DNA, 14 bp, Homo sapiens
ttgataatttcagg

SEQ ID NO: 5658268 - DNA, 23 bp, Homo sapiens
ttgataatttcagggaaattaat

SEQ ID NO: 5658269 - DNA, 11 bp, Homo sapiens
ttgataatttt

SEQ ID NO: 5658270 - DNA, 22 bp, Homo sapiens
ttgataattttttaattattta

SEQ ID NO: 5658271 - DNA, 22 bp, Homo sapiens
ttgatacaaaccactgtgaaca

SEQ ID NO: 5658272 - DNA, 17 bp, Homo sapiens
ttgatacaacaggattt

SEQ ID NO: 5658273 - DNA, 20 bp, Homo sapiens
ttgatacacaggtgagaaag

SEQ ID NO: 5658274 - DNA, 15 bp, Homo sapiens
ttgatacattcaaat

SEQ ID NO: 5658275 - DNA, 21 bp, Homo sapiens
ttgatacattcaaatttgtct

SEQ ID NO: 5658276 - DNA, 22 bp, Homo sapiens
ttgatacatttatcttctgttt

SEQ ID NO: 5658277 - DNA, 23 bp, Homo sapiens
ttgatacatttatcttctgtttt

SEQ ID NO: 5658278 - DNA, 15 bp, Homo sapiens
ttgatacccccctct

SEQ ID NO: 5658279 - DNA, 23 bp, Homo sapiens
ttgatacccctggggaacatttc

SEQ ID NO: 5658280 - DNA, 16 bp, Homo sapiens
ttgatacgtttattag

SEQ ID NO: 5658281 - DNA, 15 bp, Homo sapiens
ttgatactaagcatt

SEQ ID NO: 5658282 - DNA, 15 bp, Homo sapiens
ttgatactaccaggg

SEQ ID NO: 5658283 - DNA, 15 bp, Homo sapiens
ttgatactcgttatt

SEQ ID NO: 5658284 - DNA, 15 bp, Homo sapiens
ttgatactctttcta

SEQ ID NO: 5658285 - DNA, 20 bp, Homo sapiens
ttgatactctttctaatgct

SEQ ID NO: 5658286 - DNA, 15 bp, Homo sapiens
ttgatactgaatgca

SEQ ID NO: 5658287 - DNA, 16 bp, Homo sapiens
ttgatactgcaataaa

SEQ ID NO: 5658288 - DNA, 21 bp, Homo sapiens
ttgatactggtcccacttcac

SEQ ID NO: 5658289 - DNA, 14 bp, Homo sapiens
ttgatactgttgca

SEQ ID NO: 5658290 - DNA, 20 bp, Homo sapiens
ttgatacttatattttcgta

SEQ ID NO: 5658291 - DNA, 15 bp, Homo sapiens
ttgatacttgtaact

SEQ ID NO: 5658292 - DNA, 12 bp, Homo sapiens
ttgatagaacta

SEQ ID NO: 5658293 - DNA, 15 bp, Homo sapiens
ttgatagaagaatat

SEQ ID NO: 5658294 - DNA, 14 bp, Homo sapiens
ttgatagaagataa

SEQ ID NO: 5658295 - DNA, 18 bp, Homo sapiens
ttgatagcacagaccctg

SEQ ID NO: 5658296 - DNA, 19 bp, Homo sapiens
ttgatagcacagaccctgc

SEQ ID NO: 5658297 - DNA, 21 bp, Homo sapiens
ttgatagcacagaccctgccc

SEQ ID NO: 5658298 - DNA, 22 bp, Homo sapiens
ttgatagcaggtgtaataagac

SEQ ID NO: 5658299 - DNA, 20 bp, Homo sapiens
ttgatagcatggggcccctg

SEQ ID NO: 5658300 - DNA, 18 bp, Homo sapiens
ttgatagctgtcccatct

SEQ ID NO: 5658301 - DNA, 16 bp, Homo sapiens
ttgatagggaactggg

SEQ ID NO: 5658302 - DNA, 19 bp, Homo sapiens
ttgatagggaactggggaa

SEQ ID NO: 5658303 - DNA, 23 bp, Homo sapiens
ttgatagggtctaccaatacaaa

SEQ ID NO: 5658304 - DNA, 19 bp, Homo sapiens
ttgatagtcctgacctcat

SEQ ID NO: 5658305 - DNA, 16 bp, Homo sapiens
ttgatagtttcattta

SEQ ID NO: 5658306 - DNA, 17 bp, Homo sapiens
ttgatataataattact

SEQ ID NO: 5658307 - DNA, 23 bp, Homo sapiens
ttgatataataattacttaatgt

SEQ ID NO: 5658308 - DNA, 21 bp, Homo sapiens
ttgatataattacttaatgtg

SEQ ID NO: 5658309 - DNA, 21 bp, Homo sapiens
ttgatataatttccatagtgt

SEQ ID NO: 5658310 - DNA, 15 bp, Homo sapiens
ttgatatacagacct

SEQ ID NO: 5658311 - DNA, 15 bp, Homo sapiens
ttgatatacattgtg

SEQ ID NO: 5658312 - DNA, 13 bp, Homo sapiens
ttgatataccaaa

SEQ ID NO: 5658313 - DNA, 20 bp, Homo sapiens
ttgatatacttttttcttat

SEQ ID NO: 5658314 - DNA, 15 bp, Homo sapiens
ttgatatagaaagct

SEQ ID NO: 5658315 - DNA, 17 bp, Homo sapiens
ttgatatagaacagtgc

SEQ ID NO: 5658316 - DNA, 22 bp, Homo sapiens
ttgatatagaagtataaagaat

SEQ ID NO: 5658317 - DNA, 23 bp, Homo sapiens
ttgatatatattataaatatata

SEQ ID NO: 5658318 - DNA, 13 bp, Homo sapiens
ttgatatatgtat

SEQ ID NO: 5658319 - DNA, 21 bp, Homo sapiens
ttgatatattctttccatgca

SEQ ID NO: 5658320 - DNA, 19 bp, Homo sapiens
ttgatatcacagtctaatt

SEQ ID NO: 5658321 - DNA, 16 bp, Homo sapiens
ttgatatcgtgaaatc

SEQ ID NO: 5658322 - DNA, 16 bp, Homo sapiens
ttgatatctataaaat

SEQ ID NO: 5658323 - DNA, 13 bp, Homo sapiens
ttgatatgaaaaa

SEQ ID NO: 5658324 - DNA, 21 bp, Homo sapiens
ttgatatgaaaaatatgatat

SEQ ID NO: 5658325 - DNA, 13 bp, Homo sapiens
ttgatatgagtat

SEQ ID NO: 5658326 - DNA, 16 bp, Homo sapiens
ttgatatgagtataca

SEQ ID NO: 5658327 - DNA, 18 bp, Homo sapiens
ttgatatgagtatacaat

SEQ ID NO: 5658328 - DNA, 11 bp, Homo sapiens
ttgatattaaa

SEQ ID NO: 5658329 - DNA, 14 bp, Homo sapiens
ttgatattatgtgg

SEQ ID NO: 5658330 - DNA, 18 bp, Homo sapiens
ttgatattcctacaaaga

SEQ ID NO: 5658331 - DNA, 22 bp, Homo sapiens
ttgatattcctacaaagaaaaa

SEQ ID NO: 5658332 - DNA, 20 bp, Homo sapiens
ttgcagctgttttgttgaca

SEQ ID NO: 5658333 - DNA, 14 bp, Homo sapiens
ttgcagcttcaact

SEQ ID NO: 5658334 - DNA, 12 bp, Homo sapiens
ttgcagcttcct

SEQ ID NO: 5658335 - DNA, 22 bp, Homo sapiens
ttgcagcttgtgctgagcctgc

SEQ ID NO: 5658336 - DNA, 18 bp, Homo sapiens
ttgcagctttatgttcat

SEQ ID NO: 5658337 - DNA, 21 bp, Homo sapiens
ttgcagctttatgttcatttg

SEQ ID NO: 5658338 - DNA, 22 bp, Homo sapiens
ttgcagcttttggttaatatgt

SEQ ID NO: 5658339 - DNA, 20 bp, Homo sapiens
ttgcaggaagagatgctcta

SEQ ID NO: 5658340 - DNA, 11 bp, Homo sapiens
ttgcaggaagg

SEQ ID NO: 5658341 - DNA, 21 bp, Homo sapiens
ttgcaggaaggagccagactt

SEQ ID NO: 5658342 - DNA, 18 bp, Homo sapiens
ttgcaggagacattttca

SEQ ID NO: 5658343 - DNA, 19 bp, Homo sapiens
ttgcaggagacattttcat

SEQ ID NO: 5658344 - DNA, 20 bp, Homo sapiens
ttgcaggagacattttcata

SEQ ID NO: 5658345 - DNA, 20 bp, Homo sapiens
ttgcaggagcgtgaaggact

SEQ ID NO: 5658346 - DNA, 18 bp, Homo sapiens
ttgcaggaggccaaactg

SEQ ID NO: 5658347 - DNA, 20 bp, Homo sapiens
ttgcaggagttcctttccct

SEQ ID NO: 5658348 - DNA, 15 bp, Homo sapiens
ttgcaggagtttgtg

SEQ ID NO: 5658349 - DNA, 14 bp, Homo sapiens
ttgcaggattccct

SEQ ID NO: 5658350 - DNA, 16 bp, Homo sapiens
ttgcaggattcccttc

SEQ ID NO: 5658351 - DNA, 22 bp, Homo sapiens
ttgcaggattcccttctgggct

SEQ ID NO: 5658352 - DNA, 22 bp, Homo sapiens
ttgcaggccaggttatgcctca

SEQ ID NO: 5658353 - DNA, 17 bp, Homo sapiens
ttgcaggcccagcagac

SEQ ID NO: 5658354 - DNA, 13 bp, Homo sapiens
ttgcaggctctgg

SEQ ID NO: 5658355 - DNA, 16 bp, Homo sapiens
ttgcagggcacagatg

SEQ ID NO: 5658356 - DNA, 12 bp, Homo sapiens
ttgcagggcagc

SEQ ID NO: 5658357 - DNA, 13 bp, Homo sapiens
ttgcagggcagcc

SEQ ID NO: 5658358 - DNA, 14 bp, Homo sapiens
ttgcagggcagccc

SEQ ID NO: 5658359 - DNA, 19 bp, Homo sapiens
ttgcaggggatactgaaaa

SEQ ID NO: 5658360 - DNA, 18 bp, Homo sapiens
ttgcaggggtccctgcta

SEQ ID NO: 5658361 - DNA, 12 bp, Homo sapiens
ttgcagggtact

SEQ ID NO: 5658362 - DNA, 17 bp, Homo sapiens
ttgcagggtcctcttct

SEQ ID NO: 5658363 - DNA, 21 bp, Homo sapiens
ttgcagggtgggtgagctctc

SEQ ID NO: 5658364 - DNA, 23 bp, Homo sapiens
ttgcaggtaagtctggttttgtc

SEQ ID NO: 5658365 - DNA, 18 bp, Homo sapiens
ttgcaggtgaccagaatg

SEQ ID NO: 5658366 - DNA, 17 bp, Homo sapiens
ttgcaggtgcctggctt

SEQ ID NO: 5658367 - DNA, 18 bp, Homo sapiens
ttgcaggtggaactcagt

SEQ ID NO: 5658368 - DNA, 20 bp, Homo sapiens
ttgcaggtggaactcagtca

SEQ ID NO: 5658369 - DNA, 14 bp, Homo sapiens
ttgcaggtggccaa

SEQ ID NO: 5658370 - DNA, 15 bp, Homo sapiens
ttgcaggttgctttg

SEQ ID NO: 5658371 - DNA, 13 bp, Homo sapiens
ttgcagtacatca

SEQ ID NO: 5658372 - DNA, 16 bp, Homo sapiens
ttgcagtatcagaggg

SEQ ID NO: 5658373 - DNA, 16 bp, Homo sapiens
ttgcagtatgatggca

SEQ ID NO: 5658374 - DNA, 17 bp, Homo sapiens
ttgcagtcagaagatct

SEQ ID NO: 5658375 - DNA, 19 bp, Homo sapiens
ttgcagtcagaagatcttt

SEQ ID NO: 5658376 - DNA, 14 bp, Homo sapiens
ttgcagtcatagaa

SEQ ID NO: 5658377 - DNA, 17 bp, Homo sapiens
ttgcagtcatcagaagt

SEQ ID NO: 5658378 - DNA, 17 bp, Homo sapiens
ttgcagtctgcttctgc

SEQ ID NO: 5658379 - DNA, 14 bp, Homo sapiens
ttgcagtctttccc

SEQ ID NO: 5658380 - DNA, 17 bp, Homo sapiens
ttgcagtgaactgagac

SEQ ID NO: 5658381 - DNA, 11 bp, Homo sapiens
ttgcagtgaag

SEQ ID NO: 5658382 - DNA, 14 bp, Homo sapiens
ttgcagtgaagatg

SEQ ID NO: 5658383 - DNA, 20 bp, Homo sapiens
ttgcagtgagcagggtgggg

SEQ ID NO: 5658384 - DNA, 15 bp, Homo sapiens
ttgcagtgagctgag

SEQ ID NO: 5658385 - DNA, 13 bp, Homo sapiens
ttgcagtggaaga

SEQ ID NO: 5658386 - DNA, 15 bp, Homo sapiens
ttgcagtggcctggc

SEQ ID NO: 5658387 - DNA, 17 bp, Homo sapiens
ttgcagtggcttttcat

SEQ ID NO: 5658388 - DNA, 14 bp, Homo sapiens
ttgcagttagactc

SEQ ID NO: 5658389 - DNA, 16 bp, Homo sapiens
ttgcagttagccccag

SEQ ID NO: 5658390 - DNA, 13 bp, Homo sapiens
ttgcagttcacct

SEQ ID NO: 5658391 - DNA, 16 bp, Homo sapiens
ttgcagttcagcacca

SEQ ID NO: 5658392 - DNA, 18 bp, Homo sapiens
ttgcagttcatactgaat

SEQ ID NO: 5658393 - DNA, 17 bp, Homo sapiens
ttgcagtttacagtatt

SEQ ID NO: 5658394 - DNA, 20 bp, Homo sapiens
ttgcagtttatcattcaagt

SEQ ID NO: 5658395 - DNA, 13 bp, Homo sapiens
ttgcagttttgta

SEQ ID NO: 5658396 - DNA, 14 bp, Homo sapiens
ttgcataaagcata

SEQ ID NO: 5658397 - DNA, 19 bp, Homo sapiens
ttgcataacaattcctcta

SEQ ID NO: 5658398 - DNA, 13 bp, Homo sapiens
ttgcataagagct

SEQ ID NO: 5658399 - DNA, 17 bp, Homo sapiens
ttgcataagattaaagg

SEQ ID NO: 5658400 - DNA, 23 bp, Homo sapiens
ttgcataagattaaaggaaggaa

SEQ ID NO: 5658401 - DNA, 19 bp, Homo sapiens
ttgcataagcattgctcaa

SEQ ID NO: 5658402 - DNA, 18 bp, Homo sapiens
ttgcataagcctcaggcc

SEQ ID NO: 5658403 - DNA, 21 bp, Homo sapiens
ttgcataagtggacccagctg

SEQ ID NO: 5658404 - DNA, 12 bp, Homo sapiens
ttgcataataaa

SEQ ID NO: 5658405 - DNA, 21 bp, Homo sapiens
ttgcataataagctaaagagg

SEQ ID NO: 5658406 - DNA, 15 bp, Homo sapiens
ttgcataatactaat

SEQ ID NO: 5658407 - DNA, 16 bp, Homo sapiens
ttgcataatactaatt

SEQ ID NO: 5658408 - DNA, 17 bp, Homo sapiens
ttgcataatactaattt

SEQ ID NO: 5658409 - DNA, 17 bp, Homo sapiens
ttgcataatatgcatat

SEQ ID NO: 5658410 - DNA, 14 bp, Homo sapiens
ttgcataatgcaat

SEQ ID NO: 5658411 - DNA, 13 bp, Homo sapiens
ttgcatacaaaca

SEQ ID NO: 5658412 - DNA, 16 bp, Homo sapiens
ttgcatacaccactgc

SEQ ID NO: 5658413 - DNA, 22 bp, Homo sapiens
ttgcatacattcttcaagatcc

SEQ ID NO: 5658414 - DNA, 18 bp, Homo sapiens
ttgcatactattaaacat

SEQ ID NO: 5658415 - DNA, 19 bp, Homo sapiens
ttgcatagcagctgctact

SEQ ID NO: 5658416 - DNA, 19 bp, Homo sapiens
ttgcataggctcttaagca

SEQ ID NO: 5658417 - DNA, 20 bp, Homo sapiens
ttgcataggctcttaagcag

SEQ ID NO: 5658418 - DNA, 14 bp, Homo sapiens
ttgcatataactta

SEQ ID NO: 5658419 - DNA, 12 bp, Homo sapiens
ttgcatatagat

SEQ ID NO: 5658420 - DNA, 22 bp, Homo sapiens
ttgcatatagttaaactgagag

SEQ ID NO: 5658421 - DNA, 19 bp, Homo sapiens
ttgcatatcacccttccct

SEQ ID NO: 5658422 - DNA, 16 bp, Homo sapiens
ttgcatatgagccgtg

SEQ ID NO: 5658423 - DNA, 19 bp, Homo sapiens
ttgcatattataaaggata

SEQ ID NO: 5658424 - DNA, 23 bp, Homo sapiens
ttgcatattgaaaagcacagagg

SEQ ID NO: 5658425 - DNA, 14 bp, Homo sapiens
ttgcatcagaaatg

SEQ ID NO: 5658426 - DNA, 15 bp, Homo sapiens
ttgcatcagtattaa

SEQ ID NO: 5658427 - DNA, 21 bp, Homo sapiens
ttgcatcagtattaatactaa

SEQ ID NO: 5658428 - DNA, 22 bp, Homo sapiens
ttgcatcatagaacagaaatat

SEQ ID NO: 5658429 - DNA, 20 bp, Homo sapiens
ttgcatccattgttgtgtct

SEQ ID NO: 5658430 - DNA, 17 bp, Homo sapiens
ttgcatcccccttagaa

SEQ ID NO: 5658431 - DNA, 20 bp, Homo sapiens
ttgcatcccccttagaatgt

SEQ ID NO: 5658432 - DNA, 22 bp, Homo sapiens
ttgcatcccccttagaatgttt

SEQ ID NO: 5658433 - DNA, 14 bp, Homo sapiens
ttgcatctacctgc

SEQ ID NO: 5658434 - DNA, 18 bp, Homo sapiens
ttgcatctacctgctcct

SEQ ID NO: 5658435 - DNA, 17 bp, Homo sapiens
ttgcatctcaaaattat

SEQ ID NO: 5658436 - DNA, 20 bp, Homo sapiens
ttgcatctcccagataatgt

SEQ ID NO: 5658437 - DNA, 14 bp, Homo sapiens
ttgcatctgaaata

SEQ ID NO: 5658438 - DNA, 17 bp, Homo sapiens
ttgcatctgaccccggg

SEQ ID NO: 5658439 - DNA, 13 bp, Homo sapiens
ttgcatctgggcc

SEQ ID NO: 5658440 - DNA, 14 bp, Homo sapiens
ttgcatctgggcca

SEQ ID NO: 5658441 - DNA, 19 bp, Homo sapiens
ttgcatctgggtagctgta

SEQ ID NO: 5658442 - DNA, 23 bp, Homo sapiens
ttgcatctgtataagtaagaaaa

SEQ ID NO: 5658443 - DNA, 22 bp, Homo sapiens
ttgcatgaaaatagctattttt

SEQ ID NO: 5658444 - DNA, 11 bp, Homo sapiens
ttgcatgaaat

SEQ ID NO: 5658445 - DNA, 18 bp, Homo sapiens
ttgcatgaagagaagcaa

SEQ ID NO: 5658446 - DNA, 20 bp, Homo sapiens
ttgcatgaattcacaaacaa

SEQ ID NO: 5658447 - DNA, 21 bp, Homo sapiens
ttgcatgatctgtcaaagtga

SEQ ID NO: 5658448 - DNA, 18 bp, Homo sapiens
ttgcatgattcttctctt

SEQ ID NO: 5658449 - DNA, 16 bp, Homo sapiens
ttgcatgatttcccaa

SEQ ID NO: 5658450 - DNA, 11 bp, Homo sapiens
ttgcatgcatg

SEQ ID NO: 5658451 - DNA, 17 bp, Homo sapiens
ttgcatgcatgcaaatg

SEQ ID NO: 5658452 - DNA, 22 bp, Homo sapiens
ttgcatgctgctttaattgtga

SEQ ID NO: 5658453 - DNA, 16 bp, Homo sapiens
ttgcatggagaatggg

SEQ ID NO: 5658454 - DNA, 17 bp, Homo sapiens
ttgcatggattttggat

SEQ ID NO: 5658455 - DNA, 19 bp, Homo sapiens
ttgcatggcacttgcatct

SEQ ID NO: 5658456 - DNA, 21 bp, Homo sapiens
ttgcatggcagggcctcatct

SEQ ID NO: 5658457 - DNA, 20 bp, Homo sapiens
ttgcatggctccagaaatgt

SEQ ID NO: 5658458 - DNA, 17 bp, Homo sapiens
ttgcatgggctaatgaa

SEQ ID NO: 5658459 - DNA, 16 bp, Homo sapiens
ttgcatgggttttgta

SEQ ID NO: 5658460 - DNA, 17 bp, Homo sapiens
ttgcatgggttttgtag

SEQ ID NO: 5658461 - DNA, 13 bp, Homo sapiens
ttgcatggtgtga

SEQ ID NO: 5658462 - DNA, 17 bp, Homo sapiens
ttgcatgtaaaagccta

SEQ ID NO: 5658463 - DNA, 23 bp, Homo sapiens
ttgcatgtaaaatgcagtccaga

SEQ ID NO: 5658464 - DNA, 15 bp, Homo sapiens
ttgcatgtacttgaa

SEQ ID NO: 5658465 - DNA, 21 bp, Homo sapiens
ttgcatgtatccatacctgga

SEQ ID NO: 5658466 - DNA, 17 bp, Homo sapiens
ttgcatgtcgcacaatg

SEQ ID NO: 5658467 - DNA, 19 bp, Homo sapiens
ttgcatgtcgcacaatgtt

SEQ ID NO: 5658468 - DNA, 14 bp, Homo sapiens
ttgcatgtgaaaat

SEQ ID NO: 5658469 - DNA, 20 bp, Homo sapiens
ttgcatgtgaaaatcaaata

SEQ ID NO: 5658470 - DNA, 15 bp, Homo sapiens
ttgcatgtgactctg

SEQ ID NO: 5658471 - DNA, 15 bp, Homo sapiens
ttgcatgtggatcaa

SEQ ID NO: 5658472 - DNA, 16 bp, Homo sapiens
ttgcatgttatgttta

SEQ ID NO: 5658473 - DNA, 17 bp, Homo sapiens
ttgcatgttatgtttaa

SEQ ID NO: 5658474 - DNA, 19 bp, Homo sapiens
ttgcatgttccactaaccc

SEQ ID NO: 5658475 - DNA, 15 bp, Homo sapiens
ttgcatgttcttgtt

SEQ ID NO: 5658476 - DNA, 22 bp, Homo sapiens
ttgcatgttcttgttttgttat

SEQ ID NO: 5658477 - DNA, 16 bp, Homo sapiens
ttgcatgtttaataat

SEQ ID NO: 5658478 - DNA, 21 bp, Homo sapiens
ttgcatgtttaataatatgta

SEQ ID NO: 5658479 - DNA, 17 bp, Homo sapiens
ttgcatgtttttgaaaa

SEQ ID NO: 5658480 - DNA, 16 bp, Homo sapiens
ttgcattaaaagactg

SEQ ID NO: 5658481 - DNA, 13 bp, Homo sapiens
ttgcattaaatta

SEQ ID NO: 5658482 - DNA, 20 bp, Homo sapiens
ttgcattaaattcacaaact

SEQ ID NO: 5658483 - DNA, 12 bp, Homo sapiens
ttgcattagaaa

SEQ ID NO: 5658484 - DNA, 16 bp, Homo sapiens
ttgcattagaaactga

SEQ ID NO: 5658485 - DNA, 13 bp, Homo sapiens
ttgcattatgcaa

SEQ ID NO: 5658486 - DNA, 16 bp, Homo sapiens
ttgcattatgtattta

SEQ ID NO: 5658487 - DNA, 18 bp, Homo sapiens
ttgcattattatcattga

SEQ ID NO: 5658488 - DNA, 21 bp, Homo sapiens
ttgcattattcatatgcttcc

SEQ ID NO: 5658489 - DNA, 16 bp, Homo sapiens
ttgcattattcattta

SEQ ID NO: 5658490 - DNA, 11 bp, Homo sapiens
ttgcattcaaa

SEQ ID NO: 5658491 - DNA, 12 bp, Homo sapiens
ttgcattcaaat

SEQ ID NO: 5658492 - DNA, 14 bp, Homo sapiens
ttgcattccagaat

SEQ ID NO: 5658493 - DNA, 22 bp, Homo sapiens
ttgcattccagagttaaaatgt

SEQ ID NO: 5658494 - DNA, 20 bp, Homo sapiens
ttgcattccagcgtctgctg

SEQ ID NO: 5658495 - DNA, 14 bp, Homo sapiens
ttgcattccatgat

SEQ ID NO: 5658496 - DNA, 21 bp, Homo sapiens
ttgcattccttacttgcactg

SEQ ID NO: 5658497 - DNA, 17 bp, Homo sapiens
ttgcattcctttgtctt

SEQ ID NO: 5658498 - DNA, 19 bp, Homo sapiens
ttgcattctattgccttct

SEQ ID NO: 5658499 - DNA, 22 bp, Homo sapiens
ttgcattctattgccttctttg

SEQ ID NO: 5658500 - DNA, 12 bp, Homo sapiens
ttgcattctccc

SEQ ID NO: 5658501 - DNA, 15 bp, Homo sapiens
ttgcattgaacacaa

SEQ ID NO: 5658502 - DNA, 15 bp, Homo sapiens
ttgcattgacattat

SEQ ID NO: 5658503 - DNA, 15 bp, Homo sapiens
ttgcattgaggaaat

SEQ ID NO: 5658504 - DNA, 21 bp, Homo sapiens
ttgcattgaggaaatattaat

SEQ ID NO: 5658505 - DNA, 19 bp, Homo sapiens
ttgcattggggttcctctg

SEQ ID NO: 5658506 - DNA, 15 bp, Homo sapiens
ttgcattgtctaatg

SEQ ID NO: 5658507 - DNA, 15 bp, Homo sapiens
ttgcattgtctgtct

SEQ ID NO: 5658508 - DNA, 15 bp, Homo sapiens
ttgcatttaaaacag

SEQ ID NO: 5658509 - DNA, 22 bp, Homo sapiens
ttgcatttaaaacagacactgg

SEQ ID NO: 5658510 - DNA, 20 bp, Homo sapiens
ttgcatttacgcctgtaaat

SEQ ID NO: 5658511 - DNA, 17 bp, Homo sapiens
ttgctcactcactcact

SEQ ID NO: 5658512 - DNA, 22 bp, Homo sapiens
ttgctcactccctaaagccctc

SEQ ID NO: 5658513 - DNA, 16 bp, Homo sapiens
ttgctcagaagagaat

SEQ ID NO: 5658514 - DNA, 13 bp, Homo sapiens
ttgctcagagaaa

SEQ ID NO: 5658515 - DNA, 12 bp, Homo sapiens
ttgctcagagct

SEQ ID NO: 5658516 - DNA, 14 bp, Homo sapiens
ttgctcagagctag

SEQ ID NO: 5658517 - DNA, 18 bp, Homo sapiens
ttgctcagagtgaagagt

SEQ ID NO: 5658518 - DNA, 20 bp, Homo sapiens
ttgctcagatagatctgtgt

SEQ ID NO: 5658519 - DNA, 21 bp, Homo sapiens
ttgctcagcccgcttggccac

SEQ ID NO: 5658520 - DNA, 16 bp, Homo sapiens
ttgctcagtgtccagc

SEQ ID NO: 5658521 - DNA, 18 bp, Homo sapiens
ttgctcagtgtccagctt

SEQ ID NO: 5658522 - DNA, 20 bp, Homo sapiens
ttgctcagtgtccagcttcc

SEQ ID NO: 5658523 - DNA, 14 bp, Homo sapiens
ttgctcataatctg

SEQ ID NO: 5658524 - DNA, 16 bp, Homo sapiens
ttgctcatatttccca

SEQ ID NO: 5658525 - DNA, 11 bp, Homo sapiens
ttgctcatgga

SEQ ID NO: 5658526 - DNA, 12 bp, Homo sapiens
ttgctcatggaa

SEQ ID NO: 5658527 - DNA, 12 bp, Homo sapiens
ttgctcatgtaa

SEQ ID NO: 5658528 - DNA, 17 bp, Homo sapiens
ttgctcatgttggccaa

SEQ ID NO: 5658529 - DNA, 13 bp, Homo sapiens
ttgctccagacct

SEQ ID NO: 5658530 - DNA, 22 bp, Homo sapiens
ttgctccagacctgcccctccc

SEQ ID NO: 5658531 - DNA, 12 bp, Homo sapiens
ttgctccagata

SEQ ID NO: 5658532 - DNA, 20 bp, Homo sapiens
ttgctccagattctgatgca

SEQ ID NO: 5658533 - DNA, 14 bp, Homo sapiens
ttgctccagcctga

SEQ ID NO: 5658534 - DNA, 11 bp, Homo sapiens
ttgctccaggg

SEQ ID NO: 5658535 - DNA, 22 bp, Homo sapiens
ttgctccagtataaattacatg

SEQ ID NO: 5658536 - DNA, 21 bp, Homo sapiens
ttgctccatacaatgactagt

SEQ ID NO: 5658537 - DNA, 16 bp, Homo sapiens
ttgctccattcataca

SEQ ID NO: 5658538 - DNA, 14 bp, Homo sapiens
ttgctcccaaccca

SEQ ID NO: 5658539 - DNA, 19 bp, Homo sapiens
ttgctcccaagcccctgac

SEQ ID NO: 5658540 - DNA, 16 bp, Homo sapiens
ttgctcccaggatctc

SEQ ID NO: 5658541 - DNA, 12 bp, Homo sapiens
ttgctcccagtg

SEQ ID NO: 5658542 - DNA, 16 bp, Homo sapiens
ttgctccccagtgaag

SEQ ID NO: 5658543 - DNA, 17 bp, Homo sapiens
ttgctcccctgatagaa

SEQ ID NO: 5658544 - DNA, 14 bp, Homo sapiens
ttgctccccttccc

SEQ ID NO: 5658545 - DNA, 16 bp, Homo sapiens
ttgctccccttcccct

SEQ ID NO: 5658546 - DNA, 20 bp, Homo sapiens
ttgctccccttccccttcct

SEQ ID NO: 5658547 - DNA, 19 bp, Homo sapiens
ttgctcccgccccagggtc

SEQ ID NO: 5658548 - DNA, 14 bp, Homo sapiens
ttgctccctctcca

SEQ ID NO: 5658549 - DNA, 15 bp, Homo sapiens
ttgctccctctccaa

SEQ ID NO: 5658550 - DNA, 13 bp, Homo sapiens
ttgctccctctgt

SEQ ID NO: 5658551 - DNA, 17 bp, Homo sapiens
ttgctccctctgttagg

SEQ ID NO: 5658552 - DNA, 23 bp, Homo sapiens
ttgctccctgattaaagtgcctt

SEQ ID NO: 5658553 - DNA, 15 bp, Homo sapiens
ttgctcccttcagcc

SEQ ID NO: 5658554 - DNA, 17 bp, Homo sapiens
ttgctccgcctggcctg

SEQ ID NO: 5658555 - DNA, 19 bp, Homo sapiens
ttgctcctacccctgtcct

SEQ ID NO: 5658556 - DNA, 19 bp, Homo sapiens
ttgctcctgcatgcaacta

SEQ ID NO: 5658557 - DNA, 17 bp, Homo sapiens
ttgctcctgccaaccac

SEQ ID NO: 5658558 - DNA, 14 bp, Homo sapiens
ttgctcctgcttct

SEQ ID NO: 5658559 - DNA, 19 bp, Homo sapiens
ttgctcctgcttctcctga

SEQ ID NO: 5658560 - DNA, 18 bp, Homo sapiens
ttgctcctggaacctggc

SEQ ID NO: 5658561 - DNA, 15 bp, Homo sapiens
ttgctccttgaataa

SEQ ID NO: 5658562 - DNA, 16 bp, Homo sapiens
ttgctccttgaataag

SEQ ID NO: 5658563 - DNA, 12 bp, Homo sapiens
ttgctccttgac

SEQ ID NO: 5658564 - DNA, 18 bp, Homo sapiens
ttgctccttttgctcttt

SEQ ID NO: 5658565 - DNA, 15 bp, Homo sapiens
ttgctcgaagactgt

SEQ ID NO: 5658566 - DNA, 20 bp, Homo sapiens
ttgctcgcccagacaccatg

SEQ ID NO: 5658567 - DNA, 21 bp, Homo sapiens
ttgctcgcccagacaccatgt

SEQ ID NO: 5658568 - DNA, 22 bp, Homo sapiens
ttgctcgcttgctggaacacag

SEQ ID NO: 5658569 - DNA, 14 bp, Homo sapiens
ttgctcgcttttcc

SEQ ID NO: 5658570 - DNA, 22 bp, Homo sapiens
ttgctcgggtcccttcacctcc

SEQ ID NO: 5658571 - DNA, 21 bp, Homo sapiens
ttgctctaaaatatttatgaa

SEQ ID NO: 5658572 - DNA, 14 bp, Homo sapiens
ttgctctaattctt

SEQ ID NO: 5658573 - DNA, 22 bp, Homo sapiens
ttgctctaattcttttcaaaat

SEQ ID NO: 5658574 - DNA, 19 bp, Homo sapiens
ttgctctaccaaatagtga

SEQ ID NO: 5658575 - DNA, 21 bp, Homo sapiens
ttgctctaccaaatagtgatt

SEQ ID NO: 5658576 - DNA, 14 bp, Homo sapiens
ttgctctaggaaga

SEQ ID NO: 5658577 - DNA, 21 bp, Homo sapiens
ttgctctagtcttgctttgct

SEQ ID NO: 5658578 - DNA, 17 bp, Homo sapiens
ttgctctatatgtaata

SEQ ID NO: 5658579 - DNA, 23 bp, Homo sapiens
ttgctctatatgtaatatatcct

SEQ ID NO: 5658580 - DNA, 16 bp, Homo sapiens
ttgctctatctctcaa

SEQ ID NO: 5658581 - DNA, 12 bp, Homo sapiens
ttgctctatgtc

SEQ ID NO: 5658582 - DNA, 15 bp, Homo sapiens
ttgctctatgtctgc

SEQ ID NO: 5658583 - DNA, 20 bp, Homo sapiens
ttgctctatgtctgccttcg

SEQ ID NO: 5658584 - DNA, 23 bp, Homo sapiens
ttgctctattaagattggaaatg

SEQ ID NO: 5658585 - DNA, 16 bp, Homo sapiens
ttgctctcaattaaag

SEQ ID NO: 5658586 - DNA, 18 bp, Homo sapiens
ttgctctcagctgccaac

SEQ ID NO: 5658587 - DNA, 13 bp, Homo sapiens
ttgctctcccggt

SEQ ID NO: 5658588 - DNA, 16 bp, Homo sapiens
ttgctctcctcatctc

SEQ ID NO: 5658589 - DNA, 12 bp, Homo sapiens
ttgctctcctgg

SEQ ID NO: 5658590 - DNA, 14 bp, Homo sapiens
ttgctctcctggag

SEQ ID NO: 5658591 - DNA, 11 bp, Homo sapiens
ttgctctctca

SEQ ID NO: 5658592 - DNA, 20 bp, Homo sapiens
ttgctctctctccctgcctt

SEQ ID NO: 5658593 - DNA, 21 bp, Homo sapiens
ttgctctctctccctgccttt

SEQ ID NO: 5658594 - DNA, 22 bp, Homo sapiens
ttgctctctctccctgccttta

SEQ ID NO: 5658595 - DNA, 13 bp, Homo sapiens
ttgctctctgtga

SEQ ID NO: 5658596 - DNA, 12 bp, Homo sapiens
ttgctctctgtt

SEQ ID NO: 5658597 - DNA, 12 bp, Homo sapiens
ttgctctgcacc

SEQ ID NO: 5658598 - DNA, 21 bp, Homo sapiens
ttgctctgctcatctacacat

SEQ ID NO: 5658599 - DNA, 14 bp, Homo sapiens
ttgctctggaagcc

SEQ ID NO: 5658600 - DNA, 21 bp, Homo sapiens
ttgctctggaagcctgctgat

SEQ ID NO: 5658601 - DNA, 13 bp, Homo sapiens
ttgctctggacct

SEQ ID NO: 5658602 - DNA, 15 bp, Homo sapiens
ttgctctggacctgc

SEQ ID NO: 5658603 - DNA, 13 bp, Homo sapiens
ttgctctggagca

SEQ ID NO: 5658604 - DNA, 14 bp, Homo sapiens
ttgctctggctgag

SEQ ID NO: 5658605 - DNA, 19 bp, Homo sapiens
ttgctctgggagacttact

SEQ ID NO: 5658606 - DNA, 13 bp, Homo sapiens
ttgctctgtcacc

SEQ ID NO: 5658607 - DNA, 16 bp, Homo sapiens
ttgctctgtcccccag

SEQ ID NO: 5658608 - DNA, 21 bp, Homo sapiens
ttgctctgtcccccaggctgg

SEQ ID NO: 5658609 - DNA, 22 bp, Homo sapiens
ttgctctgtcccccaggctgga

SEQ ID NO: 5658610 - DNA, 14 bp, Homo sapiens
ttgctctgtctccc

SEQ ID NO: 5658611 - DNA, 16 bp, Homo sapiens
ttgctctgtggccttg

SEQ ID NO: 5658612 - DNA, 22 bp, Homo sapiens
ttgctctgttacccaggctgga

SEQ ID NO: 5658613 - DNA, 13 bp, Homo sapiens
ttgctctgttccc

SEQ ID NO: 5658614 - DNA, 20 bp, Homo sapiens
ttgctcttaagtaccagaag

SEQ ID NO: 5658615 - DNA, 19 bp, Homo sapiens
ttgctcttaagttgtggag

SEQ ID NO: 5658616 - DNA, 17 bp, Homo sapiens
ttgctcttagtcccaag

SEQ ID NO: 5658617 - DNA, 18 bp, Homo sapiens
ttgctcttgatgcctggc

SEQ ID NO: 5658618 - DNA, 13 bp, Homo sapiens
ttgctcttggaaa

SEQ ID NO: 5658619 - DNA, 17 bp, Homo sapiens
ttgctcttggggaaggg

SEQ ID NO: 5658620 - DNA, 11 bp, Homo sapiens
ttgctctttca

SEQ ID NO: 5658621 - DNA, 15 bp, Homo sapiens
ttgctctttcacctg

SEQ ID NO: 5658622 - DNA, 20 bp, Homo sapiens
ttgctctttgacaactaaaa

SEQ ID NO: 5658623 - DNA, 12 bp, Homo sapiens
ttgctgaaacac

SEQ ID NO: 5658624 - DNA, 12 bp, Homo sapiens
ttgctgaaactg

SEQ ID NO: 5658625 - DNA, 21 bp, Homo sapiens
ttgctgaaagatatgtatatt

SEQ ID NO: 5658626 - DNA, 23 bp, Homo sapiens
ttgctgaaagatatgtatatttt

SEQ ID NO: 5658627 - DNA, 13 bp, Homo sapiens
ttgctgaaagcca

SEQ ID NO: 5658628 - DNA, 19 bp, Homo sapiens
ttgctgaaattttatatgc

SEQ ID NO: 5658629 - DNA, 14 bp, Homo sapiens
ttgctgaacacaca

SEQ ID NO: 5658630 - DNA, 15 bp, Homo sapiens
ttgctgaactcagca

SEQ ID NO: 5658631 - DNA, 22 bp, Homo sapiens
ttgctgaaggattatatgtatt

SEQ ID NO: 5658632 - DNA, 14 bp, Homo sapiens
ttgctgaataacaa

SEQ ID NO: 5658633 - DNA, 21 bp, Homo sapiens
ttgctgaataacaacaattta

SEQ ID NO: 5658634 - DNA, 19 bp, Homo sapiens
ttgctgaatacagaggcaa

SEQ ID NO: 5658635 - DNA, 11 bp, Homo sapiens
ttgctgaatag

SEQ ID NO: 5658636 - DNA, 21 bp, Homo sapiens
ttgctgaatcccatcaggctg

SEQ ID NO: 5658637 - DNA, 16 bp, Homo sapiens
ttgctgacagagccct

SEQ ID NO: 5658638 - DNA, 14 bp, Homo sapiens
ttgctgaccctccc

SEQ ID NO: 5658639 - DNA, 22 bp, Homo sapiens
ttgctgacgattagttctaaaa

SEQ ID NO: 5658640 - DNA, 12 bp, Homo sapiens
ttgctgacttag

SEQ ID NO: 5658641 - DNA, 22 bp, Homo sapiens
ttgctgacttcccaagccctgg

SEQ ID NO: 5658642 - DNA, 11 bp, Homo sapiens
ttgctgagact

SEQ ID NO: 5658643 - DNA, 16 bp, Homo sapiens
ttgctgagatgtttag

SEQ ID NO: 5658644 - DNA, 20 bp, Homo sapiens
ttgctgagcaccctctccgg

SEQ ID NO: 5658645 - DNA, 11 bp, Homo sapiens
ttgctgagcct

SEQ ID NO: 5658646 - DNA, 14 bp, Homo sapiens
ttgctgagcctctg

SEQ ID NO: 5658647 - DNA, 22 bp, Homo sapiens
ttgctgagcctctgctccccag

SEQ ID NO: 5658648 - DNA, 19 bp, Homo sapiens
ttgctgaggagctcagggc

SEQ ID NO: 5658649 - DNA, 20 bp, Homo sapiens
ttgctgaggagctcagggct

SEQ ID NO: 5658650 - DNA, 15 bp, Homo sapiens
ttgctgagttgttct

SEQ ID NO: 5658651 - DNA, 16 bp, Homo sapiens
ttgctgagttgttcta

SEQ ID NO: 5658652 - DNA, 19 bp, Homo sapiens
ttgctgataccatatgaat

SEQ ID NO: 5658653 - DNA, 16 bp, Homo sapiens
ttgctgatggcccctc

SEQ ID NO: 5658654 - DNA, 20 bp, Homo sapiens
ttgctgatggcccctccagc

SEQ ID NO: 5658655 - DNA, 18 bp, Homo sapiens
ttgctgatggctgctaga

SEQ ID NO: 5658656 - DNA, 19 bp, Homo sapiens
ttgctgatgggttcttaga

SEQ ID NO: 5658657 - DNA, 22 bp, Homo sapiens
ttgctgatggtgcaatgacctt

SEQ ID NO: 5658658 - DNA, 17 bp, Homo sapiens
ttgctgattatttatga

SEQ ID NO: 5658659 - DNA, 14 bp, Homo sapiens
ttgctgattttaat

SEQ ID NO: 5658660 - DNA, 17 bp, Homo sapiens
ttgctgattttattctt

SEQ ID NO: 5658661 - DNA, 18 bp, Homo sapiens
ttgctgcaattttataag

SEQ ID NO: 5658662 - DNA, 19 bp, Homo sapiens
ttgctgcactcttgcacat

SEQ ID NO: 5658663 - DNA, 15 bp, Homo sapiens
ttgctgcaggccctc

SEQ ID NO: 5658664 - DNA, 22 bp, Homo sapiens
ttgctgcaggccctccctctac

SEQ ID NO: 5658665 - DNA, 15 bp, Homo sapiens
ttgctgcataaaatt

SEQ ID NO: 5658666 - DNA, 16 bp, Homo sapiens
ttgctgcataaatttg

SEQ ID NO: 5658667 - DNA, 22 bp, Homo sapiens
ttgctgcattcctttttcttca

SEQ ID NO: 5658668 - DNA, 12 bp, Homo sapiens
ttgctgcatttt

SEQ ID NO: 5658669 - DNA, 12 bp, Homo sapiens
ttgctgccaaaa

SEQ ID NO: 5658670 - DNA, 19 bp, Homo sapiens
ttgctgccaaaaccacatg

SEQ ID NO: 5658671 - DNA, 20 bp, Homo sapiens
ttgctgccaaaaccacatgg

SEQ ID NO: 5658672 - DNA, 18 bp, Homo sapiens
ttgctgccacactgtctc

SEQ ID NO: 5658673 - DNA, 15 bp, Homo sapiens
ttgctgcccctgtct

SEQ ID NO: 5658674 - DNA, 21 bp, Homo sapiens
ttgctgcccctgtctggaaga

SEQ ID NO: 5658675 - DNA, 16 bp, Homo sapiens
ttgctgccctgcccca

SEQ ID NO: 5658676 - DNA, 12 bp, Homo sapiens
ttgctgccctgg

SEQ ID NO: 5658677 - DNA, 12 bp, Homo sapiens
ttgctgcctcat

SEQ ID NO: 5658678 - DNA, 23 bp, Homo sapiens
ttgctgcctcggatccccttcct

SEQ ID NO: 5658679 - DNA, 16 bp, Homo sapiens
ttgctgcctttcaagc

SEQ ID NO: 5658680 - DNA, 18 bp, Homo sapiens
ttgctgcctttgtcccca

SEQ ID NO: 5658681 - DNA, 19 bp, Homo sapiens
ttgctgcctttgtccccac

SEQ ID NO: 5658682 - DNA, 20 bp, Homo sapiens
ttgctgctaccgccctgggc

SEQ ID NO: 5658683 - DNA, 23 bp, Homo sapiens
ttgctgctagaacttttttaaat

SEQ ID NO: 5658684 - DNA, 12 bp, Homo sapiens
ttgctgctgccc

SEQ ID NO: 5658685 - DNA, 15 bp, Homo sapiens
ttgctgctgctacca

SEQ ID NO: 5658686 - DNA, 14 bp, Homo sapiens
ttgctgctgctgca

SEQ ID NO: 5658687 - DNA, 12 bp, Homo sapiens
ttgctgctgctt

SEQ ID NO: 5658688 - DNA, 23 bp, Homo sapiens
ttgctgctgcttaatcctacccc

SEQ ID NO: 5658689 - DNA, 17 bp, Homo sapiens
ttgctgctgcttcctgt

SEQ ID NO: 5658690 - DNA, 15 bp, Homo sapiens
ttgctgctgtccagt

SEQ ID NO: 5658691 - DNA, 23 bp, Homo sapiens
ttggatcagtgaaaaacattagt

SEQ ID NO: 5658692 - DNA, 21 bp, Homo sapiens
ttggatcataaactggaaata

SEQ ID NO: 5658693 - DNA, 20 bp, Homo sapiens
ttggatcctactcaacaaaa

SEQ ID NO: 5658694 - DNA, 18 bp, Homo sapiens
ttggatcctgtgtggaga

SEQ ID NO: 5658695 - DNA, 21 bp, Homo sapiens
ttggatcgtggaagaagggcc

SEQ ID NO: 5658696 - DNA, 19 bp, Homo sapiens
ttggatctattgatttgaa

SEQ ID NO: 5658697 - DNA, 17 bp, Homo sapiens
ttggatctgcttgctgt

SEQ ID NO: 5658698 - DNA, 12 bp, Homo sapiens
ttggatgaaggt

SEQ ID NO: 5658699 - DNA, 23 bp, Homo sapiens
ttggatgaatgcagtataaaatg

SEQ ID NO: 5658700 - DNA, 14 bp, Homo sapiens
ttggatgagcatgg

SEQ ID NO: 5658701 - DNA, 12 bp, Homo sapiens
ttggatgagttt

SEQ ID NO: 5658702 - DNA, 21 bp, Homo sapiens
ttggatgatacagtgtttttt

SEQ ID NO: 5658703 - DNA, 17 bp, Homo sapiens
ttggatgattgttcata

SEQ ID NO: 5658704 - DNA, 19 bp, Homo sapiens
ttggatgattgttcataat

SEQ ID NO: 5658705 - DNA, 22 bp, Homo sapiens
ttggatgattttttaagcagac

SEQ ID NO: 5658706 - DNA, 15 bp, Homo sapiens
ttggatgcagttgta

SEQ ID NO: 5658707 - DNA, 20 bp, Homo sapiens
ttggatgcgagcttggcctt

SEQ ID NO: 5658708 - DNA, 22 bp, Homo sapiens
ttggatggctatggagagggct

SEQ ID NO: 5658709 - DNA, 16 bp, Homo sapiens
ttggatggcttgtcta

SEQ ID NO: 5658710 - DNA, 21 bp, Homo sapiens
ttggatgggagtgagacagaa

SEQ ID NO: 5658711 - DNA, 12 bp, Homo sapiens
ttggatgtctgt

SEQ ID NO: 5658712 - DNA, 16 bp, Homo sapiens
ttggatgttgctatag

SEQ ID NO: 5658713 - DNA, 16 bp, Homo sapiens
ttggatgttgtaaata

SEQ ID NO: 5658714 - DNA, 16 bp, Homo sapiens
ttggattaaatacata

SEQ ID NO: 5658715 - DNA, 20 bp, Homo sapiens
ttggattaaattctgggtga

SEQ ID NO: 5658716 - DNA, 14 bp, Homo sapiens
ttggattaatcttt

SEQ ID NO: 5658717 - DNA, 15 bp, Homo sapiens
ttggattatcctgag

SEQ ID NO: 5658718 - DNA, 13 bp, Homo sapiens
ttggattattcat

SEQ ID NO: 5658719 - DNA, 18 bp, Homo sapiens
ttggattattcatttaaa

SEQ ID NO: 5658720 - DNA, 21 bp, Homo sapiens
ttggattattctttctccttt

SEQ ID NO: 5658721 - DNA, 14 bp, Homo sapiens
ttggattatttaat

SEQ ID NO: 5658722 - DNA, 17 bp, Homo sapiens
ttggattatttaataac

SEQ ID NO: 5658723 - DNA, 20 bp, Homo sapiens
ttggattatttaataacatt

SEQ ID NO: 5658724 - DNA, 21 bp, Homo sapiens
ttggattatttaataacatta

SEQ ID NO: 5658725 - DNA, 20 bp, Homo sapiens
ttggattcacagcctttgcg

SEQ ID NO: 5658726 - DNA, 23 bp, Homo sapiens
ttggattccatgctaagcaagct

SEQ ID NO: 5658727 - DNA, 22 bp, Homo sapiens
ttggattcctaaatattttcaa

SEQ ID NO: 5658728 - DNA, 14 bp, Homo sapiens
ttggattcctgcac

SEQ ID NO: 5658729 - DNA, 23 bp, Homo sapiens
ttggattctcttagctactgtat

SEQ ID NO: 5658730 - DNA, 17 bp, Homo sapiens
ttggattggacaaaatg

SEQ ID NO: 5658731 - DNA, 19 bp, Homo sapiens
ttggatttaaaagcctgct

SEQ ID NO: 5658732 - DNA, 21 bp, Homo sapiens
ttggatttaaaagcctgctca

SEQ ID NO: 5658733 - DNA, 20 bp, Homo sapiens
ttggatttacgactgaagaa

SEQ ID NO: 5658734 - DNA, 20 bp, Homo sapiens
ttggatttagagactgtaaa

SEQ ID NO: 5658735 - DNA, 12 bp, Homo sapiens
ttggatttccta

SEQ ID NO: 5658736 - DNA, 14 bp, Homo sapiens
ttggatttcctaat

SEQ ID NO: 5658737 - DNA, 19 bp, Homo sapiens
ttggatttgctcattgctg

SEQ ID NO: 5658738 - DNA, 18 bp, Homo sapiens
ttggatttgctgtgacta

SEQ ID NO: 5658739 - DNA, 19 bp, Homo sapiens
ttggatttggagagaaata

SEQ ID NO: 5658740 - DNA, 15 bp, Homo sapiens
ttggattttaaacaa

SEQ ID NO: 5658741 - DNA, 20 bp, Homo sapiens
ttggattttatgttgacatt

SEQ ID NO: 5658742 - DNA, 22 bp, Homo sapiens
ttggattttatgttgacatttg

SEQ ID NO: 5658743 - DNA, 18 bp, Homo sapiens
ttggatttttgtcttgtg

SEQ ID NO: 5658744 - DNA, 20 bp, Homo sapiens
ttggcaaaagccttgtgtat

SEQ ID NO: 5658745 - DNA, 22 bp, Homo sapiens
ttggcaaaatggggtttgggcc

SEQ ID NO: 5658746 - DNA, 12 bp, Homo sapiens
ttggcaaaatgt

SEQ ID NO: 5658747 - DNA, 12 bp, Homo sapiens
ttggcaaaggtc

SEQ ID NO: 5658748 - DNA, 20 bp, Homo sapiens
ttggcaaaggtccctgagct

SEQ ID NO: 5658749 - DNA, 16 bp, Homo sapiens
ttggcaaattcctagt

SEQ ID NO: 5658750 - DNA, 14 bp, Homo sapiens
ttggcaacagaagc

SEQ ID NO: 5658751 - DNA, 20 bp, Homo sapiens
ttggcaacaggacagagttc

SEQ ID NO: 5658752 - DNA, 17 bp, Homo sapiens
ttggcaagaacttgttt

SEQ ID NO: 5658753 - DNA, 21 bp, Homo sapiens
ttggcaagaacttgtttacaa

SEQ ID NO: 5658754 - DNA, 22 bp, Homo sapiens
ttggcaagaacttgtttacaac

SEQ ID NO: 5658755 - DNA, 20 bp, Homo sapiens
ttggcaagaagactgtattt

SEQ ID NO: 5658756 - DNA, 17 bp, Homo sapiens
ttggcaagatgtttctt

SEQ ID NO: 5658757 - DNA, 13 bp, Homo sapiens
ttggcaaggaaag

SEQ ID NO: 5658758 - DNA, 18 bp, Homo sapiens
ttggcaataaattttgaa

SEQ ID NO: 5658759 - DNA, 20 bp, Homo sapiens
ttggcaatagtttgcataga

SEQ ID NO: 5658760 - DNA, 17 bp, Homo sapiens
ttggcaatgccatcatc

SEQ ID NO: 5658761 - DNA, 14 bp, Homo sapiens
ttggcaatgctaat

SEQ ID NO: 5658762 - DNA, 20 bp, Homo sapiens
ttggcaattcttcttctcaa

SEQ ID NO: 5658763 - DNA, 19 bp, Homo sapiens
ttggcaatttcctggccct

SEQ ID NO: 5658764 - DNA, 18 bp, Homo sapiens
ttggcacaagctccctgg

SEQ ID NO: 5658765 - DNA, 11 bp, Homo sapiens
ttggcaccaaa

SEQ ID NO: 5658766 - DNA, 12 bp, Homo sapiens
ttggcaccaaag

SEQ ID NO: 5658767 - DNA, 23 bp, Homo sapiens
ttggcaccaaagatgcagccgcc

SEQ ID NO: 5658768 - DNA, 14 bp, Homo sapiens
ttggcaccaataaa

SEQ ID NO: 5658769 - DNA, 17 bp, Homo sapiens
ttggcaccagacaccca

SEQ ID NO: 5658770 - DNA, 20 bp, Homo sapiens
ttggcaccagacacccagga

SEQ ID NO: 5658771 - DNA, 17 bp, Homo sapiens
ttggcaccgaagcccag

SEQ ID NO: 5658772 - DNA, 19 bp, Homo sapiens
ttggcacctgcacactcca

SEQ ID NO: 5658773 - DNA, 23 bp, Homo sapiens
ttggcacctgcctagctcttggg

SEQ ID NO: 5658774 - DNA, 22 bp, Homo sapiens
ttggcactcacagacctggagc

SEQ ID NO: 5658775 - DNA, 23 bp, Homo sapiens
ttggcactcacagacctggagcc

SEQ ID NO: 5658776 - DNA, 14 bp, Homo sapiens
ttggcactctctgc

SEQ ID NO: 5658777 - DNA, 15 bp, Homo sapiens
ttggcactctctgcc

SEQ ID NO: 5658778 - DNA, 19 bp, Homo sapiens
ttggcactggatggacttg

SEQ ID NO: 5658779 - DNA, 19 bp, Homo sapiens
ttggcacttgccattccaa

SEQ ID NO: 5658780 - DNA, 16 bp, Homo sapiens
ttggcacttgtattta

SEQ ID NO: 5658781 - DNA, 23 bp, Homo sapiens
ttggcactttttcgtgtggatct

SEQ ID NO: 5658782 - DNA, 19 bp, Homo sapiens
ttggcagaactgctggggc

SEQ ID NO: 5658783 - DNA, 14 bp, Homo sapiens
ttggcagacagccg

SEQ ID NO: 5658784 - DNA, 12 bp, Homo sapiens
ttggcagagagg

SEQ ID NO: 5658785 - DNA, 13 bp, Homo sapiens
ttggcagatgcag

SEQ ID NO: 5658786 - DNA, 16 bp, Homo sapiens
ttggcagatgcagctc

SEQ ID NO: 5658787 - DNA, 21 bp, Homo sapiens
ttggcagattgttttttccta

SEQ ID NO: 5658788 - DNA, 15 bp, Homo sapiens
ttggcagcacagcta

SEQ ID NO: 5658789 - DNA, 21 bp, Homo sapiens
ttggcagcacccactcagcca

SEQ ID NO: 5658790 - DNA, 21 bp, Homo sapiens
ttggcagccagacttctggag

SEQ ID NO: 5658791 - DNA, 12 bp, Homo sapiens
ttggcagcccac

SEQ ID NO: 5658792 - DNA, 14 bp, Homo sapiens
ttggcagccttgtg

SEQ ID NO: 5658793 - DNA, 18 bp, Homo sapiens
ttggcagcgcctcgcccc

SEQ ID NO: 5658794 - DNA, 19 bp, Homo sapiens
ttggcagcgcctcgcccca

SEQ ID NO: 5658795 - DNA, 16 bp, Homo sapiens
ttggcagctctactct

SEQ ID NO: 5658796 - DNA, 12 bp, Homo sapiens
ttggcagctgac

SEQ ID NO: 5658797 - DNA, 17 bp, Homo sapiens
ttggcagctttttctgt

SEQ ID NO: 5658798 - DNA, 19 bp, Homo sapiens
ttggcaggcccactcccca

SEQ ID NO: 5658799 - DNA, 20 bp, Homo sapiens
ttggcaggcccactccccag

SEQ ID NO: 5658800 - DNA, 21 bp, Homo sapiens
ttggcaggcccactccccagc

SEQ ID NO: 5658801 - DNA, 20 bp, Homo sapiens
ttggcaggtgtgggctccca

SEQ ID NO: 5658802 - DNA, 23 bp, Homo sapiens
ttggcagtgagtgagcctggctc

SEQ ID NO: 5658803 - DNA, 19 bp, Homo sapiens
ttggcagtggactcagaaa

SEQ ID NO: 5658804 - DNA, 15 bp, Homo sapiens
ttggcagtttggtat

SEQ ID NO: 5658805 - DNA, 20 bp, Homo sapiens
ttggcataacataaatctgt

SEQ ID NO: 5658806 - DNA, 22 bp, Homo sapiens
ttggcataacataaatctgtga

SEQ ID NO: 5658807 - DNA, 17 bp, Homo sapiens
ttggcataatttgtctt

SEQ ID NO: 5658808 - DNA, 14 bp, Homo sapiens
ttggcatacaaaat

SEQ ID NO: 5658809 - DNA, 15 bp, Homo sapiens
ttggcatacaaaata

SEQ ID NO: 5658810 - DNA, 16 bp, Homo sapiens
ttggcatacaaaatat

SEQ ID NO: 5658811 - DNA, 16 bp, Homo sapiens
ttggcatagctctggg

SEQ ID NO: 5658812 - DNA, 15 bp, Homo sapiens
ttggcatcagctggc

SEQ ID NO: 5658813 - DNA, 22 bp, Homo sapiens
ttggcatcctggcattctcaaa

SEQ ID NO: 5658814 - DNA, 15 bp, Homo sapiens
ttggcatctgcaaag

SEQ ID NO: 5658815 - DNA, 21 bp, Homo sapiens
ttggcatggaaatttaaagca

SEQ ID NO: 5658816 - DNA, 22 bp, Homo sapiens
ttggcatggaaatttaaagcag

SEQ ID NO: 5658817 - DNA, 22 bp, Homo sapiens
ttggcatgggcgcaggcccagt

SEQ ID NO: 5658818 - DNA, 20 bp, Homo sapiens
ttggcatgtaaatgtaaact

SEQ ID NO: 5658819 - DNA, 18 bp, Homo sapiens
ttggcatgtctcctcaac

SEQ ID NO: 5658820 - DNA, 13 bp, Homo sapiens
ttggcatgtttaa

SEQ ID NO: 5658821 - DNA, 18 bp, Homo sapiens
ttggcatgtttaattgtg

SEQ ID NO: 5658822 - DNA, 14 bp, Homo sapiens
ttggcattcctcta

SEQ ID NO: 5658823 - DNA, 22 bp, Homo sapiens
ttggcattggaattctactgga

SEQ ID NO: 5658824 - DNA, 15 bp, Homo sapiens
ttggccaaacaagtg

SEQ ID NO: 5658825 - DNA, 15 bp, Homo sapiens
ttggccaagcagaaa

SEQ ID NO: 5658826 - DNA, 15 bp, Homo sapiens
ttggccaagcaggga

SEQ ID NO: 5658827 - DNA, 17 bp, Homo sapiens
ttggccaaggaaaggca

SEQ ID NO: 5658828 - DNA, 22 bp, Homo sapiens
ttggccacaagaataagcagca

SEQ ID NO: 5658829 - DNA, 23 bp, Homo sapiens
ttggccacaagaataagcagcaa

SEQ ID NO: 5658830 - DNA, 12 bp, Homo sapiens
ttggccacagac

SEQ ID NO: 5658831 - DNA, 22 bp, Homo sapiens
ttggccacctgtagccatctgc

SEQ ID NO: 5658832 - DNA, 18 bp, Homo sapiens
ttggccacggcctgggag

SEQ ID NO: 5658833 - DNA, 19 bp, Homo sapiens
ttggccacggcctgggagg

SEQ ID NO: 5658834 - DNA, 19 bp, Homo sapiens
ttggccactgggtctcact

SEQ ID NO: 5658835 - DNA, 22 bp, Homo sapiens
ttggccactttgcagacctggg

SEQ ID NO: 5658836 - DNA, 20 bp, Homo sapiens
ttggccagaagtcaaggctt

SEQ ID NO: 5658837 - DNA, 18 bp, Homo sapiens
ttggccagaccacagcag

SEQ ID NO: 5658838 - DNA, 21 bp, Homo sapiens
ttggccagagggcccctcact

SEQ ID NO: 5658839 - DNA, 16 bp, Homo sapiens
ttggccagcacgttct

SEQ ID NO: 5658840 - DNA, 22 bp, Homo sapiens
ttggccagccaactctgggaat

SEQ ID NO: 5658841 - DNA, 12 bp, Homo sapiens
ttggccaggagg

SEQ ID NO: 5658842 - DNA, 12 bp, Homo sapiens
ttggccaggcct

SEQ ID NO: 5658843 - DNA, 12 bp, Homo sapiens
ttggccagggag

SEQ ID NO: 5658844 - DNA, 13 bp, Homo sapiens
ttggccagggagg

SEQ ID NO: 5658845 - DNA, 18 bp, Homo sapiens
ttggccagggaggcgcag

SEQ ID NO: 5658846 - DNA, 20 bp, Homo sapiens
ttggccagggaggcgcaggg

SEQ ID NO: 5658847 - DNA, 16 bp, Homo sapiens
ttggccagtgacgtgg

SEQ ID NO: 5658848 - DNA, 13 bp, Homo sapiens
ttggccagtgaga

SEQ ID NO: 5658849 - DNA, 14 bp, Homo sapiens
ttggccatttatgc

SEQ ID NO: 5658850 - DNA, 17 bp, Homo sapiens
ttggccatttgctagtt

SEQ ID NO: 5658851 - DNA, 19 bp, Homo sapiens
ttggcccaagactgggctg

SEQ ID NO: 5658852 - DNA, 17 bp, Homo sapiens
ttggcccagagacggag

SEQ ID NO: 5658853 - DNA, 16 bp, Homo sapiens
ttggcccaggagctct

SEQ ID NO: 5658854 - DNA, 13 bp, Homo sapiens
ttggcccaggagt

SEQ ID NO: 5658855 - DNA, 21 bp, Homo sapiens
ttggcccagggggcttcctga

SEQ ID NO: 5658856 - DNA, 14 bp, Homo sapiens
ttggccccagagga

SEQ ID NO: 5658857 - DNA, 15 bp, Homo sapiens
ttggcccccgagctg

SEQ ID NO: 5658858 - DNA, 16 bp, Homo sapiens
ttggcccccgagctgg

SEQ ID NO: 5658859 - DNA, 17 bp, Homo sapiens
ttggcccccttcaggag

SEQ ID NO: 5658860 - DNA, 21 bp, Homo sapiens
ttggcccccttcaggagcctg

SEQ ID NO: 5658861 - DNA, 22 bp, Homo sapiens
ttggcccctcacatcctctcca

SEQ ID NO: 5658862 - DNA, 13 bp, Homo sapiens
ttggcccctccct

SEQ ID NO: 5658863 - DNA, 18 bp, Homo sapiens
ttggcccctgcccggctg

SEQ ID NO: 5658864 - DNA, 14 bp, Homo sapiens
ttggcccctgtgtg

SEQ ID NO: 5658865 - DNA, 22 bp, Homo sapiens
ttggcccctgtgtgagttgagt

SEQ ID NO: 5658866 - DNA, 15 bp, Homo sapiens
ttggccctcctcagc

SEQ ID NO: 5658867 - DNA, 21 bp, Homo sapiens
ttggccctcctcagctccctg

SEQ ID NO: 5658868 - DNA, 12 bp, Homo sapiens
ttggtcctcttg

SEQ ID NO: 5658869 - DNA, 17 bp, Homo sapiens
ttggtcctggtgctgcc

SEQ ID NO: 5658870 - DNA, 17 bp, Homo sapiens
ttggtcctgtccccgca

SEQ ID NO: 5658871 - DNA, 19 bp, Homo sapiens
ttggtcctgttaaccctcc

SEQ ID NO: 5658872 - DNA, 14 bp, Homo sapiens
ttggtcgagtcttt

SEQ ID NO: 5658873 - DNA, 18 bp, Homo sapiens
ttggtcgagtctttgtgt

SEQ ID NO: 5658874 - DNA, 23 bp, Homo sapiens
ttggtcgagtctttgtgtgttat

SEQ ID NO: 5658875 - DNA, 13 bp, Homo sapiens
ttggtcgtttttt

SEQ ID NO: 5658876 - DNA, 17 bp, Homo sapiens
ttggtctaatttattca

SEQ ID NO: 5658877 - DNA, 17 bp, Homo sapiens
ttggtctcaggcagcac

SEQ ID NO: 5658878 - DNA, 21 bp, Homo sapiens
ttggtctcaggcagcaccaca

SEQ ID NO: 5658879 - DNA, 13 bp, Homo sapiens
ttggtctcatgcc

SEQ ID NO: 5658880 - DNA, 17 bp, Homo sapiens
ttggtctcatgccccgc

SEQ ID NO: 5658881 - DNA, 17 bp, Homo sapiens
ttggtctccatttttcc

SEQ ID NO: 5658882 - DNA, 22 bp, Homo sapiens
ttggtctcccttctctacactc

SEQ ID NO: 5658883 - DNA, 16 bp, Homo sapiens
ttggtctctttctttc

SEQ ID NO: 5658884 - DNA, 15 bp, Homo sapiens
ttggtctgccttctg

SEQ ID NO: 5658885 - DNA, 20 bp, Homo sapiens
ttggtctgccttctgctgaa

SEQ ID NO: 5658886 - DNA, 15 bp, Homo sapiens
ttggtctgctggtgt

SEQ ID NO: 5658887 - DNA, 19 bp, Homo sapiens
ttggtctgggtggatgtga

SEQ ID NO: 5658888 - DNA, 22 bp, Homo sapiens
ttggtctgggtggatgtgagca

SEQ ID NO: 5658889 - DNA, 15 bp, Homo sapiens
ttggtctgtgttcaa

SEQ ID NO: 5658890 - DNA, 23 bp, Homo sapiens
ttggtctgttttggtcccctccc

SEQ ID NO: 5658891 - DNA, 17 bp, Homo sapiens
ttggtcttactttgtgc

SEQ ID NO: 5658892 - DNA, 22 bp, Homo sapiens
ttggtcttactttgttaattta

SEQ ID NO: 5658893 - DNA, 17 bp, Homo sapiens
ttggtcttagctttaca

SEQ ID NO: 5658894 - DNA, 15 bp, Homo sapiens
ttggtcttatttatt

SEQ ID NO: 5658895 - DNA, 19 bp, Homo sapiens
ttggtcttatttattattg

SEQ ID NO: 5658896 - DNA, 17 bp, Homo sapiens
ttggtcttcagcctccc

SEQ ID NO: 5658897 - DNA, 19 bp, Homo sapiens
ttggtcttcagcctccctc

SEQ ID NO: 5658898 - DNA, 18 bp, Homo sapiens
ttggtcttgccccatcac

SEQ ID NO: 5658899 - DNA, 14 bp, Homo sapiens
ttggtctttcattg

SEQ ID NO: 5658900 - DNA, 21 bp, Homo sapiens
ttggtctttctaatgtagcta

SEQ ID NO: 5658901 - DNA, 21 bp, Homo sapiens
ttggtgaaataataaaatgca

SEQ ID NO: 5658902 - DNA, 23 bp, Homo sapiens
ttggtgaaataataaaatgcaaa

SEQ ID NO: 5658903 - DNA, 18 bp, Homo sapiens
ttggtgaacacacacgct

SEQ ID NO: 5658904 - DNA, 15 bp, Homo sapiens
ttggtgaacagtttt

SEQ ID NO: 5658905 - DNA, 21 bp, Homo sapiens
ttggtgaacattgcaatagaa

SEQ ID NO: 5658906 - DNA, 13 bp, Homo sapiens
ttggtgaattcct

SEQ ID NO: 5658907 - DNA, 17 bp, Homo sapiens
ttggtgaatttcacaag

SEQ ID NO: 5658908 - DNA, 21 bp, Homo sapiens
ttggtgacaaaattcatttgc

SEQ ID NO: 5658909 - DNA, 19 bp, Homo sapiens
ttggtgacagtttccagat

SEQ ID NO: 5658910 - DNA, 21 bp, Homo sapiens
ttggtgaccccatacatttgt

SEQ ID NO: 5658911 - DNA, 11 bp, Homo sapiens
ttggtgactca

SEQ ID NO: 5658912 - DNA, 14 bp, Homo sapiens
ttggtgactgtccc

SEQ ID NO: 5658913 - DNA, 17 bp, Homo sapiens
ttggtgacttgtctgcc

SEQ ID NO: 5658914 - DNA, 23 bp, Homo sapiens
ttggtgacttgtctgcctcctgc

SEQ ID NO: 5658915 - DNA, 16 bp, Homo sapiens
ttggtgagaaacctgt

SEQ ID NO: 5658916 - DNA, 12 bp, Homo sapiens
ttggtgaggacc

SEQ ID NO: 5658917 - DNA, 17 bp, Homo sapiens
ttggtgaggaggaggca

SEQ ID NO: 5658918 - DNA, 17 bp, Homo sapiens
ttggtgataagtggaaa

SEQ ID NO: 5658919 - DNA, 23 bp, Homo sapiens
ttggtgataagtggaaaaaagag

SEQ ID NO: 5658920 - DNA, 16 bp, Homo sapiens
ttggtgcaacccttac

SEQ ID NO: 5658921 - DNA, 17 bp, Homo sapiens
ttggtgcatctagaaag

SEQ ID NO: 5658922 - DNA, 15 bp, Homo sapiens
ttggtgcattgttat

SEQ ID NO: 5658923 - DNA, 13 bp, Homo sapiens
ttggtgccaccaa

SEQ ID NO: 5658924 - DNA, 20 bp, Homo sapiens
ttggtgccaccaaaagtgct

SEQ ID NO: 5658925 - DNA, 16 bp, Homo sapiens
ttggtgccggtcacac

SEQ ID NO: 5658926 - DNA, 22 bp, Homo sapiens
ttggtgccggtcacactctaca

SEQ ID NO: 5658927 - DNA, 14 bp, Homo sapiens
ttggtgcctttcct

SEQ ID NO: 5658928 - DNA, 18 bp, Homo sapiens
ttggtgcctttcctgttc

SEQ ID NO: 5658929 - DNA, 16 bp, Homo sapiens
ttggtgcggggtacac

SEQ ID NO: 5658930 - DNA, 19 bp, Homo sapiens
ttggtgctcatttaaatat

SEQ ID NO: 5658931 - DNA, 14 bp, Homo sapiens
ttggtgctgctcat

SEQ ID NO: 5658932 - DNA, 14 bp, Homo sapiens
ttggtgctgggaac

SEQ ID NO: 5658933 - DNA, 14 bp, Homo sapiens
ttggtgctgtgtgc

SEQ ID NO: 5658934 - DNA, 18 bp, Homo sapiens
ttggtgctgttgaaaata

SEQ ID NO: 5658935 - DNA, 22 bp, Homo sapiens
ttggtgcttacacatctcagac

SEQ ID NO: 5658936 - DNA, 13 bp, Homo sapiens
ttggtgctttgca

SEQ ID NO: 5658937 - DNA, 17 bp, Homo sapiens
ttggtgctttttataaa

SEQ ID NO: 5658938 - DNA, 20 bp, Homo sapiens
ttggtggagagtggaaggac

SEQ ID NO: 5658939 - DNA, 20 bp, Homo sapiens
ttggtggagcagccagagct

SEQ ID NO: 5658940 - DNA, 16 bp, Homo sapiens
ttggtggatgtaaata

SEQ ID NO: 5658941 - DNA, 13 bp, Homo sapiens
ttggtggatgtga

SEQ ID NO: 5658942 - DNA, 21 bp, Homo sapiens
ttggtggccaagcctggccct

SEQ ID NO: 5658943 - DNA, 14 bp, Homo sapiens
ttggtggccacata

SEQ ID NO: 5658944 - DNA, 13 bp, Homo sapiens
ttggtggccaggg

SEQ ID NO: 5658945 - DNA, 18 bp, Homo sapiens
ttggtggccgggggtggg

SEQ ID NO: 5658946 - DNA, 20 bp, Homo sapiens
ttggtggcctaatttacaag

SEQ ID NO: 5658947 - DNA, 20 bp, Homo sapiens
ttggtggctgttcctgaagg

SEQ ID NO: 5658948 - DNA, 15 bp, Homo sapiens
ttggtggcttatggg

SEQ ID NO: 5658949 - DNA, 20 bp, Homo sapiens
ttggtgggaagcaagcaggg

SEQ ID NO: 5658950 - DNA, 21 bp, Homo sapiens
ttggtgggcgtgcccctgaag

SEQ ID NO: 5658951 - DNA, 21 bp, Homo sapiens
ttggtgggctgatttacatgt

SEQ ID NO: 5658952 - DNA, 17 bp, Homo sapiens
ttggtgggctggcccag

SEQ ID NO: 5658953 - DNA, 18 bp, Homo sapiens
ttggtgggctggcccagc

SEQ ID NO: 5658954 - DNA, 13 bp, Homo sapiens
ttggtggggccag

SEQ ID NO: 5658955 - DNA, 17 bp, Homo sapiens
ttggtggggccaggcca

SEQ ID NO: 5658956 - DNA, 18 bp, Homo sapiens
ttggtgggggagcctctg

SEQ ID NO: 5658957 - DNA, 19 bp, Homo sapiens
ttggtgggggagcctctgg

SEQ ID NO: 5658958 - DNA, 20 bp, Homo sapiens
ttggtgggggagcctctgga

SEQ ID NO: 5658959 - DNA, 22 bp, Homo sapiens
ttggtgggggagcctctggaat

SEQ ID NO: 5658960 - DNA, 19 bp, Homo sapiens
ttggtggggtggcacctgt

SEQ ID NO: 5658961 - DNA, 21 bp, Homo sapiens
ttggtgggtctatgttcccca

SEQ ID NO: 5658962 - DNA, 18 bp, Homo sapiens
ttggtgggtgaaaggaat

SEQ ID NO: 5658963 - DNA, 13 bp, Homo sapiens
ttggtggtacttt

SEQ ID NO: 5658964 - DNA, 23 bp, Homo sapiens
ttggtggtctcttcacacggacg

SEQ ID NO: 5658965 - DNA, 16 bp, Homo sapiens
ttggtggtgaaattga

SEQ ID NO: 5658966 - DNA, 21 bp, Homo sapiens
ttggtggtgcagccccaggac

SEQ ID NO: 5658967 - DNA, 18 bp, Homo sapiens
ttggtggtttcagaaatg

SEQ ID NO: 5658968 - DNA, 19 bp, Homo sapiens
ttggtggtttcagaaatgt

SEQ ID NO: 5658969 - DNA, 20 bp, Homo sapiens
ttggtgtaatttgaagattg

SEQ ID NO: 5658970 - DNA, 14 bp, Homo sapiens
ttggtgtacagact

SEQ ID NO: 5658971 - DNA, 12 bp, Homo sapiens
ttggtgtactgg

SEQ ID NO: 5658972 - DNA, 18 bp, Homo sapiens
ttggtgtaggtaaatcta

SEQ ID NO: 5658973 - DNA, 19 bp, Homo sapiens
ttggtgtgattgcacagaa

SEQ ID NO: 5658974 - DNA, 17 bp, Homo sapiens
ttggtgtggagttttca

SEQ ID NO: 5658975 - DNA, 20 bp, Homo sapiens
ttggtgtggagttttcatga

SEQ ID NO: 5658976 - DNA, 21 bp, Homo sapiens
ttggtgtggctgtattcagat

SEQ ID NO: 5658977 - DNA, 13 bp, Homo sapiens
ttggtgtgtccca

SEQ ID NO: 5658978 - DNA, 12 bp, Homo sapiens
ttggtgtgttcg

SEQ ID NO: 5658979 - DNA, 14 bp, Homo sapiens
ttggtgttaaaaca

SEQ ID NO: 5658980 - DNA, 16 bp, Homo sapiens
ttggtgttaattgaaa

SEQ ID NO: 5658981 - DNA, 21 bp, Homo sapiens
ttggtgttacacagcccaaga

SEQ ID NO: 5658982 - DNA, 14 bp, Homo sapiens
ttggtgttcctgga

SEQ ID NO: 5658983 - DNA, 21 bp, Homo sapiens
ttggtgttcgtttccatcatg

SEQ ID NO: 5658984 - DNA, 24 bp, Homo sapiens
ttggtgttctggcctctggcctgg

SEQ ID NO: 5658985 - DNA, 18 bp, Homo sapiens
ttggtgttgcagccgcag

SEQ ID NO: 5658986 - DNA, 21 bp, Homo sapiens
ttggtgtttgagtgttcatca

SEQ ID NO: 5658987 - DNA, 12 bp, Homo sapiens
ttggtgtttttt

SEQ ID NO: 5658988 - DNA, 12 bp, Homo sapiens
ttggttaaaaat

SEQ ID NO: 5658989 - DNA, 16 bp, Homo sapiens
ttggttaaaatgtgat

SEQ ID NO: 5658990 - DNA, 15 bp, Homo sapiens
ttggttaaataaact

SEQ ID NO: 5658991 - DNA, 20 bp, Homo sapiens
ttggttaagctttgacactg

SEQ ID NO: 5658992 - DNA, 16 bp, Homo sapiens
ttggttaagtctgttt

SEQ ID NO: 5658993 - DNA, 15 bp, Homo sapiens
ttggttaatgaaaaa

SEQ ID NO: 5658994 - DNA, 15 bp, Homo sapiens
ttggttacaaatttt

SEQ ID NO: 5658995 - DNA, 15 bp, Homo sapiens
ttggttagtgcatgt

SEQ ID NO: 5658996 - DNA, 23 bp, Homo sapiens
ttggttatagtgcaatatatttt

SEQ ID NO: 5658997 - DNA, 17 bp, Homo sapiens
ttggttatgaaacatgt

SEQ ID NO: 5658998 - DNA, 21 bp, Homo sapiens
ttggttatgatggaaaggaag

SEQ ID NO: 5658999 - DNA, 19 bp, Homo sapiens
ttggttattctaagccctt

SEQ ID NO: 5659000 - DNA, 13 bp, Homo sapiens
ttggttcaaatgt

SEQ ID NO: 5659001 - DNA, 20 bp, Homo sapiens
ttggttcacctgtgactcct

SEQ ID NO: 5659002 - DNA, 17 bp, Homo sapiens
ttggttcatcagtgtta

SEQ ID NO: 5659003 - DNA, 17 bp, Homo sapiens
ttggttcatgcctgggg

SEQ ID NO: 5659004 - DNA, 20 bp, Homo sapiens
ttggttcattaattctataa

SEQ ID NO: 5659005 - DNA, 22 bp, Homo sapiens
ttggttccaagtctttgctatt

SEQ ID NO: 5659006 - DNA, 23 bp, Homo sapiens
ttggttccacaatcatctattga

SEQ ID NO: 5659007 - DNA, 12 bp, Homo sapiens
ttggttcccaga

SEQ ID NO: 5659008 - DNA, 13 bp, Homo sapiens
ttggttcccagaa

SEQ ID NO: 5659009 - DNA, 18 bp, Homo sapiens
ttggttcccccactgatc

SEQ ID NO: 5659010 - DNA, 16 bp, Homo sapiens
ttggttccctttgctc

SEQ ID NO: 5659011 - DNA, 15 bp, Homo sapiens
ttggttcctcatggc

SEQ ID NO: 5659012 - DNA, 15 bp, Homo sapiens
ttggttcctccagca

SEQ ID NO: 5659013 - DNA, 14 bp, Homo sapiens
ttggttcctctctg

SEQ ID NO: 5659014 - DNA, 10 bp, Homo sapiens
ttggttcctg

SEQ ID NO: 5659015 - DNA, 14 bp, Homo sapiens
ttggttcctgggat

SEQ ID NO: 5659016 - DNA, 14 bp, Homo sapiens
ttggttccttctct

SEQ ID NO: 5659017 - DNA, 12 bp, Homo sapiens
ttggttcctttt

SEQ ID NO: 5659018 - DNA, 20 bp, Homo sapiens
ttggttctaaaggtaccaaa

SEQ ID NO: 5659019 - DNA, 18 bp, Homo sapiens
ttggttctaaggacctga

SEQ ID NO: 5659020 - DNA, 17 bp, Homo sapiens
ttggttctatgctaaac

SEQ ID NO: 5659021 - DNA, 14 bp, Homo sapiens
ttggttctggggcc

SEQ ID NO: 5659022 - DNA, 17 bp, Homo sapiens
ttggttcttgacagtga

SEQ ID NO: 5659023 - DNA, 17 bp, Homo sapiens
ttggttcttgtactcta

SEQ ID NO: 5659024 - DNA, 14 bp, Homo sapiens
ttggttgaattttt

SEQ ID NO: 5659025 - DNA, 14 bp, Homo sapiens
ttggttgcaattgt

SEQ ID NO: 5659026 - DNA, 17 bp, Homo sapiens
ttggttgggggctcctg

SEQ ID NO: 5659027 - DNA, 18 bp, Homo sapiens
ttggttggggtggggcag

SEQ ID NO: 5659028 - DNA, 15 bp, Homo sapiens
ttggttggtgtgaag

SEQ ID NO: 5659029 - DNA, 15 bp, Homo sapiens
ttggttgtatataaa

SEQ ID NO: 5659030 - DNA, 16 bp, Homo sapiens
ttggttgtattctttg

SEQ ID NO: 5659031 - DNA, 12 bp, Homo sapiens
ttggttgtcaat

SEQ ID NO: 5659032 - DNA, 17 bp, Homo sapiens
ttggtttaaaaagaaaa

SEQ ID NO: 5659033 - DNA, 17 bp, Homo sapiens
ttggtttaaagaaagtg

SEQ ID NO: 5659034 - DNA, 23 bp, Homo sapiens
ttggtttaaagaaagtgtatttg

SEQ ID NO: 5659035 - DNA, 12 bp, Homo sapiens
ttggtttaatat

SEQ ID NO: 5659036 - DNA, 16 bp, Homo sapiens
ttggtttaatttaaag

SEQ ID NO: 5659037 - DNA, 21 bp, Homo sapiens
ttggtttacatttaaagcatt

SEQ ID NO: 5659038 - DNA, 15 bp, Homo sapiens
ttggtttatactgta

SEQ ID NO: 5659039 - DNA, 14 bp, Homo sapiens
ttggtttattttca

SEQ ID NO: 5659040 - DNA, 16 bp, Homo sapiens
ttggtttcccctgcac

SEQ ID NO: 5659041 - DNA, 16 bp, Homo sapiens
ttggtttctgtttgaa

SEQ ID NO: 5659042 - DNA, 16 bp, Homo sapiens
ttggtttgagaaaggc

SEQ ID NO: 5659043 - DNA, 23 bp, Homo sapiens
ttggtttgccttttatgtaaatt

SEQ ID NO: 5659044 - DNA, 19 bp, Homo sapiens
ttggtttgctagtatcttg

SEQ ID NO: 5659045 - DNA, 20 bp, Homo sapiens
ttggtttggccatctctgga

SEQ ID NO: 5659046 - DNA, 22 bp, Homo sapiens
ttgtatgttaatagaaaatata

SEQ ID NO: 5659047 - DNA, 15 bp, Homo sapiens
ttgtatgttatgaac

SEQ ID NO: 5659048 - DNA, 17 bp, Homo sapiens
ttgtatgttatgaacat

SEQ ID NO: 5659049 - DNA, 19 bp, Homo sapiens
ttgtatgttttattgtaat

SEQ ID NO: 5659050 - DNA, 16 bp, Homo sapiens
ttgtattaaactcttc

SEQ ID NO: 5659051 - DNA, 14 bp, Homo sapiens
ttgtattaacaaaa

SEQ ID NO: 5659052 - DNA, 13 bp, Homo sapiens
ttgtattaactgg

SEQ ID NO: 5659053 - DNA, 18 bp, Homo sapiens
ttgtattaagaatgaaat

SEQ ID NO: 5659054 - DNA, 12 bp, Homo sapiens
ttgtattaataa

SEQ ID NO: 5659055 - DNA, 13 bp, Homo sapiens
ttgtattacagat

SEQ ID NO: 5659056 - DNA, 19 bp, Homo sapiens
ttgtattactttctctgta

SEQ ID NO: 5659057 - DNA, 16 bp, Homo sapiens
ttgtattagatgttct

SEQ ID NO: 5659058 - DNA, 21 bp, Homo sapiens
ttgtattagcccgttttcaca

SEQ ID NO: 5659059 - DNA, 14 bp, Homo sapiens
ttgtattaggaaaa

SEQ ID NO: 5659060 - DNA, 15 bp, Homo sapiens
ttgtattaggaaaat

SEQ ID NO: 5659061 - DNA, 15 bp, Homo sapiens
ttgtattatcaatga

SEQ ID NO: 5659062 - DNA, 15 bp, Homo sapiens
ttgtattatcagtga

SEQ ID NO: 5659063 - DNA, 23 bp, Homo sapiens
ttgtattatcagtgaatataaat

SEQ ID NO: 5659064 - DNA, 22 bp, Homo sapiens
ttgtattattacaaatattgtc

SEQ ID NO: 5659065 - DNA, 13 bp, Homo sapiens
ttgtattcaatta

SEQ ID NO: 5659066 - DNA, 18 bp, Homo sapiens
ttgtattcaattaaagaa

SEQ ID NO: 5659067 - DNA, 21 bp, Homo sapiens
ttgtattcaattaaagaaata

SEQ ID NO: 5659068 - DNA, 17 bp, Homo sapiens
ttgtattcatgttcatg

SEQ ID NO: 5659069 - DNA, 13 bp, Homo sapiens
ttgtattccctta

SEQ ID NO: 5659070 - DNA, 16 bp, Homo sapiens
ttgtattcctaactgt

SEQ ID NO: 5659071 - DNA, 15 bp, Homo sapiens
ttgtattctctcctg

SEQ ID NO: 5659072 - DNA, 22 bp, Homo sapiens
ttgtattctctgagctgtgcag

SEQ ID NO: 5659073 - DNA, 23 bp, Homo sapiens
ttgtattctctgcaattttactg

SEQ ID NO: 5659074 - DNA, 14 bp, Homo sapiens
ttgtattctgtctt

SEQ ID NO: 5659075 - DNA, 18 bp, Homo sapiens
ttgtattcttcatgaaat

SEQ ID NO: 5659076 - DNA, 13 bp, Homo sapiens
ttgtattctttga

SEQ ID NO: 5659077 - DNA, 18 bp, Homo sapiens
ttgtattgaagttaactg

SEQ ID NO: 5659078 - DNA, 16 bp, Homo sapiens
ttgtattgactttatg

SEQ ID NO: 5659079 - DNA, 19 bp, Homo sapiens
ttgtattgatttttaagaa

SEQ ID NO: 5659080 - DNA, 12 bp, Homo sapiens
ttgtattgccat

SEQ ID NO: 5659081 - DNA, 16 bp, Homo sapiens
ttgtattgctgctgtg

SEQ ID NO: 5659082 - DNA, 17 bp, Homo sapiens
ttgtattgctgctgtgc

SEQ ID NO: 5659083 - DNA, 15 bp, Homo sapiens
ttgtattgcttcctg

SEQ ID NO: 5659084 - DNA, 19 bp, Homo sapiens
ttgtattgtaaaaaattca

SEQ ID NO: 5659085 - DNA, 14 bp, Homo sapiens
ttgtattgtggtat

SEQ ID NO: 5659086 - DNA, 18 bp, Homo sapiens
ttgtattgttagatgttt

SEQ ID NO: 5659087 - DNA, 19 bp, Homo sapiens
ttgtattgtttctacaata

SEQ ID NO: 5659088 - DNA, 17 bp, Homo sapiens
ttgtatttaacagaaat

SEQ ID NO: 5659089 - DNA, 16 bp, Homo sapiens
ttgtatttaagacata

SEQ ID NO: 5659090 - DNA, 17 bp, Homo sapiens
ttgtatttaagacataa

SEQ ID NO: 5659091 - DNA, 15 bp, Homo sapiens
ttgtatttaaggatt

SEQ ID NO: 5659092 - DNA, 18 bp, Homo sapiens
ttgtatttattaatttga

SEQ ID NO: 5659093 - DNA, 14 bp, Homo sapiens
ttgtatttattcaa

SEQ ID NO: 5659094 - DNA, 18 bp, Homo sapiens
ttgtatttattccatatt

SEQ ID NO: 5659095 - DNA, 15 bp, Homo sapiens
ttgtatttatttagt

SEQ ID NO: 5659096 - DNA, 17 bp, Homo sapiens
ttgtatttctatacagt

SEQ ID NO: 5659097 - DNA, 16 bp, Homo sapiens
ttgtatttcttttata

SEQ ID NO: 5659098 - DNA, 20 bp, Homo sapiens
ttgtatttcttttatatata

SEQ ID NO: 5659099 - DNA, 14 bp, Homo sapiens
ttgtatttgtattc

SEQ ID NO: 5659100 - DNA, 15 bp, Homo sapiens
ttgtatttgtattct

SEQ ID NO: 5659101 - DNA, 14 bp, Homo sapiens
ttgtatttgtgact

SEQ ID NO: 5659102 - DNA, 16 bp, Homo sapiens
ttgtatttgtgacttt

SEQ ID NO: 5659103 - DNA, 16 bp, Homo sapiens
ttgtattttaaatgtt

SEQ ID NO: 5659104 - DNA, 14 bp, Homo sapiens
ttgtattttaagat

SEQ ID NO: 5659105 - DNA, 14 bp, Homo sapiens
ttgtattttagtat

SEQ ID NO: 5659106 - DNA, 12 bp, Homo sapiens
ttgtattttcca

SEQ ID NO: 5659107 - DNA, 23 bp, Homo sapiens
ttgtattttccaagtgtgcatat

SEQ ID NO: 5659108 - DNA, 13 bp, Homo sapiens
ttgtattttccat

SEQ ID NO: 5659109 - DNA, 15 bp, Homo sapiens
ttgtattttgacaaa

SEQ ID NO: 5659110 - DNA, 18 bp, Homo sapiens
ttgtattttgacaaaaat

SEQ ID NO: 5659111 - DNA, 13 bp, Homo sapiens
ttgtattttgtac

SEQ ID NO: 5659112 - DNA, 16 bp, Homo sapiens
ttgtattttgttaaag

SEQ ID NO: 5659113 - DNA, 18 bp, Homo sapiens
ttgtattttgttaaagct

SEQ ID NO: 5659114 - DNA, 20 bp, Homo sapiens
ttgtatttttagtagagatg

SEQ ID NO: 5659115 - DNA, 17 bp, Homo sapiens
ttgtatttttgaataaa

SEQ ID NO: 5659116 - DNA, 19 bp, Homo sapiens
ttgtatttttgttgttggg

SEQ ID NO: 5659117 - DNA, 19 bp, Homo sapiens
ttgtattttttatttacat

SEQ ID NO: 5659118 - DNA, 20 bp, Homo sapiens
ttgtattttttatttacatt

SEQ ID NO: 5659119 - DNA, 14 bp, Homo sapiens
ttgtattttttcct

SEQ ID NO: 5659120 - DNA, 15 bp, Homo sapiens
ttgtattttttcctt

SEQ ID NO: 5659121 - DNA, 17 bp, Homo sapiens
ttgtattttttccttaa

SEQ ID NO: 5659122 - DNA, 21 bp, Homo sapiens
ttgtattttttgttgaaagta

SEQ ID NO: 5659123 - DNA, 22 bp, Homo sapiens
ttgtatttttttccaagtgtat

SEQ ID NO: 5659124 - DNA, 23 bp, Homo sapiens
ttgtatttttttccaagtgtata

SEQ ID NO: 5659125 - DNA, 22 bp, Homo sapiens
ttgtatttttttgcaagtgaag

SEQ ID NO: 5659126 - DNA, 13 bp, Homo sapiens
ttgtcaaatacag

SEQ ID NO: 5659127 - DNA, 23 bp, Homo sapiens
ttgtcaaatggtattttttgtga

SEQ ID NO: 5659128 - DNA, 13 bp, Homo sapiens
ttgtcaaatgtca

SEQ ID NO: 5659129 - DNA, 21 bp, Homo sapiens
ttgtcaacaaagtgctttttc

SEQ ID NO: 5659130 - DNA, 17 bp, Homo sapiens
ttgtcaacacaaagaca

SEQ ID NO: 5659131 - DNA, 22 bp, Homo sapiens
ttgtcaacactatataaataag

SEQ ID NO: 5659132 - DNA, 14 bp, Homo sapiens
ttgtcaacttcagt

SEQ ID NO: 5659133 - DNA, 22 bp, Homo sapiens
ttgtcaagaatagcattgtaaa

SEQ ID NO: 5659134 - DNA, 17 bp, Homo sapiens
ttgtcaagacagtgtca

SEQ ID NO: 5659135 - DNA, 21 bp, Homo sapiens
ttgtcaaggaagaagaaatct

SEQ ID NO: 5659136 - DNA, 23 bp, Homo sapiens
ttgtcaaggaatgttatcagtat

SEQ ID NO: 5659137 - DNA, 23 bp, Homo sapiens
ttgtcaaggatggttttgggact

SEQ ID NO: 5659138 - DNA, 21 bp, Homo sapiens
ttgtcaataaaaataaatcta

SEQ ID NO: 5659139 - DNA, 23 bp, Homo sapiens
ttgtcaataaatggcccggacat

SEQ ID NO: 5659140 - DNA, 11 bp, Homo sapiens
ttgtcaatact

SEQ ID NO: 5659141 - DNA, 19 bp, Homo sapiens
ttgtcaatattaaatacag

SEQ ID NO: 5659142 - DNA, 19 bp, Homo sapiens
ttgtcaatatttaaacatg

SEQ ID NO: 5659143 - DNA, 18 bp, Homo sapiens
ttgtcaatgctctaacaa

SEQ ID NO: 5659144 - DNA, 20 bp, Homo sapiens
ttgtcaatgctggagaaaaa

SEQ ID NO: 5659145 - DNA, 22 bp, Homo sapiens
ttgtcaatttttaaaacttttt

SEQ ID NO: 5659146 - DNA, 16 bp, Homo sapiens
ttgtcacaacaattaa

SEQ ID NO: 5659147 - DNA, 16 bp, Homo sapiens
ttgtcacaacactgaa

SEQ ID NO: 5659148 - DNA, 14 bp, Homo sapiens
ttgtcacaataaat

SEQ ID NO: 5659149 - DNA, 22 bp, Homo sapiens
ttgtcacacagtagctccaaca

SEQ ID NO: 5659150 - DNA, 18 bp, Homo sapiens
ttgtcacagtcttgtgaa

SEQ ID NO: 5659151 - DNA, 19 bp, Homo sapiens
ttgtcacagtcttgtgaac

SEQ ID NO: 5659152 - DNA, 16 bp, Homo sapiens
ttgtcaccagatctga

SEQ ID NO: 5659153 - DNA, 23 bp, Homo sapiens
ttgtcaccagttaaaagcatttt

SEQ ID NO: 5659154 - DNA, 17 bp, Homo sapiens
ttgtcaccattggacag

SEQ ID NO: 5659155 - DNA, 17 bp, Homo sapiens
ttgtcacccaggctgga

SEQ ID NO: 5659156 - DNA, 21 bp, Homo sapiens
ttgtcacctctgttaaggttg

SEQ ID NO: 5659157 - DNA, 19 bp, Homo sapiens
ttgtcacgcttcttctttt

SEQ ID NO: 5659158 - DNA, 15 bp, Homo sapiens
ttgtcactagcagct

SEQ ID NO: 5659159 - DNA, 17 bp, Homo sapiens
ttgtcactagcagctgc

SEQ ID NO: 5659160 - DNA, 18 bp, Homo sapiens
ttgtcactagcagctgca

SEQ ID NO: 5659161 - DNA, 22 bp, Homo sapiens
ttgtcactcaacaaaagtgctt

SEQ ID NO: 5659162 - DNA, 16 bp, Homo sapiens
ttgtcactcggctttg

SEQ ID NO: 5659163 - DNA, 19 bp, Homo sapiens
ttgtcactgacacaaagga

SEQ ID NO: 5659164 - DNA, 22 bp, Homo sapiens
ttgtcactgacacaaaggaagt

SEQ ID NO: 5659165 - DNA, 14 bp, Homo sapiens
ttgtcactgcttca

SEQ ID NO: 5659166 - DNA, 22 bp, Homo sapiens
ttgtcactggaacctccctggg

SEQ ID NO: 5659167 - DNA, 16 bp, Homo sapiens
ttgtcacttctgctgt

SEQ ID NO: 5659168 - DNA, 14 bp, Homo sapiens
ttgtcacttgcatg

SEQ ID NO: 5659169 - DNA, 15 bp, Homo sapiens
ttgtcacttgcatgt

SEQ ID NO: 5659170 - DNA, 16 bp, Homo sapiens
ttgtcacttgcatgtc

SEQ ID NO: 5659171 - DNA, 14 bp, Homo sapiens
ttgtcacttgccac

SEQ ID NO: 5659172 - DNA, 23 bp, Homo sapiens
ttgtcacttttccttttcttaaa

SEQ ID NO: 5659173 - DNA, 16 bp, Homo sapiens
ttgtcactttttctga

SEQ ID NO: 5659174 - DNA, 19 bp, Homo sapiens
ttgtcagacataaagccat

SEQ ID NO: 5659175 - DNA, 13 bp, Homo sapiens
ttgtcagcatctg

SEQ ID NO: 5659176 - DNA, 21 bp, Homo sapiens
ttgtcagcatctgaccatctg

SEQ ID NO: 5659177 - DNA, 22 bp, Homo sapiens
ttgtcagcatctgaccatctgt

SEQ ID NO: 5659178 - DNA, 19 bp, Homo sapiens
ttgtcagccatcgtcctgg

SEQ ID NO: 5659179 - DNA, 15 bp, Homo sapiens
ttgtcagccttgcta

SEQ ID NO: 5659180 - DNA, 15 bp, Homo sapiens
ttgtcaggacccagg

SEQ ID NO: 5659181 - DNA, 16 bp, Homo sapiens
ttgtcaggacccaggc

SEQ ID NO: 5659182 - DNA, 17 bp, Homo sapiens
ttgtcaggagtgtgtgt

SEQ ID NO: 5659183 - DNA, 19 bp, Homo sapiens
ttgtcaggttggagtgtaa

SEQ ID NO: 5659184 - DNA, 15 bp, Homo sapiens
ttgtcagtatctgta

SEQ ID NO: 5659185 - DNA, 22 bp, Homo sapiens
ttgtcagtgtagacacaggtca

SEQ ID NO: 5659186 - DNA, 17 bp, Homo sapiens
ttgtcataaaatgctat

SEQ ID NO: 5659187 - DNA, 15 bp, Homo sapiens
ttgtcataacattta

SEQ ID NO: 5659188 - DNA, 23 bp, Homo sapiens
ttgtcatatgtagccttcacaca

SEQ ID NO: 5659189 - DNA, 16 bp, Homo sapiens
ttgtcatcaccatgga

SEQ ID NO: 5659190 - DNA, 22 bp, Homo sapiens
ttgtcatccacacaacaccagg

SEQ ID NO: 5659191 - DNA, 21 bp, Homo sapiens
ttgtcatcgttccccacccct

SEQ ID NO: 5659192 - DNA, 19 bp, Homo sapiens
ttgtcatctttcttctatt

SEQ ID NO: 5659193 - DNA, 21 bp, Homo sapiens
ttgtcatctttcttctatttt

SEQ ID NO: 5659194 - DNA, 20 bp, Homo sapiens
ttgtcatcttttagagtaaa

SEQ ID NO: 5659195 - DNA, 21 bp, Homo sapiens
ttgtcatgcgtctctggccct

SEQ ID NO: 5659196 - DNA, 15 bp, Homo sapiens
ttgtcatggtgaaat

SEQ ID NO: 5659197 - DNA, 18 bp, Homo sapiens
ttgtcatggttacaaact

SEQ ID NO: 5659198 - DNA, 16 bp, Homo sapiens
ttgtcatgtaccatca

SEQ ID NO: 5659199 - DNA, 13 bp, Homo sapiens
ttgtcatgtggct

SEQ ID NO: 5659200 - DNA, 13 bp, Homo sapiens
ttgtcatgtgtat

SEQ ID NO: 5659201 - DNA, 15 bp, Homo sapiens
ttgtcatgtgtatga

SEQ ID NO: 5659202 - DNA, 15 bp, Homo sapiens
ttgtcatgttatgca

SEQ ID NO: 5659203 - DNA, 17 bp, Homo sapiens
ttgtcatgttatgcagt

SEQ ID NO: 5659204 - DNA, 14 bp, Homo sapiens
ttgtcattagcctg

SEQ ID NO: 5659205 - DNA, 17 bp, Homo sapiens
ttgtcattagcctgagt

SEQ ID NO: 5659206 - DNA, 19 bp, Homo sapiens
ttgtcattagcctgagtag

SEQ ID NO: 5659207 - DNA, 14 bp, Homo sapiens
ttgtcattatgtac

SEQ ID NO: 5659208 - DNA, 23 bp, Homo sapiens
ttgtcattcagttctaggccttt

SEQ ID NO: 5659209 - DNA, 18 bp, Homo sapiens
ttgtcattccagagtgct

SEQ ID NO: 5659210 - DNA, 13 bp, Homo sapiens
ttgtcattctcat

SEQ ID NO: 5659211 - DNA, 20 bp, Homo sapiens
ttgtcattcttacaaaacat

SEQ ID NO: 5659212 - DNA, 13 bp, Homo sapiens
ttgtcattgcttt

SEQ ID NO: 5659213 - DNA, 20 bp, Homo sapiens
ttgtcattttaaaatctgat

SEQ ID NO: 5659214 - DNA, 13 bp, Homo sapiens
ttgtcattttatg

SEQ ID NO: 5659215 - DNA, 19 bp, Homo sapiens
ttgtcattttcattagcaa

SEQ ID NO: 5659216 - DNA, 22 bp, Homo sapiens
ttgtccaaacaggtgctggccc

SEQ ID NO: 5659217 - DNA, 20 bp, Homo sapiens
ttgtccaaaggaaagcttaa

SEQ ID NO: 5659218 - DNA, 20 bp, Homo sapiens
ttgtccaacaataaacagga

SEQ ID NO: 5659219 - DNA, 13 bp, Homo sapiens
ttgtccaatttgt

SEQ ID NO: 5659220 - DNA, 17 bp, Homo sapiens
ttgtccacaaatgtcct

SEQ ID NO: 5659221 - DNA, 20 bp, Homo sapiens
ttgtccacaaatgtcctcag

SEQ ID NO: 5659222 - DNA, 13 bp, Homo sapiens
ttgtccacacaag

SEQ ID NO: 5659223 - DNA, 20 bp, Homo sapiens
ttgtccacacaagacagcag

SEQ ID NO: 5659224 - DNA, 22 bp, Homo sapiens
ttgtgtcccaaaatcccctcag

SEQ ID NO: 5659225 - DNA, 18 bp, Homo sapiens
ttgtgtcccttggtcctg

SEQ ID NO: 5659226 - DNA, 15 bp, Homo sapiens
ttgtgtctcttatgg

SEQ ID NO: 5659227 - DNA, 15 bp, Homo sapiens
ttgtgtctgcctgcc

SEQ ID NO: 5659228 - DNA, 13 bp, Homo sapiens
ttgtgtctgtaca

SEQ ID NO: 5659229 - DNA, 14 bp, Homo sapiens
ttgtgtctgtacac

SEQ ID NO: 5659230 - DNA, 22 bp, Homo sapiens
ttgtgtctgtgccctccaaaga

SEQ ID NO: 5659231 - DNA, 23 bp, Homo sapiens
ttgtgtctgtgccctccaaagag

SEQ ID NO: 5659232 - DNA, 13 bp, Homo sapiens
ttgtgtctgtggt

SEQ ID NO: 5659233 - DNA, 12 bp, Homo sapiens
ttgtgtctgttg

SEQ ID NO: 5659234 - DNA, 18 bp, Homo sapiens
ttgtgtcttaaactaggt

SEQ ID NO: 5659235 - DNA, 15 bp, Homo sapiens
ttgtgtcttttgcat

SEQ ID NO: 5659236 - DNA, 14 bp, Homo sapiens
ttgtgtcttttgtt

SEQ ID NO: 5659237 - DNA, 12 bp, Homo sapiens
ttgtgtgaaatt

SEQ ID NO: 5659238 - DNA, 13 bp, Homo sapiens
ttgtgtgaacttg

SEQ ID NO: 5659239 - DNA, 19 bp, Homo sapiens
ttgtgtgaccaactgtgtt

SEQ ID NO: 5659240 - DNA, 21 bp, Homo sapiens
ttgtgtgaccaactgtgttgt

SEQ ID NO: 5659241 - DNA, 14 bp, Homo sapiens
ttgtgtgagactta

SEQ ID NO: 5659242 - DNA, 19 bp, Homo sapiens
ttgtgtgagacttaaaaca

SEQ ID NO: 5659243 - DNA, 19 bp, Homo sapiens
ttgtgtgatatttcagaaa

SEQ ID NO: 5659244 - DNA, 20 bp, Homo sapiens
ttgtgtgatatttcagaaat

SEQ ID NO: 5659245 - DNA, 16 bp, Homo sapiens
ttgtgtgatccagccc

SEQ ID NO: 5659246 - DNA, 15 bp, Homo sapiens
ttgtgtgcatggaag

SEQ ID NO: 5659247 - DNA, 18 bp, Homo sapiens
ttgtgtgcgctgcctggc

SEQ ID NO: 5659248 - DNA, 21 bp, Homo sapiens
ttgtgtgctaaacgtgtatgt

SEQ ID NO: 5659249 - DNA, 13 bp, Homo sapiens
ttgtgtgctattc

SEQ ID NO: 5659250 - DNA, 15 bp, Homo sapiens
ttgtgtgctctccat

SEQ ID NO: 5659251 - DNA, 17 bp, Homo sapiens
ttgtgtgcttcacacaa

SEQ ID NO: 5659252 - DNA, 17 bp, Homo sapiens
ttgtgtgcttctgctca

SEQ ID NO: 5659253 - DNA, 22 bp, Homo sapiens
ttgtgtggaaatcataccagtt

SEQ ID NO: 5659254 - DNA, 23 bp, Homo sapiens
ttgtgtggagaagtgtgttctga

SEQ ID NO: 5659255 - DNA, 20 bp, Homo sapiens
ttgtgtggcaatgggatttg

SEQ ID NO: 5659256 - DNA, 23 bp, Homo sapiens
ttgtgtggctaattataattcag

SEQ ID NO: 5659257 - DNA, 22 bp, Homo sapiens
ttgtgtggctgccccacctgcc

SEQ ID NO: 5659258 - DNA, 19 bp, Homo sapiens
ttgtgtgggtttactctgt

SEQ ID NO: 5659259 - DNA, 21 bp, Homo sapiens
ttgtgtgggtttactctgtgc

SEQ ID NO: 5659260 - DNA, 21 bp, Homo sapiens
ttgtgtggtatgtcactcaga

SEQ ID NO: 5659261 - DNA, 16 bp, Homo sapiens
ttgtgtggtttcccct

SEQ ID NO: 5659262 - DNA, 22 bp, Homo sapiens
ttgtgtggtttcccctttcttt

SEQ ID NO: 5659263 - DNA, 18 bp, Homo sapiens
ttgtgtggtttggccctt

SEQ ID NO: 5659264 - DNA, 19 bp, Homo sapiens
ttgtgtgtaaggagtatac

SEQ ID NO: 5659265 - DNA, 13 bp, Homo sapiens
ttgtgtgtactca

SEQ ID NO: 5659266 - DNA, 16 bp, Homo sapiens
ttgtgtgtatatgtat

SEQ ID NO: 5659267 - DNA, 18 bp, Homo sapiens
ttgtgtgtatatgtattt

SEQ ID NO: 5659268 - DNA, 13 bp, Homo sapiens
ttgtgtgtatgca

SEQ ID NO: 5659269 - DNA, 14 bp, Homo sapiens
ttgtgtgtatgcac

SEQ ID NO: 5659270 - DNA, 20 bp, Homo sapiens
ttgtgtgtatgtctatgtgt

SEQ ID NO: 5659271 - DNA, 19 bp, Homo sapiens
ttgtgtgtattcagaggca

SEQ ID NO: 5659272 - DNA, 16 bp, Homo sapiens
ttgtgtgtatttgtat

SEQ ID NO: 5659273 - DNA, 16 bp, Homo sapiens
ttgtgtgtcaggccct

SEQ ID NO: 5659274 - DNA, 19 bp, Homo sapiens
ttgtgtgtcttaattatta

SEQ ID NO: 5659275 - DNA, 13 bp, Homo sapiens
ttgtgtgtgcaag

SEQ ID NO: 5659276 - DNA, 15 bp, Homo sapiens
ttgtgtgtgccctgg

SEQ ID NO: 5659277 - DNA, 17 bp, Homo sapiens
ttgtgtgtgccctgggc

SEQ ID NO: 5659278 - DNA, 22 bp, Homo sapiens
ttgtgtgtgccctgggccaggc

SEQ ID NO: 5659279 - DNA, 19 bp, Homo sapiens
ttgtgtgtgggctgtgagt

SEQ ID NO: 5659280 - DNA, 20 bp, Homo sapiens
ttgtgtgtgtgtcagctgag

SEQ ID NO: 5659281 - DNA, 15 bp, Homo sapiens
ttgtgtgtgtttcta

SEQ ID NO: 5659282 - DNA, 20 bp, Homo sapiens
ttgtgtgttatttaaatgag

SEQ ID NO: 5659283 - DNA, 21 bp, Homo sapiens
ttgtgtgttatttaaatgagt

SEQ ID NO: 5659284 - DNA, 22 bp, Homo sapiens
ttgtgtgttcactaaactctga

SEQ ID NO: 5659285 - DNA, 23 bp, Homo sapiens
ttgtgtgttgcactcaagttgtt

SEQ ID NO: 5659286 - DNA, 13 bp, Homo sapiens
ttgtgtgttgtct

SEQ ID NO: 5659287 - DNA, 17 bp, Homo sapiens
ttgtgtgtttaaagaag

SEQ ID NO: 5659288 - DNA, 22 bp, Homo sapiens
ttgtgtgtttaggcctcatttc

SEQ ID NO: 5659289 - DNA, 18 bp, Homo sapiens
ttgtgtgtttatttcact

SEQ ID NO: 5659290 - DNA, 16 bp, Homo sapiens
ttgtgttaagcttgcg

SEQ ID NO: 5659291 - DNA, 20 bp, Homo sapiens
ttgtgttaagtatgtgtaaa

SEQ ID NO: 5659292 - DNA, 15 bp, Homo sapiens
ttgtgttactaagtt

SEQ ID NO: 5659293 - DNA, 22 bp, Homo sapiens
ttgtgttatcggacattctaat

SEQ ID NO: 5659294 - DNA, 14 bp, Homo sapiens
ttgtgttcaatctg

SEQ ID NO: 5659295 - DNA, 13 bp, Homo sapiens
ttgtgttcacctt

SEQ ID NO: 5659296 - DNA, 22 bp, Homo sapiens
ttgtgttcagctctttccaaat

SEQ ID NO: 5659297 - DNA, 20 bp, Homo sapiens
ttgtgttcccatttcagctg

SEQ ID NO: 5659298 - DNA, 13 bp, Homo sapiens
ttgtgttcctggc

SEQ ID NO: 5659299 - DNA, 16 bp, Homo sapiens
ttgtgttcctggctga

SEQ ID NO: 5659300 - DNA, 19 bp, Homo sapiens
ttgtgttccttctgtgaag

SEQ ID NO: 5659301 - DNA, 21 bp, Homo sapiens
ttgtgttccttctgtgaagaa

SEQ ID NO: 5659302 - DNA, 22 bp, Homo sapiens
ttgtgttccttctgtgaagaag

SEQ ID NO: 5659303 - DNA, 20 bp, Homo sapiens
ttgtgttctgtttgttaaaa

SEQ ID NO: 5659304 - DNA, 19 bp, Homo sapiens
ttgtgttcttcttcatatt

SEQ ID NO: 5659305 - DNA, 16 bp, Homo sapiens
ttgtgttctttataac

SEQ ID NO: 5659306 - DNA, 12 bp, Homo sapiens
ttgtgttgacat

SEQ ID NO: 5659307 - DNA, 18 bp, Homo sapiens
ttgtgttgcactgaacag

SEQ ID NO: 5659308 - DNA, 13 bp, Homo sapiens
ttgtgttggcttt

SEQ ID NO: 5659309 - DNA, 17 bp, Homo sapiens
ttgtgttggctttacaa

SEQ ID NO: 5659310 - DNA, 18 bp, Homo sapiens
ttgtgttggctttacaaa

SEQ ID NO: 5659311 - DNA, 17 bp, Homo sapiens
ttgtgttgggccccagg

SEQ ID NO: 5659312 - DNA, 13 bp, Homo sapiens
ttgtgttggggga

SEQ ID NO: 5659313 - DNA, 21 bp, Homo sapiens
ttgtgttgggggaaatgttgt

SEQ ID NO: 5659314 - DNA, 11 bp, Homo sapiens
ttgtgttgtca

SEQ ID NO: 5659315 - DNA, 13 bp, Homo sapiens
ttgtgttgtcctt

SEQ ID NO: 5659316 - DNA, 13 bp, Homo sapiens
ttgtgttgtgaat

SEQ ID NO: 5659317 - DNA, 13 bp, Homo sapiens
ttgtgttgtttga

SEQ ID NO: 5659318 - DNA, 21 bp, Homo sapiens
ttgtgttgtttgaaaatatta

SEQ ID NO: 5659319 - DNA, 13 bp, Homo sapiens
ttgtgtttacatt

SEQ ID NO: 5659320 - DNA, 14 bp, Homo sapiens
ttgtgtttattctt

SEQ ID NO: 5659321 - DNA, 18 bp, Homo sapiens
ttgtgtttattcttgatg

SEQ ID NO: 5659322 - DNA, 13 bp, Homo sapiens
ttgtgtttctaga

SEQ ID NO: 5659323 - DNA, 14 bp, Homo sapiens
ttgtgtttgagaac

SEQ ID NO: 5659324 - DNA, 16 bp, Homo sapiens
ttgtgtttgattggct

SEQ ID NO: 5659325 - DNA, 19 bp, Homo sapiens
ttgtgtttggtttacattt

SEQ ID NO: 5659326 - DNA, 15 bp, Homo sapiens
ttgtgtttgtcatta

SEQ ID NO: 5659327 - DNA, 17 bp, Homo sapiens
ttgtgtttgtgtattta

SEQ ID NO: 5659328 - DNA, 16 bp, Homo sapiens
ttgtgttttacagtat

SEQ ID NO: 5659329 - DNA, 21 bp, Homo sapiens
ttgtgttttactgtcagatta

SEQ ID NO: 5659330 - DNA, 11 bp, Homo sapiens
ttgtgttttct

SEQ ID NO: 5659331 - DNA, 17 bp, Homo sapiens
ttgtgttttcttcgtgg

SEQ ID NO: 5659332 - DNA, 13 bp, Homo sapiens
ttgtgttttcttg

SEQ ID NO: 5659333 - DNA, 21 bp, Homo sapiens
ttgtgttttcttgtaaatgtt

SEQ ID NO: 5659334 - DNA, 21 bp, Homo sapiens
ttgtgtttttaatttatttat

SEQ ID NO: 5659335 - DNA, 16 bp, Homo sapiens
ttgtgtttttccaaaa

SEQ ID NO: 5659336 - DNA, 16 bp, Homo sapiens
ttgtgttttttaagat

SEQ ID NO: 5659337 - DNA, 22 bp, Homo sapiens
ttgttaaaaaaaaaaagattgt

SEQ ID NO: 5659338 - DNA, 18 bp, Homo sapiens
ttgttaaaaatattttct

SEQ ID NO: 5659339 - DNA, 12 bp, Homo sapiens
ttgttaaaacat

SEQ ID NO: 5659340 - DNA, 15 bp, Homo sapiens
ttgttaaaagatggt

SEQ ID NO: 5659341 - DNA, 15 bp, Homo sapiens
ttgttaaagcctgtt

SEQ ID NO: 5659342 - DNA, 21 bp, Homo sapiens
ttgttaaagctggaacatttg

SEQ ID NO: 5659343 - DNA, 17 bp, Homo sapiens
ttgttaaatacacatta

SEQ ID NO: 5659344 - DNA, 14 bp, Homo sapiens
ttgttaaatgctat

SEQ ID NO: 5659345 - DNA, 15 bp, Homo sapiens
ttgttaaattacatt

SEQ ID NO: 5659346 - DNA, 19 bp, Homo sapiens
ttgttaaattacattttta

SEQ ID NO: 5659347 - DNA, 12 bp, Homo sapiens
ttgttaaatttt

SEQ ID NO: 5659348 - DNA, 14 bp, Homo sapiens
ttgttaacagagca

SEQ ID NO: 5659349 - DNA, 19 bp, Homo sapiens
ttgttaacatgcctgggat

SEQ ID NO: 5659350 - DNA, 18 bp, Homo sapiens
ttgttaactcttgtctat

SEQ ID NO: 5659351 - DNA, 16 bp, Homo sapiens
ttgttaagaatttcaa

SEQ ID NO: 5659352 - DNA, 17 bp, Homo sapiens
ttgttaagatatgatgt

SEQ ID NO: 5659353 - DNA, 15 bp, Homo sapiens
ttgttaagttcaccg

SEQ ID NO: 5659354 - DNA, 23 bp, Homo sapiens
ttgttaataataagataatgatg

SEQ ID NO: 5659355 - DNA, 18 bp, Homo sapiens
ttgttaataataattatt

SEQ ID NO: 5659356 - DNA, 18 bp, Homo sapiens
ttgttaatacaaggtata

SEQ ID NO: 5659357 - DNA, 23 bp, Homo sapiens
ttgttaatataccccaaattgtg

SEQ ID NO: 5659358 - DNA, 23 bp, Homo sapiens
ttgttaatatatataatacttaa

SEQ ID NO: 5659359 - DNA, 21 bp, Homo sapiens
ttgttaatattaaaaagtctg

SEQ ID NO: 5659360 - DNA, 15 bp, Homo sapiens
ttgttaatattaatt

SEQ ID NO: 5659361 - DNA, 15 bp, Homo sapiens
ttgttaatattcttt

SEQ ID NO: 5659362 - DNA, 20 bp, Homo sapiens
ttgttaatctctgttatgta

SEQ ID NO: 5659363 - DNA, 21 bp, Homo sapiens
ttgttaatgattcttgtgtca

SEQ ID NO: 5659364 - DNA, 14 bp, Homo sapiens
ttgttaatgcattg

SEQ ID NO: 5659365 - DNA, 15 bp, Homo sapiens
ttgttaatgtcattg

SEQ ID NO: 5659366 - DNA, 17 bp, Homo sapiens
ttgttaatgtcattgct

SEQ ID NO: 5659367 - DNA, 18 bp, Homo sapiens
ttgttaatgtcattgcta

SEQ ID NO: 5659368 - DNA, 20 bp, Homo sapiens
ttgttaatgtcattgctaaa

SEQ ID NO: 5659369 - DNA, 17 bp, Homo sapiens
ttgttaatgtgatggat

SEQ ID NO: 5659370 - DNA, 20 bp, Homo sapiens
ttgttaattatgtacaacat

SEQ ID NO: 5659371 - DNA, 19 bp, Homo sapiens
ttgttaatttagaaaactt

SEQ ID NO: 5659372 - DNA, 22 bp, Homo sapiens
ttgttaatttagaaaactttaa

SEQ ID NO: 5659373 - DNA, 17 bp, Homo sapiens
ttgttaatttcagtcct

SEQ ID NO: 5659374 - DNA, 22 bp, Homo sapiens
ttgttaatttcttgcaatttga

SEQ ID NO: 5659375 - DNA, 23 bp, Homo sapiens
ttgttaatttcttgcaatttgaa

SEQ ID NO: 5659376 - DNA, 13 bp, Homo sapiens
ttgttaatttgga

SEQ ID NO: 5659377 - DNA, 13 bp, Homo sapiens
ttgttaattttgt

SEQ ID NO: 5659378 - DNA, 22 bp, Homo sapiens
ttgttaatttttcctatattgc

SEQ ID NO: 5659379 - DNA, 15 bp, Homo sapiens
ttgttacaataaaac

SEQ ID NO: 5659380 - DNA, 22 bp, Homo sapiens
ttgttacacattaagtaatcaa

SEQ ID NO: 5659381 - DNA, 21 bp, Homo sapiens
ttgttacaggcaccgagaatg

SEQ ID NO: 5659382 - DNA, 20 bp, Homo sapiens
ttgttaccaaatacacattt

SEQ ID NO: 5659383 - DNA, 20 bp, Homo sapiens
ttgttaccactggtaacatg

SEQ ID NO: 5659384 - DNA, 19 bp, Homo sapiens
ttgttaccatactgtctct

SEQ ID NO: 5659385 - DNA, 22 bp, Homo sapiens
ttgttaccatactgtctctgga

SEQ ID NO: 5659386 - DNA, 24 bp, Homo sapiens
ttgttaccatactgtctctggagt

SEQ ID NO: 5659387 - DNA, 20 bp, Homo sapiens
ttgttacctgtcattttgca

SEQ ID NO: 5659388 - DNA, 14 bp, Homo sapiens
ttgttactccctgt

SEQ ID NO: 5659389 - DNA, 9 bp, Homo sapiens
ttgttactg

SEQ ID NO: 5659390 - DNA, 14 bp, Homo sapiens
ttgttactgaagtt

SEQ ID NO: 5659391 - DNA, 17 bp, Homo sapiens
ttgttactgctgattct

SEQ ID NO: 5659392 - DNA, 14 bp, Homo sapiens
ttgttactgtctgt

SEQ ID NO: 5659393 - DNA, 14 bp, Homo sapiens
ttgttactgttctt

SEQ ID NO: 5659394 - DNA, 15 bp, Homo sapiens
ttgttactgttcttg

SEQ ID NO: 5659395 - DNA, 17 bp, Homo sapiens
ttgttactgttcttgct

SEQ ID NO: 5659396 - DNA, 18 bp, Homo sapiens
ttgttactgttcttgctg

SEQ ID NO: 5659397 - DNA, 21 bp, Homo sapiens
ttgttactgttcttgctgcta

SEQ ID NO: 5659398 - DNA, 22 bp, Homo sapiens
ttgttactgttcttgctgctag

SEQ ID NO: 5659399 - DNA, 19 bp, Homo sapiens
ttgttactgttttaaaggg

SEQ ID NO: 5659400 - DNA, 15 bp, Homo sapiens
ttgttacttctctaa

SEQ ID NO: 5659401 - DNA, 13 bp, Homo sapiens
ttgttactttgaa

SEQ ID NO: 5659402 - DNA, 22 bp, Homo sapiens
tttaaaaggtattttgaatacc

SEQ ID NO: 5659403 - DNA, 21 bp, Homo sapiens
tttaaaaggttgactcaagtt

SEQ ID NO: 5659404 - DNA, 13 bp, Homo sapiens
tttaaaagtaaaa

SEQ ID NO: 5659405 - DNA, 21 bp, Homo sapiens
tttaaaagtaggaaatacaat

SEQ ID NO: 5659406 - DNA, 19 bp, Homo sapiens
tttaaaagtatctttaaca

SEQ ID NO: 5659407 - DNA, 14 bp, Homo sapiens
tttaaaagtctatt

SEQ ID NO: 5659408 - DNA, 19 bp, Homo sapiens
tttaaaagttattaatatt

SEQ ID NO: 5659409 - DNA, 13 bp, Homo sapiens
tttaaaagttttg

SEQ ID NO: 5659410 - DNA, 17 bp, Homo sapiens
tttaaaagttttgttct

SEQ ID NO: 5659411 - DNA, 15 bp, Homo sapiens
tttaaaataaaaata

SEQ ID NO: 5659412 - DNA, 21 bp, Homo sapiens
tttaaaataaaaatattttta

SEQ ID NO: 5659413 - DNA, 18 bp, Homo sapiens
tttaaaataaaactctca

SEQ ID NO: 5659414 - DNA, 15 bp, Homo sapiens
tttaaaataaaagta

SEQ ID NO: 5659415 - DNA, 14 bp, Homo sapiens
tttaaaataaaata

SEQ ID NO: 5659416 - DNA, 15 bp, Homo sapiens
tttaaaataaaatga

SEQ ID NO: 5659417 - DNA, 19 bp, Homo sapiens
tttaaaataaaatttacct

SEQ ID NO: 5659418 - DNA, 20 bp, Homo sapiens
tttaaaataaactgtaaact

SEQ ID NO: 5659419 - DNA, 17 bp, Homo sapiens
tttaaaataaattccta

SEQ ID NO: 5659420 - DNA, 19 bp, Homo sapiens
tttaaaataaattcctaca

SEQ ID NO: 5659421 - DNA, 19 bp, Homo sapiens
tttaaaataagctttctca

SEQ ID NO: 5659422 - DNA, 13 bp, Homo sapiens
tttaaaataatat

SEQ ID NO: 5659423 - DNA, 19 bp, Homo sapiens
tttaaaatacacactcaaa

SEQ ID NO: 5659424 - DNA, 14 bp, Homo sapiens
tttaaaatactata

SEQ ID NO: 5659425 - DNA, 12 bp, Homo sapiens
tttaaaatactg

SEQ ID NO: 5659426 - DNA, 16 bp, Homo sapiens
tttaaaatactgtaga

SEQ ID NO: 5659427 - DNA, 17 bp, Homo sapiens
tttaaaatactgtagat

SEQ ID NO: 5659428 - DNA, 21 bp, Homo sapiens
tttaaaatagaaattttgtaa

SEQ ID NO: 5659429 - DNA, 22 bp, Homo sapiens
tttaaaatagaaattttgtaag

SEQ ID NO: 5659430 - DNA, 19 bp, Homo sapiens
tttaaaatagaatgataga

SEQ ID NO: 5659431 - DNA, 12 bp, Homo sapiens
tttaaaatagca

SEQ ID NO: 5659432 - DNA, 17 bp, Homo sapiens
tttaaaatagcgttctt

SEQ ID NO: 5659433 - DNA, 20 bp, Homo sapiens
tttaaaatagcgttcttgta

SEQ ID NO: 5659434 - DNA, 21 bp, Homo sapiens
tttaaaatagttttctaaatg

SEQ ID NO: 5659435 - DNA, 12 bp, Homo sapiens
tttaaaatatat

SEQ ID NO: 5659436 - DNA, 17 bp, Homo sapiens
tttaaaatatcctgtaa

SEQ ID NO: 5659437 - DNA, 16 bp, Homo sapiens
tttaaaatatctacat

SEQ ID NO: 5659438 - DNA, 14 bp, Homo sapiens
tttaaaatatttaa

SEQ ID NO: 5659439 - DNA, 18 bp, Homo sapiens
tttaaaatatttaacttt

SEQ ID NO: 5659440 - DNA, 19 bp, Homo sapiens
tttaaaatatttaactttt

SEQ ID NO: 5659441 - DNA, 20 bp, Homo sapiens
tttaaaatatttgtctttaa

SEQ ID NO: 5659442 - DNA, 14 bp, Homo sapiens
tttaaaatcaactt

SEQ ID NO: 5659443 - DNA, 17 bp, Homo sapiens
tttaaaatccattttag

SEQ ID NO: 5659444 - DNA, 20 bp, Homo sapiens
tttaaaatctcctaaatgct

SEQ ID NO: 5659445 - DNA, 16 bp, Homo sapiens
tttaaaatctgattta

SEQ ID NO: 5659446 - DNA, 15 bp, Homo sapiens
tttaaaatctgctga

SEQ ID NO: 5659447 - DNA, 20 bp, Homo sapiens
tttaaaatgaatcttatgca

SEQ ID NO: 5659448 - DNA, 14 bp, Homo sapiens
tttaaaatgattag

SEQ ID NO: 5659449 - DNA, 18 bp, Homo sapiens
tttaaaatgcagattcat

SEQ ID NO: 5659450 - DNA, 20 bp, Homo sapiens
tttaaaatgcgaaattattg

SEQ ID NO: 5659451 - DNA, 21 bp, Homo sapiens
tttaaaatggcatttagcaca

SEQ ID NO: 5659452 - DNA, 11 bp, Homo sapiens
tttaaaatgta

SEQ ID NO: 5659453 - DNA, 22 bp, Homo sapiens
tttaaaatgtaatttaaatgaa

SEQ ID NO: 5659454 - DNA, 23 bp, Homo sapiens
tttaaaatgtaatttaaatgaaa

SEQ ID NO: 5659455 - DNA, 13 bp, Homo sapiens
tttaaaatgtaca

SEQ ID NO: 5659456 - DNA, 21 bp, Homo sapiens
tttaaaatgtacatgtattaa

SEQ ID NO: 5659457 - DNA, 12 bp, Homo sapiens
tttaaaatgtag

SEQ ID NO: 5659458 - DNA, 20 bp, Homo sapiens
tttaaaatgtataagttgag

SEQ ID NO: 5659459 - DNA, 12 bp, Homo sapiens
tttaaaatgtca

SEQ ID NO: 5659460 - DNA, 19 bp, Homo sapiens
tttaaaatgtgaggcaata

SEQ ID NO: 5659461 - DNA, 10 bp, Homo sapiens
tttaaaatta

SEQ ID NO: 5659462 - DNA, 12 bp, Homo sapiens
tttaaaattaaa

SEQ ID NO: 5659463 - DNA, 17 bp, Homo sapiens
tttaaaattaagtagaa

SEQ ID NO: 5659464 - DNA, 15 bp, Homo sapiens
tttaaaattaatctt

SEQ ID NO: 5659465 - DNA, 16 bp, Homo sapiens
tttaaaattatatagc

SEQ ID NO: 5659466 - DNA, 13 bp, Homo sapiens
tttaaaattatta

SEQ ID NO: 5659467 - DNA, 13 bp, Homo sapiens
tttaaaattcagt

SEQ ID NO: 5659468 - DNA, 15 bp, Homo sapiens
tttaaaattcagttt

SEQ ID NO: 5659469 - DNA, 14 bp, Homo sapiens
tttaaaattctctt

SEQ ID NO: 5659470 - DNA, 18 bp, Homo sapiens
tttaaaattgctatgtta

SEQ ID NO: 5659471 - DNA, 18 bp, Homo sapiens
tttaaaatttatttgcaa

SEQ ID NO: 5659472 - DNA, 13 bp, Homo sapiens
tttaaaatttcat

SEQ ID NO: 5659473 - DNA, 13 bp, Homo sapiens
tttaaaatttctt

SEQ ID NO: 5659474 - DNA, 19 bp, Homo sapiens
tttaaaatttcttagaaaa

SEQ ID NO: 5659475 - DNA, 14 bp, Homo sapiens
tttaaaattttaag

SEQ ID NO: 5659476 - DNA, 17 bp, Homo sapiens
tttaaaattttatctct

SEQ ID NO: 5659477 - DNA, 21 bp, Homo sapiens
tttaaaattttggaatatttg

SEQ ID NO: 5659478 - DNA, 21 bp, Homo sapiens
tttaaaattttgtatgttaaa

SEQ ID NO: 5659479 - DNA, 20 bp, Homo sapiens
tttaaacaaaatagaagctg

SEQ ID NO: 5659480 - DNA, 20 bp, Homo sapiens
tttaaacaaatatgaaaaat

SEQ ID NO: 5659481 - DNA, 17 bp, Homo sapiens
tttaaacaaatgagtat

SEQ ID NO: 5659482 - DNA, 14 bp, Homo sapiens
tttaaacaaattca

SEQ ID NO: 5659483 - DNA, 22 bp, Homo sapiens
tttaaacaacgatttctccatt

SEQ ID NO: 5659484 - DNA, 15 bp, Homo sapiens
tttaaacaagtattt

SEQ ID NO: 5659485 - DNA, 14 bp, Homo sapiens
tttaaacacctcct

SEQ ID NO: 5659486 - DNA, 16 bp, Homo sapiens
tttaaacaggcccagc

SEQ ID NO: 5659487 - DNA, 17 bp, Homo sapiens
tttaaacagtatttcat

SEQ ID NO: 5659488 - DNA, 16 bp, Homo sapiens
tttaaacataagctaa

SEQ ID NO: 5659489 - DNA, 12 bp, Homo sapiens
tttaaacatatc

SEQ ID NO: 5659490 - DNA, 22 bp, Homo sapiens
tttaaacatatccaagtttgaa

SEQ ID NO: 5659491 - DNA, 14 bp, Homo sapiens
tttaaacattaaaa

SEQ ID NO: 5659492 - DNA, 19 bp, Homo sapiens
tttaaacattaatagcagc

SEQ ID NO: 5659493 - DNA, 19 bp, Homo sapiens
tttaaaccaattgctgcta

SEQ ID NO: 5659494 - DNA, 21 bp, Homo sapiens
tttaaaccagcagaaaagtgc

SEQ ID NO: 5659495 - DNA, 23 bp, Homo sapiens
tttaaaccagcagaaaagtgctt

SEQ ID NO: 5659496 - DNA, 22 bp, Homo sapiens
tttaaaccagggatgtctgttg

SEQ ID NO: 5659497 - DNA, 19 bp, Homo sapiens
tttaaacccaatcagatgc

SEQ ID NO: 5659498 - DNA, 17 bp, Homo sapiens
tttaaacccattttagt

SEQ ID NO: 5659499 - DNA, 22 bp, Homo sapiens
tttaaaccgctaaaagaaactt

SEQ ID NO: 5659500 - DNA, 18 bp, Homo sapiens
tttaaacctatactcact

SEQ ID NO: 5659501 - DNA, 11 bp, Homo sapiens
tttaaaccttt

SEQ ID NO: 5659502 - DNA, 18 bp, Homo sapiens
tttaaaccttttattata

SEQ ID NO: 5659503 - DNA, 18 bp, Homo sapiens
tttaaacgacttttgttt

SEQ ID NO: 5659504 - DNA, 17 bp, Homo sapiens
tttaaacgcttcttatg

SEQ ID NO: 5659505 - DNA, 15 bp, Homo sapiens
tttaaactaaattac

SEQ ID NO: 5659506 - DNA, 18 bp, Homo sapiens
tttaaactaaattactgt

SEQ ID NO: 5659507 - DNA, 17 bp, Homo sapiens
tttaaactaagatctgt

SEQ ID NO: 5659508 - DNA, 21 bp, Homo sapiens
tttaaactaccctccagagtg

SEQ ID NO: 5659509 - DNA, 21 bp, Homo sapiens
tttaaactacctcaaaacact

SEQ ID NO: 5659510 - DNA, 15 bp, Homo sapiens
tttaaactagtaatg

SEQ ID NO: 5659511 - DNA, 18 bp, Homo sapiens
tttaaactgtacagtgtc

SEQ ID NO: 5659512 - DNA, 14 bp, Homo sapiens
tttaaactgtgtac

SEQ ID NO: 5659513 - DNA, 13 bp, Homo sapiens
tttaaactgtgtt

SEQ ID NO: 5659514 - DNA, 17 bp, Homo sapiens
tttaaactgttctgtgt

SEQ ID NO: 5659515 - DNA, 13 bp, Homo sapiens
tttaaacttgaaa

SEQ ID NO: 5659516 - DNA, 15 bp, Homo sapiens
tttaaacttgaaata

SEQ ID NO: 5659517 - DNA, 15 bp, Homo sapiens
tttaaacttttatgc

SEQ ID NO: 5659518 - DNA, 11 bp, Homo sapiens
tttaaagaaaa

SEQ ID NO: 5659519 - DNA, 20 bp, Homo sapiens
tttaaagaaaaaaatgtcaa

SEQ ID NO: 5659520 - DNA, 21 bp, Homo sapiens
tttaaagaaaaaaattgaaat

SEQ ID NO: 5659521 - DNA, 18 bp, Homo sapiens
tttaaagaaaagatgaaa

SEQ ID NO: 5659522 - DNA, 18 bp, Homo sapiens
tttaaagaaacatggttt

SEQ ID NO: 5659523 - DNA, 13 bp, Homo sapiens
tttaaagaaagtg

SEQ ID NO: 5659524 - DNA, 14 bp, Homo sapiens
tttaaagaaagtgt

SEQ ID NO: 5659525 - DNA, 11 bp, Homo sapiens
tttaaagaaga

SEQ ID NO: 5659526 - DNA, 21 bp, Homo sapiens
tttaaagaagtccatgtgata

SEQ ID NO: 5659527 - DNA, 13 bp, Homo sapiens
tttaaagaagtct

SEQ ID NO: 5659528 - DNA, 18 bp, Homo sapiens
tttaaagaatcattattt

SEQ ID NO: 5659529 - DNA, 13 bp, Homo sapiens
tttaaagaatgct

SEQ ID NO: 5659530 - DNA, 15 bp, Homo sapiens
tttaaagaatgttag

SEQ ID NO: 5659531 - DNA, 12 bp, Homo sapiens
tttaaagaattg

SEQ ID NO: 5659532 - DNA, 13 bp, Homo sapiens
tttaaagaattgt

SEQ ID NO: 5659533 - DNA, 15 bp, Homo sapiens
tttaaagaatttctt

SEQ ID NO: 5659534 - DNA, 18 bp, Homo sapiens
tttaaagacaatgttaaa

SEQ ID NO: 5659535 - DNA, 21 bp, Homo sapiens
tttaaagacagggtcttgcta

SEQ ID NO: 5659536 - DNA, 16 bp, Homo sapiens
tttaaagactgtgaaa

SEQ ID NO: 5659537 - DNA, 15 bp, Homo sapiens
tttaaagacttaaga

SEQ ID NO: 5659538 - DNA, 15 bp, Homo sapiens
tttaaagagtctaga

SEQ ID NO: 5659539 - DNA, 21 bp, Homo sapiens
tttaaagagtctagattcaaa

SEQ ID NO: 5659540 - DNA, 22 bp, Homo sapiens
tttaaagagtgtgttataaaat

SEQ ID NO: 5659541 - DNA, 14 bp, Homo sapiens
tttaaagatctttt

SEQ ID NO: 5659542 - DNA, 19 bp, Homo sapiens
tttaaagcaattgcataat

SEQ ID NO: 5659543 - DNA, 15 bp, Homo sapiens
tttaaagcatctgta

SEQ ID NO: 5659544 - DNA, 15 bp, Homo sapiens
tttaaagcattgctg

SEQ ID NO: 5659545 - DNA, 16 bp, Homo sapiens
tttaaagcattgcttt

SEQ ID NO: 5659546 - DNA, 23 bp, Homo sapiens
tttaaagccaaatgtaaatagag

SEQ ID NO: 5659547 - DNA, 17 bp, Homo sapiens
tttaaagccagtcatca

SEQ ID NO: 5659548 - DNA, 21 bp, Homo sapiens
tttaaagcctgaaaattccaa

SEQ ID NO: 5659549 - DNA, 22 bp, Homo sapiens
tttaaagcctgaaaattccaat

SEQ ID NO: 5659550 - DNA, 11 bp, Homo sapiens
tttaaagcctt

SEQ ID NO: 5659551 - DNA, 16 bp, Homo sapiens
tttaaagctaaatttt

SEQ ID NO: 5659552 - DNA, 17 bp, Homo sapiens
tttaaagctgactttgt

SEQ ID NO: 5659553 - DNA, 16 bp, Homo sapiens
tttaaagcttactctg

SEQ ID NO: 5659554 - DNA, 24 bp, Homo sapiens
tttaaagcttattaaaactcattt

SEQ ID NO: 5659555 - DNA, 14 bp, Homo sapiens
tttaaagctttgaa

SEQ ID NO: 5659556 - DNA, 12 bp, Homo sapiens
tttaaagctttt

SEQ ID NO: 5659557 - DNA, 21 bp, Homo sapiens
tttaaaggaaaaaatgttgga

SEQ ID NO: 5659558 - DNA, 14 bp, Homo sapiens
tttaaaggaaacac

SEQ ID NO: 5659559 - DNA, 18 bp, Homo sapiens
tttaaaggaataaacttg

SEQ ID NO: 5659560 - DNA, 17 bp, Homo sapiens
tttaaaggacaaacagt

SEQ ID NO: 5659561 - DNA, 21 bp, Homo sapiens
tttaaaggacaaacagtgaat

SEQ ID NO: 5659562 - DNA, 21 bp, Homo sapiens
tttaaaggagcagctagctgc

SEQ ID NO: 5659563 - DNA, 17 bp, Homo sapiens
tttaaaggccctatctg

SEQ ID NO: 5659564 - DNA, 12 bp, Homo sapiens
tttaaagggaat

SEQ ID NO: 5659565 - DNA, 18 bp, Homo sapiens
tttaaagggacaccccta

SEQ ID NO: 5659566 - DNA, 19 bp, Homo sapiens
tttaaaggggtctgttctg

SEQ ID NO: 5659567 - DNA, 21 bp, Homo sapiens
tttaaagggtgcccatttgtg

SEQ ID NO: 5659568 - DNA, 20 bp, Homo sapiens
tttaaaggtttttaaattgt

SEQ ID NO: 5659569 - DNA, 14 bp, Homo sapiens
tttaaagtaaactt

SEQ ID NO: 5659570 - DNA, 15 bp, Homo sapiens
tttaaagtaaacttg

SEQ ID NO: 5659571 - DNA, 19 bp, Homo sapiens
tttaaagtaaatctctttt

SEQ ID NO: 5659572 - DNA, 15 bp, Homo sapiens
tttaaagtatgcatt

SEQ ID NO: 5659573 - DNA, 12 bp, Homo sapiens
tttaaagtctat

SEQ ID NO: 5659574 - DNA, 21 bp, Homo sapiens
tttaaagtcttctttcatgta

SEQ ID NO: 5659575 - DNA, 19 bp, Homo sapiens
tttaaagtgaacacacaca

SEQ ID NO: 5659576 - DNA, 19 bp, Homo sapiens
tttaaagtgcagtcatttg

SEQ ID NO: 5659577 - DNA, 23 bp, Homo sapiens
tttaaagtgcagtcatttgtggt

SEQ ID NO: 5659578 - DNA, 17 bp, Homo sapiens
tttaaagtgtattataa

SEQ ID NO: 5659579 - DNA, 14 bp, Homo sapiens
tttaaagtgtttca

SEQ ID NO: 5659580 - DNA, 13 bp, Homo sapiens
tttaaagttctta

SEQ ID NO: 5659581 - DNA, 16 bp, Homo sapiens
tttaaagttcttattt

SEQ ID NO: 5659582 - DNA, 14 bp, Homo sapiens
tttacagtgcctgt

SEQ ID NO: 5659583 - DNA, 19 bp, Homo sapiens
tttacagttacttttcctt

SEQ ID NO: 5659584 - DNA, 16 bp, Homo sapiens
tttacataactgcctt

SEQ ID NO: 5659585 - DNA, 18 bp, Homo sapiens
tttacataagagaaagag

SEQ ID NO: 5659586 - DNA, 21 bp, Homo sapiens
tttacataagttcctatacct

SEQ ID NO: 5659587 - DNA, 13 bp, Homo sapiens
tttacataattgc

SEQ ID NO: 5659588 - DNA, 14 bp, Homo sapiens
tttacatagttgag

SEQ ID NO: 5659589 - DNA, 15 bp, Homo sapiens
tttacatagttgaga

SEQ ID NO: 5659590 - DNA, 11 bp, Homo sapiens
tttacatattt

SEQ ID NO: 5659591 - DNA, 13 bp, Homo sapiens
tttacatcagaag

SEQ ID NO: 5659592 - DNA, 16 bp, Homo sapiens
tttacatcagaagttt

SEQ ID NO: 5659593 - DNA, 17 bp, Homo sapiens
tttacatcagaagtttg

SEQ ID NO: 5659594 - DNA, 23 bp, Homo sapiens
tttacatcctactaagaagttta

SEQ ID NO: 5659595 - DNA, 17 bp, Homo sapiens
tttacatctaagaattt

SEQ ID NO: 5659596 - DNA, 15 bp, Homo sapiens
tttacatgaagtatt

SEQ ID NO: 5659597 - DNA, 20 bp, Homo sapiens
tttacatgcaatttattaaa

SEQ ID NO: 5659598 - DNA, 17 bp, Homo sapiens
tttacatgctactaaat

SEQ ID NO: 5659599 - DNA, 12 bp, Homo sapiens
tttacatgctta

SEQ ID NO: 5659600 - DNA, 17 bp, Homo sapiens
tttacatgcttattcca

SEQ ID NO: 5659601 - DNA, 20 bp, Homo sapiens
tttacatgcttattccatga

SEQ ID NO: 5659602 - DNA, 18 bp, Homo sapiens
tttacatggggttttcaa

SEQ ID NO: 5659603 - DNA, 14 bp, Homo sapiens
tttacatgtctcat

SEQ ID NO: 5659604 - DNA, 15 bp, Homo sapiens
tttacatgtctcata

SEQ ID NO: 5659605 - DNA, 21 bp, Homo sapiens
tttacatgtgatgttttagtg

SEQ ID NO: 5659606 - DNA, 12 bp, Homo sapiens
tttacatgtttt

SEQ ID NO: 5659607 - DNA, 16 bp, Homo sapiens
tttacattatgcaaat

SEQ ID NO: 5659608 - DNA, 16 bp, Homo sapiens
tttacattcatcaata

SEQ ID NO: 5659609 - DNA, 16 bp, Homo sapiens
tttacattctagttca

SEQ ID NO: 5659610 - DNA, 14 bp, Homo sapiens
tttacattctgtgt

SEQ ID NO: 5659611 - DNA, 20 bp, Homo sapiens
tttacattgtaaatagtatt

SEQ ID NO: 5659612 - DNA, 19 bp, Homo sapiens
tttacattgtcctgtagct

SEQ ID NO: 5659613 - DNA, 19 bp, Homo sapiens
tttacatttaatacagata

SEQ ID NO: 5659614 - DNA, 18 bp, Homo sapiens
tttacatttatctgtaca

SEQ ID NO: 5659615 - DNA, 19 bp, Homo sapiens
tttacatttggattagaaa

SEQ ID NO: 5659616 - DNA, 12 bp, Homo sapiens
tttacattttaa

SEQ ID NO: 5659617 - DNA, 13 bp, Homo sapiens
tttacattttata

SEQ ID NO: 5659618 - DNA, 21 bp, Homo sapiens
tttacattttcagtaccaaag

SEQ ID NO: 5659619 - DNA, 16 bp, Homo sapiens
tttacattttcctgtg

SEQ ID NO: 5659620 - DNA, 17 bp, Homo sapiens
tttacattttctttcat

SEQ ID NO: 5659621 - DNA, 13 bp, Homo sapiens
tttacatttttat

SEQ ID NO: 5659622 - DNA, 19 bp, Homo sapiens
tttacatttttatttatga

SEQ ID NO: 5659623 - DNA, 20 bp, Homo sapiens
tttacatttttatttatgaa

SEQ ID NO: 5659624 - DNA, 18 bp, Homo sapiens
tttacatttttctgatgg

SEQ ID NO: 5659625 - DNA, 20 bp, Homo sapiens
tttaccaaagagatattgat

SEQ ID NO: 5659626 - DNA, 21 bp, Homo sapiens
tttaccaaagagatattgata

SEQ ID NO: 5659627 - DNA, 13 bp, Homo sapiens
tttaccaaagcat

SEQ ID NO: 5659628 - DNA, 17 bp, Homo sapiens
tttaccaaatgaaatgc

SEQ ID NO: 5659629 - DNA, 14 bp, Homo sapiens
tttaccaaattgct

SEQ ID NO: 5659630 - DNA, 22 bp, Homo sapiens
tttaccaacatgtatctgtcta

SEQ ID NO: 5659631 - DNA, 23 bp, Homo sapiens
tttaccaaggaaagaacaaatgc

SEQ ID NO: 5659632 - DNA, 22 bp, Homo sapiens
tttaccaattcacccactccct

SEQ ID NO: 5659633 - DNA, 14 bp, Homo sapiens
tttaccaattccaa

SEQ ID NO: 5659634 - DNA, 16 bp, Homo sapiens
tttaccactaattttg

SEQ ID NO: 5659635 - DNA, 22 bp, Homo sapiens
tttaccactgctgtgaacaagt

SEQ ID NO: 5659636 - DNA, 14 bp, Homo sapiens
tttaccacttatgc

SEQ ID NO: 5659637 - DNA, 13 bp, Homo sapiens
tttaccacttgtg

SEQ ID NO: 5659638 - DNA, 13 bp, Homo sapiens
tttaccagaaagc

SEQ ID NO: 5659639 - DNA, 13 bp, Homo sapiens
tttaccagaagtt

SEQ ID NO: 5659640 - DNA, 23 bp, Homo sapiens
tttaccagagagagcaaggaagc

SEQ ID NO: 5659641 - DNA, 23 bp, Homo sapiens
tttaccagcatacccacacaaat

SEQ ID NO: 5659642 - DNA, 20 bp, Homo sapiens
tttaccagttaattactcag

SEQ ID NO: 5659643 - DNA, 17 bp, Homo sapiens
tttaccagttgcctttt

SEQ ID NO: 5659644 - DNA, 16 bp, Homo sapiens
tttaccataatcttat

SEQ ID NO: 5659645 - DNA, 15 bp, Homo sapiens
tttaccatacattta

SEQ ID NO: 5659646 - DNA, 13 bp, Homo sapiens
tttaccatcatct

SEQ ID NO: 5659647 - DNA, 16 bp, Homo sapiens
tttaccatcatctctg

SEQ ID NO: 5659648 - DNA, 14 bp, Homo sapiens
tttaccatctgaaa

SEQ ID NO: 5659649 - DNA, 20 bp, Homo sapiens
tttaccatgaattcttgagt

SEQ ID NO: 5659650 - DNA, 16 bp, Homo sapiens
tttaccattaaaaagt

SEQ ID NO: 5659651 - DNA, 22 bp, Homo sapiens
tttaccattttgcgatgtgttt

SEQ ID NO: 5659652 - DNA, 16 bp, Homo sapiens
tttacccacctagaac

SEQ ID NO: 5659653 - DNA, 22 bp, Homo sapiens
tttacccagaatgtcagattcc

SEQ ID NO: 5659654 - DNA, 18 bp, Homo sapiens
tttacccatatcccctct

SEQ ID NO: 5659655 - DNA, 14 bp, Homo sapiens
tttacccctgctga

SEQ ID NO: 5659656 - DNA, 16 bp, Homo sapiens
tttaccctaatgtctt

SEQ ID NO: 5659657 - DNA, 15 bp, Homo sapiens
tttaccctatatcta

SEQ ID NO: 5659658 - DNA, 12 bp, Homo sapiens
tttaccctccac

SEQ ID NO: 5659659 - DNA, 21 bp, Homo sapiens
tttaccctcttgaatataatc

SEQ ID NO: 5659660 - DNA, 21 bp, Homo sapiens
tttaccctgaggtcactgcta

SEQ ID NO: 5659661 - DNA, 20 bp, Homo sapiens
tttaccctggcccctctccc

SEQ ID NO: 5659662 - DNA, 16 bp, Homo sapiens
tttaccctttatagaa

SEQ ID NO: 5659663 - DNA, 23 bp, Homo sapiens
tttaccggttgtttagaaacaga

SEQ ID NO: 5659664 - DNA, 15 bp, Homo sapiens
tttacctaagattac

SEQ ID NO: 5659665 - DNA, 14 bp, Homo sapiens
tttacctaatctcc

SEQ ID NO: 5659666 - DNA, 19 bp, Homo sapiens
tttacctaccacagtgtct

SEQ ID NO: 5659667 - DNA, 21 bp, Homo sapiens
tttacctaccaccttccctct

SEQ ID NO: 5659668 - DNA, 21 bp, Homo sapiens
tttacctatacctatgtgaaa

SEQ ID NO: 5659669 - DNA, 14 bp, Homo sapiens
tttacctattctga

SEQ ID NO: 5659670 - DNA, 13 bp, Homo sapiens
tttacctcagcct

SEQ ID NO: 5659671 - DNA, 13 bp, Homo sapiens
tttacctcccctt

SEQ ID NO: 5659672 - DNA, 19 bp, Homo sapiens
tttacctctctgtcatgtg

SEQ ID NO: 5659673 - DNA, 15 bp, Homo sapiens
tttacctgagacttt

SEQ ID NO: 5659674 - DNA, 14 bp, Homo sapiens
tttacctgcttttt

SEQ ID NO: 5659675 - DNA, 22 bp, Homo sapiens
tttacctggcagtggctctcag

SEQ ID NO: 5659676 - DNA, 21 bp, Homo sapiens
tttacctgtgcgttactaatt

SEQ ID NO: 5659677 - DNA, 16 bp, Homo sapiens
tttaccttcaaacttt

SEQ ID NO: 5659678 - DNA, 16 bp, Homo sapiens
tttaccttcatttcat

SEQ ID NO: 5659679 - DNA, 13 bp, Homo sapiens
tttacctttatct

SEQ ID NO: 5659680 - DNA, 17 bp, Homo sapiens
tttacctttattaatga

SEQ ID NO: 5659681 - DNA, 20 bp, Homo sapiens
tttacctttattaatgaact

SEQ ID NO: 5659682 - DNA, 16 bp, Homo sapiens
tttaccttttctataa

SEQ ID NO: 5659683 - DNA, 16 bp, Homo sapiens
tttacgcctgtaaatg

SEQ ID NO: 5659684 - DNA, 13 bp, Homo sapiens
tttacgctttgat

SEQ ID NO: 5659685 - DNA, 18 bp, Homo sapiens
tttacgctttgattcata

SEQ ID NO: 5659686 - DNA, 15 bp, Homo sapiens
tttacggaattccaa

SEQ ID NO: 5659687 - DNA, 17 bp, Homo sapiens
tttacggaattccaata

SEQ ID NO: 5659688 - DNA, 17 bp, Homo sapiens
tttacgtactgtaactg

SEQ ID NO: 5659689 - DNA, 14 bp, Homo sapiens
tttacgtagctatt

SEQ ID NO: 5659690 - DNA, 16 bp, Homo sapiens
tttacgtagctatttt

SEQ ID NO: 5659691 - DNA, 17 bp, Homo sapiens
tttacgtagctattttt

SEQ ID NO: 5659692 - DNA, 13 bp, Homo sapiens
tttacgtgcaaac

SEQ ID NO: 5659693 - DNA, 14 bp, Homo sapiens
tttacgttcatcac

SEQ ID NO: 5659694 - DNA, 20 bp, Homo sapiens
tttacgttgtaccattctgt

SEQ ID NO: 5659695 - DNA, 15 bp, Homo sapiens
tttacgttttagaaa

SEQ ID NO: 5659696 - DNA, 13 bp, Homo sapiens
tttactaaaagaa

SEQ ID NO: 5659697 - DNA, 15 bp, Homo sapiens
tttactaaaatggac

SEQ ID NO: 5659698 - DNA, 14 bp, Homo sapiens
tttactaaacatat

SEQ ID NO: 5659699 - DNA, 20 bp, Homo sapiens
tttactaaagatatcagagc

SEQ ID NO: 5659700 - DNA, 18 bp, Homo sapiens
tttactaacagtaactgc

SEQ ID NO: 5659701 - DNA, 15 bp, Homo sapiens
tttactaagatgaca

SEQ ID NO: 5659702 - DNA, 16 bp, Homo sapiens
tttactaagatgacat

SEQ ID NO: 5659703 - DNA, 23 bp, Homo sapiens
tttactaagatgacattgctaag

SEQ ID NO: 5659704 - DNA, 21 bp, Homo sapiens
tttactaagccacaagaaatt

SEQ ID NO: 5659705 - DNA, 18 bp, Homo sapiens
tttactaatagacaattt

SEQ ID NO: 5659706 - DNA, 16 bp, Homo sapiens
tttactactattctgt

SEQ ID NO: 5659707 - DNA, 23 bp, Homo sapiens
tttactactgtggaaaaatattt

SEQ ID NO: 5659708 - DNA, 15 bp, Homo sapiens
tttactagaaatggg

SEQ ID NO: 5659709 - DNA, 18 bp, Homo sapiens
tttactagggatccctca

SEQ ID NO: 5659710 - DNA, 23 bp, Homo sapiens
tttactagggatccctcatctgt

SEQ ID NO: 5659711 - DNA, 13 bp, Homo sapiens
tttactatatata

SEQ ID NO: 5659712 - DNA, 19 bp, Homo sapiens
tttactatcacacatgaat

SEQ ID NO: 5659713 - DNA, 15 bp, Homo sapiens
tttactatctcactg

SEQ ID NO: 5659714 - DNA, 20 bp, Homo sapiens
tttactatgcctgttgatct

SEQ ID NO: 5659715 - DNA, 13 bp, Homo sapiens
tttactatgtaaa

SEQ ID NO: 5659716 - DNA, 14 bp, Homo sapiens
tttactattaacat

SEQ ID NO: 5659717 - DNA, 22 bp, Homo sapiens
tttactatttcaatacttacat

SEQ ID NO: 5659718 - DNA, 15 bp, Homo sapiens
tttactatttgggct

SEQ ID NO: 5659719 - DNA, 13 bp, Homo sapiens
tttactcacagca

SEQ ID NO: 5659720 - DNA, 16 bp, Homo sapiens
tttactcacagcactt

SEQ ID NO: 5659721 - DNA, 11 bp, Homo sapiens
tttactcacat

SEQ ID NO: 5659722 - DNA, 14 bp, Homo sapiens
tttactcaggcttt

SEQ ID NO: 5659723 - DNA, 17 bp, Homo sapiens
tttactcaggctttcta

SEQ ID NO: 5659724 - DNA, 19 bp, Homo sapiens
tttactcagtgaaatcata

SEQ ID NO: 5659725 - DNA, 19 bp, Homo sapiens
tttactcatcctccaggaa

SEQ ID NO: 5659726 - DNA, 12 bp, Homo sapiens
tttactcccctt

SEQ ID NO: 5659727 - DNA, 17 bp, Homo sapiens
tttactccgtaacagat

SEQ ID NO: 5659728 - DNA, 19 bp, Homo sapiens
tttactcctttgcattcca

SEQ ID NO: 5659729 - DNA, 18 bp, Homo sapiens
tttactcggcgtgctcct

SEQ ID NO: 5659730 - DNA, 12 bp, Homo sapiens
tttactctctcc

SEQ ID NO: 5659731 - DNA, 21 bp, Homo sapiens
tttactctctccgatttgctt

SEQ ID NO: 5659732 - DNA, 13 bp, Homo sapiens
tttactctgccta

SEQ ID NO: 5659733 - DNA, 13 bp, Homo sapiens
tttactctgtgta

SEQ ID NO: 5659734 - DNA, 19 bp, Homo sapiens
tttactctgtgtaaagact

SEQ ID NO: 5659735 - DNA, 13 bp, Homo sapiens
tttactctgtgtt

SEQ ID NO: 5659736 - DNA, 19 bp, Homo sapiens
tttactctgtgtttaaaaa

SEQ ID NO: 5659737 - DNA, 13 bp, Homo sapiens
tttactcttatga

SEQ ID NO: 5659738 - DNA, 16 bp, Homo sapiens
tttactctttctaact

SEQ ID NO: 5659739 - DNA, 13 bp, Homo sapiens
tttactctttgaa

SEQ ID NO: 5659740 - DNA, 15 bp, Homo sapiens
tttactgaaacattg

SEQ ID NO: 5659741 - DNA, 14 bp, Homo sapiens
tttactgaaatgcg

SEQ ID NO: 5659742 - DNA, 15 bp, Homo sapiens
tttactgacagaaat

SEQ ID NO: 5659743 - DNA, 20 bp, Homo sapiens
tttactgacatggtgctgtg

SEQ ID NO: 5659744 - DNA, 15 bp, Homo sapiens
tttactgagagaagg

SEQ ID NO: 5659745 - DNA, 14 bp, Homo sapiens
tttactgagcttct

SEQ ID NO: 5659746 - DNA, 17 bp, Homo sapiens
tttactgattccagcaa

SEQ ID NO: 5659747 - DNA, 13 bp, Homo sapiens
tttactgcatttt

SEQ ID NO: 5659748 - DNA, 20 bp, Homo sapiens
tttactgcattttcacaaca

SEQ ID NO: 5659749 - DNA, 12 bp, Homo sapiens
tttactgccact

SEQ ID NO: 5659750 - DNA, 19 bp, Homo sapiens
tttactgccttcctcctta

SEQ ID NO: 5659751 - DNA, 17 bp, Homo sapiens
tttactgctccttccat

SEQ ID NO: 5659752 - DNA, 21 bp, Homo sapiens
tttactgctctagaaagtata

SEQ ID NO: 5659753 - DNA, 15 bp, Homo sapiens
tttactgctttctga

SEQ ID NO: 5659754 - DNA, 12 bp, Homo sapiens
tttactgctttt

SEQ ID NO: 5659755 - DNA, 17 bp, Homo sapiens
tttactggataaattta

SEQ ID NO: 5659756 - DNA, 15 bp, Homo sapiens
tttactggctgtgtg

SEQ ID NO: 5659757 - DNA, 12 bp, Homo sapiens
tttactgtaaat

SEQ ID NO: 5659758 - DNA, 20 bp, Homo sapiens
tttactgtatcaatttctaa

SEQ ID NO: 5659759 - DNA, 21 bp, Homo sapiens
tttactgtatcaatttctaat

SEQ ID NO: 5659760 - DNA, 15 bp, Homo sapiens
tttactgtatgtttt

SEQ ID NO: 5659761 - DNA, 20 bp, Homo sapiens
tttactgtatgtttttactg

SEQ ID NO: 5659762 - DNA, 21 bp, Homo sapiens
tttactgtcaaaatatttctc

SEQ ID NO: 5659763 - DNA, 21 bp, Homo sapiens
tttatatattgaaagttgctt

SEQ ID NO: 5659764 - DNA, 12 bp, Homo sapiens
tttatatattta

SEQ ID NO: 5659765 - DNA, 14 bp, Homo sapiens
tttatatcactgtc

SEQ ID NO: 5659766 - DNA, 14 bp, Homo sapiens
tttatatcatttta

SEQ ID NO: 5659767 - DNA, 22 bp, Homo sapiens
tttatatcattttaaaatgtct

SEQ ID NO: 5659768 - DNA, 21 bp, Homo sapiens
tttatatcttggcaggtagga

SEQ ID NO: 5659769 - DNA, 19 bp, Homo sapiens
tttatatctttatgcaaaa

SEQ ID NO: 5659770 - DNA, 15 bp, Homo sapiens
tttatatgaaataaa

SEQ ID NO: 5659771 - DNA, 14 bp, Homo sapiens
tttatatgaagaaa

SEQ ID NO: 5659772 - DNA, 18 bp, Homo sapiens
tttatatgaagcaagctg

SEQ ID NO: 5659773 - DNA, 22 bp, Homo sapiens
tttatatgaagcaagctgtgtt

SEQ ID NO: 5659774 - DNA, 19 bp, Homo sapiens
tttatatgattaaattatc

SEQ ID NO: 5659775 - DNA, 20 bp, Homo sapiens
tttatatgcttactgatata

SEQ ID NO: 5659776 - DNA, 13 bp, Homo sapiens
tttatatgcttca

SEQ ID NO: 5659777 - DNA, 17 bp, Homo sapiens
tttatatggaacgcatt

SEQ ID NO: 5659778 - DNA, 19 bp, Homo sapiens
tttatatggataatctgag

SEQ ID NO: 5659779 - DNA, 21 bp, Homo sapiens
tttatatggataatctgagca

SEQ ID NO: 5659780 - DNA, 23 bp, Homo sapiens
tttatatggatgattcagaaatt

SEQ ID NO: 5659781 - DNA, 18 bp, Homo sapiens
tttatatggcgttttgtc

SEQ ID NO: 5659782 - DNA, 21 bp, Homo sapiens
tttatatggcgttttgtctgt

SEQ ID NO: 5659783 - DNA, 14 bp, Homo sapiens
tttatatgtacatg

SEQ ID NO: 5659784 - DNA, 12 bp, Homo sapiens
tttatatgtact

SEQ ID NO: 5659785 - DNA, 16 bp, Homo sapiens
tttatatgtattaaat

SEQ ID NO: 5659786 - DNA, 21 bp, Homo sapiens
tttatatgtgttgaaaaccaa

SEQ ID NO: 5659787 - DNA, 13 bp, Homo sapiens
tttatatgttaat

SEQ ID NO: 5659788 - DNA, 14 bp, Homo sapiens
tttatattactctc

SEQ ID NO: 5659789 - DNA, 18 bp, Homo sapiens
tttatattacttttgtaa

SEQ ID NO: 5659790 - DNA, 19 bp, Homo sapiens
tttatattacttttgtaaa

SEQ ID NO: 5659791 - DNA, 22 bp, Homo sapiens
tttatattacttttgtaaatat

SEQ ID NO: 5659792 - DNA, 19 bp, Homo sapiens
tttatattagataaccata

SEQ ID NO: 5659793 - DNA, 22 bp, Homo sapiens
tttatattatccataggtttct

SEQ ID NO: 5659794 - DNA, 22 bp, Homo sapiens
tttatattcagagatgtaccat

SEQ ID NO: 5659795 - DNA, 23 bp, Homo sapiens
tttatattcagagatgtaccatg

SEQ ID NO: 5659796 - DNA, 16 bp, Homo sapiens
tttatattcatcaaat

SEQ ID NO: 5659797 - DNA, 21 bp, Homo sapiens
tttatattcattcagatataa

SEQ ID NO: 5659798 - DNA, 13 bp, Homo sapiens
tttatattctaat

SEQ ID NO: 5659799 - DNA, 21 bp, Homo sapiens
tttatattctaatagtttttc

SEQ ID NO: 5659800 - DNA, 16 bp, Homo sapiens
tttatattcttatgtt

SEQ ID NO: 5659801 - DNA, 17 bp, Homo sapiens
tttatattgggaagctg

SEQ ID NO: 5659802 - DNA, 16 bp, Homo sapiens
tttatattgtagcagt

SEQ ID NO: 5659803 - DNA, 15 bp, Homo sapiens
tttatattgtatatt

SEQ ID NO: 5659804 - DNA, 17 bp, Homo sapiens
tttatattgtatattct

SEQ ID NO: 5659805 - DNA, 18 bp, Homo sapiens
tttatattgtttttatat

SEQ ID NO: 5659806 - DNA, 12 bp, Homo sapiens
tttatatttaaa

SEQ ID NO: 5659807 - DNA, 14 bp, Homo sapiens
tttatatttaaatg

SEQ ID NO: 5659808 - DNA, 13 bp, Homo sapiens
tttatatttagat

SEQ ID NO: 5659809 - DNA, 21 bp, Homo sapiens
tttatatttattgactcttga

SEQ ID NO: 5659810 - DNA, 15 bp, Homo sapiens
tttatatttattgtt

SEQ ID NO: 5659811 - DNA, 16 bp, Homo sapiens
tttatatttattgtta

SEQ ID NO: 5659812 - DNA, 20 bp, Homo sapiens
tttatatttattgttagaaa

SEQ ID NO: 5659813 - DNA, 15 bp, Homo sapiens
tttatatttcaagta

SEQ ID NO: 5659814 - DNA, 13 bp, Homo sapiens
tttatatttcctt

SEQ ID NO: 5659815 - DNA, 19 bp, Homo sapiens
tttatatttcctttatgtg

SEQ ID NO: 5659816 - DNA, 14 bp, Homo sapiens
tttatatttctcgt

SEQ ID NO: 5659817 - DNA, 13 bp, Homo sapiens
tttatatttggaa

SEQ ID NO: 5659818 - DNA, 19 bp, Homo sapiens
tttatatttggggtccttt

SEQ ID NO: 5659819 - DNA, 22 bp, Homo sapiens
tttatatttgtgtattttcctg

SEQ ID NO: 5659820 - DNA, 19 bp, Homo sapiens
tttatattttcaattcaaa

SEQ ID NO: 5659821 - DNA, 15 bp, Homo sapiens
tttatattttctatt

SEQ ID NO: 5659822 - DNA, 14 bp, Homo sapiens
tttatcaaaatgta

SEQ ID NO: 5659823 - DNA, 22 bp, Homo sapiens
tttatcaaacagaattttaaag

SEQ ID NO: 5659824 - DNA, 22 bp, Homo sapiens
tttatcaaaccctagccttgct

SEQ ID NO: 5659825 - DNA, 14 bp, Homo sapiens
tttatcaaatcagt

SEQ ID NO: 5659826 - DNA, 17 bp, Homo sapiens
tttatcaactcaagaat

SEQ ID NO: 5659827 - DNA, 15 bp, Homo sapiens
tttatcaactttggt

SEQ ID NO: 5659828 - DNA, 18 bp, Homo sapiens
tttatcaagcatttacca

SEQ ID NO: 5659829 - DNA, 18 bp, Homo sapiens
tttatcaatcagtataat

SEQ ID NO: 5659830 - DNA, 19 bp, Homo sapiens
tttatcaatgtgtctttct

SEQ ID NO: 5659831 - DNA, 19 bp, Homo sapiens
tttatcaatttttcccagt

SEQ ID NO: 5659832 - DNA, 13 bp, Homo sapiens
tttatcacttaaa

SEQ ID NO: 5659833 - DNA, 18 bp, Homo sapiens
tttatcacttgccgtgtc

SEQ ID NO: 5659834 - DNA, 13 bp, Homo sapiens
tttatcacttttt

SEQ ID NO: 5659835 - DNA, 21 bp, Homo sapiens
tttatcagaatcaaatctgag

SEQ ID NO: 5659836 - DNA, 22 bp, Homo sapiens
tttatcagaatcaaatctgagc

SEQ ID NO: 5659837 - DNA, 13 bp, Homo sapiens
tttatcagataca

SEQ ID NO: 5659838 - DNA, 22 bp, Homo sapiens
tttatcagattgcttttgtgca

SEQ ID NO: 5659839 - DNA, 16 bp, Homo sapiens
tttatcagcagttgtt

SEQ ID NO: 5659840 - DNA, 20 bp, Homo sapiens
tttatcagggaaactaagat

SEQ ID NO: 5659841 - DNA, 18 bp, Homo sapiens
tttatcagtgacagagtt

SEQ ID NO: 5659842 - DNA, 24 bp, Homo sapiens
tttatcagtgcttaatgtgaacta

SEQ ID NO: 5659843 - DNA, 22 bp, Homo sapiens
tttatcataaacattttacatg

SEQ ID NO: 5659844 - DNA, 15 bp, Homo sapiens
tttatcatgaagcct

SEQ ID NO: 5659845 - DNA, 16 bp, Homo sapiens
tttatcatgaagcctg

SEQ ID NO: 5659846 - DNA, 23 bp, Homo sapiens
tttatcatgacatgttatatatt

SEQ ID NO: 5659847 - DNA, 23 bp, Homo sapiens
tttatcatgcatgtcctgtaaag

SEQ ID NO: 5659848 - DNA, 15 bp, Homo sapiens
tttatcatgtgtttc

SEQ ID NO: 5659849 - DNA, 13 bp, Homo sapiens
tttatcattaaac

SEQ ID NO: 5659850 - DNA, 15 bp, Homo sapiens
tttatcattaaacat

SEQ ID NO: 5659851 - DNA, 19 bp, Homo sapiens
tttatcattaaacatgaat

SEQ ID NO: 5659852 - DNA, 17 bp, Homo sapiens
tttatcattcaagtgta

SEQ ID NO: 5659853 - DNA, 16 bp, Homo sapiens
tttatccaaaatgtgt

SEQ ID NO: 5659854 - DNA, 17 bp, Homo sapiens
tttatccaaaatgtgta

SEQ ID NO: 5659855 - DNA, 18 bp, Homo sapiens
tttatccaaaatgtgtat

SEQ ID NO: 5659856 - DNA, 20 bp, Homo sapiens
tttatccaaaatgtgtattt

SEQ ID NO: 5659857 - DNA, 15 bp, Homo sapiens
tttatccaatcttgt

SEQ ID NO: 5659858 - DNA, 22 bp, Homo sapiens
tttatccaattttgatcttttt

SEQ ID NO: 5659859 - DNA, 14 bp, Homo sapiens
tttatccacaggaa

SEQ ID NO: 5659860 - DNA, 13 bp, Homo sapiens
tttatccacattg

SEQ ID NO: 5659861 - DNA, 14 bp, Homo sapiens
tttatccacattgt

SEQ ID NO: 5659862 - DNA, 14 bp, Homo sapiens
tttatccataatga

SEQ ID NO: 5659863 - DNA, 16 bp, Homo sapiens
tttatccatttgtaat

SEQ ID NO: 5659864 - DNA, 15 bp, Homo sapiens
tttatcccaggaaat

SEQ ID NO: 5659865 - DNA, 14 bp, Homo sapiens
tttatcccatttta

SEQ ID NO: 5659866 - DNA, 19 bp, Homo sapiens
tttatccctgcttatctga

SEQ ID NO: 5659867 - DNA, 22 bp, Homo sapiens
tttatccctgcttatctgaaac

SEQ ID NO: 5659868 - DNA, 21 bp, Homo sapiens
tttatccctttacaatgtgaa

SEQ ID NO: 5659869 - DNA, 14 bp, Homo sapiens
tttatcctaaaaat

SEQ ID NO: 5659870 - DNA, 23 bp, Homo sapiens
tttatcctaaaaatctggaatca

SEQ ID NO: 5659871 - DNA, 18 bp, Homo sapiens
tttatcctctttagagtt

SEQ ID NO: 5659872 - DNA, 18 bp, Homo sapiens
tttatcctgaaatttcag

SEQ ID NO: 5659873 - DNA, 16 bp, Homo sapiens
tttatcgccattccag

SEQ ID NO: 5659874 - DNA, 21 bp, Homo sapiens
tttatcgccctggcaggcagg

SEQ ID NO: 5659875 - DNA, 17 bp, Homo sapiens
tttatcgctaaatgact

SEQ ID NO: 5659876 - DNA, 19 bp, Homo sapiens
tttatcgctgggaaatgag

SEQ ID NO: 5659877 - DNA, 20 bp, Homo sapiens
tttatcgctgggaaatgaga

SEQ ID NO: 5659878 - DNA, 14 bp, Homo sapiens
tttatcgtttttgt

SEQ ID NO: 5659879 - DNA, 21 bp, Homo sapiens
tttatctaaaagaatttaaat

SEQ ID NO: 5659880 - DNA, 22 bp, Homo sapiens
tttatctacccaagggcagaaa

SEQ ID NO: 5659881 - DNA, 20 bp, Homo sapiens
tttatctacccagtcatgta

SEQ ID NO: 5659882 - DNA, 15 bp, Homo sapiens
tttatctagatgtaa

SEQ ID NO: 5659883 - DNA, 14 bp, Homo sapiens
tttatctataattt

SEQ ID NO: 5659884 - DNA, 12 bp, Homo sapiens
tttatctatata

SEQ ID NO: 5659885 - DNA, 20 bp, Homo sapiens
tttatctattctgagaaaac

SEQ ID NO: 5659886 - DNA, 17 bp, Homo sapiens
tttatctattgtaagat

SEQ ID NO: 5659887 - DNA, 20 bp, Homo sapiens
tttatctattgtaagataaa

SEQ ID NO: 5659888 - DNA, 16 bp, Homo sapiens
tttatctcagatgtta

SEQ ID NO: 5659889 - DNA, 21 bp, Homo sapiens
tttatctcagatgttaaaata

SEQ ID NO: 5659890 - DNA, 22 bp, Homo sapiens
tttatctccaagtggcagtttt

SEQ ID NO: 5659891 - DNA, 20 bp, Homo sapiens
tttatctccatactttggat

SEQ ID NO: 5659892 - DNA, 12 bp, Homo sapiens
tttatctcctgg

SEQ ID NO: 5659893 - DNA, 12 bp, Homo sapiens
tttatctccttg

SEQ ID NO: 5659894 - DNA, 23 bp, Homo sapiens
tttatctccttgtggcctatgaa

SEQ ID NO: 5659895 - DNA, 14 bp, Homo sapiens
tttatctctattta

SEQ ID NO: 5659896 - DNA, 16 bp, Homo sapiens
tttatctcttcttcct

SEQ ID NO: 5659897 - DNA, 11 bp, Homo sapiens
tttatctgaag

SEQ ID NO: 5659898 - DNA, 20 bp, Homo sapiens
tttatctgatatgctgagaa

SEQ ID NO: 5659899 - DNA, 21 bp, Homo sapiens
tttatctgcaaggatttttta

SEQ ID NO: 5659900 - DNA, 17 bp, Homo sapiens
tttatctgcacctagaa

SEQ ID NO: 5659901 - DNA, 12 bp, Homo sapiens
tttatctgcaga

SEQ ID NO: 5659902 - DNA, 21 bp, Homo sapiens
tttatctgcctctcttgtaat

SEQ ID NO: 5659903 - DNA, 17 bp, Homo sapiens
tttatctggccccaggt

SEQ ID NO: 5659904 - DNA, 13 bp, Homo sapiens
tttatctgtcaca

SEQ ID NO: 5659905 - DNA, 12 bp, Homo sapiens
tttatctgtgga

SEQ ID NO: 5659906 - DNA, 12 bp, Homo sapiens
tttatctgttaa

SEQ ID NO: 5659907 - DNA, 16 bp, Homo sapiens
tttatctgttcatatg

SEQ ID NO: 5659908 - DNA, 13 bp, Homo sapiens
tttatctgttctt

SEQ ID NO: 5659909 - DNA, 16 bp, Homo sapiens
tttatcttaatccatt

SEQ ID NO: 5659910 - DNA, 16 bp, Homo sapiens
tttatcttaattgcaa

SEQ ID NO: 5659911 - DNA, 15 bp, Homo sapiens
tttatcttattttct

SEQ ID NO: 5659912 - DNA, 20 bp, Homo sapiens
tttatcttattttctcaatc

SEQ ID NO: 5659913 - DNA, 16 bp, Homo sapiens
tttatcttctgttttt

SEQ ID NO: 5659914 - DNA, 18 bp, Homo sapiens
tttatcttctgtttttct

SEQ ID NO: 5659915 - DNA, 15 bp, Homo sapiens
tttatcttctttcct

SEQ ID NO: 5659916 - DNA, 12 bp, Homo sapiens
tttatcttgaca

SEQ ID NO: 5659917 - DNA, 15 bp, Homo sapiens
tttatcttgagtgtt

SEQ ID NO: 5659918 - DNA, 16 bp, Homo sapiens
tttatctttaccaaaa

SEQ ID NO: 5659919 - DNA, 13 bp, Homo sapiens
tttatctttgacc

SEQ ID NO: 5659920 - DNA, 18 bp, Homo sapiens
tttatctttgattctcct

SEQ ID NO: 5659921 - DNA, 16 bp, Homo sapiens
tttatctttgtattct

SEQ ID NO: 5659922 - DNA, 16 bp, Homo sapiens
tttatcttttctacag

SEQ ID NO: 5659923 - DNA, 15 bp, Homo sapiens
tttatcttttttcct

SEQ ID NO: 5659924 - DNA, 19 bp, Homo sapiens
tttatgaaaaaaatatatt

SEQ ID NO: 5659925 - DNA, 21 bp, Homo sapiens
tttatgaaaaactcttctact

SEQ ID NO: 5659926 - DNA, 11 bp, Homo sapiens
tttatgaaaat

SEQ ID NO: 5659927 - DNA, 19 bp, Homo sapiens
tttatgaaaggtttacatt

SEQ ID NO: 5659928 - DNA, 22 bp, Homo sapiens
tttatgaactgcatcaagactt

SEQ ID NO: 5659929 - DNA, 12 bp, Homo sapiens
tttatgaagaaa

SEQ ID NO: 5659930 - DNA, 19 bp, Homo sapiens
tttatgaagaaaaaataca

SEQ ID NO: 5659931 - DNA, 18 bp, Homo sapiens
tttatgaagaaaatactt

SEQ ID NO: 5659932 - DNA, 17 bp, Homo sapiens
tttatgaaggcaaaaaa

SEQ ID NO: 5659933 - DNA, 22 bp, Homo sapiens
tttatgaagttaacagtctcat

SEQ ID NO: 5659934 - DNA, 23 bp, Homo sapiens
tttatgaagtttaaaacagtatt

SEQ ID NO: 5659935 - DNA, 14 bp, Homo sapiens
tttatgaatgggtg

SEQ ID NO: 5659936 - DNA, 14 bp, Homo sapiens
tttatgaattgtct

SEQ ID NO: 5659937 - DNA, 14 bp, Homo sapiens
tttatgacagtatc

SEQ ID NO: 5659938 - DNA, 23 bp, Homo sapiens
tttatgacatgaaaagttattta

SEQ ID NO: 5659939 - DNA, 23 bp, Homo sapiens
tttatgaccagagcaaaaatgta

SEQ ID NO: 5659940 - DNA, 23 bp, Homo sapiens
tttatgacctgaaataatatatt

SEQ ID NO: 5659941 - DNA, 15 bp, Homo sapiens
tttcagaagcaagcc

SEQ ID NO: 5659942 - DNA, 18 bp, Homo sapiens
tttcagaagctgatgagg

SEQ ID NO: 5659943 - DNA, 16 bp, Homo sapiens
tttcagaaggagaagg

SEQ ID NO: 5659944 - DNA, 21 bp, Homo sapiens
tttcagaagtgagctttgctg

SEQ ID NO: 5659945 - DNA, 20 bp, Homo sapiens
tttcagaagtgccacttaag

SEQ ID NO: 5659946 - DNA, 15 bp, Homo sapiens
tttcagaatatgtca

SEQ ID NO: 5659947 - DNA, 11 bp, Homo sapiens
tttcagaatct

SEQ ID NO: 5659948 - DNA, 19 bp, Homo sapiens
tttcagaatctgaatgtaa

SEQ ID NO: 5659949 - DNA, 23 bp, Homo sapiens
tttcagaatctgaatgtaatttg

SEQ ID NO: 5659950 - DNA, 23 bp, Homo sapiens
tttcagaatgcaatgtttctaaa

SEQ ID NO: 5659951 - DNA, 23 bp, Homo sapiens
tttcagaattgaaggagaaaatg

SEQ ID NO: 5659952 - DNA, 14 bp, Homo sapiens
tttcagacagggtc

SEQ ID NO: 5659953 - DNA, 14 bp, Homo sapiens
tttcagaccccagc

SEQ ID NO: 5659954 - DNA, 12 bp, Homo sapiens
tttcagaccccc

SEQ ID NO: 5659955 - DNA, 20 bp, Homo sapiens
tttcagacctttgtctgaag

SEQ ID NO: 5659956 - DNA, 13 bp, Homo sapiens
tttcagacctttt

SEQ ID NO: 5659957 - DNA, 19 bp, Homo sapiens
tttcagactgcctgtctgc

SEQ ID NO: 5659958 - DNA, 22 bp, Homo sapiens
tttcagactgcctgtctgcttg

SEQ ID NO: 5659959 - DNA, 16 bp, Homo sapiens
tttcagactgtgcaat

SEQ ID NO: 5659960 - DNA, 20 bp, Homo sapiens
tttcagactgtgcaatactt

SEQ ID NO: 5659961 - DNA, 23 bp, Homo sapiens
tttcagagacagctgatacttca

SEQ ID NO: 5659962 - DNA, 20 bp, Homo sapiens
tttcagagaccttaatttat

SEQ ID NO: 5659963 - DNA, 12 bp, Homo sapiens
tttcagagattt

SEQ ID NO: 5659964 - DNA, 13 bp, Homo sapiens
tttcagagccagt

SEQ ID NO: 5659965 - DNA, 22 bp, Homo sapiens
tttcagagcccccagccctggg

SEQ ID NO: 5659966 - DNA, 21 bp, Homo sapiens
tttcagagtcatttatgagca

SEQ ID NO: 5659967 - DNA, 18 bp, Homo sapiens
tttcagagttctttttga

SEQ ID NO: 5659968 - DNA, 23 bp, Homo sapiens
tttcagagttctttttgaagtat

SEQ ID NO: 5659969 - DNA, 16 bp, Homo sapiens
tttcagagttttacta

SEQ ID NO: 5659970 - DNA, 16 bp, Homo sapiens
tttcagagttttctaa

SEQ ID NO: 5659971 - DNA, 17 bp, Homo sapiens
tttcagataaatcatgg

SEQ ID NO: 5659972 - DNA, 18 bp, Homo sapiens
tttcagataaatttcaat

SEQ ID NO: 5659973 - DNA, 14 bp, Homo sapiens
tttcagatataaaa

SEQ ID NO: 5659974 - DNA, 16 bp, Homo sapiens
tttcagatatcaaaat

SEQ ID NO: 5659975 - DNA, 22 bp, Homo sapiens
tttcagatatcaaaattctagc

SEQ ID NO: 5659976 - DNA, 17 bp, Homo sapiens
tttcagatgatttgaaa

SEQ ID NO: 5659977 - DNA, 20 bp, Homo sapiens
tttcagatgcttctgggaga

SEQ ID NO: 5659978 - DNA, 19 bp, Homo sapiens
tttcagatgtaatgttttc

SEQ ID NO: 5659979 - DNA, 17 bp, Homo sapiens
tttcagatgtcttctgc

SEQ ID NO: 5659980 - DNA, 20 bp, Homo sapiens
tttcagatgtcttctgcctg

SEQ ID NO: 5659981 - DNA, 18 bp, Homo sapiens
tttcagattgtaaaggta

SEQ ID NO: 5659982 - DNA, 13 bp, Homo sapiens
tttcagattgtat

SEQ ID NO: 5659983 - DNA, 15 bp, Homo sapiens
tttcagatttgcaca

SEQ ID NO: 5659984 - DNA, 13 bp, Homo sapiens
tttcagattttaa

SEQ ID NO: 5659985 - DNA, 21 bp, Homo sapiens
tttcagattttttaaaatttt

SEQ ID NO: 5659986 - DNA, 14 bp, Homo sapiens
tttcagcacaataa

SEQ ID NO: 5659987 - DNA, 18 bp, Homo sapiens
tttcagcacccccaccca

SEQ ID NO: 5659988 - DNA, 17 bp, Homo sapiens
tttcagcatcaaacatg

SEQ ID NO: 5659989 - DNA, 19 bp, Homo sapiens
tttcagcatcaaacatgaa

SEQ ID NO: 5659990 - DNA, 21 bp, Homo sapiens
tttcagcatcaaacatgaaaa

SEQ ID NO: 5659991 - DNA, 23 bp, Homo sapiens
tttcagcatcaaacatgaaaaca

SEQ ID NO: 5659992 - DNA, 13 bp, Homo sapiens
tttcagcatggtt

SEQ ID NO: 5659993 - DNA, 19 bp, Homo sapiens
tttcagccaaactgtagat

SEQ ID NO: 5659994 - DNA, 22 bp, Homo sapiens
tttcagccaatctggacacttc

SEQ ID NO: 5659995 - DNA, 16 bp, Homo sapiens
tttcagccatgataag

SEQ ID NO: 5659996 - DNA, 20 bp, Homo sapiens
tttcagccatgataagaaca

SEQ ID NO: 5659997 - DNA, 15 bp, Homo sapiens
tttcagcctgcttct

SEQ ID NO: 5659998 - DNA, 23 bp, Homo sapiens
tttcagcgactccgttggccact

SEQ ID NO: 5659999 - DNA, 12 bp, Homo sapiens
tttcagcgcccc

SEQ ID NO: 5660000 - DNA, 15 bp, Homo sapiens
tttcagctaggaaca

SEQ ID NO: 5660001 - DNA, 15 bp, Homo sapiens
tttcagctatcagta

SEQ ID NO: 5660002 - DNA, 16 bp, Homo sapiens
tttcagctatgcagaa

SEQ ID NO: 5660003 - DNA, 22 bp, Homo sapiens
tttcagctatgctagaggcttt

SEQ ID NO: 5660004 - DNA, 12 bp, Homo sapiens
tttcagctctct

SEQ ID NO: 5660005 - DNA, 13 bp, Homo sapiens
tttcagctgacca

SEQ ID NO: 5660006 - DNA, 14 bp, Homo sapiens
tttcagctgagccc

SEQ ID NO: 5660007 - DNA, 16 bp, Homo sapiens
tttcagctgtcttttg

SEQ ID NO: 5660008 - DNA, 14 bp, Homo sapiens
tttcagctgtgaac

SEQ ID NO: 5660009 - DNA, 17 bp, Homo sapiens
tttcagcttgtttctat

SEQ ID NO: 5660010 - DNA, 18 bp, Homo sapiens
tttcagcttgtttctata

SEQ ID NO: 5660011 - DNA, 22 bp, Homo sapiens
tttcagcttgtttctatactgt

SEQ ID NO: 5660012 - DNA, 12 bp, Homo sapiens
tttcaggaaaat

SEQ ID NO: 5660013 - DNA, 13 bp, Homo sapiens
tttcaggaaagta

SEQ ID NO: 5660014 - DNA, 23 bp, Homo sapiens
tttcaggaaatttttgcatgttt

SEQ ID NO: 5660015 - DNA, 16 bp, Homo sapiens
tttcaggaatttaatt

SEQ ID NO: 5660016 - DNA, 20 bp, Homo sapiens
tttcaggactctctccagga

SEQ ID NO: 5660017 - DNA, 21 bp, Homo sapiens
tttcaggagattgttaattcc

SEQ ID NO: 5660018 - DNA, 12 bp, Homo sapiens
tttcaggaggaa

SEQ ID NO: 5660019 - DNA, 16 bp, Homo sapiens
tttcaggatactctgt

SEQ ID NO: 5660020 - DNA, 14 bp, Homo sapiens
tttcaggatctatt

SEQ ID NO: 5660021 - DNA, 22 bp, Homo sapiens
tttcaggattaactaaagaaga

SEQ ID NO: 5660022 - DNA, 22 bp, Homo sapiens
tttcaggcaaggcagctcccag

SEQ ID NO: 5660023 - DNA, 23 bp, Homo sapiens
tttcaggctactgttcttgacaa

SEQ ID NO: 5660024 - DNA, 20 bp, Homo sapiens
tttcaggctcgccaaggcct

SEQ ID NO: 5660025 - DNA, 21 bp, Homo sapiens
tttcagggacctcaggggcac

SEQ ID NO: 5660026 - DNA, 19 bp, Homo sapiens
tttcagggagaaactccaa

SEQ ID NO: 5660027 - DNA, 22 bp, Homo sapiens
tttcaggggctgactctccagg

SEQ ID NO: 5660028 - DNA, 23 bp, Homo sapiens
tttcagggggcctttaaagactt

SEQ ID NO: 5660029 - DNA, 20 bp, Homo sapiens
tttcagggtcttggctgcct

SEQ ID NO: 5660030 - DNA, 16 bp, Homo sapiens
tttcagggttttctga

SEQ ID NO: 5660031 - DNA, 22 bp, Homo sapiens
tttcaggtagaggtgcatgcct

SEQ ID NO: 5660032 - DNA, 16 bp, Homo sapiens
tttcaggtctggggct

SEQ ID NO: 5660033 - DNA, 19 bp, Homo sapiens
tttcaggtgacatgtgaaa

SEQ ID NO: 5660034 - DNA, 12 bp, Homo sapiens
tttcaggttcct

SEQ ID NO: 5660035 - DNA, 19 bp, Homo sapiens
tttcaggtttccattctgc

SEQ ID NO: 5660036 - DNA, 14 bp, Homo sapiens
tttcaggttttagt

SEQ ID NO: 5660037 - DNA, 15 bp, Homo sapiens
tttcagtaatagctg

SEQ ID NO: 5660038 - DNA, 16 bp, Homo sapiens
tttcagtaatagctga

SEQ ID NO: 5660039 - DNA, 23 bp, Homo sapiens
tttcagtaatagctgaacctgtt

SEQ ID NO: 5660040 - DNA, 13 bp, Homo sapiens
tttcagtaccaaa

SEQ ID NO: 5660041 - DNA, 17 bp, Homo sapiens
tttcagtactcttatta

SEQ ID NO: 5660042 - DNA, 22 bp, Homo sapiens
tttcagtacttcagcaagagag

SEQ ID NO: 5660043 - DNA, 16 bp, Homo sapiens
tttcagtactttttta

SEQ ID NO: 5660044 - DNA, 18 bp, Homo sapiens
tttcagtagaattttagt

SEQ ID NO: 5660045 - DNA, 14 bp, Homo sapiens
tttcagtagcagga

SEQ ID NO: 5660046 - DNA, 18 bp, Homo sapiens
tttcagtatactgtgtgg

SEQ ID NO: 5660047 - DNA, 17 bp, Homo sapiens
tttcagtatcatctcca

SEQ ID NO: 5660048 - DNA, 23 bp, Homo sapiens
tttcagtcaagttccgtctcctc

SEQ ID NO: 5660049 - DNA, 21 bp, Homo sapiens
tttcagtcaattctgatgtta

SEQ ID NO: 5660050 - DNA, 22 bp, Homo sapiens
tttcagtcaattctgatgttac

SEQ ID NO: 5660051 - DNA, 18 bp, Homo sapiens
tttcagtccagaagaatt

SEQ ID NO: 5660052 - DNA, 16 bp, Homo sapiens
tttcagtcccctctct

SEQ ID NO: 5660053 - DNA, 17 bp, Homo sapiens
tttcagtcttttcctgt

SEQ ID NO: 5660054 - DNA, 21 bp, Homo sapiens
tttcagtgatatctttctcat

SEQ ID NO: 5660055 - DNA, 16 bp, Homo sapiens
tttcagtgcagtaatt

SEQ ID NO: 5660056 - DNA, 21 bp, Homo sapiens
tttcagtgcagtaatttctga

SEQ ID NO: 5660057 - DNA, 17 bp, Homo sapiens
tttcagtgcatcattac

SEQ ID NO: 5660058 - DNA, 14 bp, Homo sapiens
tttcagtgcctgct

SEQ ID NO: 5660059 - DNA, 16 bp, Homo sapiens
tttcagtgctgctgaa

SEQ ID NO: 5660060 - DNA, 21 bp, Homo sapiens
tttcagtgctttctcaaaatt

SEQ ID NO: 5660061 - DNA, 21 bp, Homo sapiens
tttcagtggaccctgtggcca

SEQ ID NO: 5660062 - DNA, 21 bp, Homo sapiens
tttcagtggctggaattaaaa

SEQ ID NO: 5660063 - DNA, 23 bp, Homo sapiens
tttcagtggctggaattaaaaca

SEQ ID NO: 5660064 - DNA, 19 bp, Homo sapiens
tttcagtgtattgtttatt

SEQ ID NO: 5660065 - DNA, 23 bp, Homo sapiens
tttcagtgtcaaataaacactgt

SEQ ID NO: 5660066 - DNA, 16 bp, Homo sapiens
tttcagtgttacctgt

SEQ ID NO: 5660067 - DNA, 15 bp, Homo sapiens
tttcagtgttttcat

SEQ ID NO: 5660068 - DNA, 17 bp, Homo sapiens
tttcagttaagttgctg

SEQ ID NO: 5660069 - DNA, 13 bp, Homo sapiens
tttcagttcaaag

SEQ ID NO: 5660070 - DNA, 17 bp, Homo sapiens
tttcagttcaaagtcat

SEQ ID NO: 5660071 - DNA, 18 bp, Homo sapiens
tttcagttctatttaaaa

SEQ ID NO: 5660072 - DNA, 14 bp, Homo sapiens
tttcagttttggtg

SEQ ID NO: 5660073 - DNA, 24 bp, Homo sapiens
tttcagttttggtgataatcgtct

SEQ ID NO: 5660074 - DNA, 12 bp, Homo sapiens
tttcagtttttt

SEQ ID NO: 5660075 - DNA, 15 bp, Homo sapiens
tttcataaaaggaga

SEQ ID NO: 5660076 - DNA, 12 bp, Homo sapiens
tttcataaagca

SEQ ID NO: 5660077 - DNA, 22 bp, Homo sapiens
tttcataaataaaggtgtagaa

SEQ ID NO: 5660078 - DNA, 18 bp, Homo sapiens
tttcataaattatttgat

SEQ ID NO: 5660079 - DNA, 15 bp, Homo sapiens
tttcataagatattt

SEQ ID NO: 5660080 - DNA, 18 bp, Homo sapiens
tttcataaggcctgccct

SEQ ID NO: 5660081 - DNA, 19 bp, Homo sapiens
tttcataaggcctgccctc

SEQ ID NO: 5660082 - DNA, 20 bp, Homo sapiens
tttcataaggcctgccctcc

SEQ ID NO: 5660083 - DNA, 17 bp, Homo sapiens
tttcataagtatttcaa

SEQ ID NO: 5660084 - DNA, 14 bp, Homo sapiens
tttcataataaata

SEQ ID NO: 5660085 - DNA, 20 bp, Homo sapiens
tttcataataaatagacact

SEQ ID NO: 5660086 - DNA, 15 bp, Homo sapiens
tttcataatcagtaa

SEQ ID NO: 5660087 - DNA, 12 bp, Homo sapiens
tttcataatctt

SEQ ID NO: 5660088 - DNA, 13 bp, Homo sapiens
tttcataattcat

SEQ ID NO: 5660089 - DNA, 15 bp, Homo sapiens
tttcataattctgaa

SEQ ID NO: 5660090 - DNA, 16 bp, Homo sapiens
tttcataattctgaaa

SEQ ID NO: 5660091 - DNA, 15 bp, Homo sapiens
tttcataattgccta

SEQ ID NO: 5660092 - DNA, 23 bp, Homo sapiens
tttcataattgcctacatttatc

SEQ ID NO: 5660093 - DNA, 13 bp, Homo sapiens
tttcataatttgt

SEQ ID NO: 5660094 - DNA, 16 bp, Homo sapiens
tttcatacattttcta

SEQ ID NO: 5660095 - DNA, 20 bp, Homo sapiens
tttcatacattttctaagaa

SEQ ID NO: 5660096 - DNA, 19 bp, Homo sapiens
tttcatactatttagattt

SEQ ID NO: 5660097 - DNA, 18 bp, Homo sapiens
tttcatactctagatttt

SEQ ID NO: 5660098 - DNA, 19 bp, Homo sapiens
tttcatactctagattttg

SEQ ID NO: 5660099 - DNA, 22 bp, Homo sapiens
tttcatactctagattttgttt

SEQ ID NO: 5660100 - DNA, 19 bp, Homo sapiens
tttcatactgtacacattt

SEQ ID NO: 5660101 - DNA, 20 bp, Homo sapiens
tttcatactgtacacatttc

SEQ ID NO: 5660102 - DNA, 14 bp, Homo sapiens
tttcatacttttct

SEQ ID NO: 5660103 - DNA, 16 bp, Homo sapiens
tttcataggtctgaaa

SEQ ID NO: 5660104 - DNA, 18 bp, Homo sapiens
tttcataggttactacct

SEQ ID NO: 5660105 - DNA, 17 bp, Homo sapiens
tttcatagtataacttt

SEQ ID NO: 5660106 - DNA, 22 bp, Homo sapiens
tttcatagtgcctttttcctta

SEQ ID NO: 5660107 - DNA, 13 bp, Homo sapiens
tttcatagttctg

SEQ ID NO: 5660108 - DNA, 16 bp, Homo sapiens
tttcatagttctgtta

SEQ ID NO: 5660109 - DNA, 14 bp, Homo sapiens
tttcatagtttatt

SEQ ID NO: 5660110 - DNA, 22 bp, Homo sapiens
tttcatagtttattattattaa

SEQ ID NO: 5660111 - DNA, 18 bp, Homo sapiens
tttcatagttttctaaat

SEQ ID NO: 5660112 - DNA, 18 bp, Homo sapiens
tttcatataaatggaatt

SEQ ID NO: 5660113 - DNA, 17 bp, Homo sapiens
tttcatatattattccg

SEQ ID NO: 5660114 - DNA, 15 bp, Homo sapiens
tttcatatcatttct

SEQ ID NO: 5660115 - DNA, 17 bp, Homo sapiens
tttcatatctacagata

SEQ ID NO: 5660116 - DNA, 19 bp, Homo sapiens
tttcatattattttagtgt

SEQ ID NO: 5660117 - DNA, 15 bp, Homo sapiens
tttcatattgtgcca

SEQ ID NO: 5660118 - DNA, 16 bp, Homo sapiens
tttcctatgactaatt

SEQ ID NO: 5660119 - DNA, 14 bp, Homo sapiens
tttcctatgatgta

SEQ ID NO: 5660120 - DNA, 18 bp, Homo sapiens
tttcctatgatgtatact

SEQ ID NO: 5660121 - DNA, 18 bp, Homo sapiens
tttcctatgctctgggtg

SEQ ID NO: 5660122 - DNA, 17 bp, Homo sapiens
tttcctatgggaacaat

SEQ ID NO: 5660123 - DNA, 15 bp, Homo sapiens
tttcctattctgttg

SEQ ID NO: 5660124 - DNA, 13 bp, Homo sapiens
tttcctatttaat

SEQ ID NO: 5660125 - DNA, 16 bp, Homo sapiens
tttcctatttcagtgt

SEQ ID NO: 5660126 - DNA, 14 bp, Homo sapiens
tttcctattttaaa

SEQ ID NO: 5660127 - DNA, 22 bp, Homo sapiens
tttcctcaaaacttcagacata

SEQ ID NO: 5660128 - DNA, 21 bp, Homo sapiens
tttcctcaagcaataattgtt

SEQ ID NO: 5660129 - DNA, 19 bp, Homo sapiens
tttcctcaagtatcttcta

SEQ ID NO: 5660130 - DNA, 22 bp, Homo sapiens
tttcctcaagtatcttctattt

SEQ ID NO: 5660131 - DNA, 14 bp, Homo sapiens
tttcctcaccagtc

SEQ ID NO: 5660132 - DNA, 15 bp, Homo sapiens
tttcctcactgcctg

SEQ ID NO: 5660133 - DNA, 16 bp, Homo sapiens
tttcctcagaacatga

SEQ ID NO: 5660134 - DNA, 11 bp, Homo sapiens
tttcctcagtg

SEQ ID NO: 5660135 - DNA, 12 bp, Homo sapiens
tttcctcatctg

SEQ ID NO: 5660136 - DNA, 14 bp, Homo sapiens
tttcctcatgtaac

SEQ ID NO: 5660137 - DNA, 20 bp, Homo sapiens
tttcctcatgtaacattggt

SEQ ID NO: 5660138 - DNA, 19 bp, Homo sapiens
tttcctcattcctgaaaga

SEQ ID NO: 5660139 - DNA, 23 bp, Homo sapiens
tttcctcattgagaattcaaatc

SEQ ID NO: 5660140 - DNA, 22 bp, Homo sapiens
tttcctccaaatctgatttcat

SEQ ID NO: 5660141 - DNA, 16 bp, Homo sapiens
tttcctccagacagat

SEQ ID NO: 5660142 - DNA, 14 bp, Homo sapiens
tttcctcccaattc

SEQ ID NO: 5660143 - DNA, 12 bp, Homo sapiens
tttcctccccag

SEQ ID NO: 5660144 - DNA, 13 bp, Homo sapiens
tttcctccccata

SEQ ID NO: 5660145 - DNA, 17 bp, Homo sapiens
tttcctccccatacaca

SEQ ID NO: 5660146 - DNA, 18 bp, Homo sapiens
tttcctccccatacacac

SEQ ID NO: 5660147 - DNA, 18 bp, Homo sapiens
tttcctccccattcctac

SEQ ID NO: 5660148 - DNA, 17 bp, Homo sapiens
tttcctcccttctgata

SEQ ID NO: 5660149 - DNA, 17 bp, Homo sapiens
tttcctcccttctgcta

SEQ ID NO: 5660150 - DNA, 20 bp, Homo sapiens
tttcctcccttctgctactg

SEQ ID NO: 5660151 - DNA, 16 bp, Homo sapiens
tttcctcctaaacaaa

SEQ ID NO: 5660152 - DNA, 15 bp, Homo sapiens
tttcctcctccctgt

SEQ ID NO: 5660153 - DNA, 12 bp, Homo sapiens
tttcctcctctg

SEQ ID NO: 5660154 - DNA, 13 bp, Homo sapiens
tttcctcctctgc

SEQ ID NO: 5660155 - DNA, 14 bp, Homo sapiens
tttcctcctctgcc

SEQ ID NO: 5660156 - DNA, 15 bp, Homo sapiens
tttcctcctctgcct

SEQ ID NO: 5660157 - DNA, 10 bp, Homo sapiens
tttcctcctg

SEQ ID NO: 5660158 - DNA, 22 bp, Homo sapiens
tttcctcctgaggctttggatt

SEQ ID NO: 5660159 - DNA, 16 bp, Homo sapiens
tttcctcctttatcac

SEQ ID NO: 5660160 - DNA, 12 bp, Homo sapiens
tttcctcctttc

SEQ ID NO: 5660161 - DNA, 17 bp, Homo sapiens
tttcctcctttctctgt

SEQ ID NO: 5660162 - DNA, 22 bp, Homo sapiens
tttcctcgcagcctctcagtgc

SEQ ID NO: 5660163 - DNA, 19 bp, Homo sapiens
tttcctcgcctaggcctgt

SEQ ID NO: 5660164 - DNA, 16 bp, Homo sapiens
tttcctctaattaaaa

SEQ ID NO: 5660165 - DNA, 20 bp, Homo sapiens
tttcctctaattaaaatgtg

SEQ ID NO: 5660166 - DNA, 22 bp, Homo sapiens
tttcctctatacatctctcccc

SEQ ID NO: 5660167 - DNA, 19 bp, Homo sapiens
tttcctctattgatgtaca

SEQ ID NO: 5660168 - DNA, 22 bp, Homo sapiens
tttcctctccaattgtaaaaaa

SEQ ID NO: 5660169 - DNA, 14 bp, Homo sapiens
tttcctctccacac

SEQ ID NO: 5660170 - DNA, 13 bp, Homo sapiens
tttcctctcctct

SEQ ID NO: 5660171 - DNA, 17 bp, Homo sapiens
tttcctctcctctctgg

SEQ ID NO: 5660172 - DNA, 13 bp, Homo sapiens
tttcctctctatc

SEQ ID NO: 5660173 - DNA, 14 bp, Homo sapiens
tttcctctctctcc

SEQ ID NO: 5660174 - DNA, 24 bp, Homo sapiens
tttcctctctctctctctctctgt

SEQ ID NO: 5660175 - DNA, 14 bp, Homo sapiens
tttcctctctgtct

SEQ ID NO: 5660176 - DNA, 19 bp, Homo sapiens
tttcctctctttgttctca

SEQ ID NO: 5660177 - DNA, 13 bp, Homo sapiens
tttcctctgagcc

SEQ ID NO: 5660178 - DNA, 19 bp, Homo sapiens
tttcctctgagcccagctg

SEQ ID NO: 5660179 - DNA, 22 bp, Homo sapiens
tttcctctgagctgttatcttg

SEQ ID NO: 5660180 - DNA, 16 bp, Homo sapiens
tttcctctgttcacaa

SEQ ID NO: 5660181 - DNA, 23 bp, Homo sapiens
tttcctcttaatgtctcaaaata

SEQ ID NO: 5660182 - DNA, 17 bp, Homo sapiens
tttcctcttagaagaat

SEQ ID NO: 5660183 - DNA, 13 bp, Homo sapiens
tttcctcttcaga

SEQ ID NO: 5660184 - DNA, 15 bp, Homo sapiens
tttcctcttccttct

SEQ ID NO: 5660185 - DNA, 17 bp, Homo sapiens
tttcctcttccttctct

SEQ ID NO: 5660186 - DNA, 20 bp, Homo sapiens
tttcctctttacctgttcaa

SEQ ID NO: 5660187 - DNA, 17 bp, Homo sapiens
tttcctctttctgctct

SEQ ID NO: 5660188 - DNA, 17 bp, Homo sapiens
tttcctcttttgtgaga

SEQ ID NO: 5660189 - DNA, 21 bp, Homo sapiens
tttcctgaaagcagtaaccaa

SEQ ID NO: 5660190 - DNA, 19 bp, Homo sapiens
tttcctgaaataaatgttt

SEQ ID NO: 5660191 - DNA, 15 bp, Homo sapiens
tttcctgaagcattt

SEQ ID NO: 5660192 - DNA, 13 bp, Homo sapiens
tttcctgaatcta

SEQ ID NO: 5660193 - DNA, 23 bp, Homo sapiens
tttcctgacagaaggactcaggt

SEQ ID NO: 5660194 - DNA, 16 bp, Homo sapiens
tttcctgaggctgggc

SEQ ID NO: 5660195 - DNA, 15 bp, Homo sapiens
tttcctgataataaa

SEQ ID NO: 5660196 - DNA, 21 bp, Homo sapiens
tttcctgataataaatgtatt

SEQ ID NO: 5660197 - DNA, 18 bp, Homo sapiens
tttcctgatcaaggtgct

SEQ ID NO: 5660198 - DNA, 13 bp, Homo sapiens
tttcctgatgaca

SEQ ID NO: 5660199 - DNA, 16 bp, Homo sapiens
tttcctgatgcccctg

SEQ ID NO: 5660200 - DNA, 23 bp, Homo sapiens
tttcctgatggggaagggacttt

SEQ ID NO: 5660201 - DNA, 13 bp, Homo sapiens
tttcctgcatgtt

SEQ ID NO: 5660202 - DNA, 14 bp, Homo sapiens
tttcctgcccagcc

SEQ ID NO: 5660203 - DNA, 15 bp, Homo sapiens
tttcctgccctgtcc

SEQ ID NO: 5660204 - DNA, 18 bp, Homo sapiens
tttcctgcccttttcctg

SEQ ID NO: 5660205 - DNA, 19 bp, Homo sapiens
tttcctgccgagtgctctg

SEQ ID NO: 5660206 - DNA, 20 bp, Homo sapiens
tttcctgccgagtgctctga

SEQ ID NO: 5660207 - DNA, 17 bp, Homo sapiens
tttcctgccttcttctt

SEQ ID NO: 5660208 - DNA, 18 bp, Homo sapiens
tttcctgcgtcccagcct

SEQ ID NO: 5660209 - DNA, 19 bp, Homo sapiens
tttcctgcgtcccagcctg

SEQ ID NO: 5660210 - DNA, 20 bp, Homo sapiens
tttcctgctatattaacatc

SEQ ID NO: 5660211 - DNA, 15 bp, Homo sapiens
tttcctgctcctcca

SEQ ID NO: 5660212 - DNA, 18 bp, Homo sapiens
tttcctgctgtcttctcc

SEQ ID NO: 5660213 - DNA, 14 bp, Homo sapiens
tttcctggaagcag

SEQ ID NO: 5660214 - DNA, 12 bp, Homo sapiens
tttcctggaagt

SEQ ID NO: 5660215 - DNA, 21 bp, Homo sapiens
tttcctggaatttttcccctt

SEQ ID NO: 5660216 - DNA, 16 bp, Homo sapiens
tttcctggacactcag

SEQ ID NO: 5660217 - DNA, 15 bp, Homo sapiens
tttcctggacttaaa

SEQ ID NO: 5660218 - DNA, 16 bp, Homo sapiens
tttcctggatgtctga

SEQ ID NO: 5660219 - DNA, 15 bp, Homo sapiens
tttcctggatttata

SEQ ID NO: 5660220 - DNA, 19 bp, Homo sapiens
tttcctggcactgcttcca

SEQ ID NO: 5660221 - DNA, 16 bp, Homo sapiens
tttcctggcagctgct

SEQ ID NO: 5660222 - DNA, 16 bp, Homo sapiens
tttcctggccctccac

SEQ ID NO: 5660223 - DNA, 19 bp, Homo sapiens
tttcctggcctcagagctt

SEQ ID NO: 5660224 - DNA, 22 bp, Homo sapiens
tttcctggcctcagagcttcct

SEQ ID NO: 5660225 - DNA, 12 bp, Homo sapiens
tttcctgggagt

SEQ ID NO: 5660226 - DNA, 22 bp, Homo sapiens
tttcctgggagtgggagtcaag

SEQ ID NO: 5660227 - DNA, 19 bp, Homo sapiens
tttcctggtccatctcatt

SEQ ID NO: 5660228 - DNA, 14 bp, Homo sapiens
tttcctggtgccaa

SEQ ID NO: 5660229 - DNA, 20 bp, Homo sapiens
tttcctgtacaatcatgaac

SEQ ID NO: 5660230 - DNA, 19 bp, Homo sapiens
tttcctgtagccttctgta

SEQ ID NO: 5660231 - DNA, 20 bp, Homo sapiens
tttcctgtatgttgtacaat

SEQ ID NO: 5660232 - DNA, 12 bp, Homo sapiens
tttcctgtcaat

SEQ ID NO: 5660233 - DNA, 12 bp, Homo sapiens
tttcctgtcctc

SEQ ID NO: 5660234 - DNA, 17 bp, Homo sapiens
tttcctgtcttctttct

SEQ ID NO: 5660235 - DNA, 13 bp, Homo sapiens
tttcctgtgacac

SEQ ID NO: 5660236 - DNA, 12 bp, Homo sapiens
tttcctgtgagg

SEQ ID NO: 5660237 - DNA, 17 bp, Homo sapiens
tttcctgtgtttgtcct

SEQ ID NO: 5660238 - DNA, 22 bp, Homo sapiens
tttcctgtgtttgtcctgggtt

SEQ ID NO: 5660239 - DNA, 17 bp, Homo sapiens
tttcctgttctcttgta

SEQ ID NO: 5660240 - DNA, 12 bp, Homo sapiens
tttcctgttgaa

SEQ ID NO: 5660241 - DNA, 13 bp, Homo sapiens
tttcctgtttact

SEQ ID NO: 5660242 - DNA, 16 bp, Homo sapiens
tttcctgtttctgaaa

SEQ ID NO: 5660243 - DNA, 17 bp, Homo sapiens
tttcctgtttctgaaaa

SEQ ID NO: 5660244 - DNA, 21 bp, Homo sapiens
tttcctgtttgaaatatcatg

SEQ ID NO: 5660245 - DNA, 14 bp, Homo sapiens
tttccttaaacatg

SEQ ID NO: 5660246 - DNA, 15 bp, Homo sapiens
tttccttaaacatga

SEQ ID NO: 5660247 - DNA, 23 bp, Homo sapiens
tttccttaaactgtgtggactgt

SEQ ID NO: 5660248 - DNA, 19 bp, Homo sapiens
tttccttaaattatctaaa

SEQ ID NO: 5660249 - DNA, 15 bp, Homo sapiens
tttccttaactaaat

SEQ ID NO: 5660250 - DNA, 13 bp, Homo sapiens
tttccttaatcca

SEQ ID NO: 5660251 - DNA, 16 bp, Homo sapiens
tttccttaatccagct

SEQ ID NO: 5660252 - DNA, 18 bp, Homo sapiens
tttccttacataaacatc

SEQ ID NO: 5660253 - DNA, 19 bp, Homo sapiens
tttccttagtgccaggagg

SEQ ID NO: 5660254 - DNA, 19 bp, Homo sapiens
tttccttattgaaaaatca

SEQ ID NO: 5660255 - DNA, 14 bp, Homo sapiens
tttccttcaggttt

SEQ ID NO: 5660256 - DNA, 11 bp, Homo sapiens
tttccttcagt

SEQ ID NO: 5660257 - DNA, 18 bp, Homo sapiens
tttccttcagtgccttat

SEQ ID NO: 5660258 - DNA, 21 bp, Homo sapiens
tttccttcagtgccttatgga

SEQ ID NO: 5660259 - DNA, 22 bp, Homo sapiens
tttccttcagtgccttatggaa

SEQ ID NO: 5660260 - DNA, 21 bp, Homo sapiens
tttccttccaatgtctggaga

SEQ ID NO: 5660261 - DNA, 16 bp, Homo sapiens
tttccttccagcccat

SEQ ID NO: 5660262 - DNA, 19 bp, Homo sapiens
tttccttccatccctaccc

SEQ ID NO: 5660263 - DNA, 20 bp, Homo sapiens
tttccttccatgctcccaac

SEQ ID NO: 5660264 - DNA, 13 bp, Homo sapiens
tttccttcccaat

SEQ ID NO: 5660265 - DNA, 11 bp, Homo sapiens
tttccttccct

SEQ ID NO: 5660266 - DNA, 16 bp, Homo sapiens
tttccttccctaccca

SEQ ID NO: 5660267 - DNA, 16 bp, Homo sapiens
tttccttccctcaaag

SEQ ID NO: 5660268 - DNA, 19 bp, Homo sapiens
tttccttcccttttctgtt

SEQ ID NO: 5660269 - DNA, 12 bp, Homo sapiens
tttccttcctaa

SEQ ID NO: 5660270 - DNA, 21 bp, Homo sapiens
tttccttcctgccctgtacct

SEQ ID NO: 5660271 - DNA, 16 bp, Homo sapiens
tttccttctaacatgt

SEQ ID NO: 5660272 - DNA, 15 bp, Homo sapiens
tttccttctcatctg

SEQ ID NO: 5660273 - DNA, 18 bp, Homo sapiens
tttccttctcatctgtga

SEQ ID NO: 5660274 - DNA, 17 bp, Homo sapiens
tttccttctctgaaagt

SEQ ID NO: 5660275 - DNA, 14 bp, Homo sapiens
tttccttctgaagt

SEQ ID NO: 5660276 - DNA, 14 bp, Homo sapiens
tttccttctgtatt

SEQ ID NO: 5660277 - DNA, 18 bp, Homo sapiens
tttccttctgttaaaatg

SEQ ID NO: 5660278 - DNA, 16 bp, Homo sapiens
tttccttcttgccttc

SEQ ID NO: 5660279 - DNA, 12 bp, Homo sapiens
tttccttctttg

SEQ ID NO: 5660280 - DNA, 19 bp, Homo sapiens
tttccttgcatacaaacaa

SEQ ID NO: 5660281 - DNA, 12 bp, Homo sapiens
tttccttgcttt

SEQ ID NO: 5660282 - DNA, 16 bp, Homo sapiens
tttccttggctggtgc

SEQ ID NO: 5660283 - DNA, 18 bp, Homo sapiens
tttccttggggcaggcag

SEQ ID NO: 5660284 - DNA, 13 bp, Homo sapiens
tttccttgtatgt

SEQ ID NO: 5660285 - DNA, 19 bp, Homo sapiens
tttccttgtccccacactc

SEQ ID NO: 5660286 - DNA, 21 bp, Homo sapiens
tttccttgtggcagaggatgt

SEQ ID NO: 5660287 - DNA, 16 bp, Homo sapiens
tttccttgtttatcag

SEQ ID NO: 5660288 - DNA, 12 bp, Homo sapiens
tttcctttaaaa

SEQ ID NO: 5660289 - DNA, 13 bp, Homo sapiens
tttcctttaaaaa

SEQ ID NO: 5660290 - DNA, 22 bp, Homo sapiens
tttcctttaaaaaaatttaagt

SEQ ID NO: 5660291 - DNA, 17 bp, Homo sapiens
tttcctttaaatttcag

SEQ ID NO: 5660292 - DNA, 23 bp, Homo sapiens
tttcctttaactccctttttaca

SEQ ID NO: 5660293 - DNA, 21 bp, Homo sapiens
tttcctttaactgacaagcca

SEQ ID NO: 5660294 - DNA, 23 bp, Homo sapiens
tttcctttaccttttctataagt

SEQ ID NO: 5660295 - DNA, 19 bp, Homo sapiens
tttcctttatatttagtga

SEQ ID NO: 5660296 - DNA, 21 bp, Homo sapiens
tttcctttatgtgaattttta

SEQ ID NO: 5660297 - DNA, 21 bp, Homo sapiens
tttcctttcaataaagttgtt

SEQ ID NO: 5660298 - DNA, 18 bp, Homo sapiens
tttctggaatgtaatcaa

SEQ ID NO: 5660299 - DNA, 22 bp, Homo sapiens
tttctggaattgatgtttacat

SEQ ID NO: 5660300 - DNA, 21 bp, Homo sapiens
tttctggacattctctttgat

SEQ ID NO: 5660301 - DNA, 21 bp, Homo sapiens
tttctggactgaagcctgcag

SEQ ID NO: 5660302 - DNA, 12 bp, Homo sapiens
tttctggactgg

SEQ ID NO: 5660303 - DNA, 22 bp, Homo sapiens
tttctggaggttgataactttg

SEQ ID NO: 5660304 - DNA, 20 bp, Homo sapiens
tttctggagtgattctagag

SEQ ID NO: 5660305 - DNA, 15 bp, Homo sapiens
tttctggattctggg

SEQ ID NO: 5660306 - DNA, 15 bp, Homo sapiens
tttctggcaaatatt

SEQ ID NO: 5660307 - DNA, 23 bp, Homo sapiens
tttctggcaggtcctcccctctc

SEQ ID NO: 5660308 - DNA, 11 bp, Homo sapiens
tttctggccag

SEQ ID NO: 5660309 - DNA, 16 bp, Homo sapiens
tttctggcctgttatg

SEQ ID NO: 5660310 - DNA, 22 bp, Homo sapiens
tttctggcgcccctgcctgtgc

SEQ ID NO: 5660311 - DNA, 15 bp, Homo sapiens
tttctggctatgcat

SEQ ID NO: 5660312 - DNA, 11 bp, Homo sapiens
tttctggctcc

SEQ ID NO: 5660313 - DNA, 16 bp, Homo sapiens
tttctggctcctgtgt

SEQ ID NO: 5660314 - DNA, 16 bp, Homo sapiens
tttctggctgggtcac

SEQ ID NO: 5660315 - DNA, 19 bp, Homo sapiens
tttctggctgtgatcttaa

SEQ ID NO: 5660316 - DNA, 11 bp, Homo sapiens
tttctgggaaa

SEQ ID NO: 5660317 - DNA, 11 bp, Homo sapiens
tttctgggctc

SEQ ID NO: 5660318 - DNA, 18 bp, Homo sapiens
tttctgggctctggactc

SEQ ID NO: 5660319 - DNA, 19 bp, Homo sapiens
tttctgggctgtctattct

SEQ ID NO: 5660320 - DNA, 16 bp, Homo sapiens
tttctgggctttctcc

SEQ ID NO: 5660321 - DNA, 18 bp, Homo sapiens
tttctgggctttctcctg

SEQ ID NO: 5660322 - DNA, 20 bp, Homo sapiens
tttctgggctttctcctgga

SEQ ID NO: 5660323 - DNA, 23 bp, Homo sapiens
tttctgggcttttccttttgcac

SEQ ID NO: 5660324 - DNA, 19 bp, Homo sapiens
tttctggggcaactgagag

SEQ ID NO: 5660325 - DNA, 20 bp, Homo sapiens
tttctggggcaactgagagc

SEQ ID NO: 5660326 - DNA, 17 bp, Homo sapiens
tttctggggcccaggaa

SEQ ID NO: 5660327 - DNA, 14 bp, Homo sapiens
tttctggggcctag

SEQ ID NO: 5660328 - DNA, 20 bp, Homo sapiens
tttctggggggatatttcct

SEQ ID NO: 5660329 - DNA, 16 bp, Homo sapiens
tttctggggtttttct

SEQ ID NO: 5660330 - DNA, 19 bp, Homo sapiens
tttctggggtttttctgtt

SEQ ID NO: 5660331 - DNA, 11 bp, Homo sapiens
tttctgggtct

SEQ ID NO: 5660332 - DNA, 20 bp, Homo sapiens
tttctgggtgaaagagtcac

SEQ ID NO: 5660333 - DNA, 19 bp, Homo sapiens
tttctgggtttgaagctgc

SEQ ID NO: 5660334 - DNA, 15 bp, Homo sapiens
tttctggtagataga

SEQ ID NO: 5660335 - DNA, 19 bp, Homo sapiens
tttctggtagatagaaata

SEQ ID NO: 5660336 - DNA, 11 bp, Homo sapiens
tttctggtcaa

SEQ ID NO: 5660337 - DNA, 22 bp, Homo sapiens
tttctggtccctcttctctcct

SEQ ID NO: 5660338 - DNA, 20 bp, Homo sapiens
tttctggtgcacaggtttgt

SEQ ID NO: 5660339 - DNA, 24 bp, Homo sapiens
tttctggtgccatttctgaactgt

SEQ ID NO: 5660340 - DNA, 23 bp, Homo sapiens
tttctggtgcctatttattcatt

SEQ ID NO: 5660341 - DNA, 20 bp, Homo sapiens
tttctggtggcaaatgaatt

SEQ ID NO: 5660342 - DNA, 17 bp, Homo sapiens
tttctggtggtctgttg

SEQ ID NO: 5660343 - DNA, 21 bp, Homo sapiens
tttctggtgttttatttccta

SEQ ID NO: 5660344 - DNA, 14 bp, Homo sapiens
tttctggttccaaa

SEQ ID NO: 5660345 - DNA, 15 bp, Homo sapiens
tttctggttgatttg

SEQ ID NO: 5660346 - DNA, 16 bp, Homo sapiens
tttctggtttggcatg

SEQ ID NO: 5660347 - DNA, 14 bp, Homo sapiens
tttctgtaaatgaa

SEQ ID NO: 5660348 - DNA, 14 bp, Homo sapiens
tttctgtaacaaat

SEQ ID NO: 5660349 - DNA, 13 bp, Homo sapiens
tttctgtaccatt

SEQ ID NO: 5660350 - DNA, 22 bp, Homo sapiens
tttctgtagaatgctgtagaat

SEQ ID NO: 5660351 - DNA, 16 bp, Homo sapiens
tttctgtagactctaa

SEQ ID NO: 5660352 - DNA, 17 bp, Homo sapiens
tttctgtatactgtaaa

SEQ ID NO: 5660353 - DNA, 14 bp, Homo sapiens
tttctgtatagaca

SEQ ID NO: 5660354 - DNA, 21 bp, Homo sapiens
tttctgtatatgattctctgt

SEQ ID NO: 5660355 - DNA, 15 bp, Homo sapiens
tttctgtatatttgt

SEQ ID NO: 5660356 - DNA, 14 bp, Homo sapiens
tttctgtcagaatg

SEQ ID NO: 5660357 - DNA, 16 bp, Homo sapiens
tttctgtcagaatgct

SEQ ID NO: 5660358 - DNA, 16 bp, Homo sapiens
tttctgtccagaaaat

SEQ ID NO: 5660359 - DNA, 15 bp, Homo sapiens
tttctgtcccttctg

SEQ ID NO: 5660360 - DNA, 13 bp, Homo sapiens
tttctgtcctggg

SEQ ID NO: 5660361 - DNA, 17 bp, Homo sapiens
tttctgtctcccttctc

SEQ ID NO: 5660362 - DNA, 18 bp, Homo sapiens
tttctgtctcccttctct

SEQ ID NO: 5660363 - DNA, 20 bp, Homo sapiens
tttctgtctcccttctctct

SEQ ID NO: 5660364 - DNA, 21 bp, Homo sapiens
tttctgtctcccttctctctc

SEQ ID NO: 5660365 - DNA, 14 bp, Homo sapiens
tttctgtcttctct

SEQ ID NO: 5660366 - DNA, 14 bp, Homo sapiens
tttctgtgaaagaa

SEQ ID NO: 5660367 - DNA, 19 bp, Homo sapiens
tttctgtgaagcaaaaaga

SEQ ID NO: 5660368 - DNA, 19 bp, Homo sapiens
tttctgtgaagctaataca

SEQ ID NO: 5660369 - DNA, 20 bp, Homo sapiens
tttctgtgaagctaatacaa

SEQ ID NO: 5660370 - DNA, 14 bp, Homo sapiens
tttctgtgacattt

SEQ ID NO: 5660371 - DNA, 15 bp, Homo sapiens
tttctgtgacattta

SEQ ID NO: 5660372 - DNA, 18 bp, Homo sapiens
tttctgtgacatttatgt

SEQ ID NO: 5660373 - DNA, 20 bp, Homo sapiens
tttctgtgataactctgcaa

SEQ ID NO: 5660374 - DNA, 17 bp, Homo sapiens
tttctgtgcatgtgcag

SEQ ID NO: 5660375 - DNA, 13 bp, Homo sapiens
tttctgtgccctc

SEQ ID NO: 5660376 - DNA, 14 bp, Homo sapiens
tttctgtgcttgga

SEQ ID NO: 5660377 - DNA, 18 bp, Homo sapiens
tttctgtggaaaacaatt

SEQ ID NO: 5660378 - DNA, 21 bp, Homo sapiens
tttctgtggatacagtgccca

SEQ ID NO: 5660379 - DNA, 20 bp, Homo sapiens
tttctgtgtagtatttatat

SEQ ID NO: 5660380 - DNA, 11 bp, Homo sapiens
tttctgtgtgt

SEQ ID NO: 5660381 - DNA, 18 bp, Homo sapiens
tttctgtgtgtcagtttt

SEQ ID NO: 5660382 - DNA, 14 bp, Homo sapiens
tttctgtgtgttcc

SEQ ID NO: 5660383 - DNA, 18 bp, Homo sapiens
tttctgtgtgttcctggc

SEQ ID NO: 5660384 - DNA, 13 bp, Homo sapiens
tttctgtgtttag

SEQ ID NO: 5660385 - DNA, 22 bp, Homo sapiens
tttctgtgtttagctatttaat

SEQ ID NO: 5660386 - DNA, 20 bp, Homo sapiens
tttctgttcagcgttttgca

SEQ ID NO: 5660387 - DNA, 12 bp, Homo sapiens
tttctgttcatc

SEQ ID NO: 5660388 - DNA, 12 bp, Homo sapiens
tttctgttccaa

SEQ ID NO: 5660389 - DNA, 14 bp, Homo sapiens
tttctgttccaaat

SEQ ID NO: 5660390 - DNA, 16 bp, Homo sapiens
tttctgttccaaattc

SEQ ID NO: 5660391 - DNA, 13 bp, Homo sapiens
tttctgttccttt

SEQ ID NO: 5660392 - DNA, 11 bp, Homo sapiens
tttctgttctg

SEQ ID NO: 5660393 - DNA, 16 bp, Homo sapiens
tttctgttctgtggaa

SEQ ID NO: 5660394 - DNA, 22 bp, Homo sapiens
tttctgttctgtggaaagtgta

SEQ ID NO: 5660395 - DNA, 17 bp, Homo sapiens
tttctgttcttacaaat

SEQ ID NO: 5660396 - DNA, 14 bp, Homo sapiens
tttctgttgtaact

SEQ ID NO: 5660397 - DNA, 17 bp, Homo sapiens
tttctgttgttattcct

SEQ ID NO: 5660398 - DNA, 20 bp, Homo sapiens
tttctgttgttcacttggag

SEQ ID NO: 5660399 - DNA, 20 bp, Homo sapiens
tttctgtttactgtcaaaat

SEQ ID NO: 5660400 - DNA, 12 bp, Homo sapiens
tttctgtttata

SEQ ID NO: 5660401 - DNA, 18 bp, Homo sapiens
tttctgtttcctttttta

SEQ ID NO: 5660402 - DNA, 20 bp, Homo sapiens
tttctgtttcttcttgtgat

SEQ ID NO: 5660403 - DNA, 16 bp, Homo sapiens
tttctgtttgaatttt

SEQ ID NO: 5660404 - DNA, 14 bp, Homo sapiens
tttctgtttgtaaa

SEQ ID NO: 5660405 - DNA, 12 bp, Homo sapiens
tttctgttttct

SEQ ID NO: 5660406 - DNA, 20 bp, Homo sapiens
tttctgttttgtttttttct

SEQ ID NO: 5660407 - DNA, 16 bp, Homo sapiens
tttctgtttttatgtt

SEQ ID NO: 5660408 - DNA, 17 bp, Homo sapiens
tttcttaaaaagttata

SEQ ID NO: 5660409 - DNA, 23 bp, Homo sapiens
tttcttaaaaccaatcaataata

SEQ ID NO: 5660410 - DNA, 18 bp, Homo sapiens
tttcttaaaatgtcctat

SEQ ID NO: 5660411 - DNA, 21 bp, Homo sapiens
tttcttaaaatgtcctatgta

SEQ ID NO: 5660412 - DNA, 14 bp, Homo sapiens
tttcttaaaattca

SEQ ID NO: 5660413 - DNA, 16 bp, Homo sapiens
tttcttaaacaaatgt

SEQ ID NO: 5660414 - DNA, 15 bp, Homo sapiens
tttcttaaagctttt

SEQ ID NO: 5660415 - DNA, 13 bp, Homo sapiens
tttcttaaagtgc

SEQ ID NO: 5660416 - DNA, 12 bp, Homo sapiens
tttcttaaataa

SEQ ID NO: 5660417 - DNA, 23 bp, Homo sapiens
tttcttaaataatgcttcagata

SEQ ID NO: 5660418 - DNA, 12 bp, Homo sapiens
tttcttaaatat

SEQ ID NO: 5660419 - DNA, 22 bp, Homo sapiens
tttcttaaatggaattattttg

SEQ ID NO: 5660420 - DNA, 15 bp, Homo sapiens
tttcttaaatgggct

SEQ ID NO: 5660421 - DNA, 18 bp, Homo sapiens
tttcttaacttcttgctt

SEQ ID NO: 5660422 - DNA, 16 bp, Homo sapiens
tttcttaaggtgaggc

SEQ ID NO: 5660423 - DNA, 21 bp, Homo sapiens
tttcttaagtaatgatactgt

SEQ ID NO: 5660424 - DNA, 16 bp, Homo sapiens
tttcttaatatatagc

SEQ ID NO: 5660425 - DNA, 21 bp, Homo sapiens
tttcttaatcattttttatat

SEQ ID NO: 5660426 - DNA, 20 bp, Homo sapiens
tttcttaatgctatttgcca

SEQ ID NO: 5660427 - DNA, 14 bp, Homo sapiens
tttcttaatgggtg

SEQ ID NO: 5660428 - DNA, 20 bp, Homo sapiens
tttcttaatgtctgtcagaa

SEQ ID NO: 5660429 - DNA, 19 bp, Homo sapiens
tttcttaattatggtacct

SEQ ID NO: 5660430 - DNA, 12 bp, Homo sapiens
tttcttaatttg

SEQ ID NO: 5660431 - DNA, 17 bp, Homo sapiens
tttcttaatttggaaac

SEQ ID NO: 5660432 - DNA, 18 bp, Homo sapiens
tttcttacacaagagctg

SEQ ID NO: 5660433 - DNA, 19 bp, Homo sapiens
tttcttacacacccccaga

SEQ ID NO: 5660434 - DNA, 16 bp, Homo sapiens
tttcttacacactgtc

SEQ ID NO: 5660435 - DNA, 18 bp, Homo sapiens
tttcttacacactgtctg

SEQ ID NO: 5660436 - DNA, 20 bp, Homo sapiens
tttcttacagtaactgagtg

SEQ ID NO: 5660437 - DNA, 19 bp, Homo sapiens
tttcttacataatttgcaa

SEQ ID NO: 5660438 - DNA, 13 bp, Homo sapiens
tttcttaccaaaa

SEQ ID NO: 5660439 - DNA, 17 bp, Homo sapiens
tttcttacccagattgt

SEQ ID NO: 5660440 - DNA, 22 bp, Homo sapiens
tttcttacccatatatcttatg

SEQ ID NO: 5660441 - DNA, 13 bp, Homo sapiens
tttcttactagta

SEQ ID NO: 5660442 - DNA, 16 bp, Homo sapiens
tttcttagctttttaa

SEQ ID NO: 5660443 - DNA, 21 bp, Homo sapiens
tttcttagctttttaattgtt

SEQ ID NO: 5660444 - DNA, 21 bp, Homo sapiens
tttcttagtgcttcagagttt

SEQ ID NO: 5660445 - DNA, 16 bp, Homo sapiens
tttcttagttactttt

SEQ ID NO: 5660446 - DNA, 19 bp, Homo sapiens
tttcttagttactttttcc

SEQ ID NO: 5660447 - DNA, 12 bp, Homo sapiens
tttcttatccaa

SEQ ID NO: 5660448 - DNA, 17 bp, Homo sapiens
tttcttatcttctgcaa

SEQ ID NO: 5660449 - DNA, 13 bp, Homo sapiens
tttcttatcttga

SEQ ID NO: 5660450 - DNA, 23 bp, Homo sapiens
tttcttatgatttttaaaagttg

SEQ ID NO: 5660451 - DNA, 13 bp, Homo sapiens
tttcttatgtgac

SEQ ID NO: 5660452 - DNA, 19 bp, Homo sapiens
tttcttattctctgtttgc

SEQ ID NO: 5660453 - DNA, 15 bp, Homo sapiens
tttcttatttgcaat

SEQ ID NO: 5660454 - DNA, 13 bp, Homo sapiens
tttcttattttag

SEQ ID NO: 5660455 - DNA, 20 bp, Homo sapiens
tttcttattttgtaataaac

SEQ ID NO: 5660456 - DNA, 18 bp, Homo sapiens
tttcttcaaaaagcattt

SEQ ID NO: 5660457 - DNA, 17 bp, Homo sapiens
tttcttcaaacagtata

SEQ ID NO: 5660458 - DNA, 20 bp, Homo sapiens
tttcttcaagtgagtggcat

SEQ ID NO: 5660459 - DNA, 19 bp, Homo sapiens
tttcttcaccaagtgcaat

SEQ ID NO: 5660460 - DNA, 22 bp, Homo sapiens
tttcttcactgcaacatgatga

SEQ ID NO: 5660461 - DNA, 16 bp, Homo sapiens
tttcttcacttcaagc

SEQ ID NO: 5660462 - DNA, 13 bp, Homo sapiens
tttcttcactttt

SEQ ID NO: 5660463 - DNA, 12 bp, Homo sapiens
tttcttcagaat

SEQ ID NO: 5660464 - DNA, 19 bp, Homo sapiens
tttcttcagactgaggcct

SEQ ID NO: 5660465 - DNA, 19 bp, Homo sapiens
tttcttcagctgccagtgt

SEQ ID NO: 5660466 - DNA, 14 bp, Homo sapiens
tttcttcagggtaa

SEQ ID NO: 5660467 - DNA, 12 bp, Homo sapiens
tttcttcattgt

SEQ ID NO: 5660468 - DNA, 16 bp, Homo sapiens
tttcttcattgtaatc

SEQ ID NO: 5660469 - DNA, 18 bp, Homo sapiens
tttcttcatttctctgca

SEQ ID NO: 5660470 - DNA, 15 bp, Homo sapiens
tttcttccaacatgt

SEQ ID NO: 5660471 - DNA, 16 bp, Homo sapiens
tttcttccacgtaatt

SEQ ID NO: 5660472 - DNA, 20 bp, Homo sapiens
tttcttccacgtaattcaat

SEQ ID NO: 5660473 - DNA, 21 bp, Homo sapiens
tttcttcccagaatctctgag

SEQ ID NO: 5660474 - DNA, 12 bp, Homo sapiens
tttcttcccatt

SEQ ID NO: 5660475 - DNA, 13 bp, Homo sapiens
tttcttccccagt

SEQ ID NO: 5660476 - DNA, 20 bp, Homo sapiens
tttcttcccccgctaattca

SEQ ID NO: 5660477 - DNA, 15 bp, Homo sapiens
tttgaggtaaagata

SEQ ID NO: 5660478 - DNA, 23 bp, Homo sapiens
tttgaggtagaaatgcaaggggg

SEQ ID NO: 5660479 - DNA, 16 bp, Homo sapiens
tttgaggtagaggaaa

SEQ ID NO: 5660480 - DNA, 22 bp, Homo sapiens
tttgaggtagaggaaaatcaat

SEQ ID NO: 5660481 - DNA, 16 bp, Homo sapiens
tttgaggtgaaattca

SEQ ID NO: 5660482 - DNA, 13 bp, Homo sapiens
tttgagtaaaact

SEQ ID NO: 5660483 - DNA, 14 bp, Homo sapiens
tttgagtaaaactt

SEQ ID NO: 5660484 - DNA, 12 bp, Homo sapiens
tttgagtaattc

SEQ ID NO: 5660485 - DNA, 20 bp, Homo sapiens
tttgagtacagatactgtga

SEQ ID NO: 5660486 - DNA, 19 bp, Homo sapiens
tttgagtagatattacttt

SEQ ID NO: 5660487 - DNA, 20 bp, Homo sapiens
tttgagtagatattacttta

SEQ ID NO: 5660488 - DNA, 17 bp, Homo sapiens
tttgagtatggctatct

SEQ ID NO: 5660489 - DNA, 13 bp, Homo sapiens
tttgagtcattga

SEQ ID NO: 5660490 - DNA, 18 bp, Homo sapiens
tttgagtcattgacttca

SEQ ID NO: 5660491 - DNA, 22 bp, Homo sapiens
tttgagtcattgacttcatttt

SEQ ID NO: 5660492 - DNA, 21 bp, Homo sapiens
tttgagtcctaggacttaaaa

SEQ ID NO: 5660493 - DNA, 20 bp, Homo sapiens
tttgagtcttggtgctatca

SEQ ID NO: 5660494 - DNA, 14 bp, Homo sapiens
tttgagtgctctga

SEQ ID NO: 5660495 - DNA, 17 bp, Homo sapiens
tttgagtgtatacatgt

SEQ ID NO: 5660496 - DNA, 17 bp, Homo sapiens
tttgagtgtatgctgta

SEQ ID NO: 5660497 - DNA, 21 bp, Homo sapiens
tttgagtgtcaggctctgaat

SEQ ID NO: 5660498 - DNA, 15 bp, Homo sapiens
tttgagttcaaattt

SEQ ID NO: 5660499 - DNA, 21 bp, Homo sapiens
tttgagtttcagctggaaact

SEQ ID NO: 5660500 - DNA, 22 bp, Homo sapiens
tttgagtttctttcagatcatt

SEQ ID NO: 5660501 - DNA, 17 bp, Homo sapiens
tttgagtttgctgtttt

SEQ ID NO: 5660502 - DNA, 19 bp, Homo sapiens
tttgagtttttcctcccag

SEQ ID NO: 5660503 - DNA, 13 bp, Homo sapiens
tttgataaaaacc

SEQ ID NO: 5660504 - DNA, 16 bp, Homo sapiens
tttgataaacattcct

SEQ ID NO: 5660505 - DNA, 15 bp, Homo sapiens
tttgataaagtaaaa

SEQ ID NO: 5660506 - DNA, 19 bp, Homo sapiens
tttgataaagtaaaaaagt

SEQ ID NO: 5660507 - DNA, 18 bp, Homo sapiens
tttgataaagtaataatg

SEQ ID NO: 5660508 - DNA, 22 bp, Homo sapiens
tttgataaagtaattcatacaa

SEQ ID NO: 5660509 - DNA, 14 bp, Homo sapiens
tttgataaagtagt

SEQ ID NO: 5660510 - DNA, 19 bp, Homo sapiens
tttgataaagtttctcaga

SEQ ID NO: 5660511 - DNA, 12 bp, Homo sapiens
tttgataaatta

SEQ ID NO: 5660512 - DNA, 16 bp, Homo sapiens
tttgataaattactaa

SEQ ID NO: 5660513 - DNA, 13 bp, Homo sapiens
tttgataacaaaa

SEQ ID NO: 5660514 - DNA, 14 bp, Homo sapiens
tttgataactgttt

SEQ ID NO: 5660515 - DNA, 20 bp, Homo sapiens
tttgataactgtttatatgt

SEQ ID NO: 5660516 - DNA, 22 bp, Homo sapiens
tttgataactgtttatatgtgt

SEQ ID NO: 5660517 - DNA, 17 bp, Homo sapiens
tttgataatgacactgt

SEQ ID NO: 5660518 - DNA, 14 bp, Homo sapiens
tttgataatgataa

SEQ ID NO: 5660519 - DNA, 15 bp, Homo sapiens
tttgataatgataaa

SEQ ID NO: 5660520 - DNA, 23 bp, Homo sapiens
tttgataatgttaaatttgtaag

SEQ ID NO: 5660521 - DNA, 13 bp, Homo sapiens
tttgataattgtt

SEQ ID NO: 5660522 - DNA, 20 bp, Homo sapiens
tttgataattttgaaatgat

SEQ ID NO: 5660523 - DNA, 12 bp, Homo sapiens
tttgatacaaat

SEQ ID NO: 5660524 - DNA, 16 bp, Homo sapiens
tttgatacaggaatta

SEQ ID NO: 5660525 - DNA, 11 bp, Homo sapiens
tttgatacatt

SEQ ID NO: 5660526 - DNA, 13 bp, Homo sapiens
tttgatacattta

SEQ ID NO: 5660527 - DNA, 14 bp, Homo sapiens
tttgatacatttat

SEQ ID NO: 5660528 - DNA, 16 bp, Homo sapiens
tttgatacatttatct

SEQ ID NO: 5660529 - DNA, 14 bp, Homo sapiens
tttgatacattttt

SEQ ID NO: 5660530 - DNA, 16 bp, Homo sapiens
tttgatacccctgggg

SEQ ID NO: 5660531 - DNA, 17 bp, Homo sapiens
tttgatactaagcattg

SEQ ID NO: 5660532 - DNA, 18 bp, Homo sapiens
tttgatactaagcattga

SEQ ID NO: 5660533 - DNA, 13 bp, Homo sapiens
tttgatacttata

SEQ ID NO: 5660534 - DNA, 15 bp, Homo sapiens
tttgatacttatatt

SEQ ID NO: 5660535 - DNA, 13 bp, Homo sapiens
tttgatagatgtt

SEQ ID NO: 5660536 - DNA, 19 bp, Homo sapiens
tttgatagatgtttgactt

SEQ ID NO: 5660537 - DNA, 18 bp, Homo sapiens
tttgatagtattgtgcat

SEQ ID NO: 5660538 - DNA, 13 bp, Homo sapiens
tttgatagtgctt

SEQ ID NO: 5660539 - DNA, 15 bp, Homo sapiens
tttgatataatcttg

SEQ ID NO: 5660540 - DNA, 16 bp, Homo sapiens
tttgatatacattgtg

SEQ ID NO: 5660541 - DNA, 21 bp, Homo sapiens
tttgatataccaaattaaaaa

SEQ ID NO: 5660542 - DNA, 20 bp, Homo sapiens
tttgatatcacagtctaatt

SEQ ID NO: 5660543 - DNA, 23 bp, Homo sapiens
tttgatatccaaagctgaataca

SEQ ID NO: 5660544 - DNA, 17 bp, Homo sapiens
tttgatatgttgatgaa

SEQ ID NO: 5660545 - DNA, 13 bp, Homo sapiens
tttgatattgaga

SEQ ID NO: 5660546 - DNA, 18 bp, Homo sapiens
tttgatattgagacatta

SEQ ID NO: 5660547 - DNA, 17 bp, Homo sapiens
tttgatatttgcattga

SEQ ID NO: 5660548 - DNA, 15 bp, Homo sapiens
tttgatattttcaca

SEQ ID NO: 5660549 - DNA, 17 bp, Homo sapiens
tttgatatttttttact

SEQ ID NO: 5660550 - DNA, 16 bp, Homo sapiens
tttgatcaaatgtaca

SEQ ID NO: 5660551 - DNA, 20 bp, Homo sapiens
tttgatcaaatgtacatctc

SEQ ID NO: 5660552 - DNA, 16 bp, Homo sapiens
tttgatcatccctttc

SEQ ID NO: 5660553 - DNA, 14 bp, Homo sapiens
tttgatcatttctg

SEQ ID NO: 5660554 - DNA, 15 bp, Homo sapiens
tttgatccaagctgg

SEQ ID NO: 5660555 - DNA, 16 bp, Homo sapiens
tttgatcctctactgt

SEQ ID NO: 5660556 - DNA, 16 bp, Homo sapiens
tttgatccttcccctc

SEQ ID NO: 5660557 - DNA, 13 bp, Homo sapiens
tttgatccttgga

SEQ ID NO: 5660558 - DNA, 16 bp, Homo sapiens
tttgatccttggaaac

SEQ ID NO: 5660559 - DNA, 21 bp, Homo sapiens
tttgatcgcctctttgacatt

SEQ ID NO: 5660560 - DNA, 22 bp, Homo sapiens
tttgatcgcttttaataaactg

SEQ ID NO: 5660561 - DNA, 19 bp, Homo sapiens
tttgatctattaagggatt

SEQ ID NO: 5660562 - DNA, 14 bp, Homo sapiens
tttgatctcacatt

SEQ ID NO: 5660563 - DNA, 24 bp, Homo sapiens
tttgatctcagcatcctggaaatt

SEQ ID NO: 5660564 - DNA, 13 bp, Homo sapiens
tttgatctggtgc

SEQ ID NO: 5660565 - DNA, 22 bp, Homo sapiens
tttgatcttcctctgctaaatt

SEQ ID NO: 5660566 - DNA, 23 bp, Homo sapiens
tttgatcttgtgctatgaaacaa

SEQ ID NO: 5660567 - DNA, 18 bp, Homo sapiens
tttgatgaataaaatgtt

SEQ ID NO: 5660568 - DNA, 20 bp, Homo sapiens
tttgatgagatattaaattc

SEQ ID NO: 5660569 - DNA, 18 bp, Homo sapiens
tttgatgaggccctccac

SEQ ID NO: 5660570 - DNA, 12 bp, Homo sapiens
tttgatgataaa

SEQ ID NO: 5660571 - DNA, 22 bp, Homo sapiens
tttgatgataaaaggagaataa

SEQ ID NO: 5660572 - DNA, 22 bp, Homo sapiens
tttgatgcagataaaatatttt

SEQ ID NO: 5660573 - DNA, 20 bp, Homo sapiens
tttgatgcagcatttgataa

SEQ ID NO: 5660574 - DNA, 21 bp, Homo sapiens
tttgatgcagcatttgataat

SEQ ID NO: 5660575 - DNA, 22 bp, Homo sapiens
tttgatgcatgtcttttaaaat

SEQ ID NO: 5660576 - DNA, 16 bp, Homo sapiens
tttgatgccaagaaag

SEQ ID NO: 5660577 - DNA, 20 bp, Homo sapiens
tttgatgccatttgtctttt

SEQ ID NO: 5660578 - DNA, 17 bp, Homo sapiens
tttgatgcccagacagc

SEQ ID NO: 5660579 - DNA, 18 bp, Homo sapiens
tttgatgctatttatgca

SEQ ID NO: 5660580 - DNA, 16 bp, Homo sapiens
tttgatgctgagtcat

SEQ ID NO: 5660581 - DNA, 16 bp, Homo sapiens
tttgatgctggagagg

SEQ ID NO: 5660582 - DNA, 13 bp, Homo sapiens
tttgatgctgtat

SEQ ID NO: 5660583 - DNA, 15 bp, Homo sapiens
tttgatgctgtttga

SEQ ID NO: 5660584 - DNA, 16 bp, Homo sapiens
tttgatggaaaaagaa

SEQ ID NO: 5660585 - DNA, 19 bp, Homo sapiens
tttgatggagggtggaaat

SEQ ID NO: 5660586 - DNA, 16 bp, Homo sapiens
tttgatggctatgttt

SEQ ID NO: 5660587 - DNA, 13 bp, Homo sapiens
tttgatggggaga

SEQ ID NO: 5660588 - DNA, 14 bp, Homo sapiens
tttgatggggagaa

SEQ ID NO: 5660589 - DNA, 15 bp, Homo sapiens
tttgatggtgaatat

SEQ ID NO: 5660590 - DNA, 20 bp, Homo sapiens
tttgatgtaaagatgttctg

SEQ ID NO: 5660591 - DNA, 12 bp, Homo sapiens
tttgatgtaata

SEQ ID NO: 5660592 - DNA, 12 bp, Homo sapiens
tttgatgtacat

SEQ ID NO: 5660593 - DNA, 10 bp, Homo sapiens
tttgatgtat

SEQ ID NO: 5660594 - DNA, 20 bp, Homo sapiens
tttgatgtataaaacttgat

SEQ ID NO: 5660595 - DNA, 14 bp, Homo sapiens
tttgatgtatatat

SEQ ID NO: 5660596 - DNA, 17 bp, Homo sapiens
tttgatgtatgtgtgaa

SEQ ID NO: 5660597 - DNA, 21 bp, Homo sapiens
tttgatgtatgtgtgaaacaa

SEQ ID NO: 5660598 - DNA, 14 bp, Homo sapiens
tttgatgtgacaat

SEQ ID NO: 5660599 - DNA, 13 bp, Homo sapiens
tttgatgtgactt

SEQ ID NO: 5660600 - DNA, 12 bp, Homo sapiens
tttgatgtgcct

SEQ ID NO: 5660601 - DNA, 21 bp, Homo sapiens
tttgatgtgcgtgctgtctgt

SEQ ID NO: 5660602 - DNA, 13 bp, Homo sapiens
tttgatgtgtatg

SEQ ID NO: 5660603 - DNA, 14 bp, Homo sapiens
tttgatgttaacac

SEQ ID NO: 5660604 - DNA, 17 bp, Homo sapiens
tttgattaaattatgaa

SEQ ID NO: 5660605 - DNA, 13 bp, Homo sapiens
tttgattaaattc

SEQ ID NO: 5660606 - DNA, 14 bp, Homo sapiens
tttgattaacaaat

SEQ ID NO: 5660607 - DNA, 15 bp, Homo sapiens
tttgattaacaaata

SEQ ID NO: 5660608 - DNA, 16 bp, Homo sapiens
tttgattaacaaatat

SEQ ID NO: 5660609 - DNA, 19 bp, Homo sapiens
tttgattaacaatgtattt

SEQ ID NO: 5660610 - DNA, 15 bp, Homo sapiens
tttgattaacatttg

SEQ ID NO: 5660611 - DNA, 20 bp, Homo sapiens
tttgattaagtggttacttt

SEQ ID NO: 5660612 - DNA, 17 bp, Homo sapiens
tttgattaatgaagaaa

SEQ ID NO: 5660613 - DNA, 13 bp, Homo sapiens
tttgattaatgtt

SEQ ID NO: 5660614 - DNA, 17 bp, Homo sapiens
tttgattaatgtttctt

SEQ ID NO: 5660615 - DNA, 14 bp, Homo sapiens
tttgattattatgt

SEQ ID NO: 5660616 - DNA, 16 bp, Homo sapiens
tttgattatttgcatg

SEQ ID NO: 5660617 - DNA, 18 bp, Homo sapiens
tttgattcagctcattat

SEQ ID NO: 5660618 - DNA, 13 bp, Homo sapiens
tttgattcatttt

SEQ ID NO: 5660619 - DNA, 22 bp, Homo sapiens
tttgattccaatccaattatca

SEQ ID NO: 5660620 - DNA, 12 bp, Homo sapiens
tttgattctcct

SEQ ID NO: 5660621 - DNA, 13 bp, Homo sapiens
tttgattctcctt

SEQ ID NO: 5660622 - DNA, 14 bp, Homo sapiens
tttgattctccttc

SEQ ID NO: 5660623 - DNA, 16 bp, Homo sapiens
tttgattctccttcag

SEQ ID NO: 5660624 - DNA, 10 bp, Homo sapiens
tttgattggc

SEQ ID NO: 5660625 - DNA, 20 bp, Homo sapiens
tttgattgtaaaaacaaaaa

SEQ ID NO: 5660626 - DNA, 18 bp, Homo sapiens
tttgattgtttgatgaat

SEQ ID NO: 5660627 - DNA, 23 bp, Homo sapiens
tttgatttacagtgcctgtatct

SEQ ID NO: 5660628 - DNA, 13 bp, Homo sapiens
tttgatttacata

SEQ ID NO: 5660629 - DNA, 12 bp, Homo sapiens
tttgatttatgg

SEQ ID NO: 5660630 - DNA, 13 bp, Homo sapiens
tttgatttattaa

SEQ ID NO: 5660631 - DNA, 16 bp, Homo sapiens
tttgatttattaactt

SEQ ID NO: 5660632 - DNA, 18 bp, Homo sapiens
tttgatttccaagtaata

SEQ ID NO: 5660633 - DNA, 17 bp, Homo sapiens
tttgatttgaatgtaaa

SEQ ID NO: 5660634 - DNA, 18 bp, Homo sapiens
tttgatttgatatacaga

SEQ ID NO: 5660635 - DNA, 14 bp, Homo sapiens
tttgatttgtacag

SEQ ID NO: 5660636 - DNA, 14 bp, Homo sapiens
tttgatttgtcact

SEQ ID NO: 5660637 - DNA, 20 bp, Homo sapiens
tttgattttaaaaagaagaa

SEQ ID NO: 5660638 - DNA, 14 bp, Homo sapiens
tttgattttgctga

SEQ ID NO: 5660639 - DNA, 16 bp, Homo sapiens
tttgatttttaaatca

SEQ ID NO: 5660640 - DNA, 22 bp, Homo sapiens
tttgatttttatccatttcttt

SEQ ID NO: 5660641 - DNA, 17 bp, Homo sapiens
tttgatttttttgttca

SEQ ID NO: 5660642 - DNA, 18 bp, Homo sapiens
tttgcaaaaaatgttttt

SEQ ID NO: 5660643 - DNA, 18 bp, Homo sapiens
tttgcaaaatcacttagc

SEQ ID NO: 5660644 - DNA, 16 bp, Homo sapiens
tttgcaaaatgagact

SEQ ID NO: 5660645 - DNA, 12 bp, Homo sapiens
tttgcaaaattt

SEQ ID NO: 5660646 - DNA, 17 bp, Homo sapiens
tttgcaaaccctttgta

SEQ ID NO: 5660647 - DNA, 18 bp, Homo sapiens
tttgcaaaccctttgtat

SEQ ID NO: 5660648 - DNA, 20 bp, Homo sapiens
tttgcaaaccctttgtatta

SEQ ID NO: 5660649 - DNA, 16 bp, Homo sapiens
tttgcaaagaccacct

SEQ ID NO: 5660650 - DNA, 19 bp, Homo sapiens
tttgcaaagtattgtaaat

SEQ ID NO: 5660651 - DNA, 18 bp, Homo sapiens
tttgcaaagttacagatg

SEQ ID NO: 5660652 - DNA, 18 bp, Homo sapiens
tttgcaaataacttacaa

SEQ ID NO: 5660653 - DNA, 22 bp, Homo sapiens
tttgcaaatatactttactttt

SEQ ID NO: 5660654 - DNA, 17 bp, Homo sapiens
tttgcaaatctaaagtt

SEQ ID NO: 5660655 - DNA, 21 bp, Homo sapiens
tttgcaacactgccaaacatc

SEQ ID NO: 5660656 - DNA, 11 bp, Homo sapiens
tttgcaacata

SEQ ID NO: 5660657 - DNA, 23 bp, Homo sapiens
tttgcaaccaggaacagcaaatg

SEQ ID NO: 5660658 - DNA, 15 bp, Homo sapiens
tttgtaactaataga

SEQ ID NO: 5660659 - DNA, 17 bp, Homo sapiens
tttgtaactctttggct

SEQ ID NO: 5660660 - DNA, 20 bp, Homo sapiens
tttgtaactctttggctatt

SEQ ID NO: 5660661 - DNA, 23 bp, Homo sapiens
tttgtaactgtaaagatgaatgt

SEQ ID NO: 5660662 - DNA, 13 bp, Homo sapiens
tttgtaacttcaa

SEQ ID NO: 5660663 - DNA, 21 bp, Homo sapiens
tttgtaacttgggctgtaaag

SEQ ID NO: 5660664 - DNA, 17 bp, Homo sapiens
tttgtaactttgcatgt

SEQ ID NO: 5660665 - DNA, 16 bp, Homo sapiens
tttgtaagaaaaccaa

SEQ ID NO: 5660666 - DNA, 18 bp, Homo sapiens
tttgtaagaactaaagaa

SEQ ID NO: 5660667 - DNA, 22 bp, Homo sapiens
tttgtaagacacacagcctttc

SEQ ID NO: 5660668 - DNA, 23 bp, Homo sapiens
tttgtaagacacacagcctttct

SEQ ID NO: 5660669 - DNA, 15 bp, Homo sapiens
tttgtaagacatttg

SEQ ID NO: 5660670 - DNA, 21 bp, Homo sapiens
tttgtaagacatttgtatatt

SEQ ID NO: 5660671 - DNA, 12 bp, Homo sapiens
tttgtaagagtg

SEQ ID NO: 5660672 - DNA, 17 bp, Homo sapiens
tttgtaagagtgtagaa

SEQ ID NO: 5660673 - DNA, 19 bp, Homo sapiens
tttgtaagagtgtagaagc

SEQ ID NO: 5660674 - DNA, 15 bp, Homo sapiens
tttgtaagatgctgg

SEQ ID NO: 5660675 - DNA, 20 bp, Homo sapiens
tttgtaaggacttgtgcctc

SEQ ID NO: 5660676 - DNA, 16 bp, Homo sapiens
tttgtaagtaacacag

SEQ ID NO: 5660677 - DNA, 17 bp, Homo sapiens
tttgtaagtaacacagt

SEQ ID NO: 5660678 - DNA, 21 bp, Homo sapiens
tttgtaagtaagtaagaaaga

SEQ ID NO: 5660679 - DNA, 21 bp, Homo sapiens
tttgtaagtcagtgttgagat

SEQ ID NO: 5660680 - DNA, 22 bp, Homo sapiens
tttgtaagtcagtgttgagatg

SEQ ID NO: 5660681 - DNA, 21 bp, Homo sapiens
tttgtaagtgctacataaatt

SEQ ID NO: 5660682 - DNA, 17 bp, Homo sapiens
tttgtaagttatgtttt

SEQ ID NO: 5660683 - DNA, 13 bp, Homo sapiens
tttgtaagttatt

SEQ ID NO: 5660684 - DNA, 22 bp, Homo sapiens
tttgtaataaaactatttgtat

SEQ ID NO: 5660685 - DNA, 21 bp, Homo sapiens
tttgtaataaaatggtacatt

SEQ ID NO: 5660686 - DNA, 13 bp, Homo sapiens
tttgtaataaact

SEQ ID NO: 5660687 - DNA, 19 bp, Homo sapiens
tttgtaataaactctctag

SEQ ID NO: 5660688 - DNA, 14 bp, Homo sapiens
tttgtaataaagta

SEQ ID NO: 5660689 - DNA, 12 bp, Homo sapiens
tttgtaataaca

SEQ ID NO: 5660690 - DNA, 19 bp, Homo sapiens
tttgtaataataaagaata

SEQ ID NO: 5660691 - DNA, 18 bp, Homo sapiens
tttgtaatataagacaag

SEQ ID NO: 5660692 - DNA, 14 bp, Homo sapiens
tttgtaatatacag

SEQ ID NO: 5660693 - DNA, 15 bp, Homo sapiens
tttgtaatatatcct

SEQ ID NO: 5660694 - DNA, 15 bp, Homo sapiens
tttgtaatatgattt

SEQ ID NO: 5660695 - DNA, 22 bp, Homo sapiens
tttgtaatatggaaatctttta

SEQ ID NO: 5660696 - DNA, 16 bp, Homo sapiens
tttgtaatatttttgt

SEQ ID NO: 5660697 - DNA, 16 bp, Homo sapiens
tttgtaatcactccca

SEQ ID NO: 5660698 - DNA, 16 bp, Homo sapiens
tttgtaatcccagtta

SEQ ID NO: 5660699 - DNA, 18 bp, Homo sapiens
tttgtaatcgttatgtgt

SEQ ID NO: 5660700 - DNA, 21 bp, Homo sapiens
tttgtaatcgttatgtgtgta

SEQ ID NO: 5660701 - DNA, 14 bp, Homo sapiens
tttgtaatgaattc

SEQ ID NO: 5660702 - DNA, 20 bp, Homo sapiens
tttgtaatgaattcctagaa

SEQ ID NO: 5660703 - DNA, 21 bp, Homo sapiens
tttgtaatgaccaaggtaccg

SEQ ID NO: 5660704 - DNA, 19 bp, Homo sapiens
tttgtaatgcaaaaggctg

SEQ ID NO: 5660705 - DNA, 15 bp, Homo sapiens
tttgtaatgtatctt

SEQ ID NO: 5660706 - DNA, 18 bp, Homo sapiens
tttgtaatgtgaaaagta

SEQ ID NO: 5660707 - DNA, 15 bp, Homo sapiens
tttgtaatgtgtgaa

SEQ ID NO: 5660708 - DNA, 22 bp, Homo sapiens
tttgtaattaaattatggtatt

SEQ ID NO: 5660709 - DNA, 24 bp, Homo sapiens
tttgtaattaaattatggtattaa

SEQ ID NO: 5660710 - DNA, 14 bp, Homo sapiens
tttgtaattcctct

SEQ ID NO: 5660711 - DNA, 17 bp, Homo sapiens
tttgtaattcctgatct

SEQ ID NO: 5660712 - DNA, 13 bp, Homo sapiens
tttgtaattgctt

SEQ ID NO: 5660713 - DNA, 18 bp, Homo sapiens
tttgtaattgcttacatt

SEQ ID NO: 5660714 - DNA, 20 bp, Homo sapiens
tttgtaattgcttacatttt

SEQ ID NO: 5660715 - DNA, 11 bp, Homo sapiens
tttgtaattta

SEQ ID NO: 5660716 - DNA, 13 bp, Homo sapiens
tttgtaatttaag

SEQ ID NO: 5660717 - DNA, 17 bp, Homo sapiens
tttgtaattttagtatt

SEQ ID NO: 5660718 - DNA, 18 bp, Homo sapiens
tttgtacaaactatttca

SEQ ID NO: 5660719 - DNA, 18 bp, Homo sapiens
tttgtacaaagttttcct

SEQ ID NO: 5660720 - DNA, 19 bp, Homo sapiens
tttgtacaaagttttcctt

SEQ ID NO: 5660721 - DNA, 20 bp, Homo sapiens
tttgtacaaagttttccttt

SEQ ID NO: 5660722 - DNA, 21 bp, Homo sapiens
tttgtacaaagttttcctttg

SEQ ID NO: 5660723 - DNA, 14 bp, Homo sapiens
tttgtacaaataaa

SEQ ID NO: 5660724 - DNA, 19 bp, Homo sapiens
tttgtacaaataaacctga

SEQ ID NO: 5660725 - DNA, 22 bp, Homo sapiens
tttgtacaatggggacttcccg

SEQ ID NO: 5660726 - DNA, 16 bp, Homo sapiens
tttgtacaatggttta

SEQ ID NO: 5660727 - DNA, 16 bp, Homo sapiens
tttgtacactgctgta

SEQ ID NO: 5660728 - DNA, 13 bp, Homo sapiens
tttgtacagaatt

SEQ ID NO: 5660729 - DNA, 23 bp, Homo sapiens
tttgtacagaatttttaatgact

SEQ ID NO: 5660730 - DNA, 22 bp, Homo sapiens
tttgtacagaccgagaggccag

SEQ ID NO: 5660731 - DNA, 18 bp, Homo sapiens
tttgtacagacgtatgct

SEQ ID NO: 5660732 - DNA, 14 bp, Homo sapiens
tttgtacaggggcc

SEQ ID NO: 5660733 - DNA, 17 bp, Homo sapiens
tttgtacaggggccatg

SEQ ID NO: 5660734 - DNA, 22 bp, Homo sapiens
tttgtacagtatttttcagata

SEQ ID NO: 5660735 - DNA, 18 bp, Homo sapiens
tttgtacagtggagaaat

SEQ ID NO: 5660736 - DNA, 17 bp, Homo sapiens
tttgtacagtttgctgt

SEQ ID NO: 5660737 - DNA, 23 bp, Homo sapiens
tttgtacatactgtatttttact

SEQ ID NO: 5660738 - DNA, 16 bp, Homo sapiens
tttgtacatagattta

SEQ ID NO: 5660739 - DNA, 18 bp, Homo sapiens
tttgtacatatcaaatag

SEQ ID NO: 5660740 - DNA, 19 bp, Homo sapiens
tttgtacatatgtaaaata

SEQ ID NO: 5660741 - DNA, 13 bp, Homo sapiens
tttgtacatatta

SEQ ID NO: 5660742 - DNA, 19 bp, Homo sapiens
tttgtacatctggcttatt

SEQ ID NO: 5660743 - DNA, 12 bp, Homo sapiens
tttgtacatctt

SEQ ID NO: 5660744 - DNA, 15 bp, Homo sapiens
tttgtacattacact

SEQ ID NO: 5660745 - DNA, 22 bp, Homo sapiens
tttgtacattatgttattggaa

SEQ ID NO: 5660746 - DNA, 14 bp, Homo sapiens
tttgtacattcctg

SEQ ID NO: 5660747 - DNA, 15 bp, Homo sapiens
tttgtacattcctga

SEQ ID NO: 5660748 - DNA, 19 bp, Homo sapiens
tttgtacatttttcagcag

SEQ ID NO: 5660749 - DNA, 12 bp, Homo sapiens
tttgtaccagtg

SEQ ID NO: 5660750 - DNA, 15 bp, Homo sapiens
tttgtaccagtgtga

SEQ ID NO: 5660751 - DNA, 18 bp, Homo sapiens
tttgtaccccccaacccc

SEQ ID NO: 5660752 - DNA, 15 bp, Homo sapiens
tttgtacctatgtga

SEQ ID NO: 5660753 - DNA, 14 bp, Homo sapiens
tttgtacctctaag

SEQ ID NO: 5660754 - DNA, 17 bp, Homo sapiens
tttgtacgttaattaaa

SEQ ID NO: 5660755 - DNA, 18 bp, Homo sapiens
tttgtactagttgatgaa

SEQ ID NO: 5660756 - DNA, 14 bp, Homo sapiens
tttgtactcagtgg

SEQ ID NO: 5660757 - DNA, 14 bp, Homo sapiens
tttgtactgaaaaa

SEQ ID NO: 5660758 - DNA, 14 bp, Homo sapiens
tttgtactgaatct

SEQ ID NO: 5660759 - DNA, 16 bp, Homo sapiens
tttgtactgaattttt

SEQ ID NO: 5660760 - DNA, 15 bp, Homo sapiens
tttgtactgtaaaga

SEQ ID NO: 5660761 - DNA, 18 bp, Homo sapiens
tttgtactgtttaatgtt

SEQ ID NO: 5660762 - DNA, 19 bp, Homo sapiens
tttgtacttggaagtgttt

SEQ ID NO: 5660763 - DNA, 20 bp, Homo sapiens
tttgtacttggaagtgtttc

SEQ ID NO: 5660764 - DNA, 12 bp, Homo sapiens
tttgtactttat

SEQ ID NO: 5660765 - DNA, 18 bp, Homo sapiens
tttgtactttctgttaaa

SEQ ID NO: 5660766 - DNA, 19 bp, Homo sapiens
tttgtacttttagtagaga

SEQ ID NO: 5660767 - DNA, 15 bp, Homo sapiens
tttgtagaactgccc

SEQ ID NO: 5660768 - DNA, 19 bp, Homo sapiens
tttgtagatggcactttag

SEQ ID NO: 5660769 - DNA, 21 bp, Homo sapiens
tttgtagatggcgatgtgtta

SEQ ID NO: 5660770 - DNA, 19 bp, Homo sapiens
tttgtagcactgacagatt

SEQ ID NO: 5660771 - DNA, 16 bp, Homo sapiens
tttgtagcataactgt

SEQ ID NO: 5660772 - DNA, 17 bp, Homo sapiens
tttgtagcataactgta

SEQ ID NO: 5660773 - DNA, 17 bp, Homo sapiens
tttgtagcctaaagacc

SEQ ID NO: 5660774 - DNA, 17 bp, Homo sapiens
tttgtagccttcctcca

SEQ ID NO: 5660775 - DNA, 17 bp, Homo sapiens
tttgtagctaacagtga

SEQ ID NO: 5660776 - DNA, 18 bp, Homo sapiens
tttgtagctttcctggaa

SEQ ID NO: 5660777 - DNA, 19 bp, Homo sapiens
tttgtagctttcctggaag

SEQ ID NO: 5660778 - DNA, 21 bp, Homo sapiens
tttgtaggaaggtctcattct

SEQ ID NO: 5660779 - DNA, 20 bp, Homo sapiens
tttgtaggggaactcatttg

SEQ ID NO: 5660780 - DNA, 20 bp, Homo sapiens
tttgtaggggtcaaagaaat

SEQ ID NO: 5660781 - DNA, 16 bp, Homo sapiens
tttgtagggtttctag

SEQ ID NO: 5660782 - DNA, 20 bp, Homo sapiens
tttgtaggtaaaatgtattt

SEQ ID NO: 5660783 - DNA, 19 bp, Homo sapiens
tttgtaggtatactatgta

SEQ ID NO: 5660784 - DNA, 17 bp, Homo sapiens
tttgtaggttattttat

SEQ ID NO: 5660785 - DNA, 18 bp, Homo sapiens
tttgtaggttattttata

SEQ ID NO: 5660786 - DNA, 18 bp, Homo sapiens
tttgtagtgattcattgt

SEQ ID NO: 5660787 - DNA, 21 bp, Homo sapiens
tttgtagtgttggagaagaac

SEQ ID NO: 5660788 - DNA, 19 bp, Homo sapiens
tttgtagttttatttgtat

SEQ ID NO: 5660789 - DNA, 14 bp, Homo sapiens
tttgtataaaaagg

SEQ ID NO: 5660790 - DNA, 18 bp, Homo sapiens
tttgtataaaataatttt

SEQ ID NO: 5660791 - DNA, 21 bp, Homo sapiens
tttgtataaaataatttttat

SEQ ID NO: 5660792 - DNA, 13 bp, Homo sapiens
tttgtataaaatg

SEQ ID NO: 5660793 - DNA, 23 bp, Homo sapiens
tttgtataaattaaataaactgt

SEQ ID NO: 5660794 - DNA, 20 bp, Homo sapiens
tttgtataacccatatctgt

SEQ ID NO: 5660795 - DNA, 15 bp, Homo sapiens
tttgtataacttaaa

SEQ ID NO: 5660796 - DNA, 18 bp, Homo sapiens
tttgtataacttcttaaa

SEQ ID NO: 5660797 - DNA, 13 bp, Homo sapiens
tttgtataattgg

SEQ ID NO: 5660798 - DNA, 16 bp, Homo sapiens
tttgtataattgtatc

SEQ ID NO: 5660799 - DNA, 19 bp, Homo sapiens
tttgtatacaaatatattg

SEQ ID NO: 5660800 - DNA, 22 bp, Homo sapiens
tttgtatacaaatatattgtta

SEQ ID NO: 5660801 - DNA, 14 bp, Homo sapiens
tttgtatactttaa

SEQ ID NO: 5660802 - DNA, 14 bp, Homo sapiens
tttgtatagaccaa

SEQ ID NO: 5660803 - DNA, 17 bp, Homo sapiens
tttgtatagtaaagtga

SEQ ID NO: 5660804 - DNA, 17 bp, Homo sapiens
tttgtatagttatgtaa

SEQ ID NO: 5660805 - DNA, 22 bp, Homo sapiens
tttgtatagttatgtaaataat

SEQ ID NO: 5660806 - DNA, 18 bp, Homo sapiens
tttgtatatacagttatt

SEQ ID NO: 5660807 - DNA, 21 bp, Homo sapiens
tttgtatatacagttattttg

SEQ ID NO: 5660808 - DNA, 17 bp, Homo sapiens
tttgtatatctaagact

SEQ ID NO: 5660809 - DNA, 16 bp, Homo sapiens
tttgtatattatttct

SEQ ID NO: 5660810 - DNA, 15 bp, Homo sapiens
tttgtatatttgcaa

SEQ ID NO: 5660811 - DNA, 22 bp, Homo sapiens
tttgtatcaaactcgtctgatg

SEQ ID NO: 5660812 - DNA, 22 bp, Homo sapiens
tttgtatccaactgcatccagg

SEQ ID NO: 5660813 - DNA, 13 bp, Homo sapiens
tttgtatccattt

SEQ ID NO: 5660814 - DNA, 12 bp, Homo sapiens
tttgtatcctcc

SEQ ID NO: 5660815 - DNA, 13 bp, Homo sapiens
tttgtatctgaag

SEQ ID NO: 5660816 - DNA, 22 bp, Homo sapiens
tttgtatctgcaggcagacacg

SEQ ID NO: 5660817 - DNA, 14 bp, Homo sapiens
tttgtatcttcctt

SEQ ID NO: 5660818 - DNA, 21 bp, Homo sapiens
tttgtatctttaaagacttga

SEQ ID NO: 5660819 - DNA, 15 bp, Homo sapiens
tttgtatctttatgc

SEQ ID NO: 5660820 - DNA, 21 bp, Homo sapiens
tttgtatctttatgctgtatt

SEQ ID NO: 5660821 - DNA, 22 bp, Homo sapiens
tttgtatcttttatcctgggag

SEQ ID NO: 5660822 - DNA, 13 bp, Homo sapiens
tttgtatgaaaac

SEQ ID NO: 5660823 - DNA, 22 bp, Homo sapiens
tttgtatgaaattataatctgt

SEQ ID NO: 5660824 - DNA, 18 bp, Homo sapiens
tttgtatgaagtactttt

SEQ ID NO: 5660825 - DNA, 13 bp, Homo sapiens
tttgtatgacagt

SEQ ID NO: 5660826 - DNA, 21 bp, Homo sapiens
tttgtatgagatggttaaaaa

SEQ ID NO: 5660827 - DNA, 23 bp, Homo sapiens
tttgtatgagatggttaaaaagg

SEQ ID NO: 5660828 - DNA, 20 bp, Homo sapiens
tttgtatgaggtcctcaggt

SEQ ID NO: 5660829 - DNA, 12 bp, Homo sapiens
tttgtatgatat

SEQ ID NO: 5660830 - DNA, 16 bp, Homo sapiens
tttgtatgatgtagtt

SEQ ID NO: 5660831 - DNA, 12 bp, Homo sapiens
tttgtatgcaag

SEQ ID NO: 5660832 - DNA, 22 bp, Homo sapiens
tttgtatgccaagtgagaagat

SEQ ID NO: 5660833 - DNA, 13 bp, Homo sapiens
tttgtatgccttt

SEQ ID NO: 5660834 - DNA, 16 bp, Homo sapiens
tttgtatgtaaatgtg

SEQ ID NO: 5660835 - DNA, 17 bp, Homo sapiens
ttttaaactagatgacc

SEQ ID NO: 5660836 - DNA, 20 bp, Homo sapiens
ttttaaactagatgacctca

SEQ ID NO: 5660837 - DNA, 12 bp, Homo sapiens
ttttaaactcat

SEQ ID NO: 5660838 - DNA, 15 bp, Homo sapiens
ttttaaactgtacag

SEQ ID NO: 5660839 - DNA, 13 bp, Homo sapiens
ttttaaactgtga

SEQ ID NO: 5660840 - DNA, 20 bp, Homo sapiens
ttttaaactgtgtacataac

SEQ ID NO: 5660841 - DNA, 23 bp, Homo sapiens
ttttaaactgtgtacataactga

SEQ ID NO: 5660842 - DNA, 14 bp, Homo sapiens
ttttaaacttgaaa

SEQ ID NO: 5660843 - DNA, 15 bp, Homo sapiens
ttttaaacttgaaat

SEQ ID NO: 5660844 - DNA, 16 bp, Homo sapiens
ttttaaacttgaaata

SEQ ID NO: 5660845 - DNA, 17 bp, Homo sapiens
ttttaaacttgaaatat

SEQ ID NO: 5660846 - DNA, 19 bp, Homo sapiens
ttttaaagaaaaatatgat

SEQ ID NO: 5660847 - DNA, 21 bp, Homo sapiens
ttttaaagaagtaaatttgtc

SEQ ID NO: 5660848 - DNA, 17 bp, Homo sapiens
ttttaaagaagtccatg

SEQ ID NO: 5660849 - DNA, 20 bp, Homo sapiens
ttttaaagaagtccatgtga

SEQ ID NO: 5660850 - DNA, 22 bp, Homo sapiens
ttttaaagaagtccatgtgata

SEQ ID NO: 5660851 - DNA, 19 bp, Homo sapiens
ttttaaagaagtctcttaa

SEQ ID NO: 5660852 - DNA, 17 bp, Homo sapiens
ttttaaagaatgctctt

SEQ ID NO: 5660853 - DNA, 11 bp, Homo sapiens
ttttaaagaca

SEQ ID NO: 5660854 - DNA, 22 bp, Homo sapiens
ttttaaagacccaacttgccaa

SEQ ID NO: 5660855 - DNA, 23 bp, Homo sapiens
ttttaaagaccctcctattctat

SEQ ID NO: 5660856 - DNA, 15 bp, Homo sapiens
ttttaaagacttgca

SEQ ID NO: 5660857 - DNA, 19 bp, Homo sapiens
ttttaaagagatagcttct

SEQ ID NO: 5660858 - DNA, 13 bp, Homo sapiens
ttttaaagcctgg

SEQ ID NO: 5660859 - DNA, 19 bp, Homo sapiens
ttttaaagccttctggatc

SEQ ID NO: 5660860 - DNA, 17 bp, Homo sapiens
ttttaaaggaataaact

SEQ ID NO: 5660861 - DNA, 18 bp, Homo sapiens
ttttaaaggaatgtgaaa

SEQ ID NO: 5660862 - DNA, 19 bp, Homo sapiens
ttttaaagtaaatctcttt

SEQ ID NO: 5660863 - DNA, 23 bp, Homo sapiens
ttttaaagtactttcttataaat

SEQ ID NO: 5660864 - DNA, 23 bp, Homo sapiens
ttttaaagtagttcctattttct

SEQ ID NO: 5660865 - DNA, 16 bp, Homo sapiens
ttttaaagtatatatt

SEQ ID NO: 5660866 - DNA, 22 bp, Homo sapiens
ttttaaagtcagtgttgaattt

SEQ ID NO: 5660867 - DNA, 14 bp, Homo sapiens
ttttaaagtgatta

SEQ ID NO: 5660868 - DNA, 18 bp, Homo sapiens
ttttaaagtgtttcagct

SEQ ID NO: 5660869 - DNA, 21 bp, Homo sapiens
ttttaaagttcttattttagt

SEQ ID NO: 5660870 - DNA, 14 bp, Homo sapiens
ttttaaagttgata

SEQ ID NO: 5660871 - DNA, 18 bp, Homo sapiens
ttttaaagtttaaatacc

SEQ ID NO: 5660872 - DNA, 22 bp, Homo sapiens
ttttaaagtttaaataccagta

SEQ ID NO: 5660873 - DNA, 14 bp, Homo sapiens
ttttaaagtttgtt

SEQ ID NO: 5660874 - DNA, 14 bp, Homo sapiens
ttttaaagttttgt

SEQ ID NO: 5660875 - DNA, 23 bp, Homo sapiens
ttttaaagttttgtacaaagttt

SEQ ID NO: 5660876 - DNA, 17 bp, Homo sapiens
ttttaaataaaagtgat

SEQ ID NO: 5660877 - DNA, 21 bp, Homo sapiens
ttttaaataaaatagagtctg

SEQ ID NO: 5660878 - DNA, 22 bp, Homo sapiens
ttttaaataaactttttttcaa

SEQ ID NO: 5660879 - DNA, 22 bp, Homo sapiens
ttttaaataacctctggccctt

SEQ ID NO: 5660880 - DNA, 19 bp, Homo sapiens
ttttaaataattgcatcag

SEQ ID NO: 5660881 - DNA, 14 bp, Homo sapiens
ttttaaatataaat

SEQ ID NO: 5660882 - DNA, 15 bp, Homo sapiens
ttttaaatattaact

SEQ ID NO: 5660883 - DNA, 18 bp, Homo sapiens
ttttaaatatttgttctt

SEQ ID NO: 5660884 - DNA, 18 bp, Homo sapiens
ttttaaatattttttctt

SEQ ID NO: 5660885 - DNA, 20 bp, Homo sapiens
ttttaaatcaaaaacttttc

SEQ ID NO: 5660886 - DNA, 14 bp, Homo sapiens
ttttaaatcaagga

SEQ ID NO: 5660887 - DNA, 18 bp, Homo sapiens
ttttaaatctaaatctat

SEQ ID NO: 5660888 - DNA, 12 bp, Homo sapiens
ttttaaatctgc

SEQ ID NO: 5660889 - DNA, 18 bp, Homo sapiens
ttttaaatgaaaatgtaa

SEQ ID NO: 5660890 - DNA, 21 bp, Homo sapiens
ttttaaatgaaaatgtaactt

SEQ ID NO: 5660891 - DNA, 12 bp, Homo sapiens
ttttaaatgaat

SEQ ID NO: 5660892 - DNA, 14 bp, Homo sapiens
ttttaaatgacttg

SEQ ID NO: 5660893 - DNA, 19 bp, Homo sapiens
ttttaaatgcaaattaaag

SEQ ID NO: 5660894 - DNA, 20 bp, Homo sapiens
ttttaaatgcagttacaaat

SEQ ID NO: 5660895 - DNA, 21 bp, Homo sapiens
ttttaaatgggagcaacatat

SEQ ID NO: 5660896 - DNA, 12 bp, Homo sapiens
ttttaaatgggt

SEQ ID NO: 5660897 - DNA, 14 bp, Homo sapiens
ttttaaatgtacag

SEQ ID NO: 5660898 - DNA, 15 bp, Homo sapiens
ttttaaatgtacaga

SEQ ID NO: 5660899 - DNA, 12 bp, Homo sapiens
ttttaaatgtct

SEQ ID NO: 5660900 - DNA, 14 bp, Homo sapiens
ttttaaatgtctat

SEQ ID NO: 5660901 - DNA, 13 bp, Homo sapiens
ttttaaatgtgaa

SEQ ID NO: 5660902 - DNA, 16 bp, Homo sapiens
ttttaaatgtgcttca

SEQ ID NO: 5660903 - DNA, 20 bp, Homo sapiens
ttttaaatgtgtgagtgcat

SEQ ID NO: 5660904 - DNA, 13 bp, Homo sapiens
ttttaaatgttca

SEQ ID NO: 5660905 - DNA, 19 bp, Homo sapiens
ttttaaatgttcatgtcac

SEQ ID NO: 5660906 - DNA, 16 bp, Homo sapiens
ttttaaatgtttatat

SEQ ID NO: 5660907 - DNA, 22 bp, Homo sapiens
ttttaaattaagtcattttgta

SEQ ID NO: 5660908 - DNA, 17 bp, Homo sapiens
ttttaaattaatatctt

SEQ ID NO: 5660909 - DNA, 18 bp, Homo sapiens
ttttaaattagaaaatat

SEQ ID NO: 5660910 - DNA, 19 bp, Homo sapiens
ttttaaattagaaaatatt

SEQ ID NO: 5660911 - DNA, 20 bp, Homo sapiens
ttttaaattataagatgtca

SEQ ID NO: 5660912 - DNA, 21 bp, Homo sapiens
ttttaaattataaggactgca

SEQ ID NO: 5660913 - DNA, 23 bp, Homo sapiens
ttttaaattataaggactgcatg

SEQ ID NO: 5660914 - DNA, 12 bp, Homo sapiens
ttttaaattatg

SEQ ID NO: 5660915 - DNA, 17 bp, Homo sapiens
ttttaaattattatctt

SEQ ID NO: 5660916 - DNA, 20 bp, Homo sapiens
ttttaaattcccgttttgtc

SEQ ID NO: 5660917 - DNA, 17 bp, Homo sapiens
ttttaaattctcagtca

SEQ ID NO: 5660918 - DNA, 18 bp, Homo sapiens
ttttaaattctcagtcat

SEQ ID NO: 5660919 - DNA, 13 bp, Homo sapiens
ttttaaattctga

SEQ ID NO: 5660920 - DNA, 24 bp, Homo sapiens
ttttaaattctgagacatgtgtca

SEQ ID NO: 5660921 - DNA, 13 bp, Homo sapiens
ttttaaattgcaa

SEQ ID NO: 5660922 - DNA, 23 bp, Homo sapiens
ttttaaatttcagtcaattctga

SEQ ID NO: 5660923 - DNA, 20 bp, Homo sapiens
ttttaaatttcttttattaa

SEQ ID NO: 5660924 - DNA, 11 bp, Homo sapiens
ttttaaatttg

SEQ ID NO: 5660925 - DNA, 14 bp, Homo sapiens
ttttaaattttcca

SEQ ID NO: 5660926 - DNA, 19 bp, Homo sapiens
ttttaaattttcttcagtt

SEQ ID NO: 5660927 - DNA, 20 bp, Homo sapiens
ttttaaattttcttcagttg

SEQ ID NO: 5660928 - DNA, 17 bp, Homo sapiens
ttttaaattttgtaatg

SEQ ID NO: 5660929 - DNA, 20 bp, Homo sapiens
ttttaacaaaacttcttaga

SEQ ID NO: 5660930 - DNA, 20 bp, Homo sapiens
ttttaacaaaagcaagactg

SEQ ID NO: 5660931 - DNA, 18 bp, Homo sapiens
ttttaacaactgctctta

SEQ ID NO: 5660932 - DNA, 13 bp, Homo sapiens
ttttaacaagaag

SEQ ID NO: 5660933 - DNA, 14 bp, Homo sapiens
ttttaacaagaaga

SEQ ID NO: 5660934 - DNA, 17 bp, Homo sapiens
ttttaacaagaagatga

SEQ ID NO: 5660935 - DNA, 17 bp, Homo sapiens
ttttaacacctgatgtg

SEQ ID NO: 5660936 - DNA, 13 bp, Homo sapiens
ttttaacacttaa

SEQ ID NO: 5660937 - DNA, 18 bp, Homo sapiens
ttttaacagaaccagagg

SEQ ID NO: 5660938 - DNA, 20 bp, Homo sapiens
ttttaacatagtaacgtgtt

SEQ ID NO: 5660939 - DNA, 18 bp, Homo sapiens
ttttaacatctttgtttt

SEQ ID NO: 5660940 - DNA, 13 bp, Homo sapiens
ttttaacatggaa

SEQ ID NO: 5660941 - DNA, 13 bp, Homo sapiens
ttttaacattcct

SEQ ID NO: 5660942 - DNA, 14 bp, Homo sapiens
ttttaacatttgat

SEQ ID NO: 5660943 - DNA, 23 bp, Homo sapiens
ttttaaccaagttgtttattcca

SEQ ID NO: 5660944 - DNA, 22 bp, Homo sapiens
ttttaaccggtaagagtttcag

SEQ ID NO: 5660945 - DNA, 21 bp, Homo sapiens
ttttaacctgttttgttaatg

SEQ ID NO: 5660946 - DNA, 17 bp, Homo sapiens
ttttaacgtatgtattt

SEQ ID NO: 5660947 - DNA, 20 bp, Homo sapiens
ttttaacgtggcttgtagaa

SEQ ID NO: 5660948 - DNA, 16 bp, Homo sapiens
ttttaactagaattta

SEQ ID NO: 5660949 - DNA, 19 bp, Homo sapiens
ttttaactcccaagcagta

SEQ ID NO: 5660950 - DNA, 19 bp, Homo sapiens
ttttaactcccctgtttca

SEQ ID NO: 5660951 - DNA, 19 bp, Homo sapiens
ttttaactgaaaatgtaaa

SEQ ID NO: 5660952 - DNA, 16 bp, Homo sapiens
ttttaactgcactcat

SEQ ID NO: 5660953 - DNA, 20 bp, Homo sapiens
ttttaactggcatgtcattt

SEQ ID NO: 5660954 - DNA, 17 bp, Homo sapiens
ttttaacttagagcttt

SEQ ID NO: 5660955 - DNA, 18 bp, Homo sapiens
ttttaacttagagctttt

SEQ ID NO: 5660956 - DNA, 14 bp, Homo sapiens
ttttaacttattgt

SEQ ID NO: 5660957 - DNA, 13 bp, Homo sapiens
ttttaacttattt

SEQ ID NO: 5660958 - DNA, 23 bp, Homo sapiens
ttttaacttatttatatgaagca

SEQ ID NO: 5660959 - DNA, 12 bp, Homo sapiens
ttttaacttgaa

SEQ ID NO: 5660960 - DNA, 18 bp, Homo sapiens
ttttaactttgttttatt

SEQ ID NO: 5660961 - DNA, 15 bp, Homo sapiens
ttttaacttttggga

SEQ ID NO: 5660962 - DNA, 19 bp, Homo sapiens
ttttaagaaaaacatgtca

SEQ ID NO: 5660963 - DNA, 19 bp, Homo sapiens
ttttaagaaaaattcacaa

SEQ ID NO: 5660964 - DNA, 14 bp, Homo sapiens
ttttaagaaaacat

SEQ ID NO: 5660965 - DNA, 11 bp, Homo sapiens
ttttaagaaag

SEQ ID NO: 5660966 - DNA, 13 bp, Homo sapiens
ttttaagaaagag

SEQ ID NO: 5660967 - DNA, 22 bp, Homo sapiens
ttttaagaaagagaatgaactg

SEQ ID NO: 5660968 - DNA, 13 bp, Homo sapiens
ttttaagaaagct

SEQ ID NO: 5660969 - DNA, 11 bp, Homo sapiens
ttttaagaaat

SEQ ID NO: 5660970 - DNA, 14 bp, Homo sapiens
ttttaagaaatgta

SEQ ID NO: 5660971 - DNA, 23 bp, Homo sapiens
ttttaagacttaatctttgctga

SEQ ID NO: 5660972 - DNA, 17 bp, Homo sapiens
ttttaagactttggtta

SEQ ID NO: 5660973 - DNA, 21 bp, Homo sapiens
ttttaagataataatatatgt

SEQ ID NO: 5660974 - DNA, 13 bp, Homo sapiens
ttttaagatagtg

SEQ ID NO: 5660975 - DNA, 15 bp, Homo sapiens
ttttaagatagtgta

SEQ ID NO: 5660976 - DNA, 18 bp, Homo sapiens
ttttaagatccagaaata

SEQ ID NO: 5660977 - DNA, 13 bp, Homo sapiens
ttttaagattgta

SEQ ID NO: 5660978 - DNA, 20 bp, Homo sapiens
ttttaagattgtaattcaga

SEQ ID NO: 5660979 - DNA, 18 bp, Homo sapiens
ttttaagatttctctaat

SEQ ID NO: 5660980 - DNA, 17 bp, Homo sapiens
ttttaagatttttctca

SEQ ID NO: 5660981 - DNA, 12 bp, Homo sapiens
ttttaagcaaat

SEQ ID NO: 5660982 - DNA, 15 bp, Homo sapiens
ttttaagcaaatgca

SEQ ID NO: 5660983 - DNA, 16 bp, Homo sapiens
ttttaagcagctctaa

SEQ ID NO: 5660984 - DNA, 17 bp, Homo sapiens
ttttaagcataattaat

SEQ ID NO: 5660985 - DNA, 12 bp, Homo sapiens
ttttaagcatta

SEQ ID NO: 5660986 - DNA, 19 bp, Homo sapiens
ttttaagcattactcttgt

SEQ ID NO: 5660987 - DNA, 23 bp, Homo sapiens
ttttaagcattactcttgtaaga

SEQ ID NO: 5660988 - DNA, 17 bp, Homo sapiens
ttttaagcattcttaga

SEQ ID NO: 5660989 - DNA, 23 bp, Homo sapiens
ttttaagcatttgtatattaaaa

SEQ ID NO: 5660990 - DNA, 21 bp, Homo sapiens
ttttaagccatctcagattct

SEQ ID NO: 5660991 - DNA, 15 bp, Homo sapiens
ttttaagcctttgaa

SEQ ID NO: 5660992 - DNA, 17 bp, Homo sapiens
ttttaagctaaaatgtt

SEQ ID NO: 5660993 - DNA, 14 bp, Homo sapiens
ttttaagctatcag

SEQ ID NO: 5660994 - DNA, 21 bp, Homo sapiens
ttttaagctgcaaatctgatg

SEQ ID NO: 5660995 - DNA, 14 bp, Homo sapiens
ttttaagcttttat

SEQ ID NO: 5660996 - DNA, 12 bp, Homo sapiens
ttttaaggaaaa

SEQ ID NO: 5660997 - DNA, 15 bp, Homo sapiens
ttttaaggaaaacta

SEQ ID NO: 5660998 - DNA, 21 bp, Homo sapiens
ttttaaggaaactttttaatt

SEQ ID NO: 5660999 - DNA, 15 bp, Homo sapiens
ttttaaggactgact

SEQ ID NO: 5661000 - DNA, 18 bp, Homo sapiens
ttttaaggctgtgtgaat

SEQ ID NO: 5661001 - DNA, 17 bp, Homo sapiens
ttttaagggatgttgca

SEQ ID NO: 5661002 - DNA, 17 bp, Homo sapiens
ttttaaggtctttcagt

SEQ ID NO: 5661003 - DNA, 20 bp, Homo sapiens
ttttaaggtgagttctcact

SEQ ID NO: 5661004 - DNA, 19 bp, Homo sapiens
ttttaaggttgcacacagt

SEQ ID NO: 5661005 - DNA, 19 bp, Homo sapiens
ttttaaggtttcaacaaat

SEQ ID NO: 5661006 - DNA, 16 bp, Homo sapiens
ttttaagtaaggaatt

SEQ ID NO: 5661007 - DNA, 23 bp, Homo sapiens
ttttaagtatctaggagtattta

SEQ ID NO: 5661008 - DNA, 20 bp, Homo sapiens
ttttaagtccagcttggcca

SEQ ID NO: 5661009 - DNA, 22 bp, Homo sapiens
ttttaagtcctctaaacacact

SEQ ID NO: 5661010 - DNA, 21 bp, Homo sapiens
ttttaagtgaaagtgaggaaa

SEQ ID NO: 5661011 - DNA, 15 bp, Homo sapiens
ttttaagtgaaattt

SEQ ID NO: 5661012 - DNA, 16 bp, Homo sapiens
ttttaagtgaaattta

SEQ ID NO: 5661013 - DNA, 12 bp, Homo sapiens
ttttcatttgta

SEQ ID NO: 5661014 - DNA, 13 bp, Homo sapiens
ttttcatttgtaa

SEQ ID NO: 5661015 - DNA, 13 bp, Homo sapiens
ttttcatttgtac

SEQ ID NO: 5661016 - DNA, 17 bp, Homo sapiens
ttttcattttccaatac

SEQ ID NO: 5661017 - DNA, 16 bp, Homo sapiens
ttttcattttctctcc

SEQ ID NO: 5661018 - DNA, 22 bp, Homo sapiens
ttttcattttctgcaagcctgc

SEQ ID NO: 5661019 - DNA, 19 bp, Homo sapiens
ttttccaaaacaaaaagat

SEQ ID NO: 5661020 - DNA, 23 bp, Homo sapiens
ttttccaaaagtggcctctttgt

SEQ ID NO: 5661021 - DNA, 15 bp, Homo sapiens
ttttccaaaataatt

SEQ ID NO: 5661022 - DNA, 15 bp, Homo sapiens
ttttccaaagaaaag

SEQ ID NO: 5661023 - DNA, 21 bp, Homo sapiens
ttttccaaagaaaagtattgt

SEQ ID NO: 5661024 - DNA, 12 bp, Homo sapiens
ttttccaaagag

SEQ ID NO: 5661025 - DNA, 12 bp, Homo sapiens
ttttccaaagat

SEQ ID NO: 5661026 - DNA, 11 bp, Homo sapiens
ttttccaaatg

SEQ ID NO: 5661027 - DNA, 21 bp, Homo sapiens
ttttccaacaggggctggagg

SEQ ID NO: 5661028 - DNA, 21 bp, Homo sapiens
ttttccaacatacaatttact

SEQ ID NO: 5661029 - DNA, 14 bp, Homo sapiens
ttttccaactacta

SEQ ID NO: 5661030 - DNA, 21 bp, Homo sapiens
ttttccaacttggctgcagga

SEQ ID NO: 5661031 - DNA, 13 bp, Homo sapiens
ttttccaagccct

SEQ ID NO: 5661032 - DNA, 18 bp, Homo sapiens
ttttccaagccctcagct

SEQ ID NO: 5661033 - DNA, 23 bp, Homo sapiens
ttttccaagtaaagtgatgtttg

SEQ ID NO: 5661034 - DNA, 13 bp, Homo sapiens
ttttccaataaaa

SEQ ID NO: 5661035 - DNA, 16 bp, Homo sapiens
ttttccaatattttaa

SEQ ID NO: 5661036 - DNA, 20 bp, Homo sapiens
ttttccaatattttaataaa

SEQ ID NO: 5661037 - DNA, 23 bp, Homo sapiens
ttttccaatattttaataaagta

SEQ ID NO: 5661038 - DNA, 14 bp, Homo sapiens
ttttccaatcacag

SEQ ID NO: 5661039 - DNA, 19 bp, Homo sapiens
ttttccaatcacagtgtta

SEQ ID NO: 5661040 - DNA, 18 bp, Homo sapiens
ttttccaatcatttgact

SEQ ID NO: 5661041 - DNA, 15 bp, Homo sapiens
ttttccaatgtctgc

SEQ ID NO: 5661042 - DNA, 17 bp, Homo sapiens
ttttccacactatgtgt

SEQ ID NO: 5661043 - DNA, 15 bp, Homo sapiens
ttttccaccctggaa

SEQ ID NO: 5661044 - DNA, 18 bp, Homo sapiens
ttttccactccattgtcg

SEQ ID NO: 5661045 - DNA, 13 bp, Homo sapiens
ttttccactttgt

SEQ ID NO: 5661046 - DNA, 20 bp, Homo sapiens
ttttccacttttgttctact

SEQ ID NO: 5661047 - DNA, 21 bp, Homo sapiens
ttttccagaaatacctgtcta

SEQ ID NO: 5661048 - DNA, 18 bp, Homo sapiens
ttttccagaatttgaata

SEQ ID NO: 5661049 - DNA, 20 bp, Homo sapiens
ttttccagagcattccagtc

SEQ ID NO: 5661050 - DNA, 17 bp, Homo sapiens
ttttccagccttatgtg

SEQ ID NO: 5661051 - DNA, 20 bp, Homo sapiens
ttttccagctccgtgtttct

SEQ ID NO: 5661052 - DNA, 13 bp, Homo sapiens
ttttccaggactc

SEQ ID NO: 5661053 - DNA, 21 bp, Homo sapiens
ttttccaggactgtttcaaac

SEQ ID NO: 5661054 - DNA, 19 bp, Homo sapiens
ttttccaggatcctgcagg

SEQ ID NO: 5661055 - DNA, 12 bp, Homo sapiens
ttttccaggctg

SEQ ID NO: 5661056 - DNA, 20 bp, Homo sapiens
ttttccaggcttctgctggg

SEQ ID NO: 5661057 - DNA, 19 bp, Homo sapiens
ttttccaggtttaagctgt

SEQ ID NO: 5661058 - DNA, 14 bp, Homo sapiens
ttttccagtatttt

SEQ ID NO: 5661059 - DNA, 18 bp, Homo sapiens
ttttccagtctcttgtac

SEQ ID NO: 5661060 - DNA, 12 bp, Homo sapiens
ttttccatatat

SEQ ID NO: 5661061 - DNA, 16 bp, Homo sapiens
ttttccatgaaaacgt

SEQ ID NO: 5661062 - DNA, 19 bp, Homo sapiens
ttttccatgaaaatgcaac

SEQ ID NO: 5661063 - DNA, 21 bp, Homo sapiens
ttttccatgatttagcaagca

SEQ ID NO: 5661064 - DNA, 19 bp, Homo sapiens
ttttccattacatgatctt

SEQ ID NO: 5661065 - DNA, 18 bp, Homo sapiens
ttttccattatgctgtag

SEQ ID NO: 5661066 - DNA, 14 bp, Homo sapiens
ttttccattctggg

SEQ ID NO: 5661067 - DNA, 20 bp, Homo sapiens
ttttccatttattaagcagt

SEQ ID NO: 5661068 - DNA, 23 bp, Homo sapiens
ttttccatttatttattcatgtg

SEQ ID NO: 5661069 - DNA, 15 bp, Homo sapiens
ttttccattttataa

SEQ ID NO: 5661070 - DNA, 19 bp, Homo sapiens
ttttcccaaagcactttta

SEQ ID NO: 5661071 - DNA, 20 bp, Homo sapiens
ttttcccaaagcatccctct

SEQ ID NO: 5661072 - DNA, 14 bp, Homo sapiens
ttttcccaagtgta

SEQ ID NO: 5661073 - DNA, 13 bp, Homo sapiens
ttttcccaataaa

SEQ ID NO: 5661074 - DNA, 21 bp, Homo sapiens
ttttcccaatattgagcagtt

SEQ ID NO: 5661075 - DNA, 17 bp, Homo sapiens
ttttcccacacatattc

SEQ ID NO: 5661076 - DNA, 12 bp, Homo sapiens
ttttcccacgag

SEQ ID NO: 5661077 - DNA, 20 bp, Homo sapiens
ttttcccagatacttcccat

SEQ ID NO: 5661078 - DNA, 10 bp, Homo sapiens
ttttcccagc

SEQ ID NO: 5661079 - DNA, 19 bp, Homo sapiens
ttttcccagcccaaattct

SEQ ID NO: 5661080 - DNA, 19 bp, Homo sapiens
ttttcccagctacaccttt

SEQ ID NO: 5661081 - DNA, 14 bp, Homo sapiens
ttttcccagtgagt

SEQ ID NO: 5661082 - DNA, 16 bp, Homo sapiens
ttttcccataagacaa

SEQ ID NO: 5661083 - DNA, 20 bp, Homo sapiens
ttttcccatcatcctttgtt

SEQ ID NO: 5661084 - DNA, 22 bp, Homo sapiens
ttttcccatttatctaaatatg

SEQ ID NO: 5661085 - DNA, 15 bp, Homo sapiens
ttttcccatttgtaa

SEQ ID NO: 5661086 - DNA, 16 bp, Homo sapiens
ttttcccccaaagtgg

SEQ ID NO: 5661087 - DNA, 18 bp, Homo sapiens
ttttcccccaccctccca

SEQ ID NO: 5661088 - DNA, 22 bp, Homo sapiens
ttttcccccagcaacgcccctc

SEQ ID NO: 5661089 - DNA, 22 bp, Homo sapiens
ttttccccccaccccccagcac

SEQ ID NO: 5661090 - DNA, 17 bp, Homo sapiens
ttttccccctatcagtt

SEQ ID NO: 5661091 - DNA, 23 bp, Homo sapiens
ttttcccccttgaggattgtgga

SEQ ID NO: 5661092 - DNA, 16 bp, Homo sapiens
ttttcccctttcctgt

SEQ ID NO: 5661093 - DNA, 23 bp, Homo sapiens
ttttcccgagcaaagtctaaagt

SEQ ID NO: 5661094 - DNA, 21 bp, Homo sapiens
ttttccctcactgttccccaa

SEQ ID NO: 5661095 - DNA, 16 bp, Homo sapiens
ttttccctcagaaaat

SEQ ID NO: 5661096 - DNA, 15 bp, Homo sapiens
ttttccctcctttcc

SEQ ID NO: 5661097 - DNA, 15 bp, Homo sapiens
ttttccctcttttct

SEQ ID NO: 5661098 - DNA, 15 bp, Homo sapiens
ttttccctgaagtta

SEQ ID NO: 5661099 - DNA, 22 bp, Homo sapiens
ttttccctgaagttatgtgtat

SEQ ID NO: 5661100 - DNA, 18 bp, Homo sapiens
ttttccctggaactcctg

SEQ ID NO: 5661101 - DNA, 16 bp, Homo sapiens
ttttcccttaaataca

SEQ ID NO: 5661102 - DNA, 22 bp, Homo sapiens
ttttcccttaaatacagataat

SEQ ID NO: 5661103 - DNA, 16 bp, Homo sapiens
ttttcccttcatgttt

SEQ ID NO: 5661104 - DNA, 10 bp, Homo sapiens
ttttcccttt

SEQ ID NO: 5661105 - DNA, 13 bp, Homo sapiens
ttttccctttcct

SEQ ID NO: 5661106 - DNA, 17 bp, Homo sapiens
ttttccctttcctttcc

SEQ ID NO: 5661107 - DNA, 14 bp, Homo sapiens
ttttccctttgcct

SEQ ID NO: 5661108 - DNA, 17 bp, Homo sapiens
ttttccctttttaaaaa

SEQ ID NO: 5661109 - DNA, 18 bp, Homo sapiens
ttttccgaagtctctgat

SEQ ID NO: 5661110 - DNA, 19 bp, Homo sapiens
ttttccggggcacaagttt

SEQ ID NO: 5661111 - DNA, 16 bp, Homo sapiens
ttttccgttctgttct

SEQ ID NO: 5661112 - DNA, 17 bp, Homo sapiens
ttttcctaaagagagta

SEQ ID NO: 5661113 - DNA, 20 bp, Homo sapiens
ttttcctaagacatttttca

SEQ ID NO: 5661114 - DNA, 20 bp, Homo sapiens
ttttcctaaggaaactgctt

SEQ ID NO: 5661115 - DNA, 21 bp, Homo sapiens
ttttcctaatgtgatcatatg

SEQ ID NO: 5661116 - DNA, 19 bp, Homo sapiens
ttttcctactatcatctct

SEQ ID NO: 5661117 - DNA, 22 bp, Homo sapiens
ttttcctactccgttcctggca

SEQ ID NO: 5661118 - DNA, 20 bp, Homo sapiens
ttttcctagttttatgtttc

SEQ ID NO: 5661119 - DNA, 17 bp, Homo sapiens
ttttcctatcatgttaa

SEQ ID NO: 5661120 - DNA, 21 bp, Homo sapiens
ttttcctatgactcaaagatg

SEQ ID NO: 5661121 - DNA, 18 bp, Homo sapiens
ttttcctattctgttgcc

SEQ ID NO: 5661122 - DNA, 18 bp, Homo sapiens
ttttcctattttcgatga

SEQ ID NO: 5661123 - DNA, 14 bp, Homo sapiens
ttttcctcaagcaa

SEQ ID NO: 5661124 - DNA, 18 bp, Homo sapiens
ttttcctcaagcaataat

SEQ ID NO: 5661125 - DNA, 15 bp, Homo sapiens
ttttcctcagctcta

SEQ ID NO: 5661126 - DNA, 12 bp, Homo sapiens
ttttcctcatcc

SEQ ID NO: 5661127 - DNA, 16 bp, Homo sapiens
ttttcctcatcctttc

SEQ ID NO: 5661128 - DNA, 21 bp, Homo sapiens
ttttcctccagacagatacag

SEQ ID NO: 5661129 - DNA, 19 bp, Homo sapiens
ttttcctccccattcctac

SEQ ID NO: 5661130 - DNA, 13 bp, Homo sapiens
ttttcctccctca

SEQ ID NO: 5661131 - DNA, 18 bp, Homo sapiens
ttttcctccctgcttaaa

SEQ ID NO: 5661132 - DNA, 22 bp, Homo sapiens
ttttcctcccttgggttctgat

SEQ ID NO: 5661133 - DNA, 19 bp, Homo sapiens
ttttcctccgggagagggg

SEQ ID NO: 5661134 - DNA, 16 bp, Homo sapiens
ttttcctcctttctct

SEQ ID NO: 5661135 - DNA, 14 bp, Homo sapiens
ttttcctctagaag

SEQ ID NO: 5661136 - DNA, 14 bp, Homo sapiens
ttttcctctctctc

SEQ ID NO: 5661137 - DNA, 11 bp, Homo sapiens
ttttcctctgg

SEQ ID NO: 5661138 - DNA, 17 bp, Homo sapiens
ttttcctcttagaagaa

SEQ ID NO: 5661139 - DNA, 18 bp, Homo sapiens
ttttcctcttctattttg

SEQ ID NO: 5661140 - DNA, 18 bp, Homo sapiens
ttttcctcttttgtgaga

SEQ ID NO: 5661141 - DNA, 14 bp, Homo sapiens
ttttcctgaaaacc

SEQ ID NO: 5661142 - DNA, 22 bp, Homo sapiens
ttttcctgaatattaatcccag

SEQ ID NO: 5661143 - DNA, 20 bp, Homo sapiens
ttttcctggaattgccagct

SEQ ID NO: 5661144 - DNA, 20 bp, Homo sapiens
ttttcctggacttaaagaaa

SEQ ID NO: 5661145 - DNA, 15 bp, Homo sapiens
ttttcctggatttat

SEQ ID NO: 5661146 - DNA, 14 bp, Homo sapiens
ttttcctgggcctt

SEQ ID NO: 5661147 - DNA, 16 bp, Homo sapiens
ttttcctgggccttct

SEQ ID NO: 5661148 - DNA, 11 bp, Homo sapiens
ttttcctgtca

SEQ ID NO: 5661149 - DNA, 12 bp, Homo sapiens
ttttcctgtcct

SEQ ID NO: 5661150 - DNA, 13 bp, Homo sapiens
ttttcctgtcctc

SEQ ID NO: 5661151 - DNA, 21 bp, Homo sapiens
ttttcctgtcctctttcagct

SEQ ID NO: 5661152 - DNA, 10 bp, Homo sapiens
ttttcctgtg

SEQ ID NO: 5661153 - DNA, 14 bp, Homo sapiens
ttttcctgttcagt

SEQ ID NO: 5661154 - DNA, 21 bp, Homo sapiens
ttttcctgtttactgattaga

SEQ ID NO: 5661155 - DNA, 14 bp, Homo sapiens
ttttccttactgtg

SEQ ID NO: 5661156 - DNA, 20 bp, Homo sapiens
ttttccttagctgtaaaatg

SEQ ID NO: 5661157 - DNA, 20 bp, Homo sapiens
ttttccttatagggaaaaat

SEQ ID NO: 5661158 - DNA, 20 bp, Homo sapiens
ttttccttatttgccttcta

SEQ ID NO: 5661159 - DNA, 12 bp, Homo sapiens
ttttccttcaaa

SEQ ID NO: 5661160 - DNA, 16 bp, Homo sapiens
ttttccttcaaagttt

SEQ ID NO: 5661161 - DNA, 14 bp, Homo sapiens
ttttccttcaagaa

SEQ ID NO: 5661162 - DNA, 13 bp, Homo sapiens
ttttccttccatg

SEQ ID NO: 5661163 - DNA, 19 bp, Homo sapiens
ttttccttcccttttctgt

SEQ ID NO: 5661164 - DNA, 18 bp, Homo sapiens
ttttccttcctctgtaag

SEQ ID NO: 5661165 - DNA, 16 bp, Homo sapiens
ttttccttctgttaaa

SEQ ID NO: 5661166 - DNA, 17 bp, Homo sapiens
ttttccttctgttaaaa

SEQ ID NO: 5661167 - DNA, 15 bp, Homo sapiens
ttttccttcttagat

SEQ ID NO: 5661168 - DNA, 14 bp, Homo sapiens
ttttccttgaagcc

SEQ ID NO: 5661169 - DNA, 21 bp, Homo sapiens
ttttcctttaaaaaaatttaa

SEQ ID NO: 5661170 - DNA, 14 bp, Homo sapiens
ttttcctttaatga

SEQ ID NO: 5661171 - DNA, 13 bp, Homo sapiens
ttttcctttctgg

SEQ ID NO: 5661172 - DNA, 13 bp, Homo sapiens
ttttcctttctta

SEQ ID NO: 5661173 - DNA, 13 bp, Homo sapiens
ttttcctttgaac

SEQ ID NO: 5661174 - DNA, 16 bp, Homo sapiens
ttttcctttgtagcta

SEQ ID NO: 5661175 - DNA, 16 bp, Homo sapiens
ttttccttttcatctg

SEQ ID NO: 5661176 - DNA, 16 bp, Homo sapiens
ttttccttttgctgtg

SEQ ID NO: 5661177 - DNA, 13 bp, Homo sapiens
ttttccttttgtg

SEQ ID NO: 5661178 - DNA, 14 bp, Homo sapiens
ttttcgaaaatcaa

SEQ ID NO: 5661179 - DNA, 15 bp, Homo sapiens
ttttcgaaaatcaaa

SEQ ID NO: 5661180 - DNA, 19 bp, Homo sapiens
ttttcgccaaggctcacat

SEQ ID NO: 5661181 - DNA, 16 bp, Homo sapiens
ttttcgtcatcttccc

SEQ ID NO: 5661182 - DNA, 20 bp, Homo sapiens
ttttcgtcatcttccctgcc

SEQ ID NO: 5661183 - DNA, 21 bp, Homo sapiens
ttttcgtcatcttccctgccc

SEQ ID NO: 5661184 - DNA, 17 bp, Homo sapiens
ttttcgtgcactctgct

SEQ ID NO: 5661185 - DNA, 17 bp, Homo sapiens
ttttcgtgcatttgtga

SEQ ID NO: 5661186 - DNA, 17 bp, Homo sapiens
ttttcgtgtggatcttg

SEQ ID NO: 5661187 - DNA, 20 bp, Homo sapiens
ttttctaaaacattcccctc

SEQ ID NO: 5661188 - DNA, 13 bp, Homo sapiens
ttttctaaaagct

SEQ ID NO: 5661189 - DNA, 18 bp, Homo sapiens
ttttctaaacctgtgcct

SEQ ID NO: 5661190 - DNA, 20 bp, Homo sapiens
ttttctaaacgtaagcactg

SEQ ID NO: 5661191 - DNA, 21 bp, Homo sapiens
ttttctaaacgtaagcactgt

SEQ ID NO: 5661192 - DNA, 20 bp, Homo sapiens
ttttggttgaataaactaga

SEQ ID NO: 5661193 - DNA, 15 bp, Homo sapiens
ttttggttgctttaa

SEQ ID NO: 5661194 - DNA, 11 bp, Homo sapiens
ttttggttgtg

SEQ ID NO: 5661195 - DNA, 15 bp, Homo sapiens
ttttggttgtgattt

SEQ ID NO: 5661196 - DNA, 15 bp, Homo sapiens
ttttggttgtttgct

SEQ ID NO: 5661197 - DNA, 19 bp, Homo sapiens
ttttggtttcaccttccct

SEQ ID NO: 5661198 - DNA, 12 bp, Homo sapiens
ttttggtttctg

SEQ ID NO: 5661199 - DNA, 14 bp, Homo sapiens
ttttggtttttcct

SEQ ID NO: 5661200 - DNA, 17 bp, Homo sapiens
ttttggtttttcctcat

SEQ ID NO: 5661201 - DNA, 22 bp, Homo sapiens
ttttggtttttctcatttgaaa

SEQ ID NO: 5661202 - DNA, 23 bp, Homo sapiens
ttttgtaaaaactgaagaatttt

SEQ ID NO: 5661203 - DNA, 17 bp, Homo sapiens
ttttgtaaaaagggaaa

SEQ ID NO: 5661204 - DNA, 14 bp, Homo sapiens
ttttgtaaaacaat

SEQ ID NO: 5661205 - DNA, 13 bp, Homo sapiens
ttttgtaaaactg

SEQ ID NO: 5661206 - DNA, 13 bp, Homo sapiens
ttttgtaaaatat

SEQ ID NO: 5661207 - DNA, 13 bp, Homo sapiens
ttttgtaaacatt

SEQ ID NO: 5661208 - DNA, 15 bp, Homo sapiens
ttttgtaaacattta

SEQ ID NO: 5661209 - DNA, 19 bp, Homo sapiens
ttttgtaaacgacaagaat

SEQ ID NO: 5661210 - DNA, 15 bp, Homo sapiens
ttttgtaaactttga

SEQ ID NO: 5661211 - DNA, 17 bp, Homo sapiens
ttttgtaaactttgaaa

SEQ ID NO: 5661212 - DNA, 11 bp, Homo sapiens
ttttgtaaaga

SEQ ID NO: 5661213 - DNA, 16 bp, Homo sapiens
ttttgtaaagaaaaat

SEQ ID NO: 5661214 - DNA, 19 bp, Homo sapiens
ttttgtaaagaaatttact

SEQ ID NO: 5661215 - DNA, 21 bp, Homo sapiens
ttttgtaaagatgccgggttt

SEQ ID NO: 5661216 - DNA, 21 bp, Homo sapiens
ttttgtaaatcacatccttat

SEQ ID NO: 5661217 - DNA, 13 bp, Homo sapiens
ttttgtaaatctg

SEQ ID NO: 5661218 - DNA, 19 bp, Homo sapiens
ttttgtaaatgaaacttaa

SEQ ID NO: 5661219 - DNA, 16 bp, Homo sapiens
ttttgtaaatgctgta

SEQ ID NO: 5661220 - DNA, 13 bp, Homo sapiens
ttttgtaaccata

SEQ ID NO: 5661221 - DNA, 11 bp, Homo sapiens
ttttgtaactc

SEQ ID NO: 5661222 - DNA, 12 bp, Homo sapiens
ttttgtaactct

SEQ ID NO: 5661223 - DNA, 18 bp, Homo sapiens
ttttgtaacttccatgtg

SEQ ID NO: 5661224 - DNA, 14 bp, Homo sapiens
ttttgtaagacaaa

SEQ ID NO: 5661225 - DNA, 15 bp, Homo sapiens
ttttgtaagatgctg

SEQ ID NO: 5661226 - DNA, 18 bp, Homo sapiens
ttttgtaaggtactgaat

SEQ ID NO: 5661227 - DNA, 15 bp, Homo sapiens
ttttgtaataaaagg

SEQ ID NO: 5661228 - DNA, 16 bp, Homo sapiens
ttttgtaataaactct

SEQ ID NO: 5661229 - DNA, 16 bp, Homo sapiens
ttttgtaataagcaat

SEQ ID NO: 5661230 - DNA, 19 bp, Homo sapiens
ttttgtaataataaagaat

SEQ ID NO: 5661231 - DNA, 20 bp, Homo sapiens
ttttgtaatattctgttttg

SEQ ID NO: 5661232 - DNA, 17 bp, Homo sapiens
ttttgtaattattgtga

SEQ ID NO: 5661233 - DNA, 14 bp, Homo sapiens
ttttgtaattgctt

SEQ ID NO: 5661234 - DNA, 16 bp, Homo sapiens
ttttgtaattgtgtaa

SEQ ID NO: 5661235 - DNA, 18 bp, Homo sapiens
ttttgtaattgtgtaaaa

SEQ ID NO: 5661236 - DNA, 15 bp, Homo sapiens
ttttgtaatttgaat

SEQ ID NO: 5661237 - DNA, 21 bp, Homo sapiens
ttttgtacaaagttttccttt

SEQ ID NO: 5661238 - DNA, 17 bp, Homo sapiens
ttttgtacactgctgta

SEQ ID NO: 5661239 - DNA, 12 bp, Homo sapiens
ttttgtacagaa

SEQ ID NO: 5661240 - DNA, 22 bp, Homo sapiens
ttttgtacagaatttttaatga

SEQ ID NO: 5661241 - DNA, 15 bp, Homo sapiens
ttttgtacagtattt

SEQ ID NO: 5661242 - DNA, 17 bp, Homo sapiens
ttttgtacataaataag

SEQ ID NO: 5661243 - DNA, 16 bp, Homo sapiens
ttttgtacataacttc

SEQ ID NO: 5661244 - DNA, 13 bp, Homo sapiens
ttttgtacatact

SEQ ID NO: 5661245 - DNA, 20 bp, Homo sapiens
ttttgtacatagccaactgt

SEQ ID NO: 5661246 - DNA, 11 bp, Homo sapiens
ttttgtacatc

SEQ ID NO: 5661247 - DNA, 19 bp, Homo sapiens
ttttgtacatcgcttcttt

SEQ ID NO: 5661248 - DNA, 13 bp, Homo sapiens
ttttgtacatttt

SEQ ID NO: 5661249 - DNA, 20 bp, Homo sapiens
ttttgtacatttttcagcag

SEQ ID NO: 5661250 - DNA, 15 bp, Homo sapiens
ttttgtacatttttg

SEQ ID NO: 5661251 - DNA, 11 bp, Homo sapiens
ttttgtaccag

SEQ ID NO: 5661252 - DNA, 19 bp, Homo sapiens
ttttgtaccctgaagtgtt

SEQ ID NO: 5661253 - DNA, 18 bp, Homo sapiens
ttttgtacgttaattaaa

SEQ ID NO: 5661254 - DNA, 20 bp, Homo sapiens
ttttgtacgttatatattgt

SEQ ID NO: 5661255 - DNA, 16 bp, Homo sapiens
ttttgtacttggaagt

SEQ ID NO: 5661256 - DNA, 20 bp, Homo sapiens
ttttgtagagagagctgtat

SEQ ID NO: 5661257 - DNA, 23 bp, Homo sapiens
ttttgtagagagagctgtattaa

SEQ ID NO: 5661258 - DNA, 22 bp, Homo sapiens
ttttgtagatgaacttgagctc

SEQ ID NO: 5661259 - DNA, 16 bp, Homo sapiens
ttttgtaggaagcatt

SEQ ID NO: 5661260 - DNA, 12 bp, Homo sapiens
ttttgtataaaa

SEQ ID NO: 5661261 - DNA, 16 bp, Homo sapiens
ttttgtataaaataga

SEQ ID NO: 5661262 - DNA, 14 bp, Homo sapiens
ttttgtataaaatc

SEQ ID NO: 5661263 - DNA, 22 bp, Homo sapiens
ttttgtataaaatccatagatt

SEQ ID NO: 5661264 - DNA, 23 bp, Homo sapiens
ttttgtataaatgacaaagtgtt

SEQ ID NO: 5661265 - DNA, 24 bp, Homo sapiens
ttttgtataattggatttcctaat

SEQ ID NO: 5661266 - DNA, 13 bp, Homo sapiens
ttttgtatagaaa

SEQ ID NO: 5661267 - DNA, 21 bp, Homo sapiens
ttttgtatagaaaattcttga

SEQ ID NO: 5661268 - DNA, 16 bp, Homo sapiens
ttttgtatagtaaagt

SEQ ID NO: 5661269 - DNA, 23 bp, Homo sapiens
ttttgtatagttgtggacattta

SEQ ID NO: 5661270 - DNA, 19 bp, Homo sapiens
ttttgtatatacagttatt

SEQ ID NO: 5661271 - DNA, 22 bp, Homo sapiens
ttttgtatatacagttattttg

SEQ ID NO: 5661272 - DNA, 17 bp, Homo sapiens
ttttgtatattaacttt

SEQ ID NO: 5661273 - DNA, 14 bp, Homo sapiens
ttttgtatattggt

SEQ ID NO: 5661274 - DNA, 18 bp, Homo sapiens
ttttgtatattgtaggaa

SEQ ID NO: 5661275 - DNA, 23 bp, Homo sapiens
ttttgtatcaaactcgtctgatg

SEQ ID NO: 5661276 - DNA, 18 bp, Homo sapiens
ttttgtatcttcctttct

SEQ ID NO: 5661277 - DNA, 23 bp, Homo sapiens
ttttgtatgcaagcagtttcaat

SEQ ID NO: 5661278 - DNA, 14 bp, Homo sapiens
ttttgtatgtgtgt

SEQ ID NO: 5661279 - DNA, 14 bp, Homo sapiens
ttttgtatgttaaa

SEQ ID NO: 5661280 - DNA, 22 bp, Homo sapiens
ttttgtattcaattaaagaaat

SEQ ID NO: 5661281 - DNA, 16 bp, Homo sapiens
ttttgtattgtttaaa

SEQ ID NO: 5661282 - DNA, 12 bp, Homo sapiens
ttttgtatttag

SEQ ID NO: 5661283 - DNA, 17 bp, Homo sapiens
ttttgtatttcttttat

SEQ ID NO: 5661284 - DNA, 13 bp, Homo sapiens
ttttgtattttaa

SEQ ID NO: 5661285 - DNA, 18 bp, Homo sapiens
ttttgtattttcatgaaa

SEQ ID NO: 5661286 - DNA, 15 bp, Homo sapiens
ttttgtatttttaat

SEQ ID NO: 5661287 - DNA, 15 bp, Homo sapiens
ttttgtatttttgat

SEQ ID NO: 5661288 - DNA, 16 bp, Homo sapiens
ttttgtcaacattgtg

SEQ ID NO: 5661289 - DNA, 23 bp, Homo sapiens
ttttgtcaatgcagttgtctctg

SEQ ID NO: 5661290 - DNA, 16 bp, Homo sapiens
ttttgtcacattattt

SEQ ID NO: 5661291 - DNA, 21 bp, Homo sapiens
ttttgtcacccaacctggcat

SEQ ID NO: 5661292 - DNA, 18 bp, Homo sapiens
ttttgtcactttttctga

SEQ ID NO: 5661293 - DNA, 23 bp, Homo sapiens
ttttgtcataaaatgctatttta

SEQ ID NO: 5661294 - DNA, 16 bp, Homo sapiens
ttttgtcatataagat

SEQ ID NO: 5661295 - DNA, 17 bp, Homo sapiens
ttttgtcatgttatgca

SEQ ID NO: 5661296 - DNA, 14 bp, Homo sapiens
ttttgtccatcttg

SEQ ID NO: 5661297 - DNA, 17 bp, Homo sapiens
ttttgtccattattaat

SEQ ID NO: 5661298 - DNA, 17 bp, Homo sapiens
ttttgtcccatttcctt

SEQ ID NO: 5661299 - DNA, 16 bp, Homo sapiens
ttttgtccccagggcc

SEQ ID NO: 5661300 - DNA, 16 bp, Homo sapiens
ttttgtcctttcatgt

SEQ ID NO: 5661301 - DNA, 22 bp, Homo sapiens
ttttgtcctttgagaaagaaat

SEQ ID NO: 5661302 - DNA, 18 bp, Homo sapiens
ttttgtcgagtttacttc

SEQ ID NO: 5661303 - DNA, 15 bp, Homo sapiens
ttttgtctaattaaa

SEQ ID NO: 5661304 - DNA, 15 bp, Homo sapiens
ttttgtctctgagat

SEQ ID NO: 5661305 - DNA, 19 bp, Homo sapiens
ttttgtctgtgataacaga

SEQ ID NO: 5661306 - DNA, 13 bp, Homo sapiens
ttttgtctgttta

SEQ ID NO: 5661307 - DNA, 16 bp, Homo sapiens
ttttgtcttattctta

SEQ ID NO: 5661308 - DNA, 16 bp, Homo sapiens
ttttgtcttattgaaa

SEQ ID NO: 5661309 - DNA, 14 bp, Homo sapiens
ttttgtcttcctca

SEQ ID NO: 5661310 - DNA, 12 bp, Homo sapiens
ttttgtcttgaa

SEQ ID NO: 5661311 - DNA, 23 bp, Homo sapiens
ttttgtctttctattcagcaaaa

SEQ ID NO: 5661312 - DNA, 14 bp, Homo sapiens
ttttgtcttttatg

SEQ ID NO: 5661313 - DNA, 18 bp, Homo sapiens
ttttgtgaaaatgtcaaa

SEQ ID NO: 5661314 - DNA, 20 bp, Homo sapiens
ttttgtgaaatttttcatat

SEQ ID NO: 5661315 - DNA, 14 bp, Homo sapiens
ttttgtgaagactg

SEQ ID NO: 5661316 - DNA, 16 bp, Homo sapiens
ttttgtgaagccctgt

SEQ ID NO: 5661317 - DNA, 17 bp, Homo sapiens
ttttgtgaagccctgtt

SEQ ID NO: 5661318 - DNA, 14 bp, Homo sapiens
ttttgtgaagtatt

SEQ ID NO: 5661319 - DNA, 18 bp, Homo sapiens
ttttgtgaagtattcaca

SEQ ID NO: 5661320 - DNA, 23 bp, Homo sapiens
ttttgtgaatggattggattatt

SEQ ID NO: 5661321 - DNA, 14 bp, Homo sapiens
ttttgtgaatggtt

SEQ ID NO: 5661322 - DNA, 20 bp, Homo sapiens
ttttgtgacccctttcactt

SEQ ID NO: 5661323 - DNA, 13 bp, Homo sapiens
ttttgtgagaaag

SEQ ID NO: 5661324 - DNA, 23 bp, Homo sapiens
ttttgtgagtttgtttctttgaa

SEQ ID NO: 5661325 - DNA, 18 bp, Homo sapiens
ttttgtgatgatgctgtg

SEQ ID NO: 5661326 - DNA, 22 bp, Homo sapiens
ttttgtgcaaaagcttcaaatt

SEQ ID NO: 5661327 - DNA, 13 bp, Homo sapiens
ttttgtgcattct

SEQ ID NO: 5661328 - DNA, 12 bp, Homo sapiens
ttttgtgcattt

SEQ ID NO: 5661329 - DNA, 12 bp, Homo sapiens
ttttgtgcttta

SEQ ID NO: 5661330 - DNA, 11 bp, Homo sapiens
ttttgtggatt

SEQ ID NO: 5661331 - DNA, 20 bp, Homo sapiens
ttttgtggctgatttcaaat

SEQ ID NO: 5661332 - DNA, 12 bp, Homo sapiens
ttttgtggggct

SEQ ID NO: 5661333 - DNA, 22 bp, Homo sapiens
ttttgtgggtttctctgtgctc

SEQ ID NO: 5661334 - DNA, 17 bp, Homo sapiens
ttttgtggtttggaata

SEQ ID NO: 5661335 - DNA, 17 bp, Homo sapiens
ttttgtgtaatgaaaat

SEQ ID NO: 5661336 - DNA, 16 bp, Homo sapiens
ttttgtgtacagtatg

SEQ ID NO: 5661337 - DNA, 13 bp, Homo sapiens
ttttgtgtcccat

SEQ ID NO: 5661338 - DNA, 16 bp, Homo sapiens
ttttgtgtctcattta

SEQ ID NO: 5661339 - DNA, 14 bp, Homo sapiens
ttttgtgtctcctt

SEQ ID NO: 5661340 - DNA, 15 bp, Homo sapiens
ttttgtgtcttaaga

SEQ ID NO: 5661341 - DNA, 20 bp, Homo sapiens
ttttgtgtcttttaaactgg

SEQ ID NO: 5661342 - DNA, 14 bp, Homo sapiens
ttttgtgtgaaatt

SEQ ID NO: 5661343 - DNA, 21 bp, Homo sapiens
ttttgtgtgagacttaaaaca

SEQ ID NO: 5661344 - DNA, 13 bp, Homo sapiens
ttttgtgtgtata

SEQ ID NO: 5661345 - DNA, 14 bp, Homo sapiens
ttttgtgttccttt

SEQ ID NO: 5661346 - DNA, 23 bp, Homo sapiens
ttttgtgtttattcttgatgaaa

SEQ ID NO: 5661347 - DNA, 15 bp, Homo sapiens
ttttgtgtttctaaa

SEQ ID NO: 5661348 - DNA, 18 bp, Homo sapiens
ttttgtgtttttccaaaa

SEQ ID NO: 5661349 - DNA, 14 bp, Homo sapiens
ttttgttaaagctg

SEQ ID NO: 5661350 - DNA, 18 bp, Homo sapiens
ttttgttaatcatcttct

SEQ ID NO: 5661351 - DNA, 20 bp, Homo sapiens
ttttgttactgattcaatta

SEQ ID NO: 5661352 - DNA, 12 bp, Homo sapiens
ttttgttactgt

SEQ ID NO: 5661353 - DNA, 14 bp, Homo sapiens
ttttgttactgttc

SEQ ID NO: 5661354 - DNA, 15 bp, Homo sapiens
ttttgttactgttct

SEQ ID NO: 5661355 - DNA, 20 bp, Homo sapiens
ttttgttactgttcttgctg

SEQ ID NO: 5661356 - DNA, 16 bp, Homo sapiens
ttttgttactgtttta

SEQ ID NO: 5661357 - DNA, 18 bp, Homo sapiens
ttttgttatcagtcaata

SEQ ID NO: 5661358 - DNA, 20 bp, Homo sapiens
ttttgttattaaaaaaacac

SEQ ID NO: 5661359 - DNA, 13 bp, Homo sapiens
ttttgttcagaat

SEQ ID NO: 5661360 - DNA, 20 bp, Homo sapiens
ttttgttccaatgtcaatgt

SEQ ID NO: 5661361 - DNA, 22 bp, Homo sapiens
ttttgttcccatcctcttcttt

SEQ ID NO: 5661362 - DNA, 19 bp, Homo sapiens
ttttgttcccctcctccac

SEQ ID NO: 5661363 - DNA, 16 bp, Homo sapiens
ttttgttcctgtgtat

SEQ ID NO: 5661364 - DNA, 23 bp, Homo sapiens
ttttgttcgcatggtcacacact

SEQ ID NO: 5661365 - DNA, 13 bp, Homo sapiens
ttttgttctctgg

SEQ ID NO: 5661366 - DNA, 17 bp, Homo sapiens
ttttgttctctgggaga

SEQ ID NO: 5661367 - DNA, 14 bp, Homo sapiens
ttttgttctcttct

SEQ ID NO: 5661368 - DNA, 11 bp, Homo sapiens
ttttgttctgt

SEQ ID NO: 5661369 - DNA, 12 bp, Homo sapiens
ttttgttctgta

SEQ ID NO: 5661370 - DNA, 19 bp, Homo sapiens
ttttgttcttaattgcact

SEQ ID NO: 5661371 - DNA, 22 bp, Homo sapiens
ttttgttcttacacatacagtt

SEQ ID NO: 5661372 - DNA, 17 bp, Homo sapiens
aaccattaaccagatct

SEQ ID NO: 5661373 - DNA, 14 bp, Homo sapiens
aaccattacctgta

SEQ ID NO: 5661374 - DNA, 14 bp, Homo sapiens
aaccattatacttt

SEQ ID NO: 5661375 - DNA, 18 bp, Homo sapiens
aaccattatactttatat

SEQ ID NO: 5661376 - DNA, 22 bp, Homo sapiens
aaccattatgatcaaaaactgc

SEQ ID NO: 5661377 - DNA, 19 bp, Homo sapiens
aaccattatttaataagag

SEQ ID NO: 5661378 - DNA, 22 bp, Homo sapiens
aaccattcaaatgacgcctgat

SEQ ID NO: 5661379 - DNA, 18 bp, Homo sapiens
aaccattccctagtcatt

SEQ ID NO: 5661380 - DNA, 21 bp, Homo sapiens
aaccattccctagtcatttcc

SEQ ID NO: 5661381 - DNA, 23 bp, Homo sapiens
aaccattggggaggactaggacc

SEQ ID NO: 5661382 - DNA, 24 bp, Homo sapiens
aaccattgtcttgttctgtgatga

SEQ ID NO: 5661383 - DNA, 21 bp, Homo sapiens
aaccatttaaagaaagaatgc

SEQ ID NO: 5661384 - DNA, 20 bp, Homo sapiens
aaccatttaataaagaaata

SEQ ID NO: 5661385 - DNA, 17 bp, Homo sapiens
aaccatttaattcataa

SEQ ID NO: 5661386 - DNA, 22 bp, Homo sapiens
aaccatttaattcataattaga

SEQ ID NO: 5661387 - DNA, 23 bp, Homo sapiens
aaccatttaattcataattagaa

SEQ ID NO: 5661388 - DNA, 14 bp, Homo sapiens
aaccatttcaaatg

SEQ ID NO: 5661389 - DNA, 21 bp, Homo sapiens
aaccatttcaagacagattgt

SEQ ID NO: 5661390 - DNA, 15 bp, Homo sapiens
aaccatttcctcaga

SEQ ID NO: 5661391 - DNA, 14 bp, Homo sapiens
aaccatttctcact

SEQ ID NO: 5661392 - DNA, 22 bp, Homo sapiens
aaccatttgggatggagaagca

SEQ ID NO: 5661393 - DNA, 16 bp, Homo sapiens
aaccatttgttaactg

SEQ ID NO: 5661394 - DNA, 17 bp, Homo sapiens
aaccatttgttaactgt

SEQ ID NO: 5661395 - DNA, 23 bp, Homo sapiens
aaccatttgttaactgtactgaa

SEQ ID NO: 5661396 - DNA, 21 bp, Homo sapiens
aaccattttagttcctttatt

SEQ ID NO: 5661397 - DNA, 14 bp, Homo sapiens
aaccattttataaa

SEQ ID NO: 5661398 - DNA, 20 bp, Homo sapiens
aaccattttataaagtgctt

SEQ ID NO: 5661399 - DNA, 15 bp, Homo sapiens
aaccattttcatttg

SEQ ID NO: 5661400 - DNA, 16 bp, Homo sapiens
aaccatttttgctgaa

SEQ ID NO: 5661401 - DNA, 20 bp, Homo sapiens
aaccatttttgctgaattca

SEQ ID NO: 5661402 - DNA, 14 bp, Homo sapiens
aaccatttttgtta

SEQ ID NO: 5661403 - DNA, 22 bp, Homo sapiens
aaccattttttgttctgtgtcc

SEQ ID NO: 5661404 - DNA, 20 bp, Homo sapiens
aaccattttttttcagcaga

SEQ ID NO: 5661405 - DNA, 13 bp, Homo sapiens
aacccaaaagatt

SEQ ID NO: 5661406 - DNA, 22 bp, Homo sapiens
aacccaaacaaaaatgactcta

SEQ ID NO: 5661407 - DNA, 14 bp, Homo sapiens
aacccaaacctgga

SEQ ID NO: 5661408 - DNA, 18 bp, Homo sapiens
aacccaaaggtggcagct

SEQ ID NO: 5661409 - DNA, 22 bp, Homo sapiens
aacccaaattacgtgtactaca

SEQ ID NO: 5661410 - DNA, 21 bp, Homo sapiens
aacccaaattgggacaacagt

SEQ ID NO: 5661411 - DNA, 13 bp, Homo sapiens
aacccaaggagca

SEQ ID NO: 5661412 - DNA, 16 bp, Homo sapiens
aacccaaggagcacag

SEQ ID NO: 5661413 - DNA, 20 bp, Homo sapiens
aacccaaggagcacaggtcc

SEQ ID NO: 5661414 - DNA, 15 bp, Homo sapiens
aacccaagtgcctca

SEQ ID NO: 5661415 - DNA, 16 bp, Homo sapiens
aacccaagtgggggca

SEQ ID NO: 5661416 - DNA, 15 bp, Homo sapiens
aacccaatccctctc

SEQ ID NO: 5661417 - DNA, 16 bp, Homo sapiens
aacccaatccctctcc

SEQ ID NO: 5661418 - DNA, 20 bp, Homo sapiens
aacccaattcaggactggct

SEQ ID NO: 5661419 - DNA, 17 bp, Homo sapiens
aacccacaagctgcctc

SEQ ID NO: 5661420 - DNA, 17 bp, Homo sapiens
aacccacagctcagctg

SEQ ID NO: 5661421 - DNA, 18 bp, Homo sapiens
aacccacagtttgagacc

SEQ ID NO: 5661422 - DNA, 19 bp, Homo sapiens
aacccaccagcctaagaag

SEQ ID NO: 5661423 - DNA, 23 bp, Homo sapiens
aacccaccagcctaagaagctct

SEQ ID NO: 5661424 - DNA, 14 bp, Homo sapiens
aacccacctctcct

SEQ ID NO: 5661425 - DNA, 16 bp, Homo sapiens
aacccacctctcctgc

SEQ ID NO: 5661426 - DNA, 19 bp, Homo sapiens
aacccacctctcctgccct

SEQ ID NO: 5661427 - DNA, 15 bp, Homo sapiens
aacccacctctctgg

SEQ ID NO: 5661428 - DNA, 19 bp, Homo sapiens
aacccacctctggccctgt

SEQ ID NO: 5661429 - DNA, 14 bp, Homo sapiens
aacccacctgctga

SEQ ID NO: 5661430 - DNA, 22 bp, Homo sapiens
aacccaccttgttggagcctgc

SEQ ID NO: 5661431 - DNA, 13 bp, Homo sapiens
aacccactgtgct

SEQ ID NO: 5661432 - DNA, 21 bp, Homo sapiens
aacccacttctggcctccagc

SEQ ID NO: 5661433 - DNA, 14 bp, Homo sapiens
aacccagaaacacc

SEQ ID NO: 5661434 - DNA, 19 bp, Homo sapiens
aacccagacaaccaaaaca

SEQ ID NO: 5661435 - DNA, 15 bp, Homo sapiens
aacccagagatgcct

SEQ ID NO: 5661436 - DNA, 16 bp, Homo sapiens
aacccagagctgtatt

SEQ ID NO: 5661437 - DNA, 13 bp, Homo sapiens
aacccagattttg

SEQ ID NO: 5661438 - DNA, 17 bp, Homo sapiens
aacccagcaacagaaaa

SEQ ID NO: 5661439 - DNA, 20 bp, Homo sapiens
aacccagcagttctctgcca

SEQ ID NO: 5661440 - DNA, 13 bp, Homo sapiens
aacccagcccctg

SEQ ID NO: 5661441 - DNA, 15 bp, Homo sapiens
aacccagccctgggg

SEQ ID NO: 5661442 - DNA, 16 bp, Homo sapiens
aacccagccctggggt

SEQ ID NO: 5661443 - DNA, 10 bp, Homo sapiens
aacccagccg

SEQ ID NO: 5661444 - DNA, 16 bp, Homo sapiens
aacccagccgctgccc

SEQ ID NO: 5661445 - DNA, 16 bp, Homo sapiens
aacccagcctgagtgc

SEQ ID NO: 5661446 - DNA, 22 bp, Homo sapiens
aacccagcggcttagccaagcc

SEQ ID NO: 5661447 - DNA, 11 bp, Homo sapiens
aacccagctct

SEQ ID NO: 5661448 - DNA, 13 bp, Homo sapiens
aacccagctctgg

SEQ ID NO: 5661449 - DNA, 16 bp, Homo sapiens
aacccagctgcacccc

SEQ ID NO: 5661450 - DNA, 19 bp, Homo sapiens
aacccaggacatctcctgg

SEQ ID NO: 5661451 - DNA, 22 bp, Homo sapiens
aacccaggacatctcctggcta

SEQ ID NO: 5661452 - DNA, 16 bp, Homo sapiens
aacccaggacgcttct

SEQ ID NO: 5661453 - DNA, 18 bp, Homo sapiens
aacccaggacgcttctga

SEQ ID NO: 5661454 - DNA, 13 bp, Homo sapiens
aacccaggagcat

SEQ ID NO: 5661455 - DNA, 22 bp, Homo sapiens
aacccaggagcatccacctcct

SEQ ID NO: 5661456 - DNA, 11 bp, Homo sapiens
aacccaggagg

SEQ ID NO: 5661457 - DNA, 18 bp, Homo sapiens
aacccaggaggtggaggt

SEQ ID NO: 5661458 - DNA, 20 bp, Homo sapiens
aacatgctgtacatactttt

SEQ ID NO: 5661459 - DNA, 21 bp, Homo sapiens
aacatgctgtacatacttttt

SEQ ID NO: 5661460 - DNA, 19 bp, Homo sapiens
aacatgctgtgtaagctgt

SEQ ID NO: 5661461 - DNA, 21 bp, Homo sapiens
aacatgctgtgtaagctgtgt

SEQ ID NO: 5661462 - DNA, 23 bp, Homo sapiens
aacatgctgttatttaggtattt

SEQ ID NO: 5661463 - DNA, 18 bp, Homo sapiens
aacatgcttttactttat

SEQ ID NO: 5661464 - DNA, 17 bp, Homo sapiens
aacatgcttttccaaac

SEQ ID NO: 5661465 - DNA, 13 bp, Homo sapiens
aacatggaagata

SEQ ID NO: 5661466 - DNA, 15 bp, Homo sapiens
aacatggaagtacta

SEQ ID NO: 5661467 - DNA, 20 bp, Homo sapiens
aacatggaccatccaaattt

SEQ ID NO: 5661468 - DNA, 15 bp, Homo sapiens
aacatggacttgtat

SEQ ID NO: 5661469 - DNA, 16 bp, Homo sapiens
aacatggacttgtata

SEQ ID NO: 5661470 - DNA, 20 bp, Homo sapiens
aacatggacttgtatatttg

SEQ ID NO: 5661471 - DNA, 19 bp, Homo sapiens
aacatggagaaaccctgtc

SEQ ID NO: 5661472 - DNA, 23 bp, Homo sapiens
aacatggagaaaccctgtctcta

SEQ ID NO: 5661473 - DNA, 14 bp, Homo sapiens
aacatggagaaatc

SEQ ID NO: 5661474 - DNA, 18 bp, Homo sapiens
aacatggagaaatctact

SEQ ID NO: 5661475 - DNA, 23 bp, Homo sapiens
aacatggcaaaaccccatctcta

SEQ ID NO: 5661476 - DNA, 17 bp, Homo sapiens
aacatggcatgtgaaaa

SEQ ID NO: 5661477 - DNA, 12 bp, Homo sapiens
aacatggccaat

SEQ ID NO: 5661478 - DNA, 23 bp, Homo sapiens
aacatggcctttgcttgaaagaa

SEQ ID NO: 5661479 - DNA, 20 bp, Homo sapiens
aacatggctacttgctttga

SEQ ID NO: 5661480 - DNA, 18 bp, Homo sapiens
aacatggctggcctggta

SEQ ID NO: 5661481 - DNA, 16 bp, Homo sapiens
aacatggcttctcctt

SEQ ID NO: 5661482 - DNA, 20 bp, Homo sapiens
aacatgggagggatcagccc

SEQ ID NO: 5661483 - DNA, 15 bp, Homo sapiens
aacatgggcattggg

SEQ ID NO: 5661484 - DNA, 20 bp, Homo sapiens
aacatgggctgtgattactg

SEQ ID NO: 5661485 - DNA, 21 bp, Homo sapiens
aacatgggctgtgattactgc

SEQ ID NO: 5661486 - DNA, 20 bp, Homo sapiens
aacatggggcccctctcatc

SEQ ID NO: 5661487 - DNA, 18 bp, Homo sapiens
aacatggtacactgcatc

SEQ ID NO: 5661488 - DNA, 23 bp, Homo sapiens
aacatggtgaaaccccatctcta

SEQ ID NO: 5661489 - DNA, 15 bp, Homo sapiens
aacatggtgcctata

SEQ ID NO: 5661490 - DNA, 22 bp, Homo sapiens
aacatggtggaaaacgaagctc

SEQ ID NO: 5661491 - DNA, 21 bp, Homo sapiens
aacatggtgtgtgtctctgac

SEQ ID NO: 5661492 - DNA, 13 bp, Homo sapiens
aacatgtaaaatg

SEQ ID NO: 5661493 - DNA, 20 bp, Homo sapiens
aacatgtaaccggcatgttt

SEQ ID NO: 5661494 - DNA, 14 bp, Homo sapiens
aacatgtaattaag

SEQ ID NO: 5661495 - DNA, 20 bp, Homo sapiens
aacatgtactacagctatat

SEQ ID NO: 5661496 - DNA, 21 bp, Homo sapiens
aacatgtactacagctatatt

SEQ ID NO: 5661497 - DNA, 19 bp, Homo sapiens
aacatgtagggcaagagga

SEQ ID NO: 5661498 - DNA, 18 bp, Homo sapiens
aacatgtatcactcactg

SEQ ID NO: 5661499 - DNA, 15 bp, Homo sapiens
aacatgtatctgtct

SEQ ID NO: 5661500 - DNA, 20 bp, Homo sapiens
aacatgtatctgtctacttt

SEQ ID NO: 5661501 - DNA, 19 bp, Homo sapiens
aacatgtatgatttctgtt

SEQ ID NO: 5661502 - DNA, 14 bp, Homo sapiens
aacatgtatgtgga

SEQ ID NO: 5661503 - DNA, 12 bp, Homo sapiens
aacatgtattta

SEQ ID NO: 5661504 - DNA, 21 bp, Homo sapiens
aacatgtatttatgtaatgaa

SEQ ID NO: 5661505 - DNA, 22 bp, Homo sapiens
aacatgtcatgtaggttgtcta

SEQ ID NO: 5661506 - DNA, 19 bp, Homo sapiens
aacatgtcctgcctattat

SEQ ID NO: 5661507 - DNA, 13 bp, Homo sapiens
aacatgtctccta

SEQ ID NO: 5661508 - DNA, 17 bp, Homo sapiens
aacatgtgaaaagaata

SEQ ID NO: 5661509 - DNA, 16 bp, Homo sapiens
aacatgtgcccctgcc

SEQ ID NO: 5661510 - DNA, 18 bp, Homo sapiens
aacatgtgccttttctga

SEQ ID NO: 5661511 - DNA, 19 bp, Homo sapiens
aacatgtgccttttctgaa

SEQ ID NO: 5661512 - DNA, 13 bp, Homo sapiens
aacatgtgcttca

SEQ ID NO: 5661513 - DNA, 14 bp, Homo sapiens
aacatgtggaagaa

SEQ ID NO: 5661514 - DNA, 16 bp, Homo sapiens
aacatgtggagtgtat

SEQ ID NO: 5661515 - DNA, 16 bp, Homo sapiens
aacatgtggctcctcc

SEQ ID NO: 5661516 - DNA, 20 bp, Homo sapiens
aacatgtggctcctcccagc

SEQ ID NO: 5661517 - DNA, 22 bp, Homo sapiens
aacatgtggcttgaattaagaa

SEQ ID NO: 5661518 - DNA, 15 bp, Homo sapiens
aacatgtgtttctga

SEQ ID NO: 5661519 - DNA, 19 bp, Homo sapiens
aacatgtgttttcatcatt

SEQ ID NO: 5661520 - DNA, 20 bp, Homo sapiens
aacatgtgttttcatcattt

SEQ ID NO: 5661521 - DNA, 14 bp, Homo sapiens
aacatgttaaacca

SEQ ID NO: 5661522 - DNA, 15 bp, Homo sapiens
aacatgttaaaccat

SEQ ID NO: 5661523 - DNA, 16 bp, Homo sapiens
aacatgttaaaccatg

SEQ ID NO: 5661524 - DNA, 12 bp, Homo sapiens
aacatgttaaga

SEQ ID NO: 5661525 - DNA, 22 bp, Homo sapiens
aacatgttaatgacaatattcc

SEQ ID NO: 5661526 - DNA, 17 bp, Homo sapiens
aacatgttactgaccag

SEQ ID NO: 5661527 - DNA, 21 bp, Homo sapiens
aacatgttattcaatgtgaca

SEQ ID NO: 5661528 - DNA, 13 bp, Homo sapiens
aacatgtttaatg

SEQ ID NO: 5661529 - DNA, 16 bp, Homo sapiens
aacatgtttaatgggt

SEQ ID NO: 5661530 - DNA, 14 bp, Homo sapiens
aacatgtttcactt

SEQ ID NO: 5661531 - DNA, 19 bp, Homo sapiens
aacatgtttccagcattcc

SEQ ID NO: 5661532 - DNA, 15 bp, Homo sapiens
aacattaaaactcat

SEQ ID NO: 5661533 - DNA, 19 bp, Homo sapiens
aacattaaaactcataatt

SEQ ID NO: 5661534 - DNA, 14 bp, Homo sapiens
aacattaaatgtct

SEQ ID NO: 5661535 - DNA, 15 bp, Homo sapiens
aacattaaatgtctt

SEQ ID NO: 5661536 - DNA, 14 bp, Homo sapiens
aacattaagaaaat

SEQ ID NO: 5661537 - DNA, 18 bp, Homo sapiens
aacattaagaaaatcata

SEQ ID NO: 5661538 - DNA, 14 bp, Homo sapiens
aacattaaggaatt

SEQ ID NO: 5661539 - DNA, 17 bp, Homo sapiens
aacattaaggaatttga

SEQ ID NO: 5661540 - DNA, 19 bp, Homo sapiens
aacattaaggcagtatgat

SEQ ID NO: 5661541 - DNA, 23 bp, Homo sapiens
aacattaatgcctgctttttgga

SEQ ID NO: 5661542 - DNA, 17 bp, Homo sapiens
aacattaattctactaa

SEQ ID NO: 5661543 - DNA, 18 bp, Homo sapiens
aacattacagttcataat

SEQ ID NO: 5661544 - DNA, 15 bp, Homo sapiens
aacattacttattta

SEQ ID NO: 5661545 - DNA, 15 bp, Homo sapiens
aacattagaagaaaa

SEQ ID NO: 5661546 - DNA, 20 bp, Homo sapiens
aacattagaagaaaacatat

SEQ ID NO: 5661547 - DNA, 23 bp, Homo sapiens
aacattagaagaaaacatatatt

SEQ ID NO: 5661548 - DNA, 23 bp, Homo sapiens
aacattagataattaaatagtga

SEQ ID NO: 5661549 - DNA, 20 bp, Homo sapiens
aacccctcccctccatccct

SEQ ID NO: 5661550 - DNA, 21 bp, Homo sapiens
aacccctcccctccatccctg

SEQ ID NO: 5661551 - DNA, 14 bp, Homo sapiens
aacccctcctccct

SEQ ID NO: 5661552 - DNA, 15 bp, Homo sapiens
aacccctcctggctg

SEQ ID NO: 5661553 - DNA, 12 bp, Homo sapiens
aacccctcgccc

SEQ ID NO: 5661554 - DNA, 20 bp, Homo sapiens
aacccctcgcccagtcccag

SEQ ID NO: 5661555 - DNA, 18 bp, Homo sapiens
aacccctctccaggcctg

SEQ ID NO: 5661556 - DNA, 19 bp, Homo sapiens
aacccctgacaccttttca

SEQ ID NO: 5661557 - DNA, 20 bp, Homo sapiens
aacccctgacctaccccagc

SEQ ID NO: 5661558 - DNA, 20 bp, Homo sapiens
aacccctggctccaggccag

SEQ ID NO: 5661559 - DNA, 16 bp, Homo sapiens
aacccctggctccttc

SEQ ID NO: 5661560 - DNA, 17 bp, Homo sapiens
aacccctggctccttca

SEQ ID NO: 5661561 - DNA, 13 bp, Homo sapiens
aacccctgtaccc

SEQ ID NO: 5661562 - DNA, 23 bp, Homo sapiens
aacccctgtcccatgcaggccct

SEQ ID NO: 5661563 - DNA, 20 bp, Homo sapiens
aaccccttctctgtgaccca

SEQ ID NO: 5661564 - DNA, 21 bp, Homo sapiens
aacccgaggggccggggaagc

SEQ ID NO: 5661565 - DNA, 16 bp, Homo sapiens
aacccggcttcctgtg

SEQ ID NO: 5661566 - DNA, 16 bp, Homo sapiens
aacccgggggacagag

SEQ ID NO: 5661567 - DNA, 14 bp, Homo sapiens
aacccggtcccagg

SEQ ID NO: 5661568 - DNA, 15 bp, Homo sapiens
aacccggtcccaggc

SEQ ID NO: 5661569 - DNA, 18 bp, Homo sapiens
aacccggtgctccctctg

SEQ ID NO: 5661570 - DNA, 21 bp, Homo sapiens
aacccgtccattcagaaagct

SEQ ID NO: 5661571 - DNA, 16 bp, Homo sapiens
aacccgtgcagaacca

SEQ ID NO: 5661572 - DNA, 14 bp, Homo sapiens
aacccgtggaggct

SEQ ID NO: 5661573 - DNA, 18 bp, Homo sapiens
aacccgtggaggctgctc

SEQ ID NO: 5661574 - DNA, 21 bp, Homo sapiens
aacccgttgggtcccttgctg

SEQ ID NO: 5661575 - DNA, 21 bp, Homo sapiens
aaccctaaaaagcagagcttt

SEQ ID NO: 5661576 - DNA, 22 bp, Homo sapiens
aaccctaaagcaaatctgccac

SEQ ID NO: 5661577 - DNA, 19 bp, Homo sapiens
aaccctaagtgtggatgtt

SEQ ID NO: 5661578 - DNA, 16 bp, Homo sapiens
aaccctacagtatata

SEQ ID NO: 5661579 - DNA, 16 bp, Homo sapiens
aaccctagaaatatat

SEQ ID NO: 5661580 - DNA, 17 bp, Homo sapiens
aaccctaggaatttaga

SEQ ID NO: 5661581 - DNA, 15 bp, Homo sapiens
aaccctataaaagtg

SEQ ID NO: 5661582 - DNA, 21 bp, Homo sapiens
aaccctatactgtagtattct

SEQ ID NO: 5661583 - DNA, 15 bp, Homo sapiens
aaccctatctcctga

SEQ ID NO: 5661584 - DNA, 22 bp, Homo sapiens
aaccctatctcctgacagaagg

SEQ ID NO: 5661585 - DNA, 23 bp, Homo sapiens
aaccctatctcctgacagaaggt

SEQ ID NO: 5661586 - DNA, 19 bp, Homo sapiens
aaccctatgccttttgtag

SEQ ID NO: 5661587 - DNA, 12 bp, Homo sapiens
aaccctcactgg

SEQ ID NO: 5661588 - DNA, 12 bp, Homo sapiens
aaccctcagagc

SEQ ID NO: 5661589 - DNA, 19 bp, Homo sapiens
aaccctcagctgcctcatc

SEQ ID NO: 5661590 - DNA, 10 bp, Homo sapiens
aaccctcagg

SEQ ID NO: 5661591 - DNA, 11 bp, Homo sapiens
aaccctcaggg

SEQ ID NO: 5661592 - DNA, 18 bp, Homo sapiens
aaccctcagggcaaagcc

SEQ ID NO: 5661593 - DNA, 20 bp, Homo sapiens
aaccctcagggcaaagccag

SEQ ID NO: 5661594 - DNA, 23 bp, Homo sapiens
aaccctcaggggaaaactgttac

SEQ ID NO: 5661595 - DNA, 21 bp, Homo sapiens
aaccctcattgctgtcttgcc

SEQ ID NO: 5661596 - DNA, 22 bp, Homo sapiens
aaccctcattgctgtcttgccc

SEQ ID NO: 5661597 - DNA, 18 bp, Homo sapiens
aaccctccaaaggaactc

SEQ ID NO: 5661598 - DNA, 21 bp, Homo sapiens
aaccctccaaaggaactctag

SEQ ID NO: 5661599 - DNA, 15 bp, Homo sapiens
aaccctccaccccta

SEQ ID NO: 5661600 - DNA, 21 bp, Homo sapiens
aaccctccacctcctctcttg

SEQ ID NO: 5661601 - DNA, 16 bp, Homo sapiens
aaccctccctcagccc

SEQ ID NO: 5661602 - DNA, 23 bp, Homo sapiens
aaccctccctcagcccctcttgc

SEQ ID NO: 5661603 - DNA, 21 bp, Homo sapiens
aaccctcctatcacctcccct

SEQ ID NO: 5661604 - DNA, 14 bp, Homo sapiens
aaccctcctccttt

SEQ ID NO: 5661605 - DNA, 16 bp, Homo sapiens
aaccctcctccttttt

SEQ ID NO: 5661606 - DNA, 22 bp, Homo sapiens
aaccctcctgggaaggccacct

SEQ ID NO: 5661607 - DNA, 21 bp, Homo sapiens
aaccctccttggtgcctctgg

SEQ ID NO: 5661608 - DNA, 15 bp, Homo sapiens
aaccctccttttctc

SEQ ID NO: 5661609 - DNA, 15 bp, Homo sapiens
aaccctcgccctgtc

SEQ ID NO: 5661610 - DNA, 16 bp, Homo sapiens
aaccctcgccctgtcc

SEQ ID NO: 5661611 - DNA, 21 bp, Homo sapiens
aaccctcgccctgtccctccc

SEQ ID NO: 5661612 - DNA, 18 bp, Homo sapiens
aaccctctccatctccca

SEQ ID NO: 5661613 - DNA, 17 bp, Homo sapiens
aaccctctcctgtctgc

SEQ ID NO: 5661614 - DNA, 12 bp, Homo sapiens
aaccctctgtca

SEQ ID NO: 5661615 - DNA, 13 bp, Homo sapiens
aaccctctgtcac

SEQ ID NO: 5661616 - DNA, 15 bp, Homo sapiens
aaccctcttgccatc

SEQ ID NO: 5661617 - DNA, 18 bp, Homo sapiens
aaccctcttgccatcctg

SEQ ID NO: 5661618 - DNA, 19 bp, Homo sapiens
aaccctgaggtatctgtgt

SEQ ID NO: 5661619 - DNA, 19 bp, Homo sapiens
aaccctgattcatactcct

SEQ ID NO: 5661620 - DNA, 12 bp, Homo sapiens
aaccctgccagt

SEQ ID NO: 5661621 - DNA, 15 bp, Homo sapiens
aaccctgccagtgcc

SEQ ID NO: 5661622 - DNA, 13 bp, Homo sapiens
aaccctgccatgg

SEQ ID NO: 5661623 - DNA, 23 bp, Homo sapiens
aaccctgcccacttcagcccagc

SEQ ID NO: 5661624 - DNA, 17 bp, Homo sapiens
aaccctgcccccaaata

SEQ ID NO: 5661625 - DNA, 11 bp, Homo sapiens
aaccctgccct

SEQ ID NO: 5661626 - DNA, 15 bp, Homo sapiens
aaccctgccctgcac

SEQ ID NO: 5661627 - DNA, 15 bp, Homo sapiens
aaccctgccctgctc

SEQ ID NO: 5661628 - DNA, 17 bp, Homo sapiens
aaccctgccctgctctg

SEQ ID NO: 5661629 - DNA, 22 bp, Homo sapiens
aaccctgcctgccgctgcacct

SEQ ID NO: 5661630 - DNA, 19 bp, Homo sapiens
aaccctgcgtggggacagg

SEQ ID NO: 5661631 - DNA, 13 bp, Homo sapiens
aaccctgctccgt

SEQ ID NO: 5661632 - DNA, 14 bp, Homo sapiens
aaccctgctgaaca

SEQ ID NO: 5661633 - DNA, 20 bp, Homo sapiens
aaccctgctgaacacagtgt

SEQ ID NO: 5661634 - DNA, 22 bp, Homo sapiens
aaccctgctgaacacagtgtct

SEQ ID NO: 5661635 - DNA, 23 bp, Homo sapiens
aaccctgctgaacacagtgtctg

SEQ ID NO: 5661636 - DNA, 12 bp, Homo sapiens
aaccctgcttct

SEQ ID NO: 5661637 - DNA, 12 bp, Homo sapiens
aacatttcagaa

SEQ ID NO: 5661638 - DNA, 15 bp, Homo sapiens
aacatttcagtgttt

SEQ ID NO: 5661639 - DNA, 23 bp, Homo sapiens
aacatttcagtgttttgcttttt

SEQ ID NO: 5661640 - DNA, 14 bp, Homo sapiens
aacatttcataatt

SEQ ID NO: 5661641 - DNA, 13 bp, Homo sapiens
aacatttcatgta

SEQ ID NO: 5661642 - DNA, 20 bp, Homo sapiens
aacatttccaaaagtggcta

SEQ ID NO: 5661643 - DNA, 21 bp, Homo sapiens
aacatttcccccgagctcttg

SEQ ID NO: 5661644 - DNA, 15 bp, Homo sapiens
aacatttccctgctg

SEQ ID NO: 5661645 - DNA, 16 bp, Homo sapiens
aacatttccgaataaa

SEQ ID NO: 5661646 - DNA, 16 bp, Homo sapiens
aacatttcctcttata

SEQ ID NO: 5661647 - DNA, 22 bp, Homo sapiens
aacatttcctcttataacttct

SEQ ID NO: 5661648 - DNA, 18 bp, Homo sapiens
aacatttctaactctatt

SEQ ID NO: 5661649 - DNA, 15 bp, Homo sapiens
aacatttctaagact

SEQ ID NO: 5661650 - DNA, 14 bp, Homo sapiens
aacatttctcatgt

SEQ ID NO: 5661651 - DNA, 22 bp, Homo sapiens
aacatttctcatgtgctttgta

SEQ ID NO: 5661652 - DNA, 23 bp, Homo sapiens
aacatttctcatgtgctttgtag

SEQ ID NO: 5661653 - DNA, 18 bp, Homo sapiens
aacatttctgtaaatacc

SEQ ID NO: 5661654 - DNA, 20 bp, Homo sapiens
aacatttctgtaaataccat

SEQ ID NO: 5661655 - DNA, 19 bp, Homo sapiens
aacatttctgtatactgta

SEQ ID NO: 5661656 - DNA, 17 bp, Homo sapiens
aacatttcttaaaacag

SEQ ID NO: 5661657 - DNA, 22 bp, Homo sapiens
aacatttcttacattgcagaac

SEQ ID NO: 5661658 - DNA, 20 bp, Homo sapiens
aacatttcttatgattttta

SEQ ID NO: 5661659 - DNA, 14 bp, Homo sapiens
aacatttcttgaag

SEQ ID NO: 5661660 - DNA, 23 bp, Homo sapiens
aacatttctttcttgctggctct

SEQ ID NO: 5661661 - DNA, 16 bp, Homo sapiens
aacatttgacacataa

SEQ ID NO: 5661662 - DNA, 13 bp, Homo sapiens
aacatttgagtat

SEQ ID NO: 5661663 - DNA, 16 bp, Homo sapiens
aacatttgataatttt

SEQ ID NO: 5661664 - DNA, 21 bp, Homo sapiens
aacatttgatatttttccatt

SEQ ID NO: 5661665 - DNA, 19 bp, Homo sapiens
aacatttgattaataaaat

SEQ ID NO: 5661666 - DNA, 20 bp, Homo sapiens
aacatttgccaaaaattcat

SEQ ID NO: 5661667 - DNA, 17 bp, Homo sapiens
aacatttgccttgcaga

SEQ ID NO: 5661668 - DNA, 18 bp, Homo sapiens
aacatttgccttgcagaa

SEQ ID NO: 5661669 - DNA, 23 bp, Homo sapiens
aacatttgctctggggggcaggg

SEQ ID NO: 5661670 - DNA, 12 bp, Homo sapiens
aacatttgctgc

SEQ ID NO: 5661671 - DNA, 16 bp, Homo sapiens
aacatttgctgccatt

SEQ ID NO: 5661672 - DNA, 15 bp, Homo sapiens
aacatttgctgtttt

SEQ ID NO: 5661673 - DNA, 21 bp, Homo sapiens
aacatttggaaaccatgcact

SEQ ID NO: 5661674 - DNA, 22 bp, Homo sapiens
aacatttggaaaccatgcacta

SEQ ID NO: 5661675 - DNA, 18 bp, Homo sapiens
aacatttggtaaggggaa

SEQ ID NO: 5661676 - DNA, 12 bp, Homo sapiens
aacatttgtaat

SEQ ID NO: 5661677 - DNA, 14 bp, Homo sapiens
aacatttgtacatt

SEQ ID NO: 5661678 - DNA, 13 bp, Homo sapiens
aacatttgtgata

SEQ ID NO: 5661679 - DNA, 23 bp, Homo sapiens
aacatttgtgtcactgtacagtt

SEQ ID NO: 5661680 - DNA, 17 bp, Homo sapiens
aacatttgtgtgttata

SEQ ID NO: 5661681 - DNA, 15 bp, Homo sapiens
aacatttgttcctgg

SEQ ID NO: 5661682 - DNA, 13 bp, Homo sapiens
aacatttgttgaa

SEQ ID NO: 5661683 - DNA, 21 bp, Homo sapiens
aacattttaagttttactgat

SEQ ID NO: 5661684 - DNA, 16 bp, Homo sapiens
aacattttatactgta

SEQ ID NO: 5661685 - DNA, 20 bp, Homo sapiens
aacattttatactgtacatg

SEQ ID NO: 5661686 - DNA, 23 bp, Homo sapiens
aacattttatcattaaaaattac

SEQ ID NO: 5661687 - DNA, 12 bp, Homo sapiens
aacattttcaat

SEQ ID NO: 5661688 - DNA, 13 bp, Homo sapiens
aacattttcacac

SEQ ID NO: 5661689 - DNA, 19 bp, Homo sapiens
aacattttctcttagaaaa

SEQ ID NO: 5661690 - DNA, 16 bp, Homo sapiens
aacattttgaaggaaa

SEQ ID NO: 5661691 - DNA, 20 bp, Homo sapiens
aacattttgagaacaaagat

SEQ ID NO: 5661692 - DNA, 23 bp, Homo sapiens
aacattttgagctatttccttcc

SEQ ID NO: 5661693 - DNA, 16 bp, Homo sapiens
aacattttgatttcct

SEQ ID NO: 5661694 - DNA, 13 bp, Homo sapiens
aacattttggaaa

SEQ ID NO: 5661695 - DNA, 17 bp, Homo sapiens
aacattttggaaattgt

SEQ ID NO: 5661696 - DNA, 20 bp, Homo sapiens
aacattttggggttagacct

SEQ ID NO: 5661697 - DNA, 23 bp, Homo sapiens
aacattttgtatgctgcatgaaa

SEQ ID NO: 5661698 - DNA, 11 bp, Homo sapiens
aacattttgtt

SEQ ID NO: 5661699 - DNA, 19 bp, Homo sapiens
aacatttttgataaagcct

SEQ ID NO: 5661700 - DNA, 17 bp, Homo sapiens
aacatttttgtacatta

SEQ ID NO: 5661701 - DNA, 15 bp, Homo sapiens
aacattttttaagaa

SEQ ID NO: 5661702 - DNA, 17 bp, Homo sapiens
aacattttttaaggact

SEQ ID NO: 5661703 - DNA, 19 bp, Homo sapiens
aacattttttatacatttg

SEQ ID NO: 5661704 - DNA, 14 bp, Homo sapiens
aaccaaaaacattt

SEQ ID NO: 5661705 - DNA, 20 bp, Homo sapiens
aaccaaaaacatttgattaa

SEQ ID NO: 5661706 - DNA, 15 bp, Homo sapiens
aaccaaaaatagaaa

SEQ ID NO: 5661707 - DNA, 14 bp, Homo sapiens
aaccaaaaatcact

SEQ ID NO: 5661708 - DNA, 17 bp, Homo sapiens
aaccaaaaattatgtgt

SEQ ID NO: 5661709 - DNA, 11 bp, Homo sapiens
aaccaaaacag

SEQ ID NO: 5661710 - DNA, 14 bp, Homo sapiens
aaccaaaacttcca

SEQ ID NO: 5661711 - DNA, 15 bp, Homo sapiens
aaccaaaagatgcct

SEQ ID NO: 5661712 - DNA, 18 bp, Homo sapiens
aaccaaaagatgccttga

SEQ ID NO: 5661713 - DNA, 21 bp, Homo sapiens
aaccaaaagggaaaaaataaa

SEQ ID NO: 5661714 - DNA, 22 bp, Homo sapiens
aaccaaaagtgcattcaacctt

SEQ ID NO: 5661715 - DNA, 11 bp, Homo sapiens
aaccaaaatga

SEQ ID NO: 5661716 - DNA, 15 bp, Homo sapiens
aaccaaacccagcca

SEQ ID NO: 5661717 - DNA, 22 bp, Homo sapiens
aaccaaacctcacactactgta

SEQ ID NO: 5661718 - DNA, 18 bp, Homo sapiens
aaccaaactcctatttca

SEQ ID NO: 5661719 - DNA, 20 bp, Homo sapiens
aaccaaactgggtcttcagc

SEQ ID NO: 5661720 - DNA, 17 bp, Homo sapiens
aaccaaagaaagtgggt

SEQ ID NO: 5661721 - DNA, 13 bp, Homo sapiens
aaccaaagaagaa

SEQ ID NO: 5661722 - DNA, 19 bp, Homo sapiens
aaccaaagagggcttcctc

SEQ ID NO: 5661723 - DNA, 15 bp, Homo sapiens
aaccaaagctgcctg

SEQ ID NO: 5661724 - DNA, 10 bp, Homo sapiens
aaccaaaggt

SEQ ID NO: 5661725 - DNA, 14 bp, Homo sapiens
aaccaaaggtgaag

SEQ ID NO: 5661726 - DNA, 20 bp, Homo sapiens
aaccaaagtacttttggtgt

SEQ ID NO: 5661727 - DNA, 21 bp, Homo sapiens
aaccaaagtacttttggtgtc

SEQ ID NO: 5661728 - DNA, 15 bp, Homo sapiens
aaccaaagtctgccg

SEQ ID NO: 5661729 - DNA, 15 bp, Homo sapiens
aaccaaatatgttaa

SEQ ID NO: 5661730 - DNA, 16 bp, Homo sapiens
aaccaaatattccaga

SEQ ID NO: 5661731 - DNA, 18 bp, Homo sapiens
aaccaaatgcaatgtgaa

SEQ ID NO: 5661732 - DNA, 12 bp, Homo sapiens
aaccaaatgcat

SEQ ID NO: 5661733 - DNA, 14 bp, Homo sapiens
aaccaaatgtgcat

SEQ ID NO: 5661734 - DNA, 16 bp, Homo sapiens
aaccaaattgcactga

SEQ ID NO: 5661735 - DNA, 15 bp, Homo sapiens
aaccaaattttaaaa

SEQ ID NO: 5661736 - DNA, 14 bp, Homo sapiens
aaccaacaggttta

SEQ ID NO: 5661737 - DNA, 17 bp, Homo sapiens
aaccaacattaaaactc

SEQ ID NO: 5661738 - DNA, 22 bp, Homo sapiens
aaccaacattttaaaaataaat

SEQ ID NO: 5661739 - DNA, 20 bp, Homo sapiens
aaccaacccccatctcccta

SEQ ID NO: 5661740 - DNA, 15 bp, Homo sapiens
aaccaacctttaaaa

SEQ ID NO: 5661741 - DNA, 18 bp, Homo sapiens
aaccaacctttaaaattg

SEQ ID NO: 5661742 - DNA, 22 bp, Homo sapiens
aaccaacctttaaaattgtcac

SEQ ID NO: 5661743 - DNA, 22 bp, Homo sapiens
aaccaacctttctgacatcagc

SEQ ID NO: 5661744 - DNA, 17 bp, Homo sapiens
aaccaacgggtctgtgg

SEQ ID NO: 5661745 - DNA, 14 bp, Homo sapiens
aaccaactatccaa

SEQ ID NO: 5661746 - DNA, 17 bp, Homo sapiens
aaccaactatttttgag

SEQ ID NO: 5661747 - DNA, 16 bp, Homo sapiens
aaccaactgttgacat

SEQ ID NO: 5661748 - DNA, 21 bp, Homo sapiens
aaccaacttggttctgcttca

SEQ ID NO: 5661749 - DNA, 14 bp, Homo sapiens
aaccaagagattgc

SEQ ID NO: 5661750 - DNA, 15 bp, Homo sapiens
aaccaagagattgct

SEQ ID NO: 5661751 - DNA, 18 bp, Homo sapiens
aaccaagagattgctaat

SEQ ID NO: 5661752 - DNA, 13 bp, Homo sapiens
aaccaagcagctt

SEQ ID NO: 5661753 - DNA, 15 bp, Homo sapiens
aaccaagcctctgga

SEQ ID NO: 5661754 - DNA, 19 bp, Homo sapiens
aaccaagctataaaagccc

SEQ ID NO: 5661755 - DNA, 18 bp, Homo sapiens
aaccaagctgagtttcct

SEQ ID NO: 5661756 - DNA, 20 bp, Homo sapiens
aaccaagctgagtttcctat

SEQ ID NO: 5661757 - DNA, 11 bp, Homo sapiens
aaccaagctgt

SEQ ID NO: 5661758 - DNA, 18 bp, Homo sapiens
aaccaagcttcagagcct

SEQ ID NO: 5661759 - DNA, 23 bp, Homo sapiens
aaccaaggaaggagcccctgagt

SEQ ID NO: 5661760 - DNA, 15 bp, Homo sapiens
aaccaaggcagcctc

SEQ ID NO: 5661761 - DNA, 12 bp, Homo sapiens
aaccaaggccct

SEQ ID NO: 5661762 - DNA, 20 bp, Homo sapiens
aaccaaggctccaataaacg

SEQ ID NO: 5661763 - DNA, 15 bp, Homo sapiens
aaccaagggtacaga

SEQ ID NO: 5661764 - DNA, 12 bp, Homo sapiens
aaccaaggtgca

SEQ ID NO: 5661765 - DNA, 22 bp, Homo sapiens
aaccaagtatcacactttaatg

SEQ ID NO: 5661766 - DNA, 23 bp, Homo sapiens
aaccaagtatcacactttaatgt

SEQ ID NO: 5661767 - DNA, 21 bp, Homo sapiens
aaccaagtcggaacagcagat

SEQ ID NO: 5661768 - DNA, 22 bp, Homo sapiens
aaccaagtgtagatgtagcatt

SEQ ID NO: 5661769 - DNA, 14 bp, Homo sapiens
aaccaagtgtgctc

SEQ ID NO: 5661770 - DNA, 22 bp, Homo sapiens
aaccaagttatctgtttcctgt

SEQ ID NO: 5661771 - DNA, 13 bp, Homo sapiens
aaccaagtttatt

SEQ ID NO: 5661772 - DNA, 18 bp, Homo sapiens
aaccaagtttattcagta

SEQ ID NO: 5661773 - DNA, 21 bp, Homo sapiens
aaccaagtttattcagtaaac

SEQ ID NO: 5661774 - DNA, 14 bp, Homo sapiens
aaccaatacagaat

SEQ ID NO: 5661775 - DNA, 15 bp, Homo sapiens
aaccaatacagaatt

SEQ ID NO: 5661776 - DNA, 16 bp, Homo sapiens
aaccaatacagaattg

SEQ ID NO: 5661777 - DNA, 12 bp, Homo sapiens
aaccaatagaaa

SEQ ID NO: 5661778 - DNA, 18 bp, Homo sapiens
aaccaatcccgtgaaaga

SEQ ID NO: 5661779 - DNA, 14 bp, Homo sapiens
aaccaatgagctgt

SEQ ID NO: 5661780 - DNA, 23 bp, Homo sapiens
aaccaatgagctgtatctgtaat

SEQ ID NO: 5661781 - DNA, 18 bp, Homo sapiens
aaccaatgattcataaca

SEQ ID NO: 5661782 - DNA, 19 bp, Homo sapiens
aaccaatgattcataacaa

SEQ ID NO: 5661783 - DNA, 22 bp, Homo sapiens
aaccaatggtgatcctctattt

SEQ ID NO: 5661784 - DNA, 15 bp, Homo sapiens
aaccaatgtttaaaa

SEQ ID NO: 5661785 - DNA, 17 bp, Homo sapiens
aaccaattcactttaga

SEQ ID NO: 5661786 - DNA, 16 bp, Homo sapiens
aaccaattcctcatcc

SEQ ID NO: 5661787 - DNA, 18 bp, Homo sapiens
aaccaattgaaaagtgtt

SEQ ID NO: 5661788 - DNA, 22 bp, Homo sapiens
aaccaattgtgagaattactgt

SEQ ID NO: 5661789 - DNA, 14 bp, Homo sapiens
aaccaatttgtaat

SEQ ID NO: 5661790 - DNA, 15 bp, Homo sapiens
aaccaatttgttctg

SEQ ID NO: 5661791 - DNA, 16 bp, Homo sapiens
aaccaatttgttctgt

SEQ ID NO: 5661792 - DNA, 18 bp, Homo sapiens
aaccaattttcaaagttc

SEQ ID NO: 5661793 - DNA, 20 bp, Homo sapiens
aaccaattttttgttcttca

SEQ ID NO: 5661794 - DNA, 22 bp, Homo sapiens
aaccacaaaaaaatacctcagg

SEQ ID NO: 5661795 - DNA, 16 bp, Homo sapiens
aaccacaaaactcatc

SEQ ID NO: 5661796 - DNA, 11 bp, Homo sapiens
aaccacaaagg

SEQ ID NO: 5661797 - DNA, 20 bp, Homo sapiens
aaccacaaaggccaaactgc

SEQ ID NO: 5661798 - DNA, 15 bp, Homo sapiens
aaccacaaattcatg

SEQ ID NO: 5661799 - DNA, 15 bp, Homo sapiens
aaccacaagcatctc

SEQ ID NO: 5661800 - DNA, 17 bp, Homo sapiens
aaccacaatgtttcttc

SEQ ID NO: 5661801 - DNA, 17 bp, Homo sapiens
aaccacacccacactca

SEQ ID NO: 5661802 - DNA, 12 bp, Homo sapiens
aaccacagaaca

SEQ ID NO: 5661803 - DNA, 12 bp, Homo sapiens
aaccacagagaa

SEQ ID NO: 5661804 - DNA, 11 bp, Homo sapiens
aaccacagcag

SEQ ID NO: 5661805 - DNA, 13 bp, Homo sapiens
aaccacagcagac

SEQ ID NO: 5661806 - DNA, 15 bp, Homo sapiens
aaccacagcagacac

SEQ ID NO: 5661807 - DNA, 15 bp, Homo sapiens
aaccacagccctgtc

SEQ ID NO: 5661808 - DNA, 17 bp, Homo sapiens
aaccacagggccagagg

SEQ ID NO: 5661809 - DNA, 21 bp, Homo sapiens
aaccacagggccagagggagc

SEQ ID NO: 5661810 - DNA, 15 bp, Homo sapiens
aaccacagtcagtgg

SEQ ID NO: 5661811 - DNA, 20 bp, Homo sapiens
aaccacagtcagtggagcct

SEQ ID NO: 5661812 - DNA, 22 bp, Homo sapiens
aaccacagtgccaccaagctca

SEQ ID NO: 5661813 - DNA, 20 bp, Homo sapiens
aaccacagttattaattaaa

SEQ ID NO: 5661814 - DNA, 22 bp, Homo sapiens
aaccacataatttttgtacatc

SEQ ID NO: 5661815 - DNA, 23 bp, Homo sapiens
aaccacatgaactacgtgacctc

SEQ ID NO: 5661816 - DNA, 15 bp, Homo sapiens
aaccacatgggctgg

SEQ ID NO: 5661817 - DNA, 22 bp, Homo sapiens
aaccctgcttctgctgccctga

SEQ ID NO: 5661818 - DNA, 16 bp, Homo sapiens
aaccctgctttttgac

SEQ ID NO: 5661819 - DNA, 14 bp, Homo sapiens
aaccctggaaaagg

SEQ ID NO: 5661820 - DNA, 12 bp, Homo sapiens
aaccctggagag

SEQ ID NO: 5661821 - DNA, 15 bp, Homo sapiens
aaccctggcatttgg

SEQ ID NO: 5661822 - DNA, 16 bp, Homo sapiens
aaccctggcctcactt

SEQ ID NO: 5661823 - DNA, 22 bp, Homo sapiens
aaccctggcttgcttgccgagc

SEQ ID NO: 5661824 - DNA, 12 bp, Homo sapiens
aaccctgggacc

SEQ ID NO: 5661825 - DNA, 21 bp, Homo sapiens
aaccctgggagtagctagttt

SEQ ID NO: 5661826 - DNA, 18 bp, Homo sapiens
aaccctggggcctgactg

SEQ ID NO: 5661827 - DNA, 20 bp, Homo sapiens
aaccctggggcctgactgct

SEQ ID NO: 5661828 - DNA, 11 bp, Homo sapiens
aaccctggtct

SEQ ID NO: 5661829 - DNA, 19 bp, Homo sapiens
aaccctgtcaaacattagt

SEQ ID NO: 5661830 - DNA, 12 bp, Homo sapiens
aaccctgtggaa

SEQ ID NO: 5661831 - DNA, 13 bp, Homo sapiens
aaccctgtggttg

SEQ ID NO: 5661832 - DNA, 16 bp, Homo sapiens
aaccctgttacaaagc

SEQ ID NO: 5661833 - DNA, 22 bp, Homo sapiens
aaccctgttttatactgtactt

SEQ ID NO: 5661834 - DNA, 18 bp, Homo sapiens
aacccttaaacagttgca

SEQ ID NO: 5661835 - DNA, 15 bp, Homo sapiens
aacccttaactgaca

SEQ ID NO: 5661836 - DNA, 11 bp, Homo sapiens
aacccttacag

SEQ ID NO: 5661837 - DNA, 18 bp, Homo sapiens
aacccttacagtgaagat

SEQ ID NO: 5661838 - DNA, 19 bp, Homo sapiens
aacccttagcagcccagca

SEQ ID NO: 5661839 - DNA, 23 bp, Homo sapiens
aacccttagcttttagcctggct

SEQ ID NO: 5661840 - DNA, 15 bp, Homo sapiens
aacccttcaactcct

SEQ ID NO: 5661841 - DNA, 18 bp, Homo sapiens
aacccttcaactcctggc

SEQ ID NO: 5661842 - DNA, 20 bp, Homo sapiens
aacccttcaactcctggctc

SEQ ID NO: 5661843 - DNA, 13 bp, Homo sapiens
aacccttcagtgc

SEQ ID NO: 5661844 - DNA, 20 bp, Homo sapiens
aacccttcctgagctttatg

SEQ ID NO: 5661845 - DNA, 18 bp, Homo sapiens
aacccttctcctcttgta

SEQ ID NO: 5661846 - DNA, 21 bp, Homo sapiens
aacccttctcctcttgtaaat

SEQ ID NO: 5661847 - DNA, 13 bp, Homo sapiens
aacccttctctgt

SEQ ID NO: 5661848 - DNA, 14 bp, Homo sapiens
aacccttctcttct

SEQ ID NO: 5661849 - DNA, 20 bp, Homo sapiens
aacccttctcttctcccccc

SEQ ID NO: 5661850 - DNA, 14 bp, Homo sapiens
aacccttgaaaaga

SEQ ID NO: 5661851 - DNA, 15 bp, Homo sapiens
aacccttgaaaagac

SEQ ID NO: 5661852 - DNA, 16 bp, Homo sapiens
aacccttgaatttcta

SEQ ID NO: 5661853 - DNA, 16 bp, Homo sapiens
aacccttgccaggtcc

SEQ ID NO: 5661854 - DNA, 13 bp, Homo sapiens
aacccttgctgct

SEQ ID NO: 5661855 - DNA, 13 bp, Homo sapiens
aacccttgtcagt

SEQ ID NO: 5661856 - DNA, 16 bp, Homo sapiens
aaccctttagtgcttt

SEQ ID NO: 5661857 - DNA, 16 bp, Homo sapiens
aaccctttgtgtgctc

SEQ ID NO: 5661858 - DNA, 21 bp, Homo sapiens
aacccttttcctccagacaga

SEQ ID NO: 5661859 - DNA, 23 bp, Homo sapiens
aacccttttcctccagacagata

SEQ ID NO: 5661860 - DNA, 16 bp, Homo sapiens
aacccttttggccccc

SEQ ID NO: 5661861 - DNA, 19 bp, Homo sapiens
aacccttttgtctgcctct

SEQ ID NO: 5661862 - DNA, 16 bp, Homo sapiens
aaccgaacatatcatt

SEQ ID NO: 5661863 - DNA, 21 bp, Homo sapiens
aaccgaactgatgtaagtaaa

SEQ ID NO: 5661864 - DNA, 23 bp, Homo sapiens
aaccgaagggactggatctgcag

SEQ ID NO: 5661865 - DNA, 17 bp, Homo sapiens
aaccgacaggccctggc

SEQ ID NO: 5661866 - DNA, 12 bp, Homo sapiens
aaccgacttttc

SEQ ID NO: 5661867 - DNA, 15 bp, Homo sapiens
aaccgagcaaagatc

SEQ ID NO: 5661868 - DNA, 20 bp, Homo sapiens
aaccgagggggctgctccca

SEQ ID NO: 5661869 - DNA, 19 bp, Homo sapiens
aaccgagtagaaaatgtga

SEQ ID NO: 5661870 - DNA, 13 bp, Homo sapiens
aaccgagtcagaa

SEQ ID NO: 5661871 - DNA, 18 bp, Homo sapiens
aaccgataatgcatgaag

SEQ ID NO: 5661872 - DNA, 14 bp, Homo sapiens
aaccgatgctttac

SEQ ID NO: 5661873 - DNA, 18 bp, Homo sapiens
aaccgcactcacccatgt

SEQ ID NO: 5661874 - DNA, 14 bp, Homo sapiens
aaccgcaggaagct

SEQ ID NO: 5661875 - DNA, 22 bp, Homo sapiens
aaccgcatctgctcatctgata

SEQ ID NO: 5661876 - DNA, 16 bp, Homo sapiens
aaccgcatgtgatctc

SEQ ID NO: 5661877 - DNA, 15 bp, Homo sapiens
aaccgccagctctgt

SEQ ID NO: 5661878 - DNA, 16 bp, Homo sapiens
aaccgctaaaagaaac

SEQ ID NO: 5661879 - DNA, 23 bp, Homo sapiens
aaccgctacaagagggcaaagct

SEQ ID NO: 5661880 - DNA, 14 bp, Homo sapiens
aaccgcttgccata

SEQ ID NO: 5661881 - DNA, 12 bp, Homo sapiens
aaccgcttttgg

SEQ ID NO: 5661882 - DNA, 16 bp, Homo sapiens
aaccggaaggaggcca

SEQ ID NO: 5661883 - DNA, 22 bp, Homo sapiens
aaccggaaggaggccaaccagc

SEQ ID NO: 5661884 - DNA, 23 bp, Homo sapiens
aaccggaaggaggccaaccagcc

SEQ ID NO: 5661885 - DNA, 21 bp, Homo sapiens
aaccggatggcggacacctgg

SEQ ID NO: 5661886 - DNA, 22 bp, Homo sapiens
aaccgtaaaggtttatttttct

SEQ ID NO: 5661887 - DNA, 15 bp, Homo sapiens
aaccgtcaatgtgaa

SEQ ID NO: 5661888 - DNA, 23 bp, Homo sapiens
aaccgtcaatgtgaaataaagag

SEQ ID NO: 5661889 - DNA, 18 bp, Homo sapiens
aaccgtcccctccttccc

SEQ ID NO: 5661890 - DNA, 13 bp, Homo sapiens
aaccgtcctgctg

SEQ ID NO: 5661891 - DNA, 16 bp, Homo sapiens
aaccgtcctgctgtcc

SEQ ID NO: 5661892 - DNA, 22 bp, Homo sapiens
aaccgtcctgctgtccctgtca

SEQ ID NO: 5661893 - DNA, 18 bp, Homo sapiens
aaccgtctgttatgctgt

SEQ ID NO: 5661894 - DNA, 13 bp, Homo sapiens
aaccgtgaggagg

SEQ ID NO: 5661895 - DNA, 23 bp, Homo sapiens
aaccgtggagatcgcttttctca

SEQ ID NO: 5661896 - DNA, 11 bp, Homo sapiens
aaccgtggccc

SEQ ID NO: 5661897 - DNA, 19 bp, Homo sapiens
aaccgtggcccttcctgga

SEQ ID NO: 5661898 - DNA, 21 bp, Homo sapiens
aaccgtggcccttcctggaca

SEQ ID NO: 5661899 - DNA, 20 bp, Homo sapiens
aaccgtggtacccccccttt

SEQ ID NO: 5661900 - DNA, 17 bp, Homo sapiens
aaccgtgtccagcacag

SEQ ID NO: 5661901 - DNA, 13 bp, Homo sapiens
aaccgtgtgctcc

SEQ ID NO: 5661902 - DNA, 20 bp, Homo sapiens
aaccgtgtttgtctcttctg

SEQ ID NO: 5661903 - DNA, 14 bp, Homo sapiens
aaccgtttttcaag

SEQ ID NO: 5661904 - DNA, 15 bp, Homo sapiens
aacctaaaaaagata

SEQ ID NO: 5661905 - DNA, 20 bp, Homo sapiens
aacctaaaataattggttct

SEQ ID NO: 5661906 - DNA, 21 bp, Homo sapiens
aaccagcccgacagtgccatc

SEQ ID NO: 5661907 - DNA, 15 bp, Homo sapiens
aaccagccctccaga

SEQ ID NO: 5661908 - DNA, 11 bp, Homo sapiens
aaccagccctg

SEQ ID NO: 5661909 - DNA, 21 bp, Homo sapiens
aaccagcctcaaaaacgccct

SEQ ID NO: 5661910 - DNA, 22 bp, Homo sapiens
aaccagcctcatgctctgatta

SEQ ID NO: 5661911 - DNA, 13 bp, Homo sapiens
aaccagcctgggg

SEQ ID NO: 5661912 - DNA, 17 bp, Homo sapiens
aaccagctcaggctact

SEQ ID NO: 5661913 - DNA, 16 bp, Homo sapiens
aaccagctcagtgttt

SEQ ID NO: 5661914 - DNA, 14 bp, Homo sapiens
aaccagctcatctc

SEQ ID NO: 5661915 - DNA, 23 bp, Homo sapiens
aaccagctctgggaaatttaata

SEQ ID NO: 5661916 - DNA, 15 bp, Homo sapiens
aaccagctctttggt

SEQ ID NO: 5661917 - DNA, 13 bp, Homo sapiens
aaccaggaaaaaa

SEQ ID NO: 5661918 - DNA, 13 bp, Homo sapiens
aaccaggacccag

SEQ ID NO: 5661919 - DNA, 15 bp, Homo sapiens
aaccaggacccaggg

SEQ ID NO: 5661920 - DNA, 19 bp, Homo sapiens
aaccaggacccagggtccc

SEQ ID NO: 5661921 - DNA, 21 bp, Homo sapiens
aaccaggagctgatggcagct

SEQ ID NO: 5661922 - DNA, 21 bp, Homo sapiens
aaccaggaggggtctgcctcc

SEQ ID NO: 5661923 - DNA, 22 bp, Homo sapiens
aaccaggattttgtgttttttc

SEQ ID NO: 5661924 - DNA, 11 bp, Homo sapiens
aaccaggcagc

SEQ ID NO: 5661925 - DNA, 19 bp, Homo sapiens
aaccaggcagctgagacca

SEQ ID NO: 5661926 - DNA, 12 bp, Homo sapiens
aaccaggcccag

SEQ ID NO: 5661927 - DNA, 12 bp, Homo sapiens
aaccaggccctg

SEQ ID NO: 5661928 - DNA, 23 bp, Homo sapiens
aaccaggccctgccattggcctc

SEQ ID NO: 5661929 - DNA, 12 bp, Homo sapiens
aaccaggcctct

SEQ ID NO: 5661930 - DNA, 21 bp, Homo sapiens
aaccaggctttctagaaagaa

SEQ ID NO: 5661931 - DNA, 21 bp, Homo sapiens
aaccagggagcccctttgatg

SEQ ID NO: 5661932 - DNA, 18 bp, Homo sapiens
aaccagggccccggggcc

SEQ ID NO: 5661933 - DNA, 19 bp, Homo sapiens
aaccaggggacactttgtt

SEQ ID NO: 5661934 - DNA, 22 bp, Homo sapiens
aaccagggggaagcaccagcct

SEQ ID NO: 5661935 - DNA, 19 bp, Homo sapiens
aaccaggggtaccaggcac

SEQ ID NO: 5661936 - DNA, 15 bp, Homo sapiens
aaccaggggtcctaa

SEQ ID NO: 5661937 - DNA, 22 bp, Homo sapiens
aaccaggtcaccatcctcagag

SEQ ID NO: 5661938 - DNA, 14 bp, Homo sapiens
aaccaggtgcaatt

SEQ ID NO: 5661939 - DNA, 16 bp, Homo sapiens
aaccagtacttctaag

SEQ ID NO: 5661940 - DNA, 23 bp, Homo sapiens
aaccagtagcttcccaaaaacag

SEQ ID NO: 5661941 - DNA, 18 bp, Homo sapiens
aaccagtatacaagataa

SEQ ID NO: 5661942 - DNA, 21 bp, Homo sapiens
aaccagtattgtacaaagtat

SEQ ID NO: 5661943 - DNA, 23 bp, Homo sapiens
aaccagtatttttgctgcttctg

SEQ ID NO: 5661944 - DNA, 17 bp, Homo sapiens
aaccagtcaagttgtgt

SEQ ID NO: 5661945 - DNA, 19 bp, Homo sapiens
aaccagtcagctggccaga

SEQ ID NO: 5661946 - DNA, 22 bp, Homo sapiens
aaccagtccccccaccctcatt

SEQ ID NO: 5661947 - DNA, 17 bp, Homo sapiens
aaccagtccctctgagt

SEQ ID NO: 5661948 - DNA, 14 bp, Homo sapiens
aaccagtctcctca

SEQ ID NO: 5661949 - DNA, 15 bp, Homo sapiens
aaccagtctcctcac

SEQ ID NO: 5661950 - DNA, 19 bp, Homo sapiens
aaccagtctcctcactctg

SEQ ID NO: 5661951 - DNA, 14 bp, Homo sapiens
aaccagtctgaagt

SEQ ID NO: 5661952 - DNA, 23 bp, Homo sapiens
aaccagtctgaagtttcatttat

SEQ ID NO: 5661953 - DNA, 21 bp, Homo sapiens
aaccagtctttcaactcattg

SEQ ID NO: 5661954 - DNA, 19 bp, Homo sapiens
aaccagtgaagtgccacat

SEQ ID NO: 5661955 - DNA, 18 bp, Homo sapiens
aaccagtgtacaggtcac

SEQ ID NO: 5661956 - DNA, 16 bp, Homo sapiens
aaccagtgtctgaacc

SEQ ID NO: 5661957 - DNA, 16 bp, Homo sapiens
aaccagttaaagccac

SEQ ID NO: 5661958 - DNA, 17 bp, Homo sapiens
aaccagttaaagccaca

SEQ ID NO: 5661959 - DNA, 19 bp, Homo sapiens
aaccagttatttttattat

SEQ ID NO: 5661960 - DNA, 17 bp, Homo sapiens
aaccagttgcactacat

SEQ ID NO: 5661961 - DNA, 13 bp, Homo sapiens
aaccagttggcta

SEQ ID NO: 5661962 - DNA, 17 bp, Homo sapiens
aaccagtttagatttca

SEQ ID NO: 5661963 - DNA, 22 bp, Homo sapiens
aaccagtttagatttcaagaaa

SEQ ID NO: 5661964 - DNA, 18 bp, Homo sapiens
aaccagtttcaggtgttt

SEQ ID NO: 5661965 - DNA, 19 bp, Homo sapiens
aaccagttttttcacctcc

SEQ ID NO: 5661966 - DNA, 16 bp, Homo sapiens
aaccataaaataaata

SEQ ID NO: 5661967 - DNA, 18 bp, Homo sapiens
aaccataaaatgtccagt

SEQ ID NO: 5661968 - DNA, 13 bp, Homo sapiens
aaccataaacatt

SEQ ID NO: 5661969 - DNA, 14 bp, Homo sapiens
aaccataaacattt

SEQ ID NO: 5661970 - DNA, 16 bp, Homo sapiens
aaccataactgacaag

SEQ ID NO: 5661971 - DNA, 22 bp, Homo sapiens
aaccatagcacaggctaatttt

SEQ ID NO: 5661972 - DNA, 23 bp, Homo sapiens
aaccataggactgtggcaaacaa

SEQ ID NO: 5661973 - DNA, 18 bp, Homo sapiens
aaccataggtaatgatta

SEQ ID NO: 5661974 - DNA, 18 bp, Homo sapiens
aaccatagttactgtaaa

SEQ ID NO: 5661975 - DNA, 20 bp, Homo sapiens
aaccatagttactgtaaaat

SEQ ID NO: 5661976 - DNA, 23 bp, Homo sapiens
aaccatagttactgtaaaatgca

SEQ ID NO: 5661977 - DNA, 22 bp, Homo sapiens
aaccatagttatttacttgaaa

SEQ ID NO: 5661978 - DNA, 23 bp, Homo sapiens
aaccatagttatttacttgaaag

SEQ ID NO: 5661979 - DNA, 14 bp, Homo sapiens
aaccatatggatat

SEQ ID NO: 5661980 - DNA, 19 bp, Homo sapiens
aaccatcagttactggttt

SEQ ID NO: 5661981 - DNA, 19 bp, Homo sapiens
aaccatcattgaaatcttt

SEQ ID NO: 5661982 - DNA, 19 bp, Homo sapiens
aaccatcatttaatttcta

SEQ ID NO: 5661983 - DNA, 22 bp, Homo sapiens
aaccatccagtgacaaaccatc

SEQ ID NO: 5661984 - DNA, 15 bp, Homo sapiens
aaccatccctgccac

SEQ ID NO: 5661985 - DNA, 15 bp, Homo sapiens
aaccatcggtccaca

SEQ ID NO: 5661986 - DNA, 18 bp, Homo sapiens
aaccatctccctggtgct

SEQ ID NO: 5661987 - DNA, 19 bp, Homo sapiens
aaccatctccctggtgctt

SEQ ID NO: 5661988 - DNA, 16 bp, Homo sapiens
aaccatctctcttcca

SEQ ID NO: 5661989 - DNA, 22 bp, Homo sapiens
aaccatctctcttccagctgct

SEQ ID NO: 5661990 - DNA, 16 bp, Homo sapiens
aaccatctggcctggc

SEQ ID NO: 5661991 - DNA, 17 bp, Homo sapiens
aaccatctggcctggcc

SEQ ID NO: 5661992 - DNA, 17 bp, Homo sapiens
aaccatctggtgccttt

SEQ ID NO: 5661993 - DNA, 20 bp, Homo sapiens
aaccatctggtgcctttcca

SEQ ID NO: 5661994 - DNA, 19 bp, Homo sapiens
aaccatcttgtgtctttgg

SEQ ID NO: 5661995 - DNA, 16 bp, Homo sapiens
aaccatgaagacagga

SEQ ID NO: 5661996 - DNA, 18 bp, Homo sapiens
aacctcccagaggtccag

SEQ ID NO: 5661997 - DNA, 20 bp, Homo sapiens
aacctcccagaggtccagcc

SEQ ID NO: 5661998 - DNA, 14 bp, Homo sapiens
aacctcccatccca

SEQ ID NO: 5661999 - DNA, 18 bp, Homo sapiens
aacctcccatcccacccc

SEQ ID NO: 5662000 - DNA, 14 bp, Homo sapiens
aacctccccagcct

SEQ ID NO: 5662001 - DNA, 17 bp, Homo sapiens
aacctccccagcctgcg

SEQ ID NO: 5662002 - DNA, 20 bp, Homo sapiens
aacctccctcctttcctttg

SEQ ID NO: 5662003 - DNA, 12 bp, Homo sapiens
aacctccctggg

SEQ ID NO: 5662004 - DNA, 15 bp, Homo sapiens
aacctccctgggcct

SEQ ID NO: 5662005 - DNA, 20 bp, Homo sapiens
aacctccgccaatgcacggc

SEQ ID NO: 5662006 - DNA, 16 bp, Homo sapiens
aacctccgtgctgggc

SEQ ID NO: 5662007 - DNA, 12 bp, Homo sapiens
aacctcctctgt

SEQ ID NO: 5662008 - DNA, 15 bp, Homo sapiens
aacctcctgctctgg

SEQ ID NO: 5662009 - DNA, 16 bp, Homo sapiens
aacctcctgctctggg

SEQ ID NO: 5662010 - DNA, 13 bp, Homo sapiens
aacctcctggaca

SEQ ID NO: 5662011 - DNA, 15 bp, Homo sapiens
aacctcctgtggaac

SEQ ID NO: 5662012 - DNA, 13 bp, Homo sapiens
aacctcctttctc

SEQ ID NO: 5662013 - DNA, 17 bp, Homo sapiens
aacctcctttctcttct

SEQ ID NO: 5662014 - DNA, 21 bp, Homo sapiens
aacctcgaagctgttctctgc

SEQ ID NO: 5662015 - DNA, 23 bp, Homo sapiens
aacctcgaggaactccaggacga

SEQ ID NO: 5662016 - DNA, 14 bp, Homo sapiens
aacctcgagtactg

SEQ ID NO: 5662017 - DNA, 19 bp, Homo sapiens
aacctcgagtactgtgggc

SEQ ID NO: 5662018 - DNA, 17 bp, Homo sapiens
aacctcgctccaactcc

SEQ ID NO: 5662019 - DNA, 19 bp, Homo sapiens
aacctcgttgacatgcaca

SEQ ID NO: 5662020 - DNA, 12 bp, Homo sapiens
aacctctaaatt

SEQ ID NO: 5662021 - DNA, 17 bp, Homo sapiens
aacctctaaccctcatt

SEQ ID NO: 5662022 - DNA, 21 bp, Homo sapiens
aacctctaaccctcattgctg

SEQ ID NO: 5662023 - DNA, 19 bp, Homo sapiens
aacctctaatttattttgt

SEQ ID NO: 5662024 - DNA, 15 bp, Homo sapiens
aacctctacaggcat

SEQ ID NO: 5662025 - DNA, 17 bp, Homo sapiens
aacctctatatctttaa

SEQ ID NO: 5662026 - DNA, 23 bp, Homo sapiens
aacctctatatctttaaataaat

SEQ ID NO: 5662027 - DNA, 19 bp, Homo sapiens
aacctctcagatccctcgg

SEQ ID NO: 5662028 - DNA, 23 bp, Homo sapiens
aacctctcagcactaattagtgt

SEQ ID NO: 5662029 - DNA, 21 bp, Homo sapiens
aacctctcgcttcctcagcct

SEQ ID NO: 5662030 - DNA, 20 bp, Homo sapiens
aacctctctaagccacagct

SEQ ID NO: 5662031 - DNA, 15 bp, Homo sapiens
aacctctctgatctt

SEQ ID NO: 5662032 - DNA, 20 bp, Homo sapiens
aacctctgccccccaagttc

SEQ ID NO: 5662033 - DNA, 16 bp, Homo sapiens
aacctctgcttcccag

SEQ ID NO: 5662034 - DNA, 9 bp, Homo sapiens
aacctctgg

SEQ ID NO: 5662035 - DNA, 11 bp, Homo sapiens
aacctctggcc

SEQ ID NO: 5662036 - DNA, 16 bp, Homo sapiens
aacctctggcccttgg

SEQ ID NO: 5662037 - DNA, 21 bp, Homo sapiens
aacctctggcccttggaataa

SEQ ID NO: 5662038 - DNA, 18 bp, Homo sapiens
aacctctgtggtcaccca

SEQ ID NO: 5662039 - DNA, 13 bp, Homo sapiens
aacctctgttcag

SEQ ID NO: 5662040 - DNA, 18 bp, Homo sapiens
aacctctgttccccaccc

SEQ ID NO: 5662041 - DNA, 18 bp, Homo sapiens
aacctcttatcactaaga

SEQ ID NO: 5662042 - DNA, 22 bp, Homo sapiens
aacctcttatcactaagaaaga

SEQ ID NO: 5662043 - DNA, 11 bp, Homo sapiens
aacctcttccc

SEQ ID NO: 5662044 - DNA, 14 bp, Homo sapiens
aacctcttccccag

SEQ ID NO: 5662045 - DNA, 16 bp, Homo sapiens
aacctcttctgtattt

SEQ ID NO: 5662046 - DNA, 18 bp, Homo sapiens
aacctctttcctctctgg

SEQ ID NO: 5662047 - DNA, 19 bp, Homo sapiens
aacctctttgcgtttcctt

SEQ ID NO: 5662048 - DNA, 19 bp, Homo sapiens
aacctctttttaaggacac

SEQ ID NO: 5662049 - DNA, 17 bp, Homo sapiens
aacctctttttcctcct

SEQ ID NO: 5662050 - DNA, 18 bp, Homo sapiens
aacctctttttcctcctg

SEQ ID NO: 5662051 - DNA, 19 bp, Homo sapiens
aacctctttttcctcctgg

SEQ ID NO: 5662052 - DNA, 23 bp, Homo sapiens
aacctctttttcctcctggacac

SEQ ID NO: 5662053 - DNA, 15 bp, Homo sapiens
aacctgaaagacaaa

SEQ ID NO: 5662054 - DNA, 11 bp, Homo sapiens
aacctgaagat

SEQ ID NO: 5662055 - DNA, 13 bp, Homo sapiens
aacctgaatcttt

SEQ ID NO: 5662056 - DNA, 14 bp, Homo sapiens
aacctgaatctttt

SEQ ID NO: 5662057 - DNA, 17 bp, Homo sapiens
aacctgaattaaagtct

SEQ ID NO: 5662058 - DNA, 18 bp, Homo sapiens
aacctgacagcaaacaca

SEQ ID NO: 5662059 - DNA, 23 bp, Homo sapiens
aacctgacagcaaacacagtcac

SEQ ID NO: 5662060 - DNA, 11 bp, Homo sapiens
aacctgacccc

SEQ ID NO: 5662061 - DNA, 19 bp, Homo sapiens
aacctgacccctgctcagt

SEQ ID NO: 5662062 - DNA, 20 bp, Homo sapiens
aacctgactcaattatttgc

SEQ ID NO: 5662063 - DNA, 20 bp, Homo sapiens
aacctgagtcgtacagaaag

SEQ ID NO: 5662064 - DNA, 13 bp, Homo sapiens
aacctgatgagca

SEQ ID NO: 5662065 - DNA, 17 bp, Homo sapiens
aacctgatgcagtcacg

SEQ ID NO: 5662066 - DNA, 17 bp, Homo sapiens
aacctgatgttaaaatt

SEQ ID NO: 5662067 - DNA, 17 bp, Homo sapiens
aacctgattggccactg

SEQ ID NO: 5662068 - DNA, 12 bp, Homo sapiens
aacctgattgta

SEQ ID NO: 5662069 - DNA, 15 bp, Homo sapiens
aacctgattgtaaac

SEQ ID NO: 5662070 - DNA, 18 bp, Homo sapiens
aacctgcaaggcaaagta

SEQ ID NO: 5662071 - DNA, 19 bp, Homo sapiens
aacctgcacacaggacagc

SEQ ID NO: 5662072 - DNA, 19 bp, Homo sapiens
aacctgcacaggcttgctg

SEQ ID NO: 5662073 - DNA, 21 bp, Homo sapiens
aacctgcagagtagttagaga

SEQ ID NO: 5662074 - DNA, 17 bp, Homo sapiens
aacctgcagttcctgag

SEQ ID NO: 5662075 - DNA, 15 bp, Homo sapiens
aacctgcagttttta

SEQ ID NO: 5662076 - DNA, 16 bp, Homo sapiens
aacctgcagtttttaa

SEQ ID NO: 5662077 - DNA, 15 bp, Homo sapiens
aacctgcatctttag

SEQ ID NO: 5662078 - DNA, 13 bp, Homo sapiens
aacctgcatgcag

SEQ ID NO: 5662079 - DNA, 14 bp, Homo sapiens
aacctgcatgcagc

SEQ ID NO: 5662080 - DNA, 20 bp, Homo sapiens
aacctgcatttaagaacaga

SEQ ID NO: 5662081 - DNA, 15 bp, Homo sapiens
aacctgcatttttaa

SEQ ID NO: 5662082 - DNA, 23 bp, Homo sapiens
aacctgcatttttaaaggacaaa

SEQ ID NO: 5662083 - DNA, 16 bp, Homo sapiens
aacctgccagtcccag

SEQ ID NO: 5662084 - DNA, 15 bp, Homo sapiens
aacccacctctcctg

SEQ ID NO: 5662085 - DNA, 14 bp, Homo sapiens
aacccacctctctg

SEQ ID NO: 5662086 - DNA, 15 bp, Homo sapiens
aacccacctctggcc

SEQ ID NO: 5662087 - DNA, 17 bp, Homo sapiens
aacccacctctggccct

SEQ ID NO: 5662088 - DNA, 18 bp, Homo sapiens
aacccacctctggccctg

SEQ ID NO: 5662089 - DNA, 22 bp, Homo sapiens
aacccacctctggccctgtgta

SEQ ID NO: 5662090 - DNA, 18 bp, Homo sapiens
aacccacgacctgtcctg

SEQ ID NO: 5662091 - DNA, 12 bp, Homo sapiens
aacccactgccc

SEQ ID NO: 5662092 - DNA, 22 bp, Homo sapiens
aacccacttctggcctccagcc

SEQ ID NO: 5662093 - DNA, 20 bp, Homo sapiens
aacccacttgtcactgacac

SEQ ID NO: 5662094 - DNA, 22 bp, Homo sapiens
aacccagacctgttagcagaca

SEQ ID NO: 5662095 - DNA, 16 bp, Homo sapiens
aacccagactcagaca

SEQ ID NO: 5662096 - DNA, 18 bp, Homo sapiens
aacccagactcagacatt

SEQ ID NO: 5662097 - DNA, 21 bp, Homo sapiens
aacccagactgtctccacggc

SEQ ID NO: 5662098 - DNA, 13 bp, Homo sapiens
aacccagatttta

SEQ ID NO: 5662099 - DNA, 19 bp, Homo sapiens
aacccagcagttctctgcc

SEQ ID NO: 5662100 - DNA, 14 bp, Homo sapiens
aacccagcatgtac

SEQ ID NO: 5662101 - DNA, 15 bp, Homo sapiens
aacccagcatgtaca

SEQ ID NO: 5662102 - DNA, 20 bp, Homo sapiens
aacccagcatgtacaaaagt

SEQ ID NO: 5662103 - DNA, 16 bp, Homo sapiens
aacccagcccaccccc

SEQ ID NO: 5662104 - DNA, 14 bp, Homo sapiens
aacccagcccctgc

SEQ ID NO: 5662105 - DNA, 18 bp, Homo sapiens
aacccagcggcttagcca

SEQ ID NO: 5662106 - DNA, 23 bp, Homo sapiens
aacccagcggcttagccaagccc

SEQ ID NO: 5662107 - DNA, 20 bp, Homo sapiens
aacccagctcccttcttccc

SEQ ID NO: 5662108 - DNA, 13 bp, Homo sapiens
aacccagctctca

SEQ ID NO: 5662109 - DNA, 14 bp, Homo sapiens
aacccagctctcag

SEQ ID NO: 5662110 - DNA, 21 bp, Homo sapiens
aacccagctgcaccccttcct

SEQ ID NO: 5662111 - DNA, 15 bp, Homo sapiens
aacccagcttacatt

SEQ ID NO: 5662112 - DNA, 16 bp, Homo sapiens
aacccaggacctctgg

SEQ ID NO: 5662113 - DNA, 18 bp, Homo sapiens
aacccaggacctctggac

SEQ ID NO: 5662114 - DNA, 17 bp, Homo sapiens
aacccaggcagctggca

SEQ ID NO: 5662115 - DNA, 18 bp, Homo sapiens
aacccaggcagctggcag

SEQ ID NO: 5662116 - DNA, 21 bp, Homo sapiens
aacccaggccacaaatgtgtc

SEQ ID NO: 5662117 - DNA, 12 bp, Homo sapiens
aacccagggcaa

SEQ ID NO: 5662118 - DNA, 22 bp, Homo sapiens
aacccagggctctgccccagtc

SEQ ID NO: 5662119 - DNA, 15 bp, Homo sapiens
aacccagggtggaga

SEQ ID NO: 5662120 - DNA, 19 bp, Homo sapiens
aacccaggtgttgtccgtg

SEQ ID NO: 5662121 - DNA, 22 bp, Homo sapiens
aacccaggttcatgaatatggt

SEQ ID NO: 5662122 - DNA, 15 bp, Homo sapiens
aacccagtcgccctt

SEQ ID NO: 5662123 - DNA, 18 bp, Homo sapiens
aacccagtgttcagcata

SEQ ID NO: 5662124 - DNA, 20 bp, Homo sapiens
aacccataactaccaggaat

SEQ ID NO: 5662125 - DNA, 18 bp, Homo sapiens
aacccatacaatgtatgt

SEQ ID NO: 5662126 - DNA, 18 bp, Homo sapiens
aacccataggcccacaca

SEQ ID NO: 5662127 - DNA, 19 bp, Homo sapiens
aacccataggcccacacac

SEQ ID NO: 5662128 - DNA, 14 bp, Homo sapiens
aacccatagggagc

SEQ ID NO: 5662129 - DNA, 21 bp, Homo sapiens
aacccatattgtaaaacaggt

SEQ ID NO: 5662130 - DNA, 20 bp, Homo sapiens
aacccatatttgtacaccaa

SEQ ID NO: 5662131 - DNA, 20 bp, Homo sapiens
aacccatcaacaaaaattgt

SEQ ID NO: 5662132 - DNA, 14 bp, Homo sapiens
aacccatcactgtg

SEQ ID NO: 5662133 - DNA, 19 bp, Homo sapiens
aacccatcagaaggagaag

SEQ ID NO: 5662134 - DNA, 21 bp, Homo sapiens
aacccatcgtggtatgtgaat

SEQ ID NO: 5662135 - DNA, 14 bp, Homo sapiens
aacccatgaagctg

SEQ ID NO: 5662136 - DNA, 22 bp, Homo sapiens
aacccatgagcgtccaggtgat

SEQ ID NO: 5662137 - DNA, 15 bp, Homo sapiens
aacccatgcccctga

SEQ ID NO: 5662138 - DNA, 14 bp, Homo sapiens
aacccatgccctgg

SEQ ID NO: 5662139 - DNA, 24 bp, Homo sapiens
aacccatggctctatttcttcttc

SEQ ID NO: 5662140 - DNA, 19 bp, Homo sapiens
aacccatttgccatgctgc

SEQ ID NO: 5662141 - DNA, 20 bp, Homo sapiens
aacccatttgccatgctgct

SEQ ID NO: 5662142 - DNA, 13 bp, Homo sapiens
aacccattttagt

SEQ ID NO: 5662143 - DNA, 19 bp, Homo sapiens
aacccatttttgagccaag

SEQ ID NO: 5662144 - DNA, 22 bp, Homo sapiens
aaccccaaaatgaagattattt

SEQ ID NO: 5662145 - DNA, 14 bp, Homo sapiens
aaccccaaacagtg

SEQ ID NO: 5662146 - DNA, 18 bp, Homo sapiens
aaccccaaatgctctctc

SEQ ID NO: 5662147 - DNA, 19 bp, Homo sapiens
aaccccaactactgtgtta

SEQ ID NO: 5662148 - DNA, 16 bp, Homo sapiens
aaccccaactccagta

SEQ ID NO: 5662149 - DNA, 13 bp, Homo sapiens
aaccccaactccc

SEQ ID NO: 5662150 - DNA, 20 bp, Homo sapiens
aaccccaaggactgagggca

SEQ ID NO: 5662151 - DNA, 14 bp, Homo sapiens
aaccccacagaaat

SEQ ID NO: 5662152 - DNA, 17 bp, Homo sapiens
aaccccaccctttacat

SEQ ID NO: 5662153 - DNA, 19 bp, Homo sapiens
aaccccacttccattgtat

SEQ ID NO: 5662154 - DNA, 18 bp, Homo sapiens
aaccccagaggcagaggt

SEQ ID NO: 5662155 - DNA, 12 bp, Homo sapiens
aaccccagcagt

SEQ ID NO: 5662156 - DNA, 11 bp, Homo sapiens
aaccccagccc

SEQ ID NO: 5662157 - DNA, 15 bp, Homo sapiens
aaccccagcctgacc

SEQ ID NO: 5662158 - DNA, 11 bp, Homo sapiens
aaccccagcta

SEQ ID NO: 5662159 - DNA, 12 bp, Homo sapiens
aaccccagctcc

SEQ ID NO: 5662160 - DNA, 13 bp, Homo sapiens
aaccccagctgcc

SEQ ID NO: 5662161 - DNA, 23 bp, Homo sapiens
aaccccagctgccggcagtgctg

SEQ ID NO: 5662162 - DNA, 12 bp, Homo sapiens
aaccccagctgg

SEQ ID NO: 5662163 - DNA, 15 bp, Homo sapiens
aaccccagctggcct

SEQ ID NO: 5662164 - DNA, 17 bp, Homo sapiens
aaccccagctggcctct

SEQ ID NO: 5662165 - DNA, 16 bp, Homo sapiens
aaccccaggcatccca

SEQ ID NO: 5662166 - DNA, 14 bp, Homo sapiens
aaccccaggccccg

SEQ ID NO: 5662167 - DNA, 11 bp, Homo sapiens
aaccccagtgt

SEQ ID NO: 5662168 - DNA, 12 bp, Homo sapiens
aacccccaagga

SEQ ID NO: 5662169 - DNA, 14 bp, Homo sapiens
aacccccacacaca

SEQ ID NO: 5662170 - DNA, 15 bp, Homo sapiens
aacccccacacacac

SEQ ID NO: 5662171 - DNA, 21 bp, Homo sapiens
aacccccacatttacctcgag

SEQ ID NO: 5662172 - DNA, 10 bp, Homo sapiens
aacccccacc

SEQ ID NO: 5662173 - DNA, 22 bp, Homo sapiens
aacccccaccagacatcaccct

SEQ ID NO: 5662174 - DNA, 18 bp, Homo sapiens
aacccccacctcccggtg

SEQ ID NO: 5662175 - DNA, 17 bp, Homo sapiens
aacccccagaggtggcc

SEQ ID NO: 5662176 - DNA, 11 bp, Homo sapiens
aacccccagcc

SEQ ID NO: 5662177 - DNA, 23 bp, Homo sapiens
aaccttaaaagtaataaagagaa

SEQ ID NO: 5662178 - DNA, 20 bp, Homo sapiens
aaccttaagataatggataa

SEQ ID NO: 5662179 - DNA, 13 bp, Homo sapiens
aaccttaatgaca

SEQ ID NO: 5662180 - DNA, 18 bp, Homo sapiens
aaccttaatgacaacact

SEQ ID NO: 5662181 - DNA, 15 bp, Homo sapiens
aaccttaatttgaaa

SEQ ID NO: 5662182 - DNA, 17 bp, Homo sapiens
aaccttaatttgaaata

SEQ ID NO: 5662183 - DNA, 15 bp, Homo sapiens
aaccttactatggaa

SEQ ID NO: 5662184 - DNA, 17 bp, Homo sapiens
aaccttactctgagctc

SEQ ID NO: 5662185 - DNA, 16 bp, Homo sapiens
aaccttactggcactg

SEQ ID NO: 5662186 - DNA, 22 bp, Homo sapiens
aaccttatcctgcattgttagc

SEQ ID NO: 5662187 - DNA, 16 bp, Homo sapiens
aaccttattgtacctc

SEQ ID NO: 5662188 - DNA, 18 bp, Homo sapiens
aaccttattgtacctctc

SEQ ID NO: 5662189 - DNA, 19 bp, Homo sapiens
aaccttattgtacctctct

SEQ ID NO: 5662190 - DNA, 16 bp, Homo sapiens
aaccttcaaatacatt

SEQ ID NO: 5662191 - DNA, 17 bp, Homo sapiens
aaccttcaaatacattc

SEQ ID NO: 5662192 - DNA, 19 bp, Homo sapiens
aaccttcaaatacattcta

SEQ ID NO: 5662193 - DNA, 20 bp, Homo sapiens
aaccttcaaatacattctaa

SEQ ID NO: 5662194 - DNA, 14 bp, Homo sapiens
aaccttcattttta

SEQ ID NO: 5662195 - DNA, 21 bp, Homo sapiens
aaccttcatttttaagactgt

SEQ ID NO: 5662196 - DNA, 22 bp, Homo sapiens
aaccttccaacttcctgtggcc

SEQ ID NO: 5662197 - DNA, 13 bp, Homo sapiens
aaccttccatctc

SEQ ID NO: 5662198 - DNA, 14 bp, Homo sapiens
aaccttcctgggag

SEQ ID NO: 5662199 - DNA, 21 bp, Homo sapiens
aaccttcctgtcttcatcctt

SEQ ID NO: 5662200 - DNA, 21 bp, Homo sapiens
aaccttcgccacctgggttcc

SEQ ID NO: 5662201 - DNA, 16 bp, Homo sapiens
aaccttcggctccggg

SEQ ID NO: 5662202 - DNA, 20 bp, Homo sapiens
aaccttctatgttcataaaa

SEQ ID NO: 5662203 - DNA, 18 bp, Homo sapiens
aaccttctcccttcttgg

SEQ ID NO: 5662204 - DNA, 20 bp, Homo sapiens
aaccttctgccctcctgcca

SEQ ID NO: 5662205 - DNA, 21 bp, Homo sapiens
aaccttcttttcaatgcaatg

SEQ ID NO: 5662206 - DNA, 20 bp, Homo sapiens
aaccttgaagtgactgttgt

SEQ ID NO: 5662207 - DNA, 16 bp, Homo sapiens
aaccttgaatgctgcc

SEQ ID NO: 5662208 - DNA, 23 bp, Homo sapiens
aaccttgacttctgcccaaatcc

SEQ ID NO: 5662209 - DNA, 17 bp, Homo sapiens
aaccttgagtcagaaaa

SEQ ID NO: 5662210 - DNA, 23 bp, Homo sapiens
aaccttgagtcagaaaacagaga

SEQ ID NO: 5662211 - DNA, 15 bp, Homo sapiens
aaccttgcaaactct

SEQ ID NO: 5662212 - DNA, 13 bp, Homo sapiens
aaccttgcctggt

SEQ ID NO: 5662213 - DNA, 18 bp, Homo sapiens
aaccttgccttagaaaca

SEQ ID NO: 5662214 - DNA, 15 bp, Homo sapiens
aaccttgccttgaaa

SEQ ID NO: 5662215 - DNA, 23 bp, Homo sapiens
aaccttgccttgaaatttacaca

SEQ ID NO: 5662216 - DNA, 23 bp, Homo sapiens
aaccttgcctttctcgattttat

SEQ ID NO: 5662217 - DNA, 21 bp, Homo sapiens
aaccttgctcttggggaaggg

SEQ ID NO: 5662218 - DNA, 11 bp, Homo sapiens
aaccttgctgt

SEQ ID NO: 5662219 - DNA, 13 bp, Homo sapiens
aaccttgctgtcc

SEQ ID NO: 5662220 - DNA, 21 bp, Homo sapiens
aaccttggagaggagagtggc

SEQ ID NO: 5662221 - DNA, 15 bp, Homo sapiens
aaccttgggccctgg

SEQ ID NO: 5662222 - DNA, 21 bp, Homo sapiens
aaccttggtgtagttgaactg

SEQ ID NO: 5662223 - DNA, 20 bp, Homo sapiens
aaccttgtaaaaaaagcaaa

SEQ ID NO: 5662224 - DNA, 18 bp, Homo sapiens
aaccttgtaaattcccct

SEQ ID NO: 5662225 - DNA, 20 bp, Homo sapiens
aaccttgtaaattccccttc

SEQ ID NO: 5662226 - DNA, 17 bp, Homo sapiens
aaccttgtactttacaa

SEQ ID NO: 5662227 - DNA, 18 bp, Homo sapiens
aaccttgtactttacaat

SEQ ID NO: 5662228 - DNA, 22 bp, Homo sapiens
aaccttgtcaataaaaataaat

SEQ ID NO: 5662229 - DNA, 15 bp, Homo sapiens
aaccttgtgcctggc

SEQ ID NO: 5662230 - DNA, 14 bp, Homo sapiens
aaccttgtgtaaga

SEQ ID NO: 5662231 - DNA, 19 bp, Homo sapiens
aaccttgttctctgcttga

SEQ ID NO: 5662232 - DNA, 13 bp, Homo sapiens
aaccttgtttgtt

SEQ ID NO: 5662233 - DNA, 16 bp, Homo sapiens
aaccttgtttgtttta

SEQ ID NO: 5662234 - DNA, 23 bp, Homo sapiens
aaccttgttttggacagtttacc

SEQ ID NO: 5662235 - DNA, 17 bp, Homo sapiens
aacctttaaaaatgtat

SEQ ID NO: 5662236 - DNA, 16 bp, Homo sapiens
aacctttaaaattgtc

SEQ ID NO: 5662237 - DNA, 20 bp, Homo sapiens
aacctttaaaattgtcacct

SEQ ID NO: 5662238 - DNA, 14 bp, Homo sapiens
aacctttaagaaaa

SEQ ID NO: 5662239 - DNA, 19 bp, Homo sapiens
aacctttacatgaggactc

SEQ ID NO: 5662240 - DNA, 12 bp, Homo sapiens
aacctttcaaaa

SEQ ID NO: 5662241 - DNA, 18 bp, Homo sapiens
aacctttcaaatttcaca

SEQ ID NO: 5662242 - DNA, 20 bp, Homo sapiens
aacctttcacctttgtgtat

SEQ ID NO: 5662243 - DNA, 20 bp, Homo sapiens
aacctttcacttaagtattg

SEQ ID NO: 5662244 - DNA, 16 bp, Homo sapiens
aacctttcagtactct

SEQ ID NO: 5662245 - DNA, 13 bp, Homo sapiens
aacctttccattt

SEQ ID NO: 5662246 - DNA, 11 bp, Homo sapiens
aacctttcccc

SEQ ID NO: 5662247 - DNA, 15 bp, Homo sapiens
aacctttccccagac

SEQ ID NO: 5662248 - DNA, 13 bp, Homo sapiens
aacctttccctca

SEQ ID NO: 5662249 - DNA, 14 bp, Homo sapiens
aacctttccctcac

SEQ ID NO: 5662250 - DNA, 17 bp, Homo sapiens
aacctttccctcacccc

SEQ ID NO: 5662251 - DNA, 19 bp, Homo sapiens
aacctttccctcaccccct

SEQ ID NO: 5662252 - DNA, 18 bp, Homo sapiens
aacctttccgctgtcgcc

SEQ ID NO: 5662253 - DNA, 14 bp, Homo sapiens
aacctttctgacat

SEQ ID NO: 5662254 - DNA, 16 bp, Homo sapiens
aacctttcttcaccaa

SEQ ID NO: 5662255 - DNA, 18 bp, Homo sapiens
aacctttcttcaccaaat

SEQ ID NO: 5662256 - DNA, 21 bp, Homo sapiens
aacctttgagtagatccattt

SEQ ID NO: 5662257 - DNA, 19 bp, Homo sapiens
aacctttgctatgtaaggg

SEQ ID NO: 5662258 - DNA, 14 bp, Homo sapiens
aacctttgggccaa

SEQ ID NO: 5662259 - DNA, 20 bp, Homo sapiens
aacctttgtaagaaaaccaa

SEQ ID NO: 5662260 - DNA, 12 bp, Homo sapiens
aacctttgtcaa

SEQ ID NO: 5662261 - DNA, 15 bp, Homo sapiens
aacctttgtgtggct

SEQ ID NO: 5662262 - DNA, 18 bp, Homo sapiens
aacctttgtttgcatctg

SEQ ID NO: 5662263 - DNA, 21 bp, Homo sapiens
acattgtaaacgtattttgat

SEQ ID NO: 5662264 - DNA, 12 bp, Homo sapiens
acagttgtttga

SEQ ID NO: 5662265 - DNA, 20 bp, Homo sapiens
acagtttataaagccaagaa

SEQ ID NO: 5662266 - DNA, 23 bp, Homo sapiens
acagtttataaagccaagaattg

SEQ ID NO: 5662267 - DNA, 15 bp, Homo sapiens
acagtttatcatgaa

SEQ ID NO: 5662268 - DNA, 17 bp, Homo sapiens
acagtttatcatgaagc

SEQ ID NO: 5662269 - DNA, 19 bp, Homo sapiens
acagtttatcatgaagcct

SEQ ID NO: 5662270 - DNA, 13 bp, Homo sapiens
acagtttatcctg

SEQ ID NO: 5662271 - DNA, 14 bp, Homo sapiens
acagtttatgagaa

SEQ ID NO: 5662272 - DNA, 17 bp, Homo sapiens
acagtttatgcagtgct

SEQ ID NO: 5662273 - DNA, 19 bp, Homo sapiens
acagtttatgcagtgctgc

SEQ ID NO: 5662274 - DNA, 22 bp, Homo sapiens
acagtttattgatattcaataa

SEQ ID NO: 5662275 - DNA, 19 bp, Homo sapiens
acagtttattttctgtgta

SEQ ID NO: 5662276 - DNA, 21 bp, Homo sapiens
acagtttattttctgtgtaaa

SEQ ID NO: 5662277 - DNA, 21 bp, Homo sapiens
acagtttcaggcttttatgag

SEQ ID NO: 5662278 - DNA, 15 bp, Homo sapiens
acagtttcattattc

SEQ ID NO: 5662279 - DNA, 17 bp, Homo sapiens
acagtttcattattctc

SEQ ID NO: 5662280 - DNA, 13 bp, Homo sapiens
acagtttccaaat

SEQ ID NO: 5662281 - DNA, 12 bp, Homo sapiens
acagtttcttag

SEQ ID NO: 5662282 - DNA, 17 bp, Homo sapiens
acagtttcttagctttt

SEQ ID NO: 5662283 - DNA, 18 bp, Homo sapiens
acagtttcttagcttttt

SEQ ID NO: 5662284 - DNA, 14 bp, Homo sapiens
acagtttcttcatg

SEQ ID NO: 5662285 - DNA, 21 bp, Homo sapiens
acagtttcttcatgcattact

SEQ ID NO: 5662286 - DNA, 14 bp, Homo sapiens
acagtttcttccat

SEQ ID NO: 5662287 - DNA, 13 bp, Homo sapiens
acagtttcttctg

SEQ ID NO: 5662288 - DNA, 15 bp, Homo sapiens
acagtttcttgcaag

SEQ ID NO: 5662289 - DNA, 20 bp, Homo sapiens
acagtttgaaataagctatt

SEQ ID NO: 5662290 - DNA, 22 bp, Homo sapiens
acagtttgaaataagctatttg

SEQ ID NO: 5662291 - DNA, 12 bp, Homo sapiens
acagtttgagac

SEQ ID NO: 5662292 - DNA, 14 bp, Homo sapiens
acagtttgatgctg

SEQ ID NO: 5662293 - DNA, 18 bp, Homo sapiens
acagtttgctatttgctt

SEQ ID NO: 5662294 - DNA, 12 bp, Homo sapiens
acagtttgctgt

SEQ ID NO: 5662295 - DNA, 21 bp, Homo sapiens
acagtttggaagtgttaacta

SEQ ID NO: 5662296 - DNA, 17 bp, Homo sapiens
acagtttgtaaatgtta

SEQ ID NO: 5662297 - DNA, 14 bp, Homo sapiens
acagtttgtgtttt

SEQ ID NO: 5662298 - DNA, 17 bp, Homo sapiens
acagtttgtgttttaaa

SEQ ID NO: 5662299 - DNA, 16 bp, Homo sapiens
acagtttgttagtatg

SEQ ID NO: 5662300 - DNA, 13 bp, Homo sapiens
acagtttgttcag

SEQ ID NO: 5662301 - DNA, 16 bp, Homo sapiens
acagtttgttcagtga

SEQ ID NO: 5662302 - DNA, 15 bp, Homo sapiens
acagtttgtttacac

SEQ ID NO: 5662303 - DNA, 19 bp, Homo sapiens
acagtttgtttcctgtctg

SEQ ID NO: 5662304 - DNA, 14 bp, Homo sapiens
acagttttaaagaa

SEQ ID NO: 5662305 - DNA, 21 bp, Homo sapiens
acagttttaaagaatcattat

SEQ ID NO: 5662306 - DNA, 16 bp, Homo sapiens
acagttttaagagttg

SEQ ID NO: 5662307 - DNA, 21 bp, Homo sapiens
acagttttagaataaggagga

SEQ ID NO: 5662308 - DNA, 23 bp, Homo sapiens
acagttttagaataaggaggagg

SEQ ID NO: 5662309 - DNA, 13 bp, Homo sapiens
acagttttatgct

SEQ ID NO: 5662310 - DNA, 16 bp, Homo sapiens
acagttttatgctctt

SEQ ID NO: 5662311 - DNA, 19 bp, Homo sapiens
acagttttatgctcttttt

SEQ ID NO: 5662312 - DNA, 20 bp, Homo sapiens
acagttttatgctctttttt

SEQ ID NO: 5662313 - DNA, 14 bp, Homo sapiens
acagttttcaccat

SEQ ID NO: 5662314 - DNA, 14 bp, Homo sapiens
acagttttcagaaa

SEQ ID NO: 5662315 - DNA, 14 bp, Homo sapiens
acagttttccatga

SEQ ID NO: 5662316 - DNA, 15 bp, Homo sapiens
acagttttccatgaa

SEQ ID NO: 5662317 - DNA, 16 bp, Homo sapiens
acagttttccatgaaa

SEQ ID NO: 5662318 - DNA, 18 bp, Homo sapiens
acagttttccatgaaaac

SEQ ID NO: 5662319 - DNA, 15 bp, Homo sapiens
acagttttctgagaa

SEQ ID NO: 5662320 - DNA, 17 bp, Homo sapiens
acagttttctgagaaag

SEQ ID NO: 5662321 - DNA, 20 bp, Homo sapiens
acagttttctgagaaagact

SEQ ID NO: 5662322 - DNA, 14 bp, Homo sapiens
acagttttcttcat

SEQ ID NO: 5662323 - DNA, 23 bp, Homo sapiens
acagttttgagtaaaaagacatt

SEQ ID NO: 5662324 - DNA, 12 bp, Homo sapiens
acagttttgtct

SEQ ID NO: 5662325 - DNA, 13 bp, Homo sapiens
acagttttgtgaa

SEQ ID NO: 5662326 - DNA, 15 bp, Homo sapiens
acagtttttattgct

SEQ ID NO: 5662327 - DNA, 14 bp, Homo sapiens
acagtttttcctgg

SEQ ID NO: 5662328 - DNA, 16 bp, Homo sapiens
acagtttttgacattt

SEQ ID NO: 5662329 - DNA, 21 bp, Homo sapiens
acagtttttgtaaccatatga

SEQ ID NO: 5662330 - DNA, 19 bp, Homo sapiens
acataaaaacaactttata

SEQ ID NO: 5662331 - DNA, 14 bp, Homo sapiens
acataaaaaggaca

SEQ ID NO: 5662332 - DNA, 15 bp, Homo sapiens
acataaaaaggacat

SEQ ID NO: 5662333 - DNA, 22 bp, Homo sapiens
acataaaaaggacatcagcaaa

SEQ ID NO: 5662334 - DNA, 17 bp, Homo sapiens
acataaaaagttaaaaa

SEQ ID NO: 5662335 - DNA, 22 bp, Homo sapiens
acataaaaagttaaaaaaaata

SEQ ID NO: 5662336 - DNA, 17 bp, Homo sapiens
acataaaacacccttga

SEQ ID NO: 5662337 - DNA, 14 bp, Homo sapiens
acataaaacagaat

SEQ ID NO: 5662338 - DNA, 18 bp, Homo sapiens
acataaaactttaaaagg

SEQ ID NO: 5662339 - DNA, 17 bp, Homo sapiens
acataaaagaatgtaca

SEQ ID NO: 5662340 - DNA, 19 bp, Homo sapiens
acataaaagaatgtacaga

SEQ ID NO: 5662341 - DNA, 20 bp, Homo sapiens
acataaaatatacaaacatg

SEQ ID NO: 5662342 - DNA, 17 bp, Homo sapiens
acataaaatctgtgaat

SEQ ID NO: 5662343 - DNA, 20 bp, Homo sapiens
acataaaatttacatttaat

SEQ ID NO: 5662344 - DNA, 14 bp, Homo sapiens
acataaaattttct

SEQ ID NO: 5662345 - DNA, 12 bp, Homo sapiens
acataaacaaag

SEQ ID NO: 5662346 - DNA, 16 bp, Homo sapiens
acataaacaaagacat

SEQ ID NO: 5662347 - DNA, 17 bp, Homo sapiens
acataaacaaagacatt

SEQ ID NO: 5662348 - DNA, 21 bp, Homo sapiens
acataaacaaagacattgaca

SEQ ID NO: 5662349 - DNA, 12 bp, Homo sapiens
acataaacatca

SEQ ID NO: 5662350 - DNA, 21 bp, Homo sapiens
acataaaccatttttgttact

SEQ ID NO: 5662351 - DNA, 21 bp, Homo sapiens
acataaacccatctgtaatat

SEQ ID NO: 5662352 - DNA, 15 bp, Homo sapiens
acataaaccctccaa

SEQ ID NO: 5662353 - DNA, 17 bp, Homo sapiens
acataaagaaacacttt

SEQ ID NO: 5662354 - DNA, 16 bp, Homo sapiens
acataaagaaattcaa

SEQ ID NO: 5662355 - DNA, 22 bp, Homo sapiens
acataaagcctctgactcaaac

SEQ ID NO: 5662356 - DNA, 17 bp, Homo sapiens
acataaaggaaaagaca

SEQ ID NO: 5662357 - DNA, 22 bp, Homo sapiens
acataaaggaaaagacacattt

SEQ ID NO: 5662358 - DNA, 13 bp, Homo sapiens
acataaaggataa

SEQ ID NO: 5662359 - DNA, 17 bp, Homo sapiens
acataaaggataaactt

SEQ ID NO: 5662360 - DNA, 18 bp, Homo sapiens
acataaaggtaaaacaaa

SEQ ID NO: 5662361 - DNA, 12 bp, Homo sapiens
acataaagtaaa

SEQ ID NO: 5662362 - DNA, 18 bp, Homo sapiens
acataaagtaataactgt

SEQ ID NO: 5662363 - DNA, 16 bp, Homo sapiens
acataaagtcatcaaa

SEQ ID NO: 5662364 - DNA, 15 bp, Homo sapiens
acataaagttgataa

SEQ ID NO: 5662365 - DNA, 15 bp, Homo sapiens
acataaataaaagaa

SEQ ID NO: 5662366 - DNA, 18 bp, Homo sapiens
acataaatctgtgaactt

SEQ ID NO: 5662367 - DNA, 12 bp, Homo sapiens
acataaatgaaa

SEQ ID NO: 5662368 - DNA, 14 bp, Homo sapiens
acataaatgaaaga

SEQ ID NO: 5662369 - DNA, 17 bp, Homo sapiens
acataaatgcagcccat

SEQ ID NO: 5662370 - DNA, 14 bp, Homo sapiens
acataaattgtaat

SEQ ID NO: 5662371 - DNA, 22 bp, Homo sapiens
acataacaaaatcacttccata

SEQ ID NO: 5662372 - DNA, 20 bp, Homo sapiens
acataacaacctttcccatt

SEQ ID NO: 5662373 - DNA, 13 bp, Homo sapiens
acataacaagaaa

SEQ ID NO: 5662374 - DNA, 12 bp, Homo sapiens
acataacacaca

SEQ ID NO: 5662375 - DNA, 13 bp, Homo sapiens
acataacacacat

SEQ ID NO: 5662376 - DNA, 22 bp, Homo sapiens
acataacagggtaaattattca

SEQ ID NO: 5662377 - DNA, 22 bp, Homo sapiens
acataacataagctagaaaaat

SEQ ID NO: 5662378 - DNA, 22 bp, Homo sapiens
acataacctcagagtatcttta

SEQ ID NO: 5662379 - DNA, 15 bp, Homo sapiens
acataacggaaagtt

SEQ ID NO: 5662380 - DNA, 20 bp, Homo sapiens
acataacgtttttcctttaa

SEQ ID NO: 5662381 - DNA, 22 bp, Homo sapiens
acataacgtttttcctttaaaa

SEQ ID NO: 5662382 - DNA, 18 bp, Homo sapiens
acataactaaatttgata

SEQ ID NO: 5662383 - DNA, 13 bp, Homo sapiens
acataactgataa

SEQ ID NO: 5662384 - DNA, 20 bp, Homo sapiens
acataactgatctatttatt

SEQ ID NO: 5662385 - DNA, 15 bp, Homo sapiens
acataactgccttga

SEQ ID NO: 5662386 - DNA, 12 bp, Homo sapiens
acataactggat

SEQ ID NO: 5662387 - DNA, 17 bp, Homo sapiens
acataactggattttga

SEQ ID NO: 5662388 - DNA, 15 bp, Homo sapiens
acataactgtaacat

SEQ ID NO: 5662389 - DNA, 13 bp, Homo sapiens
acataacttcagt

SEQ ID NO: 5662390 - DNA, 18 bp, Homo sapiens
acataacttgatatagaa

SEQ ID NO: 5662391 - DNA, 13 bp, Homo sapiens
acataagagaaag

SEQ ID NO: 5662392 - DNA, 14 bp, Homo sapiens
acataagagaaaga

SEQ ID NO: 5662393 - DNA, 23 bp, Homo sapiens
acataagatcactgccagagata

SEQ ID NO: 5662394 - DNA, 18 bp, Homo sapiens
acataagctatttttcta

SEQ ID NO: 5662395 - DNA, 16 bp, Homo sapiens
acataaggatgacttt

SEQ ID NO: 5662396 - DNA, 21 bp, Homo sapiens
acataaggggtttgccatttg

SEQ ID NO: 5662397 - DNA, 18 bp, Homo sapiens
acataagtaacttttaaa

SEQ ID NO: 5662398 - DNA, 19 bp, Homo sapiens
acataagtaagacttgatt

SEQ ID NO: 5662399 - DNA, 21 bp, Homo sapiens
acataagtccattaactgctt

SEQ ID NO: 5662400 - DNA, 16 bp, Homo sapiens
acataagttagaacaa

SEQ ID NO: 5662401 - DNA, 15 bp, Homo sapiens
acataagttgcattt

SEQ ID NO: 5662402 - DNA, 19 bp, Homo sapiens
acataataaacgatgttgt

SEQ ID NO: 5662403 - DNA, 21 bp, Homo sapiens
acataataaacgatgttgtga

SEQ ID NO: 5662404 - DNA, 15 bp, Homo sapiens
acataataaagtatt

SEQ ID NO: 5662405 - DNA, 21 bp, Homo sapiens
acataataaatcacacattca

SEQ ID NO: 5662406 - DNA, 14 bp, Homo sapiens
acataataataatg

SEQ ID NO: 5662407 - DNA, 17 bp, Homo sapiens
acataatactgaaccac

SEQ ID NO: 5662408 - DNA, 17 bp, Homo sapiens
acataatataagaatca

SEQ ID NO: 5662409 - DNA, 20 bp, Homo sapiens
acataatatatgacttccta

SEQ ID NO: 5662410 - DNA, 17 bp, Homo sapiens
acataatatcttgaaga

SEQ ID NO: 5662411 - DNA, 19 bp, Homo sapiens
acataatatcttgaagaat

SEQ ID NO: 5662412 - DNA, 22 bp, Homo sapiens
acataatatcttgaagaatatt

SEQ ID NO: 5662413 - DNA, 19 bp, Homo sapiens
acataatctagtttacaga

SEQ ID NO: 5662414 - DNA, 15 bp, Homo sapiens
acataatctctggaa

SEQ ID NO: 5662415 - DNA, 23 bp, Homo sapiens
acataatcttctgccttctcatg

SEQ ID NO: 5662416 - DNA, 21 bp, Homo sapiens
acataatgaacagaatttatg

SEQ ID NO: 5662417 - DNA, 15 bp, Homo sapiens
acataatgaatgcta

SEQ ID NO: 5662418 - DNA, 19 bp, Homo sapiens
acataatgcttaatttcta

SEQ ID NO: 5662419 - DNA, 20 bp, Homo sapiens
acataatgcttaatttctaa

SEQ ID NO: 5662420 - DNA, 14 bp, Homo sapiens
acataatggaaaac

SEQ ID NO: 5662421 - DNA, 19 bp, Homo sapiens
acataatgggccactgaaa

SEQ ID NO: 5662422 - DNA, 21 bp, Homo sapiens
acataatgggccactgaaatc

SEQ ID NO: 5662423 - DNA, 23 bp, Homo sapiens
acataatgggccactgaaatctg

SEQ ID NO: 5662424 - DNA, 17 bp, Homo sapiens
acataatggtactccca

SEQ ID NO: 5662425 - DNA, 21 bp, Homo sapiens
acataatggttgtgaaatgta

SEQ ID NO: 5662426 - DNA, 22 bp, Homo sapiens
acataatggttgtgaaatgtaa

SEQ ID NO: 5662427 - DNA, 20 bp, Homo sapiens
acataatgtagtgagtgtag

SEQ ID NO: 5662428 - DNA, 23 bp, Homo sapiens
acataatgttagtagcactgaga

SEQ ID NO: 5662429 - DNA, 22 bp, Homo sapiens
acataatgtttttcctttctta

SEQ ID NO: 5662430 - DNA, 19 bp, Homo sapiens
acataattaaattttgagt

SEQ ID NO: 5662431 - DNA, 17 bp, Homo sapiens
acataattatccaggaa

SEQ ID NO: 5662432 - DNA, 23 bp, Homo sapiens
acataattatccaggaagggaat

SEQ ID NO: 5662433 - DNA, 20 bp, Homo sapiens
acataattcaaagataacat

SEQ ID NO: 5662434 - DNA, 23 bp, Homo sapiens
acataattcattaaaaacatttt

SEQ ID NO: 5662435 - DNA, 17 bp, Homo sapiens
acataattccagtcaca

SEQ ID NO: 5662436 - DNA, 21 bp, Homo sapiens
acataattctgttactttgct

SEQ ID NO: 5662437 - DNA, 15 bp, Homo sapiens
acataattgattaaa

SEQ ID NO: 5662438 - DNA, 17 bp, Homo sapiens
acataattgattaaaat

SEQ ID NO: 5662439 - DNA, 22 bp, Homo sapiens
acataattgattaaaatctctt

SEQ ID NO: 5662440 - DNA, 18 bp, Homo sapiens
acataattgccaataatg

SEQ ID NO: 5662441 - DNA, 20 bp, Homo sapiens
acatataaattaatacataa

SEQ ID NO: 5662442 - DNA, 17 bp, Homo sapiens
acatataaattatagaa

SEQ ID NO: 5662443 - DNA, 14 bp, Homo sapiens
acatataacactta

SEQ ID NO: 5662444 - DNA, 16 bp, Homo sapiens
acatataacacttaac

SEQ ID NO: 5662445 - DNA, 15 bp, Homo sapiens
acatttcttttcttt

SEQ ID NO: 5662446 - DNA, 20 bp, Homo sapiens
acatttcttttctttttaca

SEQ ID NO: 5662447 - DNA, 19 bp, Homo sapiens
acatttgaattcttgatct

SEQ ID NO: 5662448 - DNA, 20 bp, Homo sapiens
acatttgagggcccagccag

SEQ ID NO: 5662449 - DNA, 16 bp, Homo sapiens
acatttgagtcccttc

SEQ ID NO: 5662450 - DNA, 23 bp, Homo sapiens
acatttgataattttgaaatgat

SEQ ID NO: 5662451 - DNA, 18 bp, Homo sapiens
acatttgatagaaaggaa

SEQ ID NO: 5662452 - DNA, 14 bp, Homo sapiens
acatttgatatttt

SEQ ID NO: 5662453 - DNA, 17 bp, Homo sapiens
acatttgatatttttcc

SEQ ID NO: 5662454 - DNA, 22 bp, Homo sapiens
acatttgatggagggtggaaat

SEQ ID NO: 5662455 - DNA, 15 bp, Homo sapiens
acatttgatgtctag

SEQ ID NO: 5662456 - DNA, 19 bp, Homo sapiens
acatttgattaataaaata

SEQ ID NO: 5662457 - DNA, 21 bp, Homo sapiens
acatttgattaataaaatatc

SEQ ID NO: 5662458 - DNA, 18 bp, Homo sapiens
acatttgcaaaatggaaa

SEQ ID NO: 5662459 - DNA, 13 bp, Homo sapiens
acatttgcaatta

SEQ ID NO: 5662460 - DNA, 12 bp, Homo sapiens
acatttgcatgc

SEQ ID NO: 5662461 - DNA, 23 bp, Homo sapiens
acatttgccttttgttaaaagat

SEQ ID NO: 5662462 - DNA, 17 bp, Homo sapiens
acatttgctactgttgt

SEQ ID NO: 5662463 - DNA, 19 bp, Homo sapiens
acatttgctactgttgtaa

SEQ ID NO: 5662464 - DNA, 16 bp, Homo sapiens
acatttgctcatggaa

SEQ ID NO: 5662465 - DNA, 12 bp, Homo sapiens
acatttgctgaa

SEQ ID NO: 5662466 - DNA, 19 bp, Homo sapiens
acatttgctgaactcagca

SEQ ID NO: 5662467 - DNA, 23 bp, Homo sapiens
acatttgctgttttaaacattaa

SEQ ID NO: 5662468 - DNA, 21 bp, Homo sapiens
acatttgctttaatgagtgca

SEQ ID NO: 5662469 - DNA, 19 bp, Homo sapiens
acatttggaaaccatgcac

SEQ ID NO: 5662470 - DNA, 20 bp, Homo sapiens
acatttggaaaccatgcact

SEQ ID NO: 5662471 - DNA, 14 bp, Homo sapiens
acatttggaacagt

SEQ ID NO: 5662472 - DNA, 18 bp, Homo sapiens
acatttggaacagtgaca

SEQ ID NO: 5662473 - DNA, 21 bp, Homo sapiens
acatttggaactaacacgtga

SEQ ID NO: 5662474 - DNA, 11 bp, Homo sapiens
acatttggaat

SEQ ID NO: 5662475 - DNA, 15 bp, Homo sapiens
acatttggaatactt

SEQ ID NO: 5662476 - DNA, 17 bp, Homo sapiens
acatttggaatactttt

SEQ ID NO: 5662477 - DNA, 18 bp, Homo sapiens
acatttggacatttccag

SEQ ID NO: 5662478 - DNA, 20 bp, Homo sapiens
acatttggagtgttcccctt

SEQ ID NO: 5662479 - DNA, 18 bp, Homo sapiens
acatttggcttacagtaa

SEQ ID NO: 5662480 - DNA, 19 bp, Homo sapiens
acatttgggagacatgtga

SEQ ID NO: 5662481 - DNA, 20 bp, Homo sapiens
acatttgggagacatgtgac

SEQ ID NO: 5662482 - DNA, 21 bp, Homo sapiens
acatttgggagtttttatgag

SEQ ID NO: 5662483 - DNA, 14 bp, Homo sapiens
acatttgggtaaat

SEQ ID NO: 5662484 - DNA, 17 bp, Homo sapiens
acatttgggtaaatcat

SEQ ID NO: 5662485 - DNA, 18 bp, Homo sapiens
acatttgggtaaatcatg

SEQ ID NO: 5662486 - DNA, 21 bp, Homo sapiens
acatttgggttactatttctt

SEQ ID NO: 5662487 - DNA, 16 bp, Homo sapiens
acatttgtaaaaatac

SEQ ID NO: 5662488 - DNA, 12 bp, Homo sapiens
acatttgtacat

SEQ ID NO: 5662489 - DNA, 14 bp, Homo sapiens
acatttgtagttga

SEQ ID NO: 5662490 - DNA, 17 bp, Homo sapiens
acatttgtagttggagt

SEQ ID NO: 5662491 - DNA, 16 bp, Homo sapiens
acatttgtataaaata

SEQ ID NO: 5662492 - DNA, 21 bp, Homo sapiens
acatttgtatttatgtggctg

SEQ ID NO: 5662493 - DNA, 19 bp, Homo sapiens
acatttgtattttgtgatg

SEQ ID NO: 5662494 - DNA, 23 bp, Homo sapiens
acatttgtcattttcattagcaa

SEQ ID NO: 5662495 - DNA, 19 bp, Homo sapiens
acatttgtcctgcagagct

SEQ ID NO: 5662496 - DNA, 21 bp, Homo sapiens
acatttgtgaactcaaacgat

SEQ ID NO: 5662497 - DNA, 13 bp, Homo sapiens
acatttgtgcata

SEQ ID NO: 5662498 - DNA, 19 bp, Homo sapiens
acatttgtgccgacactgt

SEQ ID NO: 5662499 - DNA, 21 bp, Homo sapiens
acatttgtgccgacactgttc

SEQ ID NO: 5662500 - DNA, 23 bp, Homo sapiens
acatttgtgtcactgtacagttt

SEQ ID NO: 5662501 - DNA, 13 bp, Homo sapiens
acatttgttcatg

SEQ ID NO: 5662502 - DNA, 20 bp, Homo sapiens
acatttgttcatgagtggat

SEQ ID NO: 5662503 - DNA, 14 bp, Homo sapiens
acatttgttcctgg

SEQ ID NO: 5662504 - DNA, 19 bp, Homo sapiens
acatttgttctatagcttt

SEQ ID NO: 5662505 - DNA, 12 bp, Homo sapiens
acatttgttctg

SEQ ID NO: 5662506 - DNA, 15 bp, Homo sapiens
acatttgtttgtatt

SEQ ID NO: 5662507 - DNA, 18 bp, Homo sapiens
acatttgtttgtattcat

SEQ ID NO: 5662508 - DNA, 20 bp, Homo sapiens
acattttaaaaaatggtcac

SEQ ID NO: 5662509 - DNA, 13 bp, Homo sapiens
acattttaaaatc

SEQ ID NO: 5662510 - DNA, 15 bp, Homo sapiens
acattttaaaatcaa

SEQ ID NO: 5662511 - DNA, 17 bp, Homo sapiens
acattttaaaatcaact

SEQ ID NO: 5662512 - DNA, 17 bp, Homo sapiens
acattttaaataaaaga

SEQ ID NO: 5662513 - DNA, 20 bp, Homo sapiens
acattttaaataaaagaaaa

SEQ ID NO: 5662514 - DNA, 16 bp, Homo sapiens
acattttaaatactct

SEQ ID NO: 5662515 - DNA, 21 bp, Homo sapiens
acattttaaatactctactta

SEQ ID NO: 5662516 - DNA, 15 bp, Homo sapiens
acattttaaatggac

SEQ ID NO: 5662517 - DNA, 21 bp, Homo sapiens
acattttaacaagaagatgaa

SEQ ID NO: 5662518 - DNA, 12 bp, Homo sapiens
acattttaacag

SEQ ID NO: 5662519 - DNA, 22 bp, Homo sapiens
acattttaatagagatgaatca

SEQ ID NO: 5662520 - DNA, 23 bp, Homo sapiens
acattttacatatggaaatatag

SEQ ID NO: 5662521 - DNA, 14 bp, Homo sapiens
acattttacatgca

SEQ ID NO: 5662522 - DNA, 12 bp, Homo sapiens
acattttagaat

SEQ ID NO: 5662523 - DNA, 18 bp, Homo sapiens
acattttagtttctaaag

SEQ ID NO: 5662524 - DNA, 15 bp, Homo sapiens
acattttatatgtga

SEQ ID NO: 5662525 - DNA, 15 bp, Homo sapiens
acattttatcattaa

SEQ ID NO: 5662526 - DNA, 18 bp, Homo sapiens
acattttatcattaaaaa

SEQ ID NO: 5662527 - DNA, 16 bp, Homo sapiens
acattttatgagagtt

SEQ ID NO: 5662528 - DNA, 20 bp, Homo sapiens
acattttatggtgcctagta

SEQ ID NO: 5662529 - DNA, 14 bp, Homo sapiens
acattttatgtctt

SEQ ID NO: 5662530 - DNA, 15 bp, Homo sapiens
acattttatgtcttt

SEQ ID NO: 5662531 - DNA, 22 bp, Homo sapiens
acattttatttattagctgtaa

SEQ ID NO: 5662532 - DNA, 18 bp, Homo sapiens
acattttattttattatg

SEQ ID NO: 5662533 - DNA, 20 bp, Homo sapiens
acattttattttattatgca

SEQ ID NO: 5662534 - DNA, 23 bp, Homo sapiens
acattttcaaggactattttaga

SEQ ID NO: 5662535 - DNA, 16 bp, Homo sapiens
acattttcaatactgt

SEQ ID NO: 5662536 - DNA, 20 bp, Homo sapiens
acattttcacacaatacaat

SEQ ID NO: 5662537 - DNA, 13 bp, Homo sapiens
acattttcagaag

SEQ ID NO: 5662538 - DNA, 13 bp, Homo sapiens
acattttcagaca

SEQ ID NO: 5662539 - DNA, 12 bp, Homo sapiens
acattttcagtg

SEQ ID NO: 5662540 - DNA, 18 bp, Homo sapiens
acattttcatgcacagta

SEQ ID NO: 5662541 - DNA, 21 bp, Homo sapiens
acattttccacggaaacagaa

SEQ ID NO: 5662542 - DNA, 14 bp, Homo sapiens
acattttctaaata

SEQ ID NO: 5662543 - DNA, 19 bp, Homo sapiens
acattttctaagaaacatt

SEQ ID NO: 5662544 - DNA, 12 bp, Homo sapiens
acattttctggt

SEQ ID NO: 5662545 - DNA, 12 bp, Homo sapiens
acattttcttaa

SEQ ID NO: 5662546 - DNA, 17 bp, Homo sapiens
acattttcttaatccag

SEQ ID NO: 5662547 - DNA, 23 bp, Homo sapiens
acattttctttctttttctggaa

SEQ ID NO: 5662548 - DNA, 18 bp, Homo sapiens
acattttgacacaatgtt

SEQ ID NO: 5662549 - DNA, 16 bp, Homo sapiens
acattttgagctattt

SEQ ID NO: 5662550 - DNA, 20 bp, Homo sapiens
acattttgagctatttcctt

SEQ ID NO: 5662551 - DNA, 16 bp, Homo sapiens
acattttgcctgattg

SEQ ID NO: 5662552 - DNA, 19 bp, Homo sapiens
acattttgcttgcgtgctg

SEQ ID NO: 5662553 - DNA, 12 bp, Homo sapiens
acattttggaaa

SEQ ID NO: 5662554 - DNA, 16 bp, Homo sapiens
acattttggatttctt

SEQ ID NO: 5662555 - DNA, 18 bp, Homo sapiens
acattttgggctggataa

SEQ ID NO: 5662556 - DNA, 17 bp, Homo sapiens
acattttgtaaaatatt

SEQ ID NO: 5662557 - DNA, 15 bp, Homo sapiens
acattttgtaaatct

SEQ ID NO: 5662558 - DNA, 16 bp, Homo sapiens
acattttgtaaatctg

SEQ ID NO: 5662559 - DNA, 17 bp, Homo sapiens
acattttgtaaatctgt

SEQ ID NO: 5662560 - DNA, 18 bp, Homo sapiens
acattttgtaaatctgta

SEQ ID NO: 5662561 - DNA, 16 bp, Homo sapiens
acattttgtataattg

SEQ ID NO: 5662562 - DNA, 19 bp, Homo sapiens
acattttgtataattgtat

SEQ ID NO: 5662563 - DNA, 21 bp, Homo sapiens
acattttgtataattgtatcg

SEQ ID NO: 5662564 - DNA, 14 bp, Homo sapiens
acattttgtatcaa

SEQ ID NO: 5662565 - DNA, 14 bp, Homo sapiens
acattttgtatgga

SEQ ID NO: 5662566 - DNA, 19 bp, Homo sapiens
acattttgttatagaatac

SEQ ID NO: 5662567 - DNA, 18 bp, Homo sapiens
acattttgttcttacaca

SEQ ID NO: 5662568 - DNA, 20 bp, Homo sapiens
acattttgttgtaaaaagaa

SEQ ID NO: 5662569 - DNA, 21 bp, Homo sapiens
acattttgttgtaaaaagaaa

SEQ ID NO: 5662570 - DNA, 23 bp, Homo sapiens
acattttgttgtaaaaagaaaaa

SEQ ID NO: 5662571 - DNA, 19 bp, Homo sapiens
acattttgtttttactgta

SEQ ID NO: 5662572 - DNA, 15 bp, Homo sapiens
acatttttaaaaaat

SEQ ID NO: 5662573 - DNA, 14 bp, Homo sapiens
acatttttaaaaca

SEQ ID NO: 5662574 - DNA, 21 bp, Homo sapiens
acatttttaaagtctaaactg

SEQ ID NO: 5662575 - DNA, 16 bp, Homo sapiens
acatttttaaatgtaa

SEQ ID NO: 5662576 - DNA, 19 bp, Homo sapiens
acatttttaaattcttact

SEQ ID NO: 5662577 - DNA, 19 bp, Homo sapiens
acatttttaagtgctgcat

SEQ ID NO: 5662578 - DNA, 22 bp, Homo sapiens
acatttttaatttaacaaacta

SEQ ID NO: 5662579 - DNA, 12 bp, Homo sapiens
acatttttattt

SEQ ID NO: 5662580 - DNA, 13 bp, Homo sapiens
acatttttattta

SEQ ID NO: 5662581 - DNA, 15 bp, Homo sapiens
acatttttatttatg

SEQ ID NO: 5662582 - DNA, 16 bp, Homo sapiens
acatttttcaactttg

SEQ ID NO: 5662583 - DNA, 14 bp, Homo sapiens
acatttttcaataa

SEQ ID NO: 5662584 - DNA, 15 bp, Homo sapiens
acatttttcaataaa

SEQ ID NO: 5662585 - DNA, 21 bp, Homo sapiens
acatttttcagatataaaaga

SEQ ID NO: 5662586 - DNA, 15 bp, Homo sapiens
acatttttcattcat

SEQ ID NO: 5662587 - DNA, 20 bp, Homo sapiens
acatttttgagatattaaag

SEQ ID NO: 5662588 - DNA, 18 bp, Homo sapiens
acatttttgatcaaatgt

SEQ ID NO: 5662589 - DNA, 19 bp, Homo sapiens
acatttttgatcaaatgta

SEQ ID NO: 5662590 - DNA, 20 bp, Homo sapiens
acatttttgatttcaggttt

SEQ ID NO: 5662591 - DNA, 18 bp, Homo sapiens
acatttttgcacagatta

SEQ ID NO: 5662592 - DNA, 11 bp, Homo sapiens
acatttttgcc

SEQ ID NO: 5662593 - DNA, 14 bp, Homo sapiens
acatttttgccaaa

SEQ ID NO: 5662594 - DNA, 23 bp, Homo sapiens
acatttttggatttctgtgaagt

SEQ ID NO: 5662595 - DNA, 18 bp, Homo sapiens
acatttttgtaatgctgt

SEQ ID NO: 5662596 - DNA, 19 bp, Homo sapiens
acatttttgtatgttttat

SEQ ID NO: 5662597 - DNA, 13 bp, Homo sapiens
acatttttgtctg

SEQ ID NO: 5662598 - DNA, 18 bp, Homo sapiens
acatttttgtctgtccta

SEQ ID NO: 5662599 - DNA, 20 bp, Homo sapiens
acatttttgtctttatctca

SEQ ID NO: 5662600 - DNA, 12 bp, Homo sapiens
acattttttaaa

SEQ ID NO: 5662601 - DNA, 17 bp, Homo sapiens
acattttttaaatgcac

SEQ ID NO: 5662602 - DNA, 17 bp, Homo sapiens
acattttttaactttct

SEQ ID NO: 5662603 - DNA, 20 bp, Homo sapiens
acattttttaggaaatgttt

SEQ ID NO: 5662604 - DNA, 19 bp, Homo sapiens
acattttttagtctgtaat

SEQ ID NO: 5662605 - DNA, 21 bp, Homo sapiens
acattttttctaataaagcca

SEQ ID NO: 5662606 - DNA, 13 bp, Homo sapiens
acattttttcttc

SEQ ID NO: 5662607 - DNA, 20 bp, Homo sapiens
acattttttgctataatcat

SEQ ID NO: 5662608 - DNA, 19 bp, Homo sapiens
acattttttgtttcttggt

SEQ ID NO: 5662609 - DNA, 21 bp, Homo sapiens
acatttttttaagcaacactt

SEQ ID NO: 5662610 - DNA, 20 bp, Homo sapiens
acatttttttctacctataa

SEQ ID NO: 5662611 - DNA, 21 bp, Homo sapiens
acatttttttctgatttgtcc

SEQ ID NO: 5662612 - DNA, 20 bp, Homo sapiens
acattttttttaaaaattag

SEQ ID NO: 5662613 - DNA, 17 bp, Homo sapiens
acattttttttcaagtg

SEQ ID NO: 5662614 - DNA, 18 bp, Homo sapiens
acattttttttttaaatc

SEQ ID NO: 5662615 - DNA, 21 bp, Homo sapiens
acatttttttttttaattttg

SEQ ID NO: 5662616 - DNA, 17 bp, Homo sapiens
accaaaaaaaaaaaagg

SEQ ID NO: 5662617 - DNA, 18 bp, Homo sapiens
accaaaaaaaaaaaagga

SEQ ID NO: 5662618 - DNA, 22 bp, Homo sapiens
accaactaagttgtattttaat

SEQ ID NO: 5662619 - DNA, 16 bp, Homo sapiens
accaactacaaccaag

SEQ ID NO: 5662620 - DNA, 15 bp, Homo sapiens
accaactagacattc

SEQ ID NO: 5662621 - DNA, 13 bp, Homo sapiens
accaactatccaa

SEQ ID NO: 5662622 - DNA, 16 bp, Homo sapiens
accaactatttcaata

SEQ ID NO: 5662623 - DNA, 21 bp, Homo sapiens
accaactctaatattgcttct

SEQ ID NO: 5662624 - DNA, 12 bp, Homo sapiens
accaactctctc

SEQ ID NO: 5662625 - DNA, 20 bp, Homo sapiens
acatcagccttcaagaatca

SEQ ID NO: 5662626 - DNA, 16 bp, Homo sapiens
acatcagccttctcct

SEQ ID NO: 5662627 - DNA, 14 bp, Homo sapiens
acatcagctgaatt

SEQ ID NO: 5662628 - DNA, 21 bp, Homo sapiens
acatcagcttgaccagtataa

SEQ ID NO: 5662629 - DNA, 21 bp, Homo sapiens
acatcaggagactgggctctg

SEQ ID NO: 5662630 - DNA, 21 bp, Homo sapiens
acatcagggcggcctcccagg

SEQ ID NO: 5662631 - DNA, 16 bp, Homo sapiens
acatcagtacttttct

SEQ ID NO: 5662632 - DNA, 20 bp, Homo sapiens
acatcagtagcatttttcta

SEQ ID NO: 5662633 - DNA, 21 bp, Homo sapiens
acatcagtagcatttttctaa

SEQ ID NO: 5662634 - DNA, 23 bp, Homo sapiens
acatcagtatagtgttttattat

SEQ ID NO: 5662635 - DNA, 23 bp, Homo sapiens
acatcagtccacccccattgtga

SEQ ID NO: 5662636 - DNA, 15 bp, Homo sapiens
acatcagtgtggaaa

SEQ ID NO: 5662637 - DNA, 20 bp, Homo sapiens
acatcagttactctgaaggg

SEQ ID NO: 5662638 - DNA, 13 bp, Homo sapiens
acatcagttatat

SEQ ID NO: 5662639 - DNA, 18 bp, Homo sapiens
acatcagtttgttccttt

SEQ ID NO: 5662640 - DNA, 19 bp, Homo sapiens
acatcataaggttttattc

SEQ ID NO: 5662641 - DNA, 19 bp, Homo sapiens
acatcataattacattcct

SEQ ID NO: 5662642 - DNA, 21 bp, Homo sapiens
acatcataattacattcctaa

SEQ ID NO: 5662643 - DNA, 18 bp, Homo sapiens
acatcatataaaaagcag

SEQ ID NO: 5662644 - DNA, 15 bp, Homo sapiens
acatcatatacctct

SEQ ID NO: 5662645 - DNA, 18 bp, Homo sapiens
acatcatatacctcttga

SEQ ID NO: 5662646 - DNA, 19 bp, Homo sapiens
acatcatatgttagataca

SEQ ID NO: 5662647 - DNA, 22 bp, Homo sapiens
acatcatatgttagatacacaa

SEQ ID NO: 5662648 - DNA, 21 bp, Homo sapiens
acatcatattctattgtttac

SEQ ID NO: 5662649 - DNA, 15 bp, Homo sapiens
acatcatattggaga

SEQ ID NO: 5662650 - DNA, 19 bp, Homo sapiens
acatcatcaaggcactgcc

SEQ ID NO: 5662651 - DNA, 22 bp, Homo sapiens
acatcatcgctcccaaaggaaa

SEQ ID NO: 5662652 - DNA, 18 bp, Homo sapiens
acatcatctgtaagctgt

SEQ ID NO: 5662653 - DNA, 20 bp, Homo sapiens
acatcatctttatctcctgg

SEQ ID NO: 5662654 - DNA, 15 bp, Homo sapiens
acatcatgaatttta

SEQ ID NO: 5662655 - DNA, 17 bp, Homo sapiens
acatcatgaattttaca

SEQ ID NO: 5662656 - DNA, 15 bp, Homo sapiens
acatcatgagccttc

SEQ ID NO: 5662657 - DNA, 14 bp, Homo sapiens
acatcatgtaagat

SEQ ID NO: 5662658 - DNA, 20 bp, Homo sapiens
acatcattattgtagtttga

SEQ ID NO: 5662659 - DNA, 16 bp, Homo sapiens
acatcattccttttta

SEQ ID NO: 5662660 - DNA, 22 bp, Homo sapiens
acatcattctacataatggaaa

SEQ ID NO: 5662661 - DNA, 15 bp, Homo sapiens
acatcattctgtgtc

SEQ ID NO: 5662662 - DNA, 14 bp, Homo sapiens
acatcattgtcagc

SEQ ID NO: 5662663 - DNA, 11 bp, Homo sapiens
acatcatttct

SEQ ID NO: 5662664 - DNA, 21 bp, Homo sapiens
acatccaaaatagttaagaca

SEQ ID NO: 5662665 - DNA, 18 bp, Homo sapiens
acatccaactccagcaac

SEQ ID NO: 5662666 - DNA, 14 bp, Homo sapiens
acatccaactggaa

SEQ ID NO: 5662667 - DNA, 21 bp, Homo sapiens
acatccaactggaaattccag

SEQ ID NO: 5662668 - DNA, 15 bp, Homo sapiens
acatccaatgcatag

SEQ ID NO: 5662669 - DNA, 12 bp, Homo sapiens
acatccacccag

SEQ ID NO: 5662670 - DNA, 20 bp, Homo sapiens
acatccacccaggtcccgag

SEQ ID NO: 5662671 - DNA, 13 bp, Homo sapiens
acatccactctct

SEQ ID NO: 5662672 - DNA, 22 bp, Homo sapiens
acatccactctctcttgttctt

SEQ ID NO: 5662673 - DNA, 18 bp, Homo sapiens
acatccacttaagttctt

SEQ ID NO: 5662674 - DNA, 19 bp, Homo sapiens
acatccacttaagttcttt

SEQ ID NO: 5662675 - DNA, 19 bp, Homo sapiens
acatccagaaagctgagga

SEQ ID NO: 5662676 - DNA, 11 bp, Homo sapiens
acatccagaag

SEQ ID NO: 5662677 - DNA, 18 bp, Homo sapiens
acatccagagatgactat

SEQ ID NO: 5662678 - DNA, 21 bp, Homo sapiens
acatccagagctttgtcgtat

SEQ ID NO: 5662679 - DNA, 18 bp, Homo sapiens
acatccagctcctctagg

SEQ ID NO: 5662680 - DNA, 12 bp, Homo sapiens
acatccagcttg

SEQ ID NO: 5662681 - DNA, 19 bp, Homo sapiens
acatccaggcaatggccta

SEQ ID NO: 5662682 - DNA, 19 bp, Homo sapiens
acatccataaagaagcaat

SEQ ID NO: 5662683 - DNA, 11 bp, Homo sapiens
acatccatgtc

SEQ ID NO: 5662684 - DNA, 20 bp, Homo sapiens
acatccatgtttgtaaaact

SEQ ID NO: 5662685 - DNA, 20 bp, Homo sapiens
acatccattcccaagaaatg

SEQ ID NO: 5662686 - DNA, 21 bp, Homo sapiens
acatccattcccaagaaatgc

SEQ ID NO: 5662687 - DNA, 17 bp, Homo sapiens
acatccattgctggcaa

SEQ ID NO: 5662688 - DNA, 18 bp, Homo sapiens
acatcccaaactttaaaa

SEQ ID NO: 5662689 - DNA, 20 bp, Homo sapiens
acatcccactggatctggct

SEQ ID NO: 5662690 - DNA, 13 bp, Homo sapiens
acatcccagcagc

SEQ ID NO: 5662691 - DNA, 23 bp, Homo sapiens
acatcccagcccaatccaggtac

SEQ ID NO: 5662692 - DNA, 13 bp, Homo sapiens
acatcccagcctg

SEQ ID NO: 5662693 - DNA, 15 bp, Homo sapiens
acatcccaggagggg

SEQ ID NO: 5662694 - DNA, 22 bp, Homo sapiens
acatcccagtagtgtttggaat

SEQ ID NO: 5662695 - DNA, 15 bp, Homo sapiens
acatcccatgttgaa

SEQ ID NO: 5662696 - DNA, 18 bp, Homo sapiens
acatcccattgccctggt

SEQ ID NO: 5662697 - DNA, 13 bp, Homo sapiens
acatccccaaagg

SEQ ID NO: 5662698 - DNA, 16 bp, Homo sapiens
acatccccagaatcca

SEQ ID NO: 5662699 - DNA, 18 bp, Homo sapiens
acatccccagagcccagc

SEQ ID NO: 5662700 - DNA, 18 bp, Homo sapiens
acatccccagccagggag

SEQ ID NO: 5662701 - DNA, 18 bp, Homo sapiens
acatccccccgccaaaag

SEQ ID NO: 5662702 - DNA, 16 bp, Homo sapiens
acatccccgctggctg

SEQ ID NO: 5662703 - DNA, 12 bp, Homo sapiens
acatcccctgct

SEQ ID NO: 5662704 - DNA, 15 bp, Homo sapiens
acatcccggcctctt

SEQ ID NO: 5662705 - DNA, 18 bp, Homo sapiens
acatcccgggacgcagca

SEQ ID NO: 5662706 - DNA, 18 bp, Homo sapiens
acatccctcagtttctta

SEQ ID NO: 5662707 - DNA, 19 bp, Homo sapiens
acatccctcccccagcaga

SEQ ID NO: 5662708 - DNA, 16 bp, Homo sapiens
acatccctctctgctg

SEQ ID NO: 5662709 - DNA, 15 bp, Homo sapiens
acatccctgccagct

SEQ ID NO: 5662710 - DNA, 16 bp, Homo sapiens
acatccctgccagctc

SEQ ID NO: 5662711 - DNA, 12 bp, Homo sapiens
acatccctgggc

SEQ ID NO: 5662712 - DNA, 13 bp, Homo sapiens
acatccctgggcc

SEQ ID NO: 5662713 - DNA, 14 bp, Homo sapiens
acatccctgggcct

SEQ ID NO: 5662714 - DNA, 21 bp, Homo sapiens
acatccctgggcctgctgctg

SEQ ID NO: 5662715 - DNA, 20 bp, Homo sapiens
acatcccttattagttacaa

SEQ ID NO: 5662716 - DNA, 18 bp, Homo sapiens
acatcccttcctggaaac

SEQ ID NO: 5662717 - DNA, 23 bp, Homo sapiens
acatcccttcctggaaacagcat

SEQ ID NO: 5662718 - DNA, 22 bp, Homo sapiens
acatccgcgtgtgcctgtgtgc

SEQ ID NO: 5662719 - DNA, 18 bp, Homo sapiens
acatccggggccagctcc

SEQ ID NO: 5662720 - DNA, 21 bp, Homo sapiens
acatccgtaggacaagtttta

SEQ ID NO: 5662721 - DNA, 21 bp, Homo sapiens
acatccgtcattgctgctgct

SEQ ID NO: 5662722 - DNA, 18 bp, Homo sapiens
acatcctaagacagagga

SEQ ID NO: 5662723 - DNA, 16 bp, Homo sapiens
acatcctaaggttctt

SEQ ID NO: 5662724 - DNA, 18 bp, Homo sapiens
acatcctaatagaaagaa

SEQ ID NO: 5662725 - DNA, 21 bp, Homo sapiens
acatcctaatagaaagaaatt

SEQ ID NO: 5662726 - DNA, 21 bp, Homo sapiens
acatcctagccccacccagag

SEQ ID NO: 5662727 - DNA, 15 bp, Homo sapiens
acatcctattttgta

SEQ ID NO: 5662728 - DNA, 14 bp, Homo sapiens
acatcctcaaaaga

SEQ ID NO: 5662729 - DNA, 12 bp, Homo sapiens
acatcctcagaa

SEQ ID NO: 5662730 - DNA, 11 bp, Homo sapiens
acatcctcctg

SEQ ID NO: 5662731 - DNA, 12 bp, Homo sapiens
acatcctcctgc

SEQ ID NO: 5662732 - DNA, 22 bp, Homo sapiens
acatcctcctgcccagctcctc

SEQ ID NO: 5662733 - DNA, 14 bp, Homo sapiens
acatcctctccagg

SEQ ID NO: 5662734 - DNA, 18 bp, Homo sapiens
acatcctgccagccccac

SEQ ID NO: 5662735 - DNA, 19 bp, Homo sapiens
acatcctgctacactcatc

SEQ ID NO: 5662736 - DNA, 22 bp, Homo sapiens
acatcctgggggagcataccca

SEQ ID NO: 5662737 - DNA, 12 bp, Homo sapiens
acatcctgggta

SEQ ID NO: 5662738 - DNA, 16 bp, Homo sapiens
acatcctgtataagca

SEQ ID NO: 5662739 - DNA, 23 bp, Homo sapiens
acatcctgtcatctgagaatgaa

SEQ ID NO: 5662740 - DNA, 16 bp, Homo sapiens
acatcctgtgggacct

SEQ ID NO: 5662741 - DNA, 15 bp, Homo sapiens
acatccttccttccc

SEQ ID NO: 5662742 - DNA, 22 bp, Homo sapiens
acatccttcttggcttcctggc

SEQ ID NO: 5662743 - DNA, 23 bp, Homo sapiens
acatccttcttggcttcctggcg

SEQ ID NO: 5662744 - DNA, 12 bp, Homo sapiens
acatccttgtgg

SEQ ID NO: 5662745 - DNA, 20 bp, Homo sapiens
acatcctttcttttaatgat

SEQ ID NO: 5662746 - DNA, 15 bp, Homo sapiens
acatcctttttctgc

SEQ ID NO: 5662747 - DNA, 14 bp, Homo sapiens
acatcgaatgtgta

SEQ ID NO: 5662748 - DNA, 16 bp, Homo sapiens
acatcgatatgtatat

SEQ ID NO: 5662749 - DNA, 19 bp, Homo sapiens
acatcgcacactggggccc

SEQ ID NO: 5662750 - DNA, 15 bp, Homo sapiens
acatcggaaaaataa

SEQ ID NO: 5662751 - DNA, 17 bp, Homo sapiens
acatcggttcaggagga

SEQ ID NO: 5662752 - DNA, 18 bp, Homo sapiens
acatcgtaggcagccacg

SEQ ID NO: 5662753 - DNA, 14 bp, Homo sapiens
acatcgtgggtcac

SEQ ID NO: 5662754 - DNA, 22 bp, Homo sapiens
acatcgttcgatttaagccatc

SEQ ID NO: 5662755 - DNA, 20 bp, Homo sapiens
acatctaaattgatcattca

SEQ ID NO: 5662756 - DNA, 21 bp, Homo sapiens
acatctaagcctgaaggggcg

SEQ ID NO: 5662757 - DNA, 17 bp, Homo sapiens
acatctaagtcagtttc

SEQ ID NO: 5662758 - DNA, 22 bp, Homo sapiens
acatctaatgtctcttcctctg

SEQ ID NO: 5662759 - DNA, 14 bp, Homo sapiens
acatctaattaaat

SEQ ID NO: 5662760 - DNA, 16 bp, Homo sapiens
acatctacaaaacatt

SEQ ID NO: 5662761 - DNA, 16 bp, Homo sapiens
acatctacatgccatg

SEQ ID NO: 5662762 - DNA, 18 bp, Homo sapiens
acatctacctaaaggact

SEQ ID NO: 5662763 - DNA, 17 bp, Homo sapiens
acatctacctatactta

SEQ ID NO: 5662764 - DNA, 20 bp, Homo sapiens
acatctacgaagccacaggc

SEQ ID NO: 5662765 - DNA, 20 bp, Homo sapiens
acatctagtagttgttctga

SEQ ID NO: 5662766 - DNA, 17 bp, Homo sapiens
acatctatgtgtatgtt

SEQ ID NO: 5662767 - DNA, 19 bp, Homo sapiens
acatctatgtgtatgttga

SEQ ID NO: 5662768 - DNA, 18 bp, Homo sapiens
acatctcaaatacagtag

SEQ ID NO: 5662769 - DNA, 17 bp, Homo sapiens
acatctcaacaggcctc

SEQ ID NO: 5662770 - DNA, 20 bp, Homo sapiens
acatctcaacaggcctcagg

SEQ ID NO: 5662771 - DNA, 20 bp, Homo sapiens
acatctcaataaagtgcttt

SEQ ID NO: 5662772 - DNA, 13 bp, Homo sapiens
acatctcacctcc

SEQ ID NO: 5662773 - DNA, 12 bp, Homo sapiens
acatctcagacc

SEQ ID NO: 5662774 - DNA, 21 bp, Homo sapiens
acatctcagggaactgaccct

SEQ ID NO: 5662775 - DNA, 20 bp, Homo sapiens
acatctcaggggccagagga

SEQ ID NO: 5662776 - DNA, 19 bp, Homo sapiens
acatctccagaaaaatgaa

SEQ ID NO: 5662777 - DNA, 17 bp, Homo sapiens
acatctccagtgtgcca

SEQ ID NO: 5662778 - DNA, 18 bp, Homo sapiens
acatctccagtgtgccag

SEQ ID NO: 5662779 - DNA, 22 bp, Homo sapiens
acatctccatggggaggcctca

SEQ ID NO: 5662780 - DNA, 22 bp, Homo sapiens
acatctcccccatagcaccctg

SEQ ID NO: 5662781 - DNA, 17 bp, Homo sapiens
acatctccccttcgttt

SEQ ID NO: 5662782 - DNA, 15 bp, Homo sapiens
acatctcctccaata

SEQ ID NO: 5662783 - DNA, 19 bp, Homo sapiens
acatctccttgatcatgtc

SEQ ID NO: 5662784 - DNA, 18 bp, Homo sapiens
acatctctctgccctctc

SEQ ID NO: 5662785 - DNA, 21 bp, Homo sapiens
acatctctctgccctctccct

SEQ ID NO: 5662786 - DNA, 23 bp, Homo sapiens
acatctctctgccctctccctgt

SEQ ID NO: 5662787 - DNA, 15 bp, Homo sapiens
acatctctgaaagca

SEQ ID NO: 5662788 - DNA, 18 bp, Homo sapiens
acatctctgaaagcacag

SEQ ID NO: 5662789 - DNA, 13 bp, Homo sapiens
acatctctggaaa

SEQ ID NO: 5662790 - DNA, 17 bp, Homo sapiens
acatctctggagccaga

SEQ ID NO: 5662791 - DNA, 17 bp, Homo sapiens
acatctctgtcagtgtg

SEQ ID NO: 5662792 - DNA, 12 bp, Homo sapiens
acatctcttcat

SEQ ID NO: 5662793 - DNA, 23 bp, Homo sapiens
acatctcttcctccgaggccagt

SEQ ID NO: 5662794 - DNA, 17 bp, Homo sapiens
acatctctttgaatttt

SEQ ID NO: 5662795 - DNA, 19 bp, Homo sapiens
agcagcagctctgagccag

SEQ ID NO: 5662796 - DNA, 16 bp, Homo sapiens
agcagcagctgaggcc

SEQ ID NO: 5662797 - DNA, 16 bp, Homo sapiens
agcagcaggactgtgg

SEQ ID NO: 5662798 - DNA, 11 bp, Homo sapiens
agcagcaggcc

SEQ ID NO: 5662799 - DNA, 12 bp, Homo sapiens
agcagcaggcct

SEQ ID NO: 5662800 - DNA, 18 bp, Homo sapiens
agcagcaggcctctggtt

SEQ ID NO: 5662801 - DNA, 18 bp, Homo sapiens
agcagcaggtgtggccaa

SEQ ID NO: 5662802 - DNA, 16 bp, Homo sapiens
agcagcagtgaaaaca

SEQ ID NO: 5662803 - DNA, 23 bp, Homo sapiens
agcagcagtgaaaacaagtgctg

SEQ ID NO: 5662804 - DNA, 13 bp, Homo sapiens
agcagcagtgtcc

SEQ ID NO: 5662805 - DNA, 22 bp, Homo sapiens
agcagcagttggatcttttgaa

SEQ ID NO: 5662806 - DNA, 22 bp, Homo sapiens
agcagcatcaacctaggagcag

SEQ ID NO: 5662807 - DNA, 14 bp, Homo sapiens
agcagcatcccagc

SEQ ID NO: 5662808 - DNA, 20 bp, Homo sapiens
agcagcatctctaccttctc

SEQ ID NO: 5662809 - DNA, 15 bp, Homo sapiens
agcagcatggaaaaa

SEQ ID NO: 5662810 - DNA, 17 bp, Homo sapiens
agcagcatggaaaaatg

SEQ ID NO: 5662811 - DNA, 20 bp, Homo sapiens
agcagcatggaaaaatggtt

SEQ ID NO: 5662812 - DNA, 22 bp, Homo sapiens
agcagcatggaaaaatggttga

SEQ ID NO: 5662813 - DNA, 17 bp, Homo sapiens
agcagcattcagcacac

SEQ ID NO: 5662814 - DNA, 13 bp, Homo sapiens
agcagcattttta

SEQ ID NO: 5662815 - DNA, 20 bp, Homo sapiens
agcagccaagctccttggga

SEQ ID NO: 5662816 - DNA, 22 bp, Homo sapiens
agcagccaaggccgccagcgtg

SEQ ID NO: 5662817 - DNA, 19 bp, Homo sapiens
agcagccacacttccttta

SEQ ID NO: 5662818 - DNA, 21 bp, Homo sapiens
agcagccacattcctgatgct

SEQ ID NO: 5662819 - DNA, 23 bp, Homo sapiens
agcagccaccagggagtggccat

SEQ ID NO: 5662820 - DNA, 15 bp, Homo sapiens
agcagccagagctgt

SEQ ID NO: 5662821 - DNA, 10 bp, Homo sapiens
agcagccagc

SEQ ID NO: 5662822 - DNA, 15 bp, Homo sapiens
agcagccagcaccac

SEQ ID NO: 5662823 - DNA, 12 bp, Homo sapiens
agcagccagcca

SEQ ID NO: 5662824 - DNA, 21 bp, Homo sapiens
agcagccagccaaacacacag

SEQ ID NO: 5662825 - DNA, 14 bp, Homo sapiens
agcagccagccagt

SEQ ID NO: 5662826 - DNA, 21 bp, Homo sapiens
agcagccagccagtcttgcct

SEQ ID NO: 5662827 - DNA, 14 bp, Homo sapiens
agcagccagccctg

SEQ ID NO: 5662828 - DNA, 21 bp, Homo sapiens
agcagccagccctgcctggag

SEQ ID NO: 5662829 - DNA, 22 bp, Homo sapiens
agcagccagccctgcctggagg

SEQ ID NO: 5662830 - DNA, 15 bp, Homo sapiens
agcagccagctcctg

SEQ ID NO: 5662831 - DNA, 18 bp, Homo sapiens
agcagccagctcctggta

SEQ ID NO: 5662832 - DNA, 19 bp, Homo sapiens
agcagccagctctcagcca

SEQ ID NO: 5662833 - DNA, 13 bp, Homo sapiens
agcagccaggacc

SEQ ID NO: 5662834 - DNA, 15 bp, Homo sapiens
agcagccaggacccg

SEQ ID NO: 5662835 - DNA, 13 bp, Homo sapiens
agcagccaggagg

SEQ ID NO: 5662836 - DNA, 15 bp, Homo sapiens
agcagccagggaccc

SEQ ID NO: 5662837 - DNA, 22 bp, Homo sapiens
agcagccagggacccccagaac

SEQ ID NO: 5662838 - DNA, 15 bp, Homo sapiens
agcagccagtctcag

SEQ ID NO: 5662839 - DNA, 18 bp, Homo sapiens
agcagccagtctcagaga

SEQ ID NO: 5662840 - DNA, 13 bp, Homo sapiens
agcagcccaaatt

SEQ ID NO: 5662841 - DNA, 23 bp, Homo sapiens
agcagcccagcacatagcttgcc

SEQ ID NO: 5662842 - DNA, 17 bp, Homo sapiens
agcagcccagcttcctg

SEQ ID NO: 5662843 - DNA, 18 bp, Homo sapiens
agcagcccatggcctctg

SEQ ID NO: 5662844 - DNA, 14 bp, Homo sapiens
agcagccccaggag

SEQ ID NO: 5662845 - DNA, 16 bp, Homo sapiens
agcagccccaggagaa

SEQ ID NO: 5662846 - DNA, 15 bp, Homo sapiens
agcagcccccaaaga

SEQ ID NO: 5662847 - DNA, 19 bp, Homo sapiens
agcagcccccaaagagctg

SEQ ID NO: 5662848 - DNA, 21 bp, Homo sapiens
agcagcccccaaagagctgtg

SEQ ID NO: 5662849 - DNA, 14 bp, Homo sapiens
agcagcccccagct

SEQ ID NO: 5662850 - DNA, 17 bp, Homo sapiens
agcagcccccagctccc

SEQ ID NO: 5662851 - DNA, 19 bp, Homo sapiens
agcagcccccagctcccac

SEQ ID NO: 5662852 - DNA, 21 bp, Homo sapiens
agcagccccccttgccccacc

SEQ ID NO: 5662853 - DNA, 16 bp, Homo sapiens
agcagccccctgcccg

SEQ ID NO: 5662854 - DNA, 14 bp, Homo sapiens
agcagccccctgtg

SEQ ID NO: 5662855 - DNA, 15 bp, Homo sapiens
agcagccccgggagg

SEQ ID NO: 5662856 - DNA, 15 bp, Homo sapiens
agcagcccctcgagg

SEQ ID NO: 5662857 - DNA, 20 bp, Homo sapiens
agcagcccctcgaggcctac

SEQ ID NO: 5662858 - DNA, 23 bp, Homo sapiens
agcagcccctctttaacctcatc

SEQ ID NO: 5662859 - DNA, 19 bp, Homo sapiens
agcagcccctgagagcctg

SEQ ID NO: 5662860 - DNA, 16 bp, Homo sapiens
agcagcccggggagga

SEQ ID NO: 5662861 - DNA, 21 bp, Homo sapiens
agcagccctcaacaggcccag

SEQ ID NO: 5662862 - DNA, 22 bp, Homo sapiens
agcagccctcaacaggcccagg

SEQ ID NO: 5662863 - DNA, 20 bp, Homo sapiens
agcagccctcaattgtgaaa

SEQ ID NO: 5662864 - DNA, 14 bp, Homo sapiens
agcagccctcctca

SEQ ID NO: 5662865 - DNA, 16 bp, Homo sapiens
agcagccctcctcacc

SEQ ID NO: 5662866 - DNA, 17 bp, Homo sapiens
agcagccctcctcaccc

SEQ ID NO: 5662867 - DNA, 17 bp, Homo sapiens
agcagccctctgcctcc

SEQ ID NO: 5662868 - DNA, 15 bp, Homo sapiens
agcagcccttacagt

SEQ ID NO: 5662869 - DNA, 16 bp, Homo sapiens
agcagcccttggccag

SEQ ID NO: 5662870 - DNA, 22 bp, Homo sapiens
agcagcccttggccagaagtca

SEQ ID NO: 5662871 - DNA, 14 bp, Homo sapiens
agcagcccttgtgt

SEQ ID NO: 5662872 - DNA, 16 bp, Homo sapiens
agcagcccttgtttat

SEQ ID NO: 5662873 - DNA, 12 bp, Homo sapiens
agcagccgccag

SEQ ID NO: 5662874 - DNA, 19 bp, Homo sapiens
agcagccgccagctgggag

SEQ ID NO: 5662875 - DNA, 15 bp, Homo sapiens
agcagcctcactgca

SEQ ID NO: 5662876 - DNA, 16 bp, Homo sapiens
agcagcctcagagtgg

SEQ ID NO: 5662877 - DNA, 20 bp, Homo sapiens
agcagcctcagagtggtcga

SEQ ID NO: 5662878 - DNA, 15 bp, Homo sapiens
agcagcctccaagaa

SEQ ID NO: 5662879 - DNA, 15 bp, Homo sapiens
agcagcctccactgt

SEQ ID NO: 5662880 - DNA, 14 bp, Homo sapiens
agcagcctcctggg

SEQ ID NO: 5662881 - DNA, 19 bp, Homo sapiens
agcagcctccttatatttg

SEQ ID NO: 5662882 - DNA, 12 bp, Homo sapiens
agcagcctcgag

SEQ ID NO: 5662883 - DNA, 22 bp, Homo sapiens
agagggcccctcactggctgga

SEQ ID NO: 5662884 - DNA, 24 bp, Homo sapiens
agagggcccctcactggctggact

SEQ ID NO: 5662885 - DNA, 23 bp, Homo sapiens
agagggccctggtgtttctagca

SEQ ID NO: 5662886 - DNA, 15 bp, Homo sapiens
agagggccgggcaga

SEQ ID NO: 5662887 - DNA, 16 bp, Homo sapiens
agagggcctctgcctg

SEQ ID NO: 5662888 - DNA, 17 bp, Homo sapiens
agagggcctctgcctgg

SEQ ID NO: 5662889 - DNA, 16 bp, Homo sapiens
agagggcctgtgggag

SEQ ID NO: 5662890 - DNA, 12 bp, Homo sapiens
agagggccttcc

SEQ ID NO: 5662891 - DNA, 23 bp, Homo sapiens
agagggccttcccctcccagccc

SEQ ID NO: 5662892 - DNA, 12 bp, Homo sapiens
agagggccttgc

SEQ ID NO: 5662893 - DNA, 13 bp, Homo sapiens
agagggccttgct

SEQ ID NO: 5662894 - DNA, 16 bp, Homo sapiens
agagggcgccaccacc

SEQ ID NO: 5662895 - DNA, 14 bp, Homo sapiens
agagggcgcccagc

SEQ ID NO: 5662896 - DNA, 15 bp, Homo sapiens
agagggcgcccagcc

SEQ ID NO: 5662897 - DNA, 19 bp, Homo sapiens
agagggcgcccagcccagg

SEQ ID NO: 5662898 - DNA, 14 bp, Homo sapiens
agagggcgctcctg

SEQ ID NO: 5662899 - DNA, 22 bp, Homo sapiens
agagggctagccctgagcccgg

SEQ ID NO: 5662900 - DNA, 23 bp, Homo sapiens
agagggctagccctgagcccggc

SEQ ID NO: 5662901 - DNA, 14 bp, Homo sapiens
agagggctagggag

SEQ ID NO: 5662902 - DNA, 19 bp, Homo sapiens
agagggctctgtgctgaca

SEQ ID NO: 5662903 - DNA, 14 bp, Homo sapiens
agagggctgaaggg

SEQ ID NO: 5662904 - DNA, 19 bp, Homo sapiens
agagggctgaagggagggc

SEQ ID NO: 5662905 - DNA, 15 bp, Homo sapiens
agagggctgagcccc

SEQ ID NO: 5662906 - DNA, 19 bp, Homo sapiens
agagggctgagcccctcct

SEQ ID NO: 5662907 - DNA, 21 bp, Homo sapiens
agagggctgcgagcatttccc

SEQ ID NO: 5662908 - DNA, 17 bp, Homo sapiens
agagggctgtggctggg

SEQ ID NO: 5662909 - DNA, 21 bp, Homo sapiens
agagggctgttggacagctgc

SEQ ID NO: 5662910 - DNA, 12 bp, Homo sapiens
agagggcttcct

SEQ ID NO: 5662911 - DNA, 23 bp, Homo sapiens
agagggctttcagcgcccccagg

SEQ ID NO: 5662912 - DNA, 16 bp, Homo sapiens
agagggctttttaaat

SEQ ID NO: 5662913 - DNA, 23 bp, Homo sapiens
agaggggaaaacaaaaatatctt

SEQ ID NO: 5662914 - DNA, 16 bp, Homo sapiens
agaggggaaaagagat

SEQ ID NO: 5662915 - DNA, 18 bp, Homo sapiens
agaggggaaaagctgaac

SEQ ID NO: 5662916 - DNA, 22 bp, Homo sapiens
agaggggaagagtgtactgggg

SEQ ID NO: 5662917 - DNA, 15 bp, Homo sapiens
agaggggaagggcag

SEQ ID NO: 5662918 - DNA, 16 bp, Homo sapiens
agaggggaagggccag

SEQ ID NO: 5662919 - DNA, 23 bp, Homo sapiens
agaggggaagtctcttcctgcct

SEQ ID NO: 5662920 - DNA, 19 bp, Homo sapiens
agaggggacaagccaggcc

SEQ ID NO: 5662921 - DNA, 16 bp, Homo sapiens
agaggggacatttccc

SEQ ID NO: 5662922 - DNA, 17 bp, Homo sapiens
agaggggacgcaggccc

SEQ ID NO: 5662923 - DNA, 18 bp, Homo sapiens
agaggggactctgggcta

SEQ ID NO: 5662924 - DNA, 14 bp, Homo sapiens
agaggggactgggg

SEQ ID NO: 5662925 - DNA, 23 bp, Homo sapiens
agaggggactgggggactgggag

SEQ ID NO: 5662926 - DNA, 14 bp, Homo sapiens
agaggggagaggaa

SEQ ID NO: 5662927 - DNA, 16 bp, Homo sapiens
agaggggcaaaaatat

SEQ ID NO: 5662928 - DNA, 16 bp, Homo sapiens
agaggggcaccttttc

SEQ ID NO: 5662929 - DNA, 15 bp, Homo sapiens
agaggggcagaacag

SEQ ID NO: 5662930 - DNA, 18 bp, Homo sapiens
agaggggcagcccttgct

SEQ ID NO: 5662931 - DNA, 19 bp, Homo sapiens
agaggggcagcccttgctt

SEQ ID NO: 5662932 - DNA, 23 bp, Homo sapiens
agaggggcagccgctaggagaga

SEQ ID NO: 5662933 - DNA, 16 bp, Homo sapiens
agaggggcaggggagt

SEQ ID NO: 5662934 - DNA, 17 bp, Homo sapiens
agaggggcaggggagtg

SEQ ID NO: 5662935 - DNA, 21 bp, Homo sapiens
agaggggccagcggccctccc

SEQ ID NO: 5662936 - DNA, 23 bp, Homo sapiens
agaggggccagcggccctcccag

SEQ ID NO: 5662937 - DNA, 16 bp, Homo sapiens
agaggggccaggccca

SEQ ID NO: 5662938 - DNA, 15 bp, Homo sapiens
agaggggcctcatct

SEQ ID NO: 5662939 - DNA, 21 bp, Homo sapiens
agaggggcctgatgagactcc

SEQ ID NO: 5662940 - DNA, 13 bp, Homo sapiens
agaggggcctgca

SEQ ID NO: 5662941 - DNA, 15 bp, Homo sapiens
agaggggcgctgtcc

SEQ ID NO: 5662942 - DNA, 21 bp, Homo sapiens
agaggggcgctgtcctgcgtt

SEQ ID NO: 5662943 - DNA, 13 bp, Homo sapiens
agaggggcgggct

SEQ ID NO: 5662944 - DNA, 15 bp, Homo sapiens
agaggggcgggctca

SEQ ID NO: 5662945 - DNA, 19 bp, Homo sapiens
agaggggcgggctcagagc

SEQ ID NO: 5662946 - DNA, 18 bp, Homo sapiens
agaggggcggggccagga

SEQ ID NO: 5662947 - DNA, 22 bp, Homo sapiens
agaggggcgttctcccaaagat

SEQ ID NO: 5662948 - DNA, 19 bp, Homo sapiens
agaggggctattgggccct

SEQ ID NO: 5662949 - DNA, 13 bp, Homo sapiens
agaggggctgtcc

SEQ ID NO: 5662950 - DNA, 18 bp, Homo sapiens
agaggggctttctggaga

SEQ ID NO: 5662951 - DNA, 17 bp, Homo sapiens
agagggggaggggaagc

SEQ ID NO: 5662952 - DNA, 23 bp, Homo sapiens
agagggggaggggtggtacttgg

SEQ ID NO: 5662953 - DNA, 14 bp, Homo sapiens
agagggggaggttg

SEQ ID NO: 5662954 - DNA, 19 bp, Homo sapiens
agagggggcactgtggtca

SEQ ID NO: 5662955 - DNA, 21 bp, Homo sapiens
agagggggcactgtggtcagg

SEQ ID NO: 5662956 - DNA, 23 bp, Homo sapiens
agagggggcactgtggtcaggcc

SEQ ID NO: 5662957 - DNA, 13 bp, Homo sapiens
agagggggctctg

SEQ ID NO: 5662958 - DNA, 16 bp, Homo sapiens
agagggggctggccat

SEQ ID NO: 5662959 - DNA, 22 bp, Homo sapiens
agagggggtaatggaggccaag

SEQ ID NO: 5662960 - DNA, 12 bp, Homo sapiens
agagggggtgga

SEQ ID NO: 5662961 - DNA, 19 bp, Homo sapiens
agagggggtggaggggtgt

SEQ ID NO: 5662962 - DNA, 19 bp, Homo sapiens
agaggggtacatttccctg

SEQ ID NO: 5662963 - DNA, 20 bp, Homo sapiens
agaggggtacatttccctgt

SEQ ID NO: 5662964 - DNA, 15 bp, Homo sapiens
agaggggtgcaccca

SEQ ID NO: 5662965 - DNA, 13 bp, Homo sapiens
agaggggtgcaga

SEQ ID NO: 5662966 - DNA, 19 bp, Homo sapiens
agaggggtggagactgctt

SEQ ID NO: 5662967 - DNA, 17 bp, Homo sapiens
agagggtagacaggggc

SEQ ID NO: 5662968 - DNA, 15 bp, Homo sapiens
agagggtcacagtgt

SEQ ID NO: 5662969 - DNA, 16 bp, Homo sapiens
agagggtcactggggg

SEQ ID NO: 5662970 - DNA, 16 bp, Homo sapiens
agagggtcccattgtg

SEQ ID NO: 5662971 - DNA, 20 bp, Homo sapiens
agagggtctgaggaatccag

SEQ ID NO: 5662972 - DNA, 22 bp, Homo sapiens
agagggtgacaagatagagagc

SEQ ID NO: 5662973 - DNA, 19 bp, Homo sapiens
agagtagtaagacgtgaaa

SEQ ID NO: 5662974 - DNA, 15 bp, Homo sapiens
agagtagtcagaact

SEQ ID NO: 5662975 - DNA, 23 bp, Homo sapiens
agagtagttatataattgttgaa

SEQ ID NO: 5662976 - DNA, 14 bp, Homo sapiens
agagtagtttttca

SEQ ID NO: 5662977 - DNA, 14 bp, Homo sapiens
agagtataaataac

SEQ ID NO: 5662978 - DNA, 15 bp, Homo sapiens
agagtataattttgg

SEQ ID NO: 5662979 - DNA, 15 bp, Homo sapiens
agagtataggatgga

SEQ ID NO: 5662980 - DNA, 23 bp, Homo sapiens
agagtataggatggattgcagtc

SEQ ID NO: 5662981 - DNA, 13 bp, Homo sapiens
agagtatatatgt

SEQ ID NO: 5662982 - DNA, 20 bp, Homo sapiens
agagtatatatgtacagtta

SEQ ID NO: 5662983 - DNA, 23 bp, Homo sapiens
agagtatatttaagaagccaagg

SEQ ID NO: 5662984 - DNA, 23 bp, Homo sapiens
agagtatatttttgtctgcagct

SEQ ID NO: 5662985 - DNA, 22 bp, Homo sapiens
agagtatcaaaggcagaaagga

SEQ ID NO: 5662986 - DNA, 15 bp, Homo sapiens
agagtatctaatcct

SEQ ID NO: 5662987 - DNA, 12 bp, Homo sapiens
agagtatcttta

SEQ ID NO: 5662988 - DNA, 14 bp, Homo sapiens
agagtatgagaaat

SEQ ID NO: 5662989 - DNA, 13 bp, Homo sapiens
agagtatggagct

SEQ ID NO: 5662990 - DNA, 18 bp, Homo sapiens
agagtatggtgctgggtc

SEQ ID NO: 5662991 - DNA, 22 bp, Homo sapiens
agagtatgtgccaggaaactct

SEQ ID NO: 5662992 - DNA, 13 bp, Homo sapiens
agagtatgtgtat

SEQ ID NO: 5662993 - DNA, 13 bp, Homo sapiens
agagtatgttctt

SEQ ID NO: 5662994 - DNA, 19 bp, Homo sapiens
agagtattctaaaaaaata

SEQ ID NO: 5662995 - DNA, 11 bp, Homo sapiens
agagtatttct

SEQ ID NO: 5662996 - DNA, 21 bp, Homo sapiens
agagtattttaagaagacata

SEQ ID NO: 5662997 - DNA, 13 bp, Homo sapiens
agagtcaaagctg

SEQ ID NO: 5662998 - DNA, 21 bp, Homo sapiens
agagtcaactacacaaagcag

SEQ ID NO: 5662999 - DNA, 15 bp, Homo sapiens
agagtcaaggcctgc

SEQ ID NO: 5663000 - DNA, 23 bp, Homo sapiens
agagtcaatgtcattacatagaa

SEQ ID NO: 5663001 - DNA, 19 bp, Homo sapiens
agagtcacagctttcccag

SEQ ID NO: 5663002 - DNA, 22 bp, Homo sapiens
agagtcacagttccctttattt

SEQ ID NO: 5663003 - DNA, 21 bp, Homo sapiens
agagtcactgaccctggagcg

SEQ ID NO: 5663004 - DNA, 22 bp, Homo sapiens
agagtcagaactaactttggtc

SEQ ID NO: 5663005 - DNA, 13 bp, Homo sapiens
agagtcagaggag

SEQ ID NO: 5663006 - DNA, 14 bp, Homo sapiens
agagtcagatcttt

SEQ ID NO: 5663007 - DNA, 14 bp, Homo sapiens
agagtcagccagga

SEQ ID NO: 5663008 - DNA, 20 bp, Homo sapiens
agagtcagccattcctgttc

SEQ ID NO: 5663009 - DNA, 21 bp, Homo sapiens
agagtcagccccgacttcctg

SEQ ID NO: 5663010 - DNA, 15 bp, Homo sapiens
agagtcagctctctg

SEQ ID NO: 5663011 - DNA, 16 bp, Homo sapiens
agagtcagctctctgc

SEQ ID NO: 5663012 - DNA, 21 bp, Homo sapiens
agagtcagctctctgccctgt

SEQ ID NO: 5663013 - DNA, 13 bp, Homo sapiens
agagtcaggcagg

SEQ ID NO: 5663014 - DNA, 17 bp, Homo sapiens
agagtcatattttgatt

SEQ ID NO: 5663015 - DNA, 18 bp, Homo sapiens
agagtcatattttgatta

SEQ ID NO: 5663016 - DNA, 19 bp, Homo sapiens
agagtcatctccatcagct

SEQ ID NO: 5663017 - DNA, 12 bp, Homo sapiens
agagtcatgtga

SEQ ID NO: 5663018 - DNA, 14 bp, Homo sapiens
agagtcattgtaat

SEQ ID NO: 5663019 - DNA, 15 bp, Homo sapiens
agagtcattgttaca

SEQ ID NO: 5663020 - DNA, 21 bp, Homo sapiens
agagtccaactcacttccagt

SEQ ID NO: 5663021 - DNA, 16 bp, Homo sapiens
agagtccactgtggca

SEQ ID NO: 5663022 - DNA, 18 bp, Homo sapiens
agagtccactgtggcact

SEQ ID NO: 5663023 - DNA, 12 bp, Homo sapiens
agagtccaggaa

SEQ ID NO: 5663024 - DNA, 16 bp, Homo sapiens
agagtccaggccccaa

SEQ ID NO: 5663025 - DNA, 14 bp, Homo sapiens
agagtccaggcctg

SEQ ID NO: 5663026 - DNA, 16 bp, Homo sapiens
agagtccagtgctctg

SEQ ID NO: 5663027 - DNA, 19 bp, Homo sapiens
agagtccagtgctctgcct

SEQ ID NO: 5663028 - DNA, 23 bp, Homo sapiens
agagtccagtgctctgcctcaga

SEQ ID NO: 5663029 - DNA, 23 bp, Homo sapiens
agagtccatcagcctccatccta

SEQ ID NO: 5663030 - DNA, 24 bp, Homo sapiens
agagtccatgtggactgtgccatc

SEQ ID NO: 5663031 - DNA, 22 bp, Homo sapiens
agagtccatttcccacatcttt

SEQ ID NO: 5663032 - DNA, 22 bp, Homo sapiens
agagtcccactgcctcaggttc

SEQ ID NO: 5663033 - DNA, 20 bp, Homo sapiens
agagtcccaggttggctctg

SEQ ID NO: 5663034 - DNA, 18 bp, Homo sapiens
agagtccccagactctgc

SEQ ID NO: 5663035 - DNA, 21 bp, Homo sapiens
agagtccccagactctgccta

SEQ ID NO: 5663036 - DNA, 14 bp, Homo sapiens
agagtccccccact

SEQ ID NO: 5663037 - DNA, 14 bp, Homo sapiens
agagtccgccagtg

SEQ ID NO: 5663038 - DNA, 20 bp, Homo sapiens
agagtccgtaggtttatcag

SEQ ID NO: 5663039 - DNA, 12 bp, Homo sapiens
agagtcctattt

SEQ ID NO: 5663040 - DNA, 14 bp, Homo sapiens
agagtcctcactcc

SEQ ID NO: 5663041 - DNA, 16 bp, Homo sapiens
agagtcctccttccca

SEQ ID NO: 5663042 - DNA, 14 bp, Homo sapiens
agagtcctctgaat

SEQ ID NO: 5663043 - DNA, 14 bp, Homo sapiens
agagtcctctggat

SEQ ID NO: 5663044 - DNA, 14 bp, Homo sapiens
agagtcctgcacag

SEQ ID NO: 5663045 - DNA, 13 bp, Homo sapiens
agagtcctgcctt

SEQ ID NO: 5663046 - DNA, 12 bp, Homo sapiens
agagtcctggcc

SEQ ID NO: 5663047 - DNA, 13 bp, Homo sapiens
agagtcctgggag

SEQ ID NO: 5663048 - DNA, 14 bp, Homo sapiens
agagtcctgggagc

SEQ ID NO: 5663049 - DNA, 17 bp, Homo sapiens
agagtccttagcctggg

SEQ ID NO: 5663050 - DNA, 17 bp, Homo sapiens
agagtccttattcttct

SEQ ID NO: 5663051 - DNA, 22 bp, Homo sapiens
agagtccttttagcacatcact

SEQ ID NO: 5663052 - DNA, 21 bp, Homo sapiens
agagtcgagtgatatggcttg

SEQ ID NO: 5663053 - DNA, 15 bp, Homo sapiens
agagtcgctgtgcca

SEQ ID NO: 5663054 - DNA, 19 bp, Homo sapiens
agagtcgttggagactgaa

SEQ ID NO: 5663055 - DNA, 13 bp, Homo sapiens
agagtctagattc

SEQ ID NO: 5663056 - DNA, 22 bp, Homo sapiens
agagtctagattcaaaggttct

SEQ ID NO: 5663057 - DNA, 23 bp, Homo sapiens
agagtctagattcaaaggttcta

SEQ ID NO: 5663058 - DNA, 14 bp, Homo sapiens
agagtctagattct

SEQ ID NO: 5663059 - DNA, 16 bp, Homo sapiens
agagtctatcaacatt

SEQ ID NO: 5663060 - DNA, 13 bp, Homo sapiens
agagtctcccagg

SEQ ID NO: 5663061 - DNA, 17 bp, Homo sapiens
agagtctccttctcttc

SEQ ID NO: 5663062 - DNA, 13 bp, Homo sapiens
agagtctctccag

SEQ ID NO: 5663063 - DNA, 19 bp, Homo sapiens
agagtctctccagcctcac

SEQ ID NO: 5663064 - DNA, 15 bp, Homo sapiens
agcaggcacaggaca

SEQ ID NO: 5663065 - DNA, 16 bp, Homo sapiens
agcaggcaccgccacg

SEQ ID NO: 5663066 - DNA, 20 bp, Homo sapiens
agcaggcacggcccgcagcc

SEQ ID NO: 5663067 - DNA, 19 bp, Homo sapiens
agcaggcacgggtggtccc

SEQ ID NO: 5663068 - DNA, 20 bp, Homo sapiens
agcaggcacttgattccttg

SEQ ID NO: 5663069 - DNA, 12 bp, Homo sapiens
agcaggcagagc

SEQ ID NO: 5663070 - DNA, 20 bp, Homo sapiens
agcaggcagagcggggaggt

SEQ ID NO: 5663071 - DNA, 15 bp, Homo sapiens
agcaggcagaggaga

SEQ ID NO: 5663072 - DNA, 21 bp, Homo sapiens
agcaggcagataagttggagc

SEQ ID NO: 5663073 - DNA, 11 bp, Homo sapiens
agcaggcagcc

SEQ ID NO: 5663074 - DNA, 14 bp, Homo sapiens
agcaggcagccagc

SEQ ID NO: 5663075 - DNA, 16 bp, Homo sapiens
agcaggcagccagcat

SEQ ID NO: 5663076 - DNA, 14 bp, Homo sapiens
agcaggcagcgcca

SEQ ID NO: 5663077 - DNA, 11 bp, Homo sapiens
agcaggcagga

SEQ ID NO: 5663078 - DNA, 12 bp, Homo sapiens
agcaggcaggca

SEQ ID NO: 5663079 - DNA, 20 bp, Homo sapiens
agcaggcaggcagcctgaga

SEQ ID NO: 5663080 - DNA, 13 bp, Homo sapiens
agcaggcaggggc

SEQ ID NO: 5663081 - DNA, 21 bp, Homo sapiens
agcaggcaggggcatctgtct

SEQ ID NO: 5663082 - DNA, 19 bp, Homo sapiens
agcaggcaggggcttggct

SEQ ID NO: 5663083 - DNA, 20 bp, Homo sapiens
agcaggcaggggcttggctg

SEQ ID NO: 5663084 - DNA, 23 bp, Homo sapiens
agcaggcaggtggactgactgtg

SEQ ID NO: 5663085 - DNA, 20 bp, Homo sapiens
agcaggcatggcttcccctt

SEQ ID NO: 5663086 - DNA, 19 bp, Homo sapiens
agcaggccaaacatggcca

SEQ ID NO: 5663087 - DNA, 22 bp, Homo sapiens
agcaggccaaggtctgagccac

SEQ ID NO: 5663088 - DNA, 15 bp, Homo sapiens
agcaggccagcccgg

SEQ ID NO: 5663089 - DNA, 17 bp, Homo sapiens
agcaggccagcccggac

SEQ ID NO: 5663090 - DNA, 18 bp, Homo sapiens
agcaggcccaatgctgct

SEQ ID NO: 5663091 - DNA, 19 bp, Homo sapiens
agcaggcccaatgctgctt

SEQ ID NO: 5663092 - DNA, 21 bp, Homo sapiens
agcaggcccaatgctgctttt

SEQ ID NO: 5663093 - DNA, 14 bp, Homo sapiens
agcaggcccaccta

SEQ ID NO: 5663094 - DNA, 12 bp, Homo sapiens
agcaggcccagc

SEQ ID NO: 5663095 - DNA, 14 bp, Homo sapiens
agcaggcccagcat

SEQ ID NO: 5663096 - DNA, 16 bp, Homo sapiens
agcaggcccagcatgc

SEQ ID NO: 5663097 - DNA, 14 bp, Homo sapiens
agcaggcccaggag

SEQ ID NO: 5663098 - DNA, 18 bp, Homo sapiens
agcaggcccgacagagag

SEQ ID NO: 5663099 - DNA, 15 bp, Homo sapiens
agcaggccctgggcc

SEQ ID NO: 5663100 - DNA, 20 bp, Homo sapiens
agcaggccctgggcctccac

SEQ ID NO: 5663101 - DNA, 22 bp, Homo sapiens
agcaggccctgggcctccacct

SEQ ID NO: 5663102 - DNA, 20 bp, Homo sapiens
agcaggccggaaccacaggg

SEQ ID NO: 5663103 - DNA, 21 bp, Homo sapiens
agcaggccggaaccacagggc

SEQ ID NO: 5663104 - DNA, 20 bp, Homo sapiens
agcaggcctctgggacccac

SEQ ID NO: 5663105 - DNA, 21 bp, Homo sapiens
agcaggcctctgggacccaca

SEQ ID NO: 5663106 - DNA, 15 bp, Homo sapiens
agcaggcctctggtt

SEQ ID NO: 5663107 - DNA, 20 bp, Homo sapiens
agcaggcctctggttgcctc

SEQ ID NO: 5663108 - DNA, 15 bp, Homo sapiens
agcaggcctgttgct

SEQ ID NO: 5663109 - DNA, 21 bp, Homo sapiens
agcaggccttagtacggctgc

SEQ ID NO: 5663110 - DNA, 17 bp, Homo sapiens
agcaggcgctgtgctat

SEQ ID NO: 5663111 - DNA, 14 bp, Homo sapiens
agcaggcgggctcc

SEQ ID NO: 5663112 - DNA, 20 bp, Homo sapiens
agcaggctactgtcagctcc

SEQ ID NO: 5663113 - DNA, 17 bp, Homo sapiens
agcaggctcctggctgt

SEQ ID NO: 5663114 - DNA, 21 bp, Homo sapiens
agcaggctcctggctgtgccc

SEQ ID NO: 5663115 - DNA, 23 bp, Homo sapiens
agcaggctcctggctgtgcccag

SEQ ID NO: 5663116 - DNA, 15 bp, Homo sapiens
agcaggctctcaggc

SEQ ID NO: 5663117 - DNA, 22 bp, Homo sapiens
agcaggctctcaggccagctgc

SEQ ID NO: 5663118 - DNA, 17 bp, Homo sapiens
agcaggctgccagtgcc

SEQ ID NO: 5663119 - DNA, 13 bp, Homo sapiens
agcaggctggcag

SEQ ID NO: 5663120 - DNA, 16 bp, Homo sapiens
agcaggctggcagctc

SEQ ID NO: 5663121 - DNA, 22 bp, Homo sapiens
agcaggctggcagctctccagt

SEQ ID NO: 5663122 - DNA, 13 bp, Homo sapiens
agcaggctgttcc

SEQ ID NO: 5663123 - DNA, 15 bp, Homo sapiens
agcaggcttgtggca

SEQ ID NO: 5663124 - DNA, 17 bp, Homo sapiens
agcaggcttgtggcagc

SEQ ID NO: 5663125 - DNA, 21 bp, Homo sapiens
agcaggcttgtggcagcctga

SEQ ID NO: 5663126 - DNA, 18 bp, Homo sapiens
agcaggctttgtgagaga

SEQ ID NO: 5663127 - DNA, 23 bp, Homo sapiens
agcaggctttgtgagagaggacc

SEQ ID NO: 5663128 - DNA, 24 bp, Homo sapiens
agcaggctttgtgagagaggacct

SEQ ID NO: 5663129 - DNA, 14 bp, Homo sapiens
agcagggaaacagc

SEQ ID NO: 5663130 - DNA, 16 bp, Homo sapiens
agcagggaaagctcca

SEQ ID NO: 5663131 - DNA, 17 bp, Homo sapiens
agcagggaaagctccac

SEQ ID NO: 5663132 - DNA, 21 bp, Homo sapiens
agcagggaaagctccacggtg

SEQ ID NO: 5663133 - DNA, 24 bp, Homo sapiens
agcagggaagctcttttctcctgc

SEQ ID NO: 5663134 - DNA, 12 bp, Homo sapiens
agcagggaaggc

SEQ ID NO: 5663135 - DNA, 14 bp, Homo sapiens
agcagggaaggcct

SEQ ID NO: 5663136 - DNA, 17 bp, Homo sapiens
agcagggaaggcctgac

SEQ ID NO: 5663137 - DNA, 15 bp, Homo sapiens
agcagggacaggaga

SEQ ID NO: 5663138 - DNA, 22 bp, Homo sapiens
agcagggaccgggcgcagccct

SEQ ID NO: 5663139 - DNA, 21 bp, Homo sapiens
agcagggagaccatgcctccc

SEQ ID NO: 5663140 - DNA, 21 bp, Homo sapiens
agcagggagagctcaccatgg

SEQ ID NO: 5663141 - DNA, 24 bp, Homo sapiens
agcagggatgccctggaggtggct

SEQ ID NO: 5663142 - DNA, 23 bp, Homo sapiens
agcagggcactctgttcccctcc

SEQ ID NO: 5663143 - DNA, 19 bp, Homo sapiens
agcagggcaggaaggggaa

SEQ ID NO: 5663144 - DNA, 22 bp, Homo sapiens
agcagggccggggaactggcca

SEQ ID NO: 5663145 - DNA, 20 bp, Homo sapiens
agcagggccttctgcctgct

SEQ ID NO: 5663146 - DNA, 21 bp, Homo sapiens
agcagggccttctgcctgctg

SEQ ID NO: 5663147 - DNA, 23 bp, Homo sapiens
agcagggctaaataaagaggaga

SEQ ID NO: 5663148 - DNA, 22 bp, Homo sapiens
agcagggctcagcggggacagc

SEQ ID NO: 5663149 - DNA, 16 bp, Homo sapiens
agcagggctgggcctg

SEQ ID NO: 5663150 - DNA, 23 bp, Homo sapiens
agtgcttttaagtgaaaatggtc

SEQ ID NO: 5663151 - DNA, 18 bp, Homo sapiens
agtgcttttcactacttt

SEQ ID NO: 5663152 - DNA, 18 bp, Homo sapiens
agtgcttttggcggggag

SEQ ID NO: 5663153 - DNA, 15 bp, Homo sapiens
agtgctttttccttt

SEQ ID NO: 5663154 - DNA, 19 bp, Homo sapiens
agtggaaaaaagagaaaaa

SEQ ID NO: 5663155 - DNA, 11 bp, Homo sapiens
agtggaaaaag

SEQ ID NO: 5663156 - DNA, 11 bp, Homo sapiens
agtggaaaaat

SEQ ID NO: 5663157 - DNA, 20 bp, Homo sapiens
agtggaaaaatcagaagcac

SEQ ID NO: 5663158 - DNA, 21 bp, Homo sapiens
agtggaaaataggctttttaa

SEQ ID NO: 5663159 - DNA, 20 bp, Homo sapiens
agtggaaactatgtgttttt

SEQ ID NO: 5663160 - DNA, 16 bp, Homo sapiens
agtggaaactcagccg

SEQ ID NO: 5663161 - DNA, 19 bp, Homo sapiens
agtggaaagattgtgtctg

SEQ ID NO: 5663162 - DNA, 20 bp, Homo sapiens
agtggaaagattgtgtctgg

SEQ ID NO: 5663163 - DNA, 16 bp, Homo sapiens
agtggaaagtgatttg

SEQ ID NO: 5663164 - DNA, 19 bp, Homo sapiens
agtggaaatcgcttatatg

SEQ ID NO: 5663165 - DNA, 22 bp, Homo sapiens
agtggaaattcaggtgaaaatg

SEQ ID NO: 5663166 - DNA, 17 bp, Homo sapiens
agtggaacacaaatgaa

SEQ ID NO: 5663167 - DNA, 23 bp, Homo sapiens
agtggaacagtcacccttctggg

SEQ ID NO: 5663168 - DNA, 22 bp, Homo sapiens
agtggaaccgttgccaaccgag

SEQ ID NO: 5663169 - DNA, 21 bp, Homo sapiens
agtggaacctcctatatcatt

SEQ ID NO: 5663170 - DNA, 16 bp, Homo sapiens
agtggaacgaaaatga

SEQ ID NO: 5663171 - DNA, 24 bp, Homo sapiens
agtggaacgaaaatgaaagctact

SEQ ID NO: 5663172 - DNA, 19 bp, Homo sapiens
agtggaacgttctctacct

SEQ ID NO: 5663173 - DNA, 17 bp, Homo sapiens
agtggaagaagagggag

SEQ ID NO: 5663174 - DNA, 13 bp, Homo sapiens
agtggaagacaga

SEQ ID NO: 5663175 - DNA, 13 bp, Homo sapiens
agtggaagagcag

SEQ ID NO: 5663176 - DNA, 21 bp, Homo sapiens
agtggaagagctgctgtattt

SEQ ID NO: 5663177 - DNA, 17 bp, Homo sapiens
agtggaagaggtagtaa

SEQ ID NO: 5663178 - DNA, 15 bp, Homo sapiens
agtggaaggaaagat

SEQ ID NO: 5663179 - DNA, 16 bp, Homo sapiens
agtggaaggaagaaca

SEQ ID NO: 5663180 - DNA, 16 bp, Homo sapiens
agtggaaggactgtgg

SEQ ID NO: 5663181 - DNA, 21 bp, Homo sapiens
agtggaaggataatgagatgt

SEQ ID NO: 5663182 - DNA, 19 bp, Homo sapiens
agtggaaggcattgtcctg

SEQ ID NO: 5663183 - DNA, 13 bp, Homo sapiens
agtggaagggagg

SEQ ID NO: 5663184 - DNA, 21 bp, Homo sapiens
agtggaagtgcttgatatgta

SEQ ID NO: 5663185 - DNA, 19 bp, Homo sapiens
agtggaagttcttcaagag

SEQ ID NO: 5663186 - DNA, 22 bp, Homo sapiens
agtggaagttcttcaagaggaa

SEQ ID NO: 5663187 - DNA, 23 bp, Homo sapiens
agtggaagttcttcaagaggaaa

SEQ ID NO: 5663188 - DNA, 14 bp, Homo sapiens
agtggaataagaca

SEQ ID NO: 5663189 - DNA, 20 bp, Homo sapiens
agtggaatagtatcctccag

SEQ ID NO: 5663190 - DNA, 16 bp, Homo sapiens
agtggaatccagtgtg

SEQ ID NO: 5663191 - DNA, 17 bp, Homo sapiens
agtggaatccagtgtgg

SEQ ID NO: 5663192 - DNA, 18 bp, Homo sapiens
agtggaatccagtgtggc

SEQ ID NO: 5663193 - DNA, 16 bp, Homo sapiens
agtggaatgcagggaa

SEQ ID NO: 5663194 - DNA, 20 bp, Homo sapiens
agtggaatgcagggaagagg

SEQ ID NO: 5663195 - DNA, 18 bp, Homo sapiens
agtggaattagagggcct

SEQ ID NO: 5663196 - DNA, 22 bp, Homo sapiens
agtggaattagagggccttgct

SEQ ID NO: 5663197 - DNA, 20 bp, Homo sapiens
agtggacaccaggagtccct

SEQ ID NO: 5663198 - DNA, 21 bp, Homo sapiens
agtggacaccgctcagtatta

SEQ ID NO: 5663199 - DNA, 23 bp, Homo sapiens
agtggacagagggagaagggaga

SEQ ID NO: 5663200 - DNA, 13 bp, Homo sapiens
agtggacagcagc

SEQ ID NO: 5663201 - DNA, 17 bp, Homo sapiens
agtggacagtctggcca

SEQ ID NO: 5663202 - DNA, 14 bp, Homo sapiens
agtggacatggtca

SEQ ID NO: 5663203 - DNA, 20 bp, Homo sapiens
agtggacattgttggcagca

SEQ ID NO: 5663204 - DNA, 15 bp, Homo sapiens
agtggaccaggacag

SEQ ID NO: 5663205 - DNA, 19 bp, Homo sapiens
agtggaccaggacaggacc

SEQ ID NO: 5663206 - DNA, 20 bp, Homo sapiens
agtggaccaggacaggacca

SEQ ID NO: 5663207 - DNA, 14 bp, Homo sapiens
agtggacccagctg

SEQ ID NO: 5663208 - DNA, 21 bp, Homo sapiens
agtggacccgcccgcggccct

SEQ ID NO: 5663209 - DNA, 18 bp, Homo sapiens
agtggaccctgaaatgtg

SEQ ID NO: 5663210 - DNA, 19 bp, Homo sapiens
agtggaccttaggccttcc

SEQ ID NO: 5663211 - DNA, 15 bp, Homo sapiens
agtggacgctgtcca

SEQ ID NO: 5663212 - DNA, 17 bp, Homo sapiens
agtggacggaggtcccc

SEQ ID NO: 5663213 - DNA, 16 bp, Homo sapiens
agtggactcagggcag

SEQ ID NO: 5663214 - DNA, 23 bp, Homo sapiens
agtggactctctgacaaagtggg

SEQ ID NO: 5663215 - DNA, 16 bp, Homo sapiens
agtggactcttccctc

SEQ ID NO: 5663216 - DNA, 15 bp, Homo sapiens
agtggactgcattta

SEQ ID NO: 5663217 - DNA, 20 bp, Homo sapiens
agtggactggaggagctggg

SEQ ID NO: 5663218 - DNA, 19 bp, Homo sapiens
agtggactggagtggagca

SEQ ID NO: 5663219 - DNA, 15 bp, Homo sapiens
agtggactggcccct

SEQ ID NO: 5663220 - DNA, 13 bp, Homo sapiens
agtggactgtatt

SEQ ID NO: 5663221 - DNA, 16 bp, Homo sapiens
agtggactgtatttcg

SEQ ID NO: 5663222 - DNA, 14 bp, Homo sapiens
agtggactgtgtcc

SEQ ID NO: 5663223 - DNA, 21 bp, Homo sapiens
agtggactgttccctgaggtg

SEQ ID NO: 5663224 - DNA, 14 bp, Homo sapiens
agtggacttctgaa

SEQ ID NO: 5663225 - DNA, 15 bp, Homo sapiens
agtggacttctgaaa

SEQ ID NO: 5663226 - DNA, 22 bp, Homo sapiens
agtggacttctgaaaaatgaat

SEQ ID NO: 5663227 - DNA, 18 bp, Homo sapiens
agtggactttccaccccc

SEQ ID NO: 5663228 - DNA, 14 bp, Homo sapiens
agtggagaaatatt

SEQ ID NO: 5663229 - DNA, 12 bp, Homo sapiens
agtggagacagt

SEQ ID NO: 5663230 - DNA, 17 bp, Homo sapiens
agtggagagaagctctt

SEQ ID NO: 5663231 - DNA, 14 bp, Homo sapiens
agtggagagagcag

SEQ ID NO: 5663232 - DNA, 16 bp, Homo sapiens
agtggagagatgtttg

SEQ ID NO: 5663233 - DNA, 12 bp, Homo sapiens
agtggagaggga

SEQ ID NO: 5663234 - DNA, 18 bp, Homo sapiens
agtggagatcccacatat

SEQ ID NO: 5663235 - DNA, 19 bp, Homo sapiens
agtggagatcccacatatt

SEQ ID NO: 5663236 - DNA, 12 bp, Homo sapiens
agtggagcccag

SEQ ID NO: 5663237 - DNA, 13 bp, Homo sapiens
agtggagcccagg

SEQ ID NO: 5663238 - DNA, 20 bp, Homo sapiens
agtggagcccagggtgctgg

SEQ ID NO: 5663239 - DNA, 20 bp, Homo sapiens
agtggagcctgacagccaga

SEQ ID NO: 5663240 - DNA, 16 bp, Homo sapiens
agtggagcctgccgcc

SEQ ID NO: 5663241 - DNA, 12 bp, Homo sapiens
agtggagctggg

SEQ ID NO: 5663242 - DNA, 17 bp, Homo sapiens
agtggagctggtctgcc

SEQ ID NO: 5663243 - DNA, 22 bp, Homo sapiens
agtggagctgtctgtctctaat

SEQ ID NO: 5663244 - DNA, 22 bp, Homo sapiens
agtggaggaggaggaggagcct

SEQ ID NO: 5663245 - DNA, 19 bp, Homo sapiens
agtggaggagggggtacag

SEQ ID NO: 5663246 - DNA, 20 bp, Homo sapiens
agtggaggaggtggcttcat

SEQ ID NO: 5663247 - DNA, 15 bp, Homo sapiens
agtggaggctgctgt

SEQ ID NO: 5663248 - DNA, 17 bp, Homo sapiens
agtggaggctgctgtga

SEQ ID NO: 5663249 - DNA, 16 bp, Homo sapiens
agtggagggagactga

SEQ ID NO: 5663250 - DNA, 18 bp, Homo sapiens
agtggaggggtcagcagg

SEQ ID NO: 5663251 - DNA, 19 bp, Homo sapiens
agtggagggttgagatgta

SEQ ID NO: 5663252 - DNA, 22 bp, Homo sapiens
agtggagggttgagatgtagag

SEQ ID NO: 5663253 - DNA, 22 bp, Homo sapiens
agtggaggttaaggctgaggaa

SEQ ID NO: 5663254 - DNA, 15 bp, Homo sapiens
agtggagtatttgga

SEQ ID NO: 5663255 - DNA, 17 bp, Homo sapiens
agtggagttataggatt

SEQ ID NO: 5663256 - DNA, 17 bp, Homo sapiens
agtggatattttcttaa

SEQ ID NO: 5663257 - DNA, 18 bp, Homo sapiens
agtggatattttcttaaa

SEQ ID NO: 5663258 - DNA, 15 bp, Homo sapiens
agtggatcacaaagt

SEQ ID NO: 5663259 - DNA, 14 bp, Homo sapiens
agtggatctccaag

SEQ ID NO: 5663260 - DNA, 23 bp, Homo sapiens
agtggatctccaaggaccaggtt

SEQ ID NO: 5663261 - DNA, 14 bp, Homo sapiens
agtggatcttcaga

SEQ ID NO: 5663262 - DNA, 15 bp, Homo sapiens
agtggatgatgtttc

SEQ ID NO: 5663263 - DNA, 20 bp, Homo sapiens
agtggatgatgtttcgtgaa

SEQ ID NO: 5663264 - DNA, 14 bp, Homo sapiens
agtggatggaatat

SEQ ID NO: 5663265 - DNA, 12 bp, Homo sapiens
agtggatggaca

SEQ ID NO: 5663266 - DNA, 15 bp, Homo sapiens
agtggatggacagat

SEQ ID NO: 5663267 - DNA, 22 bp, Homo sapiens
agtggatggacagatggaccaa

SEQ ID NO: 5663268 - DNA, 13 bp, Homo sapiens
agtggatggatgg

SEQ ID NO: 5663269 - DNA, 12 bp, Homo sapiens
agtggatgggaa

SEQ ID NO: 5663270 - DNA, 16 bp, Homo sapiens
agtggatgtttttaat

SEQ ID NO: 5663271 - DNA, 12 bp, Homo sapiens
agtggattccca

SEQ ID NO: 5663272 - DNA, 15 bp, Homo sapiens
agtggattcctcccc

SEQ ID NO: 5663273 - DNA, 19 bp, Homo sapiens
agtggattcctccccaccc

SEQ ID NO: 5663274 - DNA, 19 bp, Homo sapiens
agtggattgctcatctcag

SEQ ID NO: 5663275 - DNA, 18 bp, Homo sapiens
agtggattggctttgtgc

SEQ ID NO: 5663276 - DNA, 17 bp, Homo sapiens
agtggcaaagagaggtc

SEQ ID NO: 5663277 - DNA, 22 bp, Homo sapiens
agtggcaaagctgttcttcctg

SEQ ID NO: 5663278 - DNA, 21 bp, Homo sapiens
agtggcaagaccaaaatgaca

SEQ ID NO: 5663279 - DNA, 12 bp, Homo sapiens
agtggcactaaa

SEQ ID NO: 5663280 - DNA, 13 bp, Homo sapiens
agtggcactaaaa

SEQ ID NO: 5663281 - DNA, 14 bp, Homo sapiens
agtggcactgaagt

SEQ ID NO: 5663282 - DNA, 16 bp, Homo sapiens
agtggcagacaaacag

SEQ ID NO: 5663283 - DNA, 17 bp, Homo sapiens
agtggcagacaaacaga

SEQ ID NO: 5663284 - DNA, 14 bp, Homo sapiens
agtggcagagccag

SEQ ID NO: 5663285 - DNA, 13 bp, Homo sapiens
agtggcagcagcc

SEQ ID NO: 5663286 - DNA, 18 bp, Homo sapiens
agtggcagccaagagcca

SEQ ID NO: 5663287 - DNA, 22 bp, Homo sapiens
agtggcagccaagagccatctg

SEQ ID NO: 5663288 - DNA, 23 bp, Homo sapiens
agtggcagccaagagccatctga

SEQ ID NO: 5663289 - DNA, 20 bp, Homo sapiens
agtggcagcccagccagcgt

SEQ ID NO: 5663290 - DNA, 16 bp, Homo sapiens
agtggcagccgcctcc

SEQ ID NO: 5663291 - DNA, 13 bp, Homo sapiens
agtggcagctcag

SEQ ID NO: 5663292 - DNA, 14 bp, Homo sapiens
agtggcagctcagc

SEQ ID NO: 5663293 - DNA, 20 bp, Homo sapiens
agtggcagctgcttttgtct

SEQ ID NO: 5663294 - DNA, 21 bp, Homo sapiens
agtggcaggaaagagggagca

SEQ ID NO: 5663295 - DNA, 13 bp, Homo sapiens
agtggcaggagga

SEQ ID NO: 5663296 - DNA, 14 bp, Homo sapiens
agtggcaggaggac

SEQ ID NO: 5663297 - DNA, 23 bp, Homo sapiens
agtggcaggcagaggcccaggct

SEQ ID NO: 5663298 - DNA, 11 bp, Homo sapiens
agtggcaggga

SEQ ID NO: 5663299 - DNA, 17 bp, Homo sapiens
agtggcagggctcagga

SEQ ID NO: 5663300 - DNA, 18 bp, Homo sapiens
agtggcagggctcaggat

SEQ ID NO: 5663301 - DNA, 21 bp, Homo sapiens
agtggcaggtgggctgcctgc

SEQ ID NO: 5663302 - DNA, 13 bp, Homo sapiens
agtggcagtattg

SEQ ID NO: 5663303 - DNA, 20 bp, Homo sapiens
agtggcagtgaaaaatatgt

SEQ ID NO: 5663304 - DNA, 17 bp, Homo sapiens
agtggcagtttttaaaa

SEQ ID NO: 5663305 - DNA, 14 bp, Homo sapiens
ataaatgtgaaatt

SEQ ID NO: 5663306 - DNA, 14 bp, Homo sapiens
ataaatgtgactca

SEQ ID NO: 5663307 - DNA, 19 bp, Homo sapiens
ataaatgtgccttcatttt

SEQ ID NO: 5663308 - DNA, 13 bp, Homo sapiens
ataaatgtgtaaa

SEQ ID NO: 5663309 - DNA, 19 bp, Homo sapiens
ataaatgtgtaaatgtgga

SEQ ID NO: 5663310 - DNA, 23 bp, Homo sapiens
ataaatgttagttctagctctat

SEQ ID NO: 5663311 - DNA, 11 bp, Homo sapiens
ataaatgttca

SEQ ID NO: 5663312 - DNA, 18 bp, Homo sapiens
ataaatgttgctctaatc

SEQ ID NO: 5663313 - DNA, 14 bp, Homo sapiens
ataaatgtttatat

SEQ ID NO: 5663314 - DNA, 15 bp, Homo sapiens
ataaatgtttatatt

SEQ ID NO: 5663315 - DNA, 13 bp, Homo sapiens
ataaatgtttcat

SEQ ID NO: 5663316 - DNA, 15 bp, Homo sapiens
ataaatgtttcatga

SEQ ID NO: 5663317 - DNA, 12 bp, Homo sapiens
ataaatgtttcc

SEQ ID NO: 5663318 - DNA, 15 bp, Homo sapiens
ataaatgtttccccc

SEQ ID NO: 5663319 - DNA, 14 bp, Homo sapiens
ataaatgtttggaa

SEQ ID NO: 5663320 - DNA, 15 bp, Homo sapiens
ataaatgtttggaaa

SEQ ID NO: 5663321 - DNA, 14 bp, Homo sapiens
ataaatgtttgtct

SEQ ID NO: 5663322 - DNA, 15 bp, Homo sapiens
ataaatgttttacaa

SEQ ID NO: 5663323 - DNA, 14 bp, Homo sapiens
ataaattaaaatgt

SEQ ID NO: 5663324 - DNA, 18 bp, Homo sapiens
ataaattaaaatgtaaaa

SEQ ID NO: 5663325 - DNA, 11 bp, Homo sapiens
ataaattaaat

SEQ ID NO: 5663326 - DNA, 18 bp, Homo sapiens
ataaattaaataaactgt

SEQ ID NO: 5663327 - DNA, 23 bp, Homo sapiens
ataaattaaataaactgttttca

SEQ ID NO: 5663328 - DNA, 12 bp, Homo sapiens
ataaattaacaa

SEQ ID NO: 5663329 - DNA, 13 bp, Homo sapiens
ataacatcactgt

SEQ ID NO: 5663330 - DNA, 17 bp, Homo sapiens
ataacatccagagcttt

SEQ ID NO: 5663331 - DNA, 13 bp, Homo sapiens
ataacatctgaaa

SEQ ID NO: 5663332 - DNA, 16 bp, Homo sapiens
ataacatctgaaaaga

SEQ ID NO: 5663333 - DNA, 13 bp, Homo sapiens
ataacatgaaagt

SEQ ID NO: 5663334 - DNA, 16 bp, Homo sapiens
ataacatgaaatgata

SEQ ID NO: 5663335 - DNA, 13 bp, Homo sapiens
ataacatgctgcc

SEQ ID NO: 5663336 - DNA, 13 bp, Homo sapiens
ataacatgtaaaa

SEQ ID NO: 5663337 - DNA, 12 bp, Homo sapiens
ataacatgtaat

SEQ ID NO: 5663338 - DNA, 18 bp, Homo sapiens
ataacattaagaaaatat

SEQ ID NO: 5663339 - DNA, 20 bp, Homo sapiens
ataacattaagaaaatattt

SEQ ID NO: 5663340 - DNA, 13 bp, Homo sapiens
ataacattatata

SEQ ID NO: 5663341 - DNA, 16 bp, Homo sapiens
ataacattatataaca

SEQ ID NO: 5663342 - DNA, 17 bp, Homo sapiens
ataacattcaatttgct

SEQ ID NO: 5663343 - DNA, 19 bp, Homo sapiens
ataacattctgacacatat

SEQ ID NO: 5663344 - DNA, 20 bp, Homo sapiens
ataacattgattttaaaaat

SEQ ID NO: 5663345 - DNA, 12 bp, Homo sapiens
ataacattgtaa

SEQ ID NO: 5663346 - DNA, 17 bp, Homo sapiens
ataacattgtaaatgat

SEQ ID NO: 5663347 - DNA, 13 bp, Homo sapiens
ataacattgtatg

SEQ ID NO: 5663348 - DNA, 16 bp, Homo sapiens
ataacattgtatgtta

SEQ ID NO: 5663349 - DNA, 12 bp, Homo sapiens
ataacatttaaa

SEQ ID NO: 5663350 - DNA, 20 bp, Homo sapiens
ataacatttaaagagatttc

SEQ ID NO: 5663351 - DNA, 17 bp, Homo sapiens
ataacattttatacaat

SEQ ID NO: 5663352 - DNA, 11 bp, Homo sapiens
ataacattttc

SEQ ID NO: 5663353 - DNA, 18 bp, Homo sapiens
ataacattttgtttatgt

SEQ ID NO: 5663354 - DNA, 22 bp, Homo sapiens
ataacattttgtttatgttact

SEQ ID NO: 5663355 - DNA, 20 bp, Homo sapiens
ataaccaaaaaatgtgagct

SEQ ID NO: 5663356 - DNA, 15 bp, Homo sapiens
ataaccaaagcaatt

SEQ ID NO: 5663357 - DNA, 20 bp, Homo sapiens
ataaccaacattaaaactca

SEQ ID NO: 5663358 - DNA, 19 bp, Homo sapiens
ataaccaagaaatactaat

SEQ ID NO: 5663359 - DNA, 19 bp, Homo sapiens
ataaccaagtgtgctcttt

SEQ ID NO: 5663360 - DNA, 14 bp, Homo sapiens
ataaccaatgttta

SEQ ID NO: 5663361 - DNA, 15 bp, Homo sapiens
ataaccaatgtttaa

SEQ ID NO: 5663362 - DNA, 23 bp, Homo sapiens
ataaccacaaagcacagtttgaa

SEQ ID NO: 5663363 - DNA, 13 bp, Homo sapiens
ataaccacattta

SEQ ID NO: 5663364 - DNA, 14 bp, Homo sapiens
ataaccagacacaa

SEQ ID NO: 5663365 - DNA, 12 bp, Homo sapiens
ataaccagcggg

SEQ ID NO: 5663366 - DNA, 19 bp, Homo sapiens
ataaccagctgtaacacag

SEQ ID NO: 5663367 - DNA, 16 bp, Homo sapiens
ataaccatcagttact

SEQ ID NO: 5663368 - DNA, 17 bp, Homo sapiens
ataaccatcagttactg

SEQ ID NO: 5663369 - DNA, 18 bp, Homo sapiens
ataaccatcagttactgg

SEQ ID NO: 5663370 - DNA, 19 bp, Homo sapiens
ataaccatcagttactggt

SEQ ID NO: 5663371 - DNA, 15 bp, Homo sapiens
ataaccatgttctat

SEQ ID NO: 5663372 - DNA, 16 bp, Homo sapiens
ataaccattacatgtt

SEQ ID NO: 5663373 - DNA, 15 bp, Homo sapiens
ataacccacttgtca

SEQ ID NO: 5663374 - DNA, 19 bp, Homo sapiens
ataaccccaccctttacat

SEQ ID NO: 5663375 - DNA, 15 bp, Homo sapiens
ataacccctgcctgg

SEQ ID NO: 5663376 - DNA, 15 bp, Homo sapiens
ataaccctaacacac

SEQ ID NO: 5663377 - DNA, 15 bp, Homo sapiens
ataaccctgccagtg

SEQ ID NO: 5663378 - DNA, 16 bp, Homo sapiens
ataacctaataattgt

SEQ ID NO: 5663379 - DNA, 15 bp, Homo sapiens
ataacctataaagtg

SEQ ID NO: 5663380 - DNA, 18 bp, Homo sapiens
ataacctataaagtgttt

SEQ ID NO: 5663381 - DNA, 14 bp, Homo sapiens
ataacctctggccc

SEQ ID NO: 5663382 - DNA, 15 bp, Homo sapiens
ataacctctggccct

SEQ ID NO: 5663383 - DNA, 15 bp, Homo sapiens
ataaccttaaaaagg

SEQ ID NO: 5663384 - DNA, 20 bp, Homo sapiens
ataaccttcatttttaagac

SEQ ID NO: 5663385 - DNA, 23 bp, Homo sapiens
ataaccttccttctaaacatttt

SEQ ID NO: 5663386 - DNA, 14 bp, Homo sapiens
ataacgaagttggg

SEQ ID NO: 5663387 - DNA, 17 bp, Homo sapiens
ataacgaagttgggcaa

SEQ ID NO: 5663388 - DNA, 16 bp, Homo sapiens
ataacgcaggagagag

SEQ ID NO: 5663389 - DNA, 13 bp, Homo sapiens
ataacgccccaga

SEQ ID NO: 5663390 - DNA, 21 bp, Homo sapiens
ataacggaaaaataattgcca

SEQ ID NO: 5663391 - DNA, 21 bp, Homo sapiens
ataacggatcagaaatacaga

SEQ ID NO: 5663392 - DNA, 15 bp, Homo sapiens
ataacggctctccag

SEQ ID NO: 5663393 - DNA, 18 bp, Homo sapiens
ataacggttaagaaagca

SEQ ID NO: 5663394 - DNA, 18 bp, Homo sapiens
ataacgtgttcaatattt

SEQ ID NO: 5663395 - DNA, 15 bp, Homo sapiens
ataacgtttttcctt

SEQ ID NO: 5663396 - DNA, 18 bp, Homo sapiens
ataacgtttttcctttaa

SEQ ID NO: 5663397 - DNA, 16 bp, Homo sapiens
ataactaaaaggtatg

SEQ ID NO: 5663398 - DNA, 15 bp, Homo sapiens
ataactaaaatgtat

SEQ ID NO: 5663399 - DNA, 14 bp, Homo sapiens
ataactaaataaag

SEQ ID NO: 5663400 - DNA, 15 bp, Homo sapiens
ataactaaatttgat

SEQ ID NO: 5663401 - DNA, 16 bp, Homo sapiens
ataactaaatttgata

SEQ ID NO: 5663402 - DNA, 18 bp, Homo sapiens
ataactaaatttgatact

SEQ ID NO: 5663403 - DNA, 20 bp, Homo sapiens
ataactaagcaagtatattt

SEQ ID NO: 5663404 - DNA, 16 bp, Homo sapiens
ataactaagcatcctt

SEQ ID NO: 5663405 - DNA, 14 bp, Homo sapiens
ataactaaggaata

SEQ ID NO: 5663406 - DNA, 19 bp, Homo sapiens
ataactaatgaattgaaat

SEQ ID NO: 5663407 - DNA, 20 bp, Homo sapiens
ataactaatgaattgaaatt

SEQ ID NO: 5663408 - DNA, 17 bp, Homo sapiens
ataactacatattgaat

SEQ ID NO: 5663409 - DNA, 18 bp, Homo sapiens
ataactacattaaaagct

SEQ ID NO: 5663410 - DNA, 23 bp, Homo sapiens
ataactacattaaaagctttaga

SEQ ID NO: 5663411 - DNA, 22 bp, Homo sapiens
ataactactgacgaaagagtca

SEQ ID NO: 5663412 - DNA, 17 bp, Homo sapiens
ataactactgcaaaaag

SEQ ID NO: 5663413 - DNA, 16 bp, Homo sapiens
ataactactgtgttcc

SEQ ID NO: 5663414 - DNA, 19 bp, Homo sapiens
ataactactgtgttcctgg

SEQ ID NO: 5663415 - DNA, 15 bp, Homo sapiens
ataactagaaacctg

SEQ ID NO: 5663416 - DNA, 14 bp, Homo sapiens
ataactagagcacg

SEQ ID NO: 5663417 - DNA, 23 bp, Homo sapiens
ataactagagtatgtgtatgtac

SEQ ID NO: 5663418 - DNA, 18 bp, Homo sapiens
ataactagatctcctgta

SEQ ID NO: 5663419 - DNA, 21 bp, Homo sapiens
ataactagatggtgctgagaa

SEQ ID NO: 5663420 - DNA, 13 bp, Homo sapiens
ataactagccaga

SEQ ID NO: 5663421 - DNA, 13 bp, Homo sapiens
ataactagtttaa

SEQ ID NO: 5663422 - DNA, 21 bp, Homo sapiens
ataactatataagacattaag

SEQ ID NO: 5663423 - DNA, 17 bp, Homo sapiens
ataactattcagttgtg

SEQ ID NO: 5663424 - DNA, 18 bp, Homo sapiens
ataactattttaaatatc

SEQ ID NO: 5663425 - DNA, 24 bp, Homo sapiens
ataactattttgttttaatctact

SEQ ID NO: 5663426 - DNA, 15 bp, Homo sapiens
ataactcaatggaaa

SEQ ID NO: 5663427 - DNA, 19 bp, Homo sapiens
ataactcacacccctgccc

SEQ ID NO: 5663428 - DNA, 20 bp, Homo sapiens
ataactcaccatcttgaagt

SEQ ID NO: 5663429 - DNA, 20 bp, Homo sapiens
ataactcagaatattgtctg

SEQ ID NO: 5663430 - DNA, 15 bp, Homo sapiens
ataactccaagcaga

SEQ ID NO: 5663431 - DNA, 21 bp, Homo sapiens
ataactcctgtcccttttccc

SEQ ID NO: 5663432 - DNA, 22 bp, Homo sapiens
ataactcctgtcccttttccct

SEQ ID NO: 5663433 - DNA, 15 bp, Homo sapiens
ataactctagggata

SEQ ID NO: 5663434 - DNA, 17 bp, Homo sapiens
ataactctgattttgat

SEQ ID NO: 5663435 - DNA, 21 bp, Homo sapiens
ataactctgtaaaaacactga

SEQ ID NO: 5663436 - DNA, 12 bp, Homo sapiens
ataactctttga

SEQ ID NO: 5663437 - DNA, 14 bp, Homo sapiens
ataactgaaaatta

SEQ ID NO: 5663438 - DNA, 17 bp, Homo sapiens
ataactgaaaattattt

SEQ ID NO: 5663439 - DNA, 12 bp, Homo sapiens
ataactgaaata

SEQ ID NO: 5663440 - DNA, 15 bp, Homo sapiens
ataactgaactgttt

SEQ ID NO: 5663441 - DNA, 16 bp, Homo sapiens
ataactgaactgtttg

SEQ ID NO: 5663442 - DNA, 16 bp, Homo sapiens
ataactgaaggagaag

SEQ ID NO: 5663443 - DNA, 15 bp, Homo sapiens
ataactgacaagaga

SEQ ID NO: 5663444 - DNA, 15 bp, Homo sapiens
ataactgatctattt

SEQ ID NO: 5663445 - DNA, 19 bp, Homo sapiens
ataactgatctatttatta

SEQ ID NO: 5663446 - DNA, 21 bp, Homo sapiens
ataactgatctatttattatc

SEQ ID NO: 5663447 - DNA, 19 bp, Homo sapiens
ataactgatctcaagtata

SEQ ID NO: 5663448 - DNA, 15 bp, Homo sapiens
ataactgcatagtaa

SEQ ID NO: 5663449 - DNA, 18 bp, Homo sapiens
ataactgccttaaaactt

SEQ ID NO: 5663450 - DNA, 20 bp, Homo sapiens
ataactgccttgggcaagga

SEQ ID NO: 5663451 - DNA, 16 bp, Homo sapiens
ataactgctcttttac

SEQ ID NO: 5663452 - DNA, 23 bp, Homo sapiens
ataactgctcttttactaagaca

SEQ ID NO: 5663453 - DNA, 22 bp, Homo sapiens
ataactggaaaacagaacactt

SEQ ID NO: 5663454 - DNA, 18 bp, Homo sapiens
ataactggaacactctat

SEQ ID NO: 5663455 - DNA, 21 bp, Homo sapiens
ataactggaacactctataac

SEQ ID NO: 5663456 - DNA, 23 bp, Homo sapiens
ataactggaacactctataacaa

SEQ ID NO: 5663457 - DNA, 19 bp, Homo sapiens
ataactggaggaattttct

SEQ ID NO: 5663458 - DNA, 19 bp, Homo sapiens
ataactggtagctataact

SEQ ID NO: 5663459 - DNA, 17 bp, Homo sapiens
ataactggttactcagc

SEQ ID NO: 5663460 - DNA, 19 bp, Homo sapiens
ataactggtttgactctgt

SEQ ID NO: 5663461 - DNA, 13 bp, Homo sapiens
ataactgtaacat

SEQ ID NO: 5663462 - DNA, 18 bp, Homo sapiens
ataactgtaattatttga

SEQ ID NO: 5663463 - DNA, 19 bp, Homo sapiens
ataactgtaattatttgaa

SEQ ID NO: 5663464 - DNA, 15 bp, Homo sapiens
ataactgtcttctgg

SEQ ID NO: 5663465 - DNA, 14 bp, Homo sapiens
ataactgtcttgtt

SEQ ID NO: 5663466 - DNA, 15 bp, Homo sapiens
ataactgtcttgttt

SEQ ID NO: 5663467 - DNA, 16 bp, Homo sapiens
ataactgtcttgtttc

SEQ ID NO: 5663468 - DNA, 20 bp, Homo sapiens
ataactgtcttgtttcagtg

SEQ ID NO: 5663469 - DNA, 13 bp, Homo sapiens
ataactgtgaagt

SEQ ID NO: 5663470 - DNA, 16 bp, Homo sapiens
ataactgtgatgaaat

SEQ ID NO: 5663471 - DNA, 17 bp, Homo sapiens
ataactgtgatgaaata

SEQ ID NO: 5663472 - DNA, 20 bp, Homo sapiens
ataactgttatttataatca

SEQ ID NO: 5663473 - DNA, 22 bp, Homo sapiens
ataactgttatttataatcact

SEQ ID NO: 5663474 - DNA, 15 bp, Homo sapiens
ataactgttgttgat

SEQ ID NO: 5663475 - DNA, 20 bp, Homo sapiens
ataactgtttatatgtgttg

SEQ ID NO: 5663476 - DNA, 21 bp, Homo sapiens
ataactgtttatatgtgttga

SEQ ID NO: 5663477 - DNA, 19 bp, Homo sapiens
ataacttaaaaaaatgaca

SEQ ID NO: 5663478 - DNA, 12 bp, Homo sapiens
ataacttaaaat

SEQ ID NO: 5663479 - DNA, 13 bp, Homo sapiens
ataacttaaatat

SEQ ID NO: 5663480 - DNA, 23 bp, Homo sapiens
ataacttaaatattgctctatgt

SEQ ID NO: 5663481 - DNA, 16 bp, Homo sapiens
ataacttaataaatat

SEQ ID NO: 5663482 - DNA, 22 bp, Homo sapiens
ataacttaataaatattgtatt

SEQ ID NO: 5663483 - DNA, 18 bp, Homo sapiens
ataacttaatgaaaacaa

SEQ ID NO: 5663484 - DNA, 19 bp, Homo sapiens
ataacttaatgaaaacaat

SEQ ID NO: 5663485 - DNA, 21 bp, Homo sapiens
ataacttacaagactgtaaat

SEQ ID NO: 5663486 - DNA, 14 bp, Homo sapiens
ataacttactgtat

SEQ ID NO: 5663487 - DNA, 16 bp, Homo sapiens
ataacttactgtatat

SEQ ID NO: 5663488 - DNA, 17 bp, Homo sapiens
ataacttactgtatatg

SEQ ID NO: 5663489 - DNA, 22 bp, Homo sapiens
ataacttactgtatatgtattc

SEQ ID NO: 5663490 - DNA, 22 bp, Homo sapiens
ataacttatattgtaagaaata

SEQ ID NO: 5663491 - DNA, 23 bp, Homo sapiens
ataacttatattgtaagaaatac

SEQ ID NO: 5663492 - DNA, 18 bp, Homo sapiens
ataacttcagagaagtca

SEQ ID NO: 5663493 - DNA, 12 bp, Homo sapiens
ataacttcagtc

SEQ ID NO: 5663494 - DNA, 22 bp, Homo sapiens
ataacttcagtcctgctccaga

SEQ ID NO: 5663495 - DNA, 23 bp, Homo sapiens
ataacttcagtgcaagagacttt

SEQ ID NO: 5663496 - DNA, 19 bp, Homo sapiens
ataacttcattgtttggac

SEQ ID NO: 5663497 - DNA, 14 bp, Homo sapiens
ataacttccacagg

SEQ ID NO: 5663498 - DNA, 19 bp, Homo sapiens
ataacttctaggtattcga

SEQ ID NO: 5663499 - DNA, 23 bp, Homo sapiens
ataacttctatattttaatagaa

SEQ ID NO: 5663500 - DNA, 20 bp, Homo sapiens
ataacttctatgttggtttc

SEQ ID NO: 5663501 - DNA, 16 bp, Homo sapiens
ataacttctgaagtaa

SEQ ID NO: 5663502 - DNA, 17 bp, Homo sapiens
ataacttcttaaaagtt

SEQ ID NO: 5663503 - DNA, 16 bp, Homo sapiens
ataacttcttcctgct

SEQ ID NO: 5663504 - DNA, 19 bp, Homo sapiens
ataacttcttcctgctgga

SEQ ID NO: 5663505 - DNA, 22 bp, Homo sapiens
ataacttcttcctgctggacag

SEQ ID NO: 5663506 - DNA, 21 bp, Homo sapiens
ataacttgctgaatttcaggc

SEQ ID NO: 5663507 - DNA, 20 bp, Homo sapiens
ataagcttaaaataagtgaa

SEQ ID NO: 5663508 - DNA, 17 bp, Homo sapiens
ataagcttggtgacaaa

SEQ ID NO: 5663509 - DNA, 13 bp, Homo sapiens
ataagctttctca

SEQ ID NO: 5663510 - DNA, 19 bp, Homo sapiens
ataagctttctctcagaaa

SEQ ID NO: 5663511 - DNA, 13 bp, Homo sapiens
ataaggaaaagct

SEQ ID NO: 5663512 - DNA, 15 bp, Homo sapiens
ataaggaaaagttta

SEQ ID NO: 5663513 - DNA, 12 bp, Homo sapiens
ataaggaaactt

SEQ ID NO: 5663514 - DNA, 13 bp, Homo sapiens
ataaggaaacttt

SEQ ID NO: 5663515 - DNA, 18 bp, Homo sapiens
ataaggaaatatcataat

SEQ ID NO: 5663516 - DNA, 12 bp, Homo sapiens
ataaggaagaaa

SEQ ID NO: 5663517 - DNA, 13 bp, Homo sapiens
ataaggaagaaac

SEQ ID NO: 5663518 - DNA, 14 bp, Homo sapiens
ataaggaagaaaca

SEQ ID NO: 5663519 - DNA, 17 bp, Homo sapiens
ataaggaagagggctga

SEQ ID NO: 5663520 - DNA, 18 bp, Homo sapiens
ataaggaatttcctccca

SEQ ID NO: 5663521 - DNA, 16 bp, Homo sapiens
ataaggacagcagctg

SEQ ID NO: 5663522 - DNA, 17 bp, Homo sapiens
ataaggacagcagctgg

SEQ ID NO: 5663523 - DNA, 19 bp, Homo sapiens
ataaggacatgatgctttt

SEQ ID NO: 5663524 - DNA, 11 bp, Homo sapiens
ataaggactgc

SEQ ID NO: 5663525 - DNA, 16 bp, Homo sapiens
ataaggactttttgat

SEQ ID NO: 5663526 - DNA, 17 bp, Homo sapiens
ataaggagaaagaaagt

SEQ ID NO: 5663527 - DNA, 20 bp, Homo sapiens
ataaggagacttctgtcttc

SEQ ID NO: 5663528 - DNA, 14 bp, Homo sapiens
ataaggaggaggag

SEQ ID NO: 5663529 - DNA, 19 bp, Homo sapiens
ataaggaggaggagggaga

SEQ ID NO: 5663530 - DNA, 15 bp, Homo sapiens
ataaggataataatc

SEQ ID NO: 5663531 - DNA, 13 bp, Homo sapiens
ataaggatgactt

SEQ ID NO: 5663532 - DNA, 22 bp, Homo sapiens
ataaggatgttaacttggttct

SEQ ID NO: 5663533 - DNA, 20 bp, Homo sapiens
ataaggattctgaagtttta

SEQ ID NO: 5663534 - DNA, 19 bp, Homo sapiens
ataaggatttattctcaga

SEQ ID NO: 5663535 - DNA, 20 bp, Homo sapiens
ataaggatttattctcagaa

SEQ ID NO: 5663536 - DNA, 23 bp, Homo sapiens
ataaggcaacccccggtatatca

SEQ ID NO: 5663537 - DNA, 22 bp, Homo sapiens
ataaggcaagttttgaagcctg

SEQ ID NO: 5663538 - DNA, 20 bp, Homo sapiens
ataaggcatgcgaaatgttc

SEQ ID NO: 5663539 - DNA, 21 bp, Homo sapiens
ataaggccgagcccacaccat

SEQ ID NO: 5663540 - DNA, 16 bp, Homo sapiens
ataaggcctactatac

SEQ ID NO: 5663541 - DNA, 17 bp, Homo sapiens
ataaggcctgccctccc

SEQ ID NO: 5663542 - DNA, 18 bp, Homo sapiens
ataaggccttaatatgtt

SEQ ID NO: 5663543 - DNA, 15 bp, Homo sapiens
ataagggaaaagata

SEQ ID NO: 5663544 - DNA, 16 bp, Homo sapiens
ataagggaaaagataa

SEQ ID NO: 5663545 - DNA, 12 bp, Homo sapiens
ataagggaagta

SEQ ID NO: 5663546 - DNA, 22 bp, Homo sapiens
ataagggaagtagttatcatgt

SEQ ID NO: 5663547 - DNA, 23 bp, Homo sapiens
ataagggaagtagttatcatgtt

SEQ ID NO: 5663548 - DNA, 18 bp, Homo sapiens
ataagggagagctgagcc

SEQ ID NO: 5663549 - DNA, 20 bp, Homo sapiens
ataagggagagctgagccag

SEQ ID NO: 5663550 - DNA, 17 bp, Homo sapiens
ataaggggcacctggga

SEQ ID NO: 5663551 - DNA, 18 bp, Homo sapiens
ataaggggcacctgggaa

SEQ ID NO: 5663552 - DNA, 14 bp, Homo sapiens
ataaggggccttgc

SEQ ID NO: 5663553 - DNA, 22 bp, Homo sapiens
ataaggggccttgctctgagca

SEQ ID NO: 5663554 - DNA, 18 bp, Homo sapiens
ataaggggtttgccattt

SEQ ID NO: 5663555 - DNA, 18 bp, Homo sapiens
ataagggtatctggtgac

SEQ ID NO: 5663556 - DNA, 23 bp, Homo sapiens
ataagggtcacaagtctaaacaa

SEQ ID NO: 5663557 - DNA, 14 bp, Homo sapiens
ataaggtaatgtag

SEQ ID NO: 5663558 - DNA, 13 bp, Homo sapiens
ataaggtaccaag

SEQ ID NO: 5663559 - DNA, 22 bp, Homo sapiens
ataaggtaccaagatcacaaat

SEQ ID NO: 5663560 - DNA, 13 bp, Homo sapiens
ataaggtgcctca

SEQ ID NO: 5663561 - DNA, 13 bp, Homo sapiens
ataaggtgtattg

SEQ ID NO: 5663562 - DNA, 21 bp, Homo sapiens
ataaggtgttttctgtgtaac

SEQ ID NO: 5663563 - DNA, 19 bp, Homo sapiens
ataaggttcgtattgctat

SEQ ID NO: 5663564 - DNA, 19 bp, Homo sapiens
ataaggtttcgtttctgta

SEQ ID NO: 5663565 - DNA, 22 bp, Homo sapiens
ataagtaactttattcttgaaa

SEQ ID NO: 5663566 - DNA, 13 bp, Homo sapiens
ataagtaagtttg

SEQ ID NO: 5663567 - DNA, 13 bp, Homo sapiens
ataagtaatatct

SEQ ID NO: 5663568 - DNA, 16 bp, Homo sapiens
ataagtaatatttaaa

SEQ ID NO: 5663569 - DNA, 17 bp, Homo sapiens
ataagtaattcaagaaa

SEQ ID NO: 5663570 - DNA, 17 bp, Homo sapiens
ataagtacctcagcatt

SEQ ID NO: 5663571 - DNA, 18 bp, Homo sapiens
ataagtacctcagcattt

SEQ ID NO: 5663572 - DNA, 13 bp, Homo sapiens
ataagtactgtgt

SEQ ID NO: 5663573 - DNA, 18 bp, Homo sapiens
ataagtactgtgtacaga

SEQ ID NO: 5663574 - DNA, 19 bp, Homo sapiens
ataagtagcattcatgtaa

SEQ ID NO: 5663575 - DNA, 22 bp, Homo sapiens
ataagtagtgtcattcatatga

SEQ ID NO: 5663576 - DNA, 20 bp, Homo sapiens
ataagtagttggtttgtatg

SEQ ID NO: 5663577 - DNA, 17 bp, Homo sapiens
ataagtatataaatact

SEQ ID NO: 5663578 - DNA, 19 bp, Homo sapiens
ataagtatataaatactat

SEQ ID NO: 5663579 - DNA, 21 bp, Homo sapiens
ataagtatatcttaagaatgt

SEQ ID NO: 5663580 - DNA, 18 bp, Homo sapiens
ataagtatttcaaattgg

SEQ ID NO: 5663581 - DNA, 14 bp, Homo sapiens
ataagtcaaaagga

SEQ ID NO: 5663582 - DNA, 17 bp, Homo sapiens
ataagtcaacagtaaac

SEQ ID NO: 5663583 - DNA, 18 bp, Homo sapiens
ataagtcaacagtaaacc

SEQ ID NO: 5663584 - DNA, 22 bp, Homo sapiens
ataagtcaagcacatgtaataa

SEQ ID NO: 5663585 - DNA, 14 bp, Homo sapiens
ataagtcatctgat

SEQ ID NO: 5663586 - DNA, 20 bp, Homo sapiens
ataagtccatgaatgttcat

SEQ ID NO: 5663587 - DNA, 22 bp, Homo sapiens
ataagtccattttttaaaaatg

SEQ ID NO: 5663588 - DNA, 17 bp, Homo sapiens
ataagtcctaaagtgaa

SEQ ID NO: 5663589 - DNA, 19 bp, Homo sapiens
ataagtcctaaagtgaaga

SEQ ID NO: 5663590 - DNA, 20 bp, Homo sapiens
ataagtctacattaaacaat

SEQ ID NO: 5663591 - DNA, 14 bp, Homo sapiens
ataagtctgattta

SEQ ID NO: 5663592 - DNA, 19 bp, Homo sapiens
ataagtcttggtaacaaat

SEQ ID NO: 5663593 - DNA, 13 bp, Homo sapiens
ataagtgaaaata

SEQ ID NO: 5663594 - DNA, 16 bp, Homo sapiens
ataagtgaaaatctta

SEQ ID NO: 5663595 - DNA, 22 bp, Homo sapiens
ataagtgaaattttaaaagtca

SEQ ID NO: 5663596 - DNA, 20 bp, Homo sapiens
ataagtgaacaactggaaat

SEQ ID NO: 5663597 - DNA, 23 bp, Homo sapiens
ataagtgaacaactggaaataaa

SEQ ID NO: 5663598 - DNA, 15 bp, Homo sapiens
ataagtgaataataa

SEQ ID NO: 5663599 - DNA, 20 bp, Homo sapiens
ataagtgacaccaataaatg

SEQ ID NO: 5663600 - DNA, 19 bp, Homo sapiens
ataagtgactttaaacttt

SEQ ID NO: 5663601 - DNA, 20 bp, Homo sapiens
ataagtgcacacagaaatat

SEQ ID NO: 5663602 - DNA, 12 bp, Homo sapiens
ataagtgccctc

SEQ ID NO: 5663603 - DNA, 18 bp, Homo sapiens
ataagtgctcagtattga

SEQ ID NO: 5663604 - DNA, 22 bp, Homo sapiens
ataagtgctgtataaaatcagc

SEQ ID NO: 5663605 - DNA, 17 bp, Homo sapiens
ataagtggaaaaaagag

SEQ ID NO: 5663606 - DNA, 18 bp, Homo sapiens
ataagtggaaaaaagaga

SEQ ID NO: 5663607 - DNA, 20 bp, Homo sapiens
ataagtggaggcactttagg

SEQ ID NO: 5663608 - DNA, 18 bp, Homo sapiens
ataagtggtgcttagaaa

SEQ ID NO: 5663609 - DNA, 15 bp, Homo sapiens
ataagtgtaaataga

SEQ ID NO: 5663610 - DNA, 16 bp, Homo sapiens
ataagtgtacatatgt

SEQ ID NO: 5663611 - DNA, 17 bp, Homo sapiens
ataagtgtacatatgta

SEQ ID NO: 5663612 - DNA, 19 bp, Homo sapiens
ataagtgtgaccagttttg

SEQ ID NO: 5663613 - DNA, 22 bp, Homo sapiens
ataagtgtgtgtttttcataaa

SEQ ID NO: 5663614 - DNA, 13 bp, Homo sapiens
ataagtgttcagt

SEQ ID NO: 5663615 - DNA, 19 bp, Homo sapiens
ataagtgttcagtgttgac

SEQ ID NO: 5663616 - DNA, 17 bp, Homo sapiens
ataagtgttcttcagtg

SEQ ID NO: 5663617 - DNA, 22 bp, Homo sapiens
ataagtgttgtaccatatgtag

SEQ ID NO: 5663618 - DNA, 13 bp, Homo sapiens
ataagttaaaaca

SEQ ID NO: 5663619 - DNA, 22 bp, Homo sapiens
ataagttaactattttattttc

SEQ ID NO: 5663620 - DNA, 17 bp, Homo sapiens
ataagttaatattggaa

SEQ ID NO: 5663621 - DNA, 22 bp, Homo sapiens
ataagttaatattggaagtgaa

SEQ ID NO: 5663622 - DNA, 18 bp, Homo sapiens
ataagttacttgaaataa

SEQ ID NO: 5663623 - DNA, 15 bp, Homo sapiens
ataagttatagagca

SEQ ID NO: 5663624 - DNA, 14 bp, Homo sapiens
ataagttattgcag

SEQ ID NO: 5663625 - DNA, 16 bp, Homo sapiens
ataagttattgcagtt

SEQ ID NO: 5663626 - DNA, 20 bp, Homo sapiens
ataagttattgcagtttatc

SEQ ID NO: 5663627 - DNA, 12 bp, Homo sapiens
ataagttatttt

SEQ ID NO: 5663628 - DNA, 20 bp, Homo sapiens
ataagttcaaattcttctga

SEQ ID NO: 5663629 - DNA, 21 bp, Homo sapiens
ataagttcaaattcttctgaa

SEQ ID NO: 5663630 - DNA, 15 bp, Homo sapiens
ataagttcacaaaat

SEQ ID NO: 5663631 - DNA, 18 bp, Homo sapiens
ataagttcatacaatcgt

SEQ ID NO: 5663632 - DNA, 17 bp, Homo sapiens
ataagttccatgttaaa

SEQ ID NO: 5663633 - DNA, 14 bp, Homo sapiens
ataagttcctatac

SEQ ID NO: 5663634 - DNA, 16 bp, Homo sapiens
ataagttcctttcctt

SEQ ID NO: 5663635 - DNA, 14 bp, Homo sapiens
ataagttgaaggaa

SEQ ID NO: 5663636 - DNA, 21 bp, Homo sapiens
ataagttgagaaggtgcctgc

SEQ ID NO: 5663637 - DNA, 22 bp, Homo sapiens
ataagttgagaaggtgcctgcc

SEQ ID NO: 5663638 - DNA, 18 bp, Homo sapiens
ataagttgatgttttcta

SEQ ID NO: 5663639 - DNA, 20 bp, Homo sapiens
ataagttgcatttagaaatc

SEQ ID NO: 5663640 - DNA, 18 bp, Homo sapiens
ataagttgctgtaaaatt

SEQ ID NO: 5663641 - DNA, 24 bp, Homo sapiens
ataagttgctgtaaaatttgtgta

SEQ ID NO: 5663642 - DNA, 13 bp, Homo sapiens
ataagttggaaac

SEQ ID NO: 5663643 - DNA, 19 bp, Homo sapiens
ataagttggaaacactaaa

SEQ ID NO: 5663644 - DNA, 21 bp, Homo sapiens
ataagttggaaacactaaatg

SEQ ID NO: 5663645 - DNA, 23 bp, Homo sapiens
ataagttggaaacactaaatgtt

SEQ ID NO: 5663646 - DNA, 19 bp, Homo sapiens
ataagttggagaaatgttt

SEQ ID NO: 5663647 - DNA, 14 bp, Homo sapiens
ataagttggagcag

SEQ ID NO: 5663648 - DNA, 23 bp, Homo sapiens
ataagttgtataggctaaatgtt

SEQ ID NO: 5663649 - DNA, 18 bp, Homo sapiens
ataagttgtattattaga

SEQ ID NO: 5663650 - DNA, 21 bp, Homo sapiens
ataagtttaactttaaaactg

SEQ ID NO: 5663651 - DNA, 14 bp, Homo sapiens
ataagtttatttct

SEQ ID NO: 5663652 - DNA, 22 bp, Homo sapiens
ataagtttatttcttaaatcta

SEQ ID NO: 5663653 - DNA, 21 bp, Homo sapiens
ataagtttctattctgtcagt

SEQ ID NO: 5663654 - DNA, 21 bp, Homo sapiens
ataagtttctgggacctcagt

SEQ ID NO: 5663655 - DNA, 14 bp, Homo sapiens
ataagtttgaaata

SEQ ID NO: 5663656 - DNA, 20 bp, Homo sapiens
ataagtttgaaggaaacagt

SEQ ID NO: 5663657 - DNA, 13 bp, Homo sapiens
ataagttttatgt

SEQ ID NO: 5663658 - DNA, 17 bp, Homo sapiens
ataagttttctctttta

SEQ ID NO: 5663659 - DNA, 14 bp, Homo sapiens
ataagttttgatat

SEQ ID NO: 5663660 - DNA, 17 bp, Homo sapiens
ataagttttttttctgg

SEQ ID NO: 5663661 - DNA, 17 bp, Homo sapiens
ataataaaaaatttcag

SEQ ID NO: 5663662 - DNA, 16 bp, Homo sapiens
ataataaaaagaaaga

SEQ ID NO: 5663663 - DNA, 15 bp, Homo sapiens
ataataaaaatatat

SEQ ID NO: 5663664 - DNA, 21 bp, Homo sapiens
ataataaaaattgtagctttt

SEQ ID NO: 5663665 - DNA, 14 bp, Homo sapiens
agtgtaataatgtt

SEQ ID NO: 5663666 - DNA, 19 bp, Homo sapiens
agtgtaatcccccaggaga

SEQ ID NO: 5663667 - DNA, 14 bp, Homo sapiens
agtgtaatgaatac

SEQ ID NO: 5663668 - DNA, 18 bp, Homo sapiens
agtgtaatgtgacttcat

SEQ ID NO: 5663669 - DNA, 14 bp, Homo sapiens
agtgtaattgagaa

SEQ ID NO: 5663670 - DNA, 16 bp, Homo sapiens
agtgtaatttctttgc

SEQ ID NO: 5663671 - DNA, 16 bp, Homo sapiens
agtgtacaaaactgta

SEQ ID NO: 5663672 - DNA, 16 bp, Homo sapiens
agtgtacaagttgctt

SEQ ID NO: 5663673 - DNA, 18 bp, Homo sapiens
agtgtacaattgatcttt

SEQ ID NO: 5663674 - DNA, 13 bp, Homo sapiens
agtgtacaatttt

SEQ ID NO: 5663675 - DNA, 14 bp, Homo sapiens
agtgtacacagact

SEQ ID NO: 5663676 - DNA, 16 bp, Homo sapiens
agtgtacagccagacc

SEQ ID NO: 5663677 - DNA, 14 bp, Homo sapiens
agtgtacatagtgt

SEQ ID NO: 5663678 - DNA, 17 bp, Homo sapiens
agtgtacatcatgttat

SEQ ID NO: 5663679 - DNA, 22 bp, Homo sapiens
agtgtacatggaataacatgta

SEQ ID NO: 5663680 - DNA, 23 bp, Homo sapiens
agtgtacatggaataacatgtaa

SEQ ID NO: 5663681 - DNA, 13 bp, Homo sapiens
agtgtacatgtac

SEQ ID NO: 5663682 - DNA, 15 bp, Homo sapiens
agtgtacatgtacat

SEQ ID NO: 5663683 - DNA, 13 bp, Homo sapiens
agtgtaccaagtg

SEQ ID NO: 5663684 - DNA, 19 bp, Homo sapiens
attaatgtaggatgacagg

SEQ ID NO: 5663685 - DNA, 24 bp, Homo sapiens
attaatgtaggatgacaggctctc

SEQ ID NO: 5663686 - DNA, 21 bp, Homo sapiens
attaatgtcctcttgctgtct

SEQ ID NO: 5663687 - DNA, 23 bp, Homo sapiens
attaatgtctcactttactttca

SEQ ID NO: 5663688 - DNA, 13 bp, Homo sapiens
attaatgtgtaaa

SEQ ID NO: 5663689 - DNA, 15 bp, Homo sapiens
attaatgtgtattaa

SEQ ID NO: 5663690 - DNA, 12 bp, Homo sapiens
attaatgttaat

SEQ ID NO: 5663691 - DNA, 13 bp, Homo sapiens
attaatgttaatt

SEQ ID NO: 5663692 - DNA, 23 bp, Homo sapiens
attaatgttccagtttgaagacc

SEQ ID NO: 5663693 - DNA, 12 bp, Homo sapiens
attaatgttgat

SEQ ID NO: 5663694 - DNA, 16 bp, Homo sapiens
attaatgttgatttct

SEQ ID NO: 5663695 - DNA, 18 bp, Homo sapiens
attaatgtttatttagct

SEQ ID NO: 5663696 - DNA, 22 bp, Homo sapiens
attaatgtttatttagctctga

SEQ ID NO: 5663697 - DNA, 16 bp, Homo sapiens
attaatgtttctatct

SEQ ID NO: 5663698 - DNA, 20 bp, Homo sapiens
attaatgtttctatctgatt

SEQ ID NO: 5663699 - DNA, 20 bp, Homo sapiens
attaatgtttcttaaatgga

SEQ ID NO: 5663700 - DNA, 16 bp, Homo sapiens
attaatgttttcatta

SEQ ID NO: 5663701 - DNA, 23 bp, Homo sapiens
attaattaaaataaaaaacagct

SEQ ID NO: 5663702 - DNA, 13 bp, Homo sapiens
attaattaaacat

SEQ ID NO: 5663703 - DNA, 16 bp, Homo sapiens
attaattaaacattgt

SEQ ID NO: 5663704 - DNA, 14 bp, Homo sapiens
attaattaaatgca

SEQ ID NO: 5663705 - DNA, 16 bp, Homo sapiens
attaattacaattatg

SEQ ID NO: 5663706 - DNA, 14 bp, Homo sapiens
attaattagatttt

SEQ ID NO: 5663707 - DNA, 14 bp, Homo sapiens
attaattatatgta

SEQ ID NO: 5663708 - DNA, 21 bp, Homo sapiens
attaattatgaagattatgat

SEQ ID NO: 5663709 - DNA, 19 bp, Homo sapiens
attaattattttccaaaat

SEQ ID NO: 5663710 - DNA, 14 bp, Homo sapiens
attaattcaatgaa

SEQ ID NO: 5663711 - DNA, 13 bp, Homo sapiens
attaattcaatta

SEQ ID NO: 5663712 - DNA, 19 bp, Homo sapiens
attaattcaccttccagtg

SEQ ID NO: 5663713 - DNA, 22 bp, Homo sapiens
attaattctttatcacatgttg

SEQ ID NO: 5663714 - DNA, 18 bp, Homo sapiens
attaattgcctgttaaat

SEQ ID NO: 5663715 - DNA, 21 bp, Homo sapiens
attaattgcctgttaaatata

SEQ ID NO: 5663716 - DNA, 22 bp, Homo sapiens
attaattgcctgttaaatatac

SEQ ID NO: 5663717 - DNA, 19 bp, Homo sapiens
attaattggcagcagattt

SEQ ID NO: 5663718 - DNA, 21 bp, Homo sapiens
attaattggcagcagatttta

SEQ ID NO: 5663719 - DNA, 22 bp, Homo sapiens
attaattgggccagcttttcaa

SEQ ID NO: 5663720 - DNA, 13 bp, Homo sapiens
attaattgtaatc

SEQ ID NO: 5663721 - DNA, 16 bp, Homo sapiens
attaattgtcctgtgt

SEQ ID NO: 5663722 - DNA, 18 bp, Homo sapiens
attaattgtgtgaacttg

SEQ ID NO: 5663723 - DNA, 14 bp, Homo sapiens
attaatttaaatga

SEQ ID NO: 5663724 - DNA, 16 bp, Homo sapiens
attaatttatcagatt

SEQ ID NO: 5663725 - DNA, 19 bp, Homo sapiens
attaatttatcagattgct

SEQ ID NO: 5663726 - DNA, 15 bp, Homo sapiens
attaatttatggttt

SEQ ID NO: 5663727 - DNA, 16 bp, Homo sapiens
attaatttattaaatt

SEQ ID NO: 5663728 - DNA, 16 bp, Homo sapiens
attaatttatttaatt

SEQ ID NO: 5663729 - DNA, 14 bp, Homo sapiens
attaatttatttgt

SEQ ID NO: 5663730 - DNA, 22 bp, Homo sapiens
attaatttctctcaatttgggt

SEQ ID NO: 5663731 - DNA, 21 bp, Homo sapiens
attaatttctgccatttcatg

SEQ ID NO: 5663732 - DNA, 14 bp, Homo sapiens
attaatttcttcac

SEQ ID NO: 5663733 - DNA, 21 bp, Homo sapiens
attaatttgaaaccaggacat

SEQ ID NO: 5663734 - DNA, 22 bp, Homo sapiens
attaatttgaaaccaggacatt

SEQ ID NO: 5663735 - DNA, 21 bp, Homo sapiens
attaatttgattaacaaatat

SEQ ID NO: 5663736 - DNA, 22 bp, Homo sapiens
attaatttgattaacaaatatg

SEQ ID NO: 5663737 - DNA, 23 bp, Homo sapiens
atttattccccagtgactccagg

SEQ ID NO: 5663738 - DNA, 16 bp, Homo sapiens
atttattcccttttaa

SEQ ID NO: 5663739 - DNA, 18 bp, Homo sapiens
atttattcctctgtccta

SEQ ID NO: 5663740 - DNA, 13 bp, Homo sapiens
atttattcctgtt

SEQ ID NO: 5663741 - DNA, 14 bp, Homo sapiens
atttattccttcca

SEQ ID NO: 5663742 - DNA, 14 bp, Homo sapiens
atttattctaatta

SEQ ID NO: 5663743 - DNA, 14 bp, Homo sapiens
atttattctcagaa

SEQ ID NO: 5663744 - DNA, 13 bp, Homo sapiens
atttattctgctc

SEQ ID NO: 5663745 - DNA, 11 bp, Homo sapiens
atttattctgg

SEQ ID NO: 5663746 - DNA, 19 bp, Homo sapiens
atttattctgggaatgtat

SEQ ID NO: 5663747 - DNA, 22 bp, Homo sapiens
atttattctgggttttgtagca

SEQ ID NO: 5663748 - DNA, 18 bp, Homo sapiens
atttattgaaatgatttc

SEQ ID NO: 5663749 - DNA, 14 bp, Homo sapiens
atttattgaagatg

SEQ ID NO: 5663750 - DNA, 16 bp, Homo sapiens
atttattgaagatgtc

SEQ ID NO: 5663751 - DNA, 19 bp, Homo sapiens
atttattgaattattttgt

SEQ ID NO: 5663752 - DNA, 19 bp, Homo sapiens
atttattgatgttttcaca

SEQ ID NO: 5663753 - DNA, 12 bp, Homo sapiens
atttattgatta

SEQ ID NO: 5663754 - DNA, 19 bp, Homo sapiens
atttattgcacattgttca

SEQ ID NO: 5663755 - DNA, 20 bp, Homo sapiens
atttattgcacattgttcaa

SEQ ID NO: 5663756 - DNA, 16 bp, Homo sapiens
atttattgcattgctg

SEQ ID NO: 5663757 - DNA, 12 bp, Homo sapiens
atttattgcttt

SEQ ID NO: 5663758 - DNA, 23 bp, Homo sapiens
atttattggatgatacagtgttt

SEQ ID NO: 5663759 - DNA, 23 bp, Homo sapiens
atttattggcagccaaggaatgt

SEQ ID NO: 5663760 - DNA, 23 bp, Homo sapiens
atttattggccccccgaccttgt

SEQ ID NO: 5663761 - DNA, 14 bp, Homo sapiens
atttattggctttt

SEQ ID NO: 5663762 - DNA, 23 bp, Homo sapiens
atttattggcttttctgatccag

SEQ ID NO: 5663763 - DNA, 20 bp, Homo sapiens
atttattgtaccaaagctgt

SEQ ID NO: 5663764 - DNA, 13 bp, Homo sapiens
atttattgtatat

SEQ ID NO: 5663765 - DNA, 16 bp, Homo sapiens
atttattgtatatatg

SEQ ID NO: 5663766 - DNA, 13 bp, Homo sapiens
atttattgtcagt

SEQ ID NO: 5663767 - DNA, 13 bp, Homo sapiens
atttattgtctgt

SEQ ID NO: 5663768 - DNA, 14 bp, Homo sapiens
atttattgtcttta

SEQ ID NO: 5663769 - DNA, 12 bp, Homo sapiens
atttattgttaa

SEQ ID NO: 5663770 - DNA, 13 bp, Homo sapiens
atttattgttaaa

SEQ ID NO: 5663771 - DNA, 19 bp, Homo sapiens
atttattgttaaattacat

SEQ ID NO: 5663772 - DNA, 18 bp, Homo sapiens
atttattgttagaaaatg

SEQ ID NO: 5663773 - DNA, 14 bp, Homo sapiens
atttattgttgcct

SEQ ID NO: 5663774 - DNA, 22 bp, Homo sapiens
atttattgttgccttttcacgt

SEQ ID NO: 5663775 - DNA, 19 bp, Homo sapiens
atttattgtttatttatca

SEQ ID NO: 5663776 - DNA, 13 bp, Homo sapiens
atttattgtttga

SEQ ID NO: 5663777 - DNA, 18 bp, Homo sapiens
atttattgtttgaaatgt

SEQ ID NO: 5663778 - DNA, 17 bp, Homo sapiens
atttatttaaaactctg

SEQ ID NO: 5663779 - DNA, 16 bp, Homo sapiens
atttatttaaaagatt

SEQ ID NO: 5663780 - DNA, 20 bp, Homo sapiens
atttatttaaaagattcatt

SEQ ID NO: 5663781 - DNA, 20 bp, Homo sapiens
atttatttaaaatttcgttg

SEQ ID NO: 5663782 - DNA, 21 bp, Homo sapiens
atttatttaaacaaatgtgta

SEQ ID NO: 5663783 - DNA, 14 bp, Homo sapiens
atttatttaaatgt

SEQ ID NO: 5663784 - DNA, 14 bp, Homo sapiens
atttatttaaattt

SEQ ID NO: 5663785 - DNA, 12 bp, Homo sapiens
atttatttaata

SEQ ID NO: 5663786 - DNA, 16 bp, Homo sapiens
atttatttaataacaa

SEQ ID NO: 5663787 - DNA, 17 bp, Homo sapiens
atttatttactgctagt

SEQ ID NO: 5663788 - DNA, 15 bp, Homo sapiens
atttatttataagtt

SEQ ID NO: 5663789 - DNA, 15 bp, Homo sapiens
atttatttatgaaaa

SEQ ID NO: 5663790 - DNA, 16 bp, Homo sapiens
atttatttatgtactt

SEQ ID NO: 5663791 - DNA, 14 bp, Homo sapiens
atttatttatgtgt

SEQ ID NO: 5663792 - DNA, 17 bp, Homo sapiens
atttatttattaagatg

SEQ ID NO: 5663793 - DNA, 13 bp, Homo sapiens
atttatttattat

SEQ ID NO: 5663794 - DNA, 15 bp, Homo sapiens
atttatttattatta

SEQ ID NO: 5663795 - DNA, 14 bp, Homo sapiens
atttatttattcat

SEQ ID NO: 5663796 - DNA, 16 bp, Homo sapiens
atttatttatttgttt

SEQ ID NO: 5663797 - DNA, 15 bp, Homo sapiens
atttatttattttgt

SEQ ID NO: 5663798 - DNA, 14 bp, Homo sapiens
atttatttcaaaaa

SEQ ID NO: 5663799 - DNA, 12 bp, Homo sapiens
atttatttcatg

SEQ ID NO: 5663800 - DNA, 20 bp, Homo sapiens
atttatttccatattaaaat

SEQ ID NO: 5663801 - DNA, 15 bp, Homo sapiens
atttatttccccagg

SEQ ID NO: 5663802 - DNA, 13 bp, Homo sapiens
atttatttcctag

SEQ ID NO: 5663803 - DNA, 17 bp, Homo sapiens
atttatttcctccctct

SEQ ID NO: 5663804 - DNA, 13 bp, Homo sapiens
atttatttcctgc

SEQ ID NO: 5663805 - DNA, 23 bp, Homo sapiens
atttatttctctggcaaactttt

SEQ ID NO: 5663806 - DNA, 14 bp, Homo sapiens
atttatttctgtaa

SEQ ID NO: 5663807 - DNA, 13 bp, Homo sapiens
atttatttcttaa

SEQ ID NO: 5663808 - DNA, 21 bp, Homo sapiens
atttatttgaatgatttttct

SEQ ID NO: 5663809 - DNA, 21 bp, Homo sapiens
atttatttgaggtcagtgttt

SEQ ID NO: 5663810 - DNA, 17 bp, Homo sapiens
atttatttgattaggta

SEQ ID NO: 5663811 - DNA, 12 bp, Homo sapiens
atttatttgcaa

SEQ ID NO: 5663812 - DNA, 22 bp, Homo sapiens
atttatttggagtggaggcatt

SEQ ID NO: 5663813 - DNA, 12 bp, Homo sapiens
atttatttgtgt

SEQ ID NO: 5663814 - DNA, 13 bp, Homo sapiens
atttatttgtttc

SEQ ID NO: 5663815 - DNA, 14 bp, Homo sapiens
atttatttgtttcc

SEQ ID NO: 5663816 - DNA, 17 bp, Homo sapiens
atttatttgtttgattt

SEQ ID NO: 5663817 - DNA, 14 bp, Homo sapiens
atttattttaagca

SEQ ID NO: 5663818 - DNA, 17 bp, Homo sapiens
atttattttaataatgt

SEQ ID NO: 5663819 - DNA, 21 bp, Homo sapiens
atttattttaataatgtttca

SEQ ID NO: 5663820 - DNA, 16 bp, Homo sapiens
atttattttaatgtaa

SEQ ID NO: 5663821 - DNA, 16 bp, Homo sapiens
atttattttataagaa

SEQ ID NO: 5663822 - DNA, 13 bp, Homo sapiens
atttattttatga

SEQ ID NO: 5663823 - DNA, 18 bp, Homo sapiens
atttattttatgagaaat

SEQ ID NO: 5663824 - DNA, 21 bp, Homo sapiens
atttattttatttatttaatt

SEQ ID NO: 5663825 - DNA, 14 bp, Homo sapiens
atttattttcagta

SEQ ID NO: 5663826 - DNA, 16 bp, Homo sapiens
atttattttcctaaag

SEQ ID NO: 5663827 - DNA, 17 bp, Homo sapiens
atttattttcctaaaga

SEQ ID NO: 5663828 - DNA, 20 bp, Homo sapiens
atttattttcctccccagca

SEQ ID NO: 5663829 - DNA, 14 bp, Homo sapiens
atttattttctcaa

SEQ ID NO: 5663830 - DNA, 23 bp, Homo sapiens
atttattttcttttgaattgttt

SEQ ID NO: 5663831 - DNA, 22 bp, Homo sapiens
atttattttgaaatttgtttct

SEQ ID NO: 5663832 - DNA, 12 bp, Homo sapiens
atttattttgac

SEQ ID NO: 5663833 - DNA, 13 bp, Homo sapiens
atttattttgaca

SEQ ID NO: 5663834 - DNA, 14 bp, Homo sapiens
atttattttgacat

SEQ ID NO: 5663835 - DNA, 21 bp, Homo sapiens
atttattttgctccctctgtt

SEQ ID NO: 5663836 - DNA, 13 bp, Homo sapiens
atttattttgtaa

SEQ ID NO: 5663837 - DNA, 19 bp, Homo sapiens
atttattttgtatttttga

SEQ ID NO: 5663838 - DNA, 21 bp, Homo sapiens
atttattttgtatttttgaat

SEQ ID NO: 5663839 - DNA, 22 bp, Homo sapiens
atttattttgtatttttgaata

SEQ ID NO: 5663840 - DNA, 24 bp, Homo sapiens
atttatttttaaaataatttatca

SEQ ID NO: 5663841 - DNA, 19 bp, Homo sapiens
atttatttttaagaaagaa

SEQ ID NO: 5663842 - DNA, 14 bp, Homo sapiens
atttatttttaata

SEQ ID NO: 5663843 - DNA, 16 bp, Homo sapiens
atttatttttcagttc

SEQ ID NO: 5663844 - DNA, 20 bp, Homo sapiens
atttatttttgtactgtgct

SEQ ID NO: 5663845 - DNA, 16 bp, Homo sapiens
atttattttttaagaa

SEQ ID NO: 5663846 - DNA, 17 bp, Homo sapiens
atttattttttcttttc

SEQ ID NO: 5663847 - DNA, 20 bp, Homo sapiens
atttattttttgtaactctt

SEQ ID NO: 5663848 - DNA, 19 bp, Homo sapiens
atttattttttttaaagaa

SEQ ID NO: 5663849 - DNA, 21 bp, Homo sapiens
atttattttttttaattgtat

SEQ ID NO: 5663850 - DNA, 22 bp, Homo sapiens
atttcaaaaacatgcttttcca

SEQ ID NO: 5663851 - DNA, 18 bp, Homo sapiens
atttcaaaaatataactt

SEQ ID NO: 5663852 - DNA, 14 bp, Homo sapiens
atttcaaaaatttg

SEQ ID NO: 5663853 - DNA, 18 bp, Homo sapiens
atttcaaaagacatgttg

SEQ ID NO: 5663854 - DNA, 14 bp, Homo sapiens
atttcaaaatacat

SEQ ID NO: 5663855 - DNA, 19 bp, Homo sapiens
atttcaaaatacatttgta

SEQ ID NO: 5663856 - DNA, 22 bp, Homo sapiens
atttcaaaatacatttgtaagt

SEQ ID NO: 5663857 - DNA, 21 bp, Homo sapiens
atttcaaaatcagtttttcat

SEQ ID NO: 5663858 - DNA, 13 bp, Homo sapiens
atttcaaaatgca

SEQ ID NO: 5663859 - DNA, 14 bp, Homo sapiens
atttcaaaatgcat

SEQ ID NO: 5663860 - DNA, 15 bp, Homo sapiens
atttcaaaatgcatg

SEQ ID NO: 5663861 - DNA, 18 bp, Homo sapiens
atttcaaaatgcatgtga

SEQ ID NO: 5663862 - DNA, 14 bp, Homo sapiens
atttcaaaatgctt

SEQ ID NO: 5663863 - DNA, 16 bp, Homo sapiens
atttcatatactataa

SEQ ID NO: 5663864 - DNA, 15 bp, Homo sapiens
atttcatattgagat

SEQ ID NO: 5663865 - DNA, 16 bp, Homo sapiens
atttcatattgatctt

SEQ ID NO: 5663866 - DNA, 15 bp, Homo sapiens
atttcatcacaagaa

SEQ ID NO: 5663867 - DNA, 17 bp, Homo sapiens
atttcatcagaacagct

SEQ ID NO: 5663868 - DNA, 19 bp, Homo sapiens
atttcatcagaacagctgt

SEQ ID NO: 5663869 - DNA, 20 bp, Homo sapiens
atttcatcatattatacaga

SEQ ID NO: 5663870 - DNA, 14 bp, Homo sapiens
atttcatcattgtt

SEQ ID NO: 5663871 - DNA, 21 bp, Homo sapiens
atttcatccaccaatatcatg

SEQ ID NO: 5663872 - DNA, 22 bp, Homo sapiens
atttcatccaccaatatcatgt

SEQ ID NO: 5663873 - DNA, 23 bp, Homo sapiens
atttcatccagtttgttctccgg

SEQ ID NO: 5663874 - DNA, 20 bp, Homo sapiens
atttcatcctgttggctgct

SEQ ID NO: 5663875 - DNA, 19 bp, Homo sapiens
atttcatcctttcacttct

SEQ ID NO: 5663876 - DNA, 22 bp, Homo sapiens
atttcatcctttcacttctttc

SEQ ID NO: 5663877 - DNA, 15 bp, Homo sapiens
atttcatctaattta

SEQ ID NO: 5663878 - DNA, 13 bp, Homo sapiens
atttcatctattt

SEQ ID NO: 5663879 - DNA, 14 bp, Homo sapiens
atttcatctatttt

SEQ ID NO: 5663880 - DNA, 23 bp, Homo sapiens
atttcatctcatttaagggaaaa

SEQ ID NO: 5663881 - DNA, 15 bp, Homo sapiens
atttcatctgctctc

SEQ ID NO: 5663882 - DNA, 17 bp, Homo sapiens
atttcatctgctctcct

SEQ ID NO: 5663883 - DNA, 20 bp, Homo sapiens
atttcatctgctctccttcc

SEQ ID NO: 5663884 - DNA, 15 bp, Homo sapiens
atttcatctgggtgg

SEQ ID NO: 5663885 - DNA, 22 bp, Homo sapiens
atttcatctgggtggtctgaat

SEQ ID NO: 5663886 - DNA, 12 bp, Homo sapiens
atttcatctgtt

SEQ ID NO: 5663887 - DNA, 19 bp, Homo sapiens
atttcatctgttctatgct

SEQ ID NO: 5663888 - DNA, 14 bp, Homo sapiens
atttcatcttctgg

SEQ ID NO: 5663889 - DNA, 16 bp, Homo sapiens
atttcatcttctggaa

SEQ ID NO: 5663890 - DNA, 23 bp, Homo sapiens
atttcatgattagacaatgtgga

SEQ ID NO: 5663891 - DNA, 15 bp, Homo sapiens
atttcatgatttcat

SEQ ID NO: 5663892 - DNA, 20 bp, Homo sapiens
atttcatggattatttatga

SEQ ID NO: 5663893 - DNA, 18 bp, Homo sapiens
atttcatgtaatataagt

SEQ ID NO: 5663894 - DNA, 21 bp, Homo sapiens
atttcatgtactgcattattt

SEQ ID NO: 5663895 - DNA, 18 bp, Homo sapiens
atttcatgtatttcttta

SEQ ID NO: 5663896 - DNA, 23 bp, Homo sapiens
atttcatgtcctgtgtcagttta

SEQ ID NO: 5663897 - DNA, 18 bp, Homo sapiens
atttcatgtgatctatta

SEQ ID NO: 5663898 - DNA, 19 bp, Homo sapiens
atttcatgtgctatagaca

SEQ ID NO: 5663899 - DNA, 21 bp, Homo sapiens
atttcatgtgctatagacatt

SEQ ID NO: 5663900 - DNA, 14 bp, Homo sapiens
atttcatgtgtcaa

SEQ ID NO: 5663901 - DNA, 17 bp, Homo sapiens
atttcatgttagtctta

SEQ ID NO: 5663902 - DNA, 16 bp, Homo sapiens
atttcatgtttttgat

SEQ ID NO: 5663903 - DNA, 20 bp, Homo sapiens
atttcattaaccaaagaaag

SEQ ID NO: 5663904 - DNA, 14 bp, Homo sapiens
atttcattatgctt

SEQ ID NO: 5663905 - DNA, 17 bp, Homo sapiens
atttcattatgctttga

SEQ ID NO: 5663906 - DNA, 22 bp, Homo sapiens
atttcattatgctttgaacttt

SEQ ID NO: 5663907 - DNA, 17 bp, Homo sapiens
atttcattatttttcaa

SEQ ID NO: 5663908 - DNA, 19 bp, Homo sapiens
atttcattatttttcaatt

SEQ ID NO: 5663909 - DNA, 19 bp, Homo sapiens
atttcattcaaatcagtga

SEQ ID NO: 5663910 - DNA, 17 bp, Homo sapiens
atttcattccattgcct

SEQ ID NO: 5663911 - DNA, 14 bp, Homo sapiens
atttcattcctaac

SEQ ID NO: 5663912 - DNA, 13 bp, Homo sapiens
atttcattcctcg

SEQ ID NO: 5663913 - DNA, 19 bp, Homo sapiens
atttcattgagggaaaaca

SEQ ID NO: 5663914 - DNA, 22 bp, Homo sapiens
atttcattggtcttctttttta

SEQ ID NO: 5663915 - DNA, 12 bp, Homo sapiens
atttcattgtat

SEQ ID NO: 5663916 - DNA, 17 bp, Homo sapiens
atttcattgtatgatgt

SEQ ID NO: 5663917 - DNA, 14 bp, Homo sapiens
atttcatttaaata

SEQ ID NO: 5663918 - DNA, 15 bp, Homo sapiens
atttcatttatactg

SEQ ID NO: 5663919 - DNA, 21 bp, Homo sapiens
atttcatttatactgtagcaa

SEQ ID NO: 5663920 - DNA, 21 bp, Homo sapiens
attacccactgtcaggcctct

SEQ ID NO: 5663921 - DNA, 20 bp, Homo sapiens
attacccccagtcctcccta

SEQ ID NO: 5663922 - DNA, 16 bp, Homo sapiens
attaccccctcctcca

SEQ ID NO: 5663923 - DNA, 21 bp, Homo sapiens
attaccccctcctccagatca

SEQ ID NO: 5663924 - DNA, 22 bp, Homo sapiens
attacccctatacctgagcctc

SEQ ID NO: 5663925 - DNA, 14 bp, Homo sapiens
attacccctcattt

SEQ ID NO: 5663926 - DNA, 21 bp, Homo sapiens
attaccctaagaatgctttgc

SEQ ID NO: 5663927 - DNA, 23 bp, Homo sapiens
attaccctaagaatgctttgcca

SEQ ID NO: 5663928 - DNA, 13 bp, Homo sapiens
attaccctcagaa

SEQ ID NO: 5663929 - DNA, 14 bp, Homo sapiens
attaccctcagaat

SEQ ID NO: 5663930 - DNA, 17 bp, Homo sapiens
attaccctctgcagaac

SEQ ID NO: 5663931 - DNA, 14 bp, Homo sapiens
attacccttcctca

SEQ ID NO: 5663932 - DNA, 15 bp, Homo sapiens
attacccttctttcc

SEQ ID NO: 5663933 - DNA, 16 bp, Homo sapiens
attaccgcgttgtaaa

SEQ ID NO: 5663934 - DNA, 18 bp, Homo sapiens
attaccgcgttgtaaaat

SEQ ID NO: 5663935 - DNA, 21 bp, Homo sapiens
attaccgcgttgtaaaatata

SEQ ID NO: 5663936 - DNA, 16 bp, Homo sapiens
attaccgtcacactct

SEQ ID NO: 5663937 - DNA, 14 bp, Homo sapiens
attacctaatgaaa

SEQ ID NO: 5663938 - DNA, 14 bp, Homo sapiens
attacctaattttt

SEQ ID NO: 5663939 - DNA, 18 bp, Homo sapiens
attacctaccccagttca

SEQ ID NO: 5663940 - DNA, 20 bp, Homo sapiens
attacctcaggtgccaaccc

SEQ ID NO: 5663941 - DNA, 21 bp, Homo sapiens
attacctcaggtgccaaccca

SEQ ID NO: 5663942 - DNA, 14 bp, Homo sapiens
attacctccatcca

SEQ ID NO: 5663943 - DNA, 17 bp, Homo sapiens
attacctcctgagaaaa

SEQ ID NO: 5663944 - DNA, 19 bp, Homo sapiens
attacctcctgtgtggaag

SEQ ID NO: 5663945 - DNA, 13 bp, Homo sapiens
attacctctgata

SEQ ID NO: 5663946 - DNA, 15 bp, Homo sapiens
attacctcttgccct

SEQ ID NO: 5663947 - DNA, 22 bp, Homo sapiens
attacctgaaagcccttctcaa

SEQ ID NO: 5663948 - DNA, 19 bp, Homo sapiens
attacctggatgttctttt

SEQ ID NO: 5663949 - DNA, 14 bp, Homo sapiens
attacctgtggata

SEQ ID NO: 5663950 - DNA, 16 bp, Homo sapiens
attacctgtggatatt

SEQ ID NO: 5663951 - DNA, 19 bp, Homo sapiens
attacctgtggatatttgt

SEQ ID NO: 5663952 - DNA, 20 bp, Homo sapiens
attaccttaaacttgcagta

SEQ ID NO: 5663953 - DNA, 21 bp, Homo sapiens
attaccttagattagctctgg

SEQ ID NO: 5663954 - DNA, 17 bp, Homo sapiens
attaccttgtctttcaa

SEQ ID NO: 5663955 - DNA, 20 bp, Homo sapiens
attaccttgtctttcaaaag

SEQ ID NO: 5663956 - DNA, 14 bp, Homo sapiens
attacctttaatgc

SEQ ID NO: 5663957 - DNA, 16 bp, Homo sapiens
attacctttaatttta

SEQ ID NO: 5663958 - DNA, 21 bp, Homo sapiens
attaccttttaccagctttta

SEQ ID NO: 5663959 - DNA, 22 bp, Homo sapiens
attacgaatgcccctgttcatg

SEQ ID NO: 5663960 - DNA, 17 bp, Homo sapiens
attacgataaacattaa

SEQ ID NO: 5663961 - DNA, 15 bp, Homo sapiens
attacgataaggaag

SEQ ID NO: 5663962 - DNA, 16 bp, Homo sapiens
attacgatgtaaattt

SEQ ID NO: 5663963 - DNA, 17 bp, Homo sapiens
attacgatgtaaatttt

SEQ ID NO: 5663964 - DNA, 23 bp, Homo sapiens
attacgtatgcaagtctgtgagt

SEQ ID NO: 5663965 - DNA, 21 bp, Homo sapiens
attacgtatgtctggttctca

SEQ ID NO: 5663966 - DNA, 13 bp, Homo sapiens
attacgtgcattt

SEQ ID NO: 5663967 - DNA, 19 bp, Homo sapiens
attacgtgcatttaaactc

SEQ ID NO: 5663968 - DNA, 17 bp, Homo sapiens
attacgtgtatgtttct

SEQ ID NO: 5663969 - DNA, 14 bp, Homo sapiens
attacgttgtttct

SEQ ID NO: 5663970 - DNA, 20 bp, Homo sapiens
attacgtttaaagtgcagtc

SEQ ID NO: 5663971 - DNA, 13 bp, Homo sapiens
attactaaatata

SEQ ID NO: 5663972 - DNA, 15 bp, Homo sapiens
attactaacctccct

SEQ ID NO: 5663973 - DNA, 12 bp, Homo sapiens
attactaacttc

SEQ ID NO: 5663974 - DNA, 13 bp, Homo sapiens
attactaacttct

SEQ ID NO: 5663975 - DNA, 14 bp, Homo sapiens
attactaacttcta

SEQ ID NO: 5663976 - DNA, 12 bp, Homo sapiens
attactaatttc

SEQ ID NO: 5663977 - DNA, 22 bp, Homo sapiens
attactacaaaaccgtttagtc

SEQ ID NO: 5663978 - DNA, 19 bp, Homo sapiens
attactagtactattacta

SEQ ID NO: 5663979 - DNA, 15 bp, Homo sapiens
attactagtgtttaa

SEQ ID NO: 5663980 - DNA, 20 bp, Homo sapiens
attactagtgtttaagtcat

SEQ ID NO: 5663981 - DNA, 17 bp, Homo sapiens
attactcagtaatttgt

SEQ ID NO: 5663982 - DNA, 14 bp, Homo sapiens
attactcctatttt

SEQ ID NO: 5663983 - DNA, 15 bp, Homo sapiens
attactcctccatta

SEQ ID NO: 5663984 - DNA, 21 bp, Homo sapiens
attactcgatcaaaaccttcc

SEQ ID NO: 5663985 - DNA, 14 bp, Homo sapiens
attactctacactg

SEQ ID NO: 5663986 - DNA, 17 bp, Homo sapiens
attactctacactgaaa

SEQ ID NO: 5663987 - DNA, 16 bp, Homo sapiens
attactctagtttatt

SEQ ID NO: 5663988 - DNA, 15 bp, Homo sapiens
attactctattgata

SEQ ID NO: 5663989 - DNA, 19 bp, Homo sapiens
attactctcacccataaac

SEQ ID NO: 5663990 - DNA, 20 bp, Homo sapiens
attactctcacccataaaca

SEQ ID NO: 5663991 - DNA, 14 bp, Homo sapiens
attactctgacata

SEQ ID NO: 5663992 - DNA, 22 bp, Homo sapiens
attactctgcggtggtgccaga

SEQ ID NO: 5663993 - DNA, 15 bp, Homo sapiens
attactcttaaggaa

SEQ ID NO: 5663994 - DNA, 16 bp, Homo sapiens
attactcttcctctaa

SEQ ID NO: 5663995 - DNA, 15 bp, Homo sapiens
attactcttgtaaga

SEQ ID NO: 5663996 - DNA, 22 bp, Homo sapiens
attactcttgtaagattttgaa

SEQ ID NO: 5663997 - DNA, 16 bp, Homo sapiens
attactctttgctttg

SEQ ID NO: 5663998 - DNA, 13 bp, Homo sapiens
attactgacattt

SEQ ID NO: 5663999 - DNA, 15 bp, Homo sapiens
attactgacatttct

SEQ ID NO: 5664000 - DNA, 15 bp, Homo sapiens
attactgaccgtatg

SEQ ID NO: 5664001 - DNA, 17 bp, Homo sapiens
attactgatatcagagt

SEQ ID NO: 5664002 - DNA, 19 bp, Homo sapiens
attactgatttagaagcaa

SEQ ID NO: 5664003 - DNA, 16 bp, Homo sapiens
attactgcaatcactg

SEQ ID NO: 5664004 - DNA, 13 bp, Homo sapiens
attactgccattc

SEQ ID NO: 5664005 - DNA, 17 bp, Homo sapiens
attactgcccagatgtt

SEQ ID NO: 5664006 - DNA, 18 bp, Homo sapiens
attactgcccagatgttt

SEQ ID NO: 5664007 - DNA, 18 bp, Homo sapiens
attactgcctgcagagat

SEQ ID NO: 5664008 - DNA, 20 bp, Homo sapiens
attactgcctgcagagatat

SEQ ID NO: 5664009 - DNA, 12 bp, Homo sapiens
attactgctaag

SEQ ID NO: 5664010 - DNA, 21 bp, Homo sapiens
attactgctaagtatttccca

SEQ ID NO: 5664011 - DNA, 13 bp, Homo sapiens
attactgctgctg

SEQ ID NO: 5664012 - DNA, 17 bp, Homo sapiens
attactgctgctgtgct

SEQ ID NO: 5664013 - DNA, 16 bp, Homo sapiens
attactgcttgcagta

SEQ ID NO: 5664014 - DNA, 23 bp, Homo sapiens
attactggagccatgtctacaaa

SEQ ID NO: 5664015 - DNA, 17 bp, Homo sapiens
attactggcctttttca

SEQ ID NO: 5664016 - DNA, 18 bp, Homo sapiens
attactggcgtggattaa

SEQ ID NO: 5664017 - DNA, 21 bp, Homo sapiens
attactggcgtggattaaact

SEQ ID NO: 5664018 - DNA, 22 bp, Homo sapiens
attactggcgtggattaaactt

SEQ ID NO: 5664019 - DNA, 23 bp, Homo sapiens
attactggcgtggattaaactta

SEQ ID NO: 5664020 - DNA, 12 bp, Homo sapiens
attactgggcct

SEQ ID NO: 5664021 - DNA, 18 bp, Homo sapiens
attactgtacacattaag

SEQ ID NO: 5664022 - DNA, 23 bp, Homo sapiens
attactgtatgtataaattatga

SEQ ID NO: 5664023 - DNA, 15 bp, Homo sapiens
attactgtcaataaa

SEQ ID NO: 5664024 - DNA, 16 bp, Homo sapiens
attactgtcaataaac

SEQ ID NO: 5664025 - DNA, 18 bp, Homo sapiens
attactgtctggttttaa

SEQ ID NO: 5664026 - DNA, 19 bp, Homo sapiens
attactgtctttattctta

SEQ ID NO: 5664027 - DNA, 10 bp, Homo sapiens
attactgtga

SEQ ID NO: 5664028 - DNA, 20 bp, Homo sapiens
attactgtgagaactgtgaa

SEQ ID NO: 5664029 - DNA, 15 bp, Homo sapiens
attactgtgatttct

SEQ ID NO: 5664030 - DNA, 15 bp, Homo sapiens
attactgttccagat

SEQ ID NO: 5664031 - DNA, 18 bp, Homo sapiens
attactgtttattacttc

SEQ ID NO: 5664032 - DNA, 14 bp, Homo sapiens
attactgtttctaa

SEQ ID NO: 5664033 - DNA, 22 bp, Homo sapiens
attactgtttgaaacttttcaa

SEQ ID NO: 5664034 - DNA, 22 bp, Homo sapiens
attactgtttgtcttctcccca

SEQ ID NO: 5664035 - DNA, 21 bp, Homo sapiens
attactgtttgttctcttatt

SEQ ID NO: 5664036 - DNA, 18 bp, Homo sapiens
attactgttttgggcctc

SEQ ID NO: 5664037 - DNA, 12 bp, Homo sapiens
attacttaatgt

SEQ ID NO: 5664038 - DNA, 24 bp, Homo sapiens
attacttacgtatgtttgtacttg

SEQ ID NO: 5664039 - DNA, 13 bp, Homo sapiens
attacttagagga

SEQ ID NO: 5664040 - DNA, 19 bp, Homo sapiens
attacttatcatccacatt

SEQ ID NO: 5664041 - DNA, 16 bp, Homo sapiens
attaggagtaattctt

SEQ ID NO: 5664042 - DNA, 16 bp, Homo sapiens
attaggataactaaaa

SEQ ID NO: 5664043 - DNA, 19 bp, Homo sapiens
attaggataactaaaattc

SEQ ID NO: 5664044 - DNA, 20 bp, Homo sapiens
attaggatctatgcaatttt

SEQ ID NO: 5664045 - DNA, 17 bp, Homo sapiens
attaggcaaagtacaaa

SEQ ID NO: 5664046 - DNA, 20 bp, Homo sapiens
attaggcaaagtacaaaatt

SEQ ID NO: 5664047 - DNA, 20 bp, Homo sapiens
attaggcataaattaaaatg

SEQ ID NO: 5664048 - DNA, 21 bp, Homo sapiens
attaggcataaattaaaatgt

SEQ ID NO: 5664049 - DNA, 16 bp, Homo sapiens
attaggcatggttttg

SEQ ID NO: 5664050 - DNA, 14 bp, Homo sapiens
attaggccccagca

SEQ ID NO: 5664051 - DNA, 15 bp, Homo sapiens
attaggccccagcaa

SEQ ID NO: 5664052 - DNA, 14 bp, Homo sapiens
attaggcctggagt

SEQ ID NO: 5664053 - DNA, 19 bp, Homo sapiens
attaggccttatgtaagga

SEQ ID NO: 5664054 - DNA, 19 bp, Homo sapiens
attaggctcttttaggtaa

SEQ ID NO: 5664055 - DNA, 14 bp, Homo sapiens
attaggctgtaact

SEQ ID NO: 5664056 - DNA, 21 bp, Homo sapiens
attaggctgtaactactttat

SEQ ID NO: 5664057 - DNA, 23 bp, Homo sapiens
attaggctgtaactactttataa

SEQ ID NO: 5664058 - DNA, 11 bp, Homo sapiens
attaggctgtt

SEQ ID NO: 5664059 - DNA, 20 bp, Homo sapiens
attaggcttcattgcactga

SEQ ID NO: 5664060 - DNA, 16 bp, Homo sapiens
attagggagagaagat

SEQ ID NO: 5664061 - DNA, 18 bp, Homo sapiens
attagggctacattgtaa

SEQ ID NO: 5664062 - DNA, 22 bp, Homo sapiens
attaggggttgctaagaagcga

SEQ ID NO: 5664063 - DNA, 19 bp, Homo sapiens
attaggtactatctgtgaa

SEQ ID NO: 5664064 - DNA, 15 bp, Homo sapiens
attaggtatatctcc

SEQ ID NO: 5664065 - DNA, 17 bp, Homo sapiens
attaggtatgtttgtaa

SEQ ID NO: 5664066 - DNA, 19 bp, Homo sapiens
attaggtatgtttgtaact

SEQ ID NO: 5664067 - DNA, 21 bp, Homo sapiens
attaggtatgtttgtaacttt

SEQ ID NO: 5664068 - DNA, 13 bp, Homo sapiens
attaggtattttg

SEQ ID NO: 5664069 - DNA, 21 bp, Homo sapiens
attaggtcgttttccaaagag

SEQ ID NO: 5664070 - DNA, 20 bp, Homo sapiens
attaggtctgcattttctca

SEQ ID NO: 5664071 - DNA, 19 bp, Homo sapiens
attaggtggaaattttata

SEQ ID NO: 5664072 - DNA, 13 bp, Homo sapiens
attaggttaacta

SEQ ID NO: 5664073 - DNA, 15 bp, Homo sapiens
attaggttaactatg

SEQ ID NO: 5664074 - DNA, 14 bp, Homo sapiens
attaggttaagtct

SEQ ID NO: 5664075 - DNA, 16 bp, Homo sapiens
attaggttgaaacata

SEQ ID NO: 5664076 - DNA, 23 bp, Homo sapiens
attaggttgaaacatatctctta

SEQ ID NO: 5664077 - DNA, 15 bp, Homo sapiens
attaggttgtgaatg

SEQ ID NO: 5664078 - DNA, 23 bp, Homo sapiens
attagtaaaacacaagacttcag

SEQ ID NO: 5664079 - DNA, 14 bp, Homo sapiens
attagtaaagaaat

SEQ ID NO: 5664080 - DNA, 14 bp, Homo sapiens
attagtaaatgtct

SEQ ID NO: 5664081 - DNA, 16 bp, Homo sapiens
attagtaaatgtcttt

SEQ ID NO: 5664082 - DNA, 13 bp, Homo sapiens
attagtaacatgt

SEQ ID NO: 5664083 - DNA, 21 bp, Homo sapiens
attagtaacattcatgttcta

SEQ ID NO: 5664084 - DNA, 21 bp, Homo sapiens
attagtaagatctctttctaa

SEQ ID NO: 5664085 - DNA, 14 bp, Homo sapiens
attagtaattgtaa

SEQ ID NO: 5664086 - DNA, 16 bp, Homo sapiens
attagtaattgtaagt

SEQ ID NO: 5664087 - DNA, 22 bp, Homo sapiens
attagtacagtagcttaaataa

SEQ ID NO: 5664088 - DNA, 20 bp, Homo sapiens
attagtactcccctccttga

SEQ ID NO: 5664089 - DNA, 17 bp, Homo sapiens
attagtactggattatt

SEQ ID NO: 5664090 - DNA, 18 bp, Homo sapiens
attagtagaaaatacatt

SEQ ID NO: 5664091 - DNA, 21 bp, Homo sapiens
attagtagaaaatacattatt

SEQ ID NO: 5664092 - DNA, 13 bp, Homo sapiens
attagtagaaatg

SEQ ID NO: 5664093 - DNA, 22 bp, Homo sapiens
attagtagaaatgccagaaaca

SEQ ID NO: 5664094 - DNA, 19 bp, Homo sapiens
attagtatggttcaagatt

SEQ ID NO: 5664095 - DNA, 21 bp, Homo sapiens
attagtatgtatgtgtaccta

SEQ ID NO: 5664096 - DNA, 15 bp, Homo sapiens
attagtattgttgtc

SEQ ID NO: 5664097 - DNA, 17 bp, Homo sapiens
attagtcatagaagaac

SEQ ID NO: 5664098 - DNA, 15 bp, Homo sapiens
attagtcatgtttat

SEQ ID NO: 5664099 - DNA, 16 bp, Homo sapiens
atttcgaagtttgcaa

SEQ ID NO: 5664100 - DNA, 15 bp, Homo sapiens
atttcgatgtacagt

SEQ ID NO: 5664101 - DNA, 15 bp, Homo sapiens
atttcgccttaaact

SEQ ID NO: 5664102 - DNA, 20 bp, Homo sapiens
atttcggaccgaaggtgaca

SEQ ID NO: 5664103 - DNA, 20 bp, Homo sapiens
atttcggattttttccaaaa

SEQ ID NO: 5664104 - DNA, 15 bp, Homo sapiens
atttcggctatgtct

SEQ ID NO: 5664105 - DNA, 20 bp, Homo sapiens
atttcgggtgaatctgtcta

SEQ ID NO: 5664106 - DNA, 16 bp, Homo sapiens
atttcggtgcttccct

SEQ ID NO: 5664107 - DNA, 13 bp, Homo sapiens
atttcgtgtaata

SEQ ID NO: 5664108 - DNA, 17 bp, Homo sapiens
atttcgtgtactgcaaa

SEQ ID NO: 5664109 - DNA, 19 bp, Homo sapiens
atttcgtgttgtgttcttt

SEQ ID NO: 5664110 - DNA, 23 bp, Homo sapiens
atttcgtgttgtgttctttataa

SEQ ID NO: 5664111 - DNA, 13 bp, Homo sapiens
atttcgttccctg

SEQ ID NO: 5664112 - DNA, 20 bp, Homo sapiens
atttcgttccctgattattt

SEQ ID NO: 5664113 - DNA, 21 bp, Homo sapiens
atttcgttgtccaatttgtaa

SEQ ID NO: 5664114 - DNA, 21 bp, Homo sapiens
atttcgtttggtcttaggtct

SEQ ID NO: 5664115 - DNA, 22 bp, Homo sapiens
atttcgtttggtcttaggtctt

SEQ ID NO: 5664116 - DNA, 20 bp, Homo sapiens
atttctaaaaaacagaggcc

SEQ ID NO: 5664117 - DNA, 20 bp, Homo sapiens
atttctaaaacattaattga

SEQ ID NO: 5664118 - DNA, 11 bp, Homo sapiens
atttctaaacc

SEQ ID NO: 5664119 - DNA, 23 bp, Homo sapiens
atttctaaaccacaaaagttgtt

SEQ ID NO: 5664120 - DNA, 12 bp, Homo sapiens
atttctaaagta

SEQ ID NO: 5664121 - DNA, 20 bp, Homo sapiens
atttctaaataaaaaaatta

SEQ ID NO: 5664122 - DNA, 22 bp, Homo sapiens
atttctaaataaggaatttcct

SEQ ID NO: 5664123 - DNA, 18 bp, Homo sapiens
atttctaaatcctcacta

SEQ ID NO: 5664124 - DNA, 13 bp, Homo sapiens
atttctaaatctc

SEQ ID NO: 5664125 - DNA, 13 bp, Homo sapiens
atttctaaattta

SEQ ID NO: 5664126 - DNA, 14 bp, Homo sapiens
atttctaaatttat

SEQ ID NO: 5664127 - DNA, 15 bp, Homo sapiens
atttctaaatttata

SEQ ID NO: 5664128 - DNA, 17 bp, Homo sapiens
atttctaaatttgcagg

SEQ ID NO: 5664129 - DNA, 19 bp, Homo sapiens
atttctaacagtccttgct

SEQ ID NO: 5664130 - DNA, 23 bp, Homo sapiens
atttctaacagtccttgctttgg

SEQ ID NO: 5664131 - DNA, 17 bp, Homo sapiens
atttctaacatatgtat

SEQ ID NO: 5664132 - DNA, 18 bp, Homo sapiens
atttctaactaaggacag

SEQ ID NO: 5664133 - DNA, 15 bp, Homo sapiens
atttctaactctgat

SEQ ID NO: 5664134 - DNA, 18 bp, Homo sapiens
atttctaactctgatgta

SEQ ID NO: 5664135 - DNA, 23 bp, Homo sapiens
atttctaactctgatgtaaatga

SEQ ID NO: 5664136 - DNA, 14 bp, Homo sapiens
atttctaagaaata

SEQ ID NO: 5664137 - DNA, 16 bp, Homo sapiens
atttctaagaagttgt

SEQ ID NO: 5664138 - DNA, 17 bp, Homo sapiens
atttctaagactactaa

SEQ ID NO: 5664139 - DNA, 14 bp, Homo sapiens
atttctaagtattt

SEQ ID NO: 5664140 - DNA, 15 bp, Homo sapiens
atttctaagtattta

SEQ ID NO: 5664141 - DNA, 19 bp, Homo sapiens
atttctaattatgtagctc

SEQ ID NO: 5664142 - DNA, 21 bp, Homo sapiens
atttctaattatgtagctctt

SEQ ID NO: 5664143 - DNA, 16 bp, Homo sapiens
atttctaattccacag

SEQ ID NO: 5664144 - DNA, 12 bp, Homo sapiens
atttctaattgt

SEQ ID NO: 5664145 - DNA, 17 bp, Homo sapiens
atttctaatttgaatga

SEQ ID NO: 5664146 - DNA, 18 bp, Homo sapiens
atttctacaactggagtt

SEQ ID NO: 5664147 - DNA, 21 bp, Homo sapiens
atttctacaactggagttttt

SEQ ID NO: 5664148 - DNA, 19 bp, Homo sapiens
atttctacatagtaactct

SEQ ID NO: 5664149 - DNA, 21 bp, Homo sapiens
atttctacatagtaactctta

SEQ ID NO: 5664150 - DNA, 13 bp, Homo sapiens
atttctacctcag

SEQ ID NO: 5664151 - DNA, 15 bp, Homo sapiens
atttctacctcagca

SEQ ID NO: 5664152 - DNA, 13 bp, Homo sapiens
atttctactctag

SEQ ID NO: 5664153 - DNA, 21 bp, Homo sapiens
atttctactctcccatggctt

SEQ ID NO: 5664154 - DNA, 21 bp, Homo sapiens
atttctactcttaagtttctc

SEQ ID NO: 5664155 - DNA, 13 bp, Homo sapiens
atttctactgaag

SEQ ID NO: 5664156 - DNA, 15 bp, Homo sapiens
atttctactgaagtt

SEQ ID NO: 5664157 - DNA, 15 bp, Homo sapiens
atttctactgtataa

SEQ ID NO: 5664158 - DNA, 18 bp, Homo sapiens
atttctactgtataaaca

SEQ ID NO: 5664159 - DNA, 20 bp, Homo sapiens
atttctactgtataaacaaa

SEQ ID NO: 5664160 - DNA, 17 bp, Homo sapiens
atttctactgtgactga

SEQ ID NO: 5664161 - DNA, 15 bp, Homo sapiens
atttctactgtgtga

SEQ ID NO: 5664162 - DNA, 18 bp, Homo sapiens
atttctactttgaagtca

SEQ ID NO: 5664163 - DNA, 16 bp, Homo sapiens
atttctactttgacta

SEQ ID NO: 5664164 - DNA, 20 bp, Homo sapiens
atttctactttgataaagta

SEQ ID NO: 5664165 - DNA, 24 bp, Homo sapiens
atttctagaaaagcttcctagctt

SEQ ID NO: 5664166 - DNA, 18 bp, Homo sapiens
atttctagaacaattaca

SEQ ID NO: 5664167 - DNA, 20 bp, Homo sapiens
atttctagaagcacatgtgt

SEQ ID NO: 5664168 - DNA, 23 bp, Homo sapiens
atttctagatatgagaaatataa

SEQ ID NO: 5664169 - DNA, 13 bp, Homo sapiens
atttctagcagag

SEQ ID NO: 5664170 - DNA, 14 bp, Homo sapiens
atttctagcagagt

SEQ ID NO: 5664171 - DNA, 19 bp, Homo sapiens
atttctagcctgcactttg

SEQ ID NO: 5664172 - DNA, 18 bp, Homo sapiens
atttctaggactgaatta

SEQ ID NO: 5664173 - DNA, 16 bp, Homo sapiens
atttctaggcaaaatt

SEQ ID NO: 5664174 - DNA, 18 bp, Homo sapiens
atttctaggcacaaggtt

SEQ ID NO: 5664175 - DNA, 18 bp, Homo sapiens
atttctagggaaattttt

SEQ ID NO: 5664176 - DNA, 20 bp, Homo sapiens
atttctaggtaggaaatgtg

SEQ ID NO: 5664177 - DNA, 20 bp, Homo sapiens
atttctagtacctgtgactc

SEQ ID NO: 5664178 - DNA, 20 bp, Homo sapiens
atttctagtccaaaattaca

SEQ ID NO: 5664179 - DNA, 16 bp, Homo sapiens
atttctagtgtatact

SEQ ID NO: 5664180 - DNA, 17 bp, Homo sapiens
atttctagttatttatt

SEQ ID NO: 5664181 - DNA, 18 bp, Homo sapiens
atttctagttatttattc

SEQ ID NO: 5664182 - DNA, 22 bp, Homo sapiens
atttctataaaaatactacaat

SEQ ID NO: 5664183 - DNA, 14 bp, Homo sapiens
atttctataaatag

SEQ ID NO: 5664184 - DNA, 13 bp, Homo sapiens
atttctataaatt

SEQ ID NO: 5664185 - DNA, 12 bp, Homo sapiens
atttctatactt

SEQ ID NO: 5664186 - DNA, 15 bp, Homo sapiens
atttctatagccaaa

SEQ ID NO: 5664187 - DNA, 23 bp, Homo sapiens
atttctatagccaaaaatagcta

SEQ ID NO: 5664188 - DNA, 22 bp, Homo sapiens
atttctatatagacttggagaa

SEQ ID NO: 5664189 - DNA, 16 bp, Homo sapiens
atttctatattcctcc

SEQ ID NO: 5664190 - DNA, 18 bp, Homo sapiens
atttctatattcctccag

SEQ ID NO: 5664191 - DNA, 19 bp, Homo sapiens
atttctatattcctccagc

SEQ ID NO: 5664192 - DNA, 15 bp, Homo sapiens
atttctatatttatt

SEQ ID NO: 5664193 - DNA, 15 bp, Homo sapiens
atttctatattttca

SEQ ID NO: 5664194 - DNA, 13 bp, Homo sapiens
atttctatcccaa

SEQ ID NO: 5664195 - DNA, 13 bp, Homo sapiens
atttctatctgca

SEQ ID NO: 5664196 - DNA, 19 bp, Homo sapiens
atttctatcttgttccaag

SEQ ID NO: 5664197 - DNA, 14 bp, Homo sapiens
atttctatgaaata

SEQ ID NO: 5664198 - DNA, 13 bp, Homo sapiens
atttctatgacaa

SEQ ID NO: 5664199 - DNA, 17 bp, Homo sapiens
atttctatgacaaattc

SEQ ID NO: 5664200 - DNA, 22 bp, Homo sapiens
atttctatgctgagtttgtgct

SEQ ID NO: 5664201 - DNA, 18 bp, Homo sapiens
atttctatggctttcaaa

SEQ ID NO: 5664202 - DNA, 13 bp, Homo sapiens
atttctatgtcat

SEQ ID NO: 5664203 - DNA, 21 bp, Homo sapiens
atttctatgtcatttttaatg

SEQ ID NO: 5664204 - DNA, 17 bp, Homo sapiens
atttctatgttgtaata

SEQ ID NO: 5664205 - DNA, 18 bp, Homo sapiens
atttctatgttgtaatat

SEQ ID NO: 5664206 - DNA, 15 bp, Homo sapiens
atttctattaaaggt

SEQ ID NO: 5664207 - DNA, 23 bp, Homo sapiens
atttctattcaaggtggccaaat

SEQ ID NO: 5664208 - DNA, 15 bp, Homo sapiens
atttctattccttat

SEQ ID NO: 5664209 - DNA, 15 bp, Homo sapiens
atttctattttgcaa

SEQ ID NO: 5664210 - DNA, 18 bp, Homo sapiens
atttctatttttgtagaa

SEQ ID NO: 5664211 - DNA, 13 bp, Homo sapiens
atttctcaaagtt

SEQ ID NO: 5664212 - DNA, 22 bp, Homo sapiens
atttctcaacaaagcacagtgt

SEQ ID NO: 5664213 - DNA, 20 bp, Homo sapiens
atttctcaatagttcttaaa

SEQ ID NO: 5664214 - DNA, 16 bp, Homo sapiens
atttctcaatcagtgc

SEQ ID NO: 5664215 - DNA, 21 bp, Homo sapiens
atttctcacaatagacagaaa

SEQ ID NO: 5664216 - DNA, 23 bp, Homo sapiens
atttctcacactctaactgtata

SEQ ID NO: 5664217 - DNA, 14 bp, Homo sapiens
atttctcactagtg

SEQ ID NO: 5664218 - DNA, 15 bp, Homo sapiens
cactgcactccagcc

SEQ ID NO: 5664219 - DNA, 17 bp, Homo sapiens
cactgcactccagcctg

SEQ ID NO: 5664220 - DNA, 19 bp, Homo sapiens
cactgcactccagcctgag

SEQ ID NO: 5664221 - DNA, 20 bp, Homo sapiens
cactgcactccagcctgggt

SEQ ID NO: 5664222 - DNA, 13 bp, Homo sapiens
cactgcactctag

SEQ ID NO: 5664223 - DNA, 14 bp, Homo sapiens
cactgcactttgtt

SEQ ID NO: 5664224 - DNA, 17 bp, Homo sapiens
cactgcagaaaccctga

SEQ ID NO: 5664225 - DNA, 21 bp, Homo sapiens
cactgcagaacagcttcatgt

SEQ ID NO: 5664226 - DNA, 12 bp, Homo sapiens
cactgcagacgg

SEQ ID NO: 5664227 - DNA, 13 bp, Homo sapiens
cactgcagacttg

SEQ ID NO: 5664228 - DNA, 17 bp, Homo sapiens
cactgcagacttgtcca

SEQ ID NO: 5664229 - DNA, 17 bp, Homo sapiens
cactgcagatttctcac

SEQ ID NO: 5664230 - DNA, 14 bp, Homo sapiens
cactgcagcccagg

SEQ ID NO: 5664231 - DNA, 15 bp, Homo sapiens
cactgcagcccagga

SEQ ID NO: 5664232 - DNA, 12 bp, Homo sapiens
cactgcagcctc

SEQ ID NO: 5664233 - DNA, 14 bp, Homo sapiens
cactgcagcctcaa

SEQ ID NO: 5664234 - DNA, 19 bp, Homo sapiens
cactgcagcctcaacctcc

SEQ ID NO: 5664235 - DNA, 22 bp, Homo sapiens
cactgcagcctcaacctcctgg

SEQ ID NO: 5664236 - DNA, 19 bp, Homo sapiens
cactgcagcctcatactcc

SEQ ID NO: 5664237 - DNA, 19 bp, Homo sapiens
cactgcagcctccgcttcc

SEQ ID NO: 5664238 - DNA, 22 bp, Homo sapiens
cactgcagcctcgacctccctg

SEQ ID NO: 5664239 - DNA, 13 bp, Homo sapiens
cactgcagcctct

SEQ ID NO: 5664240 - DNA, 12 bp, Homo sapiens
cactgcaggaca

SEQ ID NO: 5664241 - DNA, 13 bp, Homo sapiens
cactgcaggcccc

SEQ ID NO: 5664242 - DNA, 14 bp, Homo sapiens
cactgcagggagga

SEQ ID NO: 5664243 - DNA, 16 bp, Homo sapiens
cactgcagggctgctg

SEQ ID NO: 5664244 - DNA, 19 bp, Homo sapiens
cactgcagggctgctgtgg

SEQ ID NO: 5664245 - DNA, 13 bp, Homo sapiens
cactgcaggggcc

SEQ ID NO: 5664246 - DNA, 18 bp, Homo sapiens
cactgcagtcacccctgt

SEQ ID NO: 5664247 - DNA, 14 bp, Homo sapiens
cactgcagtcagat

SEQ ID NO: 5664248 - DNA, 23 bp, Homo sapiens
cactgcagtccgcagtctggcct

SEQ ID NO: 5664249 - DNA, 16 bp, Homo sapiens
cactgcatcctccgcc

SEQ ID NO: 5664250 - DNA, 16 bp, Homo sapiens
cactgcatctcaagat

SEQ ID NO: 5664251 - DNA, 20 bp, Homo sapiens
cactgcatgcggcaaaccgc

SEQ ID NO: 5664252 - DNA, 24 bp, Homo sapiens
cactgcatgggaaatagcggccct

SEQ ID NO: 5664253 - DNA, 16 bp, Homo sapiens
cactgcatgtcagagc

SEQ ID NO: 5664254 - DNA, 19 bp, Homo sapiens
cactgcattcattctgagc

SEQ ID NO: 5664255 - DNA, 20 bp, Homo sapiens
cactgcattcattctgagcc

SEQ ID NO: 5664256 - DNA, 17 bp, Homo sapiens
cactgccaaataaacag

SEQ ID NO: 5664257 - DNA, 19 bp, Homo sapiens
cactgccaaataaacagct

SEQ ID NO: 5664258 - DNA, 17 bp, Homo sapiens
cactgccacaccctccc

SEQ ID NO: 5664259 - DNA, 13 bp, Homo sapiens
cactgccaccagc

SEQ ID NO: 5664260 - DNA, 23 bp, Homo sapiens
cactgccaccagcaatgccctgc

SEQ ID NO: 5664261 - DNA, 21 bp, Homo sapiens
cactgccactaaaatccaccc

SEQ ID NO: 5664262 - DNA, 13 bp, Homo sapiens
cactgccactcca

SEQ ID NO: 5664263 - DNA, 21 bp, Homo sapiens
cactgccactccagtcctgcc

SEQ ID NO: 5664264 - DNA, 12 bp, Homo sapiens
cactgccactgg

SEQ ID NO: 5664265 - DNA, 18 bp, Homo sapiens
cactgccactttgcacat

SEQ ID NO: 5664266 - DNA, 13 bp, Homo sapiens
cactgccagagct

SEQ ID NO: 5664267 - DNA, 12 bp, Homo sapiens
cactgccagcag

SEQ ID NO: 5664268 - DNA, 14 bp, Homo sapiens
cactgccagcagca

SEQ ID NO: 5664269 - DNA, 16 bp, Homo sapiens
cactgccagcagcagc

SEQ ID NO: 5664270 - DNA, 21 bp, Homo sapiens
cactgccagcagcagcaggtg

SEQ ID NO: 5664271 - DNA, 22 bp, Homo sapiens
cactgccagcagcagcaggtga

SEQ ID NO: 5664272 - DNA, 14 bp, Homo sapiens
cactgccagcagct

SEQ ID NO: 5664273 - DNA, 18 bp, Homo sapiens
cactgccagcatttccct

SEQ ID NO: 5664274 - DNA, 13 bp, Homo sapiens
cactgccagccca

SEQ ID NO: 5664275 - DNA, 14 bp, Homo sapiens
cactgccagccgcc

SEQ ID NO: 5664276 - DNA, 15 bp, Homo sapiens
cactgccagccgcca

SEQ ID NO: 5664277 - DNA, 13 bp, Homo sapiens
cactgccaggagg

SEQ ID NO: 5664278 - DNA, 15 bp, Homo sapiens
cactgccaggaggga

SEQ ID NO: 5664279 - DNA, 16 bp, Homo sapiens
cactgccaggagggac

SEQ ID NO: 5664280 - DNA, 17 bp, Homo sapiens
cactgccaggagggaca

SEQ ID NO: 5664281 - DNA, 15 bp, Homo sapiens
cactgccaggcacct

SEQ ID NO: 5664282 - DNA, 16 bp, Homo sapiens
cactgccaggcacctg

SEQ ID NO: 5664283 - DNA, 22 bp, Homo sapiens
cactgccaggcacctggcctgc

SEQ ID NO: 5664284 - DNA, 18 bp, Homo sapiens
cactgccaggccagcctc

SEQ ID NO: 5664285 - DNA, 17 bp, Homo sapiens
cactgccataaaacatt

SEQ ID NO: 5664286 - DNA, 14 bp, Homo sapiens
cactgccatatact

SEQ ID NO: 5664287 - DNA, 13 bp, Homo sapiens
cactgccatattg

SEQ ID NO: 5664288 - DNA, 18 bp, Homo sapiens
cactgccatattgtgtaa

SEQ ID NO: 5664289 - DNA, 21 bp, Homo sapiens
cactgccatcggacaggagga

SEQ ID NO: 5664290 - DNA, 22 bp, Homo sapiens
cactgccatcggacaggaggat

SEQ ID NO: 5664291 - DNA, 20 bp, Homo sapiens
cactgccatcttagtttgga

SEQ ID NO: 5664292 - DNA, 11 bp, Homo sapiens
cactgccatgc

SEQ ID NO: 5664293 - DNA, 17 bp, Homo sapiens
cactgccatggaggcac

SEQ ID NO: 5664294 - DNA, 20 bp, Homo sapiens
cactgcccaaagtgcttcca

SEQ ID NO: 5664295 - DNA, 21 bp, Homo sapiens
cactgcccaaagtgcttccaa

SEQ ID NO: 5664296 - DNA, 15 bp, Homo sapiens
cactgcccaccaaag

SEQ ID NO: 5664297 - DNA, 14 bp, Homo sapiens
cactgcccaccccc

SEQ ID NO: 5664298 - DNA, 17 bp, Homo sapiens
cactgcccaccccctca

SEQ ID NO: 5664299 - DNA, 18 bp, Homo sapiens
cactgcccaccccctcaa

SEQ ID NO: 5664300 - DNA, 17 bp, Homo sapiens
cactgcccacctgccag

SEQ ID NO: 5664301 - DNA, 22 bp, Homo sapiens
cactgcccacctgccaggctgc

SEQ ID NO: 5664302 - DNA, 13 bp, Homo sapiens
cactgcccactgg

SEQ ID NO: 5664303 - DNA, 13 bp, Homo sapiens
cactgcccaggga

SEQ ID NO: 5664304 - DNA, 21 bp, Homo sapiens
cactgcccagggaagccctcg

SEQ ID NO: 5664305 - DNA, 12 bp, Homo sapiens
cactgcccatcc

SEQ ID NO: 5664306 - DNA, 16 bp, Homo sapiens
cactgcccatcccacc

SEQ ID NO: 5664307 - DNA, 17 bp, Homo sapiens
cactgcccatggacagg

SEQ ID NO: 5664308 - DNA, 15 bp, Homo sapiens
cactgccccacatgc

SEQ ID NO: 5664309 - DNA, 17 bp, Homo sapiens
cactgccccacatgcat

SEQ ID NO: 5664310 - DNA, 14 bp, Homo sapiens
cactgccccaccag

SEQ ID NO: 5664311 - DNA, 21 bp, Homo sapiens
cactgccccaccagccacctc

SEQ ID NO: 5664312 - DNA, 19 bp, Homo sapiens
cactgccccacgttgtccc

SEQ ID NO: 5664313 - DNA, 16 bp, Homo sapiens
cactgccccactattt

SEQ ID NO: 5664314 - DNA, 22 bp, Homo sapiens
cactgccccccgaggctgctag

SEQ ID NO: 5664315 - DNA, 12 bp, Homo sapiens
cactgccccctc

SEQ ID NO: 5664316 - DNA, 15 bp, Homo sapiens
cactgccccctgctt

SEQ ID NO: 5664317 - DNA, 15 bp, Homo sapiens
cactgcccgaggcgc

SEQ ID NO: 5664318 - DNA, 19 bp, Homo sapiens
cactgcccgcacaccctca

SEQ ID NO: 5664319 - DNA, 18 bp, Homo sapiens
cactgccctccagggcca

SEQ ID NO: 5664320 - DNA, 14 bp, Homo sapiens
cactgccctctcca

SEQ ID NO: 5664321 - DNA, 19 bp, Homo sapiens
cactgccctctccacaccc

SEQ ID NO: 5664322 - DNA, 23 bp, Homo sapiens
cactgccctctgccactgacagg

SEQ ID NO: 5664323 - DNA, 13 bp, Homo sapiens
cactgccctgcct

SEQ ID NO: 5664324 - DNA, 17 bp, Homo sapiens
cactgccctgcctgccc

SEQ ID NO: 5664325 - DNA, 14 bp, Homo sapiens
cactgccctggcag

SEQ ID NO: 5664326 - DNA, 18 bp, Homo sapiens
cactgccctggcagcagc

SEQ ID NO: 5664327 - DNA, 19 bp, Homo sapiens
cactgccctggcagcagca

SEQ ID NO: 5664328 - DNA, 19 bp, Homo sapiens
cactgccctggtggccctc

SEQ ID NO: 5664329 - DNA, 18 bp, Homo sapiens
cactgcccttttcaggaa

SEQ ID NO: 5664330 - DNA, 20 bp, Homo sapiens
cactgcccttttcaggaagc

SEQ ID NO: 5664331 - DNA, 20 bp, Homo sapiens
cactgccctttttgaaatca

SEQ ID NO: 5664332 - DNA, 15 bp, Homo sapiens
cactgccgcctactg

SEQ ID NO: 5664333 - DNA, 15 bp, Homo sapiens
cactgccgcctcctt

SEQ ID NO: 5664334 - DNA, 14 bp, Homo sapiens
cactgccggcagga

SEQ ID NO: 5664335 - DNA, 23 bp, Homo sapiens
cactgccgtcacccactctgcac

SEQ ID NO: 5664336 - DNA, 19 bp, Homo sapiens
cactgcctaggaggctggc

SEQ ID NO: 5664337 - DNA, 21 bp, Homo sapiens
cactgcctatgaacagaccat

SEQ ID NO: 5664338 - DNA, 17 bp, Homo sapiens
cactgcctcaggttcct

SEQ ID NO: 5664339 - DNA, 14 bp, Homo sapiens
cactgcctccatga

SEQ ID NO: 5664340 - DNA, 18 bp, Homo sapiens
cactgcctccatgatgca

SEQ ID NO: 5664341 - DNA, 23 bp, Homo sapiens
cactgcctccccaaggccccctg

SEQ ID NO: 5664342 - DNA, 11 bp, Homo sapiens
cactgcctcct

SEQ ID NO: 5664343 - DNA, 21 bp, Homo sapiens
cactgcctcctccctggctgc

SEQ ID NO: 5664344 - DNA, 18 bp, Homo sapiens
cactgcctcctgcctggg

SEQ ID NO: 5664345 - DNA, 13 bp, Homo sapiens
cactgcctcctgt

SEQ ID NO: 5664346 - DNA, 22 bp, Homo sapiens
cactgcctcgggaacctcactc

SEQ ID NO: 5664347 - DNA, 23 bp, Homo sapiens
cactgcctcgggaacctcactct

SEQ ID NO: 5664348 - DNA, 19 bp, Homo sapiens
cactgcctctatgccctgc

SEQ ID NO: 5664349 - DNA, 16 bp, Homo sapiens
cactgcctctcacagc

SEQ ID NO: 5664350 - DNA, 17 bp, Homo sapiens
cactgcctctcacagct

SEQ ID NO: 5664351 - DNA, 16 bp, Homo sapiens
cactgcctctccctct

SEQ ID NO: 5664352 - DNA, 16 bp, Homo sapiens
cactgcctctccctgg

SEQ ID NO: 5664353 - DNA, 18 bp, Homo sapiens
cactgcctctccctggcc

SEQ ID NO: 5664354 - DNA, 20 bp, Homo sapiens
cactgcctctccctggccct

SEQ ID NO: 5664355 - DNA, 12 bp, Homo sapiens
cactgcctctga

SEQ ID NO: 5664356 - DNA, 22 bp, Homo sapiens
cactgcctgatggacctgtcac

SEQ ID NO: 5664357 - DNA, 16 bp, Homo sapiens
cactgcctgcaccttt

SEQ ID NO: 5664358 - DNA, 23 bp, Homo sapiens
cactgcctgcagaggtctgtgct

SEQ ID NO: 5664359 - DNA, 15 bp, Homo sapiens
cactgcctgcagctg

SEQ ID NO: 5664360 - DNA, 20 bp, Homo sapiens
cactgcctgcatgagctggc

SEQ ID NO: 5664361 - DNA, 14 bp, Homo sapiens
cactgcctgctccc

SEQ ID NO: 5664362 - DNA, 19 bp, Homo sapiens
cactgcctgctcccatcct

SEQ ID NO: 5664363 - DNA, 23 bp, Homo sapiens
cactgcctggaggatagcagaga

SEQ ID NO: 5664364 - DNA, 13 bp, Homo sapiens
cactgcctgggct

SEQ ID NO: 5664365 - DNA, 15 bp, Homo sapiens
cactgcctgtatact

SEQ ID NO: 5664366 - DNA, 17 bp, Homo sapiens
cactgcctgtatacttt

SEQ ID NO: 5664367 - DNA, 14 bp, Homo sapiens
cactgccttacctt

SEQ ID NO: 5664368 - DNA, 14 bp, Homo sapiens
cactgccttagcct

SEQ ID NO: 5664369 - DNA, 20 bp, Homo sapiens
cactgccttattacataact

SEQ ID NO: 5664370 - DNA, 22 bp, Homo sapiens
cactgccttcgatacaccgggc

SEQ ID NO: 5664371 - DNA, 21 bp, Homo sapiens
cactgccttcgcttcttgcct

SEQ ID NO: 5664372 - DNA, 24 bp, Homo sapiens
caggagcagcagccagcaccacct

SEQ ID NO: 5664373 - DNA, 19 bp, Homo sapiens
caggagcagccacattcct

SEQ ID NO: 5664374 - DNA, 22 bp, Homo sapiens
caggagcagcccacccagcaga

SEQ ID NO: 5664375 - DNA, 15 bp, Homo sapiens
caggagcagccctgg

SEQ ID NO: 5664376 - DNA, 17 bp, Homo sapiens
caggagcagccctggcc

SEQ ID NO: 5664377 - DNA, 18 bp, Homo sapiens
caggagcagccctggccc

SEQ ID NO: 5664378 - DNA, 20 bp, Homo sapiens
caggagcagcctcagaacaa

SEQ ID NO: 5664379 - DNA, 14 bp, Homo sapiens
caggagcagcctcc

SEQ ID NO: 5664380 - DNA, 13 bp, Homo sapiens
caggagcagctgg

SEQ ID NO: 5664381 - DNA, 17 bp, Homo sapiens
caggagcagctggcact

SEQ ID NO: 5664382 - DNA, 20 bp, Homo sapiens
caggagcagctggcactgac

SEQ ID NO: 5664383 - DNA, 23 bp, Homo sapiens
caggagcagcttttggtctcctt

SEQ ID NO: 5664384 - DNA, 14 bp, Homo sapiens
caggagcaggaaca

SEQ ID NO: 5664385 - DNA, 20 bp, Homo sapiens
caggagcaggaacagagact

SEQ ID NO: 5664386 - DNA, 24 bp, Homo sapiens
caggagcaggaacagagactctgg

SEQ ID NO: 5664387 - DNA, 15 bp, Homo sapiens
caggagcaggcacgg

SEQ ID NO: 5664388 - DNA, 18 bp, Homo sapiens
caggagcaggcacgggtg

SEQ ID NO: 5664389 - DNA, 11 bp, Homo sapiens
caggagcaggg

SEQ ID NO: 5664390 - DNA, 15 bp, Homo sapiens
caggagcagggcggc

SEQ ID NO: 5664391 - DNA, 17 bp, Homo sapiens
caggagcatcctctgct

SEQ ID NO: 5664392 - DNA, 23 bp, Homo sapiens
caggagcatggccgcaacttccc

SEQ ID NO: 5664393 - DNA, 23 bp, Homo sapiens
caggagcatgtatgtctgcaggt

SEQ ID NO: 5664394 - DNA, 16 bp, Homo sapiens
caggagcattttgtgt

SEQ ID NO: 5664395 - DNA, 18 bp, Homo sapiens
caggagcattttgtgtct

SEQ ID NO: 5664396 - DNA, 14 bp, Homo sapiens
cactggctgtgggc

SEQ ID NO: 5664397 - DNA, 21 bp, Homo sapiens
cactggctgtgggctcccttc

SEQ ID NO: 5664398 - DNA, 14 bp, Homo sapiens
cactggctttacat

SEQ ID NO: 5664399 - DNA, 21 bp, Homo sapiens
cactggctttgggtagtgcca

SEQ ID NO: 5664400 - DNA, 14 bp, Homo sapiens
cactgggaacagga

SEQ ID NO: 5664401 - DNA, 19 bp, Homo sapiens
cactgggaacaggagaccc

SEQ ID NO: 5664402 - DNA, 15 bp, Homo sapiens
cactgggaagctgga

SEQ ID NO: 5664403 - DNA, 17 bp, Homo sapiens
cactgggaaggaaacaa

SEQ ID NO: 5664404 - DNA, 19 bp, Homo sapiens
cactgggacagctggctgg

SEQ ID NO: 5664405 - DNA, 23 bp, Homo sapiens
cactgggacagctggctgggcct

SEQ ID NO: 5664406 - DNA, 10 bp, Homo sapiens
cactgggact

SEQ ID NO: 5664407 - DNA, 15 bp, Homo sapiens
cactgggactcccag

SEQ ID NO: 5664408 - DNA, 19 bp, Homo sapiens
cactgggactcccagcaga

SEQ ID NO: 5664409 - DNA, 20 bp, Homo sapiens
cactgggactcccagcagag

SEQ ID NO: 5664410 - DNA, 15 bp, Homo sapiens
cactgggactttgta

SEQ ID NO: 5664411 - DNA, 12 bp, Homo sapiens
cactgggagagc

SEQ ID NO: 5664412 - DNA, 14 bp, Homo sapiens
cactgggagagctg

SEQ ID NO: 5664413 - DNA, 23 bp, Homo sapiens
cactgggagaggtgccagcaact

SEQ ID NO: 5664414 - DNA, 20 bp, Homo sapiens
cactgggagagtccttagcc

SEQ ID NO: 5664415 - DNA, 23 bp, Homo sapiens
cactgggagagtccttagcctgg

SEQ ID NO: 5664416 - DNA, 10 bp, Homo sapiens
cactgggagc

SEQ ID NO: 5664417 - DNA, 21 bp, Homo sapiens
cactgggaggcagggctctcc

SEQ ID NO: 5664418 - DNA, 18 bp, Homo sapiens
cactgggaggctcccctt

SEQ ID NO: 5664419 - DNA, 20 bp, Homo sapiens
cactgggattcatggctttg

SEQ ID NO: 5664420 - DNA, 15 bp, Homo sapiens
cactgggcacaactg

SEQ ID NO: 5664421 - DNA, 19 bp, Homo sapiens
cactgggcacacgcacaaa

SEQ ID NO: 5664422 - DNA, 14 bp, Homo sapiens
cactgggcacctgc

SEQ ID NO: 5664423 - DNA, 21 bp, Homo sapiens
cactgggcacctgcgcacagg

SEQ ID NO: 5664424 - DNA, 18 bp, Homo sapiens
cactgggcactagctaga

SEQ ID NO: 5664425 - DNA, 17 bp, Homo sapiens
cactgggcagcaaggct

SEQ ID NO: 5664426 - DNA, 23 bp, Homo sapiens
cactgggcaggttcctggggccg

SEQ ID NO: 5664427 - DNA, 20 bp, Homo sapiens
cactgggccaattcaataca

SEQ ID NO: 5664428 - DNA, 16 bp, Homo sapiens
cactgggccacggagg

SEQ ID NO: 5664429 - DNA, 19 bp, Homo sapiens
cactgggccacggaggagg

SEQ ID NO: 5664430 - DNA, 22 bp, Homo sapiens
cactgggccataatgttgcttc

SEQ ID NO: 5664431 - DNA, 14 bp, Homo sapiens
cactgggcccagag

SEQ ID NO: 5664432 - DNA, 18 bp, Homo sapiens
cactgggcccagaggaga

SEQ ID NO: 5664433 - DNA, 21 bp, Homo sapiens
cactgggcccagaggagagga

SEQ ID NO: 5664434 - DNA, 19 bp, Homo sapiens
cactgggccccattctccc

SEQ ID NO: 5664435 - DNA, 21 bp, Homo sapiens
cactgggcccctgtccccagt

SEQ ID NO: 5664436 - DNA, 12 bp, Homo sapiens
cactgggccctg

SEQ ID NO: 5664437 - DNA, 19 bp, Homo sapiens
cactgggccctgagccaga

SEQ ID NO: 5664438 - DNA, 14 bp, Homo sapiens
cactgggccctggg

SEQ ID NO: 5664439 - DNA, 15 bp, Homo sapiens
cactgggccctgggg

SEQ ID NO: 5664440 - DNA, 16 bp, Homo sapiens
cactgggccctggggc

SEQ ID NO: 5664441 - DNA, 21 bp, Homo sapiens
cactgggccctggggctgccc

SEQ ID NO: 5664442 - DNA, 23 bp, Homo sapiens
cactgggccctggggctgccctc

SEQ ID NO: 5664443 - DNA, 13 bp, Homo sapiens
cactgggccggca

SEQ ID NO: 5664444 - DNA, 18 bp, Homo sapiens
cactgggccggcagcctg

SEQ ID NO: 5664445 - DNA, 20 bp, Homo sapiens
cactgggctctgaggagtgg

SEQ ID NO: 5664446 - DNA, 17 bp, Homo sapiens
cactgggctctggacct

SEQ ID NO: 5664447 - DNA, 20 bp, Homo sapiens
cactgggctctggacctcag

SEQ ID NO: 5664448 - DNA, 22 bp, Homo sapiens
cactgggctggggtccctgcct

SEQ ID NO: 5664449 - DNA, 19 bp, Homo sapiens
cactggggacttggcctct

SEQ ID NO: 5664450 - DNA, 20 bp, Homo sapiens
cactggggacttggcctctc

SEQ ID NO: 5664451 - DNA, 23 bp, Homo sapiens
cactggggactttatttatttct

SEQ ID NO: 5664452 - DNA, 21 bp, Homo sapiens
cactggggagcccgtctcagt

SEQ ID NO: 5664453 - DNA, 18 bp, Homo sapiens
cactggggattgggcccc

SEQ ID NO: 5664454 - DNA, 14 bp, Homo sapiens
cactggggcacttg

SEQ ID NO: 5664455 - DNA, 13 bp, Homo sapiens
cactggggccccg

SEQ ID NO: 5664456 - DNA, 16 bp, Homo sapiens
cactggggccccgggt

SEQ ID NO: 5664457 - DNA, 18 bp, Homo sapiens
cactggggcgtttcctac

SEQ ID NO: 5664458 - DNA, 12 bp, Homo sapiens
cactggggctca

SEQ ID NO: 5664459 - DNA, 13 bp, Homo sapiens
cactggggctgac

SEQ ID NO: 5664460 - DNA, 23 bp, Homo sapiens
cactggggctgacacccaggccc

SEQ ID NO: 5664461 - DNA, 15 bp, Homo sapiens
cactgggggaacaga

SEQ ID NO: 5664462 - DNA, 18 bp, Homo sapiens
cactgggggacactgtgg

SEQ ID NO: 5664463 - DNA, 18 bp, Homo sapiens
cactgggggaggagagga

SEQ ID NO: 5664464 - DNA, 14 bp, Homo sapiens
cactgggggagggg

SEQ ID NO: 5664465 - DNA, 19 bp, Homo sapiens
cactggggtccagggagca

SEQ ID NO: 5664466 - DNA, 15 bp, Homo sapiens
cactggggtgccgcc

SEQ ID NO: 5664467 - DNA, 21 bp, Homo sapiens
cactggggtgccgcctgcccg

SEQ ID NO: 5664468 - DNA, 22 bp, Homo sapiens
cactggggtgccttcactgggc

SEQ ID NO: 5664469 - DNA, 23 bp, Homo sapiens
cactggggtgggagggggcaggg

SEQ ID NO: 5664470 - DNA, 18 bp, Homo sapiens
cactgggtccagccttga

SEQ ID NO: 5664471 - DNA, 17 bp, Homo sapiens
cactgggtctcactcct

SEQ ID NO: 5664472 - DNA, 18 bp, Homo sapiens
cactgggtggggtgagga

SEQ ID NO: 5664473 - DNA, 17 bp, Homo sapiens
cactgggtggtggcctg

SEQ ID NO: 5664474 - DNA, 15 bp, Homo sapiens
cactgggtgtggccc

SEQ ID NO: 5664475 - DNA, 15 bp, Homo sapiens
cactgggttgacttt

SEQ ID NO: 5664476 - DNA, 18 bp, Homo sapiens
cactgggtttaaagatgt

SEQ ID NO: 5664477 - DNA, 15 bp, Homo sapiens
cactggtaaatgtta

SEQ ID NO: 5664478 - DNA, 17 bp, Homo sapiens
cactggtaacatgtgac

SEQ ID NO: 5664479 - DNA, 20 bp, Homo sapiens
cactggtagaccaaaataaa

SEQ ID NO: 5664480 - DNA, 15 bp, Homo sapiens
cactggtcagggcag

SEQ ID NO: 5664481 - DNA, 16 bp, Homo sapiens
cactggtcagggcagt

SEQ ID NO: 5664482 - DNA, 14 bp, Homo sapiens
cactggtcaggtgc

SEQ ID NO: 5664483 - DNA, 20 bp, Homo sapiens
cactggtcatcagtattgtg

SEQ ID NO: 5664484 - DNA, 20 bp, Homo sapiens
cactggtctacactggttgc

SEQ ID NO: 5664485 - DNA, 17 bp, Homo sapiens
cactggtctcagaggag

SEQ ID NO: 5664486 - DNA, 18 bp, Homo sapiens
cactggtctcagaggagg

SEQ ID NO: 5664487 - DNA, 14 bp, Homo sapiens
cactggtctgctgt

SEQ ID NO: 5664488 - DNA, 15 bp, Homo sapiens
cactggtctgtcttt

SEQ ID NO: 5664489 - DNA, 15 bp, Homo sapiens
cactggtgaactgag

SEQ ID NO: 5664490 - DNA, 12 bp, Homo sapiens
cactggtgccaa

SEQ ID NO: 5664491 - DNA, 22 bp, Homo sapiens
cactggtgccaaaaccaggcct

SEQ ID NO: 5664492 - DNA, 23 bp, Homo sapiens
cactggtgccaaaaccaggcctc

SEQ ID NO: 5664493 - DNA, 13 bp, Homo sapiens
cactggtgccaac

SEQ ID NO: 5664494 - DNA, 14 bp, Homo sapiens
cactggtgccaacc

SEQ ID NO: 5664495 - DNA, 15 bp, Homo sapiens
cactggtgccaacca

SEQ ID NO: 5664496 - DNA, 17 bp, Homo sapiens
cactggtgccatgtcag

SEQ ID NO: 5664497 - DNA, 18 bp, Homo sapiens
cactggtgggcagctgag

SEQ ID NO: 5664498 - DNA, 19 bp, Homo sapiens
cactggtgggcagctgagg

SEQ ID NO: 5664499 - DNA, 18 bp, Homo sapiens
cactggtggttctactga

SEQ ID NO: 5664500 - DNA, 22 bp, Homo sapiens
cactggtgtggattaacctgcc

SEQ ID NO: 5664501 - DNA, 16 bp, Homo sapiens
cactggttaaattaac

SEQ ID NO: 5664502 - DNA, 18 bp, Homo sapiens
cactggtttacaaatata

SEQ ID NO: 5664503 - DNA, 16 bp, Homo sapiens
cactggtttctcagaa

SEQ ID NO: 5664504 - DNA, 18 bp, Homo sapiens
cactggtttgccaggcca

SEQ ID NO: 5664505 - DNA, 22 bp, Homo sapiens
cactggttttacttacaaaaat

SEQ ID NO: 5664506 - DNA, 19 bp, Homo sapiens
cactggttttggccacccc

SEQ ID NO: 5664507 - DNA, 14 bp, Homo sapiens
cactgtaaaatgaa

SEQ ID NO: 5664508 - DNA, 13 bp, Homo sapiens
cactgtaaagaca

SEQ ID NO: 5664509 - DNA, 14 bp, Homo sapiens
cactgtaaagacaa

SEQ ID NO: 5664510 - DNA, 18 bp, Homo sapiens
cactgtaaatatccacag

SEQ ID NO: 5664511 - DNA, 23 bp, Homo sapiens
cactgtaaatatccctcccctct

SEQ ID NO: 5664512 - DNA, 20 bp, Homo sapiens
cactgtaagctttgttctgg

SEQ ID NO: 5664513 - DNA, 22 bp, Homo sapiens
cactgtaagctttgttctggga

SEQ ID NO: 5664514 - DNA, 22 bp, Homo sapiens
cactgtaaggtgcttgctcccc

SEQ ID NO: 5664515 - DNA, 23 bp, Homo sapiens
cactgtaaggtgcttgctcccca

SEQ ID NO: 5664516 - DNA, 14 bp, Homo sapiens
cactgtaagtttat

SEQ ID NO: 5664517 - DNA, 21 bp, Homo sapiens
cactgtaatcttaaaagtgta

SEQ ID NO: 5664518 - DNA, 14 bp, Homo sapiens
cactgtaatgagga

SEQ ID NO: 5664519 - DNA, 17 bp, Homo sapiens
cactgtaatgaggaaaa

SEQ ID NO: 5664520 - DNA, 14 bp, Homo sapiens
cactgtacagtttt

SEQ ID NO: 5664521 - DNA, 14 bp, Homo sapiens
cactgtactaacct

SEQ ID NO: 5664522 - DNA, 14 bp, Homo sapiens
cactgtactgcatg

SEQ ID NO: 5664523 - DNA, 22 bp, Homo sapiens
cactgtagcctgcgtcatggct

SEQ ID NO: 5664524 - DNA, 17 bp, Homo sapiens
cactgtagctctaaaat

SEQ ID NO: 5664525 - DNA, 19 bp, Homo sapiens
cactgtagctctaaaatct

SEQ ID NO: 5664526 - DNA, 20 bp, Homo sapiens
cactgtaggtatagaagatc

SEQ ID NO: 5664527 - DNA, 21 bp, Homo sapiens
cactgtagtaaataatgcttt

SEQ ID NO: 5664528 - DNA, 23 bp, Homo sapiens
cactgtagtaaataatgctttga

SEQ ID NO: 5664529 - DNA, 15 bp, Homo sapiens
cactgtagttctaag

SEQ ID NO: 5664530 - DNA, 21 bp, Homo sapiens
cactgtagtttagttctgttg

SEQ ID NO: 5664531 - DNA, 15 bp, Homo sapiens
cactgtagttttgag

SEQ ID NO: 5664532 - DNA, 17 bp, Homo sapiens
cactgtataaataggag

SEQ ID NO: 5664533 - DNA, 18 bp, Homo sapiens
cactgtataactgttctt

SEQ ID NO: 5664534 - DNA, 22 bp, Homo sapiens
cactgtataactgttcttcaat

SEQ ID NO: 5664535 - DNA, 11 bp, Homo sapiens
cactgtatata

SEQ ID NO: 5664536 - DNA, 14 bp, Homo sapiens
cactgtatataaac

SEQ ID NO: 5664537 - DNA, 15 bp, Homo sapiens
cactgtatataaaca

SEQ ID NO: 5664538 - DNA, 18 bp, Homo sapiens
cactgtatataaacatat

SEQ ID NO: 5664539 - DNA, 20 bp, Homo sapiens
cactgtatataaacatattt

SEQ ID NO: 5664540 - DNA, 17 bp, Homo sapiens
cactgtatatgtaaatt

SEQ ID NO: 5664541 - DNA, 15 bp, Homo sapiens
cactgtatgagtgga

SEQ ID NO: 5664542 - DNA, 17 bp, Homo sapiens
cactgtatgttatagaa

SEQ ID NO: 5664543 - DNA, 23 bp, Homo sapiens
cactgtattagagcgccagctcc

SEQ ID NO: 5664544 - DNA, 20 bp, Homo sapiens
cactgtatttgttaatttct

SEQ ID NO: 5664545 - DNA, 22 bp, Homo sapiens
cactgtcaaactttgtcaccct

SEQ ID NO: 5664546 - DNA, 17 bp, Homo sapiens
cactgtcaagattaagt

SEQ ID NO: 5664547 - DNA, 23 bp, Homo sapiens
cactgtcaatggactgcaccttg

SEQ ID NO: 5664548 - DNA, 14 bp, Homo sapiens
cactgtcacaggca

SEQ ID NO: 5664549 - DNA, 16 bp, Homo sapiens
cactgtcaccctccac

SEQ ID NO: 5664550 - DNA, 20 bp, Homo sapiens
cactgtcaccctccacctct

SEQ ID NO: 5664551 - DNA, 13 bp, Homo sapiens
cactgtcactgcc

SEQ ID NO: 5664552 - DNA, 14 bp, Homo sapiens
cactgtcactgccg

SEQ ID NO: 5664553 - DNA, 15 bp, Homo sapiens
caggatccccctctt

SEQ ID NO: 5664554 - DNA, 16 bp, Homo sapiens
caggatccctcccaga

SEQ ID NO: 5664555 - DNA, 19 bp, Homo sapiens
caggatccctcccagatcc

SEQ ID NO: 5664556 - DNA, 18 bp, Homo sapiens
caggatccctcctgagct

SEQ ID NO: 5664557 - DNA, 21 bp, Homo sapiens
caggatccctcctgagctcgg

SEQ ID NO: 5664558 - DNA, 22 bp, Homo sapiens
caggatcctattctcaccagga

SEQ ID NO: 5664559 - DNA, 15 bp, Homo sapiens
caggatcctcctgga

SEQ ID NO: 5664560 - DNA, 20 bp, Homo sapiens
caggatcctctcctttgaaa

SEQ ID NO: 5664561 - DNA, 14 bp, Homo sapiens
caggatcctgcagg

SEQ ID NO: 5664562 - DNA, 16 bp, Homo sapiens
caggatcctggcctga

SEQ ID NO: 5664563 - DNA, 23 bp, Homo sapiens
caggatcgcaagagccatgtaga

SEQ ID NO: 5664564 - DNA, 23 bp, Homo sapiens
caggatcggcttcctcaggggca

SEQ ID NO: 5664565 - DNA, 21 bp, Homo sapiens
caggatctatttttggaggtt

SEQ ID NO: 5664566 - DNA, 15 bp, Homo sapiens
caggatctcaagcca

SEQ ID NO: 5664567 - DNA, 17 bp, Homo sapiens
caggatctcaccaggca

SEQ ID NO: 5664568 - DNA, 18 bp, Homo sapiens
caggatctcaccaggcag

SEQ ID NO: 5664569 - DNA, 19 bp, Homo sapiens
caggatctcaccaggcagc

SEQ ID NO: 5664570 - DNA, 22 bp, Homo sapiens
caggatctcaccaggcagcctc

SEQ ID NO: 5664571 - DNA, 18 bp, Homo sapiens
caggatctcttagcattt

SEQ ID NO: 5664572 - DNA, 14 bp, Homo sapiens
ccaacccctccttc

SEQ ID NO: 5664573 - DNA, 18 bp, Homo sapiens
ccaacccctccttcccca

SEQ ID NO: 5664574 - DNA, 22 bp, Homo sapiens
ccaacccctctcccttttcaga

SEQ ID NO: 5664575 - DNA, 12 bp, Homo sapiens
ccaacccctgtg

SEQ ID NO: 5664576 - DNA, 19 bp, Homo sapiens
ccaaccccttaagccctgg

SEQ ID NO: 5664577 - DNA, 17 bp, Homo sapiens
ccaacccgtgcccctgg

SEQ ID NO: 5664578 - DNA, 21 bp, Homo sapiens
ccaacccgtgcccctgggatc

SEQ ID NO: 5664579 - DNA, 14 bp, Homo sapiens
ccaacccgtggagg

SEQ ID NO: 5664580 - DNA, 18 bp, Homo sapiens
ccaacccgtggaggctgc

SEQ ID NO: 5664581 - DNA, 21 bp, Homo sapiens
ccaacccgttgggtcccttgc

SEQ ID NO: 5664582 - DNA, 19 bp, Homo sapiens
ccaaccctaggttccctgt

SEQ ID NO: 5664583 - DNA, 15 bp, Homo sapiens
ccaaccctcagagcc

SEQ ID NO: 5664584 - DNA, 13 bp, Homo sapiens
ccaaccctcaggg

SEQ ID NO: 5664585 - DNA, 15 bp, Homo sapiens
ccaaccctcagggca

SEQ ID NO: 5664586 - DNA, 13 bp, Homo sapiens
ccaaccctcatca

SEQ ID NO: 5664587 - DNA, 15 bp, Homo sapiens
ccaaccctgcccctg

SEQ ID NO: 5664588 - DNA, 12 bp, Homo sapiens
ccaaccctgccg

SEQ ID NO: 5664589 - DNA, 13 bp, Homo sapiens
ccaaccctgccgt

SEQ ID NO: 5664590 - DNA, 18 bp, Homo sapiens
ccaaccctggcacccagg

SEQ ID NO: 5664591 - DNA, 17 bp, Homo sapiens
ccaaccctggcttgggg

SEQ ID NO: 5664592 - DNA, 13 bp, Homo sapiens
ccaaccctgggac

SEQ ID NO: 5664593 - DNA, 13 bp, Homo sapiens
ccaaccctgtctg

SEQ ID NO: 5664594 - DNA, 13 bp, Homo sapiens
ccaaccctgtggg

SEQ ID NO: 5664595 - DNA, 14 bp, Homo sapiens
ccaaccctgtgggc

SEQ ID NO: 5664596 - DNA, 15 bp, Homo sapiens
ccaaccctgtgggct

SEQ ID NO: 5664597 - DNA, 15 bp, Homo sapiens
ccaacccttcttcat

SEQ ID NO: 5664598 - DNA, 21 bp, Homo sapiens
ccaaccgaacatgaccaaaaa

SEQ ID NO: 5664599 - DNA, 14 bp, Homo sapiens
ccaaccgccttggg

SEQ ID NO: 5664600 - DNA, 16 bp, Homo sapiens
ccaaccgtgtctgtct

SEQ ID NO: 5664601 - DNA, 14 bp, Homo sapiens
ccaacctaaatttc

SEQ ID NO: 5664602 - DNA, 16 bp, Homo sapiens
ccaacctacattccac

SEQ ID NO: 5664603 - DNA, 21 bp, Homo sapiens
ccaacctacattccaccctgt

SEQ ID NO: 5664604 - DNA, 18 bp, Homo sapiens
ccaacctcaatgccctgc

SEQ ID NO: 5664605 - DNA, 21 bp, Homo sapiens
ccaacctcaatgccctgccat

SEQ ID NO: 5664606 - DNA, 23 bp, Homo sapiens
ccaacctcaatgccctgccatta

SEQ ID NO: 5664607 - DNA, 15 bp, Homo sapiens
ccaacctcactgccc

SEQ ID NO: 5664608 - DNA, 15 bp, Homo sapiens
ccaacctcacttccc

SEQ ID NO: 5664609 - DNA, 20 bp, Homo sapiens
ccaacctcagaggcagcttc

SEQ ID NO: 5664610 - DNA, 18 bp, Homo sapiens
ccaacctcagggctccca

SEQ ID NO: 5664611 - DNA, 20 bp, Homo sapiens
ccaacctcagggctcccagg

SEQ ID NO: 5664612 - DNA, 13 bp, Homo sapiens
ccaacctccagac

SEQ ID NO: 5664613 - DNA, 20 bp, Homo sapiens
ccaacctccccgcagagctc

SEQ ID NO: 5664614 - DNA, 11 bp, Homo sapiens
ccaacctcctg

SEQ ID NO: 5664615 - DNA, 13 bp, Homo sapiens
ccaacctcctgct

SEQ ID NO: 5664616 - DNA, 14 bp, Homo sapiens
ccaacctcctgtgg

SEQ ID NO: 5664617 - DNA, 20 bp, Homo sapiens
ccaacctcctgtgggcctca

SEQ ID NO: 5664618 - DNA, 20 bp, Homo sapiens
ccaacctcgccctctctcac

SEQ ID NO: 5664619 - DNA, 16 bp, Homo sapiens
ccaacctctttcctct

SEQ ID NO: 5664620 - DNA, 17 bp, Homo sapiens
ccaacctctttttcctc

SEQ ID NO: 5664621 - DNA, 22 bp, Homo sapiens
ccaacctgaaggtcccctggca

SEQ ID NO: 5664622 - DNA, 14 bp, Homo sapiens
cccagatctgcctg

SEQ ID NO: 5664623 - DNA, 16 bp, Homo sapiens
cccagatctgcctggg

SEQ ID NO: 5664624 - DNA, 17 bp, Homo sapiens
cccagatctgcctgggc

SEQ ID NO: 5664625 - DNA, 22 bp, Homo sapiens
cccagatctgcctgggcctgtg

SEQ ID NO: 5664626 - DNA, 14 bp, Homo sapiens
cccagatctgtcct

SEQ ID NO: 5664627 - DNA, 15 bp, Homo sapiens
cccagatctgtcctg

SEQ ID NO: 5664628 - DNA, 13 bp, Homo sapiens
cccagatgctggg

SEQ ID NO: 5664629 - DNA, 17 bp, Homo sapiens
cccagatggctccctgg

SEQ ID NO: 5664630 - DNA, 11 bp, Homo sapiens
cccagatgttt

SEQ ID NO: 5664631 - DNA, 13 bp, Homo sapiens
cccagatgtttta

SEQ ID NO: 5664632 - DNA, 13 bp, Homo sapiens
cccagattcccag

SEQ ID NO: 5664633 - DNA, 19 bp, Homo sapiens
cccagattcccctgtgtca

SEQ ID NO: 5664634 - DNA, 12 bp, Homo sapiens
cccagattccct

SEQ ID NO: 5664635 - DNA, 21 bp, Homo sapiens
cccagattgataagtaatgaa

SEQ ID NO: 5664636 - DNA, 16 bp, Homo sapiens
cccagattgtgtacat

SEQ ID NO: 5664637 - DNA, 16 bp, Homo sapiens
cccagatttcagtctt

SEQ ID NO: 5664638 - DNA, 17 bp, Homo sapiens
cccagattttatttata

SEQ ID NO: 5664639 - DNA, 21 bp, Homo sapiens
cccagattttgctgtatattt

SEQ ID NO: 5664640 - DNA, 17 bp, Homo sapiens
cccagcaacacgtcatt

SEQ ID NO: 5664641 - DNA, 18 bp, Homo sapiens
cccagcaacgcccctcca

SEQ ID NO: 5664642 - DNA, 16 bp, Homo sapiens
cccagcaactccaact

SEQ ID NO: 5664643 - DNA, 14 bp, Homo sapiens
cccagcaagaagga

SEQ ID NO: 5664644 - DNA, 15 bp, Homo sapiens
cccagcaagacctca

SEQ ID NO: 5664645 - DNA, 23 bp, Homo sapiens
cccagcaagacctcatctgtgga

SEQ ID NO: 5664646 - DNA, 17 bp, Homo sapiens
cccagcaagcgggagcc

SEQ ID NO: 5664647 - DNA, 14 bp, Homo sapiens
cccagcaaggcaca

SEQ ID NO: 5664648 - DNA, 15 bp, Homo sapiens
cccagcaaggcacag

SEQ ID NO: 5664649 - DNA, 13 bp, Homo sapiens
cccagcaaggcag

SEQ ID NO: 5664650 - DNA, 16 bp, Homo sapiens
cccagcacaaagcact

SEQ ID NO: 5664651 - DNA, 17 bp, Homo sapiens
cccagcacaaagcactg

SEQ ID NO: 5664652 - DNA, 21 bp, Homo sapiens
cccagcacaaagcactggcct

SEQ ID NO: 5664653 - DNA, 19 bp, Homo sapiens
cccagcacacacctatggc

SEQ ID NO: 5664654 - DNA, 23 bp, Homo sapiens
cccagcacactgcttctcggagg

SEQ ID NO: 5664655 - DNA, 17 bp, Homo sapiens
cccagcacagccacctc

SEQ ID NO: 5664656 - DNA, 18 bp, Homo sapiens
cccagcacagccacctcc

SEQ ID NO: 5664657 - DNA, 20 bp, Homo sapiens
cccagcacagccacctccgc

SEQ ID NO: 5664658 - DNA, 15 bp, Homo sapiens
cccagcacagctcct

SEQ ID NO: 5664659 - DNA, 18 bp, Homo sapiens
cccagcacagctcctccc

SEQ ID NO: 5664660 - DNA, 20 bp, Homo sapiens
cccagcacagctcctcccct

SEQ ID NO: 5664661 - DNA, 22 bp, Homo sapiens
cccagcacagctcctcccctgc

SEQ ID NO: 5664662 - DNA, 13 bp, Homo sapiens
cccagcacccagc

SEQ ID NO: 5664663 - DNA, 12 bp, Homo sapiens
cccagcacccgg

SEQ ID NO: 5664664 - DNA, 21 bp, Homo sapiens
cccagcacccgggctcaggga

SEQ ID NO: 5664665 - DNA, 11 bp, Homo sapiens
cccagcaccct

SEQ ID NO: 5664666 - DNA, 13 bp, Homo sapiens
cccagcacctagg

SEQ ID NO: 5664667 - DNA, 18 bp, Homo sapiens
cccagcacctcagcctgc

SEQ ID NO: 5664668 - DNA, 12 bp, Homo sapiens
cccagcacctgc

SEQ ID NO: 5664669 - DNA, 17 bp, Homo sapiens
cccagcacctgccaggg

SEQ ID NO: 5664670 - DNA, 17 bp, Homo sapiens
cccagcacctgcctcct

SEQ ID NO: 5664671 - DNA, 14 bp, Homo sapiens
cccagcacctgctc

SEQ ID NO: 5664672 - DNA, 14 bp, Homo sapiens
cccagcacctggca

SEQ ID NO: 5664673 - DNA, 17 bp, Homo sapiens
cccagcacctggcacac

SEQ ID NO: 5664674 - DNA, 17 bp, Homo sapiens
cccagcactaaagcagt

SEQ ID NO: 5664675 - DNA, 16 bp, Homo sapiens
cccagcactccccttg

SEQ ID NO: 5664676 - DNA, 16 bp, Homo sapiens
cccagcactcctctgt

SEQ ID NO: 5664677 - DNA, 23 bp, Homo sapiens
cccagcactcctctgtctctgct

SEQ ID NO: 5664678 - DNA, 13 bp, Homo sapiens
cccagcactgagg

SEQ ID NO: 5664679 - DNA, 21 bp, Homo sapiens
cccagcactgcccatcccacc

SEQ ID NO: 5664680 - DNA, 15 bp, Homo sapiens
cccagcactgcctcc

SEQ ID NO: 5664681 - DNA, 13 bp, Homo sapiens
cccagcactgtct

SEQ ID NO: 5664682 - DNA, 13 bp, Homo sapiens
cccagcactgtga

SEQ ID NO: 5664683 - DNA, 22 bp, Homo sapiens
cccagcactgtgaagacccagc

SEQ ID NO: 5664684 - DNA, 17 bp, Homo sapiens
cccagcactttgagagg

SEQ ID NO: 5664685 - DNA, 15 bp, Homo sapiens
cccagcactttggga

SEQ ID NO: 5664686 - DNA, 17 bp, Homo sapiens
cccagcactttgggagg

SEQ ID NO: 5664687 - DNA, 19 bp, Homo sapiens
cccagcactttgggaggcc

SEQ ID NO: 5664688 - DNA, 20 bp, Homo sapiens
cccagcactttgggaggcct

SEQ ID NO: 5664689 - DNA, 18 bp, Homo sapiens
cccagcagaaccagcctc

SEQ ID NO: 5664690 - DNA, 12 bp, Homo sapiens
cccagcagagcc

SEQ ID NO: 5664691 - DNA, 14 bp, Homo sapiens
cccagcagaggcag

SEQ ID NO: 5664692 - DNA, 14 bp, Homo sapiens
cccagcagagggat

SEQ ID NO: 5664693 - DNA, 23 bp, Homo sapiens
cccagcagaggtttgctgacagg

SEQ ID NO: 5664694 - DNA, 15 bp, Homo sapiens
cccagcagcccaagc

SEQ ID NO: 5664695 - DNA, 18 bp, Homo sapiens
cccagcagcccaagctta

SEQ ID NO: 5664696 - DNA, 21 bp, Homo sapiens
cccagcagcccctcagcgccc

SEQ ID NO: 5664697 - DNA, 16 bp, Homo sapiens
cccagcagccctcaac

SEQ ID NO: 5664698 - DNA, 17 bp, Homo sapiens
cccagcagccctcaaca

SEQ ID NO: 5664699 - DNA, 22 bp, Homo sapiens
cccagcagccctcaacaggccc

SEQ ID NO: 5664700 - DNA, 23 bp, Homo sapiens
cccagcagccctcaacaggccca

SEQ ID NO: 5664701 - DNA, 13 bp, Homo sapiens
cccagcagcctgc

SEQ ID NO: 5664702 - DNA, 16 bp, Homo sapiens
cccagcagcctgccag

SEQ ID NO: 5664703 - DNA, 17 bp, Homo sapiens
cccagcagcgcccgagg

SEQ ID NO: 5664704 - DNA, 15 bp, Homo sapiens
cccagcagcggccca

SEQ ID NO: 5664705 - DNA, 20 bp, Homo sapiens
cccagcagctcaacctaccc

SEQ ID NO: 5664706 - DNA, 19 bp, Homo sapiens
cccagcagctgggccggcc

SEQ ID NO: 5664707 - DNA, 20 bp, Homo sapiens
cccagcagctgggccggcca

SEQ ID NO: 5664708 - DNA, 21 bp, Homo sapiens
cccagcagctgggccggccag

SEQ ID NO: 5664709 - DNA, 22 bp, Homo sapiens
cccagcagctgggccggccagc

SEQ ID NO: 5664710 - DNA, 20 bp, Homo sapiens
cccagcagcttggctgagcc

SEQ ID NO: 5664711 - DNA, 19 bp, Homo sapiens
cccagcaggaagccaggct

SEQ ID NO: 5664712 - DNA, 24 bp, Homo sapiens
cccagcaggcaggcactgtggccc

SEQ ID NO: 5664713 - DNA, 13 bp, Homo sapiens
cccagcaggggcc

SEQ ID NO: 5664714 - DNA, 15 bp, Homo sapiens
cccagcaggtgggga

SEQ ID NO: 5664715 - DNA, 14 bp, Homo sapiens
cccagcagtgtgga

SEQ ID NO: 5664716 - DNA, 12 bp, Homo sapiens
cccagcagttct

SEQ ID NO: 5664717 - DNA, 15 bp, Homo sapiens
cccagcatcagcaca

SEQ ID NO: 5664718 - DNA, 14 bp, Homo sapiens
cccagcatccctgg

SEQ ID NO: 5664719 - DNA, 18 bp, Homo sapiens
cccagcatccctggagca

SEQ ID NO: 5664720 - DNA, 21 bp, Homo sapiens
cccagcatccttttctgcaga

SEQ ID NO: 5664721 - DNA, 17 bp, Homo sapiens
cccagcatcgcactctg

SEQ ID NO: 5664722 - DNA, 21 bp, Homo sapiens
cccagcatcgcactctggcag

SEQ ID NO: 5664723 - DNA, 22 bp, Homo sapiens
cccagcatcgggggcctgcaaa

SEQ ID NO: 5664724 - DNA, 16 bp, Homo sapiens
cccagcatctcagagt

SEQ ID NO: 5664725 - DNA, 12 bp, Homo sapiens
cccagcatctcc

SEQ ID NO: 5664726 - DNA, 17 bp, Homo sapiens
cccagcatctcccagca

SEQ ID NO: 5664727 - DNA, 19 bp, Homo sapiens
cccagcatctcccagcaag

SEQ ID NO: 5664728 - DNA, 22 bp, Homo sapiens
cccagcatgacataacagtgca

SEQ ID NO: 5664729 - DNA, 21 bp, Homo sapiens
cccagcatgactttccttagg

SEQ ID NO: 5664730 - DNA, 13 bp, Homo sapiens
cccagcatgtaca

SEQ ID NO: 5664731 - DNA, 18 bp, Homo sapiens
cccagcattccagcccct

SEQ ID NO: 5664732 - DNA, 19 bp, Homo sapiens
cccagcattccagcccctc

SEQ ID NO: 5664733 - DNA, 20 bp, Homo sapiens
cccagcattccagcccctct

SEQ ID NO: 5664734 - DNA, 16 bp, Homo sapiens
cccagcattccagctc

SEQ ID NO: 5664735 - DNA, 18 bp, Homo sapiens
cccagcattccagctctg

SEQ ID NO: 5664736 - DNA, 15 bp, Homo sapiens
cccagcattgctggt

SEQ ID NO: 5664737 - DNA, 18 bp, Homo sapiens
cccagcattgctggttct

SEQ ID NO: 5664738 - DNA, 13 bp, Homo sapiens
cccagcatttcca

SEQ ID NO: 5664739 - DNA, 20 bp, Homo sapiens
cccagcatttccagagcaga

SEQ ID NO: 5664740 - DNA, 18 bp, Homo sapiens
cccagcatttcccgaagg

SEQ ID NO: 5664741 - DNA, 20 bp, Homo sapiens
cccagcatttcccgaaggcc

SEQ ID NO: 5664742 - DNA, 17 bp, Homo sapiens
cccagccaaaccctgtc

SEQ ID NO: 5664743 - DNA, 14 bp, Homo sapiens
cccagccaacgaga

SEQ ID NO: 5664744 - DNA, 16 bp, Homo sapiens
cccagccaagtgcctt

SEQ ID NO: 5664745 - DNA, 17 bp, Homo sapiens
cccagccaccaccactg

SEQ ID NO: 5664746 - DNA, 21 bp, Homo sapiens
cccagccaccaccactgtccc

SEQ ID NO: 5664747 - DNA, 21 bp, Homo sapiens
cccagccaccaccctcaggtg

SEQ ID NO: 5664748 - DNA, 19 bp, Homo sapiens
cccagccaccccgggctct

SEQ ID NO: 5664749 - DNA, 22 bp, Homo sapiens
cccagccacccggatctccagg

SEQ ID NO: 5664750 - DNA, 14 bp, Homo sapiens
cccagccacctccc

SEQ ID NO: 5664751 - DNA, 15 bp, Homo sapiens
cccagccaccttcct

SEQ ID NO: 5664752 - DNA, 20 bp, Homo sapiens
ccaagcacagtggtggcagg

SEQ ID NO: 5664753 - DNA, 23 bp, Homo sapiens
ccaagcacagtggtggcagggcc

SEQ ID NO: 5664754 - DNA, 22 bp, Homo sapiens
ccaagcacctccaaccaaataa

SEQ ID NO: 5664755 - DNA, 21 bp, Homo sapiens
ccaagcactcgagaccatcct

SEQ ID NO: 5664756 - DNA, 21 bp, Homo sapiens
ccaagcactgtgctcagggct

SEQ ID NO: 5664757 - DNA, 23 bp, Homo sapiens
ccaagcagactccagcccctgga

SEQ ID NO: 5664758 - DNA, 12 bp, Homo sapiens
ccaagcagccaa

SEQ ID NO: 5664759 - DNA, 18 bp, Homo sapiens
ccaagcagccaagctcct

SEQ ID NO: 5664760 - DNA, 13 bp, Homo sapiens
ccaagcaggaagc

SEQ ID NO: 5664761 - DNA, 14 bp, Homo sapiens
ccaagcaggacatg

SEQ ID NO: 5664762 - DNA, 17 bp, Homo sapiens
ccaagcaggagacgaca

SEQ ID NO: 5664763 - DNA, 20 bp, Homo sapiens
ccaagcagttgggactacag

SEQ ID NO: 5664764 - DNA, 22 bp, Homo sapiens
ccaagcagttgggactacaggc

SEQ ID NO: 5664765 - DNA, 16 bp, Homo sapiens
ccaagcatcagcaaga

SEQ ID NO: 5664766 - DNA, 16 bp, Homo sapiens
ccaagcatcaggggga

SEQ ID NO: 5664767 - DNA, 20 bp, Homo sapiens
ccaagccaagggaacctgtg

SEQ ID NO: 5664768 - DNA, 22 bp, Homo sapiens
ccaagccaagggaacctgtgtc

SEQ ID NO: 5664769 - DNA, 18 bp, Homo sapiens
ccaagccacaagctgacc

SEQ ID NO: 5664770 - DNA, 18 bp, Homo sapiens
ccaagccaccgcagctgc

SEQ ID NO: 5664771 - DNA, 20 bp, Homo sapiens
ccaagccaccgcagctgctg

SEQ ID NO: 5664772 - DNA, 12 bp, Homo sapiens
ccaagccactga

SEQ ID NO: 5664773 - DNA, 17 bp, Homo sapiens
ccaagccagaggctggg

SEQ ID NO: 5664774 - DNA, 12 bp, Homo sapiens
ccaagccagagt

SEQ ID NO: 5664775 - DNA, 14 bp, Homo sapiens
ccaagccagattct

SEQ ID NO: 5664776 - DNA, 16 bp, Homo sapiens
ccaagccagattctct

SEQ ID NO: 5664777 - DNA, 20 bp, Homo sapiens
ccaagccagattctcttgaa

SEQ ID NO: 5664778 - DNA, 16 bp, Homo sapiens
ccaagccagctgccta

SEQ ID NO: 5664779 - DNA, 17 bp, Homo sapiens
ccaagccagctgcctag

SEQ ID NO: 5664780 - DNA, 18 bp, Homo sapiens
ccaagccagctgcctagg

SEQ ID NO: 5664781 - DNA, 23 bp, Homo sapiens
ccaagccagggatggggccacag

SEQ ID NO: 5664782 - DNA, 18 bp, Homo sapiens
ccaagccagggttccaga

SEQ ID NO: 5664783 - DNA, 19 bp, Homo sapiens
ccaagccagggttccagac

SEQ ID NO: 5664784 - DNA, 20 bp, Homo sapiens
ccaagccagggttccagaca

SEQ ID NO: 5664785 - DNA, 22 bp, Homo sapiens
ccaagccatggtgacacacagc

SEQ ID NO: 5664786 - DNA, 16 bp, Homo sapiens
ccaagcccaccaggtg

SEQ ID NO: 5664787 - DNA, 11 bp, Homo sapiens
ccaagcccagc

SEQ ID NO: 5664788 - DNA, 15 bp, Homo sapiens
ccaagcccagtgacc

SEQ ID NO: 5664789 - DNA, 14 bp, Homo sapiens
ccaagccccatcct

SEQ ID NO: 5664790 - DNA, 13 bp, Homo sapiens
ccaagccccatct

SEQ ID NO: 5664791 - DNA, 19 bp, Homo sapiens
ccaagccccatctcatcct

SEQ ID NO: 5664792 - DNA, 14 bp, Homo sapiens
ccaagccccctggc

SEQ ID NO: 5664793 - DNA, 15 bp, Homo sapiens
ccaagccccctggca

SEQ ID NO: 5664794 - DNA, 19 bp, Homo sapiens
ccaagccccctggcagctg

SEQ ID NO: 5664795 - DNA, 20 bp, Homo sapiens
ccaagccccctggcagctgc

SEQ ID NO: 5664796 - DNA, 21 bp, Homo sapiens
ccaagcccctgccctggggag

SEQ ID NO: 5664797 - DNA, 15 bp, Homo sapiens
ccaagccctcagctg

SEQ ID NO: 5664798 - DNA, 23 bp, Homo sapiens
ccaagccctgaggcctgaggcct

SEQ ID NO: 5664799 - DNA, 23 bp, Homo sapiens
ccaagccctggagccaactgctg

SEQ ID NO: 5664800 - DNA, 14 bp, Homo sapiens
ccaagccctggccc

SEQ ID NO: 5664801 - DNA, 23 bp, Homo sapiens
ccaagccctggcccccacagcgc

SEQ ID NO: 5664802 - DNA, 12 bp, Homo sapiens
ccaagccctggg

SEQ ID NO: 5664803 - DNA, 14 bp, Homo sapiens
cccagcctggggct

SEQ ID NO: 5664804 - DNA, 22 bp, Homo sapiens
cccagcctgggggccagtgggg

SEQ ID NO: 5664805 - DNA, 10 bp, Homo sapiens
cccagcctgt

SEQ ID NO: 5664806 - DNA, 22 bp, Homo sapiens
cccagcctgtcagatccaggag

SEQ ID NO: 5664807 - DNA, 13 bp, Homo sapiens
cccagcctgtccc

SEQ ID NO: 5664808 - DNA, 20 bp, Homo sapiens
cccagcctgtcccactggct

SEQ ID NO: 5664809 - DNA, 21 bp, Homo sapiens
cccagcctgtcctggtacagc

SEQ ID NO: 5664810 - DNA, 14 bp, Homo sapiens
cccagcctgtggcc

SEQ ID NO: 5664811 - DNA, 16 bp, Homo sapiens
cccagccttgcccagc

SEQ ID NO: 5664812 - DNA, 14 bp, Homo sapiens
cccagcgacacaga

SEQ ID NO: 5664813 - DNA, 23 bp, Homo sapiens
cccagcgagccctggtggcagtg

SEQ ID NO: 5664814 - DNA, 21 bp, Homo sapiens
cccagcgcatggcgccccggg

SEQ ID NO: 5664815 - DNA, 21 bp, Homo sapiens
cccagcgcctgtgctgaggac

SEQ ID NO: 5664816 - DNA, 14 bp, Homo sapiens
cccagcgcggccag

SEQ ID NO: 5664817 - DNA, 23 bp, Homo sapiens
cccagcgcggccagcgtcccagg

SEQ ID NO: 5664818 - DNA, 22 bp, Homo sapiens
cccagcgcggcttggccgccat

SEQ ID NO: 5664819 - DNA, 15 bp, Homo sapiens
cccagcgctcgccac

SEQ ID NO: 5664820 - DNA, 14 bp, Homo sapiens
cccagcgctctcct

SEQ ID NO: 5664821 - DNA, 14 bp, Homo sapiens
cccagcgctctggg

SEQ ID NO: 5664822 - DNA, 17 bp, Homo sapiens
cccagcggccccccgca

SEQ ID NO: 5664823 - DNA, 23 bp, Homo sapiens
cccagcggccccccgcacagcca

SEQ ID NO: 5664824 - DNA, 16 bp, Homo sapiens
cccagcggcctccggc

SEQ ID NO: 5664825 - DNA, 17 bp, Homo sapiens
cccagcggctggtgcag

SEQ ID NO: 5664826 - DNA, 12 bp, Homo sapiens
cccagcgggcag

SEQ ID NO: 5664827 - DNA, 13 bp, Homo sapiens
cccagcgggcaga

SEQ ID NO: 5664828 - DNA, 22 bp, Homo sapiens
cccagcgggctggcgggccttt

SEQ ID NO: 5664829 - DNA, 15 bp, Homo sapiens
cccagcggtccctgc

SEQ ID NO: 5664830 - DNA, 16 bp, Homo sapiens
cccagcggttcctgtg

SEQ ID NO: 5664831 - DNA, 17 bp, Homo sapiens
cccagcggtttccactt

SEQ ID NO: 5664832 - DNA, 22 bp, Homo sapiens
cccagcggtttccacttgtggg

SEQ ID NO: 5664833 - DNA, 20 bp, Homo sapiens
cccagcgtcagtttcactcc

SEQ ID NO: 5664834 - DNA, 21 bp, Homo sapiens
cccagcgtcagtttcactccc

SEQ ID NO: 5664835 - DNA, 17 bp, Homo sapiens
cccagcgtctgcagggt

SEQ ID NO: 5664836 - DNA, 20 bp, Homo sapiens
cccagcgtgaagccagggcc

SEQ ID NO: 5664837 - DNA, 19 bp, Homo sapiens
cccagcgtggcccaggccg

SEQ ID NO: 5664838 - DNA, 15 bp, Homo sapiens
cccagcgtgtgtatc

SEQ ID NO: 5664839 - DNA, 16 bp, Homo sapiens
cccagcgttcttcagg

SEQ ID NO: 5664840 - DNA, 24 bp, Homo sapiens
cccagcgtttagtttctagaggcc

SEQ ID NO: 5664841 - DNA, 16 bp, Homo sapiens
cccagctaagaacctg

SEQ ID NO: 5664842 - DNA, 16 bp, Homo sapiens
cccagctaataaacca

SEQ ID NO: 5664843 - DNA, 22 bp, Homo sapiens
cccagctaatttttgtattttt

SEQ ID NO: 5664844 - DNA, 21 bp, Homo sapiens
cccagctacaggggaggctga

SEQ ID NO: 5664845 - DNA, 16 bp, Homo sapiens
cccagctacattcctc

SEQ ID NO: 5664846 - DNA, 18 bp, Homo sapiens
cccagctacattcctcag

SEQ ID NO: 5664847 - DNA, 21 bp, Homo sapiens
cccagctacattcctcagctg

SEQ ID NO: 5664848 - DNA, 18 bp, Homo sapiens
cccagctaccaagtcaga

SEQ ID NO: 5664849 - DNA, 17 bp, Homo sapiens
cccagctacccaggagg

SEQ ID NO: 5664850 - DNA, 13 bp, Homo sapiens
cccagctacccct

SEQ ID NO: 5664851 - DNA, 14 bp, Homo sapiens
cccagctacctcaa

SEQ ID NO: 5664852 - DNA, 17 bp, Homo sapiens
cccagctactcagaagc

SEQ ID NO: 5664853 - DNA, 14 bp, Homo sapiens
cccagctactcagg

SEQ ID NO: 5664854 - DNA, 20 bp, Homo sapiens
cccagctactcgggaggctg

SEQ ID NO: 5664855 - DNA, 16 bp, Homo sapiens
cccagctactctgatc

SEQ ID NO: 5664856 - DNA, 22 bp, Homo sapiens
cccagctactctgatccctctg

SEQ ID NO: 5664857 - DNA, 20 bp, Homo sapiens
cccagctactctgtccaggc

SEQ ID NO: 5664858 - DNA, 21 bp, Homo sapiens
cccagctactctgtccaggcc

SEQ ID NO: 5664859 - DNA, 21 bp, Homo sapiens
cccagctactgaaccagccac

SEQ ID NO: 5664860 - DNA, 16 bp, Homo sapiens
cccagctactggggag

SEQ ID NO: 5664861 - DNA, 22 bp, Homo sapiens
cccagctactggggaggctgag

SEQ ID NO: 5664862 - DNA, 16 bp, Homo sapiens
cccagctacttgggaa

SEQ ID NO: 5664863 - DNA, 19 bp, Homo sapiens
cccagctacttgggaagct

SEQ ID NO: 5664864 - DNA, 21 bp, Homo sapiens
cccagctacttgggagcctga

SEQ ID NO: 5664865 - DNA, 13 bp, Homo sapiens
cccagctaggaag

SEQ ID NO: 5664866 - DNA, 22 bp, Homo sapiens
cccagctaggaagagcaggact

SEQ ID NO: 5664867 - DNA, 19 bp, Homo sapiens
cccagctatggccccaggg

SEQ ID NO: 5664868 - DNA, 13 bp, Homo sapiens
cccagctattttc

SEQ ID NO: 5664869 - DNA, 16 bp, Homo sapiens
cccagctattttctga

SEQ ID NO: 5664870 - DNA, 15 bp, Homo sapiens
cccagctcactgcag

SEQ ID NO: 5664871 - DNA, 21 bp, Homo sapiens
cccagctcagagccccgcccc

SEQ ID NO: 5664872 - DNA, 15 bp, Homo sapiens
cccagctcagagggt

SEQ ID NO: 5664873 - DNA, 20 bp, Homo sapiens
cccagctcaggggcagctca

SEQ ID NO: 5664874 - DNA, 12 bp, Homo sapiens
cccagctcagtg

SEQ ID NO: 5664875 - DNA, 17 bp, Homo sapiens
cccagctcagtgccaca

SEQ ID NO: 5664876 - DNA, 22 bp, Homo sapiens
cccagctcagtgccacaaagct

SEQ ID NO: 5664877 - DNA, 9 bp, Homo sapiens
cccagctcc

SEQ ID NO: 5664878 - DNA, 15 bp, Homo sapiens
cccagctccactcag

SEQ ID NO: 5664879 - DNA, 19 bp, Homo sapiens
cccagctccaggcccaccg

SEQ ID NO: 5664880 - DNA, 13 bp, Homo sapiens
cccagctccaggg

SEQ ID NO: 5664881 - DNA, 12 bp, Homo sapiens
cccagctcccac

SEQ ID NO: 5664882 - DNA, 16 bp, Homo sapiens
cccagctcccacaccg

SEQ ID NO: 5664883 - DNA, 16 bp, Homo sapiens
cccagctcccacctcc

SEQ ID NO: 5664884 - DNA, 14 bp, Homo sapiens
cccagctccccagg

SEQ ID NO: 5664885 - DNA, 15 bp, Homo sapiens
cccagctccccagga

SEQ ID NO: 5664886 - DNA, 21 bp, Homo sapiens
cccagctcccccaggcagaaa

SEQ ID NO: 5664887 - DNA, 17 bp, Homo sapiens
cccagctccctgcaccg

SEQ ID NO: 5664888 - DNA, 23 bp, Homo sapiens
cccagctcccttgggaaggacac

SEQ ID NO: 5664889 - DNA, 20 bp, Homo sapiens
cccagctccgacctctctca

SEQ ID NO: 5664890 - DNA, 19 bp, Homo sapiens
cccagctccgctgcttact

SEQ ID NO: 5664891 - DNA, 17 bp, Homo sapiens
cccagctccggcctgtc

SEQ ID NO: 5664892 - DNA, 10 bp, Homo sapiens
cccagctcct

SEQ ID NO: 5664893 - DNA, 12 bp, Homo sapiens
cccagctcctca

SEQ ID NO: 5664894 - DNA, 14 bp, Homo sapiens
cccagctcctcaca

SEQ ID NO: 5664895 - DNA, 18 bp, Homo sapiens
cccagctcctcacccagg

SEQ ID NO: 5664896 - DNA, 19 bp, Homo sapiens
cccagctcctcttcctgcc

SEQ ID NO: 5664897 - DNA, 17 bp, Homo sapiens
cccagctccttggctgc

SEQ ID NO: 5664898 - DNA, 21 bp, Homo sapiens
cccagctcctttctcctgtga

SEQ ID NO: 5664899 - DNA, 17 bp, Homo sapiens
cccagctcgctggcttt

SEQ ID NO: 5664900 - DNA, 19 bp, Homo sapiens
cccagctcgctggctttct

SEQ ID NO: 5664901 - DNA, 21 bp, Homo sapiens
cccagctctacattctgctct

SEQ ID NO: 5664902 - DNA, 23 bp, Homo sapiens
cccagctctacattctgctctgc

SEQ ID NO: 5664903 - DNA, 15 bp, Homo sapiens
cccagctctactcca

SEQ ID NO: 5664904 - DNA, 14 bp, Homo sapiens
cccagctctagaca

SEQ ID NO: 5664905 - DNA, 23 bp, Homo sapiens
cccagctctagacaaccctgcaa

SEQ ID NO: 5664906 - DNA, 20 bp, Homo sapiens
cccagctctagcctctggac

SEQ ID NO: 5664907 - DNA, 12 bp, Homo sapiens
cccagctctcag

SEQ ID NO: 5664908 - DNA, 14 bp, Homo sapiens
cccagctctcagta

SEQ ID NO: 5664909 - DNA, 14 bp, Homo sapiens
cccagctctccctc

SEQ ID NO: 5664910 - DNA, 19 bp, Homo sapiens
cccagctctccctctggcc

SEQ ID NO: 5664911 - DNA, 19 bp, Homo sapiens
cccagctctctctcctgga

SEQ ID NO: 5664912 - DNA, 14 bp, Homo sapiens
cccagctctctgac

SEQ ID NO: 5664913 - DNA, 16 bp, Homo sapiens
cccagctctctgacgc

SEQ ID NO: 5664914 - DNA, 10 bp, Homo sapiens
cccagctctg

SEQ ID NO: 5664915 - DNA, 14 bp, Homo sapiens
cccagctctgaaac

SEQ ID NO: 5664916 - DNA, 18 bp, Homo sapiens
cccagctctgaggactgc

SEQ ID NO: 5664917 - DNA, 11 bp, Homo sapiens
cccagctctgg

SEQ ID NO: 5664918 - DNA, 19 bp, Homo sapiens
cccagctctggatgaaggc

SEQ ID NO: 5664919 - DNA, 12 bp, Homo sapiens
cccagctctggt

SEQ ID NO: 5664920 - DNA, 13 bp, Homo sapiens
cccagctctggtc

SEQ ID NO: 5664921 - DNA, 16 bp, Homo sapiens
cccagctctggtccat

SEQ ID NO: 5664922 - DNA, 20 bp, Homo sapiens
cccagctctggtgagtcttg

SEQ ID NO: 5664923 - DNA, 22 bp, Homo sapiens
cccagctctggtgagtcttggc

SEQ ID NO: 5664924 - DNA, 20 bp, Homo sapiens
cccagctcttctccccaggt

SEQ ID NO: 5664925 - DNA, 18 bp, Homo sapiens
cccagctcttgctctctt

SEQ ID NO: 5664926 - DNA, 23 bp, Homo sapiens
cccagctctttgttcagttgact

SEQ ID NO: 5664927 - DNA, 14 bp, Homo sapiens
cccagctgaaggca

SEQ ID NO: 5664928 - DNA, 21 bp, Homo sapiens
cccagctgacagtcctctcca

SEQ ID NO: 5664929 - DNA, 13 bp, Homo sapiens
cgcagggccctct

SEQ ID NO: 5664930 - DNA, 14 bp, Homo sapiens
cgcagggccctctg

SEQ ID NO: 5664931 - DNA, 22 bp, Homo sapiens
cgcagggccctctggggctcag

SEQ ID NO: 5664932 - DNA, 13 bp, Homo sapiens
cgcagggcgctcc

SEQ ID NO: 5664933 - DNA, 22 bp, Homo sapiens
cgcagggcgctccggcagaggc

SEQ ID NO: 5664934 - DNA, 23 bp, Homo sapiens
cgcagggcgctccggcagaggca

SEQ ID NO: 5664935 - DNA, 22 bp, Homo sapiens
cgcaggggactgtctcagaaga

SEQ ID NO: 5664936 - DNA, 18 bp, Homo sapiens
cgcaggggtttgggtggg

SEQ ID NO: 5664937 - DNA, 21 bp, Homo sapiens
cgcaggtatttagaagcagag

SEQ ID NO: 5664938 - DNA, 20 bp, Homo sapiens
cgcaggtctcttctgggcgt

SEQ ID NO: 5664939 - DNA, 20 bp, Homo sapiens
cgcaggtgccatgcctgctc

SEQ ID NO: 5664940 - DNA, 21 bp, Homo sapiens
cgcaggtgccatgcctgctcc

SEQ ID NO: 5664941 - DNA, 17 bp, Homo sapiens
cgcagtcgtcagcctcc

SEQ ID NO: 5664942 - DNA, 22 bp, Homo sapiens
cgcagtcgtcgcacagtctctc

SEQ ID NO: 5664943 - DNA, 13 bp, Homo sapiens
cgcagtctggcct

SEQ ID NO: 5664944 - DNA, 15 bp, Homo sapiens
cgcagtctggcctgg

SEQ ID NO: 5664945 - DNA, 17 bp, Homo sapiens
cgcagtgcccagtgatg

SEQ ID NO: 5664946 - DNA, 15 bp, Homo sapiens
cgcagtgcctctggt

SEQ ID NO: 5664947 - DNA, 19 bp, Homo sapiens
cgcagtgcttctctacaga

SEQ ID NO: 5664948 - DNA, 16 bp, Homo sapiens
cgcagtgtggaggcca

SEQ ID NO: 5664949 - DNA, 15 bp, Homo sapiens
cgcagtgtttgtgtg

SEQ ID NO: 5664950 - DNA, 16 bp, Homo sapiens
cgcagtgttttgcaag

SEQ ID NO: 5664951 - DNA, 15 bp, Homo sapiens
cgcagttactggttg

SEQ ID NO: 5664952 - DNA, 22 bp, Homo sapiens
cgcagttactggttggtgttct

SEQ ID NO: 5664953 - DNA, 13 bp, Homo sapiens
cgcagttctttcc

SEQ ID NO: 5664954 - DNA, 19 bp, Homo sapiens
cgcagttgtagcagaaacc

SEQ ID NO: 5664955 - DNA, 20 bp, Homo sapiens
cgcagttgtagcagaaacca

SEQ ID NO: 5664956 - DNA, 19 bp, Homo sapiens
cgcagttgtgtggcccagc

SEQ ID NO: 5664957 - DNA, 21 bp, Homo sapiens
cgcagttgtgtggcccagcac

SEQ ID NO: 5664958 - DNA, 12 bp, Homo sapiens
cgcagttttttt

SEQ ID NO: 5664959 - DNA, 21 bp, Homo sapiens
cgcatacacacatgccctcct

SEQ ID NO: 5664960 - DNA, 13 bp, Homo sapiens
cgcatagactgag

SEQ ID NO: 5664961 - DNA, 17 bp, Homo sapiens
cgcataggaaaagaatc

SEQ ID NO: 5664962 - DNA, 15 bp, Homo sapiens
cgcataggacctttc

SEQ ID NO: 5664963 - DNA, 16 bp, Homo sapiens
cgcataggcctgcttt

SEQ ID NO: 5664964 - DNA, 12 bp, Homo sapiens
cgcatatgcatg

SEQ ID NO: 5664965 - DNA, 18 bp, Homo sapiens
cgcatcaaaagacaattc

SEQ ID NO: 5664966 - DNA, 12 bp, Homo sapiens
cgcatcatatgc

SEQ ID NO: 5664967 - DNA, 23 bp, Homo sapiens
cgcatccaccgccaccccactga

SEQ ID NO: 5664968 - DNA, 13 bp, Homo sapiens
cgcatcccatctc

SEQ ID NO: 5664969 - DNA, 17 bp, Homo sapiens
cgcatcccatctctccc

SEQ ID NO: 5664970 - DNA, 16 bp, Homo sapiens
cgcatcccctgcctcc

SEQ ID NO: 5664971 - DNA, 18 bp, Homo sapiens
cgcatcccctgcctccat

SEQ ID NO: 5664972 - DNA, 19 bp, Homo sapiens
cgcatcccggctgaccctg

SEQ ID NO: 5664973 - DNA, 19 bp, Homo sapiens
cgcatccgcctctgagcca

SEQ ID NO: 5664974 - DNA, 22 bp, Homo sapiens
cgcatccgcctctgagccagga

SEQ ID NO: 5664975 - DNA, 14 bp, Homo sapiens
cgcatccgtcctgg

SEQ ID NO: 5664976 - DNA, 16 bp, Homo sapiens
cgcatcctagtctcta

SEQ ID NO: 5664977 - DNA, 14 bp, Homo sapiens
cgcatcctcttcca

SEQ ID NO: 5664978 - DNA, 13 bp, Homo sapiens
cgcatctcacagc

SEQ ID NO: 5664979 - DNA, 14 bp, Homo sapiens
cgcatctgcctgga

SEQ ID NO: 5664980 - DNA, 16 bp, Homo sapiens
cgcatctgcctggagc

SEQ ID NO: 5664981 - DNA, 20 bp, Homo sapiens
cgcatctgcctggagcctgg

SEQ ID NO: 5664982 - DNA, 19 bp, Homo sapiens
cgcatcttcccaacccctt

SEQ ID NO: 5664983 - DNA, 13 bp, Homo sapiens
cgcatcttctcca

SEQ ID NO: 5664984 - DNA, 21 bp, Homo sapiens
cgcatcttctccatctggcag

SEQ ID NO: 5664985 - DNA, 22 bp, Homo sapiens
cgcatgaccacccctctcgcct

SEQ ID NO: 5664986 - DNA, 18 bp, Homo sapiens
cgcatgagtatctgtggg

SEQ ID NO: 5664987 - DNA, 15 bp, Homo sapiens
cgcatgccagagcct

SEQ ID NO: 5664988 - DNA, 13 bp, Homo sapiens
cgcatgccccctc

SEQ ID NO: 5664989 - DNA, 13 bp, Homo sapiens
cgcatgcctcagc

SEQ ID NO: 5664990 - DNA, 21 bp, Homo sapiens
cgcatgctgcctgcctccggc

SEQ ID NO: 5664991 - DNA, 23 bp, Homo sapiens
cgcatgctgcctgcctccggccc

SEQ ID NO: 5664992 - DNA, 22 bp, Homo sapiens
cgcatggagtgtgtattgttcc

SEQ ID NO: 5664993 - DNA, 23 bp, Homo sapiens
cgcatggagtgtgtattgttccc

SEQ ID NO: 5664994 - DNA, 12 bp, Homo sapiens
cgcatggcagaa

SEQ ID NO: 5664995 - DNA, 16 bp, Homo sapiens
cgcatggcagctgggc

SEQ ID NO: 5664996 - DNA, 18 bp, Homo sapiens
cgcatggcagctgggccc

SEQ ID NO: 5664997 - DNA, 17 bp, Homo sapiens
cgcatggcccctccagg

SEQ ID NO: 5664998 - DNA, 15 bp, Homo sapiens
cgcatgggcattgca

SEQ ID NO: 5664999 - DNA, 16 bp, Homo sapiens
cgcatgggcattgcag

SEQ ID NO: 5665000 - DNA, 19 bp, Homo sapiens
cgcatggtcacacactgat

SEQ ID NO: 5665001 - DNA, 17 bp, Homo sapiens
cgcatgtaaagatgctg

SEQ ID NO: 5665002 - DNA, 16 bp, Homo sapiens
cgcatgtaatcccagc

SEQ ID NO: 5665003 - DNA, 21 bp, Homo sapiens
cgcatgtacaaaaacacaaat

SEQ ID NO: 5665004 - DNA, 22 bp, Homo sapiens
cgcatgtacaaaaacacaaata

SEQ ID NO: 5665005 - DNA, 12 bp, Homo sapiens
cgcatgtccctc

SEQ ID NO: 5665006 - DNA, 14 bp, Homo sapiens
cgcatgtccctcca

SEQ ID NO: 5665007 - DNA, 15 bp, Homo sapiens
cgcatgtccctccaa

SEQ ID NO: 5665008 - DNA, 14 bp, Homo sapiens
cgcatgtctgcacc

SEQ ID NO: 5665009 - DNA, 15 bp, Homo sapiens
cgcatgtctgcacct

SEQ ID NO: 5665010 - DNA, 19 bp, Homo sapiens
cgcatgtctgcacctccgc

SEQ ID NO: 5665011 - DNA, 13 bp, Homo sapiens
cgcatgtgtctgt

SEQ ID NO: 5665012 - DNA, 17 bp, Homo sapiens
cgcatgtgtctgtattc

SEQ ID NO: 5665013 - DNA, 11 bp, Homo sapiens
cgcatgtgtgc

SEQ ID NO: 5665014 - DNA, 14 bp, Homo sapiens
cgcattaagcacac

SEQ ID NO: 5665015 - DNA, 15 bp, Homo sapiens
cgcattaagcacaca

SEQ ID NO: 5665016 - DNA, 19 bp, Homo sapiens
cgcattaagggcctgctgg

SEQ ID NO: 5665017 - DNA, 22 bp, Homo sapiens
cgcattcagtgcacctgcctca

SEQ ID NO: 5665018 - DNA, 15 bp, Homo sapiens
cgcattccaggctcc

SEQ ID NO: 5665019 - DNA, 13 bp, Homo sapiens
cgcattccagggg

SEQ ID NO: 5665020 - DNA, 22 bp, Homo sapiens
cgcattccaggggctgcagccc

SEQ ID NO: 5665021 - DNA, 13 bp, Homo sapiens
cgcattccctgag

SEQ ID NO: 5665022 - DNA, 19 bp, Homo sapiens
cgcattctaacctggaggt

SEQ ID NO: 5665023 - DNA, 14 bp, Homo sapiens
cgcatttctcatgc

SEQ ID NO: 5665024 - DNA, 15 bp, Homo sapiens
cgcattttctctagc

SEQ ID NO: 5665025 - DNA, 16 bp, Homo sapiens
cgcattttctctagct

SEQ ID NO: 5665026 - DNA, 23 bp, Homo sapiens
cgcattttgggtgccattaaata

SEQ ID NO: 5665027 - DNA, 18 bp, Homo sapiens
cgccaaagaatgccttga

SEQ ID NO: 5665028 - DNA, 19 bp, Homo sapiens
cgccaaataatgtctctgt

SEQ ID NO: 5665029 - DNA, 15 bp, Homo sapiens
cgccaacacgcctgg

SEQ ID NO: 5665030 - DNA, 21 bp, Homo sapiens
cgccaaccccagcagtcctgg

SEQ ID NO: 5665031 - DNA, 14 bp, Homo sapiens
cgccaacttctccc

SEQ ID NO: 5665032 - DNA, 18 bp, Homo sapiens
cgccaacttctcccaccc

SEQ ID NO: 5665033 - DNA, 22 bp, Homo sapiens
cgccaacttctcccaccccttg

SEQ ID NO: 5665034 - DNA, 12 bp, Homo sapiens
cgccaagactca

SEQ ID NO: 5665035 - DNA, 15 bp, Homo sapiens
cgccaagactcaggg

SEQ ID NO: 5665036 - DNA, 23 bp, Homo sapiens
cgccaagccatcacaggctctgc

SEQ ID NO: 5665037 - DNA, 23 bp, Homo sapiens
cgccaaggaaaggcatgtacaaa

SEQ ID NO: 5665038 - DNA, 17 bp, Homo sapiens
cgccaaggactgactga

SEQ ID NO: 5665039 - DNA, 20 bp, Homo sapiens
cgccaaggactgactgagac

SEQ ID NO: 5665040 - DNA, 13 bp, Homo sapiens
cgccaaggcctag

SEQ ID NO: 5665041 - DNA, 18 bp, Homo sapiens
cgccaaggcctaggacct

SEQ ID NO: 5665042 - DNA, 16 bp, Homo sapiens
cgccaaggctggggga

SEQ ID NO: 5665043 - DNA, 14 bp, Homo sapiens
cgccaagtctggca

SEQ ID NO: 5665044 - DNA, 20 bp, Homo sapiens
cgccaagtctggcaccatgt

SEQ ID NO: 5665045 - DNA, 16 bp, Homo sapiens
cgccaataaaccaatg

SEQ ID NO: 5665046 - DNA, 19 bp, Homo sapiens
cgccaatgttatgccagct

SEQ ID NO: 5665047 - DNA, 20 bp, Homo sapiens
cgccaatgttatgccagctc

SEQ ID NO: 5665048 - DNA, 19 bp, Homo sapiens
cgccacaaaaatagagaaa

SEQ ID NO: 5665049 - DNA, 21 bp, Homo sapiens
cgccacacccggctccccctg

SEQ ID NO: 5665050 - DNA, 14 bp, Homo sapiens
cgccacagcccagc

SEQ ID NO: 5665051 - DNA, 14 bp, Homo sapiens
cgccacagcccttt

SEQ ID NO: 5665052 - DNA, 19 bp, Homo sapiens
cgccacagcccttttgtct

SEQ ID NO: 5665053 - DNA, 21 bp, Homo sapiens
cgccacagcctgggaaggagc

SEQ ID NO: 5665054 - DNA, 11 bp, Homo sapiens
cgccacatccc

SEQ ID NO: 5665055 - DNA, 23 bp, Homo sapiens
cgccacatggcttcctcctgcgc

SEQ ID NO: 5665056 - DNA, 20 bp, Homo sapiens
cgccacatggtgtggccatc

SEQ ID NO: 5665057 - DNA, 21 bp, Homo sapiens
cgccaccagcccgcaactctc

SEQ ID NO: 5665058 - DNA, 15 bp, Homo sapiens
cgccaccattcctgg

SEQ ID NO: 5665059 - DNA, 18 bp, Homo sapiens
cgccaccccactgagagc

SEQ ID NO: 5665060 - DNA, 10 bp, Homo sapiens
cgccaccccc

SEQ ID NO: 5665061 - DNA, 14 bp, Homo sapiens
cgccacccccatct

SEQ ID NO: 5665062 - DNA, 16 bp, Homo sapiens
cgccacccccatcttc

SEQ ID NO: 5665063 - DNA, 19 bp, Homo sapiens
cgccacccccatcttccac

SEQ ID NO: 5665064 - DNA, 22 bp, Homo sapiens
cgccacccccatcttccacctg

SEQ ID NO: 5665065 - DNA, 21 bp, Homo sapiens
cgccacccccccaccccaggc

SEQ ID NO: 5665066 - DNA, 20 bp, Homo sapiens
cgccacccccgcccccaccg

SEQ ID NO: 5665067 - DNA, 22 bp, Homo sapiens
cgccacccgcccgcccccgccc

SEQ ID NO: 5665068 - DNA, 19 bp, Homo sapiens
cgccacccgggcaagggtc

SEQ ID NO: 5665069 - DNA, 23 bp, Homo sapiens
cgccaccgcgggtgtgggaaagc

SEQ ID NO: 5665070 - DNA, 23 bp, Homo sapiens
cgccacctcagggcacgcaggac

SEQ ID NO: 5665071 - DNA, 20 bp, Homo sapiens
cgccacctggcattccttct

SEQ ID NO: 5665072 - DNA, 18 bp, Homo sapiens
cgccacctttcaccctca

SEQ ID NO: 5665073 - DNA, 14 bp, Homo sapiens
cgccacgctcagtg

SEQ ID NO: 5665074 - DNA, 15 bp, Homo sapiens
cgccacgctcagtgc

SEQ ID NO: 5665075 - DNA, 12 bp, Homo sapiens
cgccacggccac

SEQ ID NO: 5665076 - DNA, 16 bp, Homo sapiens
cgccacggccaccctc

SEQ ID NO: 5665077 - DNA, 15 bp, Homo sapiens
cgccacgtcccagca

SEQ ID NO: 5665078 - DNA, 12 bp, Homo sapiens
cgccactcattt

SEQ ID NO: 5665079 - DNA, 19 bp, Homo sapiens
cgccactcatttcatctca

SEQ ID NO: 5665080 - DNA, 21 bp, Homo sapiens
cgccactcatttcatctcatt

SEQ ID NO: 5665081 - DNA, 14 bp, Homo sapiens
cgccactccctggg

SEQ ID NO: 5665082 - DNA, 15 bp, Homo sapiens
cgccactccctggga

SEQ ID NO: 5665083 - DNA, 15 bp, Homo sapiens
cgccactcctgaacc

SEQ ID NO: 5665084 - DNA, 23 bp, Homo sapiens
cgccactcgcttcccccatagcc

SEQ ID NO: 5665085 - DNA, 13 bp, Homo sapiens
cgccactgcactc

SEQ ID NO: 5665086 - DNA, 22 bp, Homo sapiens
cgccactgcactccagcctggg

SEQ ID NO: 5665087 - DNA, 23 bp, Homo sapiens
cgccactgcactccagcctgggt

SEQ ID NO: 5665088 - DNA, 21 bp, Homo sapiens
cgccactgcactctagccgga

SEQ ID NO: 5665089 - DNA, 20 bp, Homo sapiens
cgccactggctgtgcctccc

SEQ ID NO: 5665090 - DNA, 22 bp, Homo sapiens
cgccactggctgtgcctccccc

SEQ ID NO: 5665091 - DNA, 13 bp, Homo sapiens
cgccactggggct

SEQ ID NO: 5665092 - DNA, 15 bp, Homo sapiens
cgccactggggctca

SEQ ID NO: 5665093 - DNA, 15 bp, Homo sapiens
cgccacttcctttgt

SEQ ID NO: 5665094 - DNA, 14 bp, Homo sapiens
cgccagagtgtcct

SEQ ID NO: 5665095 - DNA, 16 bp, Homo sapiens
cgccagagtgtcctgc

SEQ ID NO: 5665096 - DNA, 21 bp, Homo sapiens
cgccagattctttcctgaggc

SEQ ID NO: 5665097 - DNA, 19 bp, Homo sapiens
cgccagcagcgcgcaggcc

SEQ ID NO: 5665098 - DNA, 11 bp, Homo sapiens
cgccagccaca

SEQ ID NO: 5665099 - DNA, 12 bp, Homo sapiens
cgccagccacag

SEQ ID NO: 5665100 - DNA, 17 bp, Homo sapiens
cgccagccccaagctgg

SEQ ID NO: 5665101 - DNA, 20 bp, Homo sapiens
cgccagccccgctcccacct

SEQ ID NO: 5665102 - DNA, 13 bp, Homo sapiens
cgccagccctgtt

SEQ ID NO: 5665103 - DNA, 21 bp, Homo sapiens
cgccagccctgttccgcctca

SEQ ID NO: 5665104 - DNA, 20 bp, Homo sapiens
cgccagcctcagtgccactt

SEQ ID NO: 5665105 - DNA, 13 bp, Homo sapiens
cgccagcctcctc

SEQ ID NO: 5665106 - DNA, 14 bp, Homo sapiens
cgccagcctcctct

SEQ ID NO: 5665107 - DNA, 14 bp, Homo sapiens
ctgcccccagagcc

SEQ ID NO: 5665108 - DNA, 18 bp, Homo sapiens
ctgcccccagagccacag

SEQ ID NO: 5665109 - DNA, 20 bp, Homo sapiens
ctgcccccagcactcctctg

SEQ ID NO: 5665110 - DNA, 16 bp, Homo sapiens
ctgcccccagcccaaa

SEQ ID NO: 5665111 - DNA, 16 bp, Homo sapiens
ctgcccccagccccgg

SEQ ID NO: 5665112 - DNA, 23 bp, Homo sapiens
ctgcccccagctcttctccccag

SEQ ID NO: 5665113 - DNA, 16 bp, Homo sapiens
ctgcccccagctgctc

SEQ ID NO: 5665114 - DNA, 23 bp, Homo sapiens
ctgcccccagctgctcctcgcag

SEQ ID NO: 5665115 - DNA, 13 bp, Homo sapiens
ctgcccccaggac

SEQ ID NO: 5665116 - DNA, 14 bp, Homo sapiens
ctgcccccaggact

SEQ ID NO: 5665117 - DNA, 15 bp, Homo sapiens
ctgcccccaggactg

SEQ ID NO: 5665118 - DNA, 17 bp, Homo sapiens
ctgcccccatcacctct

SEQ ID NO: 5665119 - DNA, 16 bp, Homo sapiens
ctgcccccatccagcc

SEQ ID NO: 5665120 - DNA, 23 bp, Homo sapiens
ctgcccccatctccccaggcctc

SEQ ID NO: 5665121 - DNA, 23 bp, Homo sapiens
ctgccccccaaggttctggttcc

SEQ ID NO: 5665122 - DNA, 12 bp, Homo sapiens
ctgccccccagc

SEQ ID NO: 5665123 - DNA, 16 bp, Homo sapiens
ctgccccccagcctct

SEQ ID NO: 5665124 - DNA, 19 bp, Homo sapiens
ctgccccccagggctagtg

SEQ ID NO: 5665125 - DNA, 14 bp, Homo sapiens
ctgccccccagtct

SEQ ID NO: 5665126 - DNA, 19 bp, Homo sapiens
ctgccccccagtctcccca

SEQ ID NO: 5665127 - DNA, 19 bp, Homo sapiens
ctgcccccccaccccactc

SEQ ID NO: 5665128 - DNA, 15 bp, Homo sapiens
ctgccccccctaaga

SEQ ID NO: 5665129 - DNA, 20 bp, Homo sapiens
ctgccccccctaagagacac

SEQ ID NO: 5665130 - DNA, 15 bp, Homo sapiens
ctgccccccttccca

SEQ ID NO: 5665131 - DNA, 17 bp, Homo sapiens
ctgcccccgacagccca

SEQ ID NO: 5665132 - DNA, 19 bp, Homo sapiens
ctgcccccgacagcccagc

SEQ ID NO: 5665133 - DNA, 22 bp, Homo sapiens
ctgcccccgctcccgctcccag

SEQ ID NO: 5665134 - DNA, 23 bp, Homo sapiens
ctgcccccgctcccgctcccagg

SEQ ID NO: 5665135 - DNA, 13 bp, Homo sapiens
ctgcccccgctga

SEQ ID NO: 5665136 - DNA, 16 bp, Homo sapiens
ctgcccccggccccct

SEQ ID NO: 5665137 - DNA, 18 bp, Homo sapiens
ctgcccccggccccctgg

SEQ ID NO: 5665138 - DNA, 17 bp, Homo sapiens
ctgcccccgtcccacct

SEQ ID NO: 5665139 - DNA, 21 bp, Homo sapiens
ctgcccccgtcttctctccat

SEQ ID NO: 5665140 - DNA, 16 bp, Homo sapiens
ctgcccccgttccagc

SEQ ID NO: 5665141 - DNA, 17 bp, Homo sapiens
ctgcccccgttccagct

SEQ ID NO: 5665142 - DNA, 19 bp, Homo sapiens
ctgcccccgttccagctga

SEQ ID NO: 5665143 - DNA, 20 bp, Homo sapiens
ctgcccccgttccagctgac

SEQ ID NO: 5665144 - DNA, 18 bp, Homo sapiens
ctgccccctcccactctt

SEQ ID NO: 5665145 - DNA, 14 bp, Homo sapiens
ctgccccctccccc

SEQ ID NO: 5665146 - DNA, 20 bp, Homo sapiens
ctgccccctcccccatgggc

SEQ ID NO: 5665147 - DNA, 21 bp, Homo sapiens
ctgccccctcccccatgggct

SEQ ID NO: 5665148 - DNA, 19 bp, Homo sapiens
ctgccccctcccccgcaga

SEQ ID NO: 5665149 - DNA, 20 bp, Homo sapiens
ctccagctctggcttcctgc

SEQ ID NO: 5665150 - DNA, 15 bp, Homo sapiens
ctccagctctttcct

SEQ ID NO: 5665151 - DNA, 18 bp, Homo sapiens
ctccagctgacagccaca

SEQ ID NO: 5665152 - DNA, 19 bp, Homo sapiens
ctccagctgacagccacac

SEQ ID NO: 5665153 - DNA, 21 bp, Homo sapiens
ctccagctgacagccacaccg

SEQ ID NO: 5665154 - DNA, 16 bp, Homo sapiens
ctccagctgagtcctg

SEQ ID NO: 5665155 - DNA, 17 bp, Homo sapiens
ctccagctgcaccagag

SEQ ID NO: 5665156 - DNA, 11 bp, Homo sapiens
ctccagctgcc

SEQ ID NO: 5665157 - DNA, 14 bp, Homo sapiens
ctccagctgccccg

SEQ ID NO: 5665158 - DNA, 16 bp, Homo sapiens
ctccagctgcctgggc

SEQ ID NO: 5665159 - DNA, 17 bp, Homo sapiens
ctccagctgcctgggcc

SEQ ID NO: 5665160 - DNA, 19 bp, Homo sapiens
ctccagctgcctgggcccg

SEQ ID NO: 5665161 - DNA, 14 bp, Homo sapiens
ctccagctgctgag

SEQ ID NO: 5665162 - DNA, 22 bp, Homo sapiens
ctccagctggccgggagcctga

SEQ ID NO: 5665163 - DNA, 21 bp, Homo sapiens
ctccagctggtgcccccagac

SEQ ID NO: 5665164 - DNA, 13 bp, Homo sapiens
ctccagctgtcag

SEQ ID NO: 5665165 - DNA, 18 bp, Homo sapiens
ctccagctgtcagcctgg

SEQ ID NO: 5665166 - DNA, 14 bp, Homo sapiens
ctccagctgttacc

SEQ ID NO: 5665167 - DNA, 14 bp, Homo sapiens
ctccagcttcagct

SEQ ID NO: 5665168 - DNA, 13 bp, Homo sapiens
ctccagcttctgg

SEQ ID NO: 5665169 - DNA, 19 bp, Homo sapiens
ctccagcttctggtactct

SEQ ID NO: 5665170 - DNA, 20 bp, Homo sapiens
ctccagcttgtggagcccca

SEQ ID NO: 5665171 - DNA, 23 bp, Homo sapiens
ctccagctttaagggttgtgagc

SEQ ID NO: 5665172 - DNA, 20 bp, Homo sapiens
ctccagcttttcctcagggt

SEQ ID NO: 5665173 - DNA, 12 bp, Homo sapiens
ctccaggaaaga

SEQ ID NO: 5665174 - DNA, 22 bp, Homo sapiens
ctccaggaaagagcagtcagag

SEQ ID NO: 5665175 - DNA, 17 bp, Homo sapiens
ctccaggaacattccca

SEQ ID NO: 5665176 - DNA, 13 bp, Homo sapiens
ctccaggaagaag

SEQ ID NO: 5665177 - DNA, 11 bp, Homo sapiens
ctccaggaagg

SEQ ID NO: 5665178 - DNA, 16 bp, Homo sapiens
ctccaggaaggggctg

SEQ ID NO: 5665179 - DNA, 20 bp, Homo sapiens
ctccaggaaggggctggact

SEQ ID NO: 5665180 - DNA, 19 bp, Homo sapiens
ctccaggaaggtagcccag

SEQ ID NO: 5665181 - DNA, 23 bp, Homo sapiens
ctccaggaccttgcttccttctc

SEQ ID NO: 5665182 - DNA, 21 bp, Homo sapiens
ctccaggactccactggacag

SEQ ID NO: 5665183 - DNA, 17 bp, Homo sapiens
ctccaggacttgcttcc

SEQ ID NO: 5665184 - DNA, 18 bp, Homo sapiens
ctccaggagagagccagg

SEQ ID NO: 5665185 - DNA, 19 bp, Homo sapiens
ctccaggagagagccagga

SEQ ID NO: 5665186 - DNA, 11 bp, Homo sapiens
ctccaggagca

SEQ ID NO: 5665187 - DNA, 17 bp, Homo sapiens
ctccaggagcctacccc

SEQ ID NO: 5665188 - DNA, 19 bp, Homo sapiens
ctccaggagcctaccccct

SEQ ID NO: 5665189 - DNA, 14 bp, Homo sapiens
ctccaggagcctca

SEQ ID NO: 5665190 - DNA, 19 bp, Homo sapiens
ctccaggagcctcatccag

SEQ ID NO: 5665191 - DNA, 11 bp, Homo sapiens
ctccaggagct

SEQ ID NO: 5665192 - DNA, 14 bp, Homo sapiens
ctccaggagggctc

SEQ ID NO: 5665193 - DNA, 15 bp, Homo sapiens
ctccaggagggctcg

SEQ ID NO: 5665194 - DNA, 17 bp, Homo sapiens
ctccaggagggctcggg

SEQ ID NO: 5665195 - DNA, 14 bp, Homo sapiens
ctccaggaggggcc

SEQ ID NO: 5665196 - DNA, 21 bp, Homo sapiens
ctccaggatcctcctggagca

SEQ ID NO: 5665197 - DNA, 19 bp, Homo sapiens
ctccaggatggggaggggc

SEQ ID NO: 5665198 - DNA, 22 bp, Homo sapiens
ctccaggatggggaggggctct

SEQ ID NO: 5665199 - DNA, 16 bp, Homo sapiens
ctccaggattgtccac

SEQ ID NO: 5665200 - DNA, 23 bp, Homo sapiens
ctccaggattgtccacaaatgtc

SEQ ID NO: 5665201 - DNA, 16 bp, Homo sapiens
ctccaggatttataaa

SEQ ID NO: 5665202 - DNA, 18 bp, Homo sapiens
ctccaggattttaatttc

SEQ ID NO: 5665203 - DNA, 21 bp, Homo sapiens
ctccaggattttaatttcagg

SEQ ID NO: 5665204 - DNA, 16 bp, Homo sapiens
ctccaggcaccatctc

SEQ ID NO: 5665205 - DNA, 16 bp, Homo sapiens
ctccaggcacccttct

SEQ ID NO: 5665206 - DNA, 21 bp, Homo sapiens
ctccaggcacccttctttcct

SEQ ID NO: 5665207 - DNA, 16 bp, Homo sapiens
ctccaggcagaggcag

SEQ ID NO: 5665208 - DNA, 11 bp, Homo sapiens
ctccaggcagc

SEQ ID NO: 5665209 - DNA, 12 bp, Homo sapiens
ctccaggcagca

SEQ ID NO: 5665210 - DNA, 14 bp, Homo sapiens
ctccaggcaggact

SEQ ID NO: 5665211 - DNA, 15 bp, Homo sapiens
ctccaggcaggccag

SEQ ID NO: 5665212 - DNA, 20 bp, Homo sapiens
ctccaggcaggccaggctgc

SEQ ID NO: 5665213 - DNA, 16 bp, Homo sapiens
ctccaggcatgctggc

SEQ ID NO: 5665214 - DNA, 19 bp, Homo sapiens
ctccaggcatgctggcctc

SEQ ID NO: 5665215 - DNA, 20 bp, Homo sapiens
ctccaggcatgtgtctggcc

SEQ ID NO: 5665216 - DNA, 22 bp, Homo sapiens
ctccaggcatgtgtctggccct

SEQ ID NO: 5665217 - DNA, 20 bp, Homo sapiens
ctccaggcatttagccctca

SEQ ID NO: 5665218 - DNA, 20 bp, Homo sapiens
ctccaggccacatggggctg

SEQ ID NO: 5665219 - DNA, 13 bp, Homo sapiens
ctccaggccagct

SEQ ID NO: 5665220 - DNA, 15 bp, Homo sapiens
ctccaggccagctcc

SEQ ID NO: 5665221 - DNA, 16 bp, Homo sapiens
ctccaggccagctcct

SEQ ID NO: 5665222 - DNA, 22 bp, Homo sapiens
ctccaggccagctccttttctg

SEQ ID NO: 5665223 - DNA, 12 bp, Homo sapiens
ctccaggccagg

SEQ ID NO: 5665224 - DNA, 16 bp, Homo sapiens
ctccaggcccaaggct

SEQ ID NO: 5665225 - DNA, 14 bp, Homo sapiens
ctccaggcccagcc

SEQ ID NO: 5665226 - DNA, 16 bp, Homo sapiens
ctccaggcccagcctg

SEQ ID NO: 5665227 - DNA, 21 bp, Homo sapiens
ctccaggccccaccaagaggg

SEQ ID NO: 5665228 - DNA, 18 bp, Homo sapiens
ctccaggcccccaactcc

SEQ ID NO: 5665229 - DNA, 14 bp, Homo sapiens
ctccaggcccgtct

SEQ ID NO: 5665230 - DNA, 18 bp, Homo sapiens
ctccaggcccgtctgtcc

SEQ ID NO: 5665231 - DNA, 19 bp, Homo sapiens
ctccaggcccgtctgtcca

SEQ ID NO: 5665232 - DNA, 17 bp, Homo sapiens
ctccaggccctcagatg

SEQ ID NO: 5665233 - DNA, 20 bp, Homo sapiens
ctccaggccctcctctccca

SEQ ID NO: 5665234 - DNA, 19 bp, Homo sapiens
ctccaggccgacaggaggc

SEQ ID NO: 5665235 - DNA, 15 bp, Homo sapiens
ctccaggcctctagt

SEQ ID NO: 5665236 - DNA, 16 bp, Homo sapiens
ctccaggcctgcaggg

SEQ ID NO: 5665237 - DNA, 13 bp, Homo sapiens
ctccaggcctgcc

SEQ ID NO: 5665238 - DNA, 18 bp, Homo sapiens
ctccaggcctgcctccca

SEQ ID NO: 5665239 - DNA, 13 bp, Homo sapiens
ctccaggcgccgg

SEQ ID NO: 5665240 - DNA, 17 bp, Homo sapiens
ctccaggctccagcaca

SEQ ID NO: 5665241 - DNA, 23 bp, Homo sapiens
ctccaggctcctttagcgcccag

SEQ ID NO: 5665242 - DNA, 11 bp, Homo sapiens
ctccaggctgg

SEQ ID NO: 5665243 - DNA, 14 bp, Homo sapiens
ctccaggctggaag

SEQ ID NO: 5665244 - DNA, 12 bp, Homo sapiens
ctccaggctggg

SEQ ID NO: 5665245 - DNA, 19 bp, Homo sapiens
ctccaggctgggctgagcc

SEQ ID NO: 5665246 - DNA, 23 bp, Homo sapiens
ctccaggctgggctgagccaaag

SEQ ID NO: 5665247 - DNA, 14 bp, Homo sapiens
ctccaggctggggc

SEQ ID NO: 5665248 - DNA, 19 bp, Homo sapiens
ctccaggctggggcctggc

SEQ ID NO: 5665249 - DNA, 20 bp, Homo sapiens
ctccaggctggggcctggcc

SEQ ID NO: 5665250 - DNA, 14 bp, Homo sapiens
ctccaggcttcaca

SEQ ID NO: 5665251 - DNA, 14 bp, Homo sapiens
ctccaggcttcccc

SEQ ID NO: 5665252 - DNA, 14 bp, Homo sapiens
ctccaggcttcctg

SEQ ID NO: 5665253 - DNA, 16 bp, Homo sapiens
ctccaggcttcctgcc

SEQ ID NO: 5665254 - DNA, 17 bp, Homo sapiens
ctccaggcttcctgccc

SEQ ID NO: 5665255 - DNA, 18 bp, Homo sapiens
ctccaggcttcctgccct

SEQ ID NO: 5665256 - DNA, 15 bp, Homo sapiens
ctccaggctttctgg

SEQ ID NO: 5665257 - DNA, 15 bp, Homo sapiens
ctccagggaagcgtc

SEQ ID NO: 5665258 - DNA, 20 bp, Homo sapiens
ctccagggaatccaagcctc

SEQ ID NO: 5665259 - DNA, 21 bp, Homo sapiens
ctccagggaatccaagcctcc

SEQ ID NO: 5665260 - DNA, 19 bp, Homo sapiens
ctccagggacacacagcct

SEQ ID NO: 5665261 - DNA, 13 bp, Homo sapiens
ctccagggacaga

SEQ ID NO: 5665262 - DNA, 19 bp, Homo sapiens
ctccagggagcaagacaga

SEQ ID NO: 5665263 - DNA, 20 bp, Homo sapiens
ctccagggagcaagacagag

SEQ ID NO: 5665264 - DNA, 22 bp, Homo sapiens
ctccagggagcctagaagctgg

SEQ ID NO: 5665265 - DNA, 21 bp, Homo sapiens
ctccagggagtcccctccccg

SEQ ID NO: 5665266 - DNA, 15 bp, Homo sapiens
ctccagggcattgct

SEQ ID NO: 5665267 - DNA, 21 bp, Homo sapiens
ctccagggcctctccttggaa

SEQ ID NO: 5665268 - DNA, 16 bp, Homo sapiens
ctccagggcgagcact

SEQ ID NO: 5665269 - DNA, 19 bp, Homo sapiens
ctccagggcgcaggggagg

SEQ ID NO: 5665270 - DNA, 21 bp, Homo sapiens
ctccagggctcaacactgtga

SEQ ID NO: 5665271 - DNA, 15 bp, Homo sapiens
ctccagggctgcccc

SEQ ID NO: 5665272 - DNA, 18 bp, Homo sapiens
ctccagggctgcccctgt

SEQ ID NO: 5665273 - DNA, 14 bp, Homo sapiens
ctccagggctggac

SEQ ID NO: 5665274 - DNA, 18 bp, Homo sapiens
ctccagggctggactgag

SEQ ID NO: 5665275 - DNA, 22 bp, Homo sapiens
ctccaggggcctgcagaaggaa

SEQ ID NO: 5665276 - DNA, 14 bp, Homo sapiens
ctccaggggctcct

SEQ ID NO: 5665277 - DNA, 15 bp, Homo sapiens
ctccaggggctgctt

SEQ ID NO: 5665278 - DNA, 22 bp, Homo sapiens
ctccaggggctgcttcctcctg

SEQ ID NO: 5665279 - DNA, 13 bp, Homo sapiens
ctccaggggctgg

SEQ ID NO: 5665280 - DNA, 18 bp, Homo sapiens
ctccagggggcctgcagg

SEQ ID NO: 5665281 - DNA, 21 bp, Homo sapiens
ctccagggggcctgcaggccc

SEQ ID NO: 5665282 - DNA, 15 bp, Homo sapiens
ctccaggggtggctg

SEQ ID NO: 5665283 - DNA, 16 bp, Homo sapiens
ctccagggtacatgct

SEQ ID NO: 5665284 - DNA, 15 bp, Homo sapiens
ctccagggtcccctg

SEQ ID NO: 5665285 - DNA, 13 bp, Homo sapiens
ctccatctttata

SEQ ID NO: 5665286 - DNA, 14 bp, Homo sapiens
ctccatctttttct

SEQ ID NO: 5665287 - DNA, 17 bp, Homo sapiens
ctccatctttttcttgg

SEQ ID NO: 5665288 - DNA, 21 bp, Homo sapiens
ctccatgaagagcttgtgtcc

SEQ ID NO: 5665289 - DNA, 19 bp, Homo sapiens
ctccatgaccaggccacca

SEQ ID NO: 5665290 - DNA, 21 bp, Homo sapiens
ctccatgaccaggccaccatc

SEQ ID NO: 5665291 - DNA, 20 bp, Homo sapiens
ctccatgaggtactggtccc

SEQ ID NO: 5665292 - DNA, 21 bp, Homo sapiens
ctccatgaggtactggtccct

SEQ ID NO: 5665293 - DNA, 17 bp, Homo sapiens
ctccatgagttttttct

SEQ ID NO: 5665294 - DNA, 13 bp, Homo sapiens
ctccatgatattt

SEQ ID NO: 5665295 - DNA, 20 bp, Homo sapiens
ctccatgatgcaagccagct

SEQ ID NO: 5665296 - DNA, 12 bp, Homo sapiens
ctccatgattct

SEQ ID NO: 5665297 - DNA, 19 bp, Homo sapiens
ctccatgattctctgagtg

SEQ ID NO: 5665298 - DNA, 15 bp, Homo sapiens
ctccatgcacctccc

SEQ ID NO: 5665299 - DNA, 22 bp, Homo sapiens
ctccatgcaggggtcagtgcag

SEQ ID NO: 5665300 - DNA, 13 bp, Homo sapiens
ctccatgcccaac

SEQ ID NO: 5665301 - DNA, 14 bp, Homo sapiens
ctccatgcccaacc

SEQ ID NO: 5665302 - DNA, 16 bp, Homo sapiens
ctccatgccccagctc

SEQ ID NO: 5665303 - DNA, 18 bp, Homo sapiens
ctccatgccccagctctg

SEQ ID NO: 5665304 - DNA, 21 bp, Homo sapiens
ctccatgccccagctctggat

SEQ ID NO: 5665305 - DNA, 19 bp, Homo sapiens
ctccatgcccccgccacct

SEQ ID NO: 5665306 - DNA, 20 bp, Homo sapiens
ctccatgcccccgccacctc

SEQ ID NO: 5665307 - DNA, 22 bp, Homo sapiens
ctccatgcctatttactggaaa

SEQ ID NO: 5665308 - DNA, 14 bp, Homo sapiens
ctccatgcctctgg

SEQ ID NO: 5665309 - DNA, 23 bp, Homo sapiens
ctccatgcctctggaggcctctg

SEQ ID NO: 5665310 - DNA, 23 bp, Homo sapiens
ctccatgcgcagatgaggggcca

SEQ ID NO: 5665311 - DNA, 16 bp, Homo sapiens
ctccatgctccttgag

SEQ ID NO: 5665312 - DNA, 15 bp, Homo sapiens
ctccatgctgcaaag

SEQ ID NO: 5665313 - DNA, 16 bp, Homo sapiens
ctccatgctgcctcca

SEQ ID NO: 5665314 - DNA, 21 bp, Homo sapiens
ctccatgctggatactggaca

SEQ ID NO: 5665315 - DNA, 18 bp, Homo sapiens
ctccatgctgtccctgtg

SEQ ID NO: 5665316 - DNA, 21 bp, Homo sapiens
ctccatgctgtccctgtgggc

SEQ ID NO: 5665317 - DNA, 13 bp, Homo sapiens
ctccatggaaaag

SEQ ID NO: 5665318 - DNA, 11 bp, Homo sapiens
ctccatggagg

SEQ ID NO: 5665319 - DNA, 16 bp, Homo sapiens
ctccatggaggaggtg

SEQ ID NO: 5665320 - DNA, 21 bp, Homo sapiens
ctccatggaggaggtgtccca

SEQ ID NO: 5665321 - DNA, 23 bp, Homo sapiens
ctccatggaggaggtgtcccaag

SEQ ID NO: 5665322 - DNA, 15 bp, Homo sapiens
ctccatggcagcagc

SEQ ID NO: 5665323 - DNA, 22 bp, Homo sapiens
ctccatggcagcagccagggac

SEQ ID NO: 5665324 - DNA, 23 bp, Homo sapiens
ctccatggcagcagccagggacc

SEQ ID NO: 5665325 - DNA, 21 bp, Homo sapiens
ctccatggccaccccgtgcca

SEQ ID NO: 5665326 - DNA, 22 bp, Homo sapiens
ctccatggccaccccgtgccac

SEQ ID NO: 5665327 - DNA, 15 bp, Homo sapiens
ctccatggccctgcc

SEQ ID NO: 5665328 - DNA, 19 bp, Homo sapiens
ctccatggccctgccatgc

SEQ ID NO: 5665329 - DNA, 17 bp, Homo sapiens
ctccatggcccttcctg

SEQ ID NO: 5665330 - DNA, 15 bp, Homo sapiens
ctgccctcccacccc

SEQ ID NO: 5665331 - DNA, 23 bp, Homo sapiens
ctgccctcccatgttgcatgcct

SEQ ID NO: 5665332 - DNA, 21 bp, Homo sapiens
ctgccctccccagagcactgg

SEQ ID NO: 5665333 - DNA, 12 bp, Homo sapiens
ctgccctcccct

SEQ ID NO: 5665334 - DNA, 22 bp, Homo sapiens
ctgccctcccctccggactggt

SEQ ID NO: 5665335 - DNA, 14 bp, Homo sapiens
ctgccctcccctct

SEQ ID NO: 5665336 - DNA, 13 bp, Homo sapiens
ctgccctcccctg

SEQ ID NO: 5665337 - DNA, 15 bp, Homo sapiens
ctgccctcccctgct

SEQ ID NO: 5665338 - DNA, 20 bp, Homo sapiens
ctgccctcccctgctcccag

SEQ ID NO: 5665339 - DNA, 18 bp, Homo sapiens
ctgccctccctcagccgt

SEQ ID NO: 5665340 - DNA, 16 bp, Homo sapiens
ctgccctccctggcct

SEQ ID NO: 5665341 - DNA, 16 bp, Homo sapiens
ctgccctccctggggt

SEQ ID NO: 5665342 - DNA, 16 bp, Homo sapiens
ctgccctccgcccttc

SEQ ID NO: 5665343 - DNA, 19 bp, Homo sapiens
ctgccctccgcccttccct

SEQ ID NO: 5665344 - DNA, 17 bp, Homo sapiens
ctgccctccggaggagc

SEQ ID NO: 5665345 - DNA, 20 bp, Homo sapiens
ctgccctccggaggagcagc

SEQ ID NO: 5665346 - DNA, 15 bp, Homo sapiens
ctgccctcctctccc

SEQ ID NO: 5665347 - DNA, 16 bp, Homo sapiens
ctgccctcctgccaaa

SEQ ID NO: 5665348 - DNA, 16 bp, Homo sapiens
ctgccctcctgtgctc

SEQ ID NO: 5665349 - DNA, 19 bp, Homo sapiens
ctgccctcctgtgctcagc

SEQ ID NO: 5665350 - DNA, 20 bp, Homo sapiens
ctgccctcctgtgctcagcc

SEQ ID NO: 5665351 - DNA, 21 bp, Homo sapiens
ctgccctcctgtgctcagccc

SEQ ID NO: 5665352 - DNA, 23 bp, Homo sapiens
ctgccctcctgtgctcagccctg

SEQ ID NO: 5665353 - DNA, 20 bp, Homo sapiens
ctgccctcggcaaccgtggg

SEQ ID NO: 5665354 - DNA, 17 bp, Homo sapiens
ctgccctcgtggccagc

SEQ ID NO: 5665355 - DNA, 19 bp, Homo sapiens
ctgccctcgtggccagccc

SEQ ID NO: 5665356 - DNA, 14 bp, Homo sapiens
ctgccctctccaca

SEQ ID NO: 5665357 - DNA, 15 bp, Homo sapiens
ctgccctctccctgt

SEQ ID NO: 5665358 - DNA, 12 bp, Homo sapiens
ctgccctctcct

SEQ ID NO: 5665359 - DNA, 13 bp, Homo sapiens
ctgccctctcctg

SEQ ID NO: 5665360 - DNA, 18 bp, Homo sapiens
ctgccctctccttcctta

SEQ ID NO: 5665361 - DNA, 13 bp, Homo sapiens
ctgccctctctca

SEQ ID NO: 5665362 - DNA, 20 bp, Homo sapiens
ctgccctctctcagttattc

SEQ ID NO: 5665363 - DNA, 13 bp, Homo sapiens
ctgccctctctgc

SEQ ID NO: 5665364 - DNA, 12 bp, Homo sapiens
ctgccctctgcc

SEQ ID NO: 5665365 - DNA, 13 bp, Homo sapiens
ctgccctctgctc

SEQ ID NO: 5665366 - DNA, 15 bp, Homo sapiens
ctgccctctgctctg

SEQ ID NO: 5665367 - DNA, 18 bp, Homo sapiens
ctgccctctgctgctgcc

SEQ ID NO: 5665368 - DNA, 19 bp, Homo sapiens
ctgccctctgctgctgccc

SEQ ID NO: 5665369 - DNA, 21 bp, Homo sapiens
ctgccctctgctgctgcccgg

SEQ ID NO: 5665370 - DNA, 16 bp, Homo sapiens
ctgccctctggggcca

SEQ ID NO: 5665371 - DNA, 15 bp, Homo sapiens
ctgccctcttactgt

SEQ ID NO: 5665372 - DNA, 12 bp, Homo sapiens
ctgccctgagaa

SEQ ID NO: 5665373 - DNA, 14 bp, Homo sapiens
ctgccctgagccct

SEQ ID NO: 5665374 - DNA, 21 bp, Homo sapiens
ctgccctgaggagggccctga

SEQ ID NO: 5665375 - DNA, 15 bp, Homo sapiens
ctgccctgcaccttg

SEQ ID NO: 5665376 - DNA, 19 bp, Homo sapiens
ctgccctgcaccttgggca

SEQ ID NO: 5665377 - DNA, 15 bp, Homo sapiens
ctgccctgcagcacg

SEQ ID NO: 5665378 - DNA, 20 bp, Homo sapiens
ctgccctgccacctgtctgt

SEQ ID NO: 5665379 - DNA, 12 bp, Homo sapiens
ctgccctgccca

SEQ ID NO: 5665380 - DNA, 13 bp, Homo sapiens
ctgccctgcccaa

SEQ ID NO: 5665381 - DNA, 13 bp, Homo sapiens
ctgccctgcccac

SEQ ID NO: 5665382 - DNA, 14 bp, Homo sapiens
ctgccctgccccac

SEQ ID NO: 5665383 - DNA, 15 bp, Homo sapiens
ctgccctgccctcac

SEQ ID NO: 5665384 - DNA, 16 bp, Homo sapiens
ctgccctgccctcctg

SEQ ID NO: 5665385 - DNA, 14 bp, Homo sapiens
ctgccctgcctgag

SEQ ID NO: 5665386 - DNA, 14 bp, Homo sapiens
ctgccctgcctgcc

SEQ ID NO: 5665387 - DNA, 16 bp, Homo sapiens
ctgccctgcctgggcc

SEQ ID NO: 5665388 - DNA, 14 bp, Homo sapiens
ctgccctgccttgc

SEQ ID NO: 5665389 - DNA, 14 bp, Homo sapiens
ctgccctgctccta

SEQ ID NO: 5665390 - DNA, 17 bp, Homo sapiens
ctgccctgctgagcaca

SEQ ID NO: 5665391 - DNA, 19 bp, Homo sapiens
ctgccctgctgccacagca

SEQ ID NO: 5665392 - DNA, 21 bp, Homo sapiens
ctgccctgctgccgcctccca

SEQ ID NO: 5665393 - DNA, 16 bp, Homo sapiens
ctgccctgctgtggaa

SEQ ID NO: 5665394 - DNA, 17 bp, Homo sapiens
ctgccctggaacatcct

SEQ ID NO: 5665395 - DNA, 16 bp, Homo sapiens
ctgccctggaggaagt

SEQ ID NO: 5665396 - DNA, 16 bp, Homo sapiens
ctgccctggagggagg

SEQ ID NO: 5665397 - DNA, 17 bp, Homo sapiens
ctgccctggagggaggc

SEQ ID NO: 5665398 - DNA, 17 bp, Homo sapiens
ctgccctggcagcagca

SEQ ID NO: 5665399 - DNA, 11 bp, Homo sapiens
ctgccctggcc

SEQ ID NO: 5665400 - DNA, 14 bp, Homo sapiens
ctgccctggccctg

SEQ ID NO: 5665401 - DNA, 19 bp, Homo sapiens
ctgccctggcctaccacag

SEQ ID NO: 5665402 - DNA, 12 bp, Homo sapiens
ctgccctggctg

SEQ ID NO: 5665403 - DNA, 14 bp, Homo sapiens
ctgccctggctgct

SEQ ID NO: 5665404 - DNA, 20 bp, Homo sapiens
ctgccctggctgctgccccc

SEQ ID NO: 5665405 - DNA, 22 bp, Homo sapiens
ctgccctgggaggcagtgatgg

SEQ ID NO: 5665406 - DNA, 19 bp, Homo sapiens
ctgccctgggatgtccaca

SEQ ID NO: 5665407 - DNA, 24 bp, Homo sapiens
ctgccctgggatgtccacagatgc

SEQ ID NO: 5665408 - DNA, 12 bp, Homo sapiens
ctgccctgggct

SEQ ID NO: 5665409 - DNA, 14 bp, Homo sapiens
ctgccctgggctcc

SEQ ID NO: 5665410 - DNA, 18 bp, Homo sapiens
ctgccctgggctcctctt

SEQ ID NO: 5665411 - DNA, 12 bp, Homo sapiens
ctgccctggggc

SEQ ID NO: 5665412 - DNA, 20 bp, Homo sapiens
ctgccctggggcatcatggg

SEQ ID NO: 5665413 - DNA, 16 bp, Homo sapiens
ctgccctgggtcctgc

SEQ ID NO: 5665414 - DNA, 18 bp, Homo sapiens
ctgccctgggtcctgcct

SEQ ID NO: 5665415 - DNA, 23 bp, Homo sapiens
ctgccctgggtcctgcctgcagt

SEQ ID NO: 5665416 - DNA, 14 bp, Homo sapiens
ctgccctggtccag

SEQ ID NO: 5665417 - DNA, 12 bp, Homo sapiens
ctgccctggtgc

SEQ ID NO: 5665418 - DNA, 15 bp, Homo sapiens
ctgccctggtgctgc

SEQ ID NO: 5665419 - DNA, 23 bp, Homo sapiens
ctgccctggtgctgccacacttc

SEQ ID NO: 5665420 - DNA, 17 bp, Homo sapiens
ctgccctggtggccctc

SEQ ID NO: 5665421 - DNA, 17 bp, Homo sapiens
ctgccctggtttcctgc

SEQ ID NO: 5665422 - DNA, 18 bp, Homo sapiens
ctgccctggtttcctgcc

SEQ ID NO: 5665423 - DNA, 20 bp, Homo sapiens
ctgccctggtttcctgccct

SEQ ID NO: 5665424 - DNA, 13 bp, Homo sapiens
ctgccctgtaccc

SEQ ID NO: 5665425 - DNA, 11 bp, Homo sapiens
ctgccctgtat

SEQ ID NO: 5665426 - DNA, 14 bp, Homo sapiens
ctgccctgtatata

SEQ ID NO: 5665427 - DNA, 16 bp, Homo sapiens
ctgccctgtcaagctt

SEQ ID NO: 5665428 - DNA, 13 bp, Homo sapiens
ctgccctgtccaa

SEQ ID NO: 5665429 - DNA, 14 bp, Homo sapiens
ctgccctgtccctg

SEQ ID NO: 5665430 - DNA, 13 bp, Homo sapiens
ctgccctgtctgg

SEQ ID NO: 5665431 - DNA, 20 bp, Homo sapiens
ctgccctgtgagagccacgc

SEQ ID NO: 5665432 - DNA, 21 bp, Homo sapiens
ctgccctgtgagagccacgct

SEQ ID NO: 5665433 - DNA, 21 bp, Homo sapiens
ctgccctgtgatatgtctgct

SEQ ID NO: 5665434 - DNA, 13 bp, Homo sapiens
ctgccctgtgccg

SEQ ID NO: 5665435 - DNA, 12 bp, Homo sapiens
ctgccctgtggg

SEQ ID NO: 5665436 - DNA, 20 bp, Homo sapiens
ctgccctgtgggaccccagg

SEQ ID NO: 5665437 - DNA, 22 bp, Homo sapiens
ctgccctgtgggaccccaggcc

SEQ ID NO: 5665438 - DNA, 19 bp, Homo sapiens
ctgccctgtgggcccccaa

SEQ ID NO: 5665439 - DNA, 22 bp, Homo sapiens
ctgccctgtgtacttcccgggc

SEQ ID NO: 5665440 - DNA, 19 bp, Homo sapiens
ctgccctgttagctttcca

SEQ ID NO: 5665441 - DNA, 16 bp, Homo sapiens
ctgccctgtttctgtt

SEQ ID NO: 5665442 - DNA, 16 bp, Homo sapiens
ctgcccttacctgcca

SEQ ID NO: 5665443 - DNA, 17 bp, Homo sapiens
ctgcccttcaccccagt

SEQ ID NO: 5665444 - DNA, 12 bp, Homo sapiens
ctgcccttccag

SEQ ID NO: 5665445 - DNA, 18 bp, Homo sapiens
ctgcccttccgcagtgtg

SEQ ID NO: 5665446 - DNA, 11 bp, Homo sapiens
ctgcccttcct

SEQ ID NO: 5665447 - DNA, 13 bp, Homo sapiens
ctgcccttcctca

SEQ ID NO: 5665448 - DNA, 15 bp, Homo sapiens
ctgcccttcctccag

SEQ ID NO: 5665449 - DNA, 17 bp, Homo sapiens
ctgcccttcctccagga

SEQ ID NO: 5665450 - DNA, 15 bp, Homo sapiens
ctgcccttcctcctg

SEQ ID NO: 5665451 - DNA, 20 bp, Homo sapiens
ctgcccttcctcctgatgga

SEQ ID NO: 5665452 - DNA, 19 bp, Homo sapiens
ctgcccttcgctgccagga

SEQ ID NO: 5665453 - DNA, 22 bp, Homo sapiens
ctgcccttcgctgccaggacac

SEQ ID NO: 5665454 - DNA, 18 bp, Homo sapiens
ctgcccttctctgcctcc

SEQ ID NO: 5665455 - DNA, 14 bp, Homo sapiens
ctgcccttcttccc

SEQ ID NO: 5665456 - DNA, 18 bp, Homo sapiens
ctgcccttgcagggtggg

SEQ ID NO: 5665457 - DNA, 22 bp, Homo sapiens
ctgcccttgctccagcctgaca

SEQ ID NO: 5665458 - DNA, 14 bp, Homo sapiens
ctgcccttgctgcc

SEQ ID NO: 5665459 - DNA, 16 bp, Homo sapiens
ctgcccttgctgcccg

SEQ ID NO: 5665460 - DNA, 20 bp, Homo sapiens
ctgcccttgggtccccccga

SEQ ID NO: 5665461 - DNA, 20 bp, Homo sapiens
ctgcccttggtttctggggg

SEQ ID NO: 5665462 - DNA, 16 bp, Homo sapiens
ctgcccttgtctgaga

SEQ ID NO: 5665463 - DNA, 16 bp, Homo sapiens
ctgcccttgttgcctg

SEQ ID NO: 5665464 - DNA, 20 bp, Homo sapiens
ctcccacaagtatatacttt

SEQ ID NO: 5665465 - DNA, 23 bp, Homo sapiens
ctcccacaatctgggactttcac

SEQ ID NO: 5665466 - DNA, 18 bp, Homo sapiens
ctcccacacccaaagctg

SEQ ID NO: 5665467 - DNA, 15 bp, Homo sapiens
ctcccacacccaccc

SEQ ID NO: 5665468 - DNA, 18 bp, Homo sapiens
ctcccacacccacccttt

SEQ ID NO: 5665469 - DNA, 14 bp, Homo sapiens
ctcccacaccgcgt

SEQ ID NO: 5665470 - DNA, 17 bp, Homo sapiens
ctcccacactgaaacca

SEQ ID NO: 5665471 - DNA, 20 bp, Homo sapiens
ctcccacactgaaaccaaaa

SEQ ID NO: 5665472 - DNA, 15 bp, Homo sapiens
ctcccacactgctag

SEQ ID NO: 5665473 - DNA, 22 bp, Homo sapiens
ctcccacacttcccacccccag

SEQ ID NO: 5665474 - DNA, 21 bp, Homo sapiens
ctcccacacttgtgccagccc

SEQ ID NO: 5665475 - DNA, 12 bp, Homo sapiens
ctcccacagacc

SEQ ID NO: 5665476 - DNA, 17 bp, Homo sapiens
ctcccacagacctgcag

SEQ ID NO: 5665477 - DNA, 16 bp, Homo sapiens
ctcccacagagtgctg

SEQ ID NO: 5665478 - DNA, 20 bp, Homo sapiens
ctcccacagagtgctggact

SEQ ID NO: 5665479 - DNA, 14 bp, Homo sapiens
ctcccacagcctcc

SEQ ID NO: 5665480 - DNA, 15 bp, Homo sapiens
ctcccacagcctcct

SEQ ID NO: 5665481 - DNA, 19 bp, Homo sapiens
ctcccacagcctccttctg

SEQ ID NO: 5665482 - DNA, 20 bp, Homo sapiens
ctcccacagcctccttctgt

SEQ ID NO: 5665483 - DNA, 19 bp, Homo sapiens
ctcccacagcttcctgagg

SEQ ID NO: 5665484 - DNA, 16 bp, Homo sapiens
ctcccacaggcagctt

SEQ ID NO: 5665485 - DNA, 14 bp, Homo sapiens
ctcccacaggccct

SEQ ID NO: 5665486 - DNA, 16 bp, Homo sapiens
ctcccacaggcccttc

SEQ ID NO: 5665487 - DNA, 20 bp, Homo sapiens
ctcccacaggcccttcctct

SEQ ID NO: 5665488 - DNA, 23 bp, Homo sapiens
ctcccacaggggccatgtcctct

SEQ ID NO: 5665489 - DNA, 13 bp, Homo sapiens
ctcccacaggtct

SEQ ID NO: 5665490 - DNA, 11 bp, Homo sapiens
ctcccacagtg

SEQ ID NO: 5665491 - DNA, 15 bp, Homo sapiens
ctcccacatcccact

SEQ ID NO: 5665492 - DNA, 19 bp, Homo sapiens
ctcccaccacagcaggtgt

SEQ ID NO: 5665493 - DNA, 18 bp, Homo sapiens
ctcccaccaccagtgaga

SEQ ID NO: 5665494 - DNA, 20 bp, Homo sapiens
ctcccaccaccagtgagaca

SEQ ID NO: 5665495 - DNA, 13 bp, Homo sapiens
ctcccaccacccc

SEQ ID NO: 5665496 - DNA, 22 bp, Homo sapiens
ctcccaccactccactcctcca

SEQ ID NO: 5665497 - DNA, 22 bp, Homo sapiens
ctcccaccagaacgcaccccac

SEQ ID NO: 5665498 - DNA, 19 bp, Homo sapiens
ctcccaccagtggccccca

SEQ ID NO: 5665499 - DNA, 18 bp, Homo sapiens
ctcccaccataatccctg

SEQ ID NO: 5665500 - DNA, 20 bp, Homo sapiens
ctcccaccatgcgctgctca

SEQ ID NO: 5665501 - DNA, 13 bp, Homo sapiens
ctcccacccacag

SEQ ID NO: 5665502 - DNA, 15 bp, Homo sapiens
ctcccacccacagcc

SEQ ID NO: 5665503 - DNA, 12 bp, Homo sapiens
ctcccacccagt

SEQ ID NO: 5665504 - DNA, 18 bp, Homo sapiens
ctcccacccagtctctgc

SEQ ID NO: 5665505 - DNA, 12 bp, Homo sapiens
ctcccaccccac

SEQ ID NO: 5665506 - DNA, 16 bp, Homo sapiens
ctcccaccccactcca

SEQ ID NO: 5665507 - DNA, 20 bp, Homo sapiens
ctcccaccccactccagccc

SEQ ID NO: 5665508 - DNA, 21 bp, Homo sapiens
ctcccaccccagaaatcactg

SEQ ID NO: 5665509 - DNA, 13 bp, Homo sapiens
ctcccacccccag

SEQ ID NO: 5665510 - DNA, 20 bp, Homo sapiens
ctcccacccccatctctccc

SEQ ID NO: 5665511 - DNA, 22 bp, Homo sapiens
ctgccgcctgtgcccttgctgg

SEQ ID NO: 5665512 - DNA, 15 bp, Homo sapiens
ctgccgctgcaccac

SEQ ID NO: 5665513 - DNA, 19 bp, Homo sapiens
ctgccgctgcaggaaacat

SEQ ID NO: 5665514 - DNA, 14 bp, Homo sapiens
ctgccgctgccatg

SEQ ID NO: 5665515 - DNA, 16 bp, Homo sapiens
ctgccgctgcccccac

SEQ ID NO: 5665516 - DNA, 19 bp, Homo sapiens
ctgccgctgcccccaccct

SEQ ID NO: 5665517 - DNA, 19 bp, Homo sapiens
ctgccgctgccgctgcacc

SEQ ID NO: 5665518 - DNA, 18 bp, Homo sapiens
ctgccgctgctctcccag

SEQ ID NO: 5665519 - DNA, 19 bp, Homo sapiens
ctgccgctgctctcccagg

SEQ ID NO: 5665520 - DNA, 19 bp, Homo sapiens
ctgccgctgcttgagtgga

SEQ ID NO: 5665521 - DNA, 14 bp, Homo sapiens
ctgccgctggaggc

SEQ ID NO: 5665522 - DNA, 20 bp, Homo sapiens
ctgccgctttgtctgtccag

SEQ ID NO: 5665523 - DNA, 15 bp, Homo sapiens
ctgccggacacagca

SEQ ID NO: 5665524 - DNA, 22 bp, Homo sapiens
ctgccggacacagcaccgtgcc

SEQ ID NO: 5665525 - DNA, 21 bp, Homo sapiens
ctgccggacccggaggccgag

SEQ ID NO: 5665526 - DNA, 17 bp, Homo sapiens
ctgccggagaggaagag

SEQ ID NO: 5665527 - DNA, 23 bp, Homo sapiens
ctgccggagaggaagagacactc

SEQ ID NO: 5665528 - DNA, 22 bp, Homo sapiens
ctgccggaggagcatgcgcaga

SEQ ID NO: 5665529 - DNA, 14 bp, Homo sapiens
ctgccggatctggg

SEQ ID NO: 5665530 - DNA, 18 bp, Homo sapiens
ctgccggatctgggctgt

SEQ ID NO: 5665531 - DNA, 18 bp, Homo sapiens
ctgccggcacagctggga

SEQ ID NO: 5665532 - DNA, 19 bp, Homo sapiens
ctgccggcacagctgggat

SEQ ID NO: 5665533 - DNA, 14 bp, Homo sapiens
ctgccggcagtgct

SEQ ID NO: 5665534 - DNA, 16 bp, Homo sapiens
ctgccggcagtgctgg

SEQ ID NO: 5665535 - DNA, 19 bp, Homo sapiens
ctgccggcagtgctggttc

SEQ ID NO: 5665536 - DNA, 23 bp, Homo sapiens
ctgccggcagtgctggttctcca

SEQ ID NO: 5665537 - DNA, 15 bp, Homo sapiens
ctgccggcccccagg

SEQ ID NO: 5665538 - DNA, 21 bp, Homo sapiens
ctgccggccctggggctaggc

SEQ ID NO: 5665539 - DNA, 13 bp, Homo sapiens
ctgccggccttgg

SEQ ID NO: 5665540 - DNA, 16 bp, Homo sapiens
ctgccggccttggcct

SEQ ID NO: 5665541 - DNA, 14 bp, Homo sapiens
ctgccggctctggc

SEQ ID NO: 5665542 - DNA, 15 bp, Homo sapiens
ctgccggctctgggc

SEQ ID NO: 5665543 - DNA, 23 bp, Homo sapiens
ctgccggctctgggctggctgct

SEQ ID NO: 5665544 - DNA, 18 bp, Homo sapiens
ctgccgggagactgccag

SEQ ID NO: 5665545 - DNA, 17 bp, Homo sapiens
ctgccgggcaggtccca

SEQ ID NO: 5665546 - DNA, 15 bp, Homo sapiens
ctgccgggctgaggg

SEQ ID NO: 5665547 - DNA, 19 bp, Homo sapiens
ctgccgggctgagggcctg

SEQ ID NO: 5665548 - DNA, 19 bp, Homo sapiens
ctgccgggttctagtctcc

SEQ ID NO: 5665549 - DNA, 21 bp, Homo sapiens
ctgccgggttctagtctcctt

SEQ ID NO: 5665550 - DNA, 18 bp, Homo sapiens
ctgccggtaaacacgcct

SEQ ID NO: 5665551 - DNA, 21 bp, Homo sapiens
ctgccggtaaacacgcctgca

SEQ ID NO: 5665552 - DNA, 17 bp, Homo sapiens
ctgccggtcccccatgc

SEQ ID NO: 5665553 - DNA, 16 bp, Homo sapiens
ctgccggtcgggcagc

SEQ ID NO: 5665554 - DNA, 17 bp, Homo sapiens
ctgccggtgcacaggcc

SEQ ID NO: 5665555 - DNA, 18 bp, Homo sapiens
ctgccggtgcacaggcct

SEQ ID NO: 5665556 - DNA, 14 bp, Homo sapiens
ctgccggtgggacc

SEQ ID NO: 5665557 - DNA, 23 bp, Homo sapiens
ctgccggttcttaaatccatcct

SEQ ID NO: 5665558 - DNA, 19 bp, Homo sapiens
ctgccgtagcttcagccag

SEQ ID NO: 5665559 - DNA, 21 bp, Homo sapiens
ctgccgtagcttcagccaggc

SEQ ID NO: 5665560 - DNA, 19 bp, Homo sapiens
ctgccgtcaccaccacccc

SEQ ID NO: 5665561 - DNA, 21 bp, Homo sapiens
ctgccgtcacccactctgcac

SEQ ID NO: 5665562 - DNA, 23 bp, Homo sapiens
ctgccgtcacccactctgcactg

SEQ ID NO: 5665563 - DNA, 21 bp, Homo sapiens
ctgccgtcccctagagtccca

SEQ ID NO: 5665564 - DNA, 16 bp, Homo sapiens
ctgccgtccctcctgt

SEQ ID NO: 5665565 - DNA, 21 bp, Homo sapiens
ctgccgtctctcctgctctca

SEQ ID NO: 5665566 - DNA, 18 bp, Homo sapiens
ctgccgtgagagcccaat

SEQ ID NO: 5665567 - DNA, 21 bp, Homo sapiens
ctgccgtgcacggggccagca

SEQ ID NO: 5665568 - DNA, 19 bp, Homo sapiens
ctgccgtgcatggctcctg

SEQ ID NO: 5665569 - DNA, 19 bp, Homo sapiens
ctgccgtgccgcctgcact

SEQ ID NO: 5665570 - DNA, 13 bp, Homo sapiens
ctgccgtgggcaa

SEQ ID NO: 5665571 - DNA, 23 bp, Homo sapiens
ctgccgtgggcctgtcgtgccag

SEQ ID NO: 5665572 - DNA, 15 bp, Homo sapiens
ctgccgttttctggg

SEQ ID NO: 5665573 - DNA, 21 bp, Homo sapiens
ctgcctaaaatgttctcctta

SEQ ID NO: 5665574 - DNA, 13 bp, Homo sapiens
ctgcctaaatttc

SEQ ID NO: 5665575 - DNA, 14 bp, Homo sapiens
ctgcctaaatttca

SEQ ID NO: 5665576 - DNA, 14 bp, Homo sapiens
ctgcctaacaaaat

SEQ ID NO: 5665577 - DNA, 16 bp, Homo sapiens
ctgcctaaccaggccc

SEQ ID NO: 5665578 - DNA, 17 bp, Homo sapiens
ctgcctaaccaggccca

SEQ ID NO: 5665579 - DNA, 19 bp, Homo sapiens
ctgcctaaccatgggctca

SEQ ID NO: 5665580 - DNA, 22 bp, Homo sapiens
ctgcctaaccatgggctcaggg

SEQ ID NO: 5665581 - DNA, 23 bp, Homo sapiens
ctgcctaaccatgggctcagggc

SEQ ID NO: 5665582 - DNA, 13 bp, Homo sapiens
ctgcctaagccct

SEQ ID NO: 5665583 - DNA, 13 bp, Homo sapiens
ctgcctaaggact

SEQ ID NO: 5665584 - DNA, 19 bp, Homo sapiens
ctgcctaaggccctttgtg

SEQ ID NO: 5665585 - DNA, 19 bp, Homo sapiens
ctgcctaagtggctgctga

SEQ ID NO: 5665586 - DNA, 20 bp, Homo sapiens
ctgcctaagtggctgctgac

SEQ ID NO: 5665587 - DNA, 15 bp, Homo sapiens
ctgcctaataaagag

SEQ ID NO: 5665588 - DNA, 20 bp, Homo sapiens
ctgcctacagaacttcagaa

SEQ ID NO: 5665589 - DNA, 23 bp, Homo sapiens
ctgcctacagaacttcagaaaga

SEQ ID NO: 5665590 - DNA, 14 bp, Homo sapiens
ctgcctacagccag

SEQ ID NO: 5665591 - DNA, 14 bp, Homo sapiens
ctgcctacatccca

SEQ ID NO: 5665592 - DNA, 16 bp, Homo sapiens
ctgcctacattccctg

SEQ ID NO: 5665593 - DNA, 18 bp, Homo sapiens
ctgcctacattccctggc

SEQ ID NO: 5665594 - DNA, 23 bp, Homo sapiens
ctgcctaccagtcgccctctgtg

SEQ ID NO: 5665595 - DNA, 20 bp, Homo sapiens
ctgcctacccaccccttccc

SEQ ID NO: 5665596 - DNA, 14 bp, Homo sapiens
ctgcctactgcatc

SEQ ID NO: 5665597 - DNA, 15 bp, Homo sapiens
ctgcctactgcatcg

SEQ ID NO: 5665598 - DNA, 16 bp, Homo sapiens
ctgcctactgcccctg

SEQ ID NO: 5665599 - DNA, 23 bp, Homo sapiens
ctgcctactgcccctgccctgag

SEQ ID NO: 5665600 - DNA, 22 bp, Homo sapiens
ctgcctagaaacagacctgcat

SEQ ID NO: 5665601 - DNA, 18 bp, Homo sapiens
ctgcctagagtgtagcct

SEQ ID NO: 5665602 - DNA, 21 bp, Homo sapiens
ctgcctagagtgtagcctaaa

SEQ ID NO: 5665603 - DNA, 23 bp, Homo sapiens
ctgcctagagtgtagcctaaagg

SEQ ID NO: 5665604 - DNA, 24 bp, Homo sapiens
ctgcctagatccacgtgtggcctc

SEQ ID NO: 5665605 - DNA, 19 bp, Homo sapiens
ctgcctagcactcacatgc

SEQ ID NO: 5665606 - DNA, 22 bp, Homo sapiens
ctgcctagcactcacatgctgg

SEQ ID NO: 5665607 - DNA, 15 bp, Homo sapiens
ctgcctagctcttgg

SEQ ID NO: 5665608 - DNA, 20 bp, Homo sapiens
ctgcctaggaggctggccaa

SEQ ID NO: 5665609 - DNA, 16 bp, Homo sapiens
ctgcctaggctgacct

SEQ ID NO: 5665610 - DNA, 21 bp, Homo sapiens
ctgcctagtcgggacttgtaa

SEQ ID NO: 5665611 - DNA, 17 bp, Homo sapiens
ctgcctagtgggagtta

SEQ ID NO: 5665612 - DNA, 14 bp, Homo sapiens
ctgcctataaattt

SEQ ID NO: 5665613 - DNA, 19 bp, Homo sapiens
ctgcctatatatgtaaata

SEQ ID NO: 5665614 - DNA, 17 bp, Homo sapiens
ctgcctatccatcctgc

SEQ ID NO: 5665615 - DNA, 23 bp, Homo sapiens
ctgcctatcccacttcacaggtg

SEQ ID NO: 5665616 - DNA, 16 bp, Homo sapiens
ctgcctatcctctgta

SEQ ID NO: 5665617 - DNA, 20 bp, Homo sapiens
ctgcctatgcactgaagagc

SEQ ID NO: 5665618 - DNA, 23 bp, Homo sapiens
ctgcctattcacgccgtaattct

SEQ ID NO: 5665619 - DNA, 19 bp, Homo sapiens
ctgcctatttattggggtg

SEQ ID NO: 5665620 - DNA, 13 bp, Homo sapiens
ctgcctattttaa

SEQ ID NO: 5665621 - DNA, 23 bp, Homo sapiens
ctgcctcacagctggccgtcact

SEQ ID NO: 5665622 - DNA, 17 bp, Homo sapiens
ctgcctcacccacaccc

SEQ ID NO: 5665623 - DNA, 16 bp, Homo sapiens
ctgcctcacctggtcg

SEQ ID NO: 5665624 - DNA, 13 bp, Homo sapiens
ctgcctcactcct

SEQ ID NO: 5665625 - DNA, 22 bp, Homo sapiens
ctgcctcactcctccgtgagca

SEQ ID NO: 5665626 - DNA, 12 bp, Homo sapiens
ctgcctcactgt

SEQ ID NO: 5665627 - DNA, 14 bp, Homo sapiens
ctgcctcacttcct

SEQ ID NO: 5665628 - DNA, 21 bp, Homo sapiens
ctgcctcagacgttgcctgag

SEQ ID NO: 5665629 - DNA, 11 bp, Homo sapiens
ctgcctcagcc

SEQ ID NO: 5665630 - DNA, 15 bp, Homo sapiens
ctgcctcagccaggc

SEQ ID NO: 5665631 - DNA, 17 bp, Homo sapiens
ctgcctcagccagtggc

SEQ ID NO: 5665632 - DNA, 22 bp, Homo sapiens
ctgcctcagccagtggcacagg

SEQ ID NO: 5665633 - DNA, 23 bp, Homo sapiens
ctgcctcagccagtggcacagga

SEQ ID NO: 5665634 - DNA, 14 bp, Homo sapiens
ctgcctcagcctcc

SEQ ID NO: 5665635 - DNA, 18 bp, Homo sapiens
ctgcctcagcctcccaag

SEQ ID NO: 5665636 - DNA, 17 bp, Homo sapiens
ctgcctcagcctcccat

SEQ ID NO: 5665637 - DNA, 22 bp, Homo sapiens
ctgcctcagcctcccatagctg

SEQ ID NO: 5665638 - DNA, 18 bp, Homo sapiens
ctgcctcagcctcccgag

SEQ ID NO: 5665639 - DNA, 19 bp, Homo sapiens
ctgcctcagcctccctggt

SEQ ID NO: 5665640 - DNA, 18 bp, Homo sapiens
gaagaggagcctcagaag

SEQ ID NO: 5665641 - DNA, 15 bp, Homo sapiens
gaagaggaggaggtg

SEQ ID NO: 5665642 - DNA, 20 bp, Homo sapiens
gaagaggaggaggtgggggc

SEQ ID NO: 5665643 - DNA, 20 bp, Homo sapiens
gaagaggcaggtctgggcca

SEQ ID NO: 5665644 - DNA, 19 bp, Homo sapiens
gaagaggcatcctgcctgg

SEQ ID NO: 5665645 - DNA, 23 bp, Homo sapiens
gaagaggcccactagagggccca

SEQ ID NO: 5665646 - DNA, 22 bp, Homo sapiens
gaagaggcctaagtcaaaactt

SEQ ID NO: 5665647 - DNA, 23 bp, Homo sapiens
gaagaggcctaagtcaaaacttg

SEQ ID NO: 5665648 - DNA, 16 bp, Homo sapiens
gaagaggctggtgctg

SEQ ID NO: 5665649 - DNA, 20 bp, Homo sapiens
gaagagggaaaacagaaaac

SEQ ID NO: 5665650 - DNA, 20 bp, Homo sapiens
gaagagggagaccaaatgtc

SEQ ID NO: 5665651 - DNA, 22 bp, Homo sapiens
gaagagggaggcttcctgactg

SEQ ID NO: 5665652 - DNA, 19 bp, Homo sapiens
gaagagggataaggtacct

SEQ ID NO: 5665653 - DNA, 16 bp, Homo sapiens
gaagagggcccagccc

SEQ ID NO: 5665654 - DNA, 17 bp, Homo sapiens
gaagagggcccagccca

SEQ ID NO: 5665655 - DNA, 12 bp, Homo sapiens
gaagagggctgc

SEQ ID NO: 5665656 - DNA, 16 bp, Homo sapiens
gaagaggggaggggcc

SEQ ID NO: 5665657 - DNA, 17 bp, Homo sapiens
gaagaggggaggggcct

SEQ ID NO: 5665658 - DNA, 23 bp, Homo sapiens
gaagaggggaggggcctagggag

SEQ ID NO: 5665659 - DNA, 14 bp, Homo sapiens
gaagaggggcagcc

SEQ ID NO: 5665660 - DNA, 15 bp, Homo sapiens
gaagaggggcagccc

SEQ ID NO: 5665661 - DNA, 15 bp, Homo sapiens
gaagagggggagggg

SEQ ID NO: 5665662 - DNA, 20 bp, Homo sapiens
gaagagggggaggggaagct

SEQ ID NO: 5665663 - DNA, 17 bp, Homo sapiens
gaagagggggctggcca

SEQ ID NO: 5665664 - DNA, 17 bp, Homo sapiens
gaagaggggtcttttat

SEQ ID NO: 5665665 - DNA, 17 bp, Homo sapiens
gaagagggttttaggta

SEQ ID NO: 5665666 - DNA, 22 bp, Homo sapiens
gaagaggtctgattggctgctt

SEQ ID NO: 5665667 - DNA, 21 bp, Homo sapiens
gaagaggttctcagcaagtgt

SEQ ID NO: 5665668 - DNA, 20 bp, Homo sapiens
gaagaggttgcagtgagctg

SEQ ID NO: 5665669 - DNA, 20 bp, Homo sapiens
gaagaggttttaaagcttcc

SEQ ID NO: 5665670 - DNA, 20 bp, Homo sapiens
gaagagtaacacttgaaaag

SEQ ID NO: 5665671 - DNA, 15 bp, Homo sapiens
gaagagtaagttttc

SEQ ID NO: 5665672 - DNA, 16 bp, Homo sapiens
gaagagtagataagtg

SEQ ID NO: 5665673 - DNA, 16 bp, Homo sapiens
gaagagtagcatttca

SEQ ID NO: 5665674 - DNA, 20 bp, Homo sapiens
gaagagtagcatttcattct

SEQ ID NO: 5665675 - DNA, 14 bp, Homo sapiens
gaagagtatggatt

SEQ ID NO: 5665676 - DNA, 14 bp, Homo sapiens
gaagagtcaaagta

SEQ ID NO: 5665677 - DNA, 16 bp, Homo sapiens
gaagagtcaggaaggg

SEQ ID NO: 5665678 - DNA, 14 bp, Homo sapiens
gaagagtccaggaa

SEQ ID NO: 5665679 - DNA, 16 bp, Homo sapiens
gaagagtctggaggga

SEQ ID NO: 5665680 - DNA, 22 bp, Homo sapiens
gaagagtcttggtttctctcta

SEQ ID NO: 5665681 - DNA, 21 bp, Homo sapiens
gaagagtctttgattcaccaa

SEQ ID NO: 5665682 - DNA, 21 bp, Homo sapiens
gaagagtgccctgctttgcaa

SEQ ID NO: 5665683 - DNA, 16 bp, Homo sapiens
gaagagtggaggtgga

SEQ ID NO: 5665684 - DNA, 14 bp, Homo sapiens
gaagagtgtactgg

SEQ ID NO: 5665685 - DNA, 17 bp, Homo sapiens
gaagagtgtactggggg

SEQ ID NO: 5665686 - DNA, 14 bp, Homo sapiens
gaagagtgtgtgtg

SEQ ID NO: 5665687 - DNA, 16 bp, Homo sapiens
gaagagttacaataaa

SEQ ID NO: 5665688 - DNA, 22 bp, Homo sapiens
gaagagttccaagttgaaggga

SEQ ID NO: 5665689 - DNA, 21 bp, Homo sapiens
gaagagttgccccgtctctgt

SEQ ID NO: 5665690 - DNA, 15 bp, Homo sapiens
gaagagttggagtga

SEQ ID NO: 5665691 - DNA, 21 bp, Homo sapiens
gaagagttgtgcacgcagatt

SEQ ID NO: 5665692 - DNA, 21 bp, Homo sapiens
gaagagtttaactttgggccc

SEQ ID NO: 5665693 - DNA, 23 bp, Homo sapiens
gaagagtttaactttgggcccag

SEQ ID NO: 5665694 - DNA, 16 bp, Homo sapiens
gaagagtttcttaact

SEQ ID NO: 5665695 - DNA, 13 bp, Homo sapiens
gaagagtttgtaa

SEQ ID NO: 5665696 - DNA, 13 bp, Homo sapiens
gaagataaatgct

SEQ ID NO: 5665697 - DNA, 16 bp, Homo sapiens
gaagataaatgcttta

SEQ ID NO: 5665698 - DNA, 16 bp, Homo sapiens
gaagataacattttca

SEQ ID NO: 5665699 - DNA, 20 bp, Homo sapiens
gaagataagtaatttacctg

SEQ ID NO: 5665700 - DNA, 21 bp, Homo sapiens
gaagataagtgtatttttcaa

SEQ ID NO: 5665701 - DNA, 13 bp, Homo sapiens
gaagataatcatt

SEQ ID NO: 5665702 - DNA, 16 bp, Homo sapiens
gaagataatcattgct

SEQ ID NO: 5665703 - DNA, 23 bp, Homo sapiens
gaagataatgttctttaatgttg

SEQ ID NO: 5665704 - DNA, 13 bp, Homo sapiens
gaagataattgtt

SEQ ID NO: 5665705 - DNA, 16 bp, Homo sapiens
gaagataattgttgaa

SEQ ID NO: 5665706 - DNA, 19 bp, Homo sapiens
gaagataattgttgaaatt

SEQ ID NO: 5665707 - DNA, 16 bp, Homo sapiens
gaagataatttgcata

SEQ ID NO: 5665708 - DNA, 19 bp, Homo sapiens
gaagatacactgagattga

SEQ ID NO: 5665709 - DNA, 16 bp, Homo sapiens
gaagataccatcagca

SEQ ID NO: 5665710 - DNA, 15 bp, Homo sapiens
gaagatactttgtat

SEQ ID NO: 5665711 - DNA, 16 bp, Homo sapiens
gaagatagctgtgact

SEQ ID NO: 5665712 - DNA, 13 bp, Homo sapiens
gaagataggacgt

SEQ ID NO: 5665713 - DNA, 15 bp, Homo sapiens
gaagataggctctgc

SEQ ID NO: 5665714 - DNA, 16 bp, Homo sapiens
gaagataggctctgca

SEQ ID NO: 5665715 - DNA, 17 bp, Homo sapiens
gaagataggctctgcac

SEQ ID NO: 5665716 - DNA, 14 bp, Homo sapiens
gaagatagtaactg

SEQ ID NO: 5665717 - DNA, 13 bp, Homo sapiens
gaagatattattt

SEQ ID NO: 5665718 - DNA, 15 bp, Homo sapiens
gaagatcacagcagg

SEQ ID NO: 5665719 - DNA, 19 bp, Homo sapiens
gaagatcactttgctctga

SEQ ID NO: 5665720 - DNA, 21 bp, Homo sapiens
gaagatcagagctgcagccag

SEQ ID NO: 5665721 - DNA, 17 bp, Homo sapiens
gaagatcagatgcaatt

SEQ ID NO: 5665722 - DNA, 21 bp, Homo sapiens
gaagatcagcaccctaagaga

SEQ ID NO: 5665723 - DNA, 21 bp, Homo sapiens
gaagatcatatacgtgaaaat

SEQ ID NO: 5665724 - DNA, 16 bp, Homo sapiens
gaagatcatggacctg

SEQ ID NO: 5665725 - DNA, 20 bp, Homo sapiens
gaagatcccaacatggtcct

SEQ ID NO: 5665726 - DNA, 15 bp, Homo sapiens
gaagatcccccagaa

SEQ ID NO: 5665727 - DNA, 18 bp, Homo sapiens
gaagatcccccagaaaag

SEQ ID NO: 5665728 - DNA, 20 bp, Homo sapiens
gaagatcccctcaggactgc

SEQ ID NO: 5665729 - DNA, 19 bp, Homo sapiens
gaagatcccctctcctgcc

SEQ ID NO: 5665730 - DNA, 17 bp, Homo sapiens
gaagatcctagtgacca

SEQ ID NO: 5665731 - DNA, 19 bp, Homo sapiens
gaagatcctccttccaggc

SEQ ID NO: 5665732 - DNA, 15 bp, Homo sapiens
gaagatcctgaagca

SEQ ID NO: 5665733 - DNA, 22 bp, Homo sapiens
gaagatcctgcgggtggggctt

SEQ ID NO: 5665734 - DNA, 13 bp, Homo sapiens
gaagatcctgtga

SEQ ID NO: 5665735 - DNA, 16 bp, Homo sapiens
gaagatcggaacagct

SEQ ID NO: 5665736 - DNA, 18 bp, Homo sapiens
gaagatcggaacagctcc

SEQ ID NO: 5665737 - DNA, 19 bp, Homo sapiens
gaagatctaccccagggag

SEQ ID NO: 5665738 - DNA, 14 bp, Homo sapiens
gaagatctgattta

SEQ ID NO: 5665739 - DNA, 20 bp, Homo sapiens
gaagatctgcctcccctgtg

SEQ ID NO: 5665740 - DNA, 17 bp, Homo sapiens
gaagatctgcttccctg

SEQ ID NO: 5665741 - DNA, 22 bp, Homo sapiens
gaagatctgcttccctggggcc

SEQ ID NO: 5665742 - DNA, 17 bp, Homo sapiens
gaagatcttgagagctg

SEQ ID NO: 5665743 - DNA, 22 bp, Homo sapiens
gaagatcttgagagctgctgag

SEQ ID NO: 5665744 - DNA, 15 bp, Homo sapiens
gaagatcttttaaaa

SEQ ID NO: 5665745 - DNA, 21 bp, Homo sapiens
gaagatcttttaaaaaggcag

SEQ ID NO: 5665746 - DNA, 23 bp, Homo sapiens
gaagatcttttaaaaaggcagta

SEQ ID NO: 5665747 - DNA, 13 bp, Homo sapiens
gaagatgaaagag

SEQ ID NO: 5665748 - DNA, 20 bp, Homo sapiens
gaagatgaaatatatattgt

SEQ ID NO: 5665749 - DNA, 14 bp, Homo sapiens
gaagatgaagaagc

SEQ ID NO: 5665750 - DNA, 14 bp, Homo sapiens
gaagatgaatcaat

SEQ ID NO: 5665751 - DNA, 13 bp, Homo sapiens
gaagatgatcaga

SEQ ID NO: 5665752 - DNA, 17 bp, Homo sapiens
gaagatgatttcagttc

SEQ ID NO: 5665753 - DNA, 23 bp, Homo sapiens
gaagatgatttcagttcatcaaa

SEQ ID NO: 5665754 - DNA, 22 bp, Homo sapiens
gaagatgcaggtttgaccagga

SEQ ID NO: 5665755 - DNA, 18 bp, Homo sapiens
gaagatgcattgtagttt

SEQ ID NO: 5665756 - DNA, 16 bp, Homo sapiens
gaagatgcattttaaa

SEQ ID NO: 5665757 - DNA, 20 bp, Homo sapiens
gaagatgccagcttctctct

SEQ ID NO: 5665758 - DNA, 17 bp, Homo sapiens
gaagatgcccctgctcc

SEQ ID NO: 5665759 - DNA, 19 bp, Homo sapiens
gaagatgcccctgctccct

SEQ ID NO: 5665760 - DNA, 22 bp, Homo sapiens
gaagatgctccagcaacacagc

SEQ ID NO: 5665761 - DNA, 12 bp, Homo sapiens
cttaacttcaca

SEQ ID NO: 5665762 - DNA, 16 bp, Homo sapiens
cttaacttcacatatt

SEQ ID NO: 5665763 - DNA, 22 bp, Homo sapiens
cttaacttccatgttctgggtg

SEQ ID NO: 5665764 - DNA, 14 bp, Homo sapiens
cttaacttcttgct

SEQ ID NO: 5665765 - DNA, 15 bp, Homo sapiens
cttaacttcttgctt

SEQ ID NO: 5665766 - DNA, 21 bp, Homo sapiens
cttaacttcttgcttctttct

SEQ ID NO: 5665767 - DNA, 11 bp, Homo sapiens
cttaagaaaaa

SEQ ID NO: 5665768 - DNA, 13 bp, Homo sapiens
cttaagaaaattt

SEQ ID NO: 5665769 - DNA, 17 bp, Homo sapiens
cttaagaaatgtataaa

SEQ ID NO: 5665770 - DNA, 11 bp, Homo sapiens
cttaagaacac

SEQ ID NO: 5665771 - DNA, 17 bp, Homo sapiens
cttaagaacacaaagcg

SEQ ID NO: 5665772 - DNA, 22 bp, Homo sapiens
cttaagaatgagtttcttagac

SEQ ID NO: 5665773 - DNA, 20 bp, Homo sapiens
cttaagaattcaaatttgta

SEQ ID NO: 5665774 - DNA, 15 bp, Homo sapiens
cttaagacaaatggg

SEQ ID NO: 5665775 - DNA, 22 bp, Homo sapiens
cttaagacaaatgggactgatg

SEQ ID NO: 5665776 - DNA, 23 bp, Homo sapiens
cttaagaccacctcaaatttaaa

SEQ ID NO: 5665777 - DNA, 13 bp, Homo sapiens
cttaagacggaag

SEQ ID NO: 5665778 - DNA, 16 bp, Homo sapiens
cttaagagaaatggca

SEQ ID NO: 5665779 - DNA, 16 bp, Homo sapiens
cttaagagaagaaatg

SEQ ID NO: 5665780 - DNA, 23 bp, Homo sapiens
cttaagagaatattttaagtatt

SEQ ID NO: 5665781 - DNA, 16 bp, Homo sapiens
cttaagagaatccaca

SEQ ID NO: 5665782 - DNA, 18 bp, Homo sapiens
cttaagagctatttgtgg

SEQ ID NO: 5665783 - DNA, 13 bp, Homo sapiens
cttaagataatat

SEQ ID NO: 5665784 - DNA, 21 bp, Homo sapiens
cttaagataatatttaaaata

SEQ ID NO: 5665785 - DNA, 23 bp, Homo sapiens
cttaagataatggataatcttcg

SEQ ID NO: 5665786 - DNA, 17 bp, Homo sapiens
cttaagatctgactgcc

SEQ ID NO: 5665787 - DNA, 21 bp, Homo sapiens
cttaagatctgactgccaaat

SEQ ID NO: 5665788 - DNA, 19 bp, Homo sapiens
cttaagatgctaatagaaa

SEQ ID NO: 5665789 - DNA, 20 bp, Homo sapiens
cttaagattcagttttccca

SEQ ID NO: 5665790 - DNA, 16 bp, Homo sapiens
cttaagattctttgtg

SEQ ID NO: 5665791 - DNA, 14 bp, Homo sapiens
cttaagatttttct

SEQ ID NO: 5665792 - DNA, 15 bp, Homo sapiens
cttaagcaaaagaaa

SEQ ID NO: 5665793 - DNA, 19 bp, Homo sapiens
cttaagcaaaggggacagc

SEQ ID NO: 5665794 - DNA, 20 bp, Homo sapiens
cttaagcaaattttgtatta

SEQ ID NO: 5665795 - DNA, 21 bp, Homo sapiens
cttaagcaaattttgtattat

SEQ ID NO: 5665796 - DNA, 13 bp, Homo sapiens
cttaagcactttg

SEQ ID NO: 5665797 - DNA, 23 bp, Homo sapiens
cttaagcagaactaagctcagta

SEQ ID NO: 5665798 - DNA, 18 bp, Homo sapiens
cttaagcagcatggaaaa

SEQ ID NO: 5665799 - DNA, 21 bp, Homo sapiens
cttaagcagtaatctgtcagt

SEQ ID NO: 5665800 - DNA, 22 bp, Homo sapiens
cttaagcataaaaattgaattc

SEQ ID NO: 5665801 - DNA, 15 bp, Homo sapiens
cttaagcatctggct

SEQ ID NO: 5665802 - DNA, 18 bp, Homo sapiens
cttaagcatctggctcta

SEQ ID NO: 5665803 - DNA, 13 bp, Homo sapiens
cttaagcatgacg

SEQ ID NO: 5665804 - DNA, 20 bp, Homo sapiens
cttaagccaaactcaggccc

SEQ ID NO: 5665805 - DNA, 21 bp, Homo sapiens
cttaagccaaactcaggccca

SEQ ID NO: 5665806 - DNA, 20 bp, Homo sapiens
cttaagccactgcctctccc

SEQ ID NO: 5665807 - DNA, 17 bp, Homo sapiens
cttaagccatcttggta

SEQ ID NO: 5665808 - DNA, 19 bp, Homo sapiens
cttaagcccagtgcactga

SEQ ID NO: 5665809 - DNA, 20 bp, Homo sapiens
cttaagccctcgtgcacaca

SEQ ID NO: 5665810 - DNA, 19 bp, Homo sapiens
cttaagccctttgctctgg

SEQ ID NO: 5665811 - DNA, 16 bp, Homo sapiens
cttaagcctggaaggt

SEQ ID NO: 5665812 - DNA, 23 bp, Homo sapiens
cttaagctaggatgttgctcaga

SEQ ID NO: 5665813 - DNA, 16 bp, Homo sapiens
cttaagctcccctgcc

SEQ ID NO: 5665814 - DNA, 22 bp, Homo sapiens
cttaagctcccctgccttaacc

SEQ ID NO: 5665815 - DNA, 14 bp, Homo sapiens
cttaagctgcagga

SEQ ID NO: 5665816 - DNA, 16 bp, Homo sapiens
cttaatttgaaatcta

SEQ ID NO: 5665817 - DNA, 13 bp, Homo sapiens
cttaatttggaaa

SEQ ID NO: 5665818 - DNA, 19 bp, Homo sapiens
cttaatttggaaactaata

SEQ ID NO: 5665819 - DNA, 20 bp, Homo sapiens
cttaatttggaaactaataa

SEQ ID NO: 5665820 - DNA, 22 bp, Homo sapiens
cttaatttggaaactaataaaa

SEQ ID NO: 5665821 - DNA, 18 bp, Homo sapiens
cttaatttggataataaa

SEQ ID NO: 5665822 - DNA, 15 bp, Homo sapiens
cttaatttggatcta

SEQ ID NO: 5665823 - DNA, 20 bp, Homo sapiens
cttaatttggatctatttat

SEQ ID NO: 5665824 - DNA, 21 bp, Homo sapiens
cttaatttggatctatttatt

SEQ ID NO: 5665825 - DNA, 22 bp, Homo sapiens
cttaatttggatctatttatta

SEQ ID NO: 5665826 - DNA, 15 bp, Homo sapiens
cttaattttaatcca

SEQ ID NO: 5665827 - DNA, 13 bp, Homo sapiens
cttaattttacag

SEQ ID NO: 5665828 - DNA, 16 bp, Homo sapiens
cttaattttacagccc

SEQ ID NO: 5665829 - DNA, 13 bp, Homo sapiens
cttaattttctaa

SEQ ID NO: 5665830 - DNA, 22 bp, Homo sapiens
cttaattttctgtggatcattt

SEQ ID NO: 5665831 - DNA, 20 bp, Homo sapiens
cttaattttgcgatacactg

SEQ ID NO: 5665832 - DNA, 21 bp, Homo sapiens
cttaattttggttgtattctt

SEQ ID NO: 5665833 - DNA, 16 bp, Homo sapiens
cttaattttttttaat

SEQ ID NO: 5665834 - DNA, 22 bp, Homo sapiens
cttacaaaaacaagacacccaa

SEQ ID NO: 5665835 - DNA, 14 bp, Homo sapiens
cttacaaaaatagc

SEQ ID NO: 5665836 - DNA, 15 bp, Homo sapiens
cttacaaaatgccaa

SEQ ID NO: 5665837 - DNA, 22 bp, Homo sapiens
cttacaaactgcggtatacatt

SEQ ID NO: 5665838 - DNA, 11 bp, Homo sapiens
cttacaaactt

SEQ ID NO: 5665839 - DNA, 14 bp, Homo sapiens
cttacaaagccagc

SEQ ID NO: 5665840 - DNA, 16 bp, Homo sapiens
cttacaaagccagctc

SEQ ID NO: 5665841 - DNA, 21 bp, Homo sapiens
cttacaaagccagctctgagc

SEQ ID NO: 5665842 - DNA, 16 bp, Homo sapiens
cttacaaatgattgct

SEQ ID NO: 5665843 - DNA, 20 bp, Homo sapiens
cttacaaatgattgctttta

SEQ ID NO: 5665844 - DNA, 22 bp, Homo sapiens
cttacaaatgattgcttttaaa

SEQ ID NO: 5665845 - DNA, 17 bp, Homo sapiens
cttacaactcccccacc

SEQ ID NO: 5665846 - DNA, 18 bp, Homo sapiens
cttacaactcccccaccg

SEQ ID NO: 5665847 - DNA, 17 bp, Homo sapiens
cttacaagactgtaaat

SEQ ID NO: 5665848 - DNA, 18 bp, Homo sapiens
cttacaagcctaagaatc

SEQ ID NO: 5665849 - DNA, 18 bp, Homo sapiens
cttacaagtaatgaattt

SEQ ID NO: 5665850 - DNA, 19 bp, Homo sapiens
cttacaagtggtgaccaaa

SEQ ID NO: 5665851 - DNA, 21 bp, Homo sapiens
cttacaatattgattgggaaa

SEQ ID NO: 5665852 - DNA, 17 bp, Homo sapiens
cttacaatcaaatctcc

SEQ ID NO: 5665853 - DNA, 17 bp, Homo sapiens
cttacaatcgcaaatca

SEQ ID NO: 5665854 - DNA, 21 bp, Homo sapiens
cttacaatggagtctgcagtg

SEQ ID NO: 5665855 - DNA, 14 bp, Homo sapiens
cttacaatgtgaat

SEQ ID NO: 5665856 - DNA, 23 bp, Homo sapiens
cttacaatgtgaataatggcact

SEQ ID NO: 5665857 - DNA, 16 bp, Homo sapiens
cttacaattgcactgc

SEQ ID NO: 5665858 - DNA, 14 bp, Homo sapiens
cttacaatttgcac

SEQ ID NO: 5665859 - DNA, 23 bp, Homo sapiens
cttacaatttttttaattttgta

SEQ ID NO: 5665860 - DNA, 16 bp, Homo sapiens
cttacacaaaggggat

SEQ ID NO: 5665861 - DNA, 21 bp, Homo sapiens
cttacacaaaggggatcataa

SEQ ID NO: 5665862 - DNA, 21 bp, Homo sapiens
cttacacaaatctatttaatt

SEQ ID NO: 5665863 - DNA, 16 bp, Homo sapiens
cttacacaagaagtga

SEQ ID NO: 5665864 - DNA, 13 bp, Homo sapiens
cttacacacaaaa

SEQ ID NO: 5665865 - DNA, 19 bp, Homo sapiens
cttacacacctgagaatgt

SEQ ID NO: 5665866 - DNA, 14 bp, Homo sapiens
cttacacactcagg

SEQ ID NO: 5665867 - DNA, 18 bp, Homo sapiens
cttacacactcaggcctg

SEQ ID NO: 5665868 - DNA, 18 bp, Homo sapiens
cttacacatcttccacag

SEQ ID NO: 5665869 - DNA, 22 bp, Homo sapiens
cttacaccagtttgactgtgct

SEQ ID NO: 5665870 - DNA, 20 bp, Homo sapiens
cttacacccacagtggaaag

SEQ ID NO: 5665871 - DNA, 15 bp, Homo sapiens
cttacacccatgact

SEQ ID NO: 5665872 - DNA, 23 bp, Homo sapiens
cttacacctcgttagggaagaga

SEQ ID NO: 5665873 - DNA, 18 bp, Homo sapiens
cttacacctggaatgtta

SEQ ID NO: 5665874 - DNA, 20 bp, Homo sapiens
cttacacgaagaaatagaat

SEQ ID NO: 5665875 - DNA, 14 bp, Homo sapiens
cttacacgtgcgtg

SEQ ID NO: 5665876 - DNA, 16 bp, Homo sapiens
cttacacgtgcgtgtg

SEQ ID NO: 5665877 - DNA, 16 bp, Homo sapiens
cttacactgaaaatgt

SEQ ID NO: 5665878 - DNA, 18 bp, Homo sapiens
cttacactgaaatccaaa

SEQ ID NO: 5665879 - DNA, 21 bp, Homo sapiens
cttacactgcctgtatacttt

SEQ ID NO: 5665880 - DNA, 23 bp, Homo sapiens
cttacactgcctgtatactttag

SEQ ID NO: 5665881 - DNA, 21 bp, Homo sapiens
cttacactggcaatggtagtt

SEQ ID NO: 5665882 - DNA, 12 bp, Homo sapiens
cttacacttaaa

SEQ ID NO: 5665883 - DNA, 16 bp, Homo sapiens
cttacacttaaaagaa

SEQ ID NO: 5665884 - DNA, 18 bp, Homo sapiens
cttacacttaaaagaaaa

SEQ ID NO: 5665885 - DNA, 16 bp, Homo sapiens
cttacacttggagccc

SEQ ID NO: 5665886 - DNA, 23 bp, Homo sapiens
cttacacttggagcccgtgcagt

SEQ ID NO: 5665887 - DNA, 21 bp, Homo sapiens
cttacagaaccaattcacttt

SEQ ID NO: 5665888 - DNA, 17 bp, Homo sapiens
cttacagacagaatata

SEQ ID NO: 5665889 - DNA, 21 bp, Homo sapiens
cttacagataggccttcttgt

SEQ ID NO: 5665890 - DNA, 23 bp, Homo sapiens
cttacagataggccttcttgtga

SEQ ID NO: 5665891 - DNA, 13 bp, Homo sapiens
cttacagccaagt

SEQ ID NO: 5665892 - DNA, 18 bp, Homo sapiens
cttacagccattttacat

SEQ ID NO: 5665893 - DNA, 22 bp, Homo sapiens
cttacagccctaagtggctgcc

SEQ ID NO: 5665894 - DNA, 15 bp, Homo sapiens
cttacagcctctgac

SEQ ID NO: 5665895 - DNA, 19 bp, Homo sapiens
cttacaggagccagcctgc

SEQ ID NO: 5665896 - DNA, 21 bp, Homo sapiens
cttacaggcatggacatgcag

SEQ ID NO: 5665897 - DNA, 14 bp, Homo sapiens
cttacaggtgatta

SEQ ID NO: 5665898 - DNA, 15 bp, Homo sapiens
cttacagtaactaat

SEQ ID NO: 5665899 - DNA, 20 bp, Homo sapiens
cttacagtaactgagtgtgg

SEQ ID NO: 5665900 - DNA, 22 bp, Homo sapiens
cttacagtaactgagtgtggcg

SEQ ID NO: 5665901 - DNA, 14 bp, Homo sapiens
cttacagtgaagat

SEQ ID NO: 5665902 - DNA, 13 bp, Homo sapiens
cttacagtggagt

SEQ ID NO: 5665903 - DNA, 15 bp, Homo sapiens
cttacagtgtgataa

SEQ ID NO: 5665904 - DNA, 14 bp, Homo sapiens
cttacagttaagaa

SEQ ID NO: 5665905 - DNA, 14 bp, Homo sapiens
cttacagttatcct

SEQ ID NO: 5665906 - DNA, 15 bp, Homo sapiens
cttacataaagctcc

SEQ ID NO: 5665907 - DNA, 18 bp, Homo sapiens
cttacatactaggtgcct

SEQ ID NO: 5665908 - DNA, 20 bp, Homo sapiens
cttacatactaggtgccttt

SEQ ID NO: 5665909 - DNA, 22 bp, Homo sapiens
cttacatagctcaaatattgaa

SEQ ID NO: 5665910 - DNA, 22 bp, Homo sapiens
cttacatagttttaaactcatt

SEQ ID NO: 5665911 - DNA, 15 bp, Homo sapiens
cttacatctggctgg

SEQ ID NO: 5665912 - DNA, 16 bp, Homo sapiens
cttacatcttctgtga

SEQ ID NO: 5665913 - DNA, 21 bp, Homo sapiens
cttacatcttctgtgaaatat

SEQ ID NO: 5665914 - DNA, 17 bp, Homo sapiens
cttacatcttttctaat

SEQ ID NO: 5665915 - DNA, 18 bp, Homo sapiens
cttacatgcattactgca

SEQ ID NO: 5665916 - DNA, 18 bp, Homo sapiens
cttacatgggtgttttga

SEQ ID NO: 5665917 - DNA, 14 bp, Homo sapiens
cttacatgtataaa

SEQ ID NO: 5665918 - DNA, 21 bp, Homo sapiens
cttacatgtataaagtgattg

SEQ ID NO: 5665919 - DNA, 14 bp, Homo sapiens
cttacatgttttct

SEQ ID NO: 5665920 - DNA, 20 bp, Homo sapiens
cttacattagcagtttgctt

SEQ ID NO: 5665921 - DNA, 21 bp, Homo sapiens
cttacattctctaataagaaa

SEQ ID NO: 5665922 - DNA, 22 bp, Homo sapiens
cttacattctctaataagaaaa

SEQ ID NO: 5665923 - DNA, 23 bp, Homo sapiens
cttacattctctaataagaaaac

SEQ ID NO: 5665924 - DNA, 15 bp, Homo sapiens
cttacattgaaaaca

SEQ ID NO: 5665925 - DNA, 21 bp, Homo sapiens
cttacattgcctgactaaaat

SEQ ID NO: 5665926 - DNA, 22 bp, Homo sapiens
cttacattggctttttaaattt

SEQ ID NO: 5665927 - DNA, 11 bp, Homo sapiens
cttacatttca

SEQ ID NO: 5665928 - DNA, 12 bp, Homo sapiens
cttacatttcac

SEQ ID NO: 5665929 - DNA, 22 bp, Homo sapiens
cttacatttccatttattgttt

SEQ ID NO: 5665930 - DNA, 12 bp, Homo sapiens
cttacatttcct

SEQ ID NO: 5665931 - DNA, 14 bp, Homo sapiens
cttacatttgtact

SEQ ID NO: 5665932 - DNA, 12 bp, Homo sapiens
cttacatttgtg

SEQ ID NO: 5665933 - DNA, 20 bp, Homo sapiens
cttacatttgtgagattcct

SEQ ID NO: 5665934 - DNA, 23 bp, Homo sapiens
cttaccaaaacagatggtagaga

SEQ ID NO: 5665935 - DNA, 17 bp, Homo sapiens
cttaccaaaacataaga

SEQ ID NO: 5665936 - DNA, 16 bp, Homo sapiens
cttaccaactttctgt

SEQ ID NO: 5665937 - DNA, 17 bp, Homo sapiens
cttaccaactttctgta

SEQ ID NO: 5665938 - DNA, 19 bp, Homo sapiens
cttaccaactttctgtaaa

SEQ ID NO: 5665939 - DNA, 22 bp, Homo sapiens
gaagcatggtgccctggcttct

SEQ ID NO: 5665940 - DNA, 19 bp, Homo sapiens
gaagcatgtttcatgtttt

SEQ ID NO: 5665941 - DNA, 18 bp, Homo sapiens
gaagcattagttggagct

SEQ ID NO: 5665942 - DNA, 22 bp, Homo sapiens
gaagcattccttctttgataat

SEQ ID NO: 5665943 - DNA, 16 bp, Homo sapiens
gaagcattctcattgg

SEQ ID NO: 5665944 - DNA, 22 bp, Homo sapiens
gaagcatttcaaagccctgcct

SEQ ID NO: 5665945 - DNA, 18 bp, Homo sapiens
gaagcatttgatattatc

SEQ ID NO: 5665946 - DNA, 15 bp, Homo sapiens
gaagcatttgtattt

SEQ ID NO: 5665947 - DNA, 20 bp, Homo sapiens
gaagcatttgtattttgtgt

SEQ ID NO: 5665948 - DNA, 17 bp, Homo sapiens
gaagcattttataaatc

SEQ ID NO: 5665949 - DNA, 13 bp, Homo sapiens
gaagccaaagaaa

SEQ ID NO: 5665950 - DNA, 14 bp, Homo sapiens
gaagccaaagaaaa

SEQ ID NO: 5665951 - DNA, 15 bp, Homo sapiens
gaagccaaatgaaac

SEQ ID NO: 5665952 - DNA, 13 bp, Homo sapiens
gaagccaagcctg

SEQ ID NO: 5665953 - DNA, 14 bp, Homo sapiens
gaagccaagcctgg

SEQ ID NO: 5665954 - DNA, 21 bp, Homo sapiens
gaagccaagctccctggagcc

SEQ ID NO: 5665955 - DNA, 22 bp, Homo sapiens
gaagccaagctccctggagccc

SEQ ID NO: 5665956 - DNA, 16 bp, Homo sapiens
gaagccaagggaaagg

SEQ ID NO: 5665957 - DNA, 19 bp, Homo sapiens
gaagccaagggaaaggggt

SEQ ID NO: 5665958 - DNA, 20 bp, Homo sapiens
gaagccaagggaaaggggtg

SEQ ID NO: 5665959 - DNA, 20 bp, Homo sapiens
gaagccaattcagacaggca

SEQ ID NO: 5665960 - DNA, 16 bp, Homo sapiens
gaagccacacagccca

SEQ ID NO: 5665961 - DNA, 17 bp, Homo sapiens
gaagccacacagcccag

SEQ ID NO: 5665962 - DNA, 19 bp, Homo sapiens
gaagccacacagcccagaa

SEQ ID NO: 5665963 - DNA, 23 bp, Homo sapiens
gaagccacacagcccagaaggcc

SEQ ID NO: 5665964 - DNA, 17 bp, Homo sapiens
gaagccacagcccaggc

SEQ ID NO: 5665965 - DNA, 18 bp, Homo sapiens
gaagccacagcccaggcc

SEQ ID NO: 5665966 - DNA, 16 bp, Homo sapiens
gaagccacaggcctga

SEQ ID NO: 5665967 - DNA, 17 bp, Homo sapiens
gaagccacaggcctgag

SEQ ID NO: 5665968 - DNA, 14 bp, Homo sapiens
gaagccaccagtga

SEQ ID NO: 5665969 - DNA, 20 bp, Homo sapiens
gaagccaccctcccagctct

SEQ ID NO: 5665970 - DNA, 22 bp, Homo sapiens
gaagccaccctcccagctctga

SEQ ID NO: 5665971 - DNA, 23 bp, Homo sapiens
gaagccacccttccctgcctcca

SEQ ID NO: 5665972 - DNA, 16 bp, Homo sapiens
gaagccaccgggagat

SEQ ID NO: 5665973 - DNA, 17 bp, Homo sapiens
gaagccacctcaccaag

SEQ ID NO: 5665974 - DNA, 15 bp, Homo sapiens
gaagccacgctgtcc

SEQ ID NO: 5665975 - DNA, 16 bp, Homo sapiens
gaagccacgctgtcct

SEQ ID NO: 5665976 - DNA, 19 bp, Homo sapiens
gaagccacgctgtcctctc

SEQ ID NO: 5665977 - DNA, 13 bp, Homo sapiens
gaagccacttggc

SEQ ID NO: 5665978 - DNA, 15 bp, Homo sapiens
gaagccacttggccc

SEQ ID NO: 5665979 - DNA, 15 bp, Homo sapiens
gaagccagcaggctc

SEQ ID NO: 5665980 - DNA, 21 bp, Homo sapiens
gaagccagcaggctctcaggc

SEQ ID NO: 5665981 - DNA, 22 bp, Homo sapiens
gaagccagccacagacccctgg

SEQ ID NO: 5665982 - DNA, 19 bp, Homo sapiens
gaagccaggaatttcccag

SEQ ID NO: 5665983 - DNA, 23 bp, Homo sapiens
gaagccaggaatttcccaggacc

SEQ ID NO: 5665984 - DNA, 13 bp, Homo sapiens
gaagccaggagca

SEQ ID NO: 5665985 - DNA, 22 bp, Homo sapiens
gaagccaggagcaaatgtttct

SEQ ID NO: 5665986 - DNA, 13 bp, Homo sapiens
gaagccaggctga

SEQ ID NO: 5665987 - DNA, 17 bp, Homo sapiens
gaagccaggtacaggag

SEQ ID NO: 5665988 - DNA, 20 bp, Homo sapiens
gaagccaggtacaggagagg

SEQ ID NO: 5665989 - DNA, 24 bp, Homo sapiens
gaagccaggtacaggagaggcagc

SEQ ID NO: 5665990 - DNA, 21 bp, Homo sapiens
gaagccagtcaccttctgggc

SEQ ID NO: 5665991 - DNA, 17 bp, Homo sapiens
gaagccagtcagggccc

SEQ ID NO: 5665992 - DNA, 20 bp, Homo sapiens
gaagctatttttttcagttt

SEQ ID NO: 5665993 - DNA, 15 bp, Homo sapiens
gaagctcaactgttg

SEQ ID NO: 5665994 - DNA, 15 bp, Homo sapiens
gaagctcaaggctgc

SEQ ID NO: 5665995 - DNA, 18 bp, Homo sapiens
gaagctcaaggctgcagt

SEQ ID NO: 5665996 - DNA, 20 bp, Homo sapiens
gaagctcacactgatgggct

SEQ ID NO: 5665997 - DNA, 20 bp, Homo sapiens
gaagctcacctgttgcttac

SEQ ID NO: 5665998 - DNA, 14 bp, Homo sapiens
gaagctcagactgg

SEQ ID NO: 5665999 - DNA, 14 bp, Homo sapiens
gaagctcagcccac

SEQ ID NO: 5666000 - DNA, 19 bp, Homo sapiens
gaagctcagcccacccccc

SEQ ID NO: 5666001 - DNA, 22 bp, Homo sapiens
gaagctcagcccacccccctca

SEQ ID NO: 5666002 - DNA, 12 bp, Homo sapiens
gaagctcagctg

SEQ ID NO: 5666003 - DNA, 14 bp, Homo sapiens
gaagctcagggcct

SEQ ID NO: 5666004 - DNA, 21 bp, Homo sapiens
gaagctcagggcctggctcag

SEQ ID NO: 5666005 - DNA, 11 bp, Homo sapiens
gaagctcaggt

SEQ ID NO: 5666006 - DNA, 23 bp, Homo sapiens
gaagctccactgtcaccctccac

SEQ ID NO: 5666007 - DNA, 18 bp, Homo sapiens
gaagctcccaccccactc

SEQ ID NO: 5666008 - DNA, 17 bp, Homo sapiens
gaagctcccagatgctg

SEQ ID NO: 5666009 - DNA, 14 bp, Homo sapiens
gaagctcccaggaa

SEQ ID NO: 5666010 - DNA, 20 bp, Homo sapiens
gaagctcccccagcaaagcc

SEQ ID NO: 5666011 - DNA, 17 bp, Homo sapiens
gaagctcctctccccag

SEQ ID NO: 5666012 - DNA, 19 bp, Homo sapiens
gaagctcctctccccagcc

SEQ ID NO: 5666013 - DNA, 21 bp, Homo sapiens
gaagctcctctccccagccca

SEQ ID NO: 5666014 - DNA, 22 bp, Homo sapiens
gaagctcctctccccagcccag

SEQ ID NO: 5666015 - DNA, 23 bp, Homo sapiens
gaagctcctctccccagcccaga

SEQ ID NO: 5666016 - DNA, 13 bp, Homo sapiens
gaagctcctgcta

SEQ ID NO: 5666017 - DNA, 14 bp, Homo sapiens
gaagctcctgctac

SEQ ID NO: 5666018 - DNA, 15 bp, Homo sapiens
gaagctcctgctact

SEQ ID NO: 5666019 - DNA, 24 bp, Homo sapiens
gaagctcctgctacttccccagct

SEQ ID NO: 5666020 - DNA, 17 bp, Homo sapiens
gaagctcgccccacctc

SEQ ID NO: 5666021 - DNA, 21 bp, Homo sapiens
gaagctcggtgagtgatggca

SEQ ID NO: 5666022 - DNA, 14 bp, Homo sapiens
gaagctctccgagc

SEQ ID NO: 5666023 - DNA, 17 bp, Homo sapiens
gaagctctggccccagg

SEQ ID NO: 5666024 - DNA, 18 bp, Homo sapiens
gaagctgaaccccctcca

SEQ ID NO: 5666025 - DNA, 20 bp, Homo sapiens
gaagctgaagatccccaact

SEQ ID NO: 5666026 - DNA, 23 bp, Homo sapiens
gaagctgaagtgcatccaaaggt

SEQ ID NO: 5666027 - DNA, 18 bp, Homo sapiens
gaagctgacgaacttcca

SEQ ID NO: 5666028 - DNA, 19 bp, Homo sapiens
gaagctgacgaacttccat

SEQ ID NO: 5666029 - DNA, 21 bp, Homo sapiens
gaagctgagaagaagctgagg

SEQ ID NO: 5666030 - DNA, 19 bp, Homo sapiens
gaagctgagcaccagggga

SEQ ID NO: 5666031 - DNA, 12 bp, Homo sapiens
gaagctgagcag

SEQ ID NO: 5666032 - DNA, 12 bp, Homo sapiens
gaagctgaggca

SEQ ID NO: 5666033 - DNA, 22 bp, Homo sapiens
gaagctgaggcaggtgaattgt

SEQ ID NO: 5666034 - DNA, 13 bp, Homo sapiens
gaagctgaggccc

SEQ ID NO: 5666035 - DNA, 15 bp, Homo sapiens
gaagctgaggcccat

SEQ ID NO: 5666036 - DNA, 12 bp, Homo sapiens
gaagctgaggct

SEQ ID NO: 5666037 - DNA, 13 bp, Homo sapiens
gaagctgaggctg

SEQ ID NO: 5666038 - DNA, 14 bp, Homo sapiens
gaagctgaggctgc

SEQ ID NO: 5666039 - DNA, 21 bp, Homo sapiens
gaagctgaggctgctgccagg

SEQ ID NO: 5666040 - DNA, 17 bp, Homo sapiens
gaagctgagggcaaatc

SEQ ID NO: 5666041 - DNA, 14 bp, Homo sapiens
gaagctgatccagt

SEQ ID NO: 5666042 - DNA, 12 bp, Homo sapiens
gaagctgcagct

SEQ ID NO: 5666043 - DNA, 15 bp, Homo sapiens
gaagctgcaggcttt

SEQ ID NO: 5666044 - DNA, 18 bp, Homo sapiens
gaagctgcaggggcagga

SEQ ID NO: 5666045 - DNA, 13 bp, Homo sapiens
gaagctgcatcca

SEQ ID NO: 5666046 - DNA, 14 bp, Homo sapiens
gaagctgcatgtta

SEQ ID NO: 5666047 - DNA, 15 bp, Homo sapiens
gaagctgccagccca

SEQ ID NO: 5666048 - DNA, 21 bp, Homo sapiens
gaagctgccagcccagaacac

SEQ ID NO: 5666049 - DNA, 22 bp, Homo sapiens
gaagctgccaggtgagaaactg

SEQ ID NO: 5666050 - DNA, 23 bp, Homo sapiens
gaagctgccatccttgctgcagc

SEQ ID NO: 5666051 - DNA, 13 bp, Homo sapiens
gaagctgctccgt

SEQ ID NO: 5666052 - DNA, 18 bp, Homo sapiens
gaagctgctctggaattt

SEQ ID NO: 5666053 - DNA, 10 bp, Homo sapiens
gaagctgctg

SEQ ID NO: 5666054 - DNA, 12 bp, Homo sapiens
gaagctgctgac

SEQ ID NO: 5666055 - DNA, 14 bp, Homo sapiens
gaagctgctgacca

SEQ ID NO: 5666056 - DNA, 16 bp, Homo sapiens
gaagctgctgcagctc

SEQ ID NO: 5666057 - DNA, 11 bp, Homo sapiens
gaagctgctgt

SEQ ID NO: 5666058 - DNA, 16 bp, Homo sapiens
gaagctgctgtgtcct

SEQ ID NO: 5666059 - DNA, 18 bp, Homo sapiens
gaagctggaagcactgct

SEQ ID NO: 5666060 - DNA, 16 bp, Homo sapiens
gaagctggaagcctgc

SEQ ID NO: 5666061 - DNA, 12 bp, Homo sapiens
gaagctggactt

SEQ ID NO: 5666062 - DNA, 20 bp, Homo sapiens
gaagctggacttctgtgggc

SEQ ID NO: 5666063 - DNA, 19 bp, Homo sapiens
gaagctggagggaggtggg

SEQ ID NO: 5666064 - DNA, 17 bp, Homo sapiens
gaagctggcagaacgga

SEQ ID NO: 5666065 - DNA, 21 bp, Homo sapiens
gaagctggcagcactcagtga

SEQ ID NO: 5666066 - DNA, 15 bp, Homo sapiens
gaagctggcaggaga

SEQ ID NO: 5666067 - DNA, 12 bp, Homo sapiens
gaagctggccct

SEQ ID NO: 5666068 - DNA, 22 bp, Homo sapiens
gaagctggccctcagctccctg

SEQ ID NO: 5666069 - DNA, 17 bp, Homo sapiens
gaagctggccgagggtc

SEQ ID NO: 5666070 - DNA, 23 bp, Homo sapiens
gaagctggctttgaaacctcagg

SEQ ID NO: 5666071 - DNA, 19 bp, Homo sapiens
gaagctgggactcattcac

SEQ ID NO: 5666072 - DNA, 16 bp, Homo sapiens
gaagctgggagggagg

SEQ ID NO: 5666073 - DNA, 13 bp, Homo sapiens
gaagctgggccca

SEQ ID NO: 5666074 - DNA, 14 bp, Homo sapiens
gaagctgggcccaa

SEQ ID NO: 5666075 - DNA, 13 bp, Homo sapiens
gaagctgggctgt

SEQ ID NO: 5666076 - DNA, 13 bp, Homo sapiens
gaagctggggaca

SEQ ID NO: 5666077 - DNA, 21 bp, Homo sapiens
gaagctggggacagctttcct

SEQ ID NO: 5666078 - DNA, 19 bp, Homo sapiens
gaagctgggggaagggtgg

SEQ ID NO: 5666079 - DNA, 17 bp, Homo sapiens
gaagctggggttcatga

SEQ ID NO: 5666080 - DNA, 19 bp, Homo sapiens
gaagctgggtgagccaagg

SEQ ID NO: 5666081 - DNA, 23 bp, Homo sapiens
gaagctgtagtagccctttctgt

SEQ ID NO: 5666082 - DNA, 14 bp, Homo sapiens
gaagctgtcagaag

SEQ ID NO: 5666083 - DNA, 17 bp, Homo sapiens
gaagctgtcagaagttt

SEQ ID NO: 5666084 - DNA, 17 bp, Homo sapiens
gaagctgtcaggctggg

SEQ ID NO: 5666085 - DNA, 18 bp, Homo sapiens
gaagctgtcaggctggga

SEQ ID NO: 5666086 - DNA, 12 bp, Homo sapiens
gaagctgtgtcc

SEQ ID NO: 5666087 - DNA, 17 bp, Homo sapiens
gaagctgtgtccttgca

SEQ ID NO: 5666088 - DNA, 22 bp, Homo sapiens
gaagctgtgtccttgcacctgc

SEQ ID NO: 5666089 - DNA, 24 bp, Homo sapiens
gaagctgtgtccttgcacctgcat

SEQ ID NO: 5666090 - DNA, 20 bp, Homo sapiens
gaagctgttaatttttctta

SEQ ID NO: 5666091 - DNA, 18 bp, Homo sapiens
gaagctgttctctgcttt

SEQ ID NO: 5666092 - DNA, 16 bp, Homo sapiens
gaagctgttgggagaa

SEQ ID NO: 5666093 - DNA, 18 bp, Homo sapiens
gaagctgttgtacattta

SEQ ID NO: 5666094 - DNA, 19 bp, Homo sapiens
gaagctgttgtacatttat

SEQ ID NO: 5666095 - DNA, 18 bp, Homo sapiens
gaagctgtttggaaaaga

SEQ ID NO: 5666096 - DNA, 14 bp, Homo sapiens
gaagcttattaatg

SEQ ID NO: 5666097 - DNA, 15 bp, Homo sapiens
gaagcttattaatgc

SEQ ID NO: 5666098 - DNA, 23 bp, Homo sapiens
gaagcttattaatgctaagggca

SEQ ID NO: 5666099 - DNA, 15 bp, Homo sapiens
gaagcttcagaagtt

SEQ ID NO: 5666100 - DNA, 16 bp, Homo sapiens
gaagcttcatgcactt

SEQ ID NO: 5666101 - DNA, 16 bp, Homo sapiens
gaagcttccacaaaat

SEQ ID NO: 5666102 - DNA, 13 bp, Homo sapiens
gaagcttccagtc

SEQ ID NO: 5666103 - DNA, 16 bp, Homo sapiens
gaagcttccagtccaa

SEQ ID NO: 5666104 - DNA, 22 bp, Homo sapiens
gaagcttccatgatgcacagta

SEQ ID NO: 5666105 - DNA, 22 bp, Homo sapiens
gaagcttctaaatggtgctgca

SEQ ID NO: 5666106 - DNA, 15 bp, Homo sapiens
gaagcttctaataaa

SEQ ID NO: 5666107 - DNA, 22 bp, Homo sapiens
gaagcttctggtgaccttccaa

SEQ ID NO: 5666108 - DNA, 15 bp, Homo sapiens
gaagcttctgtctcc

SEQ ID NO: 5666109 - DNA, 23 bp, Homo sapiens
gaagcttctgtctccagcttccc

SEQ ID NO: 5666110 - DNA, 14 bp, Homo sapiens
gaagcttgagcctc

SEQ ID NO: 5666111 - DNA, 21 bp, Homo sapiens
gaagcttggaggtcacagctg

SEQ ID NO: 5666112 - DNA, 17 bp, Homo sapiens
gaagcttggggaaccca

SEQ ID NO: 5666113 - DNA, 19 bp, Homo sapiens
gaagcttggggaacccatg

SEQ ID NO: 5666114 - DNA, 18 bp, Homo sapiens
gaagcttgtatctgatat

SEQ ID NO: 5666115 - DNA, 22 bp, Homo sapiens
gaagctttatttgcatatttat

SEQ ID NO: 5666116 - DNA, 14 bp, Homo sapiens
gaagctttcagtat

SEQ ID NO: 5666117 - DNA, 20 bp, Homo sapiens
gaagctttctctgcttcagc

SEQ ID NO: 5666118 - DNA, 15 bp, Homo sapiens
gaagctttgaaggcc

SEQ ID NO: 5666119 - DNA, 15 bp, Homo sapiens
gaagctttgagttga

SEQ ID NO: 5666120 - DNA, 19 bp, Homo sapiens
cttagaaaacatgggcttt

SEQ ID NO: 5666121 - DNA, 18 bp, Homo sapiens
cttagaaaaccagctcag

SEQ ID NO: 5666122 - DNA, 24 bp, Homo sapiens
cttagaaaaccagctcagcactgc

SEQ ID NO: 5666123 - DNA, 14 bp, Homo sapiens
cttagaaaataaat

SEQ ID NO: 5666124 - DNA, 15 bp, Homo sapiens
cttagaaaattaaaa

SEQ ID NO: 5666125 - DNA, 16 bp, Homo sapiens
cttagaaacaatgttt

SEQ ID NO: 5666126 - DNA, 18 bp, Homo sapiens
cttagaaacacataaatt

SEQ ID NO: 5666127 - DNA, 18 bp, Homo sapiens
cttagaaaccaaattaca

SEQ ID NO: 5666128 - DNA, 11 bp, Homo sapiens
cttagaaactc

SEQ ID NO: 5666129 - DNA, 18 bp, Homo sapiens
cttagaaagcaggggcta

SEQ ID NO: 5666130 - DNA, 23 bp, Homo sapiens
cttagaaagttccaaatgtttat

SEQ ID NO: 5666131 - DNA, 13 bp, Homo sapiens
cttagaaatactt

SEQ ID NO: 5666132 - DNA, 19 bp, Homo sapiens
cttagaaatcattgtagaa

SEQ ID NO: 5666133 - DNA, 21 bp, Homo sapiens
cttagaaatgtaaactgccat

SEQ ID NO: 5666134 - DNA, 22 bp, Homo sapiens
cttagaaatgtaaactgccata

SEQ ID NO: 5666135 - DNA, 17 bp, Homo sapiens
cttagaaattgcatttc

SEQ ID NO: 5666136 - DNA, 14 bp, Homo sapiens
cttagaaatttatt

SEQ ID NO: 5666137 - DNA, 15 bp, Homo sapiens
cttagaacattttaa

SEQ ID NO: 5666138 - DNA, 17 bp, Homo sapiens
cttagaacccttctgct

SEQ ID NO: 5666139 - DNA, 19 bp, Homo sapiens
cttagaacccttctgcttt

SEQ ID NO: 5666140 - DNA, 15 bp, Homo sapiens
cttagaacctttctt

SEQ ID NO: 5666141 - DNA, 17 bp, Homo sapiens
cttagaagaatattgta

SEQ ID NO: 5666142 - DNA, 18 bp, Homo sapiens
cttagaagccatgggacc

SEQ ID NO: 5666143 - DNA, 19 bp, Homo sapiens
cttagaagccatgggacct

SEQ ID NO: 5666144 - DNA, 18 bp, Homo sapiens
cttagaaggcactgggaa

SEQ ID NO: 5666145 - DNA, 17 bp, Homo sapiens
cttagaagtcacacagt

SEQ ID NO: 5666146 - DNA, 16 bp, Homo sapiens
cttagaagtggaagta

SEQ ID NO: 5666147 - DNA, 20 bp, Homo sapiens
cttagaagtggaccaggaca

SEQ ID NO: 5666148 - DNA, 21 bp, Homo sapiens
cttagaagtggaccaggacag

SEQ ID NO: 5666149 - DNA, 16 bp, Homo sapiens
cttagaatacagtttt

SEQ ID NO: 5666150 - DNA, 16 bp, Homo sapiens
cttagaatccaaactt

SEQ ID NO: 5666151 - DNA, 18 bp, Homo sapiens
cttagaatccctgtgtta

SEQ ID NO: 5666152 - DNA, 19 bp, Homo sapiens
cttagaatgagggaaacaa

SEQ ID NO: 5666153 - DNA, 13 bp, Homo sapiens
cttagaatgccat

SEQ ID NO: 5666154 - DNA, 22 bp, Homo sapiens
cttagaatggcctctttgtaga

SEQ ID NO: 5666155 - DNA, 12 bp, Homo sapiens
cttagaatgggg

SEQ ID NO: 5666156 - DNA, 12 bp, Homo sapiens
cttagaatgtga

SEQ ID NO: 5666157 - DNA, 16 bp, Homo sapiens
cttagaatgtgaaaaa

SEQ ID NO: 5666158 - DNA, 17 bp, Homo sapiens
cttagaatgtgaaaaaa

SEQ ID NO: 5666159 - DNA, 21 bp, Homo sapiens
cttagaattaaccattgctaa

SEQ ID NO: 5666160 - DNA, 19 bp, Homo sapiens
cttagaattagtggcactt

SEQ ID NO: 5666161 - DNA, 16 bp, Homo sapiens
cttagaattatttgca

SEQ ID NO: 5666162 - DNA, 14 bp, Homo sapiens
cttagacaaatgat

SEQ ID NO: 5666163 - DNA, 11 bp, Homo sapiens
cttagacactt

SEQ ID NO: 5666164 - DNA, 20 bp, Homo sapiens
cttagacagaggccctcaag

SEQ ID NO: 5666165 - DNA, 21 bp, Homo sapiens
cttagacagaggccctcaagt

SEQ ID NO: 5666166 - DNA, 14 bp, Homo sapiens
cttagacagtccct

SEQ ID NO: 5666167 - DNA, 15 bp, Homo sapiens
cttagacagtccctg

SEQ ID NO: 5666168 - DNA, 16 bp, Homo sapiens
cttagacataacaaaa

SEQ ID NO: 5666169 - DNA, 14 bp, Homo sapiens
cttagacccagtca

SEQ ID NO: 5666170 - DNA, 20 bp, Homo sapiens
cttagacccatgctggtcag

SEQ ID NO: 5666171 - DNA, 16 bp, Homo sapiens
gagagtacagtgagcc

SEQ ID NO: 5666172 - DNA, 16 bp, Homo sapiens
gagagtaccatgctgg

SEQ ID NO: 5666173 - DNA, 18 bp, Homo sapiens
gagagtacccccctgaga

SEQ ID NO: 5666174 - DNA, 19 bp, Homo sapiens
gagagtacccccctgagag

SEQ ID NO: 5666175 - DNA, 15 bp, Homo sapiens
gagagtagaacagat

SEQ ID NO: 5666176 - DNA, 18 bp, Homo sapiens
gagagtagccgagagcct

SEQ ID NO: 5666177 - DNA, 20 bp, Homo sapiens
gagagtagccgagagcctgc

SEQ ID NO: 5666178 - DNA, 13 bp, Homo sapiens
gagagtattctaa

SEQ ID NO: 5666179 - DNA, 14 bp, Homo sapiens
gagagtcaaagctg

SEQ ID NO: 5666180 - DNA, 21 bp, Homo sapiens
gagagtcagctctctgccctg

SEQ ID NO: 5666181 - DNA, 13 bp, Homo sapiens
gagagtcaggcag

SEQ ID NO: 5666182 - DNA, 19 bp, Homo sapiens
gagagtcattcaggtgacc

SEQ ID NO: 5666183 - DNA, 20 bp, Homo sapiens
gagagtcattcaggtgacct

SEQ ID NO: 5666184 - DNA, 13 bp, Homo sapiens
gagagtccaggcc

SEQ ID NO: 5666185 - DNA, 14 bp, Homo sapiens
gagagtccaggcct

SEQ ID NO: 5666186 - DNA, 16 bp, Homo sapiens
gagagtccaggcctgg

SEQ ID NO: 5666187 - DNA, 19 bp, Homo sapiens
gagagtcccagagcaggag

SEQ ID NO: 5666188 - DNA, 13 bp, Homo sapiens
gagagtcctggga

SEQ ID NO: 5666189 - DNA, 14 bp, Homo sapiens
gagagtccttagcc

SEQ ID NO: 5666190 - DNA, 22 bp, Homo sapiens
gcatgtagccagttaaggaaag

SEQ ID NO: 5666191 - DNA, 17 bp, Homo sapiens
gcatgtagggcttctgt

SEQ ID NO: 5666192 - DNA, 16 bp, Homo sapiens
gcatgtagggggagcc

SEQ ID NO: 5666193 - DNA, 21 bp, Homo sapiens
gcatgtagtaacactaatata

SEQ ID NO: 5666194 - DNA, 22 bp, Homo sapiens
gcatgtagtaacactaatatat

SEQ ID NO: 5666195 - DNA, 24 bp, Homo sapiens
gcatgtagtaacactaatatattt

SEQ ID NO: 5666196 - DNA, 16 bp, Homo sapiens
gcatgtatagttgctt

SEQ ID NO: 5666197 - DNA, 18 bp, Homo sapiens
gcatgtatagttgctttt

SEQ ID NO: 5666198 - DNA, 16 bp, Homo sapiens
gcatgtatgacgtgac

SEQ ID NO: 5666199 - DNA, 14 bp, Homo sapiens
gcatgtatgtcttg

SEQ ID NO: 5666200 - DNA, 15 bp, Homo sapiens
gcatgtatgtcttgg

SEQ ID NO: 5666201 - DNA, 19 bp, Homo sapiens
gcatgtattatcacatcaa

SEQ ID NO: 5666202 - DNA, 18 bp, Homo sapiens
gcatgtattggcctggag

SEQ ID NO: 5666203 - DNA, 23 bp, Homo sapiens
gcatgtattgtaaacagaaggag

SEQ ID NO: 5666204 - DNA, 15 bp, Homo sapiens
gcatgtatttaagaa

SEQ ID NO: 5666205 - DNA, 20 bp, Homo sapiens
gcatgtcaaacatgagatgt

SEQ ID NO: 5666206 - DNA, 21 bp, Homo sapiens
gcatgtcaaacatgagatgtg

SEQ ID NO: 5666207 - DNA, 15 bp, Homo sapiens
gcatgtcacatgcca

SEQ ID NO: 5666208 - DNA, 17 bp, Homo sapiens
gcatgtcacatgccaca

SEQ ID NO: 5666209 - DNA, 21 bp, Homo sapiens
gcatgtcagacagaacttgaa

SEQ ID NO: 5666210 - DNA, 22 bp, Homo sapiens
gcatgtcagaggaccccagggt

SEQ ID NO: 5666211 - DNA, 17 bp, Homo sapiens
gcatgtcatttgcacac

SEQ ID NO: 5666212 - DNA, 13 bp, Homo sapiens
gcatgtcccaccc

SEQ ID NO: 5666213 - DNA, 15 bp, Homo sapiens
gcatgtcccacccac

SEQ ID NO: 5666214 - DNA, 16 bp, Homo sapiens
gcatgtcccacccacc

SEQ ID NO: 5666215 - DNA, 17 bp, Homo sapiens
gcatgtcccacccaccc

SEQ ID NO: 5666216 - DNA, 22 bp, Homo sapiens
gcatgtcccatgtgagctgctg

SEQ ID NO: 5666217 - DNA, 18 bp, Homo sapiens
gcatgtccccagtgtgga

SEQ ID NO: 5666218 - DNA, 19 bp, Homo sapiens
gcatgtccctccaaggctg

SEQ ID NO: 5666219 - DNA, 15 bp, Homo sapiens
gcatgtcgcacaatg

SEQ ID NO: 5666220 - DNA, 18 bp, Homo sapiens
gcatgtcggggcccctgc

SEQ ID NO: 5666221 - DNA, 19 bp, Homo sapiens
gcatgtcggggcccctgcg

SEQ ID NO: 5666222 - DNA, 23 bp, Homo sapiens
gcatgtcgtgaccaactagacat

SEQ ID NO: 5666223 - DNA, 18 bp, Homo sapiens
gcatgtctaattcattta

SEQ ID NO: 5666224 - DNA, 22 bp, Homo sapiens
gcatgtctaattcatttactca

SEQ ID NO: 5666225 - DNA, 23 bp, Homo sapiens
gcatgtctaattcatttactcac

SEQ ID NO: 5666226 - DNA, 11 bp, Homo sapiens
gcatgtctgca

SEQ ID NO: 5666227 - DNA, 17 bp, Homo sapiens
gcatgtctgcatggcag

SEQ ID NO: 5666228 - DNA, 12 bp, Homo sapiens
gcatgtctgcct

SEQ ID NO: 5666229 - DNA, 16 bp, Homo sapiens
gcatgtctgcctggag

SEQ ID NO: 5666230 - DNA, 15 bp, Homo sapiens
gcatgtctgttcttc

SEQ ID NO: 5666231 - DNA, 16 bp, Homo sapiens
gcatgtctgttcttct

SEQ ID NO: 5666232 - DNA, 11 bp, Homo sapiens
gcatgtcttaa

SEQ ID NO: 5666233 - DNA, 16 bp, Homo sapiens
gcatgtcttaaatgct

SEQ ID NO: 5666234 - DNA, 17 bp, Homo sapiens
gcatgtcttaaatgctc

SEQ ID NO: 5666235 - DNA, 19 bp, Homo sapiens
gcatgtcttaaatgctcat

SEQ ID NO: 5666236 - DNA, 14 bp, Homo sapiens
gcatgtcttttaaa

SEQ ID NO: 5666237 - DNA, 15 bp, Homo sapiens
gcatgtcttttaaaa

SEQ ID NO: 5666238 - DNA, 16 bp, Homo sapiens
gcatgtctttttttct

SEQ ID NO: 5666239 - DNA, 22 bp, Homo sapiens
gcatgtgaagcatgctttgctg

SEQ ID NO: 5666240 - DNA, 21 bp, Homo sapiens
gcatgtgactctgaagctgac

SEQ ID NO: 5666241 - DNA, 17 bp, Homo sapiens
gcatgtgatgagaggaa

SEQ ID NO: 5666242 - DNA, 22 bp, Homo sapiens
gcatgtgcagacactcaagagc

SEQ ID NO: 5666243 - DNA, 13 bp, Homo sapiens
gcatgtgccaaga

SEQ ID NO: 5666244 - DNA, 18 bp, Homo sapiens
gcatgtgcggctgaactg

SEQ ID NO: 5666245 - DNA, 16 bp, Homo sapiens
gcatgtgcgtggaagt

SEQ ID NO: 5666246 - DNA, 17 bp, Homo sapiens
gcatgtgcgtggaagtg

SEQ ID NO: 5666247 - DNA, 20 bp, Homo sapiens
gcatgtgcgtggaagtgttc

SEQ ID NO: 5666248 - DNA, 21 bp, Homo sapiens
gcatgtgcgtggaagtgttcc

SEQ ID NO: 5666249 - DNA, 14 bp, Homo sapiens
gcatgtgctgtctc

SEQ ID NO: 5666250 - DNA, 22 bp, Homo sapiens
gcatgtgctgtctccatgctgg

SEQ ID NO: 5666251 - DNA, 16 bp, Homo sapiens
gcatgtgctgtgtgag

SEQ ID NO: 5666252 - DNA, 22 bp, Homo sapiens
gcatgtgctgtgtgagtgagca

SEQ ID NO: 5666253 - DNA, 12 bp, Homo sapiens
gcatgtggcctg

SEQ ID NO: 5666254 - DNA, 16 bp, Homo sapiens
gcatgtggcctgtggc

SEQ ID NO: 5666255 - DNA, 15 bp, Homo sapiens
gcatgtgggcttcaa

SEQ ID NO: 5666256 - DNA, 23 bp, Homo sapiens
gcatgtggtttggttcctctctg

SEQ ID NO: 5666257 - DNA, 18 bp, Homo sapiens
gcatgtgtaaatctgaaa

SEQ ID NO: 5666258 - DNA, 18 bp, Homo sapiens
gcatgtgtcatgcatgaa

SEQ ID NO: 5666259 - DNA, 12 bp, Homo sapiens
gcatgtgtctgt

SEQ ID NO: 5666260 - DNA, 16 bp, Homo sapiens
gcatgtgtgactttca

SEQ ID NO: 5666261 - DNA, 14 bp, Homo sapiens
gcatgtgtgcctgt

SEQ ID NO: 5666262 - DNA, 19 bp, Homo sapiens
gcatgtgtgcctgtggcag

SEQ ID NO: 5666263 - DNA, 11 bp, Homo sapiens
gcatgtgtgtg

SEQ ID NO: 5666264 - DNA, 16 bp, Homo sapiens
gcatgtgtgtgtctct

SEQ ID NO: 5666265 - DNA, 22 bp, Homo sapiens
gcatgtgtttggttctggggcc

SEQ ID NO: 5666266 - DNA, 13 bp, Homo sapiens
gcatgttaaaata

SEQ ID NO: 5666267 - DNA, 18 bp, Homo sapiens
gcatgttacctcctataa

SEQ ID NO: 5666268 - DNA, 15 bp, Homo sapiens
gcatgttactaaatt

SEQ ID NO: 5666269 - DNA, 15 bp, Homo sapiens
gcatgttactgccaa

SEQ ID NO: 5666270 - DNA, 20 bp, Homo sapiens
gcatgttcacccttatagtc

SEQ ID NO: 5666271 - DNA, 21 bp, Homo sapiens
gcatgttcacccttatagtct

SEQ ID NO: 5666272 - DNA, 22 bp, Homo sapiens
gcatgttctcctctatcttaga

SEQ ID NO: 5666273 - DNA, 14 bp, Homo sapiens
gcatgttctctgag

SEQ ID NO: 5666274 - DNA, 19 bp, Homo sapiens
gcatgttcttgttttgtta

SEQ ID NO: 5666275 - DNA, 20 bp, Homo sapiens
gcatgttgaccatgtctatg

SEQ ID NO: 5666276 - DNA, 15 bp, Homo sapiens
gcatgttgagaggct

SEQ ID NO: 5666277 - DNA, 18 bp, Homo sapiens
gcatgttggggtttcctt

SEQ ID NO: 5666278 - DNA, 17 bp, Homo sapiens
gcatgttgtctaagaaa

SEQ ID NO: 5666279 - DNA, 23 bp, Homo sapiens
gcatgtttaataatatgtacaaa

SEQ ID NO: 5666280 - DNA, 12 bp, Homo sapiens
gcatgtttaatg

SEQ ID NO: 5666281 - DNA, 14 bp, Homo sapiens
gcatgtttaatgtg

SEQ ID NO: 5666282 - DNA, 15 bp, Homo sapiens
gcatgtttaattgtg

SEQ ID NO: 5666283 - DNA, 16 bp, Homo sapiens
gcatgtttaattgtga

SEQ ID NO: 5666284 - DNA, 18 bp, Homo sapiens
gcatgtttattctgttcc

SEQ ID NO: 5666285 - DNA, 16 bp, Homo sapiens
gcatgtttcactcctg

SEQ ID NO: 5666286 - DNA, 20 bp, Homo sapiens
gcatgtttcatgttttgtga

SEQ ID NO: 5666287 - DNA, 23 bp, Homo sapiens
gcatgtttcccgctccaagagaa

SEQ ID NO: 5666288 - DNA, 18 bp, Homo sapiens
gcatgtttgtctgtgtgc

SEQ ID NO: 5666289 - DNA, 23 bp, Homo sapiens
gcatgtttgtctgtgtgctgtaa

SEQ ID NO: 5666290 - DNA, 13 bp, Homo sapiens
gcatgttttaaaa

SEQ ID NO: 5666291 - DNA, 19 bp, Homo sapiens
gcatgttttccagctcctc

SEQ ID NO: 5666292 - DNA, 19 bp, Homo sapiens
gcatgttttctgctttaaa

SEQ ID NO: 5666293 - DNA, 15 bp, Homo sapiens
gcatgttttcttcat

SEQ ID NO: 5666294 - DNA, 17 bp, Homo sapiens
gcatgttttgtatacaa

SEQ ID NO: 5666295 - DNA, 18 bp, Homo sapiens
gcatgttttgtgcatttg

SEQ ID NO: 5666296 - DNA, 15 bp, Homo sapiens
gcatgttttgttgct

SEQ ID NO: 5666297 - DNA, 15 bp, Homo sapiens
gcattaaaagaaaat

SEQ ID NO: 5666298 - DNA, 16 bp, Homo sapiens
gcattaaaataactat

SEQ ID NO: 5666299 - DNA, 23 bp, Homo sapiens
gcattaaaataactatcaggcag

SEQ ID NO: 5666300 - DNA, 14 bp, Homo sapiens
gcattaaaccacat

SEQ ID NO: 5666301 - DNA, 12 bp, Homo sapiens
gcattaaacctg

SEQ ID NO: 5666302 - DNA, 22 bp, Homo sapiens
gcattaaacctgtctccactgt

SEQ ID NO: 5666303 - DNA, 12 bp, Homo sapiens
gcattaaatata

SEQ ID NO: 5666304 - DNA, 12 bp, Homo sapiens
gcattaaatgca

SEQ ID NO: 5666305 - DNA, 18 bp, Homo sapiens
gcattaaatgcaaaaata

SEQ ID NO: 5666306 - DNA, 17 bp, Homo sapiens
gcattaaatgctttgat

SEQ ID NO: 5666307 - DNA, 15 bp, Homo sapiens
gcattaaattacaga

SEQ ID NO: 5666308 - DNA, 20 bp, Homo sapiens
gcattaaattttaaggtaga

SEQ ID NO: 5666309 - DNA, 14 bp, Homo sapiens
gcattaacaataaa

SEQ ID NO: 5666310 - DNA, 17 bp, Homo sapiens
gcattaactaaatgctc

SEQ ID NO: 5666311 - DNA, 14 bp, Homo sapiens
gcattaactaatct

SEQ ID NO: 5666312 - DNA, 16 bp, Homo sapiens
gcattaacttctctgg

SEQ ID NO: 5666313 - DNA, 14 bp, Homo sapiens
gcattaagaggttt

SEQ ID NO: 5666314 - DNA, 13 bp, Homo sapiens
gcattaagcacac

SEQ ID NO: 5666315 - DNA, 14 bp, Homo sapiens
gcattaagggcctg

SEQ ID NO: 5666316 - DNA, 17 bp, Homo sapiens
gcattaagggcctgctg

SEQ ID NO: 5666317 - DNA, 19 bp, Homo sapiens
gcattaagggcctgctgga

SEQ ID NO: 5666318 - DNA, 16 bp, Homo sapiens
gcattaataaaaatca

SEQ ID NO: 5666319 - DNA, 12 bp, Homo sapiens
gcattaatgttt

SEQ ID NO: 5666320 - DNA, 13 bp, Homo sapiens
gcattaatgtttc

SEQ ID NO: 5666321 - DNA, 14 bp, Homo sapiens
gcattaatgtttct

SEQ ID NO: 5666322 - DNA, 20 bp, Homo sapiens
gcattaccagcttaaaacac

SEQ ID NO: 5666323 - DNA, 17 bp, Homo sapiens
gcattacccaaaagcaa

SEQ ID NO: 5666324 - DNA, 23 bp, Homo sapiens
gcattaccgcgttgtaaaatata

SEQ ID NO: 5666325 - DNA, 16 bp, Homo sapiens
gcattacctctttgga

SEQ ID NO: 5666326 - DNA, 13 bp, Homo sapiens
gcattactctgca

SEQ ID NO: 5666327 - DNA, 19 bp, Homo sapiens
gcattactcttgtaagatt

SEQ ID NO: 5666328 - DNA, 24 bp, Homo sapiens
gcattactcttgtaagattttgaa

SEQ ID NO: 5666329 - DNA, 14 bp, Homo sapiens
gcattactgaattt

SEQ ID NO: 5666330 - DNA, 13 bp, Homo sapiens
gcattagaaatta

SEQ ID NO: 5666331 - DNA, 16 bp, Homo sapiens
gcattagaatggagga

SEQ ID NO: 5666332 - DNA, 20 bp, Homo sapiens
gcattagatagtcatgctgc

SEQ ID NO: 5666333 - DNA, 22 bp, Homo sapiens
gcattagcacagattttaattg

SEQ ID NO: 5666334 - DNA, 21 bp, Homo sapiens
gcattagtaactttgaaaggt

SEQ ID NO: 5666335 - DNA, 24 bp, Homo sapiens
gcattagttggagctagaaaatga

SEQ ID NO: 5666336 - DNA, 14 bp, Homo sapiens
gcattataattttt

SEQ ID NO: 5666337 - DNA, 18 bp, Homo sapiens
gcattatccttttatctc

SEQ ID NO: 5666338 - DNA, 24 bp, Homo sapiens
gcattatctagatactgtatcatg

SEQ ID NO: 5666339 - DNA, 20 bp, Homo sapiens
gcattatgcaatttttatat

SEQ ID NO: 5666340 - DNA, 19 bp, Homo sapiens
gcattatgtatttataatt

SEQ ID NO: 5666341 - DNA, 23 bp, Homo sapiens
gcattatgtatttataatttaaa

SEQ ID NO: 5666342 - DNA, 19 bp, Homo sapiens
gcattatgtccactgtgta

SEQ ID NO: 5666343 - DNA, 21 bp, Homo sapiens
gcattatgtccactgtgtata

SEQ ID NO: 5666344 - DNA, 15 bp, Homo sapiens
gcattattatcattg

SEQ ID NO: 5666345 - DNA, 16 bp, Homo sapiens
gcattattatcattga

SEQ ID NO: 5666346 - DNA, 18 bp, Homo sapiens
gcattattcatttagtga

SEQ ID NO: 5666347 - DNA, 20 bp, Homo sapiens
gcattattgacgaactggct

SEQ ID NO: 5666348 - DNA, 15 bp, Homo sapiens
gcattatttaatgtt

SEQ ID NO: 5666349 - DNA, 14 bp, Homo sapiens
gcattgttccacac

SEQ ID NO: 5666350 - DNA, 21 bp, Homo sapiens
gcattgttccacacatttaaa

SEQ ID NO: 5666351 - DNA, 16 bp, Homo sapiens
gcattgttgaggtggt

SEQ ID NO: 5666352 - DNA, 23 bp, Homo sapiens
gcattgttgaggtggtctgaatg

SEQ ID NO: 5666353 - DNA, 14 bp, Homo sapiens
gcattgttgtaaag

SEQ ID NO: 5666354 - DNA, 14 bp, Homo sapiens
gcattgtttctgtg

SEQ ID NO: 5666355 - DNA, 17 bp, Homo sapiens
gcattgtttctgtgggc

SEQ ID NO: 5666356 - DNA, 18 bp, Homo sapiens
gcattgtttgcttattgt

SEQ ID NO: 5666357 - DNA, 22 bp, Homo sapiens
gcattgtttgcttattgttcca

SEQ ID NO: 5666358 - DNA, 17 bp, Homo sapiens
gcattgtttgtgatatt

SEQ ID NO: 5666359 - DNA, 18 bp, Homo sapiens
gcatttaaaacagacact

SEQ ID NO: 5666360 - DNA, 20 bp, Homo sapiens
gcatttaaaagagtaagggt

SEQ ID NO: 5666361 - DNA, 15 bp, Homo sapiens
gcatttaaaagatac

SEQ ID NO: 5666362 - DNA, 12 bp, Homo sapiens
gcatttaaaata

SEQ ID NO: 5666363 - DNA, 13 bp, Homo sapiens
gcatttaaaatac

SEQ ID NO: 5666364 - DNA, 15 bp, Homo sapiens
gcatttaaaatacca

SEQ ID NO: 5666365 - DNA, 23 bp, Homo sapiens
gcatttaaaataccactgtaatt

SEQ ID NO: 5666366 - DNA, 14 bp, Homo sapiens
gcatttaaaatgga

SEQ ID NO: 5666367 - DNA, 15 bp, Homo sapiens
gcatttaaaatggac

SEQ ID NO: 5666368 - DNA, 16 bp, Homo sapiens
gcatttaaagtattct

SEQ ID NO: 5666369 - DNA, 12 bp, Homo sapiens
gcatttaaatca

SEQ ID NO: 5666370 - DNA, 20 bp, Homo sapiens
gcatttaacccccctgtaca

SEQ ID NO: 5666371 - DNA, 22 bp, Homo sapiens
gcatttaacccccctgtacaca

SEQ ID NO: 5666372 - DNA, 16 bp, Homo sapiens
gcatttaacttacatt

SEQ ID NO: 5666373 - DNA, 23 bp, Homo sapiens
gcatttaacttacatttgtactt

SEQ ID NO: 5666374 - DNA, 16 bp, Homo sapiens
gcatttaagaacagaa

SEQ ID NO: 5666375 - DNA, 15 bp, Homo sapiens
gcatttaaggagatt

SEQ ID NO: 5666376 - DNA, 17 bp, Homo sapiens
gcatttaagttgtaaac

SEQ ID NO: 5666377 - DNA, 13 bp, Homo sapiens
gcatttaataaag

SEQ ID NO: 5666378 - DNA, 14 bp, Homo sapiens
gcatttaataaaga

SEQ ID NO: 5666379 - DNA, 20 bp, Homo sapiens
gcatttaataaagatgagtt

SEQ ID NO: 5666380 - DNA, 13 bp, Homo sapiens
gcatttaataaat

SEQ ID NO: 5666381 - DNA, 18 bp, Homo sapiens
gcatttaatggcagctag

SEQ ID NO: 5666382 - DNA, 23 bp, Homo sapiens
gcatttaatggcagctagtgcct

SEQ ID NO: 5666383 - DNA, 19 bp, Homo sapiens
gcatttaatgtagccatgg

SEQ ID NO: 5666384 - DNA, 14 bp, Homo sapiens
gcatttacaaggtt

SEQ ID NO: 5666385 - DNA, 17 bp, Homo sapiens
gcatttacgcctgtaaa

SEQ ID NO: 5666386 - DNA, 17 bp, Homo sapiens
gcatttactgtgtcttt

SEQ ID NO: 5666387 - DNA, 18 bp, Homo sapiens
gcatttagcacagtattt

SEQ ID NO: 5666388 - DNA, 19 bp, Homo sapiens
gcatttagggagtattcta

SEQ ID NO: 5666389 - DNA, 21 bp, Homo sapiens
gcatttagtgaagttgtgcaa

SEQ ID NO: 5666390 - DNA, 20 bp, Homo sapiens
gcatttagttttatggcatg

SEQ ID NO: 5666391 - DNA, 19 bp, Homo sapiens
gcatttataaatgtgtggt

SEQ ID NO: 5666392 - DNA, 15 bp, Homo sapiens
gcatttatagatcat

SEQ ID NO: 5666393 - DNA, 14 bp, Homo sapiens
gcatttatgcatga

SEQ ID NO: 5666394 - DNA, 24 bp, Homo sapiens
gcatttatgcatgagaactaaata

SEQ ID NO: 5666395 - DNA, 18 bp, Homo sapiens
gcatttatgtagacattg

SEQ ID NO: 5666396 - DNA, 19 bp, Homo sapiens
gcatttatgtagacattgt

SEQ ID NO: 5666397 - DNA, 23 bp, Homo sapiens
gcatttcaaagccctgcctctgt

SEQ ID NO: 5666398 - DNA, 16 bp, Homo sapiens
gcatttcaaggaacag

SEQ ID NO: 5666399 - DNA, 17 bp, Homo sapiens
gcatttcaattcctggc

SEQ ID NO: 5666400 - DNA, 18 bp, Homo sapiens
gcatttcacgaactgttc

SEQ ID NO: 5666401 - DNA, 19 bp, Homo sapiens
gcatttcacttgagtggag

SEQ ID NO: 5666402 - DNA, 21 bp, Homo sapiens
gcatttcagaaagcctttcat

SEQ ID NO: 5666403 - DNA, 18 bp, Homo sapiens
gcatttcagcttgaacct

SEQ ID NO: 5666404 - DNA, 23 bp, Homo sapiens
gcatttcatagcttcacaatgtt

SEQ ID NO: 5666405 - DNA, 13 bp, Homo sapiens
gcatttcatcaag

SEQ ID NO: 5666406 - DNA, 11 bp, Homo sapiens
gcatttcatgc

SEQ ID NO: 5666407 - DNA, 14 bp, Homo sapiens
gcatttcattcaaa

SEQ ID NO: 5666408 - DNA, 20 bp, Homo sapiens
gcatttcattcttctctagc

SEQ ID NO: 5666409 - DNA, 23 bp, Homo sapiens
gcatttccaacaccacagacaca

SEQ ID NO: 5666410 - DNA, 15 bp, Homo sapiens
gcatttccacactgt

SEQ ID NO: 5666411 - DNA, 15 bp, Homo sapiens
gcatttccagctgtg

SEQ ID NO: 5666412 - DNA, 10 bp, Homo sapiens
gcatttccta

SEQ ID NO: 5666413 - DNA, 21 bp, Homo sapiens
gcatttcctatcacctatttc

SEQ ID NO: 5666414 - DNA, 13 bp, Homo sapiens
gcatttcctgggt

SEQ ID NO: 5666415 - DNA, 15 bp, Homo sapiens
gcatttctaaaatgt

SEQ ID NO: 5666416 - DNA, 17 bp, Homo sapiens
gcatttctagtcccttc

SEQ ID NO: 5666417 - DNA, 12 bp, Homo sapiens
gcatttctattg

SEQ ID NO: 5666418 - DNA, 13 bp, Homo sapiens
gcatttctctggg

SEQ ID NO: 5666419 - DNA, 11 bp, Homo sapiens
gcatttctctt

SEQ ID NO: 5666420 - DNA, 19 bp, Homo sapiens
gcatttctcttcctaaatt

SEQ ID NO: 5666421 - DNA, 15 bp, Homo sapiens
gcatttctcttctca

SEQ ID NO: 5666422 - DNA, 14 bp, Homo sapiens
gcatttctctttaa

SEQ ID NO: 5666423 - DNA, 14 bp, Homo sapiens
gcatttctgtattt

SEQ ID NO: 5666424 - DNA, 19 bp, Homo sapiens
gcatttctgtattttttgt

SEQ ID NO: 5666425 - DNA, 21 bp, Homo sapiens
gcatttctgtggatacagtgc

SEQ ID NO: 5666426 - DNA, 16 bp, Homo sapiens
gcatttcttgtgttct

SEQ ID NO: 5666427 - DNA, 19 bp, Homo sapiens
gcatttctttatttctgtc

SEQ ID NO: 5666428 - DNA, 23 bp, Homo sapiens
gcatttctttatttctgtctcat

SEQ ID NO: 5666429 - DNA, 14 bp, Homo sapiens
gcatttctttggaa

SEQ ID NO: 5666430 - DNA, 21 bp, Homo sapiens
gcatttctttttaggctctga

SEQ ID NO: 5666431 - DNA, 14 bp, Homo sapiens
gcatttgaaaattt

SEQ ID NO: 5666432 - DNA, 12 bp, Homo sapiens
gcatttgaatgc

SEQ ID NO: 5666433 - DNA, 13 bp, Homo sapiens
gcatttgaatgca

SEQ ID NO: 5666434 - DNA, 13 bp, Homo sapiens
gcatttgagaaat

SEQ ID NO: 5666435 - DNA, 13 bp, Homo sapiens
gcatttgaggggc

SEQ ID NO: 5666436 - DNA, 20 bp, Homo sapiens
gcatttgaggtctgttcttt

SEQ ID NO: 5666437 - DNA, 21 bp, Homo sapiens
gcatttgaggtctgttctttc

SEQ ID NO: 5666438 - DNA, 20 bp, Homo sapiens
gcatttgataatgataaaac

SEQ ID NO: 5666439 - DNA, 17 bp, Homo sapiens
gcatttgatctgttgca

SEQ ID NO: 5666440 - DNA, 15 bp, Homo sapiens
gcatttgatttccat

SEQ ID NO: 5666441 - DNA, 17 bp, Homo sapiens
gcatttgctaaggcagc

SEQ ID NO: 5666442 - DNA, 15 bp, Homo sapiens
gcatttgctgaataa

SEQ ID NO: 5666443 - DNA, 23 bp, Homo sapiens
gcatttgctgaatacagaggcaa

SEQ ID NO: 5666444 - DNA, 16 bp, Homo sapiens
gcatttgctgatttct

SEQ ID NO: 5666445 - DNA, 20 bp, Homo sapiens
gcatttgctgatttctagtg

SEQ ID NO: 5666446 - DNA, 13 bp, Homo sapiens
gcatttgctgttg

SEQ ID NO: 5666447 - DNA, 18 bp, Homo sapiens
gcatttggaaccaaagtc

SEQ ID NO: 5666448 - DNA, 22 bp, Homo sapiens
gcatttggaaccaaagtctaaa

SEQ ID NO: 5666449 - DNA, 15 bp, Homo sapiens
gcatttggcactgag

SEQ ID NO: 5666450 - DNA, 20 bp, Homo sapiens
gcatttggctggagcccggt

SEQ ID NO: 5666451 - DNA, 15 bp, Homo sapiens
gcatttggcttcctc

SEQ ID NO: 5666452 - DNA, 16 bp, Homo sapiens
gcatttggtctcaggc

SEQ ID NO: 5666453 - DNA, 17 bp, Homo sapiens
gcatttggtctcaggca

SEQ ID NO: 5666454 - DNA, 19 bp, Homo sapiens
gcatttggttttacacagg

SEQ ID NO: 5666455 - DNA, 17 bp, Homo sapiens
gcatttgtaaaaagtag

SEQ ID NO: 5666456 - DNA, 23 bp, Homo sapiens
gcatttgtaaaaagtagattaaa

SEQ ID NO: 5666457 - DNA, 22 bp, Homo sapiens
gcatttgtaaaaatgagacttt

SEQ ID NO: 5666458 - DNA, 17 bp, Homo sapiens
gcatttgtaaatattaa

SEQ ID NO: 5666459 - DNA, 21 bp, Homo sapiens
gcatttgtaaatattaaacca

SEQ ID NO: 5666460 - DNA, 14 bp, Homo sapiens
gcatttgtatatta

SEQ ID NO: 5666461 - DNA, 12 bp, Homo sapiens
gcatttgtatta

SEQ ID NO: 5666462 - DNA, 21 bp, Homo sapiens
gcatttgtattttgtgtgacc

SEQ ID NO: 5666463 - DNA, 13 bp, Homo sapiens
gcatttgtcaatg

SEQ ID NO: 5666464 - DNA, 18 bp, Homo sapiens
gcatttgtcaatgacagt

SEQ ID NO: 5666465 - DNA, 12 bp, Homo sapiens
gcatttgtctat

SEQ ID NO: 5666466 - DNA, 15 bp, Homo sapiens
gcatttgtgagccaa

SEQ ID NO: 5666467 - DNA, 19 bp, Homo sapiens
gcatttgtgagccaaagag

SEQ ID NO: 5666468 - DNA, 13 bp, Homo sapiens
gcatttgtgaggc

SEQ ID NO: 5666469 - DNA, 17 bp, Homo sapiens
gcatttgtgctagaaat

SEQ ID NO: 5666470 - DNA, 18 bp, Homo sapiens
gcatttgttggtttatca

SEQ ID NO: 5666471 - DNA, 18 bp, Homo sapiens
gcatttgtttatgtaatt

SEQ ID NO: 5666472 - DNA, 22 bp, Homo sapiens
gcatttgtttctttctctgagg

SEQ ID NO: 5666473 - DNA, 18 bp, Homo sapiens
gcatttgtttgaactgat

SEQ ID NO: 5666474 - DNA, 18 bp, Homo sapiens
gcatttgttttagcatta

SEQ ID NO: 5666475 - DNA, 17 bp, Homo sapiens
gcattttaaatgtctat

SEQ ID NO: 5666476 - DNA, 20 bp, Homo sapiens
gcattttaatagtttctaaa

SEQ ID NO: 5666477 - DNA, 19 bp, Homo sapiens
gcattttaatgatattgga

SEQ ID NO: 5666478 - DNA, 24 bp, Homo sapiens
gcattttaccttcaaaatatttgt

SEQ ID NO: 5666479 - DNA, 17 bp, Homo sapiens
gcattttactatgcctg

SEQ ID NO: 5666480 - DNA, 21 bp, Homo sapiens
gcattttagaaactacaaata

SEQ ID NO: 5666481 - DNA, 21 bp, Homo sapiens
gcattttcactgcaatgtcaa

SEQ ID NO: 5666482 - DNA, 18 bp, Homo sapiens
gcattttcctcctctgcc

SEQ ID NO: 5666483 - DNA, 16 bp, Homo sapiens
gcattttcctcgccta

SEQ ID NO: 5666484 - DNA, 20 bp, Homo sapiens
gcattttcctcttgtcctgg

SEQ ID NO: 5666485 - DNA, 23 bp, Homo sapiens
gcattttcctcttgtcctggccc

SEQ ID NO: 5666486 - DNA, 12 bp, Homo sapiens
gcattttctcag

SEQ ID NO: 5666487 - DNA, 14 bp, Homo sapiens
gcattttctcaggc

SEQ ID NO: 5666488 - DNA, 15 bp, Homo sapiens
gcattttctctagct

SEQ ID NO: 5666489 - DNA, 17 bp, Homo sapiens
gcattttctctagctga

SEQ ID NO: 5666490 - DNA, 16 bp, Homo sapiens
gcattttctctgtagt

SEQ ID NO: 5666491 - DNA, 23 bp, Homo sapiens
gcattttctgaaactaatgaaag

SEQ ID NO: 5666492 - DNA, 16 bp, Homo sapiens
gcattttctgatgtat

SEQ ID NO: 5666493 - DNA, 18 bp, Homo sapiens
gcattttctgatgtatta

SEQ ID NO: 5666494 - DNA, 22 bp, Homo sapiens
gcattttctgggttctgggtgg

SEQ ID NO: 5666495 - DNA, 12 bp, Homo sapiens
gcattttcttca

SEQ ID NO: 5666496 - DNA, 15 bp, Homo sapiens
gcattttgacaacat

SEQ ID NO: 5666497 - DNA, 21 bp, Homo sapiens
gcattttgagtgtttatagat

SEQ ID NO: 5666498 - DNA, 13 bp, Homo sapiens
gcattttgcaaac

SEQ ID NO: 5666499 - DNA, 13 bp, Homo sapiens
gcattttgctaag

SEQ ID NO: 5666500 - DNA, 13 bp, Homo sapiens
gcattttgctatt

SEQ ID NO: 5666501 - DNA, 14 bp, Homo sapiens
gcattttgctattg

SEQ ID NO: 5666502 - DNA, 13 bp, Homo sapiens
gcattttggcgct

SEQ ID NO: 5666503 - DNA, 15 bp, Homo sapiens
gcattttgtacaatg

SEQ ID NO: 5666504 - DNA, 14 bp, Homo sapiens
gcattttgtatttg

SEQ ID NO: 5666505 - DNA, 23 bp, Homo sapiens
gcattttgtatttgtctaactgg

SEQ ID NO: 5666506 - DNA, 18 bp, Homo sapiens
gcattttgtggctgattt

SEQ ID NO: 5666507 - DNA, 13 bp, Homo sapiens
gcattttgtttca

SEQ ID NO: 5666508 - DNA, 23 bp, Homo sapiens
gcattttgtttcactctttccag

SEQ ID NO: 5666509 - DNA, 18 bp, Homo sapiens
gcattttgtttggtattg

SEQ ID NO: 5666510 - DNA, 21 bp, Homo sapiens
gcattttgtttggtattgtat

SEQ ID NO: 5666511 - DNA, 23 bp, Homo sapiens
gcattttgtttggtattgtattt

SEQ ID NO: 5666512 - DNA, 21 bp, Homo sapiens
gcatttttaaaggacaaacag

SEQ ID NO: 5666513 - DNA, 17 bp, Homo sapiens
gcatttttacctttcat

SEQ ID NO: 5666514 - DNA, 19 bp, Homo sapiens
gcatttttatttcagattt

SEQ ID NO: 5666515 - DNA, 23 bp, Homo sapiens
gcatttttatttcagattttgat

SEQ ID NO: 5666516 - DNA, 16 bp, Homo sapiens
gcatttttccatctgt

SEQ ID NO: 5666517 - DNA, 13 bp, Homo sapiens
gcatttttcttat

SEQ ID NO: 5666518 - DNA, 13 bp, Homo sapiens
gcatttttgcttc

SEQ ID NO: 5666519 - DNA, 14 bp, Homo sapiens
gcatttttgtaaat

SEQ ID NO: 5666520 - DNA, 18 bp, Homo sapiens
gcatttttgttttgaaag

SEQ ID NO: 5666521 - DNA, 19 bp, Homo sapiens
gcatttttgttttgaaagt

SEQ ID NO: 5666522 - DNA, 21 bp, Homo sapiens
gcatttttgttttgaaagttt

SEQ ID NO: 5666523 - DNA, 15 bp, Homo sapiens
gcattttttaaaaca

SEQ ID NO: 5666524 - DNA, 13 bp, Homo sapiens
gcattttttatga

SEQ ID NO: 5666525 - DNA, 16 bp, Homo sapiens
gcattttttatgatat

SEQ ID NO: 5666526 - DNA, 15 bp, Homo sapiens
gcatttttttagtaa

SEQ ID NO: 5666527 - DNA, 22 bp, Homo sapiens
gcatttttttagtaaattaaga

SEQ ID NO: 5666528 - DNA, 15 bp, Homo sapiens
gccaacgagacacat

SEQ ID NO: 5666529 - DNA, 21 bp, Homo sapiens
gccaacgagacacattgcctt

SEQ ID NO: 5666530 - DNA, 20 bp, Homo sapiens
gccaacgcacgcaacccttg

SEQ ID NO: 5666531 - DNA, 16 bp, Homo sapiens
gccaacgtgtgtgtca

SEQ ID NO: 5666532 - DNA, 15 bp, Homo sapiens
gccaactagcccctg

SEQ ID NO: 5666533 - DNA, 16 bp, Homo sapiens
gccaactagcccctgg

SEQ ID NO: 5666534 - DNA, 17 bp, Homo sapiens
gccaactagcccctggg

SEQ ID NO: 5666535 - DNA, 20 bp, Homo sapiens
gccaactagcccctggggtg

SEQ ID NO: 5666536 - DNA, 14 bp, Homo sapiens
gccaactatggcct

SEQ ID NO: 5666537 - DNA, 16 bp, Homo sapiens
gccaactattctcagg

SEQ ID NO: 5666538 - DNA, 18 bp, Homo sapiens
gccaactcacccttggcc

SEQ ID NO: 5666539 - DNA, 21 bp, Homo sapiens
gccaactccatgaccaggcca

SEQ ID NO: 5666540 - DNA, 22 bp, Homo sapiens
gccaactccatgaccaggccac

SEQ ID NO: 5666541 - DNA, 15 bp, Homo sapiens
gccaactccatgtca

SEQ ID NO: 5666542 - DNA, 13 bp, Homo sapiens
gccaactcctcac

SEQ ID NO: 5666543 - DNA, 16 bp, Homo sapiens
gccaactcctccttgc

SEQ ID NO: 5666544 - DNA, 18 bp, Homo sapiens
gccaactctaacaggcac

SEQ ID NO: 5666545 - DNA, 20 bp, Homo sapiens
gccaactgacaaagatgcat

SEQ ID NO: 5666546 - DNA, 13 bp, Homo sapiens
gccaactgcctcc

SEQ ID NO: 5666547 - DNA, 19 bp, Homo sapiens
gccaactgctgctttttga

SEQ ID NO: 5666548 - DNA, 17 bp, Homo sapiens
gccaactgtttccctgc

SEQ ID NO: 5666549 - DNA, 15 bp, Homo sapiens
gccaacttctcccac

SEQ ID NO: 5666550 - DNA, 15 bp, Homo sapiens
gccaacttgagggcc

SEQ ID NO: 5666551 - DNA, 20 bp, Homo sapiens
gccaacttgagggcccagag

SEQ ID NO: 5666552 - DNA, 17 bp, Homo sapiens
gagcaagtgaggccgga

SEQ ID NO: 5666553 - DNA, 14 bp, Homo sapiens
gagcaataaagtgg

SEQ ID NO: 5666554 - DNA, 20 bp, Homo sapiens
gagcaataacttctatgttg

SEQ ID NO: 5666555 - DNA, 23 bp, Homo sapiens
gagcaatatttatggatgcaaca

SEQ ID NO: 5666556 - DNA, 18 bp, Homo sapiens
gagcaatcagaacttcag

SEQ ID NO: 5666557 - DNA, 14 bp, Homo sapiens
gagcaatctggaaa

SEQ ID NO: 5666558 - DNA, 15 bp, Homo sapiens
gagcaatctggaaaa

SEQ ID NO: 5666559 - DNA, 20 bp, Homo sapiens
gagcaatgcttttaatgaat

SEQ ID NO: 5666560 - DNA, 14 bp, Homo sapiens
gagcaatgggactg

SEQ ID NO: 5666561 - DNA, 15 bp, Homo sapiens
gagcaatgggactgg

SEQ ID NO: 5666562 - DNA, 16 bp, Homo sapiens
gagcaatgggactgga

SEQ ID NO: 5666563 - DNA, 21 bp, Homo sapiens
gagcaatgggactggagtcag

SEQ ID NO: 5666564 - DNA, 14 bp, Homo sapiens
gagcaatgggaggg

SEQ ID NO: 5666565 - DNA, 20 bp, Homo sapiens
gagcaatggtaactgcacct

SEQ ID NO: 5666566 - DNA, 16 bp, Homo sapiens
gagcaattaaactgtg

SEQ ID NO: 5666567 - DNA, 22 bp, Homo sapiens
gagcaattcatttcactttaaa

SEQ ID NO: 5666568 - DNA, 14 bp, Homo sapiens
gagcaattccaggc

SEQ ID NO: 5666569 - DNA, 22 bp, Homo sapiens
gagcaattccaggctgagccat

SEQ ID NO: 5666570 - DNA, 16 bp, Homo sapiens
gagcaatttgtctgga

SEQ ID NO: 5666571 - DNA, 21 bp, Homo sapiens
gagcacaaaattcaaagcatg

SEQ ID NO: 5666572 - DNA, 22 bp, Homo sapiens
gagcacaaaattcaaagcatgg

SEQ ID NO: 5666573 - DNA, 16 bp, Homo sapiens
gagcacaaacattttt

SEQ ID NO: 5666574 - DNA, 12 bp, Homo sapiens
gagcacaaagaa

SEQ ID NO: 5666575 - DNA, 16 bp, Homo sapiens
gagcacaaagaccctg

SEQ ID NO: 5666576 - DNA, 13 bp, Homo sapiens
gagcacaaagata

SEQ ID NO: 5666577 - DNA, 18 bp, Homo sapiens
gagcacaacccccagctc

SEQ ID NO: 5666578 - DNA, 18 bp, Homo sapiens
gagcacaagaaggccagc

SEQ ID NO: 5666579 - DNA, 14 bp, Homo sapiens
gagcacaaggcctt

SEQ ID NO: 5666580 - DNA, 15 bp, Homo sapiens
gagcacaaggcctta

SEQ ID NO: 5666581 - DNA, 18 bp, Homo sapiens
gagcacaatattaagtgt

SEQ ID NO: 5666582 - DNA, 14 bp, Homo sapiens
gagcacacaacagg

SEQ ID NO: 5666583 - DNA, 22 bp, Homo sapiens
gagcacacaggtacagcaacag

SEQ ID NO: 5666584 - DNA, 24 bp, Homo sapiens
gagcacacatccaagagggactcc

SEQ ID NO: 5666585 - DNA, 15 bp, Homo sapiens
gagcacacccagccc

SEQ ID NO: 5666586 - DNA, 16 bp, Homo sapiens
gagcacacccagcccc

SEQ ID NO: 5666587 - DNA, 18 bp, Homo sapiens
gagcacacccgtgtgcac

SEQ ID NO: 5666588 - DNA, 21 bp, Homo sapiens
gagcacacggccctgccccat

SEQ ID NO: 5666589 - DNA, 23 bp, Homo sapiens
gagcacacggccctgccccatcc

SEQ ID NO: 5666590 - DNA, 13 bp, Homo sapiens
gagcacagagccc

SEQ ID NO: 5666591 - DNA, 19 bp, Homo sapiens
gagcacagccaatctccag

SEQ ID NO: 5666592 - DNA, 12 bp, Homo sapiens
gagcacagccat

SEQ ID NO: 5666593 - DNA, 24 bp, Homo sapiens
gagcacagcccacggggatcacag

SEQ ID NO: 5666594 - DNA, 13 bp, Homo sapiens
gagcacagccctc

SEQ ID NO: 5666595 - DNA, 14 bp, Homo sapiens
gagcacagccctgg

SEQ ID NO: 5666596 - DNA, 16 bp, Homo sapiens
gagcacagccctggga

SEQ ID NO: 5666597 - DNA, 19 bp, Homo sapiens
gagcacagccctgggaggg

SEQ ID NO: 5666598 - DNA, 16 bp, Homo sapiens
gagcacagcctcactc

SEQ ID NO: 5666599 - DNA, 13 bp, Homo sapiens
gagcacaggtccc

SEQ ID NO: 5666600 - DNA, 16 bp, Homo sapiens
gagcacaggtcccacc

SEQ ID NO: 5666601 - DNA, 22 bp, Homo sapiens
gagcacaggtcccacctccagc

SEQ ID NO: 5666602 - DNA, 17 bp, Homo sapiens
gagcacagtcaggggct

SEQ ID NO: 5666603 - DNA, 18 bp, Homo sapiens
gagcacagtcaggggctg

SEQ ID NO: 5666604 - DNA, 20 bp, Homo sapiens
gagcacatactacctagaag

SEQ ID NO: 5666605 - DNA, 21 bp, Homo sapiens
gagcacatactacctagaagt

SEQ ID NO: 5666606 - DNA, 18 bp, Homo sapiens
gagcacatagagcttttt

SEQ ID NO: 5666607 - DNA, 17 bp, Homo sapiens
gagcacatctctctgcc

SEQ ID NO: 5666608 - DNA, 19 bp, Homo sapiens
gagcacatctctctgccct

SEQ ID NO: 5666609 - DNA, 23 bp, Homo sapiens
gagcacatctctctgccctctcc

SEQ ID NO: 5666610 - DNA, 21 bp, Homo sapiens
gagcacattcttaaaggaaaa

SEQ ID NO: 5666611 - DNA, 16 bp, Homo sapiens
gagcaccaccagggct

SEQ ID NO: 5666612 - DNA, 16 bp, Homo sapiens
gagcaccacggccaga

SEQ ID NO: 5666613 - DNA, 15 bp, Homo sapiens
gagcaccacggggtc

SEQ ID NO: 5666614 - DNA, 17 bp, Homo sapiens
gagcacccagagcaccc

SEQ ID NO: 5666615 - DNA, 18 bp, Homo sapiens
gagcacccccaagcctgg

SEQ ID NO: 5666616 - DNA, 16 bp, Homo sapiens
gagcacccccagcctc

SEQ ID NO: 5666617 - DNA, 18 bp, Homo sapiens
gagcacccccagcctccc

SEQ ID NO: 5666618 - DNA, 19 bp, Homo sapiens
gagcacccccagcctcccc

SEQ ID NO: 5666619 - DNA, 20 bp, Homo sapiens
gagcacccccagcctccccc

SEQ ID NO: 5666620 - DNA, 22 bp, Homo sapiens
gagcacccccagcctcccccag

SEQ ID NO: 5666621 - DNA, 14 bp, Homo sapiens
gagcaccccctgct

SEQ ID NO: 5666622 - DNA, 16 bp, Homo sapiens
gagcaccccctgctcc

SEQ ID NO: 5666623 - DNA, 17 bp, Homo sapiens
gagcaccccctgctcca

SEQ ID NO: 5666624 - DNA, 21 bp, Homo sapiens
gagcacccctctctgcatctg

SEQ ID NO: 5666625 - DNA, 13 bp, Homo sapiens
gagcaccctctcc

SEQ ID NO: 5666626 - DNA, 13 bp, Homo sapiens
gagcaccctgagg

SEQ ID NO: 5666627 - DNA, 15 bp, Homo sapiens
gagcaccctgagggc

SEQ ID NO: 5666628 - DNA, 15 bp, Homo sapiens
gagcaccgaggccag

SEQ ID NO: 5666629 - DNA, 23 bp, Homo sapiens
gagcaccgtgtcgggcaggtcag

SEQ ID NO: 5666630 - DNA, 12 bp, Homo sapiens
gagcacctcacc

SEQ ID NO: 5666631 - DNA, 14 bp, Homo sapiens
gagcacctccacat

SEQ ID NO: 5666632 - DNA, 16 bp, Homo sapiens
gagcacctctcagagc

SEQ ID NO: 5666633 - DNA, 22 bp, Homo sapiens
gagcacctctcagagcaagcct

SEQ ID NO: 5666634 - DNA, 13 bp, Homo sapiens
gagcacctgaacc

SEQ ID NO: 5666635 - DNA, 20 bp, Homo sapiens
gagcacctgaaccccatggg

SEQ ID NO: 5666636 - DNA, 23 bp, Homo sapiens
gagcacctgaaccccatgggctt

SEQ ID NO: 5666637 - DNA, 14 bp, Homo sapiens
gagcacctggaccc

SEQ ID NO: 5666638 - DNA, 21 bp, Homo sapiens
gagcacctggaccccctgccc

SEQ ID NO: 5666639 - DNA, 13 bp, Homo sapiens
gagcacctgtctg

SEQ ID NO: 5666640 - DNA, 23 bp, Homo sapiens
gagcaccttaatattattggggt

SEQ ID NO: 5666641 - DNA, 20 bp, Homo sapiens
gagcaccttagacagtccct

SEQ ID NO: 5666642 - DNA, 14 bp, Homo sapiens
gagcacctttggaa

SEQ ID NO: 5666643 - DNA, 15 bp, Homo sapiens
gagcacgcctgccat

SEQ ID NO: 5666644 - DNA, 16 bp, Homo sapiens
gagcacgcctgccatc

SEQ ID NO: 5666645 - DNA, 22 bp, Homo sapiens
gagcacgcctgccatcttctcc

SEQ ID NO: 5666646 - DNA, 13 bp, Homo sapiens
gagcacggactct

SEQ ID NO: 5666647 - DNA, 20 bp, Homo sapiens
gagcacggccaacaaagctg

SEQ ID NO: 5666648 - DNA, 23 bp, Homo sapiens
gagcacggctctgtccccagcct

SEQ ID NO: 5666649 - DNA, 19 bp, Homo sapiens
gagcacgggcaaagaaaac

SEQ ID NO: 5666650 - DNA, 20 bp, Homo sapiens
gagcacgggcaaagaaaaca

SEQ ID NO: 5666651 - DNA, 21 bp, Homo sapiens
gagcacgttggcgaggaaaaa

SEQ ID NO: 5666652 - DNA, 17 bp, Homo sapiens
gagcactagaatgagaa

SEQ ID NO: 5666653 - DNA, 22 bp, Homo sapiens
gagcactagaatgagaaatcat

SEQ ID NO: 5666654 - DNA, 15 bp, Homo sapiens
gagcactctggggtg

SEQ ID NO: 5666655 - DNA, 21 bp, Homo sapiens
gagcactctggggtgggaggg

SEQ ID NO: 5666656 - DNA, 22 bp, Homo sapiens
gagcactctggggtgggagggt

SEQ ID NO: 5666657 - DNA, 12 bp, Homo sapiens
gagcactgccag

SEQ ID NO: 5666658 - DNA, 15 bp, Homo sapiens
gagcactgccaggag

SEQ ID NO: 5666659 - DNA, 19 bp, Homo sapiens
gagcactgccaggagggac

SEQ ID NO: 5666660 - DNA, 13 bp, Homo sapiens
gagcactgcctct

SEQ ID NO: 5666661 - DNA, 19 bp, Homo sapiens
gagcactgcgcgctatccc

SEQ ID NO: 5666662 - DNA, 16 bp, Homo sapiens
gagcactggactccgg

SEQ ID NO: 5666663 - DNA, 18 bp, Homo sapiens
gagcactggaggcctctg

SEQ ID NO: 5666664 - DNA, 12 bp, Homo sapiens
gagcactggcca

SEQ ID NO: 5666665 - DNA, 16 bp, Homo sapiens
gagcactggccagaga

SEQ ID NO: 5666666 - DNA, 24 bp, Homo sapiens
gagcactggccagagagggcccag

SEQ ID NO: 5666667 - DNA, 17 bp, Homo sapiens
gagcactggggtggggg

SEQ ID NO: 5666668 - DNA, 20 bp, Homo sapiens
gagcactgggtcatatggaa

SEQ ID NO: 5666669 - DNA, 16 bp, Homo sapiens
gagcactgtatacccc

SEQ ID NO: 5666670 - DNA, 13 bp, Homo sapiens
gagcactgtgcag

SEQ ID NO: 5666671 - DNA, 18 bp, Homo sapiens
gagcactgtgcagccggg

SEQ ID NO: 5666672 - DNA, 12 bp, Homo sapiens
gagcactgttca

SEQ ID NO: 5666673 - DNA, 19 bp, Homo sapiens
gagcactgttctgggactc

SEQ ID NO: 5666674 - DNA, 15 bp, Homo sapiens
gagcacttaagagaa

SEQ ID NO: 5666675 - DNA, 15 bp, Homo sapiens
gagcacttactgtaa

SEQ ID NO: 5666676 - DNA, 14 bp, Homo sapiens
gagcacttagcagg

SEQ ID NO: 5666677 - DNA, 18 bp, Homo sapiens
gagcacttgagctgtctg

SEQ ID NO: 5666678 - DNA, 16 bp, Homo sapiens
gagcacttgcgtcctg

SEQ ID NO: 5666679 - DNA, 19 bp, Homo sapiens
gagcacttgttttaaaatg

SEQ ID NO: 5666680 - DNA, 12 bp, Homo sapiens
gagcactttagc

SEQ ID NO: 5666681 - DNA, 19 bp, Homo sapiens
gagcactttagcagatgtg

SEQ ID NO: 5666682 - DNA, 16 bp, Homo sapiens
gagcagaaagccaggg

SEQ ID NO: 5666683 - DNA, 20 bp, Homo sapiens
gagcagaaagccagggtcct

SEQ ID NO: 5666684 - DNA, 12 bp, Homo sapiens
gagcagaaataa

SEQ ID NO: 5666685 - DNA, 14 bp, Homo sapiens
gagcagaaattctg

SEQ ID NO: 5666686 - DNA, 17 bp, Homo sapiens
gagcagaaattctgttt

SEQ ID NO: 5666687 - DNA, 15 bp, Homo sapiens
gagcagaacaggtag

SEQ ID NO: 5666688 - DNA, 16 bp, Homo sapiens
gagcagaacaggtagt

SEQ ID NO: 5666689 - DNA, 14 bp, Homo sapiens
gagcagaagcagca

SEQ ID NO: 5666690 - DNA, 16 bp, Homo sapiens
gagcagaagcagcaac

SEQ ID NO: 5666691 - DNA, 13 bp, Homo sapiens
gagcagaaggcag

SEQ ID NO: 5666692 - DNA, 15 bp, Homo sapiens
gagcagaaggcagga

SEQ ID NO: 5666693 - DNA, 20 bp, Homo sapiens
gagcagacacccttggagct

SEQ ID NO: 5666694 - DNA, 14 bp, Homo sapiens
gagcagacagagaa

SEQ ID NO: 5666695 - DNA, 15 bp, Homo sapiens
gagcagacaggagga

SEQ ID NO: 5666696 - DNA, 14 bp, Homo sapiens
gagcagacagggcg

SEQ ID NO: 5666697 - DNA, 15 bp, Homo sapiens
gagcagagaacctgc

SEQ ID NO: 5666698 - DNA, 17 bp, Homo sapiens
gagcagagaaggccagg

SEQ ID NO: 5666699 - DNA, 16 bp, Homo sapiens
gagcagagaattctct

SEQ ID NO: 5666700 - DNA, 12 bp, Homo sapiens
gagcagagacac

SEQ ID NO: 5666701 - DNA, 16 bp, Homo sapiens
gagcagagaccatccc

SEQ ID NO: 5666702 - DNA, 17 bp, Homo sapiens
gagcagagaccatccct

SEQ ID NO: 5666703 - DNA, 19 bp, Homo sapiens
gagcagagaccatccctga

SEQ ID NO: 5666704 - DNA, 21 bp, Homo sapiens
gagcagagaccatccctgaag

SEQ ID NO: 5666705 - DNA, 11 bp, Homo sapiens
gagcagagacg

SEQ ID NO: 5666706 - DNA, 12 bp, Homo sapiens
gagcagagagag

SEQ ID NO: 5666707 - DNA, 13 bp, Homo sapiens
gcctcgaggcacc

SEQ ID NO: 5666708 - DNA, 22 bp, Homo sapiens
gcctcgaggcaccggcgctgca

SEQ ID NO: 5666709 - DNA, 23 bp, Homo sapiens
gcctcgaggcaccggcgctgcag

SEQ ID NO: 5666710 - DNA, 18 bp, Homo sapiens
gcctcgagggccgcctgc

SEQ ID NO: 5666711 - DNA, 22 bp, Homo sapiens
gcctcgagggccgcctgcctta

SEQ ID NO: 5666712 - DNA, 16 bp, Homo sapiens
gcctcgaggggcccag

SEQ ID NO: 5666713 - DNA, 23 bp, Homo sapiens
gcctcgaggtgccttcttcaggg

SEQ ID NO: 5666714 - DNA, 19 bp, Homo sapiens
gcctcgagtccccccaccc

SEQ ID NO: 5666715 - DNA, 20 bp, Homo sapiens
gcctcgcacttgcagaggag

SEQ ID NO: 5666716 - DNA, 20 bp, Homo sapiens
gcctcgcatgccagagcctg

SEQ ID NO: 5666717 - DNA, 16 bp, Homo sapiens
gcctcgcccatcccct

SEQ ID NO: 5666718 - DNA, 18 bp, Homo sapiens
gcctcgccccagccaagc

SEQ ID NO: 5666719 - DNA, 23 bp, Homo sapiens
gcctcgccccagccaagcctgac

SEQ ID NO: 5666720 - DNA, 17 bp, Homo sapiens
gcctcgcccccactttt

SEQ ID NO: 5666721 - DNA, 16 bp, Homo sapiens
gcctcgcccccgggcc

SEQ ID NO: 5666722 - DNA, 18 bp, Homo sapiens
gcctcgcccccgggccct

SEQ ID NO: 5666723 - DNA, 13 bp, Homo sapiens
gcctcgcccctcc

SEQ ID NO: 5666724 - DNA, 19 bp, Homo sapiens
gcctcgcccctccagtgtt

SEQ ID NO: 5666725 - DNA, 16 bp, Homo sapiens
gcctcgcccctggcag

SEQ ID NO: 5666726 - DNA, 18 bp, Homo sapiens
gcctcgcccctggcagag

SEQ ID NO: 5666727 - DNA, 15 bp, Homo sapiens
gcctcgcctgccctc

SEQ ID NO: 5666728 - DNA, 14 bp, Homo sapiens
gcctcgcctggcct

SEQ ID NO: 5666729 - DNA, 15 bp, Homo sapiens
gcctcgcctggcctg

SEQ ID NO: 5666730 - DNA, 19 bp, Homo sapiens
gcctcgcctgggcccaggc

SEQ ID NO: 5666731 - DNA, 23 bp, Homo sapiens
gcctcgcctgggcccaggctctg

SEQ ID NO: 5666732 - DNA, 17 bp, Homo sapiens
gcctcgcctgtcacccc

SEQ ID NO: 5666733 - DNA, 16 bp, Homo sapiens
gcctcgccttgtgtta

SEQ ID NO: 5666734 - DNA, 19 bp, Homo sapiens
gcctcgctcagtcagtgca

SEQ ID NO: 5666735 - DNA, 14 bp, Homo sapiens
gcctcggacagtcc

SEQ ID NO: 5666736 - DNA, 13 bp, Homo sapiens
gcctcggacttag

SEQ ID NO: 5666737 - DNA, 20 bp, Homo sapiens
gcctcggacttagctgggag

SEQ ID NO: 5666738 - DNA, 14 bp, Homo sapiens
gcctcggagcctca

SEQ ID NO: 5666739 - DNA, 15 bp, Homo sapiens
gcctcggagcctcat

SEQ ID NO: 5666740 - DNA, 17 bp, Homo sapiens
gcctcggaggctcctcc

SEQ ID NO: 5666741 - DNA, 22 bp, Homo sapiens
gcctcggatccccttcctacca

SEQ ID NO: 5666742 - DNA, 22 bp, Homo sapiens
gcctcggcctcccaaagtgctg

SEQ ID NO: 5666743 - DNA, 22 bp, Homo sapiens
gcctcggcctggctggccagga

SEQ ID NO: 5666744 - DNA, 15 bp, Homo sapiens
gcctcggcctggctt

SEQ ID NO: 5666745 - DNA, 14 bp, Homo sapiens
gcctcggcgggctt

SEQ ID NO: 5666746 - DNA, 16 bp, Homo sapiens
gcctcggctcctgctg

SEQ ID NO: 5666747 - DNA, 15 bp, Homo sapiens
gcctcggctgtctcc

SEQ ID NO: 5666748 - DNA, 17 bp, Homo sapiens
gcctcgggccgcctcct

SEQ ID NO: 5666749 - DNA, 22 bp, Homo sapiens
gcctcgggccgcctcctccaga

SEQ ID NO: 5666750 - DNA, 15 bp, Homo sapiens
gcctcggggcagggc

SEQ ID NO: 5666751 - DNA, 15 bp, Homo sapiens
gcctcggtatctggc

SEQ ID NO: 5666752 - DNA, 23 bp, Homo sapiens
gcctcggtatctggcttccctgg

SEQ ID NO: 5666753 - DNA, 18 bp, Homo sapiens
gcctcggtggccatgctt

SEQ ID NO: 5666754 - DNA, 19 bp, Homo sapiens
gcctcggtggccatgcttc

SEQ ID NO: 5666755 - DNA, 20 bp, Homo sapiens
gcctcggtggccatgcttct

SEQ ID NO: 5666756 - DNA, 21 bp, Homo sapiens
gcctcggtggccatgcttctt

SEQ ID NO: 5666757 - DNA, 20 bp, Homo sapiens
gcctcggttgattgtgcatg

SEQ ID NO: 5666758 - DNA, 14 bp, Homo sapiens
gcctcgtaccagcc

SEQ ID NO: 5666759 - DNA, 18 bp, Homo sapiens
gcctcgtaccagccagga

SEQ ID NO: 5666760 - DNA, 21 bp, Homo sapiens
gcctcgtccaaggcagttctg

SEQ ID NO: 5666761 - DNA, 15 bp, Homo sapiens
gcctcgtccctccct

SEQ ID NO: 5666762 - DNA, 18 bp, Homo sapiens
gcctcgtctttcagcgag

SEQ ID NO: 5666763 - DNA, 12 bp, Homo sapiens
gcctcgtgccag

SEQ ID NO: 5666764 - DNA, 17 bp, Homo sapiens
gcctcgtgccagcagcc

SEQ ID NO: 5666765 - DNA, 13 bp, Homo sapiens
gcctcgtgccatg

SEQ ID NO: 5666766 - DNA, 14 bp, Homo sapiens
gcctcgtgctggcg

SEQ ID NO: 5666767 - DNA, 23 bp, Homo sapiens
gcctcgtggagctcgcccctccc

SEQ ID NO: 5666768 - DNA, 14 bp, Homo sapiens
gcctcgtgtccaga

SEQ ID NO: 5666769 - DNA, 14 bp, Homo sapiens
gcctcgtgtcctgc

SEQ ID NO: 5666770 - DNA, 18 bp, Homo sapiens
gcctcgtgtcctgctagc

SEQ ID NO: 5666771 - DNA, 15 bp, Homo sapiens
gcctcgttggagagc

SEQ ID NO: 5666772 - DNA, 16 bp, Homo sapiens
gcctcgttggagagca

SEQ ID NO: 5666773 - DNA, 17 bp, Homo sapiens
gcctctaactccctcct

SEQ ID NO: 5666774 - DNA, 18 bp, Homo sapiens
gcctctaagagtgcccgt

SEQ ID NO: 5666775 - DNA, 21 bp, Homo sapiens
gcctctaaggccaaggcctca

SEQ ID NO: 5666776 - DNA, 22 bp, Homo sapiens
gcctctaaggccaaggcctcag

SEQ ID NO: 5666777 - DNA, 14 bp, Homo sapiens
gcctctacacaggg

SEQ ID NO: 5666778 - DNA, 20 bp, Homo sapiens
gcctctacacaggggccctg

SEQ ID NO: 5666779 - DNA, 21 bp, Homo sapiens
gcctctacacaggggccctgt

SEQ ID NO: 5666780 - DNA, 18 bp, Homo sapiens
gcctctaccagttggcag

SEQ ID NO: 5666781 - DNA, 22 bp, Homo sapiens
gcctctaccagttggcagacag

SEQ ID NO: 5666782 - DNA, 16 bp, Homo sapiens
gcctctacccaaccag

SEQ ID NO: 5666783 - DNA, 20 bp, Homo sapiens
gcctctactaggtctgctcc

SEQ ID NO: 5666784 - DNA, 21 bp, Homo sapiens
gcctctactaggtctgctcct

SEQ ID NO: 5666785 - DNA, 15 bp, Homo sapiens
gcctctactgggaag

SEQ ID NO: 5666786 - DNA, 18 bp, Homo sapiens
gcctctactgggaaggct

SEQ ID NO: 5666787 - DNA, 24 bp, Homo sapiens
gcctctactttgtcccctcacctc

SEQ ID NO: 5666788 - DNA, 22 bp, Homo sapiens
gcctctagagcagactacagct

SEQ ID NO: 5666789 - DNA, 13 bp, Homo sapiens
gcctctagggacc

SEQ ID NO: 5666790 - DNA, 17 bp, Homo sapiens
gcctctagggacccctc

SEQ ID NO: 5666791 - DNA, 18 bp, Homo sapiens
gcctctagggacccctcc

SEQ ID NO: 5666792 - DNA, 18 bp, Homo sapiens
gcctctaggtaaccagtt

SEQ ID NO: 5666793 - DNA, 21 bp, Homo sapiens
gcctctagtccccaaggcctc

SEQ ID NO: 5666794 - DNA, 15 bp, Homo sapiens
gcctctagtgtacca

SEQ ID NO: 5666795 - DNA, 20 bp, Homo sapiens
gcctctagtgtaccaagtgc

SEQ ID NO: 5666796 - DNA, 20 bp, Homo sapiens
gcctctatccctggccacct

SEQ ID NO: 5666797 - DNA, 15 bp, Homo sapiens
gcctctatgccctgc

SEQ ID NO: 5666798 - DNA, 19 bp, Homo sapiens
gcctctatgccctgcagag

SEQ ID NO: 5666799 - DNA, 17 bp, Homo sapiens
gcctctcacaggcgcct

SEQ ID NO: 5666800 - DNA, 23 bp, Homo sapiens
gcctctcaccccacttcccatct

SEQ ID NO: 5666801 - DNA, 23 bp, Homo sapiens
gcctctcactctggcagcctcag

SEQ ID NO: 5666802 - DNA, 14 bp, Homo sapiens
gcctctcagtcaaa

SEQ ID NO: 5666803 - DNA, 16 bp, Homo sapiens
gcctctcatcaactga

SEQ ID NO: 5666804 - DNA, 18 bp, Homo sapiens
gcctctcatcaactgaat

SEQ ID NO: 5666805 - DNA, 19 bp, Homo sapiens
gcctctcatcaactgaatg

SEQ ID NO: 5666806 - DNA, 17 bp, Homo sapiens
gcctctcatcccccatt

SEQ ID NO: 5666807 - DNA, 19 bp, Homo sapiens
gcctctcattccagaggaa

SEQ ID NO: 5666808 - DNA, 13 bp, Homo sapiens
ggcagccaggggc

SEQ ID NO: 5666809 - DNA, 14 bp, Homo sapiens
ggcagccagtgaga

SEQ ID NO: 5666810 - DNA, 15 bp, Homo sapiens
ggcagccagtgccct

SEQ ID NO: 5666811 - DNA, 20 bp, Homo sapiens
ggcagccagtgccctgagcc

SEQ ID NO: 5666812 - DNA, 11 bp, Homo sapiens
ggcagccatgc

SEQ ID NO: 5666813 - DNA, 14 bp, Homo sapiens
ggcagccatgcctc

SEQ ID NO: 5666814 - DNA, 16 bp, Homo sapiens
ggcagccatgcctcat

SEQ ID NO: 5666815 - DNA, 21 bp, Homo sapiens
ggcagccatgcctcatgccac

SEQ ID NO: 5666816 - DNA, 21 bp, Homo sapiens
ggcagcccactgcaccgcctc

SEQ ID NO: 5666817 - DNA, 15 bp, Homo sapiens
ggcagcccagagact

SEQ ID NO: 5666818 - DNA, 16 bp, Homo sapiens
ggcagcccagagagac

SEQ ID NO: 5666819 - DNA, 13 bp, Homo sapiens
ggcagcccagcca

SEQ ID NO: 5666820 - DNA, 22 bp, Homo sapiens
ggcagcccagcctctgtccctc

SEQ ID NO: 5666821 - DNA, 11 bp, Homo sapiens
ggcagcccagg

SEQ ID NO: 5666822 - DNA, 13 bp, Homo sapiens
ggcagcccatggg

SEQ ID NO: 5666823 - DNA, 14 bp, Homo sapiens
ggcagccccaggcc

SEQ ID NO: 5666824 - DNA, 13 bp, Homo sapiens
ggcagccccatcc

SEQ ID NO: 5666825 - DNA, 23 bp, Homo sapiens
ggcagccccatccttcccgcagc

SEQ ID NO: 5666826 - DNA, 21 bp, Homo sapiens
ggcagccccattctgcctgcc

SEQ ID NO: 5666827 - DNA, 23 bp, Homo sapiens
ggcagcccccatgggctcctgcc

SEQ ID NO: 5666828 - DNA, 22 bp, Homo sapiens
ggcagccccgacccctgtccag

SEQ ID NO: 5666829 - DNA, 18 bp, Homo sapiens
ggcagccccgttttgggg

SEQ ID NO: 5666830 - DNA, 17 bp, Homo sapiens
ggcagcccctcccagcc

SEQ ID NO: 5666831 - DNA, 14 bp, Homo sapiens
ggcagcccctgcag

SEQ ID NO: 5666832 - DNA, 19 bp, Homo sapiens
ggcagcccctgctggacca

SEQ ID NO: 5666833 - DNA, 22 bp, Homo sapiens
ggcagcccctgttctggcagag

SEQ ID NO: 5666834 - DNA, 20 bp, Homo sapiens
ggcagccccttctggccggt

SEQ ID NO: 5666835 - DNA, 14 bp, Homo sapiens
ggcagcccggctgc

SEQ ID NO: 5666836 - DNA, 16 bp, Homo sapiens
ggcagcccggctgctg

SEQ ID NO: 5666837 - DNA, 20 bp, Homo sapiens
ggcagcccggctgctgcttg

SEQ ID NO: 5666838 - DNA, 13 bp, Homo sapiens
ggcagccctcacc

SEQ ID NO: 5666839 - DNA, 18 bp, Homo sapiens
ggcagccctcacctctga

SEQ ID NO: 5666840 - DNA, 22 bp, Homo sapiens
ggcagccctcacctctgaggac

SEQ ID NO: 5666841 - DNA, 17 bp, Homo sapiens
ggcagccctccacttct

SEQ ID NO: 5666842 - DNA, 21 bp, Homo sapiens
ggcagcccttgcttgttggga

SEQ ID NO: 5666843 - DNA, 20 bp, Homo sapiens
ggcagccgaggcctggccaa

SEQ ID NO: 5666844 - DNA, 23 bp, Homo sapiens
ggcagccgctaggagagactgaa

SEQ ID NO: 5666845 - DNA, 18 bp, Homo sapiens
ggcagccgtcccaggcca

SEQ ID NO: 5666846 - DNA, 21 bp, Homo sapiens
ggcagccgtccttctaatgaa

SEQ ID NO: 5666847 - DNA, 23 bp, Homo sapiens
ggcagcctagcctatgtctggca

SEQ ID NO: 5666848 - DNA, 22 bp, Homo sapiens
ggcagcctatgggggctctcgg

SEQ ID NO: 5666849 - DNA, 11 bp, Homo sapiens
ggcagcctcaa

SEQ ID NO: 5666850 - DNA, 15 bp, Homo sapiens
ggcagcctccagagc

SEQ ID NO: 5666851 - DNA, 21 bp, Homo sapiens
ggcagcctccagagccagcct

SEQ ID NO: 5666852 - DNA, 18 bp, Homo sapiens
ggcagcctccagtctgct

SEQ ID NO: 5666853 - DNA, 19 bp, Homo sapiens
ggcagcctccagtctgctc

SEQ ID NO: 5666854 - DNA, 14 bp, Homo sapiens
ggcagcctcccatc

SEQ ID NO: 5666855 - DNA, 21 bp, Homo sapiens
ggcagcctcccatccagggcc

SEQ ID NO: 5666856 - DNA, 17 bp, Homo sapiens
ggcagcctccttgcctg

SEQ ID NO: 5666857 - DNA, 20 bp, Homo sapiens
ggcagcctctggggggtggc

SEQ ID NO: 5666858 - DNA, 23 bp, Homo sapiens
ggcagcctctggggggtggccag

SEQ ID NO: 5666859 - DNA, 12 bp, Homo sapiens
ggcagcctctgt

SEQ ID NO: 5666860 - DNA, 20 bp, Homo sapiens
ggcagcctctgtcaggcctt

SEQ ID NO: 5666861 - DNA, 15 bp, Homo sapiens
ggcagcctgagagct

SEQ ID NO: 5666862 - DNA, 19 bp, Homo sapiens
ggcagcctgagagctggcc

SEQ ID NO: 5666863 - DNA, 20 bp, Homo sapiens
ggcagcctgagagctggccc

SEQ ID NO: 5666864 - DNA, 21 bp, Homo sapiens
ggcagcctgagagctggccca

SEQ ID NO: 5666865 - DNA, 14 bp, Homo sapiens
ggcagcctgcacct

SEQ ID NO: 5666866 - DNA, 15 bp, Homo sapiens
ggcagcctgcagacc

SEQ ID NO: 5666867 - DNA, 11 bp, Homo sapiens
ggcagcctgcc

SEQ ID NO: 5666868 - DNA, 14 bp, Homo sapiens
ggcagcctgcctgg

SEQ ID NO: 5666869 - DNA, 19 bp, Homo sapiens
ggcagcctgccttgcccac

SEQ ID NO: 5666870 - DNA, 16 bp, Homo sapiens
ggcagcctgcgtggct

SEQ ID NO: 5666871 - DNA, 11 bp, Homo sapiens
ggcagcctgga

SEQ ID NO: 5666872 - DNA, 14 bp, Homo sapiens
ggcagcctggctcc

SEQ ID NO: 5666873 - DNA, 17 bp, Homo sapiens
ggcagcctgggcctggg

SEQ ID NO: 5666874 - DNA, 11 bp, Homo sapiens
ggcagcctgtg

SEQ ID NO: 5666875 - DNA, 12 bp, Homo sapiens
ggcagcctgtgg

SEQ ID NO: 5666876 - DNA, 14 bp, Homo sapiens
ggcagcctgtggga

SEQ ID NO: 5666877 - DNA, 16 bp, Homo sapiens
ggcagcctgtgggaga

SEQ ID NO: 5666878 - DNA, 14 bp, Homo sapiens
ggcagccttgtgat

SEQ ID NO: 5666879 - DNA, 14 bp, Homo sapiens
ggcagcctttccag

SEQ ID NO: 5666880 - DNA, 13 bp, Homo sapiens
ggcagcgacccca

SEQ ID NO: 5666881 - DNA, 15 bp, Homo sapiens
ggcagcgaccccagg

SEQ ID NO: 5666882 - DNA, 20 bp, Homo sapiens
ggcagcgcagggctggcacg

SEQ ID NO: 5666883 - DNA, 18 bp, Homo sapiens
ggcagcgccaagcaacct

SEQ ID NO: 5666884 - DNA, 14 bp, Homo sapiens
gcctcttgcccgtc

SEQ ID NO: 5666885 - DNA, 21 bp, Homo sapiens
gcctcttgcccgtcggccctg

SEQ ID NO: 5666886 - DNA, 20 bp, Homo sapiens
gcctcttgcggtcccttctt

SEQ ID NO: 5666887 - DNA, 16 bp, Homo sapiens
gcctcttgctgaaagc

SEQ ID NO: 5666888 - DNA, 16 bp, Homo sapiens
gcctcttgctggtgca

SEQ ID NO: 5666889 - DNA, 18 bp, Homo sapiens
gcctcttggaaaaagtga

SEQ ID NO: 5666890 - DNA, 14 bp, Homo sapiens
gcctcttggaaatc

SEQ ID NO: 5666891 - DNA, 17 bp, Homo sapiens
gcctcttggacctctgc

SEQ ID NO: 5666892 - DNA, 18 bp, Homo sapiens
gcctcttggacctctgct

SEQ ID NO: 5666893 - DNA, 14 bp, Homo sapiens
gcctcttggcacct

SEQ ID NO: 5666894 - DNA, 15 bp, Homo sapiens
gcctcttggcacctg

SEQ ID NO: 5666895 - DNA, 18 bp, Homo sapiens
gcctcttggcacctgcct

SEQ ID NO: 5666896 - DNA, 21 bp, Homo sapiens
gcctcttggcacctgcctagc

SEQ ID NO: 5666897 - DNA, 17 bp, Homo sapiens
gcctcttggcagccctt

SEQ ID NO: 5666898 - DNA, 24 bp, Homo sapiens
gcctcttggctatttctgtgtcca

SEQ ID NO: 5666899 - DNA, 13 bp, Homo sapiens
gcctcttggcttc

SEQ ID NO: 5666900 - DNA, 22 bp, Homo sapiens
gcctcttggcttctcagcccct

SEQ ID NO: 5666901 - DNA, 14 bp, Homo sapiens
gcctcttgggagac

SEQ ID NO: 5666902 - DNA, 16 bp, Homo sapiens
gcctcttgtaaagact

SEQ ID NO: 5666903 - DNA, 19 bp, Homo sapiens
gcctcttgtagtcttggct

SEQ ID NO: 5666904 - DNA, 17 bp, Homo sapiens
gcctcttgtctgaggga

SEQ ID NO: 5666905 - DNA, 20 bp, Homo sapiens
gcctcttgtctgagggacat

SEQ ID NO: 5666906 - DNA, 12 bp, Homo sapiens
gcctcttgtctt

SEQ ID NO: 5666907 - DNA, 14 bp, Homo sapiens
gcctcttgtgctca

SEQ ID NO: 5666908 - DNA, 20 bp, Homo sapiens
gcctcttgtgctcacgctcc

SEQ ID NO: 5666909 - DNA, 16 bp, Homo sapiens
gcctcttgtgtaacta

SEQ ID NO: 5666910 - DNA, 16 bp, Homo sapiens
gcctcttgttgcagag

SEQ ID NO: 5666911 - DNA, 17 bp, Homo sapiens
gcctctttaaattatga

SEQ ID NO: 5666912 - DNA, 17 bp, Homo sapiens
gcctctttaacagcttt

SEQ ID NO: 5666913 - DNA, 23 bp, Homo sapiens
gcctctttcatccactagtgcaa

SEQ ID NO: 5666914 - DNA, 21 bp, Homo sapiens
gcctctttcctaacttccttt

SEQ ID NO: 5666915 - DNA, 20 bp, Homo sapiens
gcctctttctgtgcttctct

SEQ ID NO: 5666916 - DNA, 19 bp, Homo sapiens
gcctctttgtctaaaacaa

SEQ ID NO: 5666917 - DNA, 16 bp, Homo sapiens
gcctcttttacctgct

SEQ ID NO: 5666918 - DNA, 18 bp, Homo sapiens
gcctcttttccctctcta

SEQ ID NO: 5666919 - DNA, 18 bp, Homo sapiens
gcctcttttctctgtgct

SEQ ID NO: 5666920 - DNA, 17 bp, Homo sapiens
gcctctttttccttctt

SEQ ID NO: 5666921 - DNA, 21 bp, Homo sapiens
gcctctttttccttcttcagc

SEQ ID NO: 5666922 - DNA, 19 bp, Homo sapiens
gcctgaaacagccatgtcc

SEQ ID NO: 5666923 - DNA, 21 bp, Homo sapiens
gcctgaaacagcctctccaag

SEQ ID NO: 5666924 - DNA, 18 bp, Homo sapiens
gcctgaaacccatttact

SEQ ID NO: 5666925 - DNA, 22 bp, Homo sapiens
gcctgaaacccgccctcagggg

SEQ ID NO: 5666926 - DNA, 17 bp, Homo sapiens
gcctgaaactttgagga

SEQ ID NO: 5666927 - DNA, 22 bp, Homo sapiens
gcctgaaagatacaggggatca

SEQ ID NO: 5666928 - DNA, 16 bp, Homo sapiens
gcctgaaagctgggag

SEQ ID NO: 5666929 - DNA, 14 bp, Homo sapiens
gcctgaaaggagcc

SEQ ID NO: 5666930 - DNA, 23 bp, Homo sapiens
gcctgaaaggagcccttatctgt

SEQ ID NO: 5666931 - DNA, 18 bp, Homo sapiens
gcctgaaagtaatttcaa

SEQ ID NO: 5666932 - DNA, 16 bp, Homo sapiens
gcctgaaatcctggtt

SEQ ID NO: 5666933 - DNA, 20 bp, Homo sapiens
gcctgaaatgtttccaggca

SEQ ID NO: 5666934 - DNA, 14 bp, Homo sapiens
gcctgaacagatgt

SEQ ID NO: 5666935 - DNA, 14 bp, Homo sapiens
gcctgaaccacagc

SEQ ID NO: 5666936 - DNA, 14 bp, Homo sapiens
gcctgaacccaaga

SEQ ID NO: 5666937 - DNA, 19 bp, Homo sapiens
gcctgaaccccagggctgt

SEQ ID NO: 5666938 - DNA, 20 bp, Homo sapiens
gcctgaaccgttacaaaaga

SEQ ID NO: 5666939 - DNA, 21 bp, Homo sapiens
gcctgaacctggggtcatcga

SEQ ID NO: 5666940 - DNA, 15 bp, Homo sapiens
gcctgaaccttccat

SEQ ID NO: 5666941 - DNA, 14 bp, Homo sapiens
gcctgaactgagcc

SEQ ID NO: 5666942 - DNA, 18 bp, Homo sapiens
gcctgaagagaggaaact

SEQ ID NO: 5666943 - DNA, 23 bp, Homo sapiens
gcctgaagatcagagctgcagcc

SEQ ID NO: 5666944 - DNA, 18 bp, Homo sapiens
gcctgaagctggcctgga

SEQ ID NO: 5666945 - DNA, 20 bp, Homo sapiens
gcctgaagcttcggccgcgc

SEQ ID NO: 5666946 - DNA, 21 bp, Homo sapiens
gcctgaaggaggtgagagaag

SEQ ID NO: 5666947 - DNA, 14 bp, Homo sapiens
gcctgaaggcacag

SEQ ID NO: 5666948 - DNA, 15 bp, Homo sapiens
gcctgaaggcacagc

SEQ ID NO: 5666949 - DNA, 22 bp, Homo sapiens
gcctgaaggggcgtctgttccc

SEQ ID NO: 5666950 - DNA, 17 bp, Homo sapiens
gcctgaagtcacacagt

SEQ ID NO: 5666951 - DNA, 18 bp, Homo sapiens
gcctgaagtcacacagtg

SEQ ID NO: 5666952 - DNA, 20 bp, Homo sapiens
gcctgaataaaccaagacaa

SEQ ID NO: 5666953 - DNA, 12 bp, Homo sapiens
gcctgaataaag

SEQ ID NO: 5666954 - DNA, 22 bp, Homo sapiens
gcctgaatgcttataggtggcc

SEQ ID NO: 5666955 - DNA, 21 bp, Homo sapiens
gcctgacaacagcctgagaaa

SEQ ID NO: 5666956 - DNA, 20 bp, Homo sapiens
gcctgacaaccactggtctg

SEQ ID NO: 5666957 - DNA, 21 bp, Homo sapiens
gcctgacaaccactggtctgt

SEQ ID NO: 5666958 - DNA, 18 bp, Homo sapiens
gcctgacaaggccagcac

SEQ ID NO: 5666959 - DNA, 22 bp, Homo sapiens
gcctgacaattatgaaaaaatg

SEQ ID NO: 5666960 - DNA, 17 bp, Homo sapiens
gcctgacaattgcaaat

SEQ ID NO: 5666961 - DNA, 21 bp, Homo sapiens
gcctgacacaatggtagctct

SEQ ID NO: 5666962 - DNA, 21 bp, Homo sapiens
gcctgacaccacgctggagct

SEQ ID NO: 5666963 - DNA, 17 bp, Homo sapiens
gcctgacaccccctccc

SEQ ID NO: 5666964 - DNA, 16 bp, Homo sapiens
gcctgacactgagccc

SEQ ID NO: 5666965 - DNA, 15 bp, Homo sapiens
gcctgacagaaacca

SEQ ID NO: 5666966 - DNA, 17 bp, Homo sapiens
gcctgacagcatcctct

SEQ ID NO: 5666967 - DNA, 14 bp, Homo sapiens
gcctgacagccttc

SEQ ID NO: 5666968 - DNA, 15 bp, Homo sapiens
gcctgacagctctgt

SEQ ID NO: 5666969 - DNA, 12 bp, Homo sapiens
gcctgacaggct

SEQ ID NO: 5666970 - DNA, 13 bp, Homo sapiens
gcctgacaggctg

SEQ ID NO: 5666971 - DNA, 18 bp, Homo sapiens
gcctgacagtgtgggaca

SEQ ID NO: 5666972 - DNA, 22 bp, Homo sapiens
gcctgacagtgtgggacaggct

SEQ ID NO: 5666973 - DNA, 20 bp, Homo sapiens
gcctgacatggttgtcatca

SEQ ID NO: 5666974 - DNA, 15 bp, Homo sapiens
gcctgaccaaacagc

SEQ ID NO: 5666975 - DNA, 16 bp, Homo sapiens
gcctgaccccaggcag

SEQ ID NO: 5666976 - DNA, 20 bp, Homo sapiens
gcctgaccccttgctccctt

SEQ ID NO: 5666977 - DNA, 19 bp, Homo sapiens
gcctgacctccccctcctt

SEQ ID NO: 5666978 - DNA, 22 bp, Homo sapiens
gcctgacctccccctccttccc

SEQ ID NO: 5666979 - DNA, 17 bp, Homo sapiens
gcctgacctgagactgt

SEQ ID NO: 5666980 - DNA, 14 bp, Homo sapiens
gcctgacctgagag

SEQ ID NO: 5666981 - DNA, 15 bp, Homo sapiens
gcctgaccttccttc

SEQ ID NO: 5666982 - DNA, 13 bp, Homo sapiens
gcctgaccttgag

SEQ ID NO: 5666983 - DNA, 15 bp, Homo sapiens
gcctgacgctcagcc

SEQ ID NO: 5666984 - DNA, 22 bp, Homo sapiens
gcctgacgctcagccccaggcc

SEQ ID NO: 5666985 - DNA, 23 bp, Homo sapiens
gcctgacgctcagccccaggcca

SEQ ID NO: 5666986 - DNA, 21 bp, Homo sapiens
gcctgactaatttttgtattt

SEQ ID NO: 5666987 - DNA, 19 bp, Homo sapiens
gcctgactagaactcctgt

SEQ ID NO: 5666988 - DNA, 19 bp, Homo sapiens
gcctgactagggagccatg

SEQ ID NO: 5666989 - DNA, 23 bp, Homo sapiens
ggcagggccctggggtctctgag

SEQ ID NO: 5666990 - DNA, 17 bp, Homo sapiens
ggcagggccctgtggct

SEQ ID NO: 5666991 - DNA, 22 bp, Homo sapiens
ggcagggccctgtggctccagg

SEQ ID NO: 5666992 - DNA, 21 bp, Homo sapiens
ggcagggcccttggggctggg

SEQ ID NO: 5666993 - DNA, 22 bp, Homo sapiens
ggcagggcccttggggctgggg

SEQ ID NO: 5666994 - DNA, 16 bp, Homo sapiens
ggcagggccgcagggc

SEQ ID NO: 5666995 - DNA, 21 bp, Homo sapiens
ggcagggccgctcgatgcctt

SEQ ID NO: 5666996 - DNA, 15 bp, Homo sapiens
ggcagggcctcatct

SEQ ID NO: 5666997 - DNA, 14 bp, Homo sapiens
ggcagggcctggcc

SEQ ID NO: 5666998 - DNA, 16 bp, Homo sapiens
ggcagggcctggcctg

SEQ ID NO: 5666999 - DNA, 17 bp, Homo sapiens
ggcagggcctggctcca

SEQ ID NO: 5667000 - DNA, 17 bp, Homo sapiens
ggcagggcctgggcctc

SEQ ID NO: 5667001 - DNA, 15 bp, Homo sapiens
ggcagggccttcctg

SEQ ID NO: 5667002 - DNA, 21 bp, Homo sapiens
ggcagggccttgcccagagat

SEQ ID NO: 5667003 - DNA, 19 bp, Homo sapiens
ggcagggcgagctgcagga

SEQ ID NO: 5667004 - DNA, 21 bp, Homo sapiens
ggcagggcgggcagagggctg

SEQ ID NO: 5667005 - DNA, 17 bp, Homo sapiens
ggcagggctcacactcc

SEQ ID NO: 5667006 - DNA, 19 bp, Homo sapiens
ggcagggctcacactcctg

SEQ ID NO: 5667007 - DNA, 17 bp, Homo sapiens
ggcagggctcctccctg

SEQ ID NO: 5667008 - DNA, 14 bp, Homo sapiens
ggcagggctctccc

SEQ ID NO: 5667009 - DNA, 15 bp, Homo sapiens
ggcagggctctcccg

SEQ ID NO: 5667010 - DNA, 19 bp, Homo sapiens
ggcagggctctcctggctt

SEQ ID NO: 5667011 - DNA, 20 bp, Homo sapiens
ggcagggctctcctggcttc

SEQ ID NO: 5667012 - DNA, 10 bp, Homo sapiens
ggcagggctg

SEQ ID NO: 5667013 - DNA, 17 bp, Homo sapiens
ggcagggctgcagaggg

SEQ ID NO: 5667014 - DNA, 20 bp, Homo sapiens
ggcagggctggaatgggaga

SEQ ID NO: 5667015 - DNA, 11 bp, Homo sapiens
ggcagggctgt

SEQ ID NO: 5667016 - DNA, 20 bp, Homo sapiens
ggcagggctgttccctccag

SEQ ID NO: 5667017 - DNA, 23 bp, Homo sapiens
ggcagggctgttccctccaggca

SEQ ID NO: 5667018 - DNA, 22 bp, Homo sapiens
ggcaggggacaagggaggcagt

SEQ ID NO: 5667019 - DNA, 20 bp, Homo sapiens
ggcaggggaggccatctgga

SEQ ID NO: 5667020 - DNA, 17 bp, Homo sapiens
ggcaggggagtagtgga

SEQ ID NO: 5667021 - DNA, 16 bp, Homo sapiens
ggcaggggagtctgct

SEQ ID NO: 5667022 - DNA, 15 bp, Homo sapiens
ggcaggggcagtggc

SEQ ID NO: 5667023 - DNA, 14 bp, Homo sapiens
ggcaggggcctggg

SEQ ID NO: 5667024 - DNA, 16 bp, Homo sapiens
ggcaggggcctgggcc

SEQ ID NO: 5667025 - DNA, 11 bp, Homo sapiens
ggcaggggctc

SEQ ID NO: 5667026 - DNA, 22 bp, Homo sapiens
ggcaggggctgcatcctcagcc

SEQ ID NO: 5667027 - DNA, 13 bp, Homo sapiens
ggcaggggctggg

SEQ ID NO: 5667028 - DNA, 17 bp, Homo sapiens
ggcaggggctgggcaga

SEQ ID NO: 5667029 - DNA, 16 bp, Homo sapiens
ggcaggggcttggctg

SEQ ID NO: 5667030 - DNA, 22 bp, Homo sapiens
ggcagggggccccgccagggct

SEQ ID NO: 5667031 - DNA, 15 bp, Homo sapiens
ggcagggggccctgc

SEQ ID NO: 5667032 - DNA, 21 bp, Homo sapiens
ggcagggggccctgccccacc

SEQ ID NO: 5667033 - DNA, 23 bp, Homo sapiens
ggcagggggccctgccccacccc

SEQ ID NO: 5667034 - DNA, 15 bp, Homo sapiens
ggcagggggctgctg

SEQ ID NO: 5667035 - DNA, 17 bp, Homo sapiens
ggcagggggctgctgct

SEQ ID NO: 5667036 - DNA, 22 bp, Homo sapiens
ggcagggggctgctgctgggct

SEQ ID NO: 5667037 - DNA, 17 bp, Homo sapiens
ggcaggggggctgtggg

SEQ ID NO: 5667038 - DNA, 21 bp, Homo sapiens
ggcagggggtgaaggcaggag

SEQ ID NO: 5667039 - DNA, 19 bp, Homo sapiens
ggcagggggttctgggacc

SEQ ID NO: 5667040 - DNA, 16 bp, Homo sapiens
ggcaggggtcctgcag

SEQ ID NO: 5667041 - DNA, 22 bp, Homo sapiens
ggcaggggtcgcgatgatgggc

SEQ ID NO: 5667042 - DNA, 15 bp, Homo sapiens
ggcaggggtggagga

SEQ ID NO: 5667043 - DNA, 19 bp, Homo sapiens
ggcaggggttccagcttcc

SEQ ID NO: 5667044 - DNA, 12 bp, Homo sapiens
ggcagggtccta

SEQ ID NO: 5667045 - DNA, 19 bp, Homo sapiens
ggcagggtgtctgccccct

SEQ ID NO: 5667046 - DNA, 23 bp, Homo sapiens
ggcagggttaaactgcaggagca

SEQ ID NO: 5667047 - DNA, 18 bp, Homo sapiens
ggcagggttctagaaggg

SEQ ID NO: 5667048 - DNA, 20 bp, Homo sapiens
ggcagggttttatctctgtc

SEQ ID NO: 5667049 - DNA, 18 bp, Homo sapiens
ggcaggtagggggtccct

SEQ ID NO: 5667050 - DNA, 21 bp, Homo sapiens
ggcaggtatgatcggcaggac

SEQ ID NO: 5667051 - DNA, 17 bp, Homo sapiens
ggcaggtcacagaaagg

SEQ ID NO: 5667052 - DNA, 20 bp, Homo sapiens
ggcaggtcactgtcactgcc

SEQ ID NO: 5667053 - DNA, 21 bp, Homo sapiens
ggcaggtcatggagcagcccc

SEQ ID NO: 5667054 - DNA, 17 bp, Homo sapiens
ggcaggtccagctctgt

SEQ ID NO: 5667055 - DNA, 20 bp, Homo sapiens
ggcaggtcccgagccccctg

SEQ ID NO: 5667056 - DNA, 21 bp, Homo sapiens
ggcaggtcccgagccccctgt

SEQ ID NO: 5667057 - DNA, 22 bp, Homo sapiens
ggcaggtcctagtcgggcaggg

SEQ ID NO: 5667058 - DNA, 22 bp, Homo sapiens
ggcaggtcgggctgccagccca

SEQ ID NO: 5667059 - DNA, 11 bp, Homo sapiens
gtggccctgcg

SEQ ID NO: 5667060 - DNA, 14 bp, Homo sapiens
gtggccctggggaa

SEQ ID NO: 5667061 - DNA, 16 bp, Homo sapiens
gtggccctgtccctcc

SEQ ID NO: 5667062 - DNA, 21 bp, Homo sapiens
gtggccctgtccctcccacct

SEQ ID NO: 5667063 - DNA, 23 bp, Homo sapiens
gtggccctgtccctcccacctct

SEQ ID NO: 5667064 - DNA, 14 bp, Homo sapiens
gtggccctgtcctg

SEQ ID NO: 5667065 - DNA, 20 bp, Homo sapiens
gtggccctgtgcctgggccc

SEQ ID NO: 5667066 - DNA, 13 bp, Homo sapiens
gtggcccttcctg

SEQ ID NO: 5667067 - DNA, 21 bp, Homo sapiens
gggagcccactgtcctgggcc

SEQ ID NO: 5667068 - DNA, 20 bp, Homo sapiens
gggagccccaccctagccct

SEQ ID NO: 5667069 - DNA, 19 bp, Homo sapiens
gggagcccctaggaaagca

SEQ ID NO: 5667070 - DNA, 20 bp, Homo sapiens
gggagcccctcctctgagca

SEQ ID NO: 5667071 - DNA, 16 bp, Homo sapiens
gggagccctcaggctc

SEQ ID NO: 5667072 - DNA, 18 bp, Homo sapiens
gggagccctcaggctccc

SEQ ID NO: 5667073 - DNA, 14 bp, Homo sapiens
gggagccctgacct

SEQ ID NO: 5667074 - DNA, 19 bp, Homo sapiens
gggagccctgggccagggc

SEQ ID NO: 5667075 - DNA, 14 bp, Homo sapiens
gggagccgagggcg

SEQ ID NO: 5667076 - DNA, 18 bp, Homo sapiens
gggagccgcagagcctga

SEQ ID NO: 5667077 - DNA, 20 bp, Homo sapiens
gggagccgggcaaactggcc

SEQ ID NO: 5667078 - DNA, 16 bp, Homo sapiens
gggagccgggccgcag

SEQ ID NO: 5667079 - DNA, 20 bp, Homo sapiens
gggagccggtaactgtcctg

SEQ ID NO: 5667080 - DNA, 20 bp, Homo sapiens
gggagcctaggaccactcag

SEQ ID NO: 5667081 - DNA, 13 bp, Homo sapiens
gggagcctccccc

SEQ ID NO: 5667082 - DNA, 18 bp, Homo sapiens
gggagcctcccctccctg

SEQ ID NO: 5667083 - DNA, 21 bp, Homo sapiens
gggagcctcctgcccagtccc

SEQ ID NO: 5667084 - DNA, 17 bp, Homo sapiens
gggagcctcgcccctcc

SEQ ID NO: 5667085 - DNA, 18 bp, Homo sapiens
gggagcctcgcccctcca

SEQ ID NO: 5667086 - DNA, 22 bp, Homo sapiens
gggagcctcgcccctccagtgt

SEQ ID NO: 5667087 - DNA, 12 bp, Homo sapiens
gggagcctggag

SEQ ID NO: 5667088 - DNA, 21 bp, Homo sapiens
gggagcctggagcccctgtgt

SEQ ID NO: 5667089 - DNA, 23 bp, Homo sapiens
gggagccttctgccaccagcccc

SEQ ID NO: 5667090 - DNA, 22 bp, Homo sapiens
gggagcctttggttctggccag

SEQ ID NO: 5667091 - DNA, 19 bp, Homo sapiens
gggagcgaggtcagaggag

SEQ ID NO: 5667092 - DNA, 21 bp, Homo sapiens
gggagctacagccagcggcat

SEQ ID NO: 5667093 - DNA, 15 bp, Homo sapiens
gggagctagccagag

SEQ ID NO: 5667094 - DNA, 23 bp, Homo sapiens
gggagctcagctcgctgcccagg

SEQ ID NO: 5667095 - DNA, 21 bp, Homo sapiens
gggagctccaactcagaaggg

SEQ ID NO: 5667096 - DNA, 19 bp, Homo sapiens
gggagctccactctgcttc

SEQ ID NO: 5667097 - DNA, 20 bp, Homo sapiens
gggagctcctctcctggagg

SEQ ID NO: 5667098 - DNA, 12 bp, Homo sapiens
gggagctcctgg

SEQ ID NO: 5667099 - DNA, 19 bp, Homo sapiens
gggagctcctgggaccctt

SEQ ID NO: 5667100 - DNA, 14 bp, Homo sapiens
gggagctctgcttg

SEQ ID NO: 5667101 - DNA, 16 bp, Homo sapiens
gggagctctggggaca

SEQ ID NO: 5667102 - DNA, 18 bp, Homo sapiens
gggagctctggggacagc

SEQ ID NO: 5667103 - DNA, 21 bp, Homo sapiens
gggagctcttgacagaaagca

SEQ ID NO: 5667104 - DNA, 14 bp, Homo sapiens
gggagctgagaaga

SEQ ID NO: 5667105 - DNA, 19 bp, Homo sapiens
gggagctgagcagcctctg

SEQ ID NO: 5667106 - DNA, 16 bp, Homo sapiens
gggagctgaggcctcc

SEQ ID NO: 5667107 - DNA, 13 bp, Homo sapiens
gggagctgcacac

SEQ ID NO: 5667108 - DNA, 16 bp, Homo sapiens
gggagctgcagagcag

SEQ ID NO: 5667109 - DNA, 17 bp, Homo sapiens
gggagctgcagagcagc

SEQ ID NO: 5667110 - DNA, 16 bp, Homo sapiens
gggagctgcaggggca

SEQ ID NO: 5667111 - DNA, 21 bp, Homo sapiens
gggagctgcctgttcagctcc

SEQ ID NO: 5667112 - DNA, 15 bp, Homo sapiens
gggagctgctggcca

SEQ ID NO: 5667113 - DNA, 16 bp, Homo sapiens
gggagctgctggccat

SEQ ID NO: 5667114 - DNA, 19 bp, Homo sapiens
gggagctgctggccatggc

SEQ ID NO: 5667115 - DNA, 19 bp, Homo sapiens
gggagctgctggctgacct

SEQ ID NO: 5667116 - DNA, 22 bp, Homo sapiens
gggagctgctggctgacctggg

SEQ ID NO: 5667117 - DNA, 15 bp, Homo sapiens
gggagctgctgggct

SEQ ID NO: 5667118 - DNA, 19 bp, Homo sapiens
gggagctgctgggtggcag

SEQ ID NO: 5667119 - DNA, 14 bp, Homo sapiens
gggagctggaaata

SEQ ID NO: 5667120 - DNA, 18 bp, Homo sapiens
gggagctgggagccaggc

SEQ ID NO: 5667121 - DNA, 20 bp, Homo sapiens
gggagctgggccctgcctgc

SEQ ID NO: 5667122 - DNA, 23 bp, Homo sapiens
gggagctgggccctgcctgcagc

SEQ ID NO: 5667123 - DNA, 14 bp, Homo sapiens
gggagctgggcctg

SEQ ID NO: 5667124 - DNA, 10 bp, Homo sapiens
gggagctggt

SEQ ID NO: 5667125 - DNA, 17 bp, Homo sapiens
gggagctggttgaattg

SEQ ID NO: 5667126 - DNA, 23 bp, Homo sapiens
gggagcttcccacacctgcctgc

SEQ ID NO: 5667127 - DNA, 17 bp, Homo sapiens
gggagcttcctggctct

SEQ ID NO: 5667128 - DNA, 21 bp, Homo sapiens
gggagcttcctggctctgggg

SEQ ID NO: 5667129 - DNA, 17 bp, Homo sapiens
gggagcttgggactcag

SEQ ID NO: 5667130 - DNA, 13 bp, Homo sapiens
gggagctttccca

SEQ ID NO: 5667131 - DNA, 17 bp, Homo sapiens
gggagctttgagacagg

SEQ ID NO: 5667132 - DNA, 16 bp, Homo sapiens
gggaggaaaagaaaag

SEQ ID NO: 5667133 - DNA, 24 bp, Homo sapiens
gggaggaaatttgaatgggtccat

SEQ ID NO: 5667134 - DNA, 12 bp, Homo sapiens
gggaggaagaga

SEQ ID NO: 5667135 - DNA, 14 bp, Homo sapiens
gggaggaagcagaa

SEQ ID NO: 5667136 - DNA, 18 bp, Homo sapiens
gggaggaagcagaataaa

SEQ ID NO: 5667137 - DNA, 20 bp, Homo sapiens
gggaggaagcagaataaagc

SEQ ID NO: 5667138 - DNA, 22 bp, Homo sapiens
gggaggaaggcctttcttctgt

SEQ ID NO: 5667139 - DNA, 15 bp, Homo sapiens
gggaggaagggccag

SEQ ID NO: 5667140 - DNA, 20 bp, Homo sapiens
gggaggaatcttttactgtg

SEQ ID NO: 5667141 - DNA, 16 bp, Homo sapiens
gggaggacaaaacttc

SEQ ID NO: 5667142 - DNA, 23 bp, Homo sapiens
gggaggacaaaacttcttgtcag

SEQ ID NO: 5667143 - DNA, 21 bp, Homo sapiens
gggaggacagttagacccctg

SEQ ID NO: 5667144 - DNA, 22 bp, Homo sapiens
gggaggacatgcgtgtgtcagg

SEQ ID NO: 5667145 - DNA, 13 bp, Homo sapiens
gggaggacccggg

SEQ ID NO: 5667146 - DNA, 12 bp, Homo sapiens
gggaggactccg

SEQ ID NO: 5667147 - DNA, 13 bp, Homo sapiens
gggaggagagagg

SEQ ID NO: 5667148 - DNA, 22 bp, Homo sapiens
gggaggagcaacggccccagcg

SEQ ID NO: 5667149 - DNA, 19 bp, Homo sapiens
gggaggagcacccccagcc

SEQ ID NO: 5667150 - DNA, 21 bp, Homo sapiens
gggaggagcacccccagcctc

SEQ ID NO: 5667151 - DNA, 13 bp, Homo sapiens
gggaggagcagca

SEQ ID NO: 5667152 - DNA, 13 bp, Homo sapiens
gggaggagcctct

SEQ ID NO: 5667153 - DNA, 15 bp, Homo sapiens
gggaggagcctctgg

SEQ ID NO: 5667154 - DNA, 22 bp, Homo sapiens
gggaggagcctgtgcgtcccag

SEQ ID NO: 5667155 - DNA, 13 bp, Homo sapiens
gggaggagcttct

SEQ ID NO: 5667156 - DNA, 12 bp, Homo sapiens
gggaggaggact

SEQ ID NO: 5667157 - DNA, 15 bp, Homo sapiens
gggaggaggacttgg

SEQ ID NO: 5667158 - DNA, 17 bp, Homo sapiens
gggaggaggatccgggc

SEQ ID NO: 5667159 - DNA, 15 bp, Homo sapiens
gggaggaggcagaga

SEQ ID NO: 5667160 - DNA, 12 bp, Homo sapiens
gggaggagggca

SEQ ID NO: 5667161 - DNA, 16 bp, Homo sapiens
gggaggagggcaggca

SEQ ID NO: 5667162 - DNA, 21 bp, Homo sapiens
gggaggagggggcccggctgg

SEQ ID NO: 5667163 - DNA, 20 bp, Homo sapiens
gggaggaggtggcagccctg

SEQ ID NO: 5667164 - DNA, 19 bp, Homo sapiens
gggaggaggttgtgtcact

SEQ ID NO: 5667165 - DNA, 20 bp, Homo sapiens
gggaggaggttgtgtcactg

SEQ ID NO: 5667166 - DNA, 14 bp, Homo sapiens
gggaggagtcaggg

SEQ ID NO: 5667167 - DNA, 21 bp, Homo sapiens
gggaggagtggattcctcccc

SEQ ID NO: 5667168 - DNA, 19 bp, Homo sapiens
gggaggatgccacagcccc

SEQ ID NO: 5667169 - DNA, 20 bp, Homo sapiens
gggaggatgccacagcccca

SEQ ID NO: 5667170 - DNA, 22 bp, Homo sapiens
gggaggatgccacagccccaca

SEQ ID NO: 5667171 - DNA, 18 bp, Homo sapiens
gggaggcaagtgtggggg

SEQ ID NO: 5667172 - DNA, 15 bp, Homo sapiens
gggaggcacctccag

SEQ ID NO: 5667173 - DNA, 11 bp, Homo sapiens
gggaggcagag

SEQ ID NO: 5667174 - DNA, 17 bp, Homo sapiens
gggaggcagccacaggg

SEQ ID NO: 5667175 - DNA, 13 bp, Homo sapiens
gggaggcagccgg

SEQ ID NO: 5667176 - DNA, 11 bp, Homo sapiens
gggaggcagcg

SEQ ID NO: 5667177 - DNA, 16 bp, Homo sapiens
gggaggcagcgtgggc

SEQ ID NO: 5667178 - DNA, 23 bp, Homo sapiens
gggaggcagcgtgggctctgcca

SEQ ID NO: 5667179 - DNA, 15 bp, Homo sapiens
gggaggcagggctgg

SEQ ID NO: 5667180 - DNA, 17 bp, Homo sapiens
gggaggcagggctggaa

SEQ ID NO: 5667181 - DNA, 12 bp, Homo sapiens
gggaggcaggtc

SEQ ID NO: 5667182 - DNA, 17 bp, Homo sapiens
gggaggccaaggcaggc

SEQ ID NO: 5667183 - DNA, 14 bp, Homo sapiens
gggaggccacgtcc

SEQ ID NO: 5667184 - DNA, 17 bp, Homo sapiens
gggaggccagtgagcca

SEQ ID NO: 5667185 - DNA, 20 bp, Homo sapiens
gggaggccatttgctgccct

SEQ ID NO: 5667186 - DNA, 21 bp, Homo sapiens
gggaggccatttgctgccctg

SEQ ID NO: 5667187 - DNA, 16 bp, Homo sapiens
gggaggcccatgtgac

SEQ ID NO: 5667188 - DNA, 11 bp, Homo sapiens
gggaggcccca

SEQ ID NO: 5667189 - DNA, 16 bp, Homo sapiens
gggaggccccactggg

SEQ ID NO: 5667190 - DNA, 13 bp, Homo sapiens
gggaggccccagc

SEQ ID NO: 5667191 - DNA, 18 bp, Homo sapiens
gggaggccccagctctga

SEQ ID NO: 5667192 - DNA, 17 bp, Homo sapiens
gggaggcccctggtggc

SEQ ID NO: 5667193 - DNA, 15 bp, Homo sapiens
gggaggcccggggcc

SEQ ID NO: 5667194 - DNA, 18 bp, Homo sapiens
gggaggcccggggccctt

SEQ ID NO: 5667195 - DNA, 23 bp, Homo sapiens
gggaggcccggggcccttcctcg

SEQ ID NO: 5667196 - DNA, 12 bp, Homo sapiens
gggaggccctgg

SEQ ID NO: 5667197 - DNA, 15 bp, Homo sapiens
gggaggccgaggcag

SEQ ID NO: 5667198 - DNA, 19 bp, Homo sapiens
gggaggccgaggtgggcag

SEQ ID NO: 5667199 - DNA, 21 bp, Homo sapiens
gggaggcctcgtaccagccag

SEQ ID NO: 5667200 - DNA, 23 bp, Homo sapiens
gggaggcctcgtaccagccagga

SEQ ID NO: 5667201 - DNA, 14 bp, Homo sapiens
gggaggcctgaggg

SEQ ID NO: 5667202 - DNA, 15 bp, Homo sapiens
gggaggcctgagggg

SEQ ID NO: 5667203 - DNA, 13 bp, Homo sapiens
gggaggcgcaggg

SEQ ID NO: 5667204 - DNA, 16 bp, Homo sapiens
gggaggcgcagggaca

SEQ ID NO: 5667205 - DNA, 20 bp, Homo sapiens
gggaggcggagagtacagtg

SEQ ID NO: 5667206 - DNA, 22 bp, Homo sapiens
gggaggcggcacattggcagtg

SEQ ID NO: 5667207 - DNA, 18 bp, Homo sapiens
gggaggcgtgcccccctc

SEQ ID NO: 5667208 - DNA, 18 bp, Homo sapiens
gggaggcgtggagggtga

SEQ ID NO: 5667209 - DNA, 13 bp, Homo sapiens
gggaggctcaggt

SEQ ID NO: 5667210 - DNA, 15 bp, Homo sapiens
gggaggctcaggtcc

SEQ ID NO: 5667211 - DNA, 14 bp, Homo sapiens
gggaggctcccaga

SEQ ID NO: 5667212 - DNA, 18 bp, Homo sapiens
gggaggctcccggggcct

SEQ ID NO: 5667213 - DNA, 21 bp, Homo sapiens
gggaggctcccggggcctgga

SEQ ID NO: 5667214 - DNA, 22 bp, Homo sapiens
gggaggctcccggggcctggac

SEQ ID NO: 5667215 - DNA, 13 bp, Homo sapiens
gggaggctctgaa

SEQ ID NO: 5667216 - DNA, 10 bp, Homo sapiens
gggaggctga

SEQ ID NO: 5667217 - DNA, 13 bp, Homo sapiens
gggaggctgactc

SEQ ID NO: 5667218 - DNA, 12 bp, Homo sapiens
gggaggctgaga

SEQ ID NO: 5667219 - DNA, 16 bp, Homo sapiens
gggaggctgagactgc

SEQ ID NO: 5667220 - DNA, 19 bp, Homo sapiens
gggaggctgagactgcaga

SEQ ID NO: 5667221 - DNA, 15 bp, Homo sapiens
gggaggctgaggcag

SEQ ID NO: 5667222 - DNA, 14 bp, Homo sapiens
gggaggctgaggcg

SEQ ID NO: 5667223 - DNA, 22 bp, Homo sapiens
gggaggctgcactggagccaca

SEQ ID NO: 5667224 - DNA, 13 bp, Homo sapiens
gggaggctgcagc

SEQ ID NO: 5667225 - DNA, 14 bp, Homo sapiens
gggaggctgcagcc

SEQ ID NO: 5667226 - DNA, 15 bp, Homo sapiens
gggaggctgcagcca

SEQ ID NO: 5667227 - DNA, 18 bp, Homo sapiens
gggaggctgcggcaggag

SEQ ID NO: 5667228 - DNA, 20 bp, Homo sapiens
gggaggctggaagctgggag

SEQ ID NO: 5667229 - DNA, 19 bp, Homo sapiens
gggaggctggggacccaga

SEQ ID NO: 5667230 - DNA, 20 bp, Homo sapiens
gggaggctggggacccagac

SEQ ID NO: 5667231 - DNA, 13 bp, Homo sapiens
gggaggctttcaa

SEQ ID NO: 5667232 - DNA, 13 bp, Homo sapiens
gggagggaaaagg

SEQ ID NO: 5667233 - DNA, 18 bp, Homo sapiens
gggagggaaagggagagg

SEQ ID NO: 5667234 - DNA, 16 bp, Homo sapiens
gggagggaacagacct

SEQ ID NO: 5667235 - DNA, 21 bp, Homo sapiens
gggagggaagggccaccctgc

SEQ ID NO: 5667236 - DNA, 14 bp, Homo sapiens
gggagggaagggga

SEQ ID NO: 5667237 - DNA, 16 bp, Homo sapiens
gggagggaagtgtgag

SEQ ID NO: 5667238 - DNA, 18 bp, Homo sapiens
gggatcatcatgcagctc

SEQ ID NO: 5667239 - DNA, 13 bp, Homo sapiens
gggatcatgaaag

SEQ ID NO: 5667240 - DNA, 18 bp, Homo sapiens
gggatccacgctgggcct

SEQ ID NO: 5667241 - DNA, 15 bp, Homo sapiens
gggatccagagacct

SEQ ID NO: 5667242 - DNA, 14 bp, Homo sapiens
gggatccagccact

SEQ ID NO: 5667243 - DNA, 17 bp, Homo sapiens
gggatcccacagcccta

SEQ ID NO: 5667244 - DNA, 18 bp, Homo sapiens
gggatcccacagccctag

SEQ ID NO: 5667245 - DNA, 17 bp, Homo sapiens
gggatcccaggccaggg

SEQ ID NO: 5667246 - DNA, 21 bp, Homo sapiens
gggatcccccgccccatcctc

SEQ ID NO: 5667247 - DNA, 17 bp, Homo sapiens
gggatccccgcctggcc

SEQ ID NO: 5667248 - DNA, 20 bp, Homo sapiens
gggatccccgcctggccagg

SEQ ID NO: 5667249 - DNA, 15 bp, Homo sapiens
gtggctgccccggcc

SEQ ID NO: 5667250 - DNA, 16 bp, Homo sapiens
gtggctgcctcattta

SEQ ID NO: 5667251 - DNA, 16 bp, Homo sapiens
gtggctgcctggagcc

SEQ ID NO: 5667252 - DNA, 23 bp, Homo sapiens
gtggctgcctttgatcacaggag

SEQ ID NO: 5667253 - DNA, 15 bp, Homo sapiens
gtggctgctctggga

SEQ ID NO: 5667254 - DNA, 13 bp, Homo sapiens
gtggctgctgccc

SEQ ID NO: 5667255 - DNA, 14 bp, Homo sapiens
gtggctgcttcaag

SEQ ID NO: 5667256 - DNA, 22 bp, Homo sapiens
gtggctggaaccacattgaaga

SEQ ID NO: 5667257 - DNA, 12 bp, Homo sapiens
gtggctggagga

SEQ ID NO: 5667258 - DNA, 16 bp, Homo sapiens
gtggctggaggagctg

SEQ ID NO: 5667259 - DNA, 17 bp, Homo sapiens
gtggctggaggagctgg

SEQ ID NO: 5667260 - DNA, 18 bp, Homo sapiens
gtggctggaggagctggc

SEQ ID NO: 5667261 - DNA, 15 bp, Homo sapiens
gtggctggcgcctgt

SEQ ID NO: 5667262 - DNA, 14 bp, Homo sapiens
gtggctggctcacc

SEQ ID NO: 5667263 - DNA, 21 bp, Homo sapiens
gtggctggctctaccttcctg

SEQ ID NO: 5667264 - DNA, 22 bp, Homo sapiens
gtggctggctctaccttcctgt

SEQ ID NO: 5667265 - DNA, 21 bp, Homo sapiens
gtggctgggaagggaaggaag

SEQ ID NO: 5667266 - DNA, 13 bp, Homo sapiens
gtggctgggacct

SEQ ID NO: 5667267 - DNA, 14 bp, Homo sapiens
gtggctgggacctt

SEQ ID NO: 5667268 - DNA, 19 bp, Homo sapiens
gtggctgggactcctggtg

SEQ ID NO: 5667269 - DNA, 20 bp, Homo sapiens
gtggctgggctgctcctgaa

SEQ ID NO: 5667270 - DNA, 16 bp, Homo sapiens
gtggctgggggcagga

SEQ ID NO: 5667271 - DNA, 17 bp, Homo sapiens
gtggctgggggcaggag

SEQ ID NO: 5667272 - DNA, 12 bp, Homo sapiens
gtggctgggtgc

SEQ ID NO: 5667273 - DNA, 20 bp, Homo sapiens
gtggctgggtgggcccagaa

SEQ ID NO: 5667274 - DNA, 17 bp, Homo sapiens
gtggctggtccagggct

SEQ ID NO: 5667275 - DNA, 13 bp, Homo sapiens
gtggctggtctgg

SEQ ID NO: 5667276 - DNA, 18 bp, Homo sapiens
gtggctggtctggagtcc

SEQ ID NO: 5667277 - DNA, 13 bp, Homo sapiens
gtggctggtgtcc

SEQ ID NO: 5667278 - DNA, 18 bp, Homo sapiens
gtggctggtgtccccttc

SEQ ID NO: 5667279 - DNA, 20 bp, Homo sapiens
gtggctggtgtccccttccc

SEQ ID NO: 5667280 - DNA, 21 bp, Homo sapiens
gtggctggtgtccccttcccc

SEQ ID NO: 5667281 - DNA, 23 bp, Homo sapiens
gtggctgtcaaatccatgtgtcc

SEQ ID NO: 5667282 - DNA, 19 bp, Homo sapiens
gtggctgtcagcaggaagc

SEQ ID NO: 5667283 - DNA, 14 bp, Homo sapiens
gtggctgtctctgt

SEQ ID NO: 5667284 - DNA, 21 bp, Homo sapiens
gtggctgtctctgtccctcac

SEQ ID NO: 5667285 - DNA, 12 bp, Homo sapiens
gtggctgtctgg

SEQ ID NO: 5667286 - DNA, 16 bp, Homo sapiens
gtggctgtctggatcc

SEQ ID NO: 5667287 - DNA, 14 bp, Homo sapiens
gtggctgtgaagga

SEQ ID NO: 5667288 - DNA, 20 bp, Homo sapiens
gtggctgtgacaaccctggc

SEQ ID NO: 5667289 - DNA, 21 bp, Homo sapiens
gtggctgtgacaaccctggcc

SEQ ID NO: 5667290 - DNA, 16 bp, Homo sapiens
gtggctgtgacatcta

SEQ ID NO: 5667291 - DNA, 12 bp, Homo sapiens
gtggctgtggca

SEQ ID NO: 5667292 - DNA, 12 bp, Homo sapiens
gtggctgtgtct

SEQ ID NO: 5667293 - DNA, 16 bp, Homo sapiens
gtggctgttcatgctc

SEQ ID NO: 5667294 - DNA, 15 bp, Homo sapiens
gtggcttaaacattt

SEQ ID NO: 5667295 - DNA, 15 bp, Homo sapiens
gtggcttacaaattc

SEQ ID NO: 5667296 - DNA, 22 bp, Homo sapiens
gtggcttacaaattctacagca

SEQ ID NO: 5667297 - DNA, 16 bp, Homo sapiens
gtggcttaccaagatc

SEQ ID NO: 5667298 - DNA, 15 bp, Homo sapiens
gtggcttagctgcca

SEQ ID NO: 5667299 - DNA, 15 bp, Homo sapiens
gtggcttcagcccct

SEQ ID NO: 5667300 - DNA, 16 bp, Homo sapiens
gtggcttcagcccctg

SEQ ID NO: 5667301 - DNA, 23 bp, Homo sapiens
gtggcttcagcccctggggtact

SEQ ID NO: 5667302 - DNA, 18 bp, Homo sapiens
gtggcttcccatgtcttt

SEQ ID NO: 5667303 - DNA, 23 bp, Homo sapiens
gtggcttcccttttctttgttca

SEQ ID NO: 5667304 - DNA, 15 bp, Homo sapiens
gtggcttctcccaac

SEQ ID NO: 5667305 - DNA, 19 bp, Homo sapiens
gtggcttctggcacctggc

SEQ ID NO: 5667306 - DNA, 20 bp, Homo sapiens
gtggcttctggcacctggcg

SEQ ID NO: 5667307 - DNA, 19 bp, Homo sapiens
gtggcttggagcagaggtg

SEQ ID NO: 5667308 - DNA, 16 bp, Homo sapiens
gtggcttggcatctgt

SEQ ID NO: 5667309 - DNA, 18 bp, Homo sapiens
gtggcttgggctggtcag

SEQ ID NO: 5667310 - DNA, 21 bp, Homo sapiens
gtggcttgtgattctgggatg

SEQ ID NO: 5667311 - DNA, 19 bp, Homo sapiens
gtggctttaattgtataag

SEQ ID NO: 5667312 - DNA, 19 bp, Homo sapiens
gtggctttaggagcagtgg

SEQ ID NO: 5667313 - DNA, 17 bp, Homo sapiens
gtggctttcatttctta

SEQ ID NO: 5667314 - DNA, 20 bp, Homo sapiens
gtggctttccttgtggcaga

SEQ ID NO: 5667315 - DNA, 21 bp, Homo sapiens
gtggctttccttgtggcagag

SEQ ID NO: 5667316 - DNA, 17 bp, Homo sapiens
gtggctttgcatttctt

SEQ ID NO: 5667317 - DNA, 18 bp, Homo sapiens
gtggctttgcattttaaa

SEQ ID NO: 5667318 - DNA, 14 bp, Homo sapiens
gtggctttgctgtt

SEQ ID NO: 5667319 - DNA, 18 bp, Homo sapiens
gtggctttggcagtgttt

SEQ ID NO: 5667320 - DNA, 14 bp, Homo sapiens
gtgggaaaaaagaa

SEQ ID NO: 5667321 - DNA, 22 bp, Homo sapiens
gtgggaaaatgtcccccacctc

SEQ ID NO: 5667322 - DNA, 19 bp, Homo sapiens
gtgggaaacattagtgaaa

SEQ ID NO: 5667323 - DNA, 16 bp, Homo sapiens
gtgggaaagggacccg

SEQ ID NO: 5667324 - DNA, 16 bp, Homo sapiens
gtgggaaaggggagta

SEQ ID NO: 5667325 - DNA, 22 bp, Homo sapiens
gtgggaaatatgccactgaccg

SEQ ID NO: 5667326 - DNA, 14 bp, Homo sapiens
gtgggaaccctccc

SEQ ID NO: 5667327 - DNA, 18 bp, Homo sapiens
gtgggaacgagaggggaa

SEQ ID NO: 5667328 - DNA, 21 bp, Homo sapiens
gtgggaacgagaggggaagag

SEQ ID NO: 5667329 - DNA, 17 bp, Homo sapiens
gtgggaacgtgactgcc

SEQ ID NO: 5667330 - DNA, 17 bp, Homo sapiens
gtgggaactgtgcaaag

SEQ ID NO: 5667331 - DNA, 13 bp, Homo sapiens
gtgggaagaatag

SEQ ID NO: 5667332 - DNA, 14 bp, Homo sapiens
gtgggaagagaagg

SEQ ID NO: 5667333 - DNA, 15 bp, Homo sapiens
gtgggaagagctggg

SEQ ID NO: 5667334 - DNA, 20 bp, Homo sapiens
gtgggaagagggcaggggct

SEQ ID NO: 5667335 - DNA, 14 bp, Homo sapiens
gtgggaagcaagca

SEQ ID NO: 5667336 - DNA, 22 bp, Homo sapiens
gtgggaagcttgctggcttctg

SEQ ID NO: 5667337 - DNA, 20 bp, Homo sapiens
gtgggaaggacttggcgcgc

SEQ ID NO: 5667338 - DNA, 23 bp, Homo sapiens
gtgggaaggacttggcgcgccct

SEQ ID NO: 5667339 - DNA, 13 bp, Homo sapiens
gtgggaagggaga

SEQ ID NO: 5667340 - DNA, 17 bp, Homo sapiens
gtgggaagggctacacc

SEQ ID NO: 5667341 - DNA, 13 bp, Homo sapiens
gtgggaaggggct

SEQ ID NO: 5667342 - DNA, 15 bp, Homo sapiens
gtgggaatgttcttt

SEQ ID NO: 5667343 - DNA, 18 bp, Homo sapiens
gtgggaatgttctttctg

SEQ ID NO: 5667344 - DNA, 21 bp, Homo sapiens
gtgggacaaaccagagcagag

SEQ ID NO: 5667345 - DNA, 18 bp, Homo sapiens
gtgggacacaacacagat

SEQ ID NO: 5667346 - DNA, 15 bp, Homo sapiens
gtgggacaccctgtg

SEQ ID NO: 5667347 - DNA, 22 bp, Homo sapiens
gtgggacaccctgtgatggggc

SEQ ID NO: 5667348 - DNA, 14 bp, Homo sapiens
gtgggacagacagc

SEQ ID NO: 5667349 - DNA, 19 bp, Homo sapiens
gtgggacagacagcagctg

SEQ ID NO: 5667350 - DNA, 13 bp, Homo sapiens
gtgggacagcccc

SEQ ID NO: 5667351 - DNA, 23 bp, Homo sapiens
gtgggacagcctcttcagcccct

SEQ ID NO: 5667352 - DNA, 22 bp, Homo sapiens
gtgggacagcttgtaggggagg

SEQ ID NO: 5667353 - DNA, 14 bp, Homo sapiens
gtgggacagggctt

SEQ ID NO: 5667354 - DNA, 17 bp, Homo sapiens
gtgggacagggcttctc

SEQ ID NO: 5667355 - DNA, 14 bp, Homo sapiens
gtgggacagtggtg

SEQ ID NO: 5667356 - DNA, 22 bp, Homo sapiens
gtgggacagttcctgagaccag

SEQ ID NO: 5667357 - DNA, 16 bp, Homo sapiens
gtgggacatggaaaag

SEQ ID NO: 5667358 - DNA, 17 bp, Homo sapiens
gtgggaccagtcccaca

SEQ ID NO: 5667359 - DNA, 19 bp, Homo sapiens
gtgggacccaggctcccag

SEQ ID NO: 5667360 - DNA, 23 bp, Homo sapiens
gtgggaccctcagcagctctggc

SEQ ID NO: 5667361 - DNA, 15 bp, Homo sapiens
gtgggaccgcctggc

SEQ ID NO: 5667362 - DNA, 17 bp, Homo sapiens
gtgggaccgcctggccc

SEQ ID NO: 5667363 - DNA, 22 bp, Homo sapiens
gtgggaccgcctggccctccct

SEQ ID NO: 5667364 - DNA, 20 bp, Homo sapiens
gtgggacggtgcccaagcca

SEQ ID NO: 5667365 - DNA, 15 bp, Homo sapiens
gtgggacgtggtcag

SEQ ID NO: 5667366 - DNA, 23 bp, Homo sapiens
gtgggactcatccttgcccaggt

SEQ ID NO: 5667367 - DNA, 18 bp, Homo sapiens
gtgggactggcccacccc

SEQ ID NO: 5667368 - DNA, 21 bp, Homo sapiens
gtgggactggcccacccctct

SEQ ID NO: 5667369 - DNA, 14 bp, Homo sapiens
gtgggactggtggg

SEQ ID NO: 5667370 - DNA, 17 bp, Homo sapiens
gtgggactggtgggggt

SEQ ID NO: 5667371 - DNA, 16 bp, Homo sapiens
gtgggacttggagagc

SEQ ID NO: 5667372 - DNA, 15 bp, Homo sapiens
gtgggagaaggcagt

SEQ ID NO: 5667373 - DNA, 17 bp, Homo sapiens
gtgggagaagggacagc

SEQ ID NO: 5667374 - DNA, 17 bp, Homo sapiens
gtgggagaagtggcccc

SEQ ID NO: 5667375 - DNA, 14 bp, Homo sapiens
gtgggagacagcag

SEQ ID NO: 5667376 - DNA, 17 bp, Homo sapiens
gtgggagacagcagcct

SEQ ID NO: 5667377 - DNA, 23 bp, Homo sapiens
gtgggagaccggcctgccaggag

SEQ ID NO: 5667378 - DNA, 12 bp, Homo sapiens
gtgggagagaca

SEQ ID NO: 5667379 - DNA, 17 bp, Homo sapiens
gtgggagaggaagccac

SEQ ID NO: 5667380 - DNA, 12 bp, Homo sapiens
gtgggagaggca

SEQ ID NO: 5667381 - DNA, 19 bp, Homo sapiens
gtgggagcaaactgcatgc

SEQ ID NO: 5667382 - DNA, 14 bp, Homo sapiens
gtgggagcagcttc

SEQ ID NO: 5667383 - DNA, 20 bp, Homo sapiens
gtgggagcagcttcttgggc

SEQ ID NO: 5667384 - DNA, 21 bp, Homo sapiens
gtgggagcagcttcttgggct

SEQ ID NO: 5667385 - DNA, 14 bp, Homo sapiens
gtgggagcaggaga

SEQ ID NO: 5667386 - DNA, 15 bp, Homo sapiens
gtgggagcaggagat

SEQ ID NO: 5667387 - DNA, 14 bp, Homo sapiens
gtgggagccacagg

SEQ ID NO: 5667388 - DNA, 13 bp, Homo sapiens
gtgggagcccagc

SEQ ID NO: 5667389 - DNA, 14 bp, Homo sapiens
gtgggagcccagca

SEQ ID NO: 5667390 - DNA, 13 bp, Homo sapiens
gtgggagcctcgc

SEQ ID NO: 5667391 - DNA, 14 bp, Homo sapiens
gtgggagcctcgca

SEQ ID NO: 5667392 - DNA, 16 bp, Homo sapiens
gtgggagcgtgggagg

SEQ ID NO: 5667393 - DNA, 13 bp, Homo sapiens
gtgggagctcagc

SEQ ID NO: 5667394 - DNA, 13 bp, Homo sapiens
gtgggagctcctc

SEQ ID NO: 5667395 - DNA, 12 bp, Homo sapiens
gtgggagctgag

SEQ ID NO: 5667396 - DNA, 14 bp, Homo sapiens
gtgggagctgcctg

SEQ ID NO: 5667397 - DNA, 21 bp, Homo sapiens
gtgggagcttcccacacctgc

SEQ ID NO: 5667398 - DNA, 22 bp, Homo sapiens
gtgggaggaaagggcctggcca

SEQ ID NO: 5667399 - DNA, 23 bp, Homo sapiens
gtgggaggaaagggcctggccag

SEQ ID NO: 5667400 - DNA, 19 bp, Homo sapiens
gtgggaggagagggcagag

SEQ ID NO: 5667401 - DNA, 18 bp, Homo sapiens
gtgggaggcagaaaccta

SEQ ID NO: 5667402 - DNA, 14 bp, Homo sapiens
gtgggaggcccctg

SEQ ID NO: 5667403 - DNA, 18 bp, Homo sapiens
gtgggaggcccctggtgg

SEQ ID NO: 5667404 - DNA, 16 bp, Homo sapiens
gtgggaggctcccaga

SEQ ID NO: 5667405 - DNA, 19 bp, Homo sapiens
gtgggaggctcccagaccc

SEQ ID NO: 5667406 - DNA, 20 bp, Homo sapiens
gtgggaggctggggacccag

SEQ ID NO: 5667407 - DNA, 13 bp, Homo sapiens
gtgggagggagca

SEQ ID NO: 5667408 - DNA, 15 bp, Homo sapiens
gtgggagggagcaga

SEQ ID NO: 5667409 - DNA, 13 bp, Homo sapiens
gtgggagggagga

SEQ ID NO: 5667410 - DNA, 14 bp, Homo sapiens
gtgggagggaggag

SEQ ID NO: 5667411 - DNA, 15 bp, Homo sapiens
gtgggagggaggagg

SEQ ID NO: 5667412 - DNA, 18 bp, Homo sapiens
gtgggagggcgaggcggg

SEQ ID NO: 5667413 - DNA, 17 bp, Homo sapiens
gtgggagggcgtcaggc

SEQ ID NO: 5667414 - DNA, 19 bp, Homo sapiens
gtgggagggcgtcaggcag

SEQ ID NO: 5667415 - DNA, 20 bp, Homo sapiens
gtgggagggcgtcaggcaga

SEQ ID NO: 5667416 - DNA, 13 bp, Homo sapiens
gtgggaggggaag

SEQ ID NO: 5667417 - DNA, 12 bp, Homo sapiens
gggcacacactg

SEQ ID NO: 5667418 - DNA, 13 bp, Homo sapiens
gggcacacactgt

SEQ ID NO: 5667419 - DNA, 14 bp, Homo sapiens
gggcacaccactgc

SEQ ID NO: 5667420 - DNA, 20 bp, Homo sapiens
gggcacaccactgccctgcc

SEQ ID NO: 5667421 - DNA, 17 bp, Homo sapiens
gggcacacctcctccca

SEQ ID NO: 5667422 - DNA, 13 bp, Homo sapiens
gggcacacgctgc

SEQ ID NO: 5667423 - DNA, 18 bp, Homo sapiens
gggcacacgctgctctgc

SEQ ID NO: 5667424 - DNA, 23 bp, Homo sapiens
gggcacacgctgctctgccccag

SEQ ID NO: 5667425 - DNA, 22 bp, Homo sapiens
gggcacacttccccttgggatg

SEQ ID NO: 5667426 - DNA, 18 bp, Homo sapiens
gggcacagacctctccca

SEQ ID NO: 5667427 - DNA, 13 bp, Homo sapiens
gggcacagcaggg

SEQ ID NO: 5667428 - DNA, 15 bp, Homo sapiens
gggcacagcatctgt

SEQ ID NO: 5667429 - DNA, 19 bp, Homo sapiens
gggcacagccctccgaccc

SEQ ID NO: 5667430 - DNA, 16 bp, Homo sapiens
gtgggagtgtgtctgc

SEQ ID NO: 5667431 - DNA, 14 bp, Homo sapiens
gtgggagtgtgtgc

SEQ ID NO: 5667432 - DNA, 22 bp, Homo sapiens
gtgggataggagggtgcccctg

SEQ ID NO: 5667433 - DNA, 22 bp, Homo sapiens
gtgggatcaaagctaggaaagg

SEQ ID NO: 5667434 - DNA, 19 bp, Homo sapiens
gtgggatccacgctgggcc

SEQ ID NO: 5667435 - DNA, 14 bp, Homo sapiens
gtgggatcctccct

SEQ ID NO: 5667436 - DNA, 19 bp, Homo sapiens
gtgggatggatgctgggga

SEQ ID NO: 5667437 - DNA, 17 bp, Homo sapiens
gtgggatgggctctacc

SEQ ID NO: 5667438 - DNA, 13 bp, Homo sapiens
gtgggattattca

SEQ ID NO: 5667439 - DNA, 17 bp, Homo sapiens
gtgggattttttccctt

SEQ ID NO: 5667440 - DNA, 18 bp, Homo sapiens
gtgggcaaaggcagggcc

SEQ ID NO: 5667441 - DNA, 22 bp, Homo sapiens
gtgggcaaagtcctcctttcat

SEQ ID NO: 5667442 - DNA, 17 bp, Homo sapiens
gtgggcaccaagagcca

SEQ ID NO: 5667443 - DNA, 16 bp, Homo sapiens
gtgggcacccaccctg

SEQ ID NO: 5667444 - DNA, 13 bp, Homo sapiens
gtgggcacctcag

SEQ ID NO: 5667445 - DNA, 14 bp, Homo sapiens
gtgggcacctcaga

SEQ ID NO: 5667446 - DNA, 20 bp, Homo sapiens
gtgggcacgctgtgggcagg

SEQ ID NO: 5667447 - DNA, 23 bp, Homo sapiens
gtgggcacgctgtgggcaggtgg

SEQ ID NO: 5667448 - DNA, 21 bp, Homo sapiens
gtgggcactaagggtggagag

SEQ ID NO: 5667449 - DNA, 15 bp, Homo sapiens
gtgggcactggagca

SEQ ID NO: 5667450 - DNA, 16 bp, Homo sapiens
gtgggcactggcccag

SEQ ID NO: 5667451 - DNA, 11 bp, Homo sapiens
gtgggcagagg

SEQ ID NO: 5667452 - DNA, 21 bp, Homo sapiens
gtgggcagaggaatgtgggct

SEQ ID NO: 5667453 - DNA, 14 bp, Homo sapiens
gtgggcagaggctg

SEQ ID NO: 5667454 - DNA, 21 bp, Homo sapiens
gtgggcagaggtggcgcccag

SEQ ID NO: 5667455 - DNA, 15 bp, Homo sapiens
gtgggcagcaccctc

SEQ ID NO: 5667456 - DNA, 20 bp, Homo sapiens
gtgggcagcagcatcccagc

SEQ ID NO: 5667457 - DNA, 14 bp, Homo sapiens
gtgggcagctggct

SEQ ID NO: 5667458 - DNA, 16 bp, Homo sapiens
gtgggcagctggctct

SEQ ID NO: 5667459 - DNA, 16 bp, Homo sapiens
gtgggcagctgggccc

SEQ ID NO: 5667460 - DNA, 17 bp, Homo sapiens
gtgggcagctgggcccc

SEQ ID NO: 5667461 - DNA, 14 bp, Homo sapiens
gtgggcaggaaaag

SEQ ID NO: 5667462 - DNA, 18 bp, Homo sapiens
gtgggcaggcaagccctt

SEQ ID NO: 5667463 - DNA, 22 bp, Homo sapiens
gtgggcagggaggggctggggc

SEQ ID NO: 5667464 - DNA, 14 bp, Homo sapiens
gtgggcagggctgg

SEQ ID NO: 5667465 - DNA, 21 bp, Homo sapiens
gtgggcaggggttccagcttc

SEQ ID NO: 5667466 - DNA, 14 bp, Homo sapiens
gtgggcaggtggcc

SEQ ID NO: 5667467 - DNA, 23 bp, Homo sapiens
gtgggcagtcaccacccagccct

SEQ ID NO: 5667468 - DNA, 15 bp, Homo sapiens
gtgggcatggccgct

SEQ ID NO: 5667469 - DNA, 19 bp, Homo sapiens
gtgggcattttgacaacat

SEQ ID NO: 5667470 - DNA, 20 bp, Homo sapiens
gtgggccaccgtgcctggct

SEQ ID NO: 5667471 - DNA, 13 bp, Homo sapiens
gtgggccagagct

SEQ ID NO: 5667472 - DNA, 19 bp, Homo sapiens
gtgggccagcatagggggg

SEQ ID NO: 5667473 - DNA, 23 bp, Homo sapiens
gtgggccagcataggggggaggg

SEQ ID NO: 5667474 - DNA, 19 bp, Homo sapiens
gtgggccagccacagagca

SEQ ID NO: 5667475 - DNA, 13 bp, Homo sapiens
gtgggccagcccc

SEQ ID NO: 5667476 - DNA, 17 bp, Homo sapiens
gtgggccagcccctccc

SEQ ID NO: 5667477 - DNA, 14 bp, Homo sapiens
gtgggccagggctg

SEQ ID NO: 5667478 - DNA, 19 bp, Homo sapiens
gtgggccagggctgccctg

SEQ ID NO: 5667479 - DNA, 16 bp, Homo sapiens
gtgggccagtcctggt

SEQ ID NO: 5667480 - DNA, 19 bp, Homo sapiens
gtgggccagtcctggttgt

SEQ ID NO: 5667481 - DNA, 14 bp, Homo sapiens
gtgggcccaaggcc

SEQ ID NO: 5667482 - DNA, 19 bp, Homo sapiens
gtgggcccagaactgcccc

SEQ ID NO: 5667483 - DNA, 21 bp, Homo sapiens
gtgggccccgggctggagaaa

SEQ ID NO: 5667484 - DNA, 19 bp, Homo sapiens
gtgggccctaccctcctgc

SEQ ID NO: 5667485 - DNA, 19 bp, Homo sapiens
gtgggccctgagtcctggt

SEQ ID NO: 5667486 - DNA, 18 bp, Homo sapiens
gtgggccctgcccgggga

SEQ ID NO: 5667487 - DNA, 20 bp, Homo sapiens
gtgggccctggaggggccca

SEQ ID NO: 5667488 - DNA, 16 bp, Homo sapiens
gtgggccctggctctg

SEQ ID NO: 5667489 - DNA, 22 bp, Homo sapiens
gtgggccggccccaggctcccc

SEQ ID NO: 5667490 - DNA, 13 bp, Homo sapiens
gtgggccgggagg

SEQ ID NO: 5667491 - DNA, 19 bp, Homo sapiens
gtgggccgggaggcagtgc

SEQ ID NO: 5667492 - DNA, 18 bp, Homo sapiens
gtgggccgtggcttgggc

SEQ ID NO: 5667493 - DNA, 21 bp, Homo sapiens
gtgggccgtggcttgggctgg

SEQ ID NO: 5667494 - DNA, 23 bp, Homo sapiens
gtgggcctcacctgcccctctgt

SEQ ID NO: 5667495 - DNA, 15 bp, Homo sapiens
gtgggcctcctctgt

SEQ ID NO: 5667496 - DNA, 22 bp, Homo sapiens
gtgggcctctggtttggggcga

SEQ ID NO: 5667497 - DNA, 15 bp, Homo sapiens
gtgggcctggcctga

SEQ ID NO: 5667498 - DNA, 19 bp, Homo sapiens
gtgggcctggcctgagctg

SEQ ID NO: 5667499 - DNA, 20 bp, Homo sapiens
gtgggcctggcctgagctgg

SEQ ID NO: 5667500 - DNA, 14 bp, Homo sapiens
gtgggcctggcggc

SEQ ID NO: 5667501 - DNA, 20 bp, Homo sapiens
gtgggcctgggctcctggac

SEQ ID NO: 5667502 - DNA, 18 bp, Homo sapiens
gtgggcctggtagcacat

SEQ ID NO: 5667503 - DNA, 15 bp, Homo sapiens
gtgggcctgtgtgtg

SEQ ID NO: 5667504 - DNA, 14 bp, Homo sapiens
gtgggccttccatg

SEQ ID NO: 5667505 - DNA, 16 bp, Homo sapiens
gtgggccttttgctca

SEQ ID NO: 5667506 - DNA, 13 bp, Homo sapiens
gtgggcgaggcct

SEQ ID NO: 5667507 - DNA, 16 bp, Homo sapiens
gtgggcgcaaaggtgc

SEQ ID NO: 5667508 - DNA, 17 bp, Homo sapiens
gtgggcgcccaccctgg

SEQ ID NO: 5667509 - DNA, 19 bp, Homo sapiens
gtgggcgcccaccctgggc

SEQ ID NO: 5667510 - DNA, 20 bp, Homo sapiens
gtgggcgctctccctacctt

SEQ ID NO: 5667511 - DNA, 22 bp, Homo sapiens
gtgggcggatcacaaggtcagg

SEQ ID NO: 5667512 - DNA, 13 bp, Homo sapiens
gtgggcggcagag

SEQ ID NO: 5667513 - DNA, 19 bp, Homo sapiens
gtgggcggctcctggtgct

SEQ ID NO: 5667514 - DNA, 19 bp, Homo sapiens
gtgggcgggcagcacagca

SEQ ID NO: 5667515 - DNA, 22 bp, Homo sapiens
gtgggcgtgagacctgcccctc

SEQ ID NO: 5667516 - DNA, 17 bp, Homo sapiens
gtgggcgtggtcactgc

SEQ ID NO: 5667517 - DNA, 20 bp, Homo sapiens
gtgggcgttgggagcctagc

SEQ ID NO: 5667518 - DNA, 24 bp, Homo sapiens
gtgggcgtttggggccctctatgc

SEQ ID NO: 5667519 - DNA, 12 bp, Homo sapiens
gtgggctaagca

SEQ ID NO: 5667520 - DNA, 15 bp, Homo sapiens
gtgggctagttgggc

SEQ ID NO: 5667521 - DNA, 22 bp, Homo sapiens
gtgggctcacaccggcactgtg

SEQ ID NO: 5667522 - DNA, 20 bp, Homo sapiens
gtgggctcagatcctgggca

SEQ ID NO: 5667523 - DNA, 17 bp, Homo sapiens
gtgggctcagcagggct

SEQ ID NO: 5667524 - DNA, 20 bp, Homo sapiens
gtgggctcccctcttcctct

SEQ ID NO: 5667525 - DNA, 14 bp, Homo sapiens
gtgggctccctgac

SEQ ID NO: 5667526 - DNA, 14 bp, Homo sapiens
gtgggctccctggc

SEQ ID NO: 5667527 - DNA, 13 bp, Homo sapiens
gtgggctcccttc

SEQ ID NO: 5667528 - DNA, 11 bp, Homo sapiens
gtgggctcctg

SEQ ID NO: 5667529 - DNA, 13 bp, Homo sapiens
gtgggctcctggc

SEQ ID NO: 5667530 - DNA, 19 bp, Homo sapiens
gtgggctctggctccctgg

SEQ ID NO: 5667531 - DNA, 23 bp, Homo sapiens
gtgggctgaagggaagcccagcc

SEQ ID NO: 5667532 - DNA, 15 bp, Homo sapiens
gtgggctgagccctg

SEQ ID NO: 5667533 - DNA, 13 bp, Homo sapiens
gtgggctgatggc

SEQ ID NO: 5667534 - DNA, 10 bp, Homo sapiens
gtgggctgca

SEQ ID NO: 5667535 - DNA, 17 bp, Homo sapiens
gtgggctgcacgctccc

SEQ ID NO: 5667536 - DNA, 19 bp, Homo sapiens
gtgggctgcacgctcccct

SEQ ID NO: 5667537 - DNA, 13 bp, Homo sapiens
gtgggctgcagca

SEQ ID NO: 5667538 - DNA, 15 bp, Homo sapiens
gtgggctgcatctgg

SEQ ID NO: 5667539 - DNA, 17 bp, Homo sapiens
gtgggctgctgcagtga

SEQ ID NO: 5667540 - DNA, 17 bp, Homo sapiens
gtgggctggacttctac

SEQ ID NO: 5667541 - DNA, 17 bp, Homo sapiens
gtgggctggcccagcca

SEQ ID NO: 5667542 - DNA, 16 bp, Homo sapiens
gtgggctggccgctgt

SEQ ID NO: 5667543 - DNA, 17 bp, Homo sapiens
gtgggctggccgctgtg

SEQ ID NO: 5667544 - DNA, 19 bp, Homo sapiens
gtgggctggccgctgtgcc

SEQ ID NO: 5667545 - DNA, 18 bp, Homo sapiens
gtgggctgggcccaccca

SEQ ID NO: 5667546 - DNA, 20 bp, Homo sapiens
gtgggctgggccctctcttc

SEQ ID NO: 5667547 - DNA, 20 bp, Homo sapiens
gtgggctgggccctctgtcc

SEQ ID NO: 5667548 - DNA, 14 bp, Homo sapiens
gtgggctggggact

SEQ ID NO: 5667549 - DNA, 12 bp, Homo sapiens
gtgggctggggc

SEQ ID NO: 5667550 - DNA, 13 bp, Homo sapiens
gtgggctggtgcc

SEQ ID NO: 5667551 - DNA, 11 bp, Homo sapiens
gtgggctgtgg

SEQ ID NO: 5667552 - DNA, 21 bp, Homo sapiens
gtgggctgtgttgactgctgc

SEQ ID NO: 5667553 - DNA, 12 bp, Homo sapiens
gtgggctgttca

SEQ ID NO: 5667554 - DNA, 17 bp, Homo sapiens
gtgggctgttcagcttc

SEQ ID NO: 5667555 - DNA, 16 bp, Homo sapiens
gtgggcttatgtctct

SEQ ID NO: 5667556 - DNA, 21 bp, Homo sapiens
gtgggcttatgtctctgcctt

SEQ ID NO: 5667557 - DNA, 16 bp, Homo sapiens
gtgggcttcagggcag

SEQ ID NO: 5667558 - DNA, 23 bp, Homo sapiens
gtgggcttcccagtggctgctgc

SEQ ID NO: 5667559 - DNA, 21 bp, Homo sapiens
gtgggcttcctgcccttccct

SEQ ID NO: 5667560 - DNA, 17 bp, Homo sapiens
gtgggcttcctgctggg

SEQ ID NO: 5667561 - DNA, 20 bp, Homo sapiens
gtgggcttcctgctgggact

SEQ ID NO: 5667562 - DNA, 16 bp, Homo sapiens
gtgggcttctgcgtcc

SEQ ID NO: 5667563 - DNA, 20 bp, Homo sapiens
gtgggcttctgcgtccacca

SEQ ID NO: 5667564 - DNA, 18 bp, Homo sapiens
gtgggctttaaaagaaaa

SEQ ID NO: 5667565 - DNA, 21 bp, Homo sapiens
gtgggcttttccctgggtgga

SEQ ID NO: 5667566 - DNA, 16 bp, Homo sapiens
gtggggaacacagcta

SEQ ID NO: 5667567 - DNA, 23 bp, Homo sapiens
gtggggaacatggctggcctggt

SEQ ID NO: 5667568 - DNA, 14 bp, Homo sapiens
gtggggaagagagc

SEQ ID NO: 5667569 - DNA, 17 bp, Homo sapiens
gtggggaagagagcctg

SEQ ID NO: 5667570 - DNA, 23 bp, Homo sapiens
gtggggaagcaagacgtcctgga

SEQ ID NO: 5667571 - DNA, 13 bp, Homo sapiens
gtggggaaggagg

SEQ ID NO: 5667572 - DNA, 16 bp, Homo sapiens
gtggggaaggggtgca

SEQ ID NO: 5667573 - DNA, 17 bp, Homo sapiens
gtggggaatgggcaggt

SEQ ID NO: 5667574 - DNA, 18 bp, Homo sapiens
gtggggacacagcagtga

SEQ ID NO: 5667575 - DNA, 15 bp, Homo sapiens
gtggggacagaccag

SEQ ID NO: 5667576 - DNA, 15 bp, Homo sapiens
gtggggacagggagg

SEQ ID NO: 5667577 - DNA, 14 bp, Homo sapiens
gtggggacagggct

SEQ ID NO: 5667578 - DNA, 18 bp, Homo sapiens
gtggggacccaggctccg

SEQ ID NO: 5667579 - DNA, 15 bp, Homo sapiens
gtggggaccccaccc

SEQ ID NO: 5667580 - DNA, 17 bp, Homo sapiens
gtggggacctcagcctg

SEQ ID NO: 5667581 - DNA, 18 bp, Homo sapiens
gtggggacctcagcctgc

SEQ ID NO: 5667582 - DNA, 19 bp, Homo sapiens
gtggggacctcagcctgca

SEQ ID NO: 5667583 - DNA, 15 bp, Homo sapiens
gtggggactgaacct

SEQ ID NO: 5667584 - DNA, 13 bp, Homo sapiens
gtggggacttctg

SEQ ID NO: 5667585 - DNA, 17 bp, Homo sapiens
gtggggagactgggctg

SEQ ID NO: 5667586 - DNA, 21 bp, Homo sapiens
gtggggagagacgggccctgg

SEQ ID NO: 5667587 - DNA, 21 bp, Homo sapiens
gtggggagcggagcttggccc

SEQ ID NO: 5667588 - DNA, 23 bp, Homo sapiens
gtggggagcggagcttggccctg

SEQ ID NO: 5667589 - DNA, 12 bp, Homo sapiens
gtggggaggaga

SEQ ID NO: 5667590 - DNA, 14 bp, Homo sapiens
gtggggaggagaga

SEQ ID NO: 5667591 - DNA, 16 bp, Homo sapiens
gtggggaggagagagg

SEQ ID NO: 5667592 - DNA, 17 bp, Homo sapiens
gtggggaggaggaagcc

SEQ ID NO: 5667593 - DNA, 17 bp, Homo sapiens
gtggggaggcagctcca

SEQ ID NO: 5667594 - DNA, 14 bp, Homo sapiens
gtggggagggcagg

SEQ ID NO: 5667595 - DNA, 21 bp, Homo sapiens
tatatggaataagtgtacata

SEQ ID NO: 5667596 - DNA, 12 bp, Homo sapiens
tatatggaccta

SEQ ID NO: 5667597 - DNA, 21 bp, Homo sapiens
tatatggaggattctttcccc

SEQ ID NO: 5667598 - DNA, 19 bp, Homo sapiens
tatatggataatctgagca

SEQ ID NO: 5667599 - DNA, 22 bp, Homo sapiens
tatatggatgattcagaaattg

SEQ ID NO: 5667600 - DNA, 16 bp, Homo sapiens
tatatggcccagcctt

SEQ ID NO: 5667601 - DNA, 17 bp, Homo sapiens
tatatggcctcaagatc

SEQ ID NO: 5667602 - DNA, 21 bp, Homo sapiens
tatatgggcttttacctgtgc

SEQ ID NO: 5667603 - DNA, 23 bp, Homo sapiens
tatatgggggaaaattattttga

SEQ ID NO: 5667604 - DNA, 18 bp, Homo sapiens
tatatggtatatatacat

SEQ ID NO: 5667605 - DNA, 18 bp, Homo sapiens
tatatggtccactggttt

SEQ ID NO: 5667606 - DNA, 20 bp, Homo sapiens
tatatggtggtaataaggga

SEQ ID NO: 5667607 - DNA, 15 bp, Homo sapiens
tatatgtaaatatac

SEQ ID NO: 5667608 - DNA, 16 bp, Homo sapiens
tatatgtaaatgtgtt

SEQ ID NO: 5667609 - DNA, 14 bp, Homo sapiens
tatatgtaacagtt

SEQ ID NO: 5667610 - DNA, 14 bp, Homo sapiens
tatatgtaacttca

SEQ ID NO: 5667611 - DNA, 16 bp, Homo sapiens
tatatgtaacttcaga

SEQ ID NO: 5667612 - DNA, 19 bp, Homo sapiens
tatatgtaacttcagatgt

SEQ ID NO: 5667613 - DNA, 21 bp, Homo sapiens
tatatgtaacttcagatgttt

SEQ ID NO: 5667614 - DNA, 19 bp, Homo sapiens
tatatgtaatatatacata

SEQ ID NO: 5667615 - DNA, 21 bp, Homo sapiens
tatatgtacagtttattgata

SEQ ID NO: 5667616 - DNA, 22 bp, Homo sapiens
tatatgtaccctctgaaataca

SEQ ID NO: 5667617 - DNA, 19 bp, Homo sapiens
tatatgtaccgtaggcttt

SEQ ID NO: 5667618 - DNA, 13 bp, Homo sapiens
tatatgtacttgt

SEQ ID NO: 5667619 - DNA, 19 bp, Homo sapiens
tatatgtacttgtcaaaga

SEQ ID NO: 5667620 - DNA, 18 bp, Homo sapiens
tatatgtagatgtatgca

SEQ ID NO: 5667621 - DNA, 20 bp, Homo sapiens
tatatgtagatgtatgcaca

SEQ ID NO: 5667622 - DNA, 20 bp, Homo sapiens
tatatgtataatatatatct

SEQ ID NO: 5667623 - DNA, 15 bp, Homo sapiens
tatatgtatatctgt

SEQ ID NO: 5667624 - DNA, 19 bp, Homo sapiens
tatatgtatatctttgcac

SEQ ID NO: 5667625 - DNA, 20 bp, Homo sapiens
tatatgtatatctttgcact

SEQ ID NO: 5667626 - DNA, 12 bp, Homo sapiens
tatatgtatatg

SEQ ID NO: 5667627 - DNA, 17 bp, Homo sapiens
tatatgtatatgtatat

SEQ ID NO: 5667628 - DNA, 22 bp, Homo sapiens
tatatgtatatttaccaagatt

SEQ ID NO: 5667629 - DNA, 21 bp, Homo sapiens
tatatgtatatttttttaatt

SEQ ID NO: 5667630 - DNA, 22 bp, Homo sapiens
tatatgtatctacaatacatat

SEQ ID NO: 5667631 - DNA, 12 bp, Homo sapiens
tatatgtatgta

SEQ ID NO: 5667632 - DNA, 13 bp, Homo sapiens
tatatgtatgtgt

SEQ ID NO: 5667633 - DNA, 22 bp, Homo sapiens
tatatgtatgtgtttagaattg

SEQ ID NO: 5667634 - DNA, 19 bp, Homo sapiens
tatatgtattatttataat

SEQ ID NO: 5667635 - DNA, 14 bp, Homo sapiens
tatatgtatttaag

SEQ ID NO: 5667636 - DNA, 17 bp, Homo sapiens
tatatgtatttttatat

SEQ ID NO: 5667637 - DNA, 16 bp, Homo sapiens
tatatgtattttttga

SEQ ID NO: 5667638 - DNA, 15 bp, Homo sapiens
tatatgtcaaaaata

SEQ ID NO: 5667639 - DNA, 15 bp, Homo sapiens
tatatgtcatttact

SEQ ID NO: 5667640 - DNA, 19 bp, Homo sapiens
tatatgtcctattcattca

SEQ ID NO: 5667641 - DNA, 13 bp, Homo sapiens
tatatgtccttgg

SEQ ID NO: 5667642 - DNA, 19 bp, Homo sapiens
tatatgtctgataatgatt

SEQ ID NO: 5667643 - DNA, 14 bp, Homo sapiens
tatatgtctgtgtg

SEQ ID NO: 5667644 - DNA, 11 bp, Homo sapiens
tatatgtcttg

SEQ ID NO: 5667645 - DNA, 18 bp, Homo sapiens
tatatgtgaaaggatatg

SEQ ID NO: 5667646 - DNA, 16 bp, Homo sapiens
tatatgtgaactttct

SEQ ID NO: 5667647 - DNA, 22 bp, Homo sapiens
tatatgtgaatcctcttcttta

SEQ ID NO: 5667648 - DNA, 14 bp, Homo sapiens
tatatgtgagaaat

SEQ ID NO: 5667649 - DNA, 18 bp, Homo sapiens
tatatgtgattttcaaat

SEQ ID NO: 5667650 - DNA, 20 bp, Homo sapiens
tatatgtgcagtattttatt

SEQ ID NO: 5667651 - DNA, 18 bp, Homo sapiens
tatatgtgcagtcttgct

SEQ ID NO: 5667652 - DNA, 23 bp, Homo sapiens
tatatgtggtttggatgtgtgct

SEQ ID NO: 5667653 - DNA, 17 bp, Homo sapiens
tatatgtgtaatttttt

SEQ ID NO: 5667654 - DNA, 15 bp, Homo sapiens
tatatgtgtatacat

SEQ ID NO: 5667655 - DNA, 22 bp, Homo sapiens
tatatgtgtgtttaaataaagt

SEQ ID NO: 5667656 - DNA, 23 bp, Homo sapiens
tatatgtgtgtttaaataaagta

SEQ ID NO: 5667657 - DNA, 15 bp, Homo sapiens
tatatgtgttgaaaa

SEQ ID NO: 5667658 - DNA, 16 bp, Homo sapiens
tatatgtgttgaaaac

SEQ ID NO: 5667659 - DNA, 18 bp, Homo sapiens
tatatgtgtttttcacat

SEQ ID NO: 5667660 - DNA, 22 bp, Homo sapiens
tatatgttatggcttattgtgt

SEQ ID NO: 5667661 - DNA, 18 bp, Homo sapiens
tatatgttctgcaagaat

SEQ ID NO: 5667662 - DNA, 12 bp, Homo sapiens
tatatgttgaat

SEQ ID NO: 5667663 - DNA, 15 bp, Homo sapiens
tatatgttgtaataa

SEQ ID NO: 5667664 - DNA, 16 bp, Homo sapiens
tatatgtttacacaat

SEQ ID NO: 5667665 - DNA, 18 bp, Homo sapiens
tatatgtttacacaatta

SEQ ID NO: 5667666 - DNA, 23 bp, Homo sapiens
tatatgtttaccttttaattaat

SEQ ID NO: 5667667 - DNA, 14 bp, Homo sapiens
tatatgtttataca

SEQ ID NO: 5667668 - DNA, 18 bp, Homo sapiens
tatatgtttatacacaca

SEQ ID NO: 5667669 - DNA, 14 bp, Homo sapiens
tatatgtttatata

SEQ ID NO: 5667670 - DNA, 22 bp, Homo sapiens
tatatgtttgtggaatggattt

SEQ ID NO: 5667671 - DNA, 19 bp, Homo sapiens
tatatgttttaagaggcag

SEQ ID NO: 5667672 - DNA, 14 bp, Homo sapiens
tatatgttttgaga

SEQ ID NO: 5667673 - DNA, 15 bp, Homo sapiens
tatatgttttgagaa

SEQ ID NO: 5667674 - DNA, 18 bp, Homo sapiens
tatattaaaaaagagaca

SEQ ID NO: 5667675 - DNA, 13 bp, Homo sapiens
tatattaaaaata

SEQ ID NO: 5667676 - DNA, 17 bp, Homo sapiens
tatattaaaaatggtaa

SEQ ID NO: 5667677 - DNA, 14 bp, Homo sapiens
tatattaaaacaat

SEQ ID NO: 5667678 - DNA, 15 bp, Homo sapiens
tatattaaaataagc

SEQ ID NO: 5667679 - DNA, 16 bp, Homo sapiens
tatattaaaatagcat

SEQ ID NO: 5667680 - DNA, 24 bp, Homo sapiens
tatattaaaatagcatactgtgta

SEQ ID NO: 5667681 - DNA, 21 bp, Homo sapiens
tatattaaaattccaaattca

SEQ ID NO: 5667682 - DNA, 22 bp, Homo sapiens
tatattaaacaaagtttcagag

SEQ ID NO: 5667683 - DNA, 12 bp, Homo sapiens
tatattaaacat

SEQ ID NO: 5667684 - DNA, 22 bp, Homo sapiens
tatattaaacatacataataca

SEQ ID NO: 5667685 - DNA, 13 bp, Homo sapiens
tatattaaagaaa

SEQ ID NO: 5667686 - DNA, 16 bp, Homo sapiens
tatattaaagaaaaac

SEQ ID NO: 5667687 - DNA, 18 bp, Homo sapiens
tatattaaagaaaaactt

SEQ ID NO: 5667688 - DNA, 22 bp, Homo sapiens
gtttgcttaaaatatgtgaagt

SEQ ID NO: 5667689 - DNA, 17 bp, Homo sapiens
gtttgcttaaacaaagt

SEQ ID NO: 5667690 - DNA, 21 bp, Homo sapiens
gtttgcttaaacaaagtgact

SEQ ID NO: 5667691 - DNA, 17 bp, Homo sapiens
gtttgcttaatttcctt

SEQ ID NO: 5667692 - DNA, 14 bp, Homo sapiens
gtttgcttacagtg

SEQ ID NO: 5667693 - DNA, 14 bp, Homo sapiens
gtttgcttattgtt

SEQ ID NO: 5667694 - DNA, 16 bp, Homo sapiens
gtttgcttattgttcc

SEQ ID NO: 5667695 - DNA, 17 bp, Homo sapiens
gtttgcttattgttcca

SEQ ID NO: 5667696 - DNA, 18 bp, Homo sapiens
gtttgcttattgttccaa

SEQ ID NO: 5667697 - DNA, 16 bp, Homo sapiens
gtttgcttattttatt

SEQ ID NO: 5667698 - DNA, 19 bp, Homo sapiens
gtttgcttcaactgtctcc

SEQ ID NO: 5667699 - DNA, 17 bp, Homo sapiens
gtttgcttcataaatga

SEQ ID NO: 5667700 - DNA, 13 bp, Homo sapiens
gtttgcttctaaa

SEQ ID NO: 5667701 - DNA, 20 bp, Homo sapiens
gtttgcttggaaattccttg

SEQ ID NO: 5667702 - DNA, 21 bp, Homo sapiens
gtttgctttctgatcaaggcc

SEQ ID NO: 5667703 - DNA, 15 bp, Homo sapiens
gtttggaaaactaac

SEQ ID NO: 5667704 - DNA, 22 bp, Homo sapiens
gtttggaaaagctaagtagaaa

SEQ ID NO: 5667705 - DNA, 21 bp, Homo sapiens
gtttggaaaccacagtcagtg

SEQ ID NO: 5667706 - DNA, 20 bp, Homo sapiens
gtttggaaatggggagctgg

SEQ ID NO: 5667707 - DNA, 21 bp, Homo sapiens
gtttggaaattgattttgaac

SEQ ID NO: 5667708 - DNA, 23 bp, Homo sapiens
gtttggaacggcaaaaaaaaatt

SEQ ID NO: 5667709 - DNA, 16 bp, Homo sapiens
gtttggaatattaaaa

SEQ ID NO: 5667710 - DNA, 13 bp, Homo sapiens
gtttggaatgctt

SEQ ID NO: 5667711 - DNA, 19 bp, Homo sapiens
gtttggacaaaatggaata

SEQ ID NO: 5667712 - DNA, 22 bp, Homo sapiens
gtttggacagacccacccccag

SEQ ID NO: 5667713 - DNA, 15 bp, Homo sapiens
gtttggaccccagct

SEQ ID NO: 5667714 - DNA, 16 bp, Homo sapiens
gtttggaccccagctg

SEQ ID NO: 5667715 - DNA, 14 bp, Homo sapiens
gtttggactgattt

SEQ ID NO: 5667716 - DNA, 21 bp, Homo sapiens
gtttggactgcagaagcaagg

SEQ ID NO: 5667717 - DNA, 13 bp, Homo sapiens
gtttggagacaga

SEQ ID NO: 5667718 - DNA, 21 bp, Homo sapiens
gtttggaggagcaaaggctga

SEQ ID NO: 5667719 - DNA, 13 bp, Homo sapiens
gtttggaggcccc

SEQ ID NO: 5667720 - DNA, 18 bp, Homo sapiens
gtttggatacatctgctg

SEQ ID NO: 5667721 - DNA, 21 bp, Homo sapiens
gtttggatacatctgctgtgt

SEQ ID NO: 5667722 - DNA, 23 bp, Homo sapiens
gtttggcaaaactcaggcagaag

SEQ ID NO: 5667723 - DNA, 15 bp, Homo sapiens
gtttggcaacctttg

SEQ ID NO: 5667724 - DNA, 19 bp, Homo sapiens
gtttggcaatagtttgcat

SEQ ID NO: 5667725 - DNA, 22 bp, Homo sapiens
gtttggcatgtaaatgtaaact

SEQ ID NO: 5667726 - DNA, 14 bp, Homo sapiens
gtttggccagggag

SEQ ID NO: 5667727 - DNA, 15 bp, Homo sapiens
gtttggccagggagg

SEQ ID NO: 5667728 - DNA, 13 bp, Homo sapiens
gtttggcccaagt

SEQ ID NO: 5667729 - DNA, 14 bp, Homo sapiens
gtttggccctggag

SEQ ID NO: 5667730 - DNA, 15 bp, Homo sapiens
gtttggccctggagc

SEQ ID NO: 5667731 - DNA, 17 bp, Homo sapiens
gtttggccctggagcca

SEQ ID NO: 5667732 - DNA, 19 bp, Homo sapiens
gtttggctgtgtctaaact

SEQ ID NO: 5667733 - DNA, 14 bp, Homo sapiens
gtttggcttcctcc

SEQ ID NO: 5667734 - DNA, 15 bp, Homo sapiens
gtttgggaaagatgg

SEQ ID NO: 5667735 - DNA, 17 bp, Homo sapiens
gtttgggaaaggcaggg

SEQ ID NO: 5667736 - DNA, 21 bp, Homo sapiens
gtttgggaagagcttagaaac

SEQ ID NO: 5667737 - DNA, 12 bp, Homo sapiens
gtttgggaaggt

SEQ ID NO: 5667738 - DNA, 21 bp, Homo sapiens
gtttgggagaacacatttcta

SEQ ID NO: 5667739 - DNA, 15 bp, Homo sapiens
gtttgggagccagga

SEQ ID NO: 5667740 - DNA, 16 bp, Homo sapiens
gtttgggagccaggac

SEQ ID NO: 5667741 - DNA, 22 bp, Homo sapiens
gtttgggagccaggactcccag

SEQ ID NO: 5667742 - DNA, 22 bp, Homo sapiens
gtttgggagctgctgggtggca

SEQ ID NO: 5667743 - DNA, 15 bp, Homo sapiens
gtttgggagtcaggc

SEQ ID NO: 5667744 - DNA, 19 bp, Homo sapiens
gtttgggatcctattgaac

SEQ ID NO: 5667745 - DNA, 13 bp, Homo sapiens
gtttgggcagagc

SEQ ID NO: 5667746 - DNA, 14 bp, Homo sapiens
gtttgggcagtgga

SEQ ID NO: 5667747 - DNA, 18 bp, Homo sapiens
gtttgggcagtggagagg

SEQ ID NO: 5667748 - DNA, 22 bp, Homo sapiens
gtttgggccactgcactctagc

SEQ ID NO: 5667749 - DNA, 12 bp, Homo sapiens
gtttgggctgga

SEQ ID NO: 5667750 - DNA, 12 bp, Homo sapiens
gtttggggagaa

SEQ ID NO: 5667751 - DNA, 13 bp, Homo sapiens
gtttggggagaaa

SEQ ID NO: 5667752 - DNA, 18 bp, Homo sapiens
gtttggggcaagtcatgt

SEQ ID NO: 5667753 - DNA, 12 bp, Homo sapiens
gtttgggggaaa

SEQ ID NO: 5667754 - DNA, 21 bp, Homo sapiens
gtttgggggaaaaaaaagaaa

SEQ ID NO: 5667755 - DNA, 14 bp, Homo sapiens
gtttgggggaactt

SEQ ID NO: 5667756 - DNA, 20 bp, Homo sapiens
gtttgggggacgcccagccc

SEQ ID NO: 5667757 - DNA, 20 bp, Homo sapiens
gtttgggggacgtttctcat

SEQ ID NO: 5667758 - DNA, 18 bp, Homo sapiens
gtttgggggcgccctctc

SEQ ID NO: 5667759 - DNA, 22 bp, Homo sapiens
gtttgggtatcctgcccagtgt

SEQ ID NO: 5667760 - DNA, 17 bp, Homo sapiens
gtttgggttctctgctg

SEQ ID NO: 5667761 - DNA, 23 bp, Homo sapiens
gtttggtacagttcataattcac

SEQ ID NO: 5667762 - DNA, 23 bp, Homo sapiens
gtttggtctgggacttccttgct

SEQ ID NO: 5667763 - DNA, 17 bp, Homo sapiens
gtttggtgtttttacag

SEQ ID NO: 5667764 - DNA, 14 bp, Homo sapiens
gtttggttcctctc

SEQ ID NO: 5667765 - DNA, 18 bp, Homo sapiens
gtttggttcctctctggt

SEQ ID NO: 5667766 - DNA, 14 bp, Homo sapiens
gtttggttgtaaat

SEQ ID NO: 5667767 - DNA, 15 bp, Homo sapiens
gtttggtttacattt

SEQ ID NO: 5667768 - DNA, 16 bp, Homo sapiens
gtttggtttacattta

SEQ ID NO: 5667769 - DNA, 20 bp, Homo sapiens
gtttggtttacatttaaagc

SEQ ID NO: 5667770 - DNA, 17 bp, Homo sapiens
gtttggtttgacttgtt

SEQ ID NO: 5667771 - DNA, 21 bp, Homo sapiens
gtttggttttacattttagtt

SEQ ID NO: 5667772 - DNA, 16 bp, Homo sapiens
tatattgccagtatat

SEQ ID NO: 5667773 - DNA, 17 bp, Homo sapiens
tatattgccagtatata

SEQ ID NO: 5667774 - DNA, 17 bp, Homo sapiens
tatattgcttagtaagt

SEQ ID NO: 5667775 - DNA, 18 bp, Homo sapiens
tatattggaattataaat

SEQ ID NO: 5667776 - DNA, 20 bp, Homo sapiens
tatattggaattataaatat

SEQ ID NO: 5667777 - DNA, 23 bp, Homo sapiens
tatattgggtgtagatttctgac

SEQ ID NO: 5667778 - DNA, 19 bp, Homo sapiens
tatattggtgtatattata

SEQ ID NO: 5667779 - DNA, 16 bp, Homo sapiens
tatattggtttgcaca

SEQ ID NO: 5667780 - DNA, 16 bp, Homo sapiens
tatattggttttatga

SEQ ID NO: 5667781 - DNA, 17 bp, Homo sapiens
tatattggttttatgat

SEQ ID NO: 5667782 - DNA, 19 bp, Homo sapiens
tatattggttttatgatga

SEQ ID NO: 5667783 - DNA, 23 bp, Homo sapiens
tatattggttttatgatgacgta

SEQ ID NO: 5667784 - DNA, 22 bp, Homo sapiens
tatattgtacaaatgtaagcaa

SEQ ID NO: 5667785 - DNA, 14 bp, Homo sapiens
tatattgtatattc

SEQ ID NO: 5667786 - DNA, 17 bp, Homo sapiens
tatattgtatattctgg

SEQ ID NO: 5667787 - DNA, 21 bp, Homo sapiens
tatattgtatattctggaaaa

SEQ ID NO: 5667788 - DNA, 17 bp, Homo sapiens
tatattgtatcatttga

SEQ ID NO: 5667789 - DNA, 19 bp, Homo sapiens
tatattgtcagatattttt

SEQ ID NO: 5667790 - DNA, 21 bp, Homo sapiens
tatattgtcctcccctatttt

SEQ ID NO: 5667791 - DNA, 18 bp, Homo sapiens
tatattgtgtttgtgtat

SEQ ID NO: 5667792 - DNA, 13 bp, Homo sapiens
tatattgttttct

SEQ ID NO: 5667793 - DNA, 19 bp, Homo sapiens
tatatttaaaaaattaaaa

SEQ ID NO: 5667794 - DNA, 23 bp, Homo sapiens
tatatttaaaaaattatggaata

SEQ ID NO: 5667795 - DNA, 15 bp, Homo sapiens
tatatttaaaaataa

SEQ ID NO: 5667796 - DNA, 17 bp, Homo sapiens
tatatttaaaaataagt

SEQ ID NO: 5667797 - DNA, 17 bp, Homo sapiens
tatatttaaaaattgtt

SEQ ID NO: 5667798 - DNA, 18 bp, Homo sapiens
tatatttaaaagtgtcaa

SEQ ID NO: 5667799 - DNA, 21 bp, Homo sapiens
tatatttaacttaacccagat

SEQ ID NO: 5667800 - DNA, 20 bp, Homo sapiens
tatatttaagcaacatcttt

SEQ ID NO: 5667801 - DNA, 16 bp, Homo sapiens
tatatttaatatgtca

SEQ ID NO: 5667802 - DNA, 15 bp, Homo sapiens
tatatttaatgataa

SEQ ID NO: 5667803 - DNA, 19 bp, Homo sapiens
tatatttaatgcattaaac

SEQ ID NO: 5667804 - DNA, 17 bp, Homo sapiens
tatatttaattaaagca

SEQ ID NO: 5667805 - DNA, 20 bp, Homo sapiens
tatatttaatttttacatga

SEQ ID NO: 5667806 - DNA, 12 bp, Homo sapiens
tatatttacaaa

SEQ ID NO: 5667807 - DNA, 21 bp, Homo sapiens
tatatttactaaaatggactg

SEQ ID NO: 5667808 - DNA, 14 bp, Homo sapiens
tatatttactgttt

SEQ ID NO: 5667809 - DNA, 18 bp, Homo sapiens
tatatttactgtttataa

SEQ ID NO: 5667810 - DNA, 19 bp, Homo sapiens
tatatttactgtttataat

SEQ ID NO: 5667811 - DNA, 21 bp, Homo sapiens
tatatttagaccctgtttcct

SEQ ID NO: 5667812 - DNA, 21 bp, Homo sapiens
tatatttagattgttaaaata

SEQ ID NO: 5667813 - DNA, 23 bp, Homo sapiens
tatatttagctccaaaccttcac

SEQ ID NO: 5667814 - DNA, 12 bp, Homo sapiens
tatatttaggaa

SEQ ID NO: 5667815 - DNA, 14 bp, Homo sapiens
tatatttaggattt

SEQ ID NO: 5667816 - DNA, 22 bp, Homo sapiens
tatatttagttacgtataatgc

SEQ ID NO: 5667817 - DNA, 13 bp, Homo sapiens
tatatttataaaa

SEQ ID NO: 5667818 - DNA, 14 bp, Homo sapiens
tatatttataaaat

SEQ ID NO: 5667819 - DNA, 12 bp, Homo sapiens
tatatttataac

SEQ ID NO: 5667820 - DNA, 16 bp, Homo sapiens
tatatttataactcat

SEQ ID NO: 5667821 - DNA, 15 bp, Homo sapiens
tatatttataaggaa

SEQ ID NO: 5667822 - DNA, 14 bp, Homo sapiens
tatatttatactct

SEQ ID NO: 5667823 - DNA, 14 bp, Homo sapiens
tatatttatgataa

SEQ ID NO: 5667824 - DNA, 18 bp, Homo sapiens
tatatttatgataactat

SEQ ID NO: 5667825 - DNA, 19 bp, Homo sapiens
tatatttattactgtaaga

SEQ ID NO: 5667826 - DNA, 12 bp, Homo sapiens
tatatttattga

SEQ ID NO: 5667827 - DNA, 12 bp, Homo sapiens
tatatttattgt

SEQ ID NO: 5667828 - DNA, 20 bp, Homo sapiens
tatatttcaaacattttgta

SEQ ID NO: 5667829 - DNA, 14 bp, Homo sapiens
tatatttcaataaa

SEQ ID NO: 5667830 - DNA, 20 bp, Homo sapiens
tatatttcacaggctgtaaa

SEQ ID NO: 5667831 - DNA, 21 bp, Homo sapiens
tatatttcacttttgttctgc

SEQ ID NO: 5667832 - DNA, 22 bp, Homo sapiens
tatatttcacttttgttctgct

SEQ ID NO: 5667833 - DNA, 14 bp, Homo sapiens
tatatttcagacat

SEQ ID NO: 5667834 - DNA, 15 bp, Homo sapiens
tatatttcagacatt

SEQ ID NO: 5667835 - DNA, 16 bp, Homo sapiens
tatatttcagacattt

SEQ ID NO: 5667836 - DNA, 16 bp, Homo sapiens
tatatttcagatgtaa

SEQ ID NO: 5667837 - DNA, 17 bp, Homo sapiens
tatatttccaaatattc

SEQ ID NO: 5667838 - DNA, 11 bp, Homo sapiens
tatatttcctt

SEQ ID NO: 5667839 - DNA, 22 bp, Homo sapiens
tatatttcctttatgtgaattt

SEQ ID NO: 5667840 - DNA, 16 bp, Homo sapiens
tatatttccttttgta

SEQ ID NO: 5667841 - DNA, 16 bp, Homo sapiens
tatatttctaaatgtt

SEQ ID NO: 5667842 - DNA, 13 bp, Homo sapiens
tatatttctatta

SEQ ID NO: 5667843 - DNA, 15 bp, Homo sapiens
tatatttctttaaac

SEQ ID NO: 5667844 - DNA, 14 bp, Homo sapiens
tatatttgaaactg

SEQ ID NO: 5667845 - DNA, 20 bp, Homo sapiens
tatatttgaaactgctaatt

SEQ ID NO: 5667846 - DNA, 16 bp, Homo sapiens
tatatttgaaagaagt

SEQ ID NO: 5667847 - DNA, 14 bp, Homo sapiens
tatatttgaaatag

SEQ ID NO: 5667848 - DNA, 21 bp, Homo sapiens
tatatttgagttgtgattgaa

SEQ ID NO: 5667849 - DNA, 22 bp, Homo sapiens
tatatttgagtttctttcagat

SEQ ID NO: 5667850 - DNA, 15 bp, Homo sapiens
tatatttgatacata

SEQ ID NO: 5667851 - DNA, 16 bp, Homo sapiens
tatatttgattatgta

SEQ ID NO: 5667852 - DNA, 13 bp, Homo sapiens
tatatttgattta

SEQ ID NO: 5667853 - DNA, 17 bp, Homo sapiens
tatatttgatttattaa

SEQ ID NO: 5667854 - DNA, 21 bp, Homo sapiens
tatatttgcaaaccctttgta

SEQ ID NO: 5667855 - DNA, 22 bp, Homo sapiens
tatatttgcagataattctgga

SEQ ID NO: 5667856 - DNA, 18 bp, Homo sapiens
tatatttgcattatgtat

SEQ ID NO: 5667857 - DNA, 22 bp, Homo sapiens
tatatttgctgcaaagagaaac

SEQ ID NO: 5667858 - DNA, 13 bp, Homo sapiens
tatatttgcttca

SEQ ID NO: 5667859 - DNA, 14 bp, Homo sapiens
tatatttgcttttt

SEQ ID NO: 5667860 - DNA, 11 bp, Homo sapiens
tatatttggaa

SEQ ID NO: 5667861 - DNA, 16 bp, Homo sapiens
tatatttggaaagaga

SEQ ID NO: 5667862 - DNA, 14 bp, Homo sapiens
tatatttgtaaaag

SEQ ID NO: 5667863 - DNA, 16 bp, Homo sapiens
tatatttgtaaaagct

SEQ ID NO: 5667864 - DNA, 22 bp, Homo sapiens
tatatttgtaaactacaaagta

SEQ ID NO: 5667865 - DNA, 13 bp, Homo sapiens
tatatttgtacaa

SEQ ID NO: 5667866 - DNA, 15 bp, Homo sapiens
tatatttgtacaaaa

SEQ ID NO: 5667867 - DNA, 17 bp, Homo sapiens
tatatttgtaggagaaa

SEQ ID NO: 5667868 - DNA, 16 bp, Homo sapiens
gtttgtttctttgaat

SEQ ID NO: 5667869 - DNA, 15 bp, Homo sapiens
gtttgtttctttgtg

SEQ ID NO: 5667870 - DNA, 11 bp, Homo sapiens
gtttgtttgtc

SEQ ID NO: 5667871 - DNA, 14 bp, Homo sapiens
gtttgtttgtctgt

SEQ ID NO: 5667872 - DNA, 13 bp, Homo sapiens
gtttgtttgttgc

SEQ ID NO: 5667873 - DNA, 12 bp, Homo sapiens
gtttgtttgttt

SEQ ID NO: 5667874 - DNA, 13 bp, Homo sapiens
gtttgttttcctt

SEQ ID NO: 5667875 - DNA, 14 bp, Homo sapiens
gtttgtttttgctt

SEQ ID NO: 5667876 - DNA, 16 bp, Homo sapiens
gtttgtttttgcttgt

SEQ ID NO: 5667877 - DNA, 16 bp, Homo sapiens
gtttgtttttgctttc

SEQ ID NO: 5667878 - DNA, 12 bp, Homo sapiens
gtttgttttttt

SEQ ID NO: 5667879 - DNA, 15 bp, Homo sapiens
gttttaaaaaaataa

SEQ ID NO: 5667880 - DNA, 20 bp, Homo sapiens
gttttaaaaaaataaaacat

SEQ ID NO: 5667881 - DNA, 15 bp, Homo sapiens
gttttaaaaagccag

SEQ ID NO: 5667882 - DNA, 22 bp, Homo sapiens
gttttaaaaaggaactgcagca

SEQ ID NO: 5667883 - DNA, 15 bp, Homo sapiens
gttttaaaaataagt

SEQ ID NO: 5667884 - DNA, 17 bp, Homo sapiens
gttttaaaaatgaagat

SEQ ID NO: 5667885 - DNA, 14 bp, Homo sapiens
gttttaaaataata

SEQ ID NO: 5667886 - DNA, 14 bp, Homo sapiens
gttttaaaatactg

SEQ ID NO: 5667887 - DNA, 12 bp, Homo sapiens
gttttaaaatct

SEQ ID NO: 5667888 - DNA, 11 bp, Homo sapiens
gttttaaaatg

SEQ ID NO: 5667889 - DNA, 16 bp, Homo sapiens
gttttaaaatgagaaa

SEQ ID NO: 5667890 - DNA, 23 bp, Homo sapiens
gttttaaaatgtgaggcaataag

SEQ ID NO: 5667891 - DNA, 14 bp, Homo sapiens
gttttaaaattaaa

SEQ ID NO: 5667892 - DNA, 23 bp, Homo sapiens
gttttaaacattaatagcagcct

SEQ ID NO: 5667893 - DNA, 21 bp, Homo sapiens
gttttaaacccaaaatatata

SEQ ID NO: 5667894 - DNA, 19 bp, Homo sapiens
gttttaaacctttaatgag

SEQ ID NO: 5667895 - DNA, 22 bp, Homo sapiens
gttttaaacctttaatgagaaa

SEQ ID NO: 5667896 - DNA, 20 bp, Homo sapiens
gttttaaagaagtccatgtg

SEQ ID NO: 5667897 - DNA, 15 bp, Homo sapiens
gttttaaagaagtct

SEQ ID NO: 5667898 - DNA, 14 bp, Homo sapiens
gttttaaagctaaa

SEQ ID NO: 5667899 - DNA, 22 bp, Homo sapiens
gttttaaagggtgcccatttgt

SEQ ID NO: 5667900 - DNA, 20 bp, Homo sapiens
gttttaaagttcattgcaat

SEQ ID NO: 5667901 - DNA, 13 bp, Homo sapiens
gttttaaatgtac

SEQ ID NO: 5667902 - DNA, 14 bp, Homo sapiens
gttttaaatgtaca

SEQ ID NO: 5667903 - DNA, 16 bp, Homo sapiens
gttttaaatgtacagt

SEQ ID NO: 5667904 - DNA, 12 bp, Homo sapiens
gttttaaattct

SEQ ID NO: 5667905 - DNA, 14 bp, Homo sapiens
gttttaaattctga

SEQ ID NO: 5667906 - DNA, 15 bp, Homo sapiens
gttttaaatttaaaa

SEQ ID NO: 5667907 - DNA, 22 bp, Homo sapiens
gttttaacaatttcctttatat

SEQ ID NO: 5667908 - DNA, 10 bp, Homo sapiens
gttttaacac

SEQ ID NO: 5667909 - DNA, 21 bp, Homo sapiens
gttttaacaccaacactgtaa

SEQ ID NO: 5667910 - DNA, 20 bp, Homo sapiens
gttttaaccagtacttctaa

SEQ ID NO: 5667911 - DNA, 20 bp, Homo sapiens
gttttaaccgcacatgcaca

SEQ ID NO: 5667912 - DNA, 21 bp, Homo sapiens
gttttaacctcaggttccaaa

SEQ ID NO: 5667913 - DNA, 18 bp, Homo sapiens
gttttaacctcccctctc

SEQ ID NO: 5667914 - DNA, 21 bp, Homo sapiens
gttttaacttatttatatgaa

SEQ ID NO: 5667915 - DNA, 15 bp, Homo sapiens
gttttaacttccagt

SEQ ID NO: 5667916 - DNA, 17 bp, Homo sapiens
gttttaactttaataca

SEQ ID NO: 5667917 - DNA, 17 bp, Homo sapiens
gttttaagcaaatgcat

SEQ ID NO: 5667918 - DNA, 17 bp, Homo sapiens
gttttaagctaaaatgt

SEQ ID NO: 5667919 - DNA, 19 bp, Homo sapiens
gttttaaggaaaaaagatt

SEQ ID NO: 5667920 - DNA, 16 bp, Homo sapiens
gttttaaggaagaaaa

SEQ ID NO: 5667921 - DNA, 22 bp, Homo sapiens
gttttaaggatgcttgtacata

SEQ ID NO: 5667922 - DNA, 18 bp, Homo sapiens
gttttaaggattctgcag

SEQ ID NO: 5667923 - DNA, 22 bp, Homo sapiens
gttttaagtgaaagtgaggaaa

SEQ ID NO: 5667924 - DNA, 19 bp, Homo sapiens
gttttaataagaacagatc

SEQ ID NO: 5667925 - DNA, 14 bp, Homo sapiens
gttttaatctgaaa

SEQ ID NO: 5667926 - DNA, 15 bp, Homo sapiens
gttttaatgtaattt

SEQ ID NO: 5667927 - DNA, 18 bp, Homo sapiens
gttttaattcaacatcaa

SEQ ID NO: 5667928 - DNA, 23 bp, Homo sapiens
gttttaattcaacatcaaaactt

SEQ ID NO: 5667929 - DNA, 20 bp, Homo sapiens
gttttaattccatgtcagat

SEQ ID NO: 5667930 - DNA, 21 bp, Homo sapiens
gttttaattccatgtcagata

SEQ ID NO: 5667931 - DNA, 20 bp, Homo sapiens
gttttaattgaaggaaagat

SEQ ID NO: 5667932 - DNA, 21 bp, Homo sapiens
gttttaatttatactggcatg

SEQ ID NO: 5667933 - DNA, 22 bp, Homo sapiens
gttttaatttatactggcatgc

SEQ ID NO: 5667934 - DNA, 20 bp, Homo sapiens
gttttacaagaattgtccat

SEQ ID NO: 5667935 - DNA, 17 bp, Homo sapiens
gttttacaataaaattt

SEQ ID NO: 5667936 - DNA, 16 bp, Homo sapiens
gttttacaatagttct

SEQ ID NO: 5667937 - DNA, 18 bp, Homo sapiens
gttttacaatgatttgta

SEQ ID NO: 5667938 - DNA, 18 bp, Homo sapiens
gttttacaatggctgggt

SEQ ID NO: 5667939 - DNA, 11 bp, Homo sapiens
gttttacactg

SEQ ID NO: 5667940 - DNA, 16 bp, Homo sapiens
gttttacagatttatt

SEQ ID NO: 5667941 - DNA, 14 bp, Homo sapiens
gttttacaggaaac

SEQ ID NO: 5667942 - DNA, 21 bp, Homo sapiens
gttttacaggaaacaaacctt

SEQ ID NO: 5667943 - DNA, 21 bp, Homo sapiens
gttttacagtgaatttctgat

SEQ ID NO: 5667944 - DNA, 20 bp, Homo sapiens
gttttacatcttttgggaag

SEQ ID NO: 5667945 - DNA, 21 bp, Homo sapiens
gttttacatttggattagaaa

SEQ ID NO: 5667946 - DNA, 19 bp, Homo sapiens
gttttaccttttgatgttc

SEQ ID NO: 5667947 - DNA, 20 bp, Homo sapiens
gttttactcctttttattca

SEQ ID NO: 5667948 - DNA, 18 bp, Homo sapiens
gttttactgcagctttgt

SEQ ID NO: 5667949 - DNA, 15 bp, Homo sapiens
gttttactgttttaa

SEQ ID NO: 5667950 - DNA, 17 bp, Homo sapiens
gttttacttttcacagt

SEQ ID NO: 5667951 - DNA, 16 bp, Homo sapiens
gttttctgggtgtcca

SEQ ID NO: 5667952 - DNA, 16 bp, Homo sapiens
gttttctgtaaataac

SEQ ID NO: 5667953 - DNA, 11 bp, Homo sapiens
gttttctgtag

SEQ ID NO: 5667954 - DNA, 16 bp, Homo sapiens
gttttctgtagactct

SEQ ID NO: 5667955 - DNA, 18 bp, Homo sapiens
gttttctgtagtcattta

SEQ ID NO: 5667956 - DNA, 14 bp, Homo sapiens
gttttctgttcttt

SEQ ID NO: 5667957 - DNA, 14 bp, Homo sapiens
gttttctgtttcta

SEQ ID NO: 5667958 - DNA, 15 bp, Homo sapiens
gttttctgtttgtaa

SEQ ID NO: 5667959 - DNA, 22 bp, Homo sapiens
gttttctgtttgtaaattattt

SEQ ID NO: 5667960 - DNA, 17 bp, Homo sapiens
gttttcttaaccatctt

SEQ ID NO: 5667961 - DNA, 22 bp, Homo sapiens
gttttcttcaagggaagaaaca

SEQ ID NO: 5667962 - DNA, 12 bp, Homo sapiens
gttttcttccca

SEQ ID NO: 5667963 - DNA, 15 bp, Homo sapiens
gttttcttcccatca

SEQ ID NO: 5667964 - DNA, 12 bp, Homo sapiens
gttttcttcctt

SEQ ID NO: 5667965 - DNA, 19 bp, Homo sapiens
gttttcttccttgtaaatt

SEQ ID NO: 5667966 - DNA, 15 bp, Homo sapiens
gttttcttctaatca

SEQ ID NO: 5667967 - DNA, 11 bp, Homo sapiens
gttttcttctt

SEQ ID NO: 5667968 - DNA, 17 bp, Homo sapiens
gttttcttggtggcaga

SEQ ID NO: 5667969 - DNA, 19 bp, Homo sapiens
gttttcttgtaaatgtttc

SEQ ID NO: 5667970 - DNA, 22 bp, Homo sapiens
gttttcttgttgctttgttgca

SEQ ID NO: 5667971 - DNA, 16 bp, Homo sapiens
gttttctttcctcctt

SEQ ID NO: 5667972 - DNA, 17 bp, Homo sapiens
gttttctttgctgtgcc

SEQ ID NO: 5667973 - DNA, 15 bp, Homo sapiens
gttttctttgtaaag

SEQ ID NO: 5667974 - DNA, 14 bp, Homo sapiens
gttttcttttaaga

SEQ ID NO: 5667975 - DNA, 16 bp, Homo sapiens
gttttcttttaatttt

SEQ ID NO: 5667976 - DNA, 15 bp, Homo sapiens
gttttcttttctgtg

SEQ ID NO: 5667977 - DNA, 21 bp, Homo sapiens
gttttctttttttagggagaa

SEQ ID NO: 5667978 - DNA, 14 bp, Homo sapiens
gttttgaaaagcta

SEQ ID NO: 5667979 - DNA, 15 bp, Homo sapiens
gttttgaaaagctat

SEQ ID NO: 5667980 - DNA, 14 bp, Homo sapiens
gttttgaaactaga

SEQ ID NO: 5667981 - DNA, 15 bp, Homo sapiens
gttttgaaactagaa

SEQ ID NO: 5667982 - DNA, 19 bp, Homo sapiens
gttttgaaattttctgtac

SEQ ID NO: 5667983 - DNA, 16 bp, Homo sapiens
gttttgaagattctat

SEQ ID NO: 5667984 - DNA, 17 bp, Homo sapiens
gttttgaataaaaagtg

SEQ ID NO: 5667985 - DNA, 19 bp, Homo sapiens
gttttgaataaattttcaa

SEQ ID NO: 5667986 - DNA, 12 bp, Homo sapiens
gttttgaatatt

SEQ ID NO: 5667987 - DNA, 21 bp, Homo sapiens
gttttgaatattaagctaaaa

SEQ ID NO: 5667988 - DNA, 18 bp, Homo sapiens
gttttgaatattactcct

SEQ ID NO: 5667989 - DNA, 15 bp, Homo sapiens
gttttgaatgtggat

SEQ ID NO: 5667990 - DNA, 12 bp, Homo sapiens
gttttgaatttt

SEQ ID NO: 5667991 - DNA, 21 bp, Homo sapiens
gttttgaattttgtttttatt

SEQ ID NO: 5667992 - DNA, 14 bp, Homo sapiens
gttttgacattttt

SEQ ID NO: 5667993 - DNA, 23 bp, Homo sapiens
gttttgacctttctaggttcaaa

SEQ ID NO: 5667994 - DNA, 14 bp, Homo sapiens
gttttgacttaaga

SEQ ID NO: 5667995 - DNA, 23 bp, Homo sapiens
gttttgacttgccactgccataa

SEQ ID NO: 5667996 - DNA, 13 bp, Homo sapiens
gttttgagcagac

SEQ ID NO: 5667997 - DNA, 12 bp, Homo sapiens
gttttgaggaat

SEQ ID NO: 5667998 - DNA, 13 bp, Homo sapiens
gttttgaggcggg

SEQ ID NO: 5667999 - DNA, 20 bp, Homo sapiens
gttttgataaagtagtaaaa

SEQ ID NO: 5668000 - DNA, 18 bp, Homo sapiens
gttttgatacttgtaact

SEQ ID NO: 5668001 - DNA, 19 bp, Homo sapiens
gttttgatacttgtaactt

SEQ ID NO: 5668002 - DNA, 16 bp, Homo sapiens
gttttgatctcagcat

SEQ ID NO: 5668003 - DNA, 17 bp, Homo sapiens
gttttgatgagaaaaaa

SEQ ID NO: 5668004 - DNA, 13 bp, Homo sapiens
gttttgattgaga

SEQ ID NO: 5668005 - DNA, 19 bp, Homo sapiens
gttttgattgcatattttg

SEQ ID NO: 5668006 - DNA, 20 bp, Homo sapiens
gttttgatttatatgtgtaa

SEQ ID NO: 5668007 - DNA, 14 bp, Homo sapiens
gttttgcacatttt

SEQ ID NO: 5668008 - DNA, 14 bp, Homo sapiens
gttttgcactgaca

SEQ ID NO: 5668009 - DNA, 13 bp, Homo sapiens
gttttgcactttt

SEQ ID NO: 5668010 - DNA, 14 bp, Homo sapiens
gttttgccaacatt

SEQ ID NO: 5668011 - DNA, 16 bp, Homo sapiens
gttttgccaacattgc

SEQ ID NO: 5668012 - DNA, 20 bp, Homo sapiens
gttttgccatgttggccagg

SEQ ID NO: 5668013 - DNA, 22 bp, Homo sapiens
gttttgccatgttggccaggct

SEQ ID NO: 5668014 - DNA, 20 bp, Homo sapiens
gttttgccctccctctctgc

SEQ ID NO: 5668015 - DNA, 22 bp, Homo sapiens
gttttgcctgtgactgtaaaga

SEQ ID NO: 5668016 - DNA, 21 bp, Homo sapiens
gttttgctaggtataaaaaat

SEQ ID NO: 5668017 - DNA, 17 bp, Homo sapiens
gttttgcttacaaagta

SEQ ID NO: 5668018 - DNA, 10 bp, Homo sapiens
gttttggaaa

SEQ ID NO: 5668019 - DNA, 16 bp, Homo sapiens
gttttggactccatct

SEQ ID NO: 5668020 - DNA, 16 bp, Homo sapiens
gttttggactctctgt

SEQ ID NO: 5668021 - DNA, 21 bp, Homo sapiens
gttttggagaaaaattacaga

SEQ ID NO: 5668022 - DNA, 21 bp, Homo sapiens
gttttggaggttctgaaatac

SEQ ID NO: 5668023 - DNA, 20 bp, Homo sapiens
gttttggcagccatgataat

SEQ ID NO: 5668024 - DNA, 15 bp, Homo sapiens
gttttggctctccca

SEQ ID NO: 5668025 - DNA, 15 bp, Homo sapiens
gttttggctgctctc

SEQ ID NO: 5668026 - DNA, 18 bp, Homo sapiens
gttttgggaaacactttg

SEQ ID NO: 5668027 - DNA, 14 bp, Homo sapiens
gttttgggatcagg

SEQ ID NO: 5668028 - DNA, 17 bp, Homo sapiens
gttttggggtcctgggc

SEQ ID NO: 5668029 - DNA, 18 bp, Homo sapiens
gttttgggtagctgccac

SEQ ID NO: 5668030 - DNA, 15 bp, Homo sapiens
gttttgggtatgttt

SEQ ID NO: 5668031 - DNA, 16 bp, Homo sapiens
gttttgggtgaatctt

SEQ ID NO: 5668032 - DNA, 18 bp, Homo sapiens
gttttgggtgaatcttga

SEQ ID NO: 5668033 - DNA, 18 bp, Homo sapiens
gttttgggttttcttccc

SEQ ID NO: 5668034 - DNA, 21 bp, Homo sapiens
gttttggtatctgttctttaa

SEQ ID NO: 5668035 - DNA, 21 bp, Homo sapiens
gttttggtccacttttccagt

SEQ ID NO: 5668036 - DNA, 17 bp, Homo sapiens
gttttggtcccctccct

SEQ ID NO: 5668037 - DNA, 15 bp, Homo sapiens
gttttggtgcctgcc

SEQ ID NO: 5668038 - DNA, 18 bp, Homo sapiens
gttttggtgcctgcctct

SEQ ID NO: 5668039 - DNA, 17 bp, Homo sapiens
gttttggtggttttagt

SEQ ID NO: 5668040 - DNA, 14 bp, Homo sapiens
gttttggttaagtt

SEQ ID NO: 5668041 - DNA, 14 bp, Homo sapiens
gttttgtaaaactg

SEQ ID NO: 5668042 - DNA, 15 bp, Homo sapiens
gttttgtaaaagaaa

SEQ ID NO: 5668043 - DNA, 14 bp, Homo sapiens
gttttgtaaaattc

SEQ ID NO: 5668044 - DNA, 19 bp, Homo sapiens
gttttgtaaaattccatgg

SEQ ID NO: 5668045 - DNA, 13 bp, Homo sapiens
gttttgtaaacat

SEQ ID NO: 5668046 - DNA, 12 bp, Homo sapiens
gttttgtaaatg

SEQ ID NO: 5668047 - DNA, 16 bp, Homo sapiens
gttttgtaaatgtact

SEQ ID NO: 5668048 - DNA, 23 bp, Homo sapiens
gttttgtaaatgtactggtaatt

SEQ ID NO: 5668049 - DNA, 16 bp, Homo sapiens
gttttgtaagatgctg

SEQ ID NO: 5668050 - DNA, 17 bp, Homo sapiens
gttttgtaagatgctgg

SEQ ID NO: 5668051 - DNA, 22 bp, Homo sapiens
tatcacccagaagaaaatagtg

SEQ ID NO: 5668052 - DNA, 20 bp, Homo sapiens
tatcacccagacataaagga

SEQ ID NO: 5668053 - DNA, 22 bp, Homo sapiens
tatcacccagacataaaggaaa

SEQ ID NO: 5668054 - DNA, 23 bp, Homo sapiens
tatcacccagacataaaggaaaa

SEQ ID NO: 5668055 - DNA, 13 bp, Homo sapiens
tatcacccaggct

SEQ ID NO: 5668056 - DNA, 23 bp, Homo sapiens
tatcaccccctccctacacacac

SEQ ID NO: 5668057 - DNA, 18 bp, Homo sapiens
tatcacccttccctgctc

SEQ ID NO: 5668058 - DNA, 19 bp, Homo sapiens
tatcaccgtgggctccctg

SEQ ID NO: 5668059 - DNA, 23 bp, Homo sapiens
tatcacctaagcacttctagaat

SEQ ID NO: 5668060 - DNA, 18 bp, Homo sapiens
tatcacctagcagcctca

SEQ ID NO: 5668061 - DNA, 18 bp, Homo sapiens
tatcacctagctgaatgt

SEQ ID NO: 5668062 - DNA, 16 bp, Homo sapiens
tatcacctcattctga

SEQ ID NO: 5668063 - DNA, 17 bp, Homo sapiens
tatcacctcattctgaa

SEQ ID NO: 5668064 - DNA, 18 bp, Homo sapiens
tatcacctcattctgaac

SEQ ID NO: 5668065 - DNA, 13 bp, Homo sapiens
tatcacctcccct

SEQ ID NO: 5668066 - DNA, 18 bp, Homo sapiens
tatcacctctcttcagcc

SEQ ID NO: 5668067 - DNA, 17 bp, Homo sapiens
tatcacctgaattatta

SEQ ID NO: 5668068 - DNA, 13 bp, Homo sapiens
tatcacctgtcat

SEQ ID NO: 5668069 - DNA, 22 bp, Homo sapiens
tatcaccttccaaacaaaagca

SEQ ID NO: 5668070 - DNA, 22 bp, Homo sapiens
tatcacgtctgacaaatgtgta

SEQ ID NO: 5668071 - DNA, 14 bp, Homo sapiens
tatcactaaaagca

SEQ ID NO: 5668072 - DNA, 15 bp, Homo sapiens
tatcactaaaagcat

SEQ ID NO: 5668073 - DNA, 15 bp, Homo sapiens
tatcactaagaaaga

SEQ ID NO: 5668074 - DNA, 13 bp, Homo sapiens
tatcactcaagcc

SEQ ID NO: 5668075 - DNA, 14 bp, Homo sapiens
tatcactctaaaaa

SEQ ID NO: 5668076 - DNA, 15 bp, Homo sapiens
tatcactctaaaaaa

SEQ ID NO: 5668077 - DNA, 20 bp, Homo sapiens
tatcactctaaaaaacattt

SEQ ID NO: 5668078 - DNA, 16 bp, Homo sapiens
tatcactctaatataa

SEQ ID NO: 5668079 - DNA, 18 bp, Homo sapiens
tatcactgaagcttttta

SEQ ID NO: 5668080 - DNA, 18 bp, Homo sapiens
tatcactgacacaaaaag

SEQ ID NO: 5668081 - DNA, 19 bp, Homo sapiens
tatcactggcaatatttgt

SEQ ID NO: 5668082 - DNA, 20 bp, Homo sapiens
tatcactggcaatatttgtt

SEQ ID NO: 5668083 - DNA, 11 bp, Homo sapiens
tatcactgtct

SEQ ID NO: 5668084 - DNA, 22 bp, Homo sapiens
tatcacttaaacttgcatcact

SEQ ID NO: 5668085 - DNA, 11 bp, Homo sapiens
tatcacttaat

SEQ ID NO: 5668086 - DNA, 20 bp, Homo sapiens
tatcacttccatgacataag

SEQ ID NO: 5668087 - DNA, 22 bp, Homo sapiens
tatcactttaactcaggaggca

SEQ ID NO: 5668088 - DNA, 11 bp, Homo sapiens
tatcactttgt

SEQ ID NO: 5668089 - DNA, 12 bp, Homo sapiens
tatcactttgta

SEQ ID NO: 5668090 - DNA, 15 bp, Homo sapiens
tatcacttttctggg

SEQ ID NO: 5668091 - DNA, 13 bp, Homo sapiens
tatcagaaaagta

SEQ ID NO: 5668092 - DNA, 14 bp, Homo sapiens
tatcagaaaagtag

SEQ ID NO: 5668093 - DNA, 16 bp, Homo sapiens
tatcagaaaagtagaa

SEQ ID NO: 5668094 - DNA, 14 bp, Homo sapiens
tatcagaactatgt

SEQ ID NO: 5668095 - DNA, 20 bp, Homo sapiens
tatcagaactatgtttttgt

SEQ ID NO: 5668096 - DNA, 13 bp, Homo sapiens
tatcagaactcct

SEQ ID NO: 5668097 - DNA, 21 bp, Homo sapiens
tatcagaagaccacaaaaatt

SEQ ID NO: 5668098 - DNA, 18 bp, Homo sapiens
tatcagaagcaaggaagt

SEQ ID NO: 5668099 - DNA, 17 bp, Homo sapiens
tatcagaataggaagat

SEQ ID NO: 5668100 - DNA, 14 bp, Homo sapiens
tatcagaatctgtg

SEQ ID NO: 5668101 - DNA, 16 bp, Homo sapiens
tatcagaatctgtgtg

SEQ ID NO: 5668102 - DNA, 10 bp, Homo sapiens
tatcagaatt

SEQ ID NO: 5668103 - DNA, 19 bp, Homo sapiens
tatcagaattgaaacactt

SEQ ID NO: 5668104 - DNA, 18 bp, Homo sapiens
tatcagacctctgatccc

SEQ ID NO: 5668105 - DNA, 13 bp, Homo sapiens
tatcagacctctt

SEQ ID NO: 5668106 - DNA, 15 bp, Homo sapiens
tatcagactcagttt

SEQ ID NO: 5668107 - DNA, 16 bp, Homo sapiens
tatcagactcagtttt

SEQ ID NO: 5668108 - DNA, 17 bp, Homo sapiens
tatcagacttcaccaaa

SEQ ID NO: 5668109 - DNA, 18 bp, Homo sapiens
tatcagacttcaccaaat

SEQ ID NO: 5668110 - DNA, 17 bp, Homo sapiens
tatcagagggtggagat

SEQ ID NO: 5668111 - DNA, 13 bp, Homo sapiens
tatcagaggtcta

SEQ ID NO: 5668112 - DNA, 16 bp, Homo sapiens
tatcagaggtctattt

SEQ ID NO: 5668113 - DNA, 21 bp, Homo sapiens
tatcagagtaacgagaagaca

SEQ ID NO: 5668114 - DNA, 17 bp, Homo sapiens
tatcagagtatgtcagt

SEQ ID NO: 5668115 - DNA, 22 bp, Homo sapiens
tatcagagttgcttttctaatc

SEQ ID NO: 5668116 - DNA, 18 bp, Homo sapiens
tatcagatacatcactgc

SEQ ID NO: 5668117 - DNA, 16 bp, Homo sapiens
tatcagatattttcat

SEQ ID NO: 5668118 - DNA, 12 bp, Homo sapiens
tatcagatgtga

SEQ ID NO: 5668119 - DNA, 20 bp, Homo sapiens
tatcagattgcttttgtgca

SEQ ID NO: 5668120 - DNA, 15 bp, Homo sapiens
tatcagcaatactca

SEQ ID NO: 5668121 - DNA, 17 bp, Homo sapiens
tatcagcaatgccccaa

SEQ ID NO: 5668122 - DNA, 20 bp, Homo sapiens
tatcagcaatgccccaaact

SEQ ID NO: 5668123 - DNA, 12 bp, Homo sapiens
tatcagcactgg

SEQ ID NO: 5668124 - DNA, 19 bp, Homo sapiens
tatcagcagacactccagt

SEQ ID NO: 5668125 - DNA, 13 bp, Homo sapiens
tatcagcatctga

SEQ ID NO: 5668126 - DNA, 20 bp, Homo sapiens
tatcagcatctgacaggtga

SEQ ID NO: 5668127 - DNA, 14 bp, Homo sapiens
tatcagcattgttt

SEQ ID NO: 5668128 - DNA, 17 bp, Homo sapiens
tatcagcattgtttcaa

SEQ ID NO: 5668129 - DNA, 17 bp, Homo sapiens
tatcagccagccttccc

SEQ ID NO: 5668130 - DNA, 13 bp, Homo sapiens
tatcagcctgagt

SEQ ID NO: 5668131 - DNA, 19 bp, Homo sapiens
tatcagcctgagtctcctg

SEQ ID NO: 5668132 - DNA, 14 bp, Homo sapiens
tctataaaatgagg

SEQ ID NO: 5668133 - DNA, 15 bp, Homo sapiens
tctataaacactgtt

SEQ ID NO: 5668134 - DNA, 14 bp, Homo sapiens
tctataaactataa

SEQ ID NO: 5668135 - DNA, 12 bp, Homo sapiens
tctataaagcat

SEQ ID NO: 5668136 - DNA, 17 bp, Homo sapiens
tctataaagcatttaac

SEQ ID NO: 5668137 - DNA, 19 bp, Homo sapiens
tctataaagcatttaaccc

SEQ ID NO: 5668138 - DNA, 20 bp, Homo sapiens
tctataaagggtcaggcccg

SEQ ID NO: 5668139 - DNA, 19 bp, Homo sapiens
tctataaatatatattttt

SEQ ID NO: 5668140 - DNA, 12 bp, Homo sapiens
tcaacagattca

SEQ ID NO: 5668141 - DNA, 15 bp, Homo sapiens
tcaacagcatgtcta

SEQ ID NO: 5668142 - DNA, 16 bp, Homo sapiens
tcaacagcatgtctac

SEQ ID NO: 5668143 - DNA, 18 bp, Homo sapiens
tcaacagccaagctggca

SEQ ID NO: 5668144 - DNA, 20 bp, Homo sapiens
tcaacagccaagctggcaca

SEQ ID NO: 5668145 - DNA, 21 bp, Homo sapiens
tcaacagccaagctggcacaa

SEQ ID NO: 5668146 - DNA, 14 bp, Homo sapiens
tcaacagccaagtg

SEQ ID NO: 5668147 - DNA, 14 bp, Homo sapiens
tcaacagcttccct

SEQ ID NO: 5668148 - DNA, 21 bp, Homo sapiens
tcaacaggcccagggagggaa

SEQ ID NO: 5668149 - DNA, 16 bp, Homo sapiens
tcaacaggcctcaggg

SEQ ID NO: 5668150 - DNA, 14 bp, Homo sapiens
tcaacagggcagca

SEQ ID NO: 5668151 - DNA, 21 bp, Homo sapiens
tcaacaggtcacttgatcatg

SEQ ID NO: 5668152 - DNA, 16 bp, Homo sapiens
tcaacaggttttcctg

SEQ ID NO: 5668153 - DNA, 13 bp, Homo sapiens
tcaacagtaaacc

SEQ ID NO: 5668154 - DNA, 18 bp, Homo sapiens
tcaacagtaaaccactga

SEQ ID NO: 5668155 - DNA, 16 bp, Homo sapiens
tcaacagtgaacagct

SEQ ID NO: 5668156 - DNA, 17 bp, Homo sapiens
tcaacagtgaagacaga

SEQ ID NO: 5668157 - DNA, 22 bp, Homo sapiens
tcaacagttacctccaaaaaag

SEQ ID NO: 5668158 - DNA, 22 bp, Homo sapiens
tcaacagttattgggcttaaaa

SEQ ID NO: 5668159 - DNA, 16 bp, Homo sapiens
tcaacagttcattgct

SEQ ID NO: 5668160 - DNA, 14 bp, Homo sapiens
tcaacagttttcct

SEQ ID NO: 5668161 - DNA, 15 bp, Homo sapiens
tcaacagttttccta

SEQ ID NO: 5668162 - DNA, 17 bp, Homo sapiens
tcaacagttttcctatg

SEQ ID NO: 5668163 - DNA, 16 bp, Homo sapiens
tcaacataaagagcaa

SEQ ID NO: 5668164 - DNA, 18 bp, Homo sapiens
tcaacataacataagcta

SEQ ID NO: 5668165 - DNA, 23 bp, Homo sapiens
tcaacataacccacttgtcactg

SEQ ID NO: 5668166 - DNA, 22 bp, Homo sapiens
tcaacataattatgggaacaag

SEQ ID NO: 5668167 - DNA, 13 bp, Homo sapiens
tcaacatactgta

SEQ ID NO: 5668168 - DNA, 18 bp, Homo sapiens
tcaacatactgtaatcaa

SEQ ID NO: 5668169 - DNA, 15 bp, Homo sapiens
tcaacatatcatttt

SEQ ID NO: 5668170 - DNA, 14 bp, Homo sapiens
tcaacatcaatgtt

SEQ ID NO: 5668171 - DNA, 17 bp, Homo sapiens
tcaacatcaatgttcat

SEQ ID NO: 5668172 - DNA, 17 bp, Homo sapiens
tcaacatcctgccagcc

SEQ ID NO: 5668173 - DNA, 15 bp, Homo sapiens
tcaacatctaagcct

SEQ ID NO: 5668174 - DNA, 20 bp, Homo sapiens
tcaacatctttttcctccct

SEQ ID NO: 5668175 - DNA, 20 bp, Homo sapiens
tcaacatgctccaaatataa

SEQ ID NO: 5668176 - DNA, 22 bp, Homo sapiens
tcaacatggctacttgctttga

SEQ ID NO: 5668177 - DNA, 13 bp, Homo sapiens
tcaacatgtgttt

SEQ ID NO: 5668178 - DNA, 18 bp, Homo sapiens
tcaacatgtgtttctgac

SEQ ID NO: 5668179 - DNA, 15 bp, Homo sapiens
tcaacatgttactga

SEQ ID NO: 5668180 - DNA, 19 bp, Homo sapiens
tcaacatgttactgaccag

SEQ ID NO: 5668181 - DNA, 21 bp, Homo sapiens
tcaacatgttactgaccagca

SEQ ID NO: 5668182 - DNA, 16 bp, Homo sapiens
tcaacattaaggcagt

SEQ ID NO: 5668183 - DNA, 14 bp, Homo sapiens
tcaacattactgtt

SEQ ID NO: 5668184 - DNA, 18 bp, Homo sapiens
tcaacattcaaagcagca

SEQ ID NO: 5668185 - DNA, 19 bp, Homo sapiens
tcaacattcttgtgtctgt

SEQ ID NO: 5668186 - DNA, 20 bp, Homo sapiens
tcaacattggagacatcact

SEQ ID NO: 5668187 - DNA, 17 bp, Homo sapiens
tcaacatttacatgtat

SEQ ID NO: 5668188 - DNA, 14 bp, Homo sapiens
tcaacatttccaaa

SEQ ID NO: 5668189 - DNA, 14 bp, Homo sapiens
tcaacatttctcaa

SEQ ID NO: 5668190 - DNA, 15 bp, Homo sapiens
tcaacatttctcatg

SEQ ID NO: 5668191 - DNA, 17 bp, Homo sapiens
tcaacatttctcatgtt

SEQ ID NO: 5668192 - DNA, 16 bp, Homo sapiens
tcaaccaaatggtaca

SEQ ID NO: 5668193 - DNA, 18 bp, Homo sapiens
tcaaccaactgtaatgca

SEQ ID NO: 5668194 - DNA, 14 bp, Homo sapiens
tcaaccacaaaact

SEQ ID NO: 5668195 - DNA, 15 bp, Homo sapiens
tcaaccacacctaaa

SEQ ID NO: 5668196 - DNA, 16 bp, Homo sapiens
tcaaccacgtggagaa

SEQ ID NO: 5668197 - DNA, 16 bp, Homo sapiens
tcaaccactaaagtat

SEQ ID NO: 5668198 - DNA, 22 bp, Homo sapiens
tcaaccactaaagtatagagaa

SEQ ID NO: 5668199 - DNA, 13 bp, Homo sapiens
tcaaccactgtgg

SEQ ID NO: 5668200 - DNA, 24 bp, Homo sapiens
tcaaccagaaaacttagaaataag

SEQ ID NO: 5668201 - DNA, 19 bp, Homo sapiens
tcaaccagacagagggtca

SEQ ID NO: 5668202 - DNA, 13 bp, Homo sapiens
tcaaccagagaac

SEQ ID NO: 5668203 - DNA, 14 bp, Homo sapiens
tcaaccagatttag

SEQ ID NO: 5668204 - DNA, 14 bp, Homo sapiens
tcaaccagcagatg

SEQ ID NO: 5668205 - DNA, 12 bp, Homo sapiens
tcaaccaggcag

SEQ ID NO: 5668206 - DNA, 15 bp, Homo sapiens
tcaaccaggcagagt

SEQ ID NO: 5668207 - DNA, 17 bp, Homo sapiens
tcaaccagggattgttt

SEQ ID NO: 5668208 - DNA, 22 bp, Homo sapiens
tcaaccagggattgtttctgtt

SEQ ID NO: 5668209 - DNA, 15 bp, Homo sapiens
tcaaccatggacttt

SEQ ID NO: 5668210 - DNA, 23 bp, Homo sapiens
tcaaccattagataaacacaggc

SEQ ID NO: 5668211 - DNA, 15 bp, Homo sapiens
tcaacccagaaacac

SEQ ID NO: 5668212 - DNA, 15 bp, Homo sapiens
tcaacccaggagcat

SEQ ID NO: 5668213 - DNA, 22 bp, Homo sapiens
tcaacccattgttgtcaaggaa

SEQ ID NO: 5668214 - DNA, 21 bp, Homo sapiens
tcaaccccacaagcaccactc

SEQ ID NO: 5668215 - DNA, 16 bp, Homo sapiens
tcaaccccactgtaga

SEQ ID NO: 5668216 - DNA, 23 bp, Homo sapiens
tcaacccccagctaataaaccag

SEQ ID NO: 5668217 - DNA, 18 bp, Homo sapiens
tcaacccccatttctatt

SEQ ID NO: 5668218 - DNA, 12 bp, Homo sapiens
tcaacccccctc

SEQ ID NO: 5668219 - DNA, 15 bp, Homo sapiens
tcaacccccctccca

SEQ ID NO: 5668220 - DNA, 16 bp, Homo sapiens
tcaacccccctcccag

SEQ ID NO: 5668221 - DNA, 20 bp, Homo sapiens
tcaacccccctcccagacag

SEQ ID NO: 5668222 - DNA, 12 bp, Homo sapiens
tcaaccctcagc

SEQ ID NO: 5668223 - DNA, 17 bp, Homo sapiens
tcaaccctccctcagcc

SEQ ID NO: 5668224 - DNA, 19 bp, Homo sapiens
tcaaccctccctcagcccc

SEQ ID NO: 5668225 - DNA, 23 bp, Homo sapiens
tcaaccctccctcagcccctctt

SEQ ID NO: 5668226 - DNA, 18 bp, Homo sapiens
tcaaccctctcaggtgac

SEQ ID NO: 5668227 - DNA, 15 bp, Homo sapiens
tcaaccctctcctgt

SEQ ID NO: 5668228 - DNA, 14 bp, Homo sapiens
tcaaccctgccctg

SEQ ID NO: 5668229 - DNA, 13 bp, Homo sapiens
tcaaccctggaga

SEQ ID NO: 5668230 - DNA, 18 bp, Homo sapiens
tcaacccttttgtctgcc

SEQ ID NO: 5668231 - DNA, 17 bp, Homo sapiens
tcaaccggaaggaggcc

SEQ ID NO: 5668232 - DNA, 23 bp, Homo sapiens
tcaaccggaaggaggccaaccag

SEQ ID NO: 5668233 - DNA, 15 bp, Homo sapiens
tcaaccgtacaatgg

SEQ ID NO: 5668234 - DNA, 18 bp, Homo sapiens
tcaacctaccaccccttc

SEQ ID NO: 5668235 - DNA, 21 bp, Homo sapiens
tcaacctaccaccccttcctg

SEQ ID NO: 5668236 - DNA, 13 bp, Homo sapiens
tcaacctaccctg

SEQ ID NO: 5668237 - DNA, 11 bp, Homo sapiens
tcaacctacct

SEQ ID NO: 5668238 - DNA, 16 bp, Homo sapiens
tcaacctaggagcagt

SEQ ID NO: 5668239 - DNA, 15 bp, Homo sapiens
tcaacctcctgggct

SEQ ID NO: 5668240 - DNA, 15 bp, Homo sapiens
tcaacctcctgggtt

SEQ ID NO: 5668241 - DNA, 17 bp, Homo sapiens
tcaacctcctgggttca

SEQ ID NO: 5668242 - DNA, 18 bp, Homo sapiens
tcaacctcctgtggaacc

SEQ ID NO: 5668243 - DNA, 18 bp, Homo sapiens
tcaacctcgcgcttgctg

SEQ ID NO: 5668244 - DNA, 17 bp, Homo sapiens
tcaacctctcagatccc

SEQ ID NO: 5668245 - DNA, 19 bp, Homo sapiens
tcaacctcttctggctcaa

SEQ ID NO: 5668246 - DNA, 20 bp, Homo sapiens
tcaacctggcaaaaatgcaa

SEQ ID NO: 5668247 - DNA, 19 bp, Homo sapiens
tcaacctggtggcaccaga

SEQ ID NO: 5668248 - DNA, 12 bp, Homo sapiens
tcaacctgtaaa

SEQ ID NO: 5668249 - DNA, 13 bp, Homo sapiens
tcaacctgtaaat

SEQ ID NO: 5668250 - DNA, 17 bp, Homo sapiens
tcaacctgtaaattatt

SEQ ID NO: 5668251 - DNA, 16 bp, Homo sapiens
tcaaccttaccaaaaa

SEQ ID NO: 5668252 - DNA, 20 bp, Homo sapiens
tcaaccttatcaaggatttt

SEQ ID NO: 5668253 - DNA, 15 bp, Homo sapiens
tcaaccttggccttc

SEQ ID NO: 5668254 - DNA, 18 bp, Homo sapiens
tcaaccttggccttctcc

SEQ ID NO: 5668255 - DNA, 22 bp, Homo sapiens
tcaaccttgtaaattccccttc

SEQ ID NO: 5668256 - DNA, 20 bp, Homo sapiens
tcaacctttgtgtggctcct

SEQ ID NO: 5668257 - DNA, 23 bp, Homo sapiens
tcaacctttgtgtggctcctggt

SEQ ID NO: 5668258 - DNA, 19 bp, Homo sapiens
tcaacgcctcactgaaaca

SEQ ID NO: 5668259 - DNA, 20 bp, Homo sapiens
tcaacgcttaaaggtgtctt

SEQ ID NO: 5668260 - DNA, 22 bp, Homo sapiens
tcaacggaagccccctcttcct

SEQ ID NO: 5668261 - DNA, 14 bp, Homo sapiens
tcaacggccctgtt

SEQ ID NO: 5668262 - DNA, 19 bp, Homo sapiens
tcaacggggggctcctgcc

SEQ ID NO: 5668263 - DNA, 20 bp, Homo sapiens
tcaacggggggctcctgccc

SEQ ID NO: 5668264 - DNA, 21 bp, Homo sapiens
tcaacggggggctcctgccca

SEQ ID NO: 5668265 - DNA, 23 bp, Homo sapiens
tcaacggggggctcctgcccagg

SEQ ID NO: 5668266 - DNA, 15 bp, Homo sapiens
tcaacggtctggcag

SEQ ID NO: 5668267 - DNA, 18 bp, Homo sapiens
tcaacgttggtatgataa

SEQ ID NO: 5668268 - DNA, 17 bp, Homo sapiens
tcaacgtttcttcactt

SEQ ID NO: 5668269 - DNA, 19 bp, Homo sapiens
tcaactaaaaaaaaaaaag

SEQ ID NO: 5668270 - DNA, 20 bp, Homo sapiens
tcaactaaaaaaaaaaaagt

SEQ ID NO: 5668271 - DNA, 21 bp, Homo sapiens
tcaactaaagaatagtgcctc

SEQ ID NO: 5668272 - DNA, 15 bp, Homo sapiens
tcaactaaatccaaa

SEQ ID NO: 5668273 - DNA, 23 bp, Homo sapiens
tcaactacctcgcatcattgcag

SEQ ID NO: 5668274 - DNA, 15 bp, Homo sapiens
tcaactataaccagt

SEQ ID NO: 5668275 - DNA, 13 bp, Homo sapiens
tcaactatgtagg

SEQ ID NO: 5668276 - DNA, 14 bp, Homo sapiens
tcaactattctgtt

SEQ ID NO: 5668277 - DNA, 16 bp, Homo sapiens
tcaactcacagcttct

SEQ ID NO: 5668278 - DNA, 17 bp, Homo sapiens
tcaactcacagcttctc

SEQ ID NO: 5668279 - DNA, 14 bp, Homo sapiens
tcaactccaaggca

SEQ ID NO: 5668280 - DNA, 21 bp, Homo sapiens
tcaactccaaggcaaatgtcc

SEQ ID NO: 5668281 - DNA, 22 bp, Homo sapiens
tcaactccaaggcaaatgtcca

SEQ ID NO: 5668282 - DNA, 21 bp, Homo sapiens
tcaactccaaggcacactgtt

SEQ ID NO: 5668283 - DNA, 14 bp, Homo sapiens
tcaactccagaagt

SEQ ID NO: 5668284 - DNA, 18 bp, Homo sapiens
tcaactccctcctttagt

SEQ ID NO: 5668285 - DNA, 15 bp, Homo sapiens
tcaactccctgcccc

SEQ ID NO: 5668286 - DNA, 19 bp, Homo sapiens
tcaactcccttctcggggt

SEQ ID NO: 5668287 - DNA, 19 bp, Homo sapiens
tcaactcctcgacatcact

SEQ ID NO: 5668288 - DNA, 14 bp, Homo sapiens
tcaactcctgggct

SEQ ID NO: 5668289 - DNA, 18 bp, Homo sapiens
tcaactcgggggcgcctg

SEQ ID NO: 5668290 - DNA, 17 bp, Homo sapiens
tcaactctacccctgct

SEQ ID NO: 5668291 - DNA, 17 bp, Homo sapiens
tcaactctcactcctga

SEQ ID NO: 5668292 - DNA, 21 bp, Homo sapiens
tcaactctcttattgcctcac

SEQ ID NO: 5668293 - DNA, 17 bp, Homo sapiens
tcaactctgagcccata

SEQ ID NO: 5668294 - DNA, 13 bp, Homo sapiens
tcaactctgtgag

SEQ ID NO: 5668295 - DNA, 16 bp, Homo sapiens
tcaactcttcgaagcc

SEQ ID NO: 5668296 - DNA, 23 bp, Homo sapiens
tcaactgacctgaccccattcct

SEQ ID NO: 5668297 - DNA, 17 bp, Homo sapiens
tcaactgagaagccaag

SEQ ID NO: 5668298 - DNA, 20 bp, Homo sapiens
tcaactgagaagccaagcct

SEQ ID NO: 5668299 - DNA, 14 bp, Homo sapiens
tcaactgagggcca

SEQ ID NO: 5668300 - DNA, 22 bp, Homo sapiens
tcaactgagggccagggaccca

SEQ ID NO: 5668301 - DNA, 14 bp, Homo sapiens
tcaactgcccagca

SEQ ID NO: 5668302 - DNA, 13 bp, Homo sapiens
tcaactgcctcag

SEQ ID NO: 5668303 - DNA, 22 bp, Homo sapiens
tcaactgctgtaaaattataaa

SEQ ID NO: 5668304 - DNA, 22 bp, Homo sapiens
tcaactggacatcacagcagaa

SEQ ID NO: 5668305 - DNA, 16 bp, Homo sapiens
tcaactggcgaagcct

SEQ ID NO: 5668306 - DNA, 18 bp, Homo sapiens
tcaactggcgaagcctga

SEQ ID NO: 5668307 - DNA, 12 bp, Homo sapiens
tcaactggctgg

SEQ ID NO: 5668308 - DNA, 17 bp, Homo sapiens
tcaactggctgggacat

SEQ ID NO: 5668309 - DNA, 18 bp, Homo sapiens
tcaactgggctgaacact

SEQ ID NO: 5668310 - DNA, 16 bp, Homo sapiens
tcaaggctgtgacctt

SEQ ID NO: 5668311 - DNA, 15 bp, Homo sapiens
tcaaggctgtgcagg

SEQ ID NO: 5668312 - DNA, 20 bp, Homo sapiens
tcaaggcttatattcaacca

SEQ ID NO: 5668313 - DNA, 14 bp, Homo sapiens
tcaaggcttcagtc

SEQ ID NO: 5668314 - DNA, 12 bp, Homo sapiens
tcaaggcttgga

SEQ ID NO: 5668315 - DNA, 17 bp, Homo sapiens
tcaaggcttggagaggt

SEQ ID NO: 5668316 - DNA, 13 bp, Homo sapiens
tcaagggaagaaa

SEQ ID NO: 5668317 - DNA, 19 bp, Homo sapiens
tcaagggaatgtaactgct

SEQ ID NO: 5668318 - DNA, 21 bp, Homo sapiens
tcaagggaatgtaactgctga

SEQ ID NO: 5668319 - DNA, 19 bp, Homo sapiens
tcaagggaccctgggtggg

SEQ ID NO: 5668320 - DNA, 14 bp, Homo sapiens
tcaagggcagagaa

SEQ ID NO: 5668321 - DNA, 15 bp, Homo sapiens
tcaagggcagagaac

SEQ ID NO: 5668322 - DNA, 22 bp, Homo sapiens
tcaagggcagagaactgtcttt

SEQ ID NO: 5668323 - DNA, 14 bp, Homo sapiens
tctatttatgcctt

SEQ ID NO: 5668324 - DNA, 13 bp, Homo sapiens
tctatttattggg

SEQ ID NO: 5668325 - DNA, 15 bp, Homo sapiens
tctatttattgggga

SEQ ID NO: 5668326 - DNA, 22 bp, Homo sapiens
tctatttatttactgagcttct

SEQ ID NO: 5668327 - DNA, 15 bp, Homo sapiens
tctatttatttgtga

SEQ ID NO: 5668328 - DNA, 17 bp, Homo sapiens
tctatttcactggagca

SEQ ID NO: 5668329 - DNA, 13 bp, Homo sapiens
tctatttcactta

SEQ ID NO: 5668330 - DNA, 15 bp, Homo sapiens
tctatttcatcagaa

SEQ ID NO: 5668331 - DNA, 18 bp, Homo sapiens
tctatttccactgaacaa

SEQ ID NO: 5668332 - DNA, 22 bp, Homo sapiens
tctatttccccctttcttcctc

SEQ ID NO: 5668333 - DNA, 21 bp, Homo sapiens
tctatttcccctcttctgcta

SEQ ID NO: 5668334 - DNA, 15 bp, Homo sapiens
tctatttcctggaat

SEQ ID NO: 5668335 - DNA, 19 bp, Homo sapiens
tctatttcgagtgttgtgt

SEQ ID NO: 5668336 - DNA, 19 bp, Homo sapiens
tctatttcggaaatacact

SEQ ID NO: 5668337 - DNA, 11 bp, Homo sapiens
tctatttctag

SEQ ID NO: 5668338 - DNA, 17 bp, Homo sapiens
tctatttctagagacaa

SEQ ID NO: 5668339 - DNA, 13 bp, Homo sapiens
tctatttctatct

SEQ ID NO: 5668340 - DNA, 19 bp, Homo sapiens
tctatttctatctgcaaat

SEQ ID NO: 5668341 - DNA, 16 bp, Homo sapiens
tctatttctcctccat

SEQ ID NO: 5668342 - DNA, 15 bp, Homo sapiens
tctatttctctgtgt

SEQ ID NO: 5668343 - DNA, 12 bp, Homo sapiens
tctatttctgaa

SEQ ID NO: 5668344 - DNA, 12 bp, Homo sapiens
tctatttctgct

SEQ ID NO: 5668345 - DNA, 21 bp, Homo sapiens
tctatttctgctgaattttca

SEQ ID NO: 5668346 - DNA, 19 bp, Homo sapiens
tctatttcttcttcacatc

SEQ ID NO: 5668347 - DNA, 22 bp, Homo sapiens
tctatttcttcttcacatccat

SEQ ID NO: 5668348 - DNA, 17 bp, Homo sapiens
tctatttgaataaatta

SEQ ID NO: 5668349 - DNA, 18 bp, Homo sapiens
tctatttgaataaattat

SEQ ID NO: 5668350 - DNA, 19 bp, Homo sapiens
tctatttgagaagttctca

SEQ ID NO: 5668351 - DNA, 16 bp, Homo sapiens
tctatttgatttgcaa

SEQ ID NO: 5668352 - DNA, 23 bp, Homo sapiens
tctatttgctatctgaactaatt

SEQ ID NO: 5668353 - DNA, 20 bp, Homo sapiens
tctatttgctttaatgagaa

SEQ ID NO: 5668354 - DNA, 17 bp, Homo sapiens
tctatttgtacaatttt

SEQ ID NO: 5668355 - DNA, 13 bp, Homo sapiens
tctatttgtctct

SEQ ID NO: 5668356 - DNA, 12 bp, Homo sapiens
tctattttaatt

SEQ ID NO: 5668357 - DNA, 11 bp, Homo sapiens
tctattttaca

SEQ ID NO: 5668358 - DNA, 13 bp, Homo sapiens
tctattttacaac

SEQ ID NO: 5668359 - DNA, 16 bp, Homo sapiens
tctattttactttgta

SEQ ID NO: 5668360 - DNA, 17 bp, Homo sapiens
tctattttacttttctg

SEQ ID NO: 5668361 - DNA, 14 bp, Homo sapiens
tctattttagaata

SEQ ID NO: 5668362 - DNA, 18 bp, Homo sapiens
tctattttataagggcac

SEQ ID NO: 5668363 - DNA, 14 bp, Homo sapiens
tctattttattatg

SEQ ID NO: 5668364 - DNA, 16 bp, Homo sapiens
tctattttattatgaa

SEQ ID NO: 5668365 - DNA, 20 bp, Homo sapiens
tctattttattatgaagaag

SEQ ID NO: 5668366 - DNA, 18 bp, Homo sapiens
tctattttattttattga

SEQ ID NO: 5668367 - DNA, 11 bp, Homo sapiens
tctattttcag

SEQ ID NO: 5668368 - DNA, 13 bp, Homo sapiens
tctattttcccta

SEQ ID NO: 5668369 - DNA, 14 bp, Homo sapiens
tctattttctatgt

SEQ ID NO: 5668370 - DNA, 13 bp, Homo sapiens
tctattttctcat

SEQ ID NO: 5668371 - DNA, 18 bp, Homo sapiens
tctattttctgcagaaat

SEQ ID NO: 5668372 - DNA, 13 bp, Homo sapiens
tctattttgatgc

SEQ ID NO: 5668373 - DNA, 17 bp, Homo sapiens
tctattttgcagataga

SEQ ID NO: 5668374 - DNA, 18 bp, Homo sapiens
tctattttgctggagact

SEQ ID NO: 5668375 - DNA, 24 bp, Homo sapiens
tctattttgtaactttctctatga

SEQ ID NO: 5668376 - DNA, 15 bp, Homo sapiens
tctattttgtgatga

SEQ ID NO: 5668377 - DNA, 16 bp, Homo sapiens
tctatttttacattta

SEQ ID NO: 5668378 - DNA, 15 bp, Homo sapiens
tctatttttatctga

SEQ ID NO: 5668379 - DNA, 14 bp, Homo sapiens
tctatttttatgat

SEQ ID NO: 5668380 - DNA, 13 bp, Homo sapiens
tctatttttgcac

SEQ ID NO: 5668381 - DNA, 14 bp, Homo sapiens
tctatttttgtaga

SEQ ID NO: 5668382 - DNA, 17 bp, Homo sapiens
tctatttttgtccttgc

SEQ ID NO: 5668383 - DNA, 18 bp, Homo sapiens
tctatttttgtccttgca

SEQ ID NO: 5668384 - DNA, 14 bp, Homo sapiens
tctattttttacta

SEQ ID NO: 5668385 - DNA, 21 bp, Homo sapiens
tctatttttttaactgaaaat

SEQ ID NO: 5668386 - DNA, 13 bp, Homo sapiens
tctcaaaaaaaaa

SEQ ID NO: 5668387 - DNA, 23 bp, Homo sapiens
tctcaaaaaaaagaaaatgtctt

SEQ ID NO: 5668388 - DNA, 22 bp, Homo sapiens
tctcaaaaaaagggcaataaat

SEQ ID NO: 5668389 - DNA, 13 bp, Homo sapiens
tctcaaaaaataa

SEQ ID NO: 5668390 - DNA, 20 bp, Homo sapiens
tctcaaaaaataattagtta

SEQ ID NO: 5668391 - DNA, 14 bp, Homo sapiens
tctcaaaaatacaa

SEQ ID NO: 5668392 - DNA, 23 bp, Homo sapiens
tctcaaaaatacaaaataaaaac

SEQ ID NO: 5668393 - DNA, 13 bp, Homo sapiens
tctcaaaaatcct

SEQ ID NO: 5668394 - DNA, 12 bp, Homo sapiens
tctcaaaacaaa

SEQ ID NO: 5668395 - DNA, 24 bp, Homo sapiens
tctcaaaacaatattactttgtct

SEQ ID NO: 5668396 - DNA, 14 bp, Homo sapiens
tctcaaaagaactt

SEQ ID NO: 5668397 - DNA, 13 bp, Homo sapiens
tctcaaaagcatt

SEQ ID NO: 5668398 - DNA, 18 bp, Homo sapiens
tctcaaaagcatttatca

SEQ ID NO: 5668399 - DNA, 23 bp, Homo sapiens
tctcaaaagcatttatcattctt

SEQ ID NO: 5668400 - DNA, 17 bp, Homo sapiens
tctcaaaagtctatttt

SEQ ID NO: 5668401 - DNA, 18 bp, Homo sapiens
tctcaaaataagttgaaa

SEQ ID NO: 5668402 - DNA, 20 bp, Homo sapiens
tctcaaaatacgtgttcaaa

SEQ ID NO: 5668403 - DNA, 21 bp, Homo sapiens
tctcaaaatatttttttaaga

SEQ ID NO: 5668404 - DNA, 22 bp, Homo sapiens
tctcaaaatggtgtgctataaa

SEQ ID NO: 5668405 - DNA, 23 bp, Homo sapiens
tctcaaacacagttacacttgtg

SEQ ID NO: 5668406 - DNA, 13 bp, Homo sapiens
tctcaaacctcca

SEQ ID NO: 5668407 - DNA, 21 bp, Homo sapiens
tctcaaacctggcagatgggg

SEQ ID NO: 5668408 - DNA, 19 bp, Homo sapiens
tctcaaacctgtttaaata

SEQ ID NO: 5668409 - DNA, 23 bp, Homo sapiens
tctcaaaccttgatgtgcctgtg

SEQ ID NO: 5668410 - DNA, 20 bp, Homo sapiens
tctcaaacggtacacagact

SEQ ID NO: 5668411 - DNA, 22 bp, Homo sapiens
tctcaaacggtacacagactat

SEQ ID NO: 5668412 - DNA, 17 bp, Homo sapiens
tctcaaactaaaagaca

SEQ ID NO: 5668413 - DNA, 17 bp, Homo sapiens
tctcaaactaacaggct

SEQ ID NO: 5668414 - DNA, 19 bp, Homo sapiens
tctcaaactcctgacctca

SEQ ID NO: 5668415 - DNA, 14 bp, Homo sapiens
tctcaaactggggc

SEQ ID NO: 5668416 - DNA, 18 bp, Homo sapiens
tctcaaagagggggctct

SEQ ID NO: 5668417 - DNA, 21 bp, Homo sapiens
tctcaaagagggggctctgcc

SEQ ID NO: 5668418 - DNA, 23 bp, Homo sapiens
tctcaaagagggggctctgccca

SEQ ID NO: 5668419 - DNA, 21 bp, Homo sapiens
tctcaaagccccattaactgc

SEQ ID NO: 5668420 - DNA, 22 bp, Homo sapiens
tctcaaaggagaaaaaaaacct

SEQ ID NO: 5668421 - DNA, 21 bp, Homo sapiens
tctcaaaggagctttctcaat

SEQ ID NO: 5668422 - DNA, 21 bp, Homo sapiens
tctcaaaggccctcagtgaga

SEQ ID NO: 5668423 - DNA, 20 bp, Homo sapiens
tctcaaagtataatctttct

SEQ ID NO: 5668424 - DNA, 22 bp, Homo sapiens
tctcaaagttaaaagtaaaatt

SEQ ID NO: 5668425 - DNA, 13 bp, Homo sapiens
tctcaaagtttta

SEQ ID NO: 5668426 - DNA, 14 bp, Homo sapiens
tctcaaagttttat

SEQ ID NO: 5668427 - DNA, 17 bp, Homo sapiens
tctcaaagttttgaaaa

SEQ ID NO: 5668428 - DNA, 18 bp, Homo sapiens
tctcaaagttttgaaaag

SEQ ID NO: 5668429 - DNA, 20 bp, Homo sapiens
tctcaaagttttgaaaagct

SEQ ID NO: 5668430 - DNA, 20 bp, Homo sapiens
tctcaaagtttttacagtgt

SEQ ID NO: 5668431 - DNA, 22 bp, Homo sapiens
tctcaaagtttttacagtgtat

SEQ ID NO: 5668432 - DNA, 17 bp, Homo sapiens
tctcaaataactaaaag

SEQ ID NO: 5668433 - DNA, 13 bp, Homo sapiens
tctcaaataataa

SEQ ID NO: 5668434 - DNA, 20 bp, Homo sapiens
tctcaaatacagtagtataa

SEQ ID NO: 5668435 - DNA, 21 bp, Homo sapiens
tctcaaatacagtagtataat

SEQ ID NO: 5668436 - DNA, 20 bp, Homo sapiens
tctcaaataggctattaaaa

SEQ ID NO: 5668437 - DNA, 19 bp, Homo sapiens
tctcaaatccactgacaga

SEQ ID NO: 5668438 - DNA, 22 bp, Homo sapiens
tctcaaatctgctttcatccag

SEQ ID NO: 5668439 - DNA, 16 bp, Homo sapiens
tctcaaatgatacagt

SEQ ID NO: 5668440 - DNA, 14 bp, Homo sapiens
tctcaaatgttttc

SEQ ID NO: 5668441 - DNA, 18 bp, Homo sapiens
tctcaaatttctaaatct

SEQ ID NO: 5668442 - DNA, 15 bp, Homo sapiens
tctcaaattttaagt

SEQ ID NO: 5668443 - DNA, 15 bp, Homo sapiens
tctcaaatttttcat

SEQ ID NO: 5668444 - DNA, 17 bp, Homo sapiens
tctcaacaggcctcagg

SEQ ID NO: 5668445 - DNA, 14 bp, Homo sapiens
tctcaacatggaaa

SEQ ID NO: 5668446 - DNA, 14 bp, Homo sapiens
tctcaacatgtctc

SEQ ID NO: 5668447 - DNA, 18 bp, Homo sapiens
tctcaacatgtgtttctg

SEQ ID NO: 5668448 - DNA, 21 bp, Homo sapiens
tctcaacctaccaccccttcc

SEQ ID NO: 5668449 - DNA, 22 bp, Homo sapiens
tctcaacctaccaccccttcct

SEQ ID NO: 5668450 - DNA, 23 bp, Homo sapiens
tctcaacctaccaccccttcctg

SEQ ID NO: 5668451 - DNA, 16 bp, Homo sapiens
tctcaaccttatcaag

SEQ ID NO: 5668452 - DNA, 15 bp, Homo sapiens
tctcaaccttggcct

SEQ ID NO: 5668453 - DNA, 19 bp, Homo sapiens
tctcaaccttggccttctc

SEQ ID NO: 5668454 - DNA, 20 bp, Homo sapiens
tctcaacggaagccccctct

SEQ ID NO: 5668455 - DNA, 19 bp, Homo sapiens
tctcaactataaccagttt

SEQ ID NO: 5668456 - DNA, 16 bp, Homo sapiens
tctcaactgcctcagc

SEQ ID NO: 5668457 - DNA, 14 bp, Homo sapiens
tctcaactgtccca

SEQ ID NO: 5668458 - DNA, 22 bp, Homo sapiens
tctcaagaatctagaagatgtg

SEQ ID NO: 5668459 - DNA, 18 bp, Homo sapiens
tctcaagacctgagtatt

SEQ ID NO: 5668460 - DNA, 15 bp, Homo sapiens
tctcaagagccctgt

SEQ ID NO: 5668461 - DNA, 19 bp, Homo sapiens
tctcaagagggcactggtg

SEQ ID NO: 5668462 - DNA, 16 bp, Homo sapiens
tctcaagagtgctgag

SEQ ID NO: 5668463 - DNA, 15 bp, Homo sapiens
tctcaagatgtttat

SEQ ID NO: 5668464 - DNA, 17 bp, Homo sapiens
tctcaagctagccagag

SEQ ID NO: 5668465 - DNA, 15 bp, Homo sapiens
tctcaagctagtgtt

SEQ ID NO: 5668466 - DNA, 15 bp, Homo sapiens
tctcaagctcttcct

SEQ ID NO: 5668467 - DNA, 22 bp, Homo sapiens
tctcaaggagaggcaaagaaag

SEQ ID NO: 5668468 - DNA, 18 bp, Homo sapiens
tctcaaggcttggagagg

SEQ ID NO: 5668469 - DNA, 20 bp, Homo sapiens
tctcaaggtgggccttgcta

SEQ ID NO: 5668470 - DNA, 14 bp, Homo sapiens
tctcaagtaaaaca

SEQ ID NO: 5668471 - DNA, 18 bp, Homo sapiens
tctcaagtaaaacaaatg

SEQ ID NO: 5668472 - DNA, 20 bp, Homo sapiens
tctcaagtaaaacaaatgaa

SEQ ID NO: 5668473 - DNA, 15 bp, Homo sapiens
tctcaagtatataaa

SEQ ID NO: 5668474 - DNA, 18 bp, Homo sapiens
tctcaagtatatgtcatt

SEQ ID NO: 5668475 - DNA, 20 bp, Homo sapiens
tctcaagtgcaatgccccct

SEQ ID NO: 5668476 - DNA, 13 bp, Homo sapiens
tctcaagtgtttt

SEQ ID NO: 5668477 - DNA, 22 bp, Homo sapiens
tctcaagtgttttggagaaaaa

SEQ ID NO: 5668478 - DNA, 13 bp, Homo sapiens
tctcaagttctaa

SEQ ID NO: 5668479 - DNA, 15 bp, Homo sapiens
tctcaagttctaaga

SEQ ID NO: 5668480 - DNA, 18 bp, Homo sapiens
tctcaagttctaagattc

SEQ ID NO: 5668481 - DNA, 14 bp, Homo sapiens
tctcaataaactga

SEQ ID NO: 5668482 - DNA, 21 bp, Homo sapiens
tctcaatacgcctttaaaggt

SEQ ID NO: 5668483 - DNA, 14 bp, Homo sapiens
tctcaatagctcca

SEQ ID NO: 5668484 - DNA, 20 bp, Homo sapiens
tctcaatagctccaagctgt

SEQ ID NO: 5668485 - DNA, 22 bp, Homo sapiens
tctcaatagctccaagctgtta

SEQ ID NO: 5668486 - DNA, 14 bp, Homo sapiens
tctcaatagttctt

SEQ ID NO: 5668487 - DNA, 14 bp, Homo sapiens
tctcaatatataat

SEQ ID NO: 5668488 - DNA, 14 bp, Homo sapiens
tgcgaccccatctg

SEQ ID NO: 5668489 - DNA, 15 bp, Homo sapiens
tgcgaccccatctgc

SEQ ID NO: 5668490 - DNA, 18 bp, Homo sapiens
tgcgaccccatctgccca

SEQ ID NO: 5668491 - DNA, 15 bp, Homo sapiens
tgcgaccccccaccc

SEQ ID NO: 5668492 - DNA, 18 bp, Homo sapiens
tgcgaccttgcaacctca

SEQ ID NO: 5668493 - DNA, 17 bp, Homo sapiens
tgcgacgatccccatgg

SEQ ID NO: 5668494 - DNA, 22 bp, Homo sapiens
tgcgacgcgggcttctggagct

SEQ ID NO: 5668495 - DNA, 15 bp, Homo sapiens
tgcgacgcttgctct

SEQ ID NO: 5668496 - DNA, 15 bp, Homo sapiens
tgcgacggagagaaa

SEQ ID NO: 5668497 - DNA, 16 bp, Homo sapiens
tgcgacggagagaaaa

SEQ ID NO: 5668498 - DNA, 17 bp, Homo sapiens
tgcgactttctgcctgg

SEQ ID NO: 5668499 - DNA, 21 bp, Homo sapiens
tgcgactttctgcctggagtg

SEQ ID NO: 5668500 - DNA, 22 bp, Homo sapiens
tgcgagaacacaagccacgcct

SEQ ID NO: 5668501 - DNA, 22 bp, Homo sapiens
tgcgagacgcacacagctgagc

SEQ ID NO: 5668502 - DNA, 23 bp, Homo sapiens
tgcgagacgcacacagctgagca

SEQ ID NO: 5668503 - DNA, 12 bp, Homo sapiens
tgcgagagatgt

SEQ ID NO: 5668504 - DNA, 16 bp, Homo sapiens
tgcgagagatgtgtgt

SEQ ID NO: 5668505 - DNA, 17 bp, Homo sapiens
tgcgagagatgtgtgtt

SEQ ID NO: 5668506 - DNA, 21 bp, Homo sapiens
tgcgagaggtccctgcttacc

SEQ ID NO: 5668507 - DNA, 18 bp, Homo sapiens
tgcgagcatttccctccc

SEQ ID NO: 5668508 - DNA, 21 bp, Homo sapiens
tgcgagcgctatcttcacata

SEQ ID NO: 5668509 - DNA, 11 bp, Homo sapiens
tgcgagctgcc

SEQ ID NO: 5668510 - DNA, 16 bp, Homo sapiens
tgcgagcttggccttg

SEQ ID NO: 5668511 - DNA, 19 bp, Homo sapiens
tgcgaggctcggagcaccc

SEQ ID NO: 5668512 - DNA, 13 bp, Homo sapiens
tgcgaggggccag

SEQ ID NO: 5668513 - DNA, 14 bp, Homo sapiens
tgcgaggggccagc

SEQ ID NO: 5668514 - DNA, 17 bp, Homo sapiens
tgcgaggggccagcaga

SEQ ID NO: 5668515 - DNA, 20 bp, Homo sapiens
tgcgaggggccagcagaggg

SEQ ID NO: 5668516 - DNA, 14 bp, Homo sapiens
tgcgagtatgtgtt

SEQ ID NO: 5668517 - DNA, 15 bp, Homo sapiens
tgcgagtatgtgttt

SEQ ID NO: 5668518 - DNA, 16 bp, Homo sapiens
tgcgagtccaaggcca

SEQ ID NO: 5668519 - DNA, 20 bp, Homo sapiens
tgcgagtccaaggccagtcc

SEQ ID NO: 5668520 - DNA, 22 bp, Homo sapiens
tgcgagtgtgtgcatgtgtgtg

SEQ ID NO: 5668521 - DNA, 13 bp, Homo sapiens
tgcgatagagtct

SEQ ID NO: 5668522 - DNA, 14 bp, Homo sapiens
tgcgatagagtctc

SEQ ID NO: 5668523 - DNA, 16 bp, Homo sapiens
tgcgatagagtctcac

SEQ ID NO: 5668524 - DNA, 14 bp, Homo sapiens
tgcgatctgggttc

SEQ ID NO: 5668525 - DNA, 20 bp, Homo sapiens
tgcgatctgggttcactgca

SEQ ID NO: 5668526 - DNA, 21 bp, Homo sapiens
tgcgatctgggttcactgcaa

SEQ ID NO: 5668527 - DNA, 16 bp, Homo sapiens
tgcgatgggggatcag

SEQ ID NO: 5668528 - DNA, 19 bp, Homo sapiens
tgcgattatctacccacgt

SEQ ID NO: 5668529 - DNA, 13 bp, Homo sapiens
tgcgattctggat

SEQ ID NO: 5668530 - DNA, 21 bp, Homo sapiens
tgcgattctggataaagccac

SEQ ID NO: 5668531 - DNA, 13 bp, Homo sapiens
tgcgattttatct

SEQ ID NO: 5668532 - DNA, 15 bp, Homo sapiens
tgcgattttattact

SEQ ID NO: 5668533 - DNA, 19 bp, Homo sapiens
tgcgattttgcctgtgtct

SEQ ID NO: 5668534 - DNA, 17 bp, Homo sapiens
tgcgcaaaacccagaag

SEQ ID NO: 5668535 - DNA, 16 bp, Homo sapiens
tgcgcaaaatgcagct

SEQ ID NO: 5668536 - DNA, 13 bp, Homo sapiens
tgcgcaaatacaa

SEQ ID NO: 5668537 - DNA, 19 bp, Homo sapiens
tgcgcaacaacaaggaccc

SEQ ID NO: 5668538 - DNA, 14 bp, Homo sapiens
tgcgcaagtgcctg

SEQ ID NO: 5668539 - DNA, 15 bp, Homo sapiens
tgcgcaagtgcctgg

SEQ ID NO: 5668540 - DNA, 22 bp, Homo sapiens
tgcgcacacacaccgatgtaca

SEQ ID NO: 5668541 - DNA, 22 bp, Homo sapiens
tgcgcacacacagatatgcaca

SEQ ID NO: 5668542 - DNA, 18 bp, Homo sapiens
tgcgcacaccgccagcag

SEQ ID NO: 5668543 - DNA, 21 bp, Homo sapiens
tgcgcacagagggaagccatg

SEQ ID NO: 5668544 - DNA, 15 bp, Homo sapiens
tgcgcaccaatgccc

SEQ ID NO: 5668545 - DNA, 18 bp, Homo sapiens
tgcgcaccaggctgagcc

SEQ ID NO: 5668546 - DNA, 21 bp, Homo sapiens
tgcgcacttacctgcttgagc

SEQ ID NO: 5668547 - DNA, 15 bp, Homo sapiens
tgcgcagagtggatt

SEQ ID NO: 5668548 - DNA, 16 bp, Homo sapiens
tgcgcagatctgtgcc

SEQ ID NO: 5668549 - DNA, 19 bp, Homo sapiens
tgcgcagatctgtgcctgg

SEQ ID NO: 5668550 - DNA, 19 bp, Homo sapiens
tgcgcagatgaggggccac

SEQ ID NO: 5668551 - DNA, 22 bp, Homo sapiens
tgcgcagccgcgctctgcccct

SEQ ID NO: 5668552 - DNA, 19 bp, Homo sapiens
tgcgcagcctccagggccc

SEQ ID NO: 5668553 - DNA, 15 bp, Homo sapiens
tgcgcataggcctgc

SEQ ID NO: 5668554 - DNA, 15 bp, Homo sapiens
tgcgcatcttgcctc

SEQ ID NO: 5668555 - DNA, 20 bp, Homo sapiens
tgcgcattctaacctggagg

SEQ ID NO: 5668556 - DNA, 23 bp, Homo sapiens
tgcgcattctcatggagaagtta

SEQ ID NO: 5668557 - DNA, 17 bp, Homo sapiens
tgcgccacggcactcca

SEQ ID NO: 5668558 - DNA, 20 bp, Homo sapiens
tgcgccacggcactccagcc

SEQ ID NO: 5668559 - DNA, 19 bp, Homo sapiens
tgcgccactgctccgtgga

SEQ ID NO: 5668560 - DNA, 15 bp, Homo sapiens
tgcgccacttccttt

SEQ ID NO: 5668561 - DNA, 19 bp, Homo sapiens
tgcgccacttcctttgtgt

SEQ ID NO: 5668562 - DNA, 13 bp, Homo sapiens
tgcgccaggcaga

SEQ ID NO: 5668563 - DNA, 17 bp, Homo sapiens
tgcgccaggcagagctg

SEQ ID NO: 5668564 - DNA, 18 bp, Homo sapiens
tgcgccaggcagagctga

SEQ ID NO: 5668565 - DNA, 18 bp, Homo sapiens
tgcgccattgcactccag

SEQ ID NO: 5668566 - DNA, 18 bp, Homo sapiens
tgcgcccagagctggcct

SEQ ID NO: 5668567 - DNA, 14 bp, Homo sapiens
tgcgcccagcctga

SEQ ID NO: 5668568 - DNA, 18 bp, Homo sapiens
tgcgcccagtccttccac

SEQ ID NO: 5668569 - DNA, 15 bp, Homo sapiens
tgcgccccgcccaca

SEQ ID NO: 5668570 - DNA, 17 bp, Homo sapiens
tgcgccccgcccacacc

SEQ ID NO: 5668571 - DNA, 18 bp, Homo sapiens
tgcgccccgcccacaccc

SEQ ID NO: 5668572 - DNA, 16 bp, Homo sapiens
tgcgccccgcctcccc

SEQ ID NO: 5668573 - DNA, 18 bp, Homo sapiens
tgcgccccgcctccccat

SEQ ID NO: 5668574 - DNA, 19 bp, Homo sapiens
tgcgcccctccccacccct

SEQ ID NO: 5668575 - DNA, 21 bp, Homo sapiens
tgcgcccctgcccagcacctc

SEQ ID NO: 5668576 - DNA, 21 bp, Homo sapiens
tgcgcccggccacattcagtt

SEQ ID NO: 5668577 - DNA, 20 bp, Homo sapiens
tgcgcccgggcaagaccttt

SEQ ID NO: 5668578 - DNA, 14 bp, Homo sapiens
tgcgccctccctcc

SEQ ID NO: 5668579 - DNA, 19 bp, Homo sapiens
tgcgccctccctccctcca

SEQ ID NO: 5668580 - DNA, 21 bp, Homo sapiens
tgcgccctccctccctccaca

SEQ ID NO: 5668581 - DNA, 19 bp, Homo sapiens
tctggctttgtctctagcc

SEQ ID NO: 5668582 - DNA, 23 bp, Homo sapiens
tctggctttgtctctagccgggc

SEQ ID NO: 5668583 - DNA, 15 bp, Homo sapiens
tctgggaaagcagag

SEQ ID NO: 5668584 - DNA, 15 bp, Homo sapiens
tctgggaaaggtgct

SEQ ID NO: 5668585 - DNA, 16 bp, Homo sapiens
tctgggaaaggtgctc

SEQ ID NO: 5668586 - DNA, 17 bp, Homo sapiens
tctgggaaaggtgctca

SEQ ID NO: 5668587 - DNA, 19 bp, Homo sapiens
tctgggaaaggtgctcaaa

SEQ ID NO: 5668588 - DNA, 21 bp, Homo sapiens
tctgggaaaggtgctcaaaga

SEQ ID NO: 5668589 - DNA, 22 bp, Homo sapiens
tctgggaaatgagaaggcagcc

SEQ ID NO: 5668590 - DNA, 19 bp, Homo sapiens
tctgggaaatgaggttttt

SEQ ID NO: 5668591 - DNA, 22 bp, Homo sapiens
tctgggaaatggcttgaagcca

SEQ ID NO: 5668592 - DNA, 22 bp, Homo sapiens
tctgggaaattgaagtgtcttc

SEQ ID NO: 5668593 - DNA, 18 bp, Homo sapiens
tctgggaactgtgccttt

SEQ ID NO: 5668594 - DNA, 22 bp, Homo sapiens
tctgggaacttgcgagtccaag

SEQ ID NO: 5668595 - DNA, 14 bp, Homo sapiens
tctgggaacttgtc

SEQ ID NO: 5668596 - DNA, 14 bp, Homo sapiens
tctgggaagaaaat

SEQ ID NO: 5668597 - DNA, 21 bp, Homo sapiens
tctgggaagcttgagcctccc

SEQ ID NO: 5668598 - DNA, 14 bp, Homo sapiens
tctgggaagggaag

SEQ ID NO: 5668599 - DNA, 20 bp, Homo sapiens
tctgggaagggagagggcct

SEQ ID NO: 5668600 - DNA, 20 bp, Homo sapiens
tctgggaagggagagttctt

SEQ ID NO: 5668601 - DNA, 14 bp, Homo sapiens
tctgggaaggggct

SEQ ID NO: 5668602 - DNA, 13 bp, Homo sapiens
tctgggaaggggt

SEQ ID NO: 5668603 - DNA, 14 bp, Homo sapiens
tctgggaattgtgt

SEQ ID NO: 5668604 - DNA, 14 bp, Homo sapiens
tctgggacacagtt

SEQ ID NO: 5668605 - DNA, 22 bp, Homo sapiens
tctgggacaggcaccatgctgg

SEQ ID NO: 5668606 - DNA, 19 bp, Homo sapiens
tctgggaccaggctccaat

SEQ ID NO: 5668607 - DNA, 15 bp, Homo sapiens
tctgggacccacaga

SEQ ID NO: 5668608 - DNA, 17 bp, Homo sapiens
tctgggacccacagaac

SEQ ID NO: 5668609 - DNA, 18 bp, Homo sapiens
tctgggacccacagaact

SEQ ID NO: 5668610 - DNA, 12 bp, Homo sapiens
tctgggactgct

SEQ ID NO: 5668611 - DNA, 15 bp, Homo sapiens
tctgggactgtgcct

SEQ ID NO: 5668612 - DNA, 18 bp, Homo sapiens
tctgggactgtgcctggc

SEQ ID NO: 5668613 - DNA, 18 bp, Homo sapiens
tctgggagaccctgaact

SEQ ID NO: 5668614 - DNA, 14 bp, Homo sapiens
tctgggagagccag

SEQ ID NO: 5668615 - DNA, 17 bp, Homo sapiens
tctgggagagccagctt

SEQ ID NO: 5668616 - DNA, 14 bp, Homo sapiens
tctgggagagcctg

SEQ ID NO: 5668617 - DNA, 13 bp, Homo sapiens
tctgggagcagaa

SEQ ID NO: 5668618 - DNA, 22 bp, Homo sapiens
tctgggagcagaaacagccatt

SEQ ID NO: 5668619 - DNA, 23 bp, Homo sapiens
tctgggaggaatggacagacaga

SEQ ID NO: 5668620 - DNA, 18 bp, Homo sapiens
tctgggaggcaagaaaag

SEQ ID NO: 5668621 - DNA, 15 bp, Homo sapiens
tctgggaggcttcag

SEQ ID NO: 5668622 - DNA, 11 bp, Homo sapiens
tctgggaggga

SEQ ID NO: 5668623 - DNA, 22 bp, Homo sapiens
tctgggagggggtgagaggcag

SEQ ID NO: 5668624 - DNA, 16 bp, Homo sapiens
tctgggagtcacacag

SEQ ID NO: 5668625 - DNA, 16 bp, Homo sapiens
tctgggagtcaggccc

SEQ ID NO: 5668626 - DNA, 15 bp, Homo sapiens
tctgggagttgctgt

SEQ ID NO: 5668627 - DNA, 23 bp, Homo sapiens
tctgggatatatggaggattctt

SEQ ID NO: 5668628 - DNA, 23 bp, Homo sapiens
tctgggatatggctgcccaggag

SEQ ID NO: 5668629 - DNA, 13 bp, Homo sapiens
tctgggatattta

SEQ ID NO: 5668630 - DNA, 15 bp, Homo sapiens
tctgggatatttaac

SEQ ID NO: 5668631 - DNA, 14 bp, Homo sapiens
tctgggatcatgat

SEQ ID NO: 5668632 - DNA, 18 bp, Homo sapiens
tctgggatcatgatagac

SEQ ID NO: 5668633 - DNA, 14 bp, Homo sapiens
tctgggatggaccc

SEQ ID NO: 5668634 - DNA, 15 bp, Homo sapiens
tctgggatgtagaac

SEQ ID NO: 5668635 - DNA, 22 bp, Homo sapiens
tctgggatgtagaacttcaaga

SEQ ID NO: 5668636 - DNA, 19 bp, Homo sapiens
tctgggatgtcacagtcca

SEQ ID NO: 5668637 - DNA, 15 bp, Homo sapiens
tctgggattattctt

SEQ ID NO: 5668638 - DNA, 20 bp, Homo sapiens
tctgggcaaagcccctcaca

SEQ ID NO: 5668639 - DNA, 21 bp, Homo sapiens
tctgggcaaagcccctcacac

SEQ ID NO: 5668640 - DNA, 22 bp, Homo sapiens
tctgggcaaggtgagggatgcc

SEQ ID NO: 5668641 - DNA, 18 bp, Homo sapiens
tctgggcaagtagcagga

SEQ ID NO: 5668642 - DNA, 19 bp, Homo sapiens
tctgggcacaagcagggca

SEQ ID NO: 5668643 - DNA, 20 bp, Homo sapiens
tctgggcacactctgccagc

SEQ ID NO: 5668644 - DNA, 12 bp, Homo sapiens
tctgggcacagt

SEQ ID NO: 5668645 - DNA, 13 bp, Homo sapiens
tctgggcacagtg

SEQ ID NO: 5668646 - DNA, 20 bp, Homo sapiens
tctgggcacagtgctgcccc

SEQ ID NO: 5668647 - DNA, 23 bp, Homo sapiens
tctgggcaccacctctgtgggca

SEQ ID NO: 5668648 - DNA, 21 bp, Homo sapiens
tctgggcacgcctgctggccg

SEQ ID NO: 5668649 - DNA, 21 bp, Homo sapiens
tctgggcactggtaatcccaa

SEQ ID NO: 5668650 - DNA, 22 bp, Homo sapiens
tctgggcagaagtgagcccccc

SEQ ID NO: 5668651 - DNA, 14 bp, Homo sapiens
tctgggcagagcct

SEQ ID NO: 5668652 - DNA, 16 bp, Homo sapiens
tctgggcagagcctgt

SEQ ID NO: 5668653 - DNA, 18 bp, Homo sapiens
tctgggcagcacctctgg

SEQ ID NO: 5668654 - DNA, 13 bp, Homo sapiens
tctgggcagcctg

SEQ ID NO: 5668655 - DNA, 14 bp, Homo sapiens
tctgggcagcgcta

SEQ ID NO: 5668656 - DNA, 20 bp, Homo sapiens
tctgggcagtaaatccacag

SEQ ID NO: 5668657 - DNA, 21 bp, Homo sapiens
tctgggcagtgccacagcctg

SEQ ID NO: 5668658 - DNA, 19 bp, Homo sapiens
tctgggcatctgttctggt

SEQ ID NO: 5668659 - DNA, 16 bp, Homo sapiens
tctgggcatggcaggg

SEQ ID NO: 5668660 - DNA, 21 bp, Homo sapiens
tctgggcatggcagggccagg

SEQ ID NO: 5668661 - DNA, 18 bp, Homo sapiens
tctgggcattttcctcct

SEQ ID NO: 5668662 - DNA, 22 bp, Homo sapiens
tctgggcattttcctcctctgc

SEQ ID NO: 5668663 - DNA, 16 bp, Homo sapiens
tctgggccaagttcct

SEQ ID NO: 5668664 - DNA, 16 bp, Homo sapiens
tctgggccaccagctc

SEQ ID NO: 5668665 - DNA, 17 bp, Homo sapiens
tctggtgaccagacttt

SEQ ID NO: 5668666 - DNA, 23 bp, Homo sapiens
tctggtgaccttccaagagcctg

SEQ ID NO: 5668667 - DNA, 15 bp, Homo sapiens
tctggtgactgcagc

SEQ ID NO: 5668668 - DNA, 18 bp, Homo sapiens
tctggtgaggccttgctc

SEQ ID NO: 5668669 - DNA, 18 bp, Homo sapiens
tctggtgaggtggcccag

SEQ ID NO: 5668670 - DNA, 19 bp, Homo sapiens
tctggtgaggtggcccagg

SEQ ID NO: 5668671 - DNA, 22 bp, Homo sapiens
tctggtgaggtggcccaggccc

SEQ ID NO: 5668672 - DNA, 23 bp, Homo sapiens
tctggtgaggtggcccaggcccc

SEQ ID NO: 5668673 - DNA, 17 bp, Homo sapiens
tctggtgataaggacat

SEQ ID NO: 5668674 - DNA, 13 bp, Homo sapiens
tctggtgcacgcc

SEQ ID NO: 5668675 - DNA, 13 bp, Homo sapiens
tctggtgcagaat

SEQ ID NO: 5668676 - DNA, 13 bp, Homo sapiens
tctggtgcatgtt

SEQ ID NO: 5668677 - DNA, 15 bp, Homo sapiens
tctggtgcctccaga

SEQ ID NO: 5668678 - DNA, 14 bp, Homo sapiens
tctggtgcctcctc

SEQ ID NO: 5668679 - DNA, 16 bp, Homo sapiens
tctggtgcctcctcaa

SEQ ID NO: 5668680 - DNA, 19 bp, Homo sapiens
tctggtgcctttccacaca

SEQ ID NO: 5668681 - DNA, 17 bp, Homo sapiens
tctggtgcgtgtggccc

SEQ ID NO: 5668682 - DNA, 15 bp, Homo sapiens
tctggtgctcctgca

SEQ ID NO: 5668683 - DNA, 13 bp, Homo sapiens
tctggtggaggag

SEQ ID NO: 5668684 - DNA, 14 bp, Homo sapiens
tctggtggaggagc

SEQ ID NO: 5668685 - DNA, 20 bp, Homo sapiens
tctggtggaggagctgaggg

SEQ ID NO: 5668686 - DNA, 21 bp, Homo sapiens
tctggtggaggagctgaggga

SEQ ID NO: 5668687 - DNA, 22 bp, Homo sapiens
tctggtggaggagctgagggag

SEQ ID NO: 5668688 - DNA, 16 bp, Homo sapiens
tctggtggccacttca

SEQ ID NO: 5668689 - DNA, 12 bp, Homo sapiens
tctggtggcccc

SEQ ID NO: 5668690 - DNA, 14 bp, Homo sapiens
tctggtggccccag

SEQ ID NO: 5668691 - DNA, 16 bp, Homo sapiens
tctggtggctcctcct

SEQ ID NO: 5668692 - DNA, 16 bp, Homo sapiens
tctggtggctgggctg

SEQ ID NO: 5668693 - DNA, 21 bp, Homo sapiens
tctggtggctgggctgctcct

SEQ ID NO: 5668694 - DNA, 23 bp, Homo sapiens
tctggtggctgggctgctcctga

SEQ ID NO: 5668695 - DNA, 20 bp, Homo sapiens
tctggtggggctgtcctgct

SEQ ID NO: 5668696 - DNA, 20 bp, Homo sapiens
tctggtggtcagccctagga

SEQ ID NO: 5668697 - DNA, 16 bp, Homo sapiens
tctggtggtctctgct

SEQ ID NO: 5668698 - DNA, 20 bp, Homo sapiens
tctggtggtttgattgttta

SEQ ID NO: 5668699 - DNA, 16 bp, Homo sapiens
tctggtgtccagcatg

SEQ ID NO: 5668700 - DNA, 13 bp, Homo sapiens
tctggtgtctgct

SEQ ID NO: 5668701 - DNA, 14 bp, Homo sapiens
tctggtgtttgtca

SEQ ID NO: 5668702 - DNA, 13 bp, Homo sapiens
tctggttacaatt

SEQ ID NO: 5668703 - DNA, 17 bp, Homo sapiens
tctggttagctcagccc

SEQ ID NO: 5668704 - DNA, 18 bp, Homo sapiens
tctggttagctcagcccc

SEQ ID NO: 5668705 - DNA, 13 bp, Homo sapiens
tctggttccaggg

SEQ ID NO: 5668706 - DNA, 12 bp, Homo sapiens
tctggttccatt

SEQ ID NO: 5668707 - DNA, 19 bp, Homo sapiens
tctggttccctgctgcgct

SEQ ID NO: 5668708 - DNA, 20 bp, Homo sapiens
tctggttccctgctgcgctg

SEQ ID NO: 5668709 - DNA, 18 bp, Homo sapiens
tctggttctcaattccaa

SEQ ID NO: 5668710 - DNA, 13 bp, Homo sapiens
tctggttctgatg

SEQ ID NO: 5668711 - DNA, 14 bp, Homo sapiens
tctggttctgatgc

SEQ ID NO: 5668712 - DNA, 15 bp, Homo sapiens
tctggttgaactctg

SEQ ID NO: 5668713 - DNA, 21 bp, Homo sapiens
tctggttgacgggctgtccgt

SEQ ID NO: 5668714 - DNA, 15 bp, Homo sapiens
tctggttgcctcccc

SEQ ID NO: 5668715 - DNA, 19 bp, Homo sapiens
tctggttgctaatgacagc

SEQ ID NO: 5668716 - DNA, 21 bp, Homo sapiens
tctggttgctaatgacagcct

SEQ ID NO: 5668717 - DNA, 13 bp, Homo sapiens
tctggttgcttca

SEQ ID NO: 5668718 - DNA, 14 bp, Homo sapiens
tctggttggaggcc

SEQ ID NO: 5668719 - DNA, 21 bp, Homo sapiens
tctggttgttgcaccatctgc

SEQ ID NO: 5668720 - DNA, 22 bp, Homo sapiens
tctggttgtttctgttccaaat

SEQ ID NO: 5668721 - DNA, 21 bp, Homo sapiens
tctggtttagtgttctgtatt

SEQ ID NO: 5668722 - DNA, 16 bp, Homo sapiens
tctggtttctgtgtgt

SEQ ID NO: 5668723 - DNA, 19 bp, Homo sapiens
tctggtttcttccagccac

SEQ ID NO: 5668724 - DNA, 18 bp, Homo sapiens
tctggtttgactccgctg

SEQ ID NO: 5668725 - DNA, 14 bp, Homo sapiens
tctggttttgtgtt

SEQ ID NO: 5668726 - DNA, 19 bp, Homo sapiens
tctggtttttaaaagataa

SEQ ID NO: 5668727 - DNA, 13 bp, Homo sapiens
tctgtaaaaaaga

SEQ ID NO: 5668728 - DNA, 14 bp, Homo sapiens
tctgtaaaaaagaa

SEQ ID NO: 5668729 - DNA, 14 bp, Homo sapiens
tctgtaaaaaatgg

SEQ ID NO: 5668730 - DNA, 18 bp, Homo sapiens
tctgtaaaaaatggagct

SEQ ID NO: 5668731 - DNA, 16 bp, Homo sapiens
tctgtaaaaacactga

SEQ ID NO: 5668732 - DNA, 22 bp, Homo sapiens
tctgtaaaaattgttataatta

SEQ ID NO: 5668733 - DNA, 15 bp, Homo sapiens
tctgtaaaagtgtct

SEQ ID NO: 5668734 - DNA, 16 bp, Homo sapiens
tctgtaaaagtgtctg

SEQ ID NO: 5668735 - DNA, 17 bp, Homo sapiens
tctgtaaaagtgtctgt

SEQ ID NO: 5668736 - DNA, 18 bp, Homo sapiens
tctgtaaaagtgtctgta

SEQ ID NO: 5668737 - DNA, 16 bp, Homo sapiens
tctgtaaaagttacta

SEQ ID NO: 5668738 - DNA, 17 bp, Homo sapiens
tctgtaaaagttactaa

SEQ ID NO: 5668739 - DNA, 19 bp, Homo sapiens
tctgtaaaagttactaata

SEQ ID NO: 5668740 - DNA, 23 bp, Homo sapiens
tctgtaaaagttactaatatatc

SEQ ID NO: 5668741 - DNA, 12 bp, Homo sapiens
tctgtaaaatct

SEQ ID NO: 5668742 - DNA, 13 bp, Homo sapiens
tctgtaaaatctt

SEQ ID NO: 5668743 - DNA, 14 bp, Homo sapiens
tctgtaaaatcttt

SEQ ID NO: 5668744 - DNA, 23 bp, Homo sapiens
tctgtaaaatctttctttcttag

SEQ ID NO: 5668745 - DNA, 13 bp, Homo sapiens
tctgtaaactgtg

SEQ ID NO: 5668746 - DNA, 22 bp, Homo sapiens
tctgtaaactgtgtattccaag

SEQ ID NO: 5668747 - DNA, 13 bp, Homo sapiens
tctgtaaagctaa

SEQ ID NO: 5668748 - DNA, 22 bp, Homo sapiens
tctgtaaataccattgacacat

SEQ ID NO: 5668749 - DNA, 15 bp, Homo sapiens
tctgtaaatatccca

SEQ ID NO: 5668750 - DNA, 19 bp, Homo sapiens
tctgtaaatatcccagaga

SEQ ID NO: 5668751 - DNA, 22 bp, Homo sapiens
tctgtaaatccagtgttacaat

SEQ ID NO: 5668752 - DNA, 13 bp, Homo sapiens
tctgtaaattcat

SEQ ID NO: 5668753 - DNA, 16 bp, Homo sapiens
tctgtaaatttaactg

SEQ ID NO: 5668754 - DNA, 22 bp, Homo sapiens
tctgtaaatttaactgcatata

SEQ ID NO: 5668755 - DNA, 14 bp, Homo sapiens
tctgtaacactatt

SEQ ID NO: 5668756 - DNA, 18 bp, Homo sapiens
tctgtaacactattacag

SEQ ID NO: 5668757 - DNA, 21 bp, Homo sapiens
tctgtaacactattacagtat

SEQ ID NO: 5668758 - DNA, 20 bp, Homo sapiens
tctgtaacatcgcacagttt

SEQ ID NO: 5668759 - DNA, 21 bp, Homo sapiens
tctgtaaccacctctctgtct

SEQ ID NO: 5668760 - DNA, 16 bp, Homo sapiens
tctgtaacccccaagg

SEQ ID NO: 5668761 - DNA, 20 bp, Homo sapiens
tctgtaacccttgaatttct

SEQ ID NO: 5668762 - DNA, 18 bp, Homo sapiens
tgcgtagaagatatggaa

SEQ ID NO: 5668763 - DNA, 19 bp, Homo sapiens
tgcgtagaattgcaggtct

SEQ ID NO: 5668764 - DNA, 16 bp, Homo sapiens
tgcgtatatgtgcgtc

SEQ ID NO: 5668765 - DNA, 16 bp, Homo sapiens
tgcgtatgcagtgtag

SEQ ID NO: 5668766 - DNA, 14 bp, Homo sapiens
tgcgtatgtctgtt

SEQ ID NO: 5668767 - DNA, 13 bp, Homo sapiens
tgcgtattctgtg

SEQ ID NO: 5668768 - DNA, 15 bp, Homo sapiens
tgcgtattctgtggc

SEQ ID NO: 5668769 - DNA, 18 bp, Homo sapiens
tgcgtattctgtggccgc

SEQ ID NO: 5668770 - DNA, 17 bp, Homo sapiens
tgcgtattggctttttc

SEQ ID NO: 5668771 - DNA, 22 bp, Homo sapiens
tgcgtcaggcacgtctcctgct

SEQ ID NO: 5668772 - DNA, 14 bp, Homo sapiens
tgcgtcatggctca

SEQ ID NO: 5668773 - DNA, 23 bp, Homo sapiens
tgcgtcatgggccccccatgcat

SEQ ID NO: 5668774 - DNA, 15 bp, Homo sapiens
tgcgtccaccaggcc

SEQ ID NO: 5668775 - DNA, 21 bp, Homo sapiens
tgcgtccactttcccttcccc

SEQ ID NO: 5668776 - DNA, 20 bp, Homo sapiens
tgcgtcccagctgaaggcag

SEQ ID NO: 5668777 - DNA, 14 bp, Homo sapiens
tgcgtccccactcc

SEQ ID NO: 5668778 - DNA, 21 bp, Homo sapiens
tgcgtcccccagccctcaggc

SEQ ID NO: 5668779 - DNA, 22 bp, Homo sapiens
tgcgtcccccagccctcaggcc

SEQ ID NO: 5668780 - DNA, 18 bp, Homo sapiens
tgcgtcccccgttgtgcc

SEQ ID NO: 5668781 - DNA, 22 bp, Homo sapiens
tgcgtcccccgttgtgcctggt

SEQ ID NO: 5668782 - DNA, 16 bp, Homo sapiens
tgcgtccctgctcagc

SEQ ID NO: 5668783 - DNA, 20 bp, Homo sapiens
tgcgtccctgctcagcccat

SEQ ID NO: 5668784 - DNA, 13 bp, Homo sapiens
tgcgtccctgtac

SEQ ID NO: 5668785 - DNA, 22 bp, Homo sapiens
tgcgtccgcacgcggccgctct

SEQ ID NO: 5668786 - DNA, 15 bp, Homo sapiens
tgcgtcgagctggga

SEQ ID NO: 5668787 - DNA, 15 bp, Homo sapiens
tgcgtctacccagac

SEQ ID NO: 5668788 - DNA, 16 bp, Homo sapiens
tgcgtctatcctgtgt

SEQ ID NO: 5668789 - DNA, 13 bp, Homo sapiens
tgcgtctccagtc

SEQ ID NO: 5668790 - DNA, 16 bp, Homo sapiens
tgcgtctcctgcccac

SEQ ID NO: 5668791 - DNA, 16 bp, Homo sapiens
tgcgtctgaggcctgc

SEQ ID NO: 5668792 - DNA, 20 bp, Homo sapiens
tgcgtctggaggggcccctg

SEQ ID NO: 5668793 - DNA, 22 bp, Homo sapiens
tgcgtctggaggggcccctgct

SEQ ID NO: 5668794 - DNA, 23 bp, Homo sapiens
tgcgtctggaggggcccctgctt

SEQ ID NO: 5668795 - DNA, 23 bp, Homo sapiens
tgcgtcttagcagtgatttttat

SEQ ID NO: 5668796 - DNA, 14 bp, Homo sapiens
tgcgtcttccgccc

SEQ ID NO: 5668797 - DNA, 19 bp, Homo sapiens
tgcgtcttccgcccctgcc

SEQ ID NO: 5668798 - DNA, 22 bp, Homo sapiens
tgcgtcttggtgtaatttgaag

SEQ ID NO: 5668799 - DNA, 15 bp, Homo sapiens
tgcgtcttgtgaaat

SEQ ID NO: 5668800 - DNA, 12 bp, Homo sapiens
tgcgtgaatgta

SEQ ID NO: 5668801 - DNA, 20 bp, Homo sapiens
tgcgtgaatgtatgtaatgt

SEQ ID NO: 5668802 - DNA, 17 bp, Homo sapiens
tgcgtgacaataaaaca

SEQ ID NO: 5668803 - DNA, 22 bp, Homo sapiens
tgcgtgacaataaaacattaat

SEQ ID NO: 5668804 - DNA, 19 bp, Homo sapiens
tgcgtgacactctccttgc

SEQ ID NO: 5668805 - DNA, 22 bp, Homo sapiens
tgcgtgaccggcccgccacctt

SEQ ID NO: 5668806 - DNA, 22 bp, Homo sapiens
tgcgtgccacatcaataacaac

SEQ ID NO: 5668807 - DNA, 17 bp, Homo sapiens
tgcgtgccatgagtcca

SEQ ID NO: 5668808 - DNA, 23 bp, Homo sapiens
tgcgtgccatgagtccatgtcct

SEQ ID NO: 5668809 - DNA, 17 bp, Homo sapiens
tgcgtgccgcctgctcc

SEQ ID NO: 5668810 - DNA, 18 bp, Homo sapiens
tgcgtgccgcctgctcct

SEQ ID NO: 5668811 - DNA, 15 bp, Homo sapiens
tgcgtgccgtgtgag

SEQ ID NO: 5668812 - DNA, 17 bp, Homo sapiens
tgcgtgccgtgtgagtg

SEQ ID NO: 5668813 - DNA, 17 bp, Homo sapiens
tgcgtgcgagcacacac

SEQ ID NO: 5668814 - DNA, 16 bp, Homo sapiens
tgcgtgcgtgtgcgtg

SEQ ID NO: 5668815 - DNA, 17 bp, Homo sapiens
tgcgtgctgtctgtcct

SEQ ID NO: 5668816 - DNA, 13 bp, Homo sapiens
tgcgtggaaaaag

SEQ ID NO: 5668817 - DNA, 18 bp, Homo sapiens
tgcgtggaagtgttcctg

SEQ ID NO: 5668818 - DNA, 22 bp, Homo sapiens
tgcgtggaagtgttcctgtctc

SEQ ID NO: 5668819 - DNA, 23 bp, Homo sapiens
tgcgtggaagtgttcctgtctca

SEQ ID NO: 5668820 - DNA, 20 bp, Homo sapiens
tgcgtggaatgcccttcact

SEQ ID NO: 5668821 - DNA, 17 bp, Homo sapiens
tgcgtggactctgcaca

SEQ ID NO: 5668822 - DNA, 20 bp, Homo sapiens
tgcgtggatcaagcttgtgt

SEQ ID NO: 5668823 - DNA, 22 bp, Homo sapiens
tgcgtggcacatctaaattgat

SEQ ID NO: 5668824 - DNA, 20 bp, Homo sapiens
tgcgtggcgcaggtgccatg

SEQ ID NO: 5668825 - DNA, 15 bp, Homo sapiens
tgcgtggcgtggccc

SEQ ID NO: 5668826 - DNA, 15 bp, Homo sapiens
tgcgtggctgtggca

SEQ ID NO: 5668827 - DNA, 18 bp, Homo sapiens
tgcgtgggaggcagaaac

SEQ ID NO: 5668828 - DNA, 13 bp, Homo sapiens
tgcgtgggcagag

SEQ ID NO: 5668829 - DNA, 16 bp, Homo sapiens
tgcgtgggtcagaaga

SEQ ID NO: 5668830 - DNA, 23 bp, Homo sapiens
tgcgtgggtgtgtgcgtgtttgg

SEQ ID NO: 5668831 - DNA, 21 bp, Homo sapiens
tgcgtggtggtccctgggtag

SEQ ID NO: 5668832 - DNA, 14 bp, Homo sapiens
tgcgtggtgtggcc

SEQ ID NO: 5668833 - DNA, 15 bp, Homo sapiens
tgcgtgtatatgtgc

SEQ ID NO: 5668834 - DNA, 15 bp, Homo sapiens
tgcgtgtctctgcca

SEQ ID NO: 5668835 - DNA, 20 bp, Homo sapiens
tgcgtgtgacagtgtatggg

SEQ ID NO: 5668836 - DNA, 17 bp, Homo sapiens
tgcgtgtgcgtgttcct

SEQ ID NO: 5668837 - DNA, 19 bp, Homo sapiens
tgcgtgtggccctgtggga

SEQ ID NO: 5668838 - DNA, 19 bp, Homo sapiens
tgcgtgtgtagagttaaga

SEQ ID NO: 5668839 - DNA, 24 bp, Homo sapiens
tgcgtgtgtagagttaagaagctg

SEQ ID NO: 5668840 - DNA, 12 bp, Homo sapiens
tgcgtgtgtata

SEQ ID NO: 5668841 - DNA, 21 bp, Homo sapiens
tgcgtgtgtatatttgtaata

SEQ ID NO: 5668842 - DNA, 12 bp, Homo sapiens
tgctacaggagg

SEQ ID NO: 5668843 - DNA, 18 bp, Homo sapiens
tgctacaggaggggtctc

SEQ ID NO: 5668844 - DNA, 20 bp, Homo sapiens
tgctacagggtccaacatag

SEQ ID NO: 5668845 - DNA, 19 bp, Homo sapiens
tgctacagtactatgtaaa

SEQ ID NO: 5668846 - DNA, 21 bp, Homo sapiens
tgctacagtactatgtaaatt

SEQ ID NO: 5668847 - DNA, 14 bp, Homo sapiens
tgctacataaattg

SEQ ID NO: 5668848 - DNA, 18 bp, Homo sapiens
tgctacatcagactctag

SEQ ID NO: 5668849 - DNA, 23 bp, Homo sapiens
tgctacatgacgacaaagctgct

SEQ ID NO: 5668850 - DNA, 24 bp, Homo sapiens
tgctacatgacgacaaagctgcta

SEQ ID NO: 5668851 - DNA, 16 bp, Homo sapiens
tgctacattttgtggc

SEQ ID NO: 5668852 - DNA, 23 bp, Homo sapiens
tgctaccaaagaatgcatgttct

SEQ ID NO: 5668853 - DNA, 23 bp, Homo sapiens
tgctaccaatctgtgagaagttt

SEQ ID NO: 5668854 - DNA, 14 bp, Homo sapiens
tgctaccacagact

SEQ ID NO: 5668855 - DNA, 13 bp, Homo sapiens
tgctaccaccagc

SEQ ID NO: 5668856 - DNA, 17 bp, Homo sapiens
tgctaccaccagctgtg

SEQ ID NO: 5668857 - DNA, 20 bp, Homo sapiens
tgctaccacggcctcctttc

SEQ ID NO: 5668858 - DNA, 17 bp, Homo sapiens
tgctaccgccctgggct

SEQ ID NO: 5668859 - DNA, 16 bp, Homo sapiens
tgctacctcagtcagt

SEQ ID NO: 5668860 - DNA, 19 bp, Homo sapiens
tgctacctcagtgctcctg

SEQ ID NO: 5668861 - DNA, 21 bp, Homo sapiens
tgctacctcagtgctcctgga

SEQ ID NO: 5668862 - DNA, 22 bp, Homo sapiens
tgctacctctaacaccacactg

SEQ ID NO: 5668863 - DNA, 23 bp, Homo sapiens
tgctacctctaacaccacactga

SEQ ID NO: 5668864 - DNA, 14 bp, Homo sapiens
tgctacctctgaga

SEQ ID NO: 5668865 - DNA, 18 bp, Homo sapiens
tgctacctgatcccactc

SEQ ID NO: 5668866 - DNA, 23 bp, Homo sapiens
tgctacctgatcccactcctagg

SEQ ID NO: 5668867 - DNA, 14 bp, Homo sapiens
tgctacctggtttt

SEQ ID NO: 5668868 - DNA, 18 bp, Homo sapiens
tgctacctggttttcatt

SEQ ID NO: 5668869 - DNA, 22 bp, Homo sapiens
tgctacctggttttcattattt

SEQ ID NO: 5668870 - DNA, 15 bp, Homo sapiens
tgctacctgtgagca

SEQ ID NO: 5668871 - DNA, 17 bp, Homo sapiens
tgctacctttcaaagct

SEQ ID NO: 5668872 - DNA, 16 bp, Homo sapiens
tgctacgattccactg

SEQ ID NO: 5668873 - DNA, 16 bp, Homo sapiens
tgctacgcctgcatgt

SEQ ID NO: 5668874 - DNA, 15 bp, Homo sapiens
tgctacgtgcctccc

SEQ ID NO: 5668875 - DNA, 13 bp, Homo sapiens
tgctacgtgtgat

SEQ ID NO: 5668876 - DNA, 14 bp, Homo sapiens
tgctacgtgtgatt

SEQ ID NO: 5668877 - DNA, 12 bp, Homo sapiens
tgctactaacag

SEQ ID NO: 5668878 - DNA, 23 bp, Homo sapiens
tgctactaacagattataataaa

SEQ ID NO: 5668879 - DNA, 21 bp, Homo sapiens
tgctactacccgagcccagct

SEQ ID NO: 5668880 - DNA, 20 bp, Homo sapiens
tgctactagattgtgagctc

SEQ ID NO: 5668881 - DNA, 14 bp, Homo sapiens
tgctactagctctt

SEQ ID NO: 5668882 - DNA, 20 bp, Homo sapiens
tgctactataatcaaatgat

SEQ ID NO: 5668883 - DNA, 22 bp, Homo sapiens
tgctactccactgacctggaag

SEQ ID NO: 5668884 - DNA, 16 bp, Homo sapiens
tgctactctgttcctt

SEQ ID NO: 5668885 - DNA, 14 bp, Homo sapiens
tgctactgattgtt

SEQ ID NO: 5668886 - DNA, 14 bp, Homo sapiens
tgctactgccaacc

SEQ ID NO: 5668887 - DNA, 15 bp, Homo sapiens
tgctactgctcagct

SEQ ID NO: 5668888 - DNA, 22 bp, Homo sapiens
tgctactgtacataaacaatga

SEQ ID NO: 5668889 - DNA, 14 bp, Homo sapiens
tgctactgtcagtg

SEQ ID NO: 5668890 - DNA, 15 bp, Homo sapiens
tgctactgtcagtgt

SEQ ID NO: 5668891 - DNA, 21 bp, Homo sapiens
tgctactgtcctacccaccct

SEQ ID NO: 5668892 - DNA, 18 bp, Homo sapiens
tgctactgtctttggaaa

SEQ ID NO: 5668893 - DNA, 21 bp, Homo sapiens
tgctactgttgtaagaattct

SEQ ID NO: 5668894 - DNA, 22 bp, Homo sapiens
tgctacttaattcctttctcat

SEQ ID NO: 5668895 - DNA, 22 bp, Homo sapiens
tgctacttatcatttttgtata

SEQ ID NO: 5668896 - DNA, 12 bp, Homo sapiens
tgctacttccca

SEQ ID NO: 5668897 - DNA, 15 bp, Homo sapiens
tgctacttcctgcct

SEQ ID NO: 5668898 - DNA, 22 bp, Homo sapiens
tgctacttcctgcctggtctcc

SEQ ID NO: 5668899 - DNA, 14 bp, Homo sapiens
tgctacttgctctg

SEQ ID NO: 5668900 - DNA, 18 bp, Homo sapiens
tgctactttgtatcctct

SEQ ID NO: 5668901 - DNA, 20 bp, Homo sapiens
tgctacttttacttgttcat

SEQ ID NO: 5668902 - DNA, 13 bp, Homo sapiens
tgctagaaaaatt

SEQ ID NO: 5668903 - DNA, 21 bp, Homo sapiens
tgctagaaaagacataatcat

SEQ ID NO: 5668904 - DNA, 23 bp, Homo sapiens
tgctagaaagttagggggttctt

SEQ ID NO: 5668905 - DNA, 14 bp, Homo sapiens
tgctagaaattttc

SEQ ID NO: 5668906 - DNA, 15 bp, Homo sapiens
tgctagaacatggtt

SEQ ID NO: 5668907 - DNA, 13 bp, Homo sapiens
tgctagaactttt

SEQ ID NO: 5668908 - DNA, 19 bp, Homo sapiens
tgctagaacttttttaaat

SEQ ID NO: 5668909 - DNA, 22 bp, Homo sapiens
tgctagaacttttttaaataaa

SEQ ID NO: 5668910 - DNA, 23 bp, Homo sapiens
tgctagaacttttttaaataaac

SEQ ID NO: 5668911 - DNA, 14 bp, Homo sapiens
tgctagaagaaaac

SEQ ID NO: 5668912 - DNA, 22 bp, Homo sapiens
tgctagaattgattttttttct

SEQ ID NO: 5668913 - DNA, 21 bp, Homo sapiens
tgctagactcctcaggagaga

SEQ ID NO: 5668914 - DNA, 22 bp, Homo sapiens
tgctagactcctcaggagagac

SEQ ID NO: 5668915 - DNA, 14 bp, Homo sapiens
tgctagagcaaccc

SEQ ID NO: 5668916 - DNA, 17 bp, Homo sapiens
tgctagagcaacccctg

SEQ ID NO: 5668917 - DNA, 13 bp, Homo sapiens
tgctagagctcct

SEQ ID NO: 5668918 - DNA, 14 bp, Homo sapiens
tgctagagctcctc

SEQ ID NO: 5668919 - DNA, 16 bp, Homo sapiens
tgctagagttaaaagt

SEQ ID NO: 5668920 - DNA, 19 bp, Homo sapiens
tgctagagttaaaagttag

SEQ ID NO: 5668921 - DNA, 14 bp, Homo sapiens
tgctagataaaagc

SEQ ID NO: 5668922 - DNA, 20 bp, Homo sapiens
tgctagatatcacttactca

SEQ ID NO: 5668923 - DNA, 20 bp, Homo sapiens
tgctagatgtgcaaatgcaa

SEQ ID NO: 5668924 - DNA, 22 bp, Homo sapiens
tgctagattttaatttatttgt

SEQ ID NO: 5668925 - DNA, 22 bp, Homo sapiens
tgctagcaaacaaatggcttac

SEQ ID NO: 5668926 - DNA, 17 bp, Homo sapiens
tgctagcacagaggcct

SEQ ID NO: 5668927 - DNA, 18 bp, Homo sapiens
tgctagcacagaggcctg

SEQ ID NO: 5668928 - DNA, 20 bp, Homo sapiens
tgctagcacagaggcctgac

SEQ ID NO: 5668929 - DNA, 21 bp, Homo sapiens
tgctagcacagaggcctgact

SEQ ID NO: 5668930 - DNA, 21 bp, Homo sapiens
tgctagcacctccccagacag

SEQ ID NO: 5668931 - DNA, 23 bp, Homo sapiens
tgctagcacctccccagacaggg

SEQ ID NO: 5668932 - DNA, 19 bp, Homo sapiens
tgctagcatgggtattttt

SEQ ID NO: 5668933 - DNA, 18 bp, Homo sapiens
tgctagccactggaaatg

SEQ ID NO: 5668934 - DNA, 20 bp, Homo sapiens
tgctagccagcattccatat

SEQ ID NO: 5668935 - DNA, 19 bp, Homo sapiens
tgctagccctggggtggcg

SEQ ID NO: 5668936 - DNA, 20 bp, Homo sapiens
tgctagcccttcaagtgcac

SEQ ID NO: 5668937 - DNA, 17 bp, Homo sapiens
tgctagctagccagcca

SEQ ID NO: 5668938 - DNA, 21 bp, Homo sapiens
tgctagctatatatttaggaa

SEQ ID NO: 5668939 - DNA, 21 bp, Homo sapiens
tctgtcaccacatcttgtctt

SEQ ID NO: 5668940 - DNA, 17 bp, Homo sapiens
tctgtcacccagactgg

SEQ ID NO: 5668941 - DNA, 18 bp, Homo sapiens
tctgtcacccagtctgtt

SEQ ID NO: 5668942 - DNA, 14 bp, Homo sapiens
tctgtcaccctggc

SEQ ID NO: 5668943 - DNA, 15 bp, Homo sapiens
tctgtcaccctggcc

SEQ ID NO: 5668944 - DNA, 16 bp, Homo sapiens
tctgtcaccctggcca

SEQ ID NO: 5668945 - DNA, 14 bp, Homo sapiens
tctgtcacgtgaaa

SEQ ID NO: 5668946 - DNA, 14 bp, Homo sapiens
tctgtcactcaggc

SEQ ID NO: 5668947 - DNA, 21 bp, Homo sapiens
tctgtcacttgcattccactt

SEQ ID NO: 5668948 - DNA, 14 bp, Homo sapiens
tctgtcagaagaca

SEQ ID NO: 5668949 - DNA, 15 bp, Homo sapiens
tctgtcagcatctgg

SEQ ID NO: 5668950 - DNA, 17 bp, Homo sapiens
tctgtcagcatctggct

SEQ ID NO: 5668951 - DNA, 21 bp, Homo sapiens
tctgtcagcgcaggtttagtt

SEQ ID NO: 5668952 - DNA, 14 bp, Homo sapiens
tctgtcagctgcaa

SEQ ID NO: 5668953 - DNA, 15 bp, Homo sapiens
tctgtcagcttccca

SEQ ID NO: 5668954 - DNA, 13 bp, Homo sapiens
tctgtcaggggct

SEQ ID NO: 5668955 - DNA, 19 bp, Homo sapiens
tctgtcaggggcttggatt

SEQ ID NO: 5668956 - DNA, 18 bp, Homo sapiens
tctgtcagggttggaaag

SEQ ID NO: 5668957 - DNA, 20 bp, Homo sapiens
tctgtcaggtgtgataaaat

SEQ ID NO: 5668958 - DNA, 17 bp, Homo sapiens
tctgtcagtcacagcca

SEQ ID NO: 5668959 - DNA, 17 bp, Homo sapiens
tctgtcagtttgtgaag

SEQ ID NO: 5668960 - DNA, 21 bp, Homo sapiens
tctgtcataagcattacttta

SEQ ID NO: 5668961 - DNA, 19 bp, Homo sapiens
tctgtcataggactctgga

SEQ ID NO: 5668962 - DNA, 19 bp, Homo sapiens
tctgtcatcccgctcctgc

SEQ ID NO: 5668963 - DNA, 16 bp, Homo sapiens
tctgtcatctctctgg

SEQ ID NO: 5668964 - DNA, 18 bp, Homo sapiens
tctgtcatctctctgggg

SEQ ID NO: 5668965 - DNA, 21 bp, Homo sapiens
tctgtcatctctctggggccc

SEQ ID NO: 5668966 - DNA, 15 bp, Homo sapiens
tctgtcattaaactc

SEQ ID NO: 5668967 - DNA, 22 bp, Homo sapiens
tctgtcattatattctaattaa

SEQ ID NO: 5668968 - DNA, 19 bp, Homo sapiens
tctgtcattggttacaaat

SEQ ID NO: 5668969 - DNA, 20 bp, Homo sapiens
tctgtcattggttacaaatt

SEQ ID NO: 5668970 - DNA, 19 bp, Homo sapiens
tctgtcattgttaaataca

SEQ ID NO: 5668971 - DNA, 15 bp, Homo sapiens
tctgtcatttacaca

SEQ ID NO: 5668972 - DNA, 13 bp, Homo sapiens
tctgtcatttctc

SEQ ID NO: 5668973 - DNA, 20 bp, Homo sapiens
tctgtcatttgagcagggct

SEQ ID NO: 5668974 - DNA, 12 bp, Homo sapiens
tctgtccaaccc

SEQ ID NO: 5668975 - DNA, 13 bp, Homo sapiens
tctgtccaacccc

SEQ ID NO: 5668976 - DNA, 16 bp, Homo sapiens
tctgtccaacccctcc

SEQ ID NO: 5668977 - DNA, 20 bp, Homo sapiens
tctgtccaacccctccccca

SEQ ID NO: 5668978 - DNA, 16 bp, Homo sapiens
tctgtccaactctgta

SEQ ID NO: 5668979 - DNA, 19 bp, Homo sapiens
tctgtccaactgagaagta

SEQ ID NO: 5668980 - DNA, 13 bp, Homo sapiens
tctgtccaaggaa

SEQ ID NO: 5668981 - DNA, 21 bp, Homo sapiens
tctgtccaagtacttaactat

SEQ ID NO: 5668982 - DNA, 19 bp, Homo sapiens
tctgtccaattccagagct

SEQ ID NO: 5668983 - DNA, 18 bp, Homo sapiens
tctgtccacatccccaga

SEQ ID NO: 5668984 - DNA, 14 bp, Homo sapiens
tctgtccaccagcc

SEQ ID NO: 5668985 - DNA, 15 bp, Homo sapiens
tctgtccacgtggag

SEQ ID NO: 5668986 - DNA, 12 bp, Homo sapiens
tctgtccactct

SEQ ID NO: 5668987 - DNA, 13 bp, Homo sapiens
tctgtccacttgt

SEQ ID NO: 5668988 - DNA, 23 bp, Homo sapiens
tctgtccacttgtgggtcctggg

SEQ ID NO: 5668989 - DNA, 19 bp, Homo sapiens
tctgtccagaggctgcaag

SEQ ID NO: 5668990 - DNA, 17 bp, Homo sapiens
tctgtccagccagctcc

SEQ ID NO: 5668991 - DNA, 15 bp, Homo sapiens
tctgtccagccgtgt

SEQ ID NO: 5668992 - DNA, 16 bp, Homo sapiens
tctgtccagccgtgtg

SEQ ID NO: 5668993 - DNA, 17 bp, Homo sapiens
tctgtccaggccactgt

SEQ ID NO: 5668994 - DNA, 21 bp, Homo sapiens
tctgtccaggccactgtggcc

SEQ ID NO: 5668995 - DNA, 23 bp, Homo sapiens
tctgtccaggccactgtggccag

SEQ ID NO: 5668996 - DNA, 19 bp, Homo sapiens
tctgtccagggccctgagc

SEQ ID NO: 5668997 - DNA, 13 bp, Homo sapiens
tctgtccagggct

SEQ ID NO: 5668998 - DNA, 21 bp, Homo sapiens
tctgtccatcctcctctccat

SEQ ID NO: 5668999 - DNA, 13 bp, Homo sapiens
tctgtccatctgc

SEQ ID NO: 5669000 - DNA, 16 bp, Homo sapiens
tctgtccatctgcccg

SEQ ID NO: 5669001 - DNA, 21 bp, Homo sapiens
tctgtccatctgtctgtccta

SEQ ID NO: 5669002 - DNA, 15 bp, Homo sapiens
tctgtccatggcctt

SEQ ID NO: 5669003 - DNA, 21 bp, Homo sapiens
tctgtcccaatcttaccagat

SEQ ID NO: 5669004 - DNA, 14 bp, Homo sapiens
tctgtcccacccct

SEQ ID NO: 5669005 - DNA, 17 bp, Homo sapiens
tctgtcccactgggaca

SEQ ID NO: 5669006 - DNA, 17 bp, Homo sapiens
tctgtcccacttggcat

SEQ ID NO: 5669007 - DNA, 21 bp, Homo sapiens
tctgtcccacttggcatcagc

SEQ ID NO: 5669008 - DNA, 13 bp, Homo sapiens
tctgtcccaggtt

SEQ ID NO: 5669009 - DNA, 23 bp, Homo sapiens
tctgtccccaaaatgtggaatgc

SEQ ID NO: 5669010 - DNA, 14 bp, Homo sapiens
tctgtccccacgag

SEQ ID NO: 5669011 - DNA, 14 bp, Homo sapiens
tctgtccccaggcc

SEQ ID NO: 5669012 - DNA, 19 bp, Homo sapiens
tctgtccccaggcctggct

SEQ ID NO: 5669013 - DNA, 15 bp, Homo sapiens
tctgtcccccaggct

SEQ ID NO: 5669014 - DNA, 15 bp, Homo sapiens
tctgtccccccagct

SEQ ID NO: 5669015 - DNA, 17 bp, Homo sapiens
tctgtccccgagccgag

SEQ ID NO: 5669016 - DNA, 20 bp, Homo sapiens
tctgtccccgagccgagctc

SEQ ID NO: 5669017 - DNA, 24 bp, Homo sapiens
tctgtccccgagccgagctctcct

SEQ ID NO: 5669018 - DNA, 19 bp, Homo sapiens
ttacaaactgcggtataca

SEQ ID NO: 5669019 - DNA, 20 bp, Homo sapiens
ttacaaagaaccatgcagga

SEQ ID NO: 5669020 - DNA, 17 bp, Homo sapiens
ttacaaagaggttttat

SEQ ID NO: 5669021 - DNA, 14 bp, Homo sapiens
ttacaaagcagtta

SEQ ID NO: 5669022 - DNA, 18 bp, Homo sapiens
ttacaaaggctgtattca

SEQ ID NO: 5669023 - DNA, 21 bp, Homo sapiens
ttacaaagggaaagcctctgg

SEQ ID NO: 5669024 - DNA, 22 bp, Homo sapiens
ttacaaagggaaagcctctggc

SEQ ID NO: 5669025 - DNA, 16 bp, Homo sapiens
ttacaaagtgtgtatt

SEQ ID NO: 5669026 - DNA, 14 bp, Homo sapiens
ttacaaagttatat

SEQ ID NO: 5669027 - DNA, 22 bp, Homo sapiens
ttacaaataaaattggcaccat

SEQ ID NO: 5669028 - DNA, 15 bp, Homo sapiens
ttacaaataaacagt

SEQ ID NO: 5669029 - DNA, 21 bp, Homo sapiens
ttacaaatataggttgtcttg

SEQ ID NO: 5669030 - DNA, 17 bp, Homo sapiens
ttacaaatcagaagtca

SEQ ID NO: 5669031 - DNA, 12 bp, Homo sapiens
ttacaaatgatt

SEQ ID NO: 5669032 - DNA, 21 bp, Homo sapiens
ttacaaatgattgcttttaaa

SEQ ID NO: 5669033 - DNA, 18 bp, Homo sapiens
ttacaaatggggcaaaca

SEQ ID NO: 5669034 - DNA, 17 bp, Homo sapiens
ttacaaatgtggctgta

SEQ ID NO: 5669035 - DNA, 22 bp, Homo sapiens
ttacaaattaagggttaaatca

SEQ ID NO: 5669036 - DNA, 19 bp, Homo sapiens
ttacaaattaatatttgtg

SEQ ID NO: 5669037 - DNA, 22 bp, Homo sapiens
ttacaaattcctttcagagttt

SEQ ID NO: 5669038 - DNA, 14 bp, Homo sapiens
ttacaaattggagc

SEQ ID NO: 5669039 - DNA, 22 bp, Homo sapiens
ttacaaattttcactgctgctc

SEQ ID NO: 5669040 - DNA, 14 bp, Homo sapiens
ttacaacaaacact

SEQ ID NO: 5669041 - DNA, 18 bp, Homo sapiens
ttacaacaagcaaactga

SEQ ID NO: 5669042 - DNA, 20 bp, Homo sapiens
ttacaacaagcaaactgaaa

SEQ ID NO: 5669043 - DNA, 20 bp, Homo sapiens
ttacaacagtagagagggaa

SEQ ID NO: 5669044 - DNA, 19 bp, Homo sapiens
ttacaacataatctagttt

SEQ ID NO: 5669045 - DNA, 21 bp, Homo sapiens
ttacaacattaattttatgaa

SEQ ID NO: 5669046 - DNA, 15 bp, Homo sapiens
ttacaacattcaact

SEQ ID NO: 5669047 - DNA, 19 bp, Homo sapiens
ttacaaccatactttatat

SEQ ID NO: 5669048 - DNA, 23 bp, Homo sapiens
ttacaaccatactttatatatgt

SEQ ID NO: 5669049 - DNA, 20 bp, Homo sapiens
ttacaacgaatttacagtct

SEQ ID NO: 5669050 - DNA, 14 bp, Homo sapiens
ttacaactaaataa

SEQ ID NO: 5669051 - DNA, 16 bp, Homo sapiens
ttacaactcccccacc

SEQ ID NO: 5669052 - DNA, 16 bp, Homo sapiens
ttacaactgactgact

SEQ ID NO: 5669053 - DNA, 13 bp, Homo sapiens
ttacaacttccag

SEQ ID NO: 5669054 - DNA, 13 bp, Homo sapiens
ttacaacttccat

SEQ ID NO: 5669055 - DNA, 20 bp, Homo sapiens
ttacaacttgattttttcaa

SEQ ID NO: 5669056 - DNA, 14 bp, Homo sapiens
ttacaactttctaa

SEQ ID NO: 5669057 - DNA, 16 bp, Homo sapiens
ttacaagaaataaatc

SEQ ID NO: 5669058 - DNA, 21 bp, Homo sapiens
ttacaagaaataaatctatat

SEQ ID NO: 5669059 - DNA, 18 bp, Homo sapiens
ttacaagaattgtccatg

SEQ ID NO: 5669060 - DNA, 17 bp, Homo sapiens
ttacaagactgtaaatt

SEQ ID NO: 5669061 - DNA, 21 bp, Homo sapiens
ttacaagactgtaaattccaa

SEQ ID NO: 5669062 - DNA, 22 bp, Homo sapiens
ttacaagatattattaattttt

SEQ ID NO: 5669063 - DNA, 21 bp, Homo sapiens
ttacaagcgtgagccactgca

SEQ ID NO: 5669064 - DNA, 16 bp, Homo sapiens
ttacaagcttaaagct

SEQ ID NO: 5669065 - DNA, 21 bp, Homo sapiens
ttacaagcttaaagcttgatt

SEQ ID NO: 5669066 - DNA, 20 bp, Homo sapiens
ttacaagggaagatttatgt

SEQ ID NO: 5669067 - DNA, 20 bp, Homo sapiens
ttacaagggagaagacaaca

SEQ ID NO: 5669068 - DNA, 18 bp, Homo sapiens
ttacaaggtgttgttaaa

SEQ ID NO: 5669069 - DNA, 16 bp, Homo sapiens
ttacaagtataacagt

SEQ ID NO: 5669070 - DNA, 19 bp, Homo sapiens
ttacaagtggctccccacc

SEQ ID NO: 5669071 - DNA, 16 bp, Homo sapiens
ttacaagtgtatatca

SEQ ID NO: 5669072 - DNA, 16 bp, Homo sapiens
ttacaagtgttcttag

SEQ ID NO: 5669073 - DNA, 16 bp, Homo sapiens
ttacaagtttgctaaa

SEQ ID NO: 5669074 - DNA, 20 bp, Homo sapiens
ttacaagtttgctaaaagaa

SEQ ID NO: 5669075 - DNA, 14 bp, Homo sapiens
ttacaataaacata

SEQ ID NO: 5669076 - DNA, 17 bp, Homo sapiens
ttacaataggagtggtg

SEQ ID NO: 5669077 - DNA, 15 bp, Homo sapiens
ttacaatatttgtgt

SEQ ID NO: 5669078 - DNA, 16 bp, Homo sapiens
ttacaatatttgtgtg

SEQ ID NO: 5669079 - DNA, 14 bp, Homo sapiens
ttacaatcaaatct

SEQ ID NO: 5669080 - DNA, 16 bp, Homo sapiens
ttacaatcaaatctcc

SEQ ID NO: 5669081 - DNA, 17 bp, Homo sapiens
ttacaatcattgctgaa

SEQ ID NO: 5669082 - DNA, 15 bp, Homo sapiens
ttacaatcgttctgt

SEQ ID NO: 5669083 - DNA, 14 bp, Homo sapiens
ttacaatctgtatc

SEQ ID NO: 5669084 - DNA, 14 bp, Homo sapiens
ttacaatggaaaca

SEQ ID NO: 5669085 - DNA, 17 bp, Homo sapiens
ttacaatggccagccca

SEQ ID NO: 5669086 - DNA, 15 bp, Homo sapiens
ttacaatgtaattat

SEQ ID NO: 5669087 - DNA, 17 bp, Homo sapiens
ttacaatgtaattattt

SEQ ID NO: 5669088 - DNA, 21 bp, Homo sapiens
ttacaatgtaattatttatgt

SEQ ID NO: 5669089 - DNA, 15 bp, Homo sapiens
ttacaatgtatcttt

SEQ ID NO: 5669090 - DNA, 15 bp, Homo sapiens
ttacaattgaaatga

SEQ ID NO: 5669091 - DNA, 17 bp, Homo sapiens
ttacaattgcactgctg

SEQ ID NO: 5669092 - DNA, 19 bp, Homo sapiens
ttacaattgttacagtact

SEQ ID NO: 5669093 - DNA, 16 bp, Homo sapiens
ttacaatttacaaagt

SEQ ID NO: 5669094 - DNA, 19 bp, Homo sapiens
ttacaatttacaaagtgtg

SEQ ID NO: 5669095 - DNA, 13 bp, Homo sapiens
ttacaatttcaaa

SEQ ID NO: 5669096 - DNA, 14 bp, Homo sapiens
ttacaatttgcaca

SEQ ID NO: 5669097 - DNA, 22 bp, Homo sapiens
ttacaatttgcacaatatttct

SEQ ID NO: 5669098 - DNA, 14 bp, Homo sapiens
ttacaattttctgt

SEQ ID NO: 5669099 - DNA, 17 bp, Homo sapiens
ttacaattttctgtaag

SEQ ID NO: 5669100 - DNA, 21 bp, Homo sapiens
ttacaatttttaataaattga

SEQ ID NO: 5669101 - DNA, 15 bp, Homo sapiens
ttacaattttttatc

SEQ ID NO: 5669102 - DNA, 20 bp, Homo sapiens
ttacaattttttatcatgca

SEQ ID NO: 5669103 - DNA, 21 bp, Homo sapiens
ttacaatttttttaattttgt

SEQ ID NO: 5669104 - DNA, 18 bp, Homo sapiens
ttacacaaaacaaatgcc

SEQ ID NO: 5669105 - DNA, 16 bp, Homo sapiens
ttacacaagagctgga

SEQ ID NO: 5669106 - DNA, 21 bp, Homo sapiens
ttacacaagtttaaaaatatt

SEQ ID NO: 5669107 - DNA, 20 bp, Homo sapiens
ttacacaattcttaccctgt

SEQ ID NO: 5669108 - DNA, 19 bp, Homo sapiens
ttacacacctgagaatgtg

SEQ ID NO: 5669109 - DNA, 22 bp, Homo sapiens
ttacacacctgagaatgtgcct

SEQ ID NO: 5669110 - DNA, 18 bp, Homo sapiens
ttacacactaacatcaat

SEQ ID NO: 5669111 - DNA, 13 bp, Homo sapiens
ttacacactcagg

SEQ ID NO: 5669112 - DNA, 20 bp, Homo sapiens
ttacacagaaacactgcctt

SEQ ID NO: 5669113 - DNA, 13 bp, Homo sapiens
ttacacagagaaa

SEQ ID NO: 5669114 - DNA, 17 bp, Homo sapiens
ttacacagagaaataca

SEQ ID NO: 5669115 - DNA, 15 bp, Homo sapiens
ttacacagcccaaga

SEQ ID NO: 5669116 - DNA, 16 bp, Homo sapiens
ttacacagcccaagag

SEQ ID NO: 5669117 - DNA, 19 bp, Homo sapiens
ttacacagtgagactgtac

SEQ ID NO: 5669118 - DNA, 22 bp, Homo sapiens
ttacacagtgagactgtacata

SEQ ID NO: 5669119 - DNA, 17 bp, Homo sapiens
ttacacatcttcaacag

SEQ ID NO: 5669120 - DNA, 14 bp, Homo sapiens
ttacacattaagta

SEQ ID NO: 5669121 - DNA, 17 bp, Homo sapiens
ttacacatttttcagat

SEQ ID NO: 5669122 - DNA, 14 bp, Homo sapiens
ttacaccacacttt

SEQ ID NO: 5669123 - DNA, 23 bp, Homo sapiens
ttacaccacactttcaaagacaa

SEQ ID NO: 5669124 - DNA, 21 bp, Homo sapiens
ttacaccagcctcgtcttcat

SEQ ID NO: 5669125 - DNA, 14 bp, Homo sapiens
ttacacccatgcac

SEQ ID NO: 5669126 - DNA, 18 bp, Homo sapiens
ttacaccgtgaggccaag

SEQ ID NO: 5669127 - DNA, 17 bp, Homo sapiens
ttacacctttatctcaa

SEQ ID NO: 5669128 - DNA, 15 bp, Homo sapiens
ttacacgagatttct

SEQ ID NO: 5669129 - DNA, 18 bp, Homo sapiens
ttacacgatcacctgcat

SEQ ID NO: 5669130 - DNA, 19 bp, Homo sapiens
ttacacggggttacactgt

SEQ ID NO: 5669131 - DNA, 15 bp, Homo sapiens
ttacactacaagttt

SEQ ID NO: 5669132 - DNA, 21 bp, Homo sapiens
ttacactacaagtttataagc

SEQ ID NO: 5669133 - DNA, 22 bp, Homo sapiens
ttacactacacactgtgtactg

SEQ ID NO: 5669134 - DNA, 18 bp, Homo sapiens
ttacactaggaaacgtgt

SEQ ID NO: 5669135 - DNA, 17 bp, Homo sapiens
ttacactatgataaagt

SEQ ID NO: 5669136 - DNA, 13 bp, Homo sapiens
ttacactccagcc

SEQ ID NO: 5669137 - DNA, 19 bp, Homo sapiens
ttacactcctctatcatgc

SEQ ID NO: 5669138 - DNA, 19 bp, Homo sapiens
ttacactcgaactcgggag

SEQ ID NO: 5669139 - DNA, 14 bp, Homo sapiens
ttacactgccatct

SEQ ID NO: 5669140 - DNA, 19 bp, Homo sapiens
ttacactgcctggtactga

SEQ ID NO: 5669141 - DNA, 18 bp, Homo sapiens
ttacactgcctgtatact

SEQ ID NO: 5669142 - DNA, 20 bp, Homo sapiens
ttacactgcggaagccaaag

SEQ ID NO: 5669143 - DNA, 14 bp, Homo sapiens
ttacactgtatttg

SEQ ID NO: 5669144 - DNA, 14 bp, Homo sapiens
ttacactgtgcctt

SEQ ID NO: 5669145 - DNA, 19 bp, Homo sapiens
ttacactgttagaacacta

SEQ ID NO: 5669146 - DNA, 20 bp, Homo sapiens
ttacactgttagaacactat

SEQ ID NO: 5669147 - DNA, 17 bp, Homo sapiens
ttacacttcttacccca

SEQ ID NO: 5669148 - DNA, 14 bp, Homo sapiens
ttacacttgcttta

SEQ ID NO: 5669149 - DNA, 23 bp, Homo sapiens
ttacacttgctttatttttcatt

SEQ ID NO: 5669150 - DNA, 15 bp, Homo sapiens
ttacacttggagccc

SEQ ID NO: 5669151 - DNA, 14 bp, Homo sapiens
ttacactttatggt

SEQ ID NO: 5669152 - DNA, 13 bp, Homo sapiens
ttacagaaaaaga

SEQ ID NO: 5669153 - DNA, 18 bp, Homo sapiens
ttacagaaaaagacttta

SEQ ID NO: 5669154 - DNA, 13 bp, Homo sapiens
ttacagaaaattt

SEQ ID NO: 5669155 - DNA, 15 bp, Homo sapiens
ttacagaaacacgga

SEQ ID NO: 5669156 - DNA, 19 bp, Homo sapiens
ttacagaaagtggtgctca

SEQ ID NO: 5669157 - DNA, 12 bp, Homo sapiens
ttacagaaatga

SEQ ID NO: 5669158 - DNA, 15 bp, Homo sapiens
ttacagaaatggact

SEQ ID NO: 5669159 - DNA, 19 bp, Homo sapiens
ttacagaaatggactggag

SEQ ID NO: 5669160 - DNA, 21 bp, Homo sapiens
ttacagaagagtttcttaact

SEQ ID NO: 5669161 - DNA, 22 bp, Homo sapiens
ttacagaagagtttcttaactt

SEQ ID NO: 5669162 - DNA, 14 bp, Homo sapiens
ttacagaataaaag

SEQ ID NO: 5669163 - DNA, 19 bp, Homo sapiens
ttacagaataaaagaatta

SEQ ID NO: 5669164 - DNA, 18 bp, Homo sapiens
ttacagaatattatataa

SEQ ID NO: 5669165 - DNA, 18 bp, Homo sapiens
ttacagaatgcattaaaa

SEQ ID NO: 5669166 - DNA, 23 bp, Homo sapiens
ttacagaattgcttgtttgcttc

SEQ ID NO: 5669167 - DNA, 20 bp, Homo sapiens
ttacagacaataaaatggaa

SEQ ID NO: 5669168 - DNA, 18 bp, Homo sapiens
ttacagaccatggatatg

SEQ ID NO: 5669169 - DNA, 20 bp, Homo sapiens
ttacagacctcagttttatg

SEQ ID NO: 5669170 - DNA, 23 bp, Homo sapiens
ttacagagaatttctaaagtaaa

SEQ ID NO: 5669171 - DNA, 14 bp, Homo sapiens
ttacagagaggaga

SEQ ID NO: 5669172 - DNA, 20 bp, Homo sapiens
ttacagagaggagaaacaca

SEQ ID NO: 5669173 - DNA, 22 bp, Homo sapiens
ttacagagaggagaaacacatc

SEQ ID NO: 5669174 - DNA, 18 bp, Homo sapiens
ttacagagaggatacatt

SEQ ID NO: 5669175 - DNA, 18 bp, Homo sapiens
ttacagagatataaatga

SEQ ID NO: 5669176 - DNA, 16 bp, Homo sapiens
ttacagaggaagttat

SEQ ID NO: 5669177 - DNA, 21 bp, Homo sapiens
ttacagaggtattaaaactaa

SEQ ID NO: 5669178 - DNA, 18 bp, Homo sapiens
ttacagataggccttctt

SEQ ID NO: 5669179 - DNA, 19 bp, Homo sapiens
ttacagatccagaatttat

SEQ ID NO: 5669180 - DNA, 12 bp, Homo sapiens
ttacagatgtga

SEQ ID NO: 5669181 - DNA, 15 bp, Homo sapiens
ttacagatgtgaaaa

SEQ ID NO: 5669182 - DNA, 16 bp, Homo sapiens
ttacagatgtgaaaat

SEQ ID NO: 5669183 - DNA, 22 bp, Homo sapiens
ttacagatgttttccactgagc

SEQ ID NO: 5669184 - DNA, 13 bp, Homo sapiens
tggatgtatttgt

SEQ ID NO: 5669185 - DNA, 15 bp, Homo sapiens
tggatgtcatatctt

SEQ ID NO: 5669186 - DNA, 14 bp, Homo sapiens
tggatgtccccagc

SEQ ID NO: 5669187 - DNA, 15 bp, Homo sapiens
tggatgtccccagca

SEQ ID NO: 5669188 - DNA, 16 bp, Homo sapiens
tggatgtccccagcag

SEQ ID NO: 5669189 - DNA, 21 bp, Homo sapiens
tggatgtccctattctgccat

SEQ ID NO: 5669190 - DNA, 24 bp, Homo sapiens
tggatgtccctattctgccatggg

SEQ ID NO: 5669191 - DNA, 12 bp, Homo sapiens
tggatgtctggc

SEQ ID NO: 5669192 - DNA, 13 bp, Homo sapiens
tggatgtctggct

SEQ ID NO: 5669193 - DNA, 12 bp, Homo sapiens
tggatgtgagca

SEQ ID NO: 5669194 - DNA, 15 bp, Homo sapiens
tggatgtgctttcat

SEQ ID NO: 5669195 - DNA, 17 bp, Homo sapiens
ttacatttttaaaggta

SEQ ID NO: 5669196 - DNA, 17 bp, Homo sapiens
ttacatttttacaataa

SEQ ID NO: 5669197 - DNA, 18 bp, Homo sapiens
ttacatttttacaataaa

SEQ ID NO: 5669198 - DNA, 21 bp, Homo sapiens
ttacatttttatttatgaagt

SEQ ID NO: 5669199 - DNA, 14 bp, Homo sapiens
ttacatttttctga

SEQ ID NO: 5669200 - DNA, 13 bp, Homo sapiens
ttaccaaaacaga

SEQ ID NO: 5669201 - DNA, 19 bp, Homo sapiens
ttaccaaacagcaaaccaa

SEQ ID NO: 5669202 - DNA, 10 bp, Homo sapiens
ttaccaaagc

SEQ ID NO: 5669203 - DNA, 16 bp, Homo sapiens
ttaccaaagcaatatt

SEQ ID NO: 5669204 - DNA, 23 bp, Homo sapiens
ttaccaaagtgtcttttgacatt

SEQ ID NO: 5669205 - DNA, 18 bp, Homo sapiens
ttaccaaatacacatttc

SEQ ID NO: 5669206 - DNA, 13 bp, Homo sapiens
ttaccaaatgaaa

SEQ ID NO: 5669207 - DNA, 17 bp, Homo sapiens
ttaccaacatgtatctg

SEQ ID NO: 5669208 - DNA, 16 bp, Homo sapiens
ttaccaagactcctgc

SEQ ID NO: 5669209 - DNA, 12 bp, Homo sapiens
ttaccaagcgct

SEQ ID NO: 5669210 - DNA, 22 bp, Homo sapiens
ttaccaaggaaagaacaaatgc

SEQ ID NO: 5669211 - DNA, 16 bp, Homo sapiens
ttaccaaggatgaatt

SEQ ID NO: 5669212 - DNA, 23 bp, Homo sapiens
ttaccaaggatgaattctttcaa

SEQ ID NO: 5669213 - DNA, 23 bp, Homo sapiens
ttaccaagttggtcttactttgt

SEQ ID NO: 5669214 - DNA, 22 bp, Homo sapiens
ttaccaattgaagtaaaatgtg

SEQ ID NO: 5669215 - DNA, 16 bp, Homo sapiens
ttaccacaaaagcaaa

SEQ ID NO: 5669216 - DNA, 14 bp, Homo sapiens
ttaccacagacata

SEQ ID NO: 5669217 - DNA, 22 bp, Homo sapiens
ttaccacatcacaccacttgga

SEQ ID NO: 5669218 - DNA, 13 bp, Homo sapiens
ttaccacccccac

SEQ ID NO: 5669219 - DNA, 19 bp, Homo sapiens
ttaccacggcaacccctgc

SEQ ID NO: 5669220 - DNA, 12 bp, Homo sapiens
ttaccactcagg

SEQ ID NO: 5669221 - DNA, 23 bp, Homo sapiens
ttaccagaacaattatgtttctt

SEQ ID NO: 5669222 - DNA, 17 bp, Homo sapiens
ttaccagacttcaagat

SEQ ID NO: 5669223 - DNA, 17 bp, Homo sapiens
ttaccagagacgcccag

SEQ ID NO: 5669224 - DNA, 18 bp, Homo sapiens
ttaccagataatgctact

SEQ ID NO: 5669225 - DNA, 13 bp, Homo sapiens
ttaccagatgcta

SEQ ID NO: 5669226 - DNA, 14 bp, Homo sapiens
ttaccagatgctac

SEQ ID NO: 5669227 - DNA, 20 bp, Homo sapiens
ttaccagatgctactggact

SEQ ID NO: 5669228 - DNA, 19 bp, Homo sapiens
ttaccagatgctgactggc

SEQ ID NO: 5669229 - DNA, 12 bp, Homo sapiens
ttaccagcaaga

SEQ ID NO: 5669230 - DNA, 19 bp, Homo sapiens
ttaccagcaagaataaaaa

SEQ ID NO: 5669231 - DNA, 12 bp, Homo sapiens
ttaccagccccc

SEQ ID NO: 5669232 - DNA, 21 bp, Homo sapiens
ttaccaggcaccaaaagaagt

SEQ ID NO: 5669233 - DNA, 23 bp, Homo sapiens
ttaccaggcaccaaaagaagtaa

SEQ ID NO: 5669234 - DNA, 19 bp, Homo sapiens
ttaccagggactatctttg

SEQ ID NO: 5669235 - DNA, 16 bp, Homo sapiens
ttaccaggttcactta

SEQ ID NO: 5669236 - DNA, 17 bp, Homo sapiens
ttaccagtcaatgcatt

SEQ ID NO: 5669237 - DNA, 23 bp, Homo sapiens
ttaccagtctttaaaggcccagc

SEQ ID NO: 5669238 - DNA, 23 bp, Homo sapiens
ttaccagtggcgttgttgcatgt

SEQ ID NO: 5669239 - DNA, 24 bp, Homo sapiens
ttaccagtggcgttgttgcatgtt

SEQ ID NO: 5669240 - DNA, 16 bp, Homo sapiens
ttaccagttaattact

SEQ ID NO: 5669241 - DNA, 19 bp, Homo sapiens
ttaccagttgccttttatc

SEQ ID NO: 5669242 - DNA, 16 bp, Homo sapiens
ttaccataaagccttt

SEQ ID NO: 5669243 - DNA, 20 bp, Homo sapiens
ttaccataaagcctttaaaa

SEQ ID NO: 5669244 - DNA, 22 bp, Homo sapiens
ttaccatcaaacaaatcatttt

SEQ ID NO: 5669245 - DNA, 15 bp, Homo sapiens
ttaccatcatctctg

SEQ ID NO: 5669246 - DNA, 16 bp, Homo sapiens
ttaccatcatctctga

SEQ ID NO: 5669247 - DNA, 16 bp, Homo sapiens
ttaccatcttaatctt

SEQ ID NO: 5669248 - DNA, 21 bp, Homo sapiens
ttaccatgagtgaatttatat

SEQ ID NO: 5669249 - DNA, 13 bp, Homo sapiens
ttaccatgtaaat

SEQ ID NO: 5669250 - DNA, 16 bp, Homo sapiens
ttaccatgtaaataat

SEQ ID NO: 5669251 - DNA, 14 bp, Homo sapiens
ttaccattaacatt

SEQ ID NO: 5669252 - DNA, 21 bp, Homo sapiens
ttaccattacttgtataaata

SEQ ID NO: 5669253 - DNA, 13 bp, Homo sapiens
ttaccattagcat

SEQ ID NO: 5669254 - DNA, 14 bp, Homo sapiens
ttaccatttacatg

SEQ ID NO: 5669255 - DNA, 20 bp, Homo sapiens
ttaccattttaacgctgcct

SEQ ID NO: 5669256 - DNA, 21 bp, Homo sapiens
ttaccattttaacgctgccta

SEQ ID NO: 5669257 - DNA, 13 bp, Homo sapiens
ttaccattttatc

SEQ ID NO: 5669258 - DNA, 21 bp, Homo sapiens
ttaccattttgcgatgtgttt

SEQ ID NO: 5669259 - DNA, 13 bp, Homo sapiens
ttacccaaaagca

SEQ ID NO: 5669260 - DNA, 21 bp, Homo sapiens
ttacccaaacccatggctcta

SEQ ID NO: 5669261 - DNA, 12 bp, Homo sapiens
ttacccaagcaa

SEQ ID NO: 5669262 - DNA, 13 bp, Homo sapiens
ttacccaagcaaa

SEQ ID NO: 5669263 - DNA, 20 bp, Homo sapiens
ttacccaagcaaaatcatgg

SEQ ID NO: 5669264 - DNA, 15 bp, Homo sapiens
ttacccaagctgtgg

SEQ ID NO: 5669265 - DNA, 24 bp, Homo sapiens
ttacccaaggatttttaaaactca

SEQ ID NO: 5669266 - DNA, 20 bp, Homo sapiens
ttacccaatgggaccgtgcc

SEQ ID NO: 5669267 - DNA, 21 bp, Homo sapiens
ttacccacactacgcagaaga

SEQ ID NO: 5669268 - DNA, 17 bp, Homo sapiens
ttacccacccgacctgg

SEQ ID NO: 5669269 - DNA, 20 bp, Homo sapiens
ttacccacccgacctggctg

SEQ ID NO: 5669270 - DNA, 15 bp, Homo sapiens
ttacccacctagaac

SEQ ID NO: 5669271 - DNA, 21 bp, Homo sapiens
ttacccagagaatatatacat

SEQ ID NO: 5669272 - DNA, 16 bp, Homo sapiens
ttacccagagttttta

SEQ ID NO: 5669273 - DNA, 21 bp, Homo sapiens
ttacccagattgtgtacatag

SEQ ID NO: 5669274 - DNA, 16 bp, Homo sapiens
ttacccaggtgggtcc

SEQ ID NO: 5669275 - DNA, 21 bp, Homo sapiens
ttacccagtattactgctgct

SEQ ID NO: 5669276 - DNA, 22 bp, Homo sapiens
ttacccagtattactgctgctg

SEQ ID NO: 5669277 - DNA, 12 bp, Homo sapiens
ttacccataaac

SEQ ID NO: 5669278 - DNA, 13 bp, Homo sapiens
ttacccataaaca

SEQ ID NO: 5669279 - DNA, 14 bp, Homo sapiens
ttacccataaacag

SEQ ID NO: 5669280 - DNA, 16 bp, Homo sapiens
ttacccatatcccctc

SEQ ID NO: 5669281 - DNA, 18 bp, Homo sapiens
ttacccatatcccctctc

SEQ ID NO: 5669282 - DNA, 14 bp, Homo sapiens
ttacccatcttgct

SEQ ID NO: 5669283 - DNA, 18 bp, Homo sapiens
ttaccccaaagagaaaga

SEQ ID NO: 5669284 - DNA, 20 bp, Homo sapiens
ttaccccaccctgcccactc

SEQ ID NO: 5669285 - DNA, 21 bp, Homo sapiens
ttaccccagcctacccttcct

SEQ ID NO: 5669286 - DNA, 23 bp, Homo sapiens
ttaccccataccccttattgctg

SEQ ID NO: 5669287 - DNA, 16 bp, Homo sapiens
ttaccccgagacctca

SEQ ID NO: 5669288 - DNA, 22 bp, Homo sapiens
ttaccccgtccctttccctgca

SEQ ID NO: 5669289 - DNA, 21 bp, Homo sapiens
ttacccctatacctgagcctc

SEQ ID NO: 5669290 - DNA, 17 bp, Homo sapiens
ttacccctggctgtttg

SEQ ID NO: 5669291 - DNA, 14 bp, Homo sapiens
ttaccccttagcct

SEQ ID NO: 5669292 - DNA, 16 bp, Homo sapiens
ttaccccttagcctcc

SEQ ID NO: 5669293 - DNA, 21 bp, Homo sapiens
ttacccggagaaggccgctgc

SEQ ID NO: 5669294 - DNA, 18 bp, Homo sapiens
ttaccctaatgtcttcat

SEQ ID NO: 5669295 - DNA, 17 bp, Homo sapiens
ttaccctactggctgta

SEQ ID NO: 5669296 - DNA, 15 bp, Homo sapiens
ttaccctcaaatgct

SEQ ID NO: 5669297 - DNA, 19 bp, Homo sapiens
ttaccctcatgttcttaat

SEQ ID NO: 5669298 - DNA, 19 bp, Homo sapiens
ttaccctcccaccactccc

SEQ ID NO: 5669299 - DNA, 12 bp, Homo sapiens
ttaccctccctg

SEQ ID NO: 5669300 - DNA, 16 bp, Homo sapiens
ttaccctccctgtccc

SEQ ID NO: 5669301 - DNA, 15 bp, Homo sapiens
ttaccctcctctgct

SEQ ID NO: 5669302 - DNA, 16 bp, Homo sapiens
ttaccctcctgtaaat

SEQ ID NO: 5669303 - DNA, 23 bp, Homo sapiens
ttaccctctgggtctcagtgtcc

SEQ ID NO: 5669304 - DNA, 13 bp, Homo sapiens
ttaccctctttgc

SEQ ID NO: 5669305 - DNA, 17 bp, Homo sapiens
ttaccctctttgctgca

SEQ ID NO: 5669306 - DNA, 19 bp, Homo sapiens
ttaccctgaggtcactgct

SEQ ID NO: 5669307 - DNA, 13 bp, Homo sapiens
ttaccctggcccc

SEQ ID NO: 5669308 - DNA, 17 bp, Homo sapiens
ttaccctgtgtcagagc

SEQ ID NO: 5669309 - DNA, 21 bp, Homo sapiens
ttaccctgttcccaagcaaag

SEQ ID NO: 5669310 - DNA, 14 bp, Homo sapiens
ttacccttcctcat

SEQ ID NO: 5669311 - DNA, 23 bp, Homo sapiens
ttacccttcctcatctgtgcctg

SEQ ID NO: 5669312 - DNA, 12 bp, Homo sapiens
ttacccttctgt

SEQ ID NO: 5669313 - DNA, 16 bp, Homo sapiens
ttacccttctgtgccc

SEQ ID NO: 5669314 - DNA, 17 bp, Homo sapiens
ttacccttctgtgccca

SEQ ID NO: 5669315 - DNA, 16 bp, Homo sapiens
ttacccttttccccct

SEQ ID NO: 5669316 - DNA, 22 bp, Homo sapiens
ttacccttttcccccttcccat

SEQ ID NO: 5669317 - DNA, 19 bp, Homo sapiens
ttaccgagagccaaacaga

SEQ ID NO: 5669318 - DNA, 21 bp, Homo sapiens
ttaccgaggacagcctgcctc

SEQ ID NO: 5669319 - DNA, 15 bp, Homo sapiens
ttaccgcgttgtaaa

SEQ ID NO: 5669320 - DNA, 21 bp, Homo sapiens
ttaccgcgttgtaaaatatag

SEQ ID NO: 5669321 - DNA, 22 bp, Homo sapiens
ttaccggttgtttagaaacaga

SEQ ID NO: 5669322 - DNA, 15 bp, Homo sapiens
ttaccgtagcctccg

SEQ ID NO: 5669323 - DNA, 22 bp, Homo sapiens
ttaccgtcacactcttcagtga

SEQ ID NO: 5669324 - DNA, 16 bp, Homo sapiens
ttacctaaacagatat

SEQ ID NO: 5669325 - DNA, 18 bp, Homo sapiens
ttacctaaacagatataa

SEQ ID NO: 5669326 - DNA, 19 bp, Homo sapiens
ttacctaaacagatataaa

SEQ ID NO: 5669327 - DNA, 21 bp, Homo sapiens
ttacctaaacagatataaatg

SEQ ID NO: 5669328 - DNA, 15 bp, Homo sapiens
ttacctaaactgagc

SEQ ID NO: 5669329 - DNA, 16 bp, Homo sapiens
ttacctaaagtatttt

SEQ ID NO: 5669330 - DNA, 14 bp, Homo sapiens
ttacctaagattac

SEQ ID NO: 5669331 - DNA, 21 bp, Homo sapiens
ttacctaagtgacatttgtag

SEQ ID NO: 5669332 - DNA, 23 bp, Homo sapiens
ttacctaatctccacttttttca

SEQ ID NO: 5669333 - DNA, 13 bp, Homo sapiens
ttacctaattaga

SEQ ID NO: 5669334 - DNA, 19 bp, Homo sapiens
ttacctaccacatgccaag

SEQ ID NO: 5669335 - DNA, 13 bp, Homo sapiens
ttacctactttga

SEQ ID NO: 5669336 - DNA, 14 bp, Homo sapiens
ttacctagaaatct

SEQ ID NO: 5669337 - DNA, 18 bp, Homo sapiens
ttacctagctaattattt

SEQ ID NO: 5669338 - DNA, 21 bp, Homo sapiens
ttacctagctaattatttaat

SEQ ID NO: 5669339 - DNA, 20 bp, Homo sapiens
ttacctagtagtcatttcat

SEQ ID NO: 5669340 - DNA, 15 bp, Homo sapiens
ttacctatctgtgga

SEQ ID NO: 5669341 - DNA, 15 bp, Homo sapiens
ttacctattctgaaa

SEQ ID NO: 5669342 - DNA, 18 bp, Homo sapiens
ttacctattctgaaaaag

SEQ ID NO: 5669343 - DNA, 23 bp, Homo sapiens
ttacctattctgaaaaagacata

SEQ ID NO: 5669344 - DNA, 20 bp, Homo sapiens
ttacctcagcctgggcgctg

SEQ ID NO: 5669345 - DNA, 20 bp, Homo sapiens
ttacctcatgccgctgtgtc

SEQ ID NO: 5669346 - DNA, 22 bp, Homo sapiens
ttacctcatgccgctgtgtcta

SEQ ID NO: 5669347 - DNA, 13 bp, Homo sapiens
ttacctcatttgc

SEQ ID NO: 5669348 - DNA, 14 bp, Homo sapiens
ttacctcatttgca

SEQ ID NO: 5669349 - DNA, 22 bp, Homo sapiens
ttacctccaacagaactaaatg

SEQ ID NO: 5669350 - DNA, 20 bp, Homo sapiens
ttacctcccctgccagggct

SEQ ID NO: 5669351 - DNA, 11 bp, Homo sapiens
ttacctccctc

SEQ ID NO: 5669352 - DNA, 20 bp, Homo sapiens
ttacctcctaatggcatgga

SEQ ID NO: 5669353 - DNA, 15 bp, Homo sapiens
ttacctcctgcccag

SEQ ID NO: 5669354 - DNA, 15 bp, Homo sapiens
ttacctcttaacaat

SEQ ID NO: 5669355 - DNA, 20 bp, Homo sapiens
ttacctcttaacaatttctg

SEQ ID NO: 5669356 - DNA, 17 bp, Homo sapiens
ttacctcttacattttc

SEQ ID NO: 5669357 - DNA, 23 bp, Homo sapiens
ttacctcttgcccttgggtgcta

SEQ ID NO: 5669358 - DNA, 12 bp, Homo sapiens
ttacctctttaa

SEQ ID NO: 5669359 - DNA, 16 bp, Homo sapiens
ttacctctttggaaaa

SEQ ID NO: 5669360 - DNA, 11 bp, Homo sapiens
ttacctgaaag

SEQ ID NO: 5669361 - DNA, 15 bp, Homo sapiens
ttacctgaacaggaa

SEQ ID NO: 5669362 - DNA, 19 bp, Homo sapiens
ttacctgaacaggaatcct

SEQ ID NO: 5669363 - DNA, 21 bp, Homo sapiens
ttacctgaaggggttttcttg

SEQ ID NO: 5669364 - DNA, 12 bp, Homo sapiens
ttacctgacaca

SEQ ID NO: 5669365 - DNA, 16 bp, Homo sapiens
ttacctgacctcttgc

SEQ ID NO: 5669366 - DNA, 19 bp, Homo sapiens
ttacctgacctcttgctgt

SEQ ID NO: 5669367 - DNA, 20 bp, Homo sapiens
ttacctgacctcttgctgtc

SEQ ID NO: 5669368 - DNA, 21 bp, Homo sapiens
ttacctgacctcttgctgtct

SEQ ID NO: 5669369 - DNA, 20 bp, Homo sapiens
ttacctgacttatgaaactt

SEQ ID NO: 5669370 - DNA, 18 bp, Homo sapiens
ttacctgagttgaagagg

SEQ ID NO: 5669371 - DNA, 18 bp, Homo sapiens
ttacctgatcaatgacag

SEQ ID NO: 5669372 - DNA, 21 bp, Homo sapiens
ttttctggaaattttgtccat

SEQ ID NO: 5669373 - DNA, 19 bp, Homo sapiens
ttttctggaccaaggtgaa

SEQ ID NO: 5669374 - DNA, 21 bp, Homo sapiens
ttttctggaggttgataactt

SEQ ID NO: 5669375 - DNA, 23 bp, Homo sapiens
ttttctggaggttgataactttg

SEQ ID NO: 5669376 - DNA, 16 bp, Homo sapiens
ttttctggccttgact

SEQ ID NO: 5669377 - DNA, 23 bp, Homo sapiens
ttttctggcttctgcttcatcct

SEQ ID NO: 5669378 - DNA, 13 bp, Homo sapiens
ttttctgggatgt

SEQ ID NO: 5669379 - DNA, 17 bp, Homo sapiens
ttttctgggcttttcct

SEQ ID NO: 5669380 - DNA, 10 bp, Homo sapiens
ttttctgggg

SEQ ID NO: 5669381 - DNA, 23 bp, Homo sapiens
ttttctggggaaagacactgcct

SEQ ID NO: 5669382 - DNA, 23 bp, Homo sapiens
ttttctggggaattactttcctc

SEQ ID NO: 5669383 - DNA, 21 bp, Homo sapiens
ttttctggggcccaggaagcc

SEQ ID NO: 5669384 - DNA, 22 bp, Homo sapiens
ttttctgggtagaagccaccct

SEQ ID NO: 5669385 - DNA, 21 bp, Homo sapiens
ttttctggtaattttgggttt

SEQ ID NO: 5669386 - DNA, 20 bp, Homo sapiens
ttttctggtagatagaaata

SEQ ID NO: 5669387 - DNA, 20 bp, Homo sapiens
ttttctggtggggctgtcct

SEQ ID NO: 5669388 - DNA, 23 bp, Homo sapiens
ttttctggtggggctgtcctgct

SEQ ID NO: 5669389 - DNA, 20 bp, Homo sapiens
ttttctggttccaaaccagt

SEQ ID NO: 5669390 - DNA, 20 bp, Homo sapiens
ttttctgtaacacagaatat

SEQ ID NO: 5669391 - DNA, 14 bp, Homo sapiens
ttttctgtaatgta

SEQ ID NO: 5669392 - DNA, 16 bp, Homo sapiens
ttttctgtaattcttc

SEQ ID NO: 5669393 - DNA, 21 bp, Homo sapiens
ttttctgtaccagttaatttt

SEQ ID NO: 5669394 - DNA, 17 bp, Homo sapiens
ttttctgtagttcaatt

SEQ ID NO: 5669395 - DNA, 12 bp, Homo sapiens
ttttctgtcatt

SEQ ID NO: 5669396 - DNA, 15 bp, Homo sapiens
ttttctgtcattgtt

SEQ ID NO: 5669397 - DNA, 12 bp, Homo sapiens
ttttctgtctct

SEQ ID NO: 5669398 - DNA, 22 bp, Homo sapiens
ttttctgtgaagccctttgcct

SEQ ID NO: 5669399 - DNA, 12 bp, Homo sapiens
ttttctgtgtaa

SEQ ID NO: 5669400 - DNA, 15 bp, Homo sapiens
ttttctgtgtgttcc

SEQ ID NO: 5669401 - DNA, 22 bp, Homo sapiens
ttttctgttacctcaacaagaa

SEQ ID NO: 5669402 - DNA, 13 bp, Homo sapiens
ttttctgttcata

SEQ ID NO: 5669403 - DNA, 13 bp, Homo sapiens
ttttctgttccag

SEQ ID NO: 5669404 - DNA, 23 bp, Homo sapiens
ttttctgtttcctcaagtctcag

SEQ ID NO: 5669405 - DNA, 14 bp, Homo sapiens
ttttctgtttgtaa

SEQ ID NO: 5669406 - DNA, 9 bp, Homo sapiens
ttttcttaa

SEQ ID NO: 5669407 - DNA, 12 bp, Homo sapiens
ttttcttaaaaa

SEQ ID NO: 5669408 - DNA, 14 bp, Homo sapiens
ttttcttaaataat

SEQ ID NO: 5669409 - DNA, 12 bp, Homo sapiens
ttttcttaacca

SEQ ID NO: 5669410 - DNA, 21 bp, Homo sapiens
ttttcttaaccagatcattgt

SEQ ID NO: 5669411 - DNA, 13 bp, Homo sapiens
ttttcttacataa

SEQ ID NO: 5669412 - DNA, 17 bp, Homo sapiens
ttttcttacccagattg

SEQ ID NO: 5669413 - DNA, 21 bp, Homo sapiens
ttttcttacccagattgtgta

SEQ ID NO: 5669414 - DNA, 22 bp, Homo sapiens
ttttcttaccctagttctctta

SEQ ID NO: 5669415 - DNA, 19 bp, Homo sapiens
ttttcttaccctctctttc

SEQ ID NO: 5669416 - DNA, 16 bp, Homo sapiens
ttttcttactcctcct

SEQ ID NO: 5669417 - DNA, 13 bp, Homo sapiens
ttttcttaggttt

SEQ ID NO: 5669418 - DNA, 19 bp, Homo sapiens
ttttcttatttatgtaaca

SEQ ID NO: 5669419 - DNA, 21 bp, Homo sapiens
ttttcttcaacatcaatgttc

SEQ ID NO: 5669420 - DNA, 13 bp, Homo sapiens
ttttcttcacagt

SEQ ID NO: 5669421 - DNA, 17 bp, Homo sapiens
ttttcttcactcaaatt

SEQ ID NO: 5669422 - DNA, 15 bp, Homo sapiens
ttttcttcactgtcc

SEQ ID NO: 5669423 - DNA, 16 bp, Homo sapiens
ttttcttcagcattta

SEQ ID NO: 5669424 - DNA, 11 bp, Homo sapiens
ttttcttcagg

SEQ ID NO: 5669425 - DNA, 13 bp, Homo sapiens
ttttcttcatcaa

SEQ ID NO: 5669426 - DNA, 20 bp, Homo sapiens
ttttcttcattttgttctga

SEQ ID NO: 5669427 - DNA, 22 bp, Homo sapiens
ttttcttccaacatgtgatgtg

SEQ ID NO: 5669428 - DNA, 15 bp, Homo sapiens
ttttcttccccctcc

SEQ ID NO: 5669429 - DNA, 14 bp, Homo sapiens
ttttcttccctgac

SEQ ID NO: 5669430 - DNA, 11 bp, Homo sapiens
ttttcttcctt

SEQ ID NO: 5669431 - DNA, 14 bp, Homo sapiens
ttttcttctaaaat

SEQ ID NO: 5669432 - DNA, 15 bp, Homo sapiens
ttttcttctcagtct

SEQ ID NO: 5669433 - DNA, 18 bp, Homo sapiens
ttttcttctcattcttct

SEQ ID NO: 5669434 - DNA, 13 bp, Homo sapiens
ttttcttctccct

SEQ ID NO: 5669435 - DNA, 14 bp, Homo sapiens
ttttcttctgaaat

SEQ ID NO: 5669436 - DNA, 13 bp, Homo sapiens
ttttcttcttcct

SEQ ID NO: 5669437 - DNA, 13 bp, Homo sapiens
ttttcttctttct

SEQ ID NO: 5669438 - DNA, 15 bp, Homo sapiens
ttttcttcttttact

SEQ ID NO: 5669439 - DNA, 19 bp, Homo sapiens
ttttcttcttttacttgaa

SEQ ID NO: 5669440 - DNA, 11 bp, Homo sapiens
ttttcttgata

SEQ ID NO: 5669441 - DNA, 12 bp, Homo sapiens
ttttcttgcagt

SEQ ID NO: 5669442 - DNA, 17 bp, Homo sapiens
ttttcttgcatgaggct

SEQ ID NO: 5669443 - DNA, 14 bp, Homo sapiens
ttttcttgcattga

SEQ ID NO: 5669444 - DNA, 21 bp, Homo sapiens
ttttcttgcctctgtcccctt

SEQ ID NO: 5669445 - DNA, 13 bp, Homo sapiens
ttttcttgcctga

SEQ ID NO: 5669446 - DNA, 22 bp, Homo sapiens
ttttcttgctagtattcgctgt

SEQ ID NO: 5669447 - DNA, 21 bp, Homo sapiens
ttttcttggcaaaagccttgt

SEQ ID NO: 5669448 - DNA, 24 bp, Homo sapiens
ttttcttggcaaaagccttgtgta

SEQ ID NO: 5669449 - DNA, 11 bp, Homo sapiens
ttttcttggga

SEQ ID NO: 5669450 - DNA, 15 bp, Homo sapiens
ttttcttgggaataa

SEQ ID NO: 5669451 - DNA, 10 bp, Homo sapiens
ttttcttggt

SEQ ID NO: 5669452 - DNA, 17 bp, Homo sapiens
ttttcttggttctttca

SEQ ID NO: 5669453 - DNA, 17 bp, Homo sapiens
ttcatcatttcagccaa

SEQ ID NO: 5669454 - DNA, 18 bp, Homo sapiens
ttcatcatttcagccaaa

SEQ ID NO: 5669455 - DNA, 23 bp, Homo sapiens
ttcatcatttcagccaaagtcct

SEQ ID NO: 5669456 - DNA, 14 bp, Homo sapiens
ttcatcatttttta

SEQ ID NO: 5669457 - DNA, 16 bp, Homo sapiens
ttcatccaactctaaa

SEQ ID NO: 5669458 - DNA, 18 bp, Homo sapiens
ttcatccaacttccaaga

SEQ ID NO: 5669459 - DNA, 13 bp, Homo sapiens
ttcatccaaggaa

SEQ ID NO: 5669460 - DNA, 16 bp, Homo sapiens
ttcatccaatcctcac

SEQ ID NO: 5669461 - DNA, 21 bp, Homo sapiens
ttcatccaatcctcactgggt

SEQ ID NO: 5669462 - DNA, 17 bp, Homo sapiens
ttcatccaatgtgaagt

SEQ ID NO: 5669463 - DNA, 23 bp, Homo sapiens
ttcatccactctgcctgcttaca

SEQ ID NO: 5669464 - DNA, 14 bp, Homo sapiens
ttcatccagagttc

SEQ ID NO: 5669465 - DNA, 17 bp, Homo sapiens
ttcatccagccactgcc

SEQ ID NO: 5669466 - DNA, 18 bp, Homo sapiens
ttcatccaggactgagat

SEQ ID NO: 5669467 - DNA, 15 bp, Homo sapiens
ttcatccagttgcaa

SEQ ID NO: 5669468 - DNA, 20 bp, Homo sapiens
ttcatccagttgcaataaaa

SEQ ID NO: 5669469 - DNA, 23 bp, Homo sapiens
ttcatccagtttgttctccgggt

SEQ ID NO: 5669470 - DNA, 15 bp, Homo sapiens
ttcatccataactga

SEQ ID NO: 5669471 - DNA, 23 bp, Homo sapiens
ttcatccatatttctttttcttg

SEQ ID NO: 5669472 - DNA, 13 bp, Homo sapiens
ttcatccattcct

SEQ ID NO: 5669473 - DNA, 21 bp, Homo sapiens
ttcatcccactccaactcttc

SEQ ID NO: 5669474 - DNA, 15 bp, Homo sapiens
ttcatcccagggtat

SEQ ID NO: 5669475 - DNA, 21 bp, Homo sapiens
ttcatcccatgatgtagtgcc

SEQ ID NO: 5669476 - DNA, 15 bp, Homo sapiens
ttcatcccattccag

SEQ ID NO: 5669477 - DNA, 12 bp, Homo sapiens
ttcatcccctcc

SEQ ID NO: 5669478 - DNA, 13 bp, Homo sapiens
ttcatcccctccc

SEQ ID NO: 5669479 - DNA, 14 bp, Homo sapiens
ttcatccccttacc

SEQ ID NO: 5669480 - DNA, 19 bp, Homo sapiens
ttcatcccgtatcacagtg

SEQ ID NO: 5669481 - DNA, 21 bp, Homo sapiens
ttcatccctctggggctgttc

SEQ ID NO: 5669482 - DNA, 21 bp, Homo sapiens
ttcatccctgccaagaactct

SEQ ID NO: 5669483 - DNA, 15 bp, Homo sapiens
ttcatccgcctgtgg

SEQ ID NO: 5669484 - DNA, 16 bp, Homo sapiens
ttcatcctattgttga

SEQ ID NO: 5669485 - DNA, 17 bp, Homo sapiens
ttcatcctcacatgtgg

SEQ ID NO: 5669486 - DNA, 16 bp, Homo sapiens
ttcatcctcagcaagt

SEQ ID NO: 5669487 - DNA, 16 bp, Homo sapiens
ttcatcctcctcccca

SEQ ID NO: 5669488 - DNA, 22 bp, Homo sapiens
ttcatcctcctccccagctctt

SEQ ID NO: 5669489 - DNA, 12 bp, Homo sapiens
ttcatcctctta

SEQ ID NO: 5669490 - DNA, 16 bp, Homo sapiens
ttcatcctggcctcct

SEQ ID NO: 5669491 - DNA, 12 bp, Homo sapiens
ttcatcctgtgt

SEQ ID NO: 5669492 - DNA, 17 bp, Homo sapiens
ttcatcctgtgtcccct

SEQ ID NO: 5669493 - DNA, 18 bp, Homo sapiens
ttcatcctgttggctgct

SEQ ID NO: 5669494 - DNA, 22 bp, Homo sapiens
ttcatcctgttggctgctgcca

SEQ ID NO: 5669495 - DNA, 13 bp, Homo sapiens
ttcatccttagca

SEQ ID NO: 5669496 - DNA, 15 bp, Homo sapiens
ttcatccttccccaa

SEQ ID NO: 5669497 - DNA, 20 bp, Homo sapiens
ttcatcctttcacttctttc

SEQ ID NO: 5669498 - DNA, 17 bp, Homo sapiens
ttcatccttttttctct

SEQ ID NO: 5669499 - DNA, 23 bp, Homo sapiens
ttcatccttttttctcttctgtc

SEQ ID NO: 5669500 - DNA, 16 bp, Homo sapiens
ttcatcggtgcctggt

SEQ ID NO: 5669501 - DNA, 16 bp, Homo sapiens
ttcatcgtaaagtgct

SEQ ID NO: 5669502 - DNA, 16 bp, Homo sapiens
ttcatctaaatgaaag

SEQ ID NO: 5669503 - DNA, 22 bp, Homo sapiens
ttcatctaataaatcagtgaac

SEQ ID NO: 5669504 - DNA, 16 bp, Homo sapiens
ttcatctaccttttct

SEQ ID NO: 5669505 - DNA, 14 bp, Homo sapiens
ttcatctactacag

SEQ ID NO: 5669506 - DNA, 14 bp, Homo sapiens
ttcatctagttaag

SEQ ID NO: 5669507 - DNA, 22 bp, Homo sapiens
ttcatctatggcagtccagcca

SEQ ID NO: 5669508 - DNA, 18 bp, Homo sapiens
ttcatctatttctgagaa

SEQ ID NO: 5669509 - DNA, 21 bp, Homo sapiens
ttcatctattttattttattg

SEQ ID NO: 5669510 - DNA, 20 bp, Homo sapiens
ttcatctattttctcagaat

SEQ ID NO: 5669511 - DNA, 12 bp, Homo sapiens
ttcatctcaagg

SEQ ID NO: 5669512 - DNA, 14 bp, Homo sapiens
ttcatctcaatagt

SEQ ID NO: 5669513 - DNA, 16 bp, Homo sapiens
ttcatctcatttaagg

SEQ ID NO: 5669514 - DNA, 23 bp, Homo sapiens
ttcatctcatttaagggaaaaat

SEQ ID NO: 5669515 - DNA, 14 bp, Homo sapiens
ttcatctcatttgt

SEQ ID NO: 5669516 - DNA, 14 bp, Homo sapiens
ttcatctccaggga

SEQ ID NO: 5669517 - DNA, 20 bp, Homo sapiens
ttcatctccctcctccaggt

SEQ ID NO: 5669518 - DNA, 23 bp, Homo sapiens
ttcatctccctgccatccccctc

SEQ ID NO: 5669519 - DNA, 18 bp, Homo sapiens
ttcatctctctacctcca

SEQ ID NO: 5669520 - DNA, 19 bp, Homo sapiens
ttcatctctctacctccac

SEQ ID NO: 5669521 - DNA, 21 bp, Homo sapiens
ttcatctctggttttcttgcc

SEQ ID NO: 5669522 - DNA, 21 bp, Homo sapiens
ttcatctgaggagtccaaaat

SEQ ID NO: 5669523 - DNA, 16 bp, Homo sapiens
ttcatctgcaatttgg

SEQ ID NO: 5669524 - DNA, 12 bp, Homo sapiens
ttcatctgccac

SEQ ID NO: 5669525 - DNA, 12 bp, Homo sapiens
ttcatctggaac

SEQ ID NO: 5669526 - DNA, 22 bp, Homo sapiens
ttcatctggaagtattttcctc

SEQ ID NO: 5669527 - DNA, 14 bp, Homo sapiens
ttcatctggaagtt

SEQ ID NO: 5669528 - DNA, 14 bp, Homo sapiens
ttcatctgggaaag

SEQ ID NO: 5669529 - DNA, 17 bp, Homo sapiens
ttcatctgggaggcaga

SEQ ID NO: 5669530 - DNA, 14 bp, Homo sapiens
ttcatctgggctgg

SEQ ID NO: 5669531 - DNA, 13 bp, Homo sapiens
ttcatctggggtt

SEQ ID NO: 5669532 - DNA, 16 bp, Homo sapiens
ttcatctgtccatggc

SEQ ID NO: 5669533 - DNA, 16 bp, Homo sapiens
ttcatctgtctatatt

SEQ ID NO: 5669534 - DNA, 11 bp, Homo sapiens
ttcatctgtgg

SEQ ID NO: 5669535 - DNA, 16 bp, Homo sapiens
ttcatctgtgtagctg

SEQ ID NO: 5669536 - DNA, 18 bp, Homo sapiens
ttcatctgttgttttgtt

SEQ ID NO: 5669537 - DNA, 14 bp, Homo sapiens
ttcatcttaaacta

SEQ ID NO: 5669538 - DNA, 18 bp, Homo sapiens
ttcatcttaaactaatac

SEQ ID NO: 5669539 - DNA, 17 bp, Homo sapiens
ttcatcttcagttgtct

SEQ ID NO: 5669540 - DNA, 15 bp, Homo sapiens
ttcatcttcctgtgt

SEQ ID NO: 5669541 - DNA, 17 bp, Homo sapiens
ttcatcttcctgtgtcc

SEQ ID NO: 5669542 - DNA, 15 bp, Homo sapiens
ttcatcttctggaat

SEQ ID NO: 5669543 - DNA, 16 bp, Homo sapiens
ttcatcttctggaata

SEQ ID NO: 5669544 - DNA, 19 bp, Homo sapiens
ttcatcttctggaatattg

SEQ ID NO: 5669545 - DNA, 22 bp, Homo sapiens
ttcatcttggtcacatacaatt

SEQ ID NO: 5669546 - DNA, 23 bp, Homo sapiens
ttcatcttgtacaaactttgttt

SEQ ID NO: 5669547 - DNA, 14 bp, Homo sapiens
ttcatctttcagaa

SEQ ID NO: 5669548 - DNA, 16 bp, Homo sapiens
ttcatctttgccatat

SEQ ID NO: 5669549 - DNA, 11 bp, Homo sapiens
ttcatctttgg

SEQ ID NO: 5669550 - DNA, 17 bp, Homo sapiens
ttcatcttttaatcatg

SEQ ID NO: 5669551 - DNA, 19 bp, Homo sapiens
ttcatcttttattttggaa

SEQ ID NO: 5669552 - DNA, 13 bp, Homo sapiens
ttcattctcctgc

SEQ ID NO: 5669553 - DNA, 15 bp, Homo sapiens
ttcattctccttgtt

SEQ ID NO: 5669554 - DNA, 21 bp, Homo sapiens
ttcattctcgtgagtcattta

SEQ ID NO: 5669555 - DNA, 15 bp, Homo sapiens
ttcattctgaaccct

SEQ ID NO: 5669556 - DNA, 18 bp, Homo sapiens
ttcattctgcaagtatac

SEQ ID NO: 5669557 - DNA, 14 bp, Homo sapiens
ttcattctgcattg

SEQ ID NO: 5669558 - DNA, 18 bp, Homo sapiens
ttcattctgccaaagtaa

SEQ ID NO: 5669559 - DNA, 13 bp, Homo sapiens
ttcattctggaaa

SEQ ID NO: 5669560 - DNA, 16 bp, Homo sapiens
ttcattcttaatttat

SEQ ID NO: 5669561 - DNA, 19 bp, Homo sapiens
ttcattcttgaaagctgtg

SEQ ID NO: 5669562 - DNA, 14 bp, Homo sapiens
ttcattctttactg

SEQ ID NO: 5669563 - DNA, 20 bp, Homo sapiens
ttcattctttactgcactca

SEQ ID NO: 5669564 - DNA, 22 bp, Homo sapiens
ttcattctttactgcactcaga

SEQ ID NO: 5669565 - DNA, 19 bp, Homo sapiens
ttcattctttttgaaatgt

SEQ ID NO: 5669566 - DNA, 19 bp, Homo sapiens
ttcattgacaccaaatatt

SEQ ID NO: 5669567 - DNA, 13 bp, Homo sapiens
ttcattgaccaag

SEQ ID NO: 5669568 - DNA, 16 bp, Homo sapiens
ttcattgactatcaaa

SEQ ID NO: 5669569 - DNA, 22 bp, Homo sapiens
ttcattgagagttttgtcttga

SEQ ID NO: 5669570 - DNA, 20 bp, Homo sapiens
ttcattgatttcctgtgtca

SEQ ID NO: 5669571 - DNA, 14 bp, Homo sapiens
ttcattgcactttc

SEQ ID NO: 5669572 - DNA, 16 bp, Homo sapiens
ttcattgcctttccag

SEQ ID NO: 5669573 - DNA, 14 bp, Homo sapiens
ttcattgctaagac

SEQ ID NO: 5669574 - DNA, 14 bp, Homo sapiens
ttcattgctctcca

SEQ ID NO: 5669575 - DNA, 13 bp, Homo sapiens
ttcattgctgtga

SEQ ID NO: 5669576 - DNA, 18 bp, Homo sapiens
ttcattggatttttgtta

SEQ ID NO: 5669577 - DNA, 15 bp, Homo sapiens
ttcattggcagctca

SEQ ID NO: 5669578 - DNA, 22 bp, Homo sapiens
ttcattggcagctcaaagactt

SEQ ID NO: 5669579 - DNA, 19 bp, Homo sapiens
ttcattggcattctttgca

SEQ ID NO: 5669580 - DNA, 13 bp, Homo sapiens
ttcattggctcct

SEQ ID NO: 5669581 - DNA, 13 bp, Homo sapiens
ttcattgggctgt

SEQ ID NO: 5669582 - DNA, 17 bp, Homo sapiens
ttcattggtgtactgtg

SEQ ID NO: 5669583 - DNA, 12 bp, Homo sapiens
ttcattgtaaaa

SEQ ID NO: 5669584 - DNA, 19 bp, Homo sapiens
ttcattgtaaatgaacata

SEQ ID NO: 5669585 - DNA, 20 bp, Homo sapiens
ttcattgtaatgttactgat

SEQ ID NO: 5669586 - DNA, 16 bp, Homo sapiens
ttcattgtatgatgtg

SEQ ID NO: 5669587 - DNA, 23 bp, Homo sapiens
ttcattgtggttatttttataca

SEQ ID NO: 5669588 - DNA, 14 bp, Homo sapiens
ttcattgtgtatga

SEQ ID NO: 5669589 - DNA, 14 bp, Homo sapiens
ttcatttaaaatga

SEQ ID NO: 5669590 - DNA, 16 bp, Homo sapiens
ttcatttaaaatgatt

SEQ ID NO: 5669591 - DNA, 13 bp, Homo sapiens
ttcatttaaacta

SEQ ID NO: 5669592 - DNA, 22 bp, Homo sapiens
ttcatttaaactaaattactgt

SEQ ID NO: 5669593 - DNA, 23 bp, Homo sapiens
ttcatttaaactaaattactgtt

SEQ ID NO: 5669594 - DNA, 21 bp, Homo sapiens
ttcatttaacactgagtgaaa

SEQ ID NO: 5669595 - DNA, 13 bp, Homo sapiens
ttcatttaactct

SEQ ID NO: 5669596 - DNA, 22 bp, Homo sapiens
ttcatttacaggaaattgcaaa

SEQ ID NO: 5669597 - DNA, 18 bp, Homo sapiens
ttcatttagataatttga

SEQ ID NO: 5669598 - DNA, 22 bp, Homo sapiens
ttcatttagataatttgaaaaa

SEQ ID NO: 5669599 - DNA, 17 bp, Homo sapiens
ttcatttatctataatt

SEQ ID NO: 5669600 - DNA, 18 bp, Homo sapiens
ttcatttcaatcattgaa

SEQ ID NO: 5669601 - DNA, 12 bp, Homo sapiens
ttcatttcactt

SEQ ID NO: 5669602 - DNA, 16 bp, Homo sapiens
ttcatttcactttaaa

SEQ ID NO: 5669603 - DNA, 15 bp, Homo sapiens
ttcatttcattgtat

SEQ ID NO: 5669604 - DNA, 15 bp, Homo sapiens
ttcatttcatttcag

SEQ ID NO: 5669605 - DNA, 13 bp, Homo sapiens
ttcatttccactc

SEQ ID NO: 5669606 - DNA, 13 bp, Homo sapiens
ttcatttccgtga

SEQ ID NO: 5669607 - DNA, 21 bp, Homo sapiens
ttcatttcctagctgttctaa

SEQ ID NO: 5669608 - DNA, 15 bp, Homo sapiens
ttcatttcctgtgtc

SEQ ID NO: 5669609 - DNA, 15 bp, Homo sapiens
ttcatttctaattaa

SEQ ID NO: 5669610 - DNA, 16 bp, Homo sapiens
ttcatttctagagaaa

SEQ ID NO: 5669611 - DNA, 21 bp, Homo sapiens
ttcatttctatagccaaagct

SEQ ID NO: 5669612 - DNA, 13 bp, Homo sapiens
ttcatttctctgc

SEQ ID NO: 5669613 - DNA, 17 bp, Homo sapiens
ttcatttcttcctcagc

SEQ ID NO: 5669614 - DNA, 11 bp, Homo sapiens
ttcatttcttg

SEQ ID NO: 5669615 - DNA, 18 bp, Homo sapiens
ttcatttcttgtcaatta

SEQ ID NO: 5669616 - DNA, 21 bp, Homo sapiens
ttcatttcttgtcaattatgt

SEQ ID NO: 5669617 - DNA, 18 bp, Homo sapiens
ttcatttgcaattcatgt

SEQ ID NO: 5669618 - DNA, 16 bp, Homo sapiens
ttcatttgcacaagta

SEQ ID NO: 5669619 - DNA, 22 bp, Homo sapiens
ttcatttgcttcaggagtttca

SEQ ID NO: 5669620 - DNA, 21 bp, Homo sapiens
ttcatttggggcatttgtaaa

SEQ ID NO: 5669621 - DNA, 22 bp, Homo sapiens
ttcatttggtgttcctggaagc

SEQ ID NO: 5669622 - DNA, 22 bp, Homo sapiens
ttcatttgtacaaggtaattgt

SEQ ID NO: 5669623 - DNA, 12 bp, Homo sapiens
ttcatttgtatt

SEQ ID NO: 5669624 - DNA, 13 bp, Homo sapiens
ttcatttgtattg

SEQ ID NO: 5669625 - DNA, 14 bp, Homo sapiens
ttcatttgtgccac

SEQ ID NO: 5669626 - DNA, 11 bp, Homo sapiens
ttcatttgtgg

SEQ ID NO: 5669627 - DNA, 22 bp, Homo sapiens
ttcatttgtggtgatatagaat

SEQ ID NO: 5669628 - DNA, 23 bp, Homo sapiens
ttcatttgtggtgatatagaatt

SEQ ID NO: 5669629 - DNA, 18 bp, Homo sapiens
ttcatttgttattcttaa

SEQ ID NO: 5669630 - DNA, 16 bp, Homo sapiens
ttcatttgttttgctt

SEQ ID NO: 5669631 - DNA, 18 bp, Homo sapiens
ttcatttgttttgctttt

SEQ ID NO: 5669632 - DNA, 19 bp, Homo sapiens
ttcattttaacatgatttc

SEQ ID NO: 5669633 - DNA, 16 bp, Homo sapiens
ttcattttaactggca

SEQ ID NO: 5669634 - DNA, 20 bp, Homo sapiens
ttcattttaatttatatttg

SEQ ID NO: 5669635 - DNA, 12 bp, Homo sapiens
ttcattttagat

SEQ ID NO: 5669636 - DNA, 20 bp, Homo sapiens
ttttggtggttttagtgatt

SEQ ID NO: 5669637 - DNA, 12 bp, Homo sapiens
ttttggtgtatt

SEQ ID NO: 5669638 - DNA, 14 bp, Homo sapiens
ttttggtgtgcatc

SEQ ID NO: 5669639 - DNA, 19 bp, Homo sapiens
ttttggtgttgcttttcaa

SEQ ID NO: 5669640 - DNA, 19 bp, Homo sapiens
ttttggttaagctttgaca

SEQ ID NO: 5669641 - DNA, 21 bp, Homo sapiens
ttttggttaagctttgacact

SEQ ID NO: 5669642 - DNA, 21 bp, Homo sapiens
ttttggttagaagtaaggatt

SEQ ID NO: 5669643 - DNA, 17 bp, Homo sapiens
ttttggttatggagtct

SEQ ID NO: 5669644 - DNA, 19 bp, Homo sapiens
ttttggttatggagtcttg

SEQ ID NO: 5669645 - DNA, 16 bp, Homo sapiens
ttttggttgctttaat

SEQ ID NO: 5669646 - DNA, 19 bp, Homo sapiens
ttttggttggtttttacat

SEQ ID NO: 5669647 - DNA, 14 bp, Homo sapiens
ttttggtttacctg

SEQ ID NO: 5669648 - DNA, 16 bp, Homo sapiens
ttttggtttatgactt

SEQ ID NO: 5669649 - DNA, 11 bp, Homo sapiens
ttttggtttca

SEQ ID NO: 5669650 - DNA, 14 bp, Homo sapiens
ttttggtttcacct

SEQ ID NO: 5669651 - DNA, 20 bp, Homo sapiens
ttttggttttaaaagcacaa

SEQ ID NO: 5669652 - DNA, 14 bp, Homo sapiens
ttttggttttctac

SEQ ID NO: 5669653 - DNA, 14 bp, Homo sapiens
ttttggttttgttc

SEQ ID NO: 5669654 - DNA, 16 bp, Homo sapiens
ttttgtaaaaagaaat

SEQ ID NO: 5669655 - DNA, 13 bp, Homo sapiens
ttttgtaaaacaa

SEQ ID NO: 5669656 - DNA, 15 bp, Homo sapiens
ttttgtaaaatcaaa

SEQ ID NO: 5669657 - DNA, 16 bp, Homo sapiens
ttttgtaaaatgtatt

SEQ ID NO: 5669658 - DNA, 21 bp, Homo sapiens
ttttgtaaacgacaagaataa

SEQ ID NO: 5669659 - DNA, 18 bp, Homo sapiens
ttttgtaaactcaaaata

SEQ ID NO: 5669660 - DNA, 21 bp, Homo sapiens
ttttgtaaactgtatcaaatc

SEQ ID NO: 5669661 - DNA, 18 bp, Homo sapiens
ttttgtaaagaaaaatat

SEQ ID NO: 5669662 - DNA, 15 bp, Homo sapiens
ttttgtaaagatgcc

SEQ ID NO: 5669663 - DNA, 16 bp, Homo sapiens
ttttgtaaaggtgaaa

SEQ ID NO: 5669664 - DNA, 13 bp, Homo sapiens
ttttgtaaagttt

SEQ ID NO: 5669665 - DNA, 12 bp, Homo sapiens
ttttgtaaataa

SEQ ID NO: 5669666 - DNA, 11 bp, Homo sapiens
ttttgtaaatg

SEQ ID NO: 5669667 - DNA, 19 bp, Homo sapiens
ttttgtaaatgagacacat

SEQ ID NO: 5669668 - DNA, 21 bp, Homo sapiens
ttttgtaaatgctgtaaatat

SEQ ID NO: 5669669 - DNA, 15 bp, Homo sapiens
ttttgtaaatgtact

SEQ ID NO: 5669670 - DNA, 13 bp, Homo sapiens
ttttgtaactctt

SEQ ID NO: 5669671 - DNA, 11 bp, Homo sapiens
ttttgtaactt

SEQ ID NO: 5669672 - DNA, 15 bp, Homo sapiens
ttttgtaacttcaaa

SEQ ID NO: 5669673 - DNA, 17 bp, Homo sapiens
ttttgtaacttcaaata

SEQ ID NO: 5669674 - DNA, 20 bp, Homo sapiens
ttttgtaagatgctgggttg

SEQ ID NO: 5669675 - DNA, 14 bp, Homo sapiens
ttttgtaaggggaa

SEQ ID NO: 5669676 - DNA, 15 bp, Homo sapiens
ttttgtaagtataag

SEQ ID NO: 5669677 - DNA, 19 bp, Homo sapiens
ttttgtaagttgaagcaaa

SEQ ID NO: 5669678 - DNA, 13 bp, Homo sapiens
ttttgtaataaac

SEQ ID NO: 5669679 - DNA, 22 bp, Homo sapiens
ttttgtaataagcaatcaaggt

SEQ ID NO: 5669680 - DNA, 17 bp, Homo sapiens
ttttgtaatataagaca

SEQ ID NO: 5669681 - DNA, 19 bp, Homo sapiens
ttttgtaatattctgtttt

SEQ ID NO: 5669682 - DNA, 18 bp, Homo sapiens
ttttgtaatgtgaaaagt

SEQ ID NO: 5669683 - DNA, 22 bp, Homo sapiens
ttttgtaatgtgaaaagtatca

SEQ ID NO: 5669684 - DNA, 14 bp, Homo sapiens
ttttgtaattgtgt

SEQ ID NO: 5669685 - DNA, 14 bp, Homo sapiens
ttttgtaatttaaa

SEQ ID NO: 5669686 - DNA, 19 bp, Homo sapiens
ttttgtacaattactaaat

SEQ ID NO: 5669687 - DNA, 16 bp, Homo sapiens
ttttgtacactgctgt

SEQ ID NO: 5669688 - DNA, 15 bp, Homo sapiens
ttttgtacagaattt

SEQ ID NO: 5669689 - DNA, 14 bp, Homo sapiens
ttttgtacagtatt

SEQ ID NO: 5669690 - DNA, 11 bp, Homo sapiens
ttttgtacata

SEQ ID NO: 5669691 - DNA, 18 bp, Homo sapiens
ttttgtacatcgcttctt

SEQ ID NO: 5669692 - DNA, 21 bp, Homo sapiens
ttttgtacatctggcttattt

SEQ ID NO: 5669693 - DNA, 16 bp, Homo sapiens
ttttgtacattacact

SEQ ID NO: 5669694 - DNA, 23 bp, Homo sapiens
ttttgtacattacactaaattat

SEQ ID NO: 5669695 - DNA, 17 bp, Homo sapiens
ttttgtacattatgtta

SEQ ID NO: 5669696 - DNA, 11 bp, Homo sapiens
ttttgtaccaa

SEQ ID NO: 5669697 - DNA, 13 bp, Homo sapiens
ttttgtaccagtg

SEQ ID NO: 5669698 - DNA, 19 bp, Homo sapiens
ttttgtacgttaattaaac

SEQ ID NO: 5669699 - DNA, 15 bp, Homo sapiens
ttttgtactgaatct

SEQ ID NO: 5669700 - DNA, 16 bp, Homo sapiens
ttttgtactgtaaaga

SEQ ID NO: 5669701 - DNA, 14 bp, Homo sapiens
ttttgtactgtgct

SEQ ID NO: 5669702 - DNA, 18 bp, Homo sapiens
ttttgtactttggaacga

SEQ ID NO: 5669703 - DNA, 15 bp, Homo sapiens
ttttgtacttttagt

SEQ ID NO: 5669704 - DNA, 19 bp, Homo sapiens
ttttgtagagccagggtct

SEQ ID NO: 5669705 - DNA, 18 bp, Homo sapiens
ttttgtagcactgacaga

SEQ ID NO: 5669706 - DNA, 18 bp, Homo sapiens
ttttgtagcctctctttg

SEQ ID NO: 5669707 - DNA, 14 bp, Homo sapiens
ttttgtaggtactt

SEQ ID NO: 5669708 - DNA, 15 bp, Homo sapiens
ttttgtaggtacttt

SEQ ID NO: 5669709 - DNA, 21 bp, Homo sapiens
ttttgtaggttattttatatt

SEQ ID NO: 5669710 - DNA, 19 bp, Homo sapiens
ttttgtagtcttatgaata

SEQ ID NO: 5669711 - DNA, 14 bp, Homo sapiens
ttttgtagttttat

SEQ ID NO: 5669712 - DNA, 21 bp, Homo sapiens
ttttgtagttttatttgtatt

SEQ ID NO: 5669713 - DNA, 15 bp, Homo sapiens
ttttgtataaaaagg

SEQ ID NO: 5669714 - DNA, 14 bp, Homo sapiens
ttttgtataactta

SEQ ID NO: 5669715 - DNA, 15 bp, Homo sapiens
ttttgtataatcaca

SEQ ID NO: 5669716 - DNA, 15 bp, Homo sapiens
ttttgtataattgta

SEQ ID NO: 5669717 - DNA, 11 bp, Homo sapiens
ttttgtataca

SEQ ID NO: 5669718 - DNA, 13 bp, Homo sapiens
ttttgtatacaaa

SEQ ID NO: 5669719 - DNA, 17 bp, Homo sapiens
ttttgtatagtaaagtg

SEQ ID NO: 5669720 - DNA, 20 bp, Homo sapiens
ttttgtatagtattggaaaa

SEQ ID NO: 5669721 - DNA, 15 bp, Homo sapiens
ttttgtatatacagt

SEQ ID NO: 5669722 - DNA, 17 bp, Homo sapiens
ttttgtatatacagtta

SEQ ID NO: 5669723 - DNA, 16 bp, Homo sapiens
ttttgtatatgctgca

SEQ ID NO: 5669724 - DNA, 13 bp, Homo sapiens
ttttgtatcttaa

SEQ ID NO: 5669725 - DNA, 23 bp, Homo sapiens
ttttgtatgaaatatatgtgaaa

SEQ ID NO: 5669726 - DNA, 17 bp, Homo sapiens
ttttgtatgaagtactt

SEQ ID NO: 5669727 - DNA, 18 bp, Homo sapiens
ttttgtatgacttctgct

SEQ ID NO: 5669728 - DNA, 20 bp, Homo sapiens
ttttgtatgaggtcctcagg

SEQ ID NO: 5669729 - DNA, 14 bp, Homo sapiens
ttttgtatgctgaa

SEQ ID NO: 5669730 - DNA, 12 bp, Homo sapiens
ttttgtatgtaa

SEQ ID NO: 5669731 - DNA, 14 bp, Homo sapiens
ttttgtatgtatgt

SEQ ID NO: 5669732 - DNA, 18 bp, Homo sapiens
ttttgtatgttatgaaca

SEQ ID NO: 5669733 - DNA, 15 bp, Homo sapiens
acgctgacagcctcc

SEQ ID NO: 5669734 - DNA, 19 bp, Homo sapiens
acgctgacagcctcctagg

SEQ ID NO: 5669735 - DNA, 22 bp, Homo sapiens
acgctgaccatgcgtcaggggc

SEQ ID NO: 5669736 - DNA, 22 bp, Homo sapiens
acgctgagccacctgccctttt

SEQ ID NO: 5669737 - DNA, 24 bp, Homo sapiens
acgctgattcctaaggcccagctg

SEQ ID NO: 5669738 - DNA, 17 bp, Homo sapiens
acgctgcacttgacacc

SEQ ID NO: 5669739 - DNA, 22 bp, Homo sapiens
acgctgcacttgacaccaacca

SEQ ID NO: 5669740 - DNA, 16 bp, Homo sapiens
acgctgcagaccccag

SEQ ID NO: 5669741 - DNA, 17 bp, Homo sapiens
acgctgccatttccctg

SEQ ID NO: 5669742 - DNA, 22 bp, Homo sapiens
acgctgccatttccctgaacag

SEQ ID NO: 5669743 - DNA, 11 bp, Homo sapiens
acgctgcccag

SEQ ID NO: 5669744 - DNA, 13 bp, Homo sapiens
acgctgcccaggc

SEQ ID NO: 5669745 - DNA, 16 bp, Homo sapiens
acgctgcccaggctct

SEQ ID NO: 5669746 - DNA, 19 bp, Homo sapiens
acgctgcccaggctctgct

SEQ ID NO: 5669747 - DNA, 20 bp, Homo sapiens
acgctgcccaggctctgctg

SEQ ID NO: 5669748 - DNA, 23 bp, Homo sapiens
acgctgcccaggctctgctgact

SEQ ID NO: 5669749 - DNA, 21 bp, Homo sapiens
acgctgccgggagactgccag

SEQ ID NO: 5669750 - DNA, 22 bp, Homo sapiens
acgctgccgggagactgccagt

SEQ ID NO: 5669751 - DNA, 12 bp, Homo sapiens
acgctgcctgcc

SEQ ID NO: 5669752 - DNA, 18 bp, Homo sapiens
acgctgcctgccaaagta

SEQ ID NO: 5669753 - DNA, 20 bp, Homo sapiens
acgctgcctgccaaagtagt

SEQ ID NO: 5669754 - DNA, 14 bp, Homo sapiens
acgctgcctgcccg

SEQ ID NO: 5669755 - DNA, 16 bp, Homo sapiens
acgctgcgtgccatga

SEQ ID NO: 5669756 - DNA, 14 bp, Homo sapiens
acgctgctgtcaca

SEQ ID NO: 5669757 - DNA, 19 bp, Homo sapiens
acgctgctgtcacaaccaa

SEQ ID NO: 5669758 - DNA, 21 bp, Homo sapiens
acgctgctgtcacaaccaaga

SEQ ID NO: 5669759 - DNA, 13 bp, Homo sapiens
acgctggaccttg

SEQ ID NO: 5669760 - DNA, 23 bp, Homo sapiens
acgctggaccttgaactgggtac

SEQ ID NO: 5669761 - DNA, 19 bp, Homo sapiens
acgctggagaccctgcgcc

SEQ ID NO: 5669762 - DNA, 14 bp, Homo sapiens
acgctggagatgca

SEQ ID NO: 5669763 - DNA, 22 bp, Homo sapiens
acgctggagatgcaaggtgctg

SEQ ID NO: 5669764 - DNA, 15 bp, Homo sapiens
acgctggagtgcagt

SEQ ID NO: 5669765 - DNA, 19 bp, Homo sapiens
acgctggagtgcagtgagc

SEQ ID NO: 5669766 - DNA, 12 bp, Homo sapiens
acgctgggccta

SEQ ID NO: 5669767 - DNA, 20 bp, Homo sapiens
acgctgggtattaccatgta

SEQ ID NO: 5669768 - DNA, 21 bp, Homo sapiens
acgctggtagagatggaggag

SEQ ID NO: 5669769 - DNA, 17 bp, Homo sapiens
acgctgtctccagaccc

SEQ ID NO: 5669770 - DNA, 20 bp, Homo sapiens
acgctgtctccagaccccca

SEQ ID NO: 5669771 - DNA, 17 bp, Homo sapiens
acgctgtgatgctgtgt

SEQ ID NO: 5669772 - DNA, 22 bp, Homo sapiens
acgctgtgatgctgtgtgccca

SEQ ID NO: 5669773 - DNA, 23 bp, Homo sapiens
acgctgtgatgctgtgtgcccaa

SEQ ID NO: 5669774 - DNA, 17 bp, Homo sapiens
acgctgtgctgccctgc

SEQ ID NO: 5669775 - DNA, 17 bp, Homo sapiens
acgcttccagaccacct

SEQ ID NO: 5669776 - DNA, 21 bp, Homo sapiens
acgcttccagaccacctgcca

SEQ ID NO: 5669777 - DNA, 22 bp, Homo sapiens
acgcttccagaccacctgccag

SEQ ID NO: 5669778 - DNA, 22 bp, Homo sapiens
acgcttctgaatgctgctactt

SEQ ID NO: 5669779 - DNA, 13 bp, Homo sapiens
acgcttcttcttt

SEQ ID NO: 5669780 - DNA, 16 bp, Homo sapiens
acgcttgacagttact

SEQ ID NO: 5669781 - DNA, 15 bp, Homo sapiens
acgcttgcctggtca

SEQ ID NO: 5669782 - DNA, 22 bp, Homo sapiens
acgcttgcctggtcaccctggg

SEQ ID NO: 5669783 - DNA, 20 bp, Homo sapiens
acgcttgcgtatgtctgtta

SEQ ID NO: 5669784 - DNA, 15 bp, Homo sapiens
acgcttgctcatttt

SEQ ID NO: 5669785 - DNA, 22 bp, Homo sapiens
acgcttgtagaactcactctgg

SEQ ID NO: 5669786 - DNA, 15 bp, Homo sapiens
acgcttgtgaggccc

SEQ ID NO: 5669787 - DNA, 19 bp, Homo sapiens
acgctttcatgaccactgg

SEQ ID NO: 5669788 - DNA, 22 bp, Homo sapiens
acgctttgctgctaccgccctg

SEQ ID NO: 5669789 - DNA, 17 bp, Homo sapiens
acgctttgggagaatgt

SEQ ID NO: 5669790 - DNA, 11 bp, Homo sapiens
acgctttgtca

SEQ ID NO: 5669791 - DNA, 16 bp, Homo sapiens
acgcttttgagtgggc

SEQ ID NO: 5669792 - DNA, 19 bp, Homo sapiens
acgcttttgggaaaactgg

SEQ ID NO: 5669793 - DNA, 23 bp, Homo sapiens
acgcttttgtgatggagtgctgt

SEQ ID NO: 5669794 - DNA, 14 bp, Homo sapiens
acggaaaaggggtg

SEQ ID NO: 5669795 - DNA, 19 bp, Homo sapiens
acggaaaatgccaatctct

SEQ ID NO: 5669796 - DNA, 16 bp, Homo sapiens
acggaaaatgcttaaa

SEQ ID NO: 5669797 - DNA, 19 bp, Homo sapiens
acggaaaatgcttaaaaaa

SEQ ID NO: 5669798 - DNA, 14 bp, Homo sapiens
acggaaacatagaa

SEQ ID NO: 5669799 - DNA, 15 bp, Homo sapiens
acggaaacatagaaa

SEQ ID NO: 5669800 - DNA, 17 bp, Homo sapiens
acggaaacatagaaaca

SEQ ID NO: 5669801 - DNA, 18 bp, Homo sapiens
acggaaacatagaaacat

SEQ ID NO: 5669802 - DNA, 15 bp, Homo sapiens
acggaaagtgctgtc

SEQ ID NO: 5669803 - DNA, 15 bp, Homo sapiens
acggaacactgtcaa

SEQ ID NO: 5669804 - DNA, 14 bp, Homo sapiens
acggaactcaaata

SEQ ID NO: 5669805 - DNA, 16 bp, Homo sapiens
acggaagagccttgcg

SEQ ID NO: 5669806 - DNA, 18 bp, Homo sapiens
acggaagcaagcagatga

SEQ ID NO: 5669807 - DNA, 14 bp, Homo sapiens
acggaagccaggcc

SEQ ID NO: 5669808 - DNA, 23 bp, Homo sapiens
acggaagctcatagaggtgagaa

SEQ ID NO: 5669809 - DNA, 22 bp, Homo sapiens
acggaagtggcctgagaagagt

SEQ ID NO: 5669810 - DNA, 19 bp, Homo sapiens
acggaagttttcaatgatg

SEQ ID NO: 5669811 - DNA, 15 bp, Homo sapiens
acggaatagttggct

SEQ ID NO: 5669812 - DNA, 17 bp, Homo sapiens
acggaattccaatattt

SEQ ID NO: 5669813 - DNA, 14 bp, Homo sapiens
acggacaataaacc

SEQ ID NO: 5669814 - DNA, 16 bp, Homo sapiens
acggacaccccctcgc

SEQ ID NO: 5669815 - DNA, 14 bp, Homo sapiens
acggacaggaagca

SEQ ID NO: 5669816 - DNA, 20 bp, Homo sapiens
acggacatccaggcgtggga

SEQ ID NO: 5669817 - DNA, 23 bp, Homo sapiens
acggaccaaagggagtctgccag

SEQ ID NO: 5669818 - DNA, 19 bp, Homo sapiens
acggacgaaccttgaaaac

SEQ ID NO: 5669819 - DNA, 16 bp, Homo sapiens
acggactcagactcct

SEQ ID NO: 5669820 - DNA, 18 bp, Homo sapiens
acggactcagactcctgg

SEQ ID NO: 5669821 - DNA, 20 bp, Homo sapiens
acggactcagactcctggct

SEQ ID NO: 5669822 - DNA, 24 bp, Homo sapiens
acggactcccgggccacgccccag

SEQ ID NO: 5669823 - DNA, 14 bp, Homo sapiens
acggactctttgct

SEQ ID NO: 5669824 - DNA, 15 bp, Homo sapiens
acggactctttgctg

SEQ ID NO: 5669825 - DNA, 19 bp, Homo sapiens
acggacttacaaccttgtc

SEQ ID NO: 5669826 - DNA, 13 bp, Homo sapiens
acggagagcgcct

SEQ ID NO: 5669827 - DNA, 18 bp, Homo sapiens
acggagagttgacttggt

SEQ ID NO: 5669828 - DNA, 20 bp, Homo sapiens
acggagatgaagaacatctg

SEQ ID NO: 5669829 - DNA, 22 bp, Homo sapiens
acggagcactgcacctgcctcc

SEQ ID NO: 5669830 - DNA, 18 bp, Homo sapiens
acggagccactcctctga

SEQ ID NO: 5669831 - DNA, 19 bp, Homo sapiens
acggagccactcctctgac

SEQ ID NO: 5669832 - DNA, 20 bp, Homo sapiens
acggagccactcctctgact

SEQ ID NO: 5669833 - DNA, 15 bp, Homo sapiens
acggagcccagccct

SEQ ID NO: 5669834 - DNA, 21 bp, Homo sapiens
acggagccccaggcctctgtg

SEQ ID NO: 5669835 - DNA, 21 bp, Homo sapiens
acggagcctggagggatgcca

SEQ ID NO: 5669836 - DNA, 16 bp, Homo sapiens
acggagctcctggcag

SEQ ID NO: 5669837 - DNA, 19 bp, Homo sapiens
acggaggagggatgctgct

SEQ ID NO: 5669838 - DNA, 20 bp, Homo sapiens
acggaggcctgcgaccctgg

SEQ ID NO: 5669839 - DNA, 21 bp, Homo sapiens
acggaggcctgcgaccctggg

SEQ ID NO: 5669840 - DNA, 17 bp, Homo sapiens
acggagggaccaggtgt

SEQ ID NO: 5669841 - DNA, 23 bp, Homo sapiens
acggagggagtggcacttctgcc

SEQ ID NO: 5669842 - DNA, 18 bp, Homo sapiens
acggaggggagtagagaa

SEQ ID NO: 5669843 - DNA, 21 bp, Homo sapiens
acggaggtccccggttgctgg

SEQ ID NO: 5669844 - DNA, 19 bp, Homo sapiens
acggaggtcctttggacag

SEQ ID NO: 5669845 - DNA, 12 bp, Homo sapiens
acggagtggggg

SEQ ID NO: 5669846 - DNA, 19 bp, Homo sapiens
acggagtgttggggctggg

SEQ ID NO: 5669847 - DNA, 13 bp, Homo sapiens
acggagttcagag

SEQ ID NO: 5669848 - DNA, 18 bp, Homo sapiens
acggagtttccatttgga

SEQ ID NO: 5669849 - DNA, 21 bp, Homo sapiens
acggagtttccatttggattt

SEQ ID NO: 5669850 - DNA, 23 bp, Homo sapiens
acggatcctgcactgactctgga

SEQ ID NO: 5669851 - DNA, 15 bp, Homo sapiens
acggatgatttctat

SEQ ID NO: 5669852 - DNA, 16 bp, Homo sapiens
acggatgcacacacag

SEQ ID NO: 5669853 - DNA, 22 bp, Homo sapiens
acggatgccttcccctgggccc

SEQ ID NO: 5669854 - DNA, 17 bp, Homo sapiens
acggatgcgtgggcaga

SEQ ID NO: 5669855 - DNA, 18 bp, Homo sapiens
acggatgcgtgggcagag

SEQ ID NO: 5669856 - DNA, 15 bp, Homo sapiens
acggatggaaggaga

SEQ ID NO: 5669857 - DNA, 17 bp, Homo sapiens
acggatggaaggagaga

SEQ ID NO: 5669858 - DNA, 22 bp, Homo sapiens
acggatggtgcatgggctcgcc

SEQ ID NO: 5669859 - DNA, 18 bp, Homo sapiens
acggattattttttcaga

SEQ ID NO: 5669860 - DNA, 21 bp, Homo sapiens
acggatttattatataaatat

SEQ ID NO: 5669861 - DNA, 16 bp, Homo sapiens
acggatttgtccaaat

SEQ ID NO: 5669862 - DNA, 17 bp, Homo sapiens
acggcaacccctgcagc

SEQ ID NO: 5669863 - DNA, 17 bp, Homo sapiens
acggcaacgtagcctgg

SEQ ID NO: 5669864 - DNA, 22 bp, Homo sapiens
acggcaacgtagcctgggctca

SEQ ID NO: 5669865 - DNA, 19 bp, Homo sapiens
acggcaaggctgaggtggc

SEQ ID NO: 5669866 - DNA, 23 bp, Homo sapiens
acggcacctcggggacaccagag

SEQ ID NO: 5669867 - DNA, 23 bp, Homo sapiens
acggcacctgggccctggggcct

SEQ ID NO: 5669868 - DNA, 18 bp, Homo sapiens
acggcacgcacttgcctg

SEQ ID NO: 5669869 - DNA, 19 bp, Homo sapiens
acggcacggtcttccctct

SEQ ID NO: 5669870 - DNA, 15 bp, Homo sapiens
acggcactgtggcct

SEQ ID NO: 5669871 - DNA, 23 bp, Homo sapiens
acggcagaaaacagagcctgcct

SEQ ID NO: 5669872 - DNA, 16 bp, Homo sapiens
acggcagccaccctgc

SEQ ID NO: 5669873 - DNA, 14 bp, Homo sapiens
acggcagccccatc

SEQ ID NO: 5669874 - DNA, 23 bp, Homo sapiens
acggcagcctcaacctccctggc

SEQ ID NO: 5669875 - DNA, 15 bp, Homo sapiens
acggcagctgtagct

SEQ ID NO: 5669876 - DNA, 21 bp, Homo sapiens
acggcaggcgtgtggcagcca

SEQ ID NO: 5669877 - DNA, 15 bp, Homo sapiens
acggcaggctcactg

SEQ ID NO: 5669878 - DNA, 24 bp, Homo sapiens
acggcagggaaatgtatgtgtgtc

SEQ ID NO: 5669879 - DNA, 19 bp, Homo sapiens
acggcaggtggcctaaggc

SEQ ID NO: 5669880 - DNA, 20 bp, Homo sapiens
acggcagtcacactgctggg

SEQ ID NO: 5669881 - DNA, 22 bp, Homo sapiens
acggcatcacacttatatttta

SEQ ID NO: 5669882 - DNA, 23 bp, Homo sapiens
acggcatgtgaattctgtgaaga

SEQ ID NO: 5669883 - DNA, 23 bp, Homo sapiens
acggcattatgatcccttccccc

SEQ ID NO: 5669884 - DNA, 16 bp, Homo sapiens
acggccaagaatgtac

SEQ ID NO: 5669885 - DNA, 19 bp, Homo sapiens
acggccaatggtgcttccc

SEQ ID NO: 5669886 - DNA, 22 bp, Homo sapiens
acggccaatggtgcttccccca

SEQ ID NO: 5669887 - DNA, 13 bp, Homo sapiens
acggccacatcaa

SEQ ID NO: 5669888 - DNA, 13 bp, Homo sapiens
acggccaccactg

SEQ ID NO: 5669889 - DNA, 10 bp, Homo sapiens
acggccaccc

SEQ ID NO: 5669890 - DNA, 18 bp, Homo sapiens
acggccaccctccttccc

SEQ ID NO: 5669891 - DNA, 17 bp, Homo sapiens
acggccacggccacagt

SEQ ID NO: 5669892 - DNA, 12 bp, Homo sapiens
acggccaggcca

SEQ ID NO: 5669893 - DNA, 16 bp, Homo sapiens
acggccaggccagagg

SEQ ID NO: 5669894 - DNA, 17 bp, Homo sapiens
acggccaggctccctga

SEQ ID NO: 5669895 - DNA, 17 bp, Homo sapiens
acggccagggagaagct

SEQ ID NO: 5669896 - DNA, 20 bp, Homo sapiens
acggccatctctttgtacag

SEQ ID NO: 5669897 - DNA, 22 bp, Homo sapiens
acggccatctctttgtacagga

SEQ ID NO: 5669898 - DNA, 13 bp, Homo sapiens
acggcccaggcca

SEQ ID NO: 5669899 - DNA, 15 bp, Homo sapiens
acggcccaggccagg

SEQ ID NO: 5669900 - DNA, 17 bp, Homo sapiens
acggcccaggccaggtg

SEQ ID NO: 5669901 - DNA, 20 bp, Homo sapiens
acggcccatcttggcaaggt

SEQ ID NO: 5669902 - DNA, 22 bp, Homo sapiens
acggccccgaagggcccccaca

SEQ ID NO: 5669903 - DNA, 19 bp, Homo sapiens
acggccccgcccctgcccc

SEQ ID NO: 5669904 - DNA, 20 bp, Homo sapiens
acggcccgccgtgcctgcat

SEQ ID NO: 5669905 - DNA, 15 bp, Homo sapiens
acggcccggcccctc

SEQ ID NO: 5669906 - DNA, 16 bp, Homo sapiens
acggcccggcccctca

SEQ ID NO: 5669907 - DNA, 20 bp, Homo sapiens
acggcccggcccctcaccct

SEQ ID NO: 5669908 - DNA, 12 bp, Homo sapiens
acgtgcattgtg

SEQ ID NO: 5669909 - DNA, 14 bp, Homo sapiens
acgtgcattgtgct

SEQ ID NO: 5669910 - DNA, 19 bp, Homo sapiens
acgtgccagatataactgt

SEQ ID NO: 5669911 - DNA, 14 bp, Homo sapiens
acgtgccagcagcc

SEQ ID NO: 5669912 - DNA, 14 bp, Homo sapiens
acgtgccaggcccg

SEQ ID NO: 5669913 - DNA, 17 bp, Homo sapiens
acgtgcccatttcacac

SEQ ID NO: 5669914 - DNA, 14 bp, Homo sapiens
acgtgcccccagag

SEQ ID NO: 5669915 - DNA, 15 bp, Homo sapiens
acgtgcccccagagt

SEQ ID NO: 5669916 - DNA, 17 bp, Homo sapiens
acgtgccttttgcaccc

SEQ ID NO: 5669917 - DNA, 21 bp, Homo sapiens
acgtgccttttgcacccctcc

SEQ ID NO: 5669918 - DNA, 20 bp, Homo sapiens
acgtgcgctgggcacttccc

SEQ ID NO: 5669919 - DNA, 21 bp, Homo sapiens
acgtgcgtgtctctgccatgt

SEQ ID NO: 5669920 - DNA, 17 bp, Homo sapiens
acgtgctaggggatgag

SEQ ID NO: 5669921 - DNA, 18 bp, Homo sapiens
acgtgctccgtagctctg

SEQ ID NO: 5669922 - DNA, 23 bp, Homo sapiens
acgtgctccgtagctctgctgct

SEQ ID NO: 5669923 - DNA, 18 bp, Homo sapiens
acgtgctctgtgggtctc

SEQ ID NO: 5669924 - DNA, 18 bp, Homo sapiens
acgtgctcttctgttctc

SEQ ID NO: 5669925 - DNA, 14 bp, Homo sapiens
acgtgctggagagt

SEQ ID NO: 5669926 - DNA, 14 bp, Homo sapiens
acgtgcttctttgt

SEQ ID NO: 5669927 - DNA, 21 bp, Homo sapiens
acgtgcttctttgtaatgacc

SEQ ID NO: 5669928 - DNA, 15 bp, Homo sapiens
acgtggactctgtgc

SEQ ID NO: 5669929 - DNA, 18 bp, Homo sapiens
acgtggactctgtgctca

SEQ ID NO: 5669930 - DNA, 18 bp, Homo sapiens
acgtggactggggtagga

SEQ ID NO: 5669931 - DNA, 19 bp, Homo sapiens
acgtggagaatcacaggct

SEQ ID NO: 5669932 - DNA, 21 bp, Homo sapiens
acgtggagaatcacaggctgg

SEQ ID NO: 5669933 - DNA, 21 bp, Homo sapiens
acgtggagagaagttgccctc

SEQ ID NO: 5669934 - DNA, 19 bp, Homo sapiens
acgtggagagctggtgccc

SEQ ID NO: 5669935 - DNA, 12 bp, Homo sapiens
acgtggagaggg

SEQ ID NO: 5669936 - DNA, 16 bp, Homo sapiens
acgtggagatagtgcc

SEQ ID NO: 5669937 - DNA, 19 bp, Homo sapiens
acgtggagatagtgccagg

SEQ ID NO: 5669938 - DNA, 22 bp, Homo sapiens
acgtggagcggggtatgaagag

SEQ ID NO: 5669939 - DNA, 18 bp, Homo sapiens
acgtggaggagcagtgca

SEQ ID NO: 5669940 - DNA, 18 bp, Homo sapiens
acgtggattgtatttaag

SEQ ID NO: 5669941 - DNA, 19 bp, Homo sapiens
acgtggattgtatttaaga

SEQ ID NO: 5669942 - DNA, 14 bp, Homo sapiens
acgtggattttaaa

SEQ ID NO: 5669943 - DNA, 14 bp, Homo sapiens
acgtggcacctcct

SEQ ID NO: 5669944 - DNA, 15 bp, Homo sapiens
acgtggcacctcctc

SEQ ID NO: 5669945 - DNA, 18 bp, Homo sapiens
acgtggcactatattctg

SEQ ID NO: 5669946 - DNA, 13 bp, Homo sapiens
acgtggcactggt

SEQ ID NO: 5669947 - DNA, 11 bp, Homo sapiens
acgtggcagga

SEQ ID NO: 5669948 - DNA, 21 bp, Homo sapiens
acgtggcaggacttccatctg

SEQ ID NO: 5669949 - DNA, 14 bp, Homo sapiens
acgtggccaggagc

SEQ ID NO: 5669950 - DNA, 20 bp, Homo sapiens
acgtggcccgcatgtgcatt

SEQ ID NO: 5669951 - DNA, 17 bp, Homo sapiens
acgtggccgctgcccac

SEQ ID NO: 5669952 - DNA, 20 bp, Homo sapiens
acgtggccgctgctgtgaca

SEQ ID NO: 5669953 - DNA, 18 bp, Homo sapiens
acgtggcctccgcagtgt

SEQ ID NO: 5669954 - DNA, 21 bp, Homo sapiens
acgtggcctccgcagtgtctc

SEQ ID NO: 5669955 - DNA, 21 bp, Homo sapiens
acgtggcctcgtgaggggcaa

SEQ ID NO: 5669956 - DNA, 23 bp, Homo sapiens
acgtggcctctctctctctcctc

SEQ ID NO: 5669957 - DNA, 14 bp, Homo sapiens
acgtggctctgctg

SEQ ID NO: 5669958 - DNA, 21 bp, Homo sapiens
acgtggctgcttcaaggatcc

SEQ ID NO: 5669959 - DNA, 15 bp, Homo sapiens
acgtggcttctgatg

SEQ ID NO: 5669960 - DNA, 17 bp, Homo sapiens
acgtgggagaggcagaa

SEQ ID NO: 5669961 - DNA, 21 bp, Homo sapiens
acgtgggagttcagctgcttc

SEQ ID NO: 5669962 - DNA, 16 bp, Homo sapiens
acgtgggcaaacaggc

SEQ ID NO: 5669963 - DNA, 17 bp, Homo sapiens
acgtgggcatcatttta

SEQ ID NO: 5669964 - DNA, 15 bp, Homo sapiens
acgtgggcggcagag

SEQ ID NO: 5669965 - DNA, 16 bp, Homo sapiens
acgtgggctcccctct

SEQ ID NO: 5669966 - DNA, 19 bp, Homo sapiens
acgtgggctcccctcttcc

SEQ ID NO: 5669967 - DNA, 17 bp, Homo sapiens
acgtggggagggtggag

SEQ ID NO: 5669968 - DNA, 11 bp, Homo sapiens
acgtggggctc

SEQ ID NO: 5669969 - DNA, 19 bp, Homo sapiens
acgtgggtacccaggctgg

SEQ ID NO: 5669970 - DNA, 18 bp, Homo sapiens
acgtgggtatttcctgct

SEQ ID NO: 5669971 - DNA, 21 bp, Homo sapiens
acgtgggtatttcctgctaca

SEQ ID NO: 5669972 - DNA, 15 bp, Homo sapiens
acgtggtcaaggccc

SEQ ID NO: 5669973 - DNA, 21 bp, Homo sapiens
acgtggtcactgtgcactgcc

SEQ ID NO: 5669974 - DNA, 19 bp, Homo sapiens
acgtggtcagggcagggct

SEQ ID NO: 5669975 - DNA, 15 bp, Homo sapiens
acgtggtgcttctca

SEQ ID NO: 5669976 - DNA, 21 bp, Homo sapiens
acgtggtggctcacacctgca

SEQ ID NO: 5669977 - DNA, 19 bp, Homo sapiens
acgtggttcagagactggc

SEQ ID NO: 5669978 - DNA, 18 bp, Homo sapiens
acgtgtactacaatttaa

SEQ ID NO: 5669979 - DNA, 11 bp, Homo sapiens
acgtgtagtgt

SEQ ID NO: 5669980 - DNA, 15 bp, Homo sapiens
acgtgtagtgtccat

SEQ ID NO: 5669981 - DNA, 13 bp, Homo sapiens
acgtgtatatgag

SEQ ID NO: 5669982 - DNA, 15 bp, Homo sapiens
acgtgtatgtttctt

SEQ ID NO: 5669983 - DNA, 13 bp, Homo sapiens
acgtgtatgtttt

SEQ ID NO: 5669984 - DNA, 19 bp, Homo sapiens
acgtgtatgtttttcagtt

SEQ ID NO: 5669985 - DNA, 17 bp, Homo sapiens
acgtgtccgtccaccct

SEQ ID NO: 5669986 - DNA, 21 bp, Homo sapiens
acgtgtccgtccacccttcca

SEQ ID NO: 5669987 - DNA, 21 bp, Homo sapiens
acgtgtctggaatcccagctc

SEQ ID NO: 5669988 - DNA, 23 bp, Homo sapiens
acgtgtctggaatcccagctccg

SEQ ID NO: 5669989 - DNA, 16 bp, Homo sapiens
acgtgtgaaatctgtc

SEQ ID NO: 5669990 - DNA, 17 bp, Homo sapiens
acgtgtgaaatctgtct

SEQ ID NO: 5669991 - DNA, 18 bp, Homo sapiens
acgtgtgaaatctgtctt

SEQ ID NO: 5669992 - DNA, 19 bp, Homo sapiens
acgtgtgcagactgtggct

SEQ ID NO: 5669993 - DNA, 16 bp, Homo sapiens
acgtgtgcatgtgtct

SEQ ID NO: 5669994 - DNA, 20 bp, Homo sapiens
acgtgtgcgcacgcgcagcg

SEQ ID NO: 5669995 - DNA, 14 bp, Homo sapiens
acgtgtggcctccg

SEQ ID NO: 5669996 - DNA, 22 bp, Homo sapiens
acgtgtgtaaatatgtacattt

SEQ ID NO: 5669997 - DNA, 16 bp, Homo sapiens
acgtgtgtccaggctc

SEQ ID NO: 5669998 - DNA, 22 bp, Homo sapiens
acgtgtgtccaggctctgggca

SEQ ID NO: 5669999 - DNA, 23 bp, Homo sapiens
acgtgtgtccaggctctgggcac

SEQ ID NO: 5670000 - DNA, 15 bp, Homo sapiens
acgtgtgtggctggg

SEQ ID NO: 5670001 - DNA, 21 bp, Homo sapiens
acgtgtgtgtgtgtgtatgtg

SEQ ID NO: 5670002 - DNA, 22 bp, Homo sapiens
acgtgtgtttctagagcctgct

SEQ ID NO: 5670003 - DNA, 14 bp, Homo sapiens
acgtgtgtttttct

SEQ ID NO: 5670004 - DNA, 17 bp, Homo sapiens
acgtgtgtttttctatt

SEQ ID NO: 5670005 - DNA, 15 bp, Homo sapiens
acgtgttattattat

SEQ ID NO: 5670006 - DNA, 22 bp, Homo sapiens
acgtgttccagtgtctgtctga

SEQ ID NO: 5670007 - DNA, 20 bp, Homo sapiens
acgtgttctatagagcctgg

SEQ ID NO: 5670008 - DNA, 14 bp, Homo sapiens
acgtgttgtatcta

SEQ ID NO: 5670009 - DNA, 18 bp, Homo sapiens
acgttaaaagtgtacaag

SEQ ID NO: 5670010 - DNA, 15 bp, Homo sapiens
acgttaagataaagg

SEQ ID NO: 5670011 - DNA, 17 bp, Homo sapiens
acgttaccttgacacat

SEQ ID NO: 5670012 - DNA, 23 bp, Homo sapiens
acgttactcagggctcctcccag

SEQ ID NO: 5670013 - DNA, 15 bp, Homo sapiens
acgttagcagcccag

SEQ ID NO: 5670014 - DNA, 20 bp, Homo sapiens
acgttaggaggacaaaagga

SEQ ID NO: 5670015 - DNA, 22 bp, Homo sapiens
acgttagtcgtgagctcttgtg

SEQ ID NO: 5670016 - DNA, 19 bp, Homo sapiens
acgttatatattgtattaa

SEQ ID NO: 5670017 - DNA, 14 bp, Homo sapiens
acgttatctcattg

SEQ ID NO: 5670018 - DNA, 21 bp, Homo sapiens
acgttcacccatcttatcaag

SEQ ID NO: 5670019 - DNA, 22 bp, Homo sapiens
acgttcactggtctctaagtgt

SEQ ID NO: 5670020 - DNA, 14 bp, Homo sapiens
acgttcataaccaa

SEQ ID NO: 5670021 - DNA, 14 bp, Homo sapiens
acgttcatgcattt

SEQ ID NO: 5670022 - DNA, 12 bp, Homo sapiens
acgttccagccg

SEQ ID NO: 5670023 - DNA, 13 bp, Homo sapiens
acgttccctttgg

SEQ ID NO: 5670024 - DNA, 12 bp, Homo sapiens
acgttccgggca

SEQ ID NO: 5670025 - DNA, 16 bp, Homo sapiens
acgttcctattgtcat

SEQ ID NO: 5670026 - DNA, 18 bp, Homo sapiens
acgttcctattgtcatta

SEQ ID NO: 5670027 - DNA, 15 bp, Homo sapiens
acgttcgatttctac

SEQ ID NO: 5670028 - DNA, 16 bp, Homo sapiens
acgttcgatttctacc

SEQ ID NO: 5670029 - DNA, 18 bp, Homo sapiens
acgttctatattgtgcca

SEQ ID NO: 5670030 - DNA, 15 bp, Homo sapiens
acgttctcacaccca

SEQ ID NO: 5670031 - DNA, 16 bp, Homo sapiens
acgttctccagcccac

SEQ ID NO: 5670032 - DNA, 17 bp, Homo sapiens
acgttctccagcccaca

SEQ ID NO: 5670033 - DNA, 12 bp, Homo sapiens
acgttctgattt

SEQ ID NO: 5670034 - DNA, 23 bp, Homo sapiens
acgttcttacaagcttaaagctt

SEQ ID NO: 5670035 - DNA, 23 bp, Homo sapiens
acgttgacccctttcccccaccc

SEQ ID NO: 5670036 - DNA, 13 bp, Homo sapiens
acgttgacgggcc

SEQ ID NO: 5670037 - DNA, 18 bp, Homo sapiens
acgttgacgggccgcagg

SEQ ID NO: 5670038 - DNA, 20 bp, Homo sapiens
acgttgatagtttacaaaca

SEQ ID NO: 5670039 - DNA, 11 bp, Homo sapiens
acgttgatctc

SEQ ID NO: 5670040 - DNA, 13 bp, Homo sapiens
acgttgccacacc

SEQ ID NO: 5670041 - DNA, 20 bp, Homo sapiens
acgttgccaggggcttgaga

SEQ ID NO: 5670042 - DNA, 20 bp, Homo sapiens
acgttgctgagccagctgca

SEQ ID NO: 5670043 - DNA, 21 bp, Homo sapiens
acgttgctgagccagctgcag

SEQ ID NO: 5670044 - DNA, 22 bp, Homo sapiens
acgttgctggtggtttttcagc

SEQ ID NO: 5670045 - DNA, 11 bp, Homo sapiens
acgttgctgtg

SEQ ID NO: 5670046 - DNA, 19 bp, Homo sapiens
acgttgctttttcactgtt

SEQ ID NO: 5670047 - DNA, 19 bp, Homo sapiens
acgttggacttttcgttaa

SEQ ID NO: 5670048 - DNA, 21 bp, Homo sapiens
acgttggacttttcgttaaca

SEQ ID NO: 5670049 - DNA, 19 bp, Homo sapiens
acgttggagtttgggctgg

SEQ ID NO: 5670050 - DNA, 20 bp, Homo sapiens
acgttggagtttgggctgga

SEQ ID NO: 5670051 - DNA, 23 bp, Homo sapiens
acgttggagtttgggctggagct

SEQ ID NO: 5670052 - DNA, 12 bp, Homo sapiens
acgttggtgacg

SEQ ID NO: 5670053 - DNA, 22 bp, Homo sapiens
acgttggttaaataaacttttt

SEQ ID NO: 5670054 - DNA, 13 bp, Homo sapiens
acgttgtgcattt

SEQ ID NO: 5670055 - DNA, 12 bp, Homo sapiens
acgttgttgtca

SEQ ID NO: 5670056 - DNA, 20 bp, Homo sapiens
acgttgttgtcattgtccag

SEQ ID NO: 5670057 - DNA, 14 bp, Homo sapiens
acgttgtttcttat

SEQ ID NO: 5670058 - DNA, 19 bp, Homo sapiens
acgttgtttcttatagatt

SEQ ID NO: 5670059 - DNA, 16 bp, Homo sapiens
acgtttaaaataaaac

SEQ ID NO: 5670060 - DNA, 14 bp, Homo sapiens
acgtttaaagttct

SEQ ID NO: 5670061 - DNA, 13 bp, Homo sapiens
acgtttaactgca

SEQ ID NO: 5670062 - DNA, 22 bp, Homo sapiens
acgtttaactgcagttgacttt

SEQ ID NO: 5670063 - DNA, 24 bp, Homo sapiens
acgtttaactgcagttgactttct

SEQ ID NO: 5670064 - DNA, 19 bp, Homo sapiens
acgtttaagccaaaacaat

SEQ ID NO: 5670065 - DNA, 17 bp, Homo sapiens
acgtttaatcccagcac

SEQ ID NO: 5670066 - DNA, 18 bp, Homo sapiens
acgtttaatcccagcact

SEQ ID NO: 5670067 - DNA, 16 bp, Homo sapiens
acgtttagaaatgatt

SEQ ID NO: 5670068 - DNA, 18 bp, Homo sapiens
acgtttagtaactgtttt

SEQ ID NO: 5670069 - DNA, 14 bp, Homo sapiens
acgtttataaacag

SEQ ID NO: 5670070 - DNA, 22 bp, Homo sapiens
acgtttattaggaaaagatatt

SEQ ID NO: 5670071 - DNA, 18 bp, Homo sapiens
acgtttccccgaagagtc

SEQ ID NO: 5670072 - DNA, 12 bp, Homo sapiens
acgtttctaaag

SEQ ID NO: 5670073 - DNA, 22 bp, Homo sapiens
acgtttctaaaggctacctttg

SEQ ID NO: 5670074 - DNA, 12 bp, Homo sapiens
acgtttctcatt

SEQ ID NO: 5670075 - DNA, 14 bp, Homo sapiens
acgtttctggaact

SEQ ID NO: 5670076 - DNA, 14 bp, Homo sapiens
acgtttctgtggag

SEQ ID NO: 5670077 - DNA, 13 bp, Homo sapiens
acgtttcttcccc

SEQ ID NO: 5670078 - DNA, 18 bp, Homo sapiens
acgtttcttctttctaga

SEQ ID NO: 5670079 - DNA, 21 bp, Homo sapiens
acgtttctttaaccttgtata

SEQ ID NO: 5670080 - DNA, 18 bp, Homo sapiens
acgtttgacaccagggcc

SEQ ID NO: 5670081 - DNA, 14 bp, Homo sapiens
acgtttgcaccgcc

SEQ ID NO: 5670082 - DNA, 15 bp, Homo sapiens
acgtttgcaccgcct

SEQ ID NO: 5670083 - DNA, 23 bp, Homo sapiens
acgtttggaagatcctgtgagga

SEQ ID NO: 5670084 - DNA, 13 bp, Homo sapiens
acgtttgtgcaga

SEQ ID NO: 5670085 - DNA, 14 bp, Homo sapiens
acgttttaaggact

SEQ ID NO: 5670086 - DNA, 20 bp, Homo sapiens
atcacttgggcccaggaggt

SEQ ID NO: 5670087 - DNA, 23 bp, Homo sapiens
atcacttggggtcaccaccctcc

SEQ ID NO: 5670088 - DNA, 16 bp, Homo sapiens
atcacttgtacaaaat

SEQ ID NO: 5670089 - DNA, 18 bp, Homo sapiens
atcacttgtacaaaataa

SEQ ID NO: 5670090 - DNA, 13 bp, Homo sapiens
atcactttaagtt

SEQ ID NO: 5670091 - DNA, 21 bp, Homo sapiens
atcactttacctgcaggctcc

SEQ ID NO: 5670092 - DNA, 20 bp, Homo sapiens
atcactttctcagttttcat

SEQ ID NO: 5670093 - DNA, 21 bp, Homo sapiens
atcactttggtctccattttt

SEQ ID NO: 5670094 - DNA, 19 bp, Homo sapiens
atcactttgttaaaaatat

SEQ ID NO: 5670095 - DNA, 14 bp, Homo sapiens
atcacttttcagtg

SEQ ID NO: 5670096 - DNA, 16 bp, Homo sapiens
atcacttttctagaca

SEQ ID NO: 5670097 - DNA, 18 bp, Homo sapiens
atcactttttgaactaag

SEQ ID NO: 5670098 - DNA, 23 bp, Homo sapiens
atcagaaaacccacggtttttct

SEQ ID NO: 5670099 - DNA, 13 bp, Homo sapiens
atcagaaaagcta

SEQ ID NO: 5670100 - DNA, 13 bp, Homo sapiens
atcagaaaaggga

SEQ ID NO: 5670101 - DNA, 12 bp, Homo sapiens
atcagaaaagta

SEQ ID NO: 5670102 - DNA, 23 bp, Homo sapiens
atcagaaaagtaattttgtcaca

SEQ ID NO: 5670103 - DNA, 14 bp, Homo sapiens
atcagaaaagtaga

SEQ ID NO: 5670104 - DNA, 20 bp, Homo sapiens
atcagaaacaccctcacact

SEQ ID NO: 5670105 - DNA, 17 bp, Homo sapiens
atcagaaagacattctt

SEQ ID NO: 5670106 - DNA, 19 bp, Homo sapiens
atcagaaagctttattttg

SEQ ID NO: 5670107 - DNA, 20 bp, Homo sapiens
atcagaaaggaaaaacaaac

SEQ ID NO: 5670108 - DNA, 16 bp, Homo sapiens
atcagaaagggagggc

SEQ ID NO: 5670109 - DNA, 17 bp, Homo sapiens
atcagaaagggagggct

SEQ ID NO: 5670110 - DNA, 20 bp, Homo sapiens
atcagaaagtaacaatctat

SEQ ID NO: 5670111 - DNA, 14 bp, Homo sapiens
atcagaaagtaatt

SEQ ID NO: 5670112 - DNA, 14 bp, Homo sapiens
atcagaaagttggc

SEQ ID NO: 5670113 - DNA, 14 bp, Homo sapiens
atcagaaatacaga

SEQ ID NO: 5670114 - DNA, 11 bp, Homo sapiens
atcagaaatgt

SEQ ID NO: 5670115 - DNA, 23 bp, Homo sapiens
atcagaaatgtctggagaataat

SEQ ID NO: 5670116 - DNA, 17 bp, Homo sapiens
atcagaaattttctaca

SEQ ID NO: 5670117 - DNA, 17 bp, Homo sapiens
atcagaacaaaacttct

SEQ ID NO: 5670118 - DNA, 14 bp, Homo sapiens
atcagaacagcaga

SEQ ID NO: 5670119 - DNA, 21 bp, Homo sapiens
atcagaacagggctatttgaa

SEQ ID NO: 5670120 - DNA, 19 bp, Homo sapiens
atcagaacattcagctctg

SEQ ID NO: 5670121 - DNA, 20 bp, Homo sapiens
atcagaacattcagctctgg

SEQ ID NO: 5670122 - DNA, 16 bp, Homo sapiens
atcagaactcctttct

SEQ ID NO: 5670123 - DNA, 21 bp, Homo sapiens
atcagaactcctttctaagga

SEQ ID NO: 5670124 - DNA, 15 bp, Homo sapiens
atcagaactcttcct

SEQ ID NO: 5670125 - DNA, 13 bp, Homo sapiens
atcagaagaaagg

SEQ ID NO: 5670126 - DNA, 17 bp, Homo sapiens
atcagaagcaaggaagt

SEQ ID NO: 5670127 - DNA, 23 bp, Homo sapiens
atcagaagcctattgtaaataca

SEQ ID NO: 5670128 - DNA, 13 bp, Homo sapiens
atcagaaggctgg

SEQ ID NO: 5670129 - DNA, 14 bp, Homo sapiens
atcagaaggctggg

SEQ ID NO: 5670130 - DNA, 21 bp, Homo sapiens
atcagaaggtattttttaact

SEQ ID NO: 5670131 - DNA, 17 bp, Homo sapiens
atcagaagtaactccca

SEQ ID NO: 5670132 - DNA, 22 bp, Homo sapiens
atcagaagtaactcccactcct

SEQ ID NO: 5670133 - DNA, 19 bp, Homo sapiens
atcagaagtaggaaggaaa

SEQ ID NO: 5670134 - DNA, 21 bp, Homo sapiens
atcagaagtatggaattttct

SEQ ID NO: 5670135 - DNA, 15 bp, Homo sapiens
atcagaagtttcctg

SEQ ID NO: 5670136 - DNA, 18 bp, Homo sapiens
atcagaagtttctcagct

SEQ ID NO: 5670137 - DNA, 16 bp, Homo sapiens
atcagaagtttgcatc

SEQ ID NO: 5670138 - DNA, 19 bp, Homo sapiens
atcagaatagccacatttg

SEQ ID NO: 5670139 - DNA, 17 bp, Homo sapiens
atcagaatatcagaata

SEQ ID NO: 5670140 - DNA, 17 bp, Homo sapiens
atcagaatcatggagaa

SEQ ID NO: 5670141 - DNA, 20 bp, Homo sapiens
atcagaatgaaccctcctcc

SEQ ID NO: 5670142 - DNA, 13 bp, Homo sapiens
atcagaatggaaa

SEQ ID NO: 5670143 - DNA, 12 bp, Homo sapiens
atcagaatgtta

SEQ ID NO: 5670144 - DNA, 14 bp, Homo sapiens
atcagaatgttaat

SEQ ID NO: 5670145 - DNA, 17 bp, Homo sapiens
atcagaattgaaacact

SEQ ID NO: 5670146 - DNA, 13 bp, Homo sapiens
atcagacaagcac

SEQ ID NO: 5670147 - DNA, 13 bp, Homo sapiens
atcagacagatct

SEQ ID NO: 5670148 - DNA, 10 bp, Homo sapiens
atcagacagc

SEQ ID NO: 5670149 - DNA, 13 bp, Homo sapiens
atcagacagcagg

SEQ ID NO: 5670150 - DNA, 13 bp, Homo sapiens
atcagacatacag

SEQ ID NO: 5670151 - DNA, 19 bp, Homo sapiens
atcagacccaacccatgaa

SEQ ID NO: 5670152 - DNA, 19 bp, Homo sapiens
atcagaccctaccccacca

SEQ ID NO: 5670153 - DNA, 15 bp, Homo sapiens
atcagacctgtcttc

SEQ ID NO: 5670154 - DNA, 16 bp, Homo sapiens
atcagactaagccagc

SEQ ID NO: 5670155 - DNA, 19 bp, Homo sapiens
atcagactaagccagcacc

SEQ ID NO: 5670156 - DNA, 19 bp, Homo sapiens
atcagactagagaataatt

SEQ ID NO: 5670157 - DNA, 21 bp, Homo sapiens
atcagactagtatcaagtgtt

SEQ ID NO: 5670158 - DNA, 15 bp, Homo sapiens
atcagactctagaaa

SEQ ID NO: 5670159 - DNA, 13 bp, Homo sapiens
atcagactgacag

SEQ ID NO: 5670160 - DNA, 18 bp, Homo sapiens
atcagacttcacactgca

SEQ ID NO: 5670161 - DNA, 21 bp, Homo sapiens
atcagacttgatttacaagca

SEQ ID NO: 5670162 - DNA, 16 bp, Homo sapiens
atcagacttgcggcca

SEQ ID NO: 5670163 - DNA, 22 bp, Homo sapiens
atcagacttgcggccacagcac

SEQ ID NO: 5670164 - DNA, 14 bp, Homo sapiens
atcagagaagcagc

SEQ ID NO: 5670165 - DNA, 19 bp, Homo sapiens
atcagagaccaggccctgg

SEQ ID NO: 5670166 - DNA, 19 bp, Homo sapiens
atcagagagcaagaaaaaa

SEQ ID NO: 5670167 - DNA, 16 bp, Homo sapiens
atcagagagcaaggca

SEQ ID NO: 5670168 - DNA, 16 bp, Homo sapiens
atcagagagtgtacat

SEQ ID NO: 5670169 - DNA, 22 bp, Homo sapiens
atcagagagtgtacatcatgtt

SEQ ID NO: 5670170 - DNA, 19 bp, Homo sapiens
atcagagatgggaaaacca

SEQ ID NO: 5670171 - DNA, 16 bp, Homo sapiens
atcagagattattcaa

SEQ ID NO: 5670172 - DNA, 14 bp, Homo sapiens
atcagagcaggacc

SEQ ID NO: 5670173 - DNA, 14 bp, Homo sapiens
atcagagctcttaa

SEQ ID NO: 5670174 - DNA, 15 bp, Homo sapiens
atcagagctgcagcc

SEQ ID NO: 5670175 - DNA, 17 bp, Homo sapiens
atcagagctgcagccag

SEQ ID NO: 5670176 - DNA, 12 bp, Homo sapiens
atcagagctgga

SEQ ID NO: 5670177 - DNA, 14 bp, Homo sapiens
atcagagggctgat

SEQ ID NO: 5670178 - DNA, 15 bp, Homo sapiens
atcagaggtatctta

SEQ ID NO: 5670179 - DNA, 12 bp, Homo sapiens
atcagaggtgta

SEQ ID NO: 5670180 - DNA, 17 bp, Homo sapiens
atcagaggtgtacacta

SEQ ID NO: 5670181 - DNA, 19 bp, Homo sapiens
atcagagtaacgagaagac

SEQ ID NO: 5670182 - DNA, 18 bp, Homo sapiens
atcagagtagaaataaaa

SEQ ID NO: 5670183 - DNA, 16 bp, Homo sapiens
atcagagtgacatcca

SEQ ID NO: 5670184 - DNA, 20 bp, Homo sapiens
atcagagtgacatccaggag

SEQ ID NO: 5670185 - DNA, 15 bp, Homo sapiens
atcagagtgtacaaa

SEQ ID NO: 5670186 - DNA, 20 bp, Homo sapiens
atcagagttgcttttctaat

SEQ ID NO: 5670187 - DNA, 16 bp, Homo sapiens
atcagataacaactgt

SEQ ID NO: 5670188 - DNA, 18 bp, Homo sapiens
atcagataacaactgtga

SEQ ID NO: 5670189 - DNA, 15 bp, Homo sapiens
atcagatagcatctt

SEQ ID NO: 5670190 - DNA, 16 bp, Homo sapiens
atcagatatacctaga

SEQ ID NO: 5670191 - DNA, 17 bp, Homo sapiens
atcagatattttcatat

SEQ ID NO: 5670192 - DNA, 23 bp, Homo sapiens
atcagatgctccaagattctaga

SEQ ID NO: 5670193 - DNA, 15 bp, Homo sapiens
atcagatggtgtcat

SEQ ID NO: 5670194 - DNA, 18 bp, Homo sapiens
atcagatggtgtcattta

SEQ ID NO: 5670195 - DNA, 19 bp, Homo sapiens
atcagatggtgtcatttag

SEQ ID NO: 5670196 - DNA, 11 bp, Homo sapiens
atcagatgtga

SEQ ID NO: 5670197 - DNA, 12 bp, Homo sapiens
atcagatgtgaa

SEQ ID NO: 5670198 - DNA, 14 bp, Homo sapiens
atcagatgtgttcc

SEQ ID NO: 5670199 - DNA, 15 bp, Homo sapiens
atcagatgttgaatt

SEQ ID NO: 5670200 - DNA, 19 bp, Homo sapiens
atcagatgttgaattcttt

SEQ ID NO: 5670201 - DNA, 15 bp, Homo sapiens
atcagattcaggagc

SEQ ID NO: 5670202 - DNA, 16 bp, Homo sapiens
atcagattcctgacta

SEQ ID NO: 5670203 - DNA, 21 bp, Homo sapiens
atcagattcttgctgtgaccc

SEQ ID NO: 5670204 - DNA, 21 bp, Homo sapiens
atcagattgcatgtgactctg

SEQ ID NO: 5670205 - DNA, 13 bp, Homo sapiens
atcagattgcttt

SEQ ID NO: 5670206 - DNA, 14 bp, Homo sapiens
atcagattgttaag

SEQ ID NO: 5670207 - DNA, 15 bp, Homo sapiens
atcagatttcttaat

SEQ ID NO: 5670208 - DNA, 19 bp, Homo sapiens
atcagatttcttaatgtct

SEQ ID NO: 5670209 - DNA, 14 bp, Homo sapiens
atcagcaaaaagac

SEQ ID NO: 5670210 - DNA, 16 bp, Homo sapiens
atcagcaaacacaata

SEQ ID NO: 5670211 - DNA, 21 bp, Homo sapiens
atcagcaaaccggggcctact

SEQ ID NO: 5670212 - DNA, 13 bp, Homo sapiens
atcagcaaagaaa

SEQ ID NO: 5670213 - DNA, 14 bp, Homo sapiens
atcagcaaagaaaa

SEQ ID NO: 5670214 - DNA, 22 bp, Homo sapiens
atcagcaacttctagcatatag

SEQ ID NO: 5670215 - DNA, 15 bp, Homo sapiens
atcagcaatgaagaa

SEQ ID NO: 5670216 - DNA, 14 bp, Homo sapiens
atcagcaatgcttc

SEQ ID NO: 5670217 - DNA, 15 bp, Homo sapiens
atcagcacacggctc

SEQ ID NO: 5670218 - DNA, 13 bp, Homo sapiens
atcagcactgaaa

SEQ ID NO: 5670219 - DNA, 14 bp, Homo sapiens
atcagcactggatt

SEQ ID NO: 5670220 - DNA, 22 bp, Homo sapiens
atcagcactggattgtagaact

SEQ ID NO: 5670221 - DNA, 17 bp, Homo sapiens
atcagcagacactccag

SEQ ID NO: 5670222 - DNA, 12 bp, Homo sapiens
atcagcagagag

SEQ ID NO: 5670223 - DNA, 20 bp, Homo sapiens
atcagcaggctccagttgaa

SEQ ID NO: 5670224 - DNA, 15 bp, Homo sapiens
atcagcagtggcagg

SEQ ID NO: 5670225 - DNA, 20 bp, Homo sapiens
atcagcatccaaaagcagga

SEQ ID NO: 5670226 - DNA, 21 bp, Homo sapiens
atcagcatccaaaagcaggaa

SEQ ID NO: 5670227 - DNA, 18 bp, Homo sapiens
atcagcatctgtgatggg

SEQ ID NO: 5670228 - DNA, 14 bp, Homo sapiens
atcagcatgacaaa

SEQ ID NO: 5670229 - DNA, 16 bp, Homo sapiens
atcagcatgacaaaaa

SEQ ID NO: 5670230 - DNA, 20 bp, Homo sapiens
atcagcatgacaaaaataac

SEQ ID NO: 5670231 - DNA, 15 bp, Homo sapiens
atcagcatgttttct

SEQ ID NO: 5670232 - DNA, 22 bp, Homo sapiens
atcagcatgttttctgctttaa

SEQ ID NO: 5670233 - DNA, 19 bp, Homo sapiens
atcagcattgtttcaaaat

SEQ ID NO: 5670234 - DNA, 20 bp, Homo sapiens
atcagcattgtttcaaaata

SEQ ID NO: 5670235 - DNA, 14 bp, Homo sapiens
atcagccaattatg

SEQ ID NO: 5670236 - DNA, 15 bp, Homo sapiens
atcagccacattcta

SEQ ID NO: 5670237 - DNA, 14 bp, Homo sapiens
atcagccagctgcc

SEQ ID NO: 5670238 - DNA, 17 bp, Homo sapiens
atcagccattaaaataa

SEQ ID NO: 5670239 - DNA, 20 bp, Homo sapiens
atcagccattaaaataaaac

SEQ ID NO: 5670240 - DNA, 24 bp, Homo sapiens
atcagccattaaaataaaacaagc

SEQ ID NO: 5670241 - DNA, 12 bp, Homo sapiens
atcagcccaggt

SEQ ID NO: 5670242 - DNA, 19 bp, Homo sapiens
atcagccccaccctggcct

SEQ ID NO: 5670243 - DNA, 22 bp, Homo sapiens
atcagccccgcctgtcacaata

SEQ ID NO: 5670244 - DNA, 17 bp, Homo sapiens
atcagccccgctcctcc

SEQ ID NO: 5670245 - DNA, 12 bp, Homo sapiens
atcagcccctca

SEQ ID NO: 5670246 - DNA, 11 bp, Homo sapiens
atcagcccctg

SEQ ID NO: 5670247 - DNA, 14 bp, Homo sapiens
atcagcccctggga

SEQ ID NO: 5670248 - DNA, 22 bp, Homo sapiens
atcagcccctgggaacaggccc

SEQ ID NO: 5670249 - DNA, 10 bp, Homo sapiens
atcagccctg

SEQ ID NO: 5670250 - DNA, 11 bp, Homo sapiens
atcagccctgc

SEQ ID NO: 5670251 - DNA, 24 bp, Homo sapiens
atcagccctgcccttcagcatcct

SEQ ID NO: 5670252 - DNA, 13 bp, Homo sapiens
atcagccctgcta

SEQ ID NO: 5670253 - DNA, 16 bp, Homo sapiens
atcagcctacaggcct

SEQ ID NO: 5670254 - DNA, 15 bp, Homo sapiens
atcagcctctggcca

SEQ ID NO: 5670255 - DNA, 18 bp, Homo sapiens
atcagcctctggccagac

SEQ ID NO: 5670256 - DNA, 11 bp, Homo sapiens
atcagcctctt

SEQ ID NO: 5670257 - DNA, 13 bp, Homo sapiens
atcagcctcttaa

SEQ ID NO: 5670258 - DNA, 18 bp, Homo sapiens
atcagcctgctccagctg

SEQ ID NO: 5670259 - DNA, 20 bp, Homo sapiens
atcagcctgctccagctgtt

SEQ ID NO: 5670260 - DNA, 14 bp, Homo sapiens
atcagcctgggcaa

SEQ ID NO: 5670261 - DNA, 21 bp, Homo sapiens
atcagcctgggcaatgtgata

SEQ ID NO: 5670262 - DNA, 14 bp, Homo sapiens
atcagcctgtgcca

SEQ ID NO: 5670263 - DNA, 20 bp, Homo sapiens
atcagcctgttccagaagga

SEQ ID NO: 5670264 - DNA, 22 bp, Homo sapiens
atcagccttgggatagcaaact

SEQ ID NO: 5670265 - DNA, 17 bp, Homo sapiens
atcagcctttaggtctt

SEQ ID NO: 5670266 - DNA, 12 bp, Homo sapiens
atcatctaagtc

SEQ ID NO: 5670267 - DNA, 19 bp, Homo sapiens
atcatctattgagtgtaca

SEQ ID NO: 5670268 - DNA, 13 bp, Homo sapiens
atcatctccaaat

SEQ ID NO: 5670269 - DNA, 15 bp, Homo sapiens
atcatctcctttgca

SEQ ID NO: 5670270 - DNA, 18 bp, Homo sapiens
atcatctcctttgcagaa

SEQ ID NO: 5670271 - DNA, 14 bp, Homo sapiens
atcatctctgtaaa

SEQ ID NO: 5670272 - DNA, 14 bp, Homo sapiens
atcatctcttcctc

SEQ ID NO: 5670273 - DNA, 20 bp, Homo sapiens
atcatctcttgataaaggag

SEQ ID NO: 5670274 - DNA, 21 bp, Homo sapiens
atcatctgcagttctttttgt

SEQ ID NO: 5670275 - DNA, 17 bp, Homo sapiens
atcatctgcattcctga

SEQ ID NO: 5670276 - DNA, 18 bp, Homo sapiens
atcatctgcattcctgat

SEQ ID NO: 5670277 - DNA, 13 bp, Homo sapiens
atcatctgccgtg

SEQ ID NO: 5670278 - DNA, 17 bp, Homo sapiens
atcatctgctgcacata

SEQ ID NO: 5670279 - DNA, 20 bp, Homo sapiens
atcatctgctgcacatagca

SEQ ID NO: 5670280 - DNA, 14 bp, Homo sapiens
atcatctgctgtga

SEQ ID NO: 5670281 - DNA, 17 bp, Homo sapiens
atcatctgtcattatat

SEQ ID NO: 5670282 - DNA, 23 bp, Homo sapiens
atcatctgtcattatattctaat

SEQ ID NO: 5670283 - DNA, 13 bp, Homo sapiens
atcatctgtgtga

SEQ ID NO: 5670284 - DNA, 16 bp, Homo sapiens
atcatctgtgtgaaaa

SEQ ID NO: 5670285 - DNA, 13 bp, Homo sapiens
atcatctgtttgt

SEQ ID NO: 5670286 - DNA, 15 bp, Homo sapiens
atcatcttataatta

SEQ ID NO: 5670287 - DNA, 17 bp, Homo sapiens
atcatcttctctttttc

SEQ ID NO: 5670288 - DNA, 15 bp, Homo sapiens
atcatctttgtgaag

SEQ ID NO: 5670289 - DNA, 12 bp, Homo sapiens
atcatctttttg

SEQ ID NO: 5670290 - DNA, 19 bp, Homo sapiens
atcatgaaaggttaaaaaa

SEQ ID NO: 5670291 - DNA, 14 bp, Homo sapiens
atcatgaactggct

SEQ ID NO: 5670292 - DNA, 22 bp, Homo sapiens
atcatgaactggcttgtacatt

SEQ ID NO: 5670293 - DNA, 14 bp, Homo sapiens
atcatgaagcctgt

SEQ ID NO: 5670294 - DNA, 15 bp, Homo sapiens
atcatgaagcctgtg

SEQ ID NO: 5670295 - DNA, 18 bp, Homo sapiens
atcatgaagccttgctga

SEQ ID NO: 5670296 - DNA, 18 bp, Homo sapiens
atcatgaatatttcaaaa

SEQ ID NO: 5670297 - DNA, 19 bp, Homo sapiens
atcatgaatctttgtttca

SEQ ID NO: 5670298 - DNA, 15 bp, Homo sapiens
atcatgaatgtgtaa

SEQ ID NO: 5670299 - DNA, 17 bp, Homo sapiens
atcatgaattagtttta

SEQ ID NO: 5670300 - DNA, 15 bp, Homo sapiens
atcatgaattttaaa

SEQ ID NO: 5670301 - DNA, 17 bp, Homo sapiens
atcatgaattttaaagt

SEQ ID NO: 5670302 - DNA, 18 bp, Homo sapiens
atcatgaattttaaagta

SEQ ID NO: 5670303 - DNA, 19 bp, Homo sapiens
atcatgaattttaaagtat

SEQ ID NO: 5670304 - DNA, 20 bp, Homo sapiens
atcatgacactcgtataagc

SEQ ID NO: 5670305 - DNA, 13 bp, Homo sapiens
atcatgacatgtt

SEQ ID NO: 5670306 - DNA, 16 bp, Homo sapiens
atcatgacatgttata

SEQ ID NO: 5670307 - DNA, 18 bp, Homo sapiens
atcatgacatgttatata

SEQ ID NO: 5670308 - DNA, 21 bp, Homo sapiens
atcatgagaaaaactgttctt

SEQ ID NO: 5670309 - DNA, 16 bp, Homo sapiens
atcatgagcctgctgg

SEQ ID NO: 5670310 - DNA, 21 bp, Homo sapiens
atcatgagcctgctggaagcc

SEQ ID NO: 5670311 - DNA, 16 bp, Homo sapiens
atcatgagcctgttta

SEQ ID NO: 5670312 - DNA, 24 bp, Homo sapiens
atcatgagcctgtttattgccatt

SEQ ID NO: 5670313 - DNA, 13 bp, Homo sapiens
atcatgagccttc

SEQ ID NO: 5670314 - DNA, 21 bp, Homo sapiens
atcatgatctgactttaattg

SEQ ID NO: 5670315 - DNA, 18 bp, Homo sapiens
atcatgcacacaattaga

SEQ ID NO: 5670316 - DNA, 14 bp, Homo sapiens
atcatgcatagagt

SEQ ID NO: 5670317 - DNA, 14 bp, Homo sapiens
atcatgcattcaca

SEQ ID NO: 5670318 - DNA, 16 bp, Homo sapiens
atcatgcattcacaag

SEQ ID NO: 5670319 - DNA, 12 bp, Homo sapiens
atcatgcattgt

SEQ ID NO: 5670320 - DNA, 22 bp, Homo sapiens
atcatgcattgttgaggtggtc

SEQ ID NO: 5670321 - DNA, 19 bp, Homo sapiens
atcatgcccggtcccaccc

SEQ ID NO: 5670322 - DNA, 21 bp, Homo sapiens
atcatgcccggtcccacccct

SEQ ID NO: 5670323 - DNA, 23 bp, Homo sapiens
atcatgcccggtcccacccctcc

SEQ ID NO: 5670324 - DNA, 18 bp, Homo sapiens
atcatgccgccgcagctg

SEQ ID NO: 5670325 - DNA, 16 bp, Homo sapiens
atcatgcctctgaggc

SEQ ID NO: 5670326 - DNA, 22 bp, Homo sapiens
atcatgcctctgaggccagcct

SEQ ID NO: 5670327 - DNA, 21 bp, Homo sapiens
atcatgcggtgggtgctgcca

SEQ ID NO: 5670328 - DNA, 16 bp, Homo sapiens
atcatgcgttttatat

SEQ ID NO: 5670329 - DNA, 17 bp, Homo sapiens
atcatgctaaaattcta

SEQ ID NO: 5670330 - DNA, 17 bp, Homo sapiens
atcatggaaatgtattt

SEQ ID NO: 5670331 - DNA, 16 bp, Homo sapiens
atcatggaagaaaagg

SEQ ID NO: 5670332 - DNA, 18 bp, Homo sapiens
atcatggaagaaaaggat

SEQ ID NO: 5670333 - DNA, 19 bp, Homo sapiens
atcatggaatatttatagg

SEQ ID NO: 5670334 - DNA, 19 bp, Homo sapiens
atcatggaatggttataaa

SEQ ID NO: 5670335 - DNA, 15 bp, Homo sapiens
atcatggaccaaatg

SEQ ID NO: 5670336 - DNA, 17 bp, Homo sapiens
atcatggacctggtgcc

SEQ ID NO: 5670337 - DNA, 22 bp, Homo sapiens
atcatggacctggtgcccctgc

SEQ ID NO: 5670338 - DNA, 22 bp, Homo sapiens
atcatggagcaagagaatttca

SEQ ID NO: 5670339 - DNA, 19 bp, Homo sapiens
atcatggaggtttgaagat

SEQ ID NO: 5670340 - DNA, 17 bp, Homo sapiens
atcatggcactgcattc

SEQ ID NO: 5670341 - DNA, 12 bp, Homo sapiens
atcatggccagc

SEQ ID NO: 5670342 - DNA, 22 bp, Homo sapiens
atcatggcctcttgaagagaaa

SEQ ID NO: 5670343 - DNA, 23 bp, Homo sapiens
atcatggcctcttgaagagaaaa

SEQ ID NO: 5670344 - DNA, 21 bp, Homo sapiens
atcatggctaagcttaaaaaa

SEQ ID NO: 5670345 - DNA, 20 bp, Homo sapiens
atcatggctcactgcagcct

SEQ ID NO: 5670346 - DNA, 15 bp, Homo sapiens
atcatggcttaggat

SEQ ID NO: 5670347 - DNA, 22 bp, Homo sapiens
atcatgggaaaagaccagggct

SEQ ID NO: 5670348 - DNA, 18 bp, Homo sapiens
atcatgggcattgctgga

SEQ ID NO: 5670349 - DNA, 14 bp, Homo sapiens
atcatgggccagag

SEQ ID NO: 5670350 - DNA, 18 bp, Homo sapiens
atcatgggccagagcctc

SEQ ID NO: 5670351 - DNA, 21 bp, Homo sapiens
atcatggtaatgacagatgca

SEQ ID NO: 5670352 - DNA, 20 bp, Homo sapiens
atcatggtcaagttcccaac

SEQ ID NO: 5670353 - DNA, 23 bp, Homo sapiens
atcatggtggatatggtgcagag

SEQ ID NO: 5670354 - DNA, 14 bp, Homo sapiens
atcatggtgtaata

SEQ ID NO: 5670355 - DNA, 15 bp, Homo sapiens
atcatggtttttgaa

SEQ ID NO: 5670356 - DNA, 14 bp, Homo sapiens
atcatgtaaatgta

SEQ ID NO: 5670357 - DNA, 23 bp, Homo sapiens
atcatgtaaatgtattggcacag

SEQ ID NO: 5670358 - DNA, 15 bp, Homo sapiens
atcatgtaacattct

SEQ ID NO: 5670359 - DNA, 19 bp, Homo sapiens
atcatgtaacattcttcta

SEQ ID NO: 5670360 - DNA, 20 bp, Homo sapiens
atcatgtaatagtggctttc

SEQ ID NO: 5670361 - DNA, 19 bp, Homo sapiens
atcatgtcaggcctgtgtg

SEQ ID NO: 5670362 - DNA, 16 bp, Homo sapiens
atcatgtcagtctgct

SEQ ID NO: 5670363 - DNA, 17 bp, Homo sapiens
atcatgtccatcccttt

SEQ ID NO: 5670364 - DNA, 21 bp, Homo sapiens
atcatgtcgtaggtaaactaa

SEQ ID NO: 5670365 - DNA, 16 bp, Homo sapiens
atcatgtctattgtcc

SEQ ID NO: 5670366 - DNA, 14 bp, Homo sapiens
atcatgtctggcta

SEQ ID NO: 5670367 - DNA, 22 bp, Homo sapiens
atcatgtctgtatactcctgtc

SEQ ID NO: 5670368 - DNA, 23 bp, Homo sapiens
atcatgtctgtatactcctgtca

SEQ ID NO: 5670369 - DNA, 23 bp, Homo sapiens
atcatgtcttcattttttaatgt

SEQ ID NO: 5670370 - DNA, 16 bp, Homo sapiens
atcatgtcttgtgcat

SEQ ID NO: 5670371 - DNA, 17 bp, Homo sapiens
atcatgtcttgtgcata

SEQ ID NO: 5670372 - DNA, 16 bp, Homo sapiens
atcatgtgaaatcatt

SEQ ID NO: 5670373 - DNA, 16 bp, Homo sapiens
atcatgtgcctggaaa

SEQ ID NO: 5670374 - DNA, 22 bp, Homo sapiens
atcatgtggcccaactctcctg

SEQ ID NO: 5670375 - DNA, 22 bp, Homo sapiens
atcatgtggcctaatattgaaa

SEQ ID NO: 5670376 - DNA, 18 bp, Homo sapiens
atcatgtgggtgagccag

SEQ ID NO: 5670377 - DNA, 13 bp, Homo sapiens
atcatgtgtaatc

SEQ ID NO: 5670378 - DNA, 15 bp, Homo sapiens
atcatgtgtaatcaa

SEQ ID NO: 5670379 - DNA, 13 bp, Homo sapiens
atcatgtgtttct

SEQ ID NO: 5670380 - DNA, 15 bp, Homo sapiens
atcatgtgtttctgt

SEQ ID NO: 5670381 - DNA, 18 bp, Homo sapiens
atcatgtgtttctgtgta

SEQ ID NO: 5670382 - DNA, 18 bp, Homo sapiens
atcatgttatgataaaaa

SEQ ID NO: 5670383 - DNA, 19 bp, Homo sapiens
atcatgttatgatttgtaa

SEQ ID NO: 5670384 - DNA, 21 bp, Homo sapiens
atcatgttatgatttgtaaca

SEQ ID NO: 5670385 - DNA, 16 bp, Homo sapiens
atcatgttgatcatgt

SEQ ID NO: 5670386 - DNA, 19 bp, Homo sapiens
atcatgttgatcatgtact

SEQ ID NO: 5670387 - DNA, 18 bp, Homo sapiens
atcatgttggccaggctg

SEQ ID NO: 5670388 - DNA, 20 bp, Homo sapiens
atcatgttggccaggctggt

SEQ ID NO: 5670389 - DNA, 11 bp, Homo sapiens
atcatgttgtt

SEQ ID NO: 5670390 - DNA, 21 bp, Homo sapiens
atcatgttgttaaaattatga

SEQ ID NO: 5670391 - DNA, 16 bp, Homo sapiens
atcatgtttctttgat

SEQ ID NO: 5670392 - DNA, 14 bp, Homo sapiens
atcattaaaatata

SEQ ID NO: 5670393 - DNA, 15 bp, Homo sapiens
atcattaaaatatat

SEQ ID NO: 5670394 - DNA, 17 bp, Homo sapiens
atcattaaaatatatgt

SEQ ID NO: 5670395 - DNA, 13 bp, Homo sapiens
atcattaaacatg

SEQ ID NO: 5670396 - DNA, 14 bp, Homo sapiens
atcattaaacatga

SEQ ID NO: 5670397 - DNA, 18 bp, Homo sapiens
atcattaaacatgaattt

SEQ ID NO: 5670398 - DNA, 19 bp, Homo sapiens
atcattaaacatgaattta

SEQ ID NO: 5670399 - DNA, 21 bp, Homo sapiens
atcattaaacatgaatttaat

SEQ ID NO: 5670400 - DNA, 15 bp, Homo sapiens
atcattaataagtga

SEQ ID NO: 5670401 - DNA, 23 bp, Homo sapiens
atcattaatgactttatgtatta

SEQ ID NO: 5670402 - DNA, 18 bp, Homo sapiens
atcattaatttttaattg

SEQ ID NO: 5670403 - DNA, 17 bp, Homo sapiens
atcattacccttccctg

SEQ ID NO: 5670404 - DNA, 15 bp, Homo sapiens
atcattactggtaaa

SEQ ID NO: 5670405 - DNA, 12 bp, Homo sapiens
atcattactgtt

SEQ ID NO: 5670406 - DNA, 20 bp, Homo sapiens
atcattactgttccagattc

SEQ ID NO: 5670407 - DNA, 11 bp, Homo sapiens
atcattagaac

SEQ ID NO: 5670408 - DNA, 20 bp, Homo sapiens
atcattagagcttaaattgt

SEQ ID NO: 5670409 - DNA, 14 bp, Homo sapiens
atcattagttttag

SEQ ID NO: 5670410 - DNA, 20 bp, Homo sapiens
atcattataactgaaggaga

SEQ ID NO: 5670411 - DNA, 20 bp, Homo sapiens
atcattatagcatgtaatat

SEQ ID NO: 5670412 - DNA, 16 bp, Homo sapiens
atcattatgtaatgtc

SEQ ID NO: 5670413 - DNA, 15 bp, Homo sapiens
atcattattgtagtt

SEQ ID NO: 5670414 - DNA, 20 bp, Homo sapiens
atcattattgtagtttgaaa

SEQ ID NO: 5670415 - DNA, 13 bp, Homo sapiens
atcattcagaaat

SEQ ID NO: 5670416 - DNA, 16 bp, Homo sapiens
atcattcagaaatgtt

SEQ ID NO: 5670417 - DNA, 13 bp, Homo sapiens
atcattcagcaac

SEQ ID NO: 5670418 - DNA, 21 bp, Homo sapiens
atcattcataaaagtttgcat

SEQ ID NO: 5670419 - DNA, 21 bp, Homo sapiens
atcattcatccaggactgaga

SEQ ID NO: 5670420 - DNA, 21 bp, Homo sapiens
atcattcatcttcttctttaa

SEQ ID NO: 5670421 - DNA, 11 bp, Homo sapiens
atcattccagt

SEQ ID NO: 5670422 - DNA, 19 bp, Homo sapiens
atcattccagtgctagaaa

SEQ ID NO: 5670423 - DNA, 13 bp, Homo sapiens
atcattccctctc

SEQ ID NO: 5670424 - DNA, 13 bp, Homo sapiens
atcattcctgtca

SEQ ID NO: 5670425 - DNA, 20 bp, Homo sapiens
atcattcctgtcagagcttt

SEQ ID NO: 5670426 - DNA, 13 bp, Homo sapiens
atcattccttcct

SEQ ID NO: 5670427 - DNA, 14 bp, Homo sapiens
atcattcctttcca

SEQ ID NO: 5670428 - DNA, 14 bp, Homo sapiens
atcattccttttta

SEQ ID NO: 5670429 - DNA, 20 bp, Homo sapiens
atcattcctttttatttata

SEQ ID NO: 5670430 - DNA, 21 bp, Homo sapiens
atcattcctttttatttatat

SEQ ID NO: 5670431 - DNA, 15 bp, Homo sapiens
atcattctacagaat

SEQ ID NO: 5670432 - DNA, 11 bp, Homo sapiens
atcattctcag

SEQ ID NO: 5670433 - DNA, 12 bp, Homo sapiens
atcattctcagt

SEQ ID NO: 5670434 - DNA, 16 bp, Homo sapiens
atcattctctgtctca

SEQ ID NO: 5670435 - DNA, 21 bp, Homo sapiens
atcattctctgtctcatccat

SEQ ID NO: 5670436 - DNA, 20 bp, Homo sapiens
atcattctgcttccgtattt

SEQ ID NO: 5670437 - DNA, 14 bp, Homo sapiens
atcattctggctta

SEQ ID NO: 5670438 - DNA, 13 bp, Homo sapiens
atcattctgtgtc

SEQ ID NO: 5670439 - DNA, 20 bp, Homo sapiens
atcattcttgtgggagacag

SEQ ID NO: 5670440 - DNA, 17 bp, Homo sapiens
atcattctttcccctca

SEQ ID NO: 5670441 - DNA, 23 bp, Homo sapiens
atcattctttcccctcagagctc

SEQ ID NO: 5670442 - DNA, 19 bp, Homo sapiens
atcattcttttatagagca

SEQ ID NO: 5670443 - DNA, 14 bp, Homo sapiens
atcattgaaacatt

SEQ ID NO: 5670444 - DNA, 21 bp, Homo sapiens
atccagtatcttgaagacttt

SEQ ID NO: 5670445 - DNA, 16 bp, Homo sapiens
atccagtattgctgat

SEQ ID NO: 5670446 - DNA, 16 bp, Homo sapiens
atccagtcaaagacgc

SEQ ID NO: 5670447 - DNA, 18 bp, Homo sapiens
atccagtctatcattgtt

SEQ ID NO: 5670448 - DNA, 14 bp, Homo sapiens
atccagtctggaaa

SEQ ID NO: 5670449 - DNA, 11 bp, Homo sapiens
atccagtgacc

SEQ ID NO: 5670450 - DNA, 21 bp, Homo sapiens
atccagtgacctctctctctg

SEQ ID NO: 5670451 - DNA, 22 bp, Homo sapiens
atccagtgacctctctctctgg

SEQ ID NO: 5670452 - DNA, 20 bp, Homo sapiens
atccagtgacttgttctgag

SEQ ID NO: 5670453 - DNA, 19 bp, Homo sapiens
atccagtgcagttgtgatt

SEQ ID NO: 5670454 - DNA, 16 bp, Homo sapiens
atccagtgcttccaca

SEQ ID NO: 5670455 - DNA, 22 bp, Homo sapiens
atccagtggatggattcatcat

SEQ ID NO: 5670456 - DNA, 23 bp, Homo sapiens
atccagtgggcccggagaaacct

SEQ ID NO: 5670457 - DNA, 20 bp, Homo sapiens
atccagtgggttcctcccag

SEQ ID NO: 5670458 - DNA, 12 bp, Homo sapiens
atccagtggtgg

SEQ ID NO: 5670459 - DNA, 13 bp, Homo sapiens
atccagtggtggg

SEQ ID NO: 5670460 - DNA, 13 bp, Homo sapiens
atccagtgtataa

SEQ ID NO: 5670461 - DNA, 17 bp, Homo sapiens
atccagtgtctcacagc

SEQ ID NO: 5670462 - DNA, 18 bp, Homo sapiens
atccagtgtgagatactg

SEQ ID NO: 5670463 - DNA, 19 bp, Homo sapiens
atccagttataagaagaag

SEQ ID NO: 5670464 - DNA, 14 bp, Homo sapiens
atccagttcctgct

SEQ ID NO: 5670465 - DNA, 21 bp, Homo sapiens
atccagttgcaataaaatagt

SEQ ID NO: 5670466 - DNA, 13 bp, Homo sapiens
atccagttgcagg

SEQ ID NO: 5670467 - DNA, 14 bp, Homo sapiens
atccagttgcaggt

SEQ ID NO: 5670468 - DNA, 23 bp, Homo sapiens
atccagttgttttccatcatttg

SEQ ID NO: 5670469 - DNA, 15 bp, Homo sapiens
atccagtttcccacc

SEQ ID NO: 5670470 - DNA, 14 bp, Homo sapiens
atccagtttctttc

SEQ ID NO: 5670471 - DNA, 20 bp, Homo sapiens
atccagtttgtgtttttcta

SEQ ID NO: 5670472 - DNA, 20 bp, Homo sapiens
atccagtttgttctccgggt

SEQ ID NO: 5670473 - DNA, 18 bp, Homo sapiens
atccagttttgtttggac

SEQ ID NO: 5670474 - DNA, 21 bp, Homo sapiens
atccagttttgtttggaccaa

SEQ ID NO: 5670475 - DNA, 13 bp, Homo sapiens
atccataaaattg

SEQ ID NO: 5670476 - DNA, 14 bp, Homo sapiens
atccataaagacaa

SEQ ID NO: 5670477 - DNA, 15 bp, Homo sapiens
atccataaatgtgtt

SEQ ID NO: 5670478 - DNA, 17 bp, Homo sapiens
atccataaatgtgttcc

SEQ ID NO: 5670479 - DNA, 19 bp, Homo sapiens
atccataaatgtgttcctg

SEQ ID NO: 5670480 - DNA, 16 bp, Homo sapiens
atccatacagtcaaga

SEQ ID NO: 5670481 - DNA, 22 bp, Homo sapiens
atccatacagtcaagatacata

SEQ ID NO: 5670482 - DNA, 15 bp, Homo sapiens
atccatactgaaaaa

SEQ ID NO: 5670483 - DNA, 21 bp, Homo sapiens
atccatactgtagacactctg

SEQ ID NO: 5670484 - DNA, 13 bp, Homo sapiens
atccatactgttt

SEQ ID NO: 5670485 - DNA, 15 bp, Homo sapiens
atccatagacacagt

SEQ ID NO: 5670486 - DNA, 20 bp, Homo sapiens
atccatagcacaagataaat

SEQ ID NO: 5670487 - DNA, 22 bp, Homo sapiens
atccatagcacaagataaattg

SEQ ID NO: 5670488 - DNA, 17 bp, Homo sapiens
atccatagtaactgaca

SEQ ID NO: 5670489 - DNA, 18 bp, Homo sapiens
atccatagtaactgacat

SEQ ID NO: 5670490 - DNA, 14 bp, Homo sapiens
atccatagtgactt

SEQ ID NO: 5670491 - DNA, 16 bp, Homo sapiens
atccatagtgactttt

SEQ ID NO: 5670492 - DNA, 15 bp, Homo sapiens
atccatatcagctct

SEQ ID NO: 5670493 - DNA, 19 bp, Homo sapiens
atccatattaagtaagtct

SEQ ID NO: 5670494 - DNA, 21 bp, Homo sapiens
atccatattaagtaagtctca

SEQ ID NO: 5670495 - DNA, 20 bp, Homo sapiens
atccatattacgttgtttct

SEQ ID NO: 5670496 - DNA, 21 bp, Homo sapiens
atccatattacgttgtttctt

SEQ ID NO: 5670497 - DNA, 20 bp, Homo sapiens
atccatatttaataatgctt

SEQ ID NO: 5670498 - DNA, 14 bp, Homo sapiens
atccatatttcttt

SEQ ID NO: 5670499 - DNA, 16 bp, Homo sapiens
atccatatttgctaag

SEQ ID NO: 5670500 - DNA, 20 bp, Homo sapiens
atccatcaatacctgtacta

SEQ ID NO: 5670501 - DNA, 14 bp, Homo sapiens
atccatcagcaatg

SEQ ID NO: 5670502 - DNA, 14 bp, Homo sapiens
atccatcagctccc

SEQ ID NO: 5670503 - DNA, 21 bp, Homo sapiens
atccatcagctcccttttctt

SEQ ID NO: 5670504 - DNA, 14 bp, Homo sapiens
atccatcaggactt

SEQ ID NO: 5670505 - DNA, 13 bp, Homo sapiens
atccatcaggcca

SEQ ID NO: 5670506 - DNA, 12 bp, Homo sapiens
atccatccaatc

SEQ ID NO: 5670507 - DNA, 13 bp, Homo sapiens
atccatccatctc

SEQ ID NO: 5670508 - DNA, 14 bp, Homo sapiens
atccatccatctcc

SEQ ID NO: 5670509 - DNA, 16 bp, Homo sapiens
atccatccatgtactt

SEQ ID NO: 5670510 - DNA, 17 bp, Homo sapiens
atccatccgtccagcca

SEQ ID NO: 5670511 - DNA, 23 bp, Homo sapiens
atccatccgttcattcattcagc

SEQ ID NO: 5670512 - DNA, 15 bp, Homo sapiens
atccatcctctgaga

SEQ ID NO: 5670513 - DNA, 11 bp, Homo sapiens
atccatcctga

SEQ ID NO: 5670514 - DNA, 11 bp, Homo sapiens
atccatcctgc

SEQ ID NO: 5670515 - DNA, 23 bp, Homo sapiens
atccatcctgcaaaggcccttgt

SEQ ID NO: 5670516 - DNA, 15 bp, Homo sapiens
atccatcctgctagc

SEQ ID NO: 5670517 - DNA, 23 bp, Homo sapiens
atccatcctgctagcacctcccc

SEQ ID NO: 5670518 - DNA, 19 bp, Homo sapiens
atccatcggtttatactat

SEQ ID NO: 5670519 - DNA, 21 bp, Homo sapiens
atccatctaaatacctgccct

SEQ ID NO: 5670520 - DNA, 17 bp, Homo sapiens
atccatctcagtcactt

SEQ ID NO: 5670521 - DNA, 12 bp, Homo sapiens
atccatctccag

SEQ ID NO: 5670522 - DNA, 20 bp, Homo sapiens
atccatctcctggtgttctg

SEQ ID NO: 5670523 - DNA, 18 bp, Homo sapiens
atccatcttgctttttcc

SEQ ID NO: 5670524 - DNA, 13 bp, Homo sapiens
atccatctttgta

SEQ ID NO: 5670525 - DNA, 18 bp, Homo sapiens
atccatctttttcttttt

SEQ ID NO: 5670526 - DNA, 21 bp, Homo sapiens
atccatgatcaaaatgcatac

SEQ ID NO: 5670527 - DNA, 15 bp, Homo sapiens
atccatgcaccaaac

SEQ ID NO: 5670528 - DNA, 13 bp, Homo sapiens
atccatgcacttt

SEQ ID NO: 5670529 - DNA, 16 bp, Homo sapiens
atccatgccctcccag

SEQ ID NO: 5670530 - DNA, 18 bp, Homo sapiens
atccatgccctcccagga

SEQ ID NO: 5670531 - DNA, 12 bp, Homo sapiens
atccatgcctca

SEQ ID NO: 5670532 - DNA, 21 bp, Homo sapiens
atccatgcggagtccattatt

SEQ ID NO: 5670533 - DNA, 23 bp, Homo sapiens
atccatgcggagtccattatttg

SEQ ID NO: 5670534 - DNA, 18 bp, Homo sapiens
atccatgcgtttcttcca

SEQ ID NO: 5670535 - DNA, 13 bp, Homo sapiens
atccatggccagc

SEQ ID NO: 5670536 - DNA, 14 bp, Homo sapiens
atccatggccagca

SEQ ID NO: 5670537 - DNA, 16 bp, Homo sapiens
atccatggccagcagc

SEQ ID NO: 5670538 - DNA, 17 bp, Homo sapiens
atccatggccagcagca

SEQ ID NO: 5670539 - DNA, 23 bp, Homo sapiens
atccatggccagcagcacctgcc

SEQ ID NO: 5670540 - DNA, 19 bp, Homo sapiens
atccatggggtctctcaca

SEQ ID NO: 5670541 - DNA, 16 bp, Homo sapiens
atccatgtaactgcct

SEQ ID NO: 5670542 - DNA, 19 bp, Homo sapiens
atccatgtaaggtatcagt

SEQ ID NO: 5670543 - DNA, 13 bp, Homo sapiens
atccatgtaatga

SEQ ID NO: 5670544 - DNA, 17 bp, Homo sapiens
atccatgtaatgatctt

SEQ ID NO: 5670545 - DNA, 14 bp, Homo sapiens
atccatgtactgta

SEQ ID NO: 5670546 - DNA, 22 bp, Homo sapiens
atccatgtactgtagtttttct

SEQ ID NO: 5670547 - DNA, 19 bp, Homo sapiens
atccatgtcctatgtgtga

SEQ ID NO: 5670548 - DNA, 21 bp, Homo sapiens
atccatgtgaccattctgcct

SEQ ID NO: 5670549 - DNA, 19 bp, Homo sapiens
atccatgtgattaatgttt

SEQ ID NO: 5670550 - DNA, 22 bp, Homo sapiens
atccatgtgattaatgttttca

SEQ ID NO: 5670551 - DNA, 17 bp, Homo sapiens
atccatgtgctgctgtg

SEQ ID NO: 5670552 - DNA, 19 bp, Homo sapiens
atccatgttagtttttact

SEQ ID NO: 5670553 - DNA, 20 bp, Homo sapiens
atccatgttagtttttactt

SEQ ID NO: 5670554 - DNA, 16 bp, Homo sapiens
atccatgtttgtaaaa

SEQ ID NO: 5670555 - DNA, 21 bp, Homo sapiens
atccattaaaaagttgttctt

SEQ ID NO: 5670556 - DNA, 15 bp, Homo sapiens
atccattacctccat

SEQ ID NO: 5670557 - DNA, 18 bp, Homo sapiens
atccattaggccagcaac

SEQ ID NO: 5670558 - DNA, 23 bp, Homo sapiens
atccattatgactgttgttctta

SEQ ID NO: 5670559 - DNA, 13 bp, Homo sapiens
atccattcacaag

SEQ ID NO: 5670560 - DNA, 16 bp, Homo sapiens
atccattccaaaatac

SEQ ID NO: 5670561 - DNA, 19 bp, Homo sapiens
atccattccaggtagctcg

SEQ ID NO: 5670562 - DNA, 13 bp, Homo sapiens
atccattcccaag

SEQ ID NO: 5670563 - DNA, 13 bp, Homo sapiens
atccattcctaat

SEQ ID NO: 5670564 - DNA, 22 bp, Homo sapiens
atccattcctcagggacagaga

SEQ ID NO: 5670565 - DNA, 19 bp, Homo sapiens
atccattctctctgcccaa

SEQ ID NO: 5670566 - DNA, 20 bp, Homo sapiens
atccattgaaagtgcttcaa

SEQ ID NO: 5670567 - DNA, 14 bp, Homo sapiens
atccattggagaag

SEQ ID NO: 5670568 - DNA, 15 bp, Homo sapiens
atccattgtctcttc

SEQ ID NO: 5670569 - DNA, 14 bp, Homo sapiens
atccattgtgttct

SEQ ID NO: 5670570 - DNA, 11 bp, Homo sapiens
atccattgttg

SEQ ID NO: 5670571 - DNA, 22 bp, Homo sapiens
atccatttaaaacaagctgata

SEQ ID NO: 5670572 - DNA, 14 bp, Homo sapiens
atccatttaaacta

SEQ ID NO: 5670573 - DNA, 14 bp, Homo sapiens
atccatttcaggac

SEQ ID NO: 5670574 - DNA, 17 bp, Homo sapiens
atccatttcaggactct

SEQ ID NO: 5670575 - DNA, 18 bp, Homo sapiens
atccatttcaggactctc

SEQ ID NO: 5670576 - DNA, 13 bp, Homo sapiens
atccatttcagtt

SEQ ID NO: 5670577 - DNA, 22 bp, Homo sapiens
atccatttcagtttgtttactt

SEQ ID NO: 5670578 - DNA, 20 bp, Homo sapiens
atccatttcatctatttctg

SEQ ID NO: 5670579 - DNA, 23 bp, Homo sapiens
atccatttcatctatttctgaga

SEQ ID NO: 5670580 - DNA, 16 bp, Homo sapiens
atccatttccattgct

SEQ ID NO: 5670581 - DNA, 13 bp, Homo sapiens
atccatttcccct

SEQ ID NO: 5670582 - DNA, 12 bp, Homo sapiens
atccatttctaa

SEQ ID NO: 5670583 - DNA, 23 bp, Homo sapiens
atccatttcttttactctgtgta

SEQ ID NO: 5670584 - DNA, 18 bp, Homo sapiens
atccatttgaacacatta

SEQ ID NO: 5670585 - DNA, 16 bp, Homo sapiens
atccatttgcctttct

SEQ ID NO: 5670586 - DNA, 23 bp, Homo sapiens
atccatttgcctttctgggagca

SEQ ID NO: 5670587 - DNA, 17 bp, Homo sapiens
atccatttggaaatctt

SEQ ID NO: 5670588 - DNA, 19 bp, Homo sapiens
atccatttggacaaaatgg

SEQ ID NO: 5670589 - DNA, 15 bp, Homo sapiens
atccatttggcagaa

SEQ ID NO: 5670590 - DNA, 22 bp, Homo sapiens
atccatttggcagaactgctgg

SEQ ID NO: 5670591 - DNA, 23 bp, Homo sapiens
atccatttggcagaactgctggg

SEQ ID NO: 5670592 - DNA, 15 bp, Homo sapiens
atccattttcactaa

SEQ ID NO: 5670593 - DNA, 12 bp, Homo sapiens
atccattttcta

SEQ ID NO: 5670594 - DNA, 15 bp, Homo sapiens
atccattttctaaac

SEQ ID NO: 5670595 - DNA, 21 bp, Homo sapiens
atccattttctaaactgtttt

SEQ ID NO: 5670596 - DNA, 22 bp, Homo sapiens
atccattttttatatttcaagt

SEQ ID NO: 5670597 - DNA, 19 bp, Homo sapiens
atcccaaacccttcagtgc

SEQ ID NO: 5670598 - DNA, 24 bp, Homo sapiens
atcccaaactgtgatgaagccgac

SEQ ID NO: 5670599 - DNA, 13 bp, Homo sapiens
atcccaaacttta

SEQ ID NO: 5670600 - DNA, 14 bp, Homo sapiens
atcccaaactttaa

SEQ ID NO: 5670601 - DNA, 15 bp, Homo sapiens
atcccaaactttaaa

SEQ ID NO: 5670602 - DNA, 18 bp, Homo sapiens
atcccaaactttaaaatg

SEQ ID NO: 5670603 - DNA, 15 bp, Homo sapiens
atcccaaagcaagga

SEQ ID NO: 5670604 - DNA, 22 bp, Homo sapiens
atcccaaagccttgtgtctaca

SEQ ID NO: 5670605 - DNA, 20 bp, Homo sapiens
atcccaaagttgttgtaacc

SEQ ID NO: 5670606 - DNA, 22 bp, Homo sapiens
atcccaaagttgttgtaacctg

SEQ ID NO: 5670607 - DNA, 17 bp, Homo sapiens
atcccaaatcctattta

SEQ ID NO: 5670608 - DNA, 11 bp, Homo sapiens
atcccaacact

SEQ ID NO: 5670609 - DNA, 16 bp, Homo sapiens
atcccaacactgccag

SEQ ID NO: 5670610 - DNA, 15 bp, Homo sapiens
atcccaacagccaag

SEQ ID NO: 5670611 - DNA, 19 bp, Homo sapiens
atcccaacatggtcctagc

SEQ ID NO: 5670612 - DNA, 17 bp, Homo sapiens
atcccaacattctgcaa

SEQ ID NO: 5670613 - DNA, 19 bp, Homo sapiens
atcccaaccagtgccaagg

SEQ ID NO: 5670614 - DNA, 20 bp, Homo sapiens
atcccaaccagtgccaagga

SEQ ID NO: 5670615 - DNA, 21 bp, Homo sapiens
atcccaaccagtgccaaggac

SEQ ID NO: 5670616 - DNA, 20 bp, Homo sapiens
atcccaacctggctccctcc

SEQ ID NO: 5670617 - DNA, 15 bp, Homo sapiens
atcccaactgtcttt

SEQ ID NO: 5670618 - DNA, 21 bp, Homo sapiens
atcccaagagattatgtaact

SEQ ID NO: 5670619 - DNA, 22 bp, Homo sapiens
atcccaagagattatgtaactc

SEQ ID NO: 5670620 - DNA, 15 bp, Homo sapiens
atcccaagatcattc

SEQ ID NO: 5670621 - DNA, 19 bp, Homo sapiens
atcccaagatctgtgcagc

SEQ ID NO: 5670622 - DNA, 15 bp, Homo sapiens
gtaccttcaaataat

SEQ ID NO: 5670623 - DNA, 22 bp, Homo sapiens
gtaccttccatacacagaggag

SEQ ID NO: 5670624 - DNA, 19 bp, Homo sapiens
gtaccttcccccagctttc

SEQ ID NO: 5670625 - DNA, 23 bp, Homo sapiens
gtaccttctcacctgtgagacca

SEQ ID NO: 5670626 - DNA, 14 bp, Homo sapiens
gtaccttgaacact

SEQ ID NO: 5670627 - DNA, 18 bp, Homo sapiens
gtaccttgaacactgggg

SEQ ID NO: 5670628 - DNA, 17 bp, Homo sapiens
gtaccttgcacacatca

SEQ ID NO: 5670629 - DNA, 14 bp, Homo sapiens
gtaccttgctgtgg

SEQ ID NO: 5670630 - DNA, 11 bp, Homo sapiens
gtaccttgctt

SEQ ID NO: 5670631 - DNA, 23 bp, Homo sapiens
gtaccttgcttcttactgataat

SEQ ID NO: 5670632 - DNA, 14 bp, Homo sapiens
gtacctttatgtta

SEQ ID NO: 5670633 - DNA, 17 bp, Homo sapiens
gtacctttcagaactca

SEQ ID NO: 5670634 - DNA, 15 bp, Homo sapiens
gtacctttccaccca

SEQ ID NO: 5670635 - DNA, 17 bp, Homo sapiens
gtacctttccacccaga

SEQ ID NO: 5670636 - DNA, 19 bp, Homo sapiens
gtacctttccacccagacc

SEQ ID NO: 5670637 - DNA, 22 bp, Homo sapiens
gtacctttccacccagaccctc

SEQ ID NO: 5670638 - DNA, 23 bp, Homo sapiens
gtacctttccacccagaccctcc

SEQ ID NO: 5670639 - DNA, 17 bp, Homo sapiens
gtacctttcctacattt

SEQ ID NO: 5670640 - DNA, 18 bp, Homo sapiens
gtacctttctagccttag

SEQ ID NO: 5670641 - DNA, 13 bp, Homo sapiens
gtaccttttaaca

SEQ ID NO: 5670642 - DNA, 15 bp, Homo sapiens
gtaccttttaatatg

SEQ ID NO: 5670643 - DNA, 19 bp, Homo sapiens
gtaccttttagtattagtt

SEQ ID NO: 5670644 - DNA, 23 bp, Homo sapiens
gtacgatcaagttgttgactgtg

SEQ ID NO: 5670645 - DNA, 21 bp, Homo sapiens
gtacgatggaggcctacctct

SEQ ID NO: 5670646 - DNA, 22 bp, Homo sapiens
gtacgatggaggcctacctctc

SEQ ID NO: 5670647 - DNA, 14 bp, Homo sapiens
gtacgattatactt

SEQ ID NO: 5670648 - DNA, 12 bp, Homo sapiens
gtacgcacagac

SEQ ID NO: 5670649 - DNA, 14 bp, Homo sapiens
gtacgcacagacag

SEQ ID NO: 5670650 - DNA, 16 bp, Homo sapiens
gtacgctgcgtgccat

SEQ ID NO: 5670651 - DNA, 17 bp, Homo sapiens
gtacggattttcagtta

SEQ ID NO: 5670652 - DNA, 20 bp, Homo sapiens
gtacggcaaccacatgtccc

SEQ ID NO: 5670653 - DNA, 15 bp, Homo sapiens
gtacgggaatgtgct

SEQ ID NO: 5670654 - DNA, 16 bp, Homo sapiens
gtacgggttgttttgg

SEQ ID NO: 5670655 - DNA, 20 bp, Homo sapiens
gtacgtagccacaggagccc

SEQ ID NO: 5670656 - DNA, 20 bp, Homo sapiens
gtacgtcccagcggcctcag

SEQ ID NO: 5670657 - DNA, 22 bp, Homo sapiens
gtacgtcccagcggcctcaggg

SEQ ID NO: 5670658 - DNA, 23 bp, Homo sapiens
gtacgtcccagcggcctcagggt

SEQ ID NO: 5670659 - DNA, 15 bp, Homo sapiens
gtacgtctgacaggc

SEQ ID NO: 5670660 - DNA, 13 bp, Homo sapiens
gtacgtgaccctc

SEQ ID NO: 5670661 - DNA, 20 bp, Homo sapiens
gtacgtggcacctcttccga

SEQ ID NO: 5670662 - DNA, 21 bp, Homo sapiens
gtacgtgttattattattata

SEQ ID NO: 5670663 - DNA, 15 bp, Homo sapiens
gtacgttatatattg

SEQ ID NO: 5670664 - DNA, 21 bp, Homo sapiens
gtacgttattgttgacttatt

SEQ ID NO: 5670665 - DNA, 14 bp, Homo sapiens
gtacgttgtgcatt

SEQ ID NO: 5670666 - DNA, 17 bp, Homo sapiens
gtacgtttgtatgtgtg

SEQ ID NO: 5670667 - DNA, 15 bp, Homo sapiens
gtactaaaaacactg

SEQ ID NO: 5670668 - DNA, 15 bp, Homo sapiens
gtactaaaagaaact

SEQ ID NO: 5670669 - DNA, 12 bp, Homo sapiens
gtactaaaatta

SEQ ID NO: 5670670 - DNA, 15 bp, Homo sapiens
gtactaaacatttcc

SEQ ID NO: 5670671 - DNA, 18 bp, Homo sapiens
gtactaaacatttccttt

SEQ ID NO: 5670672 - DNA, 23 bp, Homo sapiens
gtactaaacatttcctttttcta

SEQ ID NO: 5670673 - DNA, 17 bp, Homo sapiens
gtactaaatttaaattt

SEQ ID NO: 5670674 - DNA, 18 bp, Homo sapiens
gtactaacatttatttga

SEQ ID NO: 5670675 - DNA, 14 bp, Homo sapiens
gtactaagccagga

SEQ ID NO: 5670676 - DNA, 23 bp, Homo sapiens
gtactaaggaatctttctgcttt

SEQ ID NO: 5670677 - DNA, 14 bp, Homo sapiens
gtactaaggagaat

SEQ ID NO: 5670678 - DNA, 16 bp, Homo sapiens
gtactaaggagcatga

SEQ ID NO: 5670679 - DNA, 21 bp, Homo sapiens
gtactaatgaaatttacagtg

SEQ ID NO: 5670680 - DNA, 23 bp, Homo sapiens
gtactacacatttttaaattgtt

SEQ ID NO: 5670681 - DNA, 15 bp, Homo sapiens
gtactacatttgcat

SEQ ID NO: 5670682 - DNA, 16 bp, Homo sapiens
gtactacatttgcatg

SEQ ID NO: 5670683 - DNA, 22 bp, Homo sapiens
gtactaccccagaacgcatgca

SEQ ID NO: 5670684 - DNA, 14 bp, Homo sapiens
gtactaccccagga

SEQ ID NO: 5670685 - DNA, 18 bp, Homo sapiens
gtactaccccaggacgca

SEQ ID NO: 5670686 - DNA, 15 bp, Homo sapiens
gtactacctgtgtat

SEQ ID NO: 5670687 - DNA, 21 bp, Homo sapiens
gtactactagatgtctttagg

SEQ ID NO: 5670688 - DNA, 18 bp, Homo sapiens
gtactactgccttgtact

SEQ ID NO: 5670689 - DNA, 13 bp, Homo sapiens
gtactactgctgc

SEQ ID NO: 5670690 - DNA, 20 bp, Homo sapiens
gtactactgctgcaaagtgc

SEQ ID NO: 5670691 - DNA, 19 bp, Homo sapiens
gtactacttgtttcaaatg

SEQ ID NO: 5670692 - DNA, 19 bp, Homo sapiens
gtactagatgcatcactgg

SEQ ID NO: 5670693 - DNA, 13 bp, Homo sapiens
gtactagcaataa

SEQ ID NO: 5670694 - DNA, 22 bp, Homo sapiens
gtactaggatactgctgcgtca

SEQ ID NO: 5670695 - DNA, 13 bp, Homo sapiens
gtactagtactgt

SEQ ID NO: 5670696 - DNA, 17 bp, Homo sapiens
gtactagtactgtgtac

SEQ ID NO: 5670697 - DNA, 19 bp, Homo sapiens
gtactagtactgtgtactg

SEQ ID NO: 5670698 - DNA, 14 bp, Homo sapiens
gtactagtgtggtg

SEQ ID NO: 5670699 - DNA, 14 bp, Homo sapiens
gtactatctttgtc

SEQ ID NO: 5670700 - DNA, 17 bp, Homo sapiens
gtactatgatgggcttc

SEQ ID NO: 5670701 - DNA, 19 bp, Homo sapiens
gtactatggctgtattttt

SEQ ID NO: 5670702 - DNA, 22 bp, Homo sapiens
gtactatgtattaccagccccc

SEQ ID NO: 5670703 - DNA, 13 bp, Homo sapiens
gtactatgtctga

SEQ ID NO: 5670704 - DNA, 13 bp, Homo sapiens
gtactatgttaat

SEQ ID NO: 5670705 - DNA, 18 bp, Homo sapiens
gtactattcattcactct

SEQ ID NO: 5670706 - DNA, 13 bp, Homo sapiens
gtactattctgat

SEQ ID NO: 5670707 - DNA, 15 bp, Homo sapiens
gtactatttaactga

SEQ ID NO: 5670708 - DNA, 15 bp, Homo sapiens
gtactcaaatgtagc

SEQ ID NO: 5670709 - DNA, 22 bp, Homo sapiens
gtactcaatgtttctggacatt

SEQ ID NO: 5670710 - DNA, 17 bp, Homo sapiens
gtactcacatataacat

SEQ ID NO: 5670711 - DNA, 19 bp, Homo sapiens
gtactcacatataacatgc

SEQ ID NO: 5670712 - DNA, 16 bp, Homo sapiens
gtactcactgaagcct

SEQ ID NO: 5670713 - DNA, 14 bp, Homo sapiens
gtactcagagcaga

SEQ ID NO: 5670714 - DNA, 13 bp, Homo sapiens
gtactcaggagcc

SEQ ID NO: 5670715 - DNA, 17 bp, Homo sapiens
gtactcaggaggctgag

SEQ ID NO: 5670716 - DNA, 22 bp, Homo sapiens
gtactcagggcattctgttggc

SEQ ID NO: 5670717 - DNA, 18 bp, Homo sapiens
gtactcagtcagcccagt

SEQ ID NO: 5670718 - DNA, 21 bp, Homo sapiens
gtactcagtcagcccagtggg

SEQ ID NO: 5670719 - DNA, 13 bp, Homo sapiens
gtactcagtggac

SEQ ID NO: 5670720 - DNA, 20 bp, Homo sapiens
gtactcataaaggacactgg

SEQ ID NO: 5670721 - DNA, 23 bp, Homo sapiens
gtactccagccagggcaagagag

SEQ ID NO: 5670722 - DNA, 13 bp, Homo sapiens
gtactccagcctg

SEQ ID NO: 5670723 - DNA, 14 bp, Homo sapiens
gtactcccaaactg

SEQ ID NO: 5670724 - DNA, 17 bp, Homo sapiens
gtactcccccagccctc

SEQ ID NO: 5670725 - DNA, 16 bp, Homo sapiens
gtactcctcacttttc

SEQ ID NO: 5670726 - DNA, 16 bp, Homo sapiens
gtactcctgcaaaatt

SEQ ID NO: 5670727 - DNA, 15 bp, Homo sapiens
gtactcgttggatgt

SEQ ID NO: 5670728 - DNA, 16 bp, Homo sapiens
gtactctaggacttca

SEQ ID NO: 5670729 - DNA, 17 bp, Homo sapiens
gtactctaggacttcaa

SEQ ID NO: 5670730 - DNA, 21 bp, Homo sapiens
gtactctcatcactacagtat

SEQ ID NO: 5670731 - DNA, 15 bp, Homo sapiens
gtactctcctagaga

SEQ ID NO: 5670732 - DNA, 19 bp, Homo sapiens
gtactctctgctctagcca

SEQ ID NO: 5670733 - DNA, 21 bp, Homo sapiens
gtactctctgctctagccagg

SEQ ID NO: 5670734 - DNA, 15 bp, Homo sapiens
gtactctgagtcctc

SEQ ID NO: 5670735 - DNA, 19 bp, Homo sapiens
gtactctgagtcctcattg

SEQ ID NO: 5670736 - DNA, 16 bp, Homo sapiens
gtactctgcacatacg

SEQ ID NO: 5670737 - DNA, 13 bp, Homo sapiens
gtactctggcctc

SEQ ID NO: 5670738 - DNA, 15 bp, Homo sapiens
gtactctggcctctg

SEQ ID NO: 5670739 - DNA, 15 bp, Homo sapiens
gtactcttatatttt

SEQ ID NO: 5670740 - DNA, 20 bp, Homo sapiens
gtactcttatatttttctgg

SEQ ID NO: 5670741 - DNA, 18 bp, Homo sapiens
gtactcttgatgtgaaga

SEQ ID NO: 5670742 - DNA, 14 bp, Homo sapiens
gtactcttgctgat

SEQ ID NO: 5670743 - DNA, 14 bp, Homo sapiens
gtactgaagaacag

SEQ ID NO: 5670744 - DNA, 15 bp, Homo sapiens
gtactgaagaacagt

SEQ ID NO: 5670745 - DNA, 17 bp, Homo sapiens
gtactgaaggcttctgc

SEQ ID NO: 5670746 - DNA, 12 bp, Homo sapiens
gtactgaatttt

SEQ ID NO: 5670747 - DNA, 14 bp, Homo sapiens
gtactgaatttttt

SEQ ID NO: 5670748 - DNA, 20 bp, Homo sapiens
gtactgaatttttttgtaat

SEQ ID NO: 5670749 - DNA, 15 bp, Homo sapiens
gtactgacccaggac

SEQ ID NO: 5670750 - DNA, 14 bp, Homo sapiens
gtactgactttgct

SEQ ID NO: 5670751 - DNA, 20 bp, Homo sapiens
gtactgactttgcttgcttt

SEQ ID NO: 5670752 - DNA, 21 bp, Homo sapiens
gtactgagaggaggggtaaat

SEQ ID NO: 5670753 - DNA, 23 bp, Homo sapiens
gtactgagaggaggggtaaatat

SEQ ID NO: 5670754 - DNA, 14 bp, Homo sapiens
gtactgagcactga

SEQ ID NO: 5670755 - DNA, 17 bp, Homo sapiens
gtactgagcagtgatat

SEQ ID NO: 5670756 - DNA, 16 bp, Homo sapiens
gtactgagccttgtaa

SEQ ID NO: 5670757 - DNA, 17 bp, Homo sapiens
gtactgagttctcatcc

SEQ ID NO: 5670758 - DNA, 14 bp, Homo sapiens
gtactgataaaata

SEQ ID NO: 5670759 - DNA, 15 bp, Homo sapiens
gtactgatactattc

SEQ ID NO: 5670760 - DNA, 21 bp, Homo sapiens
gtactgatactattcaatgca

SEQ ID NO: 5670761 - DNA, 15 bp, Homo sapiens
gtactgattcaattt

SEQ ID NO: 5670762 - DNA, 22 bp, Homo sapiens
gtactgcatcttagtttactgg

SEQ ID NO: 5670763 - DNA, 15 bp, Homo sapiens
gtactgcattatttg

SEQ ID NO: 5670764 - DNA, 22 bp, Homo sapiens
gtactgcattctctcccatcct

SEQ ID NO: 5670765 - DNA, 22 bp, Homo sapiens
gtactgcatttgccccttgagc

SEQ ID NO: 5670766 - DNA, 21 bp, Homo sapiens
gtactgcccaaataggaggaa

SEQ ID NO: 5670767 - DNA, 11 bp, Homo sapiens
gtactgcctgc

SEQ ID NO: 5670768 - DNA, 17 bp, Homo sapiens
gtactgctcaggctgca

SEQ ID NO: 5670769 - DNA, 23 bp, Homo sapiens
gtactgctcaggctgcagctgga

SEQ ID NO: 5670770 - DNA, 15 bp, Homo sapiens
gtactggagcctgca

SEQ ID NO: 5670771 - DNA, 14 bp, Homo sapiens
gtactggatttaac

SEQ ID NO: 5670772 - DNA, 20 bp, Homo sapiens
gtactggctctttattcatt

SEQ ID NO: 5670773 - DNA, 23 bp, Homo sapiens
gtactgggaatggaaggctttgc

SEQ ID NO: 5670774 - DNA, 18 bp, Homo sapiens
gtactgggagaatcacta

SEQ ID NO: 5670775 - DNA, 21 bp, Homo sapiens
gtactgggggttgcgggggga

SEQ ID NO: 5670776 - DNA, 13 bp, Homo sapiens
gtactggtccctt

SEQ ID NO: 5670777 - DNA, 19 bp, Homo sapiens
gtactggttactttcaaaa

SEQ ID NO: 5670778 - DNA, 18 bp, Homo sapiens
gtactggttagattcatt

SEQ ID NO: 5670779 - DNA, 16 bp, Homo sapiens
gtactgtaaagagacc

SEQ ID NO: 5670780 - DNA, 16 bp, Homo sapiens
gtactgtaactgctca

SEQ ID NO: 5670781 - DNA, 19 bp, Homo sapiens
gtactgtaactgctcagag

SEQ ID NO: 5670782 - DNA, 23 bp, Homo sapiens
gtactgtaactgctcagagcttt

SEQ ID NO: 5670783 - DNA, 12 bp, Homo sapiens
gtactgtaataa

SEQ ID NO: 5670784 - DNA, 13 bp, Homo sapiens
gtactgtaataat

SEQ ID NO: 5670785 - DNA, 14 bp, Homo sapiens
gtactgtacataaa

SEQ ID NO: 5670786 - DNA, 22 bp, Homo sapiens
gtactgtacataaattccagag

SEQ ID NO: 5670787 - DNA, 16 bp, Homo sapiens
gtactgtactttccca

SEQ ID NO: 5670788 - DNA, 22 bp, Homo sapiens
gtactgtactttcccaggttga

SEQ ID NO: 5670789 - DNA, 16 bp, Homo sapiens
gtactgtatagacagt

SEQ ID NO: 5670790 - DNA, 18 bp, Homo sapiens
gtactgtatagacagttt

SEQ ID NO: 5670791 - DNA, 14 bp, Homo sapiens
gtactgtatgatca

SEQ ID NO: 5670792 - DNA, 23 bp, Homo sapiens
gtactgtatgatcaaatgtttaa

SEQ ID NO: 5670793 - DNA, 16 bp, Homo sapiens
gtactgtattgggctt

SEQ ID NO: 5670794 - DNA, 13 bp, Homo sapiens
gtactgtctgtgt

SEQ ID NO: 5670795 - DNA, 11 bp, Homo sapiens
gtactgtgctg

SEQ ID NO: 5670796 - DNA, 22 bp, Homo sapiens
gtactgtgctgattcaataaaa

SEQ ID NO: 5670797 - DNA, 16 bp, Homo sapiens
gtactgtgggcaattt

SEQ ID NO: 5670798 - DNA, 21 bp, Homo sapiens
gtactgtgggcaatttagaaa

SEQ ID NO: 5670799 - DNA, 22 bp, Homo sapiens
gtactgtgggcaatttagaaaa

SEQ ID NO: 5670800 - DNA, 22 bp, Homo sapiens
gtaggcatcagtatgtcactct

SEQ ID NO: 5670801 - DNA, 17 bp, Homo sapiens
gtaggcatgagggatca

SEQ ID NO: 5670802 - DNA, 20 bp, Homo sapiens
gtaggcatgagggatcacag

SEQ ID NO: 5670803 - DNA, 22 bp, Homo sapiens
gtaggcatgagggatcacaggg

SEQ ID NO: 5670804 - DNA, 13 bp, Homo sapiens
gtaggcattcttt

SEQ ID NO: 5670805 - DNA, 14 bp, Homo sapiens
gtaggcatttccta

SEQ ID NO: 5670806 - DNA, 16 bp, Homo sapiens
gtaggccaagctgaag

SEQ ID NO: 5670807 - DNA, 17 bp, Homo sapiens
gtaggcccttgtcctgc

SEQ ID NO: 5670808 - DNA, 19 bp, Homo sapiens
gtaggcccttgtcctgcca

SEQ ID NO: 5670809 - DNA, 19 bp, Homo sapiens
gtaggccttttaacatttt

SEQ ID NO: 5670810 - DNA, 20 bp, Homo sapiens
gtaggcgcccctggggtggg

SEQ ID NO: 5670811 - DNA, 19 bp, Homo sapiens
gtaggctcaactagggagt

SEQ ID NO: 5670812 - DNA, 16 bp, Homo sapiens
gtaggctgctccctga

SEQ ID NO: 5670813 - DNA, 20 bp, Homo sapiens
gtaggctgctccctgagggc

SEQ ID NO: 5670814 - DNA, 16 bp, Homo sapiens
gtaggctgctggcgcc

SEQ ID NO: 5670815 - DNA, 14 bp, Homo sapiens
gtaggctggggcgg

SEQ ID NO: 5670816 - DNA, 24 bp, Homo sapiens
gtaggctggtccctatgtcatgtc

SEQ ID NO: 5670817 - DNA, 19 bp, Homo sapiens
gtaggctgtattttctttt

SEQ ID NO: 5670818 - DNA, 15 bp, Homo sapiens
gtaggctgtctgtgc

SEQ ID NO: 5670819 - DNA, 12 bp, Homo sapiens
gtaggctgttcc

SEQ ID NO: 5670820 - DNA, 17 bp, Homo sapiens
gtaggctttacttagct

SEQ ID NO: 5670821 - DNA, 20 bp, Homo sapiens
gtagggaaaccttggagagg

SEQ ID NO: 5670822 - DNA, 13 bp, Homo sapiens
gtagggaataaaa

SEQ ID NO: 5670823 - DNA, 12 bp, Homo sapiens
gtagggagcctc

SEQ ID NO: 5670824 - DNA, 16 bp, Homo sapiens
gtagggagctaaggaa

SEQ ID NO: 5670825 - DNA, 20 bp, Homo sapiens
gtagggagctcactcccact

SEQ ID NO: 5670826 - DNA, 15 bp, Homo sapiens
gtagggaggcagcct

SEQ ID NO: 5670827 - DNA, 16 bp, Homo sapiens
gtagggaggcagcctc

SEQ ID NO: 5670828 - DNA, 18 bp, Homo sapiens
gtagggagtacctgctgc

SEQ ID NO: 5670829 - DNA, 21 bp, Homo sapiens
gtagggagtacctgctgcccc

SEQ ID NO: 5670830 - DNA, 15 bp, Homo sapiens
gtagggagttgtggg

SEQ ID NO: 5670831 - DNA, 20 bp, Homo sapiens
gtagggatatggcaggactc

SEQ ID NO: 5670832 - DNA, 23 bp, Homo sapiens
gtagggatatggcaggactcctg

SEQ ID NO: 5670833 - DNA, 20 bp, Homo sapiens
gtagggatgcggatcctgct

SEQ ID NO: 5670834 - DNA, 23 bp, Homo sapiens
gtagggatgcggatcctgctggg

SEQ ID NO: 5670835 - DNA, 22 bp, Homo sapiens
gtagggcagacatgccttggtg

SEQ ID NO: 5670836 - DNA, 12 bp, Homo sapiens
gtagggccaggg

SEQ ID NO: 5670837 - DNA, 21 bp, Homo sapiens
gtagggccctgacaggccttc

SEQ ID NO: 5670838 - DNA, 21 bp, Homo sapiens
gtagggcgggaggatgttctg

SEQ ID NO: 5670839 - DNA, 21 bp, Homo sapiens
gtagggctgccaccaaggtga

SEQ ID NO: 5670840 - DNA, 10 bp, Homo sapiens
gtagggctgg

SEQ ID NO: 5670841 - DNA, 19 bp, Homo sapiens
gtagggctggctggaggaa

SEQ ID NO: 5670842 - DNA, 13 bp, Homo sapiens
gtaggggaagaat

SEQ ID NO: 5670843 - DNA, 19 bp, Homo sapiens
gtaggggaagtgtgctgag

SEQ ID NO: 5670844 - DNA, 22 bp, Homo sapiens
gtaggggagccacatttacata

SEQ ID NO: 5670845 - DNA, 16 bp, Homo sapiens
gtaggggagggcaggc

SEQ ID NO: 5670846 - DNA, 18 bp, Homo sapiens
gtaggggagggcaggctt

SEQ ID NO: 5670847 - DNA, 21 bp, Homo sapiens
gtaggggagggcaggcttggg

SEQ ID NO: 5670848 - DNA, 16 bp, Homo sapiens
gtaggggcagggaggc

SEQ ID NO: 5670849 - DNA, 16 bp, Homo sapiens
gtaggggccgtgtccc

SEQ ID NO: 5670850 - DNA, 15 bp, Homo sapiens
gtaggggctcctgag

SEQ ID NO: 5670851 - DNA, 14 bp, Homo sapiens
gtagggggccttgc

SEQ ID NO: 5670852 - DNA, 16 bp, Homo sapiens
gtagggggctggagga

SEQ ID NO: 5670853 - DNA, 19 bp, Homo sapiens
gtagggggctggaggagcc

SEQ ID NO: 5670854 - DNA, 21 bp, Homo sapiens
gtagggggctggaggagccca

SEQ ID NO: 5670855 - DNA, 20 bp, Homo sapiens
gtaggggtcaaagaaatgct

SEQ ID NO: 5670856 - DNA, 17 bp, Homo sapiens
gtagggtggcactggga

SEQ ID NO: 5670857 - DNA, 13 bp, Homo sapiens
gtagggtgttctg

SEQ ID NO: 5670858 - DNA, 23 bp, Homo sapiens
gtagggtttaatccccagtaaaa

SEQ ID NO: 5670859 - DNA, 23 bp, Homo sapiens
gtaggtatgatctcttctggtgt

SEQ ID NO: 5670860 - DNA, 18 bp, Homo sapiens
gtaggtatgtctgtgcca

SEQ ID NO: 5670861 - DNA, 22 bp, Homo sapiens
gtaggtcacaacaactcatttt

SEQ ID NO: 5670862 - DNA, 19 bp, Homo sapiens
gtaggtcactctccagcag

SEQ ID NO: 5670863 - DNA, 17 bp, Homo sapiens
gtaggtcagatatttga

SEQ ID NO: 5670864 - DNA, 17 bp, Homo sapiens
gtaggtcccggccagct

SEQ ID NO: 5670865 - DNA, 16 bp, Homo sapiens
gtaggtctatgatgtc

SEQ ID NO: 5670866 - DNA, 16 bp, Homo sapiens
gtaggtctgaaggcct

SEQ ID NO: 5670867 - DNA, 23 bp, Homo sapiens
gtaggtgaacagtcacgcctgaa

SEQ ID NO: 5670868 - DNA, 13 bp, Homo sapiens
gtaggtgagcctg

SEQ ID NO: 5670869 - DNA, 15 bp, Homo sapiens
gtaggtgagcctggg

SEQ ID NO: 5670870 - DNA, 23 bp, Homo sapiens
gtaggtgatgtttccagctgcca

SEQ ID NO: 5670871 - DNA, 14 bp, Homo sapiens
gtaggtgctggcct

SEQ ID NO: 5670872 - DNA, 17 bp, Homo sapiens
gtaggtgggtaggagcc

SEQ ID NO: 5670873 - DNA, 14 bp, Homo sapiens
gtaggtgtctctgg

SEQ ID NO: 5670874 - DNA, 16 bp, Homo sapiens
gtaggtgtctctgggc

SEQ ID NO: 5670875 - DNA, 19 bp, Homo sapiens
gtaggtgtctctgggcctg

SEQ ID NO: 5670876 - DNA, 21 bp, Homo sapiens
gtaggtgtctctgggcctgtg

SEQ ID NO: 5670877 - DNA, 23 bp, Homo sapiens
gtaggtgtctctgggcctgtgtg

SEQ ID NO: 5670878 - DNA, 20 bp, Homo sapiens
gtaggtgtctgccttcacaa

SEQ ID NO: 5670879 - DNA, 20 bp, Homo sapiens
gtaggttattttatatttga

SEQ ID NO: 5670880 - DNA, 15 bp, Homo sapiens
gtaggttcagccaag

SEQ ID NO: 5670881 - DNA, 17 bp, Homo sapiens
gtaggttcagccaaggt

SEQ ID NO: 5670882 - DNA, 14 bp, Homo sapiens
gtaggttgcacact

SEQ ID NO: 5670883 - DNA, 18 bp, Homo sapiens
gtaggttgcacactttgg

SEQ ID NO: 5670884 - DNA, 19 bp, Homo sapiens
gtaggttgcacactttggt

SEQ ID NO: 5670885 - DNA, 19 bp, Homo sapiens
gtaggttgggacaccaggg

SEQ ID NO: 5670886 - DNA, 14 bp, Homo sapiens
gtaggttgggagaa

SEQ ID NO: 5670887 - DNA, 14 bp, Homo sapiens
gtaggttgtctaaa

SEQ ID NO: 5670888 - DNA, 21 bp, Homo sapiens
gtaggtttctctgcctccagg

SEQ ID NO: 5670889 - DNA, 14 bp, Homo sapiens
gtaggtttgtagta

SEQ ID NO: 5670890 - DNA, 17 bp, Homo sapiens
gtaggttttaaaaataa

SEQ ID NO: 5670891 - DNA, 23 bp, Homo sapiens
gtaggttttaaaaataagtttta

SEQ ID NO: 5670892 - DNA, 13 bp, Homo sapiens
gtagtaaaagtgg

SEQ ID NO: 5670893 - DNA, 18 bp, Homo sapiens
gtagtaaaattagaaaaa

SEQ ID NO: 5670894 - DNA, 18 bp, Homo sapiens
gtagtaaactattcttaa

SEQ ID NO: 5670895 - DNA, 17 bp, Homo sapiens
gtagtaaataatgcttt

SEQ ID NO: 5670896 - DNA, 21 bp, Homo sapiens
gtagtaaataatgctttgaaa

SEQ ID NO: 5670897 - DNA, 16 bp, Homo sapiens
gtagtaacacataaag

SEQ ID NO: 5670898 - DNA, 15 bp, Homo sapiens
gtagtaacactaata

SEQ ID NO: 5670899 - DNA, 22 bp, Homo sapiens
gtagtaacactgtgatttatct

SEQ ID NO: 5670900 - DNA, 22 bp, Homo sapiens
gtagtaataaaaagtaacacac

SEQ ID NO: 5670901 - DNA, 24 bp, Homo sapiens
gtagtaatttattgtctgtctaca

SEQ ID NO: 5670902 - DNA, 19 bp, Homo sapiens
gtagtaccaaatgctttaa

SEQ ID NO: 5670903 - DNA, 19 bp, Homo sapiens
gtagtactccttaagaaca

SEQ ID NO: 5670904 - DNA, 13 bp, Homo sapiens
gtagtactgattt

SEQ ID NO: 5670905 - DNA, 17 bp, Homo sapiens
gtagtacttcttctgta

SEQ ID NO: 5670906 - DNA, 22 bp, Homo sapiens
gtagtacttcttctgtaatatt

SEQ ID NO: 5670907 - DNA, 18 bp, Homo sapiens
gtagtagaatctcagcac

SEQ ID NO: 5670908 - DNA, 17 bp, Homo sapiens
gtagtagccctttctgt

SEQ ID NO: 5670909 - DNA, 20 bp, Homo sapiens
gtagtagccctttctgtgtg

SEQ ID NO: 5670910 - DNA, 22 bp, Homo sapiens
gtagtagcgttttttaaatgta

SEQ ID NO: 5670911 - DNA, 18 bp, Homo sapiens
gtagtagctcgtgtgctt

SEQ ID NO: 5670912 - DNA, 16 bp, Homo sapiens
gtagtaggcattttta

SEQ ID NO: 5670913 - DNA, 16 bp, Homo sapiens
gtagtataaagaaaag

SEQ ID NO: 5670914 - DNA, 18 bp, Homo sapiens
gtagtataatttcaagga

SEQ ID NO: 5670915 - DNA, 13 bp, Homo sapiens
gtagtatgatggg

SEQ ID NO: 5670916 - DNA, 13 bp, Homo sapiens
gtagtatggcact

SEQ ID NO: 5670917 - DNA, 17 bp, Homo sapiens
gtagtatggcctgtgtc

SEQ ID NO: 5670918 - DNA, 22 bp, Homo sapiens
gtagtattaaaagttgcatttg

SEQ ID NO: 5670919 - DNA, 15 bp, Homo sapiens
gtagtattcttccct

SEQ ID NO: 5670920 - DNA, 17 bp, Homo sapiens
gtagtatttatatttaa

SEQ ID NO: 5670921 - DNA, 19 bp, Homo sapiens
gtagtatttgcctatttcc

SEQ ID NO: 5670922 - DNA, 20 bp, Homo sapiens
gtagtattttttgtataatt

SEQ ID NO: 5670923 - DNA, 20 bp, Homo sapiens
gtagtcaaaaacaaagctga

SEQ ID NO: 5670924 - DNA, 16 bp, Homo sapiens
gtagtcacaaactgat

SEQ ID NO: 5670925 - DNA, 15 bp, Homo sapiens
gtagtcaggtgctca

SEQ ID NO: 5670926 - DNA, 12 bp, Homo sapiens
gtagtcataata

SEQ ID NO: 5670927 - DNA, 21 bp, Homo sapiens
gtagtcattcttacaattgca

SEQ ID NO: 5670928 - DNA, 13 bp, Homo sapiens
gtagtccaccttc

SEQ ID NO: 5670929 - DNA, 15 bp, Homo sapiens
gtagtcccagcactt

SEQ ID NO: 5670930 - DNA, 16 bp, Homo sapiens
gtagtcccagcacttt

SEQ ID NO: 5670931 - DNA, 12 bp, Homo sapiens
gtagtcccagct

SEQ ID NO: 5670932 - DNA, 15 bp, Homo sapiens
gtagtcctcccaagc

SEQ ID NO: 5670933 - DNA, 22 bp, Homo sapiens
gtagtcctcccaagctgtgctg

SEQ ID NO: 5670934 - DNA, 12 bp, Homo sapiens
gtagtcctgtga

SEQ ID NO: 5670935 - DNA, 14 bp, Homo sapiens
gtagtccttggcat

SEQ ID NO: 5670936 - DNA, 21 bp, Homo sapiens
gtagtccttggcatagacatg

SEQ ID NO: 5670937 - DNA, 16 bp, Homo sapiens
gtagtcctttctgcct

SEQ ID NO: 5670938 - DNA, 19 bp, Homo sapiens
gtagtcctttctgccttgg

SEQ ID NO: 5670939 - DNA, 20 bp, Homo sapiens
gtagtcctttctgccttggc

SEQ ID NO: 5670940 - DNA, 13 bp, Homo sapiens
gtagtctcagcta

SEQ ID NO: 5670941 - DNA, 17 bp, Homo sapiens
gtagtctctctagtagt

SEQ ID NO: 5670942 - DNA, 14 bp, Homo sapiens
gtagtcttatgaat

SEQ ID NO: 5670943 - DNA, 16 bp, Homo sapiens
gtagtcttatgaatag

SEQ ID NO: 5670944 - DNA, 12 bp, Homo sapiens
gtagtcttgatg

SEQ ID NO: 5670945 - DNA, 22 bp, Homo sapiens
gtagtcttgtcttagctctgga

SEQ ID NO: 5670946 - DNA, 22 bp, Homo sapiens
gtagtgaaataatagaatgagc

SEQ ID NO: 5670947 - DNA, 12 bp, Homo sapiens
gtagtgaccaat

SEQ ID NO: 5670948 - DNA, 23 bp, Homo sapiens
gtagtgaccaatcgggagtagca

SEQ ID NO: 5670949 - DNA, 14 bp, Homo sapiens
gtagtgagatagca

SEQ ID NO: 5670950 - DNA, 16 bp, Homo sapiens
gtagtgagcgagtgga

SEQ ID NO: 5670951 - DNA, 22 bp, Homo sapiens
gtagtgatggagttccttctgg

SEQ ID NO: 5670952 - DNA, 19 bp, Homo sapiens
gtagtgatgttgtttggga

SEQ ID NO: 5670953 - DNA, 15 bp, Homo sapiens
gtagtgcaaaatggt

SEQ ID NO: 5670954 - DNA, 11 bp, Homo sapiens
gtagtgcagtc

SEQ ID NO: 5670955 - DNA, 16 bp, Homo sapiens
gtagtgccatggccag

SEQ ID NO: 5670956 - DNA, 23 bp, Homo sapiens
gtagtgcccctcccatggcccag

SEQ ID NO: 5670957 - DNA, 23 bp, Homo sapiens
gtagtgctacagggtccaacata

SEQ ID NO: 5670958 - DNA, 16 bp, Homo sapiens
gtagtgcttattgttt

SEQ ID NO: 5670959 - DNA, 23 bp, Homo sapiens
gtagtgctttaagaatgaacaca

SEQ ID NO: 5670960 - DNA, 17 bp, Homo sapiens
gtagtggaaatgagtga

SEQ ID NO: 5670961 - DNA, 15 bp, Homo sapiens
gtagtggaagagcag

SEQ ID NO: 5670962 - DNA, 20 bp, Homo sapiens
gtagtggaagagcagcctga

SEQ ID NO: 5670963 - DNA, 16 bp, Homo sapiens
gtagtggagagcgggt

SEQ ID NO: 5670964 - DNA, 19 bp, Homo sapiens
gtagtggcaaagagaggtc

SEQ ID NO: 5670965 - DNA, 11 bp, Homo sapiens
gtagtggccac

SEQ ID NO: 5670966 - DNA, 15 bp, Homo sapiens
gtagtgtagctgtgt

SEQ ID NO: 5670967 - DNA, 17 bp, Homo sapiens
gtagtgtagtcaggtgc

SEQ ID NO: 5670968 - DNA, 20 bp, Homo sapiens
gtagtgtagtcaggtgctca

SEQ ID NO: 5670969 - DNA, 19 bp, Homo sapiens
gtagtgtccattttgtgaa

SEQ ID NO: 5670970 - DNA, 20 bp, Homo sapiens
gtagtgtccattttgtgaag

SEQ ID NO: 5670971 - DNA, 12 bp, Homo sapiens
gtagtgtcccca

SEQ ID NO: 5670972 - DNA, 19 bp, Homo sapiens
gtagtgtgtcagctctgtt

SEQ ID NO: 5670973 - DNA, 15 bp, Homo sapiens
gtagtgtgttgataa

SEQ ID NO: 5670974 - DNA, 18 bp, Homo sapiens
gtagtgtgttttcataac

SEQ ID NO: 5670975 - DNA, 17 bp, Homo sapiens
gtagtgttggagaagaa

SEQ ID NO: 5670976 - DNA, 20 bp, Homo sapiens
gtagtgttggagaagaactg

SEQ ID NO: 5670977 - DNA, 20 bp, Homo sapiens
tccagtcgttatttctgttt

SEQ ID NO: 5670978 - DNA, 21 bp, Homo sapiens
tccagtctcatctatgtcata

SEQ ID NO: 5670979 - DNA, 14 bp, Homo sapiens
tccagtctcttgta

SEQ ID NO: 5670980 - DNA, 16 bp, Homo sapiens
tccagtctcttgtaca

SEQ ID NO: 5670981 - DNA, 22 bp, Homo sapiens
tccagtctcttgtacagcgttt

SEQ ID NO: 5670982 - DNA, 20 bp, Homo sapiens
tccagtctgaagtgcctact

SEQ ID NO: 5670983 - DNA, 14 bp, Homo sapiens
tccagtctgcagac

SEQ ID NO: 5670984 - DNA, 18 bp, Homo sapiens
tccagtctgctgccctcc

SEQ ID NO: 5670985 - DNA, 13 bp, Homo sapiens
tccagtctgtgat

SEQ ID NO: 5670986 - DNA, 14 bp, Homo sapiens
tccagtctgttctc

SEQ ID NO: 5670987 - DNA, 19 bp, Homo sapiens
tccagtcttccacctggaa

SEQ ID NO: 5670988 - DNA, 21 bp, Homo sapiens
tccagtcttcctgacacttta

SEQ ID NO: 5670989 - DNA, 18 bp, Homo sapiens
tccagtgaacattcccag

SEQ ID NO: 5670990 - DNA, 23 bp, Homo sapiens
tccagtgaatagatgtgcccttt

SEQ ID NO: 5670991 - DNA, 20 bp, Homo sapiens
tccagtgacaaaccatccag

SEQ ID NO: 5670992 - DNA, 19 bp, Homo sapiens
tccagtgacatgattctga

SEQ ID NO: 5670993 - DNA, 15 bp, Homo sapiens
tccagtgaccctgga

SEQ ID NO: 5670994 - DNA, 17 bp, Homo sapiens
tccagtgacctctctct

SEQ ID NO: 5670995 - DNA, 18 bp, Homo sapiens
tccagtgacttgttctga

SEQ ID NO: 5670996 - DNA, 17 bp, Homo sapiens
tccagtgagatagaata

SEQ ID NO: 5670997 - DNA, 18 bp, Homo sapiens
tccagtgagcttatcatg

SEQ ID NO: 5670998 - DNA, 12 bp, Homo sapiens
tccagtgaggaa

SEQ ID NO: 5670999 - DNA, 16 bp, Homo sapiens
tccagtgaggaaatgg

SEQ ID NO: 5671000 - DNA, 22 bp, Homo sapiens
tccagtgaggcatctctctggg

SEQ ID NO: 5671001 - DNA, 20 bp, Homo sapiens
tccagtgagtgtaaataatt

SEQ ID NO: 5671002 - DNA, 21 bp, Homo sapiens
tccagtgagtgtaaataattt

SEQ ID NO: 5671003 - DNA, 17 bp, Homo sapiens
tccagtgatgtgctgga

SEQ ID NO: 5671004 - DNA, 18 bp, Homo sapiens
tccagtgatgtgctggag

SEQ ID NO: 5671005 - DNA, 19 bp, Homo sapiens
tccagtgatgtgctggagc

SEQ ID NO: 5671006 - DNA, 22 bp, Homo sapiens
tccagtgatgtgctggagctgg

SEQ ID NO: 5671007 - DNA, 15 bp, Homo sapiens
tccagtgcaacaaaa

SEQ ID NO: 5671008 - DNA, 11 bp, Homo sapiens
tccagtgcagt

SEQ ID NO: 5671009 - DNA, 12 bp, Homo sapiens
tccagtgcagtc

SEQ ID NO: 5671010 - DNA, 12 bp, Homo sapiens
tccagtgcatgt

SEQ ID NO: 5671011 - DNA, 15 bp, Homo sapiens
tccagtgcatgttgc

SEQ ID NO: 5671012 - DNA, 22 bp, Homo sapiens
tccagtgcattttgtttctgta

SEQ ID NO: 5671013 - DNA, 17 bp, Homo sapiens
tccagtgccagcaatga

SEQ ID NO: 5671014 - DNA, 20 bp, Homo sapiens
tccagtgcccattcctcacc

SEQ ID NO: 5671015 - DNA, 13 bp, Homo sapiens
tccagtgcctaca

SEQ ID NO: 5671016 - DNA, 18 bp, Homo sapiens
tccagtgctcagctgtgg

SEQ ID NO: 5671017 - DNA, 20 bp, Homo sapiens
tccagtgctcagctgtggct

SEQ ID NO: 5671018 - DNA, 21 bp, Homo sapiens
tccagtgctcagctgtggctg

SEQ ID NO: 5671019 - DNA, 15 bp, Homo sapiens
tccagtgctggattt

SEQ ID NO: 5671020 - DNA, 15 bp, Homo sapiens
tccagtgctggctgc

SEQ ID NO: 5671021 - DNA, 17 bp, Homo sapiens
tccagtgcttccacaga

SEQ ID NO: 5671022 - DNA, 17 bp, Homo sapiens
tccagtgcttggctgcc

SEQ ID NO: 5671023 - DNA, 18 bp, Homo sapiens
tccagtgcttggctgccc

SEQ ID NO: 5671024 - DNA, 19 bp, Homo sapiens
tccagtgcttggctgcccc

SEQ ID NO: 5671025 - DNA, 20 bp, Homo sapiens
tccagtgcttggctgcccca

SEQ ID NO: 5671026 - DNA, 21 bp, Homo sapiens
tccagtgcttggctgccccac

SEQ ID NO: 5671027 - DNA, 16 bp, Homo sapiens
tccagtgctttatcca

SEQ ID NO: 5671028 - DNA, 19 bp, Homo sapiens
tccagtggaagaagaaaac

SEQ ID NO: 5671029 - DNA, 15 bp, Homo sapiens
tccagtggaccctgg

SEQ ID NO: 5671030 - DNA, 15 bp, Homo sapiens
tccagtggactctgg

SEQ ID NO: 5671031 - DNA, 23 bp, Homo sapiens
tccagtggacttcgcagtccact

SEQ ID NO: 5671032 - DNA, 13 bp, Homo sapiens
tccagtggatgag

SEQ ID NO: 5671033 - DNA, 20 bp, Homo sapiens
tccagtggcagacaaacaga

SEQ ID NO: 5671034 - DNA, 17 bp, Homo sapiens
tccagtggcctggctcc

SEQ ID NO: 5671035 - DNA, 23 bp, Homo sapiens
tccagtggctcgctccctgtagc

SEQ ID NO: 5671036 - DNA, 22 bp, Homo sapiens
tccagtgggaggacagagccgg

SEQ ID NO: 5671037 - DNA, 14 bp, Homo sapiens
tccagtgggcaggg

SEQ ID NO: 5671038 - DNA, 15 bp, Homo sapiens
tccagtgggcagggg

SEQ ID NO: 5671039 - DNA, 13 bp, Homo sapiens
tccagtgggcccg

SEQ ID NO: 5671040 - DNA, 17 bp, Homo sapiens
tccagtgggcccggaga

SEQ ID NO: 5671041 - DNA, 21 bp, Homo sapiens
tccagtggggtctcagtccag

SEQ ID NO: 5671042 - DNA, 18 bp, Homo sapiens
tccagtggtaccagctca

SEQ ID NO: 5671043 - DNA, 22 bp, Homo sapiens
tccagtggtccatggaatgctt

SEQ ID NO: 5671044 - DNA, 17 bp, Homo sapiens
tccagtggtgggtaatt

SEQ ID NO: 5671045 - DNA, 22 bp, Homo sapiens
tccagtggtgggtaattgtaca

SEQ ID NO: 5671046 - DNA, 13 bp, Homo sapiens
tccagtggttctg

SEQ ID NO: 5671047 - DNA, 15 bp, Homo sapiens
tccagtggttgctgt

SEQ ID NO: 5671048 - DNA, 20 bp, Homo sapiens
tccagtgtacatagtgtaat

SEQ ID NO: 5671049 - DNA, 14 bp, Homo sapiens
tccagtgtcacctc

SEQ ID NO: 5671050 - DNA, 20 bp, Homo sapiens
tccagtgtcacctctctcag

SEQ ID NO: 5671051 - DNA, 17 bp, Homo sapiens
tccagtgtcagggtcca

SEQ ID NO: 5671052 - DNA, 19 bp, Homo sapiens
tccagtgtcctgagctcag

SEQ ID NO: 5671053 - DNA, 20 bp, Homo sapiens
tccagtgtcctgagctcagc

SEQ ID NO: 5671054 - DNA, 21 bp, Homo sapiens
tccagtgtcctgagctcagcg

SEQ ID NO: 5671055 - DNA, 22 bp, Homo sapiens
tccagtgtcctgagctcagcgt

SEQ ID NO: 5671056 - DNA, 18 bp, Homo sapiens
tccagtgtccttagaaca

SEQ ID NO: 5671057 - DNA, 20 bp, Homo sapiens
tccagtgtccttagaacatt

SEQ ID NO: 5671058 - DNA, 22 bp, Homo sapiens
tccagtgtgagatactgtgtat

SEQ ID NO: 5671059 - DNA, 17 bp, Homo sapiens
tccagtgtgcacccctc

SEQ ID NO: 5671060 - DNA, 19 bp, Homo sapiens
tccagtgtgcacccctccc

SEQ ID NO: 5671061 - DNA, 18 bp, Homo sapiens
tccagtgtggctcccaca

SEQ ID NO: 5671062 - DNA, 19 bp, Homo sapiens
tccagtgtgggcttgacca

SEQ ID NO: 5671063 - DNA, 15 bp, Homo sapiens
tccagtgttgcctcc

SEQ ID NO: 5671064 - DNA, 17 bp, Homo sapiens
tccagtgttgcctcctc

SEQ ID NO: 5671065 - DNA, 14 bp, Homo sapiens
tccagtgttgtcat

SEQ ID NO: 5671066 - DNA, 14 bp, Homo sapiens
tccagtgttttctt

SEQ ID NO: 5671067 - DNA, 22 bp, Homo sapiens
tccagtgttttcttgtgttgtt

SEQ ID NO: 5671068 - DNA, 22 bp, Homo sapiens
tccagttaaaaaaaattttaat

SEQ ID NO: 5671069 - DNA, 17 bp, Homo sapiens
tccagttaaccaagtca

SEQ ID NO: 5671070 - DNA, 22 bp, Homo sapiens
tccagttaaggaccgtggccct

SEQ ID NO: 5671071 - DNA, 18 bp, Homo sapiens
tccagttaattacatcct

SEQ ID NO: 5671072 - DNA, 21 bp, Homo sapiens
tccagttagaaggaggttcta

SEQ ID NO: 5671073 - DNA, 14 bp, Homo sapiens
tccagttagttctc

SEQ ID NO: 5671074 - DNA, 15 bp, Homo sapiens
tccagttataagaag

SEQ ID NO: 5671075 - DNA, 19 bp, Homo sapiens
tccagttatttatttccaa

SEQ ID NO: 5671076 - DNA, 20 bp, Homo sapiens
tccagttcaggaatttttgt

SEQ ID NO: 5671077 - DNA, 21 bp, Homo sapiens
tccagttcaggaatttttgtt

SEQ ID NO: 5671078 - DNA, 21 bp, Homo sapiens
tccagttcatcgattttctat

SEQ ID NO: 5671079 - DNA, 13 bp, Homo sapiens
tccagttcccact

SEQ ID NO: 5671080 - DNA, 22 bp, Homo sapiens
tccagttcccatggtgtatgtg

SEQ ID NO: 5671081 - DNA, 19 bp, Homo sapiens
tccagttcctgctctctgc

SEQ ID NO: 5671082 - DNA, 15 bp, Homo sapiens
tccagttcctttaga

SEQ ID NO: 5671083 - DNA, 17 bp, Homo sapiens
tccagttcctttagaaa

SEQ ID NO: 5671084 - DNA, 17 bp, Homo sapiens
tccagttctgatgaggc

SEQ ID NO: 5671085 - DNA, 17 bp, Homo sapiens
tccagttgcaataaaat

SEQ ID NO: 5671086 - DNA, 15 bp, Homo sapiens
tccagttgcaattca

SEQ ID NO: 5671087 - DNA, 15 bp, Homo sapiens
tccagttgcagacca

SEQ ID NO: 5671088 - DNA, 15 bp, Homo sapiens
tccagttgcgtgtct

SEQ ID NO: 5671089 - DNA, 17 bp, Homo sapiens
tccagttggactgtggc

SEQ ID NO: 5671090 - DNA, 23 bp, Homo sapiens
tccagttggagttgattcatgtg

SEQ ID NO: 5671091 - DNA, 23 bp, Homo sapiens
tccagttggagttttttgtacca

SEQ ID NO: 5671092 - DNA, 13 bp, Homo sapiens
tccagtttattcc

SEQ ID NO: 5671093 - DNA, 19 bp, Homo sapiens
tccagtttcagagttctca

SEQ ID NO: 5671094 - DNA, 13 bp, Homo sapiens
tccagtttcccac

SEQ ID NO: 5671095 - DNA, 22 bp, Homo sapiens
tccagtttccccatggggctgc

SEQ ID NO: 5671096 - DNA, 18 bp, Homo sapiens
tccagtttctccttgaaa

SEQ ID NO: 5671097 - DNA, 12 bp, Homo sapiens
tccagtttctct

SEQ ID NO: 5671098 - DNA, 23 bp, Homo sapiens
tccagtttgaagaccaatcaaat

SEQ ID NO: 5671099 - DNA, 18 bp, Homo sapiens
tccagtttgcacctgtcc

SEQ ID NO: 5671100 - DNA, 15 bp, Homo sapiens
tccagtttgcccacc

SEQ ID NO: 5671101 - DNA, 16 bp, Homo sapiens
tccagttttctcctct

SEQ ID NO: 5671102 - DNA, 16 bp, Homo sapiens
tccagttttttgttgt

SEQ ID NO: 5671103 - DNA, 19 bp, Homo sapiens
tccataaaaaaaaatagat

SEQ ID NO: 5671104 - DNA, 16 bp, Homo sapiens
tccataaaaagaaagc

SEQ ID NO: 5671105 - DNA, 19 bp, Homo sapiens
tccataaactaagagaaac

SEQ ID NO: 5671106 - DNA, 13 bp, Homo sapiens
tccataaagaagc

SEQ ID NO: 5671107 - DNA, 20 bp, Homo sapiens
tccataaagaagcaataaag

SEQ ID NO: 5671108 - DNA, 21 bp, Homo sapiens
tccataaagacaatcactgcc

SEQ ID NO: 5671109 - DNA, 17 bp, Homo sapiens
tccataaatccttgatg

SEQ ID NO: 5671110 - DNA, 14 bp, Homo sapiens
tccataaatgtgtt

SEQ ID NO: 5671111 - DNA, 17 bp, Homo sapiens
tccataaccccaccctt

SEQ ID NO: 5671112 - DNA, 20 bp, Homo sapiens
tccataacctctatatcttt

SEQ ID NO: 5671113 - DNA, 21 bp, Homo sapiens
tccataacctctatatcttta

SEQ ID NO: 5671114 - DNA, 21 bp, Homo sapiens
tccataagcaagtgagcagat

SEQ ID NO: 5671115 - DNA, 14 bp, Homo sapiens
tccataagctattt

SEQ ID NO: 5671116 - DNA, 17 bp, Homo sapiens
tccataagtggagaaat

SEQ ID NO: 5671117 - DNA, 11 bp, Homo sapiens
tccataataaa

SEQ ID NO: 5671118 - DNA, 18 bp, Homo sapiens
tccataatataaacactt

SEQ ID NO: 5671119 - DNA, 16 bp, Homo sapiens
tccataatcaatctat

SEQ ID NO: 5671120 - DNA, 15 bp, Homo sapiens
tccataatgatggat

SEQ ID NO: 5671121 - DNA, 21 bp, Homo sapiens
tccataatgatggatttaaca

SEQ ID NO: 5671122 - DNA, 18 bp, Homo sapiens
tccataatgcattcttct

SEQ ID NO: 5671123 - DNA, 15 bp, Homo sapiens
tccataatgccactg

SEQ ID NO: 5671124 - DNA, 21 bp, Homo sapiens
tccataattatgacagttata

SEQ ID NO: 5671125 - DNA, 14 bp, Homo sapiens
tccatacagctcta

SEQ ID NO: 5671126 - DNA, 12 bp, Homo sapiens
tccatacatttg

SEQ ID NO: 5671127 - DNA, 12 bp, Homo sapiens
tccataccagct

SEQ ID NO: 5671128 - DNA, 19 bp, Homo sapiens
tccataccccctgccccag

SEQ ID NO: 5671129 - DNA, 21 bp, Homo sapiens
tccataccccctgccccagag

SEQ ID NO: 5671130 - DNA, 16 bp, Homo sapiens
tccatacctgcccctg

SEQ ID NO: 5671131 - DNA, 14 bp, Homo sapiens
tccataccttttct

SEQ ID NO: 5671132 - DNA, 22 bp, Homo sapiens
tccataccttttctcttttctt

SEQ ID NO: 5671133 - DNA, 20 bp, Homo sapiens
tccatactgaaaaaatgctg

SEQ ID NO: 5671134 - DNA, 13 bp, Homo sapiens
tccatactgggct

SEQ ID NO: 5671135 - DNA, 18 bp, Homo sapiens
tccatactgggctaagga

SEQ ID NO: 5671136 - DNA, 16 bp, Homo sapiens
tccatactgtagacac

SEQ ID NO: 5671137 - DNA, 16 bp, Homo sapiens
tccatactgtttaata

SEQ ID NO: 5671138 - DNA, 17 bp, Homo sapiens
tccatacttctctcaga

SEQ ID NO: 5671139 - DNA, 16 bp, Homo sapiens
tccatactttggatga

SEQ ID NO: 5671140 - DNA, 20 bp, Homo sapiens
tccatagagagcaagacgct

SEQ ID NO: 5671141 - DNA, 20 bp, Homo sapiens
tccatagagatgagcccacc

SEQ ID NO: 5671142 - DNA, 20 bp, Homo sapiens
tccatagatataaagccatt

SEQ ID NO: 5671143 - DNA, 15 bp, Homo sapiens
tccatagcaacagga

SEQ ID NO: 5671144 - DNA, 16 bp, Homo sapiens
tccatagcaacaggaa

SEQ ID NO: 5671145 - DNA, 21 bp, Homo sapiens
tccatagcacaagataaattg

SEQ ID NO: 5671146 - DNA, 21 bp, Homo sapiens
tccatagcctaatccctgggc

SEQ ID NO: 5671147 - DNA, 21 bp, Homo sapiens
tccatagcgacaccctttctg

SEQ ID NO: 5671148 - DNA, 17 bp, Homo sapiens
tccatagctgagctgga

SEQ ID NO: 5671149 - DNA, 17 bp, Homo sapiens
tccatagctgctgccct

SEQ ID NO: 5671150 - DNA, 17 bp, Homo sapiens
tccatagctgggaaacg

SEQ ID NO: 5671151 - DNA, 16 bp, Homo sapiens
tccatagtaactgaca

SEQ ID NO: 5671152 - DNA, 21 bp, Homo sapiens
tccatagtatattaaaaatgg

SEQ ID NO: 5671153 - DNA, 16 bp, Homo sapiens
tccatagtttggcatt

SEQ ID NO: 5671154 - DNA, 21 bp, Homo sapiens
tcccaacaaccacacttaaat

SEQ ID NO: 5671155 - DNA, 21 bp, Homo sapiens
tcccaacaagtgctctttcca

SEQ ID NO: 5671156 - DNA, 22 bp, Homo sapiens
tcccaacaatactttgtgtctt

SEQ ID NO: 5671157 - DNA, 18 bp, Homo sapiens
tcccaacacttcagactg

SEQ ID NO: 5671158 - DNA, 14 bp, Homo sapiens
tcccaacactttgg

SEQ ID NO: 5671159 - DNA, 17 bp, Homo sapiens
tcccaacagagctgggc

SEQ ID NO: 5671160 - DNA, 16 bp, Homo sapiens
tcccaacagaggcctc

SEQ ID NO: 5671161 - DNA, 13 bp, Homo sapiens
tcccaacagcctt

SEQ ID NO: 5671162 - DNA, 11 bp, Homo sapiens
tcccaacagga

SEQ ID NO: 5671163 - DNA, 11 bp, Homo sapiens
tcccaacatcg

SEQ ID NO: 5671164 - DNA, 20 bp, Homo sapiens
tcccaacatgggagggatca

SEQ ID NO: 5671165 - DNA, 15 bp, Homo sapiens
tcccaacatggtcct

SEQ ID NO: 5671166 - DNA, 15 bp, Homo sapiens
tcccaacattctgca

SEQ ID NO: 5671167 - DNA, 19 bp, Homo sapiens
tcccaaccaaccagcaggg

SEQ ID NO: 5671168 - DNA, 14 bp, Homo sapiens
tcccaaccagtgcc

SEQ ID NO: 5671169 - DNA, 18 bp, Homo sapiens
tcccaaccagtgccaagg

SEQ ID NO: 5671170 - DNA, 20 bp, Homo sapiens
tcccaaccagtgccaaggac

SEQ ID NO: 5671171 - DNA, 13 bp, Homo sapiens
tcccaacccagcc

SEQ ID NO: 5671172 - DNA, 19 bp, Homo sapiens
tcccaaccccagctactct

SEQ ID NO: 5671173 - DNA, 13 bp, Homo sapiens
tcccaaccccagg

SEQ ID NO: 5671174 - DNA, 23 bp, Homo sapiens
tcccaaccccagggcccccacag

SEQ ID NO: 5671175 - DNA, 14 bp, Homo sapiens
tcccaacccccagc

SEQ ID NO: 5671176 - DNA, 19 bp, Homo sapiens
tcccaacccccagccccca

SEQ ID NO: 5671177 - DNA, 22 bp, Homo sapiens
tcccaacccccctcctgctcct

SEQ ID NO: 5671178 - DNA, 23 bp, Homo sapiens
tcccaacccccctcctgctcctc

SEQ ID NO: 5671179 - DNA, 22 bp, Homo sapiens
tcccaaccctgcccagcctgat

SEQ ID NO: 5671180 - DNA, 23 bp, Homo sapiens
tcccaacctcaatgccctgccat

SEQ ID NO: 5671181 - DNA, 15 bp, Homo sapiens
tcccaacctcccctg

SEQ ID NO: 5671182 - DNA, 20 bp, Homo sapiens
tcccaacctggctccctccc

SEQ ID NO: 5671183 - DNA, 23 bp, Homo sapiens
tcccaacctggctccctcccacc

SEQ ID NO: 5671184 - DNA, 19 bp, Homo sapiens
tcccaacgagcctcctcag

SEQ ID NO: 5671185 - DNA, 19 bp, Homo sapiens
tcccaacgtgcaaagccaa

SEQ ID NO: 5671186 - DNA, 21 bp, Homo sapiens
tcccaacgtgctgggattaca

SEQ ID NO: 5671187 - DNA, 14 bp, Homo sapiens
tcccaactcacccc

SEQ ID NO: 5671188 - DNA, 18 bp, Homo sapiens
tcccaactcaccccagcc

SEQ ID NO: 5671189 - DNA, 21 bp, Homo sapiens
tcccaactcactgtgctccta

SEQ ID NO: 5671190 - DNA, 13 bp, Homo sapiens
tcccaactcagcc

SEQ ID NO: 5671191 - DNA, 10 bp, Homo sapiens
tcccaactcc

SEQ ID NO: 5671192 - DNA, 19 bp, Homo sapiens
tcccaactcccttctgctt

SEQ ID NO: 5671193 - DNA, 21 bp, Homo sapiens
tcccaactcccttctgcttgt

SEQ ID NO: 5671194 - DNA, 14 bp, Homo sapiens
tcccaactctagct

SEQ ID NO: 5671195 - DNA, 15 bp, Homo sapiens
tcccaactctggcct

SEQ ID NO: 5671196 - DNA, 20 bp, Homo sapiens
tcccaactctggccttggtt

SEQ ID NO: 5671197 - DNA, 17 bp, Homo sapiens
tcccaactgctctgccc

SEQ ID NO: 5671198 - DNA, 14 bp, Homo sapiens
tcccaactttggaa

SEQ ID NO: 5671199 - DNA, 19 bp, Homo sapiens
tcccaactttggaaaacat

SEQ ID NO: 5671200 - DNA, 16 bp, Homo sapiens
tcccaagaatgcaaga

SEQ ID NO: 5671201 - DNA, 16 bp, Homo sapiens
tcccaagaccctgccc

SEQ ID NO: 5671202 - DNA, 16 bp, Homo sapiens
tcccaagatgcctgat

SEQ ID NO: 5671203 - DNA, 18 bp, Homo sapiens
tcccaagatgcctgatca

SEQ ID NO: 5671204 - DNA, 20 bp, Homo sapiens
tcccaagatggagaggaaga

SEQ ID NO: 5671205 - DNA, 19 bp, Homo sapiens
tcccaagattttttcattt

SEQ ID NO: 5671206 - DNA, 12 bp, Homo sapiens
tcccaagcaaag

SEQ ID NO: 5671207 - DNA, 15 bp, Homo sapiens
tcccaagcagctgaa

SEQ ID NO: 5671208 - DNA, 16 bp, Homo sapiens
tcccaagcagctgaag

SEQ ID NO: 5671209 - DNA, 17 bp, Homo sapiens
tcccaagcagctgaagg

SEQ ID NO: 5671210 - DNA, 19 bp, Homo sapiens
tcccaagccctggtgacca

SEQ ID NO: 5671211 - DNA, 18 bp, Homo sapiens
tcccaagccgggagccaa

SEQ ID NO: 5671212 - DNA, 13 bp, Homo sapiens
tcccaagcctcct

SEQ ID NO: 5671213 - DNA, 17 bp, Homo sapiens
tcccaagcggtgtctct

SEQ ID NO: 5671214 - DNA, 18 bp, Homo sapiens
tcccaagcgttcctggcc

SEQ ID NO: 5671215 - DNA, 15 bp, Homo sapiens
tcccaagctagactg

SEQ ID NO: 5671216 - DNA, 15 bp, Homo sapiens
tcccaagctctgctc

SEQ ID NO: 5671217 - DNA, 17 bp, Homo sapiens
tcccaagctctgctcct

SEQ ID NO: 5671218 - DNA, 22 bp, Homo sapiens
tcccaagctgatggacatgaga

SEQ ID NO: 5671219 - DNA, 22 bp, Homo sapiens
tcccaagctggagtgcagtggt

SEQ ID NO: 5671220 - DNA, 17 bp, Homo sapiens
tcccaagctggctgggg

SEQ ID NO: 5671221 - DNA, 12 bp, Homo sapiens
tcccaagctggg

SEQ ID NO: 5671222 - DNA, 22 bp, Homo sapiens
tcccaagctgggccccagccca

SEQ ID NO: 5671223 - DNA, 18 bp, Homo sapiens
tcccaagctgtatgtact

SEQ ID NO: 5671224 - DNA, 13 bp, Homo sapiens
tcccaagctgtgc

SEQ ID NO: 5671225 - DNA, 14 bp, Homo sapiens
tcccaagctgtgct

SEQ ID NO: 5671226 - DNA, 20 bp, Homo sapiens
tcccaagctgtgctgggaag

SEQ ID NO: 5671227 - DNA, 23 bp, Homo sapiens
tcccaagctttgaatacccccag

SEQ ID NO: 5671228 - DNA, 13 bp, Homo sapiens
tcccaaggaaagc

SEQ ID NO: 5671229 - DNA, 21 bp, Homo sapiens
tcccaaggaagctccttcctg

SEQ ID NO: 5671230 - DNA, 23 bp, Homo sapiens
tcccaaggaagctccttcctgtt

SEQ ID NO: 5671231 - DNA, 17 bp, Homo sapiens
tcccaaggactttccag

SEQ ID NO: 5671232 - DNA, 22 bp, Homo sapiens
tcccaaggactttccagtgagg

SEQ ID NO: 5671233 - DNA, 22 bp, Homo sapiens
tcccaaggagccattctgtgtg

SEQ ID NO: 5671234 - DNA, 14 bp, Homo sapiens
tcccaaggagctga

SEQ ID NO: 5671235 - DNA, 15 bp, Homo sapiens
tcccaaggagggcac

SEQ ID NO: 5671236 - DNA, 17 bp, Homo sapiens
tcccaaggagggcacca

SEQ ID NO: 5671237 - DNA, 20 bp, Homo sapiens
tcccaaggagggggcctcat

SEQ ID NO: 5671238 - DNA, 21 bp, Homo sapiens
tcccaaggagggggcctcatt

SEQ ID NO: 5671239 - DNA, 22 bp, Homo sapiens
tcccaaggagggggcctcattg

SEQ ID NO: 5671240 - DNA, 15 bp, Homo sapiens
tcccaaggcaagcat

SEQ ID NO: 5671241 - DNA, 18 bp, Homo sapiens
tcccaaggctgccagaca

SEQ ID NO: 5671242 - DNA, 20 bp, Homo sapiens
tcccaaggctgcgtctggag

SEQ ID NO: 5671243 - DNA, 16 bp, Homo sapiens
tcccaagggacagcaa

SEQ ID NO: 5671244 - DNA, 20 bp, Homo sapiens
tcccaagggacagcaagtga

SEQ ID NO: 5671245 - DNA, 13 bp, Homo sapiens
tcccaagggaggc

SEQ ID NO: 5671246 - DNA, 15 bp, Homo sapiens
tcccaagggctgccg

SEQ ID NO: 5671247 - DNA, 16 bp, Homo sapiens
tcccaaggtcctctca

SEQ ID NO: 5671248 - DNA, 17 bp, Homo sapiens
tcccaaggtcctctcag

SEQ ID NO: 5671249 - DNA, 21 bp, Homo sapiens
tcccaaggtgaaatgaagcaa

SEQ ID NO: 5671250 - DNA, 23 bp, Homo sapiens
tcccaagtaagaggctggagttg

SEQ ID NO: 5671251 - DNA, 17 bp, Homo sapiens
tcccaagtagaatctca

SEQ ID NO: 5671252 - DNA, 23 bp, Homo sapiens
tcccaagtagctgggattacagg

SEQ ID NO: 5671253 - DNA, 21 bp, Homo sapiens
tcccaagtaggtgggattaca

SEQ ID NO: 5671254 - DNA, 16 bp, Homo sapiens
tcccaagtatgcctta

SEQ ID NO: 5671255 - DNA, 20 bp, Homo sapiens
tcccaagtatgccttaagca

SEQ ID NO: 5671256 - DNA, 21 bp, Homo sapiens
tcccaagtatgccttaagcag

SEQ ID NO: 5671257 - DNA, 23 bp, Homo sapiens
tcccaagtatgccttaagcagaa

SEQ ID NO: 5671258 - DNA, 20 bp, Homo sapiens
tcccaagtcaaacagtgtgg

SEQ ID NO: 5671259 - DNA, 16 bp, Homo sapiens
tcccaagtcagacaga

SEQ ID NO: 5671260 - DNA, 22 bp, Homo sapiens
tcccaagtcagacagatgtcag

SEQ ID NO: 5671261 - DNA, 15 bp, Homo sapiens
tcccaagtcctccgg

SEQ ID NO: 5671262 - DNA, 15 bp, Homo sapiens
tcccaagtcctcgcc

SEQ ID NO: 5671263 - DNA, 15 bp, Homo sapiens
tcccaagtctgacag

SEQ ID NO: 5671264 - DNA, 16 bp, Homo sapiens
tcccaagtctgacagc

SEQ ID NO: 5671265 - DNA, 21 bp, Homo sapiens
tcccaagtgagtctctctggg

SEQ ID NO: 5671266 - DNA, 23 bp, Homo sapiens
tcccaagtgccaaagaagcagac

SEQ ID NO: 5671267 - DNA, 16 bp, Homo sapiens
tcccaagttgtgcttg

SEQ ID NO: 5671268 - DNA, 22 bp, Homo sapiens
tcccaagtttccatagcaacag

SEQ ID NO: 5671269 - DNA, 17 bp, Homo sapiens
tcccaataaaagtgact

SEQ ID NO: 5671270 - DNA, 14 bp, Homo sapiens
tcccaataaagctg

SEQ ID NO: 5671271 - DNA, 16 bp, Homo sapiens
tcccaataaagctgga

SEQ ID NO: 5671272 - DNA, 19 bp, Homo sapiens
tcccaataaagtcctcttc

SEQ ID NO: 5671273 - DNA, 23 bp, Homo sapiens
tcccaatagcactttcattgcca

SEQ ID NO: 5671274 - DNA, 16 bp, Homo sapiens
tcccaatagctctact

SEQ ID NO: 5671275 - DNA, 14 bp, Homo sapiens
tcccaatatgtagc

SEQ ID NO: 5671276 - DNA, 21 bp, Homo sapiens
tcccaatcaaagaattacagt

SEQ ID NO: 5671277 - DNA, 13 bp, Homo sapiens
tcccaatcagctt

SEQ ID NO: 5671278 - DNA, 23 bp, Homo sapiens
tcccaatcagcttttgttctaga

SEQ ID NO: 5671279 - DNA, 23 bp, Homo sapiens
tcccaatcctctctcccctctgc

SEQ ID NO: 5671280 - DNA, 20 bp, Homo sapiens
tcccaatccttatcccaagc

SEQ ID NO: 5671281 - DNA, 21 bp, Homo sapiens
tcccaatctcaatacagcctg

SEQ ID NO: 5671282 - DNA, 23 bp, Homo sapiens
tcccaatctctacccctttcttc

SEQ ID NO: 5671283 - DNA, 15 bp, Homo sapiens
tcccaatctgaaatt

SEQ ID NO: 5671284 - DNA, 13 bp, Homo sapiens
tcccaatcttctt

SEQ ID NO: 5671285 - DNA, 16 bp, Homo sapiens
tcccaatcttcttttt

SEQ ID NO: 5671286 - DNA, 17 bp, Homo sapiens
tcccaatcttctttttc

SEQ ID NO: 5671287 - DNA, 20 bp, Homo sapiens
tcccaatcttctttttcagg

SEQ ID NO: 5671288 - DNA, 15 bp, Homo sapiens
tcccaatctttctat

SEQ ID NO: 5671289 - DNA, 13 bp, Homo sapiens
tcccaatgaaata

SEQ ID NO: 5671290 - DNA, 23 bp, Homo sapiens
tcccaatgaaatactgagatgct

SEQ ID NO: 5671291 - DNA, 23 bp, Homo sapiens
tcccaatggtgcttggaggggga

SEQ ID NO: 5671292 - DNA, 14 bp, Homo sapiens
tcccaatggtgttt

SEQ ID NO: 5671293 - DNA, 13 bp, Homo sapiens
tcccaatgtgccg

SEQ ID NO: 5671294 - DNA, 20 bp, Homo sapiens
tcccaattagcttggcctac

SEQ ID NO: 5671295 - DNA, 18 bp, Homo sapiens
tcccaattatcaaaaaac

SEQ ID NO: 5671296 - DNA, 19 bp, Homo sapiens
tcccaatttaagagtcctg

SEQ ID NO: 5671297 - DNA, 23 bp, Homo sapiens
tcccaatttcagactcccattcc

SEQ ID NO: 5671298 - DNA, 17 bp, Homo sapiens
tcccacaaaatatttct

SEQ ID NO: 5671299 - DNA, 16 bp, Homo sapiens
tcccacaaaggagagc

SEQ ID NO: 5671300 - DNA, 21 bp, Homo sapiens
tcccacaaataagttcccatt

SEQ ID NO: 5671301 - DNA, 16 bp, Homo sapiens
tcccacaaccacatgt

SEQ ID NO: 5671302 - DNA, 14 bp, Homo sapiens
tcccacaagcctga

SEQ ID NO: 5671303 - DNA, 16 bp, Homo sapiens
tcccacaagcctgagg

SEQ ID NO: 5671304 - DNA, 14 bp, Homo sapiens
tcccacaagcctgc

SEQ ID NO: 5671305 - DNA, 18 bp, Homo sapiens
tcccacaagcctgcctcg

SEQ ID NO: 5671306 - DNA, 22 bp, Homo sapiens
tcccacaatcttaaggggcagc

SEQ ID NO: 5671307 - DNA, 16 bp, Homo sapiens
tcccacaatggctggg

SEQ ID NO: 5671308 - DNA, 19 bp, Homo sapiens
tcccacaattcttttgaaa

SEQ ID NO: 5671309 - DNA, 20 bp, Homo sapiens
tcccacaattcttttgaaag

SEQ ID NO: 5671310 - DNA, 23 bp, Homo sapiens
tcccacacaagacccaagtagct

SEQ ID NO: 5671311 - DNA, 14 bp, Homo sapiens
tcccacacaagcag

SEQ ID NO: 5671312 - DNA, 13 bp, Homo sapiens
tcccacacccacc

SEQ ID NO: 5671313 - DNA, 19 bp, Homo sapiens
tcccacacccacccttttt

SEQ ID NO: 5671314 - DNA, 17 bp, Homo sapiens
tcccacacccacctctg

SEQ ID NO: 5671315 - DNA, 21 bp, Homo sapiens
tcccacacccacctctgccac

SEQ ID NO: 5671316 - DNA, 17 bp, Homo sapiens
tcccacaccccagcgcc

SEQ ID NO: 5671317 - DNA, 21 bp, Homo sapiens
tcccacaccgcgtcccagctc

SEQ ID NO: 5671318 - DNA, 14 bp, Homo sapiens
tcccacaccgctgg

SEQ ID NO: 5671319 - DNA, 18 bp, Homo sapiens
tcccacaccgctggtccc

SEQ ID NO: 5671320 - DNA, 18 bp, Homo sapiens
tcccacacctccacagtt

SEQ ID NO: 5671321 - DNA, 19 bp, Homo sapiens
tcccacacgattagcttta

SEQ ID NO: 5671322 - DNA, 14 bp, Homo sapiens
tcccacacggcagc

SEQ ID NO: 5671323 - DNA, 16 bp, Homo sapiens
tcccacactgaaattc

SEQ ID NO: 5671324 - DNA, 16 bp, Homo sapiens
tcccacactgtgaact

SEQ ID NO: 5671325 - DNA, 22 bp, Homo sapiens
tcccacactgtgcagacccagt

SEQ ID NO: 5671326 - DNA, 16 bp, Homo sapiens
tcccacactgtggcca

SEQ ID NO: 5671327 - DNA, 13 bp, Homo sapiens
tcccacacttatc

SEQ ID NO: 5671328 - DNA, 16 bp, Homo sapiens
tcccacacttcccacc

SEQ ID NO: 5671329 - DNA, 19 bp, Homo sapiens
tcccacacttgctggggct

SEQ ID NO: 5671330 - DNA, 13 bp, Homo sapiens
tgtccttgcccca

SEQ ID NO: 5671331 - DNA, 18 bp, Homo sapiens
tgtccttgccccactcct

SEQ ID NO: 5671332 - DNA, 16 bp, Homo sapiens
tgtccttgctcctgga

SEQ ID NO: 5671333 - DNA, 13 bp, Homo sapiens
tgtccttggactc

SEQ ID NO: 5671334 - DNA, 18 bp, Homo sapiens
tgtccttggcaactttct

SEQ ID NO: 5671335 - DNA, 14 bp, Homo sapiens
tgtccttgggttgc

SEQ ID NO: 5671336 - DNA, 22 bp, Homo sapiens
tgtccttgtcacgatcacaggc

SEQ ID NO: 5671337 - DNA, 20 bp, Homo sapiens
tgtccttgtgtatcctgaca

SEQ ID NO: 5671338 - DNA, 18 bp, Homo sapiens
tgtccttgttcatggaga

SEQ ID NO: 5671339 - DNA, 22 bp, Homo sapiens
tgtccttgttcatggagagctg

SEQ ID NO: 5671340 - DNA, 17 bp, Homo sapiens
tgtcctttcaaggggaa

SEQ ID NO: 5671341 - DNA, 15 bp, Homo sapiens
tgtcctttccatctg

SEQ ID NO: 5671342 - DNA, 13 bp, Homo sapiens
tgtcctttcccct

SEQ ID NO: 5671343 - DNA, 15 bp, Homo sapiens
tgtcctttcccctct

SEQ ID NO: 5671344 - DNA, 20 bp, Homo sapiens
tgtcctttcccctctctgcc

SEQ ID NO: 5671345 - DNA, 23 bp, Homo sapiens
tgtcctttcccctctctgcccct

SEQ ID NO: 5671346 - DNA, 13 bp, Homo sapiens
tgtcctttccctc

SEQ ID NO: 5671347 - DNA, 18 bp, Homo sapiens
tgtcctttccctccactc

SEQ ID NO: 5671348 - DNA, 13 bp, Homo sapiens
tgtcctttctaga

SEQ ID NO: 5671349 - DNA, 12 bp, Homo sapiens
tgtcctttctcc

SEQ ID NO: 5671350 - DNA, 14 bp, Homo sapiens
tgtcctttctgaac

SEQ ID NO: 5671351 - DNA, 14 bp, Homo sapiens
tgtcctttcttgca

SEQ ID NO: 5671352 - DNA, 21 bp, Homo sapiens
tgtcctttgaggccccaactc

SEQ ID NO: 5671353 - DNA, 22 bp, Homo sapiens
tgtcctttgaggccccaactca

SEQ ID NO: 5671354 - DNA, 23 bp, Homo sapiens
tgtcctttgttattatcctgcat

SEQ ID NO: 5671355 - DNA, 17 bp, Homo sapiens
tgtccttttaggaatat

SEQ ID NO: 5671356 - DNA, 23 bp, Homo sapiens
tgtccttttatttctccatcttt

SEQ ID NO: 5671357 - DNA, 21 bp, Homo sapiens
tgtccttttcccctacagaat

SEQ ID NO: 5671358 - DNA, 14 bp, Homo sapiens
tgtccttttctccc

SEQ ID NO: 5671359 - DNA, 15 bp, Homo sapiens
tgtccttttgctctt

SEQ ID NO: 5671360 - DNA, 20 bp, Homo sapiens
tgtcctttttatctgatctg

SEQ ID NO: 5671361 - DNA, 17 bp, Homo sapiens
tgtcctttttcctctcc

SEQ ID NO: 5671362 - DNA, 20 bp, Homo sapiens
tgtcgaaaagagtcttccaa

SEQ ID NO: 5671363 - DNA, 22 bp, Homo sapiens
tgtcgaaaagagtcttccaatt

SEQ ID NO: 5671364 - DNA, 17 bp, Homo sapiens
tgtcgaaggggaggcac

SEQ ID NO: 5671365 - DNA, 14 bp, Homo sapiens
tgtcgacatgtttt

SEQ ID NO: 5671366 - DNA, 13 bp, Homo sapiens
tgtcgagacactt

SEQ ID NO: 5671367 - DNA, 20 bp, Homo sapiens
tgtcgaggccacattgctgg

SEQ ID NO: 5671368 - DNA, 18 bp, Homo sapiens
tgtcgaggctagaggcat

SEQ ID NO: 5671369 - DNA, 13 bp, Homo sapiens
tgtcgagtccagt

SEQ ID NO: 5671370 - DNA, 16 bp, Homo sapiens
tgtcgagtccagtcct

SEQ ID NO: 5671371 - DNA, 15 bp, Homo sapiens
tgtcgatgcacagta

SEQ ID NO: 5671372 - DNA, 14 bp, Homo sapiens
tgtcgattagactg

SEQ ID NO: 5671373 - DNA, 12 bp, Homo sapiens
tgtcgcagactc

SEQ ID NO: 5671374 - DNA, 15 bp, Homo sapiens
tgtcgccacacgcct

SEQ ID NO: 5671375 - DNA, 14 bp, Homo sapiens
tgtcgcccaggctg

SEQ ID NO: 5671376 - DNA, 22 bp, Homo sapiens
tgtcgcccttctcccggccctc

SEQ ID NO: 5671377 - DNA, 13 bp, Homo sapiens
tgtcgccgcctgc

SEQ ID NO: 5671378 - DNA, 21 bp, Homo sapiens
tgtcgccgcctgctccctgca

SEQ ID NO: 5671379 - DNA, 16 bp, Homo sapiens
tgtcgccgtccctctg

SEQ ID NO: 5671380 - DNA, 13 bp, Homo sapiens
tgtcgcctgcccc

SEQ ID NO: 5671381 - DNA, 16 bp, Homo sapiens
tgtcgcctgcccccag

SEQ ID NO: 5671382 - DNA, 16 bp, Homo sapiens
tgtcgcgcgtctccca

SEQ ID NO: 5671383 - DNA, 22 bp, Homo sapiens
tgtcgctcatgtgtgcaacagg

SEQ ID NO: 5671384 - DNA, 13 bp, Homo sapiens
tgtcgctgtaaat

SEQ ID NO: 5671385 - DNA, 14 bp, Homo sapiens
tgtcggagggctgg

SEQ ID NO: 5671386 - DNA, 18 bp, Homo sapiens
tgtcggagggctggacat

SEQ ID NO: 5671387 - DNA, 16 bp, Homo sapiens
tgtcggagtagaaatt

SEQ ID NO: 5671388 - DNA, 17 bp, Homo sapiens
tgtcggagtagaaattg

SEQ ID NO: 5671389 - DNA, 17 bp, Homo sapiens
tgtcggatcctgtgagt

SEQ ID NO: 5671390 - DNA, 23 bp, Homo sapiens
tgtcggccacaccccagactcca

SEQ ID NO: 5671391 - DNA, 21 bp, Homo sapiens
tgtcggccccaccagtgcctc

SEQ ID NO: 5671392 - DNA, 23 bp, Homo sapiens
tgtcggccccaccagtgcctctc

SEQ ID NO: 5671393 - DNA, 12 bp, Homo sapiens
tgtcggcctcta

SEQ ID NO: 5671394 - DNA, 19 bp, Homo sapiens
tgtcggcctggtgttctgt

SEQ ID NO: 5671395 - DNA, 17 bp, Homo sapiens
tgtcggctccagtcccc

SEQ ID NO: 5671396 - DNA, 19 bp, Homo sapiens
tgtcggctccagtccccag

SEQ ID NO: 5671397 - DNA, 14 bp, Homo sapiens
tgtcggctgtgagg

SEQ ID NO: 5671398 - DNA, 12 bp, Homo sapiens
tgtcgggcatga

SEQ ID NO: 5671399 - DNA, 23 bp, Homo sapiens
tgtcgggcccgcactcaggagca

SEQ ID NO: 5671400 - DNA, 21 bp, Homo sapiens
tgtcgggcccttcttgctgcc

SEQ ID NO: 5671401 - DNA, 22 bp, Homo sapiens
tgtcgggggctgtggatgggtg

SEQ ID NO: 5671402 - DNA, 16 bp, Homo sapiens
tgtcgggttctcccat

SEQ ID NO: 5671403 - DNA, 20 bp, Homo sapiens
tgtcggtcatagtttcctga

SEQ ID NO: 5671404 - DNA, 16 bp, Homo sapiens
tgtcggtggctgcctt

SEQ ID NO: 5671405 - DNA, 20 bp, Homo sapiens
tgtcggttcttcctggaagt

SEQ ID NO: 5671406 - DNA, 23 bp, Homo sapiens
tgtcggttttttttaaataaaag

SEQ ID NO: 5671407 - DNA, 23 bp, Homo sapiens
tgtcgtagaattccttcgaaagg

SEQ ID NO: 5671408 - DNA, 22 bp, Homo sapiens
tgtcgtagttactctcaggcat

SEQ ID NO: 5671409 - DNA, 14 bp, Homo sapiens
tgtcgtccccagac

SEQ ID NO: 5671410 - DNA, 15 bp, Homo sapiens
tgtcgtccccagacc

SEQ ID NO: 5671411 - DNA, 19 bp, Homo sapiens
tgtcgtctgtgaatgctaa

SEQ ID NO: 5671412 - DNA, 17 bp, Homo sapiens
tgtcgtctttttccaaa

SEQ ID NO: 5671413 - DNA, 16 bp, Homo sapiens
tgtcgtgtccagcctg

SEQ ID NO: 5671414 - DNA, 17 bp, Homo sapiens
tgtcgtgtttacaaaag

SEQ ID NO: 5671415 - DNA, 21 bp, Homo sapiens
tgtcgtgttttcaaggaagaa

SEQ ID NO: 5671416 - DNA, 17 bp, Homo sapiens
tgtcgttaaaaacagat

SEQ ID NO: 5671417 - DNA, 20 bp, Homo sapiens
tgtcgttgactttagggact

SEQ ID NO: 5671418 - DNA, 22 bp, Homo sapiens
tgtcgtttcattcattttgtgt

SEQ ID NO: 5671419 - DNA, 20 bp, Homo sapiens
tgtctaaaaataaaatgcat

SEQ ID NO: 5671420 - DNA, 23 bp, Homo sapiens
tgtctaaaaataaaatgcattta

SEQ ID NO: 5671421 - DNA, 22 bp, Homo sapiens
tgtctaaaatacttgagaaatt

SEQ ID NO: 5671422 - DNA, 23 bp, Homo sapiens
tgtctaaaataggttttccctgt

SEQ ID NO: 5671423 - DNA, 22 bp, Homo sapiens
tgtctaaaggatgagatttttc

SEQ ID NO: 5671424 - DNA, 22 bp, Homo sapiens
tgtctaaagttagggcattttt

SEQ ID NO: 5671425 - DNA, 20 bp, Homo sapiens
tgtctaacttaaatagcttt

SEQ ID NO: 5671426 - DNA, 19 bp, Homo sapiens
tgtctaagaaacattggaa

SEQ ID NO: 5671427 - DNA, 18 bp, Homo sapiens
tgtctaagaaattgaata

SEQ ID NO: 5671428 - DNA, 15 bp, Homo sapiens
tgtctaagatagtaa

SEQ ID NO: 5671429 - DNA, 14 bp, Homo sapiens
tgtctaagattcta

SEQ ID NO: 5671430 - DNA, 15 bp, Homo sapiens
tgtctaagattctag

SEQ ID NO: 5671431 - DNA, 18 bp, Homo sapiens
tgtctaagattctagatc

SEQ ID NO: 5671432 - DNA, 19 bp, Homo sapiens
tgtctaaggaatgatccaa

SEQ ID NO: 5671433 - DNA, 16 bp, Homo sapiens
tgtctaatagcccata

SEQ ID NO: 5671434 - DNA, 19 bp, Homo sapiens
tgtctaatgtattttattg

SEQ ID NO: 5671435 - DNA, 18 bp, Homo sapiens
tgtctaattaaaacactt

SEQ ID NO: 5671436 - DNA, 22 bp, Homo sapiens
tgtctaattaataaattttcca

SEQ ID NO: 5671437 - DNA, 17 bp, Homo sapiens
tgtctaattcatttact

SEQ ID NO: 5671438 - DNA, 19 bp, Homo sapiens
tgtctaattcatttactca

SEQ ID NO: 5671439 - DNA, 12 bp, Homo sapiens
tgtctaattgtc

SEQ ID NO: 5671440 - DNA, 14 bp, Homo sapiens
tgtctaattttctt

SEQ ID NO: 5671441 - DNA, 23 bp, Homo sapiens
tgtctaattttctttccgacaca

SEQ ID NO: 5671442 - DNA, 22 bp, Homo sapiens
tgtctacaaaagcaaagtgaag

SEQ ID NO: 5671443 - DNA, 12 bp, Homo sapiens
tgtctacaaata

SEQ ID NO: 5671444 - DNA, 21 bp, Homo sapiens
tgtctacaaatataagatttt

SEQ ID NO: 5671445 - DNA, 17 bp, Homo sapiens
tgtctacaccattatgt

SEQ ID NO: 5671446 - DNA, 18 bp, Homo sapiens
tgtctacaccattatgtg

SEQ ID NO: 5671447 - DNA, 14 bp, Homo sapiens
tgtctacagaaaat

SEQ ID NO: 5671448 - DNA, 17 bp, Homo sapiens
tgtctacagaaaatgct

SEQ ID NO: 5671449 - DNA, 12 bp, Homo sapiens
tgtctacagaga

SEQ ID NO: 5671450 - DNA, 17 bp, Homo sapiens
tgtctacagtagctgct

SEQ ID NO: 5671451 - DNA, 14 bp, Homo sapiens
tgtctaccatctcc

SEQ ID NO: 5671452 - DNA, 22 bp, Homo sapiens
tgtctactaagtgatgctgtga

SEQ ID NO: 5671453 - DNA, 18 bp, Homo sapiens
tgtctactcagcatttga

SEQ ID NO: 5671454 - DNA, 18 bp, Homo sapiens
tgtctactcctagaagaa

SEQ ID NO: 5671455 - DNA, 23 bp, Homo sapiens
tgtctactcctagaagaaccaaa

SEQ ID NO: 5671456 - DNA, 19 bp, Homo sapiens
tgtctactcctcacagcat

SEQ ID NO: 5671457 - DNA, 12 bp, Homo sapiens
tgtctactgaag

SEQ ID NO: 5671458 - DNA, 14 bp, Homo sapiens
tgtctactgaccaa

SEQ ID NO: 5671459 - DNA, 12 bp, Homo sapiens
tgtctactgtgg

SEQ ID NO: 5671460 - DNA, 15 bp, Homo sapiens
tgtctactgtggtga

SEQ ID NO: 5671461 - DNA, 16 bp, Homo sapiens
tgtctactgtggtgat

SEQ ID NO: 5671462 - DNA, 19 bp, Homo sapiens
tgtctactttttaattttt

SEQ ID NO: 5671463 - DNA, 19 bp, Homo sapiens
tgtctagaatcctgcttta

SEQ ID NO: 5671464 - DNA, 20 bp, Homo sapiens
tgtctagagcctcttgggga

SEQ ID NO: 5671465 - DNA, 17 bp, Homo sapiens
tgtctagaggcagactc

SEQ ID NO: 5671466 - DNA, 15 bp, Homo sapiens
tgtctagaggcaggt

SEQ ID NO: 5671467 - DNA, 21 bp, Homo sapiens
tgtctagaggtgagaccaaag

SEQ ID NO: 5671468 - DNA, 17 bp, Homo sapiens
tgtctagagtcatgtga

SEQ ID NO: 5671469 - DNA, 22 bp, Homo sapiens
tgtctagagtcatgtgagcctc

SEQ ID NO: 5671470 - DNA, 19 bp, Homo sapiens
tgtctagcatgctgagtca

SEQ ID NO: 5671471 - DNA, 15 bp, Homo sapiens
tgtctagctgtttca

SEQ ID NO: 5671472 - DNA, 17 bp, Homo sapiens
tgtctaggaaggtgtga

SEQ ID NO: 5671473 - DNA, 18 bp, Homo sapiens
tgtctaggactgcagtgt

SEQ ID NO: 5671474 - DNA, 20 bp, Homo sapiens
tgtctaggactgcagtgtgg

SEQ ID NO: 5671475 - DNA, 18 bp, Homo sapiens
tgtctaggcactgagcag

SEQ ID NO: 5671476 - DNA, 23 bp, Homo sapiens
tgtctaggcactgagcagggatc

SEQ ID NO: 5671477 - DNA, 17 bp, Homo sapiens
tgtctaggctggaagag

SEQ ID NO: 5671478 - DNA, 19 bp, Homo sapiens
tgtctagggtgttctgtac

SEQ ID NO: 5671479 - DNA, 19 bp, Homo sapiens
tgtctaggtctcctcaggg

SEQ ID NO: 5671480 - DNA, 17 bp, Homo sapiens
tgtctaggttaaagcta

SEQ ID NO: 5671481 - DNA, 19 bp, Homo sapiens
tgtctaggttaaagctaaa

SEQ ID NO: 5671482 - DNA, 12 bp, Homo sapiens
tgtctagtatac

SEQ ID NO: 5671483 - DNA, 14 bp, Homo sapiens
tgtctagtgtattc

SEQ ID NO: 5671484 - DNA, 13 bp, Homo sapiens
tgtctagtgtctg

SEQ ID NO: 5671485 - DNA, 16 bp, Homo sapiens
tgtctagtttcccaca

SEQ ID NO: 5671486 - DNA, 18 bp, Homo sapiens
tgtctagtttcccacatt

SEQ ID NO: 5671487 - DNA, 12 bp, Homo sapiens
tgtctataaagc

SEQ ID NO: 5671488 - DNA, 14 bp, Homo sapiens
tgtctataaagcat

SEQ ID NO: 5671489 - DNA, 23 bp, Homo sapiens
tgtctataaatggtgtcataact

SEQ ID NO: 5671490 - DNA, 19 bp, Homo sapiens
tgtctataagtatataaat

SEQ ID NO: 5671491 - DNA, 22 bp, Homo sapiens
tgtctataatcccagcactttg

SEQ ID NO: 5671492 - DNA, 18 bp, Homo sapiens
tgtctatagttgtcagta

SEQ ID NO: 5671493 - DNA, 12 bp, Homo sapiens
tgtctatatata

SEQ ID NO: 5671494 - DNA, 18 bp, Homo sapiens
tgtctatctctaataaaa

SEQ ID NO: 5671495 - DNA, 16 bp, Homo sapiens
tgtctatgaactagag

SEQ ID NO: 5671496 - DNA, 15 bp, Homo sapiens
tgtctatgctccctc

SEQ ID NO: 5671497 - DNA, 14 bp, Homo sapiens
tgtctatgtgtata

SEQ ID NO: 5671498 - DNA, 21 bp, Homo sapiens
tgtctatgttttctactccaa

SEQ ID NO: 5671499 - DNA, 18 bp, Homo sapiens
tgtctattacctgttagt

SEQ ID NO: 5671500 - DNA, 13 bp, Homo sapiens
tgtctattcagct

SEQ ID NO: 5671501 - DNA, 15 bp, Homo sapiens
tgtctattccctgga

SEQ ID NO: 5671502 - DNA, 14 bp, Homo sapiens
tgtctattctgagc

SEQ ID NO: 5671503 - DNA, 15 bp, Homo sapiens
tgtctattctgagcc

SEQ ID NO: 5671504 - DNA, 12 bp, Homo sapiens
tgtctattgtcc

SEQ ID NO: 5671505 - DNA, 18 bp, Homo sapiens
tgtctattgtccaaagtt

SEQ ID NO: 5671506 - DNA, 13 bp, Homo sapiens
tgtctatttccaa

SEQ ID NO: 5671507 - DNA, 13 bp, Homo sapiens
tgtctatttctga

SEQ ID NO: 5671508 - DNA, 16 bp, Homo sapiens
tgtctatttctgaaag

SEQ ID NO: 5671509 - DNA, 13 bp, Homo sapiens
tgtctatttctgc

SEQ ID NO: 5671510 - DNA, 18 bp, Homo sapiens
tgtctatttctgctgaat

SEQ ID NO: 5671511 - DNA, 11 bp, Homo sapiens
tgtctatttta

SEQ ID NO: 5671512 - DNA, 16 bp, Homo sapiens
tgtctattttaaaata

SEQ ID NO: 5671513 - DNA, 12 bp, Homo sapiens
tgtctcaaaaaa

SEQ ID NO: 5671514 - DNA, 14 bp, Homo sapiens
tgtctcaaaaggat

SEQ ID NO: 5671515 - DNA, 19 bp, Homo sapiens
tgtctcaaaataaaaccag

SEQ ID NO: 5671516 - DNA, 21 bp, Homo sapiens
tgtctcaagagggcactggtg

SEQ ID NO: 5671517 - DNA, 13 bp, Homo sapiens
tgtctcaagtgca

SEQ ID NO: 5671518 - DNA, 22 bp, Homo sapiens
tgtctcaagtgcaatgccccct

SEQ ID NO: 5671519 - DNA, 15 bp, Homo sapiens
tgtctcaataatata

SEQ ID NO: 5671520 - DNA, 23 bp, Homo sapiens
tgtctcaatagctccaagctgtt

SEQ ID NO: 5671521 - DNA, 17 bp, Homo sapiens
tgtctcaatgctcataa

SEQ ID NO: 5671522 - DNA, 14 bp, Homo sapiens
tgtctcacagacgc

SEQ ID NO: 5671523 - DNA, 15 bp, Homo sapiens
tgtctcaccagctca

SEQ ID NO: 5671524 - DNA, 20 bp, Homo sapiens
tgtctcaccagctcagcccc

SEQ ID NO: 5671525 - DNA, 18 bp, Homo sapiens
tgtctcacgattccagtg

SEQ ID NO: 5671526 - DNA, 23 bp, Homo sapiens
tgtctcactcgttctgttaccca

SEQ ID NO: 5671527 - DNA, 17 bp, Homo sapiens
tgtctcactcttctgtc

SEQ ID NO: 5671528 - DNA, 20 bp, Homo sapiens
tgtctcactgagcactgttt

SEQ ID NO: 5671529 - DNA, 17 bp, Homo sapiens
tgtctcactgttctgca

SEQ ID NO: 5671530 - DNA, 19 bp, Homo sapiens
tgtctcactgttctgcaaa

SEQ ID NO: 5671531 - DNA, 17 bp, Homo sapiens
tgtctcacttttcatct

SEQ ID NO: 5671532 - DNA, 23 bp, Homo sapiens
tgtctcactttttacccagaaca

SEQ ID NO: 5671533 - DNA, 14 bp, Homo sapiens
tgtctcagactttt

SEQ ID NO: 5671534 - DNA, 15 bp, Homo sapiens
tgtctcagacttttg

SEQ ID NO: 5671535 - DNA, 20 bp, Homo sapiens
tgtctcagacttttgtacat

SEQ ID NO: 5671536 - DNA, 13 bp, Homo sapiens
tgtctcagagcct

SEQ ID NO: 5671537 - DNA, 12 bp, Homo sapiens
tgtctcagattg

SEQ ID NO: 5671538 - DNA, 22 bp, Homo sapiens
tgtctcagattttattatgtaa

SEQ ID NO: 5671539 - DNA, 13 bp, Homo sapiens
tgtctcagcctcc

SEQ ID NO: 5671540 - DNA, 14 bp, Homo sapiens
tgtctcagcctccc

SEQ ID NO: 5671541 - DNA, 16 bp, Homo sapiens
tgtctcagcctcctca

SEQ ID NO: 5671542 - DNA, 17 bp, Homo sapiens
tgtctcagcctcctgag

SEQ ID NO: 5671543 - DNA, 20 bp, Homo sapiens
tgtctcagcgaggtgtaaag

SEQ ID NO: 5671544 - DNA, 14 bp, Homo sapiens
tgtctcaggagcac

SEQ ID NO: 5671545 - DNA, 21 bp, Homo sapiens
tgtctcaggagcaccctgtct

SEQ ID NO: 5671546 - DNA, 17 bp, Homo sapiens
tgtctcaggctcaagtt

SEQ ID NO: 5671547 - DNA, 16 bp, Homo sapiens
tgtctcaggctgcctg

SEQ ID NO: 5671548 - DNA, 18 bp, Homo sapiens
tgtctcaggctgcctgag

SEQ ID NO: 5671549 - DNA, 19 bp, Homo sapiens
tgtctcaggctgcctgagt

SEQ ID NO: 5671550 - DNA, 20 bp, Homo sapiens
tgtctcaggctgcctgagtc

SEQ ID NO: 5671551 - DNA, 13 bp, Homo sapiens
tgtctcagggccg

SEQ ID NO: 5671552 - DNA, 16 bp, Homo sapiens
tgtctcaggtccctgc

SEQ ID NO: 5671553 - DNA, 19 bp, Homo sapiens
tgtctcagtcattgctgtt

SEQ ID NO: 5671554 - DNA, 12 bp, Homo sapiens
tgtctcagtgaa

SEQ ID NO: 5671555 - DNA, 12 bp, Homo sapiens
tgtctcagtgat

SEQ ID NO: 5671556 - DNA, 13 bp, Homo sapiens
tgtctcagtgctg

SEQ ID NO: 5671557 - DNA, 16 bp, Homo sapiens
tgtctcagttggaaat

SEQ ID NO: 5671558 - DNA, 11 bp, Homo sapiens
tgtctcatcca

SEQ ID NO: 5671559 - DNA, 16 bp, Homo sapiens
tgtctcatccatcatc

SEQ ID NO: 5671560 - DNA, 11 bp, Homo sapiens
tgtctcatccc

SEQ ID NO: 5671561 - DNA, 12 bp, Homo sapiens
tgtctcatccca

SEQ ID NO: 5671562 - DNA, 16 bp, Homo sapiens
tgtctcatccccaggg

SEQ ID NO: 5671563 - DNA, 18 bp, Homo sapiens
tgtctcatcctcctggaa

SEQ ID NO: 5671564 - DNA, 13 bp, Homo sapiens
tgtctcatgccag

SEQ ID NO: 5671565 - DNA, 21 bp, Homo sapiens
tgtctcatgccagtaacaggc

SEQ ID NO: 5671566 - DNA, 23 bp, Homo sapiens
tgtctcatggtcccacttcccca

SEQ ID NO: 5671567 - DNA, 12 bp, Homo sapiens
tgtctcattctc

SEQ ID NO: 5671568 - DNA, 14 bp, Homo sapiens
tgtctcattctcag

SEQ ID NO: 5671569 - DNA, 15 bp, Homo sapiens
tgtctcattctcaga

SEQ ID NO: 5671570 - DNA, 17 bp, Homo sapiens
tgtctcatttgccagga

SEQ ID NO: 5671571 - DNA, 19 bp, Homo sapiens
tgtctcattttggtctgtt

SEQ ID NO: 5671572 - DNA, 20 bp, Homo sapiens
tgtctcattttggtctgttt

SEQ ID NO: 5671573 - DNA, 21 bp, Homo sapiens
tgtctcattttggtctgtttt

SEQ ID NO: 5671574 - DNA, 22 bp, Homo sapiens
tgtctcattttggtctgttttg

SEQ ID NO: 5671575 - DNA, 16 bp, Homo sapiens
tgtctccaaagaagat

SEQ ID NO: 5671576 - DNA, 11 bp, Homo sapiens
tgtctccaacc

SEQ ID NO: 5671577 - DNA, 16 bp, Homo sapiens
tgtctccaacccccca

SEQ ID NO: 5671578 - DNA, 22 bp, Homo sapiens
tgtctccaaccccccagcactg

SEQ ID NO: 5671579 - DNA, 20 bp, Homo sapiens
tgtctccaagtagtccacct

SEQ ID NO: 5671580 - DNA, 18 bp, Homo sapiens
tgtctccacccaccttga

SEQ ID NO: 5671581 - DNA, 22 bp, Homo sapiens
tgtctccacctacacccctgtg

SEQ ID NO: 5671582 - DNA, 21 bp, Homo sapiens
tgtctccactaaatgagctcc

SEQ ID NO: 5671583 - DNA, 23 bp, Homo sapiens
tgtctccactaaatgagctcctg

SEQ ID NO: 5671584 - DNA, 19 bp, Homo sapiens
tgtctccacttgtatatat

SEQ ID NO: 5671585 - DNA, 22 bp, Homo sapiens
tgtctccagacccccacccctt

SEQ ID NO: 5671586 - DNA, 23 bp, Homo sapiens
tgtctccagacccccaccccttc

SEQ ID NO: 5671587 - DNA, 14 bp, Homo sapiens
tgtctccagctgcc

SEQ ID NO: 5671588 - DNA, 15 bp, Homo sapiens
tgtctccagcttccc

SEQ ID NO: 5671589 - DNA, 18 bp, Homo sapiens
tgtctccaggatggtgca

SEQ ID NO: 5671590 - DNA, 19 bp, Homo sapiens
tgtctccagggcccccacc

SEQ ID NO: 5671591 - DNA, 16 bp, Homo sapiens
tgtctcccaacatggg

SEQ ID NO: 5671592 - DNA, 22 bp, Homo sapiens
tgtctcccaacatgggagggat

SEQ ID NO: 5671593 - DNA, 13 bp, Homo sapiens
tgtctcccacacc

SEQ ID NO: 5671594 - DNA, 11 bp, Homo sapiens
tgtctcccagg

SEQ ID NO: 5671595 - DNA, 15 bp, Homo sapiens
tgtctcccaggctgg

SEQ ID NO: 5671596 - DNA, 16 bp, Homo sapiens
tgtctcccagggacat

SEQ ID NO: 5671597 - DNA, 19 bp, Homo sapiens
tgtctccccagttccacag

SEQ ID NO: 5671598 - DNA, 12 bp, Homo sapiens
tgtctcccctct

SEQ ID NO: 5671599 - DNA, 24 bp, Homo sapiens
tgtctcccgccccccacacttccc

SEQ ID NO: 5671600 - DNA, 18 bp, Homo sapiens
tgtctcccgtgcatgctc

SEQ ID NO: 5671601 - DNA, 20 bp, Homo sapiens
tgtctcccgtgcatgctctg

SEQ ID NO: 5671602 - DNA, 23 bp, Homo sapiens
tgtctccctataatgctggagcg

SEQ ID NO: 5671603 - DNA, 21 bp, Homo sapiens
tgtctccctcccctctcagaa

SEQ ID NO: 5671604 - DNA, 23 bp, Homo sapiens
tgtctccctcccctctcagaaca

SEQ ID NO: 5671605 - DNA, 12 bp, Homo sapiens
tgtctccctcct

SEQ ID NO: 5671606 - DNA, 13 bp, Homo sapiens
tgtctccctcctg

SEQ ID NO: 5671607 - DNA, 11 bp, Homo sapiens
tgtctccctcg

SEQ ID NO: 5671608 - DNA, 21 bp, Homo sapiens
tgtctccctcgggggctcttc

SEQ ID NO: 5671609 - DNA, 16 bp, Homo sapiens
tgtctccctgaagagt

SEQ ID NO: 5671610 - DNA, 14 bp, Homo sapiens
tgtctccctggccc

SEQ ID NO: 5671611 - DNA, 20 bp, Homo sapiens
tgtctccctggttgcctctc

SEQ ID NO: 5671612 - DNA, 16 bp, Homo sapiens
tgtctcccttacctcg

SEQ ID NO: 5671613 - DNA, 13 bp, Homo sapiens
tgtctcccttctc

SEQ ID NO: 5671614 - DNA, 19 bp, Homo sapiens
tgtctcccttcttgggtag

SEQ ID NO: 5671615 - DNA, 13 bp, Homo sapiens
tgtctcctaagca

SEQ ID NO: 5671616 - DNA, 17 bp, Homo sapiens
tgtctcctactcctgac

SEQ ID NO: 5671617 - DNA, 17 bp, Homo sapiens
tgtctcctactgaggat

SEQ ID NO: 5671618 - DNA, 18 bp, Homo sapiens
tgtctcctatatatttct

SEQ ID NO: 5671619 - DNA, 16 bp, Homo sapiens
tgtctcctcaagcctg

SEQ ID NO: 5671620 - DNA, 18 bp, Homo sapiens
tgtctcctcaagcctgtg

SEQ ID NO: 5671621 - DNA, 19 bp, Homo sapiens
tgtctcctcaagcctgtgg

SEQ ID NO: 5671622 - DNA, 17 bp, Homo sapiens
tgtctcctccctgggct

SEQ ID NO: 5671623 - DNA, 11 bp, Homo sapiens
tgtctcctggc

SEQ ID NO: 5671624 - DNA, 21 bp, Homo sapiens
tgtctcctggcggttcctcgt

SEQ ID NO: 5671625 - DNA, 18 bp, Homo sapiens
tgtctcctggtctgtgct

SEQ ID NO: 5671626 - DNA, 13 bp, Homo sapiens
tgtctcctgtttc

SEQ ID NO: 5671627 - DNA, 18 bp, Homo sapiens
tgtctcctgtttcagacc

SEQ ID NO: 5671628 - DNA, 20 bp, Homo sapiens
tgtctcctgtttcagaccag

SEQ ID NO: 5671629 - DNA, 17 bp, Homo sapiens
tgtctccttaacactga

SEQ ID NO: 5671630 - DNA, 18 bp, Homo sapiens
tgtctccttaacactgag

SEQ ID NO: 5671631 - DNA, 21 bp, Homo sapiens
tgtctccttaagctgcagaga

SEQ ID NO: 5671632 - DNA, 13 bp, Homo sapiens
tgtctccttccca

SEQ ID NO: 5671633 - DNA, 22 bp, Homo sapiens
tgtctcctttcaccccagggcc

SEQ ID NO: 5671634 - DNA, 13 bp, Homo sapiens
tgtctcctttgct

SEQ ID NO: 5671635 - DNA, 15 bp, Homo sapiens
tgtctcctttgctct

SEQ ID NO: 5671636 - DNA, 15 bp, Homo sapiens
tgtctcgagcgccct

SEQ ID NO: 5671637 - DNA, 17 bp, Homo sapiens
tgtctcgccagaagact

SEQ ID NO: 5671638 - DNA, 19 bp, Homo sapiens
tgtctcgctatactgcact

SEQ ID NO: 5671639 - DNA, 16 bp, Homo sapiens
tgtctcgggctgaccc

SEQ ID NO: 5671640 - DNA, 18 bp, Homo sapiens
tgtctcgggctgaccctt

SEQ ID NO: 5671641 - DNA, 22 bp, Homo sapiens
tgtctcgggctgacccttttct

SEQ ID NO: 5671642 - DNA, 14 bp, Homo sapiens
tgtctcgtctcctg

SEQ ID NO: 5671643 - DNA, 20 bp, Homo sapiens
tgtctcgtctcctgacatgt

SEQ ID NO: 5671644 - DNA, 21 bp, Homo sapiens
tgtctcgtggtaggactgtag

SEQ ID NO: 5671645 - DNA, 17 bp, Homo sapiens
tgtctcgtgtacagctc

SEQ ID NO: 5671646 - DNA, 18 bp, Homo sapiens
tgtctcgtgtcagtaatt

SEQ ID NO: 5671647 - DNA, 22 bp, Homo sapiens
tgtctctaaccattcaaatgac

SEQ ID NO: 5671648 - DNA, 21 bp, Homo sapiens
tgtctctacaaaaaaaatcaa

SEQ ID NO: 5671649 - DNA, 21 bp, Homo sapiens
tgtctctacccactatgcaca

SEQ ID NO: 5671650 - DNA, 17 bp, Homo sapiens
tgtctctactaaaaata

SEQ ID NO: 5671651 - DNA, 22 bp, Homo sapiens
tgtctctactaaaacgataaaa

SEQ ID NO: 5671652 - DNA, 20 bp, Homo sapiens
tgtctctagaagtgccatct

SEQ ID NO: 5671653 - DNA, 18 bp, Homo sapiens
tgtctctagcagtgagta

SEQ ID NO: 5671654 - DNA, 20 bp, Homo sapiens
tgtctctagttgacttcaaa

SEQ ID NO: 5671655 - DNA, 22 bp, Homo sapiens
tgtctctagtttctttctgtta

SEQ ID NO: 5671656 - DNA, 18 bp, Homo sapiens
tgtctctatctgaaccac

SEQ ID NO: 5671657 - DNA, 16 bp, Homo sapiens
tgtctctattagctgg

SEQ ID NO: 5671658 - DNA, 18 bp, Homo sapiens
tgtctctcagggccaggc

SEQ ID NO: 5671659 - DNA, 13 bp, Homo sapiens
tgtctctcattct

SEQ ID NO: 5671660 - DNA, 16 bp, Homo sapiens
tgtctctcattctctt

SEQ ID NO: 5671661 - DNA, 21 bp, Homo sapiens
tgtctctcattctctttcttt

SEQ ID NO: 5671662 - DNA, 11 bp, Homo sapiens
tgtctctccca

SEQ ID NO: 5671663 - DNA, 18 bp, Homo sapiens
tgtctctcccaccccggc

SEQ ID NO: 5671664 - DNA, 22 bp, Homo sapiens
tgtctctcccaccccggcctcc

SEQ ID NO: 5671665 - DNA, 19 bp, Homo sapiens
tgtctctccctaccctctt

SEQ ID NO: 5671666 - DNA, 23 bp, Homo sapiens
tgtctctcctagcccctctctca

SEQ ID NO: 5671667 - DNA, 15 bp, Homo sapiens
tgtctctcctggctg

SEQ ID NO: 5671668 - DNA, 17 bp, Homo sapiens
tgtctctcctggctggg

SEQ ID NO: 5671669 - DNA, 22 bp, Homo sapiens
tgtctctctggcaatcttgccc

SEQ ID NO: 5671670 - DNA, 18 bp, Homo sapiens
tgtctctcttcagactct

SEQ ID NO: 5671671 - DNA, 23 bp, Homo sapiens
tgtctctcttcggtggccttgag

SEQ ID NO: 5671672 - DNA, 15 bp, Homo sapiens
tgtctctcttgcttt

SEQ ID NO: 5671673 - DNA, 12 bp, Homo sapiens
tgtctctcttgt

SEQ ID NO: 5671674 - DNA, 17 bp, Homo sapiens
tgtctctgaggctctcc

SEQ ID NO: 5671675 - DNA, 18 bp, Homo sapiens
tgtctctgaggctctcca

SEQ ID NO: 5671676 - DNA, 19 bp, Homo sapiens
tgtctctgatgcagcttat

SEQ ID NO: 5671677 - DNA, 20 bp, Homo sapiens
tgtctctgatgcagcttata

SEQ ID NO: 5671678 - DNA, 18 bp, Homo sapiens
tgtctctgcaaactgcct

SEQ ID NO: 5671679 - DNA, 19 bp, Homo sapiens
tgtctctgcatccatttga

SEQ ID NO: 5671680 - DNA, 13 bp, Homo sapiens
tgtctctgccatg

SEQ ID NO: 5671681 - DNA, 13 bp, Homo sapiens
tgtctctgcctgg

SEQ ID NO: 5671682 - DNA, 18 bp, Homo sapiens
tgtctctgcctggagcag

SEQ ID NO: 5671683 - DNA, 19 bp, Homo sapiens
tgtctctgcctggagcagg

SEQ ID NO: 5671684 - DNA, 12 bp, Homo sapiens
tgtctctgcctt

SEQ ID NO: 5671685 - DNA, 17 bp, Homo sapiens
tgtctctgctcttgcct

SEQ ID NO: 5671686 - DNA, 17 bp, Homo sapiens
atgttaaatatttgtcc

SEQ ID NO: 5671687 - DNA, 12 bp, Homo sapiens
atgttaaatcta

SEQ ID NO: 5671688 - DNA, 14 bp, Homo sapiens
atgttaaatctaca

SEQ ID NO: 5671689 - DNA, 19 bp, Homo sapiens
atgttaaatctacaaactt

SEQ ID NO: 5671690 - DNA, 12 bp, Homo sapiens
atgttaaatgac

SEQ ID NO: 5671691 - DNA, 13 bp, Homo sapiens
atgttaaatgact

SEQ ID NO: 5671692 - DNA, 14 bp, Homo sapiens
atgttaaatgactt

SEQ ID NO: 5671693 - DNA, 13 bp, Homo sapiens
atgttaaatgcaa

SEQ ID NO: 5671694 - DNA, 14 bp, Homo sapiens
atgttaaatggaat

SEQ ID NO: 5671695 - DNA, 16 bp, Homo sapiens
atgttaaatggaattc

SEQ ID NO: 5671696 - DNA, 15 bp, Homo sapiens
atgttaaatttgtaa

SEQ ID NO: 5671697 - DNA, 22 bp, Homo sapiens
atgttaacaagaggggaaaaca

SEQ ID NO: 5671698 - DNA, 18 bp, Homo sapiens
atgttaacaatgcctatt

SEQ ID NO: 5671699 - DNA, 22 bp, Homo sapiens
atgttaacaatgcctattgtaa

SEQ ID NO: 5671700 - DNA, 13 bp, Homo sapiens
atgttaacacatt

SEQ ID NO: 5671701 - DNA, 16 bp, Homo sapiens
atgttaacacattttg

SEQ ID NO: 5671702 - DNA, 23 bp, Homo sapiens
atgttaaccagaataaagttctg

SEQ ID NO: 5671703 - DNA, 16 bp, Homo sapiens
atgttaacctctgctt

SEQ ID NO: 5671704 - DNA, 19 bp, Homo sapiens
atgttaacctctgctttta

SEQ ID NO: 5671705 - DNA, 21 bp, Homo sapiens
atgttaacttggttctcagac

SEQ ID NO: 5671706 - DNA, 15 bp, Homo sapiens
atgttaagaaccaaa

SEQ ID NO: 5671707 - DNA, 21 bp, Homo sapiens
atgttaagaaccaaactccta

SEQ ID NO: 5671708 - DNA, 16 bp, Homo sapiens
atgttaagacttgaca

SEQ ID NO: 5671709 - DNA, 21 bp, Homo sapiens
atgttaagataacttactgta

SEQ ID NO: 5671710 - DNA, 21 bp, Homo sapiens
atgttaagcagctaaattttc

SEQ ID NO: 5671711 - DNA, 15 bp, Homo sapiens
atgttaagcatttat

SEQ ID NO: 5671712 - DNA, 13 bp, Homo sapiens
atgttaagctctt

SEQ ID NO: 5671713 - DNA, 23 bp, Homo sapiens
atgttaagcttctattttttact

SEQ ID NO: 5671714 - DNA, 19 bp, Homo sapiens
atgttaaggaaactcttat

SEQ ID NO: 5671715 - DNA, 19 bp, Homo sapiens
atgttaagtcctccctgac

SEQ ID NO: 5671716 - DNA, 17 bp, Homo sapiens
atgttaagttacttcac

SEQ ID NO: 5671717 - DNA, 21 bp, Homo sapiens
atgttaatagaaaatatattt

SEQ ID NO: 5671718 - DNA, 18 bp, Homo sapiens
atgttaatatctgatact

SEQ ID NO: 5671719 - DNA, 15 bp, Homo sapiens
atgttaatattgatt

SEQ ID NO: 5671720 - DNA, 16 bp, Homo sapiens
atgttaatattttatg

SEQ ID NO: 5671721 - DNA, 14 bp, Homo sapiens
atgttaattaaact

SEQ ID NO: 5671722 - DNA, 20 bp, Homo sapiens
atgttaattaaactgaagaa

SEQ ID NO: 5671723 - DNA, 23 bp, Homo sapiens
atgttaattcagcactgatttca

SEQ ID NO: 5671724 - DNA, 13 bp, Homo sapiens
atgttaatttgtt

SEQ ID NO: 5671725 - DNA, 14 bp, Homo sapiens
atgttaatttgtta

SEQ ID NO: 5671726 - DNA, 17 bp, Homo sapiens
atgttaattttttggta

SEQ ID NO: 5671727 - DNA, 23 bp, Homo sapiens
atgttaattttttggtacaaaaa

SEQ ID NO: 5671728 - DNA, 16 bp, Homo sapiens
atgttacaacaactat

SEQ ID NO: 5671729 - DNA, 17 bp, Homo sapiens
atgttacaagtttatat

SEQ ID NO: 5671730 - DNA, 20 bp, Homo sapiens
atgttacaagtttatatata

SEQ ID NO: 5671731 - DNA, 18 bp, Homo sapiens
atgttacaagtttgctaa

SEQ ID NO: 5671732 - DNA, 19 bp, Homo sapiens
atgttacacattaaacagg

SEQ ID NO: 5671733 - DNA, 20 bp, Homo sapiens
atgttacacattaaacagga

SEQ ID NO: 5671734 - DNA, 17 bp, Homo sapiens
atgttacactaagggtg

SEQ ID NO: 5671735 - DNA, 13 bp, Homo sapiens
atgttacagcatc

SEQ ID NO: 5671736 - DNA, 21 bp, Homo sapiens
atgttacagtccagttttgtg

SEQ ID NO: 5671737 - DNA, 19 bp, Homo sapiens
atgttacataagataaatg

SEQ ID NO: 5671738 - DNA, 12 bp, Homo sapiens
atgttacattag

SEQ ID NO: 5671739 - DNA, 16 bp, Homo sapiens
atgttaccattaatca

SEQ ID NO: 5671740 - DNA, 15 bp, Homo sapiens
atgttacctctgaat

SEQ ID NO: 5671741 - DNA, 15 bp, Homo sapiens
atgttactaaatggt

SEQ ID NO: 5671742 - DNA, 14 bp, Homo sapiens
atgttactattttc

SEQ ID NO: 5671743 - DNA, 23 bp, Homo sapiens
atgttactattttctacaattaa

SEQ ID NO: 5671744 - DNA, 18 bp, Homo sapiens
atgttactcagtgttaga

SEQ ID NO: 5671745 - DNA, 21 bp, Homo sapiens
atgttactccctgttttagtt

SEQ ID NO: 5671746 - DNA, 17 bp, Homo sapiens
atgttactctcttgcac

SEQ ID NO: 5671747 - DNA, 14 bp, Homo sapiens
atgttactgaccag

SEQ ID NO: 5671748 - DNA, 15 bp, Homo sapiens
atgttactgagatgt

SEQ ID NO: 5671749 - DNA, 16 bp, Homo sapiens
atgttactgatcatgc

SEQ ID NO: 5671750 - DNA, 20 bp, Homo sapiens
atgttactgatcatgcattg

SEQ ID NO: 5671751 - DNA, 15 bp, Homo sapiens
atgttactgcttcat

SEQ ID NO: 5671752 - DNA, 21 bp, Homo sapiens
atgttactgtatttttcagaa

SEQ ID NO: 5671753 - DNA, 16 bp, Homo sapiens
atgttactgtgtgaag

SEQ ID NO: 5671754 - DNA, 14 bp, Homo sapiens
atgttacttaaaca

SEQ ID NO: 5671755 - DNA, 21 bp, Homo sapiens
atgttacttattttaaaataa

SEQ ID NO: 5671756 - DNA, 17 bp, Homo sapiens
atgttacttctctgagt

SEQ ID NO: 5671757 - DNA, 19 bp, Homo sapiens
atgttacttctctgagttt

SEQ ID NO: 5671758 - DNA, 14 bp, Homo sapiens
atgttacttgagaa

SEQ ID NO: 5671759 - DNA, 20 bp, Homo sapiens
atgttacttgagaagtgctt

SEQ ID NO: 5671760 - DNA, 22 bp, Homo sapiens
atgttagactcatggtgtgtta

SEQ ID NO: 5671761 - DNA, 24 bp, Homo sapiens
atgttagactcatggtgtgttaca

SEQ ID NO: 5671762 - DNA, 15 bp, Homo sapiens
atgttagacttgtgt

SEQ ID NO: 5671763 - DNA, 23 bp, Homo sapiens
atgttagaggatccctctctgga

SEQ ID NO: 5671764 - DNA, 20 bp, Homo sapiens
atgttagatgcttagtgtga

SEQ ID NO: 5671765 - DNA, 21 bp, Homo sapiens
atgttagattaggtgtaagac

SEQ ID NO: 5671766 - DNA, 21 bp, Homo sapiens
atgttagcagacccagcttag

SEQ ID NO: 5671767 - DNA, 18 bp, Homo sapiens
atgttagcattaaagttc

SEQ ID NO: 5671768 - DNA, 12 bp, Homo sapiens
atgttagccagg

SEQ ID NO: 5671769 - DNA, 18 bp, Homo sapiens
atgttaggaaaatttcac

SEQ ID NO: 5671770 - DNA, 16 bp, Homo sapiens
atgttaggggtattta

SEQ ID NO: 5671771 - DNA, 23 bp, Homo sapiens
atgttagggtataagttgctgta

SEQ ID NO: 5671772 - DNA, 16 bp, Homo sapiens
atgttagggttatgtt

SEQ ID NO: 5671773 - DNA, 17 bp, Homo sapiens
atgttaggtgacattga

SEQ ID NO: 5671774 - DNA, 14 bp, Homo sapiens
atgttagtaaagga

SEQ ID NO: 5671775 - DNA, 15 bp, Homo sapiens
atgttagtaatacct

SEQ ID NO: 5671776 - DNA, 19 bp, Homo sapiens
atgttagtaatggcagagc

SEQ ID NO: 5671777 - DNA, 16 bp, Homo sapiens
atgttagtagcactga

SEQ ID NO: 5671778 - DNA, 15 bp, Homo sapiens
atgttagtcattgtt

SEQ ID NO: 5671779 - DNA, 18 bp, Homo sapiens
atgttagtgttttaagaa

SEQ ID NO: 5671780 - DNA, 20 bp, Homo sapiens
atgttagttaccttatagtt

SEQ ID NO: 5671781 - DNA, 21 bp, Homo sapiens
atgttagttaccttatagtta

SEQ ID NO: 5671782 - DNA, 12 bp, Homo sapiens
atgttagttcta

SEQ ID NO: 5671783 - DNA, 14 bp, Homo sapiens
atgttagttttaga

SEQ ID NO: 5671784 - DNA, 15 bp, Homo sapiens
atgttagttttcctt

SEQ ID NO: 5671785 - DNA, 20 bp, Homo sapiens
atgttagttttgctccttct

SEQ ID NO: 5671786 - DNA, 21 bp, Homo sapiens
atgttatacatcaatatgtat

SEQ ID NO: 5671787 - DNA, 14 bp, Homo sapiens
atgttatagctgca

SEQ ID NO: 5671788 - DNA, 14 bp, Homo sapiens
atgttatagtgaat

SEQ ID NO: 5671789 - DNA, 17 bp, Homo sapiens
atgttatatataaatat

SEQ ID NO: 5671790 - DNA, 13 bp, Homo sapiens
atgttatatattt

SEQ ID NO: 5671791 - DNA, 17 bp, Homo sapiens
atgttatatattttttg

SEQ ID NO: 5671792 - DNA, 16 bp, Homo sapiens
atgttatatcatatgt

SEQ ID NO: 5671793 - DNA, 19 bp, Homo sapiens
atgttatatcatatgtata

SEQ ID NO: 5671794 - DNA, 14 bp, Homo sapiens
atgttatattaaag

SEQ ID NO: 5671795 - DNA, 16 bp, Homo sapiens
atgttatattaaagaa

SEQ ID NO: 5671796 - DNA, 14 bp, Homo sapiens
atgttatatttttc

SEQ ID NO: 5671797 - DNA, 23 bp, Homo sapiens
atgttatatttttcttaaaaagt

SEQ ID NO: 5671798 - DNA, 21 bp, Homo sapiens
atgttatcaaccaactgcaca

SEQ ID NO: 5671799 - DNA, 21 bp, Homo sapiens
atgttatccaactattaagat

SEQ ID NO: 5671800 - DNA, 19 bp, Homo sapiens
atgttatcggattactgaa

SEQ ID NO: 5671801 - DNA, 20 bp, Homo sapiens
atgttatcggattactgaat

SEQ ID NO: 5671802 - DNA, 14 bp, Homo sapiens
atgttatcttaaca

SEQ ID NO: 5671803 - DNA, 20 bp, Homo sapiens
atgttatcttctcaagttct

SEQ ID NO: 5671804 - DNA, 20 bp, Homo sapiens
atgttatgaacagctgtgtc

SEQ ID NO: 5671805 - DNA, 22 bp, Homo sapiens
atgttatgaggacgtgtctgtt

SEQ ID NO: 5671806 - DNA, 14 bp, Homo sapiens
atgttatgcagtga

SEQ ID NO: 5671807 - DNA, 17 bp, Homo sapiens
atgttatgcataaagtc

SEQ ID NO: 5671808 - DNA, 18 bp, Homo sapiens
atgttatgcccagcgttt

SEQ ID NO: 5671809 - DNA, 19 bp, Homo sapiens
atgttatggcttattgtgt

SEQ ID NO: 5671810 - DNA, 17 bp, Homo sapiens
atgttatgggatgtaaa

SEQ ID NO: 5671811 - DNA, 18 bp, Homo sapiens
atgttatgggatgtaaac

SEQ ID NO: 5671812 - DNA, 23 bp, Homo sapiens
atgttatgggatgtaaacaatgt

SEQ ID NO: 5671813 - DNA, 13 bp, Homo sapiens
atgttatgtaaaa

SEQ ID NO: 5671814 - DNA, 14 bp, Homo sapiens
atgttatgtaaaag

SEQ ID NO: 5671815 - DNA, 13 bp, Homo sapiens
atgttatgtatat

SEQ ID NO: 5671816 - DNA, 12 bp, Homo sapiens
atgttatgttta

SEQ ID NO: 5671817 - DNA, 15 bp, Homo sapiens
atgttattaaacagg

SEQ ID NO: 5671818 - DNA, 18 bp, Homo sapiens
atgttattactgaggaaa

SEQ ID NO: 5671819 - DNA, 17 bp, Homo sapiens
atgttattactgttttg

SEQ ID NO: 5671820 - DNA, 22 bp, Homo sapiens
atgttattactgttttgggcct

SEQ ID NO: 5671821 - DNA, 15 bp, Homo sapiens
atgttattacttgta

SEQ ID NO: 5671822 - DNA, 15 bp, Homo sapiens
atgttattagatgtt

SEQ ID NO: 5671823 - DNA, 21 bp, Homo sapiens
atgttattattaccagcattt

SEQ ID NO: 5671824 - DNA, 16 bp, Homo sapiens
atgttattcaataact

SEQ ID NO: 5671825 - DNA, 13 bp, Homo sapiens
atgttattgaaaa

SEQ ID NO: 5671826 - DNA, 17 bp, Homo sapiens
atgttattggaattttc

SEQ ID NO: 5671827 - DNA, 23 bp, Homo sapiens
atgttatttaacagctgaattat

SEQ ID NO: 5671828 - DNA, 12 bp, Homo sapiens
atgttatttata

SEQ ID NO: 5671829 - DNA, 19 bp, Homo sapiens
atgttatttatgatgttat

SEQ ID NO: 5671830 - DNA, 19 bp, Homo sapiens
atgttatttgtaatagatg

SEQ ID NO: 5671831 - DNA, 22 bp, Homo sapiens
atgttatttgttattttcagta

SEQ ID NO: 5671832 - DNA, 17 bp, Homo sapiens
atgttattttcagtgct

SEQ ID NO: 5671833 - DNA, 14 bp, Homo sapiens
atgttatttttgta

SEQ ID NO: 5671834 - DNA, 13 bp, Homo sapiens
atgttcaaaagaa

SEQ ID NO: 5671835 - DNA, 23 bp, Homo sapiens
atgttcaaagtcaaataactcct

SEQ ID NO: 5671836 - DNA, 13 bp, Homo sapiens
atgttcaaattca

SEQ ID NO: 5671837 - DNA, 17 bp, Homo sapiens
atgttcaatagaacatg

SEQ ID NO: 5671838 - DNA, 18 bp, Homo sapiens
atgttcaattatttcccc

SEQ ID NO: 5671839 - DNA, 18 bp, Homo sapiens
atgttcacttttgacaaa

SEQ ID NO: 5671840 - DNA, 20 bp, Homo sapiens
atgttcagaacttcatctgc

SEQ ID NO: 5671841 - DNA, 16 bp, Homo sapiens
atgttcagaagaaatt

SEQ ID NO: 5671842 - DNA, 23 bp, Homo sapiens
atgttcagaaggttgctctagat

SEQ ID NO: 5671843 - DNA, 16 bp, Homo sapiens
atgttcagaattttgg

SEQ ID NO: 5671844 - DNA, 16 bp, Homo sapiens
atgttcagcactgtcc

SEQ ID NO: 5671845 - DNA, 17 bp, Homo sapiens
atgttcaggaaatgaaa

SEQ ID NO: 5671846 - DNA, 14 bp, Homo sapiens
atgttcagtgtaat

SEQ ID NO: 5671847 - DNA, 18 bp, Homo sapiens
atgttcagtgtaatttct

SEQ ID NO: 5671848 - DNA, 21 bp, Homo sapiens
atgttcagtgtaatttctttg

SEQ ID NO: 5671849 - DNA, 14 bp, Homo sapiens
atgttcataaaaaa

SEQ ID NO: 5671850 - DNA, 18 bp, Homo sapiens
atgttcatatgtacttgt

SEQ ID NO: 5671851 - DNA, 15 bp, Homo sapiens
atgttcatattggat

SEQ ID NO: 5671852 - DNA, 18 bp, Homo sapiens
atgttcatatttattgat

SEQ ID NO: 5671853 - DNA, 19 bp, Homo sapiens
atgttcatatttattgatt

SEQ ID NO: 5671854 - DNA, 21 bp, Homo sapiens
atgttcatgatagaaagaata

SEQ ID NO: 5671855 - DNA, 15 bp, Homo sapiens
atgttcatgatttca

SEQ ID NO: 5671856 - DNA, 19 bp, Homo sapiens
atgttcatgatttcaagat

SEQ ID NO: 5671857 - DNA, 15 bp, Homo sapiens
atgttcatggaattg

SEQ ID NO: 5671858 - DNA, 18 bp, Homo sapiens
atgttcatgtaagaagcc

SEQ ID NO: 5671859 - DNA, 15 bp, Homo sapiens
atgttcatgtgatta

SEQ ID NO: 5671860 - DNA, 20 bp, Homo sapiens
atgttcatgtgtaacttcta

SEQ ID NO: 5671861 - DNA, 21 bp, Homo sapiens
atgttcatgtgtaacttctag

SEQ ID NO: 5671862 - DNA, 17 bp, Homo sapiens
atgttcattaaattttc

SEQ ID NO: 5671863 - DNA, 21 bp, Homo sapiens
atgttcattgtaatgttactg

SEQ ID NO: 5671864 - DNA, 16 bp, Homo sapiens
atgttggttgcacttt

SEQ ID NO: 5671865 - DNA, 16 bp, Homo sapiens
atgttggtttactttc

SEQ ID NO: 5671866 - DNA, 15 bp, Homo sapiens
atgttggtttcagtg

SEQ ID NO: 5671867 - DNA, 11 bp, Homo sapiens
atgttggtttt

SEQ ID NO: 5671868 - DNA, 18 bp, Homo sapiens
atgttggttttttataaa

SEQ ID NO: 5671869 - DNA, 20 bp, Homo sapiens
atgttggttttttataaagt

SEQ ID NO: 5671870 - DNA, 21 bp, Homo sapiens
atgttggttttttataaagtc

SEQ ID NO: 5671871 - DNA, 14 bp, Homo sapiens
atgttgtaaaatga

SEQ ID NO: 5671872 - DNA, 15 bp, Homo sapiens
atgttgtaaaatgaa

SEQ ID NO: 5671873 - DNA, 12 bp, Homo sapiens
atgttgtaaata

SEQ ID NO: 5671874 - DNA, 22 bp, Homo sapiens
atgttgtaaattaggaggctca

SEQ ID NO: 5671875 - DNA, 14 bp, Homo sapiens
atgttgtaagcaac

SEQ ID NO: 5671876 - DNA, 12 bp, Homo sapiens
atgttgtaatat

SEQ ID NO: 5671877 - DNA, 19 bp, Homo sapiens
atgttgtaatatttcttca

SEQ ID NO: 5671878 - DNA, 14 bp, Homo sapiens
atgttgtaatgctg

SEQ ID NO: 5671879 - DNA, 16 bp, Homo sapiens
atgttgtaatgctgca

SEQ ID NO: 5671880 - DNA, 14 bp, Homo sapiens
atgttgtacaatca

SEQ ID NO: 5671881 - DNA, 15 bp, Homo sapiens
atgttgtacttgaaa

SEQ ID NO: 5671882 - DNA, 21 bp, Homo sapiens
atgttgtagatacaatcagct

SEQ ID NO: 5671883 - DNA, 19 bp, Homo sapiens
atgttgtagtgtcccccac

SEQ ID NO: 5671884 - DNA, 17 bp, Homo sapiens
atgttgtattaactggg

SEQ ID NO: 5671885 - DNA, 23 bp, Homo sapiens
atgttgtattgatttttaagaaa

SEQ ID NO: 5671886 - DNA, 15 bp, Homo sapiens
atgttgtcaaagaga

SEQ ID NO: 5671887 - DNA, 15 bp, Homo sapiens
atgttgtcaggaatc

SEQ ID NO: 5671888 - DNA, 18 bp, Homo sapiens
atgttgtcataacattta

SEQ ID NO: 5671889 - DNA, 21 bp, Homo sapiens
atgttgtcataacatttaaag

SEQ ID NO: 5671890 - DNA, 23 bp, Homo sapiens
atgttgtccaacaataaacagga

SEQ ID NO: 5671891 - DNA, 14 bp, Homo sapiens
atgttgtctaagaa

SEQ ID NO: 5671892 - DNA, 12 bp, Homo sapiens
atgttgtgaata

SEQ ID NO: 5671893 - DNA, 19 bp, Homo sapiens
atgttgtgaataattacag

SEQ ID NO: 5671894 - DNA, 19 bp, Homo sapiens
atgttgtgtattgtggttt

SEQ ID NO: 5671895 - DNA, 15 bp, Homo sapiens
atgttgtgtggcaat

SEQ ID NO: 5671896 - DNA, 17 bp, Homo sapiens
atgttgtgtgttgcact

SEQ ID NO: 5671897 - DNA, 19 bp, Homo sapiens
atgttgtgttgttatcatt

SEQ ID NO: 5671898 - DNA, 13 bp, Homo sapiens
atgttgttaaaca

SEQ ID NO: 5671899 - DNA, 23 bp, Homo sapiens
atgttgttaaacacgtgtctata

SEQ ID NO: 5671900 - DNA, 15 bp, Homo sapiens
atgttgttaaatgct

SEQ ID NO: 5671901 - DNA, 13 bp, Homo sapiens
atgttgttattta

SEQ ID NO: 5671902 - DNA, 14 bp, Homo sapiens
atgttgttatttaa

SEQ ID NO: 5671903 - DNA, 16 bp, Homo sapiens
atgttgttcccacaca

SEQ ID NO: 5671904 - DNA, 22 bp, Homo sapiens
atgttgttcgatcgtttcacat

SEQ ID NO: 5671905 - DNA, 23 bp, Homo sapiens
atgttgttctaaaggctgttaaa

SEQ ID NO: 5671906 - DNA, 18 bp, Homo sapiens
atgttgttgaactaatat

SEQ ID NO: 5671907 - DNA, 20 bp, Homo sapiens
atgttgttgaggctgtcaca

SEQ ID NO: 5671908 - DNA, 23 bp, Homo sapiens
atgttgtttcctaatatcaaatg

SEQ ID NO: 5671909 - DNA, 16 bp, Homo sapiens
atgttgtttgggagag

SEQ ID NO: 5671910 - DNA, 21 bp, Homo sapiens
atgttgttttgtacagatgtg

SEQ ID NO: 5671911 - DNA, 18 bp, Homo sapiens
atgtttaaaaaaacatta

SEQ ID NO: 5671912 - DNA, 16 bp, Homo sapiens
atgtttaaaacacctt

SEQ ID NO: 5671913 - DNA, 13 bp, Homo sapiens
atgtttaaaagca

SEQ ID NO: 5671914 - DNA, 17 bp, Homo sapiens
atgtttaaaataaaatg

SEQ ID NO: 5671915 - DNA, 18 bp, Homo sapiens
atgtttaaaataaaatga

SEQ ID NO: 5671916 - DNA, 15 bp, Homo sapiens
atgtttaaaatggca

SEQ ID NO: 5671917 - DNA, 16 bp, Homo sapiens
atgtttaaaatggcat

SEQ ID NO: 5671918 - DNA, 22 bp, Homo sapiens
atgtttaaaatggcatttagca

SEQ ID NO: 5671919 - DNA, 14 bp, Homo sapiens
atgtttaaaccttt

SEQ ID NO: 5671920 - DNA, 22 bp, Homo sapiens
atgtttaaagtaattgttccag

SEQ ID NO: 5671921 - DNA, 15 bp, Homo sapiens
atgtttaaatagcct

SEQ ID NO: 5671922 - DNA, 17 bp, Homo sapiens
atgtttaaatcatgtat

SEQ ID NO: 5671923 - DNA, 22 bp, Homo sapiens
atgtttaaatcatgtatgttat

SEQ ID NO: 5671924 - DNA, 13 bp, Homo sapiens
atgtttaaattgt

SEQ ID NO: 5671925 - DNA, 17 bp, Homo sapiens
atgtttaacaaatctaa

SEQ ID NO: 5671926 - DNA, 19 bp, Homo sapiens
atgtttaacatcattgcat

SEQ ID NO: 5671927 - DNA, 19 bp, Homo sapiens
atgtttaagaaatgagaaa

SEQ ID NO: 5671928 - DNA, 16 bp, Homo sapiens
atgtttaagcagaatt

SEQ ID NO: 5671929 - DNA, 16 bp, Homo sapiens
atgtttaataaagctt

SEQ ID NO: 5671930 - DNA, 18 bp, Homo sapiens
atgtttaatcaagagaga

SEQ ID NO: 5671931 - DNA, 17 bp, Homo sapiens
atgtttaatcatataaa

SEQ ID NO: 5671932 - DNA, 20 bp, Homo sapiens
atgtttaatggtgaaagttg

SEQ ID NO: 5671933 - DNA, 16 bp, Homo sapiens
atgtttaattcattaa

SEQ ID NO: 5671934 - DNA, 13 bp, Homo sapiens
atgtttaattgtg

SEQ ID NO: 5671935 - DNA, 15 bp, Homo sapiens
atgtttacaatgatg

SEQ ID NO: 5671936 - DNA, 19 bp, Homo sapiens
atgtttacactctttgtaa

SEQ ID NO: 5671937 - DNA, 15 bp, Homo sapiens
atgtttacagaactg

SEQ ID NO: 5671938 - DNA, 13 bp, Homo sapiens
atgtttacatatc

SEQ ID NO: 5671939 - DNA, 20 bp, Homo sapiens
atgtttacatatcacctcat

SEQ ID NO: 5671940 - DNA, 16 bp, Homo sapiens
atgtttacatgtctgt

SEQ ID NO: 5671941 - DNA, 19 bp, Homo sapiens
atgtttacatgtctgttgt

SEQ ID NO: 5671942 - DNA, 15 bp, Homo sapiens
atgtttacattttct

SEQ ID NO: 5671943 - DNA, 18 bp, Homo sapiens
atgtttaccgtgtgttat

SEQ ID NO: 5671944 - DNA, 22 bp, Homo sapiens
atgtttacctcactggtgcatt

SEQ ID NO: 5671945 - DNA, 23 bp, Homo sapiens
atgtttacctcactggtgcattt

SEQ ID NO: 5671946 - DNA, 17 bp, Homo sapiens
atgtttacctggtgctc

SEQ ID NO: 5671947 - DNA, 16 bp, Homo sapiens
atgtttactatataga

SEQ ID NO: 5671948 - DNA, 12 bp, Homo sapiens
atgtttactgta

SEQ ID NO: 5671949 - DNA, 19 bp, Homo sapiens
atgtttactgtaaattttt

SEQ ID NO: 5671950 - DNA, 16 bp, Homo sapiens
atgtttagaaataaat

SEQ ID NO: 5671951 - DNA, 19 bp, Homo sapiens
atgtttagactttaacata

SEQ ID NO: 5671952 - DNA, 21 bp, Homo sapiens
atgtttagatgaggttgagct

SEQ ID NO: 5671953 - DNA, 24 bp, Homo sapiens
atgtttagatgaggttgagctatg

SEQ ID NO: 5671954 - DNA, 17 bp, Homo sapiens
atgtttagattccagga

SEQ ID NO: 5671955 - DNA, 18 bp, Homo sapiens
atgtttagattccaggat

SEQ ID NO: 5671956 - DNA, 14 bp, Homo sapiens
atgtttaggaaatt

SEQ ID NO: 5671957 - DNA, 23 bp, Homo sapiens
atgtttaggggcaaacatcacaa

SEQ ID NO: 5671958 - DNA, 14 bp, Homo sapiens
atgtttagtaaact

SEQ ID NO: 5671959 - DNA, 14 bp, Homo sapiens
atgtttagtagctg

SEQ ID NO: 5671960 - DNA, 20 bp, Homo sapiens
atgtttagtgaatgactttt

SEQ ID NO: 5671961 - DNA, 17 bp, Homo sapiens
atgtttataaactgaga

SEQ ID NO: 5671962 - DNA, 18 bp, Homo sapiens
atgtttataaactgagag

SEQ ID NO: 5671963 - DNA, 22 bp, Homo sapiens
atgtttatactgtatttctaag

SEQ ID NO: 5671964 - DNA, 23 bp, Homo sapiens
atgtttatactgtatttctaaga

SEQ ID NO: 5671965 - DNA, 14 bp, Homo sapiens
atgtttatataaat

SEQ ID NO: 5671966 - DNA, 19 bp, Homo sapiens
atgtttatataaatgcttt

SEQ ID NO: 5671967 - DNA, 21 bp, Homo sapiens
atgtttatataaatgctttta

SEQ ID NO: 5671968 - DNA, 22 bp, Homo sapiens
atgtttatatactgggttcttg

SEQ ID NO: 5671969 - DNA, 13 bp, Homo sapiens
atgtttatatcaa

SEQ ID NO: 5671970 - DNA, 14 bp, Homo sapiens
atgtttatatcaaa

SEQ ID NO: 5671971 - DNA, 20 bp, Homo sapiens
atgtttatatctgcaaaaaa

SEQ ID NO: 5671972 - DNA, 20 bp, Homo sapiens
atgtttatcaaagagcactt

SEQ ID NO: 5671973 - DNA, 22 bp, Homo sapiens
atgtttatcaaagagcacttga

SEQ ID NO: 5671974 - DNA, 12 bp, Homo sapiens
atgtttatggaa

SEQ ID NO: 5671975 - DNA, 18 bp, Homo sapiens
atgtttatggaaatatta

SEQ ID NO: 5671976 - DNA, 12 bp, Homo sapiens
atgtttatgtaa

SEQ ID NO: 5671977 - DNA, 23 bp, Homo sapiens
atgtttatgtaaacaaatctttc

SEQ ID NO: 5671978 - DNA, 22 bp, Homo sapiens
atgtttatgtaacatagtccag

SEQ ID NO: 5671979 - DNA, 13 bp, Homo sapiens
atgtttattaaat

SEQ ID NO: 5671980 - DNA, 15 bp, Homo sapiens
atgtttattaagaat

SEQ ID NO: 5671981 - DNA, 15 bp, Homo sapiens
atgtttattaataga

SEQ ID NO: 5671982 - DNA, 17 bp, Homo sapiens
atgtttattaatagaat

SEQ ID NO: 5671983 - DNA, 12 bp, Homo sapiens
atgtttattaca

SEQ ID NO: 5671984 - DNA, 20 bp, Homo sapiens
atgtttattcatgggtgtca

SEQ ID NO: 5671985 - DNA, 14 bp, Homo sapiens
atgtttattccttg

SEQ ID NO: 5671986 - DNA, 20 bp, Homo sapiens
atgtttatttaaaagagcag

SEQ ID NO: 5671987 - DNA, 18 bp, Homo sapiens
atgtttatttagaaactg

SEQ ID NO: 5671988 - DNA, 15 bp, Homo sapiens
atgtttatttagctc

SEQ ID NO: 5671989 - DNA, 13 bp, Homo sapiens
atgtttatttata

SEQ ID NO: 5671990 - DNA, 14 bp, Homo sapiens
atgtttatttcagg

SEQ ID NO: 5671991 - DNA, 22 bp, Homo sapiens
atgtttatttttgtacatttga

SEQ ID NO: 5671992 - DNA, 16 bp, Homo sapiens
atgtttcaaaatagac

SEQ ID NO: 5671993 - DNA, 18 bp, Homo sapiens
atgtttcaaacatatata

SEQ ID NO: 5671994 - DNA, 13 bp, Homo sapiens
atgtttcaaactt

SEQ ID NO: 5671995 - DNA, 17 bp, Homo sapiens
atgtttcacacaaacaa

SEQ ID NO: 5671996 - DNA, 19 bp, Homo sapiens
atgtttcacgaagtttgtt

SEQ ID NO: 5671997 - DNA, 17 bp, Homo sapiens
atgtttcactcctgctt

SEQ ID NO: 5671998 - DNA, 22 bp, Homo sapiens
atgtttcagctgcagttgaaga

SEQ ID NO: 5671999 - DNA, 18 bp, Homo sapiens
atgtttcaggaggctgga

SEQ ID NO: 5672000 - DNA, 22 bp, Homo sapiens
atgtttcagtgaagatgctgta

SEQ ID NO: 5672001 - DNA, 13 bp, Homo sapiens
atgtttcatcaat

SEQ ID NO: 5672002 - DNA, 19 bp, Homo sapiens
atgtttcatcaatgcagtt

SEQ ID NO: 5672003 - DNA, 16 bp, Homo sapiens
atgtttccagaaaata

SEQ ID NO: 5672004 - DNA, 24 bp, Homo sapiens
atgtttccagcagaagacaaaaag

SEQ ID NO: 5672005 - DNA, 13 bp, Homo sapiens
atgtttccagcat

SEQ ID NO: 5672006 - DNA, 16 bp, Homo sapiens
atgtttccagcattcc

SEQ ID NO: 5672007 - DNA, 20 bp, Homo sapiens
atgtttccagcattcccagg

SEQ ID NO: 5672008 - DNA, 21 bp, Homo sapiens
atgtttccagcattcccaggt

SEQ ID NO: 5672009 - DNA, 22 bp, Homo sapiens
atgtttccaggcatgaccctgg

SEQ ID NO: 5672010 - DNA, 18 bp, Homo sapiens
atgtttccatcatttctg

SEQ ID NO: 5672011 - DNA, 12 bp, Homo sapiens
atgtttccatgg

SEQ ID NO: 5672012 - DNA, 18 bp, Homo sapiens
atgtttccccatctctgt

SEQ ID NO: 5672013 - DNA, 20 bp, Homo sapiens
atgtttccccatctctgtct

SEQ ID NO: 5672014 - DNA, 11 bp, Homo sapiens
atgtttccccc

SEQ ID NO: 5672015 - DNA, 15 bp, Homo sapiens
atgtttcccccactc

SEQ ID NO: 5672016 - DNA, 16 bp, Homo sapiens
atgtttccctctcctt

SEQ ID NO: 5672017 - DNA, 14 bp, Homo sapiens
atgtttcctctagt

SEQ ID NO: 5672018 - DNA, 13 bp, Homo sapiens
atgtttcctgtgg

SEQ ID NO: 5672019 - DNA, 11 bp, Homo sapiens
atgtttcctta

SEQ ID NO: 5672020 - DNA, 17 bp, Homo sapiens
atgtttccttaaacatg

SEQ ID NO: 5672021 - DNA, 21 bp, Homo sapiens
atgtttcgagtaaacttgaaa

SEQ ID NO: 5672022 - DNA, 22 bp, Homo sapiens
atgtttcgctgatatatgtgtt

SEQ ID NO: 5672023 - DNA, 23 bp, Homo sapiens
atgtttctctctctctacctttt

SEQ ID NO: 5672024 - DNA, 19 bp, Homo sapiens
atgtttctctggccccaag

SEQ ID NO: 5672025 - DNA, 20 bp, Homo sapiens
atgtttctggacattctctt

SEQ ID NO: 5672026 - DNA, 14 bp, Homo sapiens
atgtttctgtgaaa

SEQ ID NO: 5672027 - DNA, 15 bp, Homo sapiens
atgtttctgtgaaat

SEQ ID NO: 5672028 - DNA, 14 bp, Homo sapiens
atgtttctgtgtca

SEQ ID NO: 5672029 - DNA, 18 bp, Homo sapiens
atgtttcttttgtatgta

SEQ ID NO: 5672030 - DNA, 20 bp, Homo sapiens
atgtttcttttgtatgtaaa

SEQ ID NO: 5672031 - DNA, 18 bp, Homo sapiens
atgtttgaaaacaaaaaa

SEQ ID NO: 5672032 - DNA, 19 bp, Homo sapiens
atgtttgaaaataggattt

SEQ ID NO: 5672033 - DNA, 23 bp, Homo sapiens
atgtttgaaaataggatttgcac

SEQ ID NO: 5672034 - DNA, 21 bp, Homo sapiens
atgtttgaaaatgctcttaaa

SEQ ID NO: 5672035 - DNA, 22 bp, Homo sapiens
atgtttgaaatgaggtctgttt

SEQ ID NO: 5672036 - DNA, 20 bp, Homo sapiens
atgtttgaactgccaagaaa

SEQ ID NO: 5672037 - DNA, 13 bp, Homo sapiens
atgtttgaatatg

SEQ ID NO: 5672038 - DNA, 12 bp, Homo sapiens
atgtttgaatta

SEQ ID NO: 5672039 - DNA, 17 bp, Homo sapiens
atgtttgactttaaaga

SEQ ID NO: 5672040 - DNA, 19 bp, Homo sapiens
atgtttgaggagcatgttt

SEQ ID NO: 5672041 - DNA, 18 bp, Homo sapiens
atgtttgaggttaaaata

SEQ ID NO: 5672042 - DNA, 22 bp, Homo sapiens
attaaagacaggagacaaaaga

SEQ ID NO: 5672043 - DNA, 15 bp, Homo sapiens
attaaagataagact

SEQ ID NO: 5672044 - DNA, 15 bp, Homo sapiens
attaaagatatttct

SEQ ID NO: 5672045 - DNA, 17 bp, Homo sapiens
attaaagattctcttta

SEQ ID NO: 5672046 - DNA, 20 bp, Homo sapiens
attaaagatttatttagcta

SEQ ID NO: 5672047 - DNA, 12 bp, Homo sapiens
attaaagcacac

SEQ ID NO: 5672048 - DNA, 19 bp, Homo sapiens
attaaagcaccaaattcat

SEQ ID NO: 5672049 - DNA, 15 bp, Homo sapiens
attaaagcatttact

SEQ ID NO: 5672050 - DNA, 20 bp, Homo sapiens
attaaagcatttactttgaa

SEQ ID NO: 5672051 - DNA, 15 bp, Homo sapiens
attaaagcatttaga

SEQ ID NO: 5672052 - DNA, 12 bp, Homo sapiens
attaaagcccat

SEQ ID NO: 5672053 - DNA, 21 bp, Homo sapiens
attaaagctcttcatttctgg

SEQ ID NO: 5672054 - DNA, 19 bp, Homo sapiens
attaaagcttaaactgaat

SEQ ID NO: 5672055 - DNA, 14 bp, Homo sapiens
attaaaggaataaa

SEQ ID NO: 5672056 - DNA, 13 bp, Homo sapiens
attaaaggctttt

SEQ ID NO: 5672057 - DNA, 19 bp, Homo sapiens
attaaaggcttttggcagc

SEQ ID NO: 5672058 - DNA, 17 bp, Homo sapiens
attaaagggcagatatt

SEQ ID NO: 5672059 - DNA, 17 bp, Homo sapiens
attaaaggtatacaaat

SEQ ID NO: 5672060 - DNA, 15 bp, Homo sapiens
attaaaggtgaaaat

SEQ ID NO: 5672061 - DNA, 19 bp, Homo sapiens
attaaaggtgaaaattgta

SEQ ID NO: 5672062 - DNA, 21 bp, Homo sapiens
attaaaggtggaaaatctatt

SEQ ID NO: 5672063 - DNA, 21 bp, Homo sapiens
attaaaggttcctttgttccc

SEQ ID NO: 5672064 - DNA, 22 bp, Homo sapiens
attaaaggttcctttgttccct

SEQ ID NO: 5672065 - DNA, 14 bp, Homo sapiens
attaaagtaaatgg

SEQ ID NO: 5672066 - DNA, 13 bp, Homo sapiens
attaaagtattct

SEQ ID NO: 5672067 - DNA, 11 bp, Homo sapiens
attaaagtcag

SEQ ID NO: 5672068 - DNA, 19 bp, Homo sapiens
attaaagtcagaagtttta

SEQ ID NO: 5672069 - DNA, 12 bp, Homo sapiens
attaaagtctac

SEQ ID NO: 5672070 - DNA, 17 bp, Homo sapiens
attaaagtctacactgc

SEQ ID NO: 5672071 - DNA, 17 bp, Homo sapiens
attaaagtctgagaaat

SEQ ID NO: 5672072 - DNA, 15 bp, Homo sapiens
attaaagtcttccat

SEQ ID NO: 5672073 - DNA, 15 bp, Homo sapiens
attaaagtgactttc

SEQ ID NO: 5672074 - DNA, 12 bp, Homo sapiens
attaaagtgcca

SEQ ID NO: 5672075 - DNA, 13 bp, Homo sapiens
attaaagtgccat

SEQ ID NO: 5672076 - DNA, 18 bp, Homo sapiens
attaaagtgctttcagaa

SEQ ID NO: 5672077 - DNA, 20 bp, Homo sapiens
attaaagtgtccattgacat

SEQ ID NO: 5672078 - DNA, 21 bp, Homo sapiens
attaaagttgtttcccactct

SEQ ID NO: 5672079 - DNA, 12 bp, Homo sapiens
attaaagtttca

SEQ ID NO: 5672080 - DNA, 15 bp, Homo sapiens
attaaagtttcaaaa

SEQ ID NO: 5672081 - DNA, 19 bp, Homo sapiens
attaaagtttcaaaaatct

SEQ ID NO: 5672082 - DNA, 19 bp, Homo sapiens
attaaagttttcaaattat

SEQ ID NO: 5672083 - DNA, 20 bp, Homo sapiens
attaaagttttcaaattatt

SEQ ID NO: 5672084 - DNA, 13 bp, Homo sapiens
attaaataaaatc

SEQ ID NO: 5672085 - DNA, 20 bp, Homo sapiens
attaaataaaatttttatgt

SEQ ID NO: 5672086 - DNA, 15 bp, Homo sapiens
attaaataagattct

SEQ ID NO: 5672087 - DNA, 13 bp, Homo sapiens
attaaataataga

SEQ ID NO: 5672088 - DNA, 14 bp, Homo sapiens
attaaataatttta

SEQ ID NO: 5672089 - DNA, 15 bp, Homo sapiens
attaaataattttac

SEQ ID NO: 5672090 - DNA, 17 bp, Homo sapiens
attaaatacaaaacttc

SEQ ID NO: 5672091 - DNA, 19 bp, Homo sapiens
attaaatacaaaacttcca

SEQ ID NO: 5672092 - DNA, 17 bp, Homo sapiens
attaaatacagacacta

SEQ ID NO: 5672093 - DNA, 20 bp, Homo sapiens
attaaatacagacactaagt

SEQ ID NO: 5672094 - DNA, 19 bp, Homo sapiens
attaaatacatatggatgt

SEQ ID NO: 5672095 - DNA, 17 bp, Homo sapiens
attaaatactattttgc

SEQ ID NO: 5672096 - DNA, 14 bp, Homo sapiens
attaaatataaaat

SEQ ID NO: 5672097 - DNA, 13 bp, Homo sapiens
attaaatataaag

SEQ ID NO: 5672098 - DNA, 14 bp, Homo sapiens
attaaatatagatt

SEQ ID NO: 5672099 - DNA, 14 bp, Homo sapiens
attaaatatatctt

SEQ ID NO: 5672100 - DNA, 19 bp, Homo sapiens
attaaatatatgtatgtaa

SEQ ID NO: 5672101 - DNA, 23 bp, Homo sapiens
attaaatatccagccagtacagt

SEQ ID NO: 5672102 - DNA, 22 bp, Homo sapiens
attaaatatgttagcaaagagt

SEQ ID NO: 5672103 - DNA, 17 bp, Homo sapiens
attaaatattcagaaaa

SEQ ID NO: 5672104 - DNA, 12 bp, Homo sapiens
attaaatattta

SEQ ID NO: 5672105 - DNA, 19 bp, Homo sapiens
attaaatcagaatctttaa

SEQ ID NO: 5672106 - DNA, 18 bp, Homo sapiens
attaaatcagttttgtgt

SEQ ID NO: 5672107 - DNA, 18 bp, Homo sapiens
attaaatctagacattct

SEQ ID NO: 5672108 - DNA, 18 bp, Homo sapiens
attaaatctcaaatttat

SEQ ID NO: 5672109 - DNA, 15 bp, Homo sapiens
attaaatctgaattt

SEQ ID NO: 5672110 - DNA, 16 bp, Homo sapiens
attaaatcttaaacaa

SEQ ID NO: 5672111 - DNA, 17 bp, Homo sapiens
attaaatcttaaacaat

SEQ ID NO: 5672112 - DNA, 20 bp, Homo sapiens
attaaatcttaaacaatgta

SEQ ID NO: 5672113 - DNA, 19 bp, Homo sapiens
attaaatgaaagaatatct

SEQ ID NO: 5672114 - DNA, 15 bp, Homo sapiens
attaaatgaaatact

SEQ ID NO: 5672115 - DNA, 18 bp, Homo sapiens
attaaatgaacatctata

SEQ ID NO: 5672116 - DNA, 22 bp, Homo sapiens
attaaatgaatattttgataat

SEQ ID NO: 5672117 - DNA, 12 bp, Homo sapiens
attaaatgactc

SEQ ID NO: 5672118 - DNA, 14 bp, Homo sapiens
attaaatgactctt

SEQ ID NO: 5672119 - DNA, 20 bp, Homo sapiens
attaaatgacttagaaacaa

SEQ ID NO: 5672120 - DNA, 15 bp, Homo sapiens
attaaatgacttttt

SEQ ID NO: 5672121 - DNA, 12 bp, Homo sapiens
attaaatgatat

SEQ ID NO: 5672122 - DNA, 17 bp, Homo sapiens
attaaatgccacttttt

SEQ ID NO: 5672123 - DNA, 14 bp, Homo sapiens
attaaatgcccagc

SEQ ID NO: 5672124 - DNA, 17 bp, Homo sapiens
attaaatgccttgtata

SEQ ID NO: 5672125 - DNA, 18 bp, Homo sapiens
attaaatgccttgtataa

SEQ ID NO: 5672126 - DNA, 16 bp, Homo sapiens
attaaatgcttcattt

SEQ ID NO: 5672127 - DNA, 13 bp, Homo sapiens
attaaatggattt

SEQ ID NO: 5672128 - DNA, 12 bp, Homo sapiens
attaaatggcac

SEQ ID NO: 5672129 - DNA, 17 bp, Homo sapiens
attaaatggcacctgta

SEQ ID NO: 5672130 - DNA, 20 bp, Homo sapiens
attaaatgtagacagatatt

SEQ ID NO: 5672131 - DNA, 24 bp, Homo sapiens
attaaatgtagcttcagtcattaa

SEQ ID NO: 5672132 - DNA, 23 bp, Homo sapiens
attaaatgtctgacacattaatg

SEQ ID NO: 5672133 - DNA, 16 bp, Homo sapiens
attaaatgtgtcattg

SEQ ID NO: 5672134 - DNA, 11 bp, Homo sapiens
attaaatgttg

SEQ ID NO: 5672135 - DNA, 13 bp, Homo sapiens
attaaatgttgca

SEQ ID NO: 5672136 - DNA, 17 bp, Homo sapiens
attaaatgttgcacatc

SEQ ID NO: 5672137 - DNA, 21 bp, Homo sapiens
attaaatgttgcacatcattc

SEQ ID NO: 5672138 - DNA, 20 bp, Homo sapiens
attaaatgtttcaaaataga

SEQ ID NO: 5672139 - DNA, 21 bp, Homo sapiens
attaaatgtttcaaaatagac

SEQ ID NO: 5672140 - DNA, 22 bp, Homo sapiens
attaaatgtttcaaaatagaca

SEQ ID NO: 5672141 - DNA, 23 bp, Homo sapiens
attaaatgtttcaaaatagacaa

SEQ ID NO: 5672142 - DNA, 13 bp, Homo sapiens
attaaatgtttga

SEQ ID NO: 5672143 - DNA, 18 bp, Homo sapiens
attaaattaattgaatct

SEQ ID NO: 5672144 - DNA, 13 bp, Homo sapiens
attaaattacaga

SEQ ID NO: 5672145 - DNA, 12 bp, Homo sapiens
attaaattacat

SEQ ID NO: 5672146 - DNA, 17 bp, Homo sapiens
attaaattacatttgta

SEQ ID NO: 5672147 - DNA, 12 bp, Homo sapiens
attaaattacct

SEQ ID NO: 5672148 - DNA, 18 bp, Homo sapiens
attaaattagtttgtgaa

SEQ ID NO: 5672149 - DNA, 16 bp, Homo sapiens
attaaattatcattgt

SEQ ID NO: 5672150 - DNA, 11 bp, Homo sapiens
attaaattatg

SEQ ID NO: 5672151 - DNA, 15 bp, Homo sapiens
attaaattatgaatg

SEQ ID NO: 5672152 - DNA, 16 bp, Homo sapiens
attaaattatgaatga

SEQ ID NO: 5672153 - DNA, 18 bp, Homo sapiens
attaaattcacaaacttt

SEQ ID NO: 5672154 - DNA, 23 bp, Homo sapiens
attaaattcctcctgtctcctct

SEQ ID NO: 5672155 - DNA, 14 bp, Homo sapiens
attaaattctcaaa

SEQ ID NO: 5672156 - DNA, 22 bp, Homo sapiens
attaaattctcaaagttttatt

SEQ ID NO: 5672157 - DNA, 17 bp, Homo sapiens
attaaattctctctaac

SEQ ID NO: 5672158 - DNA, 20 bp, Homo sapiens
attaaattcttgcaaagtat

SEQ ID NO: 5672159 - DNA, 17 bp, Homo sapiens
attaaattgcctttgta

SEQ ID NO: 5672160 - DNA, 15 bp, Homo sapiens
attaaattggaaagc

SEQ ID NO: 5672161 - DNA, 19 bp, Homo sapiens
attaaatttaatatactgc

SEQ ID NO: 5672162 - DNA, 13 bp, Homo sapiens
attaaatttaatt

SEQ ID NO: 5672163 - DNA, 18 bp, Homo sapiens
attaaatttaattcttca

SEQ ID NO: 5672164 - DNA, 13 bp, Homo sapiens
attaaatttatta

SEQ ID NO: 5672165 - DNA, 16 bp, Homo sapiens
attaaatttatttgaa

SEQ ID NO: 5672166 - DNA, 17 bp, Homo sapiens
attaaatttgcaacaat

SEQ ID NO: 5672167 - DNA, 15 bp, Homo sapiens
attaaattttaatgt

SEQ ID NO: 5672168 - DNA, 19 bp, Homo sapiens
attaaattttaatgtaaaa

SEQ ID NO: 5672169 - DNA, 20 bp, Homo sapiens
attaaattttctatgcttat

SEQ ID NO: 5672170 - DNA, 13 bp, Homo sapiens
attaaatttttcc

SEQ ID NO: 5672171 - DNA, 18 bp, Homo sapiens
attaaatttttttgtatg

SEQ ID NO: 5672172 - DNA, 19 bp, Homo sapiens
attaacaaaatgtatgtct

SEQ ID NO: 5672173 - DNA, 15 bp, Homo sapiens
attaacaaacaggat

SEQ ID NO: 5672174 - DNA, 16 bp, Homo sapiens
attaacaaagttactg

SEQ ID NO: 5672175 - DNA, 20 bp, Homo sapiens
attaacaaagttactggctc

SEQ ID NO: 5672176 - DNA, 13 bp, Homo sapiens
attaacaaatatg

SEQ ID NO: 5672177 - DNA, 15 bp, Homo sapiens
attaacaaatatgct

SEQ ID NO: 5672178 - DNA, 16 bp, Homo sapiens
attaacaaatatgcta

SEQ ID NO: 5672179 - DNA, 13 bp, Homo sapiens
attaacaaatgct

SEQ ID NO: 5672180 - DNA, 14 bp, Homo sapiens
attaacaaattatg

SEQ ID NO: 5672181 - DNA, 12 bp, Homo sapiens
attaacaaattc

SEQ ID NO: 5672182 - DNA, 15 bp, Homo sapiens
attaacaaattgcat

SEQ ID NO: 5672183 - DNA, 16 bp, Homo sapiens
attaacaactgtgaat

SEQ ID NO: 5672184 - DNA, 22 bp, Homo sapiens
attaacaactgtgaatatgaga

SEQ ID NO: 5672185 - DNA, 12 bp, Homo sapiens
attaacaatgta

SEQ ID NO: 5672186 - DNA, 18 bp, Homo sapiens
attaacaattaattgtct

SEQ ID NO: 5672187 - DNA, 19 bp, Homo sapiens
attaacaattaggcagact

SEQ ID NO: 5672188 - DNA, 15 bp, Homo sapiens
attaacacaaaggaa

SEQ ID NO: 5672189 - DNA, 13 bp, Homo sapiens
attaacacactga

SEQ ID NO: 5672190 - DNA, 17 bp, Homo sapiens
attaacactaattatca

SEQ ID NO: 5672191 - DNA, 19 bp, Homo sapiens
attaacactactcaaagca

SEQ ID NO: 5672192 - DNA, 18 bp, Homo sapiens
attaacaggtctttgaaa

SEQ ID NO: 5672193 - DNA, 16 bp, Homo sapiens
attaacagttttccat

SEQ ID NO: 5672194 - DNA, 21 bp, Homo sapiens
attaacagttttccatgaaaa

SEQ ID NO: 5672195 - DNA, 23 bp, Homo sapiens
attaacagttttccatgaaaacg

SEQ ID NO: 5672196 - DNA, 12 bp, Homo sapiens
attaacatacct

SEQ ID NO: 5672197 - DNA, 20 bp, Homo sapiens
attaacatataatatatgtt

SEQ ID NO: 5672198 - DNA, 14 bp, Homo sapiens
attaacatattatt

SEQ ID NO: 5672199 - DNA, 16 bp, Homo sapiens
attaacatattctaaa

SEQ ID NO: 5672200 - DNA, 12 bp, Homo sapiens
attaacatcaaa

SEQ ID NO: 5672201 - DNA, 20 bp, Homo sapiens
attaacatcagtgtctgttt

SEQ ID NO: 5672202 - DNA, 13 bp, Homo sapiens
attaacatcatct

SEQ ID NO: 5672203 - DNA, 15 bp, Homo sapiens
attaacatgatgtac

SEQ ID NO: 5672204 - DNA, 17 bp, Homo sapiens
attaacatgttaaacca

SEQ ID NO: 5672205 - DNA, 21 bp, Homo sapiens
attaacattgggaaatcttat

SEQ ID NO: 5672206 - DNA, 20 bp, Homo sapiens
attaacattttgagctattt

SEQ ID NO: 5672207 - DNA, 19 bp, Homo sapiens
attaaccaaaaaagttaca

SEQ ID NO: 5672208 - DNA, 17 bp, Homo sapiens
attaaccaaagaaagtg

SEQ ID NO: 5672209 - DNA, 13 bp, Homo sapiens
attaaccaaatta

SEQ ID NO: 5672210 - DNA, 17 bp, Homo sapiens
attaaccacttcagctg

SEQ ID NO: 5672211 - DNA, 18 bp, Homo sapiens
attaaccacttcagctga

SEQ ID NO: 5672212 - DNA, 20 bp, Homo sapiens
attaaccacttcagctgact

SEQ ID NO: 5672213 - DNA, 18 bp, Homo sapiens
attaaccagaaatccagt

SEQ ID NO: 5672214 - DNA, 20 bp, Homo sapiens
attaaccagctgatttttct

SEQ ID NO: 5672215 - DNA, 20 bp, Homo sapiens
attaaccattgctaatttaa

SEQ ID NO: 5672216 - DNA, 16 bp, Homo sapiens
attaaccatttaataa

SEQ ID NO: 5672217 - DNA, 17 bp, Homo sapiens
attaaccatttaataaa

SEQ ID NO: 5672218 - DNA, 18 bp, Homo sapiens
attaaccccataattaga

SEQ ID NO: 5672219 - DNA, 17 bp, Homo sapiens
attaacctacttgtaaa

SEQ ID NO: 5672220 - DNA, 11 bp, Homo sapiens
attaacctaga

SEQ ID NO: 5672221 - DNA, 13 bp, Homo sapiens
attaacctctgca

SEQ ID NO: 5672222 - DNA, 15 bp, Homo sapiens
attaacctgcatgca

SEQ ID NO: 5672223 - DNA, 16 bp, Homo sapiens
ccacacacacagaaaa

SEQ ID NO: 5672224 - DNA, 17 bp, Homo sapiens
ccacacacacagaaaat

SEQ ID NO: 5672225 - DNA, 21 bp, Homo sapiens
ccacacacacagaaaatatac

SEQ ID NO: 5672226 - DNA, 14 bp, Homo sapiens
ccacacacaccctt

SEQ ID NO: 5672227 - DNA, 21 bp, Homo sapiens
ccacacacacccttccccact

SEQ ID NO: 5672228 - DNA, 18 bp, Homo sapiens
ccacacacacctgtctgt

SEQ ID NO: 5672229 - DNA, 21 bp, Homo sapiens
ccacacacacctgtctgtgca

SEQ ID NO: 5672230 - DNA, 19 bp, Homo sapiens
ccacacacactccttcccc

SEQ ID NO: 5672231 - DNA, 21 bp, Homo sapiens
ccacacacactccttcccctt

SEQ ID NO: 5672232 - DNA, 12 bp, Homo sapiens
ccacacacagag

SEQ ID NO: 5672233 - DNA, 21 bp, Homo sapiens
ccacacacagcagctccaacc

SEQ ID NO: 5672234 - DNA, 22 bp, Homo sapiens
ccacacacagcagctccaacct

SEQ ID NO: 5672235 - DNA, 14 bp, Homo sapiens
ccacacacagcctg

SEQ ID NO: 5672236 - DNA, 16 bp, Homo sapiens
ccacacacagcctgtc

SEQ ID NO: 5672237 - DNA, 19 bp, Homo sapiens
ccacacacagctgggctgt

SEQ ID NO: 5672238 - DNA, 23 bp, Homo sapiens
ccacacacaggccttctgtgggg

SEQ ID NO: 5672239 - DNA, 15 bp, Homo sapiens
ccacacacgcaggaa

SEQ ID NO: 5672240 - DNA, 22 bp, Homo sapiens
ccacacactgttttttggcttg

SEQ ID NO: 5672241 - DNA, 23 bp, Homo sapiens
ccacacacttagccattgaaatg

SEQ ID NO: 5672242 - DNA, 22 bp, Homo sapiens
ccacacagaactggcaggagcc

SEQ ID NO: 5672243 - DNA, 23 bp, Homo sapiens
ccacacagaactggcaggagcct

SEQ ID NO: 5672244 - DNA, 15 bp, Homo sapiens
ccacacagaatgcaa

SEQ ID NO: 5672245 - DNA, 20 bp, Homo sapiens
ccacacagacttgggcaggg

SEQ ID NO: 5672246 - DNA, 12 bp, Homo sapiens
ccacacagagcc

SEQ ID NO: 5672247 - DNA, 13 bp, Homo sapiens
ccacacagagcct

SEQ ID NO: 5672248 - DNA, 16 bp, Homo sapiens
ccacacagagcctgcc

SEQ ID NO: 5672249 - DNA, 20 bp, Homo sapiens
ccacacagcagtgtcccctg

SEQ ID NO: 5672250 - DNA, 12 bp, Homo sapiens
ccacacagccca

SEQ ID NO: 5672251 - DNA, 16 bp, Homo sapiens
ccacacagcccagaag

SEQ ID NO: 5672252 - DNA, 15 bp, Homo sapiens
ccacacagctgccct

SEQ ID NO: 5672253 - DNA, 21 bp, Homo sapiens
ccacacagctgccctagctga

SEQ ID NO: 5672254 - DNA, 12 bp, Homo sapiens
ccacacaggcag

SEQ ID NO: 5672255 - DNA, 15 bp, Homo sapiens
ccacacaggcagggc

SEQ ID NO: 5672256 - DNA, 17 bp, Homo sapiens
ccacacaggcagggcct

SEQ ID NO: 5672257 - DNA, 21 bp, Homo sapiens
ccacacaggcagggcctggct

SEQ ID NO: 5672258 - DNA, 23 bp, Homo sapiens
ccacacaggcctggcccagccag

SEQ ID NO: 5672259 - DNA, 14 bp, Homo sapiens
ccacacagggtggc

SEQ ID NO: 5672260 - DNA, 17 bp, Homo sapiens
ccacacagtcacccctc

SEQ ID NO: 5672261 - DNA, 19 bp, Homo sapiens
ccacacagtccccagactc

SEQ ID NO: 5672262 - DNA, 22 bp, Homo sapiens
ccacacagtgctcaaggccagc

SEQ ID NO: 5672263 - DNA, 22 bp, Homo sapiens
ccacacagtgggccggccccag

SEQ ID NO: 5672264 - DNA, 20 bp, Homo sapiens
ccacacatgcaagggatgaa

SEQ ID NO: 5672265 - DNA, 18 bp, Homo sapiens
ccacacattccagggctg

SEQ ID NO: 5672266 - DNA, 20 bp, Homo sapiens
ccacacatttcactgtctgt

SEQ ID NO: 5672267 - DNA, 19 bp, Homo sapiens
ccacaccaatcagagagcc

SEQ ID NO: 5672268 - DNA, 24 bp, Homo sapiens
ccacaccacccctaaagtgccagg

SEQ ID NO: 5672269 - DNA, 13 bp, Homo sapiens
ccacaccaccgcc

SEQ ID NO: 5672270 - DNA, 13 bp, Homo sapiens
ccacaccagcccc

SEQ ID NO: 5672271 - DNA, 14 bp, Homo sapiens
ccacaccaggccgt

SEQ ID NO: 5672272 - DNA, 14 bp, Homo sapiens
ccacaccatctggc

SEQ ID NO: 5672273 - DNA, 20 bp, Homo sapiens
ccacacccaatgctgctcca

SEQ ID NO: 5672274 - DNA, 16 bp, Homo sapiens
ccacacccacactcag

SEQ ID NO: 5672275 - DNA, 16 bp, Homo sapiens
ccacacccaccccctc

SEQ ID NO: 5672276 - DNA, 17 bp, Homo sapiens
ccacacccacctctgcc

SEQ ID NO: 5672277 - DNA, 18 bp, Homo sapiens
ccacacccacctctgcca

SEQ ID NO: 5672278 - DNA, 18 bp, Homo sapiens
ccacacccactccacacc

SEQ ID NO: 5672279 - DNA, 12 bp, Homo sapiens
ccacacccagcc

SEQ ID NO: 5672280 - DNA, 13 bp, Homo sapiens
ccacacccagcct

SEQ ID NO: 5672281 - DNA, 14 bp, Homo sapiens
ccacacccagcctc

SEQ ID NO: 5672282 - DNA, 17 bp, Homo sapiens
ccacacccagcctcagt

SEQ ID NO: 5672283 - DNA, 15 bp, Homo sapiens
ccacacccagcggcc

SEQ ID NO: 5672284 - DNA, 16 bp, Homo sapiens
ccacacccagctcagc

SEQ ID NO: 5672285 - DNA, 12 bp, Homo sapiens
ccacacccagga

SEQ ID NO: 5672286 - DNA, 13 bp, Homo sapiens
ccacacccaggtc

SEQ ID NO: 5672287 - DNA, 21 bp, Homo sapiens
ccacacccaggtctcttcctt

SEQ ID NO: 5672288 - DNA, 21 bp, Homo sapiens
ccacacccaggtgatttcctc

SEQ ID NO: 5672289 - DNA, 17 bp, Homo sapiens
ccacaccccagactcca

SEQ ID NO: 5672290 - DNA, 13 bp, Homo sapiens
ccacaccccagcc

SEQ ID NO: 5672291 - DNA, 14 bp, Homo sapiens
ccacaccccagccc

SEQ ID NO: 5672292 - DNA, 15 bp, Homo sapiens
ccacaccccagccca

SEQ ID NO: 5672293 - DNA, 15 bp, Homo sapiens
ccacaccccagcgcc

SEQ ID NO: 5672294 - DNA, 13 bp, Homo sapiens
ccacacccccacc

SEQ ID NO: 5672295 - DNA, 15 bp, Homo sapiens
ccacacccccacccc

SEQ ID NO: 5672296 - DNA, 19 bp, Homo sapiens
ccacaccccgtctgcccct

SEQ ID NO: 5672297 - DNA, 14 bp, Homo sapiens
ccacacccctccaa

SEQ ID NO: 5672298 - DNA, 18 bp, Homo sapiens
ccacacccctctgctgca

SEQ ID NO: 5672299 - DNA, 16 bp, Homo sapiens
ccacacccctgccggc

SEQ ID NO: 5672300 - DNA, 18 bp, Homo sapiens
ccacacccgaagtcctgt

SEQ ID NO: 5672301 - DNA, 21 bp, Homo sapiens
ccacacccgaagtcctgtcac

SEQ ID NO: 5672302 - DNA, 14 bp, Homo sapiens
ccacaccctacagc

SEQ ID NO: 5672303 - DNA, 15 bp, Homo sapiens
ccacaccctacagca

SEQ ID NO: 5672304 - DNA, 11 bp, Homo sapiens
ccacaccctcc

SEQ ID NO: 5672305 - DNA, 14 bp, Homo sapiens
ccacaccctgcctg

SEQ ID NO: 5672306 - DNA, 15 bp, Homo sapiens
ccacaccctgcctgc

SEQ ID NO: 5672307 - DNA, 16 bp, Homo sapiens
ccacaccctgcctgct

SEQ ID NO: 5672308 - DNA, 19 bp, Homo sapiens
ccacaccctgcctgctgtg

SEQ ID NO: 5672309 - DNA, 20 bp, Homo sapiens
ccacaccctggagtggcatg

SEQ ID NO: 5672310 - DNA, 21 bp, Homo sapiens
ccacaccctggagtggcatgg

SEQ ID NO: 5672311 - DNA, 16 bp, Homo sapiens
ccacaccctgtactgt

SEQ ID NO: 5672312 - DNA, 16 bp, Homo sapiens
ccacaccggtaccctc

SEQ ID NO: 5672313 - DNA, 16 bp, Homo sapiens
ccacaccgtcttcctt

SEQ ID NO: 5672314 - DNA, 20 bp, Homo sapiens
ccacaccgtgtaaaccaaag

SEQ ID NO: 5672315 - DNA, 14 bp, Homo sapiens
ccacacctccacag

SEQ ID NO: 5672316 - DNA, 15 bp, Homo sapiens
ccacacctccacagt

SEQ ID NO: 5672317 - DNA, 17 bp, Homo sapiens
ccacacctccacagttc

SEQ ID NO: 5672318 - DNA, 13 bp, Homo sapiens
ccacacctcctgg

SEQ ID NO: 5672319 - DNA, 15 bp, Homo sapiens
ccacacctccttccc

SEQ ID NO: 5672320 - DNA, 16 bp, Homo sapiens
ccacacctccttccct

SEQ ID NO: 5672321 - DNA, 15 bp, Homo sapiens
ccacacctctgccag

SEQ ID NO: 5672322 - DNA, 18 bp, Homo sapiens
ccacacctgaacttgcct

SEQ ID NO: 5672323 - DNA, 21 bp, Homo sapiens
ccacacctgagcgctgtggac

SEQ ID NO: 5672324 - DNA, 13 bp, Homo sapiens
ccacacctgcctg

SEQ ID NO: 5672325 - DNA, 13 bp, Homo sapiens
ccacacctggccc

SEQ ID NO: 5672326 - DNA, 14 bp, Homo sapiens
ccacacctggcctt

SEQ ID NO: 5672327 - DNA, 12 bp, Homo sapiens
ccacacctggct

SEQ ID NO: 5672328 - DNA, 13 bp, Homo sapiens
ccacacctggctt

SEQ ID NO: 5672329 - DNA, 13 bp, Homo sapiens
ccacacctggtgg

SEQ ID NO: 5672330 - DNA, 18 bp, Homo sapiens
ccacaccttccagggccc

SEQ ID NO: 5672331 - DNA, 15 bp, Homo sapiens
ccacaccttggcctt

SEQ ID NO: 5672332 - DNA, 23 bp, Homo sapiens
ccacacgcaaaccaacctttctg

SEQ ID NO: 5672333 - DNA, 18 bp, Homo sapiens
ccacacgcaggcggccag

SEQ ID NO: 5672334 - DNA, 14 bp, Homo sapiens
ccacacgcatgggc

SEQ ID NO: 5672335 - DNA, 16 bp, Homo sapiens
ccacacgcatgggcat

SEQ ID NO: 5672336 - DNA, 19 bp, Homo sapiens
ccacacgccggggctggcc

SEQ ID NO: 5672337 - DNA, 15 bp, Homo sapiens
ccacacgcctctgtg

SEQ ID NO: 5672338 - DNA, 13 bp, Homo sapiens
ccacacgctgccc

SEQ ID NO: 5672339 - DNA, 21 bp, Homo sapiens
ccacacgctgcccaggctctg

SEQ ID NO: 5672340 - DNA, 22 bp, Homo sapiens
ccacacgctgcccaggctctgc

SEQ ID NO: 5672341 - DNA, 23 bp, Homo sapiens
ccacacgctgcccaggctctgct

SEQ ID NO: 5672342 - DNA, 17 bp, Homo sapiens
ccacacggaagcaagca

SEQ ID NO: 5672343 - DNA, 19 bp, Homo sapiens
ccacacggactcccgggcc

SEQ ID NO: 5672344 - DNA, 23 bp, Homo sapiens
ccacacggactcccgggccacgc

SEQ ID NO: 5672345 - DNA, 14 bp, Homo sapiens
ccacacggagaggc

SEQ ID NO: 5672346 - DNA, 23 bp, Homo sapiens
ccacacggccccttcccagccag

SEQ ID NO: 5672347 - DNA, 22 bp, Homo sapiens
ccacacgtaatgaaacttggat

SEQ ID NO: 5672348 - DNA, 15 bp, Homo sapiens
ccacacgtggctggc

SEQ ID NO: 5672349 - DNA, 22 bp, Homo sapiens
ccacactaacctgggttccctt

SEQ ID NO: 5672350 - DNA, 23 bp, Homo sapiens
ccacactaacctgggttcccttt

SEQ ID NO: 5672351 - DNA, 14 bp, Homo sapiens
ccacactacacagc

SEQ ID NO: 5672352 - DNA, 15 bp, Homo sapiens
ccacactacacagca

SEQ ID NO: 5672353 - DNA, 18 bp, Homo sapiens
ccacactacgcagaagag

SEQ ID NO: 5672354 - DNA, 22 bp, Homo sapiens
ccacactagggactatcaggta

SEQ ID NO: 5672355 - DNA, 19 bp, Homo sapiens
ccacactcaccccagcctc

SEQ ID NO: 5672356 - DNA, 24 bp, Homo sapiens
ccacactcactcctgagacccctg

SEQ ID NO: 5672357 - DNA, 18 bp, Homo sapiens
ccacactcagatcctcct

SEQ ID NO: 5672358 - DNA, 14 bp, Homo sapiens
ccacactcagtccc

SEQ ID NO: 5672359 - DNA, 11 bp, Homo sapiens
ccacactccac

SEQ ID NO: 5672360 - DNA, 16 bp, Homo sapiens
ccacactccactctga

SEQ ID NO: 5672361 - DNA, 12 bp, Homo sapiens
ccacactccagc

SEQ ID NO: 5672362 - DNA, 13 bp, Homo sapiens
ccacactccagct

SEQ ID NO: 5672363 - DNA, 15 bp, Homo sapiens
ccacactcccaaggt

SEQ ID NO: 5672364 - DNA, 23 bp, Homo sapiens
ccacactcccaaggttggagccc

SEQ ID NO: 5672365 - DNA, 16 bp, Homo sapiens
ccacactcccccagac

SEQ ID NO: 5672366 - DNA, 13 bp, Homo sapiens
ccacactccccgc

SEQ ID NO: 5672367 - DNA, 17 bp, Homo sapiens
ccacactccttgtcaac

SEQ ID NO: 5672368 - DNA, 16 bp, Homo sapiens
ccacactctttctcct

SEQ ID NO: 5672369 - DNA, 18 bp, Homo sapiens
ccacactctttctcctgc

SEQ ID NO: 5672370 - DNA, 18 bp, Homo sapiens
ccacactgaaaccaaaac

SEQ ID NO: 5672371 - DNA, 13 bp, Homo sapiens
ccacactgaccac

SEQ ID NO: 5672372 - DNA, 23 bp, Homo sapiens
ccacactgaggcttaggcctctc

SEQ ID NO: 5672373 - DNA, 13 bp, Homo sapiens
ccacactgagttc

SEQ ID NO: 5672374 - DNA, 22 bp, Homo sapiens
ccacactgatccagccctgagt

SEQ ID NO: 5672375 - DNA, 22 bp, Homo sapiens
ccacactggcacgtttgtgaga

SEQ ID NO: 5672376 - DNA, 13 bp, Homo sapiens
ccacactgggcct

SEQ ID NO: 5672377 - DNA, 19 bp, Homo sapiens
ccacactggggtgccgcct

SEQ ID NO: 5672378 - DNA, 20 bp, Homo sapiens
ccacactggggtgccgcctg

SEQ ID NO: 5672379 - DNA, 22 bp, Homo sapiens
ccacactgggtgcgtctccagt

SEQ ID NO: 5672380 - DNA, 18 bp, Homo sapiens
ccacactgtcagagctgt

SEQ ID NO: 5672381 - DNA, 17 bp, Homo sapiens
ccacactgtgacacact

SEQ ID NO: 5672382 - DNA, 19 bp, Homo sapiens
ccacactgtgacacactac

SEQ ID NO: 5672383 - DNA, 21 bp, Homo sapiens
ccacactgtgacacactacac

SEQ ID NO: 5672384 - DNA, 15 bp, Homo sapiens
ccacacttaagccct

SEQ ID NO: 5672385 - DNA, 16 bp, Homo sapiens
ccacacttatcagcag

SEQ ID NO: 5672386 - DNA, 21 bp, Homo sapiens
ccacacttcaggctcttctcc

SEQ ID NO: 5672387 - DNA, 19 bp, Homo sapiens
ccacacttccacccccagc

SEQ ID NO: 5672388 - DNA, 21 bp, Homo sapiens
ccacacttccacccccagctc

SEQ ID NO: 5672389 - DNA, 16 bp, Homo sapiens
ccacacttcctgtcca

SEQ ID NO: 5672390 - DNA, 20 bp, Homo sapiens
ccacacttcctgtccagaga

SEQ ID NO: 5672391 - DNA, 12 bp, Homo sapiens
ccacacttcctt

SEQ ID NO: 5672392 - DNA, 13 bp, Homo sapiens
ccacacttccttt

SEQ ID NO: 5672393 - DNA, 17 bp, Homo sapiens
ccacacttctcaggaca

SEQ ID NO: 5672394 - DNA, 21 bp, Homo sapiens
ccacacttcttgaaacagcct

SEQ ID NO: 5672395 - DNA, 17 bp, Homo sapiens
ccacacttgagaggatg

SEQ ID NO: 5672396 - DNA, 19 bp, Homo sapiens
ccacacttgagaggatgaa

SEQ ID NO: 5672397 - DNA, 17 bp, Homo sapiens
ccacacttgtgccagcc

SEQ ID NO: 5672398 - DNA, 13 bp, Homo sapiens
ccacacttgtgtg

SEQ ID NO: 5672399 - DNA, 15 bp, Homo sapiens
ccacacttgttttct

SEQ ID NO: 5672400 - DNA, 12 bp, Homo sapiens
ccacactttgaa

SEQ ID NO: 5672401 - DNA, 13 bp, Homo sapiens
ccacactttgaag

SEQ ID NO: 5672402 - DNA, 15 bp, Homo sapiens
ccacattctggctcc

SEQ ID NO: 5672403 - DNA, 18 bp, Homo sapiens
ccacattgacagtggtgg

SEQ ID NO: 5672404 - DNA, 16 bp, Homo sapiens
ccacattgatttttct

SEQ ID NO: 5672405 - DNA, 23 bp, Homo sapiens
ccacattgcataagtggacccag

SEQ ID NO: 5672406 - DNA, 18 bp, Homo sapiens
ccacattgcttcattaaa

SEQ ID NO: 5672407 - DNA, 20 bp, Homo sapiens
ccacattgcttcattaaaac

SEQ ID NO: 5672408 - DNA, 12 bp, Homo sapiens
ccacatttctga

SEQ ID NO: 5672409 - DNA, 20 bp, Homo sapiens
ccacatttctgatcagaggt

SEQ ID NO: 5672410 - DNA, 13 bp, Homo sapiens
ccacatttggaat

SEQ ID NO: 5672411 - DNA, 19 bp, Homo sapiens
ccacatttggaatactttt

SEQ ID NO: 5672412 - DNA, 23 bp, Homo sapiens
ccacatttggttctaagaaaccc

SEQ ID NO: 5672413 - DNA, 14 bp, Homo sapiens
ccacattttttgag

SEQ ID NO: 5672414 - DNA, 15 bp, Homo sapiens
ccaccaaactcctgc

SEQ ID NO: 5672415 - DNA, 15 bp, Homo sapiens
ccaccaaactgcaca

SEQ ID NO: 5672416 - DNA, 21 bp, Homo sapiens
ccaccaaactgcacacacagc

SEQ ID NO: 5672417 - DNA, 16 bp, Homo sapiens
ccaccaaagctgccca

SEQ ID NO: 5672418 - DNA, 16 bp, Homo sapiens
ccaccaaatgcctctg

SEQ ID NO: 5672419 - DNA, 15 bp, Homo sapiens
ccaccaacaaatata

SEQ ID NO: 5672420 - DNA, 13 bp, Homo sapiens
ccaccaacactgc

SEQ ID NO: 5672421 - DNA, 21 bp, Homo sapiens
ccaccaacatactcccatctg

SEQ ID NO: 5672422 - DNA, 12 bp, Homo sapiens
ccaccaacccat

SEQ ID NO: 5672423 - DNA, 21 bp, Homo sapiens
ccaccaacccatcagaaggag

SEQ ID NO: 5672424 - DNA, 17 bp, Homo sapiens
ccaccaaccccgcggcc

SEQ ID NO: 5672425 - DNA, 15 bp, Homo sapiens
ccaccaaccctcaga

SEQ ID NO: 5672426 - DNA, 16 bp, Homo sapiens
ccaccaaccctcaggg

SEQ ID NO: 5672427 - DNA, 17 bp, Homo sapiens
ccaccaaccctcagggc

SEQ ID NO: 5672428 - DNA, 20 bp, Homo sapiens
ccaccaactctctctgcccc

SEQ ID NO: 5672429 - DNA, 12 bp, Homo sapiens
ccaccaactctg

SEQ ID NO: 5672430 - DNA, 20 bp, Homo sapiens
ccaccaactctgcactccat

SEQ ID NO: 5672431 - DNA, 15 bp, Homo sapiens
ccaccaactcttgca

SEQ ID NO: 5672432 - DNA, 16 bp, Homo sapiens
ccaccaactggccctc

SEQ ID NO: 5672433 - DNA, 18 bp, Homo sapiens
ccaccaactttttccaag

SEQ ID NO: 5672434 - DNA, 19 bp, Homo sapiens
ccaccaagctcacacctgt

SEQ ID NO: 5672435 - DNA, 17 bp, Homo sapiens
ccaccaaggaggcagga

SEQ ID NO: 5672436 - DNA, 16 bp, Homo sapiens
ccaccaaggctgcctg

SEQ ID NO: 5672437 - DNA, 17 bp, Homo sapiens
ccaccaaggctgcctgc

SEQ ID NO: 5672438 - DNA, 11 bp, Homo sapiens
ccaccaaggtc

SEQ ID NO: 5672439 - DNA, 17 bp, Homo sapiens
ccaccaaggtctcacac

SEQ ID NO: 5672440 - DNA, 20 bp, Homo sapiens
ccaccaaggtctcacactcc

SEQ ID NO: 5672441 - DNA, 23 bp, Homo sapiens
ccaccaaggtctcacactcctcc

SEQ ID NO: 5672442 - DNA, 15 bp, Homo sapiens
ccaccaataaaaatc

SEQ ID NO: 5672443 - DNA, 14 bp, Homo sapiens
ccaccaatatcatg

SEQ ID NO: 5672444 - DNA, 13 bp, Homo sapiens
ccaccacaaaaag

SEQ ID NO: 5672445 - DNA, 19 bp, Homo sapiens
ccaccacaaaaagagaagc

SEQ ID NO: 5672446 - DNA, 16 bp, Homo sapiens
ccaccacacacaccct

SEQ ID NO: 5672447 - DNA, 19 bp, Homo sapiens
ccaccacacacacccttcc

SEQ ID NO: 5672448 - DNA, 14 bp, Homo sapiens
ccaccacacagtca

SEQ ID NO: 5672449 - DNA, 16 bp, Homo sapiens
ccaccacacccagccc

SEQ ID NO: 5672450 - DNA, 15 bp, Homo sapiens
ccaccacacctggct

SEQ ID NO: 5672451 - DNA, 21 bp, Homo sapiens
ccaccacactgatccagccct

SEQ ID NO: 5672452 - DNA, 18 bp, Homo sapiens
ccaccacagccagcacct

SEQ ID NO: 5672453 - DNA, 20 bp, Homo sapiens
ccaccacagtccccagagtg

SEQ ID NO: 5672454 - DNA, 16 bp, Homo sapiens
ccaccacagtccctca

SEQ ID NO: 5672455 - DNA, 14 bp, Homo sapiens
ccaccaccactggc

SEQ ID NO: 5672456 - DNA, 16 bp, Homo sapiens
ccaccaccactggcca

SEQ ID NO: 5672457 - DNA, 16 bp, Homo sapiens
ccaccaccactgtccc

SEQ ID NO: 5672458 - DNA, 15 bp, Homo sapiens
ccaccaccagaaagc

SEQ ID NO: 5672459 - DNA, 15 bp, Homo sapiens
ccaccaccccaccca

SEQ ID NO: 5672460 - DNA, 17 bp, Homo sapiens
ccaccaccccacccacc

SEQ ID NO: 5672461 - DNA, 14 bp, Homo sapiens
ccaccaccccagct

SEQ ID NO: 5672462 - DNA, 24 bp, Homo sapiens
ccaccaccccccactctgtgcctg

SEQ ID NO: 5672463 - DNA, 14 bp, Homo sapiens
ccaccacccccttt

SEQ ID NO: 5672464 - DNA, 13 bp, Homo sapiens
ccaccacccctcc

SEQ ID NO: 5672465 - DNA, 20 bp, Homo sapiens
ccaccacccgaaatgccacg

SEQ ID NO: 5672466 - DNA, 17 bp, Homo sapiens
ccaccaccctcaggtgc

SEQ ID NO: 5672467 - DNA, 11 bp, Homo sapiens
ccaccaccctg

SEQ ID NO: 5672468 - DNA, 11 bp, Homo sapiens
ccaccaccgct

SEQ ID NO: 5672469 - DNA, 12 bp, Homo sapiens
ccaccacctagg

SEQ ID NO: 5672470 - DNA, 19 bp, Homo sapiens
ccaccacctgacggctggg

SEQ ID NO: 5672471 - DNA, 22 bp, Homo sapiens
ccaccacctgctcactggtcaa

SEQ ID NO: 5672472 - DNA, 17 bp, Homo sapiens
ccaccaccttatacatc

SEQ ID NO: 5672473 - DNA, 15 bp, Homo sapiens
ccaccaccttgccaa

SEQ ID NO: 5672474 - DNA, 21 bp, Homo sapiens
ccaccacgatgtggccctggc

SEQ ID NO: 5672475 - DNA, 17 bp, Homo sapiens
ccaccacgcatgctcag

SEQ ID NO: 5672476 - DNA, 15 bp, Homo sapiens
ccaccacgcccggct

SEQ ID NO: 5672477 - DNA, 16 bp, Homo sapiens
ccaccacgcctagcct

SEQ ID NO: 5672478 - DNA, 19 bp, Homo sapiens
ccaccacggccactggcca

SEQ ID NO: 5672479 - DNA, 14 bp, Homo sapiens
ccaccacgtctgcc

SEQ ID NO: 5672480 - DNA, 19 bp, Homo sapiens
ccaccacgtctgccaggcc

SEQ ID NO: 5672481 - DNA, 20 bp, Homo sapiens
ccaccacgtctgccaggccc

SEQ ID NO: 5672482 - DNA, 11 bp, Homo sapiens
ccaccacgtgc

SEQ ID NO: 5672483 - DNA, 13 bp, Homo sapiens
ccaccactataaa

SEQ ID NO: 5672484 - DNA, 14 bp, Homo sapiens
ccaccactataaaa

SEQ ID NO: 5672485 - DNA, 12 bp, Homo sapiens
ccaccactcctg

SEQ ID NO: 5672486 - DNA, 19 bp, Homo sapiens
ccaccactgactataccaa

SEQ ID NO: 5672487 - DNA, 14 bp, Homo sapiens
ccaccactggccac

SEQ ID NO: 5672488 - DNA, 23 bp, Homo sapiens
ccaccactggccaccaggctggc

SEQ ID NO: 5672489 - DNA, 15 bp, Homo sapiens
ccaccactgtcccta

SEQ ID NO: 5672490 - DNA, 18 bp, Homo sapiens
ccaccactgtccctacca

SEQ ID NO: 5672491 - DNA, 13 bp, Homo sapiens
ccaccactgtgtc

SEQ ID NO: 5672492 - DNA, 20 bp, Homo sapiens
ccaccacttcaggggatggg

SEQ ID NO: 5672493 - DNA, 20 bp, Homo sapiens
ccaccagaacgcaccccact

SEQ ID NO: 5672494 - DNA, 11 bp, Homo sapiens
ccaccagaagc

SEQ ID NO: 5672495 - DNA, 15 bp, Homo sapiens
ccaccagaagcccag

SEQ ID NO: 5672496 - DNA, 17 bp, Homo sapiens
ccaccagacatcaccct

SEQ ID NO: 5672497 - DNA, 15 bp, Homo sapiens
ccaccagagactggg

SEQ ID NO: 5672498 - DNA, 23 bp, Homo sapiens
ccaccagagcaggggctgctggg

SEQ ID NO: 5672499 - DNA, 14 bp, Homo sapiens
ccaccagagccggg

SEQ ID NO: 5672500 - DNA, 20 bp, Homo sapiens
ccaccagagcctccctcagc

SEQ ID NO: 5672501 - DNA, 14 bp, Homo sapiens
ccaccagagctgcc

SEQ ID NO: 5672502 - DNA, 19 bp, Homo sapiens
ccaccagagctgcctcccc

SEQ ID NO: 5672503 - DNA, 15 bp, Homo sapiens
ccaccagatgagaag

SEQ ID NO: 5672504 - DNA, 13 bp, Homo sapiens
ccaccagatgctg

SEQ ID NO: 5672505 - DNA, 12 bp, Homo sapiens
ccaccagcaagg

SEQ ID NO: 5672506 - DNA, 13 bp, Homo sapiens
ccaccagcagcat

SEQ ID NO: 5672507 - DNA, 22 bp, Homo sapiens
ccaccagcatgtcactcccaga

SEQ ID NO: 5672508 - DNA, 23 bp, Homo sapiens
ccaccagccacagcctccccacc

SEQ ID NO: 5672509 - DNA, 13 bp, Homo sapiens
ccaccagccacct

SEQ ID NO: 5672510 - DNA, 18 bp, Homo sapiens
ccaccagccagccctggc

SEQ ID NO: 5672511 - DNA, 22 bp, Homo sapiens
ccaccagccagccctggcccac

SEQ ID NO: 5672512 - DNA, 12 bp, Homo sapiens
ccaccagccatc

SEQ ID NO: 5672513 - DNA, 20 bp, Homo sapiens
ccaccagcccccgccccaga

SEQ ID NO: 5672514 - DNA, 18 bp, Homo sapiens
ccaccagcccctccccag

SEQ ID NO: 5672515 - DNA, 19 bp, Homo sapiens
ccaccagccgccccagccc

SEQ ID NO: 5672516 - DNA, 15 bp, Homo sapiens
ccaccagcctaagaa

SEQ ID NO: 5672517 - DNA, 19 bp, Homo sapiens
ccaccagcctaagaagctc

SEQ ID NO: 5672518 - DNA, 23 bp, Homo sapiens
ccaccagcctgctgacagacact

SEQ ID NO: 5672519 - DNA, 15 bp, Homo sapiens
ccaccagccttgctc

SEQ ID NO: 5672520 - DNA, 20 bp, Homo sapiens
ccaccagcgcccccactcct

SEQ ID NO: 5672521 - DNA, 22 bp, Homo sapiens
ccaccagcgcccccactcctcc

SEQ ID NO: 5672522 - DNA, 22 bp, Homo sapiens
ccaccagcgttcccttctcccc

SEQ ID NO: 5672523 - DNA, 14 bp, Homo sapiens
ccaccagctccaca

SEQ ID NO: 5672524 - DNA, 16 bp, Homo sapiens
ccaccagctccacaca

SEQ ID NO: 5672525 - DNA, 20 bp, Homo sapiens
ccaccagctccacacattcc

SEQ ID NO: 5672526 - DNA, 16 bp, Homo sapiens
ccaccagctctgccgt

SEQ ID NO: 5672527 - DNA, 15 bp, Homo sapiens
ccaccagctgcagcc

SEQ ID NO: 5672528 - DNA, 15 bp, Homo sapiens
ccaccagctggctct

SEQ ID NO: 5672529 - DNA, 15 bp, Homo sapiens
ccaccagctgtgtcc

SEQ ID NO: 5672530 - DNA, 20 bp, Homo sapiens
ccaccagcttaagcgttcat

SEQ ID NO: 5672531 - DNA, 16 bp, Homo sapiens
ccaccaggaacctctt

SEQ ID NO: 5672532 - DNA, 15 bp, Homo sapiens
ccaccaggactgaaa

SEQ ID NO: 5672533 - DNA, 15 bp, Homo sapiens
ccaccaggagcagca

SEQ ID NO: 5672534 - DNA, 16 bp, Homo sapiens
ccaccaggagcagcag

SEQ ID NO: 5672535 - DNA, 18 bp, Homo sapiens
ccaccaggagcagcagcc

SEQ ID NO: 5672536 - DNA, 19 bp, Homo sapiens
ccaccaggagcagcagcca

SEQ ID NO: 5672537 - DNA, 13 bp, Homo sapiens
ccaccaggccacc

SEQ ID NO: 5672538 - DNA, 19 bp, Homo sapiens
ccaccaggccagctcagga

SEQ ID NO: 5672539 - DNA, 17 bp, Homo sapiens
ccaccaggcctcactgg

SEQ ID NO: 5672540 - DNA, 23 bp, Homo sapiens
ccaccagggatcacagaccacag

SEQ ID NO: 5672541 - DNA, 22 bp, Homo sapiens
ccaccagggcactgtctgcgtg

SEQ ID NO: 5672542 - DNA, 19 bp, Homo sapiens
ccaccagggcatctctggg

SEQ ID NO: 5672543 - DNA, 20 bp, Homo sapiens
ccaccagggcatctctgggc

SEQ ID NO: 5672544 - DNA, 16 bp, Homo sapiens
ccaccagggccagagc

SEQ ID NO: 5672545 - DNA, 21 bp, Homo sapiens
ccaccagggctcagctccttg

SEQ ID NO: 5672546 - DNA, 19 bp, Homo sapiens
ccaccaggggaaggaagga

SEQ ID NO: 5672547 - DNA, 16 bp, Homo sapiens
ccaccagggtcccagg

SEQ ID NO: 5672548 - DNA, 20 bp, Homo sapiens
ccaccagggtggaccaggcc

SEQ ID NO: 5672549 - DNA, 22 bp, Homo sapiens
ccaccagggtggaccaggcctg

SEQ ID NO: 5672550 - DNA, 20 bp, Homo sapiens
ccaccaggtgcctttcaaat

SEQ ID NO: 5672551 - DNA, 14 bp, Homo sapiens
ccaccaggtgtcag

SEQ ID NO: 5672552 - DNA, 16 bp, Homo sapiens
ccaccagtctcaccca

SEQ ID NO: 5672553 - DNA, 13 bp, Homo sapiens
ccaccagtgcctt

SEQ ID NO: 5672554 - DNA, 15 bp, Homo sapiens
ccaccagtgtagcat

SEQ ID NO: 5672555 - DNA, 22 bp, Homo sapiens
ccaccagtgtcctccaagtgcc

SEQ ID NO: 5672556 - DNA, 13 bp, Homo sapiens
ccaccagttgctg

SEQ ID NO: 5672557 - DNA, 17 bp, Homo sapiens
ccaccagtttatacaga

SEQ ID NO: 5672558 - DNA, 20 bp, Homo sapiens
ccaccatatgaattgtacag

SEQ ID NO: 5672559 - DNA, 15 bp, Homo sapiens
ccaccatcaagccac

SEQ ID NO: 5672560 - DNA, 17 bp, Homo sapiens
ccaccatcaagccacca

SEQ ID NO: 5672561 - DNA, 20 bp, Homo sapiens
ccaccatcaagccaccaaca

SEQ ID NO: 5672562 - DNA, 14 bp, Homo sapiens
ccaccatccccacc

SEQ ID NO: 5672563 - DNA, 13 bp, Homo sapiens
ccaccatccctga

SEQ ID NO: 5672564 - DNA, 15 bp, Homo sapiens
ccaccatcctgcagc

SEQ ID NO: 5672565 - DNA, 18 bp, Homo sapiens
ccaccatccttccatcct

SEQ ID NO: 5672566 - DNA, 21 bp, Homo sapiens
ccaccatccttccatcctgag

SEQ ID NO: 5672567 - DNA, 11 bp, Homo sapiens
ccaccatctgc

SEQ ID NO: 5672568 - DNA, 13 bp, Homo sapiens
ccaccatctgctg

SEQ ID NO: 5672569 - DNA, 18 bp, Homo sapiens
ccaccatctgctgtcttt

SEQ ID NO: 5672570 - DNA, 22 bp, Homo sapiens
ccaccatctgtaccctgcttcc

SEQ ID NO: 5672571 - DNA, 22 bp, Homo sapiens
ccaccatctttgcaggttgctt

SEQ ID NO: 5672572 - DNA, 13 bp, Homo sapiens
ccaccatgcagcc

SEQ ID NO: 5672573 - DNA, 14 bp, Homo sapiens
ccaccatgcccagc

SEQ ID NO: 5672574 - DNA, 13 bp, Homo sapiens
ccaccatgcttgc

SEQ ID NO: 5672575 - DNA, 21 bp, Homo sapiens
ccaccatgcttgcctgaagct

SEQ ID NO: 5672576 - DNA, 21 bp, Homo sapiens
ccaccatggaccagcccattg

SEQ ID NO: 5672577 - DNA, 13 bp, Homo sapiens
ccaccattcacat

SEQ ID NO: 5672578 - DNA, 19 bp, Homo sapiens
ccaccattcctgcctttaa

SEQ ID NO: 5672579 - DNA, 15 bp, Homo sapiens
ccaccatttaatttc

SEQ ID NO: 5672580 - DNA, 22 bp, Homo sapiens
ccaccatttggcatccctgggc

SEQ ID NO: 5672581 - DNA, 20 bp, Homo sapiens
ccacccaaaccccttcccac

SEQ ID NO: 5672582 - DNA, 13 bp, Homo sapiens
ccacccaaagcag

SEQ ID NO: 5672583 - DNA, 15 bp, Homo sapiens
ccacccaacagctca

SEQ ID NO: 5672584 - DNA, 21 bp, Homo sapiens
ccacccaaccctatctcctga

SEQ ID NO: 5672585 - DNA, 16 bp, Homo sapiens
ccacccaacctgtcct

SEQ ID NO: 5672586 - DNA, 17 bp, Homo sapiens
ccacccaacctgtcctt

SEQ ID NO: 5672587 - DNA, 18 bp, Homo sapiens
ccacccaacctgtcctta

SEQ ID NO: 5672588 - DNA, 15 bp, Homo sapiens
ccacccaagcctgct

SEQ ID NO: 5672589 - DNA, 21 bp, Homo sapiens
ccacccaagcttggcagccga

SEQ ID NO: 5672590 - DNA, 12 bp, Homo sapiens
ccacccaaggag

SEQ ID NO: 5672591 - DNA, 16 bp, Homo sapiens
ccacccaagggcctgg

SEQ ID NO: 5672592 - DNA, 17 bp, Homo sapiens
ccacccaagggcctggc

SEQ ID NO: 5672593 - DNA, 14 bp, Homo sapiens
ccacccaagtatac

SEQ ID NO: 5672594 - DNA, 22 bp, Homo sapiens
ccacccaattcaaaacattgtg

SEQ ID NO: 5672595 - DNA, 12 bp, Homo sapiens
ccacccacaaac

SEQ ID NO: 5672596 - DNA, 17 bp, Homo sapiens
ccacccacaaactccag

SEQ ID NO: 5672597 - DNA, 19 bp, Homo sapiens
ccacccacaaactccaggc

SEQ ID NO: 5672598 - DNA, 21 bp, Homo sapiens
ccacccacaaactccaggctg

SEQ ID NO: 5672599 - DNA, 18 bp, Homo sapiens
ccacccacacagctgccc

SEQ ID NO: 5672600 - DNA, 18 bp, Homo sapiens
ccacccacatatcttaca

SEQ ID NO: 5672601 - DNA, 22 bp, Homo sapiens
ccacccacatatcttacagcca

SEQ ID NO: 5672602 - DNA, 12 bp, Homo sapiens
ccacccacatga

SEQ ID NO: 5672603 - DNA, 18 bp, Homo sapiens
ccacccaccaccgctccc

SEQ ID NO: 5672604 - DNA, 15 bp, Homo sapiens
ccacccaccagggcg

SEQ ID NO: 5672605 - DNA, 13 bp, Homo sapiens
ccacccaccccaa

SEQ ID NO: 5672606 - DNA, 14 bp, Homo sapiens
ccacccacccccag

SEQ ID NO: 5672607 - DNA, 15 bp, Homo sapiens
ccacccacccccagg

SEQ ID NO: 5672608 - DNA, 17 bp, Homo sapiens
ccacccacccccaggcc

SEQ ID NO: 5672609 - DNA, 13 bp, Homo sapiens
ccacccacccctc

SEQ ID NO: 5672610 - DNA, 11 bp, Homo sapiens
ccacccacctc

SEQ ID NO: 5672611 - DNA, 16 bp, Homo sapiens
ccacccacctcagcct

SEQ ID NO: 5672612 - DNA, 18 bp, Homo sapiens
ccacccacctccacccag

SEQ ID NO: 5672613 - DNA, 15 bp, Homo sapiens
ccacccacctcctgc

SEQ ID NO: 5672614 - DNA, 16 bp, Homo sapiens
ccacccacctcggcct

SEQ ID NO: 5672615 - DNA, 18 bp, Homo sapiens
ccacccacctcggcctcc

SEQ ID NO: 5672616 - DNA, 13 bp, Homo sapiens
ccacccacctggc

SEQ ID NO: 5672617 - DNA, 15 bp, Homo sapiens
ccacccactagccct

SEQ ID NO: 5672618 - DNA, 16 bp, Homo sapiens
ccacccactagccctc

SEQ ID NO: 5672619 - DNA, 13 bp, Homo sapiens
ccacccactgacc

SEQ ID NO: 5672620 - DNA, 23 bp, Homo sapiens
ccacccactgtggggcaagcctg

SEQ ID NO: 5672621 - DNA, 14 bp, Homo sapiens
ccacccacttgcct

SEQ ID NO: 5672622 - DNA, 20 bp, Homo sapiens
ccacccagaggtctccctat

SEQ ID NO: 5672623 - DNA, 22 bp, Homo sapiens
ccacccagaggtggccctccca

SEQ ID NO: 5672624 - DNA, 18 bp, Homo sapiens
ccacccagagtagagcca

SEQ ID NO: 5672625 - DNA, 12 bp, Homo sapiens
ccacccagcagc

SEQ ID NO: 5672626 - DNA, 15 bp, Homo sapiens
ccacccagcagcgcc

SEQ ID NO: 5672627 - DNA, 12 bp, Homo sapiens
ccacccagccca

SEQ ID NO: 5672628 - DNA, 15 bp, Homo sapiens
ccacccagcccctct

SEQ ID NO: 5672629 - DNA, 13 bp, Homo sapiens
ccacccagccctt

SEQ ID NO: 5672630 - DNA, 15 bp, Homo sapiens
ccacccagcccttcc

SEQ ID NO: 5672631 - DNA, 16 bp, Homo sapiens
ccacccagcccttcct

SEQ ID NO: 5672632 - DNA, 17 bp, Homo sapiens
ccacccagcccttcctt

SEQ ID NO: 5672633 - DNA, 20 bp, Homo sapiens
ccacccagcccttccttggg

SEQ ID NO: 5672634 - DNA, 13 bp, Homo sapiens
ccacccagctcca

SEQ ID NO: 5672635 - DNA, 11 bp, Homo sapiens
ccacccagctg

SEQ ID NO: 5672636 - DNA, 13 bp, Homo sapiens
ccacccagctggt

SEQ ID NO: 5672637 - DNA, 20 bp, Homo sapiens
ccacccagctggtcctgtgg

SEQ ID NO: 5672638 - DNA, 18 bp, Homo sapiens
ccacccaggaaaggagga

SEQ ID NO: 5672639 - DNA, 21 bp, Homo sapiens
ccacccaggaaaggaggacca

SEQ ID NO: 5672640 - DNA, 23 bp, Homo sapiens
ccacccaggaagggagggagctg

SEQ ID NO: 5672641 - DNA, 14 bp, Homo sapiens
ccacccaggagccc

SEQ ID NO: 5672642 - DNA, 14 bp, Homo sapiens
ccacccaggaggga

SEQ ID NO: 5672643 - DNA, 20 bp, Homo sapiens
ccacccaggatgacccctgg

SEQ ID NO: 5672644 - DNA, 12 bp, Homo sapiens
ccacccaggctg

SEQ ID NO: 5672645 - DNA, 16 bp, Homo sapiens
ccacccaggctgcact

SEQ ID NO: 5672646 - DNA, 22 bp, Homo sapiens
ccacccaggctgcactgcagtg

SEQ ID NO: 5672647 - DNA, 12 bp, Homo sapiens
ccacccagggaa

SEQ ID NO: 5672648 - DNA, 16 bp, Homo sapiens
ccacccagtagcccag

SEQ ID NO: 5672649 - DNA, 13 bp, Homo sapiens
ccacccagtgctg

SEQ ID NO: 5672650 - DNA, 16 bp, Homo sapiens
ccacccagtgctgcca

SEQ ID NO: 5672651 - DNA, 20 bp, Homo sapiens
ccacccagtgctgccatgcc

SEQ ID NO: 5672652 - DNA, 20 bp, Homo sapiens
ccacccatcagtggagtcca

SEQ ID NO: 5672653 - DNA, 21 bp, Homo sapiens
ccacccatcctaccaatgcat

SEQ ID NO: 5672654 - DNA, 14 bp, Homo sapiens
ccacccatcgctgt

SEQ ID NO: 5672655 - DNA, 17 bp, Homo sapiens
ccacccatcgctgtgtg

SEQ ID NO: 5672656 - DNA, 21 bp, Homo sapiens
ccacccatcgtccaccccagt

SEQ ID NO: 5672657 - DNA, 19 bp, Homo sapiens
ccacccatcttcctgctgc

SEQ ID NO: 5672658 - DNA, 20 bp, Homo sapiens
ccacccatcttcctgctgct

SEQ ID NO: 5672659 - DNA, 19 bp, Homo sapiens
ccacccatgatactccact

SEQ ID NO: 5672660 - DNA, 13 bp, Homo sapiens
ccacccatgcacg

SEQ ID NO: 5672661 - DNA, 20 bp, Homo sapiens
ccacccatgcagctgctccc

SEQ ID NO: 5672662 - DNA, 23 bp, Homo sapiens
ccacccatgcagctgctccccag

SEQ ID NO: 5672663 - DNA, 14 bp, Homo sapiens
ccacccatgccagc

SEQ ID NO: 5672664 - DNA, 11 bp, Homo sapiens
ccacccatgcg

SEQ ID NO: 5672665 - DNA, 13 bp, Homo sapiens
ccacccatgggga

SEQ ID NO: 5672666 - DNA, 14 bp, Homo sapiens
ccacccatggggag

SEQ ID NO: 5672667 - DNA, 14 bp, Homo sapiens
ccacccatgtcacc

SEQ ID NO: 5672668 - DNA, 13 bp, Homo sapiens
ccacccatgtgag

SEQ ID NO: 5672669 - DNA, 16 bp, Homo sapiens
ccacccattcttcccg

SEQ ID NO: 5672670 - DNA, 17 bp, Homo sapiens
ccacccatttgttttcg

SEQ ID NO: 5672671 - DNA, 18 bp, Homo sapiens
ccaccccaaaccccagcc

SEQ ID NO: 5672672 - DNA, 18 bp, Homo sapiens
ccaccccaaacttccagg

SEQ ID NO: 5672673 - DNA, 19 bp, Homo sapiens
ccaccccaagagaactcgc

SEQ ID NO: 5672674 - DNA, 17 bp, Homo sapiens
ccaccccaatcctccca

SEQ ID NO: 5672675 - DNA, 13 bp, Homo sapiens
ccaccccacagat

SEQ ID NO: 5672676 - DNA, 15 bp, Homo sapiens
ccaccccacagatca

SEQ ID NO: 5672677 - DNA, 14 bp, Homo sapiens
ccaccccaccccct

SEQ ID NO: 5672678 - DNA, 13 bp, Homo sapiens
ccaccccacctcc

SEQ ID NO: 5672679 - DNA, 14 bp, Homo sapiens
ccaccccacctcca

SEQ ID NO: 5672680 - DNA, 16 bp, Homo sapiens
ccaccccacctccact

SEQ ID NO: 5672681 - DNA, 16 bp, Homo sapiens
ccaccccacctcttgt

SEQ ID NO: 5672682 - DNA, 13 bp, Homo sapiens
ccaccccacgccc

SEQ ID NO: 5672683 - DNA, 19 bp, Homo sapiens
ccaccccactccagccctg

SEQ ID NO: 5672684 - DNA, 21 bp, Homo sapiens
ccaccccactctacctcctta

SEQ ID NO: 5672685 - DNA, 20 bp, Homo sapiens
ccaccccagaaatcactgtg

SEQ ID NO: 5672686 - DNA, 12 bp, Homo sapiens
ccaccccagagt

SEQ ID NO: 5672687 - DNA, 14 bp, Homo sapiens
ccaccccagagttg

SEQ ID NO: 5672688 - DNA, 22 bp, Homo sapiens
ccaccccagagttgggatgcgg

SEQ ID NO: 5672689 - DNA, 17 bp, Homo sapiens
ccaccccagcacagcca

SEQ ID NO: 5672690 - DNA, 11 bp, Homo sapiens
ccaccccagcc

SEQ ID NO: 5672691 - DNA, 20 bp, Homo sapiens
ccaccccagccccactgccc

SEQ ID NO: 5672692 - DNA, 13 bp, Homo sapiens
ccaccccaggacg

SEQ ID NO: 5672693 - DNA, 14 bp, Homo sapiens
ccaccccaggccct

SEQ ID NO: 5672694 - DNA, 14 bp, Homo sapiens
ccaccccaggctgg

SEQ ID NO: 5672695 - DNA, 17 bp, Homo sapiens
ccaccccagtgcaccca

SEQ ID NO: 5672696 - DNA, 19 bp, Homo sapiens
ccaccccagtgcacccact

SEQ ID NO: 5672697 - DNA, 13 bp, Homo sapiens
ccaccccagtggg

SEQ ID NO: 5672698 - DNA, 16 bp, Homo sapiens
ccaccccatccagcca

SEQ ID NO: 5672699 - DNA, 18 bp, Homo sapiens
ccaccccatccagccaga

SEQ ID NO: 5672700 - DNA, 16 bp, Homo sapiens
ccaccccatccctggc

SEQ ID NO: 5672701 - DNA, 12 bp, Homo sapiens
ccaccccatgct

SEQ ID NO: 5672702 - DNA, 16 bp, Homo sapiens
ccaccccattcccgca

SEQ ID NO: 5672703 - DNA, 18 bp, Homo sapiens
ccacccccaacccccaga

SEQ ID NO: 5672704 - DNA, 21 bp, Homo sapiens
ccacccccaccaagggcgcaa

SEQ ID NO: 5672705 - DNA, 14 bp, Homo sapiens
ccacccccagccag

SEQ ID NO: 5672706 - DNA, 15 bp, Homo sapiens
ccacccccagccagg

SEQ ID NO: 5672707 - DNA, 14 bp, Homo sapiens
ccacccccagcccc

SEQ ID NO: 5672708 - DNA, 13 bp, Homo sapiens
ccacccccagcct

SEQ ID NO: 5672709 - DNA, 14 bp, Homo sapiens
ccacccccaggcct

SEQ ID NO: 5672710 - DNA, 15 bp, Homo sapiens
ccacccccaggcctc

SEQ ID NO: 5672711 - DNA, 13 bp, Homo sapiens
ccacccccaggtc

SEQ ID NO: 5672712 - DNA, 21 bp, Homo sapiens
ccacccccaggtcttcctgct

SEQ ID NO: 5672713 - DNA, 13 bp, Homo sapiens
ccacccccagtcc

SEQ ID NO: 5672714 - DNA, 13 bp, Homo sapiens
ccacccccagttc

SEQ ID NO: 5672715 - DNA, 12 bp, Homo sapiens
ccacccccatct

SEQ ID NO: 5672716 - DNA, 13 bp, Homo sapiens
ccacccccatctt

SEQ ID NO: 5672717 - DNA, 22 bp, Homo sapiens
ccacccccatgtggcagcccat

SEQ ID NO: 5672718 - DNA, 17 bp, Homo sapiens
ccaccccccacgtctgt

SEQ ID NO: 5672719 - DNA, 18 bp, Homo sapiens
ccaccccccactctgtgc

SEQ ID NO: 5672720 - DNA, 22 bp, Homo sapiens
ccaccccccagaacctgtcctt

SEQ ID NO: 5672721 - DNA, 13 bp, Homo sapiens
ccaccccccaggc

SEQ ID NO: 5672722 - DNA, 19 bp, Homo sapiens
ccacccccccaccccaggc

SEQ ID NO: 5672723 - DNA, 13 bp, Homo sapiens
ccacccccctcat

SEQ ID NO: 5672724 - DNA, 13 bp, Homo sapiens
ccacccccctccc

SEQ ID NO: 5672725 - DNA, 16 bp, Homo sapiens
ccacccccctcctccc

SEQ ID NO: 5672726 - DNA, 22 bp, Homo sapiens
ccacccccctctctttctctgg

SEQ ID NO: 5672727 - DNA, 19 bp, Homo sapiens
ccacccccgagcttgcctc

SEQ ID NO: 5672728 - DNA, 20 bp, Homo sapiens
ccacccccgagcttgcctca

SEQ ID NO: 5672729 - DNA, 21 bp, Homo sapiens
ccacccccgccgtggggctcc

SEQ ID NO: 5672730 - DNA, 21 bp, Homo sapiens
ccacccccgggatcctgcccc

SEQ ID NO: 5672731 - DNA, 19 bp, Homo sapiens
ccacccccgggtgcctgtg

SEQ ID NO: 5672732 - DNA, 18 bp, Homo sapiens
ccacccccgtcaccccgc

SEQ ID NO: 5672733 - DNA, 14 bp, Homo sapiens
ccaccccctcaagc

SEQ ID NO: 5672734 - DNA, 15 bp, Homo sapiens
ccaccccctcaagcc

SEQ ID NO: 5672735 - DNA, 18 bp, Homo sapiens
ccaccccctccccgggca

SEQ ID NO: 5672736 - DNA, 22 bp, Homo sapiens
ccaccccctccctggcctgttc

SEQ ID NO: 5672737 - DNA, 19 bp, Homo sapiens
ccaccccctccttccctgt

SEQ ID NO: 5672738 - DNA, 13 bp, Homo sapiens
ccaccccctgccc

SEQ ID NO: 5672739 - DNA, 14 bp, Homo sapiens
ccaccccctgccct

SEQ ID NO: 5672740 - DNA, 17 bp, Homo sapiens
ccaccccctgccctgca

SEQ ID NO: 5672741 - DNA, 14 bp, Homo sapiens
ccaccccctgcctg

SEQ ID NO: 5672742 - DNA, 16 bp, Homo sapiens
ccaccccctgcctggt

SEQ ID NO: 5672743 - DNA, 15 bp, Homo sapiens
ccaccccctgggcag

SEQ ID NO: 5672744 - DNA, 16 bp, Homo sapiens
ccaccccctgttccct

SEQ ID NO: 5672745 - DNA, 18 bp, Homo sapiens
ccacccccttcagtgccc

SEQ ID NO: 5672746 - DNA, 22 bp, Homo sapiens
ccacccccttcagtgcccacca

SEQ ID NO: 5672747 - DNA, 19 bp, Homo sapiens
ccacccccttccctgggag

SEQ ID NO: 5672748 - DNA, 20 bp, Homo sapiens
ccacccccttctctgctcca

SEQ ID NO: 5672749 - DNA, 16 bp, Homo sapiens
ccaccccgccgttccc

SEQ ID NO: 5672750 - DNA, 14 bp, Homo sapiens
ccaccccgcctctg

SEQ ID NO: 5672751 - DNA, 16 bp, Homo sapiens
ccaccccgctctgcat

SEQ ID NO: 5672752 - DNA, 16 bp, Homo sapiens
ccaccccgctgatgga

SEQ ID NO: 5672753 - DNA, 17 bp, Homo sapiens
ccaccccggcctccact

SEQ ID NO: 5672754 - DNA, 22 bp, Homo sapiens
ccaccccggctccccctgccag

SEQ ID NO: 5672755 - DNA, 23 bp, Homo sapiens
ccaccccggctccccctgccagc

SEQ ID NO: 5672756 - DNA, 14 bp, Homo sapiens
ccaccccgggctct

SEQ ID NO: 5672757 - DNA, 17 bp, Homo sapiens
ccaccccgggctctctg

SEQ ID NO: 5672758 - DNA, 20 bp, Homo sapiens
ccaccccggggaccctgtga

SEQ ID NO: 5672759 - DNA, 20 bp, Homo sapiens
ccaccccgtagattcccatc

SEQ ID NO: 5672760 - DNA, 20 bp, Homo sapiens
ccaccccgtccatggtgcta

SEQ ID NO: 5672761 - DNA, 12 bp, Homo sapiens
ccaccccgtccc

SEQ ID NO: 5672762 - DNA, 15 bp, Homo sapiens
ccaccccgtcccggc

SEQ ID NO: 5672763 - DNA, 13 bp, Homo sapiens
ccaccccgtcctg

SEQ ID NO: 5672764 - DNA, 19 bp, Homo sapiens
ccacctctgtgacctcagg

SEQ ID NO: 5672765 - DNA, 22 bp, Homo sapiens
ccacctctgtgacctcaggcac

SEQ ID NO: 5672766 - DNA, 14 bp, Homo sapiens
ccacctctgtgcag

SEQ ID NO: 5672767 - DNA, 14 bp, Homo sapiens
ccacctctgtggca

SEQ ID NO: 5672768 - DNA, 14 bp, Homo sapiens
ccacctctgtgggc

SEQ ID NO: 5672769 - DNA, 19 bp, Homo sapiens
ccacctcttctcttcctgt

SEQ ID NO: 5672770 - DNA, 12 bp, Homo sapiens
ccacctctttct

SEQ ID NO: 5672771 - DNA, 18 bp, Homo sapiens
ccacctctttctacagcc

SEQ ID NO: 5672772 - DNA, 13 bp, Homo sapiens
ccacctctttctt

SEQ ID NO: 5672773 - DNA, 15 bp, Homo sapiens
ccacctcttttccta

SEQ ID NO: 5672774 - DNA, 16 bp, Homo sapiens
ccacctgaaagcctgt

SEQ ID NO: 5672775 - DNA, 17 bp, Homo sapiens
ccacctgaaagcctgtc

SEQ ID NO: 5672776 - DNA, 19 bp, Homo sapiens
ccacctgacaatggcagct

SEQ ID NO: 5672777 - DNA, 23 bp, Homo sapiens
ccacctgacacaccaggcgctaa

SEQ ID NO: 5672778 - DNA, 17 bp, Homo sapiens
ccacctgaccaggggcc

SEQ ID NO: 5672779 - DNA, 15 bp, Homo sapiens
ccacctgacctctgc

SEQ ID NO: 5672780 - DNA, 20 bp, Homo sapiens
ccacctgagctttggacaca

SEQ ID NO: 5672781 - DNA, 12 bp, Homo sapiens
ccacctgaggca

SEQ ID NO: 5672782 - DNA, 19 bp, Homo sapiens
ccacctgaggccccaggtg

SEQ ID NO: 5672783 - DNA, 14 bp, Homo sapiens
ccacctgaggtggg

SEQ ID NO: 5672784 - DNA, 21 bp, Homo sapiens
ccacctgaggtgggcccagga

SEQ ID NO: 5672785 - DNA, 22 bp, Homo sapiens
ccacctgaggtgggcccaggac

SEQ ID NO: 5672786 - DNA, 16 bp, Homo sapiens
ccacctgagttcctga

SEQ ID NO: 5672787 - DNA, 17 bp, Homo sapiens
ccacctgcaagtgcccg

SEQ ID NO: 5672788 - DNA, 19 bp, Homo sapiens
ccacctgcaagtgcccgcc

SEQ ID NO: 5672789 - DNA, 12 bp, Homo sapiens
ccacctgcacaa

SEQ ID NO: 5672790 - DNA, 11 bp, Homo sapiens
ccacctgcacc

SEQ ID NO: 5672791 - DNA, 13 bp, Homo sapiens
ccacctgcaccca

SEQ ID NO: 5672792 - DNA, 14 bp, Homo sapiens
ccacctgcacccag

SEQ ID NO: 5672793 - DNA, 11 bp, Homo sapiens
ccacctgcagc

SEQ ID NO: 5672794 - DNA, 21 bp, Homo sapiens
ccacctgcagccccaggcctc

SEQ ID NO: 5672795 - DNA, 13 bp, Homo sapiens
ccacctgcagcgt

SEQ ID NO: 5672796 - DNA, 19 bp, Homo sapiens
ccacctgcagggctgccct

SEQ ID NO: 5672797 - DNA, 23 bp, Homo sapiens
ccacctgcatcagcctctggcca

SEQ ID NO: 5672798 - DNA, 21 bp, Homo sapiens
ccacctgccacccccaggtct

SEQ ID NO: 5672799 - DNA, 14 bp, Homo sapiens
ccacctgccactag

SEQ ID NO: 5672800 - DNA, 12 bp, Homo sapiens
ccacctgccagc

SEQ ID NO: 5672801 - DNA, 13 bp, Homo sapiens
ccacctgccagcc

SEQ ID NO: 5672802 - DNA, 16 bp, Homo sapiens
ccacctgccagccatc

SEQ ID NO: 5672803 - DNA, 13 bp, Homo sapiens
ccacctgccaggc

SEQ ID NO: 5672804 - DNA, 19 bp, Homo sapiens
ccacctgccaggcctccct

SEQ ID NO: 5672805 - DNA, 20 bp, Homo sapiens
ccacctgccaggcctccctc

SEQ ID NO: 5672806 - DNA, 15 bp, Homo sapiens
ccacctgccaggctg

SEQ ID NO: 5672807 - DNA, 17 bp, Homo sapiens
ccacctgccaggctgca

SEQ ID NO: 5672808 - DNA, 18 bp, Homo sapiens
ccacctgccaggctgcag

SEQ ID NO: 5672809 - DNA, 14 bp, Homo sapiens
ccacctgccaggga

SEQ ID NO: 5672810 - DNA, 12 bp, Homo sapiens
ccacctgcccag

SEQ ID NO: 5672811 - DNA, 15 bp, Homo sapiens
ccacctgcccagtta

SEQ ID NO: 5672812 - DNA, 22 bp, Homo sapiens
ccacctgcccagttagcccggc

SEQ ID NO: 5672813 - DNA, 15 bp, Homo sapiens
ccacctgcccatcac

SEQ ID NO: 5672814 - DNA, 18 bp, Homo sapiens
ccacctgcccccttctcc

SEQ ID NO: 5672815 - DNA, 21 bp, Homo sapiens
ccacctgcccccttctcccac

SEQ ID NO: 5672816 - DNA, 22 bp, Homo sapiens
ccacctgcccccttctcccaca

SEQ ID NO: 5672817 - DNA, 19 bp, Homo sapiens
ccacctgcccggcccagga

SEQ ID NO: 5672818 - DNA, 24 bp, Homo sapiens
ccacctgcccggcccaggagcgca

SEQ ID NO: 5672819 - DNA, 22 bp, Homo sapiens
ccacctgcccttttttctgcct

SEQ ID NO: 5672820 - DNA, 19 bp, Homo sapiens
ccacctgcctatccatcct

SEQ ID NO: 5672821 - DNA, 20 bp, Homo sapiens
ccacctgcctggccggccag

SEQ ID NO: 5672822 - DNA, 22 bp, Homo sapiens
ccacctgcctggccggccagcc

SEQ ID NO: 5672823 - DNA, 14 bp, Homo sapiens
ccacctgcctggtg

SEQ ID NO: 5672824 - DNA, 16 bp, Homo sapiens
ccacctgccttccatt

SEQ ID NO: 5672825 - DNA, 17 bp, Homo sapiens
ccacctgcgcttctgct

SEQ ID NO: 5672826 - DNA, 14 bp, Homo sapiens
ccacctgcggctcc

SEQ ID NO: 5672827 - DNA, 22 bp, Homo sapiens
ccacctgctagtcgcccctcag

SEQ ID NO: 5672828 - DNA, 11 bp, Homo sapiens
ccacctgctgc

SEQ ID NO: 5672829 - DNA, 12 bp, Homo sapiens
ccacctgctgcc

SEQ ID NO: 5672830 - DNA, 12 bp, Homo sapiens
ccacctgctgcg

SEQ ID NO: 5672831 - DNA, 14 bp, Homo sapiens
ccacctgctgctgt

SEQ ID NO: 5672832 - DNA, 21 bp, Homo sapiens
ccacctgcttgtgttgggccc

SEQ ID NO: 5672833 - DNA, 13 bp, Homo sapiens
ccacctgctttct

SEQ ID NO: 5672834 - DNA, 19 bp, Homo sapiens
ccacctggaaactgctcag

SEQ ID NO: 5672835 - DNA, 14 bp, Homo sapiens
ccacctggagcccg

SEQ ID NO: 5672836 - DNA, 21 bp, Homo sapiens
ccacctggatctatccctgcg

SEQ ID NO: 5672837 - DNA, 19 bp, Homo sapiens
ccacctggatggatctgct

SEQ ID NO: 5672838 - DNA, 23 bp, Homo sapiens
ccacctggcagggctcacactcc

SEQ ID NO: 5672839 - DNA, 14 bp, Homo sapiens
ccacctggccacct

SEQ ID NO: 5672840 - DNA, 18 bp, Homo sapiens
ccacctggccacctgagg

SEQ ID NO: 5672841 - DNA, 12 bp, Homo sapiens
ccacctggcccc

SEQ ID NO: 5672842 - DNA, 22 bp, Homo sapiens
ccacctggccccatgtctctca

SEQ ID NO: 5672843 - DNA, 18 bp, Homo sapiens
ccacctggcctctgcact

SEQ ID NO: 5672844 - DNA, 11 bp, Homo sapiens
ccacctggctc

SEQ ID NO: 5672845 - DNA, 14 bp, Homo sapiens
ccacctggctcccc

SEQ ID NO: 5672846 - DNA, 22 bp, Homo sapiens
ccacctggctctcacctctagg

SEQ ID NO: 5672847 - DNA, 12 bp, Homo sapiens
ccacctggctgc

SEQ ID NO: 5672848 - DNA, 20 bp, Homo sapiens
ccacctggcttcatacagaa

SEQ ID NO: 5672849 - DNA, 15 bp, Homo sapiens
ccacctgggaacaca

SEQ ID NO: 5672850 - DNA, 22 bp, Homo sapiens
ccacctgggcatatccaccacc

SEQ ID NO: 5672851 - DNA, 18 bp, Homo sapiens
ccacctgggccaaggact

SEQ ID NO: 5672852 - DNA, 16 bp, Homo sapiens
ccacctgggccctagg

SEQ ID NO: 5672853 - DNA, 19 bp, Homo sapiens
ccacctgggcctcccatag

SEQ ID NO: 5672854 - DNA, 14 bp, Homo sapiens
ccacctggggcagt

SEQ ID NO: 5672855 - DNA, 15 bp, Homo sapiens
ccacctggggcagtc

SEQ ID NO: 5672856 - DNA, 13 bp, Homo sapiens
ccacctggggtct

SEQ ID NO: 5672857 - DNA, 18 bp, Homo sapiens
ccacctggggtctctctc

SEQ ID NO: 5672858 - DNA, 20 bp, Homo sapiens
ccacctggggtctctctccc

SEQ ID NO: 5672859 - DNA, 21 bp, Homo sapiens
ccacctggtactccctctcag

SEQ ID NO: 5672860 - DNA, 14 bp, Homo sapiens
ccacctggtggccc

SEQ ID NO: 5672861 - DNA, 15 bp, Homo sapiens
ccacctggtggcctc

SEQ ID NO: 5672862 - DNA, 19 bp, Homo sapiens
ccacctggttgaatataat

SEQ ID NO: 5672863 - DNA, 15 bp, Homo sapiens
ccacctgtagccatc

SEQ ID NO: 5672864 - DNA, 19 bp, Homo sapiens
ccacctgtagccatctgca

SEQ ID NO: 5672865 - DNA, 18 bp, Homo sapiens
ccacctgtagctgaagca

SEQ ID NO: 5672866 - DNA, 22 bp, Homo sapiens
ccacctgtcaaacaaagccaga

SEQ ID NO: 5672867 - DNA, 13 bp, Homo sapiens
ccacctgtcccac

SEQ ID NO: 5672868 - DNA, 11 bp, Homo sapiens
ccacctgtctc

SEQ ID NO: 5672869 - DNA, 15 bp, Homo sapiens
ccacctgtctcagcc

SEQ ID NO: 5672870 - DNA, 16 bp, Homo sapiens
ccacctgtctcagcct

SEQ ID NO: 5672871 - DNA, 14 bp, Homo sapiens
ccacctgtcttcaa

SEQ ID NO: 5672872 - DNA, 18 bp, Homo sapiens
ccacctgtgagaaaggaa

SEQ ID NO: 5672873 - DNA, 20 bp, Homo sapiens
ccacctgtgagaaaggaaaa

SEQ ID NO: 5672874 - DNA, 21 bp, Homo sapiens
ccacctgtgagaaaggaaaaa

SEQ ID NO: 5672875 - DNA, 18 bp, Homo sapiens
ccacctgtgccctcacca

SEQ ID NO: 5672876 - DNA, 14 bp, Homo sapiens
ccacctgtgcttgg

SEQ ID NO: 5672877 - DNA, 11 bp, Homo sapiens
ccacctgtggg

SEQ ID NO: 5672878 - DNA, 22 bp, Homo sapiens
ccacctgttaaaatgtacactg

SEQ ID NO: 5672879 - DNA, 21 bp, Homo sapiens
ccacctgttgtcctgaactgt

SEQ ID NO: 5672880 - DNA, 16 bp, Homo sapiens
ccacctgttttctgaa

SEQ ID NO: 5672881 - DNA, 17 bp, Homo sapiens
ccacctgttttctgaaa

SEQ ID NO: 5672882 - DNA, 20 bp, Homo sapiens
ccaccttaaattaaacaatt

SEQ ID NO: 5672883 - DNA, 19 bp, Homo sapiens
ccaccttcaagcaccctgt

SEQ ID NO: 5672884 - DNA, 22 bp, Homo sapiens
ccaccttcaatgacttctaatt

SEQ ID NO: 5672885 - DNA, 14 bp, Homo sapiens
ccaccttcaggccc

SEQ ID NO: 5672886 - DNA, 22 bp, Homo sapiens
ccaccttcatttaactctttga

SEQ ID NO: 5672887 - DNA, 12 bp, Homo sapiens
ccaccttcccag

SEQ ID NO: 5672888 - DNA, 13 bp, Homo sapiens
ccaccttcccagc

SEQ ID NO: 5672889 - DNA, 15 bp, Homo sapiens
ccaccttcccagctc

SEQ ID NO: 5672890 - DNA, 19 bp, Homo sapiens
ccaccttcccagctctccc

SEQ ID NO: 5672891 - DNA, 11 bp, Homo sapiens
ccaccttcccc

SEQ ID NO: 5672892 - DNA, 16 bp, Homo sapiens
ccaccttccccagact

SEQ ID NO: 5672893 - DNA, 14 bp, Homo sapiens
ccaccttcccccaa

SEQ ID NO: 5672894 - DNA, 15 bp, Homo sapiens
ccaccttccctcttt

SEQ ID NO: 5672895 - DNA, 23 bp, Homo sapiens
ccaccttcccttcctcagcaggc

SEQ ID NO: 5672896 - DNA, 14 bp, Homo sapiens
ccaccttcctgccc

SEQ ID NO: 5672897 - DNA, 16 bp, Homo sapiens
ccaccttcctgcccag

SEQ ID NO: 5672898 - DNA, 17 bp, Homo sapiens
ccaccttcctgcccagg

SEQ ID NO: 5672899 - DNA, 21 bp, Homo sapiens
ccaccttccttgcgaccacca

SEQ ID NO: 5672900 - DNA, 21 bp, Homo sapiens
ccaccttcgggcagtcctgtg

SEQ ID NO: 5672901 - DNA, 21 bp, Homo sapiens
ccaccttctgtccccagccct

SEQ ID NO: 5672902 - DNA, 23 bp, Homo sapiens
ccaccttcttgggactgctgtga

SEQ ID NO: 5672903 - DNA, 14 bp, Homo sapiens
ccaccttgatccca

SEQ ID NO: 5672904 - DNA, 14 bp, Homo sapiens
ccaccttgattttc

SEQ ID NO: 5672905 - DNA, 15 bp, Homo sapiens
ccaccttgattttct

SEQ ID NO: 5672906 - DNA, 16 bp, Homo sapiens
ccaccttgccagggca

SEQ ID NO: 5672907 - DNA, 17 bp, Homo sapiens
ccaccttgcttgaggga

SEQ ID NO: 5672908 - DNA, 16 bp, Homo sapiens
ccaccttggactcctc

SEQ ID NO: 5672909 - DNA, 23 bp, Homo sapiens
ccaccttggactcctcccacaat

SEQ ID NO: 5672910 - DNA, 15 bp, Homo sapiens
ccaccttggaggagg

SEQ ID NO: 5672911 - DNA, 12 bp, Homo sapiens
ccaccttggcct

SEQ ID NO: 5672912 - DNA, 21 bp, Homo sapiens
ccaccttggcctcccaaagtg

SEQ ID NO: 5672913 - DNA, 15 bp, Homo sapiens
ccaccttggctcaag

SEQ ID NO: 5672914 - DNA, 16 bp, Homo sapiens
ccaccttggctcaagt

SEQ ID NO: 5672915 - DNA, 15 bp, Homo sapiens
ccaccttggctctgc

SEQ ID NO: 5672916 - DNA, 18 bp, Homo sapiens
ccaccttggctctgccag

SEQ ID NO: 5672917 - DNA, 19 bp, Homo sapiens
ccaccttggctctgccagt

SEQ ID NO: 5672918 - DNA, 12 bp, Homo sapiens
ccaccttggctg

SEQ ID NO: 5672919 - DNA, 15 bp, Homo sapiens
ccaccttggctgcag

SEQ ID NO: 5672920 - DNA, 18 bp, Homo sapiens
ccaccttggctgcaggga

SEQ ID NO: 5672921 - DNA, 19 bp, Homo sapiens
ccaccttggctgcagggag

SEQ ID NO: 5672922 - DNA, 15 bp, Homo sapiens
ccaccttgtcctggc

SEQ ID NO: 5672923 - DNA, 14 bp, Homo sapiens
ccaccttgtctgct

SEQ ID NO: 5672924 - DNA, 17 bp, Homo sapiens
ccaccttgttggagcct

SEQ ID NO: 5672925 - DNA, 18 bp, Homo sapiens
ccaccttgttggagcctg

SEQ ID NO: 5672926 - DNA, 21 bp, Homo sapiens
ccaccttgttggagcctgcag

SEQ ID NO: 5672927 - DNA, 18 bp, Homo sapiens
ccacctttactctgctct

SEQ ID NO: 5672928 - DNA, 16 bp, Homo sapiens
ccacctttcaccctca

SEQ ID NO: 5672929 - DNA, 17 bp, Homo sapiens
ccacctttcagcccacg

SEQ ID NO: 5672930 - DNA, 18 bp, Homo sapiens
ccacctttctgaatggaa

SEQ ID NO: 5672931 - DNA, 21 bp, Homo sapiens
ccacgaacacgcatgcctcag

SEQ ID NO: 5672932 - DNA, 16 bp, Homo sapiens
ccacgaacgctcttag

SEQ ID NO: 5672933 - DNA, 23 bp, Homo sapiens
ccacgaatttctgtgccctcctg

SEQ ID NO: 5672934 - DNA, 23 bp, Homo sapiens
ccacgaatttgctggggaatctc

SEQ ID NO: 5672935 - DNA, 15 bp, Homo sapiens
ccacgaccagcccct

SEQ ID NO: 5672936 - DNA, 16 bp, Homo sapiens
ccacgacctcgtccat

SEQ ID NO: 5672937 - DNA, 17 bp, Homo sapiens
ccacgacctcgtccatt

SEQ ID NO: 5672938 - DNA, 18 bp, Homo sapiens
ccacgactggccagggcc

SEQ ID NO: 5672939 - DNA, 13 bp, Homo sapiens
ccacgaggagcag

SEQ ID NO: 5672940 - DNA, 15 bp, Homo sapiens
ccacgaggaggaacc

SEQ ID NO: 5672941 - DNA, 14 bp, Homo sapiens
ccacgaggctgccc

SEQ ID NO: 5672942 - DNA, 12 bp, Homo sapiens
ccacgagggctg

SEQ ID NO: 5672943 - DNA, 20 bp, Homo sapiens
ccacgagggctggctggcct

SEQ ID NO: 5672944 - DNA, 19 bp, Homo sapiens
ctcgctcccctctggaatc

SEQ ID NO: 5672945 - DNA, 15 bp, Homo sapiens
ctcgctccctcccag

SEQ ID NO: 5672946 - DNA, 13 bp, Homo sapiens
ctcgctcccttca

SEQ ID NO: 5672947 - DNA, 17 bp, Homo sapiens
ctcgctcctccttccca

SEQ ID NO: 5672948 - DNA, 23 bp, Homo sapiens
ctcgctctctcgtactctctctc

SEQ ID NO: 5672949 - DNA, 22 bp, Homo sapiens
ctcgctctctctcgctgcgtcc

SEQ ID NO: 5672950 - DNA, 12 bp, Homo sapiens
ctcgctctctgt

SEQ ID NO: 5672951 - DNA, 14 bp, Homo sapiens
ctcgctctctgtct

SEQ ID NO: 5672952 - DNA, 18 bp, Homo sapiens
ctcgctctgctgcccagg

SEQ ID NO: 5672953 - DNA, 13 bp, Homo sapiens
ctcgctctgtcac

SEQ ID NO: 5672954 - DNA, 17 bp, Homo sapiens
ctcgctctgtcgcccag

SEQ ID NO: 5672955 - DNA, 20 bp, Homo sapiens
ctcgctctgttgcccaggct

SEQ ID NO: 5672956 - DNA, 14 bp, Homo sapiens
ctcgctcttgggag

SEQ ID NO: 5672957 - DNA, 19 bp, Homo sapiens
ctcgctgatgctgggctgg

SEQ ID NO: 5672958 - DNA, 17 bp, Homo sapiens
ctcgctgccacccaccc

SEQ ID NO: 5672959 - DNA, 12 bp, Homo sapiens
ctcgctgctgct

SEQ ID NO: 5672960 - DNA, 15 bp, Homo sapiens
ctcgctgcttctgtg

SEQ ID NO: 5672961 - DNA, 12 bp, Homo sapiens
ctcgctggcccc

SEQ ID NO: 5672962 - DNA, 16 bp, Homo sapiens
ctcgctggcccccact

SEQ ID NO: 5672963 - DNA, 16 bp, Homo sapiens
ctcgctggctttctct

SEQ ID NO: 5672964 - DNA, 21 bp, Homo sapiens
ctcgctgtaggtcaggcccgc

SEQ ID NO: 5672965 - DNA, 18 bp, Homo sapiens
ctcgctgtcactggctgg

SEQ ID NO: 5672966 - DNA, 21 bp, Homo sapiens
ctcgctgtcactggctggctc

SEQ ID NO: 5672967 - DNA, 18 bp, Homo sapiens
ctcgctgtgccaccaccc

SEQ ID NO: 5672968 - DNA, 12 bp, Homo sapiens
ctcgctgttgct

SEQ ID NO: 5672969 - DNA, 13 bp, Homo sapiens
ctcgctgttgctg

SEQ ID NO: 5672970 - DNA, 16 bp, Homo sapiens
ctcgctgttgctgaat

SEQ ID NO: 5672971 - DNA, 19 bp, Homo sapiens
ctcgcttcctcagcctcca

SEQ ID NO: 5672972 - DNA, 16 bp, Homo sapiens
ctcgcttctcctccag

SEQ ID NO: 5672973 - DNA, 14 bp, Homo sapiens
ctcgcttctctgtg

SEQ ID NO: 5672974 - DNA, 14 bp, Homo sapiens
ctcgcttgccgggc

SEQ ID NO: 5672975 - DNA, 23 bp, Homo sapiens
ctcgcttgccgggcctgggcctc

SEQ ID NO: 5672976 - DNA, 14 bp, Homo sapiens
ctcgcttgctggaa

SEQ ID NO: 5672977 - DNA, 19 bp, Homo sapiens
ctcgcttgctggaacacag

SEQ ID NO: 5672978 - DNA, 20 bp, Homo sapiens
ctcgcttgctggaacacagg

SEQ ID NO: 5672979 - DNA, 22 bp, Homo sapiens
ctcgcttggacggctgggcaca

SEQ ID NO: 5672980 - DNA, 17 bp, Homo sapiens
ctcgctttgttgcccag

SEQ ID NO: 5672981 - DNA, 23 bp, Homo sapiens
ctcggaaccgctcacctagagcc

SEQ ID NO: 5672982 - DNA, 13 bp, Homo sapiens
ctcggaagagccc

SEQ ID NO: 5672983 - DNA, 19 bp, Homo sapiens
ctcggaagccgtctgactc

SEQ ID NO: 5672984 - DNA, 16 bp, Homo sapiens
ctcggaaggctggctg

SEQ ID NO: 5672985 - DNA, 14 bp, Homo sapiens
ctcggaatctattt

SEQ ID NO: 5672986 - DNA, 20 bp, Homo sapiens
ctcggaatctattttctcat

SEQ ID NO: 5672987 - DNA, 16 bp, Homo sapiens
ctcggaattcataata

SEQ ID NO: 5672988 - DNA, 22 bp, Homo sapiens
ctcggaatttctatgagacctc

SEQ ID NO: 5672989 - DNA, 12 bp, Homo sapiens
ctcggacacagt

SEQ ID NO: 5672990 - DNA, 12 bp, Homo sapiens
ctcggacagagc

SEQ ID NO: 5672991 - DNA, 14 bp, Homo sapiens
ctcggacagagccc

SEQ ID NO: 5672992 - DNA, 23 bp, Homo sapiens
ctcggacccaccaaactgcacac

SEQ ID NO: 5672993 - DNA, 20 bp, Homo sapiens
ctcggacccaccccaactct

SEQ ID NO: 5672994 - DNA, 21 bp, Homo sapiens
ctcggaccccactccggccct

SEQ ID NO: 5672995 - DNA, 15 bp, Homo sapiens
ctcggactccatggc

SEQ ID NO: 5672996 - DNA, 15 bp, Homo sapiens
ctcggacttactgcc

SEQ ID NO: 5672997 - DNA, 17 bp, Homo sapiens
ctcggacttactgcctg

SEQ ID NO: 5672998 - DNA, 18 bp, Homo sapiens
ctcggacttactgcctga

SEQ ID NO: 5672999 - DNA, 18 bp, Homo sapiens
ctcggacttagctgggag

SEQ ID NO: 5673000 - DNA, 16 bp, Homo sapiens
ctcggagagcagcagc

SEQ ID NO: 5673001 - DNA, 13 bp, Homo sapiens
ctcggagcaccct

SEQ ID NO: 5673002 - DNA, 19 bp, Homo sapiens
ctcggagcatggtgttttc

SEQ ID NO: 5673003 - DNA, 15 bp, Homo sapiens
ctcggagccctcaga

SEQ ID NO: 5673004 - DNA, 13 bp, Homo sapiens
ctcggagcctcat

SEQ ID NO: 5673005 - DNA, 22 bp, Homo sapiens
ctcggagcctcatccgaggcag

SEQ ID NO: 5673006 - DNA, 16 bp, Homo sapiens
ctcggagcctgtgtta

SEQ ID NO: 5673007 - DNA, 14 bp, Homo sapiens
ctcggagctggctg

SEQ ID NO: 5673008 - DNA, 17 bp, Homo sapiens
ctcggagctggctgtgc

SEQ ID NO: 5673009 - DNA, 18 bp, Homo sapiens
ctcggagctggctgtgcc

SEQ ID NO: 5673010 - DNA, 23 bp, Homo sapiens
ctcggagctggctgtgcctgctt

SEQ ID NO: 5673011 - DNA, 19 bp, Homo sapiens
ctcggagctggttcctctc

SEQ ID NO: 5673012 - DNA, 17 bp, Homo sapiens
ctcggaggaagccccca

SEQ ID NO: 5673013 - DNA, 17 bp, Homo sapiens
ctcggaggccaggccct

SEQ ID NO: 5673014 - DNA, 14 bp, Homo sapiens
ctcggaggctcctc

SEQ ID NO: 5673015 - DNA, 15 bp, Homo sapiens
ctcggaggctcctcc

SEQ ID NO: 5673016 - DNA, 16 bp, Homo sapiens
ctcggaggctcctccc

SEQ ID NO: 5673017 - DNA, 20 bp, Homo sapiens
ctcggaggctcctccctctg

SEQ ID NO: 5673018 - DNA, 21 bp, Homo sapiens
ctcggaggctcctccctctgc

SEQ ID NO: 5673019 - DNA, 22 bp, Homo sapiens
ctcggaggctcctccctctgcc

SEQ ID NO: 5673020 - DNA, 23 bp, Homo sapiens
ctcggaggctcctccctctgcct

SEQ ID NO: 5673021 - DNA, 17 bp, Homo sapiens
ctcggagggattcccct

SEQ ID NO: 5673022 - DNA, 16 bp, Homo sapiens
ctcggaggtccagctg

SEQ ID NO: 5673023 - DNA, 18 bp, Homo sapiens
ctcggaggtccagctggg

SEQ ID NO: 5673024 - DNA, 21 bp, Homo sapiens
ctcggaggtccagctgggcct

SEQ ID NO: 5673025 - DNA, 17 bp, Homo sapiens
ctcggagtgtggcctgg

SEQ ID NO: 5673026 - DNA, 18 bp, Homo sapiens
ctcggagtgtggcctgga

SEQ ID NO: 5673027 - DNA, 17 bp, Homo sapiens
ctcggatcatatggagc

SEQ ID NO: 5673028 - DNA, 17 bp, Homo sapiens
ctcggatgacaccctgg

SEQ ID NO: 5673029 - DNA, 20 bp, Homo sapiens
ctcggatgacaccctggcct

SEQ ID NO: 5673030 - DNA, 23 bp, Homo sapiens
ctcggatgaccaaaccagccttc

SEQ ID NO: 5673031 - DNA, 21 bp, Homo sapiens
ctcggatgaccatactcagac

SEQ ID NO: 5673032 - DNA, 21 bp, Homo sapiens
ctcggcaactaagcagtccct

SEQ ID NO: 5673033 - DNA, 14 bp, Homo sapiens
ctcggcacacactg

SEQ ID NO: 5673034 - DNA, 21 bp, Homo sapiens
ctcggcacctccccggcctct

SEQ ID NO: 5673035 - DNA, 20 bp, Homo sapiens
ctcggcagaactctctgtct

SEQ ID NO: 5673036 - DNA, 14 bp, Homo sapiens
ctcggcaggaagga

SEQ ID NO: 5673037 - DNA, 16 bp, Homo sapiens
ctcggcaggaaggagc

SEQ ID NO: 5673038 - DNA, 13 bp, Homo sapiens
ctcggcatggccg

SEQ ID NO: 5673039 - DNA, 18 bp, Homo sapiens
ctcggcattcacacacag

SEQ ID NO: 5673040 - DNA, 13 bp, Homo sapiens
ctcggccactgtg

SEQ ID NO: 5673041 - DNA, 15 bp, Homo sapiens
ctcggccactgtgtc

SEQ ID NO: 5673042 - DNA, 20 bp, Homo sapiens
ctcggccactgtgtctctgt

SEQ ID NO: 5673043 - DNA, 14 bp, Homo sapiens
ctcggccagagctc

SEQ ID NO: 5673044 - DNA, 15 bp, Homo sapiens
ctcggcccatctgtc

SEQ ID NO: 5673045 - DNA, 16 bp, Homo sapiens
ctcggcccatctgtcc

SEQ ID NO: 5673046 - DNA, 18 bp, Homo sapiens
ctcggcccatctgtccat

SEQ ID NO: 5673047 - DNA, 16 bp, Homo sapiens
ctcggccccacccacc

SEQ ID NO: 5673048 - DNA, 22 bp, Homo sapiens
ctcggccccatcgccccaccgc

SEQ ID NO: 5673049 - DNA, 13 bp, Homo sapiens
ctcggcccctctg

SEQ ID NO: 5673050 - DNA, 14 bp, Homo sapiens
ctcggcccctgtct

SEQ ID NO: 5673051 - DNA, 15 bp, Homo sapiens
ctcggcccctgtctg

SEQ ID NO: 5673052 - DNA, 22 bp, Homo sapiens
ctcggcccggagcagcaggaag

SEQ ID NO: 5673053 - DNA, 19 bp, Homo sapiens
ctcggccctcaagtgcccg

SEQ ID NO: 5673054 - DNA, 13 bp, Homo sapiens
ctcggccctccct

SEQ ID NO: 5673055 - DNA, 17 bp, Homo sapiens
ctcggccctccctgcgc

SEQ ID NO: 5673056 - DNA, 19 bp, Homo sapiens
ctcggccctccctgcgctt

SEQ ID NO: 5673057 - DNA, 16 bp, Homo sapiens
ctcggccctgaaccac

SEQ ID NO: 5673058 - DNA, 21 bp, Homo sapiens
ctcggccctgaaccacgaggc

SEQ ID NO: 5673059 - DNA, 17 bp, Homo sapiens
ctcggccctgtagccct

SEQ ID NO: 5673060 - DNA, 19 bp, Homo sapiens
ctcggccctgtagccctgg

SEQ ID NO: 5673061 - DNA, 23 bp, Homo sapiens
ctcggccctgtagccctggcccg

SEQ ID NO: 5673062 - DNA, 20 bp, Homo sapiens
ctcggccgaggcctgcgccc

SEQ ID NO: 5673063 - DNA, 20 bp, Homo sapiens
ctcggccgccgactggacgc

SEQ ID NO: 5673064 - DNA, 21 bp, Homo sapiens
ctcggccgtcttcactcgccc

SEQ ID NO: 5673065 - DNA, 13 bp, Homo sapiens
ctcggcctccaga

SEQ ID NO: 5673066 - DNA, 23 bp, Homo sapiens
ctcggcctcccaaaatgctggga

SEQ ID NO: 5673067 - DNA, 20 bp, Homo sapiens
ctcggcctcccaaagtgctg

SEQ ID NO: 5673068 - DNA, 21 bp, Homo sapiens
ctcggcctccctagtagctgg

SEQ ID NO: 5673069 - DNA, 18 bp, Homo sapiens
ctcggcctccgaggctcc

SEQ ID NO: 5673070 - DNA, 18 bp, Homo sapiens
ctcggcctcttgagagcc

SEQ ID NO: 5673071 - DNA, 11 bp, Homo sapiens
ctcggcctgcc

SEQ ID NO: 5673072 - DNA, 15 bp, Homo sapiens
ctcggcctggctcct

SEQ ID NO: 5673073 - DNA, 21 bp, Homo sapiens
ctcggcctggcttcaccgcat

SEQ ID NO: 5673074 - DNA, 22 bp, Homo sapiens
ctcggcctggtcaggccctggt

SEQ ID NO: 5673075 - DNA, 20 bp, Homo sapiens
ctcggcgcccccacccctgg

SEQ ID NO: 5673076 - DNA, 12 bp, Homo sapiens
ctcggctcactg

SEQ ID NO: 5673077 - DNA, 20 bp, Homo sapiens
ctcggctcactgcaacctct

SEQ ID NO: 5673078 - DNA, 12 bp, Homo sapiens
ctcggctcaggc

SEQ ID NO: 5673079 - DNA, 13 bp, Homo sapiens
ctcggctcaggct

SEQ ID NO: 5673080 - DNA, 18 bp, Homo sapiens
ctcggctcagtgcaacct

SEQ ID NO: 5673081 - DNA, 22 bp, Homo sapiens
ctcggctcagtgcaacctctgc

SEQ ID NO: 5673082 - DNA, 23 bp, Homo sapiens
ctcggctcagtgcaacctctgct

SEQ ID NO: 5673083 - DNA, 14 bp, Homo sapiens
ctcggctcctgctg

SEQ ID NO: 5673084 - DNA, 17 bp, Homo sapiens
ctcggctcctggactca

SEQ ID NO: 5673085 - DNA, 21 bp, Homo sapiens
ctcggctgcaattgtggacct

SEQ ID NO: 5673086 - DNA, 13 bp, Homo sapiens
ctcggctgccagg

SEQ ID NO: 5673087 - DNA, 16 bp, Homo sapiens
ctcggctgccaggggc

SEQ ID NO: 5673088 - DNA, 19 bp, Homo sapiens
ctcggctgccaggggctct

SEQ ID NO: 5673089 - DNA, 13 bp, Homo sapiens
ctcggctggaaga

SEQ ID NO: 5673090 - DNA, 13 bp, Homo sapiens
ctcggctgtctcc

SEQ ID NO: 5673091 - DNA, 17 bp, Homo sapiens
ctcggctgtctcctgtc

SEQ ID NO: 5673092 - DNA, 22 bp, Homo sapiens
ctcggctgtgtggggagggtgg

SEQ ID NO: 5673093 - DNA, 16 bp, Homo sapiens
ctcggcttcaccaggg

SEQ ID NO: 5673094 - DNA, 19 bp, Homo sapiens
ctcggcttcttggaccttg

SEQ ID NO: 5673095 - DNA, 17 bp, Homo sapiens
ctcggcttgtgggctgg

SEQ ID NO: 5673096 - DNA, 18 bp, Homo sapiens
ctcggcttttctcagctg

SEQ ID NO: 5673097 - DNA, 19 bp, Homo sapiens
ctcggcttttctcagctgg

SEQ ID NO: 5673098 - DNA, 15 bp, Homo sapiens
ctcgggaaggcctga

SEQ ID NO: 5673099 - DNA, 23 bp, Homo sapiens
ctcgggaaggcctgagggaagcc

SEQ ID NO: 5673100 - DNA, 21 bp, Homo sapiens
ctcgggacctcgtttgggagt

SEQ ID NO: 5673101 - DNA, 12 bp, Homo sapiens
ctcgggagccct

SEQ ID NO: 5673102 - DNA, 12 bp, Homo sapiens
ctcgggagctgc

SEQ ID NO: 5673103 - DNA, 21 bp, Homo sapiens
ctcgggaggctgagacaggag

SEQ ID NO: 5673104 - DNA, 20 bp, Homo sapiens
ctcgggaggctgaggcacaa

SEQ ID NO: 5673105 - DNA, 19 bp, Homo sapiens
ctcgggatcaaacctttct

SEQ ID NO: 5673106 - DNA, 20 bp, Homo sapiens
ctcgggattagtacacactt

SEQ ID NO: 5673107 - DNA, 13 bp, Homo sapiens
ctcgggcccacct

SEQ ID NO: 5673108 - DNA, 21 bp, Homo sapiens
ctcgggcccacctggccacct

SEQ ID NO: 5673109 - DNA, 12 bp, Homo sapiens
ctcgggcccagc

SEQ ID NO: 5673110 - DNA, 13 bp, Homo sapiens
ctcgggcccagcc

SEQ ID NO: 5673111 - DNA, 14 bp, Homo sapiens
ctcgggcccaggcc

SEQ ID NO: 5673112 - DNA, 16 bp, Homo sapiens
ctcgggcccaggccat

SEQ ID NO: 5673113 - DNA, 23 bp, Homo sapiens
ctcgggcccaggccatcttccag

SEQ ID NO: 5673114 - DNA, 21 bp, Homo sapiens
ctcgggccctctctccgcccc

SEQ ID NO: 5673115 - DNA, 22 bp, Homo sapiens
ctcgggccctctctccgccccg

SEQ ID NO: 5673116 - DNA, 15 bp, Homo sapiens
ctcgggccgaggccc

SEQ ID NO: 5673117 - DNA, 18 bp, Homo sapiens
ctcgggccgaggcccagc

SEQ ID NO: 5673118 - DNA, 22 bp, Homo sapiens
ctcgggccgaggcccagcgggc

SEQ ID NO: 5673119 - DNA, 20 bp, Homo sapiens
ctcgggccgcctcctccaga

SEQ ID NO: 5673120 - DNA, 22 bp, Homo sapiens
ctcgggccgcctcctccagact

SEQ ID NO: 5673121 - DNA, 14 bp, Homo sapiens
ctcgggcgcctgcg

SEQ ID NO: 5673122 - DNA, 19 bp, Homo sapiens
ctctagaacacccactggc

SEQ ID NO: 5673123 - DNA, 21 bp, Homo sapiens
ctctagaacacccactggcca

SEQ ID NO: 5673124 - DNA, 23 bp, Homo sapiens
ctctagaacatgcacatttatat

SEQ ID NO: 5673125 - DNA, 15 bp, Homo sapiens
ctctagaagccaagg

SEQ ID NO: 5673126 - DNA, 22 bp, Homo sapiens
ctctagaagccaagggaaaggg

SEQ ID NO: 5673127 - DNA, 14 bp, Homo sapiens
ctctagaagctcag

SEQ ID NO: 5673128 - DNA, 16 bp, Homo sapiens
ctctagaatccagcag

SEQ ID NO: 5673129 - DNA, 15 bp, Homo sapiens
ctctagaatcccagc

SEQ ID NO: 5673130 - DNA, 21 bp, Homo sapiens
ctctagaatcccagcagcaga

SEQ ID NO: 5673131 - DNA, 18 bp, Homo sapiens
ctctagacaaccctgcaa

SEQ ID NO: 5673132 - DNA, 21 bp, Homo sapiens
ctctagacaagatattgtaca

SEQ ID NO: 5673133 - DNA, 13 bp, Homo sapiens
ctctagagaacat

SEQ ID NO: 5673134 - DNA, 18 bp, Homo sapiens
ctctagagaagtggactg

SEQ ID NO: 5673135 - DNA, 23 bp, Homo sapiens
ctctagagaagtggactggagga

SEQ ID NO: 5673136 - DNA, 15 bp, Homo sapiens
ctctagagagcctta

SEQ ID NO: 5673137 - DNA, 19 bp, Homo sapiens
ctctagagcagactacagc

SEQ ID NO: 5673138 - DNA, 22 bp, Homo sapiens
ctctagagccttcagccttaat

SEQ ID NO: 5673139 - DNA, 16 bp, Homo sapiens
ctctagaggctggcaa

SEQ ID NO: 5673140 - DNA, 22 bp, Homo sapiens
ctctagagggttgctgcctttc

SEQ ID NO: 5673141 - DNA, 13 bp, Homo sapiens
ctctagagtccaa

SEQ ID NO: 5673142 - DNA, 16 bp, Homo sapiens
ctctagattcataaat

SEQ ID NO: 5673143 - DNA, 17 bp, Homo sapiens
ctctagattcataaata

SEQ ID NO: 5673144 - DNA, 15 bp, Homo sapiens
ctctagatttattag

SEQ ID NO: 5673145 - DNA, 20 bp, Homo sapiens
ctctagattttgttttgctt

SEQ ID NO: 5673146 - DNA, 16 bp, Homo sapiens
ctctagcagtgagtac

SEQ ID NO: 5673147 - DNA, 13 bp, Homo sapiens
ctctagccaggag

SEQ ID NO: 5673148 - DNA, 15 bp, Homo sapiens
ctctagccaggagtc

SEQ ID NO: 5673149 - DNA, 15 bp, Homo sapiens
ctctagccatccctt

SEQ ID NO: 5673150 - DNA, 18 bp, Homo sapiens
ctctagccatcccttggg

SEQ ID NO: 5673151 - DNA, 19 bp, Homo sapiens
ctctagccatcccttgggg

SEQ ID NO: 5673152 - DNA, 20 bp, Homo sapiens
ctctagcccactccctgcct

SEQ ID NO: 5673153 - DNA, 16 bp, Homo sapiens
ctctagccctgcccgg

SEQ ID NO: 5673154 - DNA, 13 bp, Homo sapiens
ctctagcctctgg

SEQ ID NO: 5673155 - DNA, 17 bp, Homo sapiens
ctctagcctctggactg

SEQ ID NO: 5673156 - DNA, 23 bp, Homo sapiens
ctctagcctggcaacagagcgag

SEQ ID NO: 5673157 - DNA, 13 bp, Homo sapiens
ctctagcctgggc

SEQ ID NO: 5673158 - DNA, 23 bp, Homo sapiens
ctctagctcagacatctactaca

SEQ ID NO: 5673159 - DNA, 11 bp, Homo sapiens
ctctagctgaa

SEQ ID NO: 5673160 - DNA, 13 bp, Homo sapiens
ctctagctgaatt

SEQ ID NO: 5673161 - DNA, 18 bp, Homo sapiens
ctctagctgttctggact

SEQ ID NO: 5673162 - DNA, 21 bp, Homo sapiens
ctctagctgttcttttttgta

SEQ ID NO: 5673163 - DNA, 23 bp, Homo sapiens
ctctagcttaagtgtaaatgaag

SEQ ID NO: 5673164 - DNA, 12 bp, Homo sapiens
ctctagcttttc

SEQ ID NO: 5673165 - DNA, 17 bp, Homo sapiens
ctctagcttttctattt

SEQ ID NO: 5673166 - DNA, 23 bp, Homo sapiens
ctctaggaaaagagaactttttt

SEQ ID NO: 5673167 - DNA, 21 bp, Homo sapiens
ctctaggaagacatttttccg

SEQ ID NO: 5673168 - DNA, 13 bp, Homo sapiens
ctctaggactggg

SEQ ID NO: 5673169 - DNA, 21 bp, Homo sapiens
ctctaggactgggcccgaggg

SEQ ID NO: 5673170 - DNA, 17 bp, Homo sapiens
ctctaggacttcaaagt

SEQ ID NO: 5673171 - DNA, 21 bp, Homo sapiens
ctctaggatggggcacggctc

SEQ ID NO: 5673172 - DNA, 20 bp, Homo sapiens
ctctaggcaagcaggacctg

SEQ ID NO: 5673173 - DNA, 13 bp, Homo sapiens
ctctaggcagaag

SEQ ID NO: 5673174 - DNA, 15 bp, Homo sapiens
ctctaggcctcagtg

SEQ ID NO: 5673175 - DNA, 20 bp, Homo sapiens
ctctaggcctcagtgtcctc

SEQ ID NO: 5673176 - DNA, 13 bp, Homo sapiens
ctctaggctgggg

SEQ ID NO: 5673177 - DNA, 14 bp, Homo sapiens
ctctaggctgggga

SEQ ID NO: 5673178 - DNA, 20 bp, Homo sapiens
ctctaggctgttctgtagct

SEQ ID NO: 5673179 - DNA, 23 bp, Homo sapiens
ctctagggaaggccacctgcagg

SEQ ID NO: 5673180 - DNA, 14 bp, Homo sapiens
ctctagggacccct

SEQ ID NO: 5673181 - DNA, 18 bp, Homo sapiens
ctctagggacccctcctc

SEQ ID NO: 5673182 - DNA, 20 bp, Homo sapiens
ctctagggacccctcctccc

SEQ ID NO: 5673183 - DNA, 22 bp, Homo sapiens
ctctagggagggacatggcccc

SEQ ID NO: 5673184 - DNA, 19 bp, Homo sapiens
ctctagggagtatgctgga

SEQ ID NO: 5673185 - DNA, 15 bp, Homo sapiens
ctctagggcagggaa

SEQ ID NO: 5673186 - DNA, 19 bp, Homo sapiens
ctctagggcctcagtctgg

SEQ ID NO: 5673187 - DNA, 20 bp, Homo sapiens
ctctagggcctcagtctgga

SEQ ID NO: 5673188 - DNA, 14 bp, Homo sapiens
ctctaggggcagcc

SEQ ID NO: 5673189 - DNA, 14 bp, Homo sapiens
ctctagggttgctg

SEQ ID NO: 5673190 - DNA, 19 bp, Homo sapiens
ctctagggttgctggagcc

SEQ ID NO: 5673191 - DNA, 21 bp, Homo sapiens
ctctagggttgctggagcctg

SEQ ID NO: 5673192 - DNA, 14 bp, Homo sapiens
ctctaggtggggcg

SEQ ID NO: 5673193 - DNA, 15 bp, Homo sapiens
ctctaggtggggcgg

SEQ ID NO: 5673194 - DNA, 14 bp, Homo sapiens
ctctaggttataca

SEQ ID NO: 5673195 - DNA, 19 bp, Homo sapiens
ctctagtaagatgcactga

SEQ ID NO: 5673196 - DNA, 14 bp, Homo sapiens
ctctagtactgtga

SEQ ID NO: 5673197 - DNA, 19 bp, Homo sapiens
ctctagtagtgtggcctgt

SEQ ID NO: 5673198 - DNA, 21 bp, Homo sapiens
ctctagtagtgtggcctgtgc

SEQ ID NO: 5673199 - DNA, 17 bp, Homo sapiens
ctctagtagttaaaaaa

SEQ ID NO: 5673200 - DNA, 15 bp, Homo sapiens
ctctagtattccaga

SEQ ID NO: 5673201 - DNA, 22 bp, Homo sapiens
ctctagtcaatgacatgaattt

SEQ ID NO: 5673202 - DNA, 20 bp, Homo sapiens
ctctagtcagagtataattt

SEQ ID NO: 5673203 - DNA, 19 bp, Homo sapiens
ctctagtccccaaggcctc

SEQ ID NO: 5673204 - DNA, 21 bp, Homo sapiens
ctctagtccccaaggcctctc

SEQ ID NO: 5673205 - DNA, 13 bp, Homo sapiens
ctctagtccctgt

SEQ ID NO: 5673206 - DNA, 20 bp, Homo sapiens
ctctagtcttgctttgctgt

SEQ ID NO: 5673207 - DNA, 14 bp, Homo sapiens
ctctagtgaatgtg

SEQ ID NO: 5673208 - DNA, 19 bp, Homo sapiens
ctctagtgacttcctggtg

SEQ ID NO: 5673209 - DNA, 22 bp, Homo sapiens
ctctagtgacttcctggtgagg

SEQ ID NO: 5673210 - DNA, 21 bp, Homo sapiens
ctctagtgccctccacagccg

SEQ ID NO: 5673211 - DNA, 18 bp, Homo sapiens
ctctagtgctgtgaaaaa

SEQ ID NO: 5673212 - DNA, 20 bp, Homo sapiens
ctctagtgctgtgaaaaaaa

SEQ ID NO: 5673213 - DNA, 20 bp, Homo sapiens
ctctagtgggacagcccaga

SEQ ID NO: 5673214 - DNA, 17 bp, Homo sapiens
ctctagttccctcagtg

SEQ ID NO: 5673215 - DNA, 13 bp, Homo sapiens
ctctagttctaga

SEQ ID NO: 5673216 - DNA, 16 bp, Homo sapiens
ctctagttctgttgtt

SEQ ID NO: 5673217 - DNA, 20 bp, Homo sapiens
ctctagttctgttgttttgt

SEQ ID NO: 5673218 - DNA, 14 bp, Homo sapiens
ctctagttgacttc

SEQ ID NO: 5673219 - DNA, 22 bp, Homo sapiens
ctctagttgacttcaaatgtgt

SEQ ID NO: 5673220 - DNA, 16 bp, Homo sapiens
ctctagttgagtttct

SEQ ID NO: 5673221 - DNA, 16 bp, Homo sapiens
ctctagtttacttgct

SEQ ID NO: 5673222 - DNA, 19 bp, Homo sapiens
ctctagtttctttctgtta

SEQ ID NO: 5673223 - DNA, 19 bp, Homo sapiens
ctctagtttgattaaattc

SEQ ID NO: 5673224 - DNA, 17 bp, Homo sapiens
ctctagtttgcagagga

SEQ ID NO: 5673225 - DNA, 20 bp, Homo sapiens
ctctagttttcagccttggg

SEQ ID NO: 5673226 - DNA, 21 bp, Homo sapiens
ctctagttttcagccttggga

SEQ ID NO: 5673227 - DNA, 23 bp, Homo sapiens
ctctataaagaaacttttgaaaa

SEQ ID NO: 5673228 - DNA, 22 bp, Homo sapiens
ctctataaagggtcaggcccgt

SEQ ID NO: 5673229 - DNA, 18 bp, Homo sapiens
ctctataagtgttcagtg

SEQ ID NO: 5673230 - DNA, 19 bp, Homo sapiens
ctctataagtgttcagtgt

SEQ ID NO: 5673231 - DNA, 20 bp, Homo sapiens
ctctataagtgttcagtgtt

SEQ ID NO: 5673232 - DNA, 21 bp, Homo sapiens
ctctataagtgttcagtgttg

SEQ ID NO: 5673233 - DNA, 23 bp, Homo sapiens
ctctataagtgttcagtgttgac

SEQ ID NO: 5673234 - DNA, 22 bp, Homo sapiens
ctctataatctgcagtgatgca

SEQ ID NO: 5673235 - DNA, 14 bp, Homo sapiens
ctctataattgttt

SEQ ID NO: 5673236 - DNA, 13 bp, Homo sapiens
ctctatacataaa

SEQ ID NO: 5673237 - DNA, 17 bp, Homo sapiens
ctctataccaataaagt

SEQ ID NO: 5673238 - DNA, 23 bp, Homo sapiens
ctctatacctttcaaagaactcc

SEQ ID NO: 5673239 - DNA, 18 bp, Homo sapiens
ctctatactgccctgagt

SEQ ID NO: 5673240 - DNA, 23 bp, Homo sapiens
ctctatactttgttctgttgtct

SEQ ID NO: 5673241 - DNA, 15 bp, Homo sapiens
ctctatagcaccagg

SEQ ID NO: 5673242 - DNA, 21 bp, Homo sapiens
ctctatataaaaaatatatgt

SEQ ID NO: 5673243 - DNA, 17 bp, Homo sapiens
ctctatataaaaacaaa

SEQ ID NO: 5673244 - DNA, 13 bp, Homo sapiens
ctctatatataca

SEQ ID NO: 5673245 - DNA, 21 bp, Homo sapiens
ctctatatatacatcatactt

SEQ ID NO: 5673246 - DNA, 17 bp, Homo sapiens
ctctatatatacatgta

SEQ ID NO: 5673247 - DNA, 21 bp, Homo sapiens
ctctatatatacatgtatagt

SEQ ID NO: 5673248 - DNA, 12 bp, Homo sapiens
ctctatattttt

SEQ ID NO: 5673249 - DNA, 14 bp, Homo sapiens
ctctatcatttaat

SEQ ID NO: 5673250 - DNA, 23 bp, Homo sapiens
ctctatccaaagaacttgatttg

SEQ ID NO: 5673251 - DNA, 16 bp, Homo sapiens
ctctatccctggcttc

SEQ ID NO: 5673252 - DNA, 18 bp, Homo sapiens
ctctatccctggcttccc

SEQ ID NO: 5673253 - DNA, 15 bp, Homo sapiens
ctctatcctctctct

SEQ ID NO: 5673254 - DNA, 15 bp, Homo sapiens
ctctatcctgggctt

SEQ ID NO: 5673255 - DNA, 18 bp, Homo sapiens
ctctatctgaaatcccaa

SEQ ID NO: 5673256 - DNA, 15 bp, Homo sapiens
ctctatctgctgggc

SEQ ID NO: 5673257 - DNA, 15 bp, Homo sapiens
ctctatctgggcctg

SEQ ID NO: 5673258 - DNA, 20 bp, Homo sapiens
ctctatctgggcctgggcta

SEQ ID NO: 5673259 - DNA, 22 bp, Homo sapiens
ctctatcttgcatctacctgct

SEQ ID NO: 5673260 - DNA, 21 bp, Homo sapiens
ctctatgacatgaaatgaaaa

SEQ ID NO: 5673261 - DNA, 20 bp, Homo sapiens
ctctatgatgattgcttcca

SEQ ID NO: 5673262 - DNA, 13 bp, Homo sapiens
ctctatgccaggc

SEQ ID NO: 5673263 - DNA, 20 bp, Homo sapiens
ctctatgccaggctgtgcta

SEQ ID NO: 5673264 - DNA, 12 bp, Homo sapiens
ctctatgccctg

SEQ ID NO: 5673265 - DNA, 15 bp, Homo sapiens
ctctatgccctgcag

SEQ ID NO: 5673266 - DNA, 17 bp, Homo sapiens
ctctatgccctgcagag

SEQ ID NO: 5673267 - DNA, 19 bp, Homo sapiens
ctctatgccctgcagagca

SEQ ID NO: 5673268 - DNA, 20 bp, Homo sapiens
ctctatgccctgcagagcaa

SEQ ID NO: 5673269 - DNA, 14 bp, Homo sapiens
ctctatgcctgcac

SEQ ID NO: 5673270 - DNA, 19 bp, Homo sapiens
ctctatgcctgcactggga

SEQ ID NO: 5673271 - DNA, 12 bp, Homo sapiens
ctctatgctctg

SEQ ID NO: 5673272 - DNA, 14 bp, Homo sapiens
ctctatgctttcca

SEQ ID NO: 5673273 - DNA, 20 bp, Homo sapiens
ctctatggtaaagatattat

SEQ ID NO: 5673274 - DNA, 17 bp, Homo sapiens
ctctatgtatattctat

SEQ ID NO: 5673275 - DNA, 19 bp, Homo sapiens
ctctatgttagtataagct

SEQ ID NO: 5673276 - DNA, 21 bp, Homo sapiens
ctctatgttagtataagcttt

SEQ ID NO: 5673277 - DNA, 15 bp, Homo sapiens
ctctatgtttattct

SEQ ID NO: 5673278 - DNA, 22 bp, Homo sapiens
ctctattaatgaggtctttaaa

SEQ ID NO: 5673279 - DNA, 23 bp, Homo sapiens
ctctattaccactgaagatagaa

SEQ ID NO: 5673280 - DNA, 16 bp, Homo sapiens
ctctattagtttcaat

SEQ ID NO: 5673281 - DNA, 17 bp, Homo sapiens
ctctattatattcggtt

SEQ ID NO: 5673282 - DNA, 23 bp, Homo sapiens
ctctattcgccacacagtatttt

SEQ ID NO: 5673283 - DNA, 21 bp, Homo sapiens
ctctattctcaaagtttccta

SEQ ID NO: 5673284 - DNA, 12 bp, Homo sapiens
ctctattctgta

SEQ ID NO: 5673285 - DNA, 19 bp, Homo sapiens
ctctattcttgggaaacac

SEQ ID NO: 5673286 - DNA, 18 bp, Homo sapiens
ctctattggatttgtcca

SEQ ID NO: 5673287 - DNA, 13 bp, Homo sapiens
ctctattgtaatt

SEQ ID NO: 5673288 - DNA, 21 bp, Homo sapiens
ctctattgtaattttgttcct

SEQ ID NO: 5673289 - DNA, 15 bp, Homo sapiens
ctctatttaaattct

SEQ ID NO: 5673290 - DNA, 21 bp, Homo sapiens
ctctatttaagatatatacat

SEQ ID NO: 5673291 - DNA, 12 bp, Homo sapiens
ctctatttaata

SEQ ID NO: 5673292 - DNA, 16 bp, Homo sapiens
ctctatttaatattta

SEQ ID NO: 5673293 - DNA, 14 bp, Homo sapiens
ctctatttagcatg

SEQ ID NO: 5673294 - DNA, 15 bp, Homo sapiens
ctctatttattgggg

SEQ ID NO: 5673295 - DNA, 14 bp, Homo sapiens
ctctatttcacaat

SEQ ID NO: 5673296 - DNA, 20 bp, Homo sapiens
ctctatttgagaagttctca

SEQ ID NO: 5673297 - DNA, 14 bp, Homo sapiens
ctctatttgagaat

SEQ ID NO: 5673298 - DNA, 12 bp, Homo sapiens
gatcctaagaat

SEQ ID NO: 5673299 - DNA, 22 bp, Homo sapiens
gatcctaagaatttttcattct

SEQ ID NO: 5673300 - DNA, 16 bp, Homo sapiens
gatcctaagcatctaa

SEQ ID NO: 5673301 - DNA, 22 bp, Homo sapiens
gatcctaatcccttcctctccc

SEQ ID NO: 5673302 - DNA, 22 bp, Homo sapiens
gatcctacagccagtaagtgat

SEQ ID NO: 5673303 - DNA, 23 bp, Homo sapiens
gatcctagccttatcctctgatc

SEQ ID NO: 5673304 - DNA, 19 bp, Homo sapiens
gatcctagggcacttctag

SEQ ID NO: 5673305 - DNA, 22 bp, Homo sapiens
gatcctagggcacttctagttt

SEQ ID NO: 5673306 - DNA, 16 bp, Homo sapiens
gatcctaggtgctgga

SEQ ID NO: 5673307 - DNA, 18 bp, Homo sapiens
gatcctatcctcctacct

SEQ ID NO: 5673308 - DNA, 20 bp, Homo sapiens
gatcctattctcaccaggaa

SEQ ID NO: 5673309 - DNA, 18 bp, Homo sapiens
gatcctcacactacagat

SEQ ID NO: 5673310 - DNA, 21 bp, Homo sapiens
gatcctcacactacagatcag

SEQ ID NO: 5673311 - DNA, 15 bp, Homo sapiens
gatcctcacaggagc

SEQ ID NO: 5673312 - DNA, 18 bp, Homo sapiens
gatcctcagcccctccag

SEQ ID NO: 5673313 - DNA, 12 bp, Homo sapiens
gatcctcagtgc

SEQ ID NO: 5673314 - DNA, 21 bp, Homo sapiens
gatcctccaatgtctaatttt

SEQ ID NO: 5673315 - DNA, 14 bp, Homo sapiens
gatcctccacagag

SEQ ID NO: 5673316 - DNA, 11 bp, Homo sapiens
gatcctccagg

SEQ ID NO: 5673317 - DNA, 14 bp, Homo sapiens
gatcctccaggtgc

SEQ ID NO: 5673318 - DNA, 22 bp, Homo sapiens
gatcctcccacctcagcctcct

SEQ ID NO: 5673319 - DNA, 17 bp, Homo sapiens
gatcctcccctggactc

SEQ ID NO: 5673320 - DNA, 19 bp, Homo sapiens
gatcctcctatgtgtgcct

SEQ ID NO: 5673321 - DNA, 11 bp, Homo sapiens
gatcctcctgg

SEQ ID NO: 5673322 - DNA, 18 bp, Homo sapiens
gatcctccttccaggccc

SEQ ID NO: 5673323 - DNA, 19 bp, Homo sapiens
gatcctccttccaggcccc

SEQ ID NO: 5673324 - DNA, 13 bp, Homo sapiens
gatcctctactgt

SEQ ID NO: 5673325 - DNA, 22 bp, Homo sapiens
gatcctctatttcctgaacctg

SEQ ID NO: 5673326 - DNA, 20 bp, Homo sapiens
gatcctctattttgtgatga

SEQ ID NO: 5673327 - DNA, 18 bp, Homo sapiens
gatcctctccaccctcct

SEQ ID NO: 5673328 - DNA, 19 bp, Homo sapiens
gatcctctccaccctcctc

SEQ ID NO: 5673329 - DNA, 12 bp, Homo sapiens
gatcctctctgg

SEQ ID NO: 5673330 - DNA, 21 bp, Homo sapiens
gatcctctcttcttttcccat

SEQ ID NO: 5673331 - DNA, 21 bp, Homo sapiens
gatcctctttccccactgaag

SEQ ID NO: 5673332 - DNA, 12 bp, Homo sapiens
gatcctgaagca

SEQ ID NO: 5673333 - DNA, 12 bp, Homo sapiens
gatcctgagcca

SEQ ID NO: 5673334 - DNA, 13 bp, Homo sapiens
gatcctgagccag

SEQ ID NO: 5673335 - DNA, 18 bp, Homo sapiens
gatcctgagtccagaatg

SEQ ID NO: 5673336 - DNA, 18 bp, Homo sapiens
gatcctgcactgactctg

SEQ ID NO: 5673337 - DNA, 16 bp, Homo sapiens
gatcctgccaccctgt

SEQ ID NO: 5673338 - DNA, 18 bp, Homo sapiens
gatcctgccaccctgtag

SEQ ID NO: 5673339 - DNA, 16 bp, Homo sapiens
gatcctgcccccaagt

SEQ ID NO: 5673340 - DNA, 15 bp, Homo sapiens
gatcctgctccagca

SEQ ID NO: 5673341 - DNA, 16 bp, Homo sapiens
gatcctgctccagcag

SEQ ID NO: 5673342 - DNA, 18 bp, Homo sapiens
gatcctgctccagcagca

SEQ ID NO: 5673343 - DNA, 12 bp, Homo sapiens
gatcctgctgcc

SEQ ID NO: 5673344 - DNA, 12 bp, Homo sapiens
gatcctgctggg

SEQ ID NO: 5673345 - DNA, 20 bp, Homo sapiens
gatcctgctgtggcctcact

SEQ ID NO: 5673346 - DNA, 14 bp, Homo sapiens
gatcctggaaatca

SEQ ID NO: 5673347 - DNA, 18 bp, Homo sapiens
gatcctggaaccactgat

SEQ ID NO: 5673348 - DNA, 15 bp, Homo sapiens
gatcctggagcccct

SEQ ID NO: 5673349 - DNA, 19 bp, Homo sapiens
gatcctggagcccctgtgt

SEQ ID NO: 5673350 - DNA, 16 bp, Homo sapiens
gatcctggaggcccag

SEQ ID NO: 5673351 - DNA, 17 bp, Homo sapiens
gatcctggaggctgcct

SEQ ID NO: 5673352 - DNA, 17 bp, Homo sapiens
gatcctggattcactca

SEQ ID NO: 5673353 - DNA, 16 bp, Homo sapiens
gatcctggcctgagaa

SEQ ID NO: 5673354 - DNA, 16 bp, Homo sapiens
gatcctgggcatgatg

SEQ ID NO: 5673355 - DNA, 17 bp, Homo sapiens
gatcctggggccctcag

SEQ ID NO: 5673356 - DNA, 18 bp, Homo sapiens
gatcctggggccctcagc

SEQ ID NO: 5673357 - DNA, 22 bp, Homo sapiens
gatcctggggccctcagctcct

SEQ ID NO: 5673358 - DNA, 19 bp, Homo sapiens
gatcctgggggcctgggtt

SEQ ID NO: 5673359 - DNA, 18 bp, Homo sapiens
gatcctgtaatcacaact

SEQ ID NO: 5673360 - DNA, 22 bp, Homo sapiens
gatcctgtgaggagccccatct

SEQ ID NO: 5673361 - DNA, 23 bp, Homo sapiens
gatcctgtgaggagccccatctg

SEQ ID NO: 5673362 - DNA, 15 bp, Homo sapiens
gatcctgttctgcgc

SEQ ID NO: 5673363 - DNA, 21 bp, Homo sapiens
gatccttcaaagtctcaatga

SEQ ID NO: 5673364 - DNA, 13 bp, Homo sapiens
gatccttcatttt

SEQ ID NO: 5673365 - DNA, 13 bp, Homo sapiens
gatccttccatct

SEQ ID NO: 5673366 - DNA, 17 bp, Homo sapiens
gatccttcccaaggtac

SEQ ID NO: 5673367 - DNA, 12 bp, Homo sapiens
gatccttcctcc

SEQ ID NO: 5673368 - DNA, 21 bp, Homo sapiens
gatccttctgagctccacctc

SEQ ID NO: 5673369 - DNA, 19 bp, Homo sapiens
gatccttggtgctgtgtgc

SEQ ID NO: 5673370 - DNA, 20 bp, Homo sapiens
gatcctttttccatcatttt

SEQ ID NO: 5673371 - DNA, 17 bp, Homo sapiens
gatccttttttgtcatt

SEQ ID NO: 5673372 - DNA, 21 bp, Homo sapiens
gatccttttttgtcattttat

SEQ ID NO: 5673373 - DNA, 16 bp, Homo sapiens
gatcgagaccatcctg

SEQ ID NO: 5673374 - DNA, 19 bp, Homo sapiens
gatcgagaccatcctggct

SEQ ID NO: 5673375 - DNA, 19 bp, Homo sapiens
gatcgagaccgccctggct

SEQ ID NO: 5673376 - DNA, 18 bp, Homo sapiens
gatcgagtgtagctgtga

SEQ ID NO: 5673377 - DNA, 20 bp, Homo sapiens
gatcgagtgtagctgtgaaa

SEQ ID NO: 5673378 - DNA, 22 bp, Homo sapiens
gatcgagtgtagctgtgaaatc

SEQ ID NO: 5673379 - DNA, 14 bp, Homo sapiens
gatcgcacaaggac

SEQ ID NO: 5673380 - DNA, 13 bp, Homo sapiens
gatcgcagtttgc

SEQ ID NO: 5673381 - DNA, 23 bp, Homo sapiens
gatcgcatcattgcactctagcc

SEQ ID NO: 5673382 - DNA, 14 bp, Homo sapiens
gatcgcatttccta

SEQ ID NO: 5673383 - DNA, 12 bp, Homo sapiens
gatcgccttccc

SEQ ID NO: 5673384 - DNA, 13 bp, Homo sapiens
gatcgccttcccc

SEQ ID NO: 5673385 - DNA, 17 bp, Homo sapiens
gatcgccttccccaccc

SEQ ID NO: 5673386 - DNA, 20 bp, Homo sapiens
gatcgctgcacatggcctga

SEQ ID NO: 5673387 - DNA, 23 bp, Homo sapiens
gatcgctgcacatggcctgagca

SEQ ID NO: 5673388 - DNA, 14 bp, Homo sapiens
gatcgctggcagag

SEQ ID NO: 5673389 - DNA, 20 bp, Homo sapiens
gatcgcttgagcccaggagt

SEQ ID NO: 5673390 - DNA, 14 bp, Homo sapiens
gatcggaacagctc

SEQ ID NO: 5673391 - DNA, 17 bp, Homo sapiens
gatcggactctgcccct

SEQ ID NO: 5673392 - DNA, 17 bp, Homo sapiens
gatcggagcctcctctc

SEQ ID NO: 5673393 - DNA, 22 bp, Homo sapiens
gatcggccatcaagggaagaac

SEQ ID NO: 5673394 - DNA, 13 bp, Homo sapiens
gatcgggaagcag

SEQ ID NO: 5673395 - DNA, 16 bp, Homo sapiens
gatcggttaacaaata

SEQ ID NO: 5673396 - DNA, 16 bp, Homo sapiens
gatcgtagaaaatttg

SEQ ID NO: 5673397 - DNA, 23 bp, Homo sapiens
gatcgtgcatttgaggggccagg

SEQ ID NO: 5673398 - DNA, 22 bp, Homo sapiens
gatcgtgctactgcactccagc

SEQ ID NO: 5673399 - DNA, 18 bp, Homo sapiens
gatcgtggccaacgtgga

SEQ ID NO: 5673400 - DNA, 16 bp, Homo sapiens
gatcgttatctactga

SEQ ID NO: 5673401 - DNA, 23 bp, Homo sapiens
gatcgttctgccacttgcactgt

SEQ ID NO: 5673402 - DNA, 18 bp, Homo sapiens
gatctaaaaaaatgtttt

SEQ ID NO: 5673403 - DNA, 18 bp, Homo sapiens
gatctaaaaggaggacag

SEQ ID NO: 5673404 - DNA, 19 bp, Homo sapiens
gatctaaaaggaggacagg

SEQ ID NO: 5673405 - DNA, 13 bp, Homo sapiens
gatctaaacagtt

SEQ ID NO: 5673406 - DNA, 18 bp, Homo sapiens
gatctaaacagttatttc

SEQ ID NO: 5673407 - DNA, 14 bp, Homo sapiens
gatctaaataaaat

SEQ ID NO: 5673408 - DNA, 16 bp, Homo sapiens
gatctaaataaaatgc

SEQ ID NO: 5673409 - DNA, 19 bp, Homo sapiens
gatctaaatagcccttgga

SEQ ID NO: 5673410 - DNA, 12 bp, Homo sapiens
gatctaacaaaa

SEQ ID NO: 5673411 - DNA, 15 bp, Homo sapiens
gatctaacaaaataa

SEQ ID NO: 5673412 - DNA, 18 bp, Homo sapiens
gatctaacaaaataaggt

SEQ ID NO: 5673413 - DNA, 14 bp, Homo sapiens
gatctaataaactt

SEQ ID NO: 5673414 - DNA, 13 bp, Homo sapiens
gatctaatgtgaa

SEQ ID NO: 5673415 - DNA, 16 bp, Homo sapiens
gatctaatgtgaaaat

SEQ ID NO: 5673416 - DNA, 19 bp, Homo sapiens
gatctaattaaactaaaga

SEQ ID NO: 5673417 - DNA, 21 bp, Homo sapiens
gatctacatgaatgcaaaaca

SEQ ID NO: 5673418 - DNA, 15 bp, Homo sapiens
gatctacctggaggg

SEQ ID NO: 5673419 - DNA, 17 bp, Homo sapiens
gatctacctggagggaa

SEQ ID NO: 5673420 - DNA, 17 bp, Homo sapiens
gatctacttcatagctc

SEQ ID NO: 5673421 - DNA, 20 bp, Homo sapiens
gatctactttccctctggga

SEQ ID NO: 5673422 - DNA, 13 bp, Homo sapiens
gatctagaaggga

SEQ ID NO: 5673423 - DNA, 16 bp, Homo sapiens
gatctagaatgtgttt

SEQ ID NO: 5673424 - DNA, 21 bp, Homo sapiens
gatctagaatgtgttttctga

SEQ ID NO: 5673425 - DNA, 22 bp, Homo sapiens
gatctagcactcctcaagactt

SEQ ID NO: 5673426 - DNA, 13 bp, Homo sapiens
gatctagccaggc

SEQ ID NO: 5673427 - DNA, 14 bp, Homo sapiens
gatctagccaggcc

SEQ ID NO: 5673428 - DNA, 13 bp, Homo sapiens
gatctagcttcat

SEQ ID NO: 5673429 - DNA, 19 bp, Homo sapiens
gatctagcttcatgcctca

SEQ ID NO: 5673430 - DNA, 20 bp, Homo sapiens
gatctaggtttaactcagat

SEQ ID NO: 5673431 - DNA, 21 bp, Homo sapiens
gatctaggtttaactcagatc

SEQ ID NO: 5673432 - DNA, 16 bp, Homo sapiens
gatctagtccttgtct

SEQ ID NO: 5673433 - DNA, 18 bp, Homo sapiens
gatctagttcagaaggaa

SEQ ID NO: 5673434 - DNA, 19 bp, Homo sapiens
gatctagttctcttctcct

SEQ ID NO: 5673435 - DNA, 21 bp, Homo sapiens
gatctagttctcttctcctgt

SEQ ID NO: 5673436 - DNA, 23 bp, Homo sapiens
gatctagttctcttctcctgtgt

SEQ ID NO: 5673437 - DNA, 23 bp, Homo sapiens
gatctatacttgctttgtgttct

SEQ ID NO: 5673438 - DNA, 15 bp, Homo sapiens
gatctatagatgacc

SEQ ID NO: 5673439 - DNA, 16 bp, Homo sapiens
gatctataggcagctt

SEQ ID NO: 5673440 - DNA, 17 bp, Homo sapiens
gatctataggcagcttc

SEQ ID NO: 5673441 - DNA, 14 bp, Homo sapiens
gatctatcacctgt

SEQ ID NO: 5673442 - DNA, 16 bp, Homo sapiens
gatctatcacctgtca

SEQ ID NO: 5673443 - DNA, 18 bp, Homo sapiens
gatctatcacctgtcatc

SEQ ID NO: 5673444 - DNA, 15 bp, Homo sapiens
gatctatctacaaag

SEQ ID NO: 5673445 - DNA, 12 bp, Homo sapiens
gatctatgcaat

SEQ ID NO: 5673446 - DNA, 16 bp, Homo sapiens
gatctatgcaattttt

SEQ ID NO: 5673447 - DNA, 22 bp, Homo sapiens
gatctatgcaatttttaaacta

SEQ ID NO: 5673448 - DNA, 14 bp, Homo sapiens
gatctatgggaaga

SEQ ID NO: 5673449 - DNA, 15 bp, Homo sapiens
gatctatgttgtttg

SEQ ID NO: 5673450 - DNA, 21 bp, Homo sapiens
gatctatgtttgtgtgatttc

SEQ ID NO: 5673451 - DNA, 17 bp, Homo sapiens
gatctattactctgaca

SEQ ID NO: 5673452 - DNA, 18 bp, Homo sapiens
gatctattactctgacat

SEQ ID NO: 5673453 - DNA, 21 bp, Homo sapiens
gatctattactctgacataaa

SEQ ID NO: 5673454 - DNA, 21 bp, Homo sapiens
gatctattgtttgttgcacta

SEQ ID NO: 5673455 - DNA, 14 bp, Homo sapiens
gatctatttattag

SEQ ID NO: 5673456 - DNA, 14 bp, Homo sapiens
gatctatttattat

SEQ ID NO: 5673457 - DNA, 14 bp, Homo sapiens
gatctatttcatgt

SEQ ID NO: 5673458 - DNA, 18 bp, Homo sapiens
gatctcaaatccactgac

SEQ ID NO: 5673459 - DNA, 14 bp, Homo sapiens
gatctcaagccagc

SEQ ID NO: 5673460 - DNA, 16 bp, Homo sapiens
gatctcaagccagccc

SEQ ID NO: 5673461 - DNA, 22 bp, Homo sapiens
gatctcaagccagccccctcca

SEQ ID NO: 5673462 - DNA, 19 bp, Homo sapiens
gatctcaagtatatgtcat

SEQ ID NO: 5673463 - DNA, 20 bp, Homo sapiens
gatctcaagtatatgtcatt

SEQ ID NO: 5673464 - DNA, 19 bp, Homo sapiens
gatctcagaggctcagaga

SEQ ID NO: 5673465 - DNA, 19 bp, Homo sapiens
gatctcagcatcctggaaa

SEQ ID NO: 5673466 - DNA, 19 bp, Homo sapiens
gatctcagctcactgcaag

SEQ ID NO: 5673467 - DNA, 16 bp, Homo sapiens
gatctcagctttgaga

SEQ ID NO: 5673468 - DNA, 21 bp, Homo sapiens
gatctcagctttgagaagcct

SEQ ID NO: 5673469 - DNA, 12 bp, Homo sapiens
gatctcaggagc

SEQ ID NO: 5673470 - DNA, 22 bp, Homo sapiens
gatctcaggagcttgcaagaag

SEQ ID NO: 5673471 - DNA, 14 bp, Homo sapiens
gatctcagggaagc

SEQ ID NO: 5673472 - DNA, 18 bp, Homo sapiens
gatctcagggaagcccag

SEQ ID NO: 5673473 - DNA, 20 bp, Homo sapiens
gatctcagggaagcccagct

SEQ ID NO: 5673474 - DNA, 14 bp, Homo sapiens
gatctcagggcaga

SEQ ID NO: 5673475 - DNA, 19 bp, Homo sapiens
gatctcagggcagacagcc

SEQ ID NO: 5673476 - DNA, 16 bp, Homo sapiens
gatgcatgcagggccc

SEQ ID NO: 5673477 - DNA, 20 bp, Homo sapiens
gatgcatggcctctaagagt

SEQ ID NO: 5673478 - DNA, 22 bp, Homo sapiens
gatgcatgtggtttggttcctc

SEQ ID NO: 5673479 - DNA, 21 bp, Homo sapiens
gatgcatgttttccagctcct

SEQ ID NO: 5673480 - DNA, 15 bp, Homo sapiens
gatgcattaaaagaa

SEQ ID NO: 5673481 - DNA, 16 bp, Homo sapiens
gatgcattaaaagaaa

SEQ ID NO: 5673482 - DNA, 18 bp, Homo sapiens
gatgcattaaaagaaaat

SEQ ID NO: 5673483 - DNA, 19 bp, Homo sapiens
gatgcattctgataggagg

SEQ ID NO: 5673484 - DNA, 20 bp, Homo sapiens
gatgcattgtagtttaacca

SEQ ID NO: 5673485 - DNA, 16 bp, Homo sapiens
gatgcatttaataaag

SEQ ID NO: 5673486 - DNA, 17 bp, Homo sapiens
gatgcatttaataaaga

SEQ ID NO: 5673487 - DNA, 18 bp, Homo sapiens
gatgcatttaataaagat

SEQ ID NO: 5673488 - DNA, 13 bp, Homo sapiens
gatgcatttcaaa

SEQ ID NO: 5673489 - DNA, 14 bp, Homo sapiens
gatgcatttcaaat

SEQ ID NO: 5673490 - DNA, 18 bp, Homo sapiens
gatgcatttcaaatgtta

SEQ ID NO: 5673491 - DNA, 18 bp, Homo sapiens
gatgcatttccacactgt

SEQ ID NO: 5673492 - DNA, 18 bp, Homo sapiens
gatgcatttgggtccagg

SEQ ID NO: 5673493 - DNA, 19 bp, Homo sapiens
gatgcatttgggtccagga

SEQ ID NO: 5673494 - DNA, 18 bp, Homo sapiens
gatgcattttaaatgtct

SEQ ID NO: 5673495 - DNA, 20 bp, Homo sapiens
gatgcattttatagaatgtg

SEQ ID NO: 5673496 - DNA, 18 bp, Homo sapiens
gatgcattttgagtgttt

SEQ ID NO: 5673497 - DNA, 22 bp, Homo sapiens
gatgccaaagatgtttgaaaat

SEQ ID NO: 5673498 - DNA, 14 bp, Homo sapiens
gatgccaaagcaga

SEQ ID NO: 5673499 - DNA, 15 bp, Homo sapiens
gatgccaaagcagac

SEQ ID NO: 5673500 - DNA, 12 bp, Homo sapiens
gatgccaaagct

SEQ ID NO: 5673501 - DNA, 20 bp, Homo sapiens
gatgccaacagacactacat

SEQ ID NO: 5673502 - DNA, 22 bp, Homo sapiens
gatgccaacttcccacacggca

SEQ ID NO: 5673503 - DNA, 24 bp, Homo sapiens
gatgccaacttcccacacggcagc

SEQ ID NO: 5673504 - DNA, 17 bp, Homo sapiens
gatgccaaggagcccct

SEQ ID NO: 5673505 - DNA, 20 bp, Homo sapiens
gatgccaagttgtttgagaa

SEQ ID NO: 5673506 - DNA, 13 bp, Homo sapiens
gatgccaatgaca

SEQ ID NO: 5673507 - DNA, 23 bp, Homo sapiens
gatgccaatttcctctccactgc

SEQ ID NO: 5673508 - DNA, 16 bp, Homo sapiens
gatgccacagccccac

SEQ ID NO: 5673509 - DNA, 18 bp, Homo sapiens
gatgccacagccccacag

SEQ ID NO: 5673510 - DNA, 13 bp, Homo sapiens
gatgccaccggcc

SEQ ID NO: 5673511 - DNA, 15 bp, Homo sapiens
gatgccaccggcctg

SEQ ID NO: 5673512 - DNA, 22 bp, Homo sapiens
gatgccacgctttgctgctacc

SEQ ID NO: 5673513 - DNA, 22 bp, Homo sapiens
gatgccactaccccttgatttt

SEQ ID NO: 5673514 - DNA, 15 bp, Homo sapiens
gatgccactcctccc

SEQ ID NO: 5673515 - DNA, 17 bp, Homo sapiens
gatgccactcctccctc

SEQ ID NO: 5673516 - DNA, 23 bp, Homo sapiens
gatgccacttctaagaaaagcct

SEQ ID NO: 5673517 - DNA, 15 bp, Homo sapiens
gatgccagagggcca

SEQ ID NO: 5673518 - DNA, 16 bp, Homo sapiens
gatgccagagggccag

SEQ ID NO: 5673519 - DNA, 19 bp, Homo sapiens
gatgccagagggccagcag

SEQ ID NO: 5673520 - DNA, 20 bp, Homo sapiens
gatgccagagggccagcagg

SEQ ID NO: 5673521 - DNA, 21 bp, Homo sapiens
gatgccagagggccagcaggc

SEQ ID NO: 5673522 - DNA, 14 bp, Homo sapiens
gatgccagccccgt

SEQ ID NO: 5673523 - DNA, 15 bp, Homo sapiens
gatgccagcccctgc

SEQ ID NO: 5673524 - DNA, 17 bp, Homo sapiens
gatgccagcccctgcct

SEQ ID NO: 5673525 - DNA, 21 bp, Homo sapiens
gatgccagcccctgcctgggt

SEQ ID NO: 5673526 - DNA, 12 bp, Homo sapiens
gatgccagcctt

SEQ ID NO: 5673527 - DNA, 15 bp, Homo sapiens
gatgccagctgtgtc

SEQ ID NO: 5673528 - DNA, 12 bp, Homo sapiens
gatgccagcttc

SEQ ID NO: 5673529 - DNA, 20 bp, Homo sapiens
gatgccagcttctctctcca

SEQ ID NO: 5673530 - DNA, 23 bp, Homo sapiens
gatgccagcttctctctccaggg

SEQ ID NO: 5673531 - DNA, 11 bp, Homo sapiens
gatgccaggac

SEQ ID NO: 5673532 - DNA, 17 bp, Homo sapiens
gatgccagggccgacca

SEQ ID NO: 5673533 - DNA, 22 bp, Homo sapiens
gatgccaggttctatttggaat

SEQ ID NO: 5673534 - DNA, 21 bp, Homo sapiens
gatgccagtaggctcaactag

SEQ ID NO: 5673535 - DNA, 13 bp, Homo sapiens
gatgccagtggaa

SEQ ID NO: 5673536 - DNA, 18 bp, Homo sapiens
gatgccagttacttgctt

SEQ ID NO: 5673537 - DNA, 20 bp, Homo sapiens
gatgccataatcagaacaca

SEQ ID NO: 5673538 - DNA, 21 bp, Homo sapiens
gatgccattacagaaccaaat

SEQ ID NO: 5673539 - DNA, 15 bp, Homo sapiens
gatgccattacattt

SEQ ID NO: 5673540 - DNA, 20 bp, Homo sapiens
gatgcccaaagatgcagccg

SEQ ID NO: 5673541 - DNA, 17 bp, Homo sapiens
gatgcccaaatccttag

SEQ ID NO: 5673542 - DNA, 23 bp, Homo sapiens
gatgcccaccgaggagccccagc

SEQ ID NO: 5673543 - DNA, 18 bp, Homo sapiens
gatgcccattcctgcctg

SEQ ID NO: 5673544 - DNA, 16 bp, Homo sapiens
gatgccccagagctgt

SEQ ID NO: 5673545 - DNA, 16 bp, Homo sapiens
gatgccccagggatgg

SEQ ID NO: 5673546 - DNA, 15 bp, Homo sapiens
gatgcccccaggcag

SEQ ID NO: 5673547 - DNA, 17 bp, Homo sapiens
gatgcccccaggcagcc

SEQ ID NO: 5673548 - DNA, 23 bp, Homo sapiens
gatgccccctaatccccttctcc

SEQ ID NO: 5673549 - DNA, 16 bp, Homo sapiens
gatgccccctccagga

SEQ ID NO: 5673550 - DNA, 20 bp, Homo sapiens
gatgccccctccaggagaga

SEQ ID NO: 5673551 - DNA, 23 bp, Homo sapiens
gatgccccctccaggagagagcc

SEQ ID NO: 5673552 - DNA, 17 bp, Homo sapiens
gatgccccgagcccagg

SEQ ID NO: 5673553 - DNA, 22 bp, Homo sapiens
gatgcccctgcagtttggccct

SEQ ID NO: 5673554 - DNA, 18 bp, Homo sapiens
gatgcccctgctccctct

SEQ ID NO: 5673555 - DNA, 21 bp, Homo sapiens
gatgcccctgctccctctggg

SEQ ID NO: 5673556 - DNA, 15 bp, Homo sapiens
gatgcccctggccct

SEQ ID NO: 5673557 - DNA, 22 bp, Homo sapiens
gatgccccttctccccttcctg

SEQ ID NO: 5673558 - DNA, 23 bp, Homo sapiens
gatgccctataacccctgcctgg

SEQ ID NO: 5673559 - DNA, 15 bp, Homo sapiens
gatgccctcccctca

SEQ ID NO: 5673560 - DNA, 22 bp, Homo sapiens
gatgccctcccctcagcgcagg

SEQ ID NO: 5673561 - DNA, 12 bp, Homo sapiens
gatgccctggag

SEQ ID NO: 5673562 - DNA, 19 bp, Homo sapiens
gatgccctggaggtggctg

SEQ ID NO: 5673563 - DNA, 14 bp, Homo sapiens
gatgcccttccccc

SEQ ID NO: 5673564 - DNA, 22 bp, Homo sapiens
gatgcccttgctgggcctgggg

SEQ ID NO: 5673565 - DNA, 19 bp, Homo sapiens
gatgccgaacattaggaat

SEQ ID NO: 5673566 - DNA, 22 bp, Homo sapiens
gatgccgagacctcaagccctg

SEQ ID NO: 5673567 - DNA, 18 bp, Homo sapiens
gatgccgaggtaaaagtt

SEQ ID NO: 5673568 - DNA, 17 bp, Homo sapiens
gatgccgctcttctgtc

SEQ ID NO: 5673569 - DNA, 23 bp, Homo sapiens
gatgcctaaaaattcccttcctg

SEQ ID NO: 5673570 - DNA, 21 bp, Homo sapiens
gatgcctacaaccatccctgc

SEQ ID NO: 5673571 - DNA, 13 bp, Homo sapiens
gatgcctccaccg

SEQ ID NO: 5673572 - DNA, 12 bp, Homo sapiens
gatgcctcccca

SEQ ID NO: 5673573 - DNA, 18 bp, Homo sapiens
gatgcctccccaagactg

SEQ ID NO: 5673574 - DNA, 20 bp, Homo sapiens
gatgcctcccggctttgcag

SEQ ID NO: 5673575 - DNA, 19 bp, Homo sapiens
gatgcctccctgaccctgc

SEQ ID NO: 5673576 - DNA, 22 bp, Homo sapiens
gatgcctccctgaccctgcaga

SEQ ID NO: 5673577 - DNA, 15 bp, Homo sapiens
gatgcctccttcctc

SEQ ID NO: 5673578 - DNA, 12 bp, Homo sapiens
gatgcctccttg

SEQ ID NO: 5673579 - DNA, 15 bp, Homo sapiens
gatgcctccttggcc

SEQ ID NO: 5673580 - DNA, 22 bp, Homo sapiens
gatgcctgattgccaagctcag

SEQ ID NO: 5673581 - DNA, 16 bp, Homo sapiens
gatgcctgcatgctga

SEQ ID NO: 5673582 - DNA, 16 bp, Homo sapiens
gatgcctgggcctgat

SEQ ID NO: 5673583 - DNA, 20 bp, Homo sapiens
gatgcctggtggcagctgcg

SEQ ID NO: 5673584 - DNA, 14 bp, Homo sapiens
gatgcctgttaatt

SEQ ID NO: 5673585 - DNA, 14 bp, Homo sapiens
gatgccttcatctg

SEQ ID NO: 5673586 - DNA, 12 bp, Homo sapiens
gatgccttcatg

SEQ ID NO: 5673587 - DNA, 14 bp, Homo sapiens
gatgccttgaattg

SEQ ID NO: 5673588 - DNA, 13 bp, Homo sapiens
gatgccttgaggt

SEQ ID NO: 5673589 - DNA, 20 bp, Homo sapiens
gatgcgaaaacttgaatctg

SEQ ID NO: 5673590 - DNA, 13 bp, Homo sapiens
gatgcgaggacca

SEQ ID NO: 5673591 - DNA, 14 bp, Homo sapiens
gatgcgaggaccac

SEQ ID NO: 5673592 - DNA, 16 bp, Homo sapiens
gatgcggatcctgctg

SEQ ID NO: 5673593 - DNA, 13 bp, Homo sapiens
gatgcggccaaga

SEQ ID NO: 5673594 - DNA, 22 bp, Homo sapiens
gatgcggccattcaaggggagc

SEQ ID NO: 5673595 - DNA, 18 bp, Homo sapiens
gatgcggctttctctgcc

SEQ ID NO: 5673596 - DNA, 18 bp, Homo sapiens
gatgcgggcatggcagcc

SEQ ID NO: 5673597 - DNA, 17 bp, Homo sapiens
gatgcggggcagagcca

SEQ ID NO: 5673598 - DNA, 14 bp, Homo sapiens
gatgcgtattctgt

SEQ ID NO: 5673599 - DNA, 15 bp, Homo sapiens
gatgcgtattctgtg

SEQ ID NO: 5673600 - DNA, 19 bp, Homo sapiens
gatgcgtctacccagactc

SEQ ID NO: 5673601 - DNA, 15 bp, Homo sapiens
gatgcgtgggcagag

SEQ ID NO: 5673602 - DNA, 16 bp, Homo sapiens
gatgcgttcagcagac

SEQ ID NO: 5673603 - DNA, 16 bp, Homo sapiens
gatgcgttcgcctctg

SEQ ID NO: 5673604 - DNA, 16 bp, Homo sapiens
gatgcgtttgcctcct

SEQ ID NO: 5673605 - DNA, 13 bp, Homo sapiens
gatgctaataaac

SEQ ID NO: 5673606 - DNA, 16 bp, Homo sapiens
gatgctaattttcagg

SEQ ID NO: 5673607 - DNA, 22 bp, Homo sapiens
gatgctagaactccctttcaac

SEQ ID NO: 5673608 - DNA, 16 bp, Homo sapiens
gatgctagccccagag

SEQ ID NO: 5673609 - DNA, 17 bp, Homo sapiens
gatgctagccccagaga

SEQ ID NO: 5673610 - DNA, 16 bp, Homo sapiens
gatgctaggctgtctg

SEQ ID NO: 5673611 - DNA, 16 bp, Homo sapiens
gatgctagttcttacg

SEQ ID NO: 5673612 - DNA, 15 bp, Homo sapiens
gatgctatgaaattg

SEQ ID NO: 5673613 - DNA, 16 bp, Homo sapiens
gatgctattaagaagg

SEQ ID NO: 5673614 - DNA, 23 bp, Homo sapiens
gatgctatttatgcaagttaggg

SEQ ID NO: 5673615 - DNA, 14 bp, Homo sapiens
gatgctcactgctt

SEQ ID NO: 5673616 - DNA, 20 bp, Homo sapiens
gatgctcaggtacagagaag

SEQ ID NO: 5673617 - DNA, 23 bp, Homo sapiens
gatgctcattcatattcctgcct

SEQ ID NO: 5673618 - DNA, 18 bp, Homo sapiens
gatgctcattccatgact

SEQ ID NO: 5673619 - DNA, 22 bp, Homo sapiens
gatgctcattccatgactctgc

SEQ ID NO: 5673620 - DNA, 20 bp, Homo sapiens
gatgctccaagattctagat

SEQ ID NO: 5673621 - DNA, 13 bp, Homo sapiens
gatgctccagcca

SEQ ID NO: 5673622 - DNA, 12 bp, Homo sapiens
gatgctccaggg

SEQ ID NO: 5673623 - DNA, 15 bp, Homo sapiens
gatgctccagggcag

SEQ ID NO: 5673624 - DNA, 16 bp, Homo sapiens
gatgctccagggcagc

SEQ ID NO: 5673625 - DNA, 21 bp, Homo sapiens
gatgctcccccagggaagaaa

SEQ ID NO: 5673626 - DNA, 16 bp, Homo sapiens
gatgctccctcagcct

SEQ ID NO: 5673627 - DNA, 17 bp, Homo sapiens
gatgctccctcagcctc

SEQ ID NO: 5673628 - DNA, 18 bp, Homo sapiens
gatgctccctcagcctca

SEQ ID NO: 5673629 - DNA, 22 bp, Homo sapiens
gatgctccctcagcctcagagg

SEQ ID NO: 5673630 - DNA, 15 bp, Homo sapiens
gatgctccctcccct

SEQ ID NO: 5673631 - DNA, 22 bp, Homo sapiens
gatgctccgaggactggactgt

SEQ ID NO: 5673632 - DNA, 13 bp, Homo sapiens
gatgctccttggg

SEQ ID NO: 5673633 - DNA, 13 bp, Homo sapiens
gatgctctcaggc

SEQ ID NO: 5673634 - DNA, 20 bp, Homo sapiens
gatgctctctgaggcaaggc

SEQ ID NO: 5673635 - DNA, 21 bp, Homo sapiens
gatgctctctgaggcaaggcc

SEQ ID NO: 5673636 - DNA, 16 bp, Homo sapiens
gatgctctgagaaatt

SEQ ID NO: 5673637 - DNA, 21 bp, Homo sapiens
gatgctctgagaaattgaatg

SEQ ID NO: 5673638 - DNA, 23 bp, Homo sapiens
gatgctctgagaaattgaatgta

SEQ ID NO: 5673639 - DNA, 14 bp, Homo sapiens
gatgctctggcttg

SEQ ID NO: 5673640 - DNA, 20 bp, Homo sapiens
gatgctctggcttgccccag

SEQ ID NO: 5673641 - DNA, 13 bp, Homo sapiens
gatgctctttaaa

SEQ ID NO: 5673642 - DNA, 15 bp, Homo sapiens
gatgctctttcaatg

SEQ ID NO: 5673643 - DNA, 14 bp, Homo sapiens
gatgctctttccct

SEQ ID NO: 5673644 - DNA, 21 bp, Homo sapiens
gatgctgaaacaggagagaaa

SEQ ID NO: 5673645 - DNA, 19 bp, Homo sapiens
gatgctgaaataaactagg

SEQ ID NO: 5673646 - DNA, 23 bp, Homo sapiens
gatgctgaaataaactagggttt

SEQ ID NO: 5673647 - DNA, 21 bp, Homo sapiens
gatgctgacattcacctgccc

SEQ ID NO: 5673648 - DNA, 15 bp, Homo sapiens
gatgctgacccagga

SEQ ID NO: 5673649 - DNA, 12 bp, Homo sapiens
gatgctgacctc

SEQ ID NO: 5673650 - DNA, 13 bp, Homo sapiens
gatgctgagctgt

SEQ ID NO: 5673651 - DNA, 16 bp, Homo sapiens
gatgctgagctgtgat

SEQ ID NO: 5673652 - DNA, 14 bp, Homo sapiens
gatgctgaggaggg

SEQ ID NO: 5673653 - DNA, 15 bp, Homo sapiens
gatgggtccaggggt

SEQ ID NO: 5673654 - DNA, 14 bp, Homo sapiens
gatgggtcccctcc

SEQ ID NO: 5673655 - DNA, 16 bp, Homo sapiens
gatgggtcctgctgct

SEQ ID NO: 5673656 - DNA, 21 bp, Homo sapiens
gatgggtctggctgagctgaa

SEQ ID NO: 5673657 - DNA, 22 bp, Homo sapiens
gatgggtctggtttgcagagct

SEQ ID NO: 5673658 - DNA, 15 bp, Homo sapiens
gatgggtgattatga

SEQ ID NO: 5673659 - DNA, 22 bp, Homo sapiens
gatgggtgccctttcctggcag

SEQ ID NO: 5673660 - DNA, 16 bp, Homo sapiens
gatgggtgctggtcct

SEQ ID NO: 5673661 - DNA, 22 bp, Homo sapiens
gatgggtggggaggggggcggg

SEQ ID NO: 5673662 - DNA, 23 bp, Homo sapiens
gatgggtgggggctcctggtggc

SEQ ID NO: 5673663 - DNA, 15 bp, Homo sapiens
gatgggtgttgctgt

SEQ ID NO: 5673664 - DNA, 13 bp, Homo sapiens
gatgggttcatgt

SEQ ID NO: 5673665 - DNA, 19 bp, Homo sapiens
gatgggttcatgtctctga

SEQ ID NO: 5673666 - DNA, 19 bp, Homo sapiens
gatgggttcccacgtagca

SEQ ID NO: 5673667 - DNA, 18 bp, Homo sapiens
gatgggttttatgagatg

SEQ ID NO: 5673668 - DNA, 14 bp, Homo sapiens
gatggtaagagaaa

SEQ ID NO: 5673669 - DNA, 18 bp, Homo sapiens
gatggtaagagaaaagag

SEQ ID NO: 5673670 - DNA, 22 bp, Homo sapiens
gatggtaagagaaaagagagaa

SEQ ID NO: 5673671 - DNA, 17 bp, Homo sapiens
gatggtaatcttttctg

SEQ ID NO: 5673672 - DNA, 20 bp, Homo sapiens
gatggtacgtgaccctctgc

SEQ ID NO: 5673673 - DNA, 13 bp, Homo sapiens
gatggtagagaga

SEQ ID NO: 5673674 - DNA, 17 bp, Homo sapiens
gatggtagttttttcat

SEQ ID NO: 5673675 - DNA, 15 bp, Homo sapiens
gatggtatcatatat

SEQ ID NO: 5673676 - DNA, 23 bp, Homo sapiens
gatggtatctatagtcaagacga

SEQ ID NO: 5673677 - DNA, 19 bp, Homo sapiens
gatggtatgcacaattcca

SEQ ID NO: 5673678 - DNA, 18 bp, Homo sapiens
gatggtatgtgagctagg

SEQ ID NO: 5673679 - DNA, 16 bp, Homo sapiens
gatggtatttctttct

SEQ ID NO: 5673680 - DNA, 16 bp, Homo sapiens
gatggtcagagcccag

SEQ ID NO: 5673681 - DNA, 14 bp, Homo sapiens
gatggtcagctccc

SEQ ID NO: 5673682 - DNA, 19 bp, Homo sapiens
gatggtccatttgttcctg

SEQ ID NO: 5673683 - DNA, 20 bp, Homo sapiens
gatggtccatttgttcctgc

SEQ ID NO: 5673684 - DNA, 20 bp, Homo sapiens
gatggtcccaggaagcaggg

SEQ ID NO: 5673685 - DNA, 21 bp, Homo sapiens
gatggtccgccacgaggagct

SEQ ID NO: 5673686 - DNA, 16 bp, Homo sapiens
gatggtccgtgcccag

SEQ ID NO: 5673687 - DNA, 18 bp, Homo sapiens
gatggtccgtgcccaggc

SEQ ID NO: 5673688 - DNA, 16 bp, Homo sapiens
gatggtcctaaataaa

SEQ ID NO: 5673689 - DNA, 21 bp, Homo sapiens
gatggtcctggggctctgtgc

SEQ ID NO: 5673690 - DNA, 13 bp, Homo sapiens
gatggtcgtgtgt

SEQ ID NO: 5673691 - DNA, 23 bp, Homo sapiens
gatggtctcgatatcctgatctc

SEQ ID NO: 5673692 - DNA, 13 bp, Homo sapiens
gatggtctcgatc

SEQ ID NO: 5673693 - DNA, 17 bp, Homo sapiens
gatggtctctctccctc

SEQ ID NO: 5673694 - DNA, 24 bp, Homo sapiens
gatggtctgagttcttgtgtcctg

SEQ ID NO: 5673695 - DNA, 19 bp, Homo sapiens
gatggtctgcatcagcttt

SEQ ID NO: 5673696 - DNA, 17 bp, Homo sapiens
gatggtctggtctatgt

SEQ ID NO: 5673697 - DNA, 17 bp, Homo sapiens
gatggtcttgatctcct

SEQ ID NO: 5673698 - DNA, 18 bp, Homo sapiens
gatggtcttgatctcctg

SEQ ID NO: 5673699 - DNA, 17 bp, Homo sapiens
gatggtgaatattacat

SEQ ID NO: 5673700 - DNA, 16 bp, Homo sapiens
gatggtgacattgaaa

SEQ ID NO: 5673701 - DNA, 17 bp, Homo sapiens
gatggtgacattgaaac

SEQ ID NO: 5673702 - DNA, 19 bp, Homo sapiens
gatggtgacattgaaacta

SEQ ID NO: 5673703 - DNA, 15 bp, Homo sapiens
gatggtgactcctga

SEQ ID NO: 5673704 - DNA, 15 bp, Homo sapiens
gatggtgatggagag

SEQ ID NO: 5673705 - DNA, 12 bp, Homo sapiens
gatggtgcaatg

SEQ ID NO: 5673706 - DNA, 14 bp, Homo sapiens
gatggtgcaatgac

SEQ ID NO: 5673707 - DNA, 17 bp, Homo sapiens
gatggtgcaatgacctt

SEQ ID NO: 5673708 - DNA, 14 bp, Homo sapiens
gatggtgctgagaa

SEQ ID NO: 5673709 - DNA, 17 bp, Homo sapiens
gatggtggactacaaaa

SEQ ID NO: 5673710 - DNA, 21 bp, Homo sapiens
gatggtggactacaaaataca

SEQ ID NO: 5673711 - DNA, 14 bp, Homo sapiens
gatggtggagggcc

SEQ ID NO: 5673712 - DNA, 15 bp, Homo sapiens
gatggtggcacaggc

SEQ ID NO: 5673713 - DNA, 18 bp, Homo sapiens
gatggtggcacattcctt

SEQ ID NO: 5673714 - DNA, 22 bp, Homo sapiens
gatggtggcaggaaaatggaca

SEQ ID NO: 5673715 - DNA, 21 bp, Homo sapiens
gatggtggccgcccacccgcc

SEQ ID NO: 5673716 - DNA, 19 bp, Homo sapiens
gatggtgggcttcagggca

SEQ ID NO: 5673717 - DNA, 22 bp, Homo sapiens
gatggtggggcccccagcaccc

SEQ ID NO: 5673718 - DNA, 20 bp, Homo sapiens
gatggtgtagccctcccact

SEQ ID NO: 5673719 - DNA, 21 bp, Homo sapiens
gatggtgtcattctgcctgct

SEQ ID NO: 5673720 - DNA, 17 bp, Homo sapiens
gatggtgtcctgaggcc

SEQ ID NO: 5673721 - DNA, 19 bp, Homo sapiens
gatggtgtcctgaggcctc

SEQ ID NO: 5673722 - DNA, 23 bp, Homo sapiens
gatggtgtcctgaggcctccaag

SEQ ID NO: 5673723 - DNA, 14 bp, Homo sapiens
gatggtgtccttcc

SEQ ID NO: 5673724 - DNA, 17 bp, Homo sapiens
gatggtgtgccttccag

SEQ ID NO: 5673725 - DNA, 20 bp, Homo sapiens
gatggtgttactgcagttga

SEQ ID NO: 5673726 - DNA, 14 bp, Homo sapiens
gatggtgttatctt

SEQ ID NO: 5673727 - DNA, 22 bp, Homo sapiens
gatggttaaaaaggccaaagat

SEQ ID NO: 5673728 - DNA, 23 bp, Homo sapiens
gatggttacactgttagaacact

SEQ ID NO: 5673729 - DNA, 21 bp, Homo sapiens
gatggttcccctgttcactct

SEQ ID NO: 5673730 - DNA, 22 bp, Homo sapiens
gatggttcccttgatgaagaag

SEQ ID NO: 5673731 - DNA, 15 bp, Homo sapiens
gatggttgctttgag

SEQ ID NO: 5673732 - DNA, 14 bp, Homo sapiens
gatggttgtagcat

SEQ ID NO: 5673733 - DNA, 15 bp, Homo sapiens
gatggttgtgtatgg

SEQ ID NO: 5673734 - DNA, 23 bp, Homo sapiens
gatggttttgccctccctctctg

SEQ ID NO: 5673735 - DNA, 15 bp, Homo sapiens
gatgtaaaacagaat

SEQ ID NO: 5673736 - DNA, 13 bp, Homo sapiens
gatgtaaaatctt

SEQ ID NO: 5673737 - DNA, 16 bp, Homo sapiens
gatgtaaaatcttgtc

SEQ ID NO: 5673738 - DNA, 19 bp, Homo sapiens
gatgtaaacagtgcctgct

SEQ ID NO: 5673739 - DNA, 13 bp, Homo sapiens
gatgtaaaccatt

SEQ ID NO: 5673740 - DNA, 21 bp, Homo sapiens
gatgtaaagcgggaaggacat

SEQ ID NO: 5673741 - DNA, 23 bp, Homo sapiens
gatgtaaataaccccattctttg

SEQ ID NO: 5673742 - DNA, 12 bp, Homo sapiens
gatgtaaatcct

SEQ ID NO: 5673743 - DNA, 17 bp, Homo sapiens
gatgtaaatcgggaagg

SEQ ID NO: 5673744 - DNA, 19 bp, Homo sapiens
gatgtaaatcgggaaggat

SEQ ID NO: 5673745 - DNA, 23 bp, Homo sapiens
gatgtaacaagggttttaatgta

SEQ ID NO: 5673746 - DNA, 15 bp, Homo sapiens
gatgtaaccaagctg

SEQ ID NO: 5673747 - DNA, 14 bp, Homo sapiens
gatgtaagaagccc

SEQ ID NO: 5673748 - DNA, 13 bp, Homo sapiens
gatgtaagagctt

SEQ ID NO: 5673749 - DNA, 21 bp, Homo sapiens
gatgtaagtttgtgtaaatta

SEQ ID NO: 5673750 - DNA, 17 bp, Homo sapiens
gatgtaattagctctgg

SEQ ID NO: 5673751 - DNA, 19 bp, Homo sapiens
gatgtaattagctctgggg

SEQ ID NO: 5673752 - DNA, 20 bp, Homo sapiens
gatgtaattagctctggggg

SEQ ID NO: 5673753 - DNA, 11 bp, Homo sapiens
gatgtaattga

SEQ ID NO: 5673754 - DNA, 22 bp, Homo sapiens
gatgtaatttagggtactaaat

SEQ ID NO: 5673755 - DNA, 13 bp, Homo sapiens
gatgtaattttgt

SEQ ID NO: 5673756 - DNA, 16 bp, Homo sapiens
gatgtacaattaaaaa

SEQ ID NO: 5673757 - DNA, 17 bp, Homo sapiens
gatgtacagttgggaaa

SEQ ID NO: 5673758 - DNA, 22 bp, Homo sapiens
gatgtacatagttatttttctc

SEQ ID NO: 5673759 - DNA, 23 bp, Homo sapiens
gatgtactcttatatttttctgg

SEQ ID NO: 5673760 - DNA, 15 bp, Homo sapiens
gatgtacttaagagt

SEQ ID NO: 5673761 - DNA, 20 bp, Homo sapiens
gatgtacttctctgtgtgca

SEQ ID NO: 5673762 - DNA, 13 bp, Homo sapiens
gatgtagaaagtt

SEQ ID NO: 5673763 - DNA, 18 bp, Homo sapiens
gatgtagaggagaaactg

SEQ ID NO: 5673764 - DNA, 15 bp, Homo sapiens
gatgtagagttttta

SEQ ID NO: 5673765 - DNA, 17 bp, Homo sapiens
gatgtagatttatttca

SEQ ID NO: 5673766 - DNA, 13 bp, Homo sapiens
gatgtaggaggga

SEQ ID NO: 5673767 - DNA, 16 bp, Homo sapiens
gatgtaggagggactg

SEQ ID NO: 5673768 - DNA, 20 bp, Homo sapiens
gatgtagggtaaggtgcctt

SEQ ID NO: 5673769 - DNA, 21 bp, Homo sapiens
gatgtagggtaaggtgccttc

SEQ ID NO: 5673770 - DNA, 14 bp, Homo sapiens
gatgtataaatttt

SEQ ID NO: 5673771 - DNA, 13 bp, Homo sapiens
gatgtataatgta

SEQ ID NO: 5673772 - DNA, 21 bp, Homo sapiens
gatgtatagctttaacatttt

SEQ ID NO: 5673773 - DNA, 21 bp, Homo sapiens
gatgtatattcctttgaagat

SEQ ID NO: 5673774 - DNA, 17 bp, Homo sapiens
gatgtatatttgcatat

SEQ ID NO: 5673775 - DNA, 14 bp, Homo sapiens
gatgtatcatgatt

SEQ ID NO: 5673776 - DNA, 20 bp, Homo sapiens
gatgtatgcacacacatata

SEQ ID NO: 5673777 - DNA, 16 bp, Homo sapiens
gatgtatgcccaaaga

SEQ ID NO: 5673778 - DNA, 20 bp, Homo sapiens
gatgtatgctgtttgtacaa

SEQ ID NO: 5673779 - DNA, 21 bp, Homo sapiens
gatgtatgctgtttgtacaaa

SEQ ID NO: 5673780 - DNA, 15 bp, Homo sapiens
gatgtatgtaaatat

SEQ ID NO: 5673781 - DNA, 15 bp, Homo sapiens
gatgtatgtgtatat

SEQ ID NO: 5673782 - DNA, 21 bp, Homo sapiens
gatgtatgttgaagcctttgt

SEQ ID NO: 5673783 - DNA, 14 bp, Homo sapiens
gatgtattattata

SEQ ID NO: 5673784 - DNA, 15 bp, Homo sapiens
gatgtattcagagcc

SEQ ID NO: 5673785 - DNA, 15 bp, Homo sapiens
gatgtattttcatag

SEQ ID NO: 5673786 - DNA, 19 bp, Homo sapiens
gatgtatttttgatgtata

SEQ ID NO: 5673787 - DNA, 22 bp, Homo sapiens
gatgtcaaccttgtgtgagtgt

SEQ ID NO: 5673788 - DNA, 15 bp, Homo sapiens
gatgtcaagctggcc

SEQ ID NO: 5673789 - DNA, 15 bp, Homo sapiens
gatgtcaatttctgt

SEQ ID NO: 5673790 - DNA, 13 bp, Homo sapiens
gatgtcacagggc

SEQ ID NO: 5673791 - DNA, 19 bp, Homo sapiens
gatgtcacagtttgttcag

SEQ ID NO: 5673792 - DNA, 15 bp, Homo sapiens
gatgtcactcagccc

SEQ ID NO: 5673793 - DNA, 16 bp, Homo sapiens
gatgtcactcagcccc

SEQ ID NO: 5673794 - DNA, 20 bp, Homo sapiens
gatgtcactcagccccttcc

SEQ ID NO: 5673795 - DNA, 19 bp, Homo sapiens
gatgtcagcagacacacat

SEQ ID NO: 5673796 - DNA, 22 bp, Homo sapiens
gatgtcagctgctgttgaactt

SEQ ID NO: 5673797 - DNA, 15 bp, Homo sapiens
gatgtcagtatttca

SEQ ID NO: 5673798 - DNA, 19 bp, Homo sapiens
gatgtcagtatttcaactg

SEQ ID NO: 5673799 - DNA, 19 bp, Homo sapiens
gatgtcagtctgtccacgt

SEQ ID NO: 5673800 - DNA, 16 bp, Homo sapiens
gatgtcatacagagaa

SEQ ID NO: 5673801 - DNA, 18 bp, Homo sapiens
gatgtcatacagagaagt

SEQ ID NO: 5673802 - DNA, 23 bp, Homo sapiens
gatgtcatatcatttcactgtct

SEQ ID NO: 5673803 - DNA, 17 bp, Homo sapiens
gatgtcatcaagctcca

SEQ ID NO: 5673804 - DNA, 19 bp, Homo sapiens
gatgtcatcccattgtctt

SEQ ID NO: 5673805 - DNA, 13 bp, Homo sapiens
gatgtcatcttga

SEQ ID NO: 5673806 - DNA, 20 bp, Homo sapiens
gatgtcatgtctgcttgtca

SEQ ID NO: 5673807 - DNA, 22 bp, Homo sapiens
gatgtccaaacttaacagatca

SEQ ID NO: 5673808 - DNA, 16 bp, Homo sapiens
gatgtcccacagggac

SEQ ID NO: 5673809 - DNA, 19 bp, Homo sapiens
gatgtcccacagggaccac

SEQ ID NO: 5673810 - DNA, 19 bp, Homo sapiens
gatgtcccagtttcccact

SEQ ID NO: 5673811 - DNA, 15 bp, Homo sapiens
gatgtccccagcaga

SEQ ID NO: 5673812 - DNA, 15 bp, Homo sapiens
gatgtcccctgcggg

SEQ ID NO: 5673813 - DNA, 18 bp, Homo sapiens
gatgtccctattctgcca

SEQ ID NO: 5673814 - DNA, 20 bp, Homo sapiens
gatgtccctgggccagggtc

SEQ ID NO: 5673815 - DNA, 22 bp, Homo sapiens
gatgtccctgggccagggtctg

SEQ ID NO: 5673816 - DNA, 13 bp, Homo sapiens
gatgtcccttccc

SEQ ID NO: 5673817 - DNA, 19 bp, Homo sapiens
gatgtcccttgatgcacag

SEQ ID NO: 5673818 - DNA, 20 bp, Homo sapiens
gatgtcccttgatgcacaga

SEQ ID NO: 5673819 - DNA, 21 bp, Homo sapiens
gatgtcctcaccacatgcgga

SEQ ID NO: 5673820 - DNA, 16 bp, Homo sapiens
gatgtcctcctctgtg

SEQ ID NO: 5673821 - DNA, 17 bp, Homo sapiens
gatgtcctcctctgtga

SEQ ID NO: 5673822 - DNA, 19 bp, Homo sapiens
gatgtcctcctctgtgaaa

SEQ ID NO: 5673823 - DNA, 14 bp, Homo sapiens
gatgtcctgtaaac

SEQ ID NO: 5673824 - DNA, 15 bp, Homo sapiens
gatgtcgacatgttt

SEQ ID NO: 5673825 - DNA, 19 bp, Homo sapiens
gatgtcgctgggtcctctg

SEQ ID NO: 5673826 - DNA, 18 bp, Homo sapiens
gatgtcgtggactccagc

SEQ ID NO: 5673827 - DNA, 19 bp, Homo sapiens
gatgtcgtggactccagct

SEQ ID NO: 5673828 - DNA, 22 bp, Homo sapiens
gatgtcgtggactccagctcta

SEQ ID NO: 5673829 - DNA, 16 bp, Homo sapiens
gatgtctacagaaaat

SEQ ID NO: 5673830 - DNA, 19 bp, Homo sapiens
tatttcaaaaacatgcttt

SEQ ID NO: 5673831 - DNA, 21 bp, Homo sapiens
tatttcaaaaatttggaattc

SEQ ID NO: 5673832 - DNA, 17 bp, Homo sapiens
tatttcaaaataaactg

SEQ ID NO: 5673833 - DNA, 13 bp, Homo sapiens
tatttcaaacatc

SEQ ID NO: 5673834 - DNA, 23 bp, Homo sapiens
tatttcaaacatcagctgaattc

SEQ ID NO: 5673835 - DNA, 12 bp, Homo sapiens
tatttcaaatat

SEQ ID NO: 5673836 - DNA, 14 bp, Homo sapiens
tatttcaaattgga

SEQ ID NO: 5673837 - DNA, 22 bp, Homo sapiens
tatttcaactgctgtaaaatta

SEQ ID NO: 5673838 - DNA, 23 bp, Homo sapiens
tatttcaagggttgcttctgagt

SEQ ID NO: 5673839 - DNA, 19 bp, Homo sapiens
tatttcaagtacactgaat

SEQ ID NO: 5673840 - DNA, 11 bp, Homo sapiens
tatttcaagtg

SEQ ID NO: 5673841 - DNA, 12 bp, Homo sapiens
tatttcaagtgc

SEQ ID NO: 5673842 - DNA, 16 bp, Homo sapiens
tatttcaataagtgtt

SEQ ID NO: 5673843 - DNA, 16 bp, Homo sapiens
tatttcaatgtaatta

SEQ ID NO: 5673844 - DNA, 12 bp, Homo sapiens
tatttcaattgt

SEQ ID NO: 5673845 - DNA, 22 bp, Homo sapiens
tatttcaatttccaagagctga

SEQ ID NO: 5673846 - DNA, 23 bp, Homo sapiens
tatttcacagagcacgcctgcca

SEQ ID NO: 5673847 - DNA, 20 bp, Homo sapiens
tatttcacagcaacactcta

SEQ ID NO: 5673848 - DNA, 22 bp, Homo sapiens
tatttcacaggctgtaaattga

SEQ ID NO: 5673849 - DNA, 16 bp, Homo sapiens
tatttcacatgtttat

SEQ ID NO: 5673850 - DNA, 20 bp, Homo sapiens
tatttcactaaatgtaaaat

SEQ ID NO: 5673851 - DNA, 18 bp, Homo sapiens
tatttcactatcttcttc

SEQ ID NO: 5673852 - DNA, 20 bp, Homo sapiens
tatttcactatcttcttcaa

SEQ ID NO: 5673853 - DNA, 21 bp, Homo sapiens
tatttcactatcttcttcaaa

SEQ ID NO: 5673854 - DNA, 15 bp, Homo sapiens
tatttcactggagca

SEQ ID NO: 5673855 - DNA, 11 bp, Homo sapiens
tatttcactta

SEQ ID NO: 5673856 - DNA, 19 bp, Homo sapiens
tatttcacttaaactttgt

SEQ ID NO: 5673857 - DNA, 21 bp, Homo sapiens
tatttcacttaaactttgtca

SEQ ID NO: 5673858 - DNA, 22 bp, Homo sapiens
tatttcacttaaactttgtcac

SEQ ID NO: 5673859 - DNA, 20 bp, Homo sapiens
tatttcactttagatgctga

SEQ ID NO: 5673860 - DNA, 19 bp, Homo sapiens
tatttcacttttgttctgc

SEQ ID NO: 5673861 - DNA, 13 bp, Homo sapiens
tatttcagaaata

SEQ ID NO: 5673862 - DNA, 13 bp, Homo sapiens
tatttcagaagga

SEQ ID NO: 5673863 - DNA, 20 bp, Homo sapiens
tatttcagacattttcactg

SEQ ID NO: 5673864 - DNA, 21 bp, Homo sapiens
tatttcagatatcaaaattct

SEQ ID NO: 5673865 - DNA, 22 bp, Homo sapiens
tatttcagatatcaaaattcta

SEQ ID NO: 5673866 - DNA, 20 bp, Homo sapiens
tatttcagatgtaatgtttt

SEQ ID NO: 5673867 - DNA, 16 bp, Homo sapiens
tatttcagattttgat

SEQ ID NO: 5673868 - DNA, 18 bp, Homo sapiens
tatttcagcaaacttgtt

SEQ ID NO: 5673869 - DNA, 15 bp, Homo sapiens
tatttcagcaacaac

SEQ ID NO: 5673870 - DNA, 21 bp, Homo sapiens
tatttcaggcattggatattt

SEQ ID NO: 5673871 - DNA, 18 bp, Homo sapiens
tatttcagtattttccag

SEQ ID NO: 5673872 - DNA, 22 bp, Homo sapiens
tatttcagtattttccagcctt

SEQ ID NO: 5673873 - DNA, 18 bp, Homo sapiens
tatttcagtggaatagat

SEQ ID NO: 5673874 - DNA, 22 bp, Homo sapiens
tatttcagtgtagttaatttat

SEQ ID NO: 5673875 - DNA, 15 bp, Homo sapiens
tatttcagtgtgcat

SEQ ID NO: 5673876 - DNA, 22 bp, Homo sapiens
tatttcagttccgtcagaaagt

SEQ ID NO: 5673877 - DNA, 20 bp, Homo sapiens
tatttcataaacaacttaat

SEQ ID NO: 5673878 - DNA, 15 bp, Homo sapiens
tatttcataaattaa

SEQ ID NO: 5673879 - DNA, 12 bp, Homo sapiens
tatttcataatt

SEQ ID NO: 5673880 - DNA, 13 bp, Homo sapiens
tatttcataattg

SEQ ID NO: 5673881 - DNA, 16 bp, Homo sapiens
tatttcataattgcct

SEQ ID NO: 5673882 - DNA, 19 bp, Homo sapiens
tatttcatacaaaactgtt

SEQ ID NO: 5673883 - DNA, 13 bp, Homo sapiens
tatttcatatact

SEQ ID NO: 5673884 - DNA, 15 bp, Homo sapiens
tatttcatattgaga

SEQ ID NO: 5673885 - DNA, 13 bp, Homo sapiens
tatttcatcacaa

SEQ ID NO: 5673886 - DNA, 20 bp, Homo sapiens
tatttcatcatattatacag

SEQ ID NO: 5673887 - DNA, 14 bp, Homo sapiens
tatttcatcatgac

SEQ ID NO: 5673888 - DNA, 20 bp, Homo sapiens
tatttcatctgttctatgct

SEQ ID NO: 5673889 - DNA, 15 bp, Homo sapiens
tatttcatgtcttta

SEQ ID NO: 5673890 - DNA, 22 bp, Homo sapiens
tatttcatgtggtgaatatgca

SEQ ID NO: 5673891 - DNA, 23 bp, Homo sapiens
tatttcatgtggtgaatatgcaa

SEQ ID NO: 5673892 - DNA, 13 bp, Homo sapiens
tatttcatgtttt

SEQ ID NO: 5673893 - DNA, 19 bp, Homo sapiens
tatttcattatctgtactg

SEQ ID NO: 5673894 - DNA, 22 bp, Homo sapiens
tatttcattatctgtactgaaa

SEQ ID NO: 5673895 - DNA, 12 bp, Homo sapiens
tatttcattgcc

SEQ ID NO: 5673896 - DNA, 12 bp, Homo sapiens
tatttcatttct

SEQ ID NO: 5673897 - DNA, 13 bp, Homo sapiens
tatttcatttctt

SEQ ID NO: 5673898 - DNA, 20 bp, Homo sapiens
tatttcatttgctgttcatc

SEQ ID NO: 5673899 - DNA, 12 bp, Homo sapiens
tatttcattttg

SEQ ID NO: 5673900 - DNA, 14 bp, Homo sapiens
tatttccaaaatgt

SEQ ID NO: 5673901 - DNA, 14 bp, Homo sapiens
tatttccaaatatt

SEQ ID NO: 5673902 - DNA, 20 bp, Homo sapiens
tatttccaaatattctaaaa

SEQ ID NO: 5673903 - DNA, 16 bp, Homo sapiens
tatttccaatgtgaaa

SEQ ID NO: 5673904 - DNA, 20 bp, Homo sapiens
tatttccacaatagggttca

SEQ ID NO: 5673905 - DNA, 19 bp, Homo sapiens
tatttccacataaaggtat

SEQ ID NO: 5673906 - DNA, 18 bp, Homo sapiens
tatttccacccatttgtt

SEQ ID NO: 5673907 - DNA, 15 bp, Homo sapiens
tatttccactaaaaa

SEQ ID NO: 5673908 - DNA, 19 bp, Homo sapiens
tatttccactaaaaatatt

SEQ ID NO: 5673909 - DNA, 13 bp, Homo sapiens
tatttccacttct

SEQ ID NO: 5673910 - DNA, 21 bp, Homo sapiens
tatttccagaaggatttcttg

SEQ ID NO: 5673911 - DNA, 22 bp, Homo sapiens
tatttccagaaggatttcttgt

SEQ ID NO: 5673912 - DNA, 12 bp, Homo sapiens
tatttccagtgg

SEQ ID NO: 5673913 - DNA, 13 bp, Homo sapiens
tatttccagtggt

SEQ ID NO: 5673914 - DNA, 15 bp, Homo sapiens
tatttccatattaaa

SEQ ID NO: 5673915 - DNA, 18 bp, Homo sapiens
tatttccatattaaaatc

SEQ ID NO: 5673916 - DNA, 18 bp, Homo sapiens
tatttccattcaacaaga

SEQ ID NO: 5673917 - DNA, 13 bp, Homo sapiens
tatttcccctgtc

SEQ ID NO: 5673918 - DNA, 15 bp, Homo sapiens
tatttcccctgtcag

SEQ ID NO: 5673919 - DNA, 15 bp, Homo sapiens
tatttccccttggac

SEQ ID NO: 5673920 - DNA, 21 bp, Homo sapiens
tatttcccctttccaattcca

SEQ ID NO: 5673921 - DNA, 20 bp, Homo sapiens
tatttccctaaaatacattt

SEQ ID NO: 5673922 - DNA, 15 bp, Homo sapiens
tatttccctacatta

SEQ ID NO: 5673923 - DNA, 15 bp, Homo sapiens
tatttccctcccctg

SEQ ID NO: 5673924 - DNA, 22 bp, Homo sapiens
tatttccctgaaggaaccaaag

SEQ ID NO: 5673925 - DNA, 16 bp, Homo sapiens
tatttcccttccaaag

SEQ ID NO: 5673926 - DNA, 16 bp, Homo sapiens
tatttcccttttctgt

SEQ ID NO: 5673927 - DNA, 15 bp, Homo sapiens
tatttcctaatcaaa

SEQ ID NO: 5673928 - DNA, 23 bp, Homo sapiens
tatttcctatattgttttcagtg

SEQ ID NO: 5673929 - DNA, 15 bp, Homo sapiens
tatttcctatgatgt

SEQ ID NO: 5673930 - DNA, 13 bp, Homo sapiens
tatttcctccctc

SEQ ID NO: 5673931 - DNA, 15 bp, Homo sapiens
tatttcctcttggta

SEQ ID NO: 5673932 - DNA, 13 bp, Homo sapiens
tatttcctgactt

SEQ ID NO: 5673933 - DNA, 16 bp, Homo sapiens
tatttcctgacttgag

SEQ ID NO: 5673934 - DNA, 12 bp, Homo sapiens
tatttcctgcta

SEQ ID NO: 5673935 - DNA, 12 bp, Homo sapiens
tatttccttaaa

SEQ ID NO: 5673936 - DNA, 21 bp, Homo sapiens
tatttccttatgtgtgtagga

SEQ ID NO: 5673937 - DNA, 12 bp, Homo sapiens
tatttccttcca

SEQ ID NO: 5673938 - DNA, 15 bp, Homo sapiens
tatttccttccagcc

SEQ ID NO: 5673939 - DNA, 17 bp, Homo sapiens
tatttccttccagcctt

SEQ ID NO: 5673940 - DNA, 16 bp, Homo sapiens
tatttcctttatgtga

SEQ ID NO: 5673941 - DNA, 18 bp, Homo sapiens
tatttcctttatgtgaat

SEQ ID NO: 5673942 - DNA, 12 bp, Homo sapiens
tatttcctttgc

SEQ ID NO: 5673943 - DNA, 17 bp, Homo sapiens
tatttccttttctaaat

SEQ ID NO: 5673944 - DNA, 15 bp, Homo sapiens
tatttcgaaactgcc

SEQ ID NO: 5673945 - DNA, 15 bp, Homo sapiens
tatttcgaaagctgc

SEQ ID NO: 5673946 - DNA, 16 bp, Homo sapiens
tatttcgaccctgggg

SEQ ID NO: 5673947 - DNA, 17 bp, Homo sapiens
tatttcgctatagattt

SEQ ID NO: 5673948 - DNA, 14 bp, Homo sapiens
tatttcggctatgt

SEQ ID NO: 5673949 - DNA, 16 bp, Homo sapiens
tatttcggctatgtct

SEQ ID NO: 5673950 - DNA, 19 bp, Homo sapiens
tatttcgtgtactgcaaag

SEQ ID NO: 5673951 - DNA, 14 bp, Homo sapiens
tatttctaaatgtt

SEQ ID NO: 5673952 - DNA, 17 bp, Homo sapiens
tatttctaagcttattt

SEQ ID NO: 5673953 - DNA, 23 bp, Homo sapiens
tatttctaagcttatttctaact

SEQ ID NO: 5673954 - DNA, 23 bp, Homo sapiens
tatttctaagtatttaaatgttc

SEQ ID NO: 5673955 - DNA, 20 bp, Homo sapiens
tatttctaatccttttcctt

SEQ ID NO: 5673956 - DNA, 16 bp, Homo sapiens
tatttctaggaagaat

SEQ ID NO: 5673957 - DNA, 19 bp, Homo sapiens
tatttctaggaagaatttt

SEQ ID NO: 5673958 - DNA, 14 bp, Homo sapiens
tatttctaggcaca

SEQ ID NO: 5673959 - DNA, 16 bp, Homo sapiens
tatttctatacagtag

SEQ ID NO: 5673960 - DNA, 12 bp, Homo sapiens
tatttctatata

SEQ ID NO: 5673961 - DNA, 17 bp, Homo sapiens
tatttctatattttcat

SEQ ID NO: 5673962 - DNA, 16 bp, Homo sapiens
tatttctatcccaaac

SEQ ID NO: 5673963 - DNA, 13 bp, Homo sapiens
tatttctatctgc

SEQ ID NO: 5673964 - DNA, 17 bp, Homo sapiens
tatttctatctgcaaat

SEQ ID NO: 5673965 - DNA, 21 bp, Homo sapiens
tatttctatgaaatattatgt

SEQ ID NO: 5673966 - DNA, 16 bp, Homo sapiens
tatttctatgacaaat

SEQ ID NO: 5673967 - DNA, 14 bp, Homo sapiens
tatttctatgtaaa

SEQ ID NO: 5673968 - DNA, 17 bp, Homo sapiens
tatttctatgtaaatta

SEQ ID NO: 5673969 - DNA, 22 bp, Homo sapiens
tatttctatgtaaattattgta

SEQ ID NO: 5673970 - DNA, 14 bp, Homo sapiens
tatttctattcctt

SEQ ID NO: 5673971 - DNA, 16 bp, Homo sapiens
tatttctattccttat

SEQ ID NO: 5673972 - DNA, 11 bp, Homo sapiens
tatttctattg

SEQ ID NO: 5673973 - DNA, 21 bp, Homo sapiens
tatttctcaacaaagcacagt

SEQ ID NO: 5673974 - DNA, 17 bp, Homo sapiens
tatttctcagctgtgcc

SEQ ID NO: 5673975 - DNA, 23 bp, Homo sapiens
tatttctccatcccctccctgcc

SEQ ID NO: 5673976 - DNA, 15 bp, Homo sapiens
tatttctccatcttt

SEQ ID NO: 5673977 - DNA, 12 bp, Homo sapiens
tatttctccttt

SEQ ID NO: 5673978 - DNA, 16 bp, Homo sapiens
tatttctcctttgcaa

SEQ ID NO: 5673979 - DNA, 19 bp, Homo sapiens
tatttctcgggtgcatttg

SEQ ID NO: 5673980 - DNA, 14 bp, Homo sapiens
tatttctctagtgt

SEQ ID NO: 5673981 - DNA, 14 bp, Homo sapiens
tatttctctctcct

SEQ ID NO: 5673982 - DNA, 17 bp, Homo sapiens
tatttctctctcctggt

SEQ ID NO: 5673983 - DNA, 19 bp, Homo sapiens
tatttctctgatttgcaaa

SEQ ID NO: 5673984 - DNA, 15 bp, Homo sapiens
tatttctctggcaaa

SEQ ID NO: 5673985 - DNA, 19 bp, Homo sapiens
tatttctctggcaaacttt

SEQ ID NO: 5673986 - DNA, 14 bp, Homo sapiens
tatttctctgtgta

SEQ ID NO: 5673987 - DNA, 15 bp, Homo sapiens
tatttctctttcttt

SEQ ID NO: 5673988 - DNA, 16 bp, Homo sapiens
tatttctctttcttta

SEQ ID NO: 5673989 - DNA, 23 bp, Homo sapiens
tatttctcttttattctgttata

SEQ ID NO: 5673990 - DNA, 15 bp, Homo sapiens
tatttctgaattcaa

SEQ ID NO: 5673991 - DNA, 15 bp, Homo sapiens
tatttctgactctta

SEQ ID NO: 5673992 - DNA, 17 bp, Homo sapiens
tatttctgagcaaagca

SEQ ID NO: 5673993 - DNA, 20 bp, Homo sapiens
tatttctgagcaaagcatcg

SEQ ID NO: 5673994 - DNA, 13 bp, Homo sapiens
tatttctgatgat

SEQ ID NO: 5673995 - DNA, 16 bp, Homo sapiens
tatttctgatgatgtc

SEQ ID NO: 5673996 - DNA, 12 bp, Homo sapiens
tatttctgattt

SEQ ID NO: 5673997 - DNA, 18 bp, Homo sapiens
tatttctgcctataaatt

SEQ ID NO: 5673998 - DNA, 14 bp, Homo sapiens
tatttctgcctccc

SEQ ID NO: 5673999 - DNA, 13 bp, Homo sapiens
tatttctgctctg

SEQ ID NO: 5674000 - DNA, 22 bp, Homo sapiens
tatttctgctgaattttcacat

SEQ ID NO: 5674001 - DNA, 22 bp, Homo sapiens
tatttctggcagctgtggtaca

SEQ ID NO: 5674002 - DNA, 20 bp, Homo sapiens
tatttctgtaaaatttgttt

SEQ ID NO: 5674003 - DNA, 15 bp, Homo sapiens
tatttctgtatataa

SEQ ID NO: 5674004 - DNA, 20 bp, Homo sapiens
tatttctgtatatttgtcat

SEQ ID NO: 5674005 - DNA, 11 bp, Homo sapiens
tatttctgtga

SEQ ID NO: 5674006 - DNA, 20 bp, Homo sapiens
tatttctgtggaaaacaatt

SEQ ID NO: 5674007 - DNA, 23 bp, Homo sapiens
tatttctgtggaaaacaatttgc

SEQ ID NO: 5674008 - DNA, 19 bp, Homo sapiens
tatttctgtgtacacatct

SEQ ID NO: 5674009 - DNA, 15 bp, Homo sapiens
tatttgtcatgacag

SEQ ID NO: 5674010 - DNA, 16 bp, Homo sapiens
tatttgtcatgacagt

SEQ ID NO: 5674011 - DNA, 20 bp, Homo sapiens
tatttgtcatgctgggattt

SEQ ID NO: 5674012 - DNA, 15 bp, Homo sapiens
tatttgtctcttaca

SEQ ID NO: 5674013 - DNA, 18 bp, Homo sapiens
tatttgtctgtgtgctac

SEQ ID NO: 5674014 - DNA, 20 bp, Homo sapiens
tatttgtctgtgtgctacta

SEQ ID NO: 5674015 - DNA, 21 bp, Homo sapiens
tatttgtctgtgtgctactaa

SEQ ID NO: 5674016 - DNA, 13 bp, Homo sapiens
tatttgtcttaaa

SEQ ID NO: 5674017 - DNA, 12 bp, Homo sapiens
tatttgtcttcc

SEQ ID NO: 5674018 - DNA, 12 bp, Homo sapiens
tatttgtgaaag

SEQ ID NO: 5674019 - DNA, 22 bp, Homo sapiens
tatttgtgaaagtgccaaaata

SEQ ID NO: 5674020 - DNA, 14 bp, Homo sapiens
tatttgtgactaat

SEQ ID NO: 5674021 - DNA, 19 bp, Homo sapiens
tatttgtgactaattgtat

SEQ ID NO: 5674022 - DNA, 17 bp, Homo sapiens
tatttgtgacttttaaa

SEQ ID NO: 5674023 - DNA, 15 bp, Homo sapiens
tatttgtgagactgt

SEQ ID NO: 5674024 - DNA, 13 bp, Homo sapiens
tatttgtgcattt

SEQ ID NO: 5674025 - DNA, 14 bp, Homo sapiens
tatttgtgctttga

SEQ ID NO: 5674026 - DNA, 12 bp, Homo sapiens
tatttgtggaat

SEQ ID NO: 5674027 - DNA, 14 bp, Homo sapiens
tatttgtggaataa

SEQ ID NO: 5674028 - DNA, 20 bp, Homo sapiens
tatttgtgggaggagtgaca

SEQ ID NO: 5674029 - DNA, 14 bp, Homo sapiens
tatttgtgtaactg

SEQ ID NO: 5674030 - DNA, 13 bp, Homo sapiens
tatttgtgtaata

SEQ ID NO: 5674031 - DNA, 13 bp, Homo sapiens
tatttgtgtatgt

SEQ ID NO: 5674032 - DNA, 18 bp, Homo sapiens
tatttgtgtatttaacag

SEQ ID NO: 5674033 - DNA, 12 bp, Homo sapiens
tatttgtgttca

SEQ ID NO: 5674034 - DNA, 16 bp, Homo sapiens
tatttgttaatttctt

SEQ ID NO: 5674035 - DNA, 22 bp, Homo sapiens
tatttgttacttttagttctat

SEQ ID NO: 5674036 - DNA, 20 bp, Homo sapiens
tatttgttatatataataaa

SEQ ID NO: 5674037 - DNA, 21 bp, Homo sapiens
tatttgttatatataataaat

SEQ ID NO: 5674038 - DNA, 22 bp, Homo sapiens
tatttgttatatataataaata

SEQ ID NO: 5674039 - DNA, 16 bp, Homo sapiens
tatttgttatggcaga

SEQ ID NO: 5674040 - DNA, 14 bp, Homo sapiens
tatttgttatttat

SEQ ID NO: 5674041 - DNA, 20 bp, Homo sapiens
tatttgttatttattaaatt

SEQ ID NO: 5674042 - DNA, 17 bp, Homo sapiens
tatttgttattttcagt

SEQ ID NO: 5674043 - DNA, 18 bp, Homo sapiens
tatttgttattttcagta

SEQ ID NO: 5674044 - DNA, 22 bp, Homo sapiens
tatttgttcatgtttggtgcat

SEQ ID NO: 5674045 - DNA, 13 bp, Homo sapiens
tatttgttcatta

SEQ ID NO: 5674046 - DNA, 20 bp, Homo sapiens
tatttgttcattatttgtgc

SEQ ID NO: 5674047 - DNA, 20 bp, Homo sapiens
tatttgttctggtttagtgt

SEQ ID NO: 5674048 - DNA, 18 bp, Homo sapiens
tatttgttctttttctga

SEQ ID NO: 5674049 - DNA, 15 bp, Homo sapiens
tatttgttgttttct

SEQ ID NO: 5674050 - DNA, 22 bp, Homo sapiens
tatttgttgttttctgggggaa

SEQ ID NO: 5674051 - DNA, 18 bp, Homo sapiens
tatttgtttacatgcaga

SEQ ID NO: 5674052 - DNA, 19 bp, Homo sapiens
tatttgtttagttcagcaa

SEQ ID NO: 5674053 - DNA, 12 bp, Homo sapiens
tatttgtttcat

SEQ ID NO: 5674054 - DNA, 13 bp, Homo sapiens
tatttgtttcatt

SEQ ID NO: 5674055 - DNA, 14 bp, Homo sapiens
tatttgtttgattt

SEQ ID NO: 5674056 - DNA, 14 bp, Homo sapiens
tatttgtttgcaat

SEQ ID NO: 5674057 - DNA, 16 bp, Homo sapiens
tatttgtttgtagctt

SEQ ID NO: 5674058 - DNA, 13 bp, Homo sapiens
tatttgttttcat

SEQ ID NO: 5674059 - DNA, 13 bp, Homo sapiens
tattttaaaacaa

SEQ ID NO: 5674060 - DNA, 15 bp, Homo sapiens
tattttaaaaccatg

SEQ ID NO: 5674061 - DNA, 20 bp, Homo sapiens
tattttaaaaccatgcagct

SEQ ID NO: 5674062 - DNA, 14 bp, Homo sapiens
tattttaaaagaat

SEQ ID NO: 5674063 - DNA, 18 bp, Homo sapiens
tattttaaaagaatgatt

SEQ ID NO: 5674064 - DNA, 21 bp, Homo sapiens
tattttaaaagataaatatta

SEQ ID NO: 5674065 - DNA, 23 bp, Homo sapiens
tattttaaaagccacatagagtg

SEQ ID NO: 5674066 - DNA, 16 bp, Homo sapiens
tattttaaaataaatg

SEQ ID NO: 5674067 - DNA, 23 bp, Homo sapiens
tattttaaaatagcgttcttgta

SEQ ID NO: 5674068 - DNA, 15 bp, Homo sapiens
tattttaaaatattt

SEQ ID NO: 5674069 - DNA, 13 bp, Homo sapiens
tattttaaaatga

SEQ ID NO: 5674070 - DNA, 15 bp, Homo sapiens
tattttaaaatttca

SEQ ID NO: 5674071 - DNA, 13 bp, Homo sapiens
tattttaaacatt

SEQ ID NO: 5674072 - DNA, 21 bp, Homo sapiens
tattttaaactactgattgaa

SEQ ID NO: 5674073 - DNA, 12 bp, Homo sapiens
tattttaaagaa

SEQ ID NO: 5674074 - DNA, 20 bp, Homo sapiens
tattttaaagctgactttgt

SEQ ID NO: 5674075 - DNA, 15 bp, Homo sapiens
tattttaaatatact

SEQ ID NO: 5674076 - DNA, 12 bp, Homo sapiens
tattttaaatct

SEQ ID NO: 5674077 - DNA, 17 bp, Homo sapiens
tattttaaatcttaaca

SEQ ID NO: 5674078 - DNA, 22 bp, Homo sapiens
tattttaaattataaggactgc

SEQ ID NO: 5674079 - DNA, 14 bp, Homo sapiens
tattttaacttttt

SEQ ID NO: 5674080 - DNA, 13 bp, Homo sapiens
tattttaagaaag

SEQ ID NO: 5674081 - DNA, 17 bp, Homo sapiens
tattttaagaaagagaa

SEQ ID NO: 5674082 - DNA, 18 bp, Homo sapiens
tattttaagaagttgctg

SEQ ID NO: 5674083 - DNA, 16 bp, Homo sapiens
tattttaagaattgtt

SEQ ID NO: 5674084 - DNA, 23 bp, Homo sapiens
tattttaagactgattttaatag

SEQ ID NO: 5674085 - DNA, 12 bp, Homo sapiens
tattttaagcat

SEQ ID NO: 5674086 - DNA, 14 bp, Homo sapiens
tattttaagcatta

SEQ ID NO: 5674087 - DNA, 22 bp, Homo sapiens
tattttaagcattactcttgta

SEQ ID NO: 5674088 - DNA, 21 bp, Homo sapiens
tattttaagccctatcactga

SEQ ID NO: 5674089 - DNA, 17 bp, Homo sapiens
tattttaaggttgcaca

SEQ ID NO: 5674090 - DNA, 22 bp, Homo sapiens
tattttaaggttgcacacagta

SEQ ID NO: 5674091 - DNA, 21 bp, Homo sapiens
tattttaataacatatctaaa

SEQ ID NO: 5674092 - DNA, 13 bp, Homo sapiens
tattttaatacct

SEQ ID NO: 5674093 - DNA, 19 bp, Homo sapiens
tattttaatacctttaaat

SEQ ID NO: 5674094 - DNA, 21 bp, Homo sapiens
tattttaatacctttaaatat

SEQ ID NO: 5674095 - DNA, 16 bp, Homo sapiens
tattttaatagcctgt

SEQ ID NO: 5674096 - DNA, 21 bp, Homo sapiens
tattttaatattgatgtcagt

SEQ ID NO: 5674097 - DNA, 12 bp, Homo sapiens
tattttaatcct

SEQ ID NO: 5674098 - DNA, 14 bp, Homo sapiens
tattttaatcctgt

SEQ ID NO: 5674099 - DNA, 15 bp, Homo sapiens
tattttaatgaatat

SEQ ID NO: 5674100 - DNA, 14 bp, Homo sapiens
tattttaatgtgat

SEQ ID NO: 5674101 - DNA, 14 bp, Homo sapiens
tattttaattaaaa

SEQ ID NO: 5674102 - DNA, 14 bp, Homo sapiens
tattttaattactg

SEQ ID NO: 5674103 - DNA, 13 bp, Homo sapiens
tattttaatttta

SEQ ID NO: 5674104 - DNA, 21 bp, Homo sapiens
tattttaattttaaagagtgt

SEQ ID NO: 5674105 - DNA, 23 bp, Homo sapiens
tattttacaattttttatcatgc

SEQ ID NO: 5674106 - DNA, 11 bp, Homo sapiens
tattttacaca

SEQ ID NO: 5674107 - DNA, 11 bp, Homo sapiens
tattttacatc

SEQ ID NO: 5674108 - DNA, 22 bp, Homo sapiens
tattttacatgaagctgtataa

SEQ ID NO: 5674109 - DNA, 20 bp, Homo sapiens
tattttactagaaatgggaa

SEQ ID NO: 5674110 - DNA, 17 bp, Homo sapiens
tattttactattggaat

SEQ ID NO: 5674111 - DNA, 16 bp, Homo sapiens
tattttactgtcttaa

SEQ ID NO: 5674112 - DNA, 18 bp, Homo sapiens
tattttacttctagagat

SEQ ID NO: 5674113 - DNA, 16 bp, Homo sapiens
tattttacttttacag

SEQ ID NO: 5674114 - DNA, 21 bp, Homo sapiens
tattttacttttctgccaaaa

SEQ ID NO: 5674115 - DNA, 14 bp, Homo sapiens
tattttactttttg

SEQ ID NO: 5674116 - DNA, 18 bp, Homo sapiens
tattttagaaagctaaat

SEQ ID NO: 5674117 - DNA, 16 bp, Homo sapiens
tattttagaataaatt

SEQ ID NO: 5674118 - DNA, 13 bp, Homo sapiens
tattttagacttt

SEQ ID NO: 5674119 - DNA, 15 bp, Homo sapiens
tattttagagaatgg

SEQ ID NO: 5674120 - DNA, 15 bp, Homo sapiens
tattttagattgcta

SEQ ID NO: 5674121 - DNA, 20 bp, Homo sapiens
tattttagcagttctgcaaa

SEQ ID NO: 5674122 - DNA, 18 bp, Homo sapiens
tattttaggcagggattt

SEQ ID NO: 5674123 - DNA, 19 bp, Homo sapiens
tattttagggttctaaatg

SEQ ID NO: 5674124 - DNA, 22 bp, Homo sapiens
tattttaggtgtaaaataatta

SEQ ID NO: 5674125 - DNA, 23 bp, Homo sapiens
tattttataatgttgtatttaat

SEQ ID NO: 5674126 - DNA, 22 bp, Homo sapiens
tattttataggggatacttgaa

SEQ ID NO: 5674127 - DNA, 21 bp, Homo sapiens
tattttatataataaagtatt

SEQ ID NO: 5674128 - DNA, 19 bp, Homo sapiens
tattttatatcatacagtt

SEQ ID NO: 5674129 - DNA, 15 bp, Homo sapiens
tattttatatgagag

SEQ ID NO: 5674130 - DNA, 20 bp, Homo sapiens
tattttatatgagagaatca

SEQ ID NO: 5674131 - DNA, 16 bp, Homo sapiens
tattttatatgttcat

SEQ ID NO: 5674132 - DNA, 21 bp, Homo sapiens
tattttatatgttcatattgg

SEQ ID NO: 5674133 - DNA, 15 bp, Homo sapiens
tattttatattaaaa

SEQ ID NO: 5674134 - DNA, 17 bp, Homo sapiens
tattttatattgttata

SEQ ID NO: 5674135 - DNA, 23 bp, Homo sapiens
tattttatatttaaaaattgttt

SEQ ID NO: 5674136 - DNA, 15 bp, Homo sapiens
tattttatatttgag

SEQ ID NO: 5674137 - DNA, 14 bp, Homo sapiens
tattttatcctgta

SEQ ID NO: 5674138 - DNA, 20 bp, Homo sapiens
tattttatctattggcctgt

SEQ ID NO: 5674139 - DNA, 23 bp, Homo sapiens
tattttatctttgattctccttc

SEQ ID NO: 5674140 - DNA, 10 bp, Homo sapiens
tattttatga

SEQ ID NO: 5674141 - DNA, 18 bp, Homo sapiens
tattttatgaacattgta

SEQ ID NO: 5674142 - DNA, 20 bp, Homo sapiens
tattttatgaacattgtact

SEQ ID NO: 5674143 - DNA, 14 bp, Homo sapiens
tattttatgagaaa

SEQ ID NO: 5674144 - DNA, 18 bp, Homo sapiens
tattttatgagaaatgta

SEQ ID NO: 5674145 - DNA, 13 bp, Homo sapiens
tattttatggtta

SEQ ID NO: 5674146 - DNA, 16 bp, Homo sapiens
tattttatggttatgt

SEQ ID NO: 5674147 - DNA, 14 bp, Homo sapiens
tattttatgtatgt

SEQ ID NO: 5674148 - DNA, 12 bp, Homo sapiens
tattttatgtta

SEQ ID NO: 5674149 - DNA, 21 bp, Homo sapiens
tattttatgttatatataaat

SEQ ID NO: 5674150 - DNA, 16 bp, Homo sapiens
tattttatgttgcata

SEQ ID NO: 5674151 - DNA, 20 bp, Homo sapiens
tattttattaaattaattga

SEQ ID NO: 5674152 - DNA, 19 bp, Homo sapiens
tattttattaattttctat

SEQ ID NO: 5674153 - DNA, 21 bp, Homo sapiens
tattttattaattttctatgt

SEQ ID NO: 5674154 - DNA, 20 bp, Homo sapiens
tattttattatcctagatta

SEQ ID NO: 5674155 - DNA, 13 bp, Homo sapiens
tattttattatga

SEQ ID NO: 5674156 - DNA, 18 bp, Homo sapiens
tattttattatgaaactt

SEQ ID NO: 5674157 - DNA, 15 bp, Homo sapiens
tattttattattcag

SEQ ID NO: 5674158 - DNA, 19 bp, Homo sapiens
tattttattctatgtatgt

SEQ ID NO: 5674159 - DNA, 19 bp, Homo sapiens
tattttattgaatactgtc

SEQ ID NO: 5674160 - DNA, 17 bp, Homo sapiens
tattttattgtaacaga

SEQ ID NO: 5674161 - DNA, 18 bp, Homo sapiens
tattttattgtaacagac

SEQ ID NO: 5674162 - DNA, 13 bp, Homo sapiens
tattttattgtct

SEQ ID NO: 5674163 - DNA, 15 bp, Homo sapiens
tattttattgtctaa

SEQ ID NO: 5674164 - DNA, 17 bp, Homo sapiens
tattttatttagacaag

SEQ ID NO: 5674165 - DNA, 20 bp, Homo sapiens
tattttatttagacaagaga

SEQ ID NO: 5674166 - DNA, 17 bp, Homo sapiens
tattttatttatttaat

SEQ ID NO: 5674167 - DNA, 13 bp, Homo sapiens
tattttatttgaa

SEQ ID NO: 5674168 - DNA, 16 bp, Homo sapiens
tattttatttgcttat

SEQ ID NO: 5674169 - DNA, 19 bp, Homo sapiens
tattttattttttttcaaa

SEQ ID NO: 5674170 - DNA, 16 bp, Homo sapiens
tattttcaaaaccagg

SEQ ID NO: 5674171 - DNA, 17 bp, Homo sapiens
tattttcaaaaccaggt

SEQ ID NO: 5674172 - DNA, 13 bp, Homo sapiens
tattttcaaaata

SEQ ID NO: 5674173 - DNA, 13 bp, Homo sapiens
tattttcaaagaa

SEQ ID NO: 5674174 - DNA, 15 bp, Homo sapiens
tattttcaaagagat

SEQ ID NO: 5674175 - DNA, 15 bp, Homo sapiens
tattttcaaaggaaa

SEQ ID NO: 5674176 - DNA, 18 bp, Homo sapiens
tattttcaaaggaaaaca

SEQ ID NO: 5674177 - DNA, 19 bp, Homo sapiens
tattttcaaatctggtcca

SEQ ID NO: 5674178 - DNA, 22 bp, Homo sapiens
tattttcaaattgtatctagtg

SEQ ID NO: 5674179 - DNA, 13 bp, Homo sapiens
tattttcaagaaa

SEQ ID NO: 5674180 - DNA, 16 bp, Homo sapiens
tattttcaagaaaaga

SEQ ID NO: 5674181 - DNA, 15 bp, Homo sapiens
tattttcaagcaaat

SEQ ID NO: 5674182 - DNA, 21 bp, Homo sapiens
tattttcaaggccctcagcat

SEQ ID NO: 5674183 - DNA, 13 bp, Homo sapiens
tattttcaagttt

SEQ ID NO: 5674184 - DNA, 14 bp, Homo sapiens
tattttcaagtttt

SEQ ID NO: 5674185 - DNA, 22 bp, Homo sapiens
tattttcaataaagaaaaaaat

SEQ ID NO: 5674186 - DNA, 23 bp, Homo sapiens
tattttcaatgaaacaaagaaag

SEQ ID NO: 5674187 - DNA, 16 bp, Homo sapiens
tattttcacaatgtca

SEQ ID NO: 5674188 - DNA, 13 bp, Homo sapiens
tattttcacagat

SEQ ID NO: 5674189 - DNA, 23 bp, Homo sapiens
tcaaacaaaaaagaaaagtagaa

SEQ ID NO: 5674190 - DNA, 16 bp, Homo sapiens
tcaaacaaagccagaa

SEQ ID NO: 5674191 - DNA, 17 bp, Homo sapiens
tcaaacaacactggtgt

SEQ ID NO: 5674192 - DNA, 18 bp, Homo sapiens
tcaaacaaccttcagctt

SEQ ID NO: 5674193 - DNA, 14 bp, Homo sapiens
tcaaacaagaatgt

SEQ ID NO: 5674194 - DNA, 14 bp, Homo sapiens
tcaaacaatgacaa

SEQ ID NO: 5674195 - DNA, 20 bp, Homo sapiens
tcaaacaatgacaaagcaga

SEQ ID NO: 5674196 - DNA, 15 bp, Homo sapiens
tcaaacacaaatgca

SEQ ID NO: 5674197 - DNA, 13 bp, Homo sapiens
tcaaacacaacac

SEQ ID NO: 5674198 - DNA, 12 bp, Homo sapiens
tcaaacacacac

SEQ ID NO: 5674199 - DNA, 17 bp, Homo sapiens
tcaaacacagttacact

SEQ ID NO: 5674200 - DNA, 12 bp, Homo sapiens
tcaaacactgca

SEQ ID NO: 5674201 - DNA, 14 bp, Homo sapiens
tcaaacactgcagg

SEQ ID NO: 5674202 - DNA, 18 bp, Homo sapiens
tcaaacacttgtgacttt

SEQ ID NO: 5674203 - DNA, 16 bp, Homo sapiens
tcaaacagaattttaa

SEQ ID NO: 5674204 - DNA, 19 bp, Homo sapiens
tcaaacagcatcaaaatac

SEQ ID NO: 5674205 - DNA, 23 bp, Homo sapiens
tcaaacagcatcaaaatacaact

SEQ ID NO: 5674206 - DNA, 20 bp, Homo sapiens
tcaaacagccacgaggtggt

SEQ ID NO: 5674207 - DNA, 22 bp, Homo sapiens
tcaaacagccccagtcttcctt

SEQ ID NO: 5674208 - DNA, 21 bp, Homo sapiens
tcaaacaggtcgagctgtgct

SEQ ID NO: 5674209 - DNA, 22 bp, Homo sapiens
tcaaacagtaatctaggtgtgg

SEQ ID NO: 5674210 - DNA, 22 bp, Homo sapiens
tcaaacagtctcaggaaatcaa

SEQ ID NO: 5674211 - DNA, 18 bp, Homo sapiens
tcaaacagtgccaaatgc

SEQ ID NO: 5674212 - DNA, 22 bp, Homo sapiens
tcaaacagtgccaaatgctggg

SEQ ID NO: 5674213 - DNA, 15 bp, Homo sapiens
tcaaacatgaaaaca

SEQ ID NO: 5674214 - DNA, 19 bp, Homo sapiens
tcaaacatgccctcaggct

SEQ ID NO: 5674215 - DNA, 18 bp, Homo sapiens
tcaaacatggaagatgaa

SEQ ID NO: 5674216 - DNA, 19 bp, Homo sapiens
tcaaacattagtactttat

SEQ ID NO: 5674217 - DNA, 22 bp, Homo sapiens
tcaaacattcgtgagctgggga

SEQ ID NO: 5674218 - DNA, 18 bp, Homo sapiens
tcaaacattgagactgct

SEQ ID NO: 5674219 - DNA, 13 bp, Homo sapiens
tcaaacattttct

SEQ ID NO: 5674220 - DNA, 18 bp, Homo sapiens
tcaaacattttgaaagtc

SEQ ID NO: 5674221 - DNA, 13 bp, Homo sapiens
tcaaaccaaagag

SEQ ID NO: 5674222 - DNA, 22 bp, Homo sapiens
tcaaaccaaagagtattcagtg

SEQ ID NO: 5674223 - DNA, 13 bp, Homo sapiens
tcaaaccaaagct

SEQ ID NO: 5674224 - DNA, 15 bp, Homo sapiens
tcaaaccaaagctgc

SEQ ID NO: 5674225 - DNA, 18 bp, Homo sapiens
tcaaaccaaagctgcctg

SEQ ID NO: 5674226 - DNA, 22 bp, Homo sapiens
tcaaaccaaagctgcctgtgcc

SEQ ID NO: 5674227 - DNA, 14 bp, Homo sapiens
tcaaaccaatttct

SEQ ID NO: 5674228 - DNA, 15 bp, Homo sapiens
tcaaaccaatttctt

SEQ ID NO: 5674229 - DNA, 20 bp, Homo sapiens
tcaaaccacttgcctggggc

SEQ ID NO: 5674230 - DNA, 22 bp, Homo sapiens
tcaaaccagtatacaagataag

SEQ ID NO: 5674231 - DNA, 23 bp, Homo sapiens
tcaaacccagagggttgctggtc

SEQ ID NO: 5674232 - DNA, 23 bp, Homo sapiens
tcaaaccccgaccacctgcccaa

SEQ ID NO: 5674233 - DNA, 14 bp, Homo sapiens
tcaaacccctgacc

SEQ ID NO: 5674234 - DNA, 17 bp, Homo sapiens
tcaaaccctagccttgc

SEQ ID NO: 5674235 - DNA, 18 bp, Homo sapiens
tcaaaccctagccttgct

SEQ ID NO: 5674236 - DNA, 19 bp, Homo sapiens
tcaaaccctccacttctcc

SEQ ID NO: 5674237 - DNA, 21 bp, Homo sapiens
tcaaaccctgtaagttacagt

SEQ ID NO: 5674238 - DNA, 20 bp, Homo sapiens
tcaaaccgtggtaccccccc

SEQ ID NO: 5674239 - DNA, 13 bp, Homo sapiens
tcaaacctccaaa

SEQ ID NO: 5674240 - DNA, 18 bp, Homo sapiens
tcaaacctgcaaggcaaa

SEQ ID NO: 5674241 - DNA, 21 bp, Homo sapiens
tcaaacctgtagatgcagaaa

SEQ ID NO: 5674242 - DNA, 13 bp, Homo sapiens
tcaaacctgtgaa

SEQ ID NO: 5674243 - DNA, 20 bp, Homo sapiens
tcaaaccttaagataatgga

SEQ ID NO: 5674244 - DNA, 17 bp, Homo sapiens
tcaaacctttctggcct

SEQ ID NO: 5674245 - DNA, 18 bp, Homo sapiens
tcaaacctttctggcctg

SEQ ID NO: 5674246 - DNA, 15 bp, Homo sapiens
tcaaacgtgaaaatg

SEQ ID NO: 5674247 - DNA, 13 bp, Homo sapiens
tcaaactaaaaga

SEQ ID NO: 5674248 - DNA, 17 bp, Homo sapiens
tcaaactacctatattc

SEQ ID NO: 5674249 - DNA, 17 bp, Homo sapiens
tcaaactaggaggaaaa

SEQ ID NO: 5674250 - DNA, 21 bp, Homo sapiens
tcaaactaggggacaaagcaa

SEQ ID NO: 5674251 - DNA, 17 bp, Homo sapiens
tcaaactatctggccat

SEQ ID NO: 5674252 - DNA, 16 bp, Homo sapiens
tcaaactcaatgcttt

SEQ ID NO: 5674253 - DNA, 23 bp, Homo sapiens
tcaaactcaatgctttatttgta

SEQ ID NO: 5674254 - DNA, 17 bp, Homo sapiens
tcaaactcattgcagca

SEQ ID NO: 5674255 - DNA, 20 bp, Homo sapiens
tcaaactcattgcagcagat

SEQ ID NO: 5674256 - DNA, 22 bp, Homo sapiens
tcaaactccaaggttcccttgt

SEQ ID NO: 5674257 - DNA, 21 bp, Homo sapiens
tcaaactcctgacctcaggca

SEQ ID NO: 5674258 - DNA, 14 bp, Homo sapiens
tcaaactcttaaaa

SEQ ID NO: 5674259 - DNA, 23 bp, Homo sapiens
tcaaactgaatgaaacccccaca

SEQ ID NO: 5674260 - DNA, 16 bp, Homo sapiens
tcaaactgaatttgtt

SEQ ID NO: 5674261 - DNA, 19 bp, Homo sapiens
tcaaactgaatttgttctt

SEQ ID NO: 5674262 - DNA, 19 bp, Homo sapiens
tcaaactgacaacctgtgc

SEQ ID NO: 5674263 - DNA, 15 bp, Homo sapiens
tcaaactgaggaatt

SEQ ID NO: 5674264 - DNA, 16 bp, Homo sapiens
tcaaactgctccaagt

SEQ ID NO: 5674265 - DNA, 23 bp, Homo sapiens
tcaaactgcttttgtagtgtgtt

SEQ ID NO: 5674266 - DNA, 19 bp, Homo sapiens
tcaaactggggcctccaga

SEQ ID NO: 5674267 - DNA, 20 bp, Homo sapiens
tcaaactggggcctccagaa

SEQ ID NO: 5674268 - DNA, 23 bp, Homo sapiens
tcaaactggggcctccagaactc

SEQ ID NO: 5674269 - DNA, 12 bp, Homo sapiens
tcaaactgtaaa

SEQ ID NO: 5674270 - DNA, 20 bp, Homo sapiens
tcaaactgtagaaatgatga

SEQ ID NO: 5674271 - DNA, 18 bp, Homo sapiens
tcaaactgtcttggctgt

SEQ ID NO: 5674272 - DNA, 15 bp, Homo sapiens
tcaaacttaaacaaa

SEQ ID NO: 5674273 - DNA, 15 bp, Homo sapiens
tcaaacttactattt

SEQ ID NO: 5674274 - DNA, 17 bp, Homo sapiens
tcaaacttactattttg

SEQ ID NO: 5674275 - DNA, 20 bp, Homo sapiens
tcaaacttctggctccctct

SEQ ID NO: 5674276 - DNA, 15 bp, Homo sapiens
tcaaacttgtgctga

SEQ ID NO: 5674277 - DNA, 22 bp, Homo sapiens
tcaaactttactctaagtctcc

SEQ ID NO: 5674278 - DNA, 16 bp, Homo sapiens
tcaaactttcactttg

SEQ ID NO: 5674279 - DNA, 15 bp, Homo sapiens
tcaaactttctgcct

SEQ ID NO: 5674280 - DNA, 17 bp, Homo sapiens
tcaaactttctgccttc

SEQ ID NO: 5674281 - DNA, 16 bp, Homo sapiens
tcaaagaaaaacaatg

SEQ ID NO: 5674282 - DNA, 17 bp, Homo sapiens
tcaaagaaaagactttt

SEQ ID NO: 5674283 - DNA, 14 bp, Homo sapiens
tcaaagaaaataga

SEQ ID NO: 5674284 - DNA, 16 bp, Homo sapiens
tcaaagaaacttgaag

SEQ ID NO: 5674285 - DNA, 21 bp, Homo sapiens
tcaaagaaagaaagtttagaa

SEQ ID NO: 5674286 - DNA, 22 bp, Homo sapiens
tcaaagaaagaaagtttagaag

SEQ ID NO: 5674287 - DNA, 12 bp, Homo sapiens
tcaaagaaagtg

SEQ ID NO: 5674288 - DNA, 14 bp, Homo sapiens
tcaaagaaatatct

SEQ ID NO: 5674289 - DNA, 12 bp, Homo sapiens
tcaaagaaatcc

SEQ ID NO: 5674290 - DNA, 13 bp, Homo sapiens
tcaaagaaatcct

SEQ ID NO: 5674291 - DNA, 19 bp, Homo sapiens
tcaaagaaatgctgatgga

SEQ ID NO: 5674292 - DNA, 18 bp, Homo sapiens
tcaaagaaattcagaaca

SEQ ID NO: 5674293 - DNA, 15 bp, Homo sapiens
tcaaagaacaaacat

SEQ ID NO: 5674294 - DNA, 15 bp, Homo sapiens
tcaaagaacagatgg

SEQ ID NO: 5674295 - DNA, 15 bp, Homo sapiens
tcaaagaacccccct

SEQ ID NO: 5674296 - DNA, 19 bp, Homo sapiens
tcaaagaagagtcaacatt

SEQ ID NO: 5674297 - DNA, 14 bp, Homo sapiens
tcaaagaaggcatt

SEQ ID NO: 5674298 - DNA, 18 bp, Homo sapiens
tcaaagaaggtgctgatc

SEQ ID NO: 5674299 - DNA, 22 bp, Homo sapiens
tcaaagaaggtgctgatcctaa

SEQ ID NO: 5674300 - DNA, 20 bp, Homo sapiens
tcaaagaagtactttattgc

SEQ ID NO: 5674301 - DNA, 15 bp, Homo sapiens
tcaaagaagtcggaa

SEQ ID NO: 5674302 - DNA, 12 bp, Homo sapiens
tcaaagaattac

SEQ ID NO: 5674303 - DNA, 18 bp, Homo sapiens
tcaaagaattacagtaca

SEQ ID NO: 5674304 - DNA, 17 bp, Homo sapiens
tcaaagacaatggaaac

SEQ ID NO: 5674305 - DNA, 14 bp, Homo sapiens
tcaaagacacacag

SEQ ID NO: 5674306 - DNA, 16 bp, Homo sapiens
tcaaagacagaatggt

SEQ ID NO: 5674307 - DNA, 23 bp, Homo sapiens
tcaaagaccccatggtccatccc

SEQ ID NO: 5674308 - DNA, 21 bp, Homo sapiens
tcaaagacctggggctgctgt

SEQ ID NO: 5674309 - DNA, 21 bp, Homo sapiens
tcaaagaccttgtgtgtatgt

SEQ ID NO: 5674310 - DNA, 14 bp, Homo sapiens
tcaaagagaagatg

SEQ ID NO: 5674311 - DNA, 15 bp, Homo sapiens
tcaaagagaagatgc

SEQ ID NO: 5674312 - DNA, 23 bp, Homo sapiens
tcaaagagaagatgcctgttaat

SEQ ID NO: 5674313 - DNA, 20 bp, Homo sapiens
tcaaagagagaaaataaaga

SEQ ID NO: 5674314 - DNA, 21 bp, Homo sapiens
tcaaagaggcacagagccaaa

SEQ ID NO: 5674315 - DNA, 19 bp, Homo sapiens
tcaaagaggccagtacttt

SEQ ID NO: 5674316 - DNA, 20 bp, Homo sapiens
tcaaagagggggctctgccc

SEQ ID NO: 5674317 - DNA, 21 bp, Homo sapiens
tcaaagagggtgagggccttc

SEQ ID NO: 5674318 - DNA, 18 bp, Homo sapiens
tcaaagaggtaactgagg

SEQ ID NO: 5674319 - DNA, 21 bp, Homo sapiens
tcaaagaggtgaacattaaaa

SEQ ID NO: 5674320 - DNA, 23 bp, Homo sapiens
tcaaagaggttttaaaaaaatcc

SEQ ID NO: 5674321 - DNA, 16 bp, Homo sapiens
tcaaagagtaaaacat

SEQ ID NO: 5674322 - DNA, 15 bp, Homo sapiens
tcaaagagtctgtct

SEQ ID NO: 5674323 - DNA, 18 bp, Homo sapiens
tcaaagataaatgaaata

SEQ ID NO: 5674324 - DNA, 22 bp, Homo sapiens
tcaaagatattttgctttgtga

SEQ ID NO: 5674325 - DNA, 22 bp, Homo sapiens
tcaaagatgcattttgagtgtt

SEQ ID NO: 5674326 - DNA, 15 bp, Homo sapiens
tcaaagatgtactga

SEQ ID NO: 5674327 - DNA, 16 bp, Homo sapiens
tcaaagatgtactgag

SEQ ID NO: 5674328 - DNA, 17 bp, Homo sapiens
tcaaagatgtactgaga

SEQ ID NO: 5674329 - DNA, 13 bp, Homo sapiens
tcaaagcaagcat

SEQ ID NO: 5674330 - DNA, 15 bp, Homo sapiens
tcaaagcaagcattc

SEQ ID NO: 5674331 - DNA, 21 bp, Homo sapiens
tcaaagcaagcattcagaaga

SEQ ID NO: 5674332 - DNA, 22 bp, Homo sapiens
tcaaagcaagcattcagaagaa

SEQ ID NO: 5674333 - DNA, 17 bp, Homo sapiens
tcaaagcaagggctcca

SEQ ID NO: 5674334 - DNA, 16 bp, Homo sapiens
tcaaagcaatgcattt

SEQ ID NO: 5674335 - DNA, 17 bp, Homo sapiens
tcaaagcaatgcatttt

SEQ ID NO: 5674336 - DNA, 18 bp, Homo sapiens
tcaaagcaatgcattttg

SEQ ID NO: 5674337 - DNA, 19 bp, Homo sapiens
tcaaagcaatgcattttgg

SEQ ID NO: 5674338 - DNA, 21 bp, Homo sapiens
tcaaagcaattgaaatgcatt

SEQ ID NO: 5674339 - DNA, 23 bp, Homo sapiens
tcaaagcacctgaaccactgtgg

SEQ ID NO: 5674340 - DNA, 21 bp, Homo sapiens
tcaaagcagaagtctggcttt

SEQ ID NO: 5674341 - DNA, 16 bp, Homo sapiens
tcaaagcagcagccac

SEQ ID NO: 5674342 - DNA, 13 bp, Homo sapiens
tcaaagcatcaaa

SEQ ID NO: 5674343 - DNA, 15 bp, Homo sapiens
tcaaagcatcaaata

SEQ ID NO: 5674344 - DNA, 19 bp, Homo sapiens
tcaaagcatcaaataatac

SEQ ID NO: 5674345 - DNA, 20 bp, Homo sapiens
tcaaagcatgggattattag

SEQ ID NO: 5674346 - DNA, 15 bp, Homo sapiens
tcaaagccacactct

SEQ ID NO: 5674347 - DNA, 21 bp, Homo sapiens
tcaaagccacattatttctag

SEQ ID NO: 5674348 - DNA, 21 bp, Homo sapiens
tcaaagccatatggacactgt

SEQ ID NO: 5674349 - DNA, 22 bp, Homo sapiens
tcaaagcccaaactcctttctt

SEQ ID NO: 5674350 - DNA, 22 bp, Homo sapiens
tcaaagcccccacttctctcca

SEQ ID NO: 5674351 - DNA, 23 bp, Homo sapiens
tcaaagcccccacttctctccag

SEQ ID NO: 5674352 - DNA, 18 bp, Homo sapiens
tcaaagccctgcctctgt

SEQ ID NO: 5674353 - DNA, 21 bp, Homo sapiens
tcaaagccctgcctctgtgta

SEQ ID NO: 5674354 - DNA, 17 bp, Homo sapiens
tcaaagccggttgcaga

SEQ ID NO: 5674355 - DNA, 22 bp, Homo sapiens
tcaaagctaaaatatataatat

SEQ ID NO: 5674356 - DNA, 13 bp, Homo sapiens
tcaaagctacctt

SEQ ID NO: 5674357 - DNA, 21 bp, Homo sapiens
tcaaagctaggaaaggcagaa

SEQ ID NO: 5674358 - DNA, 22 bp, Homo sapiens
tcaaagctccttaaagttctgg

SEQ ID NO: 5674359 - DNA, 20 bp, Homo sapiens
tcaaagctgaatatttttta

SEQ ID NO: 5674360 - DNA, 19 bp, Homo sapiens
tcaaagctgtgtgtttgga

SEQ ID NO: 5674361 - DNA, 20 bp, Homo sapiens
tcaaagcttgaagatcgtta

SEQ ID NO: 5674362 - DNA, 20 bp, Homo sapiens
tcaaagctttcctgtttcca

SEQ ID NO: 5674363 - DNA, 17 bp, Homo sapiens
tcaaaggagctttctca

SEQ ID NO: 5674364 - DNA, 17 bp, Homo sapiens
tggatacgtgtcaatgt

SEQ ID NO: 5674365 - DNA, 20 bp, Homo sapiens
tggatactccatggggtggg

SEQ ID NO: 5674366 - DNA, 22 bp, Homo sapiens
tggatactgcccggggcagctg

SEQ ID NO: 5674367 - DNA, 13 bp, Homo sapiens
tggatactggaca

SEQ ID NO: 5674368 - DNA, 14 bp, Homo sapiens
tggatactggacac

SEQ ID NO: 5674369 - DNA, 17 bp, Homo sapiens
tggatactggggggcag

SEQ ID NO: 5674370 - DNA, 23 bp, Homo sapiens
tggatagaacatgggatacttta

SEQ ID NO: 5674371 - DNA, 18 bp, Homo sapiens
tggatagacttgggatgg

SEQ ID NO: 5674372 - DNA, 22 bp, Homo sapiens
tggatagacttgggatggggag

SEQ ID NO: 5674373 - DNA, 18 bp, Homo sapiens
tggatagagcagcctgct

SEQ ID NO: 5674374 - DNA, 13 bp, Homo sapiens
tggatagcatgtc

SEQ ID NO: 5674375 - DNA, 17 bp, Homo sapiens
tggatagccttgaaaac

SEQ ID NO: 5674376 - DNA, 18 bp, Homo sapiens
tggatagccttgaaaaca

SEQ ID NO: 5674377 - DNA, 19 bp, Homo sapiens
tggatagccttgaaaacaa

SEQ ID NO: 5674378 - DNA, 21 bp, Homo sapiens
tggatagccttgaaaacaaac

SEQ ID NO: 5674379 - DNA, 16 bp, Homo sapiens
tggataggagcctgct

SEQ ID NO: 5674380 - DNA, 18 bp, Homo sapiens
tggataggagcttccaga

SEQ ID NO: 5674381 - DNA, 19 bp, Homo sapiens
tggataggagcttccagat

SEQ ID NO: 5674382 - DNA, 22 bp, Homo sapiens
tggataggtcgggtgttaaagt

SEQ ID NO: 5674383 - DNA, 14 bp, Homo sapiens
tggatataaatata

SEQ ID NO: 5674384 - DNA, 12 bp, Homo sapiens
tggatataaatc

SEQ ID NO: 5674385 - DNA, 15 bp, Homo sapiens
tggatataaatctta

SEQ ID NO: 5674386 - DNA, 17 bp, Homo sapiens
tggatataatctgaatc

SEQ ID NO: 5674387 - DNA, 14 bp, Homo sapiens
tggatataatgtat

SEQ ID NO: 5674388 - DNA, 17 bp, Homo sapiens
tggatatagttttactt

SEQ ID NO: 5674389 - DNA, 18 bp, Homo sapiens
tggatatatgtttttgaa

SEQ ID NO: 5674390 - DNA, 13 bp, Homo sapiens
tggatatatttaa

SEQ ID NO: 5674391 - DNA, 13 bp, Homo sapiens
tggatatcaaggt

SEQ ID NO: 5674392 - DNA, 19 bp, Homo sapiens
tggatatcagggtataaat

SEQ ID NO: 5674393 - DNA, 19 bp, Homo sapiens
tggatatcgtcattttgca

SEQ ID NO: 5674394 - DNA, 12 bp, Homo sapiens
tggatatgaccc

SEQ ID NO: 5674395 - DNA, 19 bp, Homo sapiens
tggatatgacccacactgc

SEQ ID NO: 5674396 - DNA, 14 bp, Homo sapiens
tggatatgctgctt

SEQ ID NO: 5674397 - DNA, 21 bp, Homo sapiens
tggatatgtaaaacatttatt

SEQ ID NO: 5674398 - DNA, 19 bp, Homo sapiens
tggatatgttgttaaacac

SEQ ID NO: 5674399 - DNA, 17 bp, Homo sapiens
tggatattattagaaat

SEQ ID NO: 5674400 - DNA, 18 bp, Homo sapiens
tggatatttcaatctttt

SEQ ID NO: 5674401 - DNA, 19 bp, Homo sapiens
tggatatttcaatctttta

SEQ ID NO: 5674402 - DNA, 13 bp, Homo sapiens
tggatatttgcac

SEQ ID NO: 5674403 - DNA, 20 bp, Homo sapiens
tggatatttgcacttatgta

SEQ ID NO: 5674404 - DNA, 11 bp, Homo sapiens
tggatatttgt

SEQ ID NO: 5674405 - DNA, 21 bp, Homo sapiens
tggatatttgtactgtttaat

SEQ ID NO: 5674406 - DNA, 18 bp, Homo sapiens
tggatattttcaaattgt

SEQ ID NO: 5674407 - DNA, 15 bp, Homo sapiens
tggatatttttgtac

SEQ ID NO: 5674408 - DNA, 18 bp, Homo sapiens
tggatatttttgtacttg

SEQ ID NO: 5674409 - DNA, 22 bp, Homo sapiens
tggatcaaaatctgtagagcag

SEQ ID NO: 5674410 - DNA, 24 bp, Homo sapiens
tggatcaaaatctgtagagcaggg

SEQ ID NO: 5674411 - DNA, 19 bp, Homo sapiens
tggatcaaatccagcctgc

SEQ ID NO: 5674412 - DNA, 12 bp, Homo sapiens
tggatcaagctt

SEQ ID NO: 5674413 - DNA, 18 bp, Homo sapiens
tggatcaagcttgtgtac

SEQ ID NO: 5674414 - DNA, 14 bp, Homo sapiens
tggatcacaaagtg

SEQ ID NO: 5674415 - DNA, 15 bp, Homo sapiens
tggatcacaaagtgg

SEQ ID NO: 5674416 - DNA, 20 bp, Homo sapiens
tggatcacacctcagtggga

SEQ ID NO: 5674417 - DNA, 22 bp, Homo sapiens
tggatcacacctcagtgggaag

SEQ ID NO: 5674418 - DNA, 23 bp, Homo sapiens
tggatcacagaggcttcttcaga

SEQ ID NO: 5674419 - DNA, 15 bp, Homo sapiens
tggatcacagctgct

SEQ ID NO: 5674420 - DNA, 20 bp, Homo sapiens
tggatcacagctgctttctg

SEQ ID NO: 5674421 - DNA, 20 bp, Homo sapiens
tggatcagagcatttatttt

SEQ ID NO: 5674422 - DNA, 16 bp, Homo sapiens
tggatcagatgaactc

SEQ ID NO: 5674423 - DNA, 12 bp, Homo sapiens
tggatcaggaaa

SEQ ID NO: 5674424 - DNA, 17 bp, Homo sapiens
tggatcatagaattgca

SEQ ID NO: 5674425 - DNA, 15 bp, Homo sapiens
tggatccacgtgctc

SEQ ID NO: 5674426 - DNA, 22 bp, Homo sapiens
tggatccacgtgctcgcctctg

SEQ ID NO: 5674427 - DNA, 20 bp, Homo sapiens
tggatccatccgtccagcca

SEQ ID NO: 5674428 - DNA, 18 bp, Homo sapiens
tggatcccaaagcaagga

SEQ ID NO: 5674429 - DNA, 17 bp, Homo sapiens
tggatcccaattcattt

SEQ ID NO: 5674430 - DNA, 23 bp, Homo sapiens
tggatcccctctgtctacaaata

SEQ ID NO: 5674431 - DNA, 19 bp, Homo sapiens
tggatccctgcccttctca

SEQ ID NO: 5674432 - DNA, 20 bp, Homo sapiens
tggatccctgcccttctcaa

SEQ ID NO: 5674433 - DNA, 13 bp, Homo sapiens
tggatccgtttga

SEQ ID NO: 5674434 - DNA, 19 bp, Homo sapiens
tggatccgtttgaccaatt

SEQ ID NO: 5674435 - DNA, 23 bp, Homo sapiens
tggatcctagccttatcctctga

SEQ ID NO: 5674436 - DNA, 13 bp, Homo sapiens
tggatcctgctgc

SEQ ID NO: 5674437 - DNA, 22 bp, Homo sapiens
tggatcctgctgctttgggctg

SEQ ID NO: 5674438 - DNA, 23 bp, Homo sapiens
tggatcctgctgctttgggctgg

SEQ ID NO: 5674439 - DNA, 19 bp, Homo sapiens
tggatcctgggctgggtgg

SEQ ID NO: 5674440 - DNA, 22 bp, Homo sapiens
tggatcgagtgtagctgtgaaa

SEQ ID NO: 5674441 - DNA, 18 bp, Homo sapiens
tggatcgctaagctggct

SEQ ID NO: 5674442 - DNA, 23 bp, Homo sapiens
tggatcgctgcacatggcctgag

SEQ ID NO: 5674443 - DNA, 23 bp, Homo sapiens
tggatcgtggaagaagggccacc

SEQ ID NO: 5674444 - DNA, 16 bp, Homo sapiens
tggatctaaataatac

SEQ ID NO: 5674445 - DNA, 21 bp, Homo sapiens
tggatctaaatggaagcatct

SEQ ID NO: 5674446 - DNA, 15 bp, Homo sapiens
tggatctacctggag

SEQ ID NO: 5674447 - DNA, 17 bp, Homo sapiens
tggatctacctggaggg

SEQ ID NO: 5674448 - DNA, 14 bp, Homo sapiens
tggatctagaaggg

SEQ ID NO: 5674449 - DNA, 16 bp, Homo sapiens
tggatctatcacctgt

SEQ ID NO: 5674450 - DNA, 14 bp, Homo sapiens
tggatctatttcat

SEQ ID NO: 5674451 - DNA, 14 bp, Homo sapiens
tggatctccaagga

SEQ ID NO: 5674452 - DNA, 21 bp, Homo sapiens
tggatctccaaggaccaggtt

SEQ ID NO: 5674453 - DNA, 19 bp, Homo sapiens
tggatctccccactctagg

SEQ ID NO: 5674454 - DNA, 16 bp, Homo sapiens
tggatctccccctcat

SEQ ID NO: 5674455 - DNA, 13 bp, Homo sapiens
tggatctcctgac

SEQ ID NO: 5674456 - DNA, 18 bp, Homo sapiens
tggatctcctgctgcctt

SEQ ID NO: 5674457 - DNA, 13 bp, Homo sapiens
tggatctccttcc

SEQ ID NO: 5674458 - DNA, 15 bp, Homo sapiens
tggatctccttccct

SEQ ID NO: 5674459 - DNA, 19 bp, Homo sapiens
tggatctcttcttaatgta

SEQ ID NO: 5674460 - DNA, 21 bp, Homo sapiens
tggatctcttcttaatgtaca

SEQ ID NO: 5674461 - DNA, 22 bp, Homo sapiens
tggatctcttcttaatgtacat

SEQ ID NO: 5674462 - DNA, 23 bp, Homo sapiens
tggatctcttcttaatgtacata

SEQ ID NO: 5674463 - DNA, 23 bp, Homo sapiens
tggatctgaggaggctttggtaa

SEQ ID NO: 5674464 - DNA, 19 bp, Homo sapiens
tggatctgatctgtaccat

SEQ ID NO: 5674465 - DNA, 14 bp, Homo sapiens
tggatctgcaggtg

SEQ ID NO: 5674466 - DNA, 15 bp, Homo sapiens
tggatctgctccatg

SEQ ID NO: 5674467 - DNA, 16 bp, Homo sapiens
tggatctgctccatgc

SEQ ID NO: 5674468 - DNA, 19 bp, Homo sapiens
tggatctgggaccctttcc

SEQ ID NO: 5674469 - DNA, 21 bp, Homo sapiens
tggatctgggaccctttcctt

SEQ ID NO: 5674470 - DNA, 16 bp, Homo sapiens
tggatctgtccaagga

SEQ ID NO: 5674471 - DNA, 20 bp, Homo sapiens
tggatctgtccaaggaaact

SEQ ID NO: 5674472 - DNA, 15 bp, Homo sapiens
tggatctgtgagggg

SEQ ID NO: 5674473 - DNA, 19 bp, Homo sapiens
tggatctgtgaggggctct

SEQ ID NO: 5674474 - DNA, 18 bp, Homo sapiens
tggatcttcaatggcttt

SEQ ID NO: 5674475 - DNA, 19 bp, Homo sapiens
tggatcttcagaactgccc

SEQ ID NO: 5674476 - DNA, 21 bp, Homo sapiens
tggatcttcagaactgccctt

SEQ ID NO: 5674477 - DNA, 19 bp, Homo sapiens
tggatcttgaatgtggtct

SEQ ID NO: 5674478 - DNA, 21 bp, Homo sapiens
tggatcttgatgtaaggatgg

SEQ ID NO: 5674479 - DNA, 15 bp, Homo sapiens
tggatcttgccacat

SEQ ID NO: 5674480 - DNA, 15 bp, Homo sapiens
tggatcttgcctaaa

SEQ ID NO: 5674481 - DNA, 17 bp, Homo sapiens
tggatcttgctggagaa

SEQ ID NO: 5674482 - DNA, 23 bp, Homo sapiens
tggatctttctccctttctcctc

SEQ ID NO: 5674483 - DNA, 18 bp, Homo sapiens
tggatctttggggtaaaa

SEQ ID NO: 5674484 - DNA, 16 bp, Homo sapiens
tggatcttttcattct

SEQ ID NO: 5674485 - DNA, 20 bp, Homo sapiens
tggatgaaaaatatttctga

SEQ ID NO: 5674486 - DNA, 14 bp, Homo sapiens
tggatgaaattttc

SEQ ID NO: 5674487 - DNA, 17 bp, Homo sapiens
tggatgaaattttctag

SEQ ID NO: 5674488 - DNA, 20 bp, Homo sapiens
tggatgaatctggacatttg

SEQ ID NO: 5674489 - DNA, 15 bp, Homo sapiens
tggatgacacattta

SEQ ID NO: 5674490 - DNA, 20 bp, Homo sapiens
tggatgacacatttaatgaa

SEQ ID NO: 5674491 - DNA, 16 bp, Homo sapiens
tggatgacagggcaga

SEQ ID NO: 5674492 - DNA, 13 bp, Homo sapiens
tggatgagctccc

SEQ ID NO: 5674493 - DNA, 17 bp, Homo sapiens
tggatgaggcacttctg

SEQ ID NO: 5674494 - DNA, 19 bp, Homo sapiens
tggatgaggcttcttcctg

SEQ ID NO: 5674495 - DNA, 20 bp, Homo sapiens
tggatgaggcttcttcctgg

SEQ ID NO: 5674496 - DNA, 23 bp, Homo sapiens
tggatgagggccaccaggaagca

SEQ ID NO: 5674497 - DNA, 18 bp, Homo sapiens
tggatgagtaaactgttt

SEQ ID NO: 5674498 - DNA, 20 bp, Homo sapiens
tggatgatactaataaacta

SEQ ID NO: 5674499 - DNA, 16 bp, Homo sapiens
tggatgatgctgtgct

SEQ ID NO: 5674500 - DNA, 20 bp, Homo sapiens
tggatgatggtcttcagcct

SEQ ID NO: 5674501 - DNA, 14 bp, Homo sapiens
tggatgattaaatt

SEQ ID NO: 5674502 - DNA, 15 bp, Homo sapiens
tggatgattaaattt

SEQ ID NO: 5674503 - DNA, 15 bp, Homo sapiens
tggatgattcttcca

SEQ ID NO: 5674504 - DNA, 17 bp, Homo sapiens
tggatgatttcatcttc

SEQ ID NO: 5674505 - DNA, 21 bp, Homo sapiens
tggatgatttcatcttctgga

SEQ ID NO: 5674506 - DNA, 20 bp, Homo sapiens
tggatgcaaagtacaatgtg

SEQ ID NO: 5674507 - DNA, 15 bp, Homo sapiens
tggatgcagaaatga

SEQ ID NO: 5674508 - DNA, 14 bp, Homo sapiens
tggatgcagtgctc

SEQ ID NO: 5674509 - DNA, 23 bp, Homo sapiens
tggatgcagtgctcgctgttgct

SEQ ID NO: 5674510 - DNA, 19 bp, Homo sapiens
tggatgcatgccctaagag

SEQ ID NO: 5674511 - DNA, 16 bp, Homo sapiens
tggatgcatttcaaat

SEQ ID NO: 5674512 - DNA, 20 bp, Homo sapiens
tggatgcatttcaaatgtta

SEQ ID NO: 5674513 - DNA, 20 bp, Homo sapiens
tggatgccacagcccagctt

SEQ ID NO: 5674514 - DNA, 16 bp, Homo sapiens
tggatgccagctgtgt

SEQ ID NO: 5674515 - DNA, 22 bp, Homo sapiens
tggatgccagggccgaccagag

SEQ ID NO: 5674516 - DNA, 20 bp, Homo sapiens
tggatgcctcattatgtcaa

SEQ ID NO: 5674517 - DNA, 14 bp, Homo sapiens
tggatgcctggtgg

SEQ ID NO: 5674518 - DNA, 23 bp, Homo sapiens
tggatgcctggtggcagctgcgg

SEQ ID NO: 5674519 - DNA, 19 bp, Homo sapiens
tggatgcgagcttggcctt

SEQ ID NO: 5674520 - DNA, 23 bp, Homo sapiens
tggatgcgaggaccactttggag

SEQ ID NO: 5674521 - DNA, 23 bp, Homo sapiens
tggatgcggaacccaaattacgt

SEQ ID NO: 5674522 - DNA, 16 bp, Homo sapiens
tggatgctccagggca

SEQ ID NO: 5674523 - DNA, 23 bp, Homo sapiens
tggatgctctttcaatgcagcac

SEQ ID NO: 5674524 - DNA, 13 bp, Homo sapiens
tggatgctgagct

SEQ ID NO: 5674525 - DNA, 15 bp, Homo sapiens
tggatgctgagctgt

SEQ ID NO: 5674526 - DNA, 23 bp, Homo sapiens
tggatgctgtgctacgtgtgaaa

SEQ ID NO: 5674527 - DNA, 18 bp, Homo sapiens
tggatgcttacagtgact

SEQ ID NO: 5674528 - DNA, 18 bp, Homo sapiens
tggatggaaatatgttct

SEQ ID NO: 5674529 - DNA, 19 bp, Homo sapiens
tggatggaaatatgttcta

SEQ ID NO: 5674530 - DNA, 14 bp, Homo sapiens
tggatggaaatgta

SEQ ID NO: 5674531 - DNA, 16 bp, Homo sapiens
tggatggaacatgccc

SEQ ID NO: 5674532 - DNA, 23 bp, Homo sapiens
tggatggaacgggcatgggcctc

SEQ ID NO: 5674533 - DNA, 15 bp, Homo sapiens
tggatggaaggggct

SEQ ID NO: 5674534 - DNA, 20 bp, Homo sapiens
tggatggaaggttggatgga

SEQ ID NO: 5674535 - DNA, 14 bp, Homo sapiens
tggatggacagaca

SEQ ID NO: 5674536 - DNA, 15 bp, Homo sapiens
tggatggacagacac

SEQ ID NO: 5674537 - DNA, 15 bp, Homo sapiens
tggatggacagatgg

SEQ ID NO: 5674538 - DNA, 18 bp, Homo sapiens
tggatggacagatggacc

SEQ ID NO: 5674539 - DNA, 20 bp, Homo sapiens
tggatggacttgtatagtga

SEQ ID NO: 5674540 - DNA, 24 bp, Homo sapiens
tggcaccgaagcccagagggtctg

SEQ ID NO: 5674541 - DNA, 16 bp, Homo sapiens
tggcaccgccttctct

SEQ ID NO: 5674542 - DNA, 13 bp, Homo sapiens
tggcacctcctga

SEQ ID NO: 5674543 - DNA, 18 bp, Homo sapiens
tggcacctcctgagaagg

SEQ ID NO: 5674544 - DNA, 11 bp, Homo sapiens
tggcacctgca

SEQ ID NO: 5674545 - DNA, 22 bp, Homo sapiens
tggcacctgcacactccatctc

SEQ ID NO: 5674546 - DNA, 20 bp, Homo sapiens
tggcacctgcagcggctgcc

SEQ ID NO: 5674547 - DNA, 13 bp, Homo sapiens
tggcacctgccta

SEQ ID NO: 5674548 - DNA, 18 bp, Homo sapiens
tggcacctgcctagctct

SEQ ID NO: 5674549 - DNA, 22 bp, Homo sapiens
tggcacctgcctagctcttggg

SEQ ID NO: 5674550 - DNA, 12 bp, Homo sapiens
tggcacctggcg

SEQ ID NO: 5674551 - DNA, 12 bp, Homo sapiens
tggcacctgtat

SEQ ID NO: 5674552 - DNA, 13 bp, Homo sapiens
tggcacctgtata

SEQ ID NO: 5674553 - DNA, 23 bp, Homo sapiens
tggcacctgtctgctccagctct

SEQ ID NO: 5674554 - DNA, 13 bp, Homo sapiens
tggcacctgtggc

SEQ ID NO: 5674555 - DNA, 18 bp, Homo sapiens
tggcacctgtggccagag

SEQ ID NO: 5674556 - DNA, 13 bp, Homo sapiens
tggcaccttcccc

SEQ ID NO: 5674557 - DNA, 21 bp, Homo sapiens
tggcaccttccccctccccca

SEQ ID NO: 5674558 - DNA, 19 bp, Homo sapiens
tggcacctttgagagaggg

SEQ ID NO: 5674559 - DNA, 18 bp, Homo sapiens
tggcacgaaatggctgaa

SEQ ID NO: 5674560 - DNA, 14 bp, Homo sapiens
tggcacgcacctgt

SEQ ID NO: 5674561 - DNA, 15 bp, Homo sapiens
tggcacgcacctgta

SEQ ID NO: 5674562 - DNA, 18 bp, Homo sapiens
tggcacgcatctgtagtt

SEQ ID NO: 5674563 - DNA, 15 bp, Homo sapiens
tggcacgccctactc

SEQ ID NO: 5674564 - DNA, 20 bp, Homo sapiens
tggcacgccctactccactg

SEQ ID NO: 5674565 - DNA, 17 bp, Homo sapiens
tggcacgggccctccct

SEQ ID NO: 5674566 - DNA, 20 bp, Homo sapiens
tggcacgggccctccctccc

SEQ ID NO: 5674567 - DNA, 15 bp, Homo sapiens
tggcacgtgacaggc

SEQ ID NO: 5674568 - DNA, 20 bp, Homo sapiens
tggcacgtggccaggagcca

SEQ ID NO: 5674569 - DNA, 15 bp, Homo sapiens
tggcacgttgaccca

SEQ ID NO: 5674570 - DNA, 12 bp, Homo sapiens
tggcactaaaat

SEQ ID NO: 5674571 - DNA, 17 bp, Homo sapiens
tggcactaaaatgttta

SEQ ID NO: 5674572 - DNA, 19 bp, Homo sapiens
tggcactaaaatgtttaat

SEQ ID NO: 5674573 - DNA, 20 bp, Homo sapiens
tggcactaaaccacttctct

SEQ ID NO: 5674574 - DNA, 22 bp, Homo sapiens
tggcactaaaccacttctctgc

SEQ ID NO: 5674575 - DNA, 15 bp, Homo sapiens
tggcactagggatca

SEQ ID NO: 5674576 - DNA, 16 bp, Homo sapiens
tggcactataatgtaa

SEQ ID NO: 5674577 - DNA, 23 bp, Homo sapiens
tggcactcaactctgagcccata

SEQ ID NO: 5674578 - DNA, 14 bp, Homo sapiens
tggcactcccctga

SEQ ID NO: 5674579 - DNA, 22 bp, Homo sapiens
tggcactccctaaccaaatgct

SEQ ID NO: 5674580 - DNA, 16 bp, Homo sapiens
tggcactccctccagc

SEQ ID NO: 5674581 - DNA, 17 bp, Homo sapiens
tggcactctgttgtatt

SEQ ID NO: 5674582 - DNA, 23 bp, Homo sapiens
tggcactgaagtggccctccctc

SEQ ID NO: 5674583 - DNA, 15 bp, Homo sapiens
tggcactgacagcct

SEQ ID NO: 5674584 - DNA, 17 bp, Homo sapiens
tggcactgacagcctgg

SEQ ID NO: 5674585 - DNA, 19 bp, Homo sapiens
tggcactgacagcctgggg

SEQ ID NO: 5674586 - DNA, 22 bp, Homo sapiens
tggcactgagatttaaatgcaa

SEQ ID NO: 5674587 - DNA, 16 bp, Homo sapiens
tggcactgagcccccc

SEQ ID NO: 5674588 - DNA, 10 bp, Homo sapiens
tggcactgat

SEQ ID NO: 5674589 - DNA, 13 bp, Homo sapiens
tggcactgcaggt

SEQ ID NO: 5674590 - DNA, 23 bp, Homo sapiens
tggcactgcaggtggcctccctc

SEQ ID NO: 5674591 - DNA, 15 bp, Homo sapiens
tggcactgccaccag

SEQ ID NO: 5674592 - DNA, 14 bp, Homo sapiens
tggcactgcttcca

SEQ ID NO: 5674593 - DNA, 22 bp, Homo sapiens
tggcactgcttgaggaggggca

SEQ ID NO: 5674594 - DNA, 18 bp, Homo sapiens
tggcactggaccccagca

SEQ ID NO: 5674595 - DNA, 13 bp, Homo sapiens
tggcactggatgc

SEQ ID NO: 5674596 - DNA, 15 bp, Homo sapiens
tggcactggatgcag

SEQ ID NO: 5674597 - DNA, 22 bp, Homo sapiens
tggcactggcaaacagggcctc

SEQ ID NO: 5674598 - DNA, 11 bp, Homo sapiens
tggcactggga

SEQ ID NO: 5674599 - DNA, 17 bp, Homo sapiens
tggcactggggcacttg

SEQ ID NO: 5674600 - DNA, 22 bp, Homo sapiens
tggcactggtaggttgggacac

SEQ ID NO: 5674601 - DNA, 13 bp, Homo sapiens
tggcactgtccag

SEQ ID NO: 5674602 - DNA, 17 bp, Homo sapiens
tggcactgtccagggcc

SEQ ID NO: 5674603 - DNA, 15 bp, Homo sapiens
tggcactgtggaact

SEQ ID NO: 5674604 - DNA, 19 bp, Homo sapiens
tggcactgtggaactgcca

SEQ ID NO: 5674605 - DNA, 22 bp, Homo sapiens
tggcactgtggaactgccacct

SEQ ID NO: 5674606 - DNA, 13 bp, Homo sapiens
tggcactgtggca

SEQ ID NO: 5674607 - DNA, 18 bp, Homo sapiens
tggcactgtggcactgcc

SEQ ID NO: 5674608 - DNA, 20 bp, Homo sapiens
tggcactgtggcactgccac

SEQ ID NO: 5674609 - DNA, 23 bp, Homo sapiens
tggcactgttgtcatttccaaat

SEQ ID NO: 5674610 - DNA, 19 bp, Homo sapiens
tggcacttaagtgcacttt

SEQ ID NO: 5674611 - DNA, 20 bp, Homo sapiens
tggcacttagcccaagaggt

SEQ ID NO: 5674612 - DNA, 23 bp, Homo sapiens
tggcacttccacctccagcctct

SEQ ID NO: 5674613 - DNA, 14 bp, Homo sapiens
tggcacttcgtgga

SEQ ID NO: 5674614 - DNA, 16 bp, Homo sapiens
tggcacttgcctgctg

SEQ ID NO: 5674615 - DNA, 18 bp, Homo sapiens
tggcacttgcctgggtca

SEQ ID NO: 5674616 - DNA, 22 bp, Homo sapiens
tggcacttgtatttaattcttc

SEQ ID NO: 5674617 - DNA, 11 bp, Homo sapiens
tggcactttga

SEQ ID NO: 5674618 - DNA, 18 bp, Homo sapiens
tggcacttttgagctcct

SEQ ID NO: 5674619 - DNA, 23 bp, Homo sapiens
tggcacttttgatgaaataaaat

SEQ ID NO: 5674620 - DNA, 16 bp, Homo sapiens
tggcactttttcattt

SEQ ID NO: 5674621 - DNA, 20 bp, Homo sapiens
tggcactttttcgtgtggat

SEQ ID NO: 5674622 - DNA, 19 bp, Homo sapiens
tggcacttttttaaatata

SEQ ID NO: 5674623 - DNA, 12 bp, Homo sapiens
tggcagaaaaga

SEQ ID NO: 5674624 - DNA, 12 bp, Homo sapiens
tggcagaaaagt

SEQ ID NO: 5674625 - DNA, 22 bp, Homo sapiens
tggcagaaatcccagttcatgt

SEQ ID NO: 5674626 - DNA, 16 bp, Homo sapiens
tggcagaactcccaca

SEQ ID NO: 5674627 - DNA, 14 bp, Homo sapiens
tggcagaagacacc

SEQ ID NO: 5674628 - DNA, 22 bp, Homo sapiens
tggcagaagacaccagagcaga

SEQ ID NO: 5674629 - DNA, 21 bp, Homo sapiens
tggcagaagcattgcctggac

SEQ ID NO: 5674630 - DNA, 22 bp, Homo sapiens
tggcagaagcattgcctggact

SEQ ID NO: 5674631 - DNA, 14 bp, Homo sapiens
tggcagaagcgtct

SEQ ID NO: 5674632 - DNA, 22 bp, Homo sapiens
tggcagaagcgtctcccttggc

SEQ ID NO: 5674633 - DNA, 23 bp, Homo sapiens
tggcagaagtgtcaccctgtggg

SEQ ID NO: 5674634 - DNA, 20 bp, Homo sapiens
tggcagaataatctttgggt

SEQ ID NO: 5674635 - DNA, 14 bp, Homo sapiens
tggcagacagccgt

SEQ ID NO: 5674636 - DNA, 16 bp, Homo sapiens
tggcagaccgggggcc

SEQ ID NO: 5674637 - DNA, 17 bp, Homo sapiens
tggcagactagagtctg

SEQ ID NO: 5674638 - DNA, 11 bp, Homo sapiens
tggcagactct

SEQ ID NO: 5674639 - DNA, 19 bp, Homo sapiens
tggcagactctttaataaa

SEQ ID NO: 5674640 - DNA, 15 bp, Homo sapiens
tggcagactgtgtaa

SEQ ID NO: 5674641 - DNA, 16 bp, Homo sapiens
tggcagagaagagacc

SEQ ID NO: 5674642 - DNA, 18 bp, Homo sapiens
tggcagagaaggcctctt

SEQ ID NO: 5674643 - DNA, 17 bp, Homo sapiens
tggcagagaaggcttcc

SEQ ID NO: 5674644 - DNA, 21 bp, Homo sapiens
tggcagagaaggcttcctcca

SEQ ID NO: 5674645 - DNA, 15 bp, Homo sapiens
tggcagagacagtgg

SEQ ID NO: 5674646 - DNA, 17 bp, Homo sapiens
tggcagagacagtgggc

SEQ ID NO: 5674647 - DNA, 12 bp, Homo sapiens
tggcagagagag

SEQ ID NO: 5674648 - DNA, 20 bp, Homo sapiens
tggcagagaggtaaagggtg

SEQ ID NO: 5674649 - DNA, 15 bp, Homo sapiens
tggcagagccaggat

SEQ ID NO: 5674650 - DNA, 14 bp, Homo sapiens
tggcagagccaggc

SEQ ID NO: 5674651 - DNA, 16 bp, Homo sapiens
tggcagagccatccac

SEQ ID NO: 5674652 - DNA, 20 bp, Homo sapiens
tggcagagccatccaccctg

SEQ ID NO: 5674653 - DNA, 21 bp, Homo sapiens
tggcagagccatccaccctga

SEQ ID NO: 5674654 - DNA, 20 bp, Homo sapiens
tggcagagcccccaaggact

SEQ ID NO: 5674655 - DNA, 19 bp, Homo sapiens
tggcagagcctcagctgta

SEQ ID NO: 5674656 - DNA, 22 bp, Homo sapiens
tggcagagcttggactggatgc

SEQ ID NO: 5674657 - DNA, 19 bp, Homo sapiens
tggcagaggggacagagtt

SEQ ID NO: 5674658 - DNA, 12 bp, Homo sapiens
tggcagagttac

SEQ ID NO: 5674659 - DNA, 20 bp, Homo sapiens
tggcagagttacagttctgt

SEQ ID NO: 5674660 - DNA, 15 bp, Homo sapiens
tggcagagttgtaaa

SEQ ID NO: 5674661 - DNA, 17 bp, Homo sapiens
tggcagagttgtaaata

SEQ ID NO: 5674662 - DNA, 19 bp, Homo sapiens
tggcagagttgtaaatata

SEQ ID NO: 5674663 - DNA, 20 bp, Homo sapiens
tggcagagttgtaaatatat

SEQ ID NO: 5674664 - DNA, 18 bp, Homo sapiens
tggcagagtttgtgtgtt

SEQ ID NO: 5674665 - DNA, 21 bp, Homo sapiens
tggcagataatcagcctctta

SEQ ID NO: 5674666 - DNA, 15 bp, Homo sapiens
tggcagatgcagctc

SEQ ID NO: 5674667 - DNA, 17 bp, Homo sapiens
tggcagatgcagctctt

SEQ ID NO: 5674668 - DNA, 15 bp, Homo sapiens
tggcagatgtaggag

SEQ ID NO: 5674669 - DNA, 17 bp, Homo sapiens
tggcagatgtaggaggg

SEQ ID NO: 5674670 - DNA, 19 bp, Homo sapiens
tggcagatgtaggagggac

SEQ ID NO: 5674671 - DNA, 14 bp, Homo sapiens
tggcagattcaaat

SEQ ID NO: 5674672 - DNA, 22 bp, Homo sapiens
tggcagatttagtgaaagctag

SEQ ID NO: 5674673 - DNA, 15 bp, Homo sapiens
tggcagattttacaa

SEQ ID NO: 5674674 - DNA, 20 bp, Homo sapiens
tggcagattttacaaaagat

SEQ ID NO: 5674675 - DNA, 17 bp, Homo sapiens
tggcagcaaaggaagac

SEQ ID NO: 5674676 - DNA, 19 bp, Homo sapiens
tggcagcaagcaattctgc

SEQ ID NO: 5674677 - DNA, 15 bp, Homo sapiens
tggcagcacagccca

SEQ ID NO: 5674678 - DNA, 19 bp, Homo sapiens
tggcagcacagcccagggc

SEQ ID NO: 5674679 - DNA, 21 bp, Homo sapiens
tggcagcacagcccagggcct

SEQ ID NO: 5674680 - DNA, 16 bp, Homo sapiens
tggcagcacccactca

SEQ ID NO: 5674681 - DNA, 14 bp, Homo sapiens
tggcagcagagtgt

SEQ ID NO: 5674682 - DNA, 20 bp, Homo sapiens
tggcagcagccccccttgcc

SEQ ID NO: 5674683 - DNA, 22 bp, Homo sapiens
tggcagcagccccccttgcccc

SEQ ID NO: 5674684 - DNA, 20 bp, Homo sapiens
tggcagcaggcatggcttcc

SEQ ID NO: 5674685 - DNA, 15 bp, Homo sapiens
tggcagcaggtgctg

SEQ ID NO: 5674686 - DNA, 20 bp, Homo sapiens
tggcagcaggtgctgctacc

SEQ ID NO: 5674687 - DNA, 22 bp, Homo sapiens
tggcagcagttccatgaagaca

SEQ ID NO: 5674688 - DNA, 20 bp, Homo sapiens
tggcagcataaaggcctttt

SEQ ID NO: 5674689 - DNA, 23 bp, Homo sapiens
tggcagccaaggaatgtgtccaa

SEQ ID NO: 5674690 - DNA, 16 bp, Homo sapiens
tggcagccacacgcag

SEQ ID NO: 5674691 - DNA, 15 bp, Homo sapiens
tggcagccatgcctc

SEQ ID NO: 5674692 - DNA, 12 bp, Homo sapiens
tggcagcccaga

SEQ ID NO: 5674693 - DNA, 12 bp, Homo sapiens
tggcagcccatg

SEQ ID NO: 5674694 - DNA, 17 bp, Homo sapiens
tggcagcccgcatcagc

SEQ ID NO: 5674695 - DNA, 14 bp, Homo sapiens
tggcagccctgtag

SEQ ID NO: 5674696 - DNA, 17 bp, Homo sapiens
tggcagccctgtaggga

SEQ ID NO: 5674697 - DNA, 14 bp, Homo sapiens
tggcagccgagctc

SEQ ID NO: 5674698 - DNA, 19 bp, Homo sapiens
tggcagccgtcccaggcca

SEQ ID NO: 5674699 - DNA, 20 bp, Homo sapiens
tggcagccgtcccaggccac

SEQ ID NO: 5674700 - DNA, 21 bp, Homo sapiens
tggcagccgtgccttcagctc

SEQ ID NO: 5674701 - DNA, 23 bp, Homo sapiens
tggcagccgtgccttcagctcta

SEQ ID NO: 5674702 - DNA, 22 bp, Homo sapiens
tggcagcctactagggacctgg

SEQ ID NO: 5674703 - DNA, 18 bp, Homo sapiens
tggcagcctcagaggccc

SEQ ID NO: 5674704 - DNA, 20 bp, Homo sapiens
tggcagcctcccatccaggg

SEQ ID NO: 5674705 - DNA, 14 bp, Homo sapiens
tggcagcctgattc

SEQ ID NO: 5674706 - DNA, 13 bp, Homo sapiens
tggcagcctgcac

SEQ ID NO: 5674707 - DNA, 15 bp, Homo sapiens
tggcagccttgtgat

SEQ ID NO: 5674708 - DNA, 21 bp, Homo sapiens
tggcagcgcctcgccccagcc

SEQ ID NO: 5674709 - DNA, 16 bp, Homo sapiens
tggcagctagactgga

SEQ ID NO: 5674710 - DNA, 14 bp, Homo sapiens
tggcagctagtgcc

SEQ ID NO: 5674711 - DNA, 15 bp, Homo sapiens
tggcagctagtgcct

SEQ ID NO: 5674712 - DNA, 13 bp, Homo sapiens
tggcagctcagag

SEQ ID NO: 5674713 - DNA, 17 bp, Homo sapiens
tggcagctctccagtca

SEQ ID NO: 5674714 - DNA, 11 bp, Homo sapiens
tggcagctctg

SEQ ID NO: 5674715 - DNA, 21 bp, Homo sapiens
tggcagctctggacagcccca

SEQ ID NO: 5674716 - DNA, 18 bp, Homo sapiens
tggcagctgagagccctg

SEQ ID NO: 5674717 - DNA, 23 bp, Homo sapiens
tggcagctgcccctcctggagca

SEQ ID NO: 5674718 - DNA, 12 bp, Homo sapiens
tggccaccaccc

SEQ ID NO: 5674719 - DNA, 13 bp, Homo sapiens
tggccaccaccca

SEQ ID NO: 5674720 - DNA, 17 bp, Homo sapiens
tggccaccacccaacct

SEQ ID NO: 5674721 - DNA, 13 bp, Homo sapiens
tggccaccacccc

SEQ ID NO: 5674722 - DNA, 15 bp, Homo sapiens
tggccaccacccccc

SEQ ID NO: 5674723 - DNA, 18 bp, Homo sapiens
tggccaccaccccccact

SEQ ID NO: 5674724 - DNA, 19 bp, Homo sapiens
tggccaccagccatcctcc

SEQ ID NO: 5674725 - DNA, 12 bp, Homo sapiens
tggccaccaggc

SEQ ID NO: 5674726 - DNA, 18 bp, Homo sapiens
tggccaccaggctggcgc

SEQ ID NO: 5674727 - DNA, 19 bp, Homo sapiens
tggccaccaggctggcgca

SEQ ID NO: 5674728 - DNA, 19 bp, Homo sapiens
tggccacccaacagcacca

SEQ ID NO: 5674729 - DNA, 16 bp, Homo sapiens
tggccaccccgtgcca

SEQ ID NO: 5674730 - DNA, 19 bp, Homo sapiens
tggccacccgttctgctgg

SEQ ID NO: 5674731 - DNA, 11 bp, Homo sapiens
tggccaccctg

SEQ ID NO: 5674732 - DNA, 20 bp, Homo sapiens
tggccacctctctcctttgc

SEQ ID NO: 5674733 - DNA, 14 bp, Homo sapiens
tggccacctgccag

SEQ ID NO: 5674734 - DNA, 18 bp, Homo sapiens
tggccacctgccaggcct

SEQ ID NO: 5674735 - DNA, 20 bp, Homo sapiens
tggccaccttgcttgaggga

SEQ ID NO: 5674736 - DNA, 16 bp, Homo sapiens
tggccaccttttcagc

SEQ ID NO: 5674737 - DNA, 13 bp, Homo sapiens
tggccacgaggtt

SEQ ID NO: 5674738 - DNA, 19 bp, Homo sapiens
tggccacgcagccaggaca

SEQ ID NO: 5674739 - DNA, 20 bp, Homo sapiens
tggccacggccacggccaca

SEQ ID NO: 5674740 - DNA, 15 bp, Homo sapiens
tggccacggcccagg

SEQ ID NO: 5674741 - DNA, 19 bp, Homo sapiens
tggccacggcccagggagg

SEQ ID NO: 5674742 - DNA, 14 bp, Homo sapiens
tggccacggcctgg

SEQ ID NO: 5674743 - DNA, 15 bp, Homo sapiens
tggccacggcctggg

SEQ ID NO: 5674744 - DNA, 19 bp, Homo sapiens
tggccacgttcagggaggg

SEQ ID NO: 5674745 - DNA, 18 bp, Homo sapiens
tggccactaagcagagga

SEQ ID NO: 5674746 - DNA, 19 bp, Homo sapiens
tggccactaagcagaggag

SEQ ID NO: 5674747 - DNA, 12 bp, Homo sapiens
tggccactcagc

SEQ ID NO: 5674748 - DNA, 16 bp, Homo sapiens
tggccactgagctggc

SEQ ID NO: 5674749 - DNA, 17 bp, Homo sapiens
tggccactgagctggct

SEQ ID NO: 5674750 - DNA, 20 bp, Homo sapiens
tggccactgcacagagctct

SEQ ID NO: 5674751 - DNA, 19 bp, Homo sapiens
tggccactgcagcacctgc

SEQ ID NO: 5674752 - DNA, 20 bp, Homo sapiens
tggccactgcagcacctgcc

SEQ ID NO: 5674753 - DNA, 16 bp, Homo sapiens
tggccactggatcctg

SEQ ID NO: 5674754 - DNA, 17 bp, Homo sapiens
tggccactggatcctgc

SEQ ID NO: 5674755 - DNA, 21 bp, Homo sapiens
tggccactggatcctgctgct

SEQ ID NO: 5674756 - DNA, 15 bp, Homo sapiens
tggccactggccctg

SEQ ID NO: 5674757 - DNA, 17 bp, Homo sapiens
tggccactggccctgtt

SEQ ID NO: 5674758 - DNA, 19 bp, Homo sapiens
tggccactgggtctcactc

SEQ ID NO: 5674759 - DNA, 17 bp, Homo sapiens
tggccactgtccctgtc

SEQ ID NO: 5674760 - DNA, 16 bp, Homo sapiens
tggccacttatttcac

SEQ ID NO: 5674761 - DNA, 22 bp, Homo sapiens
tggccactttaagagagaaatc

SEQ ID NO: 5674762 - DNA, 21 bp, Homo sapiens
tggccagaaataaagggacca

SEQ ID NO: 5674763 - DNA, 19 bp, Homo sapiens
tggccagaagagcttgtca

SEQ ID NO: 5674764 - DNA, 21 bp, Homo sapiens
tggccagacacaggtgcctca

SEQ ID NO: 5674765 - DNA, 14 bp, Homo sapiens
tggccagactccct

SEQ ID NO: 5674766 - DNA, 18 bp, Homo sapiens
tggccagactcccttgct

SEQ ID NO: 5674767 - DNA, 15 bp, Homo sapiens
tggccagactcgatg

SEQ ID NO: 5674768 - DNA, 12 bp, Homo sapiens
tggccagagctg

SEQ ID NO: 5674769 - DNA, 13 bp, Homo sapiens
tggccagagctga

SEQ ID NO: 5674770 - DNA, 14 bp, Homo sapiens
tggccagagctgag

SEQ ID NO: 5674771 - DNA, 20 bp, Homo sapiens
tggccagagctggaaggcag

SEQ ID NO: 5674772 - DNA, 15 bp, Homo sapiens
tggccagagctggga

SEQ ID NO: 5674773 - DNA, 21 bp, Homo sapiens
tggccagaggaaatctgaatg

SEQ ID NO: 5674774 - DNA, 14 bp, Homo sapiens
tggccagaggcagc

SEQ ID NO: 5674775 - DNA, 13 bp, Homo sapiens
tggccagagggcc

SEQ ID NO: 5674776 - DNA, 21 bp, Homo sapiens
tggccagatgcaccagccctt

SEQ ID NO: 5674777 - DNA, 14 bp, Homo sapiens
tggccagatgcggg

SEQ ID NO: 5674778 - DNA, 17 bp, Homo sapiens
tggccagatgtcgctgg

SEQ ID NO: 5674779 - DNA, 13 bp, Homo sapiens
tggccagcaaata

SEQ ID NO: 5674780 - DNA, 22 bp, Homo sapiens
tggccagcacaccaagtggctg

SEQ ID NO: 5674781 - DNA, 14 bp, Homo sapiens
tggccagcaccctc

SEQ ID NO: 5674782 - DNA, 16 bp, Homo sapiens
tggccagcagcacctg

SEQ ID NO: 5674783 - DNA, 18 bp, Homo sapiens
tggccagcagcacctgcc

SEQ ID NO: 5674784 - DNA, 21 bp, Homo sapiens
tggccagcagcacctgcccta

SEQ ID NO: 5674785 - DNA, 20 bp, Homo sapiens
tggccagccaatttcccgga

SEQ ID NO: 5674786 - DNA, 21 bp, Homo sapiens
tggccagccaatttcccggag

SEQ ID NO: 5674787 - DNA, 20 bp, Homo sapiens
tggccagccaccactgacta

SEQ ID NO: 5674788 - DNA, 16 bp, Homo sapiens
tggccagccagtgcca

SEQ ID NO: 5674789 - DNA, 15 bp, Homo sapiens
tggccagcccagatg

SEQ ID NO: 5674790 - DNA, 21 bp, Homo sapiens
tggccagcccagatggctccc

SEQ ID NO: 5674791 - DNA, 24 bp, Homo sapiens
tggccagcccagatggctccctgg

SEQ ID NO: 5674792 - DNA, 16 bp, Homo sapiens
tggccagccccacagc

SEQ ID NO: 5674793 - DNA, 17 bp, Homo sapiens
tggccagccccacagcc

SEQ ID NO: 5674794 - DNA, 18 bp, Homo sapiens
tggccagccccacagccc

SEQ ID NO: 5674795 - DNA, 20 bp, Homo sapiens
tggccagccccttagacaga

SEQ ID NO: 5674796 - DNA, 12 bp, Homo sapiens
tggccagcccgc

SEQ ID NO: 5674797 - DNA, 19 bp, Homo sapiens
tggccagcccgcagaggtg

SEQ ID NO: 5674798 - DNA, 23 bp, Homo sapiens
tggccagcccgcagaggtggggt

SEQ ID NO: 5674799 - DNA, 14 bp, Homo sapiens
tggccagcccggct

SEQ ID NO: 5674800 - DNA, 17 bp, Homo sapiens
tggccagcccggctggt

SEQ ID NO: 5674801 - DNA, 20 bp, Homo sapiens
tggccagccgctctcctgcc

SEQ ID NO: 5674802 - DNA, 22 bp, Homo sapiens
tggccagccgggagcttggctc

SEQ ID NO: 5674803 - DNA, 13 bp, Homo sapiens
tggccagcctggc

SEQ ID NO: 5674804 - DNA, 14 bp, Homo sapiens
tggccagcctggca

SEQ ID NO: 5674805 - DNA, 21 bp, Homo sapiens
tggccagcctggggcctggca

SEQ ID NO: 5674806 - DNA, 15 bp, Homo sapiens
tggccagcgccaggg

SEQ ID NO: 5674807 - DNA, 17 bp, Homo sapiens
tggccagcgccagggcc

SEQ ID NO: 5674808 - DNA, 21 bp, Homo sapiens
tggccagcgcccctcagcctc

SEQ ID NO: 5674809 - DNA, 13 bp, Homo sapiens
tggccagcgctgt

SEQ ID NO: 5674810 - DNA, 23 bp, Homo sapiens
tggccagctctgaggggaggcac

SEQ ID NO: 5674811 - DNA, 20 bp, Homo sapiens
tggccaggaagtagcacagg

SEQ ID NO: 5674812 - DNA, 12 bp, Homo sapiens
tggccaggagcc

SEQ ID NO: 5674813 - DNA, 15 bp, Homo sapiens
tggccaggagccctg

SEQ ID NO: 5674814 - DNA, 18 bp, Homo sapiens
tggccaggagccctggcc

SEQ ID NO: 5674815 - DNA, 16 bp, Homo sapiens
tggccaggagctcttc

SEQ ID NO: 5674816 - DNA, 15 bp, Homo sapiens
tggccaggagctgga

SEQ ID NO: 5674817 - DNA, 17 bp, Homo sapiens
tggccaggagctggagg

SEQ ID NO: 5674818 - DNA, 11 bp, Homo sapiens
tggccaggagg

SEQ ID NO: 5674819 - DNA, 12 bp, Homo sapiens
tggccaggaggt

SEQ ID NO: 5674820 - DNA, 21 bp, Homo sapiens
tggccaggaggttggtgactg

SEQ ID NO: 5674821 - DNA, 22 bp, Homo sapiens
tggccaggaggttggtgactga

SEQ ID NO: 5674822 - DNA, 21 bp, Homo sapiens
tggccaggcaccccctggaga

SEQ ID NO: 5674823 - DNA, 16 bp, Homo sapiens
tggccaggcactgcct

SEQ ID NO: 5674824 - DNA, 20 bp, Homo sapiens
tggccaggcagatctgtgcc

SEQ ID NO: 5674825 - DNA, 23 bp, Homo sapiens
tggccaggcagatctgtgcccca

SEQ ID NO: 5674826 - DNA, 16 bp, Homo sapiens
tggccaggcagggaga

SEQ ID NO: 5674827 - DNA, 14 bp, Homo sapiens
tggccaggcctgcc

SEQ ID NO: 5674828 - DNA, 22 bp, Homo sapiens
tggccaggcctgccagcccctc

SEQ ID NO: 5674829 - DNA, 19 bp, Homo sapiens
tggccaggctgctctcaaa

SEQ ID NO: 5674830 - DNA, 16 bp, Homo sapiens
tggccaggctgctctt

SEQ ID NO: 5674831 - DNA, 20 bp, Homo sapiens
tggccaggctggtctcgaac

SEQ ID NO: 5674832 - DNA, 15 bp, Homo sapiens
tggccaggctgttct

SEQ ID NO: 5674833 - DNA, 10 bp, Homo sapiens
tggccaggga

SEQ ID NO: 5674834 - DNA, 12 bp, Homo sapiens
tggccagggagg

SEQ ID NO: 5674835 - DNA, 20 bp, Homo sapiens
tggccagggaggagccccag

SEQ ID NO: 5674836 - DNA, 21 bp, Homo sapiens
tggccagggaggcagcctagc

SEQ ID NO: 5674837 - DNA, 14 bp, Homo sapiens
tggccagggaggcg

SEQ ID NO: 5674838 - DNA, 16 bp, Homo sapiens
tggccagggaggcgca

SEQ ID NO: 5674839 - DNA, 17 bp, Homo sapiens
tggccagggaggcgcag

SEQ ID NO: 5674840 - DNA, 21 bp, Homo sapiens
tggccagggaggcgcagggac

SEQ ID NO: 5674841 - DNA, 12 bp, Homo sapiens
tggccagggcag

SEQ ID NO: 5674842 - DNA, 16 bp, Homo sapiens
tggccagggcagggcc

SEQ ID NO: 5674843 - DNA, 20 bp, Homo sapiens
tggccagggcagggccaccc

SEQ ID NO: 5674844 - DNA, 13 bp, Homo sapiens
tggccagggcctc

SEQ ID NO: 5674845 - DNA, 15 bp, Homo sapiens
tggccagggcttgtg

SEQ ID NO: 5674846 - DNA, 14 bp, Homo sapiens
tggccaggggccag

SEQ ID NO: 5674847 - DNA, 16 bp, Homo sapiens
tggccaggggtgctcc

SEQ ID NO: 5674848 - DNA, 19 bp, Homo sapiens
tggccaggggtgctcctgt

SEQ ID NO: 5674849 - DNA, 20 bp, Homo sapiens
tggccaggggtgctcctgtg

SEQ ID NO: 5674850 - DNA, 22 bp, Homo sapiens
tggccaggggtgctcctgtgct

SEQ ID NO: 5674851 - DNA, 22 bp, Homo sapiens
tggccaggggtggtgagggcag

SEQ ID NO: 5674852 - DNA, 11 bp, Homo sapiens
tggccaggtgg

SEQ ID NO: 5674853 - DNA, 15 bp, Homo sapiens
tggccagtagctgcc

SEQ ID NO: 5674854 - DNA, 23 bp, Homo sapiens
tggccagtccaggctgccgtggg

SEQ ID NO: 5674855 - DNA, 15 bp, Homo sapiens
tggccagtcctggtc

SEQ ID NO: 5674856 - DNA, 16 bp, Homo sapiens
tggccagtcctggtcc

SEQ ID NO: 5674857 - DNA, 22 bp, Homo sapiens
tggccagtcctggtcctggctg

SEQ ID NO: 5674858 - DNA, 17 bp, Homo sapiens
tggccagtctgggtctg

SEQ ID NO: 5674859 - DNA, 20 bp, Homo sapiens
tggccagtctggtctcgaac

SEQ ID NO: 5674860 - DNA, 17 bp, Homo sapiens
tggccagtcttcctctt

SEQ ID NO: 5674861 - DNA, 21 bp, Homo sapiens
tggccagtgagaagctgaggc

SEQ ID NO: 5674862 - DNA, 22 bp, Homo sapiens
tggccagtgagaagctgaggcc

SEQ ID NO: 5674863 - DNA, 20 bp, Homo sapiens
tggccagtgagatcaatgtg

SEQ ID NO: 5674864 - DNA, 14 bp, Homo sapiens
tggccagtgccctg

SEQ ID NO: 5674865 - DNA, 12 bp, Homo sapiens
tggccagtgctg

SEQ ID NO: 5674866 - DNA, 22 bp, Homo sapiens
tggccagtgctgcccatgagca

SEQ ID NO: 5674867 - DNA, 15 bp, Homo sapiens
tggccagtgctgctt

SEQ ID NO: 5674868 - DNA, 17 bp, Homo sapiens
tggccagtgctgcttct

SEQ ID NO: 5674869 - DNA, 14 bp, Homo sapiens
tggccagtggctgg

SEQ ID NO: 5674870 - DNA, 14 bp, Homo sapiens
tggccagtgtcatt

SEQ ID NO: 5674871 - DNA, 18 bp, Homo sapiens
tggccagtgtttaaaact

SEQ ID NO: 5674872 - DNA, 16 bp, Homo sapiens
tggccagttgcccaga

SEQ ID NO: 5674873 - DNA, 16 bp, Homo sapiens
tggccagttggaacca

SEQ ID NO: 5674874 - DNA, 22 bp, Homo sapiens
tggccagtttgaagcctgtgcc

SEQ ID NO: 5674875 - DNA, 21 bp, Homo sapiens
tggccagttttctgttcagct

SEQ ID NO: 5674876 - DNA, 22 bp, Homo sapiens
tggccataagcaacaattttca

SEQ ID NO: 5674877 - DNA, 19 bp, Homo sapiens
tggccataggagaggaggg

SEQ ID NO: 5674878 - DNA, 23 bp, Homo sapiens
tggccatatatgctgtatttctt

SEQ ID NO: 5674879 - DNA, 19 bp, Homo sapiens
tggccatatttacctcagc

SEQ ID NO: 5674880 - DNA, 16 bp, Homo sapiens
tggccatcactcagcc

SEQ ID NO: 5674881 - DNA, 16 bp, Homo sapiens
tggccatcaggacttt

SEQ ID NO: 5674882 - DNA, 19 bp, Homo sapiens
tggccatcatttcattcgt

SEQ ID NO: 5674883 - DNA, 13 bp, Homo sapiens
tggccatcccaca

SEQ ID NO: 5674884 - DNA, 17 bp, Homo sapiens
tggccatccctgggccc

SEQ ID NO: 5674885 - DNA, 19 bp, Homo sapiens
tggccatccctgggcccct

SEQ ID NO: 5674886 - DNA, 13 bp, Homo sapiens
tggccatctccac

SEQ ID NO: 5674887 - DNA, 16 bp, Homo sapiens
tggccatctccacccc

SEQ ID NO: 5674888 - DNA, 18 bp, Homo sapiens
tggccatctccctcccca

SEQ ID NO: 5674889 - DNA, 14 bp, Homo sapiens
tggccatctgctcc

SEQ ID NO: 5674890 - DNA, 16 bp, Homo sapiens
tggccatcttaaaaag

SEQ ID NO: 5674891 - DNA, 15 bp, Homo sapiens
tggccatcttctttc

SEQ ID NO: 5674892 - DNA, 19 bp, Homo sapiens
tggccatcttctttcttcc

SEQ ID NO: 5674893 - DNA, 20 bp, Homo sapiens
tggccatcttctttcttcca

SEQ ID NO: 5674894 - DNA, 21 bp, Homo sapiens
tggccatgaatctctgcctct

SEQ ID NO: 5674895 - DNA, 21 bp, Homo sapiens
tggccatgaccctgcctctcc

SEQ ID NO: 5674896 - DNA, 15 bp, Homo sapiens
aaaggggacccaaga

SEQ ID NO: 5674897 - DNA, 22 bp, Homo sapiens
aaaggggacccaagaaaccaaa

SEQ ID NO: 5674898 - DNA, 17 bp, Homo sapiens
aaaggggagaaactgaa

SEQ ID NO: 5674899 - DNA, 23 bp, Homo sapiens
aaaggggagaaactgaaagtgtt

SEQ ID NO: 5674900 - DNA, 22 bp, Homo sapiens
aaaggggagaagggccagccct

SEQ ID NO: 5674901 - DNA, 23 bp, Homo sapiens
aaaggggagaagggccagcccta

SEQ ID NO: 5674902 - DNA, 10 bp, Homo sapiens
aaaggggagt

SEQ ID NO: 5674903 - DNA, 23 bp, Homo sapiens
aaaggggcaagaaattcattaaa

SEQ ID NO: 5674904 - DNA, 23 bp, Homo sapiens
aaaggggcattttgtactcttgt

SEQ ID NO: 5674905 - DNA, 21 bp, Homo sapiens
aaaggggcccaagccccatct

SEQ ID NO: 5674906 - DNA, 16 bp, Homo sapiens
aaaggggcctgcgcag

SEQ ID NO: 5674907 - DNA, 19 bp, Homo sapiens
aaaggggcgagcacccacg

SEQ ID NO: 5674908 - DNA, 14 bp, Homo sapiens
aaagggggattccc

SEQ ID NO: 5674909 - DNA, 14 bp, Homo sapiens
aaaggggggagggg

SEQ ID NO: 5674910 - DNA, 14 bp, Homo sapiens
aaaggggggaggtc

SEQ ID NO: 5674911 - DNA, 21 bp, Homo sapiens
aaaggggggtgggaggggaag

SEQ ID NO: 5674912 - DNA, 18 bp, Homo sapiens
aaaggggtcccatagagg

SEQ ID NO: 5674913 - DNA, 20 bp, Homo sapiens
aaagggtaaattataaatgt

SEQ ID NO: 5674914 - DNA, 19 bp, Homo sapiens
aaagggtcaacggccctgt

SEQ ID NO: 5674915 - DNA, 16 bp, Homo sapiens
aaagggtcctgctttc

SEQ ID NO: 5674916 - DNA, 17 bp, Homo sapiens
aaagggtcctgctttct

SEQ ID NO: 5674917 - DNA, 22 bp, Homo sapiens
aaagggtctccgaaatgctgtc

SEQ ID NO: 5674918 - DNA, 15 bp, Homo sapiens
aaagggtcttccttc

SEQ ID NO: 5674919 - DNA, 17 bp, Homo sapiens
aaagggtcttttgcagc

SEQ ID NO: 5674920 - DNA, 14 bp, Homo sapiens
aaagggtgtactta

SEQ ID NO: 5674921 - DNA, 17 bp, Homo sapiens
aaagggtgtgggtcagg

SEQ ID NO: 5674922 - DNA, 14 bp, Homo sapiens
aaagggttaatcat

SEQ ID NO: 5674923 - DNA, 17 bp, Homo sapiens
aaagggttctgtaaaat

SEQ ID NO: 5674924 - DNA, 13 bp, Homo sapiens
aaagggtttgata

SEQ ID NO: 5674925 - DNA, 20 bp, Homo sapiens
aaagggtttgatatggagaa

SEQ ID NO: 5674926 - DNA, 19 bp, Homo sapiens
aaagggtttgtaatacttt

SEQ ID NO: 5674927 - DNA, 13 bp, Homo sapiens
aaagggttttctt

SEQ ID NO: 5674928 - DNA, 13 bp, Homo sapiens
aaaggtaaaatca

SEQ ID NO: 5674929 - DNA, 20 bp, Homo sapiens
aaaggtaaaatcacttcaga

SEQ ID NO: 5674930 - DNA, 21 bp, Homo sapiens
aaaggtaacttctcccttctc

SEQ ID NO: 5674931 - DNA, 15 bp, Homo sapiens
aaaggtaatctgaaa

SEQ ID NO: 5674932 - DNA, 17 bp, Homo sapiens
aaaggtaatctgaaaca

SEQ ID NO: 5674933 - DNA, 21 bp, Homo sapiens
aaaggtacactggtatttata

SEQ ID NO: 5674934 - DNA, 19 bp, Homo sapiens
aaaggtaccaaacaaggaa

SEQ ID NO: 5674935 - DNA, 21 bp, Homo sapiens
aaaggtagcttacctgacaca

SEQ ID NO: 5674936 - DNA, 15 bp, Homo sapiens
aaaggtataattaaa

SEQ ID NO: 5674937 - DNA, 15 bp, Homo sapiens
aaaggtatattgtga

SEQ ID NO: 5674938 - DNA, 14 bp, Homo sapiens
aaaggtcagcccgt

SEQ ID NO: 5674939 - DNA, 19 bp, Homo sapiens
aaaggtccacaggtctaga

SEQ ID NO: 5674940 - DNA, 20 bp, Homo sapiens
aaaggtccacaggtctagac

SEQ ID NO: 5674941 - DNA, 18 bp, Homo sapiens
aaaggtcccaaggcaagg

SEQ ID NO: 5674942 - DNA, 22 bp, Homo sapiens
aaaggtccttgcctcctggaag

SEQ ID NO: 5674943 - DNA, 18 bp, Homo sapiens
aaaggtgaaaatgtttta

SEQ ID NO: 5674944 - DNA, 21 bp, Homo sapiens
aaaggtgaaggaatatatggc

SEQ ID NO: 5674945 - DNA, 22 bp, Homo sapiens
aaaggtgaccttgcaacttcat

SEQ ID NO: 5674946 - DNA, 20 bp, Homo sapiens
aaaggtgagtttgagctgcc

SEQ ID NO: 5674947 - DNA, 21 bp, Homo sapiens
aaaggtgagtttgagctgcct

SEQ ID NO: 5674948 - DNA, 14 bp, Homo sapiens
aaaggtgataaaat

SEQ ID NO: 5674949 - DNA, 18 bp, Homo sapiens
aaaggtgatgaatttacc

SEQ ID NO: 5674950 - DNA, 17 bp, Homo sapiens
aaaggtgattaaatatt

SEQ ID NO: 5674951 - DNA, 15 bp, Homo sapiens
aaaggtgcctcatag

SEQ ID NO: 5674952 - DNA, 13 bp, Homo sapiens
aaaggtgctttct

SEQ ID NO: 5674953 - DNA, 16 bp, Homo sapiens
aaaggtggaataaaca

SEQ ID NO: 5674954 - DNA, 21 bp, Homo sapiens
aaaggtggaataaacattaat

SEQ ID NO: 5674955 - DNA, 12 bp, Homo sapiens
aaaggtggcagc

SEQ ID NO: 5674956 - DNA, 13 bp, Homo sapiens
aaaggtggcagct

SEQ ID NO: 5674957 - DNA, 13 bp, Homo sapiens
aaaggtggccaca

SEQ ID NO: 5674958 - DNA, 18 bp, Homo sapiens
aaaggtggtaaattcaga

SEQ ID NO: 5674959 - DNA, 21 bp, Homo sapiens
aaaggtggtatgtgtgtgtat

SEQ ID NO: 5674960 - DNA, 17 bp, Homo sapiens
aaaggtggttttatttt

SEQ ID NO: 5674961 - DNA, 20 bp, Homo sapiens
aaaggtgtaagacttcagat

SEQ ID NO: 5674962 - DNA, 22 bp, Homo sapiens
aaaggtgtaagacttcagattt

SEQ ID NO: 5674963 - DNA, 17 bp, Homo sapiens
aaaggtgtagaaaaggt

SEQ ID NO: 5674964 - DNA, 18 bp, Homo sapiens
aaaggtgtcaacttttga

SEQ ID NO: 5674965 - DNA, 18 bp, Homo sapiens
aaaggtgtcttcctccca

SEQ ID NO: 5674966 - DNA, 22 bp, Homo sapiens
aaaggtgtgaggagagaggagg

SEQ ID NO: 5674967 - DNA, 20 bp, Homo sapiens
aaaggtgtgcttcctgctgt

SEQ ID NO: 5674968 - DNA, 18 bp, Homo sapiens
aaaggtgttgtcccttct

SEQ ID NO: 5674969 - DNA, 12 bp, Homo sapiens
aaaggttaacag

SEQ ID NO: 5674970 - DNA, 21 bp, Homo sapiens
aaaggttatgaaacatatcat

SEQ ID NO: 5674971 - DNA, 18 bp, Homo sapiens
aaaggttattttctcctg

SEQ ID NO: 5674972 - DNA, 18 bp, Homo sapiens
aaaggttcctttgttccc

SEQ ID NO: 5674973 - DNA, 13 bp, Homo sapiens
aaaggttctaggt

SEQ ID NO: 5674974 - DNA, 22 bp, Homo sapiens
aaaggttcttcatccctttcca

SEQ ID NO: 5674975 - DNA, 16 bp, Homo sapiens
aaaggttgaataatat

SEQ ID NO: 5674976 - DNA, 19 bp, Homo sapiens
aaaggttgccaaattgctg

SEQ ID NO: 5674977 - DNA, 21 bp, Homo sapiens
aaaggttgccaaattgctgca

SEQ ID NO: 5674978 - DNA, 19 bp, Homo sapiens
aaaggttgctgtttcacaa

SEQ ID NO: 5674979 - DNA, 14 bp, Homo sapiens
aaaggttggcctta

SEQ ID NO: 5674980 - DNA, 13 bp, Homo sapiens
aaaggtttaaatg

SEQ ID NO: 5674981 - DNA, 14 bp, Homo sapiens
aaaggtttaaatga

SEQ ID NO: 5674982 - DNA, 16 bp, Homo sapiens
aaaggtttaaatgaac

SEQ ID NO: 5674983 - DNA, 18 bp, Homo sapiens
aaaggtttaaatgaacaa

SEQ ID NO: 5674984 - DNA, 20 bp, Homo sapiens
aaaggtttaagaaatagaat

SEQ ID NO: 5674985 - DNA, 15 bp, Homo sapiens
aaaggtttacagaat

SEQ ID NO: 5674986 - DNA, 16 bp, Homo sapiens
aaaggtttacagtgaa

SEQ ID NO: 5674987 - DNA, 18 bp, Homo sapiens
aaaggtttatgaaaaaga

SEQ ID NO: 5674988 - DNA, 22 bp, Homo sapiens
aaaggtttatgaaaaagaagaa

SEQ ID NO: 5674989 - DNA, 21 bp, Homo sapiens
aaaggtttcaagacttgatac

SEQ ID NO: 5674990 - DNA, 19 bp, Homo sapiens
aaaggtttcactgttcatg

SEQ ID NO: 5674991 - DNA, 15 bp, Homo sapiens
aaaggtttcatgtag

SEQ ID NO: 5674992 - DNA, 22 bp, Homo sapiens
aaaggtttccactattatagaa

SEQ ID NO: 5674993 - DNA, 19 bp, Homo sapiens
aaaggtttcccaaaacaat

SEQ ID NO: 5674994 - DNA, 14 bp, Homo sapiens
aaaggttttcctct

SEQ ID NO: 5674995 - DNA, 13 bp, Homo sapiens
aaaggttttgagc

SEQ ID NO: 5674996 - DNA, 16 bp, Homo sapiens
aaaggttttgtatttt

SEQ ID NO: 5674997 - DNA, 12 bp, Homo sapiens
aaaggtttttaa

SEQ ID NO: 5674998 - DNA, 12 bp, Homo sapiens
aaaggttttttt

SEQ ID NO: 5674999 - DNA, 17 bp, Homo sapiens
aaagtaaaaaaataatt

SEQ ID NO: 5675000 - DNA, 15 bp, Homo sapiens
aaagtaaaaagaaca

SEQ ID NO: 5675001 - DNA, 16 bp, Homo sapiens
aaagtaaaaagaacaa

SEQ ID NO: 5675002 - DNA, 12 bp, Homo sapiens
aaagtaaaacaa

SEQ ID NO: 5675003 - DNA, 15 bp, Homo sapiens
aaagtaaaagcagca

SEQ ID NO: 5675004 - DNA, 13 bp, Homo sapiens
aaagtaaaatatg

SEQ ID NO: 5675005 - DNA, 15 bp, Homo sapiens
aaagtaaaatatgtc

SEQ ID NO: 5675006 - DNA, 13 bp, Homo sapiens
aaagtaaaatgaa

SEQ ID NO: 5675007 - DNA, 11 bp, Homo sapiens
aaagtaaaatt

SEQ ID NO: 5675008 - DNA, 21 bp, Homo sapiens
aaagtaaaattaatatattaa

SEQ ID NO: 5675009 - DNA, 14 bp, Homo sapiens
aaagtaaaattaga

SEQ ID NO: 5675010 - DNA, 17 bp, Homo sapiens
aaagtaaaattgtttca

SEQ ID NO: 5675011 - DNA, 14 bp, Homo sapiens
aaagtaaaccacaa

SEQ ID NO: 5675012 - DNA, 21 bp, Homo sapiens
aaagtaaaccacaaaaaaata

SEQ ID NO: 5675013 - DNA, 12 bp, Homo sapiens
aaagtaaacttg

SEQ ID NO: 5675014 - DNA, 17 bp, Homo sapiens
aaagtaaacttgtgtat

SEQ ID NO: 5675015 - DNA, 23 bp, Homo sapiens
aaagtaaagctaaaatgatttta

SEQ ID NO: 5675016 - DNA, 15 bp, Homo sapiens
aaagtaaaggcctcc

SEQ ID NO: 5675017 - DNA, 18 bp, Homo sapiens
aaagtaaaggcctcctcc

SEQ ID NO: 5675018 - DNA, 21 bp, Homo sapiens
aaagtaaaggcctcctccccc

SEQ ID NO: 5675019 - DNA, 22 bp, Homo sapiens
aaagtaaaggcctcctccccca

SEQ ID NO: 5675020 - DNA, 17 bp, Homo sapiens
aaagtaaatacaagact

SEQ ID NO: 5675021 - DNA, 12 bp, Homo sapiens
aaagtaaatctc

SEQ ID NO: 5675022 - DNA, 11 bp, Homo sapiens
aaagtaaatgg

SEQ ID NO: 5675023 - DNA, 14 bp, Homo sapiens
aaagtaaatgggag

SEQ ID NO: 5675024 - DNA, 13 bp, Homo sapiens
aaagtaaattgaa

SEQ ID NO: 5675025 - DNA, 15 bp, Homo sapiens
aaagtaacaatctat

SEQ ID NO: 5675026 - DNA, 20 bp, Homo sapiens
aaagtaactcatttgttaaa

SEQ ID NO: 5675027 - DNA, 11 bp, Homo sapiens
aaagtaactga

SEQ ID NO: 5675028 - DNA, 16 bp, Homo sapiens
aaagtaactgtgagaa

SEQ ID NO: 5675029 - DNA, 13 bp, Homo sapiens
aaagtaagacaca

SEQ ID NO: 5675030 - DNA, 20 bp, Homo sapiens
aaagtaagggaataaatttt

SEQ ID NO: 5675031 - DNA, 21 bp, Homo sapiens
aaagtaaggtgcttggagttt

SEQ ID NO: 5675032 - DNA, 21 bp, Homo sapiens
aaagtaagttaataatgtatt

SEQ ID NO: 5675033 - DNA, 12 bp, Homo sapiens
aaagtaataaag

SEQ ID NO: 5675034 - DNA, 14 bp, Homo sapiens
aaagtaataaagag

SEQ ID NO: 5675035 - DNA, 15 bp, Homo sapiens
aaagtaataaagaga

SEQ ID NO: 5675036 - DNA, 17 bp, Homo sapiens
aaagtaataaagagaaa

SEQ ID NO: 5675037 - DNA, 20 bp, Homo sapiens
aaagtaatcagcatatgtgt

SEQ ID NO: 5675038 - DNA, 16 bp, Homo sapiens
aaagtaatctactgta

SEQ ID NO: 5675039 - DNA, 21 bp, Homo sapiens
aaagtaatgaagaatcacgat

SEQ ID NO: 5675040 - DNA, 23 bp, Homo sapiens
aaagtaatgatgaaatctttctt

SEQ ID NO: 5675041 - DNA, 21 bp, Homo sapiens
aaagtaatgtatatctgtaat

SEQ ID NO: 5675042 - DNA, 12 bp, Homo sapiens
aaagtaatttaa

SEQ ID NO: 5675043 - DNA, 12 bp, Homo sapiens
aaagtaatttca

SEQ ID NO: 5675044 - DNA, 14 bp, Homo sapiens
aaagtaatttcaag

SEQ ID NO: 5675045 - DNA, 14 bp, Homo sapiens
aaagtaatttctaa

SEQ ID NO: 5675046 - DNA, 14 bp, Homo sapiens
aaagtaatttggaa

SEQ ID NO: 5675047 - DNA, 14 bp, Homo sapiens
aaagtaattttgtc

SEQ ID NO: 5675048 - DNA, 16 bp, Homo sapiens
aaagtaattttgtcac

SEQ ID NO: 5675049 - DNA, 17 bp, Homo sapiens
aaagtaattttgtcaca

SEQ ID NO: 5675050 - DNA, 18 bp, Homo sapiens
aaagtaattttgtcacat

SEQ ID NO: 5675051 - DNA, 19 bp, Homo sapiens
aaagtacaaccatagagga

SEQ ID NO: 5675052 - DNA, 15 bp, Homo sapiens
aaagtacaaggggat

SEQ ID NO: 5675053 - DNA, 13 bp, Homo sapiens
aaagtacagaata

SEQ ID NO: 5675054 - DNA, 21 bp, Homo sapiens
aaagtacagaatttgaattat

SEQ ID NO: 5675055 - DNA, 17 bp, Homo sapiens
aaagtacatagtgaatt

SEQ ID NO: 5675056 - DNA, 20 bp, Homo sapiens
aaagtacatagtgaatttta

SEQ ID NO: 5675057 - DNA, 17 bp, Homo sapiens
aaagtacatatttattt

SEQ ID NO: 5675058 - DNA, 16 bp, Homo sapiens
aaagtacatgttaaac

SEQ ID NO: 5675059 - DNA, 14 bp, Homo sapiens
aaagtacattgctt

SEQ ID NO: 5675060 - DNA, 14 bp, Homo sapiens
aaagtacattgtaa

SEQ ID NO: 5675061 - DNA, 20 bp, Homo sapiens
aaagtacattgtaaaataaa

SEQ ID NO: 5675062 - DNA, 12 bp, Homo sapiens
aaagtacattta

SEQ ID NO: 5675063 - DNA, 19 bp, Homo sapiens
aaagtacattttttgaaat

SEQ ID NO: 5675064 - DNA, 14 bp, Homo sapiens
aaagtaccacactg

SEQ ID NO: 5675065 - DNA, 19 bp, Homo sapiens
aaagtaccacactgagttc

SEQ ID NO: 5675066 - DNA, 20 bp, Homo sapiens
aaagtaccagcatgttaact

SEQ ID NO: 5675067 - DNA, 19 bp, Homo sapiens
aaagtactcctcacttttc

SEQ ID NO: 5675068 - DNA, 13 bp, Homo sapiens
aaagtactcttta

SEQ ID NO: 5675069 - DNA, 21 bp, Homo sapiens
aaagtactctttaacatacaa

SEQ ID NO: 5675070 - DNA, 23 bp, Homo sapiens
aaagtactctttaagagtgaaat

SEQ ID NO: 5675071 - DNA, 18 bp, Homo sapiens
aaagtactgagcagtgat

SEQ ID NO: 5675072 - DNA, 11 bp, Homo sapiens
aaagtactgta

SEQ ID NO: 5675073 - DNA, 20 bp, Homo sapiens
aaagtacttctccaccctgc

SEQ ID NO: 5675074 - DNA, 13 bp, Homo sapiens
aaagtacttgact

SEQ ID NO: 5675075 - DNA, 14 bp, Homo sapiens
aaagtactttaaaa

SEQ ID NO: 5675076 - DNA, 19 bp, Homo sapiens
aaagtactttaaaaaggaa

SEQ ID NO: 5675077 - DNA, 20 bp, Homo sapiens
aaagtactttaaaaaggaaa

SEQ ID NO: 5675078 - DNA, 21 bp, Homo sapiens
aaagtagaaaaaaaaataaca

SEQ ID NO: 5675079 - DNA, 23 bp, Homo sapiens
aaagtagaactcttaaatacttt

SEQ ID NO: 5675080 - DNA, 23 bp, Homo sapiens
aaagtagaattatatctaattta

SEQ ID NO: 5675081 - DNA, 13 bp, Homo sapiens
aaagtagagaagt

SEQ ID NO: 5675082 - DNA, 19 bp, Homo sapiens
aaagtagagaagtatccaa

SEQ ID NO: 5675083 - DNA, 20 bp, Homo sapiens
aaagtagagctagctgccac

SEQ ID NO: 5675084 - DNA, 19 bp, Homo sapiens
aaagtagattaaaatattt

SEQ ID NO: 5675085 - DNA, 21 bp, Homo sapiens
aaagtagattaaaatatttgc

SEQ ID NO: 5675086 - DNA, 22 bp, Homo sapiens
aaagtagattaaaatatttgcc

SEQ ID NO: 5675087 - DNA, 14 bp, Homo sapiens
aaagtagattaaga

SEQ ID NO: 5675088 - DNA, 19 bp, Homo sapiens
aaagtagcaaatgtttact

SEQ ID NO: 5675089 - DNA, 23 bp, Homo sapiens
aaagtagcaaatgtttactgtat

SEQ ID NO: 5675090 - DNA, 14 bp, Homo sapiens
aaagtaggaaagaa

SEQ ID NO: 5675091 - DNA, 15 bp, Homo sapiens
aaagtaggaaagaat

SEQ ID NO: 5675092 - DNA, 19 bp, Homo sapiens
aaagtaggaaagaatttgt

SEQ ID NO: 5675093 - DNA, 14 bp, Homo sapiens
aaagtaggctgccg

SEQ ID NO: 5675094 - DNA, 17 bp, Homo sapiens
aaagtaggtatacaaaa

SEQ ID NO: 5675095 - DNA, 19 bp, Homo sapiens
aaagtagtacttcttctgt

SEQ ID NO: 5675096 - DNA, 16 bp, Homo sapiens
aaagtagtgatgaaaa

SEQ ID NO: 5675097 - DNA, 16 bp, Homo sapiens
aaagtagttattttat

SEQ ID NO: 5675098 - DNA, 10 bp, Homo sapiens
aaagtagttc

SEQ ID NO: 5675099 - DNA, 20 bp, Homo sapiens
aaagtataacaattaaaatc

SEQ ID NO: 5675100 - DNA, 22 bp, Homo sapiens
aaagtataatgtttattaaatg

SEQ ID NO: 5675101 - DNA, 23 bp, Homo sapiens
aaagtataatgtttattaaatgc

SEQ ID NO: 5675102 - DNA, 21 bp, Homo sapiens
aaagtatagatacaaaacctt

SEQ ID NO: 5675103 - DNA, 17 bp, Homo sapiens
aaagtatatatagaatc

SEQ ID NO: 5675104 - DNA, 14 bp, Homo sapiens
aaagtatatgttag

SEQ ID NO: 5675105 - DNA, 20 bp, Homo sapiens
aaagtatcactctaaaaaac

SEQ ID NO: 5675106 - DNA, 23 bp, Homo sapiens
aaagtatcactctaaaaaacatt

SEQ ID NO: 5675107 - DNA, 12 bp, Homo sapiens
aaagtatcatgc

SEQ ID NO: 5675108 - DNA, 15 bp, Homo sapiens
aaagtatcatgcatt

SEQ ID NO: 5675109 - DNA, 19 bp, Homo sapiens
aaagtatcatggaaatatt

SEQ ID NO: 5675110 - DNA, 18 bp, Homo sapiens
aaagtatccctactgtaa

SEQ ID NO: 5675111 - DNA, 19 bp, Homo sapiens
aaagtatctctactttcct

SEQ ID NO: 5675112 - DNA, 20 bp, Homo sapiens
aaagtatctctactttcctg

SEQ ID NO: 5675113 - DNA, 18 bp, Homo sapiens
aaagtatgaatatttcat

SEQ ID NO: 5675114 - DNA, 19 bp, Homo sapiens
aaagtatgcaaaataaaga

SEQ ID NO: 5675115 - DNA, 18 bp, Homo sapiens
aaagtatgcattattaaa

SEQ ID NO: 5675116 - DNA, 21 bp, Homo sapiens
aaagtatggcagtgggagact

SEQ ID NO: 5675117 - DNA, 19 bp, Homo sapiens
aaagtatggtattgaaact

SEQ ID NO: 5675118 - DNA, 16 bp, Homo sapiens
aaagtatgtattattt

SEQ ID NO: 5675119 - DNA, 13 bp, Homo sapiens
aaagtatgtgttt

SEQ ID NO: 5675120 - DNA, 18 bp, Homo sapiens
aaagtatgttagtgcaaa

SEQ ID NO: 5675121 - DNA, 19 bp, Homo sapiens
aaagtatgttgtatatggt

SEQ ID NO: 5675122 - DNA, 20 bp, Homo sapiens
aaagtatgtttttaaatttt

SEQ ID NO: 5675123 - DNA, 17 bp, Homo sapiens
aaagtatgtttttacat

SEQ ID NO: 5675124 - DNA, 21 bp, Homo sapiens
aaagtatgtttttacattatg

SEQ ID NO: 5675125 - DNA, 13 bp, Homo sapiens
aaagtattaagca

SEQ ID NO: 5675126 - DNA, 16 bp, Homo sapiens
aaagtattattttcca

SEQ ID NO: 5675127 - DNA, 17 bp, Homo sapiens
aaagtattattttccaa

SEQ ID NO: 5675128 - DNA, 17 bp, Homo sapiens
aaagtattcaacaattt

SEQ ID NO: 5675129 - DNA, 14 bp, Homo sapiens
aaagtattcagaaa

SEQ ID NO: 5675130 - DNA, 15 bp, Homo sapiens
aaagtattcagaaat

SEQ ID NO: 5675131 - DNA, 16 bp, Homo sapiens
aaagtattccacctta

SEQ ID NO: 5675132 - DNA, 21 bp, Homo sapiens
aaagtattcgttacatcttgt

SEQ ID NO: 5675133 - DNA, 23 bp, Homo sapiens
aaagtattcgttacatcttgtag

SEQ ID NO: 5675134 - DNA, 19 bp, Homo sapiens
aaagtattctgtactctta

SEQ ID NO: 5675135 - DNA, 16 bp, Homo sapiens
aaagtattctttttct

SEQ ID NO: 5675136 - DNA, 18 bp, Homo sapiens
aaagtattgaaagccaac

SEQ ID NO: 5675137 - DNA, 23 bp, Homo sapiens
aaagtattgaaagccaacaactc

SEQ ID NO: 5675138 - DNA, 15 bp, Homo sapiens
aaagtattgccaaac

SEQ ID NO: 5675139 - DNA, 14 bp, Homo sapiens
aaagtattgtaaat

SEQ ID NO: 5675140 - DNA, 15 bp, Homo sapiens
aaagtattgtaaatt

SEQ ID NO: 5675141 - DNA, 16 bp, Homo sapiens
aaagtattgtaaatta

SEQ ID NO: 5675142 - DNA, 13 bp, Homo sapiens
aaagtattgtcta

SEQ ID NO: 5675143 - DNA, 18 bp, Homo sapiens
aaagtattgtgaaagtat

SEQ ID NO: 5675144 - DNA, 21 bp, Homo sapiens
aaagtattgtgtttatgcatt

SEQ ID NO: 5675145 - DNA, 19 bp, Homo sapiens
aaagtatttaattagtgct

SEQ ID NO: 5675146 - DNA, 20 bp, Homo sapiens
aaagtatttactgactgctt

SEQ ID NO: 5675147 - DNA, 21 bp, Homo sapiens
aaagtatttactttttaaaaa

SEQ ID NO: 5675148 - DNA, 20 bp, Homo sapiens
aaagtatttataaaaatata

SEQ ID NO: 5675149 - DNA, 21 bp, Homo sapiens
aaagtatttataaaaatataa

SEQ ID NO: 5675150 - DNA, 19 bp, Homo sapiens
aaagtatttgatgtacatt

SEQ ID NO: 5675151 - DNA, 20 bp, Homo sapiens
aaagtatttgatgtacatta

SEQ ID NO: 5675152 - DNA, 12 bp, Homo sapiens
aaagtattttct

SEQ ID NO: 5675153 - DNA, 13 bp, Homo sapiens
aaagtattttctt

SEQ ID NO: 5675154 - DNA, 16 bp, Homo sapiens
aaagtattttgaagtt

SEQ ID NO: 5675155 - DNA, 19 bp, Homo sapiens
aaagtatttttataatgac

SEQ ID NO: 5675156 - DNA, 16 bp, Homo sapiens
aaagtatttttgaaag

SEQ ID NO: 5675157 - DNA, 21 bp, Homo sapiens
aaagtatttttttaagttaga

SEQ ID NO: 5675158 - DNA, 23 bp, Homo sapiens
aaagtcaaaaaattatttgctat

SEQ ID NO: 5675159 - DNA, 15 bp, Homo sapiens
aaagtcaaactttca

SEQ ID NO: 5675160 - DNA, 16 bp, Homo sapiens
aaagtcaaatttactt

SEQ ID NO: 5675161 - DNA, 19 bp, Homo sapiens
aaagtcaacaaccatgcca

SEQ ID NO: 5675162 - DNA, 18 bp, Homo sapiens
aaagtcaaggacgaattt

SEQ ID NO: 5675163 - DNA, 19 bp, Homo sapiens
aaagtcaatgtacttgttt

SEQ ID NO: 5675164 - DNA, 14 bp, Homo sapiens
aaagtcacaatgtt

SEQ ID NO: 5675165 - DNA, 14 bp, Homo sapiens
aaagtcacacagac

SEQ ID NO: 5675166 - DNA, 23 bp, Homo sapiens
aaagtcacagccgtttgaatata

SEQ ID NO: 5675167 - DNA, 18 bp, Homo sapiens
aaagtcaccattctgcat

SEQ ID NO: 5675168 - DNA, 17 bp, Homo sapiens
aaagtcacccaaacact

SEQ ID NO: 5675169 - DNA, 20 bp, Homo sapiens
aaagtcacctacaggactgg

SEQ ID NO: 5675170 - DNA, 15 bp, Homo sapiens
aaagtcagaatatta

SEQ ID NO: 5675171 - DNA, 12 bp, Homo sapiens
aaagtcagagct

SEQ ID NO: 5675172 - DNA, 14 bp, Homo sapiens
aaagtcagatgttt

SEQ ID NO: 5675173 - DNA, 18 bp, Homo sapiens
aaagtcagattcttgcat

SEQ ID NO: 5675174 - DNA, 12 bp, Homo sapiens
aaagtcagattt

SEQ ID NO: 5675175 - DNA, 21 bp, Homo sapiens
aaagtcagctacaaaagttaa

SEQ ID NO: 5675176 - DNA, 20 bp, Homo sapiens
aaagtcagctttcagagcca

SEQ ID NO: 5675177 - DNA, 15 bp, Homo sapiens
aaagtcaggaatcat

SEQ ID NO: 5675178 - DNA, 16 bp, Homo sapiens
aaagtcaggtccaatt

SEQ ID NO: 5675179 - DNA, 18 bp, Homo sapiens
aaagtcagtatcatatta

SEQ ID NO: 5675180 - DNA, 15 bp, Homo sapiens
aaagtcataaatgca

SEQ ID NO: 5675181 - DNA, 21 bp, Homo sapiens
aaagtcatctttgagataatt

SEQ ID NO: 5675182 - DNA, 15 bp, Homo sapiens
aaagtcatgatgttt

SEQ ID NO: 5675183 - DNA, 22 bp, Homo sapiens
aaagtcatgatgtttttaaaat

SEQ ID NO: 5675184 - DNA, 19 bp, Homo sapiens
aaagtcatgcaaaggctgg

SEQ ID NO: 5675185 - DNA, 21 bp, Homo sapiens
aaagtcatgcaaaggctggga

SEQ ID NO: 5675186 - DNA, 22 bp, Homo sapiens
aaagtcattcagttatcactac

SEQ ID NO: 5675187 - DNA, 21 bp, Homo sapiens
aaagtcattgctgacagagcc

SEQ ID NO: 5675188 - DNA, 13 bp, Homo sapiens
aaagtcatttaaa

SEQ ID NO: 5675189 - DNA, 22 bp, Homo sapiens
aaagtccaagccgtaggaccca

SEQ ID NO: 5675190 - DNA, 23 bp, Homo sapiens
aaagtccctccctgcctgagggc

SEQ ID NO: 5675191 - DNA, 18 bp, Homo sapiens
aaagtcccttgagactcc

SEQ ID NO: 5675192 - DNA, 18 bp, Homo sapiens
aaagtccctttataaaga

SEQ ID NO: 5675193 - DNA, 15 bp, Homo sapiens
aaagtcctgctttcc

SEQ ID NO: 5675194 - DNA, 17 bp, Homo sapiens
aaagtcctggccctggc

SEQ ID NO: 5675195 - DNA, 14 bp, Homo sapiens
aaagtcctgtcacc

SEQ ID NO: 5675196 - DNA, 20 bp, Homo sapiens
aaagtccttgcaagaatgga

SEQ ID NO: 5675197 - DNA, 14 bp, Homo sapiens
aaagtccttttctt

SEQ ID NO: 5675198 - DNA, 22 bp, Homo sapiens
aaagtcctttttttccatcttt

SEQ ID NO: 5675199 - DNA, 15 bp, Homo sapiens
aaagtcgaattaata

SEQ ID NO: 5675200 - DNA, 21 bp, Homo sapiens
aaagtcgccagtcactgctgc

SEQ ID NO: 5675201 - DNA, 22 bp, Homo sapiens
aaagtctaaacaaaattgcaat

SEQ ID NO: 5675202 - DNA, 22 bp, Homo sapiens
aaagtctaaagtttacagtaaa

SEQ ID NO: 5675203 - DNA, 23 bp, Homo sapiens
aaagtctaagcaagatgttttgt

SEQ ID NO: 5675204 - DNA, 22 bp, Homo sapiens
aaagtctagaaaataatgcaaa

SEQ ID NO: 5675205 - DNA, 13 bp, Homo sapiens
aaagtctatgctt

SEQ ID NO: 5675206 - DNA, 17 bp, Homo sapiens
aaagtctattgtttgtt

SEQ ID NO: 5675207 - DNA, 22 bp, Homo sapiens
aaagtctatttttttaactgaa

SEQ ID NO: 5675208 - DNA, 15 bp, Homo sapiens
aaagtctcatagctt

SEQ ID NO: 5675209 - DNA, 16 bp, Homo sapiens
aaagtctccaccccta

SEQ ID NO: 5675210 - DNA, 19 bp, Homo sapiens
aaagtctccagaagaaaat

SEQ ID NO: 5675211 - DNA, 14 bp, Homo sapiens
aaagtctccagccc

SEQ ID NO: 5675212 - DNA, 17 bp, Homo sapiens
aaagtctcctgtatcat

SEQ ID NO: 5675213 - DNA, 15 bp, Homo sapiens
aaagtctctaattct

SEQ ID NO: 5675214 - DNA, 14 bp, Homo sapiens
aaagtctctattta

SEQ ID NO: 5675215 - DNA, 15 bp, Homo sapiens
aaagtctctatttaa

SEQ ID NO: 5675216 - DNA, 14 bp, Homo sapiens
aaagtctctgggtc

SEQ ID NO: 5675217 - DNA, 13 bp, Homo sapiens
aaagtctgagaaa

SEQ ID NO: 5675218 - DNA, 19 bp, Homo sapiens
aaagtctgagaaatttaca

SEQ ID NO: 5675219 - DNA, 23 bp, Homo sapiens
aaagtctgccgcccacctcgctc

SEQ ID NO: 5675220 - DNA, 23 bp, Homo sapiens
aaagtctgctctcatataagaca

SEQ ID NO: 5675221 - DNA, 17 bp, Homo sapiens
aaagtctgtgtccaatt

SEQ ID NO: 5675222 - DNA, 18 bp, Homo sapiens
aaagtctgttgattaaag

SEQ ID NO: 5675223 - DNA, 19 bp, Homo sapiens
aaagtctgttgattaaaga

SEQ ID NO: 5675224 - DNA, 17 bp, Homo sapiens
aaagtcttcaagggctg

SEQ ID NO: 5675225 - DNA, 20 bp, Homo sapiens
aaagtcttcactctctgaag

SEQ ID NO: 5675226 - DNA, 12 bp, Homo sapiens
aaagtcttctcc

SEQ ID NO: 5675227 - DNA, 22 bp, Homo sapiens
aaagtcttctcccaactcagcc

SEQ ID NO: 5675228 - DNA, 15 bp, Homo sapiens
aaagtcttctttcat

SEQ ID NO: 5675229 - DNA, 20 bp, Homo sapiens
aaagtcttgctgtggtctct

SEQ ID NO: 5675230 - DNA, 23 bp, Homo sapiens
aaagtcttgctgtggtctctttg

SEQ ID NO: 5675231 - DNA, 15 bp, Homo sapiens
aaagtcttgtgacta

SEQ ID NO: 5675232 - DNA, 14 bp, Homo sapiens
aaagtcttttaaaa

SEQ ID NO: 5675233 - DNA, 16 bp, Homo sapiens
aaagtcttttaaaaag

SEQ ID NO: 5675234 - DNA, 13 bp, Homo sapiens
aaagtgaaaaaaa

SEQ ID NO: 5675235 - DNA, 16 bp, Homo sapiens
aaagtgaaaaaaagaa

SEQ ID NO: 5675236 - DNA, 17 bp, Homo sapiens
aaagtgaaaaaaagaaa

SEQ ID NO: 5675237 - DNA, 14 bp, Homo sapiens
aaagtgaaagcaaa

SEQ ID NO: 5675238 - DNA, 16 bp, Homo sapiens
aaagtgaacagatttt

SEQ ID NO: 5675239 - DNA, 12 bp, Homo sapiens
aaagtgaacttt

SEQ ID NO: 5675240 - DNA, 16 bp, Homo sapiens
aaagtgaacttttgta

SEQ ID NO: 5675241 - DNA, 22 bp, Homo sapiens
aaagtgaagaagccatcaattt

SEQ ID NO: 5675242 - DNA, 21 bp, Homo sapiens
aaagtgaagaatttatctctt

SEQ ID NO: 5675243 - DNA, 12 bp, Homo sapiens
aaagtgaaggaa

SEQ ID NO: 5675244 - DNA, 20 bp, Homo sapiens
aaagtgaaggggaaacacac

SEQ ID NO: 5675245 - DNA, 20 bp, Homo sapiens
aaagtgaagtccagctccct

SEQ ID NO: 5675246 - DNA, 20 bp, Homo sapiens
aaagtgaagtgaatctgatt

SEQ ID NO: 5675247 - DNA, 14 bp, Homo sapiens
aaagtgaataaact

SEQ ID NO: 5675248 - DNA, 20 bp, Homo sapiens
aaagtgaataaacttcagca

SEQ ID NO: 5675249 - DNA, 15 bp, Homo sapiens
aaagtgaatgaaaga

SEQ ID NO: 5675250 - DNA, 18 bp, Homo sapiens
aaagtgaattgttgacaa

SEQ ID NO: 5675251 - DNA, 18 bp, Homo sapiens
aaataagtaacatataaa

SEQ ID NO: 5675252 - DNA, 16 bp, Homo sapiens
aaataagtaatatctt

SEQ ID NO: 5675253 - DNA, 13 bp, Homo sapiens
aaataagtcaaca

SEQ ID NO: 5675254 - DNA, 16 bp, Homo sapiens
aaataagtcaccattg

SEQ ID NO: 5675255 - DNA, 19 bp, Homo sapiens
aaataagtcattttaataa

SEQ ID NO: 5675256 - DNA, 17 bp, Homo sapiens
aaataagtctgatttaa

SEQ ID NO: 5675257 - DNA, 20 bp, Homo sapiens
aaataagtgaaattttaaaa

SEQ ID NO: 5675258 - DNA, 19 bp, Homo sapiens
aaataagtgccctctccca

SEQ ID NO: 5675259 - DNA, 20 bp, Homo sapiens
aaataagtggttatttctca

SEQ ID NO: 5675260 - DNA, 14 bp, Homo sapiens
aaataagtgtattt

SEQ ID NO: 5675261 - DNA, 17 bp, Homo sapiens
aaataagttaaaggcag

SEQ ID NO: 5675262 - DNA, 20 bp, Homo sapiens
aaataagttttatacataaa

SEQ ID NO: 5675263 - DNA, 16 bp, Homo sapiens
aaataataaaatgcaa

SEQ ID NO: 5675264 - DNA, 17 bp, Homo sapiens
aaataataaaatgcaaa

SEQ ID NO: 5675265 - DNA, 18 bp, Homo sapiens
aaataataaaatgcaaat

SEQ ID NO: 5675266 - DNA, 16 bp, Homo sapiens
aaataataaagatggt

SEQ ID NO: 5675267 - DNA, 16 bp, Homo sapiens
aaataataaattaaca

SEQ ID NO: 5675268 - DNA, 18 bp, Homo sapiens
aaataataaattaacatt

SEQ ID NO: 5675269 - DNA, 16 bp, Homo sapiens
aaataataaattgcat

SEQ ID NO: 5675270 - DNA, 18 bp, Homo sapiens
aaataataataaagtgtt

SEQ ID NO: 5675271 - DNA, 15 bp, Homo sapiens
aaataataatattta

SEQ ID NO: 5675272 - DNA, 21 bp, Homo sapiens
aaataatacatctttatcatt

SEQ ID NO: 5675273 - DNA, 20 bp, Homo sapiens
aaataatagatgtgaaaatg

SEQ ID NO: 5675274 - DNA, 14 bp, Homo sapiens
aaataatagggaaa

SEQ ID NO: 5675275 - DNA, 15 bp, Homo sapiens
aaataatataaaatg

SEQ ID NO: 5675276 - DNA, 19 bp, Homo sapiens
aaataatataaaatgtttc

SEQ ID NO: 5675277 - DNA, 14 bp, Homo sapiens
aaataatataaatg

SEQ ID NO: 5675278 - DNA, 13 bp, Homo sapiens
aaataatatactt

SEQ ID NO: 5675279 - DNA, 15 bp, Homo sapiens
aaataatatactttt

SEQ ID NO: 5675280 - DNA, 15 bp, Homo sapiens
aaataatatgtaaat

SEQ ID NO: 5675281 - DNA, 19 bp, Homo sapiens
aaataatattatattgtat

SEQ ID NO: 5675282 - DNA, 13 bp, Homo sapiens
aaataatattgat

SEQ ID NO: 5675283 - DNA, 15 bp, Homo sapiens
aaataatattgcctt

SEQ ID NO: 5675284 - DNA, 16 bp, Homo sapiens
aaataatcaaaccaaa

SEQ ID NO: 5675285 - DNA, 18 bp, Homo sapiens
aaataatcaagattttag

SEQ ID NO: 5675286 - DNA, 16 bp, Homo sapiens
aaataatcctctatgt

SEQ ID NO: 5675287 - DNA, 15 bp, Homo sapiens
aaataatctctgatt

SEQ ID NO: 5675288 - DNA, 12 bp, Homo sapiens
aaataatgaata

SEQ ID NO: 5675289 - DNA, 19 bp, Homo sapiens
aaataatgaataaactgaa

SEQ ID NO: 5675290 - DNA, 23 bp, Homo sapiens
aaataatgatcttggaatatttg

SEQ ID NO: 5675291 - DNA, 13 bp, Homo sapiens
aaataatgctaca

SEQ ID NO: 5675292 - DNA, 20 bp, Homo sapiens
aaataatgctacaattttaa

SEQ ID NO: 5675293 - DNA, 17 bp, Homo sapiens
aaataatgcttcagata

SEQ ID NO: 5675294 - DNA, 21 bp, Homo sapiens
aaataatgcttcagatattat

SEQ ID NO: 5675295 - DNA, 12 bp, Homo sapiens
aaataatggaaa

SEQ ID NO: 5675296 - DNA, 20 bp, Homo sapiens
aaataatggaaaaatagtaa

SEQ ID NO: 5675297 - DNA, 18 bp, Homo sapiens
aaataatgtaattgtaat

SEQ ID NO: 5675298 - DNA, 16 bp, Homo sapiens
aaataatgtatttact

SEQ ID NO: 5675299 - DNA, 13 bp, Homo sapiens
aaataatgtcttg

SEQ ID NO: 5675300 - DNA, 21 bp, Homo sapiens
aaataatgtcttgttaatatt

SEQ ID NO: 5675301 - DNA, 12 bp, Homo sapiens
aaataatgtgaa

SEQ ID NO: 5675302 - DNA, 19 bp, Homo sapiens
aaataattagctatatttt

SEQ ID NO: 5675303 - DNA, 16 bp, Homo sapiens
aaataattattttatt

SEQ ID NO: 5675304 - DNA, 14 bp, Homo sapiens
aaataattcttttt

SEQ ID NO: 5675305 - DNA, 9 bp, Homo sapiens
aaataattg

SEQ ID NO: 5675306 - DNA, 21 bp, Homo sapiens
aaataattgagactgaaagaa

SEQ ID NO: 5675307 - DNA, 14 bp, Homo sapiens
aaataattgccaca

SEQ ID NO: 5675308 - DNA, 17 bp, Homo sapiens
aaataattgttgttctg

SEQ ID NO: 5675309 - DNA, 17 bp, Homo sapiens
aaataatttaactaatt

SEQ ID NO: 5675310 - DNA, 15 bp, Homo sapiens
aaataatttaagttg

SEQ ID NO: 5675311 - DNA, 13 bp, Homo sapiens
aaataatttccta

SEQ ID NO: 5675312 - DNA, 21 bp, Homo sapiens
aaataatttgaatgtatttga

SEQ ID NO: 5675313 - DNA, 14 bp, Homo sapiens
aaataatttgcact

SEQ ID NO: 5675314 - DNA, 23 bp, Homo sapiens
aaataattttaaataacctctgg

SEQ ID NO: 5675315 - DNA, 13 bp, Homo sapiens
aaataattttaca

SEQ ID NO: 5675316 - DNA, 16 bp, Homo sapiens
aaataattttacatgt

SEQ ID NO: 5675317 - DNA, 18 bp, Homo sapiens
aaataattttattccaga

SEQ ID NO: 5675318 - DNA, 12 bp, Homo sapiens
aaataattttca

SEQ ID NO: 5675319 - DNA, 13 bp, Homo sapiens
aaataattttcca

SEQ ID NO: 5675320 - DNA, 15 bp, Homo sapiens
aaataattttccaag

SEQ ID NO: 5675321 - DNA, 23 bp, Homo sapiens
aaataattttccaagtaaagtga

SEQ ID NO: 5675322 - DNA, 14 bp, Homo sapiens
aaataattttctaa

SEQ ID NO: 5675323 - DNA, 15 bp, Homo sapiens
aaataatttttatat

SEQ ID NO: 5675324 - DNA, 21 bp, Homo sapiens
aaataatttttatatttgaaa

SEQ ID NO: 5675325 - DNA, 11 bp, Homo sapiens
aaatacaaaaa

SEQ ID NO: 5675326 - DNA, 12 bp, Homo sapiens
aaatacaaacaa

SEQ ID NO: 5675327 - DNA, 19 bp, Homo sapiens
aaatacaaacaagcacaga

SEQ ID NO: 5675328 - DNA, 18 bp, Homo sapiens
aaatacaaagtaaataca

SEQ ID NO: 5675329 - DNA, 12 bp, Homo sapiens
aaatacaaatct

SEQ ID NO: 5675330 - DNA, 15 bp, Homo sapiens
aaatacaaatctgta

SEQ ID NO: 5675331 - DNA, 16 bp, Homo sapiens
aaatacaaatctgtat

SEQ ID NO: 5675332 - DNA, 17 bp, Homo sapiens
aaatacaacacatctaa

SEQ ID NO: 5675333 - DNA, 16 bp, Homo sapiens
aaatacaacagaagtt

SEQ ID NO: 5675334 - DNA, 19 bp, Homo sapiens
aaatacaacttaaataata

SEQ ID NO: 5675335 - DNA, 14 bp, Homo sapiens
aaatacaagactgc

SEQ ID NO: 5675336 - DNA, 12 bp, Homo sapiens
aaatacaataaa

SEQ ID NO: 5675337 - DNA, 13 bp, Homo sapiens
aaatacaataaac

SEQ ID NO: 5675338 - DNA, 14 bp, Homo sapiens
aaatacaataaact

SEQ ID NO: 5675339 - DNA, 15 bp, Homo sapiens
aaatacaataaacta

SEQ ID NO: 5675340 - DNA, 14 bp, Homo sapiens
aaatacaatatgga

SEQ ID NO: 5675341 - DNA, 16 bp, Homo sapiens
aaatacaatcctgttt

SEQ ID NO: 5675342 - DNA, 14 bp, Homo sapiens
aaatacaattcaaa

SEQ ID NO: 5675343 - DNA, 19 bp, Homo sapiens
aaatacaattcaaacaatt

SEQ ID NO: 5675344 - DNA, 19 bp, Homo sapiens
aaatacaattcaaatgctt

SEQ ID NO: 5675345 - DNA, 14 bp, Homo sapiens
aaatacaattttgt

SEQ ID NO: 5675346 - DNA, 18 bp, Homo sapiens
aaatacaattttgtttct

SEQ ID NO: 5675347 - DNA, 20 bp, Homo sapiens
aaatacaattttgtttctgt

SEQ ID NO: 5675348 - DNA, 19 bp, Homo sapiens
aaatacacactcaaatcaa

SEQ ID NO: 5675349 - DNA, 12 bp, Homo sapiens
aaatacacatgg

SEQ ID NO: 5675350 - DNA, 14 bp, Homo sapiens
aaatacacatttgc

SEQ ID NO: 5675351 - DNA, 17 bp, Homo sapiens
aaatacaccacgaattt

SEQ ID NO: 5675352 - DNA, 17 bp, Homo sapiens
aaatacacgtgtatatg

SEQ ID NO: 5675353 - DNA, 18 bp, Homo sapiens
aaatacacgtgtatatga

SEQ ID NO: 5675354 - DNA, 19 bp, Homo sapiens
aaatacacgtgtatatgag

SEQ ID NO: 5675355 - DNA, 20 bp, Homo sapiens
aaatacactgaattgaatct

SEQ ID NO: 5675356 - DNA, 17 bp, Homo sapiens
aaatacagacactaagt

SEQ ID NO: 5675357 - DNA, 15 bp, Homo sapiens
aaatacagactggat

SEQ ID NO: 5675358 - DNA, 16 bp, Homo sapiens
aaatacagataaatga

SEQ ID NO: 5675359 - DNA, 14 bp, Homo sapiens
aaatacagataatt

SEQ ID NO: 5675360 - DNA, 23 bp, Homo sapiens
aaatacagataattcatttgtat

SEQ ID NO: 5675361 - DNA, 23 bp, Homo sapiens
aaatacagattttgatagcaaag

SEQ ID NO: 5675362 - DNA, 17 bp, Homo sapiens
aaatacagctgcactga

SEQ ID NO: 5675363 - DNA, 13 bp, Homo sapiens
aaatacagctggc

SEQ ID NO: 5675364 - DNA, 14 bp, Homo sapiens
aaatacagctggct

SEQ ID NO: 5675365 - DNA, 15 bp, Homo sapiens
aaatacagctggcta

SEQ ID NO: 5675366 - DNA, 16 bp, Homo sapiens
aaatacaggaaacagt

SEQ ID NO: 5675367 - DNA, 14 bp, Homo sapiens
aaatacagtattat

SEQ ID NO: 5675368 - DNA, 15 bp, Homo sapiens
aaatacagtattatt

SEQ ID NO: 5675369 - DNA, 22 bp, Homo sapiens
aaatacagttattaaaatgtta

SEQ ID NO: 5675370 - DNA, 20 bp, Homo sapiens
aaatacagtttgtcacatga

SEQ ID NO: 5675371 - DNA, 19 bp, Homo sapiens
aaatacataaaaaagtgtt

SEQ ID NO: 5675372 - DNA, 16 bp, Homo sapiens
aaatacataaaacaaa

SEQ ID NO: 5675373 - DNA, 21 bp, Homo sapiens
aaatacataaaagaatgtaca

SEQ ID NO: 5675374 - DNA, 22 bp, Homo sapiens
aaatacataaaagaatgtacag

SEQ ID NO: 5675375 - DNA, 14 bp, Homo sapiens
aaatacatagcatt

SEQ ID NO: 5675376 - DNA, 15 bp, Homo sapiens
aaatacatagtgaaa

SEQ ID NO: 5675377 - DNA, 17 bp, Homo sapiens
aaatacatagtgaaaat

SEQ ID NO: 5675378 - DNA, 22 bp, Homo sapiens
aaatacatataaagattaacac

SEQ ID NO: 5675379 - DNA, 21 bp, Homo sapiens
aaatacatatcgctgacttca

SEQ ID NO: 5675380 - DNA, 16 bp, Homo sapiens
aaatacatatttccaa

SEQ ID NO: 5675381 - DNA, 12 bp, Homo sapiens
aaatacatcaaa

SEQ ID NO: 5675382 - DNA, 14 bp, Homo sapiens
aaatacatcaagga

SEQ ID NO: 5675383 - DNA, 15 bp, Homo sapiens
aaatacatcaaggag

SEQ ID NO: 5675384 - DNA, 19 bp, Homo sapiens
aaatacatcctttttctgc

SEQ ID NO: 5675385 - DNA, 12 bp, Homo sapiens
aaatacatgaag

SEQ ID NO: 5675386 - DNA, 14 bp, Homo sapiens
aaatacatgaagct

SEQ ID NO: 5675387 - DNA, 19 bp, Homo sapiens
aaatacatgccacatcaaa

SEQ ID NO: 5675388 - DNA, 21 bp, Homo sapiens
aaatacatgcctttccagtgc

SEQ ID NO: 5675389 - DNA, 12 bp, Homo sapiens
aaatacatgtgt

SEQ ID NO: 5675390 - DNA, 22 bp, Homo sapiens
aaatacatgtgtggatgtgtaa

SEQ ID NO: 5675391 - DNA, 14 bp, Homo sapiens
aaatacatgtttgt

SEQ ID NO: 5675392 - DNA, 16 bp, Homo sapiens
aaatacattattgaaa

SEQ ID NO: 5675393 - DNA, 19 bp, Homo sapiens
aaatacattcaaattcttt

SEQ ID NO: 5675394 - DNA, 13 bp, Homo sapiens
aaatacattccag

SEQ ID NO: 5675395 - DNA, 18 bp, Homo sapiens
aaatacattgtatatatg

SEQ ID NO: 5675396 - DNA, 17 bp, Homo sapiens
aaatacatttaaaacat

SEQ ID NO: 5675397 - DNA, 12 bp, Homo sapiens
aaatacatttag

SEQ ID NO: 5675398 - DNA, 16 bp, Homo sapiens
aaatacatttatattt

SEQ ID NO: 5675399 - DNA, 14 bp, Homo sapiens
aaatacatttgtaa

SEQ ID NO: 5675400 - DNA, 15 bp, Homo sapiens
aaataccaaagcagt

SEQ ID NO: 5675401 - DNA, 16 bp, Homo sapiens
aaataccaagagcaat

SEQ ID NO: 5675402 - DNA, 19 bp, Homo sapiens
aaataccacaagcctgaga

SEQ ID NO: 5675403 - DNA, 20 bp, Homo sapiens
aaataccacaatcaccgatg

SEQ ID NO: 5675404 - DNA, 18 bp, Homo sapiens
aaataccactagtggaaa

SEQ ID NO: 5675405 - DNA, 14 bp, Homo sapiens
aaataccactgtaa

SEQ ID NO: 5675406 - DNA, 18 bp, Homo sapiens
aaataccactgtaattga

SEQ ID NO: 5675407 - DNA, 13 bp, Homo sapiens
aaataccagagca

SEQ ID NO: 5675408 - DNA, 20 bp, Homo sapiens
aaataccagccagtaaatgg

SEQ ID NO: 5675409 - DNA, 13 bp, Homo sapiens
aaataccaggacc

SEQ ID NO: 5675410 - DNA, 21 bp, Homo sapiens
aaataccagtgaaccaaagag

SEQ ID NO: 5675411 - DNA, 17 bp, Homo sapiens
aaataccagtgtggttt

SEQ ID NO: 5675412 - DNA, 15 bp, Homo sapiens
aaataccattattat

SEQ ID NO: 5675413 - DNA, 14 bp, Homo sapiens
aaataccattgaaa

SEQ ID NO: 5675414 - DNA, 15 bp, Homo sapiens
aaataccattgaaat

SEQ ID NO: 5675415 - DNA, 17 bp, Homo sapiens
aaataccattgaaatca

SEQ ID NO: 5675416 - DNA, 20 bp, Homo sapiens
aaataccattgaaatcagca

SEQ ID NO: 5675417 - DNA, 12 bp, Homo sapiens
aaataccattta

SEQ ID NO: 5675418 - DNA, 21 bp, Homo sapiens
aaatacccgttaccatattta

SEQ ID NO: 5675419 - DNA, 17 bp, Homo sapiens
aaatacctcaatttttg

SEQ ID NO: 5675420 - DNA, 14 bp, Homo sapiens
aaatacctcaggaa

SEQ ID NO: 5675421 - DNA, 17 bp, Homo sapiens
aaatacctcaggaaaga

SEQ ID NO: 5675422 - DNA, 18 bp, Homo sapiens
aaatacctcaggaaagaa

SEQ ID NO: 5675423 - DNA, 15 bp, Homo sapiens
aaatacctcatgttt

SEQ ID NO: 5675424 - DNA, 16 bp, Homo sapiens
aaatacctcatgttta

SEQ ID NO: 5675425 - DNA, 20 bp, Homo sapiens
aaatacctccattaaatggt

SEQ ID NO: 5675426 - DNA, 20 bp, Homo sapiens
aaatacctctggcttagaaa

SEQ ID NO: 5675427 - DNA, 18 bp, Homo sapiens
aaatacctcttagctgag

SEQ ID NO: 5675428 - DNA, 18 bp, Homo sapiens
aaataccttctatgtatt

SEQ ID NO: 5675429 - DNA, 19 bp, Homo sapiens
aaataccttctatgtatta

SEQ ID NO: 5675430 - DNA, 15 bp, Homo sapiens
aaatacctttaaatt

SEQ ID NO: 5675431 - DNA, 21 bp, Homo sapiens
aaatacctttgtagttactca

SEQ ID NO: 5675432 - DNA, 17 bp, Homo sapiens
agacagttaaactggct

SEQ ID NO: 5675433 - DNA, 18 bp, Homo sapiens
agacagttaaactggctt

SEQ ID NO: 5675434 - DNA, 16 bp, Homo sapiens
agacagttcttttcta

SEQ ID NO: 5675435 - DNA, 20 bp, Homo sapiens
agacagttggttttgcatgt

SEQ ID NO: 5675436 - DNA, 14 bp, Homo sapiens
agacagtttcttgc

SEQ ID NO: 5675437 - DNA, 19 bp, Homo sapiens
agacagtttcttgcaagct

SEQ ID NO: 5675438 - DNA, 13 bp, Homo sapiens
agacagtttgtaa

SEQ ID NO: 5675439 - DNA, 15 bp, Homo sapiens
agacataaaacttta

SEQ ID NO: 5675440 - DNA, 21 bp, Homo sapiens
agacataaaactttaaaaggc

SEQ ID NO: 5675441 - DNA, 12 bp, Homo sapiens
agacataaacaa

SEQ ID NO: 5675442 - DNA, 13 bp, Homo sapiens
agacataaacaaa

SEQ ID NO: 5675443 - DNA, 15 bp, Homo sapiens
agacataaacaaaga

SEQ ID NO: 5675444 - DNA, 14 bp, Homo sapiens
agacataaaggaaa

SEQ ID NO: 5675445 - DNA, 14 bp, Homo sapiens
agacataaattgta

SEQ ID NO: 5675446 - DNA, 17 bp, Homo sapiens
agacataacgtttttcc

SEQ ID NO: 5675447 - DNA, 18 bp, Homo sapiens
agacatacgaaacacaaa

SEQ ID NO: 5675448 - DNA, 19 bp, Homo sapiens
agacatactaaccagcaga

SEQ ID NO: 5675449 - DNA, 23 bp, Homo sapiens
agacatactaaccagcagaaatg

SEQ ID NO: 5675450 - DNA, 22 bp, Homo sapiens
agacatactccttccatcaaat

SEQ ID NO: 5675451 - DNA, 19 bp, Homo sapiens
agacatacttgaagggcca

SEQ ID NO: 5675452 - DNA, 15 bp, Homo sapiens
agacatagtctctac

SEQ ID NO: 5675453 - DNA, 17 bp, Homo sapiens
agacatatattatatat

SEQ ID NO: 5675454 - DNA, 19 bp, Homo sapiens
agacatatattatatatag

SEQ ID NO: 5675455 - DNA, 21 bp, Homo sapiens
agacatatattatatatagaa

SEQ ID NO: 5675456 - DNA, 16 bp, Homo sapiens
agacatattcttggag

SEQ ID NO: 5675457 - DNA, 14 bp, Homo sapiens
agacatatttacaa

SEQ ID NO: 5675458 - DNA, 20 bp, Homo sapiens
agacatcaagcacagaagga

SEQ ID NO: 5675459 - DNA, 16 bp, Homo sapiens
agacatcaagctcaag

SEQ ID NO: 5675460 - DNA, 18 bp, Homo sapiens
agacatcaagctcaaggc

SEQ ID NO: 5675461 - DNA, 12 bp, Homo sapiens
agacatcaatga

SEQ ID NO: 5675462 - DNA, 15 bp, Homo sapiens
agacatcaatgaaac

SEQ ID NO: 5675463 - DNA, 23 bp, Homo sapiens
agacatcagcctccttctttcac

SEQ ID NO: 5675464 - DNA, 12 bp, Homo sapiens
agacatcaggga

SEQ ID NO: 5675465 - DNA, 23 bp, Homo sapiens
agacatcagtctccaacatgttt

SEQ ID NO: 5675466 - DNA, 20 bp, Homo sapiens
agacatcatgaattttacat

SEQ ID NO: 5675467 - DNA, 18 bp, Homo sapiens
agacatccataaagaagc

SEQ ID NO: 5675468 - DNA, 22 bp, Homo sapiens
agacatccatgtttgtaaaact

SEQ ID NO: 5675469 - DNA, 23 bp, Homo sapiens
agacatccccctccttgccgctg

SEQ ID NO: 5675470 - DNA, 20 bp, Homo sapiens
agacatccctcatctagtct

SEQ ID NO: 5675471 - DNA, 22 bp, Homo sapiens
agacatcctcaaaagaaagaga

SEQ ID NO: 5675472 - DNA, 24 bp, Homo sapiens
agacatcctgtgatgtcatgaaag

SEQ ID NO: 5675473 - DNA, 16 bp, Homo sapiens
agacatctactacagc

SEQ ID NO: 5675474 - DNA, 14 bp, Homo sapiens
agacatctcaaata

SEQ ID NO: 5675475 - DNA, 22 bp, Homo sapiens
agacatctcaggatttcaccag

SEQ ID NO: 5675476 - DNA, 14 bp, Homo sapiens
agacatctctgcac

SEQ ID NO: 5675477 - DNA, 17 bp, Homo sapiens
agacatctctggagcca

SEQ ID NO: 5675478 - DNA, 19 bp, Homo sapiens
agacatctctggagccaga

SEQ ID NO: 5675479 - DNA, 21 bp, Homo sapiens
agacatctctggagccagaga

SEQ ID NO: 5675480 - DNA, 17 bp, Homo sapiens
agacatctgcctgtaat

SEQ ID NO: 5675481 - DNA, 18 bp, Homo sapiens
agacatctgcctgtaatt

SEQ ID NO: 5675482 - DNA, 19 bp, Homo sapiens
agacatctgcctgtaatta

SEQ ID NO: 5675483 - DNA, 23 bp, Homo sapiens
agacatgaaaggttggccttact

SEQ ID NO: 5675484 - DNA, 16 bp, Homo sapiens
agacatgaaataaaga

SEQ ID NO: 5675485 - DNA, 21 bp, Homo sapiens
agacatgagaaagggagagga

SEQ ID NO: 5675486 - DNA, 15 bp, Homo sapiens
agacatgatttcctt

SEQ ID NO: 5675487 - DNA, 14 bp, Homo sapiens
agacatgcagagat

SEQ ID NO: 5675488 - DNA, 19 bp, Homo sapiens
agacatgcagcctaaggct

SEQ ID NO: 5675489 - DNA, 23 bp, Homo sapiens
agacatgcatttttaaaactagc

SEQ ID NO: 5675490 - DNA, 18 bp, Homo sapiens
agacatgccaactcggga

SEQ ID NO: 5675491 - DNA, 23 bp, Homo sapiens
agacatgccacaaggacttcctg

SEQ ID NO: 5675492 - DNA, 16 bp, Homo sapiens
agacatgcccaaaact

SEQ ID NO: 5675493 - DNA, 15 bp, Homo sapiens
agacatgctgacttt

SEQ ID NO: 5675494 - DNA, 12 bp, Homo sapiens
agacatgctgcc

SEQ ID NO: 5675495 - DNA, 17 bp, Homo sapiens
agacatgctttccattt

SEQ ID NO: 5675496 - DNA, 14 bp, Homo sapiens
agacatggaccagc

SEQ ID NO: 5675497 - DNA, 15 bp, Homo sapiens
agacatggaccagca

SEQ ID NO: 5675498 - DNA, 15 bp, Homo sapiens
agacatggacctcca

SEQ ID NO: 5675499 - DNA, 19 bp, Homo sapiens
agacatggacctccaggct

SEQ ID NO: 5675500 - DNA, 19 bp, Homo sapiens
agacatggaccttctctcc

SEQ ID NO: 5675501 - DNA, 13 bp, Homo sapiens
agacatggagact

SEQ ID NO: 5675502 - DNA, 18 bp, Homo sapiens
agacatggagactcctgc

SEQ ID NO: 5675503 - DNA, 17 bp, Homo sapiens
agacatggaggggatga

SEQ ID NO: 5675504 - DNA, 17 bp, Homo sapiens
agacatggaggttctaa

SEQ ID NO: 5675505 - DNA, 20 bp, Homo sapiens
agacatggatgcgaggacca

SEQ ID NO: 5675506 - DNA, 21 bp, Homo sapiens
agacatggatgcgaggaccac

SEQ ID NO: 5675507 - DNA, 14 bp, Homo sapiens
agacatggatttga

SEQ ID NO: 5675508 - DNA, 15 bp, Homo sapiens
agacatggcctctgg

SEQ ID NO: 5675509 - DNA, 16 bp, Homo sapiens
agacatggcctctgga

SEQ ID NO: 5675510 - DNA, 21 bp, Homo sapiens
agacatggctttcagaaaacg

SEQ ID NO: 5675511 - DNA, 19 bp, Homo sapiens
agacatggggaggaaggac

SEQ ID NO: 5675512 - DNA, 19 bp, Homo sapiens
agacatgtaggtgtttgtt

SEQ ID NO: 5675513 - DNA, 22 bp, Homo sapiens
agacatgtaggtgtttgttcat

SEQ ID NO: 5675514 - DNA, 20 bp, Homo sapiens
agacatgtctgttctacata

SEQ ID NO: 5675515 - DNA, 15 bp, Homo sapiens
agacatgtgacattt

SEQ ID NO: 5675516 - DNA, 16 bp, Homo sapiens
agacatgtgacattta

SEQ ID NO: 5675517 - DNA, 17 bp, Homo sapiens
agacatgtgacatttat

SEQ ID NO: 5675518 - DNA, 19 bp, Homo sapiens
agacatgttttagacaaat

SEQ ID NO: 5675519 - DNA, 12 bp, Homo sapiens
agacattaaatc

SEQ ID NO: 5675520 - DNA, 15 bp, Homo sapiens
agacattaaatctat

SEQ ID NO: 5675521 - DNA, 14 bp, Homo sapiens
agacattagagaaa

SEQ ID NO: 5675522 - DNA, 22 bp, Homo sapiens
agacattagagagatttttcat

SEQ ID NO: 5675523 - DNA, 15 bp, Homo sapiens
agacattatcttttg

SEQ ID NO: 5675524 - DNA, 20 bp, Homo sapiens
agacattatcttttggctct

SEQ ID NO: 5675525 - DNA, 15 bp, Homo sapiens
agacattcaatgaat

SEQ ID NO: 5675526 - DNA, 16 bp, Homo sapiens
agacattccaaaacga

SEQ ID NO: 5675527 - DNA, 17 bp, Homo sapiens
agacattcctgggcaca

SEQ ID NO: 5675528 - DNA, 20 bp, Homo sapiens
agacattccttctacatgta

SEQ ID NO: 5675529 - DNA, 21 bp, Homo sapiens
agacattctcgcttccctgaa

SEQ ID NO: 5675530 - DNA, 20 bp, Homo sapiens
agacattctcttactttttg

SEQ ID NO: 5675531 - DNA, 16 bp, Homo sapiens
agacattgacagcaat

SEQ ID NO: 5675532 - DNA, 20 bp, Homo sapiens
agacattgacagcaattcat

SEQ ID NO: 5675533 - DNA, 23 bp, Homo sapiens
agacattgatggggacatttctt

SEQ ID NO: 5675534 - DNA, 13 bp, Homo sapiens
agacattgcctcc

SEQ ID NO: 5675535 - DNA, 20 bp, Homo sapiens
agacattgctctatgtctgc

SEQ ID NO: 5675536 - DNA, 22 bp, Homo sapiens
agacattgctctatgtctgcct

SEQ ID NO: 5675537 - DNA, 23 bp, Homo sapiens
agacattgctctatgtctgcctt

SEQ ID NO: 5675538 - DNA, 18 bp, Homo sapiens
agacattgggtctattcc

SEQ ID NO: 5675539 - DNA, 22 bp, Homo sapiens
agacattgggtctattccagct

SEQ ID NO: 5675540 - DNA, 23 bp, Homo sapiens
agacattgggtctattccagctc

SEQ ID NO: 5675541 - DNA, 20 bp, Homo sapiens
agacattgtaaataaatttt

SEQ ID NO: 5675542 - DNA, 13 bp, Homo sapiens
agacattgtcaat

SEQ ID NO: 5675543 - DNA, 21 bp, Homo sapiens
agacatttaaaatagttttct

SEQ ID NO: 5675544 - DNA, 17 bp, Homo sapiens
agacatttatactcttt

SEQ ID NO: 5675545 - DNA, 13 bp, Homo sapiens
agacatttatctt

SEQ ID NO: 5675546 - DNA, 13 bp, Homo sapiens
agacatttatgtg

SEQ ID NO: 5675547 - DNA, 15 bp, Homo sapiens
agacatttcaaataa

SEQ ID NO: 5675548 - DNA, 19 bp, Homo sapiens
agacatttctgctctcagc

SEQ ID NO: 5675549 - DNA, 22 bp, Homo sapiens
agacatttcttttctttttaca

SEQ ID NO: 5675550 - DNA, 21 bp, Homo sapiens
agacatttgatagaaaggaac

SEQ ID NO: 5675551 - DNA, 17 bp, Homo sapiens
agacatttgccttttgt

SEQ ID NO: 5675552 - DNA, 21 bp, Homo sapiens
agacatttgctatgagctggg

SEQ ID NO: 5675553 - DNA, 13 bp, Homo sapiens
agacatttgctga

SEQ ID NO: 5675554 - DNA, 23 bp, Homo sapiens
agacatttgctgaactcagcaca

SEQ ID NO: 5675555 - DNA, 20 bp, Homo sapiens
agacatttgttattttggaa

SEQ ID NO: 5675556 - DNA, 15 bp, Homo sapiens
agacatttgtttgct

SEQ ID NO: 5675557 - DNA, 15 bp, Homo sapiens
agacattttaacaag

SEQ ID NO: 5675558 - DNA, 21 bp, Homo sapiens
agacattttaacaagaagatg

SEQ ID NO: 5675559 - DNA, 13 bp, Homo sapiens
agacattttaagg

SEQ ID NO: 5675560 - DNA, 12 bp, Homo sapiens
agacattttcat

SEQ ID NO: 5675561 - DNA, 14 bp, Homo sapiens
agacattttcatat

SEQ ID NO: 5675562 - DNA, 13 bp, Homo sapiens
agacattttcatg

SEQ ID NO: 5675563 - DNA, 23 bp, Homo sapiens
agacattttcctcacacccacct

SEQ ID NO: 5675564 - DNA, 13 bp, Homo sapiens
agacattttgaaa

SEQ ID NO: 5675565 - DNA, 18 bp, Homo sapiens
agacattttgtgtgagac

SEQ ID NO: 5675566 - DNA, 12 bp, Homo sapiens
agacattttgtt

SEQ ID NO: 5675567 - DNA, 18 bp, Homo sapiens
agacattttgtttttact

SEQ ID NO: 5675568 - DNA, 19 bp, Homo sapiens
agacattttgtttttactg

SEQ ID NO: 5675569 - DNA, 21 bp, Homo sapiens
agacattttgtttttactgta

SEQ ID NO: 5675570 - DNA, 13 bp, Homo sapiens
agacatttttcat

SEQ ID NO: 5675571 - DNA, 20 bp, Homo sapiens
agacatttttcattcatgaa

SEQ ID NO: 5675572 - DNA, 22 bp, Homo sapiens
agacattttttgctataatcat

SEQ ID NO: 5675573 - DNA, 21 bp, Homo sapiens
agaccaaaaggagagattatt

SEQ ID NO: 5675574 - DNA, 18 bp, Homo sapiens
agaccaaaataatacaac

SEQ ID NO: 5675575 - DNA, 14 bp, Homo sapiens
agaccaaaatgaaa

SEQ ID NO: 5675576 - DNA, 16 bp, Homo sapiens
agaccaaacagtgctg

SEQ ID NO: 5675577 - DNA, 22 bp, Homo sapiens
agaccaaagagcctgtcgatga

SEQ ID NO: 5675578 - DNA, 16 bp, Homo sapiens
agaccaaaggaaggaa

SEQ ID NO: 5675579 - DNA, 19 bp, Homo sapiens
agaccaaataattaaaaga

SEQ ID NO: 5675580 - DNA, 14 bp, Homo sapiens
agaccaaatgtagt

SEQ ID NO: 5675581 - DNA, 21 bp, Homo sapiens
agaccaaattttgaggtcttt

SEQ ID NO: 5675582 - DNA, 14 bp, Homo sapiens
agaccaaccctggg

SEQ ID NO: 5675583 - DNA, 18 bp, Homo sapiens
agaccaacgttactcagg

SEQ ID NO: 5675584 - DNA, 17 bp, Homo sapiens
agaccaagactctgaaa

SEQ ID NO: 5675585 - DNA, 21 bp, Homo sapiens
agaccaagcttagtcctggga

SEQ ID NO: 5675586 - DNA, 13 bp, Homo sapiens
agaccaagcttgt

SEQ ID NO: 5675587 - DNA, 16 bp, Homo sapiens
agaccaagcttgtcca

SEQ ID NO: 5675588 - DNA, 21 bp, Homo sapiens
agaccaagcttgtttccctgc

SEQ ID NO: 5675589 - DNA, 11 bp, Homo sapiens
agaccaaggaa

SEQ ID NO: 5675590 - DNA, 14 bp, Homo sapiens
agaccaaggaacaa

SEQ ID NO: 5675591 - DNA, 23 bp, Homo sapiens
agaccaaggcgggagcatctctt

SEQ ID NO: 5675592 - DNA, 17 bp, Homo sapiens
agaccaagtccaagccc

SEQ ID NO: 5675593 - DNA, 20 bp, Homo sapiens
agaccaataaacttcctttt

SEQ ID NO: 5675594 - DNA, 21 bp, Homo sapiens
agaccaataaatttgtaactt

SEQ ID NO: 5675595 - DNA, 15 bp, Homo sapiens
agaccaatgtgaaga

SEQ ID NO: 5675596 - DNA, 13 bp, Homo sapiens
agaccaattgaag

SEQ ID NO: 5675597 - DNA, 19 bp, Homo sapiens
agaccaattgaagcatgaa

SEQ ID NO: 5675598 - DNA, 14 bp, Homo sapiens
agaccacaaatagt

SEQ ID NO: 5675599 - DNA, 19 bp, Homo sapiens
agaccacaaggctgaaaag

SEQ ID NO: 5675600 - DNA, 24 bp, Homo sapiens
agaccacactgcacacagtgactt

SEQ ID NO: 5675601 - DNA, 23 bp, Homo sapiens
agaccacactttgggacttggga

SEQ ID NO: 5675602 - DNA, 16 bp, Homo sapiens
agaccacagaggctca

SEQ ID NO: 5675603 - DNA, 14 bp, Homo sapiens
agaccacaggaaga

SEQ ID NO: 5675604 - DNA, 21 bp, Homo sapiens
agaccacagtttacctcaggt

SEQ ID NO: 5675605 - DNA, 13 bp, Homo sapiens
agaccacatcttt

SEQ ID NO: 5675606 - DNA, 14 bp, Homo sapiens
agaccacatgcccc

SEQ ID NO: 5675607 - DNA, 23 bp, Homo sapiens
agaccacatgcgctcctggcttt

SEQ ID NO: 5675608 - DNA, 14 bp, Homo sapiens
agaccaccaagcct

SEQ ID NO: 5675609 - DNA, 12 bp, Homo sapiens
cctaaggacttc

SEQ ID NO: 5675610 - DNA, 24 bp, Homo sapiens
cctaaggatctctcaggagcacag

SEQ ID NO: 5675611 - DNA, 22 bp, Homo sapiens
cctaaggcaacatttccgaaga

SEQ ID NO: 5675612 - DNA, 17 bp, Homo sapiens
cctaaggcccagctgcc

SEQ ID NO: 5675613 - DNA, 18 bp, Homo sapiens
cctaaggcccagctgcca

SEQ ID NO: 5675614 - DNA, 20 bp, Homo sapiens
cctaaggcccagctgccagg

SEQ ID NO: 5675615 - DNA, 23 bp, Homo sapiens
cctaagggacatgttttgataaa

SEQ ID NO: 5675616 - DNA, 18 bp, Homo sapiens
cctaagggagacaggcct

SEQ ID NO: 5675617 - DNA, 13 bp, Homo sapiens
cctaagggcagcc

SEQ ID NO: 5675618 - DNA, 16 bp, Homo sapiens
cctaagggcagccctc

SEQ ID NO: 5675619 - DNA, 18 bp, Homo sapiens
cctaaggggagctacagc

SEQ ID NO: 5675620 - DNA, 22 bp, Homo sapiens
cctaagggtagaaaactccagg

SEQ ID NO: 5675621 - DNA, 23 bp, Homo sapiens
cctaagggtagaaaactccaggg

SEQ ID NO: 5675622 - DNA, 21 bp, Homo sapiens
cctaaggttcttgctttctct

SEQ ID NO: 5675623 - DNA, 19 bp, Homo sapiens
cctaagtaaatctaaatta

SEQ ID NO: 5675624 - DNA, 20 bp, Homo sapiens
cctaagtaagtttcttcctg

SEQ ID NO: 5675625 - DNA, 12 bp, Homo sapiens
cctaagtactgt

SEQ ID NO: 5675626 - DNA, 18 bp, Homo sapiens
cctaagtactgtaataat

SEQ ID NO: 5675627 - DNA, 15 bp, Homo sapiens
cctaagtcaggtaat

SEQ ID NO: 5675628 - DNA, 22 bp, Homo sapiens
cctaagtcattcctccagtgca

SEQ ID NO: 5675629 - DNA, 13 bp, Homo sapiens
cctaagtccaact

SEQ ID NO: 5675630 - DNA, 18 bp, Homo sapiens
cctaagtccctgccccct

SEQ ID NO: 5675631 - DNA, 18 bp, Homo sapiens
cctaagtcccttcctatt

SEQ ID NO: 5675632 - DNA, 21 bp, Homo sapiens
cctaagtccttccacctgcca

SEQ ID NO: 5675633 - DNA, 17 bp, Homo sapiens
cctaagtgcccaaagtg

SEQ ID NO: 5675634 - DNA, 21 bp, Homo sapiens
cctaagtgcctcttctttttc

SEQ ID NO: 5675635 - DNA, 15 bp, Homo sapiens
cctaagtggctgctg

SEQ ID NO: 5675636 - DNA, 17 bp, Homo sapiens
cctaagtgtgtactagt

SEQ ID NO: 5675637 - DNA, 18 bp, Homo sapiens
cctaataaaactgatgtg

SEQ ID NO: 5675638 - DNA, 18 bp, Homo sapiens
cctaataaacatccttca

SEQ ID NO: 5675639 - DNA, 15 bp, Homo sapiens
cctaataaagagact

SEQ ID NO: 5675640 - DNA, 13 bp, Homo sapiens
cctaataaagctg

SEQ ID NO: 5675641 - DNA, 23 bp, Homo sapiens
cctaataaagctgtgtggcagtc

SEQ ID NO: 5675642 - DNA, 20 bp, Homo sapiens
cctaataatatcccactggg

SEQ ID NO: 5675643 - DNA, 17 bp, Homo sapiens
cctaataattgtatcta

SEQ ID NO: 5675644 - DNA, 18 bp, Homo sapiens
cctaatacattaaagcag

SEQ ID NO: 5675645 - DNA, 19 bp, Homo sapiens
cctaatagccttttgtaac

SEQ ID NO: 5675646 - DNA, 13 bp, Homo sapiens
cctaatatcattt

SEQ ID NO: 5675647 - DNA, 11 bp, Homo sapiens
cctaatatgat

SEQ ID NO: 5675648 - DNA, 15 bp, Homo sapiens
cctaatattcatgct

SEQ ID NO: 5675649 - DNA, 23 bp, Homo sapiens
cctaatattcatgctgcctgcca

SEQ ID NO: 5675650 - DNA, 17 bp, Homo sapiens
cctaatattgaaaatgt

SEQ ID NO: 5675651 - DNA, 21 bp, Homo sapiens
cctaatatttaggcaagagaa

SEQ ID NO: 5675652 - DNA, 15 bp, Homo sapiens
cctaatcaagagtct

SEQ ID NO: 5675653 - DNA, 20 bp, Homo sapiens
cctaatcaagagtctctcca

SEQ ID NO: 5675654 - DNA, 22 bp, Homo sapiens
cctaatcaagagtctctccagc

SEQ ID NO: 5675655 - DNA, 23 bp, Homo sapiens
cctaatcaagagtctctccagcc

SEQ ID NO: 5675656 - DNA, 17 bp, Homo sapiens
cctaatcacatgtgctg

SEQ ID NO: 5675657 - DNA, 15 bp, Homo sapiens
cctaatcactctgag

SEQ ID NO: 5675658 - DNA, 21 bp, Homo sapiens
cctaatcatacaccagaagac

SEQ ID NO: 5675659 - DNA, 15 bp, Homo sapiens
cctaatcatgtttct

SEQ ID NO: 5675660 - DNA, 13 bp, Homo sapiens
cctaatccaggca

SEQ ID NO: 5675661 - DNA, 18 bp, Homo sapiens
cctaatccaggcagatcc

SEQ ID NO: 5675662 - DNA, 18 bp, Homo sapiens
cctaatccccttctcccc

SEQ ID NO: 5675663 - DNA, 17 bp, Homo sapiens
cctaatcgccctgagct

SEQ ID NO: 5675664 - DNA, 19 bp, Homo sapiens
cctaatctcatacctctga

SEQ ID NO: 5675665 - DNA, 14 bp, Homo sapiens
cctaatcttctgaa

SEQ ID NO: 5675666 - DNA, 15 bp, Homo sapiens
cctaatgagagtgca

SEQ ID NO: 5675667 - DNA, 13 bp, Homo sapiens
cctaatgcagaat

SEQ ID NO: 5675668 - DNA, 19 bp, Homo sapiens
cctaatgctccttgttcct

SEQ ID NO: 5675669 - DNA, 16 bp, Homo sapiens
cctaatgctctgaaag

SEQ ID NO: 5675670 - DNA, 12 bp, Homo sapiens
cctaatgctgca

SEQ ID NO: 5675671 - DNA, 18 bp, Homo sapiens
cctaatggcatggagact

SEQ ID NO: 5675672 - DNA, 22 bp, Homo sapiens
cctaatggcatggagactctga

SEQ ID NO: 5675673 - DNA, 19 bp, Homo sapiens
cctaatggctatttttgaa

SEQ ID NO: 5675674 - DNA, 20 bp, Homo sapiens
cctaatggctatttttgaag

SEQ ID NO: 5675675 - DNA, 23 bp, Homo sapiens
cctaatgtctcactgttctgcaa

SEQ ID NO: 5675676 - DNA, 17 bp, Homo sapiens
cctaatgtgatcatatg

SEQ ID NO: 5675677 - DNA, 18 bp, Homo sapiens
cctaatgtggcagctgtc

SEQ ID NO: 5675678 - DNA, 19 bp, Homo sapiens
cctaatgtttatgagccag

SEQ ID NO: 5675679 - DNA, 17 bp, Homo sapiens
cctaatgtttttctcta

SEQ ID NO: 5675680 - DNA, 14 bp, Homo sapiens
cctaattaatttca

SEQ ID NO: 5675681 - DNA, 23 bp, Homo sapiens
cctaattagggcatcctgcccct

SEQ ID NO: 5675682 - DNA, 11 bp, Homo sapiens
cctaattattg

SEQ ID NO: 5675683 - DNA, 16 bp, Homo sapiens
cctaattcaattcaaa

SEQ ID NO: 5675684 - DNA, 20 bp, Homo sapiens
cctaattcaattcaaagctg

SEQ ID NO: 5675685 - DNA, 17 bp, Homo sapiens
cctaattcatcttttaa

SEQ ID NO: 5675686 - DNA, 19 bp, Homo sapiens
cctaattcatcttttaatc

SEQ ID NO: 5675687 - DNA, 19 bp, Homo sapiens
cctaattctcttcgctgtg

SEQ ID NO: 5675688 - DNA, 21 bp, Homo sapiens
cctaattcttattttataatt

SEQ ID NO: 5675689 - DNA, 16 bp, Homo sapiens
cctaattgaaatttaa

SEQ ID NO: 5675690 - DNA, 13 bp, Homo sapiens
cctaattggaaag

SEQ ID NO: 5675691 - DNA, 16 bp, Homo sapiens
cctaattgtcacatca

SEQ ID NO: 5675692 - DNA, 13 bp, Homo sapiens
cctaatttacaag

SEQ ID NO: 5675693 - DNA, 15 bp, Homo sapiens
cctaatttctcctcc

SEQ ID NO: 5675694 - DNA, 17 bp, Homo sapiens
cctaatttctcctccct

SEQ ID NO: 5675695 - DNA, 16 bp, Homo sapiens
cctaattttttaaaga

SEQ ID NO: 5675696 - DNA, 19 bp, Homo sapiens
cctacaacatttttcagtt

SEQ ID NO: 5675697 - DNA, 19 bp, Homo sapiens
cctacaaccatccctgcca

SEQ ID NO: 5675698 - DNA, 17 bp, Homo sapiens
cctacaagagcagcctg

SEQ ID NO: 5675699 - DNA, 19 bp, Homo sapiens
cctacaagagcagcctgtg

SEQ ID NO: 5675700 - DNA, 16 bp, Homo sapiens
cctacaagattcctgg

SEQ ID NO: 5675701 - DNA, 18 bp, Homo sapiens
cctacaagatttagaaaa

SEQ ID NO: 5675702 - DNA, 20 bp, Homo sapiens
cctacaagatttagaaaaaa

SEQ ID NO: 5675703 - DNA, 16 bp, Homo sapiens
cctacaagatttcctt

SEQ ID NO: 5675704 - DNA, 16 bp, Homo sapiens
cctacaataaaaagaa

SEQ ID NO: 5675705 - DNA, 14 bp, Homo sapiens
cctacaataaactg

SEQ ID NO: 5675706 - DNA, 17 bp, Homo sapiens
cctacaatgggaaaact

SEQ ID NO: 5675707 - DNA, 18 bp, Homo sapiens
cctacacacacactccct

SEQ ID NO: 5675708 - DNA, 21 bp, Homo sapiens
cctacacacacactccctgct

SEQ ID NO: 5675709 - DNA, 15 bp, Homo sapiens
cctacacacacccag

SEQ ID NO: 5675710 - DNA, 21 bp, Homo sapiens
cctacacacataccttcatgt

SEQ ID NO: 5675711 - DNA, 15 bp, Homo sapiens
cctacacccctgtgc

SEQ ID NO: 5675712 - DNA, 14 bp, Homo sapiens
cctacacctctggg

SEQ ID NO: 5675713 - DNA, 17 bp, Homo sapiens
cctacacgatccgcaac

SEQ ID NO: 5675714 - DNA, 14 bp, Homo sapiens
cctacactgccagc

SEQ ID NO: 5675715 - DNA, 15 bp, Homo sapiens
cctacactgccagcc

SEQ ID NO: 5675716 - DNA, 16 bp, Homo sapiens
cctacactgccagccg

SEQ ID NO: 5675717 - DNA, 13 bp, Homo sapiens
cctacagaaaaac

SEQ ID NO: 5675718 - DNA, 14 bp, Homo sapiens
cctacagaaaaacc

SEQ ID NO: 5675719 - DNA, 16 bp, Homo sapiens
cctacagaagggcagt

SEQ ID NO: 5675720 - DNA, 11 bp, Homo sapiens
cctacagaatt

SEQ ID NO: 5675721 - DNA, 15 bp, Homo sapiens
cctacagacagctta

SEQ ID NO: 5675722 - DNA, 23 bp, Homo sapiens
cctacagacagcttacaggagcc

SEQ ID NO: 5675723 - DNA, 23 bp, Homo sapiens
cctacagactaagaaggaaaaga

SEQ ID NO: 5675724 - DNA, 17 bp, Homo sapiens
cctacagactccatctc

SEQ ID NO: 5675725 - DNA, 20 bp, Homo sapiens
cctacagactccatctcttc

SEQ ID NO: 5675726 - DNA, 16 bp, Homo sapiens
cctacagaggaggcct

SEQ ID NO: 5675727 - DNA, 17 bp, Homo sapiens
cctacagaggaggcctc

SEQ ID NO: 5675728 - DNA, 13 bp, Homo sapiens
cctacagatcctc

SEQ ID NO: 5675729 - DNA, 14 bp, Homo sapiens
cctacagatgaact

SEQ ID NO: 5675730 - DNA, 12 bp, Homo sapiens
cctacagcacta

SEQ ID NO: 5675731 - DNA, 21 bp, Homo sapiens
cctacagcagatccacctgca

SEQ ID NO: 5675732 - DNA, 13 bp, Homo sapiens
cctacagcagcac

SEQ ID NO: 5675733 - DNA, 12 bp, Homo sapiens
cctacagcattg

SEQ ID NO: 5675734 - DNA, 16 bp, Homo sapiens
cctacagccacatccc

SEQ ID NO: 5675735 - DNA, 15 bp, Homo sapiens
cctacagcccacctg

SEQ ID NO: 5675736 - DNA, 15 bp, Homo sapiens
cctacagcctcactc

SEQ ID NO: 5675737 - DNA, 14 bp, Homo sapiens
cctacagcctgcac

SEQ ID NO: 5675738 - DNA, 15 bp, Homo sapiens
cctacagcctgcaca

SEQ ID NO: 5675739 - DNA, 21 bp, Homo sapiens
cctacagcctgcacacacctg

SEQ ID NO: 5675740 - DNA, 22 bp, Homo sapiens
cctacagcctgcacacacctgc

SEQ ID NO: 5675741 - DNA, 14 bp, Homo sapiens
cctacagctgtctt

SEQ ID NO: 5675742 - DNA, 18 bp, Homo sapiens
cctacaggagtgagcact

SEQ ID NO: 5675743 - DNA, 17 bp, Homo sapiens
cctacaggcgctccagg

SEQ ID NO: 5675744 - DNA, 14 bp, Homo sapiens
cctacaggctgacg

SEQ ID NO: 5675745 - DNA, 19 bp, Homo sapiens
cctacagggggtctggctg

SEQ ID NO: 5675746 - DNA, 18 bp, Homo sapiens
cctacagggggtggagag

SEQ ID NO: 5675747 - DNA, 22 bp, Homo sapiens
cctacagtatataagctttttt

SEQ ID NO: 5675748 - DNA, 21 bp, Homo sapiens
cctacagtgactccctgggag

SEQ ID NO: 5675749 - DNA, 15 bp, Homo sapiens
cctacagtgtacagt

SEQ ID NO: 5675750 - DNA, 22 bp, Homo sapiens
cctacagttgaaaaacagctga

SEQ ID NO: 5675751 - DNA, 17 bp, Homo sapiens
cctacagttttaactgt

SEQ ID NO: 5675752 - DNA, 19 bp, Homo sapiens
cctacagttttaactgtgg

SEQ ID NO: 5675753 - DNA, 20 bp, Homo sapiens
cctacagttttaactgtgga

SEQ ID NO: 5675754 - DNA, 16 bp, Homo sapiens
cctacatccagctcct

SEQ ID NO: 5675755 - DNA, 24 bp, Homo sapiens
cctacatccagctcctctaggggc

SEQ ID NO: 5675756 - DNA, 14 bp, Homo sapiens
cctacatccccagg

SEQ ID NO: 5675757 - DNA, 18 bp, Homo sapiens
cctacatccccaggtctc

SEQ ID NO: 5675758 - DNA, 20 bp, Homo sapiens
cctacatcccgggcctcagt

SEQ ID NO: 5675759 - DNA, 14 bp, Homo sapiens
cctacatcttcagc

SEQ ID NO: 5675760 - DNA, 19 bp, Homo sapiens
cctacatcttcagctccca

SEQ ID NO: 5675761 - DNA, 18 bp, Homo sapiens
cctacatgctttgtgaac

SEQ ID NO: 5675762 - DNA, 15 bp, Homo sapiens
cctacattccccaga

SEQ ID NO: 5675763 - DNA, 16 bp, Homo sapiens
cctacattccccagag

SEQ ID NO: 5675764 - DNA, 15 bp, Homo sapiens
cctacattccctctc

SEQ ID NO: 5675765 - DNA, 16 bp, Homo sapiens
cctacattccctggcc

SEQ ID NO: 5675766 - DNA, 17 bp, Homo sapiens
cctacattccctggcct

SEQ ID NO: 5675767 - DNA, 12 bp, Homo sapiens
cctacattcttt

SEQ ID NO: 5675768 - DNA, 13 bp, Homo sapiens
cctacattcttta

SEQ ID NO: 5675769 - DNA, 13 bp, Homo sapiens
cctaccaacctct

SEQ ID NO: 5675770 - DNA, 15 bp, Homo sapiens
cctaccaacctctga

SEQ ID NO: 5675771 - DNA, 19 bp, Homo sapiens
cctaccaatagattcccca

SEQ ID NO: 5675772 - DNA, 16 bp, Homo sapiens
cctaccaatgcatgca

SEQ ID NO: 5675773 - DNA, 15 bp, Homo sapiens
cctaccacagtgtct

SEQ ID NO: 5675774 - DNA, 16 bp, Homo sapiens
cctaccacagtgtctg

SEQ ID NO: 5675775 - DNA, 20 bp, Homo sapiens
cctaccacccggtccccact

SEQ ID NO: 5675776 - DNA, 14 bp, Homo sapiens
cctaccaccttccc

SEQ ID NO: 5675777 - DNA, 13 bp, Homo sapiens
cctaccactgagc

SEQ ID NO: 5675778 - DNA, 16 bp, Homo sapiens
cctaccactgagccct

SEQ ID NO: 5675779 - DNA, 20 bp, Homo sapiens
cctaccactgtggccccaag

SEQ ID NO: 5675780 - DNA, 17 bp, Homo sapiens
cctaccagagcagagaa

SEQ ID NO: 5675781 - DNA, 19 bp, Homo sapiens
cctaccagcaaacagctga

SEQ ID NO: 5675782 - DNA, 21 bp, Homo sapiens
cctaccagcgcccgctgggct

SEQ ID NO: 5675783 - DNA, 16 bp, Homo sapiens
cctaccagctcctcca

SEQ ID NO: 5675784 - DNA, 23 bp, Homo sapiens
cctaccagctcctccagccctgc

SEQ ID NO: 5675785 - DNA, 18 bp, Homo sapiens
cctaccaggacagaactt

SEQ ID NO: 5675786 - DNA, 15 bp, Homo sapiens
cctaccagttgccct

SEQ ID NO: 5675787 - DNA, 19 bp, Homo sapiens
cctaccagttgccctagcc

SEQ ID NO: 5675788 - DNA, 18 bp, Homo sapiens
cctaccatcagctctgcc

SEQ ID NO: 5675789 - DNA, 15 bp, Homo sapiens
cctaccatgctgctt

SEQ ID NO: 5675790 - DNA, 15 bp, Homo sapiens
cctacccaaccactc

SEQ ID NO: 5675791 - DNA, 18 bp, Homo sapiens
cctacccaatgtctccca

SEQ ID NO: 5675792 - DNA, 16 bp, Homo sapiens
cctacccacacctctg

SEQ ID NO: 5675793 - DNA, 20 bp, Homo sapiens
cctacccacacctctgccag

SEQ ID NO: 5675794 - DNA, 16 bp, Homo sapiens
cctacccacagggcct

SEQ ID NO: 5675795 - DNA, 18 bp, Homo sapiens
cctacccaccgatggagc

SEQ ID NO: 5675796 - DNA, 20 bp, Homo sapiens
cctacccactctttgctaca

SEQ ID NO: 5675797 - DNA, 22 bp, Homo sapiens
cctacccagagattgcttctca

SEQ ID NO: 5675798 - DNA, 14 bp, Homo sapiens
cctacccagcgtgg

SEQ ID NO: 5675799 - DNA, 17 bp, Homo sapiens
cctacccagctgatggg

SEQ ID NO: 5675800 - DNA, 19 bp, Homo sapiens
cctaccccacaccaggccg

SEQ ID NO: 5675801 - DNA, 23 bp, Homo sapiens
cctaccccacaccaggccgtcct

SEQ ID NO: 5675802 - DNA, 15 bp, Homo sapiens
cctaccccagccagg

SEQ ID NO: 5675803 - DNA, 20 bp, Homo sapiens
cctaccccagggccctggcc

SEQ ID NO: 5675804 - DNA, 13 bp, Homo sapiens
cctaccccagttc

SEQ ID NO: 5675805 - DNA, 20 bp, Homo sapiens
cctacccccagcctgacaaa

SEQ ID NO: 5675806 - DNA, 16 bp, Homo sapiens
cctaccccctcatccc

SEQ ID NO: 5675807 - DNA, 21 bp, Homo sapiens
cctaccccctcttcaaagcag

SEQ ID NO: 5675808 - DNA, 21 bp, Homo sapiens
cctacccccttgtctgctgct

SEQ ID NO: 5675809 - DNA, 14 bp, Homo sapiens
cctacccctcccag

SEQ ID NO: 5675810 - DNA, 14 bp, Homo sapiens
cctacccctgactt

SEQ ID NO: 5675811 - DNA, 13 bp, Homo sapiens
cctacccctggct

SEQ ID NO: 5675812 - DNA, 15 bp, Homo sapiens
cctacccctttctcc

SEQ ID NO: 5675813 - DNA, 22 bp, Homo sapiens
cctacccgcccgcgtccaaccc

SEQ ID NO: 5675814 - DNA, 18 bp, Homo sapiens
cctaccctaaccaagttc

SEQ ID NO: 5675815 - DNA, 17 bp, Homo sapiens
cctaccctacccccaca

SEQ ID NO: 5675816 - DNA, 13 bp, Homo sapiens
cctaccctcccac

SEQ ID NO: 5675817 - DNA, 18 bp, Homo sapiens
cctaccctcctgctgagc

SEQ ID NO: 5675818 - DNA, 18 bp, Homo sapiens
cctaccctcgggcccacc

SEQ ID NO: 5675819 - DNA, 23 bp, Homo sapiens
cctaccctcgggcccacctggcc

SEQ ID NO: 5675820 - DNA, 24 bp, Homo sapiens
cctaccctcttattgttcctctta

SEQ ID NO: 5675821 - DNA, 15 bp, Homo sapiens
cctaccctgcctccc

SEQ ID NO: 5675822 - DNA, 14 bp, Homo sapiens
cctacccttcctgc

SEQ ID NO: 5675823 - DNA, 14 bp, Homo sapiens
cctaccctttccca

SEQ ID NO: 5675824 - DNA, 16 bp, Homo sapiens
cctaccgacccagggt

SEQ ID NO: 5675825 - DNA, 17 bp, Homo sapiens
cctaccgagtctcttct

SEQ ID NO: 5675826 - DNA, 20 bp, Homo sapiens
cctaccgagtctcttctcca

SEQ ID NO: 5675827 - DNA, 21 bp, Homo sapiens
cctaccgagtctcttctccac

SEQ ID NO: 5675828 - DNA, 15 bp, Homo sapiens
cctaccgatggtccc

SEQ ID NO: 5675829 - DNA, 18 bp, Homo sapiens
cctaccgcatggcagctg

SEQ ID NO: 5675830 - DNA, 22 bp, Homo sapiens
cctaccgcatggcagctgggcc

SEQ ID NO: 5675831 - DNA, 20 bp, Homo sapiens
cctaccggcaatttccggcc

SEQ ID NO: 5675832 - DNA, 21 bp, Homo sapiens
cctaccggcaatttccggcca

SEQ ID NO: 5675833 - DNA, 23 bp, Homo sapiens
cctacctcaagttcttggaccag

SEQ ID NO: 5675834 - DNA, 13 bp, Homo sapiens
cctacctcagcct

SEQ ID NO: 5675835 - DNA, 18 bp, Homo sapiens
cctacctcagcctagacc

SEQ ID NO: 5675836 - DNA, 21 bp, Homo sapiens
cctacctcagcctagaccctc

SEQ ID NO: 5675837 - DNA, 19 bp, Homo sapiens
cctacctcaggttgctggt

SEQ ID NO: 5675838 - DNA, 22 bp, Homo sapiens
cctacctcaggttgctggttgc

SEQ ID NO: 5675839 - DNA, 13 bp, Homo sapiens
cctacctccaaag

SEQ ID NO: 5675840 - DNA, 11 bp, Homo sapiens
cctacctccct

SEQ ID NO: 5675841 - DNA, 14 bp, Homo sapiens
cctacctccctcct

SEQ ID NO: 5675842 - DNA, 16 bp, Homo sapiens
cctacctccctcctca

SEQ ID NO: 5675843 - DNA, 23 bp, Homo sapiens
cctacctgaaggcagggctcctc

SEQ ID NO: 5675844 - DNA, 13 bp, Homo sapiens
cctacctgatgga

SEQ ID NO: 5675845 - DNA, 14 bp, Homo sapiens
cctacctgccctgg

SEQ ID NO: 5675846 - DNA, 15 bp, Homo sapiens
cctacctgccctgga

SEQ ID NO: 5675847 - DNA, 19 bp, Homo sapiens
cctacctgcctgttctcca

SEQ ID NO: 5675848 - DNA, 17 bp, Homo sapiens
cctacctggggactcct

SEQ ID NO: 5675849 - DNA, 12 bp, Homo sapiens
cctacctggtaa

SEQ ID NO: 5675850 - DNA, 21 bp, Homo sapiens
cctacctggtcaacccgctgc

SEQ ID NO: 5675851 - DNA, 18 bp, Homo sapiens
cctacctgtctgctgcca

SEQ ID NO: 5675852 - DNA, 15 bp, Homo sapiens
cctacctgtgcctga

SEQ ID NO: 5675853 - DNA, 13 bp, Homo sapiens
cctacctgttcag

SEQ ID NO: 5675854 - DNA, 15 bp, Homo sapiens
cctaccttcaaagct

SEQ ID NO: 5675855 - DNA, 16 bp, Homo sapiens
cctaccttccccagac

SEQ ID NO: 5675856 - DNA, 19 bp, Homo sapiens
cctaccttgagaccctctt

SEQ ID NO: 5675857 - DNA, 15 bp, Homo sapiens
cctaccttgcctcct

SEQ ID NO: 5675858 - DNA, 16 bp, Homo sapiens
cctaccttgcctcctt

SEQ ID NO: 5675859 - DNA, 21 bp, Homo sapiens
cctaccttttgataaaatgtt

SEQ ID NO: 5675860 - DNA, 21 bp, Homo sapiens
cctacgagggaggaacacctg

SEQ ID NO: 5675861 - DNA, 19 bp, Homo sapiens
cctacgcaccattttgtca

SEQ ID NO: 5675862 - DNA, 17 bp, Homo sapiens
cctacgcagatgctgtc

SEQ ID NO: 5675863 - DNA, 16 bp, Homo sapiens
cctacgcgccttgtct

SEQ ID NO: 5675864 - DNA, 21 bp, Homo sapiens
cctacgggcgctgcagcctcc

SEQ ID NO: 5675865 - DNA, 18 bp, Homo sapiens
cctacgttcctggccccc

SEQ ID NO: 5675866 - DNA, 18 bp, Homo sapiens
cctacgttggtgcaagtg

SEQ ID NO: 5675867 - DNA, 18 bp, Homo sapiens
cctacgtttgcaccgcct

SEQ ID NO: 5675868 - DNA, 22 bp, Homo sapiens
cctacgtttgcaccgcctgccc

SEQ ID NO: 5675869 - DNA, 17 bp, Homo sapiens
cctactaacatcccaat

SEQ ID NO: 5675870 - DNA, 18 bp, Homo sapiens
cctactacatcgccctcc

SEQ ID NO: 5675871 - DNA, 17 bp, Homo sapiens
cctactactttgtgttt

SEQ ID NO: 5675872 - DNA, 16 bp, Homo sapiens
cctactagtcaccaga

SEQ ID NO: 5675873 - DNA, 14 bp, Homo sapiens
cctactatgtgctg

SEQ ID NO: 5675874 - DNA, 17 bp, Homo sapiens
cctactatgtgctgggt

SEQ ID NO: 5675875 - DNA, 23 bp, Homo sapiens
cctactatgtgctgggtgcctcc

SEQ ID NO: 5675876 - DNA, 17 bp, Homo sapiens
cctactcattggggttc

SEQ ID NO: 5675877 - DNA, 15 bp, Homo sapiens
cctactccacctgtt

SEQ ID NO: 5675878 - DNA, 19 bp, Homo sapiens
cctactccactgccctggc

SEQ ID NO: 5675879 - DNA, 18 bp, Homo sapiens
cctactccagtatgacag

SEQ ID NO: 5675880 - DNA, 22 bp, Homo sapiens
cctactccagtatgacagagga

SEQ ID NO: 5675881 - DNA, 16 bp, Homo sapiens
cctactccctcttcca

SEQ ID NO: 5675882 - DNA, 13 bp, Homo sapiens
cctactccctgca

SEQ ID NO: 5675883 - DNA, 15 bp, Homo sapiens
cctactccctgcaga

SEQ ID NO: 5675884 - DNA, 16 bp, Homo sapiens
cctactccgttcctgg

SEQ ID NO: 5675885 - DNA, 12 bp, Homo sapiens
cctactcctgga

SEQ ID NO: 5675886 - DNA, 15 bp, Homo sapiens
cctactcctggagca

SEQ ID NO: 5675887 - DNA, 18 bp, Homo sapiens
cctactcctgtcttctgc

SEQ ID NO: 5675888 - DNA, 22 bp, Homo sapiens
cctactcctgtcttctgctttg

SEQ ID NO: 5675889 - DNA, 21 bp, Homo sapiens
cctactctccttgagtgtatg

SEQ ID NO: 5675890 - DNA, 12 bp, Homo sapiens
cctactctgtgt

SEQ ID NO: 5675891 - DNA, 13 bp, Homo sapiens
cctactcttctct

SEQ ID NO: 5675892 - DNA, 18 bp, Homo sapiens
cctactcttctctctgct

SEQ ID NO: 5675893 - DNA, 16 bp, Homo sapiens
cctactgaacccagag

SEQ ID NO: 5675894 - DNA, 13 bp, Homo sapiens
cctactgactgat

SEQ ID NO: 5675895 - DNA, 19 bp, Homo sapiens
cctactgaggagcaaagca

SEQ ID NO: 5675896 - DNA, 20 bp, Homo sapiens
cctactgaggagcaaagcag

SEQ ID NO: 5675897 - DNA, 23 bp, Homo sapiens
cctactgccacccgcttcctgtt

SEQ ID NO: 5675898 - DNA, 13 bp, Homo sapiens
cctactgcccaca

SEQ ID NO: 5675899 - DNA, 16 bp, Homo sapiens
cctactgcccacattt

SEQ ID NO: 5675900 - DNA, 13 bp, Homo sapiens
cctactgcccagg

SEQ ID NO: 5675901 - DNA, 20 bp, Homo sapiens
cctactgcccaggcactgca

SEQ ID NO: 5675902 - DNA, 19 bp, Homo sapiens
cctactgcccctgccctga

SEQ ID NO: 5675903 - DNA, 23 bp, Homo sapiens
cctactgcccctgccctgaggag

SEQ ID NO: 5675904 - DNA, 16 bp, Homo sapiens
cctactgcgcctcgtg

SEQ ID NO: 5675905 - DNA, 20 bp, Homo sapiens
cctactggggggctttggcc

SEQ ID NO: 5675906 - DNA, 21 bp, Homo sapiens
cctactggtgtaatctcaatg

SEQ ID NO: 5675907 - DNA, 19 bp, Homo sapiens
cctactgtaatttgtgata

SEQ ID NO: 5675908 - DNA, 14 bp, Homo sapiens
cctactgtcctcag

SEQ ID NO: 5675909 - DNA, 15 bp, Homo sapiens
cctactgtcctcaga

SEQ ID NO: 5675910 - DNA, 13 bp, Homo sapiens
cctactgtcctgg

SEQ ID NO: 5675911 - DNA, 14 bp, Homo sapiens
cctactgtctcctt

SEQ ID NO: 5675912 - DNA, 18 bp, Homo sapiens
cctactgtctccttccca

SEQ ID NO: 5675913 - DNA, 19 bp, Homo sapiens
cctactgtctccttcccac

SEQ ID NO: 5675914 - DNA, 17 bp, Homo sapiens
cctactgtgggcaaagt

SEQ ID NO: 5675915 - DNA, 12 bp, Homo sapiens
cctactgtgggg

SEQ ID NO: 5675916 - DNA, 15 bp, Homo sapiens
cctactgtggggaga

SEQ ID NO: 5675917 - DNA, 16 bp, Homo sapiens
cctactgtggggagag

SEQ ID NO: 5675918 - DNA, 14 bp, Homo sapiens
cctactgttactct

SEQ ID NO: 5675919 - DNA, 16 bp, Homo sapiens
cctactgttcctttca

SEQ ID NO: 5675920 - DNA, 17 bp, Homo sapiens
cctactgttcctttcag

SEQ ID NO: 5675921 - DNA, 13 bp, Homo sapiens
cctactgttctaa

SEQ ID NO: 5675922 - DNA, 15 bp, Homo sapiens
cctacttaaacaaaa

SEQ ID NO: 5675923 - DNA, 19 bp, Homo sapiens
cctacttagggaagaaaaa

SEQ ID NO: 5675924 - DNA, 20 bp, Homo sapiens
cctacttagggaagaaaaag

SEQ ID NO: 5675925 - DNA, 22 bp, Homo sapiens
cctacttagggaagaaaaagca

SEQ ID NO: 5675926 - DNA, 20 bp, Homo sapiens
cctacttcattttcagagtg

SEQ ID NO: 5675927 - DNA, 14 bp, Homo sapiens
cctacttccaggat

SEQ ID NO: 5675928 - DNA, 18 bp, Homo sapiens
cctacttcctcctagcaa

SEQ ID NO: 5675929 - DNA, 14 bp, Homo sapiens
cctacttcctcctc

SEQ ID NO: 5675930 - DNA, 20 bp, Homo sapiens
cctacttctcagtccccttc

SEQ ID NO: 5675931 - DNA, 12 bp, Homo sapiens
cctacttctgac

SEQ ID NO: 5675932 - DNA, 17 bp, Homo sapiens
cctacttctgactttac

SEQ ID NO: 5675933 - DNA, 19 bp, Homo sapiens
cctacttgtaaacttgaaa

SEQ ID NO: 5675934 - DNA, 16 bp, Homo sapiens
cctacttgtaatttct

SEQ ID NO: 5675935 - DNA, 19 bp, Homo sapiens
cctacttgtgactgaaggg

SEQ ID NO: 5675936 - DNA, 13 bp, Homo sapiens
cctactttctctc

SEQ ID NO: 5675937 - DNA, 13 bp, Homo sapiens
cctactttcttca

SEQ ID NO: 5675938 - DNA, 14 bp, Homo sapiens
cctactttgacttt

SEQ ID NO: 5675939 - DNA, 15 bp, Homo sapiens
cctactttgactttt

SEQ ID NO: 5675940 - DNA, 13 bp, Homo sapiens
cctactttgcttc

SEQ ID NO: 5675941 - DNA, 14 bp, Homo sapiens
cctacttttccttc

SEQ ID NO: 5675942 - DNA, 20 bp, Homo sapiens
cctacttttgccacaaggtg

SEQ ID NO: 5675943 - DNA, 16 bp, Homo sapiens
cctacttttggcctca

SEQ ID NO: 5675944 - DNA, 16 bp, Homo sapiens
cctagaaaacccttcc

SEQ ID NO: 5675945 - DNA, 11 bp, Homo sapiens
cctagaaaagt

SEQ ID NO: 5675946 - DNA, 23 bp, Homo sapiens
cctagaaaagtttgttttacttt

SEQ ID NO: 5675947 - DNA, 15 bp, Homo sapiens
cctagaaacaacact

SEQ ID NO: 5675948 - DNA, 20 bp, Homo sapiens
cctagaaacaacactgtagt

SEQ ID NO: 5675949 - DNA, 20 bp, Homo sapiens
cctagaaaccacctgggttc

SEQ ID NO: 5675950 - DNA, 13 bp, Homo sapiens
cctagaaagccat

SEQ ID NO: 5675951 - DNA, 17 bp, Homo sapiens
cctagaaagccatattc

SEQ ID NO: 5675952 - DNA, 15 bp, Homo sapiens
cctagaaagggcaag

SEQ ID NO: 5675953 - DNA, 23 bp, Homo sapiens
cctagaaaggggcccattcagcc

SEQ ID NO: 5675954 - DNA, 15 bp, Homo sapiens
cctagaaagttctgt

SEQ ID NO: 5675955 - DNA, 23 bp, Homo sapiens
cctagaaatatctttctcttacc

SEQ ID NO: 5675956 - DNA, 20 bp, Homo sapiens
cctagaaatgtagcagcagc

SEQ ID NO: 5675957 - DNA, 17 bp, Homo sapiens
cctagaacatccctggg

SEQ ID NO: 5675958 - DNA, 19 bp, Homo sapiens
cctagaacatccctgggca

SEQ ID NO: 5675959 - DNA, 22 bp, Homo sapiens
cctagaacatccctgggcaagt

SEQ ID NO: 5675960 - DNA, 22 bp, Homo sapiens
cctagaaccaagcttcagagcc

SEQ ID NO: 5675961 - DNA, 20 bp, Homo sapiens
cctagaacctagataacgaa

SEQ ID NO: 5675962 - DNA, 17 bp, Homo sapiens
cctagaacctccctcct

SEQ ID NO: 5675963 - DNA, 14 bp, Homo sapiens
cctagaagaaaacc

SEQ ID NO: 5675964 - DNA, 16 bp, Homo sapiens
cctagaagaaaacccg

SEQ ID NO: 5675965 - DNA, 17 bp, Homo sapiens
cctagaagaaaacccga

SEQ ID NO: 5675966 - DNA, 20 bp, Homo sapiens
cctagaagatcacagcaggg

SEQ ID NO: 5675967 - DNA, 16 bp, Homo sapiens
cctagaagcccctgtc

SEQ ID NO: 5675968 - DNA, 22 bp, Homo sapiens
cctagaagggctagaacctgga

SEQ ID NO: 5675969 - DNA, 20 bp, Homo sapiens
cctagaagtaagaagaggag

SEQ ID NO: 5675970 - DNA, 21 bp, Homo sapiens
cctagaagtaagaagaggagc

SEQ ID NO: 5675971 - DNA, 11 bp, Homo sapiens
cctagaatgtc

SEQ ID NO: 5675972 - DNA, 19 bp, Homo sapiens
cctagaatgtttcatttgc

SEQ ID NO: 5675973 - DNA, 18 bp, Homo sapiens
cctagacaacctttctgt

SEQ ID NO: 5675974 - DNA, 23 bp, Homo sapiens
cctagaccagcagacagagccag

SEQ ID NO: 5675975 - DNA, 19 bp, Homo sapiens
cctagaccagtttgcatga

SEQ ID NO: 5675976 - DNA, 13 bp, Homo sapiens
cctagacctcccc

SEQ ID NO: 5675977 - DNA, 12 bp, Homo sapiens
cctagacctggg

SEQ ID NO: 5675978 - DNA, 13 bp, Homo sapiens
cctagacctgggc

SEQ ID NO: 5675979 - DNA, 15 bp, Homo sapiens
cctagacctgggcca

SEQ ID NO: 5675980 - DNA, 21 bp, Homo sapiens
cctagactcggggtgcttcct

SEQ ID NO: 5675981 - DNA, 14 bp, Homo sapiens
cctagactgctcct

SEQ ID NO: 5675982 - DNA, 19 bp, Homo sapiens
cctagactgctcctgggca

SEQ ID NO: 5675983 - DNA, 19 bp, Homo sapiens
cctagactgtaaacctctc

SEQ ID NO: 5675984 - DNA, 17 bp, Homo sapiens
cctagactgtgtatgtc

SEQ ID NO: 5675985 - DNA, 18 bp, Homo sapiens
cctagactgttactttgg

SEQ ID NO: 5675986 - DNA, 21 bp, Homo sapiens
cctagacttcccaacagcctt

SEQ ID NO: 5675987 - DNA, 18 bp, Homo sapiens
cctagagaacgcagccct

SEQ ID NO: 5675988 - DNA, 21 bp, Homo sapiens
cctagagaagataattgttga

SEQ ID NO: 5675989 - DNA, 21 bp, Homo sapiens
cctagagacagaagcaggctg

SEQ ID NO: 5675990 - DNA, 23 bp, Homo sapiens
cctagagacagtgatgcctgccc

SEQ ID NO: 5675991 - DNA, 11 bp, Homo sapiens
cctagagactc

SEQ ID NO: 5675992 - DNA, 18 bp, Homo sapiens
cctagagactcagaggac

SEQ ID NO: 5675993 - DNA, 20 bp, Homo sapiens
cctagagactcagaggaccc

SEQ ID NO: 5675994 - DNA, 17 bp, Homo sapiens
cctagagaggctggcaa

SEQ ID NO: 5675995 - DNA, 21 bp, Homo sapiens
cctagagagtgtgatgttcac

SEQ ID NO: 5675996 - DNA, 15 bp, Homo sapiens
cctagagcacactgt

SEQ ID NO: 5675997 - DNA, 15 bp, Homo sapiens
cctagagcactctca

SEQ ID NO: 5675998 - DNA, 20 bp, Homo sapiens
cctagagcactctcacccca

SEQ ID NO: 5675999 - DNA, 18 bp, Homo sapiens
cctagagcatctgtccca

SEQ ID NO: 5676000 - DNA, 13 bp, Homo sapiens
cctagagccagac

SEQ ID NO: 5676001 - DNA, 14 bp, Homo sapiens
cctagagcctgcct

SEQ ID NO: 5676002 - DNA, 18 bp, Homo sapiens
cctagagcgcggctggct

SEQ ID NO: 5676003 - DNA, 22 bp, Homo sapiens
cctagagcgcggctggctctgt

SEQ ID NO: 5676004 - DNA, 13 bp, Homo sapiens
cctagagctcctg

SEQ ID NO: 5676005 - DNA, 15 bp, Homo sapiens
cctagagctcctgtc

SEQ ID NO: 5676006 - DNA, 17 bp, Homo sapiens
cctagagctcctgtccc

SEQ ID NO: 5676007 - DNA, 20 bp, Homo sapiens
cctagagctcctgtccctac

SEQ ID NO: 5676008 - DNA, 22 bp, Homo sapiens
cctagagctcctgtccctaccc

SEQ ID NO: 5676009 - DNA, 18 bp, Homo sapiens
cctagagcttttttataa

SEQ ID NO: 5676010 - DNA, 17 bp, Homo sapiens
cctagaggccctttgct

SEQ ID NO: 5676011 - DNA, 13 bp, Homo sapiens
cctagagggaggg

SEQ ID NO: 5676012 - DNA, 21 bp, Homo sapiens
cctagaggggcaccttttcat

SEQ ID NO: 5676013 - DNA, 17 bp, Homo sapiens
cctagaggtagagaaac

SEQ ID NO: 5676014 - DNA, 22 bp, Homo sapiens
cctagaggtgggcagctgggcc

SEQ ID NO: 5676015 - DNA, 23 bp, Homo sapiens
cctagaggtgggcagctgggccc

SEQ ID NO: 5676016 - DNA, 22 bp, Homo sapiens
cctagagtagagtggagggagg

SEQ ID NO: 5676017 - DNA, 21 bp, Homo sapiens
cctagagtcccaggttggctc

SEQ ID NO: 5676018 - DNA, 21 bp, Homo sapiens
cctagagtgcagggattacag

SEQ ID NO: 5676019 - DNA, 23 bp, Homo sapiens
cctagagtggcagccaagagcca

SEQ ID NO: 5676020 - DNA, 17 bp, Homo sapiens
cctagatccacacacag

SEQ ID NO: 5676021 - DNA, 22 bp, Homo sapiens
cctagatccacgtgtggcctcc

SEQ ID NO: 5676022 - DNA, 11 bp, Homo sapiens
cctagatccag

SEQ ID NO: 5676023 - DNA, 12 bp, Homo sapiens
cctagatccaga

SEQ ID NO: 5676024 - DNA, 15 bp, Homo sapiens
cctagatccaggctt

SEQ ID NO: 5676025 - DNA, 15 bp, Homo sapiens
cctagatctgcaggc

SEQ ID NO: 5676026 - DNA, 19 bp, Homo sapiens
cctagatctgcaggctgca

SEQ ID NO: 5676027 - DNA, 16 bp, Homo sapiens
cctagatgaagaaaga

SEQ ID NO: 5676028 - DNA, 21 bp, Homo sapiens
cctagatgcacgtggggccca

SEQ ID NO: 5676029 - DNA, 23 bp, Homo sapiens
cctagatggcagtcactgaattc

SEQ ID NO: 5676030 - DNA, 21 bp, Homo sapiens
cctagattacatctgccttaa

SEQ ID NO: 5676031 - DNA, 11 bp, Homo sapiens
cctagattata

SEQ ID NO: 5676032 - DNA, 14 bp, Homo sapiens
cctagcaagctggc

SEQ ID NO: 5676033 - DNA, 16 bp, Homo sapiens
cctagcaatacaggga

SEQ ID NO: 5676034 - DNA, 17 bp, Homo sapiens
cctagcacacacttttg

SEQ ID NO: 5676035 - DNA, 15 bp, Homo sapiens
cctagcacagatggc

SEQ ID NO: 5676036 - DNA, 13 bp, Homo sapiens
cctagcacagcag

SEQ ID NO: 5676037 - DNA, 16 bp, Homo sapiens
cctagcacatgcttca

SEQ ID NO: 5676038 - DNA, 18 bp, Homo sapiens
cctagcacatgcttcaat

SEQ ID NO: 5676039 - DNA, 19 bp, Homo sapiens
cctagcactgccccacatg

SEQ ID NO: 5676040 - DNA, 21 bp, Homo sapiens
cctagcactgccccacatgca

SEQ ID NO: 5676041 - DNA, 21 bp, Homo sapiens
cctagcactttgggaggctga

SEQ ID NO: 5676042 - DNA, 16 bp, Homo sapiens
cctagcagacactgcc

SEQ ID NO: 5676043 - DNA, 12 bp, Homo sapiens
cctagcagagag

SEQ ID NO: 5676044 - DNA, 19 bp, Homo sapiens
cctagcagagtgctggcac

SEQ ID NO: 5676045 - DNA, 14 bp, Homo sapiens
cctagcaggcacag

SEQ ID NO: 5676046 - DNA, 17 bp, Homo sapiens
cctagcaggctgttcca

SEQ ID NO: 5676047 - DNA, 12 bp, Homo sapiens
cctagcagtgaa

SEQ ID NO: 5676048 - DNA, 18 bp, Homo sapiens
cctagcagtttgcctctg

SEQ ID NO: 5676049 - DNA, 20 bp, Homo sapiens
cctagcagtttgcctctgca

SEQ ID NO: 5676050 - DNA, 21 bp, Homo sapiens
cctagcagtttgcctctgcac

SEQ ID NO: 5676051 - DNA, 13 bp, Homo sapiens
cctagcatggggt

SEQ ID NO: 5676052 - DNA, 22 bp, Homo sapiens
cctagcatggggtcagccccaa

SEQ ID NO: 5676053 - DNA, 17 bp, Homo sapiens
cctagccaccagtgtcc

SEQ ID NO: 5676054 - DNA, 14 bp, Homo sapiens
cctagccacctccc

SEQ ID NO: 5676055 - DNA, 15 bp, Homo sapiens
cctagccacctccca

SEQ ID NO: 5676056 - DNA, 16 bp, Homo sapiens
cctagccacctcccac

SEQ ID NO: 5676057 - DNA, 19 bp, Homo sapiens
cctagccacctcccacccc

SEQ ID NO: 5676058 - DNA, 21 bp, Homo sapiens
cctagccacctcccaccccac

SEQ ID NO: 5676059 - DNA, 22 bp, Homo sapiens
cctagccaggtctcctgggaaa

SEQ ID NO: 5676060 - DNA, 16 bp, Homo sapiens
cctagccattcctggt

SEQ ID NO: 5676061 - DNA, 14 bp, Homo sapiens
cctagcccaccctg

SEQ ID NO: 5676062 - DNA, 15 bp, Homo sapiens
cctagcccagactct

SEQ ID NO: 5676063 - DNA, 13 bp, Homo sapiens
cctagcccagcgc

SEQ ID NO: 5676064 - DNA, 15 bp, Homo sapiens
cctagcccaggagag

SEQ ID NO: 5676065 - DNA, 18 bp, Homo sapiens
cctagcccaggagagaga

SEQ ID NO: 5676066 - DNA, 12 bp, Homo sapiens
cctagcccagtg

SEQ ID NO: 5676067 - DNA, 13 bp, Homo sapiens
cctagcccagtgc

SEQ ID NO: 5676068 - DNA, 15 bp, Homo sapiens
cctagcccagtgctt

SEQ ID NO: 5676069 - DNA, 21 bp, Homo sapiens
cctagccccaggtcttttctt

SEQ ID NO: 5676070 - DNA, 12 bp, Homo sapiens
cctagcccctct

SEQ ID NO: 5676071 - DNA, 13 bp, Homo sapiens
cctagcccctctc

SEQ ID NO: 5676072 - DNA, 20 bp, Homo sapiens
cctagccctccccccagctc

SEQ ID NO: 5676073 - DNA, 14 bp, Homo sapiens
cctagccctgctcc

SEQ ID NO: 5676074 - DNA, 20 bp, Homo sapiens
cctagccctgctccaactcc

SEQ ID NO: 5676075 - DNA, 13 bp, Homo sapiens
cctagccctggga

SEQ ID NO: 5676076 - DNA, 16 bp, Homo sapiens
cctagcccttccagcc

SEQ ID NO: 5676077 - DNA, 18 bp, Homo sapiens
cctagcccttccagcctg

SEQ ID NO: 5676078 - DNA, 20 bp, Homo sapiens
cctagcccttccagcctggg

SEQ ID NO: 5676079 - DNA, 15 bp, Homo sapiens
cctagcccttccctg

SEQ ID NO: 5676080 - DNA, 19 bp, Homo sapiens
cctagcccttccctgagtg

SEQ ID NO: 5676081 - DNA, 18 bp, Homo sapiens
cctagcccttctacccca

SEQ ID NO: 5676082 - DNA, 21 bp, Homo sapiens
cctagcccttctaccccacct

SEQ ID NO: 5676083 - DNA, 16 bp, Homo sapiens
cctagccgacctcagc

SEQ ID NO: 5676084 - DNA, 21 bp, Homo sapiens
cctagcctagaacaagccaga

SEQ ID NO: 5676085 - DNA, 17 bp, Homo sapiens
cctagcctatcaagcct

SEQ ID NO: 5676086 - DNA, 20 bp, Homo sapiens
cctagcctatgtctggcaga

SEQ ID NO: 5676087 - DNA, 14 bp, Homo sapiens
cctagcctctccgc

SEQ ID NO: 5676088 - DNA, 20 bp, Homo sapiens
cctagcctggatggcccctc

SEQ ID NO: 5676089 - DNA, 22 bp, Homo sapiens
cctagcctggatggcccctcct

SEQ ID NO: 5676090 - DNA, 21 bp, Homo sapiens
cctagcgctatctccctgcct

SEQ ID NO: 5676091 - DNA, 18 bp, Homo sapiens
cctagcggagcccagcct

SEQ ID NO: 5676092 - DNA, 20 bp, Homo sapiens
cctagcggctgctccttcag

SEQ ID NO: 5676093 - DNA, 21 bp, Homo sapiens
cctagcggctgctccttcagg

SEQ ID NO: 5676094 - DNA, 15 bp, Homo sapiens
cctagctacactgag

SEQ ID NO: 5676095 - DNA, 22 bp, Homo sapiens
cctagctacactgagcagggag

SEQ ID NO: 5676096 - DNA, 18 bp, Homo sapiens
cctagctcacactcatcc

SEQ ID NO: 5676097 - DNA, 19 bp, Homo sapiens
cctagctcacactcatcca

SEQ ID NO: 5676098 - DNA, 21 bp, Homo sapiens
cctagctccaccctcaccagg

SEQ ID NO: 5676099 - DNA, 20 bp, Homo sapiens
cctagctcctcctcctgggc

SEQ ID NO: 5676100 - DNA, 15 bp, Homo sapiens
cctagctcctgccac

SEQ ID NO: 5676101 - DNA, 12 bp, Homo sapiens
cctagctcttgg

SEQ ID NO: 5676102 - DNA, 24 bp, Homo sapiens
cctagctctttgggcctctcctgc

SEQ ID NO: 5676103 - DNA, 22 bp, Homo sapiens
cctagctgaatgtttttctaaa

SEQ ID NO: 5676104 - DNA, 19 bp, Homo sapiens
cctagctggagaggagccc

SEQ ID NO: 5676105 - DNA, 21 bp, Homo sapiens
cctagctggagtgccatggct

SEQ ID NO: 5676106 - DNA, 22 bp, Homo sapiens
cctagctggagtgccatggctg

SEQ ID NO: 5676107 - DNA, 23 bp, Homo sapiens
cctagctggagtgccatggctgg

SEQ ID NO: 5676108 - DNA, 23 bp, Homo sapiens
cctagctgtgccccctctggtta

SEQ ID NO: 5676109 - DNA, 14 bp, Homo sapiens
cctagctgtgtcag

SEQ ID NO: 5676110 - DNA, 16 bp, Homo sapiens
cctagctgtgtgaata

SEQ ID NO: 5676111 - DNA, 17 bp, Homo sapiens
cctagctgtgtgcagtc

SEQ ID NO: 5676112 - DNA, 17 bp, Homo sapiens
cctagcttagtcatggc

SEQ ID NO: 5676113 - DNA, 16 bp, Homo sapiens
cctagcttatctccct

SEQ ID NO: 5676114 - DNA, 19 bp, Homo sapiens
cctagcttatctccctgct

SEQ ID NO: 5676115 - DNA, 20 bp, Homo sapiens
cctagcttatctccctgctt

SEQ ID NO: 5676116 - DNA, 22 bp, Homo sapiens
cctagcttatctccctgcttca

SEQ ID NO: 5676117 - DNA, 14 bp, Homo sapiens
cctagcttcttcca

SEQ ID NO: 5676118 - DNA, 17 bp, Homo sapiens
cctagctttacgctcat

SEQ ID NO: 5676119 - DNA, 21 bp, Homo sapiens
cctagctttagaccctgggtg

SEQ ID NO: 5676120 - DNA, 23 bp, Homo sapiens
cctagctttagaccctgggtggg

SEQ ID NO: 5676121 - DNA, 13 bp, Homo sapiens
cctagcttttaaa

SEQ ID NO: 5676122 - DNA, 18 bp, Homo sapiens
cctagctttttcctggaa

SEQ ID NO: 5676123 - DNA, 20 bp, Homo sapiens
cctaggaaaccagctcgtgg

SEQ ID NO: 5676124 - DNA, 15 bp, Homo sapiens
cctaggaaagcagtg

SEQ ID NO: 5676125 - DNA, 13 bp, Homo sapiens
cctaggaaccagc

SEQ ID NO: 5676126 - DNA, 13 bp, Homo sapiens
cctaggaagcctc

SEQ ID NO: 5676127 - DNA, 15 bp, Homo sapiens
cctaggaagcctcag

SEQ ID NO: 5676128 - DNA, 17 bp, Homo sapiens
cctaggaagcctcagat

SEQ ID NO: 5676129 - DNA, 23 bp, Homo sapiens
cctaggacatgttcccttctcct

SEQ ID NO: 5676130 - DNA, 16 bp, Homo sapiens
cctaggaccactcagc

SEQ ID NO: 5676131 - DNA, 23 bp, Homo sapiens
cctaggaccactcagcccctagg

SEQ ID NO: 5676132 - DNA, 18 bp, Homo sapiens
cctaggacccgtctccag

SEQ ID NO: 5676133 - DNA, 21 bp, Homo sapiens
cctaggacccgtctccagctg

SEQ ID NO: 5676134 - DNA, 11 bp, Homo sapiens
cctaggacctc

SEQ ID NO: 5676135 - DNA, 14 bp, Homo sapiens
cctaggacctcagg

SEQ ID NO: 5676136 - DNA, 19 bp, Homo sapiens
cctaggacttgagcctcca

SEQ ID NO: 5676137 - DNA, 17 bp, Homo sapiens
cctaggagaagcagcct

SEQ ID NO: 5676138 - DNA, 21 bp, Homo sapiens
cctaggagagccaacctcggc

SEQ ID NO: 5676139 - DNA, 17 bp, Homo sapiens
cctaggagatatctgag

SEQ ID NO: 5676140 - DNA, 21 bp, Homo sapiens
cctaggagcagtgggccctgg

SEQ ID NO: 5676141 - DNA, 12 bp, Homo sapiens
cctaggagctgg

SEQ ID NO: 5676142 - DNA, 16 bp, Homo sapiens
cctaggagctggggag

SEQ ID NO: 5676143 - DNA, 14 bp, Homo sapiens
cctaggaggctggc

SEQ ID NO: 5676144 - DNA, 17 bp, Homo sapiens
cctaggaggctggccaa

SEQ ID NO: 5676145 - DNA, 20 bp, Homo sapiens
cctaggagggctctgagcca

SEQ ID NO: 5676146 - DNA, 19 bp, Homo sapiens
cctaggatcccgtcttcca

SEQ ID NO: 5676147 - DNA, 15 bp, Homo sapiens
cctaggatgctgcag

SEQ ID NO: 5676148 - DNA, 23 bp, Homo sapiens
cctaggattcacaccccacctgc

SEQ ID NO: 5676149 - DNA, 21 bp, Homo sapiens
cctaggattccccctgccctg

SEQ ID NO: 5676150 - DNA, 16 bp, Homo sapiens
cctaggattcctcccc

SEQ ID NO: 5676151 - DNA, 21 bp, Homo sapiens
cctaggcagccagctacaggc

SEQ ID NO: 5676152 - DNA, 15 bp, Homo sapiens
cctaggcagcctgca

SEQ ID NO: 5676153 - DNA, 17 bp, Homo sapiens
cctaggcagtgggaggc

SEQ ID NO: 5676154 - DNA, 17 bp, Homo sapiens
cctaggcatactctcca

SEQ ID NO: 5676155 - DNA, 20 bp, Homo sapiens
cctaggcattacccaaaagc

SEQ ID NO: 5676156 - DNA, 22 bp, Homo sapiens
cctaggcattgcaggaccttgg

SEQ ID NO: 5676157 - DNA, 23 bp, Homo sapiens
cctaggcatttgctgaatacaga

SEQ ID NO: 5676158 - DNA, 16 bp, Homo sapiens
cctaggccacgtccag

SEQ ID NO: 5676159 - DNA, 14 bp, Homo sapiens
cctaggccactcct

SEQ ID NO: 5676160 - DNA, 18 bp, Homo sapiens
cctaggccactcctccaa

SEQ ID NO: 5676161 - DNA, 20 bp, Homo sapiens
cctaggccactcctccaaag

SEQ ID NO: 5676162 - DNA, 18 bp, Homo sapiens
cctaggccaggagttccc

SEQ ID NO: 5676163 - DNA, 20 bp, Homo sapiens
cctaggccaggagttcccaa

SEQ ID NO: 5676164 - DNA, 12 bp, Homo sapiens
cctaggccaggt

SEQ ID NO: 5676165 - DNA, 14 bp, Homo sapiens
cctaggcccaggcc

SEQ ID NO: 5676166 - DNA, 15 bp, Homo sapiens
cctaggccccagagc

SEQ ID NO: 5676167 - DNA, 16 bp, Homo sapiens
cctaggccccagagca

SEQ ID NO: 5676168 - DNA, 18 bp, Homo sapiens
cctaggcccctcctagac

SEQ ID NO: 5676169 - DNA, 21 bp, Homo sapiens
cctaggcccctcctagaccca

SEQ ID NO: 5676170 - DNA, 20 bp, Homo sapiens
cctaggcctcagccagagaa

SEQ ID NO: 5676171 - DNA, 13 bp, Homo sapiens
cctaggcctggca

SEQ ID NO: 5676172 - DNA, 20 bp, Homo sapiens
cctaggcgcggttcaggtca

SEQ ID NO: 5676173 - DNA, 24 bp, Homo sapiens
cctaggcgggatgggctcgctgaa

SEQ ID NO: 5676174 - DNA, 14 bp, Homo sapiens
cctaggcgggcggt

SEQ ID NO: 5676175 - DNA, 22 bp, Homo sapiens
cctaggctaggacgttggcctc

SEQ ID NO: 5676176 - DNA, 15 bp, Homo sapiens
cctaggctccacccc

SEQ ID NO: 5676177 - DNA, 15 bp, Homo sapiens
cctaggctccctgag

SEQ ID NO: 5676178 - DNA, 16 bp, Homo sapiens
cctaggctccctgagg

SEQ ID NO: 5676179 - DNA, 17 bp, Homo sapiens
cctaggctccctgaggt

SEQ ID NO: 5676180 - DNA, 12 bp, Homo sapiens
cctaggctcctc

SEQ ID NO: 5676181 - DNA, 19 bp, Homo sapiens
cctaggctggaaataggat

SEQ ID NO: 5676182 - DNA, 22 bp, Homo sapiens
cctaggctggaaggaggaagaa

SEQ ID NO: 5676183 - DNA, 14 bp, Homo sapiens
cctagggaaaagtt

SEQ ID NO: 5676184 - DNA, 18 bp, Homo sapiens
cctagggaacagaaattg

SEQ ID NO: 5676185 - DNA, 22 bp, Homo sapiens
cctagggaagggtggtggagcc

SEQ ID NO: 5676186 - DNA, 24 bp, Homo sapiens
cctagggactgtcctagccaggtc

SEQ ID NO: 5676187 - DNA, 17 bp, Homo sapiens
cctagggatctgaaatc

SEQ ID NO: 5676188 - DNA, 22 bp, Homo sapiens
cctagggcattgtatctgtctt

SEQ ID NO: 5676189 - DNA, 17 bp, Homo sapiens
cctagggccactgaaga

SEQ ID NO: 5676190 - DNA, 12 bp, Homo sapiens
cctagggccccc

SEQ ID NO: 5676191 - DNA, 14 bp, Homo sapiens
cctagggcctggtc

SEQ ID NO: 5676192 - DNA, 16 bp, Homo sapiens
cctagggcctggtcca

SEQ ID NO: 5676193 - DNA, 22 bp, Homo sapiens
cctagggccttttgtggattga

SEQ ID NO: 5676194 - DNA, 13 bp, Homo sapiens
cctagggctcaga

SEQ ID NO: 5676195 - DNA, 13 bp, Homo sapiens
cctagggctgggt

SEQ ID NO: 5676196 - DNA, 18 bp, Homo sapiens
cctaggggaacagaccag

SEQ ID NO: 5676197 - DNA, 22 bp, Homo sapiens
cctaggggaacagaccagtgac

SEQ ID NO: 5676198 - DNA, 12 bp, Homo sapiens
cctaggggaagg

SEQ ID NO: 5676199 - DNA, 16 bp, Homo sapiens
cctaggggaatgaggg

SEQ ID NO: 5676200 - DNA, 22 bp, Homo sapiens
cctaggggaatgagggggctca

SEQ ID NO: 5676201 - DNA, 23 bp, Homo sapiens
cctaggggaatgagggggctcag

SEQ ID NO: 5676202 - DNA, 16 bp, Homo sapiens
cctaggggccagggct

SEQ ID NO: 5676203 - DNA, 15 bp, Homo sapiens
cctagggggtgtcag

SEQ ID NO: 5676204 - DNA, 21 bp, Homo sapiens
cctaggggtccacgggaagcc

SEQ ID NO: 5676205 - DNA, 21 bp, Homo sapiens
cctaggggtgcgctcacctgc

SEQ ID NO: 5676206 - DNA, 19 bp, Homo sapiens
cctagggttttctatttct

SEQ ID NO: 5676207 - DNA, 20 bp, Homo sapiens
cctaggtagccccctcttcc

SEQ ID NO: 5676208 - DNA, 18 bp, Homo sapiens
cctaggtcatttgtagat

SEQ ID NO: 5676209 - DNA, 23 bp, Homo sapiens
cctaggtcccttcccgacccagc

SEQ ID NO: 5676210 - DNA, 15 bp, Homo sapiens
cctaggtcctctgag

SEQ ID NO: 5676211 - DNA, 14 bp, Homo sapiens
cctaggtctccagt

SEQ ID NO: 5676212 - DNA, 19 bp, Homo sapiens
cctaggtctgagaactcag

SEQ ID NO: 5676213 - DNA, 20 bp, Homo sapiens
cctaggtgcagctcctcagc

SEQ ID NO: 5676214 - DNA, 14 bp, Homo sapiens
cctaggtgcccagg

SEQ ID NO: 5676215 - DNA, 11 bp, Homo sapiens
cctaggtgctc

SEQ ID NO: 5676216 - DNA, 13 bp, Homo sapiens
cctaggtgctcat

SEQ ID NO: 5676217 - DNA, 13 bp, Homo sapiens
cctaggtgctgga

SEQ ID NO: 5676218 - DNA, 18 bp, Homo sapiens
cctaggtgggagccacca

SEQ ID NO: 5676219 - DNA, 23 bp, Homo sapiens
cctaggtgggagccaccactcct

SEQ ID NO: 5676220 - DNA, 21 bp, Homo sapiens
cctaggtgggtcaactccaag

SEQ ID NO: 5676221 - DNA, 22 bp, Homo sapiens
cctaggtgggtcaactccaagg

SEQ ID NO: 5676222 - DNA, 23 bp, Homo sapiens
cctaggtgggtcaactccaaggc

SEQ ID NO: 5676223 - DNA, 18 bp, Homo sapiens
cctaggttcccggtcccg

SEQ ID NO: 5676224 - DNA, 21 bp, Homo sapiens
cctaggttcccggtcccgagt

SEQ ID NO: 5676225 - DNA, 20 bp, Homo sapiens
cctaggttccctgttcttcc

SEQ ID NO: 5676226 - DNA, 22 bp, Homo sapiens
cctagtaaaaccttgttctatt

SEQ ID NO: 5676227 - DNA, 15 bp, Homo sapiens
cctagtaaccaaggc

SEQ ID NO: 5676228 - DNA, 16 bp, Homo sapiens
cctagtaaccaaggcc

SEQ ID NO: 5676229 - DNA, 19 bp, Homo sapiens
cctagtaaccaaggccctg

SEQ ID NO: 5676230 - DNA, 18 bp, Homo sapiens
cctagtaagtgcctgctg

SEQ ID NO: 5676231 - DNA, 16 bp, Homo sapiens
cctagtaagtgccttc

SEQ ID NO: 5676232 - DNA, 19 bp, Homo sapiens
cctagtaagtgccttccat

SEQ ID NO: 5676233 - DNA, 17 bp, Homo sapiens
cctagtaattgcctaga

SEQ ID NO: 5676234 - DNA, 18 bp, Homo sapiens
cctagtacaatcttggga

SEQ ID NO: 5676235 - DNA, 19 bp, Homo sapiens
cctagtacaatcttgggaa

SEQ ID NO: 5676236 - DNA, 15 bp, Homo sapiens
cctagtactctctgc

SEQ ID NO: 5676237 - DNA, 16 bp, Homo sapiens
cctagtactctctgct

SEQ ID NO: 5676238 - DNA, 18 bp, Homo sapiens
cctagtactctctgctct

SEQ ID NO: 5676239 - DNA, 20 bp, Homo sapiens
cctagtagctgggattacag

SEQ ID NO: 5676240 - DNA, 16 bp, Homo sapiens
cctagtatacccactg

SEQ ID NO: 5676241 - DNA, 17 bp, Homo sapiens
cctagtatacccactgc

SEQ ID NO: 5676242 - DNA, 14 bp, Homo sapiens
cctagtcagccaca

SEQ ID NO: 5676243 - DNA, 17 bp, Homo sapiens
cctagtcccctttcctc

SEQ ID NO: 5676244 - DNA, 15 bp, Homo sapiens
cctagtcccttcccc

SEQ ID NO: 5676245 - DNA, 22 bp, Homo sapiens
cctagtccggttcttcttgtct

SEQ ID NO: 5676246 - DNA, 16 bp, Homo sapiens
cctagtcgggcagggc

SEQ ID NO: 5676247 - DNA, 15 bp, Homo sapiens
cctagtctctatcat

SEQ ID NO: 5676248 - DNA, 17 bp, Homo sapiens
cctagtctgtaactctt

SEQ ID NO: 5676249 - DNA, 19 bp, Homo sapiens
cctagtgaaacttttctag

SEQ ID NO: 5676250 - DNA, 17 bp, Homo sapiens
cctagtgaaccacaggt

SEQ ID NO: 5676251 - DNA, 12 bp, Homo sapiens
cctagtgaacct

SEQ ID NO: 5676252 - DNA, 15 bp, Homo sapiens
cctagtgatgtagaa

SEQ ID NO: 5676253 - DNA, 18 bp, Homo sapiens
cctagtgcaaaaactgta

SEQ ID NO: 5676254 - DNA, 20 bp, Homo sapiens
cctagtgcaaaaactgtaaa

SEQ ID NO: 5676255 - DNA, 13 bp, Homo sapiens
cctagtgccccag

SEQ ID NO: 5676256 - DNA, 23 bp, Homo sapiens
cctagtgctattctgtgttgaac

SEQ ID NO: 5676257 - DNA, 21 bp, Homo sapiens
cctagtggagttttataaatt

SEQ ID NO: 5676258 - DNA, 18 bp, Homo sapiens
cctagtggatgactgttg

SEQ ID NO: 5676259 - DNA, 17 bp, Homo sapiens
cctagtggctgtccagt

SEQ ID NO: 5676260 - DNA, 13 bp, Homo sapiens
cctagtgggagcc

SEQ ID NO: 5676261 - DNA, 17 bp, Homo sapiens
cctagtgggagcccagc

SEQ ID NO: 5676262 - DNA, 20 bp, Homo sapiens
cctagtgggagcccagcaca

SEQ ID NO: 5676263 - DNA, 14 bp, Homo sapiens
cctagtggggaggg

SEQ ID NO: 5676264 - DNA, 18 bp, Homo sapiens
cctagtggggaggggcct

SEQ ID NO: 5676265 - DNA, 20 bp, Homo sapiens
cctagtggggaggggcctgg

SEQ ID NO: 5676266 - DNA, 18 bp, Homo sapiens
cctagtggggtctccctc

SEQ ID NO: 5676267 - DNA, 19 bp, Homo sapiens
cctagtggggtctccctct

SEQ ID NO: 5676268 - DNA, 17 bp, Homo sapiens
cctagtgtctattccct

SEQ ID NO: 5676269 - DNA, 20 bp, Homo sapiens
cctagttagcatccaggctg

SEQ ID NO: 5676270 - DNA, 15 bp, Homo sapiens
cctagttcaggtcca

SEQ ID NO: 5676271 - DNA, 21 bp, Homo sapiens
cctagttcatccaatcctcac

SEQ ID NO: 5676272 - DNA, 22 bp, Homo sapiens
cctagttcatcccttctcttcc

SEQ ID NO: 5676273 - DNA, 21 bp, Homo sapiens
cctagttccaccatcaagcca

SEQ ID NO: 5676274 - DNA, 23 bp, Homo sapiens
cctagttccaccatcaagccacc

SEQ ID NO: 5676275 - DNA, 16 bp, Homo sapiens
cctagttccccgtgaa

SEQ ID NO: 5676276 - DNA, 17 bp, Homo sapiens
cctagttccctctgctc

SEQ ID NO: 5676277 - DNA, 17 bp, Homo sapiens
cctagttcctgtggcca

SEQ ID NO: 5676278 - DNA, 17 bp, Homo sapiens
cctagttctagaaaaac

SEQ ID NO: 5676279 - DNA, 18 bp, Homo sapiens
cctagttctgtagaaatg

SEQ ID NO: 5676280 - DNA, 22 bp, Homo sapiens
cctagttggtgagaaacctgta

SEQ ID NO: 5676281 - DNA, 14 bp, Homo sapiens
cctagtttccctga

SEQ ID NO: 5676282 - DNA, 15 bp, Homo sapiens
cctagtttgacctca

SEQ ID NO: 5676283 - DNA, 20 bp, Homo sapiens
cctagtttgctgtggccttc

SEQ ID NO: 5676284 - DNA, 21 bp, Homo sapiens
cctagtttgctgtggccttcc

SEQ ID NO: 5676285 - DNA, 20 bp, Homo sapiens
cctagtttgggaggagcaga

SEQ ID NO: 5676286 - DNA, 17 bp, Homo sapiens
cctagtttgtgagaaac

SEQ ID NO: 5676287 - DNA, 18 bp, Homo sapiens
cctagttttatgtttctt

SEQ ID NO: 5676288 - DNA, 12 bp, Homo sapiens
cctagttttcca

SEQ ID NO: 5676289 - DNA, 15 bp, Homo sapiens
cctagttttccatgc

SEQ ID NO: 5676290 - DNA, 15 bp, Homo sapiens
cctagttttctcctc

SEQ ID NO: 5676291 - DNA, 19 bp, Homo sapiens
cctagttttctcctcccag

SEQ ID NO: 5676292 - DNA, 22 bp, Homo sapiens
cctagttttctttcctcctttc

SEQ ID NO: 5676293 - DNA, 15 bp, Homo sapiens
cctagtttttctaat

SEQ ID NO: 5676294 - DNA, 13 bp, Homo sapiens
cctataaaacaaa

SEQ ID NO: 5676295 - DNA, 18 bp, Homo sapiens
cctataaaattaaatgcc

SEQ ID NO: 5676296 - DNA, 21 bp, Homo sapiens
cctataaaattaaatgccttg

SEQ ID NO: 5676297 - DNA, 16 bp, Homo sapiens
cctataaaggaaacac

SEQ ID NO: 5676298 - DNA, 17 bp, Homo sapiens
cctataaagtgtttatg

SEQ ID NO: 5676299 - DNA, 14 bp, Homo sapiens
cctataaatctaat

SEQ ID NO: 5676300 - DNA, 18 bp, Homo sapiens
cctataaatctaatgaca

SEQ ID NO: 5676301 - DNA, 17 bp, Homo sapiens
cctataacttcttcctg

SEQ ID NO: 5676302 - DNA, 20 bp, Homo sapiens
cctataacttcttcctgctg

SEQ ID NO: 5676303 - DNA, 23 bp, Homo sapiens
cctataaggagagttcaagcctg

SEQ ID NO: 5676304 - DNA, 15 bp, Homo sapiens
cctataataaaggct

SEQ ID NO: 5676305 - DNA, 13 bp, Homo sapiens
cctataatgctgg

SEQ ID NO: 5676306 - DNA, 15 bp, Homo sapiens
cctataattttgcaa

SEQ ID NO: 5676307 - DNA, 23 bp, Homo sapiens
cctataccatatgtctgcttctg

SEQ ID NO: 5676308 - DNA, 20 bp, Homo sapiens
cctataccccttacttagca

SEQ ID NO: 5676309 - DNA, 19 bp, Homo sapiens
cctataccggagctccagt

SEQ ID NO: 5676310 - DNA, 16 bp, Homo sapiens
cctatacctgagcctc

SEQ ID NO: 5676311 - DNA, 19 bp, Homo sapiens
cctatacgtttctgtggag

SEQ ID NO: 5676312 - DNA, 11 bp, Homo sapiens
cctatactgaa

SEQ ID NO: 5676313 - DNA, 12 bp, Homo sapiens
cctatactgaaa

SEQ ID NO: 5676314 - DNA, 16 bp, Homo sapiens
cctatactgaaagatc

SEQ ID NO: 5676315 - DNA, 22 bp, Homo sapiens
cctatactgaaagatctctgtc

SEQ ID NO: 5676316 - DNA, 18 bp, Homo sapiens
cctatactggttatagtt

SEQ ID NO: 5676317 - DNA, 19 bp, Homo sapiens
cctatactgtagtattctt

SEQ ID NO: 5676318 - DNA, 20 bp, Homo sapiens
cctatagaaatgtattttga

SEQ ID NO: 5676319 - DNA, 12 bp, Homo sapiens
cctatagactgt

SEQ ID NO: 5676320 - DNA, 21 bp, Homo sapiens
cctatagagagggggctctcc

SEQ ID NO: 5676321 - DNA, 22 bp, Homo sapiens
cctatagattgatttacctttg

SEQ ID NO: 5676322 - DNA, 17 bp, Homo sapiens
cctatagcactgagctc

SEQ ID NO: 5676323 - DNA, 14 bp, Homo sapiens
cctataggaacagc

SEQ ID NO: 5676324 - DNA, 18 bp, Homo sapiens
cctataggaacagcccag

SEQ ID NO: 5676325 - DNA, 15 bp, Homo sapiens
cctatagtcccagct

SEQ ID NO: 5676326 - DNA, 18 bp, Homo sapiens
cctatagtcccagctact

SEQ ID NO: 5676327 - DNA, 15 bp, Homo sapiens
cctatagtttcacca

SEQ ID NO: 5676328 - DNA, 15 bp, Homo sapiens
cctatatcagggcct

SEQ ID NO: 5676329 - DNA, 17 bp, Homo sapiens
cctatatcattatttag

SEQ ID NO: 5676330 - DNA, 13 bp, Homo sapiens
cctatatctgaga

SEQ ID NO: 5676331 - DNA, 19 bp, Homo sapiens
cctatatctgtttgtatat

SEQ ID NO: 5676332 - DNA, 22 bp, Homo sapiens
cctatatgagaagaatagccta

SEQ ID NO: 5676333 - DNA, 11 bp, Homo sapiens
cctatatgctt

SEQ ID NO: 5676334 - DNA, 22 bp, Homo sapiens
cctatatgtggcattcctttct

SEQ ID NO: 5676335 - DNA, 15 bp, Homo sapiens
cctatattggctaaa

SEQ ID NO: 5676336 - DNA, 18 bp, Homo sapiens
cctatattgttttcagtg

SEQ ID NO: 5676337 - DNA, 21 bp, Homo sapiens
cctatatttataaaccagcag

SEQ ID NO: 5676338 - DNA, 15 bp, Homo sapiens
cctatatttcctctt

SEQ ID NO: 5676339 - DNA, 19 bp, Homo sapiens
cctatcaaaaagatatcaa

SEQ ID NO: 5676340 - DNA, 16 bp, Homo sapiens
cctatcaaaaattatt

SEQ ID NO: 5676341 - DNA, 20 bp, Homo sapiens
cctatcaaaacatatcaatt

SEQ ID NO: 5676342 - DNA, 15 bp, Homo sapiens
cctatcacccaggct

SEQ ID NO: 5676343 - DNA, 17 bp, Homo sapiens
cctatcacctatttcca

SEQ ID NO: 5676344 - DNA, 21 bp, Homo sapiens
cctatcagcctgtctcttcca

SEQ ID NO: 5676345 - DNA, 20 bp, Homo sapiens
cctatcagtgtgccccccat

SEQ ID NO: 5676346 - DNA, 14 bp, Homo sapiens
cctatcatgttaac

SEQ ID NO: 5676347 - DNA, 16 bp, Homo sapiens
cctatccacccagccc

SEQ ID NO: 5676348 - DNA, 18 bp, Homo sapiens
cctatccacccagcccat

SEQ ID NO: 5676349 - DNA, 17 bp, Homo sapiens
cctatccactgggcaca

SEQ ID NO: 5676350 - DNA, 12 bp, Homo sapiens
cctatccatcct

SEQ ID NO: 5676351 - DNA, 16 bp, Homo sapiens
cctatccatggcacta

SEQ ID NO: 5676352 - DNA, 15 bp, Homo sapiens
cctatccctctccta

SEQ ID NO: 5676353 - DNA, 15 bp, Homo sapiens
cctatcctcactgcc

SEQ ID NO: 5676354 - DNA, 13 bp, Homo sapiens
cctatcctgctgt

SEQ ID NO: 5676355 - DNA, 16 bp, Homo sapiens
cctatccttggagagc

SEQ ID NO: 5676356 - DNA, 20 bp, Homo sapiens
cctatccttggagagcagct

SEQ ID NO: 5676357 - DNA, 22 bp, Homo sapiens
cctatccttggagagcagctgg

SEQ ID NO: 5676358 - DNA, 14 bp, Homo sapiens
cctatccttggcac

SEQ ID NO: 5676359 - DNA, 19 bp, Homo sapiens
cctatccttggcaccaaag

SEQ ID NO: 5676360 - DNA, 17 bp, Homo sapiens
cctatcgatctggaaag

SEQ ID NO: 5676361 - DNA, 22 bp, Homo sapiens
cctatcgccccctacgcgcctt

SEQ ID NO: 5676362 - DNA, 18 bp, Homo sapiens
cctatctaaccctcccat

SEQ ID NO: 5676363 - DNA, 22 bp, Homo sapiens
cctatctagcatttatttctct

SEQ ID NO: 5676364 - DNA, 19 bp, Homo sapiens
cctatctatgaacaacagt

SEQ ID NO: 5676365 - DNA, 17 bp, Homo sapiens
cctatctattaaagtga

SEQ ID NO: 5676366 - DNA, 22 bp, Homo sapiens
cctatctattaaagtgactttc

SEQ ID NO: 5676367 - DNA, 14 bp, Homo sapiens
cctatctcagccat

SEQ ID NO: 5676368 - DNA, 14 bp, Homo sapiens
cctatctcagggag

SEQ ID NO: 5676369 - DNA, 15 bp, Homo sapiens
cctatctcagggagg

SEQ ID NO: 5676370 - DNA, 17 bp, Homo sapiens
cctatctcagggaggga

SEQ ID NO: 5676371 - DNA, 15 bp, Homo sapiens
cctatctccctggct

SEQ ID NO: 5676372 - DNA, 19 bp, Homo sapiens
cctatctccttcccacccc

SEQ ID NO: 5676373 - DNA, 16 bp, Homo sapiens
cctatctcgtgggaga

SEQ ID NO: 5676374 - DNA, 17 bp, Homo sapiens
cctatctgcctggaggc

SEQ ID NO: 5676375 - DNA, 19 bp, Homo sapiens
cctatctgggcttcctgga

SEQ ID NO: 5676376 - DNA, 22 bp, Homo sapiens
cctatctgtaagaggtactaaa

SEQ ID NO: 5676377 - DNA, 13 bp, Homo sapiens
cctatctgtattg

SEQ ID NO: 5676378 - DNA, 14 bp, Homo sapiens
cctatctgtattgg

SEQ ID NO: 5676379 - DNA, 16 bp, Homo sapiens
cctatctgtattggca

SEQ ID NO: 5676380 - DNA, 17 bp, Homo sapiens
cctatcttaggtagtca

SEQ ID NO: 5676381 - DNA, 15 bp, Homo sapiens
cctatcttgtgaagt

SEQ ID NO: 5676382 - DNA, 14 bp, Homo sapiens
cctatctttaaaca

SEQ ID NO: 5676383 - DNA, 21 bp, Homo sapiens
cctatctttaaacatttcaat

SEQ ID NO: 5676384 - DNA, 12 bp, Homo sapiens
cctatctttgcc

SEQ ID NO: 5676385 - DNA, 13 bp, Homo sapiens
cctatctttgcca

SEQ ID NO: 5676386 - DNA, 20 bp, Homo sapiens
cctatctttgccaccctcat

SEQ ID NO: 5676387 - DNA, 17 bp, Homo sapiens
cctatgaaactggttta

SEQ ID NO: 5676388 - DNA, 16 bp, Homo sapiens
cctatgacacagttat

SEQ ID NO: 5676389 - DNA, 14 bp, Homo sapiens
cctatgaccctgtg

SEQ ID NO: 5676390 - DNA, 18 bp, Homo sapiens
cctatgaccctgtgcctg

SEQ ID NO: 5676391 - DNA, 19 bp, Homo sapiens
cctatgaccctgtgcctgt

SEQ ID NO: 5676392 - DNA, 20 bp, Homo sapiens
cctatgacttttttaaacta

SEQ ID NO: 5676393 - DNA, 19 bp, Homo sapiens
cctatgagatggccatgct

SEQ ID NO: 5676394 - DNA, 21 bp, Homo sapiens
cctatgagatggccatgctca

SEQ ID NO: 5676395 - DNA, 11 bp, Homo sapiens
cctatgatgta

SEQ ID NO: 5676396 - DNA, 15 bp, Homo sapiens
cctatgatgtatact

SEQ ID NO: 5676397 - DNA, 14 bp, Homo sapiens
cctatgcaataaaa

SEQ ID NO: 5676398 - DNA, 14 bp, Homo sapiens
cctatgcaatatat

SEQ ID NO: 5676399 - DNA, 22 bp, Homo sapiens
cctatgcaatatatctaaattg

SEQ ID NO: 5676400 - DNA, 21 bp, Homo sapiens
cctatgcacatatggactctg

SEQ ID NO: 5676401 - DNA, 21 bp, Homo sapiens
cctatgcactgaagagctctt

SEQ ID NO: 5676402 - DNA, 23 bp, Homo sapiens
cctatgcactgaagagctcttgg

SEQ ID NO: 5676403 - DNA, 22 bp, Homo sapiens
cctatgcagacatctctggagc

SEQ ID NO: 5676404 - DNA, 22 bp, Homo sapiens
cctatgcagggaggccacgtcc

SEQ ID NO: 5676405 - DNA, 23 bp, Homo sapiens
cctatgcagggaggccacgtccc

SEQ ID NO: 5676406 - DNA, 11 bp, Homo sapiens
cctatgcatgg

SEQ ID NO: 5676407 - DNA, 21 bp, Homo sapiens
cctatgcatggtgtagatgcc

SEQ ID NO: 5676408 - DNA, 20 bp, Homo sapiens
cctatgcatggtttcagcac

SEQ ID NO: 5676409 - DNA, 22 bp, Homo sapiens
cctatgcatggtttcagcacta

SEQ ID NO: 5676410 - DNA, 23 bp, Homo sapiens
cctatgcatggtttcagcactag

SEQ ID NO: 5676411 - DNA, 16 bp, Homo sapiens
cctatgcccaggtacc

SEQ ID NO: 5676412 - DNA, 19 bp, Homo sapiens
cctatgccctgcccttcct

SEQ ID NO: 5676413 - DNA, 21 bp, Homo sapiens
cctatgccctgcccttcctca

SEQ ID NO: 5676414 - DNA, 20 bp, Homo sapiens
cctatgcctcacaaatgctg

SEQ ID NO: 5676415 - DNA, 22 bp, Homo sapiens
cctatgcctcacaaatgctgtg

SEQ ID NO: 5676416 - DNA, 12 bp, Homo sapiens
cctatgcctttt

SEQ ID NO: 5676417 - DNA, 16 bp, Homo sapiens
cctatgccttttgtag

SEQ ID NO: 5676418 - DNA, 23 bp, Homo sapiens
cctatgctattgacaataaaata

SEQ ID NO: 5676419 - DNA, 22 bp, Homo sapiens
cctatgctggggtacacagtga

SEQ ID NO: 5676420 - DNA, 12 bp, Homo sapiens
cctatgctgtgc

SEQ ID NO: 5676421 - DNA, 17 bp, Homo sapiens
cctatgcttaataaaag

SEQ ID NO: 5676422 - DNA, 23 bp, Homo sapiens
cctatggaaacattttatactgt

SEQ ID NO: 5676423 - DNA, 12 bp, Homo sapiens
cctatggaaacc

SEQ ID NO: 5676424 - DNA, 21 bp, Homo sapiens
cctatggaagtggttctatgt

SEQ ID NO: 5676425 - DNA, 19 bp, Homo sapiens
cctatggaagttgttgcta

SEQ ID NO: 5676426 - DNA, 14 bp, Homo sapiens
cctatggagaggct

SEQ ID NO: 5676427 - DNA, 17 bp, Homo sapiens
cctatggagaggcttcc

SEQ ID NO: 5676428 - DNA, 18 bp, Homo sapiens
cctatggagcctctgcag

SEQ ID NO: 5676429 - DNA, 16 bp, Homo sapiens
cctatggcccagccac

SEQ ID NO: 5676430 - DNA, 16 bp, Homo sapiens
cctatggggaggccct

SEQ ID NO: 5676431 - DNA, 12 bp, Homo sapiens
cctatgtaattt

SEQ ID NO: 5676432 - DNA, 15 bp, Homo sapiens
cctatgtacagagct

SEQ ID NO: 5676433 - DNA, 19 bp, Homo sapiens
cctatgtacagagctttct

SEQ ID NO: 5676434 - DNA, 24 bp, Homo sapiens
cctatgtactctacgccaaagtgc

SEQ ID NO: 5676435 - DNA, 16 bp, Homo sapiens
cctatgtagtccgtgc

SEQ ID NO: 5676436 - DNA, 18 bp, Homo sapiens
cctatgtagtccgtgctg

SEQ ID NO: 5676437 - DNA, 14 bp, Homo sapiens
cctatgtagtgtct

SEQ ID NO: 5676438 - DNA, 19 bp, Homo sapiens
cctatgtcaatttgtatat

SEQ ID NO: 5676439 - DNA, 18 bp, Homo sapiens
cctatgtcatttcatttc

SEQ ID NO: 5676440 - DNA, 15 bp, Homo sapiens
cctatgtcatttcta

SEQ ID NO: 5676441 - DNA, 19 bp, Homo sapiens
cctatgtcctaaggacaca

SEQ ID NO: 5676442 - DNA, 20 bp, Homo sapiens
cctatgtcctaaggacacac

SEQ ID NO: 5676443 - DNA, 24 bp, Homo sapiens
cctatgtcctaaggacacactaat

SEQ ID NO: 5676444 - DNA, 12 bp, Homo sapiens
cctatgtctggc

SEQ ID NO: 5676445 - DNA, 15 bp, Homo sapiens
cctatgtctggcaga

SEQ ID NO: 5676446 - DNA, 14 bp, Homo sapiens
cctatgtcttgtat

SEQ ID NO: 5676447 - DNA, 17 bp, Homo sapiens
cctatgtgaaaagatcc

SEQ ID NO: 5676448 - DNA, 17 bp, Homo sapiens
cctatgtgattttaact

SEQ ID NO: 5676449 - DNA, 20 bp, Homo sapiens
cctatgtgattttaactctg

SEQ ID NO: 5676450 - DNA, 16 bp, Homo sapiens
cctatgtggcatgtgg

SEQ ID NO: 5676451 - DNA, 22 bp, Homo sapiens
cctatgtttttgttcaaagcca

SEQ ID NO: 5676452 - DNA, 16 bp, Homo sapiens
cctattaaaggaaaac

SEQ ID NO: 5676453 - DNA, 18 bp, Homo sapiens
cctattaagtcatcatct

SEQ ID NO: 5676454 - DNA, 13 bp, Homo sapiens
cctattagaaaag

SEQ ID NO: 5676455 - DNA, 10 bp, Homo sapiens
cctattataa

SEQ ID NO: 5676456 - DNA, 16 bp, Homo sapiens
cctattatcccagctg

SEQ ID NO: 5676457 - DNA, 18 bp, Homo sapiens
cctattatcccagctgcc

SEQ ID NO: 5676458 - DNA, 17 bp, Homo sapiens
cctattatctgtcagct

SEQ ID NO: 5676459 - DNA, 19 bp, Homo sapiens
cctattatttccgggtgga

SEQ ID NO: 5676460 - DNA, 23 bp, Homo sapiens
cctattcaacacacacatgcttc

SEQ ID NO: 5676461 - DNA, 16 bp, Homo sapiens
cctattcaccctccac

SEQ ID NO: 5676462 - DNA, 17 bp, Homo sapiens
cctattcaccctccact

SEQ ID NO: 5676463 - DNA, 19 bp, Homo sapiens
cctattcaccctccacttc

SEQ ID NO: 5676464 - DNA, 19 bp, Homo sapiens
cctattccagtgtccatgt

SEQ ID NO: 5676465 - DNA, 22 bp, Homo sapiens
cctattcccacacctccacagt

SEQ ID NO: 5676466 - DNA, 15 bp, Homo sapiens
cctattctcaccagg

SEQ ID NO: 5676467 - DNA, 15 bp, Homo sapiens
cctattctcgggctg

SEQ ID NO: 5676468 - DNA, 18 bp, Homo sapiens
cctattgatttaagcttt

SEQ ID NO: 5676469 - DNA, 19 bp, Homo sapiens
cctattgccaggaatgttt

SEQ ID NO: 5676470 - DNA, 21 bp, Homo sapiens
cctattgccaggaatgtttca

SEQ ID NO: 5676471 - DNA, 18 bp, Homo sapiens
cctattgctagagctcct

SEQ ID NO: 5676472 - DNA, 13 bp, Homo sapiens
cctattgctgcta

SEQ ID NO: 5676473 - DNA, 16 bp, Homo sapiens
cctattgcttgggtct

SEQ ID NO: 5676474 - DNA, 21 bp, Homo sapiens
cctattgcttgggtctctctc

SEQ ID NO: 5676475 - DNA, 20 bp, Homo sapiens
cctattggcttactgaaaga

SEQ ID NO: 5676476 - DNA, 13 bp, Homo sapiens
cctattgggagag

SEQ ID NO: 5676477 - DNA, 20 bp, Homo sapiens
cctattggtgttatgtttat

SEQ ID NO: 5676478 - DNA, 17 bp, Homo sapiens
cctattgtgactcttct

SEQ ID NO: 5676479 - DNA, 13 bp, Homo sapiens
cctattgtgattt

SEQ ID NO: 5676480 - DNA, 18 bp, Homo sapiens
cctattgtgatttgactg

SEQ ID NO: 5676481 - DNA, 21 bp, Homo sapiens
cctattgtgatttgactgttt

SEQ ID NO: 5676482 - DNA, 22 bp, Homo sapiens
cctattgtgatttgactgtttt

SEQ ID NO: 5676483 - DNA, 19 bp, Homo sapiens
cctattgtgcaatgtaaat

SEQ ID NO: 5676484 - DNA, 17 bp, Homo sapiens
cctatttactggaaacc

SEQ ID NO: 5676485 - DNA, 17 bp, Homo sapiens
cctatttattcattcag

SEQ ID NO: 5676486 - DNA, 19 bp, Homo sapiens
cctatttattgactttgac

SEQ ID NO: 5676487 - DNA, 13 bp, Homo sapiens
cctatttatttga

SEQ ID NO: 5676488 - DNA, 20 bp, Homo sapiens
cctatttcagtacttcagca

SEQ ID NO: 5676489 - DNA, 15 bp, Homo sapiens
cctatttcatcacaa

SEQ ID NO: 5676490 - DNA, 11 bp, Homo sapiens
cctatttctat

SEQ ID NO: 5676491 - DNA, 14 bp, Homo sapiens
cctatttctatgtc

SEQ ID NO: 5676492 - DNA, 18 bp, Homo sapiens
cctatttctatgtcattt

SEQ ID NO: 5676493 - DNA, 16 bp, Homo sapiens
cctatttctctttctt

SEQ ID NO: 5676494 - DNA, 14 bp, Homo sapiens
cctatttgactgct

SEQ ID NO: 5676495 - DNA, 14 bp, Homo sapiens
cctatttgacttac

SEQ ID NO: 5676496 - DNA, 14 bp, Homo sapiens
cctatttggtgcta

SEQ ID NO: 5676497 - DNA, 14 bp, Homo sapiens
cctattttaaaacc

SEQ ID NO: 5676498 - DNA, 19 bp, Homo sapiens
cctattttaaaaccatgca

SEQ ID NO: 5676499 - DNA, 22 bp, Homo sapiens
cctattttaggctattataata

SEQ ID NO: 5676500 - DNA, 14 bp, Homo sapiens
cctattttcatttg

SEQ ID NO: 5676501 - DNA, 23 bp, Homo sapiens
cctattttgaaaaattcctattg

SEQ ID NO: 5676502 - DNA, 14 bp, Homo sapiens
cctattttgaaagg

SEQ ID NO: 5676503 - DNA, 17 bp, Homo sapiens
cctattttgaaaggtca

SEQ ID NO: 5676504 - DNA, 22 bp, Homo sapiens
cctattttgaatgcagaaaaca

SEQ ID NO: 5676505 - DNA, 20 bp, Homo sapiens
cctattttggacgtgtgagg

SEQ ID NO: 5676506 - DNA, 21 bp, Homo sapiens
cctattttgtaatttttttga

SEQ ID NO: 5676507 - DNA, 20 bp, Homo sapiens
cctattttgtatatgtgaga

SEQ ID NO: 5676508 - DNA, 16 bp, Homo sapiens
cctatttttaaaaagt

SEQ ID NO: 5676509 - DNA, 15 bp, Homo sapiens
cctatttttaaataa

SEQ ID NO: 5676510 - DNA, 18 bp, Homo sapiens
cctatttttatattttta

SEQ ID NO: 5676511 - DNA, 14 bp, Homo sapiens
cctatttttccttt

SEQ ID NO: 5676512 - DNA, 14 bp, Homo sapiens
cctatttttgtaaa

SEQ ID NO: 5676513 - DNA, 23 bp, Homo sapiens
cctatttttgtagatctccatgc

SEQ ID NO: 5676514 - DNA, 14 bp, Homo sapiens
cctatttttgtgaa

SEQ ID NO: 5676515 - DNA, 16 bp, Homo sapiens
cctattttttgacact

SEQ ID NO: 5676516 - DNA, 16 bp, Homo sapiens
cctatttttttctccc

SEQ ID NO: 5676517 - DNA, 17 bp, Homo sapiens
cctcaaaaaaagccttt

SEQ ID NO: 5676518 - DNA, 17 bp, Homo sapiens
cctcaaaaacagtccag

SEQ ID NO: 5676519 - DNA, 22 bp, Homo sapiens
cctcaaaaacgccctcaagaac

SEQ ID NO: 5676520 - DNA, 19 bp, Homo sapiens
cctcaaaaagcagaaggag

SEQ ID NO: 5676521 - DNA, 14 bp, Homo sapiens
cctcaaaacaaagg

SEQ ID NO: 5676522 - DNA, 17 bp, Homo sapiens
cctcaaaacagaagcag

SEQ ID NO: 5676523 - DNA, 21 bp, Homo sapiens
cctcaaaacctgattggccac

SEQ ID NO: 5676524 - DNA, 14 bp, Homo sapiens
cctcaaaagaaaat

SEQ ID NO: 5676525 - DNA, 16 bp, Homo sapiens
cctcaaaagccaaaaa

SEQ ID NO: 5676526 - DNA, 18 bp, Homo sapiens
cctcaaaattgataatta

SEQ ID NO: 5676527 - DNA, 13 bp, Homo sapiens
cctcaaaccactt

SEQ ID NO: 5676528 - DNA, 18 bp, Homo sapiens
cctcaaaccacttgcctg

SEQ ID NO: 5676529 - DNA, 16 bp, Homo sapiens
cctcaaacctcctctt

SEQ ID NO: 5676530 - DNA, 18 bp, Homo sapiens
cctcaaacctcctcttct

SEQ ID NO: 5676531 - DNA, 18 bp, Homo sapiens
cctcaaacgacagaggag

SEQ ID NO: 5676532 - DNA, 20 bp, Homo sapiens
cctcaaactcattgcagcag

SEQ ID NO: 5676533 - DNA, 14 bp, Homo sapiens
cctcaaacttcaga

SEQ ID NO: 5676534 - DNA, 14 bp, Homo sapiens
cctcaaagaggcag

SEQ ID NO: 5676535 - DNA, 20 bp, Homo sapiens
cctcaaagattctgcatttt

SEQ ID NO: 5676536 - DNA, 15 bp, Homo sapiens
cctcaaagcacctga

SEQ ID NO: 5676537 - DNA, 14 bp, Homo sapiens
cctcaaagcctcaa

SEQ ID NO: 5676538 - DNA, 18 bp, Homo sapiens
cctcaaagggagagaaaa

SEQ ID NO: 5676539 - DNA, 17 bp, Homo sapiens
cctcaaagggcagtttt

SEQ ID NO: 5676540 - DNA, 16 bp, Homo sapiens
cctcaaagtaaaaatt

SEQ ID NO: 5676541 - DNA, 14 bp, Homo sapiens
cctcaaagtctgca

SEQ ID NO: 5676542 - DNA, 18 bp, Homo sapiens
cctcaaataaaaagtgct

SEQ ID NO: 5676543 - DNA, 18 bp, Homo sapiens
cctcaaatacatgcacag

SEQ ID NO: 5676544 - DNA, 23 bp, Homo sapiens
cctcaaatacatgcacagtcata

SEQ ID NO: 5676545 - DNA, 18 bp, Homo sapiens
cctcaaatcagtcttcct

SEQ ID NO: 5676546 - DNA, 16 bp, Homo sapiens
cctcaaatccaggacc

SEQ ID NO: 5676547 - DNA, 16 bp, Homo sapiens
cctcaaatgacccaaa

SEQ ID NO: 5676548 - DNA, 14 bp, Homo sapiens
cctcaaatgagaaa

SEQ ID NO: 5676549 - DNA, 13 bp, Homo sapiens
cctcaaatgtcag

SEQ ID NO: 5676550 - DNA, 17 bp, Homo sapiens
cctcaaatgtcagagct

SEQ ID NO: 5676551 - DNA, 22 bp, Homo sapiens
cctcaaattagaatagaacttg

SEQ ID NO: 5676552 - DNA, 15 bp, Homo sapiens
cctcaaattttttga

SEQ ID NO: 5676553 - DNA, 22 bp, Homo sapiens
cctcaacaaagaagaaccatct

SEQ ID NO: 5676554 - DNA, 20 bp, Homo sapiens
cctcaacaccctgcttctcc

SEQ ID NO: 5676555 - DNA, 13 bp, Homo sapiens
cctcaacagcagg

SEQ ID NO: 5676556 - DNA, 17 bp, Homo sapiens
cctcaacagcaggaggc

SEQ ID NO: 5676557 - DNA, 18 bp, Homo sapiens
cctcaacagcaggaggca

SEQ ID NO: 5676558 - DNA, 22 bp, Homo sapiens
cctcaacagcaggaggcacagc

SEQ ID NO: 5676559 - DNA, 16 bp, Homo sapiens
cctcaacaggcccagg

SEQ ID NO: 5676560 - DNA, 22 bp, Homo sapiens
cctcaacattggagacatcact

SEQ ID NO: 5676561 - DNA, 14 bp, Homo sapiens
cctcaacccctccc

SEQ ID NO: 5676562 - DNA, 23 bp, Homo sapiens
cctcaacccctcccctccatccc

SEQ ID NO: 5676563 - DNA, 18 bp, Homo sapiens
cctcaaccctccctcagc

SEQ ID NO: 5676564 - DNA, 23 bp, Homo sapiens
cctcaaccgcacatgtgccactg

SEQ ID NO: 5676565 - DNA, 13 bp, Homo sapiens
cctcaacctcatc

SEQ ID NO: 5676566 - DNA, 23 bp, Homo sapiens
cctcaacctgtaaattattttaa

SEQ ID NO: 5676567 - DNA, 14 bp, Homo sapiens
cctcaacctgtgat

SEQ ID NO: 5676568 - DNA, 18 bp, Homo sapiens
cctcaacgtattgtttcg

SEQ ID NO: 5676569 - DNA, 21 bp, Homo sapiens
cctcaactcacctaatgttta

SEQ ID NO: 5676570 - DNA, 21 bp, Homo sapiens
cctcaactccaccctctgcga

SEQ ID NO: 5676571 - DNA, 15 bp, Homo sapiens
cctcaactctgctga

SEQ ID NO: 5676572 - DNA, 13 bp, Homo sapiens
cctcaactgaagg

SEQ ID NO: 5676573 - DNA, 19 bp, Homo sapiens
cctcaactgagaagccaag

SEQ ID NO: 5676574 - DNA, 23 bp, Homo sapiens
cctcaactgagaagccaagcctg

SEQ ID NO: 5676575 - DNA, 17 bp, Homo sapiens
cctcaactgagggccag

SEQ ID NO: 5676576 - DNA, 23 bp, Homo sapiens
cctcaactgagggccagggaccc

SEQ ID NO: 5676577 - DNA, 15 bp, Homo sapiens
cctcaagaacacctt

SEQ ID NO: 5676578 - DNA, 14 bp, Homo sapiens
cctcaagaagtaat

SEQ ID NO: 5676579 - DNA, 23 bp, Homo sapiens
cctcaagactttgatccttggaa

SEQ ID NO: 5676580 - DNA, 16 bp, Homo sapiens
cctcaagatcattcag

SEQ ID NO: 5676581 - DNA, 13 bp, Homo sapiens
cctcaagcaacca

SEQ ID NO: 5676582 - DNA, 24 bp, Homo sapiens
cctcaagcaaggaagcagagcact

SEQ ID NO: 5676583 - DNA, 15 bp, Homo sapiens
cctcaagccaggaga

SEQ ID NO: 5676584 - DNA, 20 bp, Homo sapiens
cctcaagccaggagaccctg

SEQ ID NO: 5676585 - DNA, 20 bp, Homo sapiens
cctcaagccccatttcctca

SEQ ID NO: 5676586 - DNA, 16 bp, Homo sapiens
cctcaagccccttctc

SEQ ID NO: 5676587 - DNA, 17 bp, Homo sapiens
cctcaagcgatcctcct

SEQ ID NO: 5676588 - DNA, 15 bp, Homo sapiens
cctcaagctgcatct

SEQ ID NO: 5676589 - DNA, 16 bp, Homo sapiens
cctcaagcttctcaga

SEQ ID NO: 5676590 - DNA, 17 bp, Homo sapiens
cctcaaggaagagccag

SEQ ID NO: 5676591 - DNA, 18 bp, Homo sapiens
cctcaaggaagagccagc

SEQ ID NO: 5676592 - DNA, 12 bp, Homo sapiens
cctcaaggactt

SEQ ID NO: 5676593 - DNA, 16 bp, Homo sapiens
cctcaaggcctcccac

SEQ ID NO: 5676594 - DNA, 15 bp, Homo sapiens
cctcaaggctgggag

SEQ ID NO: 5676595 - DNA, 16 bp, Homo sapiens
cctcaagggacaggga

SEQ ID NO: 5676596 - DNA, 15 bp, Homo sapiens
cctcaaggggcaggg

SEQ ID NO: 5676597 - DNA, 22 bp, Homo sapiens
cctcaagggtagggtctgcgtg

SEQ ID NO: 5676598 - DNA, 21 bp, Homo sapiens
cctcaaggtccattattttgt

SEQ ID NO: 5676599 - DNA, 13 bp, Homo sapiens
cctcaagtctttc

SEQ ID NO: 5676600 - DNA, 14 bp, Homo sapiens
cctcaagtctttct

SEQ ID NO: 5676601 - DNA, 19 bp, Homo sapiens
cctcaagtctttctctttc

SEQ ID NO: 5676602 - DNA, 17 bp, Homo sapiens
cctcaagtgatcctccc

SEQ ID NO: 5676603 - DNA, 18 bp, Homo sapiens
cctcaagtgatcctccca

SEQ ID NO: 5676604 - DNA, 23 bp, Homo sapiens
cctcaagtgattctcctgcctca

SEQ ID NO: 5676605 - DNA, 17 bp, Homo sapiens
cctcaagtgtcctgaaa

SEQ ID NO: 5676606 - DNA, 17 bp, Homo sapiens
cctcaagttccagtgca

SEQ ID NO: 5676607 - DNA, 19 bp, Homo sapiens
cctcaagttcttggaccag

SEQ ID NO: 5676608 - DNA, 16 bp, Homo sapiens
cctcaatccaccttca

SEQ ID NO: 5676609 - DNA, 18 bp, Homo sapiens
cctcaatccagctatgtt

SEQ ID NO: 5676610 - DNA, 23 bp, Homo sapiens
cctcaatgccagtaacgcgtctt

SEQ ID NO: 5676611 - DNA, 17 bp, Homo sapiens
cctcaatgccctgccat

SEQ ID NO: 5676612 - DNA, 16 bp, Homo sapiens
cctcaatgtgaccagg

SEQ ID NO: 5676613 - DNA, 23 bp, Homo sapiens
cctcacacacaatgtgtctgaga

SEQ ID NO: 5676614 - DNA, 22 bp, Homo sapiens
cctcacacacacagctgggcaa

SEQ ID NO: 5676615 - DNA, 22 bp, Homo sapiens
cctcacacacagactcatatta

SEQ ID NO: 5676616 - DNA, 20 bp, Homo sapiens
cctcacacacctctgcccct

SEQ ID NO: 5676617 - DNA, 15 bp, Homo sapiens
cctcacacccagagg

SEQ ID NO: 5676618 - DNA, 12 bp, Homo sapiens
cctcacacccct

SEQ ID NO: 5676619 - DNA, 15 bp, Homo sapiens
cctcacacccctgtc

SEQ ID NO: 5676620 - DNA, 17 bp, Homo sapiens
cctcacacctcccttca

SEQ ID NO: 5676621 - DNA, 16 bp, Homo sapiens
cctcacactactgtat

SEQ ID NO: 5676622 - DNA, 14 bp, Homo sapiens
cctcacactccaga

SEQ ID NO: 5676623 - DNA, 15 bp, Homo sapiens
cctcacactccttta

SEQ ID NO: 5676624 - DNA, 17 bp, Homo sapiens
cctcacactgcaaggga

SEQ ID NO: 5676625 - DNA, 19 bp, Homo sapiens
cctcacactgctgtcctct

SEQ ID NO: 5676626 - DNA, 18 bp, Homo sapiens
cctcacagactcttccac

SEQ ID NO: 5676627 - DNA, 21 bp, Homo sapiens
cctcacagatgctggcctctt

SEQ ID NO: 5676628 - DNA, 22 bp, Homo sapiens
cctcacagatgctggcctcttg

SEQ ID NO: 5676629 - DNA, 23 bp, Homo sapiens
cctcacagatgctggcctcttgg

SEQ ID NO: 5676630 - DNA, 13 bp, Homo sapiens
cctcacagcctct

SEQ ID NO: 5676631 - DNA, 18 bp, Homo sapiens
cctcacagcctctccctt

SEQ ID NO: 5676632 - DNA, 14 bp, Homo sapiens
cctcacagcctctg

SEQ ID NO: 5676633 - DNA, 15 bp, Homo sapiens
cctcacagcctctga

SEQ ID NO: 5676634 - DNA, 19 bp, Homo sapiens
cctcacagcctctgacccc

SEQ ID NO: 5676635 - DNA, 23 bp, Homo sapiens
cctcacagcctctgacccctcct

SEQ ID NO: 5676636 - DNA, 19 bp, Homo sapiens
cctcacagccttggctcct

SEQ ID NO: 5676637 - DNA, 12 bp, Homo sapiens
cctcacaggagc

SEQ ID NO: 5676638 - DNA, 22 bp, Homo sapiens
cctcacagtattgctcacccag

SEQ ID NO: 5676639 - DNA, 23 bp, Homo sapiens
cctcacagtcccactgtgcaggt

SEQ ID NO: 5676640 - DNA, 24 bp, Homo sapiens
cctcacagtccttaccagcagagc

SEQ ID NO: 5676641 - DNA, 24 bp, Homo sapiens
cctcacagtgacccttcccaatca

SEQ ID NO: 5676642 - DNA, 22 bp, Homo sapiens
cctcacatacccacacattcca

SEQ ID NO: 5676643 - DNA, 23 bp, Homo sapiens
cctcacatacccacacattccag

SEQ ID NO: 5676644 - DNA, 21 bp, Homo sapiens
cctcacatagctacccaaaag

SEQ ID NO: 5676645 - DNA, 13 bp, Homo sapiens
cctcacatcttta

SEQ ID NO: 5676646 - DNA, 15 bp, Homo sapiens
cctcacatctttcac

SEQ ID NO: 5676647 - DNA, 15 bp, Homo sapiens
cctcacatgcccgct

SEQ ID NO: 5676648 - DNA, 19 bp, Homo sapiens
cctcacatgcccgctgtcc

SEQ ID NO: 5676649 - DNA, 12 bp, Homo sapiens
cctcacatttgt

SEQ ID NO: 5676650 - DNA, 19 bp, Homo sapiens
cctcaccaataacttcaga

SEQ ID NO: 5676651 - DNA, 14 bp, Homo sapiens
cctcaccacagcct

SEQ ID NO: 5676652 - DNA, 15 bp, Homo sapiens
cctcaccacccactt

SEQ ID NO: 5676653 - DNA, 12 bp, Homo sapiens
cctcaccacctc

SEQ ID NO: 5676654 - DNA, 14 bp, Homo sapiens
cctcaccacctgac

SEQ ID NO: 5676655 - DNA, 17 bp, Homo sapiens
cctcaccacgtggggcc

SEQ ID NO: 5676656 - DNA, 19 bp, Homo sapiens
cctcacccacccctgcaca

SEQ ID NO: 5676657 - DNA, 14 bp, Homo sapiens
cctcacccactctg

SEQ ID NO: 5676658 - DNA, 23 bp, Homo sapiens
cctcacccactttggcctccgtt

SEQ ID NO: 5676659 - DNA, 15 bp, Homo sapiens
cctcacccagatcag

SEQ ID NO: 5676660 - DNA, 15 bp, Homo sapiens
cctcacccagggccc

SEQ ID NO: 5676661 - DNA, 14 bp, Homo sapiens
cctcaccccagctc

SEQ ID NO: 5676662 - DNA, 14 bp, Homo sapiens
cctcacccccaccc

SEQ ID NO: 5676663 - DNA, 14 bp, Homo sapiens
cctcacccccacct

SEQ ID NO: 5676664 - DNA, 19 bp, Homo sapiens
cctcacccccagctttgct

SEQ ID NO: 5676665 - DNA, 20 bp, Homo sapiens
cctcaccccccactcttagg

SEQ ID NO: 5676666 - DNA, 16 bp, Homo sapiens
cctcaccccctcccac

SEQ ID NO: 5676667 - DNA, 17 bp, Homo sapiens
cctcaccccgaggccct

SEQ ID NO: 5676668 - DNA, 20 bp, Homo sapiens
cctcaccccgaggccctgca

SEQ ID NO: 5676669 - DNA, 21 bp, Homo sapiens
cctcaccccgaggccctgcat

SEQ ID NO: 5676670 - DNA, 22 bp, Homo sapiens
cctcaccccgaggccctgcatg

SEQ ID NO: 5676671 - DNA, 19 bp, Homo sapiens
cctcaccccgttacagctc

SEQ ID NO: 5676672 - DNA, 18 bp, Homo sapiens
cctcacccctgcaggcgg

SEQ ID NO: 5676673 - DNA, 16 bp, Homo sapiens
cctcacccctgccctg

SEQ ID NO: 5676674 - DNA, 18 bp, Homo sapiens
cctcacccctgccctggg

SEQ ID NO: 5676675 - DNA, 22 bp, Homo sapiens
cctcacccctggttctcatctt

SEQ ID NO: 5676676 - DNA, 23 bp, Homo sapiens
cctcacccctggttctcatcttt

SEQ ID NO: 5676677 - DNA, 15 bp, Homo sapiens
cctcacccctgtcct

SEQ ID NO: 5676678 - DNA, 16 bp, Homo sapiens
cctcaccctctccgca

SEQ ID NO: 5676679 - DNA, 17 bp, Homo sapiens
cctcaccctctgtcccc

SEQ ID NO: 5676680 - DNA, 18 bp, Homo sapiens
cctcaccctgagcccctt

SEQ ID NO: 5676681 - DNA, 23 bp, Homo sapiens
cctcaccctgagccccttccttg

SEQ ID NO: 5676682 - DNA, 15 bp, Homo sapiens
cctcaccctgcctta

SEQ ID NO: 5676683 - DNA, 12 bp, Homo sapiens
cctcaccctgct

SEQ ID NO: 5676684 - DNA, 23 bp, Homo sapiens
cctcaccctgcttggggcctggc

SEQ ID NO: 5676685 - DNA, 22 bp, Homo sapiens
cctcaccctgtgggaccgcctg

SEQ ID NO: 5676686 - DNA, 23 bp, Homo sapiens
cctcaccctgtgggaccgcctgg

SEQ ID NO: 5676687 - DNA, 12 bp, Homo sapiens
cctcaccgagca

SEQ ID NO: 5676688 - DNA, 14 bp, Homo sapiens
cctcaccgcttccc

SEQ ID NO: 5676689 - DNA, 16 bp, Homo sapiens
cctcaccggcatgctg

SEQ ID NO: 5676690 - DNA, 22 bp, Homo sapiens
cctcacctcaggaccccagagg

SEQ ID NO: 5676691 - DNA, 12 bp, Homo sapiens
cctcacctcatg

SEQ ID NO: 5676692 - DNA, 14 bp, Homo sapiens
cctcacctcatgcc

SEQ ID NO: 5676693 - DNA, 15 bp, Homo sapiens
cctcacctcccaggg

SEQ ID NO: 5676694 - DNA, 14 bp, Homo sapiens
cctcacctctaccc

SEQ ID NO: 5676695 - DNA, 13 bp, Homo sapiens
cctcacctctcca

SEQ ID NO: 5676696 - DNA, 14 bp, Homo sapiens
cctcacctctccag

SEQ ID NO: 5676697 - DNA, 19 bp, Homo sapiens
cctcacctctcccccaagg

SEQ ID NO: 5676698 - DNA, 11 bp, Homo sapiens
cctcacctctg

SEQ ID NO: 5676699 - DNA, 16 bp, Homo sapiens
cctcacctctgaggac

SEQ ID NO: 5676700 - DNA, 12 bp, Homo sapiens
cctcacctctgg

SEQ ID NO: 5676701 - DNA, 14 bp, Homo sapiens
cctcacctctttgt

SEQ ID NO: 5676702 - DNA, 13 bp, Homo sapiens
cctcacctgcatc

SEQ ID NO: 5676703 - DNA, 17 bp, Homo sapiens
cctcacctgcatcctct

SEQ ID NO: 5676704 - DNA, 19 bp, Homo sapiens
cctcacctgcccctctgtt

SEQ ID NO: 5676705 - DNA, 18 bp, Homo sapiens
cctcacctgcctgccctc

SEQ ID NO: 5676706 - DNA, 13 bp, Homo sapiens
cctcacctggctt

SEQ ID NO: 5676707 - DNA, 15 bp, Homo sapiens
cctcacctggcttcc

SEQ ID NO: 5676708 - DNA, 20 bp, Homo sapiens
cctcacctggcttcccagga

SEQ ID NO: 5676709 - DNA, 21 bp, Homo sapiens
cctcacctggcttcccaggac

SEQ ID NO: 5676710 - DNA, 24 bp, Homo sapiens
cctcacctggcttcccaggaccct

SEQ ID NO: 5676711 - DNA, 19 bp, Homo sapiens
cctcacctgggcacctggg

SEQ ID NO: 5676712 - DNA, 22 bp, Homo sapiens
cctcacctgggcacctggggag

SEQ ID NO: 5676713 - DNA, 22 bp, Homo sapiens
cctcacctgggcctttcctgtg

SEQ ID NO: 5676714 - DNA, 14 bp, Homo sapiens
cctcacctgtctag

SEQ ID NO: 5676715 - DNA, 17 bp, Homo sapiens
cctcaccttgcaacaca

SEQ ID NO: 5676716 - DNA, 19 bp, Homo sapiens
cctcaccttgcaacacaca

SEQ ID NO: 5676717 - DNA, 15 bp, Homo sapiens
cctcaccttggcacc

SEQ ID NO: 5676718 - DNA, 19 bp, Homo sapiens
cctcaccttgggctggggg

SEQ ID NO: 5676719 - DNA, 17 bp, Homo sapiens
cctcacctttcccatct

SEQ ID NO: 5676720 - DNA, 20 bp, Homo sapiens
cctcacgcaactcacacctc

SEQ ID NO: 5676721 - DNA, 14 bp, Homo sapiens
cctcacgcaagtgc

SEQ ID NO: 5676722 - DNA, 22 bp, Homo sapiens
cctcacgcaagtgccagggctg

SEQ ID NO: 5676723 - DNA, 15 bp, Homo sapiens
cctcacgcccttcaa

SEQ ID NO: 5676724 - DNA, 21 bp, Homo sapiens
cctcacgcccttcaatgctgc

SEQ ID NO: 5676725 - DNA, 23 bp, Homo sapiens
cctcacgtgcaggacagctcttg

SEQ ID NO: 5676726 - DNA, 17 bp, Homo sapiens
cctcacgtttcttcccc

SEQ ID NO: 5676727 - DNA, 14 bp, Homo sapiens
cctcactaattttt

SEQ ID NO: 5676728 - DNA, 14 bp, Homo sapiens
cctcactagctccc

SEQ ID NO: 5676729 - DNA, 17 bp, Homo sapiens
cctcactagctccccaa

SEQ ID NO: 5676730 - DNA, 21 bp, Homo sapiens
cctcactatcccggctgccct

SEQ ID NO: 5676731 - DNA, 21 bp, Homo sapiens
cctcactatggtatgctggcc

SEQ ID NO: 5676732 - DNA, 24 bp, Homo sapiens
cctcactatggtatgctggccagc

SEQ ID NO: 5676733 - DNA, 20 bp, Homo sapiens
cctcactattacttgaactt

SEQ ID NO: 5676734 - DNA, 17 bp, Homo sapiens
cctcactcagcaccact

SEQ ID NO: 5676735 - DNA, 19 bp, Homo sapiens
cctcactcaggaaccctgg

SEQ ID NO: 5676736 - DNA, 12 bp, Homo sapiens
cctcactccaaa

SEQ ID NO: 5676737 - DNA, 13 bp, Homo sapiens
cctcactccacag

SEQ ID NO: 5676738 - DNA, 16 bp, Homo sapiens
cctcactccacagagt

SEQ ID NO: 5676739 - DNA, 17 bp, Homo sapiens
cctcactccactcccct

SEQ ID NO: 5676740 - DNA, 18 bp, Homo sapiens
cctcactccactcccctc

SEQ ID NO: 5676741 - DNA, 15 bp, Homo sapiens
cctcactccccaggg

SEQ ID NO: 5676742 - DNA, 16 bp, Homo sapiens
cctcactccccaggga

SEQ ID NO: 5676743 - DNA, 20 bp, Homo sapiens
cctcactcccttcccataag

SEQ ID NO: 5676744 - DNA, 18 bp, Homo sapiens
cctcactcctccgtgagc

SEQ ID NO: 5676745 - DNA, 22 bp, Homo sapiens
cctcactcgggtttctctgtgg

SEQ ID NO: 5676746 - DNA, 16 bp, Homo sapiens
cctcactctgccaggg

SEQ ID NO: 5676747 - DNA, 19 bp, Homo sapiens
cctcactctgccagggcag

SEQ ID NO: 5676748 - DNA, 22 bp, Homo sapiens
cctcactctgctaccttgcccc

SEQ ID NO: 5676749 - DNA, 15 bp, Homo sapiens
cctcactctgtcagc

SEQ ID NO: 5676750 - DNA, 16 bp, Homo sapiens
cctcactctgtcagcc

SEQ ID NO: 5676751 - DNA, 20 bp, Homo sapiens
cctcactctgtcagccagcc

SEQ ID NO: 5676752 - DNA, 15 bp, Homo sapiens
cctcactctgtccct

SEQ ID NO: 5676753 - DNA, 18 bp, Homo sapiens
cctcactctgtccctgtc

SEQ ID NO: 5676754 - DNA, 17 bp, Homo sapiens
cctcactcttgccaacc

SEQ ID NO: 5676755 - DNA, 20 bp, Homo sapiens
cctcactgagaggcctggag

SEQ ID NO: 5676756 - DNA, 12 bp, Homo sapiens
cctcactgagga

SEQ ID NO: 5676757 - DNA, 12 bp, Homo sapiens
cctcactgcatc

SEQ ID NO: 5676758 - DNA, 21 bp, Homo sapiens
cctcactgcatctttctcttc

SEQ ID NO: 5676759 - DNA, 14 bp, Homo sapiens
cctcactgccccac

SEQ ID NO: 5676760 - DNA, 15 bp, Homo sapiens
cctcactgccccacc

SEQ ID NO: 5676761 - DNA, 19 bp, Homo sapiens
cctcactgccccaccagcc

SEQ ID NO: 5676762 - DNA, 13 bp, Homo sapiens
cctcactgcctca

SEQ ID NO: 5676763 - DNA, 19 bp, Homo sapiens
cctcactgctccctgaagc

SEQ ID NO: 5676764 - DNA, 21 bp, Homo sapiens
cctcactgctccctgaagcca

SEQ ID NO: 5676765 - DNA, 18 bp, Homo sapiens
cctcactggaggagcagc

SEQ ID NO: 5676766 - DNA, 22 bp, Homo sapiens
cctcactggccatccctcgtgg

SEQ ID NO: 5676767 - DNA, 17 bp, Homo sapiens
cctcactggcctgccat

SEQ ID NO: 5676768 - DNA, 20 bp, Homo sapiens
cctcactggctcatgcccct

SEQ ID NO: 5676769 - DNA, 22 bp, Homo sapiens
cctcactggctcatgccccttg

SEQ ID NO: 5676770 - DNA, 16 bp, Homo sapiens
cctcactggctctcct

SEQ ID NO: 5676771 - DNA, 17 bp, Homo sapiens
cctcactggctctcctg

SEQ ID NO: 5676772 - DNA, 12 bp, Homo sapiens
cctcactggctg

SEQ ID NO: 5676773 - DNA, 13 bp, Homo sapiens
cctcactggctgg

SEQ ID NO: 5676774 - DNA, 23 bp, Homo sapiens
cctcactggctggggcagagggg

SEQ ID NO: 5676775 - DNA, 21 bp, Homo sapiens
cctcactgggtggggtgagga

SEQ ID NO: 5676776 - DNA, 22 bp, Homo sapiens
cctcactgggtgtggcctggct

SEQ ID NO: 5676777 - DNA, 17 bp, Homo sapiens
cctcactggtgcattta

SEQ ID NO: 5676778 - DNA, 17 bp, Homo sapiens
cctcactgtcatctgcc

SEQ ID NO: 5676779 - DNA, 18 bp, Homo sapiens
cctcactgtcatctgcca

SEQ ID NO: 5676780 - DNA, 19 bp, Homo sapiens
cctcactgtcatctgccag

SEQ ID NO: 5676781 - DNA, 15 bp, Homo sapiens
cctcactgtgacctg

SEQ ID NO: 5676782 - DNA, 18 bp, Homo sapiens
cctcactgtgacctgctc

SEQ ID NO: 5676783 - DNA, 21 bp, Homo sapiens
cctcactgtgacctgctcctg

SEQ ID NO: 5676784 - DNA, 23 bp, Homo sapiens
cctcacttaaccaccccatacca

SEQ ID NO: 5676785 - DNA, 13 bp, Homo sapiens
cctcacttccctg

SEQ ID NO: 5676786 - DNA, 18 bp, Homo sapiens
cctcacttccctgggaac

SEQ ID NO: 5676787 - DNA, 14 bp, Homo sapiens
cctcacttcctttg

SEQ ID NO: 5676788 - DNA, 15 bp, Homo sapiens
cctcacttcctttgc

SEQ ID NO: 5676789 - DNA, 19 bp, Homo sapiens
cctcacttctgtctcctgt

SEQ ID NO: 5676790 - DNA, 22 bp, Homo sapiens
cctcacttctgtctcctgtctt

SEQ ID NO: 5676791 - DNA, 19 bp, Homo sapiens
cctcacttggtctgccagg

SEQ ID NO: 5676792 - DNA, 19 bp, Homo sapiens
cctcacttgtggcagcttc

SEQ ID NO: 5676793 - DNA, 18 bp, Homo sapiens
cctcacttttaatgaaca

SEQ ID NO: 5676794 - DNA, 22 bp, Homo sapiens
cctcacttttaatgaacaaatg

SEQ ID NO: 5676795 - DNA, 14 bp, Homo sapiens
cctcacttttcaat

SEQ ID NO: 5676796 - DNA, 20 bp, Homo sapiens
cctcagaaacactggggctg

SEQ ID NO: 5676797 - DNA, 21 bp, Homo sapiens
cctcagaaacactggggctgg

SEQ ID NO: 5676798 - DNA, 16 bp, Homo sapiens
cctcagaaagtgcagc

SEQ ID NO: 5676799 - DNA, 23 bp, Homo sapiens
cctcagaaagtgcagcatggagg

SEQ ID NO: 5676800 - DNA, 16 bp, Homo sapiens
cctcagaacccttggc

SEQ ID NO: 5676801 - DNA, 12 bp, Homo sapiens
cctcagaagaaa

SEQ ID NO: 5676802 - DNA, 19 bp, Homo sapiens
cctcagaagaaaacttttg

SEQ ID NO: 5676803 - DNA, 16 bp, Homo sapiens
cctcagaagcctcgac

SEQ ID NO: 5676804 - DNA, 18 bp, Homo sapiens
cctcagaaggccccagag

SEQ ID NO: 5676805 - DNA, 18 bp, Homo sapiens
cctcagacaatccactct

SEQ ID NO: 5676806 - DNA, 22 bp, Homo sapiens
cctcagacaatccactctcagg

SEQ ID NO: 5676807 - DNA, 14 bp, Homo sapiens
cctcagacagactt

SEQ ID NO: 5676808 - DNA, 13 bp, Homo sapiens
cctcagacattta

SEQ ID NO: 5676809 - DNA, 14 bp, Homo sapiens
cctcagaccaactc

SEQ ID NO: 5676810 - DNA, 18 bp, Homo sapiens
cctcagacccaggagtcc

SEQ ID NO: 5676811 - DNA, 21 bp, Homo sapiens
cctcagacccaggagtccaga

SEQ ID NO: 5676812 - DNA, 22 bp, Homo sapiens
cctcagacccaggagtccagac

SEQ ID NO: 5676813 - DNA, 19 bp, Homo sapiens
cctcagaccccaggtcagc

SEQ ID NO: 5676814 - DNA, 23 bp, Homo sapiens
cctcagacgagacccaagggcag

SEQ ID NO: 5676815 - DNA, 20 bp, Homo sapiens
cctcagacgggctgagagga

SEQ ID NO: 5676816 - DNA, 20 bp, Homo sapiens
cctcagacgttgcctgagaa

SEQ ID NO: 5676817 - DNA, 14 bp, Homo sapiens
cctcagactcagag

SEQ ID NO: 5676818 - DNA, 20 bp, Homo sapiens
cctcagactcagaggtccag

SEQ ID NO: 5676819 - DNA, 21 bp, Homo sapiens
cctcagactcagaggtccagg

SEQ ID NO: 5676820 - DNA, 19 bp, Homo sapiens
cctcagactctaagaaaga

SEQ ID NO: 5676821 - DNA, 17 bp, Homo sapiens
cctcagactgcacccag

SEQ ID NO: 5676822 - DNA, 21 bp, Homo sapiens
cctcagactgcacccaggagg

SEQ ID NO: 5676823 - DNA, 15 bp, Homo sapiens
cctcagactgctcaa

SEQ ID NO: 5676824 - DNA, 16 bp, Homo sapiens
cctcagagaagtccag

SEQ ID NO: 5676825 - DNA, 16 bp, Homo sapiens
cctcagagacaccaaa

SEQ ID NO: 5676826 - DNA, 22 bp, Homo sapiens
cctcagagacaccaaactgcca

SEQ ID NO: 5676827 - DNA, 20 bp, Homo sapiens
cctcagagatctcccttctc

SEQ ID NO: 5676828 - DNA, 19 bp, Homo sapiens
cctcagagcagggccaaag

SEQ ID NO: 5676829 - DNA, 18 bp, Homo sapiens
cctcagagcatgatggga

SEQ ID NO: 5676830 - DNA, 19 bp, Homo sapiens
cctcagagccctgccctgc

SEQ ID NO: 5676831 - DNA, 20 bp, Homo sapiens
cctcagagccctgccctgca

SEQ ID NO: 5676832 - DNA, 12 bp, Homo sapiens
cctcagagcctg

SEQ ID NO: 5676833 - DNA, 20 bp, Homo sapiens
cctcagagcctgacctgaga

SEQ ID NO: 5676834 - DNA, 19 bp, Homo sapiens
cctcagagcgccaggaagc

SEQ ID NO: 5676835 - DNA, 22 bp, Homo sapiens
cctcagagcgccaggaagccag

SEQ ID NO: 5676836 - DNA, 15 bp, Homo sapiens
cctcagagcttcctg

SEQ ID NO: 5676837 - DNA, 17 bp, Homo sapiens
cctcagagcttcctggg

SEQ ID NO: 5676838 - DNA, 15 bp, Homo sapiens
cctcagaggcagcag

SEQ ID NO: 5676839 - DNA, 20 bp, Homo sapiens
cctcagaggccccttgctgc

SEQ ID NO: 5676840 - DNA, 22 bp, Homo sapiens
cctcagaggccccttgctgctg

SEQ ID NO: 5676841 - DNA, 19 bp, Homo sapiens
cctcagaggcgtgctggtc

SEQ ID NO: 5676842 - DNA, 18 bp, Homo sapiens
cctcagaggctgagccct

SEQ ID NO: 5676843 - DNA, 23 bp, Homo sapiens
cctcagagggataaggcagttga

SEQ ID NO: 5676844 - DNA, 14 bp, Homo sapiens
cctcagagggtccc

SEQ ID NO: 5676845 - DNA, 18 bp, Homo sapiens
cctcagagggtccctagg

SEQ ID NO: 5676846 - DNA, 16 bp, Homo sapiens
cctcagagtccaggcc

SEQ ID NO: 5676847 - DNA, 17 bp, Homo sapiens
cctcagagtccaggccc

SEQ ID NO: 5676848 - DNA, 14 bp, Homo sapiens
cctcagagtcccgg

SEQ ID NO: 5676849 - DNA, 14 bp, Homo sapiens
cctcagagtgcaag

SEQ ID NO: 5676850 - DNA, 13 bp, Homo sapiens
cctcagagtggag

SEQ ID NO: 5676851 - DNA, 23 bp, Homo sapiens
cctcagatagacctgtgacctgg

SEQ ID NO: 5676852 - DNA, 14 bp, Homo sapiens
cctcagatcccagg

SEQ ID NO: 5676853 - DNA, 16 bp, Homo sapiens
cctcagatcccagggt

SEQ ID NO: 5676854 - DNA, 17 bp, Homo sapiens
cctcagatctgaacaca

SEQ ID NO: 5676855 - DNA, 17 bp, Homo sapiens
cctcagatgaaaataaa

SEQ ID NO: 5676856 - DNA, 14 bp, Homo sapiens
cctcagatgatctc

SEQ ID NO: 5676857 - DNA, 20 bp, Homo sapiens
cctcagatgcacatgagctg

SEQ ID NO: 5676858 - DNA, 22 bp, Homo sapiens
cctcagatgcgttcgcctctgg

SEQ ID NO: 5676859 - DNA, 21 bp, Homo sapiens
cctcagatggcagcttttaaa

SEQ ID NO: 5676860 - DNA, 17 bp, Homo sapiens
cctcagatgtcccttga

SEQ ID NO: 5676861 - DNA, 17 bp, Homo sapiens
cctcagattagatgtgc

SEQ ID NO: 5676862 - DNA, 21 bp, Homo sapiens
cctcagattccttcccatgga

SEQ ID NO: 5676863 - DNA, 14 bp, Homo sapiens
cctcagattgctga

SEQ ID NO: 5676864 - DNA, 16 bp, Homo sapiens
cctcagattgctgaat

SEQ ID NO: 5676865 - DNA, 18 bp, Homo sapiens
cctcagcaaacccaaaga

SEQ ID NO: 5676866 - DNA, 20 bp, Homo sapiens
cctcagcaaacccaaagatg

SEQ ID NO: 5676867 - DNA, 15 bp, Homo sapiens
cctcagcaagctgcc

SEQ ID NO: 5676868 - DNA, 17 bp, Homo sapiens
cctcagcaagctgccca

SEQ ID NO: 5676869 - DNA, 20 bp, Homo sapiens
cctcagcaagctgcccagcc

SEQ ID NO: 5676870 - DNA, 22 bp, Homo sapiens
cctcagcaagtgctgagtctgt

SEQ ID NO: 5676871 - DNA, 18 bp, Homo sapiens
cctcagcaccccactcct

SEQ ID NO: 5676872 - DNA, 16 bp, Homo sapiens
cctcagcacccctcca

SEQ ID NO: 5676873 - DNA, 17 bp, Homo sapiens
cctcagcatcctggcac

SEQ ID NO: 5676874 - DNA, 18 bp, Homo sapiens
cctcagcattgtcagcct

SEQ ID NO: 5676875 - DNA, 19 bp, Homo sapiens
cctcagcattgtcagcctg

SEQ ID NO: 5676876 - DNA, 20 bp, Homo sapiens
cctcagcattgtcagcctga

SEQ ID NO: 5676877 - DNA, 22 bp, Homo sapiens
cctcagcattgtcagcctgaag

SEQ ID NO: 5676878 - DNA, 12 bp, Homo sapiens
cctcagcattta

SEQ ID NO: 5676879 - DNA, 21 bp, Homo sapiens
cctcagcatttccttccagcc

SEQ ID NO: 5676880 - DNA, 18 bp, Homo sapiens
cctcagccaaacacagag

SEQ ID NO: 5676881 - DNA, 21 bp, Homo sapiens
cctcagccacaaaactctgtc

SEQ ID NO: 5676882 - DNA, 13 bp, Homo sapiens
cctcagccaccct

SEQ ID NO: 5676883 - DNA, 19 bp, Homo sapiens
cctcagccacccttggtct

SEQ ID NO: 5676884 - DNA, 11 bp, Homo sapiens
cctcagccaga

SEQ ID NO: 5676885 - DNA, 21 bp, Homo sapiens
cctcagccagccctggaggct

SEQ ID NO: 5676886 - DNA, 15 bp, Homo sapiens
cctcagccagctgcc

SEQ ID NO: 5676887 - DNA, 19 bp, Homo sapiens
cctcagccagctgcccaca

SEQ ID NO: 5676888 - DNA, 21 bp, Homo sapiens
cctcagccatgggaacctcat

SEQ ID NO: 5676889 - DNA, 16 bp, Homo sapiens
cctcagccccaggaga

SEQ ID NO: 5676890 - DNA, 17 bp, Homo sapiens
cctcagccccagggccc

SEQ ID NO: 5676891 - DNA, 15 bp, Homo sapiens
cctcagcccccagga

SEQ ID NO: 5676892 - DNA, 16 bp, Homo sapiens
cctcagcccccaggat

SEQ ID NO: 5676893 - DNA, 20 bp, Homo sapiens
cctcagcccccaggccaggt

SEQ ID NO: 5676894 - DNA, 13 bp, Homo sapiens
cctcagcccctct

SEQ ID NO: 5676895 - DNA, 20 bp, Homo sapiens
cctcagcccctcttgccccc

SEQ ID NO: 5676896 - DNA, 15 bp, Homo sapiens
cctcagccctctctt

SEQ ID NO: 5676897 - DNA, 13 bp, Homo sapiens
cctcagccctgac

SEQ ID NO: 5676898 - DNA, 15 bp, Homo sapiens
cctcagccctgctcc

SEQ ID NO: 5676899 - DNA, 18 bp, Homo sapiens
cctcagccctgctccctg

SEQ ID NO: 5676900 - DNA, 20 bp, Homo sapiens
cctcagccctgctccctgcc

SEQ ID NO: 5676901 - DNA, 15 bp, Homo sapiens
cctcagccctggccc

SEQ ID NO: 5676902 - DNA, 18 bp, Homo sapiens
cctcagccctggccctgc

SEQ ID NO: 5676903 - DNA, 19 bp, Homo sapiens
cctcagccctggccttttt

SEQ ID NO: 5676904 - DNA, 18 bp, Homo sapiens
cctcagcccttgccccca

SEQ ID NO: 5676905 - DNA, 17 bp, Homo sapiens
cctcagccgtcagccat

SEQ ID NO: 5676906 - DNA, 18 bp, Homo sapiens
cctcagccgtcagccatc

SEQ ID NO: 5676907 - DNA, 19 bp, Homo sapiens
cctcagccgtcagccatca

SEQ ID NO: 5676908 - DNA, 14 bp, Homo sapiens
cctcagcctagacc

SEQ ID NO: 5676909 - DNA, 20 bp, Homo sapiens
cctcagcctagaccctcctc

SEQ ID NO: 5676910 - DNA, 17 bp, Homo sapiens
cctcagcctcagaggag

SEQ ID NO: 5676911 - DNA, 23 bp, Homo sapiens
cctcagcctcccaagtagctggg

SEQ ID NO: 5676912 - DNA, 17 bp, Homo sapiens
cctcagcctcccaggta

SEQ ID NO: 5676913 - DNA, 22 bp, Homo sapiens
cctcagcctcccatagctggga

SEQ ID NO: 5676914 - DNA, 16 bp, Homo sapiens
cctcagcctccccttc

SEQ ID NO: 5676915 - DNA, 17 bp, Homo sapiens
cctcagcctccccttct

SEQ ID NO: 5676916 - DNA, 19 bp, Homo sapiens
cctcagcctccccttcttc

SEQ ID NO: 5676917 - DNA, 22 bp, Homo sapiens
cctcagcctccccttcttcccg

SEQ ID NO: 5676918 - DNA, 15 bp, Homo sapiens
cctcagcctcccgag

SEQ ID NO: 5676919 - DNA, 12 bp, Homo sapiens
cctcagcctcct

SEQ ID NO: 5676920 - DNA, 13 bp, Homo sapiens
cctcagcctccta

SEQ ID NO: 5676921 - DNA, 14 bp, Homo sapiens
cctcagcctcctga

SEQ ID NO: 5676922 - DNA, 12 bp, Homo sapiens
cctcagcctctc

SEQ ID NO: 5676923 - DNA, 22 bp, Homo sapiens
cctcagcctctgcaactgcaag

SEQ ID NO: 5676924 - DNA, 18 bp, Homo sapiens
cctcagcctctgccactg

SEQ ID NO: 5676925 - DNA, 22 bp, Homo sapiens
cctcagcctgaaccccagggct

SEQ ID NO: 5676926 - DNA, 13 bp, Homo sapiens
cctcagcctgcac

SEQ ID NO: 5676927 - DNA, 17 bp, Homo sapiens
cctcagcctgcccacct

SEQ ID NO: 5676928 - DNA, 21 bp, Homo sapiens
cctcagcctgcccacctctcc

SEQ ID NO: 5676929 - DNA, 15 bp, Homo sapiens
cctcagcctgcctga

SEQ ID NO: 5676930 - DNA, 18 bp, Homo sapiens
cctcagcctgcctgaaga

SEQ ID NO: 5676931 - DNA, 13 bp, Homo sapiens
cctcagcctgctt

SEQ ID NO: 5676932 - DNA, 12 bp, Homo sapiens
cctcagcctgga

SEQ ID NO: 5676933 - DNA, 13 bp, Homo sapiens
cctcagcctggag

SEQ ID NO: 5676934 - DNA, 15 bp, Homo sapiens
cctcagcctggagag

SEQ ID NO: 5676935 - DNA, 12 bp, Homo sapiens
cctcagcctggc

SEQ ID NO: 5676936 - DNA, 13 bp, Homo sapiens
cctcagcctggcc

SEQ ID NO: 5676937 - DNA, 17 bp, Homo sapiens
cctcagcctggccagac

SEQ ID NO: 5676938 - DNA, 20 bp, Homo sapiens
cctcagcctggccagacaca

SEQ ID NO: 5676939 - DNA, 22 bp, Homo sapiens
cctcagcctggccagacacagg

SEQ ID NO: 5676940 - DNA, 13 bp, Homo sapiens
cctcagcctgggc

SEQ ID NO: 5676941 - DNA, 20 bp, Homo sapiens
cctcagcctgggcgctggtc

SEQ ID NO: 5676942 - DNA, 21 bp, Homo sapiens
cctcagcctgggcgctggtcc

SEQ ID NO: 5676943 - DNA, 14 bp, Homo sapiens
cctcagcctggggc

SEQ ID NO: 5676944 - DNA, 15 bp, Homo sapiens
cctcagcctggggct

SEQ ID NO: 5676945 - DNA, 23 bp, Homo sapiens
cctcagcctggggtttgaccacc

SEQ ID NO: 5676946 - DNA, 13 bp, Homo sapiens
cctcagccttcca

SEQ ID NO: 5676947 - DNA, 20 bp, Homo sapiens
cctcagccttgaaaaacaag

SEQ ID NO: 5676948 - DNA, 17 bp, Homo sapiens
cctcagccttgactatg

SEQ ID NO: 5676949 - DNA, 19 bp, Homo sapiens
cctcagccttgccagagat

SEQ ID NO: 5676950 - DNA, 15 bp, Homo sapiens
cctcagcgcaggctg

SEQ ID NO: 5676951 - DNA, 17 bp, Homo sapiens
cctcagcgctccctgtc

SEQ ID NO: 5676952 - DNA, 22 bp, Homo sapiens
cctcagcgctccctgtcgcctg

SEQ ID NO: 5676953 - DNA, 20 bp, Homo sapiens
cctcagcgctgcccacacca

SEQ ID NO: 5676954 - DNA, 16 bp, Homo sapiens
cctcagcggaccactc

SEQ ID NO: 5676955 - DNA, 15 bp, Homo sapiens
cctcagcggaggggt

SEQ ID NO: 5676956 - DNA, 21 bp, Homo sapiens
cctcagcgggggccttgaaga

SEQ ID NO: 5676957 - DNA, 20 bp, Homo sapiens
cctcagctacccactatcct

SEQ ID NO: 5676958 - DNA, 14 bp, Homo sapiens
cctcagctcagcct

SEQ ID NO: 5676959 - DNA, 15 bp, Homo sapiens
cctcagctcagcctc

SEQ ID NO: 5676960 - DNA, 16 bp, Homo sapiens
cctcagctcagcctcc

SEQ ID NO: 5676961 - DNA, 20 bp, Homo sapiens
cctcagctccccggcactgc

SEQ ID NO: 5676962 - DNA, 14 bp, Homo sapiens
cctcagctccctga

SEQ ID NO: 5676963 - DNA, 21 bp, Homo sapiens
cctcagctccctgaccccctg

SEQ ID NO: 5676964 - DNA, 11 bp, Homo sapiens
cctcagctcta

SEQ ID NO: 5676965 - DNA, 13 bp, Homo sapiens
cctcagctctggg

SEQ ID NO: 5676966 - DNA, 16 bp, Homo sapiens
cctcagctctgggaga

SEQ ID NO: 5676967 - DNA, 14 bp, Homo sapiens
cctcagctgacccg

SEQ ID NO: 5676968 - DNA, 17 bp, Homo sapiens
cctcagctgacccggcc

SEQ ID NO: 5676969 - DNA, 21 bp, Homo sapiens
cctcagctgacccggcctctc

SEQ ID NO: 5676970 - DNA, 14 bp, Homo sapiens
cctcagctgcacat

SEQ ID NO: 5676971 - DNA, 16 bp, Homo sapiens
cctcagctgccaagca

SEQ ID NO: 5676972 - DNA, 19 bp, Homo sapiens
cctcagctgccaagcactc

SEQ ID NO: 5676973 - DNA, 13 bp, Homo sapiens
cctcagctgcctc

SEQ ID NO: 5676974 - DNA, 17 bp, Homo sapiens
cctcagctgcctcactt

SEQ ID NO: 5676975 - DNA, 18 bp, Homo sapiens
cctcagctgcctcacttc

SEQ ID NO: 5676976 - DNA, 19 bp, Homo sapiens
cctcagctgcctcacttcc

SEQ ID NO: 5676977 - DNA, 14 bp, Homo sapiens
cctcagctgcctcc

SEQ ID NO: 5676978 - DNA, 13 bp, Homo sapiens
cctcagctgctcc

SEQ ID NO: 5676979 - DNA, 14 bp, Homo sapiens
cctcagctgctccc

SEQ ID NO: 5676980 - DNA, 14 bp, Homo sapiens
cctcagctgcttct

SEQ ID NO: 5676981 - DNA, 13 bp, Homo sapiens
cctcagctggctg

SEQ ID NO: 5676982 - DNA, 21 bp, Homo sapiens
cctcagctggttactcagggt

SEQ ID NO: 5676983 - DNA, 17 bp, Homo sapiens
cctcagctgtcacctgc

SEQ ID NO: 5676984 - DNA, 22 bp, Homo sapiens
cctcagctgtcacctgctcaca

SEQ ID NO: 5676985 - DNA, 21 bp, Homo sapiens
cctcagcttctgggggagaca

SEQ ID NO: 5676986 - DNA, 17 bp, Homo sapiens
cctcaggaacccaccct

SEQ ID NO: 5676987 - DNA, 23 bp, Homo sapiens
cctcaggaactatgggagcctca

SEQ ID NO: 5676988 - DNA, 11 bp, Homo sapiens
cctcaggacaa

SEQ ID NO: 5676989 - DNA, 11 bp, Homo sapiens
cctcaggacca

SEQ ID NO: 5676990 - DNA, 23 bp, Homo sapiens
cctcaggacccatccctgcctgg

SEQ ID NO: 5676991 - DNA, 17 bp, Homo sapiens
cctcaggaccccagagg

SEQ ID NO: 5676992 - DNA, 13 bp, Homo sapiens
cctcaggaccctc

SEQ ID NO: 5676993 - DNA, 17 bp, Homo sapiens
cctcaggaccctcgctg

SEQ ID NO: 5676994 - DNA, 22 bp, Homo sapiens
cctcaggaccctcgctggcccc

SEQ ID NO: 5676995 - DNA, 13 bp, Homo sapiens
cctcaggactgca

SEQ ID NO: 5676996 - DNA, 15 bp, Homo sapiens
cctcaggagagaccc

SEQ ID NO: 5676997 - DNA, 12 bp, Homo sapiens
cctcaggagagc

SEQ ID NO: 5676998 - DNA, 19 bp, Homo sapiens
cctcaggagccgaagccca

SEQ ID NO: 5676999 - DNA, 20 bp, Homo sapiens
cctcaggagggcaggctgag

SEQ ID NO: 5677000 - DNA, 24 bp, Homo sapiens
cctcaggagggcaggctgaggtgg

SEQ ID NO: 5677001 - DNA, 16 bp, Homo sapiens
cctcaggatttcattg

SEQ ID NO: 5677002 - DNA, 20 bp, Homo sapiens
cctcaggcacaccttgcaga

SEQ ID NO: 5677003 - DNA, 13 bp, Homo sapiens
cctcaggcacccg

SEQ ID NO: 5677004 - DNA, 15 bp, Homo sapiens
cctcaggcactagcc

SEQ ID NO: 5677005 - DNA, 17 bp, Homo sapiens
cctcaggcactagcctt

SEQ ID NO: 5677006 - DNA, 22 bp, Homo sapiens
cctcaggcactagcctttggct

SEQ ID NO: 5677007 - DNA, 13 bp, Homo sapiens
cctcaggcagctc

SEQ ID NO: 5677008 - DNA, 11 bp, Homo sapiens
cctcaggcagg

SEQ ID NO: 5677009 - DNA, 15 bp, Homo sapiens
cctcaggcaggaagg

SEQ ID NO: 5677010 - DNA, 12 bp, Homo sapiens
cctcaggcaggt

SEQ ID NO: 5677011 - DNA, 18 bp, Homo sapiens
cctcaggcagtggcccag

SEQ ID NO: 5677012 - DNA, 18 bp, Homo sapiens
cctcaggcataggcctgg

SEQ ID NO: 5677013 - DNA, 20 bp, Homo sapiens
cctcaggccaagggaccagg

SEQ ID NO: 5677014 - DNA, 13 bp, Homo sapiens
cctcaggccaccc

SEQ ID NO: 5677015 - DNA, 18 bp, Homo sapiens
cctcaggccaccctccac

SEQ ID NO: 5677016 - DNA, 14 bp, Homo sapiens
cctcaggccagtgc

SEQ ID NO: 5677017 - DNA, 16 bp, Homo sapiens
cctcaggccagtgcca

SEQ ID NO: 5677018 - DNA, 18 bp, Homo sapiens
cctcaggccagtgccagg

SEQ ID NO: 5677019 - DNA, 19 bp, Homo sapiens
cctcaggccagtgccagga

SEQ ID NO: 5677020 - DNA, 13 bp, Homo sapiens
cctcaggcccagc

SEQ ID NO: 5677021 - DNA, 18 bp, Homo sapiens
cctcaggcccaggagtcc

SEQ ID NO: 5677022 - DNA, 21 bp, Homo sapiens
cctcaggcccaggagtccagg

SEQ ID NO: 5677023 - DNA, 10 bp, Homo sapiens
cctcaggcct

SEQ ID NO: 5677024 - DNA, 13 bp, Homo sapiens
cctcaggcctccc

SEQ ID NO: 5677025 - DNA, 17 bp, Homo sapiens
cctcaggcctggccctt

SEQ ID NO: 5677026 - DNA, 16 bp, Homo sapiens
cctcaggcggggagga

SEQ ID NO: 5677027 - DNA, 18 bp, Homo sapiens
cctcaggcggggaggagg

SEQ ID NO: 5677028 - DNA, 11 bp, Homo sapiens
cctcaggctcc

SEQ ID NO: 5677029 - DNA, 14 bp, Homo sapiens
cctcaggctcccca

SEQ ID NO: 5677030 - DNA, 15 bp, Homo sapiens
cctcaggctccccag

SEQ ID NO: 5677031 - DNA, 16 bp, Homo sapiens
cctcaggctccccaga

SEQ ID NO: 5677032 - DNA, 17 bp, Homo sapiens
cctcaggctccccagaa

SEQ ID NO: 5677033 - DNA, 20 bp, Homo sapiens
cctcaggctccccagaactg

SEQ ID NO: 5677034 - DNA, 13 bp, Homo sapiens
cctcaggctccta

SEQ ID NO: 5677035 - DNA, 12 bp, Homo sapiens
cctcaggctctg

SEQ ID NO: 5677036 - DNA, 13 bp, Homo sapiens
cctcaggctctgc

SEQ ID NO: 5677037 - DNA, 12 bp, Homo sapiens
cctcaggctgct

SEQ ID NO: 5677038 - DNA, 14 bp, Homo sapiens
cctcaggctgctgg

SEQ ID NO: 5677039 - DNA, 16 bp, Homo sapiens
cctcaggctgctggag

SEQ ID NO: 5677040 - DNA, 11 bp, Homo sapiens
cctcagggaca

SEQ ID NO: 5677041 - DNA, 21 bp, Homo sapiens
cctcagggacagagacacctg

SEQ ID NO: 5677042 - DNA, 23 bp, Homo sapiens
cctcagggaccaaggagatgggg

SEQ ID NO: 5677043 - DNA, 16 bp, Homo sapiens
cctcagggactcaggt

SEQ ID NO: 5677044 - DNA, 19 bp, Homo sapiens
cctcagggagcagggaagg

SEQ ID NO: 5677045 - DNA, 23 bp, Homo sapiens
cctcagggatggcccagctgatc

SEQ ID NO: 5677046 - DNA, 23 bp, Homo sapiens
cctcagggatgtgggaatctccc

SEQ ID NO: 5677047 - DNA, 19 bp, Homo sapiens
cctcagggcacgcaggacc

SEQ ID NO: 5677048 - DNA, 18 bp, Homo sapiens
cctcagggcagcctgcct

SEQ ID NO: 5677049 - DNA, 20 bp, Homo sapiens
cctcagggcagcctgcctgg

SEQ ID NO: 5677050 - DNA, 23 bp, Homo sapiens
cctcagggcagcctgcctggagt

SEQ ID NO: 5677051 - DNA, 17 bp, Homo sapiens
cctcagggccaagccgg

SEQ ID NO: 5677052 - DNA, 19 bp, Homo sapiens
cctcagggccaagccggcc

SEQ ID NO: 5677053 - DNA, 20 bp, Homo sapiens
cctcagggccaagcgggggc

SEQ ID NO: 5677054 - DNA, 15 bp, Homo sapiens
cctcagggccaggcc

SEQ ID NO: 5677055 - DNA, 18 bp, Homo sapiens
cctcagggcgctcagacg

SEQ ID NO: 5677056 - DNA, 17 bp, Homo sapiens
cctcagggctatgtgga

SEQ ID NO: 5677057 - DNA, 22 bp, Homo sapiens
cctcagggctccttgtgggcct

SEQ ID NO: 5677058 - DNA, 14 bp, Homo sapiens
cctcagggctgtcc

SEQ ID NO: 5677059 - DNA, 23 bp, Homo sapiens
cctcagggctgtcggtgtgctgt

SEQ ID NO: 5677060 - DNA, 21 bp, Homo sapiens
cctcagggcttccttatgtcc

SEQ ID NO: 5677061 - DNA, 18 bp, Homo sapiens
cctcaggggaagctgcta

SEQ ID NO: 5677062 - DNA, 21 bp, Homo sapiens
cctcaggggaagctgctaggg

SEQ ID NO: 5677063 - DNA, 22 bp, Homo sapiens
cctcaggggcaggtggtggagg

SEQ ID NO: 5677064 - DNA, 19 bp, Homo sapiens
cctcaggggcctctctcct

SEQ ID NO: 5677065 - DNA, 20 bp, Homo sapiens
cctcaggggcctctctcctg

SEQ ID NO: 5677066 - DNA, 14 bp, Homo sapiens
cctcagggggccag

SEQ ID NO: 5677067 - DNA, 16 bp, Homo sapiens
cctcagggggccagct

SEQ ID NO: 5677068 - DNA, 19 bp, Homo sapiens
cctcagggggccagctggg

SEQ ID NO: 5677069 - DNA, 20 bp, Homo sapiens
cctcagggggccagctgggg

SEQ ID NO: 5677070 - DNA, 19 bp, Homo sapiens
cctcagggggtaggagagc

SEQ ID NO: 5677071 - DNA, 17 bp, Homo sapiens
cctcaggggtggagaag

SEQ ID NO: 5677072 - DNA, 14 bp, Homo sapiens
cctcagggtccctg

SEQ ID NO: 5677073 - DNA, 17 bp, Homo sapiens
cctcagggtccctggtg

SEQ ID NO: 5677074 - DNA, 22 bp, Homo sapiens
cctcagggtccctggtggcagc

SEQ ID NO: 5677075 - DNA, 14 bp, Homo sapiens
cctcagggtcctgc

SEQ ID NO: 5677076 - DNA, 16 bp, Homo sapiens
cctcagggtcctgccc

SEQ ID NO: 5677077 - DNA, 20 bp, Homo sapiens
cctcagggtctaaggagcgc

SEQ ID NO: 5677078 - DNA, 21 bp, Homo sapiens
cctcagggtctaaggagcgct

SEQ ID NO: 5677079 - DNA, 14 bp, Homo sapiens
cctcagggtggggg

SEQ ID NO: 5677080 - DNA, 13 bp, Homo sapiens
cctcagggtgtcc

SEQ ID NO: 5677081 - DNA, 22 bp, Homo sapiens
cctcagggttttggggtcctgg

SEQ ID NO: 5677082 - DNA, 23 bp, Homo sapiens
cctcagggttttggggtcctggg

SEQ ID NO: 5677083 - DNA, 21 bp, Homo sapiens
cctcaggtaatcgacctgcct

SEQ ID NO: 5677084 - DNA, 22 bp, Homo sapiens
cctcaggtaatcgacctgcctc

SEQ ID NO: 5677085 - DNA, 17 bp, Homo sapiens
cctcaggtacagcgggc

SEQ ID NO: 5677086 - DNA, 19 bp, Homo sapiens
cctcaggtagtactgggaa

SEQ ID NO: 5677087 - DNA, 11 bp, Homo sapiens
cctcaggtcag

SEQ ID NO: 5677088 - DNA, 12 bp, Homo sapiens
cctcaggtcagc

SEQ ID NO: 5677089 - DNA, 15 bp, Homo sapiens
cctcaggtcagctgg

SEQ ID NO: 5677090 - DNA, 18 bp, Homo sapiens
cctcaggtcagctgggag

SEQ ID NO: 5677091 - DNA, 22 bp, Homo sapiens
cctcaggtcagctgggagccag

SEQ ID NO: 5677092 - DNA, 15 bp, Homo sapiens
cctcaggtgaataac

SEQ ID NO: 5677093 - DNA, 14 bp, Homo sapiens
cctcaggtgacttt

SEQ ID NO: 5677094 - DNA, 16 bp, Homo sapiens
cctcaggtgagaagca

SEQ ID NO: 5677095 - DNA, 17 bp, Homo sapiens
cctcaggtgagaagcag

SEQ ID NO: 5677096 - DNA, 20 bp, Homo sapiens
cctcaggtgagaagcagagg

SEQ ID NO: 5677097 - DNA, 11 bp, Homo sapiens
cctcaggtgcc

SEQ ID NO: 5677098 - DNA, 15 bp, Homo sapiens
cctcaggtgccaacc

SEQ ID NO: 5677099 - DNA, 15 bp, Homo sapiens
cctcaggtgcctcca

SEQ ID NO: 5677100 - DNA, 18 bp, Homo sapiens
cctcaggtgcctccaatt

SEQ ID NO: 5677101 - DNA, 18 bp, Homo sapiens
cctcaggtgctgtccatg

SEQ ID NO: 5677102 - DNA, 11 bp, Homo sapiens
cctcaggtggc

SEQ ID NO: 5677103 - DNA, 15 bp, Homo sapiens
cctcaggtgggccgc

SEQ ID NO: 5677104 - DNA, 15 bp, Homo sapiens
cctcaggttccaaat

SEQ ID NO: 5677105 - DNA, 14 bp, Homo sapiens
cctcaggttccttt

SEQ ID NO: 5677106 - DNA, 21 bp, Homo sapiens
cctcaggttgctggttgctgt

SEQ ID NO: 5677107 - DNA, 22 bp, Homo sapiens
cctcaggttgctggttgctgtg

SEQ ID NO: 5677108 - DNA, 17 bp, Homo sapiens
cctcagtaaaagtcttc

SEQ ID NO: 5677109 - DNA, 20 bp, Homo sapiens
cctcagtaacatttctgttc

SEQ ID NO: 5677110 - DNA, 22 bp, Homo sapiens
cctcagtaacatttctgttctc

SEQ ID NO: 5677111 - DNA, 15 bp, Homo sapiens
cctcagtatatttaa

SEQ ID NO: 5677112 - DNA, 19 bp, Homo sapiens
cctcagtatatttaaactc

SEQ ID NO: 5677113 - DNA, 18 bp, Homo sapiens
cctcagtatgtgggggct

SEQ ID NO: 5677114 - DNA, 21 bp, Homo sapiens
cctcagtatgtgggggcttca

SEQ ID NO: 5677115 - DNA, 23 bp, Homo sapiens
cctcagtattgatttgtcccaga

SEQ ID NO: 5677116 - DNA, 19 bp, Homo sapiens
cctcagtatttatgtaatt

SEQ ID NO: 5677117 - DNA, 14 bp, Homo sapiens
cctcagtcaccccc

SEQ ID NO: 5677118 - DNA, 15 bp, Homo sapiens
cctcagtcaccccca

SEQ ID NO: 5677119 - DNA, 19 bp, Homo sapiens
cctcagtcaggcactggct

SEQ ID NO: 5677120 - DNA, 15 bp, Homo sapiens
cctcagtcagttccc

SEQ ID NO: 5677121 - DNA, 19 bp, Homo sapiens
cctcagtccctccctcctg

SEQ ID NO: 5677122 - DNA, 21 bp, Homo sapiens
cctcagtccctccctcctggc

SEQ ID NO: 5677123 - DNA, 14 bp, Homo sapiens
cctcagtccctctt

SEQ ID NO: 5677124 - DNA, 12 bp, Homo sapiens
cctcagtcctcc

SEQ ID NO: 5677125 - DNA, 23 bp, Homo sapiens
cctcagtcggggcaggccagggg

SEQ ID NO: 5677126 - DNA, 14 bp, Homo sapiens
cctcagtctccctc

SEQ ID NO: 5677127 - DNA, 23 bp, Homo sapiens
cctcagtgacatcaaagcctggc

SEQ ID NO: 5677128 - DNA, 19 bp, Homo sapiens
cctcagtgaccctggctcc

SEQ ID NO: 5677129 - DNA, 14 bp, Homo sapiens
cctcagtgactcag

SEQ ID NO: 5677130 - DNA, 16 bp, Homo sapiens
cctcagtgagataaat

SEQ ID NO: 5677131 - DNA, 20 bp, Homo sapiens
cctcagtgagatcagtcagc

SEQ ID NO: 5677132 - DNA, 22 bp, Homo sapiens
cctcagtgcagccccctcctga

SEQ ID NO: 5677133 - DNA, 13 bp, Homo sapiens
cctcagtgccact

SEQ ID NO: 5677134 - DNA, 23 bp, Homo sapiens
cctcagtgccacttgacattcct

SEQ ID NO: 5677135 - DNA, 11 bp, Homo sapiens
cctcagtgctc

SEQ ID NO: 5677136 - DNA, 14 bp, Homo sapiens
cctcagtgctcctg

SEQ ID NO: 5677137 - DNA, 15 bp, Homo sapiens
cctcagtgctcctgg

SEQ ID NO: 5677138 - DNA, 19 bp, Homo sapiens
cctcagtgctcggcagtca

SEQ ID NO: 5677139 - DNA, 22 bp, Homo sapiens
cctcagtgctcggcagtcatac

SEQ ID NO: 5677140 - DNA, 16 bp, Homo sapiens
cctcagtggactttcc

SEQ ID NO: 5677141 - DNA, 20 bp, Homo sapiens
cctcagtggactttccaccc

SEQ ID NO: 5677142 - DNA, 16 bp, Homo sapiens
cctcagtggatcttca

SEQ ID NO: 5677143 - DNA, 12 bp, Homo sapiens
cctcagtgggaa

SEQ ID NO: 5677144 - DNA, 13 bp, Homo sapiens
cctcagtgggctc

SEQ ID NO: 5677145 - DNA, 22 bp, Homo sapiens
cctcagtgggctccctggccca

SEQ ID NO: 5677146 - DNA, 12 bp, Homo sapiens
cctcagtgtcat

SEQ ID NO: 5677147 - DNA, 13 bp, Homo sapiens
cctcagtgtgaag

SEQ ID NO: 5677148 - DNA, 14 bp, Homo sapiens
cctcagtgtgaagc

SEQ ID NO: 5677149 - DNA, 18 bp, Homo sapiens
cctcagtgtgaagcctgt

SEQ ID NO: 5677150 - DNA, 15 bp, Homo sapiens
cctcagttcaacctg

SEQ ID NO: 5677151 - DNA, 17 bp, Homo sapiens
cctcagttcccagctcc

SEQ ID NO: 5677152 - DNA, 22 bp, Homo sapiens
cctcagttcccagctccccccg

SEQ ID NO: 5677153 - DNA, 16 bp, Homo sapiens
cctcagttcccttggc

SEQ ID NO: 5677154 - DNA, 22 bp, Homo sapiens
cctcagttgaaaatgcaactct

SEQ ID NO: 5677155 - DNA, 19 bp, Homo sapiens
cctcagttggcctctgccc

SEQ ID NO: 5677156 - DNA, 21 bp, Homo sapiens
cctcagttgtttctaagagca

SEQ ID NO: 5677157 - DNA, 19 bp, Homo sapiens
cctcagtttccctatctgc

SEQ ID NO: 5677158 - DNA, 16 bp, Homo sapiens
cctcagtttcctcatc

SEQ ID NO: 5677159 - DNA, 22 bp, Homo sapiens
cctcagtttggtagtgccccac

SEQ ID NO: 5677160 - DNA, 13 bp, Homo sapiens
cctcagttttcct

SEQ ID NO: 5677161 - DNA, 15 bp, Homo sapiens
cctcagttttccttc

SEQ ID NO: 5677162 - DNA, 18 bp, Homo sapiens
cctcagttttccttctgt

SEQ ID NO: 5677163 - DNA, 23 bp, Homo sapiens
cctcataaaaatctagcacactc

SEQ ID NO: 5677164 - DNA, 12 bp, Homo sapiens
cctcatacccac

SEQ ID NO: 5677165 - DNA, 13 bp, Homo sapiens
cctcatacccacc

SEQ ID NO: 5677166 - DNA, 15 bp, Homo sapiens
cctcatacccatgca

SEQ ID NO: 5677167 - DNA, 20 bp, Homo sapiens
cctcatacctacacccaagg

SEQ ID NO: 5677168 - DNA, 14 bp, Homo sapiens
cctcatactcctgg

SEQ ID NO: 5677169 - DNA, 20 bp, Homo sapiens
cctcatatgcaatttgggat

SEQ ID NO: 5677170 - DNA, 15 bp, Homo sapiens
cctcatattttctgt

SEQ ID NO: 5677171 - DNA, 14 bp, Homo sapiens
cctcatcaccaacg

SEQ ID NO: 5677172 - DNA, 18 bp, Homo sapiens
cctcatcaccatcgtgtt

SEQ ID NO: 5677173 - DNA, 20 bp, Homo sapiens
cctcatcactggactgcatg

SEQ ID NO: 5677174 - DNA, 13 bp, Homo sapiens
cctcatcagcctt

SEQ ID NO: 5677175 - DNA, 14 bp, Homo sapiens
cctcatcagccttt

SEQ ID NO: 5677176 - DNA, 19 bp, Homo sapiens
cctcatcagccttttcagc

SEQ ID NO: 5677177 - DNA, 19 bp, Homo sapiens
cctcatcaggatgaaccca

SEQ ID NO: 5677178 - DNA, 19 bp, Homo sapiens
cctcatcagtagatggtac

SEQ ID NO: 5677179 - DNA, 23 bp, Homo sapiens
cctcatcagtatttggacttttt

SEQ ID NO: 5677180 - DNA, 15 bp, Homo sapiens
cctcatcatcagagc

SEQ ID NO: 5677181 - DNA, 14 bp, Homo sapiens
cctcatcatccacc

SEQ ID NO: 5677182 - DNA, 16 bp, Homo sapiens
cctcatcatccacccg

SEQ ID NO: 5677183 - DNA, 18 bp, Homo sapiens
cctcatcatccacccgct

SEQ ID NO: 5677184 - DNA, 21 bp, Homo sapiens
cctcatccaaactgtatcttc

SEQ ID NO: 5677185 - DNA, 19 bp, Homo sapiens
cctcatccaactccgaaag

SEQ ID NO: 5677186 - DNA, 18 bp, Homo sapiens
cctcatccaccaatctct

SEQ ID NO: 5677187 - DNA, 22 bp, Homo sapiens
cctcatccaccccatccctccc

SEQ ID NO: 5677188 - DNA, 22 bp, Homo sapiens
cctcatccagggcccagcggtc

SEQ ID NO: 5677189 - DNA, 15 bp, Homo sapiens
cctcatccagggctc

SEQ ID NO: 5677190 - DNA, 12 bp, Homo sapiens
cctcatccatgc

SEQ ID NO: 5677191 - DNA, 16 bp, Homo sapiens
cctcatccatgcactt

SEQ ID NO: 5677192 - DNA, 13 bp, Homo sapiens
cctcatccatttc

SEQ ID NO: 5677193 - DNA, 16 bp, Homo sapiens
cctcatcccacttcct

SEQ ID NO: 5677194 - DNA, 19 bp, Homo sapiens
cctcatcccacttcctttc

SEQ ID NO: 5677195 - DNA, 21 bp, Homo sapiens
cctcatcccacttcctttcct

SEQ ID NO: 5677196 - DNA, 21 bp, Homo sapiens
cctcatccccaccccacctca

SEQ ID NO: 5677197 - DNA, 15 bp, Homo sapiens
cctcatcccccagtt

SEQ ID NO: 5677198 - DNA, 13 bp, Homo sapiens
cctcatccctgac

SEQ ID NO: 5677199 - DNA, 17 bp, Homo sapiens
cctcatccgaggcaggg

SEQ ID NO: 5677200 - DNA, 20 bp, Homo sapiens
cctcatccgaggcagggtca

SEQ ID NO: 5677201 - DNA, 13 bp, Homo sapiens
cctcatcctcaga

SEQ ID NO: 5677202 - DNA, 13 bp, Homo sapiens
cctcatcctcata

SEQ ID NO: 5677203 - DNA, 22 bp, Homo sapiens
cctcatcctccctgaccctgct

SEQ ID NO: 5677204 - DNA, 14 bp, Homo sapiens
cctcatcctcctcc

SEQ ID NO: 5677205 - DNA, 15 bp, Homo sapiens
cctcatcctcctcct

SEQ ID NO: 5677206 - DNA, 17 bp, Homo sapiens
cctcatcctccttcttc

SEQ ID NO: 5677207 - DNA, 23 bp, Homo sapiens
cctcatcctgctcttttgtgatg

SEQ ID NO: 5677208 - DNA, 13 bp, Homo sapiens
cctcatcctgctt

SEQ ID NO: 5677209 - DNA, 19 bp, Homo sapiens
cctcatcctgcttctcttt

SEQ ID NO: 5677210 - DNA, 21 bp, Homo sapiens
cctcatcctttccctctccca

SEQ ID NO: 5677211 - DNA, 18 bp, Homo sapiens
cctcatcgtggctgggaa

SEQ ID NO: 5677212 - DNA, 11 bp, Homo sapiens
cctcatctagg

SEQ ID NO: 5677213 - DNA, 18 bp, Homo sapiens
cctcatctagtcttgacc

SEQ ID NO: 5677214 - DNA, 21 bp, Homo sapiens
cctcatctatgaggaaaggtt

SEQ ID NO: 5677215 - DNA, 22 bp, Homo sapiens
cctcatctatggttctaaatat

SEQ ID NO: 5677216 - DNA, 16 bp, Homo sapiens
cctcatctcacctctc

SEQ ID NO: 5677217 - DNA, 16 bp, Homo sapiens
cctcatctcagaccct

SEQ ID NO: 5677218 - DNA, 13 bp, Homo sapiens
cctcatctcattc

SEQ ID NO: 5677219 - DNA, 23 bp, Homo sapiens
cctcatctccaaggcagggacca

SEQ ID NO: 5677220 - DNA, 19 bp, Homo sapiens
cctcatctccagtatcctg

SEQ ID NO: 5677221 - DNA, 14 bp, Homo sapiens
cctcatctcccgag

SEQ ID NO: 5677222 - DNA, 15 bp, Homo sapiens
cctcatctcccgagc

SEQ ID NO: 5677223 - DNA, 14 bp, Homo sapiens
cctcatctccttta

SEQ ID NO: 5677224 - DNA, 19 bp, Homo sapiens
cctcatctctctgcccaac

SEQ ID NO: 5677225 - DNA, 15 bp, Homo sapiens
cctcatctctcttgg

SEQ ID NO: 5677226 - DNA, 15 bp, Homo sapiens
cctcatctctgcctg

SEQ ID NO: 5677227 - DNA, 17 bp, Homo sapiens
cctcatctctgcctgac

SEQ ID NO: 5677228 - DNA, 24 bp, Homo sapiens
cctcatctgagaggctctccgtgc

SEQ ID NO: 5677229 - DNA, 12 bp, Homo sapiens
cctcatctgcag

SEQ ID NO: 5677230 - DNA, 14 bp, Homo sapiens
cctcatctgcctgc

SEQ ID NO: 5677231 - DNA, 15 bp, Homo sapiens
cctcatctgcctgca

SEQ ID NO: 5677232 - DNA, 19 bp, Homo sapiens
cctcatctgctcagcagct

SEQ ID NO: 5677233 - DNA, 15 bp, Homo sapiens
cctcatctgtgcctg

SEQ ID NO: 5677234 - DNA, 16 bp, Homo sapiens
cctcatctgtgcctgt

SEQ ID NO: 5677235 - DNA, 19 bp, Homo sapiens
cctcatcttccccagccct

SEQ ID NO: 5677236 - DNA, 19 bp, Homo sapiens
cctcatcttccttctcagc

SEQ ID NO: 5677237 - DNA, 13 bp, Homo sapiens
cctcatcttctct

SEQ ID NO: 5677238 - DNA, 20 bp, Homo sapiens
cctcatcttgaagggcccag

SEQ ID NO: 5677239 - DNA, 22 bp, Homo sapiens
cctcatcttgaagggcccagga

SEQ ID NO: 5677240 - DNA, 14 bp, Homo sapiens
cctcatgaataaat

SEQ ID NO: 5677241 - DNA, 15 bp, Homo sapiens
cctcatgaataaatg

SEQ ID NO: 5677242 - DNA, 16 bp, Homo sapiens
cctcatgaataaatgg

SEQ ID NO: 5677243 - DNA, 16 bp, Homo sapiens
cctcatgaatgtaaat

SEQ ID NO: 5677244 - DNA, 19 bp, Homo sapiens
cctcatgaatgtaaatttg

SEQ ID NO: 5677245 - DNA, 19 bp, Homo sapiens
cctcatgacagccagagcc

SEQ ID NO: 5677246 - DNA, 17 bp, Homo sapiens
cctcatgaccctcctgt

SEQ ID NO: 5677247 - DNA, 18 bp, Homo sapiens
cctcatgaccctcctgtc

SEQ ID NO: 5677248 - DNA, 23 bp, Homo sapiens
cctcatgaccctcctgtccagca

SEQ ID NO: 5677249 - DNA, 13 bp, Homo sapiens
cctcatgcatctc

SEQ ID NO: 5677250 - DNA, 17 bp, Homo sapiens
cctcatgccacaccttc

SEQ ID NO: 5677251 - DNA, 20 bp, Homo sapiens
cctcatgccacaccttcttc

SEQ ID NO: 5677252 - DNA, 14 bp, Homo sapiens
cctcatgccacagt

SEQ ID NO: 5677253 - DNA, 17 bp, Homo sapiens
cctcatgccatggtctt

SEQ ID NO: 5677254 - DNA, 13 bp, Homo sapiens
cctcatgcccacc

SEQ ID NO: 5677255 - DNA, 20 bp, Homo sapiens
cctcatgcccaccccctgcc

SEQ ID NO: 5677256 - DNA, 23 bp, Homo sapiens
cctcatgcccaccccctgccctg

SEQ ID NO: 5677257 - DNA, 24 bp, Homo sapiens
cctcatgcccaccccctgccctgc

SEQ ID NO: 5677258 - DNA, 13 bp, Homo sapiens
cctcatgcctgct

SEQ ID NO: 5677259 - DNA, 15 bp, Homo sapiens
cctcatgcctggccc

SEQ ID NO: 5677260 - DNA, 19 bp, Homo sapiens
cctcatgcctggcccccct

SEQ ID NO: 5677261 - DNA, 13 bp, Homo sapiens
cctcatgctctct

SEQ ID NO: 5677262 - DNA, 20 bp, Homo sapiens
cctcatgctgccaatatcct

SEQ ID NO: 5677263 - DNA, 21 bp, Homo sapiens
cctcatgctgccaatatccta

SEQ ID NO: 5677264 - DNA, 22 bp, Homo sapiens
cctcatggagacctcatgccat

SEQ ID NO: 5677265 - DNA, 17 bp, Homo sapiens
cctcatggattgccaca

SEQ ID NO: 5677266 - DNA, 20 bp, Homo sapiens
cctcatggattgccacagct

SEQ ID NO: 5677267 - DNA, 18 bp, Homo sapiens
cctcatggcccccagggg

SEQ ID NO: 5677268 - DNA, 16 bp, Homo sapiens
cctcatggcccctctg

SEQ ID NO: 5677269 - DNA, 22 bp, Homo sapiens
cctcatggcccctctgacctgc

SEQ ID NO: 5677270 - DNA, 13 bp, Homo sapiens
cctcatggcggga

SEQ ID NO: 5677271 - DNA, 17 bp, Homo sapiens
cctcatggcgggactgg

SEQ ID NO: 5677272 - DNA, 13 bp, Homo sapiens
cctcatggctgtt

SEQ ID NO: 5677273 - DNA, 12 bp, Homo sapiens
cctcatgtaaca

SEQ ID NO: 5677274 - DNA, 13 bp, Homo sapiens
cctcatgtggctg

SEQ ID NO: 5677275 - DNA, 15 bp, Homo sapiens
cctcatgtggctgga

SEQ ID NO: 5677276 - DNA, 17 bp, Homo sapiens
cctcatgtggctggaag

SEQ ID NO: 5677277 - DNA, 23 bp, Homo sapiens
cctcatgtggctggaagatcctg

SEQ ID NO: 5677278 - DNA, 17 bp, Homo sapiens
cctcatgtgtgctgtgc

SEQ ID NO: 5677279 - DNA, 18 bp, Homo sapiens
cctcatgttactcagtgt

SEQ ID NO: 5677280 - DNA, 22 bp, Homo sapiens
cctcatgttctcttcccaggcc

SEQ ID NO: 5677281 - DNA, 21 bp, Homo sapiens
cctcatgttgctgaatttgta

SEQ ID NO: 5677282 - DNA, 17 bp, Homo sapiens
cctcatgtttatgaaaa

SEQ ID NO: 5677283 - DNA, 20 bp, Homo sapiens
cctcattcaaagggacggtc

SEQ ID NO: 5677284 - DNA, 15 bp, Homo sapiens
cctcattcagaccaa

SEQ ID NO: 5677285 - DNA, 15 bp, Homo sapiens
cctcattcagcatgg

SEQ ID NO: 5677286 - DNA, 23 bp, Homo sapiens
cctcattcagtaagttctgtggt

SEQ ID NO: 5677287 - DNA, 13 bp, Homo sapiens
cctcattcatctt

SEQ ID NO: 5677288 - DNA, 16 bp, Homo sapiens
cctcattccaagcact

SEQ ID NO: 5677289 - DNA, 21 bp, Homo sapiens
cctcattccaccttcccatgc

SEQ ID NO: 5677290 - DNA, 13 bp, Homo sapiens
cctcattcccctc

SEQ ID NO: 5677291 - DNA, 13 bp, Homo sapiens
cctcattccttgt

SEQ ID NO: 5677292 - DNA, 20 bp, Homo sapiens
cctcattccttgtcttgata

SEQ ID NO: 5677293 - DNA, 21 bp, Homo sapiens
cctcattctggttccctgctg

SEQ ID NO: 5677294 - DNA, 16 bp, Homo sapiens
cctcattgaatcctca

SEQ ID NO: 5677295 - DNA, 13 bp, Homo sapiens
cctcattgcattt

SEQ ID NO: 5677296 - DNA, 15 bp, Homo sapiens
cctcattgcctcctg

SEQ ID NO: 5677297 - DNA, 16 bp, Homo sapiens
cctcattgctaccaca

SEQ ID NO: 5677298 - DNA, 23 bp, Homo sapiens
cctcattgctaccacagacttgc

SEQ ID NO: 5677299 - DNA, 14 bp, Homo sapiens
cctcattgctgtct

SEQ ID NO: 5677300 - DNA, 20 bp, Homo sapiens
cctcattgctgtcttgcccc

SEQ ID NO: 5677301 - DNA, 14 bp, Homo sapiens
cctcattggccagc

SEQ ID NO: 5677302 - DNA, 18 bp, Homo sapiens
cctcattgtgccaagcct

SEQ ID NO: 5677303 - DNA, 19 bp, Homo sapiens
cctcattgtgccaagcctt

SEQ ID NO: 5677304 - DNA, 22 bp, Homo sapiens
cctcattgtgccaagccttctg

SEQ ID NO: 5677305 - DNA, 17 bp, Homo sapiens
cctcattgtgtctcccg

SEQ ID NO: 5677306 - DNA, 20 bp, Homo sapiens
cctcatttatcactctgacc

SEQ ID NO: 5677307 - DNA, 16 bp, Homo sapiens
cctcatttatccctca

SEQ ID NO: 5677308 - DNA, 19 bp, Homo sapiens
cctcatttcttcctctgca

SEQ ID NO: 5677309 - DNA, 12 bp, Homo sapiens
cctcatttcttt

SEQ ID NO: 5677310 - DNA, 12 bp, Homo sapiens
cctcatttgcat

SEQ ID NO: 5677311 - DNA, 20 bp, Homo sapiens
cctcatttggggtagctaga

SEQ ID NO: 5677312 - DNA, 15 bp, Homo sapiens
cctcattttgcttcc

SEQ ID NO: 5677313 - DNA, 17 bp, Homo sapiens
cctcattttgcttccca

SEQ ID NO: 5677314 - DNA, 18 bp, Homo sapiens
cctcattttgcttcccat

SEQ ID NO: 5677315 - DNA, 20 bp, Homo sapiens
cctcattttgcttcccatct

SEQ ID NO: 5677316 - DNA, 21 bp, Homo sapiens
cctcattttgcttcccatctg

SEQ ID NO: 5677317 - DNA, 18 bp, Homo sapiens
cctcattttgggggtcat

SEQ ID NO: 5677318 - DNA, 21 bp, Homo sapiens
cctccaaaaatggcagtgact

SEQ ID NO: 5677319 - DNA, 20 bp, Homo sapiens
cctccaaaacttagacccat

SEQ ID NO: 5677320 - DNA, 17 bp, Homo sapiens
cctccaaaatgtgccta

SEQ ID NO: 5677321 - DNA, 22 bp, Homo sapiens
cctccaaaatgtgcctattgct

SEQ ID NO: 5677322 - DNA, 15 bp, Homo sapiens
cctccaaacactggg

SEQ ID NO: 5677323 - DNA, 14 bp, Homo sapiens
cctccaaacctcca

SEQ ID NO: 5677324 - DNA, 17 bp, Homo sapiens
cctccaaacctccagcc

SEQ ID NO: 5677325 - DNA, 14 bp, Homo sapiens
cctccaaactcctg

SEQ ID NO: 5677326 - DNA, 18 bp, Homo sapiens
cctccaaactcctgcctg

SEQ ID NO: 5677327 - DNA, 14 bp, Homo sapiens
cctccaaagcccca

SEQ ID NO: 5677328 - DNA, 19 bp, Homo sapiens
cctccaaagcttcccacgg

SEQ ID NO: 5677329 - DNA, 16 bp, Homo sapiens
cctccaaaggaagggg

SEQ ID NO: 5677330 - DNA, 17 bp, Homo sapiens
cctccaaagtggagctg

SEQ ID NO: 5677331 - DNA, 16 bp, Homo sapiens
cctccaaatgctgtcg

SEQ ID NO: 5677332 - DNA, 17 bp, Homo sapiens
cctccaaatgtccttaa

SEQ ID NO: 5677333 - DNA, 18 bp, Homo sapiens
cctccaacaataaagagc

SEQ ID NO: 5677334 - DNA, 20 bp, Homo sapiens
cctccaacaataaagagctc

SEQ ID NO: 5677335 - DNA, 19 bp, Homo sapiens
cctccaacaccaagcacag

SEQ ID NO: 5677336 - DNA, 20 bp, Homo sapiens
cctccaaccaaataagactt

SEQ ID NO: 5677337 - DNA, 14 bp, Homo sapiens
cctccaacccaacc

SEQ ID NO: 5677338 - DNA, 16 bp, Homo sapiens
cctccaacccacagcc

SEQ ID NO: 5677339 - DNA, 19 bp, Homo sapiens
cctccaaccctagcaaaag

SEQ ID NO: 5677340 - DNA, 14 bp, Homo sapiens
cctccaaccttctg

SEQ ID NO: 5677341 - DNA, 15 bp, Homo sapiens
cctccaaccttctgc

SEQ ID NO: 5677342 - DNA, 17 bp, Homo sapiens
cctccaaccttctgccc

SEQ ID NO: 5677343 - DNA, 23 bp, Homo sapiens
cctccaacgcccctgtggccaac

SEQ ID NO: 5677344 - DNA, 22 bp, Homo sapiens
cctccaactccagctgagtcct

SEQ ID NO: 5677345 - DNA, 14 bp, Homo sapiens
cctccaagaaactt

SEQ ID NO: 5677346 - DNA, 17 bp, Homo sapiens
cctccaagaccttctcc

SEQ ID NO: 5677347 - DNA, 14 bp, Homo sapiens
cctccaagcaagta

SEQ ID NO: 5677348 - DNA, 18 bp, Homo sapiens
cctccaagcacagagcct

SEQ ID NO: 5677349 - DNA, 17 bp, Homo sapiens
cctccaagcatttcatg

SEQ ID NO: 5677350 - DNA, 20 bp, Homo sapiens
cctccaagcctggcacccac

SEQ ID NO: 5677351 - DNA, 20 bp, Homo sapiens
cctccaaggaggggctgtaa

SEQ ID NO: 5677352 - DNA, 21 bp, Homo sapiens
cctccaaggaggggctgtaaa

SEQ ID NO: 5677353 - DNA, 13 bp, Homo sapiens
cctccaaggccag

SEQ ID NO: 5677354 - DNA, 16 bp, Homo sapiens
cctccaaggctgtctt

SEQ ID NO: 5677355 - DNA, 14 bp, Homo sapiens
cctccaagggatct

SEQ ID NO: 5677356 - DNA, 22 bp, Homo sapiens
cctccaagtcacaaagagatgt

SEQ ID NO: 5677357 - DNA, 14 bp, Homo sapiens
cctccaagtcaggt

SEQ ID NO: 5677358 - DNA, 20 bp, Homo sapiens
cctccaagtgccccctcacc

SEQ ID NO: 5677359 - DNA, 16 bp, Homo sapiens
cctccaataaagtgcc

SEQ ID NO: 5677360 - DNA, 15 bp, Homo sapiens
cctccaatccccact

SEQ ID NO: 5677361 - DNA, 19 bp, Homo sapiens
cctccaatcctccccgctc

SEQ ID NO: 5677362 - DNA, 21 bp, Homo sapiens
cctccaatgctgcctgggagc

SEQ ID NO: 5677363 - DNA, 14 bp, Homo sapiens
cctccaatgtcctg

SEQ ID NO: 5677364 - DNA, 16 bp, Homo sapiens
cctccaatgtcctgaa

SEQ ID NO: 5677365 - DNA, 15 bp, Homo sapiens
cctccaattccacag

SEQ ID NO: 5677366 - DNA, 20 bp, Homo sapiens
cctccaattccacagtctct

SEQ ID NO: 5677367 - DNA, 22 bp, Homo sapiens
cctccaattccacagtctctgg

SEQ ID NO: 5677368 - DNA, 21 bp, Homo sapiens
cctccaattggtgcttcagcc

SEQ ID NO: 5677369 - DNA, 20 bp, Homo sapiens
cctccacaaagcaaaggcag

SEQ ID NO: 5677370 - DNA, 16 bp, Homo sapiens
cctccacacaagggaa

SEQ ID NO: 5677371 - DNA, 18 bp, Homo sapiens
cctccacaccagtggcct

SEQ ID NO: 5677372 - DNA, 23 bp, Homo sapiens
cctccacaccagtggcctcgtgg

SEQ ID NO: 5677373 - DNA, 22 bp, Homo sapiens
cctccacacccaccccctctgg

SEQ ID NO: 5677374 - DNA, 13 bp, Homo sapiens
cctccacacctcc

SEQ ID NO: 5677375 - DNA, 13 bp, Homo sapiens
cctccacacctgc

SEQ ID NO: 5677376 - DNA, 16 bp, Homo sapiens
cctccacacctgcggc

SEQ ID NO: 5677377 - DNA, 13 bp, Homo sapiens
cctccacagagag

SEQ ID NO: 5677378 - DNA, 16 bp, Homo sapiens
cctccacagccgcagc

SEQ ID NO: 5677379 - DNA, 15 bp, Homo sapiens
cctccacagcgaggg

SEQ ID NO: 5677380 - DNA, 23 bp, Homo sapiens
cctccacagcgagggcagctgct

SEQ ID NO: 5677381 - DNA, 16 bp, Homo sapiens
cctccacagctgcagc

SEQ ID NO: 5677382 - DNA, 14 bp, Homo sapiens
cctccacaggagcc

SEQ ID NO: 5677383 - DNA, 17 bp, Homo sapiens
cctccacaggagccgca

SEQ ID NO: 5677384 - DNA, 11 bp, Homo sapiens
cctccacagtc

SEQ ID NO: 5677385 - DNA, 21 bp, Homo sapiens
cctccacagtcccccacccac

SEQ ID NO: 5677386 - DNA, 22 bp, Homo sapiens
cctccacagtcccccacccacc

SEQ ID NO: 5677387 - DNA, 23 bp, Homo sapiens
cctccacagttcgacctgcggct

SEQ ID NO: 5677388 - DNA, 15 bp, Homo sapiens
cctccacatcccagc

SEQ ID NO: 5677389 - DNA, 17 bp, Homo sapiens
cctccacatcccagcag

SEQ ID NO: 5677390 - DNA, 14 bp, Homo sapiens
cctccacatcctcc

SEQ ID NO: 5677391 - DNA, 16 bp, Homo sapiens
cctccacatcctccac

SEQ ID NO: 5677392 - DNA, 20 bp, Homo sapiens
cctccacatcctccacgttc

SEQ ID NO: 5677393 - DNA, 17 bp, Homo sapiens
cctccacatcctgtgtc

SEQ ID NO: 5677394 - DNA, 16 bp, Homo sapiens
cctccacatcctttct

SEQ ID NO: 5677395 - DNA, 18 bp, Homo sapiens
cctccacatgctgcctgg

SEQ ID NO: 5677396 - DNA, 14 bp, Homo sapiens
cctccaccaccact

SEQ ID NO: 5677397 - DNA, 15 bp, Homo sapiens
cctccaccaccactg

SEQ ID NO: 5677398 - DNA, 18 bp, Homo sapiens
cctccaccaccactggcc

SEQ ID NO: 5677399 - DNA, 23 bp, Homo sapiens
cctccaccaccactggccaccag

SEQ ID NO: 5677400 - DNA, 16 bp, Homo sapiens
cctccaccaccctttc

SEQ ID NO: 5677401 - DNA, 14 bp, Homo sapiens
cctccaccaccgcc

SEQ ID NO: 5677402 - DNA, 14 bp, Homo sapiens
cctccaccagcaag

SEQ ID NO: 5677403 - DNA, 14 bp, Homo sapiens
cctccaccagcctg

SEQ ID NO: 5677404 - DNA, 17 bp, Homo sapiens
cctccaccagcctgctg

SEQ ID NO: 5677405 - DNA, 20 bp, Homo sapiens
cctccaccagcctgctgaca

SEQ ID NO: 5677406 - DNA, 13 bp, Homo sapiens
cctccaccatgca

SEQ ID NO: 5677407 - DNA, 21 bp, Homo sapiens
cctccacccacagtggagagg

SEQ ID NO: 5677408 - DNA, 16 bp, Homo sapiens
cctccacccaccccct

SEQ ID NO: 5677409 - DNA, 12 bp, Homo sapiens
cctccacccact

SEQ ID NO: 5677410 - DNA, 18 bp, Homo sapiens
cctccacccacttgcctg

SEQ ID NO: 5677411 - DNA, 12 bp, Homo sapiens
cctccacccagc

SEQ ID NO: 5677412 - DNA, 19 bp, Homo sapiens
cctccacccagcccctggc

SEQ ID NO: 5677413 - DNA, 11 bp, Homo sapiens
cctccacccat

SEQ ID NO: 5677414 - DNA, 20 bp, Homo sapiens
cctccaccccagtccccggg

SEQ ID NO: 5677415 - DNA, 23 bp, Homo sapiens
cctccacccccatgtggcagccc

SEQ ID NO: 5677416 - DNA, 19 bp, Homo sapiens
cctccacccccgccacggc

SEQ ID NO: 5677417 - DNA, 15 bp, Homo sapiens
cctccacccgtcctg

SEQ ID NO: 5677418 - DNA, 22 bp, Homo sapiens
cctccaccctaaagtctcaggt

SEQ ID NO: 5677419 - DNA, 11 bp, Homo sapiens
cctccaccctc

SEQ ID NO: 5677420 - DNA, 19 bp, Homo sapiens
cctccaccctgtcccccag

SEQ ID NO: 5677421 - DNA, 21 bp, Homo sapiens
cctccaccgagccagcttggt

SEQ ID NO: 5677422 - DNA, 18 bp, Homo sapiens
cctccaccgcagaaggaa

SEQ ID NO: 5677423 - DNA, 17 bp, Homo sapiens
cctccaccgccatggct

SEQ ID NO: 5677424 - DNA, 19 bp, Homo sapiens
cctccaccgccatggcttc

SEQ ID NO: 5677425 - DNA, 17 bp, Homo sapiens
cctccaccggtgcctcc

SEQ ID NO: 5677426 - DNA, 19 bp, Homo sapiens
cctccacctaccactcaca

SEQ ID NO: 5677427 - DNA, 19 bp, Homo sapiens
cctccacctatccctaaca

SEQ ID NO: 5677428 - DNA, 12 bp, Homo sapiens
cctccacctcaa

SEQ ID NO: 5677429 - DNA, 15 bp, Homo sapiens
cctccacctcccacc

SEQ ID NO: 5677430 - DNA, 12 bp, Homo sapiens
cctccacctcct

SEQ ID NO: 5677431 - DNA, 13 bp, Homo sapiens
cctccacctctca

SEQ ID NO: 5677432 - DNA, 14 bp, Homo sapiens
cctccacctctcac

SEQ ID NO: 5677433 - DNA, 19 bp, Homo sapiens
cctccacctctcacgggcc

SEQ ID NO: 5677434 - DNA, 13 bp, Homo sapiens
cctccacctctgt

SEQ ID NO: 5677435 - DNA, 15 bp, Homo sapiens
cctccacctctgtgc

SEQ ID NO: 5677436 - DNA, 16 bp, Homo sapiens
cctccacctctgtgca

SEQ ID NO: 5677437 - DNA, 14 bp, Homo sapiens
cctccacctcttca

SEQ ID NO: 5677438 - DNA, 15 bp, Homo sapiens
cctccacctgcagcc

SEQ ID NO: 5677439 - DNA, 17 bp, Homo sapiens
cctccacctgggagatg

SEQ ID NO: 5677440 - DNA, 18 bp, Homo sapiens
cctccacctgggagatgc

SEQ ID NO: 5677441 - DNA, 15 bp, Homo sapiens
cctccacctgtgaga

SEQ ID NO: 5677442 - DNA, 16 bp, Homo sapiens
cctccacctgtgagat

SEQ ID NO: 5677443 - DNA, 13 bp, Homo sapiens
cctccaccttcca

SEQ ID NO: 5677444 - DNA, 14 bp, Homo sapiens
cctccaccttccat

SEQ ID NO: 5677445 - DNA, 19 bp, Homo sapiens
cctccaccttgctcttctt

SEQ ID NO: 5677446 - DNA, 13 bp, Homo sapiens
cctccacgcctcc

SEQ ID NO: 5677447 - DNA, 19 bp, Homo sapiens
cctccacgcctcctggcca

SEQ ID NO: 5677448 - DNA, 20 bp, Homo sapiens
cctccacgcctcctggccag

SEQ ID NO: 5677449 - DNA, 21 bp, Homo sapiens
cctccacggtccgcggcctgc

SEQ ID NO: 5677450 - DNA, 22 bp, Homo sapiens
cctccacggtccgcggcctgca

SEQ ID NO: 5677451 - DNA, 12 bp, Homo sapiens
cctccacgtgat

SEQ ID NO: 5677452 - DNA, 18 bp, Homo sapiens
cctccacgtgtccgtcca

SEQ ID NO: 5677453 - DNA, 18 bp, Homo sapiens
cctccacgttctgctcat

SEQ ID NO: 5677454 - DNA, 14 bp, Homo sapiens
cctccactcactcc

SEQ ID NO: 5677455 - DNA, 21 bp, Homo sapiens
cctccactcagctgtcctgca

SEQ ID NO: 5677456 - DNA, 16 bp, Homo sapiens
cctccactcccacctc

SEQ ID NO: 5677457 - DNA, 20 bp, Homo sapiens
cctccactcccacttccctg

SEQ ID NO: 5677458 - DNA, 21 bp, Homo sapiens
cctccactcccccacctgaca

SEQ ID NO: 5677459 - DNA, 16 bp, Homo sapiens
cctccactcctctcaa

SEQ ID NO: 5677460 - DNA, 15 bp, Homo sapiens
cctccactccttcct

SEQ ID NO: 5677461 - DNA, 15 bp, Homo sapiens
cctccactcgaccca

SEQ ID NO: 5677462 - DNA, 19 bp, Homo sapiens
cctccactctcccccaccc

SEQ ID NO: 5677463 - DNA, 12 bp, Homo sapiens
cctccactctga

SEQ ID NO: 5677464 - DNA, 13 bp, Homo sapiens
cctccactctgag

SEQ ID NO: 5677465 - DNA, 12 bp, Homo sapiens
cctccactctgt

SEQ ID NO: 5677466 - DNA, 20 bp, Homo sapiens
cctccactctgtatctatgc

SEQ ID NO: 5677467 - DNA, 14 bp, Homo sapiens
cctccactgccctc

SEQ ID NO: 5677468 - DNA, 12 bp, Homo sapiens
cctccactgctg

SEQ ID NO: 5677469 - DNA, 15 bp, Homo sapiens
cctccactgctgggg

SEQ ID NO: 5677470 - DNA, 22 bp, Homo sapiens
cctccactggggaatgctccca

SEQ ID NO: 5677471 - DNA, 13 bp, Homo sapiens
cctccactgtcac

SEQ ID NO: 5677472 - DNA, 20 bp, Homo sapiens
cctccacttcccgtctcaga

SEQ ID NO: 5677473 - DNA, 16 bp, Homo sapiens
cctccacttccctcgt

SEQ ID NO: 5677474 - DNA, 22 bp, Homo sapiens
cctccagaactcactggggcct

SEQ ID NO: 5677475 - DNA, 20 bp, Homo sapiens
cctccagaactcttcctcca

SEQ ID NO: 5677476 - DNA, 19 bp, Homo sapiens
cctccagaagcctctggct

SEQ ID NO: 5677477 - DNA, 14 bp, Homo sapiens
cctccagaagctgc

SEQ ID NO: 5677478 - DNA, 14 bp, Homo sapiens
cctccagaccacca

SEQ ID NO: 5677479 - DNA, 14 bp, Homo sapiens
cctccagaccccta

SEQ ID NO: 5677480 - DNA, 15 bp, Homo sapiens
cctccagacccctac

SEQ ID NO: 5677481 - DNA, 16 bp, Homo sapiens
cctccagacccctgtg

SEQ ID NO: 5677482 - DNA, 21 bp, Homo sapiens
cctccagaccctgcctgagcc

SEQ ID NO: 5677483 - DNA, 22 bp, Homo sapiens
cctccagactcagcagagtgag

SEQ ID NO: 5677484 - DNA, 12 bp, Homo sapiens
cctccagagcca

SEQ ID NO: 5677485 - DNA, 22 bp, Homo sapiens
cctccagagccagcctgggact

SEQ ID NO: 5677486 - DNA, 12 bp, Homo sapiens
cctccagagccc

SEQ ID NO: 5677487 - DNA, 15 bp, Homo sapiens
cctccagagcctggg

SEQ ID NO: 5677488 - DNA, 22 bp, Homo sapiens
cctccagagctgtcctcctggc

SEQ ID NO: 5677489 - DNA, 23 bp, Homo sapiens
cctccagagctgtcctcctggca

SEQ ID NO: 5677490 - DNA, 22 bp, Homo sapiens
cctccagaggtcctccgtaggg

SEQ ID NO: 5677491 - DNA, 18 bp, Homo sapiens
cctccagaggtggaggtg

SEQ ID NO: 5677492 - DNA, 15 bp, Homo sapiens
cctccagcaagacct

SEQ ID NO: 5677493 - DNA, 19 bp, Homo sapiens
cctccagcaagacctcgtc

SEQ ID NO: 5677494 - DNA, 12 bp, Homo sapiens
cctccagcacaa

SEQ ID NO: 5677495 - DNA, 15 bp, Homo sapiens
cctccagcacacaca

SEQ ID NO: 5677496 - DNA, 15 bp, Homo sapiens
cctccagcacagact

SEQ ID NO: 5677497 - DNA, 16 bp, Homo sapiens
cctccagcacagactg

SEQ ID NO: 5677498 - DNA, 15 bp, Homo sapiens
cctccagcaccactt

SEQ ID NO: 5677499 - DNA, 21 bp, Homo sapiens
cctccagcacccccagtgcag

SEQ ID NO: 5677500 - DNA, 13 bp, Homo sapiens
cctccagcaggga

SEQ ID NO: 5677501 - DNA, 14 bp, Homo sapiens
cctccagcccacag

SEQ ID NO: 5677502 - DNA, 16 bp, Homo sapiens
cctccagcccacagtg

SEQ ID NO: 5677503 - DNA, 19 bp, Homo sapiens
cctccagcccacagtgctc

SEQ ID NO: 5677504 - DNA, 15 bp, Homo sapiens
cctccagcccctgtc

SEQ ID NO: 5677505 - DNA, 18 bp, Homo sapiens
cctccagcccgggagcct

SEQ ID NO: 5677506 - DNA, 23 bp, Homo sapiens
cctccagcccgggagcctaggac

SEQ ID NO: 5677507 - DNA, 15 bp, Homo sapiens
cctccagccctgggc

SEQ ID NO: 5677508 - DNA, 14 bp, Homo sapiens
cctccagcccttca

SEQ ID NO: 5677509 - DNA, 19 bp, Homo sapiens
cctccagccgccggctgtg

SEQ ID NO: 5677510 - DNA, 17 bp, Homo sapiens
cctccagccgctggcaa

SEQ ID NO: 5677511 - DNA, 16 bp, Homo sapiens
cctccagcctctcccg

SEQ ID NO: 5677512 - DNA, 18 bp, Homo sapiens
cctccagcctctcccggc

SEQ ID NO: 5677513 - DNA, 23 bp, Homo sapiens
cctccagcctgcccaagcccagg

SEQ ID NO: 5677514 - DNA, 14 bp, Homo sapiens
cctccagcctggtg

SEQ ID NO: 5677515 - DNA, 11 bp, Homo sapiens
cctccagctca

SEQ ID NO: 5677516 - DNA, 14 bp, Homo sapiens
cctccagctcctgc

SEQ ID NO: 5677517 - DNA, 21 bp, Homo sapiens
cctccagctcctgccccgccg

SEQ ID NO: 5677518 - DNA, 16 bp, Homo sapiens
cctccagctctttcct

SEQ ID NO: 5677519 - DNA, 19 bp, Homo sapiens
cctccagctctttcctcct

SEQ ID NO: 5677520 - DNA, 23 bp, Homo sapiens
cctccagctgccccgggatgcga

SEQ ID NO: 5677521 - DNA, 22 bp, Homo sapiens
cctccagctggaattgctgctc

SEQ ID NO: 5677522 - DNA, 15 bp, Homo sapiens
cctccagctgtcagc

SEQ ID NO: 5677523 - DNA, 16 bp, Homo sapiens
cctccagctgttctta

SEQ ID NO: 5677524 - DNA, 17 bp, Homo sapiens
cctccagctgttcttag

SEQ ID NO: 5677525 - DNA, 21 bp, Homo sapiens
cctccagcttctggtactctc

SEQ ID NO: 5677526 - DNA, 19 bp, Homo sapiens
cctccagcttgtggagccc

SEQ ID NO: 5677527 - DNA, 19 bp, Homo sapiens
cctccagcttttcctcagg

SEQ ID NO: 5677528 - DNA, 22 bp, Homo sapiens
cctccaggaccttgcttccttc

SEQ ID NO: 5677529 - DNA, 15 bp, Homo sapiens
cctccaggagagagc

SEQ ID NO: 5677530 - DNA, 23 bp, Homo sapiens
cctccaggagcttcttgtttcct

SEQ ID NO: 5677531 - DNA, 12 bp, Homo sapiens
cctccaggaggg

SEQ ID NO: 5677532 - DNA, 13 bp, Homo sapiens
cctccaggagggg

SEQ ID NO: 5677533 - DNA, 14 bp, Homo sapiens
cctccaggaggggc

SEQ ID NO: 5677534 - DNA, 21 bp, Homo sapiens
cctccaggcaaatgcccttca

SEQ ID NO: 5677535 - DNA, 22 bp, Homo sapiens
cctccaggcaaatgcccttcaa

SEQ ID NO: 5677536 - DNA, 23 bp, Homo sapiens
cctccaggcaaatgcccttcaaa

SEQ ID NO: 5677537 - DNA, 23 bp, Homo sapiens
cctccaggcaggacgagactcct

SEQ ID NO: 5677538 - DNA, 21 bp, Homo sapiens
cctccaggcaggccaggctgc

SEQ ID NO: 5677539 - DNA, 16 bp, Homo sapiens
cctccaggcatgctgg

SEQ ID NO: 5677540 - DNA, 17 bp, Homo sapiens
cctccaggcatgctggc

SEQ ID NO: 5677541 - DNA, 20 bp, Homo sapiens
cctccaggcatgctggcctc

SEQ ID NO: 5677542 - DNA, 17 bp, Homo sapiens
cctccaggcccatctca

SEQ ID NO: 5677543 - DNA, 20 bp, Homo sapiens
cctccaggcccgtctgtcca

SEQ ID NO: 5677544 - DNA, 19 bp, Homo sapiens
cctccaggccgacaggagg

SEQ ID NO: 5677545 - DNA, 11 bp, Homo sapiens
cctccaggcct

SEQ ID NO: 5677546 - DNA, 13 bp, Homo sapiens
cctccaggcctgc

SEQ ID NO: 5677547 - DNA, 14 bp, Homo sapiens
cctccaggcctgca

SEQ ID NO: 5677548 - DNA, 17 bp, Homo sapiens
cctccaggcctgcaggg

SEQ ID NO: 5677549 - DNA, 13 bp, Homo sapiens
cctccaggcctgt

SEQ ID NO: 5677550 - DNA, 12 bp, Homo sapiens
cctccaggctcc

SEQ ID NO: 5677551 - DNA, 12 bp, Homo sapiens
cctccaggctgg

SEQ ID NO: 5677552 - DNA, 14 bp, Homo sapiens
cctccaggctgggg

SEQ ID NO: 5677553 - DNA, 19 bp, Homo sapiens
cctccagggaatccgcctg

SEQ ID NO: 5677554 - DNA, 20 bp, Homo sapiens
cctccagggcattgctcagc

SEQ ID NO: 5677555 - DNA, 21 bp, Homo sapiens
cctccagggccacgtgccagg

SEQ ID NO: 5677556 - DNA, 22 bp, Homo sapiens
cctccagggccacgtgccaggc

SEQ ID NO: 5677557 - DNA, 15 bp, Homo sapiens
cctccagggccagga

SEQ ID NO: 5677558 - DNA, 16 bp, Homo sapiens
cctccagggccaggat

SEQ ID NO: 5677559 - DNA, 21 bp, Homo sapiens
cctccagggctggactgaggc

SEQ ID NO: 5677560 - DNA, 22 bp, Homo sapiens
cctccagggctggactgaggcc

SEQ ID NO: 5677561 - DNA, 19 bp, Homo sapiens
cctccaggggctcctgggt

SEQ ID NO: 5677562 - DNA, 21 bp, Homo sapiens
cctccagggtcctctcttcca

SEQ ID NO: 5677563 - DNA, 20 bp, Homo sapiens
cctccagggtggcagcaaca

SEQ ID NO: 5677564 - DNA, 21 bp, Homo sapiens
cctccagggtggcagcaacaa

SEQ ID NO: 5677565 - DNA, 20 bp, Homo sapiens
cctccaggtcggagtgcctg

SEQ ID NO: 5677566 - DNA, 21 bp, Homo sapiens
cctccaggtcggagtgcctgg

SEQ ID NO: 5677567 - DNA, 17 bp, Homo sapiens
cctccaggtgcacaagc

SEQ ID NO: 5677568 - DNA, 21 bp, Homo sapiens
cctccaggttcctcaaaacag

SEQ ID NO: 5677569 - DNA, 11 bp, Homo sapiens
cctccaggttt

SEQ ID NO: 5677570 - DNA, 18 bp, Homo sapiens
cctccaggtttttcaatt

SEQ ID NO: 5677571 - DNA, 22 bp, Homo sapiens
cctccaggtttttcaattaaac

SEQ ID NO: 5677572 - DNA, 22 bp, Homo sapiens
cctccagtaccataatcttaga

SEQ ID NO: 5677573 - DNA, 21 bp, Homo sapiens
cctccagtaccttctgccaga

SEQ ID NO: 5677574 - DNA, 20 bp, Homo sapiens
cctccagtacgtcccgctgc

SEQ ID NO: 5677575 - DNA, 20 bp, Homo sapiens
cctccagtcacactccccgc

SEQ ID NO: 5677576 - DNA, 18 bp, Homo sapiens
cctccagtctgctctcag

SEQ ID NO: 5677577 - DNA, 19 bp, Homo sapiens
cctccagtctgctctcagc

SEQ ID NO: 5677578 - DNA, 12 bp, Homo sapiens
cctccagtgaag

SEQ ID NO: 5677579 - DNA, 20 bp, Homo sapiens
cctccagtgagtacctgcaa

SEQ ID NO: 5677580 - DNA, 16 bp, Homo sapiens
cctccagtgctggctg

SEQ ID NO: 5677581 - DNA, 17 bp, Homo sapiens
cctccagtgctggctgc

SEQ ID NO: 5677582 - DNA, 16 bp, Homo sapiens
cctccagtgcttggct

SEQ ID NO: 5677583 - DNA, 20 bp, Homo sapiens
cctccagtgcttggctgccc

SEQ ID NO: 5677584 - DNA, 20 bp, Homo sapiens
cctccagtgggaggacagag

SEQ ID NO: 5677585 - DNA, 17 bp, Homo sapiens
cctccagtgtcagggtc

SEQ ID NO: 5677586 - DNA, 20 bp, Homo sapiens
cctccagtgttgcctcctcc

SEQ ID NO: 5677587 - DNA, 21 bp, Homo sapiens
cctccagtgttgcctcctccc

SEQ ID NO: 5677588 - DNA, 18 bp, Homo sapiens
cctccagttttgcctgag

SEQ ID NO: 5677589 - DNA, 19 bp, Homo sapiens
cctccatattttctttaaa

SEQ ID NO: 5677590 - DNA, 20 bp, Homo sapiens
cctccatcaaacgcagacac

SEQ ID NO: 5677591 - DNA, 21 bp, Homo sapiens
cctccatcacctgaaacactg

SEQ ID NO: 5677592 - DNA, 23 bp, Homo sapiens
cctccatcacctgaaacactgga

SEQ ID NO: 5677593 - DNA, 11 bp, Homo sapiens
cctccatccac

SEQ ID NO: 5677594 - DNA, 12 bp, Homo sapiens
cctccatccaca

SEQ ID NO: 5677595 - DNA, 16 bp, Homo sapiens
cctccatccacccctc

SEQ ID NO: 5677596 - DNA, 19 bp, Homo sapiens
cctccatccacccctctgg

SEQ ID NO: 5677597 - DNA, 21 bp, Homo sapiens
cctccatccccatcggccctg

SEQ ID NO: 5677598 - DNA, 18 bp, Homo sapiens
cctccatccccctctgtc

SEQ ID NO: 5677599 - DNA, 18 bp, Homo sapiens
cctccatccctgctctgg

SEQ ID NO: 5677600 - DNA, 17 bp, Homo sapiens
cctccatcccttcccca

SEQ ID NO: 5677601 - DNA, 20 bp, Homo sapiens
cctccatcccttccccagag

SEQ ID NO: 5677602 - DNA, 20 bp, Homo sapiens
cctccatccggctcctgtca

SEQ ID NO: 5677603 - DNA, 14 bp, Homo sapiens
cctccatccgtgct

SEQ ID NO: 5677604 - DNA, 17 bp, Homo sapiens
cctccatcctaccccct

SEQ ID NO: 5677605 - DNA, 15 bp, Homo sapiens
cctccatcctcatct

SEQ ID NO: 5677606 - DNA, 17 bp, Homo sapiens
cctccatcctcatctct

SEQ ID NO: 5677607 - DNA, 13 bp, Homo sapiens
cctccatcctgag

SEQ ID NO: 5677608 - DNA, 19 bp, Homo sapiens
cctccatcctgccaggagc

SEQ ID NO: 5677609 - DNA, 24 bp, Homo sapiens
cctccatctcatgtatcatctgga

SEQ ID NO: 5677610 - DNA, 18 bp, Homo sapiens
cctccatcttctttgcag

SEQ ID NO: 5677611 - DNA, 22 bp, Homo sapiens
cctccatgatgcaagccagctt

SEQ ID NO: 5677612 - DNA, 23 bp, Homo sapiens
cctccatgattccaagggcccag

SEQ ID NO: 5677613 - DNA, 17 bp, Homo sapiens
cctccatgcaggcctta

SEQ ID NO: 5677614 - DNA, 14 bp, Homo sapiens
cctccatgccccag

SEQ ID NO: 5677615 - DNA, 19 bp, Homo sapiens
cctccatgccccagctctg

SEQ ID NO: 5677616 - DNA, 13 bp, Homo sapiens
cctccatgcctga

SEQ ID NO: 5677617 - DNA, 14 bp, Homo sapiens
cctccatgctgcct

SEQ ID NO: 5677618 - DNA, 12 bp, Homo sapiens
cctccatgctgt

SEQ ID NO: 5677619 - DNA, 12 bp, Homo sapiens
cctccatggcag

SEQ ID NO: 5677620 - DNA, 15 bp, Homo sapiens
cctccatggcagcag

SEQ ID NO: 5677621 - DNA, 19 bp, Homo sapiens
cctccatggcaggaaggcg

SEQ ID NO: 5677622 - DNA, 13 bp, Homo sapiens
cctccatggcctg

SEQ ID NO: 5677623 - DNA, 15 bp, Homo sapiens
cctccatggcctggc

SEQ ID NO: 5677624 - DNA, 12 bp, Homo sapiens
cctccatgggcc

SEQ ID NO: 5677625 - DNA, 13 bp, Homo sapiens
cctccatgggcta

SEQ ID NO: 5677626 - DNA, 19 bp, Homo sapiens
cctccatgggggctcagcc

SEQ ID NO: 5677627 - DNA, 22 bp, Homo sapiens
cctccatgggggctcagccagg

SEQ ID NO: 5677628 - DNA, 14 bp, Homo sapiens
cctccatggtcctg

SEQ ID NO: 5677629 - DNA, 19 bp, Homo sapiens
cctccatggtcctgtctgt

SEQ ID NO: 5677630 - DNA, 21 bp, Homo sapiens
cctccatggtgcctctggagg

SEQ ID NO: 5677631 - DNA, 14 bp, Homo sapiens
cctccatggtggaa

SEQ ID NO: 5677632 - DNA, 15 bp, Homo sapiens
cctccatgtaccttg

SEQ ID NO: 5677633 - DNA, 23 bp, Homo sapiens
cctccatgtagaagagggagaag

SEQ ID NO: 5677634 - DNA, 21 bp, Homo sapiens
cctccatgtgagaatattttt

SEQ ID NO: 5677635 - DNA, 12 bp, Homo sapiens
cctccatgtggg

SEQ ID NO: 5677636 - DNA, 23 bp, Homo sapiens
cctccatgtgggctagttgggct

SEQ ID NO: 5677637 - DNA, 19 bp, Homo sapiens
cctccatgtgggtgctagg

SEQ ID NO: 5677638 - DNA, 12 bp, Homo sapiens
cctccatgtttt

SEQ ID NO: 5677639 - DNA, 21 bp, Homo sapiens
cctccattaaagtctgaatca

SEQ ID NO: 5677640 - DNA, 18 bp, Homo sapiens
cctccattgctgttgttg

SEQ ID NO: 5677641 - DNA, 19 bp, Homo sapiens
cctccattggctcccaagt

SEQ ID NO: 5677642 - DNA, 19 bp, Homo sapiens
cctccatttcaactccaga

SEQ ID NO: 5677643 - DNA, 13 bp, Homo sapiens
cctccatttctgt

SEQ ID NO: 5677644 - DNA, 17 bp, Homo sapiens
cctccatttgagaaaat

SEQ ID NO: 5677645 - DNA, 20 bp, Homo sapiens
cctccatttgtaccgaaaca

SEQ ID NO: 5677646 - DNA, 22 bp, Homo sapiens
cctccatttttatttcttcgtg

SEQ ID NO: 5677647 - DNA, 15 bp, Homo sapiens
cctccatttttgttg

SEQ ID NO: 5677648 - DNA, 14 bp, Homo sapiens
cctcccaaagaggc

SEQ ID NO: 5677649 - DNA, 13 bp, Homo sapiens
cctcccaaaggct

SEQ ID NO: 5677650 - DNA, 16 bp, Homo sapiens
cctcccaaagtgctgg

SEQ ID NO: 5677651 - DNA, 21 bp, Homo sapiens
cctcccaaagtgctgggatga

SEQ ID NO: 5677652 - DNA, 19 bp, Homo sapiens
cctcccaacagagctgggc

SEQ ID NO: 5677653 - DNA, 18 bp, Homo sapiens
cctcccaacccagccgtc

SEQ ID NO: 5677654 - DNA, 15 bp, Homo sapiens
cctcccaaccccagg

SEQ ID NO: 5677655 - DNA, 16 bp, Homo sapiens
cctcccaaccccaggg

SEQ ID NO: 5677656 - DNA, 12 bp, Homo sapiens
cctcccaacctc

SEQ ID NO: 5677657 - DNA, 16 bp, Homo sapiens
cctcccaacctcaatg

SEQ ID NO: 5677658 - DNA, 20 bp, Homo sapiens
cctcccaactcaccccagcc

SEQ ID NO: 5677659 - DNA, 21 bp, Homo sapiens
cctcccaactctggccttggt

SEQ ID NO: 5677660 - DNA, 15 bp, Homo sapiens
cctcccaagaggcca

SEQ ID NO: 5677661 - DNA, 20 bp, Homo sapiens
cctcccaagaggccagggtg

SEQ ID NO: 5677662 - DNA, 14 bp, Homo sapiens
cctcccaagcagct

SEQ ID NO: 5677663 - DNA, 16 bp, Homo sapiens
cctcccaagcagctga

SEQ ID NO: 5677664 - DNA, 14 bp, Homo sapiens
cctcccaagcagtt

SEQ ID NO: 5677665 - DNA, 21 bp, Homo sapiens
cctcccaagcgttcctggcct

SEQ ID NO: 5677666 - DNA, 23 bp, Homo sapiens
cctcccaagcgttcctggccttc

SEQ ID NO: 5677667 - DNA, 24 bp, Homo sapiens
cctcccaagcgttcctggccttct

SEQ ID NO: 5677668 - DNA, 11 bp, Homo sapiens
cctcccaagct

SEQ ID NO: 5677669 - DNA, 17 bp, Homo sapiens
cctcccaagctcagagc

SEQ ID NO: 5677670 - DNA, 14 bp, Homo sapiens
cctcccaagctgtg

SEQ ID NO: 5677671 - DNA, 15 bp, Homo sapiens
cctcccaagctgtgc

SEQ ID NO: 5677672 - DNA, 17 bp, Homo sapiens
cctcccaagctgtgctg

SEQ ID NO: 5677673 - DNA, 23 bp, Homo sapiens
cctcccaagctgtgctgggaagc

SEQ ID NO: 5677674 - DNA, 14 bp, Homo sapiens
cctcccaaggagaa

SEQ ID NO: 5677675 - DNA, 23 bp, Homo sapiens
cctcccaaggagaacaaatattc

SEQ ID NO: 5677676 - DNA, 18 bp, Homo sapiens
cctcccaaggtcctctca

SEQ ID NO: 5677677 - DNA, 20 bp, Homo sapiens
cctcccaagtagctgggatt

SEQ ID NO: 5677678 - DNA, 15 bp, Homo sapiens
cctcccaatcctctc

SEQ ID NO: 5677679 - DNA, 23 bp, Homo sapiens
cctcccaatctcaatacagcctg

SEQ ID NO: 5677680 - DNA, 11 bp, Homo sapiens
cctcccaattc

SEQ ID NO: 5677681 - DNA, 19 bp, Homo sapiens
cctcccaatttcagactcc

SEQ ID NO: 5677682 - DNA, 20 bp, Homo sapiens
cctcccaatttcagactccc

SEQ ID NO: 5677683 - DNA, 23 bp, Homo sapiens
cctcccacaattaaaccgcatgt

SEQ ID NO: 5677684 - DNA, 18 bp, Homo sapiens
cctcccacacccaaagct

SEQ ID NO: 5677685 - DNA, 19 bp, Homo sapiens
cctcccacacccaaagctg

SEQ ID NO: 5677686 - DNA, 19 bp, Homo sapiens
cctcccacactcccaaggt

SEQ ID NO: 5677687 - DNA, 21 bp, Homo sapiens
cctcccacacttgctggggct

SEQ ID NO: 5677688 - DNA, 15 bp, Homo sapiens
cctcccacagcctcc

SEQ ID NO: 5677689 - DNA, 14 bp, Homo sapiens
cctcccacagcctg

SEQ ID NO: 5677690 - DNA, 11 bp, Homo sapiens
cctcccacatc

SEQ ID NO: 5677691 - DNA, 14 bp, Homo sapiens
cctcccaccacagc

SEQ ID NO: 5677692 - DNA, 20 bp, Homo sapiens
cctcccaccaccctcccacc

SEQ ID NO: 5677693 - DNA, 13 bp, Homo sapiens
cctcccaccagag

SEQ ID NO: 5677694 - DNA, 20 bp, Homo sapiens
cctcccaccagtggccccca

SEQ ID NO: 5677695 - DNA, 13 bp, Homo sapiens
cctcccaccccca

SEQ ID NO: 5677696 - DNA, 14 bp, Homo sapiens
cctcccacccccag

SEQ ID NO: 5677697 - DNA, 13 bp, Homo sapiens
cctcccaccccct

SEQ ID NO: 5677698 - DNA, 21 bp, Homo sapiens
cctcccacccccttctctgct

SEQ ID NO: 5677699 - DNA, 21 bp, Homo sapiens
cctcccacccgatgctgcttt

SEQ ID NO: 5677700 - DNA, 19 bp, Homo sapiens
cctcccaccgctgcctcgt

SEQ ID NO: 5677701 - DNA, 13 bp, Homo sapiens
cctcccacctcca

SEQ ID NO: 5677702 - DNA, 14 bp, Homo sapiens
cctcccacctccag

SEQ ID NO: 5677703 - DNA, 16 bp, Homo sapiens
cctcccacctccgtgt

SEQ ID NO: 5677704 - DNA, 15 bp, Homo sapiens
cctcccacctctgtg

SEQ ID NO: 5677705 - DNA, 16 bp, Homo sapiens
cctcccaccttggcct

SEQ ID NO: 5677706 - DNA, 13 bp, Homo sapiens
cctcccacctttg

SEQ ID NO: 5677707 - DNA, 13 bp, Homo sapiens
cctcccacgcctc

SEQ ID NO: 5677708 - DNA, 16 bp, Homo sapiens
cctcccacggtgccca

SEQ ID NO: 5677709 - DNA, 12 bp, Homo sapiens
cctcccactccc

SEQ ID NO: 5677710 - DNA, 21 bp, Homo sapiens
cctcccactcccatctcctta

SEQ ID NO: 5677711 - DNA, 16 bp, Homo sapiens
cctcccactcccatgg

SEQ ID NO: 5677712 - DNA, 17 bp, Homo sapiens
cctcccactcccatggc

SEQ ID NO: 5677713 - DNA, 18 bp, Homo sapiens
cctcccactcctgctgca

SEQ ID NO: 5677714 - DNA, 19 bp, Homo sapiens
cctcccactcttgaagagg

SEQ ID NO: 5677715 - DNA, 23 bp, Homo sapiens
cctcccactgggactcccagcag

SEQ ID NO: 5677716 - DNA, 18 bp, Homo sapiens
cctcccacttgacctgag

SEQ ID NO: 5677717 - DNA, 19 bp, Homo sapiens
cctcccactttgtctgtac

SEQ ID NO: 5677718 - DNA, 20 bp, Homo sapiens
cctcccagacaggccctccc

SEQ ID NO: 5677719 - DNA, 22 bp, Homo sapiens
cctcccagacaggccctccctg

SEQ ID NO: 5677720 - DNA, 21 bp, Homo sapiens
cctcccagagcacctgctgtc

SEQ ID NO: 5677721 - DNA, 23 bp, Homo sapiens
cctcccagagctggtggacccag

SEQ ID NO: 5677722 - DNA, 20 bp, Homo sapiens
cctcccagaggagccaccag

SEQ ID NO: 5677723 - DNA, 23 bp, Homo sapiens
cctcccagaggagccaccagttc

SEQ ID NO: 5677724 - DNA, 19 bp, Homo sapiens
cctcccagaggtccagccc

SEQ ID NO: 5677725 - DNA, 20 bp, Homo sapiens
cctcccagaggtccagccca

SEQ ID NO: 5677726 - DNA, 21 bp, Homo sapiens
cctcccagaggtccagcccat

SEQ ID NO: 5677727 - DNA, 23 bp, Homo sapiens
cctcccagaggtccagcccatct

SEQ ID NO: 5677728 - DNA, 14 bp, Homo sapiens
cctcccagagtgct

SEQ ID NO: 5677729 - DNA, 9 bp, Homo sapiens
cctcccagc

SEQ ID NO: 5677730 - DNA, 11 bp, Homo sapiens
cctcccagcca

SEQ ID NO: 5677731 - DNA, 23 bp, Homo sapiens
cctcccagccacccggatctcca

SEQ ID NO: 5677732 - DNA, 23 bp, Homo sapiens
cctcccagcccattgctgccaag

SEQ ID NO: 5677733 - DNA, 12 bp, Homo sapiens
cctcccagccct

SEQ ID NO: 5677734 - DNA, 13 bp, Homo sapiens
cctcccagcccta

SEQ ID NO: 5677735 - DNA, 20 bp, Homo sapiens
cctcccagccctatggatgt

SEQ ID NO: 5677736 - DNA, 16 bp, Homo sapiens
cctcccagccctgagg

SEQ ID NO: 5677737 - DNA, 12 bp, Homo sapiens
cctcccagccta

SEQ ID NO: 5677738 - DNA, 12 bp, Homo sapiens
cctcccagctct

SEQ ID NO: 5677739 - DNA, 12 bp, Homo sapiens
cctcccagctga

SEQ ID NO: 5677740 - DNA, 12 bp, Homo sapiens
cctcccagctgc

SEQ ID NO: 5677741 - DNA, 13 bp, Homo sapiens
cctcccagctgct

SEQ ID NO: 5677742 - DNA, 15 bp, Homo sapiens
cctcccagctgcttt

SEQ ID NO: 5677743 - DNA, 23 bp, Homo sapiens
cctcccagctgtaccggccactg

SEQ ID NO: 5677744 - DNA, 13 bp, Homo sapiens
cctcccaggaacc

SEQ ID NO: 5677745 - DNA, 17 bp, Homo sapiens
cctcccaggaagcccag

SEQ ID NO: 5677746 - DNA, 14 bp, Homo sapiens
cctcccaggcgccc

SEQ ID NO: 5677747 - DNA, 18 bp, Homo sapiens
cctcccagggagcaaggg

SEQ ID NO: 5677748 - DNA, 21 bp, Homo sapiens
cctcccagggagcaagggcag

SEQ ID NO: 5677749 - DNA, 17 bp, Homo sapiens
cctcccagggcctcctg

SEQ ID NO: 5677750 - DNA, 19 bp, Homo sapiens
cctcccagggctacacaga

SEQ ID NO: 5677751 - DNA, 15 bp, Homo sapiens
cctcccaggggactg

SEQ ID NO: 5677752 - DNA, 16 bp, Homo sapiens
cctcccaggggactgt

SEQ ID NO: 5677753 - DNA, 19 bp, Homo sapiens
cctcccaggggactgttcc

SEQ ID NO: 5677754 - DNA, 13 bp, Homo sapiens
cctcccagggttt

SEQ ID NO: 5677755 - DNA, 18 bp, Homo sapiens
cctcccagggttttaact

SEQ ID NO: 5677756 - DNA, 21 bp, Homo sapiens
cctcccaggtcgggcagtgga

SEQ ID NO: 5677757 - DNA, 18 bp, Homo sapiens
cctcccaggtttcttctc

SEQ ID NO: 5677758 - DNA, 20 bp, Homo sapiens
cctcccaggtttcttctctg

SEQ ID NO: 5677759 - DNA, 22 bp, Homo sapiens
cctcccaggtttcttctctgga

SEQ ID NO: 5677760 - DNA, 17 bp, Homo sapiens
cctcccagtacctcctg

SEQ ID NO: 5677761 - DNA, 16 bp, Homo sapiens
cctcccagtcaccttg

SEQ ID NO: 5677762 - DNA, 13 bp, Homo sapiens
cctcccagtcctc

SEQ ID NO: 5677763 - DNA, 18 bp, Homo sapiens
cctcccagtgagaagggc

SEQ ID NO: 5677764 - DNA, 21 bp, Homo sapiens
cctcccagtgagactgcccca

SEQ ID NO: 5677765 - DNA, 18 bp, Homo sapiens
cctcccagtggcctggct

SEQ ID NO: 5677766 - DNA, 16 bp, Homo sapiens
cctcccataattgctt

SEQ ID NO: 5677767 - DNA, 20 bp, Homo sapiens
cctcccatagatactctctt

SEQ ID NO: 5677768 - DNA, 19 bp, Homo sapiens
cctcccatagtgctgggat

SEQ ID NO: 5677769 - DNA, 19 bp, Homo sapiens
cctcccatccagcgtctgc

SEQ ID NO: 5677770 - DNA, 15 bp, Homo sapiens
cctcccatccagggc

SEQ ID NO: 5677771 - DNA, 14 bp, Homo sapiens
cctcccatcccctg

SEQ ID NO: 5677772 - DNA, 22 bp, Homo sapiens
cctcccatcccgtaagaccacc

SEQ ID NO: 5677773 - DNA, 15 bp, Homo sapiens
cctcccatcctccag

SEQ ID NO: 5677774 - DNA, 20 bp, Homo sapiens
cctcccatctccttccccca

SEQ ID NO: 5677775 - DNA, 21 bp, Homo sapiens
cctcccatctgggagtcccct

SEQ ID NO: 5677776 - DNA, 15 bp, Homo sapiens
cctcccatggcacct

SEQ ID NO: 5677777 - DNA, 19 bp, Homo sapiens
cctcccatggcccagcagc

SEQ ID NO: 5677778 - DNA, 18 bp, Homo sapiens
cctcccatggccttccct

SEQ ID NO: 5677779 - DNA, 15 bp, Homo sapiens
cctcccatgtcactg

SEQ ID NO: 5677780 - DNA, 16 bp, Homo sapiens
cctcccatgtcactgc

SEQ ID NO: 5677781 - DNA, 23 bp, Homo sapiens
cctcccattctgcaccacacctg

SEQ ID NO: 5677782 - DNA, 23 bp, Homo sapiens
cctccccaaacccatcagacagg

SEQ ID NO: 5677783 - DNA, 15 bp, Homo sapiens
cctccccaaagccac

SEQ ID NO: 5677784 - DNA, 13 bp, Homo sapiens
cctccccaaatgg

SEQ ID NO: 5677785 - DNA, 14 bp, Homo sapiens
cctccccaactccc

SEQ ID NO: 5677786 - DNA, 17 bp, Homo sapiens
cctccccacacacaggc

SEQ ID NO: 5677787 - DNA, 15 bp, Homo sapiens
cctccccacactcca

SEQ ID NO: 5677788 - DNA, 13 bp, Homo sapiens
cctccccacagtc

SEQ ID NO: 5677789 - DNA, 23 bp, Homo sapiens
cctccccacagtcctcacagcct

SEQ ID NO: 5677790 - DNA, 14 bp, Homo sapiens
cctccccacatcgc

SEQ ID NO: 5677791 - DNA, 23 bp, Homo sapiens
cctccccacatcgcacactgggg

SEQ ID NO: 5677792 - DNA, 15 bp, Homo sapiens
cctccccaccagagc

SEQ ID NO: 5677793 - DNA, 17 bp, Homo sapiens
cctccccaccagtctca

SEQ ID NO: 5677794 - DNA, 16 bp, Homo sapiens
cctccccacccaagag

SEQ ID NO: 5677795 - DNA, 21 bp, Homo sapiens
cctccccacccctgcctttgt

SEQ ID NO: 5677796 - DNA, 14 bp, Homo sapiens
cctccccacccgct

SEQ ID NO: 5677797 - DNA, 20 bp, Homo sapiens
cctccccaccctgtcccagg

SEQ ID NO: 5677798 - DNA, 23 bp, Homo sapiens
cctccccacgtggcacctcctca

SEQ ID NO: 5677799 - DNA, 14 bp, Homo sapiens
cctccccactccag

SEQ ID NO: 5677800 - DNA, 19 bp, Homo sapiens
cctccccactcctctccca

SEQ ID NO: 5677801 - DNA, 14 bp, Homo sapiens
cctccccagacagg

SEQ ID NO: 5677802 - DNA, 12 bp, Homo sapiens
cctccccagagc

SEQ ID NO: 5677803 - DNA, 14 bp, Homo sapiens
cctccccagagccc

SEQ ID NO: 5677804 - DNA, 14 bp, Homo sapiens
cctccccagagctg

SEQ ID NO: 5677805 - DNA, 17 bp, Homo sapiens
cctccccagccagccct

SEQ ID NO: 5677806 - DNA, 15 bp, Homo sapiens
cctccccagcccagg

SEQ ID NO: 5677807 - DNA, 15 bp, Homo sapiens
cctccccagccccta

SEQ ID NO: 5677808 - DNA, 16 bp, Homo sapiens
cctccccagcccctag

SEQ ID NO: 5677809 - DNA, 21 bp, Homo sapiens
cctccccagcctgcgcctgct

SEQ ID NO: 5677810 - DNA, 12 bp, Homo sapiens
cctccccagctc

SEQ ID NO: 5677811 - DNA, 14 bp, Homo sapiens
cctccccagctcct

SEQ ID NO: 5677812 - DNA, 16 bp, Homo sapiens
cctccccagctcctcg

SEQ ID NO: 5677813 - DNA, 22 bp, Homo sapiens
cctccccaggggagagggtctg

SEQ ID NO: 5677814 - DNA, 13 bp, Homo sapiens
cctccccagtcta

SEQ ID NO: 5677815 - DNA, 17 bp, Homo sapiens
cctccccatacttcctg

SEQ ID NO: 5677816 - DNA, 17 bp, Homo sapiens
cctccccatctgtccag

SEQ ID NO: 5677817 - DNA, 21 bp, Homo sapiens
cctccccatctgtccagctgg

SEQ ID NO: 5677818 - DNA, 16 bp, Homo sapiens
cctccccatctgtgtt

SEQ ID NO: 5677819 - DNA, 16 bp, Homo sapiens
cctccccatggagcca

SEQ ID NO: 5677820 - DNA, 17 bp, Homo sapiens
cctccccattcacagag

SEQ ID NO: 5677821 - DNA, 22 bp, Homo sapiens
cctccccattcacagagccttt

SEQ ID NO: 5677822 - DNA, 21 bp, Homo sapiens
cctccccattcagacacttca

SEQ ID NO: 5677823 - DNA, 14 bp, Homo sapiens
cctccccatttccc

SEQ ID NO: 5677824 - DNA, 15 bp, Homo sapiens
cctccccatttccca

SEQ ID NO: 5677825 - DNA, 18 bp, Homo sapiens
cctcccccaaacagactc

SEQ ID NO: 5677826 - DNA, 18 bp, Homo sapiens
cctcccccaacccccacc

SEQ ID NO: 5677827 - DNA, 16 bp, Homo sapiens
cctcccccacgcctcc

SEQ ID NO: 5677828 - DNA, 15 bp, Homo sapiens
cctcccccactcctc

SEQ ID NO: 5677829 - DNA, 12 bp, Homo sapiens
cctcccccagaa

SEQ ID NO: 5677830 - DNA, 15 bp, Homo sapiens
cctcccccagagcca

SEQ ID NO: 5677831 - DNA, 11 bp, Homo sapiens
cctcccccagc

SEQ ID NO: 5677832 - DNA, 12 bp, Homo sapiens
cctcccccagct

SEQ ID NO: 5677833 - DNA, 19 bp, Homo sapiens
cctcccccagctccttggc

SEQ ID NO: 5677834 - DNA, 12 bp, Homo sapiens
cctcccccaggc

SEQ ID NO: 5677835 - DNA, 14 bp, Homo sapiens
cctcccccaggctg

SEQ ID NO: 5677836 - DNA, 18 bp, Homo sapiens
cctcccccaggctgcgcc

SEQ ID NO: 5677837 - DNA, 21 bp, Homo sapiens
cctcccccaggctgcgcctgc

SEQ ID NO: 5677838 - DNA, 14 bp, Homo sapiens
cctcccccagggag

SEQ ID NO: 5677839 - DNA, 15 bp, Homo sapiens
cctcccccagggagg

SEQ ID NO: 5677840 - DNA, 14 bp, Homo sapiens
cctcccccattccc

SEQ ID NO: 5677841 - DNA, 18 bp, Homo sapiens
cctccccccactgcaggc

SEQ ID NO: 5677842 - DNA, 20 bp, Homo sapiens
cctccccccactgcaggccc

SEQ ID NO: 5677843 - DNA, 13 bp, Homo sapiens
cctccccccactt

SEQ ID NO: 5677844 - DNA, 14 bp, Homo sapiens
cctccccccagact

SEQ ID NO: 5677845 - DNA, 16 bp, Homo sapiens
cctccccccagcccct

SEQ ID NO: 5677846 - DNA, 19 bp, Homo sapiens
cctccccccagcccctcct

SEQ ID NO: 5677847 - DNA, 13 bp, Homo sapiens
cctccccccagct

SEQ ID NO: 5677848 - DNA, 22 bp, Homo sapiens
cctccccccagctccctgcacc

SEQ ID NO: 5677849 - DNA, 12 bp, Homo sapiens
cctcccccctgt

SEQ ID NO: 5677850 - DNA, 13 bp, Homo sapiens
cctccccctaccc

SEQ ID NO: 5677851 - DNA, 14 bp, Homo sapiens
cctccccctagtcc

SEQ ID NO: 5677852 - DNA, 15 bp, Homo sapiens
cctccccctcctctc

SEQ ID NO: 5677853 - DNA, 13 bp, Homo sapiens
cctccccctcctg

SEQ ID NO: 5677854 - DNA, 12 bp, Homo sapiens
cctccccctgag

SEQ ID NO: 5677855 - DNA, 11 bp, Homo sapiens
cctccccctgc

SEQ ID NO: 5677856 - DNA, 14 bp, Homo sapiens
cctccccctgccag

SEQ ID NO: 5677857 - DNA, 16 bp, Homo sapiens
cctccccctgccagga

SEQ ID NO: 5677858 - DNA, 18 bp, Homo sapiens
cctccccctgccagtgcc

SEQ ID NO: 5677859 - DNA, 12 bp, Homo sapiens
cctccccctgcg

SEQ ID NO: 5677860 - DNA, 14 bp, Homo sapiens
cctccccctgtccc

SEQ ID NO: 5677861 - DNA, 20 bp, Homo sapiens
cctccccctgtgtggccctg

SEQ ID NO: 5677862 - DNA, 21 bp, Homo sapiens
cctccccgaggttgtggggag

SEQ ID NO: 5677863 - DNA, 18 bp, Homo sapiens
cctccccgatccccgaca

SEQ ID NO: 5677864 - DNA, 15 bp, Homo sapiens
cctccccgcaccccc

SEQ ID NO: 5677865 - DNA, 17 bp, Homo sapiens
cctccccgccccctgaa

SEQ ID NO: 5677866 - DNA, 13 bp, Homo sapiens
cctccccgcccct

SEQ ID NO: 5677867 - DNA, 14 bp, Homo sapiens
cctccccgcccctg

SEQ ID NO: 5677868 - DNA, 15 bp, Homo sapiens
cctccccgcctggcc

SEQ ID NO: 5677869 - DNA, 16 bp, Homo sapiens
cctccccgcctggcca

SEQ ID NO: 5677870 - DNA, 18 bp, Homo sapiens
cctccccgcctggccagg

SEQ ID NO: 5677871 - DNA, 20 bp, Homo sapiens
cctccccgcctggccagggc

SEQ ID NO: 5677872 - DNA, 20 bp, Homo sapiens
cctccccgcgccccagtcac

SEQ ID NO: 5677873 - DNA, 21 bp, Homo sapiens
cctccccgcgccccagtcact

SEQ ID NO: 5677874 - DNA, 19 bp, Homo sapiens
cctccccgcgcgttccttc

SEQ ID NO: 5677875 - DNA, 20 bp, Homo sapiens
cctccccgctccgtctctgt

SEQ ID NO: 5677876 - DNA, 23 bp, Homo sapiens
cctccccgctccgtctctgtcct

SEQ ID NO: 5677877 - DNA, 19 bp, Homo sapiens
cctccccgctgccctttgg

SEQ ID NO: 5677878 - DNA, 15 bp, Homo sapiens
cctccccggaagtgc

SEQ ID NO: 5677879 - DNA, 17 bp, Homo sapiens
cctccccggcaccctct

SEQ ID NO: 5677880 - DNA, 16 bp, Homo sapiens
cctccccggcatcatt

SEQ ID NO: 5677881 - DNA, 15 bp, Homo sapiens
cctccccggccacat

SEQ ID NO: 5677882 - DNA, 15 bp, Homo sapiens
cctccccgggcagca

SEQ ID NO: 5677883 - DNA, 14 bp, Homo sapiens
cctccccgtccctg

SEQ ID NO: 5677884 - DNA, 15 bp, Homo sapiens
cctcccctatgctgg

SEQ ID NO: 5677885 - DNA, 16 bp, Homo sapiens
cctcccctcacagcct

SEQ ID NO: 5677886 - DNA, 13 bp, Homo sapiens
cctcccctcagag

SEQ ID NO: 5677887 - DNA, 20 bp, Homo sapiens
cctcccctcagagcccatgg

SEQ ID NO: 5677888 - DNA, 15 bp, Homo sapiens
cctcccctcagcctc

SEQ ID NO: 5677889 - DNA, 19 bp, Homo sapiens
cctcccctcagcctgccca

SEQ ID NO: 5677890 - DNA, 12 bp, Homo sapiens
cctcccctccag

SEQ ID NO: 5677891 - DNA, 12 bp, Homo sapiens
cctcccctccat

SEQ ID NO: 5677892 - DNA, 14 bp, Homo sapiens
cctcccctccgcag

SEQ ID NO: 5677893 - DNA, 20 bp, Homo sapiens
cctcccctccttgcctcctg

SEQ ID NO: 5677894 - DNA, 14 bp, Homo sapiens
cctcccctcgccca

SEQ ID NO: 5677895 - DNA, 18 bp, Homo sapiens
cctcccctcgtgtcagct

SEQ ID NO: 5677896 - DNA, 11 bp, Homo sapiens
cctcccctctc

SEQ ID NO: 5677897 - DNA, 15 bp, Homo sapiens
cctcccctctcagaa

SEQ ID NO: 5677898 - DNA, 19 bp, Homo sapiens
cctcccctctcatccccct

SEQ ID NO: 5677899 - DNA, 24 bp, Homo sapiens
cctcccctctcatccccctgtgga

SEQ ID NO: 5677900 - DNA, 13 bp, Homo sapiens
cctcccctctccc

SEQ ID NO: 5677901 - DNA, 21 bp, Homo sapiens
cctcccctctcttgcacccgc

SEQ ID NO: 5677902 - DNA, 12 bp, Homo sapiens
cctcccctgcca

SEQ ID NO: 5677903 - DNA, 13 bp, Homo sapiens
cctcccctgccag

SEQ ID NO: 5677904 - DNA, 17 bp, Homo sapiens
cctcccctgccagggct

SEQ ID NO: 5677905 - DNA, 14 bp, Homo sapiens
cctcccctgcccta

SEQ ID NO: 5677906 - DNA, 20 bp, Homo sapiens
cctcccctgcggagctgcat

SEQ ID NO: 5677907 - DNA, 21 bp, Homo sapiens
cctcccctgcggagctgcatg

SEQ ID NO: 5677908 - DNA, 14 bp, Homo sapiens
cctcccctgctcag

SEQ ID NO: 5677909 - DNA, 13 bp, Homo sapiens
cctcccctgctcc

SEQ ID NO: 5677910 - DNA, 14 bp, Homo sapiens
cctcccctgctccc

SEQ ID NO: 5677911 - DNA, 14 bp, Homo sapiens
cctcccctgctgca

SEQ ID NO: 5677912 - DNA, 16 bp, Homo sapiens
cctcccctgctgcagg

SEQ ID NO: 5677913 - DNA, 20 bp, Homo sapiens
cctcccctgctgcaggggct

SEQ ID NO: 5677914 - DNA, 14 bp, Homo sapiens
cctcccctggaggg

SEQ ID NO: 5677915 - DNA, 13 bp, Homo sapiens
cctcccctgggca

SEQ ID NO: 5677916 - DNA, 14 bp, Homo sapiens
cctcccctgggcag

SEQ ID NO: 5677917 - DNA, 13 bp, Homo sapiens
cctcccctgggga

SEQ ID NO: 5677918 - DNA, 14 bp, Homo sapiens
cctcccctggggac

SEQ ID NO: 5677919 - DNA, 20 bp, Homo sapiens
cctcccctggggacagcaag

SEQ ID NO: 5677920 - DNA, 21 bp, Homo sapiens
cctcccctgggttaacaaatg

SEQ ID NO: 5677921 - DNA, 18 bp, Homo sapiens
cctcccctggtcctgcac

SEQ ID NO: 5677922 - DNA, 14 bp, Homo sapiens
cctccccttcccag

SEQ ID NO: 5677923 - DNA, 15 bp, Homo sapiens
cctccccttcccaga

SEQ ID NO: 5677924 - DNA, 17 bp, Homo sapiens
cctccccttcccagacc

SEQ ID NO: 5677925 - DNA, 14 bp, Homo sapiens
cctccccttcccct

SEQ ID NO: 5677926 - DNA, 13 bp, Homo sapiens
cctccccttcctg

SEQ ID NO: 5677927 - DNA, 17 bp, Homo sapiens
cctccccttcctgcacc

SEQ ID NO: 5677928 - DNA, 18 bp, Homo sapiens
cctccccttcctgcaccc

SEQ ID NO: 5677929 - DNA, 18 bp, Homo sapiens
cctccccttcttcccgcc

SEQ ID NO: 5677930 - DNA, 13 bp, Homo sapiens
cctccccttgggc

SEQ ID NO: 5677931 - DNA, 23 bp, Homo sapiens
cctccccttgggcggctgagagc

SEQ ID NO: 5677932 - DNA, 16 bp, Homo sapiens
cctccccttttctatg

SEQ ID NO: 5677933 - DNA, 15 bp, Homo sapiens
cctcccgaaaaatgt

SEQ ID NO: 5677934 - DNA, 20 bp, Homo sapiens
cctcccgaaaaatgtgtggt

SEQ ID NO: 5677935 - DNA, 21 bp, Homo sapiens
cctcccgaaaaatgtgtggtt

SEQ ID NO: 5677936 - DNA, 17 bp, Homo sapiens
cctcccgaatagctggg

SEQ ID NO: 5677937 - DNA, 18 bp, Homo sapiens
cctcccgaatagctggga

SEQ ID NO: 5677938 - DNA, 15 bp, Homo sapiens
cctcccgacagccca

SEQ ID NO: 5677939 - DNA, 16 bp, Homo sapiens
cctcccgacagcccat

SEQ ID NO: 5677940 - DNA, 17 bp, Homo sapiens
cctcccgacagcccatc

SEQ ID NO: 5677941 - DNA, 18 bp, Homo sapiens
cctcccgagtagctggga

SEQ ID NO: 5677942 - DNA, 20 bp, Homo sapiens
cctcccgagtagctgggact

SEQ ID NO: 5677943 - DNA, 20 bp, Homo sapiens
cctcccgagtagctgggatt

SEQ ID NO: 5677944 - DNA, 23 bp, Homo sapiens
cctcccgcatgctgcctgcctcc

SEQ ID NO: 5677945 - DNA, 17 bp, Homo sapiens
cctcccgccactcgcct

SEQ ID NO: 5677946 - DNA, 16 bp, Homo sapiens
cctcccgccccagcct

SEQ ID NO: 5677947 - DNA, 19 bp, Homo sapiens
cctcccgccccagcctcct

SEQ ID NO: 5677948 - DNA, 23 bp, Homo sapiens
cctcccgccccagcctcctgagt

SEQ ID NO: 5677949 - DNA, 14 bp, Homo sapiens
cctcccgccccgcc

SEQ ID NO: 5677950 - DNA, 16 bp, Homo sapiens
cctcccgccccgcccc

SEQ ID NO: 5677951 - DNA, 12 bp, Homo sapiens
cctcccgccctc

SEQ ID NO: 5677952 - DNA, 13 bp, Homo sapiens
cctcccgccgcct

SEQ ID NO: 5677953 - DNA, 19 bp, Homo sapiens
cctcccggcatgggaaagc

SEQ ID NO: 5677954 - DNA, 21 bp, Homo sapiens
cctcccggctgcccccatcac

SEQ ID NO: 5677955 - DNA, 17 bp, Homo sapiens
cctcccgggccctccct

SEQ ID NO: 5677956 - DNA, 13 bp, Homo sapiens
cctcccggggcct

SEQ ID NO: 5677957 - DNA, 20 bp, Homo sapiens
cctcccggggtgcccgtgtg

SEQ ID NO: 5677958 - DNA, 21 bp, Homo sapiens
cctcccgggtctcaggcctcc

SEQ ID NO: 5677959 - DNA, 20 bp, Homo sapiens
cctcccgtctactcattccc

SEQ ID NO: 5677960 - DNA, 17 bp, Homo sapiens
cctccctacttccaaga

SEQ ID NO: 5677961 - DNA, 22 bp, Homo sapiens
cctccctagatccaggcttctc

SEQ ID NO: 5677962 - DNA, 23 bp, Homo sapiens
cctccctagcccttccagcctgg

SEQ ID NO: 5677963 - DNA, 14 bp, Homo sapiens
cctccctagctctt

SEQ ID NO: 5677964 - DNA, 19 bp, Homo sapiens
cctccctatatgcacccct

SEQ ID NO: 5677965 - DNA, 19 bp, Homo sapiens
cctccctatgtctgcaaag

SEQ ID NO: 5677966 - DNA, 17 bp, Homo sapiens
cctccctcagactcaga

SEQ ID NO: 5677967 - DNA, 23 bp, Homo sapiens
cctccctcagagacaccaaactg

SEQ ID NO: 5677968 - DNA, 20 bp, Homo sapiens
cctccctcagccacgcctct

SEQ ID NO: 5677969 - DNA, 22 bp, Homo sapiens
cctccctcagccacgcctctct

SEQ ID NO: 5677970 - DNA, 16 bp, Homo sapiens
cctccctcagcccctc

SEQ ID NO: 5677971 - DNA, 15 bp, Homo sapiens
cctccctcagcctcc

SEQ ID NO: 5677972 - DNA, 22 bp, Homo sapiens
cctccctcagctctctgggacc

SEQ ID NO: 5677973 - DNA, 12 bp, Homo sapiens
cctccctcaggc

SEQ ID NO: 5677974 - DNA, 16 bp, Homo sapiens
cctccctcaggcccag

SEQ ID NO: 5677975 - DNA, 15 bp, Homo sapiens
cctccctcattcatc

SEQ ID NO: 5677976 - DNA, 12 bp, Homo sapiens
cctccctccaag

SEQ ID NO: 5677977 - DNA, 14 bp, Homo sapiens
cctccctccaagcc

SEQ ID NO: 5677978 - DNA, 17 bp, Homo sapiens
cctccctccaagcctgg

SEQ ID NO: 5677979 - DNA, 18 bp, Homo sapiens
cctccctccaagcctggc

SEQ ID NO: 5677980 - DNA, 19 bp, Homo sapiens
cctccctccacacctccac

SEQ ID NO: 5677981 - DNA, 17 bp, Homo sapiens
cctccctccaccccagg

SEQ ID NO: 5677982 - DNA, 15 bp, Homo sapiens
cctccctccacctca

SEQ ID NO: 5677983 - DNA, 14 bp, Homo sapiens
cctccctccagaga

SEQ ID NO: 5677984 - DNA, 10 bp, Homo sapiens
cctccctccc

SEQ ID NO: 5677985 - DNA, 16 bp, Homo sapiens
cctccctcccacactt

SEQ ID NO: 5677986 - DNA, 14 bp, Homo sapiens
cctccctcccggca

SEQ ID NO: 5677987 - DNA, 14 bp, Homo sapiens
cctccctccctagc

SEQ ID NO: 5677988 - DNA, 15 bp, Homo sapiens
cctccctccctcttt

SEQ ID NO: 5677989 - DNA, 17 bp, Homo sapiens
cctccctccctgcaggg

SEQ ID NO: 5677990 - DNA, 16 bp, Homo sapiens
cctccctccctgctcc

SEQ ID NO: 5677991 - DNA, 15 bp, Homo sapiens
cctccctccgcctcc

SEQ ID NO: 5677992 - DNA, 16 bp, Homo sapiens
cctccctccgcctccc

SEQ ID NO: 5677993 - DNA, 18 bp, Homo sapiens
cctccctcctctggccca

SEQ ID NO: 5677994 - DNA, 16 bp, Homo sapiens
cctccctcctgcaggc

SEQ ID NO: 5677995 - DNA, 18 bp, Homo sapiens
cctccctcctgcaggctg

SEQ ID NO: 5677996 - DNA, 19 bp, Homo sapiens
cctccctcctggctcacag

SEQ ID NO: 5677997 - DNA, 21 bp, Homo sapiens
cctccctcctggctcacagcc

SEQ ID NO: 5677998 - DNA, 12 bp, Homo sapiens
cctccctccttc

SEQ ID NO: 5677999 - DNA, 14 bp, Homo sapiens
cctccctcctttcc

SEQ ID NO: 5678000 - DNA, 13 bp, Homo sapiens
cctccctcgtggg

SEQ ID NO: 5678001 - DNA, 14 bp, Homo sapiens
cctccctcgtgggc

SEQ ID NO: 5678002 - DNA, 19 bp, Homo sapiens
cctccctctagaggctgcc

SEQ ID NO: 5678003 - DNA, 22 bp, Homo sapiens
cctccctctcagaggcctgctg

SEQ ID NO: 5678004 - DNA, 13 bp, Homo sapiens
cctccctctccat

SEQ ID NO: 5678005 - DNA, 22 bp, Homo sapiens
cctccctctcccaggcccgaga

SEQ ID NO: 5678006 - DNA, 22 bp, Homo sapiens
cctccctctcgtaagatttcct

SEQ ID NO: 5678007 - DNA, 11 bp, Homo sapiens
cctccctctct

SEQ ID NO: 5678008 - DNA, 14 bp, Homo sapiens
cctccctctctgcc

SEQ ID NO: 5678009 - DNA, 12 bp, Homo sapiens
cctccctctgac

SEQ ID NO: 5678010 - DNA, 15 bp, Homo sapiens
cctccctctgcccca

SEQ ID NO: 5678011 - DNA, 13 bp, Homo sapiens
cctccctctgcct

SEQ ID NO: 5678012 - DNA, 17 bp, Homo sapiens
cctccctctgcctcatc

SEQ ID NO: 5678013 - DNA, 17 bp, Homo sapiens
cctccctcttccttccc

SEQ ID NO: 5678014 - DNA, 15 bp, Homo sapiens
cctccctctttccca

SEQ ID NO: 5678015 - DNA, 21 bp, Homo sapiens
cctccctgaaacactgcttct

SEQ ID NO: 5678016 - DNA, 19 bp, Homo sapiens
cctccctgaagcctttgca

SEQ ID NO: 5678017 - DNA, 19 bp, Homo sapiens
cctccctgaccctgctcct

SEQ ID NO: 5678018 - DNA, 16 bp, Homo sapiens
cctccctgacgtctgc

SEQ ID NO: 5678019 - DNA, 18 bp, Homo sapiens
cctccctgactccctgtg

SEQ ID NO: 5678020 - DNA, 15 bp, Homo sapiens
cctccctgagcctgc

SEQ ID NO: 5678021 - DNA, 12 bp, Homo sapiens
cctccctgcact

SEQ ID NO: 5678022 - DNA, 13 bp, Homo sapiens
cctccctgcactt

SEQ ID NO: 5678023 - DNA, 16 bp, Homo sapiens
cctccctgcacttcat

SEQ ID NO: 5678024 - DNA, 12 bp, Homo sapiens
cctccctgcaga

SEQ ID NO: 5678025 - DNA, 15 bp, Homo sapiens
cctccctgcagactc

SEQ ID NO: 5678026 - DNA, 12 bp, Homo sapiens
cctccctgcagc

SEQ ID NO: 5678027 - DNA, 14 bp, Homo sapiens
cctccctgcagcca

SEQ ID NO: 5678028 - DNA, 13 bp, Homo sapiens
cctccctgcagct

SEQ ID NO: 5678029 - DNA, 16 bp, Homo sapiens
cctccctgcccaaact

SEQ ID NO: 5678030 - DNA, 13 bp, Homo sapiens
cctccctgcccag

SEQ ID NO: 5678031 - DNA, 15 bp, Homo sapiens
cctccctgcccaggc

SEQ ID NO: 5678032 - DNA, 14 bp, Homo sapiens
cctccctgcccatc

SEQ ID NO: 5678033 - DNA, 12 bp, Homo sapiens
cctccctgcccc

SEQ ID NO: 5678034 - DNA, 15 bp, Homo sapiens
cctccctgcccccca

SEQ ID NO: 5678035 - DNA, 21 bp, Homo sapiens
cctccctgcccctcccttcaa

SEQ ID NO: 5678036 - DNA, 20 bp, Homo sapiens
cctccctgccgaacacacat

SEQ ID NO: 5678037 - DNA, 11 bp, Homo sapiens
cctccctgcct

SEQ ID NO: 5678038 - DNA, 12 bp, Homo sapiens
cctccctgcctc

SEQ ID NO: 5678039 - DNA, 13 bp, Homo sapiens
cctccctgcctca

SEQ ID NO: 5678040 - DNA, 13 bp, Homo sapiens
cctccctgcctgc

SEQ ID NO: 5678041 - DNA, 14 bp, Homo sapiens
cctccctgcctgct

SEQ ID NO: 5678042 - DNA, 19 bp, Homo sapiens
cctccctgcctgctccttg

SEQ ID NO: 5678043 - DNA, 20 bp, Homo sapiens
cctccctgcctgctccttgg

SEQ ID NO: 5678044 - DNA, 14 bp, Homo sapiens
cctccctgcctggc

SEQ ID NO: 5678045 - DNA, 12 bp, Homo sapiens
cctccctgcgct

SEQ ID NO: 5678046 - DNA, 17 bp, Homo sapiens
cctccctgcgcttcctg

SEQ ID NO: 5678047 - DNA, 17 bp, Homo sapiens
cctccctgctagcacag

SEQ ID NO: 5678048 - DNA, 20 bp, Homo sapiens
cctccctgctagcacagagg

SEQ ID NO: 5678049 - DNA, 23 bp, Homo sapiens
cctccctgctagcacagaggcct

SEQ ID NO: 5678050 - DNA, 13 bp, Homo sapiens
cctccctgctcag

SEQ ID NO: 5678051 - DNA, 15 bp, Homo sapiens
cctccctgctcagct

SEQ ID NO: 5678052 - DNA, 23 bp, Homo sapiens
cctccctgctcagtgcttgggct

SEQ ID NO: 5678053 - DNA, 14 bp, Homo sapiens
cctccctgctccct

SEQ ID NO: 5678054 - DNA, 15 bp, Homo sapiens
cctccctgctccctg

SEQ ID NO: 5678055 - DNA, 13 bp, Homo sapiens
cctccctgctgcc

SEQ ID NO: 5678056 - DNA, 14 bp, Homo sapiens
cctccctgctgcca

SEQ ID NO: 5678057 - DNA, 22 bp, Homo sapiens
cctccctgctgtcattgcttct

SEQ ID NO: 5678058 - DNA, 19 bp, Homo sapiens
cctccctgctgtcccctct

SEQ ID NO: 5678059 - DNA, 20 bp, Homo sapiens
cctccctgctgtcccctctt

SEQ ID NO: 5678060 - DNA, 22 bp, Homo sapiens
cctccctgctgtcccctcttgc

SEQ ID NO: 5678061 - DNA, 15 bp, Homo sapiens
cctccctgctgtgcc

SEQ ID NO: 5678062 - DNA, 23 bp, Homo sapiens
cctccctgctgtgccatgctggg

SEQ ID NO: 5678063 - DNA, 22 bp, Homo sapiens
cctccctgcttgcacacttccc

SEQ ID NO: 5678064 - DNA, 19 bp, Homo sapiens
cctccctggcatgtcagag

SEQ ID NO: 5678065 - DNA, 24 bp, Homo sapiens
cctccctggcctcacgcccagcct

SEQ ID NO: 5678066 - DNA, 15 bp, Homo sapiens
cctccctggcctgtt

SEQ ID NO: 5678067 - DNA, 15 bp, Homo sapiens
cctccctggctcaag

SEQ ID NO: 5678068 - DNA, 20 bp, Homo sapiens
cctccctggctcccatgacc

SEQ ID NO: 5678069 - DNA, 16 bp, Homo sapiens
cctccctggctcctcc

SEQ ID NO: 5678070 - DNA, 15 bp, Homo sapiens
cctccctggcttgag

SEQ ID NO: 5678071 - DNA, 20 bp, Homo sapiens
cctccctgggcctgtctcag

SEQ ID NO: 5678072 - DNA, 15 bp, Homo sapiens
cctccctggggacca

SEQ ID NO: 5678073 - DNA, 17 bp, Homo sapiens
cctccctgggggcccca

SEQ ID NO: 5678074 - DNA, 21 bp, Homo sapiens
cctccctgggggccccaggat

SEQ ID NO: 5678075 - DNA, 14 bp, Homo sapiens
cctccctgggggcg

SEQ ID NO: 5678076 - DNA, 19 bp, Homo sapiens
cctccctgggggcgggact

SEQ ID NO: 5678077 - DNA, 22 bp, Homo sapiens
cctccctgggggtggggctcct

SEQ ID NO: 5678078 - DNA, 13 bp, Homo sapiens
cctccctgggttc

SEQ ID NO: 5678079 - DNA, 14 bp, Homo sapiens
cctccctgggttca

SEQ ID NO: 5678080 - DNA, 20 bp, Homo sapiens
cctccctggtgagagggccg

SEQ ID NO: 5678081 - DNA, 17 bp, Homo sapiens
cctccctgtaatgcact

SEQ ID NO: 5678082 - DNA, 19 bp, Homo sapiens
cctccctgtcactcagctg

SEQ ID NO: 5678083 - DNA, 15 bp, Homo sapiens
cctccctgtcccctg

SEQ ID NO: 5678084 - DNA, 20 bp, Homo sapiens
cctccctgtcccctgaggtt

SEQ ID NO: 5678085 - DNA, 12 bp, Homo sapiens
cctccctgtcct

SEQ ID NO: 5678086 - DNA, 13 bp, Homo sapiens
cctccctgtctcc

SEQ ID NO: 5678087 - DNA, 15 bp, Homo sapiens
cctccctgtctccag

SEQ ID NO: 5678088 - DNA, 22 bp, Homo sapiens
cctccctgtctccagctgcctg

SEQ ID NO: 5678089 - DNA, 17 bp, Homo sapiens
cctccctgtctctgcat

SEQ ID NO: 5678090 - DNA, 18 bp, Homo sapiens
cctccctgtctctgcatc

SEQ ID NO: 5678091 - DNA, 21 bp, Homo sapiens
cctccctgtgcccccagcctc

SEQ ID NO: 5678092 - DNA, 20 bp, Homo sapiens
cctccctgttaataaacagc

SEQ ID NO: 5678093 - DNA, 19 bp, Homo sapiens
cctccctgttcaaggcccc

SEQ ID NO: 5678094 - DNA, 13 bp, Homo sapiens
cctccctgttcac

SEQ ID NO: 5678095 - DNA, 23 bp, Homo sapiens
cctccctgttccccacaggtcct

SEQ ID NO: 5678096 - DNA, 20 bp, Homo sapiens
cctccctgttccccagagaa

SEQ ID NO: 5678097 - DNA, 23 bp, Homo sapiens
cctccctgttgacgaagtctctt

SEQ ID NO: 5678098 - DNA, 14 bp, Homo sapiens
cctccctgtttgaa

SEQ ID NO: 5678099 - DNA, 17 bp, Homo sapiens
cctcccttacagagcat

SEQ ID NO: 5678100 - DNA, 13 bp, Homo sapiens
cctcccttagctc

SEQ ID NO: 5678101 - DNA, 22 bp, Homo sapiens
cctcccttccatgccccaggat

SEQ ID NO: 5678102 - DNA, 14 bp, Homo sapiens
cctcccttcccagg

SEQ ID NO: 5678103 - DNA, 16 bp, Homo sapiens
cctcccttcccaggag

SEQ ID NO: 5678104 - DNA, 15 bp, Homo sapiens
cctcccttcccagtg

SEQ ID NO: 5678105 - DNA, 13 bp, Homo sapiens
cctcccttcccca

SEQ ID NO: 5678106 - DNA, 19 bp, Homo sapiens
cctcccttccgaccctctg

SEQ ID NO: 5678107 - DNA, 12 bp, Homo sapiens
cctcccttcctt

SEQ ID NO: 5678108 - DNA, 15 bp, Homo sapiens
cctcccttccttttc

SEQ ID NO: 5678109 - DNA, 17 bp, Homo sapiens
cctcccttccttttccc

SEQ ID NO: 5678110 - DNA, 16 bp, Homo sapiens
cctcccttcgtgtgtg

SEQ ID NO: 5678111 - DNA, 23 bp, Homo sapiens
cctcccttcgtgtgtgcgcccct

SEQ ID NO: 5678112 - DNA, 17 bp, Homo sapiens
cctcccttctactgctt

SEQ ID NO: 5678113 - DNA, 17 bp, Homo sapiens
cctcccttctccctgga

SEQ ID NO: 5678114 - DNA, 16 bp, Homo sapiens
cctcccttctcttcac

SEQ ID NO: 5678115 - DNA, 15 bp, Homo sapiens
cctcccttctgctac

SEQ ID NO: 5678116 - DNA, 21 bp, Homo sapiens
cctcccttctttccttccttt

SEQ ID NO: 5678117 - DNA, 21 bp, Homo sapiens
cctcccttgagtaggccctgc

SEQ ID NO: 5678118 - DNA, 16 bp, Homo sapiens
cctcccttgccccagg

SEQ ID NO: 5678119 - DNA, 21 bp, Homo sapiens
cctcccttgccccaggccagg

SEQ ID NO: 5678120 - DNA, 12 bp, Homo sapiens
cctcccttgctg

SEQ ID NO: 5678121 - DNA, 16 bp, Homo sapiens
cctcccttgctgaaca

SEQ ID NO: 5678122 - DNA, 20 bp, Homo sapiens
cctcccttggggcctatgca

SEQ ID NO: 5678123 - DNA, 14 bp, Homo sapiens
cctcccttgtcctt

SEQ ID NO: 5678124 - DNA, 13 bp, Homo sapiens
cctccctttctcc

SEQ ID NO: 5678125 - DNA, 15 bp, Homo sapiens
cctccctttctcccc

SEQ ID NO: 5678126 - DNA, 13 bp, Homo sapiens
cctccctttctct

SEQ ID NO: 5678127 - DNA, 18 bp, Homo sapiens
cctccctttctctctcca

SEQ ID NO: 5678128 - DNA, 19 bp, Homo sapiens
cctccctttctctctccac

SEQ ID NO: 5678129 - DNA, 14 bp, Homo sapiens
cctccctttctggg

SEQ ID NO: 5678130 - DNA, 23 bp, Homo sapiens
cctccctttgccagccacccctc

SEQ ID NO: 5678131 - DNA, 18 bp, Homo sapiens
cctccgaacgctgctcca

SEQ ID NO: 5678132 - DNA, 19 bp, Homo sapiens
cctccgaaggggctctgag

SEQ ID NO: 5678133 - DNA, 18 bp, Homo sapiens
cctccgaccctcatggcc

SEQ ID NO: 5678134 - DNA, 22 bp, Homo sapiens
cctccgaccctcatggccccca

SEQ ID NO: 5678135 - DNA, 14 bp, Homo sapiens
cctccgaggccagt

SEQ ID NO: 5678136 - DNA, 17 bp, Homo sapiens
cctccgaggcctacctg

SEQ ID NO: 5678137 - DNA, 18 bp, Homo sapiens
cctccgaggcctacctgc

SEQ ID NO: 5678138 - DNA, 21 bp, Homo sapiens
cctccgaggcctacctgctcc

SEQ ID NO: 5678139 - DNA, 22 bp, Homo sapiens
cctccgaggcctacctgctccc

SEQ ID NO: 5678140 - DNA, 13 bp, Homo sapiens
cctccgaggctcc

SEQ ID NO: 5678141 - DNA, 18 bp, Homo sapiens
cctccgaggctccccgcc

SEQ ID NO: 5678142 - DNA, 22 bp, Homo sapiens
cctccgaggctccccgcctcca

SEQ ID NO: 5678143 - DNA, 22 bp, Homo sapiens
cctccgaggttttgaggcggga

SEQ ID NO: 5678144 - DNA, 16 bp, Homo sapiens
cctccgatccttcctc

SEQ ID NO: 5678145 - DNA, 19 bp, Homo sapiens
cctccgatccttcctccca

SEQ ID NO: 5678146 - DNA, 19 bp, Homo sapiens
cctccgatgcctggcctgc

SEQ ID NO: 5678147 - DNA, 16 bp, Homo sapiens
cctccgatgctgaggc

SEQ ID NO: 5678148 - DNA, 13 bp, Homo sapiens
cctccgcatcccg

SEQ ID NO: 5678149 - DNA, 13 bp, Homo sapiens
cctccgcatgcca

SEQ ID NO: 5678150 - DNA, 13 bp, Homo sapiens
cctccgccagacc

SEQ ID NO: 5678151 - DNA, 16 bp, Homo sapiens
cctccgccaggcgaga

SEQ ID NO: 5678152 - DNA, 15 bp, Homo sapiens
cctccgccatccacc

SEQ ID NO: 5678153 - DNA, 17 bp, Homo sapiens
cctccgccccgtccccc

SEQ ID NO: 5678154 - DNA, 23 bp, Homo sapiens
cctccgccccgtccccccatccc

SEQ ID NO: 5678155 - DNA, 13 bp, Homo sapiens
cctccgcccctgc

SEQ ID NO: 5678156 - DNA, 18 bp, Homo sapiens
cctccgcctactgtccct

SEQ ID NO: 5678157 - DNA, 23 bp, Homo sapiens
cctccgcctactgtccctctcag

SEQ ID NO: 5678158 - DNA, 13 bp, Homo sapiens
cctccgcctggga

SEQ ID NO: 5678159 - DNA, 12 bp, Homo sapiens
cctccgcctgtc

SEQ ID NO: 5678160 - DNA, 13 bp, Homo sapiens
cctccgcctgtgt

SEQ ID NO: 5678161 - DNA, 21 bp, Homo sapiens
cctccgccttcccagcagcgg

SEQ ID NO: 5678162 - DNA, 20 bp, Homo sapiens
cctccgccttgctgagactt

SEQ ID NO: 5678163 - DNA, 17 bp, Homo sapiens
cctccgcggaggcccct

SEQ ID NO: 5678164 - DNA, 16 bp, Homo sapiens
cctccgcggctggagc

SEQ ID NO: 5678165 - DNA, 14 bp, Homo sapiens
cctccgcttccctg

SEQ ID NO: 5678166 - DNA, 17 bp, Homo sapiens
cctccgcttgccagagg

SEQ ID NO: 5678167 - DNA, 17 bp, Homo sapiens
cctccggaggagcagcc

SEQ ID NO: 5678168 - DNA, 18 bp, Homo sapiens
cctccggaggagcagcct

SEQ ID NO: 5678169 - DNA, 18 bp, Homo sapiens
cctccggccagcgagtgg

SEQ ID NO: 5678170 - DNA, 19 bp, Homo sapiens
cctccggccaggtgcctcc

SEQ ID NO: 5678171 - DNA, 14 bp, Homo sapiens
cctccggccctgcc

SEQ ID NO: 5678172 - DNA, 18 bp, Homo sapiens
cctccggccctgccccac

SEQ ID NO: 5678173 - DNA, 12 bp, Homo sapiens
cctccggcctcc

SEQ ID NO: 5678174 - DNA, 16 bp, Homo sapiens
cctccggcctgcactc

SEQ ID NO: 5678175 - DNA, 18 bp, Homo sapiens
cctccggcgggtgacagc

SEQ ID NO: 5678176 - DNA, 22 bp, Homo sapiens
cctccggcgggtgacagctccg

SEQ ID NO: 5678177 - DNA, 13 bp, Homo sapiens
cctccggctgcct

SEQ ID NO: 5678178 - DNA, 16 bp, Homo sapiens
cctccggctggacctg

SEQ ID NO: 5678179 - DNA, 21 bp, Homo sapiens
cctccggctggacctggggtc

SEQ ID NO: 5678180 - DNA, 16 bp, Homo sapiens
cctccgggactgacct

SEQ ID NO: 5678181 - DNA, 16 bp, Homo sapiens
cctccgggcagagacc

SEQ ID NO: 5678182 - DNA, 16 bp, Homo sapiens
cctccgggcctcggcc

SEQ ID NO: 5678183 - DNA, 17 bp, Homo sapiens
cctccgggcctcggcct

SEQ ID NO: 5678184 - DNA, 18 bp, Homo sapiens
cctccgggcctcggcctg

SEQ ID NO: 5678185 - DNA, 20 bp, Homo sapiens
cctccgggcctcggcctggc

SEQ ID NO: 5678186 - DNA, 21 bp, Homo sapiens
cctccgggcctcggcctggct

SEQ ID NO: 5678187 - DNA, 22 bp, Homo sapiens
cctccgggcctcggcctggctt

SEQ ID NO: 5678188 - DNA, 16 bp, Homo sapiens
cctccggggagagcag

SEQ ID NO: 5678189 - DNA, 17 bp, Homo sapiens
cctccggggctcagccc

SEQ ID NO: 5678190 - DNA, 15 bp, Homo sapiens
cctccggggtgggtg

SEQ ID NO: 5678191 - DNA, 20 bp, Homo sapiens
cctccggtgagcagggtcag

SEQ ID NO: 5678192 - DNA, 19 bp, Homo sapiens
cctccggttgcatactgga

SEQ ID NO: 5678193 - DNA, 18 bp, Homo sapiens
cctccgtagggtctttct

SEQ ID NO: 5678194 - DNA, 16 bp, Homo sapiens
cctccgtatttcagac

SEQ ID NO: 5678195 - DNA, 19 bp, Homo sapiens
cctccgtcactacctggct

SEQ ID NO: 5678196 - DNA, 20 bp, Homo sapiens
cctccgtcactacctggctg

SEQ ID NO: 5678197 - DNA, 14 bp, Homo sapiens
cctccgtccccagg

SEQ ID NO: 5678198 - DNA, 16 bp, Homo sapiens
cctccgtccccagggt

SEQ ID NO: 5678199 - DNA, 14 bp, Homo sapiens
cctccgtcctgtca

SEQ ID NO: 5678200 - DNA, 18 bp, Homo sapiens
cctccgtcctgtcactga

SEQ ID NO: 5678201 - DNA, 15 bp, Homo sapiens
cctccgtcgggcccc

SEQ ID NO: 5678202 - DNA, 18 bp, Homo sapiens
cctccgtcgggcccctgc

SEQ ID NO: 5678203 - DNA, 22 bp, Homo sapiens
cctccgtcgggcccctgcctgc

SEQ ID NO: 5678204 - DNA, 14 bp, Homo sapiens
cctccgtcttccca

SEQ ID NO: 5678205 - DNA, 22 bp, Homo sapiens
cctccgtgagcaccaccagggc

SEQ ID NO: 5678206 - DNA, 17 bp, Homo sapiens
cctccgtgatccatcca

SEQ ID NO: 5678207 - DNA, 18 bp, Homo sapiens
cctccgtgatccatccat

SEQ ID NO: 5678208 - DNA, 18 bp, Homo sapiens
cctccgtggaacattctg

SEQ ID NO: 5678209 - DNA, 20 bp, Homo sapiens
cctccgtggaacattctgga

SEQ ID NO: 5678210 - DNA, 24 bp, Homo sapiens
cctccgtgggcagctcctcgggtg

SEQ ID NO: 5678211 - DNA, 21 bp, Homo sapiens
cctccgttcccacctctgagg

SEQ ID NO: 5678212 - DNA, 17 bp, Homo sapiens
cctcctaaaaggcccag

SEQ ID NO: 5678213 - DNA, 18 bp, Homo sapiens
cctcctaaaaggcccaga

SEQ ID NO: 5678214 - DNA, 22 bp, Homo sapiens
cctcctaaagctgaatcccggc

SEQ ID NO: 5678215 - DNA, 18 bp, Homo sapiens
cctcctaaatgtcagctg

SEQ ID NO: 5678216 - DNA, 20 bp, Homo sapiens
cctcctaagcagctgggact

SEQ ID NO: 5678217 - DNA, 19 bp, Homo sapiens
cctcctaaggctccccacc

SEQ ID NO: 5678218 - DNA, 23 bp, Homo sapiens
cctcctaaggctccccaccccga

SEQ ID NO: 5678219 - DNA, 18 bp, Homo sapiens
cctcctacccctcccagc

SEQ ID NO: 5678220 - DNA, 15 bp, Homo sapiens
cctcctaccccttcc

SEQ ID NO: 5678221 - DNA, 23 bp, Homo sapiens
cctcctaccccttcctgtcctgc

SEQ ID NO: 5678222 - DNA, 15 bp, Homo sapiens
cctcctaccctccca

SEQ ID NO: 5678223 - DNA, 16 bp, Homo sapiens
cctcctaccctgcgcc

SEQ ID NO: 5678224 - DNA, 14 bp, Homo sapiens
cctcctacctcagc

SEQ ID NO: 5678225 - DNA, 16 bp, Homo sapiens
cctcctacctggggac

SEQ ID NO: 5678226 - DNA, 17 bp, Homo sapiens
cctcctacgcagatgct

SEQ ID NO: 5678227 - DNA, 20 bp, Homo sapiens
cctcctagaaaacccttccc

SEQ ID NO: 5678228 - DNA, 21 bp, Homo sapiens
cctcctagaaaacccttcccg

SEQ ID NO: 5678229 - DNA, 18 bp, Homo sapiens
cctcctagaggtgggcag

SEQ ID NO: 5678230 - DNA, 22 bp, Homo sapiens
cctcctagaggtgggcagctgg

SEQ ID NO: 5678231 - DNA, 15 bp, Homo sapiens
cctcctagagtgcag

SEQ ID NO: 5678232 - DNA, 14 bp, Homo sapiens
cctcctagcccctt

SEQ ID NO: 5678233 - DNA, 21 bp, Homo sapiens
cctcctagccccttcttccaa

SEQ ID NO: 5678234 - DNA, 13 bp, Homo sapiens
cctcctagcctct

SEQ ID NO: 5678235 - DNA, 22 bp, Homo sapiens
cctcctagcctctccgcccacg

SEQ ID NO: 5678236 - DNA, 21 bp, Homo sapiens
cctcctagctggagtgccatg

SEQ ID NO: 5678237 - DNA, 19 bp, Homo sapiens
cctcctaggaaaccagctc

SEQ ID NO: 5678238 - DNA, 14 bp, Homo sapiens
cctcctaggcgctc

SEQ ID NO: 5678239 - DNA, 17 bp, Homo sapiens
cctcctaggcgctcaga

SEQ ID NO: 5678240 - DNA, 18 bp, Homo sapiens
cctcctaggcgctcagag

SEQ ID NO: 5678241 - DNA, 17 bp, Homo sapiens
cctcctaggctccctga

SEQ ID NO: 5678242 - DNA, 19 bp, Homo sapiens
cctcctaggctccctgagg

SEQ ID NO: 5678243 - DNA, 20 bp, Homo sapiens
cctcctagggcattgtatct

SEQ ID NO: 5678244 - DNA, 15 bp, Homo sapiens
cctcctaggggaagg

SEQ ID NO: 5678245 - DNA, 14 bp, Homo sapiens
cctcctagggggtg

SEQ ID NO: 5678246 - DNA, 19 bp, Homo sapiens
cctcctatcagaagtttct

SEQ ID NO: 5678247 - DNA, 22 bp, Homo sapiens
cctcctatctccctggctcact

SEQ ID NO: 5678248 - DNA, 20 bp, Homo sapiens
cctcctattttaattggaat

SEQ ID NO: 5678249 - DNA, 15 bp, Homo sapiens
cctcctcacactcca

SEQ ID NO: 5678250 - DNA, 17 bp, Homo sapiens
cctcctcacccaccctg

SEQ ID NO: 5678251 - DNA, 17 bp, Homo sapiens
cctcctcacccttcccg

SEQ ID NO: 5678252 - DNA, 12 bp, Homo sapiens
cctcctcacctc

SEQ ID NO: 5678253 - DNA, 15 bp, Homo sapiens
cctcctcacctcatg

SEQ ID NO: 5678254 - DNA, 22 bp, Homo sapiens
cctcctcacctcatgcccaccc

SEQ ID NO: 5678255 - DNA, 13 bp, Homo sapiens
cctcctcacctct

SEQ ID NO: 5678256 - DNA, 14 bp, Homo sapiens
cctcctcactccct

SEQ ID NO: 5678257 - DNA, 20 bp, Homo sapiens
cctcctcactggccatccct

SEQ ID NO: 5678258 - DNA, 18 bp, Homo sapiens
cctcctcagcagcctcac

SEQ ID NO: 5678259 - DNA, 19 bp, Homo sapiens
cctcctcagccagcctcct

SEQ ID NO: 5678260 - DNA, 16 bp, Homo sapiens
cctcctcagcccccag

SEQ ID NO: 5678261 - DNA, 18 bp, Homo sapiens
cctcctcagcccccaggc

SEQ ID NO: 5678262 - DNA, 15 bp, Homo sapiens
cctcctcagcctctg

SEQ ID NO: 5678263 - DNA, 16 bp, Homo sapiens
cctcctcagcctctgc

SEQ ID NO: 5678264 - DNA, 15 bp, Homo sapiens
cctcctcagcctgaa

SEQ ID NO: 5678265 - DNA, 14 bp, Homo sapiens
cctcctcagctccc

SEQ ID NO: 5678266 - DNA, 17 bp, Homo sapiens
cctcctcagctccctgc

SEQ ID NO: 5678267 - DNA, 20 bp, Homo sapiens
cctcctcagctccctgcctg

SEQ ID NO: 5678268 - DNA, 16 bp, Homo sapiens
cctcctcagctgcatg

SEQ ID NO: 5678269 - DNA, 22 bp, Homo sapiens
cctcctcagctgcatggagcct

SEQ ID NO: 5678270 - DNA, 17 bp, Homo sapiens
cctcctcaggcacacag

SEQ ID NO: 5678271 - DNA, 21 bp, Homo sapiens
cctcctcaggcacacagctac

SEQ ID NO: 5678272 - DNA, 15 bp, Homo sapiens
cctcctcaggcccag

SEQ ID NO: 5678273 - DNA, 13 bp, Homo sapiens
cctcctcagggat

SEQ ID NO: 5678274 - DNA, 20 bp, Homo sapiens
cctcctcagtctttggggga

SEQ ID NO: 5678275 - DNA, 13 bp, Homo sapiens
cctcctcatcagt

SEQ ID NO: 5678276 - DNA, 22 bp, Homo sapiens
cctcctcatcagtgtgtaaata

SEQ ID NO: 5678277 - DNA, 13 bp, Homo sapiens
cctcctcatcccg

SEQ ID NO: 5678278 - DNA, 23 bp, Homo sapiens
cctcctcatcccgtgttctcctt

SEQ ID NO: 5678279 - DNA, 23 bp, Homo sapiens
cctcctcatctgggggagtggaa

SEQ ID NO: 5678280 - DNA, 20 bp, Homo sapiens
cctcctcatgtacataccct

SEQ ID NO: 5678281 - DNA, 20 bp, Homo sapiens
cctcctccaagaagccctcc

SEQ ID NO: 5678282 - DNA, 14 bp, Homo sapiens
cctcctccacagtg

SEQ ID NO: 5678283 - DNA, 17 bp, Homo sapiens
cctcctccacagtgctg

SEQ ID NO: 5678284 - DNA, 18 bp, Homo sapiens
cctcctccacagtgctgc

SEQ ID NO: 5678285 - DNA, 14 bp, Homo sapiens
cctcctccaccacc

SEQ ID NO: 5678286 - DNA, 17 bp, Homo sapiens
cctcctccacccacccc

SEQ ID NO: 5678287 - DNA, 22 bp, Homo sapiens
cctcctccactcactccagccc

SEQ ID NO: 5678288 - DNA, 13 bp, Homo sapiens
cctcctccacttg

SEQ ID NO: 5678289 - DNA, 14 bp, Homo sapiens
cctcctccacttgg

SEQ ID NO: 5678290 - DNA, 11 bp, Homo sapiens
cctcctccaga

SEQ ID NO: 5678291 - DNA, 13 bp, Homo sapiens
cctcctccagact

SEQ ID NO: 5678292 - DNA, 14 bp, Homo sapiens
cctcctccagactc

SEQ ID NO: 5678293 - DNA, 21 bp, Homo sapiens
cctcctccagagcctgggcgc

SEQ ID NO: 5678294 - DNA, 17 bp, Homo sapiens
cctcctccagctcctgc

SEQ ID NO: 5678295 - DNA, 19 bp, Homo sapiens
cctcctcccaacagtttta

SEQ ID NO: 5678296 - DNA, 12 bp, Homo sapiens
cctcctcccacc

SEQ ID NO: 5678297 - DNA, 23 bp, Homo sapiens
cctcctcccacccggctgcagag

SEQ ID NO: 5678298 - DNA, 22 bp, Homo sapiens
cctcctcccactgcccactggc

SEQ ID NO: 5678299 - DNA, 15 bp, Homo sapiens
cctcctcccagtgcc

SEQ ID NO: 5678300 - DNA, 20 bp, Homo sapiens
cctcctcccatctccttccc

SEQ ID NO: 5678301 - DNA, 14 bp, Homo sapiens
cctcctcccatgtc

SEQ ID NO: 5678302 - DNA, 16 bp, Homo sapiens
cctcctccccagagct

SEQ ID NO: 5678303 - DNA, 13 bp, Homo sapiens
cctcctcccccac

SEQ ID NO: 5678304 - DNA, 17 bp, Homo sapiens
cctcctcccccacccct

SEQ ID NO: 5678305 - DNA, 14 bp, Homo sapiens
cctcctcccccacg

SEQ ID NO: 5678306 - DNA, 20 bp, Homo sapiens
cctcctcccccacgcctcca

SEQ ID NO: 5678307 - DNA, 21 bp, Homo sapiens
cctcctcccccggctgggcct

SEQ ID NO: 5678308 - DNA, 15 bp, Homo sapiens
cctcctccccctttg

SEQ ID NO: 5678309 - DNA, 18 bp, Homo sapiens
cctcctcccctcctcttc

SEQ ID NO: 5678310 - DNA, 12 bp, Homo sapiens
cctcctcccctg

SEQ ID NO: 5678311 - DNA, 19 bp, Homo sapiens
cctcctccctcagacccag

SEQ ID NO: 5678312 - DNA, 19 bp, Homo sapiens
cctcctccctcagactcag

SEQ ID NO: 5678313 - DNA, 13 bp, Homo sapiens
cctcctccctccc

SEQ ID NO: 5678314 - DNA, 15 bp, Homo sapiens
cctcctccctcccag

SEQ ID NO: 5678315 - DNA, 17 bp, Homo sapiens
cctcctccctggctgca

SEQ ID NO: 5678316 - DNA, 18 bp, Homo sapiens
cctcctccctggctgcag

SEQ ID NO: 5678317 - DNA, 19 bp, Homo sapiens
cctcctccctgttattttc

SEQ ID NO: 5678318 - DNA, 15 bp, Homo sapiens
cctcctcccttagct

SEQ ID NO: 5678319 - DNA, 16 bp, Homo sapiens
cctcctcccttagctc

SEQ ID NO: 5678320 - DNA, 14 bp, Homo sapiens
cctcctcccttttt

SEQ ID NO: 5678321 - DNA, 20 bp, Homo sapiens
cctcctccgcgctgtgtaaa

SEQ ID NO: 5678322 - DNA, 14 bp, Homo sapiens
cctcctccgggggc

SEQ ID NO: 5678323 - DNA, 15 bp, Homo sapiens
cctcctccgtgggca

SEQ ID NO: 5678324 - DNA, 23 bp, Homo sapiens
cctcctccgtgggcagctcctcg

SEQ ID NO: 5678325 - DNA, 12 bp, Homo sapiens
cctcctcctagc

SEQ ID NO: 5678326 - DNA, 12 bp, Homo sapiens
cctcctcctcac

SEQ ID NO: 5678327 - DNA, 13 bp, Homo sapiens
cctcctcctcacc

SEQ ID NO: 5678328 - DNA, 13 bp, Homo sapiens
cctcctcctcatt

SEQ ID NO: 5678329 - DNA, 13 bp, Homo sapiens
cctcctcctcctc

SEQ ID NO: 5678330 - DNA, 16 bp, Homo sapiens
cctcctcctcctgccc

SEQ ID NO: 5678331 - DNA, 13 bp, Homo sapiens
cctcctcctgccc

SEQ ID NO: 5678332 - DNA, 13 bp, Homo sapiens
cctcctccttccc

SEQ ID NO: 5678333 - DNA, 13 bp, Homo sapiens
cctcctccttcct

SEQ ID NO: 5678334 - DNA, 14 bp, Homo sapiens
cctcctccttccta

SEQ ID NO: 5678335 - DNA, 15 bp, Homo sapiens
cctcctcgaacccac

SEQ ID NO: 5678336 - DNA, 20 bp, Homo sapiens
cctcctcgctcctccttccc

SEQ ID NO: 5678337 - DNA, 23 bp, Homo sapiens
cctcctcgctcctccttcccagg

SEQ ID NO: 5678338 - DNA, 15 bp, Homo sapiens
cctcctcgctgtgcc

SEQ ID NO: 5678339 - DNA, 24 bp, Homo sapiens
cctcctcggaaccgctcacctaga

SEQ ID NO: 5678340 - DNA, 13 bp, Homo sapiens
cctcctcggaaga

SEQ ID NO: 5678341 - DNA, 21 bp, Homo sapiens
cctcctcggagagcagcagca

SEQ ID NO: 5678342 - DNA, 18 bp, Homo sapiens
cctcctcgggccgaggcc

SEQ ID NO: 5678343 - DNA, 21 bp, Homo sapiens
cctcctcgggccgaggcccag

SEQ ID NO: 5678344 - DNA, 14 bp, Homo sapiens
cctcctcgggcgcc

SEQ ID NO: 5678345 - DNA, 15 bp, Homo sapiens
cctcctcgggcgcct

SEQ ID NO: 5678346 - DNA, 19 bp, Homo sapiens
cctcctcgggcgcctgcgc

SEQ ID NO: 5678347 - DNA, 18 bp, Homo sapiens
cctcctcggggctccagg

SEQ ID NO: 5678348 - DNA, 15 bp, Homo sapiens
cctcctctagaaggc

SEQ ID NO: 5678349 - DNA, 17 bp, Homo sapiens
cctcctctagaaggctg

SEQ ID NO: 5678350 - DNA, 21 bp, Homo sapiens
cctcctctcaaacctggcaga

SEQ ID NO: 5678351 - DNA, 13 bp, Homo sapiens
cctcctctccatg

SEQ ID NO: 5678352 - DNA, 22 bp, Homo sapiens
cctcctctccatgcaagtgctg

SEQ ID NO: 5678353 - DNA, 16 bp, Homo sapiens
cctcctctcccatccc

SEQ ID NO: 5678354 - DNA, 19 bp, Homo sapiens
cctcctctcccatccccct

SEQ ID NO: 5678355 - DNA, 13 bp, Homo sapiens
cctcctctcccgt

SEQ ID NO: 5678356 - DNA, 18 bp, Homo sapiens
cctcctctcccgtctcgc

SEQ ID NO: 5678357 - DNA, 13 bp, Homo sapiens
cctcctctcctcg

SEQ ID NO: 5678358 - DNA, 19 bp, Homo sapiens
cctcctctcctgcccagct

SEQ ID NO: 5678359 - DNA, 20 bp, Homo sapiens
cctcctctctccctgcctca

SEQ ID NO: 5678360 - DNA, 15 bp, Homo sapiens
cctcctctctgccac

SEQ ID NO: 5678361 - DNA, 15 bp, Homo sapiens
cctcctctctgccct

SEQ ID NO: 5678362 - DNA, 16 bp, Homo sapiens
cctcctctctgcccta

SEQ ID NO: 5678363 - DNA, 14 bp, Homo sapiens
cctcctctctgctg

SEQ ID NO: 5678364 - DNA, 13 bp, Homo sapiens
cctcctctctgga

SEQ ID NO: 5678365 - DNA, 12 bp, Homo sapiens
cctcctctgaaa

SEQ ID NO: 5678366 - DNA, 15 bp, Homo sapiens
cctcctctgaaacag

SEQ ID NO: 5678367 - DNA, 18 bp, Homo sapiens
cctcctctgaaacagctg

SEQ ID NO: 5678368 - DNA, 19 bp, Homo sapiens
cctcctctgaaacagctgc

SEQ ID NO: 5678369 - DNA, 20 bp, Homo sapiens
cctcctctgaaacagctgcc

SEQ ID NO: 5678370 - DNA, 12 bp, Homo sapiens
cctcctctgaat

SEQ ID NO: 5678371 - DNA, 13 bp, Homo sapiens
cctcctctgccac

SEQ ID NO: 5678372 - DNA, 19 bp, Homo sapiens
cctcctctgccagcaggaa

SEQ ID NO: 5678373 - DNA, 22 bp, Homo sapiens
cctcctctgccagcaggaataa

SEQ ID NO: 5678374 - DNA, 14 bp, Homo sapiens
cctcctctgccccc

SEQ ID NO: 5678375 - DNA, 15 bp, Homo sapiens
cctcctctgccccct

SEQ ID NO: 5678376 - DNA, 20 bp, Homo sapiens
cctcctctgccccctccccc

SEQ ID NO: 5678377 - DNA, 23 bp, Homo sapiens
cctcctctgccccctcccccgca

SEQ ID NO: 5678378 - DNA, 19 bp, Homo sapiens
cctcctctgcctacagcca

SEQ ID NO: 5678379 - DNA, 12 bp, Homo sapiens
cctcctctgctg

SEQ ID NO: 5678380 - DNA, 18 bp, Homo sapiens
cctcctctgcttgccatc

SEQ ID NO: 5678381 - DNA, 15 bp, Homo sapiens
cctcctctgtccagg

SEQ ID NO: 5678382 - DNA, 16 bp, Homo sapiens
cctcctctgtccaggg

SEQ ID NO: 5678383 - DNA, 13 bp, Homo sapiens
cctcctctgtgct

SEQ ID NO: 5678384 - DNA, 16 bp, Homo sapiens
cctcctcttcaccccg

SEQ ID NO: 5678385 - DNA, 16 bp, Homo sapiens
cctcctcttggagctg

SEQ ID NO: 5678386 - DNA, 18 bp, Homo sapiens
cctcctctttctctcccc

SEQ ID NO: 5678387 - DNA, 17 bp, Homo sapiens
cctcctgaagcctctgc

SEQ ID NO: 5678388 - DNA, 15 bp, Homo sapiens
cctcctgacaccctt

SEQ ID NO: 5678389 - DNA, 22 bp, Homo sapiens
cctcctgacacccttctcccac

SEQ ID NO: 5678390 - DNA, 18 bp, Homo sapiens
cctcctgacccccatgta

SEQ ID NO: 5678391 - DNA, 19 bp, Homo sapiens
cctcctgacccccatgtaa

SEQ ID NO: 5678392 - DNA, 16 bp, Homo sapiens
cctcctgacctgaggc

SEQ ID NO: 5678393 - DNA, 18 bp, Homo sapiens
cctcctgacctgaggctc

SEQ ID NO: 5678394 - DNA, 20 bp, Homo sapiens
cctcctgactcatccgcctg

SEQ ID NO: 5678395 - DNA, 14 bp, Homo sapiens
cctcctgagagctg

SEQ ID NO: 5678396 - DNA, 16 bp, Homo sapiens
cctcctgagagctgtt

SEQ ID NO: 5678397 - DNA, 14 bp, Homo sapiens
cctcctgagcctca

SEQ ID NO: 5678398 - DNA, 15 bp, Homo sapiens
cctcctgagcctcac

SEQ ID NO: 5678399 - DNA, 14 bp, Homo sapiens
cctcctgagcctgt

SEQ ID NO: 5678400 - DNA, 12 bp, Homo sapiens
cctcctgagctc

SEQ ID NO: 5678401 - DNA, 23 bp, Homo sapiens
cctcctgagctcggggggctctg

SEQ ID NO: 5678402 - DNA, 17 bp, Homo sapiens
cctcctgaggctgtttt

SEQ ID NO: 5678403 - DNA, 16 bp, Homo sapiens
cctcctgagggaggac

SEQ ID NO: 5678404 - DNA, 19 bp, Homo sapiens
cctcctgagggaggacctg

SEQ ID NO: 5678405 - DNA, 16 bp, Homo sapiens
cctcctgagggctcca

SEQ ID NO: 5678406 - DNA, 15 bp, Homo sapiens
cctcctgagtagctg

SEQ ID NO: 5678407 - DNA, 24 bp, Homo sapiens
cctcctgagtagctgagactacag

SEQ ID NO: 5678408 - DNA, 16 bp, Homo sapiens
cctcctgagtgcccca

SEQ ID NO: 5678409 - DNA, 19 bp, Homo sapiens
cctcctgagtgccccactt

SEQ ID NO: 5678410 - DNA, 22 bp, Homo sapiens
cctcctgagttgaagtcatgct

SEQ ID NO: 5678411 - DNA, 16 bp, Homo sapiens
cctcctgatggccaag

SEQ ID NO: 5678412 - DNA, 15 bp, Homo sapiens
cctcctgatgtcttg

SEQ ID NO: 5678413 - DNA, 16 bp, Homo sapiens
cctcctgcaagagtgg

SEQ ID NO: 5678414 - DNA, 16 bp, Homo sapiens
cctcctgcacacaggg

SEQ ID NO: 5678415 - DNA, 13 bp, Homo sapiens
cctcctgcacgcg

SEQ ID NO: 5678416 - DNA, 13 bp, Homo sapiens
cctcctgcagaca

SEQ ID NO: 5678417 - DNA, 20 bp, Homo sapiens
cctcctgcagacacctggac

SEQ ID NO: 5678418 - DNA, 12 bp, Homo sapiens
cctcctgcaggc

SEQ ID NO: 5678419 - DNA, 14 bp, Homo sapiens
cctcctgcaggctg

SEQ ID NO: 5678420 - DNA, 12 bp, Homo sapiens
cctcctgcagtt

SEQ ID NO: 5678421 - DNA, 18 bp, Homo sapiens
cctcctgccaccccttcc

SEQ ID NO: 5678422 - DNA, 14 bp, Homo sapiens
cctcctgccagctc

SEQ ID NO: 5678423 - DNA, 16 bp, Homo sapiens
cctcctgccagctctg

SEQ ID NO: 5678424 - DNA, 10 bp, Homo sapiens
cctcctgccc

SEQ ID NO: 5678425 - DNA, 21 bp, Homo sapiens
cctcctgcccagctcctcaca

SEQ ID NO: 5678426 - DNA, 16 bp, Homo sapiens
cctcctgcccaggact

SEQ ID NO: 5678427 - DNA, 17 bp, Homo sapiens
cctcctgcccaggactg

SEQ ID NO: 5678428 - DNA, 16 bp, Homo sapiens
cctcctgcccaggaga

SEQ ID NO: 5678429 - DNA, 21 bp, Homo sapiens
cctcctgcccaggagagccag

SEQ ID NO: 5678430 - DNA, 23 bp, Homo sapiens
cctcctgcccaggagagccagcc

SEQ ID NO: 5678431 - DNA, 13 bp, Homo sapiens
cctcctgccccct

SEQ ID NO: 5678432 - DNA, 18 bp, Homo sapiens
cctcctgcccgccctccc

SEQ ID NO: 5678433 - DNA, 20 bp, Homo sapiens
cctcctgccctcctctcccc

SEQ ID NO: 5678434 - DNA, 15 bp, Homo sapiens
cctcctgcctcagcc

SEQ ID NO: 5678435 - DNA, 17 bp, Homo sapiens
cctcctgcctcagcctt

SEQ ID NO: 5678436 - DNA, 18 bp, Homo sapiens
cctcctgcctcagccttc

SEQ ID NO: 5678437 - DNA, 13 bp, Homo sapiens
cctcctgcctcta

SEQ ID NO: 5678438 - DNA, 14 bp, Homo sapiens
cctcctgcctttct

SEQ ID NO: 5678439 - DNA, 20 bp, Homo sapiens
cctcctgcgcgcatgtgcgc

SEQ ID NO: 5678440 - DNA, 21 bp, Homo sapiens
cctcctgcggctcagccttgc

SEQ ID NO: 5678441 - DNA, 14 bp, Homo sapiens
cctcctgctcctca

SEQ ID NO: 5678442 - DNA, 14 bp, Homo sapiens
cctcctgctcctcc

SEQ ID NO: 5678443 - DNA, 11 bp, Homo sapiens
cctcctgctct

SEQ ID NO: 5678444 - DNA, 12 bp, Homo sapiens
cctcctgctctg

SEQ ID NO: 5678445 - DNA, 18 bp, Homo sapiens
cctcctgctctgcacggt

SEQ ID NO: 5678446 - DNA, 15 bp, Homo sapiens
cctcctgctctggga

SEQ ID NO: 5678447 - DNA, 10 bp, Homo sapiens
cctcctgctg

SEQ ID NO: 5678448 - DNA, 17 bp, Homo sapiens
cctcctgctgagctgcc

SEQ ID NO: 5678449 - DNA, 18 bp, Homo sapiens
cctcctgctgagctgccc

SEQ ID NO: 5678450 - DNA, 23 bp, Homo sapiens
cctcctgctgcctaataaagaga

SEQ ID NO: 5678451 - DNA, 15 bp, Homo sapiens
cctcctgctgctcac

SEQ ID NO: 5678452 - DNA, 16 bp, Homo sapiens
cctcctgctgctcact

SEQ ID NO: 5678453 - DNA, 19 bp, Homo sapiens
cctcctgctgctcactccc

SEQ ID NO: 5678454 - DNA, 12 bp, Homo sapiens
cctcctgctggg

SEQ ID NO: 5678455 - DNA, 11 bp, Homo sapiens
cctcctgctgt

SEQ ID NO: 5678456 - DNA, 20 bp, Homo sapiens
cctcctgctgtagtcctttc

SEQ ID NO: 5678457 - DNA, 18 bp, Homo sapiens
cctcctgctttgggaaga

SEQ ID NO: 5678458 - DNA, 22 bp, Homo sapiens
cctcctggaatcagtatttcct

SEQ ID NO: 5678459 - DNA, 21 bp, Homo sapiens
cctcctggacattttttcagt

SEQ ID NO: 5678460 - DNA, 18 bp, Homo sapiens
cctcctggactcccctcc

SEQ ID NO: 5678461 - DNA, 22 bp, Homo sapiens
cctcctggagcagcagctgagg

SEQ ID NO: 5678462 - DNA, 20 bp, Homo sapiens
cctcctggagctctgtgggt

SEQ ID NO: 5678463 - DNA, 16 bp, Homo sapiens
cctcctggccagacgc

SEQ ID NO: 5678464 - DNA, 17 bp, Homo sapiens
cctcctggccagacgct

SEQ ID NO: 5678465 - DNA, 16 bp, Homo sapiens
cctcctggccggggcc

SEQ ID NO: 5678466 - DNA, 21 bp, Homo sapiens
cctcctggccggggcccctca

SEQ ID NO: 5678467 - DNA, 15 bp, Homo sapiens
cctcctggcctcaga

SEQ ID NO: 5678468 - DNA, 19 bp, Homo sapiens
cctcctggcctcagactgc

SEQ ID NO: 5678469 - DNA, 21 bp, Homo sapiens
cctcctggcctcagactgcac

SEQ ID NO: 5678470 - DNA, 14 bp, Homo sapiens
cctcctggcctgag

SEQ ID NO: 5678471 - DNA, 16 bp, Homo sapiens
cctcctggcctgagcg

SEQ ID NO: 5678472 - DNA, 17 bp, Homo sapiens
cctcctggctcacagcc

SEQ ID NO: 5678473 - DNA, 19 bp, Homo sapiens
cctcctggctcacagccac

SEQ ID NO: 5678474 - DNA, 15 bp, Homo sapiens
cctcctggctcaggc

SEQ ID NO: 5678475 - DNA, 20 bp, Homo sapiens
cctcctggctcaggcccagc

SEQ ID NO: 5678476 - DNA, 21 bp, Homo sapiens
cctcctggctgtgacacctgg

SEQ ID NO: 5678477 - DNA, 23 bp, Homo sapiens
cctcctgggaaggccacctccca

SEQ ID NO: 5678478 - DNA, 17 bp, Homo sapiens
cctcctgggaccatgga

SEQ ID NO: 5678479 - DNA, 19 bp, Homo sapiens
cctcctgggcaccccaggc

SEQ ID NO: 5678480 - DNA, 20 bp, Homo sapiens
cctcctgggcatgtttgtct

SEQ ID NO: 5678481 - DNA, 17 bp, Homo sapiens
cctcctgggcccaggca

SEQ ID NO: 5678482 - DNA, 21 bp, Homo sapiens
cctcctgggcccaggcagcac

SEQ ID NO: 5678483 - DNA, 15 bp, Homo sapiens
cctcctgggccctgg

SEQ ID NO: 5678484 - DNA, 18 bp, Homo sapiens
cctcctgggccctgggct

SEQ ID NO: 5678485 - DNA, 13 bp, Homo sapiens
cctcctgggctaa

SEQ ID NO: 5678486 - DNA, 14 bp, Homo sapiens
cctcctgggctcca

SEQ ID NO: 5678487 - DNA, 14 bp, Homo sapiens
cctcctggggccag

SEQ ID NO: 5678488 - DNA, 15 bp, Homo sapiens
cctcctggggccagg

SEQ ID NO: 5678489 - DNA, 15 bp, Homo sapiens
cctcctgggggccca

SEQ ID NO: 5678490 - DNA, 17 bp, Homo sapiens
cctcctgggggctggct

SEQ ID NO: 5678491 - DNA, 18 bp, Homo sapiens
cctcctgggggctggctc

SEQ ID NO: 5678492 - DNA, 19 bp, Homo sapiens
cctcctgggggctggctcc

SEQ ID NO: 5678493 - DNA, 12 bp, Homo sapiens
cctcctgggtgc

SEQ ID NO: 5678494 - DNA, 20 bp, Homo sapiens
cctcctgggttcacatgatt

SEQ ID NO: 5678495 - DNA, 12 bp, Homo sapiens
cctcctggtcct

SEQ ID NO: 5678496 - DNA, 13 bp, Homo sapiens
cctcctggtcctg

SEQ ID NO: 5678497 - DNA, 15 bp, Homo sapiens
cctcctggtcctgga

SEQ ID NO: 5678498 - DNA, 20 bp, Homo sapiens
cctcctggtcctggacacct

SEQ ID NO: 5678499 - DNA, 22 bp, Homo sapiens
cctcctggtcctggacacctcc

SEQ ID NO: 5678500 - DNA, 17 bp, Homo sapiens
cctcctggtttcctttc

SEQ ID NO: 5678501 - DNA, 17 bp, Homo sapiens
cctcctgtacctcagtg

SEQ ID NO: 5678502 - DNA, 19 bp, Homo sapiens
cctcctgtacctcagtgga

SEQ ID NO: 5678503 - DNA, 12 bp, Homo sapiens
cctcctgtcact

SEQ ID NO: 5678504 - DNA, 17 bp, Homo sapiens
cctcctgtcactcactg

SEQ ID NO: 5678505 - DNA, 21 bp, Homo sapiens
cctcctgtctaatttgcacct

SEQ ID NO: 5678506 - DNA, 19 bp, Homo sapiens
cctcctgtcttcccagggt

SEQ ID NO: 5678507 - DNA, 11 bp, Homo sapiens
cctcctgtgcc

SEQ ID NO: 5678508 - DNA, 12 bp, Homo sapiens
cctcctgtgcct

SEQ ID NO: 5678509 - DNA, 17 bp, Homo sapiens
cctcctgtgcctggccc

SEQ ID NO: 5678510 - DNA, 19 bp, Homo sapiens
cctcctgtgcctggcccca

SEQ ID NO: 5678511 - DNA, 12 bp, Homo sapiens
cctcctgtgcta

SEQ ID NO: 5678512 - DNA, 16 bp, Homo sapiens
cctcctgtgctatttg

SEQ ID NO: 5678513 - DNA, 17 bp, Homo sapiens
cctcctgtgctatttgt

SEQ ID NO: 5678514 - DNA, 21 bp, Homo sapiens
cctcctgtgctcagccctgag

SEQ ID NO: 5678515 - DNA, 19 bp, Homo sapiens
cctcctgtggaacccagca

SEQ ID NO: 5678516 - DNA, 20 bp, Homo sapiens
cctcctgtggaacccagcag

SEQ ID NO: 5678517 - DNA, 14 bp, Homo sapiens
cctcctgtggcctg

SEQ ID NO: 5678518 - DNA, 18 bp, Homo sapiens
cctcctgtggcctgccag

SEQ ID NO: 5678519 - DNA, 18 bp, Homo sapiens
cctcctgtgtactgtgtc

SEQ ID NO: 5678520 - DNA, 12 bp, Homo sapiens
cctcctgtgtga

SEQ ID NO: 5678521 - DNA, 20 bp, Homo sapiens
cctcctgtgtgtctgcagac

SEQ ID NO: 5678522 - DNA, 13 bp, Homo sapiens
cctcctgtgtgtg

SEQ ID NO: 5678523 - DNA, 15 bp, Homo sapiens
cctcctgtgtgtgcg

SEQ ID NO: 5678524 - DNA, 18 bp, Homo sapiens
cctcctgttcctgccttc

SEQ ID NO: 5678525 - DNA, 14 bp, Homo sapiens
cctcctgttctgaa

SEQ ID NO: 5678526 - DNA, 16 bp, Homo sapiens
cctcctgttctgccca

SEQ ID NO: 5678527 - DNA, 16 bp, Homo sapiens
cctcctgttgcaccca

SEQ ID NO: 5678528 - DNA, 22 bp, Homo sapiens
cctcctgttgcacccagccctg

SEQ ID NO: 5678529 - DNA, 16 bp, Homo sapiens
cctcctgttgccacac

SEQ ID NO: 5678530 - DNA, 18 bp, Homo sapiens
cctcctgttttctccctc

SEQ ID NO: 5678531 - DNA, 19 bp, Homo sapiens
cctcctgttttctccctct

SEQ ID NO: 5678532 - DNA, 13 bp, Homo sapiens
cctccttacatta

SEQ ID NO: 5678533 - DNA, 16 bp, Homo sapiens
cctccttacctggagt

SEQ ID NO: 5678534 - DNA, 15 bp, Homo sapiens
cctccttagaaaaga

SEQ ID NO: 5678535 - DNA, 19 bp, Homo sapiens
cctccttaggagtggggtt

SEQ ID NO: 5678536 - DNA, 16 bp, Homo sapiens
cctccttataagccca

SEQ ID NO: 5678537 - DNA, 16 bp, Homo sapiens
cctccttcatttcagc

SEQ ID NO: 5678538 - DNA, 18 bp, Homo sapiens
cctccttccacctccctc

SEQ ID NO: 5678539 - DNA, 19 bp, Homo sapiens
cctccttccacctccctcc

SEQ ID NO: 5678540 - DNA, 22 bp, Homo sapiens
cctccttccagatgcccgagca

SEQ ID NO: 5678541 - DNA, 16 bp, Homo sapiens
cctccttccagcactg

SEQ ID NO: 5678542 - DNA, 19 bp, Homo sapiens
cctccttccaggccccagg

SEQ ID NO: 5678543 - DNA, 14 bp, Homo sapiens
cctccttcccaaag

SEQ ID NO: 5678544 - DNA, 14 bp, Homo sapiens
cctccttcccagct

SEQ ID NO: 5678545 - DNA, 18 bp, Homo sapiens
cctccttcccagctgccc

SEQ ID NO: 5678546 - DNA, 16 bp, Homo sapiens
cctccttcccagggac

SEQ ID NO: 5678547 - DNA, 17 bp, Homo sapiens
cctccttcccagggacc

SEQ ID NO: 5678548 - DNA, 21 bp, Homo sapiens
cctccttccccaccccataag

SEQ ID NO: 5678549 - DNA, 19 bp, Homo sapiens
cctccttccccagacccag

SEQ ID NO: 5678550 - DNA, 20 bp, Homo sapiens
cctccttccccagacccaga

SEQ ID NO: 5678551 - DNA, 15 bp, Homo sapiens
cctccttccccccat

SEQ ID NO: 5678552 - DNA, 11 bp, Homo sapiens
cctccttccct

SEQ ID NO: 5678553 - DNA, 15 bp, Homo sapiens
cctccttccctctct

SEQ ID NO: 5678554 - DNA, 20 bp, Homo sapiens
cctccttccctctctggaga

SEQ ID NO: 5678555 - DNA, 20 bp, Homo sapiens
cctccttccctgtgtctttt

SEQ ID NO: 5678556 - DNA, 22 bp, Homo sapiens
cctccttcccttctctccttcc

SEQ ID NO: 5678557 - DNA, 18 bp, Homo sapiens
cctccttcctcatccttc

SEQ ID NO: 5678558 - DNA, 11 bp, Homo sapiens
cctccttcctg

SEQ ID NO: 5678559 - DNA, 23 bp, Homo sapiens
cctccttcctggcgggggtgggc

SEQ ID NO: 5678560 - DNA, 14 bp, Homo sapiens
cctccttcctggga

SEQ ID NO: 5678561 - DNA, 15 bp, Homo sapiens
cctccttcctgggac

SEQ ID NO: 5678562 - DNA, 20 bp, Homo sapiens
cctccttccttgaccagcag

SEQ ID NO: 5678563 - DNA, 20 bp, Homo sapiens
cctccttccttgctgtccta

SEQ ID NO: 5678564 - DNA, 15 bp, Homo sapiens
cctccttctattttc

SEQ ID NO: 5678565 - DNA, 14 bp, Homo sapiens
cctccttctcccct

SEQ ID NO: 5678566 - DNA, 20 bp, Homo sapiens
cctccttctcccctccagac

SEQ ID NO: 5678567 - DNA, 21 bp, Homo sapiens
cctccttctcccctccagacc

SEQ ID NO: 5678568 - DNA, 21 bp, Homo sapiens
cctccttctcccctgccggtg

SEQ ID NO: 5678569 - DNA, 13 bp, Homo sapiens
cctccttctcctt

SEQ ID NO: 5678570 - DNA, 23 bp, Homo sapiens
cctccttctctgcccccagcctc

SEQ ID NO: 5678571 - DNA, 15 bp, Homo sapiens
cctccttctctgtct

SEQ ID NO: 5678572 - DNA, 17 bp, Homo sapiens
cctccttctctgtctca

SEQ ID NO: 5678573 - DNA, 22 bp, Homo sapiens
cctccttctgagctcctgtccc

SEQ ID NO: 5678574 - DNA, 12 bp, Homo sapiens
cctccttctgca

SEQ ID NO: 5678575 - DNA, 22 bp, Homo sapiens
cctccttctgcagtcagactga

SEQ ID NO: 5678576 - DNA, 17 bp, Homo sapiens
cctccttcttgccctga

SEQ ID NO: 5678577 - DNA, 14 bp, Homo sapiens
cctccttgagactg

SEQ ID NO: 5678578 - DNA, 11 bp, Homo sapiens
cctccttgcca

SEQ ID NO: 5678579 - DNA, 12 bp, Homo sapiens
cctccttgccac

SEQ ID NO: 5678580 - DNA, 13 bp, Homo sapiens
cctccttgccacc

SEQ ID NO: 5678581 - DNA, 18 bp, Homo sapiens
cctccttgccaccccccg

SEQ ID NO: 5678582 - DNA, 14 bp, Homo sapiens
cctccttgccagcc

SEQ ID NO: 5678583 - DNA, 12 bp, Homo sapiens
cctccttgccta

SEQ ID NO: 5678584 - DNA, 13 bp, Homo sapiens
cctccttgcctag

SEQ ID NO: 5678585 - DNA, 13 bp, Homo sapiens
cctccttgcctgg

SEQ ID NO: 5678586 - DNA, 15 bp, Homo sapiens
cctccttgctgaccc

SEQ ID NO: 5678587 - DNA, 19 bp, Homo sapiens
cctccttgctgaccccagg

SEQ ID NO: 5678588 - DNA, 13 bp, Homo sapiens
cctccttgctgat

SEQ ID NO: 5678589 - DNA, 17 bp, Homo sapiens
cctccttgcttgttaca

SEQ ID NO: 5678590 - DNA, 19 bp, Homo sapiens
cctccttggccaccagacc

SEQ ID NO: 5678591 - DNA, 22 bp, Homo sapiens
cctccttggcggcaaaagccca

SEQ ID NO: 5678592 - DNA, 15 bp, Homo sapiens
cctccttgggcaggg

SEQ ID NO: 5678593 - DNA, 17 bp, Homo sapiens
cctccttgggcagggtc

SEQ ID NO: 5678594 - DNA, 20 bp, Homo sapiens
cctccttgggcagggtctct

SEQ ID NO: 5678595 - DNA, 17 bp, Homo sapiens
cctcctttaccctcatc

SEQ ID NO: 5678596 - DNA, 23 bp, Homo sapiens
cctcctttaccgaggacagcctg

SEQ ID NO: 5678597 - DNA, 19 bp, Homo sapiens
cctcctttagtaaaactcc

SEQ ID NO: 5678598 - DNA, 22 bp, Homo sapiens
cctcctttcattaccctacaga

SEQ ID NO: 5678599 - DNA, 15 bp, Homo sapiens
cctcctttccaaata

SEQ ID NO: 5678600 - DNA, 18 bp, Homo sapiens
cctcctttcccctttctc

SEQ ID NO: 5678601 - DNA, 19 bp, Homo sapiens
cctcctttcctatcttcct

SEQ ID NO: 5678602 - DNA, 15 bp, Homo sapiens
cctcctttcctcctc

SEQ ID NO: 5678603 - DNA, 18 bp, Homo sapiens
cctcctttcctcctctga

SEQ ID NO: 5678604 - DNA, 15 bp, Homo sapiens
cctcctttctctgta

SEQ ID NO: 5678605 - DNA, 16 bp, Homo sapiens
cctcctttctcttctc

SEQ ID NO: 5678606 - DNA, 14 bp, Homo sapiens
cctcctttctgtgc

SEQ ID NO: 5678607 - DNA, 16 bp, Homo sapiens
cctcctttctgtgccc

SEQ ID NO: 5678608 - DNA, 19 bp, Homo sapiens
cctcctttgcctaggaggc

SEQ ID NO: 5678609 - DNA, 13 bp, Homo sapiens
cctcctttgtctt

SEQ ID NO: 5678610 - DNA, 20 bp, Homo sapiens
cctcctttgtgaggaagccg

SEQ ID NO: 5678611 - DNA, 17 bp, Homo sapiens
cctcctttgtttaataa

SEQ ID NO: 5678612 - DNA, 12 bp, Homo sapiens
cctccttttaaa

SEQ ID NO: 5678613 - DNA, 21 bp, Homo sapiens
cctccttttacagaattagaa

SEQ ID NO: 5678614 - DNA, 19 bp, Homo sapiens
cctccttttcactttattg

SEQ ID NO: 5678615 - DNA, 17 bp, Homo sapiens
cctccttttcttctagc

SEQ ID NO: 5678616 - DNA, 21 bp, Homo sapiens
cctcctttttaagggtttttt

SEQ ID NO: 5678617 - DNA, 15 bp, Homo sapiens
cctcgaaccaaggca

SEQ ID NO: 5678618 - DNA, 15 bp, Homo sapiens
cctcgaacccacact

SEQ ID NO: 5678619 - DNA, 15 bp, Homo sapiens
cctcgaacccactcc

SEQ ID NO: 5678620 - DNA, 14 bp, Homo sapiens
cctcgaactcctgg

SEQ ID NO: 5678621 - DNA, 21 bp, Homo sapiens
cctcgaagctgttctctgctt

SEQ ID NO: 5678622 - DNA, 19 bp, Homo sapiens
cctcgaatgtgtgggccca

SEQ ID NO: 5678623 - DNA, 16 bp, Homo sapiens
cctcgaattctcagac

SEQ ID NO: 5678624 - DNA, 20 bp, Homo sapiens
cctcgaattttatctgtgga

SEQ ID NO: 5678625 - DNA, 21 bp, Homo sapiens
cctcgaattttatctgtggag

SEQ ID NO: 5678626 - DNA, 17 bp, Homo sapiens
cctcgacagcgcccctg

SEQ ID NO: 5678627 - DNA, 14 bp, Homo sapiens
cctcgacagctctc

SEQ ID NO: 5678628 - DNA, 18 bp, Homo sapiens
cctcgacagctctctggg

SEQ ID NO: 5678629 - DNA, 15 bp, Homo sapiens
cctcgacatcactgt

SEQ ID NO: 5678630 - DNA, 14 bp, Homo sapiens
cctcgaccagaatc

SEQ ID NO: 5678631 - DNA, 22 bp, Homo sapiens
cctcgacctccccacccgctcc

SEQ ID NO: 5678632 - DNA, 15 bp, Homo sapiens
cctcgacctccctgg

SEQ ID NO: 5678633 - DNA, 17 bp, Homo sapiens
cctcgacctccctggct

SEQ ID NO: 5678634 - DNA, 19 bp, Homo sapiens
cctcgacctccctggcttg

SEQ ID NO: 5678635 - DNA, 15 bp, Homo sapiens
cctcgacgtcccttg

SEQ ID NO: 5678636 - DNA, 15 bp, Homo sapiens
cctcgactcagcacc

SEQ ID NO: 5678637 - DNA, 12 bp, Homo sapiens
cctcgagagcct

SEQ ID NO: 5678638 - DNA, 13 bp, Homo sapiens
cctcgagagcctt

SEQ ID NO: 5678639 - DNA, 13 bp, Homo sapiens
cctcgagaggcac

SEQ ID NO: 5678640 - DNA, 15 bp, Homo sapiens
cctcgagaggcacct

SEQ ID NO: 5678641 - DNA, 15 bp, Homo sapiens
cctcgagccatagag

SEQ ID NO: 5678642 - DNA, 18 bp, Homo sapiens
cctcgagccatagagcct

SEQ ID NO: 5678643 - DNA, 21 bp, Homo sapiens
cctcgagctctgtagcctggt

SEQ ID NO: 5678644 - DNA, 13 bp, Homo sapiens
cctcgaggcaccg

SEQ ID NO: 5678645 - DNA, 15 bp, Homo sapiens
cctcgaggcaccggc

SEQ ID NO: 5678646 - DNA, 14 bp, Homo sapiens
cctcgaggcctaca

SEQ ID NO: 5678647 - DNA, 16 bp, Homo sapiens
cctcgaggcctacaga

SEQ ID NO: 5678648 - DNA, 22 bp, Homo sapiens
cctcgaggcctacagaggaggc

SEQ ID NO: 5678649 - DNA, 24 bp, Homo sapiens
cctcgaggcctacagaggaggcct

SEQ ID NO: 5678650 - DNA, 13 bp, Homo sapiens
cctcgaggctggt

SEQ ID NO: 5678651 - DNA, 15 bp, Homo sapiens
cctcgaggctggtgg

SEQ ID NO: 5678652 - DNA, 15 bp, Homo sapiens
cctcgagggccgcct

SEQ ID NO: 5678653 - DNA, 18 bp, Homo sapiens
cctcgaggggcccaggga

SEQ ID NO: 5678654 - DNA, 23 bp, Homo sapiens
cctcgaggtgccttcttcagggc

SEQ ID NO: 5678655 - DNA, 18 bp, Homo sapiens
cctcgagtactgtgggca

SEQ ID NO: 5678656 - DNA, 17 bp, Homo sapiens
cctcgagtccccccacc

SEQ ID NO: 5678657 - DNA, 18 bp, Homo sapiens
cctcgagtccccccaccc

SEQ ID NO: 5678658 - DNA, 20 bp, Homo sapiens
cctcgagtccccccacccct

SEQ ID NO: 5678659 - DNA, 21 bp, Homo sapiens
cctcgagtggcgagtccagac

SEQ ID NO: 5678660 - DNA, 23 bp, Homo sapiens
cctcgatgtcctcctctgtgaaa

SEQ ID NO: 5678661 - DNA, 23 bp, Homo sapiens
cctcgatgttcatggaattggtt

SEQ ID NO: 5678662 - DNA, 13 bp, Homo sapiens
cctcgcacacagg

SEQ ID NO: 5678663 - DNA, 16 bp, Homo sapiens
cctcgcacacagggct

SEQ ID NO: 5678664 - DNA, 19 bp, Homo sapiens
cctcgcacacagggctcac

SEQ ID NO: 5678665 - DNA, 15 bp, Homo sapiens
cctcgcacaggccct

SEQ ID NO: 5678666 - DNA, 21 bp, Homo sapiens
cctcgcacagggcatgcctgg

SEQ ID NO: 5678667 - DNA, 22 bp, Homo sapiens
cctcgcacttgcagaggagccc

SEQ ID NO: 5678668 - DNA, 14 bp, Homo sapiens
cctcgcagagaggc

SEQ ID NO: 5678669 - DNA, 18 bp, Homo sapiens
cctcgcagccacacctag

SEQ ID NO: 5678670 - DNA, 22 bp, Homo sapiens
cctcgcaggcctccctgccagt

SEQ ID NO: 5678671 - DNA, 20 bp, Homo sapiens
cctcgcaggtctcagcccgg

SEQ ID NO: 5678672 - DNA, 12 bp, Homo sapiens
cctcgccagctt

SEQ ID NO: 5678673 - DNA, 17 bp, Homo sapiens
cctcgccagcttctcct

SEQ ID NO: 5678674 - DNA, 18 bp, Homo sapiens
cctcgcccagtcccagca

SEQ ID NO: 5678675 - DNA, 16 bp, Homo sapiens
cctcgccccagccaag

SEQ ID NO: 5678676 - DNA, 14 bp, Homo sapiens
cctcgcccccacca

SEQ ID NO: 5678677 - DNA, 16 bp, Homo sapiens
cctcgcccccaccagt

SEQ ID NO: 5678678 - DNA, 17 bp, Homo sapiens
cctcgccccccgcccgg

SEQ ID NO: 5678679 - DNA, 17 bp, Homo sapiens
cctcgcccctccagtgt

SEQ ID NO: 5678680 - DNA, 12 bp, Homo sapiens
cctcgccctggg

SEQ ID NO: 5678681 - DNA, 13 bp, Homo sapiens
cctcgccctgggt

SEQ ID NO: 5678682 - DNA, 16 bp, Homo sapiens
cctcgccctgtccctc

SEQ ID NO: 5678683 - DNA, 20 bp, Homo sapiens
cctcgccctgtccctcccac

SEQ ID NO: 5678684 - DNA, 21 bp, Homo sapiens
cctcgccctgtccctcccact

SEQ ID NO: 5678685 - DNA, 15 bp, Homo sapiens
cctcgccctgtgagg

SEQ ID NO: 5678686 - DNA, 15 bp, Homo sapiens
cctcgccgagctgtc

SEQ ID NO: 5678687 - DNA, 18 bp, Homo sapiens
cctcgccgtccctcccag

SEQ ID NO: 5678688 - DNA, 21 bp, Homo sapiens
cctcgccgtccctcccaggtc

SEQ ID NO: 5678689 - DNA, 17 bp, Homo sapiens
cctcgcctaggcctgtg

SEQ ID NO: 5678690 - DNA, 15 bp, Homo sapiens
cctcgcctccccacc

SEQ ID NO: 5678691 - DNA, 14 bp, Homo sapiens
cctcgcctcctcct

SEQ ID NO: 5678692 - DNA, 19 bp, Homo sapiens
cctcgcctcctcctcctgc

SEQ ID NO: 5678693 - DNA, 14 bp, Homo sapiens
cctcgcctgccctc

SEQ ID NO: 5678694 - DNA, 15 bp, Homo sapiens
cctcgcctgccctcc

SEQ ID NO: 5678695 - DNA, 13 bp, Homo sapiens
cctcgcctgcctt

SEQ ID NO: 5678696 - DNA, 13 bp, Homo sapiens
cctcgcctggcct

SEQ ID NO: 5678697 - DNA, 15 bp, Homo sapiens
cctcgcctggcctga

SEQ ID NO: 5678698 - DNA, 16 bp, Homo sapiens
cctcgcctggcctgag

SEQ ID NO: 5678699 - DNA, 14 bp, Homo sapiens
cctcgcctgggccc

SEQ ID NO: 5678700 - DNA, 16 bp, Homo sapiens
cctcgcctgggcccag

SEQ ID NO: 5678701 - DNA, 20 bp, Homo sapiens
cctcgcctgggcccaggctc

SEQ ID NO: 5678702 - DNA, 13 bp, Homo sapiens
cctcgcctgtcac

SEQ ID NO: 5678703 - DNA, 21 bp, Homo sapiens
cctcgcctgtggagctcagcc

SEQ ID NO: 5678704 - DNA, 22 bp, Homo sapiens
cctcgcctgtggagctcagccc

SEQ ID NO: 5678705 - DNA, 12 bp, Homo sapiens
cctcgcgcccct

SEQ ID NO: 5678706 - DNA, 13 bp, Homo sapiens
cctcgcgcccctg

SEQ ID NO: 5678707 - DNA, 14 bp, Homo sapiens
cctcgcgcccctgt

SEQ ID NO: 5678708 - DNA, 17 bp, Homo sapiens
cctcgcgcttgctggcc

SEQ ID NO: 5678709 - DNA, 22 bp, Homo sapiens
cctcgcgggtgtcacattcctg

SEQ ID NO: 5678710 - DNA, 19 bp, Homo sapiens
cctcgctcaccgctggccc

SEQ ID NO: 5678711 - DNA, 18 bp, Homo sapiens
cctcgctccccactctgc

SEQ ID NO: 5678712 - DNA, 14 bp, Homo sapiens
cctcgctcccctct

SEQ ID NO: 5678713 - DNA, 18 bp, Homo sapiens
cctcgctcccctctggaa

SEQ ID NO: 5678714 - DNA, 16 bp, Homo sapiens
cctcgctcctccttcc

SEQ ID NO: 5678715 - DNA, 15 bp, Homo sapiens
cctcgctctctgtct

SEQ ID NO: 5678716 - DNA, 14 bp, Homo sapiens
cctcgctctgggat

SEQ ID NO: 5678717 - DNA, 12 bp, Homo sapiens
cctcgctctgtt

SEQ ID NO: 5678718 - DNA, 16 bp, Homo sapiens
cctcgctgccacccac

SEQ ID NO: 5678719 - DNA, 18 bp, Homo sapiens
cctcgctgccacccaccc

SEQ ID NO: 5678720 - DNA, 13 bp, Homo sapiens
cctcgctgccagc

SEQ ID NO: 5678721 - DNA, 14 bp, Homo sapiens
cctcgctgccagct

SEQ ID NO: 5678722 - DNA, 19 bp, Homo sapiens
cctcgctgccagctctgta

SEQ ID NO: 5678723 - DNA, 16 bp, Homo sapiens
cctcgctgcgtctcca

SEQ ID NO: 5678724 - DNA, 12 bp, Homo sapiens
cctcgctgctgc

SEQ ID NO: 5678725 - DNA, 13 bp, Homo sapiens
cctcgctgctgct

SEQ ID NO: 5678726 - DNA, 20 bp, Homo sapiens
cctcgctggcccccactggc

SEQ ID NO: 5678727 - DNA, 22 bp, Homo sapiens
cctcgctggcccccactggctg

SEQ ID NO: 5678728 - DNA, 23 bp, Homo sapiens
cctcgctggcccccactggctgt

SEQ ID NO: 5678729 - DNA, 21 bp, Homo sapiens
cctcgctgtgccaccacccct

SEQ ID NO: 5678730 - DNA, 23 bp, Homo sapiens
cctcgctgttggagcaaaccatt

SEQ ID NO: 5678731 - DNA, 18 bp, Homo sapiens
cctcgcttcataggcaga

SEQ ID NO: 5678732 - DNA, 14 bp, Homo sapiens
cctcgcttctttca

SEQ ID NO: 5678733 - DNA, 12 bp, Homo sapiens
cctcgcttggac

SEQ ID NO: 5678734 - DNA, 23 bp, Homo sapiens
cctcggaaccgctcacctagagc

SEQ ID NO: 5678735 - DNA, 20 bp, Homo sapiens
cctcggacaccatcttggga

SEQ ID NO: 5678736 - DNA, 18 bp, Homo sapiens
cctcggacacccagggtc

SEQ ID NO: 5678737 - DNA, 14 bp, Homo sapiens
cctcggacagagcc

SEQ ID NO: 5678738 - DNA, 15 bp, Homo sapiens
cctcggacagagccc

SEQ ID NO: 5678739 - DNA, 18 bp, Homo sapiens
cctcggacagagcccccc

SEQ ID NO: 5678740 - DNA, 20 bp, Homo sapiens
cctcggaccccactccggcc

SEQ ID NO: 5678741 - DNA, 18 bp, Homo sapiens
cctcggactgtgtgcagg

SEQ ID NO: 5678742 - DNA, 21 bp, Homo sapiens
cctcggactgtgtgcaggttg

SEQ ID NO: 5678743 - DNA, 20 bp, Homo sapiens
cctcggagacgggaccctgc

SEQ ID NO: 5678744 - DNA, 17 bp, Homo sapiens
cctcggagagcagcagc

SEQ ID NO: 5678745 - DNA, 19 bp, Homo sapiens
cctcggagagcagcagcac

SEQ ID NO: 5678746 - DNA, 13 bp, Homo sapiens
cctcggagcctca

SEQ ID NO: 5678747 - DNA, 14 bp, Homo sapiens
cctcggagcctcat

SEQ ID NO: 5678748 - DNA, 12 bp, Homo sapiens
cctcggagcctg

SEQ ID NO: 5678749 - DNA, 18 bp, Homo sapiens
cctcggaggctcctccct

SEQ ID NO: 5678750 - DNA, 19 bp, Homo sapiens
cctcggaggctcctccctc

SEQ ID NO: 5678751 - DNA, 22 bp, Homo sapiens
cctcggaggctcctccctctgc

SEQ ID NO: 5678752 - DNA, 22 bp, Homo sapiens
cctcggagggatggagaaagaa

SEQ ID NO: 5678753 - DNA, 14 bp, Homo sapiens
cctcggagtgtggc

SEQ ID NO: 5678754 - DNA, 15 bp, Homo sapiens
cctcggatcagctga

SEQ ID NO: 5678755 - DNA, 20 bp, Homo sapiens
cctcggatcagctgagcctt

SEQ ID NO: 5678756 - DNA, 16 bp, Homo sapiens
cctcggatccccttcc

SEQ ID NO: 5678757 - DNA, 17 bp, Homo sapiens
cctcggatccccttcct

SEQ ID NO: 5678758 - DNA, 17 bp, Homo sapiens
cctcggcacacactgtg

SEQ ID NO: 5678759 - DNA, 20 bp, Homo sapiens
cctcggcagaactctctgtc

SEQ ID NO: 5678760 - DNA, 21 bp, Homo sapiens
cctcggcagaactctctgtct

SEQ ID NO: 5678761 - DNA, 13 bp, Homo sapiens
cctcggccagagc

SEQ ID NO: 5678762 - DNA, 17 bp, Homo sapiens
cctcggccagagctccc

SEQ ID NO: 5678763 - DNA, 21 bp, Homo sapiens
cctcggccagagctcccagga

SEQ ID NO: 5678764 - DNA, 22 bp, Homo sapiens
cctcggccattgaacactgcac

SEQ ID NO: 5678765 - DNA, 18 bp, Homo sapiens
cctcggcccatctgtcca

SEQ ID NO: 5678766 - DNA, 17 bp, Homo sapiens
cctcggcccctcaccac

SEQ ID NO: 5678767 - DNA, 17 bp, Homo sapiens
cctcggccctccctgcg

SEQ ID NO: 5678768 - DNA, 19 bp, Homo sapiens
cctcggccctgtagccctg

SEQ ID NO: 5678769 - DNA, 14 bp, Homo sapiens
cctcggcctcccaa

SEQ ID NO: 5678770 - DNA, 15 bp, Homo sapiens
cctcggcctccctag

SEQ ID NO: 5678771 - DNA, 12 bp, Homo sapiens
cctcggcctggc

SEQ ID NO: 5678772 - DNA, 16 bp, Homo sapiens
cctcggcctggctcct

SEQ ID NO: 5678773 - DNA, 20 bp, Homo sapiens
cctcggcctggctggccagg

SEQ ID NO: 5678774 - DNA, 16 bp, Homo sapiens
cctcggctcctgctgc

SEQ ID NO: 5678775 - DNA, 17 bp, Homo sapiens
cctcggctcctgctgca

SEQ ID NO: 5678776 - DNA, 18 bp, Homo sapiens
cctcggctcctgctgcac

SEQ ID NO: 5678777 - DNA, 19 bp, Homo sapiens
cctcggctcctgctgcacc

SEQ ID NO: 5678778 - DNA, 20 bp, Homo sapiens
cctcggctcctgctgcacca

SEQ ID NO: 5678779 - DNA, 22 bp, Homo sapiens
cctcggctcctgctgcaccaac

SEQ ID NO: 5678780 - DNA, 15 bp, Homo sapiens
cctcggctctggagg

SEQ ID NO: 5678781 - DNA, 18 bp, Homo sapiens
cctcggctggctcccctg

SEQ ID NO: 5678782 - DNA, 21 bp, Homo sapiens
cctcggctgtctcctgtcccc

SEQ ID NO: 5678783 - DNA, 14 bp, Homo sapiens
cctcggctgtgtgg

SEQ ID NO: 5678784 - DNA, 15 bp, Homo sapiens
cctcggctgtgtggg

SEQ ID NO: 5678785 - DNA, 15 bp, Homo sapiens
cctcggcttgtgggc

SEQ ID NO: 5678786 - DNA, 19 bp, Homo sapiens
cctcggcttttctcagctg

SEQ ID NO: 5678787 - DNA, 17 bp, Homo sapiens
cctcgggaacctcactc

SEQ ID NO: 5678788 - DNA, 17 bp, Homo sapiens
cctcgggaagcagccag

SEQ ID NO: 5678789 - DNA, 19 bp, Homo sapiens
cctcgggaagcagccagct

SEQ ID NO: 5678790 - DNA, 22 bp, Homo sapiens
cctcgggatgccgttctgttcc

SEQ ID NO: 5678791 - DNA, 23 bp, Homo sapiens
cctcgggatgccgttctgttcca

SEQ ID NO: 5678792 - DNA, 14 bp, Homo sapiens
cctcgggcaagggc

SEQ ID NO: 5678793 - DNA, 19 bp, Homo sapiens
cctcgggcccacctggcca

SEQ ID NO: 5678794 - DNA, 22 bp, Homo sapiens
cctcgggcccacctggccacct

SEQ ID NO: 5678795 - DNA, 14 bp, Homo sapiens
cctcgggcccagcc

SEQ ID NO: 5678796 - DNA, 15 bp, Homo sapiens
cctcgggcccagccc

SEQ ID NO: 5678797 - DNA, 17 bp, Homo sapiens
cctcgggcccagccccc

SEQ ID NO: 5678798 - DNA, 18 bp, Homo sapiens
cctcgggcccctgagcct

SEQ ID NO: 5678799 - DNA, 18 bp, Homo sapiens
cctcgggccgaggcccag

SEQ ID NO: 5678800 - DNA, 17 bp, Homo sapiens
cctcgggccgcctcctc

SEQ ID NO: 5678801 - DNA, 22 bp, Homo sapiens
cctcgggccgcctcctccagac

SEQ ID NO: 5678802 - DNA, 19 bp, Homo sapiens
cctcgggccgggcaccacc

SEQ ID NO: 5678803 - DNA, 14 bp, Homo sapiens
cctcgggcgcctgc

SEQ ID NO: 5678804 - DNA, 17 bp, Homo sapiens
cctcgggcgcctgcgct

SEQ ID NO: 5678805 - DNA, 18 bp, Homo sapiens
cctcgggcgcctgcgctc

SEQ ID NO: 5678806 - DNA, 12 bp, Homo sapiens
cctcggggagag

SEQ ID NO: 5678807 - DNA, 21 bp, Homo sapiens
cctcggggagcgttctaaata

SEQ ID NO: 5678808 - DNA, 18 bp, Homo sapiens
cctcggggatggggaggg

SEQ ID NO: 5678809 - DNA, 13 bp, Homo sapiens
cctcggggcaggg

SEQ ID NO: 5678810 - DNA, 19 bp, Homo sapiens
cctcggggggtcacaggcc

SEQ ID NO: 5678811 - DNA, 14 bp, Homo sapiens
cctcgggtctcctc

SEQ ID NO: 5678812 - DNA, 18 bp, Homo sapiens
cctcgggtctcctcactc

SEQ ID NO: 5678813 - DNA, 17 bp, Homo sapiens
cctcgggtggggctggt

SEQ ID NO: 5678814 - DNA, 21 bp, Homo sapiens
cctcggtaaaccgaggaccca

SEQ ID NO: 5678815 - DNA, 15 bp, Homo sapiens
cctcggtactcccat

SEQ ID NO: 5678816 - DNA, 16 bp, Homo sapiens
cctcggtagcagaggc

SEQ ID NO: 5678817 - DNA, 15 bp, Homo sapiens
cctcggtatctggct

SEQ ID NO: 5678818 - DNA, 17 bp, Homo sapiens
cctcggtatctggcttc

SEQ ID NO: 5678819 - DNA, 14 bp, Homo sapiens
cctcggtcagcacc

SEQ ID NO: 5678820 - DNA, 15 bp, Homo sapiens
cctcggtcagcgact

SEQ ID NO: 5678821 - DNA, 23 bp, Homo sapiens
cctcggtctcccaaagtgctggg

SEQ ID NO: 5678822 - DNA, 19 bp, Homo sapiens
cctcggtgcagagtgcaga

SEQ ID NO: 5678823 - DNA, 20 bp, Homo sapiens
cctcggtggcatttgctgaa

SEQ ID NO: 5678824 - DNA, 15 bp, Homo sapiens
cctcggtggccctga

SEQ ID NO: 5678825 - DNA, 22 bp, Homo sapiens
cctcggtggccctgactgtcag

SEQ ID NO: 5678826 - DNA, 13 bp, Homo sapiens
cctcggtggctct

SEQ ID NO: 5678827 - DNA, 14 bp, Homo sapiens
cctcggtggctctg

SEQ ID NO: 5678828 - DNA, 14 bp, Homo sapiens
cctcgtaccagcca

SEQ ID NO: 5678829 - DNA, 18 bp, Homo sapiens
cctcgtaccagccaggat

SEQ ID NO: 5678830 - DNA, 13 bp, Homo sapiens
cctcgtactcagg

SEQ ID NO: 5678831 - DNA, 15 bp, Homo sapiens
cctcgtactcaggag

SEQ ID NO: 5678832 - DNA, 16 bp, Homo sapiens
cctcgtactcaggagc

SEQ ID NO: 5678833 - DNA, 13 bp, Homo sapiens
cctcgtcaagagc

SEQ ID NO: 5678834 - DNA, 18 bp, Homo sapiens
cctcgtcaagagcatgca

SEQ ID NO: 5678835 - DNA, 22 bp, Homo sapiens
cctcgtcaagagcatgcacatg

SEQ ID NO: 5678836 - DNA, 14 bp, Homo sapiens
cctcgtccacaggg

SEQ ID NO: 5678837 - DNA, 21 bp, Homo sapiens
cctcgtccacaggggcaggcc

SEQ ID NO: 5678838 - DNA, 15 bp, Homo sapiens
cctcgtcccatccag

SEQ ID NO: 5678839 - DNA, 17 bp, Homo sapiens
cctcgtcccctgcctca

SEQ ID NO: 5678840 - DNA, 23 bp, Homo sapiens
cctcgtcccgagggcgcctgggt

SEQ ID NO: 5678841 - DNA, 16 bp, Homo sapiens
cctcgtcccgttctcc

SEQ ID NO: 5678842 - DNA, 15 bp, Homo sapiens
cctcgtccctccctc

SEQ ID NO: 5678843 - DNA, 18 bp, Homo sapiens
cctcgtccctccctcact

SEQ ID NO: 5678844 - DNA, 16 bp, Homo sapiens
cctcgtcctccccctg

SEQ ID NO: 5678845 - DNA, 17 bp, Homo sapiens
cctcgtcctccccctgc

SEQ ID NO: 5678846 - DNA, 16 bp, Homo sapiens
cctcgtcctgtcccag

SEQ ID NO: 5678847 - DNA, 16 bp, Homo sapiens
cctcgtctccctggcc

SEQ ID NO: 5678848 - DNA, 19 bp, Homo sapiens
cctcgtctccctggccacc

SEQ ID NO: 5678849 - DNA, 20 bp, Homo sapiens
cctcgtctccctggtgcctc

SEQ ID NO: 5678850 - DNA, 22 bp, Homo sapiens
cctcgtctgtcccttccccttc

SEQ ID NO: 5678851 - DNA, 16 bp, Homo sapiens
cctcgtcttcagctgc

SEQ ID NO: 5678852 - DNA, 21 bp, Homo sapiens
cctcgtctttgcttgtcctgc

SEQ ID NO: 5678853 - DNA, 16 bp, Homo sapiens
cctcgtgacctacagg

SEQ ID NO: 5678854 - DNA, 16 bp, Homo sapiens
cctcgtgatgggcccg

SEQ ID NO: 5678855 - DNA, 17 bp, Homo sapiens
cctcgtgcagagctggg

SEQ ID NO: 5678856 - DNA, 13 bp, Homo sapiens
cctcgtgccagca

SEQ ID NO: 5678857 - DNA, 18 bp, Homo sapiens
cctcgtgccagcagcctc

SEQ ID NO: 5678858 - DNA, 19 bp, Homo sapiens
cctcgtgccagcagcctcg

SEQ ID NO: 5678859 - DNA, 13 bp, Homo sapiens
cctcgtgccagtc

SEQ ID NO: 5678860 - DNA, 19 bp, Homo sapiens
cctcgtgcctgggggagag

SEQ ID NO: 5678861 - DNA, 16 bp, Homo sapiens
cctcgtggagctcgcc

SEQ ID NO: 5678862 - DNA, 13 bp, Homo sapiens
cctcgtggccagc

SEQ ID NO: 5678863 - DNA, 18 bp, Homo sapiens
cctcgtggccagcccggc

SEQ ID NO: 5678864 - DNA, 19 bp, Homo sapiens
cctcgtggccttccccagc

SEQ ID NO: 5678865 - DNA, 19 bp, Homo sapiens
cctcgtggtccccaacagc

SEQ ID NO: 5678866 - DNA, 13 bp, Homo sapiens
cctcgtgtccaga

SEQ ID NO: 5678867 - DNA, 13 bp, Homo sapiens
cctcgtgtcctgc

SEQ ID NO: 5678868 - DNA, 15 bp, Homo sapiens
cctcgtgtcctgcta

SEQ ID NO: 5678869 - DNA, 18 bp, Homo sapiens
cctcgttactctcacctc

SEQ ID NO: 5678870 - DNA, 22 bp, Homo sapiens
cctcgttagagaatggcctgag

SEQ ID NO: 5678871 - DNA, 20 bp, Homo sapiens
cctcgttaggacaaggctgt

SEQ ID NO: 5678872 - DNA, 22 bp, Homo sapiens
cctcgttagggaagagaaacag

SEQ ID NO: 5678873 - DNA, 15 bp, Homo sapiens
cctcgttctctgggt

SEQ ID NO: 5678874 - DNA, 20 bp, Homo sapiens
cctcgttggaagaggaacag

SEQ ID NO: 5678875 - DNA, 16 bp, Homo sapiens
cctcgttggagagcag

SEQ ID NO: 5678876 - DNA, 14 bp, Homo sapiens
cctcgtttgtgttc

SEQ ID NO: 5678877 - DNA, 12 bp, Homo sapiens
cctctaaaccta

SEQ ID NO: 5678878 - DNA, 23 bp, Homo sapiens
cctctaaagcaataatggtccca

SEQ ID NO: 5678879 - DNA, 16 bp, Homo sapiens
cctctaaagcagaggc

SEQ ID NO: 5678880 - DNA, 18 bp, Homo sapiens
cctctaaagcagaggcaa

SEQ ID NO: 5678881 - DNA, 20 bp, Homo sapiens
cctctaacaccacactgacc

SEQ ID NO: 5678882 - DNA, 24 bp, Homo sapiens
cctctaacaccacactgaccacac

SEQ ID NO: 5678883 - DNA, 23 bp, Homo sapiens
cctctaacaggggctggtgggca

SEQ ID NO: 5678884 - DNA, 13 bp, Homo sapiens
cctctaacatttt

SEQ ID NO: 5678885 - DNA, 15 bp, Homo sapiens
cctctaacccagtgg

SEQ ID NO: 5678886 - DNA, 13 bp, Homo sapiens
cctctaaccccag

SEQ ID NO: 5678887 - DNA, 22 bp, Homo sapiens
cctctaacccccagtgccacag

SEQ ID NO: 5678888 - DNA, 20 bp, Homo sapiens
cctctaaccctcattgctgt

SEQ ID NO: 5678889 - DNA, 20 bp, Homo sapiens
cctctaacctcgccctctcc

SEQ ID NO: 5678890 - DNA, 18 bp, Homo sapiens
cctctaactcattcttca

SEQ ID NO: 5678891 - DNA, 16 bp, Homo sapiens
cctctaactccctcct

SEQ ID NO: 5678892 - DNA, 20 bp, Homo sapiens
cctctaagatcttgcctctt

SEQ ID NO: 5678893 - DNA, 17 bp, Homo sapiens
cctctaaggccaaggcc

SEQ ID NO: 5678894 - DNA, 18 bp, Homo sapiens
cctctaaggccaaggcct

SEQ ID NO: 5678895 - DNA, 19 bp, Homo sapiens
cctctaaggccaaggcctc

SEQ ID NO: 5678896 - DNA, 19 bp, Homo sapiens
cctctaaggttgggcaggg

SEQ ID NO: 5678897 - DNA, 17 bp, Homo sapiens
cctctaagtgctgctgt

SEQ ID NO: 5678898 - DNA, 18 bp, Homo sapiens
cctctaagtgctgctgtg

SEQ ID NO: 5678899 - DNA, 20 bp, Homo sapiens
cctctaagtgctgctgtgga

SEQ ID NO: 5678900 - DNA, 18 bp, Homo sapiens
cctctaataaacactgtt

SEQ ID NO: 5678901 - DNA, 23 bp, Homo sapiens
cctctaatagaggcagtgagact

SEQ ID NO: 5678902 - DNA, 18 bp, Homo sapiens
cctctaatctgagctgca

SEQ ID NO: 5678903 - DNA, 21 bp, Homo sapiens
cctctaatctgagctgcagcc

SEQ ID NO: 5678904 - DNA, 22 bp, Homo sapiens
cctctaatgctcacgctcccaa

SEQ ID NO: 5678905 - DNA, 15 bp, Homo sapiens
cctctaattaaaatg

SEQ ID NO: 5678906 - DNA, 21 bp, Homo sapiens
cctctaattaaaatgtgcagt

SEQ ID NO: 5678907 - DNA, 20 bp, Homo sapiens
cctctacacaggggccctgt

SEQ ID NO: 5678908 - DNA, 18 bp, Homo sapiens
cctctacagagcttccct

SEQ ID NO: 5678909 - DNA, 20 bp, Homo sapiens
cctctacagagcttccctga

SEQ ID NO: 5678910 - DNA, 18 bp, Homo sapiens
cctctacatggactcaga

SEQ ID NO: 5678911 - DNA, 21 bp, Homo sapiens
cctctaccagttggcagacag

SEQ ID NO: 5678912 - DNA, 15 bp, Homo sapiens
cctctaccccaattt

SEQ ID NO: 5678913 - DNA, 13 bp, Homo sapiens
cctctacggcccc

SEQ ID NO: 5678914 - DNA, 19 bp, Homo sapiens
cctctactaatttcctgct

SEQ ID NO: 5678915 - DNA, 20 bp, Homo sapiens
cctctactaatttcctgctg

SEQ ID NO: 5678916 - DNA, 21 bp, Homo sapiens
cctctactaatttcctgctga

SEQ ID NO: 5678917 - DNA, 20 bp, Homo sapiens
cctctactaggtctgctcct

SEQ ID NO: 5678918 - DNA, 22 bp, Homo sapiens
cctctactaggtctgctcctga

SEQ ID NO: 5678919 - DNA, 13 bp, Homo sapiens
cctctactcttcc

SEQ ID NO: 5678920 - DNA, 14 bp, Homo sapiens
cctctactcttcct

SEQ ID NO: 5678921 - DNA, 15 bp, Homo sapiens
cctctactcttcctg

SEQ ID NO: 5678922 - DNA, 14 bp, Homo sapiens
cctctactgggaag

SEQ ID NO: 5678923 - DNA, 14 bp, Homo sapiens
cctctactgggagc

SEQ ID NO: 5678924 - DNA, 14 bp, Homo sapiens
cctctactgttgca

SEQ ID NO: 5678925 - DNA, 16 bp, Homo sapiens
cctctactgttgcaca

SEQ ID NO: 5678926 - DNA, 16 bp, Homo sapiens
cctctactttccaggc

SEQ ID NO: 5678927 - DNA, 19 bp, Homo sapiens
cctctactttgattctgat

SEQ ID NO: 5678928 - DNA, 19 bp, Homo sapiens
cctctagaaatttttcaga

SEQ ID NO: 5678929 - DNA, 16 bp, Homo sapiens
cctctagaacacccac

SEQ ID NO: 5678930 - DNA, 18 bp, Homo sapiens
cctctagaacacccactg

SEQ ID NO: 5678931 - DNA, 20 bp, Homo sapiens
cctctagaacacccactggc

SEQ ID NO: 5678932 - DNA, 19 bp, Homo sapiens
cctctagaattttaagcct

SEQ ID NO: 5678933 - DNA, 14 bp, Homo sapiens
cctctagagccttc

SEQ ID NO: 5678934 - DNA, 14 bp, Homo sapiens
cctctagaggcaag

SEQ ID NO: 5678935 - DNA, 12 bp, Homo sapiens
cctctagccatc

SEQ ID NO: 5678936 - DNA, 14 bp, Homo sapiens
cctctagccatccc

SEQ ID NO: 5678937 - DNA, 22 bp, Homo sapiens
cctctagcccactccctgccta

SEQ ID NO: 5678938 - DNA, 18 bp, Homo sapiens
cctctagccctgcccgga

SEQ ID NO: 5678939 - DNA, 19 bp, Homo sapiens
cctctagctaccatttcaa

SEQ ID NO: 5678940 - DNA, 11 bp, Homo sapiens
cctctagctga

SEQ ID NO: 5678941 - DNA, 15 bp, Homo sapiens
cctctaggcaagcag

SEQ ID NO: 5678942 - DNA, 16 bp, Homo sapiens
cctctaggcaagcagg

SEQ ID NO: 5678943 - DNA, 23 bp, Homo sapiens
cctctaggcaagcaggacctggc

SEQ ID NO: 5678944 - DNA, 18 bp, Homo sapiens
cctctagggacccctcct

SEQ ID NO: 5678945 - DNA, 20 bp, Homo sapiens
cctctagggacccctcctcc

SEQ ID NO: 5678946 - DNA, 13 bp, Homo sapiens
cctctaggggcag

SEQ ID NO: 5678947 - DNA, 17 bp, Homo sapiens
cctctaggtaaccagtt

SEQ ID NO: 5678948 - DNA, 18 bp, Homo sapiens
cctctagtagtatattta

SEQ ID NO: 5678949 - DNA, 13 bp, Homo sapiens
cctctagtcagca

SEQ ID NO: 5678950 - DNA, 20 bp, Homo sapiens
cctctagtccccaaggcctc

SEQ ID NO: 5678951 - DNA, 15 bp, Homo sapiens
cctctagtgccctcc

SEQ ID NO: 5678952 - DNA, 17 bp, Homo sapiens
cctctagtgctactgct

SEQ ID NO: 5678953 - DNA, 23 bp, Homo sapiens
cctctagttgagtttctggcgcc

SEQ ID NO: 5678954 - DNA, 16 bp, Homo sapiens
cctctatacatctctc

SEQ ID NO: 5678955 - DNA, 18 bp, Homo sapiens
cctctatacatctctccc

SEQ ID NO: 5678956 - DNA, 21 bp, Homo sapiens
cctctatacatctctccccaa

SEQ ID NO: 5678957 - DNA, 17 bp, Homo sapiens
cctctatccctggccac

SEQ ID NO: 5678958 - DNA, 22 bp, Homo sapiens
cctctatccctggccacctgcc

SEQ ID NO: 5678959 - DNA, 23 bp, Homo sapiens
cctctatccctggccacctgcca

SEQ ID NO: 5678960 - DNA, 19 bp, Homo sapiens
cctctatgaactatggacg

SEQ ID NO: 5678961 - DNA, 16 bp, Homo sapiens
cctctatgccctgcag

SEQ ID NO: 5678962 - DNA, 18 bp, Homo sapiens
cctctatgccctgcagag

SEQ ID NO: 5678963 - DNA, 20 bp, Homo sapiens
cctctatgccctgcagagca

SEQ ID NO: 5678964 - DNA, 13 bp, Homo sapiens
cctctatgctggc

SEQ ID NO: 5678965 - DNA, 22 bp, Homo sapiens
cctctatgctggcttttcaccc

SEQ ID NO: 5678966 - DNA, 19 bp, Homo sapiens
cctctattcttgggaaaca

SEQ ID NO: 5678967 - DNA, 20 bp, Homo sapiens
cctctattcttgggaaacac

SEQ ID NO: 5678968 - DNA, 20 bp, Homo sapiens
cctctattgatgtacagtct

SEQ ID NO: 5678969 - DNA, 21 bp, Homo sapiens
cctctatttattagccaactg

SEQ ID NO: 5678970 - DNA, 17 bp, Homo sapiens
cctctcaaacctggcag

SEQ ID NO: 5678971 - DNA, 18 bp, Homo sapiens
cctctcaaacctggcaga

SEQ ID NO: 5678972 - DNA, 15 bp, Homo sapiens
cctctcaacacccag

SEQ ID NO: 5678973 - DNA, 21 bp, Homo sapiens
cctctcaagctagtgtttcta

SEQ ID NO: 5678974 - DNA, 20 bp, Homo sapiens
cctctcaatattcaataaag

SEQ ID NO: 5678975 - DNA, 22 bp, Homo sapiens
cctctcaatattcaataaagct

SEQ ID NO: 5678976 - DNA, 21 bp, Homo sapiens
cctctcacacatttctgccac

SEQ ID NO: 5678977 - DNA, 19 bp, Homo sapiens
cctctcacaggcagctctg

SEQ ID NO: 5678978 - DNA, 16 bp, Homo sapiens
cctctcacccagaatc

SEQ ID NO: 5678979 - DNA, 14 bp, Homo sapiens
cctctcaccccact

SEQ ID NO: 5678980 - DNA, 16 bp, Homo sapiens
cctctcaccccactcc

SEQ ID NO: 5678981 - DNA, 16 bp, Homo sapiens
cctctcaccccacttc

SEQ ID NO: 5678982 - DNA, 15 bp, Homo sapiens
cctctcacgccaccc

SEQ ID NO: 5678983 - DNA, 18 bp, Homo sapiens
cctctcacgccacccccg

SEQ ID NO: 5678984 - DNA, 19 bp, Homo sapiens
cctctcacgccacccccgc

SEQ ID NO: 5678985 - DNA, 16 bp, Homo sapiens
cctctcacgggccctg

SEQ ID NO: 5678986 - DNA, 21 bp, Homo sapiens
cctctcacgggccctgcccca

SEQ ID NO: 5678987 - DNA, 16 bp, Homo sapiens
cctctcactaaacttt

SEQ ID NO: 5678988 - DNA, 16 bp, Homo sapiens
cctctcactagtgcca

SEQ ID NO: 5678989 - DNA, 19 bp, Homo sapiens
cctctcactccagccaaag

SEQ ID NO: 5678990 - DNA, 22 bp, Homo sapiens
cctctcactccagccaaagaaa

SEQ ID NO: 5678991 - DNA, 15 bp, Homo sapiens
cctctcactctggca

SEQ ID NO: 5678992 - DNA, 23 bp, Homo sapiens
cctctcactctggcagcctcaga

SEQ ID NO: 5678993 - DNA, 19 bp, Homo sapiens
cctctcactgtctgagagt

SEQ ID NO: 5678994 - DNA, 19 bp, Homo sapiens
cctctcagaacatactgat

SEQ ID NO: 5678995 - DNA, 20 bp, Homo sapiens
cctctcagaactcctgtgtg

SEQ ID NO: 5678996 - DNA, 21 bp, Homo sapiens
cctctcagaactcctgtgtgt

SEQ ID NO: 5678997 - DNA, 12 bp, Homo sapiens
cctctcagagca

SEQ ID NO: 5678998 - DNA, 16 bp, Homo sapiens
cctctcagagcctcag

SEQ ID NO: 5678999 - DNA, 17 bp, Homo sapiens
cctctcagagcctcagc

SEQ ID NO: 5679000 - DNA, 19 bp, Homo sapiens
cctctcagagcctcagctt

SEQ ID NO: 5679001 - DNA, 22 bp, Homo sapiens
cctctcagagcctcagcttctg

SEQ ID NO: 5679002 - DNA, 15 bp, Homo sapiens
cctctcagagctact

SEQ ID NO: 5679003 - DNA, 21 bp, Homo sapiens
cctctcagagctacttgggcc

SEQ ID NO: 5679004 - DNA, 20 bp, Homo sapiens
cctctcagcatagcctgcct

SEQ ID NO: 5679005 - DNA, 22 bp, Homo sapiens
cctctcagcatagcctgcctga

SEQ ID NO: 5679006 - DNA, 13 bp, Homo sapiens
cctctcagccctc

SEQ ID NO: 5679007 - DNA, 15 bp, Homo sapiens
cctctcagctgctgg

SEQ ID NO: 5679008 - DNA, 16 bp, Homo sapiens
cctctcagctgctgga

SEQ ID NO: 5679009 - DNA, 20 bp, Homo sapiens
cctctcagctgctggatgac

SEQ ID NO: 5679010 - DNA, 21 bp, Homo sapiens
cctctcagctgctgggacgat

SEQ ID NO: 5679011 - DNA, 11 bp, Homo sapiens
cctctcaggag

SEQ ID NO: 5679012 - DNA, 18 bp, Homo sapiens
cctctcaggatccaagct

SEQ ID NO: 5679013 - DNA, 21 bp, Homo sapiens
cctctcaggcatgcctgtgtg

SEQ ID NO: 5679014 - DNA, 19 bp, Homo sapiens
cctctcaggctgggccccg

SEQ ID NO: 5679015 - DNA, 12 bp, Homo sapiens
cctctcagggcc

SEQ ID NO: 5679016 - DNA, 19 bp, Homo sapiens
cctctcagggcctggcagg

SEQ ID NO: 5679017 - DNA, 20 bp, Homo sapiens
cctctcagggcctggcaggc

SEQ ID NO: 5679018 - DNA, 14 bp, Homo sapiens
cctctcaggtgggt

SEQ ID NO: 5679019 - DNA, 15 bp, Homo sapiens
cctctcagtactttg

SEQ ID NO: 5679020 - DNA, 13 bp, Homo sapiens
cctctcagtgcct

SEQ ID NO: 5679021 - DNA, 22 bp, Homo sapiens
cctctcatccaggtcctttcct

SEQ ID NO: 5679022 - DNA, 23 bp, Homo sapiens
cctctcatccaggtcctttcctt

SEQ ID NO: 5679023 - DNA, 17 bp, Homo sapiens
cctctcatctgacctta

SEQ ID NO: 5679024 - DNA, 17 bp, Homo sapiens
cctctcatgtccctcca

SEQ ID NO: 5679025 - DNA, 18 bp, Homo sapiens
cctctcatgtccctccag

SEQ ID NO: 5679026 - DNA, 19 bp, Homo sapiens
cctctcatgtccctccagg

SEQ ID NO: 5679027 - DNA, 21 bp, Homo sapiens
cctctcatgtccctccaggga

SEQ ID NO: 5679028 - DNA, 19 bp, Homo sapiens
cctctcatttagcctgtcc

SEQ ID NO: 5679029 - DNA, 17 bp, Homo sapiens
cctctccaaccactgtg

SEQ ID NO: 5679030 - DNA, 13 bp, Homo sapiens
cctctccaagggc

SEQ ID NO: 5679031 - DNA, 17 bp, Homo sapiens
cctctccaattgtaaaa

SEQ ID NO: 5679032 - DNA, 13 bp, Homo sapiens
cctctccacacag

SEQ ID NO: 5679033 - DNA, 12 bp, Homo sapiens
cctctccacacc

SEQ ID NO: 5679034 - DNA, 18 bp, Homo sapiens
cctctccaccagacgcct

SEQ ID NO: 5679035 - DNA, 23 bp, Homo sapiens
cctctccacccagaggtctccct

SEQ ID NO: 5679036 - DNA, 22 bp, Homo sapiens
cctctccaccctcccagacctg

SEQ ID NO: 5679037 - DNA, 15 bp, Homo sapiens
cctctccaccctcct

SEQ ID NO: 5679038 - DNA, 18 bp, Homo sapiens
cctctccactcatgtgac

SEQ ID NO: 5679039 - DNA, 23 bp, Homo sapiens
cctctccactcatgtgactcttt

SEQ ID NO: 5679040 - DNA, 14 bp, Homo sapiens
cctctccactccat

SEQ ID NO: 5679041 - DNA, 15 bp, Homo sapiens
cctctccactccatg

SEQ ID NO: 5679042 - DNA, 16 bp, Homo sapiens
cctctccactcttctc

SEQ ID NO: 5679043 - DNA, 21 bp, Homo sapiens
cctctccactcttctctcctt

SEQ ID NO: 5679044 - DNA, 19 bp, Homo sapiens
cctctccactgctggacat

SEQ ID NO: 5679045 - DNA, 12 bp, Homo sapiens
cctctccagaca

SEQ ID NO: 5679046 - DNA, 11 bp, Homo sapiens
cctctccagca

SEQ ID NO: 5679047 - DNA, 13 bp, Homo sapiens
cctctccagcatc

SEQ ID NO: 5679048 - DNA, 16 bp, Homo sapiens
cctctccagcatccca

SEQ ID NO: 5679049 - DNA, 17 bp, Homo sapiens
cctctccagcatcccag

SEQ ID NO: 5679050 - DNA, 20 bp, Homo sapiens
cctctccagcatcccagcct

SEQ ID NO: 5679051 - DNA, 22 bp, Homo sapiens
cctctccagcatcccagcctca

SEQ ID NO: 5679052 - DNA, 23 bp, Homo sapiens
cctctccagcatcccagcctcag

SEQ ID NO: 5679053 - DNA, 13 bp, Homo sapiens
cctctccagcctc

SEQ ID NO: 5679054 - DNA, 14 bp, Homo sapiens
cctctccagccttc

SEQ ID NO: 5679055 - DNA, 13 bp, Homo sapiens
cctctccagctcc

SEQ ID NO: 5679056 - DNA, 11 bp, Homo sapiens
cctctccaggc

SEQ ID NO: 5679057 - DNA, 12 bp, Homo sapiens
cctctccaggca

SEQ ID NO: 5679058 - DNA, 14 bp, Homo sapiens
cctctccaggcacc

SEQ ID NO: 5679059 - DNA, 13 bp, Homo sapiens
cctctccaggcca

SEQ ID NO: 5679060 - DNA, 16 bp, Homo sapiens
cctctccaggcctgtc

SEQ ID NO: 5679061 - DNA, 14 bp, Homo sapiens
cctctccaggtgct

SEQ ID NO: 5679062 - DNA, 21 bp, Homo sapiens
cctctccatacctgcccctgc

SEQ ID NO: 5679063 - DNA, 19 bp, Homo sapiens
cctctccatctcccaaggc

SEQ ID NO: 5679064 - DNA, 13 bp, Homo sapiens
cctctccatgcaa

SEQ ID NO: 5679065 - DNA, 18 bp, Homo sapiens
cctctccatgcaagtgct

SEQ ID NO: 5679066 - DNA, 23 bp, Homo sapiens
cctctccatgcaagtgctgtttg

SEQ ID NO: 5679067 - DNA, 17 bp, Homo sapiens
cctctccatgcccaacc

SEQ ID NO: 5679068 - DNA, 13 bp, Homo sapiens
cctctccatttgc

SEQ ID NO: 5679069 - DNA, 23 bp, Homo sapiens
cctctcccaaataaactccttaa

SEQ ID NO: 5679070 - DNA, 15 bp, Homo sapiens
cctctcccaagtcca

SEQ ID NO: 5679071 - DNA, 12 bp, Homo sapiens
cctctcccaccc

SEQ ID NO: 5679072 - DNA, 21 bp, Homo sapiens
cctctcccacccggccacagc

SEQ ID NO: 5679073 - DNA, 23 bp, Homo sapiens
cctctcccacccggccacagctg

SEQ ID NO: 5679074 - DNA, 14 bp, Homo sapiens
cctctcccaccctc

SEQ ID NO: 5679075 - DNA, 12 bp, Homo sapiens
cctctcccagga

SEQ ID NO: 5679076 - DNA, 14 bp, Homo sapiens
cctctcccaggcag

SEQ ID NO: 5679077 - DNA, 22 bp, Homo sapiens
cctctcccaggcaggggcccgc

SEQ ID NO: 5679078 - DNA, 14 bp, Homo sapiens
cctctcccagggat

SEQ ID NO: 5679079 - DNA, 13 bp, Homo sapiens
cctctcccagttg

SEQ ID NO: 5679080 - DNA, 15 bp, Homo sapiens
cctctcccagttgtc

SEQ ID NO: 5679081 - DNA, 15 bp, Homo sapiens
cctctcccatccccc

SEQ ID NO: 5679082 - DNA, 21 bp, Homo sapiens
cctctcccatccccctgccct

SEQ ID NO: 5679083 - DNA, 22 bp, Homo sapiens
cctctcccatccccctgccctc

SEQ ID NO: 5679084 - DNA, 19 bp, Homo sapiens
cctctcccattgtccctct

SEQ ID NO: 5679085 - DNA, 15 bp, Homo sapiens
cctctccccacccct

SEQ ID NO: 5679086 - DNA, 13 bp, Homo sapiens
cctctccccagcc

SEQ ID NO: 5679087 - DNA, 14 bp, Homo sapiens
cctctccccaggaa

SEQ ID NO: 5679088 - DNA, 22 bp, Homo sapiens
cctctcccccaaccccctgcaa

SEQ ID NO: 5679089 - DNA, 16 bp, Homo sapiens
cctctcccccgcccaa

SEQ ID NO: 5679090 - DNA, 14 bp, Homo sapiens
cctctcccccttca

SEQ ID NO: 5679091 - DNA, 16 bp, Homo sapiens
cctctcccccttcagc

SEQ ID NO: 5679092 - DNA, 17 bp, Homo sapiens
cctctcccccttcagct

SEQ ID NO: 5679093 - DNA, 19 bp, Homo sapiens
cctctcccccttcagctcc

SEQ ID NO: 5679094 - DNA, 21 bp, Homo sapiens
cctctcccccttcagctcctg

SEQ ID NO: 5679095 - DNA, 23 bp, Homo sapiens
cctctcccccttcagctcctgag

SEQ ID NO: 5679096 - DNA, 20 bp, Homo sapiens
cctctccccggacaagccca

SEQ ID NO: 5679097 - DNA, 21 bp, Homo sapiens
cctctccccggacaagcccag

SEQ ID NO: 5679098 - DNA, 15 bp, Homo sapiens
cctctcccctcagcc

SEQ ID NO: 5679099 - DNA, 16 bp, Homo sapiens
cctctcccctcagcct

SEQ ID NO: 5679100 - DNA, 16 bp, Homo sapiens
cctctcccctcatgga

SEQ ID NO: 5679101 - DNA, 16 bp, Homo sapiens
cctctcccctccagcc

SEQ ID NO: 5679102 - DNA, 16 bp, Homo sapiens
cctctcccctctctgc

SEQ ID NO: 5679103 - DNA, 17 bp, Homo sapiens
cctctcccctctctgct

SEQ ID NO: 5679104 - DNA, 22 bp, Homo sapiens
cctctcccctgccccctgcagg

SEQ ID NO: 5679105 - DNA, 18 bp, Homo sapiens
cctctcccctgcctgccc

SEQ ID NO: 5679106 - DNA, 14 bp, Homo sapiens
cctctccccttggt

SEQ ID NO: 5679107 - DNA, 16 bp, Homo sapiens
cctctccccttggttc

SEQ ID NO: 5679108 - DNA, 21 bp, Homo sapiens
cctctccccttggttctgcac

SEQ ID NO: 5679109 - DNA, 21 bp, Homo sapiens
cctctcccgcgggcctggaca

SEQ ID NO: 5679110 - DNA, 19 bp, Homo sapiens
cctctcccggctgcctgcc

SEQ ID NO: 5679111 - DNA, 22 bp, Homo sapiens
cctctcccgtcagggcccaagt

SEQ ID NO: 5679112 - DNA, 10 bp, Homo sapiens
cctctccctc

SEQ ID NO: 5679113 - DNA, 12 bp, Homo sapiens
cctctccctcag

SEQ ID NO: 5679114 - DNA, 17 bp, Homo sapiens
cctctccctcctcagct

SEQ ID NO: 5679115 - DNA, 17 bp, Homo sapiens
cctctccctctctctgg

SEQ ID NO: 5679116 - DNA, 12 bp, Homo sapiens
cctctccctgac

SEQ ID NO: 5679117 - DNA, 21 bp, Homo sapiens
cctctccctgaccctgtatat

SEQ ID NO: 5679118 - DNA, 15 bp, Homo sapiens
cctctccctgcatcc

SEQ ID NO: 5679119 - DNA, 21 bp, Homo sapiens
cctctccctgcatcctgaggc

SEQ ID NO: 5679120 - DNA, 12 bp, Homo sapiens
cctctccctgcc

SEQ ID NO: 5679121 - DNA, 14 bp, Homo sapiens
cctctccctgccaa

SEQ ID NO: 5679122 - DNA, 15 bp, Homo sapiens
cctctccctgcctgt

SEQ ID NO: 5679123 - DNA, 19 bp, Homo sapiens
cctctccctgctgctccta

SEQ ID NO: 5679124 - DNA, 12 bp, Homo sapiens
cctctccctggg

SEQ ID NO: 5679125 - DNA, 16 bp, Homo sapiens
cctctccctgggtctg

SEQ ID NO: 5679126 - DNA, 21 bp, Homo sapiens
cctctccctgtgttctgggct

SEQ ID NO: 5679127 - DNA, 22 bp, Homo sapiens
cctctccctgtgttctgggctg

SEQ ID NO: 5679128 - DNA, 10 bp, Homo sapiens
cctctccctt

SEQ ID NO: 5679129 - DNA, 17 bp, Homo sapiens
cctctcccttcccttcc

SEQ ID NO: 5679130 - DNA, 22 bp, Homo sapiens
cctctcccttggattgtccccg

SEQ ID NO: 5679131 - DNA, 19 bp, Homo sapiens
cctctccgcccctgagccc

SEQ ID NO: 5679132 - DNA, 20 bp, Homo sapiens
cctctccgcccctgagccca

SEQ ID NO: 5679133 - DNA, 20 bp, Homo sapiens
cctctccgcgggagacccct

SEQ ID NO: 5679134 - DNA, 18 bp, Homo sapiens
cctctccggcctggcctt

SEQ ID NO: 5679135 - DNA, 19 bp, Homo sapiens
cctctccggcctggccttt

SEQ ID NO: 5679136 - DNA, 23 bp, Homo sapiens
cctctccggcctggccttttcca

SEQ ID NO: 5679137 - DNA, 13 bp, Homo sapiens
cctctcctagcag

SEQ ID NO: 5679138 - DNA, 18 bp, Homo sapiens
cctctcctagcagcccta

SEQ ID NO: 5679139 - DNA, 20 bp, Homo sapiens
cctctcctagccctcctgag

SEQ ID NO: 5679140 - DNA, 20 bp, Homo sapiens
cctctcctatgtggcagctg

SEQ ID NO: 5679141 - DNA, 21 bp, Homo sapiens
cctctcctatgtggcagctgg

SEQ ID NO: 5679142 - DNA, 22 bp, Homo sapiens
cctctcctatgtggcagctggg

SEQ ID NO: 5679143 - DNA, 17 bp, Homo sapiens
cctctcctcagagtccc

SEQ ID NO: 5679144 - DNA, 15 bp, Homo sapiens
cctctcctcccagct

SEQ ID NO: 5679145 - DNA, 16 bp, Homo sapiens
cctctcctcccagctg

SEQ ID NO: 5679146 - DNA, 18 bp, Homo sapiens
cctctcctcccagctgct

SEQ ID NO: 5679147 - DNA, 20 bp, Homo sapiens
cctctcctcccagctgcttt

SEQ ID NO: 5679148 - DNA, 12 bp, Homo sapiens
cctctcctcccc

SEQ ID NO: 5679149 - DNA, 18 bp, Homo sapiens
cctctcctccccttcctg

SEQ ID NO: 5679150 - DNA, 16 bp, Homo sapiens
cctctcctcctcagct

SEQ ID NO: 5679151 - DNA, 16 bp, Homo sapiens
cctctcctcctctgtg

SEQ ID NO: 5679152 - DNA, 18 bp, Homo sapiens
cctctcctcctctgtgct

SEQ ID NO: 5679153 - DNA, 21 bp, Homo sapiens
cctctcctcggacacccaggg

SEQ ID NO: 5679154 - DNA, 16 bp, Homo sapiens
cctctcctcgtccggc

SEQ ID NO: 5679155 - DNA, 20 bp, Homo sapiens
cctctcctcgtccggcctgc

SEQ ID NO: 5679156 - DNA, 22 bp, Homo sapiens
cctctcctcgtccggcctgcag

SEQ ID NO: 5679157 - DNA, 12 bp, Homo sapiens
cctctcctctct

SEQ ID NO: 5679158 - DNA, 14 bp, Homo sapiens
cctctcctctgccc

SEQ ID NO: 5679159 - DNA, 12 bp, Homo sapiens
cctctcctgaag

SEQ ID NO: 5679160 - DNA, 16 bp, Homo sapiens
cctctcctgacccctg

SEQ ID NO: 5679161 - DNA, 19 bp, Homo sapiens
cctctcctgagcctgtctc

SEQ ID NO: 5679162 - DNA, 18 bp, Homo sapiens
cctctcctgcccaagcac

SEQ ID NO: 5679163 - DNA, 16 bp, Homo sapiens
cctctcctgcccagat

SEQ ID NO: 5679164 - DNA, 18 bp, Homo sapiens
cctctcctgcccagctct

SEQ ID NO: 5679165 - DNA, 15 bp, Homo sapiens
cctctcctgccctct

SEQ ID NO: 5679166 - DNA, 17 bp, Homo sapiens
cctctcctgccctctgc

SEQ ID NO: 5679167 - DNA, 18 bp, Homo sapiens
cctctcctgccctctgct

SEQ ID NO: 5679168 - DNA, 17 bp, Homo sapiens
cctctcctgcctactca

SEQ ID NO: 5679169 - DNA, 23 bp, Homo sapiens
cctctcctgcgtgtgcccactga

SEQ ID NO: 5679170 - DNA, 12 bp, Homo sapiens
cctctcctggag

SEQ ID NO: 5679171 - DNA, 21 bp, Homo sapiens
cctctcctggagggcgcccag

SEQ ID NO: 5679172 - DNA, 11 bp, Homo sapiens
cctctcctggg

SEQ ID NO: 5679173 - DNA, 13 bp, Homo sapiens
cctctcctgggca

SEQ ID NO: 5679174 - DNA, 15 bp, Homo sapiens
cctctcctgggcagc

SEQ ID NO: 5679175 - DNA, 16 bp, Homo sapiens
cctctcctgggcagct

SEQ ID NO: 5679176 - DNA, 20 bp, Homo sapiens
cctctcctgggcagctgcct

SEQ ID NO: 5679177 - DNA, 21 bp, Homo sapiens
cctctcctgggcagctgcctc

SEQ ID NO: 5679178 - DNA, 14 bp, Homo sapiens
cctctcctgggggt

SEQ ID NO: 5679179 - DNA, 14 bp, Homo sapiens
cctctcctgtagcc

SEQ ID NO: 5679180 - DNA, 11 bp, Homo sapiens
cctctccttcc

SEQ ID NO: 5679181 - DNA, 14 bp, Homo sapiens
cctctccttcccac

SEQ ID NO: 5679182 - DNA, 16 bp, Homo sapiens
cctctccttcccacaa

SEQ ID NO: 5679183 - DNA, 17 bp, Homo sapiens
cctctccttcccacaaa

SEQ ID NO: 5679184 - DNA, 13 bp, Homo sapiens
cctctccttcctg

SEQ ID NO: 5679185 - DNA, 17 bp, Homo sapiens
cctctccttccttaccc

SEQ ID NO: 5679186 - DNA, 16 bp, Homo sapiens
cctctccttgccccag

SEQ ID NO: 5679187 - DNA, 20 bp, Homo sapiens
cctctccttgccccagtcct

SEQ ID NO: 5679188 - DNA, 21 bp, Homo sapiens
cctctccttgccccagtcctg

SEQ ID NO: 5679189 - DNA, 15 bp, Homo sapiens
cctctccttgccccc

SEQ ID NO: 5679190 - DNA, 14 bp, Homo sapiens
cctctccttgggct

SEQ ID NO: 5679191 - DNA, 18 bp, Homo sapiens
cctctccttgggctcctg

SEQ ID NO: 5679192 - DNA, 20 bp, Homo sapiens
cctctccttgggctcctggc

SEQ ID NO: 5679193 - DNA, 21 bp, Homo sapiens
cctctccttgggctcctggct

SEQ ID NO: 5679194 - DNA, 12 bp, Homo sapiens
cctctcctttgt

SEQ ID NO: 5679195 - DNA, 17 bp, Homo sapiens
cctctccttttctccac

SEQ ID NO: 5679196 - DNA, 13 bp, Homo sapiens
cctctccttttga

SEQ ID NO: 5679197 - DNA, 23 bp, Homo sapiens
cctctcgacggcacgcacttgcc

SEQ ID NO: 5679198 - DNA, 24 bp, Homo sapiens
cctctcgacggcacgcacttgcct

SEQ ID NO: 5679199 - DNA, 14 bp, Homo sapiens
cctctcgagcccag

SEQ ID NO: 5679200 - DNA, 16 bp, Homo sapiens
cctctcgagcccagat

SEQ ID NO: 5679201 - DNA, 19 bp, Homo sapiens
cctctcgagttctcctatc

SEQ ID NO: 5679202 - DNA, 22 bp, Homo sapiens
cctctcgccaagccatcacagg

SEQ ID NO: 5679203 - DNA, 15 bp, Homo sapiens
cctctcgccccatcc

SEQ ID NO: 5679204 - DNA, 19 bp, Homo sapiens
cctctcgccctggccaggg

SEQ ID NO: 5679205 - DNA, 13 bp, Homo sapiens
cctctcgcctcat

SEQ ID NO: 5679206 - DNA, 14 bp, Homo sapiens
cctctcgcctcatt

SEQ ID NO: 5679207 - DNA, 20 bp, Homo sapiens
cctctcgctcctcaacccct

SEQ ID NO: 5679208 - DNA, 17 bp, Homo sapiens
cctctcggaaggctggc

SEQ ID NO: 5679209 - DNA, 16 bp, Homo sapiens
cctctcggctgccagg

SEQ ID NO: 5679210 - DNA, 21 bp, Homo sapiens
cctctcggctgccaggggctc

SEQ ID NO: 5679211 - DNA, 15 bp, Homo sapiens
cctctcggtgctcca

SEQ ID NO: 5679212 - DNA, 13 bp, Homo sapiens
cctctctaacctc

SEQ ID NO: 5679213 - DNA, 18 bp, Homo sapiens
cctctctaagccacagct

SEQ ID NO: 5679214 - DNA, 23 bp, Homo sapiens
cctctctaagccacagcttcttc

SEQ ID NO: 5679215 - DNA, 17 bp, Homo sapiens
cctctctagggacccct

SEQ ID NO: 5679216 - DNA, 12 bp, Homo sapiens
cctctctcacca

SEQ ID NO: 5679217 - DNA, 13 bp, Homo sapiens
cctctctcaccag

SEQ ID NO: 5679218 - DNA, 14 bp, Homo sapiens
cctctctcaccagc

SEQ ID NO: 5679219 - DNA, 16 bp, Homo sapiens
cctctctcaccagcct

SEQ ID NO: 5679220 - DNA, 18 bp, Homo sapiens
cctctctcaccagccttg

SEQ ID NO: 5679221 - DNA, 15 bp, Homo sapiens
cctctctcactcctt

SEQ ID NO: 5679222 - DNA, 13 bp, Homo sapiens
cctctctcagagc

SEQ ID NO: 5679223 - DNA, 13 bp, Homo sapiens
cctctctcagcac

SEQ ID NO: 5679224 - DNA, 15 bp, Homo sapiens
cctctctcagcacag

SEQ ID NO: 5679225 - DNA, 17 bp, Homo sapiens
cctctctcagcccaggt

SEQ ID NO: 5679226 - DNA, 16 bp, Homo sapiens
cctctctcagttattc

SEQ ID NO: 5679227 - DNA, 19 bp, Homo sapiens
cctctctccacacggagct

SEQ ID NO: 5679228 - DNA, 16 bp, Homo sapiens
cctctctccactaccc

SEQ ID NO: 5679229 - DNA, 20 bp, Homo sapiens
cctctctccaggccccaggt

SEQ ID NO: 5679230 - DNA, 12 bp, Homo sapiens
cctctctcccag

SEQ ID NO: 5679231 - DNA, 14 bp, Homo sapiens
cctctctcccagtc

SEQ ID NO: 5679232 - DNA, 16 bp, Homo sapiens
cctctctcccatttca

SEQ ID NO: 5679233 - DNA, 13 bp, Homo sapiens
cctctctccccaa

SEQ ID NO: 5679234 - DNA, 15 bp, Homo sapiens
cctctctccctgcct

SEQ ID NO: 5679235 - DNA, 18 bp, Homo sapiens
cctctctccctgcctcac

SEQ ID NO: 5679236 - DNA, 19 bp, Homo sapiens
cctctctccctgcctcaca

SEQ ID NO: 5679237 - DNA, 13 bp, Homo sapiens
cctctctcctgga

SEQ ID NO: 5679238 - DNA, 23 bp, Homo sapiens
cctctctccttatagacacttgc

SEQ ID NO: 5679239 - DNA, 21 bp, Homo sapiens
cctctctccttggccacagac

SEQ ID NO: 5679240 - DNA, 14 bp, Homo sapiens
cctctctcctttgc

SEQ ID NO: 5679241 - DNA, 17 bp, Homo sapiens
cctctctcggagccctc

SEQ ID NO: 5679242 - DNA, 19 bp, Homo sapiens
cctctctctaagtttagaa

SEQ ID NO: 5679243 - DNA, 12 bp, Homo sapiens
cctctctctcac

SEQ ID NO: 5679244 - DNA, 17 bp, Homo sapiens
cctctctctcactcccc

SEQ ID NO: 5679245 - DNA, 21 bp, Homo sapiens
cctctctctcactcccctctc

SEQ ID NO: 5679246 - DNA, 13 bp, Homo sapiens
cctctctctccct

SEQ ID NO: 5679247 - DNA, 14 bp, Homo sapiens
cctctctctccctc

SEQ ID NO: 5679248 - DNA, 21 bp, Homo sapiens
cctctctctccctccactcct

SEQ ID NO: 5679249 - DNA, 19 bp, Homo sapiens
cctctctctccctctttct

SEQ ID NO: 5679250 - DNA, 17 bp, Homo sapiens
cctctctctctctcctc

SEQ ID NO: 5679251 - DNA, 18 bp, Homo sapiens
cctctctctctctcctca

SEQ ID NO: 5679252 - DNA, 20 bp, Homo sapiens
cctctctctctctctctctg

SEQ ID NO: 5679253 - DNA, 14 bp, Homo sapiens
cctctctctgctcc

SEQ ID NO: 5679254 - DNA, 15 bp, Homo sapiens
cctctctctgctcct

SEQ ID NO: 5679255 - DNA, 23 bp, Homo sapiens
cctctctctgggcccaggggctg

SEQ ID NO: 5679256 - DNA, 18 bp, Homo sapiens
cctctctcttctgctcca

SEQ ID NO: 5679257 - DNA, 18 bp, Homo sapiens
cctctctctttcctccac

SEQ ID NO: 5679258 - DNA, 20 bp, Homo sapiens
cctctctctttcctccaccc

SEQ ID NO: 5679259 - DNA, 12 bp, Homo sapiens
cctctctgaagc

SEQ ID NO: 5679260 - DNA, 22 bp, Homo sapiens
cctctctgaaggaggccacctc

SEQ ID NO: 5679261 - DNA, 13 bp, Homo sapiens
cctctctgaatgt

SEQ ID NO: 5679262 - DNA, 21 bp, Homo sapiens
cctctctgagtcaaatccagt

SEQ ID NO: 5679263 - DNA, 23 bp, Homo sapiens
cctctctgagtcaaatccagtgg

SEQ ID NO: 5679264 - DNA, 24 bp, Homo sapiens
cctctctgagtcaaatccagtggt

SEQ ID NO: 5679265 - DNA, 13 bp, Homo sapiens
cctctctgagtct

SEQ ID NO: 5679266 - DNA, 14 bp, Homo sapiens
cctctctgagtctg

SEQ ID NO: 5679267 - DNA, 19 bp, Homo sapiens
cctctctgagtctggactt

SEQ ID NO: 5679268 - DNA, 16 bp, Homo sapiens
cctctctgatgtccca

SEQ ID NO: 5679269 - DNA, 18 bp, Homo sapiens
cctctctgatgtcccagt

SEQ ID NO: 5679270 - DNA, 19 bp, Homo sapiens
cctctctgcaccggacagt

SEQ ID NO: 5679271 - DNA, 13 bp, Homo sapiens
cctctctgcacct

SEQ ID NO: 5679272 - DNA, 16 bp, Homo sapiens
cctctctgcacctgtc

SEQ ID NO: 5679273 - DNA, 13 bp, Homo sapiens
cctctctgcaggt

SEQ ID NO: 5679274 - DNA, 17 bp, Homo sapiens
cctctctgcaggtccct

SEQ ID NO: 5679275 - DNA, 21 bp, Homo sapiens
cctctctgcaggtccctaata

SEQ ID NO: 5679276 - DNA, 14 bp, Homo sapiens
cctctctgccagcc

SEQ ID NO: 5679277 - DNA, 14 bp, Homo sapiens
cctctctgccccac

SEQ ID NO: 5679278 - DNA, 16 bp, Homo sapiens
cctctctgccccaccc

SEQ ID NO: 5679279 - DNA, 18 bp, Homo sapiens
cctctctgcccctgatca

SEQ ID NO: 5679280 - DNA, 13 bp, Homo sapiens
cctctctgcctct

SEQ ID NO: 5679281 - DNA, 17 bp, Homo sapiens
cctctctgcctctcttc

SEQ ID NO: 5679282 - DNA, 14 bp, Homo sapiens
cctctctgcctggg

SEQ ID NO: 5679283 - DNA, 13 bp, Homo sapiens
cctctctgcctgt

SEQ ID NO: 5679284 - DNA, 12 bp, Homo sapiens
cctctctgctat

SEQ ID NO: 5679285 - DNA, 16 bp, Homo sapiens
cctctctgctccagag

SEQ ID NO: 5679286 - DNA, 14 bp, Homo sapiens
cctctctgctcctt

SEQ ID NO: 5679287 - DNA, 17 bp, Homo sapiens
cctctctgctccttcac

SEQ ID NO: 5679288 - DNA, 15 bp, Homo sapiens
cctctctgctctgcg

SEQ ID NO: 5679289 - DNA, 16 bp, Homo sapiens
cctctctgctctgcgt

SEQ ID NO: 5679290 - DNA, 13 bp, Homo sapiens
cctctctgcttca

SEQ ID NO: 5679291 - DNA, 22 bp, Homo sapiens
cctctctggaaagaggctctgg

SEQ ID NO: 5679292 - DNA, 18 bp, Homo sapiens
cctctctggaaggcccct

SEQ ID NO: 5679293 - DNA, 15 bp, Homo sapiens
cctctctggcctccc

SEQ ID NO: 5679294 - DNA, 19 bp, Homo sapiens
cctctctggcctcccaccc

SEQ ID NO: 5679295 - DNA, 19 bp, Homo sapiens
cctctctggctcagcccgg

SEQ ID NO: 5679296 - DNA, 21 bp, Homo sapiens
cctctctggctcagcccggga

SEQ ID NO: 5679297 - DNA, 14 bp, Homo sapiens
cctctctgggacct

SEQ ID NO: 5679298 - DNA, 21 bp, Homo sapiens
cctctctgggacctaggggga

SEQ ID NO: 5679299 - DNA, 16 bp, Homo sapiens
cctctctgggcctcag

SEQ ID NO: 5679300 - DNA, 18 bp, Homo sapiens
cctctctggggctgtgtt

SEQ ID NO: 5679301 - DNA, 12 bp, Homo sapiens
cctctctggggg

SEQ ID NO: 5679302 - DNA, 14 bp, Homo sapiens
cctctctgggggag

SEQ ID NO: 5679303 - DNA, 20 bp, Homo sapiens
cctctctggtggctgggctg

SEQ ID NO: 5679304 - DNA, 22 bp, Homo sapiens
cctctctggtggctgggctgct

SEQ ID NO: 5679305 - DNA, 23 bp, Homo sapiens
cctctctggtttcctatttgcag

SEQ ID NO: 5679306 - DNA, 23 bp, Homo sapiens
cctctctgtagtttatggcagaa

SEQ ID NO: 5679307 - DNA, 13 bp, Homo sapiens
cctctctgtggct

SEQ ID NO: 5679308 - DNA, 18 bp, Homo sapiens
cctctctgttgccttttt

SEQ ID NO: 5679309 - DNA, 13 bp, Homo sapiens
cctctctgtttac

SEQ ID NO: 5679310 - DNA, 20 bp, Homo sapiens
cctctctgtttaccctccct

SEQ ID NO: 5679311 - DNA, 22 bp, Homo sapiens
cctctcttaagatgtccagggc

SEQ ID NO: 5679312 - DNA, 17 bp, Homo sapiens
cctctcttaccccgtcc

SEQ ID NO: 5679313 - DNA, 18 bp, Homo sapiens
cctctcttaccccgtccc

SEQ ID NO: 5679314 - DNA, 16 bp, Homo sapiens
cctctcttataattcc

SEQ ID NO: 5679315 - DNA, 20 bp, Homo sapiens
cctctcttatagaatattta

SEQ ID NO: 5679316 - DNA, 16 bp, Homo sapiens
cctctcttccacagtg

SEQ ID NO: 5679317 - DNA, 11 bp, Homo sapiens
cctctcttccc

SEQ ID NO: 5679318 - DNA, 17 bp, Homo sapiens
cctctcttccccttccc

SEQ ID NO: 5679319 - DNA, 20 bp, Homo sapiens
cctctcttccccttccctta

SEQ ID NO: 5679320 - DNA, 21 bp, Homo sapiens
cctctcttccccttcccttat

SEQ ID NO: 5679321 - DNA, 16 bp, Homo sapiens
cctctcttcctatccc

SEQ ID NO: 5679322 - DNA, 22 bp, Homo sapiens
cctctcttcctatcccatccca

SEQ ID NO: 5679323 - DNA, 21 bp, Homo sapiens
cctctcttcgtcctgatccct

SEQ ID NO: 5679324 - DNA, 19 bp, Homo sapiens
cctctcttgaaccccaaat

SEQ ID NO: 5679325 - DNA, 19 bp, Homo sapiens
cctctcttgattaagggct

SEQ ID NO: 5679326 - DNA, 23 bp, Homo sapiens
cctctcttgcacccgcctctccc

SEQ ID NO: 5679327 - DNA, 13 bp, Homo sapiens
cctctcttgcctt

SEQ ID NO: 5679328 - DNA, 19 bp, Homo sapiens
cctctcttggaccctggga

SEQ ID NO: 5679329 - DNA, 13 bp, Homo sapiens
cctctcttggcta

SEQ ID NO: 5679330 - DNA, 15 bp, Homo sapiens
cctctcttggctatt

SEQ ID NO: 5679331 - DNA, 21 bp, Homo sapiens
cctctcttggtttccttcctt

SEQ ID NO: 5679332 - DNA, 18 bp, Homo sapiens
cctctctttcaattgcag

SEQ ID NO: 5679333 - DNA, 21 bp, Homo sapiens
cctctctttcacacaatgccc

SEQ ID NO: 5679334 - DNA, 12 bp, Homo sapiens
cctctctttctc

SEQ ID NO: 5679335 - DNA, 14 bp, Homo sapiens
cctctctttctctg

SEQ ID NO: 5679336 - DNA, 15 bp, Homo sapiens
cctctctttctctgg

SEQ ID NO: 5679337 - DNA, 19 bp, Homo sapiens
cctctctttgttctcagct

SEQ ID NO: 5679338 - DNA, 16 bp, Homo sapiens
cctctcttttcctctc

SEQ ID NO: 5679339 - DNA, 21 bp, Homo sapiens
cctctcttttcctctctgtct

SEQ ID NO: 5679340 - DNA, 23 bp, Homo sapiens
cctctcttttcctctctgtctgt

SEQ ID NO: 5679341 - DNA, 20 bp, Homo sapiens
cctctcttttttggggggag

SEQ ID NO: 5679342 - DNA, 20 bp, Homo sapiens
cctctgaaaacggccctctt

SEQ ID NO: 5679343 - DNA, 11 bp, Homo sapiens
cctctgaaaat

SEQ ID NO: 5679344 - DNA, 14 bp, Homo sapiens
cctctgaaacagct

SEQ ID NO: 5679345 - DNA, 15 bp, Homo sapiens
cctctgaaacagctg

SEQ ID NO: 5679346 - DNA, 16 bp, Homo sapiens
cctctgaaacagctgc

SEQ ID NO: 5679347 - DNA, 17 bp, Homo sapiens
cctctgaaacagctgcc

SEQ ID NO: 5679348 - DNA, 23 bp, Homo sapiens
cctctgaaacagctgccttagct

SEQ ID NO: 5679349 - DNA, 19 bp, Homo sapiens
cctctgaaaccctggacca

SEQ ID NO: 5679350 - DNA, 18 bp, Homo sapiens
cctctgaaatttcccaca

SEQ ID NO: 5679351 - DNA, 19 bp, Homo sapiens
cctctgaactgctgctggt

SEQ ID NO: 5679352 - DNA, 15 bp, Homo sapiens
cctctgaacttgcct

SEQ ID NO: 5679353 - DNA, 21 bp, Homo sapiens
cctctgaatgtcccagaggct

SEQ ID NO: 5679354 - DNA, 13 bp, Homo sapiens
cctctgacacaca

SEQ ID NO: 5679355 - DNA, 14 bp, Homo sapiens
cctctgacacacag

SEQ ID NO: 5679356 - DNA, 15 bp, Homo sapiens
cctctgacacacagc

SEQ ID NO: 5679357 - DNA, 18 bp, Homo sapiens
cctctgacagcagcatct

SEQ ID NO: 5679358 - DNA, 20 bp, Homo sapiens
cctctgacagcagcatctct

SEQ ID NO: 5679359 - DNA, 16 bp, Homo sapiens
cctctgacccctcctc

SEQ ID NO: 5679360 - DNA, 17 bp, Homo sapiens
cctctgacccctcctca

SEQ ID NO: 5679361 - DNA, 18 bp, Homo sapiens
cctctgacccctcctcac

SEQ ID NO: 5679362 - DNA, 22 bp, Homo sapiens
cctctgacccctcctcactggc

SEQ ID NO: 5679363 - DNA, 23 bp, Homo sapiens
cctctgaccctccttctattttc

SEQ ID NO: 5679364 - DNA, 12 bp, Homo sapiens
cctctgacctat

SEQ ID NO: 5679365 - DNA, 16 bp, Homo sapiens
cctctgacctgcactg

SEQ ID NO: 5679366 - DNA, 17 bp, Homo sapiens
cctctgacctgcactgg

SEQ ID NO: 5679367 - DNA, 23 bp, Homo sapiens
cctctgacgcaccactgccaatg

SEQ ID NO: 5679368 - DNA, 16 bp, Homo sapiens
cctctgactccactca

SEQ ID NO: 5679369 - DNA, 21 bp, Homo sapiens
cctctgactcccaaagagctg

SEQ ID NO: 5679370 - DNA, 22 bp, Homo sapiens
cctctgactcccaaagagctgc

SEQ ID NO: 5679371 - DNA, 14 bp, Homo sapiens
cctctgactctgag

SEQ ID NO: 5679372 - DNA, 22 bp, Homo sapiens
cctctgactgatggtttggaaa

SEQ ID NO: 5679373 - DNA, 19 bp, Homo sapiens
cctctgagaattccaagga

SEQ ID NO: 5679374 - DNA, 20 bp, Homo sapiens
cctctgagcaactgtgcagc

SEQ ID NO: 5679375 - DNA, 15 bp, Homo sapiens
cctctgagcagcctc

SEQ ID NO: 5679376 - DNA, 11 bp, Homo sapiens
cctctgagcca

SEQ ID NO: 5679377 - DNA, 17 bp, Homo sapiens
cctctgagcccaagcta

SEQ ID NO: 5679378 - DNA, 15 bp, Homo sapiens
cctctgagcccagct

SEQ ID NO: 5679379 - DNA, 21 bp, Homo sapiens
cctctgagcccagctgcctgg

SEQ ID NO: 5679380 - DNA, 13 bp, Homo sapiens
cctctgagccgca

SEQ ID NO: 5679381 - DNA, 14 bp, Homo sapiens
cctctgagccgcca

SEQ ID NO: 5679382 - DNA, 17 bp, Homo sapiens
cctctgagccggagggc

SEQ ID NO: 5679383 - DNA, 16 bp, Homo sapiens
cctctgaggaagaagg

SEQ ID NO: 5679384 - DNA, 15 bp, Homo sapiens
cctctgaggaagcag

SEQ ID NO: 5679385 - DNA, 13 bp, Homo sapiens
cctctgaggacag

SEQ ID NO: 5679386 - DNA, 21 bp, Homo sapiens
cctctgaggcactcatctact

SEQ ID NO: 5679387 - DNA, 22 bp, Homo sapiens
cctctgaggccagcctggcctc

SEQ ID NO: 5679388 - DNA, 17 bp, Homo sapiens
cctctgaggctcagccc

SEQ ID NO: 5679389 - DNA, 17 bp, Homo sapiens
cctctgaggctgtagga

SEQ ID NO: 5679390 - DNA, 12 bp, Homo sapiens
cctctgagtccc

SEQ ID NO: 5679391 - DNA, 18 bp, Homo sapiens
cctctgagtgaagtccag

SEQ ID NO: 5679392 - DNA, 18 bp, Homo sapiens
cctctgatacccagagca

SEQ ID NO: 5679393 - DNA, 14 bp, Homo sapiens
cctctgatacctca

SEQ ID NO: 5679394 - DNA, 18 bp, Homo sapiens
cctctgatagactttgtg

SEQ ID NO: 5679395 - DNA, 19 bp, Homo sapiens
cctctgatagactttgtga

SEQ ID NO: 5679396 - DNA, 20 bp, Homo sapiens
cctctgatagctgtttcaaa

SEQ ID NO: 5679397 - DNA, 18 bp, Homo sapiens
cctctgatatgggactga

SEQ ID NO: 5679398 - DNA, 12 bp, Homo sapiens
cctctgatccct

SEQ ID NO: 5679399 - DNA, 15 bp, Homo sapiens
cctctgatctgtgca

SEQ ID NO: 5679400 - DNA, 17 bp, Homo sapiens
cctctgatgtattttgt

SEQ ID NO: 5679401 - DNA, 21 bp, Homo sapiens
cctctgatgtattttgtgagt

SEQ ID NO: 5679402 - DNA, 16 bp, Homo sapiens
cctctgattatcaggt

SEQ ID NO: 5679403 - DNA, 17 bp, Homo sapiens
cctctgattctatgtaa

SEQ ID NO: 5679404 - DNA, 19 bp, Homo sapiens
cctctgattctatgtaact

SEQ ID NO: 5679405 - DNA, 21 bp, Homo sapiens
cctctgattctatgtaacttg

SEQ ID NO: 5679406 - DNA, 21 bp, Homo sapiens
cctctgattggttttggggaa

SEQ ID NO: 5679407 - DNA, 14 bp, Homo sapiens
cctctgatttcaag

SEQ ID NO: 5679408 - DNA, 24 bp, Homo sapiens
cctctgattttggcatgtggagac

SEQ ID NO: 5679409 - DNA, 14 bp, Homo sapiens
cctctgcaactgca

SEQ ID NO: 5679410 - DNA, 14 bp, Homo sapiens
cctctgcaagtgct

SEQ ID NO: 5679411 - DNA, 19 bp, Homo sapiens
cctctgcaagtgctcaggg

SEQ ID NO: 5679412 - DNA, 20 bp, Homo sapiens
cctctgcaagtgctcaggga

SEQ ID NO: 5679413 - DNA, 17 bp, Homo sapiens
cctctgcacaagctgca

SEQ ID NO: 5679414 - DNA, 20 bp, Homo sapiens
cctctgcacaagctgcaccc

SEQ ID NO: 5679415 - DNA, 19 bp, Homo sapiens
cctctgcacaccctccaga

SEQ ID NO: 5679416 - DNA, 13 bp, Homo sapiens
cctctgcacgctc

SEQ ID NO: 5679417 - DNA, 22 bp, Homo sapiens
cctctgcacgctcaatgcccag

SEQ ID NO: 5679418 - DNA, 13 bp, Homo sapiens
cctctgcacgtgc

SEQ ID NO: 5679419 - DNA, 22 bp, Homo sapiens
cctctgcacgtgcacacacctg

SEQ ID NO: 5679420 - DNA, 16 bp, Homo sapiens
cctctgcactcccacc

SEQ ID NO: 5679421 - DNA, 17 bp, Homo sapiens
cctctgcactcccctgc

SEQ ID NO: 5679422 - DNA, 18 bp, Homo sapiens
cctctgcactcccctgct

SEQ ID NO: 5679423 - DNA, 14 bp, Homo sapiens
cctctgcagaatcc

SEQ ID NO: 5679424 - DNA, 15 bp, Homo sapiens
cctctgcagccggag

SEQ ID NO: 5679425 - DNA, 15 bp, Homo sapiens
cctctgcagcctgag

SEQ ID NO: 5679426 - DNA, 16 bp, Homo sapiens
cctctgcagcctgagc

SEQ ID NO: 5679427 - DNA, 17 bp, Homo sapiens
cctctgcagcctgagct

SEQ ID NO: 5679428 - DNA, 13 bp, Homo sapiens
cctctgcagctga

SEQ ID NO: 5679429 - DNA, 19 bp, Homo sapiens
cctctgcagctgacctctg

SEQ ID NO: 5679430 - DNA, 19 bp, Homo sapiens
cctctgcagggcagcctgt

SEQ ID NO: 5679431 - DNA, 20 bp, Homo sapiens
cctctgcagggcagcctgtg

SEQ ID NO: 5679432 - DNA, 14 bp, Homo sapiens
cctctgcagtctca

SEQ ID NO: 5679433 - DNA, 17 bp, Homo sapiens
cctctgcagtctcattt

SEQ ID NO: 5679434 - DNA, 12 bp, Homo sapiens
cctctgcagttt

SEQ ID NO: 5679435 - DNA, 18 bp, Homo sapiens
cctctgcatcctctggag

SEQ ID NO: 5679436 - DNA, 19 bp, Homo sapiens
cctctgcatcctctggagc

SEQ ID NO: 5679437 - DNA, 16 bp, Homo sapiens
cctctgcatcttgctc

SEQ ID NO: 5679438 - DNA, 17 bp, Homo sapiens
cctctgcatcttgctct

SEQ ID NO: 5679439 - DNA, 18 bp, Homo sapiens
cctctgcatcttgctctg

SEQ ID NO: 5679440 - DNA, 15 bp, Homo sapiens
cctctgcattgacct

SEQ ID NO: 5679441 - DNA, 14 bp, Homo sapiens
cctctgcattttgt

SEQ ID NO: 5679442 - DNA, 20 bp, Homo sapiens
cctctgccaaaggatgtgat

SEQ ID NO: 5679443 - DNA, 21 bp, Homo sapiens
cctctgccacagcaaggctgt

SEQ ID NO: 5679444 - DNA, 19 bp, Homo sapiens
cctctgccaccagagaccg

SEQ ID NO: 5679445 - DNA, 24 bp, Homo sapiens
cctctgccaccagagaccgtcctc

SEQ ID NO: 5679446 - DNA, 11 bp, Homo sapiens
cctctgccaga

SEQ ID NO: 5679447 - DNA, 13 bp, Homo sapiens
cctctgccagcag

SEQ ID NO: 5679448 - DNA, 16 bp, Homo sapiens
cctctgccagcaggaa

SEQ ID NO: 5679449 - DNA, 21 bp, Homo sapiens
cctctgccagcaggaataaag

SEQ ID NO: 5679450 - DNA, 16 bp, Homo sapiens
cctctgccatcctccc

SEQ ID NO: 5679451 - DNA, 17 bp, Homo sapiens
cctctgccatcctccct

SEQ ID NO: 5679452 - DNA, 17 bp, Homo sapiens
cctctgccatgcccaga

SEQ ID NO: 5679453 - DNA, 20 bp, Homo sapiens
cctctgcccagcctgcccca

SEQ ID NO: 5679454 - DNA, 14 bp, Homo sapiens
cctctgcccagctt

SEQ ID NO: 5679455 - DNA, 16 bp, Homo sapiens
cctctgcccagcttgg

SEQ ID NO: 5679456 - DNA, 17 bp, Homo sapiens
cctctgcccagcttggg

SEQ ID NO: 5679457 - DNA, 20 bp, Homo sapiens
cctctgcccagcttgggccc

SEQ ID NO: 5679458 - DNA, 15 bp, Homo sapiens
cctctgcccagggag

SEQ ID NO: 5679459 - DNA, 14 bp, Homo sapiens
cctctgccccaaga

SEQ ID NO: 5679460 - DNA, 16 bp, Homo sapiens
cctctgccccaagcag

SEQ ID NO: 5679461 - DNA, 17 bp, Homo sapiens
cctctgccccaccctca

SEQ ID NO: 5679462 - DNA, 12 bp, Homo sapiens
cctctgccccag

SEQ ID NO: 5679463 - DNA, 21 bp, Homo sapiens
cctctgcccccagctgctcct

SEQ ID NO: 5679464 - DNA, 13 bp, Homo sapiens
cctctgccccctc

SEQ ID NO: 5679465 - DNA, 16 bp, Homo sapiens
cctctgccccctcccc

SEQ ID NO: 5679466 - DNA, 21 bp, Homo sapiens
cctctgccccctcccccgcag

SEQ ID NO: 5679467 - DNA, 19 bp, Homo sapiens
cctctgcccctcccaaccc

SEQ ID NO: 5679468 - DNA, 12 bp, Homo sapiens
cctctgcccctg

SEQ ID NO: 5679469 - DNA, 18 bp, Homo sapiens
cctctgcccctgcagctg

SEQ ID NO: 5679470 - DNA, 20 bp, Homo sapiens
cctctgcccctgcagctgga

SEQ ID NO: 5679471 - DNA, 16 bp, Homo sapiens
cctctgccccttgggc

SEQ ID NO: 5679472 - DNA, 19 bp, Homo sapiens
cctctgccccttgggcctc

SEQ ID NO: 5679473 - DNA, 16 bp, Homo sapiens
cctctgcccgcagagc

SEQ ID NO: 5679474 - DNA, 21 bp, Homo sapiens
cctctgcccgggagctcagga

SEQ ID NO: 5679475 - DNA, 22 bp, Homo sapiens
cctctgcccgggagctcaggaa

SEQ ID NO: 5679476 - DNA, 11 bp, Homo sapiens
cctctgccctg

SEQ ID NO: 5679477 - DNA, 14 bp, Homo sapiens
cctctgccctgcct

SEQ ID NO: 5679478 - DNA, 15 bp, Homo sapiens
cctctgccctgcctc

SEQ ID NO: 5679479 - DNA, 20 bp, Homo sapiens
cctctgccgaccgcctgctt

SEQ ID NO: 5679480 - DNA, 18 bp, Homo sapiens
cctctgccgctgccatgc

SEQ ID NO: 5679481 - DNA, 23 bp, Homo sapiens
cctctgccgctgccatgctttga

SEQ ID NO: 5679482 - DNA, 22 bp, Homo sapiens
cctctgccgctgcttccaggct

SEQ ID NO: 5679483 - DNA, 18 bp, Homo sapiens
cctctgccggtcccccat

SEQ ID NO: 5679484 - DNA, 23 bp, Homo sapiens
cctctgccggtcgggcagccagc

SEQ ID NO: 5679485 - DNA, 10 bp, Homo sapiens
cctctgccta

SEQ ID NO: 5679486 - DNA, 15 bp, Homo sapiens
cctctgcctacagcc

SEQ ID NO: 5679487 - DNA, 18 bp, Homo sapiens
cctctgcctacagccagg

SEQ ID NO: 5679488 - DNA, 13 bp, Homo sapiens
cctctgcctcaat

SEQ ID NO: 5679489 - DNA, 13 bp, Homo sapiens
cctctgcctcatc

SEQ ID NO: 5679490 - DNA, 15 bp, Homo sapiens
cctctgcctcatcct

SEQ ID NO: 5679491 - DNA, 16 bp, Homo sapiens
cctctgcctcatcctc

SEQ ID NO: 5679492 - DNA, 17 bp, Homo sapiens
cctctgcctcatcctcc

SEQ ID NO: 5679493 - DNA, 23 bp, Homo sapiens
cctctgcctcatcctcctcctca

SEQ ID NO: 5679494 - DNA, 13 bp, Homo sapiens
cctctgcctccag

SEQ ID NO: 5679495 - DNA, 16 bp, Homo sapiens
cctctgcctccaggag

SEQ ID NO: 5679496 - DNA, 17 bp, Homo sapiens
cctctgcctccaggagg

SEQ ID NO: 5679497 - DNA, 14 bp, Homo sapiens
cctctgcctcctca

SEQ ID NO: 5679498 - DNA, 21 bp, Homo sapiens
cctctgcctcctccccaggga

SEQ ID NO: 5679499 - DNA, 13 bp, Homo sapiens
cctctgcctcctg

SEQ ID NO: 5679500 - DNA, 15 bp, Homo sapiens
cctctgcctcctggg

SEQ ID NO: 5679501 - DNA, 13 bp, Homo sapiens
cctctgcctctag

SEQ ID NO: 5679502 - DNA, 21 bp, Homo sapiens
cctctgcctctgacacacagc

SEQ ID NO: 5679503 - DNA, 11 bp, Homo sapiens
cctctgcctga

SEQ ID NO: 5679504 - DNA, 19 bp, Homo sapiens
cctctgcctgaaccttcca

SEQ ID NO: 5679505 - DNA, 22 bp, Homo sapiens
cctctgcctgaagtcacacagt

SEQ ID NO: 5679506 - DNA, 20 bp, Homo sapiens
cctctgcctgacagcatcct

SEQ ID NO: 5679507 - DNA, 22 bp, Homo sapiens
cctctgcctgacagcatcctct

SEQ ID NO: 5679508 - DNA, 11 bp, Homo sapiens
cctctgcctgc

SEQ ID NO: 5679509 - DNA, 12 bp, Homo sapiens
cctctgcctgca

SEQ ID NO: 5679510 - DNA, 13 bp, Homo sapiens
cctctgcctgcac

SEQ ID NO: 5679511 - DNA, 17 bp, Homo sapiens
cctctgcctgcactccc

SEQ ID NO: 5679512 - DNA, 23 bp, Homo sapiens
cctctgcctgcactccctggcct

SEQ ID NO: 5679513 - DNA, 14 bp, Homo sapiens
cctctgcctgggat

SEQ ID NO: 5679514 - DNA, 14 bp, Homo sapiens
cctctgcctgtccc

SEQ ID NO: 5679515 - DNA, 22 bp, Homo sapiens
cctctgcctgtccctctcaggc

SEQ ID NO: 5679516 - DNA, 19 bp, Homo sapiens
cctctgcctgtctccccca

SEQ ID NO: 5679517 - DNA, 13 bp, Homo sapiens
cctctgcctgtgc

SEQ ID NO: 5679518 - DNA, 16 bp, Homo sapiens
cctctgcctgtgcccg

SEQ ID NO: 5679519 - DNA, 17 bp, Homo sapiens
cctctgcctgtgcccgc

SEQ ID NO: 5679520 - DNA, 19 bp, Homo sapiens
cctctgccttgatggagaa

SEQ ID NO: 5679521 - DNA, 21 bp, Homo sapiens
cctctgccttgccctcctggg

SEQ ID NO: 5679522 - DNA, 23 bp, Homo sapiens
cctctgccttgccctcctgggcc

SEQ ID NO: 5679523 - DNA, 13 bp, Homo sapiens
cctctgcctttga

SEQ ID NO: 5679524 - DNA, 15 bp, Homo sapiens
cctctgcgccccagc

SEQ ID NO: 5679525 - DNA, 13 bp, Homo sapiens
cctctgcggaccc

SEQ ID NO: 5679526 - DNA, 16 bp, Homo sapiens
cctctgcggaccccag

SEQ ID NO: 5679527 - DNA, 17 bp, Homo sapiens
cctctgcggaccccagc

SEQ ID NO: 5679528 - DNA, 20 bp, Homo sapiens
cctctgcggccactgcgcca

SEQ ID NO: 5679529 - DNA, 17 bp, Homo sapiens
cctctgcggggcagggc

SEQ ID NO: 5679530 - DNA, 16 bp, Homo sapiens
cctctgcgtcccccag

SEQ ID NO: 5679531 - DNA, 23 bp, Homo sapiens
cctctgcgtcccccagccctcag

SEQ ID NO: 5679532 - DNA, 16 bp, Homo sapiens
cctctgctactgaggc

SEQ ID NO: 5679533 - DNA, 20 bp, Homo sapiens
cctctgctatgcattttctt

SEQ ID NO: 5679534 - DNA, 17 bp, Homo sapiens
cctctgctatgtctgtg

SEQ ID NO: 5679535 - DNA, 20 bp, Homo sapiens
cctctgctatgtctgtgatg

SEQ ID NO: 5679536 - DNA, 20 bp, Homo sapiens
cctctgctcaccgcccatca

SEQ ID NO: 5679537 - DNA, 21 bp, Homo sapiens
cctctgctcaccgcccatcag

SEQ ID NO: 5679538 - DNA, 16 bp, Homo sapiens
cctctgctcaggcctc

SEQ ID NO: 5679539 - DNA, 11 bp, Homo sapiens
cctctgctcca

SEQ ID NO: 5679540 - DNA, 12 bp, Homo sapiens
cctctgctccaa

SEQ ID NO: 5679541 - DNA, 20 bp, Homo sapiens
cctctgctccaaaggaaatc

SEQ ID NO: 5679542 - DNA, 23 bp, Homo sapiens
cctctgctccaacagacaccctc

SEQ ID NO: 5679543 - DNA, 16 bp, Homo sapiens
cctctgctccagcaac

SEQ ID NO: 5679544 - DNA, 13 bp, Homo sapiens
cctctgctcccca

SEQ ID NO: 5679545 - DNA, 19 bp, Homo sapiens
cctctgctcccccttttcc

SEQ ID NO: 5679546 - DNA, 16 bp, Homo sapiens
cctctgctccgtgtgt

SEQ ID NO: 5679547 - DNA, 18 bp, Homo sapiens
cctctgctcctggagcct

SEQ ID NO: 5679548 - DNA, 22 bp, Homo sapiens
cctctgctcctggagcctttga

SEQ ID NO: 5679549 - DNA, 11 bp, Homo sapiens
cctctgctcta

SEQ ID NO: 5679550 - DNA, 14 bp, Homo sapiens
cctctgctctgagg

SEQ ID NO: 5679551 - DNA, 22 bp, Homo sapiens
cctctgctctgaggcttccaga

SEQ ID NO: 5679552 - DNA, 14 bp, Homo sapiens
cctctgctctgcct

SEQ ID NO: 5679553 - DNA, 15 bp, Homo sapiens
cctctgctctgcctg

SEQ ID NO: 5679554 - DNA, 14 bp, Homo sapiens
cctctgctctgtcc

SEQ ID NO: 5679555 - DNA, 17 bp, Homo sapiens
cctctgctgaatgcagg

SEQ ID NO: 5679556 - DNA, 17 bp, Homo sapiens
cctctgctgacctgctg

SEQ ID NO: 5679557 - DNA, 23 bp, Homo sapiens
cctctgctgagtgctgggcactg

SEQ ID NO: 5679558 - DNA, 18 bp, Homo sapiens
cctctgctgatcctccca

SEQ ID NO: 5679559 - DNA, 14 bp, Homo sapiens
cctctgctgcacag

SEQ ID NO: 5679560 - DNA, 21 bp, Homo sapiens
cctctgctgcatccccttcca

SEQ ID NO: 5679561 - DNA, 15 bp, Homo sapiens
cctctgctgccatgg

SEQ ID NO: 5679562 - DNA, 20 bp, Homo sapiens
cctctgctgcccacggccac

SEQ ID NO: 5679563 - DNA, 21 bp, Homo sapiens
cctctgctgcccacggccacc

SEQ ID NO: 5679564 - DNA, 22 bp, Homo sapiens
cctctgctgcccacggccaccc

SEQ ID NO: 5679565 - DNA, 21 bp, Homo sapiens
cctctgctgccgcccttcctg

SEQ ID NO: 5679566 - DNA, 15 bp, Homo sapiens
cctctgctgccggct

SEQ ID NO: 5679567 - DNA, 19 bp, Homo sapiens
cctctgctgccggctctgg

SEQ ID NO: 5679568 - DNA, 23 bp, Homo sapiens
cctctgctgccggctctgggcct

SEQ ID NO: 5679569 - DNA, 12 bp, Homo sapiens
cctctgctgctg

SEQ ID NO: 5679570 - DNA, 15 bp, Homo sapiens
cctctgctgctgccc

SEQ ID NO: 5679571 - DNA, 16 bp, Homo sapiens
cctctgctgctgcccg

SEQ ID NO: 5679572 - DNA, 13 bp, Homo sapiens
cctctgctgctgg

SEQ ID NO: 5679573 - DNA, 19 bp, Homo sapiens
cctctgctgctgtccctcc

SEQ ID NO: 5679574 - DNA, 13 bp, Homo sapiens
cctctgctgcttt

SEQ ID NO: 5679575 - DNA, 17 bp, Homo sapiens
cctctgctgctttccaa

SEQ ID NO: 5679576 - DNA, 17 bp, Homo sapiens
cctctgctggagaaagc

SEQ ID NO: 5679577 - DNA, 21 bp, Homo sapiens
cctctgctggcacatttcccc

SEQ ID NO: 5679578 - DNA, 21 bp, Homo sapiens
cctctgctggccgggcacagc

SEQ ID NO: 5679579 - DNA, 23 bp, Homo sapiens
cctctgctggccgggcacagctg

SEQ ID NO: 5679580 - DNA, 15 bp, Homo sapiens
cctctgctggctcag

SEQ ID NO: 5679581 - DNA, 14 bp, Homo sapiens
cctctgcttcccag

SEQ ID NO: 5679582 - DNA, 15 bp, Homo sapiens
cctctgcttcccagg

SEQ ID NO: 5679583 - DNA, 12 bp, Homo sapiens
cctctgcttccg

SEQ ID NO: 5679584 - DNA, 22 bp, Homo sapiens
cctctgcttccgtactatggct

SEQ ID NO: 5679585 - DNA, 15 bp, Homo sapiens
cctctgcttctcatc

SEQ ID NO: 5679586 - DNA, 18 bp, Homo sapiens
cctctgcttctcatccca

SEQ ID NO: 5679587 - DNA, 17 bp, Homo sapiens
cctctgcttgccagcca

SEQ ID NO: 5679588 - DNA, 23 bp, Homo sapiens
cctctgcttgtcattctgctaat

SEQ ID NO: 5679589 - DNA, 14 bp, Homo sapiens
cctctgctttgaaa

SEQ ID NO: 5679590 - DNA, 15 bp, Homo sapiens
cctctgcttttatct

SEQ ID NO: 5679591 - DNA, 18 bp, Homo sapiens
cctctgcttttgcacacc

SEQ ID NO: 5679592 - DNA, 12 bp, Homo sapiens
cctctggaaccc

SEQ ID NO: 5679593 - DNA, 14 bp, Homo sapiens
cctctggaagtggc

SEQ ID NO: 5679594 - DNA, 16 bp, Homo sapiens
cctctggaatgcactg

SEQ ID NO: 5679595 - DNA, 15 bp, Homo sapiens
cctctggaatgcatg

SEQ ID NO: 5679596 - DNA, 12 bp, Homo sapiens
cctctggacacg

SEQ ID NO: 5679597 - DNA, 15 bp, Homo sapiens
cctctggacagcttg

SEQ ID NO: 5679598 - DNA, 16 bp, Homo sapiens
cctctggacagttgtg

SEQ ID NO: 5679599 - DNA, 21 bp, Homo sapiens
cctctggacggcaggctcact

SEQ ID NO: 5679600 - DNA, 15 bp, Homo sapiens
cctctggactggcta

SEQ ID NO: 5679601 - DNA, 17 bp, Homo sapiens
cctctggactggctaga

SEQ ID NO: 5679602 - DNA, 11 bp, Homo sapiens
cctctggagaa

SEQ ID NO: 5679603 - DNA, 17 bp, Homo sapiens
cctctggagccctaacc

SEQ ID NO: 5679604 - DNA, 19 bp, Homo sapiens
cctctggaggcctctgggc

SEQ ID NO: 5679605 - DNA, 20 bp, Homo sapiens
cctctggaggcctctgggcc

SEQ ID NO: 5679606 - DNA, 22 bp, Homo sapiens
cctctggaggggtgtggctcct

SEQ ID NO: 5679607 - DNA, 15 bp, Homo sapiens
cctctggagtggcca

SEQ ID NO: 5679608 - DNA, 16 bp, Homo sapiens
cctctggagtttcatg

SEQ ID NO: 5679609 - DNA, 17 bp, Homo sapiens
cctctggagtttcatgt

SEQ ID NO: 5679610 - DNA, 13 bp, Homo sapiens
cctctggatccct

SEQ ID NO: 5679611 - DNA, 12 bp, Homo sapiens
cctctggatcta

SEQ ID NO: 5679612 - DNA, 18 bp, Homo sapiens
cctctggcaggcttcccc

SEQ ID NO: 5679613 - DNA, 18 bp, Homo sapiens
cctctggccaaatatgca

SEQ ID NO: 5679614 - DNA, 12 bp, Homo sapiens
cctctggccaga

SEQ ID NO: 5679615 - DNA, 14 bp, Homo sapiens
cctctggcccagcc

SEQ ID NO: 5679616 - DNA, 15 bp, Homo sapiens
cctctggcccagcct

SEQ ID NO: 5679617 - DNA, 16 bp, Homo sapiens
cctctggcccagccta

SEQ ID NO: 5679618 - DNA, 14 bp, Homo sapiens
cctctggcccctca

SEQ ID NO: 5679619 - DNA, 13 bp, Homo sapiens
cctctggccctgc

SEQ ID NO: 5679620 - DNA, 15 bp, Homo sapiens
cctctggccctgcct

SEQ ID NO: 5679621 - DNA, 22 bp, Homo sapiens
cctctggccctggggtgtgtct

SEQ ID NO: 5679622 - DNA, 16 bp, Homo sapiens
cctctggcccttggaa

SEQ ID NO: 5679623 - DNA, 17 bp, Homo sapiens
cctctggccgcagaggt

SEQ ID NO: 5679624 - DNA, 12 bp, Homo sapiens
cctctggctaga

SEQ ID NO: 5679625 - DNA, 16 bp, Homo sapiens
cctctggctagagccg

SEQ ID NO: 5679626 - DNA, 19 bp, Homo sapiens
cctctggctagagccgagg

SEQ ID NO: 5679627 - DNA, 22 bp, Homo sapiens
cctctggctagaggccagcccc

SEQ ID NO: 5679628 - DNA, 23 bp, Homo sapiens
cctctggctagaggccagcccca

SEQ ID NO: 5679629 - DNA, 20 bp, Homo sapiens
cctctggctgcctggcccag

SEQ ID NO: 5679630 - DNA, 13 bp, Homo sapiens
cctctggcttccc

SEQ ID NO: 5679631 - DNA, 15 bp, Homo sapiens
cctctggcttcccat

SEQ ID NO: 5679632 - DNA, 16 bp, Homo sapiens
cctctggcttccctgc

SEQ ID NO: 5679633 - DNA, 20 bp, Homo sapiens
cctctggctttcccaggaga

SEQ ID NO: 5679634 - DNA, 15 bp, Homo sapiens
cctctgggaacctcc

SEQ ID NO: 5679635 - DNA, 11 bp, Homo sapiens
cctctgggacc

SEQ ID NO: 5679636 - DNA, 16 bp, Homo sapiens
cctctgggacccacag

SEQ ID NO: 5679637 - DNA, 18 bp, Homo sapiens
cctctgggaccccagctg

SEQ ID NO: 5679638 - DNA, 19 bp, Homo sapiens
cctctgggaccccagctgc

SEQ ID NO: 5679639 - DNA, 20 bp, Homo sapiens
cctctgggaccccagctgct

SEQ ID NO: 5679640 - DNA, 15 bp, Homo sapiens
cctctgggagcttct

SEQ ID NO: 5679641 - DNA, 11 bp, Homo sapiens
cctctgggagt

SEQ ID NO: 5679642 - DNA, 18 bp, Homo sapiens
cctctgggagtccccatc

SEQ ID NO: 5679643 - DNA, 22 bp, Homo sapiens
cctctgggagtccccatcccat

SEQ ID NO: 5679644 - DNA, 17 bp, Homo sapiens
cctctgggatctgccaa

SEQ ID NO: 5679645 - DNA, 18 bp, Homo sapiens
cctctgggcacgcctgct

SEQ ID NO: 5679646 - DNA, 22 bp, Homo sapiens
cctctgggcacgcctgctggcc

SEQ ID NO: 5679647 - DNA, 12 bp, Homo sapiens
cctctgggcagc

SEQ ID NO: 5679648 - DNA, 15 bp, Homo sapiens
cctctgggcagcctg

SEQ ID NO: 5679649 - DNA, 23 bp, Homo sapiens
cctctgggcagcctgctttggcc

SEQ ID NO: 5679650 - DNA, 16 bp, Homo sapiens
cctctgggcaggacct

SEQ ID NO: 5679651 - DNA, 14 bp, Homo sapiens
cctctgggcagtgt

SEQ ID NO: 5679652 - DNA, 16 bp, Homo sapiens
cctctgggcagtgtgg

SEQ ID NO: 5679653 - DNA, 21 bp, Homo sapiens
cctctgggcagtgtggcctct

SEQ ID NO: 5679654 - DNA, 12 bp, Homo sapiens
cctctgggccat

SEQ ID NO: 5679655 - DNA, 13 bp, Homo sapiens
cctctgggccctg

SEQ ID NO: 5679656 - DNA, 19 bp, Homo sapiens
cctctgggccctgcaggag

SEQ ID NO: 5679657 - DNA, 20 bp, Homo sapiens
cctctgggccctgcaggagg

SEQ ID NO: 5679658 - DNA, 14 bp, Homo sapiens
cctctgggcctgtt

SEQ ID NO: 5679659 - DNA, 16 bp, Homo sapiens
cctctgggcctgttct

SEQ ID NO: 5679660 - DNA, 10 bp, Homo sapiens
cctctgggct

SEQ ID NO: 5679661 - DNA, 22 bp, Homo sapiens
cctctgggctcacaccagccct

SEQ ID NO: 5679662 - DNA, 11 bp, Homo sapiens
cctctggggag

SEQ ID NO: 5679663 - DNA, 15 bp, Homo sapiens
cctctggggcagagc

SEQ ID NO: 5679664 - DNA, 16 bp, Homo sapiens
cctctggggctcagcc

SEQ ID NO: 5679665 - DNA, 21 bp, Homo sapiens
cctctggggctcagccctgag

SEQ ID NO: 5679666 - DNA, 23 bp, Homo sapiens
cctctggggctcagccctgagct

SEQ ID NO: 5679667 - DNA, 18 bp, Homo sapiens
cctctggggctctagggt

SEQ ID NO: 5679668 - DNA, 14 bp, Homo sapiens
cctctgggggctct

SEQ ID NO: 5679669 - DNA, 15 bp, Homo sapiens
cctctgggggctctg

SEQ ID NO: 5679670 - DNA, 12 bp, Homo sapiens
cctctgggggga

SEQ ID NO: 5679671 - DNA, 19 bp, Homo sapiens
cctctggggggtggccagg

SEQ ID NO: 5679672 - DNA, 20 bp, Homo sapiens
cctctggggggtggccaggc

SEQ ID NO: 5679673 - DNA, 14 bp, Homo sapiens
cctctgggggtcct

SEQ ID NO: 5679674 - DNA, 16 bp, Homo sapiens
cctctgggggtcctct

SEQ ID NO: 5679675 - DNA, 16 bp, Homo sapiens
cctctggggttcatct

SEQ ID NO: 5679676 - DNA, 19 bp, Homo sapiens
cctctggggttcatctagg

SEQ ID NO: 5679677 - DNA, 15 bp, Homo sapiens
cctctgggtccctcc

SEQ ID NO: 5679678 - DNA, 19 bp, Homo sapiens
cctctgggtccttggctcc

SEQ ID NO: 5679679 - DNA, 20 bp, Homo sapiens
cctctgggtctcagtgtcct

SEQ ID NO: 5679680 - DNA, 11 bp, Homo sapiens
cctctgggtga

SEQ ID NO: 5679681 - DNA, 14 bp, Homo sapiens
cctctgggtttcta

SEQ ID NO: 5679682 - DNA, 22 bp, Homo sapiens
cctctggtccacactagaaaga

SEQ ID NO: 5679683 - DNA, 23 bp, Homo sapiens
cctctggtccacactagaaagaa

SEQ ID NO: 5679684 - DNA, 16 bp, Homo sapiens
cctctggtctgggtgc

SEQ ID NO: 5679685 - DNA, 18 bp, Homo sapiens
cctctggtgtgtggtgag

SEQ ID NO: 5679686 - DNA, 19 bp, Homo sapiens
cctctggtgtgtggtgagg

SEQ ID NO: 5679687 - DNA, 20 bp, Homo sapiens
cctctggtgtgtggtgaggg

SEQ ID NO: 5679688 - DNA, 13 bp, Homo sapiens
cctctggttccac

SEQ ID NO: 5679689 - DNA, 17 bp, Homo sapiens
cctctggttccactcag

SEQ ID NO: 5679690 - DNA, 17 bp, Homo sapiens
cctctgtaccccatgac

SEQ ID NO: 5679691 - DNA, 17 bp, Homo sapiens
cctctgtaccgcccggc

SEQ ID NO: 5679692 - DNA, 18 bp, Homo sapiens
cctctgtaccgcccggca

SEQ ID NO: 5679693 - DNA, 17 bp, Homo sapiens
cctctgtagctccctcc

SEQ ID NO: 5679694 - DNA, 18 bp, Homo sapiens
cctctgtagctccctcct

SEQ ID NO: 5679695 - DNA, 17 bp, Homo sapiens
cctctgtatacaaggat

SEQ ID NO: 5679696 - DNA, 23 bp, Homo sapiens
cctctgtatttgaatcagcctac

SEQ ID NO: 5679697 - DNA, 19 bp, Homo sapiens
cctctgtcactgcaggcac

SEQ ID NO: 5679698 - DNA, 19 bp, Homo sapiens
cctctgtcagtcacagcca

SEQ ID NO: 5679699 - DNA, 21 bp, Homo sapiens
cctctgtcagtcacagccacc

SEQ ID NO: 5679700 - DNA, 15 bp, Homo sapiens
cctctgtcagtttgt

SEQ ID NO: 5679701 - DNA, 20 bp, Homo sapiens
cctctgtcatcactccctgg

SEQ ID NO: 5679702 - DNA, 14 bp, Homo sapiens
cctctgtcatttgt

SEQ ID NO: 5679703 - DNA, 15 bp, Homo sapiens
cctctgtcatttgtt

SEQ ID NO: 5679704 - DNA, 16 bp, Homo sapiens
cctctgtcatttgttg

SEQ ID NO: 5679705 - DNA, 16 bp, Homo sapiens
cctctgtccacatgtg

SEQ ID NO: 5679706 - DNA, 19 bp, Homo sapiens
cctctgtccagccagctcc

SEQ ID NO: 5679707 - DNA, 15 bp, Homo sapiens
cctctgtccagggcc

SEQ ID NO: 5679708 - DNA, 20 bp, Homo sapiens
cctctgtccagggccctgag

SEQ ID NO: 5679709 - DNA, 21 bp, Homo sapiens
cctctgtccagggccctgagc

SEQ ID NO: 5679710 - DNA, 15 bp, Homo sapiens
cctctgtccccaggc

SEQ ID NO: 5679711 - DNA, 17 bp, Homo sapiens
cctctgtccccaggcct

SEQ ID NO: 5679712 - DNA, 21 bp, Homo sapiens
cctctgtccccaggcctggct

SEQ ID NO: 5679713 - DNA, 14 bp, Homo sapiens
cctctgtccccgag

SEQ ID NO: 5679714 - DNA, 22 bp, Homo sapiens
cctctgtccccgagccgagctc

SEQ ID NO: 5679715 - DNA, 18 bp, Homo sapiens
cctctgtccccttctctc

SEQ ID NO: 5679716 - DNA, 18 bp, Homo sapiens
cctctgtccctctccttg

SEQ ID NO: 5679717 - DNA, 16 bp, Homo sapiens
cctctgtcctagactc

SEQ ID NO: 5679718 - DNA, 16 bp, Homo sapiens
cctctgtcctgacttc

SEQ ID NO: 5679719 - DNA, 17 bp, Homo sapiens
cctctgtcctgcttctg

SEQ ID NO: 5679720 - DNA, 18 bp, Homo sapiens
cctctgtccttcccccag

SEQ ID NO: 5679721 - DNA, 16 bp, Homo sapiens
cctctgtctagcatgc

SEQ ID NO: 5679722 - DNA, 17 bp, Homo sapiens
cctctgtctagcatgcc

SEQ ID NO: 5679723 - DNA, 11 bp, Homo sapiens
cctctgtctca

SEQ ID NO: 5679724 - DNA, 20 bp, Homo sapiens
cctctgtctcatcctcctgg

SEQ ID NO: 5679725 - DNA, 22 bp, Homo sapiens
cctctgtctcatcctcctggaa

SEQ ID NO: 5679726 - DNA, 23 bp, Homo sapiens
cctctgtctcatcctcctggaac

SEQ ID NO: 5679727 - DNA, 21 bp, Homo sapiens
cctctgtctcgagcgccctgc

SEQ ID NO: 5679728 - DNA, 23 bp, Homo sapiens
cctctgtctcgagcgccctgcag

SEQ ID NO: 5679729 - DNA, 14 bp, Homo sapiens
cctctgtctctgct

SEQ ID NO: 5679730 - DNA, 23 bp, Homo sapiens
cctctgtctctgctcttgcctgc

SEQ ID NO: 5679731 - DNA, 20 bp, Homo sapiens
cctctgtctgagacaggtgc

SEQ ID NO: 5679732 - DNA, 22 bp, Homo sapiens
cctctgtcttggctttcatgtt

SEQ ID NO: 5679733 - DNA, 22 bp, Homo sapiens
cctctgtcttgtgaaggcaggg

SEQ ID NO: 5679734 - DNA, 15 bp, Homo sapiens
cctctgtcttttctc

SEQ ID NO: 5679735 - DNA, 17 bp, Homo sapiens
cctctgtcttttctcct

SEQ ID NO: 5679736 - DNA, 11 bp, Homo sapiens
cctctgtgaaa

SEQ ID NO: 5679737 - DNA, 14 bp, Homo sapiens
cctctgtgaactgt

SEQ ID NO: 5679738 - DNA, 19 bp, Homo sapiens
cctctgtgaccaatgtctt

SEQ ID NO: 5679739 - DNA, 21 bp, Homo sapiens
cctctgtgaccaatgtcttga

SEQ ID NO: 5679740 - DNA, 14 bp, Homo sapiens
cctctgtgattaca

SEQ ID NO: 5679741 - DNA, 19 bp, Homo sapiens
cctctgtgattacatagat

SEQ ID NO: 5679742 - DNA, 22 bp, Homo sapiens
cctctgtgattacatagatcag

SEQ ID NO: 5679743 - DNA, 17 bp, Homo sapiens
cctctgtgcacagtggc

SEQ ID NO: 5679744 - DNA, 15 bp, Homo sapiens
cctctgtgcagacag

SEQ ID NO: 5679745 - DNA, 17 bp, Homo sapiens
cctctgtgccagggcag

SEQ ID NO: 5679746 - DNA, 18 bp, Homo sapiens
cctctgtgccagggcagc

SEQ ID NO: 5679747 - DNA, 13 bp, Homo sapiens
cctctgtgcccac

SEQ ID NO: 5679748 - DNA, 12 bp, Homo sapiens
cctctgtgccta

SEQ ID NO: 5679749 - DNA, 17 bp, Homo sapiens
cctctgtgcctaataaa

SEQ ID NO: 5679750 - DNA, 14 bp, Homo sapiens
cctctgtgccttct

SEQ ID NO: 5679751 - DNA, 17 bp, Homo sapiens
cctctgtgctgcatccc

SEQ ID NO: 5679752 - DNA, 22 bp, Homo sapiens
cctctgtgcttcgactactgct

SEQ ID NO: 5679753 - DNA, 14 bp, Homo sapiens
cctctgtggagcgc

SEQ ID NO: 5679754 - DNA, 23 bp, Homo sapiens
cctctgtggcattgaaatgagca

SEQ ID NO: 5679755 - DNA, 17 bp, Homo sapiens
cctctgtggccagctgc

SEQ ID NO: 5679756 - DNA, 22 bp, Homo sapiens
cctctgtggccagctgcatctg

SEQ ID NO: 5679757 - DNA, 19 bp, Homo sapiens
cctctgtggccaggagccc

SEQ ID NO: 5679758 - DNA, 21 bp, Homo sapiens
cctctgtggccaggagccctg

SEQ ID NO: 5679759 - DNA, 18 bp, Homo sapiens
cctctgtggtcacccatg

SEQ ID NO: 5679760 - DNA, 17 bp, Homo sapiens
cctctgtggtgtctgcc

SEQ ID NO: 5679761 - DNA, 18 bp, Homo sapiens
cctctgtgtatttgcttt

SEQ ID NO: 5679762 - DNA, 14 bp, Homo sapiens
cctctgtgtcactg

SEQ ID NO: 5679763 - DNA, 17 bp, Homo sapiens
cctctgtgtcactggct

SEQ ID NO: 5679764 - DNA, 22 bp, Homo sapiens
cctctgtgtcactggctgcctc

SEQ ID NO: 5679765 - DNA, 13 bp, Homo sapiens
cctctgtgtcctt

SEQ ID NO: 5679766 - DNA, 17 bp, Homo sapiens
cctctgtgtctgctctc

SEQ ID NO: 5679767 - DNA, 18 bp, Homo sapiens
cctctgttacccgcagat

SEQ ID NO: 5679768 - DNA, 21 bp, Homo sapiens
cctctgttacccgcagatcct

SEQ ID NO: 5679769 - DNA, 18 bp, Homo sapiens
cctctgttatttgtcctc

SEQ ID NO: 5679770 - DNA, 16 bp, Homo sapiens
cctctgttcaaagctg

SEQ ID NO: 5679771 - DNA, 16 bp, Homo sapiens
cctctgttcagtgtaa

SEQ ID NO: 5679772 - DNA, 22 bp, Homo sapiens
cctctgttcagtgtaaatagtt

SEQ ID NO: 5679773 - DNA, 18 bp, Homo sapiens
cctctgttccccacccag

SEQ ID NO: 5679774 - DNA, 16 bp, Homo sapiens
cctctgttccttccct

SEQ ID NO: 5679775 - DNA, 20 bp, Homo sapiens
cctctgttcctttctctggg

SEQ ID NO: 5679776 - DNA, 16 bp, Homo sapiens
cctctgttctctcccc

SEQ ID NO: 5679777 - DNA, 19 bp, Homo sapiens
cctctgttctctcccctca

SEQ ID NO: 5679778 - DNA, 20 bp, Homo sapiens
cctctgttctctcccctcac

SEQ ID NO: 5679779 - DNA, 21 bp, Homo sapiens
cctctgttctgcacacagcac

SEQ ID NO: 5679780 - DNA, 21 bp, Homo sapiens
cctctgttctggtggccccag

SEQ ID NO: 5679781 - DNA, 21 bp, Homo sapiens
cctctgttggaaattgggtgt

SEQ ID NO: 5679782 - DNA, 16 bp, Homo sapiens
cctctgttttctctct

SEQ ID NO: 5679783 - DNA, 19 bp, Homo sapiens
cctcttaaagaaaacccac

SEQ ID NO: 5679784 - DNA, 20 bp, Homo sapiens
cctcttaaagaaaacccacc

SEQ ID NO: 5679785 - DNA, 21 bp, Homo sapiens
cctcttaaagctgcctgtagt

SEQ ID NO: 5679786 - DNA, 23 bp, Homo sapiens
cctcttaaagctgcctgtagtta

SEQ ID NO: 5679787 - DNA, 17 bp, Homo sapiens
cctcttaaataaacctt

SEQ ID NO: 5679788 - DNA, 14 bp, Homo sapiens
cctcttaaattata

SEQ ID NO: 5679789 - DNA, 23 bp, Homo sapiens
cctcttaaattatatatttattt

SEQ ID NO: 5679790 - DNA, 19 bp, Homo sapiens
cctcttaagatctgactgc

SEQ ID NO: 5679791 - DNA, 15 bp, Homo sapiens
cctcttaagtgtgca

SEQ ID NO: 5679792 - DNA, 21 bp, Homo sapiens
cctcttaatgtatgattacat

SEQ ID NO: 5679793 - DNA, 17 bp, Homo sapiens
cctcttaccgtagcctc

SEQ ID NO: 5679794 - DNA, 19 bp, Homo sapiens
cctcttaccgtagcctccg

SEQ ID NO: 5679795 - DNA, 16 bp, Homo sapiens
cctcttactaatgtaa

SEQ ID NO: 5679796 - DNA, 14 bp, Homo sapiens
cctcttagaagaaa

SEQ ID NO: 5679797 - DNA, 21 bp, Homo sapiens
cctcttagaagaatattgtat

SEQ ID NO: 5679798 - DNA, 22 bp, Homo sapiens
cctcttagacttctgctttcca

SEQ ID NO: 5679799 - DNA, 20 bp, Homo sapiens
cctcttagcctctggatcta

SEQ ID NO: 5679800 - DNA, 17 bp, Homo sapiens
cctcttagctgagtgga

SEQ ID NO: 5679801 - DNA, 14 bp, Homo sapiens
cctcttagtccaca

SEQ ID NO: 5679802 - DNA, 19 bp, Homo sapiens
cctcttagtgattgtgtct

SEQ ID NO: 5679803 - DNA, 16 bp, Homo sapiens
cctcttatcactaaga

SEQ ID NO: 5679804 - DNA, 19 bp, Homo sapiens
cctcttatctcatcctttc

SEQ ID NO: 5679805 - DNA, 16 bp, Homo sapiens
cctcttatgggctggg

SEQ ID NO: 5679806 - DNA, 18 bp, Homo sapiens
cctcttatgtacctcttt

SEQ ID NO: 5679807 - DNA, 18 bp, Homo sapiens
cctcttcaaaaagcagag

SEQ ID NO: 5679808 - DNA, 14 bp, Homo sapiens
cctcttcaaagcag

SEQ ID NO: 5679809 - DNA, 21 bp, Homo sapiens
cctcttcacccaccccatgga

SEQ ID NO: 5679810 - DNA, 14 bp, Homo sapiens
cctcttcagaggcc

SEQ ID NO: 5679811 - DNA, 20 bp, Homo sapiens
cctcttccaaaggcagcgtg

SEQ ID NO: 5679812 - DNA, 21 bp, Homo sapiens
cctcttccagcttcttttgcc

SEQ ID NO: 5679813 - DNA, 15 bp, Homo sapiens
cctcttccaggcccc

SEQ ID NO: 5679814 - DNA, 17 bp, Homo sapiens
cctcttccagtgaacat

SEQ ID NO: 5679815 - DNA, 16 bp, Homo sapiens
cctcttcccagagtca

SEQ ID NO: 5679816 - DNA, 23 bp, Homo sapiens
cctcttcccatgactgcacccag

SEQ ID NO: 5679817 - DNA, 12 bp, Homo sapiens
cctcttccccag

SEQ ID NO: 5679818 - DNA, 16 bp, Homo sapiens
cctcttcccccaagat

SEQ ID NO: 5679819 - DNA, 21 bp, Homo sapiens
cctcttccccttgcccttgcc

SEQ ID NO: 5679820 - DNA, 15 bp, Homo sapiens
cctcttccctctccc

SEQ ID NO: 5679821 - DNA, 16 bp, Homo sapiens
cctcttccctctccct

SEQ ID NO: 5679822 - DNA, 15 bp, Homo sapiens
cctcttccctctgat

SEQ ID NO: 5679823 - DNA, 17 bp, Homo sapiens
cctcttccctctgggcc

SEQ ID NO: 5679824 - DNA, 13 bp, Homo sapiens
cctcttccctggt

SEQ ID NO: 5679825 - DNA, 18 bp, Homo sapiens
cctcttcccttagcctct

SEQ ID NO: 5679826 - DNA, 18 bp, Homo sapiens
cctcttcccttcctccat

SEQ ID NO: 5679827 - DNA, 17 bp, Homo sapiens
cctcttccgactctttc

SEQ ID NO: 5679828 - DNA, 16 bp, Homo sapiens
cctcttccgagctgct

SEQ ID NO: 5679829 - DNA, 20 bp, Homo sapiens
cctcttccggagatgtagca

SEQ ID NO: 5679830 - DNA, 18 bp, Homo sapiens
cctcttccgtgacgtcac

SEQ ID NO: 5679831 - DNA, 18 bp, Homo sapiens
cctcttccgttggaaaga

SEQ ID NO: 5679832 - DNA, 15 bp, Homo sapiens
cctcttcctactggt

SEQ ID NO: 5679833 - DNA, 21 bp, Homo sapiens
cctcttcctactggtctctct

SEQ ID NO: 5679834 - DNA, 10 bp, Homo sapiens
cctcttcctc

SEQ ID NO: 5679835 - DNA, 19 bp, Homo sapiens
cctcttcctccaaagcctg

SEQ ID NO: 5679836 - DNA, 14 bp, Homo sapiens
cctcttcctctgag

SEQ ID NO: 5679837 - DNA, 13 bp, Homo sapiens
cctcttcctctgg

SEQ ID NO: 5679838 - DNA, 16 bp, Homo sapiens
cctcttcctctgggca

SEQ ID NO: 5679839 - DNA, 23 bp, Homo sapiens
cctcttcctcttgaccctgcacc

SEQ ID NO: 5679840 - DNA, 13 bp, Homo sapiens
cctcttcctgccc

SEQ ID NO: 5679841 - DNA, 14 bp, Homo sapiens
cctcttcctgccct

SEQ ID NO: 5679842 - DNA, 20 bp, Homo sapiens
cctcttcctggaataaacat

SEQ ID NO: 5679843 - DNA, 20 bp, Homo sapiens
cctcttcctgtagtgcccct

SEQ ID NO: 5679844 - DNA, 13 bp, Homo sapiens
cctcttcctgtga

SEQ ID NO: 5679845 - DNA, 21 bp, Homo sapiens
cctcttcctgtgatccaccca

SEQ ID NO: 5679846 - DNA, 13 bp, Homo sapiens
cctcttccttccc

SEQ ID NO: 5679847 - DNA, 24 bp, Homo sapiens
cctcttccttctctactcatgcca

SEQ ID NO: 5679848 - DNA, 16 bp, Homo sapiens
cctcttccttgctgtg

SEQ ID NO: 5679849 - DNA, 13 bp, Homo sapiens
cctcttcggccct

SEQ ID NO: 5679850 - DNA, 20 bp, Homo sapiens
cctcttcggttgtcttgaaa

SEQ ID NO: 5679851 - DNA, 21 bp, Homo sapiens
cctcttctatctaatccttaa

SEQ ID NO: 5679852 - DNA, 17 bp, Homo sapiens
cctcttctattttgtaa

SEQ ID NO: 5679853 - DNA, 15 bp, Homo sapiens
cctcttctcaagtgc

SEQ ID NO: 5679854 - DNA, 15 bp, Homo sapiens
cctcttctcagctcc

SEQ ID NO: 5679855 - DNA, 15 bp, Homo sapiens
cctcttctctcagac

SEQ ID NO: 5679856 - DNA, 12 bp, Homo sapiens
cctcttctctcc

SEQ ID NO: 5679857 - DNA, 21 bp, Homo sapiens
cctcttctctgggcccagaga

SEQ ID NO: 5679858 - DNA, 17 bp, Homo sapiens
cctcttctcttcctgta

SEQ ID NO: 5679859 - DNA, 21 bp, Homo sapiens
cctcttctcttgacagtctga

SEQ ID NO: 5679860 - DNA, 20 bp, Homo sapiens
cctcttctcttttgccccct

SEQ ID NO: 5679861 - DNA, 14 bp, Homo sapiens
cctcttctgccagc

SEQ ID NO: 5679862 - DNA, 14 bp, Homo sapiens
cctcttctgctctt

SEQ ID NO: 5679863 - DNA, 17 bp, Homo sapiens
cctcttctgctcttttc

SEQ ID NO: 5679864 - DNA, 19 bp, Homo sapiens
cctcttctgctcttttcct

SEQ ID NO: 5679865 - DNA, 20 bp, Homo sapiens
cctcttctgcttaggagaga

SEQ ID NO: 5679866 - DNA, 13 bp, Homo sapiens
cctcttctgggag

SEQ ID NO: 5679867 - DNA, 18 bp, Homo sapiens
cctcttctgggagggcag

SEQ ID NO: 5679868 - DNA, 21 bp, Homo sapiens
cctcttctggtttccctttat

SEQ ID NO: 5679869 - DNA, 23 bp, Homo sapiens
cctcttctgtattttttttttcc

SEQ ID NO: 5679870 - DNA, 14 bp, Homo sapiens
cctcttctgtccca

SEQ ID NO: 5679871 - DNA, 15 bp, Homo sapiens
cctcttctgtcccaa

SEQ ID NO: 5679872 - DNA, 15 bp, Homo sapiens
cctcttcttctcaag

SEQ ID NO: 5679873 - DNA, 15 bp, Homo sapiens
cctcttcttcttcag

SEQ ID NO: 5679874 - DNA, 16 bp, Homo sapiens
cctcttcttcttcaga

SEQ ID NO: 5679875 - DNA, 17 bp, Homo sapiens
cctcttcttcttcagaa

SEQ ID NO: 5679876 - DNA, 18 bp, Homo sapiens
cctcttctttgtgccttt

SEQ ID NO: 5679877 - DNA, 20 bp, Homo sapiens
cctcttctttgtgcctttgg

SEQ ID NO: 5679878 - DNA, 19 bp, Homo sapiens
cctcttgaagagaaaaaag

SEQ ID NO: 5679879 - DNA, 14 bp, Homo sapiens
cctcttgaccaggc

SEQ ID NO: 5679880 - DNA, 15 bp, Homo sapiens
cctcttgaccaggct

SEQ ID NO: 5679881 - DNA, 15 bp, Homo sapiens
cctcttgagagaaac

SEQ ID NO: 5679882 - DNA, 14 bp, Homo sapiens
cctcttgagcagtg

SEQ ID NO: 5679883 - DNA, 19 bp, Homo sapiens
cctcttgagcagtggctgg

SEQ ID NO: 5679884 - DNA, 17 bp, Homo sapiens
cctcttgagttcctctg

SEQ ID NO: 5679885 - DNA, 14 bp, Homo sapiens
cctcttgccacatc

SEQ ID NO: 5679886 - DNA, 20 bp, Homo sapiens
cctcttgccacatcttgaaa

SEQ ID NO: 5679887 - DNA, 14 bp, Homo sapiens
cctcttgccagcct

SEQ ID NO: 5679888 - DNA, 15 bp, Homo sapiens
cctcttgccagcctc

SEQ ID NO: 5679889 - DNA, 16 bp, Homo sapiens
cctcttgccagcctcc

SEQ ID NO: 5679890 - DNA, 23 bp, Homo sapiens
cctcttgccagcctccttgctga

SEQ ID NO: 5679891 - DNA, 14 bp, Homo sapiens
cctcttgccagctc

SEQ ID NO: 5679892 - DNA, 13 bp, Homo sapiens
cctcttgccatcc

SEQ ID NO: 5679893 - DNA, 14 bp, Homo sapiens
cctcttgccatcct

SEQ ID NO: 5679894 - DNA, 15 bp, Homo sapiens
cctcttgccatcctg

SEQ ID NO: 5679895 - DNA, 23 bp, Homo sapiens
cctcttgccccaacccccagcac

SEQ ID NO: 5679896 - DNA, 21 bp, Homo sapiens
cctcttgccccccaccccagc

SEQ ID NO: 5679897 - DNA, 12 bp, Homo sapiens
cctcttgcccgc

SEQ ID NO: 5679898 - DNA, 13 bp, Homo sapiens
cctcttgcccgca

SEQ ID NO: 5679899 - DNA, 21 bp, Homo sapiens
cctcttgcccgtcggccctgc

SEQ ID NO: 5679900 - DNA, 17 bp, Homo sapiens
cctcttgcggtcccttc

SEQ ID NO: 5679901 - DNA, 18 bp, Homo sapiens
cctcttgctcagagctag

SEQ ID NO: 5679902 - DNA, 17 bp, Homo sapiens
cctcttgctgaaagcca

SEQ ID NO: 5679903 - DNA, 13 bp, Homo sapiens
cctcttgctggtg

SEQ ID NO: 5679904 - DNA, 14 bp, Homo sapiens
cctcttgctggtgc

SEQ ID NO: 5679905 - DNA, 15 bp, Homo sapiens
cctcttgctggtgca

SEQ ID NO: 5679906 - DNA, 14 bp, Homo sapiens
cctcttgctgtctc

SEQ ID NO: 5679907 - DNA, 19 bp, Homo sapiens
cctcttgctgtctctgctc

SEQ ID NO: 5679908 - DNA, 18 bp, Homo sapiens
cctcttggaattacaagc

SEQ ID NO: 5679909 - DNA, 23 bp, Homo sapiens
cctcttggaattacaagccctgg

SEQ ID NO: 5679910 - DNA, 15 bp, Homo sapiens
cctcttggacctctg

SEQ ID NO: 5679911 - DNA, 20 bp, Homo sapiens
cctcttggagaagtctcagc

SEQ ID NO: 5679912 - DNA, 21 bp, Homo sapiens
cctcttggagaagtctcagct

SEQ ID NO: 5679913 - DNA, 21 bp, Homo sapiens
cctcttggataccagctcagg

SEQ ID NO: 5679914 - DNA, 22 bp, Homo sapiens
cctcttggattaaggaagactg

SEQ ID NO: 5679915 - DNA, 23 bp, Homo sapiens
cctcttggcaagatgtttcttat

SEQ ID NO: 5679916 - DNA, 13 bp, Homo sapiens
cctcttggcacct

SEQ ID NO: 5679917 - DNA, 14 bp, Homo sapiens
cctcttggcacctg

SEQ ID NO: 5679918 - DNA, 15 bp, Homo sapiens
cctcttggcacctgc

SEQ ID NO: 5679919 - DNA, 15 bp, Homo sapiens
cctcttggctgcctt

SEQ ID NO: 5679920 - DNA, 20 bp, Homo sapiens
cctcttggcttctcagcccc

SEQ ID NO: 5679921 - DNA, 21 bp, Homo sapiens
cctcttggcttctcagcccct

SEQ ID NO: 5679922 - DNA, 13 bp, Homo sapiens
cctcttgggagac

SEQ ID NO: 5679923 - DNA, 14 bp, Homo sapiens
cctcttgggagacg

SEQ ID NO: 5679924 - DNA, 22 bp, Homo sapiens
cctcttgggcatgctcagccct

SEQ ID NO: 5679925 - DNA, 19 bp, Homo sapiens
cctcttggggaaggggcac

SEQ ID NO: 5679926 - DNA, 21 bp, Homo sapiens
cctcttggggaaggggcacct

SEQ ID NO: 5679927 - DNA, 22 bp, Homo sapiens
cctcttggggaaggggcacctc

SEQ ID NO: 5679928 - DNA, 22 bp, Homo sapiens
cctcttggggagtttagggtgg

SEQ ID NO: 5679929 - DNA, 20 bp, Homo sapiens
cctcttggtgggtgtggcca

SEQ ID NO: 5679930 - DNA, 23 bp, Homo sapiens
cctcttggtgggtgtggccagca

SEQ ID NO: 5679931 - DNA, 19 bp, Homo sapiens
cctcttggtgtctggtttc

SEQ ID NO: 5679932 - DNA, 12 bp, Homo sapiens
cctcttgtaaat

SEQ ID NO: 5679933 - DNA, 13 bp, Homo sapiens
cctcttgtaaata

SEQ ID NO: 5679934 - DNA, 16 bp, Homo sapiens
cctcttgtagtcttgg

SEQ ID NO: 5679935 - DNA, 22 bp, Homo sapiens
cctcttgtcagtgtagacacag

SEQ ID NO: 5679936 - DNA, 16 bp, Homo sapiens
cctcttgtcccttggc

SEQ ID NO: 5679937 - DNA, 13 bp, Homo sapiens
cctcttgtcctgg

SEQ ID NO: 5679938 - DNA, 16 bp, Homo sapiens
cctcttgtcctggccc

SEQ ID NO: 5679939 - DNA, 13 bp, Homo sapiens
cctcttgtgctca

SEQ ID NO: 5679940 - DNA, 13 bp, Homo sapiens
cctcttgtgctga

SEQ ID NO: 5679941 - DNA, 22 bp, Homo sapiens
cctcttgtggaccccgcctgcc

SEQ ID NO: 5679942 - DNA, 16 bp, Homo sapiens
cctcttgttactccct

SEQ ID NO: 5679943 - DNA, 17 bp, Homo sapiens
cctcttgttcctgaaat

SEQ ID NO: 5679944 - DNA, 23 bp, Homo sapiens
cctcttgttcttagggcttggat

SEQ ID NO: 5679945 - DNA, 12 bp, Homo sapiens
cctcttgttgca

SEQ ID NO: 5679946 - DNA, 18 bp, Homo sapiens
cctcttgtttctgtgccc

SEQ ID NO: 5679947 - DNA, 12 bp, Homo sapiens
cctcttgttttg

SEQ ID NO: 5679948 - DNA, 15 bp, Homo sapiens
cctcttgttttgttt

SEQ ID NO: 5679949 - DNA, 13 bp, Homo sapiens
cctctttaaaaca

SEQ ID NO: 5679950 - DNA, 14 bp, Homo sapiens
cctctttaaattat

SEQ ID NO: 5679951 - DNA, 15 bp, Homo sapiens
cctctttaaattatg

SEQ ID NO: 5679952 - DNA, 12 bp, Homo sapiens
cctctttaagag

SEQ ID NO: 5679953 - DNA, 17 bp, Homo sapiens
cctctttaatgctgtct

SEQ ID NO: 5679954 - DNA, 19 bp, Homo sapiens
cctctttactcccttcctg

SEQ ID NO: 5679955 - DNA, 19 bp, Homo sapiens
cctctttagagttagactg

SEQ ID NO: 5679956 - DNA, 16 bp, Homo sapiens
cctctttcagaaaaca

SEQ ID NO: 5679957 - DNA, 21 bp, Homo sapiens
cctctttcagaaaacagaaaa

SEQ ID NO: 5679958 - DNA, 13 bp, Homo sapiens
cctctttcagctc

SEQ ID NO: 5679959 - DNA, 19 bp, Homo sapiens
cctctttcatctcctgagt

SEQ ID NO: 5679960 - DNA, 21 bp, Homo sapiens
cctctttcccaccctccacct

SEQ ID NO: 5679961 - DNA, 11 bp, Homo sapiens
cctctttcccc

SEQ ID NO: 5679962 - DNA, 16 bp, Homo sapiens
cctctttccccacctc

SEQ ID NO: 5679963 - DNA, 15 bp, Homo sapiens
cctctttccccactg

SEQ ID NO: 5679964 - DNA, 16 bp, Homo sapiens
cctctttcccctcctt

SEQ ID NO: 5679965 - DNA, 11 bp, Homo sapiens
cctctttccct

SEQ ID NO: 5679966 - DNA, 15 bp, Homo sapiens
cctctttccctagga

SEQ ID NO: 5679967 - DNA, 19 bp, Homo sapiens
cctctttccctcccttcct

SEQ ID NO: 5679968 - DNA, 14 bp, Homo sapiens
cctctttccctgcg

SEQ ID NO: 5679969 - DNA, 15 bp, Homo sapiens
cctctttccctgcga

SEQ ID NO: 5679970 - DNA, 17 bp, Homo sapiens
cctctttcctctctggc

SEQ ID NO: 5679971 - DNA, 23 bp, Homo sapiens
cctctttcctctctttgttctca

SEQ ID NO: 5679972 - DNA, 15 bp, Homo sapiens
cctctttctagcctg

SEQ ID NO: 5679973 - DNA, 23 bp, Homo sapiens
cctctttctagcctggggcttga

SEQ ID NO: 5679974 - DNA, 14 bp, Homo sapiens
cctctttctcagtt

SEQ ID NO: 5679975 - DNA, 18 bp, Homo sapiens
cctctttctctccccaac

SEQ ID NO: 5679976 - DNA, 17 bp, Homo sapiens
cctctttctctccttct

SEQ ID NO: 5679977 - DNA, 18 bp, Homo sapiens
cctctttctctctgtgtg

SEQ ID NO: 5679978 - DNA, 19 bp, Homo sapiens
cctctttctctctgtgtgg

SEQ ID NO: 5679979 - DNA, 22 bp, Homo sapiens
cctctttctctctgtgtggcaa

SEQ ID NO: 5679980 - DNA, 13 bp, Homo sapiens
cctctttctcttt

SEQ ID NO: 5679981 - DNA, 21 bp, Homo sapiens
cctctttctctttcttccttt

SEQ ID NO: 5679982 - DNA, 12 bp, Homo sapiens
cctctttctgct

SEQ ID NO: 5679983 - DNA, 18 bp, Homo sapiens
cctctttctgctctgcca

SEQ ID NO: 5679984 - DNA, 15 bp, Homo sapiens
cctctttcttataat

SEQ ID NO: 5679985 - DNA, 12 bp, Homo sapiens
cctctttcttca

SEQ ID NO: 5679986 - DNA, 21 bp, Homo sapiens
cctctttcttcaattaatgga

SEQ ID NO: 5679987 - DNA, 13 bp, Homo sapiens
cctctttgccctg

SEQ ID NO: 5679988 - DNA, 16 bp, Homo sapiens
cctctttgcctgtgtg

SEQ ID NO: 5679989 - DNA, 18 bp, Homo sapiens
cctctttgggcagtgcca

SEQ ID NO: 5679990 - DNA, 21 bp, Homo sapiens
cctctttggtggcatggaagg

SEQ ID NO: 5679991 - DNA, 14 bp, Homo sapiens
cctctttgtctaaa

SEQ ID NO: 5679992 - DNA, 19 bp, Homo sapiens
cctctttgtctaaaacaat

SEQ ID NO: 5679993 - DNA, 22 bp, Homo sapiens
cctctttgtctgcgtgggtcag

SEQ ID NO: 5679994 - DNA, 19 bp, Homo sapiens
cctctttgttttgttttaa

SEQ ID NO: 5679995 - DNA, 13 bp, Homo sapiens
cctcttttaccaa

SEQ ID NO: 5679996 - DNA, 20 bp, Homo sapiens
cctcttttcctggcagctgc

SEQ ID NO: 5679997 - DNA, 14 bp, Homo sapiens
cctcttttctctgc

SEQ ID NO: 5679998 - DNA, 19 bp, Homo sapiens
cctcttttgttaaataata

SEQ ID NO: 5679999 - DNA, 21 bp, Homo sapiens
cctctttttaaagttcaaact

SEQ ID NO: 5680000 - DNA, 16 bp, Homo sapiens
cctctttttaaggaca

SEQ ID NO: 5680001 - DNA, 16 bp, Homo sapiens
cctctttttcctcctg

SEQ ID NO: 5680002 - DNA, 21 bp, Homo sapiens
cctctttttcctcctggacac

SEQ ID NO: 5680003 - DNA, 18 bp, Homo sapiens
cctctttttccttcttca

SEQ ID NO: 5680004 - DNA, 16 bp, Homo sapiens
cctctttttctctgta

SEQ ID NO: 5680005 - DNA, 19 bp, Homo sapiens
cctctttttgccctttagg

SEQ ID NO: 5680006 - DNA, 21 bp, Homo sapiens
cctgaaaaaaaacctgagatt

SEQ ID NO: 5680007 - DNA, 20 bp, Homo sapiens
cctgaaaaactgatcaaaaa

SEQ ID NO: 5680008 - DNA, 19 bp, Homo sapiens
cctgaaaaaggaaaaatat

SEQ ID NO: 5680009 - DNA, 21 bp, Homo sapiens
cctgaaaacgaaggggccccg

SEQ ID NO: 5680010 - DNA, 13 bp, Homo sapiens
cctgaaaagctgc

SEQ ID NO: 5680011 - DNA, 11 bp, Homo sapiens
cctgaaaaggg

SEQ ID NO: 5680012 - DNA, 22 bp, Homo sapiens
cctgaaaagggcggaagagtta

SEQ ID NO: 5680013 - DNA, 14 bp, Homo sapiens
cctgaaaatatgtc

SEQ ID NO: 5680014 - DNA, 23 bp, Homo sapiens
cctgaaaatgtttttctgccagg

SEQ ID NO: 5680015 - DNA, 15 bp, Homo sapiens
cctgaaaattccaat

SEQ ID NO: 5680016 - DNA, 13 bp, Homo sapiens
cctgaaacactgg

SEQ ID NO: 5680017 - DNA, 14 bp, Homo sapiens
cctgaaacactgga

SEQ ID NO: 5680018 - DNA, 13 bp, Homo sapiens
cctgaaacacttt

SEQ ID NO: 5680019 - DNA, 18 bp, Homo sapiens
cctgaaacagccatgtcc

SEQ ID NO: 5680020 - DNA, 21 bp, Homo sapiens
cctgaaacatgtgcccctgcc

SEQ ID NO: 5680021 - DNA, 19 bp, Homo sapiens
cctgaaacccaaagccctg

SEQ ID NO: 5680022 - DNA, 19 bp, Homo sapiens
cctgaaacccgccctcagg

SEQ ID NO: 5680023 - DNA, 20 bp, Homo sapiens
cctgaaacctagtactgccc

SEQ ID NO: 5680024 - DNA, 20 bp, Homo sapiens
cctgaaacgctcctttgtgt

SEQ ID NO: 5680025 - DNA, 14 bp, Homo sapiens
cctgaaactatatt

SEQ ID NO: 5680026 - DNA, 16 bp, Homo sapiens
cctgaaagagaggact

SEQ ID NO: 5680027 - DNA, 23 bp, Homo sapiens
cctgaaagaggaatgaagtactc

SEQ ID NO: 5680028 - DNA, 13 bp, Homo sapiens
cctgaaagccctg

SEQ ID NO: 5680029 - DNA, 14 bp, Homo sapiens
cctgaaagccctga

SEQ ID NO: 5680030 - DNA, 14 bp, Homo sapiens
cctgaaagcctcac

SEQ ID NO: 5680031 - DNA, 14 bp, Homo sapiens
cctgaaagcggctg

SEQ ID NO: 5680032 - DNA, 19 bp, Homo sapiens
cctgaaagcggctgcctcc

SEQ ID NO: 5680033 - DNA, 18 bp, Homo sapiens
cctgaaaggaacactggc

SEQ ID NO: 5680034 - DNA, 14 bp, Homo sapiens
cctgaaagggcact

SEQ ID NO: 5680035 - DNA, 18 bp, Homo sapiens
cctgaaagggcccttccc

SEQ ID NO: 5680036 - DNA, 21 bp, Homo sapiens
cctgaaagtaatttcaagaat

SEQ ID NO: 5680037 - DNA, 23 bp, Homo sapiens
cctgaaagtaatttcaagaatgt

SEQ ID NO: 5680038 - DNA, 20 bp, Homo sapiens
cctgaaagttggggcccagt

SEQ ID NO: 5680039 - DNA, 23 bp, Homo sapiens
cctgaaagttggggcccagtcct

SEQ ID NO: 5680040 - DNA, 15 bp, Homo sapiens
cctgaaataaacact

SEQ ID NO: 5680041 - DNA, 10 bp, Homo sapiens
cctgaaatcc

SEQ ID NO: 5680042 - DNA, 11 bp, Homo sapiens
cctgaaatctg

SEQ ID NO: 5680043 - DNA, 22 bp, Homo sapiens
cctgaaatgccaagtgcctgct

SEQ ID NO: 5680044 - DNA, 15 bp, Homo sapiens
cctgaaatggcctgt

SEQ ID NO: 5680045 - DNA, 22 bp, Homo sapiens
cctgaaatggcctgtccctagg

SEQ ID NO: 5680046 - DNA, 12 bp, Homo sapiens
cctgaaatgtgt

SEQ ID NO: 5680047 - DNA, 15 bp, Homo sapiens
cctgaaatgtttcca

SEQ ID NO: 5680048 - DNA, 19 bp, Homo sapiens
cctgaaatgtttccaggca

SEQ ID NO: 5680049 - DNA, 14 bp, Homo sapiens
cctgaaatttcaga

SEQ ID NO: 5680050 - DNA, 19 bp, Homo sapiens
cctgaacaaagcacctcaa

SEQ ID NO: 5680051 - DNA, 15 bp, Homo sapiens
cctgaacaagaaaga

SEQ ID NO: 5680052 - DNA, 16 bp, Homo sapiens
cctgaacaagaaagag

SEQ ID NO: 5680053 - DNA, 17 bp, Homo sapiens
cctgaacaagaaagagt

SEQ ID NO: 5680054 - DNA, 15 bp, Homo sapiens
cctgaacaagaattg

SEQ ID NO: 5680055 - DNA, 16 bp, Homo sapiens
cctgaacaagaattgg

SEQ ID NO: 5680056 - DNA, 13 bp, Homo sapiens
cctgaacactcat

SEQ ID NO: 5680057 - DNA, 14 bp, Homo sapiens
cctgaacagaagct

SEQ ID NO: 5680058 - DNA, 13 bp, Homo sapiens
cctgaacagatgt

SEQ ID NO: 5680059 - DNA, 20 bp, Homo sapiens
cctgaacagccctctctctc

SEQ ID NO: 5680060 - DNA, 15 bp, Homo sapiens
cctgaacatctgtgt

SEQ ID NO: 5680061 - DNA, 15 bp, Homo sapiens
cctgaacatgacatt

SEQ ID NO: 5680062 - DNA, 20 bp, Homo sapiens
cctgaacattcttgctcaag

SEQ ID NO: 5680063 - DNA, 21 bp, Homo sapiens
cctgaacatttagtaccctgc

SEQ ID NO: 5680064 - DNA, 23 bp, Homo sapiens
cctgaacatttagtaccctgcag

SEQ ID NO: 5680065 - DNA, 14 bp, Homo sapiens
cctgaaccacagcg

SEQ ID NO: 5680066 - DNA, 17 bp, Homo sapiens
cctgaaccacgaggctg

SEQ ID NO: 5680067 - DNA, 13 bp, Homo sapiens
cctgaaccagtcc

SEQ ID NO: 5680068 - DNA, 24 bp, Homo sapiens
cctgaaccagtcctgctgcctgga

SEQ ID NO: 5680069 - DNA, 23 bp, Homo sapiens
cctgaacccagaaacaacacaat

SEQ ID NO: 5680070 - DNA, 18 bp, Homo sapiens
cctgaaccccatgggctt

SEQ ID NO: 5680071 - DNA, 20 bp, Homo sapiens
cctgaaccccatgggcttgg

SEQ ID NO: 5680072 - DNA, 14 bp, Homo sapiens
cctgaacccctggc

SEQ ID NO: 5680073 - DNA, 22 bp, Homo sapiens
cctgaacccctggccagctctg

SEQ ID NO: 5680074 - DNA, 14 bp, Homo sapiens
cctgaaccgactga

SEQ ID NO: 5680075 - DNA, 21 bp, Homo sapiens
cctgaaccgcacagctcagga

SEQ ID NO: 5680076 - DNA, 15 bp, Homo sapiens
cctgaaccgtgtgct

SEQ ID NO: 5680077 - DNA, 16 bp, Homo sapiens
cctgaacctcagtttc

SEQ ID NO: 5680078 - DNA, 17 bp, Homo sapiens
cctgaacctcagtttcc

SEQ ID NO: 5680079 - DNA, 22 bp, Homo sapiens
cctgaacgttttcttctttccc

SEQ ID NO: 5680080 - DNA, 21 bp, Homo sapiens
cctgaactaggtgctggcatg

SEQ ID NO: 5680081 - DNA, 14 bp, Homo sapiens
cctgaactatttat

SEQ ID NO: 5680082 - DNA, 14 bp, Homo sapiens
cctgaactccagag

SEQ ID NO: 5680083 - DNA, 16 bp, Homo sapiens
cctgaactgaggcctt

SEQ ID NO: 5680084 - DNA, 14 bp, Homo sapiens
cctgaactggccac

SEQ ID NO: 5680085 - DNA, 17 bp, Homo sapiens
cctgaactttctccctc

SEQ ID NO: 5680086 - DNA, 16 bp, Homo sapiens
cctgaagaaccagtcc

SEQ ID NO: 5680087 - DNA, 19 bp, Homo sapiens
cctgaagaatctcgactct

SEQ ID NO: 5680088 - DNA, 18 bp, Homo sapiens
cctgaagaattaagatac

SEQ ID NO: 5680089 - DNA, 14 bp, Homo sapiens
cctgaagaccccag

SEQ ID NO: 5680090 - DNA, 15 bp, Homo sapiens
cctgaagaccccaga

SEQ ID NO: 5680091 - DNA, 22 bp, Homo sapiens
cctgaagacgagcatccccctc

SEQ ID NO: 5680092 - DNA, 21 bp, Homo sapiens
cctgaagactcattcttctgt

SEQ ID NO: 5680093 - DNA, 22 bp, Homo sapiens
cctgaagagtttgtaaatgact

SEQ ID NO: 5680094 - DNA, 18 bp, Homo sapiens
cctgaagatcaagccagt

SEQ ID NO: 5680095 - DNA, 15 bp, Homo sapiens
cctgaagatcagagc

SEQ ID NO: 5680096 - DNA, 16 bp, Homo sapiens
cctgaagatcagagct

SEQ ID NO: 5680097 - DNA, 17 bp, Homo sapiens
cctgaagatcagagctg

SEQ ID NO: 5680098 - DNA, 15 bp, Homo sapiens
cctgaagatgtctcc

SEQ ID NO: 5680099 - DNA, 17 bp, Homo sapiens
cctgaagatgtctcctc

SEQ ID NO: 5680100 - DNA, 13 bp, Homo sapiens
cctgaagccagat

SEQ ID NO: 5680101 - DNA, 12 bp, Homo sapiens
cctgaagccagc

SEQ ID NO: 5680102 - DNA, 14 bp, Homo sapiens
cctgaagccagcct

SEQ ID NO: 5680103 - DNA, 17 bp, Homo sapiens
cctgaagccagccttct

SEQ ID NO: 5680104 - DNA, 14 bp, Homo sapiens
cctgaagccagctg

SEQ ID NO: 5680105 - DNA, 17 bp, Homo sapiens
cctgaagccattggaga

SEQ ID NO: 5680106 - DNA, 23 bp, Homo sapiens
cctgaagcccagcgacacagaag

SEQ ID NO: 5680107 - DNA, 12 bp, Homo sapiens
cctgaagcctcc

SEQ ID NO: 5680108 - DNA, 14 bp, Homo sapiens
cctgaagcctccgt

SEQ ID NO: 5680109 - DNA, 21 bp, Homo sapiens
cctgaagcctccgtggaacat

SEQ ID NO: 5680110 - DNA, 13 bp, Homo sapiens
cctgaagcctctg

SEQ ID NO: 5680111 - DNA, 14 bp, Homo sapiens
cctgaagcctggat

SEQ ID NO: 5680112 - DNA, 16 bp, Homo sapiens
cctgaagcctggattc

SEQ ID NO: 5680113 - DNA, 18 bp, Homo sapiens
cctgaagcctggattcca

SEQ ID NO: 5680114 - DNA, 23 bp, Homo sapiens
cctgaagctatcgtaaaattaag

SEQ ID NO: 5680115 - DNA, 13 bp, Homo sapiens
cctgaagctgctg

SEQ ID NO: 5680116 - DNA, 15 bp, Homo sapiens
cctgaagctgctgtg

SEQ ID NO: 5680117 - DNA, 14 bp, Homo sapiens
cctgaagctgctta

SEQ ID NO: 5680118 - DNA, 17 bp, Homo sapiens
cctgaagcttcggccgc

SEQ ID NO: 5680119 - DNA, 22 bp, Homo sapiens
cctgaaggacctccccctgtgt

SEQ ID NO: 5680120 - DNA, 17 bp, Homo sapiens
cctgaaggaggcggggc

SEQ ID NO: 5680121 - DNA, 18 bp, Homo sapiens
cctgaaggcacagctaac

SEQ ID NO: 5680122 - DNA, 22 bp, Homo sapiens
cctgaaggcacagctaaccact

SEQ ID NO: 5680123 - DNA, 17 bp, Homo sapiens
cctgaaggcagggctcc

SEQ ID NO: 5680124 - DNA, 14 bp, Homo sapiens
cctgaaggccccgc

SEQ ID NO: 5680125 - DNA, 16 bp, Homo sapiens
cctgaaggcctgaggt

SEQ ID NO: 5680126 - DNA, 14 bp, Homo sapiens
cctgaaggggcgtc

SEQ ID NO: 5680127 - DNA, 16 bp, Homo sapiens
cctgaaggggcgtctg

SEQ ID NO: 5680128 - DNA, 16 bp, Homo sapiens
cctgaaggggttttct

SEQ ID NO: 5680129 - DNA, 17 bp, Homo sapiens
cctgaaggggttttctt

SEQ ID NO: 5680130 - DNA, 18 bp, Homo sapiens
cctgaaggtcccctggca

SEQ ID NO: 5680131 - DNA, 19 bp, Homo sapiens
cctgaagtaagcaaagact

SEQ ID NO: 5680132 - DNA, 22 bp, Homo sapiens
cctgaagtcaaaccttaagata

SEQ ID NO: 5680133 - DNA, 23 bp, Homo sapiens
cctgaagtgacctcactggcctg

SEQ ID NO: 5680134 - DNA, 14 bp, Homo sapiens
cctgaagtgtcgag

SEQ ID NO: 5680135 - DNA, 17 bp, Homo sapiens
cctgaagttcaccatta

SEQ ID NO: 5680136 - DNA, 13 bp, Homo sapiens
cctgaagttttat

SEQ ID NO: 5680137 - DNA, 16 bp, Homo sapiens
cctgaataaaccaaga

SEQ ID NO: 5680138 - DNA, 15 bp, Homo sapiens
cctgaataaagagcc

SEQ ID NO: 5680139 - DNA, 12 bp, Homo sapiens
cctgaatatttt

SEQ ID NO: 5680140 - DNA, 12 bp, Homo sapiens
cctgaatcagag

SEQ ID NO: 5680141 - DNA, 14 bp, Homo sapiens
cctgaatcagctgg

SEQ ID NO: 5680142 - DNA, 19 bp, Homo sapiens
cctgaatcatgagcctgct

SEQ ID NO: 5680143 - DNA, 21 bp, Homo sapiens
cctgaatcatgagcctgctgg

SEQ ID NO: 5680144 - DNA, 17 bp, Homo sapiens
cctgaatccaaactaat

SEQ ID NO: 5680145 - DNA, 20 bp, Homo sapiens
cctgaatccaaactaatcca

SEQ ID NO: 5680146 - DNA, 15 bp, Homo sapiens
cctgaatccatcagg

SEQ ID NO: 5680147 - DNA, 19 bp, Homo sapiens
cctgaatccatcaggactt

SEQ ID NO: 5680148 - DNA, 21 bp, Homo sapiens
cctgaatccatcaggacttgg

SEQ ID NO: 5680149 - DNA, 22 bp, Homo sapiens
cctgaatcccccttgccacccc

SEQ ID NO: 5680150 - DNA, 19 bp, Homo sapiens
cctgaatccgtacttgggt

SEQ ID NO: 5680151 - DNA, 20 bp, Homo sapiens
cctgaatctgaccacagaca

SEQ ID NO: 5680152 - DNA, 21 bp, Homo sapiens
cctgaatctgctgagaggcac

SEQ ID NO: 5680153 - DNA, 20 bp, Homo sapiens
cctgaatcttttttttatat

SEQ ID NO: 5680154 - DNA, 21 bp, Homo sapiens
cctgaatgaggcggagctcca

SEQ ID NO: 5680155 - DNA, 20 bp, Homo sapiens
cctgaatggctttgtcttga

SEQ ID NO: 5680156 - DNA, 22 bp, Homo sapiens
cctgaatggttccatgcctgag

SEQ ID NO: 5680157 - DNA, 23 bp, Homo sapiens
cctgaatggttccatgcctgagg

SEQ ID NO: 5680158 - DNA, 23 bp, Homo sapiens
cctgaatgtattgaacttggaaa

SEQ ID NO: 5680159 - DNA, 21 bp, Homo sapiens
cctgaatgtttaaagatcatg

SEQ ID NO: 5680160 - DNA, 13 bp, Homo sapiens
cctgaattaaagt

SEQ ID NO: 5680161 - DNA, 20 bp, Homo sapiens
cctgaattaaagtctacact

SEQ ID NO: 5680162 - DNA, 21 bp, Homo sapiens
cctgaattaactatcatcagt

SEQ ID NO: 5680163 - DNA, 16 bp, Homo sapiens
cctgaattcattgtct

SEQ ID NO: 5680164 - DNA, 15 bp, Homo sapiens
cctgaattgaaagag

SEQ ID NO: 5680165 - DNA, 23 bp, Homo sapiens
cctgaattgtttgatattgtcac

SEQ ID NO: 5680166 - DNA, 19 bp, Homo sapiens
cctgaatttattattgttc

SEQ ID NO: 5680167 - DNA, 13 bp, Homo sapiens
cctgacaaatttt

SEQ ID NO: 5680168 - DNA, 14 bp, Homo sapiens
cctgacaacactca

SEQ ID NO: 5680169 - DNA, 20 bp, Homo sapiens
cctgacaacagcctgagaaa

SEQ ID NO: 5680170 - DNA, 16 bp, Homo sapiens
cctgacaactcatttt

SEQ ID NO: 5680171 - DNA, 22 bp, Homo sapiens
cctgacaactcattttcatatt

SEQ ID NO: 5680172 - DNA, 12 bp, Homo sapiens
cctgacaaggcc

SEQ ID NO: 5680173 - DNA, 14 bp, Homo sapiens
cctgacaaggccag

SEQ ID NO: 5680174 - DNA, 18 bp, Homo sapiens
cctgacaatggcagctag

SEQ ID NO: 5680175 - DNA, 16 bp, Homo sapiens
cctgacaattatgaaa

SEQ ID NO: 5680176 - DNA, 13 bp, Homo sapiens
cctgacacaggcc

SEQ ID NO: 5680177 - DNA, 22 bp, Homo sapiens
cctgacacaggggacactgaac

SEQ ID NO: 5680178 - DNA, 18 bp, Homo sapiens
cctgacaccccacttagc

SEQ ID NO: 5680179 - DNA, 15 bp, Homo sapiens
cctgacaccccctcc

SEQ ID NO: 5680180 - DNA, 16 bp, Homo sapiens
cctgacaccccctccc

SEQ ID NO: 5680181 - DNA, 12 bp, Homo sapiens
cctgacacctgc

SEQ ID NO: 5680182 - DNA, 18 bp, Homo sapiens
cctgacactgagccccac

SEQ ID NO: 5680183 - DNA, 15 bp, Homo sapiens
cctgacactgctgga

SEQ ID NO: 5680184 - DNA, 14 bp, Homo sapiens
cctgacagaaggtg

SEQ ID NO: 5680185 - DNA, 15 bp, Homo sapiens
cctgacagaaggtgc

SEQ ID NO: 5680186 - DNA, 17 bp, Homo sapiens
cctgacagaaggtgcca

SEQ ID NO: 5680187 - DNA, 23 bp, Homo sapiens
cctgacagagggatggaggaaga

SEQ ID NO: 5680188 - DNA, 19 bp, Homo sapiens
cctgacagatgcctggtga

SEQ ID NO: 5680189 - DNA, 21 bp, Homo sapiens
cctgacagatgtcagccgagc

SEQ ID NO: 5680190 - DNA, 17 bp, Homo sapiens
cctgacagcaaacacag

SEQ ID NO: 5680191 - DNA, 12 bp, Homo sapiens
cctgacagcact

SEQ ID NO: 5680192 - DNA, 15 bp, Homo sapiens
cctgacagcatcctc

SEQ ID NO: 5680193 - DNA, 20 bp, Homo sapiens
cctgacagcccctccctcct

SEQ ID NO: 5680194 - DNA, 13 bp, Homo sapiens
cctgacagccttc

SEQ ID NO: 5680195 - DNA, 16 bp, Homo sapiens
cctgacagcgacagaa

SEQ ID NO: 5680196 - DNA, 17 bp, Homo sapiens
cctgacagcgacagaaa

SEQ ID NO: 5680197 - DNA, 23 bp, Homo sapiens
cctgacaggctgtgactcttctc

SEQ ID NO: 5680198 - DNA, 22 bp, Homo sapiens
cctgacaggtgaggtctgttcc

SEQ ID NO: 5680199 - DNA, 21 bp, Homo sapiens
cctgacatcaaaaaaggcagt

SEQ ID NO: 5680200 - DNA, 17 bp, Homo sapiens
cctgacatcacagcagc

SEQ ID NO: 5680201 - DNA, 19 bp, Homo sapiens
cctgacatcacagcagcct

SEQ ID NO: 5680202 - DNA, 21 bp, Homo sapiens
cctgacatcacagcagcctcc

SEQ ID NO: 5680203 - DNA, 22 bp, Homo sapiens
cctgacatcatcattcttgtgg

SEQ ID NO: 5680204 - DNA, 15 bp, Homo sapiens
cctgacatgctaacc

SEQ ID NO: 5680205 - DNA, 14 bp, Homo sapiens
cctgacatgtctca

SEQ ID NO: 5680206 - DNA, 18 bp, Homo sapiens
cctgacattccttgctga

SEQ ID NO: 5680207 - DNA, 16 bp, Homo sapiens
cctgacattggagcct

SEQ ID NO: 5680208 - DNA, 11 bp, Homo sapiens
cctgaccaaag

SEQ ID NO: 5680209 - DNA, 19 bp, Homo sapiens
cctgaccaacatggagaaa

SEQ ID NO: 5680210 - DNA, 12 bp, Homo sapiens
cctgaccaccct

SEQ ID NO: 5680211 - DNA, 23 bp, Homo sapiens
cctgaccaccctcccctctcttg

SEQ ID NO: 5680212 - DNA, 13 bp, Homo sapiens
cctgaccaccctg

SEQ ID NO: 5680213 - DNA, 14 bp, Homo sapiens
cctgaccaccctgc

SEQ ID NO: 5680214 - DNA, 15 bp, Homo sapiens
cctgaccaccctgcc

SEQ ID NO: 5680215 - DNA, 16 bp, Homo sapiens
cctgaccaccctgcct

SEQ ID NO: 5680216 - DNA, 21 bp, Homo sapiens
cctgaccaccctgcctgtgga

SEQ ID NO: 5680217 - DNA, 16 bp, Homo sapiens
cctgaccactcagaga

SEQ ID NO: 5680218 - DNA, 20 bp, Homo sapiens
cctgaccactcagagacatg

SEQ ID NO: 5680219 - DNA, 14 bp, Homo sapiens
cctgaccagctgct

SEQ ID NO: 5680220 - DNA, 22 bp, Homo sapiens
cctgaccataatcctagccccg

SEQ ID NO: 5680221 - DNA, 18 bp, Homo sapiens
cctgacccacggggcagt

SEQ ID NO: 5680222 - DNA, 14 bp, Homo sapiens
cctgacccaggccg

SEQ ID NO: 5680223 - DNA, 18 bp, Homo sapiens
cctgacccaggccgcagc

SEQ ID NO: 5680224 - DNA, 19 bp, Homo sapiens
cctgacccaggccgcagct

SEQ ID NO: 5680225 - DNA, 15 bp, Homo sapiens
cctgacccagggact

SEQ ID NO: 5680226 - DNA, 20 bp, Homo sapiens
cctgacccattgctgttgtc

SEQ ID NO: 5680227 - DNA, 23 bp, Homo sapiens
cctgaccccaagttatccacctg

SEQ ID NO: 5680228 - DNA, 17 bp, Homo sapiens
cctgaccccacctagaa

SEQ ID NO: 5680229 - DNA, 18 bp, Homo sapiens
cctgaccccattcctgat

SEQ ID NO: 5680230 - DNA, 16 bp, Homo sapiens
cctgacccccatcgct

SEQ ID NO: 5680231 - DNA, 15 bp, Homo sapiens
cctgaccccgccatg

SEQ ID NO: 5680232 - DNA, 16 bp, Homo sapiens
cctgacccctccctgc

SEQ ID NO: 5680233 - DNA, 16 bp, Homo sapiens
cctgacccctgctcag

SEQ ID NO: 5680234 - DNA, 13 bp, Homo sapiens
cctgaccccttca

SEQ ID NO: 5680235 - DNA, 19 bp, Homo sapiens
cctgacccggattggccct

SEQ ID NO: 5680236 - DNA, 21 bp, Homo sapiens
cctgacccggattggccctgc

SEQ ID NO: 5680237 - DNA, 22 bp, Homo sapiens
cctgacccgtctaatatataaa

SEQ ID NO: 5680238 - DNA, 12 bp, Homo sapiens
cctgaccctccc

SEQ ID NO: 5680239 - DNA, 14 bp, Homo sapiens
cctgaccctcccac

SEQ ID NO: 5680240 - DNA, 17 bp, Homo sapiens
cctgaccctcccactcc

SEQ ID NO: 5680241 - DNA, 18 bp, Homo sapiens
cctgaccctcccactccc

SEQ ID NO: 5680242 - DNA, 15 bp, Homo sapiens
cctgaccctccctac

SEQ ID NO: 5680243 - DNA, 21 bp, Homo sapiens
cctgaccctcctccactccac

SEQ ID NO: 5680244 - DNA, 14 bp, Homo sapiens
cctgaccctgcaga

SEQ ID NO: 5680245 - DNA, 17 bp, Homo sapiens
cctgaccctgtatatag

SEQ ID NO: 5680246 - DNA, 21 bp, Homo sapiens
cctgaccctgtgatgcctgac

SEQ ID NO: 5680247 - DNA, 20 bp, Homo sapiens
cctgacccttccacagtcat

SEQ ID NO: 5680248 - DNA, 16 bp, Homo sapiens
cctgaccgtgggcggg

SEQ ID NO: 5680249 - DNA, 15 bp, Homo sapiens
cctgacctaccccag

SEQ ID NO: 5680250 - DNA, 16 bp, Homo sapiens
cctgacctcactgtga

SEQ ID NO: 5680251 - DNA, 16 bp, Homo sapiens
cctgacctcaggtgat

SEQ ID NO: 5680252 - DNA, 15 bp, Homo sapiens
cctgacctccagtcc

SEQ ID NO: 5680253 - DNA, 19 bp, Homo sapiens
cctgacctccagtcctgct

SEQ ID NO: 5680254 - DNA, 13 bp, Homo sapiens
cctgacctcccag

SEQ ID NO: 5680255 - DNA, 17 bp, Homo sapiens
cctgacctcccagccct

SEQ ID NO: 5680256 - DNA, 16 bp, Homo sapiens
cctgacctccccctcc

SEQ ID NO: 5680257 - DNA, 20 bp, Homo sapiens
cctgacctcctggactgtag

SEQ ID NO: 5680258 - DNA, 14 bp, Homo sapiens
cctgacctcttgct

SEQ ID NO: 5680259 - DNA, 16 bp, Homo sapiens
cctgacctcttgctgt

SEQ ID NO: 5680260 - DNA, 18 bp, Homo sapiens
cctgacctcttgctgtct

SEQ ID NO: 5680261 - DNA, 24 bp, Homo sapiens
cctgacctcttgctgtctctgctc

SEQ ID NO: 5680262 - DNA, 13 bp, Homo sapiens
cctgacctgagag

SEQ ID NO: 5680263 - DNA, 13 bp, Homo sapiens
cctgacctgaggc

SEQ ID NO: 5680264 - DNA, 17 bp, Homo sapiens
cctgacctgctgaattg

SEQ ID NO: 5680265 - DNA, 13 bp, Homo sapiens
cctgacctggcac

SEQ ID NO: 5680266 - DNA, 14 bp, Homo sapiens
cctgacctgtctca

SEQ ID NO: 5680267 - DNA, 18 bp, Homo sapiens
cctgacctgtgagcccag

SEQ ID NO: 5680268 - DNA, 19 bp, Homo sapiens
cctgacctgtgagcccagc

SEQ ID NO: 5680269 - DNA, 18 bp, Homo sapiens
cctgaccttagcgttctg

SEQ ID NO: 5680270 - DNA, 15 bp, Homo sapiens
cctgaccttctccag

SEQ ID NO: 5680271 - DNA, 19 bp, Homo sapiens
cctgaccttctccagggac

SEQ ID NO: 5680272 - DNA, 21 bp, Homo sapiens
cctgaccttgaggagtcttgt

SEQ ID NO: 5680273 - DNA, 23 bp, Homo sapiens
cctgaccttgaggagtcttgtgt

SEQ ID NO: 5680274 - DNA, 22 bp, Homo sapiens
cctgaccttgtcatccacctgt

SEQ ID NO: 5680275 - DNA, 13 bp, Homo sapiens
cctgacgaaactg

SEQ ID NO: 5680276 - DNA, 16 bp, Homo sapiens
cctgacgaaactggcc

SEQ ID NO: 5680277 - DNA, 22 bp, Homo sapiens
cctgacgaaatggaaacacaca

SEQ ID NO: 5680278 - DNA, 15 bp, Homo sapiens
cctgacgatcttccc

SEQ ID NO: 5680279 - DNA, 17 bp, Homo sapiens
cctgacgatcttccccc

SEQ ID NO: 5680280 - DNA, 13 bp, Homo sapiens
cctgacgccctgc

SEQ ID NO: 5680281 - DNA, 23 bp, Homo sapiens
cctgacgcctactggggcagggc

SEQ ID NO: 5680282 - DNA, 22 bp, Homo sapiens
cctgacgctcagccccaggcca

SEQ ID NO: 5680283 - DNA, 19 bp, Homo sapiens
cctgacggacgtcctgctg

SEQ ID NO: 5680284 - DNA, 19 bp, Homo sapiens
cctgacggcgcccccagtg

SEQ ID NO: 5680285 - DNA, 21 bp, Homo sapiens
cctgacggcgcccccagtgtg

SEQ ID NO: 5680286 - DNA, 16 bp, Homo sapiens
cctgacggcgcctttt

SEQ ID NO: 5680287 - DNA, 23 bp, Homo sapiens
cctgacggcgcctttttggcctg

SEQ ID NO: 5680288 - DNA, 16 bp, Homo sapiens
cctgacggctggggac

SEQ ID NO: 5680289 - DNA, 20 bp, Homo sapiens
cctgacgtctgaagcttgac

SEQ ID NO: 5680290 - DNA, 14 bp, Homo sapiens
cctgacgtctgcca

SEQ ID NO: 5680291 - DNA, 15 bp, Homo sapiens
cctgacgtctgccac

SEQ ID NO: 5680292 - DNA, 18 bp, Homo sapiens
cctgactaaactaccacc

SEQ ID NO: 5680293 - DNA, 19 bp, Homo sapiens
cctgactaaactaccacct

SEQ ID NO: 5680294 - DNA, 20 bp, Homo sapiens
cctgactaatttttgtattt

SEQ ID NO: 5680295 - DNA, 17 bp, Homo sapiens
cctgactaggttctgta

SEQ ID NO: 5680296 - DNA, 10 bp, Homo sapiens
cctgactcaa

SEQ ID NO: 5680297 - DNA, 16 bp, Homo sapiens
cctgactcaggcatca

SEQ ID NO: 5680298 - DNA, 18 bp, Homo sapiens
cctgactcagtgaccagt

SEQ ID NO: 5680299 - DNA, 13 bp, Homo sapiens
cctgactcccatg

SEQ ID NO: 5680300 - DNA, 13 bp, Homo sapiens
cctgactccccca

SEQ ID NO: 5680301 - DNA, 15 bp, Homo sapiens
cctgactccctgtgg

SEQ ID NO: 5680302 - DNA, 16 bp, Homo sapiens
cctgactccctgtggg

SEQ ID NO: 5680303 - DNA, 20 bp, Homo sapiens
cctgactcctctaagccact

SEQ ID NO: 5680304 - DNA, 14 bp, Homo sapiens
cctgactcctctgg

SEQ ID NO: 5680305 - DNA, 18 bp, Homo sapiens
cctgactcctctggcttt

SEQ ID NO: 5680306 - DNA, 13 bp, Homo sapiens
cctgactcctggg

SEQ ID NO: 5680307 - DNA, 14 bp, Homo sapiens
cctgactccttctg

SEQ ID NO: 5680308 - DNA, 14 bp, Homo sapiens
cctgactctcagca

SEQ ID NO: 5680309 - DNA, 13 bp, Homo sapiens
cctgactctctgt

SEQ ID NO: 5680310 - DNA, 16 bp, Homo sapiens
cctgactctctgtgac

SEQ ID NO: 5680311 - DNA, 13 bp, Homo sapiens
cctgactctgaaa

SEQ ID NO: 5680312 - DNA, 13 bp, Homo sapiens
cctgactctgccc

SEQ ID NO: 5680313 - DNA, 15 bp, Homo sapiens
cctgactctgccccc

SEQ ID NO: 5680314 - DNA, 16 bp, Homo sapiens
cctgactgcacacagc

SEQ ID NO: 5680315 - DNA, 13 bp, Homo sapiens
cctgactgccaag

SEQ ID NO: 5680316 - DNA, 15 bp, Homo sapiens
cctgactgccaagcc

SEQ ID NO: 5680317 - DNA, 16 bp, Homo sapiens
cctgactgccaagcca

SEQ ID NO: 5680318 - DNA, 14 bp, Homo sapiens
cctgactgcccagc

SEQ ID NO: 5680319 - DNA, 16 bp, Homo sapiens
cctgactgcccagcat

SEQ ID NO: 5680320 - DNA, 12 bp, Homo sapiens
cctgactggcct

SEQ ID NO: 5680321 - DNA, 13 bp, Homo sapiens
cctgactggcctg

SEQ ID NO: 5680322 - DNA, 16 bp, Homo sapiens
cctgactggcctggga

SEQ ID NO: 5680323 - DNA, 17 bp, Homo sapiens
cctgactgggggcagac

SEQ ID NO: 5680324 - DNA, 13 bp, Homo sapiens
cctgactggtgct

SEQ ID NO: 5680325 - DNA, 23 bp, Homo sapiens
cctgactggtgctataggctgga

SEQ ID NO: 5680326 - DNA, 20 bp, Homo sapiens
cctgactggttgtcagaatg

SEQ ID NO: 5680327 - DNA, 18 bp, Homo sapiens
cctgactgtcagggaggg

SEQ ID NO: 5680328 - DNA, 19 bp, Homo sapiens
cctgactgtcagggagggc

SEQ ID NO: 5680329 - DNA, 20 bp, Homo sapiens
cctgactgtcagggagggcc

SEQ ID NO: 5680330 - DNA, 11 bp, Homo sapiens
cctgactgtgt

SEQ ID NO: 5680331 - DNA, 14 bp, Homo sapiens
cctgactgtgttca

SEQ ID NO: 5680332 - DNA, 22 bp, Homo sapiens
cctgactgttctcttactgccg

SEQ ID NO: 5680333 - DNA, 16 bp, Homo sapiens
cctgactgttgccccc

SEQ ID NO: 5680334 - DNA, 23 bp, Homo sapiens
cctgacttagcccgtcaccctta

SEQ ID NO: 5680335 - DNA, 21 bp, Homo sapiens
cctgacttcaggggctgcccg

SEQ ID NO: 5680336 - DNA, 22 bp, Homo sapiens
cctgacttcaggggctgcccgc

SEQ ID NO: 5680337 - DNA, 23 bp, Homo sapiens
cctgacttcaggggctgcccgct

SEQ ID NO: 5680338 - DNA, 19 bp, Homo sapiens
cctgacttcagtgaatatt

SEQ ID NO: 5680339 - DNA, 13 bp, Homo sapiens
cctgacttcccag

SEQ ID NO: 5680340 - DNA, 18 bp, Homo sapiens
cctgacttcccagctggc

SEQ ID NO: 5680341 - DNA, 19 bp, Homo sapiens
cctgacttcccagctggca

SEQ ID NO: 5680342 - DNA, 17 bp, Homo sapiens
cctgacttcctctgcca

SEQ ID NO: 5680343 - DNA, 13 bp, Homo sapiens
cctgacttctccc

SEQ ID NO: 5680344 - DNA, 14 bp, Homo sapiens
cctgacttgagcca

SEQ ID NO: 5680345 - DNA, 15 bp, Homo sapiens
cctgacttgagccac

SEQ ID NO: 5680346 - DNA, 20 bp, Homo sapiens
cctgacttgagccactcctt

SEQ ID NO: 5680347 - DNA, 19 bp, Homo sapiens
cctgacttggggagatgga

SEQ ID NO: 5680348 - DNA, 19 bp, Homo sapiens
cctgactttgcccccttgc

SEQ ID NO: 5680349 - DNA, 21 bp, Homo sapiens
cctgactttggggacaccctc

SEQ ID NO: 5680350 - DNA, 22 bp, Homo sapiens
cctgagaaacccaccagcctaa

SEQ ID NO: 5680351 - DNA, 22 bp, Homo sapiens
cctgagaaacgtccatctctct

SEQ ID NO: 5680352 - DNA, 18 bp, Homo sapiens
cctgagaaagcccacctg

SEQ ID NO: 5680353 - DNA, 14 bp, Homo sapiens
cctgagaaaggtga

SEQ ID NO: 5680354 - DNA, 21 bp, Homo sapiens
cctgagaagaagtggctgcca

SEQ ID NO: 5680355 - DNA, 13 bp, Homo sapiens
cctgagaagagag

SEQ ID NO: 5680356 - DNA, 22 bp, Homo sapiens
cctgagaataagaaagtttcac

SEQ ID NO: 5680357 - DNA, 20 bp, Homo sapiens
cctgagaatgagtgggaatc

SEQ ID NO: 5680358 - DNA, 22 bp, Homo sapiens
cctgagaatgttaccagacttc

SEQ ID NO: 5680359 - DNA, 22 bp, Homo sapiens
cctgagaattgaggggaggtgg

SEQ ID NO: 5680360 - DNA, 15 bp, Homo sapiens
cctgagaatttaatt

SEQ ID NO: 5680361 - DNA, 23 bp, Homo sapiens
cctgagaatttaatttttaaaag

SEQ ID NO: 5680362 - DNA, 19 bp, Homo sapiens
cctgagacaaatggaggcc

SEQ ID NO: 5680363 - DNA, 20 bp, Homo sapiens
cctgagacaaatggaggcct

SEQ ID NO: 5680364 - DNA, 21 bp, Homo sapiens
cctgagacagacacacagcct

SEQ ID NO: 5680365 - DNA, 18 bp, Homo sapiens
cctgagacagcaccactg

SEQ ID NO: 5680366 - DNA, 20 bp, Homo sapiens
cctgagacagcaccactgct

SEQ ID NO: 5680367 - DNA, 22 bp, Homo sapiens
cctgagacagcaccactgctga

SEQ ID NO: 5680368 - DNA, 15 bp, Homo sapiens
cctgagacagtgcgt

SEQ ID NO: 5680369 - DNA, 17 bp, Homo sapiens
cctgagaccagggtggc

SEQ ID NO: 5680370 - DNA, 22 bp, Homo sapiens
cctgagaccagttgggagcact

SEQ ID NO: 5680371 - DNA, 18 bp, Homo sapiens
cctgagacccaggactcc

SEQ ID NO: 5680372 - DNA, 16 bp, Homo sapiens
cctgagacccctggcc

SEQ ID NO: 5680373 - DNA, 18 bp, Homo sapiens
cctgagaccctactgaag

SEQ ID NO: 5680374 - DNA, 18 bp, Homo sapiens
cctgagaccctgggagag

SEQ ID NO: 5680375 - DNA, 19 bp, Homo sapiens
cctgagaccctgggagaga

SEQ ID NO: 5680376 - DNA, 20 bp, Homo sapiens
cctgagacgggcatcgcagg

SEQ ID NO: 5680377 - DNA, 13 bp, Homo sapiens
cctgagactccag

SEQ ID NO: 5680378 - DNA, 15 bp, Homo sapiens
cctgagactcccgcc

SEQ ID NO: 5680379 - DNA, 19 bp, Homo sapiens
cctgagactcccgcctttg

SEQ ID NO: 5680380 - DNA, 13 bp, Homo sapiens
cctgagactggaa

SEQ ID NO: 5680381 - DNA, 23 bp, Homo sapiens
cctgagactgtcggagaggctgt

SEQ ID NO: 5680382 - DNA, 18 bp, Homo sapiens
cctgagagaattggctca

SEQ ID NO: 5680383 - DNA, 20 bp, Homo sapiens
cctgagagagaatagagctg

SEQ ID NO: 5680384 - DNA, 23 bp, Homo sapiens
cctgagagagaatagagctgcca

SEQ ID NO: 5680385 - DNA, 14 bp, Homo sapiens
cctgagagcatctc

SEQ ID NO: 5680386 - DNA, 19 bp, Homo sapiens
cctgagagcatgtggggga

SEQ ID NO: 5680387 - DNA, 14 bp, Homo sapiens
cctgagagcctgtg

SEQ ID NO: 5680388 - DNA, 15 bp, Homo sapiens
cctgagagcctgtgg

SEQ ID NO: 5680389 - DNA, 18 bp, Homo sapiens
cctgagagctgcatgtgt

SEQ ID NO: 5680390 - DNA, 15 bp, Homo sapiens
cctgagagctgttcc

SEQ ID NO: 5680391 - DNA, 17 bp, Homo sapiens
cctgagaggcaggcata

SEQ ID NO: 5680392 - DNA, 15 bp, Homo sapiens
cctgagagtcagctc

SEQ ID NO: 5680393 - DNA, 20 bp, Homo sapiens
cctgagagtcagctctctgc

SEQ ID NO: 5680394 - DNA, 21 bp, Homo sapiens
cctgagatactgaagtgcagc

SEQ ID NO: 5680395 - DNA, 15 bp, Homo sapiens
cctgagatcagagtc

SEQ ID NO: 5680396 - DNA, 15 bp, Homo sapiens
cctgagatcccctga

SEQ ID NO: 5680397 - DNA, 18 bp, Homo sapiens
cctgagatctgcacagtc

SEQ ID NO: 5680398 - DNA, 21 bp, Homo sapiens
cctgagatctgcacagtcaga

SEQ ID NO: 5680399 - DNA, 17 bp, Homo sapiens
cctgagatgctgggagg

SEQ ID NO: 5680400 - DNA, 19 bp, Homo sapiens
cctgagatgctgggagggc

SEQ ID NO: 5680401 - DNA, 20 bp, Homo sapiens
cctgagatgctgggagggct

SEQ ID NO: 5680402 - DNA, 21 bp, Homo sapiens
cctgagatggatggacagaca

SEQ ID NO: 5680403 - DNA, 19 bp, Homo sapiens
cctgagatgggccggcccc

SEQ ID NO: 5680404 - DNA, 17 bp, Homo sapiens
cctgagattcagatgtc

SEQ ID NO: 5680405 - DNA, 14 bp, Homo sapiens
cctgagattctggg

SEQ ID NO: 5680406 - DNA, 17 bp, Homo sapiens
cctgagattctgggaaa

SEQ ID NO: 5680407 - DNA, 22 bp, Homo sapiens
cctgagattctgggaaaggtgc

SEQ ID NO: 5680408 - DNA, 15 bp, Homo sapiens
cctgagattctttaa

SEQ ID NO: 5680409 - DNA, 15 bp, Homo sapiens
cctgagatttattaa

SEQ ID NO: 5680410 - DNA, 16 bp, Homo sapiens
cctgagatttcatctg

SEQ ID NO: 5680411 - DNA, 17 bp, Homo sapiens
cctgagatttcatctgc

SEQ ID NO: 5680412 - DNA, 23 bp, Homo sapiens
cctgagcaacagagtgagaccct

SEQ ID NO: 5680413 - DNA, 13 bp, Homo sapiens
cctgagcaactct

SEQ ID NO: 5680414 - DNA, 18 bp, Homo sapiens
cctgagcacctcccagcc

SEQ ID NO: 5680415 - DNA, 19 bp, Homo sapiens
cctgagcacctcccagccc

SEQ ID NO: 5680416 - DNA, 21 bp, Homo sapiens
cctgagcacctcccagcccct

SEQ ID NO: 5680417 - DNA, 16 bp, Homo sapiens
cctgagcactcctggt

SEQ ID NO: 5680418 - DNA, 20 bp, Homo sapiens
cctgagcactcctggtgcag

SEQ ID NO: 5680419 - DNA, 12 bp, Homo sapiens
cctgagcactgc

SEQ ID NO: 5680420 - DNA, 14 bp, Homo sapiens
cctgagcactgcca

SEQ ID NO: 5680421 - DNA, 16 bp, Homo sapiens
cctgagcactgccagg

SEQ ID NO: 5680422 - DNA, 20 bp, Homo sapiens
cctgagcactgccaggaggg

SEQ ID NO: 5680423 - DNA, 23 bp, Homo sapiens
cctgagcagaatactggtctcag

SEQ ID NO: 5680424 - DNA, 22 bp, Homo sapiens
cctgagcagatcgtgccgtgga

SEQ ID NO: 5680425 - DNA, 13 bp, Homo sapiens
cctgagcagctgg

SEQ ID NO: 5680426 - DNA, 14 bp, Homo sapiens
cctgagcaggcagg

SEQ ID NO: 5680427 - DNA, 20 bp, Homo sapiens
cctgagcaggcaggggcttg

SEQ ID NO: 5680428 - DNA, 13 bp, Homo sapiens
cctgagcagggcg

SEQ ID NO: 5680429 - DNA, 19 bp, Homo sapiens
cctgagcagggtccacagc

SEQ ID NO: 5680430 - DNA, 20 bp, Homo sapiens
cctgagcagggtccacagct

SEQ ID NO: 5680431 - DNA, 21 bp, Homo sapiens
cctgagcagggtccacagctg

SEQ ID NO: 5680432 - DNA, 23 bp, Homo sapiens
cctgagcagggtccacagctgga

SEQ ID NO: 5680433 - DNA, 18 bp, Homo sapiens
cctgagcagtccctgctt

SEQ ID NO: 5680434 - DNA, 19 bp, Homo sapiens
cctgagcagtccttggcct

SEQ ID NO: 5680435 - DNA, 17 bp, Homo sapiens
cctgagcatatgtacac

SEQ ID NO: 5680436 - DNA, 17 bp, Homo sapiens
cctgagcatcctggttc

SEQ ID NO: 5680437 - DNA, 23 bp, Homo sapiens
cctgagccaagctagaattccct

SEQ ID NO: 5680438 - DNA, 14 bp, Homo sapiens
cctgagccaatggg

SEQ ID NO: 5680439 - DNA, 18 bp, Homo sapiens
cctgagccaatgggacag

SEQ ID NO: 5680440 - DNA, 17 bp, Homo sapiens
cctgagccacagtgggg

SEQ ID NO: 5680441 - DNA, 23 bp, Homo sapiens
cctgagccacagtggggcccatg

SEQ ID NO: 5680442 - DNA, 20 bp, Homo sapiens
cctgagccagatttcactct

SEQ ID NO: 5680443 - DNA, 13 bp, Homo sapiens
cctgagccaggga

SEQ ID NO: 5680444 - DNA, 18 bp, Homo sapiens
cctgagccagggtctcca

SEQ ID NO: 5680445 - DNA, 13 bp, Homo sapiens
cctgagccatggc

SEQ ID NO: 5680446 - DNA, 17 bp, Homo sapiens
cctgagccatggcggcc

SEQ ID NO: 5680447 - DNA, 23 bp, Homo sapiens
cctgagcccaaccaggccctgcc

SEQ ID NO: 5680448 - DNA, 12 bp, Homo sapiens
cctgagcccagg

SEQ ID NO: 5680449 - DNA, 14 bp, Homo sapiens
cctgagcccaggag

SEQ ID NO: 5680450 - DNA, 16 bp, Homo sapiens
cctgagcccaggagct

SEQ ID NO: 5680451 - DNA, 13 bp, Homo sapiens
cctgagcccaggg

SEQ ID NO: 5680452 - DNA, 10 bp, Homo sapiens
cctgagcccc

SEQ ID NO: 5680453 - DNA, 11 bp, Homo sapiens
cctgagcccca

SEQ ID NO: 5680454 - DNA, 23 bp, Homo sapiens
cctgagccccagggtgcccagaa

SEQ ID NO: 5680455 - DNA, 20 bp, Homo sapiens
cctgagccccgccctcttcc

SEQ ID NO: 5680456 - DNA, 22 bp, Homo sapiens
cctgagccccgccctcttcctg

SEQ ID NO: 5680457 - DNA, 13 bp, Homo sapiens
cctgagcccctca

SEQ ID NO: 5680458 - DNA, 12 bp, Homo sapiens
cctgagcccctt

SEQ ID NO: 5680459 - DNA, 13 bp, Homo sapiens
cctgagccccttc

SEQ ID NO: 5680460 - DNA, 16 bp, Homo sapiens
cctgagccccttcctt

SEQ ID NO: 5680461 - DNA, 16 bp, Homo sapiens
cctgagcccgcagccc

SEQ ID NO: 5680462 - DNA, 13 bp, Homo sapiens
cctgagcccggcc

SEQ ID NO: 5680463 - DNA, 10 bp, Homo sapiens
cctgagccct

SEQ ID NO: 5680464 - DNA, 22 bp, Homo sapiens
cctgagccctactccctgcaga

SEQ ID NO: 5680465 - DNA, 17 bp, Homo sapiens
cctgagccggccccagg

SEQ ID NO: 5680466 - DNA, 17 bp, Homo sapiens
cctgagcctgccccagc

SEQ ID NO: 5680467 - DNA, 14 bp, Homo sapiens
cctgagcctgccga

SEQ ID NO: 5680468 - DNA, 15 bp, Homo sapiens
cctgagcctgccgag

SEQ ID NO: 5680469 - DNA, 17 bp, Homo sapiens
cctgagcctgccgagca

SEQ ID NO: 5680470 - DNA, 21 bp, Homo sapiens
cctgagcctgccgagcaaccg

SEQ ID NO: 5680471 - DNA, 23 bp, Homo sapiens
cctgagcctgccgagcaaccgtg

SEQ ID NO: 5680472 - DNA, 13 bp, Homo sapiens
cctgagcctggcc

SEQ ID NO: 5680473 - DNA, 14 bp, Homo sapiens
cctgagcctggcca

SEQ ID NO: 5680474 - DNA, 13 bp, Homo sapiens
cctgagcctgtct

SEQ ID NO: 5680475 - DNA, 23 bp, Homo sapiens
cctgagcctgtgggtccccactc

SEQ ID NO: 5680476 - DNA, 16 bp, Homo sapiens
cctgagcctgtgtcct

SEQ ID NO: 5680477 - DNA, 17 bp, Homo sapiens
cctgagcctgtgtcctg

SEQ ID NO: 5680478 - DNA, 14 bp, Homo sapiens
cctgagccttagct

SEQ ID NO: 5680479 - DNA, 21 bp, Homo sapiens
cctgagccttagctcccagct

SEQ ID NO: 5680480 - DNA, 16 bp, Homo sapiens
cctgagccttcagcac

SEQ ID NO: 5680481 - DNA, 19 bp, Homo sapiens
cctgagcgagtggagtctg

SEQ ID NO: 5680482 - DNA, 20 bp, Homo sapiens
cctgagcgagtggagtctgc

SEQ ID NO: 5680483 - DNA, 22 bp, Homo sapiens
cctgagcgagtggagtctgcca

SEQ ID NO: 5680484 - DNA, 14 bp, Homo sapiens
cctgagcgctgtgg

SEQ ID NO: 5680485 - DNA, 18 bp, Homo sapiens
cctgagcggaggctcggc

SEQ ID NO: 5680486 - DNA, 15 bp, Homo sapiens
cctgagcggcaccct

SEQ ID NO: 5680487 - DNA, 18 bp, Homo sapiens
cctgagctagaagctgga

SEQ ID NO: 5680488 - DNA, 18 bp, Homo sapiens
cctgagctaggaagagtc

SEQ ID NO: 5680489 - DNA, 18 bp, Homo sapiens
cctgagctattttcctct

SEQ ID NO: 5680490 - DNA, 20 bp, Homo sapiens
cctgagctattttcctctgg

SEQ ID NO: 5680491 - DNA, 19 bp, Homo sapiens
cctgagctcaaatctctgt

SEQ ID NO: 5680492 - DNA, 14 bp, Homo sapiens
cctgagctcaggct

SEQ ID NO: 5680493 - DNA, 22 bp, Homo sapiens
cctgagctcaggctgagcccag

SEQ ID NO: 5680494 - DNA, 22 bp, Homo sapiens
cctgagctccaccctcccctct

SEQ ID NO: 5680495 - DNA, 15 bp, Homo sapiens
cctgagctccccacc

SEQ ID NO: 5680496 - DNA, 14 bp, Homo sapiens
cctgagctcgggga

SEQ ID NO: 5680497 - DNA, 18 bp, Homo sapiens
cctgagctcggggacagg

SEQ ID NO: 5680498 - DNA, 21 bp, Homo sapiens
cctgagctcggtggacccagg

SEQ ID NO: 5680499 - DNA, 15 bp, Homo sapiens
cctgagctgaggcag

SEQ ID NO: 5680500 - DNA, 17 bp, Homo sapiens
cctgagctgcagctgag

SEQ ID NO: 5680501 - DNA, 12 bp, Homo sapiens
cctgagctgctt

SEQ ID NO: 5680502 - DNA, 13 bp, Homo sapiens
cctgagctggcca

SEQ ID NO: 5680503 - DNA, 14 bp, Homo sapiens
cctgagctggcctg

SEQ ID NO: 5680504 - DNA, 17 bp, Homo sapiens
cctgagctggggaagcc

SEQ ID NO: 5680505 - DNA, 14 bp, Homo sapiens
cctgagctggggcc

SEQ ID NO: 5680506 - DNA, 15 bp, Homo sapiens
cctgagctggggcca

SEQ ID NO: 5680507 - DNA, 17 bp, Homo sapiens
cctgagctggggccaca

SEQ ID NO: 5680508 - DNA, 17 bp, Homo sapiens
cctgagctggggcctgg

SEQ ID NO: 5680509 - DNA, 15 bp, Homo sapiens
cctgagctgtcgctg

SEQ ID NO: 5680510 - DNA, 16 bp, Homo sapiens
cctgagcttggccaga

SEQ ID NO: 5680511 - DNA, 21 bp, Homo sapiens
cctgagcttggccagaagggg

SEQ ID NO: 5680512 - DNA, 14 bp, Homo sapiens
cctgagctttatgg

SEQ ID NO: 5680513 - DNA, 14 bp, Homo sapiens
cctgagctttctgc

SEQ ID NO: 5680514 - DNA, 15 bp, Homo sapiens
cctgagctttggaca

SEQ ID NO: 5680515 - DNA, 22 bp, Homo sapiens
cctgagctttggacacacacag

SEQ ID NO: 5680516 - DNA, 23 bp, Homo sapiens
cctgaggaagcgtgaaggccgag

SEQ ID NO: 5680517 - DNA, 21 bp, Homo sapiens
cctgaggaaggaggggaagct

SEQ ID NO: 5680518 - DNA, 23 bp, Homo sapiens
cctgaggaaggaggggaagctgc

SEQ ID NO: 5680519 - DNA, 17 bp, Homo sapiens
cctgaggaataaagctt

SEQ ID NO: 5680520 - DNA, 20 bp, Homo sapiens
cctgaggacagctgtcctct

SEQ ID NO: 5680521 - DNA, 18 bp, Homo sapiens
cctgaggacatggcttct

SEQ ID NO: 5680522 - DNA, 16 bp, Homo sapiens
cctgaggacctctcag

SEQ ID NO: 5680523 - DNA, 18 bp, Homo sapiens
cctgaggacctctcagca

SEQ ID NO: 5680524 - DNA, 16 bp, Homo sapiens
cctgaggactggagac

SEQ ID NO: 5680525 - DNA, 22 bp, Homo sapiens
cctgaggagcagcccacctgct

SEQ ID NO: 5680526 - DNA, 16 bp, Homo sapiens
cctgaggagccctgag

SEQ ID NO: 5680527 - DNA, 17 bp, Homo sapiens
cctgaggagctttgtgt

SEQ ID NO: 5680528 - DNA, 19 bp, Homo sapiens
cctgaggaggaggacacag

SEQ ID NO: 5680529 - DNA, 13 bp, Homo sapiens
cctgaggaggccg

SEQ ID NO: 5680530 - DNA, 19 bp, Homo sapiens
cctgaggagggccctgagg

SEQ ID NO: 5680531 - DNA, 20 bp, Homo sapiens
cctgaggagggccctgagga

SEQ ID NO: 5680532 - DNA, 13 bp, Homo sapiens
cctgaggagtctg

SEQ ID NO: 5680533 - DNA, 15 bp, Homo sapiens
cctgaggatcccctg

SEQ ID NO: 5680534 - DNA, 17 bp, Homo sapiens
cctgaggatcccctgtc

SEQ ID NO: 5680535 - DNA, 22 bp, Homo sapiens
cctgaggatcccctgtcccctg

SEQ ID NO: 5680536 - DNA, 16 bp, Homo sapiens
cctgaggatgagctgg

SEQ ID NO: 5680537 - DNA, 16 bp, Homo sapiens
cctgaggcaaggagtt

SEQ ID NO: 5680538 - DNA, 20 bp, Homo sapiens
cctgaggcagatggccactg

SEQ ID NO: 5680539 - DNA, 13 bp, Homo sapiens
cctgaggcaggag

SEQ ID NO: 5680540 - DNA, 21 bp, Homo sapiens
cctgaggcaggagaatcgctt

SEQ ID NO: 5680541 - DNA, 14 bp, Homo sapiens
cctgaggcaggagg

SEQ ID NO: 5680542 - DNA, 22 bp, Homo sapiens
cctgaggcaggagggcatgtgc

SEQ ID NO: 5680543 - DNA, 21 bp, Homo sapiens
cctgaggcaggtgagaaccca

SEQ ID NO: 5680544 - DNA, 20 bp, Homo sapiens
cctgaggccagtggcccccg

SEQ ID NO: 5680545 - DNA, 16 bp, Homo sapiens
cctgaggcccagcaga

SEQ ID NO: 5680546 - DNA, 20 bp, Homo sapiens
cctgaggcccagcagagccg

SEQ ID NO: 5680547 - DNA, 21 bp, Homo sapiens
cctgaggcccagcagagccgt

SEQ ID NO: 5680548 - DNA, 17 bp, Homo sapiens
cctgaggccccaggtgg

SEQ ID NO: 5680549 - DNA, 23 bp, Homo sapiens
cctgaggccctgggctgggtgct

SEQ ID NO: 5680550 - DNA, 16 bp, Homo sapiens
cctgaggcccttctct

SEQ ID NO: 5680551 - DNA, 19 bp, Homo sapiens
cctgaggcccttctctcca

SEQ ID NO: 5680552 - DNA, 13 bp, Homo sapiens
cctgaggcctcca

SEQ ID NO: 5680553 - DNA, 15 bp, Homo sapiens
cctgaggcctccaag

SEQ ID NO: 5680554 - DNA, 16 bp, Homo sapiens
cctgaggcctgaggcc

SEQ ID NO: 5680555 - DNA, 18 bp, Homo sapiens
cctgaggcctgaggcctg

SEQ ID NO: 5680556 - DNA, 19 bp, Homo sapiens
cctgaggcctgaggcctgt

SEQ ID NO: 5680557 - DNA, 16 bp, Homo sapiens
cctgaggcctgtgcct

SEQ ID NO: 5680558 - DNA, 17 bp, Homo sapiens
cctgaggcctgtgcctg

SEQ ID NO: 5680559 - DNA, 14 bp, Homo sapiens
cctgaggccttcca

SEQ ID NO: 5680560 - DNA, 20 bp, Homo sapiens
cctgaggcggaggctgtgct

SEQ ID NO: 5680561 - DNA, 21 bp, Homo sapiens
cctgaggcggaggctgtgctc

SEQ ID NO: 5680562 - DNA, 20 bp, Homo sapiens
cctgaggctcaagaggccca

SEQ ID NO: 5680563 - DNA, 21 bp, Homo sapiens
cctgaggctcaagaggcccag

SEQ ID NO: 5680564 - DNA, 22 bp, Homo sapiens
cctgaggctcaagaggcccagg

SEQ ID NO: 5680565 - DNA, 23 bp, Homo sapiens
cctgaggctcaagaggcccaggg

SEQ ID NO: 5680566 - DNA, 13 bp, Homo sapiens
cctgaggctcagc

SEQ ID NO: 5680567 - DNA, 17 bp, Homo sapiens
cctgaggctcagggaaa

SEQ ID NO: 5680568 - DNA, 13 bp, Homo sapiens
cctgaggctccac

SEQ ID NO: 5680569 - DNA, 18 bp, Homo sapiens
cctgaggctcctgtgcta

SEQ ID NO: 5680570 - DNA, 15 bp, Homo sapiens
cctgaggctggcatc

SEQ ID NO: 5680571 - DNA, 24 bp, Homo sapiens
cctgaggctggcatcctggctggc

SEQ ID NO: 5680572 - DNA, 13 bp, Homo sapiens
cctgaggctggct

SEQ ID NO: 5680573 - DNA, 17 bp, Homo sapiens
cctgaggctggctgggg

SEQ ID NO: 5680574 - DNA, 15 bp, Homo sapiens
cctgaggctgggctc

SEQ ID NO: 5680575 - DNA, 21 bp, Homo sapiens
cctgaggctgggctcccttcc

SEQ ID NO: 5680576 - DNA, 16 bp, Homo sapiens
cctgaggctgtggtca

SEQ ID NO: 5680577 - DNA, 13 bp, Homo sapiens
cctgaggctgttt

SEQ ID NO: 5680578 - DNA, 20 bp, Homo sapiens
cctgagggaagcccacccgc

SEQ ID NO: 5680579 - DNA, 22 bp, Homo sapiens
cctgagggaagcccacccgccc

SEQ ID NO: 5680580 - DNA, 21 bp, Homo sapiens
cctgagggacgagcagagcgc

SEQ ID NO: 5680581 - DNA, 16 bp, Homo sapiens
cctgagggaggacctg

SEQ ID NO: 5680582 - DNA, 22 bp, Homo sapiens
cctgagggaggacctggggcac

SEQ ID NO: 5680583 - DNA, 23 bp, Homo sapiens
cctgagggaggacctggggcaca

SEQ ID NO: 5680584 - DNA, 22 bp, Homo sapiens
cctgagggcagaaaggttctgc

SEQ ID NO: 5680585 - DNA, 19 bp, Homo sapiens
cctgagggcccctctgccc

SEQ ID NO: 5680586 - DNA, 20 bp, Homo sapiens
cctgagggcccctctgccca

SEQ ID NO: 5680587 - DNA, 15 bp, Homo sapiens
cctgagggcccttcc

SEQ ID NO: 5680588 - DNA, 15 bp, Homo sapiens
cctgagggctccatg

SEQ ID NO: 5680589 - DNA, 16 bp, Homo sapiens
cctgagggctcctcca

SEQ ID NO: 5680590 - DNA, 20 bp, Homo sapiens
cctgagggctcctccatggt

SEQ ID NO: 5680591 - DNA, 11 bp, Homo sapiens
cctgaggggaa

SEQ ID NO: 5680592 - DNA, 19 bp, Homo sapiens
cctgaggggagacagagca

SEQ ID NO: 5680593 - DNA, 21 bp, Homo sapiens
cctgaggggatatccctatgt

SEQ ID NO: 5680594 - DNA, 11 bp, Homo sapiens
cctgaggggca

SEQ ID NO: 5680595 - DNA, 15 bp, Homo sapiens
cctgaggggcagcct

SEQ ID NO: 5680596 - DNA, 16 bp, Homo sapiens
cctgaggggcagtccc

SEQ ID NO: 5680597 - DNA, 19 bp, Homo sapiens
cctgaggggcatctgcccc

SEQ ID NO: 5680598 - DNA, 22 bp, Homo sapiens
cctgaggggcatctgcccctcc

SEQ ID NO: 5680599 - DNA, 16 bp, Homo sapiens
cctgaggggcctctta

SEQ ID NO: 5680600 - DNA, 17 bp, Homo sapiens
cctgaggggcctgccac

SEQ ID NO: 5680601 - DNA, 15 bp, Homo sapiens
cctgaggggctgggc

SEQ ID NO: 5680602 - DNA, 16 bp, Homo sapiens
cctgaggggctgggct

SEQ ID NO: 5680603 - DNA, 16 bp, Homo sapiens
cctgagggtccacctg

SEQ ID NO: 5680604 - DNA, 13 bp, Homo sapiens
cctgagggtcccc

SEQ ID NO: 5680605 - DNA, 15 bp, Homo sapiens
cctgagggtgggctt

SEQ ID NO: 5680606 - DNA, 20 bp, Homo sapiens
cctgagggtggtcagccaag

SEQ ID NO: 5680607 - DNA, 22 bp, Homo sapiens
cctgagggtggtcagccaaggc

SEQ ID NO: 5680608 - DNA, 16 bp, Homo sapiens
cctgaggtacctttcc

SEQ ID NO: 5680609 - DNA, 22 bp, Homo sapiens
cctgaggtacctttccacccag

SEQ ID NO: 5680610 - DNA, 14 bp, Homo sapiens
cctgaggtcacctg

SEQ ID NO: 5680611 - DNA, 13 bp, Homo sapiens
cctgaggtcagga

SEQ ID NO: 5680612 - DNA, 22 bp, Homo sapiens
cctgaggtcagggagtgctggc

SEQ ID NO: 5680613 - DNA, 15 bp, Homo sapiens
cctgaggtcatgcat

SEQ ID NO: 5680614 - DNA, 15 bp, Homo sapiens
cctgaggtcccctcg

SEQ ID NO: 5680615 - DNA, 20 bp, Homo sapiens
cctgaggtccgatggcccga

SEQ ID NO: 5680616 - DNA, 17 bp, Homo sapiens
cctgaggtctggctgct

SEQ ID NO: 5680617 - DNA, 21 bp, Homo sapiens
cctgaggtctggctgcttgcc

SEQ ID NO: 5680618 - DNA, 23 bp, Homo sapiens
cctgaggtgcaggggaagaccaa

SEQ ID NO: 5680619 - DNA, 13 bp, Homo sapiens
cctgaggtgcctc

SEQ ID NO: 5680620 - DNA, 18 bp, Homo sapiens
cctgaggtgcctcccagt

SEQ ID NO: 5680621 - DNA, 22 bp, Homo sapiens
cctgaggtgcctcccagtggcc

SEQ ID NO: 5680622 - DNA, 19 bp, Homo sapiens
cctgaggtgtgggggctgc

SEQ ID NO: 5680623 - DNA, 21 bp, Homo sapiens
cctgaggtgtgggggctgcag

SEQ ID NO: 5680624 - DNA, 22 bp, Homo sapiens
cctgaggtgtgggggctgcagc

SEQ ID NO: 5680625 - DNA, 23 bp, Homo sapiens
cctgaggttaaacggtgcccatc

SEQ ID NO: 5680626 - DNA, 14 bp, Homo sapiens
cctgaggttactgg

SEQ ID NO: 5680627 - DNA, 22 bp, Homo sapiens
cctgagtaaaaaagctgtgtgc

SEQ ID NO: 5680628 - DNA, 17 bp, Homo sapiens
cctgagtactccacact

SEQ ID NO: 5680629 - DNA, 12 bp, Homo sapiens
cctgagtagctg

SEQ ID NO: 5680630 - DNA, 19 bp, Homo sapiens
cctgagtagctggattaca

SEQ ID NO: 5680631 - DNA, 14 bp, Homo sapiens
cctgagtagctggg

SEQ ID NO: 5680632 - DNA, 16 bp, Homo sapiens
cctgagtagctgggac

SEQ ID NO: 5680633 - DNA, 17 bp, Homo sapiens
cctgagtagctgggcct

SEQ ID NO: 5680634 - DNA, 22 bp, Homo sapiens
cctgagtagctgggcctgtgca

SEQ ID NO: 5680635 - DNA, 23 bp, Homo sapiens
cctgagtagctgggcctgtgcac

SEQ ID NO: 5680636 - DNA, 18 bp, Homo sapiens
cctgagtcacccatgaag

SEQ ID NO: 5680637 - DNA, 20 bp, Homo sapiens
cctgagtcacccctctgtcc

SEQ ID NO: 5680638 - DNA, 18 bp, Homo sapiens
cctgagtcagggcccaga

SEQ ID NO: 5680639 - DNA, 23 bp, Homo sapiens
cctgagtcagggcccagaggctg

SEQ ID NO: 5680640 - DNA, 12 bp, Homo sapiens
cctgagtcagtg

SEQ ID NO: 5680641 - DNA, 16 bp, Homo sapiens
cctgagtcccatccct

SEQ ID NO: 5680642 - DNA, 14 bp, Homo sapiens
cctgagtccccacc

SEQ ID NO: 5680643 - DNA, 18 bp, Homo sapiens
cctgagtcctgagcgaaa

SEQ ID NO: 5680644 - DNA, 18 bp, Homo sapiens
cctgagtcctggtccctc

SEQ ID NO: 5680645 - DNA, 20 bp, Homo sapiens
cctgagtcctggtccctctg

SEQ ID NO: 5680646 - DNA, 21 bp, Homo sapiens
cctgagtcgtgacctgctagg

SEQ ID NO: 5680647 - DNA, 22 bp, Homo sapiens
cctgagtcgtgacctgctaggc

SEQ ID NO: 5680648 - DNA, 12 bp, Homo sapiens
cctgagtctgga

SEQ ID NO: 5680649 - DNA, 14 bp, Homo sapiens
cctgagtcttggcc

SEQ ID NO: 5680650 - DNA, 17 bp, Homo sapiens
cctgagtcttggcctgc

SEQ ID NO: 5680651 - DNA, 22 bp, Homo sapiens
cctgagtcttggcctgcctccc

SEQ ID NO: 5680652 - DNA, 12 bp, Homo sapiens
cctgagtgaaca

SEQ ID NO: 5680653 - DNA, 15 bp, Homo sapiens
cctgagtgaggatta

SEQ ID NO: 5680654 - DNA, 20 bp, Homo sapiens
cctgagtgagtgtgtgtgct

SEQ ID NO: 5680655 - DNA, 22 bp, Homo sapiens
cctgagtgagtgtgtgtgcttg

SEQ ID NO: 5680656 - DNA, 22 bp, Homo sapiens
cctgagtgccccacttctggcc

SEQ ID NO: 5680657 - DNA, 14 bp, Homo sapiens
cctgagtgcctggc

SEQ ID NO: 5680658 - DNA, 14 bp, Homo sapiens
cctgagtgcgggct

SEQ ID NO: 5680659 - DNA, 19 bp, Homo sapiens
cctgagtgcgggctgaggc

SEQ ID NO: 5680660 - DNA, 22 bp, Homo sapiens
cctgagtgcgggctgaggccag

SEQ ID NO: 5680661 - DNA, 23 bp, Homo sapiens
cctgagtgcgggctgaggccaga

SEQ ID NO: 5680662 - DNA, 13 bp, Homo sapiens
cctgagtggatct

SEQ ID NO: 5680663 - DNA, 23 bp, Homo sapiens
cctgagtggatctccaaggacca

SEQ ID NO: 5680664 - DNA, 19 bp, Homo sapiens
cctgagtggctgaaataaa

SEQ ID NO: 5680665 - DNA, 14 bp, Homo sapiens
cctgagtgggctgg

SEQ ID NO: 5680666 - DNA, 22 bp, Homo sapiens
cctgagtggtgaggggccactg

SEQ ID NO: 5680667 - DNA, 17 bp, Homo sapiens
cctgagtgtcccaagcc

SEQ ID NO: 5680668 - DNA, 21 bp, Homo sapiens
cctgagtgtcccaagccggga

SEQ ID NO: 5680669 - DNA, 14 bp, Homo sapiens
cctgagttagctgt

SEQ ID NO: 5680670 - DNA, 17 bp, Homo sapiens
cctgagttagctgttta

SEQ ID NO: 5680671 - DNA, 22 bp, Homo sapiens
cctgagttaggctttctcttca

SEQ ID NO: 5680672 - DNA, 20 bp, Homo sapiens
cctgagttcatccaggccca

SEQ ID NO: 5680673 - DNA, 22 bp, Homo sapiens
cctgagttcccgggagctgggc

SEQ ID NO: 5680674 - DNA, 23 bp, Homo sapiens
cctgagttcccgggagctgggcc

SEQ ID NO: 5680675 - DNA, 17 bp, Homo sapiens
cctgagttctgacactg

SEQ ID NO: 5680676 - DNA, 16 bp, Homo sapiens
cctgagttggagctca

SEQ ID NO: 5680677 - DNA, 20 bp, Homo sapiens
cctgagttggcatcacctgc

SEQ ID NO: 5680678 - DNA, 22 bp, Homo sapiens
cctgagttggcatcacctgcgc

SEQ ID NO: 5680679 - DNA, 18 bp, Homo sapiens
cctgagttgggcagccag

SEQ ID NO: 5680680 - DNA, 20 bp, Homo sapiens
cctgagttgggcagccagga

SEQ ID NO: 5680681 - DNA, 24 bp, Homo sapiens
cctgagttgggcagccaggagtgc

SEQ ID NO: 5680682 - DNA, 19 bp, Homo sapiens
cctgagtttgggagagtgg

SEQ ID NO: 5680683 - DNA, 19 bp, Homo sapiens
cctgataagcttcaaagct

SEQ ID NO: 5680684 - DNA, 23 bp, Homo sapiens
cctgataccattctattctccag

SEQ ID NO: 5680685 - DNA, 22 bp, Homo sapiens
cctgatattgaagtaaaaaatt

SEQ ID NO: 5680686 - DNA, 21 bp, Homo sapiens
cctgatatttccctcccctgg

SEQ ID NO: 5680687 - DNA, 17 bp, Homo sapiens
cctgatcaaggtgctct

SEQ ID NO: 5680688 - DNA, 20 bp, Homo sapiens
cctgatcaagtcaccggagc

SEQ ID NO: 5680689 - DNA, 18 bp, Homo sapiens
cctgatcacctcagggca

SEQ ID NO: 5680690 - DNA, 17 bp, Homo sapiens
cctgatcactagcctgt

SEQ ID NO: 5680691 - DNA, 16 bp, Homo sapiens
cctgatcactcccagc

SEQ ID NO: 5680692 - DNA, 20 bp, Homo sapiens
cctgatcagaaaccaaccat

SEQ ID NO: 5680693 - DNA, 18 bp, Homo sapiens
cctgatcagaccacggct

SEQ ID NO: 5680694 - DNA, 13 bp, Homo sapiens
cctgatcagagcc

SEQ ID NO: 5680695 - DNA, 15 bp, Homo sapiens
cctgatcagaggcat

SEQ ID NO: 5680696 - DNA, 19 bp, Homo sapiens
cctgatcaggcttcctggt

SEQ ID NO: 5680697 - DNA, 22 bp, Homo sapiens
cctgatcatggtcagctcacac

SEQ ID NO: 5680698 - DNA, 23 bp, Homo sapiens
cctgatcatggtcagctcacacc

SEQ ID NO: 5680699 - DNA, 19 bp, Homo sapiens
cctgatcccactcctagga

SEQ ID NO: 5680700 - DNA, 17 bp, Homo sapiens
cctgatcccagagagcc

SEQ ID NO: 5680701 - DNA, 21 bp, Homo sapiens
cctgatcccattttcctctga

SEQ ID NO: 5680702 - DNA, 15 bp, Homo sapiens
cctgatccctccacc

SEQ ID NO: 5680703 - DNA, 20 bp, Homo sapiens
cctgatccctccacccccat

SEQ ID NO: 5680704 - DNA, 22 bp, Homo sapiens
cctgatccctgaacccctggcc

SEQ ID NO: 5680705 - DNA, 22 bp, Homo sapiens
cctgatccgtccgaggctgctt

SEQ ID NO: 5680706 - DNA, 13 bp, Homo sapiens
cctgatcctggag

SEQ ID NO: 5680707 - DNA, 15 bp, Homo sapiens
cctgatcctggaggc

SEQ ID NO: 5680708 - DNA, 20 bp, Homo sapiens
cctgatcctggaggcccagt

SEQ ID NO: 5680709 - DNA, 23 bp, Homo sapiens
cctgatcgccaacctttccccca

SEQ ID NO: 5680710 - DNA, 23 bp, Homo sapiens
cctgatctcgtttactccatgtt

SEQ ID NO: 5680711 - DNA, 12 bp, Homo sapiens
cctgatctctga

SEQ ID NO: 5680712 - DNA, 23 bp, Homo sapiens
cctgatctctgacctctgctgag

SEQ ID NO: 5680713 - DNA, 13 bp, Homo sapiens
cctgatctctgct

SEQ ID NO: 5680714 - DNA, 13 bp, Homo sapiens
cctgatctggacc

SEQ ID NO: 5680715 - DNA, 17 bp, Homo sapiens
cctgatctggcccaagc

SEQ ID NO: 5680716 - DNA, 21 bp, Homo sapiens
cctgatctggcccaagctggg

SEQ ID NO: 5680717 - DNA, 16 bp, Homo sapiens
cctgatcttgcctgtc

SEQ ID NO: 5680718 - DNA, 20 bp, Homo sapiens
cctgatcttggctcactgca

SEQ ID NO: 5680719 - DNA, 22 bp, Homo sapiens
cctgatgaaaaatatgtgcttg

SEQ ID NO: 5680720 - DNA, 15 bp, Homo sapiens
cctgatgaaaataaa

SEQ ID NO: 5680721 - DNA, 17 bp, Homo sapiens
cctgatgaaaataaaga

SEQ ID NO: 5680722 - DNA, 18 bp, Homo sapiens
cctgatgaaaataaagaa

SEQ ID NO: 5680723 - DNA, 19 bp, Homo sapiens
cctgatgaaaataaagaat

SEQ ID NO: 5680724 - DNA, 21 bp, Homo sapiens
cctgatgaaaataaagaatgg

SEQ ID NO: 5680725 - DNA, 13 bp, Homo sapiens
cctgatgacagag

SEQ ID NO: 5680726 - DNA, 21 bp, Homo sapiens
cctgatgacccaggctgcctg

SEQ ID NO: 5680727 - DNA, 14 bp, Homo sapiens
cctgatgacctggg

SEQ ID NO: 5680728 - DNA, 18 bp, Homo sapiens
cctgatgacgggatgctc

SEQ ID NO: 5680729 - DNA, 23 bp, Homo sapiens
cctgatgacgggatgctctttaa

SEQ ID NO: 5680730 - DNA, 19 bp, Homo sapiens
cctgatgagactccactca

SEQ ID NO: 5680731 - DNA, 16 bp, Homo sapiens
cctgatgagattttta

SEQ ID NO: 5680732 - DNA, 13 bp, Homo sapiens
cctgatgatgctg

SEQ ID NO: 5680733 - DNA, 15 bp, Homo sapiens
cctgatgatttttat

SEQ ID NO: 5680734 - DNA, 15 bp, Homo sapiens
cctgatgcaggtcag

SEQ ID NO: 5680735 - DNA, 17 bp, Homo sapiens
cctgatgcaggtcagcc

SEQ ID NO: 5680736 - DNA, 15 bp, Homo sapiens
cctgatgcagtcacg

SEQ ID NO: 5680737 - DNA, 16 bp, Homo sapiens
cctgatgcagtcacgt

SEQ ID NO: 5680738 - DNA, 14 bp, Homo sapiens
cctgatgcagtgct

SEQ ID NO: 5680739 - DNA, 21 bp, Homo sapiens
cctgatgccataaatacaaga

SEQ ID NO: 5680740 - DNA, 17 bp, Homo sapiens
cctgatgcccaggtcac

SEQ ID NO: 5680741 - DNA, 15 bp, Homo sapiens
cctgatgccccttcc

SEQ ID NO: 5680742 - DNA, 14 bp, Homo sapiens
cctgatgcccgttg

SEQ ID NO: 5680743 - DNA, 23 bp, Homo sapiens
cctgatgcgtctacccagactca

SEQ ID NO: 5680744 - DNA, 19 bp, Homo sapiens
cctgatgctccctcccctg

SEQ ID NO: 5680745 - DNA, 21 bp, Homo sapiens
cctgatgctgacattcacctg

SEQ ID NO: 5680746 - DNA, 13 bp, Homo sapiens
cctgatgctgact

SEQ ID NO: 5680747 - DNA, 16 bp, Homo sapiens
cctgatgctgccccgt

SEQ ID NO: 5680748 - DNA, 12 bp, Homo sapiens
cctgatggagag

SEQ ID NO: 5680749 - DNA, 15 bp, Homo sapiens
cctgatggagaggag

SEQ ID NO: 5680750 - DNA, 14 bp, Homo sapiens
cctgatggagagtg

SEQ ID NO: 5680751 - DNA, 18 bp, Homo sapiens
cctgatggagagtgagag

SEQ ID NO: 5680752 - DNA, 20 bp, Homo sapiens
cctgatggcagaactcccac

SEQ ID NO: 5680753 - DNA, 23 bp, Homo sapiens
cctgatggcagaactcccacaac

SEQ ID NO: 5680754 - DNA, 23 bp, Homo sapiens
cctgatggcaggatggcctggcc

SEQ ID NO: 5680755 - DNA, 17 bp, Homo sapiens
cctgatggccaggccag

SEQ ID NO: 5680756 - DNA, 13 bp, Homo sapiens
cctgatggcccaa

SEQ ID NO: 5680757 - DNA, 16 bp, Homo sapiens
cctgatggcctttgga

SEQ ID NO: 5680758 - DNA, 22 bp, Homo sapiens
cctgatgggagtaggctccaga

SEQ ID NO: 5680759 - DNA, 16 bp, Homo sapiens
cctgatggtcagctcc

SEQ ID NO: 5680760 - DNA, 22 bp, Homo sapiens
cctgatggtcagctcccttctc

SEQ ID NO: 5680761 - DNA, 23 bp, Homo sapiens
cctgatggtgtcattctgcctgc

SEQ ID NO: 5680762 - DNA, 18 bp, Homo sapiens
cctgatgtagcttgagat

SEQ ID NO: 5680763 - DNA, 22 bp, Homo sapiens
cctgatgtcttaacgaataaag

SEQ ID NO: 5680764 - DNA, 19 bp, Homo sapiens
cctgatgtgtcctcaggga

SEQ ID NO: 5680765 - DNA, 16 bp, Homo sapiens
cctgatgttaaaattc

SEQ ID NO: 5680766 - DNA, 18 bp, Homo sapiens
cctgatgttttgccgtgg

SEQ ID NO: 5680767 - DNA, 16 bp, Homo sapiens
cctgattaaagtgcct

SEQ ID NO: 5680768 - DNA, 20 bp, Homo sapiens
cctgattaccagtctgatta

SEQ ID NO: 5680769 - DNA, 13 bp, Homo sapiens
cctgattatttat

SEQ ID NO: 5680770 - DNA, 15 bp, Homo sapiens
cctgattatttatcc

SEQ ID NO: 5680771 - DNA, 14 bp, Homo sapiens
cctgattattttag

SEQ ID NO: 5680772 - DNA, 21 bp, Homo sapiens
cctgattattttcagaagctg

SEQ ID NO: 5680773 - DNA, 18 bp, Homo sapiens
cctgattcatactccttt

SEQ ID NO: 5680774 - DNA, 19 bp, Homo sapiens
cctgattcggctgtctcag

SEQ ID NO: 5680775 - DNA, 19 bp, Homo sapiens
cctgattcggggctgacct

SEQ ID NO: 5680776 - DNA, 16 bp, Homo sapiens
cctgattgacctgctc

SEQ ID NO: 5680777 - DNA, 17 bp, Homo sapiens
cctgattgacctgctcc

SEQ ID NO: 5680778 - DNA, 20 bp, Homo sapiens
cctgattgatcacacagtgt

SEQ ID NO: 5680779 - DNA, 18 bp, Homo sapiens
cctgattgctctggaagc

SEQ ID NO: 5680780 - DNA, 13 bp, Homo sapiens
cctgattggccac

SEQ ID NO: 5680781 - DNA, 13 bp, Homo sapiens
cctgattgtaaac

SEQ ID NO: 5680782 - DNA, 15 bp, Homo sapiens
cctgattgtgtctct

SEQ ID NO: 5680783 - DNA, 17 bp, Homo sapiens
cctgattgtgtctcttg

SEQ ID NO: 5680784 - DNA, 19 bp, Homo sapiens
cctgattgtgtctcttggt

SEQ ID NO: 5680785 - DNA, 23 bp, Homo sapiens
cctgattgtgtctcttggtcctg

SEQ ID NO: 5680786 - DNA, 22 bp, Homo sapiens
cctgatttaatatgcaaagtct

SEQ ID NO: 5680787 - DNA, 14 bp, Homo sapiens
cctgatttacagtt

SEQ ID NO: 5680788 - DNA, 18 bp, Homo sapiens
cctgatttagatatgcaa

SEQ ID NO: 5680789 - DNA, 22 bp, Homo sapiens
cctgatttaggagaagccagga

SEQ ID NO: 5680790 - DNA, 15 bp, Homo sapiens
cctgatttcagaaga

SEQ ID NO: 5680791 - DNA, 16 bp, Homo sapiens
cctgatttcagaagag

SEQ ID NO: 5680792 - DNA, 15 bp, Homo sapiens
cctgatttcattcct

SEQ ID NO: 5680793 - DNA, 16 bp, Homo sapiens
cctgatttcattcctc

SEQ ID NO: 5680794 - DNA, 20 bp, Homo sapiens
cctgatttctacaactggag

SEQ ID NO: 5680795 - DNA, 22 bp, Homo sapiens
cctgatttgctgggcagttttt

SEQ ID NO: 5680796 - DNA, 16 bp, Homo sapiens
cctgatttgctgtttt

SEQ ID NO: 5680797 - DNA, 22 bp, Homo sapiens
cctgatttttcatatgtggaaa

SEQ ID NO: 5680798 - DNA, 15 bp, Homo sapiens
cctgcaaaaatataa

SEQ ID NO: 5680799 - DNA, 15 bp, Homo sapiens
cctgcaaaaatgagt

SEQ ID NO: 5680800 - DNA, 23 bp, Homo sapiens
cctgcaaaaatgagttgtcacag

SEQ ID NO: 5680801 - DNA, 15 bp, Homo sapiens
cctgcaaacctgctg

SEQ ID NO: 5680802 - DNA, 16 bp, Homo sapiens
cctgcaaaccttcctg

SEQ ID NO: 5680803 - DNA, 18 bp, Homo sapiens
cctgcaaaccttcctggg

SEQ ID NO: 5680804 - DNA, 20 bp, Homo sapiens
cctgcaaaccttcctgggag

SEQ ID NO: 5680805 - DNA, 18 bp, Homo sapiens
cctgcaaacgctgcctgc

SEQ ID NO: 5680806 - DNA, 19 bp, Homo sapiens
cctgcaaacgctgcctgcc

SEQ ID NO: 5680807 - DNA, 15 bp, Homo sapiens
cctgcaaactcactg

SEQ ID NO: 5680808 - DNA, 17 bp, Homo sapiens
cctgcaaactcactgct

SEQ ID NO: 5680809 - DNA, 22 bp, Homo sapiens
cctgcaaactcactgctcaaga

SEQ ID NO: 5680810 - DNA, 20 bp, Homo sapiens
cctgcaaagacagtatttat

SEQ ID NO: 5680811 - DNA, 22 bp, Homo sapiens
cctgcaaagacagtatttattg

SEQ ID NO: 5680812 - DNA, 15 bp, Homo sapiens
cctgcaaagcccagc

SEQ ID NO: 5680813 - DNA, 16 bp, Homo sapiens
cctgcaaagcccagct

SEQ ID NO: 5680814 - DNA, 16 bp, Homo sapiens
cctgcaaaggcccttg

SEQ ID NO: 5680815 - DNA, 18 bp, Homo sapiens
cctgcaaaggcccttgtc

SEQ ID NO: 5680816 - DNA, 22 bp, Homo sapiens
cctgcaaagtacaggtactttg

SEQ ID NO: 5680817 - DNA, 15 bp, Homo sapiens
cctgcaaatctagtg

SEQ ID NO: 5680818 - DNA, 13 bp, Homo sapiens
cctgcaaccactc

SEQ ID NO: 5680819 - DNA, 17 bp, Homo sapiens
cctgcaaccactctgtg

SEQ ID NO: 5680820 - DNA, 23 bp, Homo sapiens
cctgcaaccactctgtggccagc

SEQ ID NO: 5680821 - DNA, 16 bp, Homo sapiens
cctgcaacctgattgt

SEQ ID NO: 5680822 - DNA, 21 bp, Homo sapiens
cctgcaacctgattgtgtctc

SEQ ID NO: 5680823 - DNA, 22 bp, Homo sapiens
cctgcaacctgattgtgtctct

SEQ ID NO: 5680824 - DNA, 18 bp, Homo sapiens
cctgcaactcaaggactt

SEQ ID NO: 5680825 - DNA, 12 bp, Homo sapiens
cctgcaactcat

SEQ ID NO: 5680826 - DNA, 17 bp, Homo sapiens
cctgcaacttccgctga

SEQ ID NO: 5680827 - DNA, 18 bp, Homo sapiens
cctgcaagacacaggctc

SEQ ID NO: 5680828 - DNA, 22 bp, Homo sapiens
cctgcaagacacaggctcagca

SEQ ID NO: 5680829 - DNA, 22 bp, Homo sapiens
cctgcaagagaatctgatcaat

SEQ ID NO: 5680830 - DNA, 15 bp, Homo sapiens
cctgcaagagtgggc

SEQ ID NO: 5680831 - DNA, 16 bp, Homo sapiens
cctgcaagccccaggg

SEQ ID NO: 5680832 - DNA, 20 bp, Homo sapiens
cctgcaagccccagggcctg

SEQ ID NO: 5680833 - DNA, 21 bp, Homo sapiens
cctgcaagccccagggcctgg

SEQ ID NO: 5680834 - DNA, 15 bp, Homo sapiens
cctgcaagctccgcc

SEQ ID NO: 5680835 - DNA, 22 bp, Homo sapiens
cctgcaagctccgcctcccggg

SEQ ID NO: 5680836 - DNA, 13 bp, Homo sapiens
cctgcaaggacta

SEQ ID NO: 5680837 - DNA, 15 bp, Homo sapiens
cctgcaaggcccaca

SEQ ID NO: 5680838 - DNA, 18 bp, Homo sapiens
cctgcaagggcgtggtgg

SEQ ID NO: 5680839 - DNA, 18 bp, Homo sapiens
cctgcaagttgctctgac

SEQ ID NO: 5680840 - DNA, 16 bp, Homo sapiens
cctgcaataaaatggg

SEQ ID NO: 5680841 - DNA, 16 bp, Homo sapiens
cctgcaatatttgaat

SEQ ID NO: 5680842 - DNA, 17 bp, Homo sapiens
cctgcaatgcgtcttgt

SEQ ID NO: 5680843 - DNA, 18 bp, Homo sapiens
cctgcaatgcgtcttgtg

SEQ ID NO: 5680844 - DNA, 20 bp, Homo sapiens
cctgcaatgcgtcttgtgaa

SEQ ID NO: 5680845 - DNA, 23 bp, Homo sapiens
cctgcaatgcgtcttgtgaaatt

SEQ ID NO: 5680846 - DNA, 22 bp, Homo sapiens
cctgcaatgtggtgacacctcc

SEQ ID NO: 5680847 - DNA, 23 bp, Homo sapiens
cctgcaatgtggtgacacctccc

SEQ ID NO: 5680848 - DNA, 14 bp, Homo sapiens
cctgcacaaacata

SEQ ID NO: 5680849 - DNA, 22 bp, Homo sapiens
cctgcacaaacatagacagatg

SEQ ID NO: 5680850 - DNA, 22 bp, Homo sapiens
cctgcacaaagcccttccatgt

SEQ ID NO: 5680851 - DNA, 23 bp, Homo sapiens
cctgcacaaagcccttccatgtc

SEQ ID NO: 5680852 - DNA, 10 bp, Homo sapiens
cctgcacaca

SEQ ID NO: 5680853 - DNA, 23 bp, Homo sapiens
cctgcacacaagcccacagcaca

SEQ ID NO: 5680854 - DNA, 15 bp, Homo sapiens
cctgcacacacctgc

SEQ ID NO: 5680855 - DNA, 18 bp, Homo sapiens
cctgcacacacctgcaca

SEQ ID NO: 5680856 - DNA, 19 bp, Homo sapiens
cctgcacacacctgcacac

SEQ ID NO: 5680857 - DNA, 20 bp, Homo sapiens
cctgcacacacctgcacacc

SEQ ID NO: 5680858 - DNA, 14 bp, Homo sapiens
cctgcacacagaat

SEQ ID NO: 5680859 - DNA, 20 bp, Homo sapiens
cctgcacacagaatgctcag

SEQ ID NO: 5680860 - DNA, 20 bp, Homo sapiens
cctgcacacaggacagcggg

SEQ ID NO: 5680861 - DNA, 14 bp, Homo sapiens
cctgcacacagggc

SEQ ID NO: 5680862 - DNA, 17 bp, Homo sapiens
cctgcacaccagagaca

SEQ ID NO: 5680863 - DNA, 14 bp, Homo sapiens
cctgcacaccctgg

SEQ ID NO: 5680864 - DNA, 16 bp, Homo sapiens
cctgcacaccctgggc

SEQ ID NO: 5680865 - DNA, 21 bp, Homo sapiens
cctgcacaccctgggccacgc

SEQ ID NO: 5680866 - DNA, 23 bp, Homo sapiens
cctgcacagatacctcatcatcc

SEQ ID NO: 5680867 - DNA, 24 bp, Homo sapiens
cctgcacagatacctcatcatcca

SEQ ID NO: 5680868 - DNA, 21 bp, Homo sapiens
cctgcacagattcccaggcca

SEQ ID NO: 5680869 - DNA, 22 bp, Homo sapiens
cctgcacagattcccaggccag

SEQ ID NO: 5680870 - DNA, 14 bp, Homo sapiens
cctgcacagcaggc

SEQ ID NO: 5680871 - DNA, 19 bp, Homo sapiens
cctgcacagcaggctgcca

SEQ ID NO: 5680872 - DNA, 14 bp, Homo sapiens
cctgcacagcctct

SEQ ID NO: 5680873 - DNA, 15 bp, Homo sapiens
cctgcacagcctcta

SEQ ID NO: 5680874 - DNA, 20 bp, Homo sapiens
cctgcacaggcacacagggc

SEQ ID NO: 5680875 - DNA, 17 bp, Homo sapiens
cctgcacaggcttgctg

SEQ ID NO: 5680876 - DNA, 18 bp, Homo sapiens
cctgcacagggccctctg

SEQ ID NO: 5680877 - DNA, 23 bp, Homo sapiens
cctgcacagggccctctgaggct

SEQ ID NO: 5680878 - DNA, 22 bp, Homo sapiens
cctgcacagtgacttctgagat

SEQ ID NO: 5680879 - DNA, 16 bp, Homo sapiens
cctgcacagtggtcca

SEQ ID NO: 5680880 - DNA, 20 bp, Homo sapiens
cctgcacagtgtcccccagg

SEQ ID NO: 5680881 - DNA, 13 bp, Homo sapiens
cctgcacataaac

SEQ ID NO: 5680882 - DNA, 20 bp, Homo sapiens
cctgcacatcatgagccttc

SEQ ID NO: 5680883 - DNA, 20 bp, Homo sapiens
cctgcacattgggtggggct

SEQ ID NO: 5680884 - DNA, 21 bp, Homo sapiens
cctgcaccagcccttccctgc

SEQ ID NO: 5680885 - DNA, 22 bp, Homo sapiens
cctgcaccagcccttccctgct

SEQ ID NO: 5680886 - DNA, 17 bp, Homo sapiens
cctgcaccaggagacag

SEQ ID NO: 5680887 - DNA, 19 bp, Homo sapiens
cctgcaccatgctgctggg

SEQ ID NO: 5680888 - DNA, 19 bp, Homo sapiens
cctgcacccacccctgccc

SEQ ID NO: 5680889 - DNA, 12 bp, Homo sapiens
cctgcacccagg

SEQ ID NO: 5680890 - DNA, 12 bp, Homo sapiens
cctgcaccccag

SEQ ID NO: 5680891 - DNA, 21 bp, Homo sapiens
cctgcaccccagcattccagc

SEQ ID NO: 5680892 - DNA, 12 bp, Homo sapiens
cctgcaccctct

SEQ ID NO: 5680893 - DNA, 14 bp, Homo sapiens
cctgcaccctctgc

SEQ ID NO: 5680894 - DNA, 16 bp, Homo sapiens
cctgcacccttccctc

SEQ ID NO: 5680895 - DNA, 17 bp, Homo sapiens
cctgcaccgccccttct

SEQ ID NO: 5680896 - DNA, 18 bp, Homo sapiens
cctgcaccgccgcagaag

SEQ ID NO: 5680897 - DNA, 14 bp, Homo sapiens
cctgcaccgccgcc

SEQ ID NO: 5680898 - DNA, 18 bp, Homo sapiens
cctgcaccgccgccaccc

SEQ ID NO: 5680899 - DNA, 19 bp, Homo sapiens
cctgcaccgccgccaccct

SEQ ID NO: 5680900 - DNA, 15 bp, Homo sapiens
cctgcaccggggcct

SEQ ID NO: 5680901 - DNA, 17 bp, Homo sapiens
cctgcaccggggcctgg

SEQ ID NO: 5680902 - DNA, 17 bp, Homo sapiens
cctgcacctcattccaa

SEQ ID NO: 5680903 - DNA, 21 bp, Homo sapiens
cctgcacctccccccactgca

SEQ ID NO: 5680904 - DNA, 16 bp, Homo sapiens
cctgcacctctccagc

SEQ ID NO: 5680905 - DNA, 15 bp, Homo sapiens
cctgcacctctggat

SEQ ID NO: 5680906 - DNA, 23 bp, Homo sapiens
cctgcacctgctgcgtccccact

SEQ ID NO: 5680907 - DNA, 16 bp, Homo sapiens
cctgcacctggcctgg

SEQ ID NO: 5680908 - DNA, 14 bp, Homo sapiens
cctgcacctgtgca

SEQ ID NO: 5680909 - DNA, 13 bp, Homo sapiens
cctgcaccttccc

SEQ ID NO: 5680910 - DNA, 21 bp, Homo sapiens
cctgcaccttccccaaaggaa

SEQ ID NO: 5680911 - DNA, 15 bp, Homo sapiens
cctgcacgcactgcg

SEQ ID NO: 5680912 - DNA, 21 bp, Homo sapiens
cctgcacggtgaatggctttg

SEQ ID NO: 5680913 - DNA, 19 bp, Homo sapiens
cctgcacggtgggccttgc

SEQ ID NO: 5680914 - DNA, 21 bp, Homo sapiens
cctgcacgtatacacccagat

SEQ ID NO: 5680915 - DNA, 24 bp, Homo sapiens
cctgcacgtatacacccagatggc

SEQ ID NO: 5680916 - DNA, 19 bp, Homo sapiens
cctgcacgtcatgggaggg

SEQ ID NO: 5680917 - DNA, 14 bp, Homo sapiens
cctgcactaaagcc

SEQ ID NO: 5680918 - DNA, 14 bp, Homo sapiens
cctgcactccccca

SEQ ID NO: 5680919 - DNA, 18 bp, Homo sapiens
cctgcactcccccagttc

SEQ ID NO: 5680920 - DNA, 18 bp, Homo sapiens
cctgcactccctcctgga

SEQ ID NO: 5680921 - DNA, 19 bp, Homo sapiens
cctgcactccctggccttg

SEQ ID NO: 5680922 - DNA, 14 bp, Homo sapiens
cctgcactgaaacc

SEQ ID NO: 5680923 - DNA, 20 bp, Homo sapiens
cctgcactgacccacagcct

SEQ ID NO: 5680924 - DNA, 13 bp, Homo sapiens
cctgcactgagag

SEQ ID NO: 5680925 - DNA, 17 bp, Homo sapiens
cctgcactggagtccag

SEQ ID NO: 5680926 - DNA, 19 bp, Homo sapiens
cctgcactgggaaggaaac

SEQ ID NO: 5680927 - DNA, 21 bp, Homo sapiens
cctgcactggggagcccgtct

SEQ ID NO: 5680928 - DNA, 12 bp, Homo sapiens
cctgcactgtaa

SEQ ID NO: 5680929 - DNA, 12 bp, Homo sapiens
cctgcactgtcc

SEQ ID NO: 5680930 - DNA, 15 bp, Homo sapiens
cctgcactgtcctgc

SEQ ID NO: 5680931 - DNA, 17 bp, Homo sapiens
cctgcacttacttgctt

SEQ ID NO: 5680932 - DNA, 16 bp, Homo sapiens
cctgcacttgcagact

SEQ ID NO: 5680933 - DNA, 22 bp, Homo sapiens
cctgcacttgcagactctacag

SEQ ID NO: 5680934 - DNA, 16 bp, Homo sapiens
cctgcacttgggggct

SEQ ID NO: 5680935 - DNA, 20 bp, Homo sapiens
cctgcacttgggggctcagc

SEQ ID NO: 5680936 - DNA, 22 bp, Homo sapiens
cctgcactttcctccacctccc

SEQ ID NO: 5680937 - DNA, 22 bp, Homo sapiens
cctgcactttgatgtcatgtgt

SEQ ID NO: 5680938 - DNA, 14 bp, Homo sapiens
cctgcagaaacagt

SEQ ID NO: 5680939 - DNA, 18 bp, Homo sapiens
cctgcagaaacagtactt

SEQ ID NO: 5680940 - DNA, 22 bp, Homo sapiens
cctgcagaaccggagagccagc

SEQ ID NO: 5680941 - DNA, 23 bp, Homo sapiens
cctgcagaaccggagagccagct

SEQ ID NO: 5680942 - DNA, 17 bp, Homo sapiens
cctgcagaaggaaagaa

SEQ ID NO: 5680943 - DNA, 22 bp, Homo sapiens
cctgcagaagtaagcctcatca

SEQ ID NO: 5680944 - DNA, 16 bp, Homo sapiens
cctgcagaatttgggt

SEQ ID NO: 5680945 - DNA, 19 bp, Homo sapiens
cctgcagacacctggactg

SEQ ID NO: 5680946 - DNA, 22 bp, Homo sapiens
cctgcagacagacctcaaggga

SEQ ID NO: 5680947 - DNA, 15 bp, Homo sapiens
cctgcagaccctgcc

SEQ ID NO: 5680948 - DNA, 18 bp, Homo sapiens
cctgcagaccctgccagg

SEQ ID NO: 5680949 - DNA, 17 bp, Homo sapiens
cctgcagaccctgccct

SEQ ID NO: 5680950 - DNA, 18 bp, Homo sapiens
cctgcagacctcaagcca

SEQ ID NO: 5680951 - DNA, 17 bp, Homo sapiens
cctgcagacctggctgg

SEQ ID NO: 5680952 - DNA, 19 bp, Homo sapiens
cctgcagacgtctggccct

SEQ ID NO: 5680953 - DNA, 21 bp, Homo sapiens
cctgcagacgtctggccctgg

SEQ ID NO: 5680954 - DNA, 22 bp, Homo sapiens
cctgcagacgtctggccctggc

SEQ ID NO: 5680955 - DNA, 12 bp, Homo sapiens
cctgcagagaaa

SEQ ID NO: 5680956 - DNA, 11 bp, Homo sapiens
cctgcagagag

SEQ ID NO: 5680957 - DNA, 13 bp, Homo sapiens
cctgcagagagaa

SEQ ID NO: 5680958 - DNA, 17 bp, Homo sapiens
cctgcagagcaataaca

SEQ ID NO: 5680959 - DNA, 21 bp, Homo sapiens
cctgcagagcaataacactat

SEQ ID NO: 5680960 - DNA, 11 bp, Homo sapiens
cctgcagagct

SEQ ID NO: 5680961 - DNA, 12 bp, Homo sapiens
cctgcagagctg

SEQ ID NO: 5680962 - DNA, 14 bp, Homo sapiens
cctgcagagctgcg

SEQ ID NO: 5680963 - DNA, 13 bp, Homo sapiens
cctgcagagctgg

SEQ ID NO: 5680964 - DNA, 14 bp, Homo sapiens
cctgcagagctggg

SEQ ID NO: 5680965 - DNA, 16 bp, Homo sapiens
cctgcagagctggggg

SEQ ID NO: 5680966 - DNA, 18 bp, Homo sapiens
cctgcagaggcccagcca

SEQ ID NO: 5680967 - DNA, 20 bp, Homo sapiens
cctgcagaggtctgtgctga

SEQ ID NO: 5680968 - DNA, 21 bp, Homo sapiens
cctgcagaggtctgtgctgag

SEQ ID NO: 5680969 - DNA, 21 bp, Homo sapiens
cctgcagatactttgaagtgc

SEQ ID NO: 5680970 - DNA, 13 bp, Homo sapiens
cctgcagatgcca

SEQ ID NO: 5680971 - DNA, 15 bp, Homo sapiens
cctgcagatgccacc

SEQ ID NO: 5680972 - DNA, 16 bp, Homo sapiens
cctgcagattctgagc

SEQ ID NO: 5680973 - DNA, 17 bp, Homo sapiens
cctgcagattctgagca

SEQ ID NO: 5680974 - DNA, 18 bp, Homo sapiens
cctgcagcaaacactcca

SEQ ID NO: 5680975 - DNA, 24 bp, Homo sapiens
cctgcagcaaacactccaccctcc

SEQ ID NO: 5680976 - DNA, 18 bp, Homo sapiens
cctgcagcacgcggcctt

SEQ ID NO: 5680977 - DNA, 21 bp, Homo sapiens
cctgcagcagagcctggaaga

SEQ ID NO: 5680978 - DNA, 15 bp, Homo sapiens
cctgcagcaggcagc

SEQ ID NO: 5680979 - DNA, 17 bp, Homo sapiens
cctgcagcatggtccct

SEQ ID NO: 5680980 - DNA, 22 bp, Homo sapiens
cctgcagcatggtccctgcctt

SEQ ID NO: 5680981 - DNA, 17 bp, Homo sapiens
cctgcagccaagcaaat

SEQ ID NO: 5680982 - DNA, 20 bp, Homo sapiens
cctgcagccaagcaaatgcc

SEQ ID NO: 5680983 - DNA, 13 bp, Homo sapiens
cctgcagccacca

SEQ ID NO: 5680984 - DNA, 13 bp, Homo sapiens
cctgcagccaggg

SEQ ID NO: 5680985 - DNA, 18 bp, Homo sapiens
cctgcagccagggctggg

SEQ ID NO: 5680986 - DNA, 21 bp, Homo sapiens
cctgcagcccaaaacccaggg

SEQ ID NO: 5680987 - DNA, 18 bp, Homo sapiens
cctgcagcccaccagacg

SEQ ID NO: 5680988 - DNA, 20 bp, Homo sapiens
cctgcagcccaccagacgtc

SEQ ID NO: 5680989 - DNA, 15 bp, Homo sapiens
cctgcagcccagaac

SEQ ID NO: 5680990 - DNA, 16 bp, Homo sapiens
cctgcagcccagaacg

SEQ ID NO: 5680991 - DNA, 16 bp, Homo sapiens
cctgcagcccaggcca

SEQ ID NO: 5680992 - DNA, 17 bp, Homo sapiens
cctgcagcccccactca

SEQ ID NO: 5680993 - DNA, 14 bp, Homo sapiens
cctgcagccgtgca

SEQ ID NO: 5680994 - DNA, 20 bp, Homo sapiens
cctgcagccgtgcaggactc

SEQ ID NO: 5680995 - DNA, 16 bp, Homo sapiens
cctgcagcctccctcc

SEQ ID NO: 5680996 - DNA, 15 bp, Homo sapiens
cctgcagcctcctcc

SEQ ID NO: 5680997 - DNA, 18 bp, Homo sapiens
cctgcagcctcctcctga

SEQ ID NO: 5680998 - DNA, 11 bp, Homo sapiens
cctgcagcctg

SEQ ID NO: 5680999 - DNA, 14 bp, Homo sapiens
cctgcagcctgaga

SEQ ID NO: 5681000 - DNA, 23 bp, Homo sapiens
cctgcagcctgggtctggatggg

SEQ ID NO: 5681001 - DNA, 15 bp, Homo sapiens
cctgcagcgcctccc

SEQ ID NO: 5681002 - DNA, 17 bp, Homo sapiens
cctgcagcgcctccctt

SEQ ID NO: 5681003 - DNA, 19 bp, Homo sapiens
cctgcagcgcctcccttgt

SEQ ID NO: 5681004 - DNA, 20 bp, Homo sapiens
cctgcagcgcctcccttgtc

SEQ ID NO: 5681005 - DNA, 16 bp, Homo sapiens
cctgcagcgggcaaag

SEQ ID NO: 5681006 - DNA, 12 bp, Homo sapiens
cctgcagctccc

SEQ ID NO: 5681007 - DNA, 20 bp, Homo sapiens
cctgcagctcctctgccttt

SEQ ID NO: 5681008 - DNA, 12 bp, Homo sapiens
cctgcagctctc

SEQ ID NO: 5681009 - DNA, 14 bp, Homo sapiens
cctgcagctgaccg

SEQ ID NO: 5681010 - DNA, 23 bp, Homo sapiens
cctgcagctggaatgtgccacag

SEQ ID NO: 5681011 - DNA, 17 bp, Homo sapiens
cctgcagctttctggaa

SEQ ID NO: 5681012 - DNA, 16 bp, Homo sapiens
cctgcaggaacgagca

SEQ ID NO: 5681013 - DNA, 19 bp, Homo sapiens
cctgcaggaacgagcactg

SEQ ID NO: 5681014 - DNA, 21 bp, Homo sapiens
cctgcaggaacgagcactggc

SEQ ID NO: 5681015 - DNA, 22 bp, Homo sapiens
cctgcaggaacgagcactggcc

SEQ ID NO: 5681016 - DNA, 14 bp, Homo sapiens
cctgcaggaaggag

SEQ ID NO: 5681017 - DNA, 19 bp, Homo sapiens
cctgcaggaaggagctgcc

SEQ ID NO: 5681018 - DNA, 13 bp, Homo sapiens
cctgcaggaccct

SEQ ID NO: 5681019 - DNA, 18 bp, Homo sapiens
cctgcaggagcagggcgg

SEQ ID NO: 5681020 - DNA, 20 bp, Homo sapiens
cctgcaggagcagggcggct

SEQ ID NO: 5681021 - DNA, 12 bp, Homo sapiens
cctgcaggaggc

SEQ ID NO: 5681022 - DNA, 19 bp, Homo sapiens
cctgcaggaggcctgggag

SEQ ID NO: 5681023 - DNA, 21 bp, Homo sapiens
cctgcaggaggcctgggaggg

SEQ ID NO: 5681024 - DNA, 22 bp, Homo sapiens
cctgcaggaggcctgggagggc

SEQ ID NO: 5681025 - DNA, 23 bp, Homo sapiens
cctgcaggatctcaccaggcagc

SEQ ID NO: 5681026 - DNA, 22 bp, Homo sapiens
cctgcaggcacagaggaggtca

SEQ ID NO: 5681027 - DNA, 23 bp, Homo sapiens
cctgcaggcacagaggaggtcag

SEQ ID NO: 5681028 - DNA, 16 bp, Homo sapiens
cctgcaggcagagctg

SEQ ID NO: 5681029 - DNA, 13 bp, Homo sapiens
cctgcaggcagcc

SEQ ID NO: 5681030 - DNA, 18 bp, Homo sapiens
cctgcaggcagccaggcc

SEQ ID NO: 5681031 - DNA, 12 bp, Homo sapiens
cctgcaggcagg

SEQ ID NO: 5681032 - DNA, 18 bp, Homo sapiens
cctgcaggcaggcagacc

SEQ ID NO: 5681033 - DNA, 12 bp, Homo sapiens
cctgcaggccag

SEQ ID NO: 5681034 - DNA, 19 bp, Homo sapiens
cctgcaggccaggccagct

SEQ ID NO: 5681035 - DNA, 16 bp, Homo sapiens
cctgcaggcggggctc

SEQ ID NO: 5681036 - DNA, 19 bp, Homo sapiens
cctgcaggcggggctcctc

SEQ ID NO: 5681037 - DNA, 21 bp, Homo sapiens
cctgcaggcggggctcctcct

SEQ ID NO: 5681038 - DNA, 20 bp, Homo sapiens
cctgcaggcggtatccagag

SEQ ID NO: 5681039 - DNA, 18 bp, Homo sapiens
cctgcaggcgtgacctga

SEQ ID NO: 5681040 - DNA, 20 bp, Homo sapiens
cctgcaggctccatgcacct

SEQ ID NO: 5681041 - DNA, 14 bp, Homo sapiens
cctgcaggctgcag

SEQ ID NO: 5681042 - DNA, 19 bp, Homo sapiens
cctgcaggctgcaggaggg

SEQ ID NO: 5681043 - DNA, 21 bp, Homo sapiens
cctgcaggctgcaggagggca

SEQ ID NO: 5681044 - DNA, 13 bp, Homo sapiens
cctgcaggctgga

SEQ ID NO: 5681045 - DNA, 13 bp, Homo sapiens
cctgcaggctggc

SEQ ID NO: 5681046 - DNA, 14 bp, Homo sapiens
cctgcaggctggct

SEQ ID NO: 5681047 - DNA, 22 bp, Homo sapiens
cctgcaggcttaggtcctcact

SEQ ID NO: 5681048 - DNA, 22 bp, Homo sapiens
cctgcagggagccttctgccac

SEQ ID NO: 5681049 - DNA, 12 bp, Homo sapiens
cctgcagggcca

SEQ ID NO: 5681050 - DNA, 21 bp, Homo sapiens
cctgcagggccatctgactgc

SEQ ID NO: 5681051 - DNA, 17 bp, Homo sapiens
cctgcagggccatggct

SEQ ID NO: 5681052 - DNA, 20 bp, Homo sapiens
cctgcagggccatggctcag

SEQ ID NO: 5681053 - DNA, 18 bp, Homo sapiens
cctgcagggcccttatgg
